United States Patent 11,254,933 (CRISPR/CAS TRANSCRIPTIONAL MODULATION) - sequence listing, part 5

SEQ ID NO: 184343 - DNA, 20 bp, human
gcgcgcacttcggtcgcggg

SEQ ID NO: 184344 - DNA, 20 bp, human
gactcccgcggcgggaccct

SEQ ID NO: 184345 - DNA, 20 bp, human
gagggtggactcgatttccc

SEQ ID NO: 184346 - DNA, 20 bp, human
gccgctcgcggagcaaggag

SEQ ID NO: 184347 - DNA, 20 bp, human
gtggatccgcgcacacccag

SEQ ID NO: 184348 - DNA, 20 bp, human
gcggtcgccgctgtcgggaa

SEQ ID NO: 184349 - DNA, 20 bp, human
gttgggctggacgaaaaaga

SEQ ID NO: 184350 - DNA, 20 bp, human
gcctggatgtgggaacccac

SEQ ID NO: 184351 - DNA, 20 bp, human
gctgcagcccttcccgacag

SEQ ID NO: 184352 - DNA, 20 bp, human
gtgcccggcacccctcccgt

SEQ ID NO: 184353 - DNA, 20 bp, human
gatccgcgcacacccagtgg

SEQ ID NO: 184354 - DNA, 20 bp, human
gcggcccgggctgtcaggta

SEQ ID NO: 184355 - DNA, 20 bp, human
ggcagctcggacggccaagg

SEQ ID NO: 184356 - DNA, 20 bp, human
gcccatcctactgcactata

SEQ ID NO: 184357 - DNA, 20 bp, human
gtcatcaaccctggacagta

SEQ ID NO: 184358 - DNA, 20 bp, human
gcagggttgatgaggcttgt

SEQ ID NO: 184359 - DNA, 20 bp, human
gtggacagtaaggaagaata

SEQ ID NO: 184360 - DNA, 20 bp, human
gctgactaggctggtcctca

SEQ ID NO: 184361 - DNA, 20 bp, human
gctagtcaggtaagatcaag

SEQ ID NO: 184362 - DNA, 20 bp, human
gtcatttgactatttgaggg

SEQ ID NO: 184363 - DNA, 20 bp, human
gtatagataagtatgtcaag

SEQ ID NO: 184364 - DNA, 20 bp, human
gctgctgggttctataatag

SEQ ID NO: 184365 - DNA, 20 bp, human
gagatcaagtggcttgtcac

SEQ ID NO: 184366 - DNA, 20 bp, human
gggaggaggatgctcatcat

SEQ ID NO: 184367 - DNA, 20 bp, human
gcccggtaaggcaaatggag

SEQ ID NO: 184368 - DNA, 20 bp, human
gcacttactgacgaatcctc

SEQ ID NO: 184369 - DNA, 20 bp, human
gctctcctaccaccgcccgg

SEQ ID NO: 184370 - DNA, 20 bp, human
gagtgtgcgtgcgtgacaga

SEQ ID NO: 184371 - DNA, 20 bp, human
gggatgtgcaccagagcacg

SEQ ID NO: 184372 - DNA, 20 bp, human
gagggagcaggcgctgaacc

SEQ ID NO: 184373 - DNA, 20 bp, human
gtcctaccaccgcccggtgg

SEQ ID NO: 184374 - DNA, 20 bp, human
gctcgagctgcaaagcgggg

SEQ ID NO: 184375 - DNA, 20 bp, human
gaccagagcacgtggtgcgt

SEQ ID NO: 184376 - DNA, 20 bp, human
gtggaggacggcgagatcca

SEQ ID NO: 184377 - DNA, 20 bp, human
gggcagcatcgagcaggcag

SEQ ID NO: 184378 - DNA, 20 bp, human
gagcatcgagcaggcagtgg

SEQ ID NO: 184379 - DNA, 20 bp, human
gcacgggccgcaccaccacg

SEQ ID NO: 184380 - DNA, 20 bp, human
gtcagggtcggggtcggtaa

SEQ ID NO: 184381 - DNA, 20 bp, human
gtcgcgtcggcgtcagggtc

SEQ ID NO: 184382 - DNA, 20 bp, human
ggccggtacgagccccacgg

SEQ ID NO: 184383 - DNA, 20 bp, human
gcggcgagatccagggagtg

SEQ ID NO: 184384 - DNA, 20 bp, human
gaccgccgtggggctcgtac

SEQ ID NO: 184385 - DNA, 20 bp, human
gggacgggggcaaagatcac

SEQ ID NO: 184386 - DNA, 20 bp, human
ggtccgatagggcagaatcg

SEQ ID NO: 184387 - DNA, 20 bp, human
gtccggcccccagtgcgtct

SEQ ID NO: 184388 - DNA, 20 bp, human
gtgcgtcaggcggagatgaa

SEQ ID NO: 184389 - DNA, 20 bp, human
ggagctcttccgagacgcac

SEQ ID NO: 184390 - DNA, 20 bp, human
gctcttccgagacgcactgg

SEQ ID NO: 184391 - DNA, 20 bp, human
gtgtgagctttgtttcggag

SEQ ID NO: 184392 - DNA, 20 bp, human
gtaacgggcaggctcgggag

SEQ ID NO: 184393 - DNA, 20 bp, human
ggaggagacatgcagcggat

SEQ ID NO: 184394 - DNA, 20 bp, human
gtccgagacgcactgggggc

SEQ ID NO: 184395 - DNA, 20 bp, human
gagggaactacctgtccgat

SEQ ID NO: 184396 - DNA, 20 bp, human
ggtcgaacctctccagtagg

SEQ ID NO: 184397 - DNA, 20 bp, human
gcgggtcgaacctctccagt

SEQ ID NO: 184398 - DNA, 20 bp, human
ggcgcacgccaggcacgcgg

SEQ ID NO: 184399 - DNA, 20 bp, human
gcgtcagccgcctactggag

SEQ ID NO: 184400 - DNA, 20 bp, human
gggcggccatgctgcgaacg

SEQ ID NO: 184401 - DNA, 20 bp, human
gcatgctgcgaacgcggcag

SEQ ID NO: 184402 - DNA, 20 bp, human
gctgcgaacgcggcagcgga

SEQ ID NO: 184403 - DNA, 20 bp, human
ggcgcccgcctgctctccaa

SEQ ID NO: 184404 - DNA, 20 bp, human
gccgccgaggtgctggtgta

SEQ ID NO: 184405 - DNA, 20 bp, human
gcagcggacggctggactga

SEQ ID NO: 184406 - DNA, 20 bp, human
gatgtgttagggagctaagg

SEQ ID NO: 184407 - DNA, 20 bp, human
gtagggagctaagggggtgc

SEQ ID NO: 184408 - DNA, 20 bp, human
gctaagggggtgcaggtatg

SEQ ID NO: 184409 - DNA, 20 bp, human
gtggaatactggaggatcct

SEQ ID NO: 184410 - DNA, 20 bp, human
gtaaataggatgaatgtgtt

SEQ ID NO: 184411 - DNA, 20 bp, human
gctgaagatgtatggaatac

SEQ ID NO: 184412 - DNA, 20 bp, human
gtcactccaggctctactgc

SEQ ID NO: 184413 - DNA, 20 bp, human
gtcatcaacaacctgatcca

SEQ ID NO: 184414 - DNA, 20 bp, human
gtgttgatgagtttcactcc

SEQ ID NO: 184415 - DNA, 20 bp, human
gaaaagtggggttaaattct

SEQ ID NO: 184416 - DNA, 20 bp, human
gagcgagtgggcatcgtcgg

SEQ ID NO: 184417 - DNA, 20 bp, human
gaggtgagcctgagagtcca

SEQ ID NO: 184418 - DNA, 20 bp, human
ggccaggccctgcagcgagt

SEQ ID NO: 184419 - DNA, 20 bp, human
ggtatgggccgtggactctc

SEQ ID NO: 184420 - DNA, 20 bp, human
gtgggaccgtgagtctcccg

SEQ ID NO: 184421 - DNA, 20 bp, human
gtgcagcgagtgggcatcgt

SEQ ID NO: 184422 - DNA, 20 bp, human
gagcagcagattcagcatct

SEQ ID NO: 184423 - DNA, 20 bp, human
gggtcccacgcagtgcgctg

SEQ ID NO: 184424 - DNA, 20 bp, human
gcaggcctggggctgcttcc

SEQ ID NO: 184425 - DNA, 20 bp, human
gctggcgagccgcgcctacg

SEQ ID NO: 184426 - DNA, 20 bp, human
ggagagtccgcgaccgatac

SEQ ID NO: 184427 - DNA, 20 bp, human
ggtgcatccagtatcggtcg

SEQ ID NO: 184428 - DNA, 20 bp, human
gtcagagaccttcccccccg

SEQ ID NO: 184429 - DNA, 20 bp, human
gacggcatccccggggggga

SEQ ID NO: 184430 - DNA, 20 bp, human
gcagcacggcatccccgggg

SEQ ID NO: 184431 - DNA, 20 bp, human
gcccggggcctggaagggtg

SEQ ID NO: 184432 - DNA, 20 bp, human
ggcagcgagtgggcatcgtt

SEQ ID NO: 184433 - DNA, 20 bp, human
gcgatgtggacaatgatggt

SEQ ID NO: 184434 - DNA, 20 bp, human
gcgtggctggagacgttcac

SEQ ID NO: 184435 - DNA, 20 bp, human
ggccaggccctgcagcgagt

SEQ ID NO: 184436 - DNA, 20 bp, human
ggccaggccctgcagcaaac

SEQ ID NO: 184437 - DNA, 20 bp, human
ggcaaacgggcattgttggg

SEQ ID NO: 184438 - DNA, 20 bp, human
gaagggctggtcccaggcgt

SEQ ID NO: 184439 - DNA, 20 bp, human
gccccagtgggtgctaaccg

SEQ ID NO: 184440 - DNA, 20 bp, human
gtggaaccgtgagtctcctg

SEQ ID NO: 184441 - DNA, 20 bp, human
gaagaagccgccccacgcct

SEQ ID NO: 184442 - DNA, 20 bp, human
ggcagcaaacgggcattgtt

SEQ ID NO: 184443 - DNA, 20 bp, human
gctggcgagcccggcctacg

SEQ ID NO: 184444 - DNA, 20 bp, human
gaccaggggccacgtaggcc

SEQ ID NO: 184445 - DNA, 20 bp, human
ggcccggcctacgtggcccc

SEQ ID NO: 184446 - DNA, 20 bp, human
gaggaggccacaggccccaa

SEQ ID NO: 184447 - DNA, 20 bp, human
gctacagtgggcagacacca

SEQ ID NO: 184448 - DNA, 20 bp, human
gccaggccaggtcacccacc

SEQ ID NO: 184449 - DNA, 20 bp, human
ggtcccaggccctagaacac

SEQ ID NO: 184450 - DNA, 20 bp, human
gggccataaacggcagctgg

SEQ ID NO: 184451 - DNA, 20 bp, human
gggagacacggggccccaca

SEQ ID NO: 184452 - DNA, 20 bp, human
gctgctgtctcactggccca

SEQ ID NO: 184453 - DNA, 20 bp, human
gctgtgcccggtgggtgacc

SEQ ID NO: 184454 - DNA, 20 bp, human
gtctgcccactgtagggaga

SEQ ID NO: 184455 - DNA, 20 bp, human
gtaaacggcagctggaggcc

SEQ ID NO: 184456 - DNA, 20 bp, human
gcttcggttgcgggtcggaa

SEQ ID NO: 184457 - DNA, 20 bp, human
ggccaagggatgccaggacg

SEQ ID NO: 184458 - DNA, 20 bp, human
gggtcccagggctgcgagaa

SEQ ID NO: 184459 - DNA, 20 bp, human
gtcggaacggcgctgctctg

SEQ ID NO: 184460 - DNA, 20 bp, human
ggcctcagcagcgtctcccg

SEQ ID NO: 184461 - DNA, 20 bp, human
gggcggcttcggttgcgggt

SEQ ID NO: 184462 - DNA, 20 bp, human
gccgggtgtgaggagacgag

SEQ ID NO: 184463 - DNA, 20 bp, human
gtgctctgcggggccggtcc

SEQ ID NO: 184464 - DNA, 20 bp, human
ggcggggttggacaaccggg

SEQ ID NO: 184465 - DNA, 20 bp, human
gggactgcggggctaggacg

SEQ ID NO: 184466 - DNA, 20 bp, human
gcacctaccgtggcgagacg

SEQ ID NO: 184467 - DNA, 20 bp, human
gcgggagtcgctgggtgcgt

SEQ ID NO: 184468 - DNA, 20 bp, human
gtggagagccgggagtcgct

SEQ ID NO: 184469 - DNA, 20 bp, human
ggacgctcctcgcaactcca

SEQ ID NO: 184470 - DNA, 20 bp, human
ggcctcgccgcgtctcgcca

SEQ ID NO: 184471 - DNA, 20 bp, human
gaccgtggcgagacgcggcg

SEQ ID NO: 184472 - DNA, 20 bp, human
gcgaggagcgtcagaagtgg

SEQ ID NO: 184473 - DNA, 20 bp, human
gcgcgcgcctgggcgaggtt

SEQ ID NO: 184474 - DNA, 20 bp, human
ggacccccaggcgggcgcca

SEQ ID NO: 184475 - DNA, 20 bp, human
gaggcagccgccaggacgga

SEQ ID NO: 184476 - DNA, 20 bp, human
ggagagaccttggccaccaa

SEQ ID NO: 184477 - DNA, 20 bp, human
gagtggggaccaccaggagc

SEQ ID NO: 184478 - DNA, 20 bp, human
ggcgagggtcaggctcgagc

SEQ ID NO: 184479 - DNA, 20 bp, human
gaggaagacctgtcacctgt

SEQ ID NO: 184480 - DNA, 20 bp, human
gtaacacacagagtggagag

SEQ ID NO: 184481 - DNA, 20 bp, human
ggaggacgtaacacacagag

SEQ ID NO: 184482 - DNA, 20 bp, human
gtcaggctcgagctggcagg

SEQ ID NO: 184483 - DNA, 20 bp, human
gtcaaacctgagagcggtac

SEQ ID NO: 184484 - DNA, 20 bp, human
ggctcgagctggcaggtggc

SEQ ID NO: 184485 - DNA, 20 bp, human
gtgagctctagctgcaacat

SEQ ID NO: 184486 - DNA, 20 bp, human
gcacgccagcgggtaggggt

SEQ ID NO: 184487 - DNA, 20 bp, human
ggactgaagggagacgacga

SEQ ID NO: 184488 - DNA, 20 bp, human
gccaggcgcacggtgatggg

SEQ ID NO: 184489 - DNA, 20 bp, human
gtacaagatccgggagatcg

SEQ ID NO: 184490 - DNA, 20 bp, human
gagatccgggagatcgcgga

SEQ ID NO: 184491 - DNA, 20 bp, human
gcagccggagcggcgctcgg

SEQ ID NO: 184492 - DNA, 20 bp, human
gttagcacgagcctgaaact

SEQ ID NO: 184493 - DNA, 20 bp, human
gaggggaaggtgagtcggtc

SEQ ID NO: 184494 - DNA, 20 bp, human
ggcgtcccctaggcccgcga

SEQ ID NO: 184495 - DNA, 20 bp, human
gcgcgctcggctaagaccgc

SEQ ID NO: 184496 - DNA, 20 bp, human
gccggcgctgggtaactgtt

SEQ ID NO: 184497 - DNA, 20 bp, human
gcgggcgcggagctaagtgt

SEQ ID NO: 184498 - DNA, 20 bp, human
gcgccggggcgcagcgagtc

SEQ ID NO: 184499 - DNA, 20 bp, human
gagctaagtgtaggcgccgg

SEQ ID NO: 184500 - DNA, 20 bp, human
gaggccatttcctcacgcgg

SEQ ID NO: 184501 - DNA, 20 bp, human
ggagctaacaccactcaggc

SEQ ID NO: 184502 - DNA, 20 bp, human
gcggagctaagtgtaggcgc

SEQ ID NO: 184503 - DNA, 20 bp, human
gaggccctaagtcctccggg

SEQ ID NO: 184504 - DNA, 20 bp, human
ggcccaggccctaagtcctc

SEQ ID NO: 184505 - DNA, 20 bp, human
ggtcctccgggcgggggtag

SEQ ID NO: 184506 - DNA, 20 bp, human
gggagaacgtgcccaagacc

SEQ ID NO: 184507 - DNA, 20 bp, human
gtatcagttctccaggtctt

SEQ ID NO: 184508 - DNA, 20 bp, human
ggttcctcaagttggatggc

SEQ ID NO: 184509 - DNA, 20 bp, human
gtcgaagcagtacaaatcag

SEQ ID NO: 184510 - DNA, 20 bp, human
gattgaggagggacacacag

SEQ ID NO: 184511 - DNA, 20 bp, human
gcttgcaatggaacactata

SEQ ID NO: 184512 - DNA, 20 bp, human
ggagaactgataataaattg

SEQ ID NO: 184513 - DNA, 20 bp, human
gagttggatggcaggttcac

SEQ ID NO: 184514 - DNA, 20 bp, human
gtggatggcaggttcacagg

SEQ ID NO: 184515 - DNA, 20 bp, human
gttgtggtttatccttgcaa

SEQ ID NO: 184516 - DNA, 20 bp, human
gcacacagtggaaacataca

SEQ ID NO: 184517 - DNA, 20 bp, human
gaaaaggagcaggtcacagg

SEQ ID NO: 184518 - DNA, 20 bp, human
gcactgtgtgcatgggttag

SEQ ID NO: 184519 - DNA, 20 bp, human
gaggctacattgaaaagaat

SEQ ID NO: 184520 - DNA, 20 bp, human
gaaaaaagaagctgcttact

SEQ ID NO: 184521 - DNA, 20 bp, human
gacagatggacggacatttg

SEQ ID NO: 184522 - DNA, 20 bp, human
gttctgagaagcttttaaca

SEQ ID NO: 184523 - DNA, 20 bp, human
gccttttctaatggagtcat

SEQ ID NO: 184524 - DNA, 20 bp, human
gtgggttagtggatgtgttt

SEQ ID NO: 184525 - DNA, 20 bp, human
gttttcaatgtagcctttgt

SEQ ID NO: 184526 - DNA, 20 bp, human
ggcgaggctaggtgagccgt

SEQ ID NO: 184527 - DNA, 20 bp, human
ggcgcgagccaacccgccgc

SEQ ID NO: 184528 - DNA, 20 bp, human
gcgcttcgttgtcagatctg

SEQ ID NO: 184529 - DNA, 20 bp, human
gcgatactgaatgagtcccg

SEQ ID NO: 184530 - DNA, 20 bp, human
gaatgagtcccgcggcgggt

SEQ ID NO: 184531 - DNA, 20 bp, human
gtactgaatgagtcccgcgg

SEQ ID NO: 184532 - DNA, 20 bp, human
gcttcgggccacgcttctct

SEQ ID NO: 184533 - DNA, 20 bp, human
gcgttgtcagatctgaggcg

SEQ ID NO: 184534 - DNA, 20 bp, human
gtcagatctgaggcgaggct

SEQ ID NO: 184535 - DNA, 20 bp, human
gggaggctgtcggctaataa

SEQ ID NO: 184536 - DNA, 20 bp, human
gacccgctgactggaccgtg

SEQ ID NO: 184537 - DNA, 20 bp, human
ggctggagcctgcgaccgag

SEQ ID NO: 184538 - DNA, 20 bp, human
gagacataaggaagcctcag

SEQ ID NO: 184539 - DNA, 20 bp, human
gaagggaggaagcaatgcgg

SEQ ID NO: 184540 - DNA, 20 bp, human
ggccgcgggagccgtctagg

SEQ ID NO: 184541 - DNA, 20 bp, human
gtgactggaccgtggggaag

SEQ ID NO: 184542 - DNA, 20 bp, human
gtcaatcgcgatggctccag

SEQ ID NO: 184543 - DNA, 20 bp, human
gttggaggctgactgatacc

SEQ ID NO: 184544 - DNA, 20 bp, human
ggcgggagccgtctaggcgg

SEQ ID NO: 184545 - DNA, 20 bp, human
gaaagccgcgggagccgtct

SEQ ID NO: 184546 - DNA, 20 bp, human
gtgatagaggatatgatcgt

SEQ ID NO: 184547 - DNA, 20 bp, human
gtgctaacttctgctcccaa

SEQ ID NO: 184548 - DNA, 20 bp, human
gagactatgattaccgatac

SEQ ID NO: 184549 - DNA, 20 bp, human
ggttaaaacattacctgtat

SEQ ID NO: 184550 - DNA, 20 bp, human
gtatacttttctggtctcat

SEQ ID NO: 184551 - DNA, 20 bp, human
ggttcacatacttgggctgt

SEQ ID NO: 184552 - DNA, 20 bp, human
gttattttcatctgcctcag

SEQ ID NO: 184553 - DNA, 20 bp, human
gattaagtagttatcacctt

SEQ ID NO: 184554 - DNA, 20 bp, human
gagatcatatatgacgcctt

SEQ ID NO: 184555 - DNA, 20 bp, human
gagatgatagtagtgttact

SEQ ID NO: 184556 - DNA, 20 bp, human
ggttagagcccgtgcggagg

SEQ ID NO: 184557 - DNA, 20 bp, human
gctgcggcggagcctcctta

SEQ ID NO: 184558 - DNA, 20 bp, human
gggcggagcctccttaagga

SEQ ID NO: 184559 - DNA, 20 bp, human
gcgggaaaaacggccgtctc

SEQ ID NO: 184560 - DNA, 20 bp, human
gctctgagcggctgggcgac

SEQ ID NO: 184561 - DNA, 20 bp, human
gacagcggcgagcagaacta

SEQ ID NO: 184562 - DNA, 20 bp, human
gacctcttgcaccttcctta

SEQ ID NO: 184563 - DNA, 20 bp, human
ggagcgggtacgtagagctg

SEQ ID NO: 184564 - DNA, 20 bp, human
gagcccgtgcggaggcggtg

SEQ ID NO: 184565 - DNA, 20 bp, human
ggcagccccgcacgacgcgc

SEQ ID NO: 184566 - DNA, 20 bp, human
ggcgtaccgaggcgaggcag

SEQ ID NO: 184567 - DNA, 20 bp, human
gtcctcagccggcctccatg

SEQ ID NO: 184568 - DNA, 20 bp, human
gatgcggcgcgggccctcaa

SEQ ID NO: 184569 - DNA, 20 bp, human
gcgcgcggcgtaccgaggcg

SEQ ID NO: 184570 - DNA, 20 bp, human
ggagcgccgctgcctcgcct

SEQ ID NO: 184571 - DNA, 20 bp, human
gcgcgccgcgcggcgtaccg

SEQ ID NO: 184572 - DNA, 20 bp, human
ggcgcgggccctcaacggac

SEQ ID NO: 184573 - DNA, 20 bp, human
gggagcgagcccgagtcggg

SEQ ID NO: 184574 - DNA, 20 bp, human
ggggccctcaacggacgggg

SEQ ID NO: 184575 - DNA, 20 bp, human
gggtcaggttttggagccgg

SEQ ID NO: 184576 - DNA, 20 bp, human
gaggctgccgaggcacaccg

SEQ ID NO: 184577 - DNA, 20 bp, human
gaggctgtgaggccccatag

SEQ ID NO: 184578 - DNA, 20 bp, human
gcctctgcagagggcaaggg

SEQ ID NO: 184579 - DNA, 20 bp, human
gcaacccgaccggaacccac

SEQ ID NO: 184580 - DNA, 20 bp, human
gagactgccggggcgcacgg

SEQ ID NO: 184581 - DNA, 20 bp, human
gacaggcaggctcccctatg

SEQ ID NO: 184582 - DNA, 20 bp, human
gggaccattagagcagcgca

SEQ ID NO: 184583 - DNA, 20 bp, human
gcaaggggggcccgctccac

SEQ ID NO: 184584 - DNA, 20 bp, human
gaaactcacacacggaagtc

SEQ ID NO: 184585 - DNA, 20 bp, human
gcagaggctcaaggcccccg

SEQ ID NO: 184586 - DNA, 20 bp, human
gcagggactcatcctcctca

SEQ ID NO: 184587 - DNA, 20 bp, human
ggcgtccgagagagcctctg

SEQ ID NO: 184588 - DNA, 20 bp, human
gtggcggagggcaaaggcca

SEQ ID NO: 184589 - DNA, 20 bp, human
gcctcggagccgccttgagg

SEQ ID NO: 184590 - DNA, 20 bp, human
gggcccggaacgcggaggga

SEQ ID NO: 184591 - DNA, 20 bp, human
ggccgcgaagctgcgcccgt

SEQ ID NO: 184592 - DNA, 20 bp, human
gtcggagggaaaccatccca

SEQ ID NO: 184593 - DNA, 20 bp, human
gcggatccgccagggagtac

SEQ ID NO: 184594 - DNA, 20 bp, human
gggtcagccccgcgcctagg

SEQ ID NO: 184595 - DNA, 20 bp, human
gccgaggcccggaacgcgga

SEQ ID NO: 184596 - DNA, 20 bp, human
ggagcagcatggcggagccc

SEQ ID NO: 184597 - DNA, 20 bp, human
gggaagagggagaccctcta

SEQ ID NO: 184598 - DNA, 20 bp, human
gcggccgcggagcagcatgg

SEQ ID NO: 184599 - DNA, 20 bp, human
ggctccagccgcaggatgct

SEQ ID NO: 184600 - DNA, 20 bp, human
ggaaacccccaggtccgaca

SEQ ID NO: 184601 - DNA, 20 bp, human
ggcgcgcagtgggacaagtg

SEQ ID NO: 184602 - DNA, 20 bp, human
gcagtcagccacgccccaga

SEQ ID NO: 184603 - DNA, 20 bp, human
gacacgccctcagcacccgg

SEQ ID NO: 184604 - DNA, 20 bp, human
gccacgggactagaataccc

SEQ ID NO: 184605 - DNA, 20 bp, human
gtcccggccgcggagcagca

SEQ ID NO: 184606 - DNA, 20 bp, human
gcggaagcggcggagtagag

SEQ ID NO: 184607 - DNA, 20 bp, human
ggcgggtcgcaaggagtcac

SEQ ID NO: 184608 - DNA, 20 bp, human
ggttagtgcagcaggtgggt

SEQ ID NO: 184609 - DNA, 20 bp, human
gctggcgggcgtgggaaccc

SEQ ID NO: 184610 - DNA, 20 bp, human
gtaacctggccgcctcggcg

SEQ ID NO: 184611 - DNA, 20 bp, human
gggagctgcgtagctgagta

SEQ ID NO: 184612 - DNA, 20 bp, human
gggtgggctagtgggagcct

SEQ ID NO: 184613 - DNA, 20 bp, human
gcagctcccgagcgcttgag

SEQ ID NO: 184614 - DNA, 20 bp, human
gccaggttagtgcagcaggt

SEQ ID NO: 184615 - DNA, 20 bp, human
ggtgcgaaaccccagcttga

SEQ ID NO: 184616 - DNA, 20 bp, human
gcaaggctggtcccctgccc

SEQ ID NO: 184617 - DNA, 20 bp, human
gtgagctggaggccatctca

SEQ ID NO: 184618 - DNA, 20 bp, human
gtcctactcaccagagagtg

SEQ ID NO: 184619 - DNA, 20 bp, human
gcaggacccaaaggagccca

SEQ ID NO: 184620 - DNA, 20 bp, human
ggtcctggcagacggtggga

SEQ ID NO: 184621 - DNA, 20 bp, human
gaccgtctgccaggacccaa

SEQ ID NO: 184622 - DNA, 20 bp, human
ggtcagggagtgtgagaaaa

SEQ ID NO: 184623 - DNA, 20 bp, human
gctcgaggctctcctcggtg

SEQ ID NO: 184624 - DNA, 20 bp, human
ggggaaagccatccacaccg

SEQ ID NO: 184625 - DNA, 20 bp, human
gacccgaggtgaggtgatgg

SEQ ID NO: 184626 - DNA, 20 bp, human
gggcgccccaaaggacgagt

SEQ ID NO: 184627 - DNA, 20 bp, human
gggcgcagagagactcctcg

SEQ ID NO: 184628 - DNA, 20 bp, human
gtcccacgggaagtctccgt

SEQ ID NO: 184629 - DNA, 20 bp, human
ggagtccccgcctcagcaag

SEQ ID NO: 184630 - DNA, 20 bp, human
ggcccacggagacttcccgt

SEQ ID NO: 184631 - DNA, 20 bp, human
gagctggagcggggagttcg

SEQ ID NO: 184632 - DNA, 20 bp, human
gtccatcggctccatccacg

SEQ ID NO: 184633 - DNA, 20 bp, human
ggactcctcgggtgcagccg

SEQ ID NO: 184634 - DNA, 20 bp, human
gttctacactgggcctccat

SEQ ID NO: 184635 - DNA, 20 bp, human
gtaaggagccaccagagacg

SEQ ID NO: 184636 - DNA, 20 bp, human
gccgcgctcgcctcacccaa

SEQ ID NO: 184637 - DNA, 20 bp, human
ggcgctgcgaccgttgggtg

SEQ ID NO: 184638 - DNA, 20 bp, human
ggcagcgcgcccggaactaa

SEQ ID NO: 184639 - DNA, 20 bp, human
ggcgtgctcgggagggtcag

SEQ ID NO: 184640 - DNA, 20 bp, human
gccgggcgcgctgcgaccgt

SEQ ID NO: 184641 - DNA, 20 bp, human
gtgggcgggcccttagttcc

SEQ ID NO: 184642 - DNA, 20 bp, human
gggggcttcggggacacgag

SEQ ID NO: 184643 - DNA, 20 bp, human
gggctcagagaaatcccctc

SEQ ID NO: 184644 - DNA, 20 bp, human
gagtaccgcctgaggcccgt

SEQ ID NO: 184645 - DNA, 20 bp, human
gggagcgacggacccgggac

SEQ ID NO: 184646 - DNA, 20 bp, human
gtgaaaccagcttccctcgg

SEQ ID NO: 184647 - DNA, 20 bp, human
gtgcagagcacgggaggtga

SEQ ID NO: 184648 - DNA, 20 bp, human
gggaccccacagctacctac

SEQ ID NO: 184649 - DNA, 20 bp, human
gccctcggaggctgcagcac

SEQ ID NO: 184650 - DNA, 20 bp, human
gtgcagcctccgagggaagc

SEQ ID NO: 184651 - DNA, 20 bp, human
gtgaggggccgccatgccac

SEQ ID NO: 184652 - DNA, 20 bp, human
ggcttgcacatggagccagg

SEQ ID NO: 184653 - DNA, 20 bp, human
ggacagcaccaggcacacaa

SEQ ID NO: 184654 - DNA, 20 bp, human
gggatgcatctgaaatccag

SEQ ID NO: 184655 - DNA, 20 bp, human
gacctgagtaaaaggacatg

SEQ ID NO: 184656 - DNA, 20 bp, human
gccgaagttgaggcgtccgg

SEQ ID NO: 184657 - DNA, 20 bp, human
gtgaggcgtccggaggcggg

SEQ ID NO: 184658 - DNA, 20 bp, human
ggccgggactttccagccgg

SEQ ID NO: 184659 - DNA, 20 bp, human
ggggctgcgtgagggagcga

SEQ ID NO: 184660 - DNA, 20 bp, human
ggggcgcgcaggcctcgcta

SEQ ID NO: 184661 - DNA, 20 bp, human
gcccgctggcgttgaggacc

SEQ ID NO: 184662 - DNA, 20 bp, human
gcgccgctcggccggctcag

SEQ ID NO: 184663 - DNA, 20 bp, human
ggcgcgggatggaggcgacg

SEQ ID NO: 184664 - DNA, 20 bp, human
gccgcagcgttctgctcccc

SEQ ID NO: 184665 - DNA, 20 bp, human
gccagccgggactttccagc

SEQ ID NO: 184666 - DNA, 20 bp, human
ggcgtcctggcaggaccggg

SEQ ID NO: 184667 - DNA, 20 bp, human
gtgtgggatggaaaccggag

SEQ ID NO: 184668 - DNA, 20 bp, human
gtgcactgtgggatggaaac

SEQ ID NO: 184669 - DNA, 20 bp, human
gccggcccgggccccgactc

SEQ ID NO: 184670 - DNA, 20 bp, human
gcgtgcaggtagcggaacgg

SEQ ID NO: 184671 - DNA, 20 bp, human
ggctccggtgcactgtggga

SEQ ID NO: 184672 - DNA, 20 bp, human
ggccgcgcaggcgctgtggt

SEQ ID NO: 184673 - DNA, 20 bp, human
gcggcgcgtcctggcaggac

SEQ ID NO: 184674 - DNA, 20 bp, human
gggtgggctccggtgcactg

SEQ ID NO: 184675 - DNA, 20 bp, human
gcccgggccgggtgtgaacc

SEQ ID NO: 184676 - DNA, 20 bp, human
gtacctgggcccggagaagg

SEQ ID NO: 184677 - DNA, 20 bp, human
ggagggtagtcggctctcgg

SEQ ID NO: 184678 - DNA, 20 bp, human
gcccaggtaagtagaagaac

SEQ ID NO: 184679 - DNA, 20 bp, human
gacttacctgggcccggaga

SEQ ID NO: 184680 - DNA, 20 bp, human
gctgggcccggagaaggtgg

SEQ ID NO: 184681 - DNA, 20 bp, human
gggaggggagacgaacacag

SEQ ID NO: 184682 - DNA, 20 bp, human
gacagacagactgggcccgg

SEQ ID NO: 184683 - DNA, 20 bp, human
gggagaggaggctcgcacac

SEQ ID NO: 184684 - DNA, 20 bp, human
gctctctctttggagaagtg

SEQ ID NO: 184685 - DNA, 20 bp, human
ggaagaacaggctctgaagc

SEQ ID NO: 184686 - DNA, 20 bp, human
gagaaagacggtaccaagaa

SEQ ID NO: 184687 - DNA, 20 bp, human
gatctactggaacagaggag

SEQ ID NO: 184688 - DNA, 20 bp, human
gtcaggctacccagtgatat

SEQ ID NO: 184689 - DNA, 20 bp, human
ggcacacgctttcaatccat

SEQ ID NO: 184690 - DNA, 20 bp, human
gttaatggggcccagaccta

SEQ ID NO: 184691 - DNA, 20 bp, human
gccattaacacgtcccttct

SEQ ID NO: 184692 - DNA, 20 bp, human
gatctaatctactggaacag

SEQ ID NO: 184693 - DNA, 20 bp, human
gtggcgctagccatggcaca

SEQ ID NO: 184694 - DNA, 20 bp, human
gtaggaggtaactgagaagg

SEQ ID NO: 184695 - DNA, 20 bp, human
gtccagtcctgggcagatct

SEQ ID NO: 184696 - DNA, 20 bp, human
gtttctggagagcagatcag

SEQ ID NO: 184697 - DNA, 20 bp, human
ggagcagagagatgagctgt

SEQ ID NO: 184698 - DNA, 20 bp, human
gatgaagggccacccaagtc

SEQ ID NO: 184699 - DNA, 20 bp, human
gggcggaggccatacacacc

SEQ ID NO: 184700 - DNA, 20 bp, human
gtggtgcttctgtggtgagg

SEQ ID NO: 184701 - DNA, 20 bp, human
gcccagtgaagagaggagca

SEQ ID NO: 184702 - DNA, 20 bp, human
gggaccctggggctcagacc

SEQ ID NO: 184703 - DNA, 20 bp, human
gcacacctggtgccggtctg

SEQ ID NO: 184704 - DNA, 20 bp, human
ggcccagtgttacagtatgt

SEQ ID NO: 184705 - DNA, 20 bp, human
ggggaaaaccacgcagaagc

SEQ ID NO: 184706 - DNA, 20 bp, human
gccccccgcaggaatccgag

SEQ ID NO: 184707 - DNA, 20 bp, human
gtgacgtcaagccccgaggg

SEQ ID NO: 184708 - DNA, 20 bp, human
gcgcccacccacgggatcat

SEQ ID NO: 184709 - DNA, 20 bp, human
gagcccgcgcctcgctggag

SEQ ID NO: 184710 - DNA, 20 bp, human
gcagcgaggcgcgggctgtg

SEQ ID NO: 184711 - DNA, 20 bp, human
gggaatccgaggggtccggg

SEQ ID NO: 184712 - DNA, 20 bp, human
gccctcctgaccccacgaga

SEQ ID NO: 184713 - DNA, 20 bp, human
ggtgctaggcagccgaagcc

SEQ ID NO: 184714 - DNA, 20 bp, human
gcggacccctcggattcctg

SEQ ID NO: 184715 - DNA, 20 bp, human
gagcctggcaaccagctccg

SEQ ID NO: 184716 - DNA, 20 bp, human
ggacccgccggactcacgtg

SEQ ID NO: 184717 - DNA, 20 bp, human
gtggcgagggcggagactgg

SEQ ID NO: 184718 - DNA, 20 bp, human
gtccgtcgcgagggtgccca

SEQ ID NO: 184719 - DNA, 20 bp, human
ggggcggctgtggaccggag

SEQ ID NO: 184720 - DNA, 20 bp, human
ggccgagccccacgtgagtc

SEQ ID NO: 184721 - DNA, 20 bp, human
gccagagggcggctgtggac

SEQ ID NO: 184722 - DNA, 20 bp, human
ggagccccacgtgagtccgg

SEQ ID NO: 184723 - DNA, 20 bp, human
gtcttagccggggagaggtg

SEQ ID NO: 184724 - DNA, 20 bp, human
gcgaggccggtctgcaggcg

SEQ ID NO: 184725 - DNA, 20 bp, human
gggaggggccaggttccgtc

SEQ ID NO: 184726 - DNA, 20 bp, human
gcggcaaactctggatccag

SEQ ID NO: 184727 - DNA, 20 bp, human
gaggtggcgaaggctcccac

SEQ ID NO: 184728 - DNA, 20 bp, human
gtgaccgctgggaagcgagg

SEQ ID NO: 184729 - DNA, 20 bp, human
ggtgggaagcaagcgggtag

SEQ ID NO: 184730 - DNA, 20 bp, human
ggcctccccgcgcactagaa

SEQ ID NO: 184731 - DNA, 20 bp, human
gcagcgggaagcgagaggac

SEQ ID NO: 184732 - DNA, 20 bp, human
ggcctgcgggcggccagcga

SEQ ID NO: 184733 - DNA, 20 bp, human
ggacactgcgcgccgagacg

SEQ ID NO: 184734 - DNA, 20 bp, human
gtcgaccagcgggaagcgag

SEQ ID NO: 184735 - DNA, 20 bp, human
gcgacccgtgggaagcaagc

SEQ ID NO: 184736 - DNA, 20 bp, human
gcgccgagcacaggagaact

SEQ ID NO: 184737 - DNA, 20 bp, human
gcgagggggcatcatgaagc

SEQ ID NO: 184738 - DNA, 20 bp, human
gcgggagaccgcggagaaca

SEQ ID NO: 184739 - DNA, 20 bp, human
ggcatcatgaagcgggctgg

SEQ ID NO: 184740 - DNA, 20 bp, human
gcgagggacggactactgac

SEQ ID NO: 184741 - DNA, 20 bp, human
ggaactgcgcgagaacagga

SEQ ID NO: 184742 - DNA, 20 bp, human
gtggcggcgctgccgctccc

SEQ ID NO: 184743 - DNA, 20 bp, human
gctggcacccgggagtctcg

SEQ ID NO: 184744 - DNA, 20 bp, human
gggccgcgtggtcgatggtg

SEQ ID NO: 184745 - DNA, 20 bp, human
gatcgggcgcgtggagatcg

SEQ ID NO: 184746 - DNA, 20 bp, human
gcccggagaagcggttgtag

SEQ ID NO: 184747 - DNA, 20 bp, human
gtgctctagagaggcatcta

SEQ ID NO: 184748 - DNA, 20 bp, human
gctctctagagcatgagctc

SEQ ID NO: 184749 - DNA, 20 bp, human
gctgagaccccagctcggga

SEQ ID NO: 184750 - DNA, 20 bp, human
gacccctgtggtgacgtctg

SEQ ID NO: 184751 - DNA, 20 bp, human
ggtctcaggggagctcggtg

SEQ ID NO: 184752 - DNA, 20 bp, human
gtttgtgctccacccacagg

SEQ ID NO: 184753 - DNA, 20 bp, human
ggtgggtggagcacaaatga

SEQ ID NO: 184754 - DNA, 20 bp, human
gagaggcatctacggtcctt

SEQ ID NO: 184755 - DNA, 20 bp, human
ggcagtcccgtcccgagctg

SEQ ID NO: 184756 - DNA, 20 bp, human
gacacctcaccagggacgag

SEQ ID NO: 184757 - DNA, 20 bp, human
gcgggacgcggtggtcacag

SEQ ID NO: 184758 - DNA, 20 bp, human
gccgccgctacacctcacca

SEQ ID NO: 184759 - DNA, 20 bp, human
ggacacactagctgcagaca

SEQ ID NO: 184760 - DNA, 20 bp, human
gcgtccctggtgaggtgtag

SEQ ID NO: 184761 - DNA, 20 bp, human
ggcgatgggcggaagtggtg

SEQ ID NO: 184762 - DNA, 20 bp, human
gcagaccccgcactgaacaa

SEQ ID NO: 184763 - DNA, 20 bp, human
gggtcgcgagtggcctaatg

SEQ ID NO: 184764 - DNA, 20 bp, human
gtcggactctaggcccaggc

SEQ ID NO: 184765 - DNA, 20 bp, human
ggcccgcgcggcggcatctc

SEQ ID NO: 184766 - DNA, 20 bp, human
gtagtgcacagagcacggat

SEQ ID NO: 184767 - DNA, 20 bp, human
ggcatgatggctggactcaa

SEQ ID NO: 184768 - DNA, 20 bp, human
gagcctgagggggactaaga

SEQ ID NO: 184769 - DNA, 20 bp, human
gtcccaacctgggcagaagt

SEQ ID NO: 184770 - DNA, 20 bp, human
gcacgggagcttcccaacct

SEQ ID NO: 184771 - DNA, 20 bp, human
gagagcacggataggcatga

SEQ ID NO: 184772 - DNA, 20 bp, human
ggctccaggaagtcgtgctg

SEQ ID NO: 184773 - DNA, 20 bp, human
ggcggtacccgggcaaacac

SEQ ID NO: 184774 - DNA, 20 bp, human
gggacctgtagcagtttctt

SEQ ID NO: 184775 - DNA, 20 bp, human
gctgtttgtataggtgatca

SEQ ID NO: 184776 - DNA, 20 bp, human
gctgggccgcagacatgccc

SEQ ID NO: 184777 - DNA, 20 bp, human
gagagaggaagccaacccac

SEQ ID NO: 184778 - DNA, 20 bp, human
gcaatgtccctgcgagacaa

SEQ ID NO: 184779 - DNA, 20 bp, human
gtccctgcgagacaagggcg

SEQ ID NO: 184780 - DNA, 20 bp, human
ggcatcacccgggcaggacc

SEQ ID NO: 184781 - DNA, 20 bp, human
gtaaactagaaagggaccaa

SEQ ID NO: 184782 - DNA, 20 bp, human
gggggtgtacacaaagctcc

SEQ ID NO: 184783 - DNA, 20 bp, human
gctcctggcccagcatcacc

SEQ ID NO: 184784 - DNA, 20 bp, human
gccctcttccaagaggtcct

SEQ ID NO: 184785 - DNA, 20 bp, human
gtgggtgtcatgctgcctgt

SEQ ID NO: 184786 - DNA, 20 bp, human
gcaggaagcccctaatgcag

SEQ ID NO: 184787 - DNA, 20 bp, human
gtgctgtatggcagaggata

SEQ ID NO: 184788 - DNA, 20 bp, human
ggctccagatggatgctgta

SEQ ID NO: 184789 - DNA, 20 bp, human
gccactgccagcaaccgccc

SEQ ID NO: 184790 - DNA, 20 bp, human
gtaaaagacagggctccaga

SEQ ID NO: 184791 - DNA, 20 bp, human
gtgtccctgccacgcccggg

SEQ ID NO: 184792 - DNA, 20 bp, human
gggaggaccttgggacgagg

SEQ ID NO: 184793 - DNA, 20 bp, human
gcggtgtcgccgcagaaccg

SEQ ID NO: 184794 - DNA, 20 bp, human
gcaggctgccgctgcattag

SEQ ID NO: 184795 - DNA, 20 bp, human
gccactcatcctaaaagaca

SEQ ID NO: 184796 - DNA, 20 bp, human
gggcgagtcggtgagcagct

SEQ ID NO: 184797 - DNA, 20 bp, human
gcccgctgcagccgctcgct

SEQ ID NO: 184798 - DNA, 20 bp, human
ggggagctgccgccgacgtg

SEQ ID NO: 184799 - DNA, 20 bp, human
gagggaaggcctgcacctca

SEQ ID NO: 184800 - DNA, 20 bp, human
ggcccggagatgcaaagtcc

SEQ ID NO: 184801 - DNA, 20 bp, human
ggcggctgcgtactggctgt

SEQ ID NO: 184802 - DNA, 20 bp, human
gcggcccggcggctgcgtac

SEQ ID NO: 184803 - DNA, 20 bp, human
gggagatgcaaagtcccggt

SEQ ID NO: 184804 - DNA, 20 bp, human
gaggcctgcacctcagggac

SEQ ID NO: 184805 - DNA, 20 bp, human
gtctccgcccaggacgcggg

SEQ ID NO: 184806 - DNA, 20 bp, human
gagtcagtcccgggtcgcag

SEQ ID NO: 184807 - DNA, 20 bp, human
gccgggactgacttcgggat

SEQ ID NO: 184808 - DNA, 20 bp, human
gcccggagctgctaccgtgg

SEQ ID NO: 184809 - DNA, 20 bp, human
ggcgacccgggactgacttc

SEQ ID NO: 184810 - DNA, 20 bp, human
gctgggcggccgctgcgacc

SEQ ID NO: 184811 - DNA, 20 bp, human
gtccgggaagcgccaccatg

SEQ ID NO: 184812 - DNA, 20 bp, human
gttcctggctgagaacgggg

SEQ ID NO: 184813 - DNA, 20 bp, human
gctgacttcgggatgggaag

SEQ ID NO: 184814 - DNA, 20 bp, human
gttcttacggagccccatgg

SEQ ID NO: 184815 - DNA, 20 bp, human
gagcatgtagaagaaaaccg

SEQ ID NO: 184816 - DNA, 20 bp, human
gcgggccctcctctgatcgg

SEQ ID NO: 184817 - DNA, 20 bp, human
gatacgatgagtgcccaagg

SEQ ID NO: 184818 - DNA, 20 bp, human
ggccaggagcctccgatcag

SEQ ID NO: 184819 - DNA, 20 bp, human
gcgatgagtgcccaaggggg

SEQ ID NO: 184820 - DNA, 20 bp, human
gggtacagtgcacaaagccg

SEQ ID NO: 184821 - DNA, 20 bp, human
gggggtgcagataacgtaca

SEQ ID NO: 184822 - DNA, 20 bp, human
gccgggcggtgcacgacagg

SEQ ID NO: 184823 - DNA, 20 bp, human
ggcgcaaacttctccagcac

SEQ ID NO: 184824 - DNA, 20 bp, human
gcatgctctgccgccccctt

SEQ ID NO: 184825 - DNA, 20 bp, human
gacccctccggcctgtaccc

SEQ ID NO: 184826 - DNA, 20 bp, human
gccgttcggccgctacctca

SEQ ID NO: 184827 - DNA, 20 bp, human
gtcgctggtcaggaacctgt

SEQ ID NO: 184828 - DNA, 20 bp, human
gggccgcctcccgccaggaa

SEQ ID NO: 184829 - DNA, 20 bp, human
gacccagccgcgatcagagg

SEQ ID NO: 184830 - DNA, 20 bp, human
gacctgggagcggagcacag

SEQ ID NO: 184831 - DNA, 20 bp, human
gtggggaagcgcttccctgt

SEQ ID NO: 184832 - DNA, 20 bp, human
ggcggggactggcgaccctg

SEQ ID NO: 184833 - DNA, 20 bp, human
gcgggcagctaggtgcgtag

SEQ ID NO: 184834 - DNA, 20 bp, human
gcccgcccggccatccctgt

SEQ ID NO: 184835 - DNA, 20 bp, human
ggcgggcagaaacctgggag

SEQ ID NO: 184836 - DNA, 20 bp, human
gccgcagcaaaggccgcagg

SEQ ID NO: 184837 - DNA, 20 bp, human
gccgggaggtgagggcgtcc

SEQ ID NO: 184838 - DNA, 20 bp, human
ggcgctctgggagtacgaca

SEQ ID NO: 184839 - DNA, 20 bp, human
ggcgccggcgcccgcagcaa

SEQ ID NO: 184840 - DNA, 20 bp, human
gcagcaaaggccgcaggcgg

SEQ ID NO: 184841 - DNA, 20 bp, human
gactggaccgaagctccagg

SEQ ID NO: 184842 - DNA, 20 bp, human
gaagactccgcgctccgcag

SEQ ID NO: 184843 - DNA, 20 bp, human
gcctccttcagggctcccat

SEQ ID NO: 184844 - DNA, 20 bp, human
gacgcgggaccgtacacgat

SEQ ID NO: 184845 - DNA, 20 bp, human
gaaggaggctgggtcttggg

SEQ ID NO: 184846 - DNA, 20 bp, human
ggtgtctgcactacagcgaa

SEQ ID NO: 184847 - DNA, 20 bp, human
ggaacccgagcccaaggagt

SEQ ID NO: 184848 - DNA, 20 bp, human
ggcagttccggtgagtccgt

SEQ ID NO: 184849 - DNA, 20 bp, human
gcacagccttccaaccaggt

SEQ ID NO: 184850 - DNA, 20 bp, human
gaccggaagtaactcttgac

SEQ ID NO: 184851 - DNA, 20 bp, human
gcgggcactcggagcagttc

SEQ ID NO: 184852 - DNA, 20 bp, human
gttccggtgagtccgtgggt

SEQ ID NO: 184853 - DNA, 20 bp, human
gggagtataagctgatgtac

SEQ ID NO: 184854 - DNA, 20 bp, human
ggcggagtcagagaagatgt

SEQ ID NO: 184855 - DNA, 20 bp, human
gcatcttgctgacaaacgag

SEQ ID NO: 184856 - DNA, 20 bp, human
gcgcccggcgggaaggtcag

SEQ ID NO: 184857 - DNA, 20 bp, human
gccggcgcgcgcccagtccc

SEQ ID NO: 184858 - DNA, 20 bp, human
gggcgtccccgaaaagtcag

SEQ ID NO: 184859 - DNA, 20 bp, human
gtggagccggtggaacccgg

SEQ ID NO: 184860 - DNA, 20 bp, human
gagagtccgccgggttccac

SEQ ID NO: 184861 - DNA, 20 bp, human
gccaactgcagccggcccga

SEQ ID NO: 184862 - DNA, 20 bp, human
gccatggtgtagatcaccgg

SEQ ID NO: 184863 - DNA, 20 bp, human
ggctgcggcgcaaccggctc

SEQ ID NO: 184864 - DNA, 20 bp, human
gggcactcacaggtgacgat

SEQ ID NO: 184865 - DNA, 20 bp, human
gcgccaggcagctccggagc

SEQ ID NO: 184866 - DNA, 20 bp, human
ggggatgtcacagaacgccg

SEQ ID NO: 184867 - DNA, 20 bp, human
ggccagccgggagaagacga

SEQ ID NO: 184868 - DNA, 20 bp, human
ggccgggagaagacgagggg

SEQ ID NO: 184869 - DNA, 20 bp, human
ggaacagatactgggaccat

SEQ ID NO: 184870 - DNA, 20 bp, human
gcctgggaggccctagaaac

SEQ ID NO: 184871 - DNA, 20 bp, human
gccatcgacgggtgcaatcc

SEQ ID NO: 184872 - DNA, 20 bp, human
ggagaagacgaggggaggcg

SEQ ID NO: 184873 - DNA, 20 bp, human
gctgtggggctgcggcggtg

SEQ ID NO: 184874 - DNA, 20 bp, human
gaaagaggaacgacagtgtg

SEQ ID NO: 184875 - DNA, 20 bp, human
gcctcccaggtttaagacgg

SEQ ID NO: 184876 - DNA, 20 bp, human
ggaccgtgtagcgccacctc

SEQ ID NO: 184877 - DNA, 20 bp, human
gggcgcgcctagttctgctc

SEQ ID NO: 184878 - DNA, 20 bp, human
gggcgtacagagctccccgg

SEQ ID NO: 184879 - DNA, 20 bp, human
gctgcagacgtggagagcaa

SEQ ID NO: 184880 - DNA, 20 bp, human
gcagaagccgggaatcggag

SEQ ID NO: 184881 - DNA, 20 bp, human
ggcaggcgtacagagctccc

SEQ ID NO: 184882 - DNA, 20 bp, human
ggagcacacacgcccttggg

SEQ ID NO: 184883 - DNA, 20 bp, human
gccgggaatcggagaggaac

SEQ ID NO: 184884 - DNA, 20 bp, human
gcctcggggagggagcacac

SEQ ID NO: 184885 - DNA, 20 bp, human
gctgggaccgatgctagagt

SEQ ID NO: 184886 - DNA, 20 bp, human
gggacaggttcaacttgccc

SEQ ID NO: 184887 - DNA, 20 bp, human
gtcctttgccgccaagcggg

SEQ ID NO: 184888 - DNA, 20 bp, human
ggaacctgtccagcccccgt

SEQ ID NO: 184889 - DNA, 20 bp, human
gtttgacccacagcctacgg

SEQ ID NO: 184890 - DNA, 20 bp, human
gcctaaacaggagcacctgc

SEQ ID NO: 184891 - DNA, 20 bp, human
ggtccagcccccgtaggctg

SEQ ID NO: 184892 - DNA, 20 bp, human
gtcaaaagtgccggtcaaaa

SEQ ID NO: 184893 - DNA, 20 bp, human
ggaagtgaatccccctaaac

SEQ ID NO: 184894 - DNA, 20 bp, human
gtaattcacagagatctcca

SEQ ID NO: 184895 - DNA, 20 bp, human
ggattcacttccattttgac

SEQ ID NO: 184896 - DNA, 20 bp, human
gatcgcgagagcacatccca

SEQ ID NO: 184897 - DNA, 20 bp, human
gcagacgtccgccctctcgg

SEQ ID NO: 184898 - DNA, 20 bp, human
gggtatcgcgagaactgctt

SEQ ID NO: 184899 - DNA, 20 bp, human
gcgttctggctacaggttcg

SEQ ID NO: 184900 - DNA, 20 bp, human
gcggacgtctgcaggtggaa

SEQ ID NO: 184901 - DNA, 20 bp, human
gcctcacagcacacaatggt

SEQ ID NO: 184902 - DNA, 20 bp, human
ggcgcggatgagccagcgga

SEQ ID NO: 184903 - DNA, 20 bp, human
ggtagggaatggagcaagtg

SEQ ID NO: 184904 - DNA, 20 bp, human
ggaaaccacagcccccgaga

SEQ ID NO: 184905 - DNA, 20 bp, human
gattccctacctgcagtggg

SEQ ID NO: 184906 - DNA, 20 bp, human
gcagcgctggacgggagaac

SEQ ID NO: 184907 - DNA, 20 bp, human
gtgcatcgcggtgattgcca

SEQ ID NO: 184908 - DNA, 20 bp, human
gtgcacaccgccatcttggg

SEQ ID NO: 184909 - DNA, 20 bp, human
gctgcagaggtctcaggcag

SEQ ID NO: 184910 - DNA, 20 bp, human
gccgcgcgtacgcacctcct

SEQ ID NO: 184911 - DNA, 20 bp, human
gtgtcgcggcgacgaggtgg

SEQ ID NO: 184912 - DNA, 20 bp, human
gttggaggccgcgtgaccag

SEQ ID NO: 184913 - DNA, 20 bp, human
gaagatggcggtgtgcatcg

SEQ ID NO: 184914 - DNA, 20 bp, human
gtctcaggcagaggcgtgac

SEQ ID NO: 184915 - DNA, 20 bp, human
gtccgggctcgcaccatcct

SEQ ID NO: 184916 - DNA, 20 bp, human
ggggtcgccgagctaacccg

SEQ ID NO: 184917 - DNA, 20 bp, human
gtaggctccggcgtctgcag

SEQ ID NO: 184918 - DNA, 20 bp, human
gcggcgacccctgcagacgc

SEQ ID NO: 184919 - DNA, 20 bp, human
ggccccactcgcctagccac

SEQ ID NO: 184920 - DNA, 20 bp, human
gggggcagcggcttaggctc

SEQ ID NO: 184921 - DNA, 20 bp, human
gcagtgccggtcggtcttgt

SEQ ID NO: 184922 - DNA, 20 bp, human
gtagtaagagagaagttaag

SEQ ID NO: 184923 - DNA, 20 bp, human
gggcggccggcaccatgtcg

SEQ ID NO: 184924 - DNA, 20 bp, human
gggctgaggggcagcggctt

SEQ ID NO: 184925 - DNA, 20 bp, human
ggcagtgagtcagtgccggt

SEQ ID NO: 184926 - DNA, 20 bp, human
ggcactcctgtctcaaagcg

SEQ ID NO: 184927 - DNA, 20 bp, human
gattctttatacacacttta

SEQ ID NO: 184928 - DNA, 20 bp, human
gaattgattattctttatgt

SEQ ID NO: 184929 - DNA, 20 bp, human
gttctggtcttcggtgtgca

SEQ ID NO: 184930 - DNA, 20 bp, human
gatgctataagaatttttag

SEQ ID NO: 184931 - DNA, 20 bp, human
gaagacaatcctgttgttca

SEQ ID NO: 184932 - DNA, 20 bp, human
gctcttcctcgctttgagac

SEQ ID NO: 184933 - DNA, 20 bp, human
gaatcataaatgacacatct

SEQ ID NO: 184934 - DNA, 20 bp, human
gttttcatattttctgtcag

SEQ ID NO: 184935 - DNA, 20 bp, human
gtgatacacctctaagaaac

SEQ ID NO: 184936 - DNA, 20 bp, human
gccgagcggcaaggcagcga

SEQ ID NO: 184937 - DNA, 20 bp, human
gtcaatggcatggacgtgaa

SEQ ID NO: 184938 - DNA, 20 bp, human
ggcgggacggcatccgaggt

SEQ ID NO: 184939 - DNA, 20 bp, human
ggccccagtgctgtagaagt

SEQ ID NO: 184940 - DNA, 20 bp, human
gtcacaactagcgcagactc

SEQ ID NO: 184941 - DNA, 20 bp, human
ggccagcgggacggcatccg

SEQ ID NO: 184942 - DNA, 20 bp, human
gtaccagtttccgagcggca

SEQ ID NO: 184943 - DNA, 20 bp, human
gcactgggagcgacacgctc

SEQ ID NO: 184944 - DNA, 20 bp, human
ggcccgagcctagcccacct

SEQ ID NO: 184945 - DNA, 20 bp, human
gtcccctcggcggaatcccc

SEQ ID NO: 184946 - DNA, 20 bp, human
gagcagactgctgcggttcc

SEQ ID NO: 184947 - DNA, 20 bp, human
ggggtgggtagggtctcacc

SEQ ID NO: 184948 - DNA, 20 bp, human
gcgccgagacgggatcggag

SEQ ID NO: 184949 - DNA, 20 bp, human
gaccccaacgaggtctgcgt

SEQ ID NO: 184950 - DNA, 20 bp, human
gtcgcggggccctgacccta

SEQ ID NO: 184951 - DNA, 20 bp, human
gagcggacgaggcccggcgc

SEQ ID NO: 184952 - DNA, 20 bp, human
gcgaggtctgcgtgggaggt

SEQ ID NO: 184953 - DNA, 20 bp, human
ggcgggcgccgagacgggat

SEQ ID NO: 184954 - DNA, 20 bp, human
ggcccccaccatgcatgggg

SEQ ID NO: 184955 - DNA, 20 bp, human
gacccgcccccaccatgcat

SEQ ID NO: 184956 - DNA, 20 bp, human
gctttaggcgtgcgaggagg

SEQ ID NO: 184957 - DNA, 20 bp, human
gtttcttcacacggagatgg

SEQ ID NO: 184958 - DNA, 20 bp, human
gcgcgaacgccactttccaa

SEQ ID NO: 184959 - DNA, 20 bp, human
gacgttgccctgcaaggccg

SEQ ID NO: 184960 - DNA, 20 bp, human
gcacacctagtaagtggggg

SEQ ID NO: 184961 - DNA, 20 bp, human
gaatgagagctggaagcgct

SEQ ID NO: 184962 - DNA, 20 bp, human
gcgtacctaagcctcagcgt

SEQ ID NO: 184963 - DNA, 20 bp, human
gcatctttaggcgtgcgagg

SEQ ID NO: 184964 - DNA, 20 bp, human
ggcgcatctttaggcgtgcg

SEQ ID NO: 184965 - DNA, 20 bp, human
gagctcaaggcctgagtaag

SEQ ID NO: 184966 - DNA, 20 bp, human
gtcggggctaccaaatccta

SEQ ID NO: 184967 - DNA, 20 bp, human
gggccgaactaaagtctgac

SEQ ID NO: 184968 - DNA, 20 bp, human
gggagagagcccacacttcg

SEQ ID NO: 184969 - DNA, 20 bp, human
gggatcgcatctcagctggt

SEQ ID NO: 184970 - DNA, 20 bp, human
ggttgaaggaaagcactgag

SEQ ID NO: 184971 - DNA, 20 bp, human
gaaaggacctcaaggttgtg

SEQ ID NO: 184972 - DNA, 20 bp, human
gagacaactgacaggttcta

SEQ ID NO: 184973 - DNA, 20 bp, human
gtcaccgcaaaaggacctca

SEQ ID NO: 184974 - DNA, 20 bp, human
gttagttcggccctaggatt

SEQ ID NO: 184975 - DNA, 20 bp, human
ggtcgggtggcgatgggaca

SEQ ID NO: 184976 - DNA, 20 bp, human
gtcagggttcggcctcaaca

SEQ ID NO: 184977 - DNA, 20 bp, human
gtgccgtccgaaggactaag

SEQ ID NO: 184978 - DNA, 20 bp, human
gcaccacttagtccttcgga

SEQ ID NO: 184979 - DNA, 20 bp, human
gggccggaaccgccatgttg

SEQ ID NO: 184980 - DNA, 20 bp, human
ggtgcagcgacgaagccgag

SEQ ID NO: 184981 - DNA, 20 bp, human
gtgggagtagtactgccggt

SEQ ID NO: 184982 - DNA, 20 bp, human
gtagtactgccggttggtca

SEQ ID NO: 184983 - DNA, 20 bp, human
ggcagcgacacaggggacga

SEQ ID NO: 184984 - DNA, 20 bp, human
gggcggggccccgaacgcac

SEQ ID NO: 184985 - DNA, 20 bp, human
gctgccggttggtcagggtt

SEQ ID NO: 184986 - DNA, 20 bp, human
ggctccgcccggacaggtga

SEQ ID NO: 184987 - DNA, 20 bp, human
ggcctgggaagtggccgcag

SEQ ID NO: 184988 - DNA, 20 bp, human
gggagcgggagcccacgacc

SEQ ID NO: 184989 - DNA, 20 bp, human
gccgctgcccgccaggtcgt

SEQ ID NO: 184990 - DNA, 20 bp, human
gccaggcggagacagctcgg

SEQ ID NO: 184991 - DNA, 20 bp, human
gctgggctggcgcttcctac

SEQ ID NO: 184992 - DNA, 20 bp, human
gcggggccgagcagcctctg

SEQ ID NO: 184993 - DNA, 20 bp, human
ggacagctcggaggcacaga

SEQ ID NO: 184994 - DNA, 20 bp, human
gcgggagcccacgacctggc

SEQ ID NO: 184995 - DNA, 20 bp, human
gcagcggacccggacaggtg

SEQ ID NO: 184996 - DNA, 20 bp, human
gtagccataagacaaatata

SEQ ID NO: 184997 - DNA, 20 bp, human
gtaacagagcaacatcacct

SEQ ID NO: 184998 - DNA, 20 bp, human
gacctaggaaaaaagtttgt

SEQ ID NO: 184999 - DNA, 20 bp, human
gtactaagggtcttctcgtt

SEQ ID NO: 185000 - DNA, 20 bp, human
gtagctaaactaaactaaag

SEQ ID NO: 185001 - DNA, 20 bp, human
gtaggaaaaaagtttgtagg

SEQ ID NO: 185002 - DNA, 20 bp, human
gttctaattcctcagagatt

SEQ ID NO: 185003 - DNA, 20 bp, human
gtttagtttagctattaaac

SEQ ID NO: 185004 - DNA, 20 bp, human
gaatccatatatttgtctta

SEQ ID NO: 185005 - DNA, 20 bp, human
gaaataacaagtacttcaca

SEQ ID NO: 185006 - DNA, 20 bp, human
ggggtgctggagctatacag

SEQ ID NO: 185007 - DNA, 20 bp, human
gatagctccagcacccgcag

SEQ ID NO: 185008 - DNA, 20 bp, human
gggctgcacacttagaatgg

SEQ ID NO: 185009 - DNA, 20 bp, human
ggagtctccatgcttctcgg

SEQ ID NO: 185010 - DNA, 20 bp, human
gaccggcaggcctagctccg

SEQ ID NO: 185011 - DNA, 20 bp, human
ggggaggaggagcgacggac

SEQ ID NO: 185012 - DNA, 20 bp, human
gagctatacagcggcgtggg

SEQ ID NO: 185013 - DNA, 20 bp, human
gtctggaggggtggacacgg

SEQ ID NO: 185014 - DNA, 20 bp, human
gcggcccctcgagccagact

SEQ ID NO: 185015 - DNA, 20 bp, human
gtggagctatacagcggcgt

SEQ ID NO: 185016 - DNA, 20 bp, human
ggttctgtgtcaaaacctgg

SEQ ID NO: 185017 - DNA, 20 bp, human
gaggaaaacgaagagccccc

SEQ ID NO: 185018 - DNA, 20 bp, human
gggctgccagatctgtatat

SEQ ID NO: 185019 - DNA, 20 bp, human
gaggagaggcaaagttcaac

SEQ ID NO: 185020 - DNA, 20 bp, human
gagggttctgtgtcaaaacc

SEQ ID NO: 185021 - DNA, 20 bp, human
ggacacatcgacagttaatg

SEQ ID NO: 185022 - DNA, 20 bp, human
gggcttaggttgtttccagg

SEQ ID NO: 185023 - DNA, 20 bp, human
gtgaccatagctatttatag

SEQ ID NO: 185024 - DNA, 20 bp, human
gtaacaactgttaactagtg

SEQ ID NO: 185025 - DNA, 20 bp, human
gtgccagatctgtatattgg

SEQ ID NO: 185026 - DNA, 20 bp, human
gcagcaagccgaaggtgcct

SEQ ID NO: 185027 - DNA, 20 bp, human
ggtcggtacttcagagggaa

SEQ ID NO: 185028 - DNA, 20 bp, human
gccctacctctcacagggtg

SEQ ID NO: 185029 - DNA, 20 bp, human
gtgactgaatgagcaagccc

SEQ ID NO: 185030 - DNA, 20 bp, human
ggagcaagcccaggcacctt

SEQ ID NO: 185031 - DNA, 20 bp, human
gcctacccccaccctgtgag

SEQ ID NO: 185032 - DNA, 20 bp, human
ggatgagatctcaagctctg

SEQ ID NO: 185033 - DNA, 20 bp, human
gctaatgtcccttccaacgg

SEQ ID NO: 185034 - DNA, 20 bp, human
gtctggggtcggtacttcag

SEQ ID NO: 185035 - DNA, 20 bp, human
gctgtgagaggtaggggtgt

SEQ ID NO: 185036 - DNA, 20 bp, human
ggatgaggaagaccaggctc

SEQ ID NO: 185037 - DNA, 20 bp, human
gggctcccgggacagctaca

SEQ ID NO: 185038 - DNA, 20 bp, human
gaggaaggatgaggaagacc

SEQ ID NO: 185039 - DNA, 20 bp, human
ggggagccctcagcagcagt

SEQ ID NO: 185040 - DNA, 20 bp, human
gctcaggtaagacaaggaag

SEQ ID NO: 185041 - DNA, 20 bp, human
gaggcaccacaatgacctag

SEQ ID NO: 185042 - DNA, 20 bp, human
ggatagagtagatctcatca

SEQ ID NO: 185043 - DNA, 20 bp, human
gcacggtctgccataactac

SEQ ID NO: 185044 - DNA, 20 bp, human
ggacatgcaaagcctagtat

SEQ ID NO: 185045 - DNA, 20 bp, human
ggtctgccataactactggt

SEQ ID NO: 185046 - DNA, 20 bp, human
ggtaagatgagcagccggag

SEQ ID NO: 185047 - DNA, 20 bp, human
gaggagggtgtgaagaatat

SEQ ID NO: 185048 - DNA, 20 bp, human
gtgtaggggctcataattag

SEQ ID NO: 185049 - DNA, 20 bp, human
ggtgctaacagtggcatccc

SEQ ID NO: 185050 - DNA, 20 bp, human
gagttgggggaagctttggg

SEQ ID NO: 185051 - DNA, 20 bp, human
ggcccctacagttataaagg

SEQ ID NO: 185052 - DNA, 20 bp, human
gtgagcccctacagttataa

SEQ ID NO: 185053 - DNA, 20 bp, human
ggatgcagatgaacatcctc

SEQ ID NO: 185054 - DNA, 20 bp, human
ggagaaggcatcacagggca

SEQ ID NO: 185055 - DNA, 20 bp, human
gcacatgcagaaagagtctg

SEQ ID NO: 185056 - DNA, 20 bp, human
gccacagctgaggacaccag

SEQ ID NO: 185057 - DNA, 20 bp, human
gtcagtgcccaggcaagccc

SEQ ID NO: 185058 - DNA, 20 bp, human
ggacatcctggagcctgtag

SEQ ID NO: 185059 - DNA, 20 bp, human
ggaatgctgcatcagtgccc

SEQ ID NO: 185060 - DNA, 20 bp, human
gaggtgctgcaggcacccgt

SEQ ID NO: 185061 - DNA, 20 bp, human
gtctggtgcagtgccactac

SEQ ID NO: 185062 - DNA, 20 bp, human
ggcacccctccggcaagaac

SEQ ID NO: 185063 - DNA, 20 bp, human
gtcgcagagctccagcgggc

SEQ ID NO: 185064 - DNA, 20 bp, human
gccagctgctggtatgggtg

SEQ ID NO: 185065 - DNA, 20 bp, human
gccccaggtcagggcatagt

SEQ ID NO: 185066 - DNA, 20 bp, human
gctgcctcacttccctaaat

SEQ ID NO: 185067 - DNA, 20 bp, human
gctgcccatttagggaagtg

SEQ ID NO: 185068 - DNA, 20 bp, human
gtaggctcaatgaatccctg

SEQ ID NO: 185069 - DNA, 20 bp, human
gccccaggcgaagctaaccc

SEQ ID NO: 185070 - DNA, 20 bp, human
gcacctgagacgcaaccctg

SEQ ID NO: 185071 - DNA, 20 bp, human
gctctggaccctctctgcat

SEQ ID NO: 185072 - DNA, 20 bp, human
gtaaaggagccaatgcagag

SEQ ID NO: 185073 - DNA, 20 bp, human
ggcctggagatccaaggtga

SEQ ID NO: 185074 - DNA, 20 bp, human
gaatccctgcggttggctgg

SEQ ID NO: 185075 - DNA, 20 bp, human
gctcaatgaatccctgcggt

SEQ ID NO: 185076 - DNA, 20 bp, human
ggtgggatgaagaatgagtg

SEQ ID NO: 185077 - DNA, 20 bp, human
ggcgtctgactcctcctgag

SEQ ID NO: 185078 - DNA, 20 bp, human
gctcacctggagacaccacc

SEQ ID NO: 185079 - DNA, 20 bp, human
ggaaaaaagggagccctctc

SEQ ID NO: 185080 - DNA, 20 bp, human
gctaccccatacataagagg

SEQ ID NO: 185081 - DNA, 20 bp, human
gcatacataagaggaggtag

SEQ ID NO: 185082 - DNA, 20 bp, human
gggtctaccccatacataag

SEQ ID NO: 185083 - DNA, 20 bp, human
ggaggccaggatgtaccggg

SEQ ID NO: 185084 - DNA, 20 bp, human
gaaaagggagccctctcagg

SEQ ID NO: 185085 - DNA, 20 bp, human
gcccaggtcagagctctgaa

SEQ ID NO: 185086 - DNA, 20 bp, human
gttgcggcggagggcaggaa

SEQ ID NO: 185087 - DNA, 20 bp, human
gatgctcctcgagaagacgg

SEQ ID NO: 185088 - DNA, 20 bp, human
ggctggcgggcgctatatct

SEQ ID NO: 185089 - DNA, 20 bp, human
ggtgcatgtatatagaaggg

SEQ ID NO: 185090 - DNA, 20 bp, human
gcacccagggtaggaagctt

SEQ ID NO: 185091 - DNA, 20 bp, human
gcggcgctgcaaatttccac

SEQ ID NO: 185092 - DNA, 20 bp, human
gcggctggatgcggagagtt

SEQ ID NO: 185093 - DNA, 20 bp, human
gggagaggggcttgcatctg

SEQ ID NO: 185094 - DNA, 20 bp, human
gggagcacactcttgtcggg

SEQ ID NO: 185095 - DNA, 20 bp, human
gctcttgtcggggggacgag

SEQ ID NO: 185096 - DNA, 20 bp, human
gcaggcaggcagtagtgact

SEQ ID NO: 185097 - DNA, 20 bp, human
gcaggtacgtacccaaccat

SEQ ID NO: 185098 - DNA, 20 bp, human
gtcggctgcacactctcccg

SEQ ID NO: 185099 - DNA, 20 bp, human
gctcaccgtagcaggcaggc

SEQ ID NO: 185100 - DNA, 20 bp, human
gcaggcagctggaaggacca

SEQ ID NO: 185101 - DNA, 20 bp, human
gctccttccctgccacacaa

SEQ ID NO: 185102 - DNA, 20 bp, human
ggggcctgcgagcccatggt

SEQ ID NO: 185103 - DNA, 20 bp, human
gtgagtgtggcccccacaat

SEQ ID NO: 185104 - DNA, 20 bp, human
gctgcgccatcccattgtgg

SEQ ID NO: 185105 - DNA, 20 bp, human
gactctcccgcggctctcgc

SEQ ID NO: 185106 - DNA, 20 bp, human
gcggctcggagcgcgaaaca

SEQ ID NO: 185107 - DNA, 20 bp, human
ggcgcagccggaaccggcga

SEQ ID NO: 185108 - DNA, 20 bp, human
gggcggcgacgactactcag

SEQ ID NO: 185109 - DNA, 20 bp, human
gctcggagcgcgaaacatgg

SEQ ID NO: 185110 - DNA, 20 bp, human
gacgactactcagaggacga

SEQ ID NO: 185111 - DNA, 20 bp, human
gagaccccgcaagatcccta

SEQ ID NO: 185112 - DNA, 20 bp, human
gacatggcggggcaggacgc

SEQ ID NO: 185113 - DNA, 20 bp, human
gttgccggccagtgaagcca

SEQ ID NO: 185114 - DNA, 20 bp, human
ggatccctaaggccaggcct

SEQ ID NO: 185115 - DNA, 20 bp, human
gggcgacagcagcgtgtcca

SEQ ID NO: 185116 - DNA, 20 bp, human
gggcgtcggcctgagaacct

SEQ ID NO: 185117 - DNA, 20 bp, human
gaggatgggtccgggatccg

SEQ ID NO: 185118 - DNA, 20 bp, human
gcgcctggcgcagatataag

SEQ ID NO: 185119 - DNA, 20 bp, human
gggagtgggctccacaggat

SEQ ID NO: 185120 - DNA, 20 bp, human
ggcggcggcccatctgaaga

SEQ ID NO: 185121 - DNA, 20 bp, human
ggatccgcagtcggcaggtc

SEQ ID NO: 185122 - DNA, 20 bp, human
gactcctgacctgccgactg

SEQ ID NO: 185123 - DNA, 20 bp, human
ggtccgggatccggggactc

SEQ ID NO: 185124 - DNA, 20 bp, human
gaatacccagctctgtccgg

SEQ ID NO: 185125 - DNA, 20 bp, human
gtcaggagtctgcagcgctg

SEQ ID NO: 185126 - DNA, 20 bp, human
gcagcccggtgtccagagtg

SEQ ID NO: 185127 - DNA, 20 bp, human
gccgcctcactctggacacc

SEQ ID NO: 185128 - DNA, 20 bp, human
gactgagtctgcccacgggt

SEQ ID NO: 185129 - DNA, 20 bp, human
gccacagccagagcaggcat

SEQ ID NO: 185130 - DNA, 20 bp, human
gagggggctctccgacccgt

SEQ ID NO: 185131 - DNA, 20 bp, human
gctgctgccagcccgaagcg

SEQ ID NO: 185132 - DNA, 20 bp, human
gtcccactgagtctgcccac

SEQ ID NO: 185133 - DNA, 20 bp, human
gaagcctgaggggccaccgt

SEQ ID NO: 185134 - DNA, 20 bp, human
gacgacgccgcgcttcgggc

SEQ ID NO: 185135 - DNA, 20 bp, human
gcccccatcgcggctgcgaa

SEQ ID NO: 185136 - DNA, 20 bp, human
gggcagcgctacagaggata

SEQ ID NO: 185137 - DNA, 20 bp, human
gtagttggaaagggctgtga

SEQ ID NO: 185138 - DNA, 20 bp, human
gatgacaaaccatacagccg

SEQ ID NO: 185139 - DNA, 20 bp, human
gtgcttctgccgcggctgta

SEQ ID NO: 185140 - DNA, 20 bp, human
gaaatcaggcagcgctacag

SEQ ID NO: 185141 - DNA, 20 bp, human
ggtcctctcttgaatctgtg

SEQ ID NO: 185142 - DNA, 20 bp, human
gcttttgccaggcatctaag

SEQ ID NO: 185143 - DNA, 20 bp, human
gtgtatggtttgtcattagt

SEQ ID NO: 185144 - DNA, 20 bp, human
gtgccccacagattcaagag

SEQ ID NO: 185145 - DNA, 20 bp, human
gggtttgtcattagttggaa

SEQ ID NO: 185146 - DNA, 20 bp, human
ggccatgaacagtgtggggg

SEQ ID NO: 185147 - DNA, 20 bp, human
gcttgaagaggtcggtgcac

SEQ ID NO: 185148 - DNA, 20 bp, human
ggtcgccatgaacagtgtgg

SEQ ID NO: 185149 - DNA, 20 bp, human
gcaccctaaactcgcaaggt

SEQ ID NO: 185150 - DNA, 20 bp, human
gatgcagggcctgggaacag

SEQ ID NO: 185151 - DNA, 20 bp, human
ggaaccagcgattgaagcac

SEQ ID NO: 185152 - DNA, 20 bp, human
gttcatggcgacagtggtgg

SEQ ID NO: 185153 - DNA, 20 bp, human
gacactgttcatggcgacag

SEQ ID NO: 185154 - DNA, 20 bp, human
ggattgggactggactggaa

SEQ ID NO: 185155 - DNA, 20 bp, human
gctgttcatggcgacagtgg

SEQ ID NO: 185156 - DNA, 20 bp, human
gaggctgccgatagtccggg

SEQ ID NO: 185157 - DNA, 20 bp, human
gcgggatcctgagcgctcct

SEQ ID NO: 185158 - DNA, 20 bp, human
gttggctcggcccccacgag

SEQ ID NO: 185159 - DNA, 20 bp, human
ggcagcctcggcaacaatag

SEQ ID NO: 185160 - DNA, 20 bp, human
gccgaggctgccgatagtcc

SEQ ID NO: 185161 - DNA, 20 bp, human
gccggagcccaggagcgctc

SEQ ID NO: 185162 - DNA, 20 bp, human
gcgccggctggaagaagtcg

SEQ ID NO: 185163 - DNA, 20 bp, human
gcctctgcctcccggactat

SEQ ID NO: 185164 - DNA, 20 bp, human
gcctgctttgcccctcgtgg

SEQ ID NO: 185165 - DNA, 20 bp, human
gtcatacacgcccggagccc

SEQ ID NO: 185166 - DNA, 20 bp, human
gggagagaacgaggacagat

SEQ ID NO: 185167 - DNA, 20 bp, human
gacgcccgcatcccccggcg

SEQ ID NO: 185168 - DNA, 20 bp, human
gcttacgtggccggggatct

SEQ ID NO: 185169 - DNA, 20 bp, human
gtcagcacgcccgcatcccc

SEQ ID NO: 185170 - DNA, 20 bp, human
ggccgcgcggaggtcagcac

SEQ ID NO: 185171 - DNA, 20 bp, human
gcacgtctggctgcattcgg

SEQ ID NO: 185172 - DNA, 20 bp, human
gggtaccgcgacaaagccct

SEQ ID NO: 185173 - DNA, 20 bp, human
gggtcctgcgggcgctgcaa

SEQ ID NO: 185174 - DNA, 20 bp, human
gctcggggtagggggagacg

SEQ ID NO: 185175 - DNA, 20 bp, human
gattaataccgcctcgccgg

SEQ ID NO: 185176 - DNA, 20 bp, human
gcgggggatggtgcgatccc

SEQ ID NO: 185177 - DNA, 20 bp, human
gcagcggatgcagaggagag

SEQ ID NO: 185178 - DNA, 20 bp, human
gcctgcccgggtcctagcag

SEQ ID NO: 185179 - DNA, 20 bp, human
gagactcgcagcggaagtgg

SEQ ID NO: 185180 - DNA, 20 bp, human
gccaggtgcagcggatgcag

SEQ ID NO: 185181 - DNA, 20 bp, human
ggcgcgcacgagactcgcag

SEQ ID NO: 185182 - DNA, 20 bp, human
gctcgcagcggaagtggagg

SEQ ID NO: 185183 - DNA, 20 bp, human
gcgcgtccgctgctaggacc

SEQ ID NO: 185184 - DNA, 20 bp, human
ggtccggccgtcacccctag

SEQ ID NO: 185185 - DNA, 20 bp, human
ggcccgagggcatcagacgg

SEQ ID NO: 185186 - DNA, 20 bp, human
gtgctcacctacagcctcgg

SEQ ID NO: 185187 - DNA, 20 bp, human
gcccagacggtggaagtcga

SEQ ID NO: 185188 - DNA, 20 bp, human
gggcttcgcccggccaagtc

SEQ ID NO: 185189 - DNA, 20 bp, human
ggtaggtgagcacgtcgtgg

SEQ ID NO: 185190 - DNA, 20 bp, human
gtctcctgtgcaccaacagg

SEQ ID NO: 185191 - DNA, 20 bp, human
gatgcaacaagtagtacccg

SEQ ID NO: 185192 - DNA, 20 bp, human
gtctgagctgccccagacgg

SEQ ID NO: 185193 - DNA, 20 bp, human
gactacgcggagccccctgt

SEQ ID NO: 185194 - DNA, 20 bp, human
ggtgcccaagaccagctcgc

SEQ ID NO: 185195 - DNA, 20 bp, human
gaagttgccgccgaggctgt

SEQ ID NO: 185196 - DNA, 20 bp, human
gatagtgaccggctccctca

SEQ ID NO: 185197 - DNA, 20 bp, human
gcatctgtcagggtaccctg

SEQ ID NO: 185198 - DNA, 20 bp, human
ggatgcagcggctccctata

SEQ ID NO: 185199 - DNA, 20 bp, human
gcttagatgaccataaccag

SEQ ID NO: 185200 - DNA, 20 bp, human
gggccgcagtcgatagtgac

SEQ ID NO: 185201 - DNA, 20 bp, human
gttgcagagtgggcaagtag

SEQ ID NO: 185202 - DNA, 20 bp, human
gtccaggaagcgcatggtgt

SEQ ID NO: 185203 - DNA, 20 bp, human
gtgggggcaagtgggagact

SEQ ID NO: 185204 - DNA, 20 bp, human
gtggcagctggctaacgtgg

SEQ ID NO: 185205 - DNA, 20 bp, human
gcgcttcctggaggatgcag

SEQ ID NO: 185206 - DNA, 20 bp, human
gtcgggggacgcgggacgta

SEQ ID NO: 185207 - DNA, 20 bp, human
ggtaggctccgagcgctcgg

SEQ ID NO: 185208 - DNA, 20 bp, human
gtcggtagcgctgggcgcgt

SEQ ID NO: 185209 - DNA, 20 bp, human
ggcagcgccggatgcactcg

SEQ ID NO: 185210 - DNA, 20 bp, human
gctccagggcgcaggactct

SEQ ID NO: 185211 - DNA, 20 bp, human
gacgcgggacgtagggatcc

SEQ ID NO: 185212 - DNA, 20 bp, human
gggacagctcgcggcactcg

SEQ ID NO: 185213 - DNA, 20 bp, human
gacgtagggatcccggatgc

SEQ ID NO: 185214 - DNA, 20 bp, human
gcatggcgcggacagagggg

SEQ ID NO: 185215 - DNA, 20 bp, human
ggcggaagcaggaagcgact

SEQ ID NO: 185216 - DNA, 20 bp, human
gaccgtgcggtccctgtagt

SEQ ID NO: 185217 - DNA, 20 bp, human
gcctgtagttggaggacggg

SEQ ID NO: 185218 - DNA, 20 bp, human
ggtccctgtagttggaggac

SEQ ID NO: 185219 - DNA, 20 bp, human
gtccaactacagggaccgca

SEQ ID NO: 185220 - DNA, 20 bp, human
ggcagcgcggcagaaaccag

SEQ ID NO: 185221 - DNA, 20 bp, human
gggcggcgcgctgtaaccta

SEQ ID NO: 185222 - DNA, 20 bp, human
gggcctttcccactagccgg

SEQ ID NO: 185223 - DNA, 20 bp, human
gtctccgacctccggctagt

SEQ ID NO: 185224 - DNA, 20 bp, human
ggtgcttggcgcgtaccgtg

SEQ ID NO: 185225 - DNA, 20 bp, human
gcagccccaaaatggactcg

SEQ ID NO: 185226 - DNA, 20 bp, human
ggacaagctccgacctccca

SEQ ID NO: 185227 - DNA, 20 bp, human
gcacagggcggggctcccaa

SEQ ID NO: 185228 - DNA, 20 bp, human
gaccgcttagacgccctctg

SEQ ID NO: 185229 - DNA, 20 bp, human
gagccggacccctgggaggt

SEQ ID NO: 185230 - DNA, 20 bp, human
ggacacggtcaaggacatct

SEQ ID NO: 185231 - DNA, 20 bp, human
ggtcgaccgaaagttcagag

SEQ ID NO: 185232 - DNA, 20 bp, human
gggctccccgggacacaggg

SEQ ID NO: 185233 - DNA, 20 bp, human
ggccccagagggcgtctaag

SEQ ID NO: 185234 - DNA, 20 bp, human
gagccccgccctgtgtcccg

SEQ ID NO: 185235 - DNA, 20 bp, human
gggaggtcggagcttgtcga

SEQ ID NO: 185236 - DNA, 20 bp, human
ggcctcgtccaggaacccca

SEQ ID NO: 185237 - DNA, 20 bp, human
gagggaaagggaactcgcgt

SEQ ID NO: 185238 - DNA, 20 bp, human
ggcaccaggcgcacaccgtg

SEQ ID NO: 185239 - DNA, 20 bp, human
gggccccgcacagagggtac

SEQ ID NO: 185240 - DNA, 20 bp, human
gtgggctgaggagaccggag

SEQ ID NO: 185241 - DNA, 20 bp, human
gtttctcccagcgggcccag

SEQ ID NO: 185242 - DNA, 20 bp, human
ggcagagggaaacggctgca

SEQ ID NO: 185243 - DNA, 20 bp, human
gatgcggtgaccattccctg

SEQ ID NO: 185244 - DNA, 20 bp, human
gcccgcgctctcccagatgg

SEQ ID NO: 185245 - DNA, 20 bp, human
gtgaggagaccggagtggac

SEQ ID NO: 185246 - DNA, 20 bp, human
gacagagagggtgtctgctc

SEQ ID NO: 185247 - DNA, 20 bp, human
gcagagaaaggggccggaaa

SEQ ID NO: 185248 - DNA, 20 bp, human
ggctgagggcccgcataccc

SEQ ID NO: 185249 - DNA, 20 bp, human
gtagactgaagtgtgaacgt

SEQ ID NO: 185250 - DNA, 20 bp, human
gtgaagtgtgaacgtaggag

SEQ ID NO: 185251 - DNA, 20 bp, human
gcacacttcagtctatgaaa

SEQ ID NO: 185252 - DNA, 20 bp, human
gcaaatgctccagggtatgc

SEQ ID NO: 185253 - DNA, 20 bp, human
gcagacaccctctctgtgtc

SEQ ID NO: 185254 - DNA, 20 bp, human
gtttgcaaccaaatgctcca

SEQ ID NO: 185255 - DNA, 20 bp, human
ggagagggtgtctgctctgg

SEQ ID NO: 185256 - DNA, 20 bp, human
gagactgacagtgtgaacgt

SEQ ID NO: 185257 - DNA, 20 bp, human
ggacagtgtgaacgtgggag

SEQ ID NO: 185258 - DNA, 20 bp, human
gagagagggttctctgctct

SEQ ID NO: 185259 - DNA, 20 bp, human
gacactgtcagtctataaaa

SEQ ID NO: 185260 - DNA, 20 bp, human
gccaaatgctccaggctgtg

SEQ ID NO: 185261 - DNA, 20 bp, human
gcagagaaaggggccagaag

SEQ ID NO: 185262 - DNA, 20 bp, human
gagagaaccctctctgtgtc

SEQ ID NO: 185263 - DNA, 20 bp, human
gacccaaagacacgctccgg

SEQ ID NO: 185264 - DNA, 20 bp, human
gagcatttggttggaaagtg

SEQ ID NO: 185265 - DNA, 20 bp, human
gcctctctgtgtctggacgg

SEQ ID NO: 185266 - DNA, 20 bp, human
ggtacagttgactacaccgt

SEQ ID NO: 185267 - DNA, 20 bp, human
gtgacagggtgtatgtgtgt

SEQ ID NO: 185268 - DNA, 20 bp, human
gtcaaggtgaggctacccca

SEQ ID NO: 185269 - DNA, 20 bp, human
gaagaagggcggggatgtca

SEQ ID NO: 185270 - DNA, 20 bp, human
gaatgcacacagaaggacac

SEQ ID NO: 185271 - DNA, 20 bp, human
gacttctttccagggaagaa

SEQ ID NO: 185272 - DNA, 20 bp, human
gggagcccaatgcacacaga

SEQ ID NO: 185273 - DNA, 20 bp, human
ggaagttaaacttctttcca

SEQ ID NO: 185274 - DNA, 20 bp, human
gtttccagggaagaagggcg

SEQ ID NO: 185275 - DNA, 20 bp, human
gatctcagaaaccagccggg

SEQ ID NO: 185276 - DNA, 20 bp, human
gttggagggcgaggaggacc

SEQ ID NO: 185277 - DNA, 20 bp, human
gcccccaagagccctaacgg

SEQ ID NO: 185278 - DNA, 20 bp, human
gcgggcgttggagggcgagg

SEQ ID NO: 185279 - DNA, 20 bp, human
gcgcctaggctaccctcctg

SEQ ID NO: 185280 - DNA, 20 bp, human
gaagcgcgctagcccctcca

SEQ ID NO: 185281 - DNA, 20 bp, human
ggagcgctcgctgccgggaa

SEQ ID NO: 185282 - DNA, 20 bp, human
ggctagcccctccagggacg

SEQ ID NO: 185283 - DNA, 20 bp, human
ggggaaggccgggcgttgga

SEQ ID NO: 185284 - DNA, 20 bp, human
gaactctaccgggaccctag

SEQ ID NO: 185285 - DNA, 20 bp, human
ggggcggcgcctcttaggag

SEQ ID NO: 185286 - DNA, 20 bp, human
gaccggtggcggggacggaa

SEQ ID NO: 185287 - DNA, 20 bp, human
gggctgaggccgggtgactg

SEQ ID NO: 185288 - DNA, 20 bp, human
gcttaaagcttccagaccgg

SEQ ID NO: 185289 - DNA, 20 bp, human
gtggcggggacggaaaggca

SEQ ID NO: 185290 - DNA, 20 bp, human
ggaggaggcgacagcccgga

SEQ ID NO: 185291 - DNA, 20 bp, human
ggcgcttaaagcttccagac

SEQ ID NO: 185292 - DNA, 20 bp, human
gaccttggcctaggcagcca

SEQ ID NO: 185293 - DNA, 20 bp, human
gaaagggccggaaagatcgg

SEQ ID NO: 185294 - DNA, 20 bp, human
gtaattagaaggacaggaaa

SEQ ID NO: 185295 - DNA, 20 bp, human
gggatccccaaagcataggg

SEQ ID NO: 185296 - DNA, 20 bp, human
gcagcctagccaggagggta

SEQ ID NO: 185297 - DNA, 20 bp, human
gggttcactcacctttacag

SEQ ID NO: 185298 - DNA, 20 bp, human
gagcgttgagtcccctgtaa

SEQ ID NO: 185299 - DNA, 20 bp, human
ggtgaaccccactagatcaa

SEQ ID NO: 185300 - DNA, 20 bp, human
gagggtagggagcccagtgt

SEQ ID NO: 185301 - DNA, 20 bp, human
gggcacctgacctaggatga

SEQ ID NO: 185302 - DNA, 20 bp, human
gccagccgtcatcctaggtc

SEQ ID NO: 185303 - DNA, 20 bp, human
gtctcagacttgcttctgag

SEQ ID NO: 185304 - DNA, 20 bp, human
gaggggtcccttgatctagt

SEQ ID NO: 185305 - DNA, 20 bp, human
gcctggctaggctgtagtcc

SEQ ID NO: 185306 - DNA, 20 bp, human
gcagaggagtcttgaatcag

SEQ ID NO: 185307 - DNA, 20 bp, human
gggtgagtggagcaatctgt

SEQ ID NO: 185308 - DNA, 20 bp, human
gagaagagtgaaggcagggc

SEQ ID NO: 185309 - DNA, 20 bp, human
gagcatctgctgtactggca

SEQ ID NO: 185310 - DNA, 20 bp, human
ggagtgaatctggtttacac

SEQ ID NO: 185311 - DNA, 20 bp, human
gaagcactgagtctgggaga

SEQ ID NO: 185312 - DNA, 20 bp, human
ggctctgcataaacaaaaag

SEQ ID NO: 185313 - DNA, 20 bp, human
ggattcactcaccaagccag

SEQ ID NO: 185314 - DNA, 20 bp, human
gtttgtggagaccagccctc

SEQ ID NO: 185315 - DNA, 20 bp, human
gtacataacaataaaccctg

SEQ ID NO: 185316 - DNA, 20 bp, human
gagggtagccatcctcgcag

SEQ ID NO: 185317 - DNA, 20 bp, human
gccagggcgtgaactgaggg

SEQ ID NO: 185318 - DNA, 20 bp, human
ggtctccaggatgaaccgaa

SEQ ID NO: 185319 - DNA, 20 bp, human
gccagccagggcgtgaactg

SEQ ID NO: 185320 - DNA, 20 bp, human
gggttgagccacctacccag

SEQ ID NO: 185321 - DNA, 20 bp, human
gtgaactgagggcggtgagg

SEQ ID NO: 185322 - DNA, 20 bp, human
gaatgccaaaaggggcccag

SEQ ID NO: 185323 - DNA, 20 bp, human
gccgcggcccaggcttcgat

SEQ ID NO: 185324 - DNA, 20 bp, human
gttcagagtcctcaactgag

SEQ ID NO: 185325 - DNA, 20 bp, human
gcagtggcagtgacctagac

SEQ ID NO: 185326 - DNA, 20 bp, human
gaggacaatggaggtggcgg

SEQ ID NO: 185327 - DNA, 20 bp, human
gaggaggaggaggtcgtcgg

SEQ ID NO: 185328 - DNA, 20 bp, human
gtctcggccgagcccagcat

SEQ ID NO: 185329 - DNA, 20 bp, human
gggagaacgaggccgagagt

SEQ ID NO: 185330 - DNA, 20 bp, human
gctgccgcgagtccaccgag

SEQ ID NO: 185331 - DNA, 20 bp, human
ggtccaccgagcggcctctg

SEQ ID NO: 185332 - DNA, 20 bp, human
gaggccgctcggtggactcg

SEQ ID NO: 185333 - DNA, 20 bp, human
gcccccggctcgccggtcag

SEQ ID NO: 185334 - DNA, 20 bp, human
ggcagcatgaggtagcgctg

SEQ ID NO: 185335 - DNA, 20 bp, human
gcgcggccggttctcacctt

SEQ ID NO: 185336 - DNA, 20 bp, human
gtctgccatggcgctcccag

SEQ ID NO: 185337 - DNA, 20 bp, human
gccgacccctgggagcgcca

SEQ ID NO: 185338 - DNA, 20 bp, human
gtgcgaccactgcctgaagg

SEQ ID NO: 185339 - DNA, 20 bp, human
gggcggcctccttcaggcag

SEQ ID NO: 185340 - DNA, 20 bp, human
gatgagacgtgggcagtcca

SEQ ID NO: 185341 - DNA, 20 bp, human
gtcgtgcctgaatgagacgt

SEQ ID NO: 185342 - DNA, 20 bp, human
gcagttgtgtcccgacccct

SEQ ID NO: 185343 - DNA, 20 bp, human
gcttcacggcggcctccttc

SEQ ID NO: 185344 - DNA, 20 bp, human
gagggggcacagctctgcca

SEQ ID NO: 185345 - DNA, 20 bp, human
gcccagcccgaatgcccagg

SEQ ID NO: 185346 - DNA, 20 bp, human
gcggcacccctcctctctca

SEQ ID NO: 185347 - DNA, 20 bp, human
ggaacagaccgccgtgagag

SEQ ID NO: 185348 - DNA, 20 bp, human
ggaatagccgggagattacg

SEQ ID NO: 185349 - DNA, 20 bp, human
gcagaccgccgtgagagagg

SEQ ID NO: 185350 - DNA, 20 bp, human
gctcgtgcaggagcgggacc

SEQ ID NO: 185351 - DNA, 20 bp, human
gagctccgggccgcgaatcc

SEQ ID NO: 185352 - DNA, 20 bp, human
gtagccgggagattacgggg

SEQ ID NO: 185353 - DNA, 20 bp, human
gtggttgctcgtgcaggagc

SEQ ID NO: 185354 - DNA, 20 bp, human
ggctcgggaccggtgagtag

SEQ ID NO: 185355 - DNA, 20 bp, human
gactcaccggtcccgagctc

SEQ ID NO: 185356 - DNA, 20 bp, human
ggctctcgcttagggggcac

SEQ ID NO: 185357 - DNA, 20 bp, human
gggcaggaaagggtagccga

SEQ ID NO: 185358 - DNA, 20 bp, human
ggccctgggactctgaccct

SEQ ID NO: 185359 - DNA, 20 bp, human
gggccgcagtcgagcatcat

SEQ ID NO: 185360 - DNA, 20 bp, human
gaggctcgcggccacgctag

SEQ ID NO: 185361 - DNA, 20 bp, human
ggaagtactgcaggcacacg

SEQ ID NO: 185362 - DNA, 20 bp, human
ggaatacggccggctcaccg

SEQ ID NO: 185363 - DNA, 20 bp, human
gcaaagcgcgcaagacaacg

SEQ ID NO: 185364 - DNA, 20 bp, human
ggaggcaccgggcggacgga

SEQ ID NO: 185365 - DNA, 20 bp, human
gcaacgtggccgcgtccgag

SEQ ID NO: 185366 - DNA, 20 bp, human
ggcccccggcggcgtgtgaa

SEQ ID NO: 185367 - DNA, 20 bp, human
ggcgggacgctgctacggca

SEQ ID NO: 185368 - DNA, 20 bp, human
ggaggctggagacgactcta

SEQ ID NO: 185369 - DNA, 20 bp, human
ggcagggccgatggagaagt

SEQ ID NO: 185370 - DNA, 20 bp, human
ggcggctgaggaagaagcgc

SEQ ID NO: 185371 - DNA, 20 bp, human
gcgcgtggtgcgggtttcgg

SEQ ID NO: 185372 - DNA, 20 bp, human
ggcagcggcccagcagttgg

SEQ ID NO: 185373 - DNA, 20 bp, human
ggctggagacgactctacgg

SEQ ID NO: 185374 - DNA, 20 bp, human
gactaagagttcgggatagg

SEQ ID NO: 185375 - DNA, 20 bp, human
gctacggcggcgaagagacg

SEQ ID NO: 185376 - DNA, 20 bp, human
gccagctggagccctgcgta

SEQ ID NO: 185377 - DNA, 20 bp, human
ggccgagacgcctgccagaa

SEQ ID NO: 185378 - DNA, 20 bp, human
gggatgccaagaccaccaac

SEQ ID NO: 185379 - DNA, 20 bp, human
gacctttctggcaggcgtct

SEQ ID NO: 185380 - DNA, 20 bp, human
gaggcgtctcggcagggagt

SEQ ID NO: 185381 - DNA, 20 bp, human
gtcaggataggtgacctttc

SEQ ID NO: 185382 - DNA, 20 bp, human
gagctgtttcaggcttgctg

SEQ ID NO: 185383 - DNA, 20 bp, human
gagtggggcaggcaaccacg

SEQ ID NO: 185384 - DNA, 20 bp, human
gggtgtgtctctagtcctcg

SEQ ID NO: 185385 - DNA, 20 bp, human
gctcgacccgttgctcctgg

SEQ ID NO: 185386 - DNA, 20 bp, human
gactacacgaacagcttcgg

SEQ ID NO: 185387 - DNA, 20 bp, human
gagcccaggagacctccgga

SEQ ID NO: 185388 - DNA, 20 bp, human
ggaacagcttcgggggtgag

SEQ ID NO: 185389 - DNA, 20 bp, human
gttccttccggaggtctcct

SEQ ID NO: 185390 - DNA, 20 bp, human
gggtcggcagccatctcaca

SEQ ID NO: 185391 - DNA, 20 bp, human
gcagcaccggcctggcagaa

SEQ ID NO: 185392 - DNA, 20 bp, human
gcagagggtcgggtcagcag

SEQ ID NO: 185393 - DNA, 20 bp, human
gcattcctcccgggccacac

SEQ ID NO: 185394 - DNA, 20 bp, human
gccatgtacctgacacccaa

SEQ ID NO: 185395 - DNA, 20 bp, human
gagtatctcttcatggtgtc

SEQ ID NO: 185396 - DNA, 20 bp, human
gggactgcggccactctgaa

SEQ ID NO: 185397 - DNA, 20 bp, human
gacatggacacgcctcacgt

SEQ ID NO: 185398 - DNA, 20 bp, human
ggcctgtgcggctagtccgg

SEQ ID NO: 185399 - DNA, 20 bp, human
gcgccgcgggcccttcagag

SEQ ID NO: 185400 - DNA, 20 bp, human
gcggagggtgctgaacgctg

SEQ ID NO: 185401 - DNA, 20 bp, human
gcaaaccccgcgctccccta

SEQ ID NO: 185402 - DNA, 20 bp, human
gtgaacgctgcggccgaggg

SEQ ID NO: 185403 - DNA, 20 bp, human
ggcgttggaacaggatgcga

SEQ ID NO: 185404 - DNA, 20 bp, human
gtctgggtcggagcgtctgt

SEQ ID NO: 185405 - DNA, 20 bp, human
ggagggcaaagctcggactg

SEQ ID NO: 185406 - DNA, 20 bp, human
gcctctgcaaaacttccgta

SEQ ID NO: 185407 - DNA, 20 bp, human
gtggccatgacagaacaaca

SEQ ID NO: 185408 - DNA, 20 bp, human
gtccggggctcctacagact

SEQ ID NO: 185409 - DNA, 20 bp, human
gttgttctcaagaggtagca

SEQ ID NO: 185410 - DNA, 20 bp, human
gacctgtcaccatcgactgt

SEQ ID NO: 185411 - DNA, 20 bp, human
gagggctgtttcaagactgt

SEQ ID NO: 185412 - DNA, 20 bp, human
ggtatccatttgttctcaag

SEQ ID NO: 185413 - DNA, 20 bp, human
gcgtaaggaagaacgcaatc

SEQ ID NO: 185414 - DNA, 20 bp, human
gaaattgtgcccacagtcga

SEQ ID NO: 185415 - DNA, 20 bp, human
ggccaagtctgtaggagccc

SEQ ID NO: 185416 - DNA, 20 bp, human
gctgccggcggtggactcgt

SEQ ID NO: 185417 - DNA, 20 bp, human
gacggcgcgtgcgcagaggg

SEQ ID NO: 185418 - DNA, 20 bp, human
gccgcgggcggtcaggtagg

SEQ ID NO: 185419 - DNA, 20 bp, human
ggctccgacgagtccaccgc

SEQ ID NO: 185420 - DNA, 20 bp, human
ggagccgcgggcggtcaggt

SEQ ID NO: 185421 - DNA, 20 bp, human
ggtcggagccgcgggcggtc

SEQ ID NO: 185422 - DNA, 20 bp, human
gtaatgtcggggccctgagg

SEQ ID NO: 185423 - DNA, 20 bp, human
gggtgtagcatgtgggagat

SEQ ID NO: 185424 - DNA, 20 bp, human
gggctcgggagggattcgtg

SEQ ID NO: 185425 - DNA, 20 bp, human
gggtggactcgtcggagccg

SEQ ID NO: 185426 - DNA, 20 bp, human
gggccgggcccgacgacggg

SEQ ID NO: 185427 - DNA, 20 bp, human
gtcgctctctcgctagctct

SEQ ID NO: 185428 - DNA, 20 bp, human
ggccgcagccgcagcaagag

SEQ ID NO: 185429 - DNA, 20 bp, human
gtcggctgccgctcttgctg

SEQ ID NO: 185430 - DNA, 20 bp, human
gcggcggccccggcagttac

SEQ ID NO: 185431 - DNA, 20 bp, human
gtgggcactggagttgccgg

SEQ ID NO: 185432 - DNA, 20 bp, human
gcaggctgcttcatctcctg

SEQ ID NO: 185433 - DNA, 20 bp, human
gccaccagcaccgcggtgag

SEQ ID NO: 185434 - DNA, 20 bp, human
gagcgcgccggtaactgccg

SEQ ID NO: 185435 - DNA, 20 bp, human
gtgcaagctctgctgacaca

SEQ ID NO: 185436 - DNA, 20 bp, human
gggtgaagaaaagccagggt

SEQ ID NO: 185437 - DNA, 20 bp, human
gtctcggctcctggttgaag

SEQ ID NO: 185438 - DNA, 20 bp, human
ggctctgaaggtgtgtgggg

SEQ ID NO: 185439 - DNA, 20 bp, human
gagcagcctagagtctgggg

SEQ ID NO: 185440 - DNA, 20 bp, human
gccctcctcaaaagagaagt

SEQ ID NO: 185441 - DNA, 20 bp, human
gcaacagaaatctcggctcc

SEQ ID NO: 185442 - DNA, 20 bp, human
gctgatagcagcctagagtc

SEQ ID NO: 185443 - DNA, 20 bp, human
gcttgaaagcagtgttaaag

SEQ ID NO: 185444 - DNA, 20 bp, human
gtttcttcacctcttcaacc

SEQ ID NO: 185445 - DNA, 20 bp, human
gggtgtgtggggaggtttgt

SEQ ID NO: 185446 - DNA, 20 bp, human
gagctcttcagagcaatcca

SEQ ID NO: 185447 - DNA, 20 bp, human
gtgcctttctcggaacggaa

SEQ ID NO: 185448 - DNA, 20 bp, human
gaacggagcagagtcgtgcg

SEQ ID NO: 185449 - DNA, 20 bp, human
gccagatgtgcgggtcagag

SEQ ID NO: 185450 - DNA, 20 bp, human
gggaacagagcgcgctcact

SEQ ID NO: 185451 - DNA, 20 bp, human
gtaagagccagtcaacagaa

SEQ ID NO: 185452 - DNA, 20 bp, human
gcagggcagtgaaagagata

SEQ ID NO: 185453 - DNA, 20 bp, human
gtcccctgcctttctcggaa

SEQ ID NO: 185454 - DNA, 20 bp, human
gctccgttccgttccgagaa

SEQ ID NO: 185455 - DNA, 20 bp, human
gtccagatgtaagcaatatc

SEQ ID NO: 185456 - DNA, 20 bp, human
gggccgacccccgacaccag

SEQ ID NO: 185457 - DNA, 20 bp, human
gggctgctcgtgccatggag

SEQ ID NO: 185458 - DNA, 20 bp, human
ggaaggcccgggggacacgt

SEQ ID NO: 185459 - DNA, 20 bp, human
gacgtcgggactccgctcca

SEQ ID NO: 185460 - DNA, 20 bp, human
ggctcttacccgaaagtcgt

SEQ ID NO: 185461 - DNA, 20 bp, human
gcgtgggcagtgtccttcac

SEQ ID NO: 185462 - DNA, 20 bp, human
ggcgggagccgcagagccaa

SEQ ID NO: 185463 - DNA, 20 bp, human
ggcggtgcccctggtgtcgg

SEQ ID NO: 185464 - DNA, 20 bp, human
gcgcagagccaagggattcc

SEQ ID NO: 185465 - DNA, 20 bp, human
gccttcccgctccttcaagg

SEQ ID NO: 185466 - DNA, 20 bp, human
gcagctgggcgggattcccg

SEQ ID NO: 185467 - DNA, 20 bp, human
gcctcctcccgggagagcaa

SEQ ID NO: 185468 - DNA, 20 bp, human
gcgggcgggagaaggcgaag

SEQ ID NO: 185469 - DNA, 20 bp, human
gcgcggggagaagtaagccg

SEQ ID NO: 185470 - DNA, 20 bp, human
gtgctcccagcgactacccc

SEQ ID NO: 185471 - DNA, 20 bp, human
gttctgccaggtgtcatcag

SEQ ID NO: 185472 - DNA, 20 bp, human
gagagcaaaggcaggcgtgt

SEQ ID NO: 185473 - DNA, 20 bp, human
gtgcggactgcggctgggaa

SEQ ID NO: 185474 - DNA, 20 bp, human
gggctaggttccgcaatccg

SEQ ID NO: 185475 - DNA, 20 bp, human
gcagcggctcctgcggactg

SEQ ID NO: 185476 - DNA, 20 bp, human
ggtgaaatgaaggccatcga

SEQ ID NO: 185477 - DNA, 20 bp, human
gcgcccggcttgctaggatc

SEQ ID NO: 185478 - DNA, 20 bp, human
ggctgcccgggagccctcga

SEQ ID NO: 185479 - DNA, 20 bp, human
ggatccgggtgcagcggtcg

SEQ ID NO: 185480 - DNA, 20 bp, human
gccattccagcgcctgggaa

SEQ ID NO: 185481 - DNA, 20 bp, human
gcgcagctgctgggacgccc

SEQ ID NO: 185482 - DNA, 20 bp, human
gtcggggctgcgcgatctaa

SEQ ID NO: 185483 - DNA, 20 bp, human
gcggcctgggcccccgactc

SEQ ID NO: 185484 - DNA, 20 bp, human
ggatctaacggaacaaacga

SEQ ID NO: 185485 - DNA, 20 bp, human
gctacctggcccgccactgt

SEQ ID NO: 185486 - DNA, 20 bp, human
gaaatgggggtaggcggcgc

SEQ ID NO: 185487 - DNA, 20 bp, human
ggcgggcgcgccggtaaaaa

SEQ ID NO: 185488 - DNA, 20 bp, human
ggcgcctatggaactgacgg

SEQ ID NO: 185489 - DNA, 20 bp, human
gcgcgcgcctatggaactga

SEQ ID NO: 185490 - DNA, 20 bp, human
ggccccgaggcgcagaagta

SEQ ID NO: 185491 - DNA, 20 bp, human
gcgcctaagaggtcagactg

SEQ ID NO: 185492 - DNA, 20 bp, human
gcgccgagagccggaggcaa

SEQ ID NO: 185493 - DNA, 20 bp, human
gccgtaaccagagcagctgg

SEQ ID NO: 185494 - DNA, 20 bp, human
gccatgtcctccctccagta

SEQ ID NO: 185495 - DNA, 20 bp, human
gcggtggagttcagcgaaga

SEQ ID NO: 185496 - DNA, 20 bp, human
ggaggggcctggtgtatcac

SEQ ID NO: 185497 - DNA, 20 bp, human
gtaatttaactacaattacc

SEQ ID NO: 185498 - DNA, 20 bp, human
gggaagtggcagcaacagag

SEQ ID NO: 185499 - DNA, 20 bp, human
gtggaggaaatagcctgcca

SEQ ID NO: 185500 - DNA, 20 bp, human
gaaggttacggaaaaggtcc

SEQ ID NO: 185501 - DNA, 20 bp, human
ggcagtgaaggttacggaaa

SEQ ID NO: 185502 - DNA, 20 bp, human
gtctgaagacgtgtattcct

SEQ ID NO: 185503 - DNA, 20 bp, human
ggggcctggtgtatcactgg

SEQ ID NO: 185504 - DNA, 20 bp, human
ggtgtgtactgatggcaagt

SEQ ID NO: 185505 - DNA, 20 bp, human
gaccctggagccttggaagg

SEQ ID NO: 185506 - DNA, 20 bp, human
gctctcttcgggccagtctg

SEQ ID NO: 185507 - DNA, 20 bp, human
gccgcaggcaccgctagacc

SEQ ID NO: 185508 - DNA, 20 bp, human
ggcgccgaggctcgtgtcag

SEQ ID NO: 185509 - DNA, 20 bp, human
ggacccgaagccgggaaggt

SEQ ID NO: 185510 - DNA, 20 bp, human
gcggcgaggctgtctagtcc

SEQ ID NO: 185511 - DNA, 20 bp, human
gggtgacccgaggaatcctc

SEQ ID NO: 185512 - DNA, 20 bp, human
gggaagcggaagccgcgccg

SEQ ID NO: 185513 - DNA, 20 bp, human
ggcaccgctagacccggccg

SEQ ID NO: 185514 - DNA, 20 bp, human
ggtggcggcggccaattacg

SEQ ID NO: 185515 - DNA, 20 bp, human
gaagcagcagggggaatcaa

SEQ ID NO: 185516 - DNA, 20 bp, human
gtgcaatttcccacacccac

SEQ ID NO: 185517 - DNA, 20 bp, human
gaatcggcaactaggcagta

SEQ ID NO: 185518 - DNA, 20 bp, human
gccgattaggtcggagactg

SEQ ID NO: 185519 - DNA, 20 bp, human
ggccgtcaagcggaagatcc

SEQ ID NO: 185520 - DNA, 20 bp, human
gctcagagctgcatatgcag

SEQ ID NO: 185521 - DNA, 20 bp, human
gaggtcggagactgcggtag

SEQ ID NO: 185522 - DNA, 20 bp, human
gtccgacctaatcggcaact

SEQ ID NO: 185523 - DNA, 20 bp, human
ggcagctccaggccgtcaag

SEQ ID NO: 185524 - DNA, 20 bp, human
ggatgctacacaggagtaca

SEQ ID NO: 185525 - DNA, 20 bp, human
gcctgtgtagcatcgtccag

SEQ ID NO: 185526 - DNA, 20 bp, human
gaagtcgtctggcctccccg

SEQ ID NO: 185527 - DNA, 20 bp, human
gggagacggagtccgacgtg

SEQ ID NO: 185528 - DNA, 20 bp, human
gccgcagcggctcccagtgg

SEQ ID NO: 185529 - DNA, 20 bp, human
ggaggccagcaagctgcgag

SEQ ID NO: 185530 - DNA, 20 bp, human
gttacgtgaggcggtgacgg

SEQ ID NO: 185531 - DNA, 20 bp, human
gcttctgcgaggacgaccag

SEQ ID NO: 185532 - DNA, 20 bp, human
ggtcaccgcctcacgtaaaa

SEQ ID NO: 185533 - DNA, 20 bp, human
ggagcaccagactcacgcca

SEQ ID NO: 185534 - DNA, 20 bp, human
gcctcgcagaagagccgcag

SEQ ID NO: 185535 - DNA, 20 bp, human
gcgatgggtgccgacattcg

SEQ ID NO: 185536 - DNA, 20 bp, human
gccacccggtgtgacagtgt

SEQ ID NO: 185537 - DNA, 20 bp, human
gggcaagaggtgcagcatga

SEQ ID NO: 185538 - DNA, 20 bp, human
gctggccatctctccaggtc

SEQ ID NO: 185539 - DNA, 20 bp, human
ggccaaactctctctactga

SEQ ID NO: 185540 - DNA, 20 bp, human
gagagagtttggcaggagtt

SEQ ID NO: 185541 - DNA, 20 bp, human
gcctcagtatctaagggagg

SEQ ID NO: 185542 - DNA, 20 bp, human
gtctcctacactgtcacacc

SEQ ID NO: 185543 - DNA, 20 bp, human
gccctgggagggatgttggt

SEQ ID NO: 185544 - DNA, 20 bp, human
gaattattggtggtaataat

SEQ ID NO: 185545 - DNA, 20 bp, human
gagaaagcttttcaggagtg

SEQ ID NO: 185546 - DNA, 20 bp, human
gctgtgccgggagggtagga

SEQ ID NO: 185547 - DNA, 20 bp, human
gagacgccatcctaccctcc

SEQ ID NO: 185548 - DNA, 20 bp, human
gcatcggctgtggggagtac

SEQ ID NO: 185549 - DNA, 20 bp, human
gggagtccaagggagcattg

SEQ ID NO: 185550 - DNA, 20 bp, human
ggaaggaggccggaagctag

SEQ ID NO: 185551 - DNA, 20 bp, human
gtgcagtcggctgtgccggg

SEQ ID NO: 185552 - DNA, 20 bp, human
gtccgcactagagaacaggg

SEQ ID NO: 185553 - DNA, 20 bp, human
gggatggcgtctggccgatg

SEQ ID NO: 185554 - DNA, 20 bp, human
gcgccaccgccaagtccctc

SEQ ID NO: 185555 - DNA, 20 bp, human
gtagtccgcactagagaaca

SEQ ID NO: 185556 - DNA, 20 bp, human
gagctgacggcctcaggaat

SEQ ID NO: 185557 - DNA, 20 bp, human
ggcctatgagcttcctggta

SEQ ID NO: 185558 - DNA, 20 bp, human
gcaagaagttggctgttatg

SEQ ID NO: 185559 - DNA, 20 bp, human
ggctctcagaacaggtgcag

SEQ ID NO: 185560 - DNA, 20 bp, human
gaggccggtggtaatcatgt

SEQ ID NO: 185561 - DNA, 20 bp, human
gacagacaggagcataactg

SEQ ID NO: 185562 - DNA, 20 bp, human
ggatggtattgcggcagcag

SEQ ID NO: 185563 - DNA, 20 bp, human
gcccttgtggaaagtgatga

SEQ ID NO: 185564 - DNA, 20 bp, human
gggtatggatgctcctgagg

SEQ ID NO: 185565 - DNA, 20 bp, human
gggcctcaggaatgggagga

SEQ ID NO: 185566 - DNA, 20 bp, human
gctaatagtagctcctactc

SEQ ID NO: 185567 - DNA, 20 bp, human
gattttctgagttttaaaaa

SEQ ID NO: 185568 - DNA, 20 bp, human
gcagttgcaaagctactctg

SEQ ID NO: 185569 - DNA, 20 bp, human
ggagtctcacagtgcagtgc

SEQ ID NO: 185570 - DNA, 20 bp, human
gatcagatgaattcagctca

SEQ ID NO: 185571 - DNA, 20 bp, human
ggtgcagtgctggtagcttt

SEQ ID NO: 185572 - DNA, 20 bp, human
gctgattcgacggcaagctt

SEQ ID NO: 185573 - DNA, 20 bp, human
gctctggagaagaatgagct

SEQ ID NO: 185574 - DNA, 20 bp, human
gaaagctactctgtgggctc

SEQ ID NO: 185575 - DNA, 20 bp, human
gctgaattcatctgattcga

SEQ ID NO: 185576 - DNA, 20 bp, human
gccgccatgccgaggcgcac

SEQ ID NO: 185577 - DNA, 20 bp, human
ggcgcggcagaggaagcgca

SEQ ID NO: 185578 - DNA, 20 bp, human
gatctggccgaatacgtcca

SEQ ID NO: 185579 - DNA, 20 bp, human
gtcgaggaactgcctcacga

SEQ ID NO: 185580 - DNA, 20 bp, human
ggcgccggaagtgccttgcg

SEQ ID NO: 185581 - DNA, 20 bp, human
gcccgccagctgacggagag

SEQ ID NO: 185582 - DNA, 20 bp, human
ggaagaagcggaggtcaagg

SEQ ID NO: 185583 - DNA, 20 bp, human
gcaggccgagccggcggaaa

SEQ ID NO: 185584 - DNA, 20 bp, human
gaggaagtgtgccgagaatg

SEQ ID NO: 185585 - DNA, 20 bp, human
gtgggagccgtggacgtatt

SEQ ID NO: 185586 - DNA, 20 bp, human
gacaccgagaagcccgccgg

SEQ ID NO: 185587 - DNA, 20 bp, human
ggagggagcgagaggtgcag

SEQ ID NO: 185588 - DNA, 20 bp, human
gaaaggcgcgcgccgggtga

SEQ ID NO: 185589 - DNA, 20 bp, human
ggaacttgaacagagaccat

SEQ ID NO: 185590 - DNA, 20 bp, human
gaagggcagacgggaagacg

SEQ ID NO: 185591 - DNA, 20 bp, human
gtgagggaattgcaagccgc

SEQ ID NO: 185592 - DNA, 20 bp, human
ggccctcctgagtagatctg

SEQ ID NO: 185593 - DNA, 20 bp, human
gggcttgcaattccctcacc

SEQ ID NO: 185594 - DNA, 20 bp, human
gggaattgcaagccgccggc

SEQ ID NO: 185595 - DNA, 20 bp, human
ggaagacgaggcgtcctcga

SEQ ID NO: 185596 - DNA, 20 bp, human
ggcgcagctgacacaaagga

SEQ ID NO: 185597 - DNA, 20 bp, human
gcagcccagacgcagcgggt

SEQ ID NO: 185598 - DNA, 20 bp, human
ggatgctgggatgtagacag

SEQ ID NO: 185599 - DNA, 20 bp, human
gtggctatcgggaggaatca

SEQ ID NO: 185600 - DNA, 20 bp, human
gaggggcgcagctgacacaa

SEQ ID NO: 185601 - DNA, 20 bp, human
gtcgcagccatcccggtcag

SEQ ID NO: 185602 - DNA, 20 bp, human
gcgcagcgcaacccggtcag

SEQ ID NO: 185603 - DNA, 20 bp, human
gggaccaaggtgaggtgtgg

SEQ ID NO: 185604 - DNA, 20 bp, human
gggcctccagcagtgcaccg

SEQ ID NO: 185605 - DNA, 20 bp, human
ggctgcgaagagagggacca

SEQ ID NO: 185606 - DNA, 20 bp, human
ggcggccgcggagtcatgga

SEQ ID NO: 185607 - DNA, 20 bp, human
gcaggccggagcacaatcgg

SEQ ID NO: 185608 - DNA, 20 bp, human
gcaatcggcggcgccctggg

SEQ ID NO: 185609 - DNA, 20 bp, human
ggcgtcaccggctcccggag

SEQ ID NO: 185610 - DNA, 20 bp, human
gctgggcggccgcggagtca

SEQ ID NO: 185611 - DNA, 20 bp, human
gagggcggcagagggcgacc

SEQ ID NO: 185612 - DNA, 20 bp, human
ggcggagtcatggacggcag

SEQ ID NO: 185613 - DNA, 20 bp, human
gaggtgcgcggggcaaaagg

SEQ ID NO: 185614 - DNA, 20 bp, human
gggcacgcgtcgcagcgcac

SEQ ID NO: 185615 - DNA, 20 bp, human
ggcacaatcggcggcgccct

SEQ ID NO: 185616 - DNA, 20 bp, human
gttggtttaaagtcaatagg

SEQ ID NO: 185617 - DNA, 20 bp, human
gtaagcaaatgtgagatcct

SEQ ID NO: 185618 - DNA, 20 bp, human
gactgggatccagccagcgg

SEQ ID NO: 185619 - DNA, 20 bp, human
gatcctgggtacagtccatc

SEQ ID NO: 185620 - DNA, 20 bp, human
gatcagacccaggtctgtcc

SEQ ID NO: 185621 - DNA, 20 bp, human
gatataacaacaaaaagact

SEQ ID NO: 185622 - DNA, 20 bp, human
gacttgacttacccaattgt

SEQ ID NO: 185623 - DNA, 20 bp, human
ggctttgattcatgaccact

SEQ ID NO: 185624 - DNA, 20 bp, human
gcaatggtccagaagactta

SEQ ID NO: 185625 - DNA, 20 bp, human
gaggaaaagaaatcccccgc

SEQ ID NO: 185626 - DNA, 20 bp, human
gagcgggggatttcttttcc

SEQ ID NO: 185627 - DNA, 20 bp, human
gcttgacttacccaattgtg

SEQ ID NO: 185628 - DNA, 20 bp, human
gatcctgggtacagtccacc

SEQ ID NO: 185629 - DNA, 20 bp, human
ggggggatttcttttcctgg

SEQ ID NO: 185630 - DNA, 20 bp, human
gtaagcaaatgtgagatcct

SEQ ID NO: 185631 - DNA, 20 bp, human
gactgggatccagccagcgg

SEQ ID NO: 185632 - DNA, 20 bp, human
gttggtttaaagtcaatagg

SEQ ID NO: 185633 - DNA, 20 bp, human
gatcagacccaggtctgtcc

SEQ ID NO: 185634 - DNA, 20 bp, human
gcaatggtccagaagactta

SEQ ID NO: 185635 - DNA, 20 bp, human
gatataacaacaaaaagact

SEQ ID NO: 185636 - DNA, 20 bp, human
gtcagctggctggatcccaa

SEQ ID NO: 185637 - DNA, 20 bp, human
gtggctggatcccaatggtc

SEQ ID NO: 185638 - DNA, 20 bp, human
gttggtccaaagtcattagg

SEQ ID NO: 185639 - DNA, 20 bp, human
ggtcagccctatgtctgtca

SEQ ID NO: 185640 - DNA, 20 bp, human
gagttgccccctaatgactt

SEQ ID NO: 185641 - DNA, 20 bp, human
gagctttgaatcctgaccat

SEQ ID NO: 185642 - DNA, 20 bp, human
ggctttggtccaaagtcatt

SEQ ID NO: 185643 - DNA, 20 bp, human
ggcccatcaactgtggaaac

SEQ ID NO: 185644 - DNA, 20 bp, human
gttgaaccttgacagacata

SEQ ID NO: 185645 - DNA, 20 bp, human
gatccctgttaaagtcagtt

SEQ ID NO: 185646 - DNA, 20 bp, human
gagacaggccagggaagacg

SEQ ID NO: 185647 - DNA, 20 bp, human
ggcagatcaggcccgtggat

SEQ ID NO: 185648 - DNA, 20 bp, human
gaaaagtatagagtagggag

SEQ ID NO: 185649 - DNA, 20 bp, human
gtatctgaaaagctgtgcgg

SEQ ID NO: 185650 - DNA, 20 bp, human
ggggagagctttaaagtgaa

SEQ ID NO: 185651 - DNA, 20 bp, human
gggcaggcagatttgaaaga

SEQ ID NO: 185652 - DNA, 20 bp, human
ggaagggctttgtttcccga

SEQ ID NO: 185653 - DNA, 20 bp, human
gggcagaagtaggaagtctt

SEQ ID NO: 185654 - DNA, 20 bp, human
gggccagggaagacgtggtt

SEQ ID NO: 185655 - DNA, 20 bp, human
ggacagctgtcacaccatga

SEQ ID NO: 185656 - DNA, 20 bp, human
ggatgaggcacggacgtggg

SEQ ID NO: 185657 - DNA, 20 bp, human
gtgcgggtcatgatgaggca

SEQ ID NO: 185658 - DNA, 20 bp, human
gcatgatgaggcacggacgt

SEQ ID NO: 185659 - DNA, 20 bp, human
gcatcatgacccgcacgcta

SEQ ID NO: 185660 - DNA, 20 bp, human
gcgcgcggtagcgcgaggcg

SEQ ID NO: 185661 - DNA, 20 bp, human
ggagcatgatggggcacgcg

SEQ ID NO: 185662 - DNA, 20 bp, human
ggggcacgcgcggtagcgcg

SEQ ID NO: 185663 - DNA, 20 bp, human
gggcatgtaaccatagcgtg

SEQ ID NO: 185664 - DNA, 20 bp, human
gtggggcatgatgagacaca

SEQ ID NO: 185665 - DNA, 20 bp, human
ggacacatggcgaggccatc

SEQ ID NO: 185666 - DNA, 20 bp, human
ggacatgaggttatgacatg

SEQ ID NO: 185667 - DNA, 20 bp, human
gtgtatgcatcatgggtata

SEQ ID NO: 185668 - DNA, 20 bp, human
gatagatttgtatgcatcat

SEQ ID NO: 185669 - DNA, 20 bp, human
gggaatgagctcctgatctt

SEQ ID NO: 185670 - DNA, 20 bp, human
gctgcagagttgactttcag

SEQ ID NO: 185671 - DNA, 20 bp, human
ggtactgcatgtactaatat

SEQ ID NO: 185672 - DNA, 20 bp, human
gagaagttgcactcacccca

SEQ ID NO: 185673 - DNA, 20 bp, human
gttaagtactccccaagatc

SEQ ID NO: 185674 - DNA, 20 bp, human
gaaacattcatagaaccttg

SEQ ID NO: 185675 - DNA, 20 bp, human
gacacttaattaagtaaaaa

SEQ ID NO: 185676 - DNA, 20 bp, human
gaggcggacgccgcagtgta

SEQ ID NO: 185677 - DNA, 20 bp, human
gcagggtgtgccctacactg

SEQ ID NO: 185678 - DNA, 20 bp, human
gcagctgggtcacacaccct

SEQ ID NO: 185679 - DNA, 20 bp, human
gccagcggctgcatctgagg

SEQ ID NO: 185680 - DNA, 20 bp, human
gtagccagcggctgcatctg

SEQ ID NO: 185681 - DNA, 20 bp, human
gcacgtctctcgctaccctc

SEQ ID NO: 185682 - DNA, 20 bp, human
ggacgaggaggaccagaacg

SEQ ID NO: 185683 - DNA, 20 bp, human
ggccccgaggaagaagagca

SEQ ID NO: 185684 - DNA, 20 bp, human
gacccagctgtggagtaagg

SEQ ID NO: 185685 - DNA, 20 bp, human
gccgctggctaccctgcccg

SEQ ID NO: 185686 - DNA, 20 bp, human
gcccacctggaagacgtcgt

SEQ ID NO: 185687 - DNA, 20 bp, human
gtaagcgaggaagggtctac

SEQ ID NO: 185688 - DNA, 20 bp, human
gtttgcggcacaggttgtgt

SEQ ID NO: 185689 - DNA, 20 bp, human
gcaggtgggtgccagggacg

SEQ ID NO: 185690 - DNA, 20 bp, human
gtctgctctctggggagtaa

SEQ ID NO: 185691 - DNA, 20 bp, human
ggccaggcacgaccaccgag

SEQ ID NO: 185692 - DNA, 20 bp, human
ggaacaagagagagtcattt

SEQ ID NO: 185693 - DNA, 20 bp, human
ggacgtcgttggcacatttg

SEQ ID NO: 185694 - DNA, 20 bp, human
gaactacgtgagcctggcga

SEQ ID NO: 185695 - DNA, 20 bp, human
gtgtgtgcatcccctagcag

SEQ ID NO: 185696 - DNA, 20 bp, human
ggtccatataagccagtgac

SEQ ID NO: 185697 - DNA, 20 bp, human
gaggacattgtttcaggccc

SEQ ID NO: 185698 - DNA, 20 bp, human
gtccaccgagagaaacgtaa

SEQ ID NO: 185699 - DNA, 20 bp, human
gcagcacccactccaaacca

SEQ ID NO: 185700 - DNA, 20 bp, human
gtcctttacgtttctctcgg

SEQ ID NO: 185701 - DNA, 20 bp, human
ggcacttgattccaagagga

SEQ ID NO: 185702 - DNA, 20 bp, human
ggtgtcctttacgtttctct

SEQ ID NO: 185703 - DNA, 20 bp, human
gcagggaagggtgctgcgag

SEQ ID NO: 185704 - DNA, 20 bp, human
gacacaggttgtgctgacaa

SEQ ID NO: 185705 - DNA, 20 bp, human
gtcaggccctggtttggagt

SEQ ID NO: 185706 - DNA, 20 bp, human
gcgggactccctccctccag

SEQ ID NO: 185707 - DNA, 20 bp, human
gtagaggtcaagatcagctc

SEQ ID NO: 185708 - DNA, 20 bp, human
gtccaggcacccagcaacgg

SEQ ID NO: 185709 - DNA, 20 bp, human
ggcgtgaagaggcacccgga

SEQ ID NO: 185710 - DNA, 20 bp, human
gtcccgagctcctggcacag

SEQ ID NO: 185711 - DNA, 20 bp, human
gccaaggccaagtctatcag

SEQ ID NO: 185712 - DNA, 20 bp, human
gttttccaggcacccagcaa

SEQ ID NO: 185713 - DNA, 20 bp, human
gggaggagacctcagagagt

SEQ ID NO: 185714 - DNA, 20 bp, human
gtgacctctaggatggtgag

SEQ ID NO: 185715 - DNA, 20 bp, human
gctgtggccacggagcggga

SEQ ID NO: 185716 - DNA, 20 bp, human
ggggagcgcagccctccggg

SEQ ID NO: 185717 - DNA, 20 bp, human
ggccatgacccgcctcccgg

SEQ ID NO: 185718 - DNA, 20 bp, human
ggccgggagcgcagccctcc

SEQ ID NO: 185719 - DNA, 20 bp, human
gcgccggcagctaccaggtg

SEQ ID NO: 185720 - DNA, 20 bp, human
gcgcgcagccgctccccggg

SEQ ID NO: 185721 - DNA, 20 bp, human
ggagcacaggacgcaccgca

SEQ ID NO: 185722 - DNA, 20 bp, human
ggagccgctcaggagacggg

SEQ ID NO: 185723 - DNA, 20 bp, human
gctcctgcagcggcgccgtg

SEQ ID NO: 185724 - DNA, 20 bp, human
gtaccaggtgaggcgccccc

SEQ ID NO: 185725 - DNA, 20 bp, human
gaggccacccgtctcctgag

SEQ ID NO: 185726 - DNA, 20 bp, human
gcagcgccacgagctccagg

SEQ ID NO: 185727 - DNA, 20 bp, human
ggcgagcacctcccacaaag

SEQ ID NO: 185728 - DNA, 20 bp, human
gactcaccgcggggaggaag

SEQ ID NO: 185729 - DNA, 20 bp, human
gggctccccaaactccagta

SEQ ID NO: 185730 - DNA, 20 bp, human
gcgcggggaggaagcggacc

SEQ ID NO: 185731 - DNA, 20 bp, human
gccttagactcaccgcgggg

SEQ ID NO: 185732 - DNA, 20 bp, human
gcgcgttaggagggaggcct

SEQ ID NO: 185733 - DNA, 20 bp, human
gaacgcagctccacagtgga

SEQ ID NO: 185734 - DNA, 20 bp, human
gtgctcgcaggacttaagtg

SEQ ID NO: 185735 - DNA, 20 bp, human
gaaggtccttagactcaccg

SEQ ID NO: 185736 - DNA, 20 bp, human
gcaggccgaaagactcaggg

SEQ ID NO: 185737 - DNA, 20 bp, human
gtcggcctgggtggaggacg

SEQ ID NO: 185738 - DNA, 20 bp, human
gccgcaaactcctgacctgt

SEQ ID NO: 185739 - DNA, 20 bp, human
gtgtgggtccgtccgttcaa

SEQ ID NO: 185740 - DNA, 20 bp, human
gacggacggacccacaggtc

SEQ ID NO: 185741 - DNA, 20 bp, human
gagctcttcagagcaatcca

SEQ ID NO: 185742 - DNA, 20 bp, human
gccagatgtgcgggtcagag

SEQ ID NO: 185743 - DNA, 20 bp, human
gacccaggccgaaagactca

SEQ ID NO: 185744 - DNA, 20 bp, human
gctcactaacctggaatctg

SEQ ID NO: 185745 - DNA, 20 bp, human
gtaagagccagtcaacagaa

SEQ ID NO: 185746 - DNA, 20 bp, human
gagctcttcagagcaatcca

SEQ ID NO: 185747 - DNA, 20 bp, human
gtgtgggtccgtccgttcaa

SEQ ID NO: 185748 - DNA, 20 bp, human
gccgcaaactcctgacctgt

SEQ ID NO: 185749 - DNA, 20 bp, human
gccagatgtgcgggtcagag

SEQ ID NO: 185750 - DNA, 20 bp, human
gacggacggacccacaggtc

SEQ ID NO: 185751 - DNA, 20 bp, human
gtaagagccagtcaacagaa

SEQ ID NO: 185752 - DNA, 20 bp, human
gtgcctttctcggaacggaa

SEQ ID NO: 185753 - DNA, 20 bp, human
gctccgttccgttccgagaa

SEQ ID NO: 185754 - DNA, 20 bp, human
gcagggcagtgaaagagata

SEQ ID NO: 185755 - DNA, 20 bp, human
gccgttcaacggccaaaggc

SEQ ID NO: 185756 - DNA, 20 bp, human
gcctggagcagttggaccgg

SEQ ID NO: 185757 - DNA, 20 bp, human
gtgatgctgtgcaggaccca

SEQ ID NO: 185758 - DNA, 20 bp, human
gttacctggagcagttggac

SEQ ID NO: 185759 - DNA, 20 bp, human
gcaggacccatggaaccccg

SEQ ID NO: 185760 - DNA, 20 bp, human
gaggcgcccagggttgtgtg

SEQ ID NO: 185761 - DNA, 20 bp, human
gcacgactgagctcagactg

SEQ ID NO: 185762 - DNA, 20 bp, human
gccgcggcgaaaacagaatc

SEQ ID NO: 185763 - DNA, 20 bp, human
gtcgaaaaccaaggcgccca

SEQ ID NO: 185764 - DNA, 20 bp, human
ggcgccccgcggggttccat

SEQ ID NO: 185765 - DNA, 20 bp, human
ggcgggaggcttacttaact

SEQ ID NO: 185766 - DNA, 20 bp, human
gggaagcagcccacttggtg

SEQ ID NO: 185767 - DNA, 20 bp, human
gtcgagggtgcagacgacgt

SEQ ID NO: 185768 - DNA, 20 bp, human
gtaccccaaccccaccaagt

SEQ ID NO: 185769 - DNA, 20 bp, human
ggacccaccgagcccccgcg

SEQ ID NO: 185770 - DNA, 20 bp, human
gaggaggcttaactggacag

SEQ ID NO: 185771 - DNA, 20 bp, human
gactaaggagatccagtcgt

SEQ ID NO: 185772 - DNA, 20 bp, human
ggggagttaagggagcgaag

SEQ ID NO: 185773 - DNA, 20 bp, human
gaggctggtgggttctcaac

SEQ ID NO: 185774 - DNA, 20 bp, human
ggcagacgacgtaggctggt

SEQ ID NO: 185775 - DNA, 20 bp, human
gtgggcaggcagcgacccgg

SEQ ID NO: 185776 - DNA, 20 bp, human
gaggctgcgctggaccgaag

SEQ ID NO: 185777 - DNA, 20 bp, human
gagggcagtctagaggtagt

SEQ ID NO: 185778 - DNA, 20 bp, human
gctgcgctggaccgaagcgg

SEQ ID NO: 185779 - DNA, 20 bp, human
gtgcgcggctgagactccgt

SEQ ID NO: 185780 - DNA, 20 bp, human
ggagctaccggagaagggag

SEQ ID NO: 185781 - DNA, 20 bp, human
ggcccgggagggcagtctag

SEQ ID NO: 185782 - DNA, 20 bp, human
gcggctggttccgggttgag

SEQ ID NO: 185783 - DNA, 20 bp, human
gccagcgcagcctctcaacc

SEQ ID NO: 185784 - DNA, 20 bp, human
gggagggtaacgcgaggaag

SEQ ID NO: 185785 - DNA, 20 bp, human
gggtaggagctaccggagaa

SEQ ID NO: 185786 - DNA, 20 bp, human
gctgcagaggcctctggaca

SEQ ID NO: 185787 - DNA, 20 bp, human
gacaccgggtcggatcctgt

SEQ ID NO: 185788 - DNA, 20 bp, human
gttgctctaagtagacctgg

SEQ ID NO: 185789 - DNA, 20 bp, human
gaagccaacaggatccgacc

SEQ ID NO: 185790 - DNA, 20 bp, human
ggaagccaagtagccacctg

SEQ ID NO: 185791 - DNA, 20 bp, human
gggcacggcaagatgaccac

SEQ ID NO: 185792 - DNA, 20 bp, human
gttgtcacaaaacaccgggt

SEQ ID NO: 185793 - DNA, 20 bp, human
gtgtccaggttggaagtcta

SEQ ID NO: 185794 - DNA, 20 bp, human
ggcaggggttcacttccaag

SEQ ID NO: 185795 - DNA, 20 bp, human
gagagcaaagttagtagagg

SEQ ID NO: 185796 - DNA, 20 bp, human
gcagcagcgcccgctcgtgg

SEQ ID NO: 185797 - DNA, 20 bp, human
gcacacagcggccctcggtc

SEQ ID NO: 185798 - DNA, 20 bp, human
ggccgcaacgtggccctcag

SEQ ID NO: 185799 - DNA, 20 bp, human
ggcccgcaggagtcacccgg

SEQ ID NO: 185800 - DNA, 20 bp, human
gtccggcagaagagctccag

SEQ ID NO: 185801 - DNA, 20 bp, human
gaaagggctcccggcactcg

SEQ ID NO: 185802 - DNA, 20 bp, human
gcgagagccaggcgggcccc

SEQ ID NO: 185803 - DNA, 20 bp, human
ggagtgtcgcctccacgagc

SEQ ID NO: 185804 - DNA, 20 bp, human
gagctcttctgccggaccga

SEQ ID NO: 185805 - DNA, 20 bp, human
ggctcggcgccgtcgggaaa

SEQ ID NO: 185806 - DNA, 20 bp, human
gcaggagcaggtgagtatgt

SEQ ID NO: 185807 - DNA, 20 bp, human
ggctggaacctgccccgatc

SEQ ID NO: 185808 - DNA, 20 bp, human
gactgtgacgtcacaggata

SEQ ID NO: 185809 - DNA, 20 bp, human
gtaaatgagctgccggatcg

SEQ ID NO: 185810 - DNA, 20 bp, human
gataaggacttcaggtgaag

SEQ ID NO: 185811 - DNA, 20 bp, human
gtaacaggctcacgcagcag

SEQ ID NO: 185812 - DNA, 20 bp, human
ggacggacaattggtcacta

SEQ ID NO: 185813 - DNA, 20 bp, human
gatgcccccggcactgaagg

SEQ ID NO: 185814 - DNA, 20 bp, human
gtccatgcccccggcactga

SEQ ID NO: 185815 - DNA, 20 bp, human
ggtcacaggataaggacttc

SEQ ID NO: 185816 - DNA, 20 bp, human
gtcttcctccatcgcggcgc

SEQ ID NO: 185817 - DNA, 20 bp, human
gccacagccgcccaggagta

SEQ ID NO: 185818 - DNA, 20 bp, human
gctctccaccccaggaccag

SEQ ID NO: 185819 - DNA, 20 bp, human
gggtgatagcgaggtgagac

SEQ ID NO: 185820 - DNA, 20 bp, human
gtcctcgcaggccaccgcga

SEQ ID NO: 185821 - DNA, 20 bp, human
gcaccgcgagggcagccgac

SEQ ID NO: 185822 - DNA, 20 bp, human
gcccgagggtcccgcaccag

SEQ ID NO: 185823 - DNA, 20 bp, human
gcggagggcgagcgtccggc

SEQ ID NO: 185824 - DNA, 20 bp, human
gccggcccaactccttatcg

SEQ ID NO: 185825 - DNA, 20 bp, human
gggctgggatcagcaccacg

SEQ ID NO: 185826 - DNA, 20 bp, human
gtctcgctgtaccctacgga

SEQ ID NO: 185827 - DNA, 20 bp, human
gctgggcctctgccgctctc

SEQ ID NO: 185828 - DNA, 20 bp, human
gcgggatctgacttcagaaa

SEQ ID NO: 185829 - DNA, 20 bp, human
gcccagcgggaagggagtcg

SEQ ID NO: 185830 - DNA, 20 bp, human
ggcggtaacctccggagtca

SEQ ID NO: 185831 - DNA, 20 bp, human
ggtacagcgagagtctgaga

SEQ ID NO: 185832 - DNA, 20 bp, human
gtttgactgtgccttccgta

SEQ ID NO: 185833 - DNA, 20 bp, human
gcgtcagaagctgccgttcc

SEQ ID NO: 185834 - DNA, 20 bp, human
gaggtccccaggacagcggg

SEQ ID NO: 185835 - DNA, 20 bp, human
ggttaggaccccagcgggaa

SEQ ID NO: 185836 - DNA, 20 bp, human
gaccgggcggccgcaggcca

SEQ ID NO: 185837 - DNA, 20 bp, human
ggatggagctggaaagtgat

SEQ ID NO: 185838 - DNA, 20 bp, human
ggagccctcggaaggaacct

SEQ ID NO: 185839 - DNA, 20 bp, human
gacgggcggaccccagagaa

SEQ ID NO: 185840 - DNA, 20 bp, human
gggagaagcaggtgtctgtg

SEQ ID NO: 185841 - DNA, 20 bp, human
gagtaggccggtgcatgcag

SEQ ID NO: 185842 - DNA, 20 bp, human
gtattcagcgatgagagagt

SEQ ID NO: 185843 - DNA, 20 bp, human
gaggagaaggtactcgacga

SEQ ID NO: 185844 - DNA, 20 bp, human
gactaccgggcaggactggg

SEQ ID NO: 185845 - DNA, 20 bp, human
gagtcgagaatagcgatccg

SEQ ID NO: 185846 - DNA, 20 bp, human
gcccaggcgcgaccagatct

SEQ ID NO: 185847 - DNA, 20 bp, human
gctctccgcgcacccagatc

SEQ ID NO: 185848 - DNA, 20 bp, human
gtgagacccgtgctctcccg

SEQ ID NO: 185849 - DNA, 20 bp, human
gtgaggtccagtggccgccc

SEQ ID NO: 185850 - DNA, 20 bp, human
gcgcgtcctgtgaggtccag

SEQ ID NO: 185851 - DNA, 20 bp, human
gcagtcagctgcggcccaac

SEQ ID NO: 185852 - DNA, 20 bp, human
gggagagcacgggtctcagg

SEQ ID NO: 185853 - DNA, 20 bp, human
ggccgagggcccactgggag

SEQ ID NO: 185854 - DNA, 20 bp, human
gcggctgccccgggagagca

SEQ ID NO: 185855 - DNA, 20 bp, human
gagctctactgccaggacga

SEQ ID NO: 185856 - DNA, 20 bp, human
gcatttgcaacccagcccgg

SEQ ID NO: 185857 - DNA, 20 bp, human
gcggcgcgcccgttcttggg

SEQ ID NO: 185858 - DNA, 20 bp, human
gttgcaacccagcccggagg

SEQ ID NO: 185859 - DNA, 20 bp, human
gacgagccgccgcccaagaa

SEQ ID NO: 185860 - DNA, 20 bp, human
ggatctggaaatcggtctcg

SEQ ID NO: 185861 - DNA, 20 bp, human
gtaagcaggaaggcggacga

SEQ ID NO: 185862 - DNA, 20 bp, human
gagcaacctgctcgacgcgg

SEQ ID NO: 185863 - DNA, 20 bp, human
gggcagaaggcgtgcaggca

SEQ ID NO: 185864 - DNA, 20 bp, human
gcgccggcgcgcccgttctt

SEQ ID NO: 185865 - DNA, 20 bp, human
ggtggtgccggtggttgctg

SEQ ID NO: 185866 - DNA, 20 bp, human
gcaggctccaagcaaggaca

SEQ ID NO: 185867 - DNA, 20 bp, human
gccatccagtgtaggatgtg

SEQ ID NO: 185868 - DNA, 20 bp, human
gctcgaaggaggaccggtca

SEQ ID NO: 185869 - DNA, 20 bp, human
ggcaaggacagggactcaca

SEQ ID NO: 185870 - DNA, 20 bp, human
gggtccgggactaaggtcag

SEQ ID NO: 185871 - DNA, 20 bp, human
gtgggactctgacggccaag

SEQ ID NO: 185872 - DNA, 20 bp, human
gctgacggccaaggggaaag

SEQ ID NO: 185873 - DNA, 20 bp, human
ggaactggggttgactgata

SEQ ID NO: 185874 - DNA, 20 bp, human
ggagctgagaattgcagtgg

SEQ ID NO: 185875 - DNA, 20 bp, human
gtaggatgtgaggtctttac

SEQ ID NO: 185876 - DNA, 20 bp, human
gtgtgcgggagcgccaggcg

SEQ ID NO: 185877 - DNA, 20 bp, human
ggatggggcacggacatggg

SEQ ID NO: 185878 - DNA, 20 bp, human
gagagcgtgcggggcatgat

SEQ ID NO: 185879 - DNA, 20 bp, human
ggagcatgatggggcatgtg

SEQ ID NO: 185880 - DNA, 20 bp, human
ggcatgatggggcacggaca

SEQ ID NO: 185881 - DNA, 20 bp, human
gcatgtaaccagagcgtgcg

SEQ ID NO: 185882 - DNA, 20 bp, human
ggggcatgtgcgggagcgcc

SEQ ID NO: 185883 - DNA, 20 bp, human
ggggagcgcgtggggcatga

SEQ ID NO: 185884 - DNA, 20 bp, human
ggagcgagcgggaaatgatg

SEQ ID NO: 185885 - DNA, 20 bp, human
gcttgaaggagccctcggag

SEQ ID NO: 185886 - DNA, 20 bp, human
gcccaggccagggagacgtt

SEQ ID NO: 185887 - DNA, 20 bp, human
gcctgctggagctggaggac

SEQ ID NO: 185888 - DNA, 20 bp, human
gctgcagccgcatgaaggtg

SEQ ID NO: 185889 - DNA, 20 bp, human
gttcatgcggctgcagacgg

SEQ ID NO: 185890 - DNA, 20 bp, human
gggactccttgaagacctcc

SEQ ID NO: 185891 - DNA, 20 bp, human
ggctctctggcgctatcaac

SEQ ID NO: 185892 - DNA, 20 bp, human
gggagcccagcagaccgcag

SEQ ID NO: 185893 - DNA, 20 bp, human
ggtggtaggacagggaaacc

SEQ ID NO: 185894 - DNA, 20 bp, human
gtcagcccgggcagtgagtg

SEQ ID NO: 185895 - DNA, 20 bp, human
gggtggtgcacgcagacctt

SEQ ID NO: 185896 - DNA, 20 bp, human
gcccagcgagagcccgacat

SEQ ID NO: 185897 - DNA, 20 bp, human
gtgctggcttgaggctgtag

SEQ ID NO: 185898 - DNA, 20 bp, human
gtggcttctcacaatccgct

SEQ ID NO: 185899 - DNA, 20 bp, human
gtccaatgtcgggctctcgc

SEQ ID NO: 185900 - DNA, 20 bp, human
gggctctcgctgggggcttc

SEQ ID NO: 185901 - DNA, 20 bp, human
gcaggcacagagtcagaagt

SEQ ID NO: 185902 - DNA, 20 bp, human
gtaggtccggatgcatgctg

SEQ ID NO: 185903 - DNA, 20 bp, human
gagcctcaagccagcatcac

SEQ ID NO: 185904 - DNA, 20 bp, human
ggaactgaacagcaaaacct

SEQ ID NO: 185905 - DNA, 20 bp, human
ggggagcaggtgggagatca

SEQ ID NO: 185906 - DNA, 20 bp, human
ggatggggcacggacatggg

SEQ ID NO: 185907 - DNA, 20 bp, human
gtgtgcgggagcgccaggcg

SEQ ID NO: 185908 - DNA, 20 bp, human
gagagcgtgcggggcatgat

SEQ ID NO: 185909 - DNA, 20 bp, human
ggagcatgatggggcatgtg

SEQ ID NO: 185910 - DNA, 20 bp, human
ggcatgatggggcacggaca

SEQ ID NO: 185911 - DNA, 20 bp, human
gcatgtaaccagagcgtgcg

SEQ ID NO: 185912 - DNA, 20 bp, human
ggggcatgtgcgggagcgcc

SEQ ID NO: 185913 - DNA, 20 bp, human
ggggagcgcgtggggcatga

SEQ ID NO: 185914 - DNA, 20 bp, human
ggagcgagcgggaaatgatg

SEQ ID NO: 185915 - DNA, 20 bp, human
gcttgaaggagccctcggag

SEQ ID NO: 185916 - DNA, 20 bp, human
ggctggcttgaggccatagt

SEQ ID NO: 185917 - DNA, 20 bp, human
gggcttgaggccatagtggg

SEQ ID NO: 185918 - DNA, 20 bp, human
gcagtggatcctgagaagct

SEQ ID NO: 185919 - DNA, 20 bp, human
gttggaatacctagcttctc

SEQ ID NO: 185920 - DNA, 20 bp, human
gtccactgggcctcccacta

SEQ ID NO: 185921 - DNA, 20 bp, human
gcccagcgagagcccgacat

SEQ ID NO: 185922 - DNA, 20 bp, human
gtccaatgtcgggctctcgc

SEQ ID NO: 185923 - DNA, 20 bp, human
gggctctcgctgggggcttc

SEQ ID NO: 185924 - DNA, 20 bp, human
gggcctcaagccagcatcac

SEQ ID NO: 185925 - DNA, 20 bp, human
gcaggcacagagtcagaagt

SEQ ID NO: 185926 - DNA, 20 bp, human
gaatctgtgcccacaacaaa

SEQ ID NO: 185927 - DNA, 20 bp, human
gccctgtcaccatttgttgt

SEQ ID NO: 185928 - DNA, 20 bp, human
gtgatatttccctgcacaca

SEQ ID NO: 185929 - DNA, 20 bp, human
gcagagcttgataactggca

SEQ ID NO: 185930 - DNA, 20 bp, human
ggcccacaacaaatggtgac

SEQ ID NO: 185931 - DNA, 20 bp, human
gaattgctgccctgtgtgca

SEQ ID NO: 185932 - DNA, 20 bp, human
gaaacactatatgacaaggg

SEQ ID NO: 185933 - DNA, 20 bp, human
gctgatctgtaggagacacc

SEQ ID NO: 185934 - DNA, 20 bp, human
gatcgagcaggtgagctcac

SEQ ID NO: 185935 - DNA, 20 bp, human
ggaggctgatgaatactata

SEQ ID NO: 185936 - DNA, 20 bp, human
ggggctcggtgggcctacag

SEQ ID NO: 185937 - DNA, 20 bp, human
ggctgactgagcgaccgtcg

SEQ ID NO: 185938 - DNA, 20 bp, human
gcacgtggagaagccgccgg

SEQ ID NO: 185939 - DNA, 20 bp, human
ggtgcgacgtggagatccga

SEQ ID NO: 185940 - DNA, 20 bp, human
ggtccgtccggagccgctgt

SEQ ID NO: 185941 - DNA, 20 bp, human
gatcatgtcagccacagcag

SEQ ID NO: 185942 - DNA, 20 bp, human
gctgcacgtggagaagccgc

SEQ ID NO: 185943 - DNA, 20 bp, human
gggctccggacggacccccg

SEQ ID NO: 185944 - DNA, 20 bp, human
gtcgcagtggtagaggcggt

SEQ ID NO: 185945 - DNA, 20 bp, human
gcgcagtgcagcgccgccgg

SEQ ID NO: 185946 - DNA, 20 bp, human
gctggcacggacacccagag

SEQ ID NO: 185947 - DNA, 20 bp, human
ggcgctggcgaaccccccgt

SEQ ID NO: 185948 - DNA, 20 bp, human
gtatacagcgaggcggacag

SEQ ID NO: 185949 - DNA, 20 bp, human
ggtgccagtgctgcgcggga

SEQ ID NO: 185950 - DNA, 20 bp, human
gcggctatggctcctacggg

SEQ ID NO: 185951 - DNA, 20 bp, human
ggccagggccggtgacaagt

SEQ ID NO: 185952 - DNA, 20 bp, human
gcagcggctatggctcctac

SEQ ID NO: 185953 - DNA, 20 bp, human
gggactaggagggcaggtag

SEQ ID NO: 185954 - DNA, 20 bp, human
gatgagcctatacagcgagg

SEQ ID NO: 185955 - DNA, 20 bp, human
gacagagctagcgcctctct

SEQ ID NO: 185956 - DNA, 20 bp, human
gacatccctggaagaaactg

SEQ ID NO: 185957 - DNA, 20 bp, human
gagtgagaggagccctggaa

SEQ ID NO: 185958 - DNA, 20 bp, human
gctcctgcaagagagcagag

SEQ ID NO: 185959 - DNA, 20 bp, human
gcatgaagcacaccatgagt

SEQ ID NO: 185960 - DNA, 20 bp, human
ggcgtccccagtttcttcca

SEQ ID NO: 185961 - DNA, 20 bp, human
gagcagagaggttcactcct

SEQ ID NO: 185962 - DNA, 20 bp, human
gctcttgcttcagtgtccag

SEQ ID NO: 185963 - DNA, 20 bp, human
gtgagtctgtgccgcatcac

SEQ ID NO: 185964 - DNA, 20 bp, human
gtgccgcatcacgggaatga

SEQ ID NO: 185965 - DNA, 20 bp, human
gagactcagctctgtggtgg

SEQ ID NO: 185966 - DNA, 20 bp, human
gtgcagagcgaggatgagca

SEQ ID NO: 185967 - DNA, 20 bp, human
gtctccgatgacgagcaggg

SEQ ID NO: 185968 - DNA, 20 bp, human
gtgagcagggcagctacggg

SEQ ID NO: 185969 - DNA, 20 bp, human
gaactgtaggacggcagtga

SEQ ID NO: 185970 - DNA, 20 bp, human
gcccagtgaccaccgagtgt

SEQ ID NO: 185971 - DNA, 20 bp, human
gtcggagagcgccttggcag

SEQ ID NO: 185972 - DNA, 20 bp, human
gtcgtcatcggagagcgcct

SEQ ID NO: 185973 - DNA, 20 bp, human
gcgctctccgatgacgagca

SEQ ID NO: 185974 - DNA, 20 bp, human
gcttccaccctgctcgtcat

SEQ ID NO: 185975 - DNA, 20 bp, human
gtgtctcctcaggagctggg

SEQ ID NO: 185976 - DNA, 20 bp, human
ggagtcaccacaccgaacca

SEQ ID NO: 185977 - DNA, 20 bp, human
ggaaataccttggttcggtg

SEQ ID NO: 185978 - DNA, 20 bp, human
gttccctaaaggaaatacct

SEQ ID NO: 185979 - DNA, 20 bp, human
gctttctttgtagcaatcct

SEQ ID NO: 185980 - DNA, 20 bp, human
gtttcctttagggaaaaagc

SEQ ID NO: 185981 - DNA, 20 bp, human
gaaccaaggtatttccttta

SEQ ID NO: 185982 - DNA, 20 bp, human
gaaaaaaaaaggaaataccc

SEQ ID NO: 185983 - DNA, 20 bp, human
gtgtgtatctgtgtgttatc

SEQ ID NO: 185984 - DNA, 20 bp, human
gaagcctgaagaaaaatatt

SEQ ID NO: 185985 - DNA, 20 bp, human
gtttcctaatatttttcttc

SEQ ID NO: 185986 - DNA, 20 bp, human
ggcgagacctccgggatcac

SEQ ID NO: 185987 - DNA, 20 bp, human
ggcgccgccgcagccatgag

SEQ ID NO: 185988 - DNA, 20 bp, human
gcgtggccggcgagacctcc

SEQ ID NO: 185989 - DNA, 20 bp, human
gaaatcaagatggaggctcg

SEQ ID NO: 185990 - DNA, 20 bp, human
gccgccggcgcccgtgatcc

SEQ ID NO: 185991 - DNA, 20 bp, human
gcccggacgcgcagtcgcga

SEQ ID NO: 185992 - DNA, 20 bp, human
gccagctcgcggctaccggg

SEQ ID NO: 185993 - DNA, 20 bp, human
ggcctcctctgccccctcgc

SEQ ID NO: 185994 - DNA, 20 bp, human
ggcggagtcctcgtctatgt

SEQ ID NO: 185995 - DNA, 20 bp, human
ggagcgcgcccacatagacg

SEQ ID NO: 185996 - DNA, 20 bp, human
gggagaagggcgacgacccg

SEQ ID NO: 185997 - DNA, 20 bp, human
ggagcccaggcgaccctgag

SEQ ID NO: 185998 - DNA, 20 bp, human
ggtgccgcaagtgtgaggag

SEQ ID NO: 185999 - DNA, 20 bp, human
gcacttgcggcaccagtcac

SEQ ID NO: 186000 - DNA, 20 bp, human
gaaaggaagggccggaggcg

SEQ ID NO: 186001 - DNA, 20 bp, human
gtgggctcccgggggcgagt

SEQ ID NO: 186002 - DNA, 20 bp, human
gggcagcgtcggggaaagga

SEQ ID NO: 186003 - DNA, 20 bp, human
gccagtcacgggtggattcg

SEQ ID NO: 186004 - DNA, 20 bp, human
ggactggtgccgcaagtgtg

SEQ ID NO: 186005 - DNA, 20 bp, human
gccggggcagcgtcggggaa

SEQ ID NO: 186006 - DNA, 20 bp, human
gtgtgccggaccgatggact

SEQ ID NO: 186007 - DNA, 20 bp, human
ggaagcgagatggtgacgac

SEQ ID NO: 186008 - DNA, 20 bp, human
gccagcccagtccatcggtc

SEQ ID NO: 186009 - DNA, 20 bp, human
gccggcggcctcactgctat

SEQ ID NO: 186010 - DNA, 20 bp, human
gacacccggaagtgtcttca

SEQ ID NO: 186011 - DNA, 20 bp, human
gaggatgagtacgctacacc

SEQ ID NO: 186012 - DNA, 20 bp, human
ggcgagatggtgacgaccgg

SEQ ID NO: 186013 - DNA, 20 bp, human
ggaggtggggaggtcaagaa

SEQ ID NO: 186014 - DNA, 20 bp, human
gtctccctgaagacacttcc

SEQ ID NO: 186015 - DNA, 20 bp, human
gggttctctagccacgccag

SEQ ID NO: 186016 - DNA, 20 bp, human
gagccggacaggcggacgac

SEQ ID NO: 186017 - DNA, 20 bp, human
gcctcggctgagtctccccg

SEQ ID NO: 186018 - DNA, 20 bp, human
gcggccagggcgcccaaaat

SEQ ID NO: 186019 - DNA, 20 bp, human
gccgcctgtccggctaggag

SEQ ID NO: 186020 - DNA, 20 bp, human
gagggcggggacccaggggt

SEQ ID NO: 186021 - DNA, 20 bp, human
gcggctgagtctccccgggg

SEQ ID NO: 186022 - DNA, 20 bp, human
ggggcaggcggcttatctta

SEQ ID NO: 186023 - DNA, 20 bp, human
gggagtctcagcacgctcag

SEQ ID NO: 186024 - DNA, 20 bp, human
gggcgggagcagcatggatt

SEQ ID NO: 186025 - DNA, 20 bp, human
ggataaacttcgagagagag

SEQ ID NO: 186026 - DNA, 20 bp, human
gcccgccgaccagactccca

SEQ ID NO: 186027 - DNA, 20 bp, human
gccctccctgggagtctggt

SEQ ID NO: 186028 - DNA, 20 bp, human
ggccgaccagactcccaggg

SEQ ID NO: 186029 - DNA, 20 bp, human
gcaactgcggtgagaccctg

SEQ ID NO: 186030 - DNA, 20 bp, human
gaaggctctgcgctcctaga

SEQ ID NO: 186031 - DNA, 20 bp, human
gtctgcgctcctagaaggag

SEQ ID NO: 186032 - DNA, 20 bp, human
gccgggaagccactccttct

SEQ ID NO: 186033 - DNA, 20 bp, human
gtcctgagtccaagtaaggt

SEQ ID NO: 186034 - DNA, 20 bp, human
gcatccttggcaggtctctt

SEQ ID NO: 186035 - DNA, 20 bp, human
gatgatcctgagtccaagta

SEQ ID NO: 186036 - DNA, 20 bp, human
gggccgccatgacactcgct

SEQ ID NO: 186037 - DNA, 20 bp, human
gggatcatagaaaagcgccg

SEQ ID NO: 186038 - DNA, 20 bp, human
gatggcggccggcgtcgagt

SEQ ID NO: 186039 - DNA, 20 bp, human
gttccgagcgagtgtcatgg

SEQ ID NO: 186040 - DNA, 20 bp, human
gagttggcaggagtaaccca

SEQ ID NO: 186041 - DNA, 20 bp, human
ggctttccgagcgagtgtca

SEQ ID NO: 186042 - DNA, 20 bp, human
gctcaggcaaggccgactcc

SEQ ID NO: 186043 - DNA, 20 bp, human
gagacgcggacaggtcgcaa

SEQ ID NO: 186044 - DNA, 20 bp, human
gctcgctcggaaagcggcag

SEQ ID NO: 186045 - DNA, 20 bp, human
gtgactttcctcagttccgt

SEQ ID NO: 186046 - DNA, 20 bp, human
gccgggagcaggccaagcgg

SEQ ID NO: 186047 - DNA, 20 bp, human
gagctggaacagaaagtccc

SEQ ID NO: 186048 - DNA, 20 bp, human
gagggcccttcacagaaccg

SEQ ID NO: 186049 - DNA, 20 bp, human
gggagctcggcggggaccaa

SEQ ID NO: 186050 - DNA, 20 bp, human
gtcgcggcgatgacacaacc

SEQ ID NO: 186051 - DNA, 20 bp, human
gcgggagagacgctcgaggg

SEQ ID NO: 186052 - DNA, 20 bp, human
gcggcttcccgcaatgagga

SEQ ID NO: 186053 - DNA, 20 bp, human
gacacccgcaagccttaccc

SEQ ID NO: 186054 - DNA, 20 bp, human
gaccccccccagcggcgcgg

SEQ ID NO: 186055 - DNA, 20 bp, human
ggctcggcggggaccaaggg

SEQ ID NO: 186056 - DNA, 20 bp, human
gaagctagggcggggcccgc

SEQ ID NO: 186057 - DNA, 20 bp, human
gagcagtggggacccaacca

SEQ ID NO: 186058 - DNA, 20 bp, human
ggacgctgggcgtgaggtgg

SEQ ID NO: 186059 - DNA, 20 bp, human
gcggccgggtcagtgccctg

SEQ ID NO: 186060 - DNA, 20 bp, human
gcgcggcagattcgaagcta

SEQ ID NO: 186061 - DNA, 20 bp, human
gccaccgcagggcactgacc

SEQ ID NO: 186062 - DNA, 20 bp, human
gctgatgcgaccgaacccca

SEQ ID NO: 186063 - DNA, 20 bp, human
gatgcactggaggacagccg

SEQ ID NO: 186064 - DNA, 20 bp, human
gtcgtcctacgagggtgagg

SEQ ID NO: 186065 - DNA, 20 bp, human
ggcgcttccgggtcaggagg

SEQ ID NO: 186066 - DNA, 20 bp, human
gtagtccggtgcaggacgtg

SEQ ID NO: 186067 - DNA, 20 bp, human
gtggttccggctggggaaga

SEQ ID NO: 186068 - DNA, 20 bp, human
gcggggagccgctggtgcac

SEQ ID NO: 186069 - DNA, 20 bp, human
gagaaatgcaaggctgtccc

SEQ ID NO: 186070 - DNA, 20 bp, human
gctgccccttctctctagaa

SEQ ID NO: 186071 - DNA, 20 bp, human
ggagtaaggggttcaaagtt

SEQ ID NO: 186072 - DNA, 20 bp, human
ggtttcctttctagagagaa

SEQ ID NO: 186073 - DNA, 20 bp, human
gaaagtcttccgcaactgct

SEQ ID NO: 186074 - DNA, 20 bp, human
gcccgcttcccggttcgctc

SEQ ID NO: 186075 - DNA, 20 bp, human
gaagcccgaccggcagactg

SEQ ID NO: 186076 - DNA, 20 bp, human
gaaagggggactccagacag

SEQ ID NO: 186077 - DNA, 20 bp, human
gaggtgcgggacggaagagg

SEQ ID NO: 186078 - DNA, 20 bp, human
gtcccaaacgaggtgcggga

SEQ ID NO: 186079 - DNA, 20 bp, human
gggtgaaggccagaggctcg

SEQ ID NO: 186080 - DNA, 20 bp, human
gaagagggggtgaaggccag

SEQ ID NO: 186081 - DNA, 20 bp, human
gggctggagcggtaggacag

SEQ ID NO: 186082 - DNA, 20 bp, human
gtggagtcccaaacgaggtg

SEQ ID NO: 186083 - DNA, 20 bp, human
gacgaggtgcgggacggaag

SEQ ID NO: 186084 - DNA, 20 bp, human
gagccaggtgggccccgaca

SEQ ID NO: 186085 - DNA, 20 bp, human
gacactgctcagatggaagg

SEQ ID NO: 186086 - DNA, 20 bp, human
gccctgggagcggcacttgg

SEQ ID NO: 186087 - DNA, 20 bp, human
ggattaggtggctttatcgg

SEQ ID NO: 186088 - DNA, 20 bp, human
gccacggttctgtcactcag

SEQ ID NO: 186089 - DNA, 20 bp, human
gccgcgtggaagaccttggg

SEQ ID NO: 186090 - DNA, 20 bp, human
gcccctactcccaaagggtg

SEQ ID NO: 186091 - DNA, 20 bp, human
gttctgtcactcaggggcag

SEQ ID NO: 186092 - DNA, 20 bp, human
gcagccagcgccctactcaa

SEQ ID NO: 186093 - DNA, 20 bp, human
gggagggtgctgggttcggt

SEQ ID NO: 186094 - DNA, 20 bp, human
ggagccgcgtggaagacctt

SEQ ID NO: 186095 - DNA, 20 bp, human
gctactcccaaagggtgagg

SEQ ID NO: 186096 - DNA, 20 bp, human
gcgccacggacgccatctta

SEQ ID NO: 186097 - DNA, 20 bp, human
gagcagttcccgtgggcagt

SEQ ID NO: 186098 - DNA, 20 bp, human
gagaatcactacaagaggta

SEQ ID NO: 186099 - DNA, 20 bp, human
gtgccataagatggcgtccg

SEQ ID NO: 186100 - DNA, 20 bp, human
gagcgcagactgccataaga

SEQ ID NO: 186101 - DNA, 20 bp, human
gtgggctcaggggcctgcaa

SEQ ID NO: 186102 - DNA, 20 bp, human
gccccgagaatcactacaag

SEQ ID NO: 186103 - DNA, 20 bp, human
gtcttaaagggtgaaccccg

SEQ ID NO: 186104 - DNA, 20 bp, human
gtgaaccccgaggcttgtag

SEQ ID NO: 186105 - DNA, 20 bp, human
gcgatgataagggaaacatc

SEQ ID NO: 186106 - DNA, 20 bp, human
ggatgtcctacatatctatg

SEQ ID NO: 186107 - DNA, 20 bp, human
gcggggagggattcggactc

SEQ ID NO: 186108 - DNA, 20 bp, human
gtacgagagcaggtgaggac

SEQ ID NO: 186109 - DNA, 20 bp, human
ggctctagagagcacccggg

SEQ ID NO: 186110 - DNA, 20 bp, human
gacccactgtgccaacatgg

SEQ ID NO: 186111 - DNA, 20 bp, human
gggcgcccaggtcctaattc

SEQ ID NO: 186112 - DNA, 20 bp, human
gccgggcggagcggaaagtg

SEQ ID NO: 186113 - DNA, 20 bp, human
gcgggctctagagagcaccc

SEQ ID NO: 186114 - DNA, 20 bp, human
ggactgccactcgaaaaacc

SEQ ID NO: 186115 - DNA, 20 bp, human
gcagaaaaccgaattagtca

SEQ ID NO: 186116 - DNA, 20 bp, human
gggagcctagaagggatagt

SEQ ID NO: 186117 - DNA, 20 bp, human
gagctgtctctggcgaacca

SEQ ID NO: 186118 - DNA, 20 bp, human
ggctggctgggagcctagaa

SEQ ID NO: 186119 - DNA, 20 bp, human
gacggtctctagccacgaag

SEQ ID NO: 186120 - DNA, 20 bp, human
gaaagcgccccaccacgggg

SEQ ID NO: 186121 - DNA, 20 bp, human
gttgcaggaaaaatgaggta

SEQ ID NO: 186122 - DNA, 20 bp, human
gacggaaagcgccccaccac

SEQ ID NO: 186123 - DNA, 20 bp, human
gggcgaaccagggagcagct

SEQ ID NO: 186124 - DNA, 20 bp, human
gagttacgcagtggaggcta

SEQ ID NO: 186125 - DNA, 20 bp, human
gcagctgggtaggccgcggg

SEQ ID NO: 186126 - DNA, 20 bp, human
gagccagcccccttaaccag

SEQ ID NO: 186127 - DNA, 20 bp, human
gcgctgtccgctggttaagg

SEQ ID NO: 186128 - DNA, 20 bp, human
gcacccccacgcagcggcag

SEQ ID NO: 186129 - DNA, 20 bp, human
gccgcacccccaccctaggt

SEQ ID NO: 186130 - DNA, 20 bp, human
gtgaggcctctgccaaccta

SEQ ID NO: 186131 - DNA, 20 bp, human
ggcgtgggggtgaggggatc

SEQ ID NO: 186132 - DNA, 20 bp, human
ggcgccgctgccgctgcgtg

SEQ ID NO: 186133 - DNA, 20 bp, human
gcctctgccaacctagggtg

SEQ ID NO: 186134 - DNA, 20 bp, human
ggatcaggtacgctgtccgc

SEQ ID NO: 186135 - DNA, 20 bp, human
ggtacgctgtccgctggtta

SEQ ID NO: 186136 - DNA, 20 bp, human
gtccctgggcgtccgtacgt

SEQ ID NO: 186137 - DNA, 20 bp, human
gctgcgtgctagcttcggcg

SEQ ID NO: 186138 - DNA, 20 bp, human
ggtcggctgtgtagactgtt

SEQ ID NO: 186139 - DNA, 20 bp, human
ggctgtgtagactgttgggt

SEQ ID NO: 186140 - DNA, 20 bp, human
gccccagcgaccgctctggt

SEQ ID NO: 186141 - DNA, 20 bp, human
ggacgaaggactccgacgta

SEQ ID NO: 186142 - DNA, 20 bp, human
gagcttcggcgcggatccct

SEQ ID NO: 186143 - DNA, 20 bp, human
gtccgacgtacggacgccca

SEQ ID NO: 186144 - DNA, 20 bp, human
ggtaggctgcgtgctagctt

SEQ ID NO: 186145 - DNA, 20 bp, human
gcccgctggcgcaaagaaca

SEQ ID NO: 186146 - DNA, 20 bp, human
gaggtgatctgcatagcccg

SEQ ID NO: 186147 - DNA, 20 bp, human
ggctgtcgtgtacccttaac

SEQ ID NO: 186148 - DNA, 20 bp, human
gaggagcagatacctgttaa

SEQ ID NO: 186149 - DNA, 20 bp, human
ggagggcgctacggactcac

SEQ ID NO: 186150 - DNA, 20 bp, human
ggaagttccggagggcgcta

SEQ ID NO: 186151 - DNA, 20 bp, human
gcgaggaagctgggattcgg

SEQ ID NO: 186152 - DNA, 20 bp, human
gctcatggcgcaggagcatc

SEQ ID NO: 186153 - DNA, 20 bp, human
gagacagctaacaaatgctc

SEQ ID NO: 186154 - DNA, 20 bp, human
ggctccgggagtgagatgac

SEQ ID NO: 186155 - DNA, 20 bp, human
gatctgcggatcaagctcag

SEQ ID NO: 186156 - DNA, 20 bp, human
gggcctggcgagagtttgtg

SEQ ID NO: 186157 - DNA, 20 bp, human
gctggatcagacgcaactgt

SEQ ID NO: 186158 - DNA, 20 bp, human
gaggagcatccccggaagtg

SEQ ID NO: 186159 - DNA, 20 bp, human
gatccaggtgccgaaagggc

SEQ ID NO: 186160 - DNA, 20 bp, human
gtctgatccaggtgccgaaa

SEQ ID NO: 186161 - DNA, 20 bp, human
ggccgccggcgggtacctgg

SEQ ID NO: 186162 - DNA, 20 bp, human
gactctcgccaggccggaac

SEQ ID NO: 186163 - DNA, 20 bp, human
gagaggccaaaattatctcc

SEQ ID NO: 186164 - DNA, 20 bp, human
gatccccggaagtgaggcag

SEQ ID NO: 186165 - DNA, 20 bp, human
gcgggctgaggcgggagttc

SEQ ID NO: 186166 - DNA, 20 bp, human
ggcctggtgagccgactctg

SEQ ID NO: 186167 - DNA, 20 bp, human
gaaattcccggtcttaaata

SEQ ID NO: 186168 - DNA, 20 bp, human
gggagctgcgtgagcataca

SEQ ID NO: 186169 - DNA, 20 bp, human
gatacagagaatatctccag

SEQ ID NO: 186170 - DNA, 20 bp, human
gtcctcagagtcggctcacc

SEQ ID NO: 186171 - DNA, 20 bp, human
gaccaggctgactaaattcc

SEQ ID NO: 186172 - DNA, 20 bp, human
gtgggcaggtgaacaaccct

SEQ ID NO: 186173 - DNA, 20 bp, human
gtgtatcgctgggtaaacca

SEQ ID NO: 186174 - DNA, 20 bp, human
gagcatacagggactgcctg

SEQ ID NO: 186175 - DNA, 20 bp, human
gtactccatctcctcagagt

SEQ ID NO: 186176 - DNA, 20 bp, human
gggaggtcgccataattcta

SEQ ID NO: 186177 - DNA, 20 bp, human
gttccagctgagggtagatg

SEQ ID NO: 186178 - DNA, 20 bp, human
ggaagcgagccctagaatta

SEQ ID NO: 186179 - DNA, 20 bp, human
gtaccctcagctggaaaacc

SEQ ID NO: 186180 - DNA, 20 bp, human
gggcgcgtgcggcgacgtcg

SEQ ID NO: 186181 - DNA, 20 bp, human
ggcgtgcggcgacgtcgcgg

SEQ ID NO: 186182 - DNA, 20 bp, human
ggttgccggatgctggacac

SEQ ID NO: 186183 - DNA, 20 bp, human
gccgcaaggagggcaaaact

SEQ ID NO: 186184 - DNA, 20 bp, human
gggtagatgcggttactatg

SEQ ID NO: 186185 - DNA, 20 bp, human
gcgcctggttttccagctga

SEQ ID NO: 186186 - DNA, 20 bp, human
gctggagccgaggccggagt

SEQ ID NO: 186187 - DNA, 20 bp, human
ggagtccagagccgaatccg

SEQ ID NO: 186188 - DNA, 20 bp, human
ggcggtaactatggagaata

SEQ ID NO: 186189 - DNA, 20 bp, human
gctggactcggctccgactc

SEQ ID NO: 186190 - DNA, 20 bp, human
gtcgtaacgcctcggggaaa

SEQ ID NO: 186191 - DNA, 20 bp, human
ggtaactatggagaatatgg

SEQ ID NO: 186192 - DNA, 20 bp, human
gggcacggaggcggtaacta

SEQ ID NO: 186193 - DNA, 20 bp, human
gtgtcacggtgagggatatg

SEQ ID NO: 186194 - DNA, 20 bp, human
gccgtgtagcggctaaagca

SEQ ID NO: 186195 - DNA, 20 bp, human
ggaaagaggggcccgtgtag

SEQ ID NO: 186196 - DNA, 20 bp, human
gcgcgctggcggactaagag

SEQ ID NO: 186197 - DNA, 20 bp, human
ggacgaggcaggtgcgatag

SEQ ID NO: 186198 - DNA, 20 bp, human
gcgtcctgggcctgtcacaa

SEQ ID NO: 186199 - DNA, 20 bp, human
gaacctgccagagaataggt

SEQ ID NO: 186200 - DNA, 20 bp, human
ggagacgctgggtagagacg

SEQ ID NO: 186201 - DNA, 20 bp, human
gcgcctggccacctcgtcct

SEQ ID NO: 186202 - DNA, 20 bp, human
gtgacaggcccaggacgagg

SEQ ID NO: 186203 - DNA, 20 bp, human
ggagtggctggcgaagcgag

SEQ ID NO: 186204 - DNA, 20 bp, human
ggggaagtggcctgtcacaa

SEQ ID NO: 186205 - DNA, 20 bp, human
ggagacggtagggcagctca

SEQ ID NO: 186206 - DNA, 20 bp, human
gaggaaggcggcgggtgtca

SEQ ID NO: 186207 - DNA, 20 bp, human
gggctggagacgggacccga

SEQ ID NO: 186208 - DNA, 20 bp, human
gacttagagaaggaaggcgg

SEQ ID NO: 186209 - DNA, 20 bp, human
ggaccttgcgcagtcaccgt

SEQ ID NO: 186210 - DNA, 20 bp, human
ggactgcgcaaggtcgtgta

SEQ ID NO: 186211 - DNA, 20 bp, human
gccccgccccgcggacagtt

SEQ ID NO: 186212 - DNA, 20 bp, human
gcgccgcgcttgccaagggt

SEQ ID NO: 186213 - DNA, 20 bp, human
gcggacagtttggcatagta

SEQ ID NO: 186214 - DNA, 20 bp, human
ggtcgtgtacggcccagcgt

SEQ ID NO: 186215 - DNA, 20 bp, human
ggcaagcgcggcgggacacg

SEQ ID NO: 186216 - DNA, 20 bp, human
ggctccagcgggcctccagg

SEQ ID NO: 186217 - DNA, 20 bp, human
ggtacggcccacctcagcca

SEQ ID NO: 186218 - DNA, 20 bp, human
gtgggtagctgatcccggta

SEQ ID NO: 186219 - DNA, 20 bp, human
ggcgcctgggtagctgatcc

SEQ ID NO: 186220 - DNA, 20 bp, human
gctgtgggagaagcgcgcct

SEQ ID NO: 186221 - DNA, 20 bp, human
gggccagtgccagcaagagg

SEQ ID NO: 186222 - DNA, 20 bp, human
gcaaagcgaatccagatctg

SEQ ID NO: 186223 - DNA, 20 bp, human
ggtacacctgctggctgcca

SEQ ID NO: 186224 - DNA, 20 bp, human
gtctcggcgcgccgctgcca

SEQ ID NO: 186225 - DNA, 20 bp, human
gccaccgggctgcgtcatct

SEQ ID NO: 186226 - DNA, 20 bp, human
ggctttgagcccggcccttc

SEQ ID NO: 186227 - DNA, 20 bp, human
gtcgtcggtcgcgccagagg

SEQ ID NO: 186228 - DNA, 20 bp, human
gcgatcggtaccggagcggg

SEQ ID NO: 186229 - DNA, 20 bp, human
gatgtgggtcgcgggtggat

SEQ ID NO: 186230 - DNA, 20 bp, human
gcatccgatcggtaccggag

SEQ ID NO: 186231 - DNA, 20 bp, human
gacccacatccgatcggtac

SEQ ID NO: 186232 - DNA, 20 bp, human
gcccgcgacccacatccgat

SEQ ID NO: 186233 - DNA, 20 bp, human
gtgggtcgcgggtggatggg

SEQ ID NO: 186234 - DNA, 20 bp, human
gccagctgcagagcgacgtg

SEQ ID NO: 186235 - DNA, 20 bp, human
gggaggtaccagcccgccca

SEQ ID NO: 186236 - DNA, 20 bp, human
gggcgacaaccgaggaggag

SEQ ID NO: 186237 - DNA, 20 bp, human
ggcggtggcgacaaccgagg

SEQ ID NO: 186238 - DNA, 20 bp, human
ggcactaggagccctccgac

SEQ ID NO: 186239 - DNA, 20 bp, human
gagacccgaggagacaacga

SEQ ID NO: 186240 - DNA, 20 bp, human
gagcgtcatggagggctcag

SEQ ID NO: 186241 - DNA, 20 bp, human
gcgccaggttgtgggaagtg

SEQ ID NO: 186242 - DNA, 20 bp, human
gagcggcgtgcaacacgtgg

SEQ ID NO: 186243 - DNA, 20 bp, human
gctggcggtggcgacaaccg

SEQ ID NO: 186244 - DNA, 20 bp, human
gtctgtgacagaaagacccg

SEQ ID NO: 186245 - DNA, 20 bp, human
gggccaagaatggaattctg

SEQ ID NO: 186246 - DNA, 20 bp, human
gggaggcacgtgtggagccc

SEQ ID NO: 186247 - DNA, 20 bp, human
ggactccgcggggtacaggg

SEQ ID NO: 186248 - DNA, 20 bp, human
ggccggtggacacctcgcaa

SEQ ID NO: 186249 - DNA, 20 bp, human
gcgcgtcgcggaggcacgtg

SEQ ID NO: 186250 - DNA, 20 bp, human
gcggggcgcgacgtcatcag

SEQ ID NO: 186251 - DNA, 20 bp, human
ggcggcggccacaacacttc

SEQ ID NO: 186252 - DNA, 20 bp, human
ggcctttgcgaggtgtccac

SEQ ID NO: 186253 - DNA, 20 bp, human
gtcgcaggtgagactccgcg

SEQ ID NO: 186254 - DNA, 20 bp, human
gcgcggagccggaagtgttg

SEQ ID NO: 186255 - DNA, 20 bp, human
gccggcagcaggagcgtcgc

SEQ ID NO: 186256 - DNA, 20 bp, human
gggttccgagcccctgccgc

SEQ ID NO: 186257 - DNA, 20 bp, human
ggcacagcaagacaggaccg

SEQ ID NO: 186258 - DNA, 20 bp, human
ggggcctgcgagagcatcga

SEQ ID NO: 186259 - DNA, 20 bp, human
ggccgcaggcacagcaagac

SEQ ID NO: 186260 - DNA, 20 bp, human
ggcctgaaagggtctctctc

SEQ ID NO: 186261 - DNA, 20 bp, human
gcgctcttcgacctcggtag

SEQ ID NO: 186262 - DNA, 20 bp, human
gaggactcgagcggagacca

SEQ ID NO: 186263 - DNA, 20 bp, human
ggagagctcgaggactcgag

SEQ ID NO: 186264 - DNA, 20 bp, human
ggagagcatcgaaggatcct

SEQ ID NO: 186265 - DNA, 20 bp, human
gcaggcccagtccgctaccg

SEQ ID NO: 186266 - DNA, 20 bp, human
ggcctccgaaccaaagtcag

SEQ ID NO: 186267 - DNA, 20 bp, human
gagctgcagctggcgaagtt

SEQ ID NO: 186268 - DNA, 20 bp, human
ggcaaccagcggcccaggga

SEQ ID NO: 186269 - DNA, 20 bp, human
ggaccgtggacactggtgag

SEQ ID NO: 186270 - DNA, 20 bp, human
gcccgccggcttctcactgt

SEQ ID NO: 186271 - DNA, 20 bp, human
gtccagcgagcggagaacac

SEQ ID NO: 186272 - DNA, 20 bp, human
gccgacccgcgcgcaaccag

SEQ ID NO: 186273 - DNA, 20 bp, human
gtcgtgtgcgccctgtccgg

SEQ ID NO: 186274 - DNA, 20 bp, human
gcggcaaggcgcggaagcgg

SEQ ID NO: 186275 - DNA, 20 bp, human
gggcgaagttgggcgactgg

SEQ ID NO: 186276 - DNA, 20 bp, human
gtggatgggcgacgtgagtg

SEQ ID NO: 186277 - DNA, 20 bp, human
gccgccatacccgcgcaccg

SEQ ID NO: 186278 - DNA, 20 bp, human
ggccctgggctgaacgggag

SEQ ID NO: 186279 - DNA, 20 bp, human
ggtttcaggccgctcagtgg

SEQ ID NO: 186280 - DNA, 20 bp, human
gcttgtcttcagaccccgga

SEQ ID NO: 186281 - DNA, 20 bp, human
ggaggttcgcctccactgag

SEQ ID NO: 186282 - DNA, 20 bp, human
ggagtgagggcagccgtccg

SEQ ID NO: 186283 - DNA, 20 bp, human
ggcccctcccgttcagccca

SEQ ID NO: 186284 - DNA, 20 bp, human
gtgaagaggctgagtccgtg

SEQ ID NO: 186285 - DNA, 20 bp, human
gcgcccgcaaagccccaccc

SEQ ID NO: 186286 - DNA, 20 bp, human
gggagctggccgaagcacgg

SEQ ID NO: 186287 - DNA, 20 bp, human
gcggctgtaggtgcgcaggg

SEQ ID NO: 186288 - DNA, 20 bp, human
gggcatcccccgccccccac

SEQ ID NO: 186289 - DNA, 20 bp, human
gtcggggtaggagtcaaggt

SEQ ID NO: 186290 - DNA, 20 bp, human
gacacccgaacagctagaca

SEQ ID NO: 186291 - DNA, 20 bp, human
gccccagctgcgtccggcag

SEQ ID NO: 186292 - DNA, 20 bp, human
gagcggcggggactgacccg

SEQ ID NO: 186293 - DNA, 20 bp, human
ggcgcaggccgagctctacc

SEQ ID NO: 186294 - DNA, 20 bp, human
gctcggccgccaagaaaacg

SEQ ID NO: 186295 - DNA, 20 bp, human
gctgcggctgtaggtgcgca

SEQ ID NO: 186296 - DNA, 20 bp, human
ggggcgcgcgccgctcagag

SEQ ID NO: 186297 - DNA, 20 bp, human
gcttcccggcaggccacgtg

SEQ ID NO: 186298 - DNA, 20 bp, human
ggaggtgcgaggaaactgag

SEQ ID NO: 186299 - DNA, 20 bp, human
gcaacagcggggccggtaag

SEQ ID NO: 186300 - DNA, 20 bp, human
gatgggcaggacccccgtat

SEQ ID NO: 186301 - DNA, 20 bp, human
ggctgctgcggcctccttat

SEQ ID NO: 186302 - DNA, 20 bp, human
gccgcttccgtggaatggaa

SEQ ID NO: 186303 - DNA, 20 bp, human
ggcggcgcgcgcccgcttac

SEQ ID NO: 186304 - DNA, 20 bp, human
ggggaaccccagccctgaaa

SEQ ID NO: 186305 - DNA, 20 bp, human
gccggaagtgcgcgtggcgg

SEQ ID NO: 186306 - DNA, 20 bp, human
gtcgggagggagataggaga

SEQ ID NO: 186307 - DNA, 20 bp, human
gttctggattcaagaagacg

SEQ ID NO: 186308 - DNA, 20 bp, human
gcgaggtgagctgaggtacc

SEQ ID NO: 186309 - DNA, 20 bp, human
ggggacccagagataagagt

SEQ ID NO: 186310 - DNA, 20 bp, human
gcagccaggaagcccccaca

SEQ ID NO: 186311 - DNA, 20 bp, human
gccattctgtggcccaaacg

SEQ ID NO: 186312 - DNA, 20 bp, human
gcttcagacggtagcaagag

SEQ ID NO: 186313 - DNA, 20 bp, human
gagacggcaggactccgttt

SEQ ID NO: 186314 - DNA, 20 bp, human
gggatacacacagttcggga

SEQ ID NO: 186315 - DNA, 20 bp, human
ggccacagaatggagggatc

SEQ ID NO: 186316 - DNA, 20 bp, human
gccccaactggccatgaggg

SEQ ID NO: 186317 - DNA, 20 bp, human
gcagactgagaccacagaag

SEQ ID NO: 186318 - DNA, 20 bp, human
ggtagctttaggacctgcaa

SEQ ID NO: 186319 - DNA, 20 bp, human
gctcagtctgtatatctgga

SEQ ID NO: 186320 - DNA, 20 bp, human
gggctgatctgggtaatgac

SEQ ID NO: 186321 - DNA, 20 bp, human
gaggacactgtcctcttctg

SEQ ID NO: 186322 - DNA, 20 bp, human
gaatccccaactggccatga

SEQ ID NO: 186323 - DNA, 20 bp, human
gttactgccaaggcagccca

SEQ ID NO: 186324 - DNA, 20 bp, human
gggtaaagcctggctgatct

SEQ ID NO: 186325 - DNA, 20 bp, human
gtccttggttgccgccaaca

SEQ ID NO: 186326 - DNA, 20 bp, human
ggagagggtcaggagaaaag

SEQ ID NO: 186327 - DNA, 20 bp, human
ggctccagcagcacccgaga

SEQ ID NO: 186328 - DNA, 20 bp, human
gagcagcacccgagagggtc

SEQ ID NO: 186329 - DNA, 20 bp, human
gaagctgggtaggccctgag

SEQ ID NO: 186330 - DNA, 20 bp, human
gaccttaccgaggcccctca

SEQ ID NO: 186331 - DNA, 20 bp, human
gggcgcacgatgtaacagtg

SEQ ID NO: 186332 - DNA, 20 bp, human
gggtaggagatacaccccgg

SEQ ID NO: 186333 - DNA, 20 bp, human
gaggggtaggagatacaccc

SEQ ID NO: 186334 - DNA, 20 bp, human
ggcgtaccggaatcttgcta

SEQ ID NO: 186335 - DNA, 20 bp, human
ggccctgaggggcctcggta

SEQ ID NO: 186336 - DNA, 20 bp, human
ggaaccgaacctggaatccc

SEQ ID NO: 186337 - DNA, 20 bp, human
gcgacaagcaggagcggtcc

SEQ ID NO: 186338 - DNA, 20 bp, human
gccacaggccgacgtcgaga

SEQ ID NO: 186339 - DNA, 20 bp, human
ggctgggaaacgacaaaaga

SEQ ID NO: 186340 - DNA, 20 bp, human
gggaatccccggcggcagtg

SEQ ID NO: 186341 - DNA, 20 bp, human
gcgatgccgacaagcaggag

SEQ ID NO: 186342 - DNA, 20 bp, human
gcagaagccgcgggagaagg

SEQ ID NO: 186343 - DNA, 20 bp, human
gaagcaggccctctcgacgt

SEQ ID NO: 186344 - DNA, 20 bp, human
gccgccggggattccaggtt

SEQ ID NO: 186345 - DNA, 20 bp, human
gagcggtcccggcttcggaa

SEQ ID NO: 186346 - DNA, 20 bp, human
gtgtgggcgcgtcattagta

SEQ ID NO: 186347 - DNA, 20 bp, human
gggtgtgtgcacaatccaag

SEQ ID NO: 186348 - DNA, 20 bp, human
gcattagtagggtcacctct

SEQ ID NO: 186349 - DNA, 20 bp, human
gcagcgaaaaagtcgctctg

SEQ ID NO: 186350 - DNA, 20 bp, human
gccaggagcaagaattcggt

SEQ ID NO: 186351 - DNA, 20 bp, human
gggcgagtccaaggcagacg

SEQ ID NO: 186352 - DNA, 20 bp, human
gccctgaaggggcgagtcca

SEQ ID NO: 186353 - DNA, 20 bp, human
ggacgacacggaggatttca

SEQ ID NO: 186354 - DNA, 20 bp, human
gagctccttcgcaaagaggg

SEQ ID NO: 186355 - DNA, 20 bp, human
gatcgcttaaggtactctgg

SEQ ID NO: 186356 - DNA, 20 bp, human
gaggagcagaggatgacgtg

SEQ ID NO: 186357 - DNA, 20 bp, human
gcgtcgctacagaggagcag

SEQ ID NO: 186358 - DNA, 20 bp, human
gctcgagccgaggcagcagt

SEQ ID NO: 186359 - DNA, 20 bp, human
gcgttcggcgaggaagagga

SEQ ID NO: 186360 - DNA, 20 bp, human
gctctgtagcgacgacacta

SEQ ID NO: 186361 - DNA, 20 bp, human
gacccgagcacggacctctc

SEQ ID NO: 186362 - DNA, 20 bp, human
ggccgtgccaggagtcgcag

SEQ ID NO: 186363 - DNA, 20 bp, human
gtgtagcgacgacactaggg

SEQ ID NO: 186364 - DNA, 20 bp, human
gctgcgcacgttgggctcca

SEQ ID NO: 186365 - DNA, 20 bp, human
gtacagggccgccatcatcg

SEQ ID NO: 186366 - DNA, 20 bp, human
gccggcccgtgggagaaggg

SEQ ID NO: 186367 - DNA, 20 bp, human
gggctggaggggcgtcaacg

SEQ ID NO: 186368 - DNA, 20 bp, human
gcgcgatgtccaccaaggtc

SEQ ID NO: 186369 - DNA, 20 bp, human
gggtccggcccgtgggagaa

SEQ ID NO: 186370 - DNA, 20 bp, human
gcaagcaagggtgaccttcc

SEQ ID NO: 186371 - DNA, 20 bp, human
gggctgcggtccgagtgtgg

SEQ ID NO: 186372 - DNA, 20 bp, human
gagacaggagacgggcgccg

SEQ ID NO: 186373 - DNA, 20 bp, human
gaagacgagggcgaggacga

SEQ ID NO: 186374 - DNA, 20 bp, human
ggctgcgacgaggaagcccg

SEQ ID NO: 186375 - DNA, 20 bp, human
gggccgggcccggtactcac

SEQ ID NO: 186376 - DNA, 20 bp, human
gcagctggcaccgaactggg

SEQ ID NO: 186377 - DNA, 20 bp, human
gcgagtgcggcggaagactg

SEQ ID NO: 186378 - DNA, 20 bp, human
gacgcagctggcaccgaact

SEQ ID NO: 186379 - DNA, 20 bp, human
gtgcatccagaaccacaggg

SEQ ID NO: 186380 - DNA, 20 bp, human
gctgaaagcgaagccatggg

SEQ ID NO: 186381 - DNA, 20 bp, human
ggtggcgagaatccaccctg

SEQ ID NO: 186382 - DNA, 20 bp, human
gtcaagcagttggccccggt

SEQ ID NO: 186383 - DNA, 20 bp, human
gcacgcccggcaaattccaa

SEQ ID NO: 186384 - DNA, 20 bp, human
ggagttcccacggctgacag

SEQ ID NO: 186385 - DNA, 20 bp, human
gagcggatgagcccagagaa

SEQ ID NO: 186386 - DNA, 20 bp, human
gctccagacccagccgctac

SEQ ID NO: 186387 - DNA, 20 bp, human
ggtccgacgaggagacatgg

SEQ ID NO: 186388 - DNA, 20 bp, human
ggccggccgagggagacggt

SEQ ID NO: 186389 - DNA, 20 bp, human
ggacgtggcgcaaagaaggg

SEQ ID NO: 186390 - DNA, 20 bp, human
gcccgctcggcccctgacaa

SEQ ID NO: 186391 - DNA, 20 bp, human
gtacgaggctggaccaggag

SEQ ID NO: 186392 - DNA, 20 bp, human
gcggtcggcagccacagtgg

SEQ ID NO: 186393 - DNA, 20 bp, human
ggtagacgtggcgcaaagaa

SEQ ID NO: 186394 - DNA, 20 bp, human
gatggcggcggcgccggtag

SEQ ID NO: 186395 - DNA, 20 bp, human
gcgccgccatgtctcctcgt

SEQ ID NO: 186396 - DNA, 20 bp, human
ggcgccgcaaaagaggagtc

SEQ ID NO: 186397 - DNA, 20 bp, human
gccggccaggatgcgtggtg

SEQ ID NO: 186398 - DNA, 20 bp, human
ggtgtcgtctggatgtccac

SEQ ID NO: 186399 - DNA, 20 bp, human
gcagggataggacaaagctg

SEQ ID NO: 186400 - DNA, 20 bp, human
gctgtgggctcagggtggta

SEQ ID NO: 186401 - DNA, 20 bp, human
gggcgccgcaccacgcatcc

SEQ ID NO: 186402 - DNA, 20 bp, human
gtaggcggagaagcattgac

SEQ ID NO: 186403 - DNA, 20 bp, human
gctgcctgagtgctgctgag

SEQ ID NO: 186404 - DNA, 20 bp, human
gagtgctgctgaggggcaag

SEQ ID NO: 186405 - DNA, 20 bp, human
gcgcgaaacagcagccgact

SEQ ID NO: 186406 - DNA, 20 bp, human
gacactcccaagaaaccagg

SEQ ID NO: 186407 - DNA, 20 bp, human
gtgcaggataactgaggtaa

SEQ ID NO: 186408 - DNA, 20 bp, human
gtggaggagctgagggctag

SEQ ID NO: 186409 - DNA, 20 bp, human
gaatggcagatacaaactgg

SEQ ID NO: 186410 - DNA, 20 bp, human
gtgaaactgcaggataactg

SEQ ID NO: 186411 - DNA, 20 bp, human
gggtaatggcagatacaaac

SEQ ID NO: 186412 - DNA, 20 bp, human
gatacaaactggaggagctg

SEQ ID NO: 186413 - DNA, 20 bp, human
gagtatccccctggtttctt

SEQ ID NO: 186414 - DNA, 20 bp, human
gactgccaattgcacattat

SEQ ID NO: 186415 - DNA, 20 bp, human
gttgcagtatggtaaggtag

SEQ ID NO: 186416 - DNA, 20 bp, human
ggcgtaagagcggagagcaa

SEQ ID NO: 186417 - DNA, 20 bp, human
gcagcggccgaactggacct

SEQ ID NO: 186418 - DNA, 20 bp, human
gtacgcttcgctaccaccag

SEQ ID NO: 186419 - DNA, 20 bp, human
gcgccggcactcacaagcag

SEQ ID NO: 186420 - DNA, 20 bp, human
gggaggggcagttctccccg

SEQ ID NO: 186421 - DNA, 20 bp, human
ggccgagtgggcagttccag

SEQ ID NO: 186422 - DNA, 20 bp, human
gctctcgttgcgccgcgcag

SEQ ID NO: 186423 - DNA, 20 bp, human
ggaactggacctgggcagac

SEQ ID NO: 186424 - DNA, 20 bp, human
gccccgcgaggatgcgtctg

SEQ ID NO: 186425 - DNA, 20 bp, human
gccggcgttcgggccccgga

SEQ ID NO: 186426 - DNA, 20 bp, human
gagaagcatctgtgtgagag

SEQ ID NO: 186427 - DNA, 20 bp, human
gatgcggcgtggtgatgggt

SEQ ID NO: 186428 - DNA, 20 bp, human
gtggcatgcggcgtggtgat

SEQ ID NO: 186429 - DNA, 20 bp, human
ggattccggtcatctagagg

SEQ ID NO: 186430 - DNA, 20 bp, human
ggtgagagtggcatgcggcg

SEQ ID NO: 186431 - DNA, 20 bp, human
gggtaaaaactcgccttccg

SEQ ID NO: 186432 - DNA, 20 bp, human
gtccttggctaccacccatg

SEQ ID NO: 186433 - DNA, 20 bp, human
gccggattccggtcatctag

SEQ ID NO: 186434 - DNA, 20 bp, human
gacggagagcggtacatcct

SEQ ID NO: 186435 - DNA, 20 bp, human
ggtgttgagtcgccagaagc

SEQ ID NO: 186436 - DNA, 20 bp, human
gtgcgggcagctgggcggaa

SEQ ID NO: 186437 - DNA, 20 bp, human
ggcggcagccccacactcgg

SEQ ID NO: 186438 - DNA, 20 bp, human
gcactggcctggccacccga

SEQ ID NO: 186439 - DNA, 20 bp, human
ggcctgattacagatgttgg

SEQ ID NO: 186440 - DNA, 20 bp, human
gcatccccaaaaggtttaga

SEQ ID NO: 186441 - DNA, 20 bp, human
gcagctgggcggaagggcag

SEQ ID NO: 186442 - DNA, 20 bp, human
gccacccagcacagtttggg

SEQ ID NO: 186443 - DNA, 20 bp, human
gtgattacagatgttggggg

SEQ ID NO: 186444 - DNA, 20 bp, human
gtagcaggagtcgggcagga

SEQ ID NO: 186445 - DNA, 20 bp, human
ggcctaggaggagcatgtgc

SEQ ID NO: 186446 - DNA, 20 bp, human
gagtgtagcgagctggagag

SEQ ID NO: 186447 - DNA, 20 bp, human
gtcggcaacaatgacaaggt

SEQ ID NO: 186448 - DNA, 20 bp, human
gcccttcggcaacaatgaca

SEQ ID NO: 186449 - DNA, 20 bp, human
gtgggagaacagaactgggg

SEQ ID NO: 186450 - DNA, 20 bp, human
gctggttgcagctggcgtgg

SEQ ID NO: 186451 - DNA, 20 bp, human
gtcccaatcagaccaaccat

SEQ ID NO: 186452 - DNA, 20 bp, human
ggaaccccagtgtagcgagc

SEQ ID NO: 186453 - DNA, 20 bp, human
gggtctgattgggaaatcac

SEQ ID NO: 186454 - DNA, 20 bp, human
gtggggttctagagacacat

SEQ ID NO: 186455 - DNA, 20 bp, human
gtccgagccagctttcctca

SEQ ID NO: 186456 - DNA, 20 bp, human
gcgcacgctcgggcgagatg

SEQ ID NO: 186457 - DNA, 20 bp, human
gagggcgcggcggaatgcag

SEQ ID NO: 186458 - DNA, 20 bp, human
gcgctcgggcgagatgtgga

SEQ ID NO: 186459 - DNA, 20 bp, human
ggagatgtggatggccccgc

SEQ ID NO: 186460 - DNA, 20 bp, human
gtgacgcagagcgctgcggg

SEQ ID NO: 186461 - DNA, 20 bp, human
ggggtgccgagtgcgtgcag

SEQ ID NO: 186462 - DNA, 20 bp, human
gccgtcccgggagcttgtga

SEQ ID NO: 186463 - DNA, 20 bp, human
gcgggagcttgtgaaggttg

SEQ ID NO: 186464 - DNA, 20 bp, human
gtgagtgacgcagagcgctg

SEQ ID NO: 186465 - DNA, 20 bp, human
ggagcttgtgaaggttgagg

SEQ ID NO: 186466 - DNA, 20 bp, human
gccgtggtgtcagagacaag

SEQ ID NO: 186467 - DNA, 20 bp, human
ggcacaaaacagcctgtggt

SEQ ID NO: 186468 - DNA, 20 bp, human
gacacctgcaaattccatta

SEQ ID NO: 186469 - DNA, 20 bp, human
gctgctttgactccgaccac

SEQ ID NO: 186470 - DNA, 20 bp, human
gcagcccaagtccccaagtt

SEQ ID NO: 186471 - DNA, 20 bp, human
ggtgcgaaccacactcgaga

SEQ ID NO: 186472 - DNA, 20 bp, human
gtccggatggtccagtttag

SEQ ID NO: 186473 - DNA, 20 bp, human
ggaaaataaacggtccccca

SEQ ID NO: 186474 - DNA, 20 bp, human
gtgcatttaggctcccccaa

SEQ ID NO: 186475 - DNA, 20 bp, human
gccatctgtcagacttctga

SEQ ID NO: 186476 - DNA, 20 bp, human
gcgcaacctcctgcagccca

SEQ ID NO: 186477 - DNA, 20 bp, human
ggggacaggaacaaatgtag

SEQ ID NO: 186478 - DNA, 20 bp, human
gagttgactccacagatccg

SEQ ID NO: 186479 - DNA, 20 bp, human
gactcctcaccccggatctg

SEQ ID NO: 186480 - DNA, 20 bp, human
gagcatggtggtgccggaga

SEQ ID NO: 186481 - DNA, 20 bp, human
gagattcctgggtcagacgg

SEQ ID NO: 186482 - DNA, 20 bp, human
gtgggagggtccaggttcca

SEQ ID NO: 186483 - DNA, 20 bp, human
gtggaagcagagccggcgga

SEQ ID NO: 186484 - DNA, 20 bp, human
ggccctcccgctccagactc

SEQ ID NO: 186485 - DNA, 20 bp, human
gcccaggctaggctggaaag

SEQ ID NO: 186486 - DNA, 20 bp, human
gccccgtcccggaagccccg

SEQ ID NO: 186487 - DNA, 20 bp, human
gccggtcttcagcatccccg

SEQ ID NO: 186488 - DNA, 20 bp, human
gatgtccaaggcccccgtcc

SEQ ID NO: 186489 - DNA, 20 bp, human
gtcacacagcaggtcaaggg

SEQ ID NO: 186490 - DNA, 20 bp, human
gaagaagcgaggcaaggtaa

SEQ ID NO: 186491 - DNA, 20 bp, human
ggcgccctcggctcactgag

SEQ ID NO: 186492 - DNA, 20 bp, human
gggcagtcctgacccctctc

SEQ ID NO: 186493 - DNA, 20 bp, human
ggctctgaatatggccccag

SEQ ID NO: 186494 - DNA, 20 bp, human
ggagggtctgggaagaagcg

SEQ ID NO: 186495 - DNA, 20 bp, human
gccaccatgcaggatgtcca

SEQ ID NO: 186496 - DNA, 20 bp, human
ggcttgagctgagaatccgg

SEQ ID NO: 186497 - DNA, 20 bp, human
gcggagggagaggagttcgg

SEQ ID NO: 186498 - DNA, 20 bp, human
gagggagaggagttcggagg

SEQ ID NO: 186499 - DNA, 20 bp, human
gtgagaatccggaggagaga

SEQ ID NO: 186500 - DNA, 20 bp, human
gggtagtgtacgctactaca

SEQ ID NO: 186501 - DNA, 20 bp, human
gcctgcaagcgctccaagac

SEQ ID NO: 186502 - DNA, 20 bp, human
ggtggcttgagctgagaatc

SEQ ID NO: 186503 - DNA, 20 bp, human
gcgggcacagatctcagacc

SEQ ID NO: 186504 - DNA, 20 bp, human
gtaagctcaggctgctcgac

SEQ ID NO: 186505 - DNA, 20 bp, human
gtcgggggttcagctcgggg

SEQ ID NO: 186506 - DNA, 20 bp, human
gcggcctgtagccatctatc

SEQ ID NO: 186507 - DNA, 20 bp, human
gggagacgcttcccgataga

SEQ ID NO: 186508 - DNA, 20 bp, human
gcctgtggccagtcacccgg

SEQ ID NO: 186509 - DNA, 20 bp, human
gcgtcccgagaggacaaatc

SEQ ID NO: 186510 - DNA, 20 bp, human
gcacggggcggactccggaa

SEQ ID NO: 186511 - DNA, 20 bp, human
gggagcaggtagcaagttag

SEQ ID NO: 186512 - DNA, 20 bp, human
gtccccagccccgtcgccgg

SEQ ID NO: 186513 - DNA, 20 bp, human
gctcgctgggagccgagtct

SEQ ID NO: 186514 - DNA, 20 bp, human
gtcccagcgagggcctctcc

SEQ ID NO: 186515 - DNA, 20 bp, human
gattgtgcgaccaactcctc

SEQ ID NO: 186516 - DNA, 20 bp, human
ggagagaccagcaggatcct

SEQ ID NO: 186517 - DNA, 20 bp, human
ggatgacataccctaagtga

SEQ ID NO: 186518 - DNA, 20 bp, human
gcctgctggtctctccccac

SEQ ID NO: 186519 - DNA, 20 bp, human
gtgacaaaaaccgtcactta

SEQ ID NO: 186520 - DNA, 20 bp, human
gtgtgggcataagcaaatgc

SEQ ID NO: 186521 - DNA, 20 bp, human
gtatctgaagcaatcctatt

SEQ ID NO: 186522 - DNA, 20 bp, human
gattctacaagttacagcaa

SEQ ID NO: 186523 - DNA, 20 bp, human
gaagctttcctcctcctgtg

SEQ ID NO: 186524 - DNA, 20 bp, human
gaaattcctcaaagtgttgt

SEQ ID NO: 186525 - DNA, 20 bp, human
gcaggattttctttcaccca

SEQ ID NO: 186526 - DNA, 20 bp, human
gtcggcagcccgaaagatgg

SEQ ID NO: 186527 - DNA, 20 bp, human
gacgtaatgcgcggagactg

SEQ ID NO: 186528 - DNA, 20 bp, human
gtaatcgtcaagaacaccct

SEQ ID NO: 186529 - DNA, 20 bp, human
gccctcggcagcccgaaaga

SEQ ID NO: 186530 - DNA, 20 bp, human
gggagcgccgcaaatgagag

SEQ ID NO: 186531 - DNA, 20 bp, human
gccggtgccgggtgggagag

SEQ ID NO: 186532 - DNA, 20 bp, human
gttaatcaacaggtaaggag

SEQ ID NO: 186533 - DNA, 20 bp, human
gtaaggaggggaggcccgag

SEQ ID NO: 186534 - DNA, 20 bp, human
gagcccgaaagatggtggcg

SEQ ID NO: 186535 - DNA, 20 bp, human
ggatgtgcccggtgccgggt

SEQ ID NO: 186536 - DNA, 20 bp, human
gccccgcagggtggtccggg

SEQ ID NO: 186537 - DNA, 20 bp, human
gccgcggtcgaggatcctgg

SEQ ID NO: 186538 - DNA, 20 bp, human
ggacgtgccgacggaccggg

SEQ ID NO: 186539 - DNA, 20 bp, human
ggcagggtccaggggtagaa

SEQ ID NO: 186540 - DNA, 20 bp, human
gacgcttccgcccggtccgt

SEQ ID NO: 186541 - DNA, 20 bp, human
ggccgacgtgccgacggacc

SEQ ID NO: 186542 - DNA, 20 bp, human
gggaccgggcggaagcgtcg

SEQ ID NO: 186543 - DNA, 20 bp, human
gagcgctgggtgggagtata

SEQ ID NO: 186544 - DNA, 20 bp, human
ggcggcggggacaaacctcc

SEQ ID NO: 186545 - DNA, 20 bp, human
gtactattcctggagaccac

SEQ ID NO: 186546 - DNA, 20 bp, human
gagcgactcctgctagtgca

SEQ ID NO: 186547 - DNA, 20 bp, human
gcgggcccgggaccccacgg

SEQ ID NO: 186548 - DNA, 20 bp, human
gctccttggaagcacctggg

SEQ ID NO: 186549 - DNA, 20 bp, human
gagtcgctgtggacgccctt

SEQ ID NO: 186550 - DNA, 20 bp, human
gggactcaccagctagacgc

SEQ ID NO: 186551 - DNA, 20 bp, human
gtggtctccccgcctccgtg

SEQ ID NO: 186552 - DNA, 20 bp, human
ggggagagctgggctcgtgt

SEQ ID NO: 186553 - DNA, 20 bp, human
gtgcctcaaaggtggtcgtg

SEQ ID NO: 186554 - DNA, 20 bp, human
gctgcatcagccgtcctcgg

SEQ ID NO: 186555 - DNA, 20 bp, human
gggacgcccttcggcactca

SEQ ID NO: 186556 - DNA, 20 bp, human
gcagccggcacggtggagaa

SEQ ID NO: 186557 - DNA, 20 bp, human
gtggctagcctgtcctgaca

SEQ ID NO: 186558 - DNA, 20 bp, human
gccagatggtcagtctctgg

SEQ ID NO: 186559 - DNA, 20 bp, human
gctggagccagggtctgtgt

SEQ ID NO: 186560 - DNA, 20 bp, human
gcaccctggcagcagaggaa

SEQ ID NO: 186561 - DNA, 20 bp, human
gtgtccagatggtcagtctc

SEQ ID NO: 186562 - DNA, 20 bp, human
gcccacctggccagccggca

SEQ ID NO: 186563 - DNA, 20 bp, human
gacctggccagccggcacgg

SEQ ID NO: 186564 - DNA, 20 bp, human
gagcttaactctcccctgtc

SEQ ID NO: 186565 - DNA, 20 bp, human
ggctggggcttgggagtcta

SEQ ID NO: 186566 - DNA, 20 bp, human
gggctggaatgaggcgtcag

SEQ ID NO: 186567 - DNA, 20 bp, human
gcagagggatggctggaatg

SEQ ID NO: 186568 - DNA, 20 bp, human
gggcgggaagctctcattgc

SEQ ID NO: 186569 - DNA, 20 bp, human
gtccctgggtcagcctcggg

SEQ ID NO: 186570 - DNA, 20 bp, human
gaggcccccgggtgggactg

SEQ ID NO: 186571 - DNA, 20 bp, human
gactcaggaacattcccctg

SEQ ID NO: 186572 - DNA, 20 bp, human
ggggcccaaggcccccgggt

SEQ ID NO: 186573 - DNA, 20 bp, human
gtggccctcagaggtcctct

SEQ ID NO: 186574 - DNA, 20 bp, human
gtcaatctcaccactgctgg

SEQ ID NO: 186575 - DNA, 20 bp, human
ggccttgggccccagacatg

SEQ ID NO: 186576 - DNA, 20 bp, human
ggaagtagaagccttcgtgt

SEQ ID NO: 186577 - DNA, 20 bp, human
gcagactccgcaccgggcgg

SEQ ID NO: 186578 - DNA, 20 bp, human
gaccccaagtaccaacacga

SEQ ID NO: 186579 - DNA, 20 bp, human
gcgaaggcttctacttcggt

SEQ ID NO: 186580 - DNA, 20 bp, human
gctcctcccagactccgcac

SEQ ID NO: 186581 - DNA, 20 bp, human
gtcccagactccgcaccggg

SEQ ID NO: 186582 - DNA, 20 bp, human
gactccgcaccgggcggggg

SEQ ID NO: 186583 - DNA, 20 bp, human
ggccttcgtgttggtacttg

SEQ ID NO: 186584 - DNA, 20 bp, human
gggtggagctcaaagcgggg

SEQ ID NO: 186585 - DNA, 20 bp, human
ggtcaacgcgcacgccaagg

SEQ ID NO: 186586 - DNA, 20 bp, human
ggccccacttacctccggga

SEQ ID NO: 186587 - DNA, 20 bp, human
ggccgtcccggaggtaagtg

SEQ ID NO: 186588 - DNA, 20 bp, human
gcccgggccccacttacctc

SEQ ID NO: 186589 - DNA, 20 bp, human
gcggcgcccagccgtcccgg

SEQ ID NO: 186590 - DNA, 20 bp, human
gcgacatgctcaggggccaa

SEQ ID NO: 186591 - DNA, 20 bp, human
gcaggggcgcgaggggacct

SEQ ID NO: 186592 - DNA, 20 bp, human
gtcaggaagcgcggatctcc

SEQ ID NO: 186593 - DNA, 20 bp, human
gcaggggcgcgggagacgga

SEQ ID NO: 186594 - DNA, 20 bp, human
gggggccaagggcaaacctt

SEQ ID NO: 186595 - DNA, 20 bp, human
gggcccctgagcatgtcgga

SEQ ID NO: 186596 - DNA, 20 bp, human
ggagggtctgaggatcacgg

SEQ ID NO: 186597 - DNA, 20 bp, human
gtcagagggtctgaggatca

SEQ ID NO: 186598 - DNA, 20 bp, human
gtctgaggatcacggcggta

SEQ ID NO: 186599 - DNA, 20 bp, human
gtgcatgcaggtgcgctgag

SEQ ID NO: 186600 - DNA, 20 bp, human
gtggcgaaagaaacaggtct

SEQ ID NO: 186601 - DNA, 20 bp, human
gtagggccacggatcgttct

SEQ ID NO: 186602 - DNA, 20 bp, human
gtcatatgctgcagcagaag

SEQ ID NO: 186603 - DNA, 20 bp, human
gggcttcctagaacgatccg

SEQ ID NO: 186604 - DNA, 20 bp, human
ggtgtgtgcatgcagtatgt

SEQ ID NO: 186605 - DNA, 20 bp, human
ggtctgcaaggagaagacat

SEQ ID NO: 186606 - DNA, 20 bp, human
gggtgccaaacaaagacggg

SEQ ID NO: 186607 - DNA, 20 bp, human
ggcaccatctgtccagccaa

SEQ ID NO: 186608 - DNA, 20 bp, human
gcccaaggaactcgtcagga

SEQ ID NO: 186609 - DNA, 20 bp, human
gacctctacagggagacggt

SEQ ID NO: 186610 - DNA, 20 bp, human
gagccggccctacaccccat

SEQ ID NO: 186611 - DNA, 20 bp, human
ggactcccaaggaactcgtc

SEQ ID NO: 186612 - DNA, 20 bp, human
ggccctctccaaactggctg

SEQ ID NO: 186613 - DNA, 20 bp, human
ggacacatcagcccccccaa

SEQ ID NO: 186614 - DNA, 20 bp, human
gccagcagccccagccagtt

SEQ ID NO: 186615 - DNA, 20 bp, human
gagccccagccagtttggag

SEQ ID NO: 186616 - DNA, 20 bp, human
gcggccgagcggttgcgacg

SEQ ID NO: 186617 - DNA, 20 bp, human
ggcaggccgcacccacttgg

SEQ ID NO: 186618 - DNA, 20 bp, human
gcgggacggcgaccaaagga

SEQ ID NO: 186619 - DNA, 20 bp, human
gaccaaaggagggaaccgga

SEQ ID NO: 186620 - DNA, 20 bp, human
ggtgagctgagaggtcgggt

SEQ ID NO: 186621 - DNA, 20 bp, human
gtgcgacgagggctcggctg

SEQ ID NO: 186622 - DNA, 20 bp, human
ggtcccgcccccgcttaaag

SEQ ID NO: 186623 - DNA, 20 bp, human
gcgcccgggacggcgaccaa

SEQ ID NO: 186624 - DNA, 20 bp, human
ggctgagaggaagctgtggg

SEQ ID NO: 186625 - DNA, 20 bp, human
gcaggcccggcccgcgaccc

SEQ ID NO: 186626 - DNA, 20 bp, human
gtccacgatgaaacaggtct

SEQ ID NO: 186627 - DNA, 20 bp, human
gagtatggccgcttctgagg

SEQ ID NO: 186628 - DNA, 20 bp, human
gaccaccgccgcctcagaag

SEQ ID NO: 186629 - DNA, 20 bp, human
gcaggaatctcgggcatctc

SEQ ID NO: 186630 - DNA, 20 bp, human
gcaggtactgcagcccgggt

SEQ ID NO: 186631 - DNA, 20 bp, human
gaacaggtctgcacgcccaa

SEQ ID NO: 186632 - DNA, 20 bp, human
gctgtccagagctaattcaa

SEQ ID NO: 186633 - DNA, 20 bp, human
gtgaggaagagggtcctgtc

SEQ ID NO: 186634 - DNA, 20 bp, human
ggcgagaggggaagcacatt

SEQ ID NO: 186635 - DNA, 20 bp, human
gtgaggcggtcgctgcgaga

SEQ ID NO: 186636 - DNA, 20 bp, human
gagcacccgctggacctgga

SEQ ID NO: 186637 - DNA, 20 bp, human
gatactgccctctgcaccat

SEQ ID NO: 186638 - DNA, 20 bp, human
gaagcacctgcgggatacag

SEQ ID NO: 186639 - DNA, 20 bp, human
gtggcttgtcgcggctgcat

SEQ ID NO: 186640 - DNA, 20 bp, human
ggaaggcatgtaggccaagt

SEQ ID NO: 186641 - DNA, 20 bp, human
gtcacgtgacctattcacct

SEQ ID NO: 186642 - DNA, 20 bp, human
gtaggctacgccgtcagaat

SEQ ID NO: 186643 - DNA, 20 bp, human
gcgcggtctataagcccccg

SEQ ID NO: 186644 - DNA, 20 bp, human
gcttgggggattagacaaca

SEQ ID NO: 186645 - DNA, 20 bp, human
ggtgctgtgatcttcaagta

SEQ ID NO: 186646 - DNA, 20 bp, human
gaggctgtgagcagtaccgg

SEQ ID NO: 186647 - DNA, 20 bp, human
gcgcatgtgtgtcaactcta

SEQ ID NO: 186648 - DNA, 20 bp, human
ggtgaggctgtgagcagtac

SEQ ID NO: 186649 - DNA, 20 bp, human
gaaggctagaccaaaagagt

SEQ ID NO: 186650 - DNA, 20 bp, human
gggaccgtgaaggctaagaa

SEQ ID NO: 186651 - DNA, 20 bp, human
gcatacagccattagtccag

SEQ ID NO: 186652 - DNA, 20 bp, human
gagcaacaggtggactagag

SEQ ID NO: 186653 - DNA, 20 bp, human
ggagcagtaccggagggtga

SEQ ID NO: 186654 - DNA, 20 bp, human
gggcgcaggcgccaaggctc

SEQ ID NO: 186655 - DNA, 20 bp, human
ggtgtgtcaactctagggtt

SEQ ID NO: 186656 - DNA, 20 bp, human
gggccttggccctttcacga

SEQ ID NO: 186657 - DNA, 20 bp, human
gctgtgaggtaaacagctga

SEQ ID NO: 186658 - DNA, 20 bp, human
gctgagggggaggagacggt

SEQ ID NO: 186659 - DNA, 20 bp, human
gtgctgtacgtccaagatgg

SEQ ID NO: 186660 - DNA, 20 bp, human
gggagacggtgggtgagtat

SEQ ID NO: 186661 - DNA, 20 bp, human
gacagtccctccagcctaca

SEQ ID NO: 186662 - DNA, 20 bp, human
gggttcacgctaggtgcgga

SEQ ID NO: 186663 - DNA, 20 bp, human
gaggtgctgtacgtccaaga

SEQ ID NO: 186664 - DNA, 20 bp, human
ggtcagtccctcacttggtg

SEQ ID NO: 186665 - DNA, 20 bp, human
gtagagacgcttggcgggag

SEQ ID NO: 186666 - DNA, 20 bp, human
ggggaacgcagggccgcacg

SEQ ID NO: 186667 - DNA, 20 bp, human
gttggggcgaaagggggcag

SEQ ID NO: 186668 - DNA, 20 bp, human
ggctccgggccgccccgacg

SEQ ID NO: 186669 - DNA, 20 bp, human
ggccgccccgacgcggagaa

SEQ ID NO: 186670 - DNA, 20 bp, human
gcaggcacctaggaaagccc

SEQ ID NO: 186671 - DNA, 20 bp, human
ggtgcgggtcgcgcttccgg

SEQ ID NO: 186672 - DNA, 20 bp, human
gcgacccgcacttccggtag

SEQ ID NO: 186673 - DNA, 20 bp, human
gggaaagcccgggagacacc

SEQ ID NO: 186674 - DNA, 20 bp, human
gatgccgctaccggaagtgc

SEQ ID NO: 186675 - DNA, 20 bp, human
gagctcgcaaacaggcacct

SEQ ID NO: 186676 - DNA, 20 bp, human
gtctagagctgagtggagcc

SEQ ID NO: 186677 - DNA, 20 bp, human
gggatcccagtgccgtgaag

SEQ ID NO: 186678 - DNA, 20 bp, human
gtctgggaagcgcctcttca

SEQ ID NO: 186679 - DNA, 20 bp, human
ggcttcccagatccgcagcc

SEQ ID NO: 186680 - DNA, 20 bp, human
gtggagcccggctgcggatc

SEQ ID NO: 186681 - DNA, 20 bp, human
gtctagggcttgatgatccc

SEQ ID NO: 186682 - DNA, 20 bp, human
ggaccagtggcgatggatct

SEQ ID NO: 186683 - DNA, 20 bp, human
gtcccaatggtgtagaccag

SEQ ID NO: 186684 - DNA, 20 bp, human
gctgggatccgcatctgcct

SEQ ID NO: 186685 - DNA, 20 bp, human
gctccactcagctctagacc

SEQ ID NO: 186686 - DNA, 20 bp, human
gccccatcttggcccagcgg

SEQ ID NO: 186687 - DNA, 20 bp, human
gggcagtcgacatgtccctg

SEQ ID NO: 186688 - DNA, 20 bp, human
gggctgcccggagacgagag

SEQ ID NO: 186689 - DNA, 20 bp, human
ggcagcggcggcattttagt

SEQ ID NO: 186690 - DNA, 20 bp, human
gtgagctccggctagagccg

SEQ ID NO: 186691 - DNA, 20 bp, human
gccctccgctgggccaagat

SEQ ID NO: 186692 - DNA, 20 bp, human
gggcttctctcagagagggg

SEQ ID NO: 186693 - DNA, 20 bp, human
ggagagcgcgaacccagggg

SEQ ID NO: 186694 - DNA, 20 bp, human
gaccgctggcacgggaccgg

SEQ ID NO: 186695 - DNA, 20 bp, human
gcgcggcttctctcagagag

SEQ ID NO: 186696 - DNA, 20 bp, human
gcgcggggaacagggaccgg

SEQ ID NO: 186697 - DNA, 20 bp, human
gtgaagggaagtgactcgag

SEQ ID NO: 186698 - DNA, 20 bp, human
gcgctccagctggagttgaa

SEQ ID NO: 186699 - DNA, 20 bp, human
gccccgcggtgcagcatcct

SEQ ID NO: 186700 - DNA, 20 bp, human
gtcgatgacggatcccagag

SEQ ID NO: 186701 - DNA, 20 bp, human
ggtggagtttgtgacatacg

SEQ ID NO: 186702 - DNA, 20 bp, human
gtccggcgcctcccgagccg

SEQ ID NO: 186703 - DNA, 20 bp, human
gcgccagtccaacccagact

SEQ ID NO: 186704 - DNA, 20 bp, human
gggtagaccgccacctccat

SEQ ID NO: 186705 - DNA, 20 bp, human
gatgtatcagacccccatgg

SEQ ID NO: 186706 - DNA, 20 bp, human
gggagcagtcagcaggcccg

SEQ ID NO: 186707 - DNA, 20 bp, human
ggagccgaggagcggagaca

SEQ ID NO: 186708 - DNA, 20 bp, human
gggccgaggccccagaggta

SEQ ID NO: 186709 - DNA, 20 bp, human
gtccgctcctcggctcccct

SEQ ID NO: 186710 - DNA, 20 bp, human
gaccctcaggctcagatcag

SEQ ID NO: 186711 - DNA, 20 bp, human
ggcacgcaggcggcgatcag

SEQ ID NO: 186712 - DNA, 20 bp, human
gccggtggcagccagcgagt

SEQ ID NO: 186713 - DNA, 20 bp, human
gcttaggcgccgggaccctc

SEQ ID NO: 186714 - DNA, 20 bp, human
gggcttcagaggccgctcct

SEQ ID NO: 186715 - DNA, 20 bp, human
gggtcacgcgggaggagact

SEQ ID NO: 186716 - DNA, 20 bp, human
ggcgggtcgtggtgcaccac

SEQ ID NO: 186717 - DNA, 20 bp, human
gccgtccaggcccctaaccc

SEQ ID NO: 186718 - DNA, 20 bp, human
gacctagacagcaaaactag

SEQ ID NO: 186719 - DNA, 20 bp, human
ggcgattccgagccgacccc

SEQ ID NO: 186720 - DNA, 20 bp, human
ggggatctccggcttgagag

SEQ ID NO: 186721 - DNA, 20 bp, human
gacccaggcagaacactccc

SEQ ID NO: 186722 - DNA, 20 bp, human
gagcgcttattagggatctc

SEQ ID NO: 186723 - DNA, 20 bp, human
gatctccggcttgagagggg

SEQ ID NO: 186724 - DNA, 20 bp, human
ggaggggcggagttactgtc

SEQ ID NO: 186725 - DNA, 20 bp, human
gtaaggtcaggaggcgcgag

SEQ ID NO: 186726 - DNA, 20 bp, human
ggagcgcgtggggccaagaa

SEQ ID NO: 186727 - DNA, 20 bp, human
ggccggcgttgccggggtaa

SEQ ID NO: 186728 - DNA, 20 bp, human
gcaagaaaggtaagggccct

SEQ ID NO: 186729 - DNA, 20 bp, human
gcgtggggccaagaaaggta

SEQ ID NO: 186730 - DNA, 20 bp, human
gcggcgtttccaagaaccaa

SEQ ID NO: 186731 - DNA, 20 bp, human
ggcgcacgaggaaagcgcgg

SEQ ID NO: 186732 - DNA, 20 bp, human
gttagggaggcaaggatgaa

SEQ ID NO: 186733 - DNA, 20 bp, human
ggccgcgctttcctcgccca

SEQ ID NO: 186734 - DNA, 20 bp, human
ggcgcggaggagtcagtgac

SEQ ID NO: 186735 - DNA, 20 bp, human
ggcacctcctgggcttaggg

SEQ ID NO: 186736 - DNA, 20 bp, human
ggtgcgctggcgctcggagg

SEQ ID NO: 186737 - DNA, 20 bp, human
gggtgcgctgcagcggtctg

SEQ ID NO: 186738 - DNA, 20 bp, human
ggacagtgggacattctgaa

SEQ ID NO: 186739 - DNA, 20 bp, human
gtggcgcggtgcgcagtggg

SEQ ID NO: 186740 - DNA, 20 bp, human
gcccgccccctgaggcctag

SEQ ID NO: 186741 - DNA, 20 bp, human
gggcgggaactccccaactg

SEQ ID NO: 186742 - DNA, 20 bp, human
ggcgccagcgcaccccagtt

SEQ ID NO: 186743 - DNA, 20 bp, human
gtgacgggaacacccgaagg

SEQ ID NO: 186744 - DNA, 20 bp, human
gcccagcaggtggtgaacgg

SEQ ID NO: 186745 - DNA, 20 bp, human
gcgtcagcggtcagaagctc

SEQ ID NO: 186746 - DNA, 20 bp, human
gcgccccgcgggaacctcca

SEQ ID NO: 186747 - DNA, 20 bp, human
ggacgccggccgcagacggg

SEQ ID NO: 186748 - DNA, 20 bp, human
ggctctggacttagacccaa

SEQ ID NO: 186749 - DNA, 20 bp, human
gcgggggcagaggtgacctg

SEQ ID NO: 186750 - DNA, 20 bp, human
gtagacaccccgggtctgac

SEQ ID NO: 186751 - DNA, 20 bp, human
gcccaagggctagacacccc

SEQ ID NO: 186752 - DNA, 20 bp, human
gctgggcccgcccctctcac

SEQ ID NO: 186753 - DNA, 20 bp, human
gcaccccgggtctgactggt

SEQ ID NO: 186754 - DNA, 20 bp, human
gccggtgccgggaagagctc

SEQ ID NO: 186755 - DNA, 20 bp, human
gccgagtggaggccagaaga

SEQ ID NO: 186756 - DNA, 20 bp, human
ggcgcggaccgggagctacc

SEQ ID NO: 186757 - DNA, 20 bp, human
gaggccgaggcagacagacg

SEQ ID NO: 186758 - DNA, 20 bp, human
gcgccggagggtgtttatcg

SEQ ID NO: 186759 - DNA, 20 bp, human
gagccgcgataaacaccctc

SEQ ID NO: 186760 - DNA, 20 bp, human
ggcgtcagtcgccccagcca

SEQ ID NO: 186761 - DNA, 20 bp, human
gtccggcgggcgcactggtg

SEQ ID NO: 186762 - DNA, 20 bp, human
ggcggacagtgtgcaaaggg

SEQ ID NO: 186763 - DNA, 20 bp, human
gtgaagctgcggcggaaaac

SEQ ID NO: 186764 - DNA, 20 bp, human
gtagagagatgtcgctgctg

SEQ ID NO: 186765 - DNA, 20 bp, human
gatgaggagctccttgctgg

SEQ ID NO: 186766 - DNA, 20 bp, human
gggacggcgacagtcaacaa

SEQ ID NO: 186767 - DNA, 20 bp, human
ggattgtgtgggacggtctg

SEQ ID NO: 186768 - DNA, 20 bp, human
gtgggggtgtgcgattgtgt

SEQ ID NO: 186769 - DNA, 20 bp, human
ggacagggcgcggaagggag

SEQ ID NO: 186770 - DNA, 20 bp, human
gggccgggacggactcgaca

SEQ ID NO: 186771 - DNA, 20 bp, human
gcagagggtcagccgctgct

SEQ ID NO: 186772 - DNA, 20 bp, human
gagtcaacaaaggcgtggag

SEQ ID NO: 186773 - DNA, 20 bp, human
gcggcccggaagtgacgtag

SEQ ID NO: 186774 - DNA, 20 bp, human
gccccgtacgggagctggga

SEQ ID NO: 186775 - DNA, 20 bp, human
ggcctcaaacaacaggaagt

SEQ ID NO: 186776 - DNA, 20 bp, human
ggcttgtagaccccgcgaga

SEQ ID NO: 186777 - DNA, 20 bp, human
gccctcctaggtgccctgta

SEQ ID NO: 186778 - DNA, 20 bp, human
gcagctctcggcctcagcgg

SEQ ID NO: 186779 - DNA, 20 bp, human
gtgagctctgggcaggacgg

SEQ ID NO: 186780 - DNA, 20 bp, human
gggccgagagctgacagtcg

SEQ ID NO: 186781 - DNA, 20 bp, human
gccaccccaagtctagaaag

SEQ ID NO: 186782 - DNA, 20 bp, human
ggccttacagggcacctagg

SEQ ID NO: 186783 - DNA, 20 bp, human
gactccggtacagagcgtga

SEQ ID NO: 186784 - DNA, 20 bp, human
gtggaagacgagccccactc

SEQ ID NO: 186785 - DNA, 20 bp, human
ggacgcgaagcagtgaccat

SEQ ID NO: 186786 - DNA, 20 bp, human
gggctccaggaaccagaacg

SEQ ID NO: 186787 - DNA, 20 bp, human
ggtgaccagggcaggacgtg

SEQ ID NO: 186788 - DNA, 20 bp, human
ggaccccgtcggtgtgacca

SEQ ID NO: 186789 - DNA, 20 bp, human
gggccattcagggaacactg

SEQ ID NO: 186790 - DNA, 20 bp, human
ggcgcaatggtgacaaatct

SEQ ID NO: 186791 - DNA, 20 bp, human
ggtccagatgaaactcaggg

SEQ ID NO: 186792 - DNA, 20 bp, human
gcagttggttaggaccccgt

SEQ ID NO: 186793 - DNA, 20 bp, human
gcatttgggagtgcagtcca

SEQ ID NO: 186794 - DNA, 20 bp, human
gtgggacagggaccacaggg

SEQ ID NO: 186795 - DNA, 20 bp, human
gggagtgggacagggaccac

SEQ ID NO: 186796 - DNA, 20 bp, human
ggtggaaagcccatagacaa

SEQ ID NO: 186797 - DNA, 20 bp, human
ggtgaagaaggcaaagtctt

SEQ ID NO: 186798 - DNA, 20 bp, human
gctaaacctgtgggcttcat

SEQ ID NO: 186799 - DNA, 20 bp, human
gaaggcaaagtctttggcat

SEQ ID NO: 186800 - DNA, 20 bp, human
ggacataaacccttgtctat

SEQ ID NO: 186801 - DNA, 20 bp, human
gaaattcctatgaagcccac

SEQ ID NO: 186802 - DNA, 20 bp, human
gattgggcagtataagtctt

SEQ ID NO: 186803 - DNA, 20 bp, human
ggggctttccactaaacctg

SEQ ID NO: 186804 - DNA, 20 bp, human
gacatcacgaaatcatagtt

SEQ ID NO: 186805 - DNA, 20 bp, human
gaaaaatgagctgtcaaatt

SEQ ID NO: 186806 - DNA, 20 bp, human
gcaccaatgcaaagtaaggt

SEQ ID NO: 186807 - DNA, 20 bp, human
gtgctcaccaatgcaaagta

SEQ ID NO: 186808 - DNA, 20 bp, human
gaactacctacataaggata

SEQ ID NO: 186809 - DNA, 20 bp, human
gcacctaccttactttgcat

SEQ ID NO: 186810 - DNA, 20 bp, human
gattgtttagtagtagatgg

SEQ ID NO: 186811 - DNA, 20 bp, human
gcagagtacattaccccagc

SEQ ID NO: 186812 - DNA, 20 bp, human
gcattagtacagtaattgag

SEQ ID NO: 186813 - DNA, 20 bp, human
gctgattagttccctaatga

SEQ ID NO: 186814 - DNA, 20 bp, human
ggaatttgctctaacattcc

SEQ ID NO: 186815 - DNA, 20 bp, human
ggtaggtgtctatagtgaga

SEQ ID NO: 186816 - DNA, 20 bp, human
ggagtacccgggagagatca

SEQ ID NO: 186817 - DNA, 20 bp, human
gtagcaacgagaatcctcca

SEQ ID NO: 186818 - DNA, 20 bp, human
gagtggctcccaggcagaca

SEQ ID NO: 186819 - DNA, 20 bp, human
gcgcctctgaccctcagcag

SEQ ID NO: 186820 - DNA, 20 bp, human
gactgcaggggccactccgg

SEQ ID NO: 186821 - DNA, 20 bp, human
gtctagaaggctacacgcta

SEQ ID NO: 186822 - DNA, 20 bp, human
gccaactgcaggggccactc

SEQ ID NO: 186823 - DNA, 20 bp, human
gctccggtggttgagtcgac

SEQ ID NO: 186824 - DNA, 20 bp, human
gccgcaccgcgggctagcca

SEQ ID NO: 186825 - DNA, 20 bp, human
gccgcggacagtccactccg

SEQ ID NO: 186826 - DNA, 20 bp, human
ggagcagacattcactgggt

SEQ ID NO: 186827 - DNA, 20 bp, human
gccggcgcatgtatgtacgg

SEQ ID NO: 186828 - DNA, 20 bp, human
ggtgaagagcagacattcac

SEQ ID NO: 186829 - DNA, 20 bp, human
gacccggagagtgtgtgcaa

SEQ ID NO: 186830 - DNA, 20 bp, human
gtgcgccggggggagatgtc

SEQ ID NO: 186831 - DNA, 20 bp, human
gtccccgcacttagtctaag

SEQ ID NO: 186832 - DNA, 20 bp, human
gctctctcccaggagtttga

SEQ ID NO: 186833 - DNA, 20 bp, human
gccaggagtttgaggggggg

SEQ ID NO: 186834 - DNA, 20 bp, human
gcagcctgcatcggcctcgc

SEQ ID NO: 186835 - DNA, 20 bp, human
gagcgcctgacatctccccc

SEQ ID NO: 186836 - DNA, 20 bp, human
gggcaatcctgggaaggtag

SEQ ID NO: 186837 - DNA, 20 bp, human
gacacacacaagacagggcg

SEQ ID NO: 186838 - DNA, 20 bp, human
gttcggatggaagggacgag

SEQ ID NO: 186839 - DNA, 20 bp, human
gacactcgcgcgtaaagata

SEQ ID NO: 186840 - DNA, 20 bp, human
gtatgcgagaggacaggagc

SEQ ID NO: 186841 - DNA, 20 bp, human
gatcaggtcgcggggagagg

SEQ ID NO: 186842 - DNA, 20 bp, human
ggccatagagatcggcgagg

SEQ ID NO: 186843 - DNA, 20 bp, human
gaaaaaaggcaatcctggga

SEQ ID NO: 186844 - DNA, 20 bp, human
ggtcttgtgtgtgtgtgcga

SEQ ID NO: 186845 - DNA, 20 bp, human
gatagagatcggcgaggagg

SEQ ID NO: 186846 - DNA, 20 bp, human
ggggcgcccggtacccgagg

SEQ ID NO: 186847 - DNA, 20 bp, human
ggccgcgaaccccgaacgtg

SEQ ID NO: 186848 - DNA, 20 bp, human
gctcagtgcgggcagaagag

SEQ ID NO: 186849 - DNA, 20 bp, human
ggcccgcactgagtaactcc

SEQ ID NO: 186850 - DNA, 20 bp, human
gcgcgagcggctccccaaat

SEQ ID NO: 186851 - DNA, 20 bp, human
gtccccaaatgggtgcgaga

SEQ ID NO: 186852 - DNA, 20 bp, human
ggagaagcatcatgccgagg

SEQ ID NO: 186853 - DNA, 20 bp, human
gcgaacgtgcggagggaaga

SEQ ID NO: 186854 - DNA, 20 bp, human
gccggagagctgaggaggta

SEQ ID NO: 186855 - DNA, 20 bp, human
gccggagaagcatcatgccg

SEQ ID NO: 186856 - DNA, 20 bp, human
gagtaggtaggaagtctcag

SEQ ID NO: 186857 - DNA, 20 bp, human
ggaggaaggagcccctccct

SEQ ID NO: 186858 - DNA, 20 bp, human
ggagccagacccccacacca

SEQ ID NO: 186859 - DNA, 20 bp, human
gggtaggaagtctcagagga

SEQ ID NO: 186860 - DNA, 20 bp, human
gcacaccatggcgagcgtgg

SEQ ID NO: 186861 - DNA, 20 bp, human
gcgtggtggtgaagacgatc

SEQ ID NO: 186862 - DNA, 20 bp, human
ggtctgtggtcacagtaggt

SEQ ID NO: 186863 - DNA, 20 bp, human
gggaaaagccagcaggtcgg

SEQ ID NO: 186864 - DNA, 20 bp, human
gtgtgggggtctggctccca

SEQ ID NO: 186865 - DNA, 20 bp, human
gacccacccgtggaacgaca

SEQ ID NO: 186866 - DNA, 20 bp, human
gcaaagccacggacacacaa

SEQ ID NO: 186867 - DNA, 20 bp, human
gggcccgcaaacgtggacac

SEQ ID NO: 186868 - DNA, 20 bp, human
gcgcctcggcacgctcaccc

SEQ ID NO: 186869 - DNA, 20 bp, human
gaagcagccgcgcaaagcca

SEQ ID NO: 186870 - DNA, 20 bp, human
ggaggtcttgcgggagacaa

SEQ ID NO: 186871 - DNA, 20 bp, human
gcgccggggtgagcgtgccg

SEQ ID NO: 186872 - DNA, 20 bp, human
gcaggtgagtgcagttcccc

SEQ ID NO: 186873 - DNA, 20 bp, human
gcaggcaccgaccacgtacg

SEQ ID NO: 186874 - DNA, 20 bp, human
gagtggggaacgccgaccca

SEQ ID NO: 186875 - DNA, 20 bp, human
gaagcgcaggcccgcaaacg

SEQ ID NO: 186876 - DNA, 20 bp, human
gcgagccgggtaaaagtggt

SEQ ID NO: 186877 - DNA, 20 bp, human
gcctgggcaccagatagcta

SEQ ID NO: 186878 - DNA, 20 bp, human
gtgattccgggtatcaacgt

SEQ ID NO: 186879 - DNA, 20 bp, human
gcaaacgagccgggtaaaag

SEQ ID NO: 186880 - DNA, 20 bp, human
gcaatgtggctgctcatagg

SEQ ID NO: 186881 - DNA, 20 bp, human
gtggtgagaattgagtgaaa

SEQ ID NO: 186882 - DNA, 20 bp, human
ggtatcagaaccgtagaaat

SEQ ID NO: 186883 - DNA, 20 bp, human
gttagacccacgttgatacc

SEQ ID NO: 186884 - DNA, 20 bp, human
gcagccggcggtgggattga

SEQ ID NO: 186885 - DNA, 20 bp, human
gaggcaatgtggctgctcat

SEQ ID NO: 186886 - DNA, 20 bp, human
gtcagccagtgtagcaaggg

SEQ ID NO: 186887 - DNA, 20 bp, human
gtaagaccggggggacgcgg

SEQ ID NO: 186888 - DNA, 20 bp, human
gcaatcagccagtgtagcaa

SEQ ID NO: 186889 - DNA, 20 bp, human
gccagcgcaatcaatcgcaa

SEQ ID NO: 186890 - DNA, 20 bp, human
ggtcgtggcgtaagaccggg

SEQ ID NO: 186891 - DNA, 20 bp, human
gtgattgcgctggttgcctg

SEQ ID NO: 186892 - DNA, 20 bp, human
gggcccaactaggcatggaa

SEQ ID NO: 186893 - DNA, 20 bp, human
gcgggcgaagtggcccaact

SEQ ID NO: 186894 - DNA, 20 bp, human
gaggaaaactgacacaaacg

SEQ ID NO: 186895 - DNA, 20 bp, human
ggcccgagactgagcgacag

SEQ ID NO: 186896 - DNA, 20 bp, human
gccgccgtgagcgcccggag

SEQ ID NO: 186897 - DNA, 20 bp, human
gacccagcaagtaggcgctg

SEQ ID NO: 186898 - DNA, 20 bp, human
ggttcagaccccaggtcggt

SEQ ID NO: 186899 - DNA, 20 bp, human
ggcccagagcccaccgacct

SEQ ID NO: 186900 - DNA, 20 bp, human
ggcctacttgctgggtgcaa

SEQ ID NO: 186901 - DNA, 20 bp, human
gtggaggtcagtgccgtccc

SEQ ID NO: 186902 - DNA, 20 bp, human
gagcggtccgcgagccaccg

SEQ ID NO: 186903 - DNA, 20 bp, human
ggacctccaggcgcaggcac

SEQ ID NO: 186904 - DNA, 20 bp, human
gaggcgctggggcgctcccc

SEQ ID NO: 186905 - DNA, 20 bp, human
ggtggctcgcggaccgctcc

SEQ ID NO: 186906 - DNA, 20 bp, human
ggtacaggccgagggaacct

SEQ ID NO: 186907 - DNA, 20 bp, human
gtctaaggcgagggccctgt

SEQ ID NO: 186908 - DNA, 20 bp, human
gcagcctacggtgagacgag

SEQ ID NO: 186909 - DNA, 20 bp, human
gcgggccgactacaacgcag

SEQ ID NO: 186910 - DNA, 20 bp, human
gtgcgcgaggtacaggccga

SEQ ID NO: 186911 - DNA, 20 bp, human
ggccgcccccgagtctacaa

SEQ ID NO: 186912 - DNA, 20 bp, human
gtctgcggagaaagcctcta

SEQ ID NO: 186913 - DNA, 20 bp, human
gggacgaaggcatccttcaa

SEQ ID NO: 186914 - DNA, 20 bp, human
gccgagtctacaagggacga

SEQ ID NO: 186915 - DNA, 20 bp, human
gtgagacgagcggagactga

SEQ ID NO: 186916 - DNA, 20 bp, human
gtgctggagccctagatcaa

SEQ ID NO: 186917 - DNA, 20 bp, human
ggcctctgaccattgatcta

SEQ ID NO: 186918 - DNA, 20 bp, human
gaggccagcaggaggtgcag

SEQ ID NO: 186919 - DNA, 20 bp, human
gctgtagtggttgactctca

SEQ ID NO: 186920 - DNA, 20 bp, human
gtccagcaccacagagtcaa

SEQ ID NO: 186921 - DNA, 20 bp, human
gggcgggcaatcagcacccg

SEQ ID NO: 186922 - DNA, 20 bp, human
gtacgtgctagcaaaacggt

SEQ ID NO: 186923 - DNA, 20 bp, human
ggagtaggacaaagtagcaa

SEQ ID NO: 186924 - DNA, 20 bp, human
ggccctagatcaatggtcag

SEQ ID NO: 186925 - DNA, 20 bp, human
gcaggccatgacccacgggc

SEQ ID NO: 186926 - DNA, 20 bp, human
gccgggtgttgccactgagt

SEQ ID NO: 186927 - DNA, 20 bp, human
gggtcctgggtagtatagag

SEQ ID NO: 186928 - DNA, 20 bp, human
ggtgttgccactgagtgggc

SEQ ID NO: 186929 - DNA, 20 bp, human
gtctgtgtcagaccaggtac

SEQ ID NO: 186930 - DNA, 20 bp, human
gaactgctgaggctccacaa

SEQ ID NO: 186931 - DNA, 20 bp, human
gggagaagcttggtgagata

SEQ ID NO: 186932 - DNA, 20 bp, human
ggggtagtatagaggggtaa

SEQ ID NO: 186933 - DNA, 20 bp, human
ggccagatatgccagacccc

SEQ ID NO: 186934 - DNA, 20 bp, human
ggcagtggtgtgtgagagcc

SEQ ID NO: 186935 - DNA, 20 bp, human
gggcagtgagttctgaaaga

SEQ ID NO: 186936 - DNA, 20 bp, human
gcctaggagatgcaggtcca

SEQ ID NO: 186937 - DNA, 20 bp, human
gcatctcctaggggccgtgt

SEQ ID NO: 186938 - DNA, 20 bp, human
gagagtacacaagtatgagg

SEQ ID NO: 186939 - DNA, 20 bp, human
ggtatgaggtggatgtgagg

SEQ ID NO: 186940 - DNA, 20 bp, human
gctgagagtacacaagtatg

SEQ ID NO: 186941 - DNA, 20 bp, human
gagcttctgggcacttctag

SEQ ID NO: 186942 - DNA, 20 bp, human
gcaagtatgaggtggatgtg

SEQ ID NO: 186943 - DNA, 20 bp, human
gtgtctgaggccgggagaat

SEQ ID NO: 186944 - DNA, 20 bp, human
gctcctaggggccgtgtggg

SEQ ID NO: 186945 - DNA, 20 bp, human
gctgtgcagttaggagtgta

SEQ ID NO: 186946 - DNA, 20 bp, human
gggagccagcgaacctctcc

SEQ ID NO: 186947 - DNA, 20 bp, human
gggcgccgggagaggttcgc

SEQ ID NO: 186948 - DNA, 20 bp, human
gtgcctggttggccagactg

SEQ ID NO: 186949 - DNA, 20 bp, human
gggctcacctgggacagtaa

SEQ ID NO: 186950 - DNA, 20 bp, human
gccttgcagccagcctccaa

SEQ ID NO: 186951 - DNA, 20 bp, human
gatctccctgagggccttgg

SEQ ID NO: 186952 - DNA, 20 bp, human
gtcactagaagcaaaaggac

SEQ ID NO: 186953 - DNA, 20 bp, human
ggttccagcgtcaaggatgg

SEQ ID NO: 186954 - DNA, 20 bp, human
gcgctggctcctctgtggct

SEQ ID NO: 186955 - DNA, 20 bp, human
ggggccttgggggcaatctt

SEQ ID NO: 186956 - DNA, 20 bp, human
gctgccaggggctccggaag

SEQ ID NO: 186957 - DNA, 20 bp, human
gtctgcacttaccctgccag

SEQ ID NO: 186958 - DNA, 20 bp, human
gcgcctagagagactgagag

SEQ ID NO: 186959 - DNA, 20 bp, human
ggacggcacgaggccctcag

SEQ ID NO: 186960 - DNA, 20 bp, human
gtcgccgcttccggagcccc

SEQ ID NO: 186961 - DNA, 20 bp, human
gggcccagagctctctccca

SEQ ID NO: 186962 - DNA, 20 bp, human
gaagcgcgcccgaggagtgg

SEQ ID NO: 186963 - DNA, 20 bp, human
gatgccccgggcacgctgga

SEQ ID NO: 186964 - DNA, 20 bp, human
gagaggaacagacatgcccc

SEQ ID NO: 186965 - DNA, 20 bp, human
ggtgccgtccagcgtgcccg

SEQ ID NO: 186966 - DNA, 20 bp, human
ggcacggcgggggctcatcg

SEQ ID NO: 186967 - DNA, 20 bp, human
gccggactcggagaggactt

SEQ ID NO: 186968 - DNA, 20 bp, human
ggcctcgtccggactcggag

SEQ ID NO: 186969 - DNA, 20 bp, human
gactcggagaggacttggga

SEQ ID NO: 186970 - DNA, 20 bp, human
gccgagtccggacgaggcag

SEQ ID NO: 186971 - DNA, 20 bp, human
gagtccggacgaggcagcgg

SEQ ID NO: 186972 - DNA, 20 bp, human
gtcctctccgagtccggacg

SEQ ID NO: 186973 - DNA, 20 bp, human
ggcggacgcgatggctgggt

SEQ ID NO: 186974 - DNA, 20 bp, human
ggcccgcctggggatagtcg

SEQ ID NO: 186975 - DNA, 20 bp, human
gtgtgtgctaaactacttaa

SEQ ID NO: 186976 - DNA, 20 bp, human
gcgctccgccgaccgggatc

SEQ ID NO: 186977 - DNA, 20 bp, human
ggagccccaggccagagcgg

SEQ ID NO: 186978 - DNA, 20 bp, human
gggggcagcaacgcagacgt

SEQ ID NO: 186979 - DNA, 20 bp, human
gcaacgcagacgtgggtggg

SEQ ID NO: 186980 - DNA, 20 bp, human
gggacccgctttggaacctg

SEQ ID NO: 186981 - DNA, 20 bp, human
gcagcaacgcagacgtgggt

SEQ ID NO: 186982 - DNA, 20 bp, human
ggccgggggcgcgcagacgt

SEQ ID NO: 186983 - DNA, 20 bp, human
gtgcagctgccggcaaccac

SEQ ID NO: 186984 - DNA, 20 bp, human
gacgtgggaagccgggaagg

SEQ ID NO: 186985 - DNA, 20 bp, human
gggacggatggtgaggccgg

SEQ ID NO: 186986 - DNA, 20 bp, human
ggaagttagagcaagttccg

SEQ ID NO: 186987 - DNA, 20 bp, human
gtgagtagagcgcggagacc

SEQ ID NO: 186988 - DNA, 20 bp, human
ggtgggtgactgagccgaaa

SEQ ID NO: 186989 - DNA, 20 bp, human
ggaacttgctctaacttcct

SEQ ID NO: 186990 - DNA, 20 bp, human
ggagcgcggagacctggctg

SEQ ID NO: 186991 - DNA, 20 bp, human
gcacgggcgcgcactcgccg

SEQ ID NO: 186992 - DNA, 20 bp, human
gggtgactgagccgaaaggg

SEQ ID NO: 186993 - DNA, 20 bp, human
gctccccgcctgcccaggag

SEQ ID NO: 186994 - DNA, 20 bp, human
gcagcagcgagctcggggat

SEQ ID NO: 186995 - DNA, 20 bp, human
gtaacttcctcggccgagcc

SEQ ID NO: 186996 - DNA, 20 bp, human
gtctcacactcccgaaaggg

SEQ ID NO: 186997 - DNA, 20 bp, human
gggctctcacactcccgaaa

SEQ ID NO: 186998 - DNA, 20 bp, human
gctccccgcgcgggttacgg

SEQ ID NO: 186999 - DNA, 20 bp, human
ggagccaggtggcactcggt

SEQ ID NO: 187000 - DNA, 20 bp, human
ggtcccggagagaacgccgg

SEQ ID NO: 187001 - DNA, 20 bp, human
gccatccccgggccctactg

SEQ ID NO: 187002 - DNA, 20 bp, human
gccgcccagccggtgcacac

SEQ ID NO: 187003 - DNA, 20 bp, human
gtgggtgagtgaccccagta

SEQ ID NO: 187004 - DNA, 20 bp, human
gtcagtcccggagagaacgc

SEQ ID NO: 187005 - DNA, 20 bp, human
gtcactcacccagaacacgg

SEQ ID NO: 187006 - DNA, 20 bp, human
ggagaagcaggagggatgta

SEQ ID NO: 187007 - DNA, 20 bp, human
ggccgccttggacaaccatc

SEQ ID NO: 187008 - DNA, 20 bp, human
gaagggctgcaacaaaccag

SEQ ID NO: 187009 - DNA, 20 bp, human
gccaagatgatagggatctg

SEQ ID NO: 187010 - DNA, 20 bp, human
gccttcccaaacaacttggt

SEQ ID NO: 187011 - DNA, 20 bp, human
ggctcttccatcacccacct

SEQ ID NO: 187012 - DNA, 20 bp, human
gagccatgctgaacagactg

SEQ ID NO: 187013 - DNA, 20 bp, human
ggctgcctgatggttgtcca

SEQ ID NO: 187014 - DNA, 20 bp, human
gctggccttcccaaacaact

SEQ ID NO: 187015 - DNA, 20 bp, human
gaccagctctcggttgatgg

SEQ ID NO: 187016 - DNA, 20 bp, human
gcgcccggctaggccccggg

SEQ ID NO: 187017 - DNA, 20 bp, human
gaagccgcagccgcccggct

SEQ ID NO: 187018 - DNA, 20 bp, human
gccacccgaggtagctacag

SEQ ID NO: 187019 - DNA, 20 bp, human
gccacttccaggaccacccg

SEQ ID NO: 187020 - DNA, 20 bp, human
gcccgggcggctctagccca

SEQ ID NO: 187021 - DNA, 20 bp, human
ggggcctctgtagctacctc

SEQ ID NO: 187022 - DNA, 20 bp, human
gcgggtcctagcgacagcgt

SEQ ID NO: 187023 - DNA, 20 bp, human
gccgaggcctggtggagaaa

SEQ ID NO: 187024 - DNA, 20 bp, human
gacagaggcccggattgctg

SEQ ID NO: 187025 - DNA, 20 bp, human
ggacccgcccccagcaatcc

SEQ ID NO: 187026 - DNA, 20 bp, human
gtggagtagggatcccagga

SEQ ID NO: 187027 - DNA, 20 bp, human
gagcgccgagcgatccaccg

SEQ ID NO: 187028 - DNA, 20 bp, human
gtggagccccgcgacgccgg

SEQ ID NO: 187029 - DNA, 20 bp, human
gggctccgcggtggatcgct

SEQ ID NO: 187030 - DNA, 20 bp, human
gggagccccataccttccag

SEQ ID NO: 187031 - DNA, 20 bp, human
gcgcgccgccaccgccggga

SEQ ID NO: 187032 - DNA, 20 bp, human
gtggacgcggcggggaattg

SEQ ID NO: 187033 - DNA, 20 bp, human
ggcctggagccccgcgacgc

SEQ ID NO: 187034 - DNA, 20 bp, human
gcactcaaactagcacgcgg

SEQ ID NO: 187035 - DNA, 20 bp, human
gggggtggagtagggatccc

SEQ ID NO: 187036 - DNA, 20 bp, human
gggactggatgaggagctta

SEQ ID NO: 187037 - DNA, 20 bp, human
gcctctaactgaagggatgt

SEQ ID NO: 187038 - DNA, 20 bp, human
ggcatttcagggactggatg

SEQ ID NO: 187039 - DNA, 20 bp, human
gtccctacaggtgctctaga

SEQ ID NO: 187040 - DNA, 20 bp, human
ggaatgaacaccttatacat

SEQ ID NO: 187041 - DNA, 20 bp, human
gggagcttacggttttttac

SEQ ID NO: 187042 - DNA, 20 bp, human
gtcaaaaacctctaactgaa

SEQ ID NO: 187043 - DNA, 20 bp, human
gaatcactgttcaggattaa

SEQ ID NO: 187044 - DNA, 20 bp, human
gagtgagattacatctactt

SEQ ID NO: 187045 - DNA, 20 bp, human
gggtgatttgcccatgtata

SEQ ID NO: 187046 - DNA, 20 bp, human
ggtcctccggaggtgaggag

SEQ ID NO: 187047 - DNA, 20 bp, human
gagggacccaagtcctccgg

SEQ ID NO: 187048 - DNA, 20 bp, human
ggaaggggagagacaccgtg

SEQ ID NO: 187049 - DNA, 20 bp, human
ggcggaagcgccccatgctg

SEQ ID NO: 187050 - DNA, 20 bp, human
gagcgccccatgctgcggcc

SEQ ID NO: 187051 - DNA, 20 bp, human
ggctgggtgctcaaacgcgg

SEQ ID NO: 187052 - DNA, 20 bp, human
ggatgcaccgcaggcccccg

SEQ ID NO: 187053 - DNA, 20 bp, human
gcagctagtgaccccaggtg

SEQ ID NO: 187054 - DNA, 20 bp, human
gagggctgggtgctcaaacg

SEQ ID NO: 187055 - DNA, 20 bp, human
gcgctcgtagcgcgggcctg

SEQ ID NO: 187056 - DNA, 20 bp, human
gccgcgcgcgggccctcagg

SEQ ID NO: 187057 - DNA, 20 bp, human
gaggagcgaggcacttgctg

SEQ ID NO: 187058 - DNA, 20 bp, human
gcgcgaagcggcctcacacc

SEQ ID NO: 187059 - DNA, 20 bp, human
ggcacggagccagcccgcgt

SEQ ID NO: 187060 - DNA, 20 bp, human
ggaggccgtggagtccctga

SEQ ID NO: 187061 - DNA, 20 bp, human
gccaggctcccggcttggtc

SEQ ID NO: 187062 - DNA, 20 bp, human
ggctgcgctcaccgagagag

SEQ ID NO: 187063 - DNA, 20 bp, human
gccggcgccatgggccagtg

SEQ ID NO: 187064 - DNA, 20 bp, human
ggggctgcgcgacggcgcag

SEQ ID NO: 187065 - DNA, 20 bp, human
gcggcagggacctcgcgaag

SEQ ID NO: 187066 - DNA, 20 bp, human
gcccgtggggagaatctcta

SEQ ID NO: 187067 - DNA, 20 bp, human
gcggtgcaggcgcagagtat

SEQ ID NO: 187068 - DNA, 20 bp, human
gggaatgaactgaaggccgt

SEQ ID NO: 187069 - DNA, 20 bp, human
gaggcgcagagtattgggtt

SEQ ID NO: 187070 - DNA, 20 bp, human
gtaaagagacagaagctgtc

SEQ ID NO: 187071 - DNA, 20 bp, human
gggttcacaggaaggaggta

SEQ ID NO: 187072 - DNA, 20 bp, human
gctgtcggggtcctggaaga

SEQ ID NO: 187073 - DNA, 20 bp, human
gactgaggttcacaggaagg

SEQ ID NO: 187074 - DNA, 20 bp, human
gacagaagctgtcggggtcc

SEQ ID NO: 187075 - DNA, 20 bp, human
gacttggggggagggtattg

SEQ ID NO: 187076 - DNA, 20 bp, human
ggggccttggagtcgagtca

SEQ ID NO: 187077 - DNA, 20 bp, human
gcgactccaaggccccatga

SEQ ID NO: 187078 - DNA, 20 bp, human
gtgcctgcggctgtctgcaa

SEQ ID NO: 187079 - DNA, 20 bp, human
ggacgccccagcacactcac

SEQ ID NO: 187080 - DNA, 20 bp, human
gccggagggtgctggcacag

SEQ ID NO: 187081 - DNA, 20 bp, human
gcccctcaggaggagagacg

SEQ ID NO: 187082 - DNA, 20 bp, human
ggaggagaggaaccgtcatg

SEQ ID NO: 187083 - DNA, 20 bp, human
gcaccctccggggcaggaag

SEQ ID NO: 187084 - DNA, 20 bp, human
ggatcattgtgtctacggag

SEQ ID NO: 187085 - DNA, 20 bp, human
gcggatgcagcctacctcct

SEQ ID NO: 187086 - DNA, 20 bp, human
gtaggcaagcaacaggagta

SEQ ID NO: 187087 - DNA, 20 bp, human
gagagcagcgctctcgactg

SEQ ID NO: 187088 - DNA, 20 bp, human
gtcaggagtaggcaagcaac

SEQ ID NO: 187089 - DNA, 20 bp, human
gtatgtggaggatattgggt

SEQ ID NO: 187090 - DNA, 20 bp, human
gtaatagaagcatcaggttg

SEQ ID NO: 187091 - DNA, 20 bp, human
ggactgatcggtgaagctag

SEQ ID NO: 187092 - DNA, 20 bp, human
gtcccttcctctgagaggtc

SEQ ID NO: 187093 - DNA, 20 bp, human
gctctgagaggtcaggatcc

SEQ ID NO: 187094 - DNA, 20 bp, human
ggtccacatggagttcagaa

SEQ ID NO: 187095 - DNA, 20 bp, human
gtgaggttaatagaagcatc

SEQ ID NO: 187096 - DNA, 20 bp, human
ggccagggcggcgcccctag

SEQ ID NO: 187097 - DNA, 20 bp, human
gcgcgcagctgtcagtcaag

SEQ ID NO: 187098 - DNA, 20 bp, human
ggcagagccgggacccggga

SEQ ID NO: 187099 - DNA, 20 bp, human
ggaacgcggacaggagcccg

SEQ ID NO: 187100 - DNA, 20 bp, human
gggaaagagcggaaagaacg

SEQ ID NO: 187101 - DNA, 20 bp, human
gggcggaggaacccactact

SEQ ID NO: 187102 - DNA, 20 bp, human
gccccattcccgggaaagag

SEQ ID NO: 187103 - DNA, 20 bp, human
ggcgcaattacagcccccgc

SEQ ID NO: 187104 - DNA, 20 bp, human
ggcaccccgaccccattccc

SEQ ID NO: 187105 - DNA, 20 bp, human
gtgactgacagctgcgcggc

SEQ ID NO: 187106 - DNA, 20 bp, human
gcaggggccctgagtaacgg

SEQ ID NO: 187107 - DNA, 20 bp, human
gcccaggccaccgttactca

SEQ ID NO: 187108 - DNA, 20 bp, human
gcctcaggtagagcccagtc

SEQ ID NO: 187109 - DNA, 20 bp, human
gtagagcccagtcgggactg

SEQ ID NO: 187110 - DNA, 20 bp, human
ggcagcctcgcagctgaacc

SEQ ID NO: 187111 - DNA, 20 bp, human
gtatgtgcggaggcccctgg

SEQ ID NO: 187112 - DNA, 20 bp, human
gggcagtctccagatctcag

SEQ ID NO: 187113 - DNA, 20 bp, human
gcccagtcgggactgaggac

SEQ ID NO: 187114 - DNA, 20 bp, human
ggccctcctcaggcaagcgg

SEQ ID NO: 187115 - DNA, 20 bp, human
gaggggcctccgcacatatg

SEQ ID NO: 187116 - DNA, 20 bp, human
gtgtccgggaagcactacaa

SEQ ID NO: 187117 - DNA, 20 bp, human
gatgaacccagaggatgtcc

SEQ ID NO: 187118 - DNA, 20 bp, human
gaggcggccgcggcagatgc

SEQ ID NO: 187119 - DNA, 20 bp, human
gcgccaggcggtcggtccgt

SEQ ID NO: 187120 - DNA, 20 bp, human
gccgcgcggggaccgaccgg

SEQ ID NO: 187121 - DNA, 20 bp, human
gattacaggaccatatacca

SEQ ID NO: 187122 - DNA, 20 bp, human
gtctccaccagcatctgccg

SEQ ID NO: 187123 - DNA, 20 bp, human
gcgcctttgcccgaagcccg

SEQ ID NO: 187124 - DNA, 20 bp, human
gtgcttcccggacatcctct

SEQ ID NO: 187125 - DNA, 20 bp, human
gagtgtcttcatgaacccag

SEQ ID NO: 187126 - DNA, 20 bp, human
gtgcggtggtgcagggtctc

SEQ ID NO: 187127 - DNA, 20 bp, human
gtagtctgcagtctccgaga

SEQ ID NO: 187128 - DNA, 20 bp, human
gagcggcgggagctcaggtc

SEQ ID NO: 187129 - DNA, 20 bp, human
gtcgatacgggaggcgaggt

SEQ ID NO: 187130 - DNA, 20 bp, human
gcagggtctcgggctagtca

SEQ ID NO: 187131 - DNA, 20 bp, human
gcagcgttcgagttcgatac

SEQ ID NO: 187132 - DNA, 20 bp, human
gagtcatggcgtccccgtct

SEQ ID NO: 187133 - DNA, 20 bp, human
gtgaccctggacctttgcaa

SEQ ID NO: 187134 - DNA, 20 bp, human
gtgcaagtgagccctcaaag

SEQ ID NO: 187135 - DNA, 20 bp, human
ggaacacagagagcgagacg

SEQ ID NO: 187136 - DNA, 20 bp, human
gccgccggagctctgtagta

SEQ ID NO: 187137 - DNA, 20 bp, human
gagtatggcatcgaggagaa

SEQ ID NO: 187138 - DNA, 20 bp, human
gcaggagctgaccctatccc

SEQ ID NO: 187139 - DNA, 20 bp, human
ggccacaggttagctccaag

SEQ ID NO: 187140 - DNA, 20 bp, human
ggcctcttggagctaacctg

SEQ ID NO: 187141 - DNA, 20 bp, human
ggaaccggctggtaggggaa

SEQ ID NO: 187142 - DNA, 20 bp, human
ggccgcgaaccggctggtag

SEQ ID NO: 187143 - DNA, 20 bp, human
ggcacttacccagaagacga

SEQ ID NO: 187144 - DNA, 20 bp, human
gctgcgcggagcgaggtcta

SEQ ID NO: 187145 - DNA, 20 bp, human
ggctctgtagtatggcatcg

SEQ ID NO: 187146 - DNA, 20 bp, human
gtggatacagaaatctctgc

SEQ ID NO: 187147 - DNA, 20 bp, human
gcaggagctatgacaagcaa

SEQ ID NO: 187148 - DNA, 20 bp, human
gtatcgcaaaggctatctcc

SEQ ID NO: 187149 - DNA, 20 bp, human
gcttgtcctgcaatatgctc

SEQ ID NO: 187150 - DNA, 20 bp, human
ggccatttcggaaaaggatt

SEQ ID NO: 187151 - DNA, 20 bp, human
gcctgcttgatatacaacta

SEQ ID NO: 187152 - DNA, 20 bp, human
ggaatttaactattcgttac

SEQ ID NO: 187153 - DNA, 20 bp, human
gacacctgccatttcggaaa

SEQ ID NO: 187154 - DNA, 20 bp, human
gacaaatgccccttaattaa

SEQ ID NO: 187155 - DNA, 20 bp, human
ggtgcacttttttgagtcct

SEQ ID NO: 187156 - DNA, 20 bp, human
gccgcgcccgcaggacctgg

SEQ ID NO: 187157 - DNA, 20 bp, human
gcgccgccagcggaaacagg

SEQ ID NO: 187158 - DNA, 20 bp, human
gtcagaaagggagtaacccg

SEQ ID NO: 187159 - DNA, 20 bp, human
gccatacaaggaccccagag

SEQ ID NO: 187160 - DNA, 20 bp, human
gagtaacccggggccggcaa

SEQ ID NO: 187161 - DNA, 20 bp, human
ggatatggcctgcagccccc

SEQ ID NO: 187162 - DNA, 20 bp, human
gtgcccacactgcctcccgt

SEQ ID NO: 187163 - DNA, 20 bp, human
ggcgaagtggggtcctccag

SEQ ID NO: 187164 - DNA, 20 bp, human
gaaagggagtaacccggggc

SEQ ID NO: 187165 - DNA, 20 bp, human
ggtgaccccgtgcaccgctt

SEQ ID NO: 187166 - DNA, 20 bp, human
gtcagcagggcagacatgag

SEQ ID NO: 187167 - DNA, 20 bp, human
ggggtgccaagctccatcca

SEQ ID NO: 187168 - DNA, 20 bp, human
gaggctgacgcagacgtctg

SEQ ID NO: 187169 - DNA, 20 bp, human
gactggcaggtagcaccctg

SEQ ID NO: 187170 - DNA, 20 bp, human
gggcgggaggagcacaggtg

SEQ ID NO: 187171 - DNA, 20 bp, human
gagcaggtaagcacttgtgg

SEQ ID NO: 187172 - DNA, 20 bp, human
gttagaacgcacgcagggtg

SEQ ID NO: 187173 - DNA, 20 bp, human
gggcagttgcaatagaaacg

SEQ ID NO: 187174 - DNA, 20 bp, human
gggcaggggcatgggaactc

SEQ ID NO: 187175 - DNA, 20 bp, human
gcccgcggccgcccctggaa

SEQ ID NO: 187176 - DNA, 20 bp, human
gcgagggcacgctccgggaa

SEQ ID NO: 187177 - DNA, 20 bp, human
gtccgcggaatgggcaggag

SEQ ID NO: 187178 - DNA, 20 bp, human
gggaagcgcggtcccaggag

SEQ ID NO: 187179 - DNA, 20 bp, human
gcctcactcaccagcggcga

SEQ ID NO: 187180 - DNA, 20 bp, human
gtccgcggatgggcaatccc

SEQ ID NO: 187181 - DNA, 20 bp, human
gggaagcagacaggtcccag

SEQ ID NO: 187182 - DNA, 20 bp, human
ggggagcgtcggccactcct

SEQ ID NO: 187183 - DNA, 20 bp, human
gtgagggtctcagaatatct

SEQ ID NO: 187184 - DNA, 20 bp, human
gcagcggcgagggcacgctc

SEQ ID NO: 187185 - DNA, 20 bp, human
gtgccaggcagtgcccttcc

SEQ ID NO: 187186 - DNA, 20 bp, human
gtaggaggcagagacagacg

SEQ ID NO: 187187 - DNA, 20 bp, human
ggcaggagccagaaattcct

SEQ ID NO: 187188 - DNA, 20 bp, human
gctcagagaaggtctactca

SEQ ID NO: 187189 - DNA, 20 bp, human
gggaaatgagtcaggttagg

SEQ ID NO: 187190 - DNA, 20 bp, human
gccaggaaatgagtcaggtt

SEQ ID NO: 187191 - DNA, 20 bp, human
gtgactagaaaagagtcccc

SEQ ID NO: 187192 - DNA, 20 bp, human
gagacagacgaggagccgca

SEQ ID NO: 187193 - DNA, 20 bp, human
ggacgaggagccgcagggga

SEQ ID NO: 187194 - DNA, 20 bp, human
ggagctcagaggtacaggac

SEQ ID NO: 187195 - DNA, 20 bp, human
gagagaaggtctactcacgg

SEQ ID NO: 187196 - DNA, 20 bp, human
gcccagatcggactagcaag

SEQ ID NO: 187197 - DNA, 20 bp, human
gagcagaagcgagttcagag

SEQ ID NO: 187198 - DNA, 20 bp, human
gtgctgctcggcatcaccaa

SEQ ID NO: 187199 - DNA, 20 bp, human
gggaagtgtaagtgaccgat

SEQ ID NO: 187200 - DNA, 20 bp, human
gcatgcggcagagaaaccct

SEQ ID NO: 187201 - DNA, 20 bp, human
gagcgagttcagagcggaag

SEQ ID NO: 187202 - DNA, 20 bp, human
gtcgacgccgagctgcccat

SEQ ID NO: 187203 - DNA, 20 bp, human
ggagttgccacggaccagtg

SEQ ID NO: 187204 - DNA, 20 bp, human
gccacagccacactggtccg

SEQ ID NO: 187205 - DNA, 20 bp, human
ggccgagcagcagacgtttg

SEQ ID NO: 187206 - DNA, 20 bp, human
gtaacagtcggaccaaccgc

SEQ ID NO: 187207 - DNA, 20 bp, human
ggaacgcccgttttcctcag

SEQ ID NO: 187208 - DNA, 20 bp, human
gttcggcctctgaggaaaac

SEQ ID NO: 187209 - DNA, 20 bp, human
gcggcggttagctcccagtt

SEQ ID NO: 187210 - DNA, 20 bp, human
gagtgagactgtagggtggg

SEQ ID NO: 187211 - DNA, 20 bp, human
gtttcctcagaggccgaact

SEQ ID NO: 187212 - DNA, 20 bp, human
gggacgcacaccagtacctg

SEQ ID NO: 187213 - DNA, 20 bp, human
gtgggcgccacagatttcta

SEQ ID NO: 187214 - DNA, 20 bp, human
gccgaccgcagcctgaaaaa

SEQ ID NO: 187215 - DNA, 20 bp, human
ggctgccatcaccacagaag

SEQ ID NO: 187216 - DNA, 20 bp, human
gagggaacgccagagcgagg

SEQ ID NO: 187217 - DNA, 20 bp, human
ggcaccggtaagcagagctg

SEQ ID NO: 187218 - DNA, 20 bp, human
gtgcttaccggtgcgactag

SEQ ID NO: 187219 - DNA, 20 bp, human
gtagagcgggcgctgtggga

SEQ ID NO: 187220 - DNA, 20 bp, human
gtggaggcagcggcagtcgg

SEQ ID NO: 187221 - DNA, 20 bp, human
ggacgcggctaaaagcgaag

SEQ ID NO: 187222 - DNA, 20 bp, human
gcctcgagaatgacataggg

SEQ ID NO: 187223 - DNA, 20 bp, human
gccccgaggcctcaggagtg

SEQ ID NO: 187224 - DNA, 20 bp, human
gggattctaccatcgagtcg

SEQ ID NO: 187225 - DNA, 20 bp, human
gcagcgcccgaggctccagg

SEQ ID NO: 187226 - DNA, 20 bp, human
gaccgccgagagtaaaggag

SEQ ID NO: 187227 - DNA, 20 bp, human
ggtagcaccgccgagagtaa

SEQ ID NO: 187228 - DNA, 20 bp, human
ggaagtcagactagtgggag

SEQ ID NO: 187229 - DNA, 20 bp, human
gagttccttgtcctccgcag

SEQ ID NO: 187230 - DNA, 20 bp, human
gttggaagaagtcagactag

SEQ ID NO: 187231 - DNA, 20 bp, human
gagagccccgtggccctgct

SEQ ID NO: 187232 - DNA, 20 bp, human
ggggcagagctcggccgctg

SEQ ID NO: 187233 - DNA, 20 bp, human
gccacagtcgacaggatcct

SEQ ID NO: 187234 - DNA, 20 bp, human
gcacaggtgatggcgaacac

SEQ ID NO: 187235 - DNA, 20 bp, human
gcggtgcagcgaccaaagcc

SEQ ID NO: 187236 - DNA, 20 bp, human
ggaccgagcgggtctctcca

SEQ ID NO: 187237 - DNA, 20 bp, human
ggcgcgaggccacagtccag

SEQ ID NO: 187238 - DNA, 20 bp, human
gtgggaacagcgggaaccgt

SEQ ID NO: 187239 - DNA, 20 bp, human
gaggcgctccgagagagatg

SEQ ID NO: 187240 - DNA, 20 bp, human
gcgacttcggccgctcatgg

SEQ ID NO: 187241 - DNA, 20 bp, human
gctgacgccagctctcggtc

SEQ ID NO: 187242 - DNA, 20 bp, human
gaacagcgggaaccgtggga

SEQ ID NO: 187243 - DNA, 20 bp, human
ggctctcggtcgggaccgag

SEQ ID NO: 187244 - DNA, 20 bp, human
ggagagatgcggccttcccc

SEQ ID NO: 187245 - DNA, 20 bp, human
gccgcagacactgtcttcgt

SEQ ID NO: 187246 - DNA, 20 bp, human
gccagggcagcagtgggtag

SEQ ID NO: 187247 - DNA, 20 bp, human
gctctccgggaggctcatgt

SEQ ID NO: 187248 - DNA, 20 bp, human
gagagacgcacggcctaggt

SEQ ID NO: 187249 - DNA, 20 bp, human
ggctgtgaggactctccggg

SEQ ID NO: 187250 - DNA, 20 bp, human
gctgcctcgctgacaactga

SEQ ID NO: 187251 - DNA, 20 bp, human
ggggaggctcatgttggtag

SEQ ID NO: 187252 - DNA, 20 bp, human
gctcatgttggtagcggcca

SEQ ID NO: 187253 - DNA, 20 bp, human
gaaggctctagaaacctgtg

SEQ ID NO: 187254 - DNA, 20 bp, human
gcgttgacgctacctacctc

SEQ ID NO: 187255 - DNA, 20 bp, human
gccaccgccccggcttccag

SEQ ID NO: 187256 - DNA, 20 bp, human
ggtacacgcgcgctgcggca

SEQ ID NO: 187257 - DNA, 20 bp, human
gcacgcgcgctgcggcatgg

SEQ ID NO: 187258 - DNA, 20 bp, human
ggcatggcggcccaccgccc

SEQ ID NO: 187259 - DNA, 20 bp, human
gagaccgggaggagggtcca

SEQ ID NO: 187260 - DNA, 20 bp, human
gacgcgaaaggccctttcta

SEQ ID NO: 187261 - DNA, 20 bp, human
gctgctgcttgagcgggccg

SEQ ID NO: 187262 - DNA, 20 bp, human
gactccgtacacgcgcgctg

SEQ ID NO: 187263 - DNA, 20 bp, human
gctttctaaggtgggcggag

SEQ ID NO: 187264 - DNA, 20 bp, human
gagtggaaaatgagaccggg

SEQ ID NO: 187265 - DNA, 20 bp, human
gcagcgggacggcaagggta

SEQ ID NO: 187266 - DNA, 20 bp, human
ggcagctccccgcccagtga

SEQ ID NO: 187267 - DNA, 20 bp, human
gccgcctcctgccacaccat

SEQ ID NO: 187268 - DNA, 20 bp, human
gtggctgcggagccgagcac

SEQ ID NO: 187269 - DNA, 20 bp, human
gggctgcgaagcaaacaagc

SEQ ID NO: 187270 - DNA, 20 bp, human
gtcgagtcaagaaccccggg

SEQ ID NO: 187271 - DNA, 20 bp, human
gcgccgctgccgtcactggg

SEQ ID NO: 187272 - DNA, 20 bp, human
gccccgcccagtgacggcag

SEQ ID NO: 187273 - DNA, 20 bp, human
gcagcgccgctgccgtcact

SEQ ID NO: 187274 - DNA, 20 bp, human
gtctgcccgggggacccggc

SEQ ID NO: 187275 - DNA, 20 bp, human
ggccccgcacagacgtcagg

SEQ ID NO: 187276 - DNA, 20 bp, human
gtaggcggcataagaggagt

SEQ ID NO: 187277 - DNA, 20 bp, human
gggcagaacaggagttggtt

SEQ ID NO: 187278 - DNA, 20 bp, human
gccgcgacccgcctgtgtgg

SEQ ID NO: 187279 - DNA, 20 bp, human
ggactggggccggataatgg

SEQ ID NO: 187280 - DNA, 20 bp, human
ggtggactggggccggataa

SEQ ID NO: 187281 - DNA, 20 bp, human
gcgggacgtcacgtggactg

SEQ ID NO: 187282 - DNA, 20 bp, human
gcttggctaggcggcataag

SEQ ID NO: 187283 - DNA, 20 bp, human
gatgcaggctctgcgggatg

SEQ ID NO: 187284 - DNA, 20 bp, human
gggattggtacctaaaggtg

SEQ ID NO: 187285 - DNA, 20 bp, human
ggatgcgcgagctcttttcc

SEQ ID NO: 187286 - DNA, 20 bp, human
ggcctgggccacagattcgg

SEQ ID NO: 187287 - DNA, 20 bp, human
gccgcaagctggcccgcctg

SEQ ID NO: 187288 - DNA, 20 bp, human
gcgcgccatgggccgcagga

SEQ ID NO: 187289 - DNA, 20 bp, human
gtgcgcctgggccacagatt

SEQ ID NO: 187290 - DNA, 20 bp, human
gagccgcacagcccattggg

SEQ ID NO: 187291 - DNA, 20 bp, human
ggcgtcccccgcagacaggt

SEQ ID NO: 187292 - DNA, 20 bp, human
gcaggcagcgcaccagcccc

SEQ ID NO: 187293 - DNA, 20 bp, human
gcaccccaggtccgcgccat

SEQ ID NO: 187294 - DNA, 20 bp, human
gcggcccatggcgcggacct

SEQ ID NO: 187295 - DNA, 20 bp, human
gtggaaatgaagacgacctc

SEQ ID NO: 187296 - DNA, 20 bp, human
gccggcgcgtccccacctcg

SEQ ID NO: 187297 - DNA, 20 bp, human
ggatagcatgcgcggtccca

SEQ ID NO: 187298 - DNA, 20 bp, human
gccaggtcagaagtcatgtt

SEQ ID NO: 187299 - DNA, 20 bp, human
gtccaggtgggtcactggga

SEQ ID NO: 187300 - DNA, 20 bp, human
gccactacggaagctgttct

SEQ ID NO: 187301 - DNA, 20 bp, human
gcacgctaaggacctcgcta

SEQ ID NO: 187302 - DNA, 20 bp, human
gagtttggagtcgtttgctg

SEQ ID NO: 187303 - DNA, 20 bp, human
gggaacacgcccgcgaggtg

SEQ ID NO: 187304 - DNA, 20 bp, human
ggttcgggacaggatgtgaa

SEQ ID NO: 187305 - DNA, 20 bp, human
gcagaagtcatgttcgggac

SEQ ID NO: 187306 - DNA, 20 bp, human
gcgagcagccttgagccggt

SEQ ID NO: 187307 - DNA, 20 bp, human
gggtgcggcgccgaccaaga

SEQ ID NO: 187308 - DNA, 20 bp, human
gggcgaaagccggcaacgag

SEQ ID NO: 187309 - DNA, 20 bp, human
gagcgcgccgcacggaggtg

SEQ ID NO: 187310 - DNA, 20 bp, human
gtcggcgccgcacctccgtg

SEQ ID NO: 187311 - DNA, 20 bp, human
gctgccgagcagccttgagc

SEQ ID NO: 187312 - DNA, 20 bp, human
gtgctcggcagtctccatct

SEQ ID NO: 187313 - DNA, 20 bp, human
gcggcagtctccatcttggt

SEQ ID NO: 187314 - DNA, 20 bp, human
gccgactggacagtgccgag

SEQ ID NO: 187315 - DNA, 20 bp, human
ggggatcgggctgcaagata

SEQ ID NO: 187316 - DNA, 20 bp, human
gcagagtcttggcctctagg

SEQ ID NO: 187317 - DNA, 20 bp, human
gctacagccccgaggcgcat

SEQ ID NO: 187318 - DNA, 20 bp, human
gtcctggatagagagtcctt

SEQ ID NO: 187319 - DNA, 20 bp, human
gtgctgttcctgcctcctag

SEQ ID NO: 187320 - DNA, 20 bp, human
gggcaaggtctacatcgtca

SEQ ID NO: 187321 - DNA, 20 bp, human
gcccaaaggactctctatcc

SEQ ID NO: 187322 - DNA, 20 bp, human
ggactctggagtggaacatt

SEQ ID NO: 187323 - DNA, 20 bp, human
ggtcttggcctctaggaggc

SEQ ID NO: 187324 - DNA, 20 bp, human
gtcatggagctcgcggtcca

SEQ ID NO: 187325 - DNA, 20 bp, human
gtacatcgtcatggagctcg

SEQ ID NO: 187326 - DNA, 20 bp, human
gtgagtcgaagcccagccca

SEQ ID NO: 187327 - DNA, 20 bp, human
gtgctggcccacatgacggg

SEQ ID NO: 187328 - DNA, 20 bp, human
gtgcctgctggcccacatga

SEQ ID NO: 187329 - DNA, 20 bp, human
gtcctcatttacactaccgg

SEQ ID NO: 187330 - DNA, 20 bp, human
gtcgtggcagtacttgacgg

SEQ ID NO: 187331 - DNA, 20 bp, human
gctaccggaggcgtctggct

SEQ ID NO: 187332 - DNA, 20 bp, human
ggcacttgatgaactcgagg

SEQ ID NO: 187333 - DNA, 20 bp, human
gcatgacggggggatgtaga

SEQ ID NO: 187334 - DNA, 20 bp, human
ggcctccggtagtgtaaatg

SEQ ID NO: 187335 - DNA, 20 bp, human
gcctcgggagatggacatcc

SEQ ID NO: 187336 - DNA, 20 bp, human
ggagtagagctgcctctcag

SEQ ID NO: 187337 - DNA, 20 bp, human
gcccactggagaacccccaa

SEQ ID NO: 187338 - DNA, 20 bp, human
ggctctggagtgggtcagtg

SEQ ID NO: 187339 - DNA, 20 bp, human
gccgatggcagctctggagt

SEQ ID NO: 187340 - DNA, 20 bp, human
gtcagcgcgggccagaatcg

SEQ ID NO: 187341 - DNA, 20 bp, human
gtggaaccaagcaagcccga

SEQ ID NO: 187342 - DNA, 20 bp, human
gcggctgcggatgaagtcct

SEQ ID NO: 187343 - DNA, 20 bp, human
ggccatggcgcctggagacg

SEQ ID NO: 187344 - DNA, 20 bp, human
gggcccgcgctgagtgccag

SEQ ID NO: 187345 - DNA, 20 bp, human
ggacacagcggcgggtggtg

SEQ ID NO: 187346 - DNA, 20 bp, human
gtccactaggaacttggagg

SEQ ID NO: 187347 - DNA, 20 bp, human
gccctccactaggaacttgg

SEQ ID NO: 187348 - DNA, 20 bp, human
gcagccctccactaggaact

SEQ ID NO: 187349 - DNA, 20 bp, human
gtgccccgtgaaatacaggt

SEQ ID NO: 187350 - DNA, 20 bp, human
gttgttaagatagtcatcag

SEQ ID NO: 187351 - DNA, 20 bp, human
gcttgagctgctgaaggcta

SEQ ID NO: 187352 - DNA, 20 bp, human
gtcagcaagcccaacaccat

SEQ ID NO: 187353 - DNA, 20 bp, human
gtatatagtcacacgagtct

SEQ ID NO: 187354 - DNA, 20 bp, human
gcgtgaaatacaggttggaa

SEQ ID NO: 187355 - DNA, 20 bp, human
gcattggccatggctcctat

SEQ ID NO: 187356 - DNA, 20 bp, human
gggcctgcgcaacaccccag

SEQ ID NO: 187357 - DNA, 20 bp, human
gcgaccgcgcgggaaagctc

SEQ ID NO: 187358 - DNA, 20 bp, human
gcggcacggctaggaagtcc

SEQ ID NO: 187359 - DNA, 20 bp, human
gccgcgcgggaaagctctgg

SEQ ID NO: 187360 - DNA, 20 bp, human
ggatgagaggccactagcaa

SEQ ID NO: 187361 - DNA, 20 bp, human
gaagcacttgagatggtccg

SEQ ID NO: 187362 - DNA, 20 bp, human
ggcggccggactccaatctc

SEQ ID NO: 187363 - DNA, 20 bp, human
gggatagttacactactgtc

SEQ ID NO: 187364 - DNA, 20 bp, human
gggaaaaggggccttaactg

SEQ ID NO: 187365 - DNA, 20 bp, human
gcacaacagcggccaatgtc

SEQ ID NO: 187366 - DNA, 20 bp, human
gttccgaggactccaagtag

SEQ ID NO: 187367 - DNA, 20 bp, human
gggaacccctgatccaccta

SEQ ID NO: 187368 - DNA, 20 bp, human
gcccagcgcagaagcgggtg

SEQ ID NO: 187369 - DNA, 20 bp, human
gcaagtaggggcgcttcctg

SEQ ID NO: 187370 - DNA, 20 bp, human
gccggactcgggcactctgg

SEQ ID NO: 187371 - DNA, 20 bp, human
gcagcaggtggcccgaccgg

SEQ ID NO: 187372 - DNA, 20 bp, human
gcgagctacgggccggactc

SEQ ID NO: 187373 - DNA, 20 bp, human
gtctgccctaggtggatcag

SEQ ID NO: 187374 - DNA, 20 bp, human
gagggcagcgagctacgggc

SEQ ID NO: 187375 - DNA, 20 bp, human
gcgtccggggcgagtgagtg

SEQ ID NO: 187376 - DNA, 20 bp, human
gaccgccggctccccgacag

SEQ ID NO: 187377 - DNA, 20 bp, human
gaagcccgcatgctagggac

SEQ ID NO: 187378 - DNA, 20 bp, human
ggctagggacaggcacgaga

SEQ ID NO: 187379 - DNA, 20 bp, human
gcccagggcgcggctgagtc

SEQ ID NO: 187380 - DNA, 20 bp, human
ggccagcctcgagtgggcgt

SEQ ID NO: 187381 - DNA, 20 bp, human
ggcagggccccctcccctaa

SEQ ID NO: 187382 - DNA, 20 bp, human
gcggccggaagccgctgtcg

SEQ ID NO: 187383 - DNA, 20 bp, human
gggatgctccgtgagagtca

SEQ ID NO: 187384 - DNA, 20 bp, human
gccctcaaggatcccatcct

SEQ ID NO: 187385 - DNA, 20 bp, human
gggaggaatctggctcgcca

SEQ ID NO: 187386 - DNA, 20 bp, human
ggccgcactccggagactcg

SEQ ID NO: 187387 - DNA, 20 bp, human
gggcagctgggaccatccca

SEQ ID NO: 187388 - DNA, 20 bp, human
gcaacatcccgggtataggg

SEQ ID NO: 187389 - DNA, 20 bp, human
gggcagcgcccctcccggta

SEQ ID NO: 187390 - DNA, 20 bp, human
ggtgcgctctcgcgaggagg

SEQ ID NO: 187391 - DNA, 20 bp, human
gagaccggatccggaagcaa

SEQ ID NO: 187392 - DNA, 20 bp, human
gtggcaaagaacctcctgaa

SEQ ID NO: 187393 - DNA, 20 bp, human
gcacctggcagcgcccctcc

SEQ ID NO: 187394 - DNA, 20 bp, human
ggttcaggaagcgagaccgt

SEQ ID NO: 187395 - DNA, 20 bp, human
gccgggtatagggtggagag

SEQ ID NO: 187396 - DNA, 20 bp, human
gggcgggggaataggctcga

SEQ ID NO: 187397 - DNA, 20 bp, human
ggggggaataggctcgaggg

SEQ ID NO: 187398 - DNA, 20 bp, human
ggtgctcataaagacatcag

SEQ ID NO: 187399 - DNA, 20 bp, human
gtaccaaggggcggcacgtg

SEQ ID NO: 187400 - DNA, 20 bp, human
ggctaggcggagacagtgca

SEQ ID NO: 187401 - DNA, 20 bp, human
gaaatacgcggcgggggaat

SEQ ID NO: 187402 - DNA, 20 bp, human
ggcttttctacccaaatacg

SEQ ID NO: 187403 - DNA, 20 bp, human
gcgctcacacacaggcatat

SEQ ID NO: 187404 - DNA, 20 bp, human
ggtaagaccgaaggagaatt

SEQ ID NO: 187405 - DNA, 20 bp, human
ggcctttccataccaagggg

SEQ ID NO: 187406 - DNA, 20 bp, human
gcagtctcgagcagcaacca

SEQ ID NO: 187407 - DNA, 20 bp, human
gcccaggtgccaagagtgat

SEQ ID NO: 187408 - DNA, 20 bp, human
gtcggcattacgactctcgc

SEQ ID NO: 187409 - DNA, 20 bp, human
ggaggaagtggtcactagcg

SEQ ID NO: 187410 - DNA, 20 bp, human
ggggatgtaacacccacctg

SEQ ID NO: 187411 - DNA, 20 bp, human
ggaagtggtcactagcgcgg

SEQ ID NO: 187412 - DNA, 20 bp, human
gaccagggtagcaccattgc

SEQ ID NO: 187413 - DNA, 20 bp, human
gcaagatggccactccctgc

SEQ ID NO: 187414 - DNA, 20 bp, human
gtgctccagcgaggtcgtat

SEQ ID NO: 187415 - DNA, 20 bp, human
gtagcaccattgcgggccgg

SEQ ID NO: 187416 - DNA, 20 bp, human
gggaggagcaaagtgcccgg

SEQ ID NO: 187417 - DNA, 20 bp, human
gcgtcgcccaaggaggatcg

SEQ ID NO: 187418 - DNA, 20 bp, human
gagcaaagtgcccggaggac

SEQ ID NO: 187419 - DNA, 20 bp, human
gggtgaagccatggggacag

SEQ ID NO: 187420 - DNA, 20 bp, human
gcccggccccgatcctcctt

SEQ ID NO: 187421 - DNA, 20 bp, human
gggtgacccgctccctccgg

SEQ ID NO: 187422 - DNA, 20 bp, human
gcctccttgggcgacggcgg

SEQ ID NO: 187423 - DNA, 20 bp, human
ggagccaggggtgaagccat

SEQ ID NO: 187424 - DNA, 20 bp, human
gacgctggcctacaccgcct

SEQ ID NO: 187425 - DNA, 20 bp, human
ggagccccctgagcccacga

SEQ ID NO: 187426 - DNA, 20 bp, human
ggccgcagcggcgatgggag

SEQ ID NO: 187427 - DNA, 20 bp, human
gcagcggcgatgggagcggt

SEQ ID NO: 187428 - DNA, 20 bp, human
gtaacgtcgggtcgggtcag

SEQ ID NO: 187429 - DNA, 20 bp, human
gtctgcagtagtcgccgcag

SEQ ID NO: 187430 - DNA, 20 bp, human
gcagtctcgaccccctcctc

SEQ ID NO: 187431 - DNA, 20 bp, human
ggcagcgaactgaaagtccc

SEQ ID NO: 187432 - DNA, 20 bp, human
gtccagctcaggaccgggac

SEQ ID NO: 187433 - DNA, 20 bp, human
gaggctcggtcactcggcga

SEQ ID NO: 187434 - DNA, 20 bp, human
ggctgtgtcgggttacgagg

SEQ ID NO: 187435 - DNA, 20 bp, human
gcgggtcccgccgcagtcgg

SEQ ID NO: 187436 - DNA, 20 bp, human
gaggttgtgagtaaccccgt

SEQ ID NO: 187437 - DNA, 20 bp, human
gccaacacgcttagacccac

SEQ ID NO: 187438 - DNA, 20 bp, human
gcggaagtaggagctctcag

SEQ ID NO: 187439 - DNA, 20 bp, human
gctctcagaggctaagaagg

SEQ ID NO: 187440 - DNA, 20 bp, human
gaggctaagaaggtggagac

SEQ ID NO: 187441 - DNA, 20 bp, human
gggaagtgcacctgactgag

SEQ ID NO: 187442 - DNA, 20 bp, human
ggactcagcttctacagcag

SEQ ID NO: 187443 - DNA, 20 bp, human
gcacctgactgagcggaagt

SEQ ID NO: 187444 - DNA, 20 bp, human
ggctgtgaggaacaaagcta

SEQ ID NO: 187445 - DNA, 20 bp, human
gcacaacctcacagcttctc

SEQ ID NO: 187446 - DNA, 20 bp, human
gaaagctgggcgaatcaggt

SEQ ID NO: 187447 - DNA, 20 bp, human
ggtaccccggaatcccccct

SEQ ID NO: 187448 - DNA, 20 bp, human
ggctcccaggggggattccg

SEQ ID NO: 187449 - DNA, 20 bp, human
gctctcaccctagcgtaggg

SEQ ID NO: 187450 - DNA, 20 bp, human
gctcccagggcatggatctc

SEQ ID NO: 187451 - DNA, 20 bp, human
ggtccaaagctgggcgaatc

SEQ ID NO: 187452 - DNA, 20 bp, human
gccagtgcccccctacgcta

SEQ ID NO: 187453 - DNA, 20 bp, human
gcccagctttggacaggaaa

SEQ ID NO: 187454 - DNA, 20 bp, human
gagtgcaggaccagctccca

SEQ ID NO: 187455 - DNA, 20 bp, human
ggccctctcaccctagcgta

SEQ ID NO: 187456 - DNA, 20 bp, human
gctgtcgcgcatgcgccttg

SEQ ID NO: 187457 - DNA, 20 bp, human
gccccccagtccccggactg

SEQ ID NO: 187458 - DNA, 20 bp, human
gcatgcgccttgagggaaga

SEQ ID NO: 187459 - DNA, 20 bp, human
ggatcgcgcgccgcagccgg

SEQ ID NO: 187460 - DNA, 20 bp, human
gggcctcacgcctccggctg

SEQ ID NO: 187461 - DNA, 20 bp, human
gcctccccgcctctaaccta

SEQ ID NO: 187462 - DNA, 20 bp, human
gcgcccgggcctcacgcctc

SEQ ID NO: 187463 - DNA, 20 bp, human
ggccgcactcggcagagtac

SEQ ID NO: 187464 - DNA, 20 bp, human
gcccgcctctaacctacggc

SEQ ID NO: 187465 - DNA, 20 bp, human
ggctgcggcgcgcgatccgc

SEQ ID NO: 187466 - DNA, 20 bp, human
gtaccacccggctcaagtag

SEQ ID NO: 187467 - DNA, 20 bp, human
gtagagaatgcagggcccgg

SEQ ID NO: 187468 - DNA, 20 bp, human
gcgcaaaaggtcccggtcca

SEQ ID NO: 187469 - DNA, 20 bp, human
gccggctcaagtagcggaca

SEQ ID NO: 187470 - DNA, 20 bp, human
gcagggaactatcagcccgt

SEQ ID NO: 187471 - DNA, 20 bp, human
ggcagggcccggaggccgac

SEQ ID NO: 187472 - DNA, 20 bp, human
gtccatggctagagaatgca

SEQ ID NO: 187473 - DNA, 20 bp, human
gcgactgccgcaaaaggtcc

SEQ ID NO: 187474 - DNA, 20 bp, human
gaagtagcggacacggaaca

SEQ ID NO: 187475 - DNA, 20 bp, human
gggctagagaatgcagggcc

SEQ ID NO: 187476 - DNA, 20 bp, human
gccacacaccagggcaccca

SEQ ID NO: 187477 - DNA, 20 bp, human
ggcccggaagatgtagacat

SEQ ID NO: 187478 - DNA, 20 bp, human
ggcagatgagcacactagga

SEQ ID NO: 187479 - DNA, 20 bp, human
gcagtgtgggcctcttccca

SEQ ID NO: 187480 - DNA, 20 bp, human
gctgggcagatgagcacact

SEQ ID NO: 187481 - DNA, 20 bp, human
ggatggagctcacaccctgg

SEQ ID NO: 187482 - DNA, 20 bp, human
gccctggtgtgtggcttcag

SEQ ID NO: 187483 - DNA, 20 bp, human
gaggagacaggccatgctga

SEQ ID NO: 187484 - DNA, 20 bp, human
gcaggcctgatgctgcttga

SEQ ID NO: 187485 - DNA, 20 bp, human
gctcgttggtgatgagcgtg

SEQ ID NO: 187486 - DNA, 20 bp, human
gagcctgggccggagcaagg

SEQ ID NO: 187487 - DNA, 20 bp, human
ggcaaggcggcagctcgtac

SEQ ID NO: 187488 - DNA, 20 bp, human
gcgaggaccaggagacaagt

SEQ ID NO: 187489 - DNA, 20 bp, human
gggtgacgcgtgaacccgag

SEQ ID NO: 187490 - DNA, 20 bp, human
gctgcgggagacgggcccta

SEQ ID NO: 187491 - DNA, 20 bp, human
gtgaacccgagaggcaccaa

SEQ ID NO: 187492 - DNA, 20 bp, human
gcacactcagcaaggcggaa

SEQ ID NO: 187493 - DNA, 20 bp, human
gaagcagggtaatccccccg

SEQ ID NO: 187494 - DNA, 20 bp, human
gaagggtgagaacttctagg

SEQ ID NO: 187495 - DNA, 20 bp, human
ggcgcggcccgcgaggtgga

SEQ ID NO: 187496 - DNA, 20 bp, human
gtagtcagggcagctagggt

SEQ ID NO: 187497 - DNA, 20 bp, human
ggttatagtcagggcagcta

SEQ ID NO: 187498 - DNA, 20 bp, human
gaggactaaagttatagtca

SEQ ID NO: 187499 - DNA, 20 bp, human
ggaaatgcgtgccttgccgg

SEQ ID NO: 187500 - DNA, 20 bp, human
ggttgtcaaaaacataactg

SEQ ID NO: 187501 - DNA, 20 bp, human
gggaggcctccgacgagaag

SEQ ID NO: 187502 - DNA, 20 bp, human
gctaagggagcagaagatcg

SEQ ID NO: 187503 - DNA, 20 bp, human
gctccgacgagaagcggtaa

SEQ ID NO: 187504 - DNA, 20 bp, human
gactcttgttgcccccggca

SEQ ID NO: 187505 - DNA, 20 bp, human
gccagcccggcgacctccac

SEQ ID NO: 187506 - DNA, 20 bp, human
ggctgaagcgagccaaggtg

SEQ ID NO: 187507 - DNA, 20 bp, human
gacgcggcgggagcatgttc

SEQ ID NO: 187508 - DNA, 20 bp, human
gtctggcctgcagtgcgcag

SEQ ID NO: 187509 - DNA, 20 bp, human
ggccaagaccccgctcacaa

SEQ ID NO: 187510 - DNA, 20 bp, human
gcagctgctgaagcgagcca

SEQ ID NO: 187511 - DNA, 20 bp, human
gtcctcggcagcggccccgt

SEQ ID NO: 187512 - DNA, 20 bp, human
ggagcagcagggagccgacg

SEQ ID NO: 187513 - DNA, 20 bp, human
gagtgcgcagaggacgcggc

SEQ ID NO: 187514 - DNA, 20 bp, human
gcgtgcggcgcgactcggga

SEQ ID NO: 187515 - DNA, 20 bp, human
gaggcccgctgcggcagagg

SEQ ID NO: 187516 - DNA, 20 bp, human
gggtcgtgggcactctatcg

SEQ ID NO: 187517 - DNA, 20 bp, human
gattcccgaggcagggtcgt

SEQ ID NO: 187518 - DNA, 20 bp, human
gtccgagtccgggtctggtg

SEQ ID NO: 187519 - DNA, 20 bp, human
gcccgggccacgcaccataa

SEQ ID NO: 187520 - DNA, 20 bp, human
gtggggtagctcaagaaacg

SEQ ID NO: 187521 - DNA, 20 bp, human
ggcgcaggcgagagtgagct

SEQ ID NO: 187522 - DNA, 20 bp, human
gggcactctatcgcggcggg

SEQ ID NO: 187523 - DNA, 20 bp, human
gaactgaggacagcgaaggg

SEQ ID NO: 187524 - DNA, 20 bp, human
gcgtgggcactctatcgcgg

SEQ ID NO: 187525 - DNA, 20 bp, human
ggagcgggattcccgaggca

SEQ ID NO: 187526 - DNA, 20 bp, human
gagagcgctccgggaggcta

SEQ ID NO: 187527 - DNA, 20 bp, human
gcccggaggcgcagtgtcat

SEQ ID NO: 187528 - DNA, 20 bp, human
ggggcaccgcagggaaacag

SEQ ID NO: 187529 - DNA, 20 bp, human
gggcgctagagcgctccggg

SEQ ID NO: 187530 - DNA, 20 bp, human
gggagaccggccgtgagcag

SEQ ID NO: 187531 - DNA, 20 bp, human
gttgtctcgccgcagcctaa

SEQ ID NO: 187532 - DNA, 20 bp, human
gccttaaaaatcgcacccgg

SEQ ID NO: 187533 - DNA, 20 bp, human
gttccagctgcactctccgg

SEQ ID NO: 187534 - DNA, 20 bp, human
gtgcgtcttcctttaggctg

SEQ ID NO: 187535 - DNA, 20 bp, human
ggggcgggctgcccagacct

SEQ ID NO: 187536 - DNA, 20 bp, human
ggaggcgccctgagaccgag

SEQ ID NO: 187537 - DNA, 20 bp, human
gcggctgggccaggaagaag

SEQ ID NO: 187538 - DNA, 20 bp, human
gcgagcgagctccgtgcggg

SEQ ID NO: 187539 - DNA, 20 bp, human
gccccgagcgagctccgtgc

SEQ ID NO: 187540 - DNA, 20 bp, human
ggcccgcgagtgcttcctcg

SEQ ID NO: 187541 - DNA, 20 bp, human
gaggttgcccgggtgctcgt

SEQ ID NO: 187542 - DNA, 20 bp, human
gacctcgaggaagcactcgc

SEQ ID NO: 187543 - DNA, 20 bp, human
gcaggtgaaagtggcccggg

SEQ ID NO: 187544 - DNA, 20 bp, human
gcagggcgcctcccgcaggt

SEQ ID NO: 187545 - DNA, 20 bp, human
gccgctgtgcgtcacctcct

SEQ ID NO: 187546 - DNA, 20 bp, human
gcatgaaaaagtctaaagta

SEQ ID NO: 187547 - DNA, 20 bp, human
ggtctaaagtagggcagttc

SEQ ID NO: 187548 - DNA, 20 bp, human
gatcatgcccagattatcag

SEQ ID NO: 187549 - DNA, 20 bp, human
gccgcttgctttatgggaaa

SEQ ID NO: 187550 - DNA, 20 bp, human
ggggtacctcacaaaactcc

SEQ ID NO: 187551 - DNA, 20 bp, human
gagactgggtaaactggcaa

SEQ ID NO: 187552 - DNA, 20 bp, human
gttttgcctggagttttgtg

SEQ ID NO: 187553 - DNA, 20 bp, human
gtgataaagcaggaaccaga

SEQ ID NO: 187554 - DNA, 20 bp, human
ggtgagcctctccagcagac

SEQ ID NO: 187555 - DNA, 20 bp, human
gaggtacccgcttgctttat

SEQ ID NO: 187556 - DNA, 20 bp, human
ggggtttgatgtcgacggag

SEQ ID NO: 187557 - DNA, 20 bp, human
ggaagcaagagtagagccgc

SEQ ID NO: 187558 - DNA, 20 bp, human
gggaacaggtcagtaactgg

SEQ ID NO: 187559 - DNA, 20 bp, human
ggtcatgggattgctgtcaa

SEQ ID NO: 187560 - DNA, 20 bp, human
gaactggcggttcccgaagt

SEQ ID NO: 187561 - DNA, 20 bp, human
gtgcttccggctccggcgtg

SEQ ID NO: 187562 - DNA, 20 bp, human
gctactcttgcttccggctc

SEQ ID NO: 187563 - DNA, 20 bp, human
gtagaacgaacgctcaacgt

SEQ ID NO: 187564 - DNA, 20 bp, human
gtcgacatcaaaccccacgc

SEQ ID NO: 187565 - DNA, 20 bp, human
ggcaagagtagagccgcggg

SEQ ID NO: 187566 - DNA, 20 bp, human
gcggcttcctcccgctgcgt

SEQ ID NO: 187567 - DNA, 20 bp, human
gaagccgcgccgtcgggctc

SEQ ID NO: 187568 - DNA, 20 bp, human
ggggctgcggaaggtaactg

SEQ ID NO: 187569 - DNA, 20 bp, human
gaccctggcgcacctcggtc

SEQ ID NO: 187570 - DNA, 20 bp, human
gctcggtccgggcgccaaag

SEQ ID NO: 187571 - DNA, 20 bp, human
gtagagcctccgcggcagag

SEQ ID NO: 187572 - DNA, 20 bp, human
gaggctgtgcagctttcgcg

SEQ ID NO: 187573 - DNA, 20 bp, human
ggctctcagagctcgacctg

SEQ ID NO: 187574 - DNA, 20 bp, human
gagctcgacctgcggcgtca

SEQ ID NO: 187575 - DNA, 20 bp, human
gcgttctcttagagcctccg

SEQ ID NO: 187576 - DNA, 20 bp, human
gtgccgagaggagcactgag

SEQ ID NO: 187577 - DNA, 20 bp, human
gtgagaccttcgggcaggga

SEQ ID NO: 187578 - DNA, 20 bp, human
gcttcgggcagggaaggcat

SEQ ID NO: 187579 - DNA, 20 bp, human
gaggctgctgacctacacgg

SEQ ID NO: 187580 - DNA, 20 bp, human
gggtgctggagaaaagccgg

SEQ ID NO: 187581 - DNA, 20 bp, human
gactgctgggtgagaccttc

SEQ ID NO: 187582 - DNA, 20 bp, human
ggcactgagaggcgactgct

SEQ ID NO: 187583 - DNA, 20 bp, human
gaccctggctattccctcta

SEQ ID NO: 187584 - DNA, 20 bp, human
gaccctggaggagtcgatag

SEQ ID NO: 187585 - DNA, 20 bp, human
gcacagtgctaagaaacctc

SEQ ID NO: 187586 - DNA, 20 bp, human
ggcttccacaaaccagatag

SEQ ID NO: 187587 - DNA, 20 bp, human
gaagctggagaacctctatc

SEQ ID NO: 187588 - DNA, 20 bp, human
ggaagtcgctgtacatctca

SEQ ID NO: 187589 - DNA, 20 bp, human
gccgggcccttgccagacgg

SEQ ID NO: 187590 - DNA, 20 bp, human
gtcgccttcggggtccgaca

SEQ ID NO: 187591 - DNA, 20 bp, human
gtcaccatgtcggaccccga

SEQ ID NO: 187592 - DNA, 20 bp, human
gtggcaagggcccggattct

SEQ ID NO: 187593 - DNA, 20 bp, human
gcactccctggcccagtgcg

SEQ ID NO: 187594 - DNA, 20 bp, human
gtcggccatataagagggaa

SEQ ID NO: 187595 - DNA, 20 bp, human
gtgccagacgggggcggaac

SEQ ID NO: 187596 - DNA, 20 bp, human
gtggatgcggcgaaacgctg

SEQ ID NO: 187597 - DNA, 20 bp, human
gcggccttcgctgtgtggtg

SEQ ID NO: 187598 - DNA, 20 bp, human
gagtccccaccacacagcga

SEQ ID NO: 187599 - DNA, 20 bp, human
gcgtccaggcggggttaccg

SEQ ID NO: 187600 - DNA, 20 bp, human
ggcggcgaaacgctgaggcg

SEQ ID NO: 187601 - DNA, 20 bp, human
gtccttaacaacgaacccca

SEQ ID NO: 187602 - DNA, 20 bp, human
gaggagggaagaaagcaccg

SEQ ID NO: 187603 - DNA, 20 bp, human
gtgtcccccgtgggaacaca

SEQ ID NO: 187604 - DNA, 20 bp, human
gcctggacgctggtacgaac

SEQ ID NO: 187605 - DNA, 20 bp, human
gaggcgcggccttcgctgtg

SEQ ID NO: 187606 - DNA, 20 bp, human
ggttaccgtaaatacacctg

SEQ ID NO: 187607 - DNA, 20 bp, human
gtgttatggccgcctccttg

SEQ ID NO: 187608 - DNA, 20 bp, human
gtgcggatactacctcaagg

SEQ ID NO: 187609 - DNA, 20 bp, human
gatgtgcggatactacctca

SEQ ID NO: 187610 - DNA, 20 bp, human
gggatactacctcaaggagg

SEQ ID NO: 187611 - DNA, 20 bp, human
gcaaaggcgctgaaatctag

SEQ ID NO: 187612 - DNA, 20 bp, human
gggccctagaattccatgtg

SEQ ID NO: 187613 - DNA, 20 bp, human
ggctcccacgagggccacac

SEQ ID NO: 187614 - DNA, 20 bp, human
gacacgcacgctctctggtc

SEQ ID NO: 187615 - DNA, 20 bp, human
ggtgccccgcgctgctgtta

SEQ ID NO: 187616 - DNA, 20 bp, human
gccagccgcgagccgtgagg

SEQ ID NO: 187617 - DNA, 20 bp, human
gatcccagccgcgagccgtg

SEQ ID NO: 187618 - DNA, 20 bp, human
gagtccaccggagcggtaag

SEQ ID NO: 187619 - DNA, 20 bp, human
gctgcgcacaccggggtggg

SEQ ID NO: 187620 - DNA, 20 bp, human
ggggcgcgcgcgcggtttgg

SEQ ID NO: 187621 - DNA, 20 bp, human
ggcgactgctccatccccac

SEQ ID NO: 187622 - DNA, 20 bp, human
gcgggtgccgcttaccgctc

SEQ ID NO: 187623 - DNA, 20 bp, human
ggtgccgcttaccgctccgg

SEQ ID NO: 187624 - DNA, 20 bp, human
gggcctgcgcacaccggggt

SEQ ID NO: 187625 - DNA, 20 bp, human
gcttttcccccagcccccgt

SEQ ID NO: 187626 - DNA, 20 bp, human
ggaagtcagtcccccaccgg

SEQ ID NO: 187627 - DNA, 20 bp, human
gtccgccggagcggagacag

SEQ ID NO: 187628 - DNA, 20 bp, human
ggcttcggaatcactgagag

SEQ ID NO: 187629 - DNA, 20 bp, human
ggccgaagtcagtcccccac

SEQ ID NO: 187630 - DNA, 20 bp, human
gctccggcggagccaggctt

SEQ ID NO: 187631 - DNA, 20 bp, human
ggtcctgttgagaactaggt

SEQ ID NO: 187632 - DNA, 20 bp, human
gcagcacctgccgccggtgg

SEQ ID NO: 187633 - DNA, 20 bp, human
gtcccctgtctccgctccgg

SEQ ID NO: 187634 - DNA, 20 bp, human
gcggaatcactgagagagga

SEQ ID NO: 187635 - DNA, 20 bp, human
gggagtgaaaaactaggcat

SEQ ID NO: 187636 - DNA, 20 bp, human
gacccgctccctcccgccgt

SEQ ID NO: 187637 - DNA, 20 bp, human
gggaggtgtcagccacgcac

SEQ ID NO: 187638 - DNA, 20 bp, human
gcgcgagcgcctccacccag

SEQ ID NO: 187639 - DNA, 20 bp, human
gcctccacgtcagccgacgg

SEQ ID NO: 187640 - DNA, 20 bp, human
ggagcgcctccacccagcgg

SEQ ID NO: 187641 - DNA, 20 bp, human
gggccctccacgtcagccga

SEQ ID NO: 187642 - DNA, 20 bp, human
ggcggacaccgacacaaaag

SEQ ID NO: 187643 - DNA, 20 bp, human
gacgtcagccgacggcggga

SEQ ID NO: 187644 - DNA, 20 bp, human
gcgcccgcgagcctcggacg

SEQ ID NO: 187645 - DNA, 20 bp, human
gcgacacaaaaggggcgacg

SEQ ID NO: 187646 - DNA, 20 bp, human
gccgagtggcctccggataa

SEQ ID NO: 187647 - DNA, 20 bp, human
gccacggcaacagggcaacc

SEQ ID NO: 187648 - DNA, 20 bp, human
gtcgccctcgctatacttga

SEQ ID NO: 187649 - DNA, 20 bp, human
ggttatgcgtgcggttacca

SEQ ID NO: 187650 - DNA, 20 bp, human
gggtggagcagctgctgagt

SEQ ID NO: 187651 - DNA, 20 bp, human
gctgccatcaagtatagcga

SEQ ID NO: 187652 - DNA, 20 bp, human
ggcgtggcggcagtcagaag

SEQ ID NO: 187653 - DNA, 20 bp, human
gatgagccggtacactagcg

SEQ ID NO: 187654 - DNA, 20 bp, human
gtgcggttaccacggcaaca

SEQ ID NO: 187655 - DNA, 20 bp, human
gattctggactgcagcgtgg

SEQ ID NO: 187656 - DNA, 20 bp, human
ggcagctgccgagtagggaa

SEQ ID NO: 187657 - DNA, 20 bp, human
gcccgacggggagttcaccg

SEQ ID NO: 187658 - DNA, 20 bp, human
gatgaggcggtacacgaccg

SEQ ID NO: 187659 - DNA, 20 bp, human
gactcggcagctgctctacc

SEQ ID NO: 187660 - DNA, 20 bp, human
ggttatgggtgcggttacta

SEQ ID NO: 187661 - DNA, 20 bp, human
gccgggtggcctccgcataa

SEQ ID NO: 187662 - DNA, 20 bp, human
ggcgtgcattgcggatgagg

SEQ ID NO: 187663 - DNA, 20 bp, human
gactatggcaacagagcaac

SEQ ID NO: 187664 - DNA, 20 bp, human
gggggatctgcgcgccgctc

SEQ ID NO: 187665 - DNA, 20 bp, human
gctgctatcaagtacagcga

SEQ ID NO: 187666 - DNA, 20 bp, human
ggcggatcaagctaggtgag

SEQ ID NO: 187667 - DNA, 20 bp, human
ggccgagcggaacttctgga

SEQ ID NO: 187668 - DNA, 20 bp, human
gggtatgacaagaccagtgg

SEQ ID NO: 187669 - DNA, 20 bp, human
gccacaggtggacccaagag

SEQ ID NO: 187670 - DNA, 20 bp, human
gacagtgacccggaaatgaa

SEQ ID NO: 187671 - DNA, 20 bp, human
gggagagtcgagggtagagt

SEQ ID NO: 187672 - DNA, 20 bp, human
ggaccagtgggggtctagga

SEQ ID NO: 187673 - DNA, 20 bp, human
gtgcagcagcgacctccagt

SEQ ID NO: 187674 - DNA, 20 bp, human
gcagcgggctcgggacagat

SEQ ID NO: 187675 - DNA, 20 bp, human
gaggatcttaggcaagtgag

SEQ ID NO: 187676 - DNA, 20 bp, human
ggagctccagaggcaaagat

SEQ ID NO: 187677 - DNA, 20 bp, human
gtgcctctggagctcacggt

SEQ ID NO: 187678 - DNA, 20 bp, human
gcagcgacgagagtcccggg

SEQ ID NO: 187679 - DNA, 20 bp, human
ggacactgagatgggagtcg

SEQ ID NO: 187680 - DNA, 20 bp, human
gcccgggtggaggcgacgtt

SEQ ID NO: 187681 - DNA, 20 bp, human
gcagctggctcctcacgggt

SEQ ID NO: 187682 - DNA, 20 bp, human
ggaaatccgcgacctgggaa

SEQ ID NO: 187683 - DNA, 20 bp, human
ggagacgacggatccccata

SEQ ID NO: 187684 - DNA, 20 bp, human
gacctccgagcggttagagg

SEQ ID NO: 187685 - DNA, 20 bp, human
ggccagctgccgcgacggtg

SEQ ID NO: 187686 - DNA, 20 bp, human
gggactgttcgaacgcccag

SEQ ID NO: 187687 - DNA, 20 bp, human
gccctgagcggtgggacggg

SEQ ID NO: 187688 - DNA, 20 bp, human
gaacgcgcaggtgacgtccg

SEQ ID NO: 187689 - DNA, 20 bp, human
gacgggtttggcccacccct

SEQ ID NO: 187690 - DNA, 20 bp, human
ggtggtcccggagaagagat

SEQ ID NO: 187691 - DNA, 20 bp, human
gcaccgctcagggaaggttg

SEQ ID NO: 187692 - DNA, 20 bp, human
ggccgcagacacctctccag

SEQ ID NO: 187693 - DNA, 20 bp, human
gagtccacagaagcgggcaa

SEQ ID NO: 187694 - DNA, 20 bp, human
gcagggacaagcgagtctga

SEQ ID NO: 187695 - DNA, 20 bp, human
gcccgctggagaggtgtctg

SEQ ID NO: 187696 - DNA, 20 bp, human
gggcccaggtgtgagagggt

SEQ ID NO: 187697 - DNA, 20 bp, human
gtccaggcagccctctcagt

SEQ ID NO: 187698 - DNA, 20 bp, human
gggcccagcaataggaaccc

SEQ ID NO: 187699 - DNA, 20 bp, human
ggcacaccccccgtcagtcc

SEQ ID NO: 187700 - DNA, 20 bp, human
gattccctcgtgggtggtgg

SEQ ID NO: 187701 - DNA, 20 bp, human
ggggacccagattccctcgt

SEQ ID NO: 187702 - DNA, 20 bp, human
ggagggctgcctggactgac

SEQ ID NO: 187703 - DNA, 20 bp, human
gtgtcccccaccacccacga

SEQ ID NO: 187704 - DNA, 20 bp, human
gaccacccacgagggaatct

SEQ ID NO: 187705 - DNA, 20 bp, human
gggtcctgcgtcccactgag

SEQ ID NO: 187706 - DNA, 20 bp, human
gctacgtgccctggaaccag

SEQ ID NO: 187707 - DNA, 20 bp, human
gcgtgccctggaaccagcgg

SEQ ID NO: 187708 - DNA, 20 bp, human
ggcagcccccgctggttcca

SEQ ID NO: 187709 - DNA, 20 bp, human
gggagacccgcaggaagcag

SEQ ID NO: 187710 - DNA, 20 bp, human
gctgctggtggtgctgcggg

SEQ ID NO: 187711 - DNA, 20 bp, human
ggtccggaaatggaaatccg

SEQ ID NO: 187712 - DNA, 20 bp, human
gtccagagcgcagggccgga

SEQ ID NO: 187713 - DNA, 20 bp, human
ggtccagcacagactcggtt

SEQ ID NO: 187714 - DNA, 20 bp, human
gttccagggcacgtaggcct

SEQ ID NO: 187715 - DNA, 20 bp, human
gcgccaaggcctacgtgccc

SEQ ID NO: 187716 - DNA, 20 bp, human
gcccgaggtagcagagaggg

SEQ ID NO: 187717 - DNA, 20 bp, human
gatggggactccaaatgatc

SEQ ID NO: 187718 - DNA, 20 bp, human
ggtctccaaatggggtgtca

SEQ ID NO: 187719 - DNA, 20 bp, human
gtgccaagaggagtaagctg

SEQ ID NO: 187720 - DNA, 20 bp, human
gggaagaacgagaagaaggt

SEQ ID NO: 187721 - DNA, 20 bp, human
ggcagcactgcctgatcatt

SEQ ID NO: 187722 - DNA, 20 bp, human
gggagtgtagctctgcacat

SEQ ID NO: 187723 - DNA, 20 bp, human
gttttggagttgagcaccat

SEQ ID NO: 187724 - DNA, 20 bp, human
gctggcctgctggcctcccg

SEQ ID NO: 187725 - DNA, 20 bp, human
ggttggattggacctcggag

SEQ ID NO: 187726 - DNA, 20 bp, human
ggttcggcgagagcgtgaac

SEQ ID NO: 187727 - DNA, 20 bp, human
gcctgaggcggtccacccag

SEQ ID NO: 187728 - DNA, 20 bp, human
ggcctcggcgtttgtagaag

SEQ ID NO: 187729 - DNA, 20 bp, human
gggcgagagcgtgaactggg

SEQ ID NO: 187730 - DNA, 20 bp, human
gtcctcttctacaaacgccg

SEQ ID NO: 187731 - DNA, 20 bp, human
gtttgcacaagggatcctaa

SEQ ID NO: 187732 - DNA, 20 bp, human
gctgggcggcgatgaggtgg

SEQ ID NO: 187733 - DNA, 20 bp, human
gaggagataagcgaaactgg

SEQ ID NO: 187734 - DNA, 20 bp, human
ggaactgggcggcgatgagg

SEQ ID NO: 187735 - DNA, 20 bp, human
ggtaagaagtttcaggctgt

SEQ ID NO: 187736 - DNA, 20 bp, human
ggcgactgccaggtacacgg

SEQ ID NO: 187737 - DNA, 20 bp, human
ggtacctggcagtcgcgcag

SEQ ID NO: 187738 - DNA, 20 bp, human
gtgaagggctcctggagaga

SEQ ID NO: 187739 - DNA, 20 bp, human
gctcgcggtggactccgacc

SEQ ID NO: 187740 - DNA, 20 bp, human
gggcctacagacggcaagaa

SEQ ID NO: 187741 - DNA, 20 bp, human
gttggaaccggcccaggact

SEQ ID NO: 187742 - DNA, 20 bp, human
gactccgacccggcgcaaca

SEQ ID NO: 187743 - DNA, 20 bp, human
ggacgcagggaagcccgcaa

SEQ ID NO: 187744 - DNA, 20 bp, human
ggtctcccgagtaccctgac

SEQ ID NO: 187745 - DNA, 20 bp, human
gggagtccaccgcgagctct

SEQ ID NO: 187746 - DNA, 20 bp, human
gcccagccggacgccaatcg

SEQ ID NO: 187747 - DNA, 20 bp, human
ggcagcacctgggccgcgat

SEQ ID NO: 187748 - DNA, 20 bp, human
gcacaggagtgaacgccacg

SEQ ID NO: 187749 - DNA, 20 bp, human
ggcccggctcggggttgcgg

SEQ ID NO: 187750 - DNA, 20 bp, human
gagccgaggtcatcgccgag

SEQ ID NO: 187751 - DNA, 20 bp, human
gtgaacgccacgaggcaggt

SEQ ID NO: 187752 - DNA, 20 bp, human
ggtaacagggcccaccccac

SEQ ID NO: 187753 - DNA, 20 bp, human
gctgggccgcgattggcgtc

SEQ ID NO: 187754 - DNA, 20 bp, human
gcgctgtgcggtcgcggacg

SEQ ID NO: 187755 - DNA, 20 bp, human
gcgcccctcggcgatgacct

SEQ ID NO: 187756 - DNA, 20 bp, human
ggcgcaaaggagggcaaaag

SEQ ID NO: 187757 - DNA, 20 bp, human
gctcagagctgcgggtccta

SEQ ID NO: 187758 - DNA, 20 bp, human
gtccaagtgctggcaggacg

SEQ ID NO: 187759 - DNA, 20 bp, human
gtgagcccagagccgagagc

SEQ ID NO: 187760 - DNA, 20 bp, human
gcgtgagggcgcgggaccat

SEQ ID NO: 187761 - DNA, 20 bp, human
gaccccagagaggggaccaa

SEQ ID NO: 187762 - DNA, 20 bp, human
gcgactcctgctctcggctc

SEQ ID NO: 187763 - DNA, 20 bp, human
gaagccctggacaggagtcc

SEQ ID NO: 187764 - DNA, 20 bp, human
gctcacgcccatccaagtgc

SEQ ID NO: 187765 - DNA, 20 bp, human
ggccggccccgcgagtcgtg

SEQ ID NO: 187766 - DNA, 20 bp, human
ggctgggccgaggcgagatc

SEQ ID NO: 187767 - DNA, 20 bp, human
ggctccgggcaggtagagcc

SEQ ID NO: 187768 - DNA, 20 bp, human
gcccgggagggaaaggacaa

SEQ ID NO: 187769 - DNA, 20 bp, human
gggtcctcaggtctcctccc

SEQ ID NO: 187770 - DNA, 20 bp, human
gggcagaggcgcattccctc

SEQ ID NO: 187771 - DNA, 20 bp, human
ggtgtccgagcagtcctggg

SEQ ID NO: 187772 - DNA, 20 bp, human
gatcggtgaccgacaggagg

SEQ ID NO: 187773 - DNA, 20 bp, human
gcgtgtgtccgagcagtcct

SEQ ID NO: 187774 - DNA, 20 bp, human
ggacgacggagactcggacg

SEQ ID NO: 187775 - DNA, 20 bp, human
gctgggtccggccccttcgg

SEQ ID NO: 187776 - DNA, 20 bp, human
ggccggcggaacccaaggcg

SEQ ID NO: 187777 - DNA, 20 bp, human
gatcagctatggaacaacct

SEQ ID NO: 187778 - DNA, 20 bp, human
gcccagcgccgtgaagcgag

SEQ ID NO: 187779 - DNA, 20 bp, human
gagcgagcggctccttccgg

SEQ ID NO: 187780 - DNA, 20 bp, human
gccatgacgtcgtctgaggt

SEQ ID NO: 187781 - DNA, 20 bp, human
gggcgtcgtccggactcgtg

SEQ ID NO: 187782 - DNA, 20 bp, human
gcttcacggcgctgggaccc

SEQ ID NO: 187783 - DNA, 20 bp, human
ggcgctgccgggaggattga

SEQ ID NO: 187784 - DNA, 20 bp, human
gggtctccccacgtgtgtag

SEQ ID NO: 187785 - DNA, 20 bp, human
ggagtccatgacgtcgtctg

SEQ ID NO: 187786 - DNA, 20 bp, human
ggaacccaaccgacagtggg

SEQ ID NO: 187787 - DNA, 20 bp, human
gggagaacccaaccgacagt

SEQ ID NO: 187788 - DNA, 20 bp, human
ggcgtcctgccgcccactgt

SEQ ID NO: 187789 - DNA, 20 bp, human
gaaccgtggccgggtcctcg

SEQ ID NO: 187790 - DNA, 20 bp, human
gccacaccgctgctccctgg

SEQ ID NO: 187791 - DNA, 20 bp, human
gcctgccgcccactgtcggt

SEQ ID NO: 187792 - DNA, 20 bp, human
gagcatctgtcccaaacggg

SEQ ID NO: 187793 - DNA, 20 bp, human
gtcagacgatcgggaggtgg

SEQ ID NO: 187794 - DNA, 20 bp, human
gtgtcgccgccagggagcag

SEQ ID NO: 187795 - DNA, 20 bp, human
gcaggacgcaccgcggaccc

SEQ ID NO: 187796 - DNA, 20 bp, human
gtggagtggccgggagatga

SEQ ID NO: 187797 - DNA, 20 bp, human
ggccagccagggagcctcgt

SEQ ID NO: 187798 - DNA, 20 bp, human
gtgtgtgccgaggaattcac

SEQ ID NO: 187799 - DNA, 20 bp, human
gaaattaaccgcagtcaggt

SEQ ID NO: 187800 - DNA, 20 bp, human
ggagagggcgtgcgtctctg

SEQ ID NO: 187801 - DNA, 20 bp, human
gtcttgcagaaattgcaggt

SEQ ID NO: 187802 - DNA, 20 bp, human
gcagtcaggtcggcagcagg

SEQ ID NO: 187803 - DNA, 20 bp, human
gtccaacgaggctccctggc

SEQ ID NO: 187804 - DNA, 20 bp, human
gtctgtggttataaagttgg

SEQ ID NO: 187805 - DNA, 20 bp, human
gccgatcttgcagaaattgc

SEQ ID NO: 187806 - DNA, 20 bp, human
gggcggtggcgtcggagact

SEQ ID NO: 187807 - DNA, 20 bp, human
gcgcagccggagaaggccgg

SEQ ID NO: 187808 - DNA, 20 bp, human
ggcgggctagggctctggat

SEQ ID NO: 187809 - DNA, 20 bp, human
gaaggtggcgtgtacctctg

SEQ ID NO: 187810 - DNA, 20 bp, human
gctagtctgaagctctcagg

SEQ ID NO: 187811 - DNA, 20 bp, human
gcgtacctgcggctaagagc

SEQ ID NO: 187812 - DNA, 20 bp, human
gcctctggggagggaccccg

SEQ ID NO: 187813 - DNA, 20 bp, human
gaggggagaggagcggaccg

SEQ ID NO: 187814 - DNA, 20 bp, human
gggtcgctacagatgacaag

SEQ ID NO: 187815 - DNA, 20 bp, human
gctacagatgacaaggggag

SEQ ID NO: 187816 - DNA, 20 bp, human
gtcgagcccacccggcccct

SEQ ID NO: 187817 - DNA, 20 bp, human
gcggcccctaggcacaggaa

SEQ ID NO: 187818 - DNA, 20 bp, human
gctgtgcctaggggccgggt

SEQ ID NO: 187819 - DNA, 20 bp, human
ggagcgcgtcctctcttcgg

SEQ ID NO: 187820 - DNA, 20 bp, human
gcgctgtggcaggttcaccc

SEQ ID NO: 187821 - DNA, 20 bp, human
gaccgagcgcgtcctctctt

SEQ ID NO: 187822 - DNA, 20 bp, human
ggactggctccaccgaagag

SEQ ID NO: 187823 - DNA, 20 bp, human
gcgctcggcgagtgtccaac

SEQ ID NO: 187824 - DNA, 20 bp, human
gttagcgaggcggaacagag

SEQ ID NO: 187825 - DNA, 20 bp, human
gaggtgcacgacgccccacg

SEQ ID NO: 187826 - DNA, 20 bp, human
gggagctgctacagcagagg

SEQ ID NO: 187827 - DNA, 20 bp, human
gtccggacaccggtgagtaa

SEQ ID NO: 187828 - DNA, 20 bp, human
gcacggctcctacctgaagg

SEQ ID NO: 187829 - DNA, 20 bp, human
ggagcggcccgtacgcgtac

SEQ ID NO: 187830 - DNA, 20 bp, human
gcaccggtgagtaagggaag

SEQ ID NO: 187831 - DNA, 20 bp, human
gctccggcatgcggtcccag

SEQ ID NO: 187832 - DNA, 20 bp, human
gtcgcgggcgctgtcatgga

SEQ ID NO: 187833 - DNA, 20 bp, human
ggtcccagtggccctcggcg

SEQ ID NO: 187834 - DNA, 20 bp, human
gaaaggtgaacgctgcgctc

SEQ ID NO: 187835 - DNA, 20 bp, human
gtgtcggccgaggactgtct

SEQ ID NO: 187836 - DNA, 20 bp, human
gctcccactggcactcggag

SEQ ID NO: 187837 - DNA, 20 bp, human
gggtcccgcgcacatcccct

SEQ ID NO: 187838 - DNA, 20 bp, human
gcccacaccgcgtgactccg

SEQ ID NO: 187839 - DNA, 20 bp, human
gctcagggatccgctcccac

SEQ ID NO: 187840 - DNA, 20 bp, human
gcggcgctcccgttacgccg

SEQ ID NO: 187841 - DNA, 20 bp, human
gctgggccgcagctccctcg

SEQ ID NO: 187842 - DNA, 20 bp, human
gcgcgcccggagcgtaccgt

SEQ ID NO: 187843 - DNA, 20 bp, human
gcggccaagctcatcgccaa

SEQ ID NO: 187844 - DNA, 20 bp, human
gcagcccctggcgccccccc

SEQ ID NO: 187845 - DNA, 20 bp, human
gcggagtctggggtgtccgg

SEQ ID NO: 187846 - DNA, 20 bp, human
gagcgctccaggagagaggt

SEQ ID NO: 187847 - DNA, 20 bp, human
gcattctgggacacgtatag

SEQ ID NO: 187848 - DNA, 20 bp, human
gtctgggacacgtatagggg

SEQ ID NO: 187849 - DNA, 20 bp, human
gctgccggtgcggccagcga

SEQ ID NO: 187850 - DNA, 20 bp, human
gtgggcgtggagtgaagagc

SEQ ID NO: 187851 - DNA, 20 bp, human
gagttcagggctctcattct

SEQ ID NO: 187852 - DNA, 20 bp, human
gagcgaaggcccagcgctcc

SEQ ID NO: 187853 - DNA, 20 bp, human
ggggccttcgctggccgcac

SEQ ID NO: 187854 - DNA, 20 bp, human
ggcaccggcagccatgagct

SEQ ID NO: 187855 - DNA, 20 bp, human
gcctcgtcaagtaaagttca

SEQ ID NO: 187856 - DNA, 20 bp, human
gcgcccgcggcttttaaacc

SEQ ID NO: 187857 - DNA, 20 bp, human
ggcggcttttaaacccggga

SEQ ID NO: 187858 - DNA, 20 bp, human
gtggcggccgtgacaccccg

SEQ ID NO: 187859 - DNA, 20 bp, human
gcaaggggcgcagtgctaca

SEQ ID NO: 187860 - DNA, 20 bp, human
gttctccccgctgctgccag

SEQ ID NO: 187861 - DNA, 20 bp, human
gcggccgtgacaccccgcgg

SEQ ID NO: 187862 - DNA, 20 bp, human
gggcgttgctggagctgaag

SEQ ID NO: 187863 - DNA, 20 bp, human
ggtgacaccccgcggcggtc

SEQ ID NO: 187864 - DNA, 20 bp, human
gccgacctggcccctcgctg

SEQ ID NO: 187865 - DNA, 20 bp, human
gatggagagaaagggctcgg

SEQ ID NO: 187866 - DNA, 20 bp, human
gcccgacggcgtacccgtga

SEQ ID NO: 187867 - DNA, 20 bp, human
ggcgcctcagcgaggagcag

SEQ ID NO: 187868 - DNA, 20 bp, human
gctggtggagagcacggagg

SEQ ID NO: 187869 - DNA, 20 bp, human
gcggcgcctggtggagagca

SEQ ID NO: 187870 - DNA, 20 bp, human
gaccgggacgagccgagcca

SEQ ID NO: 187871 - DNA, 20 bp, human
ggcctgggcccgagcccggt

SEQ ID NO: 187872 - DNA, 20 bp, human
gagtgttacgactccctcac

SEQ ID NO: 187873 - DNA, 20 bp, human
gggacgagccgagccatggc

SEQ ID NO: 187874 - DNA, 20 bp, human
ggatggggcacgaggggagg

SEQ ID NO: 187875 - DNA, 20 bp, human
gcagagccgtcggggagcct

SEQ ID NO: 187876 - DNA, 20 bp, human
gctcaagcaaggccctactc

SEQ ID NO: 187877 - DNA, 20 bp, human
ggtaccgagatgctgtgagt

SEQ ID NO: 187878 - DNA, 20 bp, human
ggaaccagcgctaccgggaa

SEQ ID NO: 187879 - DNA, 20 bp, human
gggcgggtccaatagaaagg

SEQ ID NO: 187880 - DNA, 20 bp, human
gccgcaacaattcctgagta

SEQ ID NO: 187881 - DNA, 20 bp, human
ggtgagaacgcctgggacac

SEQ ID NO: 187882 - DNA, 20 bp, human
gtgcgggcgtgagaacgcct

SEQ ID NO: 187883 - DNA, 20 bp, human
ggtacctactcacagcatct

SEQ ID NO: 187884 - DNA, 20 bp, human
gccagttccgcaagaaccgt

SEQ ID NO: 187885 - DNA, 20 bp, human
ggggggcgggtccaatagaa

SEQ ID NO: 187886 - DNA, 20 bp, human
gaggtggcggcgctttcgga

SEQ ID NO: 187887 - DNA, 20 bp, human
gcacttccgggttgggagaa

SEQ ID NO: 187888 - DNA, 20 bp, human
ggcgcgtaaaaactcagcgt

SEQ ID NO: 187889 - DNA, 20 bp, human
gcccggaagtgctgctgttg

SEQ ID NO: 187890 - DNA, 20 bp, human
gccttatctcggggaaactg

SEQ ID NO: 187891 - DNA, 20 bp, human
gtcctcaacagcagcacttc

SEQ ID NO: 187892 - DNA, 20 bp, human
gtgccccaggccttatctcg

SEQ ID NO: 187893 - DNA, 20 bp, human
ggcgggtctcccagaagacg

SEQ ID NO: 187894 - DNA, 20 bp, human
ggagacctcaggccaaaagg

SEQ ID NO: 187895 - DNA, 20 bp, human
gaccgcggcctggagacctc

SEQ ID NO: 187896 - DNA, 20 bp, human
gaggtgtccagagcacggta

SEQ ID NO: 187897 - DNA, 20 bp, human
ggaaccatcggcccagagag

SEQ ID NO: 187898 - DNA, 20 bp, human
gaagttaggtgtccagagca

SEQ ID NO: 187899 - DNA, 20 bp, human
gcagctccagacctactcgg

SEQ ID NO: 187900 - DNA, 20 bp, human
gaagagggcggagtaaaagg

SEQ ID NO: 187901 - DNA, 20 bp, human
ggcccagctccagacctact

SEQ ID NO: 187902 - DNA, 20 bp, human
gttcgtgcgggccaccgagt

SEQ ID NO: 187903 - DNA, 20 bp, human
gacccagagctggaaaacac

SEQ ID NO: 187904 - DNA, 20 bp, human
gcttgggggacccagcgaaa

SEQ ID NO: 187905 - DNA, 20 bp, human
gagagcacggtaaggggcta

SEQ ID NO: 187906 - DNA, 20 bp, human
gagagaaaggctggaagacg

SEQ ID NO: 187907 - DNA, 20 bp, human
gaaggctggaagacgaggta

SEQ ID NO: 187908 - DNA, 20 bp, human
gcagctgggaccctgtagag

SEQ ID NO: 187909 - DNA, 20 bp, human
gaagagtggcgggaaccaga

SEQ ID NO: 187910 - DNA, 20 bp, human
gacttccggcgaggcagagg

SEQ ID NO: 187911 - DNA, 20 bp, human
gggcaagggccggagcagag

SEQ ID NO: 187912 - DNA, 20 bp, human
gaggcgtgaaaagggcacgt

SEQ ID NO: 187913 - DNA, 20 bp, human
gcgaggtaagggaagagtgg

SEQ ID NO: 187914 - DNA, 20 bp, human
gccgcgagagcgaggtcaaa

SEQ ID NO: 187915 - DNA, 20 bp, human
ggagagccgaacacatatgg

SEQ ID NO: 187916 - DNA, 20 bp, human
ggccggtgtctaacaggatc

SEQ ID NO: 187917 - DNA, 20 bp, human
gcaccaacttaaccaccccc

SEQ ID NO: 187918 - DNA, 20 bp, human
gagccgttgcaggtacctgg

SEQ ID NO: 187919 - DNA, 20 bp, human
gcacccccaggtacctgcaa

SEQ ID NO: 187920 - DNA, 20 bp, human
gtccggatcctgttagacac

SEQ ID NO: 187921 - DNA, 20 bp, human
gcagcaatatgagctaggtc

SEQ ID NO: 187922 - DNA, 20 bp, human
ggcgagccgttgcaggtacc

SEQ ID NO: 187923 - DNA, 20 bp, human
gtacctgggggtggttaagt

SEQ ID NO: 187924 - DNA, 20 bp, human
gcacagaacgaggatggagg

SEQ ID NO: 187925 - DNA, 20 bp, human
ggggatccgttgaagaggga

SEQ ID NO: 187926 - DNA, 20 bp, human
ggaacagccgcagccggtgt

SEQ ID NO: 187927 - DNA, 20 bp, human
gcggagccaggtatgcgacg

SEQ ID NO: 187928 - DNA, 20 bp, human
gcctacagaaagctgcgctg

SEQ ID NO: 187929 - DNA, 20 bp, human
ggaccgtagtgatagcgacg

SEQ ID NO: 187930 - DNA, 20 bp, human
ggaactgggaaagaagcggg

SEQ ID NO: 187931 - DNA, 20 bp, human
gcgctggggaaatgaaaaga

SEQ ID NO: 187932 - DNA, 20 bp, human
ggcggctaaacgagctggag

SEQ ID NO: 187933 - DNA, 20 bp, human
gcctcagtgcgccggtgcac

SEQ ID NO: 187934 - DNA, 20 bp, human
gtggcccacgctggaaagaa

SEQ ID NO: 187935 - DNA, 20 bp, human
gtaacaatgagcccctacac

SEQ ID NO: 187936 - DNA, 20 bp, human
ggctcacccagtctcccgaa

SEQ ID NO: 187937 - DNA, 20 bp, human
gcgcagggccgctccgagga

SEQ ID NO: 187938 - DNA, 20 bp, human
gtgtgcccgacaagcgacag

SEQ ID NO: 187939 - DNA, 20 bp, human
gggagggcagacgggaatcg

SEQ ID NO: 187940 - DNA, 20 bp, human
gcgcgcctctcgggtgccgg

SEQ ID NO: 187941 - DNA, 20 bp, human
ggccggctaccgcgcctctc

SEQ ID NO: 187942 - DNA, 20 bp, human
gaggagcagccgggagacct

SEQ ID NO: 187943 - DNA, 20 bp, human
gccgtctgccctcctcggag

SEQ ID NO: 187944 - DNA, 20 bp, human
gtcccgcggcccgttagaac

SEQ ID NO: 187945 - DNA, 20 bp, human
gttgtcgggcacatcagaaa

SEQ ID NO: 187946 - DNA, 20 bp, human
gcgcatgggtgagagagtgt

SEQ ID NO: 187947 - DNA, 20 bp, human
gtcctgcgagcgccggagag

SEQ ID NO: 187948 - DNA, 20 bp, human
gctcagagcgccgagggact

SEQ ID NO: 187949 - DNA, 20 bp, human
gaaacgaatgggaaacgtgt

SEQ ID NO: 187950 - DNA, 20 bp, human
gctcggaggagcgccctgca

SEQ ID NO: 187951 - DNA, 20 bp, human
ggtaagtcataggaactcag

SEQ ID NO: 187952 - DNA, 20 bp, human
gacagcacgaggtaagtcat

SEQ ID NO: 187953 - DNA, 20 bp, human
ggcagggcgcaatgtacctg

SEQ ID NO: 187954 - DNA, 20 bp, human
ggtgggcgccagtgtctacg

SEQ ID NO: 187955 - DNA, 20 bp, human
gtgtgggctcagagcgccga

SEQ ID NO: 187956 - DNA, 20 bp, human
gcgacgcagatggacactgt

SEQ ID NO: 187957 - DNA, 20 bp, human
gctcctcaccaacagggcag

SEQ ID NO: 187958 - DNA, 20 bp, human
gctgtgggccggacctggag

SEQ ID NO: 187959 - DNA, 20 bp, human
gccctgttggtgaggagggt

SEQ ID NO: 187960 - DNA, 20 bp, human
ggccggcaggttccaggtgg

SEQ ID NO: 187961 - DNA, 20 bp, human
gtgccacacccggaccccct

SEQ ID NO: 187962 - DNA, 20 bp, human
gggacactgtgggccggacc

SEQ ID NO: 187963 - DNA, 20 bp, human
gtcacgtctgcacccagcac

SEQ ID NO: 187964 - DNA, 20 bp, human
gaatccccctggcccgtctg

SEQ ID NO: 187965 - DNA, 20 bp, human
gcagcaccggcctcacagcc

SEQ ID NO: 187966 - DNA, 20 bp, human
gctgggccaggaaacaacag

SEQ ID NO: 187967 - DNA, 20 bp, human
gccgcaggcagggcgtagga

SEQ ID NO: 187968 - DNA, 20 bp, human
gggcaggtaagaagcgccgg

SEQ ID NO: 187969 - DNA, 20 bp, human
ggccacgtggggccctagga

SEQ ID NO: 187970 - DNA, 20 bp, human
gcaaaggacgcacgacctgt

SEQ ID NO: 187971 - DNA, 20 bp, human
gactggacagggatcgggta

SEQ ID NO: 187972 - DNA, 20 bp, human
gccgcagagcaagtcctgga

SEQ ID NO: 187973 - DNA, 20 bp, human
gtcgggaggctgctcaggag

SEQ ID NO: 187974 - DNA, 20 bp, human
gagagcaagtcctggacgga

SEQ ID NO: 187975 - DNA, 20 bp, human
gggccggaggccgctgtcaa

SEQ ID NO: 187976 - DNA, 20 bp, human
gctcaggctcgggttgacag

SEQ ID NO: 187977 - DNA, 20 bp, human
gacccgagcctgagcgatca

SEQ ID NO: 187978 - DNA, 20 bp, human
ggcccagtgcggctgaggag

SEQ ID NO: 187979 - DNA, 20 bp, human
ggcctgagcgatcatggcaa

SEQ ID NO: 187980 - DNA, 20 bp, human
gggcggggaacgcgtggcag

SEQ ID NO: 187981 - DNA, 20 bp, human
gggcggccgctgaaggacct

SEQ ID NO: 187982 - DNA, 20 bp, human
gccggcttcggcttggacgg

SEQ ID NO: 187983 - DNA, 20 bp, human
gcgatcatggcaacgggctc

SEQ ID NO: 187984 - DNA, 20 bp, human
gcccgttgccatgatcgctc

SEQ ID NO: 187985 - DNA, 20 bp, human
ggcttggacgggggcagcgt

SEQ ID NO: 187986 - DNA, 20 bp, human
ggcgcgagcttgccaggagg

SEQ ID NO: 187987 - DNA, 20 bp, human
gggaccccgctcggcctcca

SEQ ID NO: 187988 - DNA, 20 bp, human
gctcgggcccgggcagatca

SEQ ID NO: 187989 - DNA, 20 bp, human
gatctgcccgggcccgagac

SEQ ID NO: 187990 - DNA, 20 bp, human
gggagggcagggccgacgga

SEQ ID NO: 187991 - DNA, 20 bp, human
gatcagggccgcaggtaccc

SEQ ID NO: 187992 - DNA, 20 bp, human
ggcgggtgctggcgccatgg

SEQ ID NO: 187993 - DNA, 20 bp, human
gccgggcaggccctgcgcat

SEQ ID NO: 187994 - DNA, 20 bp, human
gcaggagaccggggtacctg

SEQ ID NO: 187995 - DNA, 20 bp, human
gtggagcggcgtggagttgg

SEQ ID NO: 187996 - DNA, 20 bp, human
gtcccattggagaagcgtcc

SEQ ID NO: 187997 - DNA, 20 bp, human
gacacgagggcagttcccat

SEQ ID NO: 187998 - DNA, 20 bp, human
ggttcactcctagctcccgg

SEQ ID NO: 187999 - DNA, 20 bp, human
gtaggagtgaacccctgcgg

SEQ ID NO: 188000 - DNA, 20 bp, human
gtctcctcgtaaccacgggt

SEQ ID NO: 188001 - DNA, 20 bp, human
gagctaggagtgaacccctg

SEQ ID NO: 188002 - DNA, 20 bp, human
gctcgtgtccatggcaacgg

SEQ ID NO: 188003 - DNA, 20 bp, human
ggcggccacgggcttgctag

SEQ ID NO: 188004 - DNA, 20 bp, human
gtgtccccacgatcgcgagg

SEQ ID NO: 188005 - DNA, 20 bp, human
gagagggaaagggccagcgt

SEQ ID NO: 188006 - DNA, 20 bp, human
ggaaccagcgcccaatgaga

SEQ ID NO: 188007 - DNA, 20 bp, human
gcaggtcccgccctctcatt

SEQ ID NO: 188008 - DNA, 20 bp, human
gccagcgcccaatgagaggg

SEQ ID NO: 188009 - DNA, 20 bp, human
ggtgcactgggacccccgag

SEQ ID NO: 188010 - DNA, 20 bp, human
gcgccagctgaaatgcgcgg

SEQ ID NO: 188011 - DNA, 20 bp, human
gtcccttgaaggagtatgaa

SEQ ID NO: 188012 - DNA, 20 bp, human
gggcgacacgtaggatggga

SEQ ID NO: 188013 - DNA, 20 bp, human
gaggaggcactggacaccat

SEQ ID NO: 188014 - DNA, 20 bp, human
gcagcgccagctgaaatgcg

SEQ ID NO: 188015 - DNA, 20 bp, human
gagcacagcggccattcaat

SEQ ID NO: 188016 - DNA, 20 bp, human
gtcccaggcacccacgccca

SEQ ID NO: 188017 - DNA, 20 bp, human
gccgagggggtgggtatccg

SEQ ID NO: 188018 - DNA, 20 bp, human
gtacgtggagagagctgtca

SEQ ID NO: 188019 - DNA, 20 bp, human
gagagagctgtcaaggtcag

SEQ ID NO: 188020 - DNA, 20 bp, human
gataggggcggggtacactg

SEQ ID NO: 188021 - DNA, 20 bp, human
gaggaacttcccgggagagg

SEQ ID NO: 188022 - DNA, 20 bp, human
gtgggtatccgaggcgccct

SEQ ID NO: 188023 - DNA, 20 bp, human
gggcaggaacttcccgggag

SEQ ID NO: 188024 - DNA, 20 bp, human
gctctggcgaggatcctcca

SEQ ID NO: 188025 - DNA, 20 bp, human
gtccaaggcaatagcaaacg

SEQ ID NO: 188026 - DNA, 20 bp, human
ggctcggaggccataactag

SEQ ID NO: 188027 - DNA, 20 bp, human
ggcagtgttcgggcacccgg

SEQ ID NO: 188028 - DNA, 20 bp, human
gccgcagccgcactcaccta

SEQ ID NO: 188029 - DNA, 20 bp, human
gccgagagtctggaagaaga

SEQ ID NO: 188030 - DNA, 20 bp, human
gactcaggtagagggaggtc

SEQ ID NO: 188031 - DNA, 20 bp, human
gcaggacagaggaagctcgg

SEQ ID NO: 188032 - DNA, 20 bp, human
gggagccgcggcctcctacc

SEQ ID NO: 188033 - DNA, 20 bp, human
gctaagttcgcggggcgtgg

SEQ ID NO: 188034 - DNA, 20 bp, human
gccgaggaggcgcgaagtcc

SEQ ID NO: 188035 - DNA, 20 bp, human
gagcggacagaccgagagtc

SEQ ID NO: 188036 - DNA, 20 bp, human
gctgcgcagtggctccgagc

SEQ ID NO: 188037 - DNA, 20 bp, human
gtaaccggggaagcagccgt

SEQ ID NO: 188038 - DNA, 20 bp, human
gtcgggagaggagtctcctt

SEQ ID NO: 188039 - DNA, 20 bp, human
gcgcgcgcttccctacccta

SEQ ID NO: 188040 - DNA, 20 bp, human
gagggatgccaacctctcct

SEQ ID NO: 188041 - DNA, 20 bp, human
ggaagccaacagctactccc

SEQ ID NO: 188042 - DNA, 20 bp, human
gccgggaatgctcctcccta

SEQ ID NO: 188043 - DNA, 20 bp, human
ggctcaccccaatcccacgt

SEQ ID NO: 188044 - DNA, 20 bp, human
gcgcagtggctccgagcggg

SEQ ID NO: 188045 - DNA, 20 bp, human
gcggggagaaacaggtctat

SEQ ID NO: 188046 - DNA, 20 bp, human
gctgccggccccctcctcga

SEQ ID NO: 188047 - DNA, 20 bp, human
gcatggaacgccaccaggga

SEQ ID NO: 188048 - DNA, 20 bp, human
gccccctcctcgaaggatga

SEQ ID NO: 188049 - DNA, 20 bp, human
gcggagccgagggaccgtga

SEQ ID NO: 188050 - DNA, 20 bp, human
ggaaggagtaacgctcccat

SEQ ID NO: 188051 - DNA, 20 bp, human
gagctggactagcagcccag

SEQ ID NO: 188052 - DNA, 20 bp, human
gggaaggtttctccagacaa

SEQ ID NO: 188053 - DNA, 20 bp, human
ggagagttgtgtgagtccca

SEQ ID NO: 188054 - DNA, 20 bp, human
gagggcagcgggctaccctg

SEQ ID NO: 188055 - DNA, 20 bp, human
gcccaatgatggggatgaag

SEQ ID NO: 188056 - DNA, 20 bp, human
gggacctcctgactccgagg

SEQ ID NO: 188057 - DNA, 20 bp, human
gcccgagccgtggctgccac

SEQ ID NO: 188058 - DNA, 20 bp, human
gacaggagggatcaacggag

SEQ ID NO: 188059 - DNA, 20 bp, human
gccaccgcccgtggcagcca

SEQ ID NO: 188060 - DNA, 20 bp, human
ggggactccggtgctcgacg

SEQ ID NO: 188061 - DNA, 20 bp, human
ggtgggcggccgccccgact

SEQ ID NO: 188062 - DNA, 20 bp, human
gcggtagccgccacccgctt

SEQ ID NO: 188063 - DNA, 20 bp, human
gggcactccgcgtcgagcac

SEQ ID NO: 188064 - DNA, 20 bp, human
gattctgcccaaacctctca

SEQ ID NO: 188065 - DNA, 20 bp, human
gggctccagatgggagactc

SEQ ID NO: 188066 - DNA, 20 bp, human
gtcagaaggcctgaccacag

SEQ ID NO: 188067 - DNA, 20 bp, human
gcctctgcacacacaggtgg

SEQ ID NO: 188068 - DNA, 20 bp, human
ggcgtccctaaggggagctg

SEQ ID NO: 188069 - DNA, 20 bp, human
gtatccccacaggaagcatg

SEQ ID NO: 188070 - DNA, 20 bp, human
ggcacagtgagcgtccctaa

SEQ ID NO: 188071 - DNA, 20 bp, human
gactcagagaatgcctgcgt

SEQ ID NO: 188072 - DNA, 20 bp, human
gaagcatgaggctcctggat

SEQ ID NO: 188073 - DNA, 20 bp, human
ggggtgtggggaacctacgc

SEQ ID NO: 188074 - DNA, 20 bp, human
gggtcaggccttctgagcag

SEQ ID NO: 188075 - DNA, 20 bp, human
gggccctgggagcttatatg

SEQ ID NO: 188076 - DNA, 20 bp, human
gaagcacgcgaggcgcgcgg

SEQ ID NO: 188077 - DNA, 20 bp, human
gacataacgcgattccccag

SEQ ID NO: 188078 - DNA, 20 bp, human
gttatgtcgcgaccgaaggt

SEQ ID NO: 188079 - DNA, 20 bp, human
gtcaggtcgactcctacctt

SEQ ID NO: 188080 - DNA, 20 bp, human
gcgggacgcataagcacgcg

SEQ ID NO: 188081 - DNA, 20 bp, human
gggtttggatctggcccctg

SEQ ID NO: 188082 - DNA, 20 bp, human
gaaaaagccgaggaactcag

SEQ ID NO: 188083 - DNA, 20 bp, human
gcaggaaatctgaaattctg

SEQ ID NO: 188084 - DNA, 20 bp, human
gacttgcgcagcagcttggg

SEQ ID NO: 188085 - DNA, 20 bp, human
gctgtctgtcgccttggcaa

SEQ ID NO: 188086 - DNA, 20 bp, human
gcccacggcccgcgggacaa

SEQ ID NO: 188087 - DNA, 20 bp, human
gccgtgggcccggcacactg

SEQ ID NO: 188088 - DNA, 20 bp, human
gatggcaccatccctcctag

SEQ ID NO: 188089 - DNA, 20 bp, human
ggtggggccgccacctccgg

SEQ ID NO: 188090 - DNA, 20 bp, human
gggaggaaggctggttggta

SEQ ID NO: 188091 - DNA, 20 bp, human
gcgcgtggggccgccacctc

SEQ ID NO: 188092 - DNA, 20 bp, human
gggacaacggcagtttgttg

SEQ ID NO: 188093 - DNA, 20 bp, human
gaggggccgaaatggatgga

SEQ ID NO: 188094 - DNA, 20 bp, human
gacgggtggagaggatgtat

SEQ ID NO: 188095 - DNA, 20 bp, human
gtccatttcggcccctagga

SEQ ID NO: 188096 - DNA, 20 bp, human
gcagcctcgcctcgggtgta

SEQ ID NO: 188097 - DNA, 20 bp, human
ggcattcccagcctcgcctc

SEQ ID NO: 188098 - DNA, 20 bp, human
gataagggcaggccagaccc

SEQ ID NO: 188099 - DNA, 20 bp, human
gcacgactgctcaagagcca

SEQ ID NO: 188100 - DNA, 20 bp, human
gtatgcaatccctacacccg

SEQ ID NO: 188101 - DNA, 20 bp, human
gaatccctacacccgaggcg

SEQ ID NO: 188102 - DNA, 20 bp, human
gtctcaagagtgcctaaaaa

SEQ ID NO: 188103 - DNA, 20 bp, human
ggaggctcaccgattcatgt

SEQ ID NO: 188104 - DNA, 20 bp, human
ggaccatctccgacatgaat

SEQ ID NO: 188105 - DNA, 20 bp, human
gcaagagtgcctaaaaaggg

SEQ ID NO: 188106 - DNA, 20 bp, human
ggcactggccgacacactgg

SEQ ID NO: 188107 - DNA, 20 bp, human
gagtgctagctacgcagcag

SEQ ID NO: 188108 - DNA, 20 bp, human
gagtacctctttagcaccag

SEQ ID NO: 188109 - DNA, 20 bp, human
gggtgctgccgccagtgtgt

SEQ ID NO: 188110 - DNA, 20 bp, human
gctagcactggccgacacac

SEQ ID NO: 188111 - DNA, 20 bp, human
gtaaagaggtactgtcagaa

SEQ ID NO: 188112 - DNA, 20 bp, human
ggttgccactggtgctaaag

SEQ ID NO: 188113 - DNA, 20 bp, human
gaggagcaagtgaccatcag

SEQ ID NO: 188114 - DNA, 20 bp, human
ggctctacagcgctgatcac

SEQ ID NO: 188115 - DNA, 20 bp, human
ggaaactagaatgtgaaata

SEQ ID NO: 188116 - DNA, 20 bp, human
gcatgacccagagaaactgg

SEQ ID NO: 188117 - DNA, 20 bp, human
gtgagctgcggccccgccga

SEQ ID NO: 188118 - DNA, 20 bp, human
ggcagcaacggagagtggtc

SEQ ID NO: 188119 - DNA, 20 bp, human
ggaggcgcgatcccagccct

SEQ ID NO: 188120 - DNA, 20 bp, human
gccgggtgcccgggtagctg

SEQ ID NO: 188121 - DNA, 20 bp, human
ggcgcgatcccagccctcgg

SEQ ID NO: 188122 - DNA, 20 bp, human
gccacccggcgtgggcgctg

SEQ ID NO: 188123 - DNA, 20 bp, human
gtaacgcgcccctaaccacc

SEQ ID NO: 188124 - DNA, 20 bp, human
ggctgcggccgcagctaccc

SEQ ID NO: 188125 - DNA, 20 bp, human
gccaggcccggctgcagcaa

SEQ ID NO: 188126 - DNA, 20 bp, human
gaaggttgtccacgggatat

SEQ ID NO: 188127 - DNA, 20 bp, human
gggcctcggaaggttgtcca

SEQ ID NO: 188128 - DNA, 20 bp, human
gcggagcgcgggtcaatcgg

SEQ ID NO: 188129 - DNA, 20 bp, human
gcggcggcgggagcctcgtc

SEQ ID NO: 188130 - DNA, 20 bp, human
gcactcaccggcccgactac

SEQ ID NO: 188131 - DNA, 20 bp, human
ggtgatgctccagaaaggat

SEQ ID NO: 188132 - DNA, 20 bp, human
gggctggtgaatgagctgac

SEQ ID NO: 188133 - DNA, 20 bp, human
gtgggctcgcgggcactcac

SEQ ID NO: 188134 - DNA, 20 bp, human
gtcaccggcccgactacggg

SEQ ID NO: 188135 - DNA, 20 bp, human
gtccaggtgggggagatctt

SEQ ID NO: 188136 - DNA, 20 bp, human
gcccagctcagtaagctcag

SEQ ID NO: 188137 - DNA, 20 bp, human
gcacaaataccagtccagca

SEQ ID NO: 188138 - DNA, 20 bp, human
ggtgtctgaggctggcccta

SEQ ID NO: 188139 - DNA, 20 bp, human
gcacagaaacactcaccgta

SEQ ID NO: 188140 - DNA, 20 bp, human
gacagaagtccactcattct

SEQ ID NO: 188141 - DNA, 20 bp, human
gaatgagtggacttctgtga

SEQ ID NO: 188142 - DNA, 20 bp, human
gtacgttttgaataactata

SEQ ID NO: 188143 - DNA, 20 bp, human
gaagtccactcattcttggc

SEQ ID NO: 188144 - DNA, 20 bp, human
gggactggtatttgtgtctg

SEQ ID NO: 188145 - DNA, 20 bp, human
gcaaccagcttttattacta

SEQ ID NO: 188146 - DNA, 20 bp, human
ggccgtgcatgtgttcagaa

SEQ ID NO: 188147 - DNA, 20 bp, human
gtctttggcaacttacccag

SEQ ID NO: 188148 - DNA, 20 bp, human
gaaggctgctgatgacacct

SEQ ID NO: 188149 - DNA, 20 bp, human
gccagaggcaaatggctccc

SEQ ID NO: 188150 - DNA, 20 bp, human
gacatgcacggccacattga

SEQ ID NO: 188151 - DNA, 20 bp, human
ggcctttctgaacacatgca

SEQ ID NO: 188152 - DNA, 20 bp, human
gaagttctagatgctgtccg

SEQ ID NO: 188153 - DNA, 20 bp, human
gcaagtagattgaaaaacgt

SEQ ID NO: 188154 - DNA, 20 bp, human
gggtcaagtatgccctctga

SEQ ID NO: 188155 - DNA, 20 bp, human
ggtcacagaacactttatgt

SEQ ID NO: 188156 - DNA, 20 bp, human
ggcgccccgctcgactccgg

SEQ ID NO: 188157 - DNA, 20 bp, human
ggagcctccggagtcgagcg

SEQ ID NO: 188158 - DNA, 20 bp, human
ggcgtcccaggagaacctcc

SEQ ID NO: 188159 - DNA, 20 bp, human
gcccgcgccccgctcgactc

SEQ ID NO: 188160 - DNA, 20 bp, human
ggagctctctaaataaggga

SEQ ID NO: 188161 - DNA, 20 bp, human
gctgagggccggtagcccgg

SEQ ID NO: 188162 - DNA, 20 bp, human
gcacccctgagttcatggag

SEQ ID NO: 188163 - DNA, 20 bp, human
gaggcaggtatcagacaccc

SEQ ID NO: 188164 - DNA, 20 bp, human
gcggagctcctgggtcccga

SEQ ID NO: 188165 - DNA, 20 bp, human
gcctcccccgggggccatgg

SEQ ID NO: 188166 - DNA, 20 bp, human
ggcagccacacgacccacca

SEQ ID NO: 188167 - DNA, 20 bp, human
gcagcttgtgggtagcactc

SEQ ID NO: 188168 - DNA, 20 bp, human
ggaaagtgcaggctctcgag

SEQ ID NO: 188169 - DNA, 20 bp, human
gcgctccctggtgggtcgtg

SEQ ID NO: 188170 - DNA, 20 bp, human
gaggggtctgagaggcacgt

SEQ ID NO: 188171 - DNA, 20 bp, human
gcactcgggccgagccatgc

SEQ ID NO: 188172 - DNA, 20 bp, human
gggactacatcgctccctgg

SEQ ID NO: 188173 - DNA, 20 bp, human
gaggctctcgaggggagagg

SEQ ID NO: 188174 - DNA, 20 bp, human
gccaggttcccagacaggag

SEQ ID NO: 188175 - DNA, 20 bp, human
gggctgaaggtgctgttcac

SEQ ID NO: 188176 - DNA, 20 bp, human
gtgggccaggaccggaagtc

SEQ ID NO: 188177 - DNA, 20 bp, human
gagtaggagatgagcgtggt

SEQ ID NO: 188178 - DNA, 20 bp, human
gtactcagcgatctgagtgg

SEQ ID NO: 188179 - DNA, 20 bp, human
gggggtgaccgtggtaacca

SEQ ID NO: 188180 - DNA, 20 bp, human
gggaccggaagtctggctct

SEQ ID NO: 188181 - DNA, 20 bp, human
ggctgagtaggagatgagcg

SEQ ID NO: 188182 - DNA, 20 bp, human
gcaagtgctatgccaggcgt

SEQ ID NO: 188183 - DNA, 20 bp, human
gaggttaagacacctacccg

SEQ ID NO: 188184 - DNA, 20 bp, human
gtcctactcagcgatctgag

SEQ ID NO: 188185 - DNA, 20 bp, human
gaccacggtcaccccacgcc

SEQ ID NO: 188186 - DNA, 20 bp, human
gtcagaagggaccctcgaga

SEQ ID NO: 188187 - DNA, 20 bp, human
gtcacggcccccatccccga

SEQ ID NO: 188188 - DNA, 20 bp, human
ggaggtggccgtgaccctgg

SEQ ID NO: 188189 - DNA, 20 bp, human
gtggccgtgaccctggaggg

SEQ ID NO: 188190 - DNA, 20 bp, human
gagctacgcggcgccctggt

SEQ ID NO: 188191 - DNA, 20 bp, human
gccctggagggggggatgag

SEQ ID NO: 188192 - DNA, 20 bp, human
gggaccctcgagaaggaagg

SEQ ID NO: 188193 - DNA, 20 bp, human
ggtcatggcctcctcctcaa

SEQ ID NO: 188194 - DNA, 20 bp, human
gaagggaccctcgagaagga

SEQ ID NO: 188195 - DNA, 20 bp, human
gagggtcctaggactcagaa

SEQ ID NO: 188196 - DNA, 20 bp, human
gtccagacaggtgatcaggg

SEQ ID NO: 188197 - DNA, 20 bp, human
gcgtggccacaggatggagt

SEQ ID NO: 188198 - DNA, 20 bp, human
gcaggctgcatagtaagacc

SEQ ID NO: 188199 - DNA, 20 bp, human
gcagtactgaggcgaataca

SEQ ID NO: 188200 - DNA, 20 bp, human
gcagggaggtcccccaccat

SEQ ID NO: 188201 - DNA, 20 bp, human
gccccatcgtggccacagga

SEQ ID NO: 188202 - DNA, 20 bp, human
gtaagggatggtcccacttc

SEQ ID NO: 188203 - DNA, 20 bp, human
gtcccccaccatgggagtaa

SEQ ID NO: 188204 - DNA, 20 bp, human
gcacctgtctggagcaagag

SEQ ID NO: 188205 - DNA, 20 bp, human
gggtgtcctggcccccatcg

SEQ ID NO: 188206 - DNA, 20 bp, human
gtggcggagacgaagaggag

SEQ ID NO: 188207 - DNA, 20 bp, human
ggctgatggcggagacgaag

SEQ ID NO: 188208 - DNA, 20 bp, human
gttacagcgcgactcttagg

SEQ ID NO: 188209 - DNA, 20 bp, human
ggggcgctgactccacccaa

SEQ ID NO: 188210 - DNA, 20 bp, human
ggccccagacccctcggtcg

SEQ ID NO: 188211 - DNA, 20 bp, human
gcgaggggtctggggcgtcc

SEQ ID NO: 188212 - DNA, 20 bp, human
ggtcgatgtaagagaacctg

SEQ ID NO: 188213 - DNA, 20 bp, human
gtgggcgagctgggggacgt

SEQ ID NO: 188214 - DNA, 20 bp, human
gaacaacgcgagacagaaag

SEQ ID NO: 188215 - DNA, 20 bp, human
gaaaccgtgcgcacagacac

SEQ ID NO: 188216 - DNA, 20 bp, human
gccctgtatacagccgggaa

SEQ ID NO: 188217 - DNA, 20 bp, human
gggtaagtaacgcactaggg

SEQ ID NO: 188218 - DNA, 20 bp, human
gtccacccaaggcggagtaa

SEQ ID NO: 188219 - DNA, 20 bp, human
gcacggcttactcaccatag

SEQ ID NO: 188220 - DNA, 20 bp, human
gccgcgcgcgcgtccaccca

SEQ ID NO: 188221 - DNA, 20 bp, human
gcccgacaagctaagagtcg

SEQ ID NO: 188222 - DNA, 20 bp, human
gcgcgcgcgtccacccaagg

SEQ ID NO: 188223 - DNA, 20 bp, human
gggggcccggaaaggtcgag

SEQ ID NO: 188224 - DNA, 20 bp, human
ggactcgagggaccgcaccc

SEQ ID NO: 188225 - DNA, 20 bp, human
ggcccttactccgccttggg

SEQ ID NO: 188226 - DNA, 20 bp, human
gagactaccaaggagtccgg

SEQ ID NO: 188227 - DNA, 20 bp, human
gaggcgaagggacggcaaca

SEQ ID NO: 188228 - DNA, 20 bp, human
gaggtcgcttgagaaaacgt

SEQ ID NO: 188229 - DNA, 20 bp, human
gcggcggtgaaggaggcgaa

SEQ ID NO: 188230 - DNA, 20 bp, human
ggggtctgcggcggtgaagg

SEQ ID NO: 188231 - DNA, 20 bp, human
gctccggggcccagtttgta

SEQ ID NO: 188232 - DNA, 20 bp, human
gagggcccgctactgcccta

SEQ ID NO: 188233 - DNA, 20 bp, human
gacttctcccccggactcct

SEQ ID NO: 188234 - DNA, 20 bp, human
gtccctgaccttcctcccta

SEQ ID NO: 188235 - DNA, 20 bp, human
gaacagactaccaaggagtc

SEQ ID NO: 188236 - DNA, 20 bp, human
ggtccggacgtcctgggagg

SEQ ID NO: 188237 - DNA, 20 bp, human
gggaggagctcaacatggta

SEQ ID NO: 188238 - DNA, 20 bp, human
gtagcgttgggctgcggcag

SEQ ID NO: 188239 - DNA, 20 bp, human
gtgaggtcaagtagtagcgt

SEQ ID NO: 188240 - DNA, 20 bp, human
gaagtagtagcgttgggctg

SEQ ID NO: 188241 - DNA, 20 bp, human
gtccagcctgggcgtctgcg

SEQ ID NO: 188242 - DNA, 20 bp, human
gaggcaagggctgtggacat

SEQ ID NO: 188243 - DNA, 20 bp, human
ggggcccagggcgggacacg

SEQ ID NO: 188244 - DNA, 20 bp, human
ggcctgggcgtctgcggggt

SEQ ID NO: 188245 - DNA, 20 bp, human
gccaataggacagagacatt

SEQ ID NO: 188246 - DNA, 20 bp, human
gcccgtcaccgaaggctcct

SEQ ID NO: 188247 - DNA, 20 bp, human
ggtgctactcgaaacaactg

SEQ ID NO: 188248 - DNA, 20 bp, human
gagcggagttcgccatggta

SEQ ID NO: 188249 - DNA, 20 bp, human
gggtcccgttcactaaaggc

SEQ ID NO: 188250 - DNA, 20 bp, human
gcaatggtcccgttcactaa

SEQ ID NO: 188251 - DNA, 20 bp, human
gctgcctgtgcgcgccgcac

SEQ ID NO: 188252 - DNA, 20 bp, human
gccgcacgggattggcccgc

SEQ ID NO: 188253 - DNA, 20 bp, human
gtgtgcgcgccgcacgggat

SEQ ID NO: 188254 - DNA, 20 bp, human
gggatcgtttcctggatctt

SEQ ID NO: 188255 - DNA, 20 bp, human
gcctggatctttgggtccca

SEQ ID NO: 188256 - DNA, 20 bp, human
gtgggcaggtcattgcagtt

SEQ ID NO: 188257 - DNA, 20 bp, human
gaatcctgtgcggcgcgcgt

SEQ ID NO: 188258 - DNA, 20 bp, human
ggtccccgtccactaaaggc

SEQ ID NO: 188259 - DNA, 20 bp, human
gagtggacggggaccattga

SEQ ID NO: 188260 - DNA, 20 bp, human
gaatggtccccgtccactaa

SEQ ID NO: 188261 - DNA, 20 bp, human
gtgaagctgccggcctttag

SEQ ID NO: 188262 - DNA, 20 bp, human
gtgccggcctttagtggacg

SEQ ID NO: 188263 - DNA, 20 bp, human
ggatcgtttcctggatctgc

SEQ ID NO: 188264 - DNA, 20 bp, human
ggtgctactggaaacagctg

SEQ ID NO: 188265 - DNA, 20 bp, human
gccctgggacctgcagatcc

SEQ ID NO: 188266 - DNA, 20 bp, human
gtcaccatggtgagtccggg

SEQ ID NO: 188267 - DNA, 20 bp, human
gccaccgaaggtgaactata

SEQ ID NO: 188268 - DNA, 20 bp, human
ggcaccgcccggactcacca

SEQ ID NO: 188269 - DNA, 20 bp, human
gggccaaagtcaccaggagg

SEQ ID NO: 188270 - DNA, 20 bp, human
ggaagcccgggtgcgcggat

SEQ ID NO: 188271 - DNA, 20 bp, human
gtggcgctagaaggtggaag

SEQ ID NO: 188272 - DNA, 20 bp, human
gcgtgcttggcgctagaagg

SEQ ID NO: 188273 - DNA, 20 bp, human
gtgcgtctcacgttgagtcg

SEQ ID NO: 188274 - DNA, 20 bp, human
ggcactcaccatggtgagtc

SEQ ID NO: 188275 - DNA, 20 bp, human
ggaagtgtcccccaaaggag

SEQ ID NO: 188276 - DNA, 20 bp, human
ggcccagctgagaggtgcgc

SEQ ID NO: 188277 - DNA, 20 bp, human
gtgggggaaatagagaccag

SEQ ID NO: 188278 - DNA, 20 bp, human
ggctgtatctggagcagtcg

SEQ ID NO: 188279 - DNA, 20 bp, human
gtccacaggctgcccatctg

SEQ ID NO: 188280 - DNA, 20 bp, human
gggagagaagggcgagtccg

SEQ ID NO: 188281 - DNA, 20 bp, human
ggggagcccgacggagaagg

SEQ ID NO: 188282 - DNA, 20 bp, human
gtcgaggagtccgcaccctc

SEQ ID NO: 188283 - DNA, 20 bp, human
gctgggccggggcgactggg

SEQ ID NO: 188284 - DNA, 20 bp, human
ggtatctggagcagtcgggg

SEQ ID NO: 188285 - DNA, 20 bp, human
gcggcggaggcggctgtatc

SEQ ID NO: 188286 - DNA, 20 bp, human
gcattactacagggcaggaa

SEQ ID NO: 188287 - DNA, 20 bp, human
gcttcagacttaggtaaccg

SEQ ID NO: 188288 - DNA, 20 bp, human
ggttgggagcagatgtggac

SEQ ID NO: 188289 - DNA, 20 bp, human
gggctaacctcataaatgcc

SEQ ID NO: 188290 - DNA, 20 bp, human
gtgccctgtagtaatgactg

SEQ ID NO: 188291 - DNA, 20 bp, human
gaccctgccaggcatttatg

SEQ ID NO: 188292 - DNA, 20 bp, human
gctcctcagtcattactaca

SEQ ID NO: 188293 - DNA, 20 bp, human
gaggctgttaagagtttctg

SEQ ID NO: 188294 - DNA, 20 bp, human
gcactctgggcctaaaacaa

SEQ ID NO: 188295 - DNA, 20 bp, human
gcacgcctatgcattgttgt

SEQ ID NO: 188296 - DNA, 20 bp, human
gtgcaaacgcgacggcagga

SEQ ID NO: 188297 - DNA, 20 bp, human
gtttgtctccctaccgcgcg

SEQ ID NO: 188298 - DNA, 20 bp, human
gcagcgaggtgcaaacgcga

SEQ ID NO: 188299 - DNA, 20 bp, human
gaggttggaatgcgccccag

SEQ ID NO: 188300 - DNA, 20 bp, human
gcggcaggaaggttctgaga

SEQ ID NO: 188301 - DNA, 20 bp, human
ggaggtgcaaacgcgacggc

SEQ ID NO: 188302 - DNA, 20 bp, human
gttctaacggtccgagaacc

SEQ ID NO: 188303 - DNA, 20 bp, human
gtttgggggcgggaagaccg

SEQ ID NO: 188304 - DNA, 20 bp, human
gaagggctcttcgggtttgg

SEQ ID NO: 188305 - DNA, 20 bp, human
gtttggagaaactagtaaaa

SEQ ID NO: 188306 - DNA, 20 bp, human
gccaccgcgcggcgcacaaa

SEQ ID NO: 188307 - DNA, 20 bp, human
gtgggcaccgccccaccgcg

SEQ ID NO: 188308 - DNA, 20 bp, human
gcgctcaggccgttgttcta

SEQ ID NO: 188309 - DNA, 20 bp, human
gcgcggcgcacaaaaggctg

SEQ ID NO: 188310 - DNA, 20 bp, human
gagcggcgcttatcgaagtg

SEQ ID NO: 188311 - DNA, 20 bp, human
gcgggtcccaagtgctcggt

SEQ ID NO: 188312 - DNA, 20 bp, human
gatgccatgccctagaacaa

SEQ ID NO: 188313 - DNA, 20 bp, human
gctagggcatggcatcccgt

SEQ ID NO: 188314 - DNA, 20 bp, human
gctcgaacccctgacctgga

SEQ ID NO: 188315 - DNA, 20 bp, human
ggtcccaagtgctcggtggg

SEQ ID NO: 188316 - DNA, 20 bp, human
gtgtgagcccaacacaactg

SEQ ID NO: 188317 - DNA, 20 bp, human
gctgtggtcactgcagtggt

SEQ ID NO: 188318 - DNA, 20 bp, human
gtattatgtaatataatggt

SEQ ID NO: 188319 - DNA, 20 bp, human
gctctcagaatccagagctt

SEQ ID NO: 188320 - DNA, 20 bp, human
gatccagagcttcggttcac

SEQ ID NO: 188321 - DNA, 20 bp, human
gcaccagtgaaccgaagctc

SEQ ID NO: 188322 - DNA, 20 bp, human
ggctttaccacagtccatag

SEQ ID NO: 188323 - DNA, 20 bp, human
gtattgtacatatgtatcta

SEQ ID NO: 188324 - DNA, 20 bp, human
gtgtcttccctgctaactta

SEQ ID NO: 188325 - DNA, 20 bp, human
gattgtgagggtagcttggt

SEQ ID NO: 188326 - DNA, 20 bp, human
gcatggtgccggctgcggag

SEQ ID NO: 188327 - DNA, 20 bp, human
ggtgccggctgcggagcggg

SEQ ID NO: 188328 - DNA, 20 bp, human
gacgccgcgcaccgctccga

SEQ ID NO: 188329 - DNA, 20 bp, human
ggtgcgcggcgtggaccggc

SEQ ID NO: 188330 - DNA, 20 bp, human
gagcgggtggcgctggccct

SEQ ID NO: 188331 - DNA, 20 bp, human
gtataaaagaccgagctggg

SEQ ID NO: 188332 - DNA, 20 bp, human
gggccgggtggcacattccg

SEQ ID NO: 188333 - DNA, 20 bp, human
gtggccctcggagcggtgcg

SEQ ID NO: 188334 - DNA, 20 bp, human
gtctcagaaacttgggtcgg

SEQ ID NO: 188335 - DNA, 20 bp, human
gtgggctcaccgccacggag

SEQ ID NO: 188336 - DNA, 20 bp, human
gcactgcggggtcaccggga

SEQ ID NO: 188337 - DNA, 20 bp, human
gtagcccaggccacactcgg

SEQ ID NO: 188338 - DNA, 20 bp, human
gccccgcagtgggtgtgtga

SEQ ID NO: 188339 - DNA, 20 bp, human
gcagcgtcctcctggtccgg

SEQ ID NO: 188340 - DNA, 20 bp, human
ggccggcgctctcagcccgt

SEQ ID NO: 188341 - DNA, 20 bp, human
gcgtcagcgtcctcctggtc

SEQ ID NO: 188342 - DNA, 20 bp, human
gtcctggtccggcggcgtct

SEQ ID NO: 188343 - DNA, 20 bp, human
gcgcgtgcctggagaagacg

SEQ ID NO: 188344 - DNA, 20 bp, human
gtgccaagcagccagcgcgg

SEQ ID NO: 188345 - DNA, 20 bp, human
gtcccctcacacacccactg

SEQ ID NO: 188346 - DNA, 20 bp, human
gcacagtggaggaagctccc

SEQ ID NO: 188347 - DNA, 20 bp, human
gggcggagggagtagcatcc

SEQ ID NO: 188348 - DNA, 20 bp, human
gggcaatggaatagaaactg

SEQ ID NO: 188349 - DNA, 20 bp, human
ggctgagaaggcgcagatct

SEQ ID NO: 188350 - DNA, 20 bp, human
gcgcagggaccagccaagca

SEQ ID NO: 188351 - DNA, 20 bp, human
ggggagcgacaaagctgaga

SEQ ID NO: 188352 - DNA, 20 bp, human
gagcaggcaaagctctctcg

SEQ ID NO: 188353 - DNA, 20 bp, human
gccacggctgcggaaggaca

SEQ ID NO: 188354 - DNA, 20 bp, human
ggagaaggcgcagatcttgg

SEQ ID NO: 188355 - DNA, 20 bp, human
gggccttactgaggaacaaa

SEQ ID NO: 188356 - DNA, 20 bp, human
gagagggccacgcccagaca

SEQ ID NO: 188357 - DNA, 20 bp, human
gactgggcgcgtctggcggg

SEQ ID NO: 188358 - DNA, 20 bp, human
gggtgcaggcgagagtccca

SEQ ID NO: 188359 - DNA, 20 bp, human
gcgacagcccgaggtcacct

SEQ ID NO: 188360 - DNA, 20 bp, human
gtcatactgggcgcgtctgg

SEQ ID NO: 188361 - DNA, 20 bp, human
ggccttgagtgagacgggtg

SEQ ID NO: 188362 - DNA, 20 bp, human
gctcactcaaggctatgccg

SEQ ID NO: 188363 - DNA, 20 bp, human
gtgcacctgcggaggcccgg

SEQ ID NO: 188364 - DNA, 20 bp, human
gctttgttgcaggttcgcag

SEQ ID NO: 188365 - DNA, 20 bp, human
gaccccacccgtctcactca

SEQ ID NO: 188366 - DNA, 20 bp, human
gtgcctccctgtctccacga

SEQ ID NO: 188367 - DNA, 20 bp, human
gggcccttgttctaaggtgg

SEQ ID NO: 188368 - DNA, 20 bp, human
ggccacacgagcacactgtg

SEQ ID NO: 188369 - DNA, 20 bp, human
gacggcactgacctcctcct

SEQ ID NO: 188370 - DNA, 20 bp, human
gagtccggggtgagtgtctg

SEQ ID NO: 188371 - DNA, 20 bp, human
gcctctgctgggagaccgga

SEQ ID NO: 188372 - DNA, 20 bp, human
gtgccaccaccttagaacaa

SEQ ID NO: 188373 - DNA, 20 bp, human
gggtgagtcagccttaagcc

SEQ ID NO: 188374 - DNA, 20 bp, human
gccctgttcaagggagtccg

SEQ ID NO: 188375 - DNA, 20 bp, human
ggaaggcccttgttctaagg

SEQ ID NO: 188376 - DNA, 20 bp, human
ggcgctgagggtggacgcgg

SEQ ID NO: 188377 - DNA, 20 bp, human
ggcgagggtggaagatgcgg

SEQ ID NO: 188378 - DNA, 20 bp, human
gcagccgagtcagcacccag

SEQ ID NO: 188379 - DNA, 20 bp, human
gcacccaggctgcagcccgg

SEQ ID NO: 188380 - DNA, 20 bp, human
gctcatatagcggctcccgg

SEQ ID NO: 188381 - DNA, 20 bp, human
ggtggaagatgcggcggaga

SEQ ID NO: 188382 - DNA, 20 bp, human
ggccccgcccgctcatatag

SEQ ID NO: 188383 - DNA, 20 bp, human
gcctcacgcacaaagagccc

SEQ ID NO: 188384 - DNA, 20 bp, human
ggggacagtggcccagctgt

SEQ ID NO: 188385 - DNA, 20 bp, human
gcaaagaggctgcggagagt

SEQ ID NO: 188386 - DNA, 20 bp, human
gaggcagccccgccccggac

SEQ ID NO: 188387 - DNA, 20 bp, human
ggccgccgccgccatcatga

SEQ ID NO: 188388 - DNA, 20 bp, human
gtcacctcccaaaactacaa

SEQ ID NO: 188389 - DNA, 20 bp, human
gcccggcggccgcaatgcgg

SEQ ID NO: 188390 - DNA, 20 bp, human
gcggctcggccaattccccg

SEQ ID NO: 188391 - DNA, 20 bp, human
gctggccgccgggttcctgg

SEQ ID NO: 188392 - DNA, 20 bp, human
gacttgcaggccgggcagtg

SEQ ID NO: 188393 - DNA, 20 bp, human
gaaactacaagggacgcggg

SEQ ID NO: 188394 - DNA, 20 bp, human
ggagcacggcatcgacccca

SEQ ID NO: 188395 - DNA, 20 bp, human
gcccaaaactacaagggacg

SEQ ID NO: 188396 - DNA, 20 bp, human
gctgtgacatcccacctcgg

SEQ ID NO: 188397 - DNA, 20 bp, human
gcggttgccgccgtgttcag

SEQ ID NO: 188398 - DNA, 20 bp, human
gtgtctgtgacatcccacct

SEQ ID NO: 188399 - DNA, 20 bp, human
gacatttttagcccccgagg

SEQ ID NO: 188400 - DNA, 20 bp, human
gcgtcaggtagcggccatgg

SEQ ID NO: 188401 - DNA, 20 bp, human
gatccccaacaatgtgaaaa

SEQ ID NO: 188402 - DNA, 20 bp, human
ggcttcgttatcaatgcagt

SEQ ID NO: 188403 - DNA, 20 bp, human
gcagcagctattttgttgag

SEQ ID NO: 188404 - DNA, 20 bp, human
ggggcatgaagaagtgcagc

SEQ ID NO: 188405 - DNA, 20 bp, human
ggtctgtgttttctacgagc

SEQ ID NO: 188406 - DNA, 20 bp, human
gctggctctgcggacgacag

SEQ ID NO: 188407 - DNA, 20 bp, human
ggcggctctgcgctaggaac

SEQ ID NO: 188408 - DNA, 20 bp, human
gacccggccggaggctacgt

SEQ ID NO: 188409 - DNA, 20 bp, human
gtgatcacttcccaaaactt

SEQ ID NO: 188410 - DNA, 20 bp, human
gagagccgcgcccgccatga

SEQ ID NO: 188411 - DNA, 20 bp, human
gggaggctacgtgggagact

SEQ ID NO: 188412 - DNA, 20 bp, human
ggatgagcacggcatcgacc

SEQ ID NO: 188413 - DNA, 20 bp, human
ggcgctaggaactggctctg

SEQ ID NO: 188414 - DNA, 20 bp, human
gcgctcagaacccagagccc

SEQ ID NO: 188415 - DNA, 20 bp, human
gaccgggctccgaggaccca

SEQ ID NO: 188416 - DNA, 20 bp, human
ggatcgtgctcacgcagatc

SEQ ID NO: 188417 - DNA, 20 bp, human
gggccaaggcgggattagga

SEQ ID NO: 188418 - DNA, 20 bp, human
gggcagtgcgggaatcagat

SEQ ID NO: 188419 - DNA, 20 bp, human
gcccaggggccgcaatgcat

SEQ ID NO: 188420 - DNA, 20 bp, human
gggaggagacagacaggccg

SEQ ID NO: 188421 - DNA, 20 bp, human
gcctgccgggtggccgggga

SEQ ID NO: 188422 - DNA, 20 bp, human
gccactgccaacaccttccc

SEQ ID NO: 188423 - DNA, 20 bp, human
gaaggcgggattaggacggc

SEQ ID NO: 188424 - DNA, 20 bp, human
ggggctctgagggcctagcc

SEQ ID NO: 188425 - DNA, 20 bp, human
ggaaggtgttggcagtggcg

SEQ ID NO: 188426 - DNA, 20 bp, human
gtacgtgtggagaactcctg

SEQ ID NO: 188427 - DNA, 20 bp, human
ggttggtccgaagtttgaac

SEQ ID NO: 188428 - DNA, 20 bp, human
gagcgctggtcggcgtctgg

SEQ ID NO: 188429 - DNA, 20 bp, human
gagcactggaaatgagccgt

SEQ ID NO: 188430 - DNA, 20 bp, human
ggagtctgtctcacaaccca

SEQ ID NO: 188431 - DNA, 20 bp, human
gcggcgtctggcggtgagtc

SEQ ID NO: 188432 - DNA, 20 bp, human
gaccggacagaagcgctggt

SEQ ID NO: 188433 - DNA, 20 bp, human
ggccgaccagcgcttctgtc

SEQ ID NO: 188434 - DNA, 20 bp, human
gtgtcagctggagcgttcgg

SEQ ID NO: 188435 - DNA, 20 bp, human
gcggtgagtcgggttacgtg

SEQ ID NO: 188436 - DNA, 20 bp, human
gaccaccgactgggtcatgg

SEQ ID NO: 188437 - DNA, 20 bp, human
gacccagtcggtggtcgtac

SEQ ID NO: 188438 - DNA, 20 bp, human
gccgggagcttgctagcccg

SEQ ID NO: 188439 - DNA, 20 bp, human
gagcagagcgccgttgctgg

SEQ ID NO: 188440 - DNA, 20 bp, human
ggcggcagtagcgtgactta

SEQ ID NO: 188441 - DNA, 20 bp, human
gttctgcattcccccagcaa

SEQ ID NO: 188442 - DNA, 20 bp, human
gccgactgcgaccggaggag

SEQ ID NO: 188443 - DNA, 20 bp, human
gaccaccatgacccagtcgg

SEQ ID NO: 188444 - DNA, 20 bp, human
gtggtcgccgcggaatccag

SEQ ID NO: 188445 - DNA, 20 bp, human
gacgaccaccgactgggtca

SEQ ID NO: 188446 - DNA, 20 bp, human
gccgcactggcccaactgta

SEQ ID NO: 188447 - DNA, 20 bp, human
ggcctgaggagcgatgccga

SEQ ID NO: 188448 - DNA, 20 bp, human
ggaactcgaacccaactggg

SEQ ID NO: 188449 - DNA, 20 bp, human
gtccctcggcatcgctcctc

SEQ ID NO: 188450 - DNA, 20 bp, human
gcaagcaggcgcccacccag

SEQ ID NO: 188451 - DNA, 20 bp, human
gcagccgctcccgcccgcaa

SEQ ID NO: 188452 - DNA, 20 bp, human
gacgcaggcgcccagtcccc

SEQ ID NO: 188453 - DNA, 20 bp, human
ggctgcaacgccggtgcctg

SEQ ID NO: 188454 - DNA, 20 bp, human
gccgccccttccccccagtt

SEQ ID NO: 188455 - DNA, 20 bp, human
gcggctccgcgcctcagtga

SEQ ID NO: 188456 - DNA, 20 bp, human
ggggccggggagcccaacct

SEQ ID NO: 188457 - DNA, 20 bp, human
gcagaggctgacacgatcag

SEQ ID NO: 188458 - DNA, 20 bp, human
ggcagggtgatgatctcccg

SEQ ID NO: 188459 - DNA, 20 bp, human
gggctgacacgatcagaggg

SEQ ID NO: 188460 - DNA, 20 bp, human
gggcatcgctcttcagacgt

SEQ ID NO: 188461 - DNA, 20 bp, human
gtgggttatccagagcagca

SEQ ID NO: 188462 - DNA, 20 bp, human
gacttgggtgggacccgaag

SEQ ID NO: 188463 - DNA, 20 bp, human
ggccaggagcgcaggacgtg

SEQ ID NO: 188464 - DNA, 20 bp, human
ggaggcgcagctctcggtct

SEQ ID NO: 188465 - DNA, 20 bp, human
ggggtggacccaagatgcct

SEQ ID NO: 188466 - DNA, 20 bp, human
gctcgcggacggtggccgac

SEQ ID NO: 188467 - DNA, 20 bp, human
ggactgcagcgggagacgac

SEQ ID NO: 188468 - DNA, 20 bp, human
gttagagggaacaagatcca

SEQ ID NO: 188469 - DNA, 20 bp, human
ggtaacgggaagtcacccaa

SEQ ID NO: 188470 - DNA, 20 bp, human
gccgggactgcggtgagtcc

SEQ ID NO: 188471 - DNA, 20 bp, human
gcagcggtccccgaactctg

SEQ ID NO: 188472 - DNA, 20 bp, human
gtcacttccgccgccgtcgg

SEQ ID NO: 188473 - DNA, 20 bp, human
ggatccagtggggcctacgg

SEQ ID NO: 188474 - DNA, 20 bp, human
gcagcgggagacgacaggcg

SEQ ID NO: 188475 - DNA, 20 bp, human
gtcgccgccgtaggccccac

SEQ ID NO: 188476 - DNA, 20 bp, human
gcaggagcagggagcttgcg

SEQ ID NO: 188477 - DNA, 20 bp, human
ggcccgcgccttagcctgtc

SEQ ID NO: 188478 - DNA, 20 bp, human
ggcccggacgagggagcgga

SEQ ID NO: 188479 - DNA, 20 bp, human
gccctgctcctgacaggcta

SEQ ID NO: 188480 - DNA, 20 bp, human
gacctgtgctgcaggatcct

SEQ ID NO: 188481 - DNA, 20 bp, human
gagccggggaggacagcgga

SEQ ID NO: 188482 - DNA, 20 bp, human
gttcgagggtcagggagccg

SEQ ID NO: 188483 - DNA, 20 bp, human
gtcctgacaggctaaggcgc

SEQ ID NO: 188484 - DNA, 20 bp, human
gcaccagggcgccattttaa

SEQ ID NO: 188485 - DNA, 20 bp, human
gagccctccgctgtcctccc

SEQ ID NO: 188486 - DNA, 20 bp, human
gcacaaaccgcccgacccag

SEQ ID NO: 188487 - DNA, 20 bp, human
ggaagttcggcagctcaacg

SEQ ID NO: 188488 - DNA, 20 bp, human
ggcgcagagcgcgggaacca

SEQ ID NO: 188489 - DNA, 20 bp, human
gggagggggtgacataacca

SEQ ID NO: 188490 - DNA, 20 bp, human
gctctgcggagactgagtcg

SEQ ID NO: 188491 - DNA, 20 bp, human
gcccgggcgggagtagctgg

SEQ ID NO: 188492 - DNA, 20 bp, human
ggcctaggctagaaaacgga

SEQ ID NO: 188493 - DNA, 20 bp, human
ggagcccgggcgggagtagc

SEQ ID NO: 188494 - DNA, 20 bp, human
gctagcgagcggggcttcca

SEQ ID NO: 188495 - DNA, 20 bp, human
gacctccaggcgaccacgag

SEQ ID NO: 188496 - DNA, 20 bp, human
gtgcctgtcgcgcgagagct

SEQ ID NO: 188497 - DNA, 20 bp, human
gggtcggcttggaagtcgcc

SEQ ID NO: 188498 - DNA, 20 bp, human
ggcggaacatggcgcggcac

SEQ ID NO: 188499 - DNA, 20 bp, human
ggcgcgtccaaccgactcca

SEQ ID NO: 188500 - DNA, 20 bp, human
gcgtccaaccgactccacgg

SEQ ID NO: 188501 - DNA, 20 bp, human
ggggccaccgtggagtcggt

SEQ ID NO: 188502 - DNA, 20 bp, human
ggctgcaggagcgcggaaca

SEQ ID NO: 188503 - DNA, 20 bp, human
gggcgcggcacgggccaccg

SEQ ID NO: 188504 - DNA, 20 bp, human
ggcacgggccaccgtggagt

SEQ ID NO: 188505 - DNA, 20 bp, human
gggacgcgtcctgatcgtca

SEQ ID NO: 188506 - DNA, 20 bp, human
gagtgagagagggtccgaag

SEQ ID NO: 188507 - DNA, 20 bp, human
gagccgtgggcactttccac

SEQ ID NO: 188508 - DNA, 20 bp, human
gcggcgagagcggcagccgt

SEQ ID NO: 188509 - DNA, 20 bp, human
ggttctccaggcctcacccg

SEQ ID NO: 188510 - DNA, 20 bp, human
gtgggcagcggagagtctgg

SEQ ID NO: 188511 - DNA, 20 bp, human
ggaagaggctgaatgacagg

SEQ ID NO: 188512 - DNA, 20 bp, human
gggacgtgcaggccagaacc

SEQ ID NO: 188513 - DNA, 20 bp, human
gctgcccacgaccctcggag

SEQ ID NO: 188514 - DNA, 20 bp, human
ggtgccactccgagggtcgt

SEQ ID NO: 188515 - DNA, 20 bp, human
gtccgaagaggctgaatgac

SEQ ID NO: 188516 - DNA, 20 bp, human
ggcgctcgggctcctggtcc

SEQ ID NO: 188517 - DNA, 20 bp, human
gccgagcgcacagaagaaga

SEQ ID NO: 188518 - DNA, 20 bp, human
gactcgcgccccggtaaccg

SEQ ID NO: 188519 - DNA, 20 bp, human
ggccatcacgaagagtgagt

SEQ ID NO: 188520 - DNA, 20 bp, human
gcccggctccccggttaccg

SEQ ID NO: 188521 - DNA, 20 bp, human
gcatcggccatgtggaccac

SEQ ID NO: 188522 - DNA, 20 bp, human
gcaggtcccatcagtagata

SEQ ID NO: 188523 - DNA, 20 bp, human
gtgcggctggaaggcacttc

SEQ ID NO: 188524 - DNA, 20 bp, human
gaagggcgcctgcggctgga

SEQ ID NO: 188525 - DNA, 20 bp, human
ggtcgcgcgcagcagggtgg

SEQ ID NO: 188526 - DNA, 20 bp, human
gcccagttggagccagacag

SEQ ID NO: 188527 - DNA, 20 bp, human
ggtgtgtgctgcgaccccga

SEQ ID NO: 188528 - DNA, 20 bp, human
gaccccgagggaagatgaac

SEQ ID NO: 188529 - DNA, 20 bp, human
gagacccgcggcccaagcac

SEQ ID NO: 188530 - DNA, 20 bp, human
ggtcccgttcatcttccctc

SEQ ID NO: 188531 - DNA, 20 bp, human
gtctgggtgcacgtccacca

SEQ ID NO: 188532 - DNA, 20 bp, human
gcacggcgcggggcacggaa

SEQ ID NO: 188533 - DNA, 20 bp, human
gcacccagaggaccaggcgg

SEQ ID NO: 188534 - DNA, 20 bp, human
gggcaggacacaacgtccaa

SEQ ID NO: 188535 - DNA, 20 bp, human
ggccgcagtgtcctaccaaa

SEQ ID NO: 188536 - DNA, 20 bp, human
gcgggatgaaaccctccgag

SEQ ID NO: 188537 - DNA, 20 bp, human
gggccttccagacctgtcag

SEQ ID NO: 188538 - DNA, 20 bp, human
gggagggtttcatcccgcag

SEQ ID NO: 188539 - DNA, 20 bp, human
ggaggcccacacctctcgga

SEQ ID NO: 188540 - DNA, 20 bp, human
ggagcccgggtggaccccca

SEQ ID NO: 188541 - DNA, 20 bp, human
gagaggtgtgggcctctgac

SEQ ID NO: 188542 - DNA, 20 bp, human
gaaaggggtgcgataggcaa

SEQ ID NO: 188543 - DNA, 20 bp, human
ggcgacccgccccggcacag

SEQ ID NO: 188544 - DNA, 20 bp, human
gcagggtgtgggctgcggaa

SEQ ID NO: 188545 - DNA, 20 bp, human
gccggggcttggatcccgtg

SEQ ID NO: 188546 - DNA, 20 bp, human
gagacggctcagagggaggg

SEQ ID NO: 188547 - DNA, 20 bp, human
gactagatcccgacaggagt

SEQ ID NO: 188548 - DNA, 20 bp, human
ggaagggagtggaccagttc

SEQ ID NO: 188549 - DNA, 20 bp, human
gagggagggaggattccctc

SEQ ID NO: 188550 - DNA, 20 bp, human
gagaagaaagacggctcaga

SEQ ID NO: 188551 - DNA, 20 bp, human
gggatatctgcgaaataggg

SEQ ID NO: 188552 - DNA, 20 bp, human
ggaccagttcaggtcccaga

SEQ ID NO: 188553 - DNA, 20 bp, human
gtcgggatatctgcgaaata

SEQ ID NO: 188554 - DNA, 20 bp, human
gggtccggaagcaaatttaa

SEQ ID NO: 188555 - DNA, 20 bp, human
gccagagaggcaaggtaccg

SEQ ID NO: 188556 - DNA, 20 bp, human
gcgtccggcccgggctggta

SEQ ID NO: 188557 - DNA, 20 bp, human
gcaggagctgcggccccgtc

SEQ ID NO: 188558 - DNA, 20 bp, human
gcaggtttcgcgctgaggta

SEQ ID NO: 188559 - DNA, 20 bp, human
ggaaggcttggcttcgggag

SEQ ID NO: 188560 - DNA, 20 bp, human
ggataatacgcagccctcaa

SEQ ID NO: 188561 - DNA, 20 bp, human
gaccgcaggccggcttgtgg

SEQ ID NO: 188562 - DNA, 20 bp, human
gtcccccacaagccggcctg

SEQ ID NO: 188563 - DNA, 20 bp, human
gtcgcctggcgtgaccagcg

SEQ ID NO: 188564 - DNA, 20 bp, human
gagcccggaatgccgagaca

SEQ ID NO: 188565 - DNA, 20 bp, human
gttcgggaggggcaaaagac

SEQ ID NO: 188566 - DNA, 20 bp, human
ggggaagagtgtgtacgtgg

SEQ ID NO: 188567 - DNA, 20 bp, human
gagcctagccactctagcga

SEQ ID NO: 188568 - DNA, 20 bp, human
ggcggggaagagtgtgtacg

SEQ ID NO: 188569 - DNA, 20 bp, human
ggcctccatgcccgccaccg

SEQ ID NO: 188570 - DNA, 20 bp, human
ggccagcgcctctcccccga

SEQ ID NO: 188571 - DNA, 20 bp, human
gctcccccgagggaaacccg

SEQ ID NO: 188572 - DNA, 20 bp, human
gctagccactctagcgacgg

SEQ ID NO: 188573 - DNA, 20 bp, human
gggacttggcgactcaggga

SEQ ID NO: 188574 - DNA, 20 bp, human
gggcctcgggtttccctcgg

SEQ ID NO: 188575 - DNA, 20 bp, human
ggcggtgtcacagccgagag

SEQ ID NO: 188576 - DNA, 20 bp, human
gtatagatgcaggaaaaaag

SEQ ID NO: 188577 - DNA, 20 bp, human
gcagtgggctcaggagcccg

SEQ ID NO: 188578 - DNA, 20 bp, human
gctctagccataaccacagt

SEQ ID NO: 188579 - DNA, 20 bp, human
gagttaattaagataggcaa

SEQ ID NO: 188580 - DNA, 20 bp, human
ggttttccatatggtctgca

SEQ ID NO: 188581 - DNA, 20 bp, human
gtttacccgtgcagaccata

SEQ ID NO: 188582 - DNA, 20 bp, human
gggactagtggtgtggtgtt

SEQ ID NO: 188583 - DNA, 20 bp, human
gaagaaggaactaagtgaga

SEQ ID NO: 188584 - DNA, 20 bp, human
gaagcaagttcaagtatgat

SEQ ID NO: 188585 - DNA, 20 bp, human
gacagtctctgaatgtgaac

SEQ ID NO: 188586 - DNA, 20 bp, human
gaccggagggctagagacag

SEQ ID NO: 188587 - DNA, 20 bp, human
ggaggccagcacgaaccgga

SEQ ID NO: 188588 - DNA, 20 bp, human
gctaggcgcgggagttgctg

SEQ ID NO: 188589 - DNA, 20 bp, human
gccggccgggctcgtggtgg

SEQ ID NO: 188590 - DNA, 20 bp, human
ggcacgccgggtccctgaag

SEQ ID NO: 188591 - DNA, 20 bp, human
ggctgcggctcgagaaccgg

SEQ ID NO: 188592 - DNA, 20 bp, human
gtgaagaggccagcacgaac

SEQ ID NO: 188593 - DNA, 20 bp, human
ggctagagacagcggccgag

SEQ ID NO: 188594 - DNA, 20 bp, human
gtgcgcgggacgagtgggac

SEQ ID NO: 188595 - DNA, 20 bp, human
gagcagggcccggcggtaca

SEQ ID NO: 188596 - DNA, 20 bp, human
gcggcggcacctgcgatcag

SEQ ID NO: 188597 - DNA, 20 bp, human
gcacctgcgatcagcggctg

SEQ ID NO: 188598 - DNA, 20 bp, human
gcagcggctggggcaggtta

SEQ ID NO: 188599 - DNA, 20 bp, human
gtggctgtagtggggtacag

SEQ ID NO: 188600 - DNA, 20 bp, human
gagacagccgagcctgcgga

SEQ ID NO: 188601 - DNA, 20 bp, human
gcagccgagcctgcggaagg

SEQ ID NO: 188602 - DNA, 20 bp, human
gggcgcgtgaatacgaaggg

SEQ ID NO: 188603 - DNA, 20 bp, human
gtgagcctcattggagctgg

SEQ ID NO: 188604 - DNA, 20 bp, human
gcccgctggcgcccatgtca

SEQ ID NO: 188605 - DNA, 20 bp, human
gagtctccctagggaagagt

SEQ ID NO: 188606 - DNA, 20 bp, human
gggaagggaaagctcccggt

SEQ ID NO: 188607 - DNA, 20 bp, human
gaagccgctgccatcccgga

SEQ ID NO: 188608 - DNA, 20 bp, human
ggcgccccgggcccccatcg

SEQ ID NO: 188609 - DNA, 20 bp, human
gtcctctgcgtcctcggccg

SEQ ID NO: 188610 - DNA, 20 bp, human
ggatggcagcggctttgcga

SEQ ID NO: 188611 - DNA, 20 bp, human
gacgtcccggaaacgcccca

SEQ ID NO: 188612 - DNA, 20 bp, human
ggggcgggagccgcgagggt

SEQ ID NO: 188613 - DNA, 20 bp, human
ggctgcctagcaacacggca

SEQ ID NO: 188614 - DNA, 20 bp, human
gacgccgtaggcaagcgggg

SEQ ID NO: 188615 - DNA, 20 bp, human
gtgctctgcatccagctcgg

SEQ ID NO: 188616 - DNA, 20 bp, human
gatggagatactcctcacca

SEQ ID NO: 188617 - DNA, 20 bp, human
gctgagggcctccaggtcgg

SEQ ID NO: 188618 - DNA, 20 bp, human
gtgaggagtatctccatctc

SEQ ID NO: 188619 - DNA, 20 bp, human
gagatccagaggccccgaga

SEQ ID NO: 188620 - DNA, 20 bp, human
gggcaggtccaggaatgcgg

SEQ ID NO: 188621 - DNA, 20 bp, human
gagggtcttggacagattca

SEQ ID NO: 188622 - DNA, 20 bp, human
gggctcaggctcagtcaggg

SEQ ID NO: 188623 - DNA, 20 bp, human
gagactgagggcctccaggt

SEQ ID NO: 188624 - DNA, 20 bp, human
gtccggcaggtccaggaatg

SEQ ID NO: 188625 - DNA, 20 bp, human
ggcgtccctcaggagacgga

SEQ ID NO: 188626 - DNA, 20 bp, human
gcggtacaggagagtcgcta

SEQ ID NO: 188627 - DNA, 20 bp, human
gagcagcggaaccccccacg

SEQ ID NO: 188628 - DNA, 20 bp, human
ggcgaagtgggttccggtgg

SEQ ID NO: 188629 - DNA, 20 bp, human
gttggcgaagtgggttccgg

SEQ ID NO: 188630 - DNA, 20 bp, human
ggacttgcagagaaaaacgg

SEQ ID NO: 188631 - DNA, 20 bp, human
gaggagagtcgctatggcgg

SEQ ID NO: 188632 - DNA, 20 bp, human
gcaagcacctctgccaccac

SEQ ID NO: 188633 - DNA, 20 bp, human
ggctatggcggcggtggatt

SEQ ID NO: 188634 - DNA, 20 bp, human
gggctgtagtaacgtggcag

SEQ ID NO: 188635 - DNA, 20 bp, human
gcgaatcgctgccgcgtggg

SEQ ID NO: 188636 - DNA, 20 bp, human
gcagcggagggtgtacacga

SEQ ID NO: 188637 - DNA, 20 bp, human
gccctgagcccagcagcgga

SEQ ID NO: 188638 - DNA, 20 bp, human
gtgagctggatggtcgagtc

SEQ ID NO: 188639 - DNA, 20 bp, human
gctggaagcaaggagattga

SEQ ID NO: 188640 - DNA, 20 bp, human
gataattccggttagatcag

SEQ ID NO: 188641 - DNA, 20 bp, human
gctgctgggctcagggtcgg

SEQ ID NO: 188642 - DNA, 20 bp, human
ggtgcttctaatcccctcac

SEQ ID NO: 188643 - DNA, 20 bp, human
ggagcagagactcaggaaac

SEQ ID NO: 188644 - DNA, 20 bp, human
ggggtgagctgggacacagt

SEQ ID NO: 188645 - DNA, 20 bp, human
ggagggtgtacacgaggggc

SEQ ID NO: 188646 - DNA, 20 bp, human
gggatgtaggcagcagacgg

SEQ ID NO: 188647 - DNA, 20 bp, human
gcagcagacggtggacgctg

SEQ ID NO: 188648 - DNA, 20 bp, human
gcggcgtccgaccccttcag

SEQ ID NO: 188649 - DNA, 20 bp, human
gcagctcggagggtccactt

SEQ ID NO: 188650 - DNA, 20 bp, human
gcagcgcagcttctcgggtg

SEQ ID NO: 188651 - DNA, 20 bp, human
ggacggtggacgctgagggt

SEQ ID NO: 188652 - DNA, 20 bp, human
gtcggggcctgcgccctgtg

SEQ ID NO: 188653 - DNA, 20 bp, human
gtccacttgggaacccggtg

SEQ ID NO: 188654 - DNA, 20 bp, human
gacgcgcccaggagagaaag

SEQ ID NO: 188655 - DNA, 20 bp, human
ggagcgctggagaagccggg

SEQ ID NO: 188656 - DNA, 20 bp, human
gtggctcccggaagtagggc

SEQ ID NO: 188657 - DNA, 20 bp, human
ggaggggctgagggctcgct

SEQ ID NO: 188658 - DNA, 20 bp, human
ggggtgcgatgctattttgt

SEQ ID NO: 188659 - DNA, 20 bp, human
ggacgtggctcccggaagta

SEQ ID NO: 188660 - DNA, 20 bp, human
gccatgttgcagcaggtgag

SEQ ID NO: 188661 - DNA, 20 bp, human
gttagcttcctgacacccag

SEQ ID NO: 188662 - DNA, 20 bp, human
gggctgagggctcgctggga

SEQ ID NO: 188663 - DNA, 20 bp, human
ggacgcgggctccagtccca

SEQ ID NO: 188664 - DNA, 20 bp, human
gattaactctaagagcacaa

SEQ ID NO: 188665 - DNA, 20 bp, human
gtttgaaagcgaggctctgg

SEQ ID NO: 188666 - DNA, 20 bp, human
gtggctcctggaagcagggc

SEQ ID NO: 188667 - DNA, 20 bp, human
ggggtgcgatgctatcttgt

SEQ ID NO: 188668 - DNA, 20 bp, human
gtgacgtggctcctggaagc

SEQ ID NO: 188669 - DNA, 20 bp, human
gctccctcaaagcggaggtg

SEQ ID NO: 188670 - DNA, 20 bp, human
ggaggggctgagggcgcgct

SEQ ID NO: 188671 - DNA, 20 bp, human
gccatgttgcagcaggtgag

SEQ ID NO: 188672 - DNA, 20 bp, human
gttagcttcctgacacccag

SEQ ID NO: 188673 - DNA, 20 bp, human
gtttgagggagcaaatccag

SEQ ID NO: 188674 - DNA, 20 bp, human
gtggaagcagggctggcgta

SEQ ID NO: 188675 - DNA, 20 bp, human
gaagatagcatcgcacccct

SEQ ID NO: 188676 - DNA, 20 bp, human
gtggctcctggaagcagggc

SEQ ID NO: 188677 - DNA, 20 bp, human
ggggtgcgatgctatcttgt

SEQ ID NO: 188678 - DNA, 20 bp, human
gtgacgtggctcctggaagc

SEQ ID NO: 188679 - DNA, 20 bp, human
gctccctcaaagcggaggtg

SEQ ID NO: 188680 - DNA, 20 bp, human
ggaggggctgagggcgcgct

SEQ ID NO: 188681 - DNA, 20 bp, human
gccatgttgcagcaggtgag

SEQ ID NO: 188682 - DNA, 20 bp, human
gttagcttcctgacacccag

SEQ ID NO: 188683 - DNA, 20 bp, human
gtttgagggagcaaatccag

SEQ ID NO: 188684 - DNA, 20 bp, human
gtggaagcagggctggcgta

SEQ ID NO: 188685 - DNA, 20 bp, human
gaagatagcatcgcacccct

SEQ ID NO: 188686 - DNA, 20 bp, human
gtccctacgtgaccaaaagg

SEQ ID NO: 188687 - DNA, 20 bp, human
gggtcacgtagggaagagct

SEQ ID NO: 188688 - DNA, 20 bp, human
ggggacagtggaggcgactg

SEQ ID NO: 188689 - DNA, 20 bp, human
ggaaagttgggcgactgtcg

SEQ ID NO: 188690 - DNA, 20 bp, human
ggttgggcgactgtcgggga

SEQ ID NO: 188691 - DNA, 20 bp, human
ggaccaaaagggggaaagtt

SEQ ID NO: 188692 - DNA, 20 bp, human
gcgtgacggcagcagggacc

SEQ ID NO: 188693 - DNA, 20 bp, human
ggagggctgcaggaccggca

SEQ ID NO: 188694 - DNA, 20 bp, human
gcgaggcggcctggttgaag

SEQ ID NO: 188695 - DNA, 20 bp, human
gacgcaggccggcagcgccc

SEQ ID NO: 188696 - DNA, 20 bp, human
gacgctcgctggaccaagag

SEQ ID NO: 188697 - DNA, 20 bp, human
gctcgctggaccaagagagg

SEQ ID NO: 188698 - DNA, 20 bp, human
gtgtacacccactcccggaa

SEQ ID NO: 188699 - DNA, 20 bp, human
gcgcccgggaagctgcgcga

SEQ ID NO: 188700 - DNA, 20 bp, human
gggagccctccgcttgaccc

SEQ ID NO: 188701 - DNA, 20 bp, human
ggtcaagcggagggctccga

SEQ ID NO: 188702 - DNA, 20 bp, human
gttgccgggccagggtcaag

SEQ ID NO: 188703 - DNA, 20 bp, human
ggcccaccccaggcgacccg

SEQ ID NO: 188704 - DNA, 20 bp, human
gcgcggctgcaaaagagaac

SEQ ID NO: 188705 - DNA, 20 bp, human
ggcacaggcaggactgtaca

SEQ ID NO: 188706 - DNA, 20 bp, human
gcagcgaggaagagccagac

SEQ ID NO: 188707 - DNA, 20 bp, human
gccgccaggcctcctggaaa

SEQ ID NO: 188708 - DNA, 20 bp, human
gaccggcagcagccgccgag

SEQ ID NO: 188709 - DNA, 20 bp, human
gcgccgagcggcaagcgcgg

SEQ ID NO: 188710 - DNA, 20 bp, human
gcagagcccgcgaggtgtct

SEQ ID NO: 188711 - DNA, 20 bp, human
gccgcgaggtgtctgggagt

SEQ ID NO: 188712 - DNA, 20 bp, human
gccaaaaagaaagcgcccaa

SEQ ID NO: 188713 - DNA, 20 bp, human
ggagagagcaggaggacgga

SEQ ID NO: 188714 - DNA, 20 bp, human
ggcgggtcatggccaacgtg

SEQ ID NO: 188715 - DNA, 20 bp, human
gggcctcctggaaacggtgc

SEQ ID NO: 188716 - DNA, 20 bp, human
gcagcgaggaggagctcgag

SEQ ID NO: 188717 - DNA, 20 bp, human
ggtgcaaaaccgaggtctcc

SEQ ID NO: 188718 - DNA, 20 bp, human
gaaaccgaggtctccgggag

SEQ ID NO: 188719 - DNA, 20 bp, human
gcgggcaagcgcggcaagaa

SEQ ID NO: 188720 - DNA, 20 bp, human
ggtgcccaggctgtccacgg

SEQ ID NO: 188721 - DNA, 20 bp, human
ggtcgccgagcacacgctct

SEQ ID NO: 188722 - DNA, 20 bp, human
gaagatggcagcccgacccc

SEQ ID NO: 188723 - DNA, 20 bp, human
gaaggctctgatttcaaggc

SEQ ID NO: 188724 - DNA, 20 bp, human
gagcctgggcaccagcgagg

SEQ ID NO: 188725 - DNA, 20 bp, human
ggcgtgtgctcggcgaccgc

SEQ ID NO: 188726 - DNA, 20 bp, human
gggaaccttgacaagcagca

SEQ ID NO: 188727 - DNA, 20 bp, human
gggtggccgggccgcaccaa

SEQ ID NO: 188728 - DNA, 20 bp, human
ggccagcggcggcttctgat

SEQ ID NO: 188729 - DNA, 20 bp, human
ggaggcgccgcggccagcgg

SEQ ID NO: 188730 - DNA, 20 bp, human
gtcagaggcgccgcggccag

SEQ ID NO: 188731 - DNA, 20 bp, human
gttctgatgggtctctggta

SEQ ID NO: 188732 - DNA, 20 bp, human
gcgcgactctagaaatccag

SEQ ID NO: 188733 - DNA, 20 bp, human
gaccttaacaggaaacgcac

SEQ ID NO: 188734 - DNA, 20 bp, human
gggcataagtcggcaactct

SEQ ID NO: 188735 - DNA, 20 bp, human
gcagaagccgccgctggccg

SEQ ID NO: 188736 - DNA, 20 bp, human
gccctggcaccgctctacag

SEQ ID NO: 188737 - DNA, 20 bp, human
ggcgaggcagaggccggtag

SEQ ID NO: 188738 - DNA, 20 bp, human
gccggcggggatctaggggt

SEQ ID NO: 188739 - DNA, 20 bp, human
ggagccgagcctctgtagag

SEQ ID NO: 188740 - DNA, 20 bp, human
gatggcactgacagcgacca

SEQ ID NO: 188741 - DNA, 20 bp, human
gccgacccggcggggatcta

SEQ ID NO: 188742 - DNA, 20 bp, human
gggtagcggtgtgggggacc

SEQ ID NO: 188743 - DNA, 20 bp, human
gcggacgccccgcgaggcag

SEQ ID NO: 188744 - DNA, 20 bp, human
gtcgcgggcgctgcgctgag

SEQ ID NO: 188745 - DNA, 20 bp, human
gcagaggccggtagcggtgt

SEQ ID NO: 188746 - DNA, 20 bp, human
gcagcagtggtggatcacag

SEQ ID NO: 188747 - DNA, 20 bp, human
gtgtgtgctccccgcagaag

SEQ ID NO: 188748 - DNA, 20 bp, human
gagcccatcttactcacagg

SEQ ID NO: 188749 - DNA, 20 bp, human
gacagtcttcagttcttctg

SEQ ID NO: 188750 - DNA, 20 bp, human
gtcatggtagccccttctgc

SEQ ID NO: 188751 - DNA, 20 bp, human
gcaaagcccatcttactcac

SEQ ID NO: 188752 - DNA, 20 bp, human
gtctggatttgctccagcag

SEQ ID NO: 188753 - DNA, 20 bp, human
ggaactagaacttggtctcc

SEQ ID NO: 188754 - DNA, 20 bp, human
gtagaattacatcatcactg

SEQ ID NO: 188755 - DNA, 20 bp, human
gaactctgtcacaacatctg

SEQ ID NO: 188756 - DNA, 20 bp, human
gatattgagggagtctctaa

SEQ ID NO: 188757 - DNA, 20 bp, human
ggtcttccactagtgaagga

SEQ ID NO: 188758 - DNA, 20 bp, human
ggaacaatgccgcacacggt

SEQ ID NO: 188759 - DNA, 20 bp, human
gcagcgggtgcaaagagaca

SEQ ID NO: 188760 - DNA, 20 bp, human
gtcgtgccttccttcactag

SEQ ID NO: 188761 - DNA, 20 bp, human
gagagacatggtgactccac

SEQ ID NO: 188762 - DNA, 20 bp, human
ggcggtaagtctacttccga

SEQ ID NO: 188763 - DNA, 20 bp, human
gaaatctaaaggatcaggaa

SEQ ID NO: 188764 - DNA, 20 bp, human
gtggagaacaatgccgcaca

SEQ ID NO: 188765 - DNA, 20 bp, human
gcatgagtacgtgatattga

SEQ ID NO: 188766 - DNA, 20 bp, human
gccggtgcgaggccagaggt

SEQ ID NO: 188767 - DNA, 20 bp, human
gggaagccatcggacgtcgg

SEQ ID NO: 188768 - DNA, 20 bp, human
gggcggtgaggtacgtgcag

SEQ ID NO: 188769 - DNA, 20 bp, human
gaggagagcccgacgtgccg

SEQ ID NO: 188770 - DNA, 20 bp, human
gtggggaagccatcggacgt

SEQ ID NO: 188771 - DNA, 20 bp, human
gaagcctgccccggcacgtc

SEQ ID NO: 188772 - DNA, 20 bp, human
gacgtgcagcggcggccggt

SEQ ID NO: 188773 - DNA, 20 bp, human
ggccaagaccagagagccgt

SEQ ID NO: 188774 - DNA, 20 bp, human
ggcagctcccacagcgggtg

SEQ ID NO: 188775 - DNA, 20 bp, human
gccatcggacgtcggcggtg

SEQ ID NO: 188776 - DNA, 20 bp, human
ggctggctgtgttcttacaa

SEQ ID NO: 188777 - DNA, 20 bp, human
gacagcaggagagggcgggc

SEQ ID NO: 188778 - DNA, 20 bp, human
gtcagagctgcagcaacagc

SEQ ID NO: 188779 - DNA, 20 bp, human
gaagccctgtgagaaggtat

SEQ ID NO: 188780 - DNA, 20 bp, human
gtgtgagaaggtatagggtg

SEQ ID NO: 188781 - DNA, 20 bp, human
ggtgaaaagttctctccctg

SEQ ID NO: 188782 - DNA, 20 bp, human
gttgggaattgaattgtcct

SEQ ID NO: 188783 - DNA, 20 bp, human
gaaaatgtgttgcttaggga

SEQ ID NO: 188784 - DNA, 20 bp, human
gggagtttaaagaatagcca

SEQ ID NO: 188785 - DNA, 20 bp, human
ggtttgtcatacttaccaga

SEQ ID NO: 188786 - DNA, 20 bp, human
gcaaacaagcggcccgacaa

SEQ ID NO: 188787 - DNA, 20 bp, human
gcgtcacctcatggcgacgc

SEQ ID NO: 188788 - DNA, 20 bp, human
gctcatggcgacgcgggtag

SEQ ID NO: 188789 - DNA, 20 bp, human
gcaggtgtgacagccacgtg

SEQ ID NO: 188790 - DNA, 20 bp, human
gcctggcgcccggatccccg

SEQ ID NO: 188791 - DNA, 20 bp, human
gaggcgactgaggccggacg

SEQ ID NO: 188792 - DNA, 20 bp, human
ggccgggagcacggtgacgg

SEQ ID NO: 188793 - DNA, 20 bp, human
gccgggcccgacaacaacga

SEQ ID NO: 188794 - DNA, 20 bp, human
gccccgggagggaagaagac

SEQ ID NO: 188795 - DNA, 20 bp, human
ggcggcagaaggtcagtcag

SEQ ID NO: 188796 - DNA, 20 bp, human
gcccggcgtgcgtgtggcgg

SEQ ID NO: 188797 - DNA, 20 bp, human
gcgcgcgcggcctctgtaac

SEQ ID NO: 188798 - DNA, 20 bp, human
gagtctgacgagcggctgta

SEQ ID NO: 188799 - DNA, 20 bp, human
gggtgcaggaggcgcagcgt

SEQ ID NO: 188800 - DNA, 20 bp, human
gctcctgcaccctcccgtcc

SEQ ID NO: 188801 - DNA, 20 bp, human
ggggcgtgccagtttataaa

SEQ ID NO: 188802 - DNA, 20 bp, human
ggcgtgcgtgcaatcccccg

SEQ ID NO: 188803 - DNA, 20 bp, human
gccccgactggaggaagatg

SEQ ID NO: 188804 - DNA, 20 bp, human
gtgagagcgcagacagcgtg

SEQ ID NO: 188805 - DNA, 20 bp, human
ggcacgcggggagcgtccgg

SEQ ID NO: 188806 - DNA, 20 bp, human
gtctcagagggttgtgatta

SEQ ID NO: 188807 - DNA, 20 bp, human
gaagaccaataatgtgtgta

SEQ ID NO: 188808 - DNA, 20 bp, human
ggagtaagggaaggaatacg

SEQ ID NO: 188809 - DNA, 20 bp, human
gcgacaggcgtgcccttgac

SEQ ID NO: 188810 - DNA, 20 bp, human
gacctcgagccacccccaca

SEQ ID NO: 188811 - DNA, 20 bp, human
gctccgctcgcattgcaggg

SEQ ID NO: 188812 - DNA, 20 bp, human
ggctcgcattgcagggaggt

SEQ ID NO: 188813 - DNA, 20 bp, human
gccacactgcgagtaaggga

SEQ ID NO: 188814 - DNA, 20 bp, human
ggaggaactaagagtgtgag

SEQ ID NO: 188815 - DNA, 20 bp, human
gcagccaacactggaaccca

SEQ ID NO: 188816 - DNA, 20 bp, human
ggctccaggcggcagagcaa

SEQ ID NO: 188817 - DNA, 20 bp, human
ggccggggcgaggagaaggt

SEQ ID NO: 188818 - DNA, 20 bp, human
ggcactaaagcgggacgata

SEQ ID NO: 188819 - DNA, 20 bp, human
gggaccctggggccccgcta

SEQ ID NO: 188820 - DNA, 20 bp, human
gctgcagggccgggtcgcag

SEQ ID NO: 188821 - DNA, 20 bp, human
gaggacgccgaggacgaggg

SEQ ID NO: 188822 - DNA, 20 bp, human
gggcctcagccggggaagtc

SEQ ID NO: 188823 - DNA, 20 bp, human
ggggaggggtcagccgtcct

SEQ ID NO: 188824 - DNA, 20 bp, human
gtagggcgcagggctccacc

SEQ ID NO: 188825 - DNA, 20 bp, human
ggtggccgcaggttccggga

SEQ ID NO: 188826 - DNA, 20 bp, human
gcggcgctcggcgaactgtg

SEQ ID NO: 188827 - DNA, 20 bp, human
ggcggttgcaaggaaaaata

SEQ ID NO: 188828 - DNA, 20 bp, human
gggtcagtcgctcccaacag

SEQ ID NO: 188829 - DNA, 20 bp, human
ggagggtctctgaggagacc

SEQ ID NO: 188830 - DNA, 20 bp, human
gggaccgtctgctgggactc

SEQ ID NO: 188831 - DNA, 20 bp, human
gtgggaggggaacggtgcta

SEQ ID NO: 188832 - DNA, 20 bp, human
gggcaagaagagattatact

SEQ ID NO: 188833 - DNA, 20 bp, human
ggtagagagtagcgggtctg

SEQ ID NO: 188834 - DNA, 20 bp, human
gacctggcaagcctgttctg

SEQ ID NO: 188835 - DNA, 20 bp, human
ggtggcctaagagttagaat

SEQ ID NO: 188836 - DNA, 20 bp, human
ggaccattgcccaggccgag

SEQ ID NO: 188837 - DNA, 20 bp, human
ggctgctgaggcataccctc

SEQ ID NO: 188838 - DNA, 20 bp, human
gacgcggcccaaccaccccc

SEQ ID NO: 188839 - DNA, 20 bp, human
gacgcggggcggtcgtcgac

SEQ ID NO: 188840 - DNA, 20 bp, human
ggggcggtgcatgagatgat

SEQ ID NO: 188841 - DNA, 20 bp, human
ggcccaggccgagaggcaat

SEQ ID NO: 188842 - DNA, 20 bp, human
gaccagccacgggctgaggg

SEQ ID NO: 188843 - DNA, 20 bp, human
gcgaggagccgcatgacgcg

SEQ ID NO: 188844 - DNA, 20 bp, human
ggcagccgggaccattgccc

SEQ ID NO: 188845 - DNA, 20 bp, human
gtgcgcggggagagaagtcg

SEQ ID NO: 188846 - DNA, 20 bp, human
gcatgaacggcgggaaacac

SEQ ID NO: 188847 - DNA, 20 bp, human
gcctgcagccgccaccgact

SEQ ID NO: 188848 - DNA, 20 bp, human
ggcagccgccaccgactcgg

SEQ ID NO: 188849 - DNA, 20 bp, human
ggtccccgcccgcaggtccc

SEQ ID NO: 188850 - DNA, 20 bp, human
gctacctgcccgggacctgc

SEQ ID NO: 188851 - DNA, 20 bp, human
ggaggccgactccgccgagt

SEQ ID NO: 188852 - DNA, 20 bp, human
ggccgactccgccgagtcgg

SEQ ID NO: 188853 - DNA, 20 bp, human
gcatcccctcgacccacaaa

SEQ ID NO: 188854 - DNA, 20 bp, human
gccgtctctggggcaccgaa

SEQ ID NO: 188855 - DNA, 20 bp, human
ggagccctttgtgggtcgag

SEQ ID NO: 188856 - DNA, 20 bp, human
gacgtccggtcgccgcggtt

SEQ ID NO: 188857 - DNA, 20 bp, human
gagtgcacgtccggtcgccg

SEQ ID NO: 188858 - DNA, 20 bp, human
gccaatggcccgctatgagg

SEQ ID NO: 188859 - DNA, 20 bp, human
ggggccgtggaacagcacaa

SEQ ID NO: 188860 - DNA, 20 bp, human
gacgtgcactcctccagtag

SEQ ID NO: 188861 - DNA, 20 bp, human
ggagcctacggccagaaggg

SEQ ID NO: 188862 - DNA, 20 bp, human
ggtgccaatggcccgctatg

SEQ ID NO: 188863 - DNA, 20 bp, human
ggacgtgcagccgctactgg

SEQ ID NO: 188864 - DNA, 20 bp, human
gaagacactaatggtactgg

SEQ ID NO: 188865 - DNA, 20 bp, human
gatgaggaggtgagcgtgtc

SEQ ID NO: 188866 - DNA, 20 bp, human
ggctgggactacgcattcac

SEQ ID NO: 188867 - DNA, 20 bp, human
gatatttgagagcttcaagg

SEQ ID NO: 188868 - DNA, 20 bp, human
gcagggtgttgaaccaagaa

SEQ ID NO: 188869 - DNA, 20 bp, human
ggtgatatttgagagcttca

SEQ ID NO: 188870 - DNA, 20 bp, human
gcagaaggacaaacagcgtg

SEQ ID NO: 188871 - DNA, 20 bp, human
gtgatgctaatggtaagtag

SEQ ID NO: 188872 - DNA, 20 bp, human
ggacctatgcagttagggag

SEQ ID NO: 188873 - DNA, 20 bp, human
gtcaggaatggatgtagaca

SEQ ID NO: 188874 - DNA, 20 bp, human
gcactgttgtgaatacagag

SEQ ID NO: 188875 - DNA, 20 bp, human
gttgggtggcacgttacagt

SEQ ID NO: 188876 - DNA, 20 bp, human
ggtgcggggtgtaatactgg

SEQ ID NO: 188877 - DNA, 20 bp, human
gagcagcagcagcgcagtca

SEQ ID NO: 188878 - DNA, 20 bp, human
gcctgggcgcgcgggcatcg

SEQ ID NO: 188879 - DNA, 20 bp, human
gggcctgcgcggcgttacca

SEQ ID NO: 188880 - DNA, 20 bp, human
gtctgcggcgtgcgtgctac

SEQ ID NO: 188881 - DNA, 20 bp, human
gcgccgacggctctggtctg

SEQ ID NO: 188882 - DNA, 20 bp, human
gcgccgcagaccagagccgt

SEQ ID NO: 188883 - DNA, 20 bp, human
gatcccgtgcgtgaacatgt

SEQ ID NO: 188884 - DNA, 20 bp, human
ggcagcgcagtcagggccgc

SEQ ID NO: 188885 - DNA, 20 bp, human
gcgcagtcagggccgccggc

SEQ ID NO: 188886 - DNA, 20 bp, human
ggatccaactaaaccaacag

SEQ ID NO: 188887 - DNA, 20 bp, human
gcaactgaggtacgatccat

SEQ ID NO: 188888 - DNA, 20 bp, human
gaaaccccagatgtggaatg

SEQ ID NO: 188889 - DNA, 20 bp, human
gctgtaccatgattacacca

SEQ ID NO: 188890 - DNA, 20 bp, human
gcacttccctggtgtaatca

SEQ ID NO: 188891 - DNA, 20 bp, human
ggcaggatactgtaataaat

SEQ ID NO: 188892 - DNA, 20 bp, human
ggtacagattattaaagaca

SEQ ID NO: 188893 - DNA, 20 bp, human
ggatccatgggatcagatac

SEQ ID NO: 188894 - DNA, 20 bp, human
gggaaaattccatggaagta

SEQ ID NO: 188895 - DNA, 20 bp, human
gaggcaggaaataaaagtcc

SEQ ID NO: 188896 - DNA, 20 bp, human
gtgcaaggcaaaagccggag

SEQ ID NO: 188897 - DNA, 20 bp, human
gacagctccgctggaagggt

SEQ ID NO: 188898 - DNA, 20 bp, human
ggctactgcaaggcaaaagc

SEQ ID NO: 188899 - DNA, 20 bp, human
gtgtaaaaaggaagaatcag

SEQ ID NO: 188900 - DNA, 20 bp, human
gcttgcgcaagcgcaccagg

SEQ ID NO: 188901 - DNA, 20 bp, human
ggcgaggttcgcagccaata

SEQ ID NO: 188902 - DNA, 20 bp, human
gtctgccaggacaccgacac

SEQ ID NO: 188903 - DNA, 20 bp, human
gttccagcggagctgtaaaa

SEQ ID NO: 188904 - DNA, 20 bp, human
ggctgccggcggctgcaaac

SEQ ID NO: 188905 - DNA, 20 bp, human
gcctgcgcccggggaaacag

SEQ ID NO: 188906 - DNA, 20 bp, human
ggctggccgggtgatagtgg

SEQ ID NO: 188907 - DNA, 20 bp, human
gctcctttggagaaaaagag

SEQ ID NO: 188908 - DNA, 20 bp, human
ggtggctggccgggtgatag

SEQ ID NO: 188909 - DNA, 20 bp, human
gatctccacaagcactcctt

SEQ ID NO: 188910 - DNA, 20 bp, human
gtacggcagtggcgagaagg

SEQ ID NO: 188911 - DNA, 20 bp, human
gaggatcctggcttgcggag

SEQ ID NO: 188912 - DNA, 20 bp, human
gacgaccctgaaaaggtgta

SEQ ID NO: 188913 - DNA, 20 bp, human
gttctccaaaggagtgcttg

SEQ ID NO: 188914 - DNA, 20 bp, human
gctgaaaaggtgtacggcag

SEQ ID NO: 188915 - DNA, 20 bp, human
gcttcgcttagtgtaaccag

SEQ ID NO: 188916 - DNA, 20 bp, human
ggatctcaccattaaatcag

SEQ ID NO: 188917 - DNA, 20 bp, human
gtaagtgtggcgggccacaa

SEQ ID NO: 188918 - DNA, 20 bp, human
gtatgggtgtgtagactact

SEQ ID NO: 188919 - DNA, 20 bp, human
gtgtgtagactactgggtga

SEQ ID NO: 188920 - DNA, 20 bp, human
gctcttgagttggctggctc

SEQ ID NO: 188921 - DNA, 20 bp, human
ggaactgggtttaggggcaa

SEQ ID NO: 188922 - DNA, 20 bp, human
gcacaggtgcctatatagaa

SEQ ID NO: 188923 - DNA, 20 bp, human
gtttgaagtagtggatctgg

SEQ ID NO: 188924 - DNA, 20 bp, human
gggggcaagggcatgggact

SEQ ID NO: 188925 - DNA, 20 bp, human
gccatcaggaatgaacatgc

SEQ ID NO: 188926 - DNA, 20 bp, human
gaagcccgtcgggagcgacc

SEQ ID NO: 188927 - DNA, 20 bp, human
ggtcccgggagaagactcgg

SEQ ID NO: 188928 - DNA, 20 bp, human
gagagtcccgggagaagact

SEQ ID NO: 188929 - DNA, 20 bp, human
ggccgagtcacgccagggag

SEQ ID NO: 188930 - DNA, 20 bp, human
ggaccgccgagtcttctccc

SEQ ID NO: 188931 - DNA, 20 bp, human
gtcagtgccgagtcacgcca

SEQ ID NO: 188932 - DNA, 20 bp, human
gcaggcccccgagcccgtct

SEQ ID NO: 188933 - DNA, 20 bp, human
gctaattccggcagctcctg

SEQ ID NO: 188934 - DNA, 20 bp, human
ggcgactgccggacactccg

SEQ ID NO: 188935 - DNA, 20 bp, human
ggagatgctcaggaaggccg

SEQ ID NO: 188936 - DNA, 20 bp, human
gtgcgggagcatgtacgaca

SEQ ID NO: 188937 - DNA, 20 bp, human
gatttcgtccgtgggcccgg

SEQ ID NO: 188938 - DNA, 20 bp, human
ggagccgcggcccctcctcg

SEQ ID NO: 188939 - DNA, 20 bp, human
ggcccagacgttctgccggg

SEQ ID NO: 188940 - DNA, 20 bp, human
gggaggaatcgcctgaacga

SEQ ID NO: 188941 - DNA, 20 bp, human
gcgagctgttccccgaggag

SEQ ID NO: 188942 - DNA, 20 bp, human
gagggagggcccagcgaggt

SEQ ID NO: 188943 - DNA, 20 bp, human
ggctcgaccgcagcgagggg

SEQ ID NO: 188944 - DNA, 20 bp, human
gccctgccggcgtcgcctgg

SEQ ID NO: 188945 - DNA, 20 bp, human
gtcgtccgtgggcccggggg

SEQ ID NO: 188946 - DNA, 20 bp, human
gttattgggctgttgagcgg

SEQ ID NO: 188947 - DNA, 20 bp, human
ggaaactcctggccgtcggt

SEQ ID NO: 188948 - DNA, 20 bp, human
gggtcagagccgagcaaggt

SEQ ID NO: 188949 - DNA, 20 bp, human
gttgagcgggggccgaccga

SEQ ID NO: 188950 - DNA, 20 bp, human
gaccctcgtggccccgctag

SEQ ID NO: 188951 - DNA, 20 bp, human
ggaggcggcgtggacgagta

SEQ ID NO: 188952 - DNA, 20 bp, human
gcgtttattgggctgttgag

SEQ ID NO: 188953 - DNA, 20 bp, human
gcgtggccccgctagcggga

SEQ ID NO: 188954 - DNA, 20 bp, human
gtctctgcgtgtgaacgcat

SEQ ID NO: 188955 - DNA, 20 bp, human
gaaaagaaactcctggccgt

SEQ ID NO: 188956 - DNA, 20 bp, human
gtgcgccgagggcaaggcag

SEQ ID NO: 188957 - DNA, 20 bp, human
gcgctggctgtgagagaggt

SEQ ID NO: 188958 - DNA, 20 bp, human
gacagggccttgtgcgacat

SEQ ID NO: 188959 - DNA, 20 bp, human
gcaacggagctgcagacgaa

SEQ ID NO: 188960 - DNA, 20 bp, human
gctcggtcgtacctgaccta

SEQ ID NO: 188961 - DNA, 20 bp, human
ggacctgcccggaaacctgt

SEQ ID NO: 188962 - DNA, 20 bp, human
gacgggccctgagcgaaatc

SEQ ID NO: 188963 - DNA, 20 bp, human
gcgcccgctggctgtgagag

SEQ ID NO: 188964 - DNA, 20 bp, human
gacacggtgcttgtaggaag

SEQ ID NO: 188965 - DNA, 20 bp, human
gggaaaccgaaccgagatct

SEQ ID NO: 188966 - DNA, 20 bp, human
gggcgctgcggggattagga

SEQ ID NO: 188967 - DNA, 20 bp, human
gaccagctctgggagaccac

SEQ ID NO: 188968 - DNA, 20 bp, human
gcacggcctgcgtccgccac

SEQ ID NO: 188969 - DNA, 20 bp, human
gcatcgtcgtggggcttctg

SEQ ID NO: 188970 - DNA, 20 bp, human
gacgacgatggcggcaatgg

SEQ ID NO: 188971 - DNA, 20 bp, human
gggtgcctggtgacctcggg

SEQ ID NO: 188972 - DNA, 20 bp, human
gaggagggcgcttccggtgg

SEQ ID NO: 188973 - DNA, 20 bp, human
gccagacccctagactctag

SEQ ID NO: 188974 - DNA, 20 bp, human
gtatgtggacacccccgcgt

SEQ ID NO: 188975 - DNA, 20 bp, human
gcctagactctagaggttag

SEQ ID NO: 188976 - DNA, 20 bp, human
gtggtgagagtggccagcga

SEQ ID NO: 188977 - DNA, 20 bp, human
ggccacgcggacgccacccg

SEQ ID NO: 188978 - DNA, 20 bp, human
gcgccgggacggggcctgag

SEQ ID NO: 188979 - DNA, 20 bp, human
gttcgcgcgggtggtgagag

SEQ ID NO: 188980 - DNA, 20 bp, human
gcgcccctcaggccccgtcc

SEQ ID NO: 188981 - DNA, 20 bp, human
ggtccccatagtactcgggt

SEQ ID NO: 188982 - DNA, 20 bp, human
gcgcctacccgagtactatg

SEQ ID NO: 188983 - DNA, 20 bp, human
gcggcgaacgctgccctcgc

SEQ ID NO: 188984 - DNA, 20 bp, human
gcggtcgcgcgcggtggaac

SEQ ID NO: 188985 - DNA, 20 bp, human
gtcacaaaccgaaacgcagg

SEQ ID NO: 188986 - DNA, 20 bp, human
gcatgtggggtgaattccaa

SEQ ID NO: 188987 - DNA, 20 bp, human
gattcaccccacatgtgggg

SEQ ID NO: 188988 - DNA, 20 bp, human
gtgcagctgcaatgaaatgt

SEQ ID NO: 188989 - DNA, 20 bp, human
gggaattcaccccacatgtg

SEQ ID NO: 188990 - DNA, 20 bp, human
gttcctacctccccacatgt

SEQ ID NO: 188991 - DNA, 20 bp, human
gaccccacatgtggggaggt

SEQ ID NO: 188992 - DNA, 20 bp, human
gatgtggggaggtaggaaac

SEQ ID NO: 188993 - DNA, 20 bp, human
gagctacttgatgacaccat

SEQ ID NO: 188994 - DNA, 20 bp, human
gtggggaggtaggaaacagg

SEQ ID NO: 188995 - DNA, 20 bp, human
gaaaatatacaaatctggcc

SEQ ID NO: 188996 - DNA, 20 bp, human
gctagacccggaagaatagg

SEQ ID NO: 188997 - DNA, 20 bp, human
gcccggaagaataggaggat

SEQ ID NO: 188998 - DNA, 20 bp, human
gcctgagcgagaggagactt

SEQ ID NO: 188999 - DNA, 20 bp, human
gcctggccctgggaaagtgg

SEQ ID NO: 189000 - DNA, 20 bp, human
gagagaggacgcctctgcag

SEQ ID NO: 189001 - DNA, 20 bp, human
gaggtcctctcagattgcag

SEQ ID NO: 189002 - DNA, 20 bp, human
gagcctagacccggaagaat

SEQ ID NO: 189003 - DNA, 20 bp, human
gaggcgtcctctctggaaca

SEQ ID NO: 189004 - DNA, 20 bp, human
gactttcccagggccaggat

SEQ ID NO: 189005 - DNA, 20 bp, human
gtgctcccacaccactgcag

SEQ ID NO: 189006 - DNA, 20 bp, human
gagcttgtgttcccccggaa

SEQ ID NO: 189007 - DNA, 20 bp, human
gcaagcgcagccagtccccg

SEQ ID NO: 189008 - DNA, 20 bp, human
gtccagactcacccttccgg

SEQ ID NO: 189009 - DNA, 20 bp, human
ggaagggtgagtctggacgc

SEQ ID NO: 189010 - DNA, 20 bp, human
gagcgcggccggaggtcctc

SEQ ID NO: 189011 - DNA, 20 bp, human
gtcccccggaagggtgagtc

SEQ ID NO: 189012 - DNA, 20 bp, human
ggcgccagtatggaagtgga

SEQ ID NO: 189013 - DNA, 20 bp, human
gtccccgcggcttcttcctg

SEQ ID NO: 189014 - DNA, 20 bp, human
gtgacaggctgcacttggat

SEQ ID NO: 189015 - DNA, 20 bp, human
ggttcgagcttgtgttcccc

SEQ ID NO: 189016 - DNA, 20 bp, human
gcccgcgggtcgggaccgta

SEQ ID NO: 189017 - DNA, 20 bp, human
gtgagcgaagcggacatcag

SEQ ID NO: 189018 - DNA, 20 bp, human
ggcgcgaaccctgaacccta

SEQ ID NO: 189019 - DNA, 20 bp, human
ggcggacaccggagagacac

SEQ ID NO: 189020 - DNA, 20 bp, human
gaccctacggtcccgacccg

SEQ ID NO: 189021 - DNA, 20 bp, human
ggtcgggaccgtagggttca

SEQ ID NO: 189022 - DNA, 20 bp, human
gcagcgccctaagcaggtac

SEQ ID NO: 189023 - DNA, 20 bp, human
gtgatccgcatgaagcgaga

SEQ ID NO: 189024 - DNA, 20 bp, human
gtccgcatgaagcgagacgg

SEQ ID NO: 189025 - DNA, 20 bp, human
ggcgctcccattcaccacag

SEQ ID NO: 189026 - DNA, 20 bp, human
ggaccccgccgagcaggaag

SEQ ID NO: 189027 - DNA, 20 bp, human
gaggacgaccgcacgggcac

SEQ ID NO: 189028 - DNA, 20 bp, human
gtcaggaaggacgaccgcac

SEQ ID NO: 189029 - DNA, 20 bp, human
gcctcaatcctgcgagggag

SEQ ID NO: 189030 - DNA, 20 bp, human
gcggcgtctgtaaggcgagg

SEQ ID NO: 189031 - DNA, 20 bp, human
gtccaacacatcctccgctg

SEQ ID NO: 189032 - DNA, 20 bp, human
gcacagcagcgacagccggg

SEQ ID NO: 189033 - DNA, 20 bp, human
gtccgagccggccacaggca

SEQ ID NO: 189034 - DNA, 20 bp, human
gccctcgcaggattgaggtt

SEQ ID NO: 189035 - DNA, 20 bp, human
ggcgccagtcacgtccctaa

SEQ ID NO: 189036 - DNA, 20 bp, human
gcagaccttgtgaggactag

SEQ ID NO: 189037 - DNA, 20 bp, human
gtcacaaggtctgcaggaac

SEQ ID NO: 189038 - DNA, 20 bp, human
gtgcacagagagacgactct

SEQ ID NO: 189039 - DNA, 20 bp, human
gtctgcaggaactggctaat

SEQ ID NO: 189040 - DNA, 20 bp, human
gggtctggaaactccacagc

SEQ ID NO: 189041 - DNA, 20 bp, human
gctagggaaatggccagcgg

SEQ ID NO: 189042 - DNA, 20 bp, human
gtaatcactgtagtagtagc

SEQ ID NO: 189043 - DNA, 20 bp, human
gagtgctctggcaacttcat

SEQ ID NO: 189044 - DNA, 20 bp, human
ggatttgagtgccccagaga

SEQ ID NO: 189045 - DNA, 20 bp, human
ggacagaaggatattctgac

SEQ ID NO: 189046 - DNA, 20 bp, human
gtccgcctcagcgccatcgg

SEQ ID NO: 189047 - DNA, 20 bp, human
gtccccagtactgggaagga

SEQ ID NO: 189048 - DNA, 20 bp, human
ggtcgccgccgatggcgctg

SEQ ID NO: 189049 - DNA, 20 bp, human
gtggcgctgaggcggagcat

SEQ ID NO: 189050 - DNA, 20 bp, human
gcccggcccgcgagcgagga

SEQ ID NO: 189051 - DNA, 20 bp, human
ggccgccgatggcgctgagg

SEQ ID NO: 189052 - DNA, 20 bp, human
gacagctgggaacatcgagg

SEQ ID NO: 189053 - DNA, 20 bp, human
ggtgctcgccgccagatctc

SEQ ID NO: 189054 - DNA, 20 bp, human
ggaatggggtccccagtact

SEQ ID NO: 189055 - DNA, 20 bp, human
ggaccccgcgctgctgacgg

SEQ ID NO: 189056 - DNA, 20 bp, human
gcccaccggcccttacactg

SEQ ID NO: 189057 - DNA, 20 bp, human
gggctctgggagaaacccac

SEQ ID NO: 189058 - DNA, 20 bp, human
gcagcatccggcttcatggg

SEQ ID NO: 189059 - DNA, 20 bp, human
gtgctggacaccacagtgta

SEQ ID NO: 189060 - DNA, 20 bp, human
gcacttacagccagcaggag

SEQ ID NO: 189061 - DNA, 20 bp, human
gcgtgtctggcgggactcag

SEQ ID NO: 189062 - DNA, 20 bp, human
gacgctgcgccacatcccac

SEQ ID NO: 189063 - DNA, 20 bp, human
ggcgtccaggcaagtgaagg

SEQ ID NO: 189064 - DNA, 20 bp, human
gacagccaagaggttagcaa

SEQ ID NO: 189065 - DNA, 20 bp, human
gaggcacagagttatgacgg

SEQ ID NO: 189066 - DNA, 20 bp, human
ggacatccttcaggattgtg

SEQ ID NO: 189067 - DNA, 20 bp, human
gactggaaagaagtcctatg

SEQ ID NO: 189068 - DNA, 20 bp, human
gaaacaaaatgacgaggaca

SEQ ID NO: 189069 - DNA, 20 bp, human
gctcacccaaactaggcggg

SEQ ID NO: 189070 - DNA, 20 bp, human
gagatttgggattaattatc

SEQ ID NO: 189071 - DNA, 20 bp, human
gttaacagttctgacgtgag

SEQ ID NO: 189072 - DNA, 20 bp, human
gcttcaggattgtgaggtac

SEQ ID NO: 189073 - DNA, 20 bp, human
gagtttgggtgagcagattt

SEQ ID NO: 189074 - DNA, 20 bp, human
gttggagctgaaggaagaat

SEQ ID NO: 189075 - DNA, 20 bp, human
gaagaagtcctatggggagt

SEQ ID NO: 189076 - DNA, 20 bp, human
gcgaggacccctacccggtc

SEQ ID NO: 189077 - DNA, 20 bp, human
ggcttcagccggaccgggta

SEQ ID NO: 189078 - DNA, 20 bp, human
ggcgagcgaggacccctacc

SEQ ID NO: 189079 - DNA, 20 bp, human
gaggcagcttcagccggacc

SEQ ID NO: 189080 - DNA, 20 bp, human
ggcctctaggccggacactc

SEQ ID NO: 189081 - DNA, 20 bp, human
gggaaggccggcgaatgggt

SEQ ID NO: 189082 - DNA, 20 bp, human
ggctcgaggctcgcgcactg

SEQ ID NO: 189083 - DNA, 20 bp, human
gcgctgcctcgtccccgaag

SEQ ID NO: 189084 - DNA, 20 bp, human
ggggagccgcagaccagcaa

SEQ ID NO: 189085 - DNA, 20 bp, human
gtagccaatcgggctcgatg

SEQ ID NO: 189086 - DNA, 20 bp, human
gcgagtgcctgcagacctgt

SEQ ID NO: 189087 - DNA, 20 bp, human
gtggctgcccacaggtctgc

SEQ ID NO: 189088 - DNA, 20 bp, human
gactcggtacgccgctaacg

SEQ ID NO: 189089 - DNA, 20 bp, human
gagctacctcgccgcgttag

SEQ ID NO: 189090 - DNA, 20 bp, human
gatagcccgatgattcgcac

SEQ ID NO: 189091 - DNA, 20 bp, human
gggcttcaaacgttcaacct

SEQ ID NO: 189092 - DNA, 20 bp, human
gggtaccagtgcgaatcatc

SEQ ID NO: 189093 - DNA, 20 bp, human
ggtacgccgctaacgcggcg

SEQ ID NO: 189094 - DNA, 20 bp, human
ggcgaatcatcgggctatcc

SEQ ID NO: 189095 - DNA, 20 bp, human
gttttttaagagagatatgc

SEQ ID NO: 189096 - DNA, 20 bp, human
ggcgtcgtgcagatactagt

SEQ ID NO: 189097 - DNA, 20 bp, human
gacagtttgtcttttttaac

SEQ ID NO: 189098 - DNA, 20 bp, human
ggcacagaaacaaaccacca

SEQ ID NO: 189099 - DNA, 20 bp, human
ggcacacgccaagctcgggg

SEQ ID NO: 189100 - DNA, 20 bp, human
gctcttggacaaacactgtg

SEQ ID NO: 189101 - DNA, 20 bp, human
gttcatggttacgaaacaca

SEQ ID NO: 189102 - DNA, 20 bp, human
gatactagtaggagtattca

SEQ ID NO: 189103 - DNA, 20 bp, human
gagtcgatgctccgagggag

SEQ ID NO: 189104 - DNA, 20 bp, human
ggtcatagtcgatgctccga

SEQ ID NO: 189105 - DNA, 20 bp, human
gattagcacacgccaagctc

SEQ ID NO: 189106 - DNA, 20 bp, human
gctgcccccagggagagacg

SEQ ID NO: 189107 - DNA, 20 bp, human
gagagacgaggctaccatga

SEQ ID NO: 189108 - DNA, 20 bp, human
gtccatgggtgacggactca

SEQ ID NO: 189109 - DNA, 20 bp, human
gcctcacccggtcaaggagt

SEQ ID NO: 189110 - DNA, 20 bp, human
ggccaccgctcgcttcaata

SEQ ID NO: 189111 - DNA, 20 bp, human
gactccgcgctgcgatccat

SEQ ID NO: 189112 - DNA, 20 bp, human
ggtagcctcgtctctccctg

SEQ ID NO: 189113 - DNA, 20 bp, human
ggcagccatattgaagcgag

SEQ ID NO: 189114 - DNA, 20 bp, human
gccggtcaaggagtaggatg

SEQ ID NO: 189115 - DNA, 20 bp, human
gaccctgagtccgtcaccca

SEQ ID NO: 189116 - DNA, 20 bp, human
gctgccggtgctgtatggaa

SEQ ID NO: 189117 - DNA, 20 bp, human
gagccgaagttccgaagacc

SEQ ID NO: 189118 - DNA, 20 bp, human
gctccagccggggtaccggg

SEQ ID NO: 189119 - DNA, 20 bp, human
ggacggggccgactcaccag

SEQ ID NO: 189120 - DNA, 20 bp, human
gcaggacggcagcagatcac

SEQ ID NO: 189121 - DNA, 20 bp, human
ggttccgaagacctggaaga

SEQ ID NO: 189122 - DNA, 20 bp, human
gatggccgggcagcacctcc

SEQ ID NO: 189123 - DNA, 20 bp, human
ggagaaacgccctccagccg

SEQ ID NO: 189124 - DNA, 20 bp, human
gtggttggcccttagaccaa

SEQ ID NO: 189125 - DNA, 20 bp, human
gcggtgtcggagaaagagac

SEQ ID NO: 189126 - DNA, 20 bp, human
gtcggcagggtcggcggcgt

SEQ ID NO: 189127 - DNA, 20 bp, human
ggcgtcggcagcagtgtcga

SEQ ID NO: 189128 - DNA, 20 bp, human
ggcagcagtgtcgacggcag

SEQ ID NO: 189129 - DNA, 20 bp, human
gtgacgtctcccgagggcgt

SEQ ID NO: 189130 - DNA, 20 bp, human
gccgagggcgtcggcagggt

SEQ ID NO: 189131 - DNA, 20 bp, human
gtcagccagtccggacccca

SEQ ID NO: 189132 - DNA, 20 bp, human
gctttcagcgcggctcgagg

SEQ ID NO: 189133 - DNA, 20 bp, human
gtccgggtgacgtctcccga

SEQ ID NO: 189134 - DNA, 20 bp, human
gcgaggcggcttccgggagt

SEQ ID NO: 189135 - DNA, 20 bp, human
gtctcccgagggcgtcggca

SEQ ID NO: 189136 - DNA, 20 bp, human
gtggagggcttgggtaaaaa

SEQ ID NO: 189137 - DNA, 20 bp, human
gtaagagcagccagacctgg

SEQ ID NO: 189138 - DNA, 20 bp, human
gggactcaggaacccggaat

SEQ ID NO: 189139 - DNA, 20 bp, human
gcatgcgtacaggctacaca

SEQ ID NO: 189140 - DNA, 20 bp, human
gaaacggcacgaagaccggt

SEQ ID NO: 189141 - DNA, 20 bp, human
gggagcaccggtccccgtgc

SEQ ID NO: 189142 - DNA, 20 bp, human
ggcgtacaggctacacacgg

SEQ ID NO: 189143 - DNA, 20 bp, human
ggtgacgacggccccagaag

SEQ ID NO: 189144 - DNA, 20 bp, human
gggactcactacccgctctg

SEQ ID NO: 189145 - DNA, 20 bp, human
gtacaggttgagcagcacta

SEQ ID NO: 189146 - DNA, 20 bp, human
gcatgctgaggcggccgcgt

SEQ ID NO: 189147 - DNA, 20 bp, human
gtgaggccttcacgaagcgg

SEQ ID NO: 189148 - DNA, 20 bp, human
gcggaagtagccgaagccag

SEQ ID NO: 189149 - DNA, 20 bp, human
ggcgccacggaaccagggtt

SEQ ID NO: 189150 - DNA, 20 bp, human
ggtcgaagtccgacatgctg

SEQ ID NO: 189151 - DNA, 20 bp, human
gaagtagccgaagccagcgg

SEQ ID NO: 189152 - DNA, 20 bp, human
gggacttcgacgagttcgag

SEQ ID NO: 189153 - DNA, 20 bp, human
gtggagcgggcggcaaggcg

SEQ ID NO: 189154 - DNA, 20 bp, human
gcctccgccaggaccacgtg

SEQ ID NO: 189155 - DNA, 20 bp, human
ggcggcggaagtagccgaag

SEQ ID NO: 189156 - DNA, 20 bp, human
ggcgcaggaagctgagatac

SEQ ID NO: 189157 - DNA, 20 bp, human
gcaacctgcgcacaacggtg

SEQ ID NO: 189158 - DNA, 20 bp, human
gacgccaggcggatctcaga

SEQ ID NO: 189159 - DNA, 20 bp, human
gaggccgccagacagcgcct

SEQ ID NO: 189160 - DNA, 20 bp, human
gggggcaaagctcaagatgg

SEQ ID NO: 189161 - DNA, 20 bp, human
gtctcagaaggccagttcaa

SEQ ID NO: 189162 - DNA, 20 bp, human
gtgctgccgccgccgaagga

SEQ ID NO: 189163 - DNA, 20 bp, human
gagctttgcccctccttcgg

SEQ ID NO: 189164 - DNA, 20 bp, human
gaatcccggctgggactatg

SEQ ID NO: 189165 - DNA, 20 bp, human
ggtgctgctgccgccgccga

SEQ ID NO: 189166 - DNA, 20 bp, human
gccagcgcgcaaggagtaga

SEQ ID NO: 189167 - DNA, 20 bp, human
gtcggaggcttgggagaaag

SEQ ID NO: 189168 - DNA, 20 bp, human
gggccagaaccgccccactg

SEQ ID NO: 189169 - DNA, 20 bp, human
gtctggaagaaacctcagtg

SEQ ID NO: 189170 - DNA, 20 bp, human
ggtggggaagagacccgtag

SEQ ID NO: 189171 - DNA, 20 bp, human
ggcccccgcgcgaaccttaa

SEQ ID NO: 189172 - DNA, 20 bp, human
ggcgcgaaccttaaaggctg

SEQ ID NO: 189173 - DNA, 20 bp, human
gcgaactcgccagcaaagga

SEQ ID NO: 189174 - DNA, 20 bp, human
ggccgcacccgagcctctac

SEQ ID NO: 189175 - DNA, 20 bp, human
ggtttcttccagaagttcgg

SEQ ID NO: 189176 - DNA, 20 bp, human
gtcgcgccgagaaaggtgag

SEQ ID NO: 189177 - DNA, 20 bp, human
gagtggggcctctcccgggt

SEQ ID NO: 189178 - DNA, 20 bp, human
ggtgggcagtagagacctcg

SEQ ID NO: 189179 - DNA, 20 bp, human
ggcgttgtgggaggaggtct

SEQ ID NO: 189180 - DNA, 20 bp, human
gaccccgcgagagggtgtgt

SEQ ID NO: 189181 - DNA, 20 bp, human
gcttccgcgcggccactcat

SEQ ID NO: 189182 - DNA, 20 bp, human
ggctgcggtcgcgccgagaa

SEQ ID NO: 189183 - DNA, 20 bp, human
gccccctcggactcagacac

SEQ ID NO: 189184 - DNA, 20 bp, human
gtagagacctcgaggctctc

SEQ ID NO: 189185 - DNA, 20 bp, human
gagcgcgggacgccgatgag

SEQ ID NO: 189186 - DNA, 20 bp, human
gcgagtgccgacttgacaga

SEQ ID NO: 189187 - DNA, 20 bp, human
gtcgtgcccacggagcgggt

SEQ ID NO: 189188 - DNA, 20 bp, human
ggtctcgtgacgctggtcag

SEQ ID NO: 189189 - DNA, 20 bp, human
ggtacctccgggccgaggta

SEQ ID NO: 189190 - DNA, 20 bp, human
gtgggcgtgacctaccccaa

SEQ ID NO: 189191 - DNA, 20 bp, human
gccgacttgacagacggcag

SEQ ID NO: 189192 - DNA, 20 bp, human
gcagcgaccccgagacacgg

SEQ ID NO: 189193 - DNA, 20 bp, human
ggcaggcgcgcggccaagtc

SEQ ID NO: 189194 - DNA, 20 bp, human
gcggttcccacccgctccgt

SEQ ID NO: 189195 - DNA, 20 bp, human
gctggggcgccaggactcgg

SEQ ID NO: 189196 - DNA, 20 bp, human
gcggcagcggcgattctagg

SEQ ID NO: 189197 - DNA, 20 bp, human
gtgtcggcggctcggctgta

SEQ ID NO: 189198 - DNA, 20 bp, human
gcggctcggctgtaaggagg

SEQ ID NO: 189199 - DNA, 20 bp, human
gcggcggctcggctgtaagg

SEQ ID NO: 189200 - DNA, 20 bp, human
gagccgccgacacaagatgg

SEQ ID NO: 189201 - DNA, 20 bp, human
gcggctgtaaggaggtggca

SEQ ID NO: 189202 - DNA, 20 bp, human
gctcgggagccaggaatcag

SEQ ID NO: 189203 - DNA, 20 bp, human
gtccccggccaggaccactc

SEQ ID NO: 189204 - DNA, 20 bp, human
gcaaccacaaccacaacggc

SEQ ID NO: 189205 - DNA, 20 bp, human
gggaccactccggctccctc

SEQ ID NO: 189206 - DNA, 20 bp, human
gggcttctcttgtacgacag

SEQ ID NO: 189207 - DNA, 20 bp, human
gttctcttgtacgacagagg

SEQ ID NO: 189208 - DNA, 20 bp, human
gccgagctccgcgcaaactc

SEQ ID NO: 189209 - DNA, 20 bp, human
gcccaaacggcaccccttaa

SEQ ID NO: 189210 - DNA, 20 bp, human
gaaagtcaaggcgggactgg

SEQ ID NO: 189211 - DNA, 20 bp, human
ggcccggggtgatatttagg

SEQ ID NO: 189212 - DNA, 20 bp, human
gcttcggggaaacccctcat

SEQ ID NO: 189213 - DNA, 20 bp, human
ggtatgggcacccttgtccg

SEQ ID NO: 189214 - DNA, 20 bp, human
gaatcctgctccacggacaa

SEQ ID NO: 189215 - DNA, 20 bp, human
gaatatcaccccgggcccgg

SEQ ID NO: 189216 - DNA, 20 bp, human
gggacaaccacgagccgcgg

SEQ ID NO: 189217 - DNA, 20 bp, human
gtcccgccatggcactgtcg

SEQ ID NO: 189218 - DNA, 20 bp, human
gccccgcgacagtgccatgg

SEQ ID NO: 189219 - DNA, 20 bp, human
ggcgggacaaccacgagccg

SEQ ID NO: 189220 - DNA, 20 bp, human
gccccggcagcgccaatgtg

SEQ ID NO: 189221 - DNA, 20 bp, human
gagcccccgcgacagtgcca

SEQ ID NO: 189222 - DNA, 20 bp, human
ggctcgtggttgtcccgcca

SEQ ID NO: 189223 - DNA, 20 bp, human
gcccacgaagcgccacacat

SEQ ID NO: 189224 - DNA, 20 bp, human
gaggcgggagaaccgagccg

SEQ ID NO: 189225 - DNA, 20 bp, human
ggagccggcccagcgagcgg

SEQ ID NO: 189226 - DNA, 20 bp, human
gcgaggagccgtaagtaccg

SEQ ID NO: 189227 - DNA, 20 bp, human
ggaagaggcggagaacaata

SEQ ID NO: 189228 - DNA, 20 bp, human
ggctgcggggcggggatcag

SEQ ID NO: 189229 - DNA, 20 bp, human
gtgcagagccccggtactta

SEQ ID NO: 189230 - DNA, 20 bp, human
gcccgcaccgggcagatacc

SEQ ID NO: 189231 - DNA, 20 bp, human
gcggagaacaatatggcgga

SEQ ID NO: 189232 - DNA, 20 bp, human
gaccgggcagataccgggag

SEQ ID NO: 189233 - DNA, 20 bp, human
gtggccccgacgcccgcacc

SEQ ID NO: 189234 - DNA, 20 bp, human
gtctgcagacgcgccgggct

SEQ ID NO: 189235 - DNA, 20 bp, human
gaacaatatggcggatggcg

SEQ ID NO: 189236 - DNA, 20 bp, human
gcgctgggtgcacgtcccca

SEQ ID NO: 189237 - DNA, 20 bp, human
gctccgtgaggtcagaagtg

SEQ ID NO: 189238 - DNA, 20 bp, human
gtggcgggcgtccccatgag

SEQ ID NO: 189239 - DNA, 20 bp, human
gggagacgtgtctgtctgtg

SEQ ID NO: 189240 - DNA, 20 bp, human
gccgcgaggggtacgtgggg

SEQ ID NO: 189241 - DNA, 20 bp, human
gtcgcagaccaagaaaaggg

SEQ ID NO: 189242 - DNA, 20 bp, human
ggggcccgcgaggggtacgt

SEQ ID NO: 189243 - DNA, 20 bp, human
gggcccagccgagcaacgtg

SEQ ID NO: 189244 - DNA, 20 bp, human
ggtccccatgagcgggacgt

SEQ ID NO: 189245 - DNA, 20 bp, human
ggcttgcccgctgaatcccg

SEQ ID NO: 189246 - DNA, 20 bp, human
gttcgcgccgggccgagagc

SEQ ID NO: 189247 - DNA, 20 bp, human
gcgggccgagagcgggttgg

SEQ ID NO: 189248 - DNA, 20 bp, human
ggcgaggcggccgagctggt

SEQ ID NO: 189249 - DNA, 20 bp, human
gcgccgggccgagagcgggt

SEQ ID NO: 189250 - DNA, 20 bp, human
gggcaggctcctctccaaaa

SEQ ID NO: 189251 - DNA, 20 bp, human
gtcacgctggcaggcagagc

SEQ ID NO: 189252 - DNA, 20 bp, human
ggcagcccccaacccgctct

SEQ ID NO: 189253 - DNA, 20 bp, human
gaagcgactgacgcagtgac

SEQ ID NO: 189254 - DNA, 20 bp, human
gttggtggcggcggtcgtgc

SEQ ID NO: 189255 - DNA, 20 bp, human
gtacgtctgtaaggaggagc

SEQ ID NO: 189256 - DNA, 20 bp, human
gtgcccagcaaccccaaccc

SEQ ID NO: 189257 - DNA, 20 bp, human
ggatccccaggtcctaggaa

SEQ ID NO: 189258 - DNA, 20 bp, human
gtcaggtgggatacctgagg

SEQ ID NO: 189259 - DNA, 20 bp, human
gaacatccagaaaggtaccg

SEQ ID NO: 189260 - DNA, 20 bp, human
gacaggactgagactcccct

SEQ ID NO: 189261 - DNA, 20 bp, human
gtggtcaggtgggatacctg

SEQ ID NO: 189262 - DNA, 20 bp, human
ggcagggacccaagatcccc

SEQ ID NO: 189263 - DNA, 20 bp, human
gcagactacaacatccagaa

SEQ ID NO: 189264 - DNA, 20 bp, human
gtttctcaaaaggccaactg

SEQ ID NO: 189265 - DNA, 20 bp, human
ggggagtctcagtcctgtgt

SEQ ID NO: 189266 - DNA, 20 bp, human
ggcctgtggccgcccatcag

SEQ ID NO: 189267 - DNA, 20 bp, human
gccggcggcggtgtctcagg

SEQ ID NO: 189268 - DNA, 20 bp, human
gtgtctcaggcggcaatgga

SEQ ID NO: 189269 - DNA, 20 bp, human
ggacgcctcttccccctgat

SEQ ID NO: 189270 - DNA, 20 bp, human
gtagccggcggcggtgtctc

SEQ ID NO: 189271 - DNA, 20 bp, human
ggcggtgtctcaggcggcaa

SEQ ID NO: 189272 - DNA, 20 bp, human
ggcctcttccccctgatggg

SEQ ID NO: 189273 - DNA, 20 bp, human
ggctactggaaggtaggaag

SEQ ID NO: 189274 - DNA, 20 bp, human
gccgccggctactggaaggt

SEQ ID NO: 189275 - DNA, 20 bp, human
gggagtgggtgtggcgacgt

SEQ ID NO: 189276 - DNA, 20 bp, human
gtaggtggcggtgacagtag

SEQ ID NO: 189277 - DNA, 20 bp, human
gaccaaggccaagcgaataa

SEQ ID NO: 189278 - DNA, 20 bp, human
gccagtgcaaacaggaacca

SEQ ID NO: 189279 - DNA, 20 bp, human
ggctgcagcgctcagagata

SEQ ID NO: 189280 - DNA, 20 bp, human
gccccccaggacacttacct

SEQ ID NO: 189281 - DNA, 20 bp, human
gggctgccagaccaaggtgg

SEQ ID NO: 189282 - DNA, 20 bp, human
ggtggggatcatgcagagtg

SEQ ID NO: 189283 - DNA, 20 bp, human
gcagctgtgaggcccgaggt

SEQ ID NO: 189284 - DNA, 20 bp, human
ggtttgcactggctacagca

SEQ ID NO: 189285 - DNA, 20 bp, human
gagggtctttgtgtaggtgg

SEQ ID NO: 189286 - DNA, 20 bp, human
gctctgtggtgggatccagt

SEQ ID NO: 189287 - DNA, 20 bp, human
ggcagccacaccatccacac

SEQ ID NO: 189288 - DNA, 20 bp, human
gcaccacagagcacatctat

SEQ ID NO: 189289 - DNA, 20 bp, human
gatcccgctcacctacccac

SEQ ID NO: 189290 - DNA, 20 bp, human
gcgggcctggaaactgtcca

SEQ ID NO: 189291 - DNA, 20 bp, human
gcaggcacatcgggcacctg

SEQ ID NO: 189292 - DNA, 20 bp, human
gtccccatagatgtgctctg

SEQ ID NO: 189293 - DNA, 20 bp, human
gatccagtgggtaggtgagc

SEQ ID NO: 189294 - DNA, 20 bp, human
gcatgccgggcccactgtgg

SEQ ID NO: 189295 - DNA, 20 bp, human
gagcagtggcttcagatagt

SEQ ID NO: 189296 - DNA, 20 bp, human
gggcggcggaccccaggtcg

SEQ ID NO: 189297 - DNA, 20 bp, human
gtcactctccgcggcctcag

SEQ ID NO: 189298 - DNA, 20 bp, human
ggacgagcgtccagaggtgt

SEQ ID NO: 189299 - DNA, 20 bp, human
ggggagcgaggcgaccgctg

SEQ ID NO: 189300 - DNA, 20 bp, human
gggctgcagagttaactgag

SEQ ID NO: 189301 - DNA, 20 bp, human
ggggccgccgtcactctccg

SEQ ID NO: 189302 - DNA, 20 bp, human
gaggtgtgggatccgaaagg

SEQ ID NO: 189303 - DNA, 20 bp, human
ggtccgcagtcggaggggtc

SEQ ID NO: 189304 - DNA, 20 bp, human
gggcctgggagctgcggact

SEQ ID NO: 189305 - DNA, 20 bp, human
ggcagccacgcagggaggta

SEQ ID NO: 189306 - DNA, 20 bp, human
gcggtactcacagagcccac

SEQ ID NO: 189307 - DNA, 20 bp, human
gcaccagcaccggctccagt

SEQ ID NO: 189308 - DNA, 20 bp, human
gcctcccccggcgccctctg

SEQ ID NO: 189309 - DNA, 20 bp, human
gccccaagcctaaaagaatg

SEQ ID NO: 189310 - DNA, 20 bp, human
gccggcccacgagaacacca

SEQ ID NO: 189311 - DNA, 20 bp, human
ggcggccccaagagactcct

SEQ ID NO: 189312 - DNA, 20 bp, human
gccgggctcggagccccaga

SEQ ID NO: 189313 - DNA, 20 bp, human
gagcccactggagccggtgc

SEQ ID NO: 189314 - DNA, 20 bp, human
gctcaaagaggtgcctaggg

SEQ ID NO: 189315 - DNA, 20 bp, human
gtcacagagcccactggagc

SEQ ID NO: 189316 - DNA, 20 bp, human
gggagccggctcgctaatgg

SEQ ID NO: 189317 - DNA, 20 bp, human
gcccggcgtccggatcccaa

SEQ ID NO: 189318 - DNA, 20 bp, human
gtaatggtggacgcgtgagg

SEQ ID NO: 189319 - DNA, 20 bp, human
ggccggagccggctcgctaa

SEQ ID NO: 189320 - DNA, 20 bp, human
gcgctaatggtggacgcgtg

SEQ ID NO: 189321 - DNA, 20 bp, human
gtggtggacgcgtgaggcgg

SEQ ID NO: 189322 - DNA, 20 bp, human
ggccgttacccggacaaaag

SEQ ID NO: 189323 - DNA, 20 bp, human
gtgggaaccgggccaccggt

SEQ ID NO: 189324 - DNA, 20 bp, human
ggcggcgtatccccgaccgg

SEQ ID NO: 189325 - DNA, 20 bp, human
gggatcccaagggctcgcgg

SEQ ID NO: 189326 - DNA, 20 bp, human
gggctgccccacgtgcagag

SEQ ID NO: 189327 - DNA, 20 bp, human
gcggctcccctctgcacgtg

SEQ ID NO: 189328 - DNA, 20 bp, human
ggcccgcccggcgaatgttg

SEQ ID NO: 189329 - DNA, 20 bp, human
gccgcgagcgggtcttacgc

SEQ ID NO: 189330 - DNA, 20 bp, human
gctgcacgtggggcagccga

SEQ ID NO: 189331 - DNA, 20 bp, human
gacgtggggcagccgagggt

SEQ ID NO: 189332 - DNA, 20 bp, human
gtggggcagccgagggtcgg

SEQ ID NO: 189333 - DNA, 20 bp, human
gtgttgtggttcgactcccg

SEQ ID NO: 189334 - DNA, 20 bp, human
gtgtcggcccggaaggcgat

SEQ ID NO: 189335 - DNA, 20 bp, human
gaccacaacattcgccgggc

SEQ ID NO: 189336 - DNA, 20 bp, human
gccggagcgggcagagttgg

SEQ ID NO: 189337 - DNA, 20 bp, human
ggagctcccgacagccccta

SEQ ID NO: 189338 - DNA, 20 bp, human
gtgggaactagaggatgtca

SEQ ID NO: 189339 - DNA, 20 bp, human
gtggcgttcgctctccctag

SEQ ID NO: 189340 - DNA, 20 bp, human
ggaggggaccggagttgaag

SEQ ID NO: 189341 - DNA, 20 bp, human
gggcgccggagctaggaggt

SEQ ID NO: 189342 - DNA, 20 bp, human
gggagaagggtcggagtgag

SEQ ID NO: 189343 - DNA, 20 bp, human
gaacatggcggctgcggcac

SEQ ID NO: 189344 - DNA, 20 bp, human
ggactgggaaacgggatggg

SEQ ID NO: 189345 - DNA, 20 bp, human
gcggagttgaaggggcggag

SEQ ID NO: 189346 - DNA, 20 bp, human
ggaagccaggaactactatg

SEQ ID NO: 189347 - DNA, 20 bp, human
gaaaatctgggacaaacagg

SEQ ID NO: 189348 - DNA, 20 bp, human
gactatgtggattcacaaaa

SEQ ID NO: 189349 - DNA, 20 bp, human
gaggtaaagagctcatcata

SEQ ID NO: 189350 - DNA, 20 bp, human
gttcatgtgtggccagatac

SEQ ID NO: 189351 - DNA, 20 bp, human
gtacttaccttgtaattacc

SEQ ID NO: 189352 - DNA, 20 bp, human
gcaaaaaatctgggacaaac

SEQ ID NO: 189353 - DNA, 20 bp, human
gtggccagatacaggaagcc

SEQ ID NO: 189354 - DNA, 20 bp, human
gtatacacgctttgtctgca

SEQ ID NO: 189355 - DNA, 20 bp, human
gtcatatggaaatagcttat

SEQ ID NO: 189356 - DNA, 20 bp, human
gtactggcaggcaccgaggt

SEQ ID NO: 189357 - DNA, 20 bp, human
gtacgggcgtgaaagcggaa

SEQ ID NO: 189358 - DNA, 20 bp, human
gcggggaagctccagtctac

SEQ ID NO: 189359 - DNA, 20 bp, human
gcgctttgtaagaggcacat

SEQ ID NO: 189360 - DNA, 20 bp, human
gaagcacagggcaacgtgag

SEQ ID NO: 189361 - DNA, 20 bp, human
gtcggtgcctgccagtagac

SEQ ID NO: 189362 - DNA, 20 bp, human
gctagctacgggcgtgaaag

SEQ ID NO: 189363 - DNA, 20 bp, human
gattggcaggtaacgagcgg

SEQ ID NO: 189364 - DNA, 20 bp, human
gggcaggtaacgagcggcgg

SEQ ID NO: 189365 - DNA, 20 bp, human
ggacgacgagctgcagttgt

SEQ ID NO: 189366 - DNA, 20 bp, human
gggtaaagttgggagcgcag

SEQ ID NO: 189367 - DNA, 20 bp, human
gaggagactgaggtaaagtt

SEQ ID NO: 189368 - DNA, 20 bp, human
gtgcggctagagcctgagag

SEQ ID NO: 189369 - DNA, 20 bp, human
ggcatggcccccccttccta

SEQ ID NO: 189370 - DNA, 20 bp, human
gctgggccttgcctgaggta

SEQ ID NO: 189371 - DNA, 20 bp, human
ggaagagagagccctacctc

SEQ ID NO: 189372 - DNA, 20 bp, human
ggccagggctcgcatgactc

SEQ ID NO: 189373 - DNA, 20 bp, human
gtggagcagccgtaggaagg

SEQ ID NO: 189374 - DNA, 20 bp, human
ggcgcgagcgagcgaggcct

SEQ ID NO: 189375 - DNA, 20 bp, human
gggcccgcagtgggtggaaa

SEQ ID NO: 189376 - DNA, 20 bp, human
gccaaagcagtgcaccttgc

SEQ ID NO: 189377 - DNA, 20 bp, human
gtactcacgcggtgtgcacc

SEQ ID NO: 189378 - DNA, 20 bp, human
ggagacgcagctctacgcca

SEQ ID NO: 189379 - DNA, 20 bp, human
gggcgagcttcttggcctaa

SEQ ID NO: 189380 - DNA, 20 bp, human
gtcgcctgcacacagaaatg

SEQ ID NO: 189381 - DNA, 20 bp, human
gagcttcttggcctaagggc

SEQ ID NO: 189382 - DNA, 20 bp, human
ggccatctcttcctgccctt

SEQ ID NO: 189383 - DNA, 20 bp, human
gagccaacacaaattgaaca

SEQ ID NO: 189384 - DNA, 20 bp, human
ggctgcaggggtgtagggta

SEQ ID NO: 189385 - DNA, 20 bp, human
ggcaggaagagatggcagcg

SEQ ID NO: 189386 - DNA, 20 bp, human
gggactgctaggcgaggaga

SEQ ID NO: 189387 - DNA, 20 bp, human
gcagcaaagtcaccccccgg

SEQ ID NO: 189388 - DNA, 20 bp, human
gtctggggaaccccatggag

SEQ ID NO: 189389 - DNA, 20 bp, human
gtgttggcggttcctccggg

SEQ ID NO: 189390 - DNA, 20 bp, human
gattcccggactgctaggcg

SEQ ID NO: 189391 - DNA, 20 bp, human
gtactgcaggcgcagagctg

SEQ ID NO: 189392 - DNA, 20 bp, human
gggcaccatcaagcatggat

SEQ ID NO: 189393 - DNA, 20 bp, human
gggaccagcctcagccactc

SEQ ID NO: 189394 - DNA, 20 bp, human
ggtacagcaaagtcaccccc

SEQ ID NO: 189395 - DNA, 20 bp, human
gcacttacgcgcgggctctg

SEQ ID NO: 189396 - DNA, 20 bp, human
ggccagcccggagcatttag

SEQ ID NO: 189397 - DNA, 20 bp, human
gccctgtgggtggacgtggt

SEQ ID NO: 189398 - DNA, 20 bp, human
ggcgcgttgacggaaactaa

SEQ ID NO: 189399 - DNA, 20 bp, human
gagcccggagcatttagggg

SEQ ID NO: 189400 - DNA, 20 bp, human
gaccaaccacgtccacccac

SEQ ID NO: 189401 - DNA, 20 bp, human
gggtggacgtggttggtgat

SEQ ID NO: 189402 - DNA, 20 bp, human
gaggggcggttggctttgtt

SEQ ID NO: 189403 - DNA, 20 bp, human
gacagaatcgccgatcggtt

SEQ ID NO: 189404 - DNA, 20 bp, human
gcacccccccaaggtcgtta

SEQ ID NO: 189405 - DNA, 20 bp, human
gtgggcctttccgggacagt

SEQ ID NO: 189406 - DNA, 20 bp, human
ggtacgggtgcactgcccaa

SEQ ID NO: 189407 - DNA, 20 bp, human
gcgcgcgctcccaaaggtac

SEQ ID NO: 189408 - DNA, 20 bp, human
gcgggacttgggtgactcta

SEQ ID NO: 189409 - DNA, 20 bp, human
gtataaggacgcgccgggtg

SEQ ID NO: 189410 - DNA, 20 bp, human
gagaactgcgacccaaatcc

SEQ ID NO: 189411 - DNA, 20 bp, human
ggcgtccgggcggaaggatc

SEQ ID NO: 189412 - DNA, 20 bp, human
gggggagcgcagcaaaatgg

SEQ ID NO: 189413 - DNA, 20 bp, human
ggcgctgccacgtcagacga

SEQ ID NO: 189414 - DNA, 20 bp, human
gcgtgtggagagaccgccaa

SEQ ID NO: 189415 - DNA, 20 bp, human
gtgggctggggcaccatctg

SEQ ID NO: 189416 - DNA, 20 bp, human
ggagccatctctgcagacaa

SEQ ID NO: 189417 - DNA, 20 bp, human
gtaagttgggatttgataaa

SEQ ID NO: 189418 - DNA, 20 bp, human
gagctactcttagggataaa

SEQ ID NO: 189419 - DNA, 20 bp, human
gatgcactatggagagaacc

SEQ ID NO: 189420 - DNA, 20 bp, human
gggagagatcttagaaacgg

SEQ ID NO: 189421 - DNA, 20 bp, human
gtcctgcctctgtgtaagtt

SEQ ID NO: 189422 - DNA, 20 bp, human
gggcagtactcagggctctg

SEQ ID NO: 189423 - DNA, 20 bp, human
gtgaagagaagctggttatc

SEQ ID NO: 189424 - DNA, 20 bp, human
gggatttgataaaggggatg

SEQ ID NO: 189425 - DNA, 20 bp, human
ggggggctgggcagtactca

SEQ ID NO: 189426 - DNA, 20 bp, human
ggggaggcggaagcacccag

SEQ ID NO: 189427 - DNA, 20 bp, human
gccgaccctcgacttcggag

SEQ ID NO: 189428 - DNA, 20 bp, human
ggaggcagcgcggttcctct

SEQ ID NO: 189429 - DNA, 20 bp, human
ggctgcctctccgaagtcga

SEQ ID NO: 189430 - DNA, 20 bp, human
gggcggtggcgagaaaactg

SEQ ID NO: 189431 - DNA, 20 bp, human
gggtgagtctgcgttcgtgg

SEQ ID NO: 189432 - DNA, 20 bp, human
gaccaccccagtgtagacgg

SEQ ID NO: 189433 - DNA, 20 bp, human
gccgaagtcgagggtcggtc

SEQ ID NO: 189434 - DNA, 20 bp, human
gcgagaacaacataatggtg

SEQ ID NO: 189435 - DNA, 20 bp, human
ggacggagccccgctgactc

SEQ ID NO: 189436 - DNA, 20 bp, human
gggaaccgcgccccgctgaa

SEQ ID NO: 189437 - DNA, 20 bp, human
gcttcgggcgccagaacgag

SEQ ID NO: 189438 - DNA, 20 bp, human
gtagggccgaggctaggacc

SEQ ID NO: 189439 - DNA, 20 bp, human
ggcgggagcttgttcctctc

SEQ ID NO: 189440 - DNA, 20 bp, human
ggcccggaggaggctcatgc

SEQ ID NO: 189441 - DNA, 20 bp, human
gtcccgcatgagcctcctcc

SEQ ID NO: 189442 - DNA, 20 bp, human
gctgcggagcatgtcgaccc

SEQ ID NO: 189443 - DNA, 20 bp, human
ggtcgaccccggcccggagg

SEQ ID NO: 189444 - DNA, 20 bp, human
gctcctcggagaagacggcg

SEQ ID NO: 189445 - DNA, 20 bp, human
gatcgcctgggcgagacgcc

SEQ ID NO: 189446 - DNA, 20 bp, human
gctcccgaaggagaatggga

SEQ ID NO: 189447 - DNA, 20 bp, human
ggaagccatccgggcggcgt

SEQ ID NO: 189448 - DNA, 20 bp, human
ggcggcggcgacgctagtgg

SEQ ID NO: 189449 - DNA, 20 bp, human
gtcgggagagtctcaaagag

SEQ ID NO: 189450 - DNA, 20 bp, human
gttttgggaagccatccggg

SEQ ID NO: 189451 - DNA, 20 bp, human
gggcgacgctagtggcggct

SEQ ID NO: 189452 - DNA, 20 bp, human
ggatctcccgctccaggagg

SEQ ID NO: 189453 - DNA, 20 bp, human
gcgtgacttggccgagacag

SEQ ID NO: 189454 - DNA, 20 bp, human
gcgggcggcggcgacgctag

SEQ ID NO: 189455 - DNA, 20 bp, human
gtcttcatctaggcccacca

SEQ ID NO: 189456 - DNA, 20 bp, human
gcggcgcccggagcgagcca

SEQ ID NO: 189457 - DNA, 20 bp, human
gcaagaggctctctaccctg

SEQ ID NO: 189458 - DNA, 20 bp, human
gagcagggtcaggtcccagg

SEQ ID NO: 189459 - DNA, 20 bp, human
gccactggccgagtcagcgt

SEQ ID NO: 189460 - DNA, 20 bp, human
gccgctccctggctcgctcc

SEQ ID NO: 189461 - DNA, 20 bp, human
gagcgggcatcggacaggtg

SEQ ID NO: 189462 - DNA, 20 bp, human
ggccagggagcggctaaccg

SEQ ID NO: 189463 - DNA, 20 bp, human
gactcgcgctcgggcgcaca

SEQ ID NO: 189464 - DNA, 20 bp, human
gggcggccggaggagcttga

SEQ ID NO: 189465 - DNA, 20 bp, human
gtaccctggggctccgggag

SEQ ID NO: 189466 - DNA, 20 bp, human
gccgcctcggcgatctcggt

SEQ ID NO: 189467 - DNA, 20 bp, human
gcctgctgcaggtggaccga

SEQ ID NO: 189468 - DNA, 20 bp, human
ggcgagcccgacggagacta

SEQ ID NO: 189469 - DNA, 20 bp, human
gcggtcaccgcatcacccgg

SEQ ID NO: 189470 - DNA, 20 bp, human
ggcaccggcagcaagatcca

SEQ ID NO: 189471 - DNA, 20 bp, human
gttctcttcagagccatggt

SEQ ID NO: 189472 - DNA, 20 bp, human
gaggaggcggcgctgatcct

SEQ ID NO: 189473 - DNA, 20 bp, human
gagggcggcggcgaataaag

SEQ ID NO: 189474 - DNA, 20 bp, human
gtgcgcgccggggcctccac

SEQ ID NO: 189475 - DNA, 20 bp, human
gcagcagcgcagccgacctc

SEQ ID NO: 189476 - DNA, 20 bp, human
gcgctataccggcgtcacta

SEQ ID NO: 189477 - DNA, 20 bp, human
gacgagtggcggaaaccctt

SEQ ID NO: 189478 - DNA, 20 bp, human
gcgtgcgcgtgagccccgta

SEQ ID NO: 189479 - DNA, 20 bp, human
gaggcggagtgagtgtacgg

SEQ ID NO: 189480 - DNA, 20 bp, human
ggagtgtacggtggcgtcag

SEQ ID NO: 189481 - DNA, 20 bp, human
ggtgcctccccggccctacg

SEQ ID NO: 189482 - DNA, 20 bp, human
ggagccccgtagggccgggg

SEQ ID NO: 189483 - DNA, 20 bp, human
gggaaggcggagtgagtgta

SEQ ID NO: 189484 - DNA, 20 bp, human
ggtggccggccgggtaagag

SEQ ID NO: 189485 - DNA, 20 bp, human
gcgtcagagcggacatcttg

SEQ ID NO: 189486 - DNA, 20 bp, human
ggtatccagaagggctgggt

SEQ ID NO: 189487 - DNA, 20 bp, human
gccctgtagggtatccagaa

SEQ ID NO: 189488 - DNA, 20 bp, human
ggctgggtgggtatccagaa

SEQ ID NO: 189489 - DNA, 20 bp, human
gccggcgtgcagcttggtgg

SEQ ID NO: 189490 - DNA, 20 bp, human
gacagcgggttccccctgta

SEQ ID NO: 189491 - DNA, 20 bp, human
gctcccggcgtgcagcttgg

SEQ ID NO: 189492 - DNA, 20 bp, human
gtagggtatccagaagggct

SEQ ID NO: 189493 - DNA, 20 bp, human
ggccgctgccgtgaagtgaa

SEQ ID NO: 189494 - DNA, 20 bp, human
gctgcaacggggagactacg

SEQ ID NO: 189495 - DNA, 20 bp, human
gcggatacacctgcctggga

SEQ ID NO: 189496 - DNA, 20 bp, human
gcagacacaaagagaggtac

SEQ ID NO: 189497 - DNA, 20 bp, human
gcccgcccctggggaaaacg

SEQ ID NO: 189498 - DNA, 20 bp, human
gcactcctgtagggggatag

SEQ ID NO: 189499 - DNA, 20 bp, human
gtaacccctccggggcggaa

SEQ ID NO: 189500 - DNA, 20 bp, human
ggcccctcggtggccagtgg

SEQ ID NO: 189501 - DNA, 20 bp, human
gctcctccgtgccgccgcgg

SEQ ID NO: 189502 - DNA, 20 bp, human
gggagccccgttttccccag

SEQ ID NO: 189503 - DNA, 20 bp, human
gtgccccaagagccccccac

SEQ ID NO: 189504 - DNA, 20 bp, human
ggcagcccctatccccctac

SEQ ID NO: 189505 - DNA, 20 bp, human
ggagcccttccgccccggag

SEQ ID NO: 189506 - DNA, 20 bp, human
gttcactttccaggactcag

SEQ ID NO: 189507 - DNA, 20 bp, human
gtagaaagggcgagaaacgg

SEQ ID NO: 189508 - DNA, 20 bp, human
ggagggaactagggcacgag

SEQ ID NO: 189509 - DNA, 20 bp, human
gagggaggacgcccgaggag

SEQ ID NO: 189510 - DNA, 20 bp, human
ggaggacgcccgaggagggg

SEQ ID NO: 189511 - DNA, 20 bp, human
ggacctgcgacgcggagggg

SEQ ID NO: 189512 - DNA, 20 bp, human
gtaagcagagacctgcgacg

SEQ ID NO: 189513 - DNA, 20 bp, human
ggaggacgtcagcgagaggg

SEQ ID NO: 189514 - DNA, 20 bp, human
gaaagtgaagccaccacctc

SEQ ID NO: 189515 - DNA, 20 bp, human
gagagacctgcgacgcggag

SEQ ID NO: 189516 - DNA, 20 bp, human
ggcgcagtcagcaagttccg

SEQ ID NO: 189517 - DNA, 20 bp, human
gcctgtgccagagaaggcgg

SEQ ID NO: 189518 - DNA, 20 bp, human
ggagggaaaaaaagaagccg

SEQ ID NO: 189519 - DNA, 20 bp, human
gggaaaaaaagaagccgagg

SEQ ID NO: 189520 - DNA, 20 bp, human
gcgccttcggaaaaaagcgg

SEQ ID NO: 189521 - DNA, 20 bp, human
ggcggagcctgtgccagaga

SEQ ID NO: 189522 - DNA, 20 bp, human
ggcggccaggacaaagagcg

SEQ ID NO: 189523 - DNA, 20 bp, human
gcgccgcggctcgcggacac

SEQ ID NO: 189524 - DNA, 20 bp, human
gctcgcgcgccgctacggtg

SEQ ID NO: 189525 - DNA, 20 bp, human
ggccaggacaaagagcgcgg

SEQ ID NO: 189526 - DNA, 20 bp, human
gcgcagcagccgcccggacc

SEQ ID NO: 189527 - DNA, 20 bp, human
gacaccatgcccggtccggg

SEQ ID NO: 189528 - DNA, 20 bp, human
gcagccgcaccggctcccgg

SEQ ID NO: 189529 - DNA, 20 bp, human
ggagccggtgcggctgtgag

SEQ ID NO: 189530 - DNA, 20 bp, human
ggccgagcgtggcacagacc

SEQ ID NO: 189531 - DNA, 20 bp, human
gccgccgccgggagccggtg

SEQ ID NO: 189532 - DNA, 20 bp, human
ggcacggtcgctcctcacct

SEQ ID NO: 189533 - DNA, 20 bp, human
gcacctgggctccccgagac

SEQ ID NO: 189534 - DNA, 20 bp, human
gggcagccgatcccgcgagt

SEQ ID NO: 189535 - DNA, 20 bp, human
gcccaacaccatgcccggtc

SEQ ID NO: 189536 - DNA, 20 bp, human
gggaacccgggccccgcgac

SEQ ID NO: 189537 - DNA, 20 bp, human
gtccaagagccgggcgagaa

SEQ ID NO: 189538 - DNA, 20 bp, human
gggctcttggagggcactgg

SEQ ID NO: 189539 - DNA, 20 bp, human
ggaagcgagcggactcgcac

SEQ ID NO: 189540 - DNA, 20 bp, human
gtgcgagggtggggacctcg

SEQ ID NO: 189541 - DNA, 20 bp, human
gactcacgcccggaagggga

SEQ ID NO: 189542 - DNA, 20 bp, human
ggagccgggcgagaacggct

SEQ ID NO: 189543 - DNA, 20 bp, human
gacgtcctacagaacggtgg

SEQ ID NO: 189544 - DNA, 20 bp, human
gggcgggacgcttcccaagt

SEQ ID NO: 189545 - DNA, 20 bp, human
gcagcgactcacgcccggaa

SEQ ID NO: 189546 - DNA, 20 bp, human
gcggctgaggcgaggtcgct

SEQ ID NO: 189547 - DNA, 20 bp, human
gggcgcgctgtccgggtggt

SEQ ID NO: 189548 - DNA, 20 bp, human
ggaagcagtccccggtgtcg

SEQ ID NO: 189549 - DNA, 20 bp, human
gctccgcgggacccacaggg

SEQ ID NO: 189550 - DNA, 20 bp, human
ggtggcccggaagcagtccc

SEQ ID NO: 189551 - DNA, 20 bp, human
gcgcagggcgcggcactccg

SEQ ID NO: 189552 - DNA, 20 bp, human
ggctgttgcggggccatggc

SEQ ID NO: 189553 - DNA, 20 bp, human
ggcactccgcgggacccaca

SEQ ID NO: 189554 - DNA, 20 bp, human
gtgctgctgcggaattagga

SEQ ID NO: 189555 - DNA, 20 bp, human
gccaccgtgagcccccctgt

SEQ ID NO: 189556 - DNA, 20 bp, human
gggcaacacccccgcggtcc

SEQ ID NO: 189557 - DNA, 20 bp, human
gtgacagacgggccgaggaa

SEQ ID NO: 189558 - DNA, 20 bp, human
gcccggactgggagatgaca

SEQ ID NO: 189559 - DNA, 20 bp, human
gtcccagtccgggcaagagg

SEQ ID NO: 189560 - DNA, 20 bp, human
gaggagtcgtccgcttatag

SEQ ID NO: 189561 - DNA, 20 bp, human
gccccgggcccgtgacagac

SEQ ID NO: 189562 - DNA, 20 bp, human
gggcaagaggcggatggaca

SEQ ID NO: 189563 - DNA, 20 bp, human
gtagcagcctccactataag

SEQ ID NO: 189564 - DNA, 20 bp, human
gagtcgtccgcttatagtgg

SEQ ID NO: 189565 - DNA, 20 bp, human
ggagccgccgtaggcactgg

SEQ ID NO: 189566 - DNA, 20 bp, human
gagggaagtcccgagacaaa

SEQ ID NO: 189567 - DNA, 20 bp, human
gggacaggtggaggaccgag

SEQ ID NO: 189568 - DNA, 20 bp, human
ggagcgtagcggacaggtgg

SEQ ID NO: 189569 - DNA, 20 bp, human
gccgggcccaacaggagtag

SEQ ID NO: 189570 - DNA, 20 bp, human
gcgggggtcaaagaccactg

SEQ ID NO: 189571 - DNA, 20 bp, human
gcggcgcttccctttgtctc

SEQ ID NO: 189572 - DNA, 20 bp, human
ggcagccccggcgagcgtag

SEQ ID NO: 189573 - DNA, 20 bp, human
gggcgagcgtagcggacagg

SEQ ID NO: 189574 - DNA, 20 bp, human
ggacgcttcagaggatcctt

SEQ ID NO: 189575 - DNA, 20 bp, human
gcacagggcgctgaactcgc

SEQ ID NO: 189576 - DNA, 20 bp, human
gtgtagcgggtctccatggt

SEQ ID NO: 189577 - DNA, 20 bp, human
gccgagccgcgctgagaccc

SEQ ID NO: 189578 - DNA, 20 bp, human
gcgcgctgagacccgggcag

SEQ ID NO: 189579 - DNA, 20 bp, human
gggcctgcgactacccgagg

SEQ ID NO: 189580 - DNA, 20 bp, human
gcgaggcggcgaccaccccg

SEQ ID NO: 189581 - DNA, 20 bp, human
gccgcctgcccgggaagtac

SEQ ID NO: 189582 - DNA, 20 bp, human
ggccagacgcgaggggaccg

SEQ ID NO: 189583 - DNA, 20 bp, human
ggcctgccaggcactcaggg

SEQ ID NO: 189584 - DNA, 20 bp, human
gctgggcctgcgactacccg

SEQ ID NO: 189585 - DNA, 20 bp, human
gcgcctggtcccgtagagct

SEQ ID NO: 189586 - DNA, 20 bp, human
ggcccgctcgtcccccctgc

SEQ ID NO: 189587 - DNA, 20 bp, human
ggttcggtgggcccaatccc

SEQ ID NO: 189588 - DNA, 20 bp, human
gccgcgagcggccatcttgg

SEQ ID NO: 189589 - DNA, 20 bp, human
gatcgaggctgcccgtcctg

SEQ ID NO: 189590 - DNA, 20 bp, human
gtcccagctgacgggaaacc

SEQ ID NO: 189591 - DNA, 20 bp, human
gctggagtctaacagttcag

SEQ ID NO: 189592 - DNA, 20 bp, human
gcctgcgcggaacccgaggt

SEQ ID NO: 189593 - DNA, 20 bp, human
gctccgggtcagggtcatgt

SEQ ID NO: 189594 - DNA, 20 bp, human
ggcgctgcggcgggttcggt

SEQ ID NO: 189595 - DNA, 20 bp, human
ggcccgccgtaaccgacctc

SEQ ID NO: 189596 - DNA, 20 bp, human
gcggaggtgattccacactg

SEQ ID NO: 189597 - DNA, 20 bp, human
gcgccgcgctcgcctcagtg

SEQ ID NO: 189598 - DNA, 20 bp, human
gcccagagcgctaggatgga

SEQ ID NO: 189599 - DNA, 20 bp, human
gccgcgcccggccaccaaaa

SEQ ID NO: 189600 - DNA, 20 bp, human
gggagacatggccaacatcg

SEQ ID NO: 189601 - DNA, 20 bp, human
gccctcccagagcgctagga

SEQ ID NO: 189602 - DNA, 20 bp, human
gttcctcacaggcagaaggg

SEQ ID NO: 189603 - DNA, 20 bp, human
gcgcggtgcagcgaatcaag

SEQ ID NO: 189604 - DNA, 20 bp, human
gttccacactgaggcgagcg

SEQ ID NO: 189605 - DNA, 20 bp, human
gctcgcgggcgggtggtctg

SEQ ID NO: 189606 - DNA, 20 bp, human
gccggccgcgatgcattctg

SEQ ID NO: 189607 - DNA, 20 bp, human
ggaaccgacgaggccgtgta

SEQ ID NO: 189608 - DNA, 20 bp, human
gcctaggctccggatccccg

SEQ ID NO: 189609 - DNA, 20 bp, human
gggttgggaggctccaaacc

SEQ ID NO: 189610 - DNA, 20 bp, human
ggcgctcgggccttccccga

SEQ ID NO: 189611 - DNA, 20 bp, human
ggaaggtaaaagccattctc

SEQ ID NO: 189612 - DNA, 20 bp, human
gctgaggtcggccccgatcg

SEQ ID NO: 189613 - DNA, 20 bp, human
gggagatcgggatgactgag

SEQ ID NO: 189614 - DNA, 20 bp, human
ggatgactgagtggaggaga

SEQ ID NO: 189615 - DNA, 20 bp, human
ggaggccgcggtccgatctg

SEQ ID NO: 189616 - DNA, 20 bp, human
gcatgtcgggaccgagtgtg

SEQ ID NO: 189617 - DNA, 20 bp, human
gaggccgctgagaactgtca

SEQ ID NO: 189618 - DNA, 20 bp, human
gcaaggcggcagtccgatag

SEQ ID NO: 189619 - DNA, 20 bp, human
ggctccgtgacagttctcag

SEQ ID NO: 189620 - DNA, 20 bp, human
ggcatgctcgccatcatgtc

SEQ ID NO: 189621 - DNA, 20 bp, human
gaccgagtgtgtggcacccg

SEQ ID NO: 189622 - DNA, 20 bp, human
ggccacgggtgccacacact

SEQ ID NO: 189623 - DNA, 20 bp, human
gcgaacgccgggcagcacaa

SEQ ID NO: 189624 - DNA, 20 bp, human
gcggctccggcagcttgctg

SEQ ID NO: 189625 - DNA, 20 bp, human
gggcggcagtccgatagtgg

SEQ ID NO: 189626 - DNA, 20 bp, human
gggcagcagcggctttagcg

SEQ ID NO: 189627 - DNA, 20 bp, human
gcggccaaacggcacggtcg

SEQ ID NO: 189628 - DNA, 20 bp, human
gaagagccaaagcgggcagg

SEQ ID NO: 189629 - DNA, 20 bp, human
ggcggcggaaatatccgaag

SEQ ID NO: 189630 - DNA, 20 bp, human
gcagctgcgggtccgaggag

SEQ ID NO: 189631 - DNA, 20 bp, human
ggggcgggaagagccaaagc

SEQ ID NO: 189632 - DNA, 20 bp, human
gcaggccggagccggactac

SEQ ID NO: 189633 - DNA, 20 bp, human
ggcgctgccgagcgagtccg

SEQ ID NO: 189634 - DNA, 20 bp, human
ggacacggcagctgcggtga

SEQ ID NO: 189635 - DNA, 20 bp, human
ggagcggccccgggcagtgg

SEQ ID NO: 189636 - DNA, 20 bp, human
gacgcacgagtggaagtccc

SEQ ID NO: 189637 - DNA, 20 bp, human
gcctgcccgcgacggtggta

SEQ ID NO: 189638 - DNA, 20 bp, human
gtgcgtgaggcgagaggagc

SEQ ID NO: 189639 - DNA, 20 bp, human
gcacgccccggcggagggtg

SEQ ID NO: 189640 - DNA, 20 bp, human
gcgcggcggcgagggaagtc

SEQ ID NO: 189641 - DNA, 20 bp, human
gggggtggtctcagaagcta

SEQ ID NO: 189642 - DNA, 20 bp, human
ggcgcgcccgcggcctccgg

SEQ ID NO: 189643 - DNA, 20 bp, human
ggtggtctcagaagctatgg

SEQ ID NO: 189644 - DNA, 20 bp, human
gggagtgctgtcccacgccc

SEQ ID NO: 189645 - DNA, 20 bp, human
gcggcaacgtcccccggaag

SEQ ID NO: 189646 - DNA, 20 bp, human
gggccgaactcaggttctga

SEQ ID NO: 189647 - DNA, 20 bp, human
gggccatcagaacctgagtt

SEQ ID NO: 189648 - DNA, 20 bp, human
ggtcattgctggggaatcaa

SEQ ID NO: 189649 - DNA, 20 bp, human
gaacgggcgttgctttcatc

SEQ ID NO: 189650 - DNA, 20 bp, human
gaaataaaagtataaagtac

SEQ ID NO: 189651 - DNA, 20 bp, human
gaagtactggatgagaccag

SEQ ID NO: 189652 - DNA, 20 bp, human
gggctctgccagcaaacgct

SEQ ID NO: 189653 - DNA, 20 bp, human
gtttcatgtggtcattgctg

SEQ ID NO: 189654 - DNA, 20 bp, human
gggtcatgaaacgtacttta

SEQ ID NO: 189655 - DNA, 20 bp, human
gtttccttgatgatcctgtg

SEQ ID NO: 189656 - DNA, 20 bp, human
gtcgcgcagagcagttatgg

SEQ ID NO: 189657 - DNA, 20 bp, human
ggctctgcgcgagtctcggg

SEQ ID NO: 189658 - DNA, 20 bp, human
ggactcgcgcagagcagtta

SEQ ID NO: 189659 - DNA, 20 bp, human
gcggctacgtgcgcgtccag

SEQ ID NO: 189660 - DNA, 20 bp, human
gggcgtcaagcagcatgtga

SEQ ID NO: 189661 - DNA, 20 bp, human
gcgcgtccagtggtacccgg

SEQ ID NO: 189662 - DNA, 20 bp, human
gggctggtgcgcctcatcca

SEQ ID NO: 189663 - DNA, 20 bp, human
ggacgccctccgggtaccac

SEQ ID NO: 189664 - DNA, 20 bp, human
ggcgaggactcggactcgga

SEQ ID NO: 189665 - DNA, 20 bp, human
gactgctctgcgcgagtctc

SEQ ID NO: 189666 - DNA, 20 bp, human
gcaggaagtgcggaccgcgg

SEQ ID NO: 189667 - DNA, 20 bp, human
gtgacaaggggcccccacag

SEQ ID NO: 189668 - DNA, 20 bp, human
ggatcaggaagtgcggaccg

SEQ ID NO: 189669 - DNA, 20 bp, human
ggcgccatcttggcgaaggg

SEQ ID NO: 189670 - DNA, 20 bp, human
gcaggcaccgacccccgtgg

SEQ ID NO: 189671 - DNA, 20 bp, human
gaccgcatctccccccacgg

SEQ ID NO: 189672 - DNA, 20 bp, human
gcggccccgggcccccccct

SEQ ID NO: 189673 - DNA, 20 bp, human
gccacagaggcgcacgcgag

SEQ ID NO: 189674 - DNA, 20 bp, human
gcggaccgcatctcccccca

SEQ ID NO: 189675 - DNA, 20 bp, human
gccccaggcaccgacccccg

SEQ ID NO: 189676 - DNA, 20 bp, human
gccagcagcgctcgacgagg

SEQ ID NO: 189677 - DNA, 20 bp, human
ggggagccggagcctctccg

SEQ ID NO: 189678 - DNA, 20 bp, human
ggtcgagcgctgctggaaaa

SEQ ID NO: 189679 - DNA, 20 bp, human
gcccaggccgccacacgccg

SEQ ID NO: 189680 - DNA, 20 bp, human
gctgctgcggcaccaggaac

SEQ ID NO: 189681 - DNA, 20 bp, human
gtgcagtggagcgtgagtgg

SEQ ID NO: 189682 - DNA, 20 bp, human
gcgctgctggaaaatggcga

SEQ ID NO: 189683 - DNA, 20 bp, human
gtgggatgggcaagtcgcgg

SEQ ID NO: 189684 - DNA, 20 bp, human
ggcctgccccggagaggctc

SEQ ID NO: 189685 - DNA, 20 bp, human
gggcaagtcgcgggggaaag

SEQ ID NO: 189686 - DNA, 20 bp, human
gcgcagccggcggctcatga

SEQ ID NO: 189687 - DNA, 20 bp, human
gggcgctgcagacccgatct

SEQ ID NO: 189688 - DNA, 20 bp, human
gggagatgaagcggtcgcta

SEQ ID NO: 189689 - DNA, 20 bp, human
gcacgcaggtgcgcagccgg

SEQ ID NO: 189690 - DNA, 20 bp, human
gcagctccacggagatgaag

SEQ ID NO: 189691 - DNA, 20 bp, human
gcggcgctggccctcaccac

SEQ ID NO: 189692 - DNA, 20 bp, human
gtggtccagcgcctacaccg

SEQ ID NO: 189693 - DNA, 20 bp, human
gccttacctggcccttgacc

SEQ ID NO: 189694 - DNA, 20 bp, human
ggagcagggagcgagatggc

SEQ ID NO: 189695 - DNA, 20 bp, human
gcgctggtgtagtcagagca

SEQ ID NO: 189696 - DNA, 20 bp, human
gtcgggccgggcgagaggag

SEQ ID NO: 189697 - DNA, 20 bp, human
gggcccgagtgtgaggagaa

SEQ ID NO: 189698 - DNA, 20 bp, human
gggcccttctcctcacactc

SEQ ID NO: 189699 - DNA, 20 bp, human
gctcgcccggcccgagtgtg

SEQ ID NO: 189700 - DNA, 20 bp, human
ggccgggtgtgtgaagaccg

SEQ ID NO: 189701 - DNA, 20 bp, human
gctcggctccgttgctcccg

SEQ ID NO: 189702 - DNA, 20 bp, human
gtgatccggaagccctccac

SEQ ID NO: 189703 - DNA, 20 bp, human
ggggcgagaggagaggtcga

SEQ ID NO: 189704 - DNA, 20 bp, human
ggcctgcgtcgtgtgtgagg

SEQ ID NO: 189705 - DNA, 20 bp, human
gcgcggaagcagggtccggg

SEQ ID NO: 189706 - DNA, 20 bp, human
ggtagaccaacccgccgccc

SEQ ID NO: 189707 - DNA, 20 bp, human
gtgctcctggtaacacccat

SEQ ID NO: 189708 - DNA, 20 bp, human
gcgctttgcggcccgcccat

SEQ ID NO: 189709 - DNA, 20 bp, human
gtcgccgccagggagactgc

SEQ ID NO: 189710 - DNA, 20 bp, human
gcctgcgggcggttataaag

SEQ ID NO: 189711 - DNA, 20 bp, human
ggggttctcaaagaacggag

SEQ ID NO: 189712 - DNA, 20 bp, human
gagtctcaggggcctccgac

SEQ ID NO: 189713 - DNA, 20 bp, human
gcgactaacggtcttcctgg

SEQ ID NO: 189714 - DNA, 20 bp, human
gcgggcgcgccctgacgctg

SEQ ID NO: 189715 - DNA, 20 bp, human
gattcaaacggtccaatcag

SEQ ID NO: 189716 - DNA, 20 bp, human
gcaacagtcagaggtcgcgc

SEQ ID NO: 189717 - DNA, 20 bp, human
gagcaacgcgcggaccaacg

SEQ ID NO: 189718 - DNA, 20 bp, human
ggagaccctccgctcaacag

SEQ ID NO: 189719 - DNA, 20 bp, human
gcgcgttgctgcgttgtgag

SEQ ID NO: 189720 - DNA, 20 bp, human
ggtaagcaaggagagtattc

SEQ ID NO: 189721 - DNA, 20 bp, human
ggtgtaccttctttcagatg

SEQ ID NO: 189722 - DNA, 20 bp, human
gtctaaggctctcctttcag

SEQ ID NO: 189723 - DNA, 20 bp, human
gaaggtcactgagtcttggg

SEQ ID NO: 189724 - DNA, 20 bp, human
gtgtggcaggaggacggctc

SEQ ID NO: 189725 - DNA, 20 bp, human
gcttgctgcgggttgtgcac

SEQ ID NO: 189726 - DNA, 20 bp, human
gcaaccccgcagccacgcac

SEQ ID NO: 189727 - DNA, 20 bp, human
gtgccgtgcatgataggcag

SEQ ID NO: 189728 - DNA, 20 bp, human
ggagaggtgtacgcctatca

SEQ ID NO: 189729 - DNA, 20 bp, human
gccccgcagccacgcaccgg

SEQ ID NO: 189730 - DNA, 20 bp, human
gctccgctgcctatcatgca

SEQ ID NO: 189731 - DNA, 20 bp, human
gaagctctgccgtgcatgat

SEQ ID NO: 189732 - DNA, 20 bp, human
gggagacaagcccatgtcgt

SEQ ID NO: 189733 - DNA, 20 bp, human
gcgcctatcagggtcctagc

SEQ ID NO: 189734 - DNA, 20 bp, human
gatgtcgtcggcgcgtgagt

SEQ ID NO: 189735 - DNA, 20 bp, human
gcaggttgtcttcgcttcac

SEQ ID NO: 189736 - DNA, 20 bp, human
gcgctcacccgagcccgtgg

SEQ ID NO: 189737 - DNA, 20 bp, human
gtagaggaggcgccccacag

SEQ ID NO: 189738 - DNA, 20 bp, human
gtctagaggtcccctagagg

SEQ ID NO: 189739 - DNA, 20 bp, human
gcgatctagaggtcccctag

SEQ ID NO: 189740 - DNA, 20 bp, human
gcggatggaagtcccatact

SEQ ID NO: 189741 - DNA, 20 bp, human
gcacccctggcacccagtat

SEQ ID NO: 189742 - DNA, 20 bp, human
gggcactcctgaggataccg

SEQ ID NO: 189743 - DNA, 20 bp, human
ggtcccatactgggtgccag

SEQ ID NO: 189744 - DNA, 20 bp, human
gaggcggtggccggaagcac

SEQ ID NO: 189745 - DNA, 20 bp, human
gaccggcgcggcctgaccgg

SEQ ID NO: 189746 - DNA, 20 bp, human
gcggcccgggaaccgacctg

SEQ ID NO: 189747 - DNA, 20 bp, human
gaggcgaggaggcccaaggt

SEQ ID NO: 189748 - DNA, 20 bp, human
ggatggcggtctccacaggt

SEQ ID NO: 189749 - DNA, 20 bp, human
gaaatcacgcagcccggccc

SEQ ID NO: 189750 - DNA, 20 bp, human
ggccaaccggcaccgaagat

SEQ ID NO: 189751 - DNA, 20 bp, human
gggctgaaggctctacggga

SEQ ID NO: 189752 - DNA, 20 bp, human
gggcgccagcagcagacgga

SEQ ID NO: 189753 - DNA, 20 bp, human
gcggaggggcagagccgggt

SEQ ID NO: 189754 - DNA, 20 bp, human
ggcgtagcctgggaccgggt

SEQ ID NO: 189755 - DNA, 20 bp, human
ggcacgacccgccaacccga

SEQ ID NO: 189756 - DNA, 20 bp, human
gccgcgattcggggacaccc

SEQ ID NO: 189757 - DNA, 20 bp, human
gtggcgtcaatgcaggtgag

SEQ ID NO: 189758 - DNA, 20 bp, human
gctgccccggcaacaaccgc

SEQ ID NO: 189759 - DNA, 20 bp, human
ggcgaggccagagacgcagg

SEQ ID NO: 189760 - DNA, 20 bp, human
gccgaacgctggcactctct

SEQ ID NO: 189761 - DNA, 20 bp, human
gcctcagctcagggcgtcgg

SEQ ID NO: 189762 - DNA, 20 bp, human
gaacgctggcactctctcgg

SEQ ID NO: 189763 - DNA, 20 bp, human
ggcgttggcggtctcagaat

SEQ ID NO: 189764 - DNA, 20 bp, human
ggggggtaaaggcaaccctg

SEQ ID NO: 189765 - DNA, 20 bp, human
gggaaccatccccccaagac

SEQ ID NO: 189766 - DNA, 20 bp, human
ggagcagcggccgctctggt

SEQ ID NO: 189767 - DNA, 20 bp, human
ggcacgtccgccgaccagag

SEQ ID NO: 189768 - DNA, 20 bp, human
gcttcgcttccgggactact

SEQ ID NO: 189769 - DNA, 20 bp, human
gggaagcgaagcagcgatgg

SEQ ID NO: 189770 - DNA, 20 bp, human
gacgtgctgccgagtagtcc

SEQ ID NO: 189771 - DNA, 20 bp, human
ggcggagagtccgactgagg

SEQ ID NO: 189772 - DNA, 20 bp, human
ggagagtccgactgaggagg

SEQ ID NO: 189773 - DNA, 20 bp, human
gcgcgccgcagtgtctactc

SEQ ID NO: 189774 - DNA, 20 bp, human
gtcgcggcggcccacctcca

SEQ ID NO: 189775 - DNA, 20 bp, human
gtcggtggtgcgggagcggg

SEQ ID NO: 189776 - DNA, 20 bp, human
gggccgcggcgcaagacggg

SEQ ID NO: 189777 - DNA, 20 bp, human
gcggcgcaagacgggaggac

SEQ ID NO: 189778 - DNA, 20 bp, human
gggtcccgcatgagccccgg

SEQ ID NO: 189779 - DNA, 20 bp, human
gctgggcgggccgagtatcc

SEQ ID NO: 189780 - DNA, 20 bp, human
gctgggctcggggtgactac

SEQ ID NO: 189781 - DNA, 20 bp, human
gcaggccgcgagctattccg

SEQ ID NO: 189782 - DNA, 20 bp, human
ggtgactacaggagacgacg

SEQ ID NO: 189783 - DNA, 20 bp, human
gagggcgactacgaccagtg

SEQ ID NO: 189784 - DNA, 20 bp, human
ggcagaggtgaagcgtaagt

SEQ ID NO: 189785 - DNA, 20 bp, human
ggctgcctgtccacaccggg

SEQ ID NO: 189786 - DNA, 20 bp, human
gcccgggtctggcagaactc

SEQ ID NO: 189787 - DNA, 20 bp, human
ggtcagtcctccgagtggtg

SEQ ID NO: 189788 - DNA, 20 bp, human
ggttctgaaagcgaacaccg

SEQ ID NO: 189789 - DNA, 20 bp, human
gtgatgccgaggaaagactc

SEQ ID NO: 189790 - DNA, 20 bp, human
gcaagatggcggtagtgcgt

SEQ ID NO: 189791 - DNA, 20 bp, human
gcgaacaccgcggggcaaga

SEQ ID NO: 189792 - DNA, 20 bp, human
gccccagccccaccactcgg

SEQ ID NO: 189793 - DNA, 20 bp, human
gcctcggcatcaacaaccac

SEQ ID NO: 189794 - DNA, 20 bp, human
gccagtttaggtgagtcctg

SEQ ID NO: 189795 - DNA, 20 bp, human
gcccctaggcgcacaacgga

SEQ ID NO: 189796 - DNA, 20 bp, human
gcacagctcgggccgctgca

SEQ ID NO: 189797 - DNA, 20 bp, human
gagggccgcgcacgcactga

SEQ ID NO: 189798 - DNA, 20 bp, human
ggccatcttccctcccgagg

SEQ ID NO: 189799 - DNA, 20 bp, human
gtggaactgccgcctcggga

SEQ ID NO: 189800 - DNA, 20 bp, human
gcgccgccaagggacacctt

SEQ ID NO: 189801 - DNA, 20 bp, human
gcacctggaactgccgcctc

SEQ ID NO: 189802 - DNA, 20 bp, human
gcggcgcgagcaggaaggtg

SEQ ID NO: 189803 - DNA, 20 bp, human
ggcaggaggccggtgaaccc

SEQ ID NO: 189804 - DNA, 20 bp, human
gcgcggcccaaggtgtccct

SEQ ID NO: 189805 - DNA, 20 bp, human
gggacaggcaaggcccccac

SEQ ID NO: 189806 - DNA, 20 bp, human
gccgctggttggtccgcacg

SEQ ID NO: 189807 - DNA, 20 bp, human
gtcgctttactgctgcccgg

SEQ ID NO: 189808 - DNA, 20 bp, human
gccaagctggaggttccgag

SEQ ID NO: 189809 - DNA, 20 bp, human
gccagaccggaccaagctgg

SEQ ID NO: 189810 - DNA, 20 bp, human
gggcccgggtcaacaggacc

SEQ ID NO: 189811 - DNA, 20 bp, human
gccaggagaggttccacgtg

SEQ ID NO: 189812 - DNA, 20 bp, human
gccacccctactgacagtgt

SEQ ID NO: 189813 - DNA, 20 bp, human
gcggaacctccagcttggtc

SEQ ID NO: 189814 - DNA, 20 bp, human
gtccgccgcagaagccgcca

SEQ ID NO: 189815 - DNA, 20 bp, human
ggtggcggagccgactacag

SEQ ID NO: 189816 - DNA, 20 bp, human
gacagggtcgaagttcaaga

SEQ ID NO: 189817 - DNA, 20 bp, human
gcttcaggctctggtaagac

SEQ ID NO: 189818 - DNA, 20 bp, human
gcgacacgacagaatctcag

SEQ ID NO: 189819 - DNA, 20 bp, human
ggtcggaagtgggaaccctt

SEQ ID NO: 189820 - DNA, 20 bp, human
gcagaatctcagcggccgaa

SEQ ID NO: 189821 - DNA, 20 bp, human
ggctgtgctgagtcggaagt

SEQ ID NO: 189822 - DNA, 20 bp, human
gagacaggcaatagcttcag

SEQ ID NO: 189823 - DNA, 20 bp, human
gtccctggttagcaaagcat

SEQ ID NO: 189824 - DNA, 20 bp, human
gtcgtcgctgctggcacttc

SEQ ID NO: 189825 - DNA, 20 bp, human
gtaaagagtagataacaaat

SEQ ID NO: 189826 - DNA, 20 bp, human
gggcgagggggaaagagtag

SEQ ID NO: 189827 - DNA, 20 bp, human
gctgcagagtggataccccg

SEQ ID NO: 189828 - DNA, 20 bp, human
gctgctacagggttgtctta

SEQ ID NO: 189829 - DNA, 20 bp, human
ggagtggataccccgaggta

SEQ ID NO: 189830 - DNA, 20 bp, human
gcgccactgctgctgctaca

SEQ ID NO: 189831 - DNA, 20 bp, human
gggcagagcccagcactgta

SEQ ID NO: 189832 - DNA, 20 bp, human
gaatacttggtggggcgagg

SEQ ID NO: 189833 - DNA, 20 bp, human
gaaccctgtagcagcagcag

SEQ ID NO: 189834 - DNA, 20 bp, human
gcagcagcagtggcggccaa

SEQ ID NO: 189835 - DNA, 20 bp, human
gattattcatcaaaacaaca

SEQ ID NO: 189836 - DNA, 20 bp, human
gcggcctctgcgggagcggt

SEQ ID NO: 189837 - DNA, 20 bp, human
gcccgccgcactcaccatcc

SEQ ID NO: 189838 - DNA, 20 bp, human
ggccgggccgcatcccccag

SEQ ID NO: 189839 - DNA, 20 bp, human
gctgggctgcggggtcccca

SEQ ID NO: 189840 - DNA, 20 bp, human
gggcccgggagggagaaccg

SEQ ID NO: 189841 - DNA, 20 bp, human
gttgcaggcatggaggaacc

SEQ ID NO: 189842 - DNA, 20 bp, human
ggacacggaggccgagactg

SEQ ID NO: 189843 - DNA, 20 bp, human
gtgcctgcaagggggttagg

SEQ ID NO: 189844 - DNA, 20 bp, human
gacacccaccgctcccgcag

SEQ ID NO: 189845 - DNA, 20 bp, human
ggcgaccgcaacctcagccc

SEQ ID NO: 189846 - DNA, 20 bp, human
gtctggcggcctaaagaagg

SEQ ID NO: 189847 - DNA, 20 bp, human
gcagaggccggcgcacaaga

SEQ ID NO: 189848 - DNA, 20 bp, human
gggcctcagggccaacacgt

SEQ ID NO: 189849 - DNA, 20 bp, human
gggctctggcggcctaaaga

SEQ ID NO: 189850 - DNA, 20 bp, human
gctgcctccaggagcgctgg

SEQ ID NO: 189851 - DNA, 20 bp, human
gagccccgcgttagagccca

SEQ ID NO: 189852 - DNA, 20 bp, human
gccgtgggatctgtaggcaa

SEQ ID NO: 189853 - DNA, 20 bp, human
gggagagactgtcaaagctg

SEQ ID NO: 189854 - DNA, 20 bp, human
ggtgtggcggcaaggtccgg

SEQ ID NO: 189855 - DNA, 20 bp, human
gtttccgggcgggcctccag

SEQ ID NO: 189856 - DNA, 20 bp, human
ggaccccagctgctgtccgg

SEQ ID NO: 189857 - DNA, 20 bp, human
gcgcctccggacagcagctg

SEQ ID NO: 189858 - DNA, 20 bp, human
gagtgcgactaagggaaacg

SEQ ID NO: 189859 - DNA, 20 bp, human
ggaccgagccgagtgacaca

SEQ ID NO: 189860 - DNA, 20 bp, human
ggcctctcaaaccaacatgg

SEQ ID NO: 189861 - DNA, 20 bp, human
ggctgcctgagtgcgactaa

SEQ ID NO: 189862 - DNA, 20 bp, human
gcgcgcgggcgctccgacag

SEQ ID NO: 189863 - DNA, 20 bp, human
ggccgagtgacacacggaca

SEQ ID NO: 189864 - DNA, 20 bp, human
gtgacacacggacatggaga

SEQ ID NO: 189865 - DNA, 20 bp, human
gaggcagaagaggagtggcg

SEQ ID NO: 189866 - DNA, 20 bp, human
gcgacggcgtccactcgggc

SEQ ID NO: 189867 - DNA, 20 bp, human
gccctcgggggcggacgcgt

SEQ ID NO: 189868 - DNA, 20 bp, human
ggccatgcagctgacggtga

SEQ ID NO: 189869 - DNA, 20 bp, human
gccgggcgtctcctctccct

SEQ ID NO: 189870 - DNA, 20 bp, human
ggcgaccgccatgcagctga

SEQ ID NO: 189871 - DNA, 20 bp, human
gcgccacatgaccccaaggg

SEQ ID NO: 189872 - DNA, 20 bp, human
gcgtcccagtgcgccagcag

SEQ ID NO: 189873 - DNA, 20 bp, human
gcgcaccccgacccgacaca

SEQ ID NO: 189874 - DNA, 20 bp, human
gagctgcatggcggtcgcga

SEQ ID NO: 189875 - DNA, 20 bp, human
ggtcgcgacggcgtccactc

SEQ ID NO: 189876 - DNA, 20 bp, human
gcaggaccccctaatcttca

SEQ ID NO: 189877 - DNA, 20 bp, human
ggagctgccctgaagattag

SEQ ID NO: 189878 - DNA, 20 bp, human
gggggtcctgcgggagatgt

SEQ ID NO: 189879 - DNA, 20 bp, human
gcgggctgagtggaatcagg

SEQ ID NO: 189880 - DNA, 20 bp, human
gtgaggaacatcgggctgag

SEQ ID NO: 189881 - DNA, 20 bp, human
gtcaggagggatccatgctc

SEQ ID NO: 189882 - DNA, 20 bp, human
gctgctaaggcaggagcacg

SEQ ID NO: 189883 - DNA, 20 bp, human
gcccaatgcagtagtcagag

SEQ ID NO: 189884 - DNA, 20 bp, human
gctggcagaggagcctcacg

SEQ ID NO: 189885 - DNA, 20 bp, human
ggcccagtacctcctggcag

SEQ ID NO: 189886 - DNA, 20 bp, human
gtggagctacacaaagcggg

SEQ ID NO: 189887 - DNA, 20 bp, human
ggcaggttcgaggcgattcg

SEQ ID NO: 189888 - DNA, 20 bp, human
gggtgaggagctggtggcgt

SEQ ID NO: 189889 - DNA, 20 bp, human
gcccagggccgcgaaccccg

SEQ ID NO: 189890 - DNA, 20 bp, human
gtagctggagctacacaaag

SEQ ID NO: 189891 - DNA, 20 bp, human
gcgcagttaacgctaggaac

SEQ ID NO: 189892 - DNA, 20 bp, human
gggacaccgaaaccgtacct

SEQ ID NO: 189893 - DNA, 20 bp, human
gtaacgctaggaaccggaag

SEQ ID NO: 189894 - DNA, 20 bp, human
ggctacacaaagcggggggt

SEQ ID NO: 189895 - DNA, 20 bp, human
gaggcgcgccgggtagagag

SEQ ID NO: 189896 - DNA, 20 bp, human
gtccttccgcgggacgggtg

SEQ ID NO: 189897 - DNA, 20 bp, human
gtcctcacaacggttcccta

SEQ ID NO: 189898 - DNA, 20 bp, human
gccgtcccgcggaaggaacc

SEQ ID NO: 189899 - DNA, 20 bp, human
gtgcggccgggttccttccg

SEQ ID NO: 189900 - DNA, 20 bp, human
gccagagtgagtgtttacac

SEQ ID NO: 189901 - DNA, 20 bp, human
gagcgccctcacccgtcccg

SEQ ID NO: 189902 - DNA, 20 bp, human
gccctcacccgtcccgcgga

SEQ ID NO: 189903 - DNA, 20 bp, human
gaaatcagaaactctgacgg

SEQ ID NO: 189904 - DNA, 20 bp, human
ggagacctctgatagagaag

SEQ ID NO: 189905 - DNA, 20 bp, human
ggtttacaccggcggcagtg

SEQ ID NO: 189906 - DNA, 20 bp, human
gagggtctggaacagactcc

SEQ ID NO: 189907 - DNA, 20 bp, human
gagactcaccaatcagctca

SEQ ID NO: 189908 - DNA, 20 bp, human
gcaccaatcagctcagggtc

SEQ ID NO: 189909 - DNA, 20 bp, human
gactgggagaatactcgcta

SEQ ID NO: 189910 - DNA, 20 bp, human
gggtagttcagtataataca

SEQ ID NO: 189911 - DNA, 20 bp, human
gttccagaccctgagctgat

SEQ ID NO: 189912 - DNA, 20 bp, human
gggtgagtctctctggactg

SEQ ID NO: 189913 - DNA, 20 bp, human
ggctgattggtgagtctctc

SEQ ID NO: 189914 - DNA, 20 bp, human
ggtataatacatggctgaaa

SEQ ID NO: 189915 - DNA, 20 bp, human
gactccagggaagtgaatgt

SEQ ID NO: 189916 - DNA, 20 bp, human
ggcggtggaacctgcggcag

SEQ ID NO: 189917 - DNA, 20 bp, human
ggccccaacagcgtctccaa

SEQ ID NO: 189918 - DNA, 20 bp, human
ggacttaggggagcattagg

SEQ ID NO: 189919 - DNA, 20 bp, human
gcggcagcggacgcagaaac

SEQ ID NO: 189920 - DNA, 20 bp, human
gtccaccgcgctccaggtga

SEQ ID NO: 189921 - DNA, 20 bp, human
ggtcgctttcggtctctcag

SEQ ID NO: 189922 - DNA, 20 bp, human
gggctgtgctaactgactta

SEQ ID NO: 189923 - DNA, 20 bp, human
gaccagcaacaactgcgagg

SEQ ID NO: 189924 - DNA, 20 bp, human
gagcgaccggaagtgaaggg

SEQ ID NO: 189925 - DNA, 20 bp, human
gggctagactgctggatggg

SEQ ID NO: 189926 - DNA, 20 bp, human
ggtcacgagccgaagggagg

SEQ ID NO: 189927 - DNA, 20 bp, human
ggccggagcgcagagactcc

SEQ ID NO: 189928 - DNA, 20 bp, human
gaagcgcccgcggtctgagg

SEQ ID NO: 189929 - DNA, 20 bp, human
ggttgtcacgagccgaaggg

SEQ ID NO: 189930 - DNA, 20 bp, human
ggccgcgccgagctccgtca

SEQ ID NO: 189931 - DNA, 20 bp, human
ggcgctccaaagaacacggg

SEQ ID NO: 189932 - DNA, 20 bp, human
gttcgttgtcacgagccgaa

SEQ ID NO: 189933 - DNA, 20 bp, human
gcgagccgaagggaggggga

SEQ ID NO: 189934 - DNA, 20 bp, human
gccgccgccgcctcagaccg

SEQ ID NO: 189935 - DNA, 20 bp, human
gtccgaaagcggccgtcggg

SEQ ID NO: 189936 - DNA, 20 bp, human
ggcggcgaccctggcgatgg

SEQ ID NO: 189937 - DNA, 20 bp, human
gggcttcaccgccatcgcca

SEQ ID NO: 189938 - DNA, 20 bp, human
gtgtgggggatccaacatgg

SEQ ID NO: 189939 - DNA, 20 bp, human
gggatccaacatggcggccg

SEQ ID NO: 189940 - DNA, 20 bp, human
ggctcccgctgcagcgacat

SEQ ID NO: 189941 - DNA, 20 bp, human
ggccgcggcgaccctggcga

SEQ ID NO: 189942 - DNA, 20 bp, human
gttatgtgggggatccaaca

SEQ ID NO: 189943 - DNA, 20 bp, human
gatggcggccgcggcgaccc

SEQ ID NO: 189944 - DNA, 20 bp, human
ggggctgcgcgtccgagcgg

SEQ ID NO: 189945 - DNA, 20 bp, human
ggcgccggctcgagcaaaag

SEQ ID NO: 189946 - DNA, 20 bp, human
ggcggcggcgacacagatac

SEQ ID NO: 189947 - DNA, 20 bp, human
gtgaggctcggagtcgccgg

SEQ ID NO: 189948 - DNA, 20 bp, human
ggcgccgcaacaccaaaccg

SEQ ID NO: 189949 - DNA, 20 bp, human
ggggcagttggccggaagtg

SEQ ID NO: 189950 - DNA, 20 bp, human
gggccggccgggaggacagg

SEQ ID NO: 189951 - DNA, 20 bp, human
gctgtgaggctcggagtcgc

SEQ ID NO: 189952 - DNA, 20 bp, human
gaaaccggggacgccgcggg

SEQ ID NO: 189953 - DNA, 20 bp, human
gacctgatcctcccgaaggt

SEQ ID NO: 189954 - DNA, 20 bp, human
ggcgcagcaggcggaagtag

SEQ ID NO: 189955 - DNA, 20 bp, human
gccaggcctgcgagaggcac

SEQ ID NO: 189956 - DNA, 20 bp, human
gggcggcgagtggtcaccag

SEQ ID NO: 189957 - DNA, 20 bp, human
ggcgggtgaagcctccggag

SEQ ID NO: 189958 - DNA, 20 bp, human
gagagctgcgggggccccac

SEQ ID NO: 189959 - DNA, 20 bp, human
ggcggcgcgtgaacctaagt

SEQ ID NO: 189960 - DNA, 20 bp, human
gggcgagtggtcaccagcgg

SEQ ID NO: 189961 - DNA, 20 bp, human
ggttgaagccagcgtccggc

SEQ ID NO: 189962 - DNA, 20 bp, human
ggcccccgcagctctcgtcc

SEQ ID NO: 189963 - DNA, 20 bp, human
ggcggccgggacgagagctg

SEQ ID NO: 189964 - DNA, 20 bp, human
gctcccagcggtcccggagg

SEQ ID NO: 189965 - DNA, 20 bp, human
ggcccagcgagcaattgcag

SEQ ID NO: 189966 - DNA, 20 bp, human
ggctggacggagctattctc

SEQ ID NO: 189967 - DNA, 20 bp, human
gcgccggcgaagggacgtgg

SEQ ID NO: 189968 - DNA, 20 bp, human
gcgagcggcgcctgaacaca

SEQ ID NO: 189969 - DNA, 20 bp, human
gaagaccccgaaggaaaagg

SEQ ID NO: 189970 - DNA, 20 bp, human
ggtcaccgtgaagaccccga

SEQ ID NO: 189971 - DNA, 20 bp, human
gtagctccgtccagcaggtg

SEQ ID NO: 189972 - DNA, 20 bp, human
gcagcaggtgaggccgcctg

SEQ ID NO: 189973 - DNA, 20 bp, human
ggctccggcggcgctatcct

SEQ ID NO: 189974 - DNA, 20 bp, human
gggtcggcggataccagaga

SEQ ID NO: 189975 - DNA, 20 bp, human
gggcggcctcacctgctgga

SEQ ID NO: 189976 - DNA, 20 bp, human
gtgctgggagtgcgcgcggt

SEQ ID NO: 189977 - DNA, 20 bp, human
ggcgcggtcggatcacaagg

SEQ ID NO: 189978 - DNA, 20 bp, human
gcggtcggatcacaaggcgg

SEQ ID NO: 189979 - DNA, 20 bp, human
gtgcgcgcggtcggatcaca

SEQ ID NO: 189980 - DNA, 20 bp, human
ggctgaaccgagctgttctc

SEQ ID NO: 189981 - DNA, 20 bp, human
gtggagaaaggcctgggcgt

SEQ ID NO: 189982 - DNA, 20 bp, human
gtcggatcacaaggcggcgg

SEQ ID NO: 189983 - DNA, 20 bp, human
gtctccgcgctccggtctct

SEQ ID NO: 189984 - DNA, 20 bp, human
gcggggatcagcaggcggag

SEQ ID NO: 189985 - DNA, 20 bp, human
ggcggtgcccgagaacagct

SEQ ID NO: 189986 - DNA, 20 bp, human
gtggctgtgtagcaagatga

SEQ ID NO: 189987 - DNA, 20 bp, human
ggcaggaggcccagatctgt

SEQ ID NO: 189988 - DNA, 20 bp, human
gtctggcccagaaggcctca

SEQ ID NO: 189989 - DNA, 20 bp, human
gtgctacacagccacccctg

SEQ ID NO: 189990 - DNA, 20 bp, human
gtgaggtggggatcctggac

SEQ ID NO: 189991 - DNA, 20 bp, human
gcctgcataaagagaaggac

SEQ ID NO: 189992 - DNA, 20 bp, human
ggctgtgtccccacagatct

SEQ ID NO: 189993 - DNA, 20 bp, human
gctgtcaccttgatgaggtg

SEQ ID NO: 189994 - DNA, 20 bp, human
gtctccacctttggccatgg

SEQ ID NO: 189995 - DNA, 20 bp, human
ggtgaagacgcccaaagaca

SEQ ID NO: 189996 - DNA, 20 bp, human
ggagcgtggcgcgtgttgag

SEQ ID NO: 189997 - DNA, 20 bp, human
gccctgcgaggggagatctg

SEQ ID NO: 189998 - DNA, 20 bp, human
ggggtctgcgaagagatggg

SEQ ID NO: 189999 - DNA, 20 bp, human
ggatcgagcctcggtcaagg

SEQ ID NO: 190000 - DNA, 20 bp, human
ggaaggaccctgggtttgag

SEQ ID NO: 190001 - DNA, 20 bp, human
gaggcaaggagaggcgggta

SEQ ID NO: 190002 - DNA, 20 bp, human
gacaccttgcaccgggaagg

SEQ ID NO: 190003 - DNA, 20 bp, human
ggaggtagtacagcaggcgg

SEQ ID NO: 190004 - DNA, 20 bp, human
gggacgccggaccgtcagag

SEQ ID NO: 190005 - DNA, 20 bp, human
gttgtggcctgggggcgtgg

SEQ ID NO: 190006 - DNA, 20 bp, human
gagctgatgacatctcggta

SEQ ID NO: 190007 - DNA, 20 bp, human
ggggatgagtgaccagactg

SEQ ID NO: 190008 - DNA, 20 bp, human
ggctggggcagaaagggtga

SEQ ID NO: 190009 - DNA, 20 bp, human
ggggccacatctggagaact

SEQ ID NO: 190010 - DNA, 20 bp, human
gcagcactagttggtccatc

SEQ ID NO: 190011 - DNA, 20 bp, human
gcaccccagttctccagatg

SEQ ID NO: 190012 - DNA, 20 bp, human
gtcacccatggtggacaaag

SEQ ID NO: 190013 - DNA, 20 bp, human
ggagagatggcatgccacat

SEQ ID NO: 190014 - DNA, 20 bp, human
gcacatgggctttagtgggt

SEQ ID NO: 190015 - DNA, 20 bp, human
gatgccacatgggctttagt

SEQ ID NO: 190016 - DNA, 20 bp, human
gcgcagtagggagggaccgg

SEQ ID NO: 190017 - DNA, 20 bp, human
ggccgggacctgatattggt

SEQ ID NO: 190018 - DNA, 20 bp, human
ggctggccgggacctgatat

SEQ ID NO: 190019 - DNA, 20 bp, human
gctgcgcttaggaggatgtg

SEQ ID NO: 190020 - DNA, 20 bp, human
ggtggccggtcggagagaca

SEQ ID NO: 190021 - DNA, 20 bp, human
gacagatgccagacgctgag

SEQ ID NO: 190022 - DNA, 20 bp, human
ggctggaggtactgagagga

SEQ ID NO: 190023 - DNA, 20 bp, human
gagaggcaagcggaaacctg

SEQ ID NO: 190024 - DNA, 20 bp, human
gctccccagagccgccataa

SEQ ID NO: 190025 - DNA, 20 bp, human
ggcctgcagttgccgacccc

SEQ ID NO: 190026 - DNA, 20 bp, human
gagccagtgacttgactctt

SEQ ID NO: 190027 - DNA, 20 bp, human
gcactaccgcgtcctgcacc

SEQ ID NO: 190028 - DNA, 20 bp, human
gctggctcgtccctgaccca

SEQ ID NO: 190029 - DNA, 20 bp, human
ggaaggacacagaaaacccc

SEQ ID NO: 190030 - DNA, 20 bp, human
gcacaggcgcggcctgcgag

SEQ ID NO: 190031 - DNA, 20 bp, human
ggcgtcctgcaccaggaaag

SEQ ID NO: 190032 - DNA, 20 bp, human
ggtgagtgccggaacccggg

SEQ ID NO: 190033 - DNA, 20 bp, human
gggagtcggttcctccccac

SEQ ID NO: 190034 - DNA, 20 bp, human
ggggcaataacacccaggag

SEQ ID NO: 190035 - DNA, 20 bp, human
gcgcccaagagtcaagtcac

SEQ ID NO: 190036 - DNA, 20 bp, human
gcagcggtaggccacgaagt

SEQ ID NO: 190037 - DNA, 20 bp, human
gcagagcgccgcgggatcgt

SEQ ID NO: 190038 - DNA, 20 bp, human
ggtgcgggcctacgatcccg

SEQ ID NO: 190039 - DNA, 20 bp, human
ggatgccgcacgtccggcag

SEQ ID NO: 190040 - DNA, 20 bp, human
gcctaccgctgccggacgtg

SEQ ID NO: 190041 - DNA, 20 bp, human
gcggcgcacagcgacatgca

SEQ ID NO: 190042 - DNA, 20 bp, human
ggaagttggctgtccagacc

SEQ ID NO: 190043 - DNA, 20 bp, human
gatgatgagagctcagaatt

SEQ ID NO: 190044 - DNA, 20 bp, human
ggggcgagatgccgcacgtc

SEQ ID NO: 190045 - DNA, 20 bp, human
gcgggcagctcgggctgtga

SEQ ID NO: 190046 - DNA, 20 bp, human
ggggagccgcagtagtacga

SEQ ID NO: 190047 - DNA, 20 bp, human
ggcagtagtacgacggaaga

SEQ ID NO: 190048 - DNA, 20 bp, human
ggacggaagatggcgacgag

SEQ ID NO: 190049 - DNA, 20 bp, human
gtagcggcctccctgcggga

SEQ ID NO: 190050 - DNA, 20 bp, human
gctactgcggctccctccgg

SEQ ID NO: 190051 - DNA, 20 bp, human
ggtcatcgagaggtaccggg

SEQ ID NO: 190052 - DNA, 20 bp, human
gccggtggcaagcccccgga

SEQ ID NO: 190053 - DNA, 20 bp, human
gcgggcgacgctgttgtggg

SEQ ID NO: 190054 - DNA, 20 bp, human
gaaagcgggtccagacgatc

SEQ ID NO: 190055 - DNA, 20 bp, human
gcgttggcggagggaaaccc

SEQ ID NO: 190056 - DNA, 20 bp, human
gctgcgagacggagaaactg

SEQ ID NO: 190057 - DNA, 20 bp, human
ggcagaagtgaagatggcgg

SEQ ID NO: 190058 - DNA, 20 bp, human
gcctcgagtggaggacgaga

SEQ ID NO: 190059 - DNA, 20 bp, human
gctcccagtccccaaatgga

SEQ ID NO: 190060 - DNA, 20 bp, human
gcgcaggctccgctccggag

SEQ ID NO: 190061 - DNA, 20 bp, human
ggtccggactaggggaggtg

SEQ ID NO: 190062 - DNA, 20 bp, human
gcggagcggagcctgcgaga

SEQ ID NO: 190063 - DNA, 20 bp, human
gcagcgggtgaaccacgaaa

SEQ ID NO: 190064 - DNA, 20 bp, human
ggagggaagcaaatacgcag

SEQ ID NO: 190065 - DNA, 20 bp, human
ggtgtgtccgcggcccggag

SEQ ID NO: 190066 - DNA, 20 bp, human
gtcaactgtcagccgaacag

SEQ ID NO: 190067 - DNA, 20 bp, human
gagctccgactgccgcccag

SEQ ID NO: 190068 - DNA, 20 bp, human
gtgaggatggccggagccga

SEQ ID NO: 190069 - DNA, 20 bp, human
gctggcgggccggacagagt

SEQ ID NO: 190070 - DNA, 20 bp, human
gccggggccgagccgctgtt

SEQ ID NO: 190071 - DNA, 20 bp, human
gttcggctgacagttgagga

SEQ ID NO: 190072 - DNA, 20 bp, human
gccggacagagttggagaca

SEQ ID NO: 190073 - DNA, 20 bp, human
gcctccggctacgcccctca

SEQ ID NO: 190074 - DNA, 20 bp, human
ggctgacagttgaggatggc

SEQ ID NO: 190075 - DNA, 20 bp, human
gtgaggaagcggcagactaa

SEQ ID NO: 190076 - DNA, 20 bp, human
gaagcgagcaggtaacgatg

SEQ ID NO: 190077 - DNA, 20 bp, human
gtccccagcacggtcccagg

SEQ ID NO: 190078 - DNA, 20 bp, human
gacccaagcgccagcaccag

SEQ ID NO: 190079 - DNA, 20 bp, human
gcctctctccgcccctccag

SEQ ID NO: 190080 - DNA, 20 bp, human
gccaccaggagctacccagt

SEQ ID NO: 190081 - DNA, 20 bp, human
gcgagtcctgggcttaccga

SEQ ID NO: 190082 - DNA, 20 bp, human
gccctcctcgcccgagtcct

SEQ ID NO: 190083 - DNA, 20 bp, human
gttaccgatggactccccac

SEQ ID NO: 190084 - DNA, 20 bp, human
gctccccgatctccccccgg

SEQ ID NO: 190085 - DNA, 20 bp, human
gcggcggcgtcccgggtcaa

SEQ ID NO: 190086 - DNA, 20 bp, human
ggcgcctgtccggagctcgg

SEQ ID NO: 190087 - DNA, 20 bp, human
gccaccgccgagctccggac

SEQ ID NO: 190088 - DNA, 20 bp, human
ggcctggccgggaacaatgg

SEQ ID NO: 190089 - DNA, 20 bp, human
gagaactcggagggcaccgg

SEQ ID NO: 190090 - DNA, 20 bp, human
gctacgtccccggcgctcag

SEQ ID NO: 190091 - DNA, 20 bp, human
ggcgcccagcacgactcctc

SEQ ID NO: 190092 - DNA, 20 bp, human
ggcctcaacgagaactcgga

SEQ ID NO: 190093 - DNA, 20 bp, human
ggaggtaggtgagcgccagg

SEQ ID NO: 190094 - DNA, 20 bp, human
ggcgcctcgtccgccacctc

SEQ ID NO: 190095 - DNA, 20 bp, human
gcggagcgcggggaatgacg

SEQ ID NO: 190096 - DNA, 20 bp, human
gcgtgctggccgggcaaccc

SEQ ID NO: 190097 - DNA, 20 bp, human
ggccctcccctggccacgcg

SEQ ID NO: 190098 - DNA, 20 bp, human
gcgccagacaaagcccgaga

SEQ ID NO: 190099 - DNA, 20 bp, human
gcgctccgcttcgccatctc

SEQ ID NO: 190100 - DNA, 20 bp, human
gtgcgtgcgccccaaaccag

SEQ ID NO: 190101 - DNA, 20 bp, human
gaaagcccgagatggcgaag

SEQ ID NO: 190102 - DNA, 20 bp, human
gagcttcggtgcctacctcg

SEQ ID NO: 190103 - DNA, 20 bp, human
gcgatcgcggcgtccagctt

SEQ ID NO: 190104 - DNA, 20 bp, human
gcgccatctcgggctttgtc

SEQ ID NO: 190105 - DNA, 20 bp, human
gcggcaaggagaggaccgcg

SEQ ID NO: 190106 - DNA, 20 bp, human
gcgacaccgcggcttccgcg

SEQ ID NO: 190107 - DNA, 20 bp, human
ggcccgtcggcgggtgtcga

SEQ ID NO: 190108 - DNA, 20 bp, human
gtcccggctgctatagagcc

SEQ ID NO: 190109 - DNA, 20 bp, human
gccgggtggcggagaattgg

SEQ ID NO: 190110 - DNA, 20 bp, human
gggtaagcgctcgtcccggg

SEQ ID NO: 190111 - DNA, 20 bp, human
gcgacgagaagaaagccgag

SEQ ID NO: 190112 - DNA, 20 bp, human
ggccctcgacacccgccgac

SEQ ID NO: 190113 - DNA, 20 bp, human
gtggtgtgtgacgagaagga

SEQ ID NO: 190114 - DNA, 20 bp, human
gactggtaagcgctcgtccc

SEQ ID NO: 190115 - DNA, 20 bp, human
gacccggctctatagcagcc

SEQ ID NO: 190116 - DNA, 20 bp, human
gcggaacggctaggtgagag

SEQ ID NO: 190117 - DNA, 20 bp, human
ggatgtcccagtctccggca

SEQ ID NO: 190118 - DNA, 20 bp, human
gcgacggggacacagaccca

SEQ ID NO: 190119 - DNA, 20 bp, human
gtaccagcaggacagagccc

SEQ ID NO: 190120 - DNA, 20 bp, human
gcggatggagcggaacggct

SEQ ID NO: 190121 - DNA, 20 bp, human
gggcagagacgagaaccaga

SEQ ID NO: 190122 - DNA, 20 bp, human
gaaaaggatgtcccagtctc

SEQ ID NO: 190123 - DNA, 20 bp, human
gcaggcctggcggaggccaa

SEQ ID NO: 190124 - DNA, 20 bp, human
ggaggccgtgaactccaggt

SEQ ID NO: 190125 - DNA, 20 bp, human
gcaacaggcttaagaggcag

SEQ ID NO: 190126 - DNA, 20 bp, human
ggcctgcgtggggactccag

SEQ ID NO: 190127 - DNA, 20 bp, human
gccgcgtgacaacaagatgg

SEQ ID NO: 190128 - DNA, 20 bp, human
gcggccctgcgtggtgagtc

SEQ ID NO: 190129 - DNA, 20 bp, human
gctcagagccaggtctgaag

SEQ ID NO: 190130 - DNA, 20 bp, human
ggacggctagcggccctgcg

SEQ ID NO: 190131 - DNA, 20 bp, human
gggcgctgcgggacggctag

SEQ ID NO: 190132 - DNA, 20 bp, human
gaaaccgcgtgacaacaaga

SEQ ID NO: 190133 - DNA, 20 bp, human
ggtactgtaatacttcacgg

SEQ ID NO: 190134 - DNA, 20 bp, human
gtcaggccaaaaggtcctta

SEQ ID NO: 190135 - DNA, 20 bp, human
gaagccagactcaccacgca

SEQ ID NO: 190136 - DNA, 20 bp, human
ggcctggcgaagaccgagag

SEQ ID NO: 190137 - DNA, 20 bp, human
gcaagccgcaggcgagtcag

SEQ ID NO: 190138 - DNA, 20 bp, human
gagatcccgccagcctctct

SEQ ID NO: 190139 - DNA, 20 bp, human
ggcggccgcggaacctgagg

SEQ ID NO: 190140 - DNA, 20 bp, human
gggcgcggccgcggaacctg

SEQ ID NO: 190141 - DNA, 20 bp, human
gaagaccgagagaggctggc

SEQ ID NO: 190142 - DNA, 20 bp, human
gcgagcccctgactcgcctg

SEQ ID NO: 190143 - DNA, 20 bp, human
ggcggcgctccggctctgaa

SEQ ID NO: 190144 - DNA, 20 bp, human
gtgacttgcgagctagctga

SEQ ID NO: 190145 - DNA, 20 bp, human
gaacctgaggcggtctgggg

SEQ ID NO: 190146 - DNA, 20 bp, human
gggaatccccaagctacccg

SEQ ID NO: 190147 - DNA, 20 bp, human
ggaactcgtcctgattagtc

SEQ ID NO: 190148 - DNA, 20 bp, human
ggatagaggcggctcttaca

SEQ ID NO: 190149 - DNA, 20 bp, human
gtcgccccagccctgcggtc

SEQ ID NO: 190150 - DNA, 20 bp, human
gcccttagccagatctaagg

SEQ ID NO: 190151 - DNA, 20 bp, human
ggggcagggggcggcgatag

SEQ ID NO: 190152 - DNA, 20 bp, human
gtctccccgaccgcagggct

SEQ ID NO: 190153 - DNA, 20 bp, human
gccagctctccccgaccgca

SEQ ID NO: 190154 - DNA, 20 bp, human
gcagggggcggcgatagagg

SEQ ID NO: 190155 - DNA, 20 bp, human
gaaggcgcgaggagctgact

SEQ ID NO: 190156 - DNA, 20 bp, human
ggccgctagccagcggaaga

SEQ ID NO: 190157 - DNA, 20 bp, human
ggccatcttccgctggctag

SEQ ID NO: 190158 - DNA, 20 bp, human
gtctggagtaagtctcaaga

SEQ ID NO: 190159 - DNA, 20 bp, human
gggtcagttggtcggttcac

SEQ ID NO: 190160 - DNA, 20 bp, human
gcaaccggccccggaagttg

SEQ ID NO: 190161 - DNA, 20 bp, human
gctcctgctcgccgggctca

SEQ ID NO: 190162 - DNA, 20 bp, human
gtggctagcggcgcccgctg

SEQ ID NO: 190163 - DNA, 20 bp, human
gcggattctatccccagacg

SEQ ID NO: 190164 - DNA, 20 bp, human
ggtgactgtctacttccctg

SEQ ID NO: 190165 - DNA, 20 bp, human
ggacctcctctcctgctcgc

SEQ ID NO: 190166 - DNA, 20 bp, human
gccgcagagccggacgaaga

SEQ ID NO: 190167 - DNA, 20 bp, human
gagagccggacgaagacgga

SEQ ID NO: 190168 - DNA, 20 bp, human
gcctcgcagacactgaggaa

SEQ ID NO: 190169 - DNA, 20 bp, human
ggcgagcgcctgggcccgaa

SEQ ID NO: 190170 - DNA, 20 bp, human
gcggctgccgggagacgcag

SEQ ID NO: 190171 - DNA, 20 bp, human
gtatctcaaacgaaccgggg

SEQ ID NO: 190172 - DNA, 20 bp, human
ggcgctgaacagccacgggc

SEQ ID NO: 190173 - DNA, 20 bp, human
gtcgcgacggccaaaaggag

SEQ ID NO: 190174 - DNA, 20 bp, human
ggtctccgcagtcccgaagc

SEQ ID NO: 190175 - DNA, 20 bp, human
gggcggctgaggtatacaag

SEQ ID NO: 190176 - DNA, 20 bp, human
gggggcacggggcccagtcg

SEQ ID NO: 190177 - DNA, 20 bp, human
gggcggccccgtccccgact

SEQ ID NO: 190178 - DNA, 20 bp, human
ggcggctcgggagatcggag

SEQ ID NO: 190179 - DNA, 20 bp, human
gagcggcacgcgagggtcag

SEQ ID NO: 190180 - DNA, 20 bp, human
gcacggggcccagtcgggga

SEQ ID NO: 190181 - DNA, 20 bp, human
gacgaagtcgggccgagggt

SEQ ID NO: 190182 - DNA, 20 bp, human
ggcaggagggtccgatgcag

SEQ ID NO: 190183 - DNA, 20 bp, human
gagggggcgggtatgacccg

SEQ ID NO: 190184 - DNA, 20 bp, human
ggggaggggaactagcgcag

SEQ ID NO: 190185 - DNA, 20 bp, human
ggccgagggtgggcgtcagg

SEQ ID NO: 190186 - DNA, 20 bp, human
gagcagagccagaggagtat

SEQ ID NO: 190187 - DNA, 20 bp, human
ggaaggttttaatagaccta

SEQ ID NO: 190188 - DNA, 20 bp, human
gtcctaacaagctgccaggg

SEQ ID NO: 190189 - DNA, 20 bp, human
gcttggtgtagggctcaaca

SEQ ID NO: 190190 - DNA, 20 bp, human
gttcaagccctatactcctc

SEQ ID NO: 190191 - DNA, 20 bp, human
gtggctctgcttacataccc

SEQ ID NO: 190192 - DNA, 20 bp, human
gggtgtagggctcaacaggg

SEQ ID NO: 190193 - DNA, 20 bp, human
gcagggtcccgccacgaggg

SEQ ID NO: 190194 - DNA, 20 bp, human
ggcctccctggcagcttgtt

SEQ ID NO: 190195 - DNA, 20 bp, human
gtcctaaacccaagagggac

SEQ ID NO: 190196 - DNA, 20 bp, human
ggacgccgcggagcccccgt

SEQ ID NO: 190197 - DNA, 20 bp, human
ggtaagatggctgcccacgg

SEQ ID NO: 190198 - DNA, 20 bp, human
gtgtctgtgttgttgttcgg

SEQ ID NO: 190199 - DNA, 20 bp, human
gttcagcgccgaggacgccg

SEQ ID NO: 190200 - DNA, 20 bp, human
gactaggagacagagaacga

SEQ ID NO: 190201 - DNA, 20 bp, human
gccgggggcgggaggagtag

SEQ ID NO: 190202 - DNA, 20 bp, human
gcctgaggaagaggcgacga

SEQ ID NO: 190203 - DNA, 20 bp, human
ggcggtaagatggctgccca

SEQ ID NO: 190204 - DNA, 20 bp, human
gggagatgcaccgcaccgca

SEQ ID NO: 190205 - DNA, 20 bp, human
gtgtgggtaaagcccgaagg

SEQ ID NO: 190206 - DNA, 20 bp, human
gcggagctccagacacacaa

SEQ ID NO: 190207 - DNA, 20 bp, human
ggcccgtgaaaagccagtgg

SEQ ID NO: 190208 - DNA, 20 bp, human
gaccccacgtgaagccatgg

SEQ ID NO: 190209 - DNA, 20 bp, human
ggccaccatggcttcacgtg

SEQ ID NO: 190210 - DNA, 20 bp, human
gccaggcgcttccgccacca

SEQ ID NO: 190211 - DNA, 20 bp, human
gagccacgcagccgaagagg

SEQ ID NO: 190212 - DNA, 20 bp, human
gtggcttcacgtggggttgt

SEQ ID NO: 190213 - DNA, 20 bp, human
gcacgcccgtgaaaagccag

SEQ ID NO: 190214 - DNA, 20 bp, human
gggcaggggcgatgcagtct

SEQ ID NO: 190215 - DNA, 20 bp, human
gaagtcagctccggaagtgg

SEQ ID NO: 190216 - DNA, 20 bp, human
ggcccggcagaaatagccta

SEQ ID NO: 190217 - DNA, 20 bp, human
gcgccaggcggagctcccga

SEQ ID NO: 190218 - DNA, 20 bp, human
gccgatggagatcaaccccg

SEQ ID NO: 190219 - DNA, 20 bp, human
gggcttgagctgcatcttcg

SEQ ID NO: 190220 - DNA, 20 bp, human
gggcgcgggcagcacagact

SEQ ID NO: 190221 - DNA, 20 bp, human
gccggtcacggggagacgga

SEQ ID NO: 190222 - DNA, 20 bp, human
ggaagacgaaaaacagctag

SEQ ID NO: 190223 - DNA, 20 bp, human
gtgcacctggcgctcacctc

SEQ ID NO: 190224 - DNA, 20 bp, human
ggctcccgagggcgtggcgc

SEQ ID NO: 190225 - DNA, 20 bp, human
gagtcacccgctaaatgcag

SEQ ID NO: 190226 - DNA, 20 bp, human
gagaccattgggaattcctg

SEQ ID NO: 190227 - DNA, 20 bp, human
gatcggacttattcacgcag

SEQ ID NO: 190228 - DNA, 20 bp, human
ggtggataagcctatgtcag

SEQ ID NO: 190229 - DNA, 20 bp, human
ggtgccacaggaattcccaa

SEQ ID NO: 190230 - DNA, 20 bp, human
gcagcatagagacatctgac

SEQ ID NO: 190231 - DNA, 20 bp, human
gccaataatcaagacaaact

SEQ ID NO: 190232 - DNA, 20 bp, human
gggaattcctgtggcacaat

SEQ ID NO: 190233 - DNA, 20 bp, human
gagttcaagcttaggatggc

SEQ ID NO: 190234 - DNA, 20 bp, human
gcttcccaaaccaagattat

SEQ ID NO: 190235 - DNA, 20 bp, human
gaactgggatttggtaggtg

SEQ ID NO: 190236 - DNA, 20 bp, human
gagccagcgttgaccctcca

SEQ ID NO: 190237 - DNA, 20 bp, human
ggactgcagaatgggaccag

SEQ ID NO: 190238 - DNA, 20 bp, human
gcgggcaccgcggccatgga

SEQ ID NO: 190239 - DNA, 20 bp, human
gccggagtccccaagatacg

SEQ ID NO: 190240 - DNA, 20 bp, human
gtggaggccaatcccgaggt

SEQ ID NO: 190241 - DNA, 20 bp, human
gggactccgggtctgaggtt

SEQ ID NO: 190242 - DNA, 20 bp, human
gccgctggaggccaatcccg

SEQ ID NO: 190243 - DNA, 20 bp, human
gggccatggagggtcaacgc

SEQ ID NO: 190244 - DNA, 20 bp, human
gcccaggtcaaggcgcgcgt

SEQ ID NO: 190245 - DNA, 20 bp, human
gaggcgcgcgtgggcggaag

SEQ ID NO: 190246 - DNA, 20 bp, human
ggacgtgtggttgacgagct

SEQ ID NO: 190247 - DNA, 20 bp, human
gccggcggcagctggtgcgg

SEQ ID NO: 190248 - DNA, 20 bp, human
gccacaggccgacgtcgaga

SEQ ID NO: 190249 - DNA, 20 bp, human
ggtgtggttgacgagctcgg

SEQ ID NO: 190250 - DNA, 20 bp, human
gggtgcgcgccgcagagaag

SEQ ID NO: 190251 - DNA, 20 bp, human
gcgacaagcaggagcggtcc

SEQ ID NO: 190252 - DNA, 20 bp, human
gtgctgagatctgtggccgg

SEQ ID NO: 190253 - DNA, 20 bp, human
gaagtaggcggggtgacgtg

SEQ ID NO: 190254 - DNA, 20 bp, human
gcgatgccgacaagcaggag

SEQ ID NO: 190255 - DNA, 20 bp, human
gaagcaggccctctcgacgt

SEQ ID NO: 190256 - DNA, 20 bp, human
gcgcccagcgccgaggtcgg

SEQ ID NO: 190257 - DNA, 20 bp, human
gcaggtgtggatggtctcag

SEQ ID NO: 190258 - DNA, 20 bp, human
ggggaggacaccaacaggtg

SEQ ID NO: 190259 - DNA, 20 bp, human
gtctggaccgggccgcccgt

SEQ ID NO: 190260 - DNA, 20 bp, human
gctcccggaagtgatcgctc

SEQ ID NO: 190261 - DNA, 20 bp, human
gactgccagcgggaaggtaa

SEQ ID NO: 190262 - DNA, 20 bp, human
ggcggaggccgagatggctt

SEQ ID NO: 190263 - DNA, 20 bp, human
gcagcggcccttcctgatag

SEQ ID NO: 190264 - DNA, 20 bp, human
ggggacccgatgcgcgggag

SEQ ID NO: 190265 - DNA, 20 bp, human
gggcctccgctcccgcgcat

SEQ ID NO: 190266 - DNA, 20 bp, human
gaagcggagggagtccgacg

SEQ ID NO: 190267 - DNA, 20 bp, human
gagccgctgcgggcaaagga

SEQ ID NO: 190268 - DNA, 20 bp, human
gaggcgcgcgggccacgcgg

SEQ ID NO: 190269 - DNA, 20 bp, human
gccgcgggccgtgtcagttg

SEQ ID NO: 190270 - DNA, 20 bp, human
ggtggctgccgcaactgaca

SEQ ID NO: 190271 - DNA, 20 bp, human
ggaccagccgctgcgggcaa

SEQ ID NO: 190272 - DNA, 20 bp, human
gctggtccggtttacatccc

SEQ ID NO: 190273 - DNA, 20 bp, human
ggccgctcggagcccggtga

SEQ ID NO: 190274 - DNA, 20 bp, human
gaacagctagcggcaaggta

SEQ ID NO: 190275 - DNA, 20 bp, human
gcgctgacgcctataaggaa

SEQ ID NO: 190276 - DNA, 20 bp, human
gcgagggccccacccaccgg

SEQ ID NO: 190277 - DNA, 20 bp, human
ggggccgtaggtggcgacgt

SEQ ID NO: 190278 - DNA, 20 bp, human
gcttggtctctgcccccggt

SEQ ID NO: 190279 - DNA, 20 bp, human
gagaccaaggtcaacgctgg

SEQ ID NO: 190280 - DNA, 20 bp, human
gcccggccaggcccgcaaag

SEQ ID NO: 190281 - DNA, 20 bp, human
ggtgtgtctcgggccgtagg

SEQ ID NO: 190282 - DNA, 20 bp, human
gcccggcacgtgggagaacg

SEQ ID NO: 190283 - DNA, 20 bp, human
ggaaggatcagcgtccgcgc

SEQ ID NO: 190284 - DNA, 20 bp, human
gcagagaccaaggtcaacgc

SEQ ID NO: 190285 - DNA, 20 bp, human
ggtctctgcccccggtgggt

SEQ ID NO: 190286 - DNA, 20 bp, human
gctcagaagtggggacccaa

SEQ ID NO: 190287 - DNA, 20 bp, human
ggcccaggcgagaggaagga

SEQ ID NO: 190288 - DNA, 20 bp, human
gggctgcctgcctcagaagt

SEQ ID NO: 190289 - DNA, 20 bp, human
gggcagcccaggcgagagga

SEQ ID NO: 190290 - DNA, 20 bp, human
ggccttccttcctctcgcct

SEQ ID NO: 190291 - DNA, 20 bp, human
gctggtacgtgagaaaccac

SEQ ID NO: 190292 - DNA, 20 bp, human
gagaggtaggggctccgtcc

SEQ ID NO: 190293 - DNA, 20 bp, human
gccaggcgtcctgcaccctt

SEQ ID NO: 190294 - DNA, 20 bp, human
ggacttaccatgcacaggta

SEQ ID NO: 190295 - DNA, 20 bp, human
gctagacaggagcaccacgg

SEQ ID NO: 190296 - DNA, 20 bp, human
ggccggccctggacacacag

SEQ ID NO: 190297 - DNA, 20 bp, human
gttgtcggcgagcgtctgta

SEQ ID NO: 190298 - DNA, 20 bp, human
ggaacacagggtctgtcccg

SEQ ID NO: 190299 - DNA, 20 bp, human
gagagactggagctcaatct

SEQ ID NO: 190300 - DNA, 20 bp, human
ggcaggctgcgggcattggg

SEQ ID NO: 190301 - DNA, 20 bp, human
gagacgccttggggaacaca

SEQ ID NO: 190302 - DNA, 20 bp, human
ggccccggggcacggaacca

SEQ ID NO: 190303 - DNA, 20 bp, human
gctcgccgacaacctgtgag

SEQ ID NO: 190304 - DNA, 20 bp, human
gcctccccggaggagcgtgg

SEQ ID NO: 190305 - DNA, 20 bp, human
gaccctggttccgtgccccg

SEQ ID NO: 190306 - DNA, 20 bp, human
gggcaggaatcggatctcag

SEQ ID NO: 190307 - DNA, 20 bp, human
ggggtagagggtcagaccac

SEQ ID NO: 190308 - DNA, 20 bp, human
ggccaggcactactgtcctg

SEQ ID NO: 190309 - DNA, 20 bp, human
gaaacacagagtccacagga

SEQ ID NO: 190310 - DNA, 20 bp, human
gaccacaggacagtagtgcc

SEQ ID NO: 190311 - DNA, 20 bp, human
gagctggtggcggtaggact

SEQ ID NO: 190312 - DNA, 20 bp, human
gaccgccaccagctgcttct

SEQ ID NO: 190313 - DNA, 20 bp, human
gcaaagaaatccagagacag

SEQ ID NO: 190314 - DNA, 20 bp, human
ggactgggttgggtcgggat

SEQ ID NO: 190315 - DNA, 20 bp, human
gataaatgggccctgaagcg

SEQ ID NO: 190316 - DNA, 20 bp, human
gtcagccccaaagggaccag

SEQ ID NO: 190317 - DNA, 20 bp, human
gaaagtgacagatcacaggg

SEQ ID NO: 190318 - DNA, 20 bp, human
gccagcgtagacaccacgtc

SEQ ID NO: 190319 - DNA, 20 bp, human
gggtctctctataccaacgt

SEQ ID NO: 190320 - DNA, 20 bp, human
gagctgctagcgcccctggg

SEQ ID NO: 190321 - DNA, 20 bp, human
gtataaaagtgacagatcac

SEQ ID NO: 190322 - DNA, 20 bp, human
gtggatcgtaattccagacg

SEQ ID NO: 190323 - DNA, 20 bp, human
gcgcagcgaaacgctcaggg

SEQ ID NO: 190324 - DNA, 20 bp, human
ggctgggactgacttatgaa

SEQ ID NO: 190325 - DNA, 20 bp, human
ggcgaaacgctcagggaggc

SEQ ID NO: 190326 - DNA, 20 bp, human
ggtcctgctggcgcgagggt

SEQ ID NO: 190327 - DNA, 20 bp, human
gtgctggcgcgagggtgggt

SEQ ID NO: 190328 - DNA, 20 bp, human
ggcggaagaccggaacgcag

SEQ ID NO: 190329 - DNA, 20 bp, human
gctaccctacctagaaacag

SEQ ID NO: 190330 - DNA, 20 bp, human
gggacaggcgtgaagagcaa

SEQ ID NO: 190331 - DNA, 20 bp, human
gtgcagacggagcgcggtgt

SEQ ID NO: 190332 - DNA, 20 bp, human
ggctccaggtagctaggcag

SEQ ID NO: 190333 - DNA, 20 bp, human
ggagggtcctgctggcgcga

SEQ ID NO: 190334 - DNA, 20 bp, human
gagacggagcgcggtgttgg

SEQ ID NO: 190335 - DNA, 20 bp, human
gaccgaccgccgggcagcgg

SEQ ID NO: 190336 - DNA, 20 bp, human
gcgggccgccaacctctgtg

SEQ ID NO: 190337 - DNA, 20 bp, human
gagggcgcgtcggacgagcc

SEQ ID NO: 190338 - DNA, 20 bp, human
ggagaacacggcagtgcgtg

SEQ ID NO: 190339 - DNA, 20 bp, human
ggtgtctgtcggctggcgga

SEQ ID NO: 190340 - DNA, 20 bp, human
gggcgcggcttaagcctcgg

SEQ ID NO: 190341 - DNA, 20 bp, human
gaaagagtacaaacttgggt

SEQ ID NO: 190342 - DNA, 20 bp, human
gtgcggctgtgtctgtcggc

SEQ ID NO: 190343 - DNA, 20 bp, human
ggcagctgggcttcgcagtg

SEQ ID NO: 190344 - DNA, 20 bp, human
ggcgcacgcagaacaagcgt

SEQ ID NO: 190345 - DNA, 20 bp, human
gacgctgttagaaaccgtcc

SEQ ID NO: 190346 - DNA, 20 bp, human
gaggaatcgcagagattctg

SEQ ID NO: 190347 - DNA, 20 bp, human
ggagacaacagtgaatgaca

SEQ ID NO: 190348 - DNA, 20 bp, human
ggtgagtcctgccacggcag

SEQ ID NO: 190349 - DNA, 20 bp, human
ggagcagccccgagcagtca

SEQ ID NO: 190350 - DNA, 20 bp, human
gcaacagtgaatgacaagga

SEQ ID NO: 190351 - DNA, 20 bp, human
gaatccccatagacaggaag

SEQ ID NO: 190352 - DNA, 20 bp, human
gagggtcctcatggaaagag

SEQ ID NO: 190353 - DNA, 20 bp, human
ggctggactgaatctctatc

SEQ ID NO: 190354 - DNA, 20 bp, human
ggaggcagccagcaaggcaa

SEQ ID NO: 190355 - DNA, 20 bp, human
gttacctgtgagtcctgcca

SEQ ID NO: 190356 - DNA, 20 bp, human
gcgactgcgagggcctgaga

SEQ ID NO: 190357 - DNA, 20 bp, human
gctgggacctagctcgggac

SEQ ID NO: 190358 - DNA, 20 bp, human
gactgagttgggtcttacaa

SEQ ID NO: 190359 - DNA, 20 bp, human
gagatggagttcgactgcga

SEQ ID NO: 190360 - DNA, 20 bp, human
gtacagggagtgactgagtt

SEQ ID NO: 190361 - DNA, 20 bp, human
gagtccggaagaaggtccgg

SEQ ID NO: 190362 - DNA, 20 bp, human
gacggctgcttggcaaggtg

SEQ ID NO: 190363 - DNA, 20 bp, human
ggagggctcgcaccaggtgg

SEQ ID NO: 190364 - DNA, 20 bp, human
gacctagctcgggaccggcc

SEQ ID NO: 190365 - DNA, 20 bp, human
gcttgccaagcagccgtctc

SEQ ID NO: 190366 - DNA, 20 bp, human
gggactaaggagggatggtg

SEQ ID NO: 190367 - DNA, 20 bp, human
gccagggcgcaagagaaacg

SEQ ID NO: 190368 - DNA, 20 bp, human
gggagacacgtcaccttctg

SEQ ID NO: 190369 - DNA, 20 bp, human
gaccggaagcggcttccaca

SEQ ID NO: 190370 - DNA, 20 bp, human
gcatccgccatcttggacca

SEQ ID NO: 190371 - DNA, 20 bp, human
gcggcgttagtcttcagcac

SEQ ID NO: 190372 - DNA, 20 bp, human
ggaacaaacacctgtagcca

SEQ ID NO: 190373 - DNA, 20 bp, human
gcttgcgccctggtccaaga

SEQ ID NO: 190374 - DNA, 20 bp, human
gagagatgcggactgggagt

SEQ ID NO: 190375 - DNA, 20 bp, human
gactgggagttggcgccctg

SEQ ID NO: 190376 - DNA, 20 bp, human
gcggaggtgccgagtcaccc

SEQ ID NO: 190377 - DNA, 20 bp, human
gcggctgggagagcggtcgg

SEQ ID NO: 190378 - DNA, 20 bp, human
gcccagggagaatccgtagt

SEQ ID NO: 190379 - DNA, 20 bp, human
gtaccatgatggacaccacc

SEQ ID NO: 190380 - DNA, 20 bp, human
gagaatcagggcgctcccca

SEQ ID NO: 190381 - DNA, 20 bp, human
gcacggagctcacggagctg

SEQ ID NO: 190382 - DNA, 20 bp, human
ggactcaggcccgggtgact

SEQ ID NO: 190383 - DNA, 20 bp, human
ggcgtaccggcttggcgcgg

SEQ ID NO: 190384 - DNA, 20 bp, human
ggtgagcctctggggcgtac

SEQ ID NO: 190385 - DNA, 20 bp, human
ggagcgggggatgcccacta

SEQ ID NO: 190386 - DNA, 20 bp, human
ggcctgactcgcagtagacg

SEQ ID NO: 190387 - DNA, 20 bp, human
gcgcctgggaagagattagg

SEQ ID NO: 190388 - DNA, 20 bp, human
gtgactcgcagtagacgcgg

SEQ ID NO: 190389 - DNA, 20 bp, human
gggacgcctgggaagagatt

SEQ ID NO: 190390 - DNA, 20 bp, human
gactgcgagtcaggccgtga

SEQ ID NO: 190391 - DNA, 20 bp, human
gtcccaggcgtccgccatca

SEQ ID NO: 190392 - DNA, 20 bp, human
gagacacgtcagccgacagg

SEQ ID NO: 190393 - DNA, 20 bp, human
ggcgagtcaggccgtgatgg

SEQ ID NO: 190394 - DNA, 20 bp, human
gaccggccccgtccatggtg

SEQ ID NO: 190395 - DNA, 20 bp, human
ggatccaggctcgggacaga

SEQ ID NO: 190396 - DNA, 20 bp, human
gaagagatgaagactgcgtg

SEQ ID NO: 190397 - DNA, 20 bp, human
gggaagtcgtgctacccccg

SEQ ID NO: 190398 - DNA, 20 bp, human
gacacacgacaactccgcgg

SEQ ID NO: 190399 - DNA, 20 bp, human
gtggccccgtcacgagggtg

SEQ ID NO: 190400 - DNA, 20 bp, human
gagggagacgtggacgtgag

SEQ ID NO: 190401 - DNA, 20 bp, human
gcaccggagcctgcgaggag

SEQ ID NO: 190402 - DNA, 20 bp, human
gtaagcaaacacttacatgg

SEQ ID NO: 190403 - DNA, 20 bp, human
gcagcttggccccgtcacga

SEQ ID NO: 190404 - DNA, 20 bp, human
ggcagctggaccaggaatta

SEQ ID NO: 190405 - DNA, 20 bp, human
gcagattgcagagggagacg

SEQ ID NO: 190406 - DNA, 20 bp, human
ggggcctcgttgatcaccgc

SEQ ID NO: 190407 - DNA, 20 bp, human
gcaccgaccggcaccgaccg

SEQ ID NO: 190408 - DNA, 20 bp, human
gcggcctgcggtgatcaacg

SEQ ID NO: 190409 - DNA, 20 bp, human
gaggaccggcgcgcagactg

SEQ ID NO: 190410 - DNA, 20 bp, human
ggcaataggcagccaccgac

SEQ ID NO: 190411 - DNA, 20 bp, human
ggatcaccgcaggccgcaat

SEQ ID NO: 190412 - DNA, 20 bp, human
gccacgtggacgtccctcag

SEQ ID NO: 190413 - DNA, 20 bp, human
gtccagggccgcctgtacgg

SEQ ID NO: 190414 - DNA, 20 bp, human
gcctgtacggcggccagtcc

SEQ ID NO: 190415 - DNA, 20 bp, human
gtcctccagggccgcctgta

SEQ ID NO: 190416 - DNA, 20 bp, human
ggtgcggtgacaccacttca

SEQ ID NO: 190417 - DNA, 20 bp, human
ggtgtcaccgcacggcccag

SEQ ID NO: 190418 - DNA, 20 bp, human
ggaaataccacgggaactag

SEQ ID NO: 190419 - DNA, 20 bp, human
gcgcgacgtggcggtgacac

SEQ ID NO: 190420 - DNA, 20 bp, human
ggaagggcttaacctgggac

SEQ ID NO: 190421 - DNA, 20 bp, human
ggcctgcccaaaagttccgg

SEQ ID NO: 190422 - DNA, 20 bp, human
gcaggggagggaaataccac

SEQ ID NO: 190423 - DNA, 20 bp, human
gccgggggccggccctgaag

SEQ ID NO: 190424 - DNA, 20 bp, human
ggccggcccccggaactttt

SEQ ID NO: 190425 - DNA, 20 bp, human
gggtgacaccacttcagggc

SEQ ID NO: 190426 - DNA, 20 bp, human
gggtctcccggctctggtcg

SEQ ID NO: 190427 - DNA, 20 bp, human
gcgggagcccggcggcgaga

SEQ ID NO: 190428 - DNA, 20 bp, human
gaagaggacgaacccgaaga

SEQ ID NO: 190429 - DNA, 20 bp, human
ggcgcactaatcaaaaccgg

SEQ ID NO: 190430 - DNA, 20 bp, human
gccgccaccgccggtccgag

SEQ ID NO: 190431 - DNA, 20 bp, human
gtgattagtgcgcggagctg

SEQ ID NO: 190432 - DNA, 20 bp, human
gctgccccgagcccctcctg

SEQ ID NO: 190433 - DNA, 20 bp, human
gttagtgcgcggagctgcgg

SEQ ID NO: 190434 - DNA, 20 bp, human
ggtccagcagcgccatcccc

SEQ ID NO: 190435 - DNA, 20 bp, human
gcggctcgcgccccactcct

SEQ ID NO: 190436 - DNA, 20 bp, human
gcgcgtggcagcctgaggga

SEQ ID NO: 190437 - DNA, 20 bp, human
gggactcagagtgtaacgcg

SEQ ID NO: 190438 - DNA, 20 bp, human
gggagctaggaagcagctga

SEQ ID NO: 190439 - DNA, 20 bp, human
gagagggagctcagatcgag

SEQ ID NO: 190440 - DNA, 20 bp, human
ggaacgcccaccacaggaag

SEQ ID NO: 190441 - DNA, 20 bp, human
ggagaaccgcttcctgtggt

SEQ ID NO: 190442 - DNA, 20 bp, human
gtgtaacgcgtggcagcctg

SEQ ID NO: 190443 - DNA, 20 bp, human
gaaagccgaacgcccaccac

SEQ ID NO: 190444 - DNA, 20 bp, human
gggaggggcgtgcgccgaga

SEQ ID NO: 190445 - DNA, 20 bp, human
gcctggggatgtggtcgtct

SEQ ID NO: 190446 - DNA, 20 bp, human
ggccggtgacaggtacccag

SEQ ID NO: 190447 - DNA, 20 bp, human
gtgcaggctgcgccagtgag

SEQ ID NO: 190448 - DNA, 20 bp, human
ggcgcgtgtcggcctctcac

SEQ ID NO: 190449 - DNA, 20 bp, human
gccgcgggaaaggcgcgtgt

SEQ ID NO: 190450 - DNA, 20 bp, human
gcagagacaacgccagggca

SEQ ID NO: 190451 - DNA, 20 bp, human
gttgagtcgagccgcgggaa

SEQ ID NO: 190452 - DNA, 20 bp, human
ggaccactgagggcaactcg

SEQ ID NO: 190453 - DNA, 20 bp, human
gagtgccagagacaacgcca

SEQ ID NO: 190454 - DNA, 20 bp, human
gggcctcgtggacaaagaga

SEQ ID NO: 190455 - DNA, 20 bp, human
gggcggcgggctctgttcag

SEQ ID NO: 190456 - DNA, 20 bp, human
gcgtggcggccacagactgt

SEQ ID NO: 190457 - DNA, 20 bp, human
gagagccggccgaagcgtgg

SEQ ID NO: 190458 - DNA, 20 bp, human
gctgtgggtaccgggtccga

SEQ ID NO: 190459 - DNA, 20 bp, human
gacccggtacccacagtctg

SEQ ID NO: 190460 - DNA, 20 bp, human
gagcgcgagtccctcggacc

SEQ ID NO: 190461 - DNA, 20 bp, human
gaggtaaagtaagactgagg

SEQ ID NO: 190462 - DNA, 20 bp, human
ggtctgtggccgccacgctt

SEQ ID NO: 190463 - DNA, 20 bp, human
gggaagagccggccgaagcg

SEQ ID NO: 190464 - DNA, 20 bp, human
gagctcctcccaccggaagt

SEQ ID NO: 190465 - DNA, 20 bp, human
ggcggctgcccacttccggt

SEQ ID NO: 190466 - DNA, 20 bp, human
gtaaccggggttttcggggg

SEQ ID NO: 190467 - DNA, 20 bp, human
gttttcgggggaggcgtttg

SEQ ID NO: 190468 - DNA, 20 bp, human
ggcgcgggagtcccaaggga

SEQ ID NO: 190469 - DNA, 20 bp, human
gaccggcgcgggagtcccaa

SEQ ID NO: 190470 - DNA, 20 bp, human
ggctgacgggtggacaaggg

SEQ ID NO: 190471 - DNA, 20 bp, human
gagctgctaaaggaagagga

SEQ ID NO: 190472 - DNA, 20 bp, human
ggagctccggacacaaatga

SEQ ID NO: 190473 - DNA, 20 bp, human
gccccgcagcggacactaag

SEQ ID NO: 190474 - DNA, 20 bp, human
gtcgctggcggcttgaggag

SEQ ID NO: 190475 - DNA, 20 bp, human
ggcggacactaaggggtcac

SEQ ID NO: 190476 - DNA, 20 bp, human
gacacacacatagaggaagg

SEQ ID NO: 190477 - DNA, 20 bp, human
gcagctgagagcaagcagct

SEQ ID NO: 190478 - DNA, 20 bp, human
ggttctctgatggcttgcac

SEQ ID NO: 190479 - DNA, 20 bp, human
gctcccacctactgtatcat

SEQ ID NO: 190480 - DNA, 20 bp, human
gctcctatgatacagtaggt

SEQ ID NO: 190481 - DNA, 20 bp, human
gtcaacttcatataccctgg

SEQ ID NO: 190482 - DNA, 20 bp, human
gtattcaacttcatataccc

SEQ ID NO: 190483 - DNA, 20 bp, human
gtcgatccttttgataactg

SEQ ID NO: 190484 - DNA, 20 bp, human
gagtatatattctctattaa

SEQ ID NO: 190485 - DNA, 20 bp, human
ggccgaggcagggaagctac

SEQ ID NO: 190486 - DNA, 20 bp, human
ggcagcagagaaacacatag

SEQ ID NO: 190487 - DNA, 20 bp, human
gaataagttaaaaaaaccat

SEQ ID NO: 190488 - DNA, 20 bp, human
gtatttctgagttcatccaa

SEQ ID NO: 190489 - DNA, 20 bp, human
gagagaaacacataggggaa

SEQ ID NO: 190490 - DNA, 20 bp, human
gcagtaggcggaagaactac

SEQ ID NO: 190491 - DNA, 20 bp, human
gtctcatggctcgcacaggg

SEQ ID NO: 190492 - DNA, 20 bp, human
ggttctctcatggctcgcac

SEQ ID NO: 190493 - DNA, 20 bp, human
gggatttcgccgatgctcaa

SEQ ID NO: 190494 - DNA, 20 bp, human
gctgtggctttgctgaggca

SEQ ID NO: 190495 - DNA, 20 bp, human
gtcgggctgcagttctctca

SEQ ID NO: 190496 - DNA, 20 bp, human
ggcagtagacacacacataa

SEQ ID NO: 190497 - DNA, 20 bp, human
gacacacacataaaggaacg

SEQ ID NO: 190498 - DNA, 20 bp, human
gaataagtcaagaaaaccac

SEQ ID NO: 190499 - DNA, 20 bp, human
gactctggaagatcagaacc

SEQ ID NO: 190500 - DNA, 20 bp, human
gtattaatgagttcatccag

SEQ ID NO: 190501 - DNA, 20 bp, human
gtggatccttttgatacctg

SEQ ID NO: 190502 - DNA, 20 bp, human
gtgatcttccagagtgtacg

SEQ ID NO: 190503 - DNA, 20 bp, human
gcagtaggcggaagaagtac

SEQ ID NO: 190504 - DNA, 20 bp, human
gtctcatggctcgcgcaggg

SEQ ID NO: 190505 - DNA, 20 bp, human
gttctctcatggctcgcgca

SEQ ID NO: 190506 - DNA, 20 bp, human
gtatgtctttggtctatcat

SEQ ID NO: 190507 - DNA, 20 bp, human
gtgaagaaagcaaatgtagc

SEQ ID NO: 190508 - DNA, 20 bp, human
gatgttgaacaatatgtctt

SEQ ID NO: 190509 - DNA, 20 bp, human
gaagaaatttttcagaagta

SEQ ID NO: 190510 - DNA, 20 bp, human
gtcatcctgggtccacgaaa

SEQ ID NO: 190511 - DNA, 20 bp, human
gcagcatgcgggaggtcttg

SEQ ID NO: 190512 - DNA, 20 bp, human
gctgtggccagccacggcag

SEQ ID NO: 190513 - DNA, 20 bp, human
gtggggtgaggaccactgcc

SEQ ID NO: 190514 - DNA, 20 bp, human
ggacaacctatgccatttcg

SEQ ID NO: 190515 - DNA, 20 bp, human
ggaatttgatcgccatgtgc

SEQ ID NO: 190516 - DNA, 20 bp, human
gtccacacaacacctatgaa

SEQ ID NO: 190517 - DNA, 20 bp, human
gtgggtccatggaacagcat

SEQ ID NO: 190518 - DNA, 20 bp, human
gtggaacagcataggctgtc

SEQ ID NO: 190519 - DNA, 20 bp, human
gcgaaggaaacaaatgtagc

SEQ ID NO: 190520 - DNA, 20 bp, human
gaagagatattctagaagta

SEQ ID NO: 190521 - DNA, 20 bp, human
gctcaatgacaaggtaatta

SEQ ID NO: 190522 - DNA, 20 bp, human
gtacatgctgatttgctagg

SEQ ID NO: 190523 - DNA, 20 bp, human
gcagaccccgttaacctctg

SEQ ID NO: 190524 - DNA, 20 bp, human
gacgcgatcaaattccttct

SEQ ID NO: 190525 - DNA, 20 bp, human
gaatttgatcgcgttacgct

SEQ ID NO: 190526 - DNA, 20 bp, human
gattctaggaggcacaacgt

SEQ ID NO: 190527 - DNA, 20 bp, human
gcgaaggaaacaattctagg

SEQ ID NO: 190528 - DNA, 20 bp, human
gtatgtctttgatcatacat

SEQ ID NO: 190529 - DNA, 20 bp, human
gcacctggtggcctctcgca

SEQ ID NO: 190530 - DNA, 20 bp, human
gatgtacatattcacctcca

SEQ ID NO: 190531 - DNA, 20 bp, human
gtgcgggacctccatgcgag

SEQ ID NO: 190532 - DNA, 20 bp, human
gttgagtgtgacccagcaaa

SEQ ID NO: 190533 - DNA, 20 bp, human
gagacgaaggaaacaattct

SEQ ID NO: 190534 - DNA, 20 bp, human
gctggtggcctctcgcatgg

SEQ ID NO: 190535 - DNA, 20 bp, human
gcatattcacctccagggtg

SEQ ID NO: 190536 - DNA, 20 bp, human
gaggagaggagtcactcccc

SEQ ID NO: 190537 - DNA, 20 bp, human
gtaggattctcaccacgtac

SEQ ID NO: 190538 - DNA, 20 bp, human
gtataagtctagccagtacg

SEQ ID NO: 190539 - DNA, 20 bp, human
gagtcactcccctggcagat

SEQ ID NO: 190540 - DNA, 20 bp, human
gccctggcagatgggtggct

SEQ ID NO: 190541 - DNA, 20 bp, human
gcagctcctgaaaccataag

SEQ ID NO: 190542 - DNA, 20 bp, human
gaggttgctgaaggtgtgga

SEQ ID NO: 190543 - DNA, 20 bp, human
gctcctgaaaccataagtgg

SEQ ID NO: 190544 - DNA, 20 bp, human
gtgattagattgttgcccat

SEQ ID NO: 190545 - DNA, 20 bp, human
ggattgatttgatcaccgat

SEQ ID NO: 190546 - DNA, 20 bp, human
gcaggacctgtgaaaagcag

SEQ ID NO: 190547 - DNA, 20 bp, human
ggagcaagggagaggtagac

SEQ ID NO: 190548 - DNA, 20 bp, human
gagggtaaaattcagagcaa

SEQ ID NO: 190549 - DNA, 20 bp, human
gacctaggagccctgtgatt

SEQ ID NO: 190550 - DNA, 20 bp, human
gtagtttagggaaaatacct

SEQ ID NO: 190551 - DNA, 20 bp, human
gtgctcctcagacagagtac

SEQ ID NO: 190552 - DNA, 20 bp, human
gagccactggcttagtatga

SEQ ID NO: 190553 - DNA, 20 bp, human
gtctctgaaatgagcgaagg

SEQ ID NO: 190554 - DNA, 20 bp, human
gctggcagttgatgaagtac

SEQ ID NO: 190555 - DNA, 20 bp, human
gatccttcatactaagccag

SEQ ID NO: 190556 - DNA, 20 bp, human
gtctgatggctcgtgcaggg

SEQ ID NO: 190557 - DNA, 20 bp, human
gggtgccgtccagcgagcat

SEQ ID NO: 190558 - DNA, 20 bp, human
gttctctgatggctcgtgca

SEQ ID NO: 190559 - DNA, 20 bp, human
ggagaaaatgcacttcgcaa

SEQ ID NO: 190560 - DNA, 20 bp, human
gcttccacttactatattat

SEQ ID NO: 190561 - DNA, 20 bp, human
gtttgccgatgctcgctgga

SEQ ID NO: 190562 - DNA, 20 bp, human
gggtttttgccgatgctcgc

SEQ ID NO: 190563 - DNA, 20 bp, human
gacacacatataggggaagg

SEQ ID NO: 190564 - DNA, 20 bp, human
gtagacacacatatagggga

SEQ ID NO: 190565 - DNA, 20 bp, human
ggctcctataatatagtaag

SEQ ID NO: 190566 - DNA, 20 bp, human
gcagcaggcccaggacaagt

SEQ ID NO: 190567 - DNA, 20 bp, human
ggtaggagagggcgaacctc

SEQ ID NO: 190568 - DNA, 20 bp, human
ggaacctctggcaggagcaa

SEQ ID NO: 190569 - DNA, 20 bp, human
gggcaggagcaaaggcgcca

SEQ ID NO: 190570 - DNA, 20 bp, human
ggagagggcgaacctctggc

SEQ ID NO: 190571 - DNA, 20 bp, human
gaaggagctcatggcctccc

SEQ ID NO: 190572 - DNA, 20 bp, human
gtcccagcatgggacaccac

SEQ ID NO: 190573 - DNA, 20 bp, human
ggacaagtgggcgtccgccc

SEQ ID NO: 190574 - DNA, 20 bp, human
gctgcacaacaaggagctca

SEQ ID NO: 190575 - DNA, 20 bp, human
gccagtggctgccatccact

SEQ ID NO: 190576 - DNA, 20 bp, human
gacacacacatagaggaagg

SEQ ID NO: 190577 - DNA, 20 bp, human
gcagctgagagcaagcagct

SEQ ID NO: 190578 - DNA, 20 bp, human
gctcccacctactgtatcat

SEQ ID NO: 190579 - DNA, 20 bp, human
ggttctctgatggcttgcac

SEQ ID NO: 190580 - DNA, 20 bp, human
gctcctatgatacagtaggt

SEQ ID NO: 190581 - DNA, 20 bp, human
gtcaacttcatataccctgg

SEQ ID NO: 190582 - DNA, 20 bp, human
gtattcaacttcatataccc

SEQ ID NO: 190583 - DNA, 20 bp, human
gtcgatccttttgataactg

SEQ ID NO: 190584 - DNA, 20 bp, human
gagtatatattctctattaa

SEQ ID NO: 190585 - DNA, 20 bp, human
ggccgaggcagggaagctac

SEQ ID NO: 190586 - DNA, 20 bp, human
ggttgtcttaaggaccacag

SEQ ID NO: 190587 - DNA, 20 bp, human
gcttacctgaagtttcctgg

SEQ ID NO: 190588 - DNA, 20 bp, human
gcaaacaactctccactggt

SEQ ID NO: 190589 - DNA, 20 bp, human
gggaacaaacaactctccac

SEQ ID NO: 190590 - DNA, 20 bp, human
ggaaactttatactgatata

SEQ ID NO: 190591 - DNA, 20 bp, human
ggaactaataatgctttcat

SEQ ID NO: 190592 - DNA, 20 bp, human
gccgaatgtaaataaatcct

SEQ ID NO: 190593 - DNA, 20 bp, human
gtttatgtgtcatctaatga

SEQ ID NO: 190594 - DNA, 20 bp, human
gtcattcatgtgttgtctta

SEQ ID NO: 190595 - DNA, 20 bp, human
ggaactcaaagtcctcttta

SEQ ID NO: 190596 - DNA, 20 bp, human
ggttgtcttaaggaccacag

SEQ ID NO: 190597 - DNA, 20 bp, human
gcttacctgaagtttcctgg

SEQ ID NO: 190598 - DNA, 20 bp, human
gcaaacaactctccactggt

SEQ ID NO: 190599 - DNA, 20 bp, human
gggaacaaacaactctccac

SEQ ID NO: 190600 - DNA, 20 bp, human
ggaaactttatactgatata

SEQ ID NO: 190601 - DNA, 20 bp, human
ggaactaataatgctttcat

SEQ ID NO: 190602 - DNA, 20 bp, human
gccgaatgtaaataaatcct

SEQ ID NO: 190603 - DNA, 20 bp, human
gtttatgtgtcatctaatga

SEQ ID NO: 190604 - DNA, 20 bp, human
gtcattcatgtgttgtctta

SEQ ID NO: 190605 - DNA, 20 bp, human
ggaactcaaagtcctcttta

SEQ ID NO: 190606 - DNA, 20 bp, human
gtgagggaactgccatcatg

SEQ ID NO: 190607 - DNA, 20 bp, human
ggccaacacagaagagctgc

SEQ ID NO: 190608 - DNA, 20 bp, human
gaggtctgacaagtcagctt

SEQ ID NO: 190609 - DNA, 20 bp, human
gctcacacactgatctgcaa

SEQ ID NO: 190610 - DNA, 20 bp, human
ggtgttggctgtggattctg

SEQ ID NO: 190611 - DNA, 20 bp, human
gagctcttctgtgttggctg

SEQ ID NO: 190612 - DNA, 20 bp, human
ggttttgtagttactaagca

SEQ ID NO: 190613 - DNA, 20 bp, human
ggacttgtcagacctcatga

SEQ ID NO: 190614 - DNA, 20 bp, human
gggattctgtgggaaagtcc

SEQ ID NO: 190615 - DNA, 20 bp, human
gctcatagtgagaggccatg

SEQ ID NO: 190616 - DNA, 20 bp, human
gtcaaagtttgatgtcattc

SEQ ID NO: 190617 - DNA, 20 bp, human
gtctgaaaattctcgataga

SEQ ID NO: 190618 - DNA, 20 bp, human
gttctcgatagatggatata

SEQ ID NO: 190619 - DNA, 20 bp, human
gagctctggaagctgtggaa

SEQ ID NO: 190620 - DNA, 20 bp, human
gagaagcattgcataagacc

SEQ ID NO: 190621 - DNA, 20 bp, human
ggacagaaagaaacaacaac

SEQ ID NO: 190622 - DNA, 20 bp, human
gcctggaagagcttgttcag

SEQ ID NO: 190623 - DNA, 20 bp, human
gctgtggaaaggtgctagtg

SEQ ID NO: 190624 - DNA, 20 bp, human
gtctttaactaaaaattatt

SEQ ID NO: 190625 - DNA, 20 bp, human
gactttagctctggaagctg

SEQ ID NO: 190626 - DNA, 20 bp, human
gtatgaaaatgttcgataga

SEQ ID NO: 190627 - DNA, 20 bp, human
gtctttaactaaaaatgatt

SEQ ID NO: 190628 - DNA, 20 bp, human
gacacactaaaataaatatg

SEQ ID NO: 190629 - DNA, 20 bp, human
gcctggaagagcttgttcag

SEQ ID NO: 190630 - DNA, 20 bp, human
ggacagaaagaaacaacaac

SEQ ID NO: 190631 - DNA, 20 bp, human
gagaagcactgcataagacc

SEQ ID NO: 190632 - DNA, 20 bp, human
gtttctcatacttatatctg

SEQ ID NO: 190633 - DNA, 20 bp, human
ggtgattgtgttgacatctt

SEQ ID NO: 190634 - DNA, 20 bp, human
gcaactacaagaattgtgtt

SEQ ID NO: 190635 - DNA, 20 bp, human
gtatttcaaaaaatacattt

SEQ ID NO: 190636 - DNA, 20 bp, human
gcaagcagctggttaagaga

SEQ ID NO: 190637 - DNA, 20 bp, human
gctgttgggatcgaaagaaa

SEQ ID NO: 190638 - DNA, 20 bp, human
gtggatgaacttgtccagag

SEQ ID NO: 190639 - DNA, 20 bp, human
gttcaaatttaagagtagat

SEQ ID NO: 190640 - DNA, 20 bp, human
gacttccaaaagacacattt

SEQ ID NO: 190641 - DNA, 20 bp, human
ggaggatattatcaagcagc

SEQ ID NO: 190642 - DNA, 20 bp, human
gatgaccaaaatgtgtcttt

SEQ ID NO: 190643 - DNA, 20 bp, human
gaaacttatgaagaaactac

SEQ ID NO: 190644 - DNA, 20 bp, human
gtaagagtagatgggctgtt

SEQ ID NO: 190645 - DNA, 20 bp, human
gggtcatgaggtgactgtat

SEQ ID NO: 190646 - DNA, 20 bp, human
gcaccaggatgtctgtgaaa

SEQ ID NO: 190647 - DNA, 20 bp, human
gtaagagcggatgagttgtt

SEQ ID NO: 190648 - DNA, 20 bp, human
ggctttagctctgggaattg

SEQ ID NO: 190649 - DNA, 20 bp, human
gaggaaatcatgtcaatatt

SEQ ID NO: 190650 - DNA, 20 bp, human
gtggatgagcttattcagag

SEQ ID NO: 190651 - DNA, 20 bp, human
gtaaatttcaattttaagag

SEQ ID NO: 190652 - DNA, 20 bp, human
ggagcttttgctttagctct

SEQ ID NO: 190653 - DNA, 20 bp, human
gaccatgagaaatgacagaa

SEQ ID NO: 190654 - DNA, 20 bp, human
ggacagaaaggaacagcaac

SEQ ID NO: 190655 - DNA, 20 bp, human
gtcctttctgtcatttctca

SEQ ID NO: 190656 - DNA, 20 bp, human
gtggctgtgggcctaggaag

SEQ ID NO: 190657 - DNA, 20 bp, human
ggcgcgcctcagtactccaa

SEQ ID NO: 190658 - DNA, 20 bp, human
gaacagaagggcgagagaat

SEQ ID NO: 190659 - DNA, 20 bp, human
ggagaagcccatctagccgt

SEQ ID NO: 190660 - DNA, 20 bp, human
gctctgccccacggctagat

SEQ ID NO: 190661 - DNA, 20 bp, human
gtccccgtcccgcaggactg

SEQ ID NO: 190662 - DNA, 20 bp, human
ggaagggcgagagaattggc

SEQ ID NO: 190663 - DNA, 20 bp, human
gctgccagggctccagcgaa

SEQ ID NO: 190664 - DNA, 20 bp, human
gtgtggaagtgagcatggtt

SEQ ID NO: 190665 - DNA, 20 bp, human
ggccccagtcctgcgggacg

SEQ ID NO: 190666 - DNA, 20 bp, human
gtggcgcactgaggtgcaca

SEQ ID NO: 190667 - DNA, 20 bp, human
gccccagccctgcgggatgg

SEQ ID NO: 190668 - DNA, 20 bp, human
gtgcacagggtcccttagcc

SEQ ID NO: 190669 - DNA, 20 bp, human
gatgggggcgcgtcctgaac

SEQ ID NO: 190670 - DNA, 20 bp, human
gcgtagaagtgagcatggct

SEQ ID NO: 190671 - DNA, 20 bp, human
ggcccaggaactcaagctct

SEQ ID NO: 190672 - DNA, 20 bp, human
ggacgcgcccccatcccgca

SEQ ID NO: 190673 - DNA, 20 bp, human
gcctggcagtgcgagtatcc

SEQ ID NO: 190674 - DNA, 20 bp, human
gcagtgcctttggcgcactg

SEQ ID NO: 190675 - DNA, 20 bp, human
ggcgccctgcgcccggctaa

SEQ ID NO: 190676 - DNA, 20 bp, human
ggaggacccgagggaggaca

SEQ ID NO: 190677 - DNA, 20 bp, human
gggatcgcgggcgctatgag

SEQ ID NO: 190678 - DNA, 20 bp, human
gtcgcccggcactcacctca

SEQ ID NO: 190679 - DNA, 20 bp, human
ggagttgcgaactctgacaa

SEQ ID NO: 190680 - DNA, 20 bp, human
gtggaggcgctcgcagtcag

SEQ ID NO: 190681 - DNA, 20 bp, human
gagaaaggctaggggttgag

SEQ ID NO: 190682 - DNA, 20 bp, human
gaccacgccgttccagaggg

SEQ ID NO: 190683 - DNA, 20 bp, human
gagttagaagtggttagtgg

SEQ ID NO: 190684 - DNA, 20 bp, human
gcggtggttcgggggcgtaa

SEQ ID NO: 190685 - DNA, 20 bp, human
gggcttcggagttagcgtgt

SEQ ID NO: 190686 - DNA, 20 bp, human
gggagctgacgcgacgcctg

SEQ ID NO: 190687 - DNA, 20 bp, human
gcgaacccgatacaccgagg

SEQ ID NO: 190688 - DNA, 20 bp, human
ggaagtcccgggagtcggtg

SEQ ID NO: 190689 - DNA, 20 bp, human
gtctccgccagccggaccag

SEQ ID NO: 190690 - DNA, 20 bp, human
ggtcccgggagtcggtgagg

SEQ ID NO: 190691 - DNA, 20 bp, human
gttgcggaaaccatactcgg

SEQ ID NO: 190692 - DNA, 20 bp, human
gggcaggtacagagccgtct

SEQ ID NO: 190693 - DNA, 20 bp, human
gaccagcggctccgcaggga

SEQ ID NO: 190694 - DNA, 20 bp, human
gcagccgcctcaccgactcc

SEQ ID NO: 190695 - DNA, 20 bp, human
gccggaccagcggctccgca

SEQ ID NO: 190696 - DNA, 20 bp, human
gaaaccccacccgagatccg

SEQ ID NO: 190697 - DNA, 20 bp, human
ggtgctgcggagccaataag

SEQ ID NO: 190698 - DNA, 20 bp, human
gagccgccggggaggatgtc

SEQ ID NO: 190699 - DNA, 20 bp, human
gcggagcctgacatcctccc

SEQ ID NO: 190700 - DNA, 20 bp, human
gaggcggctcaagtgaaggg

SEQ ID NO: 190701 - DNA, 20 bp, human
gcccgccgccgggactacag

SEQ ID NO: 190702 - DNA, 20 bp, human
gacgccgagggtccagggtt

SEQ ID NO: 190703 - DNA, 20 bp, human
ggatgctcccggggaactca

SEQ ID NO: 190704 - DNA, 20 bp, human
ggccgccgggactacagagg

SEQ ID NO: 190705 - DNA, 20 bp, human
gcgcgggccagtgggagtgc

SEQ ID NO: 190706 - DNA, 20 bp, human
ggcgccaggcgcccaaagag

SEQ ID NO: 190707 - DNA, 20 bp, human
gcaccggcgccaggacagga

SEQ ID NO: 190708 - DNA, 20 bp, human
gaagcacagagcggcgacaa

SEQ ID NO: 190709 - DNA, 20 bp, human
gacagagcggcgacaacggt

SEQ ID NO: 190710 - DNA, 20 bp, human
gcgagaaagcgccatggcgg

SEQ ID NO: 190711 - DNA, 20 bp, human
gccagggggttgttagagtg

SEQ ID NO: 190712 - DNA, 20 bp, human
ggggcgagaaagcgccatgg

SEQ ID NO: 190713 - DNA, 20 bp, human
ggcgctggtgggtgggatcg

SEQ ID NO: 190714 - DNA, 20 bp, human
gtcagggaggaggtcggaga

SEQ ID NO: 190715 - DNA, 20 bp, human
ggaggggcgagaaagcgcca

SEQ ID NO: 190716 - DNA, 20 bp, human
ggccggcgacaagagatccg

SEQ ID NO: 190717 - DNA, 20 bp, human
gagacggccacgaagagagg

SEQ ID NO: 190718 - DNA, 20 bp, human
gctgggagaagacgcgtcag

SEQ ID NO: 190719 - DNA, 20 bp, human
ggagcaacaggacgagaccg

SEQ ID NO: 190720 - DNA, 20 bp, human
gcatcacgctcaggccgcca

SEQ ID NO: 190721 - DNA, 20 bp, human
gggcgctcactgacctggag

SEQ ID NO: 190722 - DNA, 20 bp, human
gacgcgtcttctcccagggt

SEQ ID NO: 190723 - DNA, 20 bp, human
gaggagacggccacgaagag

SEQ ID NO: 190724 - DNA, 20 bp, human
gtgatgctccgggttctcgg

SEQ ID NO: 190725 - DNA, 20 bp, human
gtctgtgcggtactgagcgg

SEQ ID NO: 190726 - DNA, 20 bp, human
gggagctgcgcgagcgggtg

SEQ ID NO: 190727 - DNA, 20 bp, human
ggcgcgcccaccggaccgac

SEQ ID NO: 190728 - DNA, 20 bp, human
ggacgaccggaaccactctg

SEQ ID NO: 190729 - DNA, 20 bp, human
gcgacttgaggagagacgac

SEQ ID NO: 190730 - DNA, 20 bp, human
gcagacaccgcctcaaagat

SEQ ID NO: 190731 - DNA, 20 bp, human
gctgcggcagcgcctcagag

SEQ ID NO: 190732 - DNA, 20 bp, human
gccgcctcaaagataggaag

SEQ ID NO: 190733 - DNA, 20 bp, human
ggcgcacagagccctcggac

SEQ ID NO: 190734 - DNA, 20 bp, human
gctcggaccggtgcgtccag

SEQ ID NO: 190735 - DNA, 20 bp, human
gcgcggcgcccagagctcag

SEQ ID NO: 190736 - DNA, 20 bp, human
gcatctggagaagcccaacc

SEQ ID NO: 190737 - DNA, 20 bp, human
gggacccgctgaggaagaaa

SEQ ID NO: 190738 - DNA, 20 bp, human
gtccgcggcccgctactctc

SEQ ID NO: 190739 - DNA, 20 bp, human
gccggagaaggtctacagag

SEQ ID NO: 190740 - DNA, 20 bp, human
gcgtcgggagaggcctacct

SEQ ID NO: 190741 - DNA, 20 bp, human
gtccctccggacgccgaagt

SEQ ID NO: 190742 - DNA, 20 bp, human
gccacacgttgggagcgcgg

SEQ ID NO: 190743 - DNA, 20 bp, human
gcgcccctcccggagagtag

SEQ ID NO: 190744 - DNA, 20 bp, human
ggtcgcgagccgccacacgt

SEQ ID NO: 190745 - DNA, 20 bp, human
gggacccgcccggcaaccga

SEQ ID NO: 190746 - DNA, 20 bp, human
gcggagctccaggtctacaa

SEQ ID NO: 190747 - DNA, 20 bp, human
gccgtggtgtgagcctcgaa

SEQ ID NO: 190748 - DNA, 20 bp, human
gggcactcagttcccctcgg

SEQ ID NO: 190749 - DNA, 20 bp, human
gccgcgcgcagggatacact

SEQ ID NO: 190750 - DNA, 20 bp, human
ggaactgagtgccttcagct

SEQ ID NO: 190751 - DNA, 20 bp, human
ggacctggagctccgtggac

SEQ ID NO: 190752 - DNA, 20 bp, human
gcatcagcgcctcctgtcca

SEQ ID NO: 190753 - DNA, 20 bp, human
gcggcggaaaggagccaccg

SEQ ID NO: 190754 - DNA, 20 bp, human
gggatgtagcctaagcaggg

SEQ ID NO: 190755 - DNA, 20 bp, human
gcttcagctgggcatgtctg

SEQ ID NO: 190756 - DNA, 20 bp, human
gttaaggacccagagcgcta

SEQ ID NO: 190757 - DNA, 20 bp, human
ggccgaccggaactgaacgg

SEQ ID NO: 190758 - DNA, 20 bp, human
gcacagaaggatcttggtag

SEQ ID NO: 190759 - DNA, 20 bp, human
ggggctgcagagagcgaggt

SEQ ID NO: 190760 - DNA, 20 bp, human
gggcgcgcccgtacataggg

SEQ ID NO: 190761 - DNA, 20 bp, human
gggatgagagacttgatgga

SEQ ID NO: 190762 - DNA, 20 bp, human
ggccgccgaccggaactgaa

SEQ ID NO: 190763 - DNA, 20 bp, human
gagaaggatcttggtagcgg

SEQ ID NO: 190764 - DNA, 20 bp, human
gggaggcttctagaaggacg

SEQ ID NO: 190765 - DNA, 20 bp, human
gctgctgggtgcagtccccg

SEQ ID NO: 190766 - DNA, 20 bp, human
gacacaaggcgcagtcgatg

SEQ ID NO: 190767 - DNA, 20 bp, human
gcgagctggggtcaagacat

SEQ ID NO: 190768 - DNA, 20 bp, human
gaagctgcagagggcgaggt

SEQ ID NO: 190769 - DNA, 20 bp, human
gtccttcccgaggacgagtg

SEQ ID NO: 190770 - DNA, 20 bp, human
ggccccactcgtcctcggga

SEQ ID NO: 190771 - DNA, 20 bp, human
ggaatcggaactgagcgtgg

SEQ ID NO: 190772 - DNA, 20 bp, human
gcgcagccccactcgtcctc

SEQ ID NO: 190773 - DNA, 20 bp, human
gaccagtcgaatagcaggta

SEQ ID NO: 190774 - DNA, 20 bp, human
gtcgcgccggtccttctaga

SEQ ID NO: 190775 - DNA, 20 bp, human
gatcactagctggcatgcga

SEQ ID NO: 190776 - DNA, 20 bp, human
ggcggcggcacagagaccgt

SEQ ID NO: 190777 - DNA, 20 bp, human
gccgactccggctccaacta

SEQ ID NO: 190778 - DNA, 20 bp, human
gggcccgggctcggccccaa

SEQ ID NO: 190779 - DNA, 20 bp, human
gccttcgcggtggtcttcaa

SEQ ID NO: 190780 - DNA, 20 bp, human
gcagcccgggaagagtgccg

SEQ ID NO: 190781 - DNA, 20 bp, human
gtctcggggcggggatgcag

SEQ ID NO: 190782 - DNA, 20 bp, human
gcggagaaacaaaagagccg

SEQ ID NO: 190783 - DNA, 20 bp, human
gccggctccaactagggccc

SEQ ID NO: 190784 - DNA, 20 bp, human
ggggcgagggcgcatctccg

SEQ ID NO: 190785 - DNA, 20 bp, human
gcgggctgctaatccgaatc

SEQ ID NO: 190786 - DNA, 20 bp, human
gcgcggcggtgcgggttcta

SEQ ID NO: 190787 - DNA, 20 bp, human
ggcgcccccggggcacacag

SEQ ID NO: 190788 - DNA, 20 bp, human
gggcggtgcgggttctaggg

SEQ ID NO: 190789 - DNA, 20 bp, human
ggcgcgcacagtgacggtga

SEQ ID NO: 190790 - DNA, 20 bp, human
gcccgcgcttccccgcctcg

SEQ ID NO: 190791 - DNA, 20 bp, human
gggcgcaggtatcagcaccg

SEQ ID NO: 190792 - DNA, 20 bp, human
gtcatgccgagagaccggag

SEQ ID NO: 190793 - DNA, 20 bp, human
gtagcgcgcgcgagggcgtt

SEQ ID NO: 190794 - DNA, 20 bp, human
gctctgggcgcgcacagtga

SEQ ID NO: 190795 - DNA, 20 bp, human
gacagcaagagggatctcgt

SEQ ID NO: 190796 - DNA, 20 bp, human
ggcgcaggcggccggaatgg

SEQ ID NO: 190797 - DNA, 20 bp, human
gcggccggggagactctgag

SEQ ID NO: 190798 - DNA, 20 bp, human
gctccgccgagggtcagctg

SEQ ID NO: 190799 - DNA, 20 bp, human
gggatcagctagccgagggt

SEQ ID NO: 190800 - DNA, 20 bp, human
gacagtgtgggaatagttag

SEQ ID NO: 190801 - DNA, 20 bp, human
gcggcagaggcatgtcactc

SEQ ID NO: 190802 - DNA, 20 bp, human
ggggactggagccagttggg

SEQ ID NO: 190803 - DNA, 20 bp, human
gccgagggttggagaagacc

SEQ ID NO: 190804 - DNA, 20 bp, human
gctgcgggcggcggttccgg

SEQ ID NO: 190805 - DNA, 20 bp, human
ggggcgggccgagcactggg

SEQ ID NO: 190806 - DNA, 20 bp, human
gcgggagcagccaagtggac

SEQ ID NO: 190807 - DNA, 20 bp, human
gccgctccccaggcaactcg

SEQ ID NO: 190808 - DNA, 20 bp, human
ggcggcctcgctacgtccgt

SEQ ID NO: 190809 - DNA, 20 bp, human
gcctaggaagcgctgcaggg

SEQ ID NO: 190810 - DNA, 20 bp, human
ggaaaagagtccagtccact

SEQ ID NO: 190811 - DNA, 20 bp, human
gcagggggtacggggtccac

SEQ ID NO: 190812 - DNA, 20 bp, human
ggtccacaggcccaagaatg

SEQ ID NO: 190813 - DNA, 20 bp, human
gaaccgcgggagcagccaag

SEQ ID NO: 190814 - DNA, 20 bp, human
gctcgcggcgggcgaatcgg

SEQ ID NO: 190815 - DNA, 20 bp, human
gtgcctcaggacaggtccac

SEQ ID NO: 190816 - DNA, 20 bp, human
ggccttacctgaagccagaa

SEQ ID NO: 190817 - DNA, 20 bp, human
gacctccctcaaataggatg

SEQ ID NO: 190818 - DNA, 20 bp, human
gaataggatggggagaagct

SEQ ID NO: 190819 - DNA, 20 bp, human
gggtctgaccccagtgtcca

SEQ ID NO: 190820 - DNA, 20 bp, human
gtatttgagggaggtaggag

SEQ ID NO: 190821 - DNA, 20 bp, human
gcattgttactaggacagag

SEQ ID NO: 190822 - DNA, 20 bp, human
gcttttgtgggttatatcca

SEQ ID NO: 190823 - DNA, 20 bp, human
gcagaaaggtagagttagtc

SEQ ID NO: 190824 - DNA, 20 bp, human
gttaggtcgcatcttattag

SEQ ID NO: 190825 - DNA, 20 bp, human
gagatcatgaagccaataat

SEQ ID NO: 190826 - DNA, 20 bp, human
ggggaagagcagaaaggatg

SEQ ID NO: 190827 - DNA, 20 bp, human
gtccaggcgatgctcatact

SEQ ID NO: 190828 - DNA, 20 bp, human
ggcaatgtagcacctgtcag

SEQ ID NO: 190829 - DNA, 20 bp, human
gctagatagcacctgcccaa

SEQ ID NO: 190830 - DNA, 20 bp, human
gtatctagacctgaagtagc

SEQ ID NO: 190831 - DNA, 20 bp, human
gctgacttggatgctgatgg

SEQ ID NO: 190832 - DNA, 20 bp, human
gaagtctcaagtgcgatagg

SEQ ID NO: 190833 - DNA, 20 bp, human
gcttgcttctgaggtgtcag

SEQ ID NO: 190834 - DNA, 20 bp, human
ggcagttgtgatgaaccaag

SEQ ID NO: 190835 - DNA, 20 bp, human
ggattgagatcacctctgac

SEQ ID NO: 190836 - DNA, 20 bp, human
gccctgtgcagcgggctcag

SEQ ID NO: 190837 - DNA, 20 bp, human
gctgcaggtctgaaatcgag

SEQ ID NO: 190838 - DNA, 20 bp, human
gccgctgcacagggtgacct

SEQ ID NO: 190839 - DNA, 20 bp, human
gcaccaggggggactccgag

SEQ ID NO: 190840 - DNA, 20 bp, human
gtcgacccagtccaaacaca

SEQ ID NO: 190841 - DNA, 20 bp, human
gccgagctgcgagagagtgc

SEQ ID NO: 190842 - DNA, 20 bp, human
gacagggcagcttgccaatg

SEQ ID NO: 190843 - DNA, 20 bp, human
gtacagtagccccaggacgt

SEQ ID NO: 190844 - DNA, 20 bp, human
gtgcccctcggagtcccccc

SEQ ID NO: 190845 - DNA, 20 bp, human
gcaatctccatggcttctca

SEQ ID NO: 190846 - DNA, 20 bp, human
gcgtacagacccgtcaccaa

SEQ ID NO: 190847 - DNA, 20 bp, human
gaggcagcgcgcgacaatgg

SEQ ID NO: 190848 - DNA, 20 bp, human
gtgctggcctaggaagggaa

SEQ ID NO: 190849 - DNA, 20 bp, human
gaacaggcagcgcgcgacaa

SEQ ID NO: 190850 - DNA, 20 bp, human
gcgcagatcgatgtagatgg

SEQ ID NO: 190851 - DNA, 20 bp, human
gacgggtctgtacgacgtgc

SEQ ID NO: 190852 - DNA, 20 bp, human
gaaagtcgggaaacccagtt

SEQ ID NO: 190853 - DNA, 20 bp, human
gcgtgcagctttggggccat

SEQ ID NO: 190854 - DNA, 20 bp, human
ggcacctgactcagaagacg

SEQ ID NO: 190855 - DNA, 20 bp, human
gaacacgtgtctaagcgtgt

SEQ ID NO: 190856 - DNA, 20 bp, human
gctccagccggcgcaggcag

SEQ ID NO: 190857 - DNA, 20 bp, human
gcggccccgcaaggccatga

SEQ ID NO: 190858 - DNA, 20 bp, human
gccatgaaggtgaagaaggg

SEQ ID NO: 190859 - DNA, 20 bp, human
gggcagcagcaggcgagcct

SEQ ID NO: 190860 - DNA, 20 bp, human
gcacaggagaggggactcgg

SEQ ID NO: 190861 - DNA, 20 bp, human
gctcagacctggcggcagaa

SEQ ID NO: 190862 - DNA, 20 bp, human
gcctcgcgggtgctcaccac

SEQ ID NO: 190863 - DNA, 20 bp, human
gcggatgctcccacttcccc

SEQ ID NO: 190864 - DNA, 20 bp, human
gggcgagcctcggccccgca

SEQ ID NO: 190865 - DNA, 20 bp, human
gtcaccttcatggccttgcg

SEQ ID NO: 190866 - DNA, 20 bp, human
gtgagtcgctgggctatggg

SEQ ID NO: 190867 - DNA, 20 bp, human
gcatagcccagcgactcacg

SEQ ID NO: 190868 - DNA, 20 bp, human
ggacaggccacccctacgag

SEQ ID NO: 190869 - DNA, 20 bp, human
gacctgcctcaggcggagga

SEQ ID NO: 190870 - DNA, 20 bp, human
gggcaggcgtgaactggtag

SEQ ID NO: 190871 - DNA, 20 bp, human
gggacctggaccccaatgct

SEQ ID NO: 190872 - DNA, 20 bp, human
gtcccacctgcctcaggcgg

SEQ ID NO: 190873 - DNA, 20 bp, human
gcagctcctcggagagaggg

SEQ ID NO: 190874 - DNA, 20 bp, human
ggaggaaggcaggcgtgaac

SEQ ID NO: 190875 - DNA, 20 bp, human
gtgcgcgggcagggtcttct

SEQ ID NO: 190876 - DNA, 20 bp, human
ggaggcggcggccatcttgg

SEQ ID NO: 190877 - DNA, 20 bp, human
gatgagcgggtctaacccga

SEQ ID NO: 190878 - DNA, 20 bp, human
gcgctcacgtagctctggtg

SEQ ID NO: 190879 - DNA, 20 bp, human
ggggtctaacccgaaggctg

SEQ ID NO: 190880 - DNA, 20 bp, human
gttggcggcggagcgatgag

SEQ ID NO: 190881 - DNA, 20 bp, human
ggtggaggcggcggccatct

SEQ ID NO: 190882 - DNA, 20 bp, human
ggagcaaagcccggccggcg

SEQ ID NO: 190883 - DNA, 20 bp, human
gctccacagcgcggtaacta

SEQ ID NO: 190884 - DNA, 20 bp, human
gtaccgcgctgtggaggcgg

SEQ ID NO: 190885 - DNA, 20 bp, human
gcggtaactatggagagcgg

SEQ ID NO: 190886 - DNA, 20 bp, human
gccggaaacgatctagactg

SEQ ID NO: 190887 - DNA, 20 bp, human
gcatcttggttcagcaccgg

SEQ ID NO: 190888 - DNA, 20 bp, human
ggaaccaagatggccggtgg

SEQ ID NO: 190889 - DNA, 20 bp, human
gggacgtggacgggtatccg

SEQ ID NO: 190890 - DNA, 20 bp, human
gccgcgcttggctcacgccg

SEQ ID NO: 190891 - DNA, 20 bp, human
ggctgaaccaagatggccgg

SEQ ID NO: 190892 - DNA, 20 bp, human
gggcccagctgcgtcgacaa

SEQ ID NO: 190893 - DNA, 20 bp, human
gtacccgtccacgtccacac

SEQ ID NO: 190894 - DNA, 20 bp, human
gcgctgctggaggggtcgtg

SEQ ID NO: 190895 - DNA, 20 bp, human
gtctgtcgggtcgggctcag

SEQ ID NO: 190896 - DNA, 20 bp, human
ggaatgacgggagggagtcc

SEQ ID NO: 190897 - DNA, 20 bp, human
gggtagcggtgagtaccggc

SEQ ID NO: 190898 - DNA, 20 bp, human
ggcacagcgacgccatcgct

SEQ ID NO: 190899 - DNA, 20 bp, human
gggatcccgggtggaatgac

SEQ ID NO: 190900 - DNA, 20 bp, human
gcagcgacgccatcgctggg

SEQ ID NO: 190901 - DNA, 20 bp, human
gtccgggtagcggtgagtac

SEQ ID NO: 190902 - DNA, 20 bp, human
gagacccccaaagcacggac

SEQ ID NO: 190903 - DNA, 20 bp, human
ggacgccatcgctgggaggt

SEQ ID NO: 190904 - DNA, 20 bp, human
gagctcctacctcccagcga

SEQ ID NO: 190905 - DNA, 20 bp, human
gcaccgtctgagcgaactcc

SEQ ID NO: 190906 - DNA, 20 bp, human
ggcagccttgcaccctctga

SEQ ID NO: 190907 - DNA, 20 bp, human
gcgtcagagctgccctcaga

SEQ ID NO: 190908 - DNA, 20 bp, human
gcactaattgctctccatgg

SEQ ID NO: 190909 - DNA, 20 bp, human
gctactcggtaactgaatgt

SEQ ID NO: 190910 - DNA, 20 bp, human
ggctgccctcagagggtgca

SEQ ID NO: 190911 - DNA, 20 bp, human
gctggcctcgtcttcctcag

SEQ ID NO: 190912 - DNA, 20 bp, human
gacattcataagctttgcaa

SEQ ID NO: 190913 - DNA, 20 bp, human
gttatccactgaggaagacg

SEQ ID NO: 190914 - DNA, 20 bp, human
ggccattggcaatagctact

SEQ ID NO: 190915 - DNA, 20 bp, human
gttgcactaattgctctcca

SEQ ID NO: 190916 - DNA, 20 bp, human
gcacccagcaccagcggaca

SEQ ID NO: 190917 - DNA, 20 bp, human
gtgggagaggagtgtcgcca

SEQ ID NO: 190918 - DNA, 20 bp, human
gggagggcgctgctgcggat

SEQ ID NO: 190919 - DNA, 20 bp, human
gtgtcttcacccagcaccag

SEQ ID NO: 190920 - DNA, 20 bp, human
gggcctggcgcaagaaggga

SEQ ID NO: 190921 - DNA, 20 bp, human
gtggggtcaggccaaccggg

SEQ ID NO: 190922 - DNA, 20 bp, human
gatggactctgggccactgt

SEQ ID NO: 190923 - DNA, 20 bp, human
gcccaggtcagcttctctca

SEQ ID NO: 190924 - DNA, 20 bp, human
ggagaggagtgtcgccatgg

SEQ ID NO: 190925 - DNA, 20 bp, human
ggcgccaggccatcaagata

SEQ ID NO: 190926 - DNA, 20 bp, human
gtggcctgtagagagaaagg

SEQ ID NO: 190927 - DNA, 20 bp, human
gactcacagtcatcgcggag

SEQ ID NO: 190928 - DNA, 20 bp, human
gggttgggtacgcaccccgg

SEQ ID NO: 190929 - DNA, 20 bp, human
ggcagagcccgggagctaag

SEQ ID NO: 190930 - DNA, 20 bp, human
gctccctcaccagcttgagg

SEQ ID NO: 190931 - DNA, 20 bp, human
gggcgtcgcgtccagaccca

SEQ ID NO: 190932 - DNA, 20 bp, human
gtgccacctcaagctggtga

SEQ ID NO: 190933 - DNA, 20 bp, human
gcgatgactgtgagtggtcc

SEQ ID NO: 190934 - DNA, 20 bp, human
ggagcgtgaatgtccagctg

SEQ ID NO: 190935 - DNA, 20 bp, human
gggaccaggccgttctgcac

SEQ ID NO: 190936 - DNA, 20 bp, human
gtcaagccgcgcgggaaact

SEQ ID NO: 190937 - DNA, 20 bp, human
gcgcgcggcttgaggtactg

SEQ ID NO: 190938 - DNA, 20 bp, human
gagtaacccgcaatgcggaa

SEQ ID NO: 190939 - DNA, 20 bp, human
gcgcaatgcggaagggcgag

SEQ ID NO: 190940 - DNA, 20 bp, human
gaccgaagtaacccgcaatg

SEQ ID NO: 190941 - DNA, 20 bp, human
gaacatgattgggccggtgg

SEQ ID NO: 190942 - DNA, 20 bp, human
gtctctccggtgcccagcag

SEQ ID NO: 190943 - DNA, 20 bp, human
gttgggccggtgggggattc

SEQ ID NO: 190944 - DNA, 20 bp, human
gagtcaccgagtttcccgcg

SEQ ID NO: 190945 - DNA, 20 bp, human
ggtggttgtcagtaagcggg

SEQ ID NO: 190946 - DNA, 20 bp, human
gggggagcagcatcacaaga

SEQ ID NO: 190947 - DNA, 20 bp, human
ggaagcggtacagctgaagg

SEQ ID NO: 190948 - DNA, 20 bp, human
ggtggaagcggtacagctga

SEQ ID NO: 190949 - DNA, 20 bp, human
gggacagagagtgaggcaca

SEQ ID NO: 190950 - DNA, 20 bp, human
gcctgaggtccggagctcca

SEQ ID NO: 190951 - DNA, 20 bp, human
gttccagctccaggactaca

SEQ ID NO: 190952 - DNA, 20 bp, human
ggcacagggactctcaactt

SEQ ID NO: 190953 - DNA, 20 bp, human
ggaatccccaccatcctctc

SEQ ID NO: 190954 - DNA, 20 bp, human
ggtcctggagctggaaatgc

SEQ ID NO: 190955 - DNA, 20 bp, human
gccatcctctctggtgtgag

SEQ ID NO: 190956 - DNA, 20 bp, human
ggaagtcggttcccgtgacg

SEQ ID NO: 190957 - DNA, 20 bp, human
ggtgacgcggcgcgccccaa

SEQ ID NO: 190958 - DNA, 20 bp, human
gagggaagcccgcccggtgg

SEQ ID NO: 190959 - DNA, 20 bp, human
ggccggctccgttgagggaa

SEQ ID NO: 190960 - DNA, 20 bp, human
gaccccagccgccaccgggc

SEQ ID NO: 190961 - DNA, 20 bp, human
gcaagggccggctccgttga

SEQ ID NO: 190962 - DNA, 20 bp, human
gttcagacaggccacgaata

SEQ ID NO: 190963 - DNA, 20 bp, human
gggaagggaagcccgcccgg

SEQ ID NO: 190964 - DNA, 20 bp, human
ggccaggccgcagcgacgtc

SEQ ID NO: 190965 - DNA, 20 bp, human
ggtagggccgaggactacgg

SEQ ID NO: 190966 - DNA, 20 bp, human
gcgcggcgcgtggctccctt

SEQ ID NO: 190967 - DNA, 20 bp, human
ggctgcgctcccgtgcccaa

SEQ ID NO: 190968 - DNA, 20 bp, human
ggcgtggctcccttgggcac

SEQ ID NO: 190969 - DNA, 20 bp, human
gtgaccagcgctgccagacc

SEQ ID NO: 190970 - DNA, 20 bp, human
gggactgcgctgcctccggg

SEQ ID NO: 190971 - DNA, 20 bp, human
gttgcgaggcgggacgcggg

SEQ ID NO: 190972 - DNA, 20 bp, human
gcctggacttggcagaaccc

SEQ ID NO: 190973 - DNA, 20 bp, human
gcgcaaagtttggcctcggg

SEQ ID NO: 190974 - DNA, 20 bp, human
gggagcgcagcaatgcagcc

SEQ ID NO: 190975 - DNA, 20 bp, human
gcccgagccgcggagccaag

SEQ ID NO: 190976 - DNA, 20 bp, human
gttcgggcgcctctccccca

SEQ ID NO: 190977 - DNA, 20 bp, human
ggacggcggcggcgagactg

SEQ ID NO: 190978 - DNA, 20 bp, human
gtggcgccggctctcgaacg

SEQ ID NO: 190979 - DNA, 20 bp, human
gaggcggctggggccggcta

SEQ ID NO: 190980 - DNA, 20 bp, human
gccaggccgcgggagcatgg

SEQ ID NO: 190981 - DNA, 20 bp, human
gaggcgcccgaaccaggccg

SEQ ID NO: 190982 - DNA, 20 bp, human
gagcggtcgcgcaacttcgg

SEQ ID NO: 190983 - DNA, 20 bp, human
gtcgatgcgcgcaggaaaag

SEQ ID NO: 190984 - DNA, 20 bp, human
gactcactccggcgagcgag

SEQ ID NO: 190985 - DNA, 20 bp, human
ggcggcggcgctcggcattg

SEQ ID NO: 190986 - DNA, 20 bp, human
gaacagctgaaagccccact

SEQ ID NO: 190987 - DNA, 20 bp, human
gaatggaccagggacgaacg

SEQ ID NO: 190988 - DNA, 20 bp, human
gcccccacttgggaagtcca

SEQ ID NO: 190989 - DNA, 20 bp, human
ggagggaaggaagaagctaa

SEQ ID NO: 190990 - DNA, 20 bp, human
gtagacagaggtgtgccggg

SEQ ID NO: 190991 - DNA, 20 bp, human
ggatgggcacgaatggacca

SEQ ID NO: 190992 - DNA, 20 bp, human
ggctccgccgcccaaggtaa

SEQ ID NO: 190993 - DNA, 20 bp, human
gcggagagcagtccagactt

SEQ ID NO: 190994 - DNA, 20 bp, human
gattcagcttctgcccagtg

SEQ ID NO: 190995 - DNA, 20 bp, human
gcttctgagatgggcacgaa

SEQ ID NO: 190996 - DNA, 20 bp, human
gaccgtctaggagctcttag

SEQ ID NO: 190997 - DNA, 20 bp, human
gggtgctcaacttaccgtct

SEQ ID NO: 190998 - DNA, 20 bp, human
ggatgcaactgcctagggac

SEQ ID NO: 190999 - DNA, 20 bp, human
gactgcctagggacaggtga

SEQ ID NO: 191000 - DNA, 20 bp, human
gtaagttgagcacccccttg

SEQ ID NO: 191001 - DNA, 20 bp, human
gcaatgggtatgaggaccac

SEQ ID NO: 191002 - DNA, 20 bp, human
gctggcctgccgactgaatc

SEQ ID NO: 191003 - DNA, 20 bp, human
gtggaggatgcaactgccta

SEQ ID NO: 191004 - DNA, 20 bp, human
gaggagctcttagaggctgc

SEQ ID NO: 191005 - DNA, 20 bp, human
gttccttctccgagaaacaa

SEQ ID NO: 191006 - DNA, 20 bp, human
ggcgagggctgggaactgcg

SEQ ID NO: 191007 - DNA, 20 bp, human
ggctgccgggccccgaacta

SEQ ID NO: 191008 - DNA, 20 bp, human
gagggctgggaactgcgcgg

SEQ ID NO: 191009 - DNA, 20 bp, human
gtccgcccagcgcttacctc

SEQ ID NO: 191010 - DNA, 20 bp, human
ggaagcacagccccagccac

SEQ ID NO: 191011 - DNA, 20 bp, human
gttctgggcggcagggaccg

SEQ ID NO: 191012 - DNA, 20 bp, human
ggcgtccccatagcttccca

SEQ ID NO: 191013 - DNA, 20 bp, human
ggccccgaactacggagcgg

SEQ ID NO: 191014 - DNA, 20 bp, human
gtgagggtcccgagtcgaat

SEQ ID NO: 191015 - DNA, 20 bp, human
gccccagccacgggagccag

SEQ ID NO: 191016 - DNA, 20 bp, human
ggtgcgttcgctggatccat

SEQ ID NO: 191017 - DNA, 20 bp, human
gcccaaacaaggggcatcta

SEQ ID NO: 191018 - DNA, 20 bp, human
gtactacacaagtagcaagg

SEQ ID NO: 191019 - DNA, 20 bp, human
gtcggcggccggcgtccctc

SEQ ID NO: 191020 - DNA, 20 bp, human
gcatctagggaagagcgact

SEQ ID NO: 191021 - DNA, 20 bp, human
gtcctgactaccacaaaggg

SEQ ID NO: 191022 - DNA, 20 bp, human
gctcccagcgacccgacgcc

SEQ ID NO: 191023 - DNA, 20 bp, human
gagcaggatgctgccacaag

SEQ ID NO: 191024 - DNA, 20 bp, human
ggcgacttggctctcccacg

SEQ ID NO: 191025 - DNA, 20 bp, human
gcgagtcgggccgcgtgggg

SEQ ID NO: 191026 - DNA, 20 bp, human
gcagagctgggtcctgcagt

SEQ ID NO: 191027 - DNA, 20 bp, human
ggccacaggaaggtctggat

SEQ ID NO: 191028 - DNA, 20 bp, human
gtgaagaggaagagctccga

SEQ ID NO: 191029 - DNA, 20 bp, human
gggtcctgcagtaggactcc

SEQ ID NO: 191030 - DNA, 20 bp, human
gtgtggcgcggcctcagcgg

SEQ ID NO: 191031 - DNA, 20 bp, human
gctcccgggagtcctactgc

SEQ ID NO: 191032 - DNA, 20 bp, human
gctcccgggagccaccatta

SEQ ID NO: 191033 - DNA, 20 bp, human
gagggccaggagcaggacgg

SEQ ID NO: 191034 - DNA, 20 bp, human
gttcctcttcaccataatgg

SEQ ID NO: 191035 - DNA, 20 bp, human
gctcttcctcttcaccataa

SEQ ID NO: 191036 - DNA, 20 bp, human
gcagccagagaacctaggat

SEQ ID NO: 191037 - DNA, 20 bp, human
gataagtgggacacacatat

SEQ ID NO: 191038 - DNA, 20 bp, human
ggaggtggcgtggcctctca

SEQ ID NO: 191039 - DNA, 20 bp, human
gtggagatgatggcacggaa

SEQ ID NO: 191040 - DNA, 20 bp, human
gaggcctgaaggaaagcacc

SEQ ID NO: 191041 - DNA, 20 bp, human
gacctcaacaggaggcctga

SEQ ID NO: 191042 - DNA, 20 bp, human
gagtgggacacacatatggg

SEQ ID NO: 191043 - DNA, 20 bp, human
gtaagacagagaacctcaac

SEQ ID NO: 191044 - DNA, 20 bp, human
gacttatgatagataagtgg

SEQ ID NO: 191045 - DNA, 20 bp, human
gagatgtgggatgggctccg

SEQ ID NO: 191046 - DNA, 20 bp, human
gtccatggcccgaactactg

SEQ ID NO: 191047 - DNA, 20 bp, human
gggcggtcgcagggactccg

SEQ ID NO: 191048 - DNA, 20 bp, human
gccgccatcgggtagagcgg

SEQ ID NO: 191049 - DNA, 20 bp, human
gccgaactactgcggactcg

SEQ ID NO: 191050 - DNA, 20 bp, human
gcccccgccatcgggtagag

SEQ ID NO: 191051 - DNA, 20 bp, human
ggtagttcgggccatggagg

SEQ ID NO: 191052 - DNA, 20 bp, human
ggagccgccgctctacccga

SEQ ID NO: 191053 - DNA, 20 bp, human
gctacggcgtctacctgggt

SEQ ID NO: 191054 - DNA, 20 bp, human
gaactactgcggactcgcgg

SEQ ID NO: 191055 - DNA, 20 bp, human
gggactcgcggcggtcgccc

SEQ ID NO: 191056 - DNA, 20 bp, human
ggtgcgggcgaagcatgtgt

SEQ ID NO: 191057 - DNA, 20 bp, human
gggcggcggagacagggacc

SEQ ID NO: 191058 - DNA, 20 bp, human
ggcctacctgacagcttgaa

SEQ ID NO: 191059 - DNA, 20 bp, human
gtaagtaaagcgccggagtg

SEQ ID NO: 191060 - DNA, 20 bp, human
gacacgtggtggtggcccag

SEQ ID NO: 191061 - DNA, 20 bp, human
gggccagctcgtacacgtgg

SEQ ID NO: 191062 - DNA, 20 bp, human
ggcccttcaagctgtcaggt

SEQ ID NO: 191063 - DNA, 20 bp, human
ggtggtggcccagcgggtag

SEQ ID NO: 191064 - DNA, 20 bp, human
gcgaaggagagccggctcct

SEQ ID NO: 191065 - DNA, 20 bp, human
gtcgatggagaagggcaccg

SEQ ID NO: 191066 - DNA, 20 bp, human
gccccgagccggccgtccag

SEQ ID NO: 191067 - DNA, 20 bp, human
ggtcgcttcctggcggggct

SEQ ID NO: 191068 - DNA, 20 bp, human
gggcccgcgcatgctccgag

SEQ ID NO: 191069 - DNA, 20 bp, human
gcgctcctcgggaagccata

SEQ ID NO: 191070 - DNA, 20 bp, human
gcgccacccgggaaccggcg

SEQ ID NO: 191071 - DNA, 20 bp, human
gagcctcgccggttcccggg

SEQ ID NO: 191072 - DNA, 20 bp, human
gctgcaagtggtccccgcag

SEQ ID NO: 191073 - DNA, 20 bp, human
gcggtgcgctgtccaatcag

SEQ ID NO: 191074 - DNA, 20 bp, human
gcagcgaacgcgcgccaccc

SEQ ID NO: 191075 - DNA, 20 bp, human
ggctagcctcgccggttccc

SEQ ID NO: 191076 - DNA, 20 bp, human
gtgtagtgctgcggtttctc

SEQ ID NO: 191077 - DNA, 20 bp, human
gccacagcccgaccagaggt

SEQ ID NO: 191078 - DNA, 20 bp, human
gtatggtctgaggaacagtt

SEQ ID NO: 191079 - DNA, 20 bp, human
gaggggagcggcgaagaggc

SEQ ID NO: 191080 - DNA, 20 bp, human
gcgccccacagcccgaccag

SEQ ID NO: 191081 - DNA, 20 bp, human
gcggtcccggccgccgagtg

SEQ ID NO: 191082 - DNA, 20 bp, human
gaggaacagttaggcctcga

SEQ ID NO: 191083 - DNA, 20 bp, human
gtgcagcacctgagcggtag

SEQ ID NO: 191084 - DNA, 20 bp, human
ggcgcagactgaataataaa

SEQ ID NO: 191085 - DNA, 20 bp, human
gcctccggcccggcccagac

SEQ ID NO: 191086 - DNA, 20 bp, human
ggcgctgacctgtagtgggt

SEQ ID NO: 191087 - DNA, 20 bp, human
gacgggcgctgacctgtagt

SEQ ID NO: 191088 - DNA, 20 bp, human
gccgtcggtttcgaaagcgg

SEQ ID NO: 191089 - DNA, 20 bp, human
gatgccgtcggtttcgaaag

SEQ ID NO: 191090 - DNA, 20 bp, human
gggcttctcagtctgcgggg

SEQ ID NO: 191091 - DNA, 20 bp, human
gaggtgccatcccagaccat

SEQ ID NO: 191092 - DNA, 20 bp, human
gaagcgccaccccggaccct

SEQ ID NO: 191093 - DNA, 20 bp, human
ggtttcgaaagcggcggcag

SEQ ID NO: 191094 - DNA, 20 bp, human
gtgggctacgaggtcgggtg

SEQ ID NO: 191095 - DNA, 20 bp, human
gcggcgcccatggtctggga

SEQ ID NO: 191096 - DNA, 20 bp, human
gccggttctgggcaacgtgg

SEQ ID NO: 191097 - DNA, 20 bp, human
ggcccagaaccggaaggaaa

SEQ ID NO: 191098 - DNA, 20 bp, human
ggcgcggacacaagcactgg

SEQ ID NO: 191099 - DNA, 20 bp, human
ggaagacaagcccggctccg

SEQ ID NO: 191100 - DNA, 20 bp, human
gtcctcccactgcgggcaaa

SEQ ID NO: 191101 - DNA, 20 bp, human
ggacatccagaagacaagcc

SEQ ID NO: 191102 - DNA, 20 bp, human
gtcttggggccacagagtgt

SEQ ID NO: 191103 - DNA, 20 bp, human
ggacaagcccggctccgggg

SEQ ID NO: 191104 - DNA, 20 bp, human
ggccctttgcccgcagtggg

SEQ ID NO: 191105 - DNA, 20 bp, human
gagggcaggcagttcgtgcg

SEQ ID NO: 191106 - DNA, 20 bp, human
ggagcggctggcggcttcga

SEQ ID NO: 191107 - DNA, 20 bp, human
gttcgaggggagctgaggcg

SEQ ID NO: 191108 - DNA, 20 bp, human
ggcccgagggccctacccgg

SEQ ID NO: 191109 - DNA, 20 bp, human
ggccgctcgcagcctagagc

SEQ ID NO: 191110 - DNA, 20 bp, human
ggccagacgcagacgccccc

SEQ ID NO: 191111 - DNA, 20 bp, human
gagctcgacgcgcaggtgag

SEQ ID NO: 191112 - DNA, 20 bp, human
gcggcgccagccggaccgag

SEQ ID NO: 191113 - DNA, 20 bp, human
ggggcgcgcgggggcgacag

SEQ ID NO: 191114 - DNA, 20 bp, human
gtggctaggaagagtaaagt

SEQ ID NO: 191115 - DNA, 20 bp, human
gccggcccgagggccctacc

SEQ ID NO: 191116 - DNA, 20 bp, human
ggaggggagagcccgagcgc

SEQ ID NO: 191117 - DNA, 20 bp, human
gagagcccgagcgctggagt

SEQ ID NO: 191118 - DNA, 20 bp, human
ggttggtgctgggaaacccg

SEQ ID NO: 191119 - DNA, 20 bp, human
gaggctcgaggtgagtcccg

SEQ ID NO: 191120 - DNA, 20 bp, human
gtctgtggcgagggagtgtg

SEQ ID NO: 191121 - DNA, 20 bp, human
gtcggctgcgagataggtgg

SEQ ID NO: 191122 - DNA, 20 bp, human
gatgggagcctcggagacag

SEQ ID NO: 191123 - DNA, 20 bp, human
ggagagcgaggggaggtcgg

SEQ ID NO: 191124 - DNA, 20 bp, human
ggaggggcgaaagtgttcgg

SEQ ID NO: 191125 - DNA, 20 bp, human
gaagctcctcgagagccggg

SEQ ID NO: 191126 - DNA, 20 bp, human
gtgcggctcggcggagagtg

SEQ ID NO: 191127 - DNA, 20 bp, human
gatgcgctcggaaaaggagg

SEQ ID NO: 191128 - DNA, 20 bp, human
gggcgggcctcacctcaggt

SEQ ID NO: 191129 - DNA, 20 bp, human
gtgcggcatgcgctcggaaa

SEQ ID NO: 191130 - DNA, 20 bp, human
gtctcgcgaggtttcgtcgg

SEQ ID NO: 191131 - DNA, 20 bp, human
gcgcaaccggaggacgaagt

SEQ ID NO: 191132 - DNA, 20 bp, human
gaggagaggacggccctgag

SEQ ID NO: 191133 - DNA, 20 bp, human
gggacggccctgagcaaggt

SEQ ID NO: 191134 - DNA, 20 bp, human
ggcaccgcccccgcaaccgg

SEQ ID NO: 191135 - DNA, 20 bp, human
gtcgccgccgacctgaggtg

SEQ ID NO: 191136 - DNA, 20 bp, human
gggccggaacggggttaccc

SEQ ID NO: 191137 - DNA, 20 bp, human
ggctttgacgggagcttccc

SEQ ID NO: 191138 - DNA, 20 bp, human
ggggttaccccgggcacaaa

SEQ ID NO: 191139 - DNA, 20 bp, human
gtccggccaagccgcttcag

SEQ ID NO: 191140 - DNA, 20 bp, human
ggctacgtcccccgctgaag

SEQ ID NO: 191141 - DNA, 20 bp, human
gcccctcccggccaaatcct

SEQ ID NO: 191142 - DNA, 20 bp, human
gccggccaaatcctgggtgg

SEQ ID NO: 191143 - DNA, 20 bp, human
ggaagcggcttggccggaac

SEQ ID NO: 191144 - DNA, 20 bp, human
gcccgctgaagcggcttggc

SEQ ID NO: 191145 - DNA, 20 bp, human
ggctgtgagatgataatggg

SEQ ID NO: 191146 - DNA, 20 bp, human
gagtctgggtatggcatgag

SEQ ID NO: 191147 - DNA, 20 bp, human
gcccagtgctgggagccgag

SEQ ID NO: 191148 - DNA, 20 bp, human
ggctgcagacagagaaggtg

SEQ ID NO: 191149 - DNA, 20 bp, human
ggtctctcgggcagactcag

SEQ ID NO: 191150 - DNA, 20 bp, human
gggacacccgggctccggtg

SEQ ID NO: 191151 - DNA, 20 bp, human
ggtatggcatgaggggtctg

SEQ ID NO: 191152 - DNA, 20 bp, human
gacccctcgaagccagggtg

SEQ ID NO: 191153 - DNA, 20 bp, human
ggcagtcactggcctgaact

SEQ ID NO: 191154 - DNA, 20 bp, human
gaggggacagtcctgagctc

SEQ ID NO: 191155 - DNA, 20 bp, human
ggggtccagaactgtctctc

SEQ ID NO: 191156 - DNA, 20 bp, human
gccgtgtgcgcagaaagagg

SEQ ID NO: 191157 - DNA, 20 bp, human
gtcgggtgcagactgcggag

SEQ ID NO: 191158 - DNA, 20 bp, human
gctaccgtgtgcgcagaaag

SEQ ID NO: 191159 - DNA, 20 bp, human
ggtagaaaagcacctgggtc

SEQ ID NO: 191160 - DNA, 20 bp, human
ggactccacaaggaaattgg

SEQ ID NO: 191161 - DNA, 20 bp, human
gggaaattgggggtctacaa

SEQ ID NO: 191162 - DNA, 20 bp, human
gggttcaaagaattgcagga

SEQ ID NO: 191163 - DNA, 20 bp, human
ggggaatctcccgggctcaa

SEQ ID NO: 191164 - DNA, 20 bp, human
gggaagctagcagactggga

SEQ ID NO: 191165 - DNA, 20 bp, human
gccctctgcagggaatctcc

SEQ ID NO: 191166 - DNA, 20 bp, human
gtcaagggcaaggtccggat

SEQ ID NO: 191167 - DNA, 20 bp, human
gaggtccggatgggcagcag

SEQ ID NO: 191168 - DNA, 20 bp, human
gctgcccagggttcacagag

SEQ ID NO: 191169 - DNA, 20 bp, human
gacaaaatcagccaccccag

SEQ ID NO: 191170 - DNA, 20 bp, human
gaggggtgccatgctgggct

SEQ ID NO: 191171 - DNA, 20 bp, human
ggaacctggatgccaggagt

SEQ ID NO: 191172 - DNA, 20 bp, human
gaggtggaataggtgctggc

SEQ ID NO: 191173 - DNA, 20 bp, human
ggctggtgatggcagtgact

SEQ ID NO: 191174 - DNA, 20 bp, human
gctgtgccagtatgaccacc

SEQ ID NO: 191175 - DNA, 20 bp, human
gctggggaccgcttggtgga

SEQ ID NO: 191176 - DNA, 20 bp, human
gcatgggcaagttcatggag

SEQ ID NO: 191177 - DNA, 20 bp, human
gtccagctggtcccatggac

SEQ ID NO: 191178 - DNA, 20 bp, human
gcatggtgacgcctggacgg

SEQ ID NO: 191179 - DNA, 20 bp, human
ggccctcggattcccaacag

SEQ ID NO: 191180 - DNA, 20 bp, human
gaccagacctgtccctgcca

SEQ ID NO: 191181 - DNA, 20 bp, human
gagcggaggcatcgcccggg

SEQ ID NO: 191182 - DNA, 20 bp, human
gagacgactacaggcatgga

SEQ ID NO: 191183 - DNA, 20 bp, human
gcatggaggggagacaatat

SEQ ID NO: 191184 - DNA, 20 bp, human
gacatacaggtagacctcgt

SEQ ID NO: 191185 - DNA, 20 bp, human
ggggccatagccagagaatg

SEQ ID NO: 191186 - DNA, 20 bp, human
ggcatctgcagccctaggtg

SEQ ID NO: 191187 - DNA, 20 bp, human
gctgggggcagcctcaccta

SEQ ID NO: 191188 - DNA, 20 bp, human
gtgtcatggggctaccctgg

SEQ ID NO: 191189 - DNA, 20 bp, human
gcgcgtccagccagacccaa

SEQ ID NO: 191190 - DNA, 20 bp, human
gtctccagggccaagctgtt

SEQ ID NO: 191191 - DNA, 20 bp, human
gtccggcccagcctgagcct

SEQ ID NO: 191192 - DNA, 20 bp, human
gagcctgagcctgggtgagt

SEQ ID NO: 191193 - DNA, 20 bp, human
gtgcaggtctttccagcccc

SEQ ID NO: 191194 - DNA, 20 bp, human
gggggctggtctggctgctt

SEQ ID NO: 191195 - DNA, 20 bp, human
gagctgtcatggggctaccc

SEQ ID NO: 191196 - DNA, 20 bp, human
gagaatttggaaacaaagtg

SEQ ID NO: 191197 - DNA, 20 bp, human
gggaggcttggcccggccat

SEQ ID NO: 191198 - DNA, 20 bp, human
gtggaaacaaagtgaggtct

SEQ ID NO: 191199 - DNA, 20 bp, human
gaacagctggaggcttggcc

SEQ ID NO: 191200 - DNA, 20 bp, human
gacagacaggggagcctctg

SEQ ID NO: 191201 - DNA, 20 bp, human
ggcagtgtctgcagccccag

SEQ ID NO: 191202 - DNA, 20 bp, human
ggacagacgtgggtgagtaa

SEQ ID NO: 191203 - DNA, 20 bp, human
gacagcacagactacagaca

SEQ ID NO: 191204 - DNA, 20 bp, human
gtgcagacactgcagacgga

SEQ ID NO: 191205 - DNA, 20 bp, human
gtgtcccgcagagagcccta

SEQ ID NO: 191206 - DNA, 20 bp, human
gggacgaagggacggctctc

SEQ ID NO: 191207 - DNA, 20 bp, human
gccagggccggacgaaggga

SEQ ID NO: 191208 - DNA, 20 bp, human
gacgtgggagaggtaggcac

SEQ ID NO: 191209 - DNA, 20 bp, human
gtgctccagggccggacgaa

SEQ ID NO: 191210 - DNA, 20 bp, human
gcgaagggacggctctcggg

SEQ ID NO: 191211 - DNA, 20 bp, human
gcgccggagcactcgaatga

SEQ ID NO: 191212 - DNA, 20 bp, human
ggcgcggccgggaggttctg

SEQ ID NO: 191213 - DNA, 20 bp, human
gtcgggaggctcgcagacgg

SEQ ID NO: 191214 - DNA, 20 bp, human
gcgacaaacgcaatgctcca

SEQ ID NO: 191215 - DNA, 20 bp, human
ggacccctgggaagagagaa

SEQ ID NO: 191216 - DNA, 20 bp, human
ggatctcatggacctattgg

SEQ ID NO: 191217 - DNA, 20 bp, human
gtggctcatctaagaaaatg

SEQ ID NO: 191218 - DNA, 20 bp, human
gtaggtccatgagatctgac

SEQ ID NO: 191219 - DNA, 20 bp, human
gagaggttatcattctgact

SEQ ID NO: 191220 - DNA, 20 bp, human
gtataaaagtcatgtcaggg

SEQ ID NO: 191221 - DNA, 20 bp, human
ggtggtataaaagtcatgtc

SEQ ID NO: 191222 - DNA, 20 bp, human
ggaactgaactattatgact

SEQ ID NO: 191223 - DNA, 20 bp, human
ggatgccacaccttcaaagg

SEQ ID NO: 191224 - DNA, 20 bp, human
gaatgtagagattatatcac

SEQ ID NO: 191225 - DNA, 20 bp, human
gtaggccccctttgaaggtg

SEQ ID NO: 191226 - DNA, 20 bp, human
ggaactctcccggcagatcg

SEQ ID NO: 191227 - DNA, 20 bp, human
ggtgacaagtaagccaagag

SEQ ID NO: 191228 - DNA, 20 bp, human
gggagagttcgcagtcctct

SEQ ID NO: 191229 - DNA, 20 bp, human
gtgctaaaggaaaccaacag

SEQ ID NO: 191230 - DNA, 20 bp, human
ggccagggttagatgttctg

SEQ ID NO: 191231 - DNA, 20 bp, human
ggaaaccaacagcggcctag

SEQ ID NO: 191232 - DNA, 20 bp, human
ggctggcaactccttcctag

SEQ ID NO: 191233 - DNA, 20 bp, human
gtcggccggcaggctagaat

SEQ ID NO: 191234 - DNA, 20 bp, human
gccggccgagctggactctg

SEQ ID NO: 191235 - DNA, 20 bp, human
gagttcgcagtcctctagga

SEQ ID NO: 191236 - DNA, 20 bp, human
gaccactgttacgtgtagtg

SEQ ID NO: 191237 - DNA, 20 bp, human
gcagggcgggaggaattgga

SEQ ID NO: 191238 - DNA, 20 bp, human
gcccgggttggagttcgaca

SEQ ID NO: 191239 - DNA, 20 bp, human
ggttggagttcgacaaggca

SEQ ID NO: 191240 - DNA, 20 bp, human
gtgcgagtccttgtgagtga

SEQ ID NO: 191241 - DNA, 20 bp, human
gagctctctgggtcccgggt

SEQ ID NO: 191242 - DNA, 20 bp, human
ggggagctaaggtcaaaacg

SEQ ID NO: 191243 - DNA, 20 bp, human
gcagtcagggactagaaccc

SEQ ID NO: 191244 - DNA, 20 bp, human
gcacccggaaatggttattg

SEQ ID NO: 191245 - DNA, 20 bp, human
gtccccttctcgaaagatgg

SEQ ID NO: 191246 - DNA, 20 bp, human
gcacgcggggcccaagatgg

SEQ ID NO: 191247 - DNA, 20 bp, human
gttgcccaggaggtcatcct

SEQ ID NO: 191248 - DNA, 20 bp, human
ggaacacgcggggcccaaga

SEQ ID NO: 191249 - DNA, 20 bp, human
ggagcccaggatgacctcct

SEQ ID NO: 191250 - DNA, 20 bp, human
gccgccttagcgggaggagt

SEQ ID NO: 191251 - DNA, 20 bp, human
ggatggcggccagccggtac

SEQ ID NO: 191252 - DNA, 20 bp, human
gcgctaaggcgggaacacgc

SEQ ID NO: 191253 - DNA, 20 bp, human
gcagtggacgagaccaaacg

SEQ ID NO: 191254 - DNA, 20 bp, human
ggcgccgactcctcccgcta

SEQ ID NO: 191255 - DNA, 20 bp, human
ggtgcgcaagcgccattcgt

SEQ ID NO: 191256 - DNA, 20 bp, human
gggcaagtgggtatgtaggg

SEQ ID NO: 191257 - DNA, 20 bp, human
gtcaggcgggtccaaggtca

SEQ ID NO: 191258 - DNA, 20 bp, human
gtacgaccacatcaacgagg

SEQ ID NO: 191259 - DNA, 20 bp, human
gggtgacagtggagtagagg

SEQ ID NO: 191260 - DNA, 20 bp, human
gagtggagtagaggtgggat

SEQ ID NO: 191261 - DNA, 20 bp, human
gcaggcgcggtggcgcgagt

SEQ ID NO: 191262 - DNA, 20 bp, human
gcttgaaactctgagagaca

SEQ ID NO: 191263 - DNA, 20 bp, human
gtactccactgtcacccctc

SEQ ID NO: 191264 - DNA, 20 bp, human
gggcagatttgagcaggcga

SEQ ID NO: 191265 - DNA, 20 bp, human
gcacccctcaggcgggtcca

SEQ ID NO: 191266 - DNA, 20 bp, human
ggggtgcgactccgccgcga

SEQ ID NO: 191267 - DNA, 20 bp, human
gtagccgggtcagctggaca

SEQ ID NO: 191268 - DNA, 20 bp, human
ggctggacagggtcatcctg

SEQ ID NO: 191269 - DNA, 20 bp, human
gaaccgggtcaccatcgcgg

SEQ ID NO: 191270 - DNA, 20 bp, human
ggaccagctcccggtagcgt

SEQ ID NO: 191271 - DNA, 20 bp, human
gctgtcaccgggaacaacaa

SEQ ID NO: 191272 - DNA, 20 bp, human
gcgaatggtgaccccctgga

SEQ ID NO: 191273 - DNA, 20 bp, human
gctgaggccgagaggcggag

SEQ ID NO: 191274 - DNA, 20 bp, human
ggcggcggagtcgcaccctc

SEQ ID NO: 191275 - DNA, 20 bp, human
gtcgggactcggcaccttct

SEQ ID NO: 191276 - DNA, 20 bp, human
gccttctgggtaagtcatag

SEQ ID NO: 191277 - DNA, 20 bp, human
gcctggggacagcaaacgag

SEQ ID NO: 191278 - DNA, 20 bp, human
ggcaggccggtaagtaactg

SEQ ID NO: 191279 - DNA, 20 bp, human
gtacaggcaagcccgccctg

SEQ ID NO: 191280 - DNA, 20 bp, human
gggcacaagaggataactag

SEQ ID NO: 191281 - DNA, 20 bp, human
gcgggcaccttcacaaacag

SEQ ID NO: 191282 - DNA, 20 bp, human
gcggtgaagcgcgacgatgc

SEQ ID NO: 191283 - DNA, 20 bp, human
ggggcgggcttgcctgtata

SEQ ID NO: 191284 - DNA, 20 bp, human
gaagacccccagttacttac

SEQ ID NO: 191285 - DNA, 20 bp, human
gggcttgcctgtatagggtt

SEQ ID NO: 191286 - DNA, 20 bp, human
gcaggtggactgatgtgcgc

SEQ ID NO: 191287 - DNA, 20 bp, human
ggtagcggcccgacagacca

SEQ ID NO: 191288 - DNA, 20 bp, human
ggccgactgcagctggaaga

SEQ ID NO: 191289 - DNA, 20 bp, human
gtgtcgggccgctaccgccg

SEQ ID NO: 191290 - DNA, 20 bp, human
ggcggcgtccgtggtctgtc

SEQ ID NO: 191291 - DNA, 20 bp, human
gacgcttgcgcggcgcaaca

SEQ ID NO: 191292 - DNA, 20 bp, human
gacttgtgccccggcggtag

SEQ ID NO: 191293 - DNA, 20 bp, human
gaggttagcctgctggacaa

SEQ ID NO: 191294 - DNA, 20 bp, human
gaatagcacttgtgccccgg

SEQ ID NO: 191295 - DNA, 20 bp, human
gggctgagaggactgctcgg

SEQ ID NO: 191296 - DNA, 20 bp, human
gatacgtgcccactcaggag

SEQ ID NO: 191297 - DNA, 20 bp, human
gttgagactgagaagaataa

SEQ ID NO: 191298 - DNA, 20 bp, human
gctctgagggcctcaggcag

SEQ ID NO: 191299 - DNA, 20 bp, human
gagaggacccaaggaaccat

SEQ ID NO: 191300 - DNA, 20 bp, human
gtggagaaggattatggggt

SEQ ID NO: 191301 - DNA, 20 bp, human
gggtggcttcttgaccaggt

SEQ ID NO: 191302 - DNA, 20 bp, human
gctgagaagaataatggggc

SEQ ID NO: 191303 - DNA, 20 bp, human
gaggagaggttaagctcatg

SEQ ID NO: 191304 - DNA, 20 bp, human
gggaatatctaggcatccct

SEQ ID NO: 191305 - DNA, 20 bp, human
gcagttgcggggctgatgtc

SEQ ID NO: 191306 - DNA, 20 bp, human
ggctgcagcggataaagtga

SEQ ID NO: 191307 - DNA, 20 bp, human
gaagagaccgtgaaacccag

SEQ ID NO: 191308 - DNA, 20 bp, human
gcccgcagggttcagctgaa

SEQ ID NO: 191309 - DNA, 20 bp, human
gcagcggataaagtgaaggt

SEQ ID NO: 191310 - DNA, 20 bp, human
ggtgataaaccaaggagcag

SEQ ID NO: 191311 - DNA, 20 bp, human
gtgaaccctgcgggccaagt

SEQ ID NO: 191312 - DNA, 20 bp, human
gacggtcactgccggattaa

SEQ ID NO: 191313 - DNA, 20 bp, human
ggagctcaccgagaaagagc

SEQ ID NO: 191314 - DNA, 20 bp, human
gtctgacacacggtcactgc

SEQ ID NO: 191315 - DNA, 20 bp, human
ggccaagtgggctgcagact

SEQ ID NO: 191316 - DNA, 20 bp, human
gcgggatgctaccgacaaca

SEQ ID NO: 191317 - DNA, 20 bp, human
gaccggcttggcggttggag

SEQ ID NO: 191318 - DNA, 20 bp, human
gtcaccattgaggcccacgg

SEQ ID NO: 191319 - DNA, 20 bp, human
gaaagacgccccgagcccgg

SEQ ID NO: 191320 - DNA, 20 bp, human
gactcggccgaggaggaacc

SEQ ID NO: 191321 - DNA, 20 bp, human
gggaaggtcgtccctgtgac

SEQ ID NO: 191322 - DNA, 20 bp, human
gtcagaggtggctggaacag

SEQ ID NO: 191323 - DNA, 20 bp, human
gcaaccgccaagccggtcac

SEQ ID NO: 191324 - DNA, 20 bp, human
gtcgcctccgtgggcctcaa

SEQ ID NO: 191325 - DNA, 20 bp, human
ggccaggcccagagttgcgg

SEQ ID NO: 191326 - DNA, 20 bp, human
ggcggcacctaacccagttc

SEQ ID NO: 191327 - DNA, 20 bp, human
gaccctagagggtaaactgg

SEQ ID NO: 191328 - DNA, 20 bp, human
gtctgactgactgcaaacat

SEQ ID NO: 191329 - DNA, 20 bp, human
gacccagttcaggatcaaga

SEQ ID NO: 191330 - DNA, 20 bp, human
gggattcctaacctgagctg

SEQ ID NO: 191331 - DNA, 20 bp, human
gcggagatcctgaggaggta

SEQ ID NO: 191332 - DNA, 20 bp, human
ggcccccagtttaccctcta

SEQ ID NO: 191333 - DNA, 20 bp, human
gggcgatctggccggaagtg

SEQ ID NO: 191334 - DNA, 20 bp, human
gagtcaccggacgaattctg

SEQ ID NO: 191335 - DNA, 20 bp, human
ggggtcactcagcggaaatc

SEQ ID NO: 191336 - DNA, 20 bp, human
ggcctaagccaaaacccacg

SEQ ID NO: 191337 - DNA, 20 bp, human
gtccggagatcctgaggagg

SEQ ID NO: 191338 - DNA, 20 bp, human
gaagttcacatgaacctcgt

SEQ ID NO: 191339 - DNA, 20 bp, human
gacatgaacctcgtgggttt

SEQ ID NO: 191340 - DNA, 20 bp, human
gtctgatgcccagatgatga

SEQ ID NO: 191341 - DNA, 20 bp, human
gacctcgtgggttttggctt

SEQ ID NO: 191342 - DNA, 20 bp, human
gtggtacatccgaaaccata

SEQ ID NO: 191343 - DNA, 20 bp, human
ggaatccggagatcctgagg

SEQ ID NO: 191344 - DNA, 20 bp, human
gaccgaatccggagatcctg

SEQ ID NO: 191345 - DNA, 20 bp, human
gtcctcctcctcaggatctc

SEQ ID NO: 191346 - DNA, 20 bp, human
gcggccgccagcgctcagag

SEQ ID NO: 191347 - DNA, 20 bp, human
gccgccagcgctcagagggg

SEQ ID NO: 191348 - DNA, 20 bp, human
gaccggatcggtgactgtgg

SEQ ID NO: 191349 - DNA, 20 bp, human
gcgggcccaaggcactcacg

SEQ ID NO: 191350 - DNA, 20 bp, human
gacgaacgagtcaaccggat

SEQ ID NO: 191351 - DNA, 20 bp, human
gtcaatgagaaaggtgtgta

SEQ ID NO: 191352 - DNA, 20 bp, human
gaactcgcggcccattgtgg

SEQ ID NO: 191353 - DNA, 20 bp, human
gcagaccccactcacgcaca

SEQ ID NO: 191354 - DNA, 20 bp, human
gagtgttcgtggaccctggg

SEQ ID NO: 191355 - DNA, 20 bp, human
gaatgcggcgcagaacattg

SEQ ID NO: 191356 - DNA, 20 bp, human
ggacgtcccgctgtctccag

SEQ ID NO: 191357 - DNA, 20 bp, human
gctgtctccagtggaataca

SEQ ID NO: 191358 - DNA, 20 bp, human
gatcagaggacatctctcag

SEQ ID NO: 191359 - DNA, 20 bp, human
ggtcactcactcaccgagag

SEQ ID NO: 191360 - DNA, 20 bp, human
ggccttacctgactgtgcaa

SEQ ID NO: 191361 - DNA, 20 bp, human
ggcccttgcacagtcaggta

SEQ ID NO: 191362 - DNA, 20 bp, human
gtgtgcaagggcatcaataa

SEQ ID NO: 191363 - DNA, 20 bp, human
gtccagtggaatacaaggaa

SEQ ID NO: 191364 - DNA, 20 bp, human
gtccattccttgtattccac

SEQ ID NO: 191365 - DNA, 20 bp, human
gatggaccttggagaattcg

SEQ ID NO: 191366 - DNA, 20 bp, human
ggctcctgccgggtcccctc

SEQ ID NO: 191367 - DNA, 20 bp, human
gacggaaacgacacacctga

SEQ ID NO: 191368 - DNA, 20 bp, human
gcatggcgcaggaagaggcg

SEQ ID NO: 191369 - DNA, 20 bp, human
gtcgggtcacataggctcag

SEQ ID NO: 191370 - DNA, 20 bp, human
gtcgccgacagtccagagca

SEQ ID NO: 191371 - DNA, 20 bp, human
gactgtcggcgacagcgaga

SEQ ID NO: 191372 - DNA, 20 bp, human
ggggacccccatggccgaga

SEQ ID NO: 191373 - DNA, 20 bp, human
gcgagagggcggaagcgcga

SEQ ID NO: 191374 - DNA, 20 bp, human
gaggctcagtggcaagcctc

SEQ ID NO: 191375 - DNA, 20 bp, human
gggcgcagggtcgggagcac

SEQ ID NO: 191376 - DNA, 20 bp, human
gggacgcgggacccgtacag

SEQ ID NO: 191377 - DNA, 20 bp, human
ggacagctccgggtagacag

SEQ ID NO: 191378 - DNA, 20 bp, human
gccgggcaatgcgaagtcca

SEQ ID NO: 191379 - DNA, 20 bp, human
gggtaccggtcccacgtggt

SEQ ID NO: 191380 - DNA, 20 bp, human
ggaccaagcaacaagaacca

SEQ ID NO: 191381 - DNA, 20 bp, human
gggcaatgcgaagtccaggg

SEQ ID NO: 191382 - DNA, 20 bp, human
gtgcggcggaggccgctgta

SEQ ID NO: 191383 - DNA, 20 bp, human
gtaaggccgggcccagatgg

SEQ ID NO: 191384 - DNA, 20 bp, human
gtcccgcgtccccaccacgt

SEQ ID NO: 191385 - DNA, 20 bp, human
gagctccgggtagacagggg

SEQ ID NO: 191386 - DNA, 20 bp, human
gctgcgaggcggcactcacc

SEQ ID NO: 191387 - DNA, 20 bp, human
ggcgagcggctggggaaccg

SEQ ID NO: 191388 - DNA, 20 bp, human
gcggccggtccgcccaaggt

SEQ ID NO: 191389 - DNA, 20 bp, human
gggagacctcgctgcgctca

SEQ ID NO: 191390 - DNA, 20 bp, human
gcgcggcccggggcaacccg

SEQ ID NO: 191391 - DNA, 20 bp, human
ggcctggaaatgcttcgctc

SEQ ID NO: 191392 - DNA, 20 bp, human
gtgcgctcatggcgtcgccc

SEQ ID NO: 191393 - DNA, 20 bp, human
ggcctggtatcgatgttcct

SEQ ID NO: 191394 - DNA, 20 bp, human
ggaacatcgataccaggcgc

SEQ ID NO: 191395 - DNA, 20 bp, human
gcggctggggaaccggggtg

SEQ ID NO: 191396 - DNA, 20 bp, human
gcgggtggccagcgtaaccc

SEQ ID NO: 191397 - DNA, 20 bp, human
gggcagtgcaagatcacgtg

SEQ ID NO: 191398 - DNA, 20 bp, human
gccggggccttgctgactag

SEQ ID NO: 191399 - DNA, 20 bp, human
gtcggccgcgccaggacgct

SEQ ID NO: 191400 - DNA, 20 bp, human
ggatgcatagtctaaggcca

SEQ ID NO: 191401 - DNA, 20 bp, human
gcgcccaggatgtaggaaca

SEQ ID NO: 191402 - DNA, 20 bp, human
gcgtgaggtacgactgaaca

SEQ ID NO: 191403 - DNA, 20 bp, human
gcgccgcgtgccgagcgtcc

SEQ ID NO: 191404 - DNA, 20 bp, human
gtggtcgaagccacaggacc

SEQ ID NO: 191405 - DNA, 20 bp, human
ggggaagacgcccaggatgt

SEQ ID NO: 191406 - DNA, 20 bp, human
gctgcgaggcggcactcacc

SEQ ID NO: 191407 - DNA, 20 bp, human
ggcgagcggctggggaaccg

SEQ ID NO: 191408 - DNA, 20 bp, human
gcggccggtccgcccaaggt

SEQ ID NO: 191409 - DNA, 20 bp, human
gggagacctcgctgcgctca

SEQ ID NO: 191410 - DNA, 20 bp, human
gcgcggcccggggcaacccg

SEQ ID NO: 191411 - DNA, 20 bp, human
ggcctggaaatgcttcgctc

SEQ ID NO: 191412 - DNA, 20 bp, human
gtgcgctcatggcgtcgccc

SEQ ID NO: 191413 - DNA, 20 bp, human
ggcctggtatcgatgttcct

SEQ ID NO: 191414 - DNA, 20 bp, human
ggaacatcgataccaggcgc

SEQ ID NO: 191415 - DNA, 20 bp, human
gcggctggggaaccggggtg

SEQ ID NO: 191416 - DNA, 20 bp, human
gggcccagccaggcgtcgcg

SEQ ID NO: 191417 - DNA, 20 bp, human
gccgcaccggagaggcgtct

SEQ ID NO: 191418 - DNA, 20 bp, human
gctgcgcgaggagcaggaaa

SEQ ID NO: 191419 - DNA, 20 bp, human
gcgcctggctgggcccgcac

SEQ ID NO: 191420 - DNA, 20 bp, human
gggagaggcgtctcggtacc

SEQ ID NO: 191421 - DNA, 20 bp, human
gcgcagccgcgccacatccg

SEQ ID NO: 191422 - DNA, 20 bp, human
gaggcgtctcggtacctggc

SEQ ID NO: 191423 - DNA, 20 bp, human
gccagccaggcgtcgcgtgg

SEQ ID NO: 191424 - DNA, 20 bp, human
ggcgcggacgcgaacagcag

SEQ ID NO: 191425 - DNA, 20 bp, human
gcgcaacggaaccagggcag

SEQ ID NO: 191426 - DNA, 20 bp, human
gactccacctccactgacaa

SEQ ID NO: 191427 - DNA, 20 bp, human
gatggctgcgcccttgtcag

SEQ ID NO: 191428 - DNA, 20 bp, human
gccgcctaggagagtctgag

SEQ ID NO: 191429 - DNA, 20 bp, human
ggctgcgcccttgtcagtgg

SEQ ID NO: 191430 - DNA, 20 bp, human
ggcgcccttgtcagtggagg

SEQ ID NO: 191431 - DNA, 20 bp, human
ggccgtctgtccggaaatag

SEQ ID NO: 191432 - DNA, 20 bp, human
ggggcgcgccggaagttgag

SEQ ID NO: 191433 - DNA, 20 bp, human
gcggagcacagggcaccgag

SEQ ID NO: 191434 - DNA, 20 bp, human
ggctcagatgccaaacagat

SEQ ID NO: 191435 - DNA, 20 bp, human
gcacagagctggggcgccgt

SEQ ID NO: 191436 - DNA, 20 bp, human
gacatgtgtgactgagatgg

SEQ ID NO: 191437 - DNA, 20 bp, human
gaggctgggggtcctgacag

SEQ ID NO: 191438 - DNA, 20 bp, human
gggcccctcccagagaaccg

SEQ ID NO: 191439 - DNA, 20 bp, human
ggcctccaggcgctgtgctc

SEQ ID NO: 191440 - DNA, 20 bp, human
gacggcgatcctgcacccaa

SEQ ID NO: 191441 - DNA, 20 bp, human
gctggagcccctggagtcca

SEQ ID NO: 191442 - DNA, 20 bp, human
ggcgatcctgcacccaaggg

SEQ ID NO: 191443 - DNA, 20 bp, human
gcactttggccacctccagt

SEQ ID NO: 191444 - DNA, 20 bp, human
ggaagcctgggtgctcacta

SEQ ID NO: 191445 - DNA, 20 bp, human
gtggacgcggcgcttggtgt

SEQ ID NO: 191446 - DNA, 20 bp, human
gagttacagacagctgacca

SEQ ID NO: 191447 - DNA, 20 bp, human
gttcaggttgggaggtctcc

SEQ ID NO: 191448 - DNA, 20 bp, human
gaagcaaccagagggactgg

SEQ ID NO: 191449 - DNA, 20 bp, human
gagagtagagactaagtgga

SEQ ID NO: 191450 - DNA, 20 bp, human
gaccatggaagcgaatgggt

SEQ ID NO: 191451 - DNA, 20 bp, human
ggtggagggaagaggcccca

SEQ ID NO: 191452 - DNA, 20 bp, human
ggctgaccatggaagcgaat

SEQ ID NO: 191453 - DNA, 20 bp, human
gagggaatgaaggcccacta

SEQ ID NO: 191454 - DNA, 20 bp, human
gtggaagagtagagactaag

SEQ ID NO: 191455 - DNA, 20 bp, human
gccaagctcgaagcaaccag

SEQ ID NO: 191456 - DNA, 20 bp, human
ggaccccgcacctcagactg

SEQ ID NO: 191457 - DNA, 20 bp, human
gccagaagctcggcgagggt

SEQ ID NO: 191458 - DNA, 20 bp, human
gcctcagactggggtcgcgt

SEQ ID NO: 191459 - DNA, 20 bp, human
gagctcggcgagggtaggct

SEQ ID NO: 191460 - DNA, 20 bp, human
ggcaggagcaatgacaacag

SEQ ID NO: 191461 - DNA, 20 bp, human
ggcgaccccagtctgaggtg

SEQ ID NO: 191462 - DNA, 20 bp, human
gtctgaggtgcggggtcctg

SEQ ID NO: 191463 - DNA, 20 bp, human
gcagactggggtcgcgtggg

SEQ ID NO: 191464 - DNA, 20 bp, human
ggtcaccggcgcagcggtag

SEQ ID NO: 191465 - DNA, 20 bp, human
gtccgtaccggtacagcggg

SEQ ID NO: 191466 - DNA, 20 bp, human
gtgctgctgtagcccaccag

SEQ ID NO: 191467 - DNA, 20 bp, human
gtgagcgcggcgcccctggt

SEQ ID NO: 191468 - DNA, 20 bp, human
ggtccaccagcaacctcaac

SEQ ID NO: 191469 - DNA, 20 bp, human
ggtgtgccaggcgatagagt

SEQ ID NO: 191470 - DNA, 20 bp, human
ggctggtggacctgctctgg

SEQ ID NO: 191471 - DNA, 20 bp, human
gtgccggttgaggttgctgg

SEQ ID NO: 191472 - DNA, 20 bp, human
gggacctgctctggtggtct

SEQ ID NO: 191473 - DNA, 20 bp, human
ggaactccgggtgccggttg

SEQ ID NO: 191474 - DNA, 20 bp, human
ggagggcgcttccggcacag

SEQ ID NO: 191475 - DNA, 20 bp, human
gctggacccgaacccaggtc

SEQ ID NO: 191476 - DNA, 20 bp, human
ggtgtagggccgggcgataa

SEQ ID NO: 191477 - DNA, 20 bp, human
gtcgaggctggagctaaacc

SEQ ID NO: 191478 - DNA, 20 bp, human
gtagggccgggcgataatgg

SEQ ID NO: 191479 - DNA, 20 bp, human
gggacatgggaaagaccccc

SEQ ID NO: 191480 - DNA, 20 bp, human
gctagggctcccacgtactg

SEQ ID NO: 191481 - DNA, 20 bp, human
gcggcggaaggggtggtgta

SEQ ID NO: 191482 - DNA, 20 bp, human
ggcctgcaacatgtcctcta

SEQ ID NO: 191483 - DNA, 20 bp, human
gccggccccagtagcctctc

SEQ ID NO: 191484 - DNA, 20 bp, human
gggcgataatggcggcgtcg

SEQ ID NO: 191485 - DNA, 20 bp, human
gtaacatggagccggcggaa

SEQ ID NO: 191486 - DNA, 20 bp, human
gagatacctaggccgggaga

SEQ ID NO: 191487 - DNA, 20 bp, human
ggcgcatgagcagctgtcta

SEQ ID NO: 191488 - DNA, 20 bp, human
gggccggtgagtgtaggacc

SEQ ID NO: 191489 - DNA, 20 bp, human
gctatggagatacctaggcc

SEQ ID NO: 191490 - DNA, 20 bp, human
ggctgtctatggagatacct

SEQ ID NO: 191491 - DNA, 20 bp, human
ggggcgcggggctaagactg

SEQ ID NO: 191492 - DNA, 20 bp, human
gcgccccagctgctccgcgg

SEQ ID NO: 191493 - DNA, 20 bp, human
gacgctcgcgctctggggaa

SEQ ID NO: 191494 - DNA, 20 bp, human
gtgcccggtcctacactcac

SEQ ID NO: 191495 - DNA, 20 bp, human
gagggagacgcctcattcta

SEQ ID NO: 191496 - DNA, 20 bp, human
gtcacgccgcgcggcaggag

SEQ ID NO: 191497 - DNA, 20 bp, human
gcccttgtcgtggctgccag

SEQ ID NO: 191498 - DNA, 20 bp, human
gagccgctcgcgctgatcac

SEQ ID NO: 191499 - DNA, 20 bp, human
gcacgacaagggacccgagg

SEQ ID NO: 191500 - DNA, 20 bp, human
gagccacgacaagggacccg

SEQ ID NO: 191501 - DNA, 20 bp, human
gcgccgccaggtaagatccc

SEQ ID NO: 191502 - DNA, 20 bp, human
gtccccgtgatcagcgcgag

SEQ ID NO: 191503 - DNA, 20 bp, human
gtggctgccaggggcacagg

SEQ ID NO: 191504 - DNA, 20 bp, human
ggcccctggcagccacgaca

SEQ ID NO: 191505 - DNA, 20 bp, human
gtgatcacggggacaaacag

SEQ ID NO: 191506 - DNA, 20 bp, human
ggccgggcacccgaaggaac

SEQ ID NO: 191507 - DNA, 20 bp, human
gctggcagccgggcacccga

SEQ ID NO: 191508 - DNA, 20 bp, human
gaggggcttgcccacaaagg

SEQ ID NO: 191509 - DNA, 20 bp, human
gggggcactaggaaggagag

SEQ ID NO: 191510 - DNA, 20 bp, human
gcaaccagagccatcaggtg

SEQ ID NO: 191511 - DNA, 20 bp, human
ggtctggggcagtatctgag

SEQ ID NO: 191512 - DNA, 20 bp, human
gccagccatggaccgaaaag

SEQ ID NO: 191513 - DNA, 20 bp, human
gaccttatgccggaattctc

SEQ ID NO: 191514 - DNA, 20 bp, human
gtcagaaaagcggccaagac

SEQ ID NO: 191515 - DNA, 20 bp, human
gcagccgccctcggagctgg

SEQ ID NO: 191516 - DNA, 20 bp, human
gccccgctgccgcagacgga

SEQ ID NO: 191517 - DNA, 20 bp, human
gagggtccgcctgtctgcag

SEQ ID NO: 191518 - DNA, 20 bp, human
ggtggtctcaggggcctcaa

SEQ ID NO: 191519 - DNA, 20 bp, human
gcacaaacgccagggtctaa

SEQ ID NO: 191520 - DNA, 20 bp, human
ggctccgcaccctccgtctg

SEQ ID NO: 191521 - DNA, 20 bp, human
ggtcatgccatcctcgtcgg

SEQ ID NO: 191522 - DNA, 20 bp, human
gctgccgcagacggagggtg

SEQ ID NO: 191523 - DNA, 20 bp, human
ggactcgaggttgccatggt

SEQ ID NO: 191524 - DNA, 20 bp, human
ggtctctcccacaaacgcca

SEQ ID NO: 191525 - DNA, 20 bp, human
ggcctcaagggcactgggtg

SEQ ID NO: 191526 - DNA, 20 bp, human
gaggtaccagcggaaagctt

SEQ ID NO: 191527 - DNA, 20 bp, human
gctgcacatgctgggataag

SEQ ID NO: 191528 - DNA, 20 bp, human
ggggcagctcagttccaaga

SEQ ID NO: 191529 - DNA, 20 bp, human
gattctgcagagcaaacact

SEQ ID NO: 191530 - DNA, 20 bp, human
ggccaggcaacgagggacag

SEQ ID NO: 191531 - DNA, 20 bp, human
gtaggacagacagatggtgt

SEQ ID NO: 191532 - DNA, 20 bp, human
ggctcagagcgtggtctgct

SEQ ID NO: 191533 - DNA, 20 bp, human
gtctgcagaatactttacct

SEQ ID NO: 191534 - DNA, 20 bp, human
gctatttgctgagtaaccag

SEQ ID NO: 191535 - DNA, 20 bp, human
ggcatctgtaagttagctct

SEQ ID NO: 191536 - DNA, 20 bp, human
gtacccccagaggatcagag

SEQ ID NO: 191537 - DNA, 20 bp, human
gctgggggtaacttgatcag

SEQ ID NO: 191538 - DNA, 20 bp, human
ggtcccgggacactctgttg

SEQ ID NO: 191539 - DNA, 20 bp, human
gtacctctctgatcctctgg

SEQ ID NO: 191540 - DNA, 20 bp, human
gcctttgtccaggacaacaa

SEQ ID NO: 191541 - DNA, 20 bp, human
gacgaaggagaagcattcag

SEQ ID NO: 191542 - DNA, 20 bp, human
gcccggccctcctaaatgag

SEQ ID NO: 191543 - DNA, 20 bp, human
ggacgtagtgaaggtaaaga

SEQ ID NO: 191544 - DNA, 20 bp, human
gtggcaggctgtggttttag

SEQ ID NO: 191545 - DNA, 20 bp, human
gacagagtgtcccgggactc

SEQ ID NO: 191546 - DNA, 20 bp, human
gaggtggttacattcgttga

SEQ ID NO: 191547 - DNA, 20 bp, human
gggcttctgatccccatcac

SEQ ID NO: 191548 - DNA, 20 bp, human
gtaatattggacgaggacta

SEQ ID NO: 191549 - DNA, 20 bp, human
gacaccagctgcggaatttg

SEQ ID NO: 191550 - DNA, 20 bp, human
gcgtcactgggtgacctcga

SEQ ID NO: 191551 - DNA, 20 bp, human
gttggaggagagaaacggtg

SEQ ID NO: 191552 - DNA, 20 bp, human
gtcctaaagcacagctcggt

SEQ ID NO: 191553 - DNA, 20 bp, human
gcggtgggaacaaacagcta

SEQ ID NO: 191554 - DNA, 20 bp, human
gagatgagtgagaaccactc

SEQ ID NO: 191555 - DNA, 20 bp, human
gcgggcctggcgaactgtag

SEQ ID NO: 191556 - DNA, 20 bp, human
gggcgcggccgccgtcagtc

SEQ ID NO: 191557 - DNA, 20 bp, human
gaccccccattaccccgcgg

SEQ ID NO: 191558 - DNA, 20 bp, human
gaccaccgcctccaactcgg

SEQ ID NO: 191559 - DNA, 20 bp, human
gcgccgtcagtccggccgaa

SEQ ID NO: 191560 - DNA, 20 bp, human
gtcctccgcggggtaatggg

SEQ ID NO: 191561 - DNA, 20 bp, human
ggctggagtggccgccgagt

SEQ ID NO: 191562 - DNA, 20 bp, human
gcggccgaacggcagcaatg

SEQ ID NO: 191563 - DNA, 20 bp, human
ggatttcaggagcggaagga

SEQ ID NO: 191564 - DNA, 20 bp, human
gtcccgtgcggtaccacctg

SEQ ID NO: 191565 - DNA, 20 bp, human
gggctgtttccgggcttaga

SEQ ID NO: 191566 - DNA, 20 bp, human
gaggcacacacggctccccc

SEQ ID NO: 191567 - DNA, 20 bp, human
gcacggtcccggggtctccc

SEQ ID NO: 191568 - DNA, 20 bp, human
gccccctggcaggtcgacca

SEQ ID NO: 191569 - DNA, 20 bp, human
gccaggagcgcaacaagcag

SEQ ID NO: 191570 - DNA, 20 bp, human
gccgaacgcctgaaccgcta

SEQ ID NO: 191571 - DNA, 20 bp, human
gatgggccaccacctcgaga

SEQ ID NO: 191572 - DNA, 20 bp, human
gcgcgccaagttcccctcgg

SEQ ID NO: 191573 - DNA, 20 bp, human
gagttgagggaaaagcgtac

SEQ ID NO: 191574 - DNA, 20 bp, human
gtgcgctcctggctctcccg

SEQ ID NO: 191575 - DNA, 20 bp, human
gggccccaggaaaatctggt

SEQ ID NO: 191576 - DNA, 20 bp, human
ggtgagcagccggaggatcg

SEQ ID NO: 191577 - DNA, 20 bp, human
ggaaggggttaacctccctg

SEQ ID NO: 191578 - DNA, 20 bp, human
gttgggactccgcgatcctc

SEQ ID NO: 191579 - DNA, 20 bp, human
gctgcccggagcgagcgtgt

SEQ ID NO: 191580 - DNA, 20 bp, human
gtagtcccggggaggtcgaa

SEQ ID NO: 191581 - DNA, 20 bp, human
gggccgaaggcgcagaccgg

SEQ ID NO: 191582 - DNA, 20 bp, human
ggtggctccggcctaggccc

SEQ ID NO: 191583 - DNA, 20 bp, human
gcgagcccggggtgtggagt

SEQ ID NO: 191584 - DNA, 20 bp, human
gcgcacatacacactcgcat

SEQ ID NO: 191585 - DNA, 20 bp, human
gcgacctccccgggactagg

SEQ ID NO: 191586 - DNA, 20 bp, human
gcgttggctgtagaagagaa

SEQ ID NO: 191587 - DNA, 20 bp, human
gtgaggccgagggacgacag

SEQ ID NO: 191588 - DNA, 20 bp, human
gtcggcagagggaacggtgg

SEQ ID NO: 191589 - DNA, 20 bp, human
gggctgtagaagagaacgga

SEQ ID NO: 191590 - DNA, 20 bp, human
ggacgttgcgattcattcaa

SEQ ID NO: 191591 - DNA, 20 bp, human
gatcgcaacgtctggaaaag

SEQ ID NO: 191592 - DNA, 20 bp, human
gtcggccgccgaatccccag

SEQ ID NO: 191593 - DNA, 20 bp, human
ggcctcggcagagggaacgg

SEQ ID NO: 191594 - DNA, 20 bp, human
gccacctccaggaccgaaac

SEQ ID NO: 191595 - DNA, 20 bp, human
gggagcggggacctccgtgg

SEQ ID NO: 191596 - DNA, 20 bp, human
ggccgggagtgcctgagcgc

SEQ ID NO: 191597 - DNA, 20 bp, human
ggccggcgctcaggcactcc

SEQ ID NO: 191598 - DNA, 20 bp, human
gggcggcccagcgggctcgg

SEQ ID NO: 191599 - DNA, 20 bp, human
gtcggtggttgggtccgcgg

SEQ ID NO: 191600 - DNA, 20 bp, human
gcagggcggcgcgagggtag

SEQ ID NO: 191601 - DNA, 20 bp, human
gcgcgagggtagcggtgagt

SEQ ID NO: 191602 - DNA, 20 bp, human
ggagcggccactgggagagg

SEQ ID NO: 191603 - DNA, 20 bp, human
gtgggcgaccgtgccagacg

SEQ ID NO: 191604 - DNA, 20 bp, human
gcgctcgccgccacctacca

SEQ ID NO: 191605 - DNA, 20 bp, human
gaccggcctccgggagtccc

SEQ ID NO: 191606 - DNA, 20 bp, human
gagatggctgcaggagacat

SEQ ID NO: 191607 - DNA, 20 bp, human
gacctgggcacgcggatcgt

SEQ ID NO: 191608 - DNA, 20 bp, human
gcagcgagcgggctgacggg

SEQ ID NO: 191609 - DNA, 20 bp, human
gagccaactctgccgcccgg

SEQ ID NO: 191610 - DNA, 20 bp, human
ggggccccgggaaaacacca

SEQ ID NO: 191611 - DNA, 20 bp, human
gcgcggatcgtgggcatgtg

SEQ ID NO: 191612 - DNA, 20 bp, human
gctgcggcacgtgaagccgg

SEQ ID NO: 191613 - DNA, 20 bp, human
gcctcttctcttcctccggg

SEQ ID NO: 191614 - DNA, 20 bp, human
gagaccctgtcgccggacct

SEQ ID NO: 191615 - DNA, 20 bp, human
gacacaaagagcaggattgg

SEQ ID NO: 191616 - DNA, 20 bp, human
ggtccccctgagccaccgat

SEQ ID NO: 191617 - DNA, 20 bp, human
gtggtgtgcggtgaaagtga

SEQ ID NO: 191618 - DNA, 20 bp, human
gcccctgagccaccgatggg

SEQ ID NO: 191619 - DNA, 20 bp, human
ggagctgggcctgacgaggg

SEQ ID NO: 191620 - DNA, 20 bp, human
gacgagggcggcaaagggac

SEQ ID NO: 191621 - DNA, 20 bp, human
gtgagccaccgatgggtggg

SEQ ID NO: 191622 - DNA, 20 bp, human
ggttgctgcgtcatcgccag

SEQ ID NO: 191623 - DNA, 20 bp, human
gggcggcgcggagatgaccc

SEQ ID NO: 191624 - DNA, 20 bp, human
gggcctgacgagggcggcaa

SEQ ID NO: 191625 - DNA, 20 bp, human
gaggagagctgggcctgacg

SEQ ID NO: 191626 - DNA, 20 bp, human
gggcggatctggacacccag

SEQ ID NO: 191627 - DNA, 20 bp, human
gcgctagtggaagaagatgg

SEQ ID NO: 191628 - DNA, 20 bp, human
gcttccactagcggtagggg

SEQ ID NO: 191629 - DNA, 20 bp, human
gtgaggtgggagcggcacta

SEQ ID NO: 191630 - DNA, 20 bp, human
gcttcttccactagcggtag

SEQ ID NO: 191631 - DNA, 20 bp, human
gcccgaatgataggttatag

SEQ ID NO: 191632 - DNA, 20 bp, human
ggtgggagcggcactacgga

SEQ ID NO: 191633 - DNA, 20 bp, human
ggagcggcactacggaagga

SEQ ID NO: 191634 - DNA, 20 bp, human
ggtcgcgatgtcagaccgct

SEQ ID NO: 191635 - DNA, 20 bp, human
gcggcactacggaaggaagg

SEQ ID NO: 191636 - DNA, 20 bp, human
gcagcccaaaggcccatgag

SEQ ID NO: 191637 - DNA, 20 bp, human
gaggcgccgagcaaatgggt

SEQ ID NO: 191638 - DNA, 20 bp, human
ggccagctccgtcttcctcc

SEQ ID NO: 191639 - DNA, 20 bp, human
gtgggaccagaactcaccca

SEQ ID NO: 191640 - DNA, 20 bp, human
gggtgacgaattgagagcga

SEQ ID NO: 191641 - DNA, 20 bp, human
gcataactgcatcccctcat

SEQ ID NO: 191642 - DNA, 20 bp, human
gctctcaattcgtcaccagg

SEQ ID NO: 191643 - DNA, 20 bp, human
gtggcaggcgccgagcaaat

SEQ ID NO: 191644 - DNA, 20 bp, human
gcagggacttccctatgggt

SEQ ID NO: 191645 - DNA, 20 bp, human
gcgccgagcaaatgggtggg

SEQ ID NO: 191646 - DNA, 20 bp, human
gacgtggaactcagcagcgg

SEQ ID NO: 191647 - DNA, 20 bp, human
gccccggctcagtcccgacg

SEQ ID NO: 191648 - DNA, 20 bp, human
gggcgcttgaggcaagttcg

SEQ ID NO: 191649 - DNA, 20 bp, human
gcgagcgcggggccagacca

SEQ ID NO: 191650 - DNA, 20 bp, human
gagcaggtgcgcggctgcaa

SEQ ID NO: 191651 - DNA, 20 bp, human
gatgtccataatatactcag

SEQ ID NO: 191652 - DNA, 20 bp, human
gcgggcccggagcggaactt

SEQ ID NO: 191653 - DNA, 20 bp, human
gcggaggctggacgcttgca

SEQ ID NO: 191654 - DNA, 20 bp, human
gtccacgtcgggactgagcc

SEQ ID NO: 191655 - DNA, 20 bp, human
gggaactcagcagcggaggc

SEQ ID NO: 191656 - DNA, 20 bp, human
gggccgcggcggcctgttca

SEQ ID NO: 191657 - DNA, 20 bp, human
gggcaacccgctctccgttc

SEQ ID NO: 191658 - DNA, 20 bp, human
gacctgcgccggaaccggaa

SEQ ID NO: 191659 - DNA, 20 bp, human
gggacgtcgaggcgggtaag

SEQ ID NO: 191660 - DNA, 20 bp, human
gggtcagatgtggtactggt

SEQ ID NO: 191661 - DNA, 20 bp, human
ggacccgagccggcctgaaa

SEQ ID NO: 191662 - DNA, 20 bp, human
gcggaaccggaacggagagc

SEQ ID NO: 191663 - DNA, 20 bp, human
gcgaccggggcgctgatctg

SEQ ID NO: 191664 - DNA, 20 bp, human
gtggctgcggcggtctcgct

SEQ ID NO: 191665 - DNA, 20 bp, human
gccagcgagggcaacttcgt

SEQ ID NO: 191666 - DNA, 20 bp, human
gcgctacaggacagcgtccg

SEQ ID NO: 191667 - DNA, 20 bp, human
ggaatccgtcccctcaccta

SEQ ID NO: 191668 - DNA, 20 bp, human
gcgccacgcgcccctaggtg

SEQ ID NO: 191669 - DNA, 20 bp, human
gccgggacccgggctgttgg

SEQ ID NO: 191670 - DNA, 20 bp, human
ggtaagcgtgcgatcacctg

SEQ ID NO: 191671 - DNA, 20 bp, human
ggagcgcgagagccgggacc

SEQ ID NO: 191672 - DNA, 20 bp, human
gaggccggcgagaccgctac

SEQ ID NO: 191673 - DNA, 20 bp, human
gacgaggtgcgcatgctggg

SEQ ID NO: 191674 - DNA, 20 bp, human
gcgtgcgccgccaacagccc

SEQ ID NO: 191675 - DNA, 20 bp, human
gttggcggcgcacgccgggg

SEQ ID NO: 191676 - DNA, 20 bp, human
ggctactgacctgtgtccag

SEQ ID NO: 191677 - DNA, 20 bp, human
gtgggcccggtgggtgtcag

SEQ ID NO: 191678 - DNA, 20 bp, human
ggaagaagtggatgggccca

SEQ ID NO: 191679 - DNA, 20 bp, human
ggtgtccaggggcactggat

SEQ ID NO: 191680 - DNA, 20 bp, human
gggcccagggcagtttctat

SEQ ID NO: 191681 - DNA, 20 bp, human
gagaccaaaggctcctccgg

SEQ ID NO: 191682 - DNA, 20 bp, human
gaggagaaggaaggagaccg

SEQ ID NO: 191683 - DNA, 20 bp, human
gagagaagctcagataccaa

SEQ ID NO: 191684 - DNA, 20 bp, human
ggtgtcaggggcaagaccaa

SEQ ID NO: 191685 - DNA, 20 bp, human
gcagtggaaagcccagaagc

SEQ ID NO: 191686 - DNA, 20 bp, human
gggcgcgcttgactgacagg

SEQ ID NO: 191687 - DNA, 20 bp, human
gctgcgcgtcgcctcagagg

SEQ ID NO: 191688 - DNA, 20 bp, human
ggtcaagcgcgccccctctg

SEQ ID NO: 191689 - DNA, 20 bp, human
gccacagaagcagccggtgg

SEQ ID NO: 191690 - DNA, 20 bp, human
ggcgcttgactgacaggcgg

SEQ ID NO: 191691 - DNA, 20 bp, human
gcttgactgacaggcggcgg

SEQ ID NO: 191692 - DNA, 20 bp, human
ggtgagttccgggccgccac

SEQ ID NO: 191693 - DNA, 20 bp, human
ggggggcgcgcttgactgac

SEQ ID NO: 191694 - DNA, 20 bp, human
gtggggtcgccaatgctcag

SEQ ID NO: 191695 - DNA, 20 bp, human
gtgcgagtgcaggtgagttc

SEQ ID NO: 191696 - DNA, 20 bp, human
gtgcagccgggcccacgggg

SEQ ID NO: 191697 - DNA, 20 bp, human
gccacgggggggctgcacgg

SEQ ID NO: 191698 - DNA, 20 bp, human
gcctgcggcgggagcgatct

SEQ ID NO: 191699 - DNA, 20 bp, human
gcgggcgggaccaacaaaga

SEQ ID NO: 191700 - DNA, 20 bp, human
gccgggtccgcccccctcga

SEQ ID NO: 191701 - DNA, 20 bp, human
gcccggctaaagccctgctg

SEQ ID NO: 191702 - DNA, 20 bp, human
gggattccgtagccaatcag

SEQ ID NO: 191703 - DNA, 20 bp, human
ggcgggagcgatctgggcaa

SEQ ID NO: 191704 - DNA, 20 bp, human
gatggcggcggcccctgcgg

SEQ ID NO: 191705 - DNA, 20 bp, human
ggcctttctgccctcgaggg

SEQ ID NO: 191706 - DNA, 20 bp, human
gtggggctgcgcgatcgccg

SEQ ID NO: 191707 - DNA, 20 bp, human
ggttcgcggagggtgtcgcg

SEQ ID NO: 191708 - DNA, 20 bp, human
gcggaggccggacaaagatg

SEQ ID NO: 191709 - DNA, 20 bp, human
gggacagggaaaggcaacgg

SEQ ID NO: 191710 - DNA, 20 bp, human
gctgcgcgatcgccgagggg

SEQ ID NO: 191711 - DNA, 20 bp, human
ggggcgccgagaacaaagcg

SEQ ID NO: 191712 - DNA, 20 bp, human
gtgtcccggccagagcccga

SEQ ID NO: 191713 - DNA, 20 bp, human
ggaagggagagagttgaggg

SEQ ID NO: 191714 - DNA, 20 bp, human
gctggccgggacaccatggg

SEQ ID NO: 191715 - DNA, 20 bp, human
gcgccgggctgctcgcacct

SEQ ID NO: 191716 - DNA, 20 bp, human
gcgcagggccttgcggatgg

SEQ ID NO: 191717 - DNA, 20 bp, human
gcagcgcacggcgaagctac

SEQ ID NO: 191718 - DNA, 20 bp, human
gggccgggcctcgactacgg

SEQ ID NO: 191719 - DNA, 20 bp, human
gagcggccgggcctcgacta

SEQ ID NO: 191720 - DNA, 20 bp, human
gggccaccgccgctgtccat

SEQ ID NO: 191721 - DNA, 20 bp, human
ggctacgagcccatggacag

SEQ ID NO: 191722 - DNA, 20 bp, human
gcctgcgagccgagctagtg

SEQ ID NO: 191723 - DNA, 20 bp, human
ggagccgagctagtgcggtg

SEQ ID NO: 191724 - DNA, 20 bp, human
gacgagcccatggacagcgg

SEQ ID NO: 191725 - DNA, 20 bp, human
ggcccaagccatggaatcgg

SEQ ID NO: 191726 - DNA, 20 bp, human
gcggcgaaacgccgactgtg

SEQ ID NO: 191727 - DNA, 20 bp, human
gcccaaagcagcccgcggac

SEQ ID NO: 191728 - DNA, 20 bp, human
gaagggagagaggggacgga

SEQ ID NO: 191729 - DNA, 20 bp, human
gagggagcggccgcccggaa

SEQ ID NO: 191730 - DNA, 20 bp, human
gaggacaacgccattccggg

SEQ ID NO: 191731 - DNA, 20 bp, human
gaggaggacaacgccattcc

SEQ ID NO: 191732 - DNA, 20 bp, human
ggagcgcggcgcagaaggtg

SEQ ID NO: 191733 - DNA, 20 bp, human
gagagcgcgagccagtcggg

SEQ ID NO: 191734 - DNA, 20 bp, human
gccgccgtggccctcacagt

SEQ ID NO: 191735 - DNA, 20 bp, human
gagggaggaggactcgcgga

SEQ ID NO: 191736 - DNA, 20 bp, human
gggtggagcgttggtgtgtc

SEQ ID NO: 191737 - DNA, 20 bp, human
gtcgttaagtgggcacgtgg

SEQ ID NO: 191738 - DNA, 20 bp, human
gaaaatgggccccgccacag

SEQ ID NO: 191739 - DNA, 20 bp, human
gcgatcgttaagtgggcacg

SEQ ID NO: 191740 - DNA, 20 bp, human
gttgttttcgatcgttaagt

SEQ ID NO: 191741 - DNA, 20 bp, human
gtaacgatcgaaaacaaaat

SEQ ID NO: 191742 - DNA, 20 bp, human
ggaagcctgcccctgtggcg

SEQ ID NO: 191743 - DNA, 20 bp, human
gtgggccccgccacaggggc

SEQ ID NO: 191744 - DNA, 20 bp, human
gagtaacagaaagagaggcc

SEQ ID NO: 191745 - DNA, 20 bp, human
ggagattcaccatatttctc

SEQ ID NO: 191746 - DNA, 20 bp, human
ggagccgccgccagtggagg

SEQ ID NO: 191747 - DNA, 20 bp, human
gcctcctccgcctccactgg

SEQ ID NO: 191748 - DNA, 20 bp, human
ggcccgagccctgcgagcag

SEQ ID NO: 191749 - DNA, 20 bp, human
gcgacgcggagagggatcgg

SEQ ID NO: 191750 - DNA, 20 bp, human
gcgcggtggatcggagggaa

SEQ ID NO: 191751 - DNA, 20 bp, human
ggcggcgcacgactgcgacg

SEQ ID NO: 191752 - DNA, 20 bp, human
ggaacccgagccggtccggg

SEQ ID NO: 191753 - DNA, 20 bp, human
gctgcgacgcggagagggat

SEQ ID NO: 191754 - DNA, 20 bp, human
gcctgctccgcctcccggac

SEQ ID NO: 191755 - DNA, 20 bp, human
gcctaggctgcggcggggta

SEQ ID NO: 191756 - DNA, 20 bp, human
gaccccctgtcccgcccggc

SEQ ID NO: 191757 - DNA, 20 bp, human
ggagaccggtgacccgcggc

SEQ ID NO: 191758 - DNA, 20 bp, human
ggcgggagaccggtgacccg

SEQ ID NO: 191759 - DNA, 20 bp, human
gggtgagaaacttccgaaag

SEQ ID NO: 191760 - DNA, 20 bp, human
gagctccgcagtcatggccg

SEQ ID NO: 191761 - DNA, 20 bp, human
gcagtaaggtgagccctcct

SEQ ID NO: 191762 - DNA, 20 bp, human
ggcgtgggtgagaaggccaa

SEQ ID NO: 191763 - DNA, 20 bp, human
gggggtgcgcccgccagcgt

SEQ ID NO: 191764 - DNA, 20 bp, human
ggcgcccagccgcgggtcac

SEQ ID NO: 191765 - DNA, 20 bp, human
gcgcggagcccaccgagccg

SEQ ID NO: 191766 - DNA, 20 bp, human
gaccggagtcgtcatgatgg

SEQ ID NO: 191767 - DNA, 20 bp, human
gacctccatcatgacgactc

SEQ ID NO: 191768 - DNA, 20 bp, human
gcttgagccttggggatcga

SEQ ID NO: 191769 - DNA, 20 bp, human
ggtaaccggagtcgtcatga

SEQ ID NO: 191770 - DNA, 20 bp, human
gcttggacttccggctccca

SEQ ID NO: 191771 - DNA, 20 bp, human
ggtacagttccttggacttc

SEQ ID NO: 191772 - DNA, 20 bp, human
gcctgtagtgtcagatagtc

SEQ ID NO: 191773 - DNA, 20 bp, human
gggctctggaaatctcagct

SEQ ID NO: 191774 - DNA, 20 bp, human
gctatctgacactacaggcg

SEQ ID NO: 191775 - DNA, 20 bp, human
gttgaatgtttttacgtaac

SEQ ID NO: 191776 - DNA, 20 bp, human
ggaactccggaggctccgtc

SEQ ID NO: 191777 - DNA, 20 bp, human
ggtcgggcctcgggaaacaa

SEQ ID NO: 191778 - DNA, 20 bp, human
gtccaggacccggcgaggtg

SEQ ID NO: 191779 - DNA, 20 bp, human
gggctagaagcgacaccaga

SEQ ID NO: 191780 - DNA, 20 bp, human
ggccgggccagcgaaggaga

SEQ ID NO: 191781 - DNA, 20 bp, human
gggtgggggcggaggaactc

SEQ ID NO: 191782 - DNA, 20 bp, human
gggaggcctcgagcgcgtgg

SEQ ID NO: 191783 - DNA, 20 bp, human
ggcgaccccgcaacacggac

SEQ ID NO: 191784 - DNA, 20 bp, human
gccgggcgctcggccgacgg

SEQ ID NO: 191785 - DNA, 20 bp, human
gcactccatggccacgagga

SEQ ID NO: 191786 - DNA, 20 bp, human
gtgccgaagaggccgggacc

SEQ ID NO: 191787 - DNA, 20 bp, human
gcggtttcaggcctccggtg

SEQ ID NO: 191788 - DNA, 20 bp, human
ggccggaccgagggatacga

SEQ ID NO: 191789 - DNA, 20 bp, human
gaccgtcgtatccctcggtc

SEQ ID NO: 191790 - DNA, 20 bp, human
gtgggaacaatgacaggagg

SEQ ID NO: 191791 - DNA, 20 bp, human
gacgacggttcccgagacag

SEQ ID NO: 191792 - DNA, 20 bp, human
gccgtcacgggcccaagctg

SEQ ID NO: 191793 - DNA, 20 bp, human
gattgttcccaggacacccg

SEQ ID NO: 191794 - DNA, 20 bp, human
gccgcaggttccgctgtctc

SEQ ID NO: 191795 - DNA, 20 bp, human
gggagtgccccgggtgtcct

SEQ ID NO: 191796 - DNA, 20 bp, human
gggcggcgccctcagagcta

SEQ ID NO: 191797 - DNA, 20 bp, human
gaggccgccgcggtctgggg

SEQ ID NO: 191798 - DNA, 20 bp, human
ggcgccgccccagaccgcgg

SEQ ID NO: 191799 - DNA, 20 bp, human
gcctcctctgcacgctcggt

SEQ ID NO: 191800 - DNA, 20 bp, human
gcggaggccgccgcggtctg

SEQ ID NO: 191801 - DNA, 20 bp, human
gggacagcgtcttgagaacg

SEQ ID NO: 191802 - DNA, 20 bp, human
ggcggcgctgcgggatgcgg

SEQ ID NO: 191803 - DNA, 20 bp, human
ggccgccatgtccaaggtaa

SEQ ID NO: 191804 - DNA, 20 bp, human
ggccgttaccttggacatgg

SEQ ID NO: 191805 - DNA, 20 bp, human
ggagctaaggtgcgagagcg

SEQ ID NO: 191806 - DNA, 20 bp, human
gccttctcctcggcgtccct

SEQ ID NO: 191807 - DNA, 20 bp, human
gtgcctgggaggcccgcgac

SEQ ID NO: 191808 - DNA, 20 bp, human
gtggaggagagaggtcgggt

SEQ ID NO: 191809 - DNA, 20 bp, human
ggtgccaaggagtcacggat

SEQ ID NO: 191810 - DNA, 20 bp, human
gccccccacactaacaagtg

SEQ ID NO: 191811 - DNA, 20 bp, human
gacgaggaggcgctgaggag

SEQ ID NO: 191812 - DNA, 20 bp, human
ggcggaagagtcacgtgatc

SEQ ID NO: 191813 - DNA, 20 bp, human
ggtcacgtgatccggcatgg

SEQ ID NO: 191814 - DNA, 20 bp, human
gacgtgatccggcatggagg

SEQ ID NO: 191815 - DNA, 20 bp, human
gacaagtgcggcttctgccc

SEQ ID NO: 191816 - DNA, 20 bp, human
gcaggaggcggaccccccga

SEQ ID NO: 191817 - DNA, 20 bp, human
gctagtggtcgccctgtcaa

SEQ ID NO: 191818 - DNA, 20 bp, human
gcgtcaggagggccggaaaa

SEQ ID NO: 191819 - DNA, 20 bp, human
gtggtcgccctgtcaacggt

SEQ ID NO: 191820 - DNA, 20 bp, human
gccccccgagggcagcgctg

SEQ ID NO: 191821 - DNA, 20 bp, human
gagaggggcagtgtcgcgtc

SEQ ID NO: 191822 - DNA, 20 bp, human
gggactggcaagcctgagtg

SEQ ID NO: 191823 - DNA, 20 bp, human
gccctgtcaacggtcggtgg

SEQ ID NO: 191824 - DNA, 20 bp, human
gtttgaggaagggtcctcag

SEQ ID NO: 191825 - DNA, 20 bp, human
ggcggcggccccggagacac

SEQ ID NO: 191826 - DNA, 20 bp, human
gcgtgcgggcctagcgcccc

SEQ ID NO: 191827 - DNA, 20 bp, human
ggagaactgcgcagacctgg

SEQ ID NO: 191828 - DNA, 20 bp, human
ggagcgctctgttaaaatgg

SEQ ID NO: 191829 - DNA, 20 bp, human
gccccgacaggccgctaccg

SEQ ID NO: 191830 - DNA, 20 bp, human
gcttcaccgaccagacgccg

SEQ ID NO: 191831 - DNA, 20 bp, human
gtcagtgtgatccgaagcgg

SEQ ID NO: 191832 - DNA, 20 bp, human
ggggcttaggagcggacgag

SEQ ID NO: 191833 - DNA, 20 bp, human
gcccgagcgctctgttaaaa

SEQ ID NO: 191834 - DNA, 20 bp, human
gtgcgagaactgcgcagacc

SEQ ID NO: 191835 - DNA, 20 bp, human
gcgctctgttaaaatggcgg

SEQ ID NO: 191836 - DNA, 20 bp, human
ggggcttcctggatacatag

SEQ ID NO: 191837 - DNA, 20 bp, human
gtccaggaagcccgactctg

SEQ ID NO: 191838 - DNA, 20 bp, human
ggggctgcgggatgaagcat

SEQ ID NO: 191839 - DNA, 20 bp, human
gggggccgcgccgcagagtc

SEQ ID NO: 191840 - DNA, 20 bp, human
gcgaggtgcgtgaaatgggg

SEQ ID NO: 191841 - DNA, 20 bp, human
ggctgggcccggctaggtca

SEQ ID NO: 191842 - DNA, 20 bp, human
ggggcgaggtgcgtgaaatg

SEQ ID NO: 191843 - DNA, 20 bp, human
gccctgggctcgcaagtcca

SEQ ID NO: 191844 - DNA, 20 bp, human
gggcttgtgccaggcggggt

SEQ ID NO: 191845 - DNA, 20 bp, human
ggccagcaagcgaatgtact

SEQ ID NO: 191846 - DNA, 20 bp, human
gggacgctcagggagaacgt

SEQ ID NO: 191847 - DNA, 20 bp, human
gcgggccgaaggagtcgcca

SEQ ID NO: 191848 - DNA, 20 bp, human
gattcaggtcaacttcggag

SEQ ID NO: 191849 - DNA, 20 bp, human
ggaggttgaagtcggaatca

SEQ ID NO: 191850 - DNA, 20 bp, human
gccccggcgacccccatcac

SEQ ID NO: 191851 - DNA, 20 bp, human
ggtgcggccgcagagctcag

SEQ ID NO: 191852 - DNA, 20 bp, human
gtcgcggtgacacgtgtgtg

SEQ ID NO: 191853 - DNA, 20 bp, human
ggcaggattcaggtcaactt

SEQ ID NO: 191854 - DNA, 20 bp, human
ggaggcgccggaggcccgga

SEQ ID NO: 191855 - DNA, 20 bp, human
gcccagcacgcgcaccatcc

SEQ ID NO: 191856 - DNA, 20 bp, human
gagccgagggtaatggaagt

SEQ ID NO: 191857 - DNA, 20 bp, human
gggctccggaccctcggcgc

SEQ ID NO: 191858 - DNA, 20 bp, human
gcgctagctacccctagtca

SEQ ID NO: 191859 - DNA, 20 bp, human
gagccgctctccctgactag

SEQ ID NO: 191860 - DNA, 20 bp, human
gtacccctagtcagggagag

SEQ ID NO: 191861 - DNA, 20 bp, human
gggataccgaacccaaagga

SEQ ID NO: 191862 - DNA, 20 bp, human
ggtagggataccgaacccaa

SEQ ID NO: 191863 - DNA, 20 bp, human
gtaccgaacccaaaggaggg

SEQ ID NO: 191864 - DNA, 20 bp, human
gcagggagagcggctgatgg

SEQ ID NO: 191865 - DNA, 20 bp, human
ggacagcaggccctgttaga

SEQ ID NO: 191866 - DNA, 20 bp, human
ggagtcaggaggcgctgtca

SEQ ID NO: 191867 - DNA, 20 bp, human
ggtgagaagaagccggtcct

SEQ ID NO: 191868 - DNA, 20 bp, human
gagagtgctgggatcagccg

SEQ ID NO: 191869 - DNA, 20 bp, human
ggcaggtcgtgagaagaagc

SEQ ID NO: 191870 - DNA, 20 bp, human
gcccggggcggagatgaact

SEQ ID NO: 191871 - DNA, 20 bp, human
gtcgccacgctgcaaggcca

SEQ ID NO: 191872 - DNA, 20 bp, human
ggcgctgtcacggagagtgc

SEQ ID NO: 191873 - DNA, 20 bp, human
ggcctaagaaccgacacctg

SEQ ID NO: 191874 - DNA, 20 bp, human
gcacctgacccggaactcgg

SEQ ID NO: 191875 - DNA, 20 bp, human
gtgatgctgagtgggatcga

SEQ ID NO: 191876 - DNA, 20 bp, human
gatgtccggccggtctaagc

SEQ ID NO: 191877 - DNA, 20 bp, human
ggtgaagcgggagttcgagc

SEQ ID NO: 191878 - DNA, 20 bp, human
gggccggtagtggagatgtc

SEQ ID NO: 191879 - DNA, 20 bp, human
gtggacgactcggccggtag

SEQ ID NO: 191880 - DNA, 20 bp, human
ggcgcctgcgctggacgact

SEQ ID NO: 191881 - DNA, 20 bp, human
gggccggacatctccactac

SEQ ID NO: 191882 - DNA, 20 bp, human
ggcgagactcccgcttagac

SEQ ID NO: 191883 - DNA, 20 bp, human
gctgcgctggacgactcggc

SEQ ID NO: 191884 - DNA, 20 bp, human
gctccggcgcagtgacctag

SEQ ID NO: 191885 - DNA, 20 bp, human
ggtctcgcggttccactcgc

SEQ ID NO: 191886 - DNA, 20 bp, human
gctaaaaccgagatgactag

SEQ ID NO: 191887 - DNA, 20 bp, human
gtcccaacttcggaggacct

SEQ ID NO: 191888 - DNA, 20 bp, human
gacgcttccccggcaggaat

SEQ ID NO: 191889 - DNA, 20 bp, human
gggcggtgtcccaacttcgg

SEQ ID NO: 191890 - DNA, 20 bp, human
gcgcgtcacgggggaaacgt

SEQ ID NO: 191891 - DNA, 20 bp, human
gtcggaggacctgggcgcgg

SEQ ID NO: 191892 - DNA, 20 bp, human
ggtgggcggtgtcccaactt

SEQ ID NO: 191893 - DNA, 20 bp, human
gccggcaggaatcggttaaa

SEQ ID NO: 191894 - DNA, 20 bp, human
gggccaacggtgagtcctct

SEQ ID NO: 191895 - DNA, 20 bp, human
gcgttgagagagcttcctag

SEQ ID NO: 191896 - DNA, 20 bp, human
gctccgcatccggtcgctca

SEQ ID NO: 191897 - DNA, 20 bp, human
gtgccgtgagcgaccggatg

SEQ ID NO: 191898 - DNA, 20 bp, human
ggtcacacggcgagtcctca

SEQ ID NO: 191899 - DNA, 20 bp, human
gaggttggtggggaccctaa

SEQ ID NO: 191900 - DNA, 20 bp, human
gggtggggaccctaagggtg

SEQ ID NO: 191901 - DNA, 20 bp, human
gggcgagtcctcatggtaaa

SEQ ID NO: 191902 - DNA, 20 bp, human
gggagtgtggtcctcattaa

SEQ ID NO: 191903 - DNA, 20 bp, human
gggaggctgccgtgagcgac

SEQ ID NO: 191904 - DNA, 20 bp, human
gctggagttattctcctgag

SEQ ID NO: 191905 - DNA, 20 bp, human
gactctagccgagaaaaagg

SEQ ID NO: 191906 - DNA, 20 bp, human
ggaacgaacccgccccaact

SEQ ID NO: 191907 - DNA, 20 bp, human
gaacatggcggcgcccagtt

SEQ ID NO: 191908 - DNA, 20 bp, human
gcggcgctctcctggagtcg

SEQ ID NO: 191909 - DNA, 20 bp, human
gagcataggtaccaaatgac

SEQ ID NO: 191910 - DNA, 20 bp, human
gaacgtaaagcgcctagcat

SEQ ID NO: 191911 - DNA, 20 bp, human
gcaggggcgcaaaaaggcag

SEQ ID NO: 191912 - DNA, 20 bp, human
gccgccatgttggcgagggc

SEQ ID NO: 191913 - DNA, 20 bp, human
ggagggacgtgggaagcgta

SEQ ID NO: 191914 - DNA, 20 bp, human
gtcgcttcgcgttttggcca

SEQ ID NO: 191915 - DNA, 20 bp, human
gaaaaaggcagaggtccccg

SEQ ID NO: 191916 - DNA, 20 bp, human
gctagctctgggagcagaca

SEQ ID NO: 191917 - DNA, 20 bp, human
ggagggtttggaccacacat

SEQ ID NO: 191918 - DNA, 20 bp, human
ggcgaccacagaggacaaag

SEQ ID NO: 191919 - DNA, 20 bp, human
gagcagccaagcccttgagt

SEQ ID NO: 191920 - DNA, 20 bp, human
gtgctgggtcacctagctct

SEQ ID NO: 191921 - DNA, 20 bp, human
ggaatcctctgcgaccacag

SEQ ID NO: 191922 - DNA, 20 bp, human
ggagggtgacacaagcgaga

SEQ ID NO: 191923 - DNA, 20 bp, human
gcgtgtgtccatgggagaag

SEQ ID NO: 191924 - DNA, 20 bp, human
gttgtcctctgtggtcgcag

SEQ ID NO: 191925 - DNA, 20 bp, human
gcagttcccactcaagggct

SEQ ID NO: 191926 - DNA, 20 bp, human
gcaatgacgtgcctccatcc

SEQ ID NO: 191927 - DNA, 20 bp, human
gggcggcggtgcccggatgg

SEQ ID NO: 191928 - DNA, 20 bp, human
ggcgctcgctccatccccct

SEQ ID NO: 191929 - DNA, 20 bp, human
gcgcggcgctgacccggagg

SEQ ID NO: 191930 - DNA, 20 bp, human
gggtgggagcgcagtgtcca

SEQ ID NO: 191931 - DNA, 20 bp, human
ggcggctgggctgtgtgcgg

SEQ ID NO: 191932 - DNA, 20 bp, human
ggtcattgtcccccgccggg

SEQ ID NO: 191933 - DNA, 20 bp, human
ggaggtggcagccacgcggg

SEQ ID NO: 191934 - DNA, 20 bp, human
ggcgagcgccgagccgggtc

SEQ ID NO: 191935 - DNA, 20 bp, human
ggggcgcggcgctgacccgg

SEQ ID NO: 191936 - DNA, 20 bp, human
gctcagggcttgaagaacca

SEQ ID NO: 191937 - DNA, 20 bp, human
ggagccttagagaagctgta

SEQ ID NO: 191938 - DNA, 20 bp, human
gtcgtccgcctcgcgcccgg

SEQ ID NO: 191939 - DNA, 20 bp, human
ggcgctggggcgctaccggg

SEQ ID NO: 191940 - DNA, 20 bp, human
ggtgatggcgacggtgaggg

SEQ ID NO: 191941 - DNA, 20 bp, human
gcatcacagtgtcccggctg

SEQ ID NO: 191942 - DNA, 20 bp, human
gcgggacactgtgatggcga

SEQ ID NO: 191943 - DNA, 20 bp, human
gacctgtttcatgaacgcgg

SEQ ID NO: 191944 - DNA, 20 bp, human
gcaggaagcggctgaacagg

SEQ ID NO: 191945 - DNA, 20 bp, human
gcagctccccgccggcgatg

SEQ ID NO: 191946 - DNA, 20 bp, human
gacgagcgtcgtggagaggt

SEQ ID NO: 191947 - DNA, 20 bp, human
gaagatggccgccccggctc

SEQ ID NO: 191948 - DNA, 20 bp, human
gggctggtgagtgtgcgcga

SEQ ID NO: 191949 - DNA, 20 bp, human
gtcgcggccgccgaaccggg

SEQ ID NO: 191950 - DNA, 20 bp, human
ggcgcggccgcggcgattgg

SEQ ID NO: 191951 - DNA, 20 bp, human
gcggcacgagcgtcgtggag

SEQ ID NO: 191952 - DNA, 20 bp, human
gaggggcttcgcgctgatcc

SEQ ID NO: 191953 - DNA, 20 bp, human
gctcactccgccaatcgccg

SEQ ID NO: 191954 - DNA, 20 bp, human
gagagtgcccggagatgctg

SEQ ID NO: 191955 - DNA, 20 bp, human
gccaccgaaacttcccaggg

SEQ ID NO: 191956 - DNA, 20 bp, human
ggatcgcccagtttccatca

SEQ ID NO: 191957 - DNA, 20 bp, human
gctaggaagaggtgcggagt

SEQ ID NO: 191958 - DNA, 20 bp, human
ggaaactgggcgatcctgca

SEQ ID NO: 191959 - DNA, 20 bp, human
gttatccaaaggccgacctg

SEQ ID NO: 191960 - DNA, 20 bp, human
gtgacctctgagttatccaa

SEQ ID NO: 191961 - DNA, 20 bp, human
gatttgccctgatggaaact

SEQ ID NO: 191962 - DNA, 20 bp, human
gaatgatgtaagctaggaag

SEQ ID NO: 191963 - DNA, 20 bp, human
gtctcctaagtgaaaagtcc

SEQ ID NO: 191964 - DNA, 20 bp, human
gccgccaggacttttcactt

SEQ ID NO: 191965 - DNA, 20 bp, human
gaagcttagattcgatgaga

SEQ ID NO: 191966 - DNA, 20 bp, human
ggggcgccgggcggtcaccg

SEQ ID NO: 191967 - DNA, 20 bp, human
gggttgtagacgctgcggcc

SEQ ID NO: 191968 - DNA, 20 bp, human
ggcggggtgagttgagaacg

SEQ ID NO: 191969 - DNA, 20 bp, human
gacgctgcggcccggcccgg

SEQ ID NO: 191970 - DNA, 20 bp, human
gtaagcggtggatggagatg

SEQ ID NO: 191971 - DNA, 20 bp, human
gaggccagccccgacgccca

SEQ ID NO: 191972 - DNA, 20 bp, human
gtgtgtgtgttggtgaccgg

SEQ ID NO: 191973 - DNA, 20 bp, human
ggcctcgcccacccacaagg

SEQ ID NO: 191974 - DNA, 20 bp, human
gggagaagccctgggcgtcg

SEQ ID NO: 191975 - DNA, 20 bp, human
gcgcggcgctttggtcgcag

SEQ ID NO: 191976 - DNA, 20 bp, human
gactgcccatggtggcgcgc

SEQ ID NO: 191977 - DNA, 20 bp, human
gctcgcggcgaggcaaagaa

SEQ ID NO: 191978 - DNA, 20 bp, human
gaaaccgggactgcccatgg

SEQ ID NO: 191979 - DNA, 20 bp, human
gcccgccagcgcgccaccat

SEQ ID NO: 191980 - DNA, 20 bp, human
gcgcttccaccgcaacccga

SEQ ID NO: 191981 - DNA, 20 bp, human
ggcgccaccatgggcagtcc

SEQ ID NO: 191982 - DNA, 20 bp, human
gaaactgaaagccggacccc

SEQ ID NO: 191983 - DNA, 20 bp, human
gttccaccgcaacccgaggg

SEQ ID NO: 191984 - DNA, 20 bp, human
gggcgggttccgaggtcccg

SEQ ID NO: 191985 - DNA, 20 bp, human
gccccgccctcgggttgcgg

SEQ ID NO: 191986 - DNA, 20 bp, human
ggcgcgcagacaccgaccca

SEQ ID NO: 191987 - DNA, 20 bp, human
ggcctgcgctccagcaatag

SEQ ID NO: 191988 - DNA, 20 bp, human
gggaggcgtgaggcagtcgg

SEQ ID NO: 191989 - DNA, 20 bp, human
gtgcgctccagcaatagcgg

SEQ ID NO: 191990 - DNA, 20 bp, human
gggctggacgaataaaggag

SEQ ID NO: 191991 - DNA, 20 bp, human
gggagacccgctggctctag

SEQ ID NO: 191992 - DNA, 20 bp, human
ggtgggtgcggcgagcagtt

SEQ ID NO: 191993 - DNA, 20 bp, human
gacgaaggcggctgtggtag

SEQ ID NO: 191994 - DNA, 20 bp, human
gatagcggaggcctcagcct

SEQ ID NO: 191995 - DNA, 20 bp, human
gtaaggcctaacctcctctg

SEQ ID NO: 191996 - DNA, 20 bp, human
ggtgtgtcgggtgtcgacgg

SEQ ID NO: 191997 - DNA, 20 bp, human
ggcgcgcacaggtgattgac

SEQ ID NO: 191998 - DNA, 20 bp, human
gggggtgtgtcgggtgtcga

SEQ ID NO: 191999 - DNA, 20 bp, human
ggaggacctggcgctccttc

SEQ ID NO: 192000 - DNA, 20 bp, human
ggcctcccaaatgcacgcaa

SEQ ID NO: 192001 - DNA, 20 bp, human
gtgcggccggtcgtgcgggt

SEQ ID NO: 192002 - DNA, 20 bp, human
ggctcctgcgacacctcctc

SEQ ID NO: 192003 - DNA, 20 bp, human
gccctttgcgtgcatttggg

SEQ ID NO: 192004 - DNA, 20 bp, human
gcgcgcccgacccgcacgac

SEQ ID NO: 192005 - DNA, 20 bp, human
gcggcggcagtggcgcgcac

SEQ ID NO: 192006 - DNA, 20 bp, human
gcacgcgcgagctgtcacca

SEQ ID NO: 192007 - DNA, 20 bp, human
gtcgcgcgtgctgatgatgg

SEQ ID NO: 192008 - DNA, 20 bp, human
gtgatggcggtaaatagagg

SEQ ID NO: 192009 - DNA, 20 bp, human
gaccgggtgaggggcgacaa

SEQ ID NO: 192010 - DNA, 20 bp, human
gtgatgatggcggtaaatag

SEQ ID NO: 192011 - DNA, 20 bp, human
gaaggcttggaggcgatgag

SEQ ID NO: 192012 - DNA, 20 bp, human
gagctcgcgcgtgctgatga

SEQ ID NO: 192013 - DNA, 20 bp, human
gttggggcaaaagcgttgaa

SEQ ID NO: 192014 - DNA, 20 bp, human
gaggcgagagccgggagtcg

SEQ ID NO: 192015 - DNA, 20 bp, human
gggtggggaggcagcaaagt

SEQ ID NO: 192016 - DNA, 20 bp, human
ggcgtggggaatgggcttac

SEQ ID NO: 192017 - DNA, 20 bp, human
gaggaagtcgtgctcgttgc

SEQ ID NO: 192018 - DNA, 20 bp, human
gccgcttcgtggagcactgt

SEQ ID NO: 192019 - DNA, 20 bp, human
ggaagctgctgccggtgtca

SEQ ID NO: 192020 - DNA, 20 bp, human
ggctgctgccggtgtcatgg

SEQ ID NO: 192021 - DNA, 20 bp, human
gccttagggacccggatcgt

SEQ ID NO: 192022 - DNA, 20 bp, human
gctgcgcccctagcttagaa

SEQ ID NO: 192023 - DNA, 20 bp, human
gtagcttagaacggcaacga

SEQ ID NO: 192024 - DNA, 20 bp, human
gggccccagcggaatgacca

SEQ ID NO: 192025 - DNA, 20 bp, human
gcaacggcagagtggagcgt

SEQ ID NO: 192026 - DNA, 20 bp, human
gtggagcactaccgagagac

SEQ ID NO: 192027 - DNA, 20 bp, human
ggctacttcgatggcagtgg

SEQ ID NO: 192028 - DNA, 20 bp, human
gtaacgggtagcctgtctct

SEQ ID NO: 192029 - DNA, 20 bp, human
gtgcccagcttgacagctaa

SEQ ID NO: 192030 - DNA, 20 bp, human
gttgagcacccgggaggttg

SEQ ID NO: 192031 - DNA, 20 bp, human
ggattgtttgagcacccggg

SEQ ID NO: 192032 - DNA, 20 bp, human
ggtgggcgacgctacttcga

SEQ ID NO: 192033 - DNA, 20 bp, human
ggggggcaacaaccacgctg

SEQ ID NO: 192034 - DNA, 20 bp, human
gaggctgtaccagctccatc

SEQ ID NO: 192035 - DNA, 20 bp, human
gacccgttagctgtcaagct

SEQ ID NO: 192036 - DNA, 20 bp, human
ggacagtctaggacctcctg

SEQ ID NO: 192037 - DNA, 20 bp, human
gtactcactgataccacagg

SEQ ID NO: 192038 - DNA, 20 bp, human
gtcctaaagggtgacagtct

SEQ ID NO: 192039 - DNA, 20 bp, human
gtctagattagcccagtggt

SEQ ID NO: 192040 - DNA, 20 bp, human
gttggagtggtgcctgatac

SEQ ID NO: 192041 - DNA, 20 bp, human
ggtgggaaagtcaagctcag

SEQ ID NO: 192042 - DNA, 20 bp, human
gccatggaaggtccccggaa

SEQ ID NO: 192043 - DNA, 20 bp, human
gagaaagctgtagtagatca

SEQ ID NO: 192044 - DNA, 20 bp, human
gtctctgagcctgttaacgc

SEQ ID NO: 192045 - DNA, 20 bp, human
gaaaatcagttcgcagctac

SEQ ID NO: 192046 - DNA, 20 bp, human
ggcaccgcggccatgacgct

SEQ ID NO: 192047 - DNA, 20 bp, human
ggccgatgggaggggtcctg

SEQ ID NO: 192048 - DNA, 20 bp, human
gggaggagcctctcctgagg

SEQ ID NO: 192049 - DNA, 20 bp, human
ggagctgctgtgacagcgaa

SEQ ID NO: 192050 - DNA, 20 bp, human
ggaactggcagaagaacctg

SEQ ID NO: 192051 - DNA, 20 bp, human
gtgggtccaggcctcagaca

SEQ ID NO: 192052 - DNA, 20 bp, human
gcctgaggaggcggttgaga

SEQ ID NO: 192053 - DNA, 20 bp, human
ggccggaggagaacttgacg

SEQ ID NO: 192054 - DNA, 20 bp, human
gacagcgaagggggattgaa

SEQ ID NO: 192055 - DNA, 20 bp, human
ggcttgcggcgcgggcaaac

SEQ ID NO: 192056 - DNA, 20 bp, human
gccggtgagcctcggtactg

SEQ ID NO: 192057 - DNA, 20 bp, human
gccgggaactggagcacagg

SEQ ID NO: 192058 - DNA, 20 bp, human
gcacagggtcgggctctggg

SEQ ID NO: 192059 - DNA, 20 bp, human
gttgtcgccgccctcaaaca

SEQ ID NO: 192060 - DNA, 20 bp, human
gcagcagtcagtgtgtctgg

SEQ ID NO: 192061 - DNA, 20 bp, human
ggaggcatctccgccagacg

SEQ ID NO: 192062 - DNA, 20 bp, human
gcgccagacgcggcgagaag

SEQ ID NO: 192063 - DNA, 20 bp, human
ggcggcgagaaggggcgaaa

SEQ ID NO: 192064 - DNA, 20 bp, human
gcgggtgtcggcgtgaagcg

SEQ ID NO: 192065 - DNA, 20 bp, human
ggaaagggctgcgtgacctc

SEQ ID NO: 192066 - DNA, 20 bp, human
gaatcacgagggtatctgtg

SEQ ID NO: 192067 - DNA, 20 bp, human
gcagataccctcgtgattag

SEQ ID NO: 192068 - DNA, 20 bp, human
gggcaagtgatacaagaatg

SEQ ID NO: 192069 - DNA, 20 bp, human
gggaggttgactgtgctgtc

SEQ ID NO: 192070 - DNA, 20 bp, human
gcaagaatggggagggatat

SEQ ID NO: 192071 - DNA, 20 bp, human
gaggactctcaactttcaag

SEQ ID NO: 192072 - DNA, 20 bp, human
gttgagttccttagaattaa

SEQ ID NO: 192073 - DNA, 20 bp, human
gattagaggtcttttgctgg

SEQ ID NO: 192074 - DNA, 20 bp, human
gagatagaagattcaggaac

SEQ ID NO: 192075 - DNA, 20 bp, human
gcaaaagacctctaatcacg

SEQ ID NO: 192076 - DNA, 20 bp, human
ggccgcggcggttaagtatg

SEQ ID NO: 192077 - DNA, 20 bp, human
gctatagctacagggagcca

SEQ ID NO: 192078 - DNA, 20 bp, human
gcgcggctgctatagctaca

SEQ ID NO: 192079 - DNA, 20 bp, human
ggtgagtgcgacaccctcag

SEQ ID NO: 192080 - DNA, 20 bp, human
ggcggcgccggtctgctcta

SEQ ID NO: 192081 - DNA, 20 bp, human
ggccgcatacttaaccgccg

SEQ ID NO: 192082 - DNA, 20 bp, human
ggacctgagtgtgacgtgtg

SEQ ID NO: 192083 - DNA, 20 bp, human
gtcgcgagagctggttgcct

SEQ ID NO: 192084 - DNA, 20 bp, human
ggaaatggggtacagcgacg

SEQ ID NO: 192085 - DNA, 20 bp, human
gggctacattgggaaagaag

SEQ ID NO: 192086 - DNA, 20 bp, human
gacgggccacggccatcgta

SEQ ID NO: 192087 - DNA, 20 bp, human
gggcactagaccctcaccag

SEQ ID NO: 192088 - DNA, 20 bp, human
gcgatggccgtggcccgtgg

SEQ ID NO: 192089 - DNA, 20 bp, human
gaaaaggccagtgcctgtcc

SEQ ID NO: 192090 - DNA, 20 bp, human
ggagggtctagtgcctccac

SEQ ID NO: 192091 - DNA, 20 bp, human
ggagggagcaatcttcacag

SEQ ID NO: 192092 - DNA, 20 bp, human
gcctgacagacccctggtga

SEQ ID NO: 192093 - DNA, 20 bp, human
gtgatggagctaggtacgga

SEQ ID NO: 192094 - DNA, 20 bp, human
gtcacagagggaacagctcg

SEQ ID NO: 192095 - DNA, 20 bp, human
gaccaggggtctgtcaggaa

SEQ ID NO: 192096 - DNA, 20 bp, human
gcaccaagagtgctgcccgg

SEQ ID NO: 192097 - DNA, 20 bp, human
gctggattcttagaagttct

SEQ ID NO: 192098 - DNA, 20 bp, human
gtaaagcatataattcagga

SEQ ID NO: 192099 - DNA, 20 bp, human
ggaatgtgtgaggtaccgcc

SEQ ID NO: 192100 - DNA, 20 bp, human
gtgcactctgtcttcttcta

SEQ ID NO: 192101 - DNA, 20 bp, human
gaagttcttggcagattaaa

SEQ ID NO: 192102 - DNA, 20 bp, human
gtaccgccgggcagcactct

SEQ ID NO: 192103 - DNA, 20 bp, human
gggagaaaaaaaccttgctg

SEQ ID NO: 192104 - DNA, 20 bp, human
gcagactgattatctcacaa

SEQ ID NO: 192105 - DNA, 20 bp, human
gatagataagttactctatg

SEQ ID NO: 192106 - DNA, 20 bp, human
gccgcctcggcgccgagatt

SEQ ID NO: 192107 - DNA, 20 bp, human
gctcctcggcgtcgtcgtcg

SEQ ID NO: 192108 - DNA, 20 bp, human
gggggctccggcagcggacg

SEQ ID NO: 192109 - DNA, 20 bp, human
gctcgcgattcgcccaatct

SEQ ID NO: 192110 - DNA, 20 bp, human
gagcgaggagagcaagcggg

SEQ ID NO: 192111 - DNA, 20 bp, human
ggcggcctcgtcgctcgctg

SEQ ID NO: 192112 - DNA, 20 bp, human
gagcgagcgaggagagcaag

SEQ ID NO: 192113 - DNA, 20 bp, human
gaatgtcacatccgcatggg

SEQ ID NO: 192114 - DNA, 20 bp, human
gggccgcgttccgagagccg

SEQ ID NO: 192115 - DNA, 20 bp, human
ggcggagggcggccggtcgg

SEQ ID NO: 192116 - DNA, 20 bp, human
ggttgtcccactcctctccg

SEQ ID NO: 192117 - DNA, 20 bp, human
gggagtgggacaactcctaa

SEQ ID NO: 192118 - DNA, 20 bp, human
ggaggaaagaggtcaaagtc

SEQ ID NO: 192119 - DNA, 20 bp, human
gagatgggcatttggcgaga

SEQ ID NO: 192120 - DNA, 20 bp, human
gctggggaagaagagaaact

SEQ ID NO: 192121 - DNA, 20 bp, human
gcggagacaagctctgtccg

SEQ ID NO: 192122 - DNA, 20 bp, human
ggtataagtgtccaagagaa

SEQ ID NO: 192123 - DNA, 20 bp, human
gagatggcgtaaaagactca

SEQ ID NO: 192124 - DNA, 20 bp, human
gacaagctctgtccgcggag

SEQ ID NO: 192125 - DNA, 20 bp, human
gcaccagctgctggttaccc

SEQ ID NO: 192126 - DNA, 20 bp, human
gtgacgaggacgggcatccg

SEQ ID NO: 192127 - DNA, 20 bp, human
gggagaggttgcggctccgg

SEQ ID NO: 192128 - DNA, 20 bp, human
gtcacaaccagggcacacgg

SEQ ID NO: 192129 - DNA, 20 bp, human
gcgcgacagaggccctgacg

SEQ ID NO: 192130 - DNA, 20 bp, human
gccgccatattgacgaggac

SEQ ID NO: 192131 - DNA, 20 bp, human
gccgggacgagacctaccct

SEQ ID NO: 192132 - DNA, 20 bp, human
gtgcgggcgtctcaaccaaa

SEQ ID NO: 192133 - DNA, 20 bp, human
gtagcgcccggtgcttgggt

SEQ ID NO: 192134 - DNA, 20 bp, human
gcgcggcgaggagcgagttc

SEQ ID NO: 192135 - DNA, 20 bp, human
ggggccgtcgccggccaagg

SEQ ID NO: 192136 - DNA, 20 bp, human
gcgtggacttagtcattact

SEQ ID NO: 192137 - DNA, 20 bp, human
gctagttctagtggctaaat

SEQ ID NO: 192138 - DNA, 20 bp, human
gaaaatacatgtctcaaatg

SEQ ID NO: 192139 - DNA, 20 bp, human
gtttaaggctctagttctag

SEQ ID NO: 192140 - DNA, 20 bp, human
ggtttcattaggttttataa

SEQ ID NO: 192141 - DNA, 20 bp, human
gaagacttttctgggctcag

SEQ ID NO: 192142 - DNA, 20 bp, human
gggtgtggaaagacttttct

SEQ ID NO: 192143 - DNA, 20 bp, human
gagttaaacaatctgctaat

SEQ ID NO: 192144 - DNA, 20 bp, human
ggaggtagaatactgtttgc

SEQ ID NO: 192145 - DNA, 20 bp, human
gactcactgaaattgtaaag

SEQ ID NO: 192146 - DNA, 20 bp, human
gagcagtccgaggggaacgt

SEQ ID NO: 192147 - DNA, 20 bp, human
ggggttgaacgttgcaacta

SEQ ID NO: 192148 - DNA, 20 bp, human
gctagtggagacgcgagtgg

SEQ ID NO: 192149 - DNA, 20 bp, human
gcagagacgaacaggaccaa

SEQ ID NO: 192150 - DNA, 20 bp, human
gccggaagccgccttcctag

SEQ ID NO: 192151 - DNA, 20 bp, human
gagacgaacaggaccaaagg

SEQ ID NO: 192152 - DNA, 20 bp, human
ggggggaggagcagtccgag

SEQ ID NO: 192153 - DNA, 20 bp, human
ggtcggcgcgctgaaaggat

SEQ ID NO: 192154 - DNA, 20 bp, human
gcgcgtctccactaggaagg

SEQ ID NO: 192155 - DNA, 20 bp, human
ggttcaacccacgttcccct

SEQ ID NO: 192156 - DNA, 20 bp, human
gagcgccagcgtggaccccc

SEQ ID NO: 192157 - DNA, 20 bp, human
gagaagcagcagcatcccgg

SEQ ID NO: 192158 - DNA, 20 bp, human
gcccatggggcccctatggg

SEQ ID NO: 192159 - DNA, 20 bp, human
gcgctggaggcgagccccgg

SEQ ID NO: 192160 - DNA, 20 bp, human
gagcagcagcatcccggcgg

SEQ ID NO: 192161 - DNA, 20 bp, human
gggaggggcgccccccatag

SEQ ID NO: 192162 - DNA, 20 bp, human
ggggtccacgctggcgctgg

SEQ ID NO: 192163 - DNA, 20 bp, human
gcctgggcagctggaagcgt

SEQ ID NO: 192164 - DNA, 20 bp, human
gaaagccggggggtccacgc

SEQ ID NO: 192165 - DNA, 20 bp, human
gttcaggcttctctaaaaaa

SEQ ID NO: 192166 - DNA, 20 bp, human
gggcgcggcgcgcgaggatg

SEQ ID NO: 192167 - DNA, 20 bp, human
gcagcgcgctgggggaactc

SEQ ID NO: 192168 - DNA, 20 bp, human
gggatgctcagaacgcgtgt

SEQ ID NO: 192169 - DNA, 20 bp, human
ggggccggagcagcatcccg

SEQ ID NO: 192170 - DNA, 20 bp, human
gagagggccagacgccgccc

SEQ ID NO: 192171 - DNA, 20 bp, human
gaaggaacttgtagcggcgg

SEQ ID NO: 192172 - DNA, 20 bp, human
gccgacacgcggcggtaggt

SEQ ID NO: 192173 - DNA, 20 bp, human
gcagcgcggccgacacgcgg

SEQ ID NO: 192174 - DNA, 20 bp, human
ggctcgtcgaagggcccggg

SEQ ID NO: 192175 - DNA, 20 bp, human
gccgtctcccgggcgctcca

SEQ ID NO: 192176 - DNA, 20 bp, human
gcaaggctgtacagacatgg

SEQ ID NO: 192177 - DNA, 20 bp, human
gggcagaggcagtgcggatc

SEQ ID NO: 192178 - DNA, 20 bp, human
gggagctgcccattagacgt

SEQ ID NO: 192179 - DNA, 20 bp, human
gtcagtggacttggcggcag

SEQ ID NO: 192180 - DNA, 20 bp, human
gaaagatcagtggagaacgc

SEQ ID NO: 192181 - DNA, 20 bp, human
gtatatccccaaggaaaggg

SEQ ID NO: 192182 - DNA, 20 bp, human
gtatttccggtaggaatcag

SEQ ID NO: 192183 - DNA, 20 bp, human
gtcggaaggcggctaagtcc

SEQ ID NO: 192184 - DNA, 20 bp, human
gttccaaggctgtacagaca

SEQ ID NO: 192185 - DNA, 20 bp, human
gcggtaggaatcagtggact

SEQ ID NO: 192186 - DNA, 20 bp, human
gctctcacatggaccaagaa

SEQ ID NO: 192187 - DNA, 20 bp, human
gagaggtgaagggcaacgag

SEQ ID NO: 192188 - DNA, 20 bp, human
gcggcttgcagagaggtgaa

SEQ ID NO: 192189 - DNA, 20 bp, human
gtggtccatgtgagagaagc

SEQ ID NO: 192190 - DNA, 20 bp, human
gtgcgaaccggcttgcagag

SEQ ID NO: 192191 - DNA, 20 bp, human
gcacaggagccaaaacgtgg

SEQ ID NO: 192192 - DNA, 20 bp, human
gcgaatggccagctcttcag

SEQ ID NO: 192193 - DNA, 20 bp, human
gttaaatcgggccgcgacag

SEQ ID NO: 192194 - DNA, 20 bp, human
gcatcacaggagccaaaacg

SEQ ID NO: 192195 - DNA, 20 bp, human
ggcctgcactgcctgcgcag

SEQ ID NO: 192196 - DNA, 20 bp, human
gggtgagcagccggtcgtgt

SEQ ID NO: 192197 - DNA, 20 bp, human
ggtctgtgagcccacacgac

SEQ ID NO: 192198 - DNA, 20 bp, human
gaagcgtttcctgagttcgg

SEQ ID NO: 192199 - DNA, 20 bp, human
gaggcaccagctcctttcgc

SEQ ID NO: 192200 - DNA, 20 bp, human
ggaagatggcggccggcgaa

SEQ ID NO: 192201 - DNA, 20 bp, human
gtccgccgacccccgaactc

SEQ ID NO: 192202 - DNA, 20 bp, human
gttcgggggtcggcggaaga

SEQ ID NO: 192203 - DNA, 20 bp, human
ggtttcctgagttcgggggt

SEQ ID NO: 192204 - DNA, 20 bp, human
gtagattggaaaatgtctcg

SEQ ID NO: 192205 - DNA, 20 bp, human
gatatagactggaatagact

SEQ ID NO: 192206 - DNA, 20 bp, human
gtgtgtcgccggctccttga

SEQ ID NO: 192207 - DNA, 20 bp, human
gctgctgaactgtgcagggt

SEQ ID NO: 192208 - DNA, 20 bp, human
gcactggcgtaaaaatcaca

SEQ ID NO: 192209 - DNA, 20 bp, human
ggagggagcctcgtaagcaa

SEQ ID NO: 192210 - DNA, 20 bp, human
gctccgggaactaacaacgg

SEQ ID NO: 192211 - DNA, 20 bp, human
gactgtgcagggtagggagc

SEQ ID NO: 192212 - DNA, 20 bp, human
gttaggttcacttcacctga

SEQ ID NO: 192213 - DNA, 20 bp, human
gagtgctgctgaactgtgca

SEQ ID NO: 192214 - DNA, 20 bp, human
gaatctggcatgctcttctg

SEQ ID NO: 192215 - DNA, 20 bp, human
gcccaggctatataggagag

SEQ ID NO: 192216 - DNA, 20 bp, human
gtgggcggtgaagctccggg

SEQ ID NO: 192217 - DNA, 20 bp, human
gcgaggcccgagggtgaggg

SEQ ID NO: 192218 - DNA, 20 bp, human
gcctaacgatgccgccggag

SEQ ID NO: 192219 - DNA, 20 bp, human
ggagcctgggcgacctgcgg

SEQ ID NO: 192220 - DNA, 20 bp, human
ggcgcgggctgggcgcactc

SEQ ID NO: 192221 - DNA, 20 bp, human
gaacgatgccgccggagcgg

SEQ ID NO: 192222 - DNA, 20 bp, human
gctgcgaggcccgagggtga

SEQ ID NO: 192223 - DNA, 20 bp, human
ggcggagcctgggcgacctg

SEQ ID NO: 192224 - DNA, 20 bp, human
gcggcggggagcgctcaggt

SEQ ID NO: 192225 - DNA, 20 bp, human
gagaaacgcaggcgctcacg

SEQ ID NO: 192226 - DNA, 20 bp, human
gctgaggcagcggagacccg

SEQ ID NO: 192227 - DNA, 20 bp, human
ggagcgcgggagcttaggca

SEQ ID NO: 192228 - DNA, 20 bp, human
ggccgcacgtgagaaagtct

SEQ ID NO: 192229 - DNA, 20 bp, human
gtgcaaccgacagtaaggag

SEQ ID NO: 192230 - DNA, 20 bp, human
ggccagaccccataaaacat

SEQ ID NO: 192231 - DNA, 20 bp, human
gacgtgcggcttgagcccct

SEQ ID NO: 192232 - DNA, 20 bp, human
gcactggatgtagtaaacat

SEQ ID NO: 192233 - DNA, 20 bp, human
gcgccgccatgttggagaca

SEQ ID NO: 192234 - DNA, 20 bp, human
gccgtccacgtgacccactc

SEQ ID NO: 192235 - DNA, 20 bp, human
gctcctccttgtctccaaca

SEQ ID NO: 192236 - DNA, 20 bp, human
gggaccgaggccaccggacc

SEQ ID NO: 192237 - DNA, 20 bp, human
gactggcattgagggtactg

SEQ ID NO: 192238 - DNA, 20 bp, human
gttaccgggaccgaggccac

SEQ ID NO: 192239 - DNA, 20 bp, human
gaggcgaatacctataatag

SEQ ID NO: 192240 - DNA, 20 bp, human
gcgggtgaaactggcattga

SEQ ID NO: 192241 - DNA, 20 bp, human
gctgccccgctacctcatgg

SEQ ID NO: 192242 - DNA, 20 bp, human
gcgtggagttgacagttaag

SEQ ID NO: 192243 - DNA, 20 bp, human
ggccaggcatgaagatcaca

SEQ ID NO: 192244 - DNA, 20 bp, human
gctgatgcttcctggtccgg

SEQ ID NO: 192245 - DNA, 20 bp, human
ggggtactggggcgtgcgtg

SEQ ID NO: 192246 - DNA, 20 bp, human
gcagcgcgctcccctaccac

SEQ ID NO: 192247 - DNA, 20 bp, human
ggtctgcaaactccggtggt

SEQ ID NO: 192248 - DNA, 20 bp, human
gcaggcgctccggtaactcg

SEQ ID NO: 192249 - DNA, 20 bp, human
gaggagtctgcaaactccgg

SEQ ID NO: 192250 - DNA, 20 bp, human
ggagctcccaccatcatcat

SEQ ID NO: 192251 - DNA, 20 bp, human
gtgaggacgacgaagatgga

SEQ ID NO: 192252 - DNA, 20 bp, human
ggaggtgctagccctagata

SEQ ID NO: 192253 - DNA, 20 bp, human
ggccctagatatggacgatg

SEQ ID NO: 192254 - DNA, 20 bp, human
ggaagatggagggaatgcgg

SEQ ID NO: 192255 - DNA, 20 bp, human
gcggcgcggagcagctaagt

SEQ ID NO: 192256 - DNA, 20 bp, human
ggggtctccgaacctgaaac

SEQ ID NO: 192257 - DNA, 20 bp, human
gtccgaggtctacaaccccg

SEQ ID NO: 192258 - DNA, 20 bp, human
gtaagacccggctccatgaa

SEQ ID NO: 192259 - DNA, 20 bp, human
gaacacgagcaggaagctcc

SEQ ID NO: 192260 - DNA, 20 bp, human
gttgtagacctcggacctca

SEQ ID NO: 192261 - DNA, 20 bp, human
gtccggacgcgtcggtggta

SEQ ID NO: 192262 - DNA, 20 bp, human
ggacgcgtcggtggtagggc

SEQ ID NO: 192263 - DNA, 20 bp, human
gaagctcccggtttcaggtt

SEQ ID NO: 192264 - DNA, 20 bp, human
gccgggtcttagggctgtaa

SEQ ID NO: 192265 - DNA, 20 bp, human
gcctaatgagcaggaatcct

SEQ ID NO: 192266 - DNA, 20 bp, human
ggtccagatctggtaggtaa

SEQ ID NO: 192267 - DNA, 20 bp, human
gtgaagccagtcctgacaat

SEQ ID NO: 192268 - DNA, 20 bp, human
gggatgggggtgaggatata

SEQ ID NO: 192269 - DNA, 20 bp, human
gtctttcctgccagaaactg

SEQ ID NO: 192270 - DNA, 20 bp, human
gtaggaagtgccacagtttc

SEQ ID NO: 192271 - DNA, 20 bp, human
ggggattatatgcttaatgt

SEQ ID NO: 192272 - DNA, 20 bp, human
gttctgcccattgtcaggac

SEQ ID NO: 192273 - DNA, 20 bp, human
gattcgttctgcccattgtc

SEQ ID NO: 192274 - DNA, 20 bp, human
gaggaagctcaagaaagcta

SEQ ID NO: 192275 - DNA, 20 bp, human
gatatcattaagtccagatc

SEQ ID NO: 192276 - DNA, 20 bp, human
gacccaaaacaagagtacag

SEQ ID NO: 192277 - DNA, 20 bp, human
gatgatcgccacaagataga

SEQ ID NO: 192278 - DNA, 20 bp, human
gaaggaagccgtctatcttg

SEQ ID NO: 192279 - DNA, 20 bp, human
gtttccctggagtcaaggag

SEQ ID NO: 192280 - DNA, 20 bp, human
gagatagacggcttccttct

SEQ ID NO: 192281 - DNA, 20 bp, human
ggaatgggattcctgctcga

SEQ ID NO: 192282 - DNA, 20 bp, human
gaactggttgaatgtagcac

SEQ ID NO: 192283 - DNA, 20 bp, human
gggatatttccctggagtca

SEQ ID NO: 192284 - DNA, 20 bp, human
ggtggcgatcatgtataagc

SEQ ID NO: 192285 - DNA, 20 bp, human
gcctatgaaaagcaaacagc

SEQ ID NO: 192286 - DNA, 20 bp, human
ggacgaccatatcttaccca

SEQ ID NO: 192287 - DNA, 20 bp, human
gcaactacttaagggagatt

SEQ ID NO: 192288 - DNA, 20 bp, human
ggaattacttacccacctgt

SEQ ID NO: 192289 - DNA, 20 bp, human
gtctagatcattcgtaactg

SEQ ID NO: 192290 - DNA, 20 bp, human
gagtagagcttagttgcaaa

SEQ ID NO: 192291 - DNA, 20 bp, human
gacgtaccttgggtaagata

SEQ ID NO: 192292 - DNA, 20 bp, human
ggtgaatttagtgcaatatt

SEQ ID NO: 192293 - DNA, 20 bp, human
gtattgggtaaaattaattt

SEQ ID NO: 192294 - DNA, 20 bp, human
gcaacacggataacaaagtt

SEQ ID NO: 192295 - DNA, 20 bp, human
gcaattaaaaatcctacagg

SEQ ID NO: 192296 - DNA, 20 bp, human
ggccctgagcccgtcgtgag

SEQ ID NO: 192297 - DNA, 20 bp, human
gcgtcgtgaggggtcagaga

SEQ ID NO: 192298 - DNA, 20 bp, human
gggccaccgcacgcagggag

SEQ ID NO: 192299 - DNA, 20 bp, human
ggtggacactccctgagatg

SEQ ID NO: 192300 - DNA, 20 bp, human
ggtccccgagcagcttccct

SEQ ID NO: 192301 - DNA, 20 bp, human
gagtggcacttcggggacgt

SEQ ID NO: 192302 - DNA, 20 bp, human
gagcccagggaagctgctcg

SEQ ID NO: 192303 - DNA, 20 bp, human
gcaggtgaccaccagcgtgt

SEQ ID NO: 192304 - DNA, 20 bp, human
gacccctcacgacgggctca

SEQ ID NO: 192305 - DNA, 20 bp, human
gtagcgctcgctgctcatga

SEQ ID NO: 192306 - DNA, 20 bp, human
gtcatcaccgaaggcaacag

SEQ ID NO: 192307 - DNA, 20 bp, human
ggcgagccgcgagagtgaag

SEQ ID NO: 192308 - DNA, 20 bp, human
gagcctgacagtcgaggaaa

SEQ ID NO: 192309 - DNA, 20 bp, human
gctgacagtcgaggaaaggg

SEQ ID NO: 192310 - DNA, 20 bp, human
gtaaggttgggtatcgtcgt

SEQ ID NO: 192311 - DNA, 20 bp, human
gtagattggctacaactaag

SEQ ID NO: 192312 - DNA, 20 bp, human
ggaggtcgcggcggctgcgt

SEQ ID NO: 192313 - DNA, 20 bp, human
ggtatcgccagccaaccagg

SEQ ID NO: 192314 - DNA, 20 bp, human
gttccttgcagccgctgagg

SEQ ID NO: 192315 - DNA, 20 bp, human
gggctacctggatcacatct

SEQ ID NO: 192316 - DNA, 20 bp, human
ggctcttccttagccagcgg

SEQ ID NO: 192317 - DNA, 20 bp, human
ggcggcggcggctactgtct

SEQ ID NO: 192318 - DNA, 20 bp, human
gccttagccagcggcggcaa

SEQ ID NO: 192319 - DNA, 20 bp, human
gagcagtagtgcctctcggg

SEQ ID NO: 192320 - DNA, 20 bp, human
gcggctcgcagcactcggga

SEQ ID NO: 192321 - DNA, 20 bp, human
gactgaggaagactgtcagg

SEQ ID NO: 192322 - DNA, 20 bp, human
gcggagggctcgcgggactg

SEQ ID NO: 192323 - DNA, 20 bp, human
gtagaaacccgccacccgag

SEQ ID NO: 192324 - DNA, 20 bp, human
ggggttgcactgcggtaata

SEQ ID NO: 192325 - DNA, 20 bp, human
gacggggcccccgaccgacg

SEQ ID NO: 192326 - DNA, 20 bp, human
gagtcgcgtccggagagcag

SEQ ID NO: 192327 - DNA, 20 bp, human
ggcaggggcggccctaacgg

SEQ ID NO: 192328 - DNA, 20 bp, human
gagagccccggggaccgaac

SEQ ID NO: 192329 - DNA, 20 bp, human
gcagcctgcccggataccca

SEQ ID NO: 192330 - DNA, 20 bp, human
ggccgcgtcagcggtaggtg

SEQ ID NO: 192331 - DNA, 20 bp, human
gtacccagggccgagcaccg

SEQ ID NO: 192332 - DNA, 20 bp, human
gtgctcggccctgggtatcc

SEQ ID NO: 192333 - DNA, 20 bp, human
gagagcaggggcggccctaa

SEQ ID NO: 192334 - DNA, 20 bp, human
gaggcgagcggccgcgtcag

SEQ ID NO: 192335 - DNA, 20 bp, human
gcggcgtgcctggtgggatg

SEQ ID NO: 192336 - DNA, 20 bp, human
gcctgctgcacaatgcgcgg

SEQ ID NO: 192337 - DNA, 20 bp, human
ggcggttgacggcagacacg

SEQ ID NO: 192338 - DNA, 20 bp, human
gcagcaggcgggcccccgcg

SEQ ID NO: 192339 - DNA, 20 bp, human
gccagggccctaccgcgcgg

SEQ ID NO: 192340 - DNA, 20 bp, human
gggccgcccgaggactgcta

SEQ ID NO: 192341 - DNA, 20 bp, human
ggcccctagcagtcctcggg

SEQ ID NO: 192342 - DNA, 20 bp, human
gcgggagccgcgcgggtcca

SEQ ID NO: 192343 - DNA, 20 bp, human
gggtccagggccctaccgcg

SEQ ID NO: 192344 - DNA, 20 bp, human
ggtagggccctggacccgcg

SEQ ID NO: 192345 - DNA, 20 bp, human
gggggcccctagcagtcctc

SEQ ID NO: 192346 - DNA, 20 bp, human
gcgccagcaataagaacggt

SEQ ID NO: 192347 - DNA, 20 bp, human
gcgcagcactttctcccccg

SEQ ID NO: 192348 - DNA, 20 bp, human
gtgctggcggcctgaggtaa

SEQ ID NO: 192349 - DNA, 20 bp, human
gaggccgccagcaataagaa

SEQ ID NO: 192350 - DNA, 20 bp, human
ggaacggttggtaggaaccg

SEQ ID NO: 192351 - DNA, 20 bp, human
gcaagcgcggcctttacctc

SEQ ID NO: 192352 - DNA, 20 bp, human
gacccagggacacccaagcg

SEQ ID NO: 192353 - DNA, 20 bp, human
ggccgcgcttgggtgtccct

SEQ ID NO: 192354 - DNA, 20 bp, human
gcgggtccccgagttgggag

SEQ ID NO: 192355 - DNA, 20 bp, human
ggaagtggggacgacatccg

SEQ ID NO: 192356 - DNA, 20 bp, human
gagcgggactcacgagacag

SEQ ID NO: 192357 - DNA, 20 bp, human
ggagtcccgctagtgccggg

SEQ ID NO: 192358 - DNA, 20 bp, human
gggcgtgagaagtccccctg

SEQ ID NO: 192359 - DNA, 20 bp, human
ggctccagcacacctgaccc

SEQ ID NO: 192360 - DNA, 20 bp, human
gcgtgagtcccgctagtgcc

SEQ ID NO: 192361 - DNA, 20 bp, human
gaactcccgcccggcactag

SEQ ID NO: 192362 - DNA, 20 bp, human
gttgttaagcggccagggtc

SEQ ID NO: 192363 - DNA, 20 bp, human
gccgcttaacaactcccgcc

SEQ ID NO: 192364 - DNA, 20 bp, human
ggtcaggggctgcatagcca

SEQ ID NO: 192365 - DNA, 20 bp, human
ggggagttgttaagcggcca

SEQ ID NO: 192366 - DNA, 20 bp, human
ggtggtggatggagacaact

SEQ ID NO: 192367 - DNA, 20 bp, human
gtatagtggagactcggaga

SEQ ID NO: 192368 - DNA, 20 bp, human
gcacccggtgagggacgctg

SEQ ID NO: 192369 - DNA, 20 bp, human
gcctcgcgccgactaccccg

SEQ ID NO: 192370 - DNA, 20 bp, human
ggccactcagacgagaggag

SEQ ID NO: 192371 - DNA, 20 bp, human
ggaggctgcggcgagacacc

SEQ ID NO: 192372 - DNA, 20 bp, human
ggaggcgccactcagacgag

SEQ ID NO: 192373 - DNA, 20 bp, human
gagctagaccgcggggtagt

SEQ ID NO: 192374 - DNA, 20 bp, human
ggtcggcgcgaggcggagct

SEQ ID NO: 192375 - DNA, 20 bp, human
gttccagcgcagctagaccg

SEQ ID NO: 192376 - DNA, 20 bp, human
gaggtcacgcagctcatcgg

SEQ ID NO: 192377 - DNA, 20 bp, human
gcagggctggaccgagacca

SEQ ID NO: 192378 - DNA, 20 bp, human
gggctcgcgctggctccgac

SEQ ID NO: 192379 - DNA, 20 bp, human
gccgagaccagggcttacat

SEQ ID NO: 192380 - DNA, 20 bp, human
gccgggcagccagcgccagt

SEQ ID NO: 192381 - DNA, 20 bp, human
ggggcggccgactcacatgg

SEQ ID NO: 192382 - DNA, 20 bp, human
ggcccgggacggaaagatgg

SEQ ID NO: 192383 - DNA, 20 bp, human
ggctgcccgggacggaaaga

SEQ ID NO: 192384 - DNA, 20 bp, human
gggccacccgatgtaagccc

SEQ ID NO: 192385 - DNA, 20 bp, human
ggaggtcgccctcagttgac

SEQ ID NO: 192386 - DNA, 20 bp, human
gcggcagcggcgacgagaga

SEQ ID NO: 192387 - DNA, 20 bp, human
ggaagcgaagttgggaccgg

SEQ ID NO: 192388 - DNA, 20 bp, human
gagcgggcgctcccgaacca

SEQ ID NO: 192389 - DNA, 20 bp, human
gagagaagcgaagttgggac

SEQ ID NO: 192390 - DNA, 20 bp, human
ggtcagcagagaagcgaagt

SEQ ID NO: 192391 - DNA, 20 bp, human
ggacgtccctgagaggaatg

SEQ ID NO: 192392 - DNA, 20 bp, human
gagtccccgacgtccctgag

SEQ ID NO: 192393 - DNA, 20 bp, human
gcgcagcaccgggccgagag

SEQ ID NO: 192394 - DNA, 20 bp, human
ggcggcgagacgcttcccgg

SEQ ID NO: 192395 - DNA, 20 bp, human
gtcggggactagaaagggaa

SEQ ID NO: 192396 - DNA, 20 bp, human
gcgatcggctcgatgagcgg

SEQ ID NO: 192397 - DNA, 20 bp, human
gcgccgatcggctcgatgag

SEQ ID NO: 192398 - DNA, 20 bp, human
ggctgggagggggagacagt

SEQ ID NO: 192399 - DNA, 20 bp, human
ggggaaggagtaggaagccg

SEQ ID NO: 192400 - DNA, 20 bp, human
gggaattgaggggtactctg

SEQ ID NO: 192401 - DNA, 20 bp, human
gtgggaagagaacagtacca

SEQ ID NO: 192402 - DNA, 20 bp, human
ggagggggagacagttggtg

SEQ ID NO: 192403 - DNA, 20 bp, human
ggttggtgcggacccggcgt

SEQ ID NO: 192404 - DNA, 20 bp, human
gcaggccgccgagcgccgat

SEQ ID NO: 192405 - DNA, 20 bp, human
gagagaacagtaccatggat

SEQ ID NO: 192406 - DNA, 20 bp, human
gaggcagagaagccgggagc

SEQ ID NO: 192407 - DNA, 20 bp, human
ggagtccaaagtccgcgggc

SEQ ID NO: 192408 - DNA, 20 bp, human
gggcttctctgcctgcggag

SEQ ID NO: 192409 - DNA, 20 bp, human
gcccacgagggccagacctg

SEQ ID NO: 192410 - DNA, 20 bp, human
gacgagggccagacctgagg

SEQ ID NO: 192411 - DNA, 20 bp, human
gggagcggccgcagtgccag

SEQ ID NO: 192412 - DNA, 20 bp, human
gtgcggcgcgcagggagtgg

SEQ ID NO: 192413 - DNA, 20 bp, human
gtccggggccgctggcactg

SEQ ID NO: 192414 - DNA, 20 bp, human
gggccggccagccctgcgac

SEQ ID NO: 192415 - DNA, 20 bp, human
gcggagtccgactccaaagt

SEQ ID NO: 192416 - DNA, 20 bp, human
ggccaactgcccgctcccag

SEQ ID NO: 192417 - DNA, 20 bp, human
gagggacgcgggtcagtgca

SEQ ID NO: 192418 - DNA, 20 bp, human
gaactgcccgctcccagagg

SEQ ID NO: 192419 - DNA, 20 bp, human
gcgcttcatgcggaagtcag

SEQ ID NO: 192420 - DNA, 20 bp, human
gctgtccgggcaccctctga

SEQ ID NO: 192421 - DNA, 20 bp, human
gggctcgggacggagggacg

SEQ ID NO: 192422 - DNA, 20 bp, human
gtaactcgaggcctttccag

SEQ ID NO: 192423 - DNA, 20 bp, human
ggagcccgcgcgccctcaga

SEQ ID NO: 192424 - DNA, 20 bp, human
gcgcgcgggctcgggacgga

SEQ ID NO: 192425 - DNA, 20 bp, human
ggtggaggaagggcgaataa

SEQ ID NO: 192426 - DNA, 20 bp, human
ggtgaactgagggccaccct

SEQ ID NO: 192427 - DNA, 20 bp, human
gcctagtcggcttcctccca

SEQ ID NO: 192428 - DNA, 20 bp, human
gagttcagattccagcccag

SEQ ID NO: 192429 - DNA, 20 bp, human
gaccacaccaggcagcgcct

SEQ ID NO: 192430 - DNA, 20 bp, human
ggcaagcaggaagtgaactg

SEQ ID NO: 192431 - DNA, 20 bp, human
gggcgaattcacttactgac

SEQ ID NO: 192432 - DNA, 20 bp, human
gcggcagaagctctcctctc

SEQ ID NO: 192433 - DNA, 20 bp, human
ggcgggggcaggctgaaagt

SEQ ID NO: 192434 - DNA, 20 bp, human
gatggagaaaggacacccaa

SEQ ID NO: 192435 - DNA, 20 bp, human
gataaagtgaaaggccggag

SEQ ID NO: 192436 - DNA, 20 bp, human
gcaatgcccctggagatcaa

SEQ ID NO: 192437 - DNA, 20 bp, human
gggagatcaacggcactaag

SEQ ID NO: 192438 - DNA, 20 bp, human
gaaatactacccacgaccgg

SEQ ID NO: 192439 - DNA, 20 bp, human
gtgccgccaagcaaggaatc

SEQ ID NO: 192440 - DNA, 20 bp, human
gtagtgccgttgatctccag

SEQ ID NO: 192441 - DNA, 20 bp, human
gcgccggattccttgcttgg

SEQ ID NO: 192442 - DNA, 20 bp, human
gcaggacctgcaaagaaccg

SEQ ID NO: 192443 - DNA, 20 bp, human
gttccttgcttggcggcagg

SEQ ID NO: 192444 - DNA, 20 bp, human
gatccggcgccgccggtcgt

SEQ ID NO: 192445 - DNA, 20 bp, human
gcgaggtttcaaagcagtag

SEQ ID NO: 192446 - DNA, 20 bp, human
gccgcggtctcggctcacag

SEQ ID NO: 192447 - DNA, 20 bp, human
gcccggcacgcgcaccgaag

SEQ ID NO: 192448 - DNA, 20 bp, human
ggagcgttggaggcaccggg

SEQ ID NO: 192449 - DNA, 20 bp, human
gccgaaggggcgcactccaa

SEQ ID NO: 192450 - DNA, 20 bp, human
gggtgtgagcagggaacccc

SEQ ID NO: 192451 - DNA, 20 bp, human
gcactccaaaggccagcccg

SEQ ID NO: 192452 - DNA, 20 bp, human
ggaaagcagcagtgcagcgg

SEQ ID NO: 192453 - DNA, 20 bp, human
gcccactccttggggtcccg

SEQ ID NO: 192454 - DNA, 20 bp, human
gcaggaggggcgcaacgcat

SEQ ID NO: 192455 - DNA, 20 bp, human
gggggagaaagggacgtccg

SEQ ID NO: 192456 - DNA, 20 bp, human
gcggagcgctgcggatacaa

SEQ ID NO: 192457 - DNA, 20 bp, human
ggggggccaggggggaatag

SEQ ID NO: 192458 - DNA, 20 bp, human
ggaccccagagcgagcgggg

SEQ ID NO: 192459 - DNA, 20 bp, human
gatggcgggaccaaggatca

SEQ ID NO: 192460 - DNA, 20 bp, human
ggaactcggcgctcctggac

SEQ ID NO: 192461 - DNA, 20 bp, human
ggtgcagtggggaagcggac

SEQ ID NO: 192462 - DNA, 20 bp, human
gggtactccgctgtgcagtg

SEQ ID NO: 192463 - DNA, 20 bp, human
gggctcccatggcgggacca

SEQ ID NO: 192464 - DNA, 20 bp, human
gcccacccggcagttcgcag

SEQ ID NO: 192465 - DNA, 20 bp, human
gttccccctcaaggccccgg

SEQ ID NO: 192466 - DNA, 20 bp, human
gcaccgaaccggtgacacag

SEQ ID NO: 192467 - DNA, 20 bp, human
gaaagcagccgggaaaggga

SEQ ID NO: 192468 - DNA, 20 bp, human
gcacgcagaggccgtcacgt

SEQ ID NO: 192469 - DNA, 20 bp, human
gtgggcggctgggcacccga

SEQ ID NO: 192470 - DNA, 20 bp, human
gcgggaaagggaaggcgccg

SEQ ID NO: 192471 - DNA, 20 bp, human
gcgcgcacgtaggcacgcag

SEQ ID NO: 192472 - DNA, 20 bp, human
gcaagaaagcagccgggaaa

SEQ ID NO: 192473 - DNA, 20 bp, human
gatgaagcgggccggagcaa

SEQ ID NO: 192474 - DNA, 20 bp, human
gttcgccatggcccctgagg

SEQ ID NO: 192475 - DNA, 20 bp, human
ggccgtcacgtgggtcgccg

SEQ ID NO: 192476 - DNA, 20 bp, human
gcgggggtcctctaccgggt

SEQ ID NO: 192477 - DNA, 20 bp, human
gacgggcgggggtcctctac

SEQ ID NO: 192478 - DNA, 20 bp, human
gctacgcggtgcaggcgcag

SEQ ID NO: 192479 - DNA, 20 bp, human
ggtgcaggcgcaggggcgga

SEQ ID NO: 192480 - DNA, 20 bp, human
ggtcagctcgccgggcaccg

SEQ ID NO: 192481 - DNA, 20 bp, human
gcgccccggtgacctctcag

SEQ ID NO: 192482 - DNA, 20 bp, human
ggccactccgggcagttctg

SEQ ID NO: 192483 - DNA, 20 bp, human
ggacccctgagaggtcaccg

SEQ ID NO: 192484 - DNA, 20 bp, human
gtccccagaactgcccggag

SEQ ID NO: 192485 - DNA, 20 bp, human
gccggcgcggcgggtgacgt

SEQ ID NO: 192486 - DNA, 20 bp, human
gtgccggggcggcgatctta

SEQ ID NO: 192487 - DNA, 20 bp, human
gcacaaaggggggaacacgt

SEQ ID NO: 192488 - DNA, 20 bp, human
gtcgagcgggcagagacggt

SEQ ID NO: 192489 - DNA, 20 bp, human
gcggcgatcttagggaacta

SEQ ID NO: 192490 - DNA, 20 bp, human
gagtagagaggggaccctca

SEQ ID NO: 192491 - DNA, 20 bp, human
gacgggagcgtcgtgctcag

SEQ ID NO: 192492 - DNA, 20 bp, human
ggcagacacccgagtcccat

SEQ ID NO: 192493 - DNA, 20 bp, human
gaaggctctcaggagcgggt

SEQ ID NO: 192494 - DNA, 20 bp, human
gccgggcggaggagtcgagc

SEQ ID NO: 192495 - DNA, 20 bp, human
gcggcgaaggagctcccgtg

SEQ ID NO: 192496 - DNA, 20 bp, human
gagcgtctcccacttcccgg

SEQ ID NO: 192497 - DNA, 20 bp, human
gaatccaccaaacccgaccc

SEQ ID NO: 192498 - DNA, 20 bp, human
gaggccccgccgctatccca

SEQ ID NO: 192499 - DNA, 20 bp, human
ggctatcccagggcgccccg

SEQ ID NO: 192500 - DNA, 20 bp, human
ggatagggctcagaaactca

SEQ ID NO: 192501 - DNA, 20 bp, human
gagggccacgttccagggtc

SEQ ID NO: 192502 - DNA, 20 bp, human
gcacgttccagggtcgggtt

SEQ ID NO: 192503 - DNA, 20 bp, human
gcatggagccacggatatca

SEQ ID NO: 192504 - DNA, 20 bp, human
gggaagagccctgatatccg

SEQ ID NO: 192505 - DNA, 20 bp, human
gtgcactctagctctcaagg

SEQ ID NO: 192506 - DNA, 20 bp, human
gccaggctgaggtcactgag

SEQ ID NO: 192507 - DNA, 20 bp, human
gggccgtagtcgagcctggt

SEQ ID NO: 192508 - DNA, 20 bp, human
gcgtagtcgagcctggtggg

SEQ ID NO: 192509 - DNA, 20 bp, human
gcaccagccgagccatcgca

SEQ ID NO: 192510 - DNA, 20 bp, human
ggtctcagcgggaggacggc

SEQ ID NO: 192511 - DNA, 20 bp, human
gtcagcgggaccggctcggg

SEQ ID NO: 192512 - DNA, 20 bp, human
gcgagcagcgatcggctggt

SEQ ID NO: 192513 - DNA, 20 bp, human
gctgggactggctgcagcat

SEQ ID NO: 192514 - DNA, 20 bp, human
gtcgctgctcggcgaagctg

SEQ ID NO: 192515 - DNA, 20 bp, human
ggcggcggagtccccagaaa

SEQ ID NO: 192516 - DNA, 20 bp, human
ggatgcggagcgcaagatgt

SEQ ID NO: 192517 - DNA, 20 bp, human
gtgtagcatgaaggaacagg

SEQ ID NO: 192518 - DNA, 20 bp, human
gaggggagccacgaacgtgc

SEQ ID NO: 192519 - DNA, 20 bp, human
gtggccacatctgaggaccc

SEQ ID NO: 192520 - DNA, 20 bp, human
ggcctatcaccgggagggac

SEQ ID NO: 192521 - DNA, 20 bp, human
gaacattcgagaatgggaca

SEQ ID NO: 192522 - DNA, 20 bp, human
ggcctgcagccagtccctcc

SEQ ID NO: 192523 - DNA, 20 bp, human
gtccagcgcctatcaccggg

SEQ ID NO: 192524 - DNA, 20 bp, human
ggagttccagcgcctatcac

SEQ ID NO: 192525 - DNA, 20 bp, human
ggacagcttgtgtagcatga

SEQ ID NO: 192526 - DNA, 20 bp, human
gccgtgggaggaggaagcat

SEQ ID NO: 192527 - DNA, 20 bp, human
ggaggaggaagcatgggacg

SEQ ID NO: 192528 - DNA, 20 bp, human
ggacccgccaggaaagactg

SEQ ID NO: 192529 - DNA, 20 bp, human
gtccggagtcggctcgctgg

SEQ ID NO: 192530 - DNA, 20 bp, human
ggcctccagcgagccgactc

SEQ ID NO: 192531 - DNA, 20 bp, human
ggtccgcgtccacccgcccc

SEQ ID NO: 192532 - DNA, 20 bp, human
ggtccacccgccccgggctc

SEQ ID NO: 192533 - DNA, 20 bp, human
gcatgccggaggcccagccg

SEQ ID NO: 192534 - DNA, 20 bp, human
gtcgggacccaggaccccct

SEQ ID NO: 192535 - DNA, 20 bp, human
gcggcccaggtgaccgtgtg

SEQ ID NO: 192536 - DNA, 20 bp, human
gctgtagccgccaccggcaa

SEQ ID NO: 192537 - DNA, 20 bp, human
gagcgcgcaccccttgccgg

SEQ ID NO: 192538 - DNA, 20 bp, human
gcctcaggcggtctgatgag

SEQ ID NO: 192539 - DNA, 20 bp, human
ggtaacactgtagccgccac

SEQ ID NO: 192540 - DNA, 20 bp, human
gcaggaagccggactctatg

SEQ ID NO: 192541 - DNA, 20 bp, human
gccgggagcagccagcccgt

SEQ ID NO: 192542 - DNA, 20 bp, human
gctcccccccagctagctcc

SEQ ID NO: 192543 - DNA, 20 bp, human
ggtcgtggagaagtgatcga

SEQ ID NO: 192544 - DNA, 20 bp, human
ggagcttggggagtcagtcg

SEQ ID NO: 192545 - DNA, 20 bp, human
gcccagcgcgcaccccttgc

SEQ ID NO: 192546 - DNA, 20 bp, human
ggccatgtccgacgagagag

SEQ ID NO: 192547 - DNA, 20 bp, human
gacgagagcgcacagctgga

SEQ ID NO: 192548 - DNA, 20 bp, human
gctgtcactccgggcatgga

SEQ ID NO: 192549 - DNA, 20 bp, human
gtgggcagtggggcacgagt

SEQ ID NO: 192550 - DNA, 20 bp, human
ggacgagagagaggtagccg

SEQ ID NO: 192551 - DNA, 20 bp, human
gacctctctctcgtcggaca

SEQ ID NO: 192552 - DNA, 20 bp, human
ggcgggtgttgtgatcgcag

SEQ ID NO: 192553 - DNA, 20 bp, human
gaaggtgagcgggttgcgta

SEQ ID NO: 192554 - DNA, 20 bp, human
gggctttggaggctacgaca

SEQ ID NO: 192555 - DNA, 20 bp, human
gcgcctctgcctgtcactcc

SEQ ID NO: 192556 - DNA, 20 bp, human
gttcaacaggaggaacccgc

SEQ ID NO: 192557 - DNA, 20 bp, human
gtcgagggcgcggggcgcac

SEQ ID NO: 192558 - DNA, 20 bp, human
ggcgcgcggcggttctaccc

SEQ ID NO: 192559 - DNA, 20 bp, human
gggctctgagacccgggtga

SEQ ID NO: 192560 - DNA, 20 bp, human
gccatgcccgagcctcagga

SEQ ID NO: 192561 - DNA, 20 bp, human
gggttcctcctgttgaatgt

SEQ ID NO: 192562 - DNA, 20 bp, human
gcctccccgggccaaagctg

SEQ ID NO: 192563 - DNA, 20 bp, human
ggagtggggctcctctcccg

SEQ ID NO: 192564 - DNA, 20 bp, human
gccttggccatggcgctcga

SEQ ID NO: 192565 - DNA, 20 bp, human
ggcatcccacattcaacagg

SEQ ID NO: 192566 - DNA, 20 bp, human
ggtcgctccacaggcgagca

SEQ ID NO: 192567 - DNA, 20 bp, human
gtccacctctgggcctgcaa

SEQ ID NO: 192568 - DNA, 20 bp, human
ggcactagctgtcgctccac

SEQ ID NO: 192569 - DNA, 20 bp, human
ggggcccgtgaacccacaca

SEQ ID NO: 192570 - DNA, 20 bp, human
ggacgtgctgctccacctct

SEQ ID NO: 192571 - DNA, 20 bp, human
gcccggggctgacagtcgag

SEQ ID NO: 192572 - DNA, 20 bp, human
gagcagggcaggcgtgcggg

SEQ ID NO: 192573 - DNA, 20 bp, human
ggaatatgcttacaggtcca

SEQ ID NO: 192574 - DNA, 20 bp, human
gtaactgtcgccctgagagg

SEQ ID NO: 192575 - DNA, 20 bp, human
gtggcccaggccctccggga

SEQ ID NO: 192576 - DNA, 20 bp, human
gctgcgactcgacgactcgg

SEQ ID NO: 192577 - DNA, 20 bp, human
gcgagaggagcccgaggagt

SEQ ID NO: 192578 - DNA, 20 bp, human
gggtggggcgaacaaagcgg

SEQ ID NO: 192579 - DNA, 20 bp, human
ggcgggtggggcgaacaaag

SEQ ID NO: 192580 - DNA, 20 bp, human
gcgagggccacaccacccgg

SEQ ID NO: 192581 - DNA, 20 bp, human
ggcgccccgagcgcagaatg

SEQ ID NO: 192582 - DNA, 20 bp, human
gtgcgccaggtcgaagacca

SEQ ID NO: 192583 - DNA, 20 bp, human
gtggcgcccgcgggcccgac

SEQ ID NO: 192584 - DNA, 20 bp, human
gctgaacgcggaggtcgcag

SEQ ID NO: 192585 - DNA, 20 bp, human
ggcgcgggcgggatgccccg

SEQ ID NO: 192586 - DNA, 20 bp, human
gcctgaaggagatcaacctg

SEQ ID NO: 192587 - DNA, 20 bp, human
gcgagtcccaggtcacccgg

SEQ ID NO: 192588 - DNA, 20 bp, human
gcagctgcttaacaacctcc

SEQ ID NO: 192589 - DNA, 20 bp, human
gaggtcacccggtggttggt

SEQ ID NO: 192590 - DNA, 20 bp, human
ggcgcactccatcaacctga

SEQ ID NO: 192591 - DNA, 20 bp, human
ggccgcagatgtcccaggtg

SEQ ID NO: 192592 - DNA, 20 bp, human
gcgcgcgggactcgctgcag

SEQ ID NO: 192593 - DNA, 20 bp, human
ggcccgggtgcgccgcgacc

SEQ ID NO: 192594 - DNA, 20 bp, human
gagcaggactccatcgcgga

SEQ ID NO: 192595 - DNA, 20 bp, human
ggccgcgtcccggagccgtc

SEQ ID NO: 192596 - DNA, 20 bp, human
gcctggtccgaggtagggat

SEQ ID NO: 192597 - DNA, 20 bp, human
gggacactggacgtgctcag

SEQ ID NO: 192598 - DNA, 20 bp, human
gcctacctcggaccaggatc

SEQ ID NO: 192599 - DNA, 20 bp, human
gacctcggaccaggatccgg

SEQ ID NO: 192600 - DNA, 20 bp, human
gtgtccccagcctggcgatc

SEQ ID NO: 192601 - DNA, 20 bp, human
gccggcccggcgacaggcaa

SEQ ID NO: 192602 - DNA, 20 bp, human
gctacctgatcgccaggctg

SEQ ID NO: 192603 - DNA, 20 bp, human
ggaacgcgcacaaggagagt

SEQ ID NO: 192604 - DNA, 20 bp, human
gtgtctggtttcccgaacat

SEQ ID NO: 192605 - DNA, 20 bp, human
gggagagcaagggcgcggag

SEQ ID NO: 192606 - DNA, 20 bp, human
gacttgcgagctgatggcgg

SEQ ID NO: 192607 - DNA, 20 bp, human
ggccactgccaacccctcta

SEQ ID NO: 192608 - DNA, 20 bp, human
gcggtcagcatgggcgatgg

SEQ ID NO: 192609 - DNA, 20 bp, human
gtggcagtggcggtcagcat

SEQ ID NO: 192610 - DNA, 20 bp, human
gggctggctccgccgtagag

SEQ ID NO: 192611 - DNA, 20 bp, human
gggctccgccgtagaggggt

SEQ ID NO: 192612 - DNA, 20 bp, human
ggccgtagaggggttggcag

SEQ ID NO: 192613 - DNA, 20 bp, human
gcccgagaggcggagaaacg

SEQ ID NO: 192614 - DNA, 20 bp, human
gggtggccacagcccaacgg

SEQ ID NO: 192615 - DNA, 20 bp, human
ggcagcgaatgggaccgaag

SEQ ID NO: 192616 - DNA, 20 bp, human
gcggccgttaaggacagttg

SEQ ID NO: 192617 - DNA, 20 bp, human
gcgagcgcgcgactgcctcc

SEQ ID NO: 192618 - DNA, 20 bp, human
ggcagggggacgaaaaccgg

SEQ ID NO: 192619 - DNA, 20 bp, human
gcgcgctcgcatccccaaga

SEQ ID NO: 192620 - DNA, 20 bp, human
gcaacagtcgaggcctgggt

SEQ ID NO: 192621 - DNA, 20 bp, human
gaatggccacagggaatggg

SEQ ID NO: 192622 - DNA, 20 bp, human
gccttaacggccgccatctt

SEQ ID NO: 192623 - DNA, 20 bp, human
gcccctgctggttggaaaag

SEQ ID NO: 192624 - DNA, 20 bp, human
gttgccacaactgtccttaa

SEQ ID NO: 192625 - DNA, 20 bp, human
gccagcagggggacgaaaac

SEQ ID NO: 192626 - DNA, 20 bp, human
gtatctgcatcgggcctcac

SEQ ID NO: 192627 - DNA, 20 bp, human
gacaggtgggacacaaataa

SEQ ID NO: 192628 - DNA, 20 bp, human
gaggagctgaataccctccc

SEQ ID NO: 192629 - DNA, 20 bp, human
gaggcccgatgcagataccg

SEQ ID NO: 192630 - DNA, 20 bp, human
ggtcccacctgtgtgtgcct

SEQ ID NO: 192631 - DNA, 20 bp, human
gcactccgcggtatctgcat

SEQ ID NO: 192632 - DNA, 20 bp, human
gctgactgaagccaaaacca

SEQ ID NO: 192633 - DNA, 20 bp, human
gggatcacgaccatcttccc

SEQ ID NO: 192634 - DNA, 20 bp, human
gtgacctcattgtcaagtat

SEQ ID NO: 192635 - DNA, 20 bp, human
ggactttctatttcactccg

SEQ ID NO: 192636 - DNA, 20 bp, human
gggcgaagttaagaaaatgt

SEQ ID NO: 192637 - DNA, 20 bp, human
ggctgccccgagcctttctg

SEQ ID NO: 192638 - DNA, 20 bp, human
gctggagttcttccccagaa

SEQ ID NO: 192639 - DNA, 20 bp, human
gtcttccccagaaaggctcg

SEQ ID NO: 192640 - DNA, 20 bp, human
gattaaggcaaagagctgta

SEQ ID NO: 192641 - DNA, 20 bp, human
ggacaaaagaaacccagggt

SEQ ID NO: 192642 - DNA, 20 bp, human
gcgcaacagccgagaacatt

SEQ ID NO: 192643 - DNA, 20 bp, human
gccgagaacattaggtgttg

SEQ ID NO: 192644 - DNA, 20 bp, human
gttggggagaggcatacaga

SEQ ID NO: 192645 - DNA, 20 bp, human
gtcgcctgcaagttcaaatg

SEQ ID NO: 192646 - DNA, 20 bp, human
gccgcgggcgacagagaagt

SEQ ID NO: 192647 - DNA, 20 bp, human
ggacagagaagtaggatcca

SEQ ID NO: 192648 - DNA, 20 bp, human
ggatccacggggccgggaac

SEQ ID NO: 192649 - DNA, 20 bp, human
ggagcggggcggcgaaccgc

SEQ ID NO: 192650 - DNA, 20 bp, human
gcaggcgccgagggttcgaa

SEQ ID NO: 192651 - DNA, 20 bp, human
gacagactgtgcagcgacta

SEQ ID NO: 192652 - DNA, 20 bp, human
ggaggctcaggactcgctca

SEQ ID NO: 192653 - DNA, 20 bp, human
gctgcgcgctcacccggacg

SEQ ID NO: 192654 - DNA, 20 bp, human
ggcacagtctgtctcttcgc

SEQ ID NO: 192655 - DNA, 20 bp, human
gtgcagcgactacggagtcg

SEQ ID NO: 192656 - DNA, 20 bp, human
ggctccggagtttatcctcc

SEQ ID NO: 192657 - DNA, 20 bp, human
gagaaggagcaagaagtgtc

SEQ ID NO: 192658 - DNA, 20 bp, human
gcgcgaggtggcagtggcag

SEQ ID NO: 192659 - DNA, 20 bp, human
gtggctcctgatccgcgagg

SEQ ID NO: 192660 - DNA, 20 bp, human
ggcagcgacgactcaaacga

SEQ ID NO: 192661 - DNA, 20 bp, human
gcgtgggcgcgtcagagagg

SEQ ID NO: 192662 - DNA, 20 bp, human
gggccgtgggcgcgtcagag

SEQ ID NO: 192663 - DNA, 20 bp, human
ggagtgaggggccgtggacc

SEQ ID NO: 192664 - DNA, 20 bp, human
gggcgtcgggcgaacaacgc

SEQ ID NO: 192665 - DNA, 20 bp, human
gcgcgggtaacggctacgag

SEQ ID NO: 192666 - DNA, 20 bp, human
gggtggtggccgttacgttc

SEQ ID NO: 192667 - DNA, 20 bp, human
ggccgttgccccgaacgtaa

SEQ ID NO: 192668 - DNA, 20 bp, human
gtcgatgctgacagaaccgg

SEQ ID NO: 192669 - DNA, 20 bp, human
ggcctgcgcacactcaatga

SEQ ID NO: 192670 - DNA, 20 bp, human
gacgttcggggcaacggcta

SEQ ID NO: 192671 - DNA, 20 bp, human
gatccgggcagctcccggaa

SEQ ID NO: 192672 - DNA, 20 bp, human
ggctcccggaaaggattctc

SEQ ID NO: 192673 - DNA, 20 bp, human
gtgcccggatccgaagtgtc

SEQ ID NO: 192674 - DNA, 20 bp, human
gcgcctgacacttcggatcc

SEQ ID NO: 192675 - DNA, 20 bp, human
gccgccgacgccaaggacga

SEQ ID NO: 192676 - DNA, 20 bp, human
gctcgctggaggacccactg

SEQ ID NO: 192677 - DNA, 20 bp, human
ggatacgctggagtcctcgc

SEQ ID NO: 192678 - DNA, 20 bp, human
gacgctggagtcctcgctgg

SEQ ID NO: 192679 - DNA, 20 bp, human
gtgcgcccggcaacagaaag

SEQ ID NO: 192680 - DNA, 20 bp, human
gtacagcagtatagctccgg

SEQ ID NO: 192681 - DNA, 20 bp, human
ggtagcagccatgagcccca

SEQ ID NO: 192682 - DNA, 20 bp, human
gcccgccagctcttacccga

SEQ ID NO: 192683 - DNA, 20 bp, human
gtcgcacaaagctccgcagt

SEQ ID NO: 192684 - DNA, 20 bp, human
gggcgcaatggcggatacgc

SEQ ID NO: 192685 - DNA, 20 bp, human
gataacgtcgactgaggtgt

SEQ ID NO: 192686 - DNA, 20 bp, human
gctcaacgtctcgcaacggt

SEQ ID NO: 192687 - DNA, 20 bp, human
gcctccggccaaggccacgg

SEQ ID NO: 192688 - DNA, 20 bp, human
ggctgagggagctcctggct

SEQ ID NO: 192689 - DNA, 20 bp, human
gctggctgggctggtcgctg

SEQ ID NO: 192690 - DNA, 20 bp, human
gcagcacgagctgccgccgg

SEQ ID NO: 192691 - DNA, 20 bp, human
gagggaaaagcagttcgtag

SEQ ID NO: 192692 - DNA, 20 bp, human
gcctcagcacgagctgccgc

SEQ ID NO: 192693 - DNA, 20 bp, human
gtttcctgcctccgtggcct

SEQ ID NO: 192694 - DNA, 20 bp, human
gttcctctttcctgcctccg

SEQ ID NO: 192695 - DNA, 20 bp, human
gagggagctcctggctgggc

SEQ ID NO: 192696 - DNA, 20 bp, human
gctcgctcggctccgctccc

SEQ ID NO: 192697 - DNA, 20 bp, human
gcccgccgccacatcctctg

SEQ ID NO: 192698 - DNA, 20 bp, human
ggggctgcgacgcggaggca

SEQ ID NO: 192699 - DNA, 20 bp, human
ggaggcagggagccgagcca

SEQ ID NO: 192700 - DNA, 20 bp, human
gcttgcgggcggaagtgcaa

SEQ ID NO: 192701 - DNA, 20 bp, human
gtctaggtgaccttccccgg

SEQ ID NO: 192702 - DNA, 20 bp, human
gtccgctgcgcctacctcag

SEQ ID NO: 192703 - DNA, 20 bp, human
gggaggacctgcgtgagtcg

SEQ ID NO: 192704 - DNA, 20 bp, human
ggcgggtgccgaacaggtct

SEQ ID NO: 192705 - DNA, 20 bp, human
gcgtgagctcatccccgagg

SEQ ID NO: 192706 - DNA, 20 bp, human
gagggccaaagggagatccc

SEQ ID NO: 192707 - DNA, 20 bp, human
gggagatcccgggcagagag

SEQ ID NO: 192708 - DNA, 20 bp, human
gagtaaagctgggatctctg

SEQ ID NO: 192709 - DNA, 20 bp, human
gccagggccgactccgagtc

SEQ ID NO: 192710 - DNA, 20 bp, human
gaggaggtggtcagacggtg

SEQ ID NO: 192711 - DNA, 20 bp, human
gagggttgcggcgggcggaa

SEQ ID NO: 192712 - DNA, 20 bp, human
gcccgcgccggactcggagt

SEQ ID NO: 192713 - DNA, 20 bp, human
gcggccatcttaggaagcca

SEQ ID NO: 192714 - DNA, 20 bp, human
gctgggatctctgcgggatg

SEQ ID NO: 192715 - DNA, 20 bp, human
ggcgcgtcgtaagtaaagct

SEQ ID NO: 192716 - DNA, 20 bp, human
ggcctgtctctgctccgcca

SEQ ID NO: 192717 - DNA, 20 bp, human
gtccctcggccgtaaggagg

SEQ ID NO: 192718 - DNA, 20 bp, human
ggccctggcggagcagagac

SEQ ID NO: 192719 - DNA, 20 bp, human
gctcctcacctccaccccga

SEQ ID NO: 192720 - DNA, 20 bp, human
gggagaagcgaggaacgaaa

SEQ ID NO: 192721 - DNA, 20 bp, human
ggcaccctccctcggccgta

SEQ ID NO: 192722 - DNA, 20 bp, human
gaggagagctgaggccgcgc

SEQ ID NO: 192723 - DNA, 20 bp, human
ggcgcaggcgcggacggcgt

SEQ ID NO: 192724 - DNA, 20 bp, human
gggcctaacggaggctctgt

SEQ ID NO: 192725 - DNA, 20 bp, human
gggcagggagcaggctaccg

SEQ ID NO: 192726 - DNA, 20 bp, human
gatgaggctgggacactaag

SEQ ID NO: 192727 - DNA, 20 bp, human
ggaacagcttgtccacccgc

SEQ ID NO: 192728 - DNA, 20 bp, human
ggtctctgcttgtcaaaagg

SEQ ID NO: 192729 - DNA, 20 bp, human
gtcgcacctggtccggccgg

SEQ ID NO: 192730 - DNA, 20 bp, human
gggttcgcacctggtccggc

SEQ ID NO: 192731 - DNA, 20 bp, human
ggcttgtcaaaaggcggcag

SEQ ID NO: 192732 - DNA, 20 bp, human
gtccgcgctcccggcgcaca

SEQ ID NO: 192733 - DNA, 20 bp, human
ggtgctcagaactgctggag

SEQ ID NO: 192734 - DNA, 20 bp, human
gaaggcgccccgacagaaga

SEQ ID NO: 192735 - DNA, 20 bp, human
gcccgggttcgcacctggtc

SEQ ID NO: 192736 - DNA, 20 bp, human
ggcaccagcgctctgtcggg

SEQ ID NO: 192737 - DNA, 20 bp, human
gcgagcagcgaaagcgacag

SEQ ID NO: 192738 - DNA, 20 bp, human
gcagctgcgggatcccaagg

SEQ ID NO: 192739 - DNA, 20 bp, human
ggggcagccgggtagctcgg

SEQ ID NO: 192740 - DNA, 20 bp, human
gtcggaggtcgtggcgctgg

SEQ ID NO: 192741 - DNA, 20 bp, human
gccgggtagctcggaggtcg

SEQ ID NO: 192742 - DNA, 20 bp, human
gctagcaccagcgctctgtc

SEQ ID NO: 192743 - DNA, 20 bp, human
ggtcgaggaagagagagacg

SEQ ID NO: 192744 - DNA, 20 bp, human
ggtagcggggaggatcgcgg

SEQ ID NO: 192745 - DNA, 20 bp, human
ggagctccagagagaagtcg

SEQ ID NO: 192746 - DNA, 20 bp, human
gggcgcgtgcatcccctggg

SEQ ID NO: 192747 - DNA, 20 bp, human
gcggaccccgcagatcccct

SEQ ID NO: 192748 - DNA, 20 bp, human
ggaagtgaggaggcgacccg

SEQ ID NO: 192749 - DNA, 20 bp, human
gcccggcgcgtgcatcccct

SEQ ID NO: 192750 - DNA, 20 bp, human
gcctcggccgaggggatctg

SEQ ID NO: 192751 - DNA, 20 bp, human
gccgtgccctctctcaaggt

SEQ ID NO: 192752 - DNA, 20 bp, human
gggaggagtggccccagact

SEQ ID NO: 192753 - DNA, 20 bp, human
ggagtgcggcgagcagcagg

SEQ ID NO: 192754 - DNA, 20 bp, human
gcagcaggcggcggagcaga

SEQ ID NO: 192755 - DNA, 20 bp, human
gttggacgcgggcgtctcgg

SEQ ID NO: 192756 - DNA, 20 bp, human
gcagagcgcgccgggctgag

SEQ ID NO: 192757 - DNA, 20 bp, human
ggagggcgccctgcaaagtt

SEQ ID NO: 192758 - DNA, 20 bp, human
gcctcccggcgaccccccct

SEQ ID NO: 192759 - DNA, 20 bp, human
ggtcgccgggaggagcccgg

SEQ ID NO: 192760 - DNA, 20 bp, human
gtctggaggatcctgcgccg

SEQ ID NO: 192761 - DNA, 20 bp, human
ggacacccgccgcctttccc

SEQ ID NO: 192762 - DNA, 20 bp, human
gggatcctccagagcgcgcc

SEQ ID NO: 192763 - DNA, 20 bp, human
gggcggcgggagcgggtccg

SEQ ID NO: 192764 - DNA, 20 bp, human
gctcacataagcgcaggcag

SEQ ID NO: 192765 - DNA, 20 bp, human
gacgccgccgcggtccgcgt

SEQ ID NO: 192766 - DNA, 20 bp, human
gcccccggccctgacctagt

SEQ ID NO: 192767 - DNA, 20 bp, human
gggaagctgcgctccagtga

SEQ ID NO: 192768 - DNA, 20 bp, human
gggagaggaaatccccgtca

SEQ ID NO: 192769 - DNA, 20 bp, human
gtgccctgcccactaggtca

SEQ ID NO: 192770 - DNA, 20 bp, human
gctctccttgagcccccggt

SEQ ID NO: 192771 - DNA, 20 bp, human
ggccttgccggcgccctcac

SEQ ID NO: 192772 - DNA, 20 bp, human
gtaccggccatggtcctctc

SEQ ID NO: 192773 - DNA, 20 bp, human
ggaggcagaggagcccaccg

SEQ ID NO: 192774 - DNA, 20 bp, human
gtagtgggcagggcaccgcg

SEQ ID NO: 192775 - DNA, 20 bp, human
gggcagatttgaggacccgg

SEQ ID NO: 192776 - DNA, 20 bp, human
ggacccatgaccatgctcag

SEQ ID NO: 192777 - DNA, 20 bp, human
gagacgcggctgcagcccac

SEQ ID NO: 192778 - DNA, 20 bp, human
gctgcctctgagcatggtca

SEQ ID NO: 192779 - DNA, 20 bp, human
gctctttgcacaggaatctc

SEQ ID NO: 192780 - DNA, 20 bp, human
gctgcaaagaagcaaagagt

SEQ ID NO: 192781 - DNA, 20 bp, human
gtaattaaagtaaatgtcag

SEQ ID NO: 192782 - DNA, 20 bp, human
gattcctgtgcaaagaggta

SEQ ID NO: 192783 - DNA, 20 bp, human
gtggcttgacaggcagctca

SEQ ID NO: 192784 - DNA, 20 bp, human
gtgcataatcagccagcccc

SEQ ID NO: 192785 - DNA, 20 bp, human
gtaggtctaagcagaagttt

SEQ ID NO: 192786 - DNA, 20 bp, human
gagattcaggcaggctccga

SEQ ID NO: 192787 - DNA, 20 bp, human
gcctgcgtgctactcctcaa

SEQ ID NO: 192788 - DNA, 20 bp, human
ggaaatgatggcgcaaaacg

SEQ ID NO: 192789 - DNA, 20 bp, human
gtgcagctgagtaactgcaa

SEQ ID NO: 192790 - DNA, 20 bp, human
gcaggctgcacctcacccag

SEQ ID NO: 192791 - DNA, 20 bp, human
ggctccgagggcacagcgag

SEQ ID NO: 192792 - DNA, 20 bp, human
ggaatgcagcctgatgccac

SEQ ID NO: 192793 - DNA, 20 bp, human
ggagactgggcgggagattc

SEQ ID NO: 192794 - DNA, 20 bp, human
gtggctctgtgtgtaacctt

SEQ ID NO: 192795 - DNA, 20 bp, human
gctttcccagggaagaatgg

SEQ ID NO: 192796 - DNA, 20 bp, human
gggaggaggcgacaacaaag

SEQ ID NO: 192797 - DNA, 20 bp, human
gcagcggcggctcctcaaca

SEQ ID NO: 192798 - DNA, 20 bp, human
gggaggcgacaacaaagcgg

SEQ ID NO: 192799 - DNA, 20 bp, human
gcaccccgcggcccagagaa

SEQ ID NO: 192800 - DNA, 20 bp, human
gccttcagagcgagagggaa

SEQ ID NO: 192801 - DNA, 20 bp, human
ggggctgctgaggtgaaagg

SEQ ID NO: 192802 - DNA, 20 bp, human
gagcagcccgcgctatccag

SEQ ID NO: 192803 - DNA, 20 bp, human
gctctcgctctgaaggggaa

SEQ ID NO: 192804 - DNA, 20 bp, human
gggccgcggggtgaacccgg

SEQ ID NO: 192805 - DNA, 20 bp, human
gcgggcgggcggaaaaacaa

SEQ ID NO: 192806 - DNA, 20 bp, human
gatgaaggcgggagtacagg

SEQ ID NO: 192807 - DNA, 20 bp, human
gaaatcgcggatggaaaagg

SEQ ID NO: 192808 - DNA, 20 bp, human
ggctgaggcgggtggcatgg

SEQ ID NO: 192809 - DNA, 20 bp, human
ggaaatgaaggcgggagtac

SEQ ID NO: 192810 - DNA, 20 bp, human
gcgtgctgaggcgggtggca

SEQ ID NO: 192811 - DNA, 20 bp, human
ggcctgacaggtgtagccag

SEQ ID NO: 192812 - DNA, 20 bp, human
gtactgacccaaaaaaatcg

SEQ ID NO: 192813 - DNA, 20 bp, human
gtaagttgtgactatctaaa

SEQ ID NO: 192814 - DNA, 20 bp, human
ggcgggtggcatggcggaga

SEQ ID NO: 192815 - DNA, 20 bp, human
gccggagtttgacgaagagg

SEQ ID NO: 192816 - DNA, 20 bp, human
gtcgaggtctggcgtcccgt

SEQ ID NO: 192817 - DNA, 20 bp, human
gccatccggggagtcctacg

SEQ ID NO: 192818 - DNA, 20 bp, human
gccgggcggctagctcgctc

SEQ ID NO: 192819 - DNA, 20 bp, human
gggaggccctgggtaagcga

SEQ ID NO: 192820 - DNA, 20 bp, human
ggtactaagcagcagcaata

SEQ ID NO: 192821 - DNA, 20 bp, human
gcagccgtgggcgtgaggga

SEQ ID NO: 192822 - DNA, 20 bp, human
gttgctgctgcttagtacgt

SEQ ID NO: 192823 - DNA, 20 bp, human
gccggggagtcctacgggga

SEQ ID NO: 192824 - DNA, 20 bp, human
gcacgacgcgagaggtggag

SEQ ID NO: 192825 - DNA, 20 bp, human
gaggagcgacggtcgaggtc

SEQ ID NO: 192826 - DNA, 20 bp, human
ggggtagggtgggaagtcag

SEQ ID NO: 192827 - DNA, 20 bp, human
gtacctagcagtctggggta

SEQ ID NO: 192828 - DNA, 20 bp, human
ggtgatggtccagaattaag

SEQ ID NO: 192829 - DNA, 20 bp, human
gcagccacagaatcaggtga

SEQ ID NO: 192830 - DNA, 20 bp, human
gggggcggaaagtaacaagg

SEQ ID NO: 192831 - DNA, 20 bp, human
gaatggtacctagcagtctg

SEQ ID NO: 192832 - DNA, 20 bp, human
gagaggggcggaaagtaaca

SEQ ID NO: 192833 - DNA, 20 bp, human
gcttggaacgaaatccccaa

SEQ ID NO: 192834 - DNA, 20 bp, human
ggcggaaagtaacaaggagg

SEQ ID NO: 192835 - DNA, 20 bp, human
gacctgctctgaagtgagcc

SEQ ID NO: 192836 - DNA, 20 bp, human
gggagtaaaatcgcaggagt

SEQ ID NO: 192837 - DNA, 20 bp, human
gtctgccctggagcgcggtc

SEQ ID NO: 192838 - DNA, 20 bp, human
gtactcccgaccgcgctcca

SEQ ID NO: 192839 - DNA, 20 bp, human
gtgtaggcggctgcgaagta

SEQ ID NO: 192840 - DNA, 20 bp, human
ggcaaagccagcgcgctccg

SEQ ID NO: 192841 - DNA, 20 bp, human
ggcaaacaggcgagctaaag

SEQ ID NO: 192842 - DNA, 20 bp, human
gtaattgcactaccaactgg

SEQ ID NO: 192843 - DNA, 20 bp, human
gccgcggctcggaatccagc

SEQ ID NO: 192844 - DNA, 20 bp, human
gcggtcgggagtaaaatcgc

SEQ ID NO: 192845 - DNA, 20 bp, human
gggacgcccgagacgcgcgg

SEQ ID NO: 192846 - DNA, 20 bp, human
gcagtatctgcccaacccca

SEQ ID NO: 192847 - DNA, 20 bp, human
gtggggcgccggctgatagt

SEQ ID NO: 192848 - DNA, 20 bp, human
ggctggagcagcgacagagg

SEQ ID NO: 192849 - DNA, 20 bp, human
gcggctgatagtaggctgtg

SEQ ID NO: 192850 - DNA, 20 bp, human
ggcgagggctgcggcgccca

SEQ ID NO: 192851 - DNA, 20 bp, human
ggatactgggacgctccata

SEQ ID NO: 192852 - DNA, 20 bp, human
gctgtgactggcgctgccgt

SEQ ID NO: 192853 - DNA, 20 bp, human
gggacgcggtaatgccccag

SEQ ID NO: 192854 - DNA, 20 bp, human
gcggcagggaacatccggag

SEQ ID NO: 192855 - DNA, 20 bp, human
gccctcgcgggagccggacg

SEQ ID NO: 192856 - DNA, 20 bp, human
ggccggcagcgctgacatga

SEQ ID NO: 192857 - DNA, 20 bp, human
gcagcgctgccggcttgcag

SEQ ID NO: 192858 - DNA, 20 bp, human
gctcacagcccgctgcaagc

SEQ ID NO: 192859 - DNA, 20 bp, human
gcccgtttcctaggacaaag

SEQ ID NO: 192860 - DNA, 20 bp, human
gttgcagcgggctgtgagag

SEQ ID NO: 192861 - DNA, 20 bp, human
gctaccagtaagcccttgaa

SEQ ID NO: 192862 - DNA, 20 bp, human
gctgacatgagggctatgct

SEQ ID NO: 192863 - DNA, 20 bp, human
gagtggccgggacgagcaac

SEQ ID NO: 192864 - DNA, 20 bp, human
ggaagaggaagcggcggcat

SEQ ID NO: 192865 - DNA, 20 bp, human
gacgggcagtaattctacaa

SEQ ID NO: 192866 - DNA, 20 bp, human
ggcggagggaatgccccgga

SEQ ID NO: 192867 - DNA, 20 bp, human
ggcccgggtggtctggatcg

SEQ ID NO: 192868 - DNA, 20 bp, human
gaagcgccgggcccgtacct

SEQ ID NO: 192869 - DNA, 20 bp, human
ggcgcgcgcgaagactacgg

SEQ ID NO: 192870 - DNA, 20 bp, human
ggatcgcggagggaatgccc

SEQ ID NO: 192871 - DNA, 20 bp, human
gggaccccggggcggtagag

SEQ ID NO: 192872 - DNA, 20 bp, human
gccggacgccgcgggatccg

SEQ ID NO: 192873 - DNA, 20 bp, human
gcccagttctccgccctccg

SEQ ID NO: 192874 - DNA, 20 bp, human
gcgagcgcgcgcgaagacta

SEQ ID NO: 192875 - DNA, 20 bp, human
ggcgtccggcccgggtggtc

SEQ ID NO: 192876 - DNA, 20 bp, human
ggggcaggcccaagttgtca

SEQ ID NO: 192877 - DNA, 20 bp, human
gcaagttgtcaaggcttcgg

SEQ ID NO: 192878 - DNA, 20 bp, human
gctgaagagctacctatagt

SEQ ID NO: 192879 - DNA, 20 bp, human
gggcttcggaggtaatgccc

SEQ ID NO: 192880 - DNA, 20 bp, human
gtagtgggagagatccaaat

SEQ ID NO: 192881 - DNA, 20 bp, human
ggcccaagttgtcaaggctt

SEQ ID NO: 192882 - DNA, 20 bp, human
ggtgataggaagatccagag

SEQ ID NO: 192883 - DNA, 20 bp, human
gggtagctcttcagtgggac

SEQ ID NO: 192884 - DNA, 20 bp, human
ggggacgggctaggtaagag

SEQ ID NO: 192885 - DNA, 20 bp, human
ggggctaggtaagagaggct

SEQ ID NO: 192886 - DNA, 20 bp, human
gtgcctccccaagacaggta

SEQ ID NO: 192887 - DNA, 20 bp, human
ggcagctgcctccccaagac

SEQ ID NO: 192888 - DNA, 20 bp, human
gcccaggagtgtcagaggaa

SEQ ID NO: 192889 - DNA, 20 bp, human
gacaggtaaggcaacctggt

SEQ ID NO: 192890 - DNA, 20 bp, human
gcaagacaggtaaggcaacc

SEQ ID NO: 192891 - DNA, 20 bp, human
gtgccacctgggagatctca

SEQ ID NO: 192892 - DNA, 20 bp, human
gggcaaagagatgagctggt

SEQ ID NO: 192893 - DNA, 20 bp, human
gcttcagatgaagaacgcac

SEQ ID NO: 192894 - DNA, 20 bp, human
gcgtcccctcgcaccaccta

SEQ ID NO: 192895 - DNA, 20 bp, human
gggctcggggagtgaggtca

SEQ ID NO: 192896 - DNA, 20 bp, human
gggatgtaccaagggccatg

SEQ ID NO: 192897 - DNA, 20 bp, human
gtgtgttgcggggaagacgg

SEQ ID NO: 192898 - DNA, 20 bp, human
gtcccggcttgccccattca

SEQ ID NO: 192899 - DNA, 20 bp, human
gcctgcctagcgtctcccca

SEQ ID NO: 192900 - DNA, 20 bp, human
gtccgcggagatcaggaagt

SEQ ID NO: 192901 - DNA, 20 bp, human
ggcctacaggacgagctggg

SEQ ID NO: 192902 - DNA, 20 bp, human
ggggcaagccgggaggggtt

SEQ ID NO: 192903 - DNA, 20 bp, human
gtgcggggaagacggaggtg

SEQ ID NO: 192904 - DNA, 20 bp, human
gggtgttacccaacccctcc

SEQ ID NO: 192905 - DNA, 20 bp, human
gagaaggggaggatgtacca

SEQ ID NO: 192906 - DNA, 20 bp, human
gcaggcctagcactgcccac

SEQ ID NO: 192907 - DNA, 20 bp, human
gaggcacccagggacacgag

SEQ ID NO: 192908 - DNA, 20 bp, human
gagaaggaagggctcctgta

SEQ ID NO: 192909 - DNA, 20 bp, human
gctcctgtagggagagaaag

SEQ ID NO: 192910 - DNA, 20 bp, human
ggcgccttcgccctgcctgt

SEQ ID NO: 192911 - DNA, 20 bp, human
gaatctcgggctcccttcaa

SEQ ID NO: 192912 - DNA, 20 bp, human
gaactgagcaaggtaatctc

SEQ ID NO: 192913 - DNA, 20 bp, human
gctgcccacaggcagggcga

SEQ ID NO: 192914 - DNA, 20 bp, human
gggcctgggcagagagttgg

SEQ ID NO: 192915 - DNA, 20 bp, human
gagtgggctattcaagtcaa

SEQ ID NO: 192916 - DNA, 20 bp, human
gggctcagtccagcttcgga

SEQ ID NO: 192917 - DNA, 20 bp, human
gttctgtcgagggacctaac

SEQ ID NO: 192918 - DNA, 20 bp, human
gacgagggcgcggtgggtgt

SEQ ID NO: 192919 - DNA, 20 bp, human
ggacggcgggagttgcgaga

SEQ ID NO: 192920 - DNA, 20 bp, human
gccggagaagaggcgaacga

SEQ ID NO: 192921 - DNA, 20 bp, human
gggggacctcggagcgagag

SEQ ID NO: 192922 - DNA, 20 bp, human
gaggcgaacgagggcgcggt

SEQ ID NO: 192923 - DNA, 20 bp, human
gaggaaagcccgagggagag

SEQ ID NO: 192924 - DNA, 20 bp, human
gggcgggagttgcgagacgg

SEQ ID NO: 192925 - DNA, 20 bp, human
gttggcggagagatgttggg

SEQ ID NO: 192926 - DNA, 20 bp, human
gtgtgtgggacgggtcccag

SEQ ID NO: 192927 - DNA, 20 bp, human
gcgcggacagagactcctct

SEQ ID NO: 192928 - DNA, 20 bp, human
gggagcgcaccggaagcgcc

SEQ ID NO: 192929 - DNA, 20 bp, human
gtcccagaggcaaacgccaa

SEQ ID NO: 192930 - DNA, 20 bp, human
gcgcagcccctcggtctcca

SEQ ID NO: 192931 - DNA, 20 bp, human
gtgcgacgcgcagccatgat

SEQ ID NO: 192932 - DNA, 20 bp, human
gcgtgtgcgtaggagcgcac

SEQ ID NO: 192933 - DNA, 20 bp, human
ggcgaaccaagcccttcctg

SEQ ID NO: 192934 - DNA, 20 bp, human
gcttcctgtggtagttactg

SEQ ID NO: 192935 - DNA, 20 bp, human
gctgcgcgtcgcaaaagtgg

SEQ ID NO: 192936 - DNA, 20 bp, human
gagtcctgggagtaagagaa

SEQ ID NO: 192937 - DNA, 20 bp, human
gtagagtgagaagcaccagc

SEQ ID NO: 192938 - DNA, 20 bp, human
gagttctctgcccttagcaa

SEQ ID NO: 192939 - DNA, 20 bp, human
gctgcccttagcaatggcta

SEQ ID NO: 192940 - DNA, 20 bp, human
gaacccttagccattgctaa

SEQ ID NO: 192941 - DNA, 20 bp, human
ggctccgggggagcacgact

SEQ ID NO: 192942 - DNA, 20 bp, human
gccagaacagtcagctccgg

SEQ ID NO: 192943 - DNA, 20 bp, human
ggagcctttctcttactccc

SEQ ID NO: 192944 - DNA, 20 bp, human
gtgagaaaagttccagaggc

SEQ ID NO: 192945 - DNA, 20 bp, human
gtttctcaagtcacctggta

SEQ ID NO: 192946 - DNA, 20 bp, human
gctgcacagcctgaatagaa

SEQ ID NO: 192947 - DNA, 20 bp, human
gaatagaagggctggtccag

SEQ ID NO: 192948 - DNA, 20 bp, human
ggcggaagggaataatcgta

SEQ ID NO: 192949 - DNA, 20 bp, human
gggcgctgtcctgagaggga

SEQ ID NO: 192950 - DNA, 20 bp, human
gtgggacggaagtaaccggt

SEQ ID NO: 192951 - DNA, 20 bp, human
gtcaggcggaacccacggtg

SEQ ID NO: 192952 - DNA, 20 bp, human
gggctgtgcagcttagagaa

SEQ ID NO: 192953 - DNA, 20 bp, human
gagccaggaagatacaggtg

SEQ ID NO: 192954 - DNA, 20 bp, human
gcgctgggctctgacgactg

SEQ ID NO: 192955 - DNA, 20 bp, human
gggctggcgctgtcctgaga

SEQ ID NO: 192956 - DNA, 20 bp, human
gccctcgcgggtctcgtcca

SEQ ID NO: 192957 - DNA, 20 bp, human
gcctcgggagacctgctcca

SEQ ID NO: 192958 - DNA, 20 bp, human
gcgcagcctgggaagataag

SEQ ID NO: 192959 - DNA, 20 bp, human
gaggcacagcatcagtggag

SEQ ID NO: 192960 - DNA, 20 bp, human
gccgggagcagggaacacca

SEQ ID NO: 192961 - DNA, 20 bp, human
ggcgcgggcaaagagctggc

SEQ ID NO: 192962 - DNA, 20 bp, human
gagctaagaggcgcagctca

SEQ ID NO: 192963 - DNA, 20 bp, human
ggacaaggaaggcaagtctg

SEQ ID NO: 192964 - DNA, 20 bp, human
ggacgagacccgcgagggtg

SEQ ID NO: 192965 - DNA, 20 bp, human
gaggtctcccgaggcttgaa

SEQ ID NO: 192966 - DNA, 20 bp, human
ggaaccgcggggacctagga

SEQ ID NO: 192967 - DNA, 20 bp, human
gcagcaaaccccggacggtg

SEQ ID NO: 192968 - DNA, 20 bp, human
gcggggacctaggacggagg

SEQ ID NO: 192969 - DNA, 20 bp, human
ggcgagtgcgcggagacctc

SEQ ID NO: 192970 - DNA, 20 bp, human
gtcccggcccatgctggagg

SEQ ID NO: 192971 - DNA, 20 bp, human
ggttccgccgcctccagcat

SEQ ID NO: 192972 - DNA, 20 bp, human
gccgcggggacctaggacgg

SEQ ID NO: 192973 - DNA, 20 bp, human
gccgggaggaaggcgaagac

SEQ ID NO: 192974 - DNA, 20 bp, human
gggaggaaggcgaagaccgg

SEQ ID NO: 192975 - DNA, 20 bp, human
gagcaggtcagcagcgcggg

SEQ ID NO: 192976 - DNA, 20 bp, human
ggagttgagatgaaagtgga

SEQ ID NO: 192977 - DNA, 20 bp, human
gaaagtactgagaggttgat

SEQ ID NO: 192978 - DNA, 20 bp, human
ggacataccttgtttgaaga

SEQ ID NO: 192979 - DNA, 20 bp, human
gtcccatccaaattattcta

SEQ ID NO: 192980 - DNA, 20 bp, human
gctggttttagtgctgaatt

SEQ ID NO: 192981 - DNA, 20 bp, human
gacgtttcaatgataatgaa

SEQ ID NO: 192982 - DNA, 20 bp, human
gaaattgccttcttcaaaca

SEQ ID NO: 192983 - DNA, 20 bp, human
gtccttagaataatttggat

SEQ ID NO: 192984 - DNA, 20 bp, human
ggttttagtgctgaattagg

SEQ ID NO: 192985 - DNA, 20 bp, human
gtttcttccttagaataatt

SEQ ID NO: 192986 - DNA, 20 bp, human
gggcggaacctggagataat

SEQ ID NO: 192987 - DNA, 20 bp, human
gagcgagccgcacccagcca

SEQ ID NO: 192988 - DNA, 20 bp, human
gtcgcggggtcgttgcacag

SEQ ID NO: 192989 - DNA, 20 bp, human
gggtgctgcccattatctcc

SEQ ID NO: 192990 - DNA, 20 bp, human
gacgcgcgaacagctgatgg

SEQ ID NO: 192991 - DNA, 20 bp, human
ggaataacggtgaccaggaa

SEQ ID NO: 192992 - DNA, 20 bp, human
gcgcggctgcaaggcatcaa

SEQ ID NO: 192993 - DNA, 20 bp, human
gtatctccaggttccgcccg

SEQ ID NO: 192994 - DNA, 20 bp, human
gagcggctgccaggcatgat

SEQ ID NO: 192995 - DNA, 20 bp, human
gcctggtcaccgttattcct

SEQ ID NO: 192996 - DNA, 20 bp, human
gcggctgggtcgggccccga

SEQ ID NO: 192997 - DNA, 20 bp, human
ggatcggcgggcggagactg

SEQ ID NO: 192998 - DNA, 20 bp, human
ggagtgcgcaacggccgaag

SEQ ID NO: 192999 - DNA, 20 bp, human
ggagggggtggagtgcgcaa

SEQ ID NO: 193000 - DNA, 20 bp, human
gacggccgaagaggccggat

SEQ ID NO: 193001 - DNA, 20 bp, human
ggccgaagaggccggatcgg

SEQ ID NO: 193002 - DNA, 20 bp, human
gcccgtcctgctaagagtgt

SEQ ID NO: 193003 - DNA, 20 bp, human
gaccgacactcttagcagga

SEQ ID NO: 193004 - DNA, 20 bp, human
gaaccgccccaaaaggagtg

SEQ ID NO: 193005 - DNA, 20 bp, human
ggcgcaacggccgaagaggc

SEQ ID NO: 193006 - DNA, 20 bp, human
gaagagagcacagaacggag

SEQ ID NO: 193007 - DNA, 20 bp, human
gccatccaggcgggcaccat

SEQ ID NO: 193008 - DNA, 20 bp, human
gagcggagcacccgcaccgg

SEQ ID NO: 193009 - DNA, 20 bp, human
gaacggagaggagccggtag

SEQ ID NO: 193010 - DNA, 20 bp, human
gggtagcggagcacccgcac

SEQ ID NO: 193011 - DNA, 20 bp, human
gggagcacccgcaccggcgg

SEQ ID NO: 193012 - DNA, 20 bp, human
gagagcggcgccaccggaac

SEQ ID NO: 193013 - DNA, 20 bp, human
gggggcgcgtcctcactcac

SEQ ID NO: 193014 - DNA, 20 bp, human
gcctcactcaccggttccgg

SEQ ID NO: 193015 - DNA, 20 bp, human
gggagactgtgcaagttgta

SEQ ID NO: 193016 - DNA, 20 bp, human
ggcgctcagtaagctccgcg

SEQ ID NO: 193017 - DNA, 20 bp, human
gcggccgaggcggttcgcac

SEQ ID NO: 193018 - DNA, 20 bp, human
gagtaagctccgcgagggaa

SEQ ID NO: 193019 - DNA, 20 bp, human
gcggttcgcaccggaagtag

SEQ ID NO: 193020 - DNA, 20 bp, human
gcgcgagggaacggccgagg

SEQ ID NO: 193021 - DNA, 20 bp, human
gaggccctagctgaatgggt

SEQ ID NO: 193022 - DNA, 20 bp, human
gcctcagaaggctgaccctg

SEQ ID NO: 193023 - DNA, 20 bp, human
gcgactatgcaggcccccta

SEQ ID NO: 193024 - DNA, 20 bp, human
gtgccggcacaggcgctcgg

SEQ ID NO: 193025 - DNA, 20 bp, human
ggtcatggggaataggtcag

SEQ ID NO: 193026 - DNA, 20 bp, human
gccggccctgcagatccggg

SEQ ID NO: 193027 - DNA, 20 bp, human
gtcagcacctgtgggaaagt

SEQ ID NO: 193028 - DNA, 20 bp, human
gcgggaggcaaacgcacacc

SEQ ID NO: 193029 - DNA, 20 bp, human
ggcgccgccctagacgaact

SEQ ID NO: 193030 - DNA, 20 bp, human
ggcgagaagtgacacaggtg

SEQ ID NO: 193031 - DNA, 20 bp, human
gggccaggtggacttcaccg

SEQ ID NO: 193032 - DNA, 20 bp, human
gactgggtcgcgccaaggac

SEQ ID NO: 193033 - DNA, 20 bp, human
ggcgcgacccagttcgtcta

SEQ ID NO: 193034 - DNA, 20 bp, human
gaccacagaccgcccagcgt

SEQ ID NO: 193035 - DNA, 20 bp, human
gcctgctgaagagcctgcta

SEQ ID NO: 193036 - DNA, 20 bp, human
gggtagagtcccagtctgga

SEQ ID NO: 193037 - DNA, 20 bp, human
gcgacggagtatgtaataga

SEQ ID NO: 193038 - DNA, 20 bp, human
gacgtggtagagtcccagtc

SEQ ID NO: 193039 - DNA, 20 bp, human
gagtatgtaatagagggtaa

SEQ ID NO: 193040 - DNA, 20 bp, human
ggcgcgcgcgggaacgtcct

SEQ ID NO: 193041 - DNA, 20 bp, human
gccgctggcgaagaatccat

SEQ ID NO: 193042 - DNA, 20 bp, human
gagagtcccagtctggaagg

SEQ ID NO: 193043 - DNA, 20 bp, human
gattcacagacgctacagga

SEQ ID NO: 193044 - DNA, 20 bp, human
gcacagacagatggccggaa

SEQ ID NO: 193045 - DNA, 20 bp, human
ggcgacgacactgcactgaa

SEQ ID NO: 193046 - DNA, 20 bp, human
ggcgggtgtgagagtccgta

SEQ ID NO: 193047 - DNA, 20 bp, human
gcttccaggatcctgagatc

SEQ ID NO: 193048 - DNA, 20 bp, human
gtccgtaaggagcagcttcc

SEQ ID NO: 193049 - DNA, 20 bp, human
gtggacatcccgggactaag

SEQ ID NO: 193050 - DNA, 20 bp, human
gccgctgggctccagacaac

SEQ ID NO: 193051 - DNA, 20 bp, human
gagccggggtcggagcgggt

SEQ ID NO: 193052 - DNA, 20 bp, human
ggatccggagcagccggggt

SEQ ID NO: 193053 - DNA, 20 bp, human
gcttaggcattgcggatctg

SEQ ID NO: 193054 - DNA, 20 bp, human
gcgggtgaccaaccatgaga

SEQ ID NO: 193055 - DNA, 20 bp, human
ggctccggatctcaggatcc

SEQ ID NO: 193056 - DNA, 20 bp, human
gaaagggatacctcagacaa

SEQ ID NO: 193057 - DNA, 20 bp, human
gggcttggaatccattgaga

SEQ ID NO: 193058 - DNA, 20 bp, human
gcccaaactcataaaatcag

SEQ ID NO: 193059 - DNA, 20 bp, human
gcatccacctgcatatactg

SEQ ID NO: 193060 - DNA, 20 bp, human
ggcattcatcaagacatggg

SEQ ID NO: 193061 - DNA, 20 bp, human
gtctgttgctgtgattgtgt

SEQ ID NO: 193062 - DNA, 20 bp, human
ggcaccatctgccttctcaa

SEQ ID NO: 193063 - DNA, 20 bp, human
ggatcaagattagatcccca

SEQ ID NO: 193064 - DNA, 20 bp, human
gaatatttgctgaatgacac

SEQ ID NO: 193065 - DNA, 20 bp, human
gacagaagtcaataaacctt

SEQ ID NO: 193066 - DNA, 20 bp, human
gcaaggagtcagctacagtc

SEQ ID NO: 193067 - DNA, 20 bp, human
gggtagttgttggaatcctg

SEQ ID NO: 193068 - DNA, 20 bp, human
gcaactacctggaatagtgt

SEQ ID NO: 193069 - DNA, 20 bp, human
gcttgtatcccctaaagtaa

SEQ ID NO: 193070 - DNA, 20 bp, human
ggagaaacccaccaaacctg

SEQ ID NO: 193071 - DNA, 20 bp, human
gtaagagtgaaaaattcccc

SEQ ID NO: 193072 - DNA, 20 bp, human
ggaatcaaatctgtggatct

SEQ ID NO: 193073 - DNA, 20 bp, human
gtggatacaaagcaggagac

SEQ ID NO: 193074 - DNA, 20 bp, human
gagaaaagacagctgtgtct

SEQ ID NO: 193075 - DNA, 20 bp, human
gtatatgttcctttacttta

SEQ ID NO: 193076 - DNA, 20 bp, human
gtctttaagttttgcccacc

SEQ ID NO: 193077 - DNA, 20 bp, human
gcatcagtgacagacatcag

SEQ ID NO: 193078 - DNA, 20 bp, human
gggtcctgcatggaaatagg

SEQ ID NO: 193079 - DNA, 20 bp, human
gggtcagctccaggaaatcc

SEQ ID NO: 193080 - DNA, 20 bp, human
gcccactgccacataccggg

SEQ ID NO: 193081 - DNA, 20 bp, human
gagaatggcctcccggtatg

SEQ ID NO: 193082 - DNA, 20 bp, human
gcagcggagagctaagaagt

SEQ ID NO: 193083 - DNA, 20 bp, human
gctccccaggactcccacca

SEQ ID NO: 193084 - DNA, 20 bp, human
gcagtggcagaatggcctcc

SEQ ID NO: 193085 - DNA, 20 bp, human
ggaccgtggtgggagtcctg

SEQ ID NO: 193086 - DNA, 20 bp, human
ggtgtaactgaccctgacag

SEQ ID NO: 193087 - DNA, 20 bp, human
gggagacagggccactgtca

SEQ ID NO: 193088 - DNA, 20 bp, human
gactcagttgccagcttacg

SEQ ID NO: 193089 - DNA, 20 bp, human
gtttatggccagttcctcaa

SEQ ID NO: 193090 - DNA, 20 bp, human
ggagggggtcctaggagaca

SEQ ID NO: 193091 - DNA, 20 bp, human
ggcaaaattgccacgtaagc

SEQ ID NO: 193092 - DNA, 20 bp, human
gctcatagaatccagtacac

SEQ ID NO: 193093 - DNA, 20 bp, human
ggtgaaagtgtcctggcagc

SEQ ID NO: 193094 - DNA, 20 bp, human
gacaccagtgtctcgtgagg

SEQ ID NO: 193095 - DNA, 20 bp, human
gtctgtttttcagcactcat

SEQ ID NO: 193096 - DNA, 20 bp, human
gttccggaaagagagtgatc

SEQ ID NO: 193097 - DNA, 20 bp, human
gcaagatttggaagatcaag

SEQ ID NO: 193098 - DNA, 20 bp, human
ggcccaaaacaaggaagacg

SEQ ID NO: 193099 - DNA, 20 bp, human
gaaagattcagtacaagatt

SEQ ID NO: 193100 - DNA, 20 bp, human
gtgggcatggaattcaaagg

SEQ ID NO: 193101 - DNA, 20 bp, human
gcaagatttttgagactcac

SEQ ID NO: 193102 - DNA, 20 bp, human
gaaattctgcatgcattctg

SEQ ID NO: 193103 - DNA, 20 bp, human
gaatagcaacgtaagatggg

SEQ ID NO: 193104 - DNA, 20 bp, human
gatcccgatcactctctttc

SEQ ID NO: 193105 - DNA, 20 bp, human
gtctgcatgcattctgggga

SEQ ID NO: 193106 - DNA, 20 bp, human
ggccacagagattggaaaag

SEQ ID NO: 193107 - DNA, 20 bp, human
gtccgtgtcaagacccccac

SEQ ID NO: 193108 - DNA, 20 bp, human
gcggaatccagttcacctga

SEQ ID NO: 193109 - DNA, 20 bp, human
gtgggatatcctccagataa

SEQ ID NO: 193110 - DNA, 20 bp, human
gacctgtgggggtcttgaca

SEQ ID NO: 193111 - DNA, 20 bp, human
gtcctgagtaccaacctgca

SEQ ID NO: 193112 - DNA, 20 bp, human
gccagttcacctgagggtct

SEQ ID NO: 193113 - DNA, 20 bp, human
gctggagacagcgatcaagc

SEQ ID NO: 193114 - DNA, 20 bp, human
gttcagaaatcactaaacct

SEQ ID NO: 193115 - DNA, 20 bp, human
gtaatcataatgtacacgag

SEQ ID NO: 193116 - DNA, 20 bp, human
gactggaggagcacaggcct

SEQ ID NO: 193117 - DNA, 20 bp, human
gtacttacagctttagtcaa

SEQ ID NO: 193118 - DNA, 20 bp, human
ggttaatagactggcatagt

SEQ ID NO: 193119 - DNA, 20 bp, human
gtttggcagggttaatagac

SEQ ID NO: 193120 - DNA, 20 bp, human
gggggtgactggaggagcac

SEQ ID NO: 193121 - DNA, 20 bp, human
gggtgaatgcaagaaacttt

SEQ ID NO: 193122 - DNA, 20 bp, human
gacatgcgtttgaaagggta

SEQ ID NO: 193123 - DNA, 20 bp, human
ggagagacatgcgtttgaaa

SEQ ID NO: 193124 - DNA, 20 bp, human
gtcagctgctttcctttcca

SEQ ID NO: 193125 - DNA, 20 bp, human
gatgcaagaaacttttggca

SEQ ID NO: 193126 - DNA, 20 bp, human
gccgggtgctgccggaggcg

SEQ ID NO: 193127 - DNA, 20 bp, human
gggtcaccccgagctaacgg

SEQ ID NO: 193128 - DNA, 20 bp, human
gcgcgcctcccggagctggg

SEQ ID NO: 193129 - DNA, 20 bp, human
gcgggggcggagcgcagcca

SEQ ID NO: 193130 - DNA, 20 bp, human
gaggtgcgggaccctggtga

SEQ ID NO: 193131 - DNA, 20 bp, human
gcgacggaaggcgcggaccg

SEQ ID NO: 193132 - DNA, 20 bp, human
gggcggggtgcgaaaaccga

SEQ ID NO: 193133 - DNA, 20 bp, human
gtgcctgggagcgcagacgg

SEQ ID NO: 193134 - DNA, 20 bp, human
gcggaaggcgcggaccgggg

SEQ ID NO: 193135 - DNA, 20 bp, human
gcgcagacggtggagcgacg

SEQ ID NO: 193136 - DNA, 20 bp, human
gcgcgaccacggctccacag

SEQ ID NO: 193137 - DNA, 20 bp, human
gcccgtacggaacagagact

SEQ ID NO: 193138 - DNA, 20 bp, human
gcgagtgacgcataatatgt

SEQ ID NO: 193139 - DNA, 20 bp, human
gtgcgcccctcctccaggta

SEQ ID NO: 193140 - DNA, 20 bp, human
ggtacggaacagagactagg

SEQ ID NO: 193141 - DNA, 20 bp, human
gcacacacacagcgcgacca

SEQ ID NO: 193142 - DNA, 20 bp, human
ggggcggaagagttactctc

SEQ ID NO: 193143 - DNA, 20 bp, human
gtccgcccctacctggagga

SEQ ID NO: 193144 - DNA, 20 bp, human
gggagccccgcaagcccgta

SEQ ID NO: 193145 - DNA, 20 bp, human
gctctcgggaagcttctcgt

SEQ ID NO: 193146 - DNA, 20 bp, human
gcaaacagcatgagcaggac

SEQ ID NO: 193147 - DNA, 20 bp, human
gaggcggattgtggttccaa

SEQ ID NO: 193148 - DNA, 20 bp, human
gcatgtctgcaccatgtcct

SEQ ID NO: 193149 - DNA, 20 bp, human
gtgaggaacgaccatgacat

SEQ ID NO: 193150 - DNA, 20 bp, human
gcggtgtgtacagcgtctac

SEQ ID NO: 193151 - DNA, 20 bp, human
gtggatccagagaagcgagg

SEQ ID NO: 193152 - DNA, 20 bp, human
ggttcctcagggtgcaggtg

SEQ ID NO: 193153 - DNA, 20 bp, human
gttctctggatccaaagatg

SEQ ID NO: 193154 - DNA, 20 bp, human
gcagccgccggccatgtcct

SEQ ID NO: 193155 - DNA, 20 bp, human
gcaaagatgtggccaggaac

SEQ ID NO: 193156 - DNA, 20 bp, human
gaccggcaggccatggccag

SEQ ID NO: 193157 - DNA, 20 bp, human
gcaaatcgatggggacagta

SEQ ID NO: 193158 - DNA, 20 bp, human
gcaggaaggtccccatcaga

SEQ ID NO: 193159 - DNA, 20 bp, human
gggcaagtagaagttctgca

SEQ ID NO: 193160 - DNA, 20 bp, human
ggggacagtagggcaggtcc

SEQ ID NO: 193161 - DNA, 20 bp, human
gctgcaaggaggcaaatcga

SEQ ID NO: 193162 - DNA, 20 bp, human
gccctgtgccccaaagcacc

SEQ ID NO: 193163 - DNA, 20 bp, human
gctggctgggaggcgtattc

SEQ ID NO: 193164 - DNA, 20 bp, human
gctgcaaggctatatgctcc

SEQ ID NO: 193165 - DNA, 20 bp, human
gcaggaaagattcacctgac

SEQ ID NO: 193166 - DNA, 20 bp, human
gtctcttcgggatcccggga

SEQ ID NO: 193167 - DNA, 20 bp, human
gaagcgccgccactgcaggt

SEQ ID NO: 193168 - DNA, 20 bp, human
ggagccctgggccaaaatgg

SEQ ID NO: 193169 - DNA, 20 bp, human
gtgacaaagctcccggaggt

SEQ ID NO: 193170 - DNA, 20 bp, human
gtggtctacgggaagaaaga

SEQ ID NO: 193171 - DNA, 20 bp, human
ggctcacgtgacaaagctcc

SEQ ID NO: 193172 - DNA, 20 bp, human
gttcgacaaggagctggtga

SEQ ID NO: 193173 - DNA, 20 bp, human
gcgcagacagtgatgccagg

SEQ ID NO: 193174 - DNA, 20 bp, human
gctcgccaacgataatatta

SEQ ID NO: 193175 - DNA, 20 bp, human
gtcgatctcttcgggatccc

SEQ ID NO: 193176 - DNA, 20 bp, human
gtctctcgctgggctcgcta

SEQ ID NO: 193177 - DNA, 20 bp, human
gcgagcccagcgagagacgg

SEQ ID NO: 193178 - DNA, 20 bp, human
ggcccagcgagagacggagg

SEQ ID NO: 193179 - DNA, 20 bp, human
gctgcgcgttgggccagcgg

SEQ ID NO: 193180 - DNA, 20 bp, human
gtccggggcggcttcagctg

SEQ ID NO: 193181 - DNA, 20 bp, human
ggccgcagctgaagccgccc

SEQ ID NO: 193182 - DNA, 20 bp, human
gcaagttacgtaaagccggg

SEQ ID NO: 193183 - DNA, 20 bp, human
gacacgtcccagctctctct

SEQ ID NO: 193184 - DNA, 20 bp, human
gattcggttcaccggctccg

SEQ ID NO: 193185 - DNA, 20 bp, human
gctgggcatctggaaaggta

SEQ ID NO: 193186 - DNA, 20 bp, human
gaggggacgcggcggtactc

SEQ ID NO: 193187 - DNA, 20 bp, human
gagggctactgcggccgaag

SEQ ID NO: 193188 - DNA, 20 bp, human
gcagaaacgttagaagtcgg

SEQ ID NO: 193189 - DNA, 20 bp, human
gtactctggcgtgtgagccg

SEQ ID NO: 193190 - DNA, 20 bp, human
gccctccacctccaagtccc

SEQ ID NO: 193191 - DNA, 20 bp, human
gctggcgtgtgagccgaggg

SEQ ID NO: 193192 - DNA, 20 bp, human
gacaggagcagcactgccgg

SEQ ID NO: 193193 - DNA, 20 bp, human
ggaagtcggcggtagagtga

SEQ ID NO: 193194 - DNA, 20 bp, human
gagacagaaacgttagaagt

SEQ ID NO: 193195 - DNA, 20 bp, human
gcccggaagtggcgcggtac

SEQ ID NO: 193196 - DNA, 20 bp, human
gggcgctgaggcacaaggag

SEQ ID NO: 193197 - DNA, 20 bp, human
gcagcaccatggtggcgctg

SEQ ID NO: 193198 - DNA, 20 bp, human
gtggcctcgggggacgagaa

SEQ ID NO: 193199 - DNA, 20 bp, human
gatggtggcgctgaggcaca

SEQ ID NO: 193200 - DNA, 20 bp, human
gctcgggggacgagaaaggt

SEQ ID NO: 193201 - DNA, 20 bp, human
gaaccgcccggcgcagctga

SEQ ID NO: 193202 - DNA, 20 bp, human
gaggaccacagaaacgggca

SEQ ID NO: 193203 - DNA, 20 bp, human
gacgagaaaggtgggaactt

SEQ ID NO: 193204 - DNA, 20 bp, human
gaccacagaaacgggcaggg

SEQ ID NO: 193205 - DNA, 20 bp, human
gcagggcccgggcagaatcc

SEQ ID NO: 193206 - DNA, 20 bp, human
gccgcgggcctgcgccattg

SEQ ID NO: 193207 - DNA, 20 bp, human
gggcggcccgggacaccgac

SEQ ID NO: 193208 - DNA, 20 bp, human
gccgctcggcccctacctgt

SEQ ID NO: 193209 - DNA, 20 bp, human
gccgggacaccgacaggtag

SEQ ID NO: 193210 - DNA, 20 bp, human
gctggcgccctggaattggg

SEQ ID NO: 193211 - DNA, 20 bp, human
gcctccccgccgctcctcaa

SEQ ID NO: 193212 - DNA, 20 bp, human
gctgacaccccccaattcca

SEQ ID NO: 193213 - DNA, 20 bp, human
gctgcgccattgaggagcgg

SEQ ID NO: 193214 - DNA, 20 bp, human
gcggacgtcggggttcccag

SEQ ID NO: 193215 - DNA, 20 bp, human
ggtgtgccggggtccagcgg

SEQ ID NO: 193216 - DNA, 20 bp, human
gagtccatggctggtgcaga

SEQ ID NO: 193217 - DNA, 20 bp, human
gaggggacacccacctagag

SEQ ID NO: 193218 - DNA, 20 bp, human
gaaaggcagagtccccgagt

SEQ ID NO: 193219 - DNA, 20 bp, human
gccagccatggactgctaca

SEQ ID NO: 193220 - DNA, 20 bp, human
gggactgctacacggcgaac

SEQ ID NO: 193221 - DNA, 20 bp, human
gccccctcggagcgcccctg

SEQ ID NO: 193222 - DNA, 20 bp, human
gcactttccggcaggagact

SEQ ID NO: 193223 - DNA, 20 bp, human
gctgccgtctgcaccagcca

SEQ ID NO: 193224 - DNA, 20 bp, human
gggggcagctcaccggtaaa

SEQ ID NO: 193225 - DNA, 20 bp, human
gcggcgaactggaacccact

SEQ ID NO: 193226 - DNA, 20 bp, human
gtcacctggcaccggctgaa

SEQ ID NO: 193227 - DNA, 20 bp, human
ggggcgaggttgggatcacc

SEQ ID NO: 193228 - DNA, 20 bp, human
gatgctaggagagccgaaag

SEQ ID NO: 193229 - DNA, 20 bp, human
gccccactcgggtaaggaag

SEQ ID NO: 193230 - DNA, 20 bp, human
gcactcgggtaaggaagagg

SEQ ID NO: 193231 - DNA, 20 bp, human
gcccgctacaaaaaaatcac

SEQ ID NO: 193232 - DNA, 20 bp, human
gagcccggctgccctagcgt

SEQ ID NO: 193233 - DNA, 20 bp, human
gggagagccgaaaggggcag

SEQ ID NO: 193234 - DNA, 20 bp, human
gcccggaaggcacggcccag

SEQ ID NO: 193235 - DNA, 20 bp, human
ggcgtgggcatcccccactc

SEQ ID NO: 193236 - DNA, 20 bp, human
ggcctcacgtaaagaagggt

SEQ ID NO: 193237 - DNA, 20 bp, human
ggtgggaagcgatactgcca

SEQ ID NO: 193238 - DNA, 20 bp, human
gagtggggcgcagaattaga

SEQ ID NO: 193239 - DNA, 20 bp, human
gcgtagtagcccaggaaacc

SEQ ID NO: 193240 - DNA, 20 bp, human
gcgcagaagtgcatgtgtat

SEQ ID NO: 193241 - DNA, 20 bp, human
ggatggcgatgagtttcgag

SEQ ID NO: 193242 - DNA, 20 bp, human
gctacagcgtatcctccctc

SEQ ID NO: 193243 - DNA, 20 bp, human
ggatgagtttcgagtggccg

SEQ ID NO: 193244 - DNA, 20 bp, human
gggtagcttccgggtttcct

SEQ ID NO: 193245 - DNA, 20 bp, human
gacctgccgggtgaagggag

SEQ ID NO: 193246 - DNA, 20 bp, human
gggactggctacctaggaag

SEQ ID NO: 193247 - DNA, 20 bp, human
ggggctgggagttctcctga

SEQ ID NO: 193248 - DNA, 20 bp, human
gcggcgaccagcccccgcag

SEQ ID NO: 193249 - DNA, 20 bp, human
gagtcccccgaagagtccgg

SEQ ID NO: 193250 - DNA, 20 bp, human
ggcgaggcccgagcacctac

SEQ ID NO: 193251 - DNA, 20 bp, human
gcgccgagaccgggaagagg

SEQ ID NO: 193252 - DNA, 20 bp, human
ggaacagggactggctacct

SEQ ID NO: 193253 - DNA, 20 bp, human
gacgtgacggagcgccggag

SEQ ID NO: 193254 - DNA, 20 bp, human
gggcctgtcgggccacccct

SEQ ID NO: 193255 - DNA, 20 bp, human
gtggagtaggggggacgcgg

SEQ ID NO: 193256 - DNA, 20 bp, human
gcgagctgcccagcctccgg

SEQ ID NO: 193257 - DNA, 20 bp, human
ggagccaggcagccccgcgg

SEQ ID NO: 193258 - DNA, 20 bp, human
ggggctgccctaggtaaaga

SEQ ID NO: 193259 - DNA, 20 bp, human
gacgcaccgaggcgcttcgg

SEQ ID NO: 193260 - DNA, 20 bp, human
gacaagcggctggagcacca

SEQ ID NO: 193261 - DNA, 20 bp, human
ggcggagccaggcagccccg

SEQ ID NO: 193262 - DNA, 20 bp, human
gcctaggtaaagaaggccag

SEQ ID NO: 193263 - DNA, 20 bp, human
gcgggccgagcacaagacgg

SEQ ID NO: 193264 - DNA, 20 bp, human
gggccgggcgggtctcggta

SEQ ID NO: 193265 - DNA, 20 bp, human
gcgtggagccggctgtccgt

SEQ ID NO: 193266 - DNA, 20 bp, human
gcggctcgcggtcgggaaga

SEQ ID NO: 193267 - DNA, 20 bp, human
gacctggacggctcgcggtc

SEQ ID NO: 193268 - DNA, 20 bp, human
gcgggccccgggtacctgga

SEQ ID NO: 193269 - DNA, 20 bp, human
gagggcgtcgccgctcatgt

SEQ ID NO: 193270 - DNA, 20 bp, human
ggtcgccgctcatgtaggta

SEQ ID NO: 193271 - DNA, 20 bp, human
gtctgggtcaagctctccga

SEQ ID NO: 193272 - DNA, 20 bp, human
gatgtaggtagggaacgtct

SEQ ID NO: 193273 - DNA, 20 bp, human
gccgaggaagagccgggaaa

SEQ ID NO: 193274 - DNA, 20 bp, human
ggcgcaggcgcagacatgag

SEQ ID NO: 193275 - DNA, 20 bp, human
gtacccggggcccggccggt

SEQ ID NO: 193276 - DNA, 20 bp, human
gatggtgagggctgcagttg

SEQ ID NO: 193277 - DNA, 20 bp, human
gaaaggcccagaagaggtct

SEQ ID NO: 193278 - DNA, 20 bp, human
ggacggtggtggtgactgag

SEQ ID NO: 193279 - DNA, 20 bp, human
gcccggtgacaggatggtga

SEQ ID NO: 193280 - DNA, 20 bp, human
ggcggagcccggtgacagga

SEQ ID NO: 193281 - DNA, 20 bp, human
ggctgcagttgcggcgacca

SEQ ID NO: 193282 - DNA, 20 bp, human
gctacaccccaaccagcggg

SEQ ID NO: 193283 - DNA, 20 bp, human
gcccagaagaggtctaggga

SEQ ID NO: 193284 - DNA, 20 bp, human
gctttttgcgggaaacgagt

SEQ ID NO: 193285 - DNA, 20 bp, human
ggtggtgactgagcggagcc

SEQ ID NO: 193286 - DNA, 20 bp, human
gagctgccgggctatcacag

SEQ ID NO: 193287 - DNA, 20 bp, human
ggtcctcccgtaggaaccgg

SEQ ID NO: 193288 - DNA, 20 bp, human
gggactcggttggcgttgtg

SEQ ID NO: 193289 - DNA, 20 bp, human
gaggaaccggcggactcggt

SEQ ID NO: 193290 - DNA, 20 bp, human
gcgagtccgccggttcctac

SEQ ID NO: 193291 - DNA, 20 bp, human
ggcgtccgtggtcctcccgt

SEQ ID NO: 193292 - DNA, 20 bp, human
gtggcggctcatctgtccta

SEQ ID NO: 193293 - DNA, 20 bp, human
gaaccaggccggaccagggg

SEQ ID NO: 193294 - DNA, 20 bp, human
ggtggtcctcccgtaggaac

SEQ ID NO: 193295 - DNA, 20 bp, human
gaactcaggcggtcagggaa

SEQ ID NO: 193296 - DNA, 20 bp, human
gagaccggaatcctgctgac

SEQ ID NO: 193297 - DNA, 20 bp, human
gtgacgggcagagtggatca

SEQ ID NO: 193298 - DNA, 20 bp, human
gaggagcgagggcccatctg

SEQ ID NO: 193299 - DNA, 20 bp, human
gagggagggtcgagacacgg

SEQ ID NO: 193300 - DNA, 20 bp, human
ggcgccaaggacaataccag

SEQ ID NO: 193301 - DNA, 20 bp, human
ggccaagaacaagatcaaag

SEQ ID NO: 193302 - DNA, 20 bp, human
ggggttctcctcgtacgctg

SEQ ID NO: 193303 - DNA, 20 bp, human
gagagactccgcagcgtacg

SEQ ID NO: 193304 - DNA, 20 bp, human
gagggacttccgggagatct

SEQ ID NO: 193305 - DNA, 20 bp, human
ggaccagctcatctatctgc

SEQ ID NO: 193306 - DNA, 20 bp, human
gaggctctggggagtcgcca

SEQ ID NO: 193307 - DNA, 20 bp, human
gctgcttgctgcaggctctg

SEQ ID NO: 193308 - DNA, 20 bp, human
gcgagcacaactaggcacaa

SEQ ID NO: 193309 - DNA, 20 bp, human
ggggacggccgagcacaact

SEQ ID NO: 193310 - DNA, 20 bp, human
ggagagcaggggctacaagg

SEQ ID NO: 193311 - DNA, 20 bp, human
ggcgccacctccgagtctca

SEQ ID NO: 193312 - DNA, 20 bp, human
gctacaaggagggtcgaccc

SEQ ID NO: 193313 - DNA, 20 bp, human
gctaccggtcccctcgtggt

SEQ ID NO: 193314 - DNA, 20 bp, human
gcacagcgtgcgagagtggg

SEQ ID NO: 193315 - DNA, 20 bp, human
gagcgtcacatgaccgcggg

SEQ ID NO: 193316 - DNA, 20 bp, human
ggccgctggtccaaacgaag

SEQ ID NO: 193317 - DNA, 20 bp, human
gggcgagcgctccttctccc

SEQ ID NO: 193318 - DNA, 20 bp, human
gcgctgctcgcggcctcgga

SEQ ID NO: 193319 - DNA, 20 bp, human
ggcgctcccggaagcattcc

SEQ ID NO: 193320 - DNA, 20 bp, human
ggtccaaacgaagcggtcca

SEQ ID NO: 193321 - DNA, 20 bp, human
gccagcgcgggtcccaactt

SEQ ID NO: 193322 - DNA, 20 bp, human
gcggagggattagcatatct

SEQ ID NO: 193323 - DNA, 20 bp, human
gctcccggaagcattccggg

SEQ ID NO: 193324 - DNA, 20 bp, human
gccgaggttggtgtcgtcag

SEQ ID NO: 193325 - DNA, 20 bp, human
gcattccgggcggagggaag

SEQ ID NO: 193326 - DNA, 20 bp, human
gcgcccaaaccggccagcca

SEQ ID NO: 193327 - DNA, 20 bp, human
gctccaccggaggaaaaagt

SEQ ID NO: 193328 - DNA, 20 bp, human
gacggcccagacgcccaaac

SEQ ID NO: 193329 - DNA, 20 bp, human
ggtcgctgcctctccaccgg

SEQ ID NO: 193330 - DNA, 20 bp, human
gaggctggtgaggccaccgg

SEQ ID NO: 193331 - DNA, 20 bp, human
ggcgtgtgacccacaaccaa

SEQ ID NO: 193332 - DNA, 20 bp, human
gcctccggaactcacactcc

SEQ ID NO: 193333 - DNA, 20 bp, human
gctgggggacatgctacgaa

SEQ ID NO: 193334 - DNA, 20 bp, human
ggcagactgaggcgctgtga

SEQ ID NO: 193335 - DNA, 20 bp, human
gcggggcacgcaagtgacgg

SEQ ID NO: 193336 - DNA, 20 bp, human
gcgacgacggccgagacgtg

SEQ ID NO: 193337 - DNA, 20 bp, human
ggcccgccatccccacgtct

SEQ ID NO: 193338 - DNA, 20 bp, human
gactgaggggaccgagacta

SEQ ID NO: 193339 - DNA, 20 bp, human
gcggagcctggtggccgcag

SEQ ID NO: 193340 - DNA, 20 bp, human
ggccgagacgtggggatggc

SEQ ID NO: 193341 - DNA, 20 bp, human
gtgagggcggcgcttccggt

SEQ ID NO: 193342 - DNA, 20 bp, human
ggaggggaccgagactaggg

SEQ ID NO: 193343 - DNA, 20 bp, human
gagcgacagcccggcgaacc

SEQ ID NO: 193344 - DNA, 20 bp, human
ggaaaaagggtcctgagacg

SEQ ID NO: 193345 - DNA, 20 bp, human
ggacggccgagacgtgggga

SEQ ID NO: 193346 - DNA, 20 bp, human
gggcaggtgagcggagactg

SEQ ID NO: 193347 - DNA, 20 bp, human
gtggcggaccccggaagtgt

SEQ ID NO: 193348 - DNA, 20 bp, human
ggcggctgcggtttaacccg

SEQ ID NO: 193349 - DNA, 20 bp, human
gccgcccgggccacaaccac

SEQ ID NO: 193350 - DNA, 20 bp, human
gctgcagagacgcagaaagg

SEQ ID NO: 193351 - DNA, 20 bp, human
gcaagtcggaccctactctt

SEQ ID NO: 193352 - DNA, 20 bp, human
ggcccctcgtgcccaatcac

SEQ ID NO: 193353 - DNA, 20 bp, human
gccgcaagatgctcacatat

SEQ ID NO: 193354 - DNA, 20 bp, human
gcgatgtcgtggtaactcag

SEQ ID NO: 193355 - DNA, 20 bp, human
gggcctgcagagacgcagaa

SEQ ID NO: 193356 - DNA, 20 bp, human
gcgcgaggcgtgtcctacag

SEQ ID NO: 193357 - DNA, 20 bp, human
gacgcctcgcggccatcctg

SEQ ID NO: 193358 - DNA, 20 bp, human
gtacagcggatgctccgggg

SEQ ID NO: 193359 - DNA, 20 bp, human
gcgagccagcagccgagctg

SEQ ID NO: 193360 - DNA, 20 bp, human
ggcgcggcccttccctcgag

SEQ ID NO: 193361 - DNA, 20 bp, human
gtcctacagcggatgctccg

SEQ ID NO: 193362 - DNA, 20 bp, human
gggcatgtaccgggcccggg

SEQ ID NO: 193363 - DNA, 20 bp, human
ggagcctggcacgtacgagt

SEQ ID NO: 193364 - DNA, 20 bp, human
gcccgcggagccacccccgg

SEQ ID NO: 193365 - DNA, 20 bp, human
gcaagctggaccggatcgtg

SEQ ID NO: 193366 - DNA, 20 bp, human
gaacactctgggcgagacgg

SEQ ID NO: 193367 - DNA, 20 bp, human
gggctcgaaagcgtcgtgca

SEQ ID NO: 193368 - DNA, 20 bp, human
ggatccggccaggaaccccc

SEQ ID NO: 193369 - DNA, 20 bp, human
gtctgggctaagggtagacc

SEQ ID NO: 193370 - DNA, 20 bp, human
gctaactagcaggaagtccg

SEQ ID NO: 193371 - DNA, 20 bp, human
gggaagtccggggttgacga

SEQ ID NO: 193372 - DNA, 20 bp, human
gctaagggtagaccgggatc

SEQ ID NO: 193373 - DNA, 20 bp, human
gggtagaccgggatccggcc

SEQ ID NO: 193374 - DNA, 20 bp, human
gagtcagcacaggagcggtc

SEQ ID NO: 193375 - DNA, 20 bp, human
gcgatggctgtgttgttgaa

SEQ ID NO: 193376 - DNA, 20 bp, human
gtttccctaggtgccctccc

SEQ ID NO: 193377 - DNA, 20 bp, human
ggaagcagaggagcaggtaa

SEQ ID NO: 193378 - DNA, 20 bp, human
gcacagggatatagagacta

SEQ ID NO: 193379 - DNA, 20 bp, human
gagcaggtaaagggtgcagg

SEQ ID NO: 193380 - DNA, 20 bp, human
gctgtcaggtgactctcccg

SEQ ID NO: 193381 - DNA, 20 bp, human
gctctcccgtggcgccatgg

SEQ ID NO: 193382 - DNA, 20 bp, human
gaagtaggacaataagaact

SEQ ID NO: 193383 - DNA, 20 bp, human
gtgactctcccgtggcgcca

SEQ ID NO: 193384 - DNA, 20 bp, human
gagggtgcaggtggtagttg

SEQ ID NO: 193385 - DNA, 20 bp, human
gggtggtagttgagggcaca

SEQ ID NO: 193386 - DNA, 20 bp, human
gtcagctccacgccactaag

SEQ ID NO: 193387 - DNA, 20 bp, human
gtctgtagctccataatcaa

SEQ ID NO: 193388 - DNA, 20 bp, human
ggaggccccatactcaccct

SEQ ID NO: 193389 - DNA, 20 bp, human
gtaagggagtgctctttcag

SEQ ID NO: 193390 - DNA, 20 bp, human
ggcactaacccagagacccg

SEQ ID NO: 193391 - DNA, 20 bp, human
gcttggacagcccttgatta

SEQ ID NO: 193392 - DNA, 20 bp, human
ggctgtccaagggtgagtat

SEQ ID NO: 193393 - DNA, 20 bp, human
gagaggattgataccagcac

SEQ ID NO: 193394 - DNA, 20 bp, human
gcaagcaccacttagtggcg

SEQ ID NO: 193395 - DNA, 20 bp, human
gtctttcaagcaccacttag

SEQ ID NO: 193396 - DNA, 20 bp, human
gagaagtagtctctaggcag

SEQ ID NO: 193397 - DNA, 20 bp, human
gccgggtagaagtagtctct

SEQ ID NO: 193398 - DNA, 20 bp, human
gtgagacccggccaacagac

SEQ ID NO: 193399 - DNA, 20 bp, human
gatatgtcagagcacttgga

SEQ ID NO: 193400 - DNA, 20 bp, human
gactcccggaagccgaatcc

SEQ ID NO: 193401 - DNA, 20 bp, human
gaatgggacgagcaattgta

SEQ ID NO: 193402 - DNA, 20 bp, human
gtgtagactgaaaacccacc

SEQ ID NO: 193403 - DNA, 20 bp, human
ggggttaatttagccagaaa

SEQ ID NO: 193404 - DNA, 20 bp, human
gtggcggggacatttagaaa

SEQ ID NO: 193405 - DNA, 20 bp, human
gaagccgaatcccggctggg

SEQ ID NO: 193406 - DNA, 20 bp, human
ggcagggcggccgctcgcag

SEQ ID NO: 193407 - DNA, 20 bp, human
gactcggctcccgctgcgag

SEQ ID NO: 193408 - DNA, 20 bp, human
gcgggtgaggctgatcccca

SEQ ID NO: 193409 - DNA, 20 bp, human
gggagccgaggtactgggtc

SEQ ID NO: 193410 - DNA, 20 bp, human
ggtgaggctgatccccacgg

SEQ ID NO: 193411 - DNA, 20 bp, human
gcagcgggagccgagtccga

SEQ ID NO: 193412 - DNA, 20 bp, human
gagcgcgtggaaacagacac

SEQ ID NO: 193413 - DNA, 20 bp, human
ggctacacgaagcggccctg

SEQ ID NO: 193414 - DNA, 20 bp, human
gccacgcgctcggagccggg

SEQ ID NO: 193415 - DNA, 20 bp, human
gcgaggagcgcagcccagag

SEQ ID NO: 193416 - DNA, 20 bp, human
gggcgggaccagaacctaga

SEQ ID NO: 193417 - DNA, 20 bp, human
ggggagggtcggagctctgg

SEQ ID NO: 193418 - DNA, 20 bp, human
gggattgcggaagtttggtg

SEQ ID NO: 193419 - DNA, 20 bp, human
ggtggggagggtcggagctc

SEQ ID NO: 193420 - DNA, 20 bp, human
gctagggagctgggatcgag

SEQ ID NO: 193421 - DNA, 20 bp, human
gccagaacctagagggcctc

SEQ ID NO: 193422 - DNA, 20 bp, human
gtctaaaacaagttccggaa

SEQ ID NO: 193423 - DNA, 20 bp, human
gtccaaaccagccaagatct

SEQ ID NO: 193424 - DNA, 20 bp, human
gctgtggtcgaggcgcagga

SEQ ID NO: 193425 - DNA, 20 bp, human
ggaagtgcccggagcagagg

SEQ ID NO: 193426 - DNA, 20 bp, human
ggctgcagttggaacgatgg

SEQ ID NO: 193427 - DNA, 20 bp, human
gtgggctgcagttggaacga

SEQ ID NO: 193428 - DNA, 20 bp, human
gagcagctgaggcgtctgag

SEQ ID NO: 193429 - DNA, 20 bp, human
gcagggagtacgagcagctg

SEQ ID NO: 193430 - DNA, 20 bp, human
ggaccccgggctaggcccgg

SEQ ID NO: 193431 - DNA, 20 bp, human
gcgtctgaggggatgtgagt

SEQ ID NO: 193432 - DNA, 20 bp, human
gtttccagcctcacgcccgt

SEQ ID NO: 193433 - DNA, 20 bp, human
ggatgtgagtaggactggac

SEQ ID NO: 193434 - DNA, 20 bp, human
gagaggacgaacctcggcca

SEQ ID NO: 193435 - DNA, 20 bp, human
ggagagcaggtgttcataag

SEQ ID NO: 193436 - DNA, 20 bp, human
ggtggagctacaagtcccaa

SEQ ID NO: 193437 - DNA, 20 bp, human
gtgaagtggttagagctgaa

SEQ ID NO: 193438 - DNA, 20 bp, human
gaccctgagcgggaccctag

SEQ ID NO: 193439 - DNA, 20 bp, human
gctgatcacagggaagggta

SEQ ID NO: 193440 - DNA, 20 bp, human
ggcagccgccatggtcgcag

SEQ ID NO: 193441 - DNA, 20 bp, human
gcagggtcgggtctgatcac

SEQ ID NO: 193442 - DNA, 20 bp, human
ggccaaacaggtaatatcac

SEQ ID NO: 193443 - DNA, 20 bp, human
gcgggctgggacctcagata

SEQ ID NO: 193444 - DNA, 20 bp, human
ggccgccgctgcgaccatgg

SEQ ID NO: 193445 - DNA, 20 bp, human
gtcgggtctgatcacaggga

SEQ ID NO: 193446 - DNA, 20 bp, human
gacagagcggctgacggagc

SEQ ID NO: 193447 - DNA, 20 bp, human
ggggaaacgggagtgcggga

SEQ ID NO: 193448 - DNA, 20 bp, human
gcagcacagcaactccctcg

SEQ ID NO: 193449 - DNA, 20 bp, human
gtgacggagccgggctcacc

SEQ ID NO: 193450 - DNA, 20 bp, human
gctccctcgcggcagcgacc

SEQ ID NO: 193451 - DNA, 20 bp, human
gccgggtggcggaatgatgg

SEQ ID NO: 193452 - DNA, 20 bp, human
gcctgccggaagtgccggag

SEQ ID NO: 193453 - DNA, 20 bp, human
gaggtggtgcgggtgagaag

SEQ ID NO: 193454 - DNA, 20 bp, human
gcaccaggtcgctgccgcga

SEQ ID NO: 193455 - DNA, 20 bp, human
ggccgctctgtcagccgctc

SEQ ID NO: 193456 - DNA, 20 bp, human
gagcctcggtgcgacgtgga

SEQ ID NO: 193457 - DNA, 20 bp, human
ggaggcggcggcgatgcact

SEQ ID NO: 193458 - DNA, 20 bp, human
gcacctacctgcgggtcccg

SEQ ID NO: 193459 - DNA, 20 bp, human
gtcgggagcagaagcgctag

SEQ ID NO: 193460 - DNA, 20 bp, human
gagtgaagctgggctcgaga

SEQ ID NO: 193461 - DNA, 20 bp, human
ggagccgcgcggtggattgt

SEQ ID NO: 193462 - DNA, 20 bp, human
gatgcactaggcctcgctca

SEQ ID NO: 193463 - DNA, 20 bp, human
gtgccccgggacccgcaggt

SEQ ID NO: 193464 - DNA, 20 bp, human
gacacccgggagagacgtga

SEQ ID NO: 193465 - DNA, 20 bp, human
gcgcggggcacacctacctg

SEQ ID NO: 193466 - DNA, 20 bp, human
ggtggcggcgcagtctcggt

SEQ ID NO: 193467 - DNA, 20 bp, human
gccaaaaccgagctggtgag

SEQ ID NO: 193468 - DNA, 20 bp, human
gagacggagaagctctccgg

SEQ ID NO: 193469 - DNA, 20 bp, human
gccccggacaaagaagaaga

SEQ ID NO: 193470 - DNA, 20 bp, human
gatgcaaccacgcaagtata

SEQ ID NO: 193471 - DNA, 20 bp, human
gaaccacgcaagtatacggt

SEQ ID NO: 193472 - DNA, 20 bp, human
gccagaaagccggttcccag

SEQ ID NO: 193473 - DNA, 20 bp, human
gacctgcgggtggccaccag

SEQ ID NO: 193474 - DNA, 20 bp, human
gtcggtaggcggtatgagtt

SEQ ID NO: 193475 - DNA, 20 bp, human
gcgagctcccaaaaccgagc

SEQ ID NO: 193476 - DNA, 20 bp, human
ggcagtgggtgcggtcacgt

SEQ ID NO: 193477 - DNA, 20 bp, human
gtaggtagtgcgcgtgcgtg

SEQ ID NO: 193478 - DNA, 20 bp, human
ggtgcgtgaggctagagcag

SEQ ID NO: 193479 - DNA, 20 bp, human
gcagagagcgggcccgtgga

SEQ ID NO: 193480 - DNA, 20 bp, human
gggtccggttagcccgtcag

SEQ ID NO: 193481 - DNA, 20 bp, human
gcacgtgggccggcggtcca

SEQ ID NO: 193482 - DNA, 20 bp, human
ggaggctagagcagtgggtg

SEQ ID NO: 193483 - DNA, 20 bp, human
gaatacatcaccggagtcac

SEQ ID NO: 193484 - DNA, 20 bp, human
gagatacacaaatacatcac

SEQ ID NO: 193485 - DNA, 20 bp, human
gtatagtcgcaaagtagata

SEQ ID NO: 193486 - DNA, 20 bp, human
gcggccatggcgccgagcgg

SEQ ID NO: 193487 - DNA, 20 bp, human
ggcctgggctccacctgtag

SEQ ID NO: 193488 - DNA, 20 bp, human
ggcttcatggcgctctgcag

SEQ ID NO: 193489 - DNA, 20 bp, human
gccatggcgccgagcggggg

SEQ ID NO: 193490 - DNA, 20 bp, human
gcagcggccatggcgccgag

SEQ ID NO: 193491 - DNA, 20 bp, human
gggcttcaccgtgccgtccc

SEQ ID NO: 193492 - DNA, 20 bp, human
ggggctggacgggcgaccgg

SEQ ID NO: 193493 - DNA, 20 bp, human
gtagaggagatgtagcagga

SEQ ID NO: 193494 - DNA, 20 bp, human
gatccggttgccacagggga

SEQ ID NO: 193495 - DNA, 20 bp, human
gtcctctacaggtggagccc

SEQ ID NO: 193496 - DNA, 20 bp, human
gccgctgccgagttacgagt

SEQ ID NO: 193497 - DNA, 20 bp, human
ggggtctgcggcttagggta

SEQ ID NO: 193498 - DNA, 20 bp, human
gtacgagtcggcgaaagcgg

SEQ ID NO: 193499 - DNA, 20 bp, human
gagttacgagtcggcgaaag

SEQ ID NO: 193500 - DNA, 20 bp, human
gtctgcggcttagggtaggg

SEQ ID NO: 193501 - DNA, 20 bp, human
ggagccccgcctgacagaac

SEQ ID NO: 193502 - DNA, 20 bp, human
gttcccggtgaggcccgagg

SEQ ID NO: 193503 - DNA, 20 bp, human
ggtactgggcagaacgcgac

SEQ ID NO: 193504 - DNA, 20 bp, human
ggaacgtggagctcagatgg

SEQ ID NO: 193505 - DNA, 20 bp, human
gctacagagtgagctctgcg

SEQ ID NO: 193506 - DNA, 20 bp, human
gccagagcaagagactgacc

SEQ ID NO: 193507 - DNA, 20 bp, human
ggtccccggcgtgctaaggg

SEQ ID NO: 193508 - DNA, 20 bp, human
gcgtcgcagcggcaggtagg

SEQ ID NO: 193509 - DNA, 20 bp, human
ggggctccgcctcgtcgcag

SEQ ID NO: 193510 - DNA, 20 bp, human
gcctcgtcgcagcggcaggt

SEQ ID NO: 193511 - DNA, 20 bp, human
gttagcacgccggggaccta

SEQ ID NO: 193512 - DNA, 20 bp, human
gcccgctgggagtgagaaca

SEQ ID NO: 193513 - DNA, 20 bp, human
gcgagcaaactggtacccag

SEQ ID NO: 193514 - DNA, 20 bp, human
gtgctaagggcggacggacc

SEQ ID NO: 193515 - DNA, 20 bp, human
ggctccggcactgcaagcgg

SEQ ID NO: 193516 - DNA, 20 bp, human
gcaactgagaaggtgagtcc

SEQ ID NO: 193517 - DNA, 20 bp, human
gcgcagcgctctccgcccag

SEQ ID NO: 193518 - DNA, 20 bp, human
ggtaactgcggaggatccga

SEQ ID NO: 193519 - DNA, 20 bp, human
ggcacctccatagaaaccac

SEQ ID NO: 193520 - DNA, 20 bp, human
gtttcgctgggcaactgaga

SEQ ID NO: 193521 - DNA, 20 bp, human
gctatggaggtgcggccgaa

SEQ ID NO: 193522 - DNA, 20 bp, human
gcgacgacagagcctccctt

SEQ ID NO: 193523 - DNA, 20 bp, human
gtggctaaggcggagatggg

SEQ ID NO: 193524 - DNA, 20 bp, human
gccccacctgcgctgaggtg

SEQ ID NO: 193525 - DNA, 20 bp, human
gcccaacacggagcccaagg

SEQ ID NO: 193526 - DNA, 20 bp, human
ggaggccagaccattgtgta

SEQ ID NO: 193527 - DNA, 20 bp, human
gcagaccattgtgtagggtg

SEQ ID NO: 193528 - DNA, 20 bp, human
gggaagggagataggcagac

SEQ ID NO: 193529 - DNA, 20 bp, human
gggagataggcagacgggtg

SEQ ID NO: 193530 - DNA, 20 bp, human
gagtgagacgagctcggctg

SEQ ID NO: 193531 - DNA, 20 bp, human
ggagaagcccggggaacctg

SEQ ID NO: 193532 - DNA, 20 bp, human
gccttccccaccctacacaa

SEQ ID NO: 193533 - DNA, 20 bp, human
ggtagacggtccatgctcaa

SEQ ID NO: 193534 - DNA, 20 bp, human
gtgtctgggagtgtatgtag

SEQ ID NO: 193535 - DNA, 20 bp, human
gggagcctccaaactgtacg

SEQ ID NO: 193536 - DNA, 20 bp, human
gttgagactcagcctagtcc

SEQ ID NO: 193537 - DNA, 20 bp, human
gactaggctgagtctcaaat

SEQ ID NO: 193538 - DNA, 20 bp, human
gagataagccaggcaaacct

SEQ ID NO: 193539 - DNA, 20 bp, human
gctgccttgcaggtaaggaa

SEQ ID NO: 193540 - DNA, 20 bp, human
gcttacctgcaaggcagctt

SEQ ID NO: 193541 - DNA, 20 bp, human
gtcaactaacctccacacaa

SEQ ID NO: 193542 - DNA, 20 bp, human
gggcttcttcgatcacaccg

SEQ ID NO: 193543 - DNA, 20 bp, human
gcaggtgccagtagcttgcc

SEQ ID NO: 193544 - DNA, 20 bp, human
ggaaaccaaactttgtgcta

SEQ ID NO: 193545 - DNA, 20 bp, human
gagtcaatcactgagcttaa

SEQ ID NO: 193546 - DNA, 20 bp, human
gtcctcccgggccaaggtag

SEQ ID NO: 193547 - DNA, 20 bp, human
ggatcgcggccccttaccta

SEQ ID NO: 193548 - DNA, 20 bp, human
gtcctcccaggtcctcggaa

SEQ ID NO: 193549 - DNA, 20 bp, human
ggccggccaggagcgccccg

SEQ ID NO: 193550 - DNA, 20 bp, human
ggctgggtcgccgtaggtaa

SEQ ID NO: 193551 - DNA, 20 bp, human
gcctgccggcggaaaacaac

SEQ ID NO: 193552 - DNA, 20 bp, human
gtaaggggccgcgatctgga

SEQ ID NO: 193553 - DNA, 20 bp, human
gtcctctaccttggcccggg

SEQ ID NO: 193554 - DNA, 20 bp, human
gggtcctcggaacggcagag

SEQ ID NO: 193555 - DNA, 20 bp, human
gcccgccagcctactcctgc

SEQ ID NO: 193556 - DNA, 20 bp, human
gtacccaggagtaggaagag

SEQ ID NO: 193557 - DNA, 20 bp, human
gagcaccatggacaacccac

SEQ ID NO: 193558 - DNA, 20 bp, human
gttcagagaagggggaaacc

SEQ ID NO: 193559 - DNA, 20 bp, human
gctcaaagagctcttcccag

SEQ ID NO: 193560 - DNA, 20 bp, human
gtggtgctggcctcactgaa

SEQ ID NO: 193561 - DNA, 20 bp, human
gtgccactcttcctactcct

SEQ ID NO: 193562 - DNA, 20 bp, human
gggaaaccgggctcaaatct

SEQ ID NO: 193563 - DNA, 20 bp, human
gggaaatacttcagaaccag

SEQ ID NO: 193564 - DNA, 20 bp, human
gagctgggaggtttgatgga

SEQ ID NO: 193565 - DNA, 20 bp, human
gggcctcactgaaaggacac

SEQ ID NO: 193566 - DNA, 20 bp, human
gggccggcccagcactgaga

SEQ ID NO: 193567 - DNA, 20 bp, human
gagggatgaccaggactgac

SEQ ID NO: 193568 - DNA, 20 bp, human
gtgagagggcggacattcct

SEQ ID NO: 193569 - DNA, 20 bp, human
gccagaaagaggataaggga

SEQ ID NO: 193570 - DNA, 20 bp, human
gggagccaaatagagtggca

SEQ ID NO: 193571 - DNA, 20 bp, human
gatgaccaggactgacgggc

SEQ ID NO: 193572 - DNA, 20 bp, human
gtgggccggcccgtcagtcc

SEQ ID NO: 193573 - DNA, 20 bp, human
gcgggatcgcaggaaaagtg

SEQ ID NO: 193574 - DNA, 20 bp, human
gggggccagaaagaggataa

SEQ ID NO: 193575 - DNA, 20 bp, human
ggtaacctggcagaagtggg

SEQ ID NO: 193576 - DNA, 20 bp, human
gcagggaagggagcacccaa

SEQ ID NO: 193577 - DNA, 20 bp, human
gccaggtgggcggtcaaggt

SEQ ID NO: 193578 - DNA, 20 bp, human
gggaaccgggccaggtaaga

SEQ ID NO: 193579 - DNA, 20 bp, human
gagcgagttgggcctctccg

SEQ ID NO: 193580 - DNA, 20 bp, human
gaggagcaggacaggacggc

SEQ ID NO: 193581 - DNA, 20 bp, human
ggtccccgccaggccagatg

SEQ ID NO: 193582 - DNA, 20 bp, human
ggggcggtcaaggtcggtct

SEQ ID NO: 193583 - DNA, 20 bp, human
gcaaggtcggtctgggtgtc

SEQ ID NO: 193584 - DNA, 20 bp, human
gcctgccaggtgggcggtca

SEQ ID NO: 193585 - DNA, 20 bp, human
gtgggtaaaagagccggaac

SEQ ID NO: 193586 - DNA, 20 bp, human
gcagcctcctgctaccaaag

SEQ ID NO: 193587 - DNA, 20 bp, human
gactgggcctgctactcctg

SEQ ID NO: 193588 - DNA, 20 bp, human
gtatctcaggggcatcaaga

SEQ ID NO: 193589 - DNA, 20 bp, human
gaagaggctcaaacttctgg

SEQ ID NO: 193590 - DNA, 20 bp, human
gctcctggggcacctaacag

SEQ ID NO: 193591 - DNA, 20 bp, human
ggaagactcacctgcccagt

SEQ ID NO: 193592 - DNA, 20 bp, human
gccaaagaggctcaaacttc

SEQ ID NO: 193593 - DNA, 20 bp, human
ggcttaggcaaaaggctaga

SEQ ID NO: 193594 - DNA, 20 bp, human
gaagtagctctggctgtgat

SEQ ID NO: 193595 - DNA, 20 bp, human
gtgagagagcctgcagagtt

SEQ ID NO: 193596 - DNA, 20 bp, human
gcgtagtggtgggtgtgagg

SEQ ID NO: 193597 - DNA, 20 bp, human
ggtatcccgtggggtcgtag

SEQ ID NO: 193598 - DNA, 20 bp, human
gagggcccagacactgcctg

SEQ ID NO: 193599 - DNA, 20 bp, human
gacatgtgtgagcccgacag

SEQ ID NO: 193600 - DNA, 20 bp, human
gctgggctgggtatcccgtg

SEQ ID NO: 193601 - DNA, 20 bp, human
gggatacccagcccagacgg

SEQ ID NO: 193602 - DNA, 20 bp, human
gtcccgtggggtcgtagtgg

SEQ ID NO: 193603 - DNA, 20 bp, human
ggtaggagaggggtaagcac

SEQ ID NO: 193604 - DNA, 20 bp, human
gagctcatgccgtgactagg

SEQ ID NO: 193605 - DNA, 20 bp, human
gatccctctcctcctagtca

SEQ ID NO: 193606 - DNA, 20 bp, human
gtgcaaggcgcgatccaaga

SEQ ID NO: 193607 - DNA, 20 bp, human
gcccgagcgtgttgcggcag

SEQ ID NO: 193608 - DNA, 20 bp, human
gatccagctccagggaccct

SEQ ID NO: 193609 - DNA, 20 bp, human
ggatttacccgagcgtgttg

SEQ ID NO: 193610 - DNA, 20 bp, human
ggcgtgttgcggcagcggct

SEQ ID NO: 193611 - DNA, 20 bp, human
gatgtgctcttagtccatgg

SEQ ID NO: 193612 - DNA, 20 bp, human
ggcctgcgcatccagctcca

SEQ ID NO: 193613 - DNA, 20 bp, human
ggggctgcttaaatccctct

SEQ ID NO: 193614 - DNA, 20 bp, human
gttatatgcggcgtgtttgg

SEQ ID NO: 193615 - DNA, 20 bp, human
gtattccaaaagatccccca

SEQ ID NO: 193616 - DNA, 20 bp, human
gcaggatgtgcagatagagg

SEQ ID NO: 193617 - DNA, 20 bp, human
gccccaggatgtgcagatag

SEQ ID NO: 193618 - DNA, 20 bp, human
gggacagactccgctgggaa

SEQ ID NO: 193619 - DNA, 20 bp, human
gcacatcctggggacgaacc

SEQ ID NO: 193620 - DNA, 20 bp, human
gagaaggaaactgcaagagt

SEQ ID NO: 193621 - DNA, 20 bp, human
gaggccgcgctgcagagaca

SEQ ID NO: 193622 - DNA, 20 bp, human
gcctccgtcggaatagagga

SEQ ID NO: 193623 - DNA, 20 bp, human
gctgggcttagggatctaca

SEQ ID NO: 193624 - DNA, 20 bp, human
gccacatgcaagcgaggagg

SEQ ID NO: 193625 - DNA, 20 bp, human
gtgggccggccgcagctctc

SEQ ID NO: 193626 - DNA, 20 bp, human
ggattcagcgaggcttcctg

SEQ ID NO: 193627 - DNA, 20 bp, human
ggagcccaggctggaatcgc

SEQ ID NO: 193628 - DNA, 20 bp, human
gttcccagcgattccagcct

SEQ ID NO: 193629 - DNA, 20 bp, human
ggcttcctagcaagtaacag

SEQ ID NO: 193630 - DNA, 20 bp, human
ggtgatcacgcaagccggag

SEQ ID NO: 193631 - DNA, 20 bp, human
gagctggctgggattcagcg

SEQ ID NO: 193632 - DNA, 20 bp, human
ggaggcttcctgcggagccc

SEQ ID NO: 193633 - DNA, 20 bp, human
gtgacgttggacgagctgcc

SEQ ID NO: 193634 - DNA, 20 bp, human
gccggctccgtgtttaggga

SEQ ID NO: 193635 - DNA, 20 bp, human
gctgcctgctttcagctacc

SEQ ID NO: 193636 - DNA, 20 bp, human
gagaggcggcaggtatccga

SEQ ID NO: 193637 - DNA, 20 bp, human
gacagggaggcagaagctcg

SEQ ID NO: 193638 - DNA, 20 bp, human
gcccgcgggagatggaacag

SEQ ID NO: 193639 - DNA, 20 bp, human
gtcggccacgaagagcagca

SEQ ID NO: 193640 - DNA, 20 bp, human
ggccgagggagtgcgtgcca

SEQ ID NO: 193641 - DNA, 20 bp, human
gtccgtggcacgcactccct

SEQ ID NO: 193642 - DNA, 20 bp, human
gaatcgggagcagaaccaga

SEQ ID NO: 193643 - DNA, 20 bp, human
ggcacgcactccctcggcca

SEQ ID NO: 193644 - DNA, 20 bp, human
gcactccctcggccagggat

SEQ ID NO: 193645 - DNA, 20 bp, human
ggggacccatccctggccga

SEQ ID NO: 193646 - DNA, 20 bp, human
gggaagagtcccgcagtcgg

SEQ ID NO: 193647 - DNA, 20 bp, human
gagagtcccgcagtcggagg

SEQ ID NO: 193648 - DNA, 20 bp, human
gccgggatgcccgccacgac

SEQ ID NO: 193649 - DNA, 20 bp, human
ggccgccccggggctcgaac

SEQ ID NO: 193650 - DNA, 20 bp, human
gaagggaagagtcccgcagt

SEQ ID NO: 193651 - DNA, 20 bp, human
gaaaagtgccaggtagtgga

SEQ ID NO: 193652 - DNA, 20 bp, human
gcgctcgctccccgaagccg

SEQ ID NO: 193653 - DNA, 20 bp, human
gtggagggcgcccagcgcta

SEQ ID NO: 193654 - DNA, 20 bp, human
gctcgaaccggcgccagtcg

SEQ ID NO: 193655 - DNA, 20 bp, human
gcggcccagccccggcttcg

SEQ ID NO: 193656 - DNA, 20 bp, human
gcctgccgctgggaagatct

SEQ ID NO: 193657 - DNA, 20 bp, human
gagaccctcggcgagcccac

SEQ ID NO: 193658 - DNA, 20 bp, human
ggaaagcgaaccaccaactt

SEQ ID NO: 193659 - DNA, 20 bp, human
gggagcgcagcccaagttgg

SEQ ID NO: 193660 - DNA, 20 bp, human
ggccgcccggcgctgtgacg

SEQ ID NO: 193661 - DNA, 20 bp, human
gtccgaagacaagtcaggag

SEQ ID NO: 193662 - DNA, 20 bp, human
gcggggaccgcgctcacggg

SEQ ID NO: 193663 - DNA, 20 bp, human
gtcccagcggcaggccccga

SEQ ID NO: 193664 - DNA, 20 bp, human
gcctgactgccgtggaaaaa

SEQ ID NO: 193665 - DNA, 20 bp, human
gcgtcctctgaaccttgggg

SEQ ID NO: 193666 - DNA, 20 bp, human
gaagaacctgcggcagccag

SEQ ID NO: 193667 - DNA, 20 bp, human
ggcgccgaccgtagcgggag

SEQ ID NO: 193668 - DNA, 20 bp, human
ggccctcagccggacaaggt

SEQ ID NO: 193669 - DNA, 20 bp, human
ggacccggcgccgaccgtag

SEQ ID NO: 193670 - DNA, 20 bp, human
gcagagggcgaagagtccta

SEQ ID NO: 193671 - DNA, 20 bp, human
gcagcccctcccgctacggt

SEQ ID NO: 193672 - DNA, 20 bp, human
gaaggtggcccagagataac

SEQ ID NO: 193673 - DNA, 20 bp, human
gccgctgggcagaggcctca

SEQ ID NO: 193674 - DNA, 20 bp, human
gtgcccagcccctcccgcta

SEQ ID NO: 193675 - DNA, 20 bp, human
ggcgcgccctcagccggaca

SEQ ID NO: 193676 - DNA, 20 bp, human
gtcccagggtgtccccaccg

SEQ ID NO: 193677 - DNA, 20 bp, human
gggagagaagatccgagccc

SEQ ID NO: 193678 - DNA, 20 bp, human
gatagcatgggatcatgctc

SEQ ID NO: 193679 - DNA, 20 bp, human
gtgaaggaaatagctcccga

SEQ ID NO: 193680 - DNA, 20 bp, human
gcagcgtgatggccgagtac

SEQ ID NO: 193681 - DNA, 20 bp, human
gcggctcgaggtgttgtagg

SEQ ID NO: 193682 - DNA, 20 bp, human
gctggctcctgggtaaggaa

SEQ ID NO: 193683 - DNA, 20 bp, human
ggaggtgttgtaggaggtgg

SEQ ID NO: 193684 - DNA, 20 bp, human
gacgtgcggtccggactcac

SEQ ID NO: 193685 - DNA, 20 bp, human
gcggagttgagcacggagtc

SEQ ID NO: 193686 - DNA, 20 bp, human
ggccattgggcagagcatcg

SEQ ID NO: 193687 - DNA, 20 bp, human
gcggccagctcgggtaggtg

SEQ ID NO: 193688 - DNA, 20 bp, human
ggagcattagacaccggagg

SEQ ID NO: 193689 - DNA, 20 bp, human
ggctccagagcattagacac

SEQ ID NO: 193690 - DNA, 20 bp, human
gcggctgtcgccccccagtc

SEQ ID NO: 193691 - DNA, 20 bp, human
ggacaccggagggggcacct

SEQ ID NO: 193692 - DNA, 20 bp, human
gccagagcattagacaccgg

SEQ ID NO: 193693 - DNA, 20 bp, human
gccagccagacggccagctc

SEQ ID NO: 193694 - DNA, 20 bp, human
gaagtggacgctctgcgggt

SEQ ID NO: 193695 - DNA, 20 bp, human
ggagatcctgggcttgaaca

SEQ ID NO: 193696 - DNA, 20 bp, human
ggtgccggtggagcgcgagt

SEQ ID NO: 193697 - DNA, 20 bp, human
gtgccccaagaacctcaggg

SEQ ID NO: 193698 - DNA, 20 bp, human
gggtgagttcggagtagaga

SEQ ID NO: 193699 - DNA, 20 bp, human
ggaacctcagggaggtgtgt

SEQ ID NO: 193700 - DNA, 20 bp, human
gaggctcgaggtcaaagctc

SEQ ID NO: 193701 - DNA, 20 bp, human
ggctaccgcccagacggaag

SEQ ID NO: 193702 - DNA, 20 bp, human
ggagcctgtgtagtcagtac

SEQ ID NO: 193703 - DNA, 20 bp, human
gggcatgccccaagaacctc

SEQ ID NO: 193704 - DNA, 20 bp, human
ggctccagtactgactacac

SEQ ID NO: 193705 - DNA, 20 bp, human
ggagcatacagcatcatctg

SEQ ID NO: 193706 - DNA, 20 bp, human
ggaaggttcccagcgtatct

SEQ ID NO: 193707 - DNA, 20 bp, human
gcccagggaagccatggctg

SEQ ID NO: 193708 - DNA, 20 bp, human
gggttgtgagtcaccaagga

SEQ ID NO: 193709 - DNA, 20 bp, human
gagctggttgtgagtcacca

SEQ ID NO: 193710 - DNA, 20 bp, human
gtcccagcgtatctgggtac

SEQ ID NO: 193711 - DNA, 20 bp, human
gcacagccttgacatctcag

SEQ ID NO: 193712 - DNA, 20 bp, human
gcatgactgcgacagtggag

SEQ ID NO: 193713 - DNA, 20 bp, human
ggcattcccctgagatgtca

SEQ ID NO: 193714 - DNA, 20 bp, human
gtatctgggtactggctgag

SEQ ID NO: 193715 - DNA, 20 bp, human
ggccagtacccagatacgct

SEQ ID NO: 193716 - DNA, 20 bp, human
gtcagggaaagggcctcgag

SEQ ID NO: 193717 - DNA, 20 bp, human
gagagcagaacggagaaccg

SEQ ID NO: 193718 - DNA, 20 bp, human
gttctccgttctgctctcgg

SEQ ID NO: 193719 - DNA, 20 bp, human
ggctgttcccaggagggata

SEQ ID NO: 193720 - DNA, 20 bp, human
gccccgcggcttaggaaccc

SEQ ID NO: 193721 - DNA, 20 bp, human
ggcggcttaggaaccccgga

SEQ ID NO: 193722 - DNA, 20 bp, human
ggcgacgaacaaccaggaag

SEQ ID NO: 193723 - DNA, 20 bp, human
gctcaccaggcgggagtcgt

SEQ ID NO: 193724 - DNA, 20 bp, human
ggaacaaccaggaagcggct

SEQ ID NO: 193725 - DNA, 20 bp, human
gcagatggctcagattccga

SEQ ID NO: 193726 - DNA, 20 bp, human
gtcctcagacacgcccccta

SEQ ID NO: 193727 - DNA, 20 bp, human
gcccagggaactgaatcccg

SEQ ID NO: 193728 - DNA, 20 bp, human
gtgaccgccgggctaggaaa

SEQ ID NO: 193729 - DNA, 20 bp, human
gctgggcggcggtggtgcgg

SEQ ID NO: 193730 - DNA, 20 bp, human
ggctcgagaggaccctgccg

SEQ ID NO: 193731 - DNA, 20 bp, human
gaggtccaatttactctcag

SEQ ID NO: 193732 - DNA, 20 bp, human
gcgcagggctgcgctcccca

SEQ ID NO: 193733 - DNA, 20 bp, human
gtgggacaagccagccctag

SEQ ID NO: 193734 - DNA, 20 bp, human
gggtcgccgttatggccact

SEQ ID NO: 193735 - DNA, 20 bp, human
gtaggcgactcctgagggag

SEQ ID NO: 193736 - DNA, 20 bp, human
gcgctctgatgcctgaggaa

SEQ ID NO: 193737 - DNA, 20 bp, human
gagaccgtgtactcatcctc

SEQ ID NO: 193738 - DNA, 20 bp, human
ggtatgagaaggggtctcag

SEQ ID NO: 193739 - DNA, 20 bp, human
ggcatcagagcggagacttc

SEQ ID NO: 193740 - DNA, 20 bp, human
ggtctccgctctgatgcctg

SEQ ID NO: 193741 - DNA, 20 bp, human
gcggctgagtgcaagcccca

SEQ ID NO: 193742 - DNA, 20 bp, human
gagctgctgcacagactata

SEQ ID NO: 193743 - DNA, 20 bp, human
gtgagctagaagccctgcca

SEQ ID NO: 193744 - DNA, 20 bp, human
gagagcagagctcgtcacac

SEQ ID NO: 193745 - DNA, 20 bp, human
gggccatctgggtcaatgta

SEQ ID NO: 193746 - DNA, 20 bp, human
gccactaagggccctcgcaa

SEQ ID NO: 193747 - DNA, 20 bp, human
gccttagtggagggatggta

SEQ ID NO: 193748 - DNA, 20 bp, human
gccaggccgagcgccgtcca

SEQ ID NO: 193749 - DNA, 20 bp, human
gagcatcgcgcgcgagggac

SEQ ID NO: 193750 - DNA, 20 bp, human
gaagggccctcgcaagggta

SEQ ID NO: 193751 - DNA, 20 bp, human
gcgcgcgatgctcccctgga

SEQ ID NO: 193752 - DNA, 20 bp, human
gacgcgcacagaccccggag

SEQ ID NO: 193753 - DNA, 20 bp, human
ggcgggcctggacaggaaga

SEQ ID NO: 193754 - DNA, 20 bp, human
gagggagatgtctgtcaagg

SEQ ID NO: 193755 - DNA, 20 bp, human
gagcgccagccgcaagctca

SEQ ID NO: 193756 - DNA, 20 bp, human
gcgctacgggatcacaggag

SEQ ID NO: 193757 - DNA, 20 bp, human
gcagagggggccccagtacc

SEQ ID NO: 193758 - DNA, 20 bp, human
ggtgagtcccagccccgagt

SEQ ID NO: 193759 - DNA, 20 bp, human
ggtgcggtcagcaggtaagt

SEQ ID NO: 193760 - DNA, 20 bp, human
gggactcaccggaaggagag

SEQ ID NO: 193761 - DNA, 20 bp, human
gtcgcggctgcaccgctcgg

SEQ ID NO: 193762 - DNA, 20 bp, human
gccgcgagtggccacgaggg

SEQ ID NO: 193763 - DNA, 20 bp, human
gcggctctactcacagaccc

SEQ ID NO: 193764 - DNA, 20 bp, human
ggggagcgtgaatcggtcat

SEQ ID NO: 193765 - DNA, 20 bp, human
gggctgcgcggccccgccga

SEQ ID NO: 193766 - DNA, 20 bp, human
gaagggctcctggcactcca

SEQ ID NO: 193767 - DNA, 20 bp, human
ggtgagatccaggagaagta

SEQ ID NO: 193768 - DNA, 20 bp, human
ggcgacaggaggacttccac

SEQ ID NO: 193769 - DNA, 20 bp, human
gtcgctgctgagttgcttgg

SEQ ID NO: 193770 - DNA, 20 bp, human
gtccaggagaagtaaggccc

SEQ ID NO: 193771 - DNA, 20 bp, human
ggaaaccagaagtgagatcc

SEQ ID NO: 193772 - DNA, 20 bp, human
gaggacttccacaggaggag

SEQ ID NO: 193773 - DNA, 20 bp, human
gacaggaggacttccacagg

SEQ ID NO: 193774 - DNA, 20 bp, human
ggactgagtgagaagatcga

SEQ ID NO: 193775 - DNA, 20 bp, human
gatgctcggcatgtagggag

SEQ ID NO: 193776 - DNA, 20 bp, human
gagcatcccgctggtggata

SEQ ID NO: 193777 - DNA, 20 bp, human
ggataaggcagcgattccgg

SEQ ID NO: 193778 - DNA, 20 bp, human
gagaccgcgctcggaaccag

SEQ ID NO: 193779 - DNA, 20 bp, human
gccgcctgacccgagagggc

SEQ ID NO: 193780 - DNA, 20 bp, human
ggggcccgcctgacccgaga

SEQ ID NO: 193781 - DNA, 20 bp, human
ggaggtaagcatcccgctgg

SEQ ID NO: 193782 - DNA, 20 bp, human
gcacctcggcggctctcgtg

SEQ ID NO: 193783 - DNA, 20 bp, human
gcaccagagcggctgggcgt

SEQ ID NO: 193784 - DNA, 20 bp, human
gaagagctctagagtaggag

SEQ ID NO: 193785 - DNA, 20 bp, human
gggcgaggtaagcatcccgc

SEQ ID NO: 193786 - DNA, 20 bp, human
gtctatagagaagggcttag

SEQ ID NO: 193787 - DNA, 20 bp, human
gaggtaggggaccaagctac

SEQ ID NO: 193788 - DNA, 20 bp, human
gcttaggggctgcaactgat

SEQ ID NO: 193789 - DNA, 20 bp, human
gctggatccaacccctgctc

SEQ ID NO: 193790 - DNA, 20 bp, human
gggaccaagctaccggtgca

SEQ ID NO: 193791 - DNA, 20 bp, human
ggggaaagggagctagaatg

SEQ ID NO: 193792 - DNA, 20 bp, human
gctgtgactcagagcgctcc

SEQ ID NO: 193793 - DNA, 20 bp, human
ggaagaagggccttgagatt

SEQ ID NO: 193794 - DNA, 20 bp, human
gtttacagaagagactgcgt

SEQ ID NO: 193795 - DNA, 20 bp, human
gaggccctgcaccggtagct

SEQ ID NO: 193796 - DNA, 20 bp, human
gtaaacagctatcgcaatgt

SEQ ID NO: 193797 - DNA, 20 bp, human
ggtgcagaaggcagtcactg

SEQ ID NO: 193798 - DNA, 20 bp, human
gtgcttctggggtaaggtaa

SEQ ID NO: 193799 - DNA, 20 bp, human
gcaagggggctgctctgggt

SEQ ID NO: 193800 - DNA, 20 bp, human
gactgtgtgcaggcaccatg

SEQ ID NO: 193801 - DNA, 20 bp, human
gggacctgagtagcaacatg

SEQ ID NO: 193802 - DNA, 20 bp, human
ggtgtgcaggcaccatgggg

SEQ ID NO: 193803 - DNA, 20 bp, human
gaaatggctcggcctcctgc

SEQ ID NO: 193804 - DNA, 20 bp, human
gggctggccccacttgtgtc

SEQ ID NO: 193805 - DNA, 20 bp, human
gtggccccacttgtgtcagg

SEQ ID NO: 193806 - DNA, 20 bp, human
ggccgagcgggagctcctga

SEQ ID NO: 193807 - DNA, 20 bp, human
ggccccggcaggccccgtcc

SEQ ID NO: 193808 - DNA, 20 bp, human
gggacccaggagtccgtgag

SEQ ID NO: 193809 - DNA, 20 bp, human
gagctcctgagggcgacagg

SEQ ID NO: 193810 - DNA, 20 bp, human
gctcactccagcacccggac

SEQ ID NO: 193811 - DNA, 20 bp, human
ggagccgggcccgcacgctg

SEQ ID NO: 193812 - DNA, 20 bp, human
gtcctgagggcgacaggtgg

SEQ ID NO: 193813 - DNA, 20 bp, human
gaaggagacgcgccgtccgg

SEQ ID NO: 193814 - DNA, 20 bp, human
gcgcccaccccgcgctccag

SEQ ID NO: 193815 - DNA, 20 bp, human
gccgaggccgaggtggtgtc

SEQ ID NO: 193816 - DNA, 20 bp, human
gcctgcctgcccaaagccac

SEQ ID NO: 193817 - DNA, 20 bp, human
ggacagaaggctctcaaggg

SEQ ID NO: 193818 - DNA, 20 bp, human
gagacccagcaaccaggtag

SEQ ID NO: 193819 - DNA, 20 bp, human
ggggaggcccgccctggcgt

SEQ ID NO: 193820 - DNA, 20 bp, human
ggcaggagcgaaagggccag

SEQ ID NO: 193821 - DNA, 20 bp, human
gggaagcagccgcgattcca

SEQ ID NO: 193822 - DNA, 20 bp, human
gaggaaggcctcaacagggt

SEQ ID NO: 193823 - DNA, 20 bp, human
gtgaggccctcaggttgtct

SEQ ID NO: 193824 - DNA, 20 bp, human
gcagcagcccacgccagggc

SEQ ID NO: 193825 - DNA, 20 bp, human
gcctggttgctgggtctcct

SEQ ID NO: 193826 - DNA, 20 bp, human
gtaactgctgtgtaacgtgg

SEQ ID NO: 193827 - DNA, 20 bp, human
ggacccggcacggagcgcag

SEQ ID NO: 193828 - DNA, 20 bp, human
gatcgagcggcgtcccgtgc

SEQ ID NO: 193829 - DNA, 20 bp, human
gagggggctcggggatcgag

SEQ ID NO: 193830 - DNA, 20 bp, human
gcgtgaggcagcgcggagaa

SEQ ID NO: 193831 - DNA, 20 bp, human
gcccctcgggttgcagaatc

SEQ ID NO: 193832 - DNA, 20 bp, human
gggccgacacaggtaactcg

SEQ ID NO: 193833 - DNA, 20 bp, human
gcagcagttagcgccgaggt

SEQ ID NO: 193834 - DNA, 20 bp, human
gaccttagtccagacccctc

SEQ ID NO: 193835 - DNA, 20 bp, human
ggcggggagctgaaagattg

SEQ ID NO: 193836 - DNA, 20 bp, human
gcgatgggcacggggtgagt

SEQ ID NO: 193837 - DNA, 20 bp, human
gatcgccggacacagtccgt

SEQ ID NO: 193838 - DNA, 20 bp, human
gagcagcgaaaggcagtccc

SEQ ID NO: 193839 - DNA, 20 bp, human
gagaactggggagggactcc

SEQ ID NO: 193840 - DNA, 20 bp, human
gactggggagggactcccgg

SEQ ID NO: 193841 - DNA, 20 bp, human
gtatgccgacggactgtgtc

SEQ ID NO: 193842 - DNA, 20 bp, human
gcgagcctcagagcgagggg

SEQ ID NO: 193843 - DNA, 20 bp, human
gcgccacagccggaactata

SEQ ID NO: 193844 - DNA, 20 bp, human
gaaccccaacaagcagcgaa

SEQ ID NO: 193845 - DNA, 20 bp, human
gctgtgaggcgccagttccg

SEQ ID NO: 193846 - DNA, 20 bp, human
gcccggcagccggaatgtct

SEQ ID NO: 193847 - DNA, 20 bp, human
gtcgccggccggcccaggat

SEQ ID NO: 193848 - DNA, 20 bp, human
ggcgggcgcaggggtagcag

SEQ ID NO: 193849 - DNA, 20 bp, human
ggtggcaccgaggccagcat

SEQ ID NO: 193850 - DNA, 20 bp, human
gccggacgccgggctcgcag

SEQ ID NO: 193851 - DNA, 20 bp, human
gtcggggagctctccagacc

SEQ ID NO: 193852 - DNA, 20 bp, human
gcggcgcgcgagtggcaccg

SEQ ID NO: 193853 - DNA, 20 bp, human
ggcagccgtggcgcgtcgga

SEQ ID NO: 193854 - DNA, 20 bp, human
gcacggctgcccagacattc

SEQ ID NO: 193855 - DNA, 20 bp, human
gtggcgcgcacaccgggcta

SEQ ID NO: 193856 - DNA, 20 bp, human
gcgggaattcctcagcacca

SEQ ID NO: 193857 - DNA, 20 bp, human
gtacggcagtagaggtgatt

SEQ ID NO: 193858 - DNA, 20 bp, human
gcacggacagcgccaacaac

SEQ ID NO: 193859 - DNA, 20 bp, human
ggggctcagaagccagttgt

SEQ ID NO: 193860 - DNA, 20 bp, human
ggtgtaagtgaactcatgtg

SEQ ID NO: 193861 - DNA, 20 bp, human
ggaaaggagcaactttagct

SEQ ID NO: 193862 - DNA, 20 bp, human
gtaagtgaactcatgtgtgg

SEQ ID NO: 193863 - DNA, 20 bp, human
gatggtattgccagcggagt

SEQ ID NO: 193864 - DNA, 20 bp, human
gcaccggaaaatactaactg

SEQ ID NO: 193865 - DNA, 20 bp, human
ggtgtttgctacggcagtag

SEQ ID NO: 193866 - DNA, 20 bp, human
gctcgaagcgaaacacacaa

SEQ ID NO: 193867 - DNA, 20 bp, human
gggctccgcgcctctcggag

SEQ ID NO: 193868 - DNA, 20 bp, human
gctgctgatgcctctccgag

SEQ ID NO: 193869 - DNA, 20 bp, human
gcgcgctgatagcaccccag

SEQ ID NO: 193870 - DNA, 20 bp, human
gacgccggtagcgctctccc

SEQ ID NO: 193871 - DNA, 20 bp, human
gctaccggcgtgcagtcgag

SEQ ID NO: 193872 - DNA, 20 bp, human
ggacgcggcggacgattgtg

SEQ ID NO: 193873 - DNA, 20 bp, human
gggcagcaggagcgcgacac

SEQ ID NO: 193874 - DNA, 20 bp, human
gaccagcccgaggctacacc

SEQ ID NO: 193875 - DNA, 20 bp, human
ggcagtccggcccacatgac

SEQ ID NO: 193876 - DNA, 20 bp, human
gctgggtgcaccccagaacg

SEQ ID NO: 193877 - DNA, 20 bp, human
gtctatcccacgaaaggact

SEQ ID NO: 193878 - DNA, 20 bp, human
ggcaccccagaacgaggacg

SEQ ID NO: 193879 - DNA, 20 bp, human
ggtgcacccagtcctttcgt

SEQ ID NO: 193880 - DNA, 20 bp, human
gtctgttgctgcttggaaca

SEQ ID NO: 193881 - DNA, 20 bp, human
ggaaggctctatcccacgaa

SEQ ID NO: 193882 - DNA, 20 bp, human
ggctccgcgtcctcgttctg

SEQ ID NO: 193883 - DNA, 20 bp, human
gccaagaaaggaggcccgag

SEQ ID NO: 193884 - DNA, 20 bp, human
gtcgcagacggattacgcga

SEQ ID NO: 193885 - DNA, 20 bp, human
gccgcgggtgccaggaggat

SEQ ID NO: 193886 - DNA, 20 bp, human
ggaccctcagaggcaagtgg

SEQ ID NO: 193887 - DNA, 20 bp, human
gtgagagcatggcctagggt

SEQ ID NO: 193888 - DNA, 20 bp, human
gggagtattaggatcatccc

SEQ ID NO: 193889 - DNA, 20 bp, human
gctctgtcgctggactagaa

SEQ ID NO: 193890 - DNA, 20 bp, human
gggaggccaatcccctgttg

SEQ ID NO: 193891 - DNA, 20 bp, human
ggctgtgagctgccacaaca

SEQ ID NO: 193892 - DNA, 20 bp, human
gctgcttggagaccgagacc

SEQ ID NO: 193893 - DNA, 20 bp, human
gcagctgagagcatggccta

SEQ ID NO: 193894 - DNA, 20 bp, human
gcctcagaggcaagtggagg

SEQ ID NO: 193895 - DNA, 20 bp, human
gttgctgttatgtagcccag

SEQ ID NO: 193896 - DNA, 20 bp, human
gagcggcgccaactacacgg

SEQ ID NO: 193897 - DNA, 20 bp, human
ggccatcgcggactaaataa

SEQ ID NO: 193898 - DNA, 20 bp, human
gccggatgtagttggtggag

SEQ ID NO: 193899 - DNA, 20 bp, human
gggcagcggcgccaactaca

SEQ ID NO: 193900 - DNA, 20 bp, human
gtgctcgaggctgatctcag

SEQ ID NO: 193901 - DNA, 20 bp, human
ggccgccttccggaagagga

SEQ ID NO: 193902 - DNA, 20 bp, human
gggcctgtgagtgtgtgtcg

SEQ ID NO: 193903 - DNA, 20 bp, human
ggtagttggtggagcggcag

SEQ ID NO: 193904 - DNA, 20 bp, human
gcggctgcgcgtgcgcccag

SEQ ID NO: 193905 - DNA, 20 bp, human
ggttgcccggatgtagttgg

SEQ ID NO: 193906 - DNA, 20 bp, human
gactgtgggaagcggagtga

SEQ ID NO: 193907 - DNA, 20 bp, human
gagcggagtgacggagcgag

SEQ ID NO: 193908 - DNA, 20 bp, human
gcaggctccgagggtaagtg

SEQ ID NO: 193909 - DNA, 20 bp, human
gaggcagtgcaaggccccag

SEQ ID NO: 193910 - DNA, 20 bp, human
gagcggctgttggaggaagg

SEQ ID NO: 193911 - DNA, 20 bp, human
gccgggccgctgaggaagtt

SEQ ID NO: 193912 - DNA, 20 bp, human
gagcacccgccaggctccga

SEQ ID NO: 193913 - DNA, 20 bp, human
gcactgccttaaggattcgg

SEQ ID NO: 193914 - DNA, 20 bp, human
ggcgagcggctgttggagga

SEQ ID NO: 193915 - DNA, 20 bp, human
gtgggcaggggaatgacctg

SEQ ID NO: 193916 - DNA, 20 bp, human
gaagatggcaatacataccc

SEQ ID NO: 193917 - DNA, 20 bp, human
ggcagtgtcttccacaacct

SEQ ID NO: 193918 - DNA, 20 bp, human
gccatagggaacagagatcc

SEQ ID NO: 193919 - DNA, 20 bp, human
ggtggaagacactgcagagg

SEQ ID NO: 193920 - DNA, 20 bp, human
gggtggccactggtcacgct

SEQ ID NO: 193921 - DNA, 20 bp, human
ggcaatacatacccaggttg

SEQ ID NO: 193922 - DNA, 20 bp, human
ggaacatgatgggtcccaaa

SEQ ID NO: 193923 - DNA, 20 bp, human
gggtgattcactgctcccat

SEQ ID NO: 193924 - DNA, 20 bp, human
ggcatgaacattatcttaaa

SEQ ID NO: 193925 - DNA, 20 bp, human
ggatgttgagcacagaagga

SEQ ID NO: 193926 - DNA, 20 bp, human
ggatggcgctgcactcaatg

SEQ ID NO: 193927 - DNA, 20 bp, human
gtgagcgctggagcttcatc

SEQ ID NO: 193928 - DNA, 20 bp, human
gtcatagacgagtagacctt

SEQ ID NO: 193929 - DNA, 20 bp, human
gtggagagcgggagcagctg

SEQ ID NO: 193930 - DNA, 20 bp, human
gtcatccgggcacttcataa

SEQ ID NO: 193931 - DNA, 20 bp, human
ggcggcaagaggtcagaaag

SEQ ID NO: 193932 - DNA, 20 bp, human
gacgagtagaccttaggcga

SEQ ID NO: 193933 - DNA, 20 bp, human
gggcgctccgctcccagaac

SEQ ID NO: 193934 - DNA, 20 bp, human
ggacgtcattccaaacaaga

SEQ ID NO: 193935 - DNA, 20 bp, human
ggagcgccgccgctgttgcc

SEQ ID NO: 193936 - DNA, 20 bp, human
ggcctcgccagagaagacaa

SEQ ID NO: 193937 - DNA, 20 bp, human
ggtctgggagaggaaagcag

SEQ ID NO: 193938 - DNA, 20 bp, human
gcccattgggcccccactca

SEQ ID NO: 193939 - DNA, 20 bp, human
ggtcagtggagtctggtcag

SEQ ID NO: 193940 - DNA, 20 bp, human
gggcagaaagcaccatgagt

SEQ ID NO: 193941 - DNA, 20 bp, human
gcaatgggaggaaggcccgg

SEQ ID NO: 193942 - DNA, 20 bp, human
gctgggtgcagggtaagaag

SEQ ID NO: 193943 - DNA, 20 bp, human
gaccatgagtgggggcccaa

SEQ ID NO: 193944 - DNA, 20 bp, human
gactgcagtggccagcgtct

SEQ ID NO: 193945 - DNA, 20 bp, human
gatgacagtcatgggcccaa

SEQ ID NO: 193946 - DNA, 20 bp, human
gtgggtgccgagggagacgg

SEQ ID NO: 193947 - DNA, 20 bp, human
gcgcgcgtcgagcacacggt

SEQ ID NO: 193948 - DNA, 20 bp, human
gcggtgagcgcgagtccctg

SEQ ID NO: 193949 - DNA, 20 bp, human
ggtcgagcacacggtgggtc

SEQ ID NO: 193950 - DNA, 20 bp, human
gctctcgctggagagactgt

SEQ ID NO: 193951 - DNA, 20 bp, human
gcagagcccgaccctcctgg

SEQ ID NO: 193952 - DNA, 20 bp, human
gtgggcgctcggaaaacccg

SEQ ID NO: 193953 - DNA, 20 bp, human
gcgcccgccgccgtctccct

SEQ ID NO: 193954 - DNA, 20 bp, human
ggccacagggaacgccgcct

SEQ ID NO: 193955 - DNA, 20 bp, human
gcggcccccacccccatccg

SEQ ID NO: 193956 - DNA, 20 bp, human
ggtaatggcggacacaggca

SEQ ID NO: 193957 - DNA, 20 bp, human
gatcgcgtaatggcggacac

SEQ ID NO: 193958 - DNA, 20 bp, human
ggacacaggcagggcgagcg

SEQ ID NO: 193959 - DNA, 20 bp, human
gcccagcggggtctacccaa

SEQ ID NO: 193960 - DNA, 20 bp, human
gccccttcggaaacttggag

SEQ ID NO: 193961 - DNA, 20 bp, human
gctgatggcagaaccaggtc

SEQ ID NO: 193962 - DNA, 20 bp, human
gcgtcagcgacaggaagggt

SEQ ID NO: 193963 - DNA, 20 bp, human
ggaggggtccacaagtctga

SEQ ID NO: 193964 - DNA, 20 bp, human
gctgcacggctcgggaagag

SEQ ID NO: 193965 - DNA, 20 bp, human
ggcggggaatcgcgtaatgg

SEQ ID NO: 193966 - DNA, 20 bp, human
gcgcaccacaccgcacgcag

SEQ ID NO: 193967 - DNA, 20 bp, human
gggtggctgtcccgagtcca

SEQ ID NO: 193968 - DNA, 20 bp, human
ggagtccagggagcgcgcac

SEQ ID NO: 193969 - DNA, 20 bp, human
gccagggagcgcgcaccgga

SEQ ID NO: 193970 - DNA, 20 bp, human
gcgtgcggtgtggtgcgagg

SEQ ID NO: 193971 - DNA, 20 bp, human
ggggccacagcagcctacag

SEQ ID NO: 193972 - DNA, 20 bp, human
ggaggcccgggcgccactta

SEQ ID NO: 193973 - DNA, 20 bp, human
gaccgcggaccggtgagtga

SEQ ID NO: 193974 - DNA, 20 bp, human
ggcccgggcgccacttacgg

SEQ ID NO: 193975 - DNA, 20 bp, human
ggaccgcagccctcactcac

SEQ ID NO: 193976 - DNA, 20 bp, human
gggcccgtgaggtaatgtca

SEQ ID NO: 193977 - DNA, 20 bp, human
gcgtgaggtaatgtcacggg

SEQ ID NO: 193978 - DNA, 20 bp, human
gcgcggagggtcaccaacgt

SEQ ID NO: 193979 - DNA, 20 bp, human
gttcgcgccgcgctgagaaa

SEQ ID NO: 193980 - DNA, 20 bp, human
gttcctcggcaagaaatgtg

SEQ ID NO: 193981 - DNA, 20 bp, human
gggcgggcgagaccacagga

SEQ ID NO: 193982 - DNA, 20 bp, human
gttgccgaggaaagtgaaga

SEQ ID NO: 193983 - DNA, 20 bp, human
gttccccctctcggtgacag

SEQ ID NO: 193984 - DNA, 20 bp, human
gggcgagaccacaggacgga

SEQ ID NO: 193985 - DNA, 20 bp, human
ggcggccgcacaatccaaca

SEQ ID NO: 193986 - DNA, 20 bp, human
ggtggctctccagtgaccag

SEQ ID NO: 193987 - DNA, 20 bp, human
gtctgcccggatggaagctc

SEQ ID NO: 193988 - DNA, 20 bp, human
gcgcggccggagcttccatc

SEQ ID NO: 193989 - DNA, 20 bp, human
ggggacgatgatgattggta

SEQ ID NO: 193990 - DNA, 20 bp, human
ggcatagtgaggtcccaggg

SEQ ID NO: 193991 - DNA, 20 bp, human
ggggcagaactccaccaact

SEQ ID NO: 193992 - DNA, 20 bp, human
gcctcatagaacccatccca

SEQ ID NO: 193993 - DNA, 20 bp, human
gtggtggagttctgcccgga

SEQ ID NO: 193994 - DNA, 20 bp, human
gatgggttctatgaggctac

SEQ ID NO: 193995 - DNA, 20 bp, human
gcaatctgagtcctagttgg

SEQ ID NO: 193996 - DNA, 20 bp, human
gaagcggcgctaagagaagg

SEQ ID NO: 193997 - DNA, 20 bp, human
gtgtcccccaagccgctgcg

SEQ ID NO: 193998 - DNA, 20 bp, human
gctaagagaaggcgggacag

SEQ ID NO: 193999 - DNA, 20 bp, human
gtgacgtgaggagtgcggag

SEQ ID NO: 194000 - DNA, 20 bp, human
gtagggtccaggttcaccaa

SEQ ID NO: 194001 - DNA, 20 bp, human
ggctgaccgaccatgactcg

SEQ ID NO: 194002 - DNA, 20 bp, human
gcaagatggcggtagctgag

SEQ ID NO: 194003 - DNA, 20 bp, human
ggaggaggagcggggcaaag

SEQ ID NO: 194004 - DNA, 20 bp, human
ggtacaagacgtcaaaccta

SEQ ID NO: 194005 - DNA, 20 bp, human
gggtccaggttcaccaaagg

SEQ ID NO: 194006 - DNA, 20 bp, human
gtaccataaaagggcttcaa

SEQ ID NO: 194007 - DNA, 20 bp, human
gacccaggtacactcatgag

SEQ ID NO: 194008 - DNA, 20 bp, human
ggtcaggtatgtgcagatga

SEQ ID NO: 194009 - DNA, 20 bp, human
gatcagatggagaaagtgac

SEQ ID NO: 194010 - DNA, 20 bp, human
ggtctctctcaccattatca

SEQ ID NO: 194011 - DNA, 20 bp, human
gtgtgcagatgaaggattca

SEQ ID NO: 194012 - DNA, 20 bp, human
gtccactcatgagtgtacct

SEQ ID NO: 194013 - DNA, 20 bp, human
gaggatcataattataaccc

SEQ ID NO: 194014 - DNA, 20 bp, human
gtactcagtggatgtttatg

SEQ ID NO: 194015 - DNA, 20 bp, human
gatggtatcttacatgaacc

SEQ ID NO: 194016 - DNA, 20 bp, human
gggtgactgtggctggatag

SEQ ID NO: 194017 - DNA, 20 bp, human
ggacggcaggttggttaggt

SEQ ID NO: 194018 - DNA, 20 bp, human
gatgatgccaagcgagtgag

SEQ ID NO: 194019 - DNA, 20 bp, human
ggagcagagccggaagcggg

SEQ ID NO: 194020 - DNA, 20 bp, human
gggtggagcagagccggaag

SEQ ID NO: 194021 - DNA, 20 bp, human
ggagtgaggggcgtttgaga

SEQ ID NO: 194022 - DNA, 20 bp, human
gccacagagggacacgaata

SEQ ID NO: 194023 - DNA, 20 bp, human
ggcgtggacaggatctaaag

SEQ ID NO: 194024 - DNA, 20 bp, human
gagcgtcaaacaggaaaaga

SEQ ID NO: 194025 - DNA, 20 bp, human
gttgagacggcaggttggtt

SEQ ID NO: 194026 - DNA, 20 bp, human
gacccctgttggagagacta

SEQ ID NO: 194027 - DNA, 20 bp, human
gtgagtctcgggacccctgt

SEQ ID NO: 194028 - DNA, 20 bp, human
ggccatagtctctccaacag

SEQ ID NO: 194029 - DNA, 20 bp, human
gagaatcactcggagggcgg

SEQ ID NO: 194030 - DNA, 20 bp, human
gtcaacaagaatcactcgga

SEQ ID NO: 194031 - DNA, 20 bp, human
gacaagaatcactcggaggg

SEQ ID NO: 194032 - DNA, 20 bp, human
gccgagaggtgaaaacactg

SEQ ID NO: 194033 - DNA, 20 bp, human
ggatcgtcaataacaccgag

SEQ ID NO: 194034 - DNA, 20 bp, human
gctactgaaatcacaagtct

SEQ ID NO: 194035 - DNA, 20 bp, human
gcactaggggcggggcgaag

SEQ ID NO: 194036 - DNA, 20 bp, human
gcaaagtcgcaggcacccaa

SEQ ID NO: 194037 - DNA, 20 bp, human
gagaggccggagctgaccgg

SEQ ID NO: 194038 - DNA, 20 bp, human
gtccgcggcggttctcggtg

SEQ ID NO: 194039 - DNA, 20 bp, human
ggccacaccgagaaccgccg

SEQ ID NO: 194040 - DNA, 20 bp, human
gagggatgagggctccgcgg

SEQ ID NO: 194041 - DNA, 20 bp, human
gcaggaggcccgaagcaaga

SEQ ID NO: 194042 - DNA, 20 bp, human
ggttagggatgagggctccg

SEQ ID NO: 194043 - DNA, 20 bp, human
gcccctttccatctacgggg

SEQ ID NO: 194044 - DNA, 20 bp, human
gaagagaggccggagctgac

SEQ ID NO: 194045 - DNA, 20 bp, human
gatgccggaacaccagtgag

SEQ ID NO: 194046 - DNA, 20 bp, human
gatcggagggaggttcgggt

SEQ ID NO: 194047 - DNA, 20 bp, human
gtggtcccggggactgagta

SEQ ID NO: 194048 - DNA, 20 bp, human
gcggagcaaccgggacctgt

SEQ ID NO: 194049 - DNA, 20 bp, human
gggttcgggtgggcatcggg

SEQ ID NO: 194050 - DNA, 20 bp, human
gtctggatcggagggaggtt

SEQ ID NO: 194051 - DNA, 20 bp, human
gagtaaggtgtctggatcgg

SEQ ID NO: 194052 - DNA, 20 bp, human
gagccagcgagcctagaagg

SEQ ID NO: 194053 - DNA, 20 bp, human
gacaataccctagggttcag

SEQ ID NO: 194054 - DNA, 20 bp, human
gccgcacgcactttgaccag

SEQ ID NO: 194055 - DNA, 20 bp, human
gcataccccagggcgttcag

SEQ ID NO: 194056 - DNA, 20 bp, human
gaggaagctggtatccagac

SEQ ID NO: 194057 - DNA, 20 bp, human
gtggtatccagacgggaaca

SEQ ID NO: 194058 - DNA, 20 bp, human
gagaagaacagggagacctg

SEQ ID NO: 194059 - DNA, 20 bp, human
ggaacaaggaccagattacc

SEQ ID NO: 194060 - DNA, 20 bp, human
ggcgcaggcggtggtccctg

SEQ ID NO: 194061 - DNA, 20 bp, human
gtggagagggggtgaactag

SEQ ID NO: 194062 - DNA, 20 bp, human
ggggtcctaggagaagaaca

SEQ ID NO: 194063 - DNA, 20 bp, human
gtctggtccttgttcccgtc

SEQ ID NO: 194064 - DNA, 20 bp, human
gtcagttcccgtagacctgg

SEQ ID NO: 194065 - DNA, 20 bp, human
gcccttgggaaagggactag

SEQ ID NO: 194066 - DNA, 20 bp, human
gtcctcgccggaagaggcta

SEQ ID NO: 194067 - DNA, 20 bp, human
gctgctgaggcgcggaacgg

SEQ ID NO: 194068 - DNA, 20 bp, human
gtaagggtcacgcaagatgg

SEQ ID NO: 194069 - DNA, 20 bp, human
gggtccagctccaggcgata

SEQ ID NO: 194070 - DNA, 20 bp, human
gaggctgctgaggcgcggaa

SEQ ID NO: 194071 - DNA, 20 bp, human
gcggaagtctgtccacccag

SEQ ID NO: 194072 - DNA, 20 bp, human
gcggcgaggactggtgttaa

SEQ ID NO: 194073 - DNA, 20 bp, human
gctggctgcaagcccaggag

SEQ ID NO: 194074 - DNA, 20 bp, human
gcgcccacgtactggaccac

SEQ ID NO: 194075 - DNA, 20 bp, human
gagctgggcaccacaaagga

SEQ ID NO: 194076 - DNA, 20 bp, human
gtccatcgcgccgggcagag

SEQ ID NO: 194077 - DNA, 20 bp, human
gggctgcccgggaggcacag

SEQ ID NO: 194078 - DNA, 20 bp, human
ggcgtgactgcggagcctgg

SEQ ID NO: 194079 - DNA, 20 bp, human
ggaggctggccggaaggagt

SEQ ID NO: 194080 - DNA, 20 bp, human
gccggcgcgatggagcgggt

SEQ ID NO: 194081 - DNA, 20 bp, human
ggggtcggtgagcggaacaa

SEQ ID NO: 194082 - DNA, 20 bp, human
ggaggacgtagcgctcggcc

SEQ ID NO: 194083 - DNA, 20 bp, human
gcgcggtgacaccgccgctg

SEQ ID NO: 194084 - DNA, 20 bp, human
ggcagaggggaagcccgctc

SEQ ID NO: 194085 - DNA, 20 bp, human
gcggggagcccgcatcctcc

SEQ ID NO: 194086 - DNA, 20 bp, human
ggaatactgcggggcgtccg

SEQ ID NO: 194087 - DNA, 20 bp, human
ggcgtgagaatggcgtcccg

SEQ ID NO: 194088 - DNA, 20 bp, human
ggccggcgtccggagcatgg

SEQ ID NO: 194089 - DNA, 20 bp, human
gggctgatgacataaaaacc

SEQ ID NO: 194090 - DNA, 20 bp, human
gccagagctggtaagtcccg

SEQ ID NO: 194091 - DNA, 20 bp, human
gtcagcagcacacctgcgac

SEQ ID NO: 194092 - DNA, 20 bp, human
ggccggcaggcgccagtcgc

SEQ ID NO: 194093 - DNA, 20 bp, human
ggtacctcagcgttgaggta

SEQ ID NO: 194094 - DNA, 20 bp, human
gcctcggtacctcagcgttg

SEQ ID NO: 194095 - DNA, 20 bp, human
gatgctccggacgccggccg

SEQ ID NO: 194096 - DNA, 20 bp, human
gagcgaaacggtctcgaagg

SEQ ID NO: 194097 - DNA, 20 bp, human
gcggagcgaaacggtctcga

SEQ ID NO: 194098 - DNA, 20 bp, human
ggtcgtagtccggagcccag

SEQ ID NO: 194099 - DNA, 20 bp, human
gccgaggcgcgctggattgg

SEQ ID NO: 194100 - DNA, 20 bp, human
gtgaggtggacctcgagaca

SEQ ID NO: 194101 - DNA, 20 bp, human
gcctccgactgagagagggt

SEQ ID NO: 194102 - DNA, 20 bp, human
ggtgtgggcaacaggactcg

SEQ ID NO: 194103 - DNA, 20 bp, human
gggcgacatccggagcgaaa

SEQ ID NO: 194104 - DNA, 20 bp, human
gtgacccgcgcccgcacctc

SEQ ID NO: 194105 - DNA, 20 bp, human
gtggcggtgagttctgactc

SEQ ID NO: 194106 - DNA, 20 bp, human
gtcccagctggagtaggtgg

SEQ ID NO: 194107 - DNA, 20 bp, human
gctgcaacaggatccccaaa

SEQ ID NO: 194108 - DNA, 20 bp, human
ggaggaagggcctccatgtc

SEQ ID NO: 194109 - DNA, 20 bp, human
gcctcacagatgccacaggg

SEQ ID NO: 194110 - DNA, 20 bp, human
ggatcctgttgcaggttacg

SEQ ID NO: 194111 - DNA, 20 bp, human
gaacaggatccccaaaaggc

SEQ ID NO: 194112 - DNA, 20 bp, human
gtcgttccactggatgggac

SEQ ID NO: 194113 - DNA, 20 bp, human
gtgacctcacagatgccaca

SEQ ID NO: 194114 - DNA, 20 bp, human
gccacctcgttccactggat

SEQ ID NO: 194115 - DNA, 20 bp, human
gctctcagtgctggtgagtg

SEQ ID NO: 194116 - DNA, 20 bp, human
gagtcgccgcgcgaacatgg

SEQ ID NO: 194117 - DNA, 20 bp, human
ggcggtgagacggagttccc

SEQ ID NO: 194118 - DNA, 20 bp, human
ggctgctctgcggcctggag

SEQ ID NO: 194119 - DNA, 20 bp, human
gggcggccgaaatccactcc

SEQ ID NO: 194120 - DNA, 20 bp, human
gagcagtcgccgcgcgaaca

SEQ ID NO: 194121 - DNA, 20 bp, human
gcgcccaggcgtcagctgat

SEQ ID NO: 194122 - DNA, 20 bp, human
ggcactggaacaggggtcct

SEQ ID NO: 194123 - DNA, 20 bp, human
gcggccagcgaggacaggta

SEQ ID NO: 194124 - DNA, 20 bp, human
ggcggtgggacaggggatcc

SEQ ID NO: 194125 - DNA, 20 bp, human
ggctaaggggcgcagagtgg

SEQ ID NO: 194126 - DNA, 20 bp, human
gtagcctggccgcctctctc

SEQ ID NO: 194127 - DNA, 20 bp, human
ggcggcgcgcagctgaacac

SEQ ID NO: 194128 - DNA, 20 bp, human
ggcgccactacaagaggagg

SEQ ID NO: 194129 - DNA, 20 bp, human
gcggcttgcatcccaggtcg

SEQ ID NO: 194130 - DNA, 20 bp, human
gcttgcatcccaggtcgtgg

SEQ ID NO: 194131 - DNA, 20 bp, human
ggcgtctccgaggacaggta

SEQ ID NO: 194132 - DNA, 20 bp, human
ggcggagtcgttcccgagag

SEQ ID NO: 194133 - DNA, 20 bp, human
gccgccccctcctcttgtag

SEQ ID NO: 194134 - DNA, 20 bp, human
ggccctcgagcccgcgtcag

SEQ ID NO: 194135 - DNA, 20 bp, human
gaagccggcgccactacaag

SEQ ID NO: 194136 - DNA, 20 bp, human
ggaccatcccggaaagtgag

SEQ ID NO: 194137 - DNA, 20 bp, human
gcgcggcggagcagggacgg

SEQ ID NO: 194138 - DNA, 20 bp, human
gcgacccgcagggaccatcc

SEQ ID NO: 194139 - DNA, 20 bp, human
gtccagctgggagcatccag

SEQ ID NO: 194140 - DNA, 20 bp, human
gcgggacaggcccaggagac

SEQ ID NO: 194141 - DNA, 20 bp, human
gagatggccaccaacagctg

SEQ ID NO: 194142 - DNA, 20 bp, human
gtcagacagccagcgggagg

SEQ ID NO: 194143 - DNA, 20 bp, human
gcgagggcgcacgggctacg

SEQ ID NO: 194144 - DNA, 20 bp, human
gcaccaacagctgcgggaaa

SEQ ID NO: 194145 - DNA, 20 bp, human
gccaggagacgggaccgcgg

SEQ ID NO: 194146 - DNA, 20 bp, human
gggacttgacctaccgtcag

SEQ ID NO: 194147 - DNA, 20 bp, human
ggctgaggactgacgatgtg

SEQ ID NO: 194148 - DNA, 20 bp, human
gcatagcaggaccccgagaa

SEQ ID NO: 194149 - DNA, 20 bp, human
gctgctatgaagggaaccct

SEQ ID NO: 194150 - DNA, 20 bp, human
gctcctcgacctctgacggt

SEQ ID NO: 194151 - DNA, 20 bp, human
gtaggccccacgctgacagg

SEQ ID NO: 194152 - DNA, 20 bp, human
gtcagcagtgacacacactc

SEQ ID NO: 194153 - DNA, 20 bp, human
gtcctgggaggctgactatg

SEQ ID NO: 194154 - DNA, 20 bp, human
gtgtggtcagggccactcca

SEQ ID NO: 194155 - DNA, 20 bp, human
gggctgcagctggggatagg

SEQ ID NO: 194156 - DNA, 20 bp, human
gcatacagagggacacacgg

SEQ ID NO: 194157 - DNA, 20 bp, human
ggccggagtggggactcacc

SEQ ID NO: 194158 - DNA, 20 bp, human
gtgtggatcctcagtggcgg

SEQ ID NO: 194159 - DNA, 20 bp, human
ggaccgagcctccgccactg

SEQ ID NO: 194160 - DNA, 20 bp, human
gaagcagcgaggctagggat

SEQ ID NO: 194161 - DNA, 20 bp, human
gagggaaatagcatcactaa

SEQ ID NO: 194162 - DNA, 20 bp, human
gcggctgcccgcgtccacca

SEQ ID NO: 194163 - DNA, 20 bp, human
ggcatctccttggtggacgc

SEQ ID NO: 194164 - DNA, 20 bp, human
gacggaagccaatgagatat

SEQ ID NO: 194165 - DNA, 20 bp, human
gtgcggagaacgggccctag

SEQ ID NO: 194166 - DNA, 20 bp, human
ggccagggctcacctgtctc

SEQ ID NO: 194167 - DNA, 20 bp, human
gtgggacgcctactccaaag

SEQ ID NO: 194168 - DNA, 20 bp, human
gcaggtgagccctggcccga

SEQ ID NO: 194169 - DNA, 20 bp, human
gcgggggtgcacctactcca

SEQ ID NO: 194170 - DNA, 20 bp, human
gtccaggaggtcacagtata

SEQ ID NO: 194171 - DNA, 20 bp, human
ggctcacctgtctcgggagt

SEQ ID NO: 194172 - DNA, 20 bp, human
ggcgactgaaggggagacac

SEQ ID NO: 194173 - DNA, 20 bp, human
ggaaagactggcgactgaag

SEQ ID NO: 194174 - DNA, 20 bp, human
gccccgggcagaaggttcct

SEQ ID NO: 194175 - DNA, 20 bp, human
gctccgctcagaaaagggac

SEQ ID NO: 194176 - DNA, 20 bp, human
ggcgcggcgcggtaacaagt

SEQ ID NO: 194177 - DNA, 20 bp, human
gtggcgctcgtggaaagtgg

SEQ ID NO: 194178 - DNA, 20 bp, human
gaatgcggcggggcatgtca

SEQ ID NO: 194179 - DNA, 20 bp, human
gggggacggcggggacagaa

SEQ ID NO: 194180 - DNA, 20 bp, human
gggcgcagtcaacaggtgac

SEQ ID NO: 194181 - DNA, 20 bp, human
gaaagtggaggccgccctcc

SEQ ID NO: 194182 - DNA, 20 bp, human
gccctcccggcgcagtcaac

SEQ ID NO: 194183 - DNA, 20 bp, human
gacaggtgaccggccgagac

SEQ ID NO: 194184 - DNA, 20 bp, human
gcgccctgcaccaccgaggg

SEQ ID NO: 194185 - DNA, 20 bp, human
gtcctggcgctcgtggaaag

SEQ ID NO: 194186 - DNA, 20 bp, human
gttcaagttctacaggctcc

SEQ ID NO: 194187 - DNA, 20 bp, human
ggtgcggaacctaggatcct

SEQ ID NO: 194188 - DNA, 20 bp, human
ggaggaatggaacggcaaaa

SEQ ID NO: 194189 - DNA, 20 bp, human
gctgacccgcaaccaggaag

SEQ ID NO: 194190 - DNA, 20 bp, human
gatggaacggcaaaagggcg

SEQ ID NO: 194191 - DNA, 20 bp, human
gggcggccagcccaggacct

SEQ ID NO: 194192 - DNA, 20 bp, human
ggcgttgagggcccccgtga

SEQ ID NO: 194193 - DNA, 20 bp, human
gcgaggccaaactaaccagg

SEQ ID NO: 194194 - DNA, 20 bp, human
gacaggaggagcccgaaaag

SEQ ID NO: 194195 - DNA, 20 bp, human
gccttgaagttcactgtgta

SEQ ID NO: 194196 - DNA, 20 bp, human
gaactgcggcttttagagag

SEQ ID NO: 194197 - DNA, 20 bp, human
gttctgcagaggagaccgga

SEQ ID NO: 194198 - DNA, 20 bp, human
gggtctgggcgtctgtagaa

SEQ ID NO: 194199 - DNA, 20 bp, human
gtcccaaccagaggctcact

SEQ ID NO: 194200 - DNA, 20 bp, human
gctcctctgcagaaagcacg

SEQ ID NO: 194201 - DNA, 20 bp, human
gctctaaaagccgcagttag

SEQ ID NO: 194202 - DNA, 20 bp, human
gccagaggctcactcggcag

SEQ ID NO: 194203 - DNA, 20 bp, human
gggtcgacggtggccgatag

SEQ ID NO: 194204 - DNA, 20 bp, human
gtgagagaggaaacggtcga

SEQ ID NO: 194205 - DNA, 20 bp, human
ggccgagtgagcctctggtt

SEQ ID NO: 194206 - DNA, 20 bp, human
gcagaaggaaccggcgacag

SEQ ID NO: 194207 - DNA, 20 bp, human
gaccggcgacagtggtctca

SEQ ID NO: 194208 - DNA, 20 bp, human
gcaatggtcgcctggtggaa

SEQ ID NO: 194209 - DNA, 20 bp, human
gtagcagtggacgcgaggtg

SEQ ID NO: 194210 - DNA, 20 bp, human
ggagcccagagcgaatcgat

SEQ ID NO: 194211 - DNA, 20 bp, human
gaggtgagcatgcgcagtag

SEQ ID NO: 194212 - DNA, 20 bp, human
gaccatggtaacacccgggg

SEQ ID NO: 194213 - DNA, 20 bp, human
gtggcagcaagtcttagcag

SEQ ID NO: 194214 - DNA, 20 bp, human
gttcttgaggccccccggag

SEQ ID NO: 194215 - DNA, 20 bp, human
gtgtgagcgtcccgagcgaa

SEQ ID NO: 194216 - DNA, 20 bp, human
gcaggaagggctgacctagt

SEQ ID NO: 194217 - DNA, 20 bp, human
gaggcgggccggatgagtac

SEQ ID NO: 194218 - DNA, 20 bp, human
ggtggttacgaaggagccta

SEQ ID NO: 194219 - DNA, 20 bp, human
gggctgacctagtgggagaa

SEQ ID NO: 194220 - DNA, 20 bp, human
gcgggccggatgagtacggg

SEQ ID NO: 194221 - DNA, 20 bp, human
ggacaccggggacacctgaa

SEQ ID NO: 194222 - DNA, 20 bp, human
gcctggccagggacacgcac

SEQ ID NO: 194223 - DNA, 20 bp, human
gatttcgccggaggcccaag

SEQ ID NO: 194224 - DNA, 20 bp, human
ggaaaggcagtgtgggacaa

SEQ ID NO: 194225 - DNA, 20 bp, human
gtttgttatccatccttggg

SEQ ID NO: 194226 - DNA, 20 bp, human
gctcgcggcgccttccatcg

SEQ ID NO: 194227 - DNA, 20 bp, human
ggccgcgagcccgatctcca

SEQ ID NO: 194228 - DNA, 20 bp, human
gagcgcggagccacgatgga

SEQ ID NO: 194229 - DNA, 20 bp, human
ggctgtcacgtgggcctctg

SEQ ID NO: 194230 - DNA, 20 bp, human
gtggggccgcagagatacca

SEQ ID NO: 194231 - DNA, 20 bp, human
gtccaggtaagaagccggtg

SEQ ID NO: 194232 - DNA, 20 bp, human
gtgctccgcaagccccagcg

SEQ ID NO: 194233 - DNA, 20 bp, human
gccccagcgcggagccacga

SEQ ID NO: 194234 - DNA, 20 bp, human
ggctgtgccttgtaagaatc

SEQ ID NO: 194235 - DNA, 20 bp, human
gccggcttcttacctggagg

SEQ ID NO: 194236 - DNA, 20 bp, human
gtacacacggccacctccat

SEQ ID NO: 194237 - DNA, 20 bp, human
gcagcgcctgggagctccag

SEQ ID NO: 194238 - DNA, 20 bp, human
ggccgccgagtccgtacaca

SEQ ID NO: 194239 - DNA, 20 bp, human
gcaggcctgagctgctatgg

SEQ ID NO: 194240 - DNA, 20 bp, human
ggccgtgtgtacggactcgg

SEQ ID NO: 194241 - DNA, 20 bp, human
ggagatacgtgcgacctgtt

SEQ ID NO: 194242 - DNA, 20 bp, human
gacgcacgtccggggcggtg

SEQ ID NO: 194243 - DNA, 20 bp, human
gacgatgcagctccacatcg

SEQ ID NO: 194244 - DNA, 20 bp, human
ggtggccgtgtgtacggact

SEQ ID NO: 194245 - DNA, 20 bp, human
gggactcggcggccccgatg

SEQ ID NO: 194246 - DNA, 20 bp, human
gtcgcgtagcggctcgagcg

SEQ ID NO: 194247 - DNA, 20 bp, human
gaggtggccagagagagcgg

SEQ ID NO: 194248 - DNA, 20 bp, human
gagctgaagggacgagagaa

SEQ ID NO: 194249 - DNA, 20 bp, human
gtacttcatagttcgcgtag

SEQ ID NO: 194250 - DNA, 20 bp, human
gatgaggtagctcgtgacat

SEQ ID NO: 194251 - DNA, 20 bp, human
ggagcgggggcgaagctgaa

SEQ ID NO: 194252 - DNA, 20 bp, human
gcttcgcacgcggaaagaac

SEQ ID NO: 194253 - DNA, 20 bp, human
gacttacaaattcccggggt

SEQ ID NO: 194254 - DNA, 20 bp, human
ggggtcgctgtgaagttgac

SEQ ID NO: 194255 - DNA, 20 bp, human
gtagaagcggtgcagaaagt

SEQ ID NO: 194256 - DNA, 20 bp, human
gggcgtgatccgggcactta

SEQ ID NO: 194257 - DNA, 20 bp, human
ggccggctgtactccgagtg

SEQ ID NO: 194258 - DNA, 20 bp, human
gctcctcaggagtaccccag

SEQ ID NO: 194259 - DNA, 20 bp, human
gccgcgtgctggctccgaag

SEQ ID NO: 194260 - DNA, 20 bp, human
gctccactggggtactcctg

SEQ ID NO: 194261 - DNA, 20 bp, human
gggcatccgcgctccccgta

SEQ ID NO: 194262 - DNA, 20 bp, human
gccaagatggcgacggaggg

SEQ ID NO: 194263 - DNA, 20 bp, human
gtgggccggtaactccactg

SEQ ID NO: 194264 - DNA, 20 bp, human
gccgggaccccaaagagcgg

SEQ ID NO: 194265 - DNA, 20 bp, human
gcagcacgcggggtacccta

SEQ ID NO: 194266 - DNA, 20 bp, human
ggttcctgggagcggcgcag

SEQ ID NO: 194267 - DNA, 20 bp, human
gcgagggacgggaaagacag

SEQ ID NO: 194268 - DNA, 20 bp, human
gagacgcgggaagggcccag

SEQ ID NO: 194269 - DNA, 20 bp, human
gacccccatcagccagatct

SEQ ID NO: 194270 - DNA, 20 bp, human
gctgcgggacgagaaccaga

SEQ ID NO: 194271 - DNA, 20 bp, human
gggtcagtcaatcccagcag

SEQ ID NO: 194272 - DNA, 20 bp, human
ggcccagatctggctgatgg

SEQ ID NO: 194273 - DNA, 20 bp, human
ggggttcgcgcgggggagaa

SEQ ID NO: 194274 - DNA, 20 bp, human
gtgatgggggtaccgagagg

SEQ ID NO: 194275 - DNA, 20 bp, human
gggctgatgggggtaccgag

SEQ ID NO: 194276 - DNA, 20 bp, human
gcgggagaaccgagcgcttc

SEQ ID NO: 194277 - DNA, 20 bp, human
gggttctcccggaggcagac

SEQ ID NO: 194278 - DNA, 20 bp, human
gggcagaggccgccactgat

SEQ ID NO: 194279 - DNA, 20 bp, human
ggcgtcggaacgtgactgga

SEQ ID NO: 194280 - DNA, 20 bp, human
gcgccgctcaccacacgcac

SEQ ID NO: 194281 - DNA, 20 bp, human
gttctggaatgcaaacgggt

SEQ ID NO: 194282 - DNA, 20 bp, human
gtgctggccggtctgcctcc

SEQ ID NO: 194283 - DNA, 20 bp, human
ggcacgggcaccctggtggt

SEQ ID NO: 194284 - DNA, 20 bp, human
gaagaagtaaggttggtcca

SEQ ID NO: 194285 - DNA, 20 bp, human
gctggagaagagtctaagga

SEQ ID NO: 194286 - DNA, 20 bp, human
gcctcggcggcggagggagt

SEQ ID NO: 194287 - DNA, 20 bp, human
ggcggatccgaggacagagg

SEQ ID NO: 194288 - DNA, 20 bp, human
gggagcggatccgaggacag

SEQ ID NO: 194289 - DNA, 20 bp, human
ggcagagcggagcggatccg

SEQ ID NO: 194290 - DNA, 20 bp, human
gaccagggagcagagcggag

SEQ ID NO: 194291 - DNA, 20 bp, human
ggcggccacagcctggtcag

SEQ ID NO: 194292 - DNA, 20 bp, human
ggctccgccggtgtccgagt

SEQ ID NO: 194293 - DNA, 20 bp, human
gccggtgtccgagtcggagg

SEQ ID NO: 194294 - DNA, 20 bp, human
gtccgctccgctctgctccc

SEQ ID NO: 194295 - DNA, 20 bp, human
gcgccgagagaggccgtggt

SEQ ID NO: 194296 - DNA, 20 bp, human
gcgacccacgcgagccgcta

SEQ ID NO: 194297 - DNA, 20 bp, human
gtaaccatagcggctcgcgt

SEQ ID NO: 194298 - DNA, 20 bp, human
ggggtctccaggggaattcg

SEQ ID NO: 194299 - DNA, 20 bp, human
gcatagcggcgagcgtgggg

SEQ ID NO: 194300 - DNA, 20 bp, human
gggaattcggggcacaagtc

SEQ ID NO: 194301 - DNA, 20 bp, human
gaagtcgggccggagcatcc

SEQ ID NO: 194302 - DNA, 20 bp, human
gtaaccatagcggcgagcgt

SEQ ID NO: 194303 - DNA, 20 bp, human
gtcgggccggagcatccggg

SEQ ID NO: 194304 - DNA, 20 bp, human
gggagaccctcgcactagca

SEQ ID NO: 194305 - DNA, 20 bp, human
ggagatagcgaaaggggcgt

SEQ ID NO: 194306 - DNA, 20 bp, human
ggtcctggaggtgcgtggtt

SEQ ID NO: 194307 - DNA, 20 bp, human
gactcacctcagcctccacg

SEQ ID NO: 194308 - DNA, 20 bp, human
gtcggctgggagcctcgtgg

SEQ ID NO: 194309 - DNA, 20 bp, human
gcaatcggctgggagcctcg

SEQ ID NO: 194310 - DNA, 20 bp, human
ggttaggaagcggagatcat

SEQ ID NO: 194311 - DNA, 20 bp, human
gaccgcgccgagtagctgag

SEQ ID NO: 194312 - DNA, 20 bp, human
gggtgagtcctggaggtgcg

SEQ ID NO: 194313 - DNA, 20 bp, human
ggggagcctcgtggaggctg

SEQ ID NO: 194314 - DNA, 20 bp, human
gtcgtgaactgtcagaaagg

SEQ ID NO: 194315 - DNA, 20 bp, human
gtccggaacggacccggaag

SEQ ID NO: 194316 - DNA, 20 bp, human
gcctcaggctcagtacccac

SEQ ID NO: 194317 - DNA, 20 bp, human
gagccccgcagcccaccggt

SEQ ID NO: 194318 - DNA, 20 bp, human
gaggctcagtacccaccggt

SEQ ID NO: 194319 - DNA, 20 bp, human
ggtgggagaaaggggcatag

SEQ ID NO: 194320 - DNA, 20 bp, human
gtacccaccggtgggctgcg

SEQ ID NO: 194321 - DNA, 20 bp, human
gcatagcggcagactaggag

SEQ ID NO: 194322 - DNA, 20 bp, human
ggagaagagtccccgaagat

SEQ ID NO: 194323 - DNA, 20 bp, human
gaggggcatagcggcagact

SEQ ID NO: 194324 - DNA, 20 bp, human
gtgcccctttctcccacctc

SEQ ID NO: 194325 - DNA, 20 bp, human
gggcgggaacgcggagcctg

SEQ ID NO: 194326 - DNA, 20 bp, human
gtgcgttcggtggcccatag

SEQ ID NO: 194327 - DNA, 20 bp, human
gggccaccgaacgcacgctc

SEQ ID NO: 194328 - DNA, 20 bp, human
gggcccataggggaagatgg

SEQ ID NO: 194329 - DNA, 20 bp, human
gtcgccaccgctcccagtca

SEQ ID NO: 194330 - DNA, 20 bp, human
gtagaactaaggccctgact

SEQ ID NO: 194331 - DNA, 20 bp, human
gctctggggtcatcacgcac

SEQ ID NO: 194332 - DNA, 20 bp, human
gcaacggccgagcccgaaaa

SEQ ID NO: 194333 - DNA, 20 bp, human
gaggcccccaaagcacgcaa

SEQ ID NO: 194334 - DNA, 20 bp, human
ggcggccatggttagaacta

SEQ ID NO: 194335 - DNA, 20 bp, human
gcgacgagaagacgtaagtc

SEQ ID NO: 194336 - DNA, 20 bp, human
ggcggcgctggcgacagtcg

SEQ ID NO: 194337 - DNA, 20 bp, human
gcgcagtggagggccgtcca

SEQ ID NO: 194338 - DNA, 20 bp, human
gggcacggacgccacaccca

SEQ ID NO: 194339 - DNA, 20 bp, human
gcgacagtcggggttgcgag

SEQ ID NO: 194340 - DNA, 20 bp, human
gtcagccaggcgggaagcgc

SEQ ID NO: 194341 - DNA, 20 bp, human
gtgggccgaaagtatcctct

SEQ ID NO: 194342 - DNA, 20 bp, human
gcagccggggccactcagcc

SEQ ID NO: 194343 - DNA, 20 bp, human
gccgctgcaggacgagaccc

SEQ ID NO: 194344 - DNA, 20 bp, human
gtgagtgcgtccgcacgaga

SEQ ID NO: 194345 - DNA, 20 bp, human
gccggggccactcagccagg

SEQ ID NO: 194346 - DNA, 20 bp, human
gtaaggccctcgacaagtaa

SEQ ID NO: 194347 - DNA, 20 bp, human
gcccaaaaggacctagccag

SEQ ID NO: 194348 - DNA, 20 bp, human
gatccccgagagggtcacgg

SEQ ID NO: 194349 - DNA, 20 bp, human
gggatgcgaccgggcaacag

SEQ ID NO: 194350 - DNA, 20 bp, human
gagctgctggtactcccgat

SEQ ID NO: 194351 - DNA, 20 bp, human
gcacgtggatcagcaacaag

SEQ ID NO: 194352 - DNA, 20 bp, human
ggtggatcagcaacaagtgg

SEQ ID NO: 194353 - DNA, 20 bp, human
gtcaggtagaagaacatcgt

SEQ ID NO: 194354 - DNA, 20 bp, human
gatgggagagtgctgcgaga

SEQ ID NO: 194355 - DNA, 20 bp, human
gcaagctcggccaaagactg

SEQ ID NO: 194356 - DNA, 20 bp, human
gttccactagacacgctgaa

SEQ ID NO: 194357 - DNA, 20 bp, human
gtagacacgctgaagggact

SEQ ID NO: 194358 - DNA, 20 bp, human
gatcagcacgtggacgtgac

SEQ ID NO: 194359 - DNA, 20 bp, human
gcttcaggaccagagctgag

SEQ ID NO: 194360 - DNA, 20 bp, human
gatattaataggacagggag

SEQ ID NO: 194361 - DNA, 20 bp, human
gcggatggcgaaatattaat

SEQ ID NO: 194362 - DNA, 20 bp, human
gctctgaaacacgccccagg

SEQ ID NO: 194363 - DNA, 20 bp, human
ggcacgtggacgtgaccgga

SEQ ID NO: 194364 - DNA, 20 bp, human
ggcgaaatattaataggaca

SEQ ID NO: 194365 - DNA, 20 bp, human
gagggaagcccgtggtaaat

SEQ ID NO: 194366 - DNA, 20 bp, human
gcgcgtcagtgcggagacag

SEQ ID NO: 194367 - DNA, 20 bp, human
gacccagcggcgcgggactg

SEQ ID NO: 194368 - DNA, 20 bp, human
gcctcccgcgaaccgctcgg

SEQ ID NO: 194369 - DNA, 20 bp, human
ggcgccaggttggggttgtg

SEQ ID NO: 194370 - DNA, 20 bp, human
gccgcgtcgtagggactcac

SEQ ID NO: 194371 - DNA, 20 bp, human
gcgctggtgagtcactgcgg

SEQ ID NO: 194372 - DNA, 20 bp, human
ggggcatccggggaacgact

SEQ ID NO: 194373 - DNA, 20 bp, human
gccgcctgcgctcagggccg

SEQ ID NO: 194374 - DNA, 20 bp, human
ggacactgcagggctcaagg

SEQ ID NO: 194375 - DNA, 20 bp, human
gggagtacgtgaccaagggt

SEQ ID NO: 194376 - DNA, 20 bp, human
ggccgcgggaccccaggact

SEQ ID NO: 194377 - DNA, 20 bp, human
gccgggaccccgctgttcat

SEQ ID NO: 194378 - DNA, 20 bp, human
gctgggctctgcctcgagag

SEQ ID NO: 194379 - DNA, 20 bp, human
gggaccccaggactgggcag

SEQ ID NO: 194380 - DNA, 20 bp, human
gccagagccgcagctgacaa

SEQ ID NO: 194381 - DNA, 20 bp, human
gcgcctaggagggagcccgc

SEQ ID NO: 194382 - DNA, 20 bp, human
ggagctttgtgcccctctcg

SEQ ID NO: 194383 - DNA, 20 bp, human
gcgggtgcccatgaacagcg

SEQ ID NO: 194384 - DNA, 20 bp, human
gcatccaaagccgggagtct

SEQ ID NO: 194385 - DNA, 20 bp, human
gcaaagctccctgctgactc

SEQ ID NO: 194386 - DNA, 20 bp, human
ggcggagaccggaagcgacc

SEQ ID NO: 194387 - DNA, 20 bp, human
ggaccggtgcggacaggaag

SEQ ID NO: 194388 - DNA, 20 bp, human
ggagaccggaagcgacccgg

SEQ ID NO: 194389 - DNA, 20 bp, human
gctgggctggcacatgtgta

SEQ ID NO: 194390 - DNA, 20 bp, human
gactgcggcggaggactcgt

SEQ ID NO: 194391 - DNA, 20 bp, human
gaggcgggcgggtacatggc

SEQ ID NO: 194392 - DNA, 20 bp, human
gggctggcacatgtgtatgg

SEQ ID NO: 194393 - DNA, 20 bp, human
gccgggtaggtagagcacgt

SEQ ID NO: 194394 - DNA, 20 bp, human
ggcacatgtgtatggcggtg

SEQ ID NO: 194395 - DNA, 20 bp, human
gcccggggtcaccccagagt

SEQ ID NO: 194396 - DNA, 20 bp, human
gtgttgcgatggctgatcgg

SEQ ID NO: 194397 - DNA, 20 bp, human
gtgggacctgtgacaactta

SEQ ID NO: 194398 - DNA, 20 bp, human
gttacctcggccagtccctg

SEQ ID NO: 194399 - DNA, 20 bp, human
gcatcgcaacatccgggcag

SEQ ID NO: 194400 - DNA, 20 bp, human
ggccgaggtaaaccccgggt

SEQ ID NO: 194401 - DNA, 20 bp, human
gatcagccatcgcaacatcc

SEQ ID NO: 194402 - DNA, 20 bp, human
gagccggagctcctcagacc

SEQ ID NO: 194403 - DNA, 20 bp, human
gcgcaacatccgggcagcgg

SEQ ID NO: 194404 - DNA, 20 bp, human
gactggccgaggtaaacccc

SEQ ID NO: 194405 - DNA, 20 bp, human
ggcgctcccgtacccagcca

SEQ ID NO: 194406 - DNA, 20 bp, human
gggcggtagctgcgaccccc

SEQ ID NO: 194407 - DNA, 20 bp, human
ggagcagcaatggcggcggg

SEQ ID NO: 194408 - DNA, 20 bp, human
gctgcgcacggacgaacacg

SEQ ID NO: 194409 - DNA, 20 bp, human
gcctgccgcgagggcagtga

SEQ ID NO: 194410 - DNA, 20 bp, human
gggcgcaagggaccccagca

SEQ ID NO: 194411 - DNA, 20 bp, human
ggtgcggggagaaggcgcaa

SEQ ID NO: 194412 - DNA, 20 bp, human
gcatcgcgcgtggctctcag

SEQ ID NO: 194413 - DNA, 20 bp, human
gccagagcagcaatggcggc

SEQ ID NO: 194414 - DNA, 20 bp, human
gccggcagggctcggatacg

SEQ ID NO: 194415 - DNA, 20 bp, human
gtggctgcccgtcaacagtg

SEQ ID NO: 194416 - DNA, 20 bp, human
gcggtggctcctcgcagtaa

SEQ ID NO: 194417 - DNA, 20 bp, human
gataaggagcgcgaaagagg

SEQ ID NO: 194418 - DNA, 20 bp, human
gcctaggtgcacatcttcag

SEQ ID NO: 194419 - DNA, 20 bp, human
gaagggcgcgccggctacag

SEQ ID NO: 194420 - DNA, 20 bp, human
gcgcgggtgtgtcctataaa

SEQ ID NO: 194421 - DNA, 20 bp, human
gggggcatcatagaattcct

SEQ ID NO: 194422 - DNA, 20 bp, human
gccggcgccgcctggaggaa

SEQ ID NO: 194423 - DNA, 20 bp, human
ggaagcccggcaactgaggg

SEQ ID NO: 194424 - DNA, 20 bp, human
ggcgtcggaaagcgacaccg

SEQ ID NO: 194425 - DNA, 20 bp, human
gaagatgtgcacctaggggg

SEQ ID NO: 194426 - DNA, 20 bp, human
gacacccgagccgggctcca

SEQ ID NO: 194427 - DNA, 20 bp, human
gagagcatgaggcattccag

SEQ ID NO: 194428 - DNA, 20 bp, human
gcagctgtcggtgccgcccg

SEQ ID NO: 194429 - DNA, 20 bp, human
ggctccctcccccggaagta

SEQ ID NO: 194430 - DNA, 20 bp, human
gcatcaggccctacttccgg

SEQ ID NO: 194431 - DNA, 20 bp, human
gttggactcttggaggatgg

SEQ ID NO: 194432 - DNA, 20 bp, human
gtaaggcagaggtcttgagt

SEQ ID NO: 194433 - DNA, 20 bp, human
gcatgaggcattccagtgga

SEQ ID NO: 194434 - DNA, 20 bp, human
gtgtccagagaataactcta

SEQ ID NO: 194435 - DNA, 20 bp, human
ggagggtgtaactgaaagaa

SEQ ID NO: 194436 - DNA, 20 bp, human
gggagcggtcacaacccggg

SEQ ID NO: 194437 - DNA, 20 bp, human
ggcgccggcccgaagggacc

SEQ ID NO: 194438 - DNA, 20 bp, human
gcccgggccgaggtcgaggt

SEQ ID NO: 194439 - DNA, 20 bp, human
ggcctcagcgccggcccgaa

SEQ ID NO: 194440 - DNA, 20 bp, human
gtgcctctcgctggggacgg

SEQ ID NO: 194441 - DNA, 20 bp, human
gggtcgaggtcggtgggaga

SEQ ID NO: 194442 - DNA, 20 bp, human
ggagcggcgacccagcacgg

SEQ ID NO: 194443 - DNA, 20 bp, human
gggccgaggtcgaggtcggt

SEQ ID NO: 194444 - DNA, 20 bp, human
gacggcggcctggtcccttc

SEQ ID NO: 194445 - DNA, 20 bp, human
ggcgctgcatgcctctcgct

SEQ ID NO: 194446 - DNA, 20 bp, human
gcgactgtgtggcagctgag

SEQ ID NO: 194447 - DNA, 20 bp, human
gaaaccgcggcgatactggg

SEQ ID NO: 194448 - DNA, 20 bp, human
gcacagccggagcctctcca

SEQ ID NO: 194449 - DNA, 20 bp, human
gtcactctcaaggaacgagg

SEQ ID NO: 194450 - DNA, 20 bp, human
gtagaaaccgcggcgatact

SEQ ID NO: 194451 - DNA, 20 bp, human
gcgtggatcgccgttcgggt

SEQ ID NO: 194452 - DNA, 20 bp, human
gccccgagaatggaagaacc

SEQ ID NO: 194453 - DNA, 20 bp, human
ggccgttcgggtgggcgaga

SEQ ID NO: 194454 - DNA, 20 bp, human
ggatgtgcctgtagaaaccg

SEQ ID NO: 194455 - DNA, 20 bp, human
gtccatctcgcccacccgaa

SEQ ID NO: 194456 - DNA, 20 bp, human
gcagggcaagcccggaggag

SEQ ID NO: 194457 - DNA, 20 bp, human
gaggagtcgctgggccggga

SEQ ID NO: 194458 - DNA, 20 bp, human
gtgccctggagccctcaggt

SEQ ID NO: 194459 - DNA, 20 bp, human
ggacaaccgcagtctgcaag

SEQ ID NO: 194460 - DNA, 20 bp, human
gccggagaggggtctttagt

SEQ ID NO: 194461 - DNA, 20 bp, human
gggcaagcccggaggagcgg

SEQ ID NO: 194462 - DNA, 20 bp, human
gttgggtgccgactgggagg

SEQ ID NO: 194463 - DNA, 20 bp, human
ggaaaggtgtggtccaggac

SEQ ID NO: 194464 - DNA, 20 bp, human
gggggcggacgtgagaagga

SEQ ID NO: 194465 - DNA, 20 bp, human
ggccgagctctacccgcgag

SEQ ID NO: 194466 - DNA, 20 bp, human
ggtccggaagaccgaggaac

SEQ ID NO: 194467 - DNA, 20 bp, human
gcaagatggcggcccatcac

SEQ ID NO: 194468 - DNA, 20 bp, human
gagcgcttcgaagaaagaca

SEQ ID NO: 194469 - DNA, 20 bp, human
gcacccccctgggaaacccc

SEQ ID NO: 194470 - DNA, 20 bp, human
gccccctgggaaacccctgg

SEQ ID NO: 194471 - DNA, 20 bp, human
ggtcggagccgaggcctcca

SEQ ID NO: 194472 - DNA, 20 bp, human
ggcagggcggaggaaagtgc

SEQ ID NO: 194473 - DNA, 20 bp, human
ggcggaggaaagtgcaggta

SEQ ID NO: 194474 - DNA, 20 bp, human
ggcctccaggggtttcccag

SEQ ID NO: 194475 - DNA, 20 bp, human
gcctcgctgcgtcggagccg

SEQ ID NO: 194476 - DNA, 20 bp, human
gtcagagtcaagtacttcat

SEQ ID NO: 194477 - DNA, 20 bp, human
gactcttccagacaagaaag

SEQ ID NO: 194478 - DNA, 20 bp, human
gccaggttaaacagagtata

SEQ ID NO: 194479 - DNA, 20 bp, human
gaagttgagtttcttttcaa

SEQ ID NO: 194480 - DNA, 20 bp, human
gcctttcaaggcatacgatc

SEQ ID NO: 194481 - DNA, 20 bp, human
gaggcaaaatgttcaagctg

SEQ ID NO: 194482 - DNA, 20 bp, human
gttcaaggcatacgatcagg

SEQ ID NO: 194483 - DNA, 20 bp, human
gaaaatgttcaagctgaggt

SEQ ID NO: 194484 - DNA, 20 bp, human
gttaaacagagtataaggaa

SEQ ID NO: 194485 - DNA, 20 bp, human
gtccttatagaaatagttga

SEQ ID NO: 194486 - DNA, 20 bp, human
gggcgctcggggcgtcgcgt

SEQ ID NO: 194487 - DNA, 20 bp, human
ggcccggcggggaacacgtg

SEQ ID NO: 194488 - DNA, 20 bp, human
ggcgcggactcagctcgaca

SEQ ID NO: 194489 - DNA, 20 bp, human
gcggactcagctcgacaagg

SEQ ID NO: 194490 - DNA, 20 bp, human
gctcgacaaggcggcagctc

SEQ ID NO: 194491 - DNA, 20 bp, human
gacctcgtccagggactgag

SEQ ID NO: 194492 - DNA, 20 bp, human
gagaggggcgatgtgaggcc

SEQ ID NO: 194493 - DNA, 20 bp, human
ggcgtcggccgccgcctggg

SEQ ID NO: 194494 - DNA, 20 bp, human
ggacaaggcggcagctcggg

SEQ ID NO: 194495 - DNA, 20 bp, human
gagctcgggcgggcgccagg

SEQ ID NO: 194496 - DNA, 20 bp, human
gcggcagacgctgtgaagag

SEQ ID NO: 194497 - DNA, 20 bp, human
gccgaaggtactgaccgccg

SEQ ID NO: 194498 - DNA, 20 bp, human
gtgaggtccaaactcaccga

SEQ ID NO: 194499 - DNA, 20 bp, human
gcggtaaccggagtaaacgg

SEQ ID NO: 194500 - DNA, 20 bp, human
ggctgtgaagagaggagccg

SEQ ID NO: 194501 - DNA, 20 bp, human
ggtgaagagaggagccgcgg

SEQ ID NO: 194502 - DNA, 20 bp, human
gtgaggaagccgaagtgcag

SEQ ID NO: 194503 - DNA, 20 bp, human
gtctcggtaaccggagtaaa

SEQ ID NO: 194504 - DNA, 20 bp, human
gccgcccggtcagactgaca

SEQ ID NO: 194505 - DNA, 20 bp, human
ggtcagctgggaaggtgctg

SEQ ID NO: 194506 - DNA, 20 bp, human
gaaagcagcatcgaagccac

SEQ ID NO: 194507 - DNA, 20 bp, human
gggtatgaggctggcgccgg

SEQ ID NO: 194508 - DNA, 20 bp, human
gatcactaggcgccgaggag

SEQ ID NO: 194509 - DNA, 20 bp, human
gagcgggaagcgcaggtatg

SEQ ID NO: 194510 - DNA, 20 bp, human
ggagccaccagaccagaaaa

SEQ ID NO: 194511 - DNA, 20 bp, human
gaaaacagcatcgaagtcac

SEQ ID NO: 194512 - DNA, 20 bp, human
gggaagcgcaggtatgaggc

SEQ ID NO: 194513 - DNA, 20 bp, human
gtcatctgcttactaagcgg

SEQ ID NO: 194514 - DNA, 20 bp, human
gggcgggtgaggttatcact

SEQ ID NO: 194515 - DNA, 20 bp, human
gtccaatagggagaatgacg

SEQ ID NO: 194516 - DNA, 20 bp, human
gggctgttttggggcgacgg

SEQ ID NO: 194517 - DNA, 20 bp, human
gtcgcgggcttggggccatc

SEQ ID NO: 194518 - DNA, 20 bp, human
gagtcaggcgagccgatctg

SEQ ID NO: 194519 - DNA, 20 bp, human
gacgtgcgtcgtctctatgg

SEQ ID NO: 194520 - DNA, 20 bp, human
gagcccccggcctagatcag

SEQ ID NO: 194521 - DNA, 20 bp, human
ggtctcgaggagcaagacag

SEQ ID NO: 194522 - DNA, 20 bp, human
gctgaggttgttgcacaggg

SEQ ID NO: 194523 - DNA, 20 bp, human
ggcctgactcctggttcgta

SEQ ID NO: 194524 - DNA, 20 bp, human
gaccctacgaaccaggagtc

SEQ ID NO: 194525 - DNA, 20 bp, human
ggggaatggagcgctcccag

SEQ ID NO: 194526 - DNA, 20 bp, human
gtccgaggctgactaccctg

SEQ ID NO: 194527 - DNA, 20 bp, human
gtgactaccctgcggcggcg

SEQ ID NO: 194528 - DNA, 20 bp, human
ggaggctgactaccctgcgg

SEQ ID NO: 194529 - DNA, 20 bp, human
gctcggaaccacccacactg

SEQ ID NO: 194530 - DNA, 20 bp, human
ggggcctctcctcacaagtg

SEQ ID NO: 194531 - DNA, 20 bp, human
gagtgcggtccatgctgaga

SEQ ID NO: 194532 - DNA, 20 bp, human
gtgtgaggagaggcccgctg

SEQ ID NO: 194533 - DNA, 20 bp, human
gggaccgcacttgtgaggag

SEQ ID NO: 194534 - DNA, 20 bp, human
ggctgaggatgggagcgacg

SEQ ID NO: 194535 - DNA, 20 bp, human
gtgcgagccgcgccgccgca

SEQ ID NO: 194536 - DNA, 20 bp, human
ggcacggtcccgggatactg

SEQ ID NO: 194537 - DNA, 20 bp, human
gggtccgccttgtgacactg

SEQ ID NO: 194538 - DNA, 20 bp, human
gctgattctctggctgtgtg

SEQ ID NO: 194539 - DNA, 20 bp, human
ggagggaagacgaccatcgg

SEQ ID NO: 194540 - DNA, 20 bp, human
gaccagggcacggggcgtgt

SEQ ID NO: 194541 - DNA, 20 bp, human
gccgccgtccccagtatccc

SEQ ID NO: 194542 - DNA, 20 bp, human
gatactggggacggcggggt

SEQ ID NO: 194543 - DNA, 20 bp, human
gcgtgtcggggctgattctc

SEQ ID NO: 194544 - DNA, 20 bp, human
gggtcccgggatactgggga

SEQ ID NO: 194545 - DNA, 20 bp, human
gctatgcttgggtcaaccaa

SEQ ID NO: 194546 - DNA, 20 bp, human
ggctttgttggagattgacg

SEQ ID NO: 194547 - DNA, 20 bp, human
gccaccgaaactggaaactc

SEQ ID NO: 194548 - DNA, 20 bp, human
gacgagcaaaagtagccgac

SEQ ID NO: 194549 - DNA, 20 bp, human
gactggaaactctggcctgt

SEQ ID NO: 194550 - DNA, 20 bp, human
gccagtttcggtggcttcgt

SEQ ID NO: 194551 - DNA, 20 bp, human
gaggcgttcagccctgaacc

SEQ ID NO: 194552 - DNA, 20 bp, human
gaaagcaggggcgacgcgag

SEQ ID NO: 194553 - DNA, 20 bp, human
ggtacctagcctgactggta

SEQ ID NO: 194554 - DNA, 20 bp, human
gaccaggcagtccagtactt

SEQ ID NO: 194555 - DNA, 20 bp, human
gcagcctggcgcatgtgcaa

SEQ ID NO: 194556 - DNA, 20 bp, human
gaggcagccacggctaagaa

SEQ ID NO: 194557 - DNA, 20 bp, human
gagcacctcgaggatcgaca

SEQ ID NO: 194558 - DNA, 20 bp, human
ggcgtccatgtcgatcctcg

SEQ ID NO: 194559 - DNA, 20 bp, human
gatcgacatggacgctctcg

SEQ ID NO: 194560 - DNA, 20 bp, human
gtcagcccgcgtggaaaggg

SEQ ID NO: 194561 - DNA, 20 bp, human
ggaaagggcgggtggaaccg

SEQ ID NO: 194562 - DNA, 20 bp, human
gctgtggcaccgcccctggg

SEQ ID NO: 194563 - DNA, 20 bp, human
ggttcccctgcaccctcccg

SEQ ID NO: 194564 - DNA, 20 bp, human
gtcagctcccttcttagccg

SEQ ID NO: 194565 - DNA, 20 bp, human
gtaagctccgaggttgcccg

SEQ ID NO: 194566 - DNA, 20 bp, human
gctgggacgcgcctcccgaa

SEQ ID NO: 194567 - DNA, 20 bp, human
ggtgccccgcacccttcggg

SEQ ID NO: 194568 - DNA, 20 bp, human
gggcgcggtccaccccgaag

SEQ ID NO: 194569 - DNA, 20 bp, human
gacgcgcctcccgaagggtg

SEQ ID NO: 194570 - DNA, 20 bp, human
ggaggcaggaagggaaacgg

SEQ ID NO: 194571 - DNA, 20 bp, human
ggcgaggagacgggccgcgg

SEQ ID NO: 194572 - DNA, 20 bp, human
ggaaccgctgcgcaaaggga

SEQ ID NO: 194573 - DNA, 20 bp, human
ggagcccgggaaggtcggtg

SEQ ID NO: 194574 - DNA, 20 bp, human
gacctgtgccccgcaccctt

SEQ ID NO: 194575 - DNA, 20 bp, human
gagaggccgcagggcacgct

SEQ ID NO: 194576 - DNA, 20 bp, human
gagtggtgagttggagcgca

SEQ ID NO: 194577 - DNA, 20 bp, human
gactggacgggtacagacag

SEQ ID NO: 194578 - DNA, 20 bp, human
gggacagatacagacatcac

SEQ ID NO: 194579 - DNA, 20 bp, human
gcggcttccgacgtgcagcc

SEQ ID NO: 194580 - DNA, 20 bp, human
gtaatgaccccaatccccaa

SEQ ID NO: 194581 - DNA, 20 bp, human
gtagtgggccacgctgtctt

SEQ ID NO: 194582 - DNA, 20 bp, human
ggtacaccgaggaacagcca

SEQ ID NO: 194583 - DNA, 20 bp, human
gcctcaggccccgtacaccg

SEQ ID NO: 194584 - DNA, 20 bp, human
ggatacagacatcactggac

SEQ ID NO: 194585 - DNA, 20 bp, human
gacgggtacagacagaggct

SEQ ID NO: 194586 - DNA, 20 bp, human
gagggtccggaggctatgcg

SEQ ID NO: 194587 - DNA, 20 bp, human
gtggcggccgtagggtccgg

SEQ ID NO: 194588 - DNA, 20 bp, human
gcggcggttaggggatgtaa

SEQ ID NO: 194589 - DNA, 20 bp, human
ggcctccggcgtgacgatgg

SEQ ID NO: 194590 - DNA, 20 bp, human
gctgttccagtgggtcgtgg

SEQ ID NO: 194591 - DNA, 20 bp, human
gggaggggccgtggctaaag

SEQ ID NO: 194592 - DNA, 20 bp, human
gcagcgttggagcaattcgg

SEQ ID NO: 194593 - DNA, 20 bp, human
gcgccaccgccacgacccac

SEQ ID NO: 194594 - DNA, 20 bp, human
gtggcggcagcggcggttag

SEQ ID NO: 194595 - DNA, 20 bp, human
gtgtaacggtcgcccgcctc

SEQ ID NO: 194596 - DNA, 20 bp, human
ggatgcgtcctggcaacagt

SEQ ID NO: 194597 - DNA, 20 bp, human
gtccttcgagagctggaggt

SEQ ID NO: 194598 - DNA, 20 bp, human
gacagtcggcagagttgctg

SEQ ID NO: 194599 - DNA, 20 bp, human
gaagctccttcgagagctgg

SEQ ID NO: 194600 - DNA, 20 bp, human
gcactgggtatatataacat

SEQ ID NO: 194601 - DNA, 20 bp, human
gcagcaatgtgctaggctag

SEQ ID NO: 194602 - DNA, 20 bp, human
gtaggcaatatgatagtcac

SEQ ID NO: 194603 - DNA, 20 bp, human
gagagcttccagcctcgtga

SEQ ID NO: 194604 - DNA, 20 bp, human
ggagaagctctgaatgggaa

SEQ ID NO: 194605 - DNA, 20 bp, human
gggtaagagaagctctgaat

SEQ ID NO: 194606 - DNA, 20 bp, human
gctccctgctaacatcctag

SEQ ID NO: 194607 - DNA, 20 bp, human
gaaaatcccatagtgcgggt

SEQ ID NO: 194608 - DNA, 20 bp, human
gaggagtaagagttgccact

SEQ ID NO: 194609 - DNA, 20 bp, human
ggatatccatagggacatag

SEQ ID NO: 194610 - DNA, 20 bp, human
ggagcttaatgtgaaagaat

SEQ ID NO: 194611 - DNA, 20 bp, human
gaaagaatgggtgctgaaag

SEQ ID NO: 194612 - DNA, 20 bp, human
gagagaaagaacaagaactg

SEQ ID NO: 194613 - DNA, 20 bp, human
gaaggaaaagcgtctcaaca

SEQ ID NO: 194614 - DNA, 20 bp, human
gatcttaaaatcccatagtg

SEQ ID NO: 194615 - DNA, 20 bp, human
gtgggtctgttggttagaac

SEQ ID NO: 194616 - DNA, 20 bp, human
gatccagaggcgctacctgt

SEQ ID NO: 194617 - DNA, 20 bp, human
gagaccacgcatgtatccag

SEQ ID NO: 194618 - DNA, 20 bp, human
gggttgcttaggatccctac

SEQ ID NO: 194619 - DNA, 20 bp, human
gcgggagatcatgtcagccg

SEQ ID NO: 194620 - DNA, 20 bp, human
gggtcttcagcagaactgtt

SEQ ID NO: 194621 - DNA, 20 bp, human
gccaaggcagcgcttcagag

SEQ ID NO: 194622 - DNA, 20 bp, human
ggaaagtgtccgggttgctt

SEQ ID NO: 194623 - DNA, 20 bp, human
gacggcgtttgaaagtgtcc

SEQ ID NO: 194624 - DNA, 20 bp, human
ggcgcctctggatacatgcg

SEQ ID NO: 194625 - DNA, 20 bp, human
gtccctacaggtagcgcctc

SEQ ID NO: 194626 - DNA, 20 bp, human
gtgggtggcaaccagaacta

SEQ ID NO: 194627 - DNA, 20 bp, human
ggccgccccaggccccacaa

SEQ ID NO: 194628 - DNA, 20 bp, human
ggaaggtggcggccgctgga

SEQ ID NO: 194629 - DNA, 20 bp, human
ggccccagggagacctgagt

SEQ ID NO: 194630 - DNA, 20 bp, human
gtccaactcaggtctccctg

SEQ ID NO: 194631 - DNA, 20 bp, human
gcgggtgagcgccccccaag

SEQ ID NO: 194632 - DNA, 20 bp, human
gccaggcggcgggacgactc

SEQ ID NO: 194633 - DNA, 20 bp, human
gctgctctgaatcaagtcta

SEQ ID NO: 194634 - DNA, 20 bp, human
gtcagtcaaaagaggctcgg

SEQ ID NO: 194635 - DNA, 20 bp, human
ggccccacaagggccaggtc

SEQ ID NO: 194636 - DNA, 20 bp, human
gtctccccagtgatactgca

SEQ ID NO: 194637 - DNA, 20 bp, human
ggcaggtcgggcccaaaagt

SEQ ID NO: 194638 - DNA, 20 bp, human
gcctgctgggataatccgtg

SEQ ID NO: 194639 - DNA, 20 bp, human
gggcaccttgcagtatcact

SEQ ID NO: 194640 - DNA, 20 bp, human
gagggagccacaaagacccc

SEQ ID NO: 194641 - DNA, 20 bp, human
gggtctgataggctacatcg

SEQ ID NO: 194642 - DNA, 20 bp, human
ggctgggataatccgtgggg

SEQ ID NO: 194643 - DNA, 20 bp, human
ggctagctgtcagatcgctg

SEQ ID NO: 194644 - DNA, 20 bp, human
ggtcagctgatttactgcag

SEQ ID NO: 194645 - DNA, 20 bp, human
gcctgcaccgtggaggtcag

SEQ ID NO: 194646 - DNA, 20 bp, human
gtctattctgcgttatccgt

SEQ ID NO: 194647 - DNA, 20 bp, human
gatcttcaaacctctgcaca

SEQ ID NO: 194648 - DNA, 20 bp, human
gacaccccagaaccagccac

SEQ ID NO: 194649 - DNA, 20 bp, human
ggatgacagttatgagagtc

SEQ ID NO: 194650 - DNA, 20 bp, human
ggttgtttgggctgtccctg

SEQ ID NO: 194651 - DNA, 20 bp, human
gtgacaggctcagacgcgtc

SEQ ID NO: 194652 - DNA, 20 bp, human
ggaccctcttccttgtgcag

SEQ ID NO: 194653 - DNA, 20 bp, human
gagcatttgccgcaagttat

SEQ ID NO: 194654 - DNA, 20 bp, human
gtatgagagtctggagagag

SEQ ID NO: 194655 - DNA, 20 bp, human
gacagcccaaacaactgcag

SEQ ID NO: 194656 - DNA, 20 bp, human
gccgccccacggctcaggta

SEQ ID NO: 194657 - DNA, 20 bp, human
gctgccgctcctccgcccca

SEQ ID NO: 194658 - DNA, 20 bp, human
gctgccttacctgagccgtg

SEQ ID NO: 194659 - DNA, 20 bp, human
ggaggagtctaccccagata

SEQ ID NO: 194660 - DNA, 20 bp, human
gagcccgacctgcgctctgg

SEQ ID NO: 194661 - DNA, 20 bp, human
ggccggtacccgtgacccta

SEQ ID NO: 194662 - DNA, 20 bp, human
gagactcctcccaggagcat

SEQ ID NO: 194663 - DNA, 20 bp, human
gcacccccagagcgcaggtc

SEQ ID NO: 194664 - DNA, 20 bp, human
gacagctgggccgggaaaga

SEQ ID NO: 194665 - DNA, 20 bp, human
gcctcccaggagcataggta

SEQ ID NO: 194666 - DNA, 20 bp, human
gcgaggctcagggacatcaa

SEQ ID NO: 194667 - DNA, 20 bp, human
gcatggatcctggggacgac

SEQ ID NO: 194668 - DNA, 20 bp, human
gctcatgtgtggacgtccca

SEQ ID NO: 194669 - DNA, 20 bp, human
gaggctggcgcaaactaact

SEQ ID NO: 194670 - DNA, 20 bp, human
gctcaggtgcccagaagagt

SEQ ID NO: 194671 - DNA, 20 bp, human
ggtcgttgccatggatcctg

SEQ ID NO: 194672 - DNA, 20 bp, human
gcgtccacacatgaggaccg

SEQ ID NO: 194673 - DNA, 20 bp, human
ggagcctcggtcctcatgtg

SEQ ID NO: 194674 - DNA, 20 bp, human
gggttcagtggcccaaactc

SEQ ID NO: 194675 - DNA, 20 bp, human
gtcgtacggggctgggacat

SEQ ID NO: 194676 - DNA, 20 bp, human
gtgcacgctggaaccatgtg

SEQ ID NO: 194677 - DNA, 20 bp, human
gctcggtgccgacccacaca

SEQ ID NO: 194678 - DNA, 20 bp, human
ggtgggtcggcaccgagact

SEQ ID NO: 194679 - DNA, 20 bp, human
gccgaggatggcatattcca

SEQ ID NO: 194680 - DNA, 20 bp, human
gccgagactgggatcttgaa

SEQ ID NO: 194681 - DNA, 20 bp, human
gcctccaggctttgtcatgg

SEQ ID NO: 194682 - DNA, 20 bp, human
gcagccgccatgacaaagcc

SEQ ID NO: 194683 - DNA, 20 bp, human
ggtcagagacactgcccggg

SEQ ID NO: 194684 - DNA, 20 bp, human
ggtgtgaactgtctgcctcc

SEQ ID NO: 194685 - DNA, 20 bp, human
gcgggcgtcgggaagtgcag

SEQ ID NO: 194686 - DNA, 20 bp, human
ggccgaggcgaccgaagtaa

SEQ ID NO: 194687 - DNA, 20 bp, human
gggagcgtagtatctccatg

SEQ ID NO: 194688 - DNA, 20 bp, human
ggaaatcttccattaaacaa

SEQ ID NO: 194689 - DNA, 20 bp, human
gggaagatttcgatcagtta

SEQ ID NO: 194690 - DNA, 20 bp, human
gtgagtgtcttgttgagaga

SEQ ID NO: 194691 - DNA, 20 bp, human
gacggtgcactctcccttcg

SEQ ID NO: 194692 - DNA, 20 bp, human
gacggttgttctctccccga

SEQ ID NO: 194693 - DNA, 20 bp, human
gagaagcgatacctttactt

SEQ ID NO: 194694 - DNA, 20 bp, human
gacctttacttcggtcgcct

SEQ ID NO: 194695 - DNA, 20 bp, human
gttgttgtttgagttggatt

SEQ ID NO: 194696 - DNA, 20 bp, human
gacatccgcgtggttcgttg

SEQ ID NO: 194697 - DNA, 20 bp, human
ggaggaggagaacatccgcg

SEQ ID NO: 194698 - DNA, 20 bp, human
gtactgcgcaaagatggtgg

SEQ ID NO: 194699 - DNA, 20 bp, human
ggtaggtactgcaaaggtag

SEQ ID NO: 194700 - DNA, 20 bp, human
gcgctactgcgcaaagatgg

SEQ ID NO: 194701 - DNA, 20 bp, human
gcggctggaaaatggtccag

SEQ ID NO: 194702 - DNA, 20 bp, human
ggccgccacaacgaaccacg

SEQ ID NO: 194703 - DNA, 20 bp, human
gtccgcgtggttcgttgtgg

SEQ ID NO: 194704 - DNA, 20 bp, human
ggatctggaaggtgttcggg

SEQ ID NO: 194705 - DNA, 20 bp, human
gtagcggaatggccaatctc

SEQ ID NO: 194706 - DNA, 20 bp, human
ggccgaaagatgtccaggtc

SEQ ID NO: 194707 - DNA, 20 bp, human
ggtcaaagctgaaggcctaa

SEQ ID NO: 194708 - DNA, 20 bp, human
ggcccgacctggacatcttt

SEQ ID NO: 194709 - DNA, 20 bp, human
ggtgaagccgatcataactg

SEQ ID NO: 194710 - DNA, 20 bp, human
gagacagcgaccccagatga

SEQ ID NO: 194711 - DNA, 20 bp, human
gtagtgggagagtcacatct

SEQ ID NO: 194712 - DNA, 20 bp, human
gaagaagccgaaagatgtcc

SEQ ID NO: 194713 - DNA, 20 bp, human
gcgccttcccgccaagattg

SEQ ID NO: 194714 - DNA, 20 bp, human
gcaataacccgagaaatagt

SEQ ID NO: 194715 - DNA, 20 bp, human
gcttcccgccaagattgcgg

SEQ ID NO: 194716 - DNA, 20 bp, human
gtccggcagcaaaccccacg

SEQ ID NO: 194717 - DNA, 20 bp, human
gccggccggagactccgctc

SEQ ID NO: 194718 - DNA, 20 bp, human
gcagcgcgtgaagggtagaa

SEQ ID NO: 194719 - DNA, 20 bp, human
ggaagcgccccatctacggg

SEQ ID NO: 194720 - DNA, 20 bp, human
gcggcgtccagtttgagtct

SEQ ID NO: 194721 - DNA, 20 bp, human
gaggagaagcgccccatcta

SEQ ID NO: 194722 - DNA, 20 bp, human
ggctcagaggtgcaccacgt

SEQ ID NO: 194723 - DNA, 20 bp, human
gactcaggctggaggccccg

SEQ ID NO: 194724 - DNA, 20 bp, human
gccgccgggggcactagggg

SEQ ID NO: 194725 - DNA, 20 bp, human
gttctgtgcggtctccatgg

SEQ ID NO: 194726 - DNA, 20 bp, human
gcctcggcccgagccgctaa

SEQ ID NO: 194727 - DNA, 20 bp, human
gcgctaacggaggagcttgg

SEQ ID NO: 194728 - DNA, 20 bp, human
ggggggtacagggacttcag

SEQ ID NO: 194729 - DNA, 20 bp, human
gcggcccgagccgctaacgg

SEQ ID NO: 194730 - DNA, 20 bp, human
ggcggccgcttgttgagcca

SEQ ID NO: 194731 - DNA, 20 bp, human
gcagaggcggccaaaaaaag

SEQ ID NO: 194732 - DNA, 20 bp, human
gcatccccctgggacccgga

SEQ ID NO: 194733 - DNA, 20 bp, human
ggaatgtttgccgggcgtca

SEQ ID NO: 194734 - DNA, 20 bp, human
ggctcctccgttagcggctc

SEQ ID NO: 194735 - DNA, 20 bp, human
gaggcggccaaaaaaagggg

SEQ ID NO: 194736 - DNA, 20 bp, human
gcgcggggacagggtcccag

SEQ ID NO: 194737 - DNA, 20 bp, human
gggcactagggccaccacgt

SEQ ID NO: 194738 - DNA, 20 bp, human
gagccagcgcgcaggcacta

SEQ ID NO: 194739 - DNA, 20 bp, human
gcggcgaagaggcggacggg

SEQ ID NO: 194740 - DNA, 20 bp, human
gggacctgagcatcgatccc

SEQ ID NO: 194741 - DNA, 20 bp, human
ggggcgcgcttacccctccg

SEQ ID NO: 194742 - DNA, 20 bp, human
ggtcagctgacccgtcacgg

SEQ ID NO: 194743 - DNA, 20 bp, human
gggagcgcaggacccgcgga

SEQ ID NO: 194744 - DNA, 20 bp, human
gcggcggcgaagaggcggac

SEQ ID NO: 194745 - DNA, 20 bp, human
ggggcagccggcgatcgcgg

SEQ ID NO: 194746 - DNA, 20 bp, human
gcgctgggttctgggaacga

SEQ ID NO: 194747 - DNA, 20 bp, human
gacctcttgggaggctctgg

SEQ ID NO: 194748 - DNA, 20 bp, human
ggcccccagagcctcccaag

SEQ ID NO: 194749 - DNA, 20 bp, human
gttctgggaacgacggtgtc

SEQ ID NO: 194750 - DNA, 20 bp, human
gaccctggagagctctccaa

SEQ ID NO: 194751 - DNA, 20 bp, human
gtagaaagctacctcttggg

SEQ ID NO: 194752 - DNA, 20 bp, human
gggcagagcgtcagccccca

SEQ ID NO: 194753 - DNA, 20 bp, human
ggagctatagcgtcccgcag

SEQ ID NO: 194754 - DNA, 20 bp, human
ggccgttggagagctctcca

SEQ ID NO: 194755 - DNA, 20 bp, human
gattgcaaacgcagacgccg

SEQ ID NO: 194756 - DNA, 20 bp, human
gcctgtgctgggccaccgga

SEQ ID NO: 194757 - DNA, 20 bp, human
ggcctgtcgccccaaaatgg

SEQ ID NO: 194758 - DNA, 20 bp, human
ggtgctgggccaccggaggg

SEQ ID NO: 194759 - DNA, 20 bp, human
gcagccacctcacggacaac

SEQ ID NO: 194760 - DNA, 20 bp, human
gggagggcaagtgagtgcgg

SEQ ID NO: 194761 - DNA, 20 bp, human
gggagggaggcactgagact

SEQ ID NO: 194762 - DNA, 20 bp, human
ggcgccggttgtccgtgagg

SEQ ID NO: 194763 - DNA, 20 bp, human
gtctgcctgtcgccccaaaa

SEQ ID NO: 194764 - DNA, 20 bp, human
ggacgcgccggttgtccgtg

SEQ ID NO: 194765 - DNA, 20 bp, human
ggggctgaagtcgggacgga

SEQ ID NO: 194766 - DNA, 20 bp, human
ggcgctgaggctgggatccg

SEQ ID NO: 194767 - DNA, 20 bp, human
gacccaagcgtgggtttcta

SEQ ID NO: 194768 - DNA, 20 bp, human
gtaaggttacacccaagcgt

SEQ ID NO: 194769 - DNA, 20 bp, human
ggccttagaaacccacgctt

SEQ ID NO: 194770 - DNA, 20 bp, human
gggaggatcagcatcgacct

SEQ ID NO: 194771 - DNA, 20 bp, human
ggtcaaaggagctggagtaa

SEQ ID NO: 194772 - DNA, 20 bp, human
ggtcaggaagaacaataata

SEQ ID NO: 194773 - DNA, 20 bp, human
gaaaggagctggagtaaagg

SEQ ID NO: 194774 - DNA, 20 bp, human
gctgggccgtcgatctcagg

SEQ ID NO: 194775 - DNA, 20 bp, human
gggacccggaatgaagacga

SEQ ID NO: 194776 - DNA, 20 bp, human
gtagccctgggcaatcccgg

SEQ ID NO: 194777 - DNA, 20 bp, human
ggcgcggtctggaggctcac

SEQ ID NO: 194778 - DNA, 20 bp, human
gggagagaggctgtagccct

SEQ ID NO: 194779 - DNA, 20 bp, human
gcccgggggtcgttacagga

SEQ ID NO: 194780 - DNA, 20 bp, human
gtaggaaaatgccaccctca

SEQ ID NO: 194781 - DNA, 20 bp, human
gctggaggctcacgggagag

SEQ ID NO: 194782 - DNA, 20 bp, human
gcgacccccgggattgccca

SEQ ID NO: 194783 - DNA, 20 bp, human
gctgtagccctgggcaatcc

SEQ ID NO: 194784 - DNA, 20 bp, human
gggtgttccggagagaaaag

SEQ ID NO: 194785 - DNA, 20 bp, human
gggggtcgttacaggaaggt

SEQ ID NO: 194786 - DNA, 20 bp, human
gcaatatgtcggacccacgg

SEQ ID NO: 194787 - DNA, 20 bp, human
ggtgaggaccccagcgtcgt

SEQ ID NO: 194788 - DNA, 20 bp, human
gtaacaatatgtcggaccca

SEQ ID NO: 194789 - DNA, 20 bp, human
ggtcatcgcagccccactcc

SEQ ID NO: 194790 - DNA, 20 bp, human
gcgaacaaagtgctgaggtg

SEQ ID NO: 194791 - DNA, 20 bp, human
gacctgagatcggccgggag

SEQ ID NO: 194792 - DNA, 20 bp, human
ggcgggacctgagatcggcc

SEQ ID NO: 194793 - DNA, 20 bp, human
gacctgagaacgaggcccgg

SEQ ID NO: 194794 - DNA, 20 bp, human
gcccactcccggccgatctc

SEQ ID NO: 194795 - DNA, 20 bp, human
gcagcggaagaggcgtgatc

SEQ ID NO: 194796 - DNA, 20 bp, human
gaaggagctgcgccccgcta

SEQ ID NO: 194797 - DNA, 20 bp, human
gtggtcggcgcagaccctca

SEQ ID NO: 194798 - DNA, 20 bp, human
ggcgcccaggactctaccca

SEQ ID NO: 194799 - DNA, 20 bp, human
gggcagggcggggaacaaga

SEQ ID NO: 194800 - DNA, 20 bp, human
ggccccgtgggcgcgagagg

SEQ ID NO: 194801 - DNA, 20 bp, human
gtctgcgccgaccaccgcgg

SEQ ID NO: 194802 - DNA, 20 bp, human
gccgccctgggtagagtcct

SEQ ID NO: 194803 - DNA, 20 bp, human
gagctgcgccccgctaggga

SEQ ID NO: 194804 - DNA, 20 bp, human
gccggggcgcccctccctag

SEQ ID NO: 194805 - DNA, 20 bp, human
gacaccccaccgggcgaaca

SEQ ID NO: 194806 - DNA, 20 bp, human
gcaggagctcctagagctag

SEQ ID NO: 194807 - DNA, 20 bp, human
gcaactaagaagctacctgg

SEQ ID NO: 194808 - DNA, 20 bp, human
ggcacttccgcagccccgag

SEQ ID NO: 194809 - DNA, 20 bp, human
gacagactggagctgcacga

SEQ ID NO: 194810 - DNA, 20 bp, human
gtcccgacaagggacgggta

SEQ ID NO: 194811 - DNA, 20 bp, human
gcgggagccacaagacccag

SEQ ID NO: 194812 - DNA, 20 bp, human
gcgagcctggcagagagtga

SEQ ID NO: 194813 - DNA, 20 bp, human
ggctgcacgaaggcgaccag

SEQ ID NO: 194814 - DNA, 20 bp, human
ggcggaagtgctctacagac

SEQ ID NO: 194815 - DNA, 20 bp, human
gaggattcccgacaagggac

SEQ ID NO: 194816 - DNA, 20 bp, human
gcaagcctggatgggaacgg

SEQ ID NO: 194817 - DNA, 20 bp, human
gcagcacgccctgctcaggt

SEQ ID NO: 194818 - DNA, 20 bp, human
gcgacaagcctggatgggaa

SEQ ID NO: 194819 - DNA, 20 bp, human
ggcttgtcggcggccaccgg

SEQ ID NO: 194820 - DNA, 20 bp, human
gtccccgacagcccatgaca

SEQ ID NO: 194821 - DNA, 20 bp, human
ggccgccgacaagcctggat

SEQ ID NO: 194822 - DNA, 20 bp, human
gcggcggccaccggcggacc

SEQ ID NO: 194823 - DNA, 20 bp, human
gccatctgtggtacatctgt

SEQ ID NO: 194824 - DNA, 20 bp, human
gtccctgtcatgggctgtcg

SEQ ID NO: 194825 - DNA, 20 bp, human
gtgggcctagggcctcgctg

SEQ ID NO: 194826 - DNA, 20 bp, human
ggaaaacgcaggctgcgcgg

SEQ ID NO: 194827 - DNA, 20 bp, human
ggagagggctgcccatcccg

SEQ ID NO: 194828 - DNA, 20 bp, human
ggtggtggggagagtatccg

SEQ ID NO: 194829 - DNA, 20 bp, human
gggccagcacaggtttgacc

SEQ ID NO: 194830 - DNA, 20 bp, human
gcctgtaccggagaaaacgc

SEQ ID NO: 194831 - DNA, 20 bp, human
gctgggcgggtccccgggat

SEQ ID NO: 194832 - DNA, 20 bp, human
gtagtagcctcaacctgtac

SEQ ID NO: 194833 - DNA, 20 bp, human
gtactctccccaccactaaa

SEQ ID NO: 194834 - DNA, 20 bp, human
ggctgcgcggcggcttagag

SEQ ID NO: 194835 - DNA, 20 bp, human
ggacctggtggctccgacgg

SEQ ID NO: 194836 - DNA, 20 bp, human
gcctaggcgggaagctcgag

SEQ ID NO: 194837 - DNA, 20 bp, human
gaggcgggaagctcgagcgg

SEQ ID NO: 194838 - DNA, 20 bp, human
gggcgcgcggaggcctaggc

SEQ ID NO: 194839 - DNA, 20 bp, human
ggaagcgctccgccaagcag

SEQ ID NO: 194840 - DNA, 20 bp, human
ggctgggcgcgcggaggcct

SEQ ID NO: 194841 - DNA, 20 bp, human
gacacttccgggtggacgag

SEQ ID NO: 194842 - DNA, 20 bp, human
ggagcgggcgccgggcgtca

SEQ ID NO: 194843 - DNA, 20 bp, human
ggccatgacggcggaagtaa

SEQ ID NO: 194844 - DNA, 20 bp, human
ggtcttcagacacttccggg

SEQ ID NO: 194845 - DNA, 20 bp, human
gggcaacggctgcctggcaa

SEQ ID NO: 194846 - DNA, 20 bp, human
ggacgctagcgctgcgatgg

SEQ ID NO: 194847 - DNA, 20 bp, human
ggcggaagagcaggtactcc

SEQ ID NO: 194848 - DNA, 20 bp, human
ggcgcactgacgagctggtc

SEQ ID NO: 194849 - DNA, 20 bp, human
gcgggttcacgcacacactg

SEQ ID NO: 194850 - DNA, 20 bp, human
gtattcgtgttggcttccag

SEQ ID NO: 194851 - DNA, 20 bp, human
gggagacagaaccctagacc

SEQ ID NO: 194852 - DNA, 20 bp, human
gagctcgtcagtgcgctcca

SEQ ID NO: 194853 - DNA, 20 bp, human
gagcgccgctctcgccccgg

SEQ ID NO: 194854 - DNA, 20 bp, human
ggcgatgctcctgactcggg

SEQ ID NO: 194855 - DNA, 20 bp, human
gcgagtcaggagcatcgccg

SEQ ID NO: 194856 - DNA, 20 bp, human
gaccccgcggatgagaagaa

SEQ ID NO: 194857 - DNA, 20 bp, human
ggaaaccagactccaaacat

SEQ ID NO: 194858 - DNA, 20 bp, human
ggtgcagccaatttcagcta

SEQ ID NO: 194859 - DNA, 20 bp, human
gcacccagagcccccaaaaa

SEQ ID NO: 194860 - DNA, 20 bp, human
gagaagctgaccgccgactg

SEQ ID NO: 194861 - DNA, 20 bp, human
ggcagtccggatcctcgacc

SEQ ID NO: 194862 - DNA, 20 bp, human
gggaaacattcctcagtcgg

SEQ ID NO: 194863 - DNA, 20 bp, human
gggatatgggcgatgatctg

SEQ ID NO: 194864 - DNA, 20 bp, human
ggggacaaattgccaatgtt

SEQ ID NO: 194865 - DNA, 20 bp, human
gggcttctcgaaggccgaca

SEQ ID NO: 194866 - DNA, 20 bp, human
gggggagccccggcatccaa

SEQ ID NO: 194867 - DNA, 20 bp, human
gccggaagttgtggttacca

SEQ ID NO: 194868 - DNA, 20 bp, human
gtgggactcgaggggagccc

SEQ ID NO: 194869 - DNA, 20 bp, human
ggggagtcctgggactcgag

SEQ ID NO: 194870 - DNA, 20 bp, human
gacaggtaaaggggagtcct

SEQ ID NO: 194871 - DNA, 20 bp, human
ggctcttgcttgggacggtg

SEQ ID NO: 194872 - DNA, 20 bp, human
gagtgtgaacctagcatggg

SEQ ID NO: 194873 - DNA, 20 bp, human
gcacagtgtgaacctagcat

SEQ ID NO: 194874 - DNA, 20 bp, human
gtagagctggtgtagctcaa

SEQ ID NO: 194875 - DNA, 20 bp, human
gcggttcaagccggaagttg

SEQ ID NO: 194876 - DNA, 20 bp, human
gcagcgcacgcagcacccca

SEQ ID NO: 194877 - DNA, 20 bp, human
gatacgggtgtacacagcag

SEQ ID NO: 194878 - DNA, 20 bp, human
ggggtcagggtcgcagaata

SEQ ID NO: 194879 - DNA, 20 bp, human
gggtaagagacggagggtca

SEQ ID NO: 194880 - DNA, 20 bp, human
ggggtcgcagaataaggagt

SEQ ID NO: 194881 - DNA, 20 bp, human
gaggtaaccgacccgccctg

SEQ ID NO: 194882 - DNA, 20 bp, human
gttgctgggtaagagacgga

SEQ ID NO: 194883 - DNA, 20 bp, human
gcctaaggaaccggagggag

SEQ ID NO: 194884 - DNA, 20 bp, human
gggacggggtcaaggaacaa

SEQ ID NO: 194885 - DNA, 20 bp, human
gggacaggggaggtcacacg

SEQ ID NO: 194886 - DNA, 20 bp, human
gcccggccgctcatagaggg

SEQ ID NO: 194887 - DNA, 20 bp, human
gcgtgacccgcaccgcccgt

SEQ ID NO: 194888 - DNA, 20 bp, human
gaggcccggccgctcataga

SEQ ID NO: 194889 - DNA, 20 bp, human
ggcgaccccaggcaagaggg

SEQ ID NO: 194890 - DNA, 20 bp, human
ggttagaaccgggaaatgga

SEQ ID NO: 194891 - DNA, 20 bp, human
gcccgtgggcaccttgaagg

SEQ ID NO: 194892 - DNA, 20 bp, human
gctgtggactgagcgacccc

SEQ ID NO: 194893 - DNA, 20 bp, human
gccgcccgtgggcaccttga

SEQ ID NO: 194894 - DNA, 20 bp, human
gcccgccagcctcacctgcg

SEQ ID NO: 194895 - DNA, 20 bp, human
gctctgctctgggtctccgc

SEQ ID NO: 194896 - DNA, 20 bp, human
ggggtgtgaggcggtgcgca

SEQ ID NO: 194897 - DNA, 20 bp, human
gaggagataaacagaggagg

SEQ ID NO: 194898 - DNA, 20 bp, human
ggccccgggtgtcccgagag

SEQ ID NO: 194899 - DNA, 20 bp, human
gacacccggggccccgaggc

SEQ ID NO: 194900 - DNA, 20 bp, human
gaggctgtgggagtccgggg

SEQ ID NO: 194901 - DNA, 20 bp, human
ggcccctctcgggacacccg

SEQ ID NO: 194902 - DNA, 20 bp, human
gccgcctcggcgcccgcgga

SEQ ID NO: 194903 - DNA, 20 bp, human
ggggaggctgtgggagtccg

SEQ ID NO: 194904 - DNA, 20 bp, human
gggagccggcccagagcggg

SEQ ID NO: 194905 - DNA, 20 bp, human
gtcaggcccccaggccggca

SEQ ID NO: 194906 - DNA, 20 bp, human
ggaccgactggaccagacgt

SEQ ID NO: 194907 - DNA, 20 bp, human
gctggaccagacgtaggaaa

SEQ ID NO: 194908 - DNA, 20 bp, human
gaccagacgtaggaaagggc

SEQ ID NO: 194909 - DNA, 20 bp, human
gtctgcttcggggccaggaa

SEQ ID NO: 194910 - DNA, 20 bp, human
gagccggccatggaaggtaa

SEQ ID NO: 194911 - DNA, 20 bp, human
gccagctagccggccatgga

SEQ ID NO: 194912 - DNA, 20 bp, human
ggggccggaggaagaccgac

SEQ ID NO: 194913 - DNA, 20 bp, human
gtggccggctagctgggcca

SEQ ID NO: 194914 - DNA, 20 bp, human
gcgggagcgcccccgaggag

SEQ ID NO: 194915 - DNA, 20 bp, human
gggaaagggcgggcttgtag

SEQ ID NO: 194916 - DNA, 20 bp, human
gcggggcggcccgagcaccg

SEQ ID NO: 194917 - DNA, 20 bp, human
gctcgggctgcggacggtgg

SEQ ID NO: 194918 - DNA, 20 bp, human
gggcgagtcgggctcttgaa

SEQ ID NO: 194919 - DNA, 20 bp, human
gggcagcggccacagcaccg

SEQ ID NO: 194920 - DNA, 20 bp, human
gcacagcaccggggaggact

SEQ ID NO: 194921 - DNA, 20 bp, human
gcggagcccgaacctgagac

SEQ ID NO: 194922 - DNA, 20 bp, human
gggactttccggcagaggcg

SEQ ID NO: 194923 - DNA, 20 bp, human
gctttccggcagaggcgggg

SEQ ID NO: 194924 - DNA, 20 bp, human
gagcggccacagcaccgggg

SEQ ID NO: 194925 - DNA, 20 bp, human
ggacctcagcctcggtgctc

SEQ ID NO: 194926 - DNA, 20 bp, human
gtattcccaaattggctaat

SEQ ID NO: 194927 - DNA, 20 bp, human
gtatagattggtggtactta

SEQ ID NO: 194928 - DNA, 20 bp, human
gtaaagccatgctaaattaa

SEQ ID NO: 194929 - DNA, 20 bp, human
gctgaggtcttatagattgg

SEQ ID NO: 194930 - DNA, 20 bp, human
gtgaacctacagaagcaggg

SEQ ID NO: 194931 - DNA, 20 bp, human
gctgtgaacctacagaagca

SEQ ID NO: 194932 - DNA, 20 bp, human
gaagctgaggtcttatagat

SEQ ID NO: 194933 - DNA, 20 bp, human
gctagtatttggtaacacat

SEQ ID NO: 194934 - DNA, 20 bp, human
gaactaacagctacaaaaca

SEQ ID NO: 194935 - DNA, 20 bp, human
ggaattcctttaatttagca

SEQ ID NO: 194936 - DNA, 20 bp, human
gcaggcccacgcagcgaggg

SEQ ID NO: 194937 - DNA, 20 bp, human
gcgctgcgtgggcctgtgag

SEQ ID NO: 194938 - DNA, 20 bp, human
gttgtaacaaggcaaaagta

SEQ ID NO: 194939 - DNA, 20 bp, human
gcgctcctgtccccactcac

SEQ ID NO: 194940 - DNA, 20 bp, human
gtgtgtctgagttgtgtggt

SEQ ID NO: 194941 - DNA, 20 bp, human
gaactcagacacacacggat

SEQ ID NO: 194942 - DNA, 20 bp, human
gtagggatcgcctctcctca

SEQ ID NO: 194943 - DNA, 20 bp, human
gccatcccaggcacttacac

SEQ ID NO: 194944 - DNA, 20 bp, human
gggcaggccagccaccatcg

SEQ ID NO: 194945 - DNA, 20 bp, human
ggtggaggagaagtagcaag

SEQ ID NO: 194946 - DNA, 20 bp, human
gtgacaacctggccagacat

SEQ ID NO: 194947 - DNA, 20 bp, human
gaccagggctgagaatccag

SEQ ID NO: 194948 - DNA, 20 bp, human
gagctgtctacggagagtga

SEQ ID NO: 194949 - DNA, 20 bp, human
gagatcgtgagccctatgtc

SEQ ID NO: 194950 - DNA, 20 bp, human
gcatagtgaaaggcgcacca

SEQ ID NO: 194951 - DNA, 20 bp, human
gttccctgcagagctgtcta

SEQ ID NO: 194952 - DNA, 20 bp, human
gctccgtagacagctctgca

SEQ ID NO: 194953 - DNA, 20 bp, human
gcacgatctgatcagagtca

SEQ ID NO: 194954 - DNA, 20 bp, human
gctgagtaggacctaggagt

SEQ ID NO: 194955 - DNA, 20 bp, human
gtcctactcagactggacac

SEQ ID NO: 194956 - DNA, 20 bp, human
gggagggcaagcaaaagtgt

SEQ ID NO: 194957 - DNA, 20 bp, human
gcagagcccaagaacactgg

SEQ ID NO: 194958 - DNA, 20 bp, human
gctccagagcccaagaacac

SEQ ID NO: 194959 - DNA, 20 bp, human
gatggtgtcttgtgaaagga

SEQ ID NO: 194960 - DNA, 20 bp, human
gcaagaacactggtggccaa

SEQ ID NO: 194961 - DNA, 20 bp, human
ggtgctgttcctccttctgt

SEQ ID NO: 194962 - DNA, 20 bp, human
gcagactatcccacagaagg

SEQ ID NO: 194963 - DNA, 20 bp, human
gctctggagatccagcccaa

SEQ ID NO: 194964 - DNA, 20 bp, human
ggaacagactatcccacaga

SEQ ID NO: 194965 - DNA, 20 bp, human
gttcacaagacaccatcctt

SEQ ID NO: 194966 - DNA, 20 bp, human
gactgaacaaaatggagata

SEQ ID NO: 194967 - DNA, 20 bp, human
ggaggttatcaattttgtgt

SEQ ID NO: 194968 - DNA, 20 bp, human
gggtctgttcaatttcatcc

SEQ ID NO: 194969 - DNA, 20 bp, human
ggtccagggccttttctggt

SEQ ID NO: 194970 - DNA, 20 bp, human
gttcatcctggtttaatctt

SEQ ID NO: 194971 - DNA, 20 bp, human
ggagtttgtatgattccaag

SEQ ID NO: 194972 - DNA, 20 bp, human
gacacaatcaaaaataacaa

SEQ ID NO: 194973 - DNA, 20 bp, human
gaaactcccaagattaaacc

SEQ ID NO: 194974 - DNA, 20 bp, human
gtgtatttttatggggtcag

SEQ ID NO: 194975 - DNA, 20 bp, human
gtctggtccagggccttttc

SEQ ID NO: 194976 - DNA, 20 bp, human
ggtcagatagaggcagggaa

SEQ ID NO: 194977 - DNA, 20 bp, human
gactttcatgggtcagatag

SEQ ID NO: 194978 - DNA, 20 bp, human
gctcgttcttgtgaccctgg

SEQ ID NO: 194979 - DNA, 20 bp, human
gaagaacgagagacaccatg

SEQ ID NO: 194980 - DNA, 20 bp, human
gcatgggtcagatagaggca

SEQ ID NO: 194981 - DNA, 20 bp, human
gccctccccacaccagctaa

SEQ ID NO: 194982 - DNA, 20 bp, human
gctgacccatgaaagttcgg

SEQ ID NO: 194983 - DNA, 20 bp, human
gagagggtgagcagacatgg

SEQ ID NO: 194984 - DNA, 20 bp, human
gtgctggaccccatgttgcc

SEQ ID NO: 194985 - DNA, 20 bp, human
gctgtggaaggagttaaaga

SEQ ID NO: 194986 - DNA, 20 bp, human
gacaccaccaggaactggag

SEQ ID NO: 194987 - DNA, 20 bp, human
gagggttgctgggtttgacc

SEQ ID NO: 194988 - DNA, 20 bp, human
gtggataggagaggatctga

SEQ ID NO: 194989 - DNA, 20 bp, human
gacaggcttcatggtgtcag

SEQ ID NO: 194990 - DNA, 20 bp, human
gaggagggaagtaacatgtg

SEQ ID NO: 194991 - DNA, 20 bp, human
gtaacatgtgtggataggag

SEQ ID NO: 194992 - DNA, 20 bp, human
ggggatgggtgagtaagttc

SEQ ID NO: 194993 - DNA, 20 bp, human
gaagactaagctggatgatg

SEQ ID NO: 194994 - DNA, 20 bp, human
ggctcactcttactaaacca

SEQ ID NO: 194995 - DNA, 20 bp, human
ggcagaacaccaccaggaac

SEQ ID NO: 194996 - DNA, 20 bp, human
gcatggtgctatgcccgggc

SEQ ID NO: 194997 - DNA, 20 bp, human
gctgagggccccgacgccaa

SEQ ID NO: 194998 - DNA, 20 bp, human
gagctgtgcggcgtccccta

SEQ ID NO: 194999 - DNA, 20 bp, human
gggagctctcgtactcccag

SEQ ID NO: 195000 - DNA, 20 bp, human
ggcgggcctaggcgacaagc

SEQ ID NO: 195001 - DNA, 20 bp, human
gtcacacctgcaccccgccc

SEQ ID NO: 195002 - DNA, 20 bp, human
gacgagagctccctaaccct

SEQ ID NO: 195003 - DNA, 20 bp, human
ggccccgacgccaagggtta

SEQ ID NO: 195004 - DNA, 20 bp, human
gccccactcacctgagacta

SEQ ID NO: 195005 - DNA, 20 bp, human
ggggtcagggactcctggtc

SEQ ID NO: 195006 - DNA, 20 bp, human
ggaggcgcagccctcccgag

SEQ ID NO: 195007 - DNA, 20 bp, human
gcacttagaggccttgtagg

SEQ ID NO: 195008 - DNA, 20 bp, human
gccaggacagttacacttag

SEQ ID NO: 195009 - DNA, 20 bp, human
gccaacgacctccacctaca

SEQ ID NO: 195010 - DNA, 20 bp, human
gggagctgcggggttaccat

SEQ ID NO: 195011 - DNA, 20 bp, human
gttagaggccttgtaggtgg

SEQ ID NO: 195012 - DNA, 20 bp, human
gttggggcttcctctcggga

SEQ ID NO: 195013 - DNA, 20 bp, human
ggtcgttggggcttcctctc

SEQ ID NO: 195014 - DNA, 20 bp, human
gaactgtcctgggcgaggcg

SEQ ID NO: 195015 - DNA, 20 bp, human
ggactgcggggtaggaggaa

SEQ ID NO: 195016 - DNA, 20 bp, human
gcaccccctgacatatagac

SEQ ID NO: 195017 - DNA, 20 bp, human
gagagaaacttagtcaggag

SEQ ID NO: 195018 - DNA, 20 bp, human
gctgcaggtgttaatctggg

SEQ ID NO: 195019 - DNA, 20 bp, human
gaggctgcaggtgttaatct

SEQ ID NO: 195020 - DNA, 20 bp, human
ggattgtctctacttctcta

SEQ ID NO: 195021 - DNA, 20 bp, human
gcagacaagcaccgagaaac

SEQ ID NO: 195022 - DNA, 20 bp, human
ggagtcctcgggccctcagg

SEQ ID NO: 195023 - DNA, 20 bp, human
ggtgcctgtctatatgtcag

SEQ ID NO: 195024 - DNA, 20 bp, human
gggccaagatgaagcaggca

SEQ ID NO: 195025 - DNA, 20 bp, human
gtctagggagagtaagggtt

SEQ ID NO: 195026 - DNA, 20 bp, human
gaaggtgctgggccacaccg

SEQ ID NO: 195027 - DNA, 20 bp, human
ggaagtactggcctggttga

SEQ ID NO: 195028 - DNA, 20 bp, human
gggatgaatggtaccaggat

SEQ ID NO: 195029 - DNA, 20 bp, human
ggcagatgtaggagctgctg

SEQ ID NO: 195030 - DNA, 20 bp, human
gtcttgtgggagacttcctt

SEQ ID NO: 195031 - DNA, 20 bp, human
gggatgcctgtattcaccaa

SEQ ID NO: 195032 - DNA, 20 bp, human
gagactcccttggtgaatac

SEQ ID NO: 195033 - DNA, 20 bp, human
gtgacacaggtggtgttgtg

SEQ ID NO: 195034 - DNA, 20 bp, human
gacctccaggaagaactctt

SEQ ID NO: 195035 - DNA, 20 bp, human
gggggaaaggaaactcagtg

SEQ ID NO: 195036 - DNA, 20 bp, human
ggactgtccgaactgaagga

SEQ ID NO: 195037 - DNA, 20 bp, human
ggtgaggagggtgtctatgg

SEQ ID NO: 195038 - DNA, 20 bp, human
gtgaggaagctgtctccata

SEQ ID NO: 195039 - DNA, 20 bp, human
gagcccaagtagggtaagtt

SEQ ID NO: 195040 - DNA, 20 bp, human
gatagggaagaggcctgatg

SEQ ID NO: 195041 - DNA, 20 bp, human
gttagagctggagcaaagtg

SEQ ID NO: 195042 - DNA, 20 bp, human
gagggtgaggagggtgtcta

SEQ ID NO: 195043 - DNA, 20 bp, human
gggctctgcccctccacact

SEQ ID NO: 195044 - DNA, 20 bp, human
gtgtggactgtccgaactga

SEQ ID NO: 195045 - DNA, 20 bp, human
gtggctgttggagcccaagt

SEQ ID NO: 195046 - DNA, 20 bp, human
gccaggacgcaagacaagtg

SEQ ID NO: 195047 - DNA, 20 bp, human
gacaagtggggcatctgtag

SEQ ID NO: 195048 - DNA, 20 bp, human
gtctcaatgatcatctgtag

SEQ ID NO: 195049 - DNA, 20 bp, human
gtagtggcagcaaaagaggt

SEQ ID NO: 195050 - DNA, 20 bp, human
gtctgacaaggagaatagaa

SEQ ID NO: 195051 - DNA, 20 bp, human
ggcatgagcatcctgtgagt

SEQ ID NO: 195052 - DNA, 20 bp, human
ggttcagacagtagagaggg

SEQ ID NO: 195053 - DNA, 20 bp, human
gagtatcatgactgagacct

SEQ ID NO: 195054 - DNA, 20 bp, human
ggatagctgtgtttctgaca

SEQ ID NO: 195055 - DNA, 20 bp, human
ggcaaaagaggtaggatccc

SEQ ID NO: 195056 - DNA, 20 bp, human
gccgcacggttcagacagag

SEQ ID NO: 195057 - DNA, 20 bp, human
ggctctgggcgtccacccac

SEQ ID NO: 195058 - DNA, 20 bp, human
gccctgctgggtgggtaacg

SEQ ID NO: 195059 - DNA, 20 bp, human
gagcggcaggagtggacgta

SEQ ID NO: 195060 - DNA, 20 bp, human
gcgcgagtgtagcagggacc

SEQ ID NO: 195061 - DNA, 20 bp, human
gggcgtccacccacaggttg

SEQ ID NO: 195062 - DNA, 20 bp, human
gctcctccggctgacctcgg

SEQ ID NO: 195063 - DNA, 20 bp, human
gcctgacacccctgctgggt

SEQ ID NO: 195064 - DNA, 20 bp, human
gggacgtagggcgggcatga

SEQ ID NO: 195065 - DNA, 20 bp, human
gcaccgaccacaggcccgga

SEQ ID NO: 195066 - DNA, 20 bp, human
gctgggcgcgccacccgagt

SEQ ID NO: 195067 - DNA, 20 bp, human
gtagctggctcccactcggg

SEQ ID NO: 195068 - DNA, 20 bp, human
ggcagcgccaggcttcgcgg

SEQ ID NO: 195069 - DNA, 20 bp, human
gcggcgtgggaatagcggat

SEQ ID NO: 195070 - DNA, 20 bp, human
gcgtgggaatagcggatggg

SEQ ID NO: 195071 - DNA, 20 bp, human
gggttagctggctcccactc

SEQ ID NO: 195072 - DNA, 20 bp, human
ggatgccggcgtgggaatag

SEQ ID NO: 195073 - DNA, 20 bp, human
gaccagggccttcttctcag

SEQ ID NO: 195074 - DNA, 20 bp, human
gctaacctgatgcctgtcac

SEQ ID NO: 195075 - DNA, 20 bp, human
ggtgatcagccacgggacag

SEQ ID NO: 195076 - DNA, 20 bp, human
gggcgcaaacgggagatctg

SEQ ID NO: 195077 - DNA, 20 bp, human
gcgcggccttctgcacgagg

SEQ ID NO: 195078 - DNA, 20 bp, human
gagtgcagattgctcccccg

SEQ ID NO: 195079 - DNA, 20 bp, human
ggcgggacagcaggcccgag

SEQ ID NO: 195080 - DNA, 20 bp, human
gcccgaacgggtcacccggg

SEQ ID NO: 195081 - DNA, 20 bp, human
ggcaggcccgagaggcggag

SEQ ID NO: 195082 - DNA, 20 bp, human
gccgcgtgcggcccactcac

SEQ ID NO: 195083 - DNA, 20 bp, human
gtccaggcgacagcgcgcgg

SEQ ID NO: 195084 - DNA, 20 bp, human
gtgcagaaggccgcgctagc

SEQ ID NO: 195085 - DNA, 20 bp, human
gccccttccgagctgatggg

SEQ ID NO: 195086 - DNA, 20 bp, human
gcgtgacaggcggtgcgagg

SEQ ID NO: 195087 - DNA, 20 bp, human
ggcgggaagcagcgctccag

SEQ ID NO: 195088 - DNA, 20 bp, human
ggctcggactgtcccgtgac

SEQ ID NO: 195089 - DNA, 20 bp, human
gccatggctgtcggcagcag

SEQ ID NO: 195090 - DNA, 20 bp, human
gggcgcgcaccggcagttgg

SEQ ID NO: 195091 - DNA, 20 bp, human
gtcgggctcgggccccaacc

SEQ ID NO: 195092 - DNA, 20 bp, human
gattctagcgaaaaatgatt

SEQ ID NO: 195093 - DNA, 20 bp, human
gccacagcgccgccaactgc

SEQ ID NO: 195094 - DNA, 20 bp, human
gtgcgcgagggggcccggtt

SEQ ID NO: 195095 - DNA, 20 bp, human
gccgccgctgctgcgcggta

SEQ ID NO: 195096 - DNA, 20 bp, human
gcggaggccgggacgagtcc

SEQ ID NO: 195097 - DNA, 20 bp, human
gggcgggcggctctccggag

SEQ ID NO: 195098 - DNA, 20 bp, human
ggcgcgcgagagcctcggcc

SEQ ID NO: 195099 - DNA, 20 bp, human
gctgtgggaggcctgagggg

SEQ ID NO: 195100 - DNA, 20 bp, human
gaccgcggaggcctgagggc

SEQ ID NO: 195101 - DNA, 20 bp, human
gcccctgcccggactcgtcc

SEQ ID NO: 195102 - DNA, 20 bp, human
gcgggcggcggcggctaacg

SEQ ID NO: 195103 - DNA, 20 bp, human
gccggggccgtgcggcggta

SEQ ID NO: 195104 - DNA, 20 bp, human
ggtggggaccgcgaggaccg

SEQ ID NO: 195105 - DNA, 20 bp, human
gggcggcctgagagggtcgt

SEQ ID NO: 195106 - DNA, 20 bp, human
gggccgagggggctgtgcac

SEQ ID NO: 195107 - DNA, 20 bp, human
gtaggccgcatgaaatcccc

SEQ ID NO: 195108 - DNA, 20 bp, human
ggcgtgtgtagtgctaggaa

SEQ ID NO: 195109 - DNA, 20 bp, human
gggctgaggagggaacgacg

SEQ ID NO: 195110 - DNA, 20 bp, human
ggcctgggtagcacggtcct

SEQ ID NO: 195111 - DNA, 20 bp, human
ggtgccggccgccatggcag

SEQ ID NO: 195112 - DNA, 20 bp, human
gtcctcagtgccggccgcca

SEQ ID NO: 195113 - DNA, 20 bp, human
gagaggaaggctcgggaggt

SEQ ID NO: 195114 - DNA, 20 bp, human
ggcgccggacgcctctgcca

SEQ ID NO: 195115 - DNA, 20 bp, human
gtcctgtgatcgcactgaca

SEQ ID NO: 195116 - DNA, 20 bp, human
gtctgggcgagaagcaacta

SEQ ID NO: 195117 - DNA, 20 bp, human
gactcagggttaggaggtct

SEQ ID NO: 195118 - DNA, 20 bp, human
gctgcacccagatctcagag

SEQ ID NO: 195119 - DNA, 20 bp, human
gggcggcgccggggattcgg

SEQ ID NO: 195120 - DNA, 20 bp, human
gggcgcaggagacaccccgt

SEQ ID NO: 195121 - DNA, 20 bp, human
gccacctgcacccaaaaagg

SEQ ID NO: 195122 - DNA, 20 bp, human
gcggtctcgtcagtaacata

SEQ ID NO: 195123 - DNA, 20 bp, human
gttcggcggcgaagtgatga

SEQ ID NO: 195124 - DNA, 20 bp, human
gccagcccgaggaggcactc

SEQ ID NO: 195125 - DNA, 20 bp, human
gggagccaagagaagttccg

SEQ ID NO: 195126 - DNA, 20 bp, human
ggcgccaggttgcgtaggtg

SEQ ID NO: 195127 - DNA, 20 bp, human
ggtctaaacgggaacagccc

SEQ ID NO: 195128 - DNA, 20 bp, human
gtgacggcgccaggttgcgt

SEQ ID NO: 195129 - DNA, 20 bp, human
gctggtgagcatcgatccat

SEQ ID NO: 195130 - DNA, 20 bp, human
gaccaggcaagagtactcat

SEQ ID NO: 195131 - DNA, 20 bp, human
ggtgccgcacctacgcaacc

SEQ ID NO: 195132 - DNA, 20 bp, human
gggaggagagcctgtaccta

SEQ ID NO: 195133 - DNA, 20 bp, human
gagcatcgatccataggtac

SEQ ID NO: 195134 - DNA, 20 bp, human
gacgcgcccagccgtctaaa

SEQ ID NO: 195135 - DNA, 20 bp, human
gctccagagccagagcgcgg

SEQ ID NO: 195136 - DNA, 20 bp, human
gcgagacctacggagatagt

SEQ ID NO: 195137 - DNA, 20 bp, human
gcgggacccactatctccgt

SEQ ID NO: 195138 - DNA, 20 bp, human
gtcctccccgggccatcagc

SEQ ID NO: 195139 - DNA, 20 bp, human
gagcccctgctcgagaccta

SEQ ID NO: 195140 - DNA, 20 bp, human
gcaccccagctaggacagag

SEQ ID NO: 195141 - DNA, 20 bp, human
ggtgggtcccgagccccacg

SEQ ID NO: 195142 - DNA, 20 bp, human
gacttctcccggggtccgca

SEQ ID NO: 195143 - DNA, 20 bp, human
gccgcgtcaccggtgccagg

SEQ ID NO: 195144 - DNA, 20 bp, human
gccggatggtcgcagcctcc

SEQ ID NO: 195145 - DNA, 20 bp, human
gggtcccgagccccacgggg

SEQ ID NO: 195146 - DNA, 20 bp, human
ggcgtccgcgaacaaaatgg

SEQ ID NO: 195147 - DNA, 20 bp, human
gtccgggttggcaaaagggg

SEQ ID NO: 195148 - DNA, 20 bp, human
gctgtatcggaagaacctgg

SEQ ID NO: 195149 - DNA, 20 bp, human
gggactgtatcggaagaacc

SEQ ID NO: 195150 - DNA, 20 bp, human
ggagagggcgtggggaatct

SEQ ID NO: 195151 - DNA, 20 bp, human
gagcagatccatttccgggt

SEQ ID NO: 195152 - DNA, 20 bp, human
ggacgaagccggagtgtagg

SEQ ID NO: 195153 - DNA, 20 bp, human
ggggggccgggggactgtat

SEQ ID NO: 195154 - DNA, 20 bp, human
gggcaataagggctcctgaa

SEQ ID NO: 195155 - DNA, 20 bp, human
gatttccgggttggcaaaag

SEQ ID NO: 195156 - DNA, 20 bp, human
ggagcgcagctcggcggtag

SEQ ID NO: 195157 - DNA, 20 bp, human
ggcagcgcccgtgctccaag

SEQ ID NO: 195158 - DNA, 20 bp, human
gtggggagcgaggtcaccac

SEQ ID NO: 195159 - DNA, 20 bp, human
ggccgggcggaaacaaaccg

SEQ ID NO: 195160 - DNA, 20 bp, human
gccggcagcaccagagccgg

SEQ ID NO: 195161 - DNA, 20 bp, human
gcgcaccgagcgcagctcgg

SEQ ID NO: 195162 - DNA, 20 bp, human
gcccgggacagagatcctga

SEQ ID NO: 195163 - DNA, 20 bp, human
gctcaccggggagtccagtc

SEQ ID NO: 195164 - DNA, 20 bp, human
ggctccgggaccgaccaggg

SEQ ID NO: 195165 - DNA, 20 bp, human
ggcccgttccttccaccctc

SEQ ID NO: 195166 - DNA, 20 bp, human
gcggcctcggcctccatcgg

SEQ ID NO: 195167 - DNA, 20 bp, human
gagggagttcgcaaagggag

SEQ ID NO: 195168 - DNA, 20 bp, human
ggttcgcaaagggagtggtg

SEQ ID NO: 195169 - DNA, 20 bp, human
gccgcccgcgccggctccac

SEQ ID NO: 195170 - DNA, 20 bp, human
gcgggggccacggaatatgg

SEQ ID NO: 195171 - DNA, 20 bp, human
ggaaagcagggagttcgcaa

SEQ ID NO: 195172 - DNA, 20 bp, human
ggagcgacaaggttgggcca

SEQ ID NO: 195173 - DNA, 20 bp, human
gcctcccagagcgacaaggt

SEQ ID NO: 195174 - DNA, 20 bp, human
gtcccgggccgagcccccga

SEQ ID NO: 195175 - DNA, 20 bp, human
gctctcaggacgacacccct

SEQ ID NO: 195176 - DNA, 20 bp, human
ggctccaggccagcacccga

SEQ ID NO: 195177 - DNA, 20 bp, human
gtctggagcataaacaagag

SEQ ID NO: 195178 - DNA, 20 bp, human
gcgagtggcggcgaccgagg

SEQ ID NO: 195179 - DNA, 20 bp, human
ggaggcggcggttgatccca

SEQ ID NO: 195180 - DNA, 20 bp, human
gcagcacccgagggtctccc

SEQ ID NO: 195181 - DNA, 20 bp, human
ggtcaggctgcactcagggt

SEQ ID NO: 195182 - DNA, 20 bp, human
gcacccgagggtctccctgg

SEQ ID NO: 195183 - DNA, 20 bp, human
gtggcgagtggcggcgaccg

SEQ ID NO: 195184 - DNA, 20 bp, human
gcataaacaagagcggggac

SEQ ID NO: 195185 - DNA, 20 bp, human
gtggagctgcggtcccggag

SEQ ID NO: 195186 - DNA, 20 bp, human
gcctcatgcctggacgtcag

SEQ ID NO: 195187 - DNA, 20 bp, human
gggatccgaccacctctcgg

SEQ ID NO: 195188 - DNA, 20 bp, human
gagaggtggtcggatcctct

SEQ ID NO: 195189 - DNA, 20 bp, human
gtgggcccagctcccccgag

SEQ ID NO: 195190 - DNA, 20 bp, human
ggctgcggaagaggcatatc

SEQ ID NO: 195191 - DNA, 20 bp, human
gctgatgggccggccagtct

SEQ ID NO: 195192 - DNA, 20 bp, human
gcatatctggtgctcctgat

SEQ ID NO: 195193 - DNA, 20 bp, human
gagctcccccgagaggtggt

SEQ ID NO: 195194 - DNA, 20 bp, human
gcggggccctcagcagaact

SEQ ID NO: 195195 - DNA, 20 bp, human
gctggtgggcaggatgaaaa

SEQ ID NO: 195196 - DNA, 20 bp, human
gtacctttgagaggaggcag

SEQ ID NO: 195197 - DNA, 20 bp, human
ggaggcagctctgagttcca

SEQ ID NO: 195198 - DNA, 20 bp, human
ggggcctccttacctttgag

SEQ ID NO: 195199 - DNA, 20 bp, human
gcctccttacctttgagagg

SEQ ID NO: 195200 - DNA, 20 bp, human
gctcctctgcctcctctcaa

SEQ ID NO: 195201 - DNA, 20 bp, human
gcacggagcttaggagacct

SEQ ID NO: 195202 - DNA, 20 bp, human
gtagtcagcagtgcattcca

SEQ ID NO: 195203 - DNA, 20 bp, human
ggccagactgtgcccaatgt

SEQ ID NO: 195204 - DNA, 20 bp, human
ggtatcctcattatgaatgg

SEQ ID NO: 195205 - DNA, 20 bp, human
gagccagctttgagcctggg

SEQ ID NO: 195206 - DNA, 20 bp, human
gcggtcccagcgacatgcag

SEQ ID NO: 195207 - DNA, 20 bp, human
gccggaagggaaagagtcgg

SEQ ID NO: 195208 - DNA, 20 bp, human
ggaccgtggagccaccctga

SEQ ID NO: 195209 - DNA, 20 bp, human
gtgtgacacgctcactgcga

SEQ ID NO: 195210 - DNA, 20 bp, human
gagtcccatgaaagtaaaca

SEQ ID NO: 195211 - DNA, 20 bp, human
ggcgacttctctacccctca

SEQ ID NO: 195212 - DNA, 20 bp, human
gtcggtgccattacctgaaa

SEQ ID NO: 195213 - DNA, 20 bp, human
gcgtgtcacaggtcaggaat

SEQ ID NO: 195214 - DNA, 20 bp, human
gatggccatagcctccggaa

SEQ ID NO: 195215 - DNA, 20 bp, human
gcctccggaagggaaagagt

SEQ ID NO: 195216 - DNA, 20 bp, human
ggcgtgcgccggagccaaga

SEQ ID NO: 195217 - DNA, 20 bp, human
gtttgtcactcggcactggg

SEQ ID NO: 195218 - DNA, 20 bp, human
gctgggcccacacaactaaa

SEQ ID NO: 195219 - DNA, 20 bp, human
ggtcactcggcactgggcgg

SEQ ID NO: 195220 - DNA, 20 bp, human
gactggacggaaggcgtcgg

SEQ ID NO: 195221 - DNA, 20 bp, human
ggagcggcgacagaaggccc

SEQ ID NO: 195222 - DNA, 20 bp, human
ggggcaaaggtctcgaggag

SEQ ID NO: 195223 - DNA, 20 bp, human
gcaaaggtctcgaggagcgg

SEQ ID NO: 195224 - DNA, 20 bp, human
ggctcccggggctccaaagg

SEQ ID NO: 195225 - DNA, 20 bp, human
gccctgcgagcggcgacaga

SEQ ID NO: 195226 - DNA, 20 bp, human
gtcacagctccgggcattgg

SEQ ID NO: 195227 - DNA, 20 bp, human
ggcgcccgcacggattcccc

SEQ ID NO: 195228 - DNA, 20 bp, human
gcggccacaatcacagctcc

SEQ ID NO: 195229 - DNA, 20 bp, human
gaggatgggaccgggacgga

SEQ ID NO: 195230 - DNA, 20 bp, human
ggcgtccacaggcggcggag

SEQ ID NO: 195231 - DNA, 20 bp, human
gagcgcggcgaggatgggac

SEQ ID NO: 195232 - DNA, 20 bp, human
gtgtgccccacggagcccca

SEQ ID NO: 195233 - DNA, 20 bp, human
gtgcgccgggggaatccgtg

SEQ ID NO: 195234 - DNA, 20 bp, human
ggctggagcgcggcgaggat

SEQ ID NO: 195235 - DNA, 20 bp, human
gctgtaacaagtagcccaag

SEQ ID NO: 195236 - DNA, 20 bp, human
gaccaggtccgacgcccggg

SEQ ID NO: 195237 - DNA, 20 bp, human
ggcggcggcaccgcgagcac

SEQ ID NO: 195238 - DNA, 20 bp, human
gatccgagcgggctgtgtgg

SEQ ID NO: 195239 - DNA, 20 bp, human
gttagcgcggagagtttccc

SEQ ID NO: 195240 - DNA, 20 bp, human
gcttctgtcaccgaagatgg

SEQ ID NO: 195241 - DNA, 20 bp, human
gaggccggtccccatcgctg

SEQ ID NO: 195242 - DNA, 20 bp, human
ggaggcgccgcagtcatgag

SEQ ID NO: 195243 - DNA, 20 bp, human
gagagtttcccgggtggacg

SEQ ID NO: 195244 - DNA, 20 bp, human
gcaccgagtcgaggcggatg

SEQ ID NO: 195245 - DNA, 20 bp, human
ggcgcggagagtttcccggg

SEQ ID NO: 195246 - DNA, 20 bp, human
gacgccggccccgagcccgt

SEQ ID NO: 195247 - DNA, 20 bp, human
gttctgctaggctgtcccgg

SEQ ID NO: 195248 - DNA, 20 bp, human
gctggacacggagacctggg

SEQ ID NO: 195249 - DNA, 20 bp, human
gtgggagagaggacctgcta

SEQ ID NO: 195250 - DNA, 20 bp, human
gcactcgcggacagaccctg

SEQ ID NO: 195251 - DNA, 20 bp, human
gtcccggaggcagctgtaaa

SEQ ID NO: 195252 - DNA, 20 bp, human
gggcagctgtaaaggggata

SEQ ID NO: 195253 - DNA, 20 bp, human
ggatagggaagcccgggggt

SEQ ID NO: 195254 - DNA, 20 bp, human
ggcaggcgcggtttcgacag

SEQ ID NO: 195255 - DNA, 20 bp, human
gagcctagcagaaccctcct

SEQ ID NO: 195256 - DNA, 20 bp, human
gctcgtcgtggggcgagagg

SEQ ID NO: 195257 - DNA, 20 bp, human
gtcggaggaggcgatcgagg

SEQ ID NO: 195258 - DNA, 20 bp, human
ggccggggcgctaggagaga

SEQ ID NO: 195259 - DNA, 20 bp, human
gatcgggctgagagatgaat

SEQ ID NO: 195260 - DNA, 20 bp, human
gccagccagggaattcggac

SEQ ID NO: 195261 - DNA, 20 bp, human
ggaggagtaagaagcatcgg

SEQ ID NO: 195262 - DNA, 20 bp, human
gacggccggtaggtaaagag

SEQ ID NO: 195263 - DNA, 20 bp, human
ggagtaagcgccctagcggg

SEQ ID NO: 195264 - DNA, 20 bp, human
gtaaagagcgggcggagaga

SEQ ID NO: 195265 - DNA, 20 bp, human
gagcggagctcgagacatcg

SEQ ID NO: 195266 - DNA, 20 bp, human
gccagcggagtccggaggat

SEQ ID NO: 195267 - DNA, 20 bp, human
gaccgagggagcccctgtga

SEQ ID NO: 195268 - DNA, 20 bp, human
gggaagagcagggcgccgaa

SEQ ID NO: 195269 - DNA, 20 bp, human
ggctccaaagaaccccccga

SEQ ID NO: 195270 - DNA, 20 bp, human
gtcttccgcagccttcacag

SEQ ID NO: 195271 - DNA, 20 bp, human
gccgagggcacgtggaccga

SEQ ID NO: 195272 - DNA, 20 bp, human
ggaggaggcggcctgacaga

SEQ ID NO: 195273 - DNA, 20 bp, human
gaatcagacggccggagagg

SEQ ID NO: 195274 - DNA, 20 bp, human
gtgtcaggccgcctcctctc

SEQ ID NO: 195275 - DNA, 20 bp, human
gcaagtcgactgagctacgg

SEQ ID NO: 195276 - DNA, 20 bp, human
ggctggaaagctggtctcta

SEQ ID NO: 195277 - DNA, 20 bp, human
ggctctcaggactcaaagtg

SEQ ID NO: 195278 - DNA, 20 bp, human
gagcggcaggggccaacctc

SEQ ID NO: 195279 - DNA, 20 bp, human
gccgtacggtgagctttgag

SEQ ID NO: 195280 - DNA, 20 bp, human
gactcaaagtgcggagtcgg

SEQ ID NO: 195281 - DNA, 20 bp, human
gagaggctccgcaccctaag

SEQ ID NO: 195282 - DNA, 20 bp, human
gtgccgctccgcttagggtg

SEQ ID NO: 195283 - DNA, 20 bp, human
gctccgcaccctaagcggag

SEQ ID NO: 195284 - DNA, 20 bp, human
gagtgacggtcggtgagata

SEQ ID NO: 195285 - DNA, 20 bp, human
gaacaacgaggcaggccgta

SEQ ID NO: 195286 - DNA, 20 bp, human
ggcgacaccgaagggcgatc

SEQ ID NO: 195287 - DNA, 20 bp, human
gctggctttaacaaccctgg

SEQ ID NO: 195288 - DNA, 20 bp, human
gcggaggcctaagatacccc

SEQ ID NO: 195289 - DNA, 20 bp, human
gtcgcggagggaagtcagag

SEQ ID NO: 195290 - DNA, 20 bp, human
gacggtgggacgggacgcgg

SEQ ID NO: 195291 - DNA, 20 bp, human
ggctcgcggtcccggctggt

SEQ ID NO: 195292 - DNA, 20 bp, human
ggtggcgagagttcgcagtc

SEQ ID NO: 195293 - DNA, 20 bp, human
gcaacagcagtggccgatgg

SEQ ID NO: 195294 - DNA, 20 bp, human
gactccagctctgtacaagt

SEQ ID NO: 195295 - DNA, 20 bp, human
gcggcggacagcatggctcg

SEQ ID NO: 195296 - DNA, 20 bp, human
gggacagtcacttactctac

SEQ ID NO: 195297 - DNA, 20 bp, human
gatggcgcgcaggccctgac

SEQ ID NO: 195298 - DNA, 20 bp, human
gctggctctccagtcccact

SEQ ID NO: 195299 - DNA, 20 bp, human
gcgggagcctgcgcttccga

SEQ ID NO: 195300 - DNA, 20 bp, human
gggtgaagagcgggcgaacc

SEQ ID NO: 195301 - DNA, 20 bp, human
gggccccccttacccttgag

SEQ ID NO: 195302 - DNA, 20 bp, human
ggggcggcgctgtctgtgtc

SEQ ID NO: 195303 - DNA, 20 bp, human
gccccactcccagcccgtca

SEQ ID NO: 195304 - DNA, 20 bp, human
ggccctgacgggctgggagt

SEQ ID NO: 195305 - DNA, 20 bp, human
ggctgcgctggagggttccc

SEQ ID NO: 195306 - DNA, 20 bp, human
gagacctgggaaagcaggga

SEQ ID NO: 195307 - DNA, 20 bp, human
gccgcggccgccgggaggaa

SEQ ID NO: 195308 - DNA, 20 bp, human
ggctctcaccgagctcaggg

SEQ ID NO: 195309 - DNA, 20 bp, human
ggcccggccctggaagaatg

SEQ ID NO: 195310 - DNA, 20 bp, human
gggctgcattcgcctggtca

SEQ ID NO: 195311 - DNA, 20 bp, human
ggaccccgcacccaaaccac

SEQ ID NO: 195312 - DNA, 20 bp, human
gggaagccccaggctcgggg

SEQ ID NO: 195313 - DNA, 20 bp, human
ggggcagggacgtgcacacg

SEQ ID NO: 195314 - DNA, 20 bp, human
gaagccggcgagcaaaggac

SEQ ID NO: 195315 - DNA, 20 bp, human
gcattcgcctggtcaaggct

SEQ ID NO: 195316 - DNA, 20 bp, human
gcacccgccacgaccccctt

SEQ ID NO: 195317 - DNA, 20 bp, human
gtccgcaaaggggaactctt

SEQ ID NO: 195318 - DNA, 20 bp, human
ggtgcccaagggggtcgtgg

SEQ ID NO: 195319 - DNA, 20 bp, human
gacccgcgcggagtcaggcg

SEQ ID NO: 195320 - DNA, 20 bp, human
gactcttcggagtgctgcgg

SEQ ID NO: 195321 - DNA, 20 bp, human
gccgaggcttcgctccgcaa

SEQ ID NO: 195322 - DNA, 20 bp, human
gggggcgcccgagtccgagg

SEQ ID NO: 195323 - DNA, 20 bp, human
ggcccagggagcggcgagtg

SEQ ID NO: 195324 - DNA, 20 bp, human
gctggcgggtccccgctgag

SEQ ID NO: 195325 - DNA, 20 bp, human
gggtttgcttacccgggagt

SEQ ID NO: 195326 - DNA, 20 bp, human
gaggcggcgtgcaggaccag

SEQ ID NO: 195327 - DNA, 20 bp, human
gccgtgcaggcggaggactt

SEQ ID NO: 195328 - DNA, 20 bp, human
ggtgcgctcgccccatccag

SEQ ID NO: 195329 - DNA, 20 bp, human
gctgcagccggggagagcgg

SEQ ID NO: 195330 - DNA, 20 bp, human
gagacgggcgtggaccacaa

SEQ ID NO: 195331 - DNA, 20 bp, human
gcgcgcccggggtcacaccc

SEQ ID NO: 195332 - DNA, 20 bp, human
gcaggcggaggacttcggcg

SEQ ID NO: 195333 - DNA, 20 bp, human
gggaccagcggcggccgtgc

SEQ ID NO: 195334 - DNA, 20 bp, human
ggaggtggccagaaactccg

SEQ ID NO: 195335 - DNA, 20 bp, human
gggcgagcgcaccaagaccc

SEQ ID NO: 195336 - DNA, 20 bp, human
gtggcagggaagcatcgggt

SEQ ID NO: 195337 - DNA, 20 bp, human
gtgcgcaggaggagatcccc

SEQ ID NO: 195338 - DNA, 20 bp, human
gtctcacctaggaatgcgag

SEQ ID NO: 195339 - DNA, 20 bp, human
gctggatgtgagtatggagg

SEQ ID NO: 195340 - DNA, 20 bp, human
gcagctccctgcaaacgagg

SEQ ID NO: 195341 - DNA, 20 bp, human
gagggggtgcaaaagaggag

SEQ ID NO: 195342 - DNA, 20 bp, human
gggatgctcggcagcaggta

SEQ ID NO: 195343 - DNA, 20 bp, human
gatctcctcctgcgcagggg

SEQ ID NO: 195344 - DNA, 20 bp, human
gcagctggtcacccacgtag

SEQ ID NO: 195345 - DNA, 20 bp, human
gaaactggatgtgagtatgg

SEQ ID NO: 195346 - DNA, 20 bp, human
gtcaggtcagactccgtgtg

SEQ ID NO: 195347 - DNA, 20 bp, human
gagccagattccaccgagag

SEQ ID NO: 195348 - DNA, 20 bp, human
gtgacctgatgcagacgcaa

SEQ ID NO: 195349 - DNA, 20 bp, human
gatatgaacgcccctctcgg

SEQ ID NO: 195350 - DNA, 20 bp, human
gtgtgctagagctggagacc

SEQ ID NO: 195351 - DNA, 20 bp, human
gcagccaggaagggtctatg

SEQ ID NO: 195352 - DNA, 20 bp, human
gctccgggagcgcctcgtca

SEQ ID NO: 195353 - DNA, 20 bp, human
gtctcaacaggataagaaat

SEQ ID NO: 195354 - DNA, 20 bp, human
gcttctgctctgggcacgca

SEQ ID NO: 195355 - DNA, 20 bp, human
ggctgtgggcgaggcggtcc

SEQ ID NO: 195356 - DNA, 20 bp, human
gggaggaggatccccgagag

SEQ ID NO: 195357 - DNA, 20 bp, human
ggatgtccggaagccgacga

SEQ ID NO: 195358 - DNA, 20 bp, human
ggagctgcgggcctagtgtg

SEQ ID NO: 195359 - DNA, 20 bp, human
ggaccgggtgcggtgtcagg

SEQ ID NO: 195360 - DNA, 20 bp, human
ggacaccgcacccggtcctc

SEQ ID NO: 195361 - DNA, 20 bp, human
gtgcggtgtcagggggtctg

SEQ ID NO: 195362 - DNA, 20 bp, human
gcccgccgcgcagcccggag

SEQ ID NO: 195363 - DNA, 20 bp, human
gtgagagcccgcggccgaag

SEQ ID NO: 195364 - DNA, 20 bp, human
ggtgccgaacccggggtctg

SEQ ID NO: 195365 - DNA, 20 bp, human
gccgcgtagacacgtcctgg

SEQ ID NO: 195366 - DNA, 20 bp, human
ggagcgacgcccccaatagt

SEQ ID NO: 195367 - DNA, 20 bp, human
gcgggccgcgggcagacaag

SEQ ID NO: 195368 - DNA, 20 bp, human
ggcccgcgaccatgaagagg

SEQ ID NO: 195369 - DNA, 20 bp, human
gcggacgcggcggagaaacc

SEQ ID NO: 195370 - DNA, 20 bp, human
ggtggcaccagggtcctcgc

SEQ ID NO: 195371 - DNA, 20 bp, human
gggggcctctagattgggac

SEQ ID NO: 195372 - DNA, 20 bp, human
ggcgtcgctccccctcttca

SEQ ID NO: 195373 - DNA, 20 bp, human
gccagcagaaaatccaggag

SEQ ID NO: 195374 - DNA, 20 bp, human
gggactttgttccaactatt

SEQ ID NO: 195375 - DNA, 20 bp, human
gtccgcgctgggctcgggag

SEQ ID NO: 195376 - DNA, 20 bp, human
gcggcacgcacggtcaccga

SEQ ID NO: 195377 - DNA, 20 bp, human
gagcctgcttcaggctgcag

SEQ ID NO: 195378 - DNA, 20 bp, human
gtcgccctgtccgacgccag

SEQ ID NO: 195379 - DNA, 20 bp, human
gctgcccctggcgtcggaca

SEQ ID NO: 195380 - DNA, 20 bp, human
ggcgcggcgatggccccact

SEQ ID NO: 195381 - DNA, 20 bp, human
gggagtaagaagtatccgag

SEQ ID NO: 195382 - DNA, 20 bp, human
ggctcactcaccaccagatc

SEQ ID NO: 195383 - DNA, 20 bp, human
ggcacggtcaccgaggggac

SEQ ID NO: 195384 - DNA, 20 bp, human
gctgcgggcgcggcgcacag

SEQ ID NO: 195385 - DNA, 20 bp, human
gtcaggccgctgggacgcgt

SEQ ID NO: 195386 - DNA, 20 bp, human
gccctgcccagaggcgtcag

SEQ ID NO: 195387 - DNA, 20 bp, human
gtgggcagggagccggaccc

SEQ ID NO: 195388 - DNA, 20 bp, human
ggaagacggcgaagacgagg

SEQ ID NO: 195389 - DNA, 20 bp, human
gcaggctgccggcaggcaca

SEQ ID NO: 195390 - DNA, 20 bp, human
gagggacgttcgggccgtgg

SEQ ID NO: 195391 - DNA, 20 bp, human
gtacagccagttgctcgcgg

SEQ ID NO: 195392 - DNA, 20 bp, human
gtcccgtcggggctgcaggt

SEQ ID NO: 195393 - DNA, 20 bp, human
gggtgtgcagagggacgttc

SEQ ID NO: 195394 - DNA, 20 bp, human
gagccacccctgacgcctct

SEQ ID NO: 195395 - DNA, 20 bp, human
ggacgttcgggccgtggcgg

SEQ ID NO: 195396 - DNA, 20 bp, human
gacctgggccgagcaacaag

SEQ ID NO: 195397 - DNA, 20 bp, human
gtgttgctcggcccaggttg

SEQ ID NO: 195398 - DNA, 20 bp, human
gcctcctgggtaattcactc

SEQ ID NO: 195399 - DNA, 20 bp, human
gcccctggcccccctctagt

SEQ ID NO: 195400 - DNA, 20 bp, human
ggagccagaattaattccat

SEQ ID NO: 195401 - DNA, 20 bp, human
gactcgagcgagcaggaagg

SEQ ID NO: 195402 - DNA, 20 bp, human
gcacagcaccaactagaggg

SEQ ID NO: 195403 - DNA, 20 bp, human
gatgggcgagaggagcacgg

SEQ ID NO: 195404 - DNA, 20 bp, human
gttcactcaggaacccgctg

SEQ ID NO: 195405 - DNA, 20 bp, human
gcatccccaaagcaactcct

SEQ ID NO: 195406 - DNA, 20 bp, human
gctcaagagagcgagaagac

SEQ ID NO: 195407 - DNA, 20 bp, human
gagaagactggaatcaggtg

SEQ ID NO: 195408 - DNA, 20 bp, human
gctttaaagaacagcatgat

SEQ ID NO: 195409 - DNA, 20 bp, human
gattatcctattcttccaaa

SEQ ID NO: 195410 - DNA, 20 bp, human
gagtttccatttggaagaat

SEQ ID NO: 195411 - DNA, 20 bp, human
gtatctaaacttagtttctg

SEQ ID NO: 195412 - DNA, 20 bp, human
gctaaacttagtttctgggg

SEQ ID NO: 195413 - DNA, 20 bp, human
gtagtcaccatttataaatc

SEQ ID NO: 195414 - DNA, 20 bp, human
gaaaaatccagatttataaa

SEQ ID NO: 195415 - DNA, 20 bp, human
ggagcgagaagactggaatc

SEQ ID NO: 195416 - DNA, 20 bp, human
gggcgaccaggtcccgagta

SEQ ID NO: 195417 - DNA, 20 bp, human
gaaccccgggaaggactggt

SEQ ID NO: 195418 - DNA, 20 bp, human
ggagagatggagcagagata

SEQ ID NO: 195419 - DNA, 20 bp, human
ggaccaggtcccgagtaggg

SEQ ID NO: 195420 - DNA, 20 bp, human
gccgagccaaagacaggcct

SEQ ID NO: 195421 - DNA, 20 bp, human
ggaagaactccgctatctgg

SEQ ID NO: 195422 - DNA, 20 bp, human
ggacgggtgacagaggtgag

SEQ ID NO: 195423 - DNA, 20 bp, human
ggatggagcagagatagggc

SEQ ID NO: 195424 - DNA, 20 bp, human
gcctgatggacgggtgacag

SEQ ID NO: 195425 - DNA, 20 bp, human
ggccctagctctgcaacccc

SEQ ID NO: 195426 - DNA, 20 bp, human
gaggactgcgaagcttcctg

SEQ ID NO: 195427 - DNA, 20 bp, human
gtgcttgaacagctggatgt

SEQ ID NO: 195428 - DNA, 20 bp, human
gctgaggttcttgaacactg

SEQ ID NO: 195429 - DNA, 20 bp, human
gtattattcttagagtcctg

SEQ ID NO: 195430 - DNA, 20 bp, human
gttgctcctgaactagaagg

SEQ ID NO: 195431 - DNA, 20 bp, human
ggttcaagcaggcacgaggc

SEQ ID NO: 195432 - DNA, 20 bp, human
ggagtaaggcgggattctgc

SEQ ID NO: 195433 - DNA, 20 bp, human
gcacagcccctggtgtcctg

SEQ ID NO: 195434 - DNA, 20 bp, human
gtgaacagctggatgtgggc

SEQ ID NO: 195435 - DNA, 20 bp, human
gacagctggatgtgggcagg

SEQ ID NO: 195436 - DNA, 20 bp, human
gcgagctccgcaggagacac

SEQ ID NO: 195437 - DNA, 20 bp, human
gcgaggcgggagggtaaggg

SEQ ID NO: 195438 - DNA, 20 bp, human
ggcggaggcggagagcggac

SEQ ID NO: 195439 - DNA, 20 bp, human
gcgggaggcgagggatccgg

SEQ ID NO: 195440 - DNA, 20 bp, human
ggcccgaggcgggagggtaa

SEQ ID NO: 195441 - DNA, 20 bp, human
gtctcctgcggagctcgctc

SEQ ID NO: 195442 - DNA, 20 bp, human
gccagcgcctgtgtctcctg

SEQ ID NO: 195443 - DNA, 20 bp, human
gcggccgaggccagaaagct

SEQ ID NO: 195444 - DNA, 20 bp, human
gccgggacccaggacagact

SEQ ID NO: 195445 - DNA, 20 bp, human
gagggttaggaacgtcgaag

SEQ ID NO: 195446 - DNA, 20 bp, human
ggagcacgggagccacggag

SEQ ID NO: 195447 - DNA, 20 bp, human
gtgagcctcgccaggagcac

SEQ ID NO: 195448 - DNA, 20 bp, human
gaggacaccccaggagatat

SEQ ID NO: 195449 - DNA, 20 bp, human
ggccggcagaggctcgcagg

SEQ ID NO: 195450 - DNA, 20 bp, human
gtgtggaagttggccggcag

SEQ ID NO: 195451 - DNA, 20 bp, human
gggaccagagacagccggta

SEQ ID NO: 195452 - DNA, 20 bp, human
gcgggctgcgcgcgagcgac

SEQ ID NO: 195453 - DNA, 20 bp, human
gaggccgggtgggtgcggtg

SEQ ID NO: 195454 - DNA, 20 bp, human
ggccaatcgggactatgaac

SEQ ID NO: 195455 - DNA, 20 bp, human
gctacctccggatcgggtaa

SEQ ID NO: 195456 - DNA, 20 bp, human
gcggggccgcgagtcacctg

SEQ ID NO: 195457 - DNA, 20 bp, human
gggggctgcgccatagacag

SEQ ID NO: 195458 - DNA, 20 bp, human
gctggggcggccgacaagtg

SEQ ID NO: 195459 - DNA, 20 bp, human
gccgacaagtgcggacacat

SEQ ID NO: 195460 - DNA, 20 bp, human
gaggcgctcacggcctcagg

SEQ ID NO: 195461 - DNA, 20 bp, human
gggccgcgagtcacctgggg

SEQ ID NO: 195462 - DNA, 20 bp, human
ggctcgggtgagtaccccgt

SEQ ID NO: 195463 - DNA, 20 bp, human
gctccggccgccgctgtcta

SEQ ID NO: 195464 - DNA, 20 bp, human
gcactaggcgcagccgcctg

SEQ ID NO: 195465 - DNA, 20 bp, human
ggctgcgccatagacagcgg

SEQ ID NO: 195466 - DNA, 20 bp, human
gctccagcgctggaaccggg

SEQ ID NO: 195467 - DNA, 20 bp, human
ggaggtccagaccgcagcca

SEQ ID NO: 195468 - DNA, 20 bp, human
gaccgggcgggcagggaacg

SEQ ID NO: 195469 - DNA, 20 bp, human
gggagctccccgatgcaggg

SEQ ID NO: 195470 - DNA, 20 bp, human
ggccggttcgcaccgacaga

SEQ ID NO: 195471 - DNA, 20 bp, human
gacgcggcagcgaggcccct

SEQ ID NO: 195472 - DNA, 20 bp, human
gcgcaccgacagacggacgg

SEQ ID NO: 195473 - DNA, 20 bp, human
ggcgcgccttggctgcggtc

SEQ ID NO: 195474 - DNA, 20 bp, human
ggcgccgccgccctgcatcg

SEQ ID NO: 195475 - DNA, 20 bp, human
gagcgggcgcgccttggctg

SEQ ID NO: 195476 - DNA, 20 bp, human
ggagcaggcaggactcagat

SEQ ID NO: 195477 - DNA, 20 bp, human
ggccagagcccctcacccag

SEQ ID NO: 195478 - DNA, 20 bp, human
gtacccactgagggccctaa

SEQ ID NO: 195479 - DNA, 20 bp, human
ggaaaattctgaatgtccaa

SEQ ID NO: 195480 - DNA, 20 bp, human
gcctccttggcaaggagtga

SEQ ID NO: 195481 - DNA, 20 bp, human
ggtccccttagggccctcag

SEQ ID NO: 195482 - DNA, 20 bp, human
gtgataacaggtcccaaggt

SEQ ID NO: 195483 - DNA, 20 bp, human
gggttgggaaaggacttacc

SEQ ID NO: 195484 - DNA, 20 bp, human
gtctccagaagagtcccctt

SEQ ID NO: 195485 - DNA, 20 bp, human
gttggcaaggagtgagggtt

SEQ ID NO: 195486 - DNA, 20 bp, human
ggactaaatgatgggagcgg

SEQ ID NO: 195487 - DNA, 20 bp, human
gtgggatcgcttacacacca

SEQ ID NO: 195488 - DNA, 20 bp, human
gcttacacaccaaggaagtt

SEQ ID NO: 195489 - DNA, 20 bp, human
gcagctccaggtaagagtcc

SEQ ID NO: 195490 - DNA, 20 bp, human
gcccaaacagagttaagggg

SEQ ID NO: 195491 - DNA, 20 bp, human
gttaggacccctaccaataa

SEQ ID NO: 195492 - DNA, 20 bp, human
gtattctcctcagtgccagt

SEQ ID NO: 195493 - DNA, 20 bp, human
gaaggactaaatgatgggag

SEQ ID NO: 195494 - DNA, 20 bp, human
gcgatcccaaacagagttaa

SEQ ID NO: 195495 - DNA, 20 bp, human
gtggctgagttggaggacac

SEQ ID NO: 195496 - DNA, 20 bp, human
ggagctgggagcgcgatggt

SEQ ID NO: 195497 - DNA, 20 bp, human
ggcgcggcaagatgctggat

SEQ ID NO: 195498 - DNA, 20 bp, human
gcgcgaggcagtcctgctca

SEQ ID NO: 195499 - DNA, 20 bp, human
ggcatcttgccgcgcctcgg

SEQ ID NO: 195500 - DNA, 20 bp, human
ggcgcgatggtcggccgccg

SEQ ID NO: 195501 - DNA, 20 bp, human
ggaaggcacctacccgaagt

SEQ ID NO: 195502 - DNA, 20 bp, human
gatgctggatgggtccccgc

SEQ ID NO: 195503 - DNA, 20 bp, human
gacagcgccaggcaacccgg

SEQ ID NO: 195504 - DNA, 20 bp, human
gcggccagccagcgcgccag

SEQ ID NO: 195505 - DNA, 20 bp, human
gagcagcagcgtcagcccga

SEQ ID NO: 195506 - DNA, 20 bp, human
gggcgcgaggagatgctaga

SEQ ID NO: 195507 - DNA, 20 bp, human
gcccggcgggatgaggagag

SEQ ID NO: 195508 - DNA, 20 bp, human
gagcaggcagagcccggcca

SEQ ID NO: 195509 - DNA, 20 bp, human
gccgagagggcatcagagag

SEQ ID NO: 195510 - DNA, 20 bp, human
ggtgcgcagagtccgagacc

SEQ ID NO: 195511 - DNA, 20 bp, human
ggcgggactgacgcctgaac

SEQ ID NO: 195512 - DNA, 20 bp, human
ggcgggcactgacccgaagt

SEQ ID NO: 195513 - DNA, 20 bp, human
ggacccgaagtaggaggcgg

SEQ ID NO: 195514 - DNA, 20 bp, human
ggcagagtccgagacccggc

SEQ ID NO: 195515 - DNA, 20 bp, human
ggagactcggacactgaaca

SEQ ID NO: 195516 - DNA, 20 bp, human
gtggaaggagccatcaccca

SEQ ID NO: 195517 - DNA, 20 bp, human
gggacgttagaacttgtgga

SEQ ID NO: 195518 - DNA, 20 bp, human
ggtctcctgctcagtgtggt

SEQ ID NO: 195519 - DNA, 20 bp, human
gaggcctgaatgccagtcct

SEQ ID NO: 195520 - DNA, 20 bp, human
gagtgggacgttagaacttg

SEQ ID NO: 195521 - DNA, 20 bp, human
gagctgaagcgtcagggctc

SEQ ID NO: 195522 - DNA, 20 bp, human
gtcactcactccatgagcca

SEQ ID NO: 195523 - DNA, 20 bp, human
gcagcatgtgcgtggaagct

SEQ ID NO: 195524 - DNA, 20 bp, human
gaccagatggggagtcgggg

SEQ ID NO: 195525 - DNA, 20 bp, human
ggtgaccagatggggagtcg

SEQ ID NO: 195526 - DNA, 20 bp, human
gcgggaggagaggcgaacag

SEQ ID NO: 195527 - DNA, 20 bp, human
gtaggcagaagactcccggg

SEQ ID NO: 195528 - DNA, 20 bp, human
gcgaggactcaactcactag

SEQ ID NO: 195529 - DNA, 20 bp, human
ggagtaggcagaagactccc

SEQ ID NO: 195530 - DNA, 20 bp, human
gagaggcccgtagcgacccg

SEQ ID NO: 195531 - DNA, 20 bp, human
gtgtcccaggagctacggga

SEQ ID NO: 195532 - DNA, 20 bp, human
ggtagcgacccgcggtgcta

SEQ ID NO: 195533 - DNA, 20 bp, human
ggacagcagtccggagctaa

SEQ ID NO: 195534 - DNA, 20 bp, human
gcgcggagccgggacgtgaa

SEQ ID NO: 195535 - DNA, 20 bp, human
gatgcggcggcccaatcgga

SEQ ID NO: 195536 - DNA, 20 bp, human
gctggagagcttgaatacct

SEQ ID NO: 195537 - DNA, 20 bp, human
gggacccctgggcgcgcagc

SEQ ID NO: 195538 - DNA, 20 bp, human
ggaaaacccgcgggacccct

SEQ ID NO: 195539 - DNA, 20 bp, human
ggcggccatgaacttctccg

SEQ ID NO: 195540 - DNA, 20 bp, human
gcgggccctccacctgtcta

SEQ ID NO: 195541 - DNA, 20 bp, human
gtgggtcccgcacctgtctg

SEQ ID NO: 195542 - DNA, 20 bp, human
ggtaccccaagcagatatgg

SEQ ID NO: 195543 - DNA, 20 bp, human
gccctgcgcccgaaaacccg

SEQ ID NO: 195544 - DNA, 20 bp, human
gtccgaggccggaagtcaga

SEQ ID NO: 195545 - DNA, 20 bp, human
gccaggcaggtaccccaagc

SEQ ID NO: 195546 - DNA, 20 bp, human
gatccccaccggcccttggg

SEQ ID NO: 195547 - DNA, 20 bp, human
ggcgcttggcttcaccgcgc

SEQ ID NO: 195548 - DNA, 20 bp, human
ggcggcggcgaacctcacac

SEQ ID NO: 195549 - DNA, 20 bp, human
gggctgtgctgggtccgcta

SEQ ID NO: 195550 - DNA, 20 bp, human
gccacagccagaagagtcca

SEQ ID NO: 195551 - DNA, 20 bp, human
gtggctgcctggcctcccaa

SEQ ID NO: 195552 - DNA, 20 bp, human
gtccgctacggcagctccat

SEQ ID NO: 195553 - DNA, 20 bp, human
gagcacagccaggagcgtcc

SEQ ID NO: 195554 - DNA, 20 bp, human
gtacgaaggatgagaaggac

SEQ ID NO: 195555 - DNA, 20 bp, human
gaggtacaggggtctcaact

SEQ ID NO: 195556 - DNA, 20 bp, human
gggaggcgccggcttgtact

SEQ ID NO: 195557 - DNA, 20 bp, human
gatcaagctggggccgtcag

SEQ ID NO: 195558 - DNA, 20 bp, human
gtagcactatagataccccg

SEQ ID NO: 195559 - DNA, 20 bp, human
gcgcgctgccgagtacaagc

SEQ ID NO: 195560 - DNA, 20 bp, human
ggctaggcttctgagacacg

SEQ ID NO: 195561 - DNA, 20 bp, human
ggtctgcacagcaaagtcga

SEQ ID NO: 195562 - DNA, 20 bp, human
gtggagcgccaccacaagca

SEQ ID NO: 195563 - DNA, 20 bp, human
gtctagtacggcctttatta

SEQ ID NO: 195564 - DNA, 20 bp, human
gcaaggtaaacatcaagctg

SEQ ID NO: 195565 - DNA, 20 bp, human
ggcgggtcgggtaggtctcc

SEQ ID NO: 195566 - DNA, 20 bp, human
gcgcgggagctgcggacgtg

SEQ ID NO: 195567 - DNA, 20 bp, human
gccgctggcagcgcctcacg

SEQ ID NO: 195568 - DNA, 20 bp, human
ggcctagcggagggcatcga

SEQ ID NO: 195569 - DNA, 20 bp, human
gcggcagccgagagcagcga

SEQ ID NO: 195570 - DNA, 20 bp, human
gacgctcgcgggccggagga

SEQ ID NO: 195571 - DNA, 20 bp, human
gcggcgcggggcctagcgga

SEQ ID NO: 195572 - DNA, 20 bp, human
gggtggatgcagctgatggt

SEQ ID NO: 195573 - DNA, 20 bp, human
gggacggcgaggacgacccg

SEQ ID NO: 195574 - DNA, 20 bp, human
gagggtgaggagggcgacga

SEQ ID NO: 195575 - DNA, 20 bp, human
gtccggcccgctcacctcca

SEQ ID NO: 195576 - DNA, 20 bp, human
gcggagatatctgggcggca

SEQ ID NO: 195577 - DNA, 20 bp, human
gggcggcgccggagatatct

SEQ ID NO: 195578 - DNA, 20 bp, human
gccgactgcaaacgagacac

SEQ ID NO: 195579 - DNA, 20 bp, human
gcagcccactagcgaggagg

SEQ ID NO: 195580 - DNA, 20 bp, human
gggccagcccactagcgagg

SEQ ID NO: 195581 - DNA, 20 bp, human
gcagccaactcccaccgagg

SEQ ID NO: 195582 - DNA, 20 bp, human
ggaagagctccagtgcgcca

SEQ ID NO: 195583 - DNA, 20 bp, human
gggagctcttccctcagact

SEQ ID NO: 195584 - DNA, 20 bp, human
gggaagcgactccaagtctg

SEQ ID NO: 195585 - DNA, 20 bp, human
gcagggccagcccactagcg

SEQ ID NO: 195586 - DNA, 20 bp, human
gctggcacctgggtacccag

SEQ ID NO: 195587 - DNA, 20 bp, human
gtcgccggcgggagtcaggg

SEQ ID NO: 195588 - DNA, 20 bp, human
gctgtcgccggcgggagtca

SEQ ID NO: 195589 - DNA, 20 bp, human
gcgacaggatcgggaagatc

SEQ ID NO: 195590 - DNA, 20 bp, human
gccgggagccccctctgtcc

SEQ ID NO: 195591 - DNA, 20 bp, human
gtgatggcctctccgggcgg

SEQ ID NO: 195592 - DNA, 20 bp, human
ggcgcccaccgccatgtgac

SEQ ID NO: 195593 - DNA, 20 bp, human
ggatcccccgaccgggacag

SEQ ID NO: 195594 - DNA, 20 bp, human
gacagagggggctcccgggt

SEQ ID NO: 195595 - DNA, 20 bp, human
gggctcccgggtgggactcg

SEQ ID NO: 195596 - DNA, 20 bp, human
gcttgccgggggcaccttcc

SEQ ID NO: 195597 - DNA, 20 bp, human
ggggcaccttcccgggggcc

SEQ ID NO: 195598 - DNA, 20 bp, human
gtggcgtccgggctgaacgg

SEQ ID NO: 195599 - DNA, 20 bp, human
gtgctggcgtccgggctgaa

SEQ ID NO: 195600 - DNA, 20 bp, human
gagtgagcgggtgcgtgcag

SEQ ID NO: 195601 - DNA, 20 bp, human
gacccacgcgcccgggcaca

SEQ ID NO: 195602 - DNA, 20 bp, human
gcaagcggacccacgcgccc

SEQ ID NO: 195603 - DNA, 20 bp, human
gcccggcgcccgcacgtctc

SEQ ID NO: 195604 - DNA, 20 bp, human
gtccgggctgaacggcgggg

SEQ ID NO: 195605 - DNA, 20 bp, human
ggccctgtgcccgggcgcgt

SEQ ID NO: 195606 - DNA, 20 bp, human
ggcgcctccagcgggaaagt

SEQ ID NO: 195607 - DNA, 20 bp, human
ggctggagacgtgaagtcca

SEQ ID NO: 195608 - DNA, 20 bp, human
ggcggcgcgggagctagggc

SEQ ID NO: 195609 - DNA, 20 bp, human
gaagcgaagcccagatctag

SEQ ID NO: 195610 - DNA, 20 bp, human
ggtggcgagaaaggaaatcc

SEQ ID NO: 195611 - DNA, 20 bp, human
ggcatcctctgcgcctccag

SEQ ID NO: 195612 - DNA, 20 bp, human
gacctggagaaatagcccca

SEQ ID NO: 195613 - DNA, 20 bp, human
gaagtccaggggagcgagca

SEQ ID NO: 195614 - DNA, 20 bp, human
ggccagccggcgagccaggg

SEQ ID NO: 195615 - DNA, 20 bp, human
gtcgccgctgctgcaattca

SEQ ID NO: 195616 - DNA, 20 bp, human
ggcggagagcccccgggtgt

SEQ ID NO: 195617 - DNA, 20 bp, human
gcaaggcagcgcccacaccc

SEQ ID NO: 195618 - DNA, 20 bp, human
gtaggcacccaggcccggag

SEQ ID NO: 195619 - DNA, 20 bp, human
gcgggttgcggagagccccc

SEQ ID NO: 195620 - DNA, 20 bp, human
gggtctgagccgcagcaaat

SEQ ID NO: 195621 - DNA, 20 bp, human
ggccgcgccgctcacaggca

SEQ ID NO: 195622 - DNA, 20 bp, human
ggcgttcaggtcccgcacgt

SEQ ID NO: 195623 - DNA, 20 bp, human
gtgccgtcccggctctgggt

SEQ ID NO: 195624 - DNA, 20 bp, human
gactgcgccgcgccgctcac

SEQ ID NO: 195625 - DNA, 20 bp, human
ggcaaatgggctccgacgtg

SEQ ID NO: 195626 - DNA, 20 bp, human
gagagaccggccactcacgg

SEQ ID NO: 195627 - DNA, 20 bp, human
gcggagagaccggccactca

SEQ ID NO: 195628 - DNA, 20 bp, human
gcaaataaaggggagcgcag

SEQ ID NO: 195629 - DNA, 20 bp, human
ggtcagccccagggcatcac

SEQ ID NO: 195630 - DNA, 20 bp, human
gcccaaggcccgggttgaga

SEQ ID NO: 195631 - DNA, 20 bp, human
gaggtcggaggtcagcccca

SEQ ID NO: 195632 - DNA, 20 bp, human
gagataaaatggcctcgaag

SEQ ID NO: 195633 - DNA, 20 bp, human
gcagcgagacccacaaataa

SEQ ID NO: 195634 - DNA, 20 bp, human
gcgcaggcgggaaggtagag

SEQ ID NO: 195635 - DNA, 20 bp, human
gtgcggcgggactaggagcg

SEQ ID NO: 195636 - DNA, 20 bp, human
gacctgcgggagaaaggcgg

SEQ ID NO: 195637 - DNA, 20 bp, human
gaagacctgcgggagaaagg

SEQ ID NO: 195638 - DNA, 20 bp, human
ggcgggagaaaggcggaggg

SEQ ID NO: 195639 - DNA, 20 bp, human
gacccggctccaagacctgc

SEQ ID NO: 195640 - DNA, 20 bp, human
gtcccgcaggtcttggagcc

SEQ ID NO: 195641 - DNA, 20 bp, human
gcgttcccttcttcctcacc

SEQ ID NO: 195642 - DNA, 20 bp, human
gtccaagacctgcgggagaa

SEQ ID NO: 195643 - DNA, 20 bp, human
gaaaatgtgtggaggcgccc

SEQ ID NO: 195644 - DNA, 20 bp, human
gtggagccgggtgaggaaga

SEQ ID NO: 195645 - DNA, 20 bp, human
gtgcgcgagcctctggcgcg

SEQ ID NO: 195646 - DNA, 20 bp, human
gcgctgggccgcagagggaa

SEQ ID NO: 195647 - DNA, 20 bp, human
ggacgcggcgccctgctcgg

SEQ ID NO: 195648 - DNA, 20 bp, human
gcgggccggggtcgttccgg

SEQ ID NO: 195649 - DNA, 20 bp, human
gcgggccatgcagcgctcca

SEQ ID NO: 195650 - DNA, 20 bp, human
ggacgaggcggccctactcc

SEQ ID NO: 195651 - DNA, 20 bp, human
gcagcctgcgggcagcccac

SEQ ID NO: 195652 - DNA, 20 bp, human
gccgcgcgcgccgccgagca

SEQ ID NO: 195653 - DNA, 20 bp, human
ggccatgcagcgctccaggg

SEQ ID NO: 195654 - DNA, 20 bp, human
ggcctggcggggtccgacgg

SEQ ID NO: 195655 - DNA, 20 bp, human
gcgccgggccggggtcgttc

SEQ ID NO: 195656 - DNA, 20 bp, human
gcgaggcaccatgatccggg

SEQ ID NO: 195657 - DNA, 20 bp, human
gccccggccggcccctacta

SEQ ID NO: 195658 - DNA, 20 bp, human
gtactagggccccccatctg

SEQ ID NO: 195659 - DNA, 20 bp, human
ggaactgaagagagctcaag

SEQ ID NO: 195660 - DNA, 20 bp, human
ggcgctgccccggaaacggg

SEQ ID NO: 195661 - DNA, 20 bp, human
gccgccgaggcaccatgatc

SEQ ID NO: 195662 - DNA, 20 bp, human
ggaggcagaagtcacaaacc

SEQ ID NO: 195663 - DNA, 20 bp, human
gcggccctgcagccccgacc

SEQ ID NO: 195664 - DNA, 20 bp, human
ggggtggcgcccgcagatgg

SEQ ID NO: 195665 - DNA, 20 bp, human
gggcgccaccccccggatca

SEQ ID NO: 195666 - DNA, 20 bp, human
ggggaggagggttcgctcgc

SEQ ID NO: 195667 - DNA, 20 bp, human
gcggcggcctcgccggcgag

SEQ ID NO: 195668 - DNA, 20 bp, human
ggcgcgggcccgttcggaca

SEQ ID NO: 195669 - DNA, 20 bp, human
gggctccgacgcagacatgg

SEQ ID NO: 195670 - DNA, 20 bp, human
gaggaggccagggactacga

SEQ ID NO: 195671 - DNA, 20 bp, human
gccgcgaacagcgtttcctg

SEQ ID NO: 195672 - DNA, 20 bp, human
gccgcgcccggtacctatgg

SEQ ID NO: 195673 - DNA, 20 bp, human
ggccggctccgacgcagaca

SEQ ID NO: 195674 - DNA, 20 bp, human
gcggccctcctaggcatggt

SEQ ID NO: 195675 - DNA, 20 bp, human
gtccctcccgggacccctcg

SEQ ID NO: 195676 - DNA, 20 bp, human
ggcgcgccgcgggaacggag

SEQ ID NO: 195677 - DNA, 20 bp, human
gccgcgccgaggaacgaaga

SEQ ID NO: 195678 - DNA, 20 bp, human
gggccgcccctccgttcccg

SEQ ID NO: 195679 - DNA, 20 bp, human
ggcgcgcgaagtcacagccc

SEQ ID NO: 195680 - DNA, 20 bp, human
ggcggaggatgcgccaggag

SEQ ID NO: 195681 - DNA, 20 bp, human
gggcagctcggcgctctccc

SEQ ID NO: 195682 - DNA, 20 bp, human
ggccctgcccctgctcgccc

SEQ ID NO: 195683 - DNA, 20 bp, human
ggcctcctccgccagcacta

SEQ ID NO: 195684 - DNA, 20 bp, human
gcccggccatcttcgttcct

SEQ ID NO: 195685 - DNA, 20 bp, human
ggaggatgcgccaggagcgg

SEQ ID NO: 195686 - DNA, 20 bp, human
gtccagcgggggtcacctgg

SEQ ID NO: 195687 - DNA, 20 bp, human
gggtccagggttcccagtag

SEQ ID NO: 195688 - DNA, 20 bp, human
gctgccatggctgactgtgg

SEQ ID NO: 195689 - DNA, 20 bp, human
gctggacccgaggcccacca

SEQ ID NO: 195690 - DNA, 20 bp, human
gcgcagtgcgcaggcgtgag

SEQ ID NO: 195691 - DNA, 20 bp, human
ggttcctgagcgagtggacc

SEQ ID NO: 195692 - DNA, 20 bp, human
gctgccgggtccactcgctc

SEQ ID NO: 195693 - DNA, 20 bp, human
ggacgcgcgcgggtctcgtt

SEQ ID NO: 195694 - DNA, 20 bp, human
gccggcagcgggcgataggg

SEQ ID NO: 195695 - DNA, 20 bp, human
ggcgcgggtctcgtttggag

SEQ ID NO: 195696 - DNA, 20 bp, human
gtaaggaagcctaagaactg

SEQ ID NO: 195697 - DNA, 20 bp, human
gtccgcgtgcgggttccgag

SEQ ID NO: 195698 - DNA, 20 bp, human
ggaaggcgaagagaaggcta

SEQ ID NO: 195699 - DNA, 20 bp, human
gggagaaggtagccaaggta

SEQ ID NO: 195700 - DNA, 20 bp, human
gtcagggaggtgttagggaa

SEQ ID NO: 195701 - DNA, 20 bp, human
gccctcctaggacccgtcgg

SEQ ID NO: 195702 - DNA, 20 bp, human
ggcttcgcgccgggtaagga

SEQ ID NO: 195703 - DNA, 20 bp, human
ggccactcggaacccgcacg

SEQ ID NO: 195704 - DNA, 20 bp, human
gctttgccagggcgaactcc

SEQ ID NO: 195705 - DNA, 20 bp, human
gctggcacaggcctttgcca

SEQ ID NO: 195706 - DNA, 20 bp, human
ggctcccgcccgagtggggt

SEQ ID NO: 195707 - DNA, 20 bp, human
gtggaaggcggaagtaggag

SEQ ID NO: 195708 - DNA, 20 bp, human
ggtggagggatcgggaccag

SEQ ID NO: 195709 - DNA, 20 bp, human
gcagcgctcgctacctgccg

SEQ ID NO: 195710 - DNA, 20 bp, human
gcggcgcgcccaccccactc

SEQ ID NO: 195711 - DNA, 20 bp, human
gttggaactgagctggaagg

SEQ ID NO: 195712 - DNA, 20 bp, human
ggagttcggcgccgcttctg

SEQ ID NO: 195713 - DNA, 20 bp, human
gaccaggggaaggggcgact

SEQ ID NO: 195714 - DNA, 20 bp, human
gggaagggagagactctcag

SEQ ID NO: 195715 - DNA, 20 bp, human
gccgcttctgtggccacggc

SEQ ID NO: 195716 - DNA, 20 bp, human
gctagtgctgggcgaaaagg

SEQ ID NO: 195717 - DNA, 20 bp, human
ggcgctagtgctgggcgaaa

SEQ ID NO: 195718 - DNA, 20 bp, human
gggcctaaggcgctagtgct

SEQ ID NO: 195719 - DNA, 20 bp, human
gcatcccccgagctggccta

SEQ ID NO: 195720 - DNA, 20 bp, human
gccgcaggatggcaaaggaa

SEQ ID NO: 195721 - DNA, 20 bp, human
ggaggagaagatagggcgag

SEQ ID NO: 195722 - DNA, 20 bp, human
ggcctggaggaggagaagat

SEQ ID NO: 195723 - DNA, 20 bp, human
gggcttgctgaaccgcagga

SEQ ID NO: 195724 - DNA, 20 bp, human
ggctccagcgggcactacct

SEQ ID NO: 195725 - DNA, 20 bp, human
gcagcgggcactacctgggc

SEQ ID NO: 195726 - DNA, 20 bp, human
gtccggtctctggcccatta

SEQ ID NO: 195727 - DNA, 20 bp, human
ggacatgacgatccggtctc

SEQ ID NO: 195728 - DNA, 20 bp, human
ggcgactctctcctgtacct

SEQ ID NO: 195729 - DNA, 20 bp, human
ggactcacgaagacaaggtc

SEQ ID NO: 195730 - DNA, 20 bp, human
gagacaaggtccggccgctc

SEQ ID NO: 195731 - DNA, 20 bp, human
gctgtggactcacgaagaca

SEQ ID NO: 195732 - DNA, 20 bp, human
gagatcggtgtctgaagtaa

SEQ ID NO: 195733 - DNA, 20 bp, human
gaggcttgcttacgaggcca

SEQ ID NO: 195734 - DNA, 20 bp, human
gggtgatggcgcgactctcg

SEQ ID NO: 195735 - DNA, 20 bp, human
ggagtccacagaggagccgg

SEQ ID NO: 195736 - DNA, 20 bp, human
gtggagaccgtgggccccaa

SEQ ID NO: 195737 - DNA, 20 bp, human
gagtcctggagaatctccgt

SEQ ID NO: 195738 - DNA, 20 bp, human
ggtgggccccaagggtagga

SEQ ID NO: 195739 - DNA, 20 bp, human
gccccacggctccctttcca

SEQ ID NO: 195740 - DNA, 20 bp, human
gacaagcagctggagaccgt

SEQ ID NO: 195741 - DNA, 20 bp, human
gaggagggtgagagtagtcc

SEQ ID NO: 195742 - DNA, 20 bp, human
gtccttggaaagggagccgt

SEQ ID NO: 195743 - DNA, 20 bp, human
gagcctcagggaggtagatg

SEQ ID NO: 195744 - DNA, 20 bp, human
gtgtgaaagaaagtgtccca

SEQ ID NO: 195745 - DNA, 20 bp, human
gctgggaccacacctctaac

SEQ ID NO: 195746 - DNA, 20 bp, human
gccctggattaacagctcag

SEQ ID NO: 195747 - DNA, 20 bp, human
gtgaggcatgaagggagcca

SEQ ID NO: 195748 - DNA, 20 bp, human
gcagaagggcaactcttccc

SEQ ID NO: 195749 - DNA, 20 bp, human
ggcggaggaccaacacaaac

SEQ ID NO: 195750 - DNA, 20 bp, human
gatccacatattcttcagaa

SEQ ID NO: 195751 - DNA, 20 bp, human
gggagggtggaaagaagtaa

SEQ ID NO: 195752 - DNA, 20 bp, human
ggtggatttaatggagacca

SEQ ID NO: 195753 - DNA, 20 bp, human
gggacaaatggagcgaggga

SEQ ID NO: 195754 - DNA, 20 bp, human
gtagccaaacagctcttgat

SEQ ID NO: 195755 - DNA, 20 bp, human
gaacacaaactggttagtct

SEQ ID NO: 195756 - DNA, 20 bp, human
gccgaggtctgtagagctcc

SEQ ID NO: 195757 - DNA, 20 bp, human
gtccccagcggtcaccacgt

SEQ ID NO: 195758 - DNA, 20 bp, human
gcgtgggcaaaggggtcgaa

SEQ ID NO: 195759 - DNA, 20 bp, human
gggagctgtgagagtgtgag

SEQ ID NO: 195760 - DNA, 20 bp, human
ggcccacgtggtgaccgctg

SEQ ID NO: 195761 - DNA, 20 bp, human
gtgtgtaagcggtaagaaag

SEQ ID NO: 195762 - DNA, 20 bp, human
gacactgaggcaggtgtcca

SEQ ID NO: 195763 - DNA, 20 bp, human
gtccaggtcataaggaaggt

SEQ ID NO: 195764 - DNA, 20 bp, human
gaagtgcctggaactcccaa

SEQ ID NO: 195765 - DNA, 20 bp, human
ggattccagacttcttggta

SEQ ID NO: 195766 - DNA, 20 bp, human
gacccgggaaggagcagggt

SEQ ID NO: 195767 - DNA, 20 bp, human
ggaatgccctggagttgtga

SEQ ID NO: 195768 - DNA, 20 bp, human
gccttcccgggtcgacacgg

SEQ ID NO: 195769 - DNA, 20 bp, human
gtgggccgcgtagttgagag

SEQ ID NO: 195770 - DNA, 20 bp, human
ggactcctccgtgtcgaccc

SEQ ID NO: 195771 - DNA, 20 bp, human
gggagtctggaatccgtcct

SEQ ID NO: 195772 - DNA, 20 bp, human
ggctccttcccgggtcgaca

SEQ ID NO: 195773 - DNA, 20 bp, human
gtccctggaaccctcgaccg

SEQ ID NO: 195774 - DNA, 20 bp, human
gcgtgaggtggcactgccat

SEQ ID NO: 195775 - DNA, 20 bp, human
gattcaccacgtgggaaaag

SEQ ID NO: 195776 - DNA, 20 bp, human
gccatggaagtgctcaagtg

SEQ ID NO: 195777 - DNA, 20 bp, human
gtcaagtgtggtatacactc

SEQ ID NO: 195778 - DNA, 20 bp, human
gaaaaccagaatattgtgat

SEQ ID NO: 195779 - DNA, 20 bp, human
gattcgccccccggttcaag

SEQ ID NO: 195780 - DNA, 20 bp, human
gttttccaatcacaatattc

SEQ ID NO: 195781 - DNA, 20 bp, human
gtagcagaaatttttttgtg

SEQ ID NO: 195782 - DNA, 20 bp, human
gggctgcaacattcgccccc

SEQ ID NO: 195783 - DNA, 20 bp, human
gacctgaggtcagaagctcg

SEQ ID NO: 195784 - DNA, 20 bp, human
gtctggtttttgctttggtt

SEQ ID NO: 195785 - DNA, 20 bp, human
ggcaagttagcatttggcca

SEQ ID NO: 195786 - DNA, 20 bp, human
gccaacgccattgagggtaa

SEQ ID NO: 195787 - DNA, 20 bp, human
gtggcttccaacgccattga

SEQ ID NO: 195788 - DNA, 20 bp, human
gaacacaagttcacacatcc

SEQ ID NO: 195789 - DNA, 20 bp, human
gtaagtatgtggaatcgttt

SEQ ID NO: 195790 - DNA, 20 bp, human
gttgtgttcctcgatttcac

SEQ ID NO: 195791 - DNA, 20 bp, human
gaacagtatgtagtcttctt

SEQ ID NO: 195792 - DNA, 20 bp, human
gtagcagaaatttttttgtg

SEQ ID NO: 195793 - DNA, 20 bp, human
gtaatttatgttgggttgaa

SEQ ID NO: 195794 - DNA, 20 bp, human
gctgagaccgttaccctcaa

SEQ ID NO: 195795 - DNA, 20 bp, human
ggaaatcaccagtgaaatcg

SEQ ID NO: 195796 - DNA, 20 bp, human
gccgccacgctgggaaccta

SEQ ID NO: 195797 - DNA, 20 bp, human
ggcgtagtctggagctatgg

SEQ ID NO: 195798 - DNA, 20 bp, human
gtctggagctatggtggtgg

SEQ ID NO: 195799 - DNA, 20 bp, human
gtagtctggagctatggtgg

SEQ ID NO: 195800 - DNA, 20 bp, human
gggtgcgtagtctggagcta

SEQ ID NO: 195801 - DNA, 20 bp, human
ggcaggaagcccggactgac

SEQ ID NO: 195802 - DNA, 20 bp, human
gtggcggatccggtcagtcc

SEQ ID NO: 195803 - DNA, 20 bp, human
ggtggcagccgcgccgaacc

SEQ ID NO: 195804 - DNA, 20 bp, human
ggagaaggcgctgaggaggt

SEQ ID NO: 195805 - DNA, 20 bp, human
gcggtgcgcggtgcgtagtc

SEQ ID NO: 195806 - DNA, 20 bp, human
gacctcttttatgcctccag

SEQ ID NO: 195807 - DNA, 20 bp, human
gaccactggaggcataaaag

SEQ ID NO: 195808 - DNA, 20 bp, human
ggtttgactcaggttatgac

SEQ ID NO: 195809 - DNA, 20 bp, human
gggaagtttaaggctcccct

SEQ ID NO: 195810 - DNA, 20 bp, human
ggaagtgcactgaccactgg

SEQ ID NO: 195811 - DNA, 20 bp, human
ggtctgtgagataaagaaca

SEQ ID NO: 195812 - DNA, 20 bp, human
gggactaacctgctttcccc

SEQ ID NO: 195813 - DNA, 20 bp, human
ggggctttcgaggtgggtgt

SEQ ID NO: 195814 - DNA, 20 bp, human
ggccaggatgagaagtctca

SEQ ID NO: 195815 - DNA, 20 bp, human
gagagagcagatgccaagga

SEQ ID NO: 195816 - DNA, 20 bp, human
ggtttgactcgggttttgac

SEQ ID NO: 195817 - DNA, 20 bp, human
gactaaactgctgtctccag

SEQ ID NO: 195818 - DNA, 20 bp, human
gagagagcagatgccaagga

SEQ ID NO: 195819 - DNA, 20 bp, human
ggccaggatgagaagtctca

SEQ ID NO: 195820 - DNA, 20 bp, human
gtgcagggagagtgaggatc

SEQ ID NO: 195821 - DNA, 20 bp, human
gagtgagagagcagatgcca

SEQ ID NO: 195822 - DNA, 20 bp, human
gttctcatcctggccctcct

SEQ ID NO: 195823 - DNA, 20 bp, human
ggccatgagacttctcatcc

SEQ ID NO: 195824 - DNA, 20 bp, human
gaataagcacaggccctgag

SEQ ID NO: 195825 - DNA, 20 bp, human
gaatgttagctatggattag

SEQ ID NO: 195826 - DNA, 20 bp, human
gcctcaagacgcatgtaaag

SEQ ID NO: 195827 - DNA, 20 bp, human
gtgtaaagaggtgtagattc

SEQ ID NO: 195828 - DNA, 20 bp, human
gatgcgtcttgaggcagaaa

SEQ ID NO: 195829 - DNA, 20 bp, human
ggcttaagaactcctgatat

SEQ ID NO: 195830 - DNA, 20 bp, human
gtgggaaatccctataccaa

SEQ ID NO: 195831 - DNA, 20 bp, human
gaaggaataagagccttcag

SEQ ID NO: 195832 - DNA, 20 bp, human
gggtctcatcatgttaggta

SEQ ID NO: 195833 - DNA, 20 bp, human
gatgttaggtaaggaactcc

SEQ ID NO: 195834 - DNA, 20 bp, human
gaagtccaggagttccggat

SEQ ID NO: 195835 - DNA, 20 bp, human
gtatttactagccctccagg

SEQ ID NO: 195836 - DNA, 20 bp, human
ggtgaggtacctggagttcg

SEQ ID NO: 195837 - DNA, 20 bp, human
gctcttaggagtgaggtacc

SEQ ID NO: 195838 - DNA, 20 bp, human
gctccactactgcagagagt

SEQ ID NO: 195839 - DNA, 20 bp, human
ggcacagacaagatactcag

SEQ ID NO: 195840 - DNA, 20 bp, human
ggttggggtccccgaactcc

SEQ ID NO: 195841 - DNA, 20 bp, human
ggctgtcattgtcacaggtt

SEQ ID NO: 195842 - DNA, 20 bp, human
ggaaaggggagttgagttct

SEQ ID NO: 195843 - DNA, 20 bp, human
gctcagaggccaaagaatga

SEQ ID NO: 195844 - DNA, 20 bp, human
gagggaagaagaccttctcg

SEQ ID NO: 195845 - DNA, 20 bp, human
gtgccaactctctgcagtag

SEQ ID NO: 195846 - DNA, 20 bp, human
gccaagcggattgtgagacc

SEQ ID NO: 195847 - DNA, 20 bp, human
gggaactgccagaaacaaat

SEQ ID NO: 195848 - DNA, 20 bp, human
gaaacctgtgggaccagtgt

SEQ ID NO: 195849 - DNA, 20 bp, human
gggagactaagagcgatggg

SEQ ID NO: 195850 - DNA, 20 bp, human
ggtgcctacactggtcccac

SEQ ID NO: 195851 - DNA, 20 bp, human
gcaggatgcaagaacctcag

SEQ ID NO: 195852 - DNA, 20 bp, human
gtccacagctgaaaacctgt

SEQ ID NO: 195853 - DNA, 20 bp, human
gttgcccaatgggattagaa

SEQ ID NO: 195854 - DNA, 20 bp, human
gctgggaattagatccagaa

SEQ ID NO: 195855 - DNA, 20 bp, human
gcgactgagtgtgcctacac

SEQ ID NO: 195856 - DNA, 20 bp, human
gtcggcagtccgaggaaccc

SEQ ID NO: 195857 - DNA, 20 bp, human
ggggccgggccacccctgat

SEQ ID NO: 195858 - DNA, 20 bp, human
gccgaagtgtgtccacgtca

SEQ ID NO: 195859 - DNA, 20 bp, human
ggccggcccgagggaagtgg

SEQ ID NO: 195860 - DNA, 20 bp, human
gagcgccggcccgagggaag

SEQ ID NO: 195861 - DNA, 20 bp, human
gggtggagtgtgtctggaga

SEQ ID NO: 195862 - DNA, 20 bp, human
ggaacccgggcaagcagccg

SEQ ID NO: 195863 - DNA, 20 bp, human
gccaagccgcagagcggagt

SEQ ID NO: 195864 - DNA, 20 bp, human
gtcctccgggaccctcccct

SEQ ID NO: 195865 - DNA, 20 bp, human
gggcgcgtgagggagacgaa

SEQ ID NO: 195866 - DNA, 20 bp, human
gcccatgggagctctcagag

SEQ ID NO: 195867 - DNA, 20 bp, human
gtgaagctagcagaaaggat

SEQ ID NO: 195868 - DNA, 20 bp, human
ggcagcaagaaggtgtctgt

SEQ ID NO: 195869 - DNA, 20 bp, human
ggcctgcctgaagcttccct

SEQ ID NO: 195870 - DNA, 20 bp, human
gtaggaatggctctgagtag

SEQ ID NO: 195871 - DNA, 20 bp, human
gaggcctgaagctagcagaa

SEQ ID NO: 195872 - DNA, 20 bp, human
ggaaaggataggctcctgcc

SEQ ID NO: 195873 - DNA, 20 bp, human
gtggagtgcctcaggcttca

SEQ ID NO: 195874 - DNA, 20 bp, human
gggcatgatccagaaaggcc

SEQ ID NO: 195875 - DNA, 20 bp, human
gctctcagagtggctgccac

SEQ ID NO: 195876 - DNA, 20 bp, human
gggaggcccgctccactgaa

SEQ ID NO: 195877 - DNA, 20 bp, human
gctgaaagcaatgggtgcag

SEQ ID NO: 195878 - DNA, 20 bp, human
gtgcttgatagacccttcag

SEQ ID NO: 195879 - DNA, 20 bp, human
gtaaggtcaatgaagaccat

SEQ ID NO: 195880 - DNA, 20 bp, human
gatcaagcaagtagatggga

SEQ ID NO: 195881 - DNA, 20 bp, human
gttggctgtacatgaaacaa

SEQ ID NO: 195882 - DNA, 20 bp, human
gccagtcccctgaaagcaat

SEQ ID NO: 195883 - DNA, 20 bp, human
gatagacccttcagtggagc

SEQ ID NO: 195884 - DNA, 20 bp, human
gcttcaacttacaaataaga

SEQ ID NO: 195885 - DNA, 20 bp, human
gggtctatcaagcaagtaga

SEQ ID NO: 195886 - DNA, 20 bp, human
ggctctgcgcagcccgccga

SEQ ID NO: 195887 - DNA, 20 bp, human
gttcgtggccgagacaacgg

SEQ ID NO: 195888 - DNA, 20 bp, human
gagatcaggctacaggaccg

SEQ ID NO: 195889 - DNA, 20 bp, human
gtcgagcaggtggggagatc

SEQ ID NO: 195890 - DNA, 20 bp, human
gctgttcgtggccgagacaa

SEQ ID NO: 195891 - DNA, 20 bp, human
ggggcccgcgtgccctcggc

SEQ ID NO: 195892 - DNA, 20 bp, human
gggtgcagcagcagtacgag

SEQ ID NO: 195893 - DNA, 20 bp, human
gtctgcacgcacctgaaaag

SEQ ID NO: 195894 - DNA, 20 bp, human
gggctacaggaccgaggctg

SEQ ID NO: 195895 - DNA, 20 bp, human
gcagcagcagtacgagcggg

SEQ ID NO: 195896 - DNA, 20 bp, human
gtgctaatacaagagacagt

SEQ ID NO: 195897 - DNA, 20 bp, human
gaaggaagcgagaaaaaata

SEQ ID NO: 195898 - DNA, 20 bp, human
gaatcaggagcctaattata

SEQ ID NO: 195899 - DNA, 20 bp, human
gatactcagcaagatttcga

SEQ ID NO: 195900 - DNA, 20 bp, human
gatttgctttccaggtatat

SEQ ID NO: 195901 - DNA, 20 bp, human
gcataatagagctttctaga

SEQ ID NO: 195902 - DNA, 20 bp, human
gacaaagcatctcaaaaatc

SEQ ID NO: 195903 - DNA, 20 bp, human
gtgtttattgccaatatacc

SEQ ID NO: 195904 - DNA, 20 bp, human
gtaatacaagagacagtggg

SEQ ID NO: 195905 - DNA, 20 bp, human
ggtctcttgtattagcatca

SEQ ID NO: 195906 - DNA, 20 bp, human
gggcagcagcgaagccggga

SEQ ID NO: 195907 - DNA, 20 bp, human
gtgcagaactcggaccactc

SEQ ID NO: 195908 - DNA, 20 bp, human
gggccgctaaatcagacggg

SEQ ID NO: 195909 - DNA, 20 bp, human
gcatggccgctaaatcagac

SEQ ID NO: 195910 - DNA, 20 bp, human
gggccatgatgcctccacac

SEQ ID NO: 195911 - DNA, 20 bp, human
gctccggtgtggaggcatca

SEQ ID NO: 195912 - DNA, 20 bp, human
ggcaggtccgaggagcgccg

SEQ ID NO: 195913 - DNA, 20 bp, human
gagaggaatgtgcaggtccg

SEQ ID NO: 195914 - DNA, 20 bp, human
gggagggctctcctccggtg

SEQ ID NO: 195915 - DNA, 20 bp, human
gcctcggctcccgaccccga

SEQ ID NO: 195916 - DNA, 20 bp, human
ggatgcacgcgaggctcctg

SEQ ID NO: 195917 - DNA, 20 bp, human
gaagcttgtgatggaaggaa

SEQ ID NO: 195918 - DNA, 20 bp, human
gggcatctactaaggacggg

SEQ ID NO: 195919 - DNA, 20 bp, human
gagcagagcgcgcgtgagtg

SEQ ID NO: 195920 - DNA, 20 bp, human
gaggggggggaaccgagcat

SEQ ID NO: 195921 - DNA, 20 bp, human
ggggccgcgtgcaggggaag

SEQ ID NO: 195922 - DNA, 20 bp, human
gcatgcgtgggcatctacta

SEQ ID NO: 195923 - DNA, 20 bp, human
ggggcggggggatcgtgcat

SEQ ID NO: 195924 - DNA, 20 bp, human
ggtgggcatctactaaggac

SEQ ID NO: 195925 - DNA, 20 bp, human
ggcaggctgcggggtcggca

SEQ ID NO: 195926 - DNA, 20 bp, human
ggagctgcgacgctgaggaa

SEQ ID NO: 195927 - DNA, 20 bp, human
gggcggtccaaagtgatccc

SEQ ID NO: 195928 - DNA, 20 bp, human
gcatcttggccgggagggta

SEQ ID NO: 195929 - DNA, 20 bp, human
gaaggggaccccaaaacgtc

SEQ ID NO: 195930 - DNA, 20 bp, human
gtggcggcgaaatccgatgg

SEQ ID NO: 195931 - DNA, 20 bp, human
ggctgtgagctgcgacgctg

SEQ ID NO: 195932 - DNA, 20 bp, human
gcagccccagtagcacgagg

SEQ ID NO: 195933 - DNA, 20 bp, human
gaatccggctggcccgagtg

SEQ ID NO: 195934 - DNA, 20 bp, human
gcagctgcacaacctggacg

SEQ ID NO: 195935 - DNA, 20 bp, human
gagatggcggcgaaatccga

SEQ ID NO: 195936 - DNA, 20 bp, human
ggccatgttggcggagaggg

SEQ ID NO: 195937 - DNA, 20 bp, human
ggccgcgaagtcggatggag

SEQ ID NO: 195938 - DNA, 20 bp, human
ggcgccttccggaccaaaga

SEQ ID NO: 195939 - DNA, 20 bp, human
ggagcacgaacagcaaggtg

SEQ ID NO: 195940 - DNA, 20 bp, human
gccaaggacagcgtagccgg

SEQ ID NO: 195941 - DNA, 20 bp, human
ggtagtcgtagacgaaccag

SEQ ID NO: 195942 - DNA, 20 bp, human
gcacaggtccgtggcaccgt

SEQ ID NO: 195943 - DNA, 20 bp, human
ggcgaagtcggatggagcgg

SEQ ID NO: 195944 - DNA, 20 bp, human
ggacttcgcggccatgttgg

SEQ ID NO: 195945 - DNA, 20 bp, human
gacatggccgcgaagtcgga

SEQ ID NO: 195946 - DNA, 20 bp, human
gtgagggcaggccccaaccg

SEQ ID NO: 195947 - DNA, 20 bp, human
ggggcaggccccaaccgcgg

SEQ ID NO: 195948 - DNA, 20 bp, human
gtgagtgcttcgccccggga

SEQ ID NO: 195949 - DNA, 20 bp, human
gtcagggcccggggttgccg

SEQ ID NO: 195950 - DNA, 20 bp, human
ggtacaggtgacccagctga

SEQ ID NO: 195951 - DNA, 20 bp, human
gctcggcggccgctacctgt

SEQ ID NO: 195952 - DNA, 20 bp, human
gcagcgccgcccacaggtag

SEQ ID NO: 195953 - DNA, 20 bp, human
gttcctgcctcggcaacccc

SEQ ID NO: 195954 - DNA, 20 bp, human
gccgccgagcgcatactgga

SEQ ID NO: 195955 - DNA, 20 bp, human
gcgacactcctcccctcccg

SEQ ID NO: 195956 - DNA, 20 bp, human
ggcaccagcccccgtgacag

SEQ ID NO: 195957 - DNA, 20 bp, human
gtctaggacacaaacccgtg

SEQ ID NO: 195958 - DNA, 20 bp, human
ggggctgcgcgggcagtggt

SEQ ID NO: 195959 - DNA, 20 bp, human
gaaggctggcgcgaggcgtg

SEQ ID NO: 195960 - DNA, 20 bp, human
gcaggcgagtggatccaagt

SEQ ID NO: 195961 - DNA, 20 bp, human
gaggtggcgtgaggcgaagc

SEQ ID NO: 195962 - DNA, 20 bp, human
ggagccactgcctaaaaatc

SEQ ID NO: 195963 - DNA, 20 bp, human
gctggaatctgcctctgtca

SEQ ID NO: 195964 - DNA, 20 bp, human
gtggtgggaaggctggcgcg

SEQ ID NO: 195965 - DNA, 20 bp, human
ggggggcggtgcggaactag

SEQ ID NO: 195966 - DNA, 20 bp, human
gagcaatagctaggatacct

SEQ ID NO: 195967 - DNA, 20 bp, human
gctgagagcgcgcaggtgag

SEQ ID NO: 195968 - DNA, 20 bp, human
gatctgagtctagaagagag

SEQ ID NO: 195969 - DNA, 20 bp, human
gatcctgagaaccctggact

SEQ ID NO: 195970 - DNA, 20 bp, human
gggtgtagccgatctgtcgg

SEQ ID NO: 195971 - DNA, 20 bp, human
gggagctatcctgagaaccc

SEQ ID NO: 195972 - DNA, 20 bp, human
gctaggctgtagctatcagc

SEQ ID NO: 195973 - DNA, 20 bp, human
gagtctgggatggaaagccc

SEQ ID NO: 195974 - DNA, 20 bp, human
gcggctacaccctgcctgag

SEQ ID NO: 195975 - DNA, 20 bp, human
ggaagagcgggcgcagaaga

SEQ ID NO: 195976 - DNA, 20 bp, human
gggagctaggtcctcggagt

SEQ ID NO: 195977 - DNA, 20 bp, human
gcctcggagtgggccagaga

SEQ ID NO: 195978 - DNA, 20 bp, human
gcgtcggccgccgccatctc

SEQ ID NO: 195979 - DNA, 20 bp, human
gggaggcccgcgtgcgacag

SEQ ID NO: 195980 - DNA, 20 bp, human
gagtgggccagagatggcgg

SEQ ID NO: 195981 - DNA, 20 bp, human
gggtgcagcgaagaaggccc

SEQ ID NO: 195982 - DNA, 20 bp, human
ggagctgggagctaggtcct

SEQ ID NO: 195983 - DNA, 20 bp, human
ggcacgcgcactgcacgccg

SEQ ID NO: 195984 - DNA, 20 bp, human
gaccgaggcaggcagctccg

SEQ ID NO: 195985 - DNA, 20 bp, human
gtggacaggacgctttgaca

SEQ ID NO: 195986 - DNA, 20 bp, human
gtgcgcagttcgcgtccccg

SEQ ID NO: 195987 - DNA, 20 bp, human
gccagacaagcaacatggct

SEQ ID NO: 195988 - DNA, 20 bp, human
gtcagggttgaactcggaga

SEQ ID NO: 195989 - DNA, 20 bp, human
gctgcgcagccagaaatcca

SEQ ID NO: 195990 - DNA, 20 bp, human
gcagggcgggagtccagacg

SEQ ID NO: 195991 - DNA, 20 bp, human
gtttgcccagacaagcaaca

SEQ ID NO: 195992 - DNA, 20 bp, human
gaacatggctcggaaacgcg

SEQ ID NO: 195993 - DNA, 20 bp, human
ggaagacagacggacggacc

SEQ ID NO: 195994 - DNA, 20 bp, human
gggcgggagtccagacgcgg

SEQ ID NO: 195995 - DNA, 20 bp, human
gctgtatcctctggacaacg

SEQ ID NO: 195996 - DNA, 20 bp, human
gctgtgtaaagaccacagga

SEQ ID NO: 195997 - DNA, 20 bp, human
ggtccctgtgtaaagaccac

SEQ ID NO: 195998 - DNA, 20 bp, human
gtatttaggagaaggagcac

SEQ ID NO: 195999 - DNA, 20 bp, human
gcctctggtgactgtcaatg

SEQ ID NO: 196000 - DNA, 20 bp, human
gttagcttgaatggaacact

SEQ ID NO: 196001 - DNA, 20 bp, human
gaggcacaccatctgaagag

SEQ ID NO: 196002 - DNA, 20 bp, human
gggcagcactatttaggaga

SEQ ID NO: 196003 - DNA, 20 bp, human
gtagagaggcagcactattt

SEQ ID NO: 196004 - DNA, 20 bp, human
gcagatggtgtgccttcttg

SEQ ID NO: 196005 - DNA, 20 bp, human
gcacagataaggttgtacta

SEQ ID NO: 196006 - DNA, 20 bp, human
ggtctgcgctcccctgacgt

SEQ ID NO: 196007 - DNA, 20 bp, human
ggccaccgcgagtaaggtga

SEQ ID NO: 196008 - DNA, 20 bp, human
gtctggaggctgccattcgg

SEQ ID NO: 196009 - DNA, 20 bp, human
gactcgcggtggctttctgg

SEQ ID NO: 196010 - DNA, 20 bp, human
gtgctgcactcggcctgagg

SEQ ID NO: 196011 - DNA, 20 bp, human
gtaaggtgagggcactccgc

SEQ ID NO: 196012 - DNA, 20 bp, human
gcgcgggccaggaactgtga

SEQ ID NO: 196013 - DNA, 20 bp, human
gggggcacgtcaccgccgaa

SEQ ID NO: 196014 - DNA, 20 bp, human
ggcgtccaggaaccagactc

SEQ ID NO: 196015 - DNA, 20 bp, human
gcacctccccggacacgaag

SEQ ID NO: 196016 - DNA, 20 bp, human
gctctgagctcagaaagggt

SEQ ID NO: 196017 - DNA, 20 bp, human
gtgggtggatggagggacaa

SEQ ID NO: 196018 - DNA, 20 bp, human
gttgaggaagagacacctca

SEQ ID NO: 196019 - DNA, 20 bp, human
gtagggtgtgaggctatcct

SEQ ID NO: 196020 - DNA, 20 bp, human
gttatgagggcccccaacac

SEQ ID NO: 196021 - DNA, 20 bp, human
gtcttcctcaagtcagagag

SEQ ID NO: 196022 - DNA, 20 bp, human
gcctgggctcgagcagacag

SEQ ID NO: 196023 - DNA, 20 bp, human
gccagtgagcccgggccata

SEQ ID NO: 196024 - DNA, 20 bp, human
ggacacctcagggccagtgt

SEQ ID NO: 196025 - DNA, 20 bp, human
gaacttgcacagtccgcctc

SEQ ID NO: 196026 - DNA, 20 bp, human
gagagaaagagggtaacgac

SEQ ID NO: 196027 - DNA, 20 bp, human
gctacagcgggaaccagctt

SEQ ID NO: 196028 - DNA, 20 bp, human
gcgcgtcgggaagagaaaga

SEQ ID NO: 196029 - DNA, 20 bp, human
gtacggcctaactcacgcgt

SEQ ID NO: 196030 - DNA, 20 bp, human
ggccgcgtcgccaggaaacc

SEQ ID NO: 196031 - DNA, 20 bp, human
gtccgccggaaggggaggtg

SEQ ID NO: 196032 - DNA, 20 bp, human
gtggaagacagcccctctgg

SEQ ID NO: 196033 - DNA, 20 bp, human
gagaagggtcagccgaacca

SEQ ID NO: 196034 - DNA, 20 bp, human
ggagagcagccaaggcatta

SEQ ID NO: 196035 - DNA, 20 bp, human
gcaccatgggaggagaccgt

SEQ ID NO: 196036 - DNA, 20 bp, human
gcgccggagccgcgtgagag

SEQ ID NO: 196037 - DNA, 20 bp, human
gctggaacaggcaccgccgc

SEQ ID NO: 196038 - DNA, 20 bp, human
gtggctggagggtccccctg

SEQ ID NO: 196039 - DNA, 20 bp, human
gacagtagctacagccccgg

SEQ ID NO: 196040 - DNA, 20 bp, human
ggcagaagcggcaggagtag

SEQ ID NO: 196041 - DNA, 20 bp, human
gggactgcagcagcaaagac

SEQ ID NO: 196042 - DNA, 20 bp, human
gaaatgctcccgcccggctg

SEQ ID NO: 196043 - DNA, 20 bp, human
gcaaaaggggaattaatctg

SEQ ID NO: 196044 - DNA, 20 bp, human
ggcaacagtagctacagccc

SEQ ID NO: 196045 - DNA, 20 bp, human
gagtttgaggcactaggagg

SEQ ID NO: 196046 - DNA, 20 bp, human
gtgaagagagaccatgatgg

SEQ ID NO: 196047 - DNA, 20 bp, human
gcattgaagagagaccatga

SEQ ID NO: 196048 - DNA, 20 bp, human
gccccgcagggcttcggtag

SEQ ID NO: 196049 - DNA, 20 bp, human
gcaaggcgccgggaaggagt

SEQ ID NO: 196050 - DNA, 20 bp, human
gtcctggaaggaggggacga

SEQ ID NO: 196051 - DNA, 20 bp, human
ggataaccccaactccttcc

SEQ ID NO: 196052 - DNA, 20 bp, human
ggtctgtggggcagggtgta

SEQ ID NO: 196053 - DNA, 20 bp, human
ggcgaatcccggggtctgag

SEQ ID NO: 196054 - DNA, 20 bp, human
ggctctgcgacccagtctgt

SEQ ID NO: 196055 - DNA, 20 bp, human
gggttatccccgcagggctt

SEQ ID NO: 196056 - DNA, 20 bp, human
gcctcggcgagaccacccgt

SEQ ID NO: 196057 - DNA, 20 bp, human
gcaggagcggcgagtagaga

SEQ ID NO: 196058 - DNA, 20 bp, human
gcgaggcacgacagctccct

SEQ ID NO: 196059 - DNA, 20 bp, human
ggcggcccggtaccaacggg

SEQ ID NO: 196060 - DNA, 20 bp, human
ggccgcggcccggtaccaac

SEQ ID NO: 196061 - DNA, 20 bp, human
ggttgggaaaggaggtccag

SEQ ID NO: 196062 - DNA, 20 bp, human
gccgcgaggggaaggtcccg

SEQ ID NO: 196063 - DNA, 20 bp, human
gcgtggtcccgggactgcag

SEQ ID NO: 196064 - DNA, 20 bp, human
gtaccggctggaagccctca

SEQ ID NO: 196065 - DNA, 20 bp, human
ggagaccacccgttggtacc

SEQ ID NO: 196066 - DNA, 20 bp, human
gcgtgtgggttgaggctgcg

SEQ ID NO: 196067 - DNA, 20 bp, human
ggcggccgcgcggtactagc

SEQ ID NO: 196068 - DNA, 20 bp, human
ggccgcgcggtactagcggg

SEQ ID NO: 196069 - DNA, 20 bp, human
gcgcgcgcaaggatgctcta

SEQ ID NO: 196070 - DNA, 20 bp, human
ggccgcccgctagtaccgcg

SEQ ID NO: 196071 - DNA, 20 bp, human
gcccgatgaggcgacccggg

SEQ ID NO: 196072 - DNA, 20 bp, human
ggcggcggcagtggccgtgt

SEQ ID NO: 196073 - DNA, 20 bp, human
ggcgcgttggggctgttggt

SEQ ID NO: 196074 - DNA, 20 bp, human
ggctcggatgccggcgagga

SEQ ID NO: 196075 - DNA, 20 bp, human
gggccccgaggctgaacggg

SEQ ID NO: 196076 - DNA, 20 bp, human
gtccggccgaggtgcgcgct

SEQ ID NO: 196077 - DNA, 20 bp, human
gagggggcgaccacgaagag

SEQ ID NO: 196078 - DNA, 20 bp, human
gggccggagaggagcatgaa

SEQ ID NO: 196079 - DNA, 20 bp, human
gggcgcagcggcgacggcgt

SEQ ID NO: 196080 - DNA, 20 bp, human
ggggcccgaggacttgacgg

SEQ ID NO: 196081 - DNA, 20 bp, human
gcgccccccggtgaagcgag

SEQ ID NO: 196082 - DNA, 20 bp, human
gtccccctcgcttcaccggg

SEQ ID NO: 196083 - DNA, 20 bp, human
gttgacggaggcctcccccg

SEQ ID NO: 196084 - DNA, 20 bp, human
gaggcctccgtcaagtcctc

SEQ ID NO: 196085 - DNA, 20 bp, human
ggagcggcgagtggagtcgg

SEQ ID NO: 196086 - DNA, 20 bp, human
gggagtcccgacgccaggga

SEQ ID NO: 196087 - DNA, 20 bp, human
gctggctgggcggaccgggt

SEQ ID NO: 196088 - DNA, 20 bp, human
gggggacgcagagcgactag

SEQ ID NO: 196089 - DNA, 20 bp, human
gtctatggcggtgcaccccc

SEQ ID NO: 196090 - DNA, 20 bp, human
ggcaggcttgggaccctcta

SEQ ID NO: 196091 - DNA, 20 bp, human
gatgggagcaaggctagcag

SEQ ID NO: 196092 - DNA, 20 bp, human
gggcttgggaccctctatgg

SEQ ID NO: 196093 - DNA, 20 bp, human
ggagcaaggctagcagagga

SEQ ID NO: 196094 - DNA, 20 bp, human
gaaccgccggccacgcactc

SEQ ID NO: 196095 - DNA, 20 bp, human
ggcactcgggacgcgctcct

SEQ ID NO: 196096 - DNA, 20 bp, human
gccgcgccggggcccatgtg

SEQ ID NO: 196097 - DNA, 20 bp, human
ggggagtgatgtgcgcggag

SEQ ID NO: 196098 - DNA, 20 bp, human
gtgctctgaagagacctcgg

SEQ ID NO: 196099 - DNA, 20 bp, human
gtctgaagagacctcggcgg

SEQ ID NO: 196100 - DNA, 20 bp, human
gatgccgcagtggctccccg

SEQ ID NO: 196101 - DNA, 20 bp, human
gctgccgcggggagccactg

SEQ ID NO: 196102 - DNA, 20 bp, human
gtgcatatccgttaccccgg

SEQ ID NO: 196103 - DNA, 20 bp, human
gagcgggtcaaagtctgccc

SEQ ID NO: 196104 - DNA, 20 bp, human
gcgggtccagcagctacagg

SEQ ID NO: 196105 - DNA, 20 bp, human
gcacagggagccagctgaag

SEQ ID NO: 196106 - DNA, 20 bp, human
gttcttccagacaccaatcc

SEQ ID NO: 196107 - DNA, 20 bp, human
ggtagagtatggggtccgag

SEQ ID NO: 196108 - DNA, 20 bp, human
gcccgtggaagttcacctat

SEQ ID NO: 196109 - DNA, 20 bp, human
gcatggcggaggcggatctc

SEQ ID NO: 196110 - DNA, 20 bp, human
gaggccttgggaggactcaa

SEQ ID NO: 196111 - DNA, 20 bp, human
ggctgctgcaggacacgaca

SEQ ID NO: 196112 - DNA, 20 bp, human
gccacgggaaagtgttgtag

SEQ ID NO: 196113 - DNA, 20 bp, human
ggtgttgtaggggaaactcc

SEQ ID NO: 196114 - DNA, 20 bp, human
gactccaggcagagtgtcgg

SEQ ID NO: 196115 - DNA, 20 bp, human
gcgggagagcttaaatctgg

SEQ ID NO: 196116 - DNA, 20 bp, human
ggcactacacatcgccccga

SEQ ID NO: 196117 - DNA, 20 bp, human
ggatgtgtagtgccttccat

SEQ ID NO: 196118 - DNA, 20 bp, human
gaccaactgcgcagactcta

SEQ ID NO: 196119 - DNA, 20 bp, human
gggtcccagactcagcccta

SEQ ID NO: 196120 - DNA, 20 bp, human
gacacatcgccccgaaggct

SEQ ID NO: 196121 - DNA, 20 bp, human
gttagaccataactcttggg

SEQ ID NO: 196122 - DNA, 20 bp, human
gaggactccaggctgcccag

SEQ ID NO: 196123 - DNA, 20 bp, human
gcgcagttggtgaatggcgt

SEQ ID NO: 196124 - DNA, 20 bp, human
gagtctgcgcagttggtgaa

SEQ ID NO: 196125 - DNA, 20 bp, human
ggggagccgagggaacccgg

SEQ ID NO: 196126 - DNA, 20 bp, human
gggagtgcggaacccgcggg

SEQ ID NO: 196127 - DNA, 20 bp, human
ggccgagaggagcaggacgg

SEQ ID NO: 196128 - DNA, 20 bp, human
gggacgagcgaaggcatcga

SEQ ID NO: 196129 - DNA, 20 bp, human
gcggcgggcctcacctcccg

SEQ ID NO: 196130 - DNA, 20 bp, human
gaagccagcgcggtcccagg

SEQ ID NO: 196131 - DNA, 20 bp, human
ggcggaacccgcgggaggtg

SEQ ID NO: 196132 - DNA, 20 bp, human
gagaggagtgcggaacccgc

SEQ ID NO: 196133 - DNA, 20 bp, human
gaggtgaggcccgccgagcc

SEQ ID NO: 196134 - DNA, 20 bp, human
gcggggtcggaggtcgtggg

SEQ ID NO: 196135 - DNA, 20 bp, human
ggtcccaggcggacgagcga

SEQ ID NO: 196136 - DNA, 20 bp, human
gcggaagtagagtcacggag

SEQ ID NO: 196137 - DNA, 20 bp, human
ggaggtaggatccggaagtg

SEQ ID NO: 196138 - DNA, 20 bp, human
ggataccggaagtagagtca

SEQ ID NO: 196139 - DNA, 20 bp, human
ggtcacggagaggtaggatc

SEQ ID NO: 196140 - DNA, 20 bp, human
gcgggcgttttggaagatac

SEQ ID NO: 196141 - DNA, 20 bp, human
gaaagaggcagccccacttc

SEQ ID NO: 196142 - DNA, 20 bp, human
gggaggacggttgaatccag

SEQ ID NO: 196143 - DNA, 20 bp, human
gccagagggtagtgttgagt

SEQ ID NO: 196144 - DNA, 20 bp, human
ggggttccaaccaggcatcg

SEQ ID NO: 196145 - DNA, 20 bp, human
gccagatattggtaaactgt

SEQ ID NO: 196146 - DNA, 20 bp, human
gcgctttggtcgcttcttcc

SEQ ID NO: 196147 - DNA, 20 bp, human
gcaccatgttgccggtcctc

SEQ ID NO: 196148 - DNA, 20 bp, human
ggaccaaagcgcctgaggac

SEQ ID NO: 196149 - DNA, 20 bp, human
gccaggctcggaagtaatag

SEQ ID NO: 196150 - DNA, 20 bp, human
gatggggcaagagaagatca

SEQ ID NO: 196151 - DNA, 20 bp, human
gccggaagcgagttgcgaca

SEQ ID NO: 196152 - DNA, 20 bp, human
gggaagtaatagaggaagtg

SEQ ID NO: 196153 - DNA, 20 bp, human
gatggtgcggtcggggaata

SEQ ID NO: 196154 - DNA, 20 bp, human
gaagagaagatcatggtggt

SEQ ID NO: 196155 - DNA, 20 bp, human
ggaagcgaccaaagcgcctg

SEQ ID NO: 196156 - DNA, 20 bp, human
gataacggcccgcttacctt

SEQ ID NO: 196157 - DNA, 20 bp, human
gcccgcttacctttggcgca

SEQ ID NO: 196158 - DNA, 20 bp, human
gcgcggaagccagatcccgg

SEQ ID NO: 196159 - DNA, 20 bp, human
gcgccggccctgaaacgtga

SEQ ID NO: 196160 - DNA, 20 bp, human
gtccctgcgccaaaggtaag

SEQ ID NO: 196161 - DNA, 20 bp, human
gaccgtctaaatggcgtcgg

SEQ ID NO: 196162 - DNA, 20 bp, human
gggcggtattgaggacgagg

SEQ ID NO: 196163 - DNA, 20 bp, human
ggaacaacacaaatggataa

SEQ ID NO: 196164 - DNA, 20 bp, human
ggttagtcagcatagaatcc

SEQ ID NO: 196165 - DNA, 20 bp, human
ggcccccgacgccatttaga

SEQ ID NO: 196166 - DNA, 20 bp, human
gggaggcatggcgggagctc

SEQ ID NO: 196167 - DNA, 20 bp, human
gcccaggggaatccccagca

SEQ ID NO: 196168 - DNA, 20 bp, human
gaatgggtctgagaccgggt

SEQ ID NO: 196169 - DNA, 20 bp, human
gtggctgggctgaagacgtt

SEQ ID NO: 196170 - DNA, 20 bp, human
gagtaggagccatgacctgg

SEQ ID NO: 196171 - DNA, 20 bp, human
gagaccgggtgggcgaggaa

SEQ ID NO: 196172 - DNA, 20 bp, human
gcggtctcagacccattctg

SEQ ID NO: 196173 - DNA, 20 bp, human
ggacagactgggcatcatgg

SEQ ID NO: 196174 - DNA, 20 bp, human
gacaagtaggagccatgacc

SEQ ID NO: 196175 - DNA, 20 bp, human
gaaccacagcctccaggtca

SEQ ID NO: 196176 - DNA, 20 bp, human
ggcctccggtcgtcgctccg

SEQ ID NO: 196177 - DNA, 20 bp, human
gctcgaaagccccagctcta

SEQ ID NO: 196178 - DNA, 20 bp, human
ggagcgacgaccggaggctg

SEQ ID NO: 196179 - DNA, 20 bp, human
gtccgcggagcgacgaccgg

SEQ ID NO: 196180 - DNA, 20 bp, human
gagagaagccgtgaacccag

SEQ ID NO: 196181 - DNA, 20 bp, human
gtcatccgcggagcgacgac

SEQ ID NO: 196182 - DNA, 20 bp, human
ggaaaccaaacgccccgccg

SEQ ID NO: 196183 - DNA, 20 bp, human
gcgacgaccggaggctgcgg

SEQ ID NO: 196184 - DNA, 20 bp, human
ggaggctgcgaagctggagt

SEQ ID NO: 196185 - DNA, 20 bp, human
gagcggctctgtccacacac

SEQ ID NO: 196186 - DNA, 20 bp, human
gaacgccgggactcccatag

SEQ ID NO: 196187 - DNA, 20 bp, human
gggactcccatagcggcaca

SEQ ID NO: 196188 - DNA, 20 bp, human
gaccaaagagacgggagcag

SEQ ID NO: 196189 - DNA, 20 bp, human
ggccgggaaaaagcgagtag

SEQ ID NO: 196190 - DNA, 20 bp, human
gctccggcaaggctccccgg

SEQ ID NO: 196191 - DNA, 20 bp, human
gggtctcggaagaggttcag

SEQ ID NO: 196192 - DNA, 20 bp, human
gcaaaatgcgcggtctggag

SEQ ID NO: 196193 - DNA, 20 bp, human
gcagggcgcgagctccggca

SEQ ID NO: 196194 - DNA, 20 bp, human
gggcggggcaagggcctata

SEQ ID NO: 196195 - DNA, 20 bp, human
gcatagcggcacacggctgg

SEQ ID NO: 196196 - DNA, 20 bp, human
gtaaggcgtggggaagatag

SEQ ID NO: 196197 - DNA, 20 bp, human
gacgcgacggcagacagtgt

SEQ ID NO: 196198 - DNA, 20 bp, human
gggcaggcaccgcagtggag

SEQ ID NO: 196199 - DNA, 20 bp, human
gtctcggagccgctccactg

SEQ ID NO: 196200 - DNA, 20 bp, human
gcgtcgcgtcgcagttacta

SEQ ID NO: 196201 - DNA, 20 bp, human
gcgacggcagacagtgtagg

SEQ ID NO: 196202 - DNA, 20 bp, human
gatactgcctggcagactgt

SEQ ID NO: 196203 - DNA, 20 bp, human
gcagtgtaggcggcaaccga

SEQ ID NO: 196204 - DNA, 20 bp, human
gatagcggcaggcaccgcag

SEQ ID NO: 196205 - DNA, 20 bp, human
gcggctccgagatccccggg

SEQ ID NO: 196206 - DNA, 20 bp, human
gccggcgtccgggtacccga

SEQ ID NO: 196207 - DNA, 20 bp, human
ggcaacgcgggagagccctc

SEQ ID NO: 196208 - DNA, 20 bp, human
gtacgagaccgcggcgccag

SEQ ID NO: 196209 - DNA, 20 bp, human
ggccagcggtgccagcaacg

SEQ ID NO: 196210 - DNA, 20 bp, human
gcctgagccgaggtagtaga

SEQ ID NO: 196211 - DNA, 20 bp, human
gcaggcggcggccatgaaag

SEQ ID NO: 196212 - DNA, 20 bp, human
gcccatgcgctacgagaccg

SEQ ID NO: 196213 - DNA, 20 bp, human
ggggagagccctcgggtacc

SEQ ID NO: 196214 - DNA, 20 bp, human
ggcctggcgccggggctaag

SEQ ID NO: 196215 - DNA, 20 bp, human
gctgctgatgatgttcacca

SEQ ID NO: 196216 - DNA, 20 bp, human
gcgagtcctccggcccctct

SEQ ID NO: 196217 - DNA, 20 bp, human
gcttacccgaaaggccatgg

SEQ ID NO: 196218 - DNA, 20 bp, human
gaaggaagtcagctactgta

SEQ ID NO: 196219 - DNA, 20 bp, human
gcccgggaagcccgagaggt

SEQ ID NO: 196220 - DNA, 20 bp, human
gcgactatcacgccgcgtgg

SEQ ID NO: 196221 - DNA, 20 bp, human
gagccttacccgaaaggcca

SEQ ID NO: 196222 - DNA, 20 bp, human
ggcattggcagggcatctcc

SEQ ID NO: 196223 - DNA, 20 bp, human
gcccggacgcgggaaaacat

SEQ ID NO: 196224 - DNA, 20 bp, human
gcggcccctctgggcaccgg

SEQ ID NO: 196225 - DNA, 20 bp, human
gggaaactgcaggcgctcct

SEQ ID NO: 196226 - DNA, 20 bp, human
gctccccggccccggagtcg

SEQ ID NO: 196227 - DNA, 20 bp, human
gctggcccggcgctcgcact

SEQ ID NO: 196228 - DNA, 20 bp, human
gagccggctgcagcccgagg

SEQ ID NO: 196229 - DNA, 20 bp, human
gaggcggccccggagaaccg

SEQ ID NO: 196230 - DNA, 20 bp, human
gctgtccccgcggttctccg

SEQ ID NO: 196231 - DNA, 20 bp, human
gctcccctccagcggggaca

SEQ ID NO: 196232 - DNA, 20 bp, human
gtgatggggaaggcgccggg

SEQ ID NO: 196233 - DNA, 20 bp, human
gtggccggctgctgtccccg

SEQ ID NO: 196234 - DNA, 20 bp, human
gatcaccctcccctccagcg

SEQ ID NO: 196235 - DNA, 20 bp, human
gtgccgctcgggctcccgct

SEQ ID NO: 196236 - DNA, 20 bp, human
ggcgagtgcagaagctggtg

SEQ ID NO: 196237 - DNA, 20 bp, human
gtagggtggtctccggccaa

SEQ ID NO: 196238 - DNA, 20 bp, human
ggggggagcaggtcatgcta

SEQ ID NO: 196239 - DNA, 20 bp, human
gctggtgcggcgctacaagc

SEQ ID NO: 196240 - DNA, 20 bp, human
gggagcaggtcatgctaggg

SEQ ID NO: 196241 - DNA, 20 bp, human
gccggccaagggagcgatga

SEQ ID NO: 196242 - DNA, 20 bp, human
gccctggtggattgggagtc

SEQ ID NO: 196243 - DNA, 20 bp, human
ggagcgatgaaggtcaggcg

SEQ ID NO: 196244 - DNA, 20 bp, human
ggtcatgctagggtggtctc

SEQ ID NO: 196245 - DNA, 20 bp, human
gtacaagctggcgattgcca

SEQ ID NO: 196246 - DNA, 20 bp, human
gagacgagtcaaagtaaacg

SEQ ID NO: 196247 - DNA, 20 bp, human
gattgcctcggtgatgtcgt

SEQ ID NO: 196248 - DNA, 20 bp, human
gcatcaccgaggcaattacg

SEQ ID NO: 196249 - DNA, 20 bp, human
gtgaacccacgacatcaccg

SEQ ID NO: 196250 - DNA, 20 bp, human
gaagcagcctccttgatcca

SEQ ID NO: 196251 - DNA, 20 bp, human
gtgttgaggatcacagggaa

SEQ ID NO: 196252 - DNA, 20 bp, human
gcgggatgcgttagaaactg

SEQ ID NO: 196253 - DNA, 20 bp, human
gcctccttgatccagggccc

SEQ ID NO: 196254 - DNA, 20 bp, human
ggggtcggaccgggtcccta

SEQ ID NO: 196255 - DNA, 20 bp, human
gtgcgaccccgtaattgcct

SEQ ID NO: 196256 - DNA, 20 bp, human
gcgggcgctgttacctggtg

SEQ ID NO: 196257 - DNA, 20 bp, human
gggcagcactcgcacaccag

SEQ ID NO: 196258 - DNA, 20 bp, human
gcggcgccggccccctcaag

SEQ ID NO: 196259 - DNA, 20 bp, human
gacaaacagagcggtcgcgg

SEQ ID NO: 196260 - DNA, 20 bp, human
gacacaacccggacacgacg

SEQ ID NO: 196261 - DNA, 20 bp, human
ggcggtgatagccaagccat

SEQ ID NO: 196262 - DNA, 20 bp, human
gccatcgcggctccattgtg

SEQ ID NO: 196263 - DNA, 20 bp, human
ggggcccgggcgctgttacc

SEQ ID NO: 196264 - DNA, 20 bp, human
gggcgggggtcgcagaattg

SEQ ID NO: 196265 - DNA, 20 bp, human
gtccttattgacaaacagag

SEQ ID NO: 196266 - DNA, 20 bp, human
gccgccgccagggaaaagaa

SEQ ID NO: 196267 - DNA, 20 bp, human
ggccttcgcagcccccgcag

SEQ ID NO: 196268 - DNA, 20 bp, human
gggcgcagccgccagaccag

SEQ ID NO: 196269 - DNA, 20 bp, human
gccctgacccaggcgagcga

SEQ ID NO: 196270 - DNA, 20 bp, human
ggacgcgcaccccctgaccc

SEQ ID NO: 196271 - DNA, 20 bp, human
ggtcagggggtgcgcgtcgg

SEQ ID NO: 196272 - DNA, 20 bp, human
ggcgagtttctgtctcagtc

SEQ ID NO: 196273 - DNA, 20 bp, human
gtgcctcgcagcccctcccg

SEQ ID NO: 196274 - DNA, 20 bp, human
ggctgtccggcctccgtcaa

SEQ ID NO: 196275 - DNA, 20 bp, human
gtgcgaggcactcggacctg

SEQ ID NO: 196276 - DNA, 20 bp, human
gggactcgcgtgacagttcc

SEQ ID NO: 196277 - DNA, 20 bp, human
gcgtctggcacttaataggg

SEQ ID NO: 196278 - DNA, 20 bp, human
gccacgtctggcacttaata

SEQ ID NO: 196279 - DNA, 20 bp, human
gagcgactaagcaccacgtc

SEQ ID NO: 196280 - DNA, 20 bp, human
ggcggcggcgacggtgaccc

SEQ ID NO: 196281 - DNA, 20 bp, human
ggtcgctggggatacgtcaa

SEQ ID NO: 196282 - DNA, 20 bp, human
gtcgggctcctaatccccaa

SEQ ID NO: 196283 - DNA, 20 bp, human
ggcagcggccggaaaaagtg

SEQ ID NO: 196284 - DNA, 20 bp, human
gccagctgatgcaacctggc

SEQ ID NO: 196285 - DNA, 20 bp, human
gctggcacttaatagggggg

SEQ ID NO: 196286 - DNA, 20 bp, human
gaggaaaaggaccgcaagat

SEQ ID NO: 196287 - DNA, 20 bp, human
gcgcgcctgggagacccgag

SEQ ID NO: 196288 - DNA, 20 bp, human
gatttagggtaccagaccac

SEQ ID NO: 196289 - DNA, 20 bp, human
ggacccgagcggccgtacca

SEQ ID NO: 196290 - DNA, 20 bp, human
gcgccagggcctcaagccct

SEQ ID NO: 196291 - DNA, 20 bp, human
gcttcgtgccgctaccaaga

SEQ ID NO: 196292 - DNA, 20 bp, human
gcgcctcgcgttccttggta

SEQ ID NO: 196293 - DNA, 20 bp, human
ggatggcggcgcccatcttg

SEQ ID NO: 196294 - DNA, 20 bp, human
gggccgtaccaaggaacgcg

SEQ ID NO: 196295 - DNA, 20 bp, human
gtcactgatgggcgctcctg

SEQ ID NO: 196296 - DNA, 20 bp, human
gtccagacaccggtacgtcc

SEQ ID NO: 196297 - DNA, 20 bp, human
gctttgctgggtccagacac

SEQ ID NO: 196298 - DNA, 20 bp, human
gcagcaaaggacgcgagagc

SEQ ID NO: 196299 - DNA, 20 bp, human
gaaaacccgcccggacgtac

SEQ ID NO: 196300 - DNA, 20 bp, human
ggcggttcccagagaaaagg

SEQ ID NO: 196301 - DNA, 20 bp, human
gatccggccagaaggactcc

SEQ ID NO: 196302 - DNA, 20 bp, human
gcggccagaaggactccagg

SEQ ID NO: 196303 - DNA, 20 bp, human
gtccttctggccggattccg

SEQ ID NO: 196304 - DNA, 20 bp, human
gaagcaacaacgagggtcta

SEQ ID NO: 196305 - DNA, 20 bp, human
gcaaaggacgcgagagcggg

SEQ ID NO: 196306 - DNA, 20 bp, human
gtcgaactagcgagaatggc

SEQ ID NO: 196307 - DNA, 20 bp, human
gtccccgcgagagggagtga

SEQ ID NO: 196308 - DNA, 20 bp, human
gccggtgggcaccgactccg

SEQ ID NO: 196309 - DNA, 20 bp, human
ggaggaccggacagggacgg

SEQ ID NO: 196310 - DNA, 20 bp, human
gccgccggctcgcccagctc

SEQ ID NO: 196311 - DNA, 20 bp, human
gctagcgagaatggcgggac

SEQ ID NO: 196312 - DNA, 20 bp, human
gctagggcgggtcgctcgta

SEQ ID NO: 196313 - DNA, 20 bp, human
gccgcctacgcaggccggag

SEQ ID NO: 196314 - DNA, 20 bp, human
gtgaagcgcggggcgctcca

SEQ ID NO: 196315 - DNA, 20 bp, human
gcgcggacggagagcacgtg

SEQ ID NO: 196316 - DNA, 20 bp, human
ggcgcgaggaccgagcaggg

SEQ ID NO: 196317 - DNA, 20 bp, human
ggggcccgctgccggcgtgt

SEQ ID NO: 196318 - DNA, 20 bp, human
ggaggaccgagcagggcggt

SEQ ID NO: 196319 - DNA, 20 bp, human
gggggcgcgaggaccgagca

SEQ ID NO: 196320 - DNA, 20 bp, human
ggcaggatccggaaaaccaa

SEQ ID NO: 196321 - DNA, 20 bp, human
gccgagcctcgcccacacgc

SEQ ID NO: 196322 - DNA, 20 bp, human
ggcgcacagggcggctctga

SEQ ID NO: 196323 - DNA, 20 bp, human
gcggcaggatttcccaccag

SEQ ID NO: 196324 - DNA, 20 bp, human
gcagggcggctctgaggggt

SEQ ID NO: 196325 - DNA, 20 bp, human
gcaggcccagagcgctaact

SEQ ID NO: 196326 - DNA, 20 bp, human
gccgcgcccaagagcccggt

SEQ ID NO: 196327 - DNA, 20 bp, human
gccggccgcggagcacgtgt

SEQ ID NO: 196328 - DNA, 20 bp, human
gggctgggcccgccccacta

SEQ ID NO: 196329 - DNA, 20 bp, human
gcggtgagtcaggccaggga

SEQ ID NO: 196330 - DNA, 20 bp, human
ggcaccggcccgggagggaa

SEQ ID NO: 196331 - DNA, 20 bp, human
gctcccgcaggctccgacgg

SEQ ID NO: 196332 - DNA, 20 bp, human
gcgctgcccaccgggctctt

SEQ ID NO: 196333 - DNA, 20 bp, human
gcagcgtctccagcccgggt

SEQ ID NO: 196334 - DNA, 20 bp, human
gccgcaggctccgacggagg

SEQ ID NO: 196335 - DNA, 20 bp, human
ggcggcgcaccggcccggga

SEQ ID NO: 196336 - DNA, 20 bp, human
gatgcgcctggtggtcaccg

SEQ ID NO: 196337 - DNA, 20 bp, human
ggaccaccaggcgcatgcga

SEQ ID NO: 196338 - DNA, 20 bp, human
gccgcccggagggtactgtg

SEQ ID NO: 196339 - DNA, 20 bp, human
gcggcctcacagtaccctcc

SEQ ID NO: 196340 - DNA, 20 bp, human
gcagtaaccaaagtcgtccg

SEQ ID NO: 196341 - DNA, 20 bp, human
ggagcgcgagcggtggaccc

SEQ ID NO: 196342 - DNA, 20 bp, human
gcgcatgcgagggcgggaca

SEQ ID NO: 196343 - DNA, 20 bp, human
gcgacgcgatgagggtatcg

SEQ ID NO: 196344 - DNA, 20 bp, human
gccctccgggcggagctctg

SEQ ID NO: 196345 - DNA, 20 bp, human
gtccgggccgagcagcgatg

SEQ ID NO: 196346 - DNA, 20 bp, human
ggcccagctgctgacgtgcg

SEQ ID NO: 196347 - DNA, 20 bp, human
gcaggttgcgggggtcgctg

SEQ ID NO: 196348 - DNA, 20 bp, human
gcagctgctgacgtgcgggg

SEQ ID NO: 196349 - DNA, 20 bp, human
gcctgcggaagcacacggcg

SEQ ID NO: 196350 - DNA, 20 bp, human
gcccagcaccagaaagtcgt

SEQ ID NO: 196351 - DNA, 20 bp, human
ggtgcttccgcaggttgcgg

SEQ ID NO: 196352 - DNA, 20 bp, human
gcggccgccgcgagagagca

SEQ ID NO: 196353 - DNA, 20 bp, human
ggcgcagcgccccgctgaag

SEQ ID NO: 196354 - DNA, 20 bp, human
ggaattggaacgtgagttgg

SEQ ID NO: 196355 - DNA, 20 bp, human
gcgtgcggggcggaacgcgc

SEQ ID NO: 196356 - DNA, 20 bp, human
ggagttacttgggctcacgg

SEQ ID NO: 196357 - DNA, 20 bp, human
ggagaacgccgcgaaaagag

SEQ ID NO: 196358 - DNA, 20 bp, human
ggactccggcgggagagtaa

SEQ ID NO: 196359 - DNA, 20 bp, human
ggaaggagggcgagttactt

SEQ ID NO: 196360 - DNA, 20 bp, human
ggagagccaccccggaagag

SEQ ID NO: 196361 - DNA, 20 bp, human
gaggaaacgggcgactccga

SEQ ID NO: 196362 - DNA, 20 bp, human
ggcgcgaaaggaaacccagt

SEQ ID NO: 196363 - DNA, 20 bp, human
gccggaccgcccctcttccg

SEQ ID NO: 196364 - DNA, 20 bp, human
gcgaggcgggagagccaccc

SEQ ID NO: 196365 - DNA, 20 bp, human
gcgcagggaggaaccgaggc

SEQ ID NO: 196366 - DNA, 20 bp, human
gcgcccggcggcagcaacga

SEQ ID NO: 196367 - DNA, 20 bp, human
ggtccgacctgaggttccag

SEQ ID NO: 196368 - DNA, 20 bp, human
gcgcccctggaacctcaggt

SEQ ID NO: 196369 - DNA, 20 bp, human
gccccgggacgaggaggtgg

SEQ ID NO: 196370 - DNA, 20 bp, human
gcgggacgcgttacttcagg

SEQ ID NO: 196371 - DNA, 20 bp, human
gcagggcagagaccgagtca

SEQ ID NO: 196372 - DNA, 20 bp, human
gcccgcccaagtccgacctg

SEQ ID NO: 196373 - DNA, 20 bp, human
gctgctaccgcagctcgagg

SEQ ID NO: 196374 - DNA, 20 bp, human
gcgcggccggaggacaggta

SEQ ID NO: 196375 - DNA, 20 bp, human
ggaagtaacgcgtcccgggc

SEQ ID NO: 196376 - DNA, 20 bp, human
gtggcctcggtcggtaccct

SEQ ID NO: 196377 - DNA, 20 bp, human
ggcgcccagggtaccgaccg

SEQ ID NO: 196378 - DNA, 20 bp, human
ggtgggtacgaatactaatg

SEQ ID NO: 196379 - DNA, 20 bp, human
gacatggtggccgagaccgg

SEQ ID NO: 196380 - DNA, 20 bp, human
gaggccctggacagtgatca

SEQ ID NO: 196381 - DNA, 20 bp, human
gcggacatggtggccgagac

SEQ ID NO: 196382 - DNA, 20 bp, human
ggacgtgtcgcgcggccggg

SEQ ID NO: 196383 - DNA, 20 bp, human
gtcaggttcacaacagtcaa

SEQ ID NO: 196384 - DNA, 20 bp, human
ggcgacagctggctacctgg

SEQ ID NO: 196385 - DNA, 20 bp, human
gcagtcaaaggagtttctgg

SEQ ID NO: 196386 - DNA, 20 bp, human
gcgaaccgcggcttaggtgg

SEQ ID NO: 196387 - DNA, 20 bp, human
gggccacgaagctgtcctaa

SEQ ID NO: 196388 - DNA, 20 bp, human
gcggcggcgaaggatgcacc

SEQ ID NO: 196389 - DNA, 20 bp, human
gatgcacccggcaggcttgg

SEQ ID NO: 196390 - DNA, 20 bp, human
ggaagctgtcctaagggtgt

SEQ ID NO: 196391 - DNA, 20 bp, human
gtgggatgccaggttcgggt

SEQ ID NO: 196392 - DNA, 20 bp, human
ggcgggcacgctccgaaccg

SEQ ID NO: 196393 - DNA, 20 bp, human
ggccgccgccacctaagccg

SEQ ID NO: 196394 - DNA, 20 bp, human
gctccgaaccgcggcttagg

SEQ ID NO: 196395 - DNA, 20 bp, human
gcgacagcaggcgggtactg

SEQ ID NO: 196396 - DNA, 20 bp, human
gccgggtcccgagaaggctc

SEQ ID NO: 196397 - DNA, 20 bp, human
gaaccggcgcggagcaactg

SEQ ID NO: 196398 - DNA, 20 bp, human
gcgtcccccgggtcccgaga

SEQ ID NO: 196399 - DNA, 20 bp, human
gggcagttcagcctagccag

SEQ ID NO: 196400 - DNA, 20 bp, human
gaactgggctggaccgaaac

SEQ ID NO: 196401 - DNA, 20 bp, human
gctgaggcccgagccttctc

SEQ ID NO: 196402 - DNA, 20 bp, human
ggcgtgtaaggagcctagag

SEQ ID NO: 196403 - DNA, 20 bp, human
gcgcctaaccccgcgaggtg

SEQ ID NO: 196404 - DNA, 20 bp, human
ggcggagtcaggcaattagt

SEQ ID NO: 196405 - DNA, 20 bp, human
gcagcctagccagtggttaa

SEQ ID NO: 196406 - DNA, 20 bp, human
ggtcagggtctggggacgag

SEQ ID NO: 196407 - DNA, 20 bp, human
gcggttggagtctgacgggt

SEQ ID NO: 196408 - DNA, 20 bp, human
gagagatgggtctcactcct

SEQ ID NO: 196409 - DNA, 20 bp, human
gctgaggacagagaccggtc

SEQ ID NO: 196410 - DNA, 20 bp, human
gtggcgaccaactgcaccca

SEQ ID NO: 196411 - DNA, 20 bp, human
gtgcagttggtcgccaggta

SEQ ID NO: 196412 - DNA, 20 bp, human
gctctaccccgaagcctagg

SEQ ID NO: 196413 - DNA, 20 bp, human
gacgggtaggcgagacgcgc

SEQ ID NO: 196414 - DNA, 20 bp, human
gccaccttgggggagatcaa

SEQ ID NO: 196415 - DNA, 20 bp, human
ggagtcggttggagtctgac

SEQ ID NO: 196416 - DNA, 20 bp, human
gtccggaaggtagacgtcca

SEQ ID NO: 196417 - DNA, 20 bp, human
gcgcggagtgggcaagatgt

SEQ ID NO: 196418 - DNA, 20 bp, human
gtccagggtcgaggagaggt

SEQ ID NO: 196419 - DNA, 20 bp, human
ggacgtccagggtcgaggag

SEQ ID NO: 196420 - DNA, 20 bp, human
gaggtagacgtccagggtcg

SEQ ID NO: 196421 - DNA, 20 bp, human
gcagcgacgggagccctcaa

SEQ ID NO: 196422 - DNA, 20 bp, human
gaccctggacgtctaccttc

SEQ ID NO: 196423 - DNA, 20 bp, human
gctagccccgcgcgcggagt

SEQ ID NO: 196424 - DNA, 20 bp, human
gcctgaaacccgagatcctc

SEQ ID NO: 196425 - DNA, 20 bp, human
ggatcggccggaacacaaaa

SEQ ID NO: 196426 - DNA, 20 bp, human
ggcccggaggctgcatctcg

SEQ ID NO: 196427 - DNA, 20 bp, human
gtgccggcgtcgtggtgctt

SEQ ID NO: 196428 - DNA, 20 bp, human
gtgcgagcgaggccagaaac

SEQ ID NO: 196429 - DNA, 20 bp, human
gcaaccggccgcggtagaag

SEQ ID NO: 196430 - DNA, 20 bp, human
gcgggtgatagcccttccag

SEQ ID NO: 196431 - DNA, 20 bp, human
ggtcgccaccaagaagactt

SEQ ID NO: 196432 - DNA, 20 bp, human
gggacaggcaggaagctgac

SEQ ID NO: 196433 - DNA, 20 bp, human
ggacccgcacgctcgcccta

SEQ ID NO: 196434 - DNA, 20 bp, human
gcggcgtcgtggtgcttggg

SEQ ID NO: 196435 - DNA, 20 bp, human
ggccgcggtagaagaggctg

SEQ ID NO: 196436 - DNA, 20 bp, human
gggtgcaggggaccgcgtca

SEQ ID NO: 196437 - DNA, 20 bp, human
gtgacacgtagcaacggggc

SEQ ID NO: 196438 - DNA, 20 bp, human
gggtcactcaccaaactctg

SEQ ID NO: 196439 - DNA, 20 bp, human
gcgacctcgcccctaatgga

SEQ ID NO: 196440 - DNA, 20 bp, human
gcctgtgacacgtagcaacg

SEQ ID NO: 196441 - DNA, 20 bp, human
ggtgtcacagggccaaagaa

SEQ ID NO: 196442 - DNA, 20 bp, human
gggagttgtggttccataag

SEQ ID NO: 196443 - DNA, 20 bp, human
ggaggctgcgctggcggcaa

SEQ ID NO: 196444 - DNA, 20 bp, human
gggccaaagaacggcttccg

SEQ ID NO: 196445 - DNA, 20 bp, human
ggctgtaaagcccagtccta

SEQ ID NO: 196446 - DNA, 20 bp, human
gggagtctccaggagacccg

SEQ ID NO: 196447 - DNA, 20 bp, human
gcagatcccaagctcaccag

SEQ ID NO: 196448 - DNA, 20 bp, human
ggacctggaaggaaccacga

SEQ ID NO: 196449 - DNA, 20 bp, human
ggccaagatggcggaagcgg

SEQ ID NO: 196450 - DNA, 20 bp, human
ggcctgggcgatgctgtccc

SEQ ID NO: 196451 - DNA, 20 bp, human
gagtgccagaccctcgatca

SEQ ID NO: 196452 - DNA, 20 bp, human
gctgcgacaaaagggaccga

SEQ ID NO: 196453 - DNA, 20 bp, human
ggtgggagcgacccgggaga

SEQ ID NO: 196454 - DNA, 20 bp, human
gagacctgtgggagcgaccc

SEQ ID NO: 196455 - DNA, 20 bp, human
gaggttccgcaaagacctgt

SEQ ID NO: 196456 - DNA, 20 bp, human
gagtccctggactaagacct

SEQ ID NO: 196457 - DNA, 20 bp, human
gcggcggaggcgtcaggaga

SEQ ID NO: 196458 - DNA, 20 bp, human
ggagccgaggtcttagtcca

SEQ ID NO: 196459 - DNA, 20 bp, human
gagtggagtggtcacgtgag

SEQ ID NO: 196460 - DNA, 20 bp, human
gagggtccacatgacccggg

SEQ ID NO: 196461 - DNA, 20 bp, human
gtgattgcaatactgaatcc

SEQ ID NO: 196462 - DNA, 20 bp, human
gtaccccccgtaggatccgg

SEQ ID NO: 196463 - DNA, 20 bp, human
ggggtcatgtggaccctcgt

SEQ ID NO: 196464 - DNA, 20 bp, human
gtgacagtacacacaccaca

SEQ ID NO: 196465 - DNA, 20 bp, human
gtgtccaccggatcctacgg

SEQ ID NO: 196466 - DNA, 20 bp, human
ggcccatagccccccggcgg

SEQ ID NO: 196467 - DNA, 20 bp, human
gtgggcccatagccccccgg

SEQ ID NO: 196468 - DNA, 20 bp, human
gcgatgggcccatagccccc

SEQ ID NO: 196469 - DNA, 20 bp, human
ggacccgacagtcctcgacg

SEQ ID NO: 196470 - DNA, 20 bp, human
gagaaggccgcggctcccca

SEQ ID NO: 196471 - DNA, 20 bp, human
gtgggatactgcgagtatgg

SEQ ID NO: 196472 - DNA, 20 bp, human
gtgaggcccaaagaaggccg

SEQ ID NO: 196473 - DNA, 20 bp, human
gcgcccgggaccggaagtgt

SEQ ID NO: 196474 - DNA, 20 bp, human
gttcccggcggtgtgaccgg

SEQ ID NO: 196475 - DNA, 20 bp, human
ggcgagtatggcggcgtcaa

SEQ ID NO: 196476 - DNA, 20 bp, human
ggccggcccagacccgtcgg

SEQ ID NO: 196477 - DNA, 20 bp, human
ggcagccggcccagacccgt

SEQ ID NO: 196478 - DNA, 20 bp, human
ggtcggaggcgcccgaagag

SEQ ID NO: 196479 - DNA, 20 bp, human
ggagcagcccgtaggaccgg

SEQ ID NO: 196480 - DNA, 20 bp, human
gagccgggatggaggttcaa

SEQ ID NO: 196481 - DNA, 20 bp, human
gttcccatgtcggcaagtgg

SEQ ID NO: 196482 - DNA, 20 bp, human
gcacggttggggttcggtgg

SEQ ID NO: 196483 - DNA, 20 bp, human
ggaccacggtggggaaccgg

SEQ ID NO: 196484 - DNA, 20 bp, human
ggcctccgacgggtctgggc

SEQ ID NO: 196485 - DNA, 20 bp, human
gcagaggcatgaccacggtg

SEQ ID NO: 196486 - DNA, 20 bp, human
gtaggcggcggcggtcccga

SEQ ID NO: 196487 - DNA, 20 bp, human
ggggtcggcggagggatgag

SEQ ID NO: 196488 - DNA, 20 bp, human
gaggctggtgtccgagtcag

SEQ ID NO: 196489 - DNA, 20 bp, human
gtcggcggagggatgagggg

SEQ ID NO: 196490 - DNA, 20 bp, human
gaccagccttctcagacccc

SEQ ID NO: 196491 - DNA, 20 bp, human
gctgctgacggggccaccgc

SEQ ID NO: 196492 - DNA, 20 bp, human
ggctgcgggacccgttctca

SEQ ID NO: 196493 - DNA, 20 bp, human
gctggtgtccgagtcagagg

SEQ ID NO: 196494 - DNA, 20 bp, human
gtgggggtccgagtcggagt

SEQ ID NO: 196495 - DNA, 20 bp, human
gccccaggcccactccgact

SEQ ID NO: 196496 - DNA, 20 bp, human
gaggccccggagcgtgtaaa

SEQ ID NO: 196497 - DNA, 20 bp, human
gctgtaggcgccgcgagttc

SEQ ID NO: 196498 - DNA, 20 bp, human
gaagctcatgaagcccgagg

SEQ ID NO: 196499 - DNA, 20 bp, human
gtcgcggcgcctacaggccc

SEQ ID NO: 196500 - DNA, 20 bp, human
ggcggcggtgggaccggtgg

SEQ ID NO: 196501 - DNA, 20 bp, human
gcgccccccggcatcactgg

SEQ ID NO: 196502 - DNA, 20 bp, human
gagccgccccccggcatcac

SEQ ID NO: 196503 - DNA, 20 bp, human
gccccgccagtgatgccggg

SEQ ID NO: 196504 - DNA, 20 bp, human
gagtctccgtagccgccccc

SEQ ID NO: 196505 - DNA, 20 bp, human
gaaccgacctccaggagccg

SEQ ID NO: 196506 - DNA, 20 bp, human
gacagacaatccgccccgga

SEQ ID NO: 196507 - DNA, 20 bp, human
ggttagcgcctcgccttccg

SEQ ID NO: 196508 - DNA, 20 bp, human
gcgccgggccgtggacagag

SEQ ID NO: 196509 - DNA, 20 bp, human
gggcaacgggtcggagaaaa

SEQ ID NO: 196510 - DNA, 20 bp, human
gaggggacgacgctgagagt

SEQ ID NO: 196511 - DNA, 20 bp, human
gcgttgcagtagctgtagga

SEQ ID NO: 196512 - DNA, 20 bp, human
gtccgtttctgggaggagtg

SEQ ID NO: 196513 - DNA, 20 bp, human
gggttgcaccgtgctcgaca

SEQ ID NO: 196514 - DNA, 20 bp, human
gaaacagccacgggcagggc

SEQ ID NO: 196515 - DNA, 20 bp, human
ggacgacgctgagagtgggc

SEQ ID NO: 196516 - DNA, 20 bp, human
gcccgggtgcgggaactcca

SEQ ID NO: 196517 - DNA, 20 bp, human
gcagccggaccgacacgatg

SEQ ID NO: 196518 - DNA, 20 bp, human
gcggcgcctggtttccccgg

SEQ ID NO: 196519 - DNA, 20 bp, human
gcccggcggcgtctcccaac

SEQ ID NO: 196520 - DNA, 20 bp, human
gctcgggagggtatccgacg

SEQ ID NO: 196521 - DNA, 20 bp, human
ggagatccaggcactcggga

SEQ ID NO: 196522 - DNA, 20 bp, human
gacccggcgcctggtttccc

SEQ ID NO: 196523 - DNA, 20 bp, human
ggaacagagaatgctgacgg

SEQ ID NO: 196524 - DNA, 20 bp, human
gttggtcccggcagcctgtt

SEQ ID NO: 196525 - DNA, 20 bp, human
ggcggggccagctttggtcc

SEQ ID NO: 196526 - DNA, 20 bp, human
gggccgttaacgcctaggca

SEQ ID NO: 196527 - DNA, 20 bp, human
ggctgaggccgttaacgcct

SEQ ID NO: 196528 - DNA, 20 bp, human
gggctacggctccaaaacaa

SEQ ID NO: 196529 - DNA, 20 bp, human
gtggccacccaaggatactg

SEQ ID NO: 196530 - DNA, 20 bp, human
gcggcgtctgggccgggcta

SEQ ID NO: 196531 - DNA, 20 bp, human
ggatgcctcgcgccctgcct

SEQ ID NO: 196532 - DNA, 20 bp, human
gccgcagccacagtatcctt

SEQ ID NO: 196533 - DNA, 20 bp, human
gaggtggagagaagaaacgg

SEQ ID NO: 196534 - DNA, 20 bp, human
ggcggagcggccgtgagtac

SEQ ID NO: 196535 - DNA, 20 bp, human
ggccccgccgtgaaaagata

SEQ ID NO: 196536 - DNA, 20 bp, human
ggacccggagggatgcggag

SEQ ID NO: 196537 - DNA, 20 bp, human
ggctcgcggagggagcccaa

SEQ ID NO: 196538 - DNA, 20 bp, human
ggcccggacccggagggatg

SEQ ID NO: 196539 - DNA, 20 bp, human
ggcgaagcgcggcccggctg

SEQ ID NO: 196540 - DNA, 20 bp, human
ggctccgctggggtgcgcag

SEQ ID NO: 196541 - DNA, 20 bp, human
gccatggagtccgaacccat

SEQ ID NO: 196542 - DNA, 20 bp, human
gggaccccacgcggaaccga

SEQ ID NO: 196543 - DNA, 20 bp, human
gggcgggagacgcgcgccag

SEQ ID NO: 196544 - DNA, 20 bp, human
ggtagcccccggcccggacc

SEQ ID NO: 196545 - DNA, 20 bp, human
gcgccactccgcatccctcc

SEQ ID NO: 196546 - DNA, 20 bp, human
ggctcggtgtaaacaagtcc

SEQ ID NO: 196547 - DNA, 20 bp, human
gagcatgggcgggtaggcac

SEQ ID NO: 196548 - DNA, 20 bp, human
ggagagggtcccccacctgg

SEQ ID NO: 196549 - DNA, 20 bp, human
gtccaggcgcctgcgaaccc

SEQ ID NO: 196550 - DNA, 20 bp, human
gcgggggagcatgggcgggt

SEQ ID NO: 196551 - DNA, 20 bp, human
gcccccgggcccgggttcgc

SEQ ID NO: 196552 - DNA, 20 bp, human
gaggcctcctctacgctcag

SEQ ID NO: 196553 - DNA, 20 bp, human
gtcccccacctggaggaggt

SEQ ID NO: 196554 - DNA, 20 bp, human
gtgggcgggtaggcactggt

SEQ ID NO: 196555 - DNA, 20 bp, human
ggacctcatctggagagcag

SEQ ID NO: 196556 - DNA, 20 bp, human
gagagatagacggagatctc

SEQ ID NO: 196557 - DNA, 20 bp, human
gtagttgggggctcaagact

SEQ ID NO: 196558 - DNA, 20 bp, human
gatctctggagcagacctca

SEQ ID NO: 196559 - DNA, 20 bp, human
ggttctgtacctcggtctgt

SEQ ID NO: 196560 - DNA, 20 bp, human
gaatcgtcagagcttggaga

SEQ ID NO: 196561 - DNA, 20 bp, human
ggttgccgggaaataagtgc

SEQ ID NO: 196562 - DNA, 20 bp, human
gagcaacacgcagcaggagg

SEQ ID NO: 196563 - DNA, 20 bp, human
gtgtctctcgttctgtacct

SEQ ID NO: 196564 - DNA, 20 bp, human
gtgcgggaatcgtcagagct

SEQ ID NO: 196565 - DNA, 20 bp, human
gcaactttggctgcagcatc

SEQ ID NO: 196566 - DNA, 20 bp, human
gctaaacctggagactcggg

SEQ ID NO: 196567 - DNA, 20 bp, human
gtgagcggcggtgagatccg

SEQ ID NO: 196568 - DNA, 20 bp, human
gccgcgggactcaccctgag

SEQ ID NO: 196569 - DNA, 20 bp, human
gacgcgacggggaaacgggg

SEQ ID NO: 196570 - DNA, 20 bp, human
gaggacgcgacggggaaacg

SEQ ID NO: 196571 - DNA, 20 bp, human
ggccagggcctgactaaacc

SEQ ID NO: 196572 - DNA, 20 bp, human
ggccagaccgtccgcccagg

SEQ ID NO: 196573 - DNA, 20 bp, human
gttgaggcccaaccagggag

SEQ ID NO: 196574 - DNA, 20 bp, human
ggaagccgcccgacccgaac

SEQ ID NO: 196575 - DNA, 20 bp, human
gggagactcgggtggccgag

SEQ ID NO: 196576 - DNA, 20 bp, human
gtggccgacgtctacaggta

SEQ ID NO: 196577 - DNA, 20 bp, human
gccctcgctcaaccccacgc

SEQ ID NO: 196578 - DNA, 20 bp, human
gcccgacccggccccgctag

SEQ ID NO: 196579 - DNA, 20 bp, human
gcccacgctggcagccaccg

SEQ ID NO: 196580 - DNA, 20 bp, human
gtcaccggaaacccctcccg

SEQ ID NO: 196581 - DNA, 20 bp, human
ggggcctgggcggatgtctc

SEQ ID NO: 196582 - DNA, 20 bp, human
gctcgctgcgacccttgagg

SEQ ID NO: 196583 - DNA, 20 bp, human
gcggccttacctgtagacgt

SEQ ID NO: 196584 - DNA, 20 bp, human
ggcgctgtgtaccgcctcaa

SEQ ID NO: 196585 - DNA, 20 bp, human
gccgcgtggccgacgtctac

SEQ ID NO: 196586 - DNA, 20 bp, human
gggaaacagatggcgacggc

SEQ ID NO: 196587 - DNA, 20 bp, human
ggaagggaaacagatggcga

SEQ ID NO: 196588 - DNA, 20 bp, human
gctcagactcgggctaggta

SEQ ID NO: 196589 - DNA, 20 bp, human
gaggcccagccttctcgtta

SEQ ID NO: 196590 - DNA, 20 bp, human
gatggagactgaggacgaaa

SEQ ID NO: 196591 - DNA, 20 bp, human
gtagggctcagactcgggct

SEQ ID NO: 196592 - DNA, 20 bp, human
gtctcgttagggctcagact

SEQ ID NO: 196593 - DNA, 20 bp, human
ggcagccgcggcagaagcac

SEQ ID NO: 196594 - DNA, 20 bp, human
ggccatggcggctgacagtc

SEQ ID NO: 196595 - DNA, 20 bp, human
gaacagatggcgacggcggg

SEQ ID NO: 196596 - DNA, 20 bp, human
gcgcctggccgtgatatcaa

SEQ ID NO: 196597 - DNA, 20 bp, human
gtgggctgaggtcaccagaa

SEQ ID NO: 196598 - DNA, 20 bp, human
gtccgatacggggaccagag

SEQ ID NO: 196599 - DNA, 20 bp, human
gggcacccccatcactcggt

SEQ ID NO: 196600 - DNA, 20 bp, human
gggcttcacttctgctgtgg

SEQ ID NO: 196601 - DNA, 20 bp, human
ggcggcccaccgagtgatgg

SEQ ID NO: 196602 - DNA, 20 bp, human
gcccagcgccccccaaacgg

SEQ ID NO: 196603 - DNA, 20 bp, human
ggcctgcgccattgatatca

SEQ ID NO: 196604 - DNA, 20 bp, human
ggaagagggagggaagaccc

SEQ ID NO: 196605 - DNA, 20 bp, human
ggcaggcttcacttctgctg

SEQ ID NO: 196606 - DNA, 20 bp, human
gtgacaggcccggcctctag

SEQ ID NO: 196607 - DNA, 20 bp, human
ggccccgccgccaattcccc

SEQ ID NO: 196608 - DNA, 20 bp, human
ggaggcgtcgactccaatgg

SEQ ID NO: 196609 - DNA, 20 bp, human
gggacgcggacgcactgagg

SEQ ID NO: 196610 - DNA, 20 bp, human
ggaggaggcgtcgactccaa

SEQ ID NO: 196611 - DNA, 20 bp, human
gccgggacgcggacgcactg

SEQ ID NO: 196612 - DNA, 20 bp, human
ggcgtcgactccaatggcgg

SEQ ID NO: 196613 - DNA, 20 bp, human
gtggggtacacacaacccgg

SEQ ID NO: 196614 - DNA, 20 bp, human
gcggctcgggcctcccctag

SEQ ID NO: 196615 - DNA, 20 bp, human
gcgccgcaggccgggacgtg

SEQ ID NO: 196616 - DNA, 20 bp, human
ggcagagcgccgaacagcgg

SEQ ID NO: 196617 - DNA, 20 bp, human
gggcccggcgcgaagaaccc

SEQ ID NO: 196618 - DNA, 20 bp, human
gcggcgacgcgaggaaccca

SEQ ID NO: 196619 - DNA, 20 bp, human
gtgacactcgggggcctcgg

SEQ ID NO: 196620 - DNA, 20 bp, human
gtcaggctccggctccgact

SEQ ID NO: 196621 - DNA, 20 bp, human
gccgccgagagaagggaacg

SEQ ID NO: 196622 - DNA, 20 bp, human
gggctagagcgtcgccgagt

SEQ ID NO: 196623 - DNA, 20 bp, human
ggcagcggagacacagcgcg

SEQ ID NO: 196624 - DNA, 20 bp, human
gggcagatgagccccgtctg

SEQ ID NO: 196625 - DNA, 20 bp, human
gagacgggcattgagctctt

SEQ ID NO: 196626 - DNA, 20 bp, human
gcggagcggaagtgagacta

SEQ ID NO: 196627 - DNA, 20 bp, human
gctgcttctcgggtccacaa

SEQ ID NO: 196628 - DNA, 20 bp, human
gcttctcgggtccacaatgg

SEQ ID NO: 196629 - DNA, 20 bp, human
ggccgctgccggccccataa

SEQ ID NO: 196630 - DNA, 20 bp, human
gagtggagagcggaaggtca

SEQ ID NO: 196631 - DNA, 20 bp, human
gccccgggcgcaagttgctg

SEQ ID NO: 196632 - DNA, 20 bp, human
ggcgtgcaagcggaaaagac

SEQ ID NO: 196633 - DNA, 20 bp, human
ggccttaggacagatcctga

SEQ ID NO: 196634 - DNA, 20 bp, human
ggctcgggagtcggaggaag

SEQ ID NO: 196635 - DNA, 20 bp, human
gtgctgcggtgtagctaccc

SEQ ID NO: 196636 - DNA, 20 bp, human
ggcggcggcggcgactaccc

SEQ ID NO: 196637 - DNA, 20 bp, human
gaccccggctccggaatcgg

SEQ ID NO: 196638 - DNA, 20 bp, human
ggcggaagtggcgatcggag

SEQ ID NO: 196639 - DNA, 20 bp, human
gcgtcgcagcagccagagag

SEQ ID NO: 196640 - DNA, 20 bp, human
gggcccgaagcagatagtga

SEQ ID NO: 196641 - DNA, 20 bp, human
gtgtcccttacggcacagta

SEQ ID NO: 196642 - DNA, 20 bp, human
gaagcccactactcaggcgg

SEQ ID NO: 196643 - DNA, 20 bp, human
ggctgccgccgcctgagtag

SEQ ID NO: 196644 - DNA, 20 bp, human
gccggctccggaatcggcgg

SEQ ID NO: 196645 - DNA, 20 bp, human
gcgaagcagatagtgaggga

SEQ ID NO: 196646 - DNA, 20 bp, human
gtccggcagggtctgcgcga

SEQ ID NO: 196647 - DNA, 20 bp, human
gggagttggttgtaaaatgg

SEQ ID NO: 196648 - DNA, 20 bp, human
gcgatcatccatagcggcag

SEQ ID NO: 196649 - DNA, 20 bp, human
gtccatagcggcagcggctc

SEQ ID NO: 196650 - DNA, 20 bp, human
gccagaagctcccatgaggg

SEQ ID NO: 196651 - DNA, 20 bp, human
gcctctgccgccgcccacag

SEQ ID NO: 196652 - DNA, 20 bp, human
gtcctgttcccggcctctgt

SEQ ID NO: 196653 - DNA, 20 bp, human
gccgggaacaggagacaaaa

SEQ ID NO: 196654 - DNA, 20 bp, human
gcatttttgctgcccggacg

SEQ ID NO: 196655 - DNA, 20 bp, human
gccgaacgagccaccctcat

SEQ ID NO: 196656 - DNA, 20 bp, human
gcgagaggcgacgggaaccc

SEQ ID NO: 196657 - DNA, 20 bp, human
gccgtctcgctcactgaggg

SEQ ID NO: 196658 - DNA, 20 bp, human
gcccacagagcgagcagctg

SEQ ID NO: 196659 - DNA, 20 bp, human
gggctggggagggtcccgag

SEQ ID NO: 196660 - DNA, 20 bp, human
ggagctgcgaccgcgggacc

SEQ ID NO: 196661 - DNA, 20 bp, human
gccacggggactccgaaaag

SEQ ID NO: 196662 - DNA, 20 bp, human
gcgcccgcgccgggcctgaa

SEQ ID NO: 196663 - DNA, 20 bp, human
ggggaacccgggctgtgacg

SEQ ID NO: 196664 - DNA, 20 bp, human
gaaggaccgcgtcttcggag

SEQ ID NO: 196665 - DNA, 20 bp, human
gagaggccgcgtcacagccc

SEQ ID NO: 196666 - DNA, 20 bp, human
gggaagcgcgggctaagggc

SEQ ID NO: 196667 - DNA, 20 bp, human
ggccgctcgcgccctctcgc

SEQ ID NO: 196668 - DNA, 20 bp, human
gcgagccgcgagcgacatgg

SEQ ID NO: 196669 - DNA, 20 bp, human
gggtcgcccatggccgggag

SEQ ID NO: 196670 - DNA, 20 bp, human
gcatgggcgacccggcgacc

SEQ ID NO: 196671 - DNA, 20 bp, human
ggcgctcaccgccttcatag

SEQ ID NO: 196672 - DNA, 20 bp, human
gagcgggaagcgcgggctaa

SEQ ID NO: 196673 - DNA, 20 bp, human
ggcgcgggctaagggcgggc

SEQ ID NO: 196674 - DNA, 20 bp, human
gtcgccgggtcgcccatggc

SEQ ID NO: 196675 - DNA, 20 bp, human
gggcccagggtgggggatcc

SEQ ID NO: 196676 - DNA, 20 bp, human
gcgcggccgcggagacgtga

SEQ ID NO: 196677 - DNA, 20 bp, human
gccccggggtaggctgacac

SEQ ID NO: 196678 - DNA, 20 bp, human
gagtggtgggactcgcgtcg

SEQ ID NO: 196679 - DNA, 20 bp, human
ggaagcccgcgggccgaccc

SEQ ID NO: 196680 - DNA, 20 bp, human
ggctcaccttcacgtctccg

SEQ ID NO: 196681 - DNA, 20 bp, human
ggacgtgaaggtgagcgcct

SEQ ID NO: 196682 - DNA, 20 bp, human
ggcgagaacaaaaagcagag

SEQ ID NO: 196683 - DNA, 20 bp, human
gggacacagtagggaagtca

SEQ ID NO: 196684 - DNA, 20 bp, human
gcaaccggagggacacagta

SEQ ID NO: 196685 - DNA, 20 bp, human
gctccccgggtgcccagcgg

SEQ ID NO: 196686 - DNA, 20 bp, human
ggtggtggcggcggacggac

SEQ ID NO: 196687 - DNA, 20 bp, human
gtggaagcccgcagagacaa

SEQ ID NO: 196688 - DNA, 20 bp, human
gcggctcccgaaggtggacg

SEQ ID NO: 196689 - DNA, 20 bp, human
gggcgacagggagatcccca

SEQ ID NO: 196690 - DNA, 20 bp, human
gcctcacctgtgtccggagt

SEQ ID NO: 196691 - DNA, 20 bp, human
ggcccgcagagacaagggtg

SEQ ID NO: 196692 - DNA, 20 bp, human
gcaccacccactccggacac

SEQ ID NO: 196693 - DNA, 20 bp, human
gtgaggcggagtctcctcag

SEQ ID NO: 196694 - DNA, 20 bp, human
ggccgccgagtcattatctc

SEQ ID NO: 196695 - DNA, 20 bp, human
gtctcctcagcggacacggg

SEQ ID NO: 196696 - DNA, 20 bp, human
gagacgcgcgaggaggtggt

SEQ ID NO: 196697 - DNA, 20 bp, human
gtcgggtcgtcggtgaccag

SEQ ID NO: 196698 - DNA, 20 bp, human
ggcggctgcagagcgatcat

SEQ ID NO: 196699 - DNA, 20 bp, human
ggccgggcccgagcagagtg

SEQ ID NO: 196700 - DNA, 20 bp, human
ggagaccatcgagaccacag

SEQ ID NO: 196701 - DNA, 20 bp, human
ggggcggcgacgactcggac

SEQ ID NO: 196702 - DNA, 20 bp, human
ggtggtggtgcacctgggtc

SEQ ID NO: 196703 - DNA, 20 bp, human
ggctgcagagcgatcatggg

SEQ ID NO: 196704 - DNA, 20 bp, human
gagggtgtcgcccgaggcca

SEQ ID NO: 196705 - DNA, 20 bp, human
gcgcccgaggccatggctga

SEQ ID NO: 196706 - DNA, 20 bp, human
gcggctgctttggcggcggt

SEQ ID NO: 196707 - DNA, 20 bp, human
ggtgctggcggcggctgctt

SEQ ID NO: 196708 - DNA, 20 bp, human
ggctaaaggggcaaactgag

SEQ ID NO: 196709 - DNA, 20 bp, human
gaaaggggcaaactgagagg

SEQ ID NO: 196710 - DNA, 20 bp, human
gggggaaacgatcccagtgt

SEQ ID NO: 196711 - DNA, 20 bp, human
gtgggcgaggaggttcccgt

SEQ ID NO: 196712 - DNA, 20 bp, human
gggatcccgcaaccgacact

SEQ ID NO: 196713 - DNA, 20 bp, human
gagtggagaactgggcgagg

SEQ ID NO: 196714 - DNA, 20 bp, human
gcgcacgcgcgaggagtgta

SEQ ID NO: 196715 - DNA, 20 bp, human
gcttgggctcgcgccgctga

SEQ ID NO: 196716 - DNA, 20 bp, human
ggcggctgcaacaccatcaa

SEQ ID NO: 196717 - DNA, 20 bp, human
gagagaaaggcgcgagactg

SEQ ID NO: 196718 - DNA, 20 bp, human
gggctatggcgaccacgacc

SEQ ID NO: 196719 - DNA, 20 bp, human
gagcccgtgttcgtgaagag

SEQ ID NO: 196720 - DNA, 20 bp, human
gagccgctcttcacgaacac

SEQ ID NO: 196721 - DNA, 20 bp, human
ggcggcaacgggaagaccgt

SEQ ID NO: 196722 - DNA, 20 bp, human
ggactgaggaaagcacgagc

SEQ ID NO: 196723 - DNA, 20 bp, human
gaggaaggggcgagctgcag

SEQ ID NO: 196724 - DNA, 20 bp, human
gtccagtacgaggatgtgga

SEQ ID NO: 196725 - DNA, 20 bp, human
gccgtcggaatgtcctccat

SEQ ID NO: 196726 - DNA, 20 bp, human
gtgctctgggcaaggactct

SEQ ID NO: 196727 - DNA, 20 bp, human
gacagcagccagtaggtgga

SEQ ID NO: 196728 - DNA, 20 bp, human
gcccgcacatccacgagcag

SEQ ID NO: 196729 - DNA, 20 bp, human
gttgagcgtttgcggaactg

SEQ ID NO: 196730 - DNA, 20 bp, human
gggtaagtgcctctaggcca

SEQ ID NO: 196731 - DNA, 20 bp, human
ggaccttgccctccacctac

SEQ ID NO: 196732 - DNA, 20 bp, human
ggcccctgctcgtggatgtg

SEQ ID NO: 196733 - DNA, 20 bp, human
ggggaccatagggccatcat

SEQ ID NO: 196734 - DNA, 20 bp, human
gctttgggacttgggcccta

SEQ ID NO: 196735 - DNA, 20 bp, human
gcttaccacattaaacacgt

SEQ ID NO: 196736 - DNA, 20 bp, human
gcgagcgcgcgccggagtgt

SEQ ID NO: 196737 - DNA, 20 bp, human
gggccgaccccggccagcgt

SEQ ID NO: 196738 - DNA, 20 bp, human
gattcgccttcgccagatgg

SEQ ID NO: 196739 - DNA, 20 bp, human
ggctgtgctctgctcggcta

SEQ ID NO: 196740 - DNA, 20 bp, human
gtgctctgctcggctagggc

SEQ ID NO: 196741 - DNA, 20 bp, human
gcccgggatctcgcaaactc

SEQ ID NO: 196742 - DNA, 20 bp, human
ggcggcgggttcaacttccc

SEQ ID NO: 196743 - DNA, 20 bp, human
ggagcggcaccgggcagtcc

SEQ ID NO: 196744 - DNA, 20 bp, human
gggagtgtgggcacgcgggc

SEQ ID NO: 196745 - DNA, 20 bp, human
gccgctctctgcgccgacgc

SEQ ID NO: 196746 - DNA, 20 bp, human
gttggcgccgtgcagagagg

SEQ ID NO: 196747 - DNA, 20 bp, human
gtcattggcgccgtgcagag

SEQ ID NO: 196748 - DNA, 20 bp, human
gggtcccgcgaggacttccc

SEQ ID NO: 196749 - DNA, 20 bp, human
ggccaagcagcgggtgactg

SEQ ID NO: 196750 - DNA, 20 bp, human
ggccgcggcgccgccaagtg

SEQ ID NO: 196751 - DNA, 20 bp, human
gcgaggccgcctagactccc

SEQ ID NO: 196752 - DNA, 20 bp, human
gcccgcccgggagccaggta

SEQ ID NO: 196753 - DNA, 20 bp, human
ggtgcggttcgggagagttc

SEQ ID NO: 196754 - DNA, 20 bp, human
ggcgggggttgggacgacag

SEQ ID NO: 196755 - DNA, 20 bp, human
gcggagcccgggagtctagg

SEQ ID NO: 196756 - DNA, 20 bp, human
gcactggctcttagactcca

SEQ ID NO: 196757 - DNA, 20 bp, human
gtgccaagctaaggaggcca

SEQ ID NO: 196758 - DNA, 20 bp, human
ggaaggatgccaagctaagg

SEQ ID NO: 196759 - DNA, 20 bp, human
gttggaaggatgccaagcta

SEQ ID NO: 196760 - DNA, 20 bp, human
gactggacttcagactatca

SEQ ID NO: 196761 - DNA, 20 bp, human
gaataacaagtcatatacca

SEQ ID NO: 196762 - DNA, 20 bp, human
gctacgatgcttctactgga

SEQ ID NO: 196763 - DNA, 20 bp, human
gccccctggcctccttagct

SEQ ID NO: 196764 - DNA, 20 bp, human
gaagtctaacctcaaacgaa

SEQ ID NO: 196765 - DNA, 20 bp, human
gcaatctacgatgcttctac

SEQ ID NO: 196766 - DNA, 20 bp, human
gcagctctgaggcccacggt

SEQ ID NO: 196767 - DNA, 20 bp, human
ggccaggtgccactccaccc

SEQ ID NO: 196768 - DNA, 20 bp, human
gtggccaccgtctccatggt

SEQ ID NO: 196769 - DNA, 20 bp, human
gcagcccaccatggagacgg

SEQ ID NO: 196770 - DNA, 20 bp, human
gctctccgcacacaccccgg

SEQ ID NO: 196771 - DNA, 20 bp, human
gcccagaaccggctctccat

SEQ ID NO: 196772 - DNA, 20 bp, human
gggccctggtggcaggacac

SEQ ID NO: 196773 - DNA, 20 bp, human
gaggatgtcacaccccgcca

SEQ ID NO: 196774 - DNA, 20 bp, human
gacccaggcaccacttacct

SEQ ID NO: 196775 - DNA, 20 bp, human
gcacttacctggggacgtac

SEQ ID NO: 196776 - DNA, 20 bp, human
gccggggccgagggcaccac

SEQ ID NO: 196777 - DNA, 20 bp, human
gcgtcccccagggccgccat

SEQ ID NO: 196778 - DNA, 20 bp, human
ggtaccggtacgagcagggg

SEQ ID NO: 196779 - DNA, 20 bp, human
gcgcggtacagtgctcgctg

SEQ ID NO: 196780 - DNA, 20 bp, human
gtagctgtcgaagtactcgg

SEQ ID NO: 196781 - DNA, 20 bp, human
gcataccccgcggccaccaa

SEQ ID NO: 196782 - DNA, 20 bp, human
gccgccgccgcaccctaaat

SEQ ID NO: 196783 - DNA, 20 bp, human
gcagcccgggaaggacaacg

SEQ ID NO: 196784 - DNA, 20 bp, human
gtccagcacctcgtccccca

SEQ ID NO: 196785 - DNA, 20 bp, human
ggcgcccatggcggccctgg

SEQ ID NO: 196786 - DNA, 20 bp, human
gacggttgggatgcctgaca

SEQ ID NO: 196787 - DNA, 20 bp, human
gccacccggaagtcaggcct

SEQ ID NO: 196788 - DNA, 20 bp, human
gcactgagaaatacccgcag

SEQ ID NO: 196789 - DNA, 20 bp, human
gtacccgcagcggcccaccc

SEQ ID NO: 196790 - DNA, 20 bp, human
gcacgcaccacccggaagtc

SEQ ID NO: 196791 - DNA, 20 bp, human
gcacttagtggtagtgggcg

SEQ ID NO: 196792 - DNA, 20 bp, human
gccaatagcagaacagctac

SEQ ID NO: 196793 - DNA, 20 bp, human
gggtggcctgggactcttaa

SEQ ID NO: 196794 - DNA, 20 bp, human
gtcggtcagatactgacggt

SEQ ID NO: 196795 - DNA, 20 bp, human
gggctgttatttgaaatcag

SEQ ID NO: 196796 - DNA, 20 bp, human
ggctatccgcggccatccgg

SEQ ID NO: 196797 - DNA, 20 bp, human
ggaggctggggtctccaggt

SEQ ID NO: 196798 - DNA, 20 bp, human
gccggcggtggtgacgcgag

SEQ ID NO: 196799 - DNA, 20 bp, human
gcgcagacagacaacccacc

SEQ ID NO: 196800 - DNA, 20 bp, human
gagaccaagacggaaactcc

SEQ ID NO: 196801 - DNA, 20 bp, human
ggtggtgacgcgagaggctg

SEQ ID NO: 196802 - DNA, 20 bp, human
ggaacgcgcaggcagactaa

SEQ ID NO: 196803 - DNA, 20 bp, human
gctgtctgcgggtggatgag

SEQ ID NO: 196804 - DNA, 20 bp, human
gatccgcggccatccggcgg

SEQ ID NO: 196805 - DNA, 20 bp, human
gtgggaagcagactcagctc

SEQ ID NO: 196806 - DNA, 20 bp, human
gagctgcgccaggatcaccg

SEQ ID NO: 196807 - DNA, 20 bp, human
ggcccgacccgggacaggcg

SEQ ID NO: 196808 - DNA, 20 bp, human
gccacacgcgcggggaggga

SEQ ID NO: 196809 - DNA, 20 bp, human
gctccccgcctgtcccgggt

SEQ ID NO: 196810 - DNA, 20 bp, human
gcttggttggagcccgaccc

SEQ ID NO: 196811 - DNA, 20 bp, human
gttggagcccgacccgggac

SEQ ID NO: 196812 - DNA, 20 bp, human
ggccatgtcgccattgtctg

SEQ ID NO: 196813 - DNA, 20 bp, human
ggcggccctgcgggtctacg

SEQ ID NO: 196814 - DNA, 20 bp, human
ggccgcagacaatggcgaca

SEQ ID NO: 196815 - DNA, 20 bp, human
gccccagggtaagtgaggat

SEQ ID NO: 196816 - DNA, 20 bp, human
gattccccccagccacaagt

SEQ ID NO: 196817 - DNA, 20 bp, human
gcaagtgggtacttacaagc

SEQ ID NO: 196818 - DNA, 20 bp, human
gcctctgagagacacctcta

SEQ ID NO: 196819 - DNA, 20 bp, human
gttacaagcaggcaaggctc

SEQ ID NO: 196820 - DNA, 20 bp, human
ggggtacttacaagcaggca

SEQ ID NO: 196821 - DNA, 20 bp, human
gggacaaactgaccttgcat

SEQ ID NO: 196822 - DNA, 20 bp, human
gaggtaaagagcaaaacatc

SEQ ID NO: 196823 - DNA, 20 bp, human
gtctgcaaccgtgaacagtt

SEQ ID NO: 196824 - DNA, 20 bp, human
gttattatccagatcctcat

SEQ ID NO: 196825 - DNA, 20 bp, human
gtatggtgagctgcttgcta

SEQ ID NO: 196826 - DNA, 20 bp, human
ggcgggtcgggagtccgaga

SEQ ID NO: 196827 - DNA, 20 bp, human
gagatggtagatccccctcc

SEQ ID NO: 196828 - DNA, 20 bp, human
gtcagcgaggcgcctggagg

SEQ ID NO: 196829 - DNA, 20 bp, human
gagaagggcagcccagcgaa

SEQ ID NO: 196830 - DNA, 20 bp, human
gcgacagccggcccggagaa

SEQ ID NO: 196831 - DNA, 20 bp, human
gcagggaaggagcaagaatg

SEQ ID NO: 196832 - DNA, 20 bp, human
gatgtcagcgaggcgcctgg

SEQ ID NO: 196833 - DNA, 20 bp, human
gaggtgggcccgggattctg

SEQ ID NO: 196834 - DNA, 20 bp, human
gccgggacaaaatgtcagcg

SEQ ID NO: 196835 - DNA, 20 bp, human
gcgggtaaaggggtgagtgt

SEQ ID NO: 196836 - DNA, 20 bp, human
ggacgctccattcattaccg

SEQ ID NO: 196837 - DNA, 20 bp, human
gcaggccgggcgccgacccc

SEQ ID NO: 196838 - DNA, 20 bp, human
gcccgtccgcccggaagcaa

SEQ ID NO: 196839 - DNA, 20 bp, human
gggaggggcgcagcgtccgg

SEQ ID NO: 196840 - DNA, 20 bp, human
gggacgctgcgcccctccca

SEQ ID NO: 196841 - DNA, 20 bp, human
gggccggctgcggacgacgg

SEQ ID NO: 196842 - DNA, 20 bp, human
ggcccccgcgccagctgtca

SEQ ID NO: 196843 - DNA, 20 bp, human
gagcaacggcgcgggcacgt

SEQ ID NO: 196844 - DNA, 20 bp, human
gccgcgccgttgcttccggg

SEQ ID NO: 196845 - DNA, 20 bp, human
ggcgggggcagacaaagccg

SEQ ID NO: 196846 - DNA, 20 bp, human
gggacgcgagagaagacctg

SEQ ID NO: 196847 - DNA, 20 bp, human
gcccagtcgtggcaatctgt

SEQ ID NO: 196848 - DNA, 20 bp, human
gcagctcagggatatcgcct

SEQ ID NO: 196849 - DNA, 20 bp, human
ggtagggagccccccagtcg

SEQ ID NO: 196850 - DNA, 20 bp, human
gtccatagagatccgattcg

SEQ ID NO: 196851 - DNA, 20 bp, human
ggcagcgcgcacctgtgaca

SEQ ID NO: 196852 - DNA, 20 bp, human
ggggtgggctgcgactggta

SEQ ID NO: 196853 - DNA, 20 bp, human
gagcccgcgaccgccatctt

SEQ ID NO: 196854 - DNA, 20 bp, human
gatctctatggagatggcct

SEQ ID NO: 196855 - DNA, 20 bp, human
gtaagcggtgcgctctgaaa

SEQ ID NO: 196856 - DNA, 20 bp, human
gtagcgaacaccggatgtgg

SEQ ID NO: 196857 - DNA, 20 bp, human
gccggtgttcgctaatctcg

SEQ ID NO: 196858 - DNA, 20 bp, human
gttctctcttcgggattcgg

SEQ ID NO: 196859 - DNA, 20 bp, human
gcgggattcgggggaacagt

SEQ ID NO: 196860 - DNA, 20 bp, human
gcaatataggccttccccat

SEQ ID NO: 196861 - DNA, 20 bp, human
gaacaccggatgtgggggag

SEQ ID NO: 196862 - DNA, 20 bp, human
gatcggtgcggattcctatg

SEQ ID NO: 196863 - DNA, 20 bp, human
gtcgctaatctcgaggagcc

SEQ ID NO: 196864 - DNA, 20 bp, human
gggggaacagtcggttttcg

SEQ ID NO: 196865 - DNA, 20 bp, human
ggattagcgaacaccggatg

SEQ ID NO: 196866 - DNA, 20 bp, human
ggtggtaggccgagacccag

SEQ ID NO: 196867 - DNA, 20 bp, human
gtgcagctgccagtcctccg

SEQ ID NO: 196868 - DNA, 20 bp, human
gatgcgaggcctgcccctgg

SEQ ID NO: 196869 - DNA, 20 bp, human
gagccccttcaagagtacaa

SEQ ID NO: 196870 - DNA, 20 bp, human
gagcttggttggagttccaa

SEQ ID NO: 196871 - DNA, 20 bp, human
gaggcctcgcatccagagca

SEQ ID NO: 196872 - DNA, 20 bp, human
gggcctaccacctgctggag

SEQ ID NO: 196873 - DNA, 20 bp, human
ggaggcagtgggcgaaacaa

SEQ ID NO: 196874 - DNA, 20 bp, human
gagttccaagggctgatgct

SEQ ID NO: 196875 - DNA, 20 bp, human
gagctcctcaaagggctggt

SEQ ID NO: 196876 - DNA, 20 bp, human
gactgtggccctgagagggt

SEQ ID NO: 196877 - DNA, 20 bp, human
ggagagggtgggctaggtcg

SEQ ID NO: 196878 - DNA, 20 bp, human
ggtgggctaggtcgaggctg

SEQ ID NO: 196879 - DNA, 20 bp, human
ggcagctctgaacccacaag

SEQ ID NO: 196880 - DNA, 20 bp, human
gagggatgccagcttccact

SEQ ID NO: 196881 - DNA, 20 bp, human
gggaccagcggtagctcccg

SEQ ID NO: 196882 - DNA, 20 bp, human
ggaggctggggcttctgaag

SEQ ID NO: 196883 - DNA, 20 bp, human
ggcaaggagtcggagagact

SEQ ID NO: 196884 - DNA, 20 bp, human
gcttctgaagtggccgagcc

SEQ ID NO: 196885 - DNA, 20 bp, human
gctggaccaagcgaaacagg

SEQ ID NO: 196886 - DNA, 20 bp, human
gaggcgcggctgtgcggcag

SEQ ID NO: 196887 - DNA, 20 bp, human
gggaaagtccccgggtcacg

SEQ ID NO: 196888 - DNA, 20 bp, human
gtgggaactagtctccgtag

SEQ ID NO: 196889 - DNA, 20 bp, human
ggtcggaggcgaagccccta

SEQ ID NO: 196890 - DNA, 20 bp, human
gcccccctcgaaaaaaataa

SEQ ID NO: 196891 - DNA, 20 bp, human
ggcgtgcggcctccctgagt

SEQ ID NO: 196892 - DNA, 20 bp, human
ggaggggaggtgtagacggg

SEQ ID NO: 196893 - DNA, 20 bp, human
gagggactgtgctgcaacaa

SEQ ID NO: 196894 - DNA, 20 bp, human
gcttcgcctccgactcaggg

SEQ ID NO: 196895 - DNA, 20 bp, human
gtgcggcaggcgcggctgtg

SEQ ID NO: 196896 - DNA, 20 bp, human
gtagcagtaaccgctggagg

SEQ ID NO: 196897 - DNA, 20 bp, human
gggagcgtttccgtccgacc

SEQ ID NO: 196898 - DNA, 20 bp, human
gccgtccgaccaggccctgg

SEQ ID NO: 196899 - DNA, 20 bp, human
gggacgcgtgcagcagaccc

SEQ ID NO: 196900 - DNA, 20 bp, human
ggaagcgacaataaagccgg

SEQ ID NO: 196901 - DNA, 20 bp, human
gggccctggcggaggtcgaa

SEQ ID NO: 196902 - DNA, 20 bp, human
gggcgcgggtaggtgcgtgt

SEQ ID NO: 196903 - DNA, 20 bp, human
gcggaggaaggatatctgtg

SEQ ID NO: 196904 - DNA, 20 bp, human
gtccgaccaggccctggcgg

SEQ ID NO: 196905 - DNA, 20 bp, human
ggcgcgcggctttaaagagg

SEQ ID NO: 196906 - DNA, 20 bp, human
gcgggcgagttggtaaccag

SEQ ID NO: 196907 - DNA, 20 bp, human
gcgacgccgggacctcatcg

SEQ ID NO: 196908 - DNA, 20 bp, human
gggagaagtgcagttccccc

SEQ ID NO: 196909 - DNA, 20 bp, human
gcaggtgcgccgcctcgatg

SEQ ID NO: 196910 - DNA, 20 bp, human
gcttagtccgaaggaaaagc

SEQ ID NO: 196911 - DNA, 20 bp, human
gccgctggcgactgacaaaa

SEQ ID NO: 196912 - DNA, 20 bp, human
gcgggactctgtattaccag

SEQ ID NO: 196913 - DNA, 20 bp, human
ggcggcaccgtagggagaaa

SEQ ID NO: 196914 - DNA, 20 bp, human
gcgccgggacctcatcgagg

SEQ ID NO: 196915 - DNA, 20 bp, human
gaggcggcgcacctgggtcc

SEQ ID NO: 196916 - DNA, 20 bp, human
gcggcgtcggctaggactcg

SEQ ID NO: 196917 - DNA, 20 bp, human
gcgtcggctaggactcgggg

SEQ ID NO: 196918 - DNA, 20 bp, human
gccagcagcccgctaggatg

SEQ ID NO: 196919 - DNA, 20 bp, human
ggtgcaaacgtgtaaggggg

SEQ ID NO: 196920 - DNA, 20 bp, human
gatgaggcagccggtaaagg

SEQ ID NO: 196921 - DNA, 20 bp, human
ggagggacagcacctcccca

SEQ ID NO: 196922 - DNA, 20 bp, human
gaggcagccggtaaaggggg

SEQ ID NO: 196923 - DNA, 20 bp, human
gggaatgaggcagccggtaa

SEQ ID NO: 196924 - DNA, 20 bp, human
gctccgcgtgggcgtaaggg

SEQ ID NO: 196925 - DNA, 20 bp, human
gcctggggctctggactcca

SEQ ID NO: 196926 - DNA, 20 bp, human
ggaggagggctgctaccatc

SEQ ID NO: 196927 - DNA, 20 bp, human
gaaatcgtgcacgtccctga

SEQ ID NO: 196928 - DNA, 20 bp, human
ggatgtgcggcggccgccag

SEQ ID NO: 196929 - DNA, 20 bp, human
gagcgagcgcggggaaccca

SEQ ID NO: 196930 - DNA, 20 bp, human
gcgcgctcgcagagcctcgg

SEQ ID NO: 196931 - DNA, 20 bp, human
ggcgttctcgccgagctctg

SEQ ID NO: 196932 - DNA, 20 bp, human
gcccccaccgcggtgcactg

SEQ ID NO: 196933 - DNA, 20 bp, human
gcgcatgcacgggaaggggg

SEQ ID NO: 196934 - DNA, 20 bp, human
gactgcggcggtgcgagcgg

SEQ ID NO: 196935 - DNA, 20 bp, human
ggcgcgcgctcgcagagcct

SEQ ID NO: 196936 - DNA, 20 bp, human
ggttgctctccgtatcacgg

SEQ ID NO: 196937 - DNA, 20 bp, human
gccccgaccgtgccctgaag

SEQ ID NO: 196938 - DNA, 20 bp, human
gtcctcttcagggcacggtc

SEQ ID NO: 196939 - DNA, 20 bp, human
gtgtcgctgccgccgtgata

SEQ ID NO: 196940 - DNA, 20 bp, human
gagttgagggcgatgagagc

SEQ ID NO: 196941 - DNA, 20 bp, human
gactgttgctctccgtatca

SEQ ID NO: 196942 - DNA, 20 bp, human
gagaggggtcggggatccgg

SEQ ID NO: 196943 - DNA, 20 bp, human
gggaggctttgtaccgccag

SEQ ID NO: 196944 - DNA, 20 bp, human
gggtgtgcgtgcctgtcggg

SEQ ID NO: 196945 - DNA, 20 bp, human
gagggcacggtcggggtgag

SEQ ID NO: 196946 - DNA, 20 bp, human
ggtgcatcacggccgcgaga

SEQ ID NO: 196947 - DNA, 20 bp, human
gccgcccgactctaacatgg

SEQ ID NO: 196948 - DNA, 20 bp, human
ggcgccgccatgttagagtc

SEQ ID NO: 196949 - DNA, 20 bp, human
gcgcagagggaggtgcatca

SEQ ID NO: 196950 - DNA, 20 bp, human
ggttccgcccgactctaaca

SEQ ID NO: 196951 - DNA, 20 bp, human
ggccgcgagaaggccgggga

SEQ ID NO: 196952 - DNA, 20 bp, human
gagcgcgcggggtcaagggg

SEQ ID NO: 196953 - DNA, 20 bp, human
ggacagcgcgcggggtcaag

SEQ ID NO: 196954 - DNA, 20 bp, human
gcccgcgcgctgtcgagggt

SEQ ID NO: 196955 - DNA, 20 bp, human
ggcggagatgctaccagctg

SEQ ID NO: 196956 - DNA, 20 bp, human
gagtgtgtgcggatctgtgg

SEQ ID NO: 196957 - DNA, 20 bp, human
ggttagtgtgtgcggatctg

SEQ ID NO: 196958 - DNA, 20 bp, human
gggctccaggtctgttacat

SEQ ID NO: 196959 - DNA, 20 bp, human
ggacagggagttagtgtgtg

SEQ ID NO: 196960 - DNA, 20 bp, human
gtccaggtctgttacatcgg

SEQ ID NO: 196961 - DNA, 20 bp, human
gaagagagacagatgcaaag

SEQ ID NO: 196962 - DNA, 20 bp, human
gttattctaacacacagaca

SEQ ID NO: 196963 - DNA, 20 bp, human
gctgcttttggaaatcacgt

SEQ ID NO: 196964 - DNA, 20 bp, human
gtccaccgatgtaacagacc

SEQ ID NO: 196965 - DNA, 20 bp, human
gtatttagatttgattgggg

SEQ ID NO: 196966 - DNA, 20 bp, human
gccgccgcggtcggtgtctc

SEQ ID NO: 196967 - DNA, 20 bp, human
ggtcggtgtctccggcgcgg

SEQ ID NO: 196968 - DNA, 20 bp, human
ggcgccggagacaccgaccg

SEQ ID NO: 196969 - DNA, 20 bp, human
gagaggcggcgagagagcag

SEQ ID NO: 196970 - DNA, 20 bp, human
gaccatcccccggagccagg

SEQ ID NO: 196971 - DNA, 20 bp, human
gacccggttctgggaagcga

SEQ ID NO: 196972 - DNA, 20 bp, human
ggtgtggaggaggcgcctct

SEQ ID NO: 196973 - DNA, 20 bp, human
gtcggcggcgcctccatccg

SEQ ID NO: 196974 - DNA, 20 bp, human
gcccacaaaaccccggatgg

SEQ ID NO: 196975 - DNA, 20 bp, human
ggcttgacaaaaccatcccc

SEQ ID NO: 196976 - DNA, 20 bp, human
gcagcatgagctggaaatgt

SEQ ID NO: 196977 - DNA, 20 bp, human
gacttcccaacagaattcaa

SEQ ID NO: 196978 - DNA, 20 bp, human
ggatggtacagcagtgatct

SEQ ID NO: 196979 - DNA, 20 bp, human
gggtacagtccagcatgagc

SEQ ID NO: 196980 - DNA, 20 bp, human
gcttactctttctgctcggg

SEQ ID NO: 196981 - DNA, 20 bp, human
gtgatgtggacaggagtcga

SEQ ID NO: 196982 - DNA, 20 bp, human
ggaggtagtttcaggagaca

SEQ ID NO: 196983 - DNA, 20 bp, human
gcatccccttgaattctgtt

SEQ ID NO: 196984 - DNA, 20 bp, human
gcaagcagtagtcgggtggt

SEQ ID NO: 196985 - DNA, 20 bp, human
gggggggaagggtacgactg

SEQ ID NO: 196986 - DNA, 20 bp, human
gccttctgccgaagaagtag

SEQ ID NO: 196987 - DNA, 20 bp, human
gtccaagaagaggagctgag

SEQ ID NO: 196988 - DNA, 20 bp, human
gctcctcttcttggaagcag

SEQ ID NO: 196989 - DNA, 20 bp, human
gagccgccgggcgctaagaa

SEQ ID NO: 196990 - DNA, 20 bp, human
gaagattaaagagcgcgagg

SEQ ID NO: 196991 - DNA, 20 bp, human
gagccgctgcttccaagaag

SEQ ID NO: 196992 - DNA, 20 bp, human
gtctagcagctcctgagccc

SEQ ID NO: 196993 - DNA, 20 bp, human
gtctgccgaagaagtagggg

SEQ ID NO: 196994 - DNA, 20 bp, human
gccccccgcccctacttctt

SEQ ID NO: 196995 - DNA, 20 bp, human
ggggggagcgagttacagag

SEQ ID NO: 196996 - DNA, 20 bp, human
gggcgtgtcccctaccccag

SEQ ID NO: 196997 - DNA, 20 bp, human
ggatggaatcacagcggcag

SEQ ID NO: 196998 - DNA, 20 bp, human
gtgaagagtgaagcccgtga

SEQ ID NO: 196999 - DNA, 20 bp, human
gccgagctgcccctggggta

SEQ ID NO: 197000 - DNA, 20 bp, human
gtaggggacacgcctggccc

SEQ ID NO: 197001 - DNA, 20 bp, human
ggagccgagtgtgagcggaa

SEQ ID NO: 197002 - DNA, 20 bp, human
gctgcctcgagactgaagac

SEQ ID NO: 197003 - DNA, 20 bp, human
gggagcccgcaacccgctgg

SEQ ID NO: 197004 - DNA, 20 bp, human
gatgacctcatccctggtgt

SEQ ID NO: 197005 - DNA, 20 bp, human
gagtgaagcccgtgagggaa

SEQ ID NO: 197006 - DNA, 20 bp, human
gccccccgcccctcactcgg

SEQ ID NO: 197007 - DNA, 20 bp, human
ggctctggccgccgagtgag

SEQ ID NO: 197008 - DNA, 20 bp, human
gctcaggtaagtcggaaata

SEQ ID NO: 197009 - DNA, 20 bp, human
ggagcacagaccccactgta

SEQ ID NO: 197010 - DNA, 20 bp, human
ggtgggcggaggtagacaag

SEQ ID NO: 197011 - DNA, 20 bp, human
gggtcgaaaggcccgatagt

SEQ ID NO: 197012 - DNA, 20 bp, human
gctggccgccgagtgagggg

SEQ ID NO: 197013 - DNA, 20 bp, human
gggagggagtcggcgcaaga

SEQ ID NO: 197014 - DNA, 20 bp, human
gctgccccctcccaaaaagt

SEQ ID NO: 197015 - DNA, 20 bp, human
ggtgctcttaggggctggag

SEQ ID NO: 197016 - DNA, 20 bp, human
ggcaggagcagaaaccggtg

SEQ ID NO: 197017 - DNA, 20 bp, human
ggggccgccagacacactag

SEQ ID NO: 197018 - DNA, 20 bp, human
gtggcgccgcgcttccgggt

SEQ ID NO: 197019 - DNA, 20 bp, human
gtccgccccgcccgcctctg

SEQ ID NO: 197020 - DNA, 20 bp, human
gcggcagacctaccgctcag

SEQ ID NO: 197021 - DNA, 20 bp, human
gcacagccaacccggaagcg

SEQ ID NO: 197022 - DNA, 20 bp, human
gccgccagacacactagggg

SEQ ID NO: 197023 - DNA, 20 bp, human
gtccctgctgggaccacccg

SEQ ID NO: 197024 - DNA, 20 bp, human
gccgactggggagcacacgg

SEQ ID NO: 197025 - DNA, 20 bp, human
gtcgctgccaactcacccgg

SEQ ID NO: 197026 - DNA, 20 bp, human
gccgactcctccgtgcagga

SEQ ID NO: 197027 - DNA, 20 bp, human
gagtcggcctgccgccgcgg

SEQ ID NO: 197028 - DNA, 20 bp, human
gtctgcgtcgagctccgagg

SEQ ID NO: 197029 - DNA, 20 bp, human
gggctcctcccgactcccca

SEQ ID NO: 197030 - DNA, 20 bp, human
gggaagtgactcagggccag

SEQ ID NO: 197031 - DNA, 20 bp, human
gggtcacgtggggccatcgc

SEQ ID NO: 197032 - DNA, 20 bp, human
gagccgcgcactgcaagcag

SEQ ID NO: 197033 - DNA, 20 bp, human
ggggcgaccctgaaccgacg

SEQ ID NO: 197034 - DNA, 20 bp, human
ggctgccggggcctgattca

SEQ ID NO: 197035 - DNA, 20 bp, human
gccaagcctacccttgagag

SEQ ID NO: 197036 - DNA, 20 bp, human
gggagcctgaggatgcccct

SEQ ID NO: 197037 - DNA, 20 bp, human
ggaaggccgccgtcaggatc

SEQ ID NO: 197038 - DNA, 20 bp, human
gcaggagctccggcccctcg

SEQ ID NO: 197039 - DNA, 20 bp, human
gtggcggtgccggatcctga

SEQ ID NO: 197040 - DNA, 20 bp, human
gggtaacctagcactcacag

SEQ ID NO: 197041 - DNA, 20 bp, human
gcggtgccggatcctgacgg

SEQ ID NO: 197042 - DNA, 20 bp, human
gtccgcacttacagacccgg

SEQ ID NO: 197043 - DNA, 20 bp, human
ggagccaaagggggacccaa

SEQ ID NO: 197044 - DNA, 20 bp, human
gggacccaacggaaccggaa

SEQ ID NO: 197045 - DNA, 20 bp, human
ggggctcctcaagtccccag

SEQ ID NO: 197046 - DNA, 20 bp, human
gctaccagggtgggaactag

SEQ ID NO: 197047 - DNA, 20 bp, human
gcaggggctaaggactacca

SEQ ID NO: 197048 - DNA, 20 bp, human
gtcgccctgtggctgctcgg

SEQ ID NO: 197049 - DNA, 20 bp, human
gcaaaaaaggtccccaccag

SEQ ID NO: 197050 - DNA, 20 bp, human
gtctccctcacgcattccag

SEQ ID NO: 197051 - DNA, 20 bp, human
gcccacccggtagcgtccaa

SEQ ID NO: 197052 - DNA, 20 bp, human
gtagcccctggaatgcgtga

SEQ ID NO: 197053 - DNA, 20 bp, human
gcgaggtgggcggagctaat

SEQ ID NO: 197054 - DNA, 20 bp, human
gtctccgctagttcccaccc

SEQ ID NO: 197055 - DNA, 20 bp, human
ggaagcggagggtggctaag

SEQ ID NO: 197056 - DNA, 20 bp, human
ggaaggcctcagctggagag

SEQ ID NO: 197057 - DNA, 20 bp, human
ggaggctcctgacccaatga

SEQ ID NO: 197058 - DNA, 20 bp, human
gagatgggaggaaaggacgt

SEQ ID NO: 197059 - DNA, 20 bp, human
gttcagagcatgcggtgtcc

SEQ ID NO: 197060 - DNA, 20 bp, human
gagagggctctaggttggca

SEQ ID NO: 197061 - DNA, 20 bp, human
ggggctctaggttggcaggg

SEQ ID NO: 197062 - DNA, 20 bp, human
gcaggagtccattctccaaa

SEQ ID NO: 197063 - DNA, 20 bp, human
gaatggactcctgaggagat

SEQ ID NO: 197064 - DNA, 20 bp, human
gaccgcttgtagcttcttcc

SEQ ID NO: 197065 - DNA, 20 bp, human
gtcacagggaacctgcacct

SEQ ID NO: 197066 - DNA, 20 bp, human
gaagccccggggcctaccca

SEQ ID NO: 197067 - DNA, 20 bp, human
gggggctaggggagtaaaag

SEQ ID NO: 197068 - DNA, 20 bp, human
ggtgccctgggtaggccccg

SEQ ID NO: 197069 - DNA, 20 bp, human
ggcgctgtgccctctgtcgg

SEQ ID NO: 197070 - DNA, 20 bp, human
gcgcaggcgcggcccaggga

SEQ ID NO: 197071 - DNA, 20 bp, human
ggcagcccctcggcccctaa

SEQ ID NO: 197072 - DNA, 20 bp, human
ggccaagtgggtctctgtga

SEQ ID NO: 197073 - DNA, 20 bp, human
ggtctgggtcgacgtcgacg

SEQ ID NO: 197074 - DNA, 20 bp, human
ggccccacgccgccgacaga

SEQ ID NO: 197075 - DNA, 20 bp, human
gggcgaagcgctgaagccaa

SEQ ID NO: 197076 - DNA, 20 bp, human
ggatcccgagacgccccggg

SEQ ID NO: 197077 - DNA, 20 bp, human
gacaaaagggagcgccccca

SEQ ID NO: 197078 - DNA, 20 bp, human
gtggcccggccggctctcca

SEQ ID NO: 197079 - DNA, 20 bp, human
gtgagcgcggcgctctggac

SEQ ID NO: 197080 - DNA, 20 bp, human
gccggctgagggtcgcgctc

SEQ ID NO: 197081 - DNA, 20 bp, human
gtccgggcccctagccctgg

SEQ ID NO: 197082 - DNA, 20 bp, human
gccgctgtccggctccctct

SEQ ID NO: 197083 - DNA, 20 bp, human
gtcaggcgcgcgtccccgag

SEQ ID NO: 197084 - DNA, 20 bp, human
gaggctctgggacgacaacc

SEQ ID NO: 197085 - DNA, 20 bp, human
ggagcacagctggcccctcg

SEQ ID NO: 197086 - DNA, 20 bp, human
ggagcagcacctacctccgg

SEQ ID NO: 197087 - DNA, 20 bp, human
gtggggcccgagtccagtca

SEQ ID NO: 197088 - DNA, 20 bp, human
gcagcgctcaggtgagaact

SEQ ID NO: 197089 - DNA, 20 bp, human
ggaggaacttcggagaagat

SEQ ID NO: 197090 - DNA, 20 bp, human
gggcccatttccacccccgg

SEQ ID NO: 197091 - DNA, 20 bp, human
gcaggtgagaactaggaagg

SEQ ID NO: 197092 - DNA, 20 bp, human
gaaggagcagcacctacctc

SEQ ID NO: 197093 - DNA, 20 bp, human
gtacctccgggggtggaaat

SEQ ID NO: 197094 - DNA, 20 bp, human
gggtggaaatgggccggaat

SEQ ID NO: 197095 - DNA, 20 bp, human
gttctgcgttaggaagcctg

SEQ ID NO: 197096 - DNA, 20 bp, human
ggcgctgcggccggactcac

SEQ ID NO: 197097 - DNA, 20 bp, human
ggcgcggctgtgctagaggg

SEQ ID NO: 197098 - DNA, 20 bp, human
gcacgggtccggaagcacca

SEQ ID NO: 197099 - DNA, 20 bp, human
gtcccaatccaggagacggg

SEQ ID NO: 197100 - DNA, 20 bp, human
gccagaagcgaggagcgatc

SEQ ID NO: 197101 - DNA, 20 bp, human
gcctgcgaggggcacttacg

SEQ ID NO: 197102 - DNA, 20 bp, human
ggaggaggaatgcgctcccg

SEQ ID NO: 197103 - DNA, 20 bp, human
gactgcgcggctgtgctaga

SEQ ID NO: 197104 - DNA, 20 bp, human
gcgccggcgcgtttccccgg

SEQ ID NO: 197105 - DNA, 20 bp, human
gcccgcgaagaccctgcgag

SEQ ID NO: 197106 - DNA, 20 bp, human
gcaagccccagcccagagtt

SEQ ID NO: 197107 - DNA, 20 bp, human
gctgaagccaggaaactagt

SEQ ID NO: 197108 - DNA, 20 bp, human
gaaataaaaggtgtgctata

SEQ ID NO: 197109 - DNA, 20 bp, human
gccagcccagagttgggagt

SEQ ID NO: 197110 - DNA, 20 bp, human
gtggcaagctgtaggcgtca

SEQ ID NO: 197111 - DNA, 20 bp, human
gagtccctactcccaactct

SEQ ID NO: 197112 - DNA, 20 bp, human
gttgggagaccctctaaata

SEQ ID NO: 197113 - DNA, 20 bp, human
gtgaagggcgctgagtgagg

SEQ ID NO: 197114 - DNA, 20 bp, human
gtactaagacggaaaccctg

SEQ ID NO: 197115 - DNA, 20 bp, human
gctctaaatacggccccaaa

SEQ ID NO: 197116 - DNA, 20 bp, human
gcgtgcccggcccgacgagg

SEQ ID NO: 197117 - DNA, 20 bp, human
gcccagatgcgactccggag

SEQ ID NO: 197118 - DNA, 20 bp, human
ggcggcgccgcctcctcgtc

SEQ ID NO: 197119 - DNA, 20 bp, human
gccgccgccgcttcacacaa

SEQ ID NO: 197120 - DNA, 20 bp, human
gggagggaagggcgctgcat

SEQ ID NO: 197121 - DNA, 20 bp, human
ggactccggaggggagaccg

SEQ ID NO: 197122 - DNA, 20 bp, human
gaagggcgctgcatcggctg

SEQ ID NO: 197123 - DNA, 20 bp, human
gaacagcgcggggctcaccc

SEQ ID NO: 197124 - DNA, 20 bp, human
ggtggccacccctgaacgat

SEQ ID NO: 197125 - DNA, 20 bp, human
gggcgctcgttgcctccaga

SEQ ID NO: 197126 - DNA, 20 bp, human
gacggcccccggagacgggt

SEQ ID NO: 197127 - DNA, 20 bp, human
ggggtgcgagccagagtcgt

SEQ ID NO: 197128 - DNA, 20 bp, human
gcgcccaaccagcgagcggg

SEQ ID NO: 197129 - DNA, 20 bp, human
gagcagcgaggagaggcggt

SEQ ID NO: 197130 - DNA, 20 bp, human
gcgcctgcgcaggcccgcaa

SEQ ID NO: 197131 - DNA, 20 bp, human
gatcatggctcggtacagcg

SEQ ID NO: 197132 - DNA, 20 bp, human
gaaccccccgctcgctggtt

SEQ ID NO: 197133 - DNA, 20 bp, human
gactgtccgggagagatcac

SEQ ID NO: 197134 - DNA, 20 bp, human
ggcgaccttttgaagtgaca

SEQ ID NO: 197135 - DNA, 20 bp, human
ggagacgggtgggcatctcc

SEQ ID NO: 197136 - DNA, 20 bp, human
gggggagccgatgatgtcag

SEQ ID NO: 197137 - DNA, 20 bp, human
gtcgctcggacgccatacca

SEQ ID NO: 197138 - DNA, 20 bp, human
gccgccgccgctgacatcat

SEQ ID NO: 197139 - DNA, 20 bp, human
gcgtgggacgcgatcgcctg

SEQ ID NO: 197140 - DNA, 20 bp, human
ggactaagggggccctggta

SEQ ID NO: 197141 - DNA, 20 bp, human
gatcgcctggggccgtggaa

SEQ ID NO: 197142 - DNA, 20 bp, human
gatggcgtccgagcgagggg

SEQ ID NO: 197143 - DNA, 20 bp, human
ggtgggccctggggcgaact

SEQ ID NO: 197144 - DNA, 20 bp, human
ggcccccaggtcaaccccaa

SEQ ID NO: 197145 - DNA, 20 bp, human
gccccaaaggagagcggtct

SEQ ID NO: 197146 - DNA, 20 bp, human
gcccggcgaagggacctgaa

SEQ ID NO: 197147 - DNA, 20 bp, human
ggaccgcggggacccactca

SEQ ID NO: 197148 - DNA, 20 bp, human
gcgccggagacgccagaagg

SEQ ID NO: 197149 - DNA, 20 bp, human
gtccggacgggccgagaggg

SEQ ID NO: 197150 - DNA, 20 bp, human
gccccaggcggtgtcaggtc

SEQ ID NO: 197151 - DNA, 20 bp, human
gcagcgccggagacgccaga

SEQ ID NO: 197152 - DNA, 20 bp, human
gcgggtgcgccctaaatgag

SEQ ID NO: 197153 - DNA, 20 bp, human
gggagtgagacagcgacaag

SEQ ID NO: 197154 - DNA, 20 bp, human
gcgtctccggcgctgttgaa

SEQ ID NO: 197155 - DNA, 20 bp, human
gttgcgcgccggcctcaaga

SEQ ID NO: 197156 - DNA, 20 bp, human
gggagggccgggtttagaaa

SEQ ID NO: 197157 - DNA, 20 bp, human
gtggataacagcttctgaag

SEQ ID NO: 197158 - DNA, 20 bp, human
gtctgaaggggcgtgcccaa

SEQ ID NO: 197159 - DNA, 20 bp, human
gtaacatgctttcctcgggc

SEQ ID NO: 197160 - DNA, 20 bp, human
gtggagagactcggatctcg

SEQ ID NO: 197161 - DNA, 20 bp, human
ggatggtgacaataaggccg

SEQ ID NO: 197162 - DNA, 20 bp, human
gtgctgggatggtgacaata

SEQ ID NO: 197163 - DNA, 20 bp, human
ggctgtgccttgcccgcccg

SEQ ID NO: 197164 - DNA, 20 bp, human
gttggggcggagaacaagga

SEQ ID NO: 197165 - DNA, 20 bp, human
gaggcctggaaggtgtgcct

SEQ ID NO: 197166 - DNA, 20 bp, human
gacatcgtcaaggtctgcaa

SEQ ID NO: 197167 - DNA, 20 bp, human
ggccgccgccgtcatcacct

SEQ ID NO: 197168 - DNA, 20 bp, human
gctggcgcgcgtggagctgc

SEQ ID NO: 197169 - DNA, 20 bp, human
gggcggggcgcgctccaact

SEQ ID NO: 197170 - DNA, 20 bp, human
gctgcctgtggaggacgtcc

SEQ ID NO: 197171 - DNA, 20 bp, human
ggccgggaagggcgcttcgt

SEQ ID NO: 197172 - DNA, 20 bp, human
gcagcacggtgcagtcgcat

SEQ ID NO: 197173 - DNA, 20 bp, human
gctgccaggacgtcctccac

SEQ ID NO: 197174 - DNA, 20 bp, human
gcctgaacttcactcccggg

SEQ ID NO: 197175 - DNA, 20 bp, human
gggcggcggcggcatctggt

SEQ ID NO: 197176 - DNA, 20 bp, human
gcggcagctgaggctacaac

SEQ ID NO: 197177 - DNA, 20 bp, human
gtacaacaggcctgcgccgg

SEQ ID NO: 197178 - DNA, 20 bp, human
ggccacgcagtacctgccaa

SEQ ID NO: 197179 - DNA, 20 bp, human
gccgccgcgagggtgacctt

SEQ ID NO: 197180 - DNA, 20 bp, human
ggaatctgttgcggcagctg

SEQ ID NO: 197181 - DNA, 20 bp, human
gggctacaacaggcctgcgc

SEQ ID NO: 197182 - DNA, 20 bp, human
gggcgcggcttgacgacctc

SEQ ID NO: 197183 - DNA, 20 bp, human
ggcagagaggatatcttggg

SEQ ID NO: 197184 - DNA, 20 bp, human
gctacgccccgaaaggccag

SEQ ID NO: 197185 - DNA, 20 bp, human
ggcctttcggggcgtagggt

SEQ ID NO: 197186 - DNA, 20 bp, human
gctgctcacgggcctaggcg

SEQ ID NO: 197187 - DNA, 20 bp, human
ggtgagcggagcggcaacgg

SEQ ID NO: 197188 - DNA, 20 bp, human
gccagcctggcgggagaagg

SEQ ID NO: 197189 - DNA, 20 bp, human
ggggcccctgagcctcccgg

SEQ ID NO: 197190 - DNA, 20 bp, human
gggagtgagcggagcggcaa

SEQ ID NO: 197191 - DNA, 20 bp, human
ggcctctctcctcccccggg

SEQ ID NO: 197192 - DNA, 20 bp, human
gggcgcggcggcccgagata

SEQ ID NO: 197193 - DNA, 20 bp, human
ggctcaggggcccctatctc

SEQ ID NO: 197194 - DNA, 20 bp, human
gcgccggcgcagagcattgt

SEQ ID NO: 197195 - DNA, 20 bp, human
ggccggccgcacgcgcgcgg

SEQ ID NO: 197196 - DNA, 20 bp, human
ggtgcctgaagaggagtcgg

SEQ ID NO: 197197 - DNA, 20 bp, human
gcggcgtcgggactgaggaa

SEQ ID NO: 197198 - DNA, 20 bp, human
ggtagtcggtcaggaggaag

SEQ ID NO: 197199 - DNA, 20 bp, human
gggaagtgcggccttgtagt

SEQ ID NO: 197200 - DNA, 20 bp, human
ggtcggaggtggggtcgaat

SEQ ID NO: 197201 - DNA, 20 bp, human
gaagcggccacggcagagcc

SEQ ID NO: 197202 - DNA, 20 bp, human
gtggcagcggcgggtcagag

SEQ ID NO: 197203 - DNA, 20 bp, human
ggggcaatggagcagagtat

SEQ ID NO: 197204 - DNA, 20 bp, human
gtgaagaggagtcggaggtg

SEQ ID NO: 197205 - DNA, 20 bp, human
gggccttgtagtcggtcagg

SEQ ID NO: 197206 - DNA, 20 bp, human
gcgccggcctgacggaccga

SEQ ID NO: 197207 - DNA, 20 bp, human
gggagggcgctgcgtccggg

SEQ ID NO: 197208 - DNA, 20 bp, human
gcggacggaccgagcagccc

SEQ ID NO: 197209 - DNA, 20 bp, human
gcggcggcggcggcgatcac

SEQ ID NO: 197210 - DNA, 20 bp, human
gccgagctgcgcgctcgccg

SEQ ID NO: 197211 - DNA, 20 bp, human
ggcgccgatggcccccggga

SEQ ID NO: 197212 - DNA, 20 bp, human
gggccgcgcggacaatgagc

SEQ ID NO: 197213 - DNA, 20 bp, human
gccatcggcgctcccagctg

SEQ ID NO: 197214 - DNA, 20 bp, human
gcgcgcagctcggacccgcc

SEQ ID NO: 197215 - DNA, 20 bp, human
ggtccgtcggtccgtcaggc

SEQ ID NO: 197216 - DNA, 20 bp, human
gcagcagtggtcaggtcaca

SEQ ID NO: 197217 - DNA, 20 bp, human
gcaagggggccactcagcag

SEQ ID NO: 197218 - DNA, 20 bp, human
gtgctgcatagggccaccca

SEQ ID NO: 197219 - DNA, 20 bp, human
gccagaggagtagggaccag

SEQ ID NO: 197220 - DNA, 20 bp, human
gcctccgtggcgcaaccgga

SEQ ID NO: 197221 - DNA, 20 bp, human
gtcaggtcacacggctagag

SEQ ID NO: 197222 - DNA, 20 bp, human
gtgacctgaccactgctgag

SEQ ID NO: 197223 - DNA, 20 bp, human
ggtccactggagccaagtcc

SEQ ID NO: 197224 - DNA, 20 bp, human
gcacggctagaggggcacag

SEQ ID NO: 197225 - DNA, 20 bp, human
ggatccctcaggggagcggg

SEQ ID NO: 197226 - DNA, 20 bp, human
gagtctccgcactgtcggcg

SEQ ID NO: 197227 - DNA, 20 bp, human
ggcgtaccccgccgacagtg

SEQ ID NO: 197228 - DNA, 20 bp, human
gagccgggcactaggttcgt

SEQ ID NO: 197229 - DNA, 20 bp, human
gacgtccggcgcggagacgg

SEQ ID NO: 197230 - DNA, 20 bp, human
gggtggagtctccgcactgt

SEQ ID NO: 197231 - DNA, 20 bp, human
gcggcggggtacgcatagcc

SEQ ID NO: 197232 - DNA, 20 bp, human
gcacactgacagcctcccgg

SEQ ID NO: 197233 - DNA, 20 bp, human
gacagtgagaggatcccgga

SEQ ID NO: 197234 - DNA, 20 bp, human
ggtacgcatagccgggcact

SEQ ID NO: 197235 - DNA, 20 bp, human
gagcacgagggcttgggtca

SEQ ID NO: 197236 - DNA, 20 bp, human
ggctgctgcaggtgaagagt

SEQ ID NO: 197237 - DNA, 20 bp, human
gtcgctgcgagtggccttga

SEQ ID NO: 197238 - DNA, 20 bp, human
ggctgcaggtgaagagtagg

SEQ ID NO: 197239 - DNA, 20 bp, human
gtctgtgccgggcatcacag

SEQ ID NO: 197240 - DNA, 20 bp, human
ggcactcgaggatacccggg

SEQ ID NO: 197241 - DNA, 20 bp, human
gcgagtgcccagagacggga

SEQ ID NO: 197242 - DNA, 20 bp, human
gagagatgggcagcgcgtag

SEQ ID NO: 197243 - DNA, 20 bp, human
ggccactcgcagcgatccgc

SEQ ID NO: 197244 - DNA, 20 bp, human
gaggccggccaccttaccct

SEQ ID NO: 197245 - DNA, 20 bp, human
gccggccaccttaccctcgg

SEQ ID NO: 197246 - DNA, 20 bp, human
gcagcactctgagaacacgg

SEQ ID NO: 197247 - DNA, 20 bp, human
gggaggagctaggggactag

SEQ ID NO: 197248 - DNA, 20 bp, human
ggcggagcccgactcaggtg

SEQ ID NO: 197249 - DNA, 20 bp, human
ggcctggcgtcgggacaccg

SEQ ID NO: 197250 - DNA, 20 bp, human
ggacagccagagtagtccgg

SEQ ID NO: 197251 - DNA, 20 bp, human
gggcggcgcccgaggataag

SEQ ID NO: 197252 - DNA, 20 bp, human
gagtgctgcggcgaactggc

SEQ ID NO: 197253 - DNA, 20 bp, human
gtcggactcggcagtgtcag

SEQ ID NO: 197254 - DNA, 20 bp, human
gcactctgagaacacggcgg

SEQ ID NO: 197255 - DNA, 20 bp, human
gaactggctggaggagctag

SEQ ID NO: 197256 - DNA, 20 bp, human
gactagagtcaaggattccg

SEQ ID NO: 197257 - DNA, 20 bp, human
gtaagtccatcttccggctt

SEQ ID NO: 197258 - DNA, 20 bp, human
gccaggctaagtccatcttc

SEQ ID NO: 197259 - DNA, 20 bp, human
ggcttgggcagacgctgccg

SEQ ID NO: 197260 - DNA, 20 bp, human
gtctctctggttgaaacggg

SEQ ID NO: 197261 - DNA, 20 bp, human
gactagctgaaaaaaggaac

SEQ ID NO: 197262 - DNA, 20 bp, human
gcaaggccctgtcggcccag

SEQ ID NO: 197263 - DNA, 20 bp, human
ggagagcagctgactctctc

SEQ ID NO: 197264 - DNA, 20 bp, human
gctggaggcaaccctgcgaa

SEQ ID NO: 197265 - DNA, 20 bp, human
gtgcaaccactgggccgaca

SEQ ID NO: 197266 - DNA, 20 bp, human
gccggcgcggcccccggcac

SEQ ID NO: 197267 - DNA, 20 bp, human
gccgcgcgagggagcgacca

SEQ ID NO: 197268 - DNA, 20 bp, human
ggagtcgcgagcatcatacg

SEQ ID NO: 197269 - DNA, 20 bp, human
gtactgtacagttactgtag

SEQ ID NO: 197270 - DNA, 20 bp, human
gctcgggaaggggagatccg

SEQ ID NO: 197271 - DNA, 20 bp, human
ggagccggcgtggggagata

SEQ ID NO: 197272 - DNA, 20 bp, human
gccggcgtggggagataggg

SEQ ID NO: 197273 - DNA, 20 bp, human
gcgctcgcctccggggtccg

SEQ ID NO: 197274 - DNA, 20 bp, human
ggccatgcacccgggttggg

SEQ ID NO: 197275 - DNA, 20 bp, human
gtgcccgcgtcgcgctgccc

SEQ ID NO: 197276 - DNA, 20 bp, human
gtgggctggctccctccgag

SEQ ID NO: 197277 - DNA, 20 bp, human
ggtctcccgcccgggaggta

SEQ ID NO: 197278 - DNA, 20 bp, human
gctccctccgaggggccggg

SEQ ID NO: 197279 - DNA, 20 bp, human
gaggccaggccccccacccg

SEQ ID NO: 197280 - DNA, 20 bp, human
ggctcaggcttcgcacgtgg

SEQ ID NO: 197281 - DNA, 20 bp, human
gcacgtggtggtggcgtcaa

SEQ ID NO: 197282 - DNA, 20 bp, human
gcggagccggacggccgtcc

SEQ ID NO: 197283 - DNA, 20 bp, human
gcctcccgctccctacctcc

SEQ ID NO: 197284 - DNA, 20 bp, human
gggtccgggccagaggagac

SEQ ID NO: 197285 - DNA, 20 bp, human
gcgctccctacctcccgggc

SEQ ID NO: 197286 - DNA, 20 bp, human
gggagccccccagcagcgag

SEQ ID NO: 197287 - DNA, 20 bp, human
gctgctgaggctcacagtgt

SEQ ID NO: 197288 - DNA, 20 bp, human
ggcggccttctgaccaggac

SEQ ID NO: 197289 - DNA, 20 bp, human
gaagtcacgaaggagactgg

SEQ ID NO: 197290 - DNA, 20 bp, human
gagcggcgagcaactgaccg

SEQ ID NO: 197291 - DNA, 20 bp, human
gagcagggccccaagccccc

SEQ ID NO: 197292 - DNA, 20 bp, human
gacggcttcgggatggagag

SEQ ID NO: 197293 - DNA, 20 bp, human
gtctgaccaggaccggagca

SEQ ID NO: 197294 - DNA, 20 bp, human
gctcgccgctcgctgctggg

SEQ ID NO: 197295 - DNA, 20 bp, human
ggatgccccccaaccctagg

SEQ ID NO: 197296 - DNA, 20 bp, human
gcgccacgagactctgacag

SEQ ID NO: 197297 - DNA, 20 bp, human
gtcgggcgcgcagggaccgg

SEQ ID NO: 197298 - DNA, 20 bp, human
gagggaccggcggacaccgg

SEQ ID NO: 197299 - DNA, 20 bp, human
gggcagccatgcaacggagg

SEQ ID NO: 197300 - DNA, 20 bp, human
gcgccgctgtcagagtctcg

SEQ ID NO: 197301 - DNA, 20 bp, human
ggctattcaggggctccgtg

SEQ ID NO: 197302 - DNA, 20 bp, human
gtgcggcagccatgcaacgg

SEQ ID NO: 197303 - DNA, 20 bp, human
gcgcagggaccggcggacac

SEQ ID NO: 197304 - DNA, 20 bp, human
gagccatgcaacggaggagg

SEQ ID NO: 197305 - DNA, 20 bp, human
gggcgcggccggcgaggctc

SEQ ID NO: 197306 - DNA, 20 bp, human
ggccagccgaaggaacgtaa

SEQ ID NO: 197307 - DNA, 20 bp, human
gcccgggctgggaatccacg

SEQ ID NO: 197308 - DNA, 20 bp, human
ggcgtgggccggcggcaatg

SEQ ID NO: 197309 - DNA, 20 bp, human
ggacaacctcccgccggctg

SEQ ID NO: 197310 - DNA, 20 bp, human
gctctcccggccgcccggaa

SEQ ID NO: 197311 - DNA, 20 bp, human
gcaaaggagcccgctggcgt

SEQ ID NO: 197312 - DNA, 20 bp, human
gctcttccgaaataggagag

SEQ ID NO: 197313 - DNA, 20 bp, human
gcgtgtcctgagcgccgcca

SEQ ID NO: 197314 - DNA, 20 bp, human
gatcaatgacaacctcccgc

SEQ ID NO: 197315 - DNA, 20 bp, human
gtcgccccaaaggagcccgc

SEQ ID NO: 197316 - DNA, 20 bp, human
gggcgccgcggactctggag

SEQ ID NO: 197317 - DNA, 20 bp, human
gggctgcgcggagcaaagac

SEQ ID NO: 197318 - DNA, 20 bp, human
ggcgcctccggagggcagaa

SEQ ID NO: 197319 - DNA, 20 bp, human
gcgacggctccagacacgcc

SEQ ID NO: 197320 - DNA, 20 bp, human
gaaaggaacggcctcgaaag

SEQ ID NO: 197321 - DNA, 20 bp, human
gtgggaaaggcgcctccgga

SEQ ID NO: 197322 - DNA, 20 bp, human
ggttttagggcgcaaaggaa

SEQ ID NO: 197323 - DNA, 20 bp, human
gtgcgcggagcaaagacggg

SEQ ID NO: 197324 - DNA, 20 bp, human
ggattcctggttctcggctg

SEQ ID NO: 197325 - DNA, 20 bp, human
gtacttgttttagggcgcaa

SEQ ID NO: 197326 - DNA, 20 bp, human
gtacagggcacggcccccga

SEQ ID NO: 197327 - DNA, 20 bp, human
gcacactggagaagtgccag

SEQ ID NO: 197328 - DNA, 20 bp, human
gctgcgctgctggaacccgc

SEQ ID NO: 197329 - DNA, 20 bp, human
gctccccaaaccaacgaaag

SEQ ID NO: 197330 - DNA, 20 bp, human
ggaaggtgagcgcgaagaag

SEQ ID NO: 197331 - DNA, 20 bp, human
ggtcggtgcgcggtgctccg

SEQ ID NO: 197332 - DNA, 20 bp, human
gcatcagacgacctgcagag

SEQ ID NO: 197333 - DNA, 20 bp, human
gcggaggacacccaatgaca

SEQ ID NO: 197334 - DNA, 20 bp, human
gagggcacggcccccgaggg

SEQ ID NO: 197335 - DNA, 20 bp, human
gtggcctcccgcggacaaag

SEQ ID NO: 197336 - DNA, 20 bp, human
ggcacactcccgcggcaaga

SEQ ID NO: 197337 - DNA, 20 bp, human
gccgaagtccggtggatgaa

SEQ ID NO: 197338 - DNA, 20 bp, human
gaagtccggtggatgaaggg

SEQ ID NO: 197339 - DNA, 20 bp, human
gtcaccgttgggaaatacat

SEQ ID NO: 197340 - DNA, 20 bp, human
gctctcacgtgaccctgacc

SEQ ID NO: 197341 - DNA, 20 bp, human
ggtgtctaatcctgcagtca

SEQ ID NO: 197342 - DNA, 20 bp, human
gtttggtccgcacactcccg

SEQ ID NO: 197343 - DNA, 20 bp, human
gcaaggggcggagtctagag

SEQ ID NO: 197344 - DNA, 20 bp, human
ggactcggaaagctaattag

SEQ ID NO: 197345 - DNA, 20 bp, human
gtgtgcgaggttagaggact

SEQ ID NO: 197346 - DNA, 20 bp, human
gggcagcgccgcgtgtgtaa

SEQ ID NO: 197347 - DNA, 20 bp, human
ggtctgggacggagctgtag

SEQ ID NO: 197348 - DNA, 20 bp, human
ggcccccgccgttacacacg

SEQ ID NO: 197349 - DNA, 20 bp, human
ggccgcgtgtgtaacggcgg

SEQ ID NO: 197350 - DNA, 20 bp, human
ggtcggcgggaaggacaatc

SEQ ID NO: 197351 - DNA, 20 bp, human
gagcgccgcgtgtgtaacgg

SEQ ID NO: 197352 - DNA, 20 bp, human
gtgtaacggcgggggcgtgt

SEQ ID NO: 197353 - DNA, 20 bp, human
gtagcggcactgtaactgcg

SEQ ID NO: 197354 - DNA, 20 bp, human
gggcggcttccggtctggga

SEQ ID NO: 197355 - DNA, 20 bp, human
gtcacagaagccctggataa

SEQ ID NO: 197356 - DNA, 20 bp, human
gtacagccagagctgggcgg

SEQ ID NO: 197357 - DNA, 20 bp, human
ggagactgggatcactaaaa

SEQ ID NO: 197358 - DNA, 20 bp, human
gggttgctacagccagagct

SEQ ID NO: 197359 - DNA, 20 bp, human
gggtggcgcgatggagggac

SEQ ID NO: 197360 - DNA, 20 bp, human
gaaccggacagtccccgatg

SEQ ID NO: 197361 - DNA, 20 bp, human
gcaaaatctggccagagact

SEQ ID NO: 197362 - DNA, 20 bp, human
gcgaggaggtggcgcgatgg

SEQ ID NO: 197363 - DNA, 20 bp, human
ggatcactaaaagggcactc

SEQ ID NO: 197364 - DNA, 20 bp, human
gtggaaggtgaggcgatgaa

SEQ ID NO: 197365 - DNA, 20 bp, human
gttaaggccgtggacaataa

SEQ ID NO: 197366 - DNA, 20 bp, human
gctctgagttaggaacagaa

SEQ ID NO: 197367 - DNA, 20 bp, human
ggttaggaacagaatggctg

SEQ ID NO: 197368 - DNA, 20 bp, human
ggtatgatgttatctggact

SEQ ID NO: 197369 - DNA, 20 bp, human
ggaccctttacttcacaggt

SEQ ID NO: 197370 - DNA, 20 bp, human
gatgtaagtactaaaaggat

SEQ ID NO: 197371 - DNA, 20 bp, human
ggaagtaaagggtcagatga

SEQ ID NO: 197372 - DNA, 20 bp, human
gcaagagtcttaataggcat

SEQ ID NO: 197373 - DNA, 20 bp, human
gagacagctatcaaaataaa

SEQ ID NO: 197374 - DNA, 20 bp, human
ggatttaaacggatcacaca

SEQ ID NO: 197375 - DNA, 20 bp, human
gttaggtattctaccaacat

SEQ ID NO: 197376 - DNA, 20 bp, human
ggtggcccagaggtagtgac

SEQ ID NO: 197377 - DNA, 20 bp, human
ggcgcggctgtcggttgatg

SEQ ID NO: 197378 - DNA, 20 bp, human
gctgcgtacctgaggccctc

SEQ ID NO: 197379 - DNA, 20 bp, human
gaggtcaggtctgggaaact

SEQ ID NO: 197380 - DNA, 20 bp, human
gctggcacaaagaactctca

SEQ ID NO: 197381 - DNA, 20 bp, human
gcctgctcagggaaaacccc

SEQ ID NO: 197382 - DNA, 20 bp, human
gcggctgtcggttgatgggg

SEQ ID NO: 197383 - DNA, 20 bp, human
gtcccggtgcctggaaaccg

SEQ ID NO: 197384 - DNA, 20 bp, human
gcacctcctaagggaccgaa

SEQ ID NO: 197385 - DNA, 20 bp, human
gtgtcccgaagggtcaactg

SEQ ID NO: 197386 - DNA, 20 bp, human
ggcggcagcagcaactacgg

SEQ ID NO: 197387 - DNA, 20 bp, human
gtgagggaggcgggagactt

SEQ ID NO: 197388 - DNA, 20 bp, human
gagcggaagagcgatcgggt

SEQ ID NO: 197389 - DNA, 20 bp, human
gtttgtcgaagctagaggac

SEQ ID NO: 197390 - DNA, 20 bp, human
gaagctagaggaccggcagg

SEQ ID NO: 197391 - DNA, 20 bp, human
gctagtgaggaacctcaaaa

SEQ ID NO: 197392 - DNA, 20 bp, human
gaggaagcggaagagcgatc

SEQ ID NO: 197393 - DNA, 20 bp, human
ggggaggcgggagacttagg

SEQ ID NO: 197394 - DNA, 20 bp, human
gtacgtgaatgggacactaa

SEQ ID NO: 197395 - DNA, 20 bp, human
gggaagagcgatcgggtagg

SEQ ID NO: 197396 - DNA, 20 bp, human
gtaccggccgggccttagag

SEQ ID NO: 197397 - DNA, 20 bp, human
gtagcgaacaccggatgtgg

SEQ ID NO: 197398 - DNA, 20 bp, human
ggggataggccgcgacccag

SEQ ID NO: 197399 - DNA, 20 bp, human
ggaaaggagcaggcgccgtg

SEQ ID NO: 197400 - DNA, 20 bp, human
gcgtgggggtggggtgaacg

SEQ ID NO: 197401 - DNA, 20 bp, human
gaacaccggatgtgggggag

SEQ ID NO: 197402 - DNA, 20 bp, human
gggggtggggtgaacggggt

SEQ ID NO: 197403 - DNA, 20 bp, human
gaaaagtgagcgggagcctg

SEQ ID NO: 197404 - DNA, 20 bp, human
gcctcgagattagcgaacac

SEQ ID NO: 197405 - DNA, 20 bp, human
gagggccgcgaccgggaggt

SEQ ID NO: 197406 - DNA, 20 bp, human
gggccggcggcgtctccatg

SEQ ID NO: 197407 - DNA, 20 bp, human
gcgagtcctgggggtaagga

SEQ ID NO: 197408 - DNA, 20 bp, human
gtgagctctgagtgccggac

SEQ ID NO: 197409 - DNA, 20 bp, human
ggaaagtggtggcctcagtg

SEQ ID NO: 197410 - DNA, 20 bp, human
gcgcgcgccgccccatataa

SEQ ID NO: 197411 - DNA, 20 bp, human
gctctgagtgccggacgggt

SEQ ID NO: 197412 - DNA, 20 bp, human
gtcaccccgccatgcgccag

SEQ ID NO: 197413 - DNA, 20 bp, human
gccccgccatgcgccagcgg

SEQ ID NO: 197414 - DNA, 20 bp, human
ggacgggtgggcgaaagtgg

SEQ ID NO: 197415 - DNA, 20 bp, human
gccggacgggtgggcgaaag

SEQ ID NO: 197416 - DNA, 20 bp, human
ggggatgacggccacagctg

SEQ ID NO: 197417 - DNA, 20 bp, human
ggaacaaaggtgattcagaa

SEQ ID NO: 197418 - DNA, 20 bp, human
gcaactgaccatccctaggt

SEQ ID NO: 197419 - DNA, 20 bp, human
gggtgtctctacctcagctg

SEQ ID NO: 197420 - DNA, 20 bp, human
gatggagaagagtgcctcca

SEQ ID NO: 197421 - DNA, 20 bp, human
gagagctgccaacctaggga

SEQ ID NO: 197422 - DNA, 20 bp, human
gagcaagagctgccaaccta

SEQ ID NO: 197423 - DNA, 20 bp, human
gctcagacgacccactaaac

SEQ ID NO: 197424 - DNA, 20 bp, human
gggagaaacttggacgatct

SEQ ID NO: 197425 - DNA, 20 bp, human
gatcgacagagctggcggtg

SEQ ID NO: 197426 - DNA, 20 bp, human
gccgcctctggagccgaggt

SEQ ID NO: 197427 - DNA, 20 bp, human
gttgccaacctcggctccag

SEQ ID NO: 197428 - DNA, 20 bp, human
ggtcgccgcctctggagccg

SEQ ID NO: 197429 - DNA, 20 bp, human
gcggagaagagaatgcaagt

SEQ ID NO: 197430 - DNA, 20 bp, human
ggctccagggcatgtagtga

SEQ ID NO: 197431 - DNA, 20 bp, human
gggtgctggtttgccaacct

SEQ ID NO: 197432 - DNA, 20 bp, human
ggttgtgcaacccagggagg

SEQ ID NO: 197433 - DNA, 20 bp, human
gactacatgccctggagctg

SEQ ID NO: 197434 - DNA, 20 bp, human
gctgtgagttgtgcaaccca

SEQ ID NO: 197435 - DNA, 20 bp, human
ggcggcacggacgaagggca

SEQ ID NO: 197436 - DNA, 20 bp, human
gcaatgttctcccgtcagtg

SEQ ID NO: 197437 - DNA, 20 bp, human
gcacactgactgacagccag

SEQ ID NO: 197438 - DNA, 20 bp, human
gggcatgaagtggctcctag

SEQ ID NO: 197439 - DNA, 20 bp, human
ggtggagcattggcatgaag

SEQ ID NO: 197440 - DNA, 20 bp, human
gcgtgcgccaagcagccact

SEQ ID NO: 197441 - DNA, 20 bp, human
ggactgtggcgtgcaggaag

SEQ ID NO: 197442 - DNA, 20 bp, human
gtgggggaaagattaaccag

SEQ ID NO: 197443 - DNA, 20 bp, human
gggacatgcactcaccagca

SEQ ID NO: 197444 - DNA, 20 bp, human
gttgcagctgaacgtgactg

SEQ ID NO: 197445 - DNA, 20 bp, human
ggttagagagcagtccttgg

SEQ ID NO: 197446 - DNA, 20 bp, human
gtagccaagagccggttccc

SEQ ID NO: 197447 - DNA, 20 bp, human
gagtcgcctcccccgctcct

SEQ ID NO: 197448 - DNA, 20 bp, human
gacactaccaggccgctagg

SEQ ID NO: 197449 - DNA, 20 bp, human
gtttgaggcggtcctcctag

SEQ ID NO: 197450 - DNA, 20 bp, human
gaaatgccgccggaagtcag

SEQ ID NO: 197451 - DNA, 20 bp, human
gaagctgcctgggtctacag

SEQ ID NO: 197452 - DNA, 20 bp, human
ggcaaacctctgacttccgg

SEQ ID NO: 197453 - DNA, 20 bp, human
gggcggtcctcctagcggcc

SEQ ID NO: 197454 - DNA, 20 bp, human
gctattgcagagttaagggt

SEQ ID NO: 197455 - DNA, 20 bp, human
gaggcaacaaaaacactacc

SEQ ID NO: 197456 - DNA, 20 bp, human
gcggcgcttggcttacccgg

SEQ ID NO: 197457 - DNA, 20 bp, human
gtcccgcagcggatccaaag

SEQ ID NO: 197458 - DNA, 20 bp, human
ggcttacccggaggctgccg

SEQ ID NO: 197459 - DNA, 20 bp, human
ggcgggaactcagcactgcg

SEQ ID NO: 197460 - DNA, 20 bp, human
gaggagtccgcggcagcctc

SEQ ID NO: 197461 - DNA, 20 bp, human
ggcccgccaggagcgtccag

SEQ ID NO: 197462 - DNA, 20 bp, human
ggcgcggcgcttggcttacc

SEQ ID NO: 197463 - DNA, 20 bp, human
gtggatccgctgcgggaggt

SEQ ID NO: 197464 - DNA, 20 bp, human
ggtagccgccgggaaatgga

SEQ ID NO: 197465 - DNA, 20 bp, human
gcgcgcacctcggatccccc

SEQ ID NO: 197466 - DNA, 20 bp, human
ggcgcagctgaataccgtca

SEQ ID NO: 197467 - DNA, 20 bp, human
ggcagggccagaacccctga

SEQ ID NO: 197468 - DNA, 20 bp, human
gagagagctagcgtcatcag

SEQ ID NO: 197469 - DNA, 20 bp, human
gtgggtgaacacgggcgtgt

SEQ ID NO: 197470 - DNA, 20 bp, human
gcgcacccgggtgcatgggt

SEQ ID NO: 197471 - DNA, 20 bp, human
gttgcggagacagatggcac

SEQ ID NO: 197472 - DNA, 20 bp, human
ggtgaacacgggcgtgtggg

SEQ ID NO: 197473 - DNA, 20 bp, human
gcgggtgcgaaatgacccct

SEQ ID NO: 197474 - DNA, 20 bp, human
gcggaaagcgagtcgctcat

SEQ ID NO: 197475 - DNA, 20 bp, human
ggggctcgcggcgtgagtgg

SEQ ID NO: 197476 - DNA, 20 bp, human
ggctccaggctcgacacggg

SEQ ID NO: 197477 - DNA, 20 bp, human
gtcgacacgggcggaacaaa

SEQ ID NO: 197478 - DNA, 20 bp, human
gctggctccaggctcgacac

SEQ ID NO: 197479 - DNA, 20 bp, human
gggcagcgcgcgaggagctc

SEQ ID NO: 197480 - DNA, 20 bp, human
ggaacctgtgaagagcggaa

SEQ ID NO: 197481 - DNA, 20 bp, human
gtggcccttccgctcttcac

SEQ ID NO: 197482 - DNA, 20 bp, human
gcgggctccactacccgcgg

SEQ ID NO: 197483 - DNA, 20 bp, human
gtgtgccgccggctaagggg

SEQ ID NO: 197484 - DNA, 20 bp, human
gggctcccctggagtcggag

SEQ ID NO: 197485 - DNA, 20 bp, human
gaaacgggctccactacccg

SEQ ID NO: 197486 - DNA, 20 bp, human
gtcgcggactcgggagatgg

SEQ ID NO: 197487 - DNA, 20 bp, human
gggaaaaggagatattacgg

SEQ ID NO: 197488 - DNA, 20 bp, human
gggcagatccgcctactgca

SEQ ID NO: 197489 - DNA, 20 bp, human
gggacctaccctgcagtagg

SEQ ID NO: 197490 - DNA, 20 bp, human
ggccggacctaccctgcagt

SEQ ID NO: 197491 - DNA, 20 bp, human
gcgcgtagcgatgacgtcgt

SEQ ID NO: 197492 - DNA, 20 bp, human
gccgtcgcggactcgggaga

SEQ ID NO: 197493 - DNA, 20 bp, human
gtgagccggcccacaagtcc

SEQ ID NO: 197494 - DNA, 20 bp, human
gtagtcccagccccgcagtg

SEQ ID NO: 197495 - DNA, 20 bp, human
gctccccgcgccccactgcg

SEQ ID NO: 197496 - DNA, 20 bp, human
ggagcgggcgagcgccgcga

SEQ ID NO: 197497 - DNA, 20 bp, human
gtagcttaggaggcagaagg

SEQ ID NO: 197498 - DNA, 20 bp, human
gaaagacagagcgagagcga

SEQ ID NO: 197499 - DNA, 20 bp, human
ggtgctgcggagacccacgg

SEQ ID NO: 197500 - DNA, 20 bp, human
gctatcatccaagtaggaca

SEQ ID NO: 197501 - DNA, 20 bp, human
ggacagggtgtgcctccccc

SEQ ID NO: 197502 - DNA, 20 bp, human
gatgcgtttcccccccctcg

SEQ ID NO: 197503 - DNA, 20 bp, human
gcgggcgagcgccgcgaggg

SEQ ID NO: 197504 - DNA, 20 bp, human
gccaattacaaggatggaga

SEQ ID NO: 197505 - DNA, 20 bp, human
gggggggaaacgcatgaggc

SEQ ID NO: 197506 - DNA, 20 bp, human
ggaggccaggtgccgagagt

SEQ ID NO: 197507 - DNA, 20 bp, human
gtccggaaacctccgactct

SEQ ID NO: 197508 - DNA, 20 bp, human
ggaaggtggtgatatgggtg

SEQ ID NO: 197509 - DNA, 20 bp, human
ggagagagcatgagaaacct

SEQ ID NO: 197510 - DNA, 20 bp, human
ggtcgagtgacgtcacctcc

SEQ ID NO: 197511 - DNA, 20 bp, human
gagggaaggaattcaggcta

SEQ ID NO: 197512 - DNA, 20 bp, human
gagccagaaagagctgaagg

SEQ ID NO: 197513 - DNA, 20 bp, human
gagagctgaaggtggtgata

SEQ ID NO: 197514 - DNA, 20 bp, human
gccgaaagcggtgtccgggt

SEQ ID NO: 197515 - DNA, 20 bp, human
gctccttccccggtcccgat

SEQ ID NO: 197516 - DNA, 20 bp, human
gtggcggcacccgaaacagg

SEQ ID NO: 197517 - DNA, 20 bp, human
gacatggcggcacccgaaac

SEQ ID NO: 197518 - DNA, 20 bp, human
gttctgtcggatgagaggag

SEQ ID NO: 197519 - DNA, 20 bp, human
gtttctcctcaccaacatgg

SEQ ID NO: 197520 - DNA, 20 bp, human
gatgcagggcacgacaggtc

SEQ ID NO: 197521 - DNA, 20 bp, human
ggacagactctgaacatgca

SEQ ID NO: 197522 - DNA, 20 bp, human
ggacgcggggatttggacag

SEQ ID NO: 197523 - DNA, 20 bp, human
gtgaggagaaatcaccgtta

SEQ ID NO: 197524 - DNA, 20 bp, human
gcggcgaatagagactagag

SEQ ID NO: 197525 - DNA, 20 bp, human
gcaccttgcccgggactaaa

SEQ ID NO: 197526 - DNA, 20 bp, human
gtgccgccgccgctaaccga

SEQ ID NO: 197527 - DNA, 20 bp, human
ggccgcgcgcgagcacgagg

SEQ ID NO: 197528 - DNA, 20 bp, human
gctcgctcgcagctctccct

SEQ ID NO: 197529 - DNA, 20 bp, human
gccgcggcggcgccctctag

SEQ ID NO: 197530 - DNA, 20 bp, human
gtgcgcgcggagggacgggt

SEQ ID NO: 197531 - DNA, 20 bp, human
ggctctccctcggttagcgg

SEQ ID NO: 197532 - DNA, 20 bp, human
gctccctcggttagcggcgg

SEQ ID NO: 197533 - DNA, 20 bp, human
ggcagctctccctcggttag

SEQ ID NO: 197534 - DNA, 20 bp, human
ggcgcgcggccgttaacgga

SEQ ID NO: 197535 - DNA, 20 bp, human
gcccggcccggctcctctca

SEQ ID NO: 197536 - DNA, 20 bp, human
gcccggcagctccgtccatg

SEQ ID NO: 197537 - DNA, 20 bp, human
gccgcgagcggccagccgag

SEQ ID NO: 197538 - DNA, 20 bp, human
gcggcgccgggagcaggatg

SEQ ID NO: 197539 - DNA, 20 bp, human
gcgccgggccacctggaaag

SEQ ID NO: 197540 - DNA, 20 bp, human
gcgctcgcggcagcacccgc

SEQ ID NO: 197541 - DNA, 20 bp, human
ggggaccgggatccccaaaa

SEQ ID NO: 197542 - DNA, 20 bp, human
gcgcggccccggcctggaaa

SEQ ID NO: 197543 - DNA, 20 bp, human
gctgcgccgagcccgataaa

SEQ ID NO: 197544 - DNA, 20 bp, human
gaaactttggggcagggcac

SEQ ID NO: 197545 - DNA, 20 bp, human
gaggccggggacactgcgtc

SEQ ID NO: 197546 - DNA, 20 bp, human
gtccgggttgtcactctctc

SEQ ID NO: 197547 - DNA, 20 bp, human
gcaacccggacgcgacgaga

SEQ ID NO: 197548 - DNA, 20 bp, human
gagacgctacgggaccacag

SEQ ID NO: 197549 - DNA, 20 bp, human
ggctcaggcttaggccgtca

SEQ ID NO: 197550 - DNA, 20 bp, human
gtccagaagaaactaagagg

SEQ ID NO: 197551 - DNA, 20 bp, human
gagcttcccggctcgcgaaa

SEQ ID NO: 197552 - DNA, 20 bp, human
gttcccggctcgcgaaaggg

SEQ ID NO: 197553 - DNA, 20 bp, human
ggcgaaagggaggacctgtc

SEQ ID NO: 197554 - DNA, 20 bp, human
gggtggaggcgagaaggctc

SEQ ID NO: 197555 - DNA, 20 bp, human
gcgctacgggaccacagagg

SEQ ID NO: 197556 - DNA, 20 bp, human
ggagccgagagtggatcgct

SEQ ID NO: 197557 - DNA, 20 bp, human
ggactcggttccgcggaaat

SEQ ID NO: 197558 - DNA, 20 bp, human
gcagcgcgccatggcggacc

SEQ ID NO: 197559 - DNA, 20 bp, human
gcgagcctagaaccgagagg

SEQ ID NO: 197560 - DNA, 20 bp, human
gtgatgaagcagcacacctc

SEQ ID NO: 197561 - DNA, 20 bp, human
gggacagtccaccccgacca

SEQ ID NO: 197562 - DNA, 20 bp, human
gtctaggctcggcgagggtg

SEQ ID NO: 197563 - DNA, 20 bp, human
gctcaccgaccgggtcctag

SEQ ID NO: 197564 - DNA, 20 bp, human
gtcggttctaggctcggcga

SEQ ID NO: 197565 - DNA, 20 bp, human
gtgagtgcacccggagggag

SEQ ID NO: 197566 - DNA, 20 bp, human
gcccgcgccagcgaccatgg

SEQ ID NO: 197567 - DNA, 20 bp, human
ggtgaggaaggagcacactg

SEQ ID NO: 197568 - DNA, 20 bp, human
gactgctggtgagaaggcgg

SEQ ID NO: 197569 - DNA, 20 bp, human
gcacactgtgggctccgcca

SEQ ID NO: 197570 - DNA, 20 bp, human
gggcggcgggcggggactgt

SEQ ID NO: 197571 - DNA, 20 bp, human
gcacagcaccttggtgagga

SEQ ID NO: 197572 - DNA, 20 bp, human
ggaagcgggagcgacgggaa

SEQ ID NO: 197573 - DNA, 20 bp, human
gtctgccgccggcacatgct

SEQ ID NO: 197574 - DNA, 20 bp, human
gtcaccagcagtcccggttg

SEQ ID NO: 197575 - DNA, 20 bp, human
gtgggctccgccatggtcgc

SEQ ID NO: 197576 - DNA, 20 bp, human
gggattgccccggaagaggg

SEQ ID NO: 197577 - DNA, 20 bp, human
gagggacaagcgtttgccgt

SEQ ID NO: 197578 - DNA, 20 bp, human
gagatggcggcgccctgtga

SEQ ID NO: 197579 - DNA, 20 bp, human
gactcggcagcggaccaaga

SEQ ID NO: 197580 - DNA, 20 bp, human
gcaaacgcttgtccctcaca

SEQ ID NO: 197581 - DNA, 20 bp, human
gcggggaagcaactcggcag

SEQ ID NO: 197582 - DNA, 20 bp, human
ggtaggggttgaaaagaatt

SEQ ID NO: 197583 - DNA, 20 bp, human
gaactctcggggaagcaact

SEQ ID NO: 197584 - DNA, 20 bp, human
gttctggggggtcccttctg

SEQ ID NO: 197585 - DNA, 20 bp, human
ggaatctggtacaccccgag

SEQ ID NO: 197586 - DNA, 20 bp, human
gaggagccaaagacaccttg

SEQ ID NO: 197587 - DNA, 20 bp, human
ggtacaaatacaccagccaa

SEQ ID NO: 197588 - DNA, 20 bp, human
gttgccggagaggtgaggat

SEQ ID NO: 197589 - DNA, 20 bp, human
gttgtgtctattgtatccct

SEQ ID NO: 197590 - DNA, 20 bp, human
ggtgtgccccaaggtgtctt

SEQ ID NO: 197591 - DNA, 20 bp, human
gtcccgactcctaaagagca

SEQ ID NO: 197592 - DNA, 20 bp, human
ggtgtatttgtacatctctc

SEQ ID NO: 197593 - DNA, 20 bp, human
gcaccacagacttgccggag

SEQ ID NO: 197594 - DNA, 20 bp, human
gctctcccgcaacgaagggt

SEQ ID NO: 197595 - DNA, 20 bp, human
gcacctctccggcaagtctg

SEQ ID NO: 197596 - DNA, 20 bp, human
gtaaggaaggcgctagaata

SEQ ID NO: 197597 - DNA, 20 bp, human
gcgataagtctggtgaccgg

SEQ ID NO: 197598 - DNA, 20 bp, human
ggggctattagccgatgcat

SEQ ID NO: 197599 - DNA, 20 bp, human
gccggagacaagcgtaagta

SEQ ID NO: 197600 - DNA, 20 bp, human
ggacagccgcgtaaagtctg

SEQ ID NO: 197601 - DNA, 20 bp, human
gccctccagtggacccgaac

SEQ ID NO: 197602 - DNA, 20 bp, human
gggcagggtgttcctaagga

SEQ ID NO: 197603 - DNA, 20 bp, human
gcgggcccgggcgataagtc

SEQ ID NO: 197604 - DNA, 20 bp, human
gggctcccctgtccacgcgt

SEQ ID NO: 197605 - DNA, 20 bp, human
gggaaactgaaggtttacgt

SEQ ID NO: 197606 - DNA, 20 bp, human
ggtcgtgtcccggcctccag

SEQ ID NO: 197607 - DNA, 20 bp, human
ggtgtcccggcctccagcgg

SEQ ID NO: 197608 - DNA, 20 bp, human
ggaagtgtcaggcccccagg

SEQ ID NO: 197609 - DNA, 20 bp, human
gcgggcttcgggtgtcccag

SEQ ID NO: 197610 - DNA, 20 bp, human
ggcgccccaatgccctcctc

SEQ ID NO: 197611 - DNA, 20 bp, human
gggggacgaactccacactg

SEQ ID NO: 197612 - DNA, 20 bp, human
ggccgggacacgactagctc

SEQ ID NO: 197613 - DNA, 20 bp, human
gtggccgcgaagaaacaatg

SEQ ID NO: 197614 - DNA, 20 bp, human
gtcgttagctcgcgaggagg

SEQ ID NO: 197615 - DNA, 20 bp, human
gcacacccacgcggagggaa

SEQ ID NO: 197616 - DNA, 20 bp, human
gcgcagggccgcccaaccag

SEQ ID NO: 197617 - DNA, 20 bp, human
ggccgcggctgccttaggaa

SEQ ID NO: 197618 - DNA, 20 bp, human
gcgaggcagcgccgttccta

SEQ ID NO: 197619 - DNA, 20 bp, human
gcgtctctgctacccctggt

SEQ ID NO: 197620 - DNA, 20 bp, human
gcctgcgaagcagctccttc

SEQ ID NO: 197621 - DNA, 20 bp, human
ggggaagacccaccagtact

SEQ ID NO: 197622 - DNA, 20 bp, human
gtctgggaggaatatgtggg

SEQ ID NO: 197623 - DNA, 20 bp, human
ggccgttcctaaggcagccg

SEQ ID NO: 197624 - DNA, 20 bp, human
gaagacccaccagtactggg

SEQ ID NO: 197625 - DNA, 20 bp, human
ggctgggagccgcccagtac

SEQ ID NO: 197626 - DNA, 20 bp, human
gccgaggtgggcctgctcat

SEQ ID NO: 197627 - DNA, 20 bp, human
gcatcggtaacacttgacct

SEQ ID NO: 197628 - DNA, 20 bp, human
gctactcttgcggcaaactt

SEQ ID NO: 197629 - DNA, 20 bp, human
gggttgcgccggggcctccg

SEQ ID NO: 197630 - DNA, 20 bp, human
gggcgcaaccccgctttggg

SEQ ID NO: 197631 - DNA, 20 bp, human
ggactcaccacagcagtaac

SEQ ID NO: 197632 - DNA, 20 bp, human
gtgcggcagactaggacatc

SEQ ID NO: 197633 - DNA, 20 bp, human
gtaacaggtgtaagataggg

SEQ ID NO: 197634 - DNA, 20 bp, human
gagggcatccccgagcccaa

SEQ ID NO: 197635 - DNA, 20 bp, human
gcaggtgtaagatagggtgg

SEQ ID NO: 197636 - DNA, 20 bp, human
gacgcaccttgtggcaggct

SEQ ID NO: 197637 - DNA, 20 bp, human
ggatgcagacttggggtaca

SEQ ID NO: 197638 - DNA, 20 bp, human
gacttgcccagcctgccaca

SEQ ID NO: 197639 - DNA, 20 bp, human
gaggcttggagtgcagagtt

SEQ ID NO: 197640 - DNA, 20 bp, human
gagttggggatgcagacttg

SEQ ID NO: 197641 - DNA, 20 bp, human
gacggcggcgggggccacgg

SEQ ID NO: 197642 - DNA, 20 bp, human
gcatttggggtgcgacatag

SEQ ID NO: 197643 - DNA, 20 bp, human
gaggatggggcttgggatac

SEQ ID NO: 197644 - DNA, 20 bp, human
gggcggaggtgtggaggctt

SEQ ID NO: 197645 - DNA, 20 bp, human
ggggtgcgacatagaggctt

SEQ ID NO: 197646 - DNA, 20 bp, human
ggcagggtcaccatgaaact

SEQ ID NO: 197647 - DNA, 20 bp, human
ggtaggtagtcacctgagtg

SEQ ID NO: 197648 - DNA, 20 bp, human
gtagctgtgaagaagacact

SEQ ID NO: 197649 - DNA, 20 bp, human
gaagaagaggcaacattgag

SEQ ID NO: 197650 - DNA, 20 bp, human
gtatggtacaggcatcactg

SEQ ID NO: 197651 - DNA, 20 bp, human
ggagatgctaacagctgaat

SEQ ID NO: 197652 - DNA, 20 bp, human
gctgattccaggagacataa

SEQ ID NO: 197653 - DNA, 20 bp, human
ggctcaagtgagtatggtac

SEQ ID NO: 197654 - DNA, 20 bp, human
gtgagatgctcaagtgagta

SEQ ID NO: 197655 - DNA, 20 bp, human
gatgtctcctggaatcaggt

SEQ ID NO: 197656 - DNA, 20 bp, human
ggtacgtatgaggaagaacg

SEQ ID NO: 197657 - DNA, 20 bp, human
ggaaacgcgctggctgactg

SEQ ID NO: 197658 - DNA, 20 bp, human
gcagcctcctcggccaaatg

SEQ ID NO: 197659 - DNA, 20 bp, human
gaggcgtcgcctccagactc

SEQ ID NO: 197660 - DNA, 20 bp, human
gtagttcagcgcagcgactc

SEQ ID NO: 197661 - DNA, 20 bp, human
ggcgcgctgggtcttgtggg

SEQ ID NO: 197662 - DNA, 20 bp, human
gctgacgcctagtacgtatg

SEQ ID NO: 197663 - DNA, 20 bp, human
gtaggcgcgctgggtcttgt

SEQ ID NO: 197664 - DNA, 20 bp, human
gcggccaaatggggcaccgg

SEQ ID NO: 197665 - DNA, 20 bp, human
gatcactgtctctctcaggg

SEQ ID NO: 197666 - DNA, 20 bp, human
ggagggccgaactggagggt

SEQ ID NO: 197667 - DNA, 20 bp, human
gcgcggttgctttcagtctc

SEQ ID NO: 197668 - DNA, 20 bp, human
gcgcacgaccgcccagcgag

SEQ ID NO: 197669 - DNA, 20 bp, human
gccttggcctggttgcgctg

SEQ ID NO: 197670 - DNA, 20 bp, human
gcctggattaaggtgggtgg

SEQ ID NO: 197671 - DNA, 20 bp, human
gtggagggtgggcgcagcct

SEQ ID NO: 197672 - DNA, 20 bp, human
gggatttgcctggattaagg

SEQ ID NO: 197673 - DNA, 20 bp, human
gcgtgcgcactcgctaggtc

SEQ ID NO: 197674 - DNA, 20 bp, human
ggcgcagccttggctgcctt

SEQ ID NO: 197675 - DNA, 20 bp, human
ggggtgttgttgggtgtcgg

SEQ ID NO: 197676 - DNA, 20 bp, human
gcggggtgcgttggcttcag

SEQ ID NO: 197677 - DNA, 20 bp, human
gtcctcagcatcctcggcta

SEQ ID NO: 197678 - DNA, 20 bp, human
gcgagccggtgaggacggag

SEQ ID NO: 197679 - DNA, 20 bp, human
gccagccgctccgtcctcac

SEQ ID NO: 197680 - DNA, 20 bp, human
gtcagcatcctcggctaggg

SEQ ID NO: 197681 - DNA, 20 bp, human
gggcgcagacatgcgagcgg

SEQ ID NO: 197682 - DNA, 20 bp, human
gctccgagtcgcgcaggtag

SEQ ID NO: 197683 - DNA, 20 bp, human
ggcaggagcgggtatacgag

SEQ ID NO: 197684 - DNA, 20 bp, human
ggcggctccgcggggtgcgt

SEQ ID NO: 197685 - DNA, 20 bp, human
gcctcgcgagccggtgagga

SEQ ID NO: 197686 - DNA, 20 bp, human
gtgggcgggctggtacaccg

SEQ ID NO: 197687 - DNA, 20 bp, human
ggcgggctggtacaccgagg

SEQ ID NO: 197688 - DNA, 20 bp, human
gggaacggcccgccacggtg

SEQ ID NO: 197689 - DNA, 20 bp, human
gcgccggggccgcagtcggg

SEQ ID NO: 197690 - DNA, 20 bp, human
gagctgcagcgcggagaggt

SEQ ID NO: 197691 - DNA, 20 bp, human
ggaaggaggcagcgaaagtt

SEQ ID NO: 197692 - DNA, 20 bp, human
gtcgggccggaaggcatcga

SEQ ID NO: 197693 - DNA, 20 bp, human
gaggaagagcgggtcagaca

SEQ ID NO: 197694 - DNA, 20 bp, human
ggggcgagcccagctgctcg

SEQ ID NO: 197695 - DNA, 20 bp, human
ggacagggaacggcccgcca

SEQ ID NO: 197696 - DNA, 20 bp, human
ggaggtaaaatggccaccgg

SEQ ID NO: 197697 - DNA, 20 bp, human
gggcaggaggaagaaggccg

SEQ ID NO: 197698 - DNA, 20 bp, human
gaggaggaagaaggccgagg

SEQ ID NO: 197699 - DNA, 20 bp, human
gccgccggctcatcctggag

SEQ ID NO: 197700 - DNA, 20 bp, human
gcggaggaagagaggaaacg

SEQ ID NO: 197701 - DNA, 20 bp, human
gtgctgggaaggaggtaaaa

SEQ ID NO: 197702 - DNA, 20 bp, human
gcgcaaaaagaagggcgctg

SEQ ID NO: 197703 - DNA, 20 bp, human
gcgccgccgccggctcatcc

SEQ ID NO: 197704 - DNA, 20 bp, human
ggtaaaatggccaccggcgg

SEQ ID NO: 197705 - DNA, 20 bp, human
gacggcggccgcgagaagat

SEQ ID NO: 197706 - DNA, 20 bp, human
ggatggcggcctccaggaat

SEQ ID NO: 197707 - DNA, 20 bp, human
gaatgggtttgaagccgtgg

SEQ ID NO: 197708 - DNA, 20 bp, human
gcgtactgaggctttcggga

SEQ ID NO: 197709 - DNA, 20 bp, human
gttgaagccgtggaggcaga

SEQ ID NO: 197710 - DNA, 20 bp, human
ggcacactggtgagggaaag

SEQ ID NO: 197711 - DNA, 20 bp, human
gactgaggctttcgggacgg

SEQ ID NO: 197712 - DNA, 20 bp, human
gacggcttcaaacccattcc

SEQ ID NO: 197713 - DNA, 20 bp, human
gaagaggcgggtaaaaatac

SEQ ID NO: 197714 - DNA, 20 bp, human
gcggggacggcaggatccaa

SEQ ID NO: 197715 - DNA, 20 bp, human
gagggcagcgcagggtgccg

SEQ ID NO: 197716 - DNA, 20 bp, human
ggtctgtgtacccattgctg

SEQ ID NO: 197717 - DNA, 20 bp, human
ggtgtacccattgctgagga

SEQ ID NO: 197718 - DNA, 20 bp, human
gccattcagagacttagtcc

SEQ ID NO: 197719 - DNA, 20 bp, human
gaccacacaagaccagcctc

SEQ ID NO: 197720 - DNA, 20 bp, human
ggaggagggaaatgtgtaaa

SEQ ID NO: 197721 - DNA, 20 bp, human
ggactagggtggtaggaagt

SEQ ID NO: 197722 - DNA, 20 bp, human
gtcttgtgtggttacttatg

SEQ ID NO: 197723 - DNA, 20 bp, human
gtcctgaggctggtcttgtg

SEQ ID NO: 197724 - DNA, 20 bp, human
gtatttttgggtgactaggg

SEQ ID NO: 197725 - DNA, 20 bp, human
gagatatttttgggtgacta

SEQ ID NO: 197726 - DNA, 20 bp, human
gatcagcccggaggcgagtc

SEQ ID NO: 197727 - DNA, 20 bp, human
ggatggaaccaacgtacctc

SEQ ID NO: 197728 - DNA, 20 bp, human
ggcgagtctggcagggacgt

SEQ ID NO: 197729 - DNA, 20 bp, human
gctcaaaagggtggaaacta

SEQ ID NO: 197730 - DNA, 20 bp, human
gctccacgtcgggctcaaaa

SEQ ID NO: 197731 - DNA, 20 bp, human
ggaaggtggtgagtgctctt

SEQ ID NO: 197732 - DNA, 20 bp, human
gcacgtcgggctcaaaaggg

SEQ ID NO: 197733 - DNA, 20 bp, human
ggagcccgacgtggagaaag

SEQ ID NO: 197734 - DNA, 20 bp, human
gtggcagggacgttgggaga

SEQ ID NO: 197735 - DNA, 20 bp, human
gctggccaagaagccaccgt

SEQ ID NO: 197736 - DNA, 20 bp, human
gccgcccctcactcgtggca

SEQ ID NO: 197737 - DNA, 20 bp, human
gtgcgccctgccacgagtga

SEQ ID NO: 197738 - DNA, 20 bp, human
gggcgggcaagaaggagggt

SEQ ID NO: 197739 - DNA, 20 bp, human
gcgaacaggaagcaccaacc

SEQ ID NO: 197740 - DNA, 20 bp, human
gcactgccgcagctgcgaac

SEQ ID NO: 197741 - DNA, 20 bp, human
gcccagccgctctagaatca

SEQ ID NO: 197742 - DNA, 20 bp, human
gagcccggcgggcaagaagg

SEQ ID NO: 197743 - DNA, 20 bp, human
gtgcttcctgttcgcagctg

SEQ ID NO: 197744 - DNA, 20 bp, human
gcacagcccggcgggcaaga

SEQ ID NO: 197745 - DNA, 20 bp, human
gtagagcggctgggcgtcta

SEQ ID NO: 197746 - DNA, 20 bp, human
ggtcggcgacgcggagctac

SEQ ID NO: 197747 - DNA, 20 bp, human
gcgacgcggagctacgggag

SEQ ID NO: 197748 - DNA, 20 bp, human
ggagccgttcgaccacccag

SEQ ID NO: 197749 - DNA, 20 bp, human
gaggagacggcctccctgag

SEQ ID NO: 197750 - DNA, 20 bp, human
gccggcggaccgagagtcta

SEQ ID NO: 197751 - DNA, 20 bp, human
gctaaacacggcacccgggt

SEQ ID NO: 197752 - DNA, 20 bp, human
gactcctctgggtggtcgaa

SEQ ID NO: 197753 - DNA, 20 bp, human
gcagcccaaaatggccgcag

SEQ ID NO: 197754 - DNA, 20 bp, human
gggggaagaggtctgcgccg

SEQ ID NO: 197755 - DNA, 20 bp, human
gaacacggcacccgggtggg

SEQ ID NO: 197756 - DNA, 20 bp, human
gtgcgcggtaagaagctgcg

SEQ ID NO: 197757 - DNA, 20 bp, human
gcttccccggctcgccaact

SEQ ID NO: 197758 - DNA, 20 bp, human
gtcccccagagcagccgagt

SEQ ID NO: 197759 - DNA, 20 bp, human
gccacaggcggattccaggg

SEQ ID NO: 197760 - DNA, 20 bp, human
ggaagagtgcgctggtaaag

SEQ ID NO: 197761 - DNA, 20 bp, human
ggccaactcggctgctctgg

SEQ ID NO: 197762 - DNA, 20 bp, human
gcacccacaggcggattcca

SEQ ID NO: 197763 - DNA, 20 bp, human
gagccaagcggcccacccac

SEQ ID NO: 197764 - DNA, 20 bp, human
gggtctccaataccgcagga

SEQ ID NO: 197765 - DNA, 20 bp, human
gcagccgagttggcgagccg

SEQ ID NO: 197766 - DNA, 20 bp, human
ggagcagataatagcagcca

SEQ ID NO: 197767 - DNA, 20 bp, human
gcagtcgggaagaagcaccg

SEQ ID NO: 197768 - DNA, 20 bp, human
ggcccggatctcaaacagtc

SEQ ID NO: 197769 - DNA, 20 bp, human
gggcatcacgagtcctggga

SEQ ID NO: 197770 - DNA, 20 bp, human
gtggaaaaatactgactcta

SEQ ID NO: 197771 - DNA, 20 bp, human
gccccataacaccaaacatg

SEQ ID NO: 197772 - DNA, 20 bp, human
ggccccgaaggcgggcccag

SEQ ID NO: 197773 - DNA, 20 bp, human
ggagatccgggccccgaagg

SEQ ID NO: 197774 - DNA, 20 bp, human
gcaggcagaggttaaggtcc

SEQ ID NO: 197775 - DNA, 20 bp, human
ggtaaacgcctcctcagctg

SEQ ID NO: 197776 - DNA, 20 bp, human
ggagtgctgggccgaggaca

SEQ ID NO: 197777 - DNA, 20 bp, human
ggagcactagctccacccga

SEQ ID NO: 197778 - DNA, 20 bp, human
gcactagctccacccgaggg

SEQ ID NO: 197779 - DNA, 20 bp, human
gcgcccggtctccctgccag

SEQ ID NO: 197780 - DNA, 20 bp, human
gccgggcggcgcatctcccc

SEQ ID NO: 197781 - DNA, 20 bp, human
gacctgggttgaggtgtgag

SEQ ID NO: 197782 - DNA, 20 bp, human
gtggtgcccgccaggagact

SEQ ID NO: 197783 - DNA, 20 bp, human
gaggcaacgggtgccaggac

SEQ ID NO: 197784 - DNA, 20 bp, human
gtccctgccagcggagtgct

SEQ ID NO: 197785 - DNA, 20 bp, human
gaggacctaaaggcgatggg

SEQ ID NO: 197786 - DNA, 20 bp, human
gagctgctccgggcacgtcg

SEQ ID NO: 197787 - DNA, 20 bp, human
gggccgaggtcccccttcag

SEQ ID NO: 197788 - DNA, 20 bp, human
gggagcagctcccttcgctg

SEQ ID NO: 197789 - DNA, 20 bp, human
gcccttcgctgtggaagcgg

SEQ ID NO: 197790 - DNA, 20 bp, human
gctgccgagtcagaagaaat

SEQ ID NO: 197791 - DNA, 20 bp, human
gtagaaaacagaggctacag

SEQ ID NO: 197792 - DNA, 20 bp, human
ggcgccgagcccgcggacag

SEQ ID NO: 197793 - DNA, 20 bp, human
gggagggaggggaagcactc

SEQ ID NO: 197794 - DNA, 20 bp, human
gtcccgccgcggaggctcac

SEQ ID NO: 197795 - DNA, 20 bp, human
gccagagggcgcccctgaag

SEQ ID NO: 197796 - DNA, 20 bp, human
ggacacctctcacgcagcag

SEQ ID NO: 197797 - DNA, 20 bp, human
gccactcacgcaggcatcca

SEQ ID NO: 197798 - DNA, 20 bp, human
gcgcggcccggaaggaatcc

SEQ ID NO: 197799 - DNA, 20 bp, human
ggcggtccggaggcgagaag

SEQ ID NO: 197800 - DNA, 20 bp, human
gtgcccgcggagccagaaat

SEQ ID NO: 197801 - DNA, 20 bp, human
gctccgggccgggatcgagg

SEQ ID NO: 197802 - DNA, 20 bp, human
gtctcgcctccggaccgcag

SEQ ID NO: 197803 - DNA, 20 bp, human
ggagcgcgtctctcaggacg

SEQ ID NO: 197804 - DNA, 20 bp, human
gcgccggcccctctgaccca

SEQ ID NO: 197805 - DNA, 20 bp, human
ggtcgcgactccactcacgc

SEQ ID NO: 197806 - DNA, 20 bp, human
gtcaggccaccggctccagg

SEQ ID NO: 197807 - DNA, 20 bp, human
gagactggctgggcctcgtc

SEQ ID NO: 197808 - DNA, 20 bp, human
gcccatcccggacggagact

SEQ ID NO: 197809 - DNA, 20 bp, human
gggcagcatccgctaccccg

SEQ ID NO: 197810 - DNA, 20 bp, human
gggctccgaggtgagaaacc

SEQ ID NO: 197811 - DNA, 20 bp, human
ggccgcgcctcagaccctcg

SEQ ID NO: 197812 - DNA, 20 bp, human
gccagagctcgaggactcac

SEQ ID NO: 197813 - DNA, 20 bp, human
gccctgccaaagtcagccag

SEQ ID NO: 197814 - DNA, 20 bp, human
gagggtggaaggccaggcgt

SEQ ID NO: 197815 - DNA, 20 bp, human
ggacggtccccgggactggg

SEQ ID NO: 197816 - DNA, 20 bp, human
gccctgcttagggtcaggac

SEQ ID NO: 197817 - DNA, 20 bp, human
gggtcaggacaggacagcgt

SEQ ID NO: 197818 - DNA, 20 bp, human
gtccggagagggaatctgtc

SEQ ID NO: 197819 - DNA, 20 bp, human
ggccacaggagggacatccc

SEQ ID NO: 197820 - DNA, 20 bp, human
ggacaaacacagactctcca

SEQ ID NO: 197821 - DNA, 20 bp, human
gaggacagcgttggctgagg

SEQ ID NO: 197822 - DNA, 20 bp, human
gggagagggaatctgtcagg

SEQ ID NO: 197823 - DNA, 20 bp, human
gacctgggatgtccctcctg

SEQ ID NO: 197824 - DNA, 20 bp, human
ggggtcctgcgccacgccag

SEQ ID NO: 197825 - DNA, 20 bp, human
ggagctgacgtcccaggcac

SEQ ID NO: 197826 - DNA, 20 bp, human
gcggtctgacatagggtcag

SEQ ID NO: 197827 - DNA, 20 bp, human
gtcctgcgtggcccatcgtc

SEQ ID NO: 197828 - DNA, 20 bp, human
gcgcaggaatggcctgatgt

SEQ ID NO: 197829 - DNA, 20 bp, human
gtgcgtggcccatcgtcggg

SEQ ID NO: 197830 - DNA, 20 bp, human
ggctctgtccacccgacgat

SEQ ID NO: 197831 - DNA, 20 bp, human
ggctgtcctgaccctgagca

SEQ ID NO: 197832 - DNA, 20 bp, human
ggggctgcacagagcacgaa

SEQ ID NO: 197833 - DNA, 20 bp, human
gcacagccaggtccatcgca

SEQ ID NO: 197834 - DNA, 20 bp, human
gtggaaatacatcgcctatg

SEQ ID NO: 197835 - DNA, 20 bp, human
ggtccatcgcagggtcctcc

SEQ ID NO: 197836 - DNA, 20 bp, human
gggcacaccgtgctgacctg

SEQ ID NO: 197837 - DNA, 20 bp, human
ggtcggtccttggatctggt

SEQ ID NO: 197838 - DNA, 20 bp, human
gttcctgggaaggatcatgt

SEQ ID NO: 197839 - DNA, 20 bp, human
gccagggctgaggagcgccc

SEQ ID NO: 197840 - DNA, 20 bp, human
ggtgattccccaggtcagca

SEQ ID NO: 197841 - DNA, 20 bp, human
ggcccagggcgccatcgcct

SEQ ID NO: 197842 - DNA, 20 bp, human
gggggacatggggctcaagt

SEQ ID NO: 197843 - DNA, 20 bp, human
gcctaatccctggagatcct

SEQ ID NO: 197844 - DNA, 20 bp, human
gtggagatcgggccaatccc

SEQ ID NO: 197845 - DNA, 20 bp, human
gctggggtcctggtgcggac

SEQ ID NO: 197846 - DNA, 20 bp, human
gcacagcggctgaggctact

SEQ ID NO: 197847 - DNA, 20 bp, human
gtgggagaagaggcgaccca

SEQ ID NO: 197848 - DNA, 20 bp, human
ggcccggcggggacctctgt

SEQ ID NO: 197849 - DNA, 20 bp, human
gcagcccgccagcccgcctt

SEQ ID NO: 197850 - DNA, 20 bp, human
ggcacgagcggggaccgcag

SEQ ID NO: 197851 - DNA, 20 bp, human
gctccgggtaccggccccag

SEQ ID NO: 197852 - DNA, 20 bp, human
gctgacacctctcccgggaa

SEQ ID NO: 197853 - DNA, 20 bp, human
gagaaaaggcgaggactgag

SEQ ID NO: 197854 - DNA, 20 bp, human
ggcccacagaggtccccgcc

SEQ ID NO: 197855 - DNA, 20 bp, human
gggggacgatggcccttccc

SEQ ID NO: 197856 - DNA, 20 bp, human
gtccgggtaggagggagcaa

SEQ ID NO: 197857 - DNA, 20 bp, human
gtcctcgggagccacttctg

SEQ ID NO: 197858 - DNA, 20 bp, human
gcgccgggaggcatccacga

SEQ ID NO: 197859 - DNA, 20 bp, human
gtgcgccccgaggggacacg

SEQ ID NO: 197860 - DNA, 20 bp, human
ggccgcctcgtgtcccctcg

SEQ ID NO: 197861 - DNA, 20 bp, human
gggcgccgcggcccctacac

SEQ ID NO: 197862 - DNA, 20 bp, human
ggccgcagaagtggctcccg

SEQ ID NO: 197863 - DNA, 20 bp, human
gagcggccccggcgcgagga

SEQ ID NO: 197864 - DNA, 20 bp, human
gcctggccgcgccgcagaag

SEQ ID NO: 197865 - DNA, 20 bp, human
gggaaggagtggacccaacc

SEQ ID NO: 197866 - DNA, 20 bp, human
gcacccaggacagtacccgg

SEQ ID NO: 197867 - DNA, 20 bp, human
ggagaaaagggagccctcgt

SEQ ID NO: 197868 - DNA, 20 bp, human
gagagccaggacattattgt

SEQ ID NO: 197869 - DNA, 20 bp, human
ggatcttcgagccaaagatg

SEQ ID NO: 197870 - DNA, 20 bp, human
gcctcaacttggtacagtag

SEQ ID NO: 197871 - DNA, 20 bp, human
gagcggaagggtgatccgtc

SEQ ID NO: 197872 - DNA, 20 bp, human
gtcgagccaaagatgcggcg

SEQ ID NO: 197873 - DNA, 20 bp, human
ggtcctggctcttcccacga

SEQ ID NO: 197874 - DNA, 20 bp, human
gcgaggacaataacgagcac

SEQ ID NO: 197875 - DNA, 20 bp, human
gggaagatggctctgtctgg

SEQ ID NO: 197876 - DNA, 20 bp, human
gtgcgcgtgtggttgaggat

SEQ ID NO: 197877 - DNA, 20 bp, human
gtaccccgggacaaatccgg

SEQ ID NO: 197878 - DNA, 20 bp, human
gcagcgccaggcagcggacc

SEQ ID NO: 197879 - DNA, 20 bp, human
ggtcggcaggcggcaggtaa

SEQ ID NO: 197880 - DNA, 20 bp, human
gtgcgggcggcgggccatgg

SEQ ID NO: 197881 - DNA, 20 bp, human
gcactcaagacaaggcccca

SEQ ID NO: 197882 - DNA, 20 bp, human
gactggaagtcaaaaaccgt

SEQ ID NO: 197883 - DNA, 20 bp, human
gacgctggcgcctgcgcgtg

SEQ ID NO: 197884 - DNA, 20 bp, human
ggcgcctgcgcgtgtggttg

SEQ ID NO: 197885 - DNA, 20 bp, human
gaacctcagattcagagaca

SEQ ID NO: 197886 - DNA, 20 bp, human
ggaggcttggagcaagacta

SEQ ID NO: 197887 - DNA, 20 bp, human
gcagcacggttcctcacctc

SEQ ID NO: 197888 - DNA, 20 bp, human
gggctgcgagcggataacgg

SEQ ID NO: 197889 - DNA, 20 bp, human
gacggttcctcacctctggg

SEQ ID NO: 197890 - DNA, 20 bp, human
ggcgctgcgtttgagagcag

SEQ ID NO: 197891 - DNA, 20 bp, human
ggcttccacctggccccaag

SEQ ID NO: 197892 - DNA, 20 bp, human
gggtgaggaaccgtgctgag

SEQ ID NO: 197893 - DNA, 20 bp, human
gtgccgaagttggggagggt

SEQ ID NO: 197894 - DNA, 20 bp, human
ggatgagtacgataccgaag

SEQ ID NO: 197895 - DNA, 20 bp, human
gcaagcctcttggggccagg

SEQ ID NO: 197896 - DNA, 20 bp, human
gccgggaccgggccgagcag

SEQ ID NO: 197897 - DNA, 20 bp, human
gacgaagaagaggccggtgg

SEQ ID NO: 197898 - DNA, 20 bp, human
ggctcggcccggtcccggag

SEQ ID NO: 197899 - DNA, 20 bp, human
ggtggccggccagcatgagg

SEQ ID NO: 197900 - DNA, 20 bp, human
ggcctgttcaagaagccctg

SEQ ID NO: 197901 - DNA, 20 bp, human
ggccgggccactccgggacc

SEQ ID NO: 197902 - DNA, 20 bp, human
gggcccgaggaggatcccaa

SEQ ID NO: 197903 - DNA, 20 bp, human
ggtacccaaatggaccaagg

SEQ ID NO: 197904 - DNA, 20 bp, human
ggagggcaccagcgcggatg

SEQ ID NO: 197905 - DNA, 20 bp, human
gccacctccgctgctcggcc

SEQ ID NO: 197906 - DNA, 20 bp, human
ggggcctccttcgcctccag

SEQ ID NO: 197907 - DNA, 20 bp, human
gtggctctgacctcccctgg

SEQ ID NO: 197908 - DNA, 20 bp, human
gcctccttcgcctccagggg

SEQ ID NO: 197909 - DNA, 20 bp, human
gggtgcagaggtcaagggtg

SEQ ID NO: 197910 - DNA, 20 bp, human
ggcatccgttaagagtgtca

SEQ ID NO: 197911 - DNA, 20 bp, human
gtccaggaaccgacgtgcaa

SEQ ID NO: 197912 - DNA, 20 bp, human
gtgacctcccctggaggcga

SEQ ID NO: 197913 - DNA, 20 bp, human
gtcacgggaatgcgaagaag

SEQ ID NO: 197914 - DNA, 20 bp, human
gggggagtgcagaagaccgg

SEQ ID NO: 197915 - DNA, 20 bp, human
gctctttgtgggaaacctaa

SEQ ID NO: 197916 - DNA, 20 bp, human
ggagcgtcccgggacagtcg

SEQ ID NO: 197917 - DNA, 20 bp, human
ggtcccgggacagtcggggt

SEQ ID NO: 197918 - DNA, 20 bp, human
gccgcctccccggaatccag

SEQ ID NO: 197919 - DNA, 20 bp, human
gctgcgagcggaggccgagg

SEQ ID NO: 197920 - DNA, 20 bp, human
gtcccggctcctcagcccgg

SEQ ID NO: 197921 - DNA, 20 bp, human
gcgcatccggggggcgagag

SEQ ID NO: 197922 - DNA, 20 bp, human
ggtgagtgcgccccccgccg

SEQ ID NO: 197923 - DNA, 20 bp, human
gcgctgctgcccgggcccga

SEQ ID NO: 197924 - DNA, 20 bp, human
ggtgctgtactggatcccgg

SEQ ID NO: 197925 - DNA, 20 bp, human
ggaggcggcggggccacggt

SEQ ID NO: 197926 - DNA, 20 bp, human
gcctccgaggcaggacttgt

SEQ ID NO: 197927 - DNA, 20 bp, human
gtccggcgctggctccagaa

SEQ ID NO: 197928 - DNA, 20 bp, human
ggccgcaggattgaacaaag

SEQ ID NO: 197929 - DNA, 20 bp, human
ggtgactcggacgctccagg

SEQ ID NO: 197930 - DNA, 20 bp, human
ggcggcgggtgcagcaacct

SEQ ID NO: 197931 - DNA, 20 bp, human
gagccccggcgacggtgact

SEQ ID NO: 197932 - DNA, 20 bp, human
gggatgcagacccccggtgt

SEQ ID NO: 197933 - DNA, 20 bp, human
gccagaaggatgcagacccc

SEQ ID NO: 197934 - DNA, 20 bp, human
gctgggccagacctgcaccc

SEQ ID NO: 197935 - DNA, 20 bp, human
gagcagcgccacagcgtcca

SEQ ID NO: 197936 - DNA, 20 bp, human
ggaggcaccgagaaaccccc

SEQ ID NO: 197937 - DNA, 20 bp, human
gctggcggtcgggagagcgg

SEQ ID NO: 197938 - DNA, 20 bp, human
ggggaggagcacttagcaag

SEQ ID NO: 197939 - DNA, 20 bp, human
ggctctagtcgagacgatgt

SEQ ID NO: 197940 - DNA, 20 bp, human
ggcagcgagaggcgagccag

SEQ ID NO: 197941 - DNA, 20 bp, human
gtccgcttccgggagcctga

SEQ ID NO: 197942 - DNA, 20 bp, human
gtcggccggtccaggccctc

SEQ ID NO: 197943 - DNA, 20 bp, human
gagtgctcctccctcaactg

SEQ ID NO: 197944 - DNA, 20 bp, human
ggggcctggaccggccgagt

SEQ ID NO: 197945 - DNA, 20 bp, human
gctgctggcggtcgggagag

SEQ ID NO: 197946 - DNA, 20 bp, human
gggcaagtagcggggatgtg

SEQ ID NO: 197947 - DNA, 20 bp, human
gggaaggcggcgaaggacag

SEQ ID NO: 197948 - DNA, 20 bp, human
gtcgggaactgggcaagtag

SEQ ID NO: 197949 - DNA, 20 bp, human
gctacaccccggggccccac

SEQ ID NO: 197950 - DNA, 20 bp, human
gctggccctgcgcgggagaa

SEQ ID NO: 197951 - DNA, 20 bp, human
ggcgcttcgcttcgggaact

SEQ ID NO: 197952 - DNA, 20 bp, human
gcttgggcgccagcgagtaa

SEQ ID NO: 197953 - DNA, 20 bp, human
ggccggagccttggaaagac

SEQ ID NO: 197954 - DNA, 20 bp, human
gagctgctggcttcccactt

SEQ ID NO: 197955 - DNA, 20 bp, human
ggacagctccctacaccccg

SEQ ID NO: 197956 - DNA, 20 bp, human
ggcctcggggctatagggaa

SEQ ID NO: 197957 - DNA, 20 bp, human
gtagcagcggctgacacacc

SEQ ID NO: 197958 - DNA, 20 bp, human
gagcatatgcccgctagcag

SEQ ID NO: 197959 - DNA, 20 bp, human
gggagaggcgcaccctgcaa

SEQ ID NO: 197960 - DNA, 20 bp, human
ggatgggtcggcttccccgg

SEQ ID NO: 197961 - DNA, 20 bp, human
gactcagcctcggggctata

SEQ ID NO: 197962 - DNA, 20 bp, human
ggcgggctgtggtcacaggt

SEQ ID NO: 197963 - DNA, 20 bp, human
gccgccaatccggaggacgt

SEQ ID NO: 197964 - DNA, 20 bp, human
gtgcagccaaagaggcggag

SEQ ID NO: 197965 - DNA, 20 bp, human
gtcccgagagcgcgtccagg

SEQ ID NO: 197966 - DNA, 20 bp, human
gctgtcggagccggaggact

SEQ ID NO: 197967 - DNA, 20 bp, human
gacagcgcggtgagcacgag

SEQ ID NO: 197968 - DNA, 20 bp, human
gggcctggacacccagctgt

SEQ ID NO: 197969 - DNA, 20 bp, human
gcgtattggggcggagatag

SEQ ID NO: 197970 - DNA, 20 bp, human
gcaggccatggggcagccct

SEQ ID NO: 197971 - DNA, 20 bp, human
gcggaagcggcctagtcctc

SEQ ID NO: 197972 - DNA, 20 bp, human
gggcggctgggagcacggac

SEQ ID NO: 197973 - DNA, 20 bp, human
gctccgacagctgggtgtcc

SEQ ID NO: 197974 - DNA, 20 bp, human
gagctgggtgtccaggccat

SEQ ID NO: 197975 - DNA, 20 bp, human
gctccgccccaatacggaag

SEQ ID NO: 197976 - DNA, 20 bp, human
gcatcgagctctcccggcag

SEQ ID NO: 197977 - DNA, 20 bp, human
gagagaccccgactaaggag

SEQ ID NO: 197978 - DNA, 20 bp, human
gcgagctctcccggcagtgg

SEQ ID NO: 197979 - DNA, 20 bp, human
ggagagagagaccccgacta

SEQ ID NO: 197980 - DNA, 20 bp, human
ggaagcccatcgagctctcc

SEQ ID NO: 197981 - DNA, 20 bp, human
gctggactcggccagacacc

SEQ ID NO: 197982 - DNA, 20 bp, human
gcaactgaccgtgaagccgg

SEQ ID NO: 197983 - DNA, 20 bp, human
ggtccgcccctccttagtcg

SEQ ID NO: 197984 - DNA, 20 bp, human
gcgcctctccagccatccta

SEQ ID NO: 197985 - DNA, 20 bp, human
gccagtcccagaccccggtg

SEQ ID NO: 197986 - DNA, 20 bp, human
gccggaagtcagcccctcag

SEQ ID NO: 197987 - DNA, 20 bp, human
ggcttcccacagccccgcgg

SEQ ID NO: 197988 - DNA, 20 bp, human
ggagtgcagcaggctcggag

SEQ ID NO: 197989 - DNA, 20 bp, human
gagcccagcggctggcggta

SEQ ID NO: 197990 - DNA, 20 bp, human
gtcagcacggcgcccctgag

SEQ ID NO: 197991 - DNA, 20 bp, human
gcggcggccctacacacaag

SEQ ID NO: 197992 - DNA, 20 bp, human
gcggtaaggccgcctccgcg

SEQ ID NO: 197993 - DNA, 20 bp, human
ggagccctggtagggggacg

SEQ ID NO: 197994 - DNA, 20 bp, human
ggtctcgtatcgcgcccggg

SEQ ID NO: 197995 - DNA, 20 bp, human
ggcgatacgagacttcctgc

SEQ ID NO: 197996 - DNA, 20 bp, human
gctccgagacgagcgacgcc

SEQ ID NO: 197997 - DNA, 20 bp, human
gcaaccgcggcgggacccat

SEQ ID NO: 197998 - DNA, 20 bp, human
gcgaccgccagggctcggaa

SEQ ID NO: 197999 - DNA, 20 bp, human
ggaggcggcggtgacaacga

SEQ ID NO: 198000 - DNA, 20 bp, human
gaccgcggtctcgagctgag

SEQ ID NO: 198001 - DNA, 20 bp, human
gcaacgacggcggtggtgac

SEQ ID NO: 198002 - DNA, 20 bp, human
gcggggatccacgaccgcca

SEQ ID NO: 198003 - DNA, 20 bp, human
gggacgacgagtagaggccg

SEQ ID NO: 198004 - DNA, 20 bp, human
ggacccggcactgagggcaa

SEQ ID NO: 198005 - DNA, 20 bp, human
ggttcgagacccggcactga

SEQ ID NO: 198006 - DNA, 20 bp, human
gtgactcgggcgggaaactg

SEQ ID NO: 198007 - DNA, 20 bp, human
gacaagcagagagcaaaccc

SEQ ID NO: 198008 - DNA, 20 bp, human
gagcgggagagtcctggcga

SEQ ID NO: 198009 - DNA, 20 bp, human
gtccggagagatttgtggaa

SEQ ID NO: 198010 - DNA, 20 bp, human
ggcccgagtcatggagcaga

SEQ ID NO: 198011 - DNA, 20 bp, human
ggcgctggccgagaggtgct

SEQ ID NO: 198012 - DNA, 20 bp, human
gactgcgcagggggcctgag

SEQ ID NO: 198013 - DNA, 20 bp, human
gtgaggtgggagtcaaggca

SEQ ID NO: 198014 - DNA, 20 bp, human
gtccatgacggagtcatcca

SEQ ID NO: 198015 - DNA, 20 bp, human
ggagcctgctcccactctgg

SEQ ID NO: 198016 - DNA, 20 bp, human
gcgccgggcaggtcggaagg

SEQ ID NO: 198017 - DNA, 20 bp, human
gcctgcccggcgggacccag

SEQ ID NO: 198018 - DNA, 20 bp, human
gtcccgccgggcaggtcgga

SEQ ID NO: 198019 - DNA, 20 bp, human
gtatcccgagagagcaacta

SEQ ID NO: 198020 - DNA, 20 bp, human
gtggtcccctgggtcccgcc

SEQ ID NO: 198021 - DNA, 20 bp, human
gggcacctggaagggaagtc

SEQ ID NO: 198022 - DNA, 20 bp, human
gctggaagggaagtcaggtg

SEQ ID NO: 198023 - DNA, 20 bp, human
ggagctgagtgtcacgccca

SEQ ID NO: 198024 - DNA, 20 bp, human
gcgctctccagccaaggctc

SEQ ID NO: 198025 - DNA, 20 bp, human
ggagtgtcacgcccaaggtc

SEQ ID NO: 198026 - DNA, 20 bp, human
ggcctgcctggacactcccg

SEQ ID NO: 198027 - DNA, 20 bp, human
gggcccagcgctccccgcca

SEQ ID NO: 198028 - DNA, 20 bp, human
gcgaggtgcccagcccgcac

SEQ ID NO: 198029 - DNA, 20 bp, human
gagcggtgtgccggcgtccc

SEQ ID NO: 198030 - DNA, 20 bp, human
gagtccctctccacccgctg

SEQ ID NO: 198031 - DNA, 20 bp, human
gggaggaaatcccaccccac

SEQ ID NO: 198032 - DNA, 20 bp, human
gtgtgtggggacaccagtgc

SEQ ID NO: 198033 - DNA, 20 bp, human
gcggggtgagtcccttgtgt

SEQ ID NO: 198034 - DNA, 20 bp, human
ggggcacctcgggagtgtcc

SEQ ID NO: 198035 - DNA, 20 bp, human
ggcccgcgtgcccccagacg

SEQ ID NO: 198036 - DNA, 20 bp, human
gccgtcccagggaatcacgt

SEQ ID NO: 198037 - DNA, 20 bp, human
gtcacgtcggcagccaaagg

SEQ ID NO: 198038 - DNA, 20 bp, human
gccgcggcgtggcggagtca

SEQ ID NO: 198039 - DNA, 20 bp, human
ggaatcacgtcggcagccaa

SEQ ID NO: 198040 - DNA, 20 bp, human
ggcgcgtcccaacctgcctg

SEQ ID NO: 198041 - DNA, 20 bp, human
gaccactggggccccttgtc

SEQ ID NO: 198042 - DNA, 20 bp, human
gtttagggccccgaccactg

SEQ ID NO: 198043 - DNA, 20 bp, human
gcaaggggccccagtggtcg

SEQ ID NO: 198044 - DNA, 20 bp, human
gcggggccctaaaccagctg

SEQ ID NO: 198045 - DNA, 20 bp, human
gagtcagggcgggcctcgag

SEQ ID NO: 198046 - DNA, 20 bp, human
ggcgcaataacggtgagtgg

SEQ ID NO: 198047 - DNA, 20 bp, human
gacaagcgagaggatcatgg

SEQ ID NO: 198048 - DNA, 20 bp, human
gccacccgggaccagaaaag

SEQ ID NO: 198049 - DNA, 20 bp, human
ggacacaagcgagaggatca

SEQ ID NO: 198050 - DNA, 20 bp, human
gcagaaagcaggcgaacccg

SEQ ID NO: 198051 - DNA, 20 bp, human
ggggagagggaggcgccgaa

SEQ ID NO: 198052 - DNA, 20 bp, human
ggcgggcggccgggacgcac

SEQ ID NO: 198053 - DNA, 20 bp, human
gcgctaggcggagagagacc

SEQ ID NO: 198054 - DNA, 20 bp, human
gcgaacccgcggcgcaataa

SEQ ID NO: 198055 - DNA, 20 bp, human
gcgccgaagggcacaagagt

SEQ ID NO: 198056 - DNA, 20 bp, human
gcagcagctgcacagacgct

SEQ ID NO: 198057 - DNA, 20 bp, human
gcagctgcacagacgctggg

SEQ ID NO: 198058 - DNA, 20 bp, human
gtgttgatcgccagagaaag

SEQ ID NO: 198059 - DNA, 20 bp, human
gcagcggcaacagctcaata

SEQ ID NO: 198060 - DNA, 20 bp, human
gaaagccacatcagcaacag

SEQ ID NO: 198061 - DNA, 20 bp, human
ggagatgacttgttatagca

SEQ ID NO: 198062 - DNA, 20 bp, human
gcaagaaaagcccctttctc

SEQ ID NO: 198063 - DNA, 20 bp, human
ggcaattttagattttgtgt

SEQ ID NO: 198064 - DNA, 20 bp, human
ggttgccgctgttgctgatg

SEQ ID NO: 198065 - DNA, 20 bp, human
gtatgaaaggtaagttggtt

SEQ ID NO: 198066 - DNA, 20 bp, human
gatgaagaagccgcgaagtg

SEQ ID NO: 198067 - DNA, 20 bp, human
ggaagcgaagaaacagctcc

SEQ ID NO: 198068 - DNA, 20 bp, human
gcctcgccaagagtgtcggg

SEQ ID NO: 198069 - DNA, 20 bp, human
gtccaggaaacacaaacctg

SEQ ID NO: 198070 - DNA, 20 bp, human
gaggacgagcacaccaaaaa

SEQ ID NO: 198071 - DNA, 20 bp, human
gagtgagaaggggtgtccgt

SEQ ID NO: 198072 - DNA, 20 bp, human
gtcctgcctcccgacactct

SEQ ID NO: 198073 - DNA, 20 bp, human
ggtgggtaggaatttcaggt

SEQ ID NO: 198074 - DNA, 20 bp, human
gaagaagccgcgaagtgtgg

SEQ ID NO: 198075 - DNA, 20 bp, human
gcctgaatgaacaggtacag

SEQ ID NO: 198076 - DNA, 20 bp, human
gctacgcggctcgagaccca

SEQ ID NO: 198077 - DNA, 20 bp, human
gcgccaaagcgaaacttcgg

SEQ ID NO: 198078 - DNA, 20 bp, human
gcaacgccaaagcgaaactt

SEQ ID NO: 198079 - DNA, 20 bp, human
gggaaaaggaaccgaggcgg

SEQ ID NO: 198080 - DNA, 20 bp, human
ggcgcaaacaagccaatccc

SEQ ID NO: 198081 - DNA, 20 bp, human
gtagggcgagcctccctccg

SEQ ID NO: 198082 - DNA, 20 bp, human
gtggactcggcgccctgctt

SEQ ID NO: 198083 - DNA, 20 bp, human
gacgcgcgcgggccgcccag

SEQ ID NO: 198084 - DNA, 20 bp, human
gggccgccgaagtttcgctt

SEQ ID NO: 198085 - DNA, 20 bp, human
gccaaacacagcgacaatgt

SEQ ID NO: 198086 - DNA, 20 bp, human
ggccgtaggagccggatcgg

SEQ ID NO: 198087 - DNA, 20 bp, human
gcctcagagagtggttgcag

SEQ ID NO: 198088 - DNA, 20 bp, human
gtcccccgatccggctccta

SEQ ID NO: 198089 - DNA, 20 bp, human
gggcgatgcttaggccccgt

SEQ ID NO: 198090 - DNA, 20 bp, human
ggccccgggtttgttgacag

SEQ ID NO: 198091 - DNA, 20 bp, human
gcgtaggcaggaggcgaagg

SEQ ID NO: 198092 - DNA, 20 bp, human
gccgggtttgttgacagcgg

SEQ ID NO: 198093 - DNA, 20 bp, human
ggctgcaggctccgagccgt

SEQ ID NO: 198094 - DNA, 20 bp, human
ggtccatctccgccagtggt

SEQ ID NO: 198095 - DNA, 20 bp, human
gcccggcccctcccccgatc

SEQ ID NO: 198096 - DNA, 20 bp, human
gtacggcgccggagagatgg

SEQ ID NO: 198097 - DNA, 20 bp, human
gctgccggcaatgctccacc

SEQ ID NO: 198098 - DNA, 20 bp, human
gccttacggcgccggagaga

SEQ ID NO: 198099 - DNA, 20 bp, human
ggatggcggagttggacatc

SEQ ID NO: 198100 - DNA, 20 bp, human
gccccggccgcgggagacca

SEQ ID NO: 198101 - DNA, 20 bp, human
ggccggcagcgaggtgatcc

SEQ ID NO: 198102 - DNA, 20 bp, human
gctgccaggtggagcattgc

SEQ ID NO: 198103 - DNA, 20 bp, human
gtccaactccgccatctctc

SEQ ID NO: 198104 - DNA, 20 bp, human
ggggcggggcaaagcctgag

SEQ ID NO: 198105 - DNA, 20 bp, human
gatcgggcagcactgccagg

SEQ ID NO: 198106 - DNA, 20 bp, human
gcactaggatgcaggtgtgt

SEQ ID NO: 198107 - DNA, 20 bp, human
gaaagaccgacaaagactgt

SEQ ID NO: 198108 - DNA, 20 bp, human
gcggcgccacccggccctct

SEQ ID NO: 198109 - DNA, 20 bp, human
gctctcgctcaactcccaga

SEQ ID NO: 198110 - DNA, 20 bp, human
gtgtgtgcctggatgctagt

SEQ ID NO: 198111 - DNA, 20 bp, human
gtatgagtgtgtggacacaa

SEQ ID NO: 198112 - DNA, 20 bp, human
ggaggccaccgctgggacgt

SEQ ID NO: 198113 - DNA, 20 bp, human
gcctgggaccgtccctagtg

SEQ ID NO: 198114 - DNA, 20 bp, human
ggacaaagactgtgggaagt

SEQ ID NO: 198115 - DNA, 20 bp, human
ggcacaagacccctggacat

SEQ ID NO: 198116 - DNA, 20 bp, human
gagacggctctcagatccgg

SEQ ID NO: 198117 - DNA, 20 bp, human
ggctgcggataaatccccgt

SEQ ID NO: 198118 - DNA, 20 bp, human
gccccgacgagagccaggta

SEQ ID NO: 198119 - DNA, 20 bp, human
gggcgcgcccggaaacccca

SEQ ID NO: 198120 - DNA, 20 bp, human
gagctacccggagccgacta

SEQ ID NO: 198121 - DNA, 20 bp, human
gtcgctgcccgcggcctacg

SEQ ID NO: 198122 - DNA, 20 bp, human
ggataaatccccgtaggccg

SEQ ID NO: 198123 - DNA, 20 bp, human
gagatgttgcgttccggtgt

SEQ ID NO: 198124 - DNA, 20 bp, human
gcccgagcaacctgacctca

SEQ ID NO: 198125 - DNA, 20 bp, human
gtcaaggcaggcccgacccc

SEQ ID NO: 198126 - DNA, 20 bp, human
ggcgtggccaaggaggtaat

SEQ ID NO: 198127 - DNA, 20 bp, human
ggggcggtgtgtcgaaaata

SEQ ID NO: 198128 - DNA, 20 bp, human
gcggtgtgtcgaaaataggg

SEQ ID NO: 198129 - DNA, 20 bp, human
ggcgggggctccggtaaccc

SEQ ID NO: 198130 - DNA, 20 bp, human
gcagggagcccgccagagtg

SEQ ID NO: 198131 - DNA, 20 bp, human
ggctgggggggggtggtcag

SEQ ID NO: 198132 - DNA, 20 bp, human
gggtcggattgcaggtccag

SEQ ID NO: 198133 - DNA, 20 bp, human
gggtaacccgggctgggcgg

SEQ ID NO: 198134 - DNA, 20 bp, human
ggcaccgcgaccccgcactc

SEQ ID NO: 198135 - DNA, 20 bp, human
ggcgctgacgtcatcccgca

SEQ ID NO: 198136 - DNA, 20 bp, human
gcgggaggccggaaccttgg

SEQ ID NO: 198137 - DNA, 20 bp, human
gtcaggccggcgagtcccaa

SEQ ID NO: 198138 - DNA, 20 bp, human
gcccgggccccgctctgagg

SEQ ID NO: 198139 - DNA, 20 bp, human
ggccgggggcgcagacgcca

SEQ ID NO: 198140 - DNA, 20 bp, human
gccagcccgggcctacgggg

SEQ ID NO: 198141 - DNA, 20 bp, human
ggctgaccggcctggaatcc

SEQ ID NO: 198142 - DNA, 20 bp, human
gaccgctccgggaggagcag

SEQ ID NO: 198143 - DNA, 20 bp, human
gttccaggccggtcagctgg

SEQ ID NO: 198144 - DNA, 20 bp, human
gcctgggccacgggtgaggg

SEQ ID NO: 198145 - DNA, 20 bp, human
gaagggtagcaacgcacccc

SEQ ID NO: 198146 - DNA, 20 bp, human
gtcgacagggcccaacgacc

SEQ ID NO: 198147 - DNA, 20 bp, human
ggcccgcctacaggtcgaca

SEQ ID NO: 198148 - DNA, 20 bp, human
gcggcgagcaacttcacgga

SEQ ID NO: 198149 - DNA, 20 bp, human
ggcggggacaggactctacc

SEQ ID NO: 198150 - DNA, 20 bp, human
ggagccagcggacaagactg

SEQ ID NO: 198151 - DNA, 20 bp, human
gaggcgggcgagcgagccag

SEQ ID NO: 198152 - DNA, 20 bp, human
ggaatggcgcaaggccggag

SEQ ID NO: 198153 - DNA, 20 bp, human
gttgggccctgtcgacctgt

SEQ ID NO: 198154 - DNA, 20 bp, human
gggccctgtcgacctgtagg

SEQ ID NO: 198155 - DNA, 20 bp, human
ggctcctccaagaccaatcc

SEQ ID NO: 198156 - DNA, 20 bp, human
ggcgcgaagccggcacgatg

SEQ ID NO: 198157 - DNA, 20 bp, human
gccaggaagcacaaagacgg

SEQ ID NO: 198158 - DNA, 20 bp, human
gctagaggccggccccgcag

SEQ ID NO: 198159 - DNA, 20 bp, human
gagccgcgcagcttccccgg

SEQ ID NO: 198160 - DNA, 20 bp, human
ggctgtgtgcatctcctacg

SEQ ID NO: 198161 - DNA, 20 bp, human
gggaggcgtgaggcgacgac

SEQ ID NO: 198162 - DNA, 20 bp, human
ggcgaggcctggggccgtaa

SEQ ID NO: 198163 - DNA, 20 bp, human
gaagccggcacgatgaggcc

SEQ ID NO: 198164 - DNA, 20 bp, human
ggggaagctgcgcggctccc

SEQ ID NO: 198165 - DNA, 20 bp, human
ggggcggcgagtgcgttagt

SEQ ID NO: 198166 - DNA, 20 bp, human
gagagacccgccgccaggtg

SEQ ID NO: 198167 - DNA, 20 bp, human
gcggcggcgcgcagcgtgtc

SEQ ID NO: 198168 - DNA, 20 bp, human
gggagcaagcaggggttcgg

SEQ ID NO: 198169 - DNA, 20 bp, human
gtaataaacagcggacggag

SEQ ID NO: 198170 - DNA, 20 bp, human
gtggcggagccggagcaagc

SEQ ID NO: 198171 - DNA, 20 bp, human
gggccgcgctcctcacctgg

SEQ ID NO: 198172 - DNA, 20 bp, human
ggccggtagccgccggtgaa

SEQ ID NO: 198173 - DNA, 20 bp, human
ggccggagcaagcaggggtt

SEQ ID NO: 198174 - DNA, 20 bp, human
gacctgtacccattcaccgg

SEQ ID NO: 198175 - DNA, 20 bp, human
gaagggccccgggcacactg

SEQ ID NO: 198176 - DNA, 20 bp, human
ggaatctgcggcatccaaca

SEQ ID NO: 198177 - DNA, 20 bp, human
gcttcgccctcctccccacg

SEQ ID NO: 198178 - DNA, 20 bp, human
gcgaggttatggcgaatctg

SEQ ID NO: 198179 - DNA, 20 bp, human
gtctgcggcatccaacatgg

SEQ ID NO: 198180 - DNA, 20 bp, human
gaagcaaggcgggagcgagt

SEQ ID NO: 198181 - DNA, 20 bp, human
gcctcccgtgccgaccgagg

SEQ ID NO: 198182 - DNA, 20 bp, human
gggccagcgacggaacgcag

SEQ ID NO: 198183 - DNA, 20 bp, human
gggctcacgttcagtcgctg

SEQ ID NO: 198184 - DNA, 20 bp, human
gaaaagagccggcgaggtta

SEQ ID NO: 198185 - DNA, 20 bp, human
gatgcgcccggccgtttcca

SEQ ID NO: 198186 - DNA, 20 bp, human
gcttcccacggagcatgcag

SEQ ID NO: 198187 - DNA, 20 bp, human
ggcgcctccgccgcttccca

SEQ ID NO: 198188 - DNA, 20 bp, human
gcatgctccgtgggaagcgg

SEQ ID NO: 198189 - DNA, 20 bp, human
gtgagaagaaagggtgtaga

SEQ ID NO: 198190 - DNA, 20 bp, human
gccaaacaggcaccacccta

SEQ ID NO: 198191 - DNA, 20 bp, human
gcctcgtaaacctccaccaa

SEQ ID NO: 198192 - DNA, 20 bp, human
gctgcctgcgtctctaacta

SEQ ID NO: 198193 - DNA, 20 bp, human
gtcacctctgcatgctccgt

SEQ ID NO: 198194 - DNA, 20 bp, human
gccaccaagggcagagtagg

SEQ ID NO: 198195 - DNA, 20 bp, human
gccgcatctctagccaacca

SEQ ID NO: 198196 - DNA, 20 bp, human
gcgatcgctgaggagcaagg

SEQ ID NO: 198197 - DNA, 20 bp, human
ggcaagggggcgctaggaaa

SEQ ID NO: 198198 - DNA, 20 bp, human
ggaactgggttgcgacggtc

SEQ ID NO: 198199 - DNA, 20 bp, human
gggaagaaccccgatcgctg

SEQ ID NO: 198200 - DNA, 20 bp, human
gcgggctgttaccctatccg

SEQ ID NO: 198201 - DNA, 20 bp, human
gcgccccgggccgagtgagg

SEQ ID NO: 198202 - DNA, 20 bp, human
gcccggggcggtggatctgg

SEQ ID NO: 198203 - DNA, 20 bp, human
gggtccggcgagagagagct

SEQ ID NO: 198204 - DNA, 20 bp, human
ggccggggccggagtatctg

SEQ ID NO: 198205 - DNA, 20 bp, human
gaaagggaactgggttgcga

SEQ ID NO: 198206 - DNA, 20 bp, human
ggtctaggcgtcccacacaa

SEQ ID NO: 198207 - DNA, 20 bp, human
gagactccagccagtgaatg

SEQ ID NO: 198208 - DNA, 20 bp, human
gcagccagtgaatgaggcgg

SEQ ID NO: 198209 - DNA, 20 bp, human
gtgaatgaggcggaggagtg

SEQ ID NO: 198210 - DNA, 20 bp, human
gcccgcctcgcgctgctcgg

SEQ ID NO: 198211 - DNA, 20 bp, human
gcgctccggggcgtcaggga

SEQ ID NO: 198212 - DNA, 20 bp, human
gtggaagctcgagacgggag

SEQ ID NO: 198213 - DNA, 20 bp, human
gagggacgggagtcgaaccg

SEQ ID NO: 198214 - DNA, 20 bp, human
gacggcggtgagggaagtga

SEQ ID NO: 198215 - DNA, 20 bp, human
gattgattattccattgtgt

SEQ ID NO: 198216 - DNA, 20 bp, human
gctgaactggggctacaagg

SEQ ID NO: 198217 - DNA, 20 bp, human
ggaacgttgagggtaagagt

SEQ ID NO: 198218 - DNA, 20 bp, human
gcaacagttggagacctaga

SEQ ID NO: 198219 - DNA, 20 bp, human
ggctttaggtagagtaccgc

SEQ ID NO: 198220 - DNA, 20 bp, human
gcgcaggccagtggcaatgg

SEQ ID NO: 198221 - DNA, 20 bp, human
ggcgacaggaaagctgcact

SEQ ID NO: 198222 - DNA, 20 bp, human
gaactggggctacaaggcgg

SEQ ID NO: 198223 - DNA, 20 bp, human
gacaaggcggcggggagagt

SEQ ID NO: 198224 - DNA, 20 bp, human
gggtacgtaaggagaagacg

SEQ ID NO: 198225 - DNA, 20 bp, human
gagcacctgggtggtacgta

SEQ ID NO: 198226 - DNA, 20 bp, human
ggcggctgcagcggtcggag

SEQ ID NO: 198227 - DNA, 20 bp, human
ggaggggacgcgctggaagt

SEQ ID NO: 198228 - DNA, 20 bp, human
gcgccaaccatgctgctcgg

SEQ ID NO: 198229 - DNA, 20 bp, human
gggagaagcaaccgcgtaag

SEQ ID NO: 198230 - DNA, 20 bp, human
gtgccgccgagcagcatggt

SEQ ID NO: 198231 - DNA, 20 bp, human
gccgccgctgctgccttgat

SEQ ID NO: 198232 - DNA, 20 bp, human
gatcccgaaaagaggcgctc

SEQ ID NO: 198233 - DNA, 20 bp, human
ggcggttgcttctccggcgg

SEQ ID NO: 198234 - DNA, 20 bp, human
gtggcccctgcccgctccgg

SEQ ID NO: 198235 - DNA, 20 bp, human
gggccacggaagagaagcgg

SEQ ID NO: 198236 - DNA, 20 bp, human
gagcaggagcgagcgaggta

SEQ ID NO: 198237 - DNA, 20 bp, human
gaaagaggcgaagatcgagt

SEQ ID NO: 198238 - DNA, 20 bp, human
gggcatggagcggtcctcgg

SEQ ID NO: 198239 - DNA, 20 bp, human
ggcagagcggaagagatggt

SEQ ID NO: 198240 - DNA, 20 bp, human
gacgctggagcagaaagtgg

SEQ ID NO: 198241 - DNA, 20 bp, human
gcaaacagcgagaccgcggt

SEQ ID NO: 198242 - DNA, 20 bp, human
gaagagatggtcgggatgag

SEQ ID NO: 198243 - DNA, 20 bp, human
gagattgtgcaagatcaggc

SEQ ID NO: 198244 - DNA, 20 bp, human
gtcgctgtttggttgtgaag

SEQ ID NO: 198245 - DNA, 20 bp, human
gcaaccaaacagcgagaccg

SEQ ID NO: 198246 - DNA, 20 bp, human
gcgaagacgcgcggagacgg

SEQ ID NO: 198247 - DNA, 20 bp, human
gcccaccaccagcggcgagt

SEQ ID NO: 198248 - DNA, 20 bp, human
gcaggagatgcgcctcagac

SEQ ID NO: 198249 - DNA, 20 bp, human
gtaggcggcagtgaccctca

SEQ ID NO: 198250 - DNA, 20 bp, human
ggcccttcgccgcccgtctg

SEQ ID NO: 198251 - DNA, 20 bp, human
gccagtgccacagcgggtca

SEQ ID NO: 198252 - DNA, 20 bp, human
ggtcacccactcgccgctgg

SEQ ID NO: 198253 - DNA, 20 bp, human
gcacgaggcaccgggcatcg

SEQ ID NO: 198254 - DNA, 20 bp, human
gagggtgggagcccaaactt

SEQ ID NO: 198255 - DNA, 20 bp, human
gccaaacttcggctactcgt

SEQ ID NO: 198256 - DNA, 20 bp, human
gtgctggtgtcggctccgag

SEQ ID NO: 198257 - DNA, 20 bp, human
gacccccgcgcccattgcct

SEQ ID NO: 198258 - DNA, 20 bp, human
ggacctcagtgtgagccagg

SEQ ID NO: 198259 - DNA, 20 bp, human
gaaacccgatggaaataaca

SEQ ID NO: 198260 - DNA, 20 bp, human
gaccgaggcaatgggcgcgg

SEQ ID NO: 198261 - DNA, 20 bp, human
gtttgcgcgcagtagacgga

SEQ ID NO: 198262 - DNA, 20 bp, human
ggagttggtcgcttgcaccg

SEQ ID NO: 198263 - DNA, 20 bp, human
gcaggtccagcggcccggaa

SEQ ID NO: 198264 - DNA, 20 bp, human
gtcgcttgcaccgaggcaat

SEQ ID NO: 198265 - DNA, 20 bp, human
gaagcgaccaactcacctct

SEQ ID NO: 198266 - DNA, 20 bp, human
gcggccaccacgggtcaggg

SEQ ID NO: 198267 - DNA, 20 bp, human
gtgggcccctccctgacccg

SEQ ID NO: 198268 - DNA, 20 bp, human
gggcctacaagactcacgga

SEQ ID NO: 198269 - DNA, 20 bp, human
ggggctgtaagcgccggtcg

SEQ ID NO: 198270 - DNA, 20 bp, human
gcgccggccaccacgggtca

SEQ ID NO: 198271 - DNA, 20 bp, human
ggcgccggtcgcggctgtgt

SEQ ID NO: 198272 - DNA, 20 bp, human
ggcccctccctgacccgtgg

SEQ ID NO: 198273 - DNA, 20 bp, human
gcgaccgacacagccgcgac

SEQ ID NO: 198274 - DNA, 20 bp, human
ggagcgactcttggaacctt

SEQ ID NO: 198275 - DNA, 20 bp, human
ggggccacgccggccaccac

SEQ ID NO: 198276 - DNA, 20 bp, human
gtgtgagggaccggtcggaa

SEQ ID NO: 198277 - DNA, 20 bp, human
ggccccccgcatgtcacccg

SEQ ID NO: 198278 - DNA, 20 bp, human
gcaggggtgtgggtctgtga

SEQ ID NO: 198279 - DNA, 20 bp, human
ggcctcgggtgacatgcggg

SEQ ID NO: 198280 - DNA, 20 bp, human
gcgcgcgacgcccttccgac

SEQ ID NO: 198281 - DNA, 20 bp, human
ggcagcaagccgcggtaaaa

SEQ ID NO: 198282 - DNA, 20 bp, human
ggggcgcctctacccgggag

SEQ ID NO: 198283 - DNA, 20 bp, human
gggaatggcctcgcatccaa

SEQ ID NO: 198284 - DNA, 20 bp, human
gccaccagcttcaaagacca

SEQ ID NO: 198285 - DNA, 20 bp, human
gccacgttgtggcagtccct

SEQ ID NO: 198286 - DNA, 20 bp, human
ggcgctcgctcactccgctg

SEQ ID NO: 198287 - DNA, 20 bp, human
gtaccgaggtggggacccgt

SEQ ID NO: 198288 - DNA, 20 bp, human
ggcccgtcgccagtgacacc

SEQ ID NO: 198289 - DNA, 20 bp, human
ggacaccgggacaacagctg

SEQ ID NO: 198290 - DNA, 20 bp, human
gaccgctaggacgaaatggc

SEQ ID NO: 198291 - DNA, 20 bp, human
gtccccacctcggtacagaa

SEQ ID NO: 198292 - DNA, 20 bp, human
gagcgagcgcggggcagtag

SEQ ID NO: 198293 - DNA, 20 bp, human
ggctgttgtcccggtgtcac

SEQ ID NO: 198294 - DNA, 20 bp, human
ggtgctgccagacaagatat

SEQ ID NO: 198295 - DNA, 20 bp, human
ggtaaaccgctaggacgaaa

SEQ ID NO: 198296 - DNA, 20 bp, human
gctggcgccgctgactccca

SEQ ID NO: 198297 - DNA, 20 bp, human
gccagcctcacccgactcag

SEQ ID NO: 198298 - DNA, 20 bp, human
ggtcagcggcgccagaatac

SEQ ID NO: 198299 - DNA, 20 bp, human
gagaaaagcagcggccacag

SEQ ID NO: 198300 - DNA, 20 bp, human
gcagaggatagcccagccct

SEQ ID NO: 198301 - DNA, 20 bp, human
gctatcctctgagtcgggtg

SEQ ID NO: 198302 - DNA, 20 bp, human
gctgggctatcctctgagtc

SEQ ID NO: 198303 - DNA, 20 bp, human
gggagctgcgaacccagacg

SEQ ID NO: 198304 - DNA, 20 bp, human
gtgggagccgggcgccactg

SEQ ID NO: 198305 - DNA, 20 bp, human
gggtgaacgccccaggatga

SEQ ID NO: 198306 - DNA, 20 bp, human
gtagatggcagtcagatcca

SEQ ID NO: 198307 - DNA, 20 bp, human
gaggggtgtcggccgagagt

SEQ ID NO: 198308 - DNA, 20 bp, human
ggagtgggagcgctgaagtc

SEQ ID NO: 198309 - DNA, 20 bp, human
gtgtaacggttggccatgag

SEQ ID NO: 198310 - DNA, 20 bp, human
gtctcggccgacacccctca

SEQ ID NO: 198311 - DNA, 20 bp, human
gacgccctcagcaacgacta

SEQ ID NO: 198312 - DNA, 20 bp, human
gttgcgcggaggcgtctctg

SEQ ID NO: 198313 - DNA, 20 bp, human
gcggggactcacctcgtaga

SEQ ID NO: 198314 - DNA, 20 bp, human
ggatctgactgccatctacg

SEQ ID NO: 198315 - DNA, 20 bp, human
gactaggggtgagccaggta

SEQ ID NO: 198316 - DNA, 20 bp, human
ggtgggactccagacaggag

SEQ ID NO: 198317 - DNA, 20 bp, human
gccggagtcagaaaggcgag

SEQ ID NO: 198318 - DNA, 20 bp, human
gaggcgcagcctctcctgtc

SEQ ID NO: 198319 - DNA, 20 bp, human
gtggtgtgtcgcgaaggtcc

SEQ ID NO: 198320 - DNA, 20 bp, human
ggcgccgggaactggcgtgt

SEQ ID NO: 198321 - DNA, 20 bp, human
ggaaggtcccggtgcgggga

SEQ ID NO: 198322 - DNA, 20 bp, human
gggattacatgtgaatctgg

SEQ ID NO: 198323 - DNA, 20 bp, human
gcatgtgaatctggaggcca

SEQ ID NO: 198324 - DNA, 20 bp, human
gcgagccaggggcgaggatc

SEQ ID NO: 198325 - DNA, 20 bp, human
gggctgcgccttccccgcac

SEQ ID NO: 198326 - DNA, 20 bp, human
gagcggcagtgcaggtgagg

SEQ ID NO: 198327 - DNA, 20 bp, human
ggcgcgggtaaggagcggga

SEQ ID NO: 198328 - DNA, 20 bp, human
gggaagcggcagtgcaggtg

SEQ ID NO: 198329 - DNA, 20 bp, human
ggactgcgcgggtaaggagc

SEQ ID NO: 198330 - DNA, 20 bp, human
gcggcccaccgcctcccggt

SEQ ID NO: 198331 - DNA, 20 bp, human
gaccgcctcccggtcggaag

SEQ ID NO: 198332 - DNA, 20 bp, human
gtaccggccccgccgaccaa

SEQ ID NO: 198333 - DNA, 20 bp, human
gccttacccgcgcagtcccc

SEQ ID NO: 198334 - DNA, 20 bp, human
gcgccctcgggccctcaccg

SEQ ID NO: 198335 - DNA, 20 bp, human
gcggggccggtaaacaactc

SEQ ID NO: 198336 - DNA, 20 bp, human
ggggtccggcggagtgcggc

SEQ ID NO: 198337 - DNA, 20 bp, human
gttgagccacgacgaataac

SEQ ID NO: 198338 - DNA, 20 bp, human
ggatcccgcagtggccggag

SEQ ID NO: 198339 - DNA, 20 bp, human
gaggtccgcctcggagaaca

SEQ ID NO: 198340 - DNA, 20 bp, human
ggcagggaaagacacgtcca

SEQ ID NO: 198341 - DNA, 20 bp, human
ggcggactgctggaactcgg

SEQ ID NO: 198342 - DNA, 20 bp, human
gtcaggtcgggaaagtcccg

SEQ ID NO: 198343 - DNA, 20 bp, human
gcactcccgggctctatata

SEQ ID NO: 198344 - DNA, 20 bp, human
gagcggcaggccgggaggtc

SEQ ID NO: 198345 - DNA, 20 bp, human
gcacccggcggcatccactg

SEQ ID NO: 198346 - DNA, 20 bp, human
gccgccatgtcggtctccag

SEQ ID NO: 198347 - DNA, 20 bp, human
ggacatggcggctacccgga

SEQ ID NO: 198348 - DNA, 20 bp, human
gagatagggaaggaccgtgg

SEQ ID NO: 198349 - DNA, 20 bp, human
gcccaggctctaaccaccac

SEQ ID NO: 198350 - DNA, 20 bp, human
ggccagagaccgtggaccgg

SEQ ID NO: 198351 - DNA, 20 bp, human
gacccgctaaggccgccctc

SEQ ID NO: 198352 - DNA, 20 bp, human
ggcggctgccggacccgcta

SEQ ID NO: 198353 - DNA, 20 bp, human
gcccgtgcgctattaccgaa

SEQ ID NO: 198354 - DNA, 20 bp, human
gccgaagggcgccgccatcg

SEQ ID NO: 198355 - DNA, 20 bp, human
gaaagccagagaccgtggac

SEQ ID NO: 198356 - DNA, 20 bp, human
gccccgtcggccctaggcac

SEQ ID NO: 198357 - DNA, 20 bp, human
gttggggggtcccgcatcta

SEQ ID NO: 198358 - DNA, 20 bp, human
gaaaggagagccctagatgc

SEQ ID NO: 198359 - DNA, 20 bp, human
ggcatctgagccaggcggag

SEQ ID NO: 198360 - DNA, 20 bp, human
gcgtgcgtgctcctagttag

SEQ ID NO: 198361 - DNA, 20 bp, human
gctagggccgacggggacgc

SEQ ID NO: 198362 - DNA, 20 bp, human
gttagaggctctcctttcaa

SEQ ID NO: 198363 - DNA, 20 bp, human
ggcgcgtcctgggccggagg

SEQ ID NO: 198364 - DNA, 20 bp, human
gaggagcacgcacgggaccc

SEQ ID NO: 198365 - DNA, 20 bp, human
ggtacctggctggagacgag

SEQ ID NO: 198366 - DNA, 20 bp, human
ggagtgcttcgcggtaacag

SEQ ID NO: 198367 - DNA, 20 bp, human
gtgccatctccagagataag

SEQ ID NO: 198368 - DNA, 20 bp, human
gccagccacgggtcaccgca

SEQ ID NO: 198369 - DNA, 20 bp, human
ggaaatagcagagtgcttcg

SEQ ID NO: 198370 - DNA, 20 bp, human
ggcgagggctacaagtctcc

SEQ ID NO: 198371 - DNA, 20 bp, human
gcctcccaaacgtaaaacaa

SEQ ID NO: 198372 - DNA, 20 bp, human
gacgggtcaccgcagggcga

SEQ ID NO: 198373 - DNA, 20 bp, human
ggggttagatagtcagggag

SEQ ID NO: 198374 - DNA, 20 bp, human
gcaaaggggttagatagtca

SEQ ID NO: 198375 - DNA, 20 bp, human
gatgttgaaaacgggcagat

SEQ ID NO: 198376 - DNA, 20 bp, human
gtggtgtaaaccttcaagaa

SEQ ID NO: 198377 - DNA, 20 bp, human
gagccagcaactgaagaaac

SEQ ID NO: 198378 - DNA, 20 bp, human
ggacaccagaaaggcctggg

SEQ ID NO: 198379 - DNA, 20 bp, human
gggaggtggttgatatatcc

SEQ ID NO: 198380 - DNA, 20 bp, human
gctggccctcaggctctcgg

SEQ ID NO: 198381 - DNA, 20 bp, human
gcttcaagaagggcacaggc

SEQ ID NO: 198382 - DNA, 20 bp, human
gatcccctccgagagcctga

SEQ ID NO: 198383 - DNA, 20 bp, human
gagcttccacaaaagatagt

SEQ ID NO: 198384 - DNA, 20 bp, human
gtcagatcactactgcctgg

SEQ ID NO: 198385 - DNA, 20 bp, human
gttggaatacatgaaaaaag

SEQ ID NO: 198386 - DNA, 20 bp, human
gagggtctcccggggaccag

SEQ ID NO: 198387 - DNA, 20 bp, human
ggcagtggaccgcgatttag

SEQ ID NO: 198388 - DNA, 20 bp, human
gaccagcggctggagcgctc

SEQ ID NO: 198389 - DNA, 20 bp, human
gagagtgcccacagtggaca

SEQ ID NO: 198390 - DNA, 20 bp, human
gccagcctcgaagcttccgg

SEQ ID NO: 198391 - DNA, 20 bp, human
gggaaggtagtcccaaccaa

SEQ ID NO: 198392 - DNA, 20 bp, human
gtgctcagaaacggtcccat

SEQ ID NO: 198393 - DNA, 20 bp, human
gtttccccggaggaccccag

SEQ ID NO: 198394 - DNA, 20 bp, human
gttaggggcacagggtctcc

SEQ ID NO: 198395 - DNA, 20 bp, human
ggtcgcgctagcggtagtag

SEQ ID NO: 198396 - DNA, 20 bp, human
gactcacgtactggctgtgg

SEQ ID NO: 198397 - DNA, 20 bp, human
gagtgccccagggccggcgc

SEQ ID NO: 198398 - DNA, 20 bp, human
gcggccgcggactcacgtac

SEQ ID NO: 198399 - DNA, 20 bp, human
gagagggagcacgaaatggt

SEQ ID NO: 198400 - DNA, 20 bp, human
ggtgtgaatagagaccccgg

SEQ ID NO: 198401 - DNA, 20 bp, human
ggctggcggccgggttcccg

SEQ ID NO: 198402 - DNA, 20 bp, human
ggagttaactaggtagggag

SEQ ID NO: 198403 - DNA, 20 bp, human
ggacccggccaaaaagggga

SEQ ID NO: 198404 - DNA, 20 bp, human
ggagggcagagagacctcta

SEQ ID NO: 198405 - DNA, 20 bp, human
ggacttgagagtgattgcga

SEQ ID NO: 198406 - DNA, 20 bp, human
gagcgagggcgagagcttcg

SEQ ID NO: 198407 - DNA, 20 bp, human
gcggcgggcgcgctgtgcag

SEQ ID NO: 198408 - DNA, 20 bp, human
gcgacctggcgcaagaccgg

SEQ ID NO: 198409 - DNA, 20 bp, human
gcttgcgagaccccttggaa

SEQ ID NO: 198410 - DNA, 20 bp, human
gccttggaagggaacagtgg

SEQ ID NO: 198411 - DNA, 20 bp, human
gcggccgggatgccaaagtg

SEQ ID NO: 198412 - DNA, 20 bp, human
ggacaatcgccaccccctaa

SEQ ID NO: 198413 - DNA, 20 bp, human
ggggcgggaatgcccttagg

SEQ ID NO: 198414 - DNA, 20 bp, human
gcctccccgcctcgcagagt

SEQ ID NO: 198415 - DNA, 20 bp, human
gccagccttgcgagacccct

SEQ ID NO: 198416 - DNA, 20 bp, human
gagctgcagcgggaccgcgt

SEQ ID NO: 198417 - DNA, 20 bp, human
gcaacccgcgcgtcttccgg

SEQ ID NO: 198418 - DNA, 20 bp, human
gtgcagccctggcggtcccg

SEQ ID NO: 198419 - DNA, 20 bp, human
gctccgtggcagccccctgt

SEQ ID NO: 198420 - DNA, 20 bp, human
gcgtcttgcagaccccgggg

SEQ ID NO: 198421 - DNA, 20 bp, human
gcaacccgccggaagacgcg

SEQ ID NO: 198422 - DNA, 20 bp, human
gaagcgtccagcgttgaggt

SEQ ID NO: 198423 - DNA, 20 bp, human
gcggaggccgagggtcctcc

SEQ ID NO: 198424 - DNA, 20 bp, human
gattgcgttgagtggagatg

SEQ ID NO: 198425 - DNA, 20 bp, human
gagaggccaggcgagacacc

SEQ ID NO: 198426 - DNA, 20 bp, human
gggaacccggctgcagcggt

SEQ ID NO: 198427 - DNA, 20 bp, human
gctaaggaggctcagtcata

SEQ ID NO: 198428 - DNA, 20 bp, human
gcggagtcgtgctcagacaa

SEQ ID NO: 198429 - DNA, 20 bp, human
ggccgcgcagtgccggaacc

SEQ ID NO: 198430 - DNA, 20 bp, human
gaaagatacacggagacggt

SEQ ID NO: 198431 - DNA, 20 bp, human
gcccggctgcagcggtggga

SEQ ID NO: 198432 - DNA, 20 bp, human
gctgcagcggtgggaaggcg

SEQ ID NO: 198433 - DNA, 20 bp, human
ggtgagcgggtggctgtccc

SEQ ID NO: 198434 - DNA, 20 bp, human
gctcctcctccccaaatgag

SEQ ID NO: 198435 - DNA, 20 bp, human
ggcccgccgcagcgctacgt

SEQ ID NO: 198436 - DNA, 20 bp, human
gcacagcgatgcccgaacgg

SEQ ID NO: 198437 - DNA, 20 bp, human
gaggcacagcgatgcccgaa

SEQ ID NO: 198438 - DNA, 20 bp, human
gggccaggactgctcactcg

SEQ ID NO: 198439 - DNA, 20 bp, human
gcggggattgtggcgtgacc

SEQ ID NO: 198440 - DNA, 20 bp, human
gttgtggcgtgacccggcag

SEQ ID NO: 198441 - DNA, 20 bp, human
gcagactaggccggaccagg

SEQ ID NO: 198442 - DNA, 20 bp, human
ggcgcagactaggccggacc

SEQ ID NO: 198443 - DNA, 20 bp, human
ggcgtgcagaaactgaccga

SEQ ID NO: 198444 - DNA, 20 bp, human
gcgcagcccgttaggccccg

SEQ ID NO: 198445 - DNA, 20 bp, human
gcgttaggccccggggattg

SEQ ID NO: 198446 - DNA, 20 bp, human
gccattgtccgaccccggtg

SEQ ID NO: 198447 - DNA, 20 bp, human
gccaattctgatctgcggag

SEQ ID NO: 198448 - DNA, 20 bp, human
ggtgcggctgaggccccttt

SEQ ID NO: 198449 - DNA, 20 bp, human
gggtcggacaatggccgcag

SEQ ID NO: 198450 - DNA, 20 bp, human
ggacaatggccgcagcggtg

SEQ ID NO: 198451 - DNA, 20 bp, human
gaggggcctcagccgcaccg

SEQ ID NO: 198452 - DNA, 20 bp, human
ggaaatccggagccccccag

SEQ ID NO: 198453 - DNA, 20 bp, human
ggcctcagccgcaccggggt

SEQ ID NO: 198454 - DNA, 20 bp, human
gtctgggcgggacccctcct

SEQ ID NO: 198455 - DNA, 20 bp, human
gtatctccaattctgatctg

SEQ ID NO: 198456 - DNA, 20 bp, human
gcgtggctcggcgacttaca

SEQ ID NO: 198457 - DNA, 20 bp, human
gcttacagggagggagaaca

SEQ ID NO: 198458 - DNA, 20 bp, human
gggctcggcgacttacaggg

SEQ ID NO: 198459 - DNA, 20 bp, human
ggcgcagccagactccgtcc

SEQ ID NO: 198460 - DNA, 20 bp, human
ggcaaggcgcgaaacccacc

SEQ ID NO: 198461 - DNA, 20 bp, human
gcccagcgcaccaaggtacc

SEQ ID NO: 198462 - DNA, 20 bp, human
gctggctgcgcgaccccctg

SEQ ID NO: 198463 - DNA, 20 bp, human
gctcgaccgcggccccgggt

SEQ ID NO: 198464 - DNA, 20 bp, human
gcggcagttgtcgagttgca

SEQ ID NO: 198465 - DNA, 20 bp, human
gcacactcgggggaattcat

SEQ ID NO: 198466 - DNA, 20 bp, human
ggtgagccgcaggcttcggg

SEQ ID NO: 198467 - DNA, 20 bp, human
gtagcggaccttgagtggca

SEQ ID NO: 198468 - DNA, 20 bp, human
gagcggtagcggaccttgag

SEQ ID NO: 198469 - DNA, 20 bp, human
gcccctccgcccggctccga

SEQ ID NO: 198470 - DNA, 20 bp, human
gcgcagctgtgtcccgccgg

SEQ ID NO: 198471 - DNA, 20 bp, human
gcgcgcgccgccagcggtag

SEQ ID NO: 198472 - DNA, 20 bp, human
gtccgccgcctaggactagg

SEQ ID NO: 198473 - DNA, 20 bp, human
gtccggaggagccccaacaa

SEQ ID NO: 198474 - DNA, 20 bp, human
gggccgagtatccccgccgg

SEQ ID NO: 198475 - DNA, 20 bp, human
ggaaggccgagtatccccgc

SEQ ID NO: 198476 - DNA, 20 bp, human
gatgaggaggcagcagacgg

SEQ ID NO: 198477 - DNA, 20 bp, human
gcaggcagcacagccgacag

SEQ ID NO: 198478 - DNA, 20 bp, human
gctcctgaccacgagaccca

SEQ ID NO: 198479 - DNA, 20 bp, human
gctcctctgcgccctggtga

SEQ ID NO: 198480 - DNA, 20 bp, human
gaggggccaccactcacctt

SEQ ID NO: 198481 - DNA, 20 bp, human
gccactcaccttgggtctcg

SEQ ID NO: 198482 - DNA, 20 bp, human
gccagggcgcagaggagcta

SEQ ID NO: 198483 - DNA, 20 bp, human
gacacatcctcaaaagatac

SEQ ID NO: 198484 - DNA, 20 bp, human
gctctacaagcgggtgatgc

SEQ ID NO: 198485 - DNA, 20 bp, human
ggaaaggaaaacgatgctaa

SEQ ID NO: 198486 - DNA, 20 bp, human
ggccgcacccggaagagacg

SEQ ID NO: 198487 - DNA, 20 bp, human
gggcagcggagggataatcg

SEQ ID NO: 198488 - DNA, 20 bp, human
ggatggctcgaggcgcggaa

SEQ ID NO: 198489 - DNA, 20 bp, human
gggagaggcgcaggagccct

SEQ ID NO: 198490 - DNA, 20 bp, human
gagcggagggataatcgggg

SEQ ID NO: 198491 - DNA, 20 bp, human
gcccggaagagacgtggcag

SEQ ID NO: 198492 - DNA, 20 bp, human
gtgggctggtgagagcgtag

SEQ ID NO: 198493 - DNA, 20 bp, human
gccgcataaggagggacagt

SEQ ID NO: 198494 - DNA, 20 bp, human
gggagttaagagtggaaact

SEQ ID NO: 198495 - DNA, 20 bp, human
ggaatatgagaggtgtctgg

SEQ ID NO: 198496 - DNA, 20 bp, human
ggccaggagcgccctcgcag

SEQ ID NO: 198497 - DNA, 20 bp, human
gtctcaatggaacccgcggg

SEQ ID NO: 198498 - DNA, 20 bp, human
ggagcaggcggccactgcga

SEQ ID NO: 198499 - DNA, 20 bp, human
gcggcgccggagacatgtcc

SEQ ID NO: 198500 - DNA, 20 bp, human
ggcctccgcggcagctccag

SEQ ID NO: 198501 - DNA, 20 bp, human
gtgaaggtcgccggcgccca

SEQ ID NO: 198502 - DNA, 20 bp, human
ggccgctcggcttttctcaa

SEQ ID NO: 198503 - DNA, 20 bp, human
ggggcggccgcggagaccgg

SEQ ID NO: 198504 - DNA, 20 bp, human
gaaaagccgagcggccgcgg

SEQ ID NO: 198505 - DNA, 20 bp, human
gttttctcaatggaacccgc

SEQ ID NO: 198506 - DNA, 20 bp, human
gtttcgccgggacatctcgg

SEQ ID NO: 198507 - DNA, 20 bp, human
ggcgtgcgggacggatactc

SEQ ID NO: 198508 - DNA, 20 bp, human
ggtatccgtcccgcacgccg

SEQ ID NO: 198509 - DNA, 20 bp, human
gggccgagcctggccagcgg

SEQ ID NO: 198510 - DNA, 20 bp, human
ggcgaaagcaaagcaaaccc

SEQ ID NO: 198511 - DNA, 20 bp, human
gatgtacaagcgaacggtca

SEQ ID NO: 198512 - DNA, 20 bp, human
gagagcgacggggggagaat

SEQ ID NO: 198513 - DNA, 20 bp, human
ggagcgagcagcgaggagag

SEQ ID NO: 198514 - DNA, 20 bp, human
ggagagtgtgacagtgagga

SEQ ID NO: 198515 - DNA, 20 bp, human
ggcccggagcacctggagtc

SEQ ID NO: 198516 - DNA, 20 bp, human
gataggtgaaagaaactaca

SEQ ID NO: 198517 - DNA, 20 bp, human
ggccacattagactcaccat

SEQ ID NO: 198518 - DNA, 20 bp, human
gtgcggcccaatataggtaa

SEQ ID NO: 198519 - DNA, 20 bp, human
gcaaggggcgaacagagaga

SEQ ID NO: 198520 - DNA, 20 bp, human
ggccgccgccgccccgctgt

SEQ ID NO: 198521 - DNA, 20 bp, human
ggagccgagacgccgaggga

SEQ ID NO: 198522 - DNA, 20 bp, human
gggcggctgcggcccaatat

SEQ ID NO: 198523 - DNA, 20 bp, human
gaagaaactacagggcatat

SEQ ID NO: 198524 - DNA, 20 bp, human
gggcgggacaagagacacag

SEQ ID NO: 198525 - DNA, 20 bp, human
gatatgggaatcatgggctc

SEQ ID NO: 198526 - DNA, 20 bp, human
gctcgtggcgcccccatcag

SEQ ID NO: 198527 - DNA, 20 bp, human
ggatgggggcgccacgagga

SEQ ID NO: 198528 - DNA, 20 bp, human
gcctctcgctgccctcctcg

SEQ ID NO: 198529 - DNA, 20 bp, human
gacggaactgacccaatgca

SEQ ID NO: 198530 - DNA, 20 bp, human
gccgcccggtgcctaacctg

SEQ ID NO: 198531 - DNA, 20 bp, human
ggggtggtctgaccgaggag

SEQ ID NO: 198532 - DNA, 20 bp, human
gctcggggaagacgccaaga

SEQ ID NO: 198533 - DNA, 20 bp, human
gtcccgccgacagacaccgt

SEQ ID NO: 198534 - DNA, 20 bp, human
gacgcggcgggagaaggggt

SEQ ID NO: 198535 - DNA, 20 bp, human
ggggcggcggcccgcagtac

SEQ ID NO: 198536 - DNA, 20 bp, human
ggactcaccggacggacgtg

SEQ ID NO: 198537 - DNA, 20 bp, human
gggcggcacccgggactcac

SEQ ID NO: 198538 - DNA, 20 bp, human
ggcacccgggactcaccgga

SEQ ID NO: 198539 - DNA, 20 bp, human
gggccgcccgcacgtccgtc

SEQ ID NO: 198540 - DNA, 20 bp, human
gtcctccccgggcctaactg

SEQ ID NO: 198541 - DNA, 20 bp, human
ggccaggaggacccaccggg

SEQ ID NO: 198542 - DNA, 20 bp, human
gctgctgcaggggacgatag

SEQ ID NO: 198543 - DNA, 20 bp, human
gtacatagcgaaaatcggcc

SEQ ID NO: 198544 - DNA, 20 bp, human
gtcctcctggcaccccgtgt

SEQ ID NO: 198545 - DNA, 20 bp, human
gtgaggtgaaggccgcaggc

SEQ ID NO: 198546 - DNA, 20 bp, human
ggcacgcgggactcacccga

SEQ ID NO: 198547 - DNA, 20 bp, human
gtgcgggcggtcggcgacag

SEQ ID NO: 198548 - DNA, 20 bp, human
ggaccgcccgcacatccgtc

SEQ ID NO: 198549 - DNA, 20 bp, human
ggactcacccgacggatgtg

SEQ ID NO: 198550 - DNA, 20 bp, human
ggcacctccgcagccgctca

SEQ ID NO: 198551 - DNA, 20 bp, human
gggaggtgcgctccataagc

SEQ ID NO: 198552 - DNA, 20 bp, human
ggcaggcgtgaggtgaaggc

SEQ ID NO: 198553 - DNA, 20 bp, human
gtaatcactaggcctaactg

SEQ ID NO: 198554 - DNA, 20 bp, human
gcgccgagaggcccaccggg

SEQ ID NO: 198555 - DNA, 20 bp, human
ggagtccagtgacctcactg

SEQ ID NO: 198556 - DNA, 20 bp, human
gtcccaactgacaacaggag

SEQ ID NO: 198557 - DNA, 20 bp, human
ggaagcccgggaggcaacga

SEQ ID NO: 198558 - DNA, 20 bp, human
gcaactgacaacaggagagg

SEQ ID NO: 198559 - DNA, 20 bp, human
ggcccgggaggcaacgaagg

SEQ ID NO: 198560 - DNA, 20 bp, human
gggccgcagggcgccagtgg

SEQ ID NO: 198561 - DNA, 20 bp, human
ggctgatcccaactgacaac

SEQ ID NO: 198562 - DNA, 20 bp, human
gtcgaggtgggggcccgagt

SEQ ID NO: 198563 - DNA, 20 bp, human
gctgcggccgagcttctcag

SEQ ID NO: 198564 - DNA, 20 bp, human
gccagctcggactaacagga

SEQ ID NO: 198565 - DNA, 20 bp, human
gaccaccgccacaacccgag

SEQ ID NO: 198566 - DNA, 20 bp, human
gccaggagcgccgaacactc

SEQ ID NO: 198567 - DNA, 20 bp, human
gtcctgggagtgccagatcc

SEQ ID NO: 198568 - DNA, 20 bp, human
gagagaccccagcggacgga

SEQ ID NO: 198569 - DNA, 20 bp, human
gcgagacgaccggtcacggg

SEQ ID NO: 198570 - DNA, 20 bp, human
gagaggctcggtccccgcag

SEQ ID NO: 198571 - DNA, 20 bp, human
ggacggagggagaagcgccc

SEQ ID NO: 198572 - DNA, 20 bp, human
gtacctccctacagcccctg

SEQ ID NO: 198573 - DNA, 20 bp, human
ggaagccctgagccgggatc

SEQ ID NO: 198574 - DNA, 20 bp, human
gtggaccgggagggcaatca

SEQ ID NO: 198575 - DNA, 20 bp, human
gaggggctgcgactgcggag

SEQ ID NO: 198576 - DNA, 20 bp, human
gcccgcggcctctaggagac

SEQ ID NO: 198577 - DNA, 20 bp, human
gtctaggagacaggggccac

SEQ ID NO: 198578 - DNA, 20 bp, human
gctctcctgcagccagcgta

SEQ ID NO: 198579 - DNA, 20 bp, human
gacagtgccagtgggcgtgt

SEQ ID NO: 198580 - DNA, 20 bp, human
gatccgtcaggccggaacca

SEQ ID NO: 198581 - DNA, 20 bp, human
gtagcacctactctccatgg

SEQ ID NO: 198582 - DNA, 20 bp, human
gccctgtctcctagaggccg

SEQ ID NO: 198583 - DNA, 20 bp, human
gcccgccgcgacctagagca

SEQ ID NO: 198584 - DNA, 20 bp, human
gcacgcgcgcttagactctt

SEQ ID NO: 198585 - DNA, 20 bp, human
gggagagcggatgccagcag

SEQ ID NO: 198586 - DNA, 20 bp, human
gcacacacaagcgaaacgca

SEQ ID NO: 198587 - DNA, 20 bp, human
gccggcagggtacatacaga

SEQ ID NO: 198588 - DNA, 20 bp, human
gggcggctgcggctgagtga

SEQ ID NO: 198589 - DNA, 20 bp, human
gccgcagccgccatctccat

SEQ ID NO: 198590 - DNA, 20 bp, human
gtccgagcgaccgatggaga

SEQ ID NO: 198591 - DNA, 20 bp, human
ggctgagtgacggacggtgg

SEQ ID NO: 198592 - DNA, 20 bp, human
ggcggctgagtgacggacgg

SEQ ID NO: 198593 - DNA, 20 bp, human
gtaccctgccgggctcctgc

SEQ ID NO: 198594 - DNA, 20 bp, human
gtgggtgtgacgtgagaggt

SEQ ID NO: 198595 - DNA, 20 bp, human
gtgtcccccccttcaggccc

SEQ ID NO: 198596 - DNA, 20 bp, human
gggcaggaggcacctgtcca

SEQ ID NO: 198597 - DNA, 20 bp, human
gcggcccctcgcccagcccg

SEQ ID NO: 198598 - DNA, 20 bp, human
gtcgcggcgcgcggacacct

SEQ ID NO: 198599 - DNA, 20 bp, human
gggcggcgtcatgtcctccg

SEQ ID NO: 198600 - DNA, 20 bp, human
gggaggcacctgtccagggc

SEQ ID NO: 198601 - DNA, 20 bp, human
ggcgctagcccagcacgaac

SEQ ID NO: 198602 - DNA, 20 bp, human
gccaacctgggagagagcgg

SEQ ID NO: 198603 - DNA, 20 bp, human
gtgcggggccgctggccgag

SEQ ID NO: 198604 - DNA, 20 bp, human
ggcagggccgcacccacccc

SEQ ID NO: 198605 - DNA, 20 bp, human
gcagtgggtcccggacaagg

SEQ ID NO: 198606 - DNA, 20 bp, human
ggacgaatctgtgtcataag

SEQ ID NO: 198607 - DNA, 20 bp, human
gcaatcctctgccttaacag

SEQ ID NO: 198608 - DNA, 20 bp, human
gacctgactcggctcaaaca

SEQ ID NO: 198609 - DNA, 20 bp, human
gaggggcccctccctctcag

SEQ ID NO: 198610 - DNA, 20 bp, human
gctactggtccgcctgggaa

SEQ ID NO: 198611 - DNA, 20 bp, human
ggtgtaagacacccctgaga

SEQ ID NO: 198612 - DNA, 20 bp, human
gtgggttctgtcacctgact

SEQ ID NO: 198613 - DNA, 20 bp, human
gggaatccgcgtgaagagat

SEQ ID NO: 198614 - DNA, 20 bp, human
ggccatgtttgagccgagtc

SEQ ID NO: 198615 - DNA, 20 bp, human
gcagagggctcaaactaggg

SEQ ID NO: 198616 - DNA, 20 bp, human
gaggccgagccaaggcgaaa

SEQ ID NO: 198617 - DNA, 20 bp, human
gtgcgacttccgaacaaccc

SEQ ID NO: 198618 - DNA, 20 bp, human
gcagccgcgacctgatggga

SEQ ID NO: 198619 - DNA, 20 bp, human
gctctaagcagcaaacgagg

SEQ ID NO: 198620 - DNA, 20 bp, human
gaacgccgctcctcctgcca

SEQ ID NO: 198621 - DNA, 20 bp, human
gatccccgcaggccgagcca

SEQ ID NO: 198622 - DNA, 20 bp, human
gcccttcctgggctcatacc

SEQ ID NO: 198623 - DNA, 20 bp, human
gatgctggccccacgacctc

SEQ ID NO: 198624 - DNA, 20 bp, human
gaggagcggcgttcagccgg

SEQ ID NO: 198625 - DNA, 20 bp, human
gcggcgccaggtatgagccc

SEQ ID NO: 198626 - DNA, 20 bp, human
ggcggggcggccgtgaccag

SEQ ID NO: 198627 - DNA, 20 bp, human
gcggacagacgcgggcacgg

SEQ ID NO: 198628 - DNA, 20 bp, human
gcgggcgcacggacagacgc

SEQ ID NO: 198629 - DNA, 20 bp, human
gccggccacggacagggaaa

SEQ ID NO: 198630 - DNA, 20 bp, human
gaagaggccggccacggaca

SEQ ID NO: 198631 - DNA, 20 bp, human
gaaagggagtccgtcttgta

SEQ ID NO: 198632 - DNA, 20 bp, human
gcccagcgctccgctggtca

SEQ ID NO: 198633 - DNA, 20 bp, human
gggcgccctaggcgcatgtg

SEQ ID NO: 198634 - DNA, 20 bp, human
ggacccgggagtgggcgctc

SEQ ID NO: 198635 - DNA, 20 bp, human
gagacctcagacccgggagt

SEQ ID NO: 198636 - DNA, 20 bp, human
gggctgcggcgggacgaccg

SEQ ID NO: 198637 - DNA, 20 bp, human
ggacgctggaggcttcgctg

SEQ ID NO: 198638 - DNA, 20 bp, human
ggcagccacgcggatcccgg

SEQ ID NO: 198639 - DNA, 20 bp, human
gtctccccgcgtcccccggg

SEQ ID NO: 198640 - DNA, 20 bp, human
gcagctcctacaggagtggg

SEQ ID NO: 198641 - DNA, 20 bp, human
gcggagcgagggcttcccaa

SEQ ID NO: 198642 - DNA, 20 bp, human
gcgagccgcagggaacgcta

SEQ ID NO: 198643 - DNA, 20 bp, human
gccgcgccggtgccctccgg

SEQ ID NO: 198644 - DNA, 20 bp, human
gccgcagctcctacaggagt

SEQ ID NO: 198645 - DNA, 20 bp, human
gagcggccacccgacgctgg

SEQ ID NO: 198646 - DNA, 20 bp, human
gtgctccccaggtaacatag

SEQ ID NO: 198647 - DNA, 20 bp, human
ggttgcctctatgttacctg

SEQ ID NO: 198648 - DNA, 20 bp, human
gtcccccccaactcagattc

SEQ ID NO: 198649 - DNA, 20 bp, human
gtgaattggcctggattatg

SEQ ID NO: 198650 - DNA, 20 bp, human
gtggcatccacctggtctca

SEQ ID NO: 198651 - DNA, 20 bp, human
gcatctgaaactgtcaggtg

SEQ ID NO: 198652 - DNA, 20 bp, human
ggttacctggggagcaaagt

SEQ ID NO: 198653 - DNA, 20 bp, human
gggacctggtataaaacatc

SEQ ID NO: 198654 - DNA, 20 bp, human
gaggtctctgctgaaggact

SEQ ID NO: 198655 - DNA, 20 bp, human
gctgggtctgcagtaatctt

SEQ ID NO: 198656 - DNA, 20 bp, human
ggggcccggcaaggtcacac

SEQ ID NO: 198657 - DNA, 20 bp, human
gtcatggtcgtagtcttcag

SEQ ID NO: 198658 - DNA, 20 bp, human
gcaaccagacgcccagtcac

SEQ ID NO: 198659 - DNA, 20 bp, human
ggtgcatcccagggctctgt

SEQ ID NO: 198660 - DNA, 20 bp, human
gggtgcttggctccatgggt

SEQ ID NO: 198661 - DNA, 20 bp, human
gagacgcccagtcacaggcg

SEQ ID NO: 198662 - DNA, 20 bp, human
gagaagcgaggggccgccag

SEQ ID NO: 198663 - DNA, 20 bp, human
gctctggccggtgcatccca

SEQ ID NO: 198664 - DNA, 20 bp, human
gtgggcagggagtaagtcag

SEQ ID NO: 198665 - DNA, 20 bp, human
gcaagggccgggtgagtccc

SEQ ID NO: 198666 - DNA, 20 bp, human
gttagagctggcaactccca

SEQ ID NO: 198667 - DNA, 20 bp, human
ggccacagcaaagccaggaa

SEQ ID NO: 198668 - DNA, 20 bp, human
gtaaaggccccacctagctc

SEQ ID NO: 198669 - DNA, 20 bp, human
gccagggctgatccagagct

SEQ ID NO: 198670 - DNA, 20 bp, human
gggctgatccagagctaggt

SEQ ID NO: 198671 - DNA, 20 bp, human
ggcccccactgcatcctaaa

SEQ ID NO: 198672 - DNA, 20 bp, human
gtctaaggacctgatcccac

SEQ ID NO: 198673 - DNA, 20 bp, human
gctggagagacgctgaagat

SEQ ID NO: 198674 - DNA, 20 bp, human
gtgagctcgggatgcctgtg

SEQ ID NO: 198675 - DNA, 20 bp, human
gggagtcgggcattttgtgg

SEQ ID NO: 198676 - DNA, 20 bp, human
ggcctcagacctggcggcgg

SEQ ID NO: 198677 - DNA, 20 bp, human
gctcctggggagcgcgccgg

SEQ ID NO: 198678 - DNA, 20 bp, human
gctcgggaggaagtgccgat

SEQ ID NO: 198679 - DNA, 20 bp, human
gtgagccggtgtctccccga

SEQ ID NO: 198680 - DNA, 20 bp, human
gcgccaagcacttccggaag

SEQ ID NO: 198681 - DNA, 20 bp, human
gcggctgctggggcgaaaag

SEQ ID NO: 198682 - DNA, 20 bp, human
gcgtgggagcgaagcctcgg

SEQ ID NO: 198683 - DNA, 20 bp, human
gccggcctcaccggctagag

SEQ ID NO: 198684 - DNA, 20 bp, human
gaagcgcggagcctgagcgg

SEQ ID NO: 198685 - DNA, 20 bp, human
gctggggggagcggactaca

SEQ ID NO: 198686 - DNA, 20 bp, human
gagttgctgggtcctcacca

SEQ ID NO: 198687 - DNA, 20 bp, human
gtggcgcaccgcgggaggta

SEQ ID NO: 198688 - DNA, 20 bp, human
gttgaaatgcaagatggcgg

SEQ ID NO: 198689 - DNA, 20 bp, human
gcagcgggcccggagactct

SEQ ID NO: 198690 - DNA, 20 bp, human
gtgggtcctcaccaaggcag

SEQ ID NO: 198691 - DNA, 20 bp, human
gcgccaccgaaagagcttgg

SEQ ID NO: 198692 - DNA, 20 bp, human
gggtttgaaatgcaagatgg

SEQ ID NO: 198693 - DNA, 20 bp, human
gcgcaccgcgggaggtaggg

SEQ ID NO: 198694 - DNA, 20 bp, human
gggctcgcgccactacctgc

SEQ ID NO: 198695 - DNA, 20 bp, human
ggagccggctccgcgaccag

SEQ ID NO: 198696 - DNA, 20 bp, human
ggagagagccggccaaggcg

SEQ ID NO: 198697 - DNA, 20 bp, human
gcagcgggcccggagactct

SEQ ID NO: 198698 - DNA, 20 bp, human
gaggccccgtccctccccct

SEQ ID NO: 198699 - DNA, 20 bp, human
gagggtgggggtgcgaggag

SEQ ID NO: 198700 - DNA, 20 bp, human
gcctcacagcagagacccct

SEQ ID NO: 198701 - DNA, 20 bp, human
gcggcgtggggcgtccgagg

SEQ ID NO: 198702 - DNA, 20 bp, human
ggagccggctccgcgaccag

SEQ ID NO: 198703 - DNA, 20 bp, human
ggtggggcgtccgaggggga

SEQ ID NO: 198704 - DNA, 20 bp, human
gttgaaatgcaagatggcgg

SEQ ID NO: 198705 - DNA, 20 bp, human
ggggagggccccgccttggc

SEQ ID NO: 198706 - DNA, 20 bp, human
gcgggctccgtgggaaagag

SEQ ID NO: 198707 - DNA, 20 bp, human
gaaatgagcggatacagaga

SEQ ID NO: 198708 - DNA, 20 bp, human
gaatgggagccagagcgagg

SEQ ID NO: 198709 - DNA, 20 bp, human
ggacagaaaaagcccccgta

SEQ ID NO: 198710 - DNA, 20 bp, human
gcgcccggctcgggctccgt

SEQ ID NO: 198711 - DNA, 20 bp, human
ggcccccgtacggagaacga

SEQ ID NO: 198712 - DNA, 20 bp, human
ggccatcgttctccgtacgg

SEQ ID NO: 198713 - DNA, 20 bp, human
gttggaaggggggtacggaa

SEQ ID NO: 198714 - DNA, 20 bp, human
ggggcgcccggtggggagtg

SEQ ID NO: 198715 - DNA, 20 bp, human
gataaatgggagccagagcg

SEQ ID NO: 198716 - DNA, 20 bp, human
gggagccgcggactgctgag

SEQ ID NO: 198717 - DNA, 20 bp, human
gcagccgagcggcccggagt

SEQ ID NO: 198718 - DNA, 20 bp, human
gcgagcggcccggagtcggt

SEQ ID NO: 198719 - DNA, 20 bp, human
gtccaggagcgggcgtccag

SEQ ID NO: 198720 - DNA, 20 bp, human
ggcggagcctctcagcatgg

SEQ ID NO: 198721 - DNA, 20 bp, human
gcgcagacacagggtctgac

SEQ ID NO: 198722 - DNA, 20 bp, human
gcgggcgtccaggggtccta

SEQ ID NO: 198723 - DNA, 20 bp, human
gagccgagcgcctccgagag

SEQ ID NO: 198724 - DNA, 20 bp, human
gagctgcaccaaccgactcc

SEQ ID NO: 198725 - DNA, 20 bp, human
ggcggggctccggggggaag

SEQ ID NO: 198726 - DNA, 20 bp, human
ggctcaccgcccggctgagg

SEQ ID NO: 198727 - DNA, 20 bp, human
ggtcaaggctgcccggggaa

SEQ ID NO: 198728 - DNA, 20 bp, human
gctagtggagaagtaaggag

SEQ ID NO: 198729 - DNA, 20 bp, human
gccgagagggccgcgcgtca

SEQ ID NO: 198730 - DNA, 20 bp, human
gcgcgcgtcaaggctgcccg

SEQ ID NO: 198731 - DNA, 20 bp, human
gggaggcgagcgtgagagaa

SEQ ID NO: 198732 - DNA, 20 bp, human
gtttcacctcctcagccggg

SEQ ID NO: 198733 - DNA, 20 bp, human
gtctatgctacaaatccagg

SEQ ID NO: 198734 - DNA, 20 bp, human
gcagtctcgcgctcaccgcc

SEQ ID NO: 198735 - DNA, 20 bp, human
gaggggctagtggagaagta

SEQ ID NO: 198736 - DNA, 20 bp, human
ggcggccgggcgcgtagcga

SEQ ID NO: 198737 - DNA, 20 bp, human
ggcgtagcgaaggcgcggag

SEQ ID NO: 198738 - DNA, 20 bp, human
gcgcccgaggcagatccagg

SEQ ID NO: 198739 - DNA, 20 bp, human
gtcacggtcctgcatctcgg

SEQ ID NO: 198740 - DNA, 20 bp, human
ggaccgtgaactgagcctgg

SEQ ID NO: 198741 - DNA, 20 bp, human
gcgtgaactgagcctggcgg

SEQ ID NO: 198742 - DNA, 20 bp, human
ggagccttcaagctcaaccc

SEQ ID NO: 198743 - DNA, 20 bp, human
gcgggcgcgtagcgaaggcg

SEQ ID NO: 198744 - DNA, 20 bp, human
gtcgggagcgggagtcgagg

SEQ ID NO: 198745 - DNA, 20 bp, human
gggatcgggagcgggagtcg

SEQ ID NO: 198746 - DNA, 20 bp, human
gacccccaaggcgctaccag

SEQ ID NO: 198747 - DNA, 20 bp, human
gctcctgcagagggatagga

SEQ ID NO: 198748 - DNA, 20 bp, human
ggagtctcctgcagagggat

SEQ ID NO: 198749 - DNA, 20 bp, human
gcactgcggggagaccccca

SEQ ID NO: 198750 - DNA, 20 bp, human
gtgccgtagtcggaaagggg

SEQ ID NO: 198751 - DNA, 20 bp, human
gctgcagagggataggaggg

SEQ ID NO: 198752 - DNA, 20 bp, human
gatccggccgaagtgagaga

SEQ ID NO: 198753 - DNA, 20 bp, human
gtggcgtagcccgaaccctg

SEQ ID NO: 198754 - DNA, 20 bp, human
ggaagaggctgggactcgcg

SEQ ID NO: 198755 - DNA, 20 bp, human
gcattactctggaggcgaag

SEQ ID NO: 198756 - DNA, 20 bp, human
gcgcagcccggagggccacc

SEQ ID NO: 198757 - DNA, 20 bp, human
gagccgcctggtggccctcc

SEQ ID NO: 198758 - DNA, 20 bp, human
gacaggccaaatgggatccg

SEQ ID NO: 198759 - DNA, 20 bp, human
gccgaagccgcagcgctcaa

SEQ ID NO: 198760 - DNA, 20 bp, human
gcaggcctggctccgcagcc

SEQ ID NO: 198761 - DNA, 20 bp, human
gtatctggagggatcccgga

SEQ ID NO: 198762 - DNA, 20 bp, human
ggctggcataggccggggag

SEQ ID NO: 198763 - DNA, 20 bp, human
gcagggggtagaaggaaaga

SEQ ID NO: 198764 - DNA, 20 bp, human
gccggcctatgccagccgcc

SEQ ID NO: 198765 - DNA, 20 bp, human
ggtggttgcggtagacacct

SEQ ID NO: 198766 - DNA, 20 bp, human
gccgcaaaggggcaacgcag

SEQ ID NO: 198767 - DNA, 20 bp, human
gccccactgacactaagggg

SEQ ID NO: 198768 - DNA, 20 bp, human
ggtaccctcaaggggaccac

SEQ ID NO: 198769 - DNA, 20 bp, human
ggtaagtgcgtgagtccagg

SEQ ID NO: 198770 - DNA, 20 bp, human
gcagctttcaggaagcagtt

SEQ ID NO: 198771 - DNA, 20 bp, human
ggggtagcaagtaccctcaa

SEQ ID NO: 198772 - DNA, 20 bp, human
gagggggcccttccgcaaag

SEQ ID NO: 198773 - DNA, 20 bp, human
gcccaccccactgacactaa

SEQ ID NO: 198774 - DNA, 20 bp, human
gggcacccaaaccccagtgg

SEQ ID NO: 198775 - DNA, 20 bp, human
gcgctggaaccacaaaagag

SEQ ID NO: 198776 - DNA, 20 bp, human
ggctacaccaccaccaacag

SEQ ID NO: 198777 - DNA, 20 bp, human
ggtggtggtgtagcccgaga

SEQ ID NO: 198778 - DNA, 20 bp, human
gcgtggcggaaaggtccctc

SEQ ID NO: 198779 - DNA, 20 bp, human
gggcggaaaggtccctccgg

SEQ ID NO: 198780 - DNA, 20 bp, human
gggggacgcgcactacgggg

SEQ ID NO: 198781 - DNA, 20 bp, human
gtctggggacgcgcactacg

SEQ ID NO: 198782 - DNA, 20 bp, human
ggctccgtagccgtgcaggg

SEQ ID NO: 198783 - DNA, 20 bp, human
gacgcgggcccggacggcag

SEQ ID NO: 198784 - DNA, 20 bp, human
gccgccgccactgttggtgg

SEQ ID NO: 198785 - DNA, 20 bp, human
gcgccgcagccgccaggttc

SEQ ID NO: 198786 - DNA, 20 bp, human
gggagggtgaggcccagtag

SEQ ID NO: 198787 - DNA, 20 bp, human
gcgcagccatcggagtctgt

SEQ ID NO: 198788 - DNA, 20 bp, human
ggcgctgagggccccgactc

SEQ ID NO: 198789 - DNA, 20 bp, human
ggacagtcggaaggcgcgag

SEQ ID NO: 198790 - DNA, 20 bp, human
gggatgctaggagccgtgga

SEQ ID NO: 198791 - DNA, 20 bp, human
gggcagcgctcacctgagtc

SEQ ID NO: 198792 - DNA, 20 bp, human
ggccgggacccgacagctac

SEQ ID NO: 198793 - DNA, 20 bp, human
gaccgccactgaagtgatac

SEQ ID NO: 198794 - DNA, 20 bp, human
gtccggtatcacttcagtgg

SEQ ID NO: 198795 - DNA, 20 bp, human
ggagggaaaactcctcacct

SEQ ID NO: 198796 - DNA, 20 bp, human
gcacctcggtgcagaagtct

SEQ ID NO: 198797 - DNA, 20 bp, human
gcgcgggagatgtccaccct

SEQ ID NO: 198798 - DNA, 20 bp, human
gggccaccgcagcaaaccgg

SEQ ID NO: 198799 - DNA, 20 bp, human
gggcccccggccagtcagaa

SEQ ID NO: 198800 - DNA, 20 bp, human
ggaggcgtcgagctgcacct

SEQ ID NO: 198801 - DNA, 20 bp, human
gctgcggagaagccctgaca

SEQ ID NO: 198802 - DNA, 20 bp, human
ggcagcagcccctcagaccc

SEQ ID NO: 198803 - DNA, 20 bp, human
gcagaccccggactgcaaga

SEQ ID NO: 198804 - DNA, 20 bp, human
ggctcgacgcctccttgtca

SEQ ID NO: 198805 - DNA, 20 bp, human
gccggccagtcagaaaggcg

SEQ ID NO: 198806 - DNA, 20 bp, human
gttattccagcaaataggag

SEQ ID NO: 198807 - DNA, 20 bp, human
gagaagtcgaggaaagaatt

SEQ ID NO: 198808 - DNA, 20 bp, human
gattccattggaaactgatt

SEQ ID NO: 198809 - DNA, 20 bp, human
gctgcccaatcagtttccaa

SEQ ID NO: 198810 - DNA, 20 bp, human
gattatgatgcggaatacag

SEQ ID NO: 198811 - DNA, 20 bp, human
ggatgtggcctgataggatc

SEQ ID NO: 198812 - DNA, 20 bp, human
gggcctgataggatcaggtg

SEQ ID NO: 198813 - DNA, 20 bp, human
gtgcggaatacagcgggtag

SEQ ID NO: 198814 - DNA, 20 bp, human
gtcttgactggattatgatg

SEQ ID NO: 198815 - DNA, 20 bp, human
gttagcttattccagcaaat

SEQ ID NO: 198816 - DNA, 20 bp, human
ggagggcctaagtccgtgtg

SEQ ID NO: 198817 - DNA, 20 bp, human
gctgtgtcgaggcgtcggga

SEQ ID NO: 198818 - DNA, 20 bp, human
gggccgaagggcaccgcaca

SEQ ID NO: 198819 - DNA, 20 bp, human
gggggctcaggccggccgaa

SEQ ID NO: 198820 - DNA, 20 bp, human
ggagggtgcccggagacccg

SEQ ID NO: 198821 - DNA, 20 bp, human
ggagaaaggggagctgactc

SEQ ID NO: 198822 - DNA, 20 bp, human
ggagggggcgagggtttcag

SEQ ID NO: 198823 - DNA, 20 bp, human
gcaaagcaaatggcgactaa

SEQ ID NO: 198824 - DNA, 20 bp, human
ggggcaccgcacacggactt

SEQ ID NO: 198825 - DNA, 20 bp, human
ggtccgtgtgcggtgccctt

SEQ ID NO: 198826 - DNA, 20 bp, human
gcagggctcgcagggggcag

SEQ ID NO: 198827 - DNA, 20 bp, human
gtgcaaagtcggaaaccggg

SEQ ID NO: 198828 - DNA, 20 bp, human
ggcgaagccagggctcgcag

SEQ ID NO: 198829 - DNA, 20 bp, human
gggcatccctcaacctccag

SEQ ID NO: 198830 - DNA, 20 bp, human
ggcgctctccgcgggccgag

SEQ ID NO: 198831 - DNA, 20 bp, human
gtagtgcaaagtcggaaacc

SEQ ID NO: 198832 - DNA, 20 bp, human
ggagctgcggggcgaagcca

SEQ ID NO: 198833 - DNA, 20 bp, human
ggagaggcgagtccccgagt

SEQ ID NO: 198834 - DNA, 20 bp, human
gaaccgggaggctggacgac

SEQ ID NO: 198835 - DNA, 20 bp, human
gctgggagtgtgataaggta

SEQ ID NO: 198836 - DNA, 20 bp, human
ggaactgcaggaccgacagg

SEQ ID NO: 198837 - DNA, 20 bp, human
gcccgcggctctcctcctgt

SEQ ID NO: 198838 - DNA, 20 bp, human
gtggccaagagccagaacgt

SEQ ID NO: 198839 - DNA, 20 bp, human
gatgagatttaaccccacag

SEQ ID NO: 198840 - DNA, 20 bp, human
gggcgtcggccttccactgt

SEQ ID NO: 198841 - DNA, 20 bp, human
ggaggctgcaggaactgggg

SEQ ID NO: 198842 - DNA, 20 bp, human
gcgttaccgagtgtccgggt

SEQ ID NO: 198843 - DNA, 20 bp, human
gagggaagggcgctctgcgg

SEQ ID NO: 198844 - DNA, 20 bp, human
gcggtaacggccctaaacaa

SEQ ID NO: 198845 - DNA, 20 bp, human
gcccccacggcttctcgcag

SEQ ID NO: 198846 - DNA, 20 bp, human
gtgcgcctcagggggtgtcc

SEQ ID NO: 198847 - DNA, 20 bp, human
gccacagtaagtatcaccaa

SEQ ID NO: 198848 - DNA, 20 bp, human
gtcactctccagacatagga

SEQ ID NO: 198849 - DNA, 20 bp, human
ggaagcctccgccttgacgg

SEQ ID NO: 198850 - DNA, 20 bp, human
gccctgggcatgacaggagg

SEQ ID NO: 198851 - DNA, 20 bp, human
gctcacctccgccgtcaagg

SEQ ID NO: 198852 - DNA, 20 bp, human
gtcttcagaggattctggaa

SEQ ID NO: 198853 - DNA, 20 bp, human
gtatcaccaaaggatgtctt

SEQ ID NO: 198854 - DNA, 20 bp, human
ggaagcctcggaagcgctgg

SEQ ID NO: 198855 - DNA, 20 bp, human
ggctctcacctccgccgtca

SEQ ID NO: 198856 - DNA, 20 bp, human
ggaagatgcggttcttccca

SEQ ID NO: 198857 - DNA, 20 bp, human
gccctcaaggccccactcta

SEQ ID NO: 198858 - DNA, 20 bp, human
ggggcggggcctccagagtt

SEQ ID NO: 198859 - DNA, 20 bp, human
gcggccttctgagccgactg

SEQ ID NO: 198860 - DNA, 20 bp, human
gggtgtgacgttgaagatgt

SEQ ID NO: 198861 - DNA, 20 bp, human
gcttccggcgaggaagtgtt

SEQ ID NO: 198862 - DNA, 20 bp, human
gtcacacccgcgagtcgcag

SEQ ID NO: 198863 - DNA, 20 bp, human
gcgtccgagtcactgagggt

SEQ ID NO: 198864 - DNA, 20 bp, human
ggcgggtgaagaaaacctaa

SEQ ID NO: 198865 - DNA, 20 bp, human
ggtcccgcgcgccacctcct

SEQ ID NO: 198866 - DNA, 20 bp, human
gtaacgggcagtagagtgtc

SEQ ID NO: 198867 - DNA, 20 bp, human
gccgcgtctcggcccactcg

SEQ ID NO: 198868 - DNA, 20 bp, human
gcgtctcggcccactcgcgg

SEQ ID NO: 198869 - DNA, 20 bp, human
ggccgagtgccaccgcgagt

SEQ ID NO: 198870 - DNA, 20 bp, human
gtggcactcggcaccgaagc

SEQ ID NO: 198871 - DNA, 20 bp, human
ggccgagccggaagcgagag

SEQ ID NO: 198872 - DNA, 20 bp, human
ggcagtagagtgtccggctt

SEQ ID NO: 198873 - DNA, 20 bp, human
ggcccactcgcggtggcact

SEQ ID NO: 198874 - DNA, 20 bp, human
ggcgggtacagcgatgaaca

SEQ ID NO: 198875 - DNA, 20 bp, human
ggaagcggctctacatcggg

SEQ ID NO: 198876 - DNA, 20 bp, human
gtactcggaccaggcccctc

SEQ ID NO: 198877 - DNA, 20 bp, human
gaaggaaggtcggggagtaa

SEQ ID NO: 198878 - DNA, 20 bp, human
gatctgcggaggcacaacac

SEQ ID NO: 198879 - DNA, 20 bp, human
gtagaagttagtggccggag

SEQ ID NO: 198880 - DNA, 20 bp, human
gaggcgatgaaagctgtact

SEQ ID NO: 198881 - DNA, 20 bp, human
gctctgggccggaggaaagt

SEQ ID NO: 198882 - DNA, 20 bp, human
gccactaacttctaaatctg

SEQ ID NO: 198883 - DNA, 20 bp, human
gctaacttctaaatctgcgg

SEQ ID NO: 198884 - DNA, 20 bp, human
gacagactcgaaggaaggtc

SEQ ID NO: 198885 - DNA, 20 bp, human
gtgaaagctgtactcggacc

SEQ ID NO: 198886 - DNA, 20 bp, human
gtctcggacgggctgaagag

SEQ ID NO: 198887 - DNA, 20 bp, human
gactgcgccacggcaggtgg

SEQ ID NO: 198888 - DNA, 20 bp, human
ggcccagcccaatctcggac

SEQ ID NO: 198889 - DNA, 20 bp, human
ggcgcgcctcgctgcgatgg

SEQ ID NO: 198890 - DNA, 20 bp, human
ggagacggtagcttcctgag

SEQ ID NO: 198891 - DNA, 20 bp, human
gacactcggggctaatacgg

SEQ ID NO: 198892 - DNA, 20 bp, human
gacctgccgtggcgcagtaa

SEQ ID NO: 198893 - DNA, 20 bp, human
ggaagactccgccgccagcg

SEQ ID NO: 198894 - DNA, 20 bp, human
gtgcacactcggggctaata

SEQ ID NO: 198895 - DNA, 20 bp, human
gcggggctaaaggagcttaa

SEQ ID NO: 198896 - DNA, 20 bp, human
gctgaggaggaggttttgcg

SEQ ID NO: 198897 - DNA, 20 bp, human
ggtaggtgttgtgtctgagg

SEQ ID NO: 198898 - DNA, 20 bp, human
gggactgtacgagaagactg

SEQ ID NO: 198899 - DNA, 20 bp, human
gtggcgtcgggcagcggggt

SEQ ID NO: 198900 - DNA, 20 bp, human
gtgagaaactcgccgagaag

SEQ ID NO: 198901 - DNA, 20 bp, human
gtgggtgctaactacatcaa

SEQ ID NO: 198902 - DNA, 20 bp, human
gaagatggcgtcgggcagcg

SEQ ID NO: 198903 - DNA, 20 bp, human
gagggctaagggtatcacag

SEQ ID NO: 198904 - DNA, 20 bp, human
gatcttcacagcgaagtgaa

SEQ ID NO: 198905 - DNA, 20 bp, human
gcagagggtcagtagaatcg

SEQ ID NO: 198906 - DNA, 20 bp, human
gaactggagagttctaatag

SEQ ID NO: 198907 - DNA, 20 bp, human
gcggcctgtgctgaaacaac

SEQ ID NO: 198908 - DNA, 20 bp, human
gaagatggctggagtaagaa

SEQ ID NO: 198909 - DNA, 20 bp, human
ggtctgtgactgtgtggtga

SEQ ID NO: 198910 - DNA, 20 bp, human
gaaagaaacgtaaggcttgg

SEQ ID NO: 198911 - DNA, 20 bp, human
gatgtgatccagaaagttga

SEQ ID NO: 198912 - DNA, 20 bp, human
gctggaggccgtgaggtaag

SEQ ID NO: 198913 - DNA, 20 bp, human
gcctcatggcctccagaatg

SEQ ID NO: 198914 - DNA, 20 bp, human
gaatgaggcctcttacctca

SEQ ID NO: 198915 - DNA, 20 bp, human
gtcctggacccagctggcca

SEQ ID NO: 198916 - DNA, 20 bp, human
ggagccccctccgcagccga

SEQ ID NO: 198917 - DNA, 20 bp, human
gaagtgactgcggaaccggg

SEQ ID NO: 198918 - DNA, 20 bp, human
ggtttccctgtgggtcgggt

SEQ ID NO: 198919 - DNA, 20 bp, human
gggggcaactgagagggcca

SEQ ID NO: 198920 - DNA, 20 bp, human
gcagctgtttccctgtgggt

SEQ ID NO: 198921 - DNA, 20 bp, human
ggaatcccccgactcccacg

SEQ ID NO: 198922 - DNA, 20 bp, human
gcagtccaacccgacccaca

SEQ ID NO: 198923 - DNA, 20 bp, human
gcggggcgggggcaactgag

SEQ ID NO: 198924 - DNA, 20 bp, human
gcgcacttaccggaaccccc

SEQ ID NO: 198925 - DNA, 20 bp, human
ggacagtcagccttcggctg

SEQ ID NO: 198926 - DNA, 20 bp, human
gagcagtagagcgaagctgt

SEQ ID NO: 198927 - DNA, 20 bp, human
gtccgagctgccgaaaggtc

SEQ ID NO: 198928 - DNA, 20 bp, human
gtgtgggctggagcacgctg

SEQ ID NO: 198929 - DNA, 20 bp, human
ggaaccagcctatccatgat

SEQ ID NO: 198930 - DNA, 20 bp, human
ggttggtccgagctgccgaa

SEQ ID NO: 198931 - DNA, 20 bp, human
gccaggaaacagcacaccct

SEQ ID NO: 198932 - DNA, 20 bp, human
gtaggtctggtctcaggcta

SEQ ID NO: 198933 - DNA, 20 bp, human
gtctctgcgaccagaccttt

SEQ ID NO: 198934 - DNA, 20 bp, human
gctagggtgtctgcagggct

SEQ ID NO: 198935 - DNA, 20 bp, human
gtggtgcacccatcatggat

SEQ ID NO: 198936 - DNA, 20 bp, human
gcccctcgacgtctcgcgga

SEQ ID NO: 198937 - DNA, 20 bp, human
gaaggtacctggctccccgg

SEQ ID NO: 198938 - DNA, 20 bp, human
gcagggcgtacgcacagaga

SEQ ID NO: 198939 - DNA, 20 bp, human
gacgtctcgcggaaggtacc

SEQ ID NO: 198940 - DNA, 20 bp, human
gcccggagctgcagccaccg

SEQ ID NO: 198941 - DNA, 20 bp, human
gaccttccgcgagacgtcga

SEQ ID NO: 198942 - DNA, 20 bp, human
gctcgcccctcgacgtctcg

SEQ ID NO: 198943 - DNA, 20 bp, human
gggatagggtgtggatagag

SEQ ID NO: 198944 - DNA, 20 bp, human
gcgcgacgcgaggacgcagg

SEQ ID NO: 198945 - DNA, 20 bp, human
gaagggctttggagtacctg

SEQ ID NO: 198946 - DNA, 20 bp, human
gccccggccgccaaggagag

SEQ ID NO: 198947 - DNA, 20 bp, human
ggccgccaaggagagcggag

SEQ ID NO: 198948 - DNA, 20 bp, human
gccgccgccaccgccgggta

SEQ ID NO: 198949 - DNA, 20 bp, human
gccgagcctgccctacccgg

SEQ ID NO: 198950 - DNA, 20 bp, human
ggcggcggcgcgtcctccag

SEQ ID NO: 198951 - DNA, 20 bp, human
gacattaaaaaagcgagcgg

SEQ ID NO: 198952 - DNA, 20 bp, human
gcagacagtgaaaaggaact

SEQ ID NO: 198953 - DNA, 20 bp, human
gtggacattaaaaaagcgag

SEQ ID NO: 198954 - DNA, 20 bp, human
ggccggtcgccccgctccgg

SEQ ID NO: 198955 - DNA, 20 bp, human
gaggcgggcgagcagcgatc

SEQ ID NO: 198956 - DNA, 20 bp, human
ggcctccaacaaagactcag

SEQ ID NO: 198957 - DNA, 20 bp, human
gccgctgcggcgccacggta

SEQ ID NO: 198958 - DNA, 20 bp, human
gattgtgccctcggagcggg

SEQ ID NO: 198959 - DNA, 20 bp, human
ggcgagcaggaagagcgcag

SEQ ID NO: 198960 - DNA, 20 bp, human
gtccaacaaagactcagggg

SEQ ID NO: 198961 - DNA, 20 bp, human
gctccattgtgccctcggag

SEQ ID NO: 198962 - DNA, 20 bp, human
gacgcacgcgtggcaggtgc

SEQ ID NO: 198963 - DNA, 20 bp, human
gctcggccccgtgggcgtca

SEQ ID NO: 198964 - DNA, 20 bp, human
gtggcgccgcagcggaaccg

SEQ ID NO: 198965 - DNA, 20 bp, human
ggagcgccgcttacacccct

SEQ ID NO: 198966 - DNA, 20 bp, human
gtgcacgctgaaggagccgg

SEQ ID NO: 198967 - DNA, 20 bp, human
gcgggtggccatggggatgt

SEQ ID NO: 198968 - DNA, 20 bp, human
gcgaagccaaggctactcca

SEQ ID NO: 198969 - DNA, 20 bp, human
ggcggaaccgggtggccatg

SEQ ID NO: 198970 - DNA, 20 bp, human
gtggcaccggtgcacgctga

SEQ ID NO: 198971 - DNA, 20 bp, human
gaccgcggggacgctctgaa

SEQ ID NO: 198972 - DNA, 20 bp, human
ggctctgaagggacgagtgt

SEQ ID NO: 198973 - DNA, 20 bp, human
gcggcaggtgagcctagaca

SEQ ID NO: 198974 - DNA, 20 bp, human
gagtctcagggtcgaagcca

SEQ ID NO: 198975 - DNA, 20 bp, human
gcaatccctttagggcctgg

SEQ ID NO: 198976 - DNA, 20 bp, human
gggagttcccgacccccatc

SEQ ID NO: 198977 - DNA, 20 bp, human
gccgaaaccagagccgcatg

SEQ ID NO: 198978 - DNA, 20 bp, human
gaaaccagagccgcatgagg

SEQ ID NO: 198979 - DNA, 20 bp, human
ggagagatacaggtgtgatg

SEQ ID NO: 198980 - DNA, 20 bp, human
gatgagggcaaggttaaagg

SEQ ID NO: 198981 - DNA, 20 bp, human
gctcaatgaaggagagatac

SEQ ID NO: 198982 - DNA, 20 bp, human
gagattgtttcagaagcgtt

SEQ ID NO: 198983 - DNA, 20 bp, human
gtaacccccccagtctatga

SEQ ID NO: 198984 - DNA, 20 bp, human
gggcttactaatttctctca

SEQ ID NO: 198985 - DNA, 20 bp, human
gtgcggattccgccagatgg

SEQ ID NO: 198986 - DNA, 20 bp, human
gaagccgggactggaccgag

SEQ ID NO: 198987 - DNA, 20 bp, human
gtgtgcgtgtcgccgaaggg

SEQ ID NO: 198988 - DNA, 20 bp, human
gccagcgctaaagccgggac

SEQ ID NO: 198989 - DNA, 20 bp, human
gcccctcgggccgcacgcaa

SEQ ID NO: 198990 - DNA, 20 bp, human
gcgacacgcacaactccgct

SEQ ID NO: 198991 - DNA, 20 bp, human
ggcggaggcgactagggagg

SEQ ID NO: 198992 - DNA, 20 bp, human
gcccggctttagcgctggtg

SEQ ID NO: 198993 - DNA, 20 bp, human
gtcctcaccagcgctaaagc

SEQ ID NO: 198994 - DNA, 20 bp, human
gggcggaggcggaggcgact

SEQ ID NO: 198995 - DNA, 20 bp, human
gggggctgcgctcatgtcac

SEQ ID NO: 198996 - DNA, 20 bp, human
gagctttgaagccggccccc

SEQ ID NO: 198997 - DNA, 20 bp, human
gcaggcccgacccctacctg

SEQ ID NO: 198998 - DNA, 20 bp, human
gctgtcccggctgctaggga

SEQ ID NO: 198999 - DNA, 20 bp, human
gacccctgtcccggctgcta

SEQ ID NO: 199000 - DNA, 20 bp, human
ggacctgaaaggtaactggg

SEQ ID NO: 199001 - DNA, 20 bp, human
gggggccgcgacccctgtcc

SEQ ID NO: 199002 - DNA, 20 bp, human
gtgcgaagggcagtttgtgg

SEQ ID NO: 199003 - DNA, 20 bp, human
gccgcctggtgcagagcgct

SEQ ID NO: 199004 - DNA, 20 bp, human
gcaacaggagaagggaggac

SEQ ID NO: 199005 - DNA, 20 bp, human
ggacagggtgggtaaagact

SEQ ID NO: 199006 - DNA, 20 bp, human
ggtgcgcacgagaagcagag

SEQ ID NO: 199007 - DNA, 20 bp, human
gggagacaaaaagagatagg

SEQ ID NO: 199008 - DNA, 20 bp, human
ggagagatcagccctggtga

SEQ ID NO: 199009 - DNA, 20 bp, human
gtctgagagtcagagttatg

SEQ ID NO: 199010 - DNA, 20 bp, human
ggcttgatccccagccacac

SEQ ID NO: 199011 - DNA, 20 bp, human
ggagagagagagatcagccc

SEQ ID NO: 199012 - DNA, 20 bp, human
gagatcagccctggtgaggg

SEQ ID NO: 199013 - DNA, 20 bp, human
gccacacaggtcgggttaaa

SEQ ID NO: 199014 - DNA, 20 bp, human
gtaatacagggagctcctgc

SEQ ID NO: 199015 - DNA, 20 bp, human
gagactgttgagagagtagg

SEQ ID NO: 199016 - DNA, 20 bp, human
gccatactcaggttcgtgga

SEQ ID NO: 199017 - DNA, 20 bp, human
gcggtggcggcggtacctct

SEQ ID NO: 199018 - DNA, 20 bp, human
gccccgaaagagggtaggtg

SEQ ID NO: 199019 - DNA, 20 bp, human
gccggcccccgaaagagggt

SEQ ID NO: 199020 - DNA, 20 bp, human
ggagtccggcccccgaaaga

SEQ ID NO: 199021 - DNA, 20 bp, human
gccagcgcgctccggaccca

SEQ ID NO: 199022 - DNA, 20 bp, human
gcgagcggggcccaacatgg

SEQ ID NO: 199023 - DNA, 20 bp, human
gcccaacatggcggagagag

SEQ ID NO: 199024 - DNA, 20 bp, human
gtccaaggggccccgtgagt

SEQ ID NO: 199025 - DNA, 20 bp, human
ggggtgcgcctgcgcatcag

SEQ ID NO: 199026 - DNA, 20 bp, human
ggaacaagcccaccccgctt

SEQ ID NO: 199027 - DNA, 20 bp, human
gaagccgggactggacctcg

SEQ ID NO: 199028 - DNA, 20 bp, human
ggagcgaggccgggagggtt

SEQ ID NO: 199029 - DNA, 20 bp, human
gtgccctcgaggccccgaag

SEQ ID NO: 199030 - DNA, 20 bp, human
gcccgccccccgccactatg

SEQ ID NO: 199031 - DNA, 20 bp, human
gcagcgcgaaaagccgggac

SEQ ID NO: 199032 - DNA, 20 bp, human
ggggtgagagcagcctccgg

SEQ ID NO: 199033 - DNA, 20 bp, human
gaaaagcgccggtgacagga

SEQ ID NO: 199034 - DNA, 20 bp, human
gcccgaagcggcaacggcga

SEQ ID NO: 199035 - DNA, 20 bp, human
gtgtgcttgtcgccgaagcg

SEQ ID NO: 199036 - DNA, 20 bp, human
gccaggtgggctacgcggct

SEQ ID NO: 199037 - DNA, 20 bp, human
gggctgcggatatcgcctta

SEQ ID NO: 199038 - DNA, 20 bp, human
ggaatgtcaacgcgtcccta

SEQ ID NO: 199039 - DNA, 20 bp, human
gtgtgaagcggggctctgag

SEQ ID NO: 199040 - DNA, 20 bp, human
ggggacgcgttgacattcac

SEQ ID NO: 199041 - DNA, 20 bp, human
gcggtgccaggtgggctacg

SEQ ID NO: 199042 - DNA, 20 bp, human
gtgtggtctccgactgagag

SEQ ID NO: 199043 - DNA, 20 bp, human
gcagggaggcgacagaaggt

SEQ ID NO: 199044 - DNA, 20 bp, human
gctagtccaccgctctcagt

SEQ ID NO: 199045 - DNA, 20 bp, human
gtgctcctccggtagcaggg

SEQ ID NO: 199046 - DNA, 20 bp, human
ggccgcgctccccccaccgt

SEQ ID NO: 199047 - DNA, 20 bp, human
gaccgaaagcaggagcgcca

SEQ ID NO: 199048 - DNA, 20 bp, human
gtttcggcggggccaaccca

SEQ ID NO: 199049 - DNA, 20 bp, human
gggcggggccaacccacggt

SEQ ID NO: 199050 - DNA, 20 bp, human
gcccacccccccggaccctg

SEQ ID NO: 199051 - DNA, 20 bp, human
ggagggaggaaatgagccgg

SEQ ID NO: 199052 - DNA, 20 bp, human
gaagctctcggaggagatct

SEQ ID NO: 199053 - DNA, 20 bp, human
ggggttggccaagctctcgg

SEQ ID NO: 199054 - DNA, 20 bp, human
gcaggcaaatctagagcctt

SEQ ID NO: 199055 - DNA, 20 bp, human
gcatcctcccccagggtccg

SEQ ID NO: 199056 - DNA, 20 bp, human
gccccgacggtgccaaagtc

SEQ ID NO: 199057 - DNA, 20 bp, human
gagatgggctccgaagggtg

SEQ ID NO: 199058 - DNA, 20 bp, human
gcggtgccaaagtctgggac

SEQ ID NO: 199059 - DNA, 20 bp, human
gggacaggacagttgcggga

SEQ ID NO: 199060 - DNA, 20 bp, human
gacgcgagatgggctccgaa

SEQ ID NO: 199061 - DNA, 20 bp, human
gcccagactttggcaccgtc

SEQ ID NO: 199062 - DNA, 20 bp, human
gggacagttgcgggacggtt

SEQ ID NO: 199063 - DNA, 20 bp, human
ggtcccctcaggatcaggtt

SEQ ID NO: 199064 - DNA, 20 bp, human
gtggaggggctcccaaatgg

SEQ ID NO: 199065 - DNA, 20 bp, human
gccggggtccggcggatcct

SEQ ID NO: 199066 - DNA, 20 bp, human
gtcgccggctcaggcccgag

SEQ ID NO: 199067 - DNA, 20 bp, human
ggaaggaggcggcaccggag

SEQ ID NO: 199068 - DNA, 20 bp, human
gcgcgcactgggggctctag

SEQ ID NO: 199069 - DNA, 20 bp, human
ggggcggcggcggcaccagt

SEQ ID NO: 199070 - DNA, 20 bp, human
gggagccggagcataatggt

SEQ ID NO: 199071 - DNA, 20 bp, human
gtgcctggccgcggcctctg

SEQ ID NO: 199072 - DNA, 20 bp, human
ggccgccgcccgggaaagtt

SEQ ID NO: 199073 - DNA, 20 bp, human
gctcaggcccgagaggcgcc

SEQ ID NO: 199074 - DNA, 20 bp, human
gggccggccgcgcgcaagtc

SEQ ID NO: 199075 - DNA, 20 bp, human
gcaggaggcctgaccgaaag

SEQ ID NO: 199076 - DNA, 20 bp, human
gacccactggcagtccccaa

SEQ ID NO: 199077 - DNA, 20 bp, human
gatgaatgtgatctacccac

SEQ ID NO: 199078 - DNA, 20 bp, human
ggcgcacacccgctcggctg

SEQ ID NO: 199079 - DNA, 20 bp, human
gaggtacccaagccagaccc

SEQ ID NO: 199080 - DNA, 20 bp, human
ggaggccacgggagtcttag

SEQ ID NO: 199081 - DNA, 20 bp, human
ggtgggagatgagacagacg

SEQ ID NO: 199082 - DNA, 20 bp, human
gactggtaggccctgaaacg

SEQ ID NO: 199083 - DNA, 20 bp, human
ggggcgcagactctgctgtg

SEQ ID NO: 199084 - DNA, 20 bp, human
gcccgtacagtggccggtaa

SEQ ID NO: 199085 - DNA, 20 bp, human
gggccggtaagggtcaaaca

SEQ ID NO: 199086 - DNA, 20 bp, human
ggctgcatgagcctcccggg

SEQ ID NO: 199087 - DNA, 20 bp, human
gcgcgctgcatgagcctccc

SEQ ID NO: 199088 - DNA, 20 bp, human
gtggcggcgactctctccac

SEQ ID NO: 199089 - DNA, 20 bp, human
gtggcggctgcaggtaccgg

SEQ ID NO: 199090 - DNA, 20 bp, human
gagagagtcgccgccagccc

SEQ ID NO: 199091 - DNA, 20 bp, human
gacttgaaagtgggtgacca

SEQ ID NO: 199092 - DNA, 20 bp, human
gcctgcggggcagccacccg

SEQ ID NO: 199093 - DNA, 20 bp, human
ggcagcgcggctgggtcccg

SEQ ID NO: 199094 - DNA, 20 bp, human
gggaggggctaggtctaccg

SEQ ID NO: 199095 - DNA, 20 bp, human
gtctctccaccgggccgccc

SEQ ID NO: 199096 - DNA, 20 bp, human
gaggtccggcgggcgcgagg

SEQ ID NO: 199097 - DNA, 20 bp, human
gctccgggcgggacgaggct

SEQ ID NO: 199098 - DNA, 20 bp, human
gcggcgcgtggcaggtccgg

SEQ ID NO: 199099 - DNA, 20 bp, human
gcgcaccacagcgagcggag

SEQ ID NO: 199100 - DNA, 20 bp, human
gcggcggcgcgtggcaggtc

SEQ ID NO: 199101 - DNA, 20 bp, human
gccgcgcgcaccacagcgag

SEQ ID NO: 199102 - DNA, 20 bp, human
gcccgctcggcgcctcccga

SEQ ID NO: 199103 - DNA, 20 bp, human
gggtgcaccccagagccgag

SEQ ID NO: 199104 - DNA, 20 bp, human
gccctccgctccgctcgctg

SEQ ID NO: 199105 - DNA, 20 bp, human
gcccgcgcggaggcctggac

SEQ ID NO: 199106 - DNA, 20 bp, human
ggttaacaatgcatccacag

SEQ ID NO: 199107 - DNA, 20 bp, human
gaaagtcgagcttacctctg

SEQ ID NO: 199108 - DNA, 20 bp, human
gagagaagacaatagtgcag

SEQ ID NO: 199109 - DNA, 20 bp, human
gaagacaatagtgcaggggt

SEQ ID NO: 199110 - DNA, 20 bp, human
gcacaattcggatgtctcag

SEQ ID NO: 199111 - DNA, 20 bp, human
ggctgggggaagaaaatgga

SEQ ID NO: 199112 - DNA, 20 bp, human
gcttcccccagcagggcatg

SEQ ID NO: 199113 - DNA, 20 bp, human
gattcggatgtctcagaggg

SEQ ID NO: 199114 - DNA, 20 bp, human
gcaatacttataaaacatgg

SEQ ID NO: 199115 - DNA, 20 bp, human
gagagtttgaagctagatcc

SEQ ID NO: 199116 - DNA, 20 bp, human
ggaaagcgatcccgtcacaa

SEQ ID NO: 199117 - DNA, 20 bp, human
gacgcgactccattcaccag

SEQ ID NO: 199118 - DNA, 20 bp, human
ggcgcgaagagcggcgtcag

SEQ ID NO: 199119 - DNA, 20 bp, human
gggcgtcagaggtgagtctg

SEQ ID NO: 199120 - DNA, 20 bp, human
gttcgcgctccgctggtgaa

SEQ ID NO: 199121 - DNA, 20 bp, human
gctggagattgacgcagagt

SEQ ID NO: 199122 - DNA, 20 bp, human
ggagattgacgcagagtggg

SEQ ID NO: 199123 - DNA, 20 bp, human
gattgacgcagagtgggcgg

SEQ ID NO: 199124 - DNA, 20 bp, human
ggtctgaggccggctcggca

SEQ ID NO: 199125 - DNA, 20 bp, human
gggtgagtctgaggccggct

SEQ ID NO: 199126 - DNA, 20 bp, human
gttatggccgaaggggacgg

SEQ ID NO: 199127 - DNA, 20 bp, human
gagacggcgaaagggctggt

SEQ ID NO: 199128 - DNA, 20 bp, human
gatcccgagagacggcgaaa

SEQ ID NO: 199129 - DNA, 20 bp, human
gcgagagacggcgaaagggc

SEQ ID NO: 199130 - DNA, 20 bp, human
gatcttatggccgaagggga

SEQ ID NO: 199131 - DNA, 20 bp, human
gatctgcgccttgcccagct

SEQ ID NO: 199132 - DNA, 20 bp, human
gagagcaaaacctggagctc

SEQ ID NO: 199133 - DNA, 20 bp, human
gcctaggggcctagcctgtg

SEQ ID NO: 199134 - DNA, 20 bp, human
ggagaagtgagagcaaaacc

SEQ ID NO: 199135 - DNA, 20 bp, human
gtgtgaagctgactgcggag

SEQ ID NO: 199136 - DNA, 20 bp, human
ggccgtatccggggcaccag

SEQ ID NO: 199137 - DNA, 20 bp, human
gtccccgaggaactaaaacc

SEQ ID NO: 199138 - DNA, 20 bp, human
gcggcgaccgaggggaccaa

SEQ ID NO: 199139 - DNA, 20 bp, human
ggcctcaggagggtcttagg

SEQ ID NO: 199140 - DNA, 20 bp, human
gtcgtgcgggggcctcagga

SEQ ID NO: 199141 - DNA, 20 bp, human
gaaacccggacccgaatggg

SEQ ID NO: 199142 - DNA, 20 bp, human
gggaggagccgtggcctgtg

SEQ ID NO: 199143 - DNA, 20 bp, human
gtccgggttttagttcctcg

SEQ ID NO: 199144 - DNA, 20 bp, human
gacaaaatcagccgtatccg

SEQ ID NO: 199145 - DNA, 20 bp, human
ggacctgaggaggagctggt

SEQ ID NO: 199146 - DNA, 20 bp, human
gtgagtgcagctggcaccat

SEQ ID NO: 199147 - DNA, 20 bp, human
gttgctctggagcacaccca

SEQ ID NO: 199148 - DNA, 20 bp, human
gtgtgcggggtcacagaagt

SEQ ID NO: 199149 - DNA, 20 bp, human
ggtcatgagtgccgagtgtg

SEQ ID NO: 199150 - DNA, 20 bp, human
gtcagaggaaacatggtgaa

SEQ ID NO: 199151 - DNA, 20 bp, human
gctcatgactaatgtcccta

SEQ ID NO: 199152 - DNA, 20 bp, human
gtgaaggacactgcacactt

SEQ ID NO: 199153 - DNA, 20 bp, human
ggacattcaattctccccac

SEQ ID NO: 199154 - DNA, 20 bp, human
gaatcttgtcagaggaaaca

SEQ ID NO: 199155 - DNA, 20 bp, human
ggtgagtgtgccatgccagt

SEQ ID NO: 199156 - DNA, 20 bp, human
gcggcatccctgcacaatcg

SEQ ID NO: 199157 - DNA, 20 bp, human
gtctcccctgatgaccctcc

SEQ ID NO: 199158 - DNA, 20 bp, human
gctcgggcctccaaagtccg

SEQ ID NO: 199159 - DNA, 20 bp, human
gcggggccgcgggggactga

SEQ ID NO: 199160 - DNA, 20 bp, human
gattgtgcagggatgccggg

SEQ ID NO: 199161 - DNA, 20 bp, human
gctgcgggtgcaaagccgcc

SEQ ID NO: 199162 - DNA, 20 bp, human
gagccacagccacttccgat

SEQ ID NO: 199163 - DNA, 20 bp, human
gttggggccgcggactttgg

SEQ ID NO: 199164 - DNA, 20 bp, human
gaacttggggccgcggactt

SEQ ID NO: 199165 - DNA, 20 bp, human
gaaggagaactcggggccgc

SEQ ID NO: 199166 - DNA, 20 bp, human
ggagcgctcacctttctggg

SEQ ID NO: 199167 - DNA, 20 bp, human
gctgggaggaacgaaggccg

SEQ ID NO: 199168 - DNA, 20 bp, human
gggggagcgctcacctttct

SEQ ID NO: 199169 - DNA, 20 bp, human
ggcagagccacttccgcccc

SEQ ID NO: 199170 - DNA, 20 bp, human
gttattatactgctaggaag

SEQ ID NO: 199171 - DNA, 20 bp, human
gtggacccccggcgctaagt

SEQ ID NO: 199172 - DNA, 20 bp, human
gatgtaggatcttggacccc

SEQ ID NO: 199173 - DNA, 20 bp, human
gctcccctagagctactgcc

SEQ ID NO: 199174 - DNA, 20 bp, human
ggctactgcccggttgctac

SEQ ID NO: 199175 - DNA, 20 bp, human
gggggaggataatccacttg

SEQ ID NO: 199176 - DNA, 20 bp, human
gaggcgacagcgaggaccca

SEQ ID NO: 199177 - DNA, 20 bp, human
gcagctggagagcctaggaa

SEQ ID NO: 199178 - DNA, 20 bp, human
gctggagagcctaggaacgg

SEQ ID NO: 199179 - DNA, 20 bp, human
gctaggaacggtggcgcggg

SEQ ID NO: 199180 - DNA, 20 bp, human
ggacggtgtaagggaccagg

SEQ ID NO: 199181 - DNA, 20 bp, human
ggcccttagtacggacactc

SEQ ID NO: 199182 - DNA, 20 bp, human
gaggggagccgagcaggcag

SEQ ID NO: 199183 - DNA, 20 bp, human
gctcggagctgcaccaggat

SEQ ID NO: 199184 - DNA, 20 bp, human
ggcagctccgagacgctcct

SEQ ID NO: 199185 - DNA, 20 bp, human
gcccggtcccgcccttagta

SEQ ID NO: 199186 - DNA, 20 bp, human
gttgttctggagtcctctgt

SEQ ID NO: 199187 - DNA, 20 bp, human
gaagactacaccagaagctc

SEQ ID NO: 199188 - DNA, 20 bp, human
gcagcccggccgccatccta

SEQ ID NO: 199189 - DNA, 20 bp, human
gtaacgaggccacagaagct

SEQ ID NO: 199190 - DNA, 20 bp, human
gtcccctgacgaccgtccag

SEQ ID NO: 199191 - DNA, 20 bp, human
gggaccactggacggtcgtc

SEQ ID NO: 199192 - DNA, 20 bp, human
gggctgacagctcggacccc

SEQ ID NO: 199193 - DNA, 20 bp, human
gtcggggagagctgcggcag

SEQ ID NO: 199194 - DNA, 20 bp, human
gactctggcctccccgcagc

SEQ ID NO: 199195 - DNA, 20 bp, human
gcagtgactgtgccttgttc

SEQ ID NO: 199196 - DNA, 20 bp, human
gcgcgattctcgcccaccgg

SEQ ID NO: 199197 - DNA, 20 bp, human
gctagggcgagcggtgacct

SEQ ID NO: 199198 - DNA, 20 bp, human
gcggcctgtcgggagcggtg

SEQ ID NO: 199199 - DNA, 20 bp, human
gccaggctttggcctccggt

SEQ ID NO: 199200 - DNA, 20 bp, human
ggcctgggaactagggcgag

SEQ ID NO: 199201 - DNA, 20 bp, human
gggccgggcggtgacgacgg

SEQ ID NO: 199202 - DNA, 20 bp, human
ggccggccgggcggtgacga

SEQ ID NO: 199203 - DNA, 20 bp, human
gggccgtcgaggacgcacac

SEQ ID NO: 199204 - DNA, 20 bp, human
gcaaggccgttctgctccag

SEQ ID NO: 199205 - DNA, 20 bp, human
gcgacggcgctggggcccaa

SEQ ID NO: 199206 - DNA, 20 bp, human
gatcgtggtggagtccaccc

SEQ ID NO: 199207 - DNA, 20 bp, human
gggagccaacctgactggaa

SEQ ID NO: 199208 - DNA, 20 bp, human
gatctccgggatccccaagc

SEQ ID NO: 199209 - DNA, 20 bp, human
gtagaggccgcaggctcagt

SEQ ID NO: 199210 - DNA, 20 bp, human
gggatcccggagatagcggg

SEQ ID NO: 199211 - DNA, 20 bp, human
gtcccagtcaggagccaggt

SEQ ID NO: 199212 - DNA, 20 bp, human
ggccgccccccgctatctcc

SEQ ID NO: 199213 - DNA, 20 bp, human
gcccgacctggctcctgact

SEQ ID NO: 199214 - DNA, 20 bp, human
ggcctgcggcctctagccac

SEQ ID NO: 199215 - DNA, 20 bp, human
gcatttcgcctttatcgtgg

SEQ ID NO: 199216 - DNA, 20 bp, human
gggagcagattccacataag

SEQ ID NO: 199217 - DNA, 20 bp, human
gcacataagtggcactgttg

SEQ ID NO: 199218 - DNA, 20 bp, human
ggattgattagtctacaaca

SEQ ID NO: 199219 - DNA, 20 bp, human
ggtattgttaatagctatag

SEQ ID NO: 199220 - DNA, 20 bp, human
gtgttaatagctatagggga

SEQ ID NO: 199221 - DNA, 20 bp, human
gtaataaaccattaatgatg

SEQ ID NO: 199222 - DNA, 20 bp, human
gtttaacaatcggatctttc

SEQ ID NO: 199223 - DNA, 20 bp, human
gcatgtggttttactctagc

SEQ ID NO: 199224 - DNA, 20 bp, human
gatgacaaccccatcattaa

SEQ ID NO: 199225 - DNA, 20 bp, human
gcagattaaaatttggcatc

SEQ ID NO: 199226 - DNA, 20 bp, human
gcgcgcaagtccaacaaggg

SEQ ID NO: 199227 - DNA, 20 bp, human
gggcgacccgagagtcgttg

SEQ ID NO: 199228 - DNA, 20 bp, human
ggcgacccacgagctaggta

SEQ ID NO: 199229 - DNA, 20 bp, human
ggggatttggcgctcacgaa

SEQ ID NO: 199230 - DNA, 20 bp, human
ggaagaaaccgggcagcggt

SEQ ID NO: 199231 - DNA, 20 bp, human
gcagcggggcccgagcagaa

SEQ ID NO: 199232 - DNA, 20 bp, human
gccaggtctcggaaggaagg

SEQ ID NO: 199233 - DNA, 20 bp, human
gggcgcacgtgcgttcggtt

SEQ ID NO: 199234 - DNA, 20 bp, human
ggttcggttgggcacccggg

SEQ ID NO: 199235 - DNA, 20 bp, human
gtggcgctcacgaagggcga

SEQ ID NO: 199236 - DNA, 20 bp, human
gctgagggccggaatcccag

SEQ ID NO: 199237 - DNA, 20 bp, human
gagcaaaatgaggaccgcaa

SEQ ID NO: 199238 - DNA, 20 bp, human
gtgggcccggcgcaggtaag

SEQ ID NO: 199239 - DNA, 20 bp, human
gccacaccagggcacgggag

SEQ ID NO: 199240 - DNA, 20 bp, human
gcagcccacaggttctaatg

SEQ ID NO: 199241 - DNA, 20 bp, human
gaaaatgaggaccgcaatgg

SEQ ID NO: 199242 - DNA, 20 bp, human
gctgggcaccgcagggacga

SEQ ID NO: 199243 - DNA, 20 bp, human
gtcctgaagcccagatagag

SEQ ID NO: 199244 - DNA, 20 bp, human
gaaatgcgcgcaaggcctct

SEQ ID NO: 199245 - DNA, 20 bp, human
gccggaatcccagcgggtga

SEQ ID NO: 199246 - DNA, 20 bp, human
gagcgccaccaaagaacaag

SEQ ID NO: 199247 - DNA, 20 bp, human
gagtcctggcgccccgctgg

SEQ ID NO: 199248 - DNA, 20 bp, human
ggctgcggcaagggtcccgc

SEQ ID NO: 199249 - DNA, 20 bp, human
gtgtgggcgtgcatctccag

SEQ ID NO: 199250 - DNA, 20 bp, human
gggagcgaccccttgttctt

SEQ ID NO: 199251 - DNA, 20 bp, human
gccccaaaaccggggactta

SEQ ID NO: 199252 - DNA, 20 bp, human
gtgaagtcgggtattgggaa

SEQ ID NO: 199253 - DNA, 20 bp, human
gtttcgcgcagaaaagggta

SEQ ID NO: 199254 - DNA, 20 bp, human
ggatcgggctctctctccta

SEQ ID NO: 199255 - DNA, 20 bp, human
gcgctgatgccataagtccc

SEQ ID NO: 199256 - DNA, 20 bp, human
gccatcggagcagaagctcg

SEQ ID NO: 199257 - DNA, 20 bp, human
ggacattgcaggcctgacta

SEQ ID NO: 199258 - DNA, 20 bp, human
gagaggggcagcctgagcat

SEQ ID NO: 199259 - DNA, 20 bp, human
gcatcttgtcggctcttagg

SEQ ID NO: 199260 - DNA, 20 bp, human
gtccaccgcgaggaagatac

SEQ ID NO: 199261 - DNA, 20 bp, human
ggcgcaggccccagtgtcca

SEQ ID NO: 199262 - DNA, 20 bp, human
ggcagaagctcggggttgct

SEQ ID NO: 199263 - DNA, 20 bp, human
gggacatcttgtcggctctt

SEQ ID NO: 199264 - DNA, 20 bp, human
ggtcaggcctgcaatgtcga

SEQ ID NO: 199265 - DNA, 20 bp, human
gctgcggacggaagctctct

SEQ ID NO: 199266 - DNA, 20 bp, human
gtgatggaagagagaaactg

SEQ ID NO: 199267 - DNA, 20 bp, human
gtacagtgacaagggccggg

SEQ ID NO: 199268 - DNA, 20 bp, human
gtgagctaggccggcgagga

SEQ ID NO: 199269 - DNA, 20 bp, human
gctttgtctcgcagtcagga

SEQ ID NO: 199270 - DNA, 20 bp, human
ggcggcccagtgcccggtgt

SEQ ID NO: 199271 - DNA, 20 bp, human
gcgctacagtgacaagggcc

SEQ ID NO: 199272 - DNA, 20 bp, human
ggctcgcgccggcgcagtgt

SEQ ID NO: 199273 - DNA, 20 bp, human
gagggtgagctaggccggcg

SEQ ID NO: 199274 - DNA, 20 bp, human
gcttaacgctacagtgacaa

SEQ ID NO: 199275 - DNA, 20 bp, human
gcagagcctggggagctccg

SEQ ID NO: 199276 - DNA, 20 bp, human
gctgaggccgagggtaccaa

SEQ ID NO: 199277 - DNA, 20 bp, human
gaccgcgccacagagactcc

SEQ ID NO: 199278 - DNA, 20 bp, human
gactccaggcgagccactct

SEQ ID NO: 199279 - DNA, 20 bp, human
gagcgaagcgaaaccaagta

SEQ ID NO: 199280 - DNA, 20 bp, human
gttcgcttcgctagtcccag

SEQ ID NO: 199281 - DNA, 20 bp, human
gaggcccagagtggctcgcc

SEQ ID NO: 199282 - DNA, 20 bp, human
gtccctccggatcccaaggc

SEQ ID NO: 199283 - DNA, 20 bp, human
gttcctccctccggatccca

SEQ ID NO: 199284 - DNA, 20 bp, human
gacctgccttgggatccgga

SEQ ID NO: 199285 - DNA, 20 bp, human
ggaaggagctgtggtgtatg

SEQ ID NO: 199286 - DNA, 20 bp, human
gctgggcctctaggagtaag

SEQ ID NO: 199287 - DNA, 20 bp, human
gagaggacgcagaaaagtga

SEQ ID NO: 199288 - DNA, 20 bp, human
ggcgattgtgcagagacgac

SEQ ID NO: 199289 - DNA, 20 bp, human
gtgcgtcctcttactcctag

SEQ ID NO: 199290 - DNA, 20 bp, human
gattgtgcagagacgacggg

SEQ ID NO: 199291 - DNA, 20 bp, human
gggacatgacgtcttccggg

SEQ ID NO: 199292 - DNA, 20 bp, human
gcagtcggctgcaaaatccg

SEQ ID NO: 199293 - DNA, 20 bp, human
gcctctgtggcgctgtgatc

SEQ ID NO: 199294 - DNA, 20 bp, human
gagtggctgtggcagtactc

SEQ ID NO: 199295 - DNA, 20 bp, human
gcagcccagctgccatgcta

SEQ ID NO: 199296 - DNA, 20 bp, human
gcggtcctggagccctctat

SEQ ID NO: 199297 - DNA, 20 bp, human
ggatgcgctagagccacctt

SEQ ID NO: 199298 - DNA, 20 bp, human
ggctgtcaccgaacaatccg

SEQ ID NO: 199299 - DNA, 20 bp, human
ggtcgccattcctggcccat

SEQ ID NO: 199300 - DNA, 20 bp, human
gctcccacagagaggaccga

SEQ ID NO: 199301 - DNA, 20 bp, human
ggcaggtcacggcgcgacaa

SEQ ID NO: 199302 - DNA, 20 bp, human
gagagccaccttcggccttc

SEQ ID NO: 199303 - DNA, 20 bp, human
gttgttcggtgacagcggga

SEQ ID NO: 199304 - DNA, 20 bp, human
gaccttcggccttcaggagc

SEQ ID NO: 199305 - DNA, 20 bp, human
gagtcacggtgtcctcccta

SEQ ID NO: 199306 - DNA, 20 bp, human
gcatccggcgcagaccggga

SEQ ID NO: 199307 - DNA, 20 bp, human
gcggccaagcgcacaactag

SEQ ID NO: 199308 - DNA, 20 bp, human
gccgagcgtctggcctgtgt

SEQ ID NO: 199309 - DNA, 20 bp, human
gcgttgcctacagccaacac

SEQ ID NO: 199310 - DNA, 20 bp, human
ggttggctgtaggcaacgaa

SEQ ID NO: 199311 - DNA, 20 bp, human
gggcgccctgctctctacgt

SEQ ID NO: 199312 - DNA, 20 bp, human
gccggtgcgccagagcatag

SEQ ID NO: 199313 - DNA, 20 bp, human
gtgcgccggatggccccggg

SEQ ID NO: 199314 - DNA, 20 bp, human
gtagctcacagaagggaagg

SEQ ID NO: 199315 - DNA, 20 bp, human
gagcggagaaacgaagaacg

SEQ ID NO: 199316 - DNA, 20 bp, human
gagatgaagcccctaacccg

SEQ ID NO: 199317 - DNA, 20 bp, human
gagctgtggccgaatcacca

SEQ ID NO: 199318 - DNA, 20 bp, human
gctggctactaccagaccgc

SEQ ID NO: 199319 - DNA, 20 bp, human
gaagcccctaacccgcggtc

SEQ ID NO: 199320 - DNA, 20 bp, human
gctaccagaccgcgggttag

SEQ ID NO: 199321 - DNA, 20 bp, human
gctggggcctcagtaccctc

SEQ ID NO: 199322 - DNA, 20 bp, human
gctgcgttctcagttgtggg

SEQ ID NO: 199323 - DNA, 20 bp, human
gaccctccggtgagggacct

SEQ ID NO: 199324 - DNA, 20 bp, human
gtctctgcgttctcagttgt

SEQ ID NO: 199325 - DNA, 20 bp, human
gcatcggagctggcgggaaa

SEQ ID NO: 199326 - DNA, 20 bp, human
gggagccgcatctctatggt

SEQ ID NO: 199327 - DNA, 20 bp, human
gctcggaaggaggtactgaa

SEQ ID NO: 199328 - DNA, 20 bp, human
gggcgggagccgcatctcta

SEQ ID NO: 199329 - DNA, 20 bp, human
gtctaccccagagctctcga

SEQ ID NO: 199330 - DNA, 20 bp, human
gagcaccatcgagagctctg

SEQ ID NO: 199331 - DNA, 20 bp, human
gctctggggtagagtggcgt

SEQ ID NO: 199332 - DNA, 20 bp, human
gccaggcccaccctgatccc

SEQ ID NO: 199333 - DNA, 20 bp, human
ggacaaaacatagagtaccc

SEQ ID NO: 199334 - DNA, 20 bp, human
gcgcacaaagcgggccccgg

SEQ ID NO: 199335 - DNA, 20 bp, human
ggctgggaactctcggaagg

SEQ ID NO: 199336 - DNA, 20 bp, human
gtgcccagacgccgctaccg

SEQ ID NO: 199337 - DNA, 20 bp, human
gggtcggacgaaggaattgt

SEQ ID NO: 199338 - DNA, 20 bp, human
gacgcggccaaggctcccga

SEQ ID NO: 199339 - DNA, 20 bp, human
gtgtcctggtgcatggtggt

SEQ ID NO: 199340 - DNA, 20 bp, human
ggaggtcaggccgagaaacg

SEQ ID NO: 199341 - DNA, 20 bp, human
gaggcggcggaactctgcct

SEQ ID NO: 199342 - DNA, 20 bp, human
ggctccgccgcctagagtgg

SEQ ID NO: 199343 - DNA, 20 bp, human
gtcaggggaccgccaagggg

SEQ ID NO: 199344 - DNA, 20 bp, human
gggcccggcgtcccaggcgg

SEQ ID NO: 199345 - DNA, 20 bp, human
gccctcaggggaccgccaag

SEQ ID NO: 199346 - DNA, 20 bp, human
gtcgcgccacgtggacccag

SEQ ID NO: 199347 - DNA, 20 bp, human
gcacgtggcgcgaaagtagg

SEQ ID NO: 199348 - DNA, 20 bp, human
gtacggcccctgggtccacg

SEQ ID NO: 199349 - DNA, 20 bp, human
ggtccacgtggcgcgaaagt

SEQ ID NO: 199350 - DNA, 20 bp, human
gtggcgcgaaagtaggaggt

SEQ ID NO: 199351 - DNA, 20 bp, human
gcaggggccgtactgacccg

SEQ ID NO: 199352 - DNA, 20 bp, human
gctttgtccgcgggtcagta

SEQ ID NO: 199353 - DNA, 20 bp, human
ggcaagcgcagcgcaccgag

SEQ ID NO: 199354 - DNA, 20 bp, human
gggatctgggcgtctcgggt

SEQ ID NO: 199355 - DNA, 20 bp, human
ggcgcaccgagtggacattt

SEQ ID NO: 199356 - DNA, 20 bp, human
gcaggccgagcgctttaccg

SEQ ID NO: 199357 - DNA, 20 bp, human
gccgcccgcggtaaagcgct

SEQ ID NO: 199358 - DNA, 20 bp, human
ggaagaggagaaaggcgcag

SEQ ID NO: 199359 - DNA, 20 bp, human
gaggcgggtgtcagaggtag

SEQ ID NO: 199360 - DNA, 20 bp, human
gtgaggagggataatgacgg

SEQ ID NO: 199361 - DNA, 20 bp, human
gtgtgggtgtgaaaaggcta

SEQ ID NO: 199362 - DNA, 20 bp, human
ggaagcagggcgcggagggt

SEQ ID NO: 199363 - DNA, 20 bp, human
gggcagctccaacctttcta

SEQ ID NO: 199364 - DNA, 20 bp, human
gggagggataatgacggggg

SEQ ID NO: 199365 - DNA, 20 bp, human
ggaggccgagggaaacgctg

SEQ ID NO: 199366 - DNA, 20 bp, human
gcgccttcgtggccccaact

SEQ ID NO: 199367 - DNA, 20 bp, human
gtgtgggagagcgtgacagg

SEQ ID NO: 199368 - DNA, 20 bp, human
ggcctgacgtgggtccccca

SEQ ID NO: 199369 - DNA, 20 bp, human
gtgagttggcgtcctcagag

SEQ ID NO: 199370 - DNA, 20 bp, human
gttctctgaggtgtgttcac

SEQ ID NO: 199371 - DNA, 20 bp, human
ggcgtgacaggcggaggaac

SEQ ID NO: 199372 - DNA, 20 bp, human
gggggccacgaaggcgtgag

SEQ ID NO: 199373 - DNA, 20 bp, human
ggatagcagagcgccgagtt

SEQ ID NO: 199374 - DNA, 20 bp, human
gactgcgtgtgacgaggtgt

SEQ ID NO: 199375 - DNA, 20 bp, human
gtgaggcggagttactccta

SEQ ID NO: 199376 - DNA, 20 bp, human
ggacccgcaagacacatact

SEQ ID NO: 199377 - DNA, 20 bp, human
gacactgctacttaacaagg

SEQ ID NO: 199378 - DNA, 20 bp, human
gcgccagaaggctccatcga

SEQ ID NO: 199379 - DNA, 20 bp, human
gctgtactcaggtccaccgg

SEQ ID NO: 199380 - DNA, 20 bp, human
ggaacccccgacgactcctc

SEQ ID NO: 199381 - DNA, 20 bp, human
gtaagtagcagtgtcctgct

SEQ ID NO: 199382 - DNA, 20 bp, human
gaaacggcaatgggaggtac

SEQ ID NO: 199383 - DNA, 20 bp, human
gccaccggaggagtcgtcgg

SEQ ID NO: 199384 - DNA, 20 bp, human
gacacttccggtctccgagc

SEQ ID NO: 199385 - DNA, 20 bp, human
gtttaaaaaacggcaatggg

SEQ ID NO: 199386 - DNA, 20 bp, human
ggctgtccagcacggaaggt

SEQ ID NO: 199387 - DNA, 20 bp, human
gggtcctgcagcctccagta

SEQ ID NO: 199388 - DNA, 20 bp, human
ggagccttaccccttactgg

SEQ ID NO: 199389 - DNA, 20 bp, human
ggacagctgtctgtgtgtag

SEQ ID NO: 199390 - DNA, 20 bp, human
ggacagctgtccagcacgga

SEQ ID NO: 199391 - DNA, 20 bp, human
gcactcccctcttaaccctg

SEQ ID NO: 199392 - DNA, 20 bp, human
gcagcctccagtaaggggta

SEQ ID NO: 199393 - DNA, 20 bp, human
ggttaagaggggagtgatgg

SEQ ID NO: 199394 - DNA, 20 bp, human
gtcagggcagggaatctctg

SEQ ID NO: 199395 - DNA, 20 bp, human
gtggtgccccagggttaaga

SEQ ID NO: 199396 - DNA, 20 bp, human
gcgggtcgcgcttggaaagg

SEQ ID NO: 199397 - DNA, 20 bp, human
gcaacgggtcgcgcttggaa

SEQ ID NO: 199398 - DNA, 20 bp, human
gtccgcccgagctcgaatgg

SEQ ID NO: 199399 - DNA, 20 bp, human
gttcgcggaactaacctcaa

SEQ ID NO: 199400 - DNA, 20 bp, human
gcccggagaccccctaccgg

SEQ ID NO: 199401 - DNA, 20 bp, human
gctccccggagaccccctac

SEQ ID NO: 199402 - DNA, 20 bp, human
ggggaacgccaccagcctgt

SEQ ID NO: 199403 - DNA, 20 bp, human
ggagctcgggcggagcgacg

SEQ ID NO: 199404 - DNA, 20 bp, human
gctgggccccccaaccacgg

SEQ ID NO: 199405 - DNA, 20 bp, human
gcagcctgtgggcggagtcc

SEQ ID NO: 199406 - DNA, 20 bp, human
ggcaggttgagtctacacag

SEQ ID NO: 199407 - DNA, 20 bp, human
gcccaaggcagaaagaccgg

SEQ ID NO: 199408 - DNA, 20 bp, human
ggacccggaagtggatcgtg

SEQ ID NO: 199409 - DNA, 20 bp, human
gcggagcaagcatcacacca

SEQ ID NO: 199410 - DNA, 20 bp, human
ggaggaacactcatacgcca

SEQ ID NO: 199411 - DNA, 20 bp, human
gggcctccccgggactgggt

SEQ ID NO: 199412 - DNA, 20 bp, human
ggcatcgggtgtgcgaatgg

SEQ ID NO: 199413 - DNA, 20 bp, human
gaccaagtggagggacccgg

SEQ ID NO: 199414 - DNA, 20 bp, human
gcgggtgtgcgaatggggga

SEQ ID NO: 199415 - DNA, 20 bp, human
ggtgcgaatgggggacggcg

SEQ ID NO: 199416 - DNA, 20 bp, human
gggaatcagccctgtccgag

SEQ ID NO: 199417 - DNA, 20 bp, human
gttccggtggaaggactgag

SEQ ID NO: 199418 - DNA, 20 bp, human
gcctgtccgagaggtgagtc

SEQ ID NO: 199419 - DNA, 20 bp, human
gatgtttggagggggacacg

SEQ ID NO: 199420 - DNA, 20 bp, human
gcgcgcggcggcggtaacta

SEQ ID NO: 199421 - DNA, 20 bp, human
gtccgatcggacacttccgg

SEQ ID NO: 199422 - DNA, 20 bp, human
gcagaggctgctaatttcaa

SEQ ID NO: 199423 - DNA, 20 bp, human
gaccagaccttggccctcag

SEQ ID NO: 199424 - DNA, 20 bp, human
gcggcggttactcttcccaa

SEQ ID NO: 199425 - DNA, 20 bp, human
gcaagtgtcctacaaaacgg

SEQ ID NO: 199426 - DNA, 20 bp, human
gccaggcagagcccactcag

SEQ ID NO: 199427 - DNA, 20 bp, human
gagctcaccagaactgtgaa

SEQ ID NO: 199428 - DNA, 20 bp, human
gtggtgagctagcccggagg

SEQ ID NO: 199429 - DNA, 20 bp, human
gggggatggcgggatactag

SEQ ID NO: 199430 - DNA, 20 bp, human
gttctggtgagctagcccgg

SEQ ID NO: 199431 - DNA, 20 bp, human
gaggcgacgatgccggaacg

SEQ ID NO: 199432 - DNA, 20 bp, human
ggatgctgtctgggtacccc

SEQ ID NO: 199433 - DNA, 20 bp, human
gacgcaccaggcgacgatgc

SEQ ID NO: 199434 - DNA, 20 bp, human
gcctccgaggcgcgatggtg

SEQ ID NO: 199435 - DNA, 20 bp, human
gtggcggaggtcctctggtg

SEQ ID NO: 199436 - DNA, 20 bp, human
gagaggtgctgcagagcggg

SEQ ID NO: 199437 - DNA, 20 bp, human
gtcaggctgagtcgagactg

SEQ ID NO: 199438 - DNA, 20 bp, human
gcttcctgcaacgcctcctg

SEQ ID NO: 199439 - DNA, 20 bp, human
gcggtgtccgcggtgctgtg

SEQ ID NO: 199440 - DNA, 20 bp, human
gccatattgacaaccccagg

SEQ ID NO: 199441 - DNA, 20 bp, human
ggcacgtgcaggtccctgac

SEQ ID NO: 199442 - DNA, 20 bp, human
ggtgacctggacgctgacag

SEQ ID NO: 199443 - DNA, 20 bp, human
gttgggatctgttcaccttc

SEQ ID NO: 199444 - DNA, 20 bp, human
gaggcgggggagctcctgtc

SEQ ID NO: 199445 - DNA, 20 bp, human
gcggcactcggaggagggat

SEQ ID NO: 199446 - DNA, 20 bp, human
gtccgggaacccaagaccga

SEQ ID NO: 199447 - DNA, 20 bp, human
ggggacttaggacccgacac

SEQ ID NO: 199448 - DNA, 20 bp, human
gacccgacaccggcgagcac

SEQ ID NO: 199449 - DNA, 20 bp, human
gccaggatgcgggagagttg

SEQ ID NO: 199450 - DNA, 20 bp, human
gggactggcgactgcgacac

SEQ ID NO: 199451 - DNA, 20 bp, human
gtgcagccgactcacctctc

SEQ ID NO: 199452 - DNA, 20 bp, human
ggcccggtgtgagctcggac

SEQ ID NO: 199453 - DNA, 20 bp, human
gctctaaccggcgggtggag

SEQ ID NO: 199454 - DNA, 20 bp, human
gagcccgtgctcgccggtgt

SEQ ID NO: 199455 - DNA, 20 bp, human
gaggccacagcgccagccgg

SEQ ID NO: 199456 - DNA, 20 bp, human
gagcgtccagtaagcgacat

SEQ ID NO: 199457 - DNA, 20 bp, human
gtggtgctggaggacgttca

SEQ ID NO: 199458 - DNA, 20 bp, human
gcctccagcaccatccgcaa

SEQ ID NO: 199459 - DNA, 20 bp, human
gactggacgctgaagtgatt

SEQ ID NO: 199460 - DNA, 20 bp, human
gtagcagtgggggttctgta

SEQ ID NO: 199461 - DNA, 20 bp, human
gctgtagggtcaggaagggg

SEQ ID NO: 199462 - DNA, 20 bp, human
gaggctgtgaggtgagtgac

SEQ ID NO: 199463 - DNA, 20 bp, human
gtcactgtccgtgggactag

SEQ ID NO: 199464 - DNA, 20 bp, human
gtggcagccaagagcttcag

SEQ ID NO: 199465 - DNA, 20 bp, human
gctggaggacgttcagggaa

SEQ ID NO: 199466 - DNA, 20 bp, human
gagcctcatagggcccggcg

SEQ ID NO: 199467 - DNA, 20 bp, human
gggacaggctccatttcact

SEQ ID NO: 199468 - DNA, 20 bp, human
gggcatttcgagcatcttgt

SEQ ID NO: 199469 - DNA, 20 bp, human
gcagccacgcgagagtagaa

SEQ ID NO: 199470 - DNA, 20 bp, human
ggaaatgcccgaaagtgcac

SEQ ID NO: 199471 - DNA, 20 bp, human
gccacgcgagagtagaaggg

SEQ ID NO: 199472 - DNA, 20 bp, human
ggcccgaaagtgcacgggac

SEQ ID NO: 199473 - DNA, 20 bp, human
gccaggaggacaccaagcga

SEQ ID NO: 199474 - DNA, 20 bp, human
gtgtgggctctcccaagtcg

SEQ ID NO: 199475 - DNA, 20 bp, human
gcgccgcgccgggccctatg

SEQ ID NO: 199476 - DNA, 20 bp, human
gggcattggttcccgggagg

SEQ ID NO: 199477 - DNA, 20 bp, human
gcgggaggaaccaaagccgg

SEQ ID NO: 199478 - DNA, 20 bp, human
gcagctgcaggcgacagcta

SEQ ID NO: 199479 - DNA, 20 bp, human
gtccgccggcctcactagtg

SEQ ID NO: 199480 - DNA, 20 bp, human
gagtggggcgcacctggacc

SEQ ID NO: 199481 - DNA, 20 bp, human
gcaggtgcgccccactagtg

SEQ ID NO: 199482 - DNA, 20 bp, human
gaggcgacagctatgggaga

SEQ ID NO: 199483 - DNA, 20 bp, human
gtcgggagggaaggggtcaa

SEQ ID NO: 199484 - DNA, 20 bp, human
gcgggaaccaatgcccggaa

SEQ ID NO: 199485 - DNA, 20 bp, human
ggtgcatccacataacagag

SEQ ID NO: 199486 - DNA, 20 bp, human
gggatgtgtgaaccccgtcc

SEQ ID NO: 199487 - DNA, 20 bp, human
gagcccttaggggaagacag

SEQ ID NO: 199488 - DNA, 20 bp, human
gactgcactctgatgagaga

SEQ ID NO: 199489 - DNA, 20 bp, human
gctggaagaggaaacccgat

SEQ ID NO: 199490 - DNA, 20 bp, human
gcccggcctccggccgctcg

SEQ ID NO: 199491 - DNA, 20 bp, human
gcgcgcgctcccagacgcat

SEQ ID NO: 199492 - DNA, 20 bp, human
gctgcactgggaccgaaaac

SEQ ID NO: 199493 - DNA, 20 bp, human
gtggcccctccgtagctccg

SEQ ID NO: 199494 - DNA, 20 bp, human
gagggctgaaaatgagtctc

SEQ ID NO: 199495 - DNA, 20 bp, human
ggctgggcaccccggagcta

SEQ ID NO: 199496 - DNA, 20 bp, human
ggcgtccgcgcgcgggacaa

SEQ ID NO: 199497 - DNA, 20 bp, human
gtgcacgcagaggacagtcg

SEQ ID NO: 199498 - DNA, 20 bp, human
ggctgggggttaagtctgaa

SEQ ID NO: 199499 - DNA, 20 bp, human
gtctgaagggccgagctgct

SEQ ID NO: 199500 - DNA, 20 bp, human
gcagcaacctgggcatcctc

SEQ ID NO: 199501 - DNA, 20 bp, human
gcatcaaccccggtgacccg

SEQ ID NO: 199502 - DNA, 20 bp, human
gggagacctggtatctgtgc

SEQ ID NO: 199503 - DNA, 20 bp, human
gggcaggacgaactcgggtt

SEQ ID NO: 199504 - DNA, 20 bp, human
gccctgtgttccagcaacct

SEQ ID NO: 199505 - DNA, 20 bp, human
gcggacgcccaggttggtag

SEQ ID NO: 199506 - DNA, 20 bp, human
ggtcaggcctgaggctacag

SEQ ID NO: 199507 - DNA, 20 bp, human
gcagtgtcgtccccagaggt

SEQ ID NO: 199508 - DNA, 20 bp, human
gcaacggccgccgacctctg

SEQ ID NO: 199509 - DNA, 20 bp, human
gggagtcgccgtcaggcctg

SEQ ID NO: 199510 - DNA, 20 bp, human
gtgggcagtgtcgtccccag

SEQ ID NO: 199511 - DNA, 20 bp, human
gacactgcccagaatcgtcc

SEQ ID NO: 199512 - DNA, 20 bp, human
ggagcctgggagtcgccgtc

SEQ ID NO: 199513 - DNA, 20 bp, human
gcagaatcgtcccggagcct

SEQ ID NO: 199514 - DNA, 20 bp, human
ggcctgaggctacagcgggg

SEQ ID NO: 199515 - DNA, 20 bp, human
gcggccagtatgagtcccgg

SEQ ID NO: 199516 - DNA, 20 bp, human
gcaaagagtcggtcccgaag

SEQ ID NO: 199517 - DNA, 20 bp, human
gggctgcggtgccaaagagt

SEQ ID NO: 199518 - DNA, 20 bp, human
gaagaggccttcgggtgcgg

SEQ ID NO: 199519 - DNA, 20 bp, human
gacaccaggcccccacctcg

SEQ ID NO: 199520 - DNA, 20 bp, human
gtcagtggacgaggttctag

SEQ ID NO: 199521 - DNA, 20 bp, human
ggggcctggtgtgaatgctc

SEQ ID NO: 199522 - DNA, 20 bp, human
gcttgcccaagccccgaggt

SEQ ID NO: 199523 - DNA, 20 bp, human
gctgttatcgagagagagtg

SEQ ID NO: 199524 - DNA, 20 bp, human
gcgaggttctaggggctcac

SEQ ID NO: 199525 - DNA, 20 bp, human
gccgaagcggaagtgcttgt

SEQ ID NO: 199526 - DNA, 20 bp, human
gtgtaggcgtggaaagaggt

SEQ ID NO: 199527 - DNA, 20 bp, human
ggaccgccccgcacagaagg

SEQ ID NO: 199528 - DNA, 20 bp, human
ggtgttatccgagctcgcag

SEQ ID NO: 199529 - DNA, 20 bp, human
gcccggccagattctagggt

SEQ ID NO: 199530 - DNA, 20 bp, human
gatgccccggccagattcta

SEQ ID NO: 199531 - DNA, 20 bp, human
gtggtgcccaccctagaatc

SEQ ID NO: 199532 - DNA, 20 bp, human
gagctggggagtcctcgaag

SEQ ID NO: 199533 - DNA, 20 bp, human
gagagcactagagaggtgtg

SEQ ID NO: 199534 - DNA, 20 bp, human
ggctggaaggtggacaaaca

SEQ ID NO: 199535 - DNA, 20 bp, human
gctccctgcgttaggtctgg

SEQ ID NO: 199536 - DNA, 20 bp, human
gccgaggccgagctcgtccc

SEQ ID NO: 199537 - DNA, 20 bp, human
gaggccgagctcgtcccggg

SEQ ID NO: 199538 - DNA, 20 bp, human
gcactggacacgggtcgtca

SEQ ID NO: 199539 - DNA, 20 bp, human
gcaaagtgaaatggccgccc

SEQ ID NO: 199540 - DNA, 20 bp, human
ggtcatcctgacatcccgca

SEQ ID NO: 199541 - DNA, 20 bp, human
gcccgagggcccagcgtggt

SEQ ID NO: 199542 - DNA, 20 bp, human
gacgcaggcgtactcactac

SEQ ID NO: 199543 - DNA, 20 bp, human
ggtgatcctcgggcgacctc

SEQ ID NO: 199544 - DNA, 20 bp, human
gtctgaagccgcggccagag

SEQ ID NO: 199545 - DNA, 20 bp, human
gtcagcccgagggcccagcg

SEQ ID NO: 199546 - DNA, 20 bp, human
gcgtaaccaggcaggagtag

SEQ ID NO: 199547 - DNA, 20 bp, human
gggctctagcgaggcctgaa

SEQ ID NO: 199548 - DNA, 20 bp, human
gtctcccaggcagagaatag

SEQ ID NO: 199549 - DNA, 20 bp, human
ggccgggtaggcctcaccag

SEQ ID NO: 199550 - DNA, 20 bp, human
gcaaggcgctggccctaaag

SEQ ID NO: 199551 - DNA, 20 bp, human
gggcgctggccctaaagagg

SEQ ID NO: 199552 - DNA, 20 bp, human
gcctgaaaggctgcgtaacc

SEQ ID NO: 199553 - DNA, 20 bp, human
gtggccctaaagaggcggtc

SEQ ID NO: 199554 - DNA, 20 bp, human
gaaagaggcggtcaggaggt

SEQ ID NO: 199555 - DNA, 20 bp, human
ggcaccccaatgcactagtg

SEQ ID NO: 199556 - DNA, 20 bp, human
ggagcctagcaaggactcct

SEQ ID NO: 199557 - DNA, 20 bp, human
gtgggcggcgtcgagaacag

SEQ ID NO: 199558 - DNA, 20 bp, human
gtctacgtgcactaagtcac

SEQ ID NO: 199559 - DNA, 20 bp, human
gggcactgcacctctagaga

SEQ ID NO: 199560 - DNA, 20 bp, human
ggatgcagcggtgaatgagg

SEQ ID NO: 199561 - DNA, 20 bp, human
gaaaccccaacactcacctc

SEQ ID NO: 199562 - DNA, 20 bp, human
gtttcctgaggtgagtgttg

SEQ ID NO: 199563 - DNA, 20 bp, human
ggcctcagtggagggagaca

SEQ ID NO: 199564 - DNA, 20 bp, human
gttgggcggaaagcttcctg

SEQ ID NO: 199565 - DNA, 20 bp, human
gcggaatctagagcaggaac

SEQ ID NO: 199566 - DNA, 20 bp, human
gcacgacctacggctagcag

SEQ ID NO: 199567 - DNA, 20 bp, human
gctgcgggtcacacgaccta

SEQ ID NO: 199568 - DNA, 20 bp, human
gactccctcgagagaaagga

SEQ ID NO: 199569 - DNA, 20 bp, human
gagcaggggacacagagccg

SEQ ID NO: 199570 - DNA, 20 bp, human
gcggagcccggaacccaccc

SEQ ID NO: 199571 - DNA, 20 bp, human
ggctccacttcctgtccccg

SEQ ID NO: 199572 - DNA, 20 bp, human
gtggagctctgtcgggacaa

SEQ ID NO: 199573 - DNA, 20 bp, human
ggatgatctgtagcccgtgg

SEQ ID NO: 199574 - DNA, 20 bp, human
gagaatcccgactccgtggg

SEQ ID NO: 199575 - DNA, 20 bp, human
ggacggcttccgggatctag

SEQ ID NO: 199576 - DNA, 20 bp, human
gggccgctaggagatgacac

SEQ ID NO: 199577 - DNA, 20 bp, human
gtgtgcctcggctgccggaa

SEQ ID NO: 199578 - DNA, 20 bp, human
gagcccaccccgctcaccgg

SEQ ID NO: 199579 - DNA, 20 bp, human
gcagccgaggcacagaataa

SEQ ID NO: 199580 - DNA, 20 bp, human
ggcccgggagaggctaccga

SEQ ID NO: 199581 - DNA, 20 bp, human
ggccgaggcggcggtacgca

SEQ ID NO: 199582 - DNA, 20 bp, human
gctgggggagcaggctactg

SEQ ID NO: 199583 - DNA, 20 bp, human
gttagcctcagacaagactg

SEQ ID NO: 199584 - DNA, 20 bp, human
gacacaggaacgagcccttc

SEQ ID NO: 199585 - DNA, 20 bp, human
gtcaccgggggctcccgctg

SEQ ID NO: 199586 - DNA, 20 bp, human
gcagggcagggagctaaatg

SEQ ID NO: 199587 - DNA, 20 bp, human
gcacagagtgctcgggaccc

SEQ ID NO: 199588 - DNA, 20 bp, human
gcctccggcacagagtgctc

SEQ ID NO: 199589 - DNA, 20 bp, human
gagctaaatgaggcaatctg

SEQ ID NO: 199590 - DNA, 20 bp, human
gatgggtgcccagaccccac

SEQ ID NO: 199591 - DNA, 20 bp, human
gcactctgtgccggaggtga

SEQ ID NO: 199592 - DNA, 20 bp, human
gaggcgctgtctggcaaaga

SEQ ID NO: 199593 - DNA, 20 bp, human
gttggtttcccgacctgaag

SEQ ID NO: 199594 - DNA, 20 bp, human
ggcactcgtgcggaggccca

SEQ ID NO: 199595 - DNA, 20 bp, human
ggaagaggcgccgtcttccc

SEQ ID NO: 199596 - DNA, 20 bp, human
gggcgtcttgcaccaaaggg

SEQ ID NO: 199597 - DNA, 20 bp, human
gggagcgacagaagctatgg

SEQ ID NO: 199598 - DNA, 20 bp, human
ggatggagcgacagaagcta

SEQ ID NO: 199599 - DNA, 20 bp, human
gcgagatcccgacctccctt

SEQ ID NO: 199600 - DNA, 20 bp, human
gtggggagacgcgggactac

SEQ ID NO: 199601 - DNA, 20 bp, human
gcccaggcgtcttgcaccaa

SEQ ID NO: 199602 - DNA, 20 bp, human
ggcagtcgcagcgcagagac

SEQ ID NO: 199603 - DNA, 20 bp, human
gagacgcgggactacgggcg

SEQ ID NO: 199604 - DNA, 20 bp, human
ggccgggggtcccgagacgg

SEQ ID NO: 199605 - DNA, 20 bp, human
gcggttttccggccccgaga

SEQ ID NO: 199606 - DNA, 20 bp, human
gcctctcggagtaggaaatc

SEQ ID NO: 199607 - DNA, 20 bp, human
ggttgtggcagagggacccg

SEQ ID NO: 199608 - DNA, 20 bp, human
gggccggagtccccagacgg

SEQ ID NO: 199609 - DNA, 20 bp, human
gtgctatgcaggttgttgtc

SEQ ID NO: 199610 - DNA, 20 bp, human
gcaacggtccgtccggaagg

SEQ ID NO: 199611 - DNA, 20 bp, human
gcggtccgtccggaaggagg

SEQ ID NO: 199612 - DNA, 20 bp, human
gttcgggtcccagatccagg

SEQ ID NO: 199613 - DNA, 20 bp, human
gcgcgcaggaacagaacagg

SEQ ID NO: 199614 - DNA, 20 bp, human
gacagaacaggaggacgccc

SEQ ID NO: 199615 - DNA, 20 bp, human
ggcccgcgcaggaacagaac

SEQ ID NO: 199616 - DNA, 20 bp, human
gcctgtgagggcactcggaa

SEQ ID NO: 199617 - DNA, 20 bp, human
gagtcgccggcgacctgtga

SEQ ID NO: 199618 - DNA, 20 bp, human
ggacacgctccgctccccag

SEQ ID NO: 199619 - DNA, 20 bp, human
gcgccgccagttgaggagaa

SEQ ID NO: 199620 - DNA, 20 bp, human
gagcagatgcaaggccgagg

SEQ ID NO: 199621 - DNA, 20 bp, human
gggcgcgaacgaatagtcgc

SEQ ID NO: 199622 - DNA, 20 bp, human
ggggcactcggaagggcgag

SEQ ID NO: 199623 - DNA, 20 bp, human
gggcgacctgtgagggcact

SEQ ID NO: 199624 - DNA, 20 bp, human
gggccttgctccctcagcaa

SEQ ID NO: 199625 - DNA, 20 bp, human
gtggcccggcggtccttagt

SEQ ID NO: 199626 - DNA, 20 bp, human
ggccccgcgcggctcggatc

SEQ ID NO: 199627 - DNA, 20 bp, human
gctagcgggtcggaacacgt

SEQ ID NO: 199628 - DNA, 20 bp, human
ggtgggtgggagagaagccg

SEQ ID NO: 199629 - DNA, 20 bp, human
gcgttaggaggtacgaggta

SEQ ID NO: 199630 - DNA, 20 bp, human
ggtttcggtcgggagtgggt

SEQ ID NO: 199631 - DNA, 20 bp, human
gacggctccgacagctccgg

SEQ ID NO: 199632 - DNA, 20 bp, human
ggcgctgtttcggtcgggag

SEQ ID NO: 199633 - DNA, 20 bp, human
gcggcggcgctgtttcggtc

SEQ ID NO: 199634 - DNA, 20 bp, human
gcgacccgctaggccccgcg

SEQ ID NO: 199635 - DNA, 20 bp, human
ggaccgggccggaccagatc

SEQ ID NO: 199636 - DNA, 20 bp, human
gtgggcatgggagtcaggta

SEQ ID NO: 199637 - DNA, 20 bp, human
ggtggagactcccttcccgg

SEQ ID NO: 199638 - DNA, 20 bp, human
ggggccccctcccccgggaa

SEQ ID NO: 199639 - DNA, 20 bp, human
ggagtctccacagcctgcac

SEQ ID NO: 199640 - DNA, 20 bp, human
gctccacagcctgcacgggg

SEQ ID NO: 199641 - DNA, 20 bp, human
gacacacggtgtatgtcctg

SEQ ID NO: 199642 - DNA, 20 bp, human
gggattaccctggccttgac

SEQ ID NO: 199643 - DNA, 20 bp, human
gcaggaggggatggggtcaa

SEQ ID NO: 199644 - DNA, 20 bp, human
ggactgggagtagggaagac

SEQ ID NO: 199645 - DNA, 20 bp, human
gctccaccccggtgagaagg

SEQ ID NO: 199646 - DNA, 20 bp, human
gccgttgggttgggaaagtg

SEQ ID NO: 199647 - DNA, 20 bp, human
gctggatttggcttacggcg

SEQ ID NO: 199648 - DNA, 20 bp, human
gtgcttcctgtgggacgtgg

SEQ ID NO: 199649 - DNA, 20 bp, human
gggacgtggtggtagccgtt

SEQ ID NO: 199650 - DNA, 20 bp, human
gggctaccaccacgtcccac

SEQ ID NO: 199651 - DNA, 20 bp, human
ggtggctgaatagtccctag

SEQ ID NO: 199652 - DNA, 20 bp, human
gtcgtcaccaaaacaacgga

SEQ ID NO: 199653 - DNA, 20 bp, human
gggcctggacccctccgcca

SEQ ID NO: 199654 - DNA, 20 bp, human
gtggtggtagccgttgggtt

SEQ ID NO: 199655 - DNA, 20 bp, human
gtaccggcaaagtaaaaggg

SEQ ID NO: 199656 - DNA, 20 bp, human
ggaggaatataaccttgctg

SEQ ID NO: 199657 - DNA, 20 bp, human
ggctgaggttgaacaggctg

SEQ ID NO: 199658 - DNA, 20 bp, human
gtactaggcacaagcctaca

SEQ ID NO: 199659 - DNA, 20 bp, human
gaatcctatgtgctacctgg

SEQ ID NO: 199660 - DNA, 20 bp, human
gcaaatattaaagagttaga

SEQ ID NO: 199661 - DNA, 20 bp, human
gattgaaaaagatcattact

SEQ ID NO: 199662 - DNA, 20 bp, human
ggaatgccaccagttatgcc

SEQ ID NO: 199663 - DNA, 20 bp, human
gtatatatcttgtctaataa

SEQ ID NO: 199664 - DNA, 20 bp, human
gtttttgcttctagaaggta

SEQ ID NO: 199665 - DNA, 20 bp, human
gttatattccttaaatttac

SEQ ID NO: 199666 - DNA, 20 bp, human
ggatgtgcagggaccatgag

SEQ ID NO: 199667 - DNA, 20 bp, human
gtcgctgcagccggaggtca

SEQ ID NO: 199668 - DNA, 20 bp, human
gaccatgagagggtcgtgag

SEQ ID NO: 199669 - DNA, 20 bp, human
gaggacgagaccttgacctc

SEQ ID NO: 199670 - DNA, 20 bp, human
ggtcgagctaggcaagaact

SEQ ID NO: 199671 - DNA, 20 bp, human
ggcctagctcgacctcagtc

SEQ ID NO: 199672 - DNA, 20 bp, human
gcacactgagagagtggccc

SEQ ID NO: 199673 - DNA, 20 bp, human
gggcccgggctgcttggaac

SEQ ID NO: 199674 - DNA, 20 bp, human
gcaccggttccaagcagccc

SEQ ID NO: 199675 - DNA, 20 bp, human
gtgtctctcgctgcagccgg

SEQ ID NO: 199676 - DNA, 20 bp, human
gacagaacggacctccggga

SEQ ID NO: 199677 - DNA, 20 bp, human
ggcgcgtgcagggcttggac

SEQ ID NO: 199678 - DNA, 20 bp, human
gaagcggctgacagacagaa

SEQ ID NO: 199679 - DNA, 20 bp, human
gacagacagaacggacctcc

SEQ ID NO: 199680 - DNA, 20 bp, human
gccgatgcagcgtaccaaag

SEQ ID NO: 199681 - DNA, 20 bp, human
gtcgaagtgacggaccgtga

SEQ ID NO: 199682 - DNA, 20 bp, human
gggacgggcaaccgagaagg

SEQ ID NO: 199683 - DNA, 20 bp, human
ggaagccgggtccctcagtg

SEQ ID NO: 199684 - DNA, 20 bp, human
gacttgtggcgtcttcgcag

SEQ ID NO: 199685 - DNA, 20 bp, human
gattttggctgccctcccgg

SEQ ID NO: 199686 - DNA, 20 bp, human
ggcacctggcatcaacacgg

SEQ ID NO: 199687 - DNA, 20 bp, human
gcggcttccaacaggctctg

SEQ ID NO: 199688 - DNA, 20 bp, human
gaatgcacctggcatcaaca

SEQ ID NO: 199689 - DNA, 20 bp, human
gggacaggaacgcagcacgg

SEQ ID NO: 199690 - DNA, 20 bp, human
gcgggaaaccaagaccccgg

SEQ ID NO: 199691 - DNA, 20 bp, human
gctgggagcagcgacctccc

SEQ ID NO: 199692 - DNA, 20 bp, human
gcctggcatcaacacggcgg

SEQ ID NO: 199693 - DNA, 20 bp, human
gggcggcggcggcttccaac

SEQ ID NO: 199694 - DNA, 20 bp, human
gccccgggaaaccaagaccc

SEQ ID NO: 199695 - DNA, 20 bp, human
gtctggggcgccgagcggac

SEQ ID NO: 199696 - DNA, 20 bp, human
gggagcccggtgcttgatgt

SEQ ID NO: 199697 - DNA, 20 bp, human
gtcaagcaccgggctccgag

SEQ ID NO: 199698 - DNA, 20 bp, human
gtggctccaacatcaagcac

SEQ ID NO: 199699 - DNA, 20 bp, human
ggcggcactatgagcttccg

SEQ ID NO: 199700 - DNA, 20 bp, human
gcaggacacggcaggcggga

SEQ ID NO: 199701 - DNA, 20 bp, human
gtggtgcgcgcacctttcag

SEQ ID NO: 199702 - DNA, 20 bp, human
ggcgagcggcgatcgtacag

SEQ ID NO: 199703 - DNA, 20 bp, human
gggatctcctgggccgtagt

SEQ ID NO: 199704 - DNA, 20 bp, human
gtgcctcggggcgctgatcc

SEQ ID NO: 199705 - DNA, 20 bp, human
gctagagcatatccataccg

SEQ ID NO: 199706 - DNA, 20 bp, human
gcagcccggctggaccgaaa

SEQ ID NO: 199707 - DNA, 20 bp, human
ggtctccgccacagacccgg

SEQ ID NO: 199708 - DNA, 20 bp, human
gggagcctgtgagagtggac

SEQ ID NO: 199709 - DNA, 20 bp, human
ggcaggagcaggggaccccc

SEQ ID NO: 199710 - DNA, 20 bp, human
gctgtgagagtggaccggga

SEQ ID NO: 199711 - DNA, 20 bp, human
gactcagtccacacaaacaa

SEQ ID NO: 199712 - DNA, 20 bp, human
gggaccgaaacggaagtccc

SEQ ID NO: 199713 - DNA, 20 bp, human
ggtgatgtacccatctacac

SEQ ID NO: 199714 - DNA, 20 bp, human
ggctgtgcttgaaggaagag

SEQ ID NO: 199715 - DNA, 20 bp, human
gggatctggataagcaacgg

SEQ ID NO: 199716 - DNA, 20 bp, human
gacgggagggatggaaacgt

SEQ ID NO: 199717 - DNA, 20 bp, human
ggcagcgacagagggcgagg

SEQ ID NO: 199718 - DNA, 20 bp, human
ggagggcgcgagctgacggg

SEQ ID NO: 199719 - DNA, 20 bp, human
ggcgttgagagcagcgacag

SEQ ID NO: 199720 - DNA, 20 bp, human
gtctgtgccggaaaacctgg

SEQ ID NO: 199721 - DNA, 20 bp, human
gtgccggaaaacctggagga

SEQ ID NO: 199722 - DNA, 20 bp, human
ggtgcgtcgaggttgttccg

SEQ ID NO: 199723 - DNA, 20 bp, human
gactgaacgggccactggag

SEQ ID NO: 199724 - DNA, 20 bp, human
gcccgcgacccggatcggtg

SEQ ID NO: 199725 - DNA, 20 bp, human
gcggcagtgagttgagggtt

SEQ ID NO: 199726 - DNA, 20 bp, human
ggcgggcggagggggaacgt

SEQ ID NO: 199727 - DNA, 20 bp, human
ggcccgcaccttcccgcggg

SEQ ID NO: 199728 - DNA, 20 bp, human
ggctcctgcgcttccgcccg

SEQ ID NO: 199729 - DNA, 20 bp, human
gccctccgcccgcgccccaa

SEQ ID NO: 199730 - DNA, 20 bp, human
gtggggagggggcgccctag

SEQ ID NO: 199731 - DNA, 20 bp, human
ggatcgcccgcaccttcccg

SEQ ID NO: 199732 - DNA, 20 bp, human
gctttctatccgctcctcta

SEQ ID NO: 199733 - DNA, 20 bp, human
gggagggggaacgtcggcgt

SEQ ID NO: 199734 - DNA, 20 bp, human
gttcccgcgggcggaagcgc

SEQ ID NO: 199735 - DNA, 20 bp, human
gcgcgccccaagggccaact

SEQ ID NO: 199736 - DNA, 20 bp, human
gctccaggatccttgactga

SEQ ID NO: 199737 - DNA, 20 bp, human
ggttccaggacaatctggag

SEQ ID NO: 199738 - DNA, 20 bp, human
gatcccaacgccctcagtca

SEQ ID NO: 199739 - DNA, 20 bp, human
gtggaggttccaggacaatc

SEQ ID NO: 199740 - DNA, 20 bp, human
gtctgcagcacatatcatag

SEQ ID NO: 199741 - DNA, 20 bp, human
gtctggagaggcgaggaaga

SEQ ID NO: 199742 - DNA, 20 bp, human
ggatccttgactgagggcgt

SEQ ID NO: 199743 - DNA, 20 bp, human
gtatataatgcttgcacctc

SEQ ID NO: 199744 - DNA, 20 bp, human
ggggcgttgggatggcttgt

SEQ ID NO: 199745 - DNA, 20 bp, human
gtcgcctctccagattgtcc

SEQ ID NO: 199746 - DNA, 20 bp, human
gggaccccgggagccgcgag

SEQ ID NO: 199747 - DNA, 20 bp, human
gcagggcgcgagggacctgg

SEQ ID NO: 199748 - DNA, 20 bp, human
gccccgggagccgcgagagg

SEQ ID NO: 199749 - DNA, 20 bp, human
ggagagctggggggccccaa

SEQ ID NO: 199750 - DNA, 20 bp, human
gggctctggctccggggaca

SEQ ID NO: 199751 - DNA, 20 bp, human
gtcgcccagagctcctgggg

SEQ ID NO: 199752 - DNA, 20 bp, human
gccgagccgggcgcgctgag

SEQ ID NO: 199753 - DNA, 20 bp, human
gagcgggccccccctccggg

SEQ ID NO: 199754 - DNA, 20 bp, human
gctgggggagcagacaccaa

SEQ ID NO: 199755 - DNA, 20 bp, human
gcgggcgtcagcgttacgtg

SEQ ID NO: 199756 - DNA, 20 bp, human
ggcccagcgagccagagtgg

SEQ ID NO: 199757 - DNA, 20 bp, human
ggcgggaccagccaccactc

SEQ ID NO: 199758 - DNA, 20 bp, human
ggcgaggccctcacttccgg

SEQ ID NO: 199759 - DNA, 20 bp, human
gcgcgcggtgagtgggattg

SEQ ID NO: 199760 - DNA, 20 bp, human
ggcggcgaggccctcacttc

SEQ ID NO: 199761 - DNA, 20 bp, human
gatacgtggaacaaatgctt

SEQ ID NO: 199762 - DNA, 20 bp, human
gcaaatgcttaggcagcaca

SEQ ID NO: 199763 - DNA, 20 bp, human
gggacgacccagaattggaa

SEQ ID NO: 199764 - DNA, 20 bp, human
gtaagcggacgacccagaat

SEQ ID NO: 199765 - DNA, 20 bp, human
gacgctccgagcgacggaag

SEQ ID NO: 199766 - DNA, 20 bp, human
gtgtggagtcgcgggagcta

SEQ ID NO: 199767 - DNA, 20 bp, human
ggtcgcgggagctacggctg

SEQ ID NO: 199768 - DNA, 20 bp, human
gcgttgagggttccgagagt

SEQ ID NO: 199769 - DNA, 20 bp, human
gtgacaggaccgagtccctc

SEQ ID NO: 199770 - DNA, 20 bp, human
gcggcggtttgcgatccccg

SEQ ID NO: 199771 - DNA, 20 bp, human
ggccccgcgccagtagtgga

SEQ ID NO: 199772 - DNA, 20 bp, human
gggctgtcctagcatcccga

SEQ ID NO: 199773 - DNA, 20 bp, human
gaagcaccgtcggaaagcaa

SEQ ID NO: 199774 - DNA, 20 bp, human
gccccagaaacccccaaata

SEQ ID NO: 199775 - DNA, 20 bp, human
gatcggccccgcgccagtag

SEQ ID NO: 199776 - DNA, 20 bp, human
gggttgcgagccccaaggaa

SEQ ID NO: 199777 - DNA, 20 bp, human
gcaaggaaaggagactcgtt

SEQ ID NO: 199778 - DNA, 20 bp, human
gtgggtggttgcgagcccca

SEQ ID NO: 199779 - DNA, 20 bp, human
gcggaaggactcgcaagatg

SEQ ID NO: 199780 - DNA, 20 bp, human
ggaaaggagactcgttcgga

SEQ ID NO: 199781 - DNA, 20 bp, human
ggactaagcgaggtcaaagt

SEQ ID NO: 199782 - DNA, 20 bp, human
ggctgcacacgtagggagga

SEQ ID NO: 199783 - DNA, 20 bp, human
gccccaccagaggacctgac

SEQ ID NO: 199784 - DNA, 20 bp, human
ggaaatgactcaaactactg

SEQ ID NO: 199785 - DNA, 20 bp, human
ggcctgtcaggtcctctggt

SEQ ID NO: 199786 - DNA, 20 bp, human
ggaaatggctcaaactaccc

SEQ ID NO: 199787 - DNA, 20 bp, human
gcttccggtctcctagtctg

SEQ ID NO: 199788 - DNA, 20 bp, human
ggagtggagtccagacactc

SEQ ID NO: 199789 - DNA, 20 bp, human
ggttcctgctttaatgaccg

SEQ ID NO: 199790 - DNA, 20 bp, human
gggttgcgagcctcaagcaa

SEQ ID NO: 199791 - DNA, 20 bp, human
gctaccccggtcattaaagc

SEQ ID NO: 199792 - DNA, 20 bp, human
gggctttgctcgcctcccgg

SEQ ID NO: 199793 - DNA, 20 bp, human
gagtgacagggacaacttta

SEQ ID NO: 199794 - DNA, 20 bp, human
ggtgtacacactgcatacgt

SEQ ID NO: 199795 - DNA, 20 bp, human
gtagaggtgcgagggcgggg

SEQ ID NO: 199796 - DNA, 20 bp, human
ggaactgccccaaactatcg

SEQ ID NO: 199797 - DNA, 20 bp, human
gagcaacctcagtccccgag

SEQ ID NO: 199798 - DNA, 20 bp, human
ggactttagggccatcctaa

SEQ ID NO: 199799 - DNA, 20 bp, human
ggtctgtcctcgcttcccgg

SEQ ID NO: 199800 - DNA, 20 bp, human
gcacttccgctcggggactg

SEQ ID NO: 199801 - DNA, 20 bp, human
gcagaagggcctgcaacgcg

SEQ ID NO: 199802 - DNA, 20 bp, human
ggtggagtccaaacattcgg

SEQ ID NO: 199803 - DNA, 20 bp, human
ggtttttccgcgatagtttg

SEQ ID NO: 199804 - DNA, 20 bp, human
gaacagtaacgggaaaccca

SEQ ID NO: 199805 - DNA, 20 bp, human
gttcccacgaaggaccgggt

SEQ ID NO: 199806 - DNA, 20 bp, human
gcaacctcacagtaacggag

SEQ ID NO: 199807 - DNA, 20 bp, human
ggtggagtccagacactcag

SEQ ID NO: 199808 - DNA, 20 bp, human
gggaactgacccaaactacc

SEQ ID NO: 199809 - DNA, 20 bp, human
gcttccgctccgttactgtg

SEQ ID NO: 199810 - DNA, 20 bp, human
ggaaattcagaagggtctcg

SEQ ID NO: 199811 - DNA, 20 bp, human
gaccagtcaccaagtgacag

SEQ ID NO: 199812 - DNA, 20 bp, human
gaactgtaacgggagaccca

SEQ ID NO: 199813 - DNA, 20 bp, human
gtcgtcagtggagccttctt

SEQ ID NO: 199814 - DNA, 20 bp, human
gccccggagaccctaaaacc

SEQ ID NO: 199815 - DNA, 20 bp, human
gagacactcagtggagtagc

SEQ ID NO: 199816 - DNA, 20 bp, human
ggctgctacgtcgtcttcct

SEQ ID NO: 199817 - DNA, 20 bp, human
ggtagcagccatcttttccc

SEQ ID NO: 199818 - DNA, 20 bp, human
gccttcagaacagcaaacga

SEQ ID NO: 199819 - DNA, 20 bp, human
gcatttcggggaagtttgaa

SEQ ID NO: 199820 - DNA, 20 bp, human
ggctacgtcgtcttcctggg

SEQ ID NO: 199821 - DNA, 20 bp, human
gctcgcaggcacttccgccc

SEQ ID NO: 199822 - DNA, 20 bp, human
ggggctggctcattaggtgg

SEQ ID NO: 199823 - DNA, 20 bp, human
gtgaccacaagtgcatttcg

SEQ ID NO: 199824 - DNA, 20 bp, human
ggaacagcaaacgaaggcac

SEQ ID NO: 199825 - DNA, 20 bp, human
gtccctggctttggtgattc

SEQ ID NO: 199826 - DNA, 20 bp, human
gattgtcacggcacattcca

SEQ ID NO: 199827 - DNA, 20 bp, human
gcgggcccctcctaatgtca

SEQ ID NO: 199828 - DNA, 20 bp, human
ggaactggaagaaactaccg

SEQ ID NO: 199829 - DNA, 20 bp, human
gaagtccctgacattaggag

SEQ ID NO: 199830 - DNA, 20 bp, human
ggaagagggggcgattgtca

SEQ ID NO: 199831 - DNA, 20 bp, human
gaggaggggcccgcgagtcg

SEQ ID NO: 199832 - DNA, 20 bp, human
gttccgctccagggaagagg

SEQ ID NO: 199833 - DNA, 20 bp, human
ggagtgcagggaggcggagt

SEQ ID NO: 199834 - DNA, 20 bp, human
gtgtcagggacttaagattg

SEQ ID NO: 199835 - DNA, 20 bp, human
gggcccgcgagtcgcggaac

SEQ ID NO: 199836 - DNA, 20 bp, human
ggcagggctgactcacctcc

SEQ ID NO: 199837 - DNA, 20 bp, human
gacctcccggacccaaaaga

SEQ ID NO: 199838 - DNA, 20 bp, human
gaggttcaagaggggtcgtg

SEQ ID NO: 199839 - DNA, 20 bp, human
gaaacaggagcgcggatcat

SEQ ID NO: 199840 - DNA, 20 bp, human
gggatacgacagaaaggcca

SEQ ID NO: 199841 - DNA, 20 bp, human
ggtggcacctgatactgggt

SEQ ID NO: 199842 - DNA, 20 bp, human
gcaggctgaaaaggttcaag

SEQ ID NO: 199843 - DNA, 20 bp, human
ggcagcgccgctagttctgt

SEQ ID NO: 199844 - DNA, 20 bp, human
gagcgcctattcccaagcac

SEQ ID NO: 199845 - DNA, 20 bp, human
gaccatcttttgggtccggg

SEQ ID NO: 199846 - DNA, 20 bp, human
gtaagcgctgtgcaagtcgt

SEQ ID NO: 199847 - DNA, 20 bp, human
ggcctgacagtacaaccgca

SEQ ID NO: 199848 - DNA, 20 bp, human
gggttgtactgtcaggccat

SEQ ID NO: 199849 - DNA, 20 bp, human
ggagccgatcctaattccca

SEQ ID NO: 199850 - DNA, 20 bp, human
ggtcaccttgattgcttctt

SEQ ID NO: 199851 - DNA, 20 bp, human
gcgagctcatggaaatccgt

SEQ ID NO: 199852 - DNA, 20 bp, human
gctgtcaggccatgggaatt

SEQ ID NO: 199853 - DNA, 20 bp, human
gaggccatgggaattaggat

SEQ ID NO: 199854 - DNA, 20 bp, human
gcgatccgcaactgacacag

SEQ ID NO: 199855 - DNA, 20 bp, human
ggcacgttgtcccttcacac

SEQ ID NO: 199856 - DNA, 20 bp, human
ggccggggagcagtccgcta

SEQ ID NO: 199857 - DNA, 20 bp, human
gccatactcgggatgcacat

SEQ ID NO: 199858 - DNA, 20 bp, human
gcctgcactcacctccgtag

SEQ ID NO: 199859 - DNA, 20 bp, human
gaccctgcagcacccagggt

SEQ ID NO: 199860 - DNA, 20 bp, human
gggggagcagtccgctacgg

SEQ ID NO: 199861 - DNA, 20 bp, human
gggaggtgagtgcagggctc

SEQ ID NO: 199862 - DNA, 20 bp, human
gggagcacacggtccatact

SEQ ID NO: 199863 - DNA, 20 bp, human
gctcccaggctcctgacata

SEQ ID NO: 199864 - DNA, 20 bp, human
ggggcacggcacacagcgcc

SEQ ID NO: 199865 - DNA, 20 bp, human
gtgagacgcactcccaccct

SEQ ID NO: 199866 - DNA, 20 bp, human
ggccggccccaactaagagt

SEQ ID NO: 199867 - DNA, 20 bp, human
gaccgctagcgagaacggtt

SEQ ID NO: 199868 - DNA, 20 bp, human
gcccaagctccgcccaactg

SEQ ID NO: 199869 - DNA, 20 bp, human
gactgcctgggcaccaggag

SEQ ID NO: 199870 - DNA, 20 bp, human
gactgtgggtccttgcactt

SEQ ID NO: 199871 - DNA, 20 bp, human
gagcgcaccgctagcgagaa

SEQ ID NO: 199872 - DNA, 20 bp, human
gttgagcgcggactcaaaac

SEQ ID NO: 199873 - DNA, 20 bp, human
ggctagcgagaacggttagg

SEQ ID NO: 199874 - DNA, 20 bp, human
ggcaaggacccacagttggg

SEQ ID NO: 199875 - DNA, 20 bp, human
ggttgggcggagcttgggtt

SEQ ID NO: 199876 - DNA, 20 bp, human
ggacccgccagacgcagaaa

SEQ ID NO: 199877 - DNA, 20 bp, human
gtcgttgcgaccccaagcga

SEQ ID NO: 199878 - DNA, 20 bp, human
gtgctgtgctcgcatcccgg

SEQ ID NO: 199879 - DNA, 20 bp, human
ggaaagcggtcgcacaggta

SEQ ID NO: 199880 - DNA, 20 bp, human
gcgaaggtgacaagttcaga

SEQ ID NO: 199881 - DNA, 20 bp, human
gagaaatggctcaaactacg

SEQ ID NO: 199882 - DNA, 20 bp, human
gagcggtcgcacaggtaggg

SEQ ID NO: 199883 - DNA, 20 bp, human
gaagaggtcaggtccccggg

SEQ ID NO: 199884 - DNA, 20 bp, human
ggcggttatgtagcaaccgc

SEQ ID NO: 199885 - DNA, 20 bp, human
ggaacttgtcaccttcgctt

SEQ ID NO: 199886 - DNA, 20 bp, human
gctcacctcacaggaccagg

SEQ ID NO: 199887 - DNA, 20 bp, human
gggaccaggaggttccatcg

SEQ ID NO: 199888 - DNA, 20 bp, human
ggaccgctggcctaagacaa

SEQ ID NO: 199889 - DNA, 20 bp, human
gcggcgccgggcatcaccct

SEQ ID NO: 199890 - DNA, 20 bp, human
gggaggcgcgaggaaaaacg

SEQ ID NO: 199891 - DNA, 20 bp, human
gcgctggcctaagacaaagg

SEQ ID NO: 199892 - DNA, 20 bp, human
ggcgccccgatggaacctcc

SEQ ID NO: 199893 - DNA, 20 bp, human
gctgtaagtggcgcgattcg

SEQ ID NO: 199894 - DNA, 20 bp, human
gcttacagccctcaccccag

SEQ ID NO: 199895 - DNA, 20 bp, human
gacactcacctcacaggacc

SEQ ID NO: 199896 - DNA, 20 bp, human
gccttaggctccgaagagat

SEQ ID NO: 199897 - DNA, 20 bp, human
gggacctgggctggatcctt

SEQ ID NO: 199898 - DNA, 20 bp, human
gccgcgacgacgacaaggat

SEQ ID NO: 199899 - DNA, 20 bp, human
gagggcggagctgtgtccag

SEQ ID NO: 199900 - DNA, 20 bp, human
ggagcctaaggatccagccc

SEQ ID NO: 199901 - DNA, 20 bp, human
gtcgccctaccggacctgag

SEQ ID NO: 199902 - DNA, 20 bp, human
gccacctctcaggtccggta

SEQ ID NO: 199903 - DNA, 20 bp, human
gcgtcttctggcagcttggt

SEQ ID NO: 199904 - DNA, 20 bp, human
gaggatggggcccatctctt

SEQ ID NO: 199905 - DNA, 20 bp, human
gccgcgcctaagctcccacc

SEQ ID NO: 199906 - DNA, 20 bp, human
ggcgctgactcacctcccag

SEQ ID NO: 199907 - DNA, 20 bp, human
gaagctcgccgtagatgcag

SEQ ID NO: 199908 - DNA, 20 bp, human
gcgcggaacctctgcatcta

SEQ ID NO: 199909 - DNA, 20 bp, human
gtcccagaggggatagatga

SEQ ID NO: 199910 - DNA, 20 bp, human
ggccgtcatctatcccctct

SEQ ID NO: 199911 - DNA, 20 bp, human
gccaggaagaaataacagat

SEQ ID NO: 199912 - DNA, 20 bp, human
gagtagtacctaactggtag

SEQ ID NO: 199913 - DNA, 20 bp, human
ggcagagcgtgtggaaggtg

SEQ ID NO: 199914 - DNA, 20 bp, human
gcctgcagcggaagtacaca

SEQ ID NO: 199915 - DNA, 20 bp, human
gcgagtccaacgcccaggcc

SEQ ID NO: 199916 - DNA, 20 bp, human
ggctgctacgtcgtcttcct

SEQ ID NO: 199917 - DNA, 20 bp, human
ggtagcagccatcttttccc

SEQ ID NO: 199918 - DNA, 20 bp, human
gccttcagaacagcaaacga

SEQ ID NO: 199919 - DNA, 20 bp, human
gcatttcggggaagtttgaa

SEQ ID NO: 199920 - DNA, 20 bp, human
ggctacgtcgtcttcctggg

SEQ ID NO: 199921 - DNA, 20 bp, human
gctcgcaggcacttccgccc

SEQ ID NO: 199922 - DNA, 20 bp, human
ggggctggctcattaggtgg

SEQ ID NO: 199923 - DNA, 20 bp, human
gtgaccacaagtgcatttcg

SEQ ID NO: 199924 - DNA, 20 bp, human
ggaacagcaaacgaaggcac

SEQ ID NO: 199925 - DNA, 20 bp, human
gtccctggctttggtgattc

SEQ ID NO: 199926 - DNA, 20 bp, human
gattgtcacggcacattcca

SEQ ID NO: 199927 - DNA, 20 bp, human
gcgggcccctcctaatgtca

SEQ ID NO: 199928 - DNA, 20 bp, human
ggaactggaagaaactaccg

SEQ ID NO: 199929 - DNA, 20 bp, human
gaagtccctgacattaggag

SEQ ID NO: 199930 - DNA, 20 bp, human
ggaagagggggcgattgtca

SEQ ID NO: 199931 - DNA, 20 bp, human
gaggaggggcccgcgagtcg

SEQ ID NO: 199932 - DNA, 20 bp, human
gttccgctccagggaagagg

SEQ ID NO: 199933 - DNA, 20 bp, human
ggagtgcagggaggcggagt

SEQ ID NO: 199934 - DNA, 20 bp, human
gtgtcagggacttaagattg

SEQ ID NO: 199935 - DNA, 20 bp, human
gggcccgcgagtcgcggaac

SEQ ID NO: 199936 - DNA, 20 bp, human
gggatctgagatatctccca

SEQ ID NO: 199937 - DNA, 20 bp, human
gcgctccaggaaggcgaggt

SEQ ID NO: 199938 - DNA, 20 bp, human
gaggcacttccgctccagga

SEQ ID NO: 199939 - DNA, 20 bp, human
gtctgagatatctcccaggg

SEQ ID NO: 199940 - DNA, 20 bp, human
gacgaaccgtgggcactcgg

SEQ ID NO: 199941 - DNA, 20 bp, human
gaggtgcgtgaggacggcta

SEQ ID NO: 199942 - DNA, 20 bp, human
gagagggctcggagaagtct

SEQ ID NO: 199943 - DNA, 20 bp, human
gagtggagtccacgaaccgt

SEQ ID NO: 199944 - DNA, 20 bp, human
gggagctgactcacctccct

SEQ ID NO: 199945 - DNA, 20 bp, human
gcggagaagtcttggagacc

SEQ ID NO: 199946 - DNA, 20 bp, human
gcggccccgggacggaacac

SEQ ID NO: 199947 - DNA, 20 bp, human
gggccccgcggcatcgtcgg

SEQ ID NO: 199948 - DNA, 20 bp, human
gggcggccccgcggcatcgt

SEQ ID NO: 199949 - DNA, 20 bp, human
gcggcccgcgctgaacttga

SEQ ID NO: 199950 - DNA, 20 bp, human
gcagcgcgggcggaatgata

SEQ ID NO: 199951 - DNA, 20 bp, human
gcccgggacggaacacgggg

SEQ ID NO: 199952 - DNA, 20 bp, human
gggcccgcccggccagtcgg

SEQ ID NO: 199953 - DNA, 20 bp, human
gggccgccccccgaagccca

SEQ ID NO: 199954 - DNA, 20 bp, human
gcgcgcgccttgctctccct

SEQ ID NO: 199955 - DNA, 20 bp, human
gtgctctccctgggcttcgg

SEQ ID NO: 199956 - DNA, 20 bp, human
gcgctggcagaggcgttcag

SEQ ID NO: 199957 - DNA, 20 bp, human
gtccacgtgggaggtgagac

SEQ ID NO: 199958 - DNA, 20 bp, human
ggccagtctcacctcccacg

SEQ ID NO: 199959 - DNA, 20 bp, human
gctgcaataacgcccgtcac

SEQ ID NO: 199960 - DNA, 20 bp, human
gcaggcgtggggttccacgt

SEQ ID NO: 199961 - DNA, 20 bp, human
gtcacaggcgaggaaaaggc

SEQ ID NO: 199962 - DNA, 20 bp, human
gcagagctcggccaggaggg

SEQ ID NO: 199963 - DNA, 20 bp, human
gcgggagggcggcgatggta

SEQ ID NO: 199964 - DNA, 20 bp, human
gacgcctctgccagcggctg

SEQ ID NO: 199965 - DNA, 20 bp, human
gggccccacaggcttcggtg

SEQ ID NO: 199966 - DNA, 20 bp, human
ggcacaccggcgcaaacctc

SEQ ID NO: 199967 - DNA, 20 bp, human
ggcagcagcttcgctgtcca

SEQ ID NO: 199968 - DNA, 20 bp, human
gctgggaaaaggcttgtgaa

SEQ ID NO: 199969 - DNA, 20 bp, human
ggacaacagcgtcggaacca

SEQ ID NO: 199970 - DNA, 20 bp, human
ggggtctcggaggacacagg

SEQ ID NO: 199971 - DNA, 20 bp, human
gctgggagtcgtgatgggag

SEQ ID NO: 199972 - DNA, 20 bp, human
ggagtcgtgatgggaggggg

SEQ ID NO: 199973 - DNA, 20 bp, human
gaaccctccgcgagacgcca

SEQ ID NO: 199974 - DNA, 20 bp, human
ggggttctgggagtcgtgat

SEQ ID NO: 199975 - DNA, 20 bp, human
ggcgtctcgcggagggttct

SEQ ID NO: 199976 - DNA, 20 bp, human
gctgccctcagactctccag

SEQ ID NO: 199977 - DNA, 20 bp, human
ggaggccgagcgcccgagtt

SEQ ID NO: 199978 - DNA, 20 bp, human
gtgcacatgcgcagagggag

SEQ ID NO: 199979 - DNA, 20 bp, human
gtgtgtgctggtgcaaggtc

SEQ ID NO: 199980 - DNA, 20 bp, human
gtgcaggagccgtctccctc

SEQ ID NO: 199981 - DNA, 20 bp, human
gcctcctccccgcgggctca

SEQ ID NO: 199982 - DNA, 20 bp, human
ggttccctgggagagcccga

SEQ ID NO: 199983 - DNA, 20 bp, human
gctccaggcgagtccttccc

SEQ ID NO: 199984 - DNA, 20 bp, human
ggccctcgcccagtgctccg

SEQ ID NO: 199985 - DNA, 20 bp, human
ggagggattgtttcccacaa

SEQ ID NO: 199986 - DNA, 20 bp, human
ggccagcgcgcctcacatgg

SEQ ID NO: 199987 - DNA, 20 bp, human
gggtcttacgccctagggtg

SEQ ID NO: 199988 - DNA, 20 bp, human
gtccaaagccgcagggacgt

SEQ ID NO: 199989 - DNA, 20 bp, human
gagcccagacccggaggcac

SEQ ID NO: 199990 - DNA, 20 bp, human
ggtctgggctgggccgcaaa

SEQ ID NO: 199991 - DNA, 20 bp, human
ggcgctggccgctgcagacg

SEQ ID NO: 199992 - DNA, 20 bp, human
gtgaccggagccgccatgtg

SEQ ID NO: 199993 - DNA, 20 bp, human
gaccaggcggctcccaccca

SEQ ID NO: 199994 - DNA, 20 bp, human
gccggtcacgtcacacaatg

SEQ ID NO: 199995 - DNA, 20 bp, human
gagaggactccggtgcctcc

SEQ ID NO: 199996 - DNA, 20 bp, human
gggccggacacagcgaagag

SEQ ID NO: 199997 - DNA, 20 bp, human
gggagatctgaggagatcca

SEQ ID NO: 199998 - DNA, 20 bp, human
gccagcagcgggaaccgcaa

SEQ ID NO: 199999 - DNA, 20 bp, human
gagcctcacgcgcgaaggaa

SEQ ID NO: 200000 - DNA, 20 bp, human
gcggtagaaagcgcgcggga

SEQ ID NO: 200001 - DNA, 20 bp, human
gcgtgaggctgcggctctga

SEQ ID NO: 200002 - DNA, 20 bp, human
gcccggcgtgctcccgacag

SEQ ID NO: 200003 - DNA, 20 bp, human
gctgagtgctgcgaggtccg

SEQ ID NO: 200004 - DNA, 20 bp, human
gaggatggccggagtcctag

SEQ ID NO: 200005 - DNA, 20 bp, human
gagcgcgcgggagggcacga

SEQ ID NO: 200006 - DNA, 20 bp, human
gcgggtcgagcaaacaggtg

SEQ ID NO: 200007 - DNA, 20 bp, human
gagtcgcaccgagcccggaa

SEQ ID NO: 200008 - DNA, 20 bp, human
gagccaccgaggaagcgccg

SEQ ID NO: 200009 - DNA, 20 bp, human
gcgacccggggaagccaccg

SEQ ID NO: 200010 - DNA, 20 bp, human
gtgagggtgcagcctcacca

SEQ ID NO: 200011 - DNA, 20 bp, human
gcaggagtcactgagcagta

SEQ ID NO: 200012 - DNA, 20 bp, human
gtggggcaaagagccacgtg

SEQ ID NO: 200013 - DNA, 20 bp, human
ggctgaaggccctggaaatg

SEQ ID NO: 200014 - DNA, 20 bp, human
gcttcctcggtggcttcccc

SEQ ID NO: 200015 - DNA, 20 bp, human
ggctctggacccggttctgt

SEQ ID NO: 200016 - DNA, 20 bp, human
gtatagaggcccgtcctctg

SEQ ID NO: 200017 - DNA, 20 bp, human
ggacgggcctctataagcac

SEQ ID NO: 200018 - DNA, 20 bp, human
gtgggcagggagaactccgg

SEQ ID NO: 200019 - DNA, 20 bp, human
gctgtgtcctgtgcttatag

SEQ ID NO: 200020 - DNA, 20 bp, human
gacccgcagggaaccgagtc

SEQ ID NO: 200021 - DNA, 20 bp, human
gcgtgtgacctgcaagtatt

SEQ ID NO: 200022 - DNA, 20 bp, human
ggaactccggcggcagattg

SEQ ID NO: 200023 - DNA, 20 bp, human
gagaacactgaggataaacc

SEQ ID NO: 200024 - DNA, 20 bp, human
ggggtcccggggtttagctg

SEQ ID NO: 200025 - DNA, 20 bp, human
ggcggctgcggtgacatccg

SEQ ID NO: 200026 - DNA, 20 bp, human
ggagcagtgaagacagacct

SEQ ID NO: 200027 - DNA, 20 bp, human
ggaagacagacctgggactc

SEQ ID NO: 200028 - DNA, 20 bp, human
gcagattgttcagggacccg

SEQ ID NO: 200029 - DNA, 20 bp, human
gcaaagcggcttccgggata

SEQ ID NO: 200030 - DNA, 20 bp, human
gagcggcttccgggatatgg

SEQ ID NO: 200031 - DNA, 20 bp, human
gacagctggactggacaaag

SEQ ID NO: 200032 - DNA, 20 bp, human
gattgttcagggacccgggg

SEQ ID NO: 200033 - DNA, 20 bp, human
gtcgagctgggcgcagattg

SEQ ID NO: 200034 - DNA, 20 bp, human
gactggacaaagcggcttcc

SEQ ID NO: 200035 - DNA, 20 bp, human
gcgcagattgtggagctgac

SEQ ID NO: 200036 - DNA, 20 bp, human
ggcaaggagcccctgatgag

SEQ ID NO: 200037 - DNA, 20 bp, human
gcacctggtgtgctagggaa

SEQ ID NO: 200038 - DNA, 20 bp, human
gaccgccacaaggaggacaa

SEQ ID NO: 200039 - DNA, 20 bp, human
ggaggacgcggcacatacct

SEQ ID NO: 200040 - DNA, 20 bp, human
gtcagtggcgcctctcatca

SEQ ID NO: 200041 - DNA, 20 bp, human
ggagccgggtgccctcgcaa

SEQ ID NO: 200042 - DNA, 20 bp, human
gggtgacacagccattgcga

SEQ ID NO: 200043 - DNA, 20 bp, human
gtcacagagtcagatggcgg

SEQ ID NO: 200044 - DNA, 20 bp, human
gcaggcatggggctacgggg

SEQ ID NO: 200045 - DNA, 20 bp, human
gacttccgttgtcctccttg

SEQ ID NO: 200046 - DNA, 20 bp, human
gaactcgggcgcagatggta

SEQ ID NO: 200047 - DNA, 20 bp, human
gagctggccaaggaaaactc

SEQ ID NO: 200048 - DNA, 20 bp, human
gcgcagcgccgagtctcccc

SEQ ID NO: 200049 - DNA, 20 bp, human
ggaagacgagacctgcagct

SEQ ID NO: 200050 - DNA, 20 bp, human
gctgtggtccctgcacaacc

SEQ ID NO: 200051 - DNA, 20 bp, human
gctaagacgccaggtcctcc

SEQ ID NO: 200052 - DNA, 20 bp, human
gtcgctctagcccgagctgc

SEQ ID NO: 200053 - DNA, 20 bp, human
gttatggctgagggggaccg

SEQ ID NO: 200054 - DNA, 20 bp, human
gagggggtggttggaacctg

SEQ ID NO: 200055 - DNA, 20 bp, human
gagtgctgggtccgacatcc

SEQ ID NO: 200056 - DNA, 20 bp, human
gctgtggaaccagggccccc

SEQ ID NO: 200057 - DNA, 20 bp, human
gcagcggggctgtggaacca

SEQ ID NO: 200058 - DNA, 20 bp, human
gggagcgcccggagatagta

SEQ ID NO: 200059 - DNA, 20 bp, human
gccacgcgcaattcagacct

SEQ ID NO: 200060 - DNA, 20 bp, human
gttgcgcgtggtggccatgg

SEQ ID NO: 200061 - DNA, 20 bp, human
gcgcgagcggcgggtgggta

SEQ ID NO: 200062 - DNA, 20 bp, human
ggaattgcgcgtggtggcca

SEQ ID NO: 200063 - DNA, 20 bp, human
gtctgacccccggctcgtcc

SEQ ID NO: 200064 - DNA, 20 bp, human
gccacagtgctcgcaggaaa

SEQ ID NO: 200065 - DNA, 20 bp, human
gacagccccgctggccgcca

SEQ ID NO: 200066 - DNA, 20 bp, human
gggctgcggagagaccgtga

SEQ ID NO: 200067 - DNA, 20 bp, human
gcggcttagactcagtggac

SEQ ID NO: 200068 - DNA, 20 bp, human
gacacccgctggccagattc

SEQ ID NO: 200069 - DNA, 20 bp, human
ggcaggcagcgcgcgaacgt

SEQ ID NO: 200070 - DNA, 20 bp, human
ggactcagtggaccggaatc

SEQ ID NO: 200071 - DNA, 20 bp, human
ggcggaggcgcggagctaag

SEQ ID NO: 200072 - DNA, 20 bp, human
gtctggccagcgggtgtacc

SEQ ID NO: 200073 - DNA, 20 bp, human
gcggccacagagactcagcc

SEQ ID NO: 200074 - DNA, 20 bp, human
ggaagctgtccggaaactgg

SEQ ID NO: 200075 - DNA, 20 bp, human
ggttcgcgcgctgcctgcgg

SEQ ID NO: 200076 - DNA, 20 bp, human
ggggccgaaacccaactcac

SEQ ID NO: 200077 - DNA, 20 bp, human
gcggcagacaaagacgacca

SEQ ID NO: 200078 - DNA, 20 bp, human
gacgcccgcgatgagcaaga

SEQ ID NO: 200079 - DNA, 20 bp, human
ggcaggggtacagttcgggt

SEQ ID NO: 200080 - DNA, 20 bp, human
gagacacggttcgggaatga

SEQ ID NO: 200081 - DNA, 20 bp, human
gccgcgggcagcgctcccag

SEQ ID NO: 200082 - DNA, 20 bp, human
ggcgccatcttgctcatcgc

SEQ ID NO: 200083 - DNA, 20 bp, human
ggcctgcgcactccttccgc

SEQ ID NO: 200084 - DNA, 20 bp, human
gcgtgtctgagagtctcctg

SEQ ID NO: 200085 - DNA, 20 bp, human
gtgggtgaccgagagtgtga

SEQ ID NO: 200086 - DNA, 20 bp, human
gtcggtcctgggtcaggtgg

SEQ ID NO: 200087 - DNA, 20 bp, human
gatttccggcgtgggagcag

SEQ ID NO: 200088 - DNA, 20 bp, human
gtgcgtgggtcctctatata

SEQ ID NO: 200089 - DNA, 20 bp, human
gctgcgccaggacttccccg

SEQ ID NO: 200090 - DNA, 20 bp, human
gctcaggccgaagccaccca

SEQ ID NO: 200091 - DNA, 20 bp, human
gggcgccctgaacccatgta

SEQ ID NO: 200092 - DNA, 20 bp, human
gagaggtctgagtcttgcgt

SEQ ID NO: 200093 - DNA, 20 bp, human
ggcgcaagtgggaggcctcg

SEQ ID NO: 200094 - DNA, 20 bp, human
gcgggctcccaggaacggga

SEQ ID NO: 200095 - DNA, 20 bp, human
ggcgccgtccaaccttacat

SEQ ID NO: 200096 - DNA, 20 bp, human
ggagcctggaagccacgaag

SEQ ID NO: 200097 - DNA, 20 bp, human
gctggaagccacgaagtggt

SEQ ID NO: 200098 - DNA, 20 bp, human
gcgactggcacgactgtcag

SEQ ID NO: 200099 - DNA, 20 bp, human
ggcctgggggaggagacgtg

SEQ ID NO: 200100 - DNA, 20 bp, human
gagagcggcagaagataaag

SEQ ID NO: 200101 - DNA, 20 bp, human
gccaaagggaagcggcctgg

SEQ ID NO: 200102 - DNA, 20 bp, human
ggagtccggggtctccggtc

SEQ ID NO: 200103 - DNA, 20 bp, human
ggaagttgcaaaacagggtg

SEQ ID NO: 200104 - DNA, 20 bp, human
gccggcgccccaaagggaag

SEQ ID NO: 200105 - DNA, 20 bp, human
ggtagcggtagagaataaaa

SEQ ID NO: 200106 - DNA, 20 bp, human
gccccgaccggggccctcag

SEQ ID NO: 200107 - DNA, 20 bp, human
gagccactgagggccccggt

SEQ ID NO: 200108 - DNA, 20 bp, human
gccctgctcggtcctgacta

SEQ ID NO: 200109 - DNA, 20 bp, human
gtcagccccgcggtctccag

SEQ ID NO: 200110 - DNA, 20 bp, human
gtgcaaagcggccccgaccg

SEQ ID NO: 200111 - DNA, 20 bp, human
gccagggggtgacgtgatgg

SEQ ID NO: 200112 - DNA, 20 bp, human
gcgggcaaccggccagggtc

SEQ ID NO: 200113 - DNA, 20 bp, human
gtgactagggacctgcaaag

SEQ ID NO: 200114 - DNA, 20 bp, human
gggcccagggggtgacgtga

SEQ ID NO: 200115 - DNA, 20 bp, human
gtcccagctctgcggcccag

SEQ ID NO: 200116 - DNA, 20 bp, human
ggcgaggtcggatgacgggt

SEQ ID NO: 200117 - DNA, 20 bp, human
ggtgggagccagcggtggaa

SEQ ID NO: 200118 - DNA, 20 bp, human
gctcgtcgcggtgagtactg

SEQ ID NO: 200119 - DNA, 20 bp, human
gccaggtacgggagattggg

SEQ ID NO: 200120 - DNA, 20 bp, human
gtttggcgaggtcggatgac

SEQ ID NO: 200121 - DNA, 20 bp, human
gctctaaggaggcccctcgg

SEQ ID NO: 200122 - DNA, 20 bp, human
gtggcgagtccagctcgtcg

SEQ ID NO: 200123 - DNA, 20 bp, human
gagctggactcgccaggtac

SEQ ID NO: 200124 - DNA, 20 bp, human
gtgagtactggggtgaaagt

SEQ ID NO: 200125 - DNA, 20 bp, human
gaacgccaccaggaagaaaa

SEQ ID NO: 200126 - DNA, 20 bp, human
ggcaagtcgcagagcaacag

SEQ ID NO: 200127 - DNA, 20 bp, human
gaacgaaagactcggagctg

SEQ ID NO: 200128 - DNA, 20 bp, human
ggaggacgggagcgtctcag

SEQ ID NO: 200129 - DNA, 20 bp, human
gcagattgtgcggtgaggac

SEQ ID NO: 200130 - DNA, 20 bp, human
gaagactcggagctgtggcg

SEQ ID NO: 200131 - DNA, 20 bp, human
gaggagacccgagctctaac

SEQ ID NO: 200132 - DNA, 20 bp, human
gcctcccagaacgaaagact

SEQ ID NO: 200133 - DNA, 20 bp, human
gtcggctccagttagagctc

SEQ ID NO: 200134 - DNA, 20 bp, human
gggcccgggtgcccctacag

SEQ ID NO: 200135 - DNA, 20 bp, human
gcgcagagcgacctcgtccc

SEQ ID NO: 200136 - DNA, 20 bp, human
gcagcttctttagaatattt

SEQ ID NO: 200137 - DNA, 20 bp, human
gtagttattagatattccga

SEQ ID NO: 200138 - DNA, 20 bp, human
ggctcagaagaatttgtatc

SEQ ID NO: 200139 - DNA, 20 bp, human
gattcttctgagctggttcc

SEQ ID NO: 200140 - DNA, 20 bp, human
gacaaagcacaagatcccaa

SEQ ID NO: 200141 - DNA, 20 bp, human
gtacatcacctcaaataaaa

SEQ ID NO: 200142 - DNA, 20 bp, human
gttaggaagcattttaaatc

SEQ ID NO: 200143 - DNA, 20 bp, human
gtcttttcagaatgtccctt

SEQ ID NO: 200144 - DNA, 20 bp, human
gttggaggagtgggaacacc

SEQ ID NO: 200145 - DNA, 20 bp, human
gatattctaaagaagctggt

SEQ ID NO: 200146 - DNA, 20 bp, human
ggggcgatgaacgctatctg

SEQ ID NO: 200147 - DNA, 20 bp, human
gcatcggcgcggaacaatgg

SEQ ID NO: 200148 - DNA, 20 bp, human
gctggcccgttgaccacgac

SEQ ID NO: 200149 - DNA, 20 bp, human
gcagtccccaaacccagagg

SEQ ID NO: 200150 - DNA, 20 bp, human
gtcctgtgcgacatacgtag

SEQ ID NO: 200151 - DNA, 20 bp, human
gggaacaaggatctcgccat

SEQ ID NO: 200152 - DNA, 20 bp, human
ggaacgctatctgaggaaca

SEQ ID NO: 200153 - DNA, 20 bp, human
gcgccatcggcgcggaacaa

SEQ ID NO: 200154 - DNA, 20 bp, human
gaccctggtggccatcccta

SEQ ID NO: 200155 - DNA, 20 bp, human
ggctcctccaaaccctgaag

SEQ ID NO: 200156 - DNA, 20 bp, human
ggagtcatcgaggagagatg

SEQ ID NO: 200157 - DNA, 20 bp, human
gggatgcagggttcatgact

SEQ ID NO: 200158 - DNA, 20 bp, human
gctcgatgactcgggatgca

SEQ ID NO: 200159 - DNA, 20 bp, human
gtcgctgcagtcgcagctcc

SEQ ID NO: 200160 - DNA, 20 bp, human
gcaaggagaactcctggccg

SEQ ID NO: 200161 - DNA, 20 bp, human
gtttggagtctactgcaggg

SEQ ID NO: 200162 - DNA, 20 bp, human
ggattttggagtctactgca

SEQ ID NO: 200163 - DNA, 20 bp, human
gtctctcgggatctgggacc

SEQ ID NO: 200164 - DNA, 20 bp, human
gagccatcttatgactgaag

SEQ ID NO: 200165 - DNA, 20 bp, human
gtcagtcataagatggctgc

SEQ ID NO: 200166 - DNA, 20 bp, human
ggacagccgcatacacactc

SEQ ID NO: 200167 - DNA, 20 bp, human
gactagtcgccaggcaacga

SEQ ID NO: 200168 - DNA, 20 bp, human
gactagtccctgcggcttag

SEQ ID NO: 200169 - DNA, 20 bp, human
gggctgcccgagtgtgtatg

SEQ ID NO: 200170 - DNA, 20 bp, human
gactcccacgatctaggaca

SEQ ID NO: 200171 - DNA, 20 bp, human
gagatcgtgggagtatcccg

SEQ ID NO: 200172 - DNA, 20 bp, human
gctgccctgtcctagatcgt

SEQ ID NO: 200173 - DNA, 20 bp, human
gcagcctgaggaaacgtcaa

SEQ ID NO: 200174 - DNA, 20 bp, human
gggaagcccctcccgggaga

SEQ ID NO: 200175 - DNA, 20 bp, human
gatccaaaaggatccgcagg

SEQ ID NO: 200176 - DNA, 20 bp, human
gcacgaaggcgaccactctt

SEQ ID NO: 200177 - DNA, 20 bp, human
gcgcgctcgcccccaactaa

SEQ ID NO: 200178 - DNA, 20 bp, human
gccgatgcgcgggacagagg

SEQ ID NO: 200179 - DNA, 20 bp, human
gcgaaacctgcgtccgtcgg

SEQ ID NO: 200180 - DNA, 20 bp, human
ggccgacgggcgccattgtg

SEQ ID NO: 200181 - DNA, 20 bp, human
gcttggggcagagcagaagc

SEQ ID NO: 200182 - DNA, 20 bp, human
gcgcagcctccgcccaggaa

SEQ ID NO: 200183 - DNA, 20 bp, human
ggtccagaaccgttagttgg

SEQ ID NO: 200184 - DNA, 20 bp, human
ggagtcgtgccctgccacga

SEQ ID NO: 200185 - DNA, 20 bp, human
gcagggccccacactaatgt

SEQ ID NO: 200186 - DNA, 20 bp, human
gtgttagctcggctgggcac

SEQ ID NO: 200187 - DNA, 20 bp, human
gagccgagctaacagccccg

SEQ ID NO: 200188 - DNA, 20 bp, human
gggcgtggcaggaagcgcca

SEQ ID NO: 200189 - DNA, 20 bp, human
gaggcccgaaggccttcccg

SEQ ID NO: 200190 - DNA, 20 bp, human
ggcagggcggaggtgatcgt

SEQ ID NO: 200191 - DNA, 20 bp, human
gccggatgacgagtacgaag

SEQ ID NO: 200192 - DNA, 20 bp, human
ggccgcgagaggatgtgcag

SEQ ID NO: 200193 - DNA, 20 bp, human
gcgagtacgaagaggcccga

SEQ ID NO: 200194 - DNA, 20 bp, human
gcgcgcggccctcggtggag

SEQ ID NO: 200195 - DNA, 20 bp, human
ggccagcgccgctccaccga

SEQ ID NO: 200196 - DNA, 20 bp, human
gcccggcccgaggttcctag

SEQ ID NO: 200197 - DNA, 20 bp, human
ggcctaacgccgggtcctct

SEQ ID NO: 200198 - DNA, 20 bp, human
gggacgccagcagaatcccg

SEQ ID NO: 200199 - DNA, 20 bp, human
gcgggtcctctaggaacctc

SEQ ID NO: 200200 - DNA, 20 bp, human
ggccgagcggagcctaacgc

SEQ ID NO: 200201 - DNA, 20 bp, human
gcacccggccaagggcgtag

SEQ ID NO: 200202 - DNA, 20 bp, human
gcaagggcgtagcggactcg

SEQ ID NO: 200203 - DNA, 20 bp, human
gctctcctccacccggccaa

SEQ ID NO: 200204 - DNA, 20 bp, human
gtggcgagaagggcccctca

SEQ ID NO: 200205 - DNA, 20 bp, human
gcgcgtactgcgggccccac

SEQ ID NO: 200206 - DNA, 20 bp, human
gcttggaagcagccattacc

SEQ ID NO: 200207 - DNA, 20 bp, human
gggagctgcagcacagtcgg

SEQ ID NO: 200208 - DNA, 20 bp, human
ggaatgcaggaagaccgtga

SEQ ID NO: 200209 - DNA, 20 bp, human
ggcgacagccccctgggtct

SEQ ID NO: 200210 - DNA, 20 bp, human
gggtcaaaccaagcaaacca

SEQ ID NO: 200211 - DNA, 20 bp, human
ggctcctagggtcagaccag

SEQ ID NO: 200212 - DNA, 20 bp, human
gccgctgggccaccacccgt

SEQ ID NO: 200213 - DNA, 20 bp, human
gattcgggcgacagccccct

SEQ ID NO: 200214 - DNA, 20 bp, human
gggacctctggtctgaccct

SEQ ID NO: 200215 - DNA, 20 bp, human
gggaggggaaggccattcca

SEQ ID NO: 200216 - DNA, 20 bp, human
gggagaacttccaggtctag

SEQ ID NO: 200217 - DNA, 20 bp, human
gctctgagtgaacgaagaaa

SEQ ID NO: 200218 - DNA, 20 bp, human
gaacccaggaggatgaggct

SEQ ID NO: 200219 - DNA, 20 bp, human
gtggaatgacggtgacgccg

SEQ ID NO: 200220 - DNA, 20 bp, human
gagcaggaaaactacgagat

SEQ ID NO: 200221 - DNA, 20 bp, human
gtgtggggtccccctagacc

SEQ ID NO: 200222 - DNA, 20 bp, human
gctgtggtcctgggatcctg

SEQ ID NO: 200223 - DNA, 20 bp, human
gtgaggctgggaggcgcaca

SEQ ID NO: 200224 - DNA, 20 bp, human
gcgctgtgctccaggaaccc

SEQ ID NO: 200225 - DNA, 20 bp, human
ggggtgggaatacacctcta

SEQ ID NO: 200226 - DNA, 20 bp, human
gggagtgggaccttctgatc

SEQ ID NO: 200227 - DNA, 20 bp, human
gaagcagtgctgccggtctc

SEQ ID NO: 200228 - DNA, 20 bp, human
gtctcccggaggtggagaca

SEQ ID NO: 200229 - DNA, 20 bp, human
gaagcggcgttgttcgcctg

SEQ ID NO: 200230 - DNA, 20 bp, human
gctggacaaatttctcccgg

SEQ ID NO: 200231 - DNA, 20 bp, human
gccacaagggaaagcgaagc

SEQ ID NO: 200232 - DNA, 20 bp, human
gtaaggggcttaaaaggagt

SEQ ID NO: 200233 - DNA, 20 bp, human
ggacaaatttctcccggagg

SEQ ID NO: 200234 - DNA, 20 bp, human
gaagggaggattaccatccc

SEQ ID NO: 200235 - DNA, 20 bp, human
gaaaatgattgggcaataag

SEQ ID NO: 200236 - DNA, 20 bp, human
gggccacgcaccagccccgg

SEQ ID NO: 200237 - DNA, 20 bp, human
gcgtctgcgtgagggagtgg

SEQ ID NO: 200238 - DNA, 20 bp, human
gtgccccgggagcgcctccg

SEQ ID NO: 200239 - DNA, 20 bp, human
ggccaaaagagaccccgcgg

SEQ ID NO: 200240 - DNA, 20 bp, human
ggaccccgcgggggcgatgg

SEQ ID NO: 200241 - DNA, 20 bp, human
gtgtattgcaaaggccgctc

SEQ ID NO: 200242 - DNA, 20 bp, human
ggtgtgcgtgaggggatcgt

SEQ ID NO: 200243 - DNA, 20 bp, human
ggccggccacgcaccagccc

SEQ ID NO: 200244 - DNA, 20 bp, human
gaggcccgggcccagcccgg

SEQ ID NO: 200245 - DNA, 20 bp, human
gtccggactggtaaggacgg

SEQ ID NO: 200246 - DNA, 20 bp, human
ggaggagcgcgaaaaacctc

SEQ ID NO: 200247 - DNA, 20 bp, human
gccgcgctggaagtctccgg

SEQ ID NO: 200248 - DNA, 20 bp, human
ggagcagatcggtctgactg

SEQ ID NO: 200249 - DNA, 20 bp, human
gcagaccgacaggactcagg

SEQ ID NO: 200250 - DNA, 20 bp, human
gcttgcgccgggccctgaag

SEQ ID NO: 200251 - DNA, 20 bp, human
gtggggttcggataaggagg

SEQ ID NO: 200252 - DNA, 20 bp, human
gtcagcaacagcgactcccc

SEQ ID NO: 200253 - DNA, 20 bp, human
ggcctgtgccgcgcggaagg

SEQ ID NO: 200254 - DNA, 20 bp, human
gaaacagaccgacaggactc

SEQ ID NO: 200255 - DNA, 20 bp, human
ggaaccggcgtctcagccgg

SEQ ID NO: 200256 - DNA, 20 bp, human
gatgggtcttggccaaacat

SEQ ID NO: 200257 - DNA, 20 bp, human
ggcgcttaccgtgagcggag

SEQ ID NO: 200258 - DNA, 20 bp, human
gtacgactgaagagacacgg

SEQ ID NO: 200259 - DNA, 20 bp, human
gtaccgtgagcggagcggat

SEQ ID NO: 200260 - DNA, 20 bp, human
gctgggccgacgcaagatgg

SEQ ID NO: 200261 - DNA, 20 bp, human
gcgcacacgcctgggagagg

SEQ ID NO: 200262 - DNA, 20 bp, human
gggccgatccgctccgctca

SEQ ID NO: 200263 - DNA, 20 bp, human
gggggggcgcttaccgtgag

SEQ ID NO: 200264 - DNA, 20 bp, human
ggaggtatcccggcgcgacg

SEQ ID NO: 200265 - DNA, 20 bp, human
ggtaggaaaggagaccaaag

SEQ ID NO: 200266 - DNA, 20 bp, human
gccatgcgtgccggtgccgg

SEQ ID NO: 200267 - DNA, 20 bp, human
ggacccgtaagtattgccgg

SEQ ID NO: 200268 - DNA, 20 bp, human
gtattaactggaggcgacgg

SEQ ID NO: 200269 - DNA, 20 bp, human
gcggctgcgcagtacacggg

SEQ ID NO: 200270 - DNA, 20 bp, human
gccgcggctgcgcagtacac

SEQ ID NO: 200271 - DNA, 20 bp, human
gtgagtggcggcggaggtac

SEQ ID NO: 200272 - DNA, 20 bp, human
gaggaggcctggctgaagaa

SEQ ID NO: 200273 - DNA, 20 bp, human
gggtgaccgggggaagacgg

SEQ ID NO: 200274 - DNA, 20 bp, human
ggcggaggtaccggcagtag

SEQ ID NO: 200275 - DNA, 20 bp, human
ggaggtaccggcagtagcgg

SEQ ID NO: 200276 - DNA, 20 bp, human
ggcccgacgcaggcccggaa

SEQ ID NO: 200277 - DNA, 20 bp, human
gcggtcgccgggcccaagtg

SEQ ID NO: 200278 - DNA, 20 bp, human
gggtggcagacctcctccgg

SEQ ID NO: 200279 - DNA, 20 bp, human
gcaaagggagccccaagccg

SEQ ID NO: 200280 - DNA, 20 bp, human
ggtcccggaaaggacggtcc

SEQ ID NO: 200281 - DNA, 20 bp, human
ggatgcagtttgtgtcaaca

SEQ ID NO: 200282 - DNA, 20 bp, human
gtgccaggtcccggaaagga

SEQ ID NO: 200283 - DNA, 20 bp, human
gtcgccgggcccaagtgcgg

SEQ ID NO: 200284 - DNA, 20 bp, human
gctgggcgcggaagctggga

SEQ ID NO: 200285 - DNA, 20 bp, human
gaccgggccgcgccgtcctc

SEQ ID NO: 200286 - DNA, 20 bp, human
gctgggtccaaactaaccac

SEQ ID NO: 200287 - DNA, 20 bp, human
ggcagagtccaagaacctta

SEQ ID NO: 200288 - DNA, 20 bp, human
gggcccgaagacaggctaaa

SEQ ID NO: 200289 - DNA, 20 bp, human
gaccttaaggacaccggaaa

SEQ ID NO: 200290 - DNA, 20 bp, human
gttgtggcaggcccgaagac

SEQ ID NO: 200291 - DNA, 20 bp, human
gccaagaaccttaaggacac

SEQ ID NO: 200292 - DNA, 20 bp, human
gggacagagcgtgtcgtgtc

SEQ ID NO: 200293 - DNA, 20 bp, human
gaatgtgtgacgggctgaca

SEQ ID NO: 200294 - DNA, 20 bp, human
gcggctgctcgcgtgcacac

SEQ ID NO: 200295 - DNA, 20 bp, human
gaaactaaccacaggtctct

SEQ ID NO: 200296 - DNA, 20 bp, human
ggttgctgcagtgcattcgg

SEQ ID NO: 200297 - DNA, 20 bp, human
gagaaggaccgacaagacac

SEQ ID NO: 200298 - DNA, 20 bp, human
gcaacctcgccccccgggag

SEQ ID NO: 200299 - DNA, 20 bp, human
ggaacagcagtgggaggtac

SEQ ID NO: 200300 - DNA, 20 bp, human
ggacagccccaagaccaaga

SEQ ID NO: 200301 - DNA, 20 bp, human
ggaggttgctgcagtgcatt

SEQ ID NO: 200302 - DNA, 20 bp, human
gtgcgagccagcatcgtaag

SEQ ID NO: 200303 - DNA, 20 bp, human
ggggcacttccgctcccggg

SEQ ID NO: 200304 - DNA, 20 bp, human
gaccaccagtcactaaggga

SEQ ID NO: 200305 - DNA, 20 bp, human
gcacacgctgcgcggggtag

SEQ ID NO: 200306 - DNA, 20 bp, human
gctggctacgcctccaagag

SEQ ID NO: 200307 - DNA, 20 bp, human
gagaggggcgcggtacagac

SEQ ID NO: 200308 - DNA, 20 bp, human
ggacattgtttgggacgctg

SEQ ID NO: 200309 - DNA, 20 bp, human
gtcgtaggtggggtagacta

SEQ ID NO: 200310 - DNA, 20 bp, human
gtggtactggacgcacgctg

SEQ ID NO: 200311 - DNA, 20 bp, human
gcgctgcgggcgacattgtt

SEQ ID NO: 200312 - DNA, 20 bp, human
ggacctacccgggataggat

SEQ ID NO: 200313 - DNA, 20 bp, human
gtggaggcgtagccaggagt

SEQ ID NO: 200314 - DNA, 20 bp, human
gagagcgtgggctcgagcgt

SEQ ID NO: 200315 - DNA, 20 bp, human
gggactgtgcgtccctgaat

SEQ ID NO: 200316 - DNA, 20 bp, human
ggattctcccagccgcacca

SEQ ID NO: 200317 - DNA, 20 bp, human
ggtagttccgggcgggatga

SEQ ID NO: 200318 - DNA, 20 bp, human
ggtgctgccctcatcccgcc

SEQ ID NO: 200319 - DNA, 20 bp, human
ggagcacccgtggtgcggct

SEQ ID NO: 200320 - DNA, 20 bp, human
gccgcaggtgggagcacccg

SEQ ID NO: 200321 - DNA, 20 bp, human
gggtgggagcacccgtggtg

SEQ ID NO: 200322 - DNA, 20 bp, human
ggagtcgcgcatgcgtaaga

SEQ ID NO: 200323 - DNA, 20 bp, human
gggggtggtcgcggggttct

SEQ ID NO: 200324 - DNA, 20 bp, human
ggggatgagggcagcacgcc

SEQ ID NO: 200325 - DNA, 20 bp, human
ggggaattgtagttccgggc

SEQ ID NO: 200326 - DNA, 20 bp, human
ggcgctcggggcactggccc

SEQ ID NO: 200327 - DNA, 20 bp, human
ggtgctgctctcattccgcc

SEQ ID NO: 200328 - DNA, 20 bp, human
gggaatgagagcagcacgcc

SEQ ID NO: 200329 - DNA, 20 bp, human
gggcctcggcggtagttccc

SEQ ID NO: 200330 - DNA, 20 bp, human
ggtcacctcttccaggcgcc

SEQ ID NO: 200331 - DNA, 20 bp, human
gcctgggggaaccgggcgcc

SEQ ID NO: 200332 - DNA, 20 bp, human
ggagtcgcgcatgagtaaga

SEQ ID NO: 200333 - DNA, 20 bp, human
gcatcccgggcctcacaaag

SEQ ID NO: 200334 - DNA, 20 bp, human
ggcgcatgagtaagaaggag

SEQ ID NO: 200335 - DNA, 20 bp, human
gaggactgaggcagactcca

SEQ ID NO: 200336 - DNA, 20 bp, human
gtgacgccgaggcgaggtcg

SEQ ID NO: 200337 - DNA, 20 bp, human
gaagcccggcccagaaaccc

SEQ ID NO: 200338 - DNA, 20 bp, human
ggccgcagggtcgaggtcga

SEQ ID NO: 200339 - DNA, 20 bp, human
ggccctcgacctcgaccctg

SEQ ID NO: 200340 - DNA, 20 bp, human
gctcgaccctgcggctgaag

SEQ ID NO: 200341 - DNA, 20 bp, human
gcacatgcgcagtgacgccg

SEQ ID NO: 200342 - DNA, 20 bp, human
gttgcgggagggcaaagacg

SEQ ID NO: 200343 - DNA, 20 bp, human
ggggcttctcaggaccgggc

SEQ ID NO: 200344 - DNA, 20 bp, human
gcagaggcgccggggtttct

SEQ ID NO: 200345 - DNA, 20 bp, human
gtggcgggctcagtcccgag

SEQ ID NO: 200346 - DNA, 20 bp, human
ggcgctaggcggccgagagg

SEQ ID NO: 200347 - DNA, 20 bp, human
gcgaagaggccgagcaggag

SEQ ID NO: 200348 - DNA, 20 bp, human
gacggagcggggtgtgaaga

SEQ ID NO: 200349 - DNA, 20 bp, human
ggacccaggtgcgtacgcga

SEQ ID NO: 200350 - DNA, 20 bp, human
ggcagtcccgagttcaggga

SEQ ID NO: 200351 - DNA, 20 bp, human
gaggtgcgtacgcgacggag

SEQ ID NO: 200352 - DNA, 20 bp, human
ggtgaagatggcggacgaag

SEQ ID NO: 200353 - DNA, 20 bp, human
gggttgagttgcggcgaagg

SEQ ID NO: 200354 - DNA, 20 bp, human
gcccgagttcagggaaggaa

SEQ ID NO: 200355 - DNA, 20 bp, human
gagaggttgagttgcggcga

SEQ ID NO: 200356 - DNA, 20 bp, human
gcgagggtcaaaggtaaggg

SEQ ID NO: 200357 - DNA, 20 bp, human
gcgggcggaggacgcacgag

SEQ ID NO: 200358 - DNA, 20 bp, human
gagggaagggtcccacccga

SEQ ID NO: 200359 - DNA, 20 bp, human
gacccgagggtcaaaggtaa

SEQ ID NO: 200360 - DNA, 20 bp, human
gggtcccacccgagggtcaa

SEQ ID NO: 200361 - DNA, 20 bp, human
ggcgctcaggtgagtgactg

SEQ ID NO: 200362 - DNA, 20 bp, human
ggcggaggacgcacgagcgg

SEQ ID NO: 200363 - DNA, 20 bp, human
ggggcgaaggagataaggca

SEQ ID NO: 200364 - DNA, 20 bp, human
gcggcgtccacagggtccac

SEQ ID NO: 200365 - DNA, 20 bp, human
gcacgtgtaagagttcgcgg

SEQ ID NO: 200366 - DNA, 20 bp, human
gtctgtgacagggtccaaca

SEQ ID NO: 200367 - DNA, 20 bp, human
gtctcaggctggctcgcgaa

SEQ ID NO: 200368 - DNA, 20 bp, human
gctgtcacagacccacacac

SEQ ID NO: 200369 - DNA, 20 bp, human
gacccggaagcgaaacgagg

SEQ ID NO: 200370 - DNA, 20 bp, human
gccggggacagaacaaagaa

SEQ ID NO: 200371 - DNA, 20 bp, human
ggggaagcggagtagaggac

SEQ ID NO: 200372 - DNA, 20 bp, human
ggacacggaccaggccctgt

SEQ ID NO: 200373 - DNA, 20 bp, human
ggacgcgtggactcaccctg

SEQ ID NO: 200374 - DNA, 20 bp, human
gagtttcagcagagcggtag

SEQ ID NO: 200375 - DNA, 20 bp, human
gccgacccggaagcgaaacg

SEQ ID NO: 200376 - DNA, 20 bp, human
gggcatgctcggcggtgtga

SEQ ID NO: 200377 - DNA, 20 bp, human
gctgcgccgggcatgctcgg

SEQ ID NO: 200378 - DNA, 20 bp, human
gctcggcggtgtgacggctc

SEQ ID NO: 200379 - DNA, 20 bp, human
ggagctctgcagacctgtgt

SEQ ID NO: 200380 - DNA, 20 bp, human
ggagattgaggtcgttccag

SEQ ID NO: 200381 - DNA, 20 bp, human
gggactgcgccgggcatgct

SEQ ID NO: 200382 - DNA, 20 bp, human
gcagcgcccagctccgaggt

SEQ ID NO: 200383 - DNA, 20 bp, human
ggtgtgcatccgcgaagact

SEQ ID NO: 200384 - DNA, 20 bp, human
ggccatgcacccagtcttcg

SEQ ID NO: 200385 - DNA, 20 bp, human
gagtccacaaggccgcccac

SEQ ID NO: 200386 - DNA, 20 bp, human
ggacgaccgggctctcaaga

SEQ ID NO: 200387 - DNA, 20 bp, human
gtaatcgagctgggagtcag

SEQ ID NO: 200388 - DNA, 20 bp, human
ggcccgttccgcatcttcag

SEQ ID NO: 200389 - DNA, 20 bp, human
gcccatgcggaaacagctcc

SEQ ID NO: 200390 - DNA, 20 bp, human
gtgcaggtggactgactggt

SEQ ID NO: 200391 - DNA, 20 bp, human
gggaggagaggagcccgtga

SEQ ID NO: 200392 - DNA, 20 bp, human
gctttgttcaggaagcaaca

SEQ ID NO: 200393 - DNA, 20 bp, human
gtcaagatggcggccccatg

SEQ ID NO: 200394 - DNA, 20 bp, human
gcgctagtacgaagacgacc

SEQ ID NO: 200395 - DNA, 20 bp, human
ggacatgggggagttcagta

SEQ ID NO: 200396 - DNA, 20 bp, human
gggcggcggcttccaagcta

SEQ ID NO: 200397 - DNA, 20 bp, human
ggctggtgagcgggtaacgg

SEQ ID NO: 200398 - DNA, 20 bp, human
ggtagctggtgagcgggtaa

SEQ ID NO: 200399 - DNA, 20 bp, human
gcagtgtcgttcccggaggt

SEQ ID NO: 200400 - DNA, 20 bp, human
gtccaagctaaggaacggtt

SEQ ID NO: 200401 - DNA, 20 bp, human
gccaggcctgaagctatcgc

SEQ ID NO: 200402 - DNA, 20 bp, human
ggtaacggcggccgacctcc

SEQ ID NO: 200403 - DNA, 20 bp, human
gtgaggactccggcaagtgt

SEQ ID NO: 200404 - DNA, 20 bp, human
gcaaaccgcgcgcggaccca

SEQ ID NO: 200405 - DNA, 20 bp, human
gggggcagtgtcgttcccgg

SEQ ID NO: 200406 - DNA, 20 bp, human
gtgagttctagagatcgggt

SEQ ID NO: 200407 - DNA, 20 bp, human
gcaaccagaatgcacggacc

SEQ ID NO: 200408 - DNA, 20 bp, human
gccgtgcattctggttgtga

SEQ ID NO: 200409 - DNA, 20 bp, human
gggacacaccaaccaggccg

SEQ ID NO: 200410 - DNA, 20 bp, human
gaaggctgagttctagagat

SEQ ID NO: 200411 - DNA, 20 bp, human
gccgccgctgccatgagaag

SEQ ID NO: 200412 - DNA, 20 bp, human
ggcggcggtgctgatggacc

SEQ ID NO: 200413 - DNA, 20 bp, human
gaacgctcacaagactaagg

SEQ ID NO: 200414 - DNA, 20 bp, human
ggacaagaggacgtgtgtgg

SEQ ID NO: 200415 - DNA, 20 bp, human
ggaatgcacggaccgggcat

SEQ ID NO: 200416 - DNA, 20 bp, human
gtgggtcacgagcccctggg

SEQ ID NO: 200417 - DNA, 20 bp, human
gcatcttagggcctttccat

SEQ ID NO: 200418 - DNA, 20 bp, human
gtaattggcggactaggaag

SEQ ID NO: 200419 - DNA, 20 bp, human
gaggtgaagggagcagccaa

SEQ ID NO: 200420 - DNA, 20 bp, human
gttcttggggagagtaccgg

SEQ ID NO: 200421 - DNA, 20 bp, human
gggagatcgcttaaggtgaa

SEQ ID NO: 200422 - DNA, 20 bp, human
ggcccctgcctgcaacccca

SEQ ID NO: 200423 - DNA, 20 bp, human
gtagccatggagatcgctta

SEQ ID NO: 200424 - DNA, 20 bp, human
gccatcaggattggaaggag

SEQ ID NO: 200425 - DNA, 20 bp, human
gccgggtatttaggtgaggg

SEQ ID NO: 200426 - DNA, 20 bp, human
gatcgggggagcggaggtga

SEQ ID NO: 200427 - DNA, 20 bp, human
ggcgaattctttcggcctgt

SEQ ID NO: 200428 - DNA, 20 bp, human
gcgattgccccgagacacat

SEQ ID NO: 200429 - DNA, 20 bp, human
gaaagccctaagtctctggt

SEQ ID NO: 200430 - DNA, 20 bp, human
gtctggcgtggggacacgag

SEQ ID NO: 200431 - DNA, 20 bp, human
gtcacgggaggcctatctgg

SEQ ID NO: 200432 - DNA, 20 bp, human
gccccgagacacatgggcca

SEQ ID NO: 200433 - DNA, 20 bp, human
gggcagttcaggagattggg

SEQ ID NO: 200434 - DNA, 20 bp, human
gtcatacgggaggtccagtc

SEQ ID NO: 200435 - DNA, 20 bp, human
gctggcggtgaggactaaga

SEQ ID NO: 200436 - DNA, 20 bp, human
gccgaccccgctcgccctca

SEQ ID NO: 200437 - DNA, 20 bp, human
gggcgacagctctgacccgg

SEQ ID NO: 200438 - DNA, 20 bp, human
gcggccgtcccgggcatagt

SEQ ID NO: 200439 - DNA, 20 bp, human
gcgggcccggccggcttcag

SEQ ID NO: 200440 - DNA, 20 bp, human
ggtcggcgcgggactccccc

SEQ ID NO: 200441 - DNA, 20 bp, human
ggagaccatccaggcgacag

SEQ ID NO: 200442 - DNA, 20 bp, human
ggcccggcgggaagagtcgt

SEQ ID NO: 200443 - DNA, 20 bp, human
gccgggggcgccctagacgc

SEQ ID NO: 200444 - DNA, 20 bp, human
gtccgcgacgaggagccgga

SEQ ID NO: 200445 - DNA, 20 bp, human
gcacggcgacagctctgacc

SEQ ID NO: 200446 - DNA, 20 bp, human
gggacatgggggctcttcaa

SEQ ID NO: 200447 - DNA, 20 bp, human
gaccaagcggacagactaca

SEQ ID NO: 200448 - DNA, 20 bp, human
gtgcaggaggatgccataga

SEQ ID NO: 200449 - DNA, 20 bp, human
gggctctgcctacaggacat

SEQ ID NO: 200450 - DNA, 20 bp, human
ggcccgagtcagtaaccaag

SEQ ID NO: 200451 - DNA, 20 bp, human
gaagagcccccatgtcctgt

SEQ ID NO: 200452 - DNA, 20 bp, human
gccctgggctgtgccgtcta

SEQ ID NO: 200453 - DNA, 20 bp, human
ggcacggcggagaaccccct

SEQ ID NO: 200454 - DNA, 20 bp, human
gtggacaaggacctcagaca

SEQ ID NO: 200455 - DNA, 20 bp, human
ggagagccaggccccaaatg

SEQ ID NO: 200456 - DNA, 20 bp, human
gaggccagactgtcctgtga

SEQ ID NO: 200457 - DNA, 20 bp, human
gtctttggcagagcagttag

SEQ ID NO: 200458 - DNA, 20 bp, human
ggcattgccaaggcagacca

SEQ ID NO: 200459 - DNA, 20 bp, human
gtctagcccccatcacctat

SEQ ID NO: 200460 - DNA, 20 bp, human
gctgtgtggacatcaagcct

SEQ ID NO: 200461 - DNA, 20 bp, human
gtgatgggggctagatgaga

SEQ ID NO: 200462 - DNA, 20 bp, human
gtaggcttggagtaagggaa

SEQ ID NO: 200463 - DNA, 20 bp, human
gtgtggacatcaagcctggg

SEQ ID NO: 200464 - DNA, 20 bp, human
gttgacactatgagattcag

SEQ ID NO: 200465 - DNA, 20 bp, human
gtaaagttctgggtaattgt

SEQ ID NO: 200466 - DNA, 20 bp, human
gggcgcgtgcccgcagacaa

SEQ ID NO: 200467 - DNA, 20 bp, human
gcgtgcccgcagacaaaggc

SEQ ID NO: 200468 - DNA, 20 bp, human
gcaccccggaaggccggcac

SEQ ID NO: 200469 - DNA, 20 bp, human
gggcgctctgacccggccag

SEQ ID NO: 200470 - DNA, 20 bp, human
gttgccccggcgctctgacc

SEQ ID NO: 200471 - DNA, 20 bp, human
gctcgctgaagcccgcacgg

SEQ ID NO: 200472 - DNA, 20 bp, human
gagccggtgccggccttccg

SEQ ID NO: 200473 - DNA, 20 bp, human
ggagggcagcgtctgcggag

SEQ ID NO: 200474 - DNA, 20 bp, human
gaggccgcggcaggctcacc

SEQ ID NO: 200475 - DNA, 20 bp, human
gtcctcccaccccggaaggc

SEQ ID NO: 200476 - DNA, 20 bp, human
gagccgccgagagcgacggt

SEQ ID NO: 200477 - DNA, 20 bp, human
gatagcagcaccacaggact

SEQ ID NO: 200478 - DNA, 20 bp, human
gcccggtatagcagcaccac

SEQ ID NO: 200479 - DNA, 20 bp, human
ggagcgccgcgcctcaaccc

SEQ ID NO: 200480 - DNA, 20 bp, human
gcgggaggacaggtcaggaa

SEQ ID NO: 200481 - DNA, 20 bp, human
gcaacaccgcacaaggaggg

SEQ ID NO: 200482 - DNA, 20 bp, human
ggtggcgtctgcaggatctt

SEQ ID NO: 200483 - DNA, 20 bp, human
gtcgggcccactcccctctg

SEQ ID NO: 200484 - DNA, 20 bp, human
gtagcaacaccgcacaagga

SEQ ID NO: 200485 - DNA, 20 bp, human
gctgaagccgccgagagcga

SEQ ID NO: 200486 - DNA, 20 bp, human
ggtcctccgtccgccgtcag

SEQ ID NO: 200487 - DNA, 20 bp, human
gaaagaagagaaccttagta

SEQ ID NO: 200488 - DNA, 20 bp, human
gcggtgggacccaagaccca

SEQ ID NO: 200489 - DNA, 20 bp, human
gtctaggaactaccgtacta

SEQ ID NO: 200490 - DNA, 20 bp, human
gctggacactgagcatggtc

SEQ ID NO: 200491 - DNA, 20 bp, human
gccgcaggccgcgcttaccc

SEQ ID NO: 200492 - DNA, 20 bp, human
gcggacggaggactgaaaga

SEQ ID NO: 200493 - DNA, 20 bp, human
gacccacggccacagtcgag

SEQ ID NO: 200494 - DNA, 20 bp, human
ggcgcacccatcccacccct

SEQ ID NO: 200495 - DNA, 20 bp, human
gctccgctgacggcggacgg

SEQ ID NO: 200496 - DNA, 20 bp, human
gggaaaccggacccgacccg

SEQ ID NO: 200497 - DNA, 20 bp, human
gaagcggcctccctccgtga

SEQ ID NO: 200498 - DNA, 20 bp, human
gcagaccgcgccctcacgga

SEQ ID NO: 200499 - DNA, 20 bp, human
gctggcggcgaggaaggtac

SEQ ID NO: 200500 - DNA, 20 bp, human
gtgggctggggaccgcgggt

SEQ ID NO: 200501 - DNA, 20 bp, human
gtgggccaatgagaaccgaa

SEQ ID NO: 200502 - DNA, 20 bp, human
ggacgcactctgagaaacag

SEQ ID NO: 200503 - DNA, 20 bp, human
gggtcgggtccggtttccag

SEQ ID NO: 200504 - DNA, 20 bp, human
ggcgcacgcgtcgtgatcaa

SEQ ID NO: 200505 - DNA, 20 bp, human
gcaccgtgcggcagcccagg

SEQ ID NO: 200506 - DNA, 20 bp, human
gaagcggcctcactccgtgg

SEQ ID NO: 200507 - DNA, 20 bp, human
gccgaggcgggcggccagga

SEQ ID NO: 200508 - DNA, 20 bp, human
gactgcgcccccacggagtg

SEQ ID NO: 200509 - DNA, 20 bp, human
gaggaagcggcctcactccg

SEQ ID NO: 200510 - DNA, 20 bp, human
gcacacagactgcgccccca

SEQ ID NO: 200511 - DNA, 20 bp, human
gtcagcctgcccggcagtca

SEQ ID NO: 200512 - DNA, 20 bp, human
gtcacttggctgctcgcgtc

SEQ ID NO: 200513 - DNA, 20 bp, human
gcaagtgacagtcccaacgc

SEQ ID NO: 200514 - DNA, 20 bp, human
gctcgtggtccgtaccttcc

SEQ ID NO: 200515 - DNA, 20 bp, human
gctggtgagctcccgacttc

SEQ ID NO: 200516 - DNA, 20 bp, human
gcgtgtggaatcgcgggtcg

SEQ ID NO: 200517 - DNA, 20 bp, human
gttaccgtcctcgaagtcca

SEQ ID NO: 200518 - DNA, 20 bp, human
ggtcgcgcggagtgatcgtg

SEQ ID NO: 200519 - DNA, 20 bp, human
gcactccgcgcgaccgagag

SEQ ID NO: 200520 - DNA, 20 bp, human
gcgggaagttggagacgtcg

SEQ ID NO: 200521 - DNA, 20 bp, human
gggcgaatgcgagactaggt

SEQ ID NO: 200522 - DNA, 20 bp, human
gagtgatcgtgtggaatcgc

SEQ ID NO: 200523 - DNA, 20 bp, human
gcggcggagacaagagaact

SEQ ID NO: 200524 - DNA, 20 bp, human
gctagagcgcgagagcctcc

SEQ ID NO: 200525 - DNA, 20 bp, human
gagcggcgcgctaccagccc

SEQ ID NO: 200526 - DNA, 20 bp, human
gatgcgtcggcacttacggt

SEQ ID NO: 200527 - DNA, 20 bp, human
gttccctccgcaggaaacgg

SEQ ID NO: 200528 - DNA, 20 bp, human
gggaggcagcgcagggctca

SEQ ID NO: 200529 - DNA, 20 bp, human
gacttacggttggcggccgg

SEQ ID NO: 200530 - DNA, 20 bp, human
gagggatgcgtcggcactta

SEQ ID NO: 200531 - DNA, 20 bp, human
gatgcgagcgcggaactcac

SEQ ID NO: 200532 - DNA, 20 bp, human
ggacttccctccgcaggaaa

SEQ ID NO: 200533 - DNA, 20 bp, human
gagcgcaatcgcccggaaca

SEQ ID NO: 200534 - DNA, 20 bp, human
gcgtcggcacttacggttgg

SEQ ID NO: 200535 - DNA, 20 bp, human
gggagtgaccccaatcgcca

SEQ ID NO: 200536 - DNA, 20 bp, human
gaccactgcgggatagaacg

SEQ ID NO: 200537 - DNA, 20 bp, human
gcggggccgagtgctctcag

SEQ ID NO: 200538 - DNA, 20 bp, human
gtcatgcgcaatggagggtc

SEQ ID NO: 200539 - DNA, 20 bp, human
ggccccgttctatcccgcag

SEQ ID NO: 200540 - DNA, 20 bp, human
gtcactcccacccgccaagg

SEQ ID NO: 200541 - DNA, 20 bp, human
gtcatcactcccacccgcca

SEQ ID NO: 200542 - DNA, 20 bp, human
ggagggtccggcgtccgcct

SEQ ID NO: 200543 - DNA, 20 bp, human
ggtccggcgtccgccttggc

SEQ ID NO: 200544 - DNA, 20 bp, human
ggctcgggaacgtctgctgg

SEQ ID NO: 200545 - DNA, 20 bp, human
gtctcgggccgccccggtag

SEQ ID NO: 200546 - DNA, 20 bp, human
ggtgtcccgcgggcgggtga

SEQ ID NO: 200547 - DNA, 20 bp, human
gaaggtactaacagccaggg

SEQ ID NO: 200548 - DNA, 20 bp, human
gaccaggactccgggaaaga

SEQ ID NO: 200549 - DNA, 20 bp, human
gaagaaggtactaacagcca

SEQ ID NO: 200550 - DNA, 20 bp, human
gactcgtggaccaggactcc

SEQ ID NO: 200551 - DNA, 20 bp, human
gaagggcttgaacccgtata

SEQ ID NO: 200552 - DNA, 20 bp, human
gggagaccggactcactcag

SEQ ID NO: 200553 - DNA, 20 bp, human
gcggtccgtctcctagtgtc

SEQ ID NO: 200554 - DNA, 20 bp, human
gccggagcgcgcacgaggta

SEQ ID NO: 200555 - DNA, 20 bp, human
gggaggctgacagccgattc

SEQ ID NO: 200556 - DNA, 20 bp, human
gctcacagaacagagtcccg

SEQ ID NO: 200557 - DNA, 20 bp, human
gcgctctgggggatatgtgg

SEQ ID NO: 200558 - DNA, 20 bp, human
gaacccgcacctgtgaacct

SEQ ID NO: 200559 - DNA, 20 bp, human
gctgccgaggttcacaggtg

SEQ ID NO: 200560 - DNA, 20 bp, human
ggtgcgctctgggggatatg

SEQ ID NO: 200561 - DNA, 20 bp, human
gtagggctggggtgctcccg

SEQ ID NO: 200562 - DNA, 20 bp, human
gagtgcaaaggcacatccgt

SEQ ID NO: 200563 - DNA, 20 bp, human
gagcttctgtgtgctgggat

SEQ ID NO: 200564 - DNA, 20 bp, human
ggccactccacacagtgcaa

SEQ ID NO: 200565 - DNA, 20 bp, human
ggggtgctcccgaggctttg

SEQ ID NO: 200566 - DNA, 20 bp, human
gccgtgcctgtgaacctcgg

SEQ ID NO: 200567 - DNA, 20 bp, human
gacctcggcggtgcgtccct

SEQ ID NO: 200568 - DNA, 20 bp, human
gagcccgtgcctgtgaacct

SEQ ID NO: 200569 - DNA, 20 bp, human
ggtgaccgggggtgctccag

SEQ ID NO: 200570 - DNA, 20 bp, human
gccccataactggtgaccgg

SEQ ID NO: 200571 - DNA, 20 bp, human
gcgctctgggggttgtgcgg

SEQ ID NO: 200572 - DNA, 20 bp, human
gaggcgctcacgtccctccg

SEQ ID NO: 200573 - DNA, 20 bp, human
gaccaccccacacggtgcag

SEQ ID NO: 200574 - DNA, 20 bp, human
gtggaaattcaccagcaaga

SEQ ID NO: 200575 - DNA, 20 bp, human
gacccccggtcaccagttat

SEQ ID NO: 200576 - DNA, 20 bp, human
gctgagagcgagagaccggg

SEQ ID NO: 200577 - DNA, 20 bp, human
gggcgcggtgcggcacggca

SEQ ID NO: 200578 - DNA, 20 bp, human
gcgtgaggcccacacagtca

SEQ ID NO: 200579 - DNA, 20 bp, human
gtgcgaggccctgactgtgt

SEQ ID NO: 200580 - DNA, 20 bp, human
gtgcatactgtaggcaaggt

SEQ ID NO: 200581 - DNA, 20 bp, human
gggcacggtgggagtgtctc

SEQ ID NO: 200582 - DNA, 20 bp, human
ggggaggaaacccctcacac

SEQ ID NO: 200583 - DNA, 20 bp, human
gttcccggcggccccgagac

SEQ ID NO: 200584 - DNA, 20 bp, human
ggcggtgcggcacggcacgg

SEQ ID NO: 200585 - DNA, 20 bp, human
gtctcaggtaccccccgtcc

SEQ ID NO: 200586 - DNA, 20 bp, human
gggcgggaccagggattcac

SEQ ID NO: 200587 - DNA, 20 bp, human
gtcgcaccaggtccaagtct

SEQ ID NO: 200588 - DNA, 20 bp, human
gcaccaggtccaagtctcgg

SEQ ID NO: 200589 - DNA, 20 bp, human
gagagcctggcgaaccggaa

SEQ ID NO: 200590 - DNA, 20 bp, human
gaggcagccagggcaggatt

SEQ ID NO: 200591 - DNA, 20 bp, human
gtcgggaggcgaggcagcca

SEQ ID NO: 200592 - DNA, 20 bp, human
ggggtgcacccacaacctat

SEQ ID NO: 200593 - DNA, 20 bp, human
gtcccgccgagacttggacc

SEQ ID NO: 200594 - DNA, 20 bp, human
ggtgcgaactggaggcgaag

SEQ ID NO: 200595 - DNA, 20 bp, human
ggaaggatgtgagctggaat

SEQ ID NO: 200596 - DNA, 20 bp, human
gtggcgccgggtttccgctc

SEQ ID NO: 200597 - DNA, 20 bp, human
gatggcgacctcgtcgatgc

SEQ ID NO: 200598 - DNA, 20 bp, human
ggtcgatgccggagtcagag

SEQ ID NO: 200599 - DNA, 20 bp, human
gccgctgcggaggaacccat

SEQ ID NO: 200600 - DNA, 20 bp, human
gccggagtcagagaggaacg

SEQ ID NO: 200601 - DNA, 20 bp, human
gccggatggggctcacagag

SEQ ID NO: 200602 - DNA, 20 bp, human
gcctccgcagcggaggaaag

SEQ ID NO: 200603 - DNA, 20 bp, human
ggccgaagggctgaaccact

SEQ ID NO: 200604 - DNA, 20 bp, human
gcgctccacgagaatcgtgg

SEQ ID NO: 200605 - DNA, 20 bp, human
gtctacccgaagctcacccg

SEQ ID NO: 200606 - DNA, 20 bp, human
ggagatgcgtggtccaccat

SEQ ID NO: 200607 - DNA, 20 bp, human
ggaggcggtgaggtcaccga

SEQ ID NO: 200608 - DNA, 20 bp, human
ggcaggagcgcagctcaccg

SEQ ID NO: 200609 - DNA, 20 bp, human
gggcggctgagggcgaaccg

SEQ ID NO: 200610 - DNA, 20 bp, human
gtccggccaaaagacccccg

SEQ ID NO: 200611 - DNA, 20 bp, human
ggcggtgaggtcaccgatgg

SEQ ID NO: 200612 - DNA, 20 bp, human
gggagcgcagctcaccgggg

SEQ ID NO: 200613 - DNA, 20 bp, human
gacccgaggagcggcgaccc

SEQ ID NO: 200614 - DNA, 20 bp, human
gccctggcacaagaggacct

SEQ ID NO: 200615 - DNA, 20 bp, human
gcacggctcgctgacgccca

SEQ ID NO: 200616 - DNA, 20 bp, human
ggagtggggtaagccccagt

SEQ ID NO: 200617 - DNA, 20 bp, human
gctagggcgccgcggtacgt

SEQ ID NO: 200618 - DNA, 20 bp, human
gaggcccggggacctcatag

SEQ ID NO: 200619 - DNA, 20 bp, human
gcgctaggccggttcctcaa

SEQ ID NO: 200620 - DNA, 20 bp, human
ggtgcagtcgcccgccagac

SEQ ID NO: 200621 - DNA, 20 bp, human
gcagacgtagccggcggacg

SEQ ID NO: 200622 - DNA, 20 bp, human
ggggccggtaccaagtggtg

SEQ ID NO: 200623 - DNA, 20 bp, human
gcccgccagaccggcagact

SEQ ID NO: 200624 - DNA, 20 bp, human
ggagccccgcgcgactcctg

SEQ ID NO: 200625 - DNA, 20 bp, human
gtccgcggcccccacaaatg

SEQ ID NO: 200626 - DNA, 20 bp, human
gctacctgggtaggaaaggg

SEQ ID NO: 200627 - DNA, 20 bp, human
ggggccgcgccctagcacat

SEQ ID NO: 200628 - DNA, 20 bp, human
gcgtagcccgctccctacag

SEQ ID NO: 200629 - DNA, 20 bp, human
gctagggcgcggccctacct

SEQ ID NO: 200630 - DNA, 20 bp, human
gcgggatttcaggggtctac

SEQ ID NO: 200631 - DNA, 20 bp, human
gggccctacctgggtaggaa

SEQ ID NO: 200632 - DNA, 20 bp, human
ggggtctaccggctctctta

SEQ ID NO: 200633 - DNA, 20 bp, human
gcggaaacgcagaaacgcag

SEQ ID NO: 200634 - DNA, 20 bp, human
gcgctacgccagttcctcta

SEQ ID NO: 200635 - DNA, 20 bp, human
ggtccctgcccaacccgcgg

SEQ ID NO: 200636 - DNA, 20 bp, human
ggtgagtgtgagcccggcgg

SEQ ID NO: 200637 - DNA, 20 bp, human
ggctgacaggagaggagcgt

SEQ ID NO: 200638 - DNA, 20 bp, human
ggaggtgagtgtgagcccgg

SEQ ID NO: 200639 - DNA, 20 bp, human
gctcgggccgctgggaccaa

SEQ ID NO: 200640 - DNA, 20 bp, human
ggggctgccgtgctgctcgg

SEQ ID NO: 200641 - DNA, 20 bp, human
gacgctaaaggcaggagggg

SEQ ID NO: 200642 - DNA, 20 bp, human
gccgcccctgaaaagctgac

SEQ ID NO: 200643 - DNA, 20 bp, human
gcgtgggagggagccgggat

SEQ ID NO: 200644 - DNA, 20 bp, human
gccggacaaggccccgagta

SEQ ID NO: 200645 - DNA, 20 bp, human
ggggccgaacgggcgaggtt

SEQ ID NO: 200646 - DNA, 20 bp, human
ggacggcggcggctccaaga

SEQ ID NO: 200647 - DNA, 20 bp, human
gcgccgccgctcaccctcca

SEQ ID NO: 200648 - DNA, 20 bp, human
gggccctggagggtgagcgg

SEQ ID NO: 200649 - DNA, 20 bp, human
gcgggcttcggttcctgtgg

SEQ ID NO: 200650 - DNA, 20 bp, human
gggaacagccgcggccaggg

SEQ ID NO: 200651 - DNA, 20 bp, human
gagccgggcttcggttcctg

SEQ ID NO: 200652 - DNA, 20 bp, human
ggtcgcagctgcgggcagga

SEQ ID NO: 200653 - DNA, 20 bp, human
ggggcggtctggaacagccg

SEQ ID NO: 200654 - DNA, 20 bp, human
ggcgaccgcacccccgtccc

SEQ ID NO: 200655 - DNA, 20 bp, human
gtgaccacgaagaacttctg

SEQ ID NO: 200656 - DNA, 20 bp, human
ggccctggccacagtctcac

SEQ ID NO: 200657 - DNA, 20 bp, human
gcaagcgggaacagtgccag

SEQ ID NO: 200658 - DNA, 20 bp, human
ggagactgtggccagggcgg

SEQ ID NO: 200659 - DNA, 20 bp, human
gatctcgccccactccacaa

SEQ ID NO: 200660 - DNA, 20 bp, human
gcagggcgggggcattcccc

SEQ ID NO: 200661 - DNA, 20 bp, human
ggaaggtgggtagatgctgt

SEQ ID NO: 200662 - DNA, 20 bp, human
gttgagggcctaacatgctc

SEQ ID NO: 200663 - DNA, 20 bp, human
gccaagcacgatagacaata

SEQ ID NO: 200664 - DNA, 20 bp, human
gcacagtgcctgagcatgtt

SEQ ID NO: 200665 - DNA, 20 bp, human
gagataggggatgccagacg

SEQ ID NO: 200666 - DNA, 20 bp, human
gggtcggtggccgagatccc

SEQ ID NO: 200667 - DNA, 20 bp, human
gcacgagagagggcatcctg

SEQ ID NO: 200668 - DNA, 20 bp, human
gcggaggtccgggcaagcag

SEQ ID NO: 200669 - DNA, 20 bp, human
ggctaggtccgcacatccct

SEQ ID NO: 200670 - DNA, 20 bp, human
ggccagcgtgcccgggatct

SEQ ID NO: 200671 - DNA, 20 bp, human
gatcccgggcacgctggctc

SEQ ID NO: 200672 - DNA, 20 bp, human
gcgaagcctgcgaggatgtt

SEQ ID NO: 200673 - DNA, 20 bp, human
ggccgagatcccgggcacgc

SEQ ID NO: 200674 - DNA, 20 bp, human
gacgctggctctggtgagcg

SEQ ID NO: 200675 - DNA, 20 bp, human
gaccccaggacgcacgactg

SEQ ID NO: 200676 - DNA, 20 bp, human
ggggctttgtgagatagcta

SEQ ID NO: 200677 - DNA, 20 bp, human
gtagctagggtcgacttgtg

SEQ ID NO: 200678 - DNA, 20 bp, human
ggagctgaccctatccgaac

SEQ ID NO: 200679 - DNA, 20 bp, human
gggctgggtgaaggagttaa

SEQ ID NO: 200680 - DNA, 20 bp, human
gaccgtgtatggaactgtga

SEQ ID NO: 200681 - DNA, 20 bp, human
gggagccgccctctgaggct

SEQ ID NO: 200682 - DNA, 20 bp, human
gactcccggaaggctccgat

SEQ ID NO: 200683 - DNA, 20 bp, human
gacttacgcctgttcggata

SEQ ID NO: 200684 - DNA, 20 bp, human
gcgaacaggcgtaagtgagg

SEQ ID NO: 200685 - DNA, 20 bp, human
gccaagcaaaaagggctcag

SEQ ID NO: 200686 - DNA, 20 bp, human
gcgcctgagaggctctctac

SEQ ID NO: 200687 - DNA, 20 bp, human
gtagtgaatgatgaaggagg

SEQ ID NO: 200688 - DNA, 20 bp, human
gcgatacctaggcgcctgag

SEQ ID NO: 200689 - DNA, 20 bp, human
gcttccccgcaaaccctcac

SEQ ID NO: 200690 - DNA, 20 bp, human
gctgtagtgaatgatgaagg

SEQ ID NO: 200691 - DNA, 20 bp, human
ggagtatcccgcgccggcca

SEQ ID NO: 200692 - DNA, 20 bp, human
gcaggccgcggacggcggag

SEQ ID NO: 200693 - DNA, 20 bp, human
gccggccgctccgccgtccg

SEQ ID NO: 200694 - DNA, 20 bp, human
gcgcgggcaccccaagaatc

SEQ ID NO: 200695 - DNA, 20 bp, human
ggcaactccgagctgctgta

SEQ ID NO: 200696 - DNA, 20 bp, human
ggcgtgagtgtccctcagta

SEQ ID NO: 200697 - DNA, 20 bp, human
ggagggacactcacgctcgg

SEQ ID NO: 200698 - DNA, 20 bp, human
gggaactggctgcggaaacg

SEQ ID NO: 200699 - DNA, 20 bp, human
gctgcggaaacggggcacgg

SEQ ID NO: 200700 - DNA, 20 bp, human
gccacaccgcgagtcagctg

SEQ ID NO: 200701 - DNA, 20 bp, human
gtccggaagcggatcgtgtt

SEQ ID NO: 200702 - DNA, 20 bp, human
ggcgcggtgcggggatctta

SEQ ID NO: 200703 - DNA, 20 bp, human
gctgtagcgagcccgggaac

SEQ ID NO: 200704 - DNA, 20 bp, human
gctccaccccagctgactcg

SEQ ID NO: 200705 - DNA, 20 bp, human
gcaccgcgagtcagctgggg

SEQ ID NO: 200706 - DNA, 20 bp, human
ggcacagggccctctatcaa

SEQ ID NO: 200707 - DNA, 20 bp, human
gccggtacttcagcttctac

SEQ ID NO: 200708 - DNA, 20 bp, human
ggagccggaagcccatcccg

SEQ ID NO: 200709 - DNA, 20 bp, human
gctgtgccgtctgggaccgg

SEQ ID NO: 200710 - DNA, 20 bp, human
gacggacctccggtcccaga

SEQ ID NO: 200711 - DNA, 20 bp, human
gtgatgagagtactcactgt

SEQ ID NO: 200712 - DNA, 20 bp, human
ggccgcgaggagcctatacg

SEQ ID NO: 200713 - DNA, 20 bp, human
gccggcacgagaacaatgac

SEQ ID NO: 200714 - DNA, 20 bp, human
gacagtgagtggggtcggag

SEQ ID NO: 200715 - DNA, 20 bp, human
ggccctgtgccgtctgggac

SEQ ID NO: 200716 - DNA, 20 bp, human
ggtgcgaggactccagaagt

SEQ ID NO: 200717 - DNA, 20 bp, human
gttctccagatacacaagaa

SEQ ID NO: 200718 - DNA, 20 bp, human
ggtggcgattaggatcgatg

SEQ ID NO: 200719 - DNA, 20 bp, human
gaggcacgcggaccacagac

SEQ ID NO: 200720 - DNA, 20 bp, human
ggtggtacaaaggcttgtga

SEQ ID NO: 200721 - DNA, 20 bp, human
gcgtggttcggatgagtaag

SEQ ID NO: 200722 - DNA, 20 bp, human
ggtcactgtactcacaccaa

SEQ ID NO: 200723 - DNA, 20 bp, human
gttacggaagtgtaacgttg

SEQ ID NO: 200724 - DNA, 20 bp, human
gctgtagagtgtctggtccg

SEQ ID NO: 200725 - DNA, 20 bp, human
gggaagactggggagcgccg

SEQ ID NO: 200726 - DNA, 20 bp, human
gggtcgcccagacgccgtcg

SEQ ID NO: 200727 - DNA, 20 bp, human
gcgcgaggcccacatggagt

SEQ ID NO: 200728 - DNA, 20 bp, human
ggggtcgcgaggctgcatcc

SEQ ID NO: 200729 - DNA, 20 bp, human
gcggcggttccggagcctcg

SEQ ID NO: 200730 - DNA, 20 bp, human
gcgcccagacgccgtcgggg

SEQ ID NO: 200731 - DNA, 20 bp, human
ggacgcgggtgcaccagcaa

SEQ ID NO: 200732 - DNA, 20 bp, human
gctccgccccgacggcgtct

SEQ ID NO: 200733 - DNA, 20 bp, human
gcgcgaggctgcatcccggc

SEQ ID NO: 200734 - DNA, 20 bp, human
gctccccagccgcgaggctc

SEQ ID NO: 200735 - DNA, 20 bp, human
gaggccaagccggtaggagg

SEQ ID NO: 200736 - DNA, 20 bp, human
gcagagcgcctgggacctag

SEQ ID NO: 200737 - DNA, 20 bp, human
gcttgaggtcgcccagacgt

SEQ ID NO: 200738 - DNA, 20 bp, human
ggaggtcgcccagacgtcgg

SEQ ID NO: 200739 - DNA, 20 bp, human
ggctttcgctgcccggtgag

SEQ ID NO: 200740 - DNA, 20 bp, human
gcacacggcgcgcgcagggt

SEQ ID NO: 200741 - DNA, 20 bp, human
gacccggctcctccgacgtc

SEQ ID NO: 200742 - DNA, 20 bp, human
gtcggaggagccgggtcacg

SEQ ID NO: 200743 - DNA, 20 bp, human
ggcggccgccttgctcctct

SEQ ID NO: 200744 - DNA, 20 bp, human
ggaggcaggggcgtcggcag

SEQ ID NO: 200745 - DNA, 20 bp, human
gcaccggagcggcccgtgag

SEQ ID NO: 200746 - DNA, 20 bp, human
gacagctcgcggcctttcgg

SEQ ID NO: 200747 - DNA, 20 bp, human
gctctgtcaggaggagaccg

SEQ ID NO: 200748 - DNA, 20 bp, human
ggcatccctgctaacagata

SEQ ID NO: 200749 - DNA, 20 bp, human
gatgcccgccgagagcgctc

SEQ ID NO: 200750 - DNA, 20 bp, human
gtccctgctaacagataggg

SEQ ID NO: 200751 - DNA, 20 bp, human
gacggcgccccgggacccag

SEQ ID NO: 200752 - DNA, 20 bp, human
gctgctaacagatagggtgg

SEQ ID NO: 200753 - DNA, 20 bp, human
ggcgggagaactaccactcc

SEQ ID NO: 200754 - DNA, 20 bp, human
ggagcgcctcaaccccaggc

SEQ ID NO: 200755 - DNA, 20 bp, human
gcggcaatcctagccaagcc

SEQ ID NO: 200756 - DNA, 20 bp, human
gggtcctggatcgcctccta

SEQ ID NO: 200757 - DNA, 20 bp, human
gaggttgggagccttcaatc

SEQ ID NO: 200758 - DNA, 20 bp, human
gtggatcgcctcctagggag

SEQ ID NO: 200759 - DNA, 20 bp, human
gggccggccgagggccgcag

SEQ ID NO: 200760 - DNA, 20 bp, human
gcgctcccggggagcgagag

SEQ ID NO: 200761 - DNA, 20 bp, human
ggtcccagcagctcccgctg

SEQ ID NO: 200762 - DNA, 20 bp, human
gcaatacctcgaatcaggag

SEQ ID NO: 200763 - DNA, 20 bp, human
gtacctcgaatcaggagggg

SEQ ID NO: 200764 - DNA, 20 bp, human
gaggacgccccctccctagg

SEQ ID NO: 200765 - DNA, 20 bp, human
gctcgaatcaggaggggagg

SEQ ID NO: 200766 - DNA, 20 bp, human
gcgcagagctgacagcgata

SEQ ID NO: 200767 - DNA, 20 bp, human
gcgcaccactgcccggtgtg

SEQ ID NO: 200768 - DNA, 20 bp, human
gaggagcgagccgtgcccga

SEQ ID NO: 200769 - DNA, 20 bp, human
gcgcactgcggacacgggta

SEQ ID NO: 200770 - DNA, 20 bp, human
ggagaagccgcaccactgcc

SEQ ID NO: 200771 - DNA, 20 bp, human
gcacccgtttgtgcttggtg

SEQ ID NO: 200772 - DNA, 20 bp, human
ggcgcacaccgggcacttgt

SEQ ID NO: 200773 - DNA, 20 bp, human
gcactgcccggtgtgtggca

SEQ ID NO: 200774 - DNA, 20 bp, human
gagcacaaacgggtgcatga

SEQ ID NO: 200775 - DNA, 20 bp, human
ggaagcccttggcgcacacc

SEQ ID NO: 200776 - DNA, 20 bp, human
ggggtaggaagtgtctcccg

SEQ ID NO: 200777 - DNA, 20 bp, human
gctccggctctggctcgctg

SEQ ID NO: 200778 - DNA, 20 bp, human
ggtctcccgcggcgtgtctg

SEQ ID NO: 200779 - DNA, 20 bp, human
ggaacagcaggcgacccgga

SEQ ID NO: 200780 - DNA, 20 bp, human
gaagtgaacagcaggcgacc

SEQ ID NO: 200781 - DNA, 20 bp, human
gaccagccccagacacgccg

SEQ ID NO: 200782 - DNA, 20 bp, human
gccggcccccgcccgcaact

SEQ ID NO: 200783 - DNA, 20 bp, human
ggcagcccgtccggccccgg

SEQ ID NO: 200784 - DNA, 20 bp, human
gctcggcgcaactttcccgc

SEQ ID NO: 200785 - DNA, 20 bp, human
ggagccgcgcgcaaaccttc

SEQ ID NO: 200786 - DNA, 20 bp, human
ggcagcagcagcaacaagtc

SEQ ID NO: 200787 - DNA, 20 bp, human
gtgatgctgcgggagcgaag

SEQ ID NO: 200788 - DNA, 20 bp, human
gctggcacgcagcggagagg

SEQ ID NO: 200789 - DNA, 20 bp, human
gggccaaagacgctgacaag

SEQ ID NO: 200790 - DNA, 20 bp, human
gcagcaacaagtcgggtaag

SEQ ID NO: 200791 - DNA, 20 bp, human
gaatccactctggcacccgt

SEQ ID NO: 200792 - DNA, 20 bp, human
ggggggcaatgggaaaaggg

SEQ ID NO: 200793 - DNA, 20 bp, human
gaagacgctgacaagaggta

SEQ ID NO: 200794 - DNA, 20 bp, human
gcagcccacgggtgccagag

SEQ ID NO: 200795 - DNA, 20 bp, human
gagccgcgggcgcagatggc

SEQ ID NO: 200796 - DNA, 20 bp, human
gtgggagaaccaggagccac

SEQ ID NO: 200797 - DNA, 20 bp, human
ggagagcagggatcaggtaa

SEQ ID NO: 200798 - DNA, 20 bp, human
gctcccaggacacagtactg

SEQ ID NO: 200799 - DNA, 20 bp, human
gtgtcctgggagccttatca

SEQ ID NO: 200800 - DNA, 20 bp, human
gcctgggtggatactgctgt

SEQ ID NO: 200801 - DNA, 20 bp, human
ggacacatctcacacgccag

SEQ ID NO: 200802 - DNA, 20 bp, human
gttaaggactactcccagta

SEQ ID NO: 200803 - DNA, 20 bp, human
ggcctgcagcctctggtatc

SEQ ID NO: 200804 - DNA, 20 bp, human
gtggacaggacaggccacta

SEQ ID NO: 200805 - DNA, 20 bp, human
gctgatgctttgcagaacta

SEQ ID NO: 200806 - DNA, 20 bp, human
gcacccgcttcggggagtcg

SEQ ID NO: 200807 - DNA, 20 bp, human
gtgtaacgcgggaaaagccg

SEQ ID NO: 200808 - DNA, 20 bp, human
gtcggagcagagcgagtgag

SEQ ID NO: 200809 - DNA, 20 bp, human
gcgtggcagaagatgacggg

SEQ ID NO: 200810 - DNA, 20 bp, human
gccgcacgttggcttgatcg

SEQ ID NO: 200811 - DNA, 20 bp, human
gctgccacgactccccgaag

SEQ ID NO: 200812 - DNA, 20 bp, human
gggctggtggggatgagcgg

SEQ ID NO: 200813 - DNA, 20 bp, human
gccgaagcgggtgctggtgt

SEQ ID NO: 200814 - DNA, 20 bp, human
gcttgcggtgacaggaaagc

SEQ ID NO: 200815 - DNA, 20 bp, human
gcgctgcggagtacaaagag

SEQ ID NO: 200816 - DNA, 20 bp, human
ggagccgcttcgggccttct

SEQ ID NO: 200817 - DNA, 20 bp, human
gatgcccagaaggcccgaag

SEQ ID NO: 200818 - DNA, 20 bp, human
gaaacaaacctggagccata

SEQ ID NO: 200819 - DNA, 20 bp, human
gccgcggcgacgccgaccac

SEQ ID NO: 200820 - DNA, 20 bp, human
gtctgggcatgtctgccata

SEQ ID NO: 200821 - DNA, 20 bp, human
gagagaagcgcgcatctatt

SEQ ID NO: 200822 - DNA, 20 bp, human
gcctccccgtcagagtgccg

SEQ ID NO: 200823 - DNA, 20 bp, human
gccggggagaaaaacaaacc

SEQ ID NO: 200824 - DNA, 20 bp, human
gtctccccggcactctgacg

SEQ ID NO: 200825 - DNA, 20 bp, human
gggacgcggagggtgagtaa

SEQ ID NO: 200826 - DNA, 20 bp, human
gcacggacgcagccacagaa

SEQ ID NO: 200827 - DNA, 20 bp, human
ggcgggcgcgcgctgaatag

SEQ ID NO: 200828 - DNA, 20 bp, human
gggcgcagacgactcaccct

SEQ ID NO: 200829 - DNA, 20 bp, human
gacgactcaccctgggccgg

SEQ ID NO: 200830 - DNA, 20 bp, human
gggcgcgcgctgaatagggg

SEQ ID NO: 200831 - DNA, 20 bp, human
gaggcccggctcgtacagat

SEQ ID NO: 200832 - DNA, 20 bp, human
gtcgctccgggtcaccctca

SEQ ID NO: 200833 - DNA, 20 bp, human
ggttccgggagagctgtcta

SEQ ID NO: 200834 - DNA, 20 bp, human
ggccgggcctggaaattctg

SEQ ID NO: 200835 - DNA, 20 bp, human
ggcttccgcgggatcagaac

SEQ ID NO: 200836 - DNA, 20 bp, human
gcacacccgcgcacacagag

SEQ ID NO: 200837 - DNA, 20 bp, human
gagaggcccccgcgagtcca

SEQ ID NO: 200838 - DNA, 20 bp, human
gccctccgcctcaagggtag

SEQ ID NO: 200839 - DNA, 20 bp, human
gatggtaccggccaacccca

SEQ ID NO: 200840 - DNA, 20 bp, human
gagccgagcctgcaagaccc

SEQ ID NO: 200841 - DNA, 20 bp, human
gggcccgcaggtacgtgcat

SEQ ID NO: 200842 - DNA, 20 bp, human
gcaagggtaggggaagtgcg

SEQ ID NO: 200843 - DNA, 20 bp, human
ggtccagcaggcaaatgaag

SEQ ID NO: 200844 - DNA, 20 bp, human
gtgctggaccctccgcctca

SEQ ID NO: 200845 - DNA, 20 bp, human
gagtgcgcggtgagcggcct

SEQ ID NO: 200846 - DNA, 20 bp, human
gtggcgcgcgccggctgtag

SEQ ID NO: 200847 - DNA, 20 bp, human
ggcgggcgatgggaaggaat

SEQ ID NO: 200848 - DNA, 20 bp, human
ggcgccggaaacgaaaaggg

SEQ ID NO: 200849 - DNA, 20 bp, human
gcggcgcgagactcaccggg

SEQ ID NO: 200850 - DNA, 20 bp, human
gagctctgcggagagaaggc

SEQ ID NO: 200851 - DNA, 20 bp, human
ggtggcagagttcagctccc

SEQ ID NO: 200852 - DNA, 20 bp, human
gtccgtcccggaaccggaag

SEQ ID NO: 200853 - DNA, 20 bp, human
gaggagggacgtcccaagga

SEQ ID NO: 200854 - DNA, 20 bp, human
ggcgcgcgggcacgcacttc

SEQ ID NO: 200855 - DNA, 20 bp, human
gcagagttcagctccctgga

SEQ ID NO: 200856 - DNA, 20 bp, human
gcctggctagggagtgggac

SEQ ID NO: 200857 - DNA, 20 bp, human
gtagttgctgaagaggccaa

SEQ ID NO: 200858 - DNA, 20 bp, human
ggggctggctcgagtgggaa

SEQ ID NO: 200859 - DNA, 20 bp, human
gtctgcttgaggtccagtgg

SEQ ID NO: 200860 - DNA, 20 bp, human
gagggcccctgcctctgcta

SEQ ID NO: 200861 - DNA, 20 bp, human
ggtgggggctgcatgatcgg

SEQ ID NO: 200862 - DNA, 20 bp, human
gagggtgacacttctgagtg

SEQ ID NO: 200863 - DNA, 20 bp, human
gaggaagatggggtcataag

SEQ ID NO: 200864 - DNA, 20 bp, human
gggatctgcttgaggtccag

SEQ ID NO: 200865 - DNA, 20 bp, human
gtgtacactatgtgcactga

SEQ ID NO: 200866 - DNA, 20 bp, human
gcgggcggccgcagtcaccg

SEQ ID NO: 200867 - DNA, 20 bp, human
gtcaccgcggtgccgggaga

SEQ ID NO: 200868 - DNA, 20 bp, human
gcccccgggacagagcgacg

SEQ ID NO: 200869 - DNA, 20 bp, human
gcagagcgacgcggaacccc

SEQ ID NO: 200870 - DNA, 20 bp, human
gacccccagcccggccagaa

SEQ ID NO: 200871 - DNA, 20 bp, human
gggaaccggtcgctgacggg

SEQ ID NO: 200872 - DNA, 20 bp, human
gcccggccagaacggccccc

SEQ ID NO: 200873 - DNA, 20 bp, human
gtcgcagagaccactcaccg

SEQ ID NO: 200874 - DNA, 20 bp, human
gaccagtctacgagaggctg

SEQ ID NO: 200875 - DNA, 20 bp, human
ggttccgcgtcgctctgtcc

SEQ ID NO: 200876 - DNA, 20 bp, human
ggcgggaccgcagcaaccac

SEQ ID NO: 200877 - DNA, 20 bp, human
gcaagagttggacagttcag

SEQ ID NO: 200878 - DNA, 20 bp, human
gtcccgccagggctgcaccg

SEQ ID NO: 200879 - DNA, 20 bp, human
gtactaagcagagacttgcg

SEQ ID NO: 200880 - DNA, 20 bp, human
gcggcgcgcgagagtggcgt

SEQ ID NO: 200881 - DNA, 20 bp, human
ggcgcgccgaggtaagctct

SEQ ID NO: 200882 - DNA, 20 bp, human
gtcgcgcgccgaagctgtga

SEQ ID NO: 200883 - DNA, 20 bp, human
gcagcttcggcgcgcgagag

SEQ ID NO: 200884 - DNA, 20 bp, human
gatgaggcggaaccgttcgg

SEQ ID NO: 200885 - DNA, 20 bp, human
gggcgccctcctctacaagt

SEQ ID NO: 200886 - DNA, 20 bp, human
gtgggcttaggtggttctgg

SEQ ID NO: 200887 - DNA, 20 bp, human
gtccgagaggtcctacagaa

SEQ ID NO: 200888 - DNA, 20 bp, human
gactcagcagctccagatat

SEQ ID NO: 200889 - DNA, 20 bp, human
gccacccccaccggctgaga

SEQ ID NO: 200890 - DNA, 20 bp, human
gccagacgcaaagaccccca

SEQ ID NO: 200891 - DNA, 20 bp, human
gaggacctctcggaatctgt

SEQ ID NO: 200892 - DNA, 20 bp, human
gacgcaaagacccccatgga

SEQ ID NO: 200893 - DNA, 20 bp, human
ggaccctaagaccccattga

SEQ ID NO: 200894 - DNA, 20 bp, human
ggcccaagcgagaaagaaag

SEQ ID NO: 200895 - DNA, 20 bp, human
ggtctccttctcagccggtg

SEQ ID NO: 200896 - DNA, 20 bp, human
ggaggagtcggattacagta

SEQ ID NO: 200897 - DNA, 20 bp, human
gggacatcgcaaggaggagt

SEQ ID NO: 200898 - DNA, 20 bp, human
ggtcggattacagtaaggat

SEQ ID NO: 200899 - DNA, 20 bp, human
gccagggctaagatccccgg

SEQ ID NO: 200900 - DNA, 20 bp, human
gcggcaaggacatcgcaagg

SEQ ID NO: 200901 - DNA, 20 bp, human
ggcgcggcaaggacatcgca

SEQ ID NO: 200902 - DNA, 20 bp, human
gccagttgccaactggaggt

SEQ ID NO: 200903 - DNA, 20 bp, human
gggggatcttagccctggaa

SEQ ID NO: 200904 - DNA, 20 bp, human
gagccccagttgtggcacaa

SEQ ID NO: 200905 - DNA, 20 bp, human
gtaaggatgggcagtgcagc

SEQ ID NO: 200906 - DNA, 20 bp, human
gcccgcccggggtgtgtcgg

SEQ ID NO: 200907 - DNA, 20 bp, human
gcaagtgcgggacccgcccg

SEQ ID NO: 200908 - DNA, 20 bp, human
gagggccccgggaccaaggt

SEQ ID NO: 200909 - DNA, 20 bp, human
gagtacccccgacacacccc

SEQ ID NO: 200910 - DNA, 20 bp, human
gccggtgagtgaggcttaca

SEQ ID NO: 200911 - DNA, 20 bp, human
gtcaggttccgctccaagtg

SEQ ID NO: 200912 - DNA, 20 bp, human
gctcactcaccggccgcctc

SEQ ID NO: 200913 - DNA, 20 bp, human
gggccagcctagtccctctg

SEQ ID NO: 200914 - DNA, 20 bp, human
ggggtcaggaggcacctcca

SEQ ID NO: 200915 - DNA, 20 bp, human
gagggaggtcttcggtactg

SEQ ID NO: 200916 - DNA, 20 bp, human
gcagctgcgttaccaggagg

SEQ ID NO: 200917 - DNA, 20 bp, human
gaggcagctgcgttaccagg

SEQ ID NO: 200918 - DNA, 20 bp, human
ggtttgaccgagagagttgt

SEQ ID NO: 200919 - DNA, 20 bp, human
ggaggtggctggaccggaag

SEQ ID NO: 200920 - DNA, 20 bp, human
gtaccaggaggtggctggac

SEQ ID NO: 200921 - DNA, 20 bp, human
ggctccgagaactctgtcgt

SEQ ID NO: 200922 - DNA, 20 bp, human
gagttgtaggcgcaaagctg

SEQ ID NO: 200923 - DNA, 20 bp, human
gaggaaaggagagtgtggag

SEQ ID NO: 200924 - DNA, 20 bp, human
gagacccgagctgctctcca

SEQ ID NO: 200925 - DNA, 20 bp, human
gtgggagcccaactatcccg

SEQ ID NO: 200926 - DNA, 20 bp, human
ggtgggcgccaaccgagcct

SEQ ID NO: 200927 - DNA, 20 bp, human
gccgcccgccgaggctcggt

SEQ ID NO: 200928 - DNA, 20 bp, human
ggcgccaaccgagcctcggc

SEQ ID NO: 200929 - DNA, 20 bp, human
ggcggagggcgaggtaaaca

SEQ ID NO: 200930 - DNA, 20 bp, human
gcggtccctgtccctgcgag

SEQ ID NO: 200931 - DNA, 20 bp, human
ggtcccgactgcccgaagtc

SEQ ID NO: 200932 - DNA, 20 bp, human
ggagggggctccgagagtgg

SEQ ID NO: 200933 - DNA, 20 bp, human
ggactgcccgaagtcgggag

SEQ ID NO: 200934 - DNA, 20 bp, human
ggagctgcgcggggacctag

SEQ ID NO: 200935 - DNA, 20 bp, human
gacaaggcgacgcgcgggag

SEQ ID NO: 200936 - DNA, 20 bp, human
gcgccgtcggggagaaaccg

SEQ ID NO: 200937 - DNA, 20 bp, human
ggtccgccggggaaggacga

SEQ ID NO: 200938 - DNA, 20 bp, human
gcgtcgggaggtgagacccg

SEQ ID NO: 200939 - DNA, 20 bp, human
ggagccggcccaccacagca

SEQ ID NO: 200940 - DNA, 20 bp, human
gcagcctgggggccctaaag

SEQ ID NO: 200941 - DNA, 20 bp, human
gagcagggtagagccgagag

SEQ ID NO: 200942 - DNA, 20 bp, human
gaaggggtgcgcggactcag

SEQ ID NO: 200943 - DNA, 20 bp, human
gatcaaagcctgggacgcag

SEQ ID NO: 200944 - DNA, 20 bp, human
gtctcacctcccgacgccgt

SEQ ID NO: 200945 - DNA, 20 bp, human
ggcccccaggctgcggtcag

SEQ ID NO: 200946 - DNA, 20 bp, human
gaagcgactggggaactcag

SEQ ID NO: 200947 - DNA, 20 bp, human
gtgggcccctaggaagaggg

SEQ ID NO: 200948 - DNA, 20 bp, human
ggacgtgggcccctaggaag

SEQ ID NO: 200949 - DNA, 20 bp, human
gcgactggggaactcagagg

SEQ ID NO: 200950 - DNA, 20 bp, human
gaggatggcgagatatcgat

SEQ ID NO: 200951 - DNA, 20 bp, human
ggcttcgcggtgagggacgt

SEQ ID NO: 200952 - DNA, 20 bp, human
gtacgaagtcacggggtcag

SEQ ID NO: 200953 - DNA, 20 bp, human
ggtccctcaccgcgaagccc

SEQ ID NO: 200954 - DNA, 20 bp, human
gtcatttcctggccgctcct

SEQ ID NO: 200955 - DNA, 20 bp, human
gtggccgctcctgggcttcg

SEQ ID NO: 200956 - DNA, 20 bp, human
gccacaaagcgccagctgag

SEQ ID NO: 200957 - DNA, 20 bp, human
gcaggcggcggatcaagctg

SEQ ID NO: 200958 - DNA, 20 bp, human
gcgccgcactccacccgcag

SEQ ID NO: 200959 - DNA, 20 bp, human
gcccgagacccagaccccga

SEQ ID NO: 200960 - DNA, 20 bp, human
gcgagaacggcgcctatgcc

SEQ ID NO: 200961 - DNA, 20 bp, human
ggcacgggcgacaggcgacg

SEQ ID NO: 200962 - DNA, 20 bp, human
gctcgcgtgaggggacttag

SEQ ID NO: 200963 - DNA, 20 bp, human
ggccgcctgtggagaggacc

SEQ ID NO: 200964 - DNA, 20 bp, human
ggcctgtcgcccgtgcttgg

SEQ ID NO: 200965 - DNA, 20 bp, human
gggatcaagctggggtcgcg

SEQ ID NO: 200966 - DNA, 20 bp, human
gcatcaactcacccgggcca

SEQ ID NO: 200967 - DNA, 20 bp, human
gttctgagataggaggtttc

SEQ ID NO: 200968 - DNA, 20 bp, human
gagattcaggtgctgaatgg

SEQ ID NO: 200969 - DNA, 20 bp, human
gagggcagaggcaggcataa

SEQ ID NO: 200970 - DNA, 20 bp, human
gatatttaaactcggatcag

SEQ ID NO: 200971 - DNA, 20 bp, human
gatactaacttggtctcatt

SEQ ID NO: 200972 - DNA, 20 bp, human
gcttcctacataaaaaacca

SEQ ID NO: 200973 - DNA, 20 bp, human
gaagaagtaattataggaca

SEQ ID NO: 200974 - DNA, 20 bp, human
ggaagtttgttaggtggaat

SEQ ID NO: 200975 - DNA, 20 bp, human
gaaaccatggttttttatgt

SEQ ID NO: 200976 - DNA, 20 bp, human
gggcccaccgtcttcattat

SEQ ID NO: 200977 - DNA, 20 bp, human
ggattctctttccagatcaa

SEQ ID NO: 200978 - DNA, 20 bp, human
ggtgctaaaattgcaagaag

SEQ ID NO: 200979 - DNA, 20 bp, human
gtgagtgactgcacagttgg

SEQ ID NO: 200980 - DNA, 20 bp, human
gaaacgcaggaaattagatg

SEQ ID NO: 200981 - DNA, 20 bp, human
gaataaacccgaaaatgatg

SEQ ID NO: 200982 - DNA, 20 bp, human
gatcccataatgaagacggt

SEQ ID NO: 200983 - DNA, 20 bp, human
gaggcagagccccttaaatc

SEQ ID NO: 200984 - DNA, 20 bp, human
ggaaatggtttcccttgatc

SEQ ID NO: 200985 - DNA, 20 bp, human
ggtcagcactttattaatga

SEQ ID NO: 200986 - DNA, 20 bp, human
gtgacccggaatggaggagg

SEQ ID NO: 200987 - DNA, 20 bp, human
gttctgacccggaatggagg

SEQ ID NO: 200988 - DNA, 20 bp, human
gggaagaaggcgctgcaact

SEQ ID NO: 200989 - DNA, 20 bp, human
gcaggtgagggctctaagga

SEQ ID NO: 200990 - DNA, 20 bp, human
gaagcgaggatgtctcgggt

SEQ ID NO: 200991 - DNA, 20 bp, human
ggctcacttccggcgtaggg

SEQ ID NO: 200992 - DNA, 20 bp, human
gcgtacagccttctccggaa

SEQ ID NO: 200993 - DNA, 20 bp, human
ggctttctgacccggaatgg

SEQ ID NO: 200994 - DNA, 20 bp, human
ggggacaggtgagggctcta

SEQ ID NO: 200995 - DNA, 20 bp, human
gagaagaggaagctcacttc

SEQ ID NO: 200996 - DNA, 20 bp, human
gctccttgggagtgtctcta

SEQ ID NO: 200997 - DNA, 20 bp, human
gccactggaaaatcccacag

SEQ ID NO: 200998 - DNA, 20 bp, human
gcgcggcaactgcacaggtt

SEQ ID NO: 200999 - DNA, 20 bp, human
gacacgcacgactccccccg

SEQ ID NO: 201000 - DNA, 20 bp, human
gccccccgcggcaactgcac

SEQ ID NO: 201001 - DNA, 20 bp, human
gtaactcctagaggctgcgg

SEQ ID NO: 201002 - DNA, 20 bp, human
ggtcccacagagcagtgcgg

SEQ ID NO: 201003 - DNA, 20 bp, human
gggaggtgactaactcctag

SEQ ID NO: 201004 - DNA, 20 bp, human
gcgggaaacactcggcgtct

SEQ ID NO: 201005 - DNA, 20 bp, human
gaggcggaggctccccggta

SEQ ID NO: 201006 - DNA, 20 bp, human
gagagggcgggggccagtac

SEQ ID NO: 201007 - DNA, 20 bp, human
gggtactacctaaccgagga

SEQ ID NO: 201008 - DNA, 20 bp, human
gaagccggccggccgtcagt

SEQ ID NO: 201009 - DNA, 20 bp, human
gggaattcgggaccgactga

SEQ ID NO: 201010 - DNA, 20 bp, human
gataaggccccaaggtccgt

SEQ ID NO: 201011 - DNA, 20 bp, human
gaactggaaggtgagctccg

SEQ ID NO: 201012 - DNA, 20 bp, human
ggcgctcgagctgcttccgg

SEQ ID NO: 201013 - DNA, 20 bp, human
gttcgggaccgactgacggc

SEQ ID NO: 201014 - DNA, 20 bp, human
gcctctaccccacaccacaa

SEQ ID NO: 201015 - DNA, 20 bp, human
gggaccgactgacggccggc

SEQ ID NO: 201016 - DNA, 20 bp, human
gactcgcactgcccagaggg

SEQ ID NO: 201017 - DNA, 20 bp, human
gagcgtggcctagagggagt

SEQ ID NO: 201018 - DNA, 20 bp, human
gttaggcggcggccaccctc

SEQ ID NO: 201019 - DNA, 20 bp, human
gtctcgcgagagctgagagg

SEQ ID NO: 201020 - DNA, 20 bp, human
gccggcggctgcagcttagg

SEQ ID NO: 201021 - DNA, 20 bp, human
gatgctagaggagctagaca

SEQ ID NO: 201022 - DNA, 20 bp, human
gtggactgggaagatgctag

SEQ ID NO: 201023 - DNA, 20 bp, human
gcgaccccgcccccacatcc

SEQ ID NO: 201024 - DNA, 20 bp, human
gtcagctctcgcgagactgg

SEQ ID NO: 201025 - DNA, 20 bp, human
gccggagccgcagaaacaag

SEQ ID NO: 201026 - DNA, 20 bp, human
gtcgcgttgggtgaaggtga

SEQ ID NO: 201027 - DNA, 20 bp, human
gcgacagcgccttcagacag

SEQ ID NO: 201028 - DNA, 20 bp, human
ggcaggtttaatctacacag

SEQ ID NO: 201029 - DNA, 20 bp, human
gggaccaggcagaggacgca

SEQ ID NO: 201030 - DNA, 20 bp, human
gcagcgccttcagacagggg

SEQ ID NO: 201031 - DNA, 20 bp, human
gccgtatcgaccctggacat

SEQ ID NO: 201032 - DNA, 20 bp, human
gaacggatcgcgttgggtga

SEQ ID NO: 201033 - DNA, 20 bp, human
gcagaggacgcaaggctccc

SEQ ID NO: 201034 - DNA, 20 bp, human
gcgaggcctgtattcacctg

SEQ ID NO: 201035 - DNA, 20 bp, human
ggagccttgcgtcctctgcc

SEQ ID NO: 201036 - DNA, 20 bp, human
ggacccccgctctgtgccgg

SEQ ID NO: 201037 - DNA, 20 bp, human
ggagggtgtggcaggcggag

SEQ ID NO: 201038 - DNA, 20 bp, human
ggcagcgtttctaactcagg

SEQ ID NO: 201039 - DNA, 20 bp, human
ggaggcagcgtttctaactc

SEQ ID NO: 201040 - DNA, 20 bp, human
gactcaggcggcgtgggccg

SEQ ID NO: 201041 - DNA, 20 bp, human
gtgcctccggcacagagcgg

SEQ ID NO: 201042 - DNA, 20 bp, human
gaccagcgccagcgacccac

SEQ ID NO: 201043 - DNA, 20 bp, human
gcgctccgagatggtaattt

SEQ ID NO: 201044 - DNA, 20 bp, human
gtttctaactcaggcggcgt

SEQ ID NO: 201045 - DNA, 20 bp, human
ggtgcttagggattcgactt

SEQ ID NO: 201046 - DNA, 20 bp, human
gggtccccccccagcactca

SEQ ID NO: 201047 - DNA, 20 bp, human
gcggctgtgtatcggtgacg

SEQ ID NO: 201048 - DNA, 20 bp, human
ggttacacagggacccccac

SEQ ID NO: 201049 - DNA, 20 bp, human
gcagagccgtcaggctgttc

SEQ ID NO: 201050 - DNA, 20 bp, human
gctgtgtaactgtccagtgg

SEQ ID NO: 201051 - DNA, 20 bp, human
ggtcaggctgttctggagac

SEQ ID NO: 201052 - DNA, 20 bp, human
ggcgccgaggcgcccgactc

SEQ ID NO: 201053 - DNA, 20 bp, human
gtaattgacgcagagccgtc

SEQ ID NO: 201054 - DNA, 20 bp, human
gacactgaggcgctcgcagg

SEQ ID NO: 201055 - DNA, 20 bp, human
gcgccacaattacctgagtc

SEQ ID NO: 201056 - DNA, 20 bp, human
ggagctatgggtccgaaccg

SEQ ID NO: 201057 - DNA, 20 bp, human
ggtgtgcgcacgtaacgtag

SEQ ID NO: 201058 - DNA, 20 bp, human
gatggcctggaggacagacc

SEQ ID NO: 201059 - DNA, 20 bp, human
gcaggattcgggttaggatg

SEQ ID NO: 201060 - DNA, 20 bp, human
gtcctgaagcagcgagagag

SEQ ID NO: 201061 - DNA, 20 bp, human
gtgagaggcgctggagctat

SEQ ID NO: 201062 - DNA, 20 bp, human
gaccggcgcgggctatggcc

SEQ ID NO: 201063 - DNA, 20 bp, human
gacaggcacagggaccggcg

SEQ ID NO: 201064 - DNA, 20 bp, human
gctgcggtttgtgaggtgag

SEQ ID NO: 201065 - DNA, 20 bp, human
gctgcttcaggattcgggtt

SEQ ID NO: 201066 - DNA, 20 bp, human
gccagcgccggaaggcacgg

SEQ ID NO: 201067 - DNA, 20 bp, human
gagaagctggttgtgcgctg

SEQ ID NO: 201068 - DNA, 20 bp, human
ggaactaacctgcgagaagc

SEQ ID NO: 201069 - DNA, 20 bp, human
gcctgtgagtagagctggag

SEQ ID NO: 201070 - DNA, 20 bp, human
gtgaggcgaccagcgccgga

SEQ ID NO: 201071 - DNA, 20 bp, human
gcgaccagcgccggaaggca

SEQ ID NO: 201072 - DNA, 20 bp, human
gcgcacaaccagcttctcgc

SEQ ID NO: 201073 - DNA, 20 bp, human
gtactcacaggctccgatgg

SEQ ID NO: 201074 - DNA, 20 bp, human
gggacttccggcgtctcgtt

SEQ ID NO: 201075 - DNA, 20 bp, human
gctctactcacaggctccga

SEQ ID NO: 201076 - DNA, 20 bp, human
ggagagggccgcgtctgtgg

SEQ ID NO: 201077 - DNA, 20 bp, human
gggctggcgaacccgaaatt

SEQ ID NO: 201078 - DNA, 20 bp, human
gacaggcagtcgccaatacc

SEQ ID NO: 201079 - DNA, 20 bp, human
gagatttggaggcctcgcgt

SEQ ID NO: 201080 - DNA, 20 bp, human
ggaacccgggagccagatct

SEQ ID NO: 201081 - DNA, 20 bp, human
ggaggcctcgcgtggggaga

SEQ ID NO: 201082 - DNA, 20 bp, human
ggacactcctaccttgacag

SEQ ID NO: 201083 - DNA, 20 bp, human
gccgcgtctgtggaggagct

SEQ ID NO: 201084 - DNA, 20 bp, human
gtcgggttcgccagcccagc

SEQ ID NO: 201085 - DNA, 20 bp, human
ggcttggctccgcacctgct

SEQ ID NO: 201086 - DNA, 20 bp, human
gagggtccccgctgcaacag

SEQ ID NO: 201087 - DNA, 20 bp, human
gcaacagtggtcctcttcag

SEQ ID NO: 201088 - DNA, 20 bp, human
gccggaatgtccccctgaag

SEQ ID NO: 201089 - DNA, 20 bp, human
gcagcggggaccctcctttc

SEQ ID NO: 201090 - DNA, 20 bp, human
gttatcacaggcaaggaaca

SEQ ID NO: 201091 - DNA, 20 bp, human
gaaagggacatgataaaatg

SEQ ID NO: 201092 - DNA, 20 bp, human
gaagaggaccactgttgcag

SEQ ID NO: 201093 - DNA, 20 bp, human
gccttccccaatcacacagg

SEQ ID NO: 201094 - DNA, 20 bp, human
gttgggatcgaagattaagg

SEQ ID NO: 201095 - DNA, 20 bp, human
gctgttattcttattatcac

SEQ ID NO: 201096 - DNA, 20 bp, human
ggacatggatgcataagaag

SEQ ID NO: 201097 - DNA, 20 bp, human
ggcccctagctgagtcagaa

SEQ ID NO: 201098 - DNA, 20 bp, human
gccttgcctggggaggatga

SEQ ID NO: 201099 - DNA, 20 bp, human
gagggaagtaggcagacaga

SEQ ID NO: 201100 - DNA, 20 bp, human
gttcccccaggaaaacttcc

SEQ ID NO: 201101 - DNA, 20 bp, human
gcataagaagaggggtgagc

SEQ ID NO: 201102 - DNA, 20 bp, human
ggtaaaatccatccttctcc

SEQ ID NO: 201103 - DNA, 20 bp, human
gtcccttctgactcagctag

SEQ ID NO: 201104 - DNA, 20 bp, human
gtcagctaggggccttgcct

SEQ ID NO: 201105 - DNA, 20 bp, human
gtttaaatccaagttagatg

SEQ ID NO: 201106 - DNA, 20 bp, human
gcagccctgctggcccccaa

SEQ ID NO: 201107 - DNA, 20 bp, human
gggccagcagggctgtacct

SEQ ID NO: 201108 - DNA, 20 bp, human
gcagggctgtacctgggagt

SEQ ID NO: 201109 - DNA, 20 bp, human
gcaggcagggccggttcgtg

SEQ ID NO: 201110 - DNA, 20 bp, human
gctgtacctgggagttgggt

SEQ ID NO: 201111 - DNA, 20 bp, human
gggtccgcgtccagggagtg

SEQ ID NO: 201112 - DNA, 20 bp, human
gggggaggccgtgccaggca

SEQ ID NO: 201113 - DNA, 20 bp, human
gcggtaagaagggccggtgg

SEQ ID NO: 201114 - DNA, 20 bp, human
ggaagccggctcggccatgg

SEQ ID NO: 201115 - DNA, 20 bp, human
gactcagaggcaccgcgcga

SEQ ID NO: 201116 - DNA, 20 bp, human
ggtgaggccttaactctgaa

SEQ ID NO: 201117 - DNA, 20 bp, human
gctggcctgggtgagttccg

SEQ ID NO: 201118 - DNA, 20 bp, human
gatctcctcggaactcaccc

SEQ ID NO: 201119 - DNA, 20 bp, human
ggtgagcactgggtgaaagt

SEQ ID NO: 201120 - DNA, 20 bp, human
ggccggcgtcacaaaaggaa

SEQ ID NO: 201121 - DNA, 20 bp, human
gggtgaaagttggttctagg

SEQ ID NO: 201122 - DNA, 20 bp, human
gcgaggagcgacggtccgag

SEQ ID NO: 201123 - DNA, 20 bp, human
ggccaggcctctctaacgtc

SEQ ID NO: 201124 - DNA, 20 bp, human
ggttaaggcctcactggcct

SEQ ID NO: 201125 - DNA, 20 bp, human
gcctgaaccgggaagatcct

SEQ ID NO: 201126 - DNA, 20 bp, human
gccccgctccggctctgcgg

SEQ ID NO: 201127 - DNA, 20 bp, human
gcgacgcaggcgcagaggct

SEQ ID NO: 201128 - DNA, 20 bp, human
gctgccgctgaccgtcctgg

SEQ ID NO: 201129 - DNA, 20 bp, human
gacttgcgacgcaggcgcag

SEQ ID NO: 201130 - DNA, 20 bp, human
gaagcctccaggacggtcag

SEQ ID NO: 201131 - DNA, 20 bp, human
ggcgctccaagcctccagga

SEQ ID NO: 201132 - DNA, 20 bp, human
ggttctcccaggatgcccca

SEQ ID NO: 201133 - DNA, 20 bp, human
ggacggtcagcggcaggtgt

SEQ ID NO: 201134 - DNA, 20 bp, human
gctgggaaggtggtcgctat

SEQ ID NO: 201135 - DNA, 20 bp, human
gtggggccgtggtgacccga

SEQ ID NO: 201136 - DNA, 20 bp, human
ggctgggcctctaagaacaa

SEQ ID NO: 201137 - DNA, 20 bp, human
gccagacagggctacacgtc

SEQ ID NO: 201138 - DNA, 20 bp, human
gcgcagctggagcgacagga

SEQ ID NO: 201139 - DNA, 20 bp, human
gacgtcaggcacagtcactg

SEQ ID NO: 201140 - DNA, 20 bp, human
gccgccacggccacttctca

SEQ ID NO: 201141 - DNA, 20 bp, human
ggtcactgcggagggaagac

SEQ ID NO: 201142 - DNA, 20 bp, human
gcaggacggtttccggaata

SEQ ID NO: 201143 - DNA, 20 bp, human
gtggtcggaaccgtgagaag

SEQ ID NO: 201144 - DNA, 20 bp, human
gtcaggcacagtcactgcgg

SEQ ID NO: 201145 - DNA, 20 bp, human
gcaggtgagaatagtgactc

SEQ ID NO: 201146 - DNA, 20 bp, human
gccggcctgcagccctctgt

SEQ ID NO: 201147 - DNA, 20 bp, human
gtctcctgacgaccctcctg

SEQ ID NO: 201148 - DNA, 20 bp, human
gtgggagagacgccgcgttg

SEQ ID NO: 201149 - DNA, 20 bp, human
gcagctctgcagccgcaacg

SEQ ID NO: 201150 - DNA, 20 bp, human
ggtgatgcagtttcatgaat

SEQ ID NO: 201151 - DNA, 20 bp, human
gtgaaactgcatcacgagtc

SEQ ID NO: 201152 - DNA, 20 bp, human
gctgtggcccctgcacaatt

SEQ ID NO: 201153 - DNA, 20 bp, human
gctccggcacgcgcagattg

SEQ ID NO: 201154 - DNA, 20 bp, human
gtctctcccaaattgtgcag

SEQ ID NO: 201155 - DNA, 20 bp, human
gctgtgacctgcgggtattg

SEQ ID NO: 201156 - DNA, 20 bp, human
gggagaacgcggaaaagcag

SEQ ID NO: 201157 - DNA, 20 bp, human
gggctgcgacaaagtcaccg

SEQ ID NO: 201158 - DNA, 20 bp, human
ggatgcccggcggatgatcg

SEQ ID NO: 201159 - DNA, 20 bp, human
gggcgggtcccaaggtctag

SEQ ID NO: 201160 - DNA, 20 bp, human
gaaagcagaggcgggtccca

SEQ ID NO: 201161 - DNA, 20 bp, human
gattcccgagttggagaacg

SEQ ID NO: 201162 - DNA, 20 bp, human
gacagaaactgaagacccca

SEQ ID NO: 201163 - DNA, 20 bp, human
gtcaccggggattcccgagt

SEQ ID NO: 201164 - DNA, 20 bp, human
gcttgcagatcacagggtaa

SEQ ID NO: 201165 - DNA, 20 bp, human
ggcgccagcgaccaggactc

SEQ ID NO: 201166 - DNA, 20 bp, human
gggagctcaggccacagcga

SEQ ID NO: 201167 - DNA, 20 bp, human
gaccacgggaggatcgtcac

SEQ ID NO: 201168 - DNA, 20 bp, human
gcgtcacgggagaatcgtca

SEQ ID NO: 201169 - DNA, 20 bp, human
ggggcctttgtccctcgctg

SEQ ID NO: 201170 - DNA, 20 bp, human
gaggggctggttgtaatggg

SEQ ID NO: 201171 - DNA, 20 bp, human
ggggaggggctggttgtaat

SEQ ID NO: 201172 - DNA, 20 bp, human
gaggaagagacgggacgtgc

SEQ ID NO: 201173 - DNA, 20 bp, human
gggttgtaatgggtgggaag

SEQ ID NO: 201174 - DNA, 20 bp, human
gatgggaagaactttggtcc

SEQ ID NO: 201175 - DNA, 20 bp, human
gaggccacagcgagggacaa

SEQ ID NO: 201176 - DNA, 20 bp, human
ggagcagcgaaggggagacc

SEQ ID NO: 201177 - DNA, 20 bp, human
gcctagaggcccaacatctg

SEQ ID NO: 201178 - DNA, 20 bp, human
gagaggacacagagcagcga

SEQ ID NO: 201179 - DNA, 20 bp, human
gaggggacagttctgactcg

SEQ ID NO: 201180 - DNA, 20 bp, human
gtggcggctgtgctgacagt

SEQ ID NO: 201181 - DNA, 20 bp, human
gtcacagggccacagatgtt

SEQ ID NO: 201182 - DNA, 20 bp, human
gagaggaactgggaactcca

SEQ ID NO: 201183 - DNA, 20 bp, human
gtctctcgggatgtccgacc

SEQ ID NO: 201184 - DNA, 20 bp, human
ggtcccggtgtcttagctgt

SEQ ID NO: 201185 - DNA, 20 bp, human
gaagggctggttgtaaccgg

SEQ ID NO: 201186 - DNA, 20 bp, human
gcgcggctgaccgtctctgg

SEQ ID NO: 201187 - DNA, 20 bp, human
gctcgcgggtcactccccag

SEQ ID NO: 201188 - DNA, 20 bp, human
gcagggcgtggaaacgtggt

SEQ ID NO: 201189 - DNA, 20 bp, human
ggtgggagggagctttctga

SEQ ID NO: 201190 - DNA, 20 bp, human
ggctggtaggagtccctggt

SEQ ID NO: 201191 - DNA, 20 bp, human
gcgtctctggaggtttagag

SEQ ID NO: 201192 - DNA, 20 bp, human
gaaacgcggctgaccgtctc

SEQ ID NO: 201193 - DNA, 20 bp, human
ggagagtcaggtcagtgtgt

SEQ ID NO: 201194 - DNA, 20 bp, human
gcagaagtggaagaagttta

SEQ ID NO: 201195 - DNA, 20 bp, human
gtgttggtggcgctatatgg

SEQ ID NO: 201196 - DNA, 20 bp, human
gcaggcggcgagctgaggtt

SEQ ID NO: 201197 - DNA, 20 bp, human
gcgcctggagccgggaaccg

SEQ ID NO: 201198 - DNA, 20 bp, human
ggcgaaggccctgctctcct

SEQ ID NO: 201199 - DNA, 20 bp, human
ggcctgccgagtgtccatcg

SEQ ID NO: 201200 - DNA, 20 bp, human
ggcacaggcgacagaagcta

SEQ ID NO: 201201 - DNA, 20 bp, human
ggtagtccccgcacaatgtg

SEQ ID NO: 201202 - DNA, 20 bp, human
gggcacctgaaccctctcgg

SEQ ID NO: 201203 - DNA, 20 bp, human
gcggcgcttcgtccaatcag

SEQ ID NO: 201204 - DNA, 20 bp, human
gcagctcgccgcctggagcc

SEQ ID NO: 201205 - DNA, 20 bp, human
ggccgagtgtccatcgggga

SEQ ID NO: 201206 - DNA, 20 bp, human
gacagcagcggtctaacccc

SEQ ID NO: 201207 - DNA, 20 bp, human
gcctggtactaggcccctgg

SEQ ID NO: 201208 - DNA, 20 bp, human
ggagaaacgccggacgaggt

SEQ ID NO: 201209 - DNA, 20 bp, human
gaggtgggtaagcagagaca

SEQ ID NO: 201210 - DNA, 20 bp, human
gggcaatgccggaatctact

SEQ ID NO: 201211 - DNA, 20 bp, human
gatctactaggacagccccc

SEQ ID NO: 201212 - DNA, 20 bp, human
gcgcgggagggacccagcca

SEQ ID NO: 201213 - DNA, 20 bp, human
gtcgcgctcgagggtcaggg

SEQ ID NO: 201214 - DNA, 20 bp, human
gttagaccgctgctgtctca

SEQ ID NO: 201215 - DNA, 20 bp, human
gtagcagacagcgctgaagg

SEQ ID NO: 201216 - DNA, 20 bp, human
gcaggtctgagagaacgctg

SEQ ID NO: 201217 - DNA, 20 bp, human
gggcgaagcccagatatcgt

SEQ ID NO: 201218 - DNA, 20 bp, human
gtcagaaaccacaggctcat

SEQ ID NO: 201219 - DNA, 20 bp, human
gggatgagggaattagacaa

SEQ ID NO: 201220 - DNA, 20 bp, human
ggctcgctgtagccttggag

SEQ ID NO: 201221 - DNA, 20 bp, human
gcagatccctgagaccacag

SEQ ID NO: 201222 - DNA, 20 bp, human
gaagccgaaaacccgagtgg

SEQ ID NO: 201223 - DNA, 20 bp, human
gcaatggaagtcgagcactg

SEQ ID NO: 201224 - DNA, 20 bp, human
gaaagcaggcattctgcgtg

SEQ ID NO: 201225 - DNA, 20 bp, human
gcccgaggcctcagactcgc

SEQ ID NO: 201226 - DNA, 20 bp, human
gcacagcggggtgacgtcac

SEQ ID NO: 201227 - DNA, 20 bp, human
gtacagcgtgcgcgtcacag

SEQ ID NO: 201228 - DNA, 20 bp, human
ggctgggcggtagggacctg

SEQ ID NO: 201229 - DNA, 20 bp, human
ggtcacgggcccagcagtcg

SEQ ID NO: 201230 - DNA, 20 bp, human
gaggattcctattctctgag

SEQ ID NO: 201231 - DNA, 20 bp, human
gtgggagcgaggccttagaa

SEQ ID NO: 201232 - DNA, 20 bp, human
gtggcagctggcagtcccgg

SEQ ID NO: 201233 - DNA, 20 bp, human
ggagacgcgccccgccccag

SEQ ID NO: 201234 - DNA, 20 bp, human
gggaaaactgtaagtttacg

SEQ ID NO: 201235 - DNA, 20 bp, human
gacgggcccagcagtcgggg

SEQ ID NO: 201236 - DNA, 20 bp, human
gtaacagtaatgacttggag

SEQ ID NO: 201237 - DNA, 20 bp, human
ggaggagtgggcctcaccag

SEQ ID NO: 201238 - DNA, 20 bp, human
gggtcataacagtaatgact

SEQ ID NO: 201239 - DNA, 20 bp, human
ggggacttagtagagagaag

SEQ ID NO: 201240 - DNA, 20 bp, human
gtctctggtatgtatctatg

SEQ ID NO: 201241 - DNA, 20 bp, human
gagttcagtgtggctcacca

SEQ ID NO: 201242 - DNA, 20 bp, human
gtactaagtcccagaggagt

SEQ ID NO: 201243 - DNA, 20 bp, human
gtcaccaccactcagccttc

SEQ ID NO: 201244 - DNA, 20 bp, human
gtctctctactaagtcccag

SEQ ID NO: 201245 - DNA, 20 bp, human
ggttaaaagtgtgctttctc

SEQ ID NO: 201246 - DNA, 20 bp, human
gctcgcagcgacaaaggtga

SEQ ID NO: 201247 - DNA, 20 bp, human
ggccgccctcgcagcgacaa

SEQ ID NO: 201248 - DNA, 20 bp, human
gggccaaggccgcagtcgac

SEQ ID NO: 201249 - DNA, 20 bp, human
gggcgcggagctgcacaaaa

SEQ ID NO: 201250 - DNA, 20 bp, human
ggacagagcgacagaaatct

SEQ ID NO: 201251 - DNA, 20 bp, human
gcgcagtcgacgggcaggga

SEQ ID NO: 201252 - DNA, 20 bp, human
gcccgggtcccgccagttcc

SEQ ID NO: 201253 - DNA, 20 bp, human
gccgtgcctggatgcacagt

SEQ ID NO: 201254 - DNA, 20 bp, human
ggtccctctcggggctggaa

SEQ ID NO: 201255 - DNA, 20 bp, human
gcagaccgctgctcctccta

SEQ ID NO: 201256 - DNA, 20 bp, human
gagacgccctgggacatctg

SEQ ID NO: 201257 - DNA, 20 bp, human
ggtgacagaatacggaacag

SEQ ID NO: 201258 - DNA, 20 bp, human
ggtctctcagtgacagaata

SEQ ID NO: 201259 - DNA, 20 bp, human
gcgccctgggacatctgtgg

SEQ ID NO: 201260 - DNA, 20 bp, human
gcaactcccgtagtcagggt

SEQ ID NO: 201261 - DNA, 20 bp, human
gcgtccgggtgcagtgactt

SEQ ID NO: 201262 - DNA, 20 bp, human
gtgtgcggcggaaccagtac

SEQ ID NO: 201263 - DNA, 20 bp, human
gtctcacggaggcggatcta

SEQ ID NO: 201264 - DNA, 20 bp, human
gtgggacctaccctgactac

SEQ ID NO: 201265 - DNA, 20 bp, human
gtgtcactgagagacgccct

SEQ ID NO: 201266 - DNA, 20 bp, human
gcggctccggagcctaatct

SEQ ID NO: 201267 - DNA, 20 bp, human
gccgacagcggtcaggatct

SEQ ID NO: 201268 - DNA, 20 bp, human
gtgctgcgccgacagcggtc

SEQ ID NO: 201269 - DNA, 20 bp, human
ggctgtcggcgcagcactaa

SEQ ID NO: 201270 - DNA, 20 bp, human
gcggcgcagcactaaaggaa

SEQ ID NO: 201271 - DNA, 20 bp, human
ggcagcactaaaggaatgga

SEQ ID NO: 201272 - DNA, 20 bp, human
gtacagagcgacagaagctc

SEQ ID NO: 201273 - DNA, 20 bp, human
ggtggcccccgcataatgtg

SEQ ID NO: 201274 - DNA, 20 bp, human
gcactaaaggaatggacgga

SEQ ID NO: 201275 - DNA, 20 bp, human
ggggccacgggagggatatg

SEQ ID NO: 201276 - DNA, 20 bp, human
gtggccctggaggcctgtct

SEQ ID NO: 201277 - DNA, 20 bp, human
gctgcccagacaggcctcca

SEQ ID NO: 201278 - DNA, 20 bp, human
gaatcaggcgcactgaccgg

SEQ ID NO: 201279 - DNA, 20 bp, human
gaggcgcactgaccggagga

SEQ ID NO: 201280 - DNA, 20 bp, human
gcgtgagaggagagactggt

SEQ ID NO: 201281 - DNA, 20 bp, human
gagaacccggagcccagtgc

SEQ ID NO: 201282 - DNA, 20 bp, human
gctgggacccgcactgacag

SEQ ID NO: 201283 - DNA, 20 bp, human
gagctgcgccagggtgtcgc

SEQ ID NO: 201284 - DNA, 20 bp, human
gcgtgcggccgagggaaccg

SEQ ID NO: 201285 - DNA, 20 bp, human
ggtcaatcaggcgcactgac

SEQ ID NO: 201286 - DNA, 20 bp, human
gggttccccgctgccagcat

SEQ ID NO: 201287 - DNA, 20 bp, human
ggtcacgctgagtcctatgc

SEQ ID NO: 201288 - DNA, 20 bp, human
gccaggagcgggagctcaga

SEQ ID NO: 201289 - DNA, 20 bp, human
ggtgtcccgtgttctcccca

SEQ ID NO: 201290 - DNA, 20 bp, human
gctggcagcggggaaccttg

SEQ ID NO: 201291 - DNA, 20 bp, human
gctgagtcctatgctggcag

SEQ ID NO: 201292 - DNA, 20 bp, human
ggctgcaggccttggagtct

SEQ ID NO: 201293 - DNA, 20 bp, human
gctcccaccccgcggccgag

SEQ ID NO: 201294 - DNA, 20 bp, human
gagccggccttcagtcccct

SEQ ID NO: 201295 - DNA, 20 bp, human
gctgtggacccgagttcccc

SEQ ID NO: 201296 - DNA, 20 bp, human
ggtctggctggaacacgcat

SEQ ID NO: 201297 - DNA, 20 bp, human
gggcagcgggagctgtcggt

SEQ ID NO: 201298 - DNA, 20 bp, human
gggagctgtcggtaggacct

SEQ ID NO: 201299 - DNA, 20 bp, human
gcattggcagcgggagctgt

SEQ ID NO: 201300 - DNA, 20 bp, human
gttctgaggcagcctttgtc

SEQ ID NO: 201301 - DNA, 20 bp, human
gaggctgcctcagaacttcc

SEQ ID NO: 201302 - DNA, 20 bp, human
gacggtttaacaggaggaga

SEQ ID NO: 201303 - DNA, 20 bp, human
gcccagagccgagcgcaggt

SEQ ID NO: 201304 - DNA, 20 bp, human
gtgggtgtagcgtccttggt

SEQ ID NO: 201305 - DNA, 20 bp, human
ggaggcagcctttgtctggc

SEQ ID NO: 201306 - DNA, 20 bp, human
gggggaccctagcagagggt

SEQ ID NO: 201307 - DNA, 20 bp, human
gcgcatgtgcggggaggtga

SEQ ID NO: 201308 - DNA, 20 bp, human
ggggaaggggaccctagcag

SEQ ID NO: 201309 - DNA, 20 bp, human
ggcccccagactcctttgta

SEQ ID NO: 201310 - DNA, 20 bp, human
gggcctcaggagggaaagat

SEQ ID NO: 201311 - DNA, 20 bp, human
gggctgggagagggaactag

SEQ ID NO: 201312 - DNA, 20 bp, human
ggagagagtgaggtgagcga

SEQ ID NO: 201313 - DNA, 20 bp, human
gcacagcccaccctctgcta

SEQ ID NO: 201314 - DNA, 20 bp, human
gtgtgagatgaaagctgagt

SEQ ID NO: 201315 - DNA, 20 bp, human
gcgagggagggaccagaggt

SEQ ID NO: 201316 - DNA, 20 bp, human
gcgcgactggagccgccggg

SEQ ID NO: 201317 - DNA, 20 bp, human
gcgggaggtaggcgcgggac

SEQ ID NO: 201318 - DNA, 20 bp, human
gtggaccgattgtcgctcgg

SEQ ID NO: 201319 - DNA, 20 bp, human
gcccgccgccgagcgacaat

SEQ ID NO: 201320 - DNA, 20 bp, human
gagatacgccctcagcgtgg

SEQ ID NO: 201321 - DNA, 20 bp, human
gcgggagtcggtgagaggcc

SEQ ID NO: 201322 - DNA, 20 bp, human
gaccgattgtcgctcggcgg

SEQ ID NO: 201323 - DNA, 20 bp, human
gaccgccagacccccgccac

SEQ ID NO: 201324 - DNA, 20 bp, human
ggggtggaccgattgtcgct

SEQ ID NO: 201325 - DNA, 20 bp, human
gttctctaccccggacgcct

SEQ ID NO: 201326 - DNA, 20 bp, human
gggaaaggctgcgcccactc

SEQ ID NO: 201327 - DNA, 20 bp, human
gcgctcacctcaacccggag

SEQ ID NO: 201328 - DNA, 20 bp, human
ggcctgcgctcacctcaacc

SEQ ID NO: 201329 - DNA, 20 bp, human
gccggaacggcgttgagggt

SEQ ID NO: 201330 - DNA, 20 bp, human
gcaggcccggccccccggaa

SEQ ID NO: 201331 - DNA, 20 bp, human
gacggcgttgagggtaggaa

SEQ ID NO: 201332 - DNA, 20 bp, human
ggttgtgcggcgccacatcc

SEQ ID NO: 201333 - DNA, 20 bp, human
ggccctcccacggggtggaa

SEQ ID NO: 201334 - DNA, 20 bp, human
gggcctccaagcaaccgctc

SEQ ID NO: 201335 - DNA, 20 bp, human
ggtaggaaaggcctgagcga

SEQ ID NO: 201336 - DNA, 20 bp, human
ggtgagcttgggagaaccgt

SEQ ID NO: 201337 - DNA, 20 bp, human
ggcgcccgcgccccagggaa

SEQ ID NO: 201338 - DNA, 20 bp, human
gagaaccgtgggcgctgagg

SEQ ID NO: 201339 - DNA, 20 bp, human
ggaggcggtgagtccccgag

SEQ ID NO: 201340 - DNA, 20 bp, human
ggagtccccgagcggccaga

SEQ ID NO: 201341 - DNA, 20 bp, human
gggcagttgccggtgagctt

SEQ ID NO: 201342 - DNA, 20 bp, human
gccagcccagaaggactccc

SEQ ID NO: 201343 - DNA, 20 bp, human
gagggcgtggccgttccctg

SEQ ID NO: 201344 - DNA, 20 bp, human
ggtcgggtcgcagggagtgg

SEQ ID NO: 201345 - DNA, 20 bp, human
gcacgccctctggccgctcg

SEQ ID NO: 201346 - DNA, 20 bp, human
gacttccacgagaggaatga

SEQ ID NO: 201347 - DNA, 20 bp, human
ggtggaagtgagtgagtcct

SEQ ID NO: 201348 - DNA, 20 bp, human
gagcagctccggatacagta

SEQ ID NO: 201349 - DNA, 20 bp, human
ggctctcccgggcacttccg

SEQ ID NO: 201350 - DNA, 20 bp, human
gactcactcacttccacgag

SEQ ID NO: 201351 - DNA, 20 bp, human
gggttcgggagtcccctggt

SEQ ID NO: 201352 - DNA, 20 bp, human
gcaggtccacttccaaccag

SEQ ID NO: 201353 - DNA, 20 bp, human
ggaagtggacctgaatgggg

SEQ ID NO: 201354 - DNA, 20 bp, human
gcggcaagaggttgagagcg

SEQ ID NO: 201355 - DNA, 20 bp, human
gtacagagctgtgggaggtg

SEQ ID NO: 201356 - DNA, 20 bp, human
gaggggattcgtggcgacgg

SEQ ID NO: 201357 - DNA, 20 bp, human
gggccgctcctcctttgaag

SEQ ID NO: 201358 - DNA, 20 bp, human
gggcgtcggcgctcacgcag

SEQ ID NO: 201359 - DNA, 20 bp, human
ggtcggcgctcacgcagggg

SEQ ID NO: 201360 - DNA, 20 bp, human
gtgagcgccgacgccaccgg

SEQ ID NO: 201361 - DNA, 20 bp, human
ggggcatagcgggccagtaa

SEQ ID NO: 201362 - DNA, 20 bp, human
ggcgtgagcgccgacgccac

SEQ ID NO: 201363 - DNA, 20 bp, human
gagcggctccgggggcatag

SEQ ID NO: 201364 - DNA, 20 bp, human
gcgcaaaacctcttcaaagg

SEQ ID NO: 201365 - DNA, 20 bp, human
gaacctcttcaaaggaggag

SEQ ID NO: 201366 - DNA, 20 bp, human
gctgagatttgatcccagag

SEQ ID NO: 201367 - DNA, 20 bp, human
gctcctcgaagagcgacacg

SEQ ID NO: 201368 - DNA, 20 bp, human
ggcttcgccaggtccctcgg

SEQ ID NO: 201369 - DNA, 20 bp, human
gaggaactcgccaaggccgg

SEQ ID NO: 201370 - DNA, 20 bp, human
gctgcgccaggaactcgcca

SEQ ID NO: 201371 - DNA, 20 bp, human
ggatctctcgccgccggcag

SEQ ID NO: 201372 - DNA, 20 bp, human
gttcgaggagcctctgccgg

SEQ ID NO: 201373 - DNA, 20 bp, human
ggagttcctggcgcaggact

SEQ ID NO: 201374 - DNA, 20 bp, human
ggcggactccgagaagccca

SEQ ID NO: 201375 - DNA, 20 bp, human
ggagcgacacggggctgacc

SEQ ID NO: 201376 - DNA, 20 bp, human
gcggtgggacacctcgttag

SEQ ID NO: 201377 - DNA, 20 bp, human
ggccaaaggaggcccaatag

SEQ ID NO: 201378 - DNA, 20 bp, human
gaaggaggcccaatagaggg

SEQ ID NO: 201379 - DNA, 20 bp, human
ggctgggtgggcgcgttctg

SEQ ID NO: 201380 - DNA, 20 bp, human
gtggggcctagagcgctggg

SEQ ID NO: 201381 - DNA, 20 bp, human
gggcccaaggcgcagcgtcg

SEQ ID NO: 201382 - DNA, 20 bp, human
gtaaaatagccacccaaagg

SEQ ID NO: 201383 - DNA, 20 bp, human
gagggccaccgccttagtat

SEQ ID NO: 201384 - DNA, 20 bp, human
gggacagaccgccctctatt

SEQ ID NO: 201385 - DNA, 20 bp, human
ggcagggacgggtagtgaag

SEQ ID NO: 201386 - DNA, 20 bp, human
gaggaatggtctccgggtag

SEQ ID NO: 201387 - DNA, 20 bp, human
ggtccacagctacttccggt

SEQ ID NO: 201388 - DNA, 20 bp, human
gcctcgcaggaatggtctcc

SEQ ID NO: 201389 - DNA, 20 bp, human
gattcctgcgaggctcctac

SEQ ID NO: 201390 - DNA, 20 bp, human
ggcgggatcagcccttaggt

SEQ ID NO: 201391 - DNA, 20 bp, human
gaggcaggtaaggatgtccc

SEQ ID NO: 201392 - DNA, 20 bp, human
ggggctgatcccgcactcag

SEQ ID NO: 201393 - DNA, 20 bp, human
ggcgtgtccgaaggtgactc

SEQ ID NO: 201394 - DNA, 20 bp, human
gaggtaaggatgtcccgggc

SEQ ID NO: 201395 - DNA, 20 bp, human
gatggtctccgggtagaggc

SEQ ID NO: 201396 - DNA, 20 bp, human
ggagcactcggaccaccccg

SEQ ID NO: 201397 - DNA, 20 bp, human
gttctgccgggtctcagcaa

SEQ ID NO: 201398 - DNA, 20 bp, human
gtgccgggtctcagcaatgg

SEQ ID NO: 201399 - DNA, 20 bp, human
gggaagtcccctgcatggac

SEQ ID NO: 201400 - DNA, 20 bp, human
gggagagagacggatatctc

SEQ ID NO: 201401 - DNA, 20 bp, human
gtgaataatgagcaaccagg

SEQ ID NO: 201402 - DNA, 20 bp, human
gcactcggaccaccccgagg

SEQ ID NO: 201403 - DNA, 20 bp, human
ggagaacccgaagcacctcc

SEQ ID NO: 201404 - DNA, 20 bp, human
gggagaggaagtcccctgca

SEQ ID NO: 201405 - DNA, 20 bp, human
gcaataacccgagcaggaag

SEQ ID NO: 201406 - DNA, 20 bp, human
gccgccggctctgctcacaa

SEQ ID NO: 201407 - DNA, 20 bp, human
gctgcggggaagggtgccaa

SEQ ID NO: 201408 - DNA, 20 bp, human
ggaagtgggagctcaggacg

SEQ ID NO: 201409 - DNA, 20 bp, human
gtcagcacccgagctgcagg

SEQ ID NO: 201410 - DNA, 20 bp, human
ggcggccggccagccaggta

SEQ ID NO: 201411 - DNA, 20 bp, human
gaaggctccgagcctggagt

SEQ ID NO: 201412 - DNA, 20 bp, human
gagccaggtaagggccgggg

SEQ ID NO: 201413 - DNA, 20 bp, human
ggcggcgctgagggagacgc

SEQ ID NO: 201414 - DNA, 20 bp, human
ggccggccgtgacccaaccg

SEQ ID NO: 201415 - DNA, 20 bp, human
gtccgagcctggagtaggtg

SEQ ID NO: 201416 - DNA, 20 bp, human
gaacccaggagagtaaggct

SEQ ID NO: 201417 - DNA, 20 bp, human
gccaggagagtaaggctggg

SEQ ID NO: 201418 - DNA, 20 bp, human
gaaacgtatacattgcccta

SEQ ID NO: 201419 - DNA, 20 bp, human
gccaggaacccaggagagta

SEQ ID NO: 201420 - DNA, 20 bp, human
gtggaatgacggtcacgccg

SEQ ID NO: 201421 - DNA, 20 bp, human
gcccgggtctttctgccata

SEQ ID NO: 201422 - DNA, 20 bp, human
gcgctgtgctccaggaaccc

SEQ ID NO: 201423 - DNA, 20 bp, human
gagtggatcccgtggaatga

SEQ ID NO: 201424 - DNA, 20 bp, human
gtaaggctgggaggcgcaca

SEQ ID NO: 201425 - DNA, 20 bp, human
gctgtggtcctgggatcctg

SEQ ID NO: 201426 - DNA, 20 bp, human
gctgaggtggacacccccca

SEQ ID NO: 201427 - DNA, 20 bp, human
gggtctccagtcatggtggg

SEQ ID NO: 201428 - DNA, 20 bp, human
gggctgcaggtctccagtca

SEQ ID NO: 201429 - DNA, 20 bp, human
gccagagaacccacagctgg

SEQ ID NO: 201430 - DNA, 20 bp, human
gtgcaggtctccagtcatgg

SEQ ID NO: 201431 - DNA, 20 bp, human
gtcgaggaccaagcccaccc

SEQ ID NO: 201432 - DNA, 20 bp, human
gggctgctggcaacttggcg

SEQ ID NO: 201433 - DNA, 20 bp, human
gttctctggtgtctcgtcca

SEQ ID NO: 201434 - DNA, 20 bp, human
gacaccagagaacccacagc

SEQ ID NO: 201435 - DNA, 20 bp, human
gctggggtgttgtcctccag

SEQ ID NO: 201436 - DNA, 20 bp, human
gagcggccgaggctggactg

SEQ ID NO: 201437 - DNA, 20 bp, human
gactgcgtagagcccagtgt

SEQ ID NO: 201438 - DNA, 20 bp, human
ggctctgccccttccagata

SEQ ID NO: 201439 - DNA, 20 bp, human
ggcggtgctgtgctgaggag

SEQ ID NO: 201440 - DNA, 20 bp, human
gccgcacgctcaccacgtat

SEQ ID NO: 201441 - DNA, 20 bp, human
gggcgaggagcgaagaccat

SEQ ID NO: 201442 - DNA, 20 bp, human
gggtgtcctggttcctgtgt

SEQ ID NO: 201443 - DNA, 20 bp, human
gcagattcgcggccacgcac

SEQ ID NO: 201444 - DNA, 20 bp, human
gccttctcctcagcaaccgg

SEQ ID NO: 201445 - DNA, 20 bp, human
gccggaaaggacccaaagcc

SEQ ID NO: 201446 - DNA, 20 bp, human
gccttcggatgagagcgtct

SEQ ID NO: 201447 - DNA, 20 bp, human
gacaaacccccggcctcgtc

SEQ ID NO: 201448 - DNA, 20 bp, human
gagcgtctgggtgccagacg

SEQ ID NO: 201449 - DNA, 20 bp, human
ggtcgactcacggagtcctt

SEQ ID NO: 201450 - DNA, 20 bp, human
gagagtccagtgtgagacca

SEQ ID NO: 201451 - DNA, 20 bp, human
gtgggtgccagacgaggccg

SEQ ID NO: 201452 - DNA, 20 bp, human
gggactccgtgagtcgacgc

SEQ ID NO: 201453 - DNA, 20 bp, human
gacataccctggtctcacac

SEQ ID NO: 201454 - DNA, 20 bp, human
gcgtactcgagtctgcgggg

SEQ ID NO: 201455 - DNA, 20 bp, human
gactcactggtctctcacac

SEQ ID NO: 201456 - DNA, 20 bp, human
gacaggaagtcgctgcgagg

SEQ ID NO: 201457 - DNA, 20 bp, human
gctgcgaggaggcgcgtgtg

SEQ ID NO: 201458 - DNA, 20 bp, human
gctgcacccaggatcctccg

SEQ ID NO: 201459 - DNA, 20 bp, human
gcgcgagaagcttctctgag

SEQ ID NO: 201460 - DNA, 20 bp, human
gcgcacaggaagtcgctgcg

SEQ ID NO: 201461 - DNA, 20 bp, human
gcgactacaatcccgaggta

SEQ ID NO: 201462 - DNA, 20 bp, human
gtgaaaaccgctcaaggtct

SEQ ID NO: 201463 - DNA, 20 bp, human
gagagaagcttctcgcgcac

SEQ ID NO: 201464 - DNA, 20 bp, human
ggcgctgccgcggaggatcc

SEQ ID NO: 201465 - DNA, 20 bp, human
gaagggtgcgtcgccttggg

SEQ ID NO: 201466 - DNA, 20 bp, human
ggacaatgatgagtgaacta

SEQ ID NO: 201467 - DNA, 20 bp, human
gctgcaaggaatgtgaatct

SEQ ID NO: 201468 - DNA, 20 bp, human
ggcagttgttattagttgaa

SEQ ID NO: 201469 - DNA, 20 bp, human
ggaacaaatgtcacaaggtg

SEQ ID NO: 201470 - DNA, 20 bp, human
ggagctggtgtgagtttttg

SEQ ID NO: 201471 - DNA, 20 bp, human
ggtgtgcattctctgttgtc

SEQ ID NO: 201472 - DNA, 20 bp, human
gaagaaaagtagatgaagtc

SEQ ID NO: 201473 - DNA, 20 bp, human
gcacaaggtgaggctctcgc

SEQ ID NO: 201474 - DNA, 20 bp, human
ggcattctctgttgtctggt

SEQ ID NO: 201475 - DNA, 20 bp, human
gtttgaggctgctgagtaac

SEQ ID NO: 201476 - DNA, 20 bp, human
ggccagcacctggcaccctg

SEQ ID NO: 201477 - DNA, 20 bp, human
gtttcttgcagtcagttcca

SEQ ID NO: 201478 - DNA, 20 bp, human
ggatttgggtcggcaggccc

SEQ ID NO: 201479 - DNA, 20 bp, human
gggaaaaagacaaaaacccc

SEQ ID NO: 201480 - DNA, 20 bp, human
gaaagaggatttgggtcggc

SEQ ID NO: 201481 - DNA, 20 bp, human
gggccaaagaggatttgggt

SEQ ID NO: 201482 - DNA, 20 bp, human
gagctgggccaaagaggatt

SEQ ID NO: 201483 - DNA, 20 bp, human
ggagaggggtgggggctgat

SEQ ID NO: 201484 - DNA, 20 bp, human
gaactgactgcaagaaagtc

SEQ ID NO: 201485 - DNA, 20 bp, human
gaccccagggtgccaggtgc

SEQ ID NO: 201486 - DNA, 20 bp, human
gtggcgcggagcctgcatcc

SEQ ID NO: 201487 - DNA, 20 bp, human
gcccgctgaggagctccgga

SEQ ID NO: 201488 - DNA, 20 bp, human
gctccgcgccaagccgggag

SEQ ID NO: 201489 - DNA, 20 bp, human
gggcgtcgggtcccaggtac

SEQ ID NO: 201490 - DNA, 20 bp, human
ggtgcctctggggagatagg

SEQ ID NO: 201491 - DNA, 20 bp, human
ggaggcgcccgcacaggtga

SEQ ID NO: 201492 - DNA, 20 bp, human
gctccgggcggtggagatct

SEQ ID NO: 201493 - DNA, 20 bp, human
gtctccaccgcccggaggag

SEQ ID NO: 201494 - DNA, 20 bp, human
ggccagcggctccgggatgc

SEQ ID NO: 201495 - DNA, 20 bp, human
gcaagcatcgcagtccccac

SEQ ID NO: 201496 - DNA, 20 bp, human
gtgtgctccagggccaacaa

SEQ ID NO: 201497 - DNA, 20 bp, human
gcagcactgggcagaagacg

SEQ ID NO: 201498 - DNA, 20 bp, human
gagggtctggatcaagagat

SEQ ID NO: 201499 - DNA, 20 bp, human
ggtctggatcaagagatggg

SEQ ID NO: 201500 - DNA, 20 bp, human
gtccagggccaacaaaggcg

SEQ ID NO: 201501 - DNA, 20 bp, human
gcccgtatcaaggagggtaa

SEQ ID NO: 201502 - DNA, 20 bp, human
gatcaaggagggtaaaggta

SEQ ID NO: 201503 - DNA, 20 bp, human
ggcgcagtttcccacaaacc

SEQ ID NO: 201504 - DNA, 20 bp, human
gccctgtggcagaaggacgg

SEQ ID NO: 201505 - DNA, 20 bp, human
gaccggaatccgcctagcgg

SEQ ID NO: 201506 - DNA, 20 bp, human
ggctcgactaggacgagagg

SEQ ID NO: 201507 - DNA, 20 bp, human
gttagctcgactaggacgag

SEQ ID NO: 201508 - DNA, 20 bp, human
gtcgctgcgggacaagcttc

SEQ ID NO: 201509 - DNA, 20 bp, human
ggccagaggatctcaaccag

SEQ ID NO: 201510 - DNA, 20 bp, human
gccgggagcagcctaccaac

SEQ ID NO: 201511 - DNA, 20 bp, human
gcggatgctgatgcaggtac

SEQ ID NO: 201512 - DNA, 20 bp, human
gggaggtgcgcactccgctg

SEQ ID NO: 201513 - DNA, 20 bp, human
gggtggtactgttatctaac

SEQ ID NO: 201514 - DNA, 20 bp, human
gcagcgcacagcccgttggt

SEQ ID NO: 201515 - DNA, 20 bp, human
gcttgcgcgcgcactcgctg

SEQ ID NO: 201516 - DNA, 20 bp, human
gtgtgggggaggatgactat

SEQ ID NO: 201517 - DNA, 20 bp, human
gtgactatgggaactaagga

SEQ ID NO: 201518 - DNA, 20 bp, human
gcactgtcctgagaggacgt

SEQ ID NO: 201519 - DNA, 20 bp, human
gcggagtgagggcggactgt

SEQ ID NO: 201520 - DNA, 20 bp, human
gatcactgaccggaaggctc

SEQ ID NO: 201521 - DNA, 20 bp, human
gagcagtcttcatggcctga

SEQ ID NO: 201522 - DNA, 20 bp, human
gcgactatagtcacctcccg

SEQ ID NO: 201523 - DNA, 20 bp, human
gtacttcttacagcgctgcc

SEQ ID NO: 201524 - DNA, 20 bp, human
gttgattactggcaaccttc

SEQ ID NO: 201525 - DNA, 20 bp, human
gcctgagaggacgtgggtga

SEQ ID NO: 201526 - DNA, 20 bp, human
gggacagtaaccaccagcca

SEQ ID NO: 201527 - DNA, 20 bp, human
ggcccgttccctccacaggt

SEQ ID NO: 201528 - DNA, 20 bp, human
ggtgtggtcgctgactctct

SEQ ID NO: 201529 - DNA, 20 bp, human
gtgggtacgctcgggaagaa

SEQ ID NO: 201530 - DNA, 20 bp, human
gctgtccgaacggcgtggtg

SEQ ID NO: 201531 - DNA, 20 bp, human
gggtccaggtgggtacgctc

SEQ ID NO: 201532 - DNA, 20 bp, human
gctggtggttactgtccgaa

SEQ ID NO: 201533 - DNA, 20 bp, human
ggcagattctagctaggcta

SEQ ID NO: 201534 - DNA, 20 bp, human
ggtgcagcgctcgcaccacg

SEQ ID NO: 201535 - DNA, 20 bp, human
gagctaggctagggcacgga

SEQ ID NO: 201536 - DNA, 20 bp, human
gaaccacgagaaggtcatca

SEQ ID NO: 201537 - DNA, 20 bp, human
gtcgctgcatctggagctct

SEQ ID NO: 201538 - DNA, 20 bp, human
gcgtggttcccgcaccatct

SEQ ID NO: 201539 - DNA, 20 bp, human
gggagagctgctgcacagag

SEQ ID NO: 201540 - DNA, 20 bp, human
gtgggagagacccgaagctg

SEQ ID NO: 201541 - DNA, 20 bp, human
ggggtctctcccagatggtg

SEQ ID NO: 201542 - DNA, 20 bp, human
gtcccctgatgaccttctcg

SEQ ID NO: 201543 - DNA, 20 bp, human
gggtcccggcatcttggctg

SEQ ID NO: 201544 - DNA, 20 bp, human
ggcgctgacagccggtcccg

SEQ ID NO: 201545 - DNA, 20 bp, human
gcattggacatcctgagaga

SEQ ID NO: 201546 - DNA, 20 bp, human
gcgcagtgctcttggccggg

SEQ ID NO: 201547 - DNA, 20 bp, human
gtgggactcggagacgacgt

SEQ ID NO: 201548 - DNA, 20 bp, human
ggaaaggaccccacagtcaa

SEQ ID NO: 201549 - DNA, 20 bp, human
ggatgtggagcaagaggtgc

SEQ ID NO: 201550 - DNA, 20 bp, human
gccctaggagaaaaattcat

SEQ ID NO: 201551 - DNA, 20 bp, human
gcacgcgcagtgctcttggc

SEQ ID NO: 201552 - DNA, 20 bp, human
gctgcgcgtggctctgaact

SEQ ID NO: 201553 - DNA, 20 bp, human
gaggagggtgcgcctcacct

SEQ ID NO: 201554 - DNA, 20 bp, human
ggagccacgcgcagtgctct

SEQ ID NO: 201555 - DNA, 20 bp, human
gttgagtgctgaaaaaacag

SEQ ID NO: 201556 - DNA, 20 bp, human
gcccacagcggtctggacag

SEQ ID NO: 201557 - DNA, 20 bp, human
gcagaccgctgtgggcacag

SEQ ID NO: 201558 - DNA, 20 bp, human
gacagcggtctggacagagg

SEQ ID NO: 201559 - DNA, 20 bp, human
gagtaaggtcagtaaggcca

SEQ ID NO: 201560 - DNA, 20 bp, human
gcgacagcggtgaccctcca

SEQ ID NO: 201561 - DNA, 20 bp, human
ggcatggagtaaggtcagta

SEQ ID NO: 201562 - DNA, 20 bp, human
gggcgcaggcaggttcccgg

SEQ ID NO: 201563 - DNA, 20 bp, human
gatcagcactgcatggagta

SEQ ID NO: 201564 - DNA, 20 bp, human
ggtgctgatgcatgcgacag

SEQ ID NO: 201565 - DNA, 20 bp, human
gcagaaccccaacagaacaa

SEQ ID NO: 201566 - DNA, 20 bp, human
gccggatctcgggtcggaca

SEQ ID NO: 201567 - DNA, 20 bp, human
gattgttccggatctcgggt

SEQ ID NO: 201568 - DNA, 20 bp, human
gagtcccagctactgcgtgg

SEQ ID NO: 201569 - DNA, 20 bp, human
gcccagctactgcgtggtgg

SEQ ID NO: 201570 - DNA, 20 bp, human
gtccatctggaaactgagac

SEQ ID NO: 201571 - DNA, 20 bp, human
gaccagttccgtcccaccgg

SEQ ID NO: 201572 - DNA, 20 bp, human
gtctggacttgctcctcgag

SEQ ID NO: 201573 - DNA, 20 bp, human
gcagatggagcgacccctcg

SEQ ID NO: 201574 - DNA, 20 bp, human
gagggtcactattccacgag

SEQ ID NO: 201575 - DNA, 20 bp, human
gagaaattgttccggatctc

SEQ ID NO: 201576 - DNA, 20 bp, human
gctctcggagcagcaaggac

SEQ ID NO: 201577 - DNA, 20 bp, human
ggactggatgcagaacgcaa

SEQ ID NO: 201578 - DNA, 20 bp, human
gcgccacagcaggatcctgt

SEQ ID NO: 201579 - DNA, 20 bp, human
gagcgtcacaggagccgtgg

SEQ ID NO: 201580 - DNA, 20 bp, human
gggcctagcgtccagatacg

SEQ ID NO: 201581 - DNA, 20 bp, human
gcacaatctgggaagacgcc

SEQ ID NO: 201582 - DNA, 20 bp, human
ggccccaggtgcctccgcca

SEQ ID NO: 201583 - DNA, 20 bp, human
ggacagcgtcacaggagccg

SEQ ID NO: 201584 - DNA, 20 bp, human
gtggcggccgagcggaccga

SEQ ID NO: 201585 - DNA, 20 bp, human
gacgcgggtcccaatcgccg

SEQ ID NO: 201586 - DNA, 20 bp, human
gtctcgctgcagtcggagta

SEQ ID NO: 201587 - DNA, 20 bp, human
gtgggagagacacgacgctg

SEQ ID NO: 201588 - DNA, 20 bp, human
gggctgggcaaggcgaactt

SEQ ID NO: 201589 - DNA, 20 bp, human
gagcgcagccgccaatctga

SEQ ID NO: 201590 - DNA, 20 bp, human
gtccccttcagccatcagat

SEQ ID NO: 201591 - DNA, 20 bp, human
gttcgctgttctgcgtcctc

SEQ ID NO: 201592 - DNA, 20 bp, human
gaatgggaagagctttggtt

SEQ ID NO: 201593 - DNA, 20 bp, human
gggctgaaggggactgaggc

SEQ ID NO: 201594 - DNA, 20 bp, human
gctgcgtcctctggtcctag

SEQ ID NO: 201595 - DNA, 20 bp, human
gcagattgtggagccgactg

SEQ ID NO: 201596 - DNA, 20 bp, human
ggagcagtgaagggtagacc

SEQ ID NO: 201597 - DNA, 20 bp, human
gcacgaagccacacacgctg

SEQ ID NO: 201598 - DNA, 20 bp, human
gggagttgctcggaaccggt

SEQ ID NO: 201599 - DNA, 20 bp, human
ggggtgcagaactgccagag

SEQ ID NO: 201600 - DNA, 20 bp, human
gtggcgcagccgccaactta

SEQ ID NO: 201601 - DNA, 20 bp, human
gggaaggagttgctcggaac

SEQ ID NO: 201602 - DNA, 20 bp, human
gacatttggagcggcgagga

SEQ ID NO: 201603 - DNA, 20 bp, human
gtccttcagccgtaagttgg

SEQ ID NO: 201604 - DNA, 20 bp, human
gcttcgtgacctgaagatac

SEQ ID NO: 201605 - DNA, 20 bp, human
gtggatttcccagtatcttc

SEQ ID NO: 201606 - DNA, 20 bp, human
gctgtggcggcggaagtcca

SEQ ID NO: 201607 - DNA, 20 bp, human
gggaggcgcctgaaaaacaa

SEQ ID NO: 201608 - DNA, 20 bp, human
gtcggctcgggggcaaatgg

SEQ ID NO: 201609 - DNA, 20 bp, human
gcgcgtgtgagggagaccga

SEQ ID NO: 201610 - DNA, 20 bp, human
ggacttccgccgccacagga

SEQ ID NO: 201611 - DNA, 20 bp, human
ggccgaaaaccctcctgtgg

SEQ ID NO: 201612 - DNA, 20 bp, human
gggaaggagaaggtcgctgt

SEQ ID NO: 201613 - DNA, 20 bp, human
gcgccgcggcgcgtccctgt

SEQ ID NO: 201614 - DNA, 20 bp, human
gcgcggcggtgagtgcaccc

SEQ ID NO: 201615 - DNA, 20 bp, human
gcccgccggacgccgaggaa

SEQ ID NO: 201616 - DNA, 20 bp, human
gccgctcctagtggacgcag

SEQ ID NO: 201617 - DNA, 20 bp, human
gcctggccgagggtgtccgt

SEQ ID NO: 201618 - DNA, 20 bp, human
gtgagctccgaaactacccg

SEQ ID NO: 201619 - DNA, 20 bp, human
gtcgagccgcgtggaatggt

SEQ ID NO: 201620 - DNA, 20 bp, human
gcgcagaggcgggccgagga

SEQ ID NO: 201621 - DNA, 20 bp, human
ggccgcgtggaatggtagga

SEQ ID NO: 201622 - DNA, 20 bp, human
gcgtggaatggtaggagggc

SEQ ID NO: 201623 - DNA, 20 bp, human
gcctgtgcgggcagctccgg

SEQ ID NO: 201624 - DNA, 20 bp, human
gctgaaagaggcccgcacgc

SEQ ID NO: 201625 - DNA, 20 bp, human
ggcccgcctctgcgtccact

SEQ ID NO: 201626 - DNA, 20 bp, human
ggccgaagaccctaaaccag

SEQ ID NO: 201627 - DNA, 20 bp, human
gtcgccagacctggacaccg

SEQ ID NO: 201628 - DNA, 20 bp, human
ggccagggacgccagagccg

SEQ ID NO: 201629 - DNA, 20 bp, human
ggagtgggtcctatatggaa

SEQ ID NO: 201630 - DNA, 20 bp, human
ggcctcaggcttggcagcca

SEQ ID NO: 201631 - DNA, 20 bp, human
gggtgcaaaccaggccgtgc

SEQ ID NO: 201632 - DNA, 20 bp, human
gccgtcaggcacccccgcgt

SEQ ID NO: 201633 - DNA, 20 bp, human
ggtcgtgaccacccacgcgg

SEQ ID NO: 201634 - DNA, 20 bp, human
gcaaaccaggccgtgcgggt

SEQ ID NO: 201635 - DNA, 20 bp, human
ggcctgacggggccgcgtag

SEQ ID NO: 201636 - DNA, 20 bp, human
gttccgcagggcagcaccca

SEQ ID NO: 201637 - DNA, 20 bp, human
ggtgttgcaaggtgcgagag

SEQ ID NO: 201638 - DNA, 20 bp, human
gcagggacctgagtgttgca

SEQ ID NO: 201639 - DNA, 20 bp, human
gtgcggaaaggagtaagtcc

SEQ ID NO: 201640 - DNA, 20 bp, human
gctcgcaccttgcaacactc

SEQ ID NO: 201641 - DNA, 20 bp, human
ggctcaccatgcgcttcccg

SEQ ID NO: 201642 - DNA, 20 bp, human
ggagcgccgcgggaagcgca

SEQ ID NO: 201643 - DNA, 20 bp, human
gaggagctggaatcgacccg

SEQ ID NO: 201644 - DNA, 20 bp, human
ggcaaacttgccatgaagaa

SEQ ID NO: 201645 - DNA, 20 bp, human
gagcggaggcccgaggccta

SEQ ID NO: 201646 - DNA, 20 bp, human
gaaccggaagaatggtggcg

SEQ ID NO: 201647 - DNA, 20 bp, human
gactctccgcggagcggcgc

SEQ ID NO: 201648 - DNA, 20 bp, human
ggcgcaggcgctcccagagg

SEQ ID NO: 201649 - DNA, 20 bp, human
ggcggcgcaggcgctcccag

SEQ ID NO: 201650 - DNA, 20 bp, human
gctggccccagtccacctct

SEQ ID NO: 201651 - DNA, 20 bp, human
gggacgtagggcactcctag

SEQ ID NO: 201652 - DNA, 20 bp, human
ggcgctcccagaggtggact

SEQ ID NO: 201653 - DNA, 20 bp, human
ggtgagcgagttgggaccca

SEQ ID NO: 201654 - DNA, 20 bp, human
gtcgctcactgtgagatcca

SEQ ID NO: 201655 - DNA, 20 bp, human
gcgcgtgctgcccggacgta

SEQ ID NO: 201656 - DNA, 20 bp, human
ggccccggctggacacgcag

SEQ ID NO: 201657 - DNA, 20 bp, human
gtaagaagcagtaagcacag

SEQ ID NO: 201658 - DNA, 20 bp, human
ggaagcagtaagcacagcgg

SEQ ID NO: 201659 - DNA, 20 bp, human
ggccagacgcgagtaatcct

SEQ ID NO: 201660 - DNA, 20 bp, human
ggagcgcgctggtccaggca

SEQ ID NO: 201661 - DNA, 20 bp, human
gccagagagcgcgctggtcc

SEQ ID NO: 201662 - DNA, 20 bp, human
gggctcgcggtgtccgcctc

SEQ ID NO: 201663 - DNA, 20 bp, human
gttcttagggcagaaagcga

SEQ ID NO: 201664 - DNA, 20 bp, human
ggcagtaagcacagcggcgg

SEQ ID NO: 201665 - DNA, 20 bp, human
ggcatcgcagagcgcagcgc

SEQ ID NO: 201666 - DNA, 20 bp, human
gcaatctgggaaagacctgt

SEQ ID NO: 201667 - DNA, 20 bp, human
gcggagagggttccacgcca

SEQ ID NO: 201668 - DNA, 20 bp, human
gggcgtcagcgagagacaat

SEQ ID NO: 201669 - DNA, 20 bp, human
gcgccccagccataacatgg

SEQ ID NO: 201670 - DNA, 20 bp, human
gaagacgatagctggatctc

SEQ ID NO: 201671 - DNA, 20 bp, human
ggcagctgtagcgaacagga

SEQ ID NO: 201672 - DNA, 20 bp, human
gtgtggcagtggcagaactc

SEQ ID NO: 201673 - DNA, 20 bp, human
ggagcagtgaagacgatagc

SEQ ID NO: 201674 - DNA, 20 bp, human
ggaaaagacaggacaccccg

SEQ ID NO: 201675 - DNA, 20 bp, human
gacaatgggcccgccaaagc

SEQ ID NO: 201676 - DNA, 20 bp, human
gggatgcacatggccggcgg

SEQ ID NO: 201677 - DNA, 20 bp, human
ggctggccaaacgaggctcg

SEQ ID NO: 201678 - DNA, 20 bp, human
gaaagagccgggagagaggt

SEQ ID NO: 201679 - DNA, 20 bp, human
gtggagctccggatgaggag

SEQ ID NO: 201680 - DNA, 20 bp, human
ggagaggtgggcaaggacga

SEQ ID NO: 201681 - DNA, 20 bp, human
gcctgaggggaggatgcaca

SEQ ID NO: 201682 - DNA, 20 bp, human
ggggaaaccgggggaaaaga

SEQ ID NO: 201683 - DNA, 20 bp, human
gcaaggcctgcggagactct

SEQ ID NO: 201684 - DNA, 20 bp, human
ggcgctaacagcgggcggag

SEQ ID NO: 201685 - DNA, 20 bp, human
ggagaaggaagcaacgcctg

SEQ ID NO: 201686 - DNA, 20 bp, human
ggcaccagcaaacactaaca

SEQ ID NO: 201687 - DNA, 20 bp, human
gtgcagagggttcgcagctc

SEQ ID NO: 201688 - DNA, 20 bp, human
ggccgagcctaggagctaga

SEQ ID NO: 201689 - DNA, 20 bp, human
gcagggagaagccggaaagt

SEQ ID NO: 201690 - DNA, 20 bp, human
gaggtccgcaatccgcgtgg

SEQ ID NO: 201691 - DNA, 20 bp, human
gcgtacagcccgtgggtctg

SEQ ID NO: 201692 - DNA, 20 bp, human
gcctctcaccgcagacccac

SEQ ID NO: 201693 - DNA, 20 bp, human
gcaaagcgcgtacagcccgt

SEQ ID NO: 201694 - DNA, 20 bp, human
gttagtgtttgctggtgcag

SEQ ID NO: 201695 - DNA, 20 bp, human
gcagcctgagaagggccggt

SEQ ID NO: 201696 - DNA, 20 bp, human
gggggacacccgggacgacc

SEQ ID NO: 201697 - DNA, 20 bp, human
gtgcagcggtccccgaactc

SEQ ID NO: 201698 - DNA, 20 bp, human
ggatcccgctctacaggcag

SEQ ID NO: 201699 - DNA, 20 bp, human
gggggcaactgcatcacccc

SEQ ID NO: 201700 - DNA, 20 bp, human
gccggagcgcgggatgactg

SEQ ID NO: 201701 - DNA, 20 bp, human
ggatcacgtcctggaggtag

SEQ ID NO: 201702 - DNA, 20 bp, human
gcacgtcctggaggtagagg

SEQ ID NO: 201703 - DNA, 20 bp, human
gaggcgggcgcacagcgcgg

SEQ ID NO: 201704 - DNA, 20 bp, human
gtcgccgccgtaggccccac

SEQ ID NO: 201705 - DNA, 20 bp, human
gccgggccccgcagcgaggc

SEQ ID NO: 201706 - DNA, 20 bp, human
gcggagccgagcccacatcc

SEQ ID NO: 201707 - DNA, 20 bp, human
gtggtctggccggagccctt

SEQ ID NO: 201708 - DNA, 20 bp, human
gtgagaatgggggaagacga

SEQ ID NO: 201709 - DNA, 20 bp, human
ggcgggtacagcaccgagtc

SEQ ID NO: 201710 - DNA, 20 bp, human
ggcctaacaatttcacccaa

SEQ ID NO: 201711 - DNA, 20 bp, human
gccctgtcccaggctctaaa

SEQ ID NO: 201712 - DNA, 20 bp, human
ggtcccaggctctaaaaggg

SEQ ID NO: 201713 - DNA, 20 bp, human
gaggagagcggaagtggcgt

SEQ ID NO: 201714 - DNA, 20 bp, human
ggaagtggcgttggtctggc

SEQ ID NO: 201715 - DNA, 20 bp, human
gagcggaagtggcgttggtc

SEQ ID NO: 201716 - DNA, 20 bp, human
ggcggggcgctgggtccggg

SEQ ID NO: 201717 - DNA, 20 bp, human
gtcacccgcgcgccaggcct

SEQ ID NO: 201718 - DNA, 20 bp, human
gcccgcagtaaaactgtcaa

SEQ ID NO: 201719 - DNA, 20 bp, human
gcgcgcagggtcgagatccg

SEQ ID NO: 201720 - DNA, 20 bp, human
gcctggcgcgcgggtgagcg

SEQ ID NO: 201721 - DNA, 20 bp, human
gcagtaaaactgtcaaaggt

SEQ ID NO: 201722 - DNA, 20 bp, human
gttacctgcggcgcccagcg

SEQ ID NO: 201723 - DNA, 20 bp, human
gcgaccctgcgcgcaggcca

SEQ ID NO: 201724 - DNA, 20 bp, human
gcgaaggcagtgaaccaaaa

SEQ ID NO: 201725 - DNA, 20 bp, human
ggcggccagggacgcgcacc

SEQ ID NO: 201726 - DNA, 20 bp, human
gggagccccctaccccccta

SEQ ID NO: 201727 - DNA, 20 bp, human
ggcactaagggaatcagagt

SEQ ID NO: 201728 - DNA, 20 bp, human
gcgggaagtgtggtccacga

SEQ ID NO: 201729 - DNA, 20 bp, human
gccagctggtctccgtaggg

SEQ ID NO: 201730 - DNA, 20 bp, human
ggctccatgaatggaagcgg

SEQ ID NO: 201731 - DNA, 20 bp, human
gagagtgggtcagcgagtac

SEQ ID NO: 201732 - DNA, 20 bp, human
gcttcccaccgaggcactaa

SEQ ID NO: 201733 - DNA, 20 bp, human
gccatgaatggaagcggcgg

SEQ ID NO: 201734 - DNA, 20 bp, human
ggactcctgagggatgaagt

SEQ ID NO: 201735 - DNA, 20 bp, human
gtcagcgagtacgggaagtg

SEQ ID NO: 201736 - DNA, 20 bp, human
gcggctcgctctcccagcta

SEQ ID NO: 201737 - DNA, 20 bp, human
gggctgaacaggatccaaaa

SEQ ID NO: 201738 - DNA, 20 bp, human
gggccgttccagcaactcca

SEQ ID NO: 201739 - DNA, 20 bp, human
gcagcgctgtcgccttagct

SEQ ID NO: 201740 - DNA, 20 bp, human
gagaggcaggcagtacttca

SEQ ID NO: 201741 - DNA, 20 bp, human
gtgcaaacgccggcttcccg

SEQ ID NO: 201742 - DNA, 20 bp, human
gctgggagagcgagccgttg

SEQ ID NO: 201743 - DNA, 20 bp, human
gtggagggacgcgacactag

SEQ ID NO: 201744 - DNA, 20 bp, human
gggtgtgcgctgaagctgtc

SEQ ID NO: 201745 - DNA, 20 bp, human
ggggacgcgacactagaggc

SEQ ID NO: 201746 - DNA, 20 bp, human
gctgcacagtccctagcggg

SEQ ID NO: 201747 - DNA, 20 bp, human
ggggcgcgcagacctgtact

SEQ ID NO: 201748 - DNA, 20 bp, human
gcggggcgcgggcccagtac

SEQ ID NO: 201749 - DNA, 20 bp, human
ggagcagggccggcaaaccc

SEQ ID NO: 201750 - DNA, 20 bp, human
gtgtgagcgttcggagactg

SEQ ID NO: 201751 - DNA, 20 bp, human
gcggcctgcacagtccctag

SEQ ID NO: 201752 - DNA, 20 bp, human
gctagcggggggcactcgga

SEQ ID NO: 201753 - DNA, 20 bp, human
gggccccgccgcgcctagtg

SEQ ID NO: 201754 - DNA, 20 bp, human
ggacacggggcatccccact

SEQ ID NO: 201755 - DNA, 20 bp, human
gtgtgcgtgtggatccacgt

SEQ ID NO: 201756 - DNA, 20 bp, human
gcgcctccctgccaaggtag

SEQ ID NO: 201757 - DNA, 20 bp, human
gcgcggcccctaccttggca

SEQ ID NO: 201758 - DNA, 20 bp, human
gaaaggcgacgcgggaggag

SEQ ID NO: 201759 - DNA, 20 bp, human
ggcacgccccgcgcatctga

SEQ ID NO: 201760 - DNA, 20 bp, human
ggagcagagcaactacccac

SEQ ID NO: 201761 - DNA, 20 bp, human
gcggcgcacaccagagtacg

SEQ ID NO: 201762 - DNA, 20 bp, human
gcgctccggctaatgaaggt

SEQ ID NO: 201763 - DNA, 20 bp, human
gaggtgaagccgagcgcccg

SEQ ID NO: 201764 - DNA, 20 bp, human
gcagagtacggggcacgtcg

SEQ ID NO: 201765 - DNA, 20 bp, human
ggctttgtacactttgtcaa

SEQ ID NO: 201766 - DNA, 20 bp, human
gggaagagcccgccatcgga

SEQ ID NO: 201767 - DNA, 20 bp, human
gccacagccagcatggaccg

SEQ ID NO: 201768 - DNA, 20 bp, human
gcggaacccaaggcgagcgg

SEQ ID NO: 201769 - DNA, 20 bp, human
ggataagggttcggaaccca

SEQ ID NO: 201770 - DNA, 20 bp, human
gctccgcgcgcccactgcgg

SEQ ID NO: 201771 - DNA, 20 bp, human
ggccgggaagagcccgccat

SEQ ID NO: 201772 - DNA, 20 bp, human
gctgggccgccgagacagcg

SEQ ID NO: 201773 - DNA, 20 bp, human
gggctgctccggggaggacc

SEQ ID NO: 201774 - DNA, 20 bp, human
gcgggaaacggcgtccgccg

SEQ ID NO: 201775 - DNA, 20 bp, human
ggcagggtaaatgaacgctg

SEQ ID NO: 201776 - DNA, 20 bp, human
gagcggcgaacccagctcca

SEQ ID NO: 201777 - DNA, 20 bp, human
gcgctcggtctgacgagact

SEQ ID NO: 201778 - DNA, 20 bp, human
gtacccggatggaagtgtaa

SEQ ID NO: 201779 - DNA, 20 bp, human
gtacattctaggagctgggt

SEQ ID NO: 201780 - DNA, 20 bp, human
ggccgccatcagggactcgc

SEQ ID NO: 201781 - DNA, 20 bp, human
gaggcaatgggtactacgac

SEQ ID NO: 201782 - DNA, 20 bp, human
gctgggcagtcccgctgacg

SEQ ID NO: 201783 - DNA, 20 bp, human
gagtgtaatggccgccatca

SEQ ID NO: 201784 - DNA, 20 bp, human
gccgcggggcagccgaaccc

SEQ ID NO: 201785 - DNA, 20 bp, human
gtcagggactcgcaggcaat

SEQ ID NO: 201786 - DNA, 20 bp, human
gcgtggggcaccggctgggg

SEQ ID NO: 201787 - DNA, 20 bp, human
gcccgggtagggacctacag

SEQ ID NO: 201788 - DNA, 20 bp, human
ggtgccaggtcccggcgaag

SEQ ID NO: 201789 - DNA, 20 bp, human
ggcgcacaaaggcgagctgg

SEQ ID NO: 201790 - DNA, 20 bp, human
ggaaggggcgtctacaccgc

SEQ ID NO: 201791 - DNA, 20 bp, human
ggcggggtcgcggcgcacaa

SEQ ID NO: 201792 - DNA, 20 bp, human
gcgacgcgccggggcgaccg

SEQ ID NO: 201793 - DNA, 20 bp, human
gtacccggcaggccggattc

SEQ ID NO: 201794 - DNA, 20 bp, human
gacgccccttcgccgggacc

SEQ ID NO: 201795 - DNA, 20 bp, human
gtagggacctacagcgggcg

SEQ ID NO: 201796 - DNA, 20 bp, human
gcgtaccgagactggggagg

SEQ ID NO: 201797 - DNA, 20 bp, human
gcacagagcgacggagtgag

SEQ ID NO: 201798 - DNA, 20 bp, human
gaagccctaaccccgcgctc

SEQ ID NO: 201799 - DNA, 20 bp, human
gtcacttcagccagagcgcg

SEQ ID NO: 201800 - DNA, 20 bp, human
gctgcaccggaggggactga

SEQ ID NO: 201801 - DNA, 20 bp, human
gcctctgctccgggagactt

SEQ ID NO: 201802 - DNA, 20 bp, human
gcagccagagcgcggggtta

SEQ ID NO: 201803 - DNA, 20 bp, human
gcccaggttgtgaggtgatg

SEQ ID NO: 201804 - DNA, 20 bp, human
ggtgatgaggcgaaagtcat

SEQ ID NO: 201805 - DNA, 20 bp, human
gtctggctgaagtgagacaa

SEQ ID NO: 201806 - DNA, 20 bp, human
gatcaggatggctccagagg

SEQ ID NO: 201807 - DNA, 20 bp, human
gaccggggctctaaagtcta

SEQ ID NO: 201808 - DNA, 20 bp, human
ggcccccaaagccatcagga

SEQ ID NO: 201809 - DNA, 20 bp, human
ggtacagagcgagtccctgc

SEQ ID NO: 201810 - DNA, 20 bp, human
gacccgagccgacggccccc

SEQ ID NO: 201811 - DNA, 20 bp, human
ggctctgtacgtaatcactg

SEQ ID NO: 201812 - DNA, 20 bp, human
gtctacggctgcctcggcag

SEQ ID NO: 201813 - DNA, 20 bp, human
gccgcgcccccgcccagaga

SEQ ID NO: 201814 - DNA, 20 bp, human
ggccaaagcacccgagccga

SEQ ID NO: 201815 - DNA, 20 bp, human
gggcggctggcgctggaccg

SEQ ID NO: 201816 - DNA, 20 bp, human
gcgagcgcgggagcaggaac

SEQ ID NO: 201817 - DNA, 20 bp, human
gcccgtgggagcgaaccgta

SEQ ID NO: 201818 - DNA, 20 bp, human
gctagactaggctaccccgt

SEQ ID NO: 201819 - DNA, 20 bp, human
gctctggacagcagtctatg

SEQ ID NO: 201820 - DNA, 20 bp, human
gagcgaaccgtatggaaagg

SEQ ID NO: 201821 - DNA, 20 bp, human
gggcaacggggccggcgcgt

SEQ ID NO: 201822 - DNA, 20 bp, human
gcgcgcgcgcgggggcaacg

SEQ ID NO: 201823 - DNA, 20 bp, human
ggggagcgaaccgtatggaa

SEQ ID NO: 201824 - DNA, 20 bp, human
ggtagcctagtctaggagtc

SEQ ID NO: 201825 - DNA, 20 bp, human
gccccggcgacatgcaaatg

SEQ ID NO: 201826 - DNA, 20 bp, human
gcgagggtctgtgtcaagag

SEQ ID NO: 201827 - DNA, 20 bp, human
gtctgtgtcaagagcggcag

SEQ ID NO: 201828 - DNA, 20 bp, human
gccctcggctccaggcgtgt

SEQ ID NO: 201829 - DNA, 20 bp, human
gctacttagggaaagaatgg

SEQ ID NO: 201830 - DNA, 20 bp, human
ggaatttccagggccctagt

SEQ ID NO: 201831 - DNA, 20 bp, human
gtgcaggagataagagaaac

SEQ ID NO: 201832 - DNA, 20 bp, human
gatccacacctcccattggg

SEQ ID NO: 201833 - DNA, 20 bp, human
gagccttggggcctgcgcta

SEQ ID NO: 201834 - DNA, 20 bp, human
ggtaggctcccgcacactaa

SEQ ID NO: 201835 - DNA, 20 bp, human
ggattggtcgccacgggtaa

SEQ ID NO: 201836 - DNA, 20 bp, human
gggcgggagcgggaagtcaa

SEQ ID NO: 201837 - DNA, 20 bp, human
gcctcgcggaggattctggg

SEQ ID NO: 201838 - DNA, 20 bp, human
gacgtcgcgggtctcggtcg

SEQ ID NO: 201839 - DNA, 20 bp, human
ggcggcgccgggaggtgagt

SEQ ID NO: 201840 - DNA, 20 bp, human
gggcccgtttgcagagcccg

SEQ ID NO: 201841 - DNA, 20 bp, human
gcgccgcgggctctgcaaac

SEQ ID NO: 201842 - DNA, 20 bp, human
gattctgggaggtgacgtcg

SEQ ID NO: 201843 - DNA, 20 bp, human
ggaggtgacgtcgcgggtct

SEQ ID NO: 201844 - DNA, 20 bp, human
gggagcgggaagtcaagggc

SEQ ID NO: 201845 - DNA, 20 bp, human
gttgtatccgcagaaacagg

SEQ ID NO: 201846 - DNA, 20 bp, human
ggtctgcagaaaccaggtct

SEQ ID NO: 201847 - DNA, 20 bp, human
gggagcaaaaaggcaggagt

SEQ ID NO: 201848 - DNA, 20 bp, human
ggaacagagggtccagatta

SEQ ID NO: 201849 - DNA, 20 bp, human
gtctatacccgggagctgag

SEQ ID NO: 201850 - DNA, 20 bp, human
ggacccggaagccgattgca

SEQ ID NO: 201851 - DNA, 20 bp, human
gtatagaagcagagaagaac

SEQ ID NO: 201852 - DNA, 20 bp, human
gctagacttaacatagacaa

SEQ ID NO: 201853 - DNA, 20 bp, human
gtccagattaaggagcaaaa

SEQ ID NO: 201854 - DNA, 20 bp, human
gcgccccaacagggcacgag

SEQ ID NO: 201855 - DNA, 20 bp, human
gcgataggaggtgtctacgt

SEQ ID NO: 201856 - DNA, 20 bp, human
ggcacccacggcacacacta

SEQ ID NO: 201857 - DNA, 20 bp, human
gggaggagctcgcggtgagg

SEQ ID NO: 201858 - DNA, 20 bp, human
ggactcaggacggtgagtag

SEQ ID NO: 201859 - DNA, 20 bp, human
gagttaagcctggcgagtcg

SEQ ID NO: 201860 - DNA, 20 bp, human
gctggcgagtcgaggtgacc

SEQ ID NO: 201861 - DNA, 20 bp, human
gcacgtggaccgacctcgcc

SEQ ID NO: 201862 - DNA, 20 bp, human
gatcacgtcaccgtagacca

SEQ ID NO: 201863 - DNA, 20 bp, human
gtcaggctcccggctccacg

SEQ ID NO: 201864 - DNA, 20 bp, human
gatcgtgtgaccctggtcta

SEQ ID NO: 201865 - DNA, 20 bp, human
gcgggagctgcggacgatgg

SEQ ID NO: 201866 - DNA, 20 bp, human
gcagcacctaggtccagatc

SEQ ID NO: 201867 - DNA, 20 bp, human
gcaaagtgcccgccacaggg

SEQ ID NO: 201868 - DNA, 20 bp, human
gacttccggcgtcctccctg

SEQ ID NO: 201869 - DNA, 20 bp, human
ggtgcaggtagcagagggtg

SEQ ID NO: 201870 - DNA, 20 bp, human
gctaggtgctgacagcgaga

SEQ ID NO: 201871 - DNA, 20 bp, human
gagggagcgggagagcgaca

SEQ ID NO: 201872 - DNA, 20 bp, human
gcagatccggcacccgcgga

SEQ ID NO: 201873 - DNA, 20 bp, human
gggtccagatccggcacccg

SEQ ID NO: 201874 - DNA, 20 bp, human
gcttgtgtcagttccatccg

SEQ ID NO: 201875 - DNA, 20 bp, human
gtccgcccagagtccgatgg

SEQ ID NO: 201876 - DNA, 20 bp, human
ggtcactgagctactacagt

SEQ ID NO: 201877 - DNA, 20 bp, human
gttttggctgccatgaaggg

SEQ ID NO: 201878 - DNA, 20 bp, human
gcaaaagcagaggagcttgc

SEQ ID NO: 201879 - DNA, 20 bp, human
ggcagggtctgagattactt

SEQ ID NO: 201880 - DNA, 20 bp, human
ggtgcattcacatactgtgt

SEQ ID NO: 201881 - DNA, 20 bp, human
gaagtgtccccaccctagca

SEQ ID NO: 201882 - DNA, 20 bp, human
gttcacatactgtgtaggga

SEQ ID NO: 201883 - DNA, 20 bp, human
gcttagacaccacacagcac

SEQ ID NO: 201884 - DNA, 20 bp, human
gaagctactaaagggtgttg

SEQ ID NO: 201885 - DNA, 20 bp, human
gagcactggtacgtgactaa

SEQ ID NO: 201886 - DNA, 20 bp, human
gcaccccggcccgcaggagt

SEQ ID NO: 201887 - DNA, 20 bp, human
ggggcggcgagcgaacaaaa

SEQ ID NO: 201888 - DNA, 20 bp, human
ggcggcgccgcgctgaacaa

SEQ ID NO: 201889 - DNA, 20 bp, human
gcgaaggccggctgtcccca

SEQ ID NO: 201890 - DNA, 20 bp, human
gcggacccaggggcgcgggt

SEQ ID NO: 201891 - DNA, 20 bp, human
gcgccgcgaaggccaacccc

SEQ ID NO: 201892 - DNA, 20 bp, human
ggggtgggacaggccactgc

SEQ ID NO: 201893 - DNA, 20 bp, human
gagcgaacaaaagggagcgc

SEQ ID NO: 201894 - DNA, 20 bp, human
ggagcctcacgcgctcaccc

SEQ ID NO: 201895 - DNA, 20 bp, human
ggcgaaggccaaccccggga

SEQ ID NO: 201896 - DNA, 20 bp, human
gtgtaccccagagataccaa

SEQ ID NO: 201897 - DNA, 20 bp, human
ggacccggaagtcgagatca

SEQ ID NO: 201898 - DNA, 20 bp, human
gcggcctagaagcctccaag

SEQ ID NO: 201899 - DNA, 20 bp, human
gacaaaggcaaactcacgag

SEQ ID NO: 201900 - DNA, 20 bp, human
gtcagcccttggtatctctg

SEQ ID NO: 201901 - DNA, 20 bp, human
gagtcgggtgccgggtctac

SEQ ID NO: 201902 - DNA, 20 bp, human
gaaggcaaactcacgagtgg

SEQ ID NO: 201903 - DNA, 20 bp, human
ggcgctttttcctgtagacc

SEQ ID NO: 201904 - DNA, 20 bp, human
gtctctggggtacacatcaa

SEQ ID NO: 201905 - DNA, 20 bp, human
gcattctctagagagtctgg

SEQ ID NO: 201906 - DNA, 20 bp, human
gtgatggagagaattaatgt

SEQ ID NO: 201907 - DNA, 20 bp, human
gcgtgtcccggcagtaccag

SEQ ID NO: 201908 - DNA, 20 bp, human
ggtacagtcagattagatgg

SEQ ID NO: 201909 - DNA, 20 bp, human
gagatcctatgatgacaacg

SEQ ID NO: 201910 - DNA, 20 bp, human
ggtttccacgttgtcatcat

SEQ ID NO: 201911 - DNA, 20 bp, human
gttagaaagggaccatccga

SEQ ID NO: 201912 - DNA, 20 bp, human
ggaattaatgtaggaattat

SEQ ID NO: 201913 - DNA, 20 bp, human
gtcaggtaaaaatccaagca

SEQ ID NO: 201914 - DNA, 20 bp, human
ggtcccggcagtaccagggg

SEQ ID NO: 201915 - DNA, 20 bp, human
gctgaggccagctttggaac

SEQ ID NO: 201916 - DNA, 20 bp, human
ggtaggctcggaccatagta

SEQ ID NO: 201917 - DNA, 20 bp, human
gcagaacagaacgatccctg

SEQ ID NO: 201918 - DNA, 20 bp, human
gcagcagctaagatcgggtc

SEQ ID NO: 201919 - DNA, 20 bp, human
gaggcccagcagctaagatc

SEQ ID NO: 201920 - DNA, 20 bp, human
gagtcccacagttcgagcaa

SEQ ID NO: 201921 - DNA, 20 bp, human
ggctcccttgctcgaactgt

SEQ ID NO: 201922 - DNA, 20 bp, human
gtgtgggacttaccctacta

SEQ ID NO: 201923 - DNA, 20 bp, human
gtcctctgtgggtgcagagt

SEQ ID NO: 201924 - DNA, 20 bp, human
gaatctgacgcacatcacac

SEQ ID NO: 201925 - DNA, 20 bp, human
gttatgcttgaggctattag

SEQ ID NO: 201926 - DNA, 20 bp, human
gcagctccgccaagccgcta

SEQ ID NO: 201927 - DNA, 20 bp, human
ggcctggggacgggccctag

SEQ ID NO: 201928 - DNA, 20 bp, human
gcgccgacgcactgccaggg

SEQ ID NO: 201929 - DNA, 20 bp, human
gcagcagccccggtacacac

SEQ ID NO: 201930 - DNA, 20 bp, human
gacgggccctagcggcttgg

SEQ ID NO: 201931 - DNA, 20 bp, human
gcgcgctcccagcaccgtct

SEQ ID NO: 201932 - DNA, 20 bp, human
ggcgtcggggagatccgata

SEQ ID NO: 201933 - DNA, 20 bp, human
gaggcaggcctgacgcgtcg

SEQ ID NO: 201934 - DNA, 20 bp, human
ggtcactgtgacgcgagccc

SEQ ID NO: 201935 - DNA, 20 bp, human
gcccgcggactacagagaaa

SEQ ID NO: 201936 - DNA, 20 bp, human
gccggtgaaggaagagaatg

SEQ ID NO: 201937 - DNA, 20 bp, human
gtcagggtggaaacatctac

SEQ ID NO: 201938 - DNA, 20 bp, human
gagggtgcatgcaggatcgg

SEQ ID NO: 201939 - DNA, 20 bp, human
gctcttccttcaccggatgg

SEQ ID NO: 201940 - DNA, 20 bp, human
gaggctcccccatccggtga

SEQ ID NO: 201941 - DNA, 20 bp, human
gatctacaggctcccccatc

SEQ ID NO: 201942 - DNA, 20 bp, human
gaggtgtgtgccaatatacg

SEQ ID NO: 201943 - DNA, 20 bp, human
gggccagaggactcctgcca

SEQ ID NO: 201944 - DNA, 20 bp, human
ggtccagggccggcacagga

SEQ ID NO: 201945 - DNA, 20 bp, human
gggccctggacaagtgagtg

SEQ ID NO: 201946 - DNA, 20 bp, human
ggctggacgcgcctacccag

SEQ ID NO: 201947 - DNA, 20 bp, human
gcgtccagcggcctgagcag

SEQ ID NO: 201948 - DNA, 20 bp, human
ggcattcccgggccccgcta

SEQ ID NO: 201949 - DNA, 20 bp, human
gtcaggctcccgccaagatg

SEQ ID NO: 201950 - DNA, 20 bp, human
gccagcggcctgagcagggg

SEQ ID NO: 201951 - DNA, 20 bp, human
gtcatctccgtgagcaggat

SEQ ID NO: 201952 - DNA, 20 bp, human
gcgcgcctacccagcggtcc

SEQ ID NO: 201953 - DNA, 20 bp, human
gcaaagcgggcgcagcgtcg

SEQ ID NO: 201954 - DNA, 20 bp, human
gtcccgccaagatgcggaga

SEQ ID NO: 201955 - DNA, 20 bp, human
gccggtggaacaccccgtta

SEQ ID NO: 201956 - DNA, 20 bp, human
gagtctggcggcctcaaggt

SEQ ID NO: 201957 - DNA, 20 bp, human
gcggtgcgtgcaggtgagtc

SEQ ID NO: 201958 - DNA, 20 bp, human
gtgcacgcaccggccaatgg

SEQ ID NO: 201959 - DNA, 20 bp, human
gcgacccaggcaccctctgt

SEQ ID NO: 201960 - DNA, 20 bp, human
gatgcggcgaggccgagcaa

SEQ ID NO: 201961 - DNA, 20 bp, human
gcgacccagcgggcctctcc

SEQ ID NO: 201962 - DNA, 20 bp, human
gggtgggccctcccgacaga

SEQ ID NO: 201963 - DNA, 20 bp, human
gctcccgacagagggtgcct

SEQ ID NO: 201964 - DNA, 20 bp, human
gccaccggaagcaccgccat

SEQ ID NO: 201965 - DNA, 20 bp, human
gggcctcaaggttggctcgg

SEQ ID NO: 201966 - DNA, 20 bp, human
gagtgttgcctggaccccaa

SEQ ID NO: 201967 - DNA, 20 bp, human
ggcccgcaagtgaataataa

SEQ ID NO: 201968 - DNA, 20 bp, human
ggagaagtccgagctaggtg

SEQ ID NO: 201969 - DNA, 20 bp, human
gctgctgtgtgcaaacaccg

SEQ ID NO: 201970 - DNA, 20 bp, human
gaacaccgaggccgtgagga

SEQ ID NO: 201971 - DNA, 20 bp, human
gcgcaatgtaaagggccctt

SEQ ID NO: 201972 - DNA, 20 bp, human
gaagtccgagctaggtgagg

SEQ ID NO: 201973 - DNA, 20 bp, human
gcagcaagaaggtacagacc

SEQ ID NO: 201974 - DNA, 20 bp, human
gcgttaagaacgcaatgtaa

SEQ ID NO: 201975 - DNA, 20 bp, human
ggcgctccagggcccagacc

SEQ ID NO: 201976 - DNA, 20 bp, human
ggcagaggcggtagtgacac

SEQ ID NO: 201977 - DNA, 20 bp, human
gacacaggcacaactgacag

SEQ ID NO: 201978 - DNA, 20 bp, human
gcttggttccttgtacgcag

SEQ ID NO: 201979 - DNA, 20 bp, human
gccgccgaagaacccgaggt

SEQ ID NO: 201980 - DNA, 20 bp, human
gagtccagccagggaagaga

SEQ ID NO: 201981 - DNA, 20 bp, human
gtgccaagtgggccgcgtcg

SEQ ID NO: 201982 - DNA, 20 bp, human
gggttccttgtacgcagagg

SEQ ID NO: 201983 - DNA, 20 bp, human
gtgacaaggactggggacgg

SEQ ID NO: 201984 - DNA, 20 bp, human
ggactccgcaagtccagcca

SEQ ID NO: 201985 - DNA, 20 bp, human
ggtccccgccgaagaacccg

SEQ ID NO: 201986 - DNA, 20 bp, human
gtgacgtcagacagagccat

SEQ ID NO: 201987 - DNA, 20 bp, human
gcagagccataggccgaagt

SEQ ID NO: 201988 - DNA, 20 bp, human
gctgaacctgaggtccctaa

SEQ ID NO: 201989 - DNA, 20 bp, human
gacttccgccgtcctcctgg

SEQ ID NO: 201990 - DNA, 20 bp, human
ggtccctaacgggagctctg

SEQ ID NO: 201991 - DNA, 20 bp, human
gctcggttcccaccacggag

SEQ ID NO: 201992 - DNA, 20 bp, human
gggctgtgttggggcgtcag

SEQ ID NO: 201993 - DNA, 20 bp, human
gagctcccgttagggacctc

SEQ ID NO: 201994 - DNA, 20 bp, human
gcatggaggcgctgccgagt

SEQ ID NO: 201995 - DNA, 20 bp, human
gagcactgggaggaccggtc

SEQ ID NO: 201996 - DNA, 20 bp, human
gaggtggtgtccgcccgcag

SEQ ID NO: 201997 - DNA, 20 bp, human
gaaaggcgggcggtaaagcc

SEQ ID NO: 201998 - DNA, 20 bp, human
gcgggcggtgaggtgaagaa

SEQ ID NO: 201999 - DNA, 20 bp, human
gggtcctcagagctgacggg

SEQ ID NO: 202000 - DNA, 20 bp, human
gagagcgttgcgtaccgtgg

SEQ ID NO: 202001 - DNA, 20 bp, human
gacagcgaggagttctgggt

SEQ ID NO: 202002 - DNA, 20 bp, human
gaactggagccggaaaccgg

SEQ ID NO: 202003 - DNA, 20 bp, human
gtgggtccgggccaggtaac

SEQ ID NO: 202004 - DNA, 20 bp, human
gtcagagctgacgggcggtg

SEQ ID NO: 202005 - DNA, 20 bp, human
gtctgcgcgtgcagccccca

SEQ ID NO: 202006 - DNA, 20 bp, human
gtgtgctgggaaggatggta

SEQ ID NO: 202007 - DNA, 20 bp, human
ggcaggcgaccgcgacacag

SEQ ID NO: 202008 - DNA, 20 bp, human
ggcccgagaaaggacatggt

SEQ ID NO: 202009 - DNA, 20 bp, human
gcccgggtcctacaacggtg

SEQ ID NO: 202010 - DNA, 20 bp, human
ggggtcccggaacccctcac

SEQ ID NO: 202011 - DNA, 20 bp, human
ggcaggcccgagaaaggaca

SEQ ID NO: 202012 - DNA, 20 bp, human
ggcgaccgcagtcctcctcg

SEQ ID NO: 202013 - DNA, 20 bp, human
gggttggaagagccacgagg

SEQ ID NO: 202014 - DNA, 20 bp, human
gaaggatggtagggcgactg

SEQ ID NO: 202015 - DNA, 20 bp, human
gcctaccccgggtcctacaa

SEQ ID NO: 202016 - DNA, 20 bp, human
gagtccacggagctcaatgg

SEQ ID NO: 202017 - DNA, 20 bp, human
gggaggtcgcgactgaggga

SEQ ID NO: 202018 - DNA, 20 bp, human
gcctagtccacggagctcaa

SEQ ID NO: 202019 - DNA, 20 bp, human
ggtgtgtacggaaatgtgac

SEQ ID NO: 202020 - DNA, 20 bp, human
gacttccggcgtcctcctcg

SEQ ID NO: 202021 - DNA, 20 bp, human
gcgacctccactgcagaaac

SEQ ID NO: 202022 - DNA, 20 bp, human
gcaaaatgaccgccacgagg

SEQ ID NO: 202023 - DNA, 20 bp, human
gtccggcgtcctcctcgtgg

SEQ ID NO: 202024 - DNA, 20 bp, human
gcagtggaggtcgcgactga

SEQ ID NO: 202025 - DNA, 20 bp, human
gactggcgggctggacaaac

SEQ ID NO: 202026 - DNA, 20 bp, human
gggagatggacggatccggg

SEQ ID NO: 202027 - DNA, 20 bp, human
gagagcgacaggtacaggga

SEQ ID NO: 202028 - DNA, 20 bp, human
ggagcgctgtgttgggaccg

SEQ ID NO: 202029 - DNA, 20 bp, human
gggtgaccggagagcacgga

SEQ ID NO: 202030 - DNA, 20 bp, human
gggtggtgactggatccagg

SEQ ID NO: 202031 - DNA, 20 bp, human
gttgggaccgtggtggtgac

SEQ ID NO: 202032 - DNA, 20 bp, human
gggaaatggtcgctactaaa

SEQ ID NO: 202033 - DNA, 20 bp, human
gtagtagcgaccatttccat

SEQ ID NO: 202034 - DNA, 20 bp, human
gtagggaacaacctgtgagg

SEQ ID NO: 202035 - DNA, 20 bp, human
gtcctcctggaaaagcaagg

SEQ ID NO: 202036 - DNA, 20 bp, human
gacgcgcgcagaggtaaact

SEQ ID NO: 202037 - DNA, 20 bp, human
gcgagcgccgaggagccgag

SEQ ID NO: 202038 - DNA, 20 bp, human
gggctgcggcgagttcctga

SEQ ID NO: 202039 - DNA, 20 bp, human
gaggcccagcctgcaaggag

SEQ ID NO: 202040 - DNA, 20 bp, human
ggcgtcccagggacacgcag

SEQ ID NO: 202041 - DNA, 20 bp, human
gcgatagggtccccacggga

SEQ ID NO: 202042 - DNA, 20 bp, human
ggtcgcgatagggtccccac

SEQ ID NO: 202043 - DNA, 20 bp, human
gcggctcccgaccctcccgt

SEQ ID NO: 202044 - DNA, 20 bp, human
gagggtccccacgggagggt

SEQ ID NO: 202045 - DNA, 20 bp, human
gtgggcgcaggtgaccatcg

SEQ ID NO: 202046 - DNA, 20 bp, human
gggacgccagggaccgctag

SEQ ID NO: 202047 - DNA, 20 bp, human
ggtgccccgcctgcccctag

SEQ ID NO: 202048 - DNA, 20 bp, human
ggacaggaaccgggacgcca

SEQ ID NO: 202049 - DNA, 20 bp, human
ggcactcacggctaggacag

SEQ ID NO: 202050 - DNA, 20 bp, human
gaggtgagcgcgacaggaac

SEQ ID NO: 202051 - DNA, 20 bp, human
ggagcctggaccgcacctcg

SEQ ID NO: 202052 - DNA, 20 bp, human
ggccagggaccgctaggggc

SEQ ID NO: 202053 - DNA, 20 bp, human
ggcctgcccctagcggtccc

SEQ ID NO: 202054 - DNA, 20 bp, human
ggccgcagcgaaacgctccg

SEQ ID NO: 202055 - DNA, 20 bp, human
gcggggaccccgggacgacg

SEQ ID NO: 202056 - DNA, 20 bp, human
gggacacctgtggtcactca

SEQ ID NO: 202057 - DNA, 20 bp, human
gggtgcaggtgagcacgacg

SEQ ID NO: 202058 - DNA, 20 bp, human
gagcacgacggggacacctg

SEQ ID NO: 202059 - DNA, 20 bp, human
gaactccccgcaggacccgg

SEQ ID NO: 202060 - DNA, 20 bp, human
gctgttgcaccgcctcgctg

SEQ ID NO: 202061 - DNA, 20 bp, human
gtcgcccctcccagggacgt

SEQ ID NO: 202062 - DNA, 20 bp, human
gtgctcctcgcagccggtgc

SEQ ID NO: 202063 - DNA, 20 bp, human
gaacttcgcgagaccccaca

SEQ ID NO: 202064 - DNA, 20 bp, human
gaggacccgggggtgacaca

SEQ ID NO: 202065 - DNA, 20 bp, human
ggctccctgctcctcgcagc

SEQ ID NO: 202066 - DNA, 20 bp, human
gcggaatgaagcacctctcg

SEQ ID NO: 202067 - DNA, 20 bp, human
ggctagccggagaccggaag

SEQ ID NO: 202068 - DNA, 20 bp, human
gagccgcgcttgcagcgtct

SEQ ID NO: 202069 - DNA, 20 bp, human
gctctctggactcggactca

SEQ ID NO: 202070 - DNA, 20 bp, human
ggcacagcccgaggcctcag

SEQ ID NO: 202071 - DNA, 20 bp, human
gagtgtggctagccggagac

SEQ ID NO: 202072 - DNA, 20 bp, human
ggttgggaaaccctgctgga

SEQ ID NO: 202073 - DNA, 20 bp, human
gactactgtaatctagaggg

SEQ ID NO: 202074 - DNA, 20 bp, human
gagcgtctgggagaatcttt

SEQ ID NO: 202075 - DNA, 20 bp, human
gctcccagacgctgcaagcg

SEQ ID NO: 202076 - DNA, 20 bp, human
ggccgactcgcggggacgga

SEQ ID NO: 202077 - DNA, 20 bp, human
gggactgtcctgtacaacgt

SEQ ID NO: 202078 - DNA, 20 bp, human
gaagcgcggggcggtaccgt

SEQ ID NO: 202079 - DNA, 20 bp, human
gtccctccgtccccgcgagt

SEQ ID NO: 202080 - DNA, 20 bp, human
gggcctcatgaaccgaaaca

SEQ ID NO: 202081 - DNA, 20 bp, human
gcggggcggtaccgtgggag

SEQ ID NO: 202082 - DNA, 20 bp, human
gcgggccctgcgtccctcca

SEQ ID NO: 202083 - DNA, 20 bp, human
gggccaaaagcgccgactcg

SEQ ID NO: 202084 - DNA, 20 bp, human
ggcttttggccccgcgggag

SEQ ID NO: 202085 - DNA, 20 bp, human
ggccagtcgctcaccgagcc

SEQ ID NO: 202086 - DNA, 20 bp, human
gcagccacgcgagagtagaa

SEQ ID NO: 202087 - DNA, 20 bp, human
ggaacgcgctgttaagatgg

SEQ ID NO: 202088 - DNA, 20 bp, human
gccacgcgagagtagaaggg

SEQ ID NO: 202089 - DNA, 20 bp, human
ggcgttcccgttggcgtctg

SEQ ID NO: 202090 - DNA, 20 bp, human
gctgtcctcaggggtcgagg

SEQ ID NO: 202091 - DNA, 20 bp, human
ggcagccgcctcgacccctg

SEQ ID NO: 202092 - DNA, 20 bp, human
gcgggaacgcgctgttaaga

SEQ ID NO: 202093 - DNA, 20 bp, human
gcgccgcgccgggccctatg

SEQ ID NO: 202094 - DNA, 20 bp, human
gcgctttgggcggattgggt

SEQ ID NO: 202095 - DNA, 20 bp, human
gaaaggcacaacgctggatg

SEQ ID NO: 202096 - DNA, 20 bp, human
gcagccacgcgagagtagaa

SEQ ID NO: 202097 - DNA, 20 bp, human
gccacgcgagagtagaaggg

SEQ ID NO: 202098 - DNA, 20 bp, human
gggacaggctccatttcact

SEQ ID NO: 202099 - DNA, 20 bp, human
gaaaggcacaacgctggatg

SEQ ID NO: 202100 - DNA, 20 bp, human
ggctgttccttatagagaaa

SEQ ID NO: 202101 - DNA, 20 bp, human
gtactctcgcgtggctgcac

SEQ ID NO: 202102 - DNA, 20 bp, human
ggcggcgttcggtggtgtcc

SEQ ID NO: 202103 - DNA, 20 bp, human
gcgccgcgccgggccctatg

SEQ ID NO: 202104 - DNA, 20 bp, human
gctgtcctcaggggtcgagg

SEQ ID NO: 202105 - DNA, 20 bp, human
gtagagaaaaggcacaacgc

SEQ ID NO: 202106 - DNA, 20 bp, human
ggaacgaccagacaacacaa

SEQ ID NO: 202107 - DNA, 20 bp, human
gtcccctagaggagccgggt

SEQ ID NO: 202108 - DNA, 20 bp, human
gcgggtgggaagtgcagtat

SEQ ID NO: 202109 - DNA, 20 bp, human
ggtggagtcgccaggtccgt

SEQ ID NO: 202110 - DNA, 20 bp, human
gaaagtggctctgaggaaac

SEQ ID NO: 202111 - DNA, 20 bp, human
ggaggctcgtgtggactagt

SEQ ID NO: 202112 - DNA, 20 bp, human
gttcccacccggctcctcta

SEQ ID NO: 202113 - DNA, 20 bp, human
gcgtggggctacaggatctt

SEQ ID NO: 202114 - DNA, 20 bp, human
gcaggagtcgcggagccatc

SEQ ID NO: 202115 - DNA, 20 bp, human
ggtcgcggagccatcgggtg

SEQ ID NO: 202116 - DNA, 20 bp, human
ggcagactccaccaccataa

SEQ ID NO: 202117 - DNA, 20 bp, human
gcgaaaccgcactgacggag

SEQ ID NO: 202118 - DNA, 20 bp, human
gccagcgccggaaaagatgg

SEQ ID NO: 202119 - DNA, 20 bp, human
gatccccgggaccgccaagg

SEQ ID NO: 202120 - DNA, 20 bp, human
gctgtgcgtccagttcggag

SEQ ID NO: 202121 - DNA, 20 bp, human
gtgcggtttcgcctttatgg

SEQ ID NO: 202122 - DNA, 20 bp, human
gtggctcctctccgtcagtg

SEQ ID NO: 202123 - DNA, 20 bp, human
gaaaggcgaaaccgcactga

SEQ ID NO: 202124 - DNA, 20 bp, human
ggctatccccgggaccgcca

SEQ ID NO: 202125 - DNA, 20 bp, human
gccgaactggacgcacaggg

SEQ ID NO: 202126 - DNA, 20 bp, human
gccacagccggtaaagatgg

SEQ ID NO: 202127 - DNA, 20 bp, human
ggcatgttcctggtgagcaa

SEQ ID NO: 202128 - DNA, 20 bp, human
gccagacgcgggagaatgcg

SEQ ID NO: 202129 - DNA, 20 bp, human
gcaccacaataaaggttaaa

SEQ ID NO: 202130 - DNA, 20 bp, human
gagaactcaccacagcgggg

SEQ ID NO: 202131 - DNA, 20 bp, human
gcagccggtaaagatggcgg

SEQ ID NO: 202132 - DNA, 20 bp, human
ggcctctggccagttccgag

SEQ ID NO: 202133 - DNA, 20 bp, human
gaagagataggttccagacg

SEQ ID NO: 202134 - DNA, 20 bp, human
ggagccacagccggtaaaga

SEQ ID NO: 202135 - DNA, 20 bp, human
ggcctctcggaactggccag

SEQ ID NO: 202136 - DNA, 20 bp, human
ggggcgtctctcagcgactg

SEQ ID NO: 202137 - DNA, 20 bp, human
gaggctacacagacgttcca

SEQ ID NO: 202138 - DNA, 20 bp, human
ggcgggtcccactgtgacag

SEQ ID NO: 202139 - DNA, 20 bp, human
gtgccgcgcagggaccggat

SEQ ID NO: 202140 - DNA, 20 bp, human
gggtcaggcgtcccaaaagt

SEQ ID NO: 202141 - DNA, 20 bp, human
gcagaccccggagctgacgg

SEQ ID NO: 202142 - DNA, 20 bp, human
gaaccggccgcggcgaacgt

SEQ ID NO: 202143 - DNA, 20 bp, human
ggtgaccctcccccaatcct

SEQ ID NO: 202144 - DNA, 20 bp, human
gggaggaccctggaacatcc

SEQ ID NO: 202145 - DNA, 20 bp, human
gttgggggagggtcacggaa

SEQ ID NO: 202146 - DNA, 20 bp, human
ggaccggaacccaaacgcag

SEQ ID NO: 202147 - DNA, 20 bp, human
gccactggagaagcggagac

SEQ ID NO: 202148 - DNA, 20 bp, human
ggtacaaacaatctggagag

SEQ ID NO: 202149 - DNA, 20 bp, human
gacacgggagggtcataagg

SEQ ID NO: 202150 - DNA, 20 bp, human
gacaggccggagagagccgt

SEQ ID NO: 202151 - DNA, 20 bp, human
gtacggcccaacccaccctg

SEQ ID NO: 202152 - DNA, 20 bp, human
gcgctgcggtggagccaccg

SEQ ID NO: 202153 - DNA, 20 bp, human
gaacgcagcggacacgaaac

SEQ ID NO: 202154 - DNA, 20 bp, human
gagcgcgccagacgctgcgg

SEQ ID NO: 202155 - DNA, 20 bp, human
gctgcggccgaggggacaga

SEQ ID NO: 202156 - DNA, 20 bp, human
gaggacccggacgcgaccag

SEQ ID NO: 202157 - DNA, 20 bp, human
gacccggacgcgaccagggg

SEQ ID NO: 202158 - DNA, 20 bp, human
ggcctgcgcgcacagattcg

SEQ ID NO: 202159 - DNA, 20 bp, human
gagttagctccgcaaggacc

SEQ ID NO: 202160 - DNA, 20 bp, human
gctggccgcggtgaccgagg

SEQ ID NO: 202161 - DNA, 20 bp, human
gggatacaggaatacacaag

SEQ ID NO: 202162 - DNA, 20 bp, human
gcgacgttgctggtaataga

SEQ ID NO: 202163 - DNA, 20 bp, human
gccgcgtcgcggagacttct

SEQ ID NO: 202164 - DNA, 20 bp, human
gggcctggccgcggtgaccg

SEQ ID NO: 202165 - DNA, 20 bp, human
ggccctctccgaagactcgt

SEQ ID NO: 202166 - DNA, 20 bp, human
gcgcgctggcgggaccctca

SEQ ID NO: 202167 - DNA, 20 bp, human
gagaaccctccccggcactg

SEQ ID NO: 202168 - DNA, 20 bp, human
gtgtgcggcagagttcaggt

SEQ ID NO: 202169 - DNA, 20 bp, human
ggctgcttcgaaagctggta

SEQ ID NO: 202170 - DNA, 20 bp, human
gggaaacacactcatcacaa

SEQ ID NO: 202171 - DNA, 20 bp, human
gaggtgagaaacccgggaga

SEQ ID NO: 202172 - DNA, 20 bp, human
gactaccccagtgccgggga

SEQ ID NO: 202173 - DNA, 20 bp, human
gtccgaggccgtgctgcaca

SEQ ID NO: 202174 - DNA, 20 bp, human
ggagggagcaggaccacgtg

SEQ ID NO: 202175 - DNA, 20 bp, human
gagcacggcctcggagactg

SEQ ID NO: 202176 - DNA, 20 bp, human
gcggccggcaaccgaaggtg

SEQ ID NO: 202177 - DNA, 20 bp, human
gtgaggctggtgggtcccgc

SEQ ID NO: 202178 - DNA, 20 bp, human
gcggcaaccgaaggtgaggc

SEQ ID NO: 202179 - DNA, 20 bp, human
gaaccgaaggtgaggctggt

SEQ ID NO: 202180 - DNA, 20 bp, human
ggcctcagagaaggctggga

SEQ ID NO: 202181 - DNA, 20 bp, human
ggcatgcgcagacgcccggc

SEQ ID NO: 202182 - DNA, 20 bp, human
gggtcccgcgggcgcggaga

SEQ ID NO: 202183 - DNA, 20 bp, human
gtgacccgtaaggaaggctg

SEQ ID NO: 202184 - DNA, 20 bp, human
gggtgacggtgtgacccgta

SEQ ID NO: 202185 - DNA, 20 bp, human
gcgagtccgggcctcagaga

SEQ ID NO: 202186 - DNA, 20 bp, human
ggtgaaggcgacccgcagat

SEQ ID NO: 202187 - DNA, 20 bp, human
gctggcgcggagggatggtt

SEQ ID NO: 202188 - DNA, 20 bp, human
gcccagagtgtcccgagtag

SEQ ID NO: 202189 - DNA, 20 bp, human
gtttctgagatgctgggtga

SEQ ID NO: 202190 - DNA, 20 bp, human
ggctgtagcgagtgtgaacg

SEQ ID NO: 202191 - DNA, 20 bp, human
gagtgctcagggtacgctaa

SEQ ID NO: 202192 - DNA, 20 bp, human
ggaaacgtcgctggcgcgga

SEQ ID NO: 202193 - DNA, 20 bp, human
gtgctgggaggtgttgtcct

SEQ ID NO: 202194 - DNA, 20 bp, human
gacgggacacggatcctcta

SEQ ID NO: 202195 - DNA, 20 bp, human
ggtgtcccgagtagcggcag

SEQ ID NO: 202196 - DNA, 20 bp, human
gtctcggtccgttacaccag

SEQ ID NO: 202197 - DNA, 20 bp, human
gctcagggaaccacaagcac

SEQ ID NO: 202198 - DNA, 20 bp, human
ggcactgaggccggcgctgt

SEQ ID NO: 202199 - DNA, 20 bp, human
gagcgtcgcccctggtgtaa

SEQ ID NO: 202200 - DNA, 20 bp, human
gctgagagcgccacaagtct

SEQ ID NO: 202201 - DNA, 20 bp, human
ggtgcaaacgtgcatgacag

SEQ ID NO: 202202 - DNA, 20 bp, human
gccgtaagcggatttcgtgg

SEQ ID NO: 202203 - DNA, 20 bp, human
gtgtaacggaccgagacttg

SEQ ID NO: 202204 - DNA, 20 bp, human
gctctgggaagcgtcgcccc

SEQ ID NO: 202205 - DNA, 20 bp, human
gaaagtggcagagccggcgc

SEQ ID NO: 202206 - DNA, 20 bp, human
gcggcgcagctgaaaggtac

SEQ ID NO: 202207 - DNA, 20 bp, human
gctcccgggccgctcgtggt

SEQ ID NO: 202208 - DNA, 20 bp, human
gcgcggccggcgcagctgaa

SEQ ID NO: 202209 - DNA, 20 bp, human
ggaaaggtacaggtactccc

SEQ ID NO: 202210 - DNA, 20 bp, human
gctccaaggcgagctctccg

SEQ ID NO: 202211 - DNA, 20 bp, human
ggggccgctcgtggtaggca

SEQ ID NO: 202212 - DNA, 20 bp, human
gggccacggagagctcgcct

SEQ ID NO: 202213 - DNA, 20 bp, human
gcgagctctccgtggcctcg

SEQ ID NO: 202214 - DNA, 20 bp, human
gggacggtaggggcggtcag

SEQ ID NO: 202215 - DNA, 20 bp, human
gcccggggacgccatcacag

SEQ ID NO: 202216 - DNA, 20 bp, human
gtccatccaactaagggtag

SEQ ID NO: 202217 - DNA, 20 bp, human
gctgggttccatccaactaa

SEQ ID NO: 202218 - DNA, 20 bp, human
gctgggtgcgaggaagtcaa

SEQ ID NO: 202219 - DNA, 20 bp, human
ggctcggggaatctgcactc

SEQ ID NO: 202220 - DNA, 20 bp, human
gcttctttccgggcccgtaa

SEQ ID NO: 202221 - DNA, 20 bp, human
ggtgacagcctcgcactgaa

SEQ ID NO: 202222 - DNA, 20 bp, human
gggacgtggacaggcacacg

SEQ ID NO: 202223 - DNA, 20 bp, human
gtctcaccgctacccttagt

SEQ ID NO: 202224 - DNA, 20 bp, human
gcttgtgatagataccctgg

SEQ ID NO: 202225 - DNA, 20 bp, human
ggccttgccggtatgggaaa

SEQ ID NO: 202226 - DNA, 20 bp, human
gaggttcgcaaggtccgtga

SEQ ID NO: 202227 - DNA, 20 bp, human
ggctccagccgactgtaaga

SEQ ID NO: 202228 - DNA, 20 bp, human
gagccttaaggtcctgacag

SEQ ID NO: 202229 - DNA, 20 bp, human
gaaggtccgtgaaggaagcc

SEQ ID NO: 202230 - DNA, 20 bp, human
gtcgtgagcgaaaagtagtg

SEQ ID NO: 202231 - DNA, 20 bp, human
gcctgacagcggctagaaga

SEQ ID NO: 202232 - DNA, 20 bp, human
ggcacgacctcagatgtcac

SEQ ID NO: 202233 - DNA, 20 bp, human
gatttggagtggggtttcca

SEQ ID NO: 202234 - DNA, 20 bp, human
ggaatacagcggggtgaagg

SEQ ID NO: 202235 - DNA, 20 bp, human
gctgaggctagaatacagcg

SEQ ID NO: 202236 - DNA, 20 bp, human
gctgcgagcggttcccggtg

SEQ ID NO: 202237 - DNA, 20 bp, human
gggcaggtgagcccaccccg

SEQ ID NO: 202238 - DNA, 20 bp, human
gtgtcacacgaggagtactg

SEQ ID NO: 202239 - DNA, 20 bp, human
gcgctaggagcattaacagg

SEQ ID NO: 202240 - DNA, 20 bp, human
gcacacgcacacgtccaggg

SEQ ID NO: 202241 - DNA, 20 bp, human
ggcaacccaaaagctgcgag

SEQ ID NO: 202242 - DNA, 20 bp, human
gaagcgctaggagcattaac

SEQ ID NO: 202243 - DNA, 20 bp, human
gggtgagtgggcggcctcac

SEQ ID NO: 202244 - DNA, 20 bp, human
gcccctgccgcggacaaaat

SEQ ID NO: 202245 - DNA, 20 bp, human
gaggagtactgcggcccggg

SEQ ID NO: 202246 - DNA, 20 bp, human
ggcacccccagcggtccggg

SEQ ID NO: 202247 - DNA, 20 bp, human
gagagtttaggaccctgggt

SEQ ID NO: 202248 - DNA, 20 bp, human
gcctgcacccccagcggtcc

SEQ ID NO: 202249 - DNA, 20 bp, human
gaaaggagcccccggaacag

SEQ ID NO: 202250 - DNA, 20 bp, human
gcaggctgcagtggacgtcc

SEQ ID NO: 202251 - DNA, 20 bp, human
gctaaactctcaaacccgga

SEQ ID NO: 202252 - DNA, 20 bp, human
ggccagcggttcttaaaact

SEQ ID NO: 202253 - DNA, 20 bp, human
gtttaggaccctgggttggt

SEQ ID NO: 202254 - DNA, 20 bp, human
gtttgagagtttaggaccct

SEQ ID NO: 202255 - DNA, 20 bp, human
ggttctgggtgctacaccca

SEQ ID NO: 202256 - DNA, 20 bp, human
ggtgggtgcatgaacagcag

SEQ ID NO: 202257 - DNA, 20 bp, human
ggaaccacgcgaaaacggaa

SEQ ID NO: 202258 - DNA, 20 bp, human
gaacgggaacacccaatcta

SEQ ID NO: 202259 - DNA, 20 bp, human
ggtgtagagccggtagggga

SEQ ID NO: 202260 - DNA, 20 bp, human
gcttgcgtgacggggatatg

SEQ ID NO: 202261 - DNA, 20 bp, human
gttgagtgtagagccggtag

SEQ ID NO: 202262 - DNA, 20 bp, human
gcggaagggaagccatagat

SEQ ID NO: 202263 - DNA, 20 bp, human
ggaagtggaatccgaactcg

SEQ ID NO: 202264 - DNA, 20 bp, human
gaccgtggaagcctctagtg

SEQ ID NO: 202265 - DNA, 20 bp, human
gaactggccgtccacactag

SEQ ID NO: 202266 - DNA, 20 bp, human
ggcgacggcgagagctagag

SEQ ID NO: 202267 - DNA, 20 bp, human
gtagggcggagcggcaccaa

SEQ ID NO: 202268 - DNA, 20 bp, human
ggagagcgaggctacggagc

SEQ ID NO: 202269 - DNA, 20 bp, human
gcggagcaggcgagaggcga

SEQ ID NO: 202270 - DNA, 20 bp, human
gaggctacggagcaggcgag

SEQ ID NO: 202271 - DNA, 20 bp, human
gagggctccgcggctcccca

SEQ ID NO: 202272 - DNA, 20 bp, human
gctgtcccaagagggctccg

SEQ ID NO: 202273 - DNA, 20 bp, human
gagcgggcgcagcgttaggg

SEQ ID NO: 202274 - DNA, 20 bp, human
gctagagcgggcgcagcgtt

SEQ ID NO: 202275 - DNA, 20 bp, human
gcacgtgggtgcccagttag

SEQ ID NO: 202276 - DNA, 20 bp, human
gactgaggtagtgactgagg

SEQ ID NO: 202277 - DNA, 20 bp, human
gaccactgaggtagtgactg

SEQ ID NO: 202278 - DNA, 20 bp, human
ggaagacacgactgcacagg

SEQ ID NO: 202279 - DNA, 20 bp, human
gggtgctgctgtagctggtg

SEQ ID NO: 202280 - DNA, 20 bp, human
gcacctgcggagtcaccggg

SEQ ID NO: 202281 - DNA, 20 bp, human
ggcagcacctgcggagtcac

SEQ ID NO: 202282 - DNA, 20 bp, human
gggtggtggcagcggcagat

SEQ ID NO: 202283 - DNA, 20 bp, human
ggggcccggaggaacaacag

SEQ ID NO: 202284 - DNA, 20 bp, human
gaggggtcaggctgagacac

SEQ ID NO: 202285 - DNA, 20 bp, human
gggtgctggtccagactgga

SEQ ID NO: 202286 - DNA, 20 bp, human
gtgcactgccctcggaccag

SEQ ID NO: 202287 - DNA, 20 bp, human
gggcagctccgctggtccga

SEQ ID NO: 202288 - DNA, 20 bp, human
ggagcctcgggagggtgcat

SEQ ID NO: 202289 - DNA, 20 bp, human
gggggacctggaggaagata

SEQ ID NO: 202290 - DNA, 20 bp, human
ggctcctcccgccacggcca

SEQ ID NO: 202291 - DNA, 20 bp, human
gggccgtggaggatagaggg

SEQ ID NO: 202292 - DNA, 20 bp, human
gcttccggctcctcccgcca

SEQ ID NO: 202293 - DNA, 20 bp, human
gacctggaggaagatacgga

SEQ ID NO: 202294 - DNA, 20 bp, human
gatggggccgtggaggatag

SEQ ID NO: 202295 - DNA, 20 bp, human
gaagaagggcgcagttgacg

SEQ ID NO: 202296 - DNA, 20 bp, human
gcctgggagcaggaacctgt

SEQ ID NO: 202297 - DNA, 20 bp, human
gagtatgtcgtaggggtcaa

SEQ ID NO: 202298 - DNA, 20 bp, human
ggagcctctggcgatgtcaa

SEQ ID NO: 202299 - DNA, 20 bp, human
gggacccttctagtcaggag

SEQ ID NO: 202300 - DNA, 20 bp, human
gggcagcgcttgagggtagc

SEQ ID NO: 202301 - DNA, 20 bp, human
gaccctcaagcgctgcctac

SEQ ID NO: 202302 - DNA, 20 bp, human
gaaggcagccctctgctgta

SEQ ID NO: 202303 - DNA, 20 bp, human
gagcagctgcaagcgcgcgt

SEQ ID NO: 202304 - DNA, 20 bp, human
gtgacctttgacatcgccag

SEQ ID NO: 202305 - DNA, 20 bp, human
gggctgacaggcgcagcgaa

SEQ ID NO: 202306 - DNA, 20 bp, human
gcactgctggaggcgagtca

SEQ ID NO: 202307 - DNA, 20 bp, human
gttcgcggggcggcgggtag

SEQ ID NO: 202308 - DNA, 20 bp, human
ggtgtgtggggttcgcgggg

SEQ ID NO: 202309 - DNA, 20 bp, human
ggtcgcgtctgcagtgtgtg

SEQ ID NO: 202310 - DNA, 20 bp, human
gccatgggctcccagactct

SEQ ID NO: 202311 - DNA, 20 bp, human
ggcagtgtgtggggttcgcg

SEQ ID NO: 202312 - DNA, 20 bp, human
ggttccaatgcggagaccat

SEQ ID NO: 202313 - DNA, 20 bp, human
gagcgctagggcgtcgtggt

SEQ ID NO: 202314 - DNA, 20 bp, human
gcagtgttggagactgctct

SEQ ID NO: 202315 - DNA, 20 bp, human
gggcgagtgtttagagactt

SEQ ID NO: 202316 - DNA, 20 bp, human
gcccggaagccgatcgcgtg

SEQ ID NO: 202317 - DNA, 20 bp, human
gtcgcgtggggagccggtct

SEQ ID NO: 202318 - DNA, 20 bp, human
ggcggatctaatctagacaa

SEQ ID NO: 202319 - DNA, 20 bp, human
gaagcgtctacgtggcccga

SEQ ID NO: 202320 - DNA, 20 bp, human
gtcacccgctgctccaagac

SEQ ID NO: 202321 - DNA, 20 bp, human
gtgacgcgggaccgaaggag

SEQ ID NO: 202322 - DNA, 20 bp, human
ggaacccctccgccaacacc

SEQ ID NO: 202323 - DNA, 20 bp, human
gcctaggatggagggaacgg

SEQ ID NO: 202324 - DNA, 20 bp, human
ggggcgtgaatacacctcat

SEQ ID NO: 202325 - DNA, 20 bp, human
gtgcgggaccgagctccaag

SEQ ID NO: 202326 - DNA, 20 bp, human
gggccaaacgcggacggtgg

SEQ ID NO: 202327 - DNA, 20 bp, human
gccccacggccggccaaacg

SEQ ID NO: 202328 - DNA, 20 bp, human
gggtcccaggtcctagaggg

SEQ ID NO: 202329 - DNA, 20 bp, human
ggccggccaaacgcggacgg

SEQ ID NO: 202330 - DNA, 20 bp, human
gacggccggccaaacgcgga

SEQ ID NO: 202331 - DNA, 20 bp, human
gcggacccctggactcggga

SEQ ID NO: 202332 - DNA, 20 bp, human
gggcttggtcctggtcgctg

SEQ ID NO: 202333 - DNA, 20 bp, human
gcaaacgcggacggtggtgg

SEQ ID NO: 202334 - DNA, 20 bp, human
ggcctccctcccgagtccag

SEQ ID NO: 202335 - DNA, 20 bp, human
gggttcttacctcgcctcct

SEQ ID NO: 202336 - DNA, 20 bp, human
gcggcggaaccgagacttcc

SEQ ID NO: 202337 - DNA, 20 bp, human
gccggggacgcggggactgg

SEQ ID NO: 202338 - DNA, 20 bp, human
gcggagctgcccggaagtct

SEQ ID NO: 202339 - DNA, 20 bp, human
ggaccacgctgtgtgtaaca

SEQ ID NO: 202340 - DNA, 20 bp, human
ggggagcagagcaaaagaac

SEQ ID NO: 202341 - DNA, 20 bp, human
gagcagagcaaaagaacggg

SEQ ID NO: 202342 - DNA, 20 bp, human
gcgctgtgtgtaacagggag

SEQ ID NO: 202343 - DNA, 20 bp, human
gctggagccacccgggatgg

SEQ ID NO: 202344 - DNA, 20 bp, human
ggaagtgaaggcaataggag

SEQ ID NO: 202345 - DNA, 20 bp, human
gcggccggcgccttttccca

SEQ ID NO: 202346 - DNA, 20 bp, human
ggcgtagggatagggagacc

SEQ ID NO: 202347 - DNA, 20 bp, human
ggaggggctacggtgaccag

SEQ ID NO: 202348 - DNA, 20 bp, human
gggacccagactgcaggctg

SEQ ID NO: 202349 - DNA, 20 bp, human
gcggattgcggggagtgagc

SEQ ID NO: 202350 - DNA, 20 bp, human
gggagaccgggccggattgc

SEQ ID NO: 202351 - DNA, 20 bp, human
gcagaggccactcagatctc

SEQ ID NO: 202352 - DNA, 20 bp, human
gagtttgctgcgtagggata

SEQ ID NO: 202353 - DNA, 20 bp, human
gcactccccgcaatccggcc

SEQ ID NO: 202354 - DNA, 20 bp, human
gtgaccaggggacgaggtat

SEQ ID NO: 202355 - DNA, 20 bp, human
gtcccatgggaagacaaagt

SEQ ID NO: 202356 - DNA, 20 bp, human
gggtgtgccccaggaactgg

SEQ ID NO: 202357 - DNA, 20 bp, human
gcggcgagaaggggacctct

SEQ ID NO: 202358 - DNA, 20 bp, human
gccggcgccgccagttcctg

SEQ ID NO: 202359 - DNA, 20 bp, human
ggccgaaagagagaagccga

SEQ ID NO: 202360 - DNA, 20 bp, human
gctgggtgtgccccaggaac

SEQ ID NO: 202361 - DNA, 20 bp, human
gtgcaggcggcggcgagaag

SEQ ID NO: 202362 - DNA, 20 bp, human
gcctagaacgagcctggtgg

SEQ ID NO: 202363 - DNA, 20 bp, human
ggctccagaacagccccctc

SEQ ID NO: 202364 - DNA, 20 bp, human
gggacctagaacgagcctgg

SEQ ID NO: 202365 - DNA, 20 bp, human
gctaccctcgcagttgcagg

SEQ ID NO: 202366 - DNA, 20 bp, human
ggcgtagggatagggagacc

SEQ ID NO: 202367 - DNA, 20 bp, human
ggaggggctacggtgaccag

SEQ ID NO: 202368 - DNA, 20 bp, human
gggacccagactgcaggctg

SEQ ID NO: 202369 - DNA, 20 bp, human
gcggattgcggggagtgagc

SEQ ID NO: 202370 - DNA, 20 bp, human
gggagaccgggccggattgc

SEQ ID NO: 202371 - DNA, 20 bp, human
gcagaggccactcagatctc

SEQ ID NO: 202372 - DNA, 20 bp, human
gagtttgctgcgtagggata

SEQ ID NO: 202373 - DNA, 20 bp, human
gcactccccgcaatccggcc

SEQ ID NO: 202374 - DNA, 20 bp, human
gtgaccaggggacgaggtat

SEQ ID NO: 202375 - DNA, 20 bp, human
gtcccatgggaagacaaagt

SEQ ID NO: 202376 - DNA, 20 bp, human
gctgcgcacggcgaatccac

SEQ ID NO: 202377 - DNA, 20 bp, human
gccagggcgcgcttccacca

SEQ ID NO: 202378 - DNA, 20 bp, human
ggaatccaccggtaccgtgg

SEQ ID NO: 202379 - DNA, 20 bp, human
ggcttccaccacggtaccgg

SEQ ID NO: 202380 - DNA, 20 bp, human
gggcgaatccaccggtaccg

SEQ ID NO: 202381 - DNA, 20 bp, human
gtcgggtccaagtgccaccg

SEQ ID NO: 202382 - DNA, 20 bp, human
gcgcgcttccaccacggtac

SEQ ID NO: 202383 - DNA, 20 bp, human
ggccgtgcgcagccggaaga

SEQ ID NO: 202384 - DNA, 20 bp, human
gaagccacagagcgacgatg

SEQ ID NO: 202385 - DNA, 20 bp, human
gtgcggcgccggccctatca

SEQ ID NO: 202386 - DNA, 20 bp, human
gcaaaggcgccgcagcccta

SEQ ID NO: 202387 - DNA, 20 bp, human
gccggcggccgcgctcacaa

SEQ ID NO: 202388 - DNA, 20 bp, human
ggcccctgcggcctgcccta

SEQ ID NO: 202389 - DNA, 20 bp, human
gaaggctcccgcatacaccg

SEQ ID NO: 202390 - DNA, 20 bp, human
ggaaggaggtgcccactgga

SEQ ID NO: 202391 - DNA, 20 bp, human
ggaccatgtgggacaaatgt

SEQ ID NO: 202392 - DNA, 20 bp, human
gggaggtgcccactggaggg

SEQ ID NO: 202393 - DNA, 20 bp, human
gcctgcgcaggtggaacggg

SEQ ID NO: 202394 - DNA, 20 bp, human
gtggaacgggtggaacgggt

SEQ ID NO: 202395 - DNA, 20 bp, human
gcggtcccatatactgtcaa

SEQ ID NO: 202396 - DNA, 20 bp, human
ggagccgggaatggaggtcg

SEQ ID NO: 202397 - DNA, 20 bp, human
gtcccgggcgcggaaaccct

SEQ ID NO: 202398 - DNA, 20 bp, human
gatggaggtcgtggcgtgag

SEQ ID NO: 202399 - DNA, 20 bp, human
ggcttcccgggaaggttcca

SEQ ID NO: 202400 - DNA, 20 bp, human
gtcccgggaaggttccacgg

SEQ ID NO: 202401 - DNA, 20 bp, human
gatcccctgcgcgaggtgaa

SEQ ID NO: 202402 - DNA, 20 bp, human
ggccgccgtggaaccttccc

SEQ ID NO: 202403 - DNA, 20 bp, human
ggctgggaaggaggacggta

SEQ ID NO: 202404 - DNA, 20 bp, human
ggcctcaggcagctctgcgt

SEQ ID NO: 202405 - DNA, 20 bp, human
gcgggcaacgccggaactcc

SEQ ID NO: 202406 - DNA, 20 bp, human
gaaaatactcctgacaccag

SEQ ID NO: 202407 - DNA, 20 bp, human
gaagtggaagtggtcttcca

SEQ ID NO: 202408 - DNA, 20 bp, human
gaccagcggcaaaaaagcct

SEQ ID NO: 202409 - DNA, 20 bp, human
gcttttttgccgctggtgtc

SEQ ID NO: 202410 - DNA, 20 bp, human
gctgtggagccagtaatagg

SEQ ID NO: 202411 - DNA, 20 bp, human
gtcaacagcctacaaagggg

SEQ ID NO: 202412 - DNA, 20 bp, human
gcttcggtgatggggttctg

SEQ ID NO: 202413 - DNA, 20 bp, human
gctcaaagatttatcggtat

SEQ ID NO: 202414 - DNA, 20 bp, human
gaatccgtcacaatcaacaa

SEQ ID NO: 202415 - DNA, 20 bp, human
ggagcctgtagggtcagtta

SEQ ID NO: 202416 - DNA, 20 bp, human
gaagtggaagtggtccccga

SEQ ID NO: 202417 - DNA, 20 bp, human
gaatcgtcacagagacctct

SEQ ID NO: 202418 - DNA, 20 bp, human
gaaaatagtcctgacgccag

SEQ ID NO: 202419 - DNA, 20 bp, human
ggcacttctaaacagctcat

SEQ ID NO: 202420 - DNA, 20 bp, human
gcagcggcgaaatagccttc

SEQ ID NO: 202421 - DNA, 20 bp, human
gatcaacagtccataagggg

SEQ ID NO: 202422 - DNA, 20 bp, human
gtgtcacagacaaccatcaa

SEQ ID NO: 202423 - DNA, 20 bp, human
ggggcctgtagggtcagcta

SEQ ID NO: 202424 - DNA, 20 bp, human
gtctgtgacagggatttctc

SEQ ID NO: 202425 - DNA, 20 bp, human
gctatttcgccgctggcgtc

SEQ ID NO: 202426 - DNA, 20 bp, human
gtggacgagctcgggaggag

SEQ ID NO: 202427 - DNA, 20 bp, human
gtgagcaggcgccctcagag

SEQ ID NO: 202428 - DNA, 20 bp, human
gctcagggtctgggtgggta

SEQ ID NO: 202429 - DNA, 20 bp, human
ggctgggtctggacgagctc

SEQ ID NO: 202430 - DNA, 20 bp, human
ggggtctggacgagctcggg

SEQ ID NO: 202431 - DNA, 20 bp, human
gcatccggcgatgctgggtc

SEQ ID NO: 202432 - DNA, 20 bp, human
gaggcggccctcacgatcag

SEQ ID NO: 202433 - DNA, 20 bp, human
gttggcctgtcaggtccatc

SEQ ID NO: 202434 - DNA, 20 bp, human
ggcaggaggatgcggaacac

SEQ ID NO: 202435 - DNA, 20 bp, human
gatcgccggatggacctgac

SEQ ID NO: 202436 - DNA, 20 bp, human
gtgtctcccgaacagcagga

SEQ ID NO: 202437 - DNA, 20 bp, human
gcggctgtgtatcggcgatg

SEQ ID NO: 202438 - DNA, 20 bp, human
gactggacggttacaaggag

SEQ ID NO: 202439 - DNA, 20 bp, human
gcggctacagacccacgagc

SEQ ID NO: 202440 - DNA, 20 bp, human
gcaccacaattacctgagtt

SEQ ID NO: 202441 - DNA, 20 bp, human
ggagccgatttatgaagact

SEQ ID NO: 202442 - DNA, 20 bp, human
gttcaaaatttggcgggtag

SEQ ID NO: 202443 - DNA, 20 bp, human
gagagttttcaaaatttggc

SEQ ID NO: 202444 - DNA, 20 bp, human
ggcggtcccacccagcactc

SEQ ID NO: 202445 - DNA, 20 bp, human
ggtgccgaggcgcccaactc

SEQ ID NO: 202446 - DNA, 20 bp, human
gtagccggcggccaagagat

SEQ ID NO: 202447 - DNA, 20 bp, human
gttgggtttatttgtcggag

SEQ ID NO: 202448 - DNA, 20 bp, human
gagtcgcctctgtgcagcag

SEQ ID NO: 202449 - DNA, 20 bp, human
gcaaggaagagtctttaagg

SEQ ID NO: 202450 - DNA, 20 bp, human
gggcggtggtggccacgctg

SEQ ID NO: 202451 - DNA, 20 bp, human
gtttaaggtggcagagccat

SEQ ID NO: 202452 - DNA, 20 bp, human
gggcatgacggtccctatcc

SEQ ID NO: 202453 - DNA, 20 bp, human
gtttattaggagtgactgtc

SEQ ID NO: 202454 - DNA, 20 bp, human
ggccaagcgtgacccacccc

SEQ ID NO: 202455 - DNA, 20 bp, human
gcgtggttcgatggcggtgg

SEQ ID NO: 202456 - DNA, 20 bp, human
gcgcacgcacgaagcaaacg

SEQ ID NO: 202457 - DNA, 20 bp, human
gggagtaagagccgctgtag

SEQ ID NO: 202458 - DNA, 20 bp, human
ggcgctgactacccctacag

SEQ ID NO: 202459 - DNA, 20 bp, human
gccccgcgggagcagctact

SEQ ID NO: 202460 - DNA, 20 bp, human
gagactgtacgggacaccta

SEQ ID NO: 202461 - DNA, 20 bp, human
gagcagcaccgtgtgtgaaa

SEQ ID NO: 202462 - DNA, 20 bp, human
ggcgcaccgcgggccactgg

SEQ ID NO: 202463 - DNA, 20 bp, human
gcggctggagcaccgaatgg

SEQ ID NO: 202464 - DNA, 20 bp, human
ggcgtcggccgtatccacca

SEQ ID NO: 202465 - DNA, 20 bp, human
gtgcgtgcgcgcgcagatgt

SEQ ID NO: 202466 - DNA, 20 bp, human
ggcccgccaggcggcggtcg

SEQ ID NO: 202467 - DNA, 20 bp, human
ggcgtccccagcgccggctg

SEQ ID NO: 202468 - DNA, 20 bp, human
gggctgcgggagccacaaca

SEQ ID NO: 202469 - DNA, 20 bp, human
gcgactgcaggccagagtct

SEQ ID NO: 202470 - DNA, 20 bp, human
gccagcccgggcacggataa

SEQ ID NO: 202471 - DNA, 20 bp, human
gacgcgcgcggccgagactc

SEQ ID NO: 202472 - DNA, 20 bp, human
ggctgacaggccgtcccaga

SEQ ID NO: 202473 - DNA, 20 bp, human
gggccgccggctatcgccga

SEQ ID NO: 202474 - DNA, 20 bp, human
ggtcgcagcggcggtcgcag

SEQ ID NO: 202475 - DNA, 20 bp, human
gccgcgctgggcgggacgtg

SEQ ID NO: 202476 - DNA, 20 bp, human
gtacgtcaggccacgccggg

SEQ ID NO: 202477 - DNA, 20 bp, human
gtcggtgcgcgcctgtccgg

SEQ ID NO: 202478 - DNA, 20 bp, human
gtggcgtcagggacaagcta

SEQ ID NO: 202479 - DNA, 20 bp, human
gaacagcccggccggccaag

SEQ ID NO: 202480 - DNA, 20 bp, human
gtagggagataggtgcactt

SEQ ID NO: 202481 - DNA, 20 bp, human
gcagggacaagctagggcta

SEQ ID NO: 202482 - DNA, 20 bp, human
gtgtccctgacgccaggatc

SEQ ID NO: 202483 - DNA, 20 bp, human
gctgctcctggccccttggc

SEQ ID NO: 202484 - DNA, 20 bp, human
gggatccgggtctgagaaac

SEQ ID NO: 202485 - DNA, 20 bp, human
gtcgaccccgacctgccagg

SEQ ID NO: 202486 - DNA, 20 bp, human
gggcgcggggtccaagatgg

SEQ ID NO: 202487 - DNA, 20 bp, human
gctccacggccgctatcact

SEQ ID NO: 202488 - DNA, 20 bp, human
gatatacctggcacagatgt

SEQ ID NO: 202489 - DNA, 20 bp, human
gccccagcggggtcactcgt

SEQ ID NO: 202490 - DNA, 20 bp, human
gaggcccagaatccaccgtc

SEQ ID NO: 202491 - DNA, 20 bp, human
gtcggtcgggggcccctcca

SEQ ID NO: 202492 - DNA, 20 bp, human
gggccgctatcactgggtcg

SEQ ID NO: 202493 - DNA, 20 bp, human
gagccgcgacccagtgatag

SEQ ID NO: 202494 - DNA, 20 bp, human
ggcagtcccggggagcgcac

SEQ ID NO: 202495 - DNA, 20 bp, human
gtgggccaggcgagaacttc

SEQ ID NO: 202496 - DNA, 20 bp, human
gcaggtcacagagcaacggg

SEQ ID NO: 202497 - DNA, 20 bp, human
gacagagcaacgggaggcag

SEQ ID NO: 202498 - DNA, 20 bp, human
gctgcgttctcggctccggg

SEQ ID NO: 202499 - DNA, 20 bp, human
gctgaatcaccgaggcctcc

SEQ ID NO: 202500 - DNA, 20 bp, human
gtttcctctggctcctgcga

SEQ ID NO: 202501 - DNA, 20 bp, human
gcctgcgagggcttggttta

SEQ ID NO: 202502 - DNA, 20 bp, human
gcaggagcccggtccgtcac

SEQ ID NO: 202503 - DNA, 20 bp, human
ggcagggcgtccggaggctg

SEQ ID NO: 202504 - DNA, 20 bp, human
gcaggcgggcacctcgcacg

SEQ ID NO: 202505 - DNA, 20 bp, human
gtctctgcgttctcggctcc

SEQ ID NO: 202506 - DNA, 20 bp, human
gtactactatcctagagtga

SEQ ID NO: 202507 - DNA, 20 bp, human
ggaaaaaaattgggatttgc

SEQ ID NO: 202508 - DNA, 20 bp, human
gttctttgcagaatgtctct

SEQ ID NO: 202509 - DNA, 20 bp, human
gctactgaatcaaaaataag

SEQ ID NO: 202510 - DNA, 20 bp, human
gattagctcaagaaaagaga

SEQ ID NO: 202511 - DNA, 20 bp, human
ggtattctaaagattctgtc

SEQ ID NO: 202512 - DNA, 20 bp, human
ggaaactctgaggaagtatt

SEQ ID NO: 202513 - DNA, 20 bp, human
gcaatttttttcttgtagaa

SEQ ID NO: 202514 - DNA, 20 bp, human
gtctgtcaggaaacaatttt

SEQ ID NO: 202515 - DNA, 20 bp, human
ggtgtaaaaagaaaatcttt

SEQ ID NO: 202516 - DNA, 20 bp, human
gccgcaggaagggaactgcg

SEQ ID NO: 202517 - DNA, 20 bp, human
gaacggattctccggagccg

SEQ ID NO: 202518 - DNA, 20 bp, human
gcagacgcagatctggcagc

SEQ ID NO: 202519 - DNA, 20 bp, human
gcgagggttgttacaggatc

SEQ ID NO: 202520 - DNA, 20 bp, human
gggaccctgagtccgagact

SEQ ID NO: 202521 - DNA, 20 bp, human
gaggtcccctaccccagtct

SEQ ID NO: 202522 - DNA, 20 bp, human
gtaccccagtctcggactca

SEQ ID NO: 202523 - DNA, 20 bp, human
gcacaatcgcctcccactag

SEQ ID NO: 202524 - DNA, 20 bp, human
ggaagcacgagggttgttac

SEQ ID NO: 202525 - DNA, 20 bp, human
ggcgattgtgcagaagcacg

SEQ ID NO: 202526 - DNA, 20 bp, human
ggacgcgacgaagaacgcca

SEQ ID NO: 202527 - DNA, 20 bp, human
gtaaaggagcatgagagcgt

SEQ ID NO: 202528 - DNA, 20 bp, human
gccgaggcccaggtgagtcg

SEQ ID NO: 202529 - DNA, 20 bp, human
gcaactctcctccaaaggag

SEQ ID NO: 202530 - DNA, 20 bp, human
gtcttcgtcgcgtctcggtc

SEQ ID NO: 202531 - DNA, 20 bp, human
ggagcgtgggagttttgcag

SEQ ID NO: 202532 - DNA, 20 bp, human
gtaggggtagtggaggaact

SEQ ID NO: 202533 - DNA, 20 bp, human
gagggaatcgagggaggcta

SEQ ID NO: 202534 - DNA, 20 bp, human
gggagcactcctaccacaac

SEQ ID NO: 202535 - DNA, 20 bp, human
gtagtggaggaacttggcag

SEQ ID NO: 202536 - DNA, 20 bp, human
ggccggatcccggaccatgg

SEQ ID NO: 202537 - DNA, 20 bp, human
gatccggcccccctctcggc

SEQ ID NO: 202538 - DNA, 20 bp, human
gccacgaccggccgagaggg

SEQ ID NO: 202539 - DNA, 20 bp, human
gccacggccggacctcagtg

SEQ ID NO: 202540 - DNA, 20 bp, human
gcgggatccggcccccctct

SEQ ID NO: 202541 - DNA, 20 bp, human
ggcgccacgaccggccgaga

SEQ ID NO: 202542 - DNA, 20 bp, human
gttccgagagaggcctggtg

SEQ ID NO: 202543 - DNA, 20 bp, human
gcccggccgccgccatggtc

SEQ ID NO: 202544 - DNA, 20 bp, human
ggccgccatggtccgggatc

SEQ ID NO: 202545 - DNA, 20 bp, human
gtagagcagcggtagcacac

SEQ ID NO: 202546 - DNA, 20 bp, human
gtgggtagaacgccagacag

SEQ ID NO: 202547 - DNA, 20 bp, human
gagcagccgcaacctaacgg

SEQ ID NO: 202548 - DNA, 20 bp, human
gccgggatctccataaccta

SEQ ID NO: 202549 - DNA, 20 bp, human
gtggttgccaacgctacact

SEQ ID NO: 202550 - DNA, 20 bp, human
gggcatccgccgtattacag

SEQ ID NO: 202551 - DNA, 20 bp, human
gagggagaagcacagagtcc

SEQ ID NO: 202552 - DNA, 20 bp, human
ggttctacccagtgtagcgt

SEQ ID NO: 202553 - DNA, 20 bp, human
gtgggtgaggccgtgagagt

SEQ ID NO: 202554 - DNA, 20 bp, human
gcctaacggcggacgaagac

SEQ ID NO: 202555 - DNA, 20 bp, human
gtgcgcgccgtgaggacaca

SEQ ID NO: 202556 - DNA, 20 bp, human
gcgacggcaccctaagacaa

SEQ ID NO: 202557 - DNA, 20 bp, human
gagaggacgcagcctccccg

SEQ ID NO: 202558 - DNA, 20 bp, human
gtcctgggcgcgcacaaacc

SEQ ID NO: 202559 - DNA, 20 bp, human
ggcgctccaggtgccaactg

SEQ ID NO: 202560 - DNA, 20 bp, human
gcggcaccctaagacaaagg

SEQ ID NO: 202561 - DNA, 20 bp, human
gctgggacgtgggatcccca

SEQ ID NO: 202562 - DNA, 20 bp, human
gctcccagcctcgccccagt

SEQ ID NO: 202563 - DNA, 20 bp, human
gaaaactcacgcgccgtggt

SEQ ID NO: 202564 - DNA, 20 bp, human
gtgccaactggggcgaggct

SEQ ID NO: 202565 - DNA, 20 bp, human
gccaggtgccaactggggcg

SEQ ID NO: 202566 - DNA, 20 bp, human
gcagccagctcgttcgcgct

SEQ ID NO: 202567 - DNA, 20 bp, human
gtggaactacacttcccggg

SEQ ID NO: 202568 - DNA, 20 bp, human
gcggccctgcgaggtccgag

SEQ ID NO: 202569 - DNA, 20 bp, human
gtagacttggggtgcagcac

SEQ ID NO: 202570 - DNA, 20 bp, human
gcggcggacacggcccgatc

SEQ ID NO: 202571 - DNA, 20 bp, human
gctgcgaggtccgaggggta

SEQ ID NO: 202572 - DNA, 20 bp, human
gtggaggtcgctgtagactt

SEQ ID NO: 202573 - DNA, 20 bp, human
ggcctccaatgctcacccaa

SEQ ID NO: 202574 - DNA, 20 bp, human
ggccagcggggtgaatgatg

SEQ ID NO: 202575 - DNA, 20 bp, human
ggcggcggggcgctgaatgt

SEQ ID NO: 202576 - DNA, 20 bp, human
gcctcagccgcggacaatgg

SEQ ID NO: 202577 - DNA, 20 bp, human
ggccggccgcgagccaggtg

SEQ ID NO: 202578 - DNA, 20 bp, human
gcggcggtcccccttgaagg

SEQ ID NO: 202579 - DNA, 20 bp, human
gacgctgcaaaagctcgtcc

SEQ ID NO: 202580 - DNA, 20 bp, human
gtcacctcagccgcggacaa

SEQ ID NO: 202581 - DNA, 20 bp, human
gccaagccccgcagctacgg

SEQ ID NO: 202582 - DNA, 20 bp, human
gtgctgcgccgccttcaagg

SEQ ID NO: 202583 - DNA, 20 bp, human
gggccggcggtcccccttga

SEQ ID NO: 202584 - DNA, 20 bp, human
gaagcagccgccattgtccg

SEQ ID NO: 202585 - DNA, 20 bp, human
gtgaggtgaggcctttgctc

SEQ ID NO: 202586 - DNA, 20 bp, human
gtcgctgccgtatttctcgt

SEQ ID NO: 202587 - DNA, 20 bp, human
ggaagtctccggggctcgag

SEQ ID NO: 202588 - DNA, 20 bp, human
ggtgggaggcgcggtccaag

SEQ ID NO: 202589 - DNA, 20 bp, human
gtgctggagctgcggaggag

SEQ ID NO: 202590 - DNA, 20 bp, human
gccgcagctccagcacccta

SEQ ID NO: 202591 - DNA, 20 bp, human
gcggggctcgagcggtgggt

SEQ ID NO: 202592 - DNA, 20 bp, human
gcgtctctaggagacaggcg

SEQ ID NO: 202593 - DNA, 20 bp, human
gcagtcaggaccgcaggtac

SEQ ID NO: 202594 - DNA, 20 bp, human
gtctccggggctcgagcggt

SEQ ID NO: 202595 - DNA, 20 bp, human
gggaggaggggcccgtctct

SEQ ID NO: 202596 - DNA, 20 bp, human
gtcacggtgactctgaagtc

SEQ ID NO: 202597 - DNA, 20 bp, human
gtcccatgtagcaaacctac

SEQ ID NO: 202598 - DNA, 20 bp, human
gctctgaagtctggaactga

SEQ ID NO: 202599 - DNA, 20 bp, human
gatgggatcattactgatca

SEQ ID NO: 202600 - DNA, 20 bp, human
gtgaagtctggaactgaagg

SEQ ID NO: 202601 - DNA, 20 bp, human
gagacagaatgtgctaacat

SEQ ID NO: 202602 - DNA, 20 bp, human
ggttactagcggacgcctgt

SEQ ID NO: 202603 - DNA, 20 bp, human
gcacaggcttgtttgccgag

SEQ ID NO: 202604 - DNA, 20 bp, human
gcttgtttgccgagtggagt

SEQ ID NO: 202605 - DNA, 20 bp, human
gcattctgtctcgttactag

SEQ ID NO: 202606 - DNA, 20 bp, human
gaaatgaggaactagttaca

SEQ ID NO: 202607 - DNA, 20 bp, human
gaagcttgactgggcactcg

SEQ ID NO: 202608 - DNA, 20 bp, human
gtagcggggacttcatgcag

SEQ ID NO: 202609 - DNA, 20 bp, human
gaacacacacacagggggag

SEQ ID NO: 202610 - DNA, 20 bp, human
gaagtccctttcaggtatag

SEQ ID NO: 202611 - DNA, 20 bp, human
gggcactcggggtaacttag

SEQ ID NO: 202612 - DNA, 20 bp, human
gtgttctgcaacactaaatc

SEQ ID NO: 202613 - DNA, 20 bp, human
gaggaactagttacagggtt

SEQ ID NO: 202614 - DNA, 20 bp, human
gtgttgtgtgtgtgcaccag

SEQ ID NO: 202615 - DNA, 20 bp, human
gaagggtgaattttattcag

SEQ ID NO: 202616 - DNA, 20 bp, human
ggggcatgtactgaccaatg

SEQ ID NO: 202617 - DNA, 20 bp, human
gccctcacttggagtgaaca

SEQ ID NO: 202618 - DNA, 20 bp, human
ggtgccaggtcctcaaggga

SEQ ID NO: 202619 - DNA, 20 bp, human
gaacagggaagtccctggag

SEQ ID NO: 202620 - DNA, 20 bp, human
gttggtcagtacatgcccag

SEQ ID NO: 202621 - DNA, 20 bp, human
ggttctcagacctgccacat

SEQ ID NO: 202622 - DNA, 20 bp, human
ggaaatgtcaggctcaaagg

SEQ ID NO: 202623 - DNA, 20 bp, human
gatgtactgaccaatgtggc

SEQ ID NO: 202624 - DNA, 20 bp, human
gacactagcaaacccactcc

SEQ ID NO: 202625 - DNA, 20 bp, human
gtgctagctgccccctcact

SEQ ID NO: 202626 - DNA, 20 bp, human
ggtgttgactctcagatccc

SEQ ID NO: 202627 - DNA, 20 bp, human
gagtaggaaggcccggatca

SEQ ID NO: 202628 - DNA, 20 bp, human
gggaggccgcgtcctgtact

SEQ ID NO: 202629 - DNA, 20 bp, human
gaggaaggcccggatcaagg

SEQ ID NO: 202630 - DNA, 20 bp, human
ggcctcccccgccgggactg

SEQ ID NO: 202631 - DNA, 20 bp, human
gaagggaaactgacgcgctg

SEQ ID NO: 202632 - DNA, 20 bp, human
gcgcgtcctgtactgggtcc

SEQ ID NO: 202633 - DNA, 20 bp, human
gtggcccaaggcagaacgag

SEQ ID NO: 202634 - DNA, 20 bp, human
ggctgaattattagaagtgt

SEQ ID NO: 202635 - DNA, 20 bp, human
gaagcgcggggcaggacgtt

SEQ ID NO: 202636 - DNA, 20 bp, human
gagtgtaggtcatatcgccg

SEQ ID NO: 202637 - DNA, 20 bp, human
gggcgccttaggaccaggat

SEQ ID NO: 202638 - DNA, 20 bp, human
gggcgcgaggagtcagaaca

SEQ ID NO: 202639 - DNA, 20 bp, human
gtgcgctaactaggttccca

SEQ ID NO: 202640 - DNA, 20 bp, human
gcgagtcctctgccaggtcc

SEQ ID NO: 202641 - DNA, 20 bp, human
gctgcggcgcggcgctcccg

SEQ ID NO: 202642 - DNA, 20 bp, human
gtgggcaagaatccacatcg

SEQ ID NO: 202643 - DNA, 20 bp, human
gcatccccgtgagagcccga

SEQ ID NO: 202644 - DNA, 20 bp, human
gccaaaaggaagcgaccctc

SEQ ID NO: 202645 - DNA, 20 bp, human
gtattaagtctgcgctaact

SEQ ID NO: 202646 - DNA, 20 bp, human
gggttctgggaagtctcggt

SEQ ID NO: 202647 - DNA, 20 bp, human
gcgaccactgggatccctca

SEQ ID NO: 202648 - DNA, 20 bp, human
gtgcaggttctgggaagtct

SEQ ID NO: 202649 - DNA, 20 bp, human
gcagcctccaagccggccta

SEQ ID NO: 202650 - DNA, 20 bp, human
gcctccaagccggcctacgg

SEQ ID NO: 202651 - DNA, 20 bp, human
gcccagaagtggaataattc

SEQ ID NO: 202652 - DNA, 20 bp, human
ggtctgtctgtcaggatgag

SEQ ID NO: 202653 - DNA, 20 bp, human
ggactctgaccaccgaccac

SEQ ID NO: 202654 - DNA, 20 bp, human
ggtctccggagtcagccctg

SEQ ID NO: 202655 - DNA, 20 bp, human
ggtgggttccccgcaaaatc

SEQ ID NO: 202656 - DNA, 20 bp, human
ggaacctctccagacaccac

SEQ ID NO: 202657 - DNA, 20 bp, human
gtgaagcgaggcgaggacca

SEQ ID NO: 202658 - DNA, 20 bp, human
gcgcaggagcgcgtctgaat

SEQ ID NO: 202659 - DNA, 20 bp, human
gcggtaaagaccgtgaagcg

SEQ ID NO: 202660 - DNA, 20 bp, human
gcgtaaagggtgactcacaa

SEQ ID NO: 202661 - DNA, 20 bp, human
ggcgctcctgcgcggactcc

SEQ ID NO: 202662 - DNA, 20 bp, human
ggacgagtccgactctgtct

SEQ ID NO: 202663 - DNA, 20 bp, human
gagtctgaactcgcgatccc

SEQ ID NO: 202664 - DNA, 20 bp, human
gaggacgctccacgcaccat

SEQ ID NO: 202665 - DNA, 20 bp, human
ggcgtggagcgtcctgattg

SEQ ID NO: 202666 - DNA, 20 bp, human
gctgaggaggccgagagatg

SEQ ID NO: 202667 - DNA, 20 bp, human
gtcgccgtcaggcactgagg

SEQ ID NO: 202668 - DNA, 20 bp, human
ggcctgacggcgactatcca

SEQ ID NO: 202669 - DNA, 20 bp, human
gttacttcccagaacttggt

SEQ ID NO: 202670 - DNA, 20 bp, human
ggacggcgactatccagggt

SEQ ID NO: 202671 - DNA, 20 bp, human
ggccggagcccaccaagttc

SEQ ID NO: 202672 - DNA, 20 bp, human
gtcagtgattgcgaactgga

SEQ ID NO: 202673 - DNA, 20 bp, human
gtgacttgggcactcagtag

SEQ ID NO: 202674 - DNA, 20 bp, human
ggggctccggcctcatctct

SEQ ID NO: 202675 - DNA, 20 bp, human
gggcgactatccagggtcgg

SEQ ID NO: 202676 - DNA, 20 bp, human
gcccctccaggcgtcgacaa

SEQ ID NO: 202677 - DNA, 20 bp, human
gagcagattgcgccagggaa

SEQ ID NO: 202678 - DNA, 20 bp, human
gccggaagcagattgcgcca

SEQ ID NO: 202679 - DNA, 20 bp, human
gcagcgataaggcctttccc

SEQ ID NO: 202680 - DNA, 20 bp, human
gcgacaagggcgaagctcgg

SEQ ID NO: 202681 - DNA, 20 bp, human
gaaacacacacacagcgata

SEQ ID NO: 202682 - DNA, 20 bp, human
ggagtgacggaaactgctag

SEQ ID NO: 202683 - DNA, 20 bp, human
gtcactggtacggagaagtg

SEQ ID NO: 202684 - DNA, 20 bp, human
ggaagctcgggggtctcgac

SEQ ID NO: 202685 - DNA, 20 bp, human
gaggagccgcttcttctccc

SEQ ID NO: 202686 - DNA, 20 bp, human
gacgtttgcgggctttttgt

SEQ ID NO: 202687 - DNA, 20 bp, human
gcccgctcaggccggggggg

SEQ ID NO: 202688 - DNA, 20 bp, human
gcggagcccagaaaacaaag

SEQ ID NO: 202689 - DNA, 20 bp, human
gcatgggtccgtgcgggagg

SEQ ID NO: 202690 - DNA, 20 bp, human
gcgccgcccggctggttcat

SEQ ID NO: 202691 - DNA, 20 bp, human
ggacccatgaaccagccggg

SEQ ID NO: 202692 - DNA, 20 bp, human
gcggccccccgtcgtacctg

SEQ ID NO: 202693 - DNA, 20 bp, human
ggctccgcaggtacgacggg

SEQ ID NO: 202694 - DNA, 20 bp, human
ggttcatgggtccgtgcggg

SEQ ID NO: 202695 - DNA, 20 bp, human
gaccgcgcgggggaccccgg

SEQ ID NO: 202696 - DNA, 20 bp, human
gagaacaggtagccgagtca

SEQ ID NO: 202697 - DNA, 20 bp, human
gagccgagtcagggaagccc

SEQ ID NO: 202698 - DNA, 20 bp, human
gccctcggcgacctctgcaa

SEQ ID NO: 202699 - DNA, 20 bp, human
gacccagccccgggtgacaa

SEQ ID NO: 202700 - DNA, 20 bp, human
gcgctcgggttgagtttccc

SEQ ID NO: 202701 - DNA, 20 bp, human
gggccaccttgcgagcgctc

SEQ ID NO: 202702 - DNA, 20 bp, human
ggagctggcctgatgtcctc

SEQ ID NO: 202703 - DNA, 20 bp, human
ggagaaagtaggatataacg

SEQ ID NO: 202704 - DNA, 20 bp, human
gctcggagcaggaaggtcga

SEQ ID NO: 202705 - DNA, 20 bp, human
gttcccgggcttccctgact

SEQ ID NO: 202706 - DNA, 20 bp, human
gcactatgagagggatggag

SEQ ID NO: 202707 - DNA, 20 bp, human
gcgcggtccgggtaactgat

SEQ ID NO: 202708 - DNA, 20 bp, human
gtccgagctgaagaggttcg

SEQ ID NO: 202709 - DNA, 20 bp, human
gttcgcggtccgagctgaag

SEQ ID NO: 202710 - DNA, 20 bp, human
ggcaaaggggttgcaaaacc

SEQ ID NO: 202711 - DNA, 20 bp, human
ggatgcacaatggaagccac

SEQ ID NO: 202712 - DNA, 20 bp, human
ggaggcagcatcaatctcac

SEQ ID NO: 202713 - DNA, 20 bp, human
gctgaagaggttcgcggtcc

SEQ ID NO: 202714 - DNA, 20 bp, human
gtcggaccgcgaatcccgcg

SEQ ID NO: 202715 - DNA, 20 bp, human
gggaaaaccaatcagttacc

SEQ ID NO: 202716 - DNA, 20 bp, human
gggagctggtcactaactaa

SEQ ID NO: 202717 - DNA, 20 bp, human
gactaaaggccgagccggaa

SEQ ID NO: 202718 - DNA, 20 bp, human
gtcggcgttctgcagagcgt

SEQ ID NO: 202719 - DNA, 20 bp, human
gcacggtccgggtgaaggag

SEQ ID NO: 202720 - DNA, 20 bp, human
gcccagtgggtgatgctgac

SEQ ID NO: 202721 - DNA, 20 bp, human
gctcgccgaagccgtcaagg

SEQ ID NO: 202722 - DNA, 20 bp, human
gagccggcaccgggcggacc

SEQ ID NO: 202723 - DNA, 20 bp, human
ggtggctgaatgcggattaa

SEQ ID NO: 202724 - DNA, 20 bp, human
gcactaactaaaggccgagc

SEQ ID NO: 202725 - DNA, 20 bp, human
gggcctcgccgaagccgtca

SEQ ID NO: 202726 - DNA, 20 bp, human
gcgtgtcgagtggctcttcc

SEQ ID NO: 202727 - DNA, 20 bp, human
gaagccctcggcggtcactg

SEQ ID NO: 202728 - DNA, 20 bp, human
gaggaagtcggcgtgtcgag

SEQ ID NO: 202729 - DNA, 20 bp, human
gtggctgctgaggcgggtta

SEQ ID NO: 202730 - DNA, 20 bp, human
ggacttgaggtggttctcgt

SEQ ID NO: 202731 - DNA, 20 bp, human
gctggcaccgctacaacctg

SEQ ID NO: 202732 - DNA, 20 bp, human
gggcccactataagacggac

SEQ ID NO: 202733 - DNA, 20 bp, human
gtaaggtctgagggtcttgt

SEQ ID NO: 202734 - DNA, 20 bp, human
gcgctcctggaagccctcgg

SEQ ID NO: 202735 - DNA, 20 bp, human
gctggagaagaaggccgtgc

SEQ ID NO: 202736 - DNA, 20 bp, human
ggccggcggggtccagtcag

SEQ ID NO: 202737 - DNA, 20 bp, human
gggacctgaagactgcgaca

SEQ ID NO: 202738 - DNA, 20 bp, human
gtccctgaggagcgccgtgt

SEQ ID NO: 202739 - DNA, 20 bp, human
ggccgctgactggaccccgc

SEQ ID NO: 202740 - DNA, 20 bp, human
ggcggcggtgcaggctttgt

SEQ ID NO: 202741 - DNA, 20 bp, human
gggctttgtcggctgatctg

SEQ ID NO: 202742 - DNA, 20 bp, human
ggagcccggccgccttgcca

SEQ ID NO: 202743 - DNA, 20 bp, human
gggtccagtcagcggctgca

SEQ ID NO: 202744 - DNA, 20 bp, human
gcaacctcacgcaggcctgg

SEQ ID NO: 202745 - DNA, 20 bp, human
gccgctagggcgtccaggag

SEQ ID NO: 202746 - DNA, 20 bp, human
ggggcgcagggagtcgagta

SEQ ID NO: 202747 - DNA, 20 bp, human
gaggagggcatacccgaagt

SEQ ID NO: 202748 - DNA, 20 bp, human
gccgaactgaggacaactga

SEQ ID NO: 202749 - DNA, 20 bp, human
ggtacctggcggccgaactg

SEQ ID NO: 202750 - DNA, 20 bp, human
ggcccgggacaacgagtacc

SEQ ID NO: 202751 - DNA, 20 bp, human
gtgggaagaccgggaaagtc

SEQ ID NO: 202752 - DNA, 20 bp, human
ggcgggaacgcttccagcaa

SEQ ID NO: 202753 - DNA, 20 bp, human
ggggaactcgcagagcaggg

SEQ ID NO: 202754 - DNA, 20 bp, human
gcgccttgcaggccctgagg

SEQ ID NO: 202755 - DNA, 20 bp, human
ggcatacccgaagtgggtag

SEQ ID NO: 202756 - DNA, 20 bp, human
gggcgtcttgcaccaaaggg

SEQ ID NO: 202757 - DNA, 20 bp, human
gggagcgacagaagctatgg

SEQ ID NO: 202758 - DNA, 20 bp, human
ggatggagcgacagaagcta

SEQ ID NO: 202759 - DNA, 20 bp, human
gtggggagacgcgggactac

SEQ ID NO: 202760 - DNA, 20 bp, human
gcgagatcccgacctccctt

SEQ ID NO: 202761 - DNA, 20 bp, human
gcccaggcgtcttgcaccaa

SEQ ID NO: 202762 - DNA, 20 bp, human
ggcagtcgcagcgcagagac

SEQ ID NO: 202763 - DNA, 20 bp, human
gcggttttccggccccgaga

SEQ ID NO: 202764 - DNA, 20 bp, human
gagacgcgggactacgggcg

SEQ ID NO: 202765 - DNA, 20 bp, human
gcgacttcgggtctgcagag

SEQ ID NO: 202766 - DNA, 20 bp, human
gttaggagaagaaccagacc

SEQ ID NO: 202767 - DNA, 20 bp, human
gtgggagagacgccacgctg

SEQ ID NO: 202768 - DNA, 20 bp, human
gacacggggccacacagcct

SEQ ID NO: 202769 - DNA, 20 bp, human
gagagaaactgtaaacccaa

SEQ ID NO: 202770 - DNA, 20 bp, human
ggttcttctcctaaaggccc

SEQ ID NO: 202771 - DNA, 20 bp, human
gcactgcgcggtgactaccc

SEQ ID NO: 202772 - DNA, 20 bp, human
gagcgaagaggacggtttcc

SEQ ID NO: 202773 - DNA, 20 bp, human
ggtcttgtctcttcactgcg

SEQ ID NO: 202774 - DNA, 20 bp, human
gaccatttttggcttccagg

SEQ ID NO: 202775 - DNA, 20 bp, human
gtgcgctgacagccggcacc

SEQ ID NO: 202776 - DNA, 20 bp, human
gggacggtcgccagaaacaa

SEQ ID NO: 202777 - DNA, 20 bp, human
gcagggcctgcgcctcccta

SEQ ID NO: 202778 - DNA, 20 bp, human
gcggagacgcgagcccgggt

SEQ ID NO: 202779 - DNA, 20 bp, human
gcagaaacaaaggctccgta

SEQ ID NO: 202780 - DNA, 20 bp, human
gacgcgagcccgggtgggga

SEQ ID NO: 202781 - DNA, 20 bp, human
gcttgggcctctcggagaaa

SEQ ID NO: 202782 - DNA, 20 bp, human
ggctgcggcggagacacctt

SEQ ID NO: 202783 - DNA, 20 bp, human
gcacggcgcgacagaggctg

SEQ ID NO: 202784 - DNA, 20 bp, human
gaaacaaaggctccgtaggg

SEQ ID NO: 202785 - DNA, 20 bp, human
gcacgaaccacatccgagga

SEQ ID NO: 202786 - DNA, 20 bp, human
ggaggccgccgataaaggtt

SEQ ID NO: 202787 - DNA, 20 bp, human
gcgcgagaggccgccgataa

SEQ ID NO: 202788 - DNA, 20 bp, human
gggggcgcactccctcccaa

SEQ ID NO: 202789 - DNA, 20 bp, human
gggcacccaacctttatcgg

SEQ ID NO: 202790 - DNA, 20 bp, human
gcgcaggtgagagaccggag

SEQ ID NO: 202791 - DNA, 20 bp, human
gccgggtccgccctcttaaa

SEQ ID NO: 202792 - DNA, 20 bp, human
gcggcctagctggcaaatgt

SEQ ID NO: 202793 - DNA, 20 bp, human
gcacattgagagggcgggtc

SEQ ID NO: 202794 - DNA, 20 bp, human
gcacctgcggccccaatcgg

SEQ ID NO: 202795 - DNA, 20 bp, human
gcgaggcacccaacctttat

SEQ ID NO: 202796 - DNA, 20 bp, human
ggactgggcgccgaggactc

SEQ ID NO: 202797 - DNA, 20 bp, human
gacggccgccggggaacaat

SEQ ID NO: 202798 - DNA, 20 bp, human
ggaaggagccgggaccccgg

SEQ ID NO: 202799 - DNA, 20 bp, human
gggaccagttcagggtgact

SEQ ID NO: 202800 - DNA, 20 bp, human
gctggaatcaccccttgaga

SEQ ID NO: 202801 - DNA, 20 bp, human
gctgcctcgggggacggact

SEQ ID NO: 202802 - DNA, 20 bp, human
gaggggagcctggggattct

SEQ ID NO: 202803 - DNA, 20 bp, human
ggcgcccagtccgtcccccg

SEQ ID NO: 202804 - DNA, 20 bp, human
gtcaccctgaactggtcccc

SEQ ID NO: 202805 - DNA, 20 bp, human
gcccgaggcagggcactgaa

SEQ ID NO: 202806 - DNA, 20 bp, human
gatcctacgaaagcagtgtg

SEQ ID NO: 202807 - DNA, 20 bp, human
gcactcacccggacaagtcg

SEQ ID NO: 202808 - DNA, 20 bp, human
ggaagggccgcgacttgtcc

SEQ ID NO: 202809 - DNA, 20 bp, human
gacggatggagacaagtgga

SEQ ID NO: 202810 - DNA, 20 bp, human
gcgttcccggccaccagaag

SEQ ID NO: 202811 - DNA, 20 bp, human
gagtgacggatggagacaag

SEQ ID NO: 202812 - DNA, 20 bp, human
ggacgtggagaacagtgata

SEQ ID NO: 202813 - DNA, 20 bp, human
ggatatcacgaggactcccc

SEQ ID NO: 202814 - DNA, 20 bp, human
gccgggaacgcccactcacc

SEQ ID NO: 202815 - DNA, 20 bp, human
gtcttcccggagagatgtca

SEQ ID NO: 202816 - DNA, 20 bp, human
gctgagtgctaaactgtgtg

SEQ ID NO: 202817 - DNA, 20 bp, human
gaggcggaggccggtatcgt

SEQ ID NO: 202818 - DNA, 20 bp, human
ggatcctcggcccagtgcaa

SEQ ID NO: 202819 - DNA, 20 bp, human
gttttcggcgtcgagactgg

SEQ ID NO: 202820 - DNA, 20 bp, human
gcatgcgtgcagctctttgg

SEQ ID NO: 202821 - DNA, 20 bp, human
gcgtcaggcagctcttctcg

SEQ ID NO: 202822 - DNA, 20 bp, human
ggcggctccgcacaaaatgg

SEQ ID NO: 202823 - DNA, 20 bp, human
gtacccgggagggcccgtcc

SEQ ID NO: 202824 - DNA, 20 bp, human
gatccagctgttagtcgggt

SEQ ID NO: 202825 - DNA, 20 bp, human
ggcgttttcggcgtcgagac

SEQ ID NO: 202826 - DNA, 20 bp, human
gcctgcgccgcgcacctcag

SEQ ID NO: 202827 - DNA, 20 bp, human
gtcccggccggcccacgcag

SEQ ID NO: 202828 - DNA, 20 bp, human
gcccgcccagaaggagactg

SEQ ID NO: 202829 - DNA, 20 bp, human
ggcgcggagcgtggcggcca

SEQ ID NO: 202830 - DNA, 20 bp, human
gccatcccgccatataacga

SEQ ID NO: 202831 - DNA, 20 bp, human
gccctctcggcgggcccctg

SEQ ID NO: 202832 - DNA, 20 bp, human
gaaaggttccgtaaagacaa

SEQ ID NO: 202833 - DNA, 20 bp, human
gcggccggcccacgcagagg

SEQ ID NO: 202834 - DNA, 20 bp, human
ggtggaactgccttcgggat

SEQ ID NO: 202835 - DNA, 20 bp, human
ggtgcgggcgcatcttctaa

SEQ ID NO: 202836 - DNA, 20 bp, human
gcggcggagccagcgacagg

SEQ ID NO: 202837 - DNA, 20 bp, human
gcgcgggccaagcctaccgg

SEQ ID NO: 202838 - DNA, 20 bp, human
ggctcccagacgcaagcgga

SEQ ID NO: 202839 - DNA, 20 bp, human
gcccagacgcaagcggaggg

SEQ ID NO: 202840 - DNA, 20 bp, human
gacctgtgcgcgagtgacag

SEQ ID NO: 202841 - DNA, 20 bp, human
gtcgcgcacaggttaccccg

SEQ ID NO: 202842 - DNA, 20 bp, human
gagccagcgacaggcggaga

SEQ ID NO: 202843 - DNA, 20 bp, human
ggccggctcccagacgcaag

SEQ ID NO: 202844 - DNA, 20 bp, human
gggctccactcacccccggt

SEQ ID NO: 202845 - DNA, 20 bp, human
gcgatgggcacggggagaca

SEQ ID NO: 202846 - DNA, 20 bp, human
gtcaccaacccctctcgttg

SEQ ID NO: 202847 - DNA, 20 bp, human
gcagcctcaacgagaggggt

SEQ ID NO: 202848 - DNA, 20 bp, human
gagccgagtagcgtacagag

SEQ ID NO: 202849 - DNA, 20 bp, human
gcgccccggtttgacgcaca

SEQ ID NO: 202850 - DNA, 20 bp, human
ggtgccgtgtgcgtcaaacc

SEQ ID NO: 202851 - DNA, 20 bp, human
ggctgcggcgtcggaggatc

SEQ ID NO: 202852 - DNA, 20 bp, human
ggcgtcggaggatccggtag

SEQ ID NO: 202853 - DNA, 20 bp, human
gtggccagcgaggagctccc

SEQ ID NO: 202854 - DNA, 20 bp, human
ggccgcacaggctaagatgg

SEQ ID NO: 202855 - DNA, 20 bp, human
gtccggtagcggacacaaag

SEQ ID NO: 202856 - DNA, 20 bp, human
gaatatgtgtctgaactcca

SEQ ID NO: 202857 - DNA, 20 bp, human
ggcatcttgttcatattcct

SEQ ID NO: 202858 - DNA, 20 bp, human
ggaattgaggcgcataaacg

SEQ ID NO: 202859 - DNA, 20 bp, human
gcacattcttgttcaccagc

SEQ ID NO: 202860 - DNA, 20 bp, human
gaagggaagtactactctaa

SEQ ID NO: 202861 - DNA, 20 bp, human
gtatcctgtgctgagaattg

SEQ ID NO: 202862 - DNA, 20 bp, human
gtgtccccccaacggtaacc

SEQ ID NO: 202863 - DNA, 20 bp, human
gttgttttcgagctctctta

SEQ ID NO: 202864 - DNA, 20 bp, human
ggcgcctcaattctcagcac

SEQ ID NO: 202865 - DNA, 20 bp, human
gattcctggttaccgttggg

SEQ ID NO: 202866 - DNA, 20 bp, human
gtgtgaggtgagaattccgg

SEQ ID NO: 202867 - DNA, 20 bp, human
gcaggacgcctacctcgcac

SEQ ID NO: 202868 - DNA, 20 bp, human
gacgagatgagtgaggtcag

SEQ ID NO: 202869 - DNA, 20 bp, human
gaggcgtcctgagaggaaat

SEQ ID NO: 202870 - DNA, 20 bp, human
gaggaagtgtccgtagagct

SEQ ID NO: 202871 - DNA, 20 bp, human
ggggtaagatcaggaggcat

SEQ ID NO: 202872 - DNA, 20 bp, human
gagagaaaagagggcgcagc

SEQ ID NO: 202873 - DNA, 20 bp, human
ggcggctgcagttagggtaa

SEQ ID NO: 202874 - DNA, 20 bp, human
gggcgcagctggcatgagcc

SEQ ID NO: 202875 - DNA, 20 bp, human
gttcattggtggttgactag

SEQ ID NO: 202876 - DNA, 20 bp, human
gctgcagagagagcctctgg

SEQ ID NO: 202877 - DNA, 20 bp, human
gagagaggcccgccatacca

SEQ ID NO: 202878 - DNA, 20 bp, human
gcagatgtgctagtccccag

SEQ ID NO: 202879 - DNA, 20 bp, human
gcgctttgtgtccagtccag

SEQ ID NO: 202880 - DNA, 20 bp, human
ggaacactgatgccatggta

SEQ ID NO: 202881 - DNA, 20 bp, human
gtcagcaacaggaaccagtt

SEQ ID NO: 202882 - DNA, 20 bp, human
gtatgaggttggggagtcaa

SEQ ID NO: 202883 - DNA, 20 bp, human
gctctctgcagccgctggac

SEQ ID NO: 202884 - DNA, 20 bp, human
ggcagaggaagttccagcaa

SEQ ID NO: 202885 - DNA, 20 bp, human
gcagagagagcctctggagg

SEQ ID NO: 202886 - DNA, 20 bp, human
gggccagtgccggggtttaa

SEQ ID NO: 202887 - DNA, 20 bp, human
gccgccataggccagtgccg

SEQ ID NO: 202888 - DNA, 20 bp, human
gctcccacgccggaccgcaa

SEQ ID NO: 202889 - DNA, 20 bp, human
gggcagcgtacgagggtgtg

SEQ ID NO: 202890 - DNA, 20 bp, human
gggggtttaagggccaggaa

SEQ ID NO: 202891 - DNA, 20 bp, human
gaaaccccggcactggccta

SEQ ID NO: 202892 - DNA, 20 bp, human
gggtgctgggcagcgtacga

SEQ ID NO: 202893 - DNA, 20 bp, human
gcactggatggagaactcta

SEQ ID NO: 202894 - DNA, 20 bp, human
gggcccttaaaccccggcac

SEQ ID NO: 202895 - DNA, 20 bp, human
gcaaaggcaccccaacccaa

SEQ ID NO: 202896 - DNA, 20 bp, human
ggagtcgcgagacgtcggag

SEQ ID NO: 202897 - DNA, 20 bp, human
ggaagggagtcgcgagacgt

SEQ ID NO: 202898 - DNA, 20 bp, human
gctcctcaggcacccagctt

SEQ ID NO: 202899 - DNA, 20 bp, human
gggccggcccgggtgagtaa

SEQ ID NO: 202900 - DNA, 20 bp, human
gggccctgaggacagacgtt

SEQ ID NO: 202901 - DNA, 20 bp, human
gcggcggccacgtagcgctg

SEQ ID NO: 202902 - DNA, 20 bp, human
gggccggagcagcccccatc

SEQ ID NO: 202903 - DNA, 20 bp, human
gcgccctcgcgcgctgggaa

SEQ ID NO: 202904 - DNA, 20 bp, human
gccggcgtaacccttcgccg

SEQ ID NO: 202905 - DNA, 20 bp, human
gggtctgaggagcggccctg

SEQ ID NO: 202906 - DNA, 20 bp, human
ggtctggctcctaacaacgg

SEQ ID NO: 202907 - DNA, 20 bp, human
ggaggctggtaaccagggtg

SEQ ID NO: 202908 - DNA, 20 bp, human
gcgggggaggctggtaacca

SEQ ID NO: 202909 - DNA, 20 bp, human
gctggccctagaagcggagg

SEQ ID NO: 202910 - DNA, 20 bp, human
gtggctcctaacaacggggg

SEQ ID NO: 202911 - DNA, 20 bp, human
gatgcgcgccacttccggtc

SEQ ID NO: 202912 - DNA, 20 bp, human
gctagagcccgaggcggagg

SEQ ID NO: 202913 - DNA, 20 bp, human
gttaggagccagaccggaag

SEQ ID NO: 202914 - DNA, 20 bp, human
gcgggggctggccctagaag

SEQ ID NO: 202915 - DNA, 20 bp, human
gcgggcgctagagcccgagg

SEQ ID NO: 202916 - DNA, 20 bp, human
gtatctggagtgcagcctaa

SEQ ID NO: 202917 - DNA, 20 bp, human
gcccaggctcatcagaaaaa

SEQ ID NO: 202918 - DNA, 20 bp, human
gctgatcctgatgatgtatc

SEQ ID NO: 202919 - DNA, 20 bp, human
gcacttactgcttctagtga

SEQ ID NO: 202920 - DNA, 20 bp, human
gtttaggtggtcacattgta

SEQ ID NO: 202921 - DNA, 20 bp, human
gagtagatcacaatgtccca

SEQ ID NO: 202922 - DNA, 20 bp, human
gcacattgtaaggcatgccc

SEQ ID NO: 202923 - DNA, 20 bp, human
gaattctgatagtaaggatt

SEQ ID NO: 202924 - DNA, 20 bp, human
gtgaattcagccacatgctc

SEQ ID NO: 202925 - DNA, 20 bp, human
gaatgggaattctgatagta

SEQ ID NO: 202926 - DNA, 20 bp, human
gccccgaggccggcgcttct

SEQ ID NO: 202927 - DNA, 20 bp, human
gcgaggccggcgcttctcgg

SEQ ID NO: 202928 - DNA, 20 bp, human
gccgcgaggtgaatgaacca

SEQ ID NO: 202929 - DNA, 20 bp, human
gccttcacgggagtagaagg

SEQ ID NO: 202930 - DNA, 20 bp, human
gtacagaccagctcgcacca

SEQ ID NO: 202931 - DNA, 20 bp, human
ggggcctccgcgcactctcg

SEQ ID NO: 202932 - DNA, 20 bp, human
gcacggtcgccggctcctga

SEQ ID NO: 202933 - DNA, 20 bp, human
gcggggaagcgaactaccgt

SEQ ID NO: 202934 - DNA, 20 bp, human
ggccccgagcgcgagtgtgt

SEQ ID NO: 202935 - DNA, 20 bp, human
ggccaaggcaaagtcccaaa

SEQ ID NO: 202936 - DNA, 20 bp, human
gcgggaagaggaaatgtgcg

SEQ ID NO: 202937 - DNA, 20 bp, human
ggaggaaatgtgcgtggatg

SEQ ID NO: 202938 - DNA, 20 bp, human
gaccaaagaggtcgttgtga

SEQ ID NO: 202939 - DNA, 20 bp, human
gagaggtcgttgtgagggtc

SEQ ID NO: 202940 - DNA, 20 bp, human
gtaggtctgcgcgggagccg

SEQ ID NO: 202941 - DNA, 20 bp, human
ggcacctggggtgagagcgt

SEQ ID NO: 202942 - DNA, 20 bp, human
gtcaccgacgctctcacccc

SEQ ID NO: 202943 - DNA, 20 bp, human
gccgcgcagacctaaagact

SEQ ID NO: 202944 - DNA, 20 bp, human
ggtccctttcaggcccggga

SEQ ID NO: 202945 - DNA, 20 bp, human
gtgccctcccgggcctgaaa

SEQ ID NO: 202946 - DNA, 20 bp, human
gtgaggggtgctctacagtc

SEQ ID NO: 202947 - DNA, 20 bp, human
ggactggacccaagacaaag

SEQ ID NO: 202948 - DNA, 20 bp, human
gccgggttctgggagcgtgt

SEQ ID NO: 202949 - DNA, 20 bp, human
ggtccaagcgagcagctacg

SEQ ID NO: 202950 - DNA, 20 bp, human
gctctacagtctggcgtggg

SEQ ID NO: 202951 - DNA, 20 bp, human
ggctacgaggagtcagagac

SEQ ID NO: 202952 - DNA, 20 bp, human
gctggtaacgggagggatat

SEQ ID NO: 202953 - DNA, 20 bp, human
gggtctggcgctttcggtga

SEQ ID NO: 202954 - DNA, 20 bp, human
gtgcgctttgttcaagatgt

SEQ ID NO: 202955 - DNA, 20 bp, human
gggactcgaccgctactacc

SEQ ID NO: 202956 - DNA, 20 bp, human
gtctccgggcctagaaccca

SEQ ID NO: 202957 - DNA, 20 bp, human
gggaagagcgctctgcacct

SEQ ID NO: 202958 - DNA, 20 bp, human
ggtgcggcggctgggaaatg

SEQ ID NO: 202959 - DNA, 20 bp, human
ggtgtggagcacggggagtc

SEQ ID NO: 202960 - DNA, 20 bp, human
ggtgaggggcctcgagggac

SEQ ID NO: 202961 - DNA, 20 bp, human
gcacctgggcaggcctgaca

SEQ ID NO: 202962 - DNA, 20 bp, human
gctggcgggtgtggagcacg

SEQ ID NO: 202963 - DNA, 20 bp, human
ggcgcgccagaccggaccag

SEQ ID NO: 202964 - DNA, 20 bp, human
gccaggccccagcatccggg

SEQ ID NO: 202965 - DNA, 20 bp, human
gcgtcctagagcaaccggag

SEQ ID NO: 202966 - DNA, 20 bp, human
ggctcggaggcgcacctgtg

SEQ ID NO: 202967 - DNA, 20 bp, human
gcacgcgcgctgtcccccgg

SEQ ID NO: 202968 - DNA, 20 bp, human
ggccggtgcgagcgagggct

SEQ ID NO: 202969 - DNA, 20 bp, human
ggctccacgggcgacgaggg

SEQ ID NO: 202970 - DNA, 20 bp, human
gctgtcccccggaggcgtct

SEQ ID NO: 202971 - DNA, 20 bp, human
gccctcggctccaacaacaa

SEQ ID NO: 202972 - DNA, 20 bp, human
gtggcggccggtgcgagcga

SEQ ID NO: 202973 - DNA, 20 bp, human
gcacacccagacgcctccgg

SEQ ID NO: 202974 - DNA, 20 bp, human
ggcgcacgcgcgctgtcccc

SEQ ID NO: 202975 - DNA, 20 bp, human
gcaacaatggagcctggctc

SEQ ID NO: 202976 - DNA, 20 bp, human
ggctcggaggcgcacctgtg

SEQ ID NO: 202977 - DNA, 20 bp, human
gcacgcgcgctgtcccccgg

SEQ ID NO: 202978 - DNA, 20 bp, human
ggccggtgcgagcgagggct

SEQ ID NO: 202979 - DNA, 20 bp, human
ggctccacgggcgacgaggg

SEQ ID NO: 202980 - DNA, 20 bp, human
gctgtcccccggaggcgtct

SEQ ID NO: 202981 - DNA, 20 bp, human
gccctcggctccaacaacaa

SEQ ID NO: 202982 - DNA, 20 bp, human
gtggcggccggtgcgagcga

SEQ ID NO: 202983 - DNA, 20 bp, human
gcacacccagacgcctccgg

SEQ ID NO: 202984 - DNA, 20 bp, human
ggcgcacgcgcgctgtcccc

SEQ ID NO: 202985 - DNA, 20 bp, human
gcaacaatggagcctggctc

SEQ ID NO: 202986 - DNA, 20 bp, human
gagatagagggaaactcacg

SEQ ID NO: 202987 - DNA, 20 bp, human
gacgctccagtagctgacta

SEQ ID NO: 202988 - DNA, 20 bp, human
gagcagatctcttggagtga

SEQ ID NO: 202989 - DNA, 20 bp, human
gaacccccggacatcgggta

SEQ ID NO: 202990 - DNA, 20 bp, human
gatcgggtacggaggagcag

SEQ ID NO: 202991 - DNA, 20 bp, human
gaacccggaagcagatctct

SEQ ID NO: 202992 - DNA, 20 bp, human
gccccggacatcgggtacgg

SEQ ID NO: 202993 - DNA, 20 bp, human
gctgaaggccgaaagaccgc

SEQ ID NO: 202994 - DNA, 20 bp, human
gcaggtttaatctagataga

SEQ ID NO: 202995 - DNA, 20 bp, human
gctagggcgaggttagggga

SEQ ID NO: 202996 - DNA, 20 bp, human
gacccacgcgaaggaaacaa

SEQ ID NO: 202997 - DNA, 20 bp, human
gtctgagcccgggaagaccg

SEQ ID NO: 202998 - DNA, 20 bp, human
gtcttcccgggctcagaccc

SEQ ID NO: 202999 - DNA, 20 bp, human
gtcccgggctcagaccccgg

SEQ ID NO: 203000 - DNA, 20 bp, human
gccctgctcggctgtctcgg

SEQ ID NO: 203001 - DNA, 20 bp, human
gcccttacctcggtcttccc

SEQ ID NO: 203002 - DNA, 20 bp, human
gcccactcccggcttcccaa

SEQ ID NO: 203003 - DNA, 20 bp, human
ggcccgggaagaccgaggta

SEQ ID NO: 203004 - DNA, 20 bp, human
gcgagaaccacagcagcgaa

SEQ ID NO: 203005 - DNA, 20 bp, human
gtgtgtgagggagctatgtc

SEQ ID NO: 203006 - DNA, 20 bp, human
gtcacaccacctgactccgg

SEQ ID NO: 203007 - DNA, 20 bp, human
gccctccagcagggctgcta

SEQ ID NO: 203008 - DNA, 20 bp, human
gccacacagtggcaggtggt

SEQ ID NO: 203009 - DNA, 20 bp, human
gcatagccgggtgcactcgg

SEQ ID NO: 203010 - DNA, 20 bp, human
gggctgcccccggagtcagg

SEQ ID NO: 203011 - DNA, 20 bp, human
gcaggtggtgggcatgacgg

SEQ ID NO: 203012 - DNA, 20 bp, human
gggcgtcctgggacctcaag

SEQ ID NO: 203013 - DNA, 20 bp, human
gggtgcatggccaggtccgc

SEQ ID NO: 203014 - DNA, 20 bp, human
gaggctcgacgacaccacaa

SEQ ID NO: 203015 - DNA, 20 bp, human
ggctgggggaccctccagca

SEQ ID NO: 203016 - DNA, 20 bp, human
gcgactcggtccgcaggttc

SEQ ID NO: 203017 - DNA, 20 bp, human
ggagagacaaagcaaccgcc

SEQ ID NO: 203018 - DNA, 20 bp, human
gcacactacctggatagggg

SEQ ID NO: 203019 - DNA, 20 bp, human
gactagcagcggagactaac

SEQ ID NO: 203020 - DNA, 20 bp, human
gaggcgaggggttcccgaca

SEQ ID NO: 203021 - DNA, 20 bp, human
gatactcgcaggtcacaggg

SEQ ID NO: 203022 - DNA, 20 bp, human
gcaccacactacctggatag

SEQ ID NO: 203023 - DNA, 20 bp, human
gccaggtagtgtggtgacca

SEQ ID NO: 203024 - DNA, 20 bp, human
ggctagttcttggctctggg

SEQ ID NO: 203025 - DNA, 20 bp, human
ggaagagccggctccggcga

SEQ ID NO: 203026 - DNA, 20 bp, human
ggtcctccctaaggaccttc

SEQ ID NO: 203027 - DNA, 20 bp, human
gcccctgaggaccctcccgt

SEQ ID NO: 203028 - DNA, 20 bp, human
ggggagatgcgggtctacag

SEQ ID NO: 203029 - DNA, 20 bp, human
gcctcccagggataagggga

SEQ ID NO: 203030 - DNA, 20 bp, human
gcaggcccggaaccctttct

SEQ ID NO: 203031 - DNA, 20 bp, human
ggcacgatccgagggagatg

SEQ ID NO: 203032 - DNA, 20 bp, human
ggtgttgggcagcgcgaatg

SEQ ID NO: 203033 - DNA, 20 bp, human
gcaagcgcgccgcgaaagga

SEQ ID NO: 203034 - DNA, 20 bp, human
gcgccggcggaaactcgggt

SEQ ID NO: 203035 - DNA, 20 bp, human
gtcggcaccgcacgatccga

SEQ ID NO: 203036 - DNA, 20 bp, human
gcgttacagaaccccggcca

SEQ ID NO: 203037 - DNA, 20 bp, human
gttgtgtgggccgcaggtgg

SEQ ID NO: 203038 - DNA, 20 bp, human
gcacaagcgttacagaaccc

SEQ ID NO: 203039 - DNA, 20 bp, human
gagctccgccataggaccgt

SEQ ID NO: 203040 - DNA, 20 bp, human
ggaggggacggcgcaggtaa

SEQ ID NO: 203041 - DNA, 20 bp, human
gtgaggaactgtgactggaa

SEQ ID NO: 203042 - DNA, 20 bp, human
ggtgggtgtgggagagttac

SEQ ID NO: 203043 - DNA, 20 bp, human
gggtgtgggagagttacggg

SEQ ID NO: 203044 - DNA, 20 bp, human
gacggcgcaggtaaaggctc

SEQ ID NO: 203045 - DNA, 20 bp, human
gtggaggtgttgggaaagcg

SEQ ID NO: 203046 - DNA, 20 bp, human
ggaccggtgaggggactgaa

SEQ ID NO: 203047 - DNA, 20 bp, human
ggggcagcagtcctcagctg

SEQ ID NO: 203048 - DNA, 20 bp, human
ggcgtcactcgcagcccggg

SEQ ID NO: 203049 - DNA, 20 bp, human
gccagcgaggacaggcggag

SEQ ID NO: 203050 - DNA, 20 bp, human
gctggcgcgggcagtgtcac

SEQ ID NO: 203051 - DNA, 20 bp, human
gccagtcgcccgaggcagat

SEQ ID NO: 203052 - DNA, 20 bp, human
gctcgggcgactggtgtctg

SEQ ID NO: 203053 - DNA, 20 bp, human
gcaccggttgctgggaagac

SEQ ID NO: 203054 - DNA, 20 bp, human
gcgtcggctagtggtcagtc

SEQ ID NO: 203055 - DNA, 20 bp, human
gaaccgcgcggtgtctgagg

SEQ ID NO: 203056 - DNA, 20 bp, human
gggcagtgaagtaagcggga

SEQ ID NO: 203057 - DNA, 20 bp, human
gctgtcggcagtgaagtaag

SEQ ID NO: 203058 - DNA, 20 bp, human
gcagcctgaaacctcagggg

SEQ ID NO: 203059 - DNA, 20 bp, human
gccgacagcctgaaacctca

SEQ ID NO: 203060 - DNA, 20 bp, human
gggtggcgcttcgttcacac

SEQ ID NO: 203061 - DNA, 20 bp, human
gctgttgtcatccgcccctg

SEQ ID NO: 203062 - DNA, 20 bp, human
gaatgctcggctgacccgga

SEQ ID NO: 203063 - DNA, 20 bp, human
ggagagaaaacggtacagtg

SEQ ID NO: 203064 - DNA, 20 bp, human
gagtgtctggcagttaccac

SEQ ID NO: 203065 - DNA, 20 bp, human
gtggcagttaccaccgggtg

SEQ ID NO: 203066 - DNA, 20 bp, human
ggagcaatgaaagcgagacc

SEQ ID NO: 203067 - DNA, 20 bp, human
gaccacaggagggccgtcac

SEQ ID NO: 203068 - DNA, 20 bp, human
gaccctgagtcaggattctc

SEQ ID NO: 203069 - DNA, 20 bp, human
gctagaggtccagcctctgt

SEQ ID NO: 203070 - DNA, 20 bp, human
gtccggtgacggccctcctg

SEQ ID NO: 203071 - DNA, 20 bp, human
gagggtgcgggttcattaat

SEQ ID NO: 203072 - DNA, 20 bp, human
gtgagagaaatgcggcgctg

SEQ ID NO: 203073 - DNA, 20 bp, human
gaacccgtgggaaatggcta

SEQ ID NO: 203074 - DNA, 20 bp, human
ggaagagacgggatgccccg

SEQ ID NO: 203075 - DNA, 20 bp, human
gcgtgggaaatggctatggc

SEQ ID NO: 203076 - DNA, 20 bp, human
gattctgctgtgtagaatcc

SEQ ID NO: 203077 - DNA, 20 bp, human
gagttctgcccatgaccaat

SEQ ID NO: 203078 - DNA, 20 bp, human
gtaactctgagaaaagaaag

SEQ ID NO: 203079 - DNA, 20 bp, human
gatatttaccaattggtcat

SEQ ID NO: 203080 - DNA, 20 bp, human
gtacatatacacagatgtta

SEQ ID NO: 203081 - DNA, 20 bp, human
ggaaacctgtagtatatact

SEQ ID NO: 203082 - DNA, 20 bp, human
gtggagagagtagagagagc

SEQ ID NO: 203083 - DNA, 20 bp, human
gcctaaatgtcaatgctccc

SEQ ID NO: 203084 - DNA, 20 bp, human
gaacacatatatttaccaat

SEQ ID NO: 203085 - DNA, 20 bp, human
gaattcctagtatatactac

SEQ ID NO: 203086 - DNA, 20 bp, human
ggcgagatccgcttccgggt

SEQ ID NO: 203087 - DNA, 20 bp, human
gcaggcttgaacccgaaaga

SEQ ID NO: 203088 - DNA, 20 bp, human
gcggggctactggcgctctc

SEQ ID NO: 203089 - DNA, 20 bp, human
ggttcctgccgacccggaag

SEQ ID NO: 203090 - DNA, 20 bp, human
gagcggagcgtgggaacctg

SEQ ID NO: 203091 - DNA, 20 bp, human
gcgaccccaaaacccgacag

SEQ ID NO: 203092 - DNA, 20 bp, human
gtgggaacctgtggcccgcg

SEQ ID NO: 203093 - DNA, 20 bp, human
gcctggtaaagccctcactc

SEQ ID NO: 203094 - DNA, 20 bp, human
gcacccttcgcccttctcca

SEQ ID NO: 203095 - DNA, 20 bp, human
gaaacccgacagcggagcgt

SEQ ID NO: 203096 - DNA, 20 bp, human
gcagctggagcacaagacaa

SEQ ID NO: 203097 - DNA, 20 bp, human
gccagaggggagggtcatcg

SEQ ID NO: 203098 - DNA, 20 bp, human
ggataaatagccgagaatac

SEQ ID NO: 203099 - DNA, 20 bp, human
gacgggaccaaagctccagc

SEQ ID NO: 203100 - DNA, 20 bp, human
gcagaggtgacagatcccac

SEQ ID NO: 203101 - DNA, 20 bp, human
gtagccgcccagagaggccg

SEQ ID NO: 203102 - DNA, 20 bp, human
gcggtgtgcgaaacatgcgt

SEQ ID NO: 203103 - DNA, 20 bp, human
gggacaaagcacacagtctg

SEQ ID NO: 203104 - DNA, 20 bp, human
gaggagcgcagcttgagagg

SEQ ID NO: 203105 - DNA, 20 bp, human
gtgatgggaggagaatcccg

SEQ ID NO: 203106 - DNA, 20 bp, human
gaggacccggaaaattacgg

SEQ ID NO: 203107 - DNA, 20 bp, human
gcagagaaacacaaaggacc

SEQ ID NO: 203108 - DNA, 20 bp, human
ggtcccctcgagccataata

SEQ ID NO: 203109 - DNA, 20 bp, human
gcaccatattatggctcgag

SEQ ID NO: 203110 - DNA, 20 bp, human
ggatgcctccgtaattttcc

SEQ ID NO: 203111 - DNA, 20 bp, human
gttcctagggtcctagccgc

SEQ ID NO: 203112 - DNA, 20 bp, human
ggagccataatatggtgcct

SEQ ID NO: 203113 - DNA, 20 bp, human
gaggggactaacagcccacc

SEQ ID NO: 203114 - DNA, 20 bp, human
gcccaaatcctccttggccc

SEQ ID NO: 203115 - DNA, 20 bp, human
gaaatcctccttggcccagg

SEQ ID NO: 203116 - DNA, 20 bp, human
ggagcagtaaagactagacc

SEQ ID NO: 203117 - DNA, 20 bp, human
ggcagataacggagtcacag

SEQ ID NO: 203118 - DNA, 20 bp, human
gcgagttatcggcagagatg

SEQ ID NO: 203119 - DNA, 20 bp, human
gtaacggagtcacagaggct

SEQ ID NO: 203120 - DNA, 20 bp, human
ggggtgcagggttcataaat

SEQ ID NO: 203121 - DNA, 20 bp, human
gactccaggctccaagcact

SEQ ID NO: 203122 - DNA, 20 bp, human
gcggcagagatgcggcactg

SEQ ID NO: 203123 - DNA, 20 bp, human
gaccctgcaccccgagttat

SEQ ID NO: 203124 - DNA, 20 bp, human
gcctttgtctctagctgctg

SEQ ID NO: 203125 - DNA, 20 bp, human
ggccgataactcggggtgca

SEQ ID NO: 203126 - DNA, 20 bp, human
ggctgggcctctagaagaag

SEQ ID NO: 203127 - DNA, 20 bp, human
gagagagactaggaacgcca

SEQ ID NO: 203128 - DNA, 20 bp, human
gcacttggaccataagatgg

SEQ ID NO: 203129 - DNA, 20 bp, human
gaagtggactgaggccgcct

SEQ ID NO: 203130 - DNA, 20 bp, human
gcgtcaggggcgaatcctga

SEQ ID NO: 203131 - DNA, 20 bp, human
gctcccttcagcccgagctc

SEQ ID NO: 203132 - DNA, 20 bp, human
gcatgaacccggcacccgtc

SEQ ID NO: 203133 - DNA, 20 bp, human
gaggagaaaggacgcccggg

SEQ ID NO: 203134 - DNA, 20 bp, human
ggaactcagggcgcaaattg

SEQ ID NO: 203135 - DNA, 20 bp, human
ggaagacgagacccggagct

SEQ ID NO: 203136 - DNA, 20 bp, human
gacgcgcgcggctcttccca

SEQ ID NO: 203137 - DNA, 20 bp, human
ggacaatggaagcgtcctca

SEQ ID NO: 203138 - DNA, 20 bp, human
gtcgctccagccagagctca

SEQ ID NO: 203139 - DNA, 20 bp, human
ggactccagtccgcagactc

SEQ ID NO: 203140 - DNA, 20 bp, human
gtgtgcccggaggtgatcga

SEQ ID NO: 203141 - DNA, 20 bp, human
ggtctgcggactggagtccc

SEQ ID NO: 203142 - DNA, 20 bp, human
ggccgcgcatcccgaggtgg

SEQ ID NO: 203143 - DNA, 20 bp, human
gtccattgtccccgcagtcg

SEQ ID NO: 203144 - DNA, 20 bp, human
gtccggagctgacagctggg

SEQ ID NO: 203145 - DNA, 20 bp, human
gggccggaaccggcagtgac

SEQ ID NO: 203146 - DNA, 20 bp, human
gctgtggctgaggccccagt

SEQ ID NO: 203147 - DNA, 20 bp, human
ggcactgctgcagcaccgag

SEQ ID NO: 203148 - DNA, 20 bp, human
gccccagtgggagtgagaga

SEQ ID NO: 203149 - DNA, 20 bp, human
ggccagtcaggggcatccgg

SEQ ID NO: 203150 - DNA, 20 bp, human
gaataccatggacccccgaa

SEQ ID NO: 203151 - DNA, 20 bp, human
gagtgggagtgagagatggc

SEQ ID NO: 203152 - DNA, 20 bp, human
gattcaaagagtggtccctg

SEQ ID NO: 203153 - DNA, 20 bp, human
gcactggagtgagggtctta

SEQ ID NO: 203154 - DNA, 20 bp, human
gagtggtccctgaggtgacg

SEQ ID NO: 203155 - DNA, 20 bp, human
gggaataaagcctgaatgag

SEQ ID NO: 203156 - DNA, 20 bp, human
gtcagcgccgcgggaagtgc

SEQ ID NO: 203157 - DNA, 20 bp, human
gccgcacacgcgtagtagga

SEQ ID NO: 203158 - DNA, 20 bp, human
ggccgtgtcaagggatccag

SEQ ID NO: 203159 - DNA, 20 bp, human
gcacccgcccgcacttcccg

SEQ ID NO: 203160 - DNA, 20 bp, human
gacagcgtcgtccagagaca

SEQ ID NO: 203161 - DNA, 20 bp, human
gtaggtcaaggtcactatgt

SEQ ID NO: 203162 - DNA, 20 bp, human
gcgacgctgtgactgatccc

SEQ ID NO: 203163 - DNA, 20 bp, human
ggcgccgcgggaagtgcggg

SEQ ID NO: 203164 - DNA, 20 bp, human
gtgcgagcgaggcagtgaaa

SEQ ID NO: 203165 - DNA, 20 bp, human
gggagtccaggaactctagg

SEQ ID NO: 203166 - DNA, 20 bp, human
ggcccatccgccccaatgga

SEQ ID NO: 203167 - DNA, 20 bp, human
gagtgcggcccggagattga

SEQ ID NO: 203168 - DNA, 20 bp, human
gccgcccccatccccgggaa

SEQ ID NO: 203169 - DNA, 20 bp, human
gggaaggaatcgggacctaa

SEQ ID NO: 203170 - DNA, 20 bp, human
ggaatcgggacctaaaggtt

SEQ ID NO: 203171 - DNA, 20 bp, human
gtcgagaggcacccgaagtg

SEQ ID NO: 203172 - DNA, 20 bp, human
ggagaagcaggaagtagcgg

SEQ ID NO: 203173 - DNA, 20 bp, human
ggctgacccgcacccagtcg

SEQ ID NO: 203174 - DNA, 20 bp, human
gcccgcagagggaggagcga

SEQ ID NO: 203175 - DNA, 20 bp, human
gctggcgcccccggctcgag

SEQ ID NO: 203176 - DNA, 20 bp, human
ggcctcgcagccccgatcgg

SEQ ID NO: 203177 - DNA, 20 bp, human
gtcgttgtccacaggaaggg

SEQ ID NO: 203178 - DNA, 20 bp, human
gggacaacgacagctgaggc

SEQ ID NO: 203179 - DNA, 20 bp, human
gctgaagccctgggaacggg

SEQ ID NO: 203180 - DNA, 20 bp, human
gacctggcggccgccgatcg

SEQ ID NO: 203181 - DNA, 20 bp, human
gcagccacctcccgttccca

SEQ ID NO: 203182 - DNA, 20 bp, human
ggggtgaaaacactcccgag

SEQ ID NO: 203183 - DNA, 20 bp, human
gagggcttcaggtaccccct

SEQ ID NO: 203184 - DNA, 20 bp, human
gcggctgcgttcggacgcca

SEQ ID NO: 203185 - DNA, 20 bp, human
ggtgcaagagtgcgggatta

SEQ ID NO: 203186 - DNA, 20 bp, human
gccagacccagtcggaaaag

SEQ ID NO: 203187 - DNA, 20 bp, human
gccgcctttgcctggaacac

SEQ ID NO: 203188 - DNA, 20 bp, human
gacttgagggcaaagaggtt

SEQ ID NO: 203189 - DNA, 20 bp, human
gaggagcccctgccggacca

SEQ ID NO: 203190 - DNA, 20 bp, human
gattgaccggagcgccatgc

SEQ ID NO: 203191 - DNA, 20 bp, human
gggcaaagaggttaggaagc

SEQ ID NO: 203192 - DNA, 20 bp, human
gatgccttcggggaaaatgg

SEQ ID NO: 203193 - DNA, 20 bp, human
gctgcctgtgttccaggcaa

SEQ ID NO: 203194 - DNA, 20 bp, human
gggaagccggcatggcgctc

SEQ ID NO: 203195 - DNA, 20 bp, human
gaggggctcctcgatcccag

SEQ ID NO: 203196 - DNA, 20 bp, human
ggcagcccgcgcagggacaa

SEQ ID NO: 203197 - DNA, 20 bp, human
gcggttccagagccctctat

SEQ ID NO: 203198 - DNA, 20 bp, human
gcagggacaaaggtgaggta

SEQ ID NO: 203199 - DNA, 20 bp, human
gcagtgtctggaggaacagt

SEQ ID NO: 203200 - DNA, 20 bp, human
gctctcggggctggaaagac

SEQ ID NO: 203201 - DNA, 20 bp, human
ggttcctccagacactgagg

SEQ ID NO: 203202 - DNA, 20 bp, human
gcgccgcgcagagacgagac

SEQ ID NO: 203203 - DNA, 20 bp, human
ggaccgaccggaaccgactg

SEQ ID NO: 203204 - DNA, 20 bp, human
gtcccctcgactgctcggtg

SEQ ID NO: 203205 - DNA, 20 bp, human
gcgaccccctcagtgtctgg

SEQ ID NO: 203206 - DNA, 20 bp, human
gggcgctgtccctgatcgag

SEQ ID NO: 203207 - DNA, 20 bp, human
ggggacagcgccgcctctgt

SEQ ID NO: 203208 - DNA, 20 bp, human
gctccttccctcgcctacag

SEQ ID NO: 203209 - DNA, 20 bp, human
gcgctcccgccgctcgatca

SEQ ID NO: 203210 - DNA, 20 bp, human
gcttccctcgcctacagagg

SEQ ID NO: 203211 - DNA, 20 bp, human
gcgcgacctcgggcccaacc

SEQ ID NO: 203212 - DNA, 20 bp, human
ggccaatggcggaggtccaa

SEQ ID NO: 203213 - DNA, 20 bp, human
ggcgccgcctctgtaggcga

SEQ ID NO: 203214 - DNA, 20 bp, human
ggctgtccctgatcgagcgg

SEQ ID NO: 203215 - DNA, 20 bp, human
gggcgggagcgaggtgggtc

SEQ ID NO: 203216 - DNA, 20 bp, human
gtacagcagccgacgccgag

SEQ ID NO: 203217 - DNA, 20 bp, human
gaacgctgcgcgcgcgaggt

SEQ ID NO: 203218 - DNA, 20 bp, human
gaaacggtgcctctcggcgt

SEQ ID NO: 203219 - DNA, 20 bp, human
gtggagcggactaatcccaa

SEQ ID NO: 203220 - DNA, 20 bp, human
gaagaagaaacggtgcctct

SEQ ID NO: 203221 - DNA, 20 bp, human
gccgtggtcagaggtctgga

SEQ ID NO: 203222 - DNA, 20 bp, human
gggcctttactggtttctag

SEQ ID NO: 203223 - DNA, 20 bp, human
gcgactcgcccctccctctg

SEQ ID NO: 203224 - DNA, 20 bp, human
gctgctgtagcccggaactg

SEQ ID NO: 203225 - DNA, 20 bp, human
gaggcccgcgccccagaggg

SEQ ID NO: 203226 - DNA, 20 bp, human
ggagcctgcggcagtcaccc

SEQ ID NO: 203227 - DNA, 20 bp, human
ggtcatcacagcacaatcca

SEQ ID NO: 203228 - DNA, 20 bp, human
gccacccaggaacctttcac

SEQ ID NO: 203229 - DNA, 20 bp, human
ggagtcccgactcccgtgaa

SEQ ID NO: 203230 - DNA, 20 bp, human
ggagcagggtgtcccgagaa

SEQ ID NO: 203231 - DNA, 20 bp, human
gaggccccgccagatcccca

SEQ ID NO: 203232 - DNA, 20 bp, human
gggtctctgcctggtgactt

SEQ ID NO: 203233 - DNA, 20 bp, human
ggggccgtgccgaagtcacc

SEQ ID NO: 203234 - DNA, 20 bp, human
gactcccgtgaaaggttcct

SEQ ID NO: 203235 - DNA, 20 bp, human
gcggccgctgggtgactgtc

SEQ ID NO: 203236 - DNA, 20 bp, human
gcccgcacgtgtcggacccc

SEQ ID NO: 203237 - DNA, 20 bp, human
gcaggaagccccgcacgtgt

SEQ ID NO: 203238 - DNA, 20 bp, human
ggacggggcggggaccgtag

SEQ ID NO: 203239 - DNA, 20 bp, human
gcgcggccgagagaacgggg

SEQ ID NO: 203240 - DNA, 20 bp, human
gtggcaggcgggattacagg

SEQ ID NO: 203241 - DNA, 20 bp, human
gctggggtgtcgattcggga

SEQ ID NO: 203242 - DNA, 20 bp, human
gcccacgccgcgcccgagag

SEQ ID NO: 203243 - DNA, 20 bp, human
ggggcgcggccgagagaacg

SEQ ID NO: 203244 - DNA, 20 bp, human
gagctggactgcacccgcta

SEQ ID NO: 203245 - DNA, 20 bp, human
gccccgggtacgcacctgca

SEQ ID NO: 203246 - DNA, 20 bp, human
gctggcgcggcgaggagcta

SEQ ID NO: 203247 - DNA, 20 bp, human
gtcccgccgaccaccgaagg

SEQ ID NO: 203248 - DNA, 20 bp, human
gccaggactgagctccctca

SEQ ID NO: 203249 - DNA, 20 bp, human
gcacgctcctacctgcgagg

SEQ ID NO: 203250 - DNA, 20 bp, human
gcccggctgactcctcactg

SEQ ID NO: 203251 - DNA, 20 bp, human
ggccccaggggagcggacaa

SEQ ID NO: 203252 - DNA, 20 bp, human
gaccgttgtccgctcccctg

SEQ ID NO: 203253 - DNA, 20 bp, human
gccctcgccacatacccctg

SEQ ID NO: 203254 - DNA, 20 bp, human
ggcagggccccgggcttatg

SEQ ID NO: 203255 - DNA, 20 bp, human
ggagctccctcaggggtatg

SEQ ID NO: 203256 - DNA, 20 bp, human
gtaaaacactgagggagacc

SEQ ID NO: 203257 - DNA, 20 bp, human
gcttcatgaaggcgacatgg

SEQ ID NO: 203258 - DNA, 20 bp, human
gagaaacactacggccggcc

SEQ ID NO: 203259 - DNA, 20 bp, human
gtttcttcatgaaggcgaca

SEQ ID NO: 203260 - DNA, 20 bp, human
gttgtgccctaaaacactga

SEQ ID NO: 203261 - DNA, 20 bp, human
ggcaatagaaacactacggc

SEQ ID NO: 203262 - DNA, 20 bp, human
gatagtattttaggcactga

SEQ ID NO: 203263 - DNA, 20 bp, human
gagaatatttccattgtacc

SEQ ID NO: 203264 - DNA, 20 bp, human
gcgccttcatgaagaaaagc

SEQ ID NO: 203265 - DNA, 20 bp, human
gtgagggagacctggtacaa

SEQ ID NO: 203266 - DNA, 20 bp, human
gggtgacatttgcctcggct

SEQ ID NO: 203267 - DNA, 20 bp, human
ggatcagctcacagagaacg

SEQ ID NO: 203268 - DNA, 20 bp, human
gctcccgcggacccgacccg

SEQ ID NO: 203269 - DNA, 20 bp, human
gggaccagccgcggccacag

SEQ ID NO: 203270 - DNA, 20 bp, human
ggagcaaaggatgctttcgg

SEQ ID NO: 203271 - DNA, 20 bp, human
gcggacaaggagtggcgggg

SEQ ID NO: 203272 - DNA, 20 bp, human
gcgccctgcctgccccgggt

SEQ ID NO: 203273 - DNA, 20 bp, human
ggcggggtccggacaaggag

SEQ ID NO: 203274 - DNA, 20 bp, human
gggctgatgaactacgacat

SEQ ID NO: 203275 - DNA, 20 bp, human
gtgagctgatctgtggatcg

SEQ ID NO: 203276 - DNA, 20 bp, human
gcctccctgaggaccacccg

SEQ ID NO: 203277 - DNA, 20 bp, human
ggagcctcgggtggtcctca

SEQ ID NO: 203278 - DNA, 20 bp, human
gggcctaggataagtgacag

SEQ ID NO: 203279 - DNA, 20 bp, human
ggagaaaaggctctagaagg

SEQ ID NO: 203280 - DNA, 20 bp, human
gcagggatcactcggaccga

SEQ ID NO: 203281 - DNA, 20 bp, human
gggtgtccggggcctgagta

SEQ ID NO: 203282 - DNA, 20 bp, human
ggggccccgggagtagaccc

SEQ ID NO: 203283 - DNA, 20 bp, human
gcagggagggtgagtcggcg

SEQ ID NO: 203284 - DNA, 20 bp, human
gagggctaaggaagcgacca

SEQ ID NO: 203285 - DNA, 20 bp, human
gggccaaggcccgtttccgg

SEQ ID NO: 203286 - DNA, 20 bp, human
gccggagaaggccccgacag

SEQ ID NO: 203287 - DNA, 20 bp, human
gagaaggccccgacagaggt

SEQ ID NO: 203288 - DNA, 20 bp, human
ggggccaccggagggacagg

SEQ ID NO: 203289 - DNA, 20 bp, human
gcacacccagggccaccgga

SEQ ID NO: 203290 - DNA, 20 bp, human
gggccctagggactctctgg

SEQ ID NO: 203291 - DNA, 20 bp, human
gcaggcagcgtcggccgcgt

SEQ ID NO: 203292 - DNA, 20 bp, human
gtgttgtgggagacagataa

SEQ ID NO: 203293 - DNA, 20 bp, human
gctgtggagccaggcagcgt

SEQ ID NO: 203294 - DNA, 20 bp, human
gcctgagctgctccaacccg

SEQ ID NO: 203295 - DNA, 20 bp, human
gaggcggactcaggtcacac

SEQ ID NO: 203296 - DNA, 20 bp, human
gccgcgcagcgaggaaggtg

SEQ ID NO: 203297 - DNA, 20 bp, human
ggcgacagaagcctgggtac

SEQ ID NO: 203298 - DNA, 20 bp, human
gcggtcagaccagcccgaga

SEQ ID NO: 203299 - DNA, 20 bp, human
ggaccagcccgagagggacc

SEQ ID NO: 203300 - DNA, 20 bp, human
gttgtgcggaagcaacggga

SEQ ID NO: 203301 - DNA, 20 bp, human
gttcctcgctgcgcgggcgg

SEQ ID NO: 203302 - DNA, 20 bp, human
ggcgggcggcggttggtaac

SEQ ID NO: 203303 - DNA, 20 bp, human
gcagattgtgcggaagcaac

SEQ ID NO: 203304 - DNA, 20 bp, human
gcagttcatccggaaatgga

SEQ ID NO: 203305 - DNA, 20 bp, human
gagggccgaactgctcaagg

SEQ ID NO: 203306 - DNA, 20 bp, human
gcgcgatcccagtctcaggg

SEQ ID NO: 203307 - DNA, 20 bp, human
gcagcaccaggcagagaact

SEQ ID NO: 203308 - DNA, 20 bp, human
gcggaagtgccggggatatg

SEQ ID NO: 203309 - DNA, 20 bp, human
gactcggcctccctgagact

SEQ ID NO: 203310 - DNA, 20 bp, human
gtagcagaaagactggagac

SEQ ID NO: 203311 - DNA, 20 bp, human
gcggtgcgaccttcactcca

SEQ ID NO: 203312 - DNA, 20 bp, human
ggtgcgacgacgccttcggt

SEQ ID NO: 203313 - DNA, 20 bp, human
gcgtcgcgatcccagtctca

SEQ ID NO: 203314 - DNA, 20 bp, human
gatcttgtggaccccaccga

SEQ ID NO: 203315 - DNA, 20 bp, human
gtccacaagatcccagcacc

SEQ ID NO: 203316 - DNA, 20 bp, human
gccggggactgacctcaatg

SEQ ID NO: 203317 - DNA, 20 bp, human
gtgctagccggggccagcgg

SEQ ID NO: 203318 - DNA, 20 bp, human
gtgcggctcgaggaaggcga

SEQ ID NO: 203319 - DNA, 20 bp, human
gtcaatggggctgacgggag

SEQ ID NO: 203320 - DNA, 20 bp, human
gtgggtcagggtcccggtcg

SEQ ID NO: 203321 - DNA, 20 bp, human
ggcccgctggatctaaccca

SEQ ID NO: 203322 - DNA, 20 bp, human
gcacccgaaagcagcggcag

SEQ ID NO: 203323 - DNA, 20 bp, human
gcggtcgcggtgggaggaat

SEQ ID NO: 203324 - DNA, 20 bp, human
gtgttgctagccggggccag

SEQ ID NO: 203325 - DNA, 20 bp, human
gtccgggtgcaggaggtgac

SEQ ID NO: 203326 - DNA, 20 bp, human
gagcagcaccggcgacgagg

SEQ ID NO: 203327 - DNA, 20 bp, human
ggaatggctcgcgaagaggg

SEQ ID NO: 203328 - DNA, 20 bp, human
gcggcgccgctgaccgtcct

SEQ ID NO: 203329 - DNA, 20 bp, human
ggccgggaccggcccccctc

SEQ ID NO: 203330 - DNA, 20 bp, human
ggcccgccccggagagctgg

SEQ ID NO: 203331 - DNA, 20 bp, human
ggacccgccagcccggggag

SEQ ID NO: 203332 - DNA, 20 bp, human
gtggctcgcgaagagggggg

SEQ ID NO: 203333 - DNA, 20 bp, human
gagcaccggcgacgaggcgg

SEQ ID NO: 203334 - DNA, 20 bp, human
gcggccaggaggggtgtgtc

SEQ ID NO: 203335 - DNA, 20 bp, human
gcaggacccgcggctgccac

SEQ ID NO: 203336 - DNA, 20 bp, human
gtggtattaggggaacaatg

SEQ ID NO: 203337 - DNA, 20 bp, human
ggaaatgcaattccgcttaa

SEQ ID NO: 203338 - DNA, 20 bp, human
ggcataatggaaaattgcaa

SEQ ID NO: 203339 - DNA, 20 bp, human
gtgagtatattcaggaggat

SEQ ID NO: 203340 - DNA, 20 bp, human
gggttaagctgctctgtgag

SEQ ID NO: 203341 - DNA, 20 bp, human
gagtattttcctggtattag

SEQ ID NO: 203342 - DNA, 20 bp, human
gcagacataatgaagtctaa

SEQ ID NO: 203343 - DNA, 20 bp, human
gaagagtgagtatattcagg

SEQ ID NO: 203344 - DNA, 20 bp, human
gaaaagctacagttcagagc

SEQ ID NO: 203345 - DNA, 20 bp, human
gtcgtcaaaaatctgcataa

SEQ ID NO: 203346 - DNA, 20 bp, human
gtttccagtagggccaactg

SEQ ID NO: 203347 - DNA, 20 bp, human
ggccaactggggctaaagaa

SEQ ID NO: 203348 - DNA, 20 bp, human
gactggggctaaagaagggg

SEQ ID NO: 203349 - DNA, 20 bp, human
gtagccccagttggccctac

SEQ ID NO: 203350 - DNA, 20 bp, human
ggcacacagcctgtggaggg

SEQ ID NO: 203351 - DNA, 20 bp, human
gtacagcacacagcctgtgg

SEQ ID NO: 203352 - DNA, 20 bp, human
gtggttcctccaccctccac

SEQ ID NO: 203353 - DNA, 20 bp, human
ggaggaaccaactgcaaggt

SEQ ID NO: 203354 - DNA, 20 bp, human
gacatacagcacacagcctg

SEQ ID NO: 203355 - DNA, 20 bp, human
gggtggaggaaccaactgca

SEQ ID NO: 203356 - DNA, 20 bp, human
gatctaacatctgaaaatca

SEQ ID NO: 203357 - DNA, 20 bp, human
gtgttttagctttattgtat

SEQ ID NO: 203358 - DNA, 20 bp, human
gggaggttggaagccatgag

SEQ ID NO: 203359 - DNA, 20 bp, human
gctaagtacttacctcaata

SEQ ID NO: 203360 - DNA, 20 bp, human
gagttcaggaatggtgaaag

SEQ ID NO: 203361 - DNA, 20 bp, human
gactgctttgaatatattgg

SEQ ID NO: 203362 - DNA, 20 bp, human
gtcattcttttaccttattg

SEQ ID NO: 203363 - DNA, 20 bp, human
gaaagctaaaacaatatcga

SEQ ID NO: 203364 - DNA, 20 bp, human
gggaatttaaaattattcta

SEQ ID NO: 203365 - DNA, 20 bp, human
ggcttgagaaaatctgtgaa

SEQ ID NO: 203366 - DNA, 20 bp, human
gtcattcttttaccctattg

SEQ ID NO: 203367 - DNA, 20 bp, human
gatctaacatctgaaaatca

SEQ ID NO: 203368 - DNA, 20 bp, human
gggaggttggaagccatgag

SEQ ID NO: 203369 - DNA, 20 bp, human
gctaagtacttacctcaata

SEQ ID NO: 203370 - DNA, 20 bp, human
gagttcaggaatggtgaaag

SEQ ID NO: 203371 - DNA, 20 bp, human
gactgctttgaatatattgg

SEQ ID NO: 203372 - DNA, 20 bp, human
ggcttgagaaaatctgtgaa

SEQ ID NO: 203373 - DNA, 20 bp, human
gggaatttaaaattattcta

SEQ ID NO: 203374 - DNA, 20 bp, human
gaaagctaaaacaatatcga

SEQ ID NO: 203375 - DNA, 20 bp, human
gtgaactgctttgaatatat

SEQ ID NO: 203376 - DNA, 20 bp, human
gcaggcaacagtatagttaa

SEQ ID NO: 203377 - DNA, 20 bp, human
gtcctgagaaaacttaatgg

SEQ ID NO: 203378 - DNA, 20 bp, human
gacaatcctaagtctatttc

SEQ ID NO: 203379 - DNA, 20 bp, human
gttggaacacccaggcaggg

SEQ ID NO: 203380 - DNA, 20 bp, human
gcatttggaacacccaggca

SEQ ID NO: 203381 - DNA, 20 bp, human
gatgtaaaatccaccctgcc

SEQ ID NO: 203382 - DNA, 20 bp, human
gttaggattgtgattaatgc

SEQ ID NO: 203383 - DNA, 20 bp, human
gtgttgcctgaaatagactt

SEQ ID NO: 203384 - DNA, 20 bp, human
gttacaaaaaaagatatgag

SEQ ID NO: 203385 - DNA, 20 bp, human
ggggtgttccaaatgcaatc

SEQ ID NO: 203386 - DNA, 20 bp, human
gccaactggttttaaataag

SEQ ID NO: 203387 - DNA, 20 bp, human
gctggttttaaataaggggt

SEQ ID NO: 203388 - DNA, 20 bp, human
ggttttaaataaggggtggg

SEQ ID NO: 203389 - DNA, 20 bp, human
gtaaaaccagttggccctac

SEQ ID NO: 203390 - DNA, 20 bp, human
gtacagcacacagcctgtgg

SEQ ID NO: 203391 - DNA, 20 bp, human
ggcacacagcctgtggaggg

SEQ ID NO: 203392 - DNA, 20 bp, human
gtggttcctccaccctccac

SEQ ID NO: 203393 - DNA, 20 bp, human
gacatacagcacacagcctg

SEQ ID NO: 203394 - DNA, 20 bp, human
ggaggaaccaactgcaaggt

SEQ ID NO: 203395 - DNA, 20 bp, human
gggtggaggaaccaactgca

SEQ ID NO: 203396 - DNA, 20 bp, human
gcactctggcagctgaccgg

SEQ ID NO: 203397 - DNA, 20 bp, human
gggagcggtaaccttacccc

SEQ ID NO: 203398 - DNA, 20 bp, human
gggcagtctcggcctccagg

SEQ ID NO: 203399 - DNA, 20 bp, human
ggtgaggactggctagatgg

SEQ ID NO: 203400 - DNA, 20 bp, human
gctgtcccggcccgggtgag

SEQ ID NO: 203401 - DNA, 20 bp, human
gcagagtgtggcgctcccgg

SEQ ID NO: 203402 - DNA, 20 bp, human
gaccaagacgcgcctcctgg

SEQ ID NO: 203403 - DNA, 20 bp, human
gccgggtcgcaggccagccg

SEQ ID NO: 203404 - DNA, 20 bp, human
ggcgggacgcccgggaaacg

SEQ ID NO: 203405 - DNA, 20 bp, human
gcacgccgcgccgctctcct

SEQ ID NO: 203406 - DNA, 20 bp, human
gggatgcagcatcctagtgg

SEQ ID NO: 203407 - DNA, 20 bp, human
gacgggcgcactcaccacag

SEQ ID NO: 203408 - DNA, 20 bp, human
gggctaccggcgcggcgtag

SEQ ID NO: 203409 - DNA, 20 bp, human
gcacaggggcgtcctccact

SEQ ID NO: 203410 - DNA, 20 bp, human
gagtggatgcagcatcctag

SEQ ID NO: 203411 - DNA, 20 bp, human
ggggtctcatcggagcgata

SEQ ID NO: 203412 - DNA, 20 bp, human
gcgacccagggacggagggg

SEQ ID NO: 203413 - DNA, 20 bp, human
gcgtgccctcggctattcgg

SEQ ID NO: 203414 - DNA, 20 bp, human
gctgctgggacagaccgggg

SEQ ID NO: 203415 - DNA, 20 bp, human
gcggctgctgggacagaccg

SEQ ID NO: 203416 - DNA, 20 bp, human
ggaagacgagaccggagctc

SEQ ID NO: 203417 - DNA, 20 bp, human
gacacgcagctggaccggac

SEQ ID NO: 203418 - DNA, 20 bp, human
gtcacagagccacagagtct

SEQ ID NO: 203419 - DNA, 20 bp, human
gatgaacccgaccccaagtc

SEQ ID NO: 203420 - DNA, 20 bp, human
ggttcactcagacacgcagc

SEQ ID NO: 203421 - DNA, 20 bp, human
gtctctgggcggctctgcac

SEQ ID NO: 203422 - DNA, 20 bp, human
gtccctgcacaatctgggag

SEQ ID NO: 203423 - DNA, 20 bp, human
gctcagacacgcagctggac

SEQ ID NO: 203424 - DNA, 20 bp, human
gacagcagtgaagacgagac

SEQ ID NO: 203425 - DNA, 20 bp, human
gcctagaggcccagactctg

SEQ ID NO: 203426 - DNA, 20 bp, human
ggaccggaacccaaacgcag

SEQ ID NO: 203427 - DNA, 20 bp, human
gccactggagaagcggagac

SEQ ID NO: 203428 - DNA, 20 bp, human
gacacgggagggtcataagg

SEQ ID NO: 203429 - DNA, 20 bp, human
ggtacaaacaatctggagag

SEQ ID NO: 203430 - DNA, 20 bp, human
gacaggccggagagagccgt

SEQ ID NO: 203431 - DNA, 20 bp, human
gagcgcgccagacgctgcgg

SEQ ID NO: 203432 - DNA, 20 bp, human
gcgctgcggtggagccaccg

SEQ ID NO: 203433 - DNA, 20 bp, human
gtacggcccaacccaccctg

SEQ ID NO: 203434 - DNA, 20 bp, human
gctgcggccgaggggacaga

SEQ ID NO: 203435 - DNA, 20 bp, human
gtcctgcctacggctctctc

SEQ ID NO: 203436 - DNA, 20 bp, human
gcccggcacaggtagagggt

SEQ ID NO: 203437 - DNA, 20 bp, human
gcggcccccggcacaggtag

SEQ ID NO: 203438 - DNA, 20 bp, human
ggcgggcgcggtcattgtcc

SEQ ID NO: 203439 - DNA, 20 bp, human
gggcagtgcatatcatcctg

SEQ ID NO: 203440 - DNA, 20 bp, human
gggtggcctgtgtgagagac

SEQ ID NO: 203441 - DNA, 20 bp, human
gtcctggcagagcggcgagc

SEQ ID NO: 203442 - DNA, 20 bp, human
gacacgagggccatcctggg

SEQ ID NO: 203443 - DNA, 20 bp, human
gcggcgtgcaggcccaggta

SEQ ID NO: 203444 - DNA, 20 bp, human
gtgccgtcgggcgggcctag

SEQ ID NO: 203445 - DNA, 20 bp, human
gcacaggccaccttcccccc

SEQ ID NO: 203446 - DNA, 20 bp, human
gctgcgcgcggccgtcccca

SEQ ID NO: 203447 - DNA, 20 bp, human
gcgcggccgtccccagggag

SEQ ID NO: 203448 - DNA, 20 bp, human
gctcctaagccagctcgcag

SEQ ID NO: 203449 - DNA, 20 bp, human
ggaggcagggctgacgtgaa

SEQ ID NO: 203450 - DNA, 20 bp, human
gtctccggcatgagggaatg

SEQ ID NO: 203451 - DNA, 20 bp, human
gcagcagcagcccgggcggt

SEQ ID NO: 203452 - DNA, 20 bp, human
gggagccgcgcccggaccca

SEQ ID NO: 203453 - DNA, 20 bp, human
ggagaaagagaggagccgga

SEQ ID NO: 203454 - DNA, 20 bp, human
ggagggagagatggcgtctg

SEQ ID NO: 203455 - DNA, 20 bp, human
ggcgcgggggtgggtcgctg

SEQ ID NO: 203456 - DNA, 20 bp, human
gccaccgacggtctcaacga

SEQ ID NO: 203457 - DNA, 20 bp, human
ggtagctgcagcagcaggta

SEQ ID NO: 203458 - DNA, 20 bp, human
gggctctggcctagggaaag

SEQ ID NO: 203459 - DNA, 20 bp, human
gggcagctgtggatccctta

SEQ ID NO: 203460 - DNA, 20 bp, human
gccgaatgtgaggaccttaa

SEQ ID NO: 203461 - DNA, 20 bp, human
ggagccgtcgttgagaccgt

SEQ ID NO: 203462 - DNA, 20 bp, human
ggcggtcacagtccgactgg

SEQ ID NO: 203463 - DNA, 20 bp, human
gcgggggctggaggaattga

SEQ ID NO: 203464 - DNA, 20 bp, human
gactgtgaccgcgctctgga

SEQ ID NO: 203465 - DNA, 20 bp, human
gctcctgacgagaaactaga

SEQ ID NO: 203466 - DNA, 20 bp, human
ggcgcgccagacctgctctg

SEQ ID NO: 203467 - DNA, 20 bp, human
ggccccaggagcccagtcac

SEQ ID NO: 203468 - DNA, 20 bp, human
ggctgtcctcagagcaggtc

SEQ ID NO: 203469 - DNA, 20 bp, human
ggacagcctccccgcaatgg

SEQ ID NO: 203470 - DNA, 20 bp, human
gctggggccggtccagccac

SEQ ID NO: 203471 - DNA, 20 bp, human
ggaggacagcctccccgcaa

SEQ ID NO: 203472 - DNA, 20 bp, human
gctatctgggaatgactctg

SEQ ID NO: 203473 - DNA, 20 bp, human
gccaatgacgcccggtgact

SEQ ID NO: 203474 - DNA, 20 bp, human
gccgcagacaaagggcgctt

SEQ ID NO: 203475 - DNA, 20 bp, human
gggcgcgccggtggctggac

SEQ ID NO: 203476 - DNA, 20 bp, human
gctctgcgagcagaggacac

SEQ ID NO: 203477 - DNA, 20 bp, human
gctgacctggagtcctctca

SEQ ID NO: 203478 - DNA, 20 bp, human
ggagtcaggattctacccct

SEQ ID NO: 203479 - DNA, 20 bp, human
ggggagagacgcgccgctga

SEQ ID NO: 203480 - DNA, 20 bp, human
ggtttatgaatgggtccgtg

SEQ ID NO: 203481 - DNA, 20 bp, human
gggggcgggttgtaagcggt

SEQ ID NO: 203482 - DNA, 20 bp, human
gggaaggggcgggttgtaag

SEQ ID NO: 203483 - DNA, 20 bp, human
gtctaggcttccggggtacc

SEQ ID NO: 203484 - DNA, 20 bp, human
gctcttctgttgaaaatgta

SEQ ID NO: 203485 - DNA, 20 bp, human
gcttttccctgcgcagtgac

SEQ ID NO: 203486 - DNA, 20 bp, human
gggacgcttccgtaaggtta

SEQ ID NO: 203487 - DNA, 20 bp, human
gagggaagaatccagactta

SEQ ID NO: 203488 - DNA, 20 bp, human
gagggtgcaggattcgtgag

SEQ ID NO: 203489 - DNA, 20 bp, human
gcagcatcttaacgctcgag

SEQ ID NO: 203490 - DNA, 20 bp, human
ggagcgttaagatgctgcct

SEQ ID NO: 203491 - DNA, 20 bp, human
gaaaagaacccgtaacctta

SEQ ID NO: 203492 - DNA, 20 bp, human
gtaaatctgcgaatacttgc

SEQ ID NO: 203493 - DNA, 20 bp, human
gacccagactgtgcagggat

SEQ ID NO: 203494 - DNA, 20 bp, human
gtcccatccctgcacagtct

SEQ ID NO: 203495 - DNA, 20 bp, human
gtaagagccgagctgggaca

SEQ ID NO: 203496 - DNA, 20 bp, human
gttgtagctgggccagcctg

SEQ ID NO: 203497 - DNA, 20 bp, human
ggaggaacccgtgggcccgg

SEQ ID NO: 203498 - DNA, 20 bp, human
gacgcccagtttaagactcg

SEQ ID NO: 203499 - DNA, 20 bp, human
gtgcgcctcgagtcttaaac

SEQ ID NO: 203500 - DNA, 20 bp, human
gccgggatcccccgggccca

SEQ ID NO: 203501 - DNA, 20 bp, human
ggaagtgcaggtgcaggccg

SEQ ID NO: 203502 - DNA, 20 bp, human
ggcgtctgctcccacaactg

SEQ ID NO: 203503 - DNA, 20 bp, human
gtgcaggccgcggaccctgg

SEQ ID NO: 203504 - DNA, 20 bp, human
gaggtgcaggccgcggaccc

SEQ ID NO: 203505 - DNA, 20 bp, human
ggaccagtgttccccagttg

SEQ ID NO: 203506 - DNA, 20 bp, human
gaagataagataagatatac

SEQ ID NO: 203507 - DNA, 20 bp, human
gttatgtaaattaagggttg

SEQ ID NO: 203508 - DNA, 20 bp, human
gacattcttcacatgtgtag

SEQ ID NO: 203509 - DNA, 20 bp, human
gatgtggtaaaggctttact

SEQ ID NO: 203510 - DNA, 20 bp, human
gctgggtagttaataagcat

SEQ ID NO: 203511 - DNA, 20 bp, human
gagaattgaggaccaattaa

SEQ ID NO: 203512 - DNA, 20 bp, human
gattctcttatgtaaattaa

SEQ ID NO: 203513 - DNA, 20 bp, human
gcctacatatgtgaaaaatg

SEQ ID NO: 203514 - DNA, 20 bp, human
ggattgaattgtttttttct

SEQ ID NO: 203515 - DNA, 20 bp, human
gagtgtgaagaatgtggtaa

SEQ ID NO: 203516 - DNA, 20 bp, human
gcaaaaggacatgagaaacg

SEQ ID NO: 203517 - DNA, 20 bp, human
gtccttttggtataagtttg

SEQ ID NO: 203518 - DNA, 20 bp, human
gaagataagataagatatac

SEQ ID NO: 203519 - DNA, 20 bp, human
gcaaaacctttggacagtgc

SEQ ID NO: 203520 - DNA, 20 bp, human
gatgtggtaaaggctttact

SEQ ID NO: 203521 - DNA, 20 bp, human
gtccacaaacttataccaaa

SEQ ID NO: 203522 - DNA, 20 bp, human
gacattcttcacatgtgtag

SEQ ID NO: 203523 - DNA, 20 bp, human
gtatgccctgcactgtccaa

SEQ ID NO: 203524 - DNA, 20 bp, human
gagaattgaggaccaattaa

SEQ ID NO: 203525 - DNA, 20 bp, human
gagtgtgaagaatgtggtaa

SEQ ID NO: 203526 - DNA, 20 bp, human
gccgaggcttccctaaggag

SEQ ID NO: 203527 - DNA, 20 bp, human
ggagcgggagcagagcgatg

SEQ ID NO: 203528 - DNA, 20 bp, human
gaatcaccgaggcttcccta

SEQ ID NO: 203529 - DNA, 20 bp, human
ggctcatccggaagacaccg

SEQ ID NO: 203530 - DNA, 20 bp, human
ggccctaaccgagctctggc

SEQ ID NO: 203531 - DNA, 20 bp, human
gggtagccctgcactttccc

SEQ ID NO: 203532 - DNA, 20 bp, human
gggtgggaggagtctgtgaa

SEQ ID NO: 203533 - DNA, 20 bp, human
gaggccgccgcggtgtcttc

SEQ ID NO: 203534 - DNA, 20 bp, human
gcgctctgctcccgctcctt

SEQ ID NO: 203535 - DNA, 20 bp, human
gtcccacgccggcaccgcgc

SEQ ID NO: 203536 - DNA, 20 bp, human
ggagctcagtctcttcacca

SEQ ID NO: 203537 - DNA, 20 bp, human
gggctgcggcgacccaaaga

SEQ ID NO: 203538 - DNA, 20 bp, human
gccttggcctcccagatgga

SEQ ID NO: 203539 - DNA, 20 bp, human
ggccggtcacagagtaacag

SEQ ID NO: 203540 - DNA, 20 bp, human
gcccagtccttccatctggg

SEQ ID NO: 203541 - DNA, 20 bp, human
gacggctccggccatggcag

SEQ ID NO: 203542 - DNA, 20 bp, human
gttgtgcggtgagaacgtga

SEQ ID NO: 203543 - DNA, 20 bp, human
ggagcgacctctgccatggc

SEQ ID NO: 203544 - DNA, 20 bp, human
gttgcggcggaggggaccaa

SEQ ID NO: 203545 - DNA, 20 bp, human
gggcgacccaaagacggctc

SEQ ID NO: 203546 - DNA, 20 bp, human
gtccctgcttccacacctca

SEQ ID NO: 203547 - DNA, 20 bp, human
gatcgggaagacgccaggtg

SEQ ID NO: 203548 - DNA, 20 bp, human
gcagaaccggcggcaaatgg

SEQ ID NO: 203549 - DNA, 20 bp, human
gaggctgaagcaacaggcca

SEQ ID NO: 203550 - DNA, 20 bp, human
gtaccgcgtaggaggagctg

SEQ ID NO: 203551 - DNA, 20 bp, human
gcggcatccgggatcttcgg

SEQ ID NO: 203552 - DNA, 20 bp, human
gtgttgcttcagcctgagct

SEQ ID NO: 203553 - DNA, 20 bp, human
gaggcgcgcagtctgagagg

SEQ ID NO: 203554 - DNA, 20 bp, human
ggggcggcatccgggatctt

SEQ ID NO: 203555 - DNA, 20 bp, human
gcgcgcagtctgagaggagg

SEQ ID NO: 203556 - DNA, 20 bp, human
gcgccgggaagacggcccca

SEQ ID NO: 203557 - DNA, 20 bp, human
gacctcggacatacgaacag

SEQ ID NO: 203558 - DNA, 20 bp, human
ggcggtgttcccggctccgt

SEQ ID NO: 203559 - DNA, 20 bp, human
gcggacatacgaacagcggg

SEQ ID NO: 203560 - DNA, 20 bp, human
gccgtgggcggcgaccgtcg

SEQ ID NO: 203561 - DNA, 20 bp, human
gcgcggactcgccgggaaga

SEQ ID NO: 203562 - DNA, 20 bp, human
gctccgtggggccgtcttcc

SEQ ID NO: 203563 - DNA, 20 bp, human
gccgaggtgacgccccgctg

SEQ ID NO: 203564 - DNA, 20 bp, human
gcctcgtacctcgccgtggg

SEQ ID NO: 203565 - DNA, 20 bp, human
gaaacctcgtacctcgccgt

SEQ ID NO: 203566 - DNA, 20 bp, human
ggaccatgggaggaacgtca

SEQ ID NO: 203567 - DNA, 20 bp, human
gcagaagacacagagtagtg

SEQ ID NO: 203568 - DNA, 20 bp, human
ggccgagctgggcaacaact

SEQ ID NO: 203569 - DNA, 20 bp, human
ggtgaagagacagaacgccc

SEQ ID NO: 203570 - DNA, 20 bp, human
gtgtaaaactgacagcgagg

SEQ ID NO: 203571 - DNA, 20 bp, human
ggattgtaaaactgacagcg

SEQ ID NO: 203572 - DNA, 20 bp, human
gctttgtctctatctgcggc

SEQ ID NO: 203573 - DNA, 20 bp, human
gtttggtccgtggggttttc

SEQ ID NO: 203574 - DNA, 20 bp, human
gatttaatgtttttgcagtg

SEQ ID NO: 203575 - DNA, 20 bp, human
ggggcctttgtctctatctg

SEQ ID NO: 203576 - DNA, 20 bp, human
gcaccgaggagctaatggag

SEQ ID NO: 203577 - DNA, 20 bp, human
gggagtcaccgaggagctaa

SEQ ID NO: 203578 - DNA, 20 bp, human
ggagatggaatagtacagac

SEQ ID NO: 203579 - DNA, 20 bp, human
gagcagctccgagtccccgt

SEQ ID NO: 203580 - DNA, 20 bp, human
gtctgcgacggagggaagtg

SEQ ID NO: 203581 - DNA, 20 bp, human
gggctatggtggagtcaccg

SEQ ID NO: 203582 - DNA, 20 bp, human
gaagaaggcggaacatccgg

SEQ ID NO: 203583 - DNA, 20 bp, human
gaggataacaggggctatgg

SEQ ID NO: 203584 - DNA, 20 bp, human
ggctaatggagcggaagaga

SEQ ID NO: 203585 - DNA, 20 bp, human
gagctgcccaaaaagtctct

SEQ ID NO: 203586 - DNA, 20 bp, human
gtcgctgcacgcggaggtca

SEQ ID NO: 203587 - DNA, 20 bp, human
gcgggatgtggtaggaccgt

SEQ ID NO: 203588 - DNA, 20 bp, human
gagcatgggagggtcgtcac

SEQ ID NO: 203589 - DNA, 20 bp, human
gtggctctcgctgcacgcgg

SEQ ID NO: 203590 - DNA, 20 bp, human
ggaatcctgactcggcgtgt

SEQ ID NO: 203591 - DNA, 20 bp, human
ggtgtgtcgtccgctcctaa

SEQ ID NO: 203592 - DNA, 20 bp, human
ggtcacagggccatagaagc

SEQ ID NO: 203593 - DNA, 20 bp, human
gtcccaccggttccaaccag

SEQ ID NO: 203594 - DNA, 20 bp, human
gcagcggctgccactctctc

SEQ ID NO: 203595 - DNA, 20 bp, human
ggagagtggcagccgctggt

SEQ ID NO: 203596 - DNA, 20 bp, human
gaaggcgagaccgggaactg

SEQ ID NO: 203597 - DNA, 20 bp, human
gtccaatgccgcaggttaca

SEQ ID NO: 203598 - DNA, 20 bp, human
ggcacctggcatgttagctg

SEQ ID NO: 203599 - DNA, 20 bp, human
gcgagatgggaaagaactcc

SEQ ID NO: 203600 - DNA, 20 bp, human
ggccctgtaacctgcggcat

SEQ ID NO: 203601 - DNA, 20 bp, human
gaaaggcggcatccgagatg

SEQ ID NO: 203602 - DNA, 20 bp, human
gctaacatgccaggtgcccc

SEQ ID NO: 203603 - DNA, 20 bp, human
gtggttgcagccgcagttcc

SEQ ID NO: 203604 - DNA, 20 bp, human
gcaacggccccgccacatct

SEQ ID NO: 203605 - DNA, 20 bp, human
gtcggagagacgcggccatg

SEQ ID NO: 203606 - DNA, 20 bp, human
gacgaaaattggagcttcgg

SEQ ID NO: 203607 - DNA, 20 bp, human
gaaccagagaggatcgtcag

SEQ ID NO: 203608 - DNA, 20 bp, human
gcagcgcggccgccatcgta

SEQ ID NO: 203609 - DNA, 20 bp, human
gtgtgtggccctgcgacctg

SEQ ID NO: 203610 - DNA, 20 bp, human
gctcctctgacgatcctctc

SEQ ID NO: 203611 - DNA, 20 bp, human
gcagacgaaaattggagctt

SEQ ID NO: 203612 - DNA, 20 bp, human
gaaagcagacagacgaaaat

SEQ ID NO: 203613 - DNA, 20 bp, human
gcccataaatttttaacaga

SEQ ID NO: 203614 - DNA, 20 bp, human
gcgagctgggcaagaactct

SEQ ID NO: 203615 - DNA, 20 bp, human
ggctgggcttctacgtgcag

SEQ ID NO: 203616 - DNA, 20 bp, human
ggccgtgctttcacccctca

SEQ ID NO: 203617 - DNA, 20 bp, human
gtccctgaggggtgaaagca

SEQ ID NO: 203618 - DNA, 20 bp, human
gtcacccctcagggaggcgt

SEQ ID NO: 203619 - DNA, 20 bp, human
gaggggtgaaagcacggccg

SEQ ID NO: 203620 - DNA, 20 bp, human
gcgccagcgtgagctcggtt

SEQ ID NO: 203621 - DNA, 20 bp, human
gcagggaggcgtcggtgatt

SEQ ID NO: 203622 - DNA, 20 bp, human
gggaagggaccaaggactga

SEQ ID NO: 203623 - DNA, 20 bp, human
ggagctcacgctggcgcaaa

SEQ ID NO: 203624 - DNA, 20 bp, human
gaccctaaccgagctcacgc

SEQ ID NO: 203625 - DNA, 20 bp, human
gaaagtagggactcgacgac

SEQ ID NO: 203626 - DNA, 20 bp, human
gggattgggaaagttatcag

SEQ ID NO: 203627 - DNA, 20 bp, human
gtaacagccgaactgggcca

SEQ ID NO: 203628 - DNA, 20 bp, human
gccaggcaccatcttagggc

SEQ ID NO: 203629 - DNA, 20 bp, human
gtttccttttagagatgtgt

SEQ ID NO: 203630 - DNA, 20 bp, human
ggggggctaacagccgaact

SEQ ID NO: 203631 - DNA, 20 bp, human
gtccagattgtacagggatt

SEQ ID NO: 203632 - DNA, 20 bp, human
ggaatcctgcaccctgtgtc

SEQ ID NO: 203633 - DNA, 20 bp, human
ggcaccatcttagggctgga

SEQ ID NO: 203634 - DNA, 20 bp, human
gtctgcagtggctttgccct

SEQ ID NO: 203635 - DNA, 20 bp, human
gagctgactgcgaggaagta

SEQ ID NO: 203636 - DNA, 20 bp, human
gcgaggaactccaggaacgg

SEQ ID NO: 203637 - DNA, 20 bp, human
gtctggaggagggagactcg

SEQ ID NO: 203638 - DNA, 20 bp, human
gcaccgaggaactccaggaa

SEQ ID NO: 203639 - DNA, 20 bp, human
gggagggagactcgaggttg

SEQ ID NO: 203640 - DNA, 20 bp, human
gccagctcagatcccttcct

SEQ ID NO: 203641 - DNA, 20 bp, human
gagagtcaccgaggaactcc

SEQ ID NO: 203642 - DNA, 20 bp, human
gccccacacaatctggagga

SEQ ID NO: 203643 - DNA, 20 bp, human
ggcgaactaggatcagagcc

SEQ ID NO: 203644 - DNA, 20 bp, human
gaggacggcggaacatctgg

SEQ ID NO: 203645 - DNA, 20 bp, human
gggcggcctcttcaatatgg

SEQ ID NO: 203646 - DNA, 20 bp, human
gaccagggagctcccatcat

SEQ ID NO: 203647 - DNA, 20 bp, human
gagaggggcggagtccaaac

SEQ ID NO: 203648 - DNA, 20 bp, human
gctcccaggatgtacggtga

SEQ ID NO: 203649 - DNA, 20 bp, human
ggggagggtaaacctaacta

SEQ ID NO: 203650 - DNA, 20 bp, human
gcagctctagacgcgcagag

SEQ ID NO: 203651 - DNA, 20 bp, human
ggccaccaacgggctacgag

SEQ ID NO: 203652 - DNA, 20 bp, human
gaccgctcgtagcccgttgg

SEQ ID NO: 203653 - DNA, 20 bp, human
gtagtgcagcccctcagtaa

SEQ ID NO: 203654 - DNA, 20 bp, human
ggtgcaaagataccagagac

SEQ ID NO: 203655 - DNA, 20 bp, human
gggtgcagctaatggcccgt

SEQ ID NO: 203656 - DNA, 20 bp, human
gcactacgcagggaagacac

SEQ ID NO: 203657 - DNA, 20 bp, human
gtcccctgacgaccctctgg

SEQ ID NO: 203658 - DNA, 20 bp, human
gggaccaccagagggtcgtc

SEQ ID NO: 203659 - DNA, 20 bp, human
gctgcacattctgggagaga

SEQ ID NO: 203660 - DNA, 20 bp, human
gtaagacgcccgggagcccc

SEQ ID NO: 203661 - DNA, 20 bp, human
gggaagacacaggacgccag

SEQ ID NO: 203662 - DNA, 20 bp, human
gcagcgtagccgccaaatta

SEQ ID NO: 203663 - DNA, 20 bp, human
gccctgcgtagtgactgctc

SEQ ID NO: 203664 - DNA, 20 bp, human
ggagagggggataggctggt

SEQ ID NO: 203665 - DNA, 20 bp, human
gtggtggtccctgcacattc

SEQ ID NO: 203666 - DNA, 20 bp, human
gcagaccggactcccacaaa

SEQ ID NO: 203667 - DNA, 20 bp, human
gtgccggtccctcagaccgt

SEQ ID NO: 203668 - DNA, 20 bp, human
gtcggacgcggagcgaccag

SEQ ID NO: 203669 - DNA, 20 bp, human
gcagcggacaggtcccgaag

SEQ ID NO: 203670 - DNA, 20 bp, human
gagcggacagagaccgccga

SEQ ID NO: 203671 - DNA, 20 bp, human
ggcagtcgcagtccttttgt

SEQ ID NO: 203672 - DNA, 20 bp, human
gctgcccactcctcctgggg

SEQ ID NO: 203673 - DNA, 20 bp, human
gccccggagcccgagaagac

SEQ ID NO: 203674 - DNA, 20 bp, human
gcggtccctcagaccgtcgg

SEQ ID NO: 203675 - DNA, 20 bp, human
gggtctgagggaccggcaag

SEQ ID NO: 203676 - DNA, 20 bp, human
gcttgcctcggtcccggtgg

SEQ ID NO: 203677 - DNA, 20 bp, human
ggcagccgcggcggtggggt

SEQ ID NO: 203678 - DNA, 20 bp, human
ggttggtgcagcgggtgcag

SEQ ID NO: 203679 - DNA, 20 bp, human
gcgcgcttctcggcactctc

SEQ ID NO: 203680 - DNA, 20 bp, human
ggctgcccccaccgggaccg

SEQ ID NO: 203681 - DNA, 20 bp, human
gcaccaaccgggagcagagc

SEQ ID NO: 203682 - DNA, 20 bp, human
gcgggagagggctctcggag

SEQ ID NO: 203683 - DNA, 20 bp, human
gcctgccaaccccaccgccg

SEQ ID NO: 203684 - DNA, 20 bp, human
gcttcccgcgcggcacccca

SEQ ID NO: 203685 - DNA, 20 bp, human
gaggcaggcgaagcccggcg

SEQ ID NO: 203686 - DNA, 20 bp, human
gagcctgagaggcgaacggc

SEQ ID NO: 203687 - DNA, 20 bp, human
gggcagccagcgaggagcgg

SEQ ID NO: 203688 - DNA, 20 bp, human
gctctgccgccgctcctcgc

SEQ ID NO: 203689 - DNA, 20 bp, human
gcgacgggcgcagtaggccc

SEQ ID NO: 203690 - DNA, 20 bp, human
gacggaggcggcgcgactgc

SEQ ID NO: 203691 - DNA, 20 bp, human
gcggcagacgaaggcccgtg

SEQ ID NO: 203692 - DNA, 20 bp, human
ggctcgggttcggctcggag

SEQ ID NO: 203693 - DNA, 20 bp, human
gggcccaaagaacttggcgt

SEQ ID NO: 203694 - DNA, 20 bp, human
gcacggcgccgcaggccctg

SEQ ID NO: 203695 - DNA, 20 bp, human
gtggaccggccgggcgctga

SEQ ID NO: 203696 - DNA, 20 bp, human
gccccgaaggcccactagag

SEQ ID NO: 203697 - DNA, 20 bp, human
gtagaggggatggaaactaa

SEQ ID NO: 203698 - DNA, 20 bp, human
ggcgagtccatggtcagaac

SEQ ID NO: 203699 - DNA, 20 bp, human
ggccgatggctgcgagtcca

SEQ ID NO: 203700 - DNA, 20 bp, human
gcgcaggggcaaaggtcgag

SEQ ID NO: 203701 - DNA, 20 bp, human
gtccgagtggagaaagcccg

SEQ ID NO: 203702 - DNA, 20 bp, human
gcgtgggtacaattgcgcag

SEQ ID NO: 203703 - DNA, 20 bp, human
gacgtcagtagagcccccga

SEQ ID NO: 203704 - DNA, 20 bp, human
ggggccggggaagtgttctc

SEQ ID NO: 203705 - DNA, 20 bp, human
gaaacggggcgggatccgag

SEQ ID NO: 203706 - DNA, 20 bp, human
ggcgttagcatggctaccta

SEQ ID NO: 203707 - DNA, 20 bp, human
gcatgctaacgcaaccatga

SEQ ID NO: 203708 - DNA, 20 bp, human
gggaggcactgcagaacggg

SEQ ID NO: 203709 - DNA, 20 bp, human
gctgggactgcggtgcgatg

SEQ ID NO: 203710 - DNA, 20 bp, human
gaatcagtgaacagatccct

SEQ ID NO: 203711 - DNA, 20 bp, human
gggactgcggtgcgatgagg

SEQ ID NO: 203712 - DNA, 20 bp, human
gctgcggtgcgatgaggcgg

SEQ ID NO: 203713 - DNA, 20 bp, human
ggtcacctggacgctgacgg

SEQ ID NO: 203714 - DNA, 20 bp, human
gagtcccgacccagagctct

SEQ ID NO: 203715 - DNA, 20 bp, human
gggagaccgacacgtctctg

SEQ ID NO: 203716 - DNA, 20 bp, human
gcagccaccggcaccaagac

SEQ ID NO: 203717 - DNA, 20 bp, human
gaatagtgagtacttaccag

SEQ ID NO: 203718 - DNA, 20 bp, human
gatgtggccggtcttggtgc

SEQ ID NO: 203719 - DNA, 20 bp, human
gtaaatgctaacaagaggta

SEQ ID NO: 203720 - DNA, 20 bp, human
gtggccggtcttggtgccgg

SEQ ID NO: 203721 - DNA, 20 bp, human
gtgggctccgaggattactc

SEQ ID NO: 203722 - DNA, 20 bp, human
ggctgggatgtggccggtct

SEQ ID NO: 203723 - DNA, 20 bp, human
gtggagcctgctgttccagt

SEQ ID NO: 203724 - DNA, 20 bp, human
gcacgcttgctgggtgaaac

SEQ ID NO: 203725 - DNA, 20 bp, human
ggtagtttgtttttgaggtt

SEQ ID NO: 203726 - DNA, 20 bp, human
gctgcgacaggcgtgcccgt

SEQ ID NO: 203727 - DNA, 20 bp, human
gctggctctgtacctggaca

SEQ ID NO: 203728 - DNA, 20 bp, human
gccgaaaggccgccgatctg

SEQ ID NO: 203729 - DNA, 20 bp, human
ggctgcggtaggccagcggt

SEQ ID NO: 203730 - DNA, 20 bp, human
ggcctaccgcagccctgtcc

SEQ ID NO: 203731 - DNA, 20 bp, human
ggcacgcctgtcgcagacac

SEQ ID NO: 203732 - DNA, 20 bp, human
ggcggttgcgctcctcagat

SEQ ID NO: 203733 - DNA, 20 bp, human
gtccagggtcgaagccatag

SEQ ID NO: 203734 - DNA, 20 bp, human
gcagggctgcggtaggccag

SEQ ID NO: 203735 - DNA, 20 bp, human
gcagccacgcagaacagacg

SEQ ID NO: 203736 - DNA, 20 bp, human
gtcctgtgagagggaaacta

SEQ ID NO: 203737 - DNA, 20 bp, human
gcagcttaggaccaacgtta

SEQ ID NO: 203738 - DNA, 20 bp, human
ggcgggagcagcaggagttc

SEQ ID NO: 203739 - DNA, 20 bp, human
gaggccgccaagctagacct

SEQ ID NO: 203740 - DNA, 20 bp, human
gcaggccagacgccacagtc

SEQ ID NO: 203741 - DNA, 20 bp, human
gggaaacgcagccctaacgt

SEQ ID NO: 203742 - DNA, 20 bp, human
gttctaccaggacctccggg

SEQ ID NO: 203743 - DNA, 20 bp, human
ggctgctcccgcccgaccca

SEQ ID NO: 203744 - DNA, 20 bp, human
gctttctgcgtgtggaccgg

SEQ ID NO: 203745 - DNA, 20 bp, human
gaagtcctagcacggaagtt

SEQ ID NO: 203746 - DNA, 20 bp, human
ggccgcaaggcggaaaagag

SEQ ID NO: 203747 - DNA, 20 bp, human
ggacctcaccaggtaaccgt

SEQ ID NO: 203748 - DNA, 20 bp, human
gaactgagggagtcactggt

SEQ ID NO: 203749 - DNA, 20 bp, human
gcggccaggccgccctgcta

SEQ ID NO: 203750 - DNA, 20 bp, human
gaccgttggttattattcat

SEQ ID NO: 203751 - DNA, 20 bp, human
ggccaatgaataataaccaa

SEQ ID NO: 203752 - DNA, 20 bp, human
ggtgaggtcttggggtcagt

SEQ ID NO: 203753 - DNA, 20 bp, human
gtatggcgcaggcgggttgt

SEQ ID NO: 203754 - DNA, 20 bp, human
gaaccaacggttacctggtg

SEQ ID NO: 203755 - DNA, 20 bp, human
gccggtgcatggcggtctgt

SEQ ID NO: 203756 - DNA, 20 bp, human
ggcagacttaatacaagaca

SEQ ID NO: 203757 - DNA, 20 bp, human
gcgacagcaccttaaggcaa

SEQ ID NO: 203758 - DNA, 20 bp, human
gcacaaggagggaggtgaag

SEQ ID NO: 203759 - DNA, 20 bp, human
gcgctgccccagtcccggaa

SEQ ID NO: 203760 - DNA, 20 bp, human
gagcaccttaaggcaagggt

SEQ ID NO: 203761 - DNA, 20 bp, human
gctcgtgagaggccgtgggt

SEQ ID NO: 203762 - DNA, 20 bp, human
gaggcgagaatccacctctc

SEQ ID NO: 203763 - DNA, 20 bp, human
gcgacctcgtgagaggccgt

SEQ ID NO: 203764 - DNA, 20 bp, human
gattgagacgacctcgtgag

SEQ ID NO: 203765 - DNA, 20 bp, human
gcgaaacccgtggagcagca

SEQ ID NO: 203766 - DNA, 20 bp, human
gccgcgcagcgaggaaggtg

SEQ ID NO: 203767 - DNA, 20 bp, human
ggcgacagaagcctgggtac

SEQ ID NO: 203768 - DNA, 20 bp, human
gcggtcagaccagcccgaga

SEQ ID NO: 203769 - DNA, 20 bp, human
ggaccagcccgagagggacc

SEQ ID NO: 203770 - DNA, 20 bp, human
gttgtgcggaagcaacggga

SEQ ID NO: 203771 - DNA, 20 bp, human
gttcctcgctgcgcgggcgg

SEQ ID NO: 203772 - DNA, 20 bp, human
ggcgggcggcggttggtaac

SEQ ID NO: 203773 - DNA, 20 bp, human
gcagattgtgcggaagcaac

SEQ ID NO: 203774 - DNA, 20 bp, human
gcagttcatccggaaatgga

SEQ ID NO: 203775 - DNA, 20 bp, human
gagggccgaactgctcaagg

SEQ ID NO: 203776 - DNA, 20 bp, human
gtagagggcgtggaaactaa

SEQ ID NO: 203777 - DNA, 20 bp, human
gcccccgagggcgcactaga

SEQ ID NO: 203778 - DNA, 20 bp, human
gaggttactagggcccccga

SEQ ID NO: 203779 - DNA, 20 bp, human
gggaaggagggaggttacta

SEQ ID NO: 203780 - DNA, 20 bp, human
ggagggcgcactagagggcg

SEQ ID NO: 203781 - DNA, 20 bp, human
gattatacacccgctgccat

SEQ ID NO: 203782 - DNA, 20 bp, human
gtggaaactaacggtgccga

SEQ ID NO: 203783 - DNA, 20 bp, human
gcttcttccctaggaatcgg

SEQ ID NO: 203784 - DNA, 20 bp, human
ggagctgcgcgtgaagttgg

SEQ ID NO: 203785 - DNA, 20 bp, human
gatgccctcataaaaaatgg

SEQ ID NO: 203786 - DNA, 20 bp, human
gacagagcgaaactcacccg

SEQ ID NO: 203787 - DNA, 20 bp, human
ggagcgaaactcacccgcgg

SEQ ID NO: 203788 - DNA, 20 bp, human
gtgccaacgagggcgagact

SEQ ID NO: 203789 - DNA, 20 bp, human
gcaacgagggcgagactggg

SEQ ID NO: 203790 - DNA, 20 bp, human
gtgcgtccagctgccaacga

SEQ ID NO: 203791 - DNA, 20 bp, human
gactgggaggcgctcaggga

SEQ ID NO: 203792 - DNA, 20 bp, human
gagaggacgcggcctccttg

SEQ ID NO: 203793 - DNA, 20 bp, human
gagtgactatcccaccgccg

SEQ ID NO: 203794 - DNA, 20 bp, human
ggaaactcacccgcggcggt

SEQ ID NO: 203795 - DNA, 20 bp, human
ggcagctggacgcagcgcgg

SEQ ID NO: 203796 - DNA, 20 bp, human
gtggagtgaaggtccctcag

SEQ ID NO: 203797 - DNA, 20 bp, human
ggagcagacttcatacaaga

SEQ ID NO: 203798 - DNA, 20 bp, human
gcgtcgcagctccggtcccg

SEQ ID NO: 203799 - DNA, 20 bp, human
ggctcagacgcgcgcaaacc

SEQ ID NO: 203800 - DNA, 20 bp, human
gctgcgacgctgcgctctag

SEQ ID NO: 203801 - DNA, 20 bp, human
ggaaactcacgcgccgctga

SEQ ID NO: 203802 - DNA, 20 bp, human
gcgtccccgtgagagcccgg

SEQ ID NO: 203803 - DNA, 20 bp, human
gcgagttctctgcctgtcct

SEQ ID NO: 203804 - DNA, 20 bp, human
gatagcagaaagatccggaa

SEQ ID NO: 203805 - DNA, 20 bp, human
ggagcgcagcgtcgcagctc

SEQ ID NO: 203806 - DNA, 20 bp, human
gggcccaaggaggactacgg

SEQ ID NO: 203807 - DNA, 20 bp, human
gctgcagacccggaagtgga

SEQ ID NO: 203808 - DNA, 20 bp, human
gtggagatatggcgcaactg

SEQ ID NO: 203809 - DNA, 20 bp, human
gaacggcccaaggaggacta

SEQ ID NO: 203810 - DNA, 20 bp, human
gcccgggtacagaagcgtga

SEQ ID NO: 203811 - DNA, 20 bp, human
gagtggatggcgtggagata

SEQ ID NO: 203812 - DNA, 20 bp, human
gggacgcggcccctcccgaa

SEQ ID NO: 203813 - DNA, 20 bp, human
gggagacagaaccagcccta

SEQ ID NO: 203814 - DNA, 20 bp, human
ggaacacttaatctaaacaa

SEQ ID NO: 203815 - DNA, 20 bp, human
gccaggggccgacaaggacg

SEQ ID NO: 203816 - DNA, 20 bp, human
gcgccgcccaggggactcgg

SEQ ID NO: 203817 - DNA, 20 bp, human
gtcaagacgtccggcctcgg

SEQ ID NO: 203818 - DNA, 20 bp, human
gggcgcggggtcaagacgtc

SEQ ID NO: 203819 - DNA, 20 bp, human
ggccagcgaccctgcatgtg

SEQ ID NO: 203820 - DNA, 20 bp, human
gcgaaatgaggagccccgaa

SEQ ID NO: 203821 - DNA, 20 bp, human
ggcaagtccactcctcggac

SEQ ID NO: 203822 - DNA, 20 bp, human
ggacacctgggactcgaagg

SEQ ID NO: 203823 - DNA, 20 bp, human
gacctctgaggtacccttcg

SEQ ID NO: 203824 - DNA, 20 bp, human
gagcgaccctgcatgtgagg

SEQ ID NO: 203825 - DNA, 20 bp, human
ggtgtcttgggtcagctgag

SEQ ID NO: 203826 - DNA, 20 bp, human
gccccgaaggcccactagag

SEQ ID NO: 203827 - DNA, 20 bp, human
gtagaggggatggaaactaa

SEQ ID NO: 203828 - DNA, 20 bp, human
ggcgagtccatggtcagaac

SEQ ID NO: 203829 - DNA, 20 bp, human
ggccgatggctgcgagtcca

SEQ ID NO: 203830 - DNA, 20 bp, human
gcgcaggggcaaaggtcgag

SEQ ID NO: 203831 - DNA, 20 bp, human
gtccgagtggagaaagcccg

SEQ ID NO: 203832 - DNA, 20 bp, human
gcgtgggtacaattgcgcag

SEQ ID NO: 203833 - DNA, 20 bp, human
gacgtcagtagagcccccga

SEQ ID NO: 203834 - DNA, 20 bp, human
ggatggaaactaagggccga

SEQ ID NO: 203835 - DNA, 20 bp, human
gaaacggggcgggatccgag

SEQ ID NO: 203836 - DNA, 20 bp, human
gcacctgagccgctcggggt

SEQ ID NO: 203837 - DNA, 20 bp, human
gcttccccgcctaccccgag

SEQ ID NO: 203838 - DNA, 20 bp, human
gagaggtttaaggggcacag

SEQ ID NO: 203839 - DNA, 20 bp, human
gcaggacacctgagccgctc

SEQ ID NO: 203840 - DNA, 20 bp, human
gcgccccgcggtccagcgac

SEQ ID NO: 203841 - DNA, 20 bp, human
gggaagcgcgcaaggcagag

SEQ ID NO: 203842 - DNA, 20 bp, human
gcaatttaagtggacagtag

SEQ ID NO: 203843 - DNA, 20 bp, human
gggaagggagtcaggctcaa

SEQ ID NO: 203844 - DNA, 20 bp, human
gcagtttgcgggaacagaca

SEQ ID NO: 203845 - DNA, 20 bp, human
gtggacagtagaggtttaag

SEQ ID NO: 203846 - DNA, 20 bp, human
gtcaggcccaggtgccgcga

SEQ ID NO: 203847 - DNA, 20 bp, human
gcccgggaggcacgcacctc

SEQ ID NO: 203848 - DNA, 20 bp, human
gtgagacgcactcaataggt

SEQ ID NO: 203849 - DNA, 20 bp, human
gcgccaggaaaggaagggta

SEQ ID NO: 203850 - DNA, 20 bp, human
gcctggggacccaagaacgg

SEQ ID NO: 203851 - DNA, 20 bp, human
ggcgcgcacgtccgcagggc

SEQ ID NO: 203852 - DNA, 20 bp, human
gcgctgccttcgcggcacct

SEQ ID NO: 203853 - DNA, 20 bp, human
gcgtgcgcgcgctgccttcg

SEQ ID NO: 203854 - DNA, 20 bp, human
gcgcgtgagacgcactcaat

SEQ ID NO: 203855 - DNA, 20 bp, human
gccctcccagtggactacac

SEQ ID NO: 203856 - DNA, 20 bp, human
ggtgcgcactcaccagccga

SEQ ID NO: 203857 - DNA, 20 bp, human
gcactcaccagccgaaggtt

SEQ ID NO: 203858 - DNA, 20 bp, human
gtcggcgacctggagctctg

SEQ ID NO: 203859 - DNA, 20 bp, human
gctcgcggtgccccaggcct

SEQ ID NO: 203860 - DNA, 20 bp, human
gaccgcgagtgccgaacctt

SEQ ID NO: 203861 - DNA, 20 bp, human
ggccgaaggttcggcactcg

SEQ ID NO: 203862 - DNA, 20 bp, human
gggatcggggcggaaacccc

SEQ ID NO: 203863 - DNA, 20 bp, human
ggggcggaaaccccggggag

SEQ ID NO: 203864 - DNA, 20 bp, human
gggaccagattcggagacca

SEQ ID NO: 203865 - DNA, 20 bp, human
gcttgaatgctgggatgagt

SEQ ID NO: 203866 - DNA, 20 bp, human
ggaacgcaatgtcagacctg

SEQ ID NO: 203867 - DNA, 20 bp, human
gaggcctgtggactacggaa

SEQ ID NO: 203868 - DNA, 20 bp, human
ggttctggaaactaaaccag

SEQ ID NO: 203869 - DNA, 20 bp, human
gtagtccacaggcctgatgg

SEQ ID NO: 203870 - DNA, 20 bp, human
ggcccctgtatctagaacag

SEQ ID NO: 203871 - DNA, 20 bp, human
ggacctgaggtgacagaaaa

SEQ ID NO: 203872 - DNA, 20 bp, human
gcctgtatctagaacagtgg

SEQ ID NO: 203873 - DNA, 20 bp, human
ggacttcctctaccatcctc

SEQ ID NO: 203874 - DNA, 20 bp, human
gcccagcggctaggtcactc

SEQ ID NO: 203875 - DNA, 20 bp, human
ggtccacccgaggatggtag

SEQ ID NO: 203876 - DNA, 20 bp, human
gggaagctggttgttcgctg

SEQ ID NO: 203877 - DNA, 20 bp, human
ggcaagctgagttctcttga

SEQ ID NO: 203878 - DNA, 20 bp, human
gagctccggaaagcgcggtg

SEQ ID NO: 203879 - DNA, 20 bp, human
gcgaccagctccggaaagcg

SEQ ID NO: 203880 - DNA, 20 bp, human
gtcgctgcggcgaccagctc

SEQ ID NO: 203881 - DNA, 20 bp, human
gccgccacaggctccgatgg

SEQ ID NO: 203882 - DNA, 20 bp, human
gttccggcgtctcccctcgg

SEQ ID NO: 203883 - DNA, 20 bp, human
gctgtgttctcgcagctcag

SEQ ID NO: 203884 - DNA, 20 bp, human
ggacttccggcgtctcccct

SEQ ID NO: 203885 - DNA, 20 bp, human
gtcaccgccacaggctccga

SEQ ID NO: 203886 - DNA, 20 bp, human
gaagacccgggggctcccaa

SEQ ID NO: 203887 - DNA, 20 bp, human
gggcacagcctcggggttgc

SEQ ID NO: 203888 - DNA, 20 bp, human
gatcccggtcgggttctggg

SEQ ID NO: 203889 - DNA, 20 bp, human
gcctgtcacgaatcccggtc

SEQ ID NO: 203890 - DNA, 20 bp, human
gtctgggaggcacagcctcg

SEQ ID NO: 203891 - DNA, 20 bp, human
gacagcccagcaagacccgg

SEQ ID NO: 203892 - DNA, 20 bp, human
ggcactggagcttctcacag

SEQ ID NO: 203893 - DNA, 20 bp, human
gtgcctcccagaacccgacc

SEQ ID NO: 203894 - DNA, 20 bp, human
gtcaaggagggagaccgcgg

SEQ ID NO: 203895 - DNA, 20 bp, human
gacagccctgtcacgaatcc

SEQ ID NO: 203896 - DNA, 20 bp, human
ggcccaagtcgccctcgggg

SEQ ID NO: 203897 - DNA, 20 bp, human
gacgggaactgccaccccga

SEQ ID NO: 203898 - DNA, 20 bp, human
ggactcggagggaggcgacg

SEQ ID NO: 203899 - DNA, 20 bp, human
gggtgcccaagtcgccctcg

SEQ ID NO: 203900 - DNA, 20 bp, human
gaaatgcagagggactcgga

SEQ ID NO: 203901 - DNA, 20 bp, human
gtctatcagggaggcgaaca

SEQ ID NO: 203902 - DNA, 20 bp, human
gcccgcgggcggtctctcct

SEQ ID NO: 203903 - DNA, 20 bp, human
gagggaggcgaacagggacg

SEQ ID NO: 203904 - DNA, 20 bp, human
ggacgcggtggcgagtagag

SEQ ID NO: 203905 - DNA, 20 bp, human
ggacggggaactcggaacaa

SEQ ID NO: 203906 - DNA, 20 bp, human
gtgagagaccgcggagtgtt

SEQ ID NO: 203907 - DNA, 20 bp, human
gacactgaggcgctctctat

SEQ ID NO: 203908 - DNA, 20 bp, human
gtacacgacccaacactccg

SEQ ID NO: 203909 - DNA, 20 bp, human
gccgcgggtgtcaaaaacgg

SEQ ID NO: 203910 - DNA, 20 bp, human
gcggccgccgccatccgact

SEQ ID NO: 203911 - DNA, 20 bp, human
gaagcggggtcgaaaggagg

SEQ ID NO: 203912 - DNA, 20 bp, human
gatcccgcgggtgtcaaaaa

SEQ ID NO: 203913 - DNA, 20 bp, human
gtcaaaatggccactagtag

SEQ ID NO: 203914 - DNA, 20 bp, human
gctctcctgagcgcatcccg

SEQ ID NO: 203915 - DNA, 20 bp, human
gtacaccctgaacccggcgt

SEQ ID NO: 203916 - DNA, 20 bp, human
gtgctaaagaggcgccggga

SEQ ID NO: 203917 - DNA, 20 bp, human
ggcctcgcccgagggtgcct

SEQ ID NO: 203918 - DNA, 20 bp, human
gtcgcctgcccaggcaccct

SEQ ID NO: 203919 - DNA, 20 bp, human
gacactccgaggctcgtcgg

SEQ ID NO: 203920 - DNA, 20 bp, human
gctacaaactgcatcctggg

SEQ ID NO: 203921 - DNA, 20 bp, human
gccggccggctgcgtcccgg

SEQ ID NO: 203922 - DNA, 20 bp, human
gagaccccagcacgtcgcct

SEQ ID NO: 203923 - DNA, 20 bp, human
gggcgaggaccccaggtgag

SEQ ID NO: 203924 - DNA, 20 bp, human
ggaaacactccgaggctcgt

SEQ ID NO: 203925 - DNA, 20 bp, human
gcagcccaggcgacgtgctg

SEQ ID NO: 203926 - DNA, 20 bp, human
gggacacgcgcggaactctc

SEQ ID NO: 203927 - DNA, 20 bp, human
ggacagcccgaggacacgcg

SEQ ID NO: 203928 - DNA, 20 bp, human
gtcccggaccagcttccccg

SEQ ID NO: 203929 - DNA, 20 bp, human
ggagttccgcgcgtgtcctc

SEQ ID NO: 203930 - DNA, 20 bp, human
gcttccaggcccggccctcg

SEQ ID NO: 203931 - DNA, 20 bp, human
gggatcagctgtaagacagg

SEQ ID NO: 203932 - DNA, 20 bp, human
ggctgatccggttcttgcgg

SEQ ID NO: 203933 - DNA, 20 bp, human
gtccaagaccagcgggacaa

SEQ ID NO: 203934 - DNA, 20 bp, human
gcgccgctcgcggtagaccc

SEQ ID NO: 203935 - DNA, 20 bp, human
gtcagctgtaagacaggcgg

SEQ ID NO: 203936 - DNA, 20 bp, human
gtctatgcacaggcccggga

SEQ ID NO: 203937 - DNA, 20 bp, human
gggtaaggtcttcacgtctg

SEQ ID NO: 203938 - DNA, 20 bp, human
gcagaggaatggccccagta

SEQ ID NO: 203939 - DNA, 20 bp, human
ggtgtgtgcgcgggtatcag

SEQ ID NO: 203940 - DNA, 20 bp, human
gccgcactgtcgggtcagtc

SEQ ID NO: 203941 - DNA, 20 bp, human
gctgtgaagcggaaagaggg

SEQ ID NO: 203942 - DNA, 20 bp, human
gaggaatggccccagtaggg

SEQ ID NO: 203943 - DNA, 20 bp, human
gtccggggtcgacgacatag

SEQ ID NO: 203944 - DNA, 20 bp, human
gcagagctctgaggacgctg

SEQ ID NO: 203945 - DNA, 20 bp, human
gtgcgcgggtatcagaggag

SEQ ID NO: 203946 - DNA, 20 bp, human
gcgtcctaggaagaaatcgg

SEQ ID NO: 203947 - DNA, 20 bp, human
gtcacgtcctaggaagaaat

SEQ ID NO: 203948 - DNA, 20 bp, human
gagcaggagcctagtaccac

SEQ ID NO: 203949 - DNA, 20 bp, human
ggcgtgtgcgcgggcatcaa

SEQ ID NO: 203950 - DNA, 20 bp, human
gggtaaggtcttcacgtcct

SEQ ID NO: 203951 - DNA, 20 bp, human
gttgacgacctagctgggta

SEQ ID NO: 203952 - DNA, 20 bp, human
gaggcgcagatctggactcg

SEQ ID NO: 203953 - DNA, 20 bp, human
gcagctaggtcgtcaacccc

SEQ ID NO: 203954 - DNA, 20 bp, human
gcagccaccgatttcttcct

SEQ ID NO: 203955 - DNA, 20 bp, human
gcctgtgcacaggaccggga

SEQ ID NO: 203956 - DNA, 20 bp, human
gcagcgactactaggtcagg

SEQ ID NO: 203957 - DNA, 20 bp, human
gaagctgcgcccggagacgt

SEQ ID NO: 203958 - DNA, 20 bp, human
gtcgaagaagggaagataag

SEQ ID NO: 203959 - DNA, 20 bp, human
gtggacgctggcccaagtgg

SEQ ID NO: 203960 - DNA, 20 bp, human
ggagaacgctcccacgtctc

SEQ ID NO: 203961 - DNA, 20 bp, human
ggcttgtgccagcgactact

SEQ ID NO: 203962 - DNA, 20 bp, human
gtgccagcgactactaggtc

SEQ ID NO: 203963 - DNA, 20 bp, human
gctaaaccgttaggaatcag

SEQ ID NO: 203964 - DNA, 20 bp, human
gggctaccagcccacaaacg

SEQ ID NO: 203965 - DNA, 20 bp, human
gggcggaaccggttgcgggg

SEQ ID NO: 203966 - DNA, 20 bp, human
gggccgaagtccctctccag

SEQ ID NO: 203967 - DNA, 20 bp, human
gctcgagaacccaaatgagg

SEQ ID NO: 203968 - DNA, 20 bp, human
gttgggttctcgagactccc

SEQ ID NO: 203969 - DNA, 20 bp, human
gtcggctcggaaagtagagg

SEQ ID NO: 203970 - DNA, 20 bp, human
ggggtcggctcggaaagtag

SEQ ID NO: 203971 - DNA, 20 bp, human
gggaagccgaggcgaatgta

SEQ ID NO: 203972 - DNA, 20 bp, human
gacagagatggaacttaccc

SEQ ID NO: 203973 - DNA, 20 bp, human
ggagccccgcctcctcattt

SEQ ID NO: 203974 - DNA, 20 bp, human
gagcggtttgggaagctcgg

SEQ ID NO: 203975 - DNA, 20 bp, human
gcgtgcccgaaatccccgga

SEQ ID NO: 203976 - DNA, 20 bp, human
gcctgagagctactgccggg

SEQ ID NO: 203977 - DNA, 20 bp, human
gcggcagtagctctcaggtt

SEQ ID NO: 203978 - DNA, 20 bp, human
gtgacgatccggcccatctg

SEQ ID NO: 203979 - DNA, 20 bp, human
gcagccccacgggacagtag

SEQ ID NO: 203980 - DNA, 20 bp, human
ggtcacgctcggcgacgagg

SEQ ID NO: 203981 - DNA, 20 bp, human
ggtcgccgagcgtgactctg

SEQ ID NO: 203982 - DNA, 20 bp, human
gcggcctgtcgggcccgggg

SEQ ID NO: 203983 - DNA, 20 bp, human
gcctggctgaggccgcagat

SEQ ID NO: 203984 - DNA, 20 bp, human
gaaatgggacaatactccta

SEQ ID NO: 203985 - DNA, 20 bp, human
gggccacccaccctcacccg

SEQ ID NO: 203986 - DNA, 20 bp, human
ggcgcccagaggcccagagt

SEQ ID NO: 203987 - DNA, 20 bp, human
ggggatcgcgactccggagt

SEQ ID NO: 203988 - DNA, 20 bp, human
gaccaggtccagtggctcct

SEQ ID NO: 203989 - DNA, 20 bp, human
ggaggagactatgtcatggt

SEQ ID NO: 203990 - DNA, 20 bp, human
ggctcctgggatcgcgactc

SEQ ID NO: 203991 - DNA, 20 bp, human
gagtcggagctcaccgactc

SEQ ID NO: 203992 - DNA, 20 bp, human
gtcgcgatcccaggagccac

SEQ ID NO: 203993 - DNA, 20 bp, human
gcggggcctcataaattcta

SEQ ID NO: 203994 - DNA, 20 bp, human
gttgggtggagccttgtaag

SEQ ID NO: 203995 - DNA, 20 bp, human
gacctggtgcgggcaaggaa

SEQ ID NO: 203996 - DNA, 20 bp, human
gcggtgatcggtgtccccag

SEQ ID NO: 203997 - DNA, 20 bp, human
gtggcaaagggaggcttccg

SEQ ID NO: 203998 - DNA, 20 bp, human
gtcctcagacaagtccgtaa

SEQ ID NO: 203999 - DNA, 20 bp, human
gtaagggcaggagtccctta

SEQ ID NO: 204000 - DNA, 20 bp, human
gcggaggcccaggatcccga

SEQ ID NO: 204001 - DNA, 20 bp, human
gggacccccagtccgtcggt

SEQ ID NO: 204002 - DNA, 20 bp, human
gcctgcgaaggagaaacaat

SEQ ID NO: 204003 - DNA, 20 bp, human
gctttctgcctggcaaaggg

SEQ ID NO: 204004 - DNA, 20 bp, human
ggccgggacccccagtccgt

SEQ ID NO: 204005 - DNA, 20 bp, human
gtccagcccactagcctctg

SEQ ID NO: 204006 - DNA, 20 bp, human
gggagccgccggagacggtc

SEQ ID NO: 204007 - DNA, 20 bp, human
gtggcaaacccgaccgtctc

SEQ ID NO: 204008 - DNA, 20 bp, human
gcaaacccgaccgtctccgg

SEQ ID NO: 204009 - DNA, 20 bp, human
gctagcccgcttacccgagg

SEQ ID NO: 204010 - DNA, 20 bp, human
gggggagtcagtgcgcagca

SEQ ID NO: 204011 - DNA, 20 bp, human
ggtgcgcgcggtgcacgggt

SEQ ID NO: 204012 - DNA, 20 bp, human
ggggaccgcggggaccatgg

SEQ ID NO: 204013 - DNA, 20 bp, human
gaggctagcccgcttacccg

SEQ ID NO: 204014 - DNA, 20 bp, human
gggcgggaccgcggggacca

SEQ ID NO: 204015 - DNA, 20 bp, human
gaccgaggccgacctaggag

SEQ ID NO: 204016 - DNA, 20 bp, human
ggaggaggaggagtgcggcg

SEQ ID NO: 204017 - DNA, 20 bp, human
gctggagggcgagcgcgact

SEQ ID NO: 204018 - DNA, 20 bp, human
ggcctcgcggatggtggcag

SEQ ID NO: 204019 - DNA, 20 bp, human
gagcagagggacccccaccg

SEQ ID NO: 204020 - DNA, 20 bp, human
gtctcctgcctcgcggatgg

SEQ ID NO: 204021 - DNA, 20 bp, human
gagcggcgactcagaccctg

SEQ ID NO: 204022 - DNA, 20 bp, human
ggtgcgcgggtccgggtcca

SEQ ID NO: 204023 - DNA, 20 bp, human
gcccgggaccaaggaggtga

SEQ ID NO: 204024 - DNA, 20 bp, human
gctctgctgcgggccgtcgg

SEQ ID NO: 204025 - DNA, 20 bp, human
ggtgcgcgccgaagagctgt

SEQ ID NO: 204026 - DNA, 20 bp, human
gggaacagacacaaccactc

SEQ ID NO: 204027 - DNA, 20 bp, human
ggcgaatcaccccttaccgg

SEQ ID NO: 204028 - DNA, 20 bp, human
gtcggcgaatcaccccttac

SEQ ID NO: 204029 - DNA, 20 bp, human
gtagagtgggagatgagccg

SEQ ID NO: 204030 - DNA, 20 bp, human
gcgcggaccagacagacctc

SEQ ID NO: 204031 - DNA, 20 bp, human
ggccaagccgcctccaccag

SEQ ID NO: 204032 - DNA, 20 bp, human
gcagcctcagagcctctcgc

SEQ ID NO: 204033 - DNA, 20 bp, human
ggatgagccgtggttgttag

SEQ ID NO: 204034 - DNA, 20 bp, human
ggcacacccccggctcgcag

SEQ ID NO: 204035 - DNA, 20 bp, human
gtgtgtctgttcctccggta

SEQ ID NO: 204036 - DNA, 20 bp, human
ggcaactggcaacaatctac

SEQ ID NO: 204037 - DNA, 20 bp, human
gtctgattcggctcacacag

SEQ ID NO: 204038 - DNA, 20 bp, human
gttgggcggtacttggacag

SEQ ID NO: 204039 - DNA, 20 bp, human
gggagcgattgtcaagagat

SEQ ID NO: 204040 - DNA, 20 bp, human
gtgtgactcgggagacggag

SEQ ID NO: 204041 - DNA, 20 bp, human
gaccgcccaacgccaggtcc

SEQ ID NO: 204042 - DNA, 20 bp, human
gttgaggccgagccaaagag

SEQ ID NO: 204043 - DNA, 20 bp, human
gaggaggtgaggagtggtag

SEQ ID NO: 204044 - DNA, 20 bp, human
gagcggttcttgagctctcg

SEQ ID NO: 204045 - DNA, 20 bp, human
gggagacggagtggaacacc

SEQ ID NO: 204046 - DNA, 20 bp, human
gcggaaccttccaccatcaa

SEQ ID NO: 204047 - DNA, 20 bp, human
gccctgcggtcccttgatgg

SEQ ID NO: 204048 - DNA, 20 bp, human
gcggccctgcggtcccttga

SEQ ID NO: 204049 - DNA, 20 bp, human
ggaagccgaatgactccgga

SEQ ID NO: 204050 - DNA, 20 bp, human
gcgggccctccggagtcatt

SEQ ID NO: 204051 - DNA, 20 bp, human
gtgtctcggaatcactcacc

SEQ ID NO: 204052 - DNA, 20 bp, human
gcacagaagccgaatgactc

SEQ ID NO: 204053 - DNA, 20 bp, human
gagggttaatagaaagatcg

SEQ ID NO: 204054 - DNA, 20 bp, human
gtcattcggcttctgtgtct

SEQ ID NO: 204055 - DNA, 20 bp, human
gtccaccatcaagggaccgc

SEQ ID NO: 204056 - DNA, 20 bp, human
gagttgggcccatctatccc

SEQ ID NO: 204057 - DNA, 20 bp, human
gagcctcgccggggatagat

SEQ ID NO: 204058 - DNA, 20 bp, human
ggaattccaagcagcctccg

SEQ ID NO: 204059 - DNA, 20 bp, human
ggggagagcgcaccccaatg

SEQ ID NO: 204060 - DNA, 20 bp, human
gacagttagtctggtcactg

SEQ ID NO: 204061 - DNA, 20 bp, human
gctccggggcacagttagtc

SEQ ID NO: 204062 - DNA, 20 bp, human
gctggaccgcagggtctcct

SEQ ID NO: 204063 - DNA, 20 bp, human
gcgtagtccaagcctcgccg

SEQ ID NO: 204064 - DNA, 20 bp, human
gaaccgcgtgcgggtcagat

SEQ ID NO: 204065 - DNA, 20 bp, human
gggcccatctatccccggcg

SEQ ID NO: 204066 - DNA, 20 bp, human
gtgggaggagctacagtctg

SEQ ID NO: 204067 - DNA, 20 bp, human
gcagcaacctgacgcgtcaa

SEQ ID NO: 204068 - DNA, 20 bp, human
ggctacgtcactgtgcgatc

SEQ ID NO: 204069 - DNA, 20 bp, human
gtgcggccggaggtgaccgt

SEQ ID NO: 204070 - DNA, 20 bp, human
ggtacagcgcatccgatgca

SEQ ID NO: 204071 - DNA, 20 bp, human
gcacctccggccgcagtgtg

SEQ ID NO: 204072 - DNA, 20 bp, human
gggttgctgtacccctgcat

SEQ ID NO: 204073 - DNA, 20 bp, human
ggcctccccacggtcacctc

SEQ ID NO: 204074 - DNA, 20 bp, human
gcgtgggaggagctaggctg

SEQ ID NO: 204075 - DNA, 20 bp, human
gcctggccccttgacgcgtc

SEQ ID NO: 204076 - DNA, 20 bp, human
gccagacgaggtgtgacccc

SEQ ID NO: 204077 - DNA, 20 bp, human
ggccaggccaatgacagtac

SEQ ID NO: 204078 - DNA, 20 bp, human
ggaaggagagcggatctcgt

SEQ ID NO: 204079 - DNA, 20 bp, human
gttgcaacgggggtacccag

SEQ ID NO: 204080 - DNA, 20 bp, human
gcagccgctggtgcacaggc

SEQ ID NO: 204081 - DNA, 20 bp, human
ggtctggggcacggccaggt

SEQ ID NO: 204082 - DNA, 20 bp, human
ggccggcggggcagcttcac

SEQ ID NO: 204083 - DNA, 20 bp, human
gttctgcccagcctctcgtc

SEQ ID NO: 204084 - DNA, 20 bp, human
gttttgcacgggggagactg

SEQ ID NO: 204085 - DNA, 20 bp, human
ggcagaaactcgcgatcccc

SEQ ID NO: 204086 - DNA, 20 bp, human
gatgggacgaccttataccg

SEQ ID NO: 204087 - DNA, 20 bp, human
gcgcaccggccattcaggat

SEQ ID NO: 204088 - DNA, 20 bp, human
gcgagaggatcagtgatcgg

SEQ ID NO: 204089 - DNA, 20 bp, human
gagaggtttgcgggagtcag

SEQ ID NO: 204090 - DNA, 20 bp, human
gggatgcagcataaatggga

SEQ ID NO: 204091 - DNA, 20 bp, human
gcccgtgagggtcaatgaca

SEQ ID NO: 204092 - DNA, 20 bp, human
gtgcatggggtcagtaatag

SEQ ID NO: 204093 - DNA, 20 bp, human
gacgaccttataccgcggtg

SEQ ID NO: 204094 - DNA, 20 bp, human
gcggaggttctaagttctgt

SEQ ID NO: 204095 - DNA, 20 bp, human
gtcaatgacaagggaactga

SEQ ID NO: 204096 - DNA, 20 bp, human
gaccgagcgcccagcgcagg

SEQ ID NO: 204097 - DNA, 20 bp, human
gaacccgggtccgtagatcc

SEQ ID NO: 204098 - DNA, 20 bp, human
gttcaaccacacactcctct

SEQ ID NO: 204099 - DNA, 20 bp, human
gaggctgccacggaacttcc

SEQ ID NO: 204100 - DNA, 20 bp, human
gcctccccaagggctactcc

SEQ ID NO: 204101 - DNA, 20 bp, human
ggtcccgcgggaacccgcat

SEQ ID NO: 204102 - DNA, 20 bp, human
ggtgtcccaggtcctccgga

SEQ ID NO: 204103 - DNA, 20 bp, human
gggagccgtccggaggacct

SEQ ID NO: 204104 - DNA, 20 bp, human
gcgcggtgtcccaggtcctc

SEQ ID NO: 204105 - DNA, 20 bp, human
gtagatcccggagtagccct

SEQ ID NO: 204106 - DNA, 20 bp, human
gggtgatccccagaccagag

SEQ ID NO: 204107 - DNA, 20 bp, human
ggccgaacgccggacaatgg

SEQ ID NO: 204108 - DNA, 20 bp, human
gctcgccgaacgccggacaa

SEQ ID NO: 204109 - DNA, 20 bp, human
ggcgagtcgggtggtccctt

SEQ ID NO: 204110 - DNA, 20 bp, human
gcggcgttcggcgagtcggg

SEQ ID NO: 204111 - DNA, 20 bp, human
ggtccggcgttcggcgagtc

SEQ ID NO: 204112 - DNA, 20 bp, human
gagtcgccgcgtcgccggtg

SEQ ID NO: 204113 - DNA, 20 bp, human
ggggcctgctcgattctctc

SEQ ID NO: 204114 - DNA, 20 bp, human
gcctcgcggcgcgatgagag

SEQ ID NO: 204115 - DNA, 20 bp, human
gctggtctggggatcacctc

SEQ ID NO: 204116 - DNA, 20 bp, human
gccacacggagaccttctgg

SEQ ID NO: 204117 - DNA, 20 bp, human
gcagctcttaaggcttaagg

SEQ ID NO: 204118 - DNA, 20 bp, human
gctcccacacggagaccttc

SEQ ID NO: 204119 - DNA, 20 bp, human
gttacagctcttaaggctta

SEQ ID NO: 204120 - DNA, 20 bp, human
gctgcatttccaactgtgtc

SEQ ID NO: 204121 - DNA, 20 bp, human
gttggctgcagtctcccaca

SEQ ID NO: 204122 - DNA, 20 bp, human
ggcagaagggcacttgagtt

SEQ ID NO: 204123 - DNA, 20 bp, human
gcacagttggaaatgcagaa

SEQ ID NO: 204124 - DNA, 20 bp, human
gttgcggtgagtgttacagc

SEQ ID NO: 204125 - DNA, 20 bp, human
ggtgtggaaagggaccccag

SEQ ID NO: 204126 - DNA, 20 bp, human
gccgcgggccgagacgactg

SEQ ID NO: 204127 - DNA, 20 bp, human
gagactctccggcagcgaca

SEQ ID NO: 204128 - DNA, 20 bp, human
gccgcggagcgcgtaggaag

SEQ ID NO: 204129 - DNA, 20 bp, human
gctaccgccgcggagcgcgt

SEQ ID NO: 204130 - DNA, 20 bp, human
gagagcccgagctaccgccg

SEQ ID NO: 204131 - DNA, 20 bp, human
gtcgggctctccggaggagg

SEQ ID NO: 204132 - DNA, 20 bp, human
gcgggccgagacgactgcgg

SEQ ID NO: 204133 - DNA, 20 bp, human
ggcctagccacacagcgcgg

SEQ ID NO: 204134 - DNA, 20 bp, human
gccgggctccgggactacgg

SEQ ID NO: 204135 - DNA, 20 bp, human
gcgctccgcggcggtagctc

SEQ ID NO: 204136 - DNA, 20 bp, human
gctcggcgctcaccacagag

SEQ ID NO: 204137 - DNA, 20 bp, human
gacaggagcgagagactgag

SEQ ID NO: 204138 - DNA, 20 bp, human
ggctccacgcatctcagcaa

SEQ ID NO: 204139 - DNA, 20 bp, human
ggcggggtgcgtggaagcgg

SEQ ID NO: 204140 - DNA, 20 bp, human
gggctcactgcacccctctg

SEQ ID NO: 204141 - DNA, 20 bp, human
gtgatactgagagctgtcag

SEQ ID NO: 204142 - DNA, 20 bp, human
gcagcagcaactccgagtgc

SEQ ID NO: 204143 - DNA, 20 bp, human
gccggcgaaacggaaccgag

SEQ ID NO: 204144 - DNA, 20 bp, human
gggctgggaacccgccacga

SEQ ID NO: 204145 - DNA, 20 bp, human
ggagcgcggcgagcatgcgg

SEQ ID NO: 204146 - DNA, 20 bp, human
ggtcagagcagcatgtggac

SEQ ID NO: 204147 - DNA, 20 bp, human
gacatgctgctctgacgagg

SEQ ID NO: 204148 - DNA, 20 bp, human
gaagcgggcgggtttctcag

SEQ ID NO: 204149 - DNA, 20 bp, human
gcgaggtggctgctcaaccg

SEQ ID NO: 204150 - DNA, 20 bp, human
gcaagccatgtgggtccggg

SEQ ID NO: 204151 - DNA, 20 bp, human
ggtatcctgatacaatgagt

SEQ ID NO: 204152 - DNA, 20 bp, human
gtcagcaatgggcactaccg

SEQ ID NO: 204153 - DNA, 20 bp, human
ggcctccgcccggacccaca

SEQ ID NO: 204154 - DNA, 20 bp, human
gggcgcgggtacccatcgtc

SEQ ID NO: 204155 - DNA, 20 bp, human
gagagtggcggggagtcctt

SEQ ID NO: 204156 - DNA, 20 bp, human
ggctggggaaatgagcaggt

SEQ ID NO: 204157 - DNA, 20 bp, human
gcacggttcgctccgagacg

SEQ ID NO: 204158 - DNA, 20 bp, human
gggttcgctccgagacgcgg

SEQ ID NO: 204159 - DNA, 20 bp, human
gaaactctctcgttacgggg

SEQ ID NO: 204160 - DNA, 20 bp, human
gcggcgctggggaaatgagc

SEQ ID NO: 204161 - DNA, 20 bp, human
ggagacgcggaggtcgctgt

SEQ ID NO: 204162 - DNA, 20 bp, human
gctcgttacggggaggctca

SEQ ID NO: 204163 - DNA, 20 bp, human
ggtccacgccggctctaggg

SEQ ID NO: 204164 - DNA, 20 bp, human
ggaatattgaagcggacagt

SEQ ID NO: 204165 - DNA, 20 bp, human
gtctcaggtactaccacgac

SEQ ID NO: 204166 - DNA, 20 bp, human
gcacgtcccagggacagaag

SEQ ID NO: 204167 - DNA, 20 bp, human
gagtgaaggtcacgtcgcca

SEQ ID NO: 204168 - DNA, 20 bp, human
gctgcggcgcgacgctccag

SEQ ID NO: 204169 - DNA, 20 bp, human
gcgctccaggggccgacgag

SEQ ID NO: 204170 - DNA, 20 bp, human
gggctctggcacgagtaggg

SEQ ID NO: 204171 - DNA, 20 bp, human
ggggcaagaatccacctcgt

SEQ ID NO: 204172 - DNA, 20 bp, human
ggacagcccagtgagaggcc

SEQ ID NO: 204173 - DNA, 20 bp, human
gcgacacccggcctctcact

SEQ ID NO: 204174 - DNA, 20 bp, human
gcccgaaaggaagcgacacc

SEQ ID NO: 204175 - DNA, 20 bp, human
ggggccgacgaggggtggct

SEQ ID NO: 204176 - DNA, 20 bp, human
gcctgggcgcgcaaaccccg

SEQ ID NO: 204177 - DNA, 20 bp, human
ggaagcgcaaacttaataca

SEQ ID NO: 204178 - DNA, 20 bp, human
ggggcgcgcaaaccccgagg

SEQ ID NO: 204179 - DNA, 20 bp, human
gccaggggccgaagacggag

SEQ ID NO: 204180 - DNA, 20 bp, human
ggcgctgtgtccccagtcct

SEQ ID NO: 204181 - DNA, 20 bp, human
gtcgctccaggggccgaaga

SEQ ID NO: 204182 - DNA, 20 bp, human
gcggaggctggtcccaaccc

SEQ ID NO: 204183 - DNA, 20 bp, human
gacacagcgcttcgctccag

SEQ ID NO: 204184 - DNA, 20 bp, human
ggtggcacctgcagaattcc

SEQ ID NO: 204185 - DNA, 20 bp, human
gtccagggacagacgcgcca

SEQ ID NO: 204186 - DNA, 20 bp, human
gtcaaaccccggctgagaac

SEQ ID NO: 204187 - DNA, 20 bp, human
gtaggggtagtgaccggaag

SEQ ID NO: 204188 - DNA, 20 bp, human
gtctcgccggttctcagccg

SEQ ID NO: 204189 - DNA, 20 bp, human
gcctgacaactatcaaaccc

SEQ ID NO: 204190 - DNA, 20 bp, human
gagacttatggcctagtccg

SEQ ID NO: 204191 - DNA, 20 bp, human
gcagggatgtggaggtgatg

SEQ ID NO: 204192 - DNA, 20 bp, human
gtagtgaccggaagcggctg

SEQ ID NO: 204193 - DNA, 20 bp, human
gcggtgctaggggtagtgac

SEQ ID NO: 204194 - DNA, 20 bp, human
gaagcggctgcggttctcgc

SEQ ID NO: 204195 - DNA, 20 bp, human
gcgaaaaagggcggtgctag

SEQ ID NO: 204196 - DNA, 20 bp, human
gccagcgcgggaaaagatag

SEQ ID NO: 204197 - DNA, 20 bp, human
ggtgaaacagcactgaccgt

SEQ ID NO: 204198 - DNA, 20 bp, human
ggcgcgggaaaagatagtgg

SEQ ID NO: 204199 - DNA, 20 bp, human
gctccaggacccccaagcag

SEQ ID NO: 204200 - DNA, 20 bp, human
gcctgacgcggctcctgacg

SEQ ID NO: 204201 - DNA, 20 bp, human
gtgggaggaccaacaacccc

SEQ ID NO: 204202 - DNA, 20 bp, human
ggaaatgagcaggatcagag

SEQ ID NO: 204203 - DNA, 20 bp, human
gggttcagtcggtccacgtc

SEQ ID NO: 204204 - DNA, 20 bp, human
gaagtaaaatgggcttactg

SEQ ID NO: 204205 - DNA, 20 bp, human
ggcgcacccaatccttcctt

SEQ ID NO: 204206 - DNA, 20 bp, human
ggcgctccaccggccgaagt

SEQ ID NO: 204207 - DNA, 20 bp, human
gagaaccgcggccccagtcc

SEQ ID NO: 204208 - DNA, 20 bp, human
ggaagtcctcacccaagggg

SEQ ID NO: 204209 - DNA, 20 bp, human
gccgcggttctgcgctccac

SEQ ID NO: 204210 - DNA, 20 bp, human
gtgggcgagaatccacccct

SEQ ID NO: 204211 - DNA, 20 bp, human
ggattctcgcccacttcggc

SEQ ID NO: 204212 - DNA, 20 bp, human
gagaatccaccccttgggtg

SEQ ID NO: 204213 - DNA, 20 bp, human
gtctcgcccacttcggccgg

SEQ ID NO: 204214 - DNA, 20 bp, human
gccaggcctgggcgggacct

SEQ ID NO: 204215 - DNA, 20 bp, human
gggtggattctcgcccactt

SEQ ID NO: 204216 - DNA, 20 bp, human
ggtgactgaacccagaagtc

SEQ ID NO: 204217 - DNA, 20 bp, human
gaagcagagtcgggaggata

SEQ ID NO: 204218 - DNA, 20 bp, human
gggggagaccggcaggtaca

SEQ ID NO: 204219 - DNA, 20 bp, human
ggagagcctcagcgtagccg

SEQ ID NO: 204220 - DNA, 20 bp, human
gagtagcctctgtgcagcgg

SEQ ID NO: 204221 - DNA, 20 bp, human
gcgtatcctggcccaggagt

SEQ ID NO: 204222 - DNA, 20 bp, human
gctgttgggagcaaattatg

SEQ ID NO: 204223 - DNA, 20 bp, human
gactggcgcgggcaaaggcc

SEQ ID NO: 204224 - DNA, 20 bp, human
gtcccacgggtgtcagaaat

SEQ ID NO: 204225 - DNA, 20 bp, human
ggggtccacaggtgcctgtt

SEQ ID NO: 204226 - DNA, 20 bp, human
gatagcagcaccagacaact

SEQ ID NO: 204227 - DNA, 20 bp, human
gcaaagcaccggccaccctg

SEQ ID NO: 204228 - DNA, 20 bp, human
ggtctggtgctgctatatag

SEQ ID NO: 204229 - DNA, 20 bp, human
gtggactgaaagttgcacgg

SEQ ID NO: 204230 - DNA, 20 bp, human
gtggaagtgggagggctaca

SEQ ID NO: 204231 - DNA, 20 bp, human
gtctgagacgtggtggaagt

SEQ ID NO: 204232 - DNA, 20 bp, human
gaggagtggccacaaagcac

SEQ ID NO: 204233 - DNA, 20 bp, human
gctgctatataggggacgtg

SEQ ID NO: 204234 - DNA, 20 bp, human
gtactacgggtggggagatg

SEQ ID NO: 204235 - DNA, 20 bp, human
gcgggaggacgcgtcagaaa

SEQ ID NO: 204236 - DNA, 20 bp, human
ggagtgacggtcccaccgcg

SEQ ID NO: 204237 - DNA, 20 bp, human
ggattacggagggaagacct

SEQ ID NO: 204238 - DNA, 20 bp, human
gagtccccgtgagagtctgg

SEQ ID NO: 204239 - DNA, 20 bp, human
ggcaaaactcacccccgcgg

SEQ ID NO: 204240 - DNA, 20 bp, human
gacagaagcgcctgggaccc

SEQ ID NO: 204241 - DNA, 20 bp, human
gggagaaacggtgattacgg

SEQ ID NO: 204242 - DNA, 20 bp, human
gtcgggacgggaccggtcta

SEQ ID NO: 204243 - DNA, 20 bp, human
ggagcagattcgcacaaacc

SEQ ID NO: 204244 - DNA, 20 bp, human
gtcaggagaaacggtgatta

SEQ ID NO: 204245 - DNA, 20 bp, human
gtctgggtaaagaaagacgg

SEQ ID NO: 204246 - DNA, 20 bp, human
gacagcagacagacagacgg

SEQ ID NO: 204247 - DNA, 20 bp, human
gaagccaccgcgaagcgtgg

SEQ ID NO: 204248 - DNA, 20 bp, human
ggatccgggctaaggagagg

SEQ ID NO: 204249 - DNA, 20 bp, human
gggccagctccggcctaggg

SEQ ID NO: 204250 - DNA, 20 bp, human
gtgtgaccacgggccttggt

SEQ ID NO: 204251 - DNA, 20 bp, human
gcgcgaagcgtgggggaatg

SEQ ID NO: 204252 - DNA, 20 bp, human
gcgcgcccgagagcgccaag

SEQ ID NO: 204253 - DNA, 20 bp, human
ggagcggccggggaggaatt

SEQ ID NO: 204254 - DNA, 20 bp, human
gccaggatcggggctgggta

SEQ ID NO: 204255 - DNA, 20 bp, human
gtggtcacattcaaagcctc

SEQ ID NO: 204256 - DNA, 20 bp, human
gttgcggcccaggggaccaa

SEQ ID NO: 204257 - DNA, 20 bp, human
gcgctgatacagaccttcca

SEQ ID NO: 204258 - DNA, 20 bp, human
ggcgtcccgaggcaaagaag

SEQ ID NO: 204259 - DNA, 20 bp, human
ggcgctctgagtcctggctc

SEQ ID NO: 204260 - DNA, 20 bp, human
gtcccctgggccgcaagatg

SEQ ID NO: 204261 - DNA, 20 bp, human
gcagattgtgcagttgtaac

SEQ ID NO: 204262 - DNA, 20 bp, human
gcgaggcccgggtcccctca

SEQ ID NO: 204263 - DNA, 20 bp, human
ggcccgggtcccctcacggt

SEQ ID NO: 204264 - DNA, 20 bp, human
gaccgaccgtgaggggaccc

SEQ ID NO: 204265 - DNA, 20 bp, human
gaatcaggcacgctgcaggg

SEQ ID NO: 204266 - DNA, 20 bp, human
gatcaaataaacccccgtgg

SEQ ID NO: 204267 - DNA, 20 bp, human
gtgcctctctgcccccacgg

SEQ ID NO: 204268 - DNA, 20 bp, human
ggagcggggaggtagttggg

SEQ ID NO: 204269 - DNA, 20 bp, human
gtacgtgagggaaggcgctt

SEQ ID NO: 204270 - DNA, 20 bp, human
ggccatagacaccgccgcac

SEQ ID NO: 204271 - DNA, 20 bp, human
gcctaaacgaggagtaaccc

SEQ ID NO: 204272 - DNA, 20 bp, human
ggagcccctaacactaatgt

SEQ ID NO: 204273 - DNA, 20 bp, human
ggaagggatgacttacgtga

SEQ ID NO: 204274 - DNA, 20 bp, human
gtgctcgcgtgtgtgatggg

SEQ ID NO: 204275 - DNA, 20 bp, human
gcgggatcaaagggcagcgg

SEQ ID NO: 204276 - DNA, 20 bp, human
ggacctgagccagttctcct

SEQ ID NO: 204277 - DNA, 20 bp, human
gctggcgggacccttagatc

SEQ ID NO: 204278 - DNA, 20 bp, human
gctgggagataataacactg

SEQ ID NO: 204279 - DNA, 20 bp, human
gggagcggcctgaaaggtgg

SEQ ID NO: 204280 - DNA, 20 bp, human
gggcggagcggcctgaaagg

SEQ ID NO: 204281 - DNA, 20 bp, human
gcgcctgggcccacccgaaa

SEQ ID NO: 204282 - DNA, 20 bp, human
gggaggttgtgaaattgtct

SEQ ID NO: 204283 - DNA, 20 bp, human
gatctcacctcccagatcta

SEQ ID NO: 204284 - DNA, 20 bp, human
gtaacactgcggcttatgtg

SEQ ID NO: 204285 - DNA, 20 bp, human
gacggcgacccgcaactccg

SEQ ID NO: 204286 - DNA, 20 bp, human
gagagcgaaactcaccgcca

SEQ ID NO: 204287 - DNA, 20 bp, human
gtggagtgaaagttacaccg

SEQ ID NO: 204288 - DNA, 20 bp, human
gagtgaaagttacaccgtgg

SEQ ID NO: 204289 - DNA, 20 bp, human
gaacccggaagcggattatg

SEQ ID NO: 204290 - DNA, 20 bp, human
gcaggaccaggcaaagtacg

SEQ ID NO: 204291 - DNA, 20 bp, human
ggcgctccagtggcctacga

SEQ ID NO: 204292 - DNA, 20 bp, human
gcagtggcctacgaaggcga

SEQ ID NO: 204293 - DNA, 20 bp, human
gtggcctacgaaggcgaggg

SEQ ID NO: 204294 - DNA, 20 bp, human
gctcccaccctcgccttcgt

SEQ ID NO: 204295 - DNA, 20 bp, human
ggctgctgtacctgagacgt

SEQ ID NO: 204296 - DNA, 20 bp, human
gcttcatgctacacagtcca

SEQ ID NO: 204297 - DNA, 20 bp, human
gtaaagagcactgtaatatg

SEQ ID NO: 204298 - DNA, 20 bp, human
gagcacaggagtagcaaata

SEQ ID NO: 204299 - DNA, 20 bp, human
gaagtgaaaataagatgggt

SEQ ID NO: 204300 - DNA, 20 bp, human
gggagtagcaaatagggaac

SEQ ID NO: 204301 - DNA, 20 bp, human
gctacagaaacatagggctg

SEQ ID NO: 204302 - DNA, 20 bp, human
gagtaggaaacatgacatgt

SEQ ID NO: 204303 - DNA, 20 bp, human
gttcagaaggaggcagtcag

SEQ ID NO: 204304 - DNA, 20 bp, human
gtctttaaagattcagaagg

SEQ ID NO: 204305 - DNA, 20 bp, human
gtgctctttaaagattcaga

SEQ ID NO: 204306 - DNA, 20 bp, human
gtgaggacgatagaacgatt

SEQ ID NO: 204307 - DNA, 20 bp, human
gagaagttaggtaagttgcg

SEQ ID NO: 204308 - DNA, 20 bp, human
gagagatatgtacacaatta

SEQ ID NO: 204309 - DNA, 20 bp, human
ggaaggaacagcaagaagtt

SEQ ID NO: 204310 - DNA, 20 bp, human
gtgcgaggatggagcagaag

SEQ ID NO: 204311 - DNA, 20 bp, human
ggttaggtaagttgcgagga

SEQ ID NO: 204312 - DNA, 20 bp, human
gatatgtacacaattaggga

SEQ ID NO: 204313 - DNA, 20 bp, human
gaggggataaacagcaggag

SEQ ID NO: 204314 - DNA, 20 bp, human
gaggagaggggtacaaaatg

SEQ ID NO: 204315 - DNA, 20 bp, human
gcggaaatatatcaagattg

SEQ ID NO: 204316 - DNA, 20 bp, human
gttccctgccggagtccggg

SEQ ID NO: 204317 - DNA, 20 bp, human
gaagcagcaccgagagaaag

SEQ ID NO: 204318 - DNA, 20 bp, human
gctccgcccggactccggca

SEQ ID NO: 204319 - DNA, 20 bp, human
gtccgcctccgcccggactc

SEQ ID NO: 204320 - DNA, 20 bp, human
gcgcttccctgccggagtcc

SEQ ID NO: 204321 - DNA, 20 bp, human
gatgtggagggctgtacctg

SEQ ID NO: 204322 - DNA, 20 bp, human
gtggtccacgcagatgtgga

SEQ ID NO: 204323 - DNA, 20 bp, human
ggaggcggaggacgccatct

SEQ ID NO: 204324 - DNA, 20 bp, human
gggctgtacctgaggcacca

SEQ ID NO: 204325 - DNA, 20 bp, human
gaagagagcgaaggccacct

SEQ ID NO: 204326 - DNA, 20 bp, human
gggcagtcgcgaccacagtg

SEQ ID NO: 204327 - DNA, 20 bp, human
gtgacgggcagcctagatgg

SEQ ID NO: 204328 - DNA, 20 bp, human
gccaggcccggcgacaggac

SEQ ID NO: 204329 - DNA, 20 bp, human
gcgctgacggtgaacatcgt

SEQ ID NO: 204330 - DNA, 20 bp, human
gcaggcaaggtgcggaatgc

SEQ ID NO: 204331 - DNA, 20 bp, human
gctctggcggcagaaggaca

SEQ ID NO: 204332 - DNA, 20 bp, human
gcccgcgccccgctagtgac

SEQ ID NO: 204333 - DNA, 20 bp, human
ggcccccgggaggcaccgtg

SEQ ID NO: 204334 - DNA, 20 bp, human
ggcgaccacagtgcggacac

SEQ ID NO: 204335 - DNA, 20 bp, human
ggagctggctggtccctcgc

SEQ ID NO: 204336 - DNA, 20 bp, human
gtctaaggaaggaggcacca

SEQ ID NO: 204337 - DNA, 20 bp, human
gttagctcgtctaaggaagg

SEQ ID NO: 204338 - DNA, 20 bp, human
gcaggtacagacacagtgac

SEQ ID NO: 204339 - DNA, 20 bp, human
gcctgggccaacgcagaccc

SEQ ID NO: 204340 - DNA, 20 bp, human
ggcgcaggcgcagtccaccc

SEQ ID NO: 204341 - DNA, 20 bp, human
gcttgaccttagctcgtcta

SEQ ID NO: 204342 - DNA, 20 bp, human
gaccttagctcgtctaagga

SEQ ID NO: 204343 - DNA, 20 bp, human
gtaccgggaggcgagagcaa

SEQ ID NO: 204344 - DNA, 20 bp, human
gggcgcagtccaccccggcc

SEQ ID NO: 204345 - DNA, 20 bp, human
gtagcggtgtcagcccgtat

SEQ ID NO: 204346 - DNA, 20 bp, human
gcgttcgattcaggcagacg

SEQ ID NO: 204347 - DNA, 20 bp, human
ggtgcgacccgcaagggaaa

SEQ ID NO: 204348 - DNA, 20 bp, human
gtgggaaccctgaaagggtg

SEQ ID NO: 204349 - DNA, 20 bp, human
ggtcctaaggcagaaaggca

SEQ ID NO: 204350 - DNA, 20 bp, human
ggccgaagcagaggtcagta

SEQ ID NO: 204351 - DNA, 20 bp, human
gcacaaggtggcagggggta

SEQ ID NO: 204352 - DNA, 20 bp, human
ggatccccaggaaacgggta

SEQ ID NO: 204353 - DNA, 20 bp, human
ggccttgccccaccctttca

SEQ ID NO: 204354 - DNA, 20 bp, human
gtgacgacggagaagctccg

SEQ ID NO: 204355 - DNA, 20 bp, human
ggtagcgatccccaggaaac

SEQ ID NO: 204356 - DNA, 20 bp, human
gtgcgggggcagagacggta

SEQ ID NO: 204357 - DNA, 20 bp, human
gtgcaaaggccaggatgcgg

SEQ ID NO: 204358 - DNA, 20 bp, human
gtcggcctcggctagcaggt

SEQ ID NO: 204359 - DNA, 20 bp, human
ggccgcctccagagagtaag

SEQ ID NO: 204360 - DNA, 20 bp, human
gccaggcccgggacccatcc

SEQ ID NO: 204361 - DNA, 20 bp, human
gcccgggtccctcagtgccg

SEQ ID NO: 204362 - DNA, 20 bp, human
gagccgcaggccgccaggat

SEQ ID NO: 204363 - DNA, 20 bp, human
gggacccggagcgcgaggac

SEQ ID NO: 204364 - DNA, 20 bp, human
gacggtagggaggccggcgt

SEQ ID NO: 204365 - DNA, 20 bp, human
ggcagagacggtagggaggc

SEQ ID NO: 204366 - DNA, 20 bp, human
gggctccgcatccgccatgg

SEQ ID NO: 204367 - DNA, 20 bp, human
gtcggccgccatggcggatg

SEQ ID NO: 204368 - DNA, 20 bp, human
gtccggctccgcatccgcca

SEQ ID NO: 204369 - DNA, 20 bp, human
gtaagactcagggcgtcccc

SEQ ID NO: 204370 - DNA, 20 bp, human
gacgccctgagtcttaaccc

SEQ ID NO: 204371 - DNA, 20 bp, human
gctgggggcggcagcgagga

SEQ ID NO: 204372 - DNA, 20 bp, human
gtccgcccgggttaagactc

SEQ ID NO: 204373 - DNA, 20 bp, human
gcgtcccgcagcacgaaggg

SEQ ID NO: 204374 - DNA, 20 bp, human
gagcaaccgctcctagagtg

SEQ ID NO: 204375 - DNA, 20 bp, human
gtcctggggtgaaaatgcca

SEQ ID NO: 204376 - DNA, 20 bp, human
ggcggtgtcacgtgatcgcg

SEQ ID NO: 204377 - DNA, 20 bp, human
ggcgccgtggccctaaggag

SEQ ID NO: 204378 - DNA, 20 bp, human
ggcgcgcgggcgcgactcgg

SEQ ID NO: 204379 - DNA, 20 bp, human
ggctctgccgctatcgaagg

SEQ ID NO: 204380 - DNA, 20 bp, human
ggcgcgtgcgcgggacacgg

SEQ ID NO: 204381 - DNA, 20 bp, human
gctggctctgccgctatcga

SEQ ID NO: 204382 - DNA, 20 bp, human
gtaaaagcctccttcgatag

SEQ ID NO: 204383 - DNA, 20 bp, human
gtggtggatgcggtccagca

SEQ ID NO: 204384 - DNA, 20 bp, human
gcgggcgcgcgggcgcgact

SEQ ID NO: 204385 - DNA, 20 bp, human
ggcagggcagccgctcctta

SEQ ID NO: 204386 - DNA, 20 bp, human
ggaggggagcgcccactgtc

SEQ ID NO: 204387 - DNA, 20 bp, human
ggcgtgaggacgacacgagg

SEQ ID NO: 204388 - DNA, 20 bp, human
gccttcaggagccggacagt

SEQ ID NO: 204389 - DNA, 20 bp, human
gtccgggtgtgcaggaaact

SEQ ID NO: 204390 - DNA, 20 bp, human
gccggaagcagatcgcgctg

SEQ ID NO: 204391 - DNA, 20 bp, human
gagcagatcgcgctggggaa

SEQ ID NO: 204392 - DNA, 20 bp, human
gtcacgggtatggagaaccg

SEQ ID NO: 204393 - DNA, 20 bp, human
gggagctcggggatcgcgaa

SEQ ID NO: 204394 - DNA, 20 bp, human
gagaacgatgtctcacgaca

SEQ ID NO: 204395 - DNA, 20 bp, human
gctacttacttgggacgaag

SEQ ID NO: 204396 - DNA, 20 bp, human
ggagccgcccccgagagaca

SEQ ID NO: 204397 - DNA, 20 bp, human
gccgcccccgagagacacgg

SEQ ID NO: 204398 - DNA, 20 bp, human
ggatccgccgtgtctctcgg

SEQ ID NO: 204399 - DNA, 20 bp, human
gcagccgggcgcgtagctcc

SEQ ID NO: 204400 - DNA, 20 bp, human
gggcgcgtagctccgggaag

SEQ ID NO: 204401 - DNA, 20 bp, human
gaggggacgtggcgaggacc

SEQ ID NO: 204402 - DNA, 20 bp, human
gtacctcccgcatgacactt

SEQ ID NO: 204403 - DNA, 20 bp, human
gcggggcctgtggggaaaca

SEQ ID NO: 204404 - DNA, 20 bp, human
gcgggtaagagcgagcgaag

SEQ ID NO: 204405 - DNA, 20 bp, human
gtccgatccgccgtgtctct

SEQ ID NO: 204406 - DNA, 20 bp, human
gggccccgcacaatatggag

SEQ ID NO: 204407 - DNA, 20 bp, human
gcgacagggcgacagaagta

SEQ ID NO: 204408 - DNA, 20 bp, human
gtctcagagcaggaaaaacg

SEQ ID NO: 204409 - DNA, 20 bp, human
gcccgtggccccgcacaata

SEQ ID NO: 204410 - DNA, 20 bp, human
gcagggcgacagaagtatgg

SEQ ID NO: 204411 - DNA, 20 bp, human
gcaacctcacccggcgggag

SEQ ID NO: 204412 - DNA, 20 bp, human
gtggcccctcccgccgggtg

SEQ ID NO: 204413 - DNA, 20 bp, human
gggcgacagaagtatggcgg

SEQ ID NO: 204414 - DNA, 20 bp, human
ggggtgccaacctcacccgg

SEQ ID NO: 204415 - DNA, 20 bp, human
gggccaaagactgaggcgaa

SEQ ID NO: 204416 - DNA, 20 bp, human
gagtgatggtcccaccgcag

SEQ ID NO: 204417 - DNA, 20 bp, human
gcgggaagggaccatcctca

SEQ ID NO: 204418 - DNA, 20 bp, human
gagcataagggcctggaacg

SEQ ID NO: 204419 - DNA, 20 bp, human
ggtaagcggtgactgcggtg

SEQ ID NO: 204420 - DNA, 20 bp, human
gcgtcctcgtcagagtccag

SEQ ID NO: 204421 - DNA, 20 bp, human
ggctctaggtgaaggaacac

SEQ ID NO: 204422 - DNA, 20 bp, human
gcgacccctggactctgacg

SEQ ID NO: 204423 - DNA, 20 bp, human
ggcaaaactcaccgctgcgg

SEQ ID NO: 204424 - DNA, 20 bp, human
gcggggctgtcctatgacac

SEQ ID NO: 204425 - DNA, 20 bp, human
gtacagaagcgccggggact

SEQ ID NO: 204426 - DNA, 20 bp, human
gcgctgctgctccggagaag

SEQ ID NO: 204427 - DNA, 20 bp, human
gtctccggagcagcagcggg

SEQ ID NO: 204428 - DNA, 20 bp, human
gggaggaggcgccgcttctc

SEQ ID NO: 204429 - DNA, 20 bp, human
gctggacggaggagatgatc

SEQ ID NO: 204430 - DNA, 20 bp, human
gaagaggcgctcagaagaga

SEQ ID NO: 204431 - DNA, 20 bp, human
gcagcgctcatgctcaacct

SEQ ID NO: 204432 - DNA, 20 bp, human
ggacgctccggacttctgct

SEQ ID NO: 204433 - DNA, 20 bp, human
gtgctaggtctgagacgcgc

SEQ ID NO: 204434 - DNA, 20 bp, human
gcctcggggtcctggcgggg

SEQ ID NO: 204435 - DNA, 20 bp, human
ggggtcggagggtgacgctc

SEQ ID NO: 204436 - DNA, 20 bp, human
ggctgcgctgacagccggcc

SEQ ID NO: 204437 - DNA, 20 bp, human
gcttatggctggaggaactg

SEQ ID NO: 204438 - DNA, 20 bp, human
gcgagctgggcaaaaagaac

SEQ ID NO: 204439 - DNA, 20 bp, human
ggaggaactggggccgagct

SEQ ID NO: 204440 - DNA, 20 bp, human
gaaaacaagacctagagctc

SEQ ID NO: 204441 - DNA, 20 bp, human
gcaggtccgccatcccgagg

SEQ ID NO: 204442 - DNA, 20 bp, human
gagaactggagcgcagattg

SEQ ID NO: 204443 - DNA, 20 bp, human
ggccatcccgagggggaaag

SEQ ID NO: 204444 - DNA, 20 bp, human
gaggggttggttgaaaccgg

SEQ ID NO: 204445 - DNA, 20 bp, human
gtgccaggtccgccatcccg

SEQ ID NO: 204446 - DNA, 20 bp, human
gtcaggactccaaggcgcgg

SEQ ID NO: 204447 - DNA, 20 bp, human
gggcgcggcggcagctaaat

SEQ ID NO: 204448 - DNA, 20 bp, human
ggcggaaccagagaatgctg

SEQ ID NO: 204449 - DNA, 20 bp, human
gcttggagtcctgaggaact

SEQ ID NO: 204450 - DNA, 20 bp, human
gtgggtaagtggatatgcgg

SEQ ID NO: 204451 - DNA, 20 bp, human
ggactgtgcgcgcccggagt

SEQ ID NO: 204452 - DNA, 20 bp, human
gcagtgggtaagtggatatg

SEQ ID NO: 204453 - DNA, 20 bp, human
gcgcacaacgagggtcgtcc

SEQ ID NO: 204454 - DNA, 20 bp, human
gcctctctcacatacaccaa

SEQ ID NO: 204455 - DNA, 20 bp, human
gtggctgccgtgggtctccg

SEQ ID NO: 204456 - DNA, 20 bp, human
gtgtctctcggcggcggagt

SEQ ID NO: 204457 - DNA, 20 bp, human
gttggatgattgtctctcgg

SEQ ID NO: 204458 - DNA, 20 bp, human
gcgacgcgcgtgcgcaactg

SEQ ID NO: 204459 - DNA, 20 bp, human
ggtgcgcaactggggaagct

SEQ ID NO: 204460 - DNA, 20 bp, human
ggatgattgtctctcggcgg

SEQ ID NO: 204461 - DNA, 20 bp, human
gcgcggccgggcgggatcca

SEQ ID NO: 204462 - DNA, 20 bp, human
ggcggagtcggtgagcggcc

SEQ ID NO: 204463 - DNA, 20 bp, human
ggataaagccagaagaaacc

SEQ ID NO: 204464 - DNA, 20 bp, human
ggcggctgtgcgtgcgagag

SEQ ID NO: 204465 - DNA, 20 bp, human
gtctgccccagacgcccggg

SEQ ID NO: 204466 - DNA, 20 bp, human
ggctcatgccggtggacctg

SEQ ID NO: 204467 - DNA, 20 bp, human
ggagctggagctcatgccgg

SEQ ID NO: 204468 - DNA, 20 bp, human
gcagcagctgctacaacagc

SEQ ID NO: 204469 - DNA, 20 bp, human
gggtgcattagctgcagttc

SEQ ID NO: 204470 - DNA, 20 bp, human
gtactattgctgcagcagca

SEQ ID NO: 204471 - DNA, 20 bp, human
gcagctgttacagcaacagc

SEQ ID NO: 204472 - DNA, 20 bp, human
gtcctcctcctcgggctcca

SEQ ID NO: 204473 - DNA, 20 bp, human
gtggctgtaactgttgctgc

SEQ ID NO: 204474 - DNA, 20 bp, human
gttctggtttcagttcctga

SEQ ID NO: 204475 - DNA, 20 bp, human
gttcagttcctgatggtgca

SEQ ID NO: 204476 - DNA, 20 bp, human
gccgggcagcctctgcgcta

SEQ ID NO: 204477 - DNA, 20 bp, human
gtccaccaggtgaggcccag

SEQ ID NO: 204478 - DNA, 20 bp, human
gcctctgcgctagggaggtg

SEQ ID NO: 204479 - DNA, 20 bp, human
gggcagcctctgcgctaggg

SEQ ID NO: 204480 - DNA, 20 bp, human
gccagcgccaacgaccccct

SEQ ID NO: 204481 - DNA, 20 bp, human
ggagcaggaaatgctccacc

SEQ ID NO: 204482 - DNA, 20 bp, human
gtccagagcactgtcaccca

SEQ ID NO: 204483 - DNA, 20 bp, human
gcgttggcgctgggcaaccg

SEQ ID NO: 204484 - DNA, 20 bp, human
gcgggccagggtggactctc

SEQ ID NO: 204485 - DNA, 20 bp, human
gtggactctcaggagcgcct

SEQ ID NO: 204486 - DNA, 20 bp, human
gtgtgcggaagaccgagaga

SEQ ID NO: 204487 - DNA, 20 bp, human
gaccgggaaaactgctccag

SEQ ID NO: 204488 - DNA, 20 bp, human
gcacgtgcacctaggagcag

SEQ ID NO: 204489 - DNA, 20 bp, human
ggtaacctggaaattatcac

SEQ ID NO: 204490 - DNA, 20 bp, human
gtctggcgcagcatcgtgtg

SEQ ID NO: 204491 - DNA, 20 bp, human
ggagcagaggctctgaaacc

SEQ ID NO: 204492 - DNA, 20 bp, human
ggtgaggcgcgcgaactctc

SEQ ID NO: 204493 - DNA, 20 bp, human
gccccttcggatccaagaga

SEQ ID NO: 204494 - DNA, 20 bp, human
gcttgcccgggaaactagtg

SEQ ID NO: 204495 - DNA, 20 bp, human
gtgaatggcacgcataaacc

SEQ ID NO: 204496 - DNA, 20 bp, human
ggcgcttatcctgggtccac

SEQ ID NO: 204497 - DNA, 20 bp, human
ggggggagggcacccaggta

SEQ ID NO: 204498 - DNA, 20 bp, human
gaggatgcgcggacaccgaa

SEQ ID NO: 204499 - DNA, 20 bp, human
gccagagagtcggggaaggt

SEQ ID NO: 204500 - DNA, 20 bp, human
ggacgctcggcagctcgggg

SEQ ID NO: 204501 - DNA, 20 bp, human
ggccgaagtgcgggaagaga

SEQ ID NO: 204502 - DNA, 20 bp, human
gcaacccagcatcgacccag

SEQ ID NO: 204503 - DNA, 20 bp, human
ggaacttcgctctctcacgt

SEQ ID NO: 204504 - DNA, 20 bp, human
gttcgctctctcacgtcggg

SEQ ID NO: 204505 - DNA, 20 bp, human
ggtgagagagcgaagttctt

SEQ ID NO: 204506 - DNA, 20 bp, human
ggagatggaggcgaacccag

SEQ ID NO: 204507 - DNA, 20 bp, human
gggtccacgatgccccactg

SEQ ID NO: 204508 - DNA, 20 bp, human
gaggcgaacccagcgggcag

SEQ ID NO: 204509 - DNA, 20 bp, human
gtcccacccgccggagatgg

SEQ ID NO: 204510 - DNA, 20 bp, human
ggggcatcgtggacctctcg

SEQ ID NO: 204511 - DNA, 20 bp, human
gcaagtgctggtgccccgag

SEQ ID NO: 204512 - DNA, 20 bp, human
gccctgtgaagaggaggacg

SEQ ID NO: 204513 - DNA, 20 bp, human
ggaattccaggaagtcgaag

SEQ ID NO: 204514 - DNA, 20 bp, human
gaagcagcgtcaaagagggg

SEQ ID NO: 204515 - DNA, 20 bp, human
gggttcgcctccatctccgg

SEQ ID NO: 204516 - DNA, 20 bp, human
gggaagtaactggtccctct

SEQ ID NO: 204517 - DNA, 20 bp, human
gcagctacggcggaagtaac

SEQ ID NO: 204518 - DNA, 20 bp, human
gagagcaacagcagctacgg

SEQ ID NO: 204519 - DNA, 20 bp, human
ggggctgctcgcgctagtta

SEQ ID NO: 204520 - DNA, 20 bp, human
gcccgctctcttcactccta

SEQ ID NO: 204521 - DNA, 20 bp, human
gtcgcgctagttaaggtctg

SEQ ID NO: 204522 - DNA, 20 bp, human
gccggcccagctccacccag

SEQ ID NO: 204523 - DNA, 20 bp, human
gcgccacagcgggttcctct

SEQ ID NO: 204524 - DNA, 20 bp, human
gttgtgcggtgaccatggaa

SEQ ID NO: 204525 - DNA, 20 bp, human
ggcccccctgcagcgactct

SEQ ID NO: 204526 - DNA, 20 bp, human
gacaccgcacaagaggcgag

SEQ ID NO: 204527 - DNA, 20 bp, human
gcagctccacaccgcacaag

SEQ ID NO: 204528 - DNA, 20 bp, human
ggttccgctcgcctcttgtg

SEQ ID NO: 204529 - DNA, 20 bp, human
gcgggaaacgtctctgaatt

SEQ ID NO: 204530 - DNA, 20 bp, human
gggctccggaccctgaaccg

SEQ ID NO: 204531 - DNA, 20 bp, human
gtccggaccctgaaccgagg

SEQ ID NO: 204532 - DNA, 20 bp, human
gccgaggcgggcccaggtac

SEQ ID NO: 204533 - DNA, 20 bp, human
gctccgggaaacggagtagg

SEQ ID NO: 204534 - DNA, 20 bp, human
gtcagggtccggagccctcc

SEQ ID NO: 204535 - DNA, 20 bp, human
gcgcggcgggaccaggacga

SEQ ID NO: 204536 - DNA, 20 bp, human
gagcagattacgtggagtga

SEQ ID NO: 204537 - DNA, 20 bp, human
ggccctgtggtgaaagaccg

SEQ ID NO: 204538 - DNA, 20 bp, human
gccgggtacagaagcgcgag

SEQ ID NO: 204539 - DNA, 20 bp, human
gcagcgcgggccgtgtctag

SEQ ID NO: 204540 - DNA, 20 bp, human
gggggcaggcctgtgaaaag

SEQ ID NO: 204541 - DNA, 20 bp, human
gtctgtacccggcatctcag

SEQ ID NO: 204542 - DNA, 20 bp, human
gggcctgtgaaaagagggcg

SEQ ID NO: 204543 - DNA, 20 bp, human
gcgcgcgcagctgagaggcg

SEQ ID NO: 204544 - DNA, 20 bp, human
gaagacgtggatccatctcg

SEQ ID NO: 204545 - DNA, 20 bp, human
gtgatgtttcagcctccatt

SEQ ID NO: 204546 - DNA, 20 bp, human
gccacacgagtgcaagggtc

SEQ ID NO: 204547 - DNA, 20 bp, human
gcttggtggtaggtagacct

SEQ ID NO: 204548 - DNA, 20 bp, human
gagagcacggtcgggcgatg

SEQ ID NO: 204549 - DNA, 20 bp, human
gtcacgttgcagtggagggg

SEQ ID NO: 204550 - DNA, 20 bp, human
ggggcaaccaccccagacct

SEQ ID NO: 204551 - DNA, 20 bp, human
ggaggaaagccgattaggtc

SEQ ID NO: 204552 - DNA, 20 bp, human
gttgctttgactgtgatggg

SEQ ID NO: 204553 - DNA, 20 bp, human
gcaccccagaccttggtggt

SEQ ID NO: 204554 - DNA, 20 bp, human
gacctcccacacgagtgcaa

SEQ ID NO: 204555 - DNA, 20 bp, human
gcaccgaaaaataaagagca

SEQ ID NO: 204556 - DNA, 20 bp, human
gtctagaaaagaccgataag

SEQ ID NO: 204557 - DNA, 20 bp, human
gttgcagtaggcatggtcct

SEQ ID NO: 204558 - DNA, 20 bp, human
gatgacatgaacatgagaag

SEQ ID NO: 204559 - DNA, 20 bp, human
gttaatgtgcacaaagaaca

SEQ ID NO: 204560 - DNA, 20 bp, human
ggattgttcagggccgcatc

SEQ ID NO: 204561 - DNA, 20 bp, human
gttggcagctactctaatct

SEQ ID NO: 204562 - DNA, 20 bp, human
gtcagtggtgttgggcggca

SEQ ID NO: 204563 - DNA, 20 bp, human
gagaaaacatttcctcttat

SEQ ID NO: 204564 - DNA, 20 bp, human
gcatgagaagaggttgcagt

SEQ ID NO: 204565 - DNA, 20 bp, human
gtggtgtcagtggtgttggg

SEQ ID NO: 204566 - DNA, 20 bp, human
gcacctcgttggctccacgg

SEQ ID NO: 204567 - DNA, 20 bp, human
gagagcagggatccacctct

SEQ ID NO: 204568 - DNA, 20 bp, human
gcgggcgaatctacaagcac

SEQ ID NO: 204569 - DNA, 20 bp, human
ggtccgcaggatcccaccac

SEQ ID NO: 204570 - DNA, 20 bp, human
ggcgatccgcttcctggtcc

SEQ ID NO: 204571 - DNA, 20 bp, human
gcgctgacaccacagtccca

SEQ ID NO: 204572 - DNA, 20 bp, human
gactggaagtcacactgcgg

SEQ ID NO: 204573 - DNA, 20 bp, human
gttgtagattcgcccggacc

SEQ ID NO: 204574 - DNA, 20 bp, human
gacgccttcggacaagggtg

SEQ ID NO: 204575 - DNA, 20 bp, human
gggactgtggtgtcagcgct

SEQ ID NO: 204576 - DNA, 20 bp, human
gggccaggctgatcccacga

SEQ ID NO: 204577 - DNA, 20 bp, human
gaccgcggacgcctggaggc

SEQ ID NO: 204578 - DNA, 20 bp, human
ggcaacacgggagggctaaa

SEQ ID NO: 204579 - DNA, 20 bp, human
gaggtttagagattcaagag

SEQ ID NO: 204580 - DNA, 20 bp, human
ggcctcgcgtccccctcggg

SEQ ID NO: 204581 - DNA, 20 bp, human
gcccgggacaagtccctcgt

SEQ ID NO: 204582 - DNA, 20 bp, human
gtcccgggtgaacgagccac

SEQ ID NO: 204583 - DNA, 20 bp, human
ggtagcccctcctccctcaa

SEQ ID NO: 204584 - DNA, 20 bp, human
gtcccacgagggacttgtcc

SEQ ID NO: 204585 - DNA, 20 bp, human
gcgtccgcggtcccgcccga

SEQ ID NO: 204586 - DNA, 20 bp, human
ggagcacgggagggttctcg

SEQ ID NO: 204587 - DNA, 20 bp, human
gaagcagctaagaccagatt

SEQ ID NO: 204588 - DNA, 20 bp, human
gctctctcggaatgctggaa

SEQ ID NO: 204589 - DNA, 20 bp, human
gagaagtcggtcgcagattg

SEQ ID NO: 204590 - DNA, 20 bp, human
gagaggaaggctttcgggtt

SEQ ID NO: 204591 - DNA, 20 bp, human
gcggcgctgttgccatctta

SEQ ID NO: 204592 - DNA, 20 bp, human
ggacttctccttgcccagtt

SEQ ID NO: 204593 - DNA, 20 bp, human
ggaagagacaggacgccgcg

SEQ ID NO: 204594 - DNA, 20 bp, human
gttgggagatccacagctga

SEQ ID NO: 204595 - DNA, 20 bp, human
gctcccctctctcggaatgc

SEQ ID NO: 204596 - DNA, 20 bp, human
gcgagacctggaaactccgg

SEQ ID NO: 204597 - DNA, 20 bp, human
gagtcgagacctggaaactc

SEQ ID NO: 204598 - DNA, 20 bp, human
ggaggtgctggctcatgaat

SEQ ID NO: 204599 - DNA, 20 bp, human
gcgctgccgccggagtttcc

SEQ ID NO: 204600 - DNA, 20 bp, human
gtgagccagcacctccagtc

SEQ ID NO: 204601 - DNA, 20 bp, human
gttagtccgtggggttccca

SEQ ID NO: 204602 - DNA, 20 bp, human
gggcaaggagaacccgggca

SEQ ID NO: 204603 - DNA, 20 bp, human
gcgttgaaaccggtgggatg

SEQ ID NO: 204604 - DNA, 20 bp, human
gcggggctcgttgaaaccgg

SEQ ID NO: 204605 - DNA, 20 bp, human
gggaagcactttagtccgtg

SEQ ID NO: 204606 - DNA, 20 bp, human
ggcaggtaacagggtcacag

SEQ ID NO: 204607 - DNA, 20 bp, human
ggagcagtgaagactagacg

SEQ ID NO: 204608 - DNA, 20 bp, human
gctgcgtcctgtgctgataa

SEQ ID NO: 204609 - DNA, 20 bp, human
gggcgagcctttatcagcac

SEQ ID NO: 204610 - DNA, 20 bp, human
gccgagtgtgcagggacgac

SEQ ID NO: 204611 - DNA, 20 bp, human
gcagtcggctccgagatccg

SEQ ID NO: 204612 - DNA, 20 bp, human
gaagactagacgtggagcgc

SEQ ID NO: 204613 - DNA, 20 bp, human
gggcgagagatgcgacgctg

SEQ ID NO: 204614 - DNA, 20 bp, human
ggttacctgcaagaacttgg

SEQ ID NO: 204615 - DNA, 20 bp, human
gctcggagccgactgcggga

SEQ ID NO: 204616 - DNA, 20 bp, human
ggctgggcctgtaggagcac

SEQ ID NO: 204617 - DNA, 20 bp, human
gaaccggtggaaagtgacgg

SEQ ID NO: 204618 - DNA, 20 bp, human
gttatggctgaagggaaccg

SEQ ID NO: 204619 - DNA, 20 bp, human
gaacagggcggcttctggtt

SEQ ID NO: 204620 - DNA, 20 bp, human
gtggcgggtcctttgtctct

SEQ ID NO: 204621 - DNA, 20 bp, human
gcggtggaaagtgacggtgg

SEQ ID NO: 204622 - DNA, 20 bp, human
ggtcctgtctcttcactgtg

SEQ ID NO: 204623 - DNA, 20 bp, human
gggtccgacatcccaagcga

SEQ ID NO: 204624 - DNA, 20 bp, human
gcgaatgggaagagctttag

SEQ ID NO: 204625 - DNA, 20 bp, human
gggaagagctttagtgggtt

SEQ ID NO: 204626 - DNA, 20 bp, human
ggctaggcaaggagaactag

SEQ ID NO: 204627 - DNA, 20 bp, human
gaagacgagaccaggaactc

SEQ ID NO: 204628 - DNA, 20 bp, human
ggaagggcgaagacgagacc

SEQ ID NO: 204629 - DNA, 20 bp, human
ggggaccacgagagggtcgt

SEQ ID NO: 204630 - DNA, 20 bp, human
gcatccctagagaggagaag

SEQ ID NO: 204631 - DNA, 20 bp, human
gtctgccgacgaccctctcg

SEQ ID NO: 204632 - DNA, 20 bp, human
ggagtccgacatccctagag

SEQ ID NO: 204633 - DNA, 20 bp, human
ggaactaggggcacggattg

SEQ ID NO: 204634 - DNA, 20 bp, human
gcagccccttctcctctcta

SEQ ID NO: 204635 - DNA, 20 bp, human
ggcaaggagaactaggggca

SEQ ID NO: 204636 - DNA, 20 bp, human
gcacagggccacagaggcta

SEQ ID NO: 204637 - DNA, 20 bp, human
ggactgtggagctcactgag

SEQ ID NO: 204638 - DNA, 20 bp, human
ggagcagtaaaaacgagatc

SEQ ID NO: 204639 - DNA, 20 bp, human
gtagtcacagtgcaggaagg

SEQ ID NO: 204640 - DNA, 20 bp, human
gcctgcacaatctgtgagag

SEQ ID NO: 204641 - DNA, 20 bp, human
gcgagctgggcaagagctcg

SEQ ID NO: 204642 - DNA, 20 bp, human
ggaaggaggcaggtcgcccg

SEQ ID NO: 204643 - DNA, 20 bp, human
gggtccgatatcctgagaag

SEQ ID NO: 204644 - DNA, 20 bp, human
gggcggcttgtgggatgtgg

SEQ ID NO: 204645 - DNA, 20 bp, human
ggactggaaccggtggaaag

SEQ ID NO: 204646 - DNA, 20 bp, human
gggctctgagtgggtgatgg

SEQ ID NO: 204647 - DNA, 20 bp, human
gcccagggtggagagcacga

SEQ ID NO: 204648 - DNA, 20 bp, human
gaagccccagcactcgccgg

SEQ ID NO: 204649 - DNA, 20 bp, human
ggctgagaggcgctctgagt

SEQ ID NO: 204650 - DNA, 20 bp, human
ggcgaggcaaggaagaatca

SEQ ID NO: 204651 - DNA, 20 bp, human
ggacactaaagagagtacag

SEQ ID NO: 204652 - DNA, 20 bp, human
ggcgcctccgccctcgagga

SEQ ID NO: 204653 - DNA, 20 bp, human
gactcgccggcggcagtgaa

SEQ ID NO: 204654 - DNA, 20 bp, human
ggaggtgacgccctcctcga

SEQ ID NO: 204655 - DNA, 20 bp, human
ggtgcgtgtgaagcgcgaca

SEQ ID NO: 204656 - DNA, 20 bp, human
gagttgtgttgtgccaatgg

SEQ ID NO: 204657 - DNA, 20 bp, human
gagagtgcgggcggaagacg

SEQ ID NO: 204658 - DNA, 20 bp, human
ggacagttgtgttgtgccaa

SEQ ID NO: 204659 - DNA, 20 bp, human
gcccccaggcctccgtcccg

SEQ ID NO: 204660 - DNA, 20 bp, human
ggctgaggaagggatttacg

SEQ ID NO: 204661 - DNA, 20 bp, human
gtcgggtatgtgagcccccg

SEQ ID NO: 204662 - DNA, 20 bp, human
gcgcacgcgtactaacccca

SEQ ID NO: 204663 - DNA, 20 bp, human
gacggaggcctgggggaact

SEQ ID NO: 204664 - DNA, 20 bp, human
gcctgcccagagagtgcggg

SEQ ID NO: 204665 - DNA, 20 bp, human
ggagcttctccgggcagaag

SEQ ID NO: 204666 - DNA, 20 bp, human
gtgcgttcgcaggtagatcg

SEQ ID NO: 204667 - DNA, 20 bp, human
gtccgcggcgtcactacccg

SEQ ID NO: 204668 - DNA, 20 bp, human
gcagggcccggccggctcca

SEQ ID NO: 204669 - DNA, 20 bp, human
ggtagggcgcattacagcga

SEQ ID NO: 204670 - DNA, 20 bp, human
gagcagcgcagcgagcagta

SEQ ID NO: 204671 - DNA, 20 bp, human
gtccggcggggtcctcgcag

SEQ ID NO: 204672 - DNA, 20 bp, human
gacctgcgaacgcacgccgg

SEQ ID NO: 204673 - DNA, 20 bp, human
gtcctccagaagctgcggtc

SEQ ID NO: 204674 - DNA, 20 bp, human
gggccgtggtggtggaaccg

SEQ ID NO: 204675 - DNA, 20 bp, human
gtccaccaccacggccgcca

SEQ ID NO: 204676 - DNA, 20 bp, human
gcggctgcgtgagaggcgcg

SEQ ID NO: 204677 - DNA, 20 bp, human
gctacatttgagcgacgcca

SEQ ID NO: 204678 - DNA, 20 bp, human
gttacaggcagggacaacag

SEQ ID NO: 204679 - DNA, 20 bp, human
gaagcagatcacgcagacga

SEQ ID NO: 204680 - DNA, 20 bp, human
ggcgacctccccgctcacta

SEQ ID NO: 204681 - DNA, 20 bp, human
ggtccacgcccccaagacgg

SEQ ID NO: 204682 - DNA, 20 bp, human
gcgagcagctgtaacaacag

SEQ ID NO: 204683 - DNA, 20 bp, human
gcggagacccgaggcgggaa

SEQ ID NO: 204684 - DNA, 20 bp, human
gaacccgcggagacccgagg

SEQ ID NO: 204685 - DNA, 20 bp, human
ggaaaggaagcgcagcccaa

SEQ ID NO: 204686 - DNA, 20 bp, human
ggctgcttggctccacacgt

SEQ ID NO: 204687 - DNA, 20 bp, human
gccgccgtaggtattccgac

SEQ ID NO: 204688 - DNA, 20 bp, human
gttaccggtcggaataccta

SEQ ID NO: 204689 - DNA, 20 bp, human
ggctgctgcacaccaatagg

SEQ ID NO: 204690 - DNA, 20 bp, human
gacctacggcggcccacgtg

SEQ ID NO: 204691 - DNA, 20 bp, human
ggaccggtaattcctcctat

SEQ ID NO: 204692 - DNA, 20 bp, human
gtccacacgtgggccgccgt

SEQ ID NO: 204693 - DNA, 20 bp, human
gggagtaagggacttagcag

SEQ ID NO: 204694 - DNA, 20 bp, human
ggaaataccgatggacctaa

SEQ ID NO: 204695 - DNA, 20 bp, human
gagttcggcggcggagagga

SEQ ID NO: 204696 - DNA, 20 bp, human
ggcgctctagcccacggagt

SEQ ID NO: 204697 - DNA, 20 bp, human
gcatgcggtcgggtctgagg

SEQ ID NO: 204698 - DNA, 20 bp, human
gagacagcgtcgggtactaa

SEQ ID NO: 204699 - DNA, 20 bp, human
gcgtcgggtactaaaggact

SEQ ID NO: 204700 - DNA, 20 bp, human
ggacttggaaccctttccag

SEQ ID NO: 204701 - DNA, 20 bp, human
gctctcaccggcccctggaa

SEQ ID NO: 204702 - DNA, 20 bp, human
gcggaattcccagacagcgt

SEQ ID NO: 204703 - DNA, 20 bp, human
ggatcggttgggttgaggag

SEQ ID NO: 204704 - DNA, 20 bp, human
ggagctggcgctctagccca

SEQ ID NO: 204705 - DNA, 20 bp, human
gaggagttaaccaactccgt

SEQ ID NO: 204706 - DNA, 20 bp, human
gccgtggagacaatggaggg

SEQ ID NO: 204707 - DNA, 20 bp, human
gctcgccgccgtggagacaa

SEQ ID NO: 204708 - DNA, 20 bp, human
gcgcagcccgggaccgagcg

SEQ ID NO: 204709 - DNA, 20 bp, human
gggtccaaagaggcgcagtc

SEQ ID NO: 204710 - DNA, 20 bp, human
gggctgggcgagcataaagg

SEQ ID NO: 204711 - DNA, 20 bp, human
gagcccgggaccgagcgggg

SEQ ID NO: 204712 - DNA, 20 bp, human
gggcacggcgctgtcatcgg

SEQ ID NO: 204713 - DNA, 20 bp, human
gtccggtagtgcccgaaatg

SEQ ID NO: 204714 - DNA, 20 bp, human
gtcagctcggtggcaggcat

SEQ ID NO: 204715 - DNA, 20 bp, human
gagtcaaaaaggagacccgg

SEQ ID NO: 204716 - DNA, 20 bp, human
ggaggcggtgccgagatcgg

SEQ ID NO: 204717 - DNA, 20 bp, human
gcggcagcagagagcggtag

SEQ ID NO: 204718 - DNA, 20 bp, human
ggagcggtagcggcccgtcg

SEQ ID NO: 204719 - DNA, 20 bp, human
gcgctcggcgcccccgatct

SEQ ID NO: 204720 - DNA, 20 bp, human
ggccccgcgccggaaggccg

SEQ ID NO: 204721 - DNA, 20 bp, human
gggcggctcaagtggccgtg

SEQ ID NO: 204722 - DNA, 20 bp, human
ggaggaggcggtgccgagat

SEQ ID NO: 204723 - DNA, 20 bp, human
gacatgggcgccaaacagag

SEQ ID NO: 204724 - DNA, 20 bp, human
gcaggaaggggcggctcaag

SEQ ID NO: 204725 - DNA, 20 bp, human
gggcaccgcctcctctcggg

SEQ ID NO: 204726 - DNA, 20 bp, human
gcccgtgaggccggtggtgt

SEQ ID NO: 204727 - DNA, 20 bp, human
gcctcacagccccatcacgg

SEQ ID NO: 204728 - DNA, 20 bp, human
gtcacgtggagcagatgaaa

SEQ ID NO: 204729 - DNA, 20 bp, human
ggtgaggccggtggtgtagg

SEQ ID NO: 204730 - DNA, 20 bp, human
gggagcagatgaaagggccg

SEQ ID NO: 204731 - DNA, 20 bp, human
gtgaaagggccgcggcgcga

SEQ ID NO: 204732 - DNA, 20 bp, human
ggccgcggcgcgacggccgg

SEQ ID NO: 204733 - DNA, 20 bp, human
gcgccacaagatggctccgg

SEQ ID NO: 204734 - DNA, 20 bp, human
gccgcgagaagcggcccgtg

SEQ ID NO: 204735 - DNA, 20 bp, human
ggccgagggcgagatcgtgc

SEQ ID NO: 204736 - DNA, 20 bp, human
gagtgctccggacggcagag

SEQ ID NO: 204737 - DNA, 20 bp, human
gtagccccgtatgccctcgg

SEQ ID NO: 204738 - DNA, 20 bp, human
gtgctgctaggtcccactgg

SEQ ID NO: 204739 - DNA, 20 bp, human
gtggcccccgagggcatacg

SEQ ID NO: 204740 - DNA, 20 bp, human
gcacgatggcgcccagagag

SEQ ID NO: 204741 - DNA, 20 bp, human
gggcatacggggctacctga

SEQ ID NO: 204742 - DNA, 20 bp, human
ggtgtgctgctaggtcccac

SEQ ID NO: 204743 - DNA, 20 bp, human
gtggagaccaggagtcacca

SEQ ID NO: 204744 - DNA, 20 bp, human
gtttgaaggccggtctcagg

SEQ ID NO: 204745 - DNA, 20 bp, human
gtcgatgggatggcacgcgt

SEQ ID NO: 204746 - DNA, 20 bp, human
gctgggacaaaggcagatga

SEQ ID NO: 204747 - DNA, 20 bp, human
gggatggacaccaaacccca

SEQ ID NO: 204748 - DNA, 20 bp, human
gggtcccttggattctgaag

SEQ ID NO: 204749 - DNA, 20 bp, human
gagggaccaggatcttgctg

SEQ ID NO: 204750 - DNA, 20 bp, human
ggcacagagacgggatggct

SEQ ID NO: 204751 - DNA, 20 bp, human
gatccagcacagagacggga

SEQ ID NO: 204752 - DNA, 20 bp, human
gccttggattctgaagcgga

SEQ ID NO: 204753 - DNA, 20 bp, human
gagctgtctcctccagctgg

SEQ ID NO: 204754 - DNA, 20 bp, human
ggtccatccagcacagagac

SEQ ID NO: 204755 - DNA, 20 bp, human
gtctgggagttgggctctcc

SEQ ID NO: 204756 - DNA, 20 bp, human
gtggcgtgcaggcagagagg

SEQ ID NO: 204757 - DNA, 20 bp, human
ggatcaaccaggtagagggt

SEQ ID NO: 204758 - DNA, 20 bp, human
ggaggcagtgagggattgga

SEQ ID NO: 204759 - DNA, 20 bp, human
ggcaggtatagtgagtctac

SEQ ID NO: 204760 - DNA, 20 bp, human
ggagcagcctaccctctacc

SEQ ID NO: 204761 - DNA, 20 bp, human
gctgcattgaaccagcctga

SEQ ID NO: 204762 - DNA, 20 bp, human
gagagacagggagatagtca

SEQ ID NO: 204763 - DNA, 20 bp, human
gctggttcaatgcaggctgg

SEQ ID NO: 204764 - DNA, 20 bp, human
gtaataaagggggtgaatgg

SEQ ID NO: 204765 - DNA, 20 bp, human
gaacctgaccaaggtaataa

SEQ ID NO: 204766 - DNA, 20 bp, human
gaccaaggaggcggtaccct

SEQ ID NO: 204767 - DNA, 20 bp, human
gccagtctggaccaaggagg

SEQ ID NO: 204768 - DNA, 20 bp, human
gcccccagtctggaccaagg

SEQ ID NO: 204769 - DNA, 20 bp, human
gtggacaacgtgcactgcga

SEQ ID NO: 204770 - DNA, 20 bp, human
gctacccccagtctggacca

SEQ ID NO: 204771 - DNA, 20 bp, human
gcccaggatctacaaccctt

SEQ ID NO: 204772 - DNA, 20 bp, human
gcgtgtgtgacgacgactgg

SEQ ID NO: 204773 - DNA, 20 bp, human
gtcctgcacagtggcctgtg

SEQ ID NO: 204774 - DNA, 20 bp, human
ggagtggagatcctgcacag

SEQ ID NO: 204775 - DNA, 20 bp, human
gacaacgtgcactgcgaagg

SEQ ID NO: 204776 - DNA, 20 bp, human
gtgcagccggcaggaactcc

SEQ ID NO: 204777 - DNA, 20 bp, human
ggccttgccattagacccca

SEQ ID NO: 204778 - DNA, 20 bp, human
ggaccctcggctcttgggag

SEQ ID NO: 204779 - DNA, 20 bp, human
gaggagcaactgtcaataag

SEQ ID NO: 204780 - DNA, 20 bp, human
gagtggccagcataagcctg

SEQ ID NO: 204781 - DNA, 20 bp, human
ggaagatagggagacatctt

SEQ ID NO: 204782 - DNA, 20 bp, human
gaggcagaccctcggctctt

SEQ ID NO: 204783 - DNA, 20 bp, human
ggcagccacataatgctacc

SEQ ID NO: 204784 - DNA, 20 bp, human
ggtatcaatacgggaagata

SEQ ID NO: 204785 - DNA, 20 bp, human
gggcccacagtggagcacac

SEQ ID NO: 204786 - DNA, 20 bp, human
ggaccttccgcgcggacggt

SEQ ID NO: 204787 - DNA, 20 bp, human
ggcggacggtgggcaggcga

SEQ ID NO: 204788 - DNA, 20 bp, human
ggtccgcgcggaaggtcgtt

SEQ ID NO: 204789 - DNA, 20 bp, human
gaaacctggcagatgaccca

SEQ ID NO: 204790 - DNA, 20 bp, human
gccccgccgcgctgggccaa

SEQ ID NO: 204791 - DNA, 20 bp, human
gccaacttccggctgcaggt

SEQ ID NO: 204792 - DNA, 20 bp, human
gcgcgctgggccaagggcga

SEQ ID NO: 204793 - DNA, 20 bp, human
ggatgacccatggactgaat

SEQ ID NO: 204794 - DNA, 20 bp, human
gagtgaatgacaggaaatta

SEQ ID NO: 204795 - DNA, 20 bp, human
ggagggcacccgcaccagga

SEQ ID NO: 204796 - DNA, 20 bp, human
gcaggacagccaggtaataa

SEQ ID NO: 204797 - DNA, 20 bp, human
gtgcgacggacgggtagggg

SEQ ID NO: 204798 - DNA, 20 bp, human
gagtgcggagcagaacgccg

SEQ ID NO: 204799 - DNA, 20 bp, human
gaggcaggaccgggaagctc

SEQ ID NO: 204800 - DNA, 20 bp, human
gccgttgcgacggacgggta

SEQ ID NO: 204801 - DNA, 20 bp, human
ggttctgctccgcactgtgg

SEQ ID NO: 204802 - DNA, 20 bp, human
gaggagcagggttcagagtc

SEQ ID NO: 204803 - DNA, 20 bp, human
gtcccgccgttgcgacggac

SEQ ID NO: 204804 - DNA, 20 bp, human
gctctccaggaagctcttcc

SEQ ID NO: 204805 - DNA, 20 bp, human
ggggagccccacctcctgtg

SEQ ID NO: 204806 - DNA, 20 bp, human
gcaggtcgtaccctccacaa

SEQ ID NO: 204807 - DNA, 20 bp, human
gatgcaggaaaacaatgtct

SEQ ID NO: 204808 - DNA, 20 bp, human
gccacaagggcatccaatgc

SEQ ID NO: 204809 - DNA, 20 bp, human
gacaatacaaagtgtctcat

SEQ ID NO: 204810 - DNA, 20 bp, human
gacacccatatctcttataa

SEQ ID NO: 204811 - DNA, 20 bp, human
gtgtgcaggggaaatgatga

SEQ ID NO: 204812 - DNA, 20 bp, human
gtgaaggtaaggttgaggat

SEQ ID NO: 204813 - DNA, 20 bp, human
gtacagttgaactataaaga

SEQ ID NO: 204814 - DNA, 20 bp, human
ggtctaggtctgaacttctt

SEQ ID NO: 204815 - DNA, 20 bp, human
gactatagagattcaaaata

SEQ ID NO: 204816 - DNA, 20 bp, human
gtcagggtctgatcactggg

SEQ ID NO: 204817 - DNA, 20 bp, human
ggtcactggtgcctgaccca

SEQ ID NO: 204818 - DNA, 20 bp, human
gtgatggcacccagggtcac

SEQ ID NO: 204819 - DNA, 20 bp, human
gtggttgcagatcagctgaa

SEQ ID NO: 204820 - DNA, 20 bp, human
gggagcctctcttatcagaa

SEQ ID NO: 204821 - DNA, 20 bp, human
gagctgaaaggtgaagttgt

SEQ ID NO: 204822 - DNA, 20 bp, human
gtaatctctgaacaccatga

SEQ ID NO: 204823 - DNA, 20 bp, human
gcatttgacttgcctgaatg

SEQ ID NO: 204824 - DNA, 20 bp, human
ggggcaacatggaaatgaga

SEQ ID NO: 204825 - DNA, 20 bp, human
gggtcaggcaccagtgaccc

SEQ ID NO: 204826 - DNA, 20 bp, human
gataggcaggagatataacg

SEQ ID NO: 204827 - DNA, 20 bp, human
gtaagaaggatgagattaac

SEQ ID NO: 204828 - DNA, 20 bp, human
gtcagaacgtggaattaagt

SEQ ID NO: 204829 - DNA, 20 bp, human
gtttggaatgcaaaagagat

SEQ ID NO: 204830 - DNA, 20 bp, human
gattgttccactaggtcttt

SEQ ID NO: 204831 - DNA, 20 bp, human
gagtgcacaatgtcagaacg

SEQ ID NO: 204832 - DNA, 20 bp, human
ggaaatgtttaatttcaggg

SEQ ID NO: 204833 - DNA, 20 bp, human
gtagtacacttgattgcaga

SEQ ID NO: 204834 - DNA, 20 bp, human
ggctataaataattaggaca

SEQ ID NO: 204835 - DNA, 20 bp, human
gttgggcagcgtatttttgg

SEQ ID NO: 204836 - DNA, 20 bp, human
gcccgcagctatgtcttcac

SEQ ID NO: 204837 - DNA, 20 bp, human
ggccgcctcaacccgtctta

SEQ ID NO: 204838 - DNA, 20 bp, human
gggcgccataaggacaaccc

SEQ ID NO: 204839 - DNA, 20 bp, human
ggcagagaaaagtcacgtgg

SEQ ID NO: 204840 - DNA, 20 bp, human
gcggagagccccctacaggt

SEQ ID NO: 204841 - DNA, 20 bp, human
gaatttccgagtcagtgacg

SEQ ID NO: 204842 - DNA, 20 bp, human
gtcctgtgaagacatagctg

SEQ ID NO: 204843 - DNA, 20 bp, human
gtatcgctaaaacctggccg

SEQ ID NO: 204844 - DNA, 20 bp, human
ggcctcggagagccccctac

SEQ ID NO: 204845 - DNA, 20 bp, human
gacctctctcgtgaggagat

SEQ ID NO: 204846 - DNA, 20 bp, human
gacctcaggctccaactcgt

SEQ ID NO: 204847 - DNA, 20 bp, human
gggctccaactcgtgggaaa

SEQ ID NO: 204848 - DNA, 20 bp, human
gggcggcatgggtacctctc

SEQ ID NO: 204849 - DNA, 20 bp, human
gcaccgcgacaagtgaacgg

SEQ ID NO: 204850 - DNA, 20 bp, human
gggacgtgtccgcccctaag

SEQ ID NO: 204851 - DNA, 20 bp, human
ggccgcttcagccaatgaaa

SEQ ID NO: 204852 - DNA, 20 bp, human
gcgaatacgccaggtgtgac

SEQ ID NO: 204853 - DNA, 20 bp, human
gacccgttagcgctaagggg

SEQ ID NO: 204854 - DNA, 20 bp, human
ggcgggagttggagattctg

SEQ ID NO: 204855 - DNA, 20 bp, human
gggcatgctgcttaaggggt

SEQ ID NO: 204856 - DNA, 20 bp, human
gcaagctaagtgagccaccg

SEQ ID NO: 204857 - DNA, 20 bp, human
gagaggatcaggttggcgga

SEQ ID NO: 204858 - DNA, 20 bp, human
gaggcgagcgggccgatcgt

SEQ ID NO: 204859 - DNA, 20 bp, human
gaaccaaggtaagcgccgta

SEQ ID NO: 204860 - DNA, 20 bp, human
ggcctgctcatctccccgta

SEQ ID NO: 204861 - DNA, 20 bp, human
ggcccgtgcaagtccgggga

SEQ ID NO: 204862 - DNA, 20 bp, human
gctccaggtctggcaggaaa

SEQ ID NO: 204863 - DNA, 20 bp, human
gcgggcctaagagtcgagac

SEQ ID NO: 204864 - DNA, 20 bp, human
gacatatacacgacgatcag

SEQ ID NO: 204865 - DNA, 20 bp, human
gaccagagcgcgcaccagga

SEQ ID NO: 204866 - DNA, 20 bp, human
gtcaggagggagataggtcc

SEQ ID NO: 204867 - DNA, 20 bp, human
gccgcgcgcgggcttcgctc

SEQ ID NO: 204868 - DNA, 20 bp, human
gggcctgggccactcggtca

SEQ ID NO: 204869 - DNA, 20 bp, human
ggacaggcggatgccaacag

SEQ ID NO: 204870 - DNA, 20 bp, human
gcgacctcaggactcccgat

SEQ ID NO: 204871 - DNA, 20 bp, human
ggtgtttgggcgggcaatgg

SEQ ID NO: 204872 - DNA, 20 bp, human
ggggcaatgggggtacgtag

SEQ ID NO: 204873 - DNA, 20 bp, human
gaggtcccgggatgctgatc

SEQ ID NO: 204874 - DNA, 20 bp, human
gctcggtcatggcgacccct

SEQ ID NO: 204875 - DNA, 20 bp, human
ggcttcggcctcaaacggac

SEQ ID NO: 204876 - DNA, 20 bp, human
gctcggagtccccactacac

SEQ ID NO: 204877 - DNA, 20 bp, human
gcactcagcccagcacgcgg

SEQ ID NO: 204878 - DNA, 20 bp, human
gggatgtagagggtctgctg

SEQ ID NO: 204879 - DNA, 20 bp, human
gctacacaggcagagatgct

SEQ ID NO: 204880 - DNA, 20 bp, human
ggagtcttgggaggatgtag

SEQ ID NO: 204881 - DNA, 20 bp, human
gctttctccctggacacagt

SEQ ID NO: 204882 - DNA, 20 bp, human
gtggggaaggcggcaaaggt

SEQ ID NO: 204883 - DNA, 20 bp, human
gtgctcccaggtggactgat

SEQ ID NO: 204884 - DNA, 20 bp, human
gcagcccagcacgcggaggg

SEQ ID NO: 204885 - DNA, 20 bp, human
gctccaacaaacaacaaatc

SEQ ID NO: 204886 - DNA, 20 bp, human
gagaagagaactccctccta

SEQ ID NO: 204887 - DNA, 20 bp, human
gactccctcctacggagcga

SEQ ID NO: 204888 - DNA, 20 bp, human
gtgggttccgggtcccaaaa

SEQ ID NO: 204889 - DNA, 20 bp, human
gttgccttcgctccgtagga

SEQ ID NO: 204890 - DNA, 20 bp, human
gcctcttgccttcgctccgt

SEQ ID NO: 204891 - DNA, 20 bp, human
gcacagaccacgaggttaga

SEQ ID NO: 204892 - DNA, 20 bp, human
ggcacaacatcgctcacctg

SEQ ID NO: 204893 - DNA, 20 bp, human
gcgggtcccaaaagggttcg

SEQ ID NO: 204894 - DNA, 20 bp, human
gaggcttccctctaacctcg

SEQ ID NO: 204895 - DNA, 20 bp, human
gctgtacgctgcgagcaggt

SEQ ID NO: 204896 - DNA, 20 bp, human
gcagccttccgggagaggat

SEQ ID NO: 204897 - DNA, 20 bp, human
ggcgtaaggtgagtgtctcc

SEQ ID NO: 204898 - DNA, 20 bp, human
gtttgttcggggctgtccaa

SEQ ID NO: 204899 - DNA, 20 bp, human
gactcaccttacgcgcaggg

SEQ ID NO: 204900 - DNA, 20 bp, human
gtgagtgtctcccggctccc

SEQ ID NO: 204901 - DNA, 20 bp, human
ggctcccaggtggagaaaag

SEQ ID NO: 204902 - DNA, 20 bp, human
gagctggcccgtgcatctca

SEQ ID NO: 204903 - DNA, 20 bp, human
ggtgtctcccggctcccagg

SEQ ID NO: 204904 - DNA, 20 bp, human
gctcctgtagatctgttggg

SEQ ID NO: 204905 - DNA, 20 bp, human
gcccgcgacagggaggtgtg

SEQ ID NO: 204906 - DNA, 20 bp, human
gcggccgccatcgcgcactg

SEQ ID NO: 204907 - DNA, 20 bp, human
gcatcgcgcactggggctcc

SEQ ID NO: 204908 - DNA, 20 bp, human
gggctccgggcggctgggac

SEQ ID NO: 204909 - DNA, 20 bp, human
gctgcgcagctaccccaggc

SEQ ID NO: 204910 - DNA, 20 bp, human
gaggcgcttagggcaccctg

SEQ ID NO: 204911 - DNA, 20 bp, human
gagcaggtgggtcggtcccg

SEQ ID NO: 204912 - DNA, 20 bp, human
gcttagggcaccctgtgggt

SEQ ID NO: 204913 - DNA, 20 bp, human
gcccgtgtaggctcgtggag

SEQ ID NO: 204914 - DNA, 20 bp, human
gacccccgcgctgcatcccc

SEQ ID NO: 204915 - DNA, 20 bp, human
gtgcgcactgggcctcaccg

SEQ ID NO: 204916 - DNA, 20 bp, human
gcgagctgacgaggacgcta

SEQ ID NO: 204917 - DNA, 20 bp, human
ggcccatgcggagagtcgga

SEQ ID NO: 204918 - DNA, 20 bp, human
ggctgacgaggacgctacgg

SEQ ID NO: 204919 - DNA, 20 bp, human
gcaccacgaaaggagagtag

SEQ ID NO: 204920 - DNA, 20 bp, human
ggcgcgcccatgcggagagt

SEQ ID NO: 204921 - DNA, 20 bp, human
ggccctccgactctccgcat

SEQ ID NO: 204922 - DNA, 20 bp, human
gccacgcccaacgaagagga

SEQ ID NO: 204923 - DNA, 20 bp, human
ggtcggagggcgagctgacg

SEQ ID NO: 204924 - DNA, 20 bp, human
ggtccgcgccccaccacgaa

SEQ ID NO: 204925 - DNA, 20 bp, human
ggggcccacgcccaacgaag

SEQ ID NO: 204926 - DNA, 20 bp, human
gaccccggctcaagcccgtg

SEQ ID NO: 204927 - DNA, 20 bp, human
gtgagccggggtgaatctgg

SEQ ID NO: 204928 - DNA, 20 bp, human
ggcttgagccggggtgaatc

SEQ ID NO: 204929 - DNA, 20 bp, human
gctgcagggcccgcaggata

SEQ ID NO: 204930 - DNA, 20 bp, human
gcaggacctggtctcccgag

SEQ ID NO: 204931 - DNA, 20 bp, human
gcccgagaggtgagccggag

SEQ ID NO: 204932 - DNA, 20 bp, human
gctgcgcttctcggtaggag

SEQ ID NO: 204933 - DNA, 20 bp, human
ggggcaccgagaacaatgga

SEQ ID NO: 204934 - DNA, 20 bp, human
gggagccggcgcgtaaatcg

SEQ ID NO: 204935 - DNA, 20 bp, human
gcccgaggtgagggaatagt

SEQ ID NO: 204936 - DNA, 20 bp, human
ggtgaagtgggtgtctcggt

SEQ ID NO: 204937 - DNA, 20 bp, human
gcacccacttcacaacaggg

SEQ ID NO: 204938 - DNA, 20 bp, human
gtgtctcggtgggtgagtcc

SEQ ID NO: 204939 - DNA, 20 bp, human
gacagggcggaagtgctccc

SEQ ID NO: 204940 - DNA, 20 bp, human
gtgttgtgaagtgggtgtct

SEQ ID NO: 204941 - DNA, 20 bp, human
gagatgggaagggtcataca

SEQ ID NO: 204942 - DNA, 20 bp, human
gggacggtcaaaggatgtag

SEQ ID NO: 204943 - DNA, 20 bp, human
gggatgtagaggccggagat

SEQ ID NO: 204944 - DNA, 20 bp, human
gtctgggctggagacttagg

SEQ ID NO: 204945 - DNA, 20 bp, human
gatgcttgttctagatggga

SEQ ID NO: 204946 - DNA, 20 bp, human
gggtctcccggtacccggag

SEQ ID NO: 204947 - DNA, 20 bp, human
gcaaggtgttggaaacctgt

SEQ ID NO: 204948 - DNA, 20 bp, human
gccggagcggctctgattca

SEQ ID NO: 204949 - DNA, 20 bp, human
gggtcccgaggtacgcggtg

SEQ ID NO: 204950 - DNA, 20 bp, human
gatgaggttcggcttcccac

SEQ ID NO: 204951 - DNA, 20 bp, human
gcgaacgcaaggctcattga

SEQ ID NO: 204952 - DNA, 20 bp, human
ggaacctcattagaagtgtt

SEQ ID NO: 204953 - DNA, 20 bp, human
gtgggtagaatcaaatccaa

SEQ ID NO: 204954 - DNA, 20 bp, human
gtgcgcggtcccgaggtacg

SEQ ID NO: 204955 - DNA, 20 bp, human
gtcagagccgctccgggtac

SEQ ID NO: 204956 - DNA, 20 bp, human
gagccggcggacccttccgg

SEQ ID NO: 204957 - DNA, 20 bp, human
gtagtctctgcggccacctc

SEQ ID NO: 204958 - DNA, 20 bp, human
gccagcgggtagagagtgag

SEQ ID NO: 204959 - DNA, 20 bp, human
gagagtgagaggctgactag

SEQ ID NO: 204960 - DNA, 20 bp, human
gtgggagctgtggtccgggt

SEQ ID NO: 204961 - DNA, 20 bp, human
gcacctccggaagggtccgc

SEQ ID NO: 204962 - DNA, 20 bp, human
gggaccgacggagaatgtgt

SEQ ID NO: 204963 - DNA, 20 bp, human
gggtcggcgggcgcgcaagt

SEQ ID NO: 204964 - DNA, 20 bp, human
gggactgacggagtgtgtgt

SEQ ID NO: 204965 - DNA, 20 bp, human
gacctcaccagcacagccgg

SEQ ID NO: 204966 - DNA, 20 bp, human
gccgactccgaagctcaccg

SEQ ID NO: 204967 - DNA, 20 bp, human
gagatgtgatctgcgctagg

SEQ ID NO: 204968 - DNA, 20 bp, human
gtcaccgaggcatccgtgag

SEQ ID NO: 204969 - DNA, 20 bp, human
ggatgggccgggcaggtgaa

SEQ ID NO: 204970 - DNA, 20 bp, human
gcccttccgaagcccctcag

SEQ ID NO: 204971 - DNA, 20 bp, human
ggttagactaagaaaggctg

SEQ ID NO: 204972 - DNA, 20 bp, human
ggttgctccgcagcctggaa

SEQ ID NO: 204973 - DNA, 20 bp, human
ggatgtcttattctctactg

SEQ ID NO: 204974 - DNA, 20 bp, human
gccatcagtacagggcagag

SEQ ID NO: 204975 - DNA, 20 bp, human
ggagtcgggctaccgctgag

SEQ ID NO: 204976 - DNA, 20 bp, human
gcacccgccgcggccctgaa

SEQ ID NO: 204977 - DNA, 20 bp, human
gtagcactggcgaccctagc

SEQ ID NO: 204978 - DNA, 20 bp, human
gacccgctgcggccctgaag

SEQ ID NO: 204979 - DNA, 20 bp, human
gtccggaccgcggatagcac

SEQ ID NO: 204980 - DNA, 20 bp, human
gaagggcctctcacccgcta

SEQ ID NO: 204981 - DNA, 20 bp, human
ggggtcgccagtgctatccg

SEQ ID NO: 204982 - DNA, 20 bp, human
gctgccgccgagccccgtag

SEQ ID NO: 204983 - DNA, 20 bp, human
gaagaggctctcacccgccg

SEQ ID NO: 204984 - DNA, 20 bp, human
ggcggtccggaagtgagctg

SEQ ID NO: 204985 - DNA, 20 bp, human
gggcgaccctagcgggtgag

SEQ ID NO: 204986 - DNA, 20 bp, human
gcgcagaaggagactaacat

SEQ ID NO: 204987 - DNA, 20 bp, human
gatggagaggaagagtgtag

SEQ ID NO: 204988 - DNA, 20 bp, human
gtccgctctaggaacgctgg

SEQ ID NO: 204989 - DNA, 20 bp, human
ggagggggcggggtccgtag

SEQ ID NO: 204990 - DNA, 20 bp, human
gcggttggagcagtgaacaa

SEQ ID NO: 204991 - DNA, 20 bp, human
gcggcagcaccatcgagcca

SEQ ID NO: 204992 - DNA, 20 bp, human
gtccttctgcgatgcctaag

SEQ ID NO: 204993 - DNA, 20 bp, human
gagggccgacacctccgcta

SEQ ID NO: 204994 - DNA, 20 bp, human
gttctccgctctaggaacgc

SEQ ID NO: 204995 - DNA, 20 bp, human
gaagagctagagctgacact

SEQ ID NO: 204996 - DNA, 20 bp, human
gggtgtacccaagaaagaga

SEQ ID NO: 204997 - DNA, 20 bp, human
gcctcaccgctcctttgaaa

SEQ ID NO: 204998 - DNA, 20 bp, human
gcaagttccgataaaaacta

SEQ ID NO: 204999 - DNA, 20 bp, human
ggaggtaatatgaataccag

SEQ ID NO: 205000 - DNA, 20 bp, human
ggtgaggagtagattcatat

SEQ ID NO: 205001 - DNA, 20 bp, human
gaaaagaatggatcttctgg

SEQ ID NO: 205002 - DNA, 20 bp, human
gctttcttgggtacacccct

SEQ ID NO: 205003 - DNA, 20 bp, human
gtcttctgggggaaagctta

SEQ ID NO: 205004 - DNA, 20 bp, human
gtcaaaccttttcaaaggag

SEQ ID NO: 205005 - DNA, 20 bp, human
gcattccaagttgggaagta

SEQ ID NO: 205006 - DNA, 20 bp, human
gccaagcaggtccctggcta

SEQ ID NO: 205007 - DNA, 20 bp, human
gcctggctaaggcactgcta

SEQ ID NO: 205008 - DNA, 20 bp, human
gtgctagggacagctcgcgg

SEQ ID NO: 205009 - DNA, 20 bp, human
gcgctggccaagcaggtccc

SEQ ID NO: 205010 - DNA, 20 bp, human
gcactgctagggacagctcg

SEQ ID NO: 205011 - DNA, 20 bp, human
gcagcaactccggagttgtg

SEQ ID NO: 205012 - DNA, 20 bp, human
ggatctgtcgctggccaagc

SEQ ID NO: 205013 - DNA, 20 bp, human
ggcagcaaaggatctgtcgc

SEQ ID NO: 205014 - DNA, 20 bp, human
ggaatcagataagcgatagg

SEQ ID NO: 205015 - DNA, 20 bp, human
gatgcgcgctactcttctgg

SEQ ID NO: 205016 - DNA, 20 bp, human
gtggccagttctctcttaca

SEQ ID NO: 205017 - DNA, 20 bp, human
gggtcaagaacagaaccacc

SEQ ID NO: 205018 - DNA, 20 bp, human
gtaaataagagtaggcctgg

SEQ ID NO: 205019 - DNA, 20 bp, human
gtgaccctgtaagagagaac

SEQ ID NO: 205020 - DNA, 20 bp, human
gcacttacagctgtactcct

SEQ ID NO: 205021 - DNA, 20 bp, human
ggtgattaaagatagttctg

SEQ ID NO: 205022 - DNA, 20 bp, human
gtgctgagaagggctgcggt

SEQ ID NO: 205023 - DNA, 20 bp, human
gtggcatgcttgttaattcc

SEQ ID NO: 205024 - DNA, 20 bp, human
gccgaggggagttgttggat

SEQ ID NO: 205025 - DNA, 20 bp, human
gcgtttgctgagaagggctg

SEQ ID NO: 205026 - DNA, 20 bp, human
gcggcaagctacggaacagg

SEQ ID NO: 205027 - DNA, 20 bp, human
ggggccaagactcaccttcg

SEQ ID NO: 205028 - DNA, 20 bp, human
gccagaacgggccccataat

SEQ ID NO: 205029 - DNA, 20 bp, human
gacctggcgggtcgcgacaa

SEQ ID NO: 205030 - DNA, 20 bp, human
gtcggggcaccggcaagcta

SEQ ID NO: 205031 - DNA, 20 bp, human
gcaagctacggaacaggtgg

SEQ ID NO: 205032 - DNA, 20 bp, human
gcaccggcaagctacggaac

SEQ ID NO: 205033 - DNA, 20 bp, human
gacctccacctactccacgg

SEQ ID NO: 205034 - DNA, 20 bp, human
ggtgccccgaaggtgagtct

SEQ ID NO: 205035 - DNA, 20 bp, human
gaccgggagtacccattatg

SEQ ID NO: 205036 - DNA, 20 bp, human
gaaggaagcggagaactcac

SEQ ID NO: 205037 - DNA, 20 bp, human
gcctccgggccggaagtcag

SEQ ID NO: 205038 - DNA, 20 bp, human
gcccgccggccgcaaggaag

SEQ ID NO: 205039 - DNA, 20 bp, human
gagtcgcgagtgctggtgtc

SEQ ID NO: 205040 - DNA, 20 bp, human
gtaggcactgtggatgagta

SEQ ID NO: 205041 - DNA, 20 bp, human
gcttccggcccggaggctga

SEQ ID NO: 205042 - DNA, 20 bp, human
ggatggggagccaggttgat

SEQ ID NO: 205043 - DNA, 20 bp, human
ggcgccgctgacttccggcc

SEQ ID NO: 205044 - DNA, 20 bp, human
gctgtggatgagtagggagt

SEQ ID NO: 205045 - DNA, 20 bp, human
gcaggggcgtgcgtaatggg

SEQ ID NO: 205046 - DNA, 20 bp, human
gcaggttggaagaccgacat

SEQ ID NO: 205047 - DNA, 20 bp, human
gttaggagctggcatgtcgg

SEQ ID NO: 205048 - DNA, 20 bp, human
gacccgacagacatccccgc

SEQ ID NO: 205049 - DNA, 20 bp, human
ggagctggcatgtcgggggt

SEQ ID NO: 205050 - DNA, 20 bp, human
gtaactttctcatcaagctt

SEQ ID NO: 205051 - DNA, 20 bp, human
gaaaatttatccagtcgttg

SEQ ID NO: 205052 - DNA, 20 bp, human
gattttttcgtgcgttttct

SEQ ID NO: 205053 - DNA, 20 bp, human
gtgggaacatgctagagccc

SEQ ID NO: 205054 - DNA, 20 bp, human
gaggcatatgccacaacgac

SEQ ID NO: 205055 - DNA, 20 bp, human
gcaggaattccaggctagtc

SEQ ID NO: 205056 - DNA, 20 bp, human
gtaccaggttcagacttcgt

SEQ ID NO: 205057 - DNA, 20 bp, human
ggcccgccgacctgaagcag

SEQ ID NO: 205058 - DNA, 20 bp, human
ggcctgcgcagagaatcaag

SEQ ID NO: 205059 - DNA, 20 bp, human
gtccgcgtcgaggccctacg

SEQ ID NO: 205060 - DNA, 20 bp, human
gcccagtgaccggaatgcag

SEQ ID NO: 205061 - DNA, 20 bp, human
gcccgggcgcatacgcggtg

SEQ ID NO: 205062 - DNA, 20 bp, human
gcaggttcagacttcgtggg

SEQ ID NO: 205063 - DNA, 20 bp, human
gctacgtactcagtcaccag

SEQ ID NO: 205064 - DNA, 20 bp, human
gaaccacccgggcgcatacg

SEQ ID NO: 205065 - DNA, 20 bp, human
ggtgggaggctttaagaggg

SEQ ID NO: 205066 - DNA, 20 bp, human
gctggggacgccacagaccg

SEQ ID NO: 205067 - DNA, 20 bp, human
gcgacaggaaccctgagact

SEQ ID NO: 205068 - DNA, 20 bp, human
gcaaattggacactctcatg

SEQ ID NO: 205069 - DNA, 20 bp, human
gaaatacctgacctaggaga

SEQ ID NO: 205070 - DNA, 20 bp, human
gagtagatatggctgcaaat

SEQ ID NO: 205071 - DNA, 20 bp, human
gtattgcaaatacctgacct

SEQ ID NO: 205072 - DNA, 20 bp, human
gctgtgctgatatttgagac

SEQ ID NO: 205073 - DNA, 20 bp, human
gattcatgtgccaagtctca

SEQ ID NO: 205074 - DNA, 20 bp, human
gccctgggtcagacactcca

SEQ ID NO: 205075 - DNA, 20 bp, human
gctgacccagggctgttgca

SEQ ID NO: 205076 - DNA, 20 bp, human
gctttctcggtcgggcccag

SEQ ID NO: 205077 - DNA, 20 bp, human
gttcggagctggcatgcggg

SEQ ID NO: 205078 - DNA, 20 bp, human
ggagctggcatgcggggggt

SEQ ID NO: 205079 - DNA, 20 bp, human
gggtgagtgtccagcggcga

SEQ ID NO: 205080 - DNA, 20 bp, human
gtcaacgccgattacgaaaa

SEQ ID NO: 205081 - DNA, 20 bp, human
ggtccagcggcgatggctgt

SEQ ID NO: 205082 - DNA, 20 bp, human
gcagagtccattttcgtaat

SEQ ID NO: 205083 - DNA, 20 bp, human
gtaatattaactttctcggt

SEQ ID NO: 205084 - DNA, 20 bp, human
gggaataatattaactttct

SEQ ID NO: 205085 - DNA, 20 bp, human
gccctaaaccaatcacggcg

SEQ ID NO: 205086 - DNA, 20 bp, human
gccagatgcgagaaagttgg

SEQ ID NO: 205087 - DNA, 20 bp, human
gtaggagctggcatgcaggg

SEQ ID NO: 205088 - DNA, 20 bp, human
gggagaagtcgaaggactcc

SEQ ID NO: 205089 - DNA, 20 bp, human
gatgcactctccaactggcc

SEQ ID NO: 205090 - DNA, 20 bp, human
ggtgaagtctcgccaatgac

SEQ ID NO: 205091 - DNA, 20 bp, human
gcttcgacttctccataaat

SEQ ID NO: 205092 - DNA, 20 bp, human
gtcctgcactgccccatgat

SEQ ID NO: 205093 - DNA, 20 bp, human
gtcgccaatgactggagacc

SEQ ID NO: 205094 - DNA, 20 bp, human
gacaagccagagttaatcac

SEQ ID NO: 205095 - DNA, 20 bp, human
gaccaatcatggggcagtgc

SEQ ID NO: 205096 - DNA, 20 bp, human
gagaagcgcggcacgaacaa

SEQ ID NO: 205097 - DNA, 20 bp, human
gcgcggcacgaacaatggcc

SEQ ID NO: 205098 - DNA, 20 bp, human
ggacccggaacgcgcaagga

SEQ ID NO: 205099 - DNA, 20 bp, human
gcccggcgttgctagaagcg

SEQ ID NO: 205100 - DNA, 20 bp, human
gtccgccttcgaggagaggt

SEQ ID NO: 205101 - DNA, 20 bp, human
gtagaggtaagagggtatac

SEQ ID NO: 205102 - DNA, 20 bp, human
gctcagggaaagaaacaccc

SEQ ID NO: 205103 - DNA, 20 bp, human
gggagagggggttaccggcc

SEQ ID NO: 205104 - DNA, 20 bp, human
gtcgaaggcggacggagcag

SEQ ID NO: 205105 - DNA, 20 bp, human
gactttggcagccttcacga

SEQ ID NO: 205106 - DNA, 20 bp, human
gtcggaggcagggtcaaata

SEQ ID NO: 205107 - DNA, 20 bp, human
gtgggtgagtgcttcctgaa

SEQ ID NO: 205108 - DNA, 20 bp, human
ggctgtgtgacggctaactg

SEQ ID NO: 205109 - DNA, 20 bp, human
gtcggtctggggccaaatag

SEQ ID NO: 205110 - DNA, 20 bp, human
ggggtgaaagtgtgagacag

SEQ ID NO: 205111 - DNA, 20 bp, human
gggccaaatagaggaaacaa

SEQ ID NO: 205112 - DNA, 20 bp, human
ggagtattgctgctaaaaga

SEQ ID NO: 205113 - DNA, 20 bp, human
gagagggatatagtagaggc

SEQ ID NO: 205114 - DNA, 20 bp, human
gccctttgggagctgtgtga

SEQ ID NO: 205115 - DNA, 20 bp, human
ggttagaggtgagaggtcaa

SEQ ID NO: 205116 - DNA, 20 bp, human
gccctctgctcggctcactg

SEQ ID NO: 205117 - DNA, 20 bp, human
ggcctcagtgagccgagcag

SEQ ID NO: 205118 - DNA, 20 bp, human
gtagagtctggaacactcgt

SEQ ID NO: 205119 - DNA, 20 bp, human
gatgcttcgccgaggctata

SEQ ID NO: 205120 - DNA, 20 bp, human
gcggcgaagcatgctgggtg

SEQ ID NO: 205121 - DNA, 20 bp, human
gggccaactgggggcggtag

SEQ ID NO: 205122 - DNA, 20 bp, human
gagcctcggcgaagcatgct

SEQ ID NO: 205123 - DNA, 20 bp, human
gaggcgtatgaatacctggt

SEQ ID NO: 205124 - DNA, 20 bp, human
gacattgggtatgccagtgg

SEQ ID NO: 205125 - DNA, 20 bp, human
gcagccggtctccaagacga

SEQ ID NO: 205126 - DNA, 20 bp, human
gcctccaggcagccctccgg

SEQ ID NO: 205127 - DNA, 20 bp, human
gaggaaccctaggcctgacc

SEQ ID NO: 205128 - DNA, 20 bp, human
gggcctgaccgggttacaag

SEQ ID NO: 205129 - DNA, 20 bp, human
gtgggaccagcccctagtgt

SEQ ID NO: 205130 - DNA, 20 bp, human
gtgtaacccggtcaggccta

SEQ ID NO: 205131 - DNA, 20 bp, human
gtgaccgggttacaagagga

SEQ ID NO: 205132 - DNA, 20 bp, human
gcgggcccaagatcacacca

SEQ ID NO: 205133 - DNA, 20 bp, human
gccgcgaagacatcctgtaa

SEQ ID NO: 205134 - DNA, 20 bp, human
gagggtccgccccaactggg

SEQ ID NO: 205135 - DNA, 20 bp, human
ggaggaggctggacctccgg

SEQ ID NO: 205136 - DNA, 20 bp, human
gccgggccggcagggtgatg

SEQ ID NO: 205137 - DNA, 20 bp, human
ggcagggttaagggtcctgg

SEQ ID NO: 205138 - DNA, 20 bp, human
ggacggcggagctaaagcgg

SEQ ID NO: 205139 - DNA, 20 bp, human
ggacgacggcggagctaaag

SEQ ID NO: 205140 - DNA, 20 bp, human
gtcctgggggtggaatctca

SEQ ID NO: 205141 - DNA, 20 bp, human
gccgagcgcagaggacggac

SEQ ID NO: 205142 - DNA, 20 bp, human
gtgcggtaggggtcccgggg

SEQ ID NO: 205143 - DNA, 20 bp, human
ggttgtgaagagtcttaaag

SEQ ID NO: 205144 - DNA, 20 bp, human
ggacccgcgccgggccggca

SEQ ID NO: 205145 - DNA, 20 bp, human
gaggtgaccgcgggggaagg

SEQ ID NO: 205146 - DNA, 20 bp, human
gtagccggagagaccggtga

SEQ ID NO: 205147 - DNA, 20 bp, human
ggactgcgccgccaagacgg

SEQ ID NO: 205148 - DNA, 20 bp, human
gccccagcaatggcggacgg

SEQ ID NO: 205149 - DNA, 20 bp, human
ggcggacggaggtgagcgag

SEQ ID NO: 205150 - DNA, 20 bp, human
ggagctgctctcgccgtcac

SEQ ID NO: 205151 - DNA, 20 bp, human
ggaaggaccagtagacgatg

SEQ ID NO: 205152 - DNA, 20 bp, human
gttggcggcgcagtccagta

SEQ ID NO: 205153 - DNA, 20 bp, human
gtcgccgtcaccggtctctc

SEQ ID NO: 205154 - DNA, 20 bp, human
gtcggccggcgaagcccccg

SEQ ID NO: 205155 - DNA, 20 bp, human
ggcgccgcgagggcagacgc

SEQ ID NO: 205156 - DNA, 20 bp, human
ggcggccccggcgacgacag

SEQ ID NO: 205157 - DNA, 20 bp, human
gagaagcggcgcggtcatgg

SEQ ID NO: 205158 - DNA, 20 bp, human
ggccgcttctaacccgacag

SEQ ID NO: 205159 - DNA, 20 bp, human
ggcagcctcctcccgcgaaa

SEQ ID NO: 205160 - DNA, 20 bp, human
gccggcgacgacagcggtgg

SEQ ID NO: 205161 - DNA, 20 bp, human
gactcgtccttcaacaccgg

SEQ ID NO: 205162 - DNA, 20 bp, human
ggttagaagcggcgcggtca

SEQ ID NO: 205163 - DNA, 20 bp, human
ggttgcggccggggaagacg

SEQ ID NO: 205164 - DNA, 20 bp, human
gggcagcaaagccgtttcgc

SEQ ID NO: 205165 - DNA, 20 bp, human
gagcaaagccgtttcgcggg

SEQ ID NO: 205166 - DNA, 20 bp, human
ggcagtcagctggagcgtcg

SEQ ID NO: 205167 - DNA, 20 bp, human
ggcggtccgccggtcgtgga

SEQ ID NO: 205168 - DNA, 20 bp, human
ggtcagctggagcgtcgcgg

SEQ ID NO: 205169 - DNA, 20 bp, human
gaggacacgccctccacgac

SEQ ID NO: 205170 - DNA, 20 bp, human
gacacgccctccacgaccgg

SEQ ID NO: 205171 - DNA, 20 bp, human
ggttgcaggagcccctccgt

SEQ ID NO: 205172 - DNA, 20 bp, human
gtgactgcgcctacctgtgg

SEQ ID NO: 205173 - DNA, 20 bp, human
gtcggagcgagtaggccagt

SEQ ID NO: 205174 - DNA, 20 bp, human
gcctactcgctccgacggag

SEQ ID NO: 205175 - DNA, 20 bp, human
gagctgactgcgcctacctg

SEQ ID NO: 205176 - DNA, 20 bp, human
gtcgtcccggccctaagtct

SEQ ID NO: 205177 - DNA, 20 bp, human
ggccgggacgaagcgctcgg

SEQ ID NO: 205178 - DNA, 20 bp, human
gggccagtctccgagactta

SEQ ID NO: 205179 - DNA, 20 bp, human
gggatggcgcaaacagtcag

SEQ ID NO: 205180 - DNA, 20 bp, human
ggcggtgcaagcggtgatct

SEQ ID NO: 205181 - DNA, 20 bp, human
gagtccagatcagctgatgg

SEQ ID NO: 205182 - DNA, 20 bp, human
gagtctccgagacttagggc

SEQ ID NO: 205183 - DNA, 20 bp, human
gcgagagcctctgccagaac

SEQ ID NO: 205184 - DNA, 20 bp, human
gtcaggcctgggaaagagac

SEQ ID NO: 205185 - DNA, 20 bp, human
gcgtgccgggcgagaatctc

SEQ ID NO: 205186 - DNA, 20 bp, human
gctcagaggaagcgagtgag

SEQ ID NO: 205187 - DNA, 20 bp, human
ggttaaccgaggaaagaatt

SEQ ID NO: 205188 - DNA, 20 bp, human
gagcctagcggagctcagtg

SEQ ID NO: 205189 - DNA, 20 bp, human
gggcctggggaataagggag

SEQ ID NO: 205190 - DNA, 20 bp, human
gaatgaggtactgagggcca

SEQ ID NO: 205191 - DNA, 20 bp, human
gctgccagcgaggcccaaag

SEQ ID NO: 205192 - DNA, 20 bp, human
gaagagacaagagagtaccc

SEQ ID NO: 205193 - DNA, 20 bp, human
gctttgggcctggggaataa

SEQ ID NO: 205194 - DNA, 20 bp, human
ggccaagctaggtacgtggt

SEQ ID NO: 205195 - DNA, 20 bp, human
gccggaagagaagaaactcc

SEQ ID NO: 205196 - DNA, 20 bp, human
gtcaagacggccggcgggac

SEQ ID NO: 205197 - DNA, 20 bp, human
gaacgaggccatggccaaga

SEQ ID NO: 205198 - DNA, 20 bp, human
gacgggaaccaacgctgact

SEQ ID NO: 205199 - DNA, 20 bp, human
gagagtgacccagtcagcgt

SEQ ID NO: 205200 - DNA, 20 bp, human
gtcagcgttggttcccgtct

SEQ ID NO: 205201 - DNA, 20 bp, human
gcgaggagacctgggactgt

SEQ ID NO: 205202 - DNA, 20 bp, human
gcggcgggtggaggagatca

SEQ ID NO: 205203 - DNA, 20 bp, human
gtgggactgtggggacgaac

SEQ ID NO: 205204 - DNA, 20 bp, human
gggaagctccgaggaagcta

SEQ ID NO: 205205 - DNA, 20 bp, human
gtgtggggacgaacaggcgg

SEQ ID NO: 205206 - DNA, 20 bp, human
gcggctgaactgcgcagcag

SEQ ID NO: 205207 - DNA, 20 bp, human
gcccaatgtgagagcggtac

SEQ ID NO: 205208 - DNA, 20 bp, human
gacacacttgccataagtag

SEQ ID NO: 205209 - DNA, 20 bp, human
gataagtagaggcaccaccc

SEQ ID NO: 205210 - DNA, 20 bp, human
gacccgggatacggaaaact

SEQ ID NO: 205211 - DNA, 20 bp, human
gaagagactagactcactga

SEQ ID NO: 205212 - DNA, 20 bp, human
gcacacggtcaaccccacac

SEQ ID NO: 205213 - DNA, 20 bp, human
gtcacattggggcgggatgt

SEQ ID NO: 205214 - DNA, 20 bp, human
gtccggtaccgctctcacat

SEQ ID NO: 205215 - DNA, 20 bp, human
gagaggcaccacccgggata

SEQ ID NO: 205216 - DNA, 20 bp, human
gaatcttagggattgtggga

SEQ ID NO: 205217 - DNA, 20 bp, human
ggccgcaaacacttactcta

SEQ ID NO: 205218 - DNA, 20 bp, human
gactggagcaatctacgaag

SEQ ID NO: 205219 - DNA, 20 bp, human
ggatgcctcggtctactcta

SEQ ID NO: 205220 - DNA, 20 bp, human
gaactcggcgcctggaaaga

SEQ ID NO: 205221 - DNA, 20 bp, human
gagcaggcaacagacacctc

SEQ ID NO: 205222 - DNA, 20 bp, human
gaaaaccctagagtagaccg

SEQ ID NO: 205223 - DNA, 20 bp, human
ggcggcgaacggtcccccaa

SEQ ID NO: 205224 - DNA, 20 bp, human
ggtcccgtcttaggttcctg

SEQ ID NO: 205225 - DNA, 20 bp, human
gaagtaatcttagggattgt

SEQ ID NO: 205226 - DNA, 20 bp, human
gcctccgcagggcagccgaa

SEQ ID NO: 205227 - DNA, 20 bp, human
gggggggcgatcagacacct

SEQ ID NO: 205228 - DNA, 20 bp, human
gggaggtcggaccgcagctc

SEQ ID NO: 205229 - DNA, 20 bp, human
gttgcgggaacccagcttgg

SEQ ID NO: 205230 - DNA, 20 bp, human
gggcttgcgggaacccagct

SEQ ID NO: 205231 - DNA, 20 bp, human
gcctgctccggcgccccagg

SEQ ID NO: 205232 - DNA, 20 bp, human
ggcagaacccgcgcctgctc

SEQ ID NO: 205233 - DNA, 20 bp, human
gttctgcgggctcggctagc

SEQ ID NO: 205234 - DNA, 20 bp, human
gatattgcttgctgcagcca

SEQ ID NO: 205235 - DNA, 20 bp, human
gctgggctctggtccaggcg

SEQ ID NO: 205236 - DNA, 20 bp, human
gcctctgccgggcagccaaa

SEQ ID NO: 205237 - DNA, 20 bp, human
ggaggtctggcggcagctct

SEQ ID NO: 205238 - DNA, 20 bp, human
ggcggggcgatcagacaccc

SEQ ID NO: 205239 - DNA, 20 bp, human
ggagctggcgcgggttcggc

SEQ ID NO: 205240 - DNA, 20 bp, human
gccagctccggcgcctgagg

SEQ ID NO: 205241 - DNA, 20 bp, human
gcaagtacagcaccacgcct

SEQ ID NO: 205242 - DNA, 20 bp, human
gtacagcaccacgcctgggc

SEQ ID NO: 205243 - DNA, 20 bp, human
gctgcggccctttggctgcc

SEQ ID NO: 205244 - DNA, 20 bp, human
ggagaactcattcaaatgcg

SEQ ID NO: 205245 - DNA, 20 bp, human
gctgggctccggcccaggcg

SEQ ID NO: 205246 - DNA, 20 bp, human
gtccatcttggtcccagcga

SEQ ID NO: 205247 - DNA, 20 bp, human
ggggcggcgcacgcacacct

SEQ ID NO: 205248 - DNA, 20 bp, human
gcggctcgccaggttgacac

SEQ ID NO: 205249 - DNA, 20 bp, human
ggcgcacgcacacctgggcg

SEQ ID NO: 205250 - DNA, 20 bp, human
gagcgccgggaggtccatct

SEQ ID NO: 205251 - DNA, 20 bp, human
gttggtcccagcgacggcgt

SEQ ID NO: 205252 - DNA, 20 bp, human
gcgcgcggagggcaacatgg

SEQ ID NO: 205253 - DNA, 20 bp, human
ggcccgccggggctacgcca

SEQ ID NO: 205254 - DNA, 20 bp, human
ggccgtcgctgggaccaaga

SEQ ID NO: 205255 - DNA, 20 bp, human
ggacggcgtcggagcagctt

SEQ ID NO: 205256 - DNA, 20 bp, human
gactggggcgaggaatcctg

SEQ ID NO: 205257 - DNA, 20 bp, human
ggatcccgcgagaaccaagc

SEQ ID NO: 205258 - DNA, 20 bp, human
gtgtgcctcgcaggcgtggt

SEQ ID NO: 205259 - DNA, 20 bp, human
gcccgcgagaaccaagcggg

SEQ ID NO: 205260 - DNA, 20 bp, human
gcgacgcctgcgcctggaag

SEQ ID NO: 205261 - DNA, 20 bp, human
ggtggtacaggtgagcaccg

SEQ ID NO: 205262 - DNA, 20 bp, human
gtctcgcgggatccgggctc

SEQ ID NO: 205263 - DNA, 20 bp, human
gtgcggaggtgcgttgtcgg

SEQ ID NO: 205264 - DNA, 20 bp, human
gaagagagccggcgtcgagc

SEQ ID NO: 205265 - DNA, 20 bp, human
gctgctgtgagcttagacgt

SEQ ID NO: 205266 - DNA, 20 bp, human
ggaggagctgaacaccgagg

SEQ ID NO: 205267 - DNA, 20 bp, human
gcgaggggacaccagagaca

SEQ ID NO: 205268 - DNA, 20 bp, human
gctcctagcttgagggaaag

SEQ ID NO: 205269 - DNA, 20 bp, human
gccggcgcggaggctccagg

SEQ ID NO: 205270 - DNA, 20 bp, human
gggcctctttccctcaagct

SEQ ID NO: 205271 - DNA, 20 bp, human
gtggcgggcggctgcggcta

SEQ ID NO: 205272 - DNA, 20 bp, human
ggggaggggcaagaccgcag

SEQ ID NO: 205273 - DNA, 20 bp, human
gaggaggctccggcgagcgg

SEQ ID NO: 205274 - DNA, 20 bp, human
gtcaccgaagcaggtgaatg

SEQ ID NO: 205275 - DNA, 20 bp, human
gtgctacgctcctagcttga

SEQ ID NO: 205276 - DNA, 20 bp, human
gcccgccgcataccttccgg

SEQ ID NO: 205277 - DNA, 20 bp, human
ggaggcggccacccgagacg

SEQ ID NO: 205278 - DNA, 20 bp, human
ggcgcacagatgggccgggt

SEQ ID NO: 205279 - DNA, 20 bp, human
gcgctgtccccgggccggaa

SEQ ID NO: 205280 - DNA, 20 bp, human
ggaccgggacgcagagtctg

SEQ ID NO: 205281 - DNA, 20 bp, human
ggggcccagcgcgcacagat

SEQ ID NO: 205282 - DNA, 20 bp, human
gacatctgctcgggacaggg

SEQ ID NO: 205283 - DNA, 20 bp, human
ggagcgtgcgcgccgcgtct

SEQ ID NO: 205284 - DNA, 20 bp, human
gcagcgcgcacagatgggcc

SEQ ID NO: 205285 - DNA, 20 bp, human
ggccggagccgagaccgaaa

SEQ ID NO: 205286 - DNA, 20 bp, human
ggacgcggaggagacgacgg

SEQ ID NO: 205287 - DNA, 20 bp, human
ggcccgccagctgctgtcgg

SEQ ID NO: 205288 - DNA, 20 bp, human
ggtcggaggttgacaggtcg

SEQ ID NO: 205289 - DNA, 20 bp, human
gagttcgaggaggtcagggc

SEQ ID NO: 205290 - DNA, 20 bp, human
gggaggttgacaggtcgagg

SEQ ID NO: 205291 - DNA, 20 bp, human
ggagcagttcgaggaggtca

SEQ ID NO: 205292 - DNA, 20 bp, human
gtctagcgagcagttcgagg

SEQ ID NO: 205293 - DNA, 20 bp, human
ggctgctgtcggaggttgac

SEQ ID NO: 205294 - DNA, 20 bp, human
gaacctccgacagcagctgg

SEQ ID NO: 205295 - DNA, 20 bp, human
gggcgaagagtctgtcactc

SEQ ID NO: 205296 - DNA, 20 bp, human
gaccaagaggcactcgcccc

SEQ ID NO: 205297 - DNA, 20 bp, human
gcacgtatcccggcaccaag

SEQ ID NO: 205298 - DNA, 20 bp, human
ggctgcaggaagctcgatag

SEQ ID NO: 205299 - DNA, 20 bp, human
gcagtagcggcccacgtgac

SEQ ID NO: 205300 - DNA, 20 bp, human
ggagcgcgctcgctcagtag

SEQ ID NO: 205301 - DNA, 20 bp, human
ggacccacctggaagcgccg

SEQ ID NO: 205302 - DNA, 20 bp, human
gtccactagacccaacatgg

SEQ ID NO: 205303 - DNA, 20 bp, human
gtgtgcgcgggcgaaagggg

SEQ ID NO: 205304 - DNA, 20 bp, human
ggattctcgcgggacctcgt

SEQ ID NO: 205305 - DNA, 20 bp, human
gcgtggtgagggccagacac

SEQ ID NO: 205306 - DNA, 20 bp, human
gcgcgcctgcgcctcagccc

SEQ ID NO: 205307 - DNA, 20 bp, human
ggtgcggggacactcacgtg

SEQ ID NO: 205308 - DNA, 20 bp, human
gaagacagggaagatgaagc

SEQ ID NO: 205309 - DNA, 20 bp, human
gtgggcgcagagggctcctc

SEQ ID NO: 205310 - DNA, 20 bp, human
ggggacactcacgtgtggcg

SEQ ID NO: 205311 - DNA, 20 bp, human
gctgcgcccaggaacaagac

SEQ ID NO: 205312 - DNA, 20 bp, human
gcacccctcccccaggaccg

SEQ ID NO: 205313 - DNA, 20 bp, human
gcacgtgtggcgcggatgtc

SEQ ID NO: 205314 - DNA, 20 bp, human
gggtcactctgacgggtgaa

SEQ ID NO: 205315 - DNA, 20 bp, human
gtccacgtcgcccggagctg

SEQ ID NO: 205316 - DNA, 20 bp, human
gcagggcccccatggggtca

SEQ ID NO: 205317 - DNA, 20 bp, human
gggcaaagggtgaacttctg

SEQ ID NO: 205318 - DNA, 20 bp, human
gtgtccttcccggaaggcgg

SEQ ID NO: 205319 - DNA, 20 bp, human
gagcagctccaggtagagtg

SEQ ID NO: 205320 - DNA, 20 bp, human
gctgcccccgccttccggga

SEQ ID NO: 205321 - DNA, 20 bp, human
gagaaggaaccacagtcctc

SEQ ID NO: 205322 - DNA, 20 bp, human
ggccccaagggagggcggtg

SEQ ID NO: 205323 - DNA, 20 bp, human
gaggatccatcactgaaatg

SEQ ID NO: 205324 - DNA, 20 bp, human
gaccccaccgccctcccttg

SEQ ID NO: 205325 - DNA, 20 bp, human
gtctgcggttgccctcacat

SEQ ID NO: 205326 - DNA, 20 bp, human
ggccctttgaccagataatt

SEQ ID NO: 205327 - DNA, 20 bp, human
gctgtagtgacccaattatc

SEQ ID NO: 205328 - DNA, 20 bp, human
gatctggtcaaagggctgca

SEQ ID NO: 205329 - DNA, 20 bp, human
gggttcagtggctttaggtt

SEQ ID NO: 205330 - DNA, 20 bp, human
gcaagtacgtagataaatgc

SEQ ID NO: 205331 - DNA, 20 bp, human
ggagtaaagtgtggagtttt

SEQ ID NO: 205332 - DNA, 20 bp, human
gtcaaactccaaaggttcag

SEQ ID NO: 205333 - DNA, 20 bp, human
gccaaaggttcagtggcttt

SEQ ID NO: 205334 - DNA, 20 bp, human
ggagttaaagtttaactccc

SEQ ID NO: 205335 - DNA, 20 bp, human
ggttttagtagattatatct

SEQ ID NO: 205336 - DNA, 20 bp, human
gtctctggaaaggtcattga

SEQ ID NO: 205337 - DNA, 20 bp, human
gagtgagctcttacgggaat

SEQ ID NO: 205338 - DNA, 20 bp, human
ggaggtctctgaacattctc

SEQ ID NO: 205339 - DNA, 20 bp, human
gatgtgagaagcaccataaa

SEQ ID NO: 205340 - DNA, 20 bp, human
gaaggcgttgtgaggagttg

SEQ ID NO: 205341 - DNA, 20 bp, human
ggcgggctaaatagaatccc

SEQ ID NO: 205342 - DNA, 20 bp, human
gggctaaatagaatccctgg

SEQ ID NO: 205343 - DNA, 20 bp, human
gttgtttagagatcttgtgt

SEQ ID NO: 205344 - DNA, 20 bp, human
gaagcttattagctgctgta

SEQ ID NO: 205345 - DNA, 20 bp, human
gcaccataaaaggcgttgtg

SEQ ID NO: 205346 - DNA, 20 bp, human
gctgcctggaacatccatac

SEQ ID NO: 205347 - DNA, 20 bp, human
gaaaactggctgaaccagta

SEQ ID NO: 205348 - DNA, 20 bp, human
ggaaccagtatggatgttcc

SEQ ID NO: 205349 - DNA, 20 bp, human
gtaaccaccaggttaggtgg

SEQ ID NO: 205350 - DNA, 20 bp, human
gcagagctgagtattcataa

SEQ ID NO: 205351 - DNA, 20 bp, human
gggtccaccacctaacctgg

SEQ ID NO: 205352 - DNA, 20 bp, human
gctaacctggtggttacaga

SEQ ID NO: 205353 - DNA, 20 bp, human
gcctggtccaccacctaacc

SEQ ID NO: 205354 - DNA, 20 bp, human
gcatcactgcacaccctacc

SEQ ID NO: 205355 - DNA, 20 bp, human
ggctatagtcagtcacctcc

SEQ ID NO: 205356 - DNA, 20 bp, human
gtgcctgcgagggacctgcc

SEQ ID NO: 205357 - DNA, 20 bp, human
gggtctgagtaggccagttc

SEQ ID NO: 205358 - DNA, 20 bp, human
gcccacaggagcagtcagga

SEQ ID NO: 205359 - DNA, 20 bp, human
gcaggtgattggccccaaaa

SEQ ID NO: 205360 - DNA, 20 bp, human
ggccggggatgcaacctttt

SEQ ID NO: 205361 - DNA, 20 bp, human
gcaggatggactgcctgcga

SEQ ID NO: 205362 - DNA, 20 bp, human
gcaatcacctggaagagggt

SEQ ID NO: 205363 - DNA, 20 bp, human
gggggctggcaacccttttg

SEQ ID NO: 205364 - DNA, 20 bp, human
gtgagtaggccagttctggt

SEQ ID NO: 205365 - DNA, 20 bp, human
gtgcacccacaggagcagtc

SEQ ID NO: 205366 - DNA, 20 bp, human
gccgccccggggagcagcga

SEQ ID NO: 205367 - DNA, 20 bp, human
ggggacccgcagggtaggtc

SEQ ID NO: 205368 - DNA, 20 bp, human
ggggagcgctccctacctgt

SEQ ID NO: 205369 - DNA, 20 bp, human
ggcgctccctacctgttggc

SEQ ID NO: 205370 - DNA, 20 bp, human
gggaccgggacccgcagggt

SEQ ID NO: 205371 - DNA, 20 bp, human
gtggtaacccgtaatactgg

SEQ ID NO: 205372 - DNA, 20 bp, human
gccgtcccgacctaccctgc

SEQ ID NO: 205373 - DNA, 20 bp, human
gcgtaatactggcggcgcgg

SEQ ID NO: 205374 - DNA, 20 bp, human
ggggtcgcggggaccccgca

SEQ ID NO: 205375 - DNA, 20 bp, human
gcgcgccctcgctgctcccc

SEQ ID NO: 205376 - DNA, 20 bp, human
gctcccaaacacagccactt

SEQ ID NO: 205377 - DNA, 20 bp, human
gaatagatccacaaacaggc

SEQ ID NO: 205378 - DNA, 20 bp, human
gacaggcaggattagtgtgt

SEQ ID NO: 205379 - DNA, 20 bp, human
gttcccaagtggctgtgttt

SEQ ID NO: 205380 - DNA, 20 bp, human
gcagccacttgggaacaaga

SEQ ID NO: 205381 - DNA, 20 bp, human
gtttgggagaacttagtaaa

SEQ ID NO: 205382 - DNA, 20 bp, human
gctattatgggggttataaa

SEQ ID NO: 205383 - DNA, 20 bp, human
gttccaactcaacaacacag

SEQ ID NO: 205384 - DNA, 20 bp, human
gtgttgttgagttggaagat

SEQ ID NO: 205385 - DNA, 20 bp, human
gttggctccaaggttatgcc

SEQ ID NO: 205386 - DNA, 20 bp, human
ggtaaccaacggttggccgg

SEQ ID NO: 205387 - DNA, 20 bp, human
gacgtcccccggccaaccgt

SEQ ID NO: 205388 - DNA, 20 bp, human
gacggcgaggcggaactcaa

SEQ ID NO: 205389 - DNA, 20 bp, human
ggggaaaaacagtagtctca

SEQ ID NO: 205390 - DNA, 20 bp, human
gggggcgcaggaagaagctt

SEQ ID NO: 205391 - DNA, 20 bp, human
ggtccgcgctgctccccctc

SEQ ID NO: 205392 - DNA, 20 bp, human
gtagcccgggaaccgagttg

SEQ ID NO: 205393 - DNA, 20 bp, human
gcagcctggtaaccaacggt

SEQ ID NO: 205394 - DNA, 20 bp, human
gaaaagactaacgggaaaga

SEQ ID NO: 205395 - DNA, 20 bp, human
gaggacgagtacgcggtccc

SEQ ID NO: 205396 - DNA, 20 bp, human
gtgagtgcagcgccgctcaa

SEQ ID NO: 205397 - DNA, 20 bp, human
ggcactcagcggagggttac

SEQ ID NO: 205398 - DNA, 20 bp, human
gcggagggttacaggcggga

SEQ ID NO: 205399 - DNA, 20 bp, human
gcggcgctgcactcagcgga

SEQ ID NO: 205400 - DNA, 20 bp, human
gtacacgtgtaggaaacagc

SEQ ID NO: 205401 - DNA, 20 bp, human
gaaggagtgctcgcagccgc

SEQ ID NO: 205402 - DNA, 20 bp, human
gggttacaggcgggagggcg

SEQ ID NO: 205403 - DNA, 20 bp, human
gctccagctccaggtgaggt

SEQ ID NO: 205404 - DNA, 20 bp, human
ggaggggcgctcacgagcct

SEQ ID NO: 205405 - DNA, 20 bp, human
gggggcggggattcgaggcg

SEQ ID NO: 205406 - DNA, 20 bp, human
gaatgagtaataggaaacta

SEQ ID NO: 205407 - DNA, 20 bp, human
gagttgctcacttagtttaa

SEQ ID NO: 205408 - DNA, 20 bp, human
gggaagtggggacggggttt

SEQ ID NO: 205409 - DNA, 20 bp, human
gcccgtcagacccaagtcac

SEQ ID NO: 205410 - DNA, 20 bp, human
gcacttaacatgactgtatc

SEQ ID NO: 205411 - DNA, 20 bp, human
gcatgtattgagtaataact

SEQ ID NO: 205412 - DNA, 20 bp, human
gtttaagggttggcataata

SEQ ID NO: 205413 - DNA, 20 bp, human
gtgacacaaaacgcttctta

SEQ ID NO: 205414 - DNA, 20 bp, human
ggtccccacttcccaatgca

SEQ ID NO: 205415 - DNA, 20 bp, human
gctctgttttcaaagctttt

SEQ ID NO: 205416 - DNA, 20 bp, human
ggggctgatgatggtatcac

SEQ ID NO: 205417 - DNA, 20 bp, human
gagcttccaggcttagtcta

SEQ ID NO: 205418 - DNA, 20 bp, human
gcagatctcataattcatga

SEQ ID NO: 205419 - DNA, 20 bp, human
gttattcagtgctgtcattt

SEQ ID NO: 205420 - DNA, 20 bp, human
gaatttttgtgattgggtgg

SEQ ID NO: 205421 - DNA, 20 bp, human
gataattgcactgagcttcc

SEQ ID NO: 205422 - DNA, 20 bp, human
ggattaaaaaacaaggaatg

SEQ ID NO: 205423 - DNA, 20 bp, human
gagttgttttgggctgatga

SEQ ID NO: 205424 - DNA, 20 bp, human
gcttgtggtgaaacaagttt

SEQ ID NO: 205425 - DNA, 20 bp, human
gtgatattaagtcaaaatcc

SEQ ID NO: 205426 - DNA, 20 bp, human
gtggctggatccggctggat

SEQ ID NO: 205427 - DNA, 20 bp, human
gagaaagtggcccatccagc

SEQ ID NO: 205428 - DNA, 20 bp, human
gtggagttgaatcacagagt

SEQ ID NO: 205429 - DNA, 20 bp, human
gaggatgtggttctaggaca

SEQ ID NO: 205430 - DNA, 20 bp, human
gagttgaatcacagagtcgg

SEQ ID NO: 205431 - DNA, 20 bp, human
gagagtcccagcttacaatc

SEQ ID NO: 205432 - DNA, 20 bp, human
gcccagcccaggtgagtcac

SEQ ID NO: 205433 - DNA, 20 bp, human
ggagtctagccgaggtctag

SEQ ID NO: 205434 - DNA, 20 bp, human
ggctctgggacatcctccac

SEQ ID NO: 205435 - DNA, 20 bp, human
gccgaggtctaggggaagaa

SEQ ID NO: 205436 - DNA, 20 bp, human
gtggcctgacacagcttctc

SEQ ID NO: 205437 - DNA, 20 bp, human
gctgggtccccacattgctt

SEQ ID NO: 205438 - DNA, 20 bp, human
gtctcagggtaagcacaaaa

SEQ ID NO: 205439 - DNA, 20 bp, human
gcccagagagagtgaggtgg

SEQ ID NO: 205440 - DNA, 20 bp, human
gcatcatggggagtcttgga

SEQ ID NO: 205441 - DNA, 20 bp, human
gttgaaagatcaggccctgg

SEQ ID NO: 205442 - DNA, 20 bp, human
gggcccagagggtacatagg

SEQ ID NO: 205443 - DNA, 20 bp, human
ggggttagggaagctagcta

SEQ ID NO: 205444 - DNA, 20 bp, human
ggaagctagctagggagctg

SEQ ID NO: 205445 - DNA, 20 bp, human
ggcacaaaaaggccaatggg

SEQ ID NO: 205446 - DNA, 20 bp, human
gagcgcgcgggaacgagggt

SEQ ID NO: 205447 - DNA, 20 bp, human
gagcccaggggctgaccgag

SEQ ID NO: 205448 - DNA, 20 bp, human
gagtcccagtgactgagagg

SEQ ID NO: 205449 - DNA, 20 bp, human
gaaccatctggcggcgactt

SEQ ID NO: 205450 - DNA, 20 bp, human
gctggcctcctctcagtcac

SEQ ID NO: 205451 - DNA, 20 bp, human
ggacccaagtcgccgccaga

SEQ ID NO: 205452 - DNA, 20 bp, human
gcggcgaggtcaagagtcat

SEQ ID NO: 205453 - DNA, 20 bp, human
ggacttgggtccactgcagg

SEQ ID NO: 205454 - DNA, 20 bp, human
gtcccggctgggcgcagctc

SEQ ID NO: 205455 - DNA, 20 bp, human
gcggcccagaggctagccca

SEQ ID NO: 205456 - DNA, 20 bp, human
gagaaagtaaggtccgtcca

SEQ ID NO: 205457 - DNA, 20 bp, human
gtgactcagctctcagggta

SEQ ID NO: 205458 - DNA, 20 bp, human
gctgtcggagtgaaccccac

SEQ ID NO: 205459 - DNA, 20 bp, human
gggttctgactcagctctca

SEQ ID NO: 205460 - DNA, 20 bp, human
gtgagtcagaaccgcccgtg

SEQ ID NO: 205461 - DNA, 20 bp, human
gcggcgagcaagcattattg

SEQ ID NO: 205462 - DNA, 20 bp, human
gctgtcagcgcggaccgggg

SEQ ID NO: 205463 - DNA, 20 bp, human
gtaggtgagaacatccgctc

SEQ ID NO: 205464 - DNA, 20 bp, human
ggggtgtatgtgtaaaaggt

SEQ ID NO: 205465 - DNA, 20 bp, human
ggttcactccgacagctccc

SEQ ID NO: 205466 - DNA, 20 bp, human
gcgcgcgcggtgttgccatg

SEQ ID NO: 205467 - DNA, 20 bp, human
ggaggcgcggtttccaagca

SEQ ID NO: 205468 - DNA, 20 bp, human
gggagcggaagggggtctag

SEQ ID NO: 205469 - DNA, 20 bp, human
gggaacggctacctccgcgg

SEQ ID NO: 205470 - DNA, 20 bp, human
gacctggcctgttccacgct

SEQ ID NO: 205471 - DNA, 20 bp, human
gtccgctcccagcgtggaac

SEQ ID NO: 205472 - DNA, 20 bp, human
gaggccggagagggcgttct

SEQ ID NO: 205473 - DNA, 20 bp, human
ggggcgttctcggaatgacc

SEQ ID NO: 205474 - DNA, 20 bp, human
ggcaccaaatgggtgagcgt

SEQ ID NO: 205475 - DNA, 20 bp, human
gcggaagggggtctaggggc

SEQ ID NO: 205476 - DNA, 20 bp, human
gccgccccgaggggcacttc

SEQ ID NO: 205477 - DNA, 20 bp, human
gcggctccatccacccaacc

SEQ ID NO: 205478 - DNA, 20 bp, human
ggccgccggaagtgcccctc

SEQ ID NO: 205479 - DNA, 20 bp, human
gccggcggcggttcacttcc

SEQ ID NO: 205480 - DNA, 20 bp, human
gcctcgccgcgccgccccga

SEQ ID NO: 205481 - DNA, 20 bp, human
gaccgcgagaagaggactgg

SEQ ID NO: 205482 - DNA, 20 bp, human
gggcggttcacttcctggtt

SEQ ID NO: 205483 - DNA, 20 bp, human
gccccgaggggcacttccgg

SEQ ID NO: 205484 - DNA, 20 bp, human
gagaacggcggttgcaggag

SEQ ID NO: 205485 - DNA, 20 bp, human
gagggtggaacatacagcgg

SEQ ID NO: 205486 - DNA, 20 bp, human
ggaggcagtggcaagcccga

SEQ ID NO: 205487 - DNA, 20 bp, human
gaaagagggcggaaagtgaa

SEQ ID NO: 205488 - DNA, 20 bp, human
gaatgaaaacaagggaagcg

SEQ ID NO: 205489 - DNA, 20 bp, human
ggatcccagcgtctcaggga

SEQ ID NO: 205490 - DNA, 20 bp, human
gacaggaggcgctctcaagt

SEQ ID NO: 205491 - DNA, 20 bp, human
gtgccactgcctcgtgtgac

SEQ ID NO: 205492 - DNA, 20 bp, human
gggaaagtgaaaggcgccga

SEQ ID NO: 205493 - DNA, 20 bp, human
gcgatcccacaatacatcgg

SEQ ID NO: 205494 - DNA, 20 bp, human
ggagacgctgggatccgcag

SEQ ID NO: 205495 - DNA, 20 bp, human
gcgggccgccgatgtattgt

SEQ ID NO: 205496 - DNA, 20 bp, human
gcgcgcctccggggtctcct

SEQ ID NO: 205497 - DNA, 20 bp, human
gacagagcggcattggaaga

SEQ ID NO: 205498 - DNA, 20 bp, human
gtgactccgcccccaactgg

SEQ ID NO: 205499 - DNA, 20 bp, human
gaccaatcacagagcggcat

SEQ ID NO: 205500 - DNA, 20 bp, human
ggttcggccaatagctacga

SEQ ID NO: 205501 - DNA, 20 bp, human
gaggaagagcgacggccgtt

SEQ ID NO: 205502 - DNA, 20 bp, human
gtccccagcaggaagagcga

SEQ ID NO: 205503 - DNA, 20 bp, human
gggccaatagctacgaaggt

SEQ ID NO: 205504 - DNA, 20 bp, human
ggtcaggtggggcggagttt

SEQ ID NO: 205505 - DNA, 20 bp, human
gcccggcaggaagtaggcgt

SEQ ID NO: 205506 - DNA, 20 bp, human
ggcacagaagggattaccag

SEQ ID NO: 205507 - DNA, 20 bp, human
gtgaagggaaacgtcagctc

SEQ ID NO: 205508 - DNA, 20 bp, human
gacaagcccacctcttatgt

SEQ ID NO: 205509 - DNA, 20 bp, human
gctccccccacataagaggt

SEQ ID NO: 205510 - DNA, 20 bp, human
gcggcccctgccttgctgaa

SEQ ID NO: 205511 - DNA, 20 bp, human
gctctcgagctatcccaggc

SEQ ID NO: 205512 - DNA, 20 bp, human
gcagcctgtggtgctgttag

SEQ ID NO: 205513 - DNA, 20 bp, human
ggtttggggaagagagcgtg

SEQ ID NO: 205514 - DNA, 20 bp, human
gcaagactccgagggacaga

SEQ ID NO: 205515 - DNA, 20 bp, human
gaggcaggatgacgccagca

SEQ ID NO: 205516 - DNA, 20 bp, human
gcggcagagccctgggtcgc

SEQ ID NO: 205517 - DNA, 20 bp, human
gtggggcgaggcggtgagtg

SEQ ID NO: 205518 - DNA, 20 bp, human
gccctgggtcgcgggaagaa

SEQ ID NO: 205519 - DNA, 20 bp, human
gggtcactaaagcacagcca

SEQ ID NO: 205520 - DNA, 20 bp, human
gcgtctgactggagcgacgg

SEQ ID NO: 205521 - DNA, 20 bp, human
gccaccagccatcttacttt

SEQ ID NO: 205522 - DNA, 20 bp, human
gctgtgaccgggatagagac

SEQ ID NO: 205523 - DNA, 20 bp, human
gcggtacagcggaaacgcac

SEQ ID NO: 205524 - DNA, 20 bp, human
gtggcgtctgactggagcga

SEQ ID NO: 205525 - DNA, 20 bp, human
gtgtaccggaacgtggggcg

SEQ ID NO: 205526 - DNA, 20 bp, human
ggctaatggaggactaagat

SEQ ID NO: 205527 - DNA, 20 bp, human
gcgggggcggaggtaattca

SEQ ID NO: 205528 - DNA, 20 bp, human
gcccgcgtgcgacttcttcg

SEQ ID NO: 205529 - DNA, 20 bp, human
ggctggaggacctcagacga

SEQ ID NO: 205530 - DNA, 20 bp, human
gaggcggttcccataactcc

SEQ ID NO: 205531 - DNA, 20 bp, human
gtaaacttctcctggagtta

SEQ ID NO: 205532 - DNA, 20 bp, human
gaagtccccggggcccatcg

SEQ ID NO: 205533 - DNA, 20 bp, human
gtaagtggaagttgaggtac

SEQ ID NO: 205534 - DNA, 20 bp, human
gctgcagcggcggaagtccc

SEQ ID NO: 205535 - DNA, 20 bp, human
gaaggagcgtctctgaatgg

SEQ ID NO: 205536 - DNA, 20 bp, human
gtgggaaggcggctctaact

SEQ ID NO: 205537 - DNA, 20 bp, human
gccaggaatccactaatgaa

SEQ ID NO: 205538 - DNA, 20 bp, human
gctcccggaggtcgacattt

SEQ ID NO: 205539 - DNA, 20 bp, human
ggattcgtcctcagtttgac

SEQ ID NO: 205540 - DNA, 20 bp, human
gggacgaatccgttcattag

SEQ ID NO: 205541 - DNA, 20 bp, human
ggcggcggggcactttccgt

SEQ ID NO: 205542 - DNA, 20 bp, human
gtgcaactgcgagaaaaggt

SEQ ID NO: 205543 - DNA, 20 bp, human
gctgatgcaactgcgagaaa

SEQ ID NO: 205544 - DNA, 20 bp, human
gttacctcatgagatattat

SEQ ID NO: 205545 - DNA, 20 bp, human
gtgtggtaggtcgtggtctg

SEQ ID NO: 205546 - DNA, 20 bp, human
gggggtggaagcgatcgatt

SEQ ID NO: 205547 - DNA, 20 bp, human
gggcggtaggaggactcagg

SEQ ID NO: 205548 - DNA, 20 bp, human
gggccgctgtaggaaacgcc

SEQ ID NO: 205549 - DNA, 20 bp, human
gaagcgatcgattgggtcgc

SEQ ID NO: 205550 - DNA, 20 bp, human
gtacagcggcccctggcggt

SEQ ID NO: 205551 - DNA, 20 bp, human
gcgtggtcaaagagtgacga

SEQ ID NO: 205552 - DNA, 20 bp, human
gggtaggaggactcaggggg

SEQ ID NO: 205553 - DNA, 20 bp, human
ggtcaaagagtgacgaggga

SEQ ID NO: 205554 - DNA, 20 bp, human
gtcgatcgcttccaccccgg

SEQ ID NO: 205555 - DNA, 20 bp, human
gagtaggctcttaattcatt

SEQ ID NO: 205556 - DNA, 20 bp, human
gagcgaacggagagcgacgt

SEQ ID NO: 205557 - DNA, 20 bp, human
ggcgcagaagcaggagggta

SEQ ID NO: 205558 - DNA, 20 bp, human
gacatccctggggccccaag

SEQ ID NO: 205559 - DNA, 20 bp, human
ggtgggacaaacgtcatcaa

SEQ ID NO: 205560 - DNA, 20 bp, human
gcccagggatgtaagtattc

SEQ ID NO: 205561 - DNA, 20 bp, human
gggcggggacgggactggca

SEQ ID NO: 205562 - DNA, 20 bp, human
gtaaggaatggaatgcggtt

SEQ ID NO: 205563 - DNA, 20 bp, human
gaatcccagcgcatagaggc

SEQ ID NO: 205564 - DNA, 20 bp, human
gaaaaaacgcgacctggaca

SEQ ID NO: 205565 - DNA, 20 bp, human
gtaaaccacgtgccttgtcc

SEQ ID NO: 205566 - DNA, 20 bp, human
gtccctgtgtgtagcgtcta

SEQ ID NO: 205567 - DNA, 20 bp, human
ggccctagacgctacacaca

SEQ ID NO: 205568 - DNA, 20 bp, human
gtctgaagaccccacggtga

SEQ ID NO: 205569 - DNA, 20 bp, human
gtgccctggttccagcagat

SEQ ID NO: 205570 - DNA, 20 bp, human
gctccagagtgcagatccct

SEQ ID NO: 205571 - DNA, 20 bp, human
gttccccgggaatttaattc

SEQ ID NO: 205572 - DNA, 20 bp, human
gaagatggcggctgtcgaag

SEQ ID NO: 205573 - DNA, 20 bp, human
gaggaagagagaacatgacc

SEQ ID NO: 205574 - DNA, 20 bp, human
gaacccatctgctggaacca

SEQ ID NO: 205575 - DNA, 20 bp, human
gaaacaggtgaatgataccg

SEQ ID NO: 205576 - DNA, 20 bp, human
gagtgcgagcgaccccgggc

SEQ ID NO: 205577 - DNA, 20 bp, human
gagcgcctcggcttcaggag

SEQ ID NO: 205578 - DNA, 20 bp, human
gtcgcgcatggtctcggaca

SEQ ID NO: 205579 - DNA, 20 bp, human
ggacgcggaagatttacgta

SEQ ID NO: 205580 - DNA, 20 bp, human
ggagaccatgcgcgacccca

SEQ ID NO: 205581 - DNA, 20 bp, human
gggcaagtacgaaagggtta

SEQ ID NO: 205582 - DNA, 20 bp, human
gggcgctaacttgagtgaag

SEQ ID NO: 205583 - DNA, 20 bp, human
gagcgccagctccacgcagc

SEQ ID NO: 205584 - DNA, 20 bp, human
gagaataaaaacatcaccta

SEQ ID NO: 205585 - DNA, 20 bp, human
gagctccacgcagccggccc

SEQ ID NO: 205586 - DNA, 20 bp, human
gaggcttcggaggcgagcga

SEQ ID NO: 205587 - DNA, 20 bp, human
gtctcggagaaagcagctgg

SEQ ID NO: 205588 - DNA, 20 bp, human
gcaagtaggcgaggcttcgg

SEQ ID NO: 205589 - DNA, 20 bp, human
gagtcgggggcgggctggga

SEQ ID NO: 205590 - DNA, 20 bp, human
gcgagcgaagggcgggacca

SEQ ID NO: 205591 - DNA, 20 bp, human
ggaggaggtggctgagtcgg

SEQ ID NO: 205592 - DNA, 20 bp, human
gtgtgagtggcgtaactgtc

SEQ ID NO: 205593 - DNA, 20 bp, human
gcgtcaagtaggcgaggctt

SEQ ID NO: 205594 - DNA, 20 bp, human
gtcccggcgtccgtgcgcag

SEQ ID NO: 205595 - DNA, 20 bp, human
gctccctgcctccagaggac

SEQ ID NO: 205596 - DNA, 20 bp, human
gcagagacagaaggatcttg

SEQ ID NO: 205597 - DNA, 20 bp, human
gatgagaaggttgttccctc

SEQ ID NO: 205598 - DNA, 20 bp, human
gccgggcatgacgtagcaac

SEQ ID NO: 205599 - DNA, 20 bp, human
ggctgctgattggctacggg

SEQ ID NO: 205600 - DNA, 20 bp, human
gcaatcagcagccgccctga

SEQ ID NO: 205601 - DNA, 20 bp, human
ggaaggttgttccctcaggg

SEQ ID NO: 205602 - DNA, 20 bp, human
gtgggacgtcgagttctccc

SEQ ID NO: 205603 - DNA, 20 bp, human
gacgtcccagctaagaacgc

SEQ ID NO: 205604 - DNA, 20 bp, human
gaactggcagcgccgccgat

SEQ ID NO: 205605 - DNA, 20 bp, human
gtctgacctgcgttcttagc

SEQ ID NO: 205606 - DNA, 20 bp, human
ggaagcgcgcagaaggttga

SEQ ID NO: 205607 - DNA, 20 bp, human
gcgtgcgagtgcgcgggaag

SEQ ID NO: 205608 - DNA, 20 bp, human
gggcgttgctagcatgaagg

SEQ ID NO: 205609 - DNA, 20 bp, human
gcgtgcgcgtgcgagtgcgc

SEQ ID NO: 205610 - DNA, 20 bp, human
ggaagggattggagccgtat

SEQ ID NO: 205611 - DNA, 20 bp, human
gaacgcccgcagtgacgcgc

SEQ ID NO: 205612 - DNA, 20 bp, human
gggatcaaggcgagaggatc

SEQ ID NO: 205613 - DNA, 20 bp, human
gacgcgcacacgcgcccata

SEQ ID NO: 205614 - DNA, 20 bp, human
ggagtcggggaatcggatca

SEQ ID NO: 205615 - DNA, 20 bp, human
ggcgggcgttgctagcatga

SEQ ID NO: 205616 - DNA, 20 bp, human
gacacagaagggggcttgga

SEQ ID NO: 205617 - DNA, 20 bp, human
gagcggggatggcacggagt

SEQ ID NO: 205618 - DNA, 20 bp, human
gcccaccggtgcgggctctg

SEQ ID NO: 205619 - DNA, 20 bp, human
gacacggaggggaggcatgg

SEQ ID NO: 205620 - DNA, 20 bp, human
gcatggggggagcacggaga

SEQ ID NO: 205621 - DNA, 20 bp, human
gcacggagagggggacacgg

SEQ ID NO: 205622 - DNA, 20 bp, human
gcggcggcctggggctgagg

SEQ ID NO: 205623 - DNA, 20 bp, human
ggggaaacggaagtcgtgaa

SEQ ID NO: 205624 - DNA, 20 bp, human
ggaacccgggagcacaccca

SEQ ID NO: 205625 - DNA, 20 bp, human
gcggagtgggggacacagaa

SEQ ID NO: 205626 - DNA, 20 bp, human
gcccaccagagggaccgcga

SEQ ID NO: 205627 - DNA, 20 bp, human
ggggcagagtccagcctccg

SEQ ID NO: 205628 - DNA, 20 bp, human
gccgtggcgggcgcacccat

SEQ ID NO: 205629 - DNA, 20 bp, human
gaggacccccgtcaagttgt

SEQ ID NO: 205630 - DNA, 20 bp, human
gcgggccaccgcccccagga

SEQ ID NO: 205631 - DNA, 20 bp, human
gccagccctcgcggtccctc

SEQ ID NO: 205632 - DNA, 20 bp, human
gggtccccacaacttgacgg

SEQ ID NO: 205633 - DNA, 20 bp, human
gtgtggggaccctgaccctc

SEQ ID NO: 205634 - DNA, 20 bp, human
gactggggaggagacggctg

SEQ ID NO: 205635 - DNA, 20 bp, human
gtcggcggagccagggagtc

SEQ ID NO: 205636 - DNA, 20 bp, human
ggggttggggaggaacctac

SEQ ID NO: 205637 - DNA, 20 bp, human
ggcggggtcaggtggagcgt

SEQ ID NO: 205638 - DNA, 20 bp, human
ggggacaaagcagaaatccc

SEQ ID NO: 205639 - DNA, 20 bp, human
gcgggcttcagattcctaaa

SEQ ID NO: 205640 - DNA, 20 bp, human
gaggctcaggaacccctgaa

SEQ ID NO: 205641 - DNA, 20 bp, human
gtccacctgaccccgcctcg

SEQ ID NO: 205642 - DNA, 20 bp, human
gggagatagcctattttaca

SEQ ID NO: 205643 - DNA, 20 bp, human
gcaacccccgaggcggggtc

SEQ ID NO: 205644 - DNA, 20 bp, human
gcggagccccgtcatggctg

SEQ ID NO: 205645 - DNA, 20 bp, human
gcagcttggtttaagccaga

SEQ ID NO: 205646 - DNA, 20 bp, human
gtccctagatgtgtcgtggg

SEQ ID NO: 205647 - DNA, 20 bp, human
gcggggcccgccccttaaac

SEQ ID NO: 205648 - DNA, 20 bp, human
gaactccctagatgtgtcgt

SEQ ID NO: 205649 - DNA, 20 bp, human
ggactgaactacataaacag

SEQ ID NO: 205650 - DNA, 20 bp, human
ggccgcccacgacacatcta

SEQ ID NO: 205651 - DNA, 20 bp, human
ggacacatctagggagttgg

SEQ ID NO: 205652 - DNA, 20 bp, human
ggctgaacgtcgcccgttta

SEQ ID NO: 205653 - DNA, 20 bp, human
gcagaaagcacgtggagccg

SEQ ID NO: 205654 - DNA, 20 bp, human
gtaaacagaggccgggaacg

SEQ ID NO: 205655 - DNA, 20 bp, human
ggggtacagcaggtgtctta

SEQ ID NO: 205656 - DNA, 20 bp, human
gagagagtgtaatgaattgt

SEQ ID NO: 205657 - DNA, 20 bp, human
gtctgaagagtaactggaca

SEQ ID NO: 205658 - DNA, 20 bp, human
gtcagatgaaactttctcat

SEQ ID NO: 205659 - DNA, 20 bp, human
ggtactagaaagtgttctaa

SEQ ID NO: 205660 - DNA, 20 bp, human
gatgagtccagaatagtatc

SEQ ID NO: 205661 - DNA, 20 bp, human
gtaaacaaatttgaaaggtg

SEQ ID NO: 205662 - DNA, 20 bp, human
gttaactaccactatgaaaa

SEQ ID NO: 205663 - DNA, 20 bp, human
gtggagtccagatactattc

SEQ ID NO: 205664 - DNA, 20 bp, human
gccacatatttacaattgca

SEQ ID NO: 205665 - DNA, 20 bp, human
gataggaattagtgaataca

SEQ ID NO: 205666 - DNA, 20 bp, human
gagagcatttcacagacact

SEQ ID NO: 205667 - DNA, 20 bp, human
ggatgcgtcacagggactag

SEQ ID NO: 205668 - DNA, 20 bp, human
ggtctgctctagcagaggca

SEQ ID NO: 205669 - DNA, 20 bp, human
gttgggggaagaaactatgt

SEQ ID NO: 205670 - DNA, 20 bp, human
gtgtgatgaaaggtgggacc

SEQ ID NO: 205671 - DNA, 20 bp, human
gcgtcacagggactaggggg

SEQ ID NO: 205672 - DNA, 20 bp, human
gcccatcattagatatacta

SEQ ID NO: 205673 - DNA, 20 bp, human
gttatagtgaaaggggacac

SEQ ID NO: 205674 - DNA, 20 bp, human
gctgcactggatgcgtcaca

SEQ ID NO: 205675 - DNA, 20 bp, human
ggagaacatgtcacctgcac

SEQ ID NO: 205676 - DNA, 20 bp, human
gtgcccgagaaagtccctga

SEQ ID NO: 205677 - DNA, 20 bp, human
ggaagcagtgttggtgtctg

SEQ ID NO: 205678 - DNA, 20 bp, human
ggtgatgcaagagagattac

SEQ ID NO: 205679 - DNA, 20 bp, human
gcagcagatgccgaacaaga

SEQ ID NO: 205680 - DNA, 20 bp, human
ggtcgcacagatcagttctg

SEQ ID NO: 205681 - DNA, 20 bp, human
gttctgtgggttctcggaaa

SEQ ID NO: 205682 - DNA, 20 bp, human
gtctgggggagtttggggaa

SEQ ID NO: 205683 - DNA, 20 bp, human
gagctgttcagtgtttcagg

SEQ ID NO: 205684 - DNA, 20 bp, human
gtgtgggttctcggaaaggg

SEQ ID NO: 205685 - DNA, 20 bp, human
gaaggagaagtatgaagtgc

SEQ ID NO: 205686 - DNA, 20 bp, human
ggccgcgcccgggaccgacc

SEQ ID NO: 205687 - DNA, 20 bp, human
gtcgggcccgggtcggtccc

SEQ ID NO: 205688 - DNA, 20 bp, human
gggcggcgcgcgcagggtct

SEQ ID NO: 205689 - DNA, 20 bp, human
gagggtcccccggcctacga

SEQ ID NO: 205690 - DNA, 20 bp, human
gggccagctcacccccgtaa

SEQ ID NO: 205691 - DNA, 20 bp, human
gggcgcagccggatgcctct

SEQ ID NO: 205692 - DNA, 20 bp, human
gggcagagtcgctgtcgccg

SEQ ID NO: 205693 - DNA, 20 bp, human
gtccgggacccgatccgcgc

SEQ ID NO: 205694 - DNA, 20 bp, human
gcggggtctcggattcgatg

SEQ ID NO: 205695 - DNA, 20 bp, human
ggagcgcggcgcctttaagc

SEQ ID NO: 205696 - DNA, 20 bp, human
ggggcatgggcgacatgcag

SEQ ID NO: 205697 - DNA, 20 bp, human
gtgcgaaccgcgtactcgca

SEQ ID NO: 205698 - DNA, 20 bp, human
gcagccaccctgcgagtacg

SEQ ID NO: 205699 - DNA, 20 bp, human
gaggccaccgcgccctcgct

SEQ ID NO: 205700 - DNA, 20 bp, human
gcagagcagtgcgcaagcac

SEQ ID NO: 205701 - DNA, 20 bp, human
gcgcgccccctgctggacat

SEQ ID NO: 205702 - DNA, 20 bp, human
ggtcgcccatgcccggcaga

SEQ ID NO: 205703 - DNA, 20 bp, human
gaccgcgcaggcgcggggtt

SEQ ID NO: 205704 - DNA, 20 bp, human
gcgagtacgcggttcgcacc

SEQ ID NO: 205705 - DNA, 20 bp, human
gagcggcggtagccgagcga

SEQ ID NO: 205706 - DNA, 20 bp, human
gcatgagaggggttcctgag

SEQ ID NO: 205707 - DNA, 20 bp, human
ggaggaggccgacactgtgt

SEQ ID NO: 205708 - DNA, 20 bp, human
gtaagcccttagttggggag

SEQ ID NO: 205709 - DNA, 20 bp, human
gaccagggaaattgaggtgg

SEQ ID NO: 205710 - DNA, 20 bp, human
ggcctcctctccccaactaa

SEQ ID NO: 205711 - DNA, 20 bp, human
gacacataagcccttagttg

SEQ ID NO: 205712 - DNA, 20 bp, human
gttgaggtgggggatgcaat

SEQ ID NO: 205713 - DNA, 20 bp, human
gtgagtcgattggacttaaa

SEQ ID NO: 205714 - DNA, 20 bp, human
gaagggagccaacacagtgt

SEQ ID NO: 205715 - DNA, 20 bp, human
gacctaaagacatccccctc

SEQ ID NO: 205716 - DNA, 20 bp, human
gcggaagaggagagcggctg

SEQ ID NO: 205717 - DNA, 20 bp, human
gaaagcgccgctccgcgtac

SEQ ID NO: 205718 - DNA, 20 bp, human
gcccctgagccactagagtc

SEQ ID NO: 205719 - DNA, 20 bp, human
ggcagagcgcacctgagggc

SEQ ID NO: 205720 - DNA, 20 bp, human
gctcctgcagagcgcacctg

SEQ ID NO: 205721 - DNA, 20 bp, human
gtctgaagcgcgcccgtacg

SEQ ID NO: 205722 - DNA, 20 bp, human
gaggaggcggggcgcgactt

SEQ ID NO: 205723 - DNA, 20 bp, human
gccagctgggatctgtgcga

SEQ ID NO: 205724 - DNA, 20 bp, human
gacgcggagcggcgctttct

SEQ ID NO: 205725 - DNA, 20 bp, human
gggcccgactctagtggctc

SEQ ID NO: 205726 - DNA, 20 bp, human
gttcaactacagggataagg

SEQ ID NO: 205727 - DNA, 20 bp, human
gcaaggaaatgactgttccg

SEQ ID NO: 205728 - DNA, 20 bp, human
gagggggaaaacggtaaaca

SEQ ID NO: 205729 - DNA, 20 bp, human
ggaaatgactgttccgtggt

SEQ ID NO: 205730 - DNA, 20 bp, human
ggactgttccgtggttggtt

SEQ ID NO: 205731 - DNA, 20 bp, human
gcctttcaactacagggata

SEQ ID NO: 205732 - DNA, 20 bp, human
gcacttagcctttcaactac

SEQ ID NO: 205733 - DNA, 20 bp, human
gcatcatgtacagcttggtc

SEQ ID NO: 205734 - DNA, 20 bp, human
ggtagacctgggcaaaccac

SEQ ID NO: 205735 - DNA, 20 bp, human
gcttgcagaataattggctt

SEQ ID NO: 205736 - DNA, 20 bp, human
ggagcaggccagtgagtgac

SEQ ID NO: 205737 - DNA, 20 bp, human
gtcggagctgcgcgggccaa

SEQ ID NO: 205738 - DNA, 20 bp, human
gcctagccgggtttcttaaa

SEQ ID NO: 205739 - DNA, 20 bp, human
gcgacctgcccgtcactcac

SEQ ID NO: 205740 - DNA, 20 bp, human
ggaggagacgggatcacaga

SEQ ID NO: 205741 - DNA, 20 bp, human
ggcgcagcctcgttcccgga

SEQ ID NO: 205742 - DNA, 20 bp, human
gtgctccgtcggagctgcgc

SEQ ID NO: 205743 - DNA, 20 bp, human
gaggccgccctccgggaacg

SEQ ID NO: 205744 - DNA, 20 bp, human
ggcctctgcacgctgctatt

SEQ ID NO: 205745 - DNA, 20 bp, human
ggggtggcggagtgcccggc

SEQ ID NO: 205746 - DNA, 20 bp, human
gtcggtccctggaggattag

SEQ ID NO: 205747 - DNA, 20 bp, human
gaggactgtcgctctgagca

SEQ ID NO: 205748 - DNA, 20 bp, human
gtaagcccaaactcggtccc

SEQ ID NO: 205749 - DNA, 20 bp, human
gagccgtcctcgcatctgat

SEQ ID NO: 205750 - DNA, 20 bp, human
gaagaggctccgctacccca

SEQ ID NO: 205751 - DNA, 20 bp, human
gaggggtggagtaaaccaat

SEQ ID NO: 205752 - DNA, 20 bp, human
ggcccaaactcggtccctgg

SEQ ID NO: 205753 - DNA, 20 bp, human
gaaagcgttaagcccaaact

SEQ ID NO: 205754 - DNA, 20 bp, human
gtcctccagggaccgagttt

SEQ ID NO: 205755 - DNA, 20 bp, human
gcagatgcgaggacggctgc

SEQ ID NO: 205756 - DNA, 20 bp, human
ggagcagtggcatttatact

SEQ ID NO: 205757 - DNA, 20 bp, human
gatgacgtgaatgtgatgtt

SEQ ID NO: 205758 - DNA, 20 bp, human
gcctggctatatcatattat

SEQ ID NO: 205759 - DNA, 20 bp, human
gaagactgctttcagagtgg

SEQ ID NO: 205760 - DNA, 20 bp, human
gacattcacgtcatcatgct

SEQ ID NO: 205761 - DNA, 20 bp, human
ggtgaagactgctttcagag

SEQ ID NO: 205762 - DNA, 20 bp, human
gattaagcagactagagctc

SEQ ID NO: 205763 - DNA, 20 bp, human
gtttacgtccaagattattg

SEQ ID NO: 205764 - DNA, 20 bp, human
ggtattagccacaataatct

SEQ ID NO: 205765 - DNA, 20 bp, human
ggcatttatactgggttgcc

SEQ ID NO: 205766 - DNA, 20 bp, human
gtccctgctgagtaactagc

SEQ ID NO: 205767 - DNA, 20 bp, human
ggagcagaagatattttggc

SEQ ID NO: 205768 - DNA, 20 bp, human
gagaaaggctagattctcct

SEQ ID NO: 205769 - DNA, 20 bp, human
ggggagtttgtagttgcaga

SEQ ID NO: 205770 - DNA, 20 bp, human
gaactgagaccagattctcc

SEQ ID NO: 205771 - DNA, 20 bp, human
gggggtcaactctcccatta

SEQ ID NO: 205772 - DNA, 20 bp, human
gaagcaatgtaattttcttc

SEQ ID NO: 205773 - DNA, 20 bp, human
gtgaaaagaccgattgagaa

SEQ ID NO: 205774 - DNA, 20 bp, human
ggttctgctctactcttctc

SEQ ID NO: 205775 - DNA, 20 bp, human
ggctctactcttctctggat

SEQ ID NO: 205776 - DNA, 20 bp, human
gcgaagagttacatggctta

SEQ ID NO: 205777 - DNA, 20 bp, human
gagttacatggcttagggat

SEQ ID NO: 205778 - DNA, 20 bp, human
gggaggagctacatgaacta

SEQ ID NO: 205779 - DNA, 20 bp, human
gtccacccaaacttatcctt

SEQ ID NO: 205780 - DNA, 20 bp, human
gaaaacccaaggataagttt

SEQ ID NO: 205781 - DNA, 20 bp, human
gaaaacctcgaagagttaca

SEQ ID NO: 205782 - DNA, 20 bp, human
ggagctacatgaactaaggc

SEQ ID NO: 205783 - DNA, 20 bp, human
gtacatgaactaaggcaggc

SEQ ID NO: 205784 - DNA, 20 bp, human
gtagctcctcctctggtact

SEQ ID NO: 205785 - DNA, 20 bp, human
gtggctaaacttctcaactc

SEQ ID NO: 205786 - DNA, 20 bp, human
ggcaccgcgcggacgaggat

SEQ ID NO: 205787 - DNA, 20 bp, human
ggggtgcaggcacgataagg

SEQ ID NO: 205788 - DNA, 20 bp, human
gagctgcagtccccggagtg

SEQ ID NO: 205789 - DNA, 20 bp, human
ggcctctccgccccactccg

SEQ ID NO: 205790 - DNA, 20 bp, human
gcgcgcggacgaggatgggg

SEQ ID NO: 205791 - DNA, 20 bp, human
gcgagggtgcaggcacgata

SEQ ID NO: 205792 - DNA, 20 bp, human
gcggcccggccccgagcaaa

SEQ ID NO: 205793 - DNA, 20 bp, human
gtgcagggagggcacccgag

SEQ ID NO: 205794 - DNA, 20 bp, human
ggggttgggggcgctcggaa

SEQ ID NO: 205795 - DNA, 20 bp, human
ggcaaagggcgtggacgcgg

SEQ ID NO: 205796 - DNA, 20 bp, human
gtgcttgggaaaccctctga

SEQ ID NO: 205797 - DNA, 20 bp, human
gccaaacacagagtgtgctt

SEQ ID NO: 205798 - DNA, 20 bp, human
gggtgaatcagcaatttcca

SEQ ID NO: 205799 - DNA, 20 bp, human
gaccctctgagggtgtcaac

SEQ ID NO: 205800 - DNA, 20 bp, human
gtgggatagcctgaattcca

SEQ ID NO: 205801 - DNA, 20 bp, human
gtgagggtgtcaacaggcct

SEQ ID NO: 205802 - DNA, 20 bp, human
gtacaggcctgtaaaaaata

SEQ ID NO: 205803 - DNA, 20 bp, human
gtgtgcttgggctgccctta

SEQ ID NO: 205804 - DNA, 20 bp, human
gcatctggatcctgcaacca

SEQ ID NO: 205805 - DNA, 20 bp, human
ggcctgtaaaaaataagggt

SEQ ID NO: 205806 - DNA, 20 bp, human
ggatgactgtcacaccccat

SEQ ID NO: 205807 - DNA, 20 bp, human
gcctggcccgcgcctagcct

SEQ ID NO: 205808 - DNA, 20 bp, human
ggccctcgccctggctgcaa

SEQ ID NO: 205809 - DNA, 20 bp, human
gctctccccaggctaggcgc

SEQ ID NO: 205810 - DNA, 20 bp, human
gcggcgggagctgctctcgc

SEQ ID NO: 205811 - DNA, 20 bp, human
gccagaaccagcccggtcgc

SEQ ID NO: 205812 - DNA, 20 bp, human
gaccgttgcagccagggcga

SEQ ID NO: 205813 - DNA, 20 bp, human
gaacgcctaccgttgcagcc

SEQ ID NO: 205814 - DNA, 20 bp, human
gtgtctcttaagtgctaaga

SEQ ID NO: 205815 - DNA, 20 bp, human
gcccaaggagcataatgtga

SEQ ID NO: 205816 - DNA, 20 bp, human
gtcaccatggggtttataca

SEQ ID NO: 205817 - DNA, 20 bp, human
ggggagtgcaactcaccatg

SEQ ID NO: 205818 - DNA, 20 bp, human
gaggggtcacccaacaagga

SEQ ID NO: 205819 - DNA, 20 bp, human
gttcaaggggtcacccaaca

SEQ ID NO: 205820 - DNA, 20 bp, human
ggtaagagctcctagcttga

SEQ ID NO: 205821 - DNA, 20 bp, human
gtgaccatgtataaacccca

SEQ ID NO: 205822 - DNA, 20 bp, human
gttgcactcccctccttgtt

SEQ ID NO: 205823 - DNA, 20 bp, human
gcttgtggttatcacatgct

SEQ ID NO: 205824 - DNA, 20 bp, human
gcccagccacacataaattg

SEQ ID NO: 205825 - DNA, 20 bp, human
gttatgtgtggctgggtatc

SEQ ID NO: 205826 - DNA, 20 bp, human
gcctgggcacgtgaccaagc

SEQ ID NO: 205827 - DNA, 20 bp, human
gcccgagccaggattccgtg

SEQ ID NO: 205828 - DNA, 20 bp, human
gtagagaagcagagccggct

SEQ ID NO: 205829 - DNA, 20 bp, human
gtggccaaatgtctccgagg

SEQ ID NO: 205830 - DNA, 20 bp, human
gcaaattagagaagcagagc

SEQ ID NO: 205831 - DNA, 20 bp, human
gcaacaccgagcattcccgt

SEQ ID NO: 205832 - DNA, 20 bp, human
gctcccccctcggagacatt

SEQ ID NO: 205833 - DNA, 20 bp, human
gccgacccacagttccgtgg

SEQ ID NO: 205834 - DNA, 20 bp, human
gtcgtcagatttcccgccct

SEQ ID NO: 205835 - DNA, 20 bp, human
gccgagccacgattccgtgg

SEQ ID NO: 205836 - DNA, 20 bp, human
ggacactggcggactgaatt

SEQ ID NO: 205837 - DNA, 20 bp, human
gagaatccatttccggtctg

SEQ ID NO: 205838 - DNA, 20 bp, human
gcagggccccagaccggaaa

SEQ ID NO: 205839 - DNA, 20 bp, human
ggaggattatgggacactgg

SEQ ID NO: 205840 - DNA, 20 bp, human
gggggagcgtgacattgagt

SEQ ID NO: 205841 - DNA, 20 bp, human
gagtgttactccaatattcc

SEQ ID NO: 205842 - DNA, 20 bp, human
gtcctcttcttgttttccca

SEQ ID NO: 205843 - DNA, 20 bp, human
gcaatcaaagctcggcccta

SEQ ID NO: 205844 - DNA, 20 bp, human
gaattgaaacttaactaggt

SEQ ID NO: 205845 - DNA, 20 bp, human
gtatttcatctggcaactcc

SEQ ID NO: 205846 - DNA, 20 bp, human
ggaaaatggcccgaggtcgg

SEQ ID NO: 205847 - DNA, 20 bp, human
gtcggctccgcccagagcag

SEQ ID NO: 205848 - DNA, 20 bp, human
gccagtcgggccacaccctt

SEQ ID NO: 205849 - DNA, 20 bp, human
gaaggcgcgagggggttgtc

SEQ ID NO: 205850 - DNA, 20 bp, human
ggggtgacgtccaaagggtg

SEQ ID NO: 205851 - DNA, 20 bp, human
gggctccgggtgacgtccaa

SEQ ID NO: 205852 - DNA, 20 bp, human
gcgactggccctccaagcta

SEQ ID NO: 205853 - DNA, 20 bp, human
gtgggaaaatggcccgaggt

SEQ ID NO: 205854 - DNA, 20 bp, human
ggggacatctgtcacgtgaa

SEQ ID NO: 205855 - DNA, 20 bp, human
gcggagcccacaggagcacc

SEQ ID NO: 205856 - DNA, 20 bp, human
ggaagcctccgggtggggac

SEQ ID NO: 205857 - DNA, 20 bp, human
ggaggcccgtccccacccgg

SEQ ID NO: 205858 - DNA, 20 bp, human
ggggcggggcccccgaggag

SEQ ID NO: 205859 - DNA, 20 bp, human
ggcggggcctcaggaggagt

SEQ ID NO: 205860 - DNA, 20 bp, human
ggggtggggacgggcctcct

SEQ ID NO: 205861 - DNA, 20 bp, human
ggcggggcctcagtgacgga

SEQ ID NO: 205862 - DNA, 20 bp, human
gtggaggccagcacgcagtg

SEQ ID NO: 205863 - DNA, 20 bp, human
ggctggcgaagcctccgggt

SEQ ID NO: 205864 - DNA, 20 bp, human
gcatcctgaggggacggaaa

SEQ ID NO: 205865 - DNA, 20 bp, human
gccctcccgggaggctccgc

SEQ ID NO: 205866 - DNA, 20 bp, human
gcgcctggccctcacatctc

SEQ ID NO: 205867 - DNA, 20 bp, human
gaagtcgggcgagcagtggt

SEQ ID NO: 205868 - DNA, 20 bp, human
gaggaggcgcagttactacc

SEQ ID NO: 205869 - DNA, 20 bp, human
gctcaggcccggctgcacag

SEQ ID NO: 205870 - DNA, 20 bp, human
gagccaggaaggggctcctc

SEQ ID NO: 205871 - DNA, 20 bp, human
ggaagcgctcaccctgtagc

SEQ ID NO: 205872 - DNA, 20 bp, human
gactgctcgcccgacttccc

SEQ ID NO: 205873 - DNA, 20 bp, human
gagccgggcctgagatgtga

SEQ ID NO: 205874 - DNA, 20 bp, human
ggttactacccggggaagtc

SEQ ID NO: 205875 - DNA, 20 bp, human
ggggtgaggaccacaggcat

SEQ ID NO: 205876 - DNA, 20 bp, human
gacctcgcgcgtctcggcgt

SEQ ID NO: 205877 - DNA, 20 bp, human
gtacactccaggcaggtagg

SEQ ID NO: 205878 - DNA, 20 bp, human
gtggttggcccgcgcgtcac

SEQ ID NO: 205879 - DNA, 20 bp, human
gcgccgagaggtggctggtc

SEQ ID NO: 205880 - DNA, 20 bp, human
gccgagacgcgcgaggtgag

SEQ ID NO: 205881 - DNA, 20 bp, human
gaaggcgcccggtacactcc

SEQ ID NO: 205882 - DNA, 20 bp, human
gcccagatcctccaaggctt

SEQ ID NO: 205883 - DNA, 20 bp, human
ggggtgggcctaagccttgg

SEQ ID NO: 205884 - DNA, 20 bp, human
gcaggggaaaataacgtgaa

SEQ ID NO: 205885 - DNA, 20 bp, human
gcggaagcgcctgggatctt

SEQ ID NO: 205886 - DNA, 20 bp, human
gaatgacgttgcactaaggg

SEQ ID NO: 205887 - DNA, 20 bp, human
gccagcgcgcctgcgtgcaa

SEQ ID NO: 205888 - DNA, 20 bp, human
gtggcaccccacctagaggt

SEQ ID NO: 205889 - DNA, 20 bp, human
gtgggcgtggcgaatagcgc

SEQ ID NO: 205890 - DNA, 20 bp, human
gcagacgcacagttgcgttt

SEQ ID NO: 205891 - DNA, 20 bp, human
gcgtgcagctaccagcatat

SEQ ID NO: 205892 - DNA, 20 bp, human
gtgtgcactgctctctgctt

SEQ ID NO: 205893 - DNA, 20 bp, human
gaatgggcggggtctggctt

SEQ ID NO: 205894 - DNA, 20 bp, human
gaggtcttccaacctctagg

SEQ ID NO: 205895 - DNA, 20 bp, human
gcgcgccggtagatcccagg

SEQ ID NO: 205896 - DNA, 20 bp, human
gcgctgctgctcacccacga

SEQ ID NO: 205897 - DNA, 20 bp, human
gcagcagcgggaggcgactg

SEQ ID NO: 205898 - DNA, 20 bp, human
gctggtgcgcatggtggagc

SEQ ID NO: 205899 - DNA, 20 bp, human
gtgacagcccccagtgcgaa

SEQ ID NO: 205900 - DNA, 20 bp, human
gtggaggcgggtctgaggtt

SEQ ID NO: 205901 - DNA, 20 bp, human
gggcagcaggacgccctcgt

SEQ ID NO: 205902 - DNA, 20 bp, human
gcgggaggcgactggggatc

SEQ ID NO: 205903 - DNA, 20 bp, human
ggggctcactgatgacatgc

SEQ ID NO: 205904 - DNA, 20 bp, human
gtggcagcctttcgcactgg

SEQ ID NO: 205905 - DNA, 20 bp, human
gtggcggggtcaggcgtgtt

SEQ ID NO: 205906 - DNA, 20 bp, human
gtggctggcatgctgaccca

SEQ ID NO: 205907 - DNA, 20 bp, human
gaccctgaaaagtgtaaatt

SEQ ID NO: 205908 - DNA, 20 bp, human
ggcttgaaaggatattgtac

SEQ ID NO: 205909 - DNA, 20 bp, human
gctactaagcagaaaaatgc

SEQ ID NO: 205910 - DNA, 20 bp, human
gttacacttttcagggtaca

SEQ ID NO: 205911 - DNA, 20 bp, human
gctgagaagtcggcactatg

SEQ ID NO: 205912 - DNA, 20 bp, human
gcagccaagttctatactgc

SEQ ID NO: 205913 - DNA, 20 bp, human
gtgtaaatttggaagaaagc

SEQ ID NO: 205914 - DNA, 20 bp, human
gccatcttgaaatgcttgaa

SEQ ID NO: 205915 - DNA, 20 bp, human
gcattgttttcttagtgaaa

SEQ ID NO: 205916 - DNA, 20 bp, human
gtgaccagtgggtatcagga

SEQ ID NO: 205917 - DNA, 20 bp, human
gtgtgggtgtatgcgcatgg

SEQ ID NO: 205918 - DNA, 20 bp, human
gacagaagtgtggggaatgt

SEQ ID NO: 205919 - DNA, 20 bp, human
gggaccagccacatctggac

SEQ ID NO: 205920 - DNA, 20 bp, human
gccagtgggtatcaggatgg

SEQ ID NO: 205921 - DNA, 20 bp, human
gcctcaggaccagccacatc

SEQ ID NO: 205922 - DNA, 20 bp, human
ggtggatgcaaaaactcctg

SEQ ID NO: 205923 - DNA, 20 bp, human
ggtgtgtgggtgtatgcgca

SEQ ID NO: 205924 - DNA, 20 bp, human
gcagcagtcacagaagtgtg

SEQ ID NO: 205925 - DNA, 20 bp, human
gtctctgaccagtgggtatc

SEQ ID NO: 205926 - DNA, 20 bp, human
gactaaaaagccctagggac

SEQ ID NO: 205927 - DNA, 20 bp, human
gaagcgaaactgcacattta

SEQ ID NO: 205928 - DNA, 20 bp, human
gacagaggcctcttgtactt

SEQ ID NO: 205929 - DNA, 20 bp, human
gaggagtggccatacataaa

SEQ ID NO: 205930 - DNA, 20 bp, human
gtgaaagatgtcaacagagc

SEQ ID NO: 205931 - DNA, 20 bp, human
gcaagaggcctctgtaggag

SEQ ID NO: 205932 - DNA, 20 bp, human
gtgtatggccactcctacag

SEQ ID NO: 205933 - DNA, 20 bp, human
gggcaaggttaacgattaaa

SEQ ID NO: 205934 - DNA, 20 bp, human
gtactgatgctgccctttgt

SEQ ID NO: 205935 - DNA, 20 bp, human
gcaaaggcttcattcccatt

SEQ ID NO: 205936 - DNA, 20 bp, human
gcggccccacggacttgttc

SEQ ID NO: 205937 - DNA, 20 bp, human
ggcccaggggccgctcgcag

SEQ ID NO: 205938 - DNA, 20 bp, human
gacccagaggcactggggta

SEQ ID NO: 205939 - DNA, 20 bp, human
ggtcgcaacccgcgggacgg

SEQ ID NO: 205940 - DNA, 20 bp, human
gcactcccgaacaagtccgt

SEQ ID NO: 205941 - DNA, 20 bp, human
gaggcgctgtcgcaacccgc

SEQ ID NO: 205942 - DNA, 20 bp, human
gctccctgggagggactttg

SEQ ID NO: 205943 - DNA, 20 bp, human
ggcgacagcgcctccctggg

SEQ ID NO: 205944 - DNA, 20 bp, human
gggttgcgacagcgcctccc

SEQ ID NO: 205945 - DNA, 20 bp, human
gagaaggtcacgttcctctc

SEQ ID NO: 205946 - DNA, 20 bp, human
gacgcccaggggtgaggcga

SEQ ID NO: 205947 - DNA, 20 bp, human
gctcccgccgcgtcacccgt

SEQ ID NO: 205948 - DNA, 20 bp, human
ggaccgacgggtgacgcggc

SEQ ID NO: 205949 - DNA, 20 bp, human
gcacccctgggcgtagctct

SEQ ID NO: 205950 - DNA, 20 bp, human
gggagcccagagctacgccc

SEQ ID NO: 205951 - DNA, 20 bp, human
gtcccggccgcgctcgcacg

SEQ ID NO: 205952 - DNA, 20 bp, human
gtaggcgccgacacagaagg

SEQ ID NO: 205953 - DNA, 20 bp, human
gcgaagctggcgacgccaaa

SEQ ID NO: 205954 - DNA, 20 bp, human
ggtagcgggcgcccccgagg

SEQ ID NO: 205955 - DNA, 20 bp, human
gcgtagctctgggctccctt

SEQ ID NO: 205956 - DNA, 20 bp, human
gaccgcccccgggatgtcac

SEQ ID NO: 205957 - DNA, 20 bp, human
ggccctgggcactcggaagg

SEQ ID NO: 205958 - DNA, 20 bp, human
gcgggagctcggtgggaaga

SEQ ID NO: 205959 - DNA, 20 bp, human
gacagagccgggagctcggt

SEQ ID NO: 205960 - DNA, 20 bp, human
gaagcgccggtgacatcccg

SEQ ID NO: 205961 - DNA, 20 bp, human
gtctcgcagaggcacgggga

SEQ ID NO: 205962 - DNA, 20 bp, human
ggcagccctgggcactcgga

SEQ ID NO: 205963 - DNA, 20 bp, human
ggggaaggatggaacagagc

SEQ ID NO: 205964 - DNA, 20 bp, human
gtcctccttccgagtgccca

SEQ ID NO: 205965 - DNA, 20 bp, human
ggtgcccagggctgcggacg

SEQ ID NO: 205966 - DNA, 20 bp, human
gccaaagtgtttaggaagtc

SEQ ID NO: 205967 - DNA, 20 bp, human
gaacttagaagattatgcaa

SEQ ID NO: 205968 - DNA, 20 bp, human
gattatgcaatgggctggca

SEQ ID NO: 205969 - DNA, 20 bp, human
gagaagattatgcaatgggc

SEQ ID NO: 205970 - DNA, 20 bp, human
ggcaaggtccagctgcgcgg

SEQ ID NO: 205971 - DNA, 20 bp, human
ggggacgggcaccgggttgg

SEQ ID NO: 205972 - DNA, 20 bp, human
gaacaggcgaggtgggggat

SEQ ID NO: 205973 - DNA, 20 bp, human
gccggctgggattcgagctc

SEQ ID NO: 205974 - DNA, 20 bp, human
gaggtgaaaacaggcgaggt

SEQ ID NO: 205975 - DNA, 20 bp, human
ggcggcgggagtgaggccac

SEQ ID NO: 205976 - DNA, 20 bp, human
ggggcggcgaggaacccgac

SEQ ID NO: 205977 - DNA, 20 bp, human
gctcccagatgttgccgggg

SEQ ID NO: 205978 - DNA, 20 bp, human
gcaagcgtagcagggccggt

SEQ ID NO: 205979 - DNA, 20 bp, human
ggcaggctaagatggggagt

SEQ ID NO: 205980 - DNA, 20 bp, human
gggaaaggcaggctaagatg

SEQ ID NO: 205981 - DNA, 20 bp, human
gagggtggggcgtgcagaag

SEQ ID NO: 205982 - DNA, 20 bp, human
gccagcgcacgcgtgcatca

SEQ ID NO: 205983 - DNA, 20 bp, human
gccgggcggcggagctgcaa

SEQ ID NO: 205984 - DNA, 20 bp, human
ggtgtgggcacactggagtc

SEQ ID NO: 205985 - DNA, 20 bp, human
gggcgcaagcgtagcagggc

SEQ ID NO: 205986 - DNA, 20 bp, human
gtccttacgtggctaataaa

SEQ ID NO: 205987 - DNA, 20 bp, human
gaaggggacgcctattactt

SEQ ID NO: 205988 - DNA, 20 bp, human
gcagccgccgcgctatcgaa

SEQ ID NO: 205989 - DNA, 20 bp, human
gccaaatccgcttccttacg

SEQ ID NO: 205990 - DNA, 20 bp, human
gtattagccacgtaaggaag

SEQ ID NO: 205991 - DNA, 20 bp, human
gtcgcccttcgatagcgcgg

SEQ ID NO: 205992 - DNA, 20 bp, human
ggacaccgcggctgagaagc

SEQ ID NO: 205993 - DNA, 20 bp, human
gtcagccgcggtgtctgccc

SEQ ID NO: 205994 - DNA, 20 bp, human
gaagggctcattctaggtag

SEQ ID NO: 205995 - DNA, 20 bp, human
gctaggtcgccggggaaaag

SEQ ID NO: 205996 - DNA, 20 bp, human
ggggcgagaacgggaggtgg

SEQ ID NO: 205997 - DNA, 20 bp, human
gccgccgaggggcgagaaca

SEQ ID NO: 205998 - DNA, 20 bp, human
ggccgcgcggactagagaag

SEQ ID NO: 205999 - DNA, 20 bp, human
gttccccaggggcgagtcgg

SEQ ID NO: 206000 - DNA, 20 bp, human
ggtcccacgtctctgtggtg

SEQ ID NO: 206001 - DNA, 20 bp, human
ggaagagtgggtggggattc

SEQ ID NO: 206002 - DNA, 20 bp, human
ggggcggggcggggctttgt

SEQ ID NO: 206003 - DNA, 20 bp, human
ggccgaggggcgagaacggg

SEQ ID NO: 206004 - DNA, 20 bp, human
gtcccgcaccacagagacgt

SEQ ID NO: 206005 - DNA, 20 bp, human
ggcgccggccctccgctccg

SEQ ID NO: 206006 - DNA, 20 bp, human
gggaagctgcgaggattcca

SEQ ID NO: 206007 - DNA, 20 bp, human
ggtcgaatcaggccatctgc

SEQ ID NO: 206008 - DNA, 20 bp, human
gatctgctggcgaacaaaac

SEQ ID NO: 206009 - DNA, 20 bp, human
gaaaatgtctatttttggag

SEQ ID NO: 206010 - DNA, 20 bp, human
gaccgccctcacagccaatg

SEQ ID NO: 206011 - DNA, 20 bp, human
gcctcattttcaaggttcaa

SEQ ID NO: 206012 - DNA, 20 bp, human
gaggcccctcattggctgtg

SEQ ID NO: 206013 - DNA, 20 bp, human
gggaaccacgaaaatgaggg

SEQ ID NO: 206014 - DNA, 20 bp, human
gaatgagacgaggagggaga

SEQ ID NO: 206015 - DNA, 20 bp, human
gagaaaagaaagtgacaagt

SEQ ID NO: 206016 - DNA, 20 bp, human
gcgtgcgcagagcgcgtccc

SEQ ID NO: 206017 - DNA, 20 bp, human
gcggactccttcagggtctc

SEQ ID NO: 206018 - DNA, 20 bp, human
ggcagcactgacgcctcgca

SEQ ID NO: 206019 - DNA, 20 bp, human
gcgtgggcggaacagttccc

SEQ ID NO: 206020 - DNA, 20 bp, human
gcgcgctcggcagcctccgt

SEQ ID NO: 206021 - DNA, 20 bp, human
gggggtgtgcgcgcgaagag

SEQ ID NO: 206022 - DNA, 20 bp, human
ggtgcgcgcgaagagtggga

SEQ ID NO: 206023 - DNA, 20 bp, human
gcccactaggtcgtcgctgc

SEQ ID NO: 206024 - DNA, 20 bp, human
gggtctccggaaacgcggcg

SEQ ID NO: 206025 - DNA, 20 bp, human
gtggagcccactttgtactt

SEQ ID NO: 206026 - DNA, 20 bp, human
gacagcgcccccatattttc

SEQ ID NO: 206027 - DNA, 20 bp, human
gagagtggactcggctgacc

SEQ ID NO: 206028 - DNA, 20 bp, human
ggaagtctcccagaaaatat

SEQ ID NO: 206029 - DNA, 20 bp, human
ggtggactcggctgacccgg

SEQ ID NO: 206030 - DNA, 20 bp, human
ggccccggctaccacagaga

SEQ ID NO: 206031 - DNA, 20 bp, human
gaagtaccagagagtggact

SEQ ID NO: 206032 - DNA, 20 bp, human
gcgagagtgtaactacttta

SEQ ID NO: 206033 - DNA, 20 bp, human
gtactgggtagagtccgagg

SEQ ID NO: 206034 - DNA, 20 bp, human
gtagagtccgaggaggggcg

SEQ ID NO: 206035 - DNA, 20 bp, human
gcggatacctattgtcaaaa

SEQ ID NO: 206036 - DNA, 20 bp, human
gcggaaccctggaggtaggt

SEQ ID NO: 206037 - DNA, 20 bp, human
gtggcgaagccagctgctgg

SEQ ID NO: 206038 - DNA, 20 bp, human
ggaggcggaaccctggaggt

SEQ ID NO: 206039 - DNA, 20 bp, human
gcgccaacggcgttgaacaa

SEQ ID NO: 206040 - DNA, 20 bp, human
ggacccttgttcaacgccgt

SEQ ID NO: 206041 - DNA, 20 bp, human
gcgcgacatagagcgtgagg

SEQ ID NO: 206042 - DNA, 20 bp, human
gagagcgtgaggcggaaccc

SEQ ID NO: 206043 - DNA, 20 bp, human
gctaggaccacgctcgacgt

SEQ ID NO: 206044 - DNA, 20 bp, human
ggcgtgaggcggaaccctgg

SEQ ID NO: 206045 - DNA, 20 bp, human
gtcctcaaggccggtgggtc

SEQ ID NO: 206046 - DNA, 20 bp, human
ggaggcgtggcctgcaatga

SEQ ID NO: 206047 - DNA, 20 bp, human
ggtggcctgcaatgacggag

SEQ ID NO: 206048 - DNA, 20 bp, human
gcgtggccctggttcagtgg

SEQ ID NO: 206049 - DNA, 20 bp, human
gagcttcgccgtcatctcgg

SEQ ID NO: 206050 - DNA, 20 bp, human
gggccccgctccgtcattgc

SEQ ID NO: 206051 - DNA, 20 bp, human
gggccacgcccccgagatga

SEQ ID NO: 206052 - DNA, 20 bp, human
gccctggttcagtggaggcg

SEQ ID NO: 206053 - DNA, 20 bp, human
ggccacgcctccactgaacc

SEQ ID NO: 206054 - DNA, 20 bp, human
gtggagagccagccccatcg

SEQ ID NO: 206055 - DNA, 20 bp, human
gcggcggcggggaaccccga

SEQ ID NO: 206056 - DNA, 20 bp, human
ggggcgggtactgaaatgac

SEQ ID NO: 206057 - DNA, 20 bp, human
gcgggtactgaaatgacagg

SEQ ID NO: 206058 - DNA, 20 bp, human
ggaagtcagtaggatggtca

SEQ ID NO: 206059 - DNA, 20 bp, human
gcgccccaaaaccccgcgga

SEQ ID NO: 206060 - DNA, 20 bp, human
gcagctgaatggagcaacat

SEQ ID NO: 206061 - DNA, 20 bp, human
ggccacagaagtcagtagga

SEQ ID NO: 206062 - DNA, 20 bp, human
gcagggggagaacatgagat

SEQ ID NO: 206063 - DNA, 20 bp, human
gtacccgccccaaaaccccg

SEQ ID NO: 206064 - DNA, 20 bp, human
gttccctccgcggggttttg

SEQ ID NO: 206065 - DNA, 20 bp, human
ggaatccaacttgaagatca

SEQ ID NO: 206066 - DNA, 20 bp, human
gcgcggccccgcgaggtctg

SEQ ID NO: 206067 - DNA, 20 bp, human
gcgagcctcgcgcatcctga

SEQ ID NO: 206068 - DNA, 20 bp, human
gcccgctagcagagagctct

SEQ ID NO: 206069 - DNA, 20 bp, human
ggacgccatcaggatgcgcg

SEQ ID NO: 206070 - DNA, 20 bp, human
gtcaaggcgggtctcactct

SEQ ID NO: 206071 - DNA, 20 bp, human
ggtatcccacagacctcgcg

SEQ ID NO: 206072 - DNA, 20 bp, human
gaaccacccgaggccgtgat

SEQ ID NO: 206073 - DNA, 20 bp, human
ggcgcgccgagaaccacccg

SEQ ID NO: 206074 - DNA, 20 bp, human
gggggccgcgtgacgccatc

SEQ ID NO: 206075 - DNA, 20 bp, human
gcaccagccaatcacggcct

SEQ ID NO: 206076 - DNA, 20 bp, human
gcgagcggggccttgaggag

SEQ ID NO: 206077 - DNA, 20 bp, human
gtgtagcggtgacgcaggaa

SEQ ID NO: 206078 - DNA, 20 bp, human
gggagtgcgcagagcccggt

SEQ ID NO: 206079 - DNA, 20 bp, human
ggggagctcaaggtttatcg

SEQ ID NO: 206080 - DNA, 20 bp, human
gaggaagggcgagatttcgg

SEQ ID NO: 206081 - DNA, 20 bp, human
gcgcgcagagagcgcggctc

SEQ ID NO: 206082 - DNA, 20 bp, human
gcatgtggctaatctttcag

SEQ ID NO: 206083 - DNA, 20 bp, human
gttgcaaggcgcatgtgtag

SEQ ID NO: 206084 - DNA, 20 bp, human
gcgcgcacgcgcagagagcg

SEQ ID NO: 206085 - DNA, 20 bp, human
gcagccgcctgcctcttggg

SEQ ID NO: 206086 - DNA, 20 bp, human
ggacagacgccggggttccc

SEQ ID NO: 206087 - DNA, 20 bp, human
gccgggtcccgaactcgcgg

SEQ ID NO: 206088 - DNA, 20 bp, human
ggaggcctcgcaggcggcat

SEQ ID NO: 206089 - DNA, 20 bp, human
ggcctgcgaggcctcggctc

SEQ ID NO: 206090 - DNA, 20 bp, human
gcccgccccgagcgcgcgat

SEQ ID NO: 206091 - DNA, 20 bp, human
gctcccggaacctgcacttc

SEQ ID NO: 206092 - DNA, 20 bp, human
gtgtgtgatggggtcgaaga

SEQ ID NO: 206093 - DNA, 20 bp, human
gggacaccggacagacgccg

SEQ ID NO: 206094 - DNA, 20 bp, human
gccgcccgcccccttggtgc

SEQ ID NO: 206095 - DNA, 20 bp, human
gcccccaacagcaccggtgt

SEQ ID NO: 206096 - DNA, 20 bp, human
ggtaccaccgccctccctcg

SEQ ID NO: 206097 - DNA, 20 bp, human
ggccggagcgccgaagcacc

SEQ ID NO: 206098 - DNA, 20 bp, human
ggggagacccggacatccag

SEQ ID NO: 206099 - DNA, 20 bp, human
gacatccaggggacgagctc

SEQ ID NO: 206100 - DNA, 20 bp, human
gaaacccggggcgctgggga

SEQ ID NO: 206101 - DNA, 20 bp, human
ggtggtaccagtcctgctgg

SEQ ID NO: 206102 - DNA, 20 bp, human
gtccccaggtcggggttcgc

SEQ ID NO: 206103 - DNA, 20 bp, human
gtatcgcggcccggcagtcg

SEQ ID NO: 206104 - DNA, 20 bp, human
gccactgcgttcagctctgg

SEQ ID NO: 206105 - DNA, 20 bp, human
gaggcgtggccccgactgcc

SEQ ID NO: 206106 - DNA, 20 bp, human
gggggtgaactcaggactgg

SEQ ID NO: 206107 - DNA, 20 bp, human
gcggtcccgccgttcttaaa

SEQ ID NO: 206108 - DNA, 20 bp, human
gagagctggagtcactccgt

SEQ ID NO: 206109 - DNA, 20 bp, human
gagcccgcggggggcgagga

SEQ ID NO: 206110 - DNA, 20 bp, human
gctccgtggggacaagtccc

SEQ ID NO: 206111 - DNA, 20 bp, human
gaaggagagagcagcgcttg

SEQ ID NO: 206112 - DNA, 20 bp, human
ggggaccggcgagcagtagc

SEQ ID NO: 206113 - DNA, 20 bp, human
gaaagtgtgaatggggagac

SEQ ID NO: 206114 - DNA, 20 bp, human
gacagattaggcaagggtgt

SEQ ID NO: 206115 - DNA, 20 bp, human
gcggggggcgaggacggcaa

SEQ ID NO: 206116 - DNA, 20 bp, human
gggcggaggggaacagattc

SEQ ID NO: 206117 - DNA, 20 bp, human
gaacacacacgtttgtaggt

SEQ ID NO: 206118 - DNA, 20 bp, human
gcactcaccgaggtatcctg

SEQ ID NO: 206119 - DNA, 20 bp, human
gagcaatgggaagtcggccc

SEQ ID NO: 206120 - DNA, 20 bp, human
gcccacaggtctgtgaccct

SEQ ID NO: 206121 - DNA, 20 bp, human
gtgagtgagcaatgggaagt

SEQ ID NO: 206122 - DNA, 20 bp, human
gtaggacagaaggctcctga

SEQ ID NO: 206123 - DNA, 20 bp, human
ggagagagggctgccgaaag

SEQ ID NO: 206124 - DNA, 20 bp, human
gaagtcggcccaggcctggt

SEQ ID NO: 206125 - DNA, 20 bp, human
ggccactccccaggatacct

SEQ ID NO: 206126 - DNA, 20 bp, human
gcccagtcctgctgtcccaa

SEQ ID NO: 206127 - DNA, 20 bp, human
gctgctgtcccaagggactc

SEQ ID NO: 206128 - DNA, 20 bp, human
gcccaactgaagccactctg

SEQ ID NO: 206129 - DNA, 20 bp, human
gaacacacacgtttgtaggt

SEQ ID NO: 206130 - DNA, 20 bp, human
gagacccatggaccctccgg

SEQ ID NO: 206131 - DNA, 20 bp, human
gcctgaccccggagtccctt

SEQ ID NO: 206132 - DNA, 20 bp, human
gtgtcaagataaggacgcgc

SEQ ID NO: 206133 - DNA, 20 bp, human
ggccaacaggcagcaaagct

SEQ ID NO: 206134 - DNA, 20 bp, human
gcatcagataatggtctccg

SEQ ID NO: 206135 - DNA, 20 bp, human
gataaggacgcgctggctaa

SEQ ID NO: 206136 - DNA, 20 bp, human
ggctgcacagccaagaaccg

SEQ ID NO: 206137 - DNA, 20 bp, human
gtcgccggggaagagtttaa

SEQ ID NO: 206138 - DNA, 20 bp, human
ggcacagccaagaaccgcgg

SEQ ID NO: 206139 - DNA, 20 bp, human
gagggcgggaggccattcgc

SEQ ID NO: 206140 - DNA, 20 bp, human
ggggggaggccgcttgtctc

SEQ ID NO: 206141 - DNA, 20 bp, human
ggagatgccccgcaccaaga

SEQ ID NO: 206142 - DNA, 20 bp, human
gaacccgagtgacctgcgaa

SEQ ID NO: 206143 - DNA, 20 bp, human
gaagacacggacagtaacat

SEQ ID NO: 206144 - DNA, 20 bp, human
gagaaccgcggaggggaaga

SEQ ID NO: 206145 - DNA, 20 bp, human
gaccgccggtgccccgggat

SEQ ID NO: 206146 - DNA, 20 bp, human
gtgagggacacgctacgcaa

SEQ ID NO: 206147 - DNA, 20 bp, human
gcgggaggctgccctatcag

SEQ ID NO: 206148 - DNA, 20 bp, human
gtgcgcttcaggctggaagg

SEQ ID NO: 206149 - DNA, 20 bp, human
ggcgtagcgtgtccctcagt

SEQ ID NO: 206150 - DNA, 20 bp, human
ggcaagctgaaaatcttgcg

SEQ ID NO: 206151 - DNA, 20 bp, human
gcaagcctggtgtcctcgac

SEQ ID NO: 206152 - DNA, 20 bp, human
ggtctcctgtcgaggacacc

SEQ ID NO: 206153 - DNA, 20 bp, human
gctatccaacggtcctagat

SEQ ID NO: 206154 - DNA, 20 bp, human
ggcacatgcgcagagcgtcg

SEQ ID NO: 206155 - DNA, 20 bp, human
gtagtagcggggtttggctt

SEQ ID NO: 206156 - DNA, 20 bp, human
gacgtaatggcgtaaggggc

SEQ ID NO: 206157 - DNA, 20 bp, human
gcgtaaggaaacgggaccaa

SEQ ID NO: 206158 - DNA, 20 bp, human
ggcggggccggactgttctc

SEQ ID NO: 206159 - DNA, 20 bp, human
ggcggagaatcccgcgatgg

SEQ ID NO: 206160 - DNA, 20 bp, human
ggattacgtaatggcgtaag

SEQ ID NO: 206161 - DNA, 20 bp, human
gaggccaggtgcggcgctca

SEQ ID NO: 206162 - DNA, 20 bp, human
ggacccgcgcaaagcctgcg

SEQ ID NO: 206163 - DNA, 20 bp, human
ggcctgcggggattacgtaa

SEQ ID NO: 206164 - DNA, 20 bp, human
ggagagggcggggctcaagt

SEQ ID NO: 206165 - DNA, 20 bp, human
gcggggctcaagtcggaact

SEQ ID NO: 206166 - DNA, 20 bp, human
gagggtgggcgaagctgcag

SEQ ID NO: 206167 - DNA, 20 bp, human
ggaactagagaggaggtggc

SEQ ID NO: 206168 - DNA, 20 bp, human
gctccttggaactagagagg

SEQ ID NO: 206169 - DNA, 20 bp, human
gcagcggcgcgtcatctgca

SEQ ID NO: 206170 - DNA, 20 bp, human
ggcgctccttggaactagag

SEQ ID NO: 206171 - DNA, 20 bp, human
gcaggccggccaatcagcgc

SEQ ID NO: 206172 - DNA, 20 bp, human
gagccattttgtgggagggt

SEQ ID NO: 206173 - DNA, 20 bp, human
gggctacgaaccagcggcgg

SEQ ID NO: 206174 - DNA, 20 bp, human
gaatggctgcgggtggcgcc

SEQ ID NO: 206175 - DNA, 20 bp, human
ggctcccggtcgtgcccgaa

SEQ ID NO: 206176 - DNA, 20 bp, human
gggtgcgctccgcccgggtc

SEQ ID NO: 206177 - DNA, 20 bp, human
ggccgcgaacagcctgaccc

SEQ ID NO: 206178 - DNA, 20 bp, human
gaggcaggctggtacggcgg

SEQ ID NO: 206179 - DNA, 20 bp, human
ggtcaggcaggctggtacgg

SEQ ID NO: 206180 - DNA, 20 bp, human
gccgggcggagcgcaccctc

SEQ ID NO: 206181 - DNA, 20 bp, human
gctcctccgcgcggtcaggc

SEQ ID NO: 206182 - DNA, 20 bp, human
ggcggtcaggcaggctggta

SEQ ID NO: 206183 - DNA, 20 bp, human
ggcccgggtcaggctgttcg

SEQ ID NO: 206184 - DNA, 20 bp, human
gcgggggagacgcggcccga

SEQ ID NO: 206185 - DNA, 20 bp, human
gagcctgcctgaccgcgcgg

SEQ ID NO: 206186 - DNA, 20 bp, human
gcccgcgacggtggcccgga

SEQ ID NO: 206187 - DNA, 20 bp, human
ggacggaaaagatacctcgg

SEQ ID NO: 206188 - DNA, 20 bp, human
gcgggcagggttcccactcc

SEQ ID NO: 206189 - DNA, 20 bp, human
gcagtgagcccccgcgacgg

SEQ ID NO: 206190 - DNA, 20 bp, human
gtgccagtgagcccccgcga

SEQ ID NO: 206191 - DNA, 20 bp, human
gatccctaggtcctggagca

SEQ ID NO: 206192 - DNA, 20 bp, human
ggctccctgctccaggacct

SEQ ID NO: 206193 - DNA, 20 bp, human
gccggacggaaaagatacct

SEQ ID NO: 206194 - DNA, 20 bp, human
gcctcgggtacggaactgga

SEQ ID NO: 206195 - DNA, 20 bp, human
ggtggaaggccaagatccct

SEQ ID NO: 206196 - DNA, 20 bp, human
gaagccacatggctctccgc

SEQ ID NO: 206197 - DNA, 20 bp, human
ggcagagccccagcgctctc

SEQ ID NO: 206198 - DNA, 20 bp, human
gcagcccaggctctgaccgt

SEQ ID NO: 206199 - DNA, 20 bp, human
gaccgagtcgtctgcgtgga

SEQ ID NO: 206200 - DNA, 20 bp, human
gcgtgggtgtgcgtcgggga

SEQ ID NO: 206201 - DNA, 20 bp, human
ggagccggcggagagccatg

SEQ ID NO: 206202 - DNA, 20 bp, human
gcagtggaacatctccaccc

SEQ ID NO: 206203 - DNA, 20 bp, human
ggacccgtccttaagaacct

SEQ ID NO: 206204 - DNA, 20 bp, human
gcgctccccgcccagatttt

SEQ ID NO: 206205 - DNA, 20 bp, human
gggcctgtataatggagtta

SEQ ID NO: 206206 - DNA, 20 bp, human
ggctgtgagaacgagtttag

SEQ ID NO: 206207 - DNA, 20 bp, human
ggccgggccccatccagcgg

SEQ ID NO: 206208 - DNA, 20 bp, human
gtggggcatgtgagaccgag

SEQ ID NO: 206209 - DNA, 20 bp, human
ggtctcacatgccccaaacg

SEQ ID NO: 206210 - DNA, 20 bp, human
gtgaggaggaaagttccttc

SEQ ID NO: 206211 - DNA, 20 bp, human
gagttcaagctggggataag

SEQ ID NO: 206212 - DNA, 20 bp, human
gtggcaggaaacaggctcgg

SEQ ID NO: 206213 - DNA, 20 bp, human
gagcaaggatgcgatcccga

SEQ ID NO: 206214 - DNA, 20 bp, human
gatggacatggagcagtctg

SEQ ID NO: 206215 - DNA, 20 bp, human
gatgtgagaccgagaggctt

SEQ ID NO: 206216 - DNA, 20 bp, human
gaggtcgcctgcgaggtcgc

SEQ ID NO: 206217 - DNA, 20 bp, human
gacctcgcaggcgacctcgc

SEQ ID NO: 206218 - DNA, 20 bp, human
gtggccgaggccggatgtcg

SEQ ID NO: 206219 - DNA, 20 bp, human
gcctgagcctgcgacctcgc

SEQ ID NO: 206220 - DNA, 20 bp, human
gggccctggggagggataga

SEQ ID NO: 206221 - DNA, 20 bp, human
gccggcctcggccacgtggt

SEQ ID NO: 206222 - DNA, 20 bp, human
gcgagcgtgagcccagcgac

SEQ ID NO: 206223 - DNA, 20 bp, human
gtccgcccaccacgtggccg

SEQ ID NO: 206224 - DNA, 20 bp, human
gctcgctggaccctaagtcc

SEQ ID NO: 206225 - DNA, 20 bp, human
gagggccgtcccggcgccag

SEQ ID NO: 206226 - DNA, 20 bp, human
gcagagggtgagaggagccg

SEQ ID NO: 206227 - DNA, 20 bp, human
gggagagcagggccgcccga

SEQ ID NO: 206228 - DNA, 20 bp, human
gccggctcccgggaccccgt

SEQ ID NO: 206229 - DNA, 20 bp, human
ggggagagcggtgttggcca

SEQ ID NO: 206230 - DNA, 20 bp, human
gtacagcaattgcaacaagt

SEQ ID NO: 206231 - DNA, 20 bp, human
gcgggcagaggcagccagtt

SEQ ID NO: 206232 - DNA, 20 bp, human
ggtccggcactgggctagag

SEQ ID NO: 206233 - DNA, 20 bp, human
ggaggcagccagttcgggcc

SEQ ID NO: 206234 - DNA, 20 bp, human
gcgcgcggccgccgccccac

SEQ ID NO: 206235 - DNA, 20 bp, human
ggtggggagggcacgagccg

SEQ ID NO: 206236 - DNA, 20 bp, human
gcggtacgggctgacgtcaa

SEQ ID NO: 206237 - DNA, 20 bp, human
gggagctacgggtacagcag

SEQ ID NO: 206238 - DNA, 20 bp, human
gactgcgcgaaactcttctc

SEQ ID NO: 206239 - DNA, 20 bp, human
gagggcacacaacacctcag

SEQ ID NO: 206240 - DNA, 20 bp, human
ggggagcaaaaggccgtaaa

SEQ ID NO: 206241 - DNA, 20 bp, human
gagagcgacagcggaaacga

SEQ ID NO: 206242 - DNA, 20 bp, human
gccggaggcggagccggtac

SEQ ID NO: 206243 - DNA, 20 bp, human
ggtcgcaactcgcccggagg

SEQ ID NO: 206244 - DNA, 20 bp, human
ggtggaagaccactagaacg

SEQ ID NO: 206245 - DNA, 20 bp, human
ggcagactctagagcgacag

SEQ ID NO: 206246 - DNA, 20 bp, human
gaggcacagggcagtcttag

SEQ ID NO: 206247 - DNA, 20 bp, human
gtaggtgatgggtgcacaaa

SEQ ID NO: 206248 - DNA, 20 bp, human
gtagctgctcaaatcatggg

SEQ ID NO: 206249 - DNA, 20 bp, human
gacagtagctgctcaaatca

SEQ ID NO: 206250 - DNA, 20 bp, human
ggctggtggggtcttggcga

SEQ ID NO: 206251 - DNA, 20 bp, human
ggggcctgggagcgtttagc

SEQ ID NO: 206252 - DNA, 20 bp, human
gctggaaggccaggtcacaa

SEQ ID NO: 206253 - DNA, 20 bp, human
gcaggtcacaaaggccatca

SEQ ID NO: 206254 - DNA, 20 bp, human
gggatcgccgcgagaggcac

SEQ ID NO: 206255 - DNA, 20 bp, human
gccaccagctaaacgctccc

SEQ ID NO: 206256 - DNA, 20 bp, human
gtactggcctcaacctattc

SEQ ID NO: 206257 - DNA, 20 bp, human
ggggcggggctgatatgtcg

SEQ ID NO: 206258 - DNA, 20 bp, human
gtgtgggcggggccaaactt

SEQ ID NO: 206259 - DNA, 20 bp, human
gtcacttggggacccggaat

SEQ ID NO: 206260 - DNA, 20 bp, human
gaccgcgcgactagcgtcct

SEQ ID NO: 206261 - DNA, 20 bp, human
gggggacccggaataggttg

SEQ ID NO: 206262 - DNA, 20 bp, human
ggcgtggcctgctgctctgt

SEQ ID NO: 206263 - DNA, 20 bp, human
gccccaggacgctagtcgcg

SEQ ID NO: 206264 - DNA, 20 bp, human
gggccagtaaagttctcgcc

SEQ ID NO: 206265 - DNA, 20 bp, human
gcttaggtttcattcacttg

SEQ ID NO: 206266 - DNA, 20 bp, human
gagaggccgcccggcagggt

SEQ ID NO: 206267 - DNA, 20 bp, human
gctgccgggcggcctctgat

SEQ ID NO: 206268 - DNA, 20 bp, human
ggtagtccatcaaatcaaag

SEQ ID NO: 206269 - DNA, 20 bp, human
gccgggcggcctctgattgg

SEQ ID NO: 206270 - DNA, 20 bp, human
gggcgcagcctcgacccctc

SEQ ID NO: 206271 - DNA, 20 bp, human
gaaagtgggacttgttctcc

SEQ ID NO: 206272 - DNA, 20 bp, human
gcgcctcccaccctgccggg

SEQ ID NO: 206273 - DNA, 20 bp, human
gcccccgcccgctagtaggc

SEQ ID NO: 206274 - DNA, 20 bp, human
gtctccccccgcccgctagt

SEQ ID NO: 206275 - DNA, 20 bp, human
gcctcccagaagagtcacgt

SEQ ID NO: 206276 - DNA, 20 bp, human
gagcccgggcgggtcagcgg

SEQ ID NO: 206277 - DNA, 20 bp, human
gcggagcccgggcgggtcag

SEQ ID NO: 206278 - DNA, 20 bp, human
ggcgcctcgcctgggttccg

SEQ ID NO: 206279 - DNA, 20 bp, human
gcggccccggaacccaggcg

SEQ ID NO: 206280 - DNA, 20 bp, human
gggtaacccggaagtggcgg

SEQ ID NO: 206281 - DNA, 20 bp, human
ggcgccgccgcgcggtaacc

SEQ ID NO: 206282 - DNA, 20 bp, human
ggctctgcgccgcgtcccag

SEQ ID NO: 206283 - DNA, 20 bp, human
gaagccggcggcggcgtcca

SEQ ID NO: 206284 - DNA, 20 bp, human
gcacgggagaaacctggatt

SEQ ID NO: 206285 - DNA, 20 bp, human
ggggggcggcgcgcacgagc

SEQ ID NO: 206286 - DNA, 20 bp, human
gcgcggggcaagtggagaag

SEQ ID NO: 206287 - DNA, 20 bp, human
ggaacagcttcgctgatcaa

SEQ ID NO: 206288 - DNA, 20 bp, human
gtggcagaagcggtcgtcag

SEQ ID NO: 206289 - DNA, 20 bp, human
ggataaggccagcccggagt

SEQ ID NO: 206290 - DNA, 20 bp, human
ggaactgcccaatgaacaag

SEQ ID NO: 206291 - DNA, 20 bp, human
ggcgctcattgcgtctagga

SEQ ID NO: 206292 - DNA, 20 bp, human
gccgcgcgctcattgcgtct

SEQ ID NO: 206293 - DNA, 20 bp, human
ggaatcccgcctccactctg

SEQ ID NO: 206294 - DNA, 20 bp, human
gaatgagcgcgcggggcaag

SEQ ID NO: 206295 - DNA, 20 bp, human
ggtggaggcgggattcttag

SEQ ID NO: 206296 - DNA, 20 bp, human
gccaagaccggccaccggga

SEQ ID NO: 206297 - DNA, 20 bp, human
ggatggggatccccaagggt

SEQ ID NO: 206298 - DNA, 20 bp, human
ggggcgatggggatccccaa

SEQ ID NO: 206299 - DNA, 20 bp, human
gctaggtcgcagtgggcgat

SEQ ID NO: 206300 - DNA, 20 bp, human
gcgggcggcgttggagtctc

SEQ ID NO: 206301 - DNA, 20 bp, human
gagacactgtggtcgggagt

SEQ ID NO: 206302 - DNA, 20 bp, human
ggggccgagagctgacggat

SEQ ID NO: 206303 - DNA, 20 bp, human
gcgccaggcaggagacactg

SEQ ID NO: 206304 - DNA, 20 bp, human
ggacctgcggatgttgtccc

SEQ ID NO: 206305 - DNA, 20 bp, human
ggaccggccaccgggagggc

SEQ ID NO: 206306 - DNA, 20 bp, human
gtctctgacggtctcagaat

SEQ ID NO: 206307 - DNA, 20 bp, human
gcaatcactggcatgtgtcc

SEQ ID NO: 206308 - DNA, 20 bp, human
ggggaggccgcggggagcaa

SEQ ID NO: 206309 - DNA, 20 bp, human
gcgggccggcggtcggcggt

SEQ ID NO: 206310 - DNA, 20 bp, human
gccgtcagagacatctctgc

SEQ ID NO: 206311 - DNA, 20 bp, human
gcagcaccagctgacccggg

SEQ ID NO: 206312 - DNA, 20 bp, human
gacgccagcaccagctgacc

SEQ ID NO: 206313 - DNA, 20 bp, human
gctcgcggcgggccggcggt

SEQ ID NO: 206314 - DNA, 20 bp, human
ggggtcccaccgccgaccgc

SEQ ID NO: 206315 - DNA, 20 bp, human
gagggggcagggctcgcggc

SEQ ID NO: 206316 - DNA, 20 bp, human
ggagtctcgccagtccctct

SEQ ID NO: 206317 - DNA, 20 bp, human
gccgccccgcgcttacaccc

SEQ ID NO: 206318 - DNA, 20 bp, human
gtacacccgggagcgtcggg

SEQ ID NO: 206319 - DNA, 20 bp, human
gaactagtgcatgctggctg

SEQ ID NO: 206320 - DNA, 20 bp, human
gcgggagaactagtgcatgc

SEQ ID NO: 206321 - DNA, 20 bp, human
gcgcttacacccgggagcgt

SEQ ID NO: 206322 - DNA, 20 bp, human
ggctcccgggtgtaagcgcg

SEQ ID NO: 206323 - DNA, 20 bp, human
gggcgggacagtcagcccag

SEQ ID NO: 206324 - DNA, 20 bp, human
gatggcggacgcaaagccgg

SEQ ID NO: 206325 - DNA, 20 bp, human
gacactagctaggctcttcc

SEQ ID NO: 206326 - DNA, 20 bp, human
ggcagcgcgcggaggaactg

SEQ ID NO: 206327 - DNA, 20 bp, human
ggccgcgcgctgtcccccag

SEQ ID NO: 206328 - DNA, 20 bp, human
ggaactggggataagcgccc

SEQ ID NO: 206329 - DNA, 20 bp, human
gggatcgcctacagaggtac

SEQ ID NO: 206330 - DNA, 20 bp, human
gcccggaacgcacacggtgg

SEQ ID NO: 206331 - DNA, 20 bp, human
gccgcccccggtacctctgt

SEQ ID NO: 206332 - DNA, 20 bp, human
gccccgccccggaacgcaca

SEQ ID NO: 206333 - DNA, 20 bp, human
gtcacagcgttaaacccgga

SEQ ID NO: 206334 - DNA, 20 bp, human
gagagcaggatcgcctacag

SEQ ID NO: 206335 - DNA, 20 bp, human
gggcggggcggcttttctgt

SEQ ID NO: 206336 - DNA, 20 bp, human
ggtgaacccccaaaaggggc

SEQ ID NO: 206337 - DNA, 20 bp, human
gggcaattccgtagtggagg

SEQ ID NO: 206338 - DNA, 20 bp, human
gagaggcggcaattccgtag

SEQ ID NO: 206339 - DNA, 20 bp, human
gccagagcccgcctccacta

SEQ ID NO: 206340 - DNA, 20 bp, human
gcggaattgccgcctctcat

SEQ ID NO: 206341 - DNA, 20 bp, human
gtctcattgggctcctaact

SEQ ID NO: 206342 - DNA, 20 bp, human
gcgtggctccgcctactcgg

SEQ ID NO: 206343 - DNA, 20 bp, human
gagaagggggttgcagtcta

SEQ ID NO: 206344 - DNA, 20 bp, human
gacggccccgccccttttgg

SEQ ID NO: 206345 - DNA, 20 bp, human
ggccccggccgcacactccc

SEQ ID NO: 206346 - DNA, 20 bp, human
ggggaattgtagtctctcct

SEQ ID NO: 206347 - DNA, 20 bp, human
gtcaggcggctgcacgaagg

SEQ ID NO: 206348 - DNA, 20 bp, human
gcgagagaacgaggttcagg

SEQ ID NO: 206349 - DNA, 20 bp, human
ggctgcacgaagggggtgga

SEQ ID NO: 206350 - DNA, 20 bp, human
gcgcagaaagcggagaccga

SEQ ID NO: 206351 - DNA, 20 bp, human
gctgccgcgttggttttcgg

SEQ ID NO: 206352 - DNA, 20 bp, human
gaaaaatcccgcggtccgtg

SEQ ID NO: 206353 - DNA, 20 bp, human
gaaacgctcgcgagagaacg

SEQ ID NO: 206354 - DNA, 20 bp, human
gtgtctgggcgcatgcgctt

SEQ ID NO: 206355 - DNA, 20 bp, human
gaggcgggagggcgggtagg

SEQ ID NO: 206356 - DNA, 20 bp, human
gcggcggcgcgggcgagggt

SEQ ID NO: 206357 - DNA, 20 bp, human
gctccctccgggactcatct

SEQ ID NO: 206358 - DNA, 20 bp, human
gctagcgacggcgggggtag

SEQ ID NO: 206359 - DNA, 20 bp, human
gagccgacggactccgagga

SEQ ID NO: 206360 - DNA, 20 bp, human
gcgtctcctagcgacggcgg

SEQ ID NO: 206361 - DNA, 20 bp, human
gtcgccgcggtgaccgtcct

SEQ ID NO: 206362 - DNA, 20 bp, human
ggctaggagacgccggaagt

SEQ ID NO: 206363 - DNA, 20 bp, human
gaggagggtcccaagagtgg

SEQ ID NO: 206364 - DNA, 20 bp, human
gcaggggcgcaggaaagctg

SEQ ID NO: 206365 - DNA, 20 bp, human
gttccggcgtctcctagcga

SEQ ID NO: 206366 - DNA, 20 bp, human
gcatctgcacagagcgtgta

SEQ ID NO: 206367 - DNA, 20 bp, human
gaggcagagcaaccaatcaa

SEQ ID NO: 206368 - DNA, 20 bp, human
gagaggaaactggtcggctg

SEQ ID NO: 206369 - DNA, 20 bp, human
ggggggatggggtcggagac

SEQ ID NO: 206370 - DNA, 20 bp, human
gacccctcttgctgccgcat

SEQ ID NO: 206371 - DNA, 20 bp, human
gatgctcattccgggacaag

SEQ ID NO: 206372 - DNA, 20 bp, human
ggcggcagcaagaggggtca

SEQ ID NO: 206373 - DNA, 20 bp, human
gccaaaagcaataagaggga

SEQ ID NO: 206374 - DNA, 20 bp, human
ggatgagtcaccaagggaca

SEQ ID NO: 206375 - DNA, 20 bp, human
gcgggaagacatgaccagag

SEQ ID NO: 206376 - DNA, 20 bp, human
ggtgccgtgggcttactcac

SEQ ID NO: 206377 - DNA, 20 bp, human
gccccctgtgagtaagccca

SEQ ID NO: 206378 - DNA, 20 bp, human
ggccgcccgcctctgtcact

SEQ ID NO: 206379 - DNA, 20 bp, human
gtgtctcccagtgacagagg

SEQ ID NO: 206380 - DNA, 20 bp, human
gctgcacttagctgtgccgt

SEQ ID NO: 206381 - DNA, 20 bp, human
ggactgtctcccagtgacag

SEQ ID NO: 206382 - DNA, 20 bp, human
gactatgtgagcctcaactg

SEQ ID NO: 206383 - DNA, 20 bp, human
gccacttaaatgcagctcca

SEQ ID NO: 206384 - DNA, 20 bp, human
ggcttttagtacattgtttc

SEQ ID NO: 206385 - DNA, 20 bp, human
gaagaattgggttggtttac

SEQ ID NO: 206386 - DNA, 20 bp, human
gcaaagcagagaagcgagag

SEQ ID NO: 206387 - DNA, 20 bp, human
gaccccttgacagcaaggga

SEQ ID NO: 206388 - DNA, 20 bp, human
gggagaccccttgacagcaa

SEQ ID NO: 206389 - DNA, 20 bp, human
gctgagactaagggggccgt

SEQ ID NO: 206390 - DNA, 20 bp, human
gagggggccgtaggtgacat

SEQ ID NO: 206391 - DNA, 20 bp, human
ggggccgggatccggaataa

SEQ ID NO: 206392 - DNA, 20 bp, human
gcgggatccggaataagggg

SEQ ID NO: 206393 - DNA, 20 bp, human
gcggaataaggggcggcttg

SEQ ID NO: 206394 - DNA, 20 bp, human
gggagccaccttgggggaag

SEQ ID NO: 206395 - DNA, 20 bp, human
ggggcaaactcgctgaaatc

SEQ ID NO: 206396 - DNA, 20 bp, human
gtgggtggagagtgacctaa

SEQ ID NO: 206397 - DNA, 20 bp, human
gccagagggaaccaataaaa

SEQ ID NO: 206398 - DNA, 20 bp, human
ggcaaaagactgagtcagaa

SEQ ID NO: 206399 - DNA, 20 bp, human
gtggctctatagcttaataa

SEQ ID NO: 206400 - DNA, 20 bp, human
gggtcactctccacccactt

SEQ ID NO: 206401 - DNA, 20 bp, human
gctagagagaaaagtttcct

SEQ ID NO: 206402 - DNA, 20 bp, human
gcatttactcatgtactcag

SEQ ID NO: 206403 - DNA, 20 bp, human
gagagccagattgttagcaa

SEQ ID NO: 206404 - DNA, 20 bp, human
gactgcctttgctaacaatc

SEQ ID NO: 206405 - DNA, 20 bp, human
gtcagtcttttgcggattgc

SEQ ID NO: 206406 - DNA, 20 bp, human
gtgtcaaatgagtgagtcga

SEQ ID NO: 206407 - DNA, 20 bp, human
gcctccgccgcggggaagga

SEQ ID NO: 206408 - DNA, 20 bp, human
ggaggtgcggcgacaggacg

SEQ ID NO: 206409 - DNA, 20 bp, human
gcgcgggagggggtcggctg

SEQ ID NO: 206410 - DNA, 20 bp, human
gcagcggtggccggcaaatg

SEQ ID NO: 206411 - DNA, 20 bp, human
gtggagccgaacgcgggagg

SEQ ID NO: 206412 - DNA, 20 bp, human
ggtcggctgaggcggattga

SEQ ID NO: 206413 - DNA, 20 bp, human
ggaccgaccaaccccaaagg

SEQ ID NO: 206414 - DNA, 20 bp, human
gggtggccggcaaatgaggt

SEQ ID NO: 206415 - DNA, 20 bp, human
gggctgaggcggattgaggg

SEQ ID NO: 206416 - DNA, 20 bp, human
gtataaaaacagccactacc

SEQ ID NO: 206417 - DNA, 20 bp, human
gactgaaagtctcgagttcc

SEQ ID NO: 206418 - DNA, 20 bp, human
gtggtaagagtactgagaat

SEQ ID NO: 206419 - DNA, 20 bp, human
ggggaacagagagaattgtg

SEQ ID NO: 206420 - DNA, 20 bp, human
gagtcatctgactgagaata

SEQ ID NO: 206421 - DNA, 20 bp, human
gagtctcgagttcctggtag

SEQ ID NO: 206422 - DNA, 20 bp, human
gggggtccccttctagaaaa

SEQ ID NO: 206423 - DNA, 20 bp, human
gtgcccagcaaagaagatta

SEQ ID NO: 206424 - DNA, 20 bp, human
ggtggggcagcaccgctcct

SEQ ID NO: 206425 - DNA, 20 bp, human
gtactgtcgtaatgtttcat

SEQ ID NO: 206426 - DNA, 20 bp, human
gtgccgcccgggagcaccct

SEQ ID NO: 206427 - DNA, 20 bp, human
gcgcaggcgcagacgggcga

SEQ ID NO: 206428 - DNA, 20 bp, human
gaggcgcagacgggcgacgg

SEQ ID NO: 206429 - DNA, 20 bp, human
gtccccagctgcggggcgat

SEQ ID NO: 206430 - DNA, 20 bp, human
ggaggtgcctacacttccca

SEQ ID NO: 206431 - DNA, 20 bp, human
gacggcctgaggggcgacgt

SEQ ID NO: 206432 - DNA, 20 bp, human
gcaagtcccagcacgcttcg

SEQ ID NO: 206433 - DNA, 20 bp, human
gttcccagggtgctcccggg

SEQ ID NO: 206434 - DNA, 20 bp, human
gtcgacgccaccgctccgcc

SEQ ID NO: 206435 - DNA, 20 bp, human
ggactcccggattccgtgag

SEQ ID NO: 206436 - DNA, 20 bp, human
ggaaccccaggatcgaggga

SEQ ID NO: 206437 - DNA, 20 bp, human
gcctgggccctagggtgtga

SEQ ID NO: 206438 - DNA, 20 bp, human
gaggccttgtgagatggacg

SEQ ID NO: 206439 - DNA, 20 bp, human
gcgctcaagcactccctcgt

SEQ ID NO: 206440 - DNA, 20 bp, human
gaggcctcgtccatctcaca

SEQ ID NO: 206441 - DNA, 20 bp, human
gcggggcctcggacacgcgc

SEQ ID NO: 206442 - DNA, 20 bp, human
gaggcagagacggtagtgac

SEQ ID NO: 206443 - DNA, 20 bp, human
gccccgccgggcttctgcct

SEQ ID NO: 206444 - DNA, 20 bp, human
gtgtgtcctgggaccaacga

SEQ ID NO: 206445 - DNA, 20 bp, human
gaacccgcgagcccgcatca

SEQ ID NO: 206446 - DNA, 20 bp, human
gtcctcgcgcgcatccccaa

SEQ ID NO: 206447 - DNA, 20 bp, human
gaggcggccgcgggtcccca

SEQ ID NO: 206448 - DNA, 20 bp, human
gacagggccccaaggtacca

SEQ ID NO: 206449 - DNA, 20 bp, human
gcccgaggccgaacacggga

SEQ ID NO: 206450 - DNA, 20 bp, human
gacttcccgaggccgaacac

SEQ ID NO: 206451 - DNA, 20 bp, human
gaggggcgcgcgggtccctt

SEQ ID NO: 206452 - DNA, 20 bp, human
gcgggagacagggtgtcaag

SEQ ID NO: 206453 - DNA, 20 bp, human
gagccgctcggccccagggc

SEQ ID NO: 206454 - DNA, 20 bp, human
gcctgaagccccgtccccgg

SEQ ID NO: 206455 - DNA, 20 bp, human
gccttcctagcaggggtccc

SEQ ID NO: 206456 - DNA, 20 bp, human
ggcggtccggaacccgtgag

SEQ ID NO: 206457 - DNA, 20 bp, human
ggtgcccaagaaccaccagg

SEQ ID NO: 206458 - DNA, 20 bp, human
gtggtcccacaagtactcgg

SEQ ID NO: 206459 - DNA, 20 bp, human
gagcccctggcagccgctca

SEQ ID NO: 206460 - DNA, 20 bp, human
ggcggtgcccaagaaccacc

SEQ ID NO: 206461 - DNA, 20 bp, human
gaacccgtgagcggctgcca

SEQ ID NO: 206462 - DNA, 20 bp, human
gttggcctggtcgaccatca

SEQ ID NO: 206463 - DNA, 20 bp, human
gcaagaaccaccaggcggtc

SEQ ID NO: 206464 - DNA, 20 bp, human
gacctgggggggttcttcgg

SEQ ID NO: 206465 - DNA, 20 bp, human
gctaaaaccaagggcgggag

SEQ ID NO: 206466 - DNA, 20 bp, human
ggcccccggccgggctaagg

SEQ ID NO: 206467 - DNA, 20 bp, human
gtgcccccttagcccggccg

SEQ ID NO: 206468 - DNA, 20 bp, human
ggacgcccccggccgggcta

SEQ ID NO: 206469 - DNA, 20 bp, human
gcccccgcgaagttgctcat

SEQ ID NO: 206470 - DNA, 20 bp, human
gtaagggggcagcggggctc

SEQ ID NO: 206471 - DNA, 20 bp, human
gtcgaggctccgccctccgc

SEQ ID NO: 206472 - DNA, 20 bp, human
ggggggcgtcctgcggaggg

SEQ ID NO: 206473 - DNA, 20 bp, human
gggagggaccaatcggctcg

SEQ ID NO: 206474 - DNA, 20 bp, human
gcccggccgggggcgtcctg

SEQ ID NO: 206475 - DNA, 20 bp, human
ggccgggggcgtcctgcgga

SEQ ID NO: 206476 - DNA, 20 bp, human
ggacagctccagtttcatca

SEQ ID NO: 206477 - DNA, 20 bp, human
gagggacatctctgctggta

SEQ ID NO: 206478 - DNA, 20 bp, human
gtaaatagaagcagggtgcg

SEQ ID NO: 206479 - DNA, 20 bp, human
gtagaagcagggtgcggggt

SEQ ID NO: 206480 - DNA, 20 bp, human
gaaggagagcttagtgacga

SEQ ID NO: 206481 - DNA, 20 bp, human
gccctctgccgtgatgaaac

SEQ ID NO: 206482 - DNA, 20 bp, human
ggggctgctggggtttaagt

SEQ ID NO: 206483 - DNA, 20 bp, human
gtaattaggagctgtactga

SEQ ID NO: 206484 - DNA, 20 bp, human
ggatctagtaatttccactc

SEQ ID NO: 206485 - DNA, 20 bp, human
gtccagtttcatcacggcag

SEQ ID NO: 206486 - DNA, 20 bp, human
gaaaggggctgactgcagac

SEQ ID NO: 206487 - DNA, 20 bp, human
ggaggagacgtccaagaaag

SEQ ID NO: 206488 - DNA, 20 bp, human
gctatgaggaggaaactcag

SEQ ID NO: 206489 - DNA, 20 bp, human
ggctctgggcccgttttcct

SEQ ID NO: 206490 - DNA, 20 bp, human
ggcaaagagaaagacggctg

SEQ ID NO: 206491 - DNA, 20 bp, human
gtggaaaagtgaggtaatcc

SEQ ID NO: 206492 - DNA, 20 bp, human
gcctgggctcctaggaaaac

SEQ ID NO: 206493 - DNA, 20 bp, human
gatgcagatcctgggatcct

SEQ ID NO: 206494 - DNA, 20 bp, human
gttggctctgagtagcacgg

SEQ ID NO: 206495 - DNA, 20 bp, human
gagaaagacggctgtggagg

SEQ ID NO: 206496 - DNA, 20 bp, human
gagggaggaagtggtgtgtc

SEQ ID NO: 206497 - DNA, 20 bp, human
ggggatgggaaacttgggtt

SEQ ID NO: 206498 - DNA, 20 bp, human
gtgcgacggcctgagacgag

SEQ ID NO: 206499 - DNA, 20 bp, human
ggggcaatacagtcgggtcc

SEQ ID NO: 206500 - DNA, 20 bp, human
gtacagtcgggtccagggga

SEQ ID NO: 206501 - DNA, 20 bp, human
gcagagcgtggaagcgggat

SEQ ID NO: 206502 - DNA, 20 bp, human
gaatgattgggcaatacagt

SEQ ID NO: 206503 - DNA, 20 bp, human
ggaagcgggatgggaaactt

SEQ ID NO: 206504 - DNA, 20 bp, human
gggtggtgatgacaaatgaa

SEQ ID NO: 206505 - DNA, 20 bp, human
gcgagggggcgggtccaagg

SEQ ID NO: 206506 - DNA, 20 bp, human
gtgggcccggcgtggtctcc

SEQ ID NO: 206507 - DNA, 20 bp, human
gtcaagaaggcagacgcgct

SEQ ID NO: 206508 - DNA, 20 bp, human
gccgcggggccggggttcag

SEQ ID NO: 206509 - DNA, 20 bp, human
gggcgggtttaattgagtcc

SEQ ID NO: 206510 - DNA, 20 bp, human
gcccgctctgcagcggcgtc

SEQ ID NO: 206511 - DNA, 20 bp, human
gagccgccgtgtgaagtcgg

SEQ ID NO: 206512 - DNA, 20 bp, human
gggcggcgcttcctgcgccc

SEQ ID NO: 206513 - DNA, 20 bp, human
gtgactcattcttatttccg

SEQ ID NO: 206514 - DNA, 20 bp, human
gttgaggcctgcccctcggg

SEQ ID NO: 206515 - DNA, 20 bp, human
gtaattgagtcccggggcgc

SEQ ID NO: 206516 - DNA, 20 bp, human
ggcggtcgaaacgatagctc

SEQ ID NO: 206517 - DNA, 20 bp, human
gcagccgcgtgcccgaccct

SEQ ID NO: 206518 - DNA, 20 bp, human
gaggccgagggtcgggcacg

SEQ ID NO: 206519 - DNA, 20 bp, human
gcgccgcggggtttaacccg

SEQ ID NO: 206520 - DNA, 20 bp, human
ggctgcaccaatgatctccg

SEQ ID NO: 206521 - DNA, 20 bp, human
gggggctggaggccgagggt

SEQ ID NO: 206522 - DNA, 20 bp, human
gttaaaccccgcggcgaagg

SEQ ID NO: 206523 - DNA, 20 bp, human
gtgcctcgggttaaaccccg

SEQ ID NO: 206524 - DNA, 20 bp, human
ggcaccaatgatctccgagg

SEQ ID NO: 206525 - DNA, 20 bp, human
ggtcgggcacgcggctggga

SEQ ID NO: 206526 - DNA, 20 bp, human
ggggcattgagtggaaagct

SEQ ID NO: 206527 - DNA, 20 bp, human
gtaccaagccctctatagga

SEQ ID NO: 206528 - DNA, 20 bp, human
gcccaggccgactctccttg

SEQ ID NO: 206529 - DNA, 20 bp, human
gctgtgggccctcctataga

SEQ ID NO: 206530 - DNA, 20 bp, human
gagggcttggtaggcggtgg

SEQ ID NO: 206531 - DNA, 20 bp, human
gggtggacgggacttttgga

SEQ ID NO: 206532 - DNA, 20 bp, human
gcgcctaccaagccctctat

SEQ ID NO: 206533 - DNA, 20 bp, human
gcccgcccagaaatgcagac

SEQ ID NO: 206534 - DNA, 20 bp, human
gagccaaccacaaggagagt

SEQ ID NO: 206535 - DNA, 20 bp, human
gtggaggtggacgggacttt

SEQ ID NO: 206536 - DNA, 20 bp, human
ggctccctcgggctggggtg

SEQ ID NO: 206537 - DNA, 20 bp, human
ggggaagagtcatcgcctgt

SEQ ID NO: 206538 - DNA, 20 bp, human
gtgtcggggctaggatatga

SEQ ID NO: 206539 - DNA, 20 bp, human
ggcggggtcccagcgtaaga

SEQ ID NO: 206540 - DNA, 20 bp, human
gggcgggcagcgctacgcgt

SEQ ID NO: 206541 - DNA, 20 bp, human
gccgcctcaccccagcccga

SEQ ID NO: 206542 - DNA, 20 bp, human
ggcagcgctacgcgtggggt

SEQ ID NO: 206543 - DNA, 20 bp, human
gcccagcccgagggagccca

SEQ ID NO: 206544 - DNA, 20 bp, human
gcacccacgctcttgaaatc

SEQ ID NO: 206545 - DNA, 20 bp, human
gggaccgaacgtcctgtggg

SEQ ID NO: 206546 - DNA, 20 bp, human
ggagcggggtcggaggtgaa

SEQ ID NO: 206547 - DNA, 20 bp, human
gtacccggctgtggcagaag

SEQ ID NO: 206548 - DNA, 20 bp, human
gcggcccggcacacggagaa

SEQ ID NO: 206549 - DNA, 20 bp, human
ggaacggcctggagtaaccc

SEQ ID NO: 206550 - DNA, 20 bp, human
gtcagccggcgagctccatg

SEQ ID NO: 206551 - DNA, 20 bp, human
ggggcccagcggctagaggg

SEQ ID NO: 206552 - DNA, 20 bp, human
gcatgaggtgactacgtccg

SEQ ID NO: 206553 - DNA, 20 bp, human
gctagccgctgggccccgaa

SEQ ID NO: 206554 - DNA, 20 bp, human
ggagaaggggcggggcttca

SEQ ID NO: 206555 - DNA, 20 bp, human
ggatgccgatggtccgagcg

SEQ ID NO: 206556 - DNA, 20 bp, human
gtaagcttgaggtcaggaga

SEQ ID NO: 206557 - DNA, 20 bp, human
gtgtgctcccaggggcttcg

SEQ ID NO: 206558 - DNA, 20 bp, human
gaggctatctgtgctcccag

SEQ ID NO: 206559 - DNA, 20 bp, human
gggcgtgcatcaggccatgg

SEQ ID NO: 206560 - DNA, 20 bp, human
gtgagtgaggacctttgaaa

SEQ ID NO: 206561 - DNA, 20 bp, human
gggggaacgctcacccatgt

SEQ ID NO: 206562 - DNA, 20 bp, human
gccggccagcactccgacat

SEQ ID NO: 206563 - DNA, 20 bp, human
gtgctgcactgccaacttgg

SEQ ID NO: 206564 - DNA, 20 bp, human
gactacctaagcttgaggtc

SEQ ID NO: 206565 - DNA, 20 bp, human
gacaacagccctgggtagac

SEQ ID NO: 206566 - DNA, 20 bp, human
gtgtaggggtgtcccatatt

SEQ ID NO: 206567 - DNA, 20 bp, human
gtcagcggcgggtcggaggt

SEQ ID NO: 206568 - DNA, 20 bp, human
ggggaagcggtggaaaatat

SEQ ID NO: 206569 - DNA, 20 bp, human
gcggaggtaggccggcccgg

SEQ ID NO: 206570 - DNA, 20 bp, human
ggagggccccgccttccgga

SEQ ID NO: 206571 - DNA, 20 bp, human
ggggcggggctccgtccgga

SEQ ID NO: 206572 - DNA, 20 bp, human
gcggcagccgaaatgagctg

SEQ ID NO: 206573 - DNA, 20 bp, human
gttcggctgccgaagctcag

SEQ ID NO: 206574 - DNA, 20 bp, human
gacacacgatagggaagcgg

SEQ ID NO: 206575 - DNA, 20 bp, human
gtgcgcagccacctgtccca

SEQ ID NO: 206576 - DNA, 20 bp, human
ggtaaaccgcaggtcagcga

SEQ ID NO: 206577 - DNA, 20 bp, human
ggcggaagtggaggttgttg

SEQ ID NO: 206578 - DNA, 20 bp, human
gaccgcgcacagcgattggg

SEQ ID NO: 206579 - DNA, 20 bp, human
gtggctccgagggctgttcg

SEQ ID NO: 206580 - DNA, 20 bp, human
gggccgccgtcgctgacctg

SEQ ID NO: 206581 - DNA, 20 bp, human
ggaggttgttgtggctccga

SEQ ID NO: 206582 - DNA, 20 bp, human
ggggctcaggcgaggctgga

SEQ ID NO: 206583 - DNA, 20 bp, human
ggggtcacccactgctcttc

SEQ ID NO: 206584 - DNA, 20 bp, human
gaggaccgcgcacagcgatt

SEQ ID NO: 206585 - DNA, 20 bp, human
ggggcccagacccggctaca

SEQ ID NO: 206586 - DNA, 20 bp, human
gttagccggcccagcgagga

SEQ ID NO: 206587 - DNA, 20 bp, human
ggtctgcgacgcaccggaag

SEQ ID NO: 206588 - DNA, 20 bp, human
gcctcggcccatgctctaga

SEQ ID NO: 206589 - DNA, 20 bp, human
gagggtcccgttcagaaaaa

SEQ ID NO: 206590 - DNA, 20 bp, human
gacggcgcgtaggctgtgtg

SEQ ID NO: 206591 - DNA, 20 bp, human
ggggcccagccgagcaacgt

SEQ ID NO: 206592 - DNA, 20 bp, human
gccggggtgataagtgtcca

SEQ ID NO: 206593 - DNA, 20 bp, human
gtgaaacccgaacacacatt

SEQ ID NO: 206594 - DNA, 20 bp, human
ggggcccgcgaggggtacgt

SEQ ID NO: 206595 - DNA, 20 bp, human
ggagcaacgtggggcgaagg

SEQ ID NO: 206596 - DNA, 20 bp, human
gtgccaggcgggctcccaag

SEQ ID NO: 206597 - DNA, 20 bp, human
ggggaggactacaaccccca

SEQ ID NO: 206598 - DNA, 20 bp, human
gcgagcgcaacggaggtcga

SEQ ID NO: 206599 - DNA, 20 bp, human
ggacccccgcggcgcttggt

SEQ ID NO: 206600 - DNA, 20 bp, human
gccccgcggcgcttggtggg

SEQ ID NO: 206601 - DNA, 20 bp, human
gctgtcccactgcaccctgg

SEQ ID NO: 206602 - DNA, 20 bp, human
gctgtgcagcgcgacccccg

SEQ ID NO: 206603 - DNA, 20 bp, human
gtgggagcccgcctggcacc

SEQ ID NO: 206604 - DNA, 20 bp, human
gcaccgcccaccaagcgccg

SEQ ID NO: 206605 - DNA, 20 bp, human
gcactctgcagactcgactg

SEQ ID NO: 206606 - DNA, 20 bp, human
ggggccgcgggcatctcggc

SEQ ID NO: 206607 - DNA, 20 bp, human
gagccaggtgcacgtgacta

SEQ ID NO: 206608 - DNA, 20 bp, human
gtgcacgtgactaaggcctt

SEQ ID NO: 206609 - DNA, 20 bp, human
gcttgcgcggccaaaggagc

SEQ ID NO: 206610 - DNA, 20 bp, human
gtctcggcgggtataatctc

SEQ ID NO: 206611 - DNA, 20 bp, human
gtgcgcggtcccccgcagca

SEQ ID NO: 206612 - DNA, 20 bp, human
gaggaacaaaacagtatctc

SEQ ID NO: 206613 - DNA, 20 bp, human
ggtaggcgtgtgacgtcatc

SEQ ID NO: 206614 - DNA, 20 bp, human
ggctggccggaggaaattgt

SEQ ID NO: 206615 - DNA, 20 bp, human
ggcaagcgcagtggggccgg

SEQ ID NO: 206616 - DNA, 20 bp, human
ggcgcttcaggacgctaaaa

SEQ ID NO: 206617 - DNA, 20 bp, human
gggcgagagtaattgttcaa

SEQ ID NO: 206618 - DNA, 20 bp, human
ggagtaacggatgaaagcta

SEQ ID NO: 206619 - DNA, 20 bp, human
gcctgaagcgctttgagtaa

SEQ ID NO: 206620 - DNA, 20 bp, human
gggagccccaaccacgccac

SEQ ID NO: 206621 - DNA, 20 bp, human
gccagcctgtggcgtggttg

SEQ ID NO: 206622 - DNA, 20 bp, human
gcgagggaatacgcccgtct

SEQ ID NO: 206623 - DNA, 20 bp, human
ggggctcccagagctatgcc

SEQ ID NO: 206624 - DNA, 20 bp, human
gggtatttgcgcgtatttgg

SEQ ID NO: 206625 - DNA, 20 bp, human
gtctctactaaatcctgtgt

SEQ ID NO: 206626 - DNA, 20 bp, human
gacggcgcacgcaagggtca

SEQ ID NO: 206627 - DNA, 20 bp, human
ggtcgctgcgacctggggag

SEQ ID NO: 206628 - DNA, 20 bp, human
gaggggtcgcatcccctctc

SEQ ID NO: 206629 - DNA, 20 bp, human
gggagcccgtgggcgggatg

SEQ ID NO: 206630 - DNA, 20 bp, human
ggggttagagggcgtggctg

SEQ ID NO: 206631 - DNA, 20 bp, human
ggacgggaacctgggttaga

SEQ ID NO: 206632 - DNA, 20 bp, human
gagggtcacggagcatgcgt

SEQ ID NO: 206633 - DNA, 20 bp, human
gagggcccggttgcgctgaa

SEQ ID NO: 206634 - DNA, 20 bp, human
gacggggcgctgcgctaggc

SEQ ID NO: 206635 - DNA, 20 bp, human
gcccgaacgcgggactcctc

SEQ ID NO: 206636 - DNA, 20 bp, human
gcgcgcgcgcagtcgagcgt

SEQ ID NO: 206637 - DNA, 20 bp, human
ggctcgactgcgcgcgcggt

SEQ ID NO: 206638 - DNA, 20 bp, human
gtcggttcctcgccttggga

SEQ ID NO: 206639 - DNA, 20 bp, human
ggacagaggccacgcccgta

SEQ ID NO: 206640 - DNA, 20 bp, human
gccttgggagggaccactgg

SEQ ID NO: 206641 - DNA, 20 bp, human
gcggggccgaggtgcgctcg

SEQ ID NO: 206642 - DNA, 20 bp, human
gacagcgcgctcgcagcggg

SEQ ID NO: 206643 - DNA, 20 bp, human
gcggaacagcgcgctcgcag

SEQ ID NO: 206644 - DNA, 20 bp, human
gagcgtcggttcctcgcctt

SEQ ID NO: 206645 - DNA, 20 bp, human
ggcgcgcgcggtcggtcagc

SEQ ID NO: 206646 - DNA, 20 bp, human
gctcgcgtgagcaggatgga

SEQ ID NO: 206647 - DNA, 20 bp, human
gcgagacttgagcaaggcag

SEQ ID NO: 206648 - DNA, 20 bp, human
gactgtgacggtgacgaaga

SEQ ID NO: 206649 - DNA, 20 bp, human
gaagtctcgcgtgagcagga

SEQ ID NO: 206650 - DNA, 20 bp, human
gaaccccaagagagacaaac

SEQ ID NO: 206651 - DNA, 20 bp, human
gacggtgacgaagacggcgg

SEQ ID NO: 206652 - DNA, 20 bp, human
gatggcggcggcgactgtga

SEQ ID NO: 206653 - DNA, 20 bp, human
gttgagcaaggcaggggggc

SEQ ID NO: 206654 - DNA, 20 bp, human
gctcacgcgagacttgagca

SEQ ID NO: 206655 - DNA, 20 bp, human
gtggagggcgaaagcgagga

SEQ ID NO: 206656 - DNA, 20 bp, human
ggcactgtggacgatgagtc

SEQ ID NO: 206657 - DNA, 20 bp, human
gggagatccctctaagtcag

SEQ ID NO: 206658 - DNA, 20 bp, human
gtatcccatcaccccgtcgg

SEQ ID NO: 206659 - DNA, 20 bp, human
gagtcagcggaacgcagggc

SEQ ID NO: 206660 - DNA, 20 bp, human
ggcgggattaaggagtttgg

SEQ ID NO: 206661 - DNA, 20 bp, human
gcgggcgggattaaggagtt

SEQ ID NO: 206662 - DNA, 20 bp, human
ggactagactctaggtcgga

SEQ ID NO: 206663 - DNA, 20 bp, human
gggaggactagactctaggt

SEQ ID NO: 206664 - DNA, 20 bp, human
gtccacagtgcaccgggcgg

SEQ ID NO: 206665 - DNA, 20 bp, human
gaagggagggcttctccggt

SEQ ID NO: 206666 - DNA, 20 bp, human
ggaccgaggggcggccgaca

SEQ ID NO: 206667 - DNA, 20 bp, human
gggagggcccgtgaggggtg

SEQ ID NO: 206668 - DNA, 20 bp, human
ggccgcccctcggtccctgg

SEQ ID NO: 206669 - DNA, 20 bp, human
gtctggagcgcgctggaccc

SEQ ID NO: 206670 - DNA, 20 bp, human
gctggaccctggctccggac

SEQ ID NO: 206671 - DNA, 20 bp, human
gccggaccggcgcgccgatg

SEQ ID NO: 206672 - DNA, 20 bp, human
ggaggaaggcggcgcgagaa

SEQ ID NO: 206673 - DNA, 20 bp, human
gggcgcgccggtccggagcc

SEQ ID NO: 206674 - DNA, 20 bp, human
gcccaagtgcccggactctg

SEQ ID NO: 206675 - DNA, 20 bp, human
gggcgcgccgatggggaagc

SEQ ID NO: 206676 - DNA, 20 bp, human
ggggcctgggcggaggatgg

SEQ ID NO: 206677 - DNA, 20 bp, human
gagctggcagatcgtctctg

SEQ ID NO: 206678 - DNA, 20 bp, human
ggcagatcgtctctgagggt

SEQ ID NO: 206679 - DNA, 20 bp, human
ggaatcagagagctcgtcca

SEQ ID NO: 206680 - DNA, 20 bp, human
ggggctgtacgaagtgaaga

SEQ ID NO: 206681 - DNA, 20 bp, human
gccagcactgcctggaagtg

SEQ ID NO: 206682 - DNA, 20 bp, human
gtcacttcgtacagccctgg

SEQ ID NO: 206683 - DNA, 20 bp, human
gctctcttcgtggttatctt

SEQ ID NO: 206684 - DNA, 20 bp, human
gaggcccccatcctccgccc

SEQ ID NO: 206685 - DNA, 20 bp, human
gcttccaggcagtgctggga

SEQ ID NO: 206686 - DNA, 20 bp, human
ggacgcccgcgcatcccggt

SEQ ID NO: 206687 - DNA, 20 bp, human
ggggcaacgggtctgagcga

SEQ ID NO: 206688 - DNA, 20 bp, human
gcatcccggttggccctcgg

SEQ ID NO: 206689 - DNA, 20 bp, human
gcccttggccgccaggttcg

SEQ ID NO: 206690 - DNA, 20 bp, human
gcctgcgggcgcccgggcaa

SEQ ID NO: 206691 - DNA, 20 bp, human
gcatccggcagcaccgcctg

SEQ ID NO: 206692 - DNA, 20 bp, human
gtcgcgctgctcattggctc

SEQ ID NO: 206693 - DNA, 20 bp, human
gccaatgagcagcgcgaccg

SEQ ID NO: 206694 - DNA, 20 bp, human
gggccagccagccacgaacc

SEQ ID NO: 206695 - DNA, 20 bp, human
gtggccctcgggggcggttg

SEQ ID NO: 206696 - DNA, 20 bp, human
gtccagggaccaccccggtc

SEQ ID NO: 206697 - DNA, 20 bp, human
ggcgcggcggcctcattccg

SEQ ID NO: 206698 - DNA, 20 bp, human
gagtgaggcggggcctgcca

SEQ ID NO: 206699 - DNA, 20 bp, human
gcctcacttccggaccgggg

SEQ ID NO: 206700 - DNA, 20 bp, human
gctccccggcggtgacaggc

SEQ ID NO: 206701 - DNA, 20 bp, human
gagagcgcggggtgaccgcg

SEQ ID NO: 206702 - DNA, 20 bp, human
gggcctgccacggccgtctc

SEQ ID NO: 206703 - DNA, 20 bp, human
gcggcggcctcattccgggg

SEQ ID NO: 206704 - DNA, 20 bp, human
gccccgcctcacttccggac

SEQ ID NO: 206705 - DNA, 20 bp, human
gacgcctctcgcagcgtcca

SEQ ID NO: 206706 - DNA, 20 bp, human
ggacgagtgaaggacgtgga

SEQ ID NO: 206707 - DNA, 20 bp, human
gtgcccgcgccgggccgcta

SEQ ID NO: 206708 - DNA, 20 bp, human
ggcgattggccggcagccaa

SEQ ID NO: 206709 - DNA, 20 bp, human
gggccccggcaggttagact

SEQ ID NO: 206710 - DNA, 20 bp, human
gactgagaggcgactattgg

SEQ ID NO: 206711 - DNA, 20 bp, human
ggatggagacactggcgctg

SEQ ID NO: 206712 - DNA, 20 bp, human
gaggaaaggttgacgagtga

SEQ ID NO: 206713 - DNA, 20 bp, human
gcgggagccagcagcgtgtc

SEQ ID NO: 206714 - DNA, 20 bp, human
gattggccggcagccaaggg

SEQ ID NO: 206715 - DNA, 20 bp, human
ggctgcggtgtcccagcgcc

SEQ ID NO: 206716 - DNA, 20 bp, human
gccgccgagacgatgaccac

SEQ ID NO: 206717 - DNA, 20 bp, human
gccgcccgcggcaggcctgt

SEQ ID NO: 206718 - DNA, 20 bp, human
ggcgcggggaggtggtgcgc

SEQ ID NO: 206719 - DNA, 20 bp, human
ggggagccgcgcagagtccg

SEQ ID NO: 206720 - DNA, 20 bp, human
ggggctgtagcaccaggtca

SEQ ID NO: 206721 - DNA, 20 bp, human
gtgcgcacagtgggatgcgc

SEQ ID NO: 206722 - DNA, 20 bp, human
gctgccgcgggcgggacctg

SEQ ID NO: 206723 - DNA, 20 bp, human
ggggacggagtgcgcacatc

SEQ ID NO: 206724 - DNA, 20 bp, human
gggagaggcaggccacgcga

SEQ ID NO: 206725 - DNA, 20 bp, human
gggagtgcgcacatcgggag

SEQ ID NO: 206726 - DNA, 20 bp, human
gggcaactgacgattccgga

SEQ ID NO: 206727 - DNA, 20 bp, human
ggggagttggggagcctgaa

SEQ ID NO: 206728 - DNA, 20 bp, human
gcagcagccggagatggcgg

SEQ ID NO: 206729 - DNA, 20 bp, human
ggtcggtaagcggaggtcag

SEQ ID NO: 206730 - DNA, 20 bp, human
gccgcccacctggagcaact

SEQ ID NO: 206731 - DNA, 20 bp, human
ggcaccgaaccgagcggtgg

SEQ ID NO: 206732 - DNA, 20 bp, human
gccgcgcgggggtcggagta

SEQ ID NO: 206733 - DNA, 20 bp, human
gaagttccggtgtcggtaag

SEQ ID NO: 206734 - DNA, 20 bp, human
gagttggggagcctgaaggg

SEQ ID NO: 206735 - DNA, 20 bp, human
ggcagcaccgaaccgagcgg

SEQ ID NO: 206736 - DNA, 20 bp, human
gcaggcggggcttaatcgaa

SEQ ID NO: 206737 - DNA, 20 bp, human
gcagcccgggatggccaagg

SEQ ID NO: 206738 - DNA, 20 bp, human
gcggggcttaatcgaagggt

SEQ ID NO: 206739 - DNA, 20 bp, human
gccctggtgcacatagtgaa

SEQ ID NO: 206740 - DNA, 20 bp, human
ggagctgtgctgaatggttg

SEQ ID NO: 206741 - DNA, 20 bp, human
ggggttgcctcggatcggcc

SEQ ID NO: 206742 - DNA, 20 bp, human
gatggcgacgcagatcgagg

SEQ ID NO: 206743 - DNA, 20 bp, human
gcgattaagccccgcctgat

SEQ ID NO: 206744 - DNA, 20 bp, human
gagcctttcccaatcaggcg

SEQ ID NO: 206745 - DNA, 20 bp, human
gccggccctgctggaccccg

SEQ ID NO: 206746 - DNA, 20 bp, human
gtagcggcgcgggagggagt

SEQ ID NO: 206747 - DNA, 20 bp, human
ggggcccggggtctgcacgc

SEQ ID NO: 206748 - DNA, 20 bp, human
gggcgagcgaagaaacttag

SEQ ID NO: 206749 - DNA, 20 bp, human
ggggcagcggggcgccgctc

SEQ ID NO: 206750 - DNA, 20 bp, human
ggccgcctcgctcagagccg

SEQ ID NO: 206751 - DNA, 20 bp, human
ggggtctgcacgcggggaca

SEQ ID NO: 206752 - DNA, 20 bp, human
ggcacagcatggcttggcgg

SEQ ID NO: 206753 - DNA, 20 bp, human
gcgcgggagggagtcggagg

SEQ ID NO: 206754 - DNA, 20 bp, human
ggccccggctctgagcgagg

SEQ ID NO: 206755 - DNA, 20 bp, human
ggaaacttagcggcgcggga

SEQ ID NO: 206756 - DNA, 20 bp, human
gtgtccccagaggagggtcc

SEQ ID NO: 206757 - DNA, 20 bp, human
ggggtcctccggtgactctg

SEQ ID NO: 206758 - DNA, 20 bp, human
gtccgtctgtccccagagga

SEQ ID NO: 206759 - DNA, 20 bp, human
ggcggtccgtctgtccccag

SEQ ID NO: 206760 - DNA, 20 bp, human
ggcggcgccagtgggtcctc

SEQ ID NO: 206761 - DNA, 20 bp, human
gactgacagacggactccgg

SEQ ID NO: 206762 - DNA, 20 bp, human
gctcccccggggcgtgacta

SEQ ID NO: 206763 - DNA, 20 bp, human
ggtccgggaagcggggaaag

SEQ ID NO: 206764 - DNA, 20 bp, human
gcggactgacagacggactc

SEQ ID NO: 206765 - DNA, 20 bp, human
gcgcgtccttgccgcggcgg

SEQ ID NO: 206766 - DNA, 20 bp, human
gtgcgccggcggggaagcgc

SEQ ID NO: 206767 - DNA, 20 bp, human
ggcttggggcgcacaatctg

SEQ ID NO: 206768 - DNA, 20 bp, human
gcggagcccgccaccgggat

SEQ ID NO: 206769 - DNA, 20 bp, human
ggtcgcccgcgcttccccgc

SEQ ID NO: 206770 - DNA, 20 bp, human
gcggagtcgcgggaaacgcg

SEQ ID NO: 206771 - DNA, 20 bp, human
gagcggcgtgcgattctgtg

SEQ ID NO: 206772 - DNA, 20 bp, human
gtgtgaggcctgctctgcgc

SEQ ID NO: 206773 - DNA, 20 bp, human
gaacgcgaggctgaggacta

SEQ ID NO: 206774 - DNA, 20 bp, human
ggatctgttgcgtgcgcgtt

SEQ ID NO: 206775 - DNA, 20 bp, human
gaaagtgccgtcagctgtag

SEQ ID NO: 206776 - DNA, 20 bp, human
gccccaggctgcaaatggaa

SEQ ID NO: 206777 - DNA, 20 bp, human
ggccgcctcccattggtcgc

SEQ ID NO: 206778 - DNA, 20 bp, human
gggagcgcggccaatggcag

SEQ ID NO: 206779 - DNA, 20 bp, human
ggcagcggccggaggagacg

SEQ ID NO: 206780 - DNA, 20 bp, human
gaagcggtgggtgcgagagg

SEQ ID NO: 206781 - DNA, 20 bp, human
gcgggaggggcgctccgcga

SEQ ID NO: 206782 - DNA, 20 bp, human
gcccccgcgcccgcgaccaa

SEQ ID NO: 206783 - DNA, 20 bp, human
gcaaatggaaaggcgaagac

SEQ ID NO: 206784 - DNA, 20 bp, human
ggcgagagggggcagagcac

SEQ ID NO: 206785 - DNA, 20 bp, human
gcggccgtttaagaagcggt

SEQ ID NO: 206786 - DNA, 20 bp, human
gcctgcggcgacttacgcgt

SEQ ID NO: 206787 - DNA, 20 bp, human
gcgcccggactaggagactg

SEQ ID NO: 206788 - DNA, 20 bp, human
ggccctcagtctcctagtcc

SEQ ID NO: 206789 - DNA, 20 bp, human
gtcctccagctccgccaagt

SEQ ID NO: 206790 - DNA, 20 bp, human
gcaggcgggggcggtctcgg

SEQ ID NO: 206791 - DNA, 20 bp, human
gcaagggattcgagatggaa

SEQ ID NO: 206792 - DNA, 20 bp, human
gggcgccaagggattcgaga

SEQ ID NO: 206793 - DNA, 20 bp, human
ggagaccgcccccgcctgag

SEQ ID NO: 206794 - DNA, 20 bp, human
gccagctccgccaagtaggt

SEQ ID NO: 206795 - DNA, 20 bp, human
gaggcggtgctggcactcgg

SEQ ID NO: 206796 - DNA, 20 bp, human
gggaccctcaggtccaggaa

SEQ ID NO: 206797 - DNA, 20 bp, human
gaagagttacctactcttta

SEQ ID NO: 206798 - DNA, 20 bp, human
gcaatctggtcatataacca

SEQ ID NO: 206799 - DNA, 20 bp, human
gctcaggttgaagaacgggg

SEQ ID NO: 206800 - DNA, 20 bp, human
ggtgctcaggttgaagaacg

SEQ ID NO: 206801 - DNA, 20 bp, human
gcatccattcctggacctga

SEQ ID NO: 206802 - DNA, 20 bp, human
gactcattgccctaaagagt

SEQ ID NO: 206803 - DNA, 20 bp, human
gaatagagcactcagtgtct

SEQ ID NO: 206804 - DNA, 20 bp, human
ggagcagggggatatgaaca

SEQ ID NO: 206805 - DNA, 20 bp, human
gggcattaggatgtgttctg

SEQ ID NO: 206806 - DNA, 20 bp, human
gccagcatcccgtgcaccag

SEQ ID NO: 206807 - DNA, 20 bp, human
gggcgcggggtgtacgtggg

SEQ ID NO: 206808 - DNA, 20 bp, human
gcacgagggcgtcctgctcg

SEQ ID NO: 206809 - DNA, 20 bp, human
gcctgtgtgcagactcccgc

SEQ ID NO: 206810 - DNA, 20 bp, human
gaccccgcgcctgcgcacga

SEQ ID NO: 206811 - DNA, 20 bp, human
ggggtcacacggtgctgaaa

SEQ ID NO: 206812 - DNA, 20 bp, human
gatcccgtgcaccagcgggg

SEQ ID NO: 206813 - DNA, 20 bp, human
gcccaggccccgcctttcct

SEQ ID NO: 206814 - DNA, 20 bp, human
gccggtagggaacagaacaa

SEQ ID NO: 206815 - DNA, 20 bp, human
gtcccgctggtccaccccgc

SEQ ID NO: 206816 - DNA, 20 bp, human
gccacccccgggctgcacct

SEQ ID NO: 206817 - DNA, 20 bp, human
gggggactctggagcggagg

SEQ ID NO: 206818 - DNA, 20 bp, human
gtgggcaggctcgggtgttc

SEQ ID NO: 206819 - DNA, 20 bp, human
gcgctcgtgcggcggggatg

SEQ ID NO: 206820 - DNA, 20 bp, human
ggctggggactctggagcgg

SEQ ID NO: 206821 - DNA, 20 bp, human
gagcccgggggtggcgggat

SEQ ID NO: 206822 - DNA, 20 bp, human
gacctcggcccgcgccgctg

SEQ ID NO: 206823 - DNA, 20 bp, human
gggccccggccttgtcactc

SEQ ID NO: 206824 - DNA, 20 bp, human
gaggctgcgcggccgcacgg

SEQ ID NO: 206825 - DNA, 20 bp, human
gtcctggcccgccccgggca

SEQ ID NO: 206826 - DNA, 20 bp, human
gagggtgtgctcagacctga

SEQ ID NO: 206827 - DNA, 20 bp, human
gaggccctgctgatgagctt

SEQ ID NO: 206828 - DNA, 20 bp, human
gccccccaagctcatcagca

SEQ ID NO: 206829 - DNA, 20 bp, human
gcctgagtgaggatggtgtg

SEQ ID NO: 206830 - DNA, 20 bp, human
gcctccaggacagggtacca

SEQ ID NO: 206831 - DNA, 20 bp, human
gcacaccctctctaggatgc

SEQ ID NO: 206832 - DNA, 20 bp, human
gcatgcctgtccccactcgc

SEQ ID NO: 206833 - DNA, 20 bp, human
gtgtctggcttcctctggaa

SEQ ID NO: 206834 - DNA, 20 bp, human
gcatcagcagggcctgcgag

SEQ ID NO: 206835 - DNA, 20 bp, human
ggtctgagcacaccctctct

SEQ ID NO: 206836 - DNA, 20 bp, human
ggcgcccaacccaagttcaa

SEQ ID NO: 206837 - DNA, 20 bp, human
gaggagaggtaaggttctct

SEQ ID NO: 206838 - DNA, 20 bp, human
gggccataaagtgacaggag

SEQ ID NO: 206839 - DNA, 20 bp, human
gccaaagaggtctagaacta

SEQ ID NO: 206840 - DNA, 20 bp, human
ggccaatataaagttcatcc

SEQ ID NO: 206841 - DNA, 20 bp, human
gtccaggatgaactttatat

SEQ ID NO: 206842 - DNA, 20 bp, human
gcttatcagcctttgaactt

SEQ ID NO: 206843 - DNA, 20 bp, human
gaagggcaaagtcatgtatt

SEQ ID NO: 206844 - DNA, 20 bp, human
gtcagcctttgaacttgggt

SEQ ID NO: 206845 - DNA, 20 bp, human
gtcccagaaactctctactt

SEQ ID NO: 206846 - DNA, 20 bp, human
gcagccctgagcataagccg

SEQ ID NO: 206847 - DNA, 20 bp, human
gccgctccccagttgcacca

SEQ ID NO: 206848 - DNA, 20 bp, human
gagtcccacggcttatgctc

SEQ ID NO: 206849 - DNA, 20 bp, human
gtgccccgcggcaggcagac

SEQ ID NO: 206850 - DNA, 20 bp, human
gcaggaataggaatcggggt

SEQ ID NO: 206851 - DNA, 20 bp, human
gcctgggtaatctggatggg

SEQ ID NO: 206852 - DNA, 20 bp, human
gtacccaggaataggaatcg

SEQ ID NO: 206853 - DNA, 20 bp, human
gaggctgccctggtgcaact

SEQ ID NO: 206854 - DNA, 20 bp, human
gctgctgtcactgcacagcc

SEQ ID NO: 206855 - DNA, 20 bp, human
gtattcctgggtaatctgga

SEQ ID NO: 206856 - DNA, 20 bp, human
ggagtaacctcccgcaggcg

SEQ ID NO: 206857 - DNA, 20 bp, human
gtccagggtggggcgcctgg

SEQ ID NO: 206858 - DNA, 20 bp, human
gtggaagccacgcccaccgt

SEQ ID NO: 206859 - DNA, 20 bp, human
ggcgggtcccgccccacggt

SEQ ID NO: 206860 - DNA, 20 bp, human
gtggggcgggacccgcgtgg

SEQ ID NO: 206861 - DNA, 20 bp, human
gcgaacgagtaacctcccgc

SEQ ID NO: 206862 - DNA, 20 bp, human
gcaggtggccagggcctcga

SEQ ID NO: 206863 - DNA, 20 bp, human
gagactacccagcacccggc

SEQ ID NO: 206864 - DNA, 20 bp, human
gagccacgcccaccgtgggg

SEQ ID NO: 206865 - DNA, 20 bp, human
gcctggacccctcctccacg

SEQ ID NO: 206866 - DNA, 20 bp, human
gccccgcccaagggtgaaga

SEQ ID NO: 206867 - DNA, 20 bp, human
gccagccggcgccctccgag

SEQ ID NO: 206868 - DNA, 20 bp, human
gggtgtaaggcccactcgga

SEQ ID NO: 206869 - DNA, 20 bp, human
gacccccaacctacggccat

SEQ ID NO: 206870 - DNA, 20 bp, human
gggtgggcggggcctccgtc

SEQ ID NO: 206871 - DNA, 20 bp, human
gccaggcccgacctggtgta

SEQ ID NO: 206872 - DNA, 20 bp, human
ggcaggggcgtgatccagga

SEQ ID NO: 206873 - DNA, 20 bp, human
gaatcacggggattggttgg

SEQ ID NO: 206874 - DNA, 20 bp, human
gtgatccaggaaggagccgg

SEQ ID NO: 206875 - DNA, 20 bp, human
gcccgcccctcttcaccctt

SEQ ID NO: 206876 - DNA, 20 bp, human
gcgggtctcggctccaaggg

SEQ ID NO: 206877 - DNA, 20 bp, human
gtctgggccccggggtctcc

SEQ ID NO: 206878 - DNA, 20 bp, human
gtgtcactgcgctctgtcgt

SEQ ID NO: 206879 - DNA, 20 bp, human
gtctccgggtctcggctcca

SEQ ID NO: 206880 - DNA, 20 bp, human
gagccgagacccggagaccc

SEQ ID NO: 206881 - DNA, 20 bp, human
gccctccccgctctcccggg

SEQ ID NO: 206882 - DNA, 20 bp, human
gactgcgctctgtcgtcggt

SEQ ID NO: 206883 - DNA, 20 bp, human
gtctggcactggagtgcgtc

SEQ ID NO: 206884 - DNA, 20 bp, human
gacccaaagacctgcagcgg

SEQ ID NO: 206885 - DNA, 20 bp, human
gaggtggccacccgggagag

SEQ ID NO: 206886 - DNA, 20 bp, human
ggcctcgcaggggttgaatc

SEQ ID NO: 206887 - DNA, 20 bp, human
gtgcccgcggtccctggcgg

SEQ ID NO: 206888 - DNA, 20 bp, human
gaaccgcgcggcccagggac

SEQ ID NO: 206889 - DNA, 20 bp, human
ggaaccgggtcccgcaggca

SEQ ID NO: 206890 - DNA, 20 bp, human
gtgcgggacccggttcccgt

SEQ ID NO: 206891 - DNA, 20 bp, human
ggcgccgccgccagggaccg

SEQ ID NO: 206892 - DNA, 20 bp, human
gtcaactagggcacatggtc

SEQ ID NO: 206893 - DNA, 20 bp, human
ggggcctcggagactgggct

SEQ ID NO: 206894 - DNA, 20 bp, human
gcatctgtgcccactgtctc

SEQ ID NO: 206895 - DNA, 20 bp, human
gccagggactggcaagactc

SEQ ID NO: 206896 - DNA, 20 bp, human
gagaactccccgggttcctc

SEQ ID NO: 206897 - DNA, 20 bp, human
gcgagaaaaggggcgctgca

SEQ ID NO: 206898 - DNA, 20 bp, human
gaaaaccgagcctgaaagca

SEQ ID NO: 206899 - DNA, 20 bp, human
ggaacccggggagttctgag

SEQ ID NO: 206900 - DNA, 20 bp, human
ggcagtgggcggggtcatct

SEQ ID NO: 206901 - DNA, 20 bp, human
ggagttctgagtggtaatcg

SEQ ID NO: 206902 - DNA, 20 bp, human
gtccgattatggttatacca

SEQ ID NO: 206903 - DNA, 20 bp, human
gaggacatccggaggaaccc

SEQ ID NO: 206904 - DNA, 20 bp, human
ggaggggtagagtatggcag

SEQ ID NO: 206905 - DNA, 20 bp, human
gtccgaggccggaagtgcgt

SEQ ID NO: 206906 - DNA, 20 bp, human
gtacagaggcttaacccccc

SEQ ID NO: 206907 - DNA, 20 bp, human
gtatcctttggcaggccaca

SEQ ID NO: 206908 - DNA, 20 bp, human
ggagggagcactccagccct

SEQ ID NO: 206909 - DNA, 20 bp, human
ggaaggcaggcaaacagtag

SEQ ID NO: 206910 - DNA, 20 bp, human
gccctcctggtcttcccagg

SEQ ID NO: 206911 - DNA, 20 bp, human
ggagcaaggttcttatcctt

SEQ ID NO: 206912 - DNA, 20 bp, human
ggcaggcaaacagtagaggt

SEQ ID NO: 206913 - DNA, 20 bp, human
gcagtcagatgctgcaggta

SEQ ID NO: 206914 - DNA, 20 bp, human
ggaaagctggatagagggtg

SEQ ID NO: 206915 - DNA, 20 bp, human
gtcagatgctgcaggtaggg

SEQ ID NO: 206916 - DNA, 20 bp, human
gtaaaactttgatcaatagg

SEQ ID NO: 206917 - DNA, 20 bp, human
gacagagtcacctgtatctt

SEQ ID NO: 206918 - DNA, 20 bp, human
gtttgatcaataggaggctg

SEQ ID NO: 206919 - DNA, 20 bp, human
gatgtaaaactttgatcaat

SEQ ID NO: 206920 - DNA, 20 bp, human
gaacaaaggatatgagctaa

SEQ ID NO: 206921 - DNA, 20 bp, human
gtctgtctcattatatgctt

SEQ ID NO: 206922 - DNA, 20 bp, human
ggggtctcactctatggcct

SEQ ID NO: 206923 - DNA, 20 bp, human
gaatgtactgtatttgatca

SEQ ID NO: 206924 - DNA, 20 bp, human
gtcaaagttttacatgatgc

SEQ ID NO: 206925 - DNA, 20 bp, human
gtgcttaggtttgatgaaac

SEQ ID NO: 206926 - DNA, 20 bp, human
gcctgcacaagtgtactctt

SEQ ID NO: 206927 - DNA, 20 bp, human
gactagtgaggtttacaaga

SEQ ID NO: 206928 - DNA, 20 bp, human
gaggaaacaacagactagtg

SEQ ID NO: 206929 - DNA, 20 bp, human
gagtgaggtttacaagaggg

SEQ ID NO: 206930 - DNA, 20 bp, human
gggagcctctagcctctaga

SEQ ID NO: 206931 - DNA, 20 bp, human
gcacaaagtccaaaccccac

SEQ ID NO: 206932 - DNA, 20 bp, human
gaaagtccaaaccccacggg

SEQ ID NO: 206933 - DNA, 20 bp, human
ggtgtctgcctgtgggatgg

SEQ ID NO: 206934 - DNA, 20 bp, human
gtgcaaatgaaagaaggctg

SEQ ID NO: 206935 - DNA, 20 bp, human
gaggagctcttggtgttaat

SEQ ID NO: 206936 - DNA, 20 bp, human
gcaagcgccagcggggaatg

SEQ ID NO: 206937 - DNA, 20 bp, human
gcggaactaggggacgggtg

SEQ ID NO: 206938 - DNA, 20 bp, human
gggtgcttggggcctgaact

SEQ ID NO: 206939 - DNA, 20 bp, human
gcgccagcggggaatggggc

SEQ ID NO: 206940 - DNA, 20 bp, human
gtcccagaaaacaggcctgg

SEQ ID NO: 206941 - DNA, 20 bp, human
ggccccgcccggcggaacta

SEQ ID NO: 206942 - DNA, 20 bp, human
gccaccctgtcccagaaaac

SEQ ID NO: 206943 - DNA, 20 bp, human
gcgggacccctagaggatgg

SEQ ID NO: 206944 - DNA, 20 bp, human
gacccagccgggacccctag

SEQ ID NO: 206945 - DNA, 20 bp, human
gacgggtgggggacgtcgaa

SEQ ID NO: 206946 - DNA, 20 bp, human
gactaagtggaaactatgaa

SEQ ID NO: 206947 - DNA, 20 bp, human
ggtgctgcctagatgccctc

SEQ ID NO: 206948 - DNA, 20 bp, human
gttaaattcaacttcttaag

SEQ ID NO: 206949 - DNA, 20 bp, human
gagaaggagaatccacctga

SEQ ID NO: 206950 - DNA, 20 bp, human
gatagtttccacttagtcaa

SEQ ID NO: 206951 - DNA, 20 bp, human
ggctcacaaggttaaatttc

SEQ ID NO: 206952 - DNA, 20 bp, human
ggcatctaggcagcacttgt

SEQ ID NO: 206953 - DNA, 20 bp, human
ggggaaaatactctgggaca

SEQ ID NO: 206954 - DNA, 20 bp, human
gtggatacaagataaaggcg

SEQ ID NO: 206955 - DNA, 20 bp, human
gaacaaaagtagctggagtt

SEQ ID NO: 206956 - DNA, 20 bp, human
gcccggggcccgccctcgtg

SEQ ID NO: 206957 - DNA, 20 bp, human
ggctcctcccaattcgctgc

SEQ ID NO: 206958 - DNA, 20 bp, human
ggcttggctccgccccacga

SEQ ID NO: 206959 - DNA, 20 bp, human
gagccctggcgctcaggcta

SEQ ID NO: 206960 - DNA, 20 bp, human
ggccaagccagcagcgaatt

SEQ ID NO: 206961 - DNA, 20 bp, human
gaagccagcagcgaattggg

SEQ ID NO: 206962 - DNA, 20 bp, human
gttccctagcctgagcgcca

SEQ ID NO: 206963 - DNA, 20 bp, human
ggctcccaagaggcggtgga

SEQ ID NO: 206964 - DNA, 20 bp, human
gggccccgcaggctcccaag

SEQ ID NO: 206965 - DNA, 20 bp, human
gaggagaacgcgcggtgctg

SEQ ID NO: 206966 - DNA, 20 bp, human
gaatggacctagactgggtt

SEQ ID NO: 206967 - DNA, 20 bp, human
gcctactgactgctgcctga

SEQ ID NO: 206968 - DNA, 20 bp, human
gaactgtactcaactgtatg

SEQ ID NO: 206969 - DNA, 20 bp, human
gtatttgttaatcaagcttt

SEQ ID NO: 206970 - DNA, 20 bp, human
gtcaacacagtttggtagtc

SEQ ID NO: 206971 - DNA, 20 bp, human
gagttctaatggacctagac

SEQ ID NO: 206972 - DNA, 20 bp, human
gagtaagaaaaggtgagtca

SEQ ID NO: 206973 - DNA, 20 bp, human
gatgaggtcaaaagcacagc

SEQ ID NO: 206974 - DNA, 20 bp, human
ggctttgggtcaacacagtt

SEQ ID NO: 206975 - DNA, 20 bp, human
gtgcctgaaggttgctgtaa

SEQ ID NO: 206976 - DNA, 20 bp, human
gcgcaggcgcgactccacga

SEQ ID NO: 206977 - DNA, 20 bp, human
gagggcgcgcgacctctatc

SEQ ID NO: 206978 - DNA, 20 bp, human
gtccgcccgcagcggagctt

SEQ ID NO: 206979 - DNA, 20 bp, human
gcggagcttgggtttccggg

SEQ ID NO: 206980 - DNA, 20 bp, human
gggaaacccaagctccgctg

SEQ ID NO: 206981 - DNA, 20 bp, human
gtccgctgcgggcggaaaac

SEQ ID NO: 206982 - DNA, 20 bp, human
gaacttgcgtattagtgaac

SEQ ID NO: 206983 - DNA, 20 bp, human
gggaggacctgattgtgcaa

SEQ ID NO: 206984 - DNA, 20 bp, human
gccggaaggcagacgaaaga

SEQ ID NO: 206985 - DNA, 20 bp, human
gcgcaggcgcagtcggcggt

SEQ ID NO: 206986 - DNA, 20 bp, human
gggcctggaggacttcgccc

SEQ ID NO: 206987 - DNA, 20 bp, human
gagcctgcgggcgcccccgc

SEQ ID NO: 206988 - DNA, 20 bp, human
gcgccccgggctggaggcta

SEQ ID NO: 206989 - DNA, 20 bp, human
gtcctccgctggaagtggga

SEQ ID NO: 206990 - DNA, 20 bp, human
gaagtcctccaggcccgcgg

SEQ ID NO: 206991 - DNA, 20 bp, human
ggcaggctccgccccttctt

SEQ ID NO: 206992 - DNA, 20 bp, human
ggggcagctagccgaagaag

SEQ ID NO: 206993 - DNA, 20 bp, human
gcagctagccgaagaagggg

SEQ ID NO: 206994 - DNA, 20 bp, human
ggcccggggcgaagtcctcc

SEQ ID NO: 206995 - DNA, 20 bp, human
gctggaggctagggttgcga

SEQ ID NO: 206996 - DNA, 20 bp, human
gagaaccctgtgaacgcaat

SEQ ID NO: 206997 - DNA, 20 bp, human
gaccctgtgaacgcaatggg

SEQ ID NO: 206998 - DNA, 20 bp, human
ggggcgtgcccggaagagtg

SEQ ID NO: 206999 - DNA, 20 bp, human
ggaaggcgaggcctccctag

SEQ ID NO: 207000 - DNA, 20 bp, human
gcagggttctggcgcctcta

SEQ ID NO: 207001 - DNA, 20 bp, human
gcagacacgcaagaggaaat

SEQ ID NO: 207002 - DNA, 20 bp, human
gactcgcgcgagagcaagac

SEQ ID NO: 207003 - DNA, 20 bp, human
gtccgcccattgcgttcaca

SEQ ID NO: 207004 - DNA, 20 bp, human
gggttctggcgcctctaggg

SEQ ID NO: 207005 - DNA, 20 bp, human
ggcaagacgggcctggtgca

SEQ ID NO: 207006 - DNA, 20 bp, human
ggcgaagaggaatgcaggac

SEQ ID NO: 207007 - DNA, 20 bp, human
gtgatggcgaagaggaatgc

SEQ ID NO: 207008 - DNA, 20 bp, human
gctggctcgcggaatgggct

SEQ ID NO: 207009 - DNA, 20 bp, human
ggcttgctggctcgcggaat

SEQ ID NO: 207010 - DNA, 20 bp, human
gggccaggactggttcgtcc

SEQ ID NO: 207011 - DNA, 20 bp, human
gctggttcgtcccggctact

SEQ ID NO: 207012 - DNA, 20 bp, human
gataagaaaataataactat

SEQ ID NO: 207013 - DNA, 20 bp, human
ggaaaataataactattggc

SEQ ID NO: 207014 - DNA, 20 bp, human
gtctgagctttattccttac

SEQ ID NO: 207015 - DNA, 20 bp, human
gtaataactattacctcatt

SEQ ID NO: 207016 - DNA, 20 bp, human
gtaggccacagccacgtcaa

SEQ ID NO: 207017 - DNA, 20 bp, human
ggcccgcctagcggagagga

SEQ ID NO: 207018 - DNA, 20 bp, human
ggacgcggggtgataacagc

SEQ ID NO: 207019 - DNA, 20 bp, human
gctaggagaaggggggtaga

SEQ ID NO: 207020 - DNA, 20 bp, human
gagggcagtctgaagagagg

SEQ ID NO: 207021 - DNA, 20 bp, human
ggggtgataacagctggctc

SEQ ID NO: 207022 - DNA, 20 bp, human
gaacagctggctctggtggg

SEQ ID NO: 207023 - DNA, 20 bp, human
ggacgtggctgtggcctagc

SEQ ID NO: 207024 - DNA, 20 bp, human
gaggccccttgacgtggctg

SEQ ID NO: 207025 - DNA, 20 bp, human
gcactggagctttctgtgca

SEQ ID NO: 207026 - DNA, 20 bp, human
gcccgcaaggcgtcaatccc

SEQ ID NO: 207027 - DNA, 20 bp, human
gcccaggctgcacatcacac

SEQ ID NO: 207028 - DNA, 20 bp, human
ggcaccaggcaaagtccggg

SEQ ID NO: 207029 - DNA, 20 bp, human
ggcgctgtagagttcctgga

SEQ ID NO: 207030 - DNA, 20 bp, human
gcccggggattgacgccttg

SEQ ID NO: 207031 - DNA, 20 bp, human
ggccaggctccccgcccgca

SEQ ID NO: 207032 - DNA, 20 bp, human
ggtgccgcacccgcgccgga

SEQ ID NO: 207033 - DNA, 20 bp, human
gctgggcgcaggcggaaacg

SEQ ID NO: 207034 - DNA, 20 bp, human
ggcgctgtgcttgtcctcat

SEQ ID NO: 207035 - DNA, 20 bp, human
gatcgcagaaggcggctcag

SEQ ID NO: 207036 - DNA, 20 bp, human
gccccactcgcgatagtcct

SEQ ID NO: 207037 - DNA, 20 bp, human
gagggggctcccgggtagac

SEQ ID NO: 207038 - DNA, 20 bp, human
ggggcccgcactgtcatccc

SEQ ID NO: 207039 - DNA, 20 bp, human
gcgggtctcaggagaagtct

SEQ ID NO: 207040 - DNA, 20 bp, human
ggctcccgggtagacaggtc

SEQ ID NO: 207041 - DNA, 20 bp, human
gcgggcggagcgggcatggt

SEQ ID NO: 207042 - DNA, 20 bp, human
gccgggtagacaggtctgga

SEQ ID NO: 207043 - DNA, 20 bp, human
ggggggaaaaccagcgctct

SEQ ID NO: 207044 - DNA, 20 bp, human
gggtagacaggtctggaagg

SEQ ID NO: 207045 - DNA, 20 bp, human
ggaagtctgggaagtgcgcg

SEQ ID NO: 207046 - DNA, 20 bp, human
gcgctcccgcatcaaccgcc

SEQ ID NO: 207047 - DNA, 20 bp, human
gtaaaggggcggtgcagagg

SEQ ID NO: 207048 - DNA, 20 bp, human
gcatgcgcgcttcgtcacaa

SEQ ID NO: 207049 - DNA, 20 bp, human
gcggggaaatgcgctgctct

SEQ ID NO: 207050 - DNA, 20 bp, human
gtgcgcaggcgcctgtgtca

SEQ ID NO: 207051 - DNA, 20 bp, human
gcctgcgcagagccgcgcgt

SEQ ID NO: 207052 - DNA, 20 bp, human
gtgcgggagcgccatgacac

SEQ ID NO: 207053 - DNA, 20 bp, human
gggcggcaggaagatggagt

SEQ ID NO: 207054 - DNA, 20 bp, human
gtgcgccgcaagggagccgc

SEQ ID NO: 207055 - DNA, 20 bp, human
gtggtgcagctgcgccgcaa

SEQ ID NO: 207056 - DNA, 20 bp, human
ggcttgctggcctgcggaat

SEQ ID NO: 207057 - DNA, 20 bp, human
ggcttgttagacatcctctc

SEQ ID NO: 207058 - DNA, 20 bp, human
gggctggttcttaaagaacc

SEQ ID NO: 207059 - DNA, 20 bp, human
gtcagaagcttgctggcctg

SEQ ID NO: 207060 - DNA, 20 bp, human
gaatagccaaatggggtaat

SEQ ID NO: 207061 - DNA, 20 bp, human
gtactacctattaccccatt

SEQ ID NO: 207062 - DNA, 20 bp, human
ggcgaagaggaatgcagagc

SEQ ID NO: 207063 - DNA, 20 bp, human
ggaatgggctggaccagggc

SEQ ID NO: 207064 - DNA, 20 bp, human
gaagtgtaaaaatagccaaa

SEQ ID NO: 207065 - DNA, 20 bp, human
gctggtccagcccattccgc

SEQ ID NO: 207066 - DNA, 20 bp, human
gcgcgcacggcaatgcgcac

SEQ ID NO: 207067 - DNA, 20 bp, human
ggccggagcggggaattcaa

SEQ ID NO: 207068 - DNA, 20 bp, human
gccccggggcgcgcaaggtg

SEQ ID NO: 207069 - DNA, 20 bp, human
gaaccggtctgaagtcccag

SEQ ID NO: 207070 - DNA, 20 bp, human
ggcggggaattcaaaggtcg

SEQ ID NO: 207071 - DNA, 20 bp, human
gaacaaccgagggtggtgtg

SEQ ID NO: 207072 - DNA, 20 bp, human
gtccagcagcagcggcctgg

SEQ ID NO: 207073 - DNA, 20 bp, human
gagcccctgggacttcagac

SEQ ID NO: 207074 - DNA, 20 bp, human
gcgctgctgctggaacgagc

SEQ ID NO: 207075 - DNA, 20 bp, human
gagcgcgccgaatgtccgga

SEQ ID NO: 207076 - DNA, 20 bp, human
gaggggctggaatagagcca

SEQ ID NO: 207077 - DNA, 20 bp, human
gccagcccctccctacaaac

SEQ ID NO: 207078 - DNA, 20 bp, human
gctcaagcatagaacgtgct

SEQ ID NO: 207079 - DNA, 20 bp, human
gtgggttggggatggactgc

SEQ ID NO: 207080 - DNA, 20 bp, human
ggaaagacatcctgtttgta

SEQ ID NO: 207081 - DNA, 20 bp, human
gtgcagggcagttctctggt

SEQ ID NO: 207082 - DNA, 20 bp, human
gtcctgagagagggacggac

SEQ ID NO: 207083 - DNA, 20 bp, human
gagggcatatgaaatgtact

SEQ ID NO: 207084 - DNA, 20 bp, human
gcctccagatcctgggggtc

SEQ ID NO: 207085 - DNA, 20 bp, human
gttaatatggcaccttggtc

SEQ ID NO: 207086 - DNA, 20 bp, human
gagcccgggccgcgccataa

SEQ ID NO: 207087 - DNA, 20 bp, human
gagggcagaggtggagcgat

SEQ ID NO: 207088 - DNA, 20 bp, human
gcgcgggcgtacgattctgg

SEQ ID NO: 207089 - DNA, 20 bp, human
gtcgcgcgggcgtacgattc

SEQ ID NO: 207090 - DNA, 20 bp, human
gcgccgggggcaatcgaacg

SEQ ID NO: 207091 - DNA, 20 bp, human
gcgggcgactggtgccgggg

SEQ ID NO: 207092 - DNA, 20 bp, human
ggggcgcggcagcgaatcgg

SEQ ID NO: 207093 - DNA, 20 bp, human
ggccccagacgcttccctcg

SEQ ID NO: 207094 - DNA, 20 bp, human
gaggctgcagagagctcgcg

SEQ ID NO: 207095 - DNA, 20 bp, human
ggacccggtggcagccccga

SEQ ID NO: 207096 - DNA, 20 bp, human
gactcctgtcagtccgctgg

SEQ ID NO: 207097 - DNA, 20 bp, human
gactggatatgtcgctgagg

SEQ ID NO: 207098 - DNA, 20 bp, human
gaggaaccctaggcctgacc

SEQ ID NO: 207099 - DNA, 20 bp, human
ggaggaatctaggttatgat

SEQ ID NO: 207100 - DNA, 20 bp, human
ggctgaggaggcggaacctc

SEQ ID NO: 207101 - DNA, 20 bp, human
gtgaccgggttacaagagga

SEQ ID NO: 207102 - DNA, 20 bp, human
gagggtttataggcaggcgt

SEQ ID NO: 207103 - DNA, 20 bp, human
gtgcgaatcctgtgtgtgac

SEQ ID NO: 207104 - DNA, 20 bp, human
gggcctgaccgggttacaag

SEQ ID NO: 207105 - DNA, 20 bp, human
ggtcaaaggtcacactatga

SEQ ID NO: 207106 - DNA, 20 bp, human
gctcccgccaatgaacgggt

SEQ ID NO: 207107 - DNA, 20 bp, human
gagggcgtgacgtcgagaag

SEQ ID NO: 207108 - DNA, 20 bp, human
ggaccctacccgttcattgg

SEQ ID NO: 207109 - DNA, 20 bp, human
gcagcctcccgccaatgaac

SEQ ID NO: 207110 - DNA, 20 bp, human
gggcgggaccgcggcgtcca

SEQ ID NO: 207111 - DNA, 20 bp, human
gcccgcacaactgattgagt

SEQ ID NO: 207112 - DNA, 20 bp, human
ggaaccacgcagcaacgcca

SEQ ID NO: 207113 - DNA, 20 bp, human
ggcgcggggatcaaggataa

SEQ ID NO: 207114 - DNA, 20 bp, human
ggcggaccctacccgttcat

SEQ ID NO: 207115 - DNA, 20 bp, human
gagccaaggcgcggggatca

SEQ ID NO: 207116 - DNA, 20 bp, human
gaggccgcggggtaagaggg

SEQ ID NO: 207117 - DNA, 20 bp, human
gaggcctaggggcacggacc

SEQ ID NO: 207118 - DNA, 20 bp, human
gacagcggcccagacagagg

SEQ ID NO: 207119 - DNA, 20 bp, human
ggaccggcgacgcctagaac

SEQ ID NO: 207120 - DNA, 20 bp, human
gctcgggaaaggggctccga

SEQ ID NO: 207121 - DNA, 20 bp, human
gtcgtggctggggccggtcg

SEQ ID NO: 207122 - DNA, 20 bp, human
gggaagggggcgggacaacg

SEQ ID NO: 207123 - DNA, 20 bp, human
ggggacaacgaggctgagga

SEQ ID NO: 207124 - DNA, 20 bp, human
ggggcgggacaacgaggctg

SEQ ID NO: 207125 - DNA, 20 bp, human
ggccaggggaggctcccgag

SEQ ID NO: 207126 - DNA, 20 bp, human
ggctccataagcccagacaa

SEQ ID NO: 207127 - DNA, 20 bp, human
gtgctctcaagcccttgtct

SEQ ID NO: 207128 - DNA, 20 bp, human
gtctcctcccacataggggc

SEQ ID NO: 207129 - DNA, 20 bp, human
gcacacccatgcaggaagag

SEQ ID NO: 207130 - DNA, 20 bp, human
gacaaaggtcacacccatgc

SEQ ID NO: 207131 - DNA, 20 bp, human
gctgccctgggaggacttct

SEQ ID NO: 207132 - DNA, 20 bp, human
ggccccagcgacaggcacaa

SEQ ID NO: 207133 - DNA, 20 bp, human
gccctggctttgagatgtaa

SEQ ID NO: 207134 - DNA, 20 bp, human
gtgtgttccagcccctatgt

SEQ ID NO: 207135 - DNA, 20 bp, human
ggtagtgtcaaaggaatccc

SEQ ID NO: 207136 - DNA, 20 bp, human
gtgtaggggcataagagtga

SEQ ID NO: 207137 - DNA, 20 bp, human
ggtctccaggattgggaaga

SEQ ID NO: 207138 - DNA, 20 bp, human
gaaagctagcttatgaggat

SEQ ID NO: 207139 - DNA, 20 bp, human
gcaaaatccgtaactcctgg

SEQ ID NO: 207140 - DNA, 20 bp, human
gctcctacaacccagtaagt

SEQ ID NO: 207141 - DNA, 20 bp, human
gccactgtaagcccacttac

SEQ ID NO: 207142 - DNA, 20 bp, human
ggtaactcctggaggtttgt

SEQ ID NO: 207143 - DNA, 20 bp, human
gggccagtgtctccaggatt

SEQ ID NO: 207144 - DNA, 20 bp, human
gcacccagaggcacacaatt

SEQ ID NO: 207145 - DNA, 20 bp, human
gcagcaaaatccgtaactcc

SEQ ID NO: 207146 - DNA, 20 bp, human
ggacgccgctgccacccggg

SEQ ID NO: 207147 - DNA, 20 bp, human
gccgcccatgggacggacgg

SEQ ID NO: 207148 - DNA, 20 bp, human
gagcgcctggcgaagcttcg

SEQ ID NO: 207149 - DNA, 20 bp, human
ggaactacggcgctccgaga

SEQ ID NO: 207150 - DNA, 20 bp, human
gtcgtggcttccagcccgcc

SEQ ID NO: 207151 - DNA, 20 bp, human
gagcggcgtccgcgtttcca

SEQ ID NO: 207152 - DNA, 20 bp, human
ggccccgcccatgggacgga

SEQ ID NO: 207153 - DNA, 20 bp, human
gcggcctccgtccgtcccat

SEQ ID NO: 207154 - DNA, 20 bp, human
gcctcgttgccctggaaacg

SEQ ID NO: 207155 - DNA, 20 bp, human
gggcgcggttcgatgacgtc

SEQ ID NO: 207156 - DNA, 20 bp, human
ggtaccgggatcagctaccc

SEQ ID NO: 207157 - DNA, 20 bp, human
gctgggctgcggtcgaagtg

SEQ ID NO: 207158 - DNA, 20 bp, human
ggtacggcccacctcagcca

SEQ ID NO: 207159 - DNA, 20 bp, human
ggtacacctgctggctgcca

SEQ ID NO: 207160 - DNA, 20 bp, human
gcgcgttgacgtcatggagg

SEQ ID NO: 207161 - DNA, 20 bp, human
gccaccgggctgcgtcatct

SEQ ID NO: 207162 - DNA, 20 bp, human
gtctcggcgcgccgctgcca

SEQ ID NO: 207163 - DNA, 20 bp, human
ggccgcaggtggcaaacaaa

SEQ ID NO: 207164 - DNA, 20 bp, human
gatgacgcagcccggtggcg

SEQ ID NO: 207165 - DNA, 20 bp, human
gggccagtgccagcaagagg

SEQ ID NO: 207166 - DNA, 20 bp, human
gcctcccgcccgggaagcca

SEQ ID NO: 207167 - DNA, 20 bp, human
gcgagcgggcgcttctacgg

SEQ ID NO: 207168 - DNA, 20 bp, human
gctgccctggcttcccgggc

SEQ ID NO: 207169 - DNA, 20 bp, human
ggggaggagacgggccggga

SEQ ID NO: 207170 - DNA, 20 bp, human
gttgagggacagttgataac

SEQ ID NO: 207171 - DNA, 20 bp, human
gccggctgctcaggactgac

SEQ ID NO: 207172 - DNA, 20 bp, human
gtgactggcaccctttctag

SEQ ID NO: 207173 - DNA, 20 bp, human
ggcgcgagcgggcgcttcta

SEQ ID NO: 207174 - DNA, 20 bp, human
gaggagggaggagacgggcc

SEQ ID NO: 207175 - DNA, 20 bp, human
ggcttcccgggcgggaggtc

SEQ ID NO: 207176 - DNA, 20 bp, human
gtgcggaggcggtcctatga

SEQ ID NO: 207177 - DNA, 20 bp, human
ggacggtagtaggacgggcg

SEQ ID NO: 207178 - DNA, 20 bp, human
ggcactggagccgattgcgc

SEQ ID NO: 207179 - DNA, 20 bp, human
ggtagtaggacgggcgggga

SEQ ID NO: 207180 - DNA, 20 bp, human
gcccgtcctactaccgtcat

SEQ ID NO: 207181 - DNA, 20 bp, human
gggctccagtgcgcctgcgg

SEQ ID NO: 207182 - DNA, 20 bp, human
gagagccacgcctgcgcaat

SEQ ID NO: 207183 - DNA, 20 bp, human
ggggctgcgggtcgcttgga

SEQ ID NO: 207184 - DNA, 20 bp, human
ggccctgttggcgttggtgc

SEQ ID NO: 207185 - DNA, 20 bp, human
gtcccgcaccaacgccaaca

SEQ ID NO: 207186 - DNA, 20 bp, human
ggaaaaggcgcagtctcggt

SEQ ID NO: 207187 - DNA, 20 bp, human
ggggtgcagaattgaggcga

SEQ ID NO: 207188 - DNA, 20 bp, human
gcggggaaaaggcgcagtct

SEQ ID NO: 207189 - DNA, 20 bp, human
gtctcggtgggattgcgtgc

SEQ ID NO: 207190 - DNA, 20 bp, human
gattgcgtgcaggagggtcg

SEQ ID NO: 207191 - DNA, 20 bp, human
gcacccgtaaggacacacgc

SEQ ID NO: 207192 - DNA, 20 bp, human
ggcaagtgccaccttggtaa

SEQ ID NO: 207193 - DNA, 20 bp, human
gggtgggattgcgtgcagga

SEQ ID NO: 207194 - DNA, 20 bp, human
gctgctggggtgcggggaaa

SEQ ID NO: 207195 - DNA, 20 bp, human
ggtgcaggagggtcgtggtc

SEQ ID NO: 207196 - DNA, 20 bp, human
gcaggacacgggattggggt

SEQ ID NO: 207197 - DNA, 20 bp, human
ggtccacccggaggctgtgt

SEQ ID NO: 207198 - DNA, 20 bp, human
gccggaggctgtgtgggccg

SEQ ID NO: 207199 - DNA, 20 bp, human
gcacacgtgtgcagcagcct

SEQ ID NO: 207200 - DNA, 20 bp, human
gagggctcacatgacccaag

SEQ ID NO: 207201 - DNA, 20 bp, human
gctggagcaggacacgggat

SEQ ID NO: 207202 - DNA, 20 bp, human
ggctcacatgacccaagggg

SEQ ID NO: 207203 - DNA, 20 bp, human
gaggaagtggatcattagtg

SEQ ID NO: 207204 - DNA, 20 bp, human
gagcctccgggtggacctgc

SEQ ID NO: 207205 - DNA, 20 bp, human
gggtgcaggagatgtgtctt

SEQ ID NO: 207206 - DNA, 20 bp, human
ggcagatggaggctcctggt

SEQ ID NO: 207207 - DNA, 20 bp, human
gcagctgcagctgggctaga

SEQ ID NO: 207208 - DNA, 20 bp, human
ggggtctgagccgacccttg

SEQ ID NO: 207209 - DNA, 20 bp, human
gcaggagcctccatctgcct

SEQ ID NO: 207210 - DNA, 20 bp, human
gatgggccgatgaaccccaa

SEQ ID NO: 207211 - DNA, 20 bp, human
gctacagccgggaggcgtgg

SEQ ID NO: 207212 - DNA, 20 bp, human
gtgggctagaaggggtggcc

SEQ ID NO: 207213 - DNA, 20 bp, human
gggcccatgggtgcccccaa

SEQ ID NO: 207214 - DNA, 20 bp, human
gctcacaagagcttggcccc

SEQ ID NO: 207215 - DNA, 20 bp, human
gagcctacagccgggaggcg

SEQ ID NO: 207216 - DNA, 20 bp, human
ggacccgcgcacaggagcac

SEQ ID NO: 207217 - DNA, 20 bp, human
gcctgtgcgcgggtccactt

SEQ ID NO: 207218 - DNA, 20 bp, human
gggtccctgagtaggtgagg

SEQ ID NO: 207219 - DNA, 20 bp, human
gtgcgcgggtccacttggga

SEQ ID NO: 207220 - DNA, 20 bp, human
gttgggacgggtccctgagt

SEQ ID NO: 207221 - DNA, 20 bp, human
gccacctcctcacctactca

SEQ ID NO: 207222 - DNA, 20 bp, human
gttcccgtgctcctgtgcgc

SEQ ID NO: 207223 - DNA, 20 bp, human
gcgggtacaagccacttctt

SEQ ID NO: 207224 - DNA, 20 bp, human
ggcggtacgcgcagccttgt

SEQ ID NO: 207225 - DNA, 20 bp, human
gcgaggcccgcaggcgaggg

SEQ ID NO: 207226 - DNA, 20 bp, human
gcctccggggcggagctcca

SEQ ID NO: 207227 - DNA, 20 bp, human
gcggaggcggtgttgcggtg

SEQ ID NO: 207228 - DNA, 20 bp, human
gggccggccgaactgagacg

SEQ ID NO: 207229 - DNA, 20 bp, human
gtgggcgggggcgaccgcgc

SEQ ID NO: 207230 - DNA, 20 bp, human
ggggcgcggcggggtcggca

SEQ ID NO: 207231 - DNA, 20 bp, human
ggagccctggagctccgccc

SEQ ID NO: 207232 - DNA, 20 bp, human
gcgccccggaggcggtgttg

SEQ ID NO: 207233 - DNA, 20 bp, human
ggtgttgcggtgcggctggg

SEQ ID NO: 207234 - DNA, 20 bp, human
ggcagactgaccagtctctc

SEQ ID NO: 207235 - DNA, 20 bp, human
ggccgcgccccgtctcagtt

SEQ ID NO: 207236 - DNA, 20 bp, human
gaggaagcgtagggcaggtt

SEQ ID NO: 207237 - DNA, 20 bp, human
gcggggaaagctgttgatca

SEQ ID NO: 207238 - DNA, 20 bp, human
gttggtgtcctaacttaaat

SEQ ID NO: 207239 - DNA, 20 bp, human
gtttccaggaagcgtagggc

SEQ ID NO: 207240 - DNA, 20 bp, human
gcagtttccccatttaagtt

SEQ ID NO: 207241 - DNA, 20 bp, human
gaaagtttccaggaagcgta

SEQ ID NO: 207242 - DNA, 20 bp, human
gcaacagctttccccgctct

SEQ ID NO: 207243 - DNA, 20 bp, human
gacttcaaaagcctgtagag

SEQ ID NO: 207244 - DNA, 20 bp, human
gaggggaagctatttaatta

SEQ ID NO: 207245 - DNA, 20 bp, human
gcataagtagtaaagtttcc

SEQ ID NO: 207246 - DNA, 20 bp, human
gggcagaggcgctggggaat

SEQ ID NO: 207247 - DNA, 20 bp, human
gtgccagggcctgctataat

SEQ ID NO: 207248 - DNA, 20 bp, human
gaaacgggttaatccaaggc

SEQ ID NO: 207249 - DNA, 20 bp, human
gtcagcctctgcaactcagg

SEQ ID NO: 207250 - DNA, 20 bp, human
gccctggcacgctcccccag

SEQ ID NO: 207251 - DNA, 20 bp, human
gagacgaacaatgtggggtg

SEQ ID NO: 207252 - DNA, 20 bp, human
gttgctgagacgaacaatgt

SEQ ID NO: 207253 - DNA, 20 bp, human
gtcagcacccccattatagc

SEQ ID NO: 207254 - DNA, 20 bp, human
ggatgaaacgggttaatcca

SEQ ID NO: 207255 - DNA, 20 bp, human
gcaaggctggcagaggcgct

SEQ ID NO: 207256 - DNA, 20 bp, human
gcccccaccaccaggatgat

SEQ ID NO: 207257 - DNA, 20 bp, human
gaaggcgaggggctcttacc

SEQ ID NO: 207258 - DNA, 20 bp, human
gaagagcccctcgccttaac

SEQ ID NO: 207259 - DNA, 20 bp, human
gacttcttgacttcctgcat

SEQ ID NO: 207260 - DNA, 20 bp, human
gcaggagtcccccatcatcc

SEQ ID NO: 207261 - DNA, 20 bp, human
gggacctcgcaagagttact

SEQ ID NO: 207262 - DNA, 20 bp, human
ggcaccgtctcatcactgaa

SEQ ID NO: 207263 - DNA, 20 bp, human
ggccttgggacagagggagt

SEQ ID NO: 207264 - DNA, 20 bp, human
gagacggtgcaacatgtttg

SEQ ID NO: 207265 - DNA, 20 bp, human
gtacctggcctgactgctgg

SEQ ID NO: 207266 - DNA, 20 bp, human
gcacaaagagcgggccgggg

SEQ ID NO: 207267 - DNA, 20 bp, human
gcccacgcgtcacaaagagc

SEQ ID NO: 207268 - DNA, 20 bp, human
gctcgacagccgggctctca

SEQ ID NO: 207269 - DNA, 20 bp, human
gcgtcacaaagagcgggccg

SEQ ID NO: 207270 - DNA, 20 bp, human
gggctctcagggccctaaag

SEQ ID NO: 207271 - DNA, 20 bp, human
gccattcctaccatctggat

SEQ ID NO: 207272 - DNA, 20 bp, human
gggggcggggcctcgacagc

SEQ ID NO: 207273 - DNA, 20 bp, human
gagaaaaagacgctaagtga

SEQ ID NO: 207274 - DNA, 20 bp, human
ggcagagagagccgcaggcg

SEQ ID NO: 207275 - DNA, 20 bp, human
ggtttgccattcctaccatc

SEQ ID NO: 207276 - DNA, 20 bp, human
gcgggagcaggggcgtggac

SEQ ID NO: 207277 - DNA, 20 bp, human
gcgtggacgggaacaccgag

SEQ ID NO: 207278 - DNA, 20 bp, human
gagaactggagcgaaggcgc

SEQ ID NO: 207279 - DNA, 20 bp, human
gggggcgggggcacgagaac

SEQ ID NO: 207280 - DNA, 20 bp, human
gctgccttgctcttatctag

SEQ ID NO: 207281 - DNA, 20 bp, human
gtaggtccgggcactataaa

SEQ ID NO: 207282 - DNA, 20 bp, human
gggacgggaacaccgagggg

SEQ ID NO: 207283 - DNA, 20 bp, human
gctgtaacgcttccgggatc

SEQ ID NO: 207284 - DNA, 20 bp, human
gacaaataagcaacatccgt

SEQ ID NO: 207285 - DNA, 20 bp, human
gtatagtgcccggacctagg

SEQ ID NO: 207286 - DNA, 20 bp, human
ggcacacagaaaataatcat

SEQ ID NO: 207287 - DNA, 20 bp, human
gtacagatcagagccaagaa

SEQ ID NO: 207288 - DNA, 20 bp, human
gcacaatgggttgggctctg

SEQ ID NO: 207289 - DNA, 20 bp, human
gaacagaggtcaaccttcca

SEQ ID NO: 207290 - DNA, 20 bp, human
ggtagcctgttcaggcaagt

SEQ ID NO: 207291 - DNA, 20 bp, human
gagggccaacttgcctgaac

SEQ ID NO: 207292 - DNA, 20 bp, human
gaacccatgtttcttcacaa

SEQ ID NO: 207293 - DNA, 20 bp, human
gttggctctgatctgtaccc

SEQ ID NO: 207294 - DNA, 20 bp, human
gacccattgtgaagaaacat

SEQ ID NO: 207295 - DNA, 20 bp, human
gagtgtcaactgtggcagga

SEQ ID NO: 207296 - DNA, 20 bp, human
gcacccccactgctcactca

SEQ ID NO: 207297 - DNA, 20 bp, human
gaggtctggccaatgggctc

SEQ ID NO: 207298 - DNA, 20 bp, human
gaatccgctccgcttctccc

SEQ ID NO: 207299 - DNA, 20 bp, human
gcaactagagtgacccaaag

SEQ ID NO: 207300 - DNA, 20 bp, human
gagtgggtgagatccctccc

SEQ ID NO: 207301 - DNA, 20 bp, human
gccagacccagatcctgaag

SEQ ID NO: 207302 - DNA, 20 bp, human
gtcccccaggtcctgcatgg

SEQ ID NO: 207303 - DNA, 20 bp, human
gggtctgccgaatgctgccc

SEQ ID NO: 207304 - DNA, 20 bp, human
gccgctccgcttctcccagg

SEQ ID NO: 207305 - DNA, 20 bp, human
gctgaagtggctgctacccc

SEQ ID NO: 207306 - DNA, 20 bp, human
gccgcccaggcagggagtct

SEQ ID NO: 207307 - DNA, 20 bp, human
gctggaagcagcttccccta

SEQ ID NO: 207308 - DNA, 20 bp, human
gccacctcttgtgacatcac

SEQ ID NO: 207309 - DNA, 20 bp, human
gaagcagcttcccctagggg

SEQ ID NO: 207310 - DNA, 20 bp, human
gaagccctcaacatgccttg

SEQ ID NO: 207311 - DNA, 20 bp, human
gcagcacaatccctgccatt

SEQ ID NO: 207312 - DNA, 20 bp, human
gaagccatgaccctaatggc

SEQ ID NO: 207313 - DNA, 20 bp, human
gagagccccaaggcatgttg

SEQ ID NO: 207314 - DNA, 20 bp, human
gtgggatggaacgttctgga

SEQ ID NO: 207315 - DNA, 20 bp, human
gcagccagtgatgtcacaag

SEQ ID NO: 207316 - DNA, 20 bp, human
gacatccgtgaggggccaga

SEQ ID NO: 207317 - DNA, 20 bp, human
gggccagcacgtgacccgag

SEQ ID NO: 207318 - DNA, 20 bp, human
gggagggccgcggggtcgga

SEQ ID NO: 207319 - DNA, 20 bp, human
gtcctcgcgaccatcctcag

SEQ ID NO: 207320 - DNA, 20 bp, human
gcgaatccgccgcaccccat

SEQ ID NO: 207321 - DNA, 20 bp, human
gcaggcgcgaagcgtccttg

SEQ ID NO: 207322 - DNA, 20 bp, human
gaaaccagggctattcttcg

SEQ ID NO: 207323 - DNA, 20 bp, human
gcgccgcaccccataggcag

SEQ ID NO: 207324 - DNA, 20 bp, human
ggcggcggcgacttcgcgcg

SEQ ID NO: 207325 - DNA, 20 bp, human
gagggctattcttcgagggt

SEQ ID NO: 207326 - DNA, 20 bp, human
gaggcccagcaatccgcgtt

SEQ ID NO: 207327 - DNA, 20 bp, human
gggccccgaccccgccacga

SEQ ID NO: 207328 - DNA, 20 bp, human
gcgaccccgccacgacggga

SEQ ID NO: 207329 - DNA, 20 bp, human
gtccccccggcgcggcgccg

SEQ ID NO: 207330 - DNA, 20 bp, human
gcccgcccgtcccgtcgtgg

SEQ ID NO: 207331 - DNA, 20 bp, human
gacggctcacgagacgcccg

SEQ ID NO: 207332 - DNA, 20 bp, human
gccgcgccggggaagctgtt

SEQ ID NO: 207333 - DNA, 20 bp, human
gcggggaagctgttgggcgc

SEQ ID NO: 207334 - DNA, 20 bp, human
ggcgccgtggcggcgggttc

SEQ ID NO: 207335 - DNA, 20 bp, human
gtgtcccgcccgtcccgtcg

SEQ ID NO: 207336 - DNA, 20 bp, human
gcgggtggccggcggtcgag

SEQ ID NO: 207337 - DNA, 20 bp, human
gccacgcgcgcccagacagg

SEQ ID NO: 207338 - DNA, 20 bp, human
ggcgcgcccagacaggaggg

SEQ ID NO: 207339 - DNA, 20 bp, human
ggcagtctgggcgactccag

SEQ ID NO: 207340 - DNA, 20 bp, human
ggggccccgcgatgcccgag

SEQ ID NO: 207341 - DNA, 20 bp, human
gtgagggtgcaggatccgga

SEQ ID NO: 207342 - DNA, 20 bp, human
ggagcgcaccagcagcatcc

SEQ ID NO: 207343 - DNA, 20 bp, human
ggggcgcaaccagcgggccg

SEQ ID NO: 207344 - DNA, 20 bp, human
gtggcgggggcgcaaccagc

SEQ ID NO: 207345 - DNA, 20 bp, human
gggagtcgcccagactgcct

SEQ ID NO: 207346 - DNA, 20 bp, human
ggggctgggcctatcgaatt

SEQ ID NO: 207347 - DNA, 20 bp, human
ggggcggggcgaggttacta

SEQ ID NO: 207348 - DNA, 20 bp, human
gggaacggggtcgaccagga

SEQ ID NO: 207349 - DNA, 20 bp, human
gccacccattggcccgcgag

SEQ ID NO: 207350 - DNA, 20 bp, human
gagccgccgcggaccggacc

SEQ ID NO: 207351 - DNA, 20 bp, human
gagctcctgcagaccctatt

SEQ ID NO: 207352 - DNA, 20 bp, human
gtgcagccaggtccggtccg

SEQ ID NO: 207353 - DNA, 20 bp, human
gtccccggcccgaattcgat

SEQ ID NO: 207354 - DNA, 20 bp, human
gggatctgcggcagcgacgt

SEQ ID NO: 207355 - DNA, 20 bp, human
gagggacggaccgcgggtgg

SEQ ID NO: 207356 - DNA, 20 bp, human
ggggacgtcagtcgaaaagg

SEQ ID NO: 207357 - DNA, 20 bp, human
ggcagagccagccgaatcgc

SEQ ID NO: 207358 - DNA, 20 bp, human
gccgtctgcagccagcgatt

SEQ ID NO: 207359 - DNA, 20 bp, human
gcggaaaagacgcgcccgga

SEQ ID NO: 207360 - DNA, 20 bp, human
ggcgccccgggaagcccgtt

SEQ ID NO: 207361 - DNA, 20 bp, human
gagcccggaaaagacgcgcc

SEQ ID NO: 207362 - DNA, 20 bp, human
gaggaaggcgaggcggctaa

SEQ ID NO: 207363 - DNA, 20 bp, human
gcgaaaaggcggagccgaac

SEQ ID NO: 207364 - DNA, 20 bp, human
gcccgggacgtcagtcgaaa

SEQ ID NO: 207365 - DNA, 20 bp, human
ggagccgaacgggcttcccg

SEQ ID NO: 207366 - DNA, 20 bp, human
gggcagggtcaactgtgttg

SEQ ID NO: 207367 - DNA, 20 bp, human
ggaagctgccaaagctaccc

SEQ ID NO: 207368 - DNA, 20 bp, human
gagctctggcgactggagag

SEQ ID NO: 207369 - DNA, 20 bp, human
gcttttgtgtcggcccttag

SEQ ID NO: 207370 - DNA, 20 bp, human
gcaactgtgttgaggcaagc

SEQ ID NO: 207371 - DNA, 20 bp, human
ggaagtgttctgaccaggag

SEQ ID NO: 207372 - DNA, 20 bp, human
gtgaggcttctgatctgagg

SEQ ID NO: 207373 - DNA, 20 bp, human
gggggtagaaggtgtttgtg

SEQ ID NO: 207374 - DNA, 20 bp, human
gaagcaagtcaggaacgaca

SEQ ID NO: 207375 - DNA, 20 bp, human
ggggctgtgagtcgttcaat

SEQ ID NO: 207376 - DNA, 20 bp, human
gtgaggtagagctttatcga

SEQ ID NO: 207377 - DNA, 20 bp, human
gaaagctctacctcagggga

SEQ ID NO: 207378 - DNA, 20 bp, human
gtgtcacaacagaagttcaa

SEQ ID NO: 207379 - DNA, 20 bp, human
ggttatgcaatgggcttaag

SEQ ID NO: 207380 - DNA, 20 bp, human
gggaaggagaaggggtagac

SEQ ID NO: 207381 - DNA, 20 bp, human
gacaagagattgttatgcaa

SEQ ID NO: 207382 - DNA, 20 bp, human
ggtcccttctagaagatagc

SEQ ID NO: 207383 - DNA, 20 bp, human
gcgttagctttctgaactaa

SEQ ID NO: 207384 - DNA, 20 bp, human
gaggttccaggggagtgtgt

SEQ ID NO: 207385 - DNA, 20 bp, human
gcaatccttgagactgtgat

SEQ ID NO: 207386 - DNA, 20 bp, human
ggaaccgccaagctcccggg

SEQ ID NO: 207387 - DNA, 20 bp, human
ggcttgccccgcactgaccg

SEQ ID NO: 207388 - DNA, 20 bp, human
gccgctgcggagacggctca

SEQ ID NO: 207389 - DNA, 20 bp, human
gcggagacggctcaaggggg

SEQ ID NO: 207390 - DNA, 20 bp, human
gtcggaaccgccaagctccc

SEQ ID NO: 207391 - DNA, 20 bp, human
gcagcctggccggccgggtc

SEQ ID NO: 207392 - DNA, 20 bp, human
ggggcagggtcgcgtgttga

SEQ ID NO: 207393 - DNA, 20 bp, human
gctgcggagacggctcaagg

SEQ ID NO: 207394 - DNA, 20 bp, human
ggcggggcaagccccagacc

SEQ ID NO: 207395 - DNA, 20 bp, human
gtgggctcaatgtcacgctc

SEQ ID NO: 207396 - DNA, 20 bp, human
ggacagggcagcataggaag

SEQ ID NO: 207397 - DNA, 20 bp, human
gcagcagagtgggctccgca

SEQ ID NO: 207398 - DNA, 20 bp, human
gtgttaggtcgcagcgtcag

SEQ ID NO: 207399 - DNA, 20 bp, human
gccgactgactgcaagtgag

SEQ ID NO: 207400 - DNA, 20 bp, human
ggcataggaagcggagtgtt

SEQ ID NO: 207401 - DNA, 20 bp, human
gccagggatcctggagaaat

SEQ ID NO: 207402 - DNA, 20 bp, human
gacacagaaaccagcagagt

SEQ ID NO: 207403 - DNA, 20 bp, human
gcagggaagtctcctctctg

SEQ ID NO: 207404 - DNA, 20 bp, human
gtccctgcccgggtagccca

SEQ ID NO: 207405 - DNA, 20 bp, human
gatggtcctggagggtaaac

SEQ ID NO: 207406 - DNA, 20 bp, human
gtgcaaggaggcatggtcgt

SEQ ID NO: 207407 - DNA, 20 bp, human
gggacaagaggacacccact

SEQ ID NO: 207408 - DNA, 20 bp, human
gctgatcagaggcttaacaa

SEQ ID NO: 207409 - DNA, 20 bp, human
gttctgcaaaggctaaaggc

SEQ ID NO: 207410 - DNA, 20 bp, human
gtacactctgtttaacccta

SEQ ID NO: 207411 - DNA, 20 bp, human
gcctttgcagaagggcttct

SEQ ID NO: 207412 - DNA, 20 bp, human
gtacattaactgagttcagg

SEQ ID NO: 207413 - DNA, 20 bp, human
gggaaaaggctggtttggac

SEQ ID NO: 207414 - DNA, 20 bp, human
ggacacagcatttgtaaggc

SEQ ID NO: 207415 - DNA, 20 bp, human
ggtgtacattaactgagttc

SEQ ID NO: 207416 - DNA, 20 bp, human
gagagaaatggagctcacat

SEQ ID NO: 207417 - DNA, 20 bp, human
gaatccaaggggcatgaagc

SEQ ID NO: 207418 - DNA, 20 bp, human
gagctccatttctctctctt

SEQ ID NO: 207419 - DNA, 20 bp, human
gaaacctgcttcatgcccct

SEQ ID NO: 207420 - DNA, 20 bp, human
gaggttggatacacacgtgt

SEQ ID NO: 207421 - DNA, 20 bp, human
gaacgtggataaagatgagg

SEQ ID NO: 207422 - DNA, 20 bp, human
ggacttgcactttcaatcca

SEQ ID NO: 207423 - DNA, 20 bp, human
ggaggaatcagcaaaagaga

SEQ ID NO: 207424 - DNA, 20 bp, human
ggtgaacgtggataaagatg

SEQ ID NO: 207425 - DNA, 20 bp, human
gtaactttggagtcttacaa

SEQ ID NO: 207426 - DNA, 20 bp, human
gagagaaatggagctcacat

SEQ ID NO: 207427 - DNA, 20 bp, human
gaatccaaggggcatgaagc

SEQ ID NO: 207428 - DNA, 20 bp, human
gagctccatttctctctctt

SEQ ID NO: 207429 - DNA, 20 bp, human
gaaacctgcttcatgcccct

SEQ ID NO: 207430 - DNA, 20 bp, human
gaacgtggataaagatgagg

SEQ ID NO: 207431 - DNA, 20 bp, human
gatgaagcaggtttatgccc

SEQ ID NO: 207432 - DNA, 20 bp, human
ggaggaatcagcaaaagaga

SEQ ID NO: 207433 - DNA, 20 bp, human
gcctggaatgagagtggcca

SEQ ID NO: 207434 - DNA, 20 bp, human
gaggttggatacacacgtgt

SEQ ID NO: 207435 - DNA, 20 bp, human
ggggccattggcaagccaca

SEQ ID NO: 207436 - DNA, 20 bp, human
gtggaggaggagccaagctc

SEQ ID NO: 207437 - DNA, 20 bp, human
gtcccagcggttcctcttac

SEQ ID NO: 207438 - DNA, 20 bp, human
ggaggagcagtctgacaatc

SEQ ID NO: 207439 - DNA, 20 bp, human
gacctgtaagaggaaccgct

SEQ ID NO: 207440 - DNA, 20 bp, human
gacagcaagcttttgagggg

SEQ ID NO: 207441 - DNA, 20 bp, human
gattggtggagacattctgg

SEQ ID NO: 207442 - DNA, 20 bp, human
ggagcagtctgacaatccgg

SEQ ID NO: 207443 - DNA, 20 bp, human
gggtggagacattctggagg

SEQ ID NO: 207444 - DNA, 20 bp, human
gagaatgtctccaccaatca

SEQ ID NO: 207445 - DNA, 20 bp, human
gagaaacagcaagcttttga

SEQ ID NO: 207446 - DNA, 20 bp, human
gatgaagaggaagggtccag

SEQ ID NO: 207447 - DNA, 20 bp, human
gtgtgtgtccctggcaagtt

SEQ ID NO: 207448 - DNA, 20 bp, human
ggtataaagcaggcgaaagg

SEQ ID NO: 207449 - DNA, 20 bp, human
gtgctgccttagccactgac

SEQ ID NO: 207450 - DNA, 20 bp, human
gtgactggtctccctgccac

SEQ ID NO: 207451 - DNA, 20 bp, human
gaggtgttccccaacttgcc

SEQ ID NO: 207452 - DNA, 20 bp, human
ggaaacttcgctgtctggac

SEQ ID NO: 207453 - DNA, 20 bp, human
gctgacaattctgtagttaa

SEQ ID NO: 207454 - DNA, 20 bp, human
gaatcacaatgggaagttga

SEQ ID NO: 207455 - DNA, 20 bp, human
gacagaacagtgtataaagc

SEQ ID NO: 207456 - DNA, 20 bp, human
gctggtgggtgtgcccaaac

SEQ ID NO: 207457 - DNA, 20 bp, human
ggtgggtgtgcccaaactgg

SEQ ID NO: 207458 - DNA, 20 bp, human
gaacccagcagctgacacag

SEQ ID NO: 207459 - DNA, 20 bp, human
gccaccaggcacgacagttg

SEQ ID NO: 207460 - DNA, 20 bp, human
gggcagggggccactctcac

SEQ ID NO: 207461 - DNA, 20 bp, human
gagtactgagaaaacttggc

SEQ ID NO: 207462 - DNA, 20 bp, human
gggaatacatccaccagttt

SEQ ID NO: 207463 - DNA, 20 bp, human
gtctcagtactcacagtggc

SEQ ID NO: 207464 - DNA, 20 bp, human
gactgagaaaacttggcagg

SEQ ID NO: 207465 - DNA, 20 bp, human
gtctaatcggaaaaagcaac

SEQ ID NO: 207466 - DNA, 20 bp, human
ggagcgcagcgcctgggcca

SEQ ID NO: 207467 - DNA, 20 bp, human
ggggcccgcggagactccac

SEQ ID NO: 207468 - DNA, 20 bp, human
gaaggggtgcaggggagcgc

SEQ ID NO: 207469 - DNA, 20 bp, human
ggggagagggggggccgctt

SEQ ID NO: 207470 - DNA, 20 bp, human
ggagactccacggggcgccc

SEQ ID NO: 207471 - DNA, 20 bp, human
gggggggccgcttaggaaga

SEQ ID NO: 207472 - DNA, 20 bp, human
gactcgaggaacatccgggt

SEQ ID NO: 207473 - DNA, 20 bp, human
gtcaccggagcgcagcgcct

SEQ ID NO: 207474 - DNA, 20 bp, human
gctgcgctccggtgagtctg

SEQ ID NO: 207475 - DNA, 20 bp, human
gggaatggatggtggcggaa

SEQ ID NO: 207476 - DNA, 20 bp, human
gaggaaaagtcgagggatag

SEQ ID NO: 207477 - DNA, 20 bp, human
ggttggggagggatcgaggt

SEQ ID NO: 207478 - DNA, 20 bp, human
gaaaagtcgagggatagggg

SEQ ID NO: 207479 - DNA, 20 bp, human
gggcggggccgtgtctggtt

SEQ ID NO: 207480 - DNA, 20 bp, human
ggggtgggcggtgccagagg

SEQ ID NO: 207481 - DNA, 20 bp, human
gggccgtgtctggttgggga

SEQ ID NO: 207482 - DNA, 20 bp, human
ggccgggtgtgacaagggag

SEQ ID NO: 207483 - DNA, 20 bp, human
gaggtgggcccatggagtga

SEQ ID NO: 207484 - DNA, 20 bp, human
gcgtcgagtgaaagcagaag

SEQ ID NO: 207485 - DNA, 20 bp, human
gggcggggccgggtgtgaca

SEQ ID NO: 207486 - DNA, 20 bp, human
ggggttggaagtgcatgttg

SEQ ID NO: 207487 - DNA, 20 bp, human
gagaagcaacaggctaaagt

SEQ ID NO: 207488 - DNA, 20 bp, human
gaagtgggggccccgggaca

SEQ ID NO: 207489 - DNA, 20 bp, human
gtcgccgggaaaaaccgacc

SEQ ID NO: 207490 - DNA, 20 bp, human
ggagcgaccagagaagcaac

SEQ ID NO: 207491 - DNA, 20 bp, human
gtcaacacacaagtactcct

SEQ ID NO: 207492 - DNA, 20 bp, human
gcgcaactaacctgctgcaa

SEQ ID NO: 207493 - DNA, 20 bp, human
gtttcccggcgactctagtg

SEQ ID NO: 207494 - DNA, 20 bp, human
gtgaccactgagagggtagg

SEQ ID NO: 207495 - DNA, 20 bp, human
ggctccaggtcggtttttcc

SEQ ID NO: 207496 - DNA, 20 bp, human
gcaggaggggcaaacccgct

SEQ ID NO: 207497 - DNA, 20 bp, human
gttgcccgccggaggggatg

SEQ ID NO: 207498 - DNA, 20 bp, human
gcaactgggtcgggtcagga

SEQ ID NO: 207499 - DNA, 20 bp, human
gggccaacccgctccttctt

SEQ ID NO: 207500 - DNA, 20 bp, human
gtggtcaacgcaggggaccc

SEQ ID NO: 207501 - DNA, 20 bp, human
gcccctgcgttgaccaaaga

SEQ ID NO: 207502 - DNA, 20 bp, human
ggaccaaagaaggagcgggt

SEQ ID NO: 207503 - DNA, 20 bp, human
gccctccctcggccggttcg

SEQ ID NO: 207504 - DNA, 20 bp, human
ggcgttgaccaaagaaggag

SEQ ID NO: 207505 - DNA, 20 bp, human
gcaggccgcgaaccggccga

SEQ ID NO: 207506 - DNA, 20 bp, human
ggaagtctcagcggcagggg

SEQ ID NO: 207507 - DNA, 20 bp, human
gcggcaggggggggtaagcc

SEQ ID NO: 207508 - DNA, 20 bp, human
ggcagaagtctcagcggcag

SEQ ID NO: 207509 - DNA, 20 bp, human
gcctccctccccaggaacct

SEQ ID NO: 207510 - DNA, 20 bp, human
ggagatgtccctaggttcct

SEQ ID NO: 207511 - DNA, 20 bp, human
gtcctggggagggaggacgt

SEQ ID NO: 207512 - DNA, 20 bp, human
gtctgccagggcggcgacca

SEQ ID NO: 207513 - DNA, 20 bp, human
gcagcccttagccggggcaa

SEQ ID NO: 207514 - DNA, 20 bp, human
gagccactcaaattctgcca

SEQ ID NO: 207515 - DNA, 20 bp, human
ggctccggcctggtgaaagc

SEQ ID NO: 207516 - DNA, 20 bp, human
ggacactgagctagggtaat

SEQ ID NO: 207517 - DNA, 20 bp, human
gagcaagctggcatcctctg

SEQ ID NO: 207518 - DNA, 20 bp, human
ggcagaccagtggaatgcag

SEQ ID NO: 207519 - DNA, 20 bp, human
gggtctgctcatgaaacggg

SEQ ID NO: 207520 - DNA, 20 bp, human
gcaaaactctctaatctggg

SEQ ID NO: 207521 - DNA, 20 bp, human
gagcacaaaactctctaatc

SEQ ID NO: 207522 - DNA, 20 bp, human
gctgctcatgaaacgggagg

SEQ ID NO: 207523 - DNA, 20 bp, human
gtaccctagctcagtgtctc

SEQ ID NO: 207524 - DNA, 20 bp, human
gttgtgctgaggtccctata

SEQ ID NO: 207525 - DNA, 20 bp, human
ggcccagagacactgagcta

SEQ ID NO: 207526 - DNA, 20 bp, human
gaagcagtggttaagccgga

SEQ ID NO: 207527 - DNA, 20 bp, human
gtgagtgcgcgccgccccgc

SEQ ID NO: 207528 - DNA, 20 bp, human
gcgcactcacccacccgcgc

SEQ ID NO: 207529 - DNA, 20 bp, human
gtctcgaaaaagttatatgg

SEQ ID NO: 207530 - DNA, 20 bp, human
gccgcgccggagcggacctt

SEQ ID NO: 207531 - DNA, 20 bp, human
gaccgaagcagtggttaagc

SEQ ID NO: 207532 - DNA, 20 bp, human
gtctgtgtgacaataaaaaa

SEQ ID NO: 207533 - DNA, 20 bp, human
gccaagccaaaggtccgctc

SEQ ID NO: 207534 - DNA, 20 bp, human
gaccaagcagaaatcaccat

SEQ ID NO: 207535 - DNA, 20 bp, human
gaattcccggaagggagaca

SEQ ID NO: 207536 - DNA, 20 bp, human
gccggcgcgcgcccagattg

SEQ ID NO: 207537 - DNA, 20 bp, human
gctggcgcccggttgggagg

SEQ ID NO: 207538 - DNA, 20 bp, human
gacccaccgcgggacatcct

SEQ ID NO: 207539 - DNA, 20 bp, human
ggaagtgcgcgcaagcgccc

SEQ ID NO: 207540 - DNA, 20 bp, human
gacccggcgctgtttgaacc

SEQ ID NO: 207541 - DNA, 20 bp, human
gaaggcgggctcggccggaa

SEQ ID NO: 207542 - DNA, 20 bp, human
gctgcactgtgcggcgaagc

SEQ ID NO: 207543 - DNA, 20 bp, human
gggctcggccggaaggggtg

SEQ ID NO: 207544 - DNA, 20 bp, human
gcggaacggcgcacgctgat

SEQ ID NO: 207545 - DNA, 20 bp, human
gggggcggacgcggtctcgg

SEQ ID NO: 207546 - DNA, 20 bp, human
gcaggctgacggtcatgtgt

SEQ ID NO: 207547 - DNA, 20 bp, human
ggataactatgatgatgcag

SEQ ID NO: 207548 - DNA, 20 bp, human
gcaccagttcccagcatttc

SEQ ID NO: 207549 - DNA, 20 bp, human
ggtgtgggttgcctaattac

SEQ ID NO: 207550 - DNA, 20 bp, human
gtgccaagtggtcaaatctc

SEQ ID NO: 207551 - DNA, 20 bp, human
gtggtggagtaggacatggg

SEQ ID NO: 207552 - DNA, 20 bp, human
gacctcaccaggcaggctga

SEQ ID NO: 207553 - DNA, 20 bp, human
gtctagagacctcaccaggc

SEQ ID NO: 207554 - DNA, 20 bp, human
ggtatggcaacactgctggg

SEQ ID NO: 207555 - DNA, 20 bp, human
gctaggtatggcaacactgc

SEQ ID NO: 207556 - DNA, 20 bp, human
ggggaggggcaggcgctgaa

SEQ ID NO: 207557 - DNA, 20 bp, human
gaccaggcgaggagtgaacg

SEQ ID NO: 207558 - DNA, 20 bp, human
ggggcaggcgctgaagggta

SEQ ID NO: 207559 - DNA, 20 bp, human
gtcggcggggcgggtcggct

SEQ ID NO: 207560 - DNA, 20 bp, human
gcccttccttacatggtctg

SEQ ID NO: 207561 - DNA, 20 bp, human
ggtgcgaaggggaccaaata

SEQ ID NO: 207562 - DNA, 20 bp, human
gcccccagaccatgtaagga

SEQ ID NO: 207563 - DNA, 20 bp, human
gccgggcgctgactcaccgt

SEQ ID NO: 207564 - DNA, 20 bp, human
gacccagagcccgctgccgc

SEQ ID NO: 207565 - DNA, 20 bp, human
gaggcgaggagtgaacgcgg

SEQ ID NO: 207566 - DNA, 20 bp, human
ggactgccgcgccgtgggga

SEQ ID NO: 207567 - DNA, 20 bp, human
gccgccgggcagggacacgt

SEQ ID NO: 207568 - DNA, 20 bp, human
gagcccgcaccgcctcccaa

SEQ ID NO: 207569 - DNA, 20 bp, human
gtggcgcgggcggggccgtt

SEQ ID NO: 207570 - DNA, 20 bp, human
gggtcgccgggagggccgaa

SEQ ID NO: 207571 - DNA, 20 bp, human
gacgtccagctcaggccccg

SEQ ID NO: 207572 - DNA, 20 bp, human
gtccgcttaaataacggcgg

SEQ ID NO: 207573 - DNA, 20 bp, human
gcaccggcagagaaacgcga

SEQ ID NO: 207574 - DNA, 20 bp, human
gggcctgagctggacgtcgc

SEQ ID NO: 207575 - DNA, 20 bp, human
gtccctgcccggcgggccaa

SEQ ID NO: 207576 - DNA, 20 bp, human
gtcgccttgggggtagggaa

SEQ ID NO: 207577 - DNA, 20 bp, human
gtcactctgggcagcttata

SEQ ID NO: 207578 - DNA, 20 bp, human
gcccgctgccattcttggta

SEQ ID NO: 207579 - DNA, 20 bp, human
gggaacaaatctaccagcac

SEQ ID NO: 207580 - DNA, 20 bp, human
gtttcaataaatcgccttgg

SEQ ID NO: 207581 - DNA, 20 bp, human
ggtggcaacagccccggtgc

SEQ ID NO: 207582 - DNA, 20 bp, human
gccaggggccgcatgcagca

SEQ ID NO: 207583 - DNA, 20 bp, human
gggaggcccgctgccattct

SEQ ID NO: 207584 - DNA, 20 bp, human
gtatgcaagtgcagcataaa

SEQ ID NO: 207585 - DNA, 20 bp, human
gtgtatgcaaaaggactcag

SEQ ID NO: 207586 - DNA, 20 bp, human
gtgtactggagtagtcatac

SEQ ID NO: 207587 - DNA, 20 bp, human
gtcaactgccagtgagtggg

SEQ ID NO: 207588 - DNA, 20 bp, human
ggcacacttccaggagggac

SEQ ID NO: 207589 - DNA, 20 bp, human
gggctcaactgccagtgagt

SEQ ID NO: 207590 - DNA, 20 bp, human
gctaacccccagtacacaga

SEQ ID NO: 207591 - DNA, 20 bp, human
gctgaccctacctgcaatca

SEQ ID NO: 207592 - DNA, 20 bp, human
ggtcaccttctgtgtactgg

SEQ ID NO: 207593 - DNA, 20 bp, human
gcatgcagagggtaggccac

SEQ ID NO: 207594 - DNA, 20 bp, human
ggggagtgtggaaaggaact

SEQ ID NO: 207595 - DNA, 20 bp, human
gtgtgccctgattgcaggta

SEQ ID NO: 207596 - DNA, 20 bp, human
gcaggcttcagtctccgctc

SEQ ID NO: 207597 - DNA, 20 bp, human
ggggaggagcagaactttga

SEQ ID NO: 207598 - DNA, 20 bp, human
ggggcggaacagcaaagcag

SEQ ID NO: 207599 - DNA, 20 bp, human
ggaagcctgaactaggggcc

SEQ ID NO: 207600 - DNA, 20 bp, human
gtcagcaagggctgacgggg

SEQ ID NO: 207601 - DNA, 20 bp, human
ggcggggctttcagaccaga

SEQ ID NO: 207602 - DNA, 20 bp, human
gggcccggacagaagaggcg

SEQ ID NO: 207603 - DNA, 20 bp, human
ggaggcccggcccctagttc

SEQ ID NO: 207604 - DNA, 20 bp, human
gtagccacgagctgaaaagg

SEQ ID NO: 207605 - DNA, 20 bp, human
gggtccagggagttgtcata

SEQ ID NO: 207606 - DNA, 20 bp, human
gaggcctggaccctagtgat

SEQ ID NO: 207607 - DNA, 20 bp, human
gcagcaggacagaaggagtt

SEQ ID NO: 207608 - DNA, 20 bp, human
gcccgggtgggcgagggaat

SEQ ID NO: 207609 - DNA, 20 bp, human
ggggactaggaggtgcgtct

SEQ ID NO: 207610 - DNA, 20 bp, human
gagcggcgggaacccgggta

SEQ ID NO: 207611 - DNA, 20 bp, human
gccccatggctgccttcgat

SEQ ID NO: 207612 - DNA, 20 bp, human
gagcaggtttagccaatcga

SEQ ID NO: 207613 - DNA, 20 bp, human
gtaggaggagccagcaagtg

SEQ ID NO: 207614 - DNA, 20 bp, human
gaaggctggaagaagcatgg

SEQ ID NO: 207615 - DNA, 20 bp, human
gaggaaggctggaagaagca

SEQ ID NO: 207616 - DNA, 20 bp, human
ggggggcagctgctttaaag

SEQ ID NO: 207617 - DNA, 20 bp, human
gtcgcctggcagccaatcgg

SEQ ID NO: 207618 - DNA, 20 bp, human
gaccgtcgctaaggaactgg

SEQ ID NO: 207619 - DNA, 20 bp, human
gcgagacaatgaccgaccgg

SEQ ID NO: 207620 - DNA, 20 bp, human
gaggcgagacaatgaccgac

SEQ ID NO: 207621 - DNA, 20 bp, human
gggcggggcgggactctcag

SEQ ID NO: 207622 - DNA, 20 bp, human
gctccaacggcgccgccgat

SEQ ID NO: 207623 - DNA, 20 bp, human
gtaagcggccaggaggagat

SEQ ID NO: 207624 - DNA, 20 bp, human
gggcggcgccgttggagcgg

SEQ ID NO: 207625 - DNA, 20 bp, human
gggacagctcccgggatccc

SEQ ID NO: 207626 - DNA, 20 bp, human
ggtaccctaacacaggataa

SEQ ID NO: 207627 - DNA, 20 bp, human
gaacaagccggggaccggat

SEQ ID NO: 207628 - DNA, 20 bp, human
gaaggcagctgggaattcgc

SEQ ID NO: 207629 - DNA, 20 bp, human
gagagccatgtgtatgtcag

SEQ ID NO: 207630 - DNA, 20 bp, human
gcagggtggcagtgctagtg

SEQ ID NO: 207631 - DNA, 20 bp, human
gcaaacccttatcctgtgtt

SEQ ID NO: 207632 - DNA, 20 bp, human
gtgcagtccaatccggtccc

SEQ ID NO: 207633 - DNA, 20 bp, human
gggtccccggcttgttggat

SEQ ID NO: 207634 - DNA, 20 bp, human
gtctagtcggtggcgggtgg

SEQ ID NO: 207635 - DNA, 20 bp, human
gcccgccaccgactagaata

SEQ ID NO: 207636 - DNA, 20 bp, human
ggttaggcatggaaatgcaa

SEQ ID NO: 207637 - DNA, 20 bp, human
ggtccagtagtgaacaggtt

SEQ ID NO: 207638 - DNA, 20 bp, human
gagtgccatgacaaccaccc

SEQ ID NO: 207639 - DNA, 20 bp, human
gaacttgagttagagaggtg

SEQ ID NO: 207640 - DNA, 20 bp, human
gaagcacactagggtctcag

SEQ ID NO: 207641 - DNA, 20 bp, human
gcgggattgtgatgtcactc

SEQ ID NO: 207642 - DNA, 20 bp, human
gactcttggggcggttaagg

SEQ ID NO: 207643 - DNA, 20 bp, human
ggtgacatcacaatcccggg

SEQ ID NO: 207644 - DNA, 20 bp, human
gtagaaatccaagcacacta

SEQ ID NO: 207645 - DNA, 20 bp, human
gagtgcctgccttactggag

SEQ ID NO: 207646 - DNA, 20 bp, human
gtttaccaagcaggcaagaa

SEQ ID NO: 207647 - DNA, 20 bp, human
ggggagccccagcagcgggg

SEQ ID NO: 207648 - DNA, 20 bp, human
gtgccacgtgctcacagagt

SEQ ID NO: 207649 - DNA, 20 bp, human
gcgctggggagccccagcag

SEQ ID NO: 207650 - DNA, 20 bp, human
ggctccccagcgccctctac

SEQ ID NO: 207651 - DNA, 20 bp, human
gaagaagggtgaatgtggag

SEQ ID NO: 207652 - DNA, 20 bp, human
gcccagcatgcctgctggcc

SEQ ID NO: 207653 - DNA, 20 bp, human
ggtgctcacagagtaggctg

SEQ ID NO: 207654 - DNA, 20 bp, human
gctgtgagcacgtggcaagc

SEQ ID NO: 207655 - DNA, 20 bp, human
gggggagttcccaagaatga

SEQ ID NO: 207656 - DNA, 20 bp, human
ggcgctagaagctaatacga

SEQ ID NO: 207657 - DNA, 20 bp, human
gacaatgcagccaagaggat

SEQ ID NO: 207658 - DNA, 20 bp, human
gcgacagaaatgtgttaaga

SEQ ID NO: 207659 - DNA, 20 bp, human
ggggcagggacccatcctct

SEQ ID NO: 207660 - DNA, 20 bp, human
gagaagagatgacagccttt

SEQ ID NO: 207661 - DNA, 20 bp, human
gcccgcaatctatgacgtca

SEQ ID NO: 207662 - DNA, 20 bp, human
gtggattcctagctcccagt

SEQ ID NO: 207663 - DNA, 20 bp, human
gctgagaaacagacttgtgc

SEQ ID NO: 207664 - DNA, 20 bp, human
gttctctgaagagccaaatt

SEQ ID NO: 207665 - DNA, 20 bp, human
ggacagcctttgggcaggca

SEQ ID NO: 207666 - DNA, 20 bp, human
ggggctgcggcgcatatagg

SEQ ID NO: 207667 - DNA, 20 bp, human
gccaatggagagcctcggga

SEQ ID NO: 207668 - DNA, 20 bp, human
gcccaatgagaggcgatggg

SEQ ID NO: 207669 - DNA, 20 bp, human
gggaacgggtccaatcccgg

SEQ ID NO: 207670 - DNA, 20 bp, human
ggcggcgcatataggtggac

SEQ ID NO: 207671 - DNA, 20 bp, human
gcgtgggagcgcaataacgg

SEQ ID NO: 207672 - DNA, 20 bp, human
gaggcgatggggggaagttt

SEQ ID NO: 207673 - DNA, 20 bp, human
gagcccggctgacggatgcc

SEQ ID NO: 207674 - DNA, 20 bp, human
gaattcccaatgagaggcga

SEQ ID NO: 207675 - DNA, 20 bp, human
gctggccaatggagagcctc

SEQ ID NO: 207676 - DNA, 20 bp, human
gagcacgtgcgggcggacaa

SEQ ID NO: 207677 - DNA, 20 bp, human
ggaggcctccgggaacgtga

SEQ ID NO: 207678 - DNA, 20 bp, human
ggcaggcggcctctgggcgg

SEQ ID NO: 207679 - DNA, 20 bp, human
gcgcccgcacgtgctcgggg

SEQ ID NO: 207680 - DNA, 20 bp, human
ggccccgccccgagcacgtg

SEQ ID NO: 207681 - DNA, 20 bp, human
gtccgggaacgtgaggggag

SEQ ID NO: 207682 - DNA, 20 bp, human
ggcggctggggcccgacggg

SEQ ID NO: 207683 - DNA, 20 bp, human
gggtccgtcggtgtcccggg

SEQ ID NO: 207684 - DNA, 20 bp, human
gtcccggaggcctcggcgga

SEQ ID NO: 207685 - DNA, 20 bp, human
gtcggcggaaggcgtgcagg

SEQ ID NO: 207686 - DNA, 20 bp, human
gcggaagcggcctagtcctc

SEQ ID NO: 207687 - DNA, 20 bp, human
gggcgccggggtggatctcg

SEQ ID NO: 207688 - DNA, 20 bp, human
gggcggggctccgacgggat

SEQ ID NO: 207689 - DNA, 20 bp, human
ggaggctcctcccatcccgt

SEQ ID NO: 207690 - DNA, 20 bp, human
gggggcggctgtggggagta

SEQ ID NO: 207691 - DNA, 20 bp, human
gagggctattaatatcgggg

SEQ ID NO: 207692 - DNA, 20 bp, human
gctgtcggagccggaggact

SEQ ID NO: 207693 - DNA, 20 bp, human
gggcccctcccccctgtcca

SEQ ID NO: 207694 - DNA, 20 bp, human
gggctctgagccagctggat

SEQ ID NO: 207695 - DNA, 20 bp, human
gggcctggacacccagctgt

SEQ ID NO: 207696 - DNA, 20 bp, human
ggcccccgggctgagtcggg

SEQ ID NO: 207697 - DNA, 20 bp, human
gcgggctgaagcagctgaag

SEQ ID NO: 207698 - DNA, 20 bp, human
gatcggacctgaaccagctc

SEQ ID NO: 207699 - DNA, 20 bp, human
gacgacgcgcgcgttcacgc

SEQ ID NO: 207700 - DNA, 20 bp, human
gcgcgttcacgccggagagg

SEQ ID NO: 207701 - DNA, 20 bp, human
ggccgcccgactcagcccgg

SEQ ID NO: 207702 - DNA, 20 bp, human
gcaacctcggcgctgtgcgc

SEQ ID NO: 207703 - DNA, 20 bp, human
gctggccgcccgactcagcc

SEQ ID NO: 207704 - DNA, 20 bp, human
gcgtcgttcgcgtatgggcg

SEQ ID NO: 207705 - DNA, 20 bp, human
ggcgcctgcgcacagcgccg

SEQ ID NO: 207706 - DNA, 20 bp, human
gggcgcgaatccgagtgcgg

SEQ ID NO: 207707 - DNA, 20 bp, human
gcccacgcgcggctgtgaag

SEQ ID NO: 207708 - DNA, 20 bp, human
gcgcgccggtcgccctgagg

SEQ ID NO: 207709 - DNA, 20 bp, human
gctgccgtcgccaggactag

SEQ ID NO: 207710 - DNA, 20 bp, human
gactaggggaaaagaggcgc

SEQ ID NO: 207711 - DNA, 20 bp, human
gtgcaagggtgggtccaacg

SEQ ID NO: 207712 - DNA, 20 bp, human
gtccgccccctcagggcgac

SEQ ID NO: 207713 - DNA, 20 bp, human
gaggcgcgccggtcgccctg

SEQ ID NO: 207714 - DNA, 20 bp, human
gccaaagccgcacccacgcg

SEQ ID NO: 207715 - DNA, 20 bp, human
ggctgtgcctcattccgcgt

SEQ ID NO: 207716 - DNA, 20 bp, human
gtctctggctgtttaatcta

SEQ ID NO: 207717 - DNA, 20 bp, human
gcagtctagccgccggttca

SEQ ID NO: 207718 - DNA, 20 bp, human
gggggattgtagttcttcag

SEQ ID NO: 207719 - DNA, 20 bp, human
gttccaatgcgcagtaccct

SEQ ID NO: 207720 - DNA, 20 bp, human
gcctcgccgccctgaaccgg

SEQ ID NO: 207721 - DNA, 20 bp, human
gccaggcgcaaagcttgctg

SEQ ID NO: 207722 - DNA, 20 bp, human
gcgactcccaatcttaaact

SEQ ID NO: 207723 - DNA, 20 bp, human
gagggagaccacaaatccca

SEQ ID NO: 207724 - DNA, 20 bp, human
gaacgtcggggggagtggca

SEQ ID NO: 207725 - DNA, 20 bp, human
gctccctcgccgccctgaac

SEQ ID NO: 207726 - DNA, 20 bp, human
ggccaggtgggagcgatgat

SEQ ID NO: 207727 - DNA, 20 bp, human
ggccccgcggggctttctgg

SEQ ID NO: 207728 - DNA, 20 bp, human
gggcggcagaaagtggagct

SEQ ID NO: 207729 - DNA, 20 bp, human
gggggctggctgcgcgaagg

SEQ ID NO: 207730 - DNA, 20 bp, human
gacctggcccgattgacagc

SEQ ID NO: 207731 - DNA, 20 bp, human
gccgggcacctgctgtcaat

SEQ ID NO: 207732 - DNA, 20 bp, human
ggccaatcatcgctcccacc

SEQ ID NO: 207733 - DNA, 20 bp, human
gagtgtctgggatgatgtca

SEQ ID NO: 207734 - DNA, 20 bp, human
gcgagccccgcggggctttc

SEQ ID NO: 207735 - DNA, 20 bp, human
ggtaggctgcaggctcgggg

SEQ ID NO: 207736 - DNA, 20 bp, human
gaaaagatggaggagcgtcg

SEQ ID NO: 207737 - DNA, 20 bp, human
gcaggcagcgcgactggcag

SEQ ID NO: 207738 - DNA, 20 bp, human
gggtgagctccaataaaaga

SEQ ID NO: 207739 - DNA, 20 bp, human
gagcagcgaagaacccgggt

SEQ ID NO: 207740 - DNA, 20 bp, human
gcggaccccaccattcgaca

SEQ ID NO: 207741 - DNA, 20 bp, human
gcgcagctccgcttccggct

SEQ ID NO: 207742 - DNA, 20 bp, human
gaatgcctgcacgaaaaggg

SEQ ID NO: 207743 - DNA, 20 bp, human
ggcgaccgtgacagccgagc

SEQ ID NO: 207744 - DNA, 20 bp, human
gtagaagcagcgaagaaccc

SEQ ID NO: 207745 - DNA, 20 bp, human
gcgaaaagggtgggacgggc

SEQ ID NO: 207746 - DNA, 20 bp, human
gttggcttcccggggaaagg

SEQ ID NO: 207747 - DNA, 20 bp, human
gcgtgaggggaagaagttgt

SEQ ID NO: 207748 - DNA, 20 bp, human
ggggaagaagttgtagggtg

SEQ ID NO: 207749 - DNA, 20 bp, human
gctcgctagcccctcccgct

SEQ ID NO: 207750 - DNA, 20 bp, human
gtgggctccgatcctgaagt

SEQ ID NO: 207751 - DNA, 20 bp, human
gctagcgagcatgcgcaata

SEQ ID NO: 207752 - DNA, 20 bp, human
gcctcccgctcggagcggaa

SEQ ID NO: 207753 - DNA, 20 bp, human
gtcggcaccggcggccatct

SEQ ID NO: 207754 - DNA, 20 bp, human
gaaggtacgttcgcctgcct

SEQ ID NO: 207755 - DNA, 20 bp, human
gtttccccgggaagccaaga

SEQ ID NO: 207756 - DNA, 20 bp, human
gcagcaaggttggacgtatg

SEQ ID NO: 207757 - DNA, 20 bp, human
gggcgtgcgcgcgttctgat

SEQ ID NO: 207758 - DNA, 20 bp, human
gcttgctgctggagagattg

SEQ ID NO: 207759 - DNA, 20 bp, human
gcgggagcccggatgctcgg

SEQ ID NO: 207760 - DNA, 20 bp, human
gagcactaaagatggcgcgc

SEQ ID NO: 207761 - DNA, 20 bp, human
ggacacgtgacgtcactccc

SEQ ID NO: 207762 - DNA, 20 bp, human
gaagatggcgcgccggagtg

SEQ ID NO: 207763 - DNA, 20 bp, human
gccggtaggggacatagtca

SEQ ID NO: 207764 - DNA, 20 bp, human
gcgttctgattggccgaccg

SEQ ID NO: 207765 - DNA, 20 bp, human
gtcgagcgaagacttacagg

SEQ ID NO: 207766 - DNA, 20 bp, human
gccctcgcgccgaaacacac

SEQ ID NO: 207767 - DNA, 20 bp, human
gccccggggggccacctgct

SEQ ID NO: 207768 - DNA, 20 bp, human
ggggagagatgggtaagggc

SEQ ID NO: 207769 - DNA, 20 bp, human
gtcggcacagagggagagat

SEQ ID NO: 207770 - DNA, 20 bp, human
gccgccgaggttcagggaag

SEQ ID NO: 207771 - DNA, 20 bp, human
gagggcagttctcggcacag

SEQ ID NO: 207772 - DNA, 20 bp, human
gcgccgaaacacactgggag

SEQ ID NO: 207773 - DNA, 20 bp, human
ggggagaggccagaatcttc

SEQ ID NO: 207774 - DNA, 20 bp, human
ggtgtgctggagcaggatca

SEQ ID NO: 207775 - DNA, 20 bp, human
gtccccgcttacctgagggg

SEQ ID NO: 207776 - DNA, 20 bp, human
gaaggggcgtgggcactcat

SEQ ID NO: 207777 - DNA, 20 bp, human
ggcgtcccggctagagtgaa

SEQ ID NO: 207778 - DNA, 20 bp, human
gcgggcttcgagaagggagg

SEQ ID NO: 207779 - DNA, 20 bp, human
ggactcgcctctggctgtca

SEQ ID NO: 207780 - DNA, 20 bp, human
gcgctgagacgtacccattc

SEQ ID NO: 207781 - DNA, 20 bp, human
ggctggccgggcttcgagaa

SEQ ID NO: 207782 - DNA, 20 bp, human
gggggcatcgaggtacttaa

SEQ ID NO: 207783 - DNA, 20 bp, human
gggcgataggctttggggcg

SEQ ID NO: 207784 - DNA, 20 bp, human
gtcgcgcggcgtgacgtcgg

SEQ ID NO: 207785 - DNA, 20 bp, human
gtagccaggacgcaagactg

SEQ ID NO: 207786 - DNA, 20 bp, human
gaaagctcgagcagaggggt

SEQ ID NO: 207787 - DNA, 20 bp, human
gcggaaagggaaaacaacta

SEQ ID NO: 207788 - DNA, 20 bp, human
gccggcgtcctccgttgcta

SEQ ID NO: 207789 - DNA, 20 bp, human
gaacggaggacgccggaagt

SEQ ID NO: 207790 - DNA, 20 bp, human
gacggctgcggtgtggttgg

SEQ ID NO: 207791 - DNA, 20 bp, human
gtcgagcagaggggtcggaa

SEQ ID NO: 207792 - DNA, 20 bp, human
gtaagcagcaccgaatgtta

SEQ ID NO: 207793 - DNA, 20 bp, human
gccgttgctaaggtgaccag

SEQ ID NO: 207794 - DNA, 20 bp, human
gggaaaaagctcgagcagag

SEQ ID NO: 207795 - DNA, 20 bp, human
gaagcacagcccctaacatt

SEQ ID NO: 207796 - DNA, 20 bp, human
ggccgcggagtcgccccaga

SEQ ID NO: 207797 - DNA, 20 bp, human
gcggctgcccacagtcaaga

SEQ ID NO: 207798 - DNA, 20 bp, human
ggccccagagggctccgaaa

SEQ ID NO: 207799 - DNA, 20 bp, human
ggtgtgcatgcggattgatt

SEQ ID NO: 207800 - DNA, 20 bp, human
gtgcatgcggattgattggg

SEQ ID NO: 207801 - DNA, 20 bp, human
gaggagaagagatgcctgtg

SEQ ID NO: 207802 - DNA, 20 bp, human
ggagggctccgaaaaggcgg

SEQ ID NO: 207803 - DNA, 20 bp, human
ggctccgaaaaggcgggggt

SEQ ID NO: 207804 - DNA, 20 bp, human
gccagagggctccgaaaagg

SEQ ID NO: 207805 - DNA, 20 bp, human
gggtggggctgcccggcgca

SEQ ID NO: 207806 - DNA, 20 bp, human
gaccaagtagggagtactat

SEQ ID NO: 207807 - DNA, 20 bp, human
gtagaagcatgtggagaagt

SEQ ID NO: 207808 - DNA, 20 bp, human
gggctggattgtgacataga

SEQ ID NO: 207809 - DNA, 20 bp, human
ggggagtactattggctcag

SEQ ID NO: 207810 - DNA, 20 bp, human
gtcctcagtgagcatcagag

SEQ ID NO: 207811 - DNA, 20 bp, human
gagtgagcatcagaggggcc

SEQ ID NO: 207812 - DNA, 20 bp, human
gttggtcagatacaaagcca

SEQ ID NO: 207813 - DNA, 20 bp, human
ggccaatagtactccctact

SEQ ID NO: 207814 - DNA, 20 bp, human
ggcattcctacagcgactgt

SEQ ID NO: 207815 - DNA, 20 bp, human
gggccattctaataccttct

SEQ ID NO: 207816 - DNA, 20 bp, human
gccctgagctgcaacttctg

SEQ ID NO: 207817 - DNA, 20 bp, human
gcagagaagctggttttcta

SEQ ID NO: 207818 - DNA, 20 bp, human
ggagtcccccatcccccaca

SEQ ID NO: 207819 - DNA, 20 bp, human
gagagagacaagtgcatcct

SEQ ID NO: 207820 - DNA, 20 bp, human
ggcggtgctggacaagcctg

SEQ ID NO: 207821 - DNA, 20 bp, human
gacagccaggactaatggga

SEQ ID NO: 207822 - DNA, 20 bp, human
gacagacagccaggactaat

SEQ ID NO: 207823 - DNA, 20 bp, human
gagacaagtgcatcctaggg

SEQ ID NO: 207824 - DNA, 20 bp, human
gacctcaccctgtgggggat

SEQ ID NO: 207825 - DNA, 20 bp, human
gccctccatcccattagtcc

SEQ ID NO: 207826 - DNA, 20 bp, human
gcccaggcggaaggactcgc

SEQ ID NO: 207827 - DNA, 20 bp, human
gtgcgagaagcaatagcggg

SEQ ID NO: 207828 - DNA, 20 bp, human
gatcccggaatcccagtatc

SEQ ID NO: 207829 - DNA, 20 bp, human
gattgcttctcgcaggaatt

SEQ ID NO: 207830 - DNA, 20 bp, human
gttcctgcgagaagcaatag

SEQ ID NO: 207831 - DNA, 20 bp, human
gaaccagaattccgtggctt

SEQ ID NO: 207832 - DNA, 20 bp, human
gcgcaggcagggggtcggca

SEQ ID NO: 207833 - DNA, 20 bp, human
gaatagcgggcggtaacatg

SEQ ID NO: 207834 - DNA, 20 bp, human
gtccgggattccaggtgttg

SEQ ID NO: 207835 - DNA, 20 bp, human
gaccccaacacctggaatcc

SEQ ID NO: 207836 - DNA, 20 bp, human
gtcccgaggcgcagaggctc

SEQ ID NO: 207837 - DNA, 20 bp, human
gcggggcgggcggaccagct

SEQ ID NO: 207838 - DNA, 20 bp, human
ggcagcctccccctcggcgc

SEQ ID NO: 207839 - DNA, 20 bp, human
gcagctgggcttgcccccgg

SEQ ID NO: 207840 - DNA, 20 bp, human
gtcctcccggcgcggatcca

SEQ ID NO: 207841 - DNA, 20 bp, human
gcaaagagcaggagccggag

SEQ ID NO: 207842 - DNA, 20 bp, human
gcgctcggccaatgagtgtc

SEQ ID NO: 207843 - DNA, 20 bp, human
gctcccccggctctttcccc

SEQ ID NO: 207844 - DNA, 20 bp, human
gagttccccctgcgccgagg

SEQ ID NO: 207845 - DNA, 20 bp, human
ggggagcacgaccgcgggcg

SEQ ID NO: 207846 - DNA, 20 bp, human
gagggaggagactgcacgtt

SEQ ID NO: 207847 - DNA, 20 bp, human
gcgcgggcgcccgccttaaa

SEQ ID NO: 207848 - DNA, 20 bp, human
gcgccgcgcgcgcccccgaa

SEQ ID NO: 207849 - DNA, 20 bp, human
gcacgcctcggccaacttcg

SEQ ID NO: 207850 - DNA, 20 bp, human
gcctgcacgtgcgctcccgg

SEQ ID NO: 207851 - DNA, 20 bp, human
ggggagtgtccctgttaaag

SEQ ID NO: 207852 - DNA, 20 bp, human
gcccgcccacccctttaaca

SEQ ID NO: 207853 - DNA, 20 bp, human
gagtgtccctgttaaagggg

SEQ ID NO: 207854 - DNA, 20 bp, human
ggagactgcacgttcggctc

SEQ ID NO: 207855 - DNA, 20 bp, human
gcgcacgtgcaggcgccggg

SEQ ID NO: 207856 - DNA, 20 bp, human
gcctgagtatctagtcccgg

SEQ ID NO: 207857 - DNA, 20 bp, human
gggcccgggcggctgcgaga

SEQ ID NO: 207858 - DNA, 20 bp, human
gcaggaatggggcttctcac

SEQ ID NO: 207859 - DNA, 20 bp, human
gtctgcgggaggttatagag

SEQ ID NO: 207860 - DNA, 20 bp, human
ggggactagatactcaggaa

SEQ ID NO: 207861 - DNA, 20 bp, human
ggcgaagaaagagggggcgt

SEQ ID NO: 207862 - DNA, 20 bp, human
gagtgagatcgcccagagct

SEQ ID NO: 207863 - DNA, 20 bp, human
gagccccgcgggcttcctac

SEQ ID NO: 207864 - DNA, 20 bp, human
ggcggctgcgagagggcgca

SEQ ID NO: 207865 - DNA, 20 bp, human
ggcaaaggcggccctgtgcc

SEQ ID NO: 207866 - DNA, 20 bp, human
gggagattgtcggggaagcg

SEQ ID NO: 207867 - DNA, 20 bp, human
ggagcgcgaggagattgtcg

SEQ ID NO: 207868 - DNA, 20 bp, human
ggaggaacgctcggcggcag

SEQ ID NO: 207869 - DNA, 20 bp, human
gcgggcgcagcgcgcgtgcc

SEQ ID NO: 207870 - DNA, 20 bp, human
gcgcagcgcgcgtgccgggc

SEQ ID NO: 207871 - DNA, 20 bp, human
gcggggaagcgaggcgggag

SEQ ID NO: 207872 - DNA, 20 bp, human
gaggaagaggaccccgaggt

SEQ ID NO: 207873 - DNA, 20 bp, human
ggggccggaaccggaagttt

SEQ ID NO: 207874 - DNA, 20 bp, human
gtgaggcgacgaagaggcgg

SEQ ID NO: 207875 - DNA, 20 bp, human
gtccggttccggcccgaagc

SEQ ID NO: 207876 - DNA, 20 bp, human
gtagagatccgactttccca

SEQ ID NO: 207877 - DNA, 20 bp, human
gggcgtctgggccagagtcc

SEQ ID NO: 207878 - DNA, 20 bp, human
gtggtccgcgcccccctgag

SEQ ID NO: 207879 - DNA, 20 bp, human
gctcccacagggcgcgggat

SEQ ID NO: 207880 - DNA, 20 bp, human
gtccgcgcccccctgagggg

SEQ ID NO: 207881 - DNA, 20 bp, human
gcggggcgcgcggacggagg

SEQ ID NO: 207882 - DNA, 20 bp, human
gcgcgcgtgcaccaacttgc

SEQ ID NO: 207883 - DNA, 20 bp, human
ggctcccgggcaaagtggtc

SEQ ID NO: 207884 - DNA, 20 bp, human
gccccagagaaacaacaaca

SEQ ID NO: 207885 - DNA, 20 bp, human
gcgcgtcctcccacagggcg

SEQ ID NO: 207886 - DNA, 20 bp, human
gcaggggtatacaggcccag

SEQ ID NO: 207887 - DNA, 20 bp, human
gctaacccaaggccgtcctc

SEQ ID NO: 207888 - DNA, 20 bp, human
gcctgtgctgagtgcggatc

SEQ ID NO: 207889 - DNA, 20 bp, human
gactcagcacaggggtatac

SEQ ID NO: 207890 - DNA, 20 bp, human
ggctgagtgcggatcgggag

SEQ ID NO: 207891 - DNA, 20 bp, human
gagggctcaaaccatcctca

SEQ ID NO: 207892 - DNA, 20 bp, human
gcatcctcagggctaaccca

SEQ ID NO: 207893 - DNA, 20 bp, human
ggacaggaggggacaaatgg

SEQ ID NO: 207894 - DNA, 20 bp, human
ggggaaggggccaccgagga

SEQ ID NO: 207895 - DNA, 20 bp, human
gaggaggcttgcagcaatga

SEQ ID NO: 207896 - DNA, 20 bp, human
gaggaggcgcccttagggga

SEQ ID NO: 207897 - DNA, 20 bp, human
gagctcccggcgcatacctg

SEQ ID NO: 207898 - DNA, 20 bp, human
gtggccgaggccggatgtcg

SEQ ID NO: 207899 - DNA, 20 bp, human
gagggccgtcccggcgccag

SEQ ID NO: 207900 - DNA, 20 bp, human
gtcgctgaggcccgaaccag

SEQ ID NO: 207901 - DNA, 20 bp, human
ggctgcccggggacgggatc

SEQ ID NO: 207902 - DNA, 20 bp, human
gcgggcctcagcgagattac

SEQ ID NO: 207903 - DNA, 20 bp, human
gaaggaggaggcgcccttag

SEQ ID NO: 207904 - DNA, 20 bp, human
ggtggcaggcgtgtcgtgtg

SEQ ID NO: 207905 - DNA, 20 bp, human
gctgaggcccgaaccagagg

SEQ ID NO: 207906 - DNA, 20 bp, human
gccaagggcaacccggatcc

SEQ ID NO: 207907 - DNA, 20 bp, human
gctacccagatccgggatcc

SEQ ID NO: 207908 - DNA, 20 bp, human
gtgtctggctctacgtgccg

SEQ ID NO: 207909 - DNA, 20 bp, human
ggatctctagacttcagcgc

SEQ ID NO: 207910 - DNA, 20 bp, human
gaaagtggactttgccccgt

SEQ ID NO: 207911 - DNA, 20 bp, human
gctggctctacgtgccgtgg

SEQ ID NO: 207912 - DNA, 20 bp, human
gagacagaaaccgaaagcag

SEQ ID NO: 207913 - DNA, 20 bp, human
gcaacagtgggactagtttt

SEQ ID NO: 207914 - DNA, 20 bp, human
gccccgtgggttgactgaaa

SEQ ID NO: 207915 - DNA, 20 bp, human
gggatctgggtagacaacag

SEQ ID NO: 207916 - DNA, 20 bp, human
ggcagcacaagtagcagcgt

SEQ ID NO: 207917 - DNA, 20 bp, human
gcacaagtagcagcgtgggg

SEQ ID NO: 207918 - DNA, 20 bp, human
gccaacgagtccaggtcctg

SEQ ID NO: 207919 - DNA, 20 bp, human
ggggtgggtgggacgggctg

SEQ ID NO: 207920 - DNA, 20 bp, human
gggaacttgcccgcaggacc

SEQ ID NO: 207921 - DNA, 20 bp, human
ggccacggcccaacgagtcc

SEQ ID NO: 207922 - DNA, 20 bp, human
ggccaaaggtcggagtgctg

SEQ ID NO: 207923 - DNA, 20 bp, human
gggcccagcagaaggacgaa

SEQ ID NO: 207924 - DNA, 20 bp, human
gctaagaggtacacccgcag

SEQ ID NO: 207925 - DNA, 20 bp, human
gttaaggaaggtggcccctc

SEQ ID NO: 207926 - DNA, 20 bp, human
gccgaggcgccgtctctgat

SEQ ID NO: 207927 - DNA, 20 bp, human
gccgggcccgcccagaaggt

SEQ ID NO: 207928 - DNA, 20 bp, human
gaaggtgggatttcaggacg

SEQ ID NO: 207929 - DNA, 20 bp, human
ggttgactgagatgcgatga

SEQ ID NO: 207930 - DNA, 20 bp, human
gaacccaaaagctttgggtt

SEQ ID NO: 207931 - DNA, 20 bp, human
gccagctgaccaatcagaga

SEQ ID NO: 207932 - DNA, 20 bp, human
gtccggcaacccaaaagctt

SEQ ID NO: 207933 - DNA, 20 bp, human
gatccccaacccaaagcttt

SEQ ID NO: 207934 - DNA, 20 bp, human
ggcgatgagggctaggtttg

SEQ ID NO: 207935 - DNA, 20 bp, human
ggtcctgaggagcttaattc

SEQ ID NO: 207936 - DNA, 20 bp, human
gcggctgtcggttgatgggg

SEQ ID NO: 207937 - DNA, 20 bp, human
gccctcgccgcgaactcctc

SEQ ID NO: 207938 - DNA, 20 bp, human
ggggcctcaggtacgcagaa

SEQ ID NO: 207939 - DNA, 20 bp, human
gcagaagggcggggagacat

SEQ ID NO: 207940 - DNA, 20 bp, human
gagagcgcctgcgcggctgt

SEQ ID NO: 207941 - DNA, 20 bp, human
gtcctcggggagacgcgcgc

SEQ ID NO: 207942 - DNA, 20 bp, human
gtgcgcggctgtcggttgat

SEQ ID NO: 207943 - DNA, 20 bp, human
gttgatggggaggtcaggtc

SEQ ID NO: 207944 - DNA, 20 bp, human
gcgtctccccgaggagttcg

SEQ ID NO: 207945 - DNA, 20 bp, human
gccacctcctaagggaccga

SEQ ID NO: 207946 - DNA, 20 bp, human
ggcagccggggacgccagga

SEQ ID NO: 207947 - DNA, 20 bp, human
gagtccgggaagagaggcct

SEQ ID NO: 207948 - DNA, 20 bp, human
ggatgaaaggggttggaaat

SEQ ID NO: 207949 - DNA, 20 bp, human
gctgggagcgagggcagccg

SEQ ID NO: 207950 - DNA, 20 bp, human
gcggggtcacgcgtcggaag

SEQ ID NO: 207951 - DNA, 20 bp, human
ggcgcgccggggtcacgcgt

SEQ ID NO: 207952 - DNA, 20 bp, human
gcgcaccccgcgcctgtcac

SEQ ID NO: 207953 - DNA, 20 bp, human
gcaggagggaagaggccgct

SEQ ID NO: 207954 - DNA, 20 bp, human
gaagcggcaaatgagactgc

SEQ ID NO: 207955 - DNA, 20 bp, human
gagcgtccgggaccggtgac

SEQ ID NO: 207956 - DNA, 20 bp, human
gggagcgcgcgcccacaggt

SEQ ID NO: 207957 - DNA, 20 bp, human
gcccacaggtgggtccggtc

SEQ ID NO: 207958 - DNA, 20 bp, human
gccggggcccgccctctcgc

SEQ ID NO: 207959 - DNA, 20 bp, human
gcccgccgacccgaaaacta

SEQ ID NO: 207960 - DNA, 20 bp, human
ggggtccccgcttctagctt

SEQ ID NO: 207961 - DNA, 20 bp, human
gcagcagcgcccagactgca

SEQ ID NO: 207962 - DNA, 20 bp, human
gccgcggggccgtagttttc

SEQ ID NO: 207963 - DNA, 20 bp, human
gaaggcagcgcccagcgagg

SEQ ID NO: 207964 - DNA, 20 bp, human
gcggccacgctcttcttaac

SEQ ID NO: 207965 - DNA, 20 bp, human
ggaggcttgcgatgctcccg

SEQ ID NO: 207966 - DNA, 20 bp, human
ggggcacgggacagtaaggg

SEQ ID NO: 207967 - DNA, 20 bp, human
gggggggcacgggacagtaa

SEQ ID NO: 207968 - DNA, 20 bp, human
gtggacccggtccttgtgtt

SEQ ID NO: 207969 - DNA, 20 bp, human
gccgcgtcttgcgtcaccta

SEQ ID NO: 207970 - DNA, 20 bp, human
gaagagacgccgaccatcgc

SEQ ID NO: 207971 - DNA, 20 bp, human
ggggcagccttcaaccgctc

SEQ ID NO: 207972 - DNA, 20 bp, human
gctccgagacggttagtgat

SEQ ID NO: 207973 - DNA, 20 bp, human
ggagctcggctgcacgacgc

SEQ ID NO: 207974 - DNA, 20 bp, human
gcgacgctggcgcaagcgcg

SEQ ID NO: 207975 - DNA, 20 bp, human
gcgcaagcccgggtcctgca

SEQ ID NO: 207976 - DNA, 20 bp, human
ggccagtctcccaacgacgg

SEQ ID NO: 207977 - DNA, 20 bp, human
gagagccctgagatctgtga

SEQ ID NO: 207978 - DNA, 20 bp, human
gcatccaagccgccgtcgtt

SEQ ID NO: 207979 - DNA, 20 bp, human
gaaggccagtctcccaacga

SEQ ID NO: 207980 - DNA, 20 bp, human
gacggcggcttggatgctta

SEQ ID NO: 207981 - DNA, 20 bp, human
gctgtccatcacagatctca

SEQ ID NO: 207982 - DNA, 20 bp, human
gggccatcgtatggcagggg

SEQ ID NO: 207983 - DNA, 20 bp, human
gggaacttccgtccaggcag

SEQ ID NO: 207984 - DNA, 20 bp, human
gctccacccctgccatacga

SEQ ID NO: 207985 - DNA, 20 bp, human
ggcctggagggaagttccgg

SEQ ID NO: 207986 - DNA, 20 bp, human
ggaggtgtgtgctaaccaag

SEQ ID NO: 207987 - DNA, 20 bp, human
ggcgcaccgctcattcaccg

SEQ ID NO: 207988 - DNA, 20 bp, human
gcaggaatggcagtctgtca

SEQ ID NO: 207989 - DNA, 20 bp, human
gtgcgcggacgtagtagcct

SEQ ID NO: 207990 - DNA, 20 bp, human
gacacctcacggacctcggt

SEQ ID NO: 207991 - DNA, 20 bp, human
ggccagggaacgcttgctga

SEQ ID NO: 207992 - DNA, 20 bp, human
gcccccggagccgtgagcgt

SEQ ID NO: 207993 - DNA, 20 bp, human
gccagtgctaagttcgcttg

SEQ ID NO: 207994 - DNA, 20 bp, human
gccccctaccgaggtccgtg

SEQ ID NO: 207995 - DNA, 20 bp, human
gttaaccgggcctttcgaga

SEQ ID NO: 207996 - DNA, 20 bp, human
gtaggagcgctcccgccccg

SEQ ID NO: 207997 - DNA, 20 bp, human
ggcggcaggcctagcagcac

SEQ ID NO: 207998 - DNA, 20 bp, human
gtgggtgcccgcgcgtcacg

SEQ ID NO: 207999 - DNA, 20 bp, human
gagagaagagggaacgagca

SEQ ID NO: 208000 - DNA, 20 bp, human
gtctgagtttcgaaggaggg

SEQ ID NO: 208001 - DNA, 20 bp, human
ggaggtctgagtttcgaagg

SEQ ID NO: 208002 - DNA, 20 bp, human
gtgacgcgcgggcacccaac

SEQ ID NO: 208003 - DNA, 20 bp, human
gcgcgcccctgaagcgcctg

SEQ ID NO: 208004 - DNA, 20 bp, human
ggccgcttcctgtccgccgg

SEQ ID NO: 208005 - DNA, 20 bp, human
ggagagctgggattgggctt

SEQ ID NO: 208006 - DNA, 20 bp, human
gaggccgcgggataagtacg

SEQ ID NO: 208007 - DNA, 20 bp, human
gaggggacggggtacccccg

SEQ ID NO: 208008 - DNA, 20 bp, human
ggagacttcgaggtgcgagg

SEQ ID NO: 208009 - DNA, 20 bp, human
gcgccgcggcaggacaaaag

SEQ ID NO: 208010 - DNA, 20 bp, human
gagaaggagccgatgggaag

SEQ ID NO: 208011 - DNA, 20 bp, human
gggtacccccggggtcgacc

SEQ ID NO: 208012 - DNA, 20 bp, human
gctcggagatgctcaggcag

SEQ ID NO: 208013 - DNA, 20 bp, human
gcggccgcggccatcccggc

SEQ ID NO: 208014 - DNA, 20 bp, human
gcaaaagaggcgccgccccg

SEQ ID NO: 208015 - DNA, 20 bp, human
gcgccccgccgggatggccg

SEQ ID NO: 208016 - DNA, 20 bp, human
gagggtgggcggctcagacg

SEQ ID NO: 208017 - DNA, 20 bp, human
ggcggctcgctcacccccga

SEQ ID NO: 208018 - DNA, 20 bp, human
gtctgagccgcccaccctcg

SEQ ID NO: 208019 - DNA, 20 bp, human
gctgccaagcgcacatgcgg

SEQ ID NO: 208020 - DNA, 20 bp, human
gagggtcccgccccgagccg

SEQ ID NO: 208021 - DNA, 20 bp, human
gctcgctcacccccgagggt

SEQ ID NO: 208022 - DNA, 20 bp, human
gcggctcagacgtggctcag

SEQ ID NO: 208023 - DNA, 20 bp, human
gcggccacatcatcctgggg

SEQ ID NO: 208024 - DNA, 20 bp, human
gcgctcgggtccccccgcca

SEQ ID NO: 208025 - DNA, 20 bp, human
gcggccctaagcgcccaaag

SEQ ID NO: 208026 - DNA, 20 bp, human
gtgagcagcgcgggcgtagt

SEQ ID NO: 208027 - DNA, 20 bp, human
gaagctactagggaggggtc

SEQ ID NO: 208028 - DNA, 20 bp, human
gagccggtgcccggtccgac

SEQ ID NO: 208029 - DNA, 20 bp, human
ggcagcgcgggcgtagtggg

SEQ ID NO: 208030 - DNA, 20 bp, human
gggaggccgcgaagctacta

SEQ ID NO: 208031 - DNA, 20 bp, human
ggcggggcgggctttgccgg

SEQ ID NO: 208032 - DNA, 20 bp, human
gggagcgaggcgggaaagaa

SEQ ID NO: 208033 - DNA, 20 bp, human
gtccccgcaactgtgcggag

SEQ ID NO: 208034 - DNA, 20 bp, human
ggtgtagagacatgtcgtga

SEQ ID NO: 208035 - DNA, 20 bp, human
gcgcccaagccggtcggacc

SEQ ID NO: 208036 - DNA, 20 bp, human
ggcggggccgaacacggcag

SEQ ID NO: 208037 - DNA, 20 bp, human
ggcccgcggcgcaccggcgt

SEQ ID NO: 208038 - DNA, 20 bp, human
gagccccagctagacgtgac

SEQ ID NO: 208039 - DNA, 20 bp, human
gcccagctagacgtgacggg

SEQ ID NO: 208040 - DNA, 20 bp, human
gacagaggccaggccggact

SEQ ID NO: 208041 - DNA, 20 bp, human
gtgacgggcggggccgaaca

SEQ ID NO: 208042 - DNA, 20 bp, human
ggaacacggcagcggaccag

SEQ ID NO: 208043 - DNA, 20 bp, human
ggcagcggaccagaggcccg

SEQ ID NO: 208044 - DNA, 20 bp, human
gaccacccacagccggaagc

SEQ ID NO: 208045 - DNA, 20 bp, human
gccgcgcggcagccggcttc

SEQ ID NO: 208046 - DNA, 20 bp, human
gcacttccgcagggcgggga

SEQ ID NO: 208047 - DNA, 20 bp, human
gccaccgggcgcctgggcca

SEQ ID NO: 208048 - DNA, 20 bp, human
ggagctgggccacttccgca

SEQ ID NO: 208049 - DNA, 20 bp, human
gtaccccaatgtaactactg

SEQ ID NO: 208050 - DNA, 20 bp, human
ggccctcagtagttacattg

SEQ ID NO: 208051 - DNA, 20 bp, human
gctgggccacttccgcaggg

SEQ ID NO: 208052 - DNA, 20 bp, human
gaaatgccagatgcaagcat

SEQ ID NO: 208053 - DNA, 20 bp, human
ggagctcgcgggcaggctct

SEQ ID NO: 208054 - DNA, 20 bp, human
gagtgaggttttctttagtg

SEQ ID NO: 208055 - DNA, 20 bp, human
gtctccatatcacagtttta

SEQ ID NO: 208056 - DNA, 20 bp, human
gaggagctggcgagactcgg

SEQ ID NO: 208057 - DNA, 20 bp, human
gacaaatccctcctcctggg

SEQ ID NO: 208058 - DNA, 20 bp, human
gggccgccactctcggagac

SEQ ID NO: 208059 - DNA, 20 bp, human
gtgagggagaccgcggggaa

SEQ ID NO: 208060 - DNA, 20 bp, human
gacagtgcgggacagtaaac

SEQ ID NO: 208061 - DNA, 20 bp, human
gaggcggagcgtctcggcag

SEQ ID NO: 208062 - DNA, 20 bp, human
gaggggaggctccagcccgg

SEQ ID NO: 208063 - DNA, 20 bp, human
gtcaggtgagggagaccgcg

SEQ ID NO: 208064 - DNA, 20 bp, human
gggcgagactcgggggagcg

SEQ ID NO: 208065 - DNA, 20 bp, human
gccccgcgggcctccgccag

SEQ ID NO: 208066 - DNA, 20 bp, human
gtgcaggacaagcactccac

SEQ ID NO: 208067 - DNA, 20 bp, human
ggaagcgcgagatgacgccc

SEQ ID NO: 208068 - DNA, 20 bp, human
gtggacgtgatgcctaatta

SEQ ID NO: 208069 - DNA, 20 bp, human
gcttcctgttcctcagctgt

SEQ ID NO: 208070 - DNA, 20 bp, human
gctggaagaggtaggcggct

SEQ ID NO: 208071 - DNA, 20 bp, human
gttcaccatgttgcggaaac

SEQ ID NO: 208072 - DNA, 20 bp, human
gtgttgctgttgccttaatt

SEQ ID NO: 208073 - DNA, 20 bp, human
gatatatataaacacgtatc

SEQ ID NO: 208074 - DNA, 20 bp, human
gcggccacgcagcctggaag

SEQ ID NO: 208075 - DNA, 20 bp, human
ggcttgtcctgcaagagaca

SEQ ID NO: 208076 - DNA, 20 bp, human
gtcaaacagggagcttataa

SEQ ID NO: 208077 - DNA, 20 bp, human
gtcactagtaaaggagacta

SEQ ID NO: 208078 - DNA, 20 bp, human
gattgacccaagtgtgtaag

SEQ ID NO: 208079 - DNA, 20 bp, human
gtgggctctttcactagtaa

SEQ ID NO: 208080 - DNA, 20 bp, human
gaacagggagcttataatgg

SEQ ID NO: 208081 - DNA, 20 bp, human
ggagtacctcaaagactgag

SEQ ID NO: 208082 - DNA, 20 bp, human
gtgaatacatagatacgtca

SEQ ID NO: 208083 - DNA, 20 bp, human
gaggagactaggggatattt

SEQ ID NO: 208084 - DNA, 20 bp, human
gcatagatacgtcaagggaa

SEQ ID NO: 208085 - DNA, 20 bp, human
ggtgcatagacttctcagac

SEQ ID NO: 208086 - DNA, 20 bp, human
gctatgtcccctgacagcac

SEQ ID NO: 208087 - DNA, 20 bp, human
gtcggaagtgagtatagaaa

SEQ ID NO: 208088 - DNA, 20 bp, human
gaatttaatacaattggaat

SEQ ID NO: 208089 - DNA, 20 bp, human
gaagttataaagagagttac

SEQ ID NO: 208090 - DNA, 20 bp, human
gcttccgaatttaatacaat

SEQ ID NO: 208091 - DNA, 20 bp, human
gatgattggtggagaattta

SEQ ID NO: 208092 - DNA, 20 bp, human
ggaatttatggtatagtgtt

SEQ ID NO: 208093 - DNA, 20 bp, human
gatttagctacttagcaaca

SEQ ID NO: 208094 - DNA, 20 bp, human
ggtcaggggacatagactgg

SEQ ID NO: 208095 - DNA, 20 bp, human
ggctgtcaggggacatagac

SEQ ID NO: 208096 - DNA, 20 bp, human
gcgggcgacaagagctcggc

SEQ ID NO: 208097 - DNA, 20 bp, human
gcgcccttgcctgcgcgcgg

SEQ ID NO: 208098 - DNA, 20 bp, human
ggccccccgcgcgcaggcaa

SEQ ID NO: 208099 - DNA, 20 bp, human
gccacctcatcccctggcaa

SEQ ID NO: 208100 - DNA, 20 bp, human
ggtcccgcttgtctccacga

SEQ ID NO: 208101 - DNA, 20 bp, human
gccgcccgagcctttgccag

SEQ ID NO: 208102 - DNA, 20 bp, human
gtgccgtcgtggagacaagc

SEQ ID NO: 208103 - DNA, 20 bp, human
gcgcggggggcgagtgcacc

SEQ ID NO: 208104 - DNA, 20 bp, human
ggagcgagcgagtgctgcat

SEQ ID NO: 208105 - DNA, 20 bp, human
ggagcctttgccaggggatg

SEQ ID NO: 208106 - DNA, 20 bp, human
gagcacccgaagccccgctc

SEQ ID NO: 208107 - DNA, 20 bp, human
ggcagcccaagcagcatcgg

SEQ ID NO: 208108 - DNA, 20 bp, human
ggcagcagcccaagcagcat

SEQ ID NO: 208109 - DNA, 20 bp, human
gactgcgcatgctttgttgg

SEQ ID NO: 208110 - DNA, 20 bp, human
gccgctcgggcgcgctctcg

SEQ ID NO: 208111 - DNA, 20 bp, human
ggcgccgcctcagcatcctc

SEQ ID NO: 208112 - DNA, 20 bp, human
ggggtggtacctcaaaagat

SEQ ID NO: 208113 - DNA, 20 bp, human
ggtcacctccgatgctgctt

SEQ ID NO: 208114 - DNA, 20 bp, human
gcagcatcggaggtgacggg

SEQ ID NO: 208115 - DNA, 20 bp, human
gccagcagcgggtgggactg

SEQ ID NO: 208116 - DNA, 20 bp, human
gtactttggagtggggagta

SEQ ID NO: 208117 - DNA, 20 bp, human
gaatgtactactttggagtg

SEQ ID NO: 208118 - DNA, 20 bp, human
gagataagctacaaggaaag

SEQ ID NO: 208119 - DNA, 20 bp, human
gagccaggacttccgcctgc

SEQ ID NO: 208120 - DNA, 20 bp, human
gaagtaatcttagagccagg

SEQ ID NO: 208121 - DNA, 20 bp, human
gtatagccagataagctaca

SEQ ID NO: 208122 - DNA, 20 bp, human
gagctgtggtcctgcaacaa

SEQ ID NO: 208123 - DNA, 20 bp, human
gctcacacaagtgtactctc

SEQ ID NO: 208124 - DNA, 20 bp, human
gttgcgcaacctcgaagctg

SEQ ID NO: 208125 - DNA, 20 bp, human
gagaatgctatatagtaatt

SEQ ID NO: 208126 - DNA, 20 bp, human
gttacagctaggaaacaaaa

SEQ ID NO: 208127 - DNA, 20 bp, human
gctgggactgaataactatc

SEQ ID NO: 208128 - DNA, 20 bp, human
ggagggcgacagttatgcac

SEQ ID NO: 208129 - DNA, 20 bp, human
gatgtatgacagatgtcaca

SEQ ID NO: 208130 - DNA, 20 bp, human
gggatgtgatgtcacaaagg

SEQ ID NO: 208131 - DNA, 20 bp, human
gtgaataactatcaggtgcc

SEQ ID NO: 208132 - DNA, 20 bp, human
gatgtcccttcattgcataa

SEQ ID NO: 208133 - DNA, 20 bp, human
gagtggatgtgatgtcacaa

SEQ ID NO: 208134 - DNA, 20 bp, human
gcctcaacattttgattgat

SEQ ID NO: 208135 - DNA, 20 bp, human
gagtgtttgaggtttattag

SEQ ID NO: 208136 - DNA, 20 bp, human
gggcacgtgggttggagaga

SEQ ID NO: 208137 - DNA, 20 bp, human
gagagggtagagaacaccat

SEQ ID NO: 208138 - DNA, 20 bp, human
gacaccatcggaaatggaga

SEQ ID NO: 208139 - DNA, 20 bp, human
ggggctgttggcacgtgggt

SEQ ID NO: 208140 - DNA, 20 bp, human
gtagagaacaccatcggaaa

SEQ ID NO: 208141 - DNA, 20 bp, human
gacaaaggagaacgtgttaa

SEQ ID NO: 208142 - DNA, 20 bp, human
ggggccgtaccgttgggcgc

SEQ ID NO: 208143 - DNA, 20 bp, human
gacagtggcccataaaacat

SEQ ID NO: 208144 - DNA, 20 bp, human
ggaagaaaggagggaaacgt

SEQ ID NO: 208145 - DNA, 20 bp, human
gagaggggctgttggcacgt

SEQ ID NO: 208146 - DNA, 20 bp, human
gaccgagagcaccccgtctc

SEQ ID NO: 208147 - DNA, 20 bp, human
gacacaaagcgaaaagttag

SEQ ID NO: 208148 - DNA, 20 bp, human
gggctggggtgcgccgggaa

SEQ ID NO: 208149 - DNA, 20 bp, human
ggggaagtcgggaattgcca

SEQ ID NO: 208150 - DNA, 20 bp, human
gccgctccccgcacgttcat

SEQ ID NO: 208151 - DNA, 20 bp, human
gttagcgtccggaacacgaa

SEQ ID NO: 208152 - DNA, 20 bp, human
gcgagcgcgatctcgacaga

SEQ ID NO: 208153 - DNA, 20 bp, human
gcaaagcgaaaagttagtgg

SEQ ID NO: 208154 - DNA, 20 bp, human
ggatctcgacagagggcgct

SEQ ID NO: 208155 - DNA, 20 bp, human
ggcaattcccgacttcccaa

SEQ ID NO: 208156 - DNA, 20 bp, human
gccggaccgccgcccctcga

SEQ ID NO: 208157 - DNA, 20 bp, human
gaggggcggcggtccgggag

SEQ ID NO: 208158 - DNA, 20 bp, human
gcccgctcggagcctggcca

SEQ ID NO: 208159 - DNA, 20 bp, human
ggccaggctccgagcggggt

SEQ ID NO: 208160 - DNA, 20 bp, human
gcctctgagaccgacgggga

SEQ ID NO: 208161 - DNA, 20 bp, human
gcccccatggcgcgcgccgt

SEQ ID NO: 208162 - DNA, 20 bp, human
gggtgcccccaaggatagga

SEQ ID NO: 208163 - DNA, 20 bp, human
gaggccctctgagaccgacg

SEQ ID NO: 208164 - DNA, 20 bp, human
ggcaggacgggtagcaagga

SEQ ID NO: 208165 - DNA, 20 bp, human
gcccagctccaccccctcga

SEQ ID NO: 208166 - DNA, 20 bp, human
gacaactaccgaggtggtgg

SEQ ID NO: 208167 - DNA, 20 bp, human
gaagacaactaccgaggtgg

SEQ ID NO: 208168 - DNA, 20 bp, human
gaagttgtgtaactccctca

SEQ ID NO: 208169 - DNA, 20 bp, human
gccaatggacagatgtgcaa

SEQ ID NO: 208170 - DNA, 20 bp, human
gggtggtggtgaaggttggc

SEQ ID NO: 208171 - DNA, 20 bp, human
ggggagttacacaacttgct

SEQ ID NO: 208172 - DNA, 20 bp, human
gttaaagacaactaccgagg

SEQ ID NO: 208173 - DNA, 20 bp, human
gacaacttgctaggtgcttg

SEQ ID NO: 208174 - DNA, 20 bp, human
gtaattaaagacaactaccg

SEQ ID NO: 208175 - DNA, 20 bp, human
gggtgcttgaggctaaaacc

SEQ ID NO: 208176 - DNA, 20 bp, human
gccggccagagccccgagag

SEQ ID NO: 208177 - DNA, 20 bp, human
gagggaggatgctggattgt

SEQ ID NO: 208178 - DNA, 20 bp, human
gggcccctcggccggtggga

SEQ ID NO: 208179 - DNA, 20 bp, human
ggcacagcctgtcccaagtc

SEQ ID NO: 208180 - DNA, 20 bp, human
gggcccgcaggcgtccaagt

SEQ ID NO: 208181 - DNA, 20 bp, human
gccggcgccccgcagccaat

SEQ ID NO: 208182 - DNA, 20 bp, human
gggcctctcgaaggacccgg

SEQ ID NO: 208183 - DNA, 20 bp, human
gctctggccggacttgggac

SEQ ID NO: 208184 - DNA, 20 bp, human
gcaccggccgaggggcccat

SEQ ID NO: 208185 - DNA, 20 bp, human
gcggggcgcgcggcacctgg

SEQ ID NO: 208186 - DNA, 20 bp, human
ggccgggcacgcccacctag

SEQ ID NO: 208187 - DNA, 20 bp, human
ggcggggcggatatgactgg

SEQ ID NO: 208188 - DNA, 20 bp, human
gggggcggggcggatatgac

SEQ ID NO: 208189 - DNA, 20 bp, human
ggggagcgagctcggaccga

SEQ ID NO: 208190 - DNA, 20 bp, human
gcgggcggggctacgcggaa

SEQ ID NO: 208191 - DNA, 20 bp, human
gcagtccccggcgcgagaat

SEQ ID NO: 208192 - DNA, 20 bp, human
gaaaaggtcgagcagacggg

SEQ ID NO: 208193 - DNA, 20 bp, human
gtagggaaaaatccagtccc

SEQ ID NO: 208194 - DNA, 20 bp, human
gtccgtcgacccccctaggt

SEQ ID NO: 208195 - DNA, 20 bp, human
ggcccacctaggggggtcga

SEQ ID NO: 208196 - DNA, 20 bp, human
gtcaacttctaaagagaaat

SEQ ID NO: 208197 - DNA, 20 bp, human
ggtgtgaactgagactgagg

SEQ ID NO: 208198 - DNA, 20 bp, human
gcccacttttcgtgtgagat

SEQ ID NO: 208199 - DNA, 20 bp, human
gtctcctaatgagtcaacag

SEQ ID NO: 208200 - DNA, 20 bp, human
gctcattgaggactcacatc

SEQ ID NO: 208201 - DNA, 20 bp, human
gctgcttataggagcaccag

SEQ ID NO: 208202 - DNA, 20 bp, human
gtactgaacaacaatcgtaa

SEQ ID NO: 208203 - DNA, 20 bp, human
gcccaatctcacacgaaaag

SEQ ID NO: 208204 - DNA, 20 bp, human
gcatcccctgttgactcatt

SEQ ID NO: 208205 - DNA, 20 bp, human
gcaatcgtaatggtccagtt

SEQ ID NO: 208206 - DNA, 20 bp, human
gacgccgcccccggctccgt

SEQ ID NO: 208207 - DNA, 20 bp, human
gccactgctcgtcaatctag

SEQ ID NO: 208208 - DNA, 20 bp, human
gtggtccaggaaaccggcga

SEQ ID NO: 208209 - DNA, 20 bp, human
gaaaccgcgctccgcgctgc

SEQ ID NO: 208210 - DNA, 20 bp, human
gagggagaaaagcggtggaa

SEQ ID NO: 208211 - DNA, 20 bp, human
ggtcaatctaggggcggaag

SEQ ID NO: 208212 - DNA, 20 bp, human
gtactgctggggccgctcca

SEQ ID NO: 208213 - DNA, 20 bp, human
ggagccgggggcggcgtctt

SEQ ID NO: 208214 - DNA, 20 bp, human
gggatggaaaagggccaaag

SEQ ID NO: 208215 - DNA, 20 bp, human
gcggcgagggagaaaagcgg

SEQ ID NO: 208216 - DNA, 20 bp, human
ggccccaggggagaagccgc

SEQ ID NO: 208217 - DNA, 20 bp, human
gggaactgtagtggtgccgg

SEQ ID NO: 208218 - DNA, 20 bp, human
ggtggcgaggcgctcgctgg

SEQ ID NO: 208219 - DNA, 20 bp, human
ggccgcgcacgccctcgcag

SEQ ID NO: 208220 - DNA, 20 bp, human
gtggcgcactgcttctactc

SEQ ID NO: 208221 - DNA, 20 bp, human
gtgccggcggcttctcccct

SEQ ID NO: 208222 - DNA, 20 bp, human
gagaacgtggggcgcaaatc

SEQ ID NO: 208223 - DNA, 20 bp, human
ggcctcccccagcaggtaga

SEQ ID NO: 208224 - DNA, 20 bp, human
gtagaagcagtgcgccaggt

SEQ ID NO: 208225 - DNA, 20 bp, human
gggaatcggcagggcgacgt

SEQ ID NO: 208226 - DNA, 20 bp, human
ggcggggcggcccgagttcc

SEQ ID NO: 208227 - DNA, 20 bp, human
gcgcccccgccgcgtgggag

SEQ ID NO: 208228 - DNA, 20 bp, human
ggccagggacccgggaactc

SEQ ID NO: 208229 - DNA, 20 bp, human
gggcggggaggggacgaagc

SEQ ID NO: 208230 - DNA, 20 bp, human
gggcggcggggagaatgggt

SEQ ID NO: 208231 - DNA, 20 bp, human
gaacccccacccacccaatt

SEQ ID NO: 208232 - DNA, 20 bp, human
gctggctggggtccagcccg

SEQ ID NO: 208233 - DNA, 20 bp, human
gagcgggagaaatcgagtgg

SEQ ID NO: 208234 - DNA, 20 bp, human
gcgaagcgggagaaatcgag

SEQ ID NO: 208235 - DNA, 20 bp, human
ggaccagcgcccccgccgcg

SEQ ID NO: 208236 - DNA, 20 bp, human
gaggccgcggggcatgcggg

SEQ ID NO: 208237 - DNA, 20 bp, human
gacagtgtccgctttcggcg

SEQ ID NO: 208238 - DNA, 20 bp, human
gtggccgagccggccaaata

SEQ ID NO: 208239 - DNA, 20 bp, human
gcggccaaataggggagacc

SEQ ID NO: 208240 - DNA, 20 bp, human
gtggaatgggccagagcggg

SEQ ID NO: 208241 - DNA, 20 bp, human
gctttcggcggggtgtggaa

SEQ ID NO: 208242 - DNA, 20 bp, human
gggaggaagatgcaccgagc

SEQ ID NO: 208243 - DNA, 20 bp, human
gccgcctcccgcatgccccg

SEQ ID NO: 208244 - DNA, 20 bp, human
gcagctgggcctggcgttcg

SEQ ID NO: 208245 - DNA, 20 bp, human
gagacccgggagagccgccc

SEQ ID NO: 208246 - DNA, 20 bp, human
gtgcacgcccacccccttag

SEQ ID NO: 208247 - DNA, 20 bp, human
gctaagatggttgcagttca

SEQ ID NO: 208248 - DNA, 20 bp, human
gggagcggggaccccggaga

SEQ ID NO: 208249 - DNA, 20 bp, human
gcaggggccgtggctagggt

SEQ ID NO: 208250 - DNA, 20 bp, human
ggtcccttctccagattaga

SEQ ID NO: 208251 - DNA, 20 bp, human
gggcgcaggcacagagtagg

SEQ ID NO: 208252 - DNA, 20 bp, human
gaggcctaagccatctaatc

SEQ ID NO: 208253 - DNA, 20 bp, human
ggctgtctggtgtgcaggac

SEQ ID NO: 208254 - DNA, 20 bp, human
gtaatctggagaagggacac

SEQ ID NO: 208255 - DNA, 20 bp, human
ggctgggccttgctctaaga

SEQ ID NO: 208256 - DNA, 20 bp, human
gaggccctgcggccaagaaa

SEQ ID NO: 208257 - DNA, 20 bp, human
ggggatcccaggcgtctgag

SEQ ID NO: 208258 - DNA, 20 bp, human
gcgcccgcgcagtgacgctc

SEQ ID NO: 208259 - DNA, 20 bp, human
ggctttgggccaccactccg

SEQ ID NO: 208260 - DNA, 20 bp, human
ggctgcctgcggccggggat

SEQ ID NO: 208261 - DNA, 20 bp, human
ggggctggagtctggaaaat

SEQ ID NO: 208262 - DNA, 20 bp, human
gggtagatccaaggggtcga

SEQ ID NO: 208263 - DNA, 20 bp, human
gacgcctgggatccccggag

SEQ ID NO: 208264 - DNA, 20 bp, human
gccaccactccggggatccc

SEQ ID NO: 208265 - DNA, 20 bp, human
gaggcgtctgaggggacaat

SEQ ID NO: 208266 - DNA, 20 bp, human
gtggctctccgctctggagg

SEQ ID NO: 208267 - DNA, 20 bp, human
ggagagccacttggcgggga

SEQ ID NO: 208268 - DNA, 20 bp, human
gccactccctccccgccaag

SEQ ID NO: 208269 - DNA, 20 bp, human
gagagcggagagccacttgg

SEQ ID NO: 208270 - DNA, 20 bp, human
gcaggggccaccggagaact

SEQ ID NO: 208271 - DNA, 20 bp, human
ggaggcgggaccgagttctc

SEQ ID NO: 208272 - DNA, 20 bp, human
ggcagaagcgagtgaggcgt

SEQ ID NO: 208273 - DNA, 20 bp, human
ggtgggctggcccgagaaac

SEQ ID NO: 208274 - DNA, 20 bp, human
gcaaactgagacttcagcgc

SEQ ID NO: 208275 - DNA, 20 bp, human
gaagtggctctccgctctgg

SEQ ID NO: 208276 - DNA, 20 bp, human
gcccctgtggtcaacctcgt

SEQ ID NO: 208277 - DNA, 20 bp, human
gcggaattccgagaagaatc

SEQ ID NO: 208278 - DNA, 20 bp, human
gtgcctacgaggttgaccac

SEQ ID NO: 208279 - DNA, 20 bp, human
gggacacgtaatcgcccctg

SEQ ID NO: 208280 - DNA, 20 bp, human
gtgatggtgcatgatttcat

SEQ ID NO: 208281 - DNA, 20 bp, human
gactgggtggaaaggtcatg

SEQ ID NO: 208282 - DNA, 20 bp, human
gagcagaggctgagtcattt

SEQ ID NO: 208283 - DNA, 20 bp, human
gaatcatgcaccatcagcgg

SEQ ID NO: 208284 - DNA, 20 bp, human
gtgaggagcatgcccctgag

SEQ ID NO: 208285 - DNA, 20 bp, human
gcacactttgaattcagtat

SEQ ID NO: 208286 - DNA, 20 bp, human
gggaggaggcgaggtcagcg

SEQ ID NO: 208287 - DNA, 20 bp, human
gggtcagcggggcgctgagg

SEQ ID NO: 208288 - DNA, 20 bp, human
gaccgaggaggggagagtgc

SEQ ID NO: 208289 - DNA, 20 bp, human
gcgcgcggggaccacacagt

SEQ ID NO: 208290 - DNA, 20 bp, human
gaggcacggactgcaggccg

SEQ ID NO: 208291 - DNA, 20 bp, human
ggcagagaggcacggactgc

SEQ ID NO: 208292 - DNA, 20 bp, human
gcagcgggcagcgccagagg

SEQ ID NO: 208293 - DNA, 20 bp, human
ggcagggcaggagcgcgcac

SEQ ID NO: 208294 - DNA, 20 bp, human
gtggccgcgcctctgtgccc

SEQ ID NO: 208295 - DNA, 20 bp, human
gcggccagaccgcactccgc

SEQ ID NO: 208296 - DNA, 20 bp, human
ggcggggcggaggaaagcga

SEQ ID NO: 208297 - DNA, 20 bp, human
gcgacccatcccaaccagta

SEQ ID NO: 208298 - DNA, 20 bp, human
gacaacctaactacgcactg

SEQ ID NO: 208299 - DNA, 20 bp, human
gtcccctcggaaggcgggag

SEQ ID NO: 208300 - DNA, 20 bp, human
gcttccctactggttgggat

SEQ ID NO: 208301 - DNA, 20 bp, human
ggaccggagccgtgggaccc

SEQ ID NO: 208302 - DNA, 20 bp, human
gctcctccttccctactggt

SEQ ID NO: 208303 - DNA, 20 bp, human
ggtggcgcgcgggagccgac

SEQ ID NO: 208304 - DNA, 20 bp, human
ggggagccgaccggagccgt

SEQ ID NO: 208305 - DNA, 20 bp, human
gacggcaccaggtggcgcgc

SEQ ID NO: 208306 - DNA, 20 bp, human
gaggctgggtgggagtgata

SEQ ID NO: 208307 - DNA, 20 bp, human
ggggaccgaccgccatgaga

SEQ ID NO: 208308 - DNA, 20 bp, human
gcgggctggtgcaagggcgt

SEQ ID NO: 208309 - DNA, 20 bp, human
gtgcaagggcgtgggattcc

SEQ ID NO: 208310 - DNA, 20 bp, human
gtctgagggagggggcgaag

SEQ ID NO: 208311 - DNA, 20 bp, human
gaccgaccgccatgagaagg

SEQ ID NO: 208312 - DNA, 20 bp, human
ggatgagttcggaagacgaa

SEQ ID NO: 208313 - DNA, 20 bp, human
ggagcccccgggctggtgca

SEQ ID NO: 208314 - DNA, 20 bp, human
ggcgcactgggagatgagtt

SEQ ID NO: 208315 - DNA, 20 bp, human
ggaaaatgagaagtctgcac

SEQ ID NO: 208316 - DNA, 20 bp, human
gaattcgccagggagctcga

SEQ ID NO: 208317 - DNA, 20 bp, human
gagggaatgagtagggagat

SEQ ID NO: 208318 - DNA, 20 bp, human
ggctgtgggtctgtcttgtg

SEQ ID NO: 208319 - DNA, 20 bp, human
ggcgcgggagggaatgagta

SEQ ID NO: 208320 - DNA, 20 bp, human
gacccccgccagggcttcgg

SEQ ID NO: 208321 - DNA, 20 bp, human
gtgcgggtgagagccttcag

SEQ ID NO: 208322 - DNA, 20 bp, human
gaggcagcactcccggctct

SEQ ID NO: 208323 - DNA, 20 bp, human
gtgcacccgcgcggaacggg

SEQ ID NO: 208324 - DNA, 20 bp, human
ggtgcgtcctaaggagcgtg

SEQ ID NO: 208325 - DNA, 20 bp, human
ggggtgcaggcggcgagcct

SEQ ID NO: 208326 - DNA, 20 bp, human
gcggccgcgccaagatgcgc

SEQ ID NO: 208327 - DNA, 20 bp, human
gcgaagagggaagcgggcgg

SEQ ID NO: 208328 - DNA, 20 bp, human
ggagcccggcaccgcggcga

SEQ ID NO: 208329 - DNA, 20 bp, human
gcagagacaccccgaggcgg

SEQ ID NO: 208330 - DNA, 20 bp, human
gggcgacggcggcgcgaaga

SEQ ID NO: 208331 - DNA, 20 bp, human
gcccaggggcacaacctccg

SEQ ID NO: 208332 - DNA, 20 bp, human
gagatgcgccgggtcaccgc

SEQ ID NO: 208333 - DNA, 20 bp, human
gggccggcgccgctcctcgg

SEQ ID NO: 208334 - DNA, 20 bp, human
ggcctcagcctgcggtgacc

SEQ ID NO: 208335 - DNA, 20 bp, human
gaagcagagacaccccgagg

SEQ ID NO: 208336 - DNA, 20 bp, human
ggggtaccgcagtccccttg

SEQ ID NO: 208337 - DNA, 20 bp, human
ggcggctgagtggagaaggg

SEQ ID NO: 208338 - DNA, 20 bp, human
gtggccgggaacagcccata

SEQ ID NO: 208339 - DNA, 20 bp, human
gcgcggggaaaagcgagcag

SEQ ID NO: 208340 - DNA, 20 bp, human
gcttctccactcagccgcaa

SEQ ID NO: 208341 - DNA, 20 bp, human
gcataggggcgggctctccg

SEQ ID NO: 208342 - DNA, 20 bp, human
gcccggctgggcaccaattc

SEQ ID NO: 208343 - DNA, 20 bp, human
gcgggaacagcccatagggg

SEQ ID NO: 208344 - DNA, 20 bp, human
gagcaagtcgcgcgcccact

SEQ ID NO: 208345 - DNA, 20 bp, human
gcgtacgtgaaaggtgccta

SEQ ID NO: 208346 - DNA, 20 bp, human
ggacccgcggggcgctaata

SEQ ID NO: 208347 - DNA, 20 bp, human
gtccgcctagggcgagagga

SEQ ID NO: 208348 - DNA, 20 bp, human
ggcgccccccgcaccgtgtc

SEQ ID NO: 208349 - DNA, 20 bp, human
gttcgggccccgcatgacgt

SEQ ID NO: 208350 - DNA, 20 bp, human
gtcgcagcgcggcagtctgc

SEQ ID NO: 208351 - DNA, 20 bp, human
gcccacctctgcgtgtgcgg

SEQ ID NO: 208352 - DNA, 20 bp, human
gggaggagtgggccgctcgc

SEQ ID NO: 208353 - DNA, 20 bp, human
ggccctaggcggagaaggag

SEQ ID NO: 208354 - DNA, 20 bp, human
ggtggcgcccacgtcatgcg

SEQ ID NO: 208355 - DNA, 20 bp, human
gggggcgctaataaggcgtc

SEQ ID NO: 208356 - DNA, 20 bp, human
ggggctctgtcccaccaaaa

SEQ ID NO: 208357 - DNA, 20 bp, human
gaaaaatgggacttgcccag

SEQ ID NO: 208358 - DNA, 20 bp, human
gcagctgagggctgattgtg

SEQ ID NO: 208359 - DNA, 20 bp, human
gtagcagccgaatggataat

SEQ ID NO: 208360 - DNA, 20 bp, human
gccagtgcctattatccatt

SEQ ID NO: 208361 - DNA, 20 bp, human
gggaatctctagcagccgaa

SEQ ID NO: 208362 - DNA, 20 bp, human
gctgtcggtgggactcagat

SEQ ID NO: 208363 - DNA, 20 bp, human
gctagagattcccctcccct

SEQ ID NO: 208364 - DNA, 20 bp, human
gaaaaggctatgtcatcagc

SEQ ID NO: 208365 - DNA, 20 bp, human
ggtgagcctctgcgattgat

SEQ ID NO: 208366 - DNA, 20 bp, human
gtccgcgcctaatcagatgg

SEQ ID NO: 208367 - DNA, 20 bp, human
gaggagggtgatcgaggaaa

SEQ ID NO: 208368 - DNA, 20 bp, human
gcaaaagaggagggtgatcg

SEQ ID NO: 208369 - DNA, 20 bp, human
gggcgcggactgggaagggt

SEQ ID NO: 208370 - DNA, 20 bp, human
gacccggcgaggtggtagga

SEQ ID NO: 208371 - DNA, 20 bp, human
ggaggaaagggagacgaagt

SEQ ID NO: 208372 - DNA, 20 bp, human
ggaaagggagacgaagtagg

SEQ ID NO: 208373 - DNA, 20 bp, human
gattaggcgcggactgggaa

SEQ ID NO: 208374 - DNA, 20 bp, human
gactgcacgctgcctcttaa

SEQ ID NO: 208375 - DNA, 20 bp, human
ggggaagctctccctttaag

SEQ ID NO: 208376 - DNA, 20 bp, human
gggaggtagaggtacaatcg

SEQ ID NO: 208377 - DNA, 20 bp, human
ggatgtgcctgggctgcgtc

SEQ ID NO: 208378 - DNA, 20 bp, human
gcccctccacgtgacgaccc

SEQ ID NO: 208379 - DNA, 20 bp, human
gtcctgggtcgtcacgtgga

SEQ ID NO: 208380 - DNA, 20 bp, human
gtcgggtgcgcatgtgtcct

SEQ ID NO: 208381 - DNA, 20 bp, human
gcttctgaatggctggtagt

SEQ ID NO: 208382 - DNA, 20 bp, human
gttgtctaagcccttctgaa

SEQ ID NO: 208383 - DNA, 20 bp, human
gaaaagaggcggaatgagat

SEQ ID NO: 208384 - DNA, 20 bp, human
gtgtgtcctgggtcgtcacg

SEQ ID NO: 208385 - DNA, 20 bp, human
gtgcgcacccgacgcagccc

SEQ ID NO: 208386 - DNA, 20 bp, human
gcaggccgtgctcgcctcaa

SEQ ID NO: 208387 - DNA, 20 bp, human
gcgcaggcagcgccccgcaa

SEQ ID NO: 208388 - DNA, 20 bp, human
gacggcctgcggggccgatg

SEQ ID NO: 208389 - DNA, 20 bp, human
gggggggcggacatccgttg

SEQ ID NO: 208390 - DNA, 20 bp, human
ggaggcgagcacggcctgcg

SEQ ID NO: 208391 - DNA, 20 bp, human
gccagcccttgaggcgagca

SEQ ID NO: 208392 - DNA, 20 bp, human
gcctgcggggccgatgaggc

SEQ ID NO: 208393 - DNA, 20 bp, human
ggggcgggggaaggagtccg

SEQ ID NO: 208394 - DNA, 20 bp, human
ggctcgggacaggggggcga

SEQ ID NO: 208395 - DNA, 20 bp, human
gcggccggccccggcctcat

SEQ ID NO: 208396 - DNA, 20 bp, human
gaccccgggaagcaccgagt

SEQ ID NO: 208397 - DNA, 20 bp, human
gatcccaggggaggggaaac

SEQ ID NO: 208398 - DNA, 20 bp, human
gaaagcggttggggtctccc

SEQ ID NO: 208399 - DNA, 20 bp, human
gcctctgcggccaagagtcc

SEQ ID NO: 208400 - DNA, 20 bp, human
gggtcagtccagcatggtag

SEQ ID NO: 208401 - DNA, 20 bp, human
gtgtagttgacacttcaggg

SEQ ID NO: 208402 - DNA, 20 bp, human
gggtccacgcgtagagggaa

SEQ ID NO: 208403 - DNA, 20 bp, human
gacgggtctcgctgcctgat

SEQ ID NO: 208404 - DNA, 20 bp, human
gccgcagaggagaaagcggt

SEQ ID NO: 208405 - DNA, 20 bp, human
ggcatggtaggggttaacgt

SEQ ID NO: 208406 - DNA, 20 bp, human
gaggaaaaagagactcggaa

SEQ ID NO: 208407 - DNA, 20 bp, human
gccgaggaggggacatggtc

SEQ ID NO: 208408 - DNA, 20 bp, human
gcccggtgcacgcctctaag

SEQ ID NO: 208409 - DNA, 20 bp, human
gaggccctgccggctgcaag

SEQ ID NO: 208410 - DNA, 20 bp, human
gggagaaagcgagacgaacg

SEQ ID NO: 208411 - DNA, 20 bp, human
gccggctgcgagtcccgcac

SEQ ID NO: 208412 - DNA, 20 bp, human
gaacagacagggacacggtg

SEQ ID NO: 208413 - DNA, 20 bp, human
gacgcctctaagaggaggag

SEQ ID NO: 208414 - DNA, 20 bp, human
gccgccacctcgctgaagtg

SEQ ID NO: 208415 - DNA, 20 bp, human
gcctcctcggccggcccgtg

SEQ ID NO: 208416 - DNA, 20 bp, human
gacggtgcgagcaaaaaagg

SEQ ID NO: 208417 - DNA, 20 bp, human
gagcaggcagccagccaatc

SEQ ID NO: 208418 - DNA, 20 bp, human
ggtaacggtgcgagcaaaaa

SEQ ID NO: 208419 - DNA, 20 bp, human
gtgattagcaggagcctgat

SEQ ID NO: 208420 - DNA, 20 bp, human
gtcggtcaggaaatgtgaga

SEQ ID NO: 208421 - DNA, 20 bp, human
gctgatggaagctgataggc

SEQ ID NO: 208422 - DNA, 20 bp, human
gggagtgttagcaccagtac

SEQ ID NO: 208423 - DNA, 20 bp, human
gcatgctgaataacaaagcc

SEQ ID NO: 208424 - DNA, 20 bp, human
gacccacccacccctcggtc

SEQ ID NO: 208425 - DNA, 20 bp, human
gagctgaatggaatctctct

SEQ ID NO: 208426 - DNA, 20 bp, human
gttcccgggtccagaactgg

SEQ ID NO: 208427 - DNA, 20 bp, human
ggcagggaggccttcttccc

SEQ ID NO: 208428 - DNA, 20 bp, human
gggcccccagttctggaccc

SEQ ID NO: 208429 - DNA, 20 bp, human
gtggcctgaggttaccgggg

SEQ ID NO: 208430 - DNA, 20 bp, human
gctccctgctcgccgctcct

SEQ ID NO: 208431 - DNA, 20 bp, human
gtccctggggctcctgagaa

SEQ ID NO: 208432 - DNA, 20 bp, human
gttaacccgctctgcgcctc

SEQ ID NO: 208433 - DNA, 20 bp, human
ggaactgggggccacatgtc

SEQ ID NO: 208434 - DNA, 20 bp, human
gctggaggcagaagccggac

SEQ ID NO: 208435 - DNA, 20 bp, human
gcgtctggacacccgacatg

SEQ ID NO: 208436 - DNA, 20 bp, human
gcgcctccagctcaagccga

SEQ ID NO: 208437 - DNA, 20 bp, human
gtgccggcgcgcaggctgac

SEQ ID NO: 208438 - DNA, 20 bp, human
gcgcccgtcagcctgcgcgc

SEQ ID NO: 208439 - DNA, 20 bp, human
ggcgccgtgcacttgccggg

SEQ ID NO: 208440 - DNA, 20 bp, human
ggcaccgcccggcaagtgca

SEQ ID NO: 208441 - DNA, 20 bp, human
gggcgcgccgtgcacttgcc

SEQ ID NO: 208442 - DNA, 20 bp, human
gcgcgcgctccgagcggccc

SEQ ID NO: 208443 - DNA, 20 bp, human
gtgccgggcggtgcaggtgg

SEQ ID NO: 208444 - DNA, 20 bp, human
gcgcaggctgacgggcgcct

SEQ ID NO: 208445 - DNA, 20 bp, human
gcggggtgggtggaggctat

SEQ ID NO: 208446 - DNA, 20 bp, human
gggacttaagcagcccgggc

SEQ ID NO: 208447 - DNA, 20 bp, human
gaggcagaccggccccaccc

SEQ ID NO: 208448 - DNA, 20 bp, human
gtgggtggtcctggcgagtg

SEQ ID NO: 208449 - DNA, 20 bp, human
gcccctcggcggccccgggg

SEQ ID NO: 208450 - DNA, 20 bp, human
gtcagctcacgcagccgtcg

SEQ ID NO: 208451 - DNA, 20 bp, human
gtcgctccaggcgcccctgg

SEQ ID NO: 208452 - DNA, 20 bp, human
gcctcgcagccccactcgcc

SEQ ID NO: 208453 - DNA, 20 bp, human
gcgggtgagcggtgcgaaca

SEQ ID NO: 208454 - DNA, 20 bp, human
gggctggggcgcgtggcggg

SEQ ID NO: 208455 - DNA, 20 bp, human
gagggaagcgccctggacgg

SEQ ID NO: 208456 - DNA, 20 bp, human
gcgcggcgggcgcggatctg

SEQ ID NO: 208457 - DNA, 20 bp, human
gcgggcgcggatctgcggca

SEQ ID NO: 208458 - DNA, 20 bp, human
ggcgcccggaatagcagccc

SEQ ID NO: 208459 - DNA, 20 bp, human
gcgcccaggcccgggtcagg

SEQ ID NO: 208460 - DNA, 20 bp, human
gaatagcagccccggggcag

SEQ ID NO: 208461 - DNA, 20 bp, human
gcgacaccagcctgcggctc

SEQ ID NO: 208462 - DNA, 20 bp, human
gcggtgggagggaccgtccc

SEQ ID NO: 208463 - DNA, 20 bp, human
ggccccggggctgctattcc

SEQ ID NO: 208464 - DNA, 20 bp, human
gggtgtcgggcgcccgggtc

SEQ ID NO: 208465 - DNA, 20 bp, human
gtgccaaggtcacccggacc

SEQ ID NO: 208466 - DNA, 20 bp, human
ggcctcgcgcccaggcaggt

SEQ ID NO: 208467 - DNA, 20 bp, human
gaccgcggcggagacacgag

SEQ ID NO: 208468 - DNA, 20 bp, human
ggggacgctgcgcgcggatg

SEQ ID NO: 208469 - DNA, 20 bp, human
gagcgtgtggcctcctccct

SEQ ID NO: 208470 - DNA, 20 bp, human
gccaggccggccaggttttg

SEQ ID NO: 208471 - DNA, 20 bp, human
ggggcggcccccagcggtgc

SEQ ID NO: 208472 - DNA, 20 bp, human
gcgctcgcctgcaccgctgg

SEQ ID NO: 208473 - DNA, 20 bp, human
ggcggagacacgagcggcgg

SEQ ID NO: 208474 - DNA, 20 bp, human
ggcgcagcgtcccacctgcc

SEQ ID NO: 208475 - DNA, 20 bp, human
ggcggcgggcgatttcccag

SEQ ID NO: 208476 - DNA, 20 bp, human
gctccgccgacgcgcgggga

SEQ ID NO: 208477 - DNA, 20 bp, human
ggggacaggagcacgcaaat

SEQ ID NO: 208478 - DNA, 20 bp, human
ggaggggcggacagtcctga

SEQ ID NO: 208479 - DNA, 20 bp, human
gagacccacagaggttgaat

SEQ ID NO: 208480 - DNA, 20 bp, human
ggtccctccccgcgcgtcgg

SEQ ID NO: 208481 - DNA, 20 bp, human
gccaggcagggtatcacaga

SEQ ID NO: 208482 - DNA, 20 bp, human
gccgagctccgccgacgcgc

SEQ ID NO: 208483 - DNA, 20 bp, human
gagccccgccccgcaccgtc

SEQ ID NO: 208484 - DNA, 20 bp, human
gggactggacctgccgaggg

SEQ ID NO: 208485 - DNA, 20 bp, human
gaggctggaaagattactcc

SEQ ID NO: 208486 - DNA, 20 bp, human
ggaggggttcgacttgtaac

SEQ ID NO: 208487 - DNA, 20 bp, human
gttgcgccacgcttggtttc

SEQ ID NO: 208488 - DNA, 20 bp, human
gccttcccctccggaaagtt

SEQ ID NO: 208489 - DNA, 20 bp, human
gcggaggggaaggctttccg

SEQ ID NO: 208490 - DNA, 20 bp, human
ggccacgcttggtttcaggc

SEQ ID NO: 208491 - DNA, 20 bp, human
ggctgcatgagaactacgga

SEQ ID NO: 208492 - DNA, 20 bp, human
gggaaagtttggccaagagg

SEQ ID NO: 208493 - DNA, 20 bp, human
gttggccaaactttccggag

SEQ ID NO: 208494 - DNA, 20 bp, human
ggtagttctcatgcagcgga

SEQ ID NO: 208495 - DNA, 20 bp, human
gcgcccgtccggtactgttt

SEQ ID NO: 208496 - DNA, 20 bp, human
gcagtggggagtaggtacat

SEQ ID NO: 208497 - DNA, 20 bp, human
gaaggcctgagaagatacgt

SEQ ID NO: 208498 - DNA, 20 bp, human
gcgcagattggtgacatcat

SEQ ID NO: 208499 - DNA, 20 bp, human
gttggcgcgccgggcgtggg

SEQ ID NO: 208500 - DNA, 20 bp, human
gataacgtggttgggccgga

SEQ ID NO: 208501 - DNA, 20 bp, human
gcctagagcgcaaacaaaag

SEQ ID NO: 208502 - DNA, 20 bp, human
gccgctgttttgggtacagt

SEQ ID NO: 208503 - DNA, 20 bp, human
gggagtaggtacatgggttt

SEQ ID NO: 208504 - DNA, 20 bp, human
gagaggcagtggcacaagat

SEQ ID NO: 208505 - DNA, 20 bp, human
gaacacaacgtaaaaaacca

SEQ ID NO: 208506 - DNA, 20 bp, human
ggggcgcccgtgtctgtcgt

SEQ ID NO: 208507 - DNA, 20 bp, human
gccgccgcaggtggtcgtga

SEQ ID NO: 208508 - DNA, 20 bp, human
ggacgggcgcggggccgttg

SEQ ID NO: 208509 - DNA, 20 bp, human
gtggggcgagagcgcgggac

SEQ ID NO: 208510 - DNA, 20 bp, human
gcggctgcccacgacagaca

SEQ ID NO: 208511 - DNA, 20 bp, human
gagaagcaggggtggctcgg

SEQ ID NO: 208512 - DNA, 20 bp, human
gcctccctcacgaccacctg

SEQ ID NO: 208513 - DNA, 20 bp, human
ggggcgcgcgcacgccgagg

SEQ ID NO: 208514 - DNA, 20 bp, human
gggcgcggggccgttggggc

SEQ ID NO: 208515 - DNA, 20 bp, human
gtcgtgggcagccggagctg

SEQ ID NO: 208516 - DNA, 20 bp, human
gaggctgctcccggggaaca

SEQ ID NO: 208517 - DNA, 20 bp, human
gctcccggggaacaaggacg

SEQ ID NO: 208518 - DNA, 20 bp, human
ggtgaagctcccaggaccgg

SEQ ID NO: 208519 - DNA, 20 bp, human
ggcgccgcgtccttgttccc

SEQ ID NO: 208520 - DNA, 20 bp, human
gacgcggcgcgggtgcgtct

SEQ ID NO: 208521 - DNA, 20 bp, human
gcgggagctgagtttgcaag

SEQ ID NO: 208522 - DNA, 20 bp, human
gtgcgtgattggcttcaaag

SEQ ID NO: 208523 - DNA, 20 bp, human
gtgcaaactcagctcccgtt

SEQ ID NO: 208524 - DNA, 20 bp, human
gacggtgaagctcccaggac

SEQ ID NO: 208525 - DNA, 20 bp, human
gggagcttcaccgtccaaac

SEQ ID NO: 208526 - DNA, 20 bp, human
ggggccctgtagtttttccg

SEQ ID NO: 208527 - DNA, 20 bp, human
gtcttagagaggcgtgaaac

SEQ ID NO: 208528 - DNA, 20 bp, human
gaggcgtgaaaccggatgat

SEQ ID NO: 208529 - DNA, 20 bp, human
gttccggggagtcggtgcca

SEQ ID NO: 208530 - DNA, 20 bp, human
ggctgcgggacttgaagcgc

SEQ ID NO: 208531 - DNA, 20 bp, human
gactgcgcgcctctgggagc

SEQ ID NO: 208532 - DNA, 20 bp, human
gacttgaagcgcgggaatct

SEQ ID NO: 208533 - DNA, 20 bp, human
gtctgggagcgggagccgaa

SEQ ID NO: 208534 - DNA, 20 bp, human
ggatgatgggagccgcttgt

SEQ ID NO: 208535 - DNA, 20 bp, human
gactccccggaaaaactaca

SEQ ID NO: 208536 - DNA, 20 bp, human
ggctccggtgacagtctctg

SEQ ID NO: 208537 - DNA, 20 bp, human
gactgtcaccggagcggcaa

SEQ ID NO: 208538 - DNA, 20 bp, human
gtcggaccagtgagcggcgg

SEQ ID NO: 208539 - DNA, 20 bp, human
gttgtcggaccagtgagcgg

SEQ ID NO: 208540 - DNA, 20 bp, human
gggcttgtcggaccagtgag

SEQ ID NO: 208541 - DNA, 20 bp, human
gtgaacggacctgggcttgt

SEQ ID NO: 208542 - DNA, 20 bp, human
gtttccgcagagactgtcac

SEQ ID NO: 208543 - DNA, 20 bp, human
gtaggggtgtgggctgacta

SEQ ID NO: 208544 - DNA, 20 bp, human
gcgctcttgctgggtcatct

SEQ ID NO: 208545 - DNA, 20 bp, human
ggggcccgggaccccgtttc

SEQ ID NO: 208546 - DNA, 20 bp, human
ggacctccgggcggcgggag

SEQ ID NO: 208547 - DNA, 20 bp, human
gtggagccgcggagcacgac

SEQ ID NO: 208548 - DNA, 20 bp, human
gtgagcgcagtgccggagcg

SEQ ID NO: 208549 - DNA, 20 bp, human
ggctccaggcggagacgagg

SEQ ID NO: 208550 - DNA, 20 bp, human
gcgacgggagcgtagttcca

SEQ ID NO: 208551 - DNA, 20 bp, human
gcgctcacatgacctccggg

SEQ ID NO: 208552 - DNA, 20 bp, human
gcgtgctccgcggctccagg

SEQ ID NO: 208553 - DNA, 20 bp, human
gggtcatgtgagcgcagtgc

SEQ ID NO: 208554 - DNA, 20 bp, human
gaacccgggggatctttgga

SEQ ID NO: 208555 - DNA, 20 bp, human
gaaggactacaattgctagt

SEQ ID NO: 208556 - DNA, 20 bp, human
gctacctgctatggcccggg

SEQ ID NO: 208557 - DNA, 20 bp, human
gcgggccatagcaggtaggt

SEQ ID NO: 208558 - DNA, 20 bp, human
ggacaaccctggtgaacagg

SEQ ID NO: 208559 - DNA, 20 bp, human
gagaacacggccgccagcct

SEQ ID NO: 208560 - DNA, 20 bp, human
gtggtcggtcgcctgccttc

SEQ ID NO: 208561 - DNA, 20 bp, human
gtctgggtgggtgtggtaga

SEQ ID NO: 208562 - DNA, 20 bp, human
gcacctgcctggagctatgc

SEQ ID NO: 208563 - DNA, 20 bp, human
gcgtccccccgggccatagc

SEQ ID NO: 208564 - DNA, 20 bp, human
gaggaggccaaggtccgcgc

SEQ ID NO: 208565 - DNA, 20 bp, human
gcgactgccccccaacagca

SEQ ID NO: 208566 - DNA, 20 bp, human
gggggagaagactacagtaa

SEQ ID NO: 208567 - DNA, 20 bp, human
ggtagccaccgccaggcctc

SEQ ID NO: 208568 - DNA, 20 bp, human
gagagctgaatgctttatgt

SEQ ID NO: 208569 - DNA, 20 bp, human
gctacggccaagcggaggta

SEQ ID NO: 208570 - DNA, 20 bp, human
gtggccgtagccctggcaac

SEQ ID NO: 208571 - DNA, 20 bp, human
gccaagcggaggtagggcct

SEQ ID NO: 208572 - DNA, 20 bp, human
gtatgtcggaatcgaccaat

SEQ ID NO: 208573 - DNA, 20 bp, human
gtggcggcacccggttgcca

SEQ ID NO: 208574 - DNA, 20 bp, human
gagggcctcggcactatggg

SEQ ID NO: 208575 - DNA, 20 bp, human
gtcggaatcgaccaatggga

SEQ ID NO: 208576 - DNA, 20 bp, human
ggtggaggcacaggggtctc

SEQ ID NO: 208577 - DNA, 20 bp, human
gtcgccctggcaaagcaaca

SEQ ID NO: 208578 - DNA, 20 bp, human
ggtctcgggcttactccgtc

SEQ ID NO: 208579 - DNA, 20 bp, human
ggatcccgcgggcagtactg

SEQ ID NO: 208580 - DNA, 20 bp, human
gtggccttgttgctttgcca

SEQ ID NO: 208581 - DNA, 20 bp, human
ggcccgcgggatcgcggcgt

SEQ ID NO: 208582 - DNA, 20 bp, human
gtccccacgccgcgatcccg

SEQ ID NO: 208583 - DNA, 20 bp, human
gaagcaacaaggccacctga

SEQ ID NO: 208584 - DNA, 20 bp, human
gactgcgcttagtgaagccg

SEQ ID NO: 208585 - DNA, 20 bp, human
ggatcgcggcgtggggaacc

SEQ ID NO: 208586 - DNA, 20 bp, human
gagggcgggcggagcgtcgg

SEQ ID NO: 208587 - DNA, 20 bp, human
gaggggcgcgggagatggat

SEQ ID NO: 208588 - DNA, 20 bp, human
gagggctgtggtggagcgga

SEQ ID NO: 208589 - DNA, 20 bp, human
gagggcggggcggagcgtgg

SEQ ID NO: 208590 - DNA, 20 bp, human
ggtgcaggtgcagggaaccg

SEQ ID NO: 208591 - DNA, 20 bp, human
ggtcgggggcggagcgtcgg

SEQ ID NO: 208592 - DNA, 20 bp, human
ggagatggatgggacgggtt

SEQ ID NO: 208593 - DNA, 20 bp, human
ggcgcgggagatggatggga

SEQ ID NO: 208594 - DNA, 20 bp, human
gggccagtatgagatcgctg

SEQ ID NO: 208595 - DNA, 20 bp, human
ggcgcccgcgacctgagcga

SEQ ID NO: 208596 - DNA, 20 bp, human
gtagccgggaggtggggaaa

SEQ ID NO: 208597 - DNA, 20 bp, human
gaggagggccctgtccgcta

SEQ ID NO: 208598 - DNA, 20 bp, human
gcggagcaagaggagccaat

SEQ ID NO: 208599 - DNA, 20 bp, human
ggcgcagagcggcattcggc

SEQ ID NO: 208600 - DNA, 20 bp, human
gctcggtcgcgattggctac

SEQ ID NO: 208601 - DNA, 20 bp, human
gcgtgctcggcccgtgctcc

SEQ ID NO: 208602 - DNA, 20 bp, human
gagccaatcgcgaccgagag

SEQ ID NO: 208603 - DNA, 20 bp, human
ggctcctcttgctccgctct

SEQ ID NO: 208604 - DNA, 20 bp, human
gggctacgggccgggagcac

SEQ ID NO: 208605 - DNA, 20 bp, human
gcgaccgagagcggagcaag

SEQ ID NO: 208606 - DNA, 20 bp, human
gacccctcgcgggatttaaa

SEQ ID NO: 208607 - DNA, 20 bp, human
gtaacccttgcgcggcgggg

SEQ ID NO: 208608 - DNA, 20 bp, human
gcccaccggacgtgacggaa

SEQ ID NO: 208609 - DNA, 20 bp, human
gcggccgaagcccgaaccga

SEQ ID NO: 208610 - DNA, 20 bp, human
gcccgccccaccggacgtga

SEQ ID NO: 208611 - DNA, 20 bp, human
ggtgacggaacggaacgaga

SEQ ID NO: 208612 - DNA, 20 bp, human
gtgggaggcggagtcggaca

SEQ ID NO: 208613 - DNA, 20 bp, human
ggggctggagctccgcgggc

SEQ ID NO: 208614 - DNA, 20 bp, human
gagcccgccccgccgcgcaa

SEQ ID NO: 208615 - DNA, 20 bp, human
gccccagccacacccctcgc

SEQ ID NO: 208616 - DNA, 20 bp, human
gggaatgcgcagtgcgccga

SEQ ID NO: 208617 - DNA, 20 bp, human
gcacgtggataatccgggga

SEQ ID NO: 208618 - DNA, 20 bp, human
gataatccggggagggctga

SEQ ID NO: 208619 - DNA, 20 bp, human
ggtcgtgccggcctccgcgg

SEQ ID NO: 208620 - DNA, 20 bp, human
gccaaaaggtaagcctctgg

SEQ ID NO: 208621 - DNA, 20 bp, human
gggaaccctccgctctcagg

SEQ ID NO: 208622 - DNA, 20 bp, human
gcggaggccggcacgactcg

SEQ ID NO: 208623 - DNA, 20 bp, human
ggccacgccccgagtcgtgc

SEQ ID NO: 208624 - DNA, 20 bp, human
gactggaaccctccgctctc

SEQ ID NO: 208625 - DNA, 20 bp, human
ggagacacgccataacagaa

SEQ ID NO: 208626 - DNA, 20 bp, human
gccccgaccgtggtcctcgg

SEQ ID NO: 208627 - DNA, 20 bp, human
ggcgccccgaccgtggtcct

SEQ ID NO: 208628 - DNA, 20 bp, human
gccccgggagccgcgaacct

SEQ ID NO: 208629 - DNA, 20 bp, human
gaacgcaggacgcggagttg

SEQ ID NO: 208630 - DNA, 20 bp, human
gcggtcgccgccgaggacca

SEQ ID NO: 208631 - DNA, 20 bp, human
ggggacaaggaaggtactcg

SEQ ID NO: 208632 - DNA, 20 bp, human
ggccgccgaggaccacggtc

SEQ ID NO: 208633 - DNA, 20 bp, human
gggccctcgcccctacgaga

SEQ ID NO: 208634 - DNA, 20 bp, human
gaccacggtcggggcgcggg

SEQ ID NO: 208635 - DNA, 20 bp, human
gctgtgcgcgcccaggttcg

SEQ ID NO: 208636 - DNA, 20 bp, human
ggacccttgcctcaaatgtg

SEQ ID NO: 208637 - DNA, 20 bp, human
gaggccactcaggttggtgg

SEQ ID NO: 208638 - DNA, 20 bp, human
gctactgtacaaggaaggac

SEQ ID NO: 208639 - DNA, 20 bp, human
ggcctactactgtacaagga

SEQ ID NO: 208640 - DNA, 20 bp, human
gtatccgcacatttgaggca

SEQ ID NO: 208641 - DNA, 20 bp, human
gtgagctactgatgagggtg

SEQ ID NO: 208642 - DNA, 20 bp, human
ggaacaatgagctactgatg

SEQ ID NO: 208643 - DNA, 20 bp, human
gagtggcctactactgtaca

SEQ ID NO: 208644 - DNA, 20 bp, human
gccactcaggttggtggggg

SEQ ID NO: 208645 - DNA, 20 bp, human
gagtagtaggccactcaggt

SEQ ID NO: 208646 - DNA, 20 bp, human
gaccgcccctgcacggaggc

SEQ ID NO: 208647 - DNA, 20 bp, human
gacggcgggggctgtacggt

SEQ ID NO: 208648 - DNA, 20 bp, human
gtgcagccgggccgtcgggt

SEQ ID NO: 208649 - DNA, 20 bp, human
gccacgctgcactcgggata

SEQ ID NO: 208650 - DNA, 20 bp, human
gggggggagtggcgaactga

SEQ ID NO: 208651 - DNA, 20 bp, human
gcgacaccgcccctgcacgg

SEQ ID NO: 208652 - DNA, 20 bp, human
ggcgggggctgtacggtggg

SEQ ID NO: 208653 - DNA, 20 bp, human
gggagggggcgggttccacg

SEQ ID NO: 208654 - DNA, 20 bp, human
gaggccccgcagcccactaa

SEQ ID NO: 208655 - DNA, 20 bp, human
gcgacggcccggctgcaggc

SEQ ID NO: 208656 - DNA, 20 bp, human
gccggaacgcgccgccgaga

SEQ ID NO: 208657 - DNA, 20 bp, human
gttccggagtggggcggcga

SEQ ID NO: 208658 - DNA, 20 bp, human
gcggcggcgcgttccggagt

SEQ ID NO: 208659 - DNA, 20 bp, human
gaccgggcctcctcgctgga

SEQ ID NO: 208660 - DNA, 20 bp, human
gtctcgcccgcgcgggtcct

SEQ ID NO: 208661 - DNA, 20 bp, human
gcgcgcgggcgagaggtgga

SEQ ID NO: 208662 - DNA, 20 bp, human
gggcgcgttccggagtgggg

SEQ ID NO: 208663 - DNA, 20 bp, human
gcagcgaggaggcccggtct

SEQ ID NO: 208664 - DNA, 20 bp, human
gctgcgggcgggcgcgtccc

SEQ ID NO: 208665 - DNA, 20 bp, human
ggcccccgatccggcgcggg

SEQ ID NO: 208666 - DNA, 20 bp, human
gccctgaaggggctgaagcg

SEQ ID NO: 208667 - DNA, 20 bp, human
gggaagggcaatgtggaccc

SEQ ID NO: 208668 - DNA, 20 bp, human
ggaccctgggagagatgcga

SEQ ID NO: 208669 - DNA, 20 bp, human
ggggctggggtggacccaat

SEQ ID NO: 208670 - DNA, 20 bp, human
ggaagcctggcgagaatgta

SEQ ID NO: 208671 - DNA, 20 bp, human
ggaggtgaacgtttggtagt

SEQ ID NO: 208672 - DNA, 20 bp, human
ggggagagatgcgaaggggt

SEQ ID NO: 208673 - DNA, 20 bp, human
ggaccaggggagtccggctt

SEQ ID NO: 208674 - DNA, 20 bp, human
gtgccaaagccggactcccc

SEQ ID NO: 208675 - DNA, 20 bp, human
gccaatgggatgtgtccaaa

SEQ ID NO: 208676 - DNA, 20 bp, human
gcggctcctagtcccaggga

SEQ ID NO: 208677 - DNA, 20 bp, human
gaggcctgaggatgcccgcg

SEQ ID NO: 208678 - DNA, 20 bp, human
gcggtcccgtcaccagacct

SEQ ID NO: 208679 - DNA, 20 bp, human
ggcgccccgcgggcatcctc

SEQ ID NO: 208680 - DNA, 20 bp, human
gcccgcggggcgccgaggct

SEQ ID NO: 208681 - DNA, 20 bp, human
gggaagaccgcgctccaccc

SEQ ID NO: 208682 - DNA, 20 bp, human
gggggcgcagcgagaatttt

SEQ ID NO: 208683 - DNA, 20 bp, human
ggatgcggctcctagtccca

SEQ ID NO: 208684 - DNA, 20 bp, human
ggatgcggagggctctccgg

SEQ ID NO: 208685 - DNA, 20 bp, human
ggcagcgagaattttaggtg

SEQ ID NO: 208686 - DNA, 20 bp, human
gtcggcccccacttctgggg

SEQ ID NO: 208687 - DNA, 20 bp, human
gaactcggcccccacttctg

SEQ ID NO: 208688 - DNA, 20 bp, human
gcctaccccgctgctaggaa

SEQ ID NO: 208689 - DNA, 20 bp, human
gcgcttcctcccccagtcct

SEQ ID NO: 208690 - DNA, 20 bp, human
ggaggggacttctggatccg

SEQ ID NO: 208691 - DNA, 20 bp, human
gtgcgctggacagctcggga

SEQ ID NO: 208692 - DNA, 20 bp, human
ggatcaagaccccgcgggga

SEQ ID NO: 208693 - DNA, 20 bp, human
gcccgcaaacccacccctca

SEQ ID NO: 208694 - DNA, 20 bp, human
gggcgggaatggctaggtgg

SEQ ID NO: 208695 - DNA, 20 bp, human
gcccggactccccgccttaa

SEQ ID NO: 208696 - DNA, 20 bp, human
ggggccctgcacaccccgag

SEQ ID NO: 208697 - DNA, 20 bp, human
gagagcagcactgtggctgg

SEQ ID NO: 208698 - DNA, 20 bp, human
gcccacagcccagcctctcg

SEQ ID NO: 208699 - DNA, 20 bp, human
ggacccaccacttcctgctc

SEQ ID NO: 208700 - DNA, 20 bp, human
gagtcccaggaaggcgcggg

SEQ ID NO: 208701 - DNA, 20 bp, human
gactttgaacagttgtcttg

SEQ ID NO: 208702 - DNA, 20 bp, human
gttggagcccgacagctccc

SEQ ID NO: 208703 - DNA, 20 bp, human
gtcgggctccaatgacttca

SEQ ID NO: 208704 - DNA, 20 bp, human
ggtcttggggcttctaatgg

SEQ ID NO: 208705 - DNA, 20 bp, human
gaggccccccgcgccttcct

SEQ ID NO: 208706 - DNA, 20 bp, human
ggggcgccccgcgacagggt

SEQ ID NO: 208707 - DNA, 20 bp, human
gccccgcgacagggttggag

SEQ ID NO: 208708 - DNA, 20 bp, human
gcagaagcatccctcccgga

SEQ ID NO: 208709 - DNA, 20 bp, human
gcgcgacagggttggagagg

SEQ ID NO: 208710 - DNA, 20 bp, human
gtccccacaccccctccggg

SEQ ID NO: 208711 - DNA, 20 bp, human
gagagtccccacaccccctc

SEQ ID NO: 208712 - DNA, 20 bp, human
gtggcggggcgccccgcgac

SEQ ID NO: 208713 - DNA, 20 bp, human
gctgggggcgggggcaaaga

SEQ ID NO: 208714 - DNA, 20 bp, human
gtggccagaagcatccctcc

SEQ ID NO: 208715 - DNA, 20 bp, human
ggggtcacggtgaggtggcg

SEQ ID NO: 208716 - DNA, 20 bp, human
gcggcccgtgcgcgtgtccg

SEQ ID NO: 208717 - DNA, 20 bp, human
gacagcccgccgcctagaag

SEQ ID NO: 208718 - DNA, 20 bp, human
gcctctgggacgccgaggga

SEQ ID NO: 208719 - DNA, 20 bp, human
gcccagcgcgcgcaccaagg

SEQ ID NO: 208720 - DNA, 20 bp, human
ggggcggcgccgcttctagg

SEQ ID NO: 208721 - DNA, 20 bp, human
gcggcgccgcttctaggcgg

SEQ ID NO: 208722 - DNA, 20 bp, human
gcccgggcggcgccgcttct

SEQ ID NO: 208723 - DNA, 20 bp, human
ggcccggggtcccgaccctg

SEQ ID NO: 208724 - DNA, 20 bp, human
gtggccgctgtccgcgctcc

SEQ ID NO: 208725 - DNA, 20 bp, human
gcccgccttggtgcgcgcgc

SEQ ID NO: 208726 - DNA, 20 bp, human
gtatgagaagtcgatgactc

SEQ ID NO: 208727 - DNA, 20 bp, human
gtagacgcgcagaaccagga

SEQ ID NO: 208728 - DNA, 20 bp, human
ggcgaactgcacagataaat

SEQ ID NO: 208729 - DNA, 20 bp, human
gctcatagccctactgtcaa

SEQ ID NO: 208730 - DNA, 20 bp, human
gctgctcccgctggttcctg

SEQ ID NO: 208731 - DNA, 20 bp, human
gctggctgccgttgacagta

SEQ ID NO: 208732 - DNA, 20 bp, human
gtcacccgtttctcaaggac

SEQ ID NO: 208733 - DNA, 20 bp, human
gtggccgtaagtccacccgg

SEQ ID NO: 208734 - DNA, 20 bp, human
ggtcaacggcagccagactc

SEQ ID NO: 208735 - DNA, 20 bp, human
gaggcagatgttgacaaaga

SEQ ID NO: 208736 - DNA, 20 bp, human
gggcggggttagatcgaggg

SEQ ID NO: 208737 - DNA, 20 bp, human
gaggagacggggatgacagg

SEQ ID NO: 208738 - DNA, 20 bp, human
gcaggccaatgagcgcccgg

SEQ ID NO: 208739 - DNA, 20 bp, human
gctgcggcgggaaatcccag

SEQ ID NO: 208740 - DNA, 20 bp, human
gccagtctgtgctgcgggtg

SEQ ID NO: 208741 - DNA, 20 bp, human
gcgggaaatcccagcggcgg

SEQ ID NO: 208742 - DNA, 20 bp, human
gctgtgctgcgggtggggtc

SEQ ID NO: 208743 - DNA, 20 bp, human
gcagaggagacggggatgac

SEQ ID NO: 208744 - DNA, 20 bp, human
gctccccctgctcacttcac

SEQ ID NO: 208745 - DNA, 20 bp, human
ggggggcggggttagatcga

SEQ ID NO: 208746 - DNA, 20 bp, human
gtggcgggacccatgagggg

SEQ ID NO: 208747 - DNA, 20 bp, human
gcgggaccctgggcctccgc

SEQ ID NO: 208748 - DNA, 20 bp, human
ggattggcgggacccatgag

SEQ ID NO: 208749 - DNA, 20 bp, human
gccccggcggggtcgccccg

SEQ ID NO: 208750 - DNA, 20 bp, human
ggactcgccaggcccgcctc

SEQ ID NO: 208751 - DNA, 20 bp, human
gcaacaacgcgccgtcccat

SEQ ID NO: 208752 - DNA, 20 bp, human
gcaggggacccgcccctcat

SEQ ID NO: 208753 - DNA, 20 bp, human
gcccctgcgggcagggcgat

SEQ ID NO: 208754 - DNA, 20 bp, human
gaaaccgtgtccagcggacc

SEQ ID NO: 208755 - DNA, 20 bp, human
gaggccgcacccaggtcggg

SEQ ID NO: 208756 - DNA, 20 bp, human
ggggcgctgcggggcggtag

SEQ ID NO: 208757 - DNA, 20 bp, human
gtggctaggggggtctgcgg

SEQ ID NO: 208758 - DNA, 20 bp, human
gaggccgctgcggggcggtg

SEQ ID NO: 208759 - DNA, 20 bp, human
gcagcaccgcggccctcggg

SEQ ID NO: 208760 - DNA, 20 bp, human
ggccccccaccgccccgcag

SEQ ID NO: 208761 - DNA, 20 bp, human
gccgggtagtgagtggtgcg

SEQ ID NO: 208762 - DNA, 20 bp, human
gagcaggggagtctgttact

SEQ ID NO: 208763 - DNA, 20 bp, human
gggccctgcgcgctgacaaa

SEQ ID NO: 208764 - DNA, 20 bp, human
gctgacaaaaggccgctgcg

SEQ ID NO: 208765 - DNA, 20 bp, human
gcaccactcactacccggga

SEQ ID NO: 208766 - DNA, 20 bp, human
ggcggggccagaggcgtagg

SEQ ID NO: 208767 - DNA, 20 bp, human
gcggggccagagagagctcg

SEQ ID NO: 208768 - DNA, 20 bp, human
gaggcggggccgggaggctt

SEQ ID NO: 208769 - DNA, 20 bp, human
ggggaccaagggacgctcga

SEQ ID NO: 208770 - DNA, 20 bp, human
gcagaggcgaggtcttgagg

SEQ ID NO: 208771 - DNA, 20 bp, human
gcccgccccgagcgcccctc

SEQ ID NO: 208772 - DNA, 20 bp, human
ggcgggaccaggactcccga

SEQ ID NO: 208773 - DNA, 20 bp, human
gaggcgaggtcttgaggagg

SEQ ID NO: 208774 - DNA, 20 bp, human
ggctgcgaggggcggacctt

SEQ ID NO: 208775 - DNA, 20 bp, human
ggactcccgaggggcgctcg

SEQ ID NO: 208776 - DNA, 20 bp, human
ggggagaaatcgaggttctg

SEQ ID NO: 208777 - DNA, 20 bp, human
gggtgtctggggagaaatcg

SEQ ID NO: 208778 - DNA, 20 bp, human
gccgtggaggaacttggagt

SEQ ID NO: 208779 - DNA, 20 bp, human
gaaatcccacatccccgtgg

SEQ ID NO: 208780 - DNA, 20 bp, human
ggtccagcgcccggagagcg

SEQ ID NO: 208781 - DNA, 20 bp, human
ggggcgggctctgcggcctg

SEQ ID NO: 208782 - DNA, 20 bp, human
gaggttctggggcacgggtt

SEQ ID NO: 208783 - DNA, 20 bp, human
gtctcctggcaacgcagacg

SEQ ID NO: 208784 - DNA, 20 bp, human
ggacacgctgaaattgtcaa

SEQ ID NO: 208785 - DNA, 20 bp, human
gctgaaatcccacatccccg

SEQ ID NO: 208786 - DNA, 20 bp, human
gaccactgtgggactaagag

SEQ ID NO: 208787 - DNA, 20 bp, human
ggggctcagtcaatgctgat

SEQ ID NO: 208788 - DNA, 20 bp, human
gtaaagacctagatcatgtg

SEQ ID NO: 208789 - DNA, 20 bp, human
gctgtcaaatcataaagaag

SEQ ID NO: 208790 - DNA, 20 bp, human
gagtctgtgaataatctaat

SEQ ID NO: 208791 - DNA, 20 bp, human
gtgagccaaacacattcctc

SEQ ID NO: 208792 - DNA, 20 bp, human
gccagttccacacatgatct

SEQ ID NO: 208793 - DNA, 20 bp, human
gtggagcttaatgcagataa

SEQ ID NO: 208794 - DNA, 20 bp, human
ggtgaataatctaatgggtg

SEQ ID NO: 208795 - DNA, 20 bp, human
gccaaacggtgcagttagga

SEQ ID NO: 208796 - DNA, 20 bp, human
gaaggcagaacgacctatgt

SEQ ID NO: 208797 - DNA, 20 bp, human
ggggaataatccagtgggtg

SEQ ID NO: 208798 - DNA, 20 bp, human
gaaaacaggaaaaacgaagt

SEQ ID NO: 208799 - DNA, 20 bp, human
gagtctgggaataatccagt

SEQ ID NO: 208800 - DNA, 20 bp, human
gaattccagaggccgggggg

SEQ ID NO: 208801 - DNA, 20 bp, human
gtaaagacatagatcacgtg

SEQ ID NO: 208802 - DNA, 20 bp, human
gctctgctgtaaagacaaag

SEQ ID NO: 208803 - DNA, 20 bp, human
ggcaactttgaatgcacatg

SEQ ID NO: 208804 - DNA, 20 bp, human
gaggaattccagaggccggg

SEQ ID NO: 208805 - DNA, 20 bp, human
ggtctttaagccacacccac

SEQ ID NO: 208806 - DNA, 20 bp, human
gtatcaaatcataaagaaat

SEQ ID NO: 208807 - DNA, 20 bp, human
gaactctgaatgacccctgt

SEQ ID NO: 208808 - DNA, 20 bp, human
gcacgtgtgtagttggaatt

SEQ ID NO: 208809 - DNA, 20 bp, human
gccaactacacacgtgatct

SEQ ID NO: 208810 - DNA, 20 bp, human
gaattctgaatgaccccaaa

SEQ ID NO: 208811 - DNA, 20 bp, human
gggtttgagagaagagaagc

SEQ ID NO: 208812 - DNA, 20 bp, human
gaatgctgattgttattgag

SEQ ID NO: 208813 - DNA, 20 bp, human
gctcttctctcaaacccaca

SEQ ID NO: 208814 - DNA, 20 bp, human
gagtctgagaagaatacgac

SEQ ID NO: 208815 - DNA, 20 bp, human
gaagtcaaggttttgagtgc

SEQ ID NO: 208816 - DNA, 20 bp, human
gctgtgaattacagcaacaa

SEQ ID NO: 208817 - DNA, 20 bp, human
ggagctcactgggagcaatg

SEQ ID NO: 208818 - DNA, 20 bp, human
gatgtggtaagaggccggca

SEQ ID NO: 208819 - DNA, 20 bp, human
ggtacaaatgatgtggtaag

SEQ ID NO: 208820 - DNA, 20 bp, human
gagttaaatgggcgattctg

SEQ ID NO: 208821 - DNA, 20 bp, human
ggagaattaagcaacatgaa

SEQ ID NO: 208822 - DNA, 20 bp, human
gtccaatagtacaaatgatg

SEQ ID NO: 208823 - DNA, 20 bp, human
ggattctcacatagagtaga

SEQ ID NO: 208824 - DNA, 20 bp, human
gaaaaaatcttggagctcac

SEQ ID NO: 208825 - DNA, 20 bp, human
ggtaaaccactaaatatgca

SEQ ID NO: 208826 - DNA, 20 bp, human
gctcgccggcgagtgcaccc

SEQ ID NO: 208827 - DNA, 20 bp, human
ggcaatggctccaaccggaa

SEQ ID NO: 208828 - DNA, 20 bp, human
gaagggcggtgctcgagctg

SEQ ID NO: 208829 - DNA, 20 bp, human
gccgctaagttgtgcgttcc

SEQ ID NO: 208830 - DNA, 20 bp, human
gcgcgcagcgacggaggcat

SEQ ID NO: 208831 - DNA, 20 bp, human
gcgagcaccgcccttccggt

SEQ ID NO: 208832 - DNA, 20 bp, human
ggcgtggggggggcttgcaa

SEQ ID NO: 208833 - DNA, 20 bp, human
gcgttccagggtgcactcgc

SEQ ID NO: 208834 - DNA, 20 bp, human
ggggaggaagcattcgccag

SEQ ID NO: 208835 - DNA, 20 bp, human
gggcgagcgcctagcgaggg

SEQ ID NO: 208836 - DNA, 20 bp, human
gcaaaaaaatggataataag

SEQ ID NO: 208837 - DNA, 20 bp, human
ggaggggacctgtttgatta

SEQ ID NO: 208838 - DNA, 20 bp, human
gctcagtgaaagagcacaaa

SEQ ID NO: 208839 - DNA, 20 bp, human
gtgcagagctggttactcag

SEQ ID NO: 208840 - DNA, 20 bp, human
gaggctctcccgctgcttga

SEQ ID NO: 208841 - DNA, 20 bp, human
ggggccttgggtcaagaccc

SEQ ID NO: 208842 - DNA, 20 bp, human
gggccccttgttgacagata

SEQ ID NO: 208843 - DNA, 20 bp, human
gtcaagagctcctcactctt

SEQ ID NO: 208844 - DNA, 20 bp, human
gcacacacggagattttcta

SEQ ID NO: 208845 - DNA, 20 bp, human
ggggcctaccaacttggatt

SEQ ID NO: 208846 - DNA, 20 bp, human
gtatgatcaaaccaagagga

SEQ ID NO: 208847 - DNA, 20 bp, human
gagttggtctgcaaagggta

SEQ ID NO: 208848 - DNA, 20 bp, human
ggaccattgcaaagttgtga

SEQ ID NO: 208849 - DNA, 20 bp, human
ggcaacagtaggtcaagttt

SEQ ID NO: 208850 - DNA, 20 bp, human
gaagctgctttgcctaggca

SEQ ID NO: 208851 - DNA, 20 bp, human
gagccgtcacaactttgcaa

SEQ ID NO: 208852 - DNA, 20 bp, human
gctactatgatcaaaccaag

SEQ ID NO: 208853 - DNA, 20 bp, human
gtatatccttcaaaataagg

SEQ ID NO: 208854 - DNA, 20 bp, human
gctgtgagtcatattgctga

SEQ ID NO: 208855 - DNA, 20 bp, human
gcctatccaccttattttga

SEQ ID NO: 208856 - DNA, 20 bp, human
gcctcaagccagtcgggctc

SEQ ID NO: 208857 - DNA, 20 bp, human
gcctgcccacccgcttcgcg

SEQ ID NO: 208858 - DNA, 20 bp, human
ggctcagggccattttccca

SEQ ID NO: 208859 - DNA, 20 bp, human
ggatggtgcgagcgccgctg

SEQ ID NO: 208860 - DNA, 20 bp, human
gtctacggcaatttcaaggg

SEQ ID NO: 208861 - DNA, 20 bp, human
ggttctggttcttactccgt

SEQ ID NO: 208862 - DNA, 20 bp, human
gacaggtgaccccgcgaagc

SEQ ID NO: 208863 - DNA, 20 bp, human
ggtgaccccgcgaagcgggt

SEQ ID NO: 208864 - DNA, 20 bp, human
gtggcacagccaagccctcc

SEQ ID NO: 208865 - DNA, 20 bp, human
ggtaactgctccgtaggcct

SEQ ID NO: 208866 - DNA, 20 bp, human
ggggcctcaggcaggtccga

SEQ ID NO: 208867 - DNA, 20 bp, human
ggcccggcgcgtctggcgaa

SEQ ID NO: 208868 - DNA, 20 bp, human
ggcaccctcggacctgcctg

SEQ ID NO: 208869 - DNA, 20 bp, human
gggcaggtgaagctcaccgt

SEQ ID NO: 208870 - DNA, 20 bp, human
gtccgagggtgcccaggaca

SEQ ID NO: 208871 - DNA, 20 bp, human
gaaggcacgtgcgatgccta

SEQ ID NO: 208872 - DNA, 20 bp, human
gaccctgtcctgggcaccct

SEQ ID NO: 208873 - DNA, 20 bp, human
ggggaggcgtggacgcgcat

SEQ ID NO: 208874 - DNA, 20 bp, human
gttcacctgcccggcgcgtc

SEQ ID NO: 208875 - DNA, 20 bp, human
gcccacggctccgctgtttt

SEQ ID NO: 208876 - DNA, 20 bp, human
gcatgcaggggacactttga

SEQ ID NO: 208877 - DNA, 20 bp, human
gtcacagcttagtcacagtt

SEQ ID NO: 208878 - DNA, 20 bp, human
gcaggcctgcctggaaacct

SEQ ID NO: 208879 - DNA, 20 bp, human
gttacaagaaaaagggtcag

SEQ ID NO: 208880 - DNA, 20 bp, human
gctgccccatgggacctggc

SEQ ID NO: 208881 - DNA, 20 bp, human
ggagagctgttctggatgaa

SEQ ID NO: 208882 - DNA, 20 bp, human
ggacccagctggctcctgga

SEQ ID NO: 208883 - DNA, 20 bp, human
gccccaccaagtgtggacgt

SEQ ID NO: 208884 - DNA, 20 bp, human
gtgcccacgtccacacttgg

SEQ ID NO: 208885 - DNA, 20 bp, human
gtctcagtccagtagctatt

SEQ ID NO: 208886 - DNA, 20 bp, human
gtggcttccgaagcccaagc

SEQ ID NO: 208887 - DNA, 20 bp, human
gaggctgtgggcaactgcca

SEQ ID NO: 208888 - DNA, 20 bp, human
ggcccaagctgggttgtacc

SEQ ID NO: 208889 - DNA, 20 bp, human
gacctggtacaacccagctt

SEQ ID NO: 208890 - DNA, 20 bp, human
gagtaccaggctgttgaggc

SEQ ID NO: 208891 - DNA, 20 bp, human
gtcaacagcctggtactcac

SEQ ID NO: 208892 - DNA, 20 bp, human
gggttgtaccaggttcccta

SEQ ID NO: 208893 - DNA, 20 bp, human
gtcaaagcacttgtgtttcc

SEQ ID NO: 208894 - DNA, 20 bp, human
gcttctgttgctgttgtagg

SEQ ID NO: 208895 - DNA, 20 bp, human
gtacaacagcaacagaagat

SEQ ID NO: 208896 - DNA, 20 bp, human
gggactccgcgagagggcct

SEQ ID NO: 208897 - DNA, 20 bp, human
gagcccgcgaggaggtgacg

SEQ ID NO: 208898 - DNA, 20 bp, human
gcagggaaggcggggcagca

SEQ ID NO: 208899 - DNA, 20 bp, human
gtcaggctgcgataacgagg

SEQ ID NO: 208900 - DNA, 20 bp, human
gcggggtagaggacgttcgt

SEQ ID NO: 208901 - DNA, 20 bp, human
gtccacccgccccggggtag

SEQ ID NO: 208902 - DNA, 20 bp, human
gaggtaacctccacccgccc

SEQ ID NO: 208903 - DNA, 20 bp, human
gctggctgcggcggggaggt

SEQ ID NO: 208904 - DNA, 20 bp, human
gggacagaggagatgagata

SEQ ID NO: 208905 - DNA, 20 bp, human
gctcgcggagtcccaatcac

SEQ ID NO: 208906 - DNA, 20 bp, human
gcagccgcgctgtcctaaac

SEQ ID NO: 208907 - DNA, 20 bp, human
gcatcgtgggagctgtggtt

SEQ ID NO: 208908 - DNA, 20 bp, human
gtaaaacctgggtgcatcgt

SEQ ID NO: 208909 - DNA, 20 bp, human
gcggtcagaggggcggcttc

SEQ ID NO: 208910 - DNA, 20 bp, human
gaaaactatactgggtgttg

SEQ ID NO: 208911 - DNA, 20 bp, human
gtatactgggtgttgagggc

SEQ ID NO: 208912 - DNA, 20 bp, human
gtttagagcggtcagagggg

SEQ ID NO: 208913 - DNA, 20 bp, human
gtctgaccgctctaaaacct

SEQ ID NO: 208914 - DNA, 20 bp, human
ggcacggcgtgtggtcttat

SEQ ID NO: 208915 - DNA, 20 bp, human
gtgacgcgcatcgcacgagg

SEQ ID NO: 208916 - DNA, 20 bp, human
gtcccaccgcggcccgtctt

SEQ ID NO: 208917 - DNA, 20 bp, human
gccctgctccagagtccgca

SEQ ID NO: 208918 - DNA, 20 bp, human
gcgaagaggtgccaggacag

SEQ ID NO: 208919 - DNA, 20 bp, human
ggacgggccgcggtgggaaa

SEQ ID NO: 208920 - DNA, 20 bp, human
gtgacccagcgctcacgccc

SEQ ID NO: 208921 - DNA, 20 bp, human
ggcagggcccggccactccc

SEQ ID NO: 208922 - DNA, 20 bp, human
gggctggcctgccccgcgta

SEQ ID NO: 208923 - DNA, 20 bp, human
ggaaaggggcagaccgaacc

SEQ ID NO: 208924 - DNA, 20 bp, human
gtcacgcccaggatcagaaa

SEQ ID NO: 208925 - DNA, 20 bp, human
gctgccccgcgtaggggaga

SEQ ID NO: 208926 - DNA, 20 bp, human
gcggtggcccacggcgtctg

SEQ ID NO: 208927 - DNA, 20 bp, human
ggggctagcgagatgactag

SEQ ID NO: 208928 - DNA, 20 bp, human
gggcgctccgccccgtgcga

SEQ ID NO: 208929 - DNA, 20 bp, human
gagcttgccgaggtagacag

SEQ ID NO: 208930 - DNA, 20 bp, human
gtgagctggcacgagacacg

SEQ ID NO: 208931 - DNA, 20 bp, human
gcctgtaaactgcggggtga

SEQ ID NO: 208932 - DNA, 20 bp, human
ggcccggcgtgctgattgga

SEQ ID NO: 208933 - DNA, 20 bp, human
gcccgcgcgcggggtgtgtg

SEQ ID NO: 208934 - DNA, 20 bp, human
ggatcgtccccagacgccgt

SEQ ID NO: 208935 - DNA, 20 bp, human
gtctcgccctgtaaactgcg

SEQ ID NO: 208936 - DNA, 20 bp, human
gagggaccccagactgcgtt

SEQ ID NO: 208937 - DNA, 20 bp, human
ggtctggggtccctcatggt

SEQ ID NO: 208938 - DNA, 20 bp, human
gtgctgcctaacgcagtctg

SEQ ID NO: 208939 - DNA, 20 bp, human
ggatgacagcggcacagaat

SEQ ID NO: 208940 - DNA, 20 bp, human
ggcacagaatgggcggagtc

SEQ ID NO: 208941 - DNA, 20 bp, human
gtgggcggggcattcgctgt

SEQ ID NO: 208942 - DNA, 20 bp, human
gagaggaaagacgtctcttg

SEQ ID NO: 208943 - DNA, 20 bp, human
gcctcatggtaggggaggcg

SEQ ID NO: 208944 - DNA, 20 bp, human
ggcggggtcaggaatgggcg

SEQ ID NO: 208945 - DNA, 20 bp, human
gatgaccgcctgaatctaga

SEQ ID NO: 208946 - DNA, 20 bp, human
gtgcccagagggcttaggta

SEQ ID NO: 208947 - DNA, 20 bp, human
gagcccatacctaagccctc

SEQ ID NO: 208948 - DNA, 20 bp, human
ggaggtccctcgtgcccaga

SEQ ID NO: 208949 - DNA, 20 bp, human
gaccctgcgggttaagaggt

SEQ ID NO: 208950 - DNA, 20 bp, human
gcctaagccctctgggcacg

SEQ ID NO: 208951 - DNA, 20 bp, human
ggccgcatgggtcctggata

SEQ ID NO: 208952 - DNA, 20 bp, human
gtagtggcgccccttcgctc

SEQ ID NO: 208953 - DNA, 20 bp, human
gcgcgcgcattgcttccttt

SEQ ID NO: 208954 - DNA, 20 bp, human
gaccccagactcccgcggag

SEQ ID NO: 208955 - DNA, 20 bp, human
gaatgcgcgcgtccgagagc

SEQ ID NO: 208956 - DNA, 20 bp, human
gccagaaggcgcttggagtg

SEQ ID NO: 208957 - DNA, 20 bp, human
gcggcgaagggagcggtgga

SEQ ID NO: 208958 - DNA, 20 bp, human
gagcgctcggcgaccggccc

SEQ ID NO: 208959 - DNA, 20 bp, human
ggggctgcgtccccaccaga

SEQ ID NO: 208960 - DNA, 20 bp, human
gtggaggggcctgtccccgc

SEQ ID NO: 208961 - DNA, 20 bp, human
ggcaccgcgtcagaggagag

SEQ ID NO: 208962 - DNA, 20 bp, human
gcgagctgatcccacggctg

SEQ ID NO: 208963 - DNA, 20 bp, human
gggcccagccaccctcgggg

SEQ ID NO: 208964 - DNA, 20 bp, human
gaaggcgcttggagtgaggc

SEQ ID NO: 208965 - DNA, 20 bp, human
ggctgcagcggggttctggg

SEQ ID NO: 208966 - DNA, 20 bp, human
gcctcagcgcatccggtagt

SEQ ID NO: 208967 - DNA, 20 bp, human
gagggtgggaccagcagttg

SEQ ID NO: 208968 - DNA, 20 bp, human
gcagctggcccttgaagtcc

SEQ ID NO: 208969 - DNA, 20 bp, human
gcccttgaagtccaggtcga

SEQ ID NO: 208970 - DNA, 20 bp, human
gcagcgcatccggtagtcgg

SEQ ID NO: 208971 - DNA, 20 bp, human
gagggtcagggcagctgcta

SEQ ID NO: 208972 - DNA, 20 bp, human
gcccctaaaacccccttctg

SEQ ID NO: 208973 - DNA, 20 bp, human
gcatgagggcggaacccacc

SEQ ID NO: 208974 - DNA, 20 bp, human
gctctccctgcagcgggacc

SEQ ID NO: 208975 - DNA, 20 bp, human
gaagcccactagactcactc

SEQ ID NO: 208976 - DNA, 20 bp, human
ggcgcctcctagtgggtcaa

SEQ ID NO: 208977 - DNA, 20 bp, human
gtgtccagctaaataggggg

SEQ ID NO: 208978 - DNA, 20 bp, human
ggcactgcggccattatccg

SEQ ID NO: 208979 - DNA, 20 bp, human
ggggagctctcgcgagaacc

SEQ ID NO: 208980 - DNA, 20 bp, human
gaaccccccctggggaaaag

SEQ ID NO: 208981 - DNA, 20 bp, human
gcctgccctagccaaaatgg

SEQ ID NO: 208982 - DNA, 20 bp, human
ggtaagaggaaccccccctg

SEQ ID NO: 208983 - DNA, 20 bp, human
ggaaaagttaggtgcaagca

SEQ ID NO: 208984 - DNA, 20 bp, human
ggacccactaggaggcgccg

SEQ ID NO: 208985 - DNA, 20 bp, human
gtcggccgccattttggcta

SEQ ID NO: 208986 - DNA, 20 bp, human
gcccctgcctaaagctggac

SEQ ID NO: 208987 - DNA, 20 bp, human
gatgacgtcactaaaggggt

SEQ ID NO: 208988 - DNA, 20 bp, human
gggcccctggcacttcccac

SEQ ID NO: 208989 - DNA, 20 bp, human
ggggcctgtgggaagtgcca

SEQ ID NO: 208990 - DNA, 20 bp, human
gggcaatgacgtcactaaag

SEQ ID NO: 208991 - DNA, 20 bp, human
gtttaggcaggggccccggg

SEQ ID NO: 208992 - DNA, 20 bp, human
ggagtcagggggtccaacag

SEQ ID NO: 208993 - DNA, 20 bp, human
gtggcctcaggaagtgacgt

SEQ ID NO: 208994 - DNA, 20 bp, human
gaagcacactctgctctcat

SEQ ID NO: 208995 - DNA, 20 bp, human
ggggacaagtgtgccatgat

SEQ ID NO: 208996 - DNA, 20 bp, human
gggcgcccggccaccgtcgt

SEQ ID NO: 208997 - DNA, 20 bp, human
gcggcccgcacctacgacgg

SEQ ID NO: 208998 - DNA, 20 bp, human
gtaggtgcgggccgcatgaa

SEQ ID NO: 208999 - DNA, 20 bp, human
gatgcggcccgcacctacga

SEQ ID NO: 209000 - DNA, 20 bp, human
gtgctcccggagcgtgagtg

SEQ ID NO: 209001 - DNA, 20 bp, human
ggcccggcgctccattcatg

SEQ ID NO: 209002 - DNA, 20 bp, human
gggaccctgcggagcatgcc

SEQ ID NO: 209003 - DNA, 20 bp, human
ggccgggagttgtagtcaag

SEQ ID NO: 209004 - DNA, 20 bp, human
gaggccgctacgaggagcta

SEQ ID NO: 209005 - DNA, 20 bp, human
gctggcccccggagtagtgg

SEQ ID NO: 209006 - DNA, 20 bp, human
gggactggggtggcagacgt

SEQ ID NO: 209007 - DNA, 20 bp, human
ggggtggcagacgtgggtct

SEQ ID NO: 209008 - DNA, 20 bp, human
gtgcgggcacgctggggaat

SEQ ID NO: 209009 - DNA, 20 bp, human
ggcaccagacgggtctcaag

SEQ ID NO: 209010 - DNA, 20 bp, human
gagagcctgcaaaacaatat

SEQ ID NO: 209011 - DNA, 20 bp, human
ggtcgctggaggccagacca

SEQ ID NO: 209012 - DNA, 20 bp, human
gagacgggtctcaagtgggt

SEQ ID NO: 209013 - DNA, 20 bp, human
gacccctggggctccccaat

SEQ ID NO: 209014 - DNA, 20 bp, human
gagagctggaacgggaccag

SEQ ID NO: 209015 - DNA, 20 bp, human
gccagtcccaggtgcgaaac

SEQ ID NO: 209016 - DNA, 20 bp, human
gccgctgcgcggagaaaccg

SEQ ID NO: 209017 - DNA, 20 bp, human
ggcccgcaggcgatcctgga

SEQ ID NO: 209018 - DNA, 20 bp, human
ggggcccggagcgctccaag

SEQ ID NO: 209019 - DNA, 20 bp, human
gcccccagcgcgctcctccc

SEQ ID NO: 209020 - DNA, 20 bp, human
ggagaaaccgaggccggagg

SEQ ID NO: 209021 - DNA, 20 bp, human
gggcccgaggactcctggaa

SEQ ID NO: 209022 - DNA, 20 bp, human
gtcgcggcctcgtcctgaca

SEQ ID NO: 209023 - DNA, 20 bp, human
gtgcgcggagaaaccgaggc

SEQ ID NO: 209024 - DNA, 20 bp, human
gggagggggacccgaggcat

SEQ ID NO: 209025 - DNA, 20 bp, human
gtgtggcgctgaggaagcgg

SEQ ID NO: 209026 - DNA, 20 bp, human
gcgggcgcgaactttgggct

SEQ ID NO: 209027 - DNA, 20 bp, human
gggccccgacccgtgggtcc

SEQ ID NO: 209028 - DNA, 20 bp, human
gcagccgcgtgagacccgcc

SEQ ID NO: 209029 - DNA, 20 bp, human
gcgcccgcccgtctcgggct

SEQ ID NO: 209030 - DNA, 20 bp, human
ggcccggcgcgccttcggta

SEQ ID NO: 209031 - DNA, 20 bp, human
ggtggccgggacccacgggt

SEQ ID NO: 209032 - DNA, 20 bp, human
ggggtgccgcctcttggccg

SEQ ID NO: 209033 - DNA, 20 bp, human
ggccaagaggcggcacccat

SEQ ID NO: 209034 - DNA, 20 bp, human
gccgtgccgcgtcttggtgg

SEQ ID NO: 209035 - DNA, 20 bp, human
gatgcccggcgggtctcacg

SEQ ID NO: 209036 - DNA, 20 bp, human
gagaagctttgtgctggaca

SEQ ID NO: 209037 - DNA, 20 bp, human
ggcagctcctgccctcctga

SEQ ID NO: 209038 - DNA, 20 bp, human
gagcctcggcaccagtattt

SEQ ID NO: 209039 - DNA, 20 bp, human
gttcacagatgccatggtca

SEQ ID NO: 209040 - DNA, 20 bp, human
gaccccaaatactggtgccg

SEQ ID NO: 209041 - DNA, 20 bp, human
gcacatgattggtgctgtta

SEQ ID NO: 209042 - DNA, 20 bp, human
gtgggcattgtagttgcaga

SEQ ID NO: 209043 - DNA, 20 bp, human
ggatgatgttgcagtagtca

SEQ ID NO: 209044 - DNA, 20 bp, human
gacactgacaatacaaacag

SEQ ID NO: 209045 - DNA, 20 bp, human
gtgtgttttcacagatgcca

SEQ ID NO: 209046 - DNA, 20 bp, human
gagaaggctcgagacaagat

SEQ ID NO: 209047 - DNA, 20 bp, human
gggacagtgcaggatcaggt

SEQ ID NO: 209048 - DNA, 20 bp, human
ggccatgagtggcatagaga

SEQ ID NO: 209049 - DNA, 20 bp, human
gaagataagcaaccctcttc

SEQ ID NO: 209050 - DNA, 20 bp, human
gcctgaaacacccctgaaga

SEQ ID NO: 209051 - DNA, 20 bp, human
gagttctggctaaggttagg

SEQ ID NO: 209052 - DNA, 20 bp, human
gaacttagcaggaatagttc

SEQ ID NO: 209053 - DNA, 20 bp, human
gagagggttgcttatcttga

SEQ ID NO: 209054 - DNA, 20 bp, human
gtgctgcaaaggctgggtat

SEQ ID NO: 209055 - DNA, 20 bp, human
gaatagttctggctaaggtt

SEQ ID NO: 209056 - DNA, 20 bp, human
gcgccaggacggagcgaggg

SEQ ID NO: 209057 - DNA, 20 bp, human
gaggcctgggactgaggcgt

SEQ ID NO: 209058 - DNA, 20 bp, human
ggcgccacggggccccccaa

SEQ ID NO: 209059 - DNA, 20 bp, human
gacaccgcagtgccaggcct

SEQ ID NO: 209060 - DNA, 20 bp, human
ggaccccacgcctcagtccc

SEQ ID NO: 209061 - DNA, 20 bp, human
gacggggccccccaaggggc

SEQ ID NO: 209062 - DNA, 20 bp, human
gcgtcgccccgccccttggg

SEQ ID NO: 209063 - DNA, 20 bp, human
ggcgacgggcggcgccagga

SEQ ID NO: 209064 - DNA, 20 bp, human
ggtcccccctcgctccgtcc

SEQ ID NO: 209065 - DNA, 20 bp, human
gcgcgcgccgagcccggaag

SEQ ID NO: 209066 - DNA, 20 bp, human
ggtcccgtccactctcgctt

SEQ ID NO: 209067 - DNA, 20 bp, human
ggcacccaagcgagagtgga

SEQ ID NO: 209068 - DNA, 20 bp, human
gtggggacagtcccggaacc

SEQ ID NO: 209069 - DNA, 20 bp, human
ggcccggaatgtggcggcac

SEQ ID NO: 209070 - DNA, 20 bp, human
gctcttcagagcatttgggg

SEQ ID NO: 209071 - DNA, 20 bp, human
ggggccctcacgcataaagt

SEQ ID NO: 209072 - DNA, 20 bp, human
gcatttggggcgggcgacgg

SEQ ID NO: 209073 - DNA, 20 bp, human
gcctggtgcccggaatgtgg

SEQ ID NO: 209074 - DNA, 20 bp, human
ggcgtcagccggggccacac

SEQ ID NO: 209075 - DNA, 20 bp, human
gttccggtgccgccacattc

SEQ ID NO: 209076 - DNA, 20 bp, human
gggcaccagctcctcagcag

SEQ ID NO: 209077 - DNA, 20 bp, human
ggctgccggcagaagctagc

SEQ ID NO: 209078 - DNA, 20 bp, human
gaaaactgacacctcccacg

SEQ ID NO: 209079 - DNA, 20 bp, human
gcagagcgttgacagagcag

SEQ ID NO: 209080 - DNA, 20 bp, human
gtcaccccacgccacacacg

SEQ ID NO: 209081 - DNA, 20 bp, human
gacttccccgtgtgtggcgt

SEQ ID NO: 209082 - DNA, 20 bp, human
gcaacgctctgaatgtgctg

SEQ ID NO: 209083 - DNA, 20 bp, human
gcagatgggttgttgcccga

SEQ ID NO: 209084 - DNA, 20 bp, human
gtgtgtggcgtggggtgatg

SEQ ID NO: 209085 - DNA, 20 bp, human
gactgacacctcccacgtgg

SEQ ID NO: 209086 - DNA, 20 bp, human
ggagtgagccccggtcagag

SEQ ID NO: 209087 - DNA, 20 bp, human
gagggtcggggcagcctgtg

SEQ ID NO: 209088 - DNA, 20 bp, human
gaacagggctgtctccttct

SEQ ID NO: 209089 - DNA, 20 bp, human
gtccgggtgagcctctgaac

SEQ ID NO: 209090 - DNA, 20 bp, human
gctgctgctagagtgagcac

SEQ ID NO: 209091 - DNA, 20 bp, human
gcacacagccccgtggctcg

SEQ ID NO: 209092 - DNA, 20 bp, human
ggccacggggctgtgtggtc

SEQ ID NO: 209093 - DNA, 20 bp, human
gtgtgtggtctggcaaaccc

SEQ ID NO: 209094 - DNA, 20 bp, human
ggccagaccacacagccccg

SEQ ID NO: 209095 - DNA, 20 bp, human
gcccgtggctcgtggggtga

SEQ ID NO: 209096 - DNA, 20 bp, human
gttagcccagtggtgaggag

SEQ ID NO: 209097 - DNA, 20 bp, human
gagcgctgcggacggaagta

SEQ ID NO: 209098 - DNA, 20 bp, human
gaaggccactatggggtctc

SEQ ID NO: 209099 - DNA, 20 bp, human
ggggtgggaaggccactatg

SEQ ID NO: 209100 - DNA, 20 bp, human
gcaggctggcgggaagtgcg

SEQ ID NO: 209101 - DNA, 20 bp, human
ggtgggctgcagtgatccaa

SEQ ID NO: 209102 - DNA, 20 bp, human
gcggaagtagggaaactgtg

SEQ ID NO: 209103 - DNA, 20 bp, human
gtcccccggagaccccatag

SEQ ID NO: 209104 - DNA, 20 bp, human
ggcggcggagtggaaactct

SEQ ID NO: 209105 - DNA, 20 bp, human
gcagcagcgcggcctctacc

SEQ ID NO: 209106 - DNA, 20 bp, human
gctaccggaaatcgcgggga

SEQ ID NO: 209107 - DNA, 20 bp, human
gaaatcgcggggagggtcaa

SEQ ID NO: 209108 - DNA, 20 bp, human
ggggagggtcaaaggagacc

SEQ ID NO: 209109 - DNA, 20 bp, human
gaggcaagaagcgccaaagt

SEQ ID NO: 209110 - DNA, 20 bp, human
ggaacgctaccggaaatcgc

SEQ ID NO: 209111 - DNA, 20 bp, human
gaaaggagacccggtctccg

SEQ ID NO: 209112 - DNA, 20 bp, human
gtaacagcgccaccaacgag

SEQ ID NO: 209113 - DNA, 20 bp, human
gtgtccgtcccgctcgttgg

SEQ ID NO: 209114 - DNA, 20 bp, human
ggccatgagcctcggagacc

SEQ ID NO: 209115 - DNA, 20 bp, human
gcgatgctggtcctagtacc

SEQ ID NO: 209116 - DNA, 20 bp, human
gcggtagcagcaggagatta

SEQ ID NO: 209117 - DNA, 20 bp, human
gttttcctctggcctagagg

SEQ ID NO: 209118 - DNA, 20 bp, human
gctagaacccaaccccctct

SEQ ID NO: 209119 - DNA, 20 bp, human
gcacacagcaatatctagca

SEQ ID NO: 209120 - DNA, 20 bp, human
ggtgtgtatggtgtgttcat

SEQ ID NO: 209121 - DNA, 20 bp, human
gctgctaccgtattactcta

SEQ ID NO: 209122 - DNA, 20 bp, human
gctctggcctagagggggtt

SEQ ID NO: 209123 - DNA, 20 bp, human
gctgttgccgtagagtaata

SEQ ID NO: 209124 - DNA, 20 bp, human
gaagtgaatcatattaaata

SEQ ID NO: 209125 - DNA, 20 bp, human
ggcttgatttgattaacatt

SEQ ID NO: 209126 - DNA, 20 bp, human
gcggcactagggggcaatgc

SEQ ID NO: 209127 - DNA, 20 bp, human
gaaccccagcgggccgccta

SEQ ID NO: 209128 - DNA, 20 bp, human
gtcccagggcgcgccctctg

SEQ ID NO: 209129 - DNA, 20 bp, human
ggcgtcccccgccgctccca

SEQ ID NO: 209130 - DNA, 20 bp, human
ggcccagcgagcgccgaaga

SEQ ID NO: 209131 - DNA, 20 bp, human
gccagcgggccgcctagggg

SEQ ID NO: 209132 - DNA, 20 bp, human
gttgcggggtggcggcgtcg

SEQ ID NO: 209133 - DNA, 20 bp, human
gcggcggtgacatcaggcgg

SEQ ID NO: 209134 - DNA, 20 bp, human
gggcttcccggcttgcgggg

SEQ ID NO: 209135 - DNA, 20 bp, human
ggcacggcggtgacatcagg

SEQ ID NO: 209136 - DNA, 20 bp, human
gaacgcaaagggcaccgcta

SEQ ID NO: 209137 - DNA, 20 bp, human
ggaggtgcggcagatccatg

SEQ ID NO: 209138 - DNA, 20 bp, human
gtagaagggacccttcgctc

SEQ ID NO: 209139 - DNA, 20 bp, human
gaggggcagcgccaggaagg

SEQ ID NO: 209140 - DNA, 20 bp, human
gccgctgcgggttgcctcct

SEQ ID NO: 209141 - DNA, 20 bp, human
gcaccgctaggggagagcgc

SEQ ID NO: 209142 - DNA, 20 bp, human
ggccacactccagggtagaa

SEQ ID NO: 209143 - DNA, 20 bp, human
ggagacgggcgccacactcc

SEQ ID NO: 209144 - DNA, 20 bp, human
ggccacggccataaggatga

SEQ ID NO: 209145 - DNA, 20 bp, human
ggagtgaccgagagactcgg

SEQ ID NO: 209146 - DNA, 20 bp, human
gcgctagactggcggagggg

SEQ ID NO: 209147 - DNA, 20 bp, human
gcgggacgagccctttggag

SEQ ID NO: 209148 - DNA, 20 bp, human
gctcggggagcgttgccctc

SEQ ID NO: 209149 - DNA, 20 bp, human
gcgggcgctagactggcgga

SEQ ID NO: 209150 - DNA, 20 bp, human
gggcgcgggcgctagactgg

SEQ ID NO: 209151 - DNA, 20 bp, human
gccgacggagcagaacgcaa

SEQ ID NO: 209152 - DNA, 20 bp, human
gccggcgtcagcccccacgt

SEQ ID NO: 209153 - DNA, 20 bp, human
gctaggcgcgggcgctagac

SEQ ID NO: 209154 - DNA, 20 bp, human
gaggtacccgcctctccaaa

SEQ ID NO: 209155 - DNA, 20 bp, human
gcgcgcctagcgctggacct

SEQ ID NO: 209156 - DNA, 20 bp, human
gtccgggcgcgggaagtccc

SEQ ID NO: 209157 - DNA, 20 bp, human
gaggggcagcgcctgggaaa

SEQ ID NO: 209158 - DNA, 20 bp, human
gtcgcgggaggcgtgagccc

SEQ ID NO: 209159 - DNA, 20 bp, human
gtgaaggtgcgcttcgcggg

SEQ ID NO: 209160 - DNA, 20 bp, human
gcagctgtggaggggtcggt

SEQ ID NO: 209161 - DNA, 20 bp, human
gggaaggcaggtagaggcgc

SEQ ID NO: 209162 - DNA, 20 bp, human
gagaggcgctgggcggggtc

SEQ ID NO: 209163 - DNA, 20 bp, human
ggcgcctcgggagagcggag

SEQ ID NO: 209164 - DNA, 20 bp, human
ggggctgaaggtgcgcttcg

SEQ ID NO: 209165 - DNA, 20 bp, human
gcctgggaaagggtcgggac

SEQ ID NO: 209166 - DNA, 20 bp, human
gggcgagggcgccccctcca

SEQ ID NO: 209167 - DNA, 20 bp, human
gggcgccgccgcgagtcctc

SEQ ID NO: 209168 - DNA, 20 bp, human
gccgcccgggaaagtaaagt

SEQ ID NO: 209169 - DNA, 20 bp, human
gcgcgcgggcaggttcgacc

SEQ ID NO: 209170 - DNA, 20 bp, human
gtgcgcccatgcctgcgccg

SEQ ID NO: 209171 - DNA, 20 bp, human
ggccgagcggcggccggcct

SEQ ID NO: 209172 - DNA, 20 bp, human
gtgcgatcggcttccaactt

SEQ ID NO: 209173 - DNA, 20 bp, human
gcctcccccggcgcaggcat

SEQ ID NO: 209174 - DNA, 20 bp, human
gcctcccatccggccggcta

SEQ ID NO: 209175 - DNA, 20 bp, human
gaacctgcccgcgcggcgcc

SEQ ID NO: 209176 - DNA, 20 bp, human
ggagccgctcaattgccaac

SEQ ID NO: 209177 - DNA, 20 bp, human
ggcaaaggcacgcccccgtc

SEQ ID NO: 209178 - DNA, 20 bp, human
gcctcccgttggcaattgag

SEQ ID NO: 209179 - DNA, 20 bp, human
gcgatcagctcgggactctc

SEQ ID NO: 209180 - DNA, 20 bp, human
gacccccggggcctcgcgtc

SEQ ID NO: 209181 - DNA, 20 bp, human
gaaccagcgggcgcaggaag

SEQ ID NO: 209182 - DNA, 20 bp, human
ggccaacgggaggggggtgc

SEQ ID NO: 209183 - DNA, 20 bp, human
gggccccgggggttggcttg

SEQ ID NO: 209184 - DNA, 20 bp, human
ggggagccaggcgcggaagg

SEQ ID NO: 209185 - DNA, 20 bp, human
gctccccaagccaacccccg

SEQ ID NO: 209186 - DNA, 20 bp, human
gggagtgcctcgccccttcg

SEQ ID NO: 209187 - DNA, 20 bp, human
ggcacgccggcagccgcgaa

SEQ ID NO: 209188 - DNA, 20 bp, human
gagtggtggcccgccctcca

SEQ ID NO: 209189 - DNA, 20 bp, human
gcgccctccagggagcagtt

SEQ ID NO: 209190 - DNA, 20 bp, human
gttcccgtacgtcacggcga

SEQ ID NO: 209191 - DNA, 20 bp, human
gtgccctcgccgtgacgtac

SEQ ID NO: 209192 - DNA, 20 bp, human
gctcctggggctggcccggg

SEQ ID NO: 209193 - DNA, 20 bp, human
gtatgtgcacaggactttag

SEQ ID NO: 209194 - DNA, 20 bp, human
ggagccaaaagctcccgggt

SEQ ID NO: 209195 - DNA, 20 bp, human
ggctcccgggttggctggta

SEQ ID NO: 209196 - DNA, 20 bp, human
ggaaacgtggagcatcccat

SEQ ID NO: 209197 - DNA, 20 bp, human
gactcctcccccaagagcgg

SEQ ID NO: 209198 - DNA, 20 bp, human
gggagccgaattggagagtg

SEQ ID NO: 209199 - DNA, 20 bp, human
gcccacgcgcgacccgggga

SEQ ID NO: 209200 - DNA, 20 bp, human
gctcaccaagctgaggtctt

SEQ ID NO: 209201 - DNA, 20 bp, human
gaggaggacagcagcacgta

SEQ ID NO: 209202 - DNA, 20 bp, human
gactcagcatagcactccct

SEQ ID NO: 209203 - DNA, 20 bp, human
gggggcctctggagccgaat

SEQ ID NO: 209204 - DNA, 20 bp, human
ggagtggggaggatggccaa

SEQ ID NO: 209205 - DNA, 20 bp, human
gggagtgctatgctgagtcc

SEQ ID NO: 209206 - DNA, 20 bp, human
gggtctccgtccagcatcga

SEQ ID NO: 209207 - DNA, 20 bp, human
gggtctgagcccgcggtcgc

SEQ ID NO: 209208 - DNA, 20 bp, human
gagcccgcgaggggccgagc

SEQ ID NO: 209209 - DNA, 20 bp, human
gaacgccagcgagcccgcga

SEQ ID NO: 209210 - DNA, 20 bp, human
gcccgccgggactgcagtcg

SEQ ID NO: 209211 - DNA, 20 bp, human
gcggtcgcaggtctggttcg

SEQ ID NO: 209212 - DNA, 20 bp, human
ggagcccgcggtcgcaggtc

SEQ ID NO: 209213 - DNA, 20 bp, human
ggccccgactgcagtcccgg

SEQ ID NO: 209214 - DNA, 20 bp, human
gcaacctcgggtcacatctc

SEQ ID NO: 209215 - DNA, 20 bp, human
gtgacctcggccctcgatgc

SEQ ID NO: 209216 - DNA, 20 bp, human
gcgggaggtcggggcagtga

SEQ ID NO: 209217 - DNA, 20 bp, human
gaacccaaggggttatgggg

SEQ ID NO: 209218 - DNA, 20 bp, human
gtcagagcgcgtggaacctg

SEQ ID NO: 209219 - DNA, 20 bp, human
gagcgcgtggaacctggggc

SEQ ID NO: 209220 - DNA, 20 bp, human
gccagacgtccacaacccaa

SEQ ID NO: 209221 - DNA, 20 bp, human
gtctggcccagggcttctct

SEQ ID NO: 209222 - DNA, 20 bp, human
gaggcctccccataacccct

SEQ ID NO: 209223 - DNA, 20 bp, human
gccctcgtggccaccccgag

SEQ ID NO: 209224 - DNA, 20 bp, human
gccacaacccaaggggttat

SEQ ID NO: 209225 - DNA, 20 bp, human
gtacggtcgccctcccctcg

SEQ ID NO: 209226 - DNA, 20 bp, human
gcggggaggagcgagtgcga

SEQ ID NO: 209227 - DNA, 20 bp, human
ggaggagcgagtgcgatgga

SEQ ID NO: 209228 - DNA, 20 bp, human
ggggcgctggggaactgctc

SEQ ID NO: 209229 - DNA, 20 bp, human
gggaaaagagccgccggcgc

SEQ ID NO: 209230 - DNA, 20 bp, human
gctggggaactgctcaggtg

SEQ ID NO: 209231 - DNA, 20 bp, human
ggaccacaggcgggtttcag

SEQ ID NO: 209232 - DNA, 20 bp, human
gcggcggcggcccctagagg

SEQ ID NO: 209233 - DNA, 20 bp, human
ggcccctagaggcggcgcca

SEQ ID NO: 209234 - DNA, 20 bp, human
gggtcgccctcgccaatcgt

SEQ ID NO: 209235 - DNA, 20 bp, human
gccaggcgggggctcttaga

SEQ ID NO: 209236 - DNA, 20 bp, human
gtagcgcggctaagtaacgt

SEQ ID NO: 209237 - DNA, 20 bp, human
ggggcgggacttccttcacg

SEQ ID NO: 209238 - DNA, 20 bp, human
gccgcagccggcagcgccca

SEQ ID NO: 209239 - DNA, 20 bp, human
gttcacgcggtctcgctctc

SEQ ID NO: 209240 - DNA, 20 bp, human
gtctgggttccgggcgccct

SEQ ID NO: 209241 - DNA, 20 bp, human
gtgtgggggccccagaccgg

SEQ ID NO: 209242 - DNA, 20 bp, human
ggccgcgggcaggagtgggt

SEQ ID NO: 209243 - DNA, 20 bp, human
gaggtacattaagacttcct

SEQ ID NO: 209244 - DNA, 20 bp, human
ggaagcatcaatcatgtttc

SEQ ID NO: 209245 - DNA, 20 bp, human
ggtgcgccgcgggcaggagt

SEQ ID NO: 209246 - DNA, 20 bp, human
gaaggggcgtggcctcggtc

SEQ ID NO: 209247 - DNA, 20 bp, human
gggcctgcgcggggcagtca

SEQ ID NO: 209248 - DNA, 20 bp, human
ggcgtggcctcggtccgggg

SEQ ID NO: 209249 - DNA, 20 bp, human
gcgccacagcccgctcaagg

SEQ ID NO: 209250 - DNA, 20 bp, human
gcaaacctcgcgagcggaaa

SEQ ID NO: 209251 - DNA, 20 bp, human
gctcgcgagcggaaaaggtc

SEQ ID NO: 209252 - DNA, 20 bp, human
gtgaaagcgagaggtagagc

SEQ ID NO: 209253 - DNA, 20 bp, human
gcccgtgcaaacctcgcgag

SEQ ID NO: 209254 - DNA, 20 bp, human
gggaagcgcgtgtggagcgt

SEQ ID NO: 209255 - DNA, 20 bp, human
gggagtggcgcgccaggccg

SEQ ID NO: 209256 - DNA, 20 bp, human
gcctccgttggcaaattcgt

SEQ ID NO: 209257 - DNA, 20 bp, human
ggaagtcctgggcccggcaa

SEQ ID NO: 209258 - DNA, 20 bp, human
gtggcggccggaggtcaccg

SEQ ID NO: 209259 - DNA, 20 bp, human
gggcactcggggttccacgg

SEQ ID NO: 209260 - DNA, 20 bp, human
gtgcggggacacaaagtcct

SEQ ID NO: 209261 - DNA, 20 bp, human
gggggcggggatgtggcggc

SEQ ID NO: 209262 - DNA, 20 bp, human
gaagtgctcgagactcaact

SEQ ID NO: 209263 - DNA, 20 bp, human
gcacaagccctggtccccga

SEQ ID NO: 209264 - DNA, 20 bp, human
gtgagtctcgagcactttag

SEQ ID NO: 209265 - DNA, 20 bp, human
gccggcccggctccatttaa

SEQ ID NO: 209266 - DNA, 20 bp, human
gggactgagagttccaacac

SEQ ID NO: 209267 - DNA, 20 bp, human
gccggcctgctgttggactt

SEQ ID NO: 209268 - DNA, 20 bp, human
gcctgcctctgaagtttatc

SEQ ID NO: 209269 - DNA, 20 bp, human
ggctacaaaccacacccctc

SEQ ID NO: 209270 - DNA, 20 bp, human
gttaggctgtgacccacaga

SEQ ID NO: 209271 - DNA, 20 bp, human
gggtgtggtttgtagctctc

SEQ ID NO: 209272 - DNA, 20 bp, human
gaaccaaattcagcctgtgt

SEQ ID NO: 209273 - DNA, 20 bp, human
gtcagaggcaggattactgc

SEQ ID NO: 209274 - DNA, 20 bp, human
gttccaacacaggctgaatt

SEQ ID NO: 209275 - DNA, 20 bp, human
gtggaactctcagtcccaga

SEQ ID NO: 209276 - DNA, 20 bp, human
gctggggtgcgggtctgagg

SEQ ID NO: 209277 - DNA, 20 bp, human
ggagccgagagtggacggag

SEQ ID NO: 209278 - DNA, 20 bp, human
gcgggaccccgagtccaccg

SEQ ID NO: 209279 - DNA, 20 bp, human
gtgtcctaggcgcaagtctc

SEQ ID NO: 209280 - DNA, 20 bp, human
ggcggcgagcgtcccaagcc

SEQ ID NO: 209281 - DNA, 20 bp, human
ggagacctctctcaattcgg

SEQ ID NO: 209282 - DNA, 20 bp, human
gccgacctgaagaggttggt

SEQ ID NO: 209283 - DNA, 20 bp, human
ggacttgcgcctaggacaga

SEQ ID NO: 209284 - DNA, 20 bp, human
gcggggtcccgccttaaggg

SEQ ID NO: 209285 - DNA, 20 bp, human
ggttcctggtcacccgcgga

SEQ ID NO: 209286 - DNA, 20 bp, human
gtcagcctgcacacgcgcta

SEQ ID NO: 209287 - DNA, 20 bp, human
gacggagcccgcgcggggac

SEQ ID NO: 209288 - DNA, 20 bp, human
gggcgcagaacccgcagccg

SEQ ID NO: 209289 - DNA, 20 bp, human
gagggagagagagtcgagag

SEQ ID NO: 209290 - DNA, 20 bp, human
gtgctctgcagcggcgtcgg

SEQ ID NO: 209291 - DNA, 20 bp, human
gggctccgtagcgcgtgtgc

SEQ ID NO: 209292 - DNA, 20 bp, human
ggcgactacgcgcactcaca

SEQ ID NO: 209293 - DNA, 20 bp, human
gctgcctcgtgccgccgcgc

SEQ ID NO: 209294 - DNA, 20 bp, human
ggcgctacggagcccgcgcg

SEQ ID NO: 209295 - DNA, 20 bp, human
gagagagagtcgagagaggg

SEQ ID NO: 209296 - DNA, 20 bp, human
gggagccggggaacactgat

SEQ ID NO: 209297 - DNA, 20 bp, human
gaggcgggcgagagcagaag

SEQ ID NO: 209298 - DNA, 20 bp, human
gcacgagttacgccctcttc

SEQ ID NO: 209299 - DNA, 20 bp, human
gtgcccgcctattggctcgc

SEQ ID NO: 209300 - DNA, 20 bp, human
gagcctgcctggcagcgggg

SEQ ID NO: 209301 - DNA, 20 bp, human
gcccgacccaggtagaggag

SEQ ID NO: 209302 - DNA, 20 bp, human
gcgcctccccgctgccaggc

SEQ ID NO: 209303 - DNA, 20 bp, human
gcggtcccatcagtgttccc

SEQ ID NO: 209304 - DNA, 20 bp, human
gaatcagaagaggtcttggg

SEQ ID NO: 209305 - DNA, 20 bp, human
gaccgggcagggacgacagg

SEQ ID NO: 209306 - DNA, 20 bp, human
gccggctgccgggtaggaga

SEQ ID NO: 209307 - DNA, 20 bp, human
gcgcccgccgcggtgacctt

SEQ ID NO: 209308 - DNA, 20 bp, human
ggccgggcccaaggtcaccg

SEQ ID NO: 209309 - DNA, 20 bp, human
ggcccggccggctgccgggt

SEQ ID NO: 209310 - DNA, 20 bp, human
gcgtgcgcgccgccgagggg

SEQ ID NO: 209311 - DNA, 20 bp, human
gggcccaaggtcaccgcggc

SEQ ID NO: 209312 - DNA, 20 bp, human
gggcctgcggatccccacgc

SEQ ID NO: 209313 - DNA, 20 bp, human
gccccaccgctattgtctaa

SEQ ID NO: 209314 - DNA, 20 bp, human
gcggggaggcgggccggcgt

SEQ ID NO: 209315 - DNA, 20 bp, human
ggggatccgcaggcctcccc

SEQ ID NO: 209316 - DNA, 20 bp, human
gtgggcgcccggctccgctg

SEQ ID NO: 209317 - DNA, 20 bp, human
gcgcgcagctcgcttcccat

SEQ ID NO: 209318 - DNA, 20 bp, human
gggaagcgagctgcgcggag

SEQ ID NO: 209319 - DNA, 20 bp, human
ggatctcgagcggggtacac

SEQ ID NO: 209320 - DNA, 20 bp, human
ggccgggacagacaccacgc

SEQ ID NO: 209321 - DNA, 20 bp, human
gcgagctgcgcggagtgggc

SEQ ID NO: 209322 - DNA, 20 bp, human
gctcgcttcccattggccgg

SEQ ID NO: 209323 - DNA, 20 bp, human
gttgagctgggtattctagg

SEQ ID NO: 209324 - DNA, 20 bp, human
ggagggaacaaagggaggtt

SEQ ID NO: 209325 - DNA, 20 bp, human
gtgggcttgcggggtcccgc

SEQ ID NO: 209326 - DNA, 20 bp, human
gctccgcggcgctcccactt

SEQ ID NO: 209327 - DNA, 20 bp, human
gccggcgagcatcctgtctg

SEQ ID NO: 209328 - DNA, 20 bp, human
gggggcgtgtgcggcaccac

SEQ ID NO: 209329 - DNA, 20 bp, human
gggaacgaacgcgtgcggac

SEQ ID NO: 209330 - DNA, 20 bp, human
gaccacgggacagcgggctg

SEQ ID NO: 209331 - DNA, 20 bp, human
ggggtcctccaagcccaagt

SEQ ID NO: 209332 - DNA, 20 bp, human
ggtgcggcaccacgggacag

SEQ ID NO: 209333 - DNA, 20 bp, human
gacagcgggctgcggcccag

SEQ ID NO: 209334 - DNA, 20 bp, human
gggtaagaccccatcgctag

SEQ ID NO: 209335 - DNA, 20 bp, human
gcagcggccggcgctctctg

SEQ ID NO: 209336 - DNA, 20 bp, human
gtcggcgggccggagttctc

SEQ ID NO: 209337 - DNA, 20 bp, human
ggcggccccgccaggaggtc

SEQ ID NO: 209338 - DNA, 20 bp, human
gagcgtgacctcacggggag

SEQ ID NO: 209339 - DNA, 20 bp, human
ggcccgccgaggctgacagt

SEQ ID NO: 209340 - DNA, 20 bp, human
gtcgcggccggacctcctgg

SEQ ID NO: 209341 - DNA, 20 bp, human
gagcgcccctgtcccagcgc

SEQ ID NO: 209342 - DNA, 20 bp, human
ggttctccggcgctgggaca

SEQ ID NO: 209343 - DNA, 20 bp, human
gcccggagtcaagacgtgaa

SEQ ID NO: 209344 - DNA, 20 bp, human
gagccgactgtcagcctcgg

SEQ ID NO: 209345 - DNA, 20 bp, human
ggactccgggggcgtcgaga

SEQ ID NO: 209346 - DNA, 20 bp, human
gcggccctcccgggattggt

SEQ ID NO: 209347 - DNA, 20 bp, human
gggcgccacccaagcggcaa

SEQ ID NO: 209348 - DNA, 20 bp, human
gcctcccaccaatcccggga

SEQ ID NO: 209349 - DNA, 20 bp, human
gctagctggcgccacccaag

SEQ ID NO: 209350 - DNA, 20 bp, human
gcaagcggcaagggacgtcg

SEQ ID NO: 209351 - DNA, 20 bp, human
gccggcccgcgccctctagc

SEQ ID NO: 209352 - DNA, 20 bp, human
ggaacccggtaccgcagctc

SEQ ID NO: 209353 - DNA, 20 bp, human
gaatacggcaatgaccgccc

SEQ ID NO: 209354 - DNA, 20 bp, human
gacgtcccttgccgcttggg

SEQ ID NO: 209355 - DNA, 20 bp, human
gcgcgagggtgaccctgccc

SEQ ID NO: 209356 - DNA, 20 bp, human
gcgagcccctgccagatccg

SEQ ID NO: 209357 - DNA, 20 bp, human
ggtgggagagggttcccgaa

SEQ ID NO: 209358 - DNA, 20 bp, human
gacccgggacgcaggggccg

SEQ ID NO: 209359 - DNA, 20 bp, human
gacgtgcctgctccatgtcg

SEQ ID NO: 209360 - DNA, 20 bp, human
gtagctgattttgacagtgg

SEQ ID NO: 209361 - DNA, 20 bp, human
gggttcccgaaaggcagggg

SEQ ID NO: 209362 - DNA, 20 bp, human
gtcgcggcttctagctgtcc

SEQ ID NO: 209363 - DNA, 20 bp, human
gtatcatccccggatctggc

SEQ ID NO: 209364 - DNA, 20 bp, human
ggacccggacccgggacgca

SEQ ID NO: 209365 - DNA, 20 bp, human
gtaagtgtgtgatgctgccg

SEQ ID NO: 209366 - DNA, 20 bp, human
gtctccccagagtagagtcc

SEQ ID NO: 209367 - DNA, 20 bp, human
gccctgccacaagtgagagt

SEQ ID NO: 209368 - DNA, 20 bp, human
gagtgtgcaggtgttgatag

SEQ ID NO: 209369 - DNA, 20 bp, human
ggccacaagtgagagttggc

SEQ ID NO: 209370 - DNA, 20 bp, human
gtcaaagagaccttctccct

SEQ ID NO: 209371 - DNA, 20 bp, human
gaagtgagagttggccggtt

SEQ ID NO: 209372 - DNA, 20 bp, human
ggttcctgggattcttttat

SEQ ID NO: 209373 - DNA, 20 bp, human
gagttggccggttgggtatc

SEQ ID NO: 209374 - DNA, 20 bp, human
gggtcacaacccaagtgtgc

SEQ ID NO: 209375 - DNA, 20 bp, human
gaccaggaaagaagagtctt

SEQ ID NO: 209376 - DNA, 20 bp, human
gggctcaggcctataccgct

SEQ ID NO: 209377 - DNA, 20 bp, human
ggggctgccacggcagtaca

SEQ ID NO: 209378 - DNA, 20 bp, human
gggccgggaggcgacgcccg

SEQ ID NO: 209379 - DNA, 20 bp, human
gcaccccgggcgtcgcctcc

SEQ ID NO: 209380 - DNA, 20 bp, human
ggggtctgatgacccgggcc

SEQ ID NO: 209381 - DNA, 20 bp, human
gtgcaggccctgtactgccg

SEQ ID NO: 209382 - DNA, 20 bp, human
ggctgtggggtctgatgacc

SEQ ID NO: 209383 - DNA, 20 bp, human
gacgcggccgcagtgcccag

SEQ ID NO: 209384 - DNA, 20 bp, human
ggtggtgacgttcccggctg

SEQ ID NO: 209385 - DNA, 20 bp, human
gccgggaacgtcaccacccc

SEQ ID NO: 209386 - DNA, 20 bp, human
gggggccgacggagcagcgt

SEQ ID NO: 209387 - DNA, 20 bp, human
ggcagaagacaggaccaaat

SEQ ID NO: 209388 - DNA, 20 bp, human
ggcggggccgagaaggaccc

SEQ ID NO: 209389 - DNA, 20 bp, human
ggccgacggagcagcgttgg

SEQ ID NO: 209390 - DNA, 20 bp, human
ggaccaaatgggaggagcat

SEQ ID NO: 209391 - DNA, 20 bp, human
gaccgggccgagggaggact

SEQ ID NO: 209392 - DNA, 20 bp, human
gtggaggcggggccgacgga

SEQ ID NO: 209393 - DNA, 20 bp, human
ggagggcaagggggagctag

SEQ ID NO: 209394 - DNA, 20 bp, human
gggctgatggcgcacgtggg

SEQ ID NO: 209395 - DNA, 20 bp, human
ggccctcccgagtcctccct

SEQ ID NO: 209396 - DNA, 20 bp, human
gagttggaacaaaagtccac

SEQ ID NO: 209397 - DNA, 20 bp, human
gtgcttgattatatctgttc

SEQ ID NO: 209398 - DNA, 20 bp, human
gattgtgcatacttagcctg

SEQ ID NO: 209399 - DNA, 20 bp, human
gaattacctttgtgtttcgc

SEQ ID NO: 209400 - DNA, 20 bp, human
gtttttccagcgaaacacaa

SEQ ID NO: 209401 - DNA, 20 bp, human
gagaagatatacctgcactt

SEQ ID NO: 209402 - DNA, 20 bp, human
gtttttatatgttgactgac

SEQ ID NO: 209403 - DNA, 20 bp, human
gtggaaaaaatctactgagt

SEQ ID NO: 209404 - DNA, 20 bp, human
gtttcagaaatagattaaat

SEQ ID NO: 209405 - DNA, 20 bp, human
gacaggttgttttcatattt

SEQ ID NO: 209406 - DNA, 20 bp, human
ggacgtggctgatcggggtg

SEQ ID NO: 209407 - DNA, 20 bp, human
gcgcccggccgctgacctgg

SEQ ID NO: 209408 - DNA, 20 bp, human
gaatccgggacgtgcgccca

SEQ ID NO: 209409 - DNA, 20 bp, human
gggaaccaggggcttactgc

SEQ ID NO: 209410 - DNA, 20 bp, human
gccccctcgtgggaggaatc

SEQ ID NO: 209411 - DNA, 20 bp, human
gggcctggaaatcagggcga

SEQ ID NO: 209412 - DNA, 20 bp, human
gtcccggattcctcccacga

SEQ ID NO: 209413 - DNA, 20 bp, human
gcagcccgccccctcgtggg

SEQ ID NO: 209414 - DNA, 20 bp, human
gagtccctgggcgcacgtcc

SEQ ID NO: 209415 - DNA, 20 bp, human
gctgggagggcctggaaatc

SEQ ID NO: 209416 - DNA, 20 bp, human
gcaaggacacagagctcttt

SEQ ID NO: 209417 - DNA, 20 bp, human
gccgctatgctgttaattat

SEQ ID NO: 209418 - DNA, 20 bp, human
gttaactagtaaccttttgt

SEQ ID NO: 209419 - DNA, 20 bp, human
gtaacagatataccaacaaa

SEQ ID NO: 209420 - DNA, 20 bp, human
gcaagatgaagagtctgaat

SEQ ID NO: 209421 - DNA, 20 bp, human
gatttccttaggttgaaaat

SEQ ID NO: 209422 - DNA, 20 bp, human
gagacaatgtcttgtgtgcc

SEQ ID NO: 209423 - DNA, 20 bp, human
gtggtatatctgttacttta

SEQ ID NO: 209424 - DNA, 20 bp, human
gatgtcccattttcaaccta

SEQ ID NO: 209425 - DNA, 20 bp, human
gattcttttatactcttttc

SEQ ID NO: 209426 - DNA, 20 bp, human
gataataggagtacagggag

SEQ ID NO: 209427 - DNA, 20 bp, human
ggagtctgtgagaagaagca

SEQ ID NO: 209428 - DNA, 20 bp, human
gtaaaatcaatgaagctccg

SEQ ID NO: 209429 - DNA, 20 bp, human
gcggacagactatgacagaa

SEQ ID NO: 209430 - DNA, 20 bp, human
ggaggttgagaatacaagtc

SEQ ID NO: 209431 - DNA, 20 bp, human
ggcttctataataggagtac

SEQ ID NO: 209432 - DNA, 20 bp, human
gaccacagatcagacctcac

SEQ ID NO: 209433 - DNA, 20 bp, human
ggcggcctcttccagaaact

SEQ ID NO: 209434 - DNA, 20 bp, human
gaactcatgaatgactcagc

SEQ ID NO: 209435 - DNA, 20 bp, human
ggtaaatgcatctcaaaagt

SEQ ID NO: 209436 - DNA, 20 bp, human
gcccggaagtgacgtgtcgg

SEQ ID NO: 209437 - DNA, 20 bp, human
gcaggtggctaggtcgggac

SEQ ID NO: 209438 - DNA, 20 bp, human
ggcgcccggaagtgacgtgt

SEQ ID NO: 209439 - DNA, 20 bp, human
gcgagtcatagagctgtagg

SEQ ID NO: 209440 - DNA, 20 bp, human
gagaacgcttatccctgcgc

SEQ ID NO: 209441 - DNA, 20 bp, human
ggccgccgacacgtcacttc

SEQ ID NO: 209442 - DNA, 20 bp, human
gtgactcgcaaggaagtaaa

SEQ ID NO: 209443 - DNA, 20 bp, human
ggaggacactccaggggaat

SEQ ID NO: 209444 - DNA, 20 bp, human
gcgggcgcaggtggctaggt

SEQ ID NO: 209445 - DNA, 20 bp, human
gtctgtgacaccaattcccc

SEQ ID NO: 209446 - DNA, 20 bp, human
gcccacgcccgctctctcgg

SEQ ID NO: 209447 - DNA, 20 bp, human
gccgcgggagagttgtgtca

SEQ ID NO: 209448 - DNA, 20 bp, human
ggaggcgtccctgggcccgc

SEQ ID NO: 209449 - DNA, 20 bp, human
gctcgtctcgcgagagttga

SEQ ID NO: 209450 - DNA, 20 bp, human
gccaggcgggcggggcactg

SEQ ID NO: 209451 - DNA, 20 bp, human
gtgagctgttccctgcgcta

SEQ ID NO: 209452 - DNA, 20 bp, human
gacaactctcccgcgggccc

SEQ ID NO: 209453 - DNA, 20 bp, human
gcgcgagacgaggcgtccct

SEQ ID NO: 209454 - DNA, 20 bp, human
gggaaaagcagcaacttgtc

SEQ ID NO: 209455 - DNA, 20 bp, human
gacccccgagagagcgggcg

SEQ ID NO: 209456 - DNA, 20 bp, human
ggggcctggcgcaattcccc

SEQ ID NO: 209457 - DNA, 20 bp, human
gccgccccgcgcctgcctct

SEQ ID NO: 209458 - DNA, 20 bp, human
gggacactggcgagtcgcag

SEQ ID NO: 209459 - DNA, 20 bp, human
ggaagcccagaggcaggcgc

SEQ ID NO: 209460 - DNA, 20 bp, human
gtcccagcgcgccggatccc

SEQ ID NO: 209461 - DNA, 20 bp, human
gcggagggcggcaagcgcgc

SEQ ID NO: 209462 - DNA, 20 bp, human
gtgcgcggggtgttcacact

SEQ ID NO: 209463 - DNA, 20 bp, human
gtcggcgcttcccagcgcgc

SEQ ID NO: 209464 - DNA, 20 bp, human
gccccgggatccggcgcgct

SEQ ID NO: 209465 - DNA, 20 bp, human
ggggtgttcacactgggccg

SEQ ID NO: 209466 - DNA, 20 bp, human
ggtgacctttccaagtttga

SEQ ID NO: 209467 - DNA, 20 bp, human
gaaagcagacaaattctcat

SEQ ID NO: 209468 - DNA, 20 bp, human
gtcttccctcaaacttggaa

SEQ ID NO: 209469 - DNA, 20 bp, human
gtttcatcttccctcaaact

SEQ ID NO: 209470 - DNA, 20 bp, human
gatttgtctgctttgggaga

SEQ ID NO: 209471 - DNA, 20 bp, human
ggtggcatacactactcagg

SEQ ID NO: 209472 - DNA, 20 bp, human
gatggtggcatacactactc

SEQ ID NO: 209473 - DNA, 20 bp, human
ggatcaagaaaatattggct

SEQ ID NO: 209474 - DNA, 20 bp, human
gcaaacgtccagtggtagaa

SEQ ID NO: 209475 - DNA, 20 bp, human
gtgaggcttttctttatctt

SEQ ID NO: 209476 - DNA, 20 bp, human
gcggggcagaaaggtctggt

SEQ ID NO: 209477 - DNA, 20 bp, human
ggtggggcacctgtagtcgg

SEQ ID NO: 209478 - DNA, 20 bp, human
gccgctccggccgctgacac

SEQ ID NO: 209479 - DNA, 20 bp, human
ggtcggtggtgcctcaacag

SEQ ID NO: 209480 - DNA, 20 bp, human
gcagaggcatggcaatggtg

SEQ ID NO: 209481 - DNA, 20 bp, human
gatgccccaagcaggtcccc

SEQ ID NO: 209482 - DNA, 20 bp, human
gttgaggcaccaccgactac

SEQ ID NO: 209483 - DNA, 20 bp, human
gctgccccgcctctgtggcc

SEQ ID NO: 209484 - DNA, 20 bp, human
gtggttagcagtcttgtcga

SEQ ID NO: 209485 - DNA, 20 bp, human
gttggggcattgtggacaga

SEQ ID NO: 209486 - DNA, 20 bp, human
gactggctggcagggttgat

SEQ ID NO: 209487 - DNA, 20 bp, human
gttgatgggccaacactaga

SEQ ID NO: 209488 - DNA, 20 bp, human
gtagcagggactggctggca

SEQ ID NO: 209489 - DNA, 20 bp, human
gaggaagtgaggtcgacaga

SEQ ID NO: 209490 - DNA, 20 bp, human
ggtgaggtcgacagacggaa

SEQ ID NO: 209491 - DNA, 20 bp, human
gctcccaccccctctagtgt

SEQ ID NO: 209492 - DNA, 20 bp, human
ggggccaacactagaggggg

SEQ ID NO: 209493 - DNA, 20 bp, human
gctggctgggaaatcatagc

SEQ ID NO: 209494 - DNA, 20 bp, human
gctagaatgcagggctgtga

SEQ ID NO: 209495 - DNA, 20 bp, human
gtagtgctgtcccaggctgt

SEQ ID NO: 209496 - DNA, 20 bp, human
gcccacccgcattgcctcga

SEQ ID NO: 209497 - DNA, 20 bp, human
ggcagctgtcccctccgcga

SEQ ID NO: 209498 - DNA, 20 bp, human
ggcctcgagggccaccctcg

SEQ ID NO: 209499 - DNA, 20 bp, human
gggcagcagggtggtctcta

SEQ ID NO: 209500 - DNA, 20 bp, human
gcccgggccggcgcgcagga

SEQ ID NO: 209501 - DNA, 20 bp, human
ggggctgcgtgtgccggagc

SEQ ID NO: 209502 - DNA, 20 bp, human
gggtggccctcgaggcaatg

SEQ ID NO: 209503 - DNA, 20 bp, human
gggtgcgtgcgcatgacgcg

SEQ ID NO: 209504 - DNA, 20 bp, human
ggccctcgaggcaatgcggg

SEQ ID NO: 209505 - DNA, 20 bp, human
gggaagggccgaggctgagt

SEQ ID NO: 209506 - DNA, 20 bp, human
ggacaaaaatgaccactcgt

SEQ ID NO: 209507 - DNA, 20 bp, human
gatagaggaagatggcttca

SEQ ID NO: 209508 - DNA, 20 bp, human
gggaggcaggatgggtccta

SEQ ID NO: 209509 - DNA, 20 bp, human
ggattgctgtggtcaagttg

SEQ ID NO: 209510 - DNA, 20 bp, human
gtacaaagcctcagtagagt

SEQ ID NO: 209511 - DNA, 20 bp, human
gtgaccactcgttggaagac

SEQ ID NO: 209512 - DNA, 20 bp, human
gagggccccagggattgctg

SEQ ID NO: 209513 - DNA, 20 bp, human
gttgaccacagcaatccctg

SEQ ID NO: 209514 - DNA, 20 bp, human
gtactctcaataaagagtta

SEQ ID NO: 209515 - DNA, 20 bp, human
gctttattgagagtagagct

SEQ ID NO: 209516 - DNA, 20 bp, human
ggtgacctttccaagtttga

SEQ ID NO: 209517 - DNA, 20 bp, human
gaaagcagacaaattctcat

SEQ ID NO: 209518 - DNA, 20 bp, human
gtcttccctcaaacttggaa

SEQ ID NO: 209519 - DNA, 20 bp, human
gtttcatcttccctcaaact

SEQ ID NO: 209520 - DNA, 20 bp, human
gatttgtctgctttgggaga

SEQ ID NO: 209521 - DNA, 20 bp, human
ggtggcatacactactcagg

SEQ ID NO: 209522 - DNA, 20 bp, human
gatggtggcatacactactc

SEQ ID NO: 209523 - DNA, 20 bp, human
ggatcaagaaaatattggct

SEQ ID NO: 209524 - DNA, 20 bp, human
gcaaacgtccagtggtagaa

SEQ ID NO: 209525 - DNA, 20 bp, human
gagatgaaacaaacgtccag

SEQ ID NO: 209526 - DNA, 20 bp, human
ggggaagagggttgtgaaat

SEQ ID NO: 209527 - DNA, 20 bp, human
gtgctctgtctctagttggg

SEQ ID NO: 209528 - DNA, 20 bp, human
gaaatggggattattacttg

SEQ ID NO: 209529 - DNA, 20 bp, human
ggatagtacaactttaacac

SEQ ID NO: 209530 - DNA, 20 bp, human
gaagttgtactatcagttaa

SEQ ID NO: 209531 - DNA, 20 bp, human
ggttgcagctgaacacaact

SEQ ID NO: 209532 - DNA, 20 bp, human
gtactatcagttaagggaag

SEQ ID NO: 209533 - DNA, 20 bp, human
ggtaacaaggattgggatga

SEQ ID NO: 209534 - DNA, 20 bp, human
ggattcaaatgtatagcaga

SEQ ID NO: 209535 - DNA, 20 bp, human
gcttctgctccaaggaaaat

SEQ ID NO: 209536 - DNA, 20 bp, human
gatcagggatgtacatggaa

SEQ ID NO: 209537 - DNA, 20 bp, human
ggaagactaaatatggaggg

SEQ ID NO: 209538 - DNA, 20 bp, human
gacaggcaaggggattcact

SEQ ID NO: 209539 - DNA, 20 bp, human
gtctgaagactaaatatgga

SEQ ID NO: 209540 - DNA, 20 bp, human
ggagttctgaagactaaata

SEQ ID NO: 209541 - DNA, 20 bp, human
gggaaggagttggatgatca

SEQ ID NO: 209542 - DNA, 20 bp, human
gggatgatcagggatgtaca

SEQ ID NO: 209543 - DNA, 20 bp, human
gttcacttggtaagagaccc

SEQ ID NO: 209544 - DNA, 20 bp, human
gacaggtctgttatttcagt

SEQ ID NO: 209545 - DNA, 20 bp, human
gttgtgggccagagtagcac

SEQ ID NO: 209546 - DNA, 20 bp, human
gggaaggtctgcaacatgta

SEQ ID NO: 209547 - DNA, 20 bp, human
gtaggcctcgcccccaagga

SEQ ID NO: 209548 - DNA, 20 bp, human
gtggggctgtgatgtatgag

SEQ ID NO: 209549 - DNA, 20 bp, human
gaggtctgcaacatgtatgg

SEQ ID NO: 209550 - DNA, 20 bp, human
gggtccccgctccctccttg

SEQ ID NO: 209551 - DNA, 20 bp, human
ggggccctcacagaaggcgg

SEQ ID NO: 209552 - DNA, 20 bp, human
gctacccgggccctcacaga

SEQ ID NO: 209553 - DNA, 20 bp, human
ggggcggtcgggcgcttccg

SEQ ID NO: 209554 - DNA, 20 bp, human
gcagcttggaagtatgttga

SEQ ID NO: 209555 - DNA, 20 bp, human
ggagctaggcctcgccccca

SEQ ID NO: 209556 - DNA, 20 bp, human
ggatgccgggaactcggggt

SEQ ID NO: 209557 - DNA, 20 bp, human
gccagaggatgccgggaact

SEQ ID NO: 209558 - DNA, 20 bp, human
gcacctagcaaccagctcgg

SEQ ID NO: 209559 - DNA, 20 bp, human
gccaggaagagggatcccag

SEQ ID NO: 209560 - DNA, 20 bp, human
gagcctctctgaccgccctg

SEQ ID NO: 209561 - DNA, 20 bp, human
gggccgcagggcggtcagag

SEQ ID NO: 209562 - DNA, 20 bp, human
ggcggcccaccccgagttcc

SEQ ID NO: 209563 - DNA, 20 bp, human
ggctgtccgaagtctcgcga

SEQ ID NO: 209564 - DNA, 20 bp, human
gaaggagcctgcgtaggttt

SEQ ID NO: 209565 - DNA, 20 bp, human
ggggtctgtcgggagaattt

SEQ ID NO: 209566 - DNA, 20 bp, human
gacctggcccctgtgctcta

SEQ ID NO: 209567 - DNA, 20 bp, human
ggcacaggggccaggtctgt

SEQ ID NO: 209568 - DNA, 20 bp, human
gttgccaggatgcggtggat

SEQ ID NO: 209569 - DNA, 20 bp, human
gagctgggacttgggccccg

SEQ ID NO: 209570 - DNA, 20 bp, human
gttgcggaggagcagcgccc

SEQ ID NO: 209571 - DNA, 20 bp, human
gtgcggtggatcggttgcgg

SEQ ID NO: 209572 - DNA, 20 bp, human
gagtctgggcggtcagtacg

SEQ ID NO: 209573 - DNA, 20 bp, human
gctcagttgccaggatgcgg

SEQ ID NO: 209574 - DNA, 20 bp, human
gggatgcggtggatcggttg

SEQ ID NO: 209575 - DNA, 20 bp, human
gcgcctgccgcccgttgccc

SEQ ID NO: 209576 - DNA, 20 bp, human
gtgtcgttcggggacgatgg

SEQ ID NO: 209577 - DNA, 20 bp, human
gtacctgagcgagtgtcgtt

SEQ ID NO: 209578 - DNA, 20 bp, human
gaaccctgagagctgaccaa

SEQ ID NO: 209579 - DNA, 20 bp, human
gtcttccggaagacggttaa

SEQ ID NO: 209580 - DNA, 20 bp, human
gccccgaacgacactcgctc

SEQ ID NO: 209581 - DNA, 20 bp, human
ggggttctagcagcgtcttc

SEQ ID NO: 209582 - DNA, 20 bp, human
gtaccattggtcagctctca

SEQ ID NO: 209583 - DNA, 20 bp, human
gggacgcaaaagctgagtgg

SEQ ID NO: 209584 - DNA, 20 bp, human
ggagtgtcgttcggggacga

SEQ ID NO: 209585 - DNA, 20 bp, human
ggggttcctcgcacgttagt

SEQ ID NO: 209586 - DNA, 20 bp, human
gacagcgcagctccatggtg

SEQ ID NO: 209587 - DNA, 20 bp, human
gccgctctggccctgagagc

SEQ ID NO: 209588 - DNA, 20 bp, human
ggaaaacaagggttaggtta

SEQ ID NO: 209589 - DNA, 20 bp, human
gctagcccacgtggagaagg

SEQ ID NO: 209590 - DNA, 20 bp, human
gctgggggaaaacaagggtt

SEQ ID NO: 209591 - DNA, 20 bp, human
ggagagctgggggaaaacaa

SEQ ID NO: 209592 - DNA, 20 bp, human
ggcatcctcctgccccgctc

SEQ ID NO: 209593 - DNA, 20 bp, human
gaatctagcccacgtggaga

SEQ ID NO: 209594 - DNA, 20 bp, human
ggagtgccctatgaaacaaa

SEQ ID NO: 209595 - DNA, 20 bp, human
gtatggtggtgagtgtatct

SEQ ID NO: 209596 - DNA, 20 bp, human
ggctggtagtacccaggggt

SEQ ID NO: 209597 - DNA, 20 bp, human
ggggaagtgactgtacccag

SEQ ID NO: 209598 - DNA, 20 bp, human
gatggggagtgtaccctcta

SEQ ID NO: 209599 - DNA, 20 bp, human
gcagaggctggtagtaccca

SEQ ID NO: 209600 - DNA, 20 bp, human
gggtcaccaggcagccctga

SEQ ID NO: 209601 - DNA, 20 bp, human
gatggaataaataggatcgg

SEQ ID NO: 209602 - DNA, 20 bp, human
ggtggcctccgccctaggtg

SEQ ID NO: 209603 - DNA, 20 bp, human
gggcagccctgatggactga

SEQ ID NO: 209604 - DNA, 20 bp, human
gtgaaggactcttgtcccaa

SEQ ID NO: 209605 - DNA, 20 bp, human
gtgacaagacgactgaaaga

SEQ ID NO: 209606 - DNA, 20 bp, human
gagtcactgcggcctcgctg

SEQ ID NO: 209607 - DNA, 20 bp, human
gccgggtctggagccaagta

SEQ ID NO: 209608 - DNA, 20 bp, human
gctgaggcatgggccgggtc

SEQ ID NO: 209609 - DNA, 20 bp, human
gtgcggcctcgctgaggcat

SEQ ID NO: 209610 - DNA, 20 bp, human
gtggccaggaggagtcactg

SEQ ID NO: 209611 - DNA, 20 bp, human
gccaagtagggtagacacaa

SEQ ID NO: 209612 - DNA, 20 bp, human
gaggggaaaagacgaggaag

SEQ ID NO: 209613 - DNA, 20 bp, human
gcccggcccatgcctcagcg

SEQ ID NO: 209614 - DNA, 20 bp, human
gtatgcaaagcgtttcacat

SEQ ID NO: 209615 - DNA, 20 bp, human
ggcaagaggaggcccgccct

SEQ ID NO: 209616 - DNA, 20 bp, human
gcggtggggcggggcattgg

SEQ ID NO: 209617 - DNA, 20 bp, human
gggaactaggaggcgggcca

SEQ ID NO: 209618 - DNA, 20 bp, human
gttagcgcgcgagacagagg

SEQ ID NO: 209619 - DNA, 20 bp, human
gagggccaatcggagtaagg

SEQ ID NO: 209620 - DNA, 20 bp, human
gggccaataggagaggcctg

SEQ ID NO: 209621 - DNA, 20 bp, human
gcgggccacggtggaggcag

SEQ ID NO: 209622 - DNA, 20 bp, human
gctctgccggccaataggag

SEQ ID NO: 209623 - DNA, 20 bp, human
gcgcacggttctcgctgctg

SEQ ID NO: 209624 - DNA, 20 bp, human
gtggtgagtcctcggcactc

SEQ ID NO: 209625 - DNA, 20 bp, human
gcctgaggcctgaaggcggt

SEQ ID NO: 209626 - DNA, 20 bp, human
gcctccgcaggccgagacgt

SEQ ID NO: 209627 - DNA, 20 bp, human
ggcggaggggcgttacctga

SEQ ID NO: 209628 - DNA, 20 bp, human
gagccctaagagcgacaggg

SEQ ID NO: 209629 - DNA, 20 bp, human
gagcctccctgtcgctctta

SEQ ID NO: 209630 - DNA, 20 bp, human
gggcgggaccaagacggaac

SEQ ID NO: 209631 - DNA, 20 bp, human
ggcggcaggcgggaccaaga

SEQ ID NO: 209632 - DNA, 20 bp, human
ggtggagagctgtggcaatg

SEQ ID NO: 209633 - DNA, 20 bp, human
gaagacggaacaggaagcga

SEQ ID NO: 209634 - DNA, 20 bp, human
gaacaggaagcgacggaaag

SEQ ID NO: 209635 - DNA, 20 bp, human
gagtgtacgtgccgacgtct

SEQ ID NO: 209636 - DNA, 20 bp, human
gggaaccggctcggatgctc

SEQ ID NO: 209637 - DNA, 20 bp, human
gagcgcgcgcgggccagttc

SEQ ID NO: 209638 - DNA, 20 bp, human
ggccccgcggcggaacccga

SEQ ID NO: 209639 - DNA, 20 bp, human
gcgtccctgagcatccgagc

SEQ ID NO: 209640 - DNA, 20 bp, human
gtggagggagcacacaggaa

SEQ ID NO: 209641 - DNA, 20 bp, human
gaacgagggaacgccgggaa

SEQ ID NO: 209642 - DNA, 20 bp, human
ggggaaaggcagcctcaagc

SEQ ID NO: 209643 - DNA, 20 bp, human
gtcggatgctcagggacggt

SEQ ID NO: 209644 - DNA, 20 bp, human
gacgagccggggaatctgga

SEQ ID NO: 209645 - DNA, 20 bp, human
gcgcgcgggccagttcgggc

SEQ ID NO: 209646 - DNA, 20 bp, human
gggcccggagccgactgaga

SEQ ID NO: 209647 - DNA, 20 bp, human
gggccggtgcaccttcccca

SEQ ID NO: 209648 - DNA, 20 bp, human
gggcaccgcaccgtctcagt

SEQ ID NO: 209649 - DNA, 20 bp, human
gcctctggcccacttccggg

SEQ ID NO: 209650 - DNA, 20 bp, human
ggtacggtccgctcccacct

SEQ ID NO: 209651 - DNA, 20 bp, human
gtgccctggggaaggtgcac

SEQ ID NO: 209652 - DNA, 20 bp, human
gtgagctcgcaggctgttaa

SEQ ID NO: 209653 - DNA, 20 bp, human
gctcgcaggctgttaaagga

SEQ ID NO: 209654 - DNA, 20 bp, human
ggcaccgtctcagtcggctc

SEQ ID NO: 209655 - DNA, 20 bp, human
gtgggagcggaccgtacctc

SEQ ID NO: 209656 - DNA, 20 bp, human
ggacacccctggcacagtgc

SEQ ID NO: 209657 - DNA, 20 bp, human
ggggcgccctaggatcaagg

SEQ ID NO: 209658 - DNA, 20 bp, human
gcgccctaggatcaaggcgg

SEQ ID NO: 209659 - DNA, 20 bp, human
gcaggggcgccctaggatca

SEQ ID NO: 209660 - DNA, 20 bp, human
gggaacccgagccggctcaa

SEQ ID NO: 209661 - DNA, 20 bp, human
ggagccggctcaaaggtcag

SEQ ID NO: 209662 - DNA, 20 bp, human
ggcctctggcaaatagagtc

SEQ ID NO: 209663 - DNA, 20 bp, human
gtgggagaagaggctgctga

SEQ ID NO: 209664 - DNA, 20 bp, human
gctggcaaatagagtcaggc

SEQ ID NO: 209665 - DNA, 20 bp, human
gctcccccgccttgatccta

SEQ ID NO: 209666 - DNA, 20 bp, human
ggggcgctgggccagaaaca

SEQ ID NO: 209667 - DNA, 20 bp, human
gagtgcagtttgactgtagg

SEQ ID NO: 209668 - DNA, 20 bp, human
gccagaaacagggcatgtgg

SEQ ID NO: 209669 - DNA, 20 bp, human
ggcactgtatgactttgatt

SEQ ID NO: 209670 - DNA, 20 bp, human
gtacagagttcagtgggcgc

SEQ ID NO: 209671 - DNA, 20 bp, human
gtcctacagagactgtgtat

SEQ ID NO: 209672 - DNA, 20 bp, human
gcgattctgtgtagagagac

SEQ ID NO: 209673 - DNA, 20 bp, human
gaagaaaaaagtgataacgc

SEQ ID NO: 209674 - DNA, 20 bp, human
ggcctatacacagtctctgt

SEQ ID NO: 209675 - DNA, 20 bp, human
gtcagtaagcactgaatatc

SEQ ID NO: 209676 - DNA, 20 bp, human
gcagtggtataagtggggca

SEQ ID NO: 209677 - DNA, 20 bp, human
gccgccgggctgcatggcga

SEQ ID NO: 209678 - DNA, 20 bp, human
gtggcgacgggtgaccgcca

SEQ ID NO: 209679 - DNA, 20 bp, human
gtctactggcgccctcccgc

SEQ ID NO: 209680 - DNA, 20 bp, human
gtataagtggggcagggcga

SEQ ID NO: 209681 - DNA, 20 bp, human
ggccatgcagcccggcggga

SEQ ID NO: 209682 - DNA, 20 bp, human
gcacccgtcgccatgcagcc

SEQ ID NO: 209683 - DNA, 20 bp, human
gcgccccgcttgactcgttc

SEQ ID NO: 209684 - DNA, 20 bp, human
gggcgccagtagaggtgcct

SEQ ID NO: 209685 - DNA, 20 bp, human
gggcgctccgacggcaacaa

SEQ ID NO: 209686 - DNA, 20 bp, human
ggggcccggctcctccccgt

SEQ ID NO: 209687 - DNA, 20 bp, human
gtggcagtgaagggtccccg

SEQ ID NO: 209688 - DNA, 20 bp, human
gagaagccgcgtcttcccga

SEQ ID NO: 209689 - DNA, 20 bp, human
gggcggcgccgggtctggcg

SEQ ID NO: 209690 - DNA, 20 bp, human
gggcccctgactgctggaat

SEQ ID NO: 209691 - DNA, 20 bp, human
gcctccccgtcgggaagacg

SEQ ID NO: 209692 - DNA, 20 bp, human
ggtatcagggatcagatcag

SEQ ID NO: 209693 - DNA, 20 bp, human
gactacagaaacacggaggt

SEQ ID NO: 209694 - DNA, 20 bp, human
gttacccgacgcggccgggg

SEQ ID NO: 209695 - DNA, 20 bp, human
gcggagcttgaacttgaacg

SEQ ID NO: 209696 - DNA, 20 bp, human
gacgtcggggcaggagcggc

SEQ ID NO: 209697 - DNA, 20 bp, human
gggagccgggccacatgcgg

SEQ ID NO: 209698 - DNA, 20 bp, human
gtgcccctccgcgttgtctc

SEQ ID NO: 209699 - DNA, 20 bp, human
gccgtgccggagcgacgtcg

SEQ ID NO: 209700 - DNA, 20 bp, human
ggagcccgccgcatgtggcc

SEQ ID NO: 209701 - DNA, 20 bp, human
gggcacggcccggcggggta

SEQ ID NO: 209702 - DNA, 20 bp, human
gcggcggcccgcagtcgtgg

SEQ ID NO: 209703 - DNA, 20 bp, human
gtctgggccccgagccgtgc

SEQ ID NO: 209704 - DNA, 20 bp, human
gtccccggcgtcctccgcgc

SEQ ID NO: 209705 - DNA, 20 bp, human
gggacgccggggaggtgtcc

SEQ ID NO: 209706 - DNA, 20 bp, human
gcggtggccaacggctctgg

SEQ ID NO: 209707 - DNA, 20 bp, human
ggctacgtgccatcccccca

SEQ ID NO: 209708 - DNA, 20 bp, human
gcggcctcctcgggtggacg

SEQ ID NO: 209709 - DNA, 20 bp, human
gctgccccgtccacccgagg

SEQ ID NO: 209710 - DNA, 20 bp, human
ggaacgagcgcgcgcccgga

SEQ ID NO: 209711 - DNA, 20 bp, human
gtccacccgaggaggccgtc

SEQ ID NO: 209712 - DNA, 20 bp, human
ggtccggtggccaacggctc

SEQ ID NO: 209713 - DNA, 20 bp, human
gaagtggaaaactgaatctg

SEQ ID NO: 209714 - DNA, 20 bp, human
ggtgctgaatgaagggatga

SEQ ID NO: 209715 - DNA, 20 bp, human
ggaggccgtccggtggccaa

SEQ ID NO: 209716 - DNA, 20 bp, human
gggggctcgcaagaggacac

SEQ ID NO: 209717 - DNA, 20 bp, human
ggaggacactggtagatgtg

SEQ ID NO: 209718 - DNA, 20 bp, human
gctggggcggggctcgcaag

SEQ ID NO: 209719 - DNA, 20 bp, human
ggacactggtagatgtgggg

SEQ ID NO: 209720 - DNA, 20 bp, human
gaggaggaatacagcaccag

SEQ ID NO: 209721 - DNA, 20 bp, human
gaaccagcaggcgttgggga

SEQ ID NO: 209722 - DNA, 20 bp, human
gagatgggggcaaagaccga

SEQ ID NO: 209723 - DNA, 20 bp, human
ggggtccttaagaatagttg

SEQ ID NO: 209724 - DNA, 20 bp, human
ggaggagatgccagagtttc

SEQ ID NO: 209725 - DNA, 20 bp, human
gcaggggatccagagctgaa

SEQ ID NO: 209726 - DNA, 20 bp, human
gtgaccctcactgtgactaa

SEQ ID NO: 209727 - DNA, 20 bp, human
gactccccggggtccaacct

SEQ ID NO: 209728 - DNA, 20 bp, human
gcgggaagaggattggtagt

SEQ ID NO: 209729 - DNA, 20 bp, human
gatgccctcgggaagaggat

SEQ ID NO: 209730 - DNA, 20 bp, human
gaggaaaagcccaaactccc

SEQ ID NO: 209731 - DNA, 20 bp, human
gtccgcgggtctccttaaaa

SEQ ID NO: 209732 - DNA, 20 bp, human
gtaaaggtgtggctagaggg

SEQ ID NO: 209733 - DNA, 20 bp, human
gtcgtccagccgaatgagtt

SEQ ID NO: 209734 - DNA, 20 bp, human
gacaaagcccgcccctttta

SEQ ID NO: 209735 - DNA, 20 bp, human
gagggcgggtctagcctccg

SEQ ID NO: 209736 - DNA, 20 bp, human
gggaagggggggccgtgtcg

SEQ ID NO: 209737 - DNA, 20 bp, human
gaccgtgtcggggcgttgtt

SEQ ID NO: 209738 - DNA, 20 bp, human
gcctggtgaggggaccgtgt

SEQ ID NO: 209739 - DNA, 20 bp, human
gcccgccgccctcgcaataa

SEQ ID NO: 209740 - DNA, 20 bp, human
ggtaacctggcagaaggctg

SEQ ID NO: 209741 - DNA, 20 bp, human
gaggaggcccagaccatggg

SEQ ID NO: 209742 - DNA, 20 bp, human
gggtccgggccgggtgaccc

SEQ ID NO: 209743 - DNA, 20 bp, human
gcccctgcggggagactcgt

SEQ ID NO: 209744 - DNA, 20 bp, human
ggcgctgccccccatggtct

SEQ ID NO: 209745 - DNA, 20 bp, human
gccaccggcaagccatgatg

SEQ ID NO: 209746 - DNA, 20 bp, human
ggggacgcggaggggacacg

SEQ ID NO: 209747 - DNA, 20 bp, human
ggcggccgagggacacgctg

SEQ ID NO: 209748 - DNA, 20 bp, human
gtgggatccgctaacggacg

SEQ ID NO: 209749 - DNA, 20 bp, human
gccccagccccgtccgttag

SEQ ID NO: 209750 - DNA, 20 bp, human
gggacacgggggaaggacgc

SEQ ID NO: 209751 - DNA, 20 bp, human
gcgcgcgcggagagaggtgt

SEQ ID NO: 209752 - DNA, 20 bp, human
gcgcgcgccggcggaactgt

SEQ ID NO: 209753 - DNA, 20 bp, human
gggctcccccggaccgggtc

SEQ ID NO: 209754 - DNA, 20 bp, human
ggtccccccagcgtgtccct

SEQ ID NO: 209755 - DNA, 20 bp, human
gccaggctggggtcccgcga

SEQ ID NO: 209756 - DNA, 20 bp, human
gaagttagcagttgccgaga

SEQ ID NO: 209757 - DNA, 20 bp, human
gtaaaaggaagtgacatggg

SEQ ID NO: 209758 - DNA, 20 bp, human
gtccccttccaattagtgta

SEQ ID NO: 209759 - DNA, 20 bp, human
gctgccttacactaattgga

SEQ ID NO: 209760 - DNA, 20 bp, human
gtggggagagacgtcagctg

SEQ ID NO: 209761 - DNA, 20 bp, human
gcctgaagggtccaccccat

SEQ ID NO: 209762 - DNA, 20 bp, human
gagaaagcaaggccacttcc

SEQ ID NO: 209763 - DNA, 20 bp, human
gaaaagcgagactccaccca

SEQ ID NO: 209764 - DNA, 20 bp, human
gcgagactccacccatgggg

SEQ ID NO: 209765 - DNA, 20 bp, human
gctaacctcaacccagactc

SEQ ID NO: 209766 - DNA, 20 bp, human
ggctcccggcggcaaagcaa

SEQ ID NO: 209767 - DNA, 20 bp, human
ggaggtggaactatggcaac

SEQ ID NO: 209768 - DNA, 20 bp, human
gggccgggtaggcgagtgcg

SEQ ID NO: 209769 - DNA, 20 bp, human
gcggcgcggcccatgcggct

SEQ ID NO: 209770 - DNA, 20 bp, human
gggcgatgggtgagggtcat

SEQ ID NO: 209771 - DNA, 20 bp, human
gtggtggcgactgacggaac

SEQ ID NO: 209772 - DNA, 20 bp, human
ggggatgtggcgatgggtga

SEQ ID NO: 209773 - DNA, 20 bp, human
gaggcggccaatcaccgccc

SEQ ID NO: 209774 - DNA, 20 bp, human
gcctacccggccccgggcgg

SEQ ID NO: 209775 - DNA, 20 bp, human
gcgcggccctcccggatcga

SEQ ID NO: 209776 - DNA, 20 bp, human
ggacccgcggagtcgccctc

SEQ ID NO: 209777 - DNA, 20 bp, human
ggtgccgcgtggaccggtcg

SEQ ID NO: 209778 - DNA, 20 bp, human
ggtgccccctagtccgccag

SEQ ID NO: 209779 - DNA, 20 bp, human
ggggtcgcccaacccgcgac

SEQ ID NO: 209780 - DNA, 20 bp, human
gccgccagagggcgactccg

SEQ ID NO: 209781 - DNA, 20 bp, human
gaacccgcgaccggtccacg

SEQ ID NO: 209782 - DNA, 20 bp, human
gtcgccctctggcggactag

SEQ ID NO: 209783 - DNA, 20 bp, human
gtgggcggcgcagacaaagg

SEQ ID NO: 209784 - DNA, 20 bp, human
gcggcccgcgcgcgcccgac

SEQ ID NO: 209785 - DNA, 20 bp, human
gcgcgcccgacgggagcgtg

SEQ ID NO: 209786 - DNA, 20 bp, human
gagggaacctggctcgggga

SEQ ID NO: 209787 - DNA, 20 bp, human
ggagctcccccgttgggtga

SEQ ID NO: 209788 - DNA, 20 bp, human
gaaagtgcggtgctcccgca

SEQ ID NO: 209789 - DNA, 20 bp, human
gggtgctcccgcagggaacc

SEQ ID NO: 209790 - DNA, 20 bp, human
gagaacggagaccgcccagg

SEQ ID NO: 209791 - DNA, 20 bp, human
gcccgcagggaacctggctc

SEQ ID NO: 209792 - DNA, 20 bp, human
ggccagggagctcccccgtt

SEQ ID NO: 209793 - DNA, 20 bp, human
gtaaaacgaactcttggaaa

SEQ ID NO: 209794 - DNA, 20 bp, human
ggagggcagcgcgcagaaat

SEQ ID NO: 209795 - DNA, 20 bp, human
gggaagaacggagaccgccc

SEQ ID NO: 209796 - DNA, 20 bp, human
gccggcgcgaccattcgctg

SEQ ID NO: 209797 - DNA, 20 bp, human
gaaccctgggtggtgtcctc

SEQ ID NO: 209798 - DNA, 20 bp, human
gcacccgcgcccagcggttc

SEQ ID NO: 209799 - DNA, 20 bp, human
gggagcgccggcgcggtggg

SEQ ID NO: 209800 - DNA, 20 bp, human
gggtgaaaggtcactcagag

SEQ ID NO: 209801 - DNA, 20 bp, human
gcaccgcggcgacttggcgg

SEQ ID NO: 209802 - DNA, 20 bp, human
gaggcgtgacaagggagcgc

SEQ ID NO: 209803 - DNA, 20 bp, human
gcacccgaggacaccaccca

SEQ ID NO: 209804 - DNA, 20 bp, human
gtggaccgggctgggccaac

SEQ ID NO: 209805 - DNA, 20 bp, human
ggtggcctgggggctttcga

SEQ ID NO: 209806 - DNA, 20 bp, human
gaaatgcagcactagtgggt

SEQ ID NO: 209807 - DNA, 20 bp, human
gcaaggaactctttaaccca

SEQ ID NO: 209808 - DNA, 20 bp, human
ggcactagtgggtgggattg

SEQ ID NO: 209809 - DNA, 20 bp, human
gtgggcagagtgccaaatcc

SEQ ID NO: 209810 - DNA, 20 bp, human
gcccaagtgattatcttccc

SEQ ID NO: 209811 - DNA, 20 bp, human
gtgtgaaacgtattgttaag

SEQ ID NO: 209812 - DNA, 20 bp, human
gaagtaaatgcagcactagt

SEQ ID NO: 209813 - DNA, 20 bp, human
gttcaaagtctacctggatt

SEQ ID NO: 209814 - DNA, 20 bp, human
gagacatttgatttgcctga

SEQ ID NO: 209815 - DNA, 20 bp, human
ggtgggattgaggtatgccc

SEQ ID NO: 209816 - DNA, 20 bp, human
ggaaacaagagcatagttac

SEQ ID NO: 209817 - DNA, 20 bp, human
ggtgtgagaagcatgagaac

SEQ ID NO: 209818 - DNA, 20 bp, human
gcccaaggtagtttaatgtt

SEQ ID NO: 209819 - DNA, 20 bp, human
gtatgctcttgtttctatgc

SEQ ID NO: 209820 - DNA, 20 bp, human
gggaatttctatttgaacaa

SEQ ID NO: 209821 - DNA, 20 bp, human
gtaagggttactctgtttac

SEQ ID NO: 209822 - DNA, 20 bp, human
ggcaggtgaggttgtaggtc

SEQ ID NO: 209823 - DNA, 20 bp, human
gtcttgtttctatgcaggtg

SEQ ID NO: 209824 - DNA, 20 bp, human
gtctatgcaggtgaggttgt

SEQ ID NO: 209825 - DNA, 20 bp, human
gagagaaagaagcacaaaga

SEQ ID NO: 209826 - DNA, 20 bp, human
gcgtcccggggctttgttcg

SEQ ID NO: 209827 - DNA, 20 bp, human
ggcgccgggcgctgcgtccc

SEQ ID NO: 209828 - DNA, 20 bp, human
ggcggccgtggggcgggaaa

SEQ ID NO: 209829 - DNA, 20 bp, human
gccgcggccccccggaagtg

SEQ ID NO: 209830 - DNA, 20 bp, human
gtcggtgtccggccccgcgg

SEQ ID NO: 209831 - DNA, 20 bp, human
ggtgcagccgcacttccggg

SEQ ID NO: 209832 - DNA, 20 bp, human
gaatctggaggagacgtgac

SEQ ID NO: 209833 - DNA, 20 bp, human
gccgccgcgaacaaagcccc

SEQ ID NO: 209834 - DNA, 20 bp, human
gccggccgagcctcggtgtc

SEQ ID NO: 209835 - DNA, 20 bp, human
gacgtgacgggactgccgag

SEQ ID NO: 209836 - DNA, 20 bp, human
ggctcaggttcagggagtga

SEQ ID NO: 209837 - DNA, 20 bp, human
gagtgcctatctccaatttg

SEQ ID NO: 209838 - DNA, 20 bp, human
gctccaggaagggtccttca

SEQ ID NO: 209839 - DNA, 20 bp, human
gctcaccccaaattggagat

SEQ ID NO: 209840 - DNA, 20 bp, human
gcgggtcaaggacattggag

SEQ ID NO: 209841 - DNA, 20 bp, human
gtggaaacctcaccccaaat

SEQ ID NO: 209842 - DNA, 20 bp, human
ggaaacaacatgccacatag

SEQ ID NO: 209843 - DNA, 20 bp, human
gctcctaggtccctgtcctg

SEQ ID NO: 209844 - DNA, 20 bp, human
ggggttgagtaagcatctct

SEQ ID NO: 209845 - DNA, 20 bp, human
gtatggcagggcctaatgaa

SEQ ID NO: 209846 - DNA, 20 bp, human
gtcacgctgggacctcttcc

SEQ ID NO: 209847 - DNA, 20 bp, human
gccagaagcgacactcacgc

SEQ ID NO: 209848 - DNA, 20 bp, human
ggaccctgctgcccgctcat

SEQ ID NO: 209849 - DNA, 20 bp, human
gagcctgaggccaaccaccc

SEQ ID NO: 209850 - DNA, 20 bp, human
gaacagagtgagccggtgca

SEQ ID NO: 209851 - DNA, 20 bp, human
gggcctgggtggttggcctc

SEQ ID NO: 209852 - DNA, 20 bp, human
ggaaacgggagcatctccct

SEQ ID NO: 209853 - DNA, 20 bp, human
gagaccacaggctggccaga

SEQ ID NO: 209854 - DNA, 20 bp, human
ggtgtaactcgaccctgcac

SEQ ID NO: 209855 - DNA, 20 bp, human
gcacccctcagctataaata

SEQ ID NO: 209856 - DNA, 20 bp, human
gtgcgaggccgcgaaagggg

SEQ ID NO: 209857 - DNA, 20 bp, human
gtcccagcacgcgcagggag

SEQ ID NO: 209858 - DNA, 20 bp, human
gtctctgcgcgcctgacggg

SEQ ID NO: 209859 - DNA, 20 bp, human
ggcgcgcacggaggtaacaa

SEQ ID NO: 209860 - DNA, 20 bp, human
ggcgtgcgaggccgcgaaag

SEQ ID NO: 209861 - DNA, 20 bp, human
gcgcacgggagcgggaatta

SEQ ID NO: 209862 - DNA, 20 bp, human
gaagggacgcggcgggaaga

SEQ ID NO: 209863 - DNA, 20 bp, human
gcgggagcgggaattagggg

SEQ ID NO: 209864 - DNA, 20 bp, human
gacggaggtaacaagggacg

SEQ ID NO: 209865 - DNA, 20 bp, human
gtggcaaggcgtgcggtggg

SEQ ID NO: 209866 - DNA, 20 bp, human
gtcccgagagggaggaggtt

SEQ ID NO: 209867 - DNA, 20 bp, human
gcaaaacagagcctcgtccc

SEQ ID NO: 209868 - DNA, 20 bp, human
gcccgaaccccgcctagcga

SEQ ID NO: 209869 - DNA, 20 bp, human
gggaggaggttgggccggga

SEQ ID NO: 209870 - DNA, 20 bp, human
gctaggcggggttcgggacc

SEQ ID NO: 209871 - DNA, 20 bp, human
ggcctagcgaggggtcgtga

SEQ ID NO: 209872 - DNA, 20 bp, human
gctgccgtcaatatcccgag

SEQ ID NO: 209873 - DNA, 20 bp, human
gctccctctcgggatattga

SEQ ID NO: 209874 - DNA, 20 bp, human
gcccctcgctaggcggggtt

SEQ ID NO: 209875 - DNA, 20 bp, human
gctgatctgatagttgacac

SEQ ID NO: 209876 - DNA, 20 bp, human
gttgaagtcagtggcttact

SEQ ID NO: 209877 - DNA, 20 bp, human
gacagaccaaacatataaga

SEQ ID NO: 209878 - DNA, 20 bp, human
gctagaattatgtaggttga

SEQ ID NO: 209879 - DNA, 20 bp, human
gttgaatgagctgttatgat

SEQ ID NO: 209880 - DNA, 20 bp, human
gaaattctctagcacatttg

SEQ ID NO: 209881 - DNA, 20 bp, human
ggtaggttgaaggctcccag

SEQ ID NO: 209882 - DNA, 20 bp, human
gagtcagtggcttacttggt

SEQ ID NO: 209883 - DNA, 20 bp, human
gcaaaaactgcgcaaagcaa

SEQ ID NO: 209884 - DNA, 20 bp, human
gtatgtttggtctgtccact

SEQ ID NO: 209885 - DNA, 20 bp, human
gaaattagtgagtagagact

SEQ ID NO: 209886 - DNA, 20 bp, human
gcggcccccaagtactgcct

SEQ ID NO: 209887 - DNA, 20 bp, human
gtctcctagcaaccaagcgg

SEQ ID NO: 209888 - DNA, 20 bp, human
gcaccgcccaggcagtactt

SEQ ID NO: 209889 - DNA, 20 bp, human
gggttgctaggagacggcgt

SEQ ID NO: 209890 - DNA, 20 bp, human
gccgtctcctagcaaccaag

SEQ ID NO: 209891 - DNA, 20 bp, human
ggagtctggagcttggctga

SEQ ID NO: 209892 - DNA, 20 bp, human
ggcccagggcgtatcctgcc

SEQ ID NO: 209893 - DNA, 20 bp, human
gacgtgaaacgggctggagc

SEQ ID NO: 209894 - DNA, 20 bp, human
gagctcaagaccacgtgaaa

SEQ ID NO: 209895 - DNA, 20 bp, human
gtgaccgccgcttggttgct

SEQ ID NO: 209896 - DNA, 20 bp, human
gagtgggagcgaggagggct

SEQ ID NO: 209897 - DNA, 20 bp, human
gactcagagtgggagcgagg

SEQ ID NO: 209898 - DNA, 20 bp, human
gtgtgctgcgggtcacggcc

SEQ ID NO: 209899 - DNA, 20 bp, human
gaggactcagagtgggagcg

SEQ ID NO: 209900 - DNA, 20 bp, human
gccctgctgggaaatattcc

SEQ ID NO: 209901 - DNA, 20 bp, human
gcttatctgtgcttgtgctg

SEQ ID NO: 209902 - DNA, 20 bp, human
gcccagcagggcggacacag

SEQ ID NO: 209903 - DNA, 20 bp, human
ggctttgcaagcacgcagca

SEQ ID NO: 209904 - DNA, 20 bp, human
gagcacagataattgaggct

SEQ ID NO: 209905 - DNA, 20 bp, human
gtaagaggggctggacgtgc

SEQ ID NO: 209906 - DNA, 20 bp, human
gtacccggatgaaactccga

SEQ ID NO: 209907 - DNA, 20 bp, human
gtaaaaggggaatcctggag

SEQ ID NO: 209908 - DNA, 20 bp, human
gctagaaatagagagctctg

SEQ ID NO: 209909 - DNA, 20 bp, human
gggcgctaaaaggggaatcc

SEQ ID NO: 209910 - DNA, 20 bp, human
gggggaggaggcgctaaaag

SEQ ID NO: 209911 - DNA, 20 bp, human
gggtgactgcccatggcttc

SEQ ID NO: 209912 - DNA, 20 bp, human
gaacccccatggaagcagat

SEQ ID NO: 209913 - DNA, 20 bp, human
gcatgggcagtcaccactcc

SEQ ID NO: 209914 - DNA, 20 bp, human
gccccatggaagcagattgg

SEQ ID NO: 209915 - DNA, 20 bp, human
gatagtgagcagttagagcc

SEQ ID NO: 209916 - DNA, 20 bp, human
ggggaccagagttctcgcga

SEQ ID NO: 209917 - DNA, 20 bp, human
gttcacgcgcaaggcactgt

SEQ ID NO: 209918 - DNA, 20 bp, human
gggaaccatcgcgagaactc

SEQ ID NO: 209919 - DNA, 20 bp, human
gtcaaactctcggtgaaaga

SEQ ID NO: 209920 - DNA, 20 bp, human
gtggttccgcgctctagcgc

SEQ ID NO: 209921 - DNA, 20 bp, human
gtgcaatcgcagcaggcggc

SEQ ID NO: 209922 - DNA, 20 bp, human
gctcggtgaaagaaggaggt

SEQ ID NO: 209923 - DNA, 20 bp, human
ggagggaggggagaaccggc

SEQ ID NO: 209924 - DNA, 20 bp, human
ggcgggagatcgcggctgca

SEQ ID NO: 209925 - DNA, 20 bp, human
gccccgtgcgcagttgggag

SEQ ID NO: 209926 - DNA, 20 bp, human
gccccaggagtctcactcac

SEQ ID NO: 209927 - DNA, 20 bp, human
gccggcgctcccttccggac

SEQ ID NO: 209928 - DNA, 20 bp, human
ggggcggggcccaacgcgca

SEQ ID NO: 209929 - DNA, 20 bp, human
gctctcccggcgctcccttc

SEQ ID NO: 209930 - DNA, 20 bp, human
gggagtctcactcaccggtc

SEQ ID NO: 209931 - DNA, 20 bp, human
gctcactcaccggtccggaa

SEQ ID NO: 209932 - DNA, 20 bp, human
ggacggcccggctggctctc

SEQ ID NO: 209933 - DNA, 20 bp, human
gaaccagcgagaggacggcc

SEQ ID NO: 209934 - DNA, 20 bp, human
gagccgggccgtcctctcgc

SEQ ID NO: 209935 - DNA, 20 bp, human
gcggggcccaacgcgcaggg

SEQ ID NO: 209936 - DNA, 20 bp, human
ggaacctcgcgctgctccca

SEQ ID NO: 209937 - DNA, 20 bp, human
gctcgagagcgaagttccca

SEQ ID NO: 209938 - DNA, 20 bp, human
gtactggcagctcccgggag

SEQ ID NO: 209939 - DNA, 20 bp, human
ggtgacgccacgtcaagtac

SEQ ID NO: 209940 - DNA, 20 bp, human
gctgcggaacggagggtctt

SEQ ID NO: 209941 - DNA, 20 bp, human
ggcgcatgaaaggggtgttt

SEQ ID NO: 209942 - DNA, 20 bp, human
ggagctgccagtacttgacg

SEQ ID NO: 209943 - DNA, 20 bp, human
gggttcatgcaacgatgctg

SEQ ID NO: 209944 - DNA, 20 bp, human
gaaacacgcacgcaaagcga

SEQ ID NO: 209945 - DNA, 20 bp, human
ggtcgtgacgtcaccacgct

SEQ ID NO: 209946 - DNA, 20 bp, human
gcaagggtcaaactactctt

SEQ ID NO: 209947 - DNA, 20 bp, human
ggtgaagtgtttagtcttac

SEQ ID NO: 209948 - DNA, 20 bp, human
ggcctcgattactcattgac

SEQ ID NO: 209949 - DNA, 20 bp, human
ggggactgagaaaagaagta

SEQ ID NO: 209950 - DNA, 20 bp, human
gaactgctgagtcacttaaa

SEQ ID NO: 209951 - DNA, 20 bp, human
gtaagtgactcagcagtttg

SEQ ID NO: 209952 - DNA, 20 bp, human
ggcagtaagtaggacagaaa

SEQ ID NO: 209953 - DNA, 20 bp, human
ggaagaggtgaggcaatacc

SEQ ID NO: 209954 - DNA, 20 bp, human
gacaggtcaggcaactaggt

SEQ ID NO: 209955 - DNA, 20 bp, human
gctgagtcacttaaaaggta

SEQ ID NO: 209956 - DNA, 20 bp, human
gaggccagaccgggacgggg

SEQ ID NO: 209957 - DNA, 20 bp, human
ggactggcgggcggagaaag

SEQ ID NO: 209958 - DNA, 20 bp, human
gtgactcgacggaggggatg

SEQ ID NO: 209959 - DNA, 20 bp, human
ggggcgcgcagtgtaggtcg

SEQ ID NO: 209960 - DNA, 20 bp, human
gcacgcggcgagaagaccgt

SEQ ID NO: 209961 - DNA, 20 bp, human
ggggccggcagctaacagaa

SEQ ID NO: 209962 - DNA, 20 bp, human
gaggggaggggaagtggtag

SEQ ID NO: 209963 - DNA, 20 bp, human
ggagaagaccgtgggacctc

SEQ ID NO: 209964 - DNA, 20 bp, human
gccgaggagagggagcgcta

SEQ ID NO: 209965 - DNA, 20 bp, human
ggtgaggataggtgactcga

SEQ ID NO: 209966 - DNA, 20 bp, human
ggccgcgccggctgctccga

SEQ ID NO: 209967 - DNA, 20 bp, human
gcggggtctgagagtggaat

SEQ ID NO: 209968 - DNA, 20 bp, human
gaaggggcggggtctgagag

SEQ ID NO: 209969 - DNA, 20 bp, human
gcccggggaccccgcgcctg

SEQ ID NO: 209970 - DNA, 20 bp, human
ggggctcctggccgcgccgt

SEQ ID NO: 209971 - DNA, 20 bp, human
ggggcgaagatcctccccaa

SEQ ID NO: 209972 - DNA, 20 bp, human
gcagacgagccccaggcgcg

SEQ ID NO: 209973 - DNA, 20 bp, human
gtcccccctggggttccgga

SEQ ID NO: 209974 - DNA, 20 bp, human
ggccggctgctccgacggcg

SEQ ID NO: 209975 - DNA, 20 bp, human
gtcaccatccggaaccccag

SEQ ID NO: 209976 - DNA, 20 bp, human
gtcctcctggaagaaggcgg

SEQ ID NO: 209977 - DNA, 20 bp, human
gcctagagcgcgggacgcat

SEQ ID NO: 209978 - DNA, 20 bp, human
ggcgctctaggcgaagaccg

SEQ ID NO: 209979 - DNA, 20 bp, human
gtccaggaggaggggccgtg

SEQ ID NO: 209980 - DNA, 20 bp, human
ggggccgtgcggcgcctgcc

SEQ ID NO: 209981 - DNA, 20 bp, human
ggcactgcggcacagagccg

SEQ ID NO: 209982 - DNA, 20 bp, human
ggggtcgctggcgggttagg

SEQ ID NO: 209983 - DNA, 20 bp, human
ggaaaactcaagactctgta

SEQ ID NO: 209984 - DNA, 20 bp, human
gcgcctgcccgggggccctc

SEQ ID NO: 209985 - DNA, 20 bp, human
ggggacgcatcggtcgccat

SEQ ID NO: 209986 - DNA, 20 bp, human
ggggctgggactggcgagcg

SEQ ID NO: 209987 - DNA, 20 bp, human
ggggggcagtggatgcgggg

SEQ ID NO: 209988 - DNA, 20 bp, human
gacagggggcagtggatgcg

SEQ ID NO: 209989 - DNA, 20 bp, human
gcggagcaagctgacggtcg

SEQ ID NO: 209990 - DNA, 20 bp, human
gcaggtccgggacaggacag

SEQ ID NO: 209991 - DNA, 20 bp, human
gtcgggcgggcgggtctgcc

SEQ ID NO: 209992 - DNA, 20 bp, human
gtggagagcaggtccaggtc

SEQ ID NO: 209993 - DNA, 20 bp, human
gatgtccccgcgtcccccag

SEQ ID NO: 209994 - DNA, 20 bp, human
gaagctgagagaaaactcaa

SEQ ID NO: 209995 - DNA, 20 bp, human
gagaacgcgagaaatgggcg

SEQ ID NO: 209996 - DNA, 20 bp, human
gaccactcctccctgagttc

SEQ ID NO: 209997 - DNA, 20 bp, human
gcgggcttggcgtgggagga

SEQ ID NO: 209998 - DNA, 20 bp, human
gggaaagcgccgcctccgga

SEQ ID NO: 209999 - DNA, 20 bp, human
gccaactcccaaacccgtcc

SEQ ID NO: 210000 - DNA, 20 bp, human
gtctggtttgaattagtcac

SEQ ID NO: 210001 - DNA, 20 bp, human
gcaaacccgtccgggcggga

SEQ ID NO: 210002 - DNA, 20 bp, human
gcgccgcctccggaggggaa

SEQ ID NO: 210003 - DNA, 20 bp, human
ggggctggtggtacagaaca

SEQ ID NO: 210004 - DNA, 20 bp, human
gggggccatcccgcccggac

SEQ ID NO: 210005 - DNA, 20 bp, human
gctcccaaacccgtccgggc

SEQ ID NO: 210006 - DNA, 20 bp, human
gagtgggcgggtcccctgat

SEQ ID NO: 210007 - DNA, 20 bp, human
gcaggctcctggcccatcag

SEQ ID NO: 210008 - DNA, 20 bp, human
gacccccacatcccaccaga

SEQ ID NO: 210009 - DNA, 20 bp, human
gactccctctggtgggatgt

SEQ ID NO: 210010 - DNA, 20 bp, human
ggcagaggcgggacaatggg

SEQ ID NO: 210011 - DNA, 20 bp, human
gcccaccagagggagtgggc

SEQ ID NO: 210012 - DNA, 20 bp, human
gctaaggcactcaccagact

SEQ ID NO: 210013 - DNA, 20 bp, human
gaagaagctgagtgagtgtt

SEQ ID NO: 210014 - DNA, 20 bp, human
gctggctgtgtgactcagag

SEQ ID NO: 210015 - DNA, 20 bp, human
ggcagtcagctgctcaggct

SEQ ID NO: 210016 - DNA, 20 bp, human
gcagccctgccgggccactg

SEQ ID NO: 210017 - DNA, 20 bp, human
ggctccgcagtggcccggca

SEQ ID NO: 210018 - DNA, 20 bp, human
gagcgcgctccgcagtggcc

SEQ ID NO: 210019 - DNA, 20 bp, human
ggcagcctgcggggacaaca

SEQ ID NO: 210020 - DNA, 20 bp, human
ggagtccaaagttaattctg

SEQ ID NO: 210021 - DNA, 20 bp, human
gcgctcgcgggcggtgccgt

SEQ ID NO: 210022 - DNA, 20 bp, human
gcctcggtgcggggatccag

SEQ ID NO: 210023 - DNA, 20 bp, human
gcggacgcgacaggcgggcc

SEQ ID NO: 210024 - DNA, 20 bp, human
ggcgtccgcagaattaactt

SEQ ID NO: 210025 - DNA, 20 bp, human
gtcggcctcattcagcccat

SEQ ID NO: 210026 - DNA, 20 bp, human
gggaatggaatccagatggg

SEQ ID NO: 210027 - DNA, 20 bp, human
ggggctacgcgggatctggg

SEQ ID NO: 210028 - DNA, 20 bp, human
gcacgtgccgggatgagggt

SEQ ID NO: 210029 - DNA, 20 bp, human
gtcccggcacgtgatgacgt

SEQ ID NO: 210030 - DNA, 20 bp, human
ggccctcaaggaagacggaa

SEQ ID NO: 210031 - DNA, 20 bp, human
gtaaggacgcccccccccgc

SEQ ID NO: 210032 - DNA, 20 bp, human
gcacgaagatggctaccggc

SEQ ID NO: 210033 - DNA, 20 bp, human
gtatgcacgaagatggctac

SEQ ID NO: 210034 - DNA, 20 bp, human
gatggaatccagatgggcgg

SEQ ID NO: 210035 - DNA, 20 bp, human
gcgtgatgacgtaggacgta

SEQ ID NO: 210036 - DNA, 20 bp, human
gggtccggctgtctcgggtc

SEQ ID NO: 210037 - DNA, 20 bp, human
ggggaaccggatggcgtctc

SEQ ID NO: 210038 - DNA, 20 bp, human
gacgccatccggttcccctg

SEQ ID NO: 210039 - DNA, 20 bp, human
gcagagggcgcccgcgggtc

SEQ ID NO: 210040 - DNA, 20 bp, human
gcccgcgggtccggctgtct

SEQ ID NO: 210041 - DNA, 20 bp, human
gtcggggcacggagactccg

SEQ ID NO: 210042 - DNA, 20 bp, human
ggggcggtgtagacccgaac

SEQ ID NO: 210043 - DNA, 20 bp, human
gtctccgtgccccgaggcgg

SEQ ID NO: 210044 - DNA, 20 bp, human
gcagccggacccgagacagc

SEQ ID NO: 210045 - DNA, 20 bp, human
ggggatcactgggacgcgaa

SEQ ID NO: 210046 - DNA, 20 bp, human
gtgggacggaagtaaccggt

SEQ ID NO: 210047 - DNA, 20 bp, human
ggaagtaaccggtgggagtg

SEQ ID NO: 210048 - DNA, 20 bp, human
ggcggaagggaataatcgta

SEQ ID NO: 210049 - DNA, 20 bp, human
gagaacccgatggagtctga

SEQ ID NO: 210050 - DNA, 20 bp, human
gaacccacggtgcggcgagt

SEQ ID NO: 210051 - DNA, 20 bp, human
gtcaggcggaacccacggtg

SEQ ID NO: 210052 - DNA, 20 bp, human
gaggagccggaagttaagga

SEQ ID NO: 210053 - DNA, 20 bp, human
ggagttgggacggaagtaac

SEQ ID NO: 210054 - DNA, 20 bp, human
gcgcggaaggtctcgcggaa

SEQ ID NO: 210055 - DNA, 20 bp, human
gacaaccattcctcacccat

SEQ ID NO: 210056 - DNA, 20 bp, human
ggagacgcgcagcggaaccc

SEQ ID NO: 210057 - DNA, 20 bp, human
gacgcgcagcggaaccccgg

SEQ ID NO: 210058 - DNA, 20 bp, human
gcgacccgcctcccagatcc

SEQ ID NO: 210059 - DNA, 20 bp, human
ggggcgggacggggctgtct

SEQ ID NO: 210060 - DNA, 20 bp, human
gtgcgcgtctcctaacgcta

SEQ ID NO: 210061 - DNA, 20 bp, human
ggaagcagggcgctgagtag

SEQ ID NO: 210062 - DNA, 20 bp, human
ggccccagccgggatctggg

SEQ ID NO: 210063 - DNA, 20 bp, human
gtgtctgggccgcctgcgaa

SEQ ID NO: 210064 - DNA, 20 bp, human
ggcctcccagatcccggctg

SEQ ID NO: 210065 - DNA, 20 bp, human
ggccctccgcccttcgcagg

SEQ ID NO: 210066 - DNA, 20 bp, human
gaaacaggttaggacatcgc

SEQ ID NO: 210067 - DNA, 20 bp, human
gtaacctgtttgcttttcca

SEQ ID NO: 210068 - DNA, 20 bp, human
gtggactttggcagatttct

SEQ ID NO: 210069 - DNA, 20 bp, human
gtcctctgctgccaaaccca

SEQ ID NO: 210070 - DNA, 20 bp, human
gttccaagaggagtcctaca

SEQ ID NO: 210071 - DNA, 20 bp, human
gcaaaggtacagatgtgtat

SEQ ID NO: 210072 - DNA, 20 bp, human
gtggggtctgtgagagggaa

SEQ ID NO: 210073 - DNA, 20 bp, human
ggtgatctgagcatgccatg

SEQ ID NO: 210074 - DNA, 20 bp, human
gagtcagcctcagagtgcca

SEQ ID NO: 210075 - DNA, 20 bp, human
gccatgttccaagcagactt

SEQ ID NO: 210076 - DNA, 20 bp, human
gagggtgataggtcattcta

SEQ ID NO: 210077 - DNA, 20 bp, human
ggtgataggtcattctaggg

SEQ ID NO: 210078 - DNA, 20 bp, human
gggtcctgaaggagggtgat

SEQ ID NO: 210079 - DNA, 20 bp, human
gcaggaacatgcccctggtt

SEQ ID NO: 210080 - DNA, 20 bp, human
gtgcatctaggtcctgaagg

SEQ ID NO: 210081 - DNA, 20 bp, human
gccctgcatctaggtcctga

SEQ ID NO: 210082 - DNA, 20 bp, human
gtgaaggtagaaagataaca

SEQ ID NO: 210083 - DNA, 20 bp, human
ggaaggcaagagccaaacca

SEQ ID NO: 210084 - DNA, 20 bp, human
gtgcagggcgtttctatctt

SEQ ID NO: 210085 - DNA, 20 bp, human
gatagaaacgccctgcatct

SEQ ID NO: 210086 - DNA, 20 bp, human
ggggtgggtggggctgtcat

SEQ ID NO: 210087 - DNA, 20 bp, human
gtcaggggaggagcccaaaa

SEQ ID NO: 210088 - DNA, 20 bp, human
gggatccagtgaagatgggt

SEQ ID NO: 210089 - DNA, 20 bp, human
gcccacccacccatcttcac

SEQ ID NO: 210090 - DNA, 20 bp, human
ggatttggatccagtgaaga

SEQ ID NO: 210091 - DNA, 20 bp, human
ggccgttggggtacctggtg

SEQ ID NO: 210092 - DNA, 20 bp, human
gaaagcagagctgccctcaa

SEQ ID NO: 210093 - DNA, 20 bp, human
ggtgggggtgatgctgtcag

SEQ ID NO: 210094 - DNA, 20 bp, human
gtttagagcagcagccccaa

SEQ ID NO: 210095 - DNA, 20 bp, human
gacacaggttaaaccattga

SEQ ID NO: 210096 - DNA, 20 bp, human
gctattgcggcattctccct

SEQ ID NO: 210097 - DNA, 20 bp, human
ggagaatgccgcaatagcga

SEQ ID NO: 210098 - DNA, 20 bp, human
gaaccgagactacagaacca

SEQ ID NO: 210099 - DNA, 20 bp, human
gtccctcggctccggaggta

SEQ ID NO: 210100 - DNA, 20 bp, human
gccgccgggtcacgtgactc

SEQ ID NO: 210101 - DNA, 20 bp, human
gcccctacctccggagccga

SEQ ID NO: 210102 - DNA, 20 bp, human
gcggcattctccctcggctc

SEQ ID NO: 210103 - DNA, 20 bp, human
gtgagactccggggaagtag

SEQ ID NO: 210104 - DNA, 20 bp, human
gagggccgccatcgctattg

SEQ ID NO: 210105 - DNA, 20 bp, human
ggagccgcaaagtttggctg

SEQ ID NO: 210106 - DNA, 20 bp, human
gagggtgtaaggagctagag

SEQ ID NO: 210107 - DNA, 20 bp, human
gactgtaggcggtggagaca

SEQ ID NO: 210108 - DNA, 20 bp, human
ggtggaggagacaacgtgga

SEQ ID NO: 210109 - DNA, 20 bp, human
gggcagcggcattagatcgg

SEQ ID NO: 210110 - DNA, 20 bp, human
gtgggcaggcagctgtggat

SEQ ID NO: 210111 - DNA, 20 bp, human
gaaagggaccgcagtgtggc

SEQ ID NO: 210112 - DNA, 20 bp, human
gataggcagcggcattagat

SEQ ID NO: 210113 - DNA, 20 bp, human
ggtgagggggaaactgtagg

SEQ ID NO: 210114 - DNA, 20 bp, human
ggtgtcagcagaacctgatg

SEQ ID NO: 210115 - DNA, 20 bp, human
ggagttgaggggccccgcta

SEQ ID NO: 210116 - DNA, 20 bp, human
gctccagcagaggggtcggc

SEQ ID NO: 210117 - DNA, 20 bp, human
gcgctccgcgggcttcaaag

SEQ ID NO: 210118 - DNA, 20 bp, human
gacttgctgaggtccgggga

SEQ ID NO: 210119 - DNA, 20 bp, human
gcttcaaagcggctattatg

SEQ ID NO: 210120 - DNA, 20 bp, human
gttgaagcccgcggagcggg

SEQ ID NO: 210121 - DNA, 20 bp, human
gagcccgcggagcgggtggc

SEQ ID NO: 210122 - DNA, 20 bp, human
gcagcagaggggtcggccgg

SEQ ID NO: 210123 - DNA, 20 bp, human
gacccctctgctggaggacg

SEQ ID NO: 210124 - DNA, 20 bp, human
gtgaggaccaagtgccgtcg

SEQ ID NO: 210125 - DNA, 20 bp, human
gtagcatgaactccatgggg

SEQ ID NO: 210126 - DNA, 20 bp, human
ggaaggggaacggcgaccgg

SEQ ID NO: 210127 - DNA, 20 bp, human
ggtgcggaccaatcgcaatg

SEQ ID NO: 210128 - DNA, 20 bp, human
gctcgctgccgcattgcgat

SEQ ID NO: 210129 - DNA, 20 bp, human
gtgttcaaggagggactcgt

SEQ ID NO: 210130 - DNA, 20 bp, human
gcgcaagctcgcaaagacgc

SEQ ID NO: 210131 - DNA, 20 bp, human
gagtgctacgcctgcgcagt

SEQ ID NO: 210132 - DNA, 20 bp, human
gcctcctcccagctccgggt

SEQ ID NO: 210133 - DNA, 20 bp, human
ggaccggaggcctactgcgc

SEQ ID NO: 210134 - DNA, 20 bp, human
gcgcctgcgcagtaggcctc

SEQ ID NO: 210135 - DNA, 20 bp, human
gcgcaaatcctctcgccgtg

SEQ ID NO: 210136 - DNA, 20 bp, human
gaaacggtcctggcacgctg

SEQ ID NO: 210137 - DNA, 20 bp, human
gcaggccccggaaacggtcc

SEQ ID NO: 210138 - DNA, 20 bp, human
gcgtgccaggaccgtttccg

SEQ ID NO: 210139 - DNA, 20 bp, human
ggctggggctggtctccgaa

SEQ ID NO: 210140 - DNA, 20 bp, human
gagggtcaaggttagtccgg

SEQ ID NO: 210141 - DNA, 20 bp, human
gaaccttgaccctgagcgaa

SEQ ID NO: 210142 - DNA, 20 bp, human
ggagccggagaggcgacatc

SEQ ID NO: 210143 - DNA, 20 bp, human
ggaatggctcggcaggactg

SEQ ID NO: 210144 - DNA, 20 bp, human
gctgccgagccattcagact

SEQ ID NO: 210145 - DNA, 20 bp, human
gcaacgccccggccaggccc

SEQ ID NO: 210146 - DNA, 20 bp, human
gctctgtggtgaacagaagt

SEQ ID NO: 210147 - DNA, 20 bp, human
gcccgggcctgatggggtta

SEQ ID NO: 210148 - DNA, 20 bp, human
gcggccagcccgggcctgat

SEQ ID NO: 210149 - DNA, 20 bp, human
gtggggctgggccagtccac

SEQ ID NO: 210150 - DNA, 20 bp, human
gcctggtgggcgtttgtgaa

SEQ ID NO: 210151 - DNA, 20 bp, human
gtggctgctgggcacaggcg

SEQ ID NO: 210152 - DNA, 20 bp, human
ggccctgcaaggtgccctgg

SEQ ID NO: 210153 - DNA, 20 bp, human
gcccctaaccccatcaggcc

SEQ ID NO: 210154 - DNA, 20 bp, human
gtccctggggaccagtggac

SEQ ID NO: 210155 - DNA, 20 bp, human
ggggccttagggtgatatgg

SEQ ID NO: 210156 - DNA, 20 bp, human
gactccggtccggacgccga

SEQ ID NO: 210157 - DNA, 20 bp, human
gaggcagccaggggccgctc

SEQ ID NO: 210158 - DNA, 20 bp, human
gtccctacgccccgcgactc

SEQ ID NO: 210159 - DNA, 20 bp, human
gaggccctcggcgtccggac

SEQ ID NO: 210160 - DNA, 20 bp, human
gccgccgggccggagcaggt

SEQ ID NO: 210161 - DNA, 20 bp, human
ggaccggagtcgcggggcgt

SEQ ID NO: 210162 - DNA, 20 bp, human
gaaccatctgtgggcggggt

SEQ ID NO: 210163 - DNA, 20 bp, human
ggggcagcaaggtttgattg

SEQ ID NO: 210164 - DNA, 20 bp, human
ggcgtccggaccggagtcgc

SEQ ID NO: 210165 - DNA, 20 bp, human
gaactcccccaaccagtgaa

SEQ ID NO: 210166 - DNA, 20 bp, human
gcgacctctgagtgctacga

SEQ ID NO: 210167 - DNA, 20 bp, human
gcctcctggccgggtgtccc

SEQ ID NO: 210168 - DNA, 20 bp, human
gccggccagtacaggtcacc

SEQ ID NO: 210169 - DNA, 20 bp, human
gcgcaggagcagaatgacga

SEQ ID NO: 210170 - DNA, 20 bp, human
gcgcggccgcgccagtcccc

SEQ ID NO: 210171 - DNA, 20 bp, human
gggcgccccctaggcatccc

SEQ ID NO: 210172 - DNA, 20 bp, human
gtccggggcgggaacatttg

SEQ ID NO: 210173 - DNA, 20 bp, human
gccggtgggggtgtgaacgt

SEQ ID NO: 210174 - DNA, 20 bp, human
gagctggtgccccgtgcgga

SEQ ID NO: 210175 - DNA, 20 bp, human
gaatcgcggtgacgcttcct

SEQ ID NO: 210176 - DNA, 20 bp, human
gctccctgagagcgctgcca

SEQ ID NO: 210177 - DNA, 20 bp, human
gaggtccagcggccgtaggt

SEQ ID NO: 210178 - DNA, 20 bp, human
ggcagcgctctcagggagct

SEQ ID NO: 210179 - DNA, 20 bp, human
ggtccctggcagcgctctca

SEQ ID NO: 210180 - DNA, 20 bp, human
gctcccagagcggaagattg

SEQ ID NO: 210181 - DNA, 20 bp, human
ggccagcgataacgcctcgg

SEQ ID NO: 210182 - DNA, 20 bp, human
gtccgcgggcagccctcgac

SEQ ID NO: 210183 - DNA, 20 bp, human
gcctccgcctccccgaccta

SEQ ID NO: 210184 - DNA, 20 bp, human
gagaaatccaccgactcccc

SEQ ID NO: 210185 - DNA, 20 bp, human
gtcaccgcaatcttccgctc

SEQ ID NO: 210186 - DNA, 20 bp, human
ggcggccctgaggaatctga

SEQ ID NO: 210187 - DNA, 20 bp, human
gccgtccggcaccctgtgat

SEQ ID NO: 210188 - DNA, 20 bp, human
gaggcaagcaccaggggagg

SEQ ID NO: 210189 - DNA, 20 bp, human
gcagaggtgtggagctggtt

SEQ ID NO: 210190 - DNA, 20 bp, human
gggtgacagtgatgtagtag

SEQ ID NO: 210191 - DNA, 20 bp, human
ggagagcccaatcgcatcag

SEQ ID NO: 210192 - DNA, 20 bp, human
gagcgggtcctcctggaaga

SEQ ID NO: 210193 - DNA, 20 bp, human
ggaagagggacgcgtgtgta

SEQ ID NO: 210194 - DNA, 20 bp, human
gtgatggggcgtggcccctg

SEQ ID NO: 210195 - DNA, 20 bp, human
gcacgcgtccctcttccagg

SEQ ID NO: 210196 - DNA, 20 bp, human
gaccggctgcagcgaggcga

SEQ ID NO: 210197 - DNA, 20 bp, human
gcgcccccacgcagaggtag

SEQ ID NO: 210198 - DNA, 20 bp, human
gtcgctgcagccggtcctac

SEQ ID NO: 210199 - DNA, 20 bp, human
gcagcccgctacctctgcgt

SEQ ID NO: 210200 - DNA, 20 bp, human
ggcggccggcacgcacctgt

SEQ ID NO: 210201 - DNA, 20 bp, human
gcggcacgcacctgtaggac

SEQ ID NO: 210202 - DNA, 20 bp, human
gcggggcgcacccgaactcc

SEQ ID NO: 210203 - DNA, 20 bp, human
gaacagtacgtgctggagaa

SEQ ID NO: 210204 - DNA, 20 bp, human
gttggggcggggccttagaa

SEQ ID NO: 210205 - DNA, 20 bp, human
gggcgtgtatcgtaactgcg

SEQ ID NO: 210206 - DNA, 20 bp, human
gtgacaactggagctctaat

SEQ ID NO: 210207 - DNA, 20 bp, human
gaatcagtgtagttcctatg

SEQ ID NO: 210208 - DNA, 20 bp, human
gtatctgagtcatgccacat

SEQ ID NO: 210209 - DNA, 20 bp, human
gaaaccaacgacaccctcaa

SEQ ID NO: 210210 - DNA, 20 bp, human
gcaagcacactgatctcaga

SEQ ID NO: 210211 - DNA, 20 bp, human
gcctcccttgagggtgtcgt

SEQ ID NO: 210212 - DNA, 20 bp, human
gaataagcacaatgaaggta

SEQ ID NO: 210213 - DNA, 20 bp, human
gtactctgtaatcaagggga

SEQ ID NO: 210214 - DNA, 20 bp, human
gccccaggcccagtgtgggt

SEQ ID NO: 210215 - DNA, 20 bp, human
gatcaaggggaggggttttc

SEQ ID NO: 210216 - DNA, 20 bp, human
gccaccgcgacccaacgctg

SEQ ID NO: 210217 - DNA, 20 bp, human
ggggaaggacaccacaagtc

SEQ ID NO: 210218 - DNA, 20 bp, human
ggaagacgaggagcgtggta

SEQ ID NO: 210219 - DNA, 20 bp, human
gcgtggtatggcaggttaat

SEQ ID NO: 210220 - DNA, 20 bp, human
ggattgaaaatactgggtga

SEQ ID NO: 210221 - DNA, 20 bp, human
gaagaggtgcggggggacgg

SEQ ID NO: 210222 - DNA, 20 bp, human
gcaggctgaggggagggtag

SEQ ID NO: 210223 - DNA, 20 bp, human
ggaagaaaaggccaggctga

SEQ ID NO: 210224 - DNA, 20 bp, human
ggctgtgagggcggaagaaa

SEQ ID NO: 210225 - DNA, 20 bp, human
ggaggaaagaccccgacttg

SEQ ID NO: 210226 - DNA, 20 bp, human
gccgcctcctgaactcccat

SEQ ID NO: 210227 - DNA, 20 bp, human
gcagccaatgggagttcagg

SEQ ID NO: 210228 - DNA, 20 bp, human
gccactccggggcctccagg

SEQ ID NO: 210229 - DNA, 20 bp, human
gaaaccgtcagaggtcacga

SEQ ID NO: 210230 - DNA, 20 bp, human
gtcgtgacgtcaaagagcct

SEQ ID NO: 210231 - DNA, 20 bp, human
ggggtcagaagggaggtggc

SEQ ID NO: 210232 - DNA, 20 bp, human
gcgttcgggaaaacgcagtc

SEQ ID NO: 210233 - DNA, 20 bp, human
gaagcagccaatgggagttc

SEQ ID NO: 210234 - DNA, 20 bp, human
gggatcgggtgttgcatcca

SEQ ID NO: 210235 - DNA, 20 bp, human
gtctccgtcgtgacctctga

SEQ ID NO: 210236 - DNA, 20 bp, human
gagcgcgcgcgtctgctcgg

SEQ ID NO: 210237 - DNA, 20 bp, human
gggagcctaggaatgtctcg

SEQ ID NO: 210238 - DNA, 20 bp, human
gccagcctgtcaaggaggaa

SEQ ID NO: 210239 - DNA, 20 bp, human
gcgtggaaacggatggtgat

SEQ ID NO: 210240 - DNA, 20 bp, human
gggaccccagcctgtcaagg

SEQ ID NO: 210241 - DNA, 20 bp, human
gccagccccgagacattcct

SEQ ID NO: 210242 - DNA, 20 bp, human
gccggcccttcctccttgac

SEQ ID NO: 210243 - DNA, 20 bp, human
gctagcgccattttggttga

SEQ ID NO: 210244 - DNA, 20 bp, human
gggtgattggttctctgcgc

SEQ ID NO: 210245 - DNA, 20 bp, human
ggctggaccccagcctgtca

SEQ ID NO: 210246 - DNA, 20 bp, human
gtccggggaagacacttagg

SEQ ID NO: 210247 - DNA, 20 bp, human
gaccacaggcccggcccgag

SEQ ID NO: 210248 - DNA, 20 bp, human
gggagataatctcacctccg

SEQ ID NO: 210249 - DNA, 20 bp, human
gtggggggaagggcagacgg

SEQ ID NO: 210250 - DNA, 20 bp, human
gttacccagccaggaggagt

SEQ ID NO: 210251 - DNA, 20 bp, human
gtggctctgatgagaagccg

SEQ ID NO: 210252 - DNA, 20 bp, human
gccagaatcactggaagcaa

SEQ ID NO: 210253 - DNA, 20 bp, human
ggaggctgcctgtggaccac

SEQ ID NO: 210254 - DNA, 20 bp, human
gacggtgggggcggtgacct

SEQ ID NO: 210255 - DNA, 20 bp, human
gccaaatctagcacaaccct

SEQ ID NO: 210256 - DNA, 20 bp, human
gtggcctgactcacccacca

SEQ ID NO: 210257 - DNA, 20 bp, human
gccgccccggcgcccaatca

SEQ ID NO: 210258 - DNA, 20 bp, human
gtcgctctcgggaagtctcc

SEQ ID NO: 210259 - DNA, 20 bp, human
gccctcgccgaggcaggaca

SEQ ID NO: 210260 - DNA, 20 bp, human
gcgagggccctgctcgaatg

SEQ ID NO: 210261 - DNA, 20 bp, human
gcagcagcgcctccatcaca

SEQ ID NO: 210262 - DNA, 20 bp, human
ggctgtccctccctcgctct

SEQ ID NO: 210263 - DNA, 20 bp, human
gcagggccagggcctcccgc

SEQ ID NO: 210264 - DNA, 20 bp, human
gacagagactcgctctgtgc

SEQ ID NO: 210265 - DNA, 20 bp, human
gtcgagcagggccctcgccg

SEQ ID NO: 210266 - DNA, 20 bp, human
gaccccggcccccgcaaggt

SEQ ID NO: 210267 - DNA, 20 bp, human
ggagcagaggagtccctcgt

SEQ ID NO: 210268 - DNA, 20 bp, human
gggctcgagctcccgttcga

SEQ ID NO: 210269 - DNA, 20 bp, human
gtcgccgccccaccttgcgg

SEQ ID NO: 210270 - DNA, 20 bp, human
ggggtcgccgcgggtggtgg

SEQ ID NO: 210271 - DNA, 20 bp, human
gaggggcgacagcgcaggcg

SEQ ID NO: 210272 - DNA, 20 bp, human
ggaacgggagctcgagcccc

SEQ ID NO: 210273 - DNA, 20 bp, human
gggcgcccccgtaaccgggt

SEQ ID NO: 210274 - DNA, 20 bp, human
gccgccggatggtgttgcca

SEQ ID NO: 210275 - DNA, 20 bp, human
ggcaaggtggggcggcgagc

SEQ ID NO: 210276 - DNA, 20 bp, human
gtggccggatctactttcct

SEQ ID NO: 210277 - DNA, 20 bp, human
ggcggtgtgtgcgagagcgc

SEQ ID NO: 210278 - DNA, 20 bp, human
ggggagagaagttcggtctg

SEQ ID NO: 210279 - DNA, 20 bp, human
gatccctgcgcggacacccc

SEQ ID NO: 210280 - DNA, 20 bp, human
ggtgtccgcgcagggatagc

SEQ ID NO: 210281 - DNA, 20 bp, human
gcacaccagctatccctgcg

SEQ ID NO: 210282 - DNA, 20 bp, human
gcctcctgtcgtccggtccc

SEQ ID NO: 210283 - DNA, 20 bp, human
gccccctaggaaagtagatc

SEQ ID NO: 210284 - DNA, 20 bp, human
gccctggatgtggagacccg

SEQ ID NO: 210285 - DNA, 20 bp, human
ggctagcgtgagagctaggg

SEQ ID NO: 210286 - DNA, 20 bp, human
gcacagtcggggtatcgcaa

SEQ ID NO: 210287 - DNA, 20 bp, human
gtgcgcggcgacaccgcacc

SEQ ID NO: 210288 - DNA, 20 bp, human
gtgtgtgggcacagccacct

SEQ ID NO: 210289 - DNA, 20 bp, human
gtatcgcaatggaaaactct

SEQ ID NO: 210290 - DNA, 20 bp, human
gggtgcggggcacacggtgc

SEQ ID NO: 210291 - DNA, 20 bp, human
ggtcgccgcgcacccgggct

SEQ ID NO: 210292 - DNA, 20 bp, human
ggcggtgtcgccgcgcaccc

SEQ ID NO: 210293 - DNA, 20 bp, human
ggggcacacggtgccgggtg

SEQ ID NO: 210294 - DNA, 20 bp, human
gcgggagccggcgttcccga

SEQ ID NO: 210295 - DNA, 20 bp, human
ggaccagggaccgggaagcg

SEQ ID NO: 210296 - DNA, 20 bp, human
gagtgggcgggaaaacgcga

SEQ ID NO: 210297 - DNA, 20 bp, human
gggccagcatgtactaaggg

SEQ ID NO: 210298 - DNA, 20 bp, human
ggggcgggaaaacgcgaagg

SEQ ID NO: 210299 - DNA, 20 bp, human
gcaactgcacggcgatactg

SEQ ID NO: 210300 - DNA, 20 bp, human
gggcgggccagcatgtacta

SEQ ID NO: 210301 - DNA, 20 bp, human
ggctcaggggcgggcggaac

SEQ ID NO: 210302 - DNA, 20 bp, human
gaattggtgcgggataagga

SEQ ID NO: 210303 - DNA, 20 bp, human
gcgaaggaggacaggaggtc

SEQ ID NO: 210304 - DNA, 20 bp, human
gtatcgccgtgcagttggta

SEQ ID NO: 210305 - DNA, 20 bp, human
gactaagggtggcgggtgtg

SEQ ID NO: 210306 - DNA, 20 bp, human
gggaacaggcgctcggtcgg

SEQ ID NO: 210307 - DNA, 20 bp, human
gggccgagcgagcgcagagg

SEQ ID NO: 210308 - DNA, 20 bp, human
ggggctgtcggctcacttcc

SEQ ID NO: 210309 - DNA, 20 bp, human
ggggtcccgcgctgtctggg

SEQ ID NO: 210310 - DNA, 20 bp, human
gcccagcggccggtggagag

SEQ ID NO: 210311 - DNA, 20 bp, human
ggtgcgccggggtagccgag

SEQ ID NO: 210312 - DNA, 20 bp, human
ggtggggccagggttgtcaa

SEQ ID NO: 210313 - DNA, 20 bp, human
gtcccacctgcgcctctccg

SEQ ID NO: 210314 - DNA, 20 bp, human
gcgccggggtagccgagagg

SEQ ID NO: 210315 - DNA, 20 bp, human
ggctacgaaagggttgttgg

SEQ ID NO: 210316 - DNA, 20 bp, human
ggtgccccgccctgccgact

SEQ ID NO: 210317 - DNA, 20 bp, human
gggaccgcggtctactgcaa

SEQ ID NO: 210318 - DNA, 20 bp, human
gtggagttaaggatgaaggt

SEQ ID NO: 210319 - DNA, 20 bp, human
gggggagcgagctggagtta

SEQ ID NO: 210320 - DNA, 20 bp, human
ggctccctgcgacccagcga

SEQ ID NO: 210321 - DNA, 20 bp, human
ggcggcagctgagactccgg

SEQ ID NO: 210322 - DNA, 20 bp, human
ggctcggcggagactggctt

SEQ ID NO: 210323 - DNA, 20 bp, human
gtgtgccagcttccccggct

SEQ ID NO: 210324 - DNA, 20 bp, human
ggggaagctggcacaagcgg

SEQ ID NO: 210325 - DNA, 20 bp, human
gcccttctcggacgcggcgt

SEQ ID NO: 210326 - DNA, 20 bp, human
gccccgagccgggtctgcgg

SEQ ID NO: 210327 - DNA, 20 bp, human
gtgggggcgggcacgcgcaa

SEQ ID NO: 210328 - DNA, 20 bp, human
ggggctggcgcgaggtgcgg

SEQ ID NO: 210329 - DNA, 20 bp, human
ggatgcagctaccggggacc

SEQ ID NO: 210330 - DNA, 20 bp, human
ggctccgcgcctccccgagc

SEQ ID NO: 210331 - DNA, 20 bp, human
gaccaggtggccaagggaac

SEQ ID NO: 210332 - DNA, 20 bp, human
ggggtcgtagtcatacccct

SEQ ID NO: 210333 - DNA, 20 bp, human
gggcgccggtgccgcaccga

SEQ ID NO: 210334 - DNA, 20 bp, human
ggtggccaagggaacagggt

SEQ ID NO: 210335 - DNA, 20 bp, human
ggcggcgcgctgaaccggag

SEQ ID NO: 210336 - DNA, 20 bp, human
ggcggggaggggcgtgtcgt

SEQ ID NO: 210337 - DNA, 20 bp, human
ggggcggggcgtgccgggta

SEQ ID NO: 210338 - DNA, 20 bp, human
gaggcggggcaggttctctc

SEQ ID NO: 210339 - DNA, 20 bp, human
gtcgtgcccggcgctaatca

SEQ ID NO: 210340 - DNA, 20 bp, human
gagggcggggcgagtcgtgc

SEQ ID NO: 210341 - DNA, 20 bp, human
ggcggggtgtgtagtgcagt

SEQ ID NO: 210342 - DNA, 20 bp, human
gggcacgccctgattagcgc

SEQ ID NO: 210343 - DNA, 20 bp, human
gccgggcgaagcggggctca

SEQ ID NO: 210344 - DNA, 20 bp, human
ggcgtgtcgtgggcgaagca

SEQ ID NO: 210345 - DNA, 20 bp, human
ggcggggcgagtcgtgccgg

SEQ ID NO: 210346 - DNA, 20 bp, human
ggacccgcgcgaccgaggat

SEQ ID NO: 210347 - DNA, 20 bp, human
gccgcagagcgcgtcagccg

SEQ ID NO: 210348 - DNA, 20 bp, human
gggcccagatacccgatcct

SEQ ID NO: 210349 - DNA, 20 bp, human
gcgaccgaggatcgggtatc

SEQ ID NO: 210350 - DNA, 20 bp, human
ggagccagaacttgaagctg

SEQ ID NO: 210351 - DNA, 20 bp, human
gtggggacgtcgggcgagaa

SEQ ID NO: 210352 - DNA, 20 bp, human
gcagagcgcgtcagccgggg

SEQ ID NO: 210353 - DNA, 20 bp, human
gagtcggccctccgagggga

SEQ ID NO: 210354 - DNA, 20 bp, human
ggggctcgactctaggagtt

SEQ ID NO: 210355 - DNA, 20 bp, human
gcccagctggaagccacctg

SEQ ID NO: 210356 - DNA, 20 bp, human
ggaggcggggcgcagggatc

SEQ ID NO: 210357 - DNA, 20 bp, human
gagccccgctcccgacgtga

SEQ ID NO: 210358 - DNA, 20 bp, human
gccgcccctcacgtcgggag

SEQ ID NO: 210359 - DNA, 20 bp, human
gaggtcgggtagaggctccc

SEQ ID NO: 210360 - DNA, 20 bp, human
gaggctcgtgccctgttgtg

SEQ ID NO: 210361 - DNA, 20 bp, human
gtataggtttagtgcctaat

SEQ ID NO: 210362 - DNA, 20 bp, human
ggaaacacctgatcatctat

SEQ ID NO: 210363 - DNA, 20 bp, human
ggcctaatgggtgttgttcc

SEQ ID NO: 210364 - DNA, 20 bp, human
gggcatggcggcggcaaatg

SEQ ID NO: 210365 - DNA, 20 bp, human
gcggaccgccccaggagact

SEQ ID NO: 210366 - DNA, 20 bp, human
gtctcccagctgcgccagag

SEQ ID NO: 210367 - DNA, 20 bp, human
gcgggagcgcgcgggcacaa

SEQ ID NO: 210368 - DNA, 20 bp, human
gcgcgagcaagacccggctc

SEQ ID NO: 210369 - DNA, 20 bp, human
ggggcgcggtctacagcgct

SEQ ID NO: 210370 - DNA, 20 bp, human
gcgagagcgcgagcaagacc

SEQ ID NO: 210371 - DNA, 20 bp, human
ggggacggtacagcaaccgg

SEQ ID NO: 210372 - DNA, 20 bp, human
gcgcgcgggcacaagggcga

SEQ ID NO: 210373 - DNA, 20 bp, human
gcgcgcacgcgcaggtgagc

SEQ ID NO: 210374 - DNA, 20 bp, human
gtctccggtgcccgggagag

SEQ ID NO: 210375 - DNA, 20 bp, human
gcttgcggggcagggaatca

SEQ ID NO: 210376 - DNA, 20 bp, human
gcacccagggcccgggaaag

SEQ ID NO: 210377 - DNA, 20 bp, human
gaaaacagctgcaggaacgg

SEQ ID NO: 210378 - DNA, 20 bp, human
ggtacccaggggccggaagc

SEQ ID NO: 210379 - DNA, 20 bp, human
gctacccgcgcctctttccc

SEQ ID NO: 210380 - DNA, 20 bp, human
gtggctcgctccaggcaccc

SEQ ID NO: 210381 - DNA, 20 bp, human
gctcccgtgaagcctagcgc

SEQ ID NO: 210382 - DNA, 20 bp, human
ggccggaagccggggaccta

SEQ ID NO: 210383 - DNA, 20 bp, human
gcccctgcacccgcgggagg

SEQ ID NO: 210384 - DNA, 20 bp, human
gcgggtcacgtgggcgatgc

SEQ ID NO: 210385 - DNA, 20 bp, human
gggtctgcagcgctccaccg

SEQ ID NO: 210386 - DNA, 20 bp, human
gtctcgcgagagagagtggg

SEQ ID NO: 210387 - DNA, 20 bp, human
gagtgggaggcgtggagagt

SEQ ID NO: 210388 - DNA, 20 bp, human
gccctctcgcgagagagagt

SEQ ID NO: 210389 - DNA, 20 bp, human
ggaccagcggggctgccccg

SEQ ID NO: 210390 - DNA, 20 bp, human
ggggctgcactggagcacgt

SEQ ID NO: 210391 - DNA, 20 bp, human
ggccgagcccgcgcaaaagt

SEQ ID NO: 210392 - DNA, 20 bp, human
ggcggcggaagccgaggggt

SEQ ID NO: 210393 - DNA, 20 bp, human
ggtgttgcgggccggagctg

SEQ ID NO: 210394 - DNA, 20 bp, human
gagcccgcgcaaaagtgggt

SEQ ID NO: 210395 - DNA, 20 bp, human
gtgggtcccggccaatggag

SEQ ID NO: 210396 - DNA, 20 bp, human
gggcgcctcccgtttctaac

SEQ ID NO: 210397 - DNA, 20 bp, human
gtctggtcccggcagcctgg

SEQ ID NO: 210398 - DNA, 20 bp, human
gagaaacgggaggcgcccga

SEQ ID NO: 210399 - DNA, 20 bp, human
gtgctcatgtgatgaagcga

SEQ ID NO: 210400 - DNA, 20 bp, human
gtgcagcagcatctgccccc

SEQ ID NO: 210401 - DNA, 20 bp, human
ggggactcggactcgctcct

SEQ ID NO: 210402 - DNA, 20 bp, human
gaagcgagggaaaaaccggg

SEQ ID NO: 210403 - DNA, 20 bp, human
ggctgctgcagggcgtgtct

SEQ ID NO: 210404 - DNA, 20 bp, human
gtggcgcgtcgcagcgcctc

SEQ ID NO: 210405 - DNA, 20 bp, human
gtagtcgccctgttagaaac

SEQ ID NO: 210406 - DNA, 20 bp, human
gagtcccgggagggtttaaa

SEQ ID NO: 210407 - DNA, 20 bp, human
gctcacagagcccagctcgg

SEQ ID NO: 210408 - DNA, 20 bp, human
gtaaagccctcccccgagct

SEQ ID NO: 210409 - DNA, 20 bp, human
gtaaacggttacttcattcc

SEQ ID NO: 210410 - DNA, 20 bp, human
gcgcccgggccgcacaagca

SEQ ID NO: 210411 - DNA, 20 bp, human
gccagcgccagcccgcgtgt

SEQ ID NO: 210412 - DNA, 20 bp, human
gacagagcccagctcggggg

SEQ ID NO: 210413 - DNA, 20 bp, human
gccccctgcttgtgcggccc

SEQ ID NO: 210414 - DNA, 20 bp, human
ggcgccagcccgcgtgtggg

SEQ ID NO: 210415 - DNA, 20 bp, human
gggctctgtgagtggtcagc

SEQ ID NO: 210416 - DNA, 20 bp, human
gggagcaagaactgcgagct

SEQ ID NO: 210417 - DNA, 20 bp, human
gcaacctgagtgccccgtcc

SEQ ID NO: 210418 - DNA, 20 bp, human
gtggtctcatgcagcgagat

SEQ ID NO: 210419 - DNA, 20 bp, human
gatagtaaggctcctggacg

SEQ ID NO: 210420 - DNA, 20 bp, human
gcgccgaaagacgctcggga

SEQ ID NO: 210421 - DNA, 20 bp, human
gtactcacgggaggactcgc

SEQ ID NO: 210422 - DNA, 20 bp, human
gcaccctcccgagcgtcttt

SEQ ID NO: 210423 - DNA, 20 bp, human
gcggcaaagtgatcaaagta

SEQ ID NO: 210424 - DNA, 20 bp, human
gcaaagtgatcaaagtaggg

SEQ ID NO: 210425 - DNA, 20 bp, human
gggtaaccaccagtacacag

SEQ ID NO: 210426 - DNA, 20 bp, human
gcacttgcaaacattccatc

SEQ ID NO: 210427 - DNA, 20 bp, human
gcagccgaagatgagcttac

SEQ ID NO: 210428 - DNA, 20 bp, human
gtgcttatgttaataacaga

SEQ ID NO: 210429 - DNA, 20 bp, human
gactgtctgaccgcaataat

SEQ ID NO: 210430 - DNA, 20 bp, human
gtgtaggctatgcttcccat

SEQ ID NO: 210431 - DNA, 20 bp, human
gtggtgataagcctcacagc

SEQ ID NO: 210432 - DNA, 20 bp, human
gcttcggctgaagagaagct

SEQ ID NO: 210433 - DNA, 20 bp, human
gaggtatagctactacagtt

SEQ ID NO: 210434 - DNA, 20 bp, human
gtaagcagtcagaaacatgt

SEQ ID NO: 210435 - DNA, 20 bp, human
gttatcaccactgttcttcc

SEQ ID NO: 210436 - DNA, 20 bp, human
gcacgcgcagtgcaaaaggt

SEQ ID NO: 210437 - DNA, 20 bp, human
gacctcccctggttacccgc

SEQ ID NO: 210438 - DNA, 20 bp, human
gcctgcctgcgggtaaccag

SEQ ID NO: 210439 - DNA, 20 bp, human
gcgcgcacgcgcagtgcaaa

SEQ ID NO: 210440 - DNA, 20 bp, human
gggtaaccaggggaggtact

SEQ ID NO: 210441 - DNA, 20 bp, human
ggaaatgcgtcatagagggc

SEQ ID NO: 210442 - DNA, 20 bp, human
gcatagagggcgggcggcga

SEQ ID NO: 210443 - DNA, 20 bp, human
gagtggaaatgcgtcataga

SEQ ID NO: 210444 - DNA, 20 bp, human
ggcccttaagccaaacagga

SEQ ID NO: 210445 - DNA, 20 bp, human
ggcgcgcgggctcgcggaag

SEQ ID NO: 210446 - DNA, 20 bp, human
ggagaaggtgtgggtagatg

SEQ ID NO: 210447 - DNA, 20 bp, human
gggagggaggggcggtccgt

SEQ ID NO: 210448 - DNA, 20 bp, human
gtgggcgctgggctactgga

SEQ ID NO: 210449 - DNA, 20 bp, human
gctcctctcagtggcttcgg

SEQ ID NO: 210450 - DNA, 20 bp, human
gaggggcggtccgtgggcgc

SEQ ID NO: 210451 - DNA, 20 bp, human
gtccgtgggcgctgggctac

SEQ ID NO: 210452 - DNA, 20 bp, human
gagcctccgggcgcgctgga

SEQ ID NO: 210453 - DNA, 20 bp, human
gtccgggcgcgctggagggc

SEQ ID NO: 210454 - DNA, 20 bp, human
ggcagggagtggtagcctcc

SEQ ID NO: 210455 - DNA, 20 bp, human
gggctactggaggggaagcg

SEQ ID NO: 210456 - DNA, 20 bp, human
ggacaggacccggacaaccc

SEQ ID NO: 210457 - DNA, 20 bp, human
gcagcactcccggctgacta

SEQ ID NO: 210458 - DNA, 20 bp, human
gtcagccgggagtgctgtcg

SEQ ID NO: 210459 - DNA, 20 bp, human
gtcccccacgacagcactcc

SEQ ID NO: 210460 - DNA, 20 bp, human
ggccgggagtgctgtcgtgg

SEQ ID NO: 210461 - DNA, 20 bp, human
gggaacggcggcccctggtc

SEQ ID NO: 210462 - DNA, 20 bp, human
gtgctgtcgtgggggattgt

SEQ ID NO: 210463 - DNA, 20 bp, human
gcagagtgtgcctaggaagt

SEQ ID NO: 210464 - DNA, 20 bp, human
ggtaagcgaagaggagaatg

SEQ ID NO: 210465 - DNA, 20 bp, human
gccgtctcggaatcccgacc

SEQ ID NO: 210466 - DNA, 20 bp, human
gggtgaagatatactccaag

SEQ ID NO: 210467 - DNA, 20 bp, human
gggtcaacaggacaaagagg

SEQ ID NO: 210468 - DNA, 20 bp, human
gggctgatgtttagtttaga

SEQ ID NO: 210469 - DNA, 20 bp, human
gaaactaaacatcagcccct

SEQ ID NO: 210470 - DNA, 20 bp, human
gctctatagcaacagtagtg

SEQ ID NO: 210471 - DNA, 20 bp, human
gtgtttagtttagaaggact

SEQ ID NO: 210472 - DNA, 20 bp, human
gaacgtacactttccacaat

SEQ ID NO: 210473 - DNA, 20 bp, human
gaatggtcaacaggacaaag

SEQ ID NO: 210474 - DNA, 20 bp, human
gcactctccagtcccagcaa

SEQ ID NO: 210475 - DNA, 20 bp, human
gaattctctctttagagcag

SEQ ID NO: 210476 - DNA, 20 bp, human
gggcagtcaaggctgtagga

SEQ ID NO: 210477 - DNA, 20 bp, human
gtaagcaaaggtgggcatgt

SEQ ID NO: 210478 - DNA, 20 bp, human
gggctgatctagttgagaca

SEQ ID NO: 210479 - DNA, 20 bp, human
gtcacaacctaagcaaaggt

SEQ ID NO: 210480 - DNA, 20 bp, human
gaactctgattctctagtag

SEQ ID NO: 210481 - DNA, 20 bp, human
ggtgtggcaacagagtttgt

SEQ ID NO: 210482 - DNA, 20 bp, human
gaaggcatctcaaagtgtaa

SEQ ID NO: 210483 - DNA, 20 bp, human
gagggggcatcttaatggtg

SEQ ID NO: 210484 - DNA, 20 bp, human
gtggtaccagctggcagtca

SEQ ID NO: 210485 - DNA, 20 bp, human
gaacaagaaaacatcattcc

SEQ ID NO: 210486 - DNA, 20 bp, human
gcgcccgggcggagcacgat

SEQ ID NO: 210487 - DNA, 20 bp, human
gcaggcagcgccaatgcgag

SEQ ID NO: 210488 - DNA, 20 bp, human
gcctcggcgctgatgtggtc

SEQ ID NO: 210489 - DNA, 20 bp, human
gtgctgctgcaggtgggtcc

SEQ ID NO: 210490 - DNA, 20 bp, human
gagcgccaatgcgagcggag

SEQ ID NO: 210491 - DNA, 20 bp, human
gaagcccatcgtgctccgcc

SEQ ID NO: 210492 - DNA, 20 bp, human
gagccagccggaaggttcgg

SEQ ID NO: 210493 - DNA, 20 bp, human
ggggaaggcgggggggacca

SEQ ID NO: 210494 - DNA, 20 bp, human
ggtggtctggcagtggagat

SEQ ID NO: 210495 - DNA, 20 bp, human
gccgcgcggggacagacagc

SEQ ID NO: 210496 - DNA, 20 bp, human
gagggcttccgtattgtctc

SEQ ID NO: 210497 - DNA, 20 bp, human
gggaaagactgctgttgcta

SEQ ID NO: 210498 - DNA, 20 bp, human
gatggcaactgggatgtgct

SEQ ID NO: 210499 - DNA, 20 bp, human
gtctaaatgtataacaacaa

SEQ ID NO: 210500 - DNA, 20 bp, human
gagtggagcctgagacaata

SEQ ID NO: 210501 - DNA, 20 bp, human
gtaaccaggacagacttcat

SEQ ID NO: 210502 - DNA, 20 bp, human
gagatgatgcagctcattat

SEQ ID NO: 210503 - DNA, 20 bp, human
gatccttgctgcatttccag

SEQ ID NO: 210504 - DNA, 20 bp, human
ggacagacttcattggccaa

SEQ ID NO: 210505 - DNA, 20 bp, human
gtatggattttagtccaatg

SEQ ID NO: 210506 - DNA, 20 bp, human
gggctgccaaaggccgtcgg

SEQ ID NO: 210507 - DNA, 20 bp, human
gaaactagggccggcgactg

SEQ ID NO: 210508 - DNA, 20 bp, human
gcaagggcgagattgggact

SEQ ID NO: 210509 - DNA, 20 bp, human
gcgccacgggaaataaatga

SEQ ID NO: 210510 - DNA, 20 bp, human
ggggcagggcgggggaaact

SEQ ID NO: 210511 - DNA, 20 bp, human
gtgcagagtcgagacgacct

SEQ ID NO: 210512 - DNA, 20 bp, human
ggcccctcccacgctttcaa

SEQ ID NO: 210513 - DNA, 20 bp, human
gtcgcccttgaaagcgtggg

SEQ ID NO: 210514 - DNA, 20 bp, human
gcgactctgcaatgcgacgc

SEQ ID NO: 210515 - DNA, 20 bp, human
ggactcgggtcggccccttc

SEQ ID NO: 210516 - DNA, 20 bp, human
gaggccagctgggacggcga

SEQ ID NO: 210517 - DNA, 20 bp, human
gtggatcgtagcagcccgaa

SEQ ID NO: 210518 - DNA, 20 bp, human
gtgggaccacaactcccatt

SEQ ID NO: 210519 - DNA, 20 bp, human
gcacaactcccattaggcca

SEQ ID NO: 210520 - DNA, 20 bp, human
gaacagagaaacccggaggt

SEQ ID NO: 210521 - DNA, 20 bp, human
ggggagttgtggtcccaccg

SEQ ID NO: 210522 - DNA, 20 bp, human
gaagcggcagggatctcgga

SEQ ID NO: 210523 - DNA, 20 bp, human
ggggatgggaaaactttatt

SEQ ID NO: 210524 - DNA, 20 bp, human
gcacctccgccatcgactac

SEQ ID NO: 210525 - DNA, 20 bp, human
gggccgtcgggcaccgcggt

SEQ ID NO: 210526 - DNA, 20 bp, human
gtccctctggcgggtctcca

SEQ ID NO: 210527 - DNA, 20 bp, human
gtccagccactgatatgagg

SEQ ID NO: 210528 - DNA, 20 bp, human
gccccgcctcccgaccgcat

SEQ ID NO: 210529 - DNA, 20 bp, human
ggggtctacggctcagggca

SEQ ID NO: 210530 - DNA, 20 bp, human
gcccgccttctgttattcta

SEQ ID NO: 210531 - DNA, 20 bp, human
gcccaaggcccaagcatggt

SEQ ID NO: 210532 - DNA, 20 bp, human
gaccctggagacccgccaga

SEQ ID NO: 210533 - DNA, 20 bp, human
gagacccgccagagggagtc

SEQ ID NO: 210534 - DNA, 20 bp, human
gccgccccctcaaattctat

SEQ ID NO: 210535 - DNA, 20 bp, human
gggcccaagcatggtcgggc

SEQ ID NO: 210536 - DNA, 20 bp, human
ggcctggcaagggttgaccc

SEQ ID NO: 210537 - DNA, 20 bp, human
gtctacggcgggatcctcgc

SEQ ID NO: 210538 - DNA, 20 bp, human
gaacacacggcgaggcggga

SEQ ID NO: 210539 - DNA, 20 bp, human
gtgctcctggggtgccgccc

SEQ ID NO: 210540 - DNA, 20 bp, human
gtcgtgggcaggtgctcctg

SEQ ID NO: 210541 - DNA, 20 bp, human
gtggcaagggttgaccccgg

SEQ ID NO: 210542 - DNA, 20 bp, human
gcgggatcctcgctggtagg

SEQ ID NO: 210543 - DNA, 20 bp, human
gtacgtggagacgaagatgg

SEQ ID NO: 210544 - DNA, 20 bp, human
gggtgacggcgcttcccgtg

SEQ ID NO: 210545 - DNA, 20 bp, human
gagccgttgatgtgcgggaa

SEQ ID NO: 210546 - DNA, 20 bp, human
gaactcgcgcgcagacgcca

SEQ ID NO: 210547 - DNA, 20 bp, human
gcgggagaggcgggagaagt

SEQ ID NO: 210548 - DNA, 20 bp, human
ggccaaggctgggacgcaga

SEQ ID NO: 210549 - DNA, 20 bp, human
gcgcgcgcagacgccaaggc

SEQ ID NO: 210550 - DNA, 20 bp, human
gcgtggggctggcccttaga

SEQ ID NO: 210551 - DNA, 20 bp, human
gacagcgtggacagatgccc

SEQ ID NO: 210552 - DNA, 20 bp, human
gcgtctgcgcgcgagttgcc

SEQ ID NO: 210553 - DNA, 20 bp, human
gcattggcggaaggcgggag

SEQ ID NO: 210554 - DNA, 20 bp, human
gcagcgcagtagccctctaa

SEQ ID NO: 210555 - DNA, 20 bp, human
gccgccgggagcgctaggcc

SEQ ID NO: 210556 - DNA, 20 bp, human
gtgaagaaatggaacggtct

SEQ ID NO: 210557 - DNA, 20 bp, human
ggcgccccctgctgaagaaa

SEQ ID NO: 210558 - DNA, 20 bp, human
gcgacagccccaaagcgggg

SEQ ID NO: 210559 - DNA, 20 bp, human
ggggcgcgacagccccaaag

SEQ ID NO: 210560 - DNA, 20 bp, human
gggaagagggtggctctgcg

SEQ ID NO: 210561 - DNA, 20 bp, human
gcccggctgaggagcctctt

SEQ ID NO: 210562 - DNA, 20 bp, human
gggtcccatcccccccgctt

SEQ ID NO: 210563 - DNA, 20 bp, human
ggcacaccatcgcccggcag

SEQ ID NO: 210564 - DNA, 20 bp, human
gtcaccaagcaacaccggga

SEQ ID NO: 210565 - DNA, 20 bp, human
gaccatcgcccggcagaggg

SEQ ID NO: 210566 - DNA, 20 bp, human
ggggtgggagagttctacga

SEQ ID NO: 210567 - DNA, 20 bp, human
gtcggcttgaaaggcgggaa

SEQ ID NO: 210568 - DNA, 20 bp, human
gaggaatcggcttgaaaggc

SEQ ID NO: 210569 - DNA, 20 bp, human
gcggttggacgtgttcgctt

SEQ ID NO: 210570 - DNA, 20 bp, human
gcacgggggcgggccaaacc

SEQ ID NO: 210571 - DNA, 20 bp, human
gtttaggtaccgggaggaat

SEQ ID NO: 210572 - DNA, 20 bp, human
gggcgcgcgattccgagttc

SEQ ID NO: 210573 - DNA, 20 bp, human
gaatcgcgcgccttgcatga

SEQ ID NO: 210574 - DNA, 20 bp, human
gggggtgtgaggctggaacg

SEQ ID NO: 210575 - DNA, 20 bp, human
gtacactcaagctgtgtagg

SEQ ID NO: 210576 - DNA, 20 bp, human
gactgcggagggcttgcaag

SEQ ID NO: 210577 - DNA, 20 bp, human
ggggcagcgctgactgcgga

SEQ ID NO: 210578 - DNA, 20 bp, human
ggcggcctcaaccacggcag

SEQ ID NO: 210579 - DNA, 20 bp, human
ggtcaggccgtggttgaaga

SEQ ID NO: 210580 - DNA, 20 bp, human
gatcccaagcccaggacgtc

SEQ ID NO: 210581 - DNA, 20 bp, human
ggagaggtggggagcgatgc

SEQ ID NO: 210582 - DNA, 20 bp, human
gcgtgcagagcaagagctgg

SEQ ID NO: 210583 - DNA, 20 bp, human
ggggccctgaggcctagtga

SEQ ID NO: 210584 - DNA, 20 bp, human
gtggttgaagagggcctaga

SEQ ID NO: 210585 - DNA, 20 bp, human
gagtcagcgctgcccaggaa

SEQ ID NO: 210586 - DNA, 20 bp, human
gccccaggaactcggacata

SEQ ID NO: 210587 - DNA, 20 bp, human
gggagcgcaaaccctgctgc

SEQ ID NO: 210588 - DNA, 20 bp, human
ggggccgccccctgctgtcg

SEQ ID NO: 210589 - DNA, 20 bp, human
gcggcccgcccccaggaact

SEQ ID NO: 210590 - DNA, 20 bp, human
gcaccgaaaggccgccgcca

SEQ ID NO: 210591 - DNA, 20 bp, human
gaggcccgcccgcgacagca

SEQ ID NO: 210592 - DNA, 20 bp, human
gctgtcgcgggcgggcctca

SEQ ID NO: 210593 - DNA, 20 bp, human
gggcctcagggattatgcaa

SEQ ID NO: 210594 - DNA, 20 bp, human
ggcggcggcctttcggtgat

SEQ ID NO: 210595 - DNA, 20 bp, human
gctccctatgtccgagttcc

SEQ ID NO: 210596 - DNA, 20 bp, human
ggccagtccctgagtaggaa

SEQ ID NO: 210597 - DNA, 20 bp, human
ggtaggaatggacaacaagg

SEQ ID NO: 210598 - DNA, 20 bp, human
gtgagtaggaatggacaaca

SEQ ID NO: 210599 - DNA, 20 bp, human
gaggatgactgggaatctga

SEQ ID NO: 210600 - DNA, 20 bp, human
ggagacaaagagattgtcac

SEQ ID NO: 210601 - DNA, 20 bp, human
gcagggaatagctgtcagca

SEQ ID NO: 210602 - DNA, 20 bp, human
gtaaccatggctaggatgac

SEQ ID NO: 210603 - DNA, 20 bp, human
gctgaagtgttttcacagcc

SEQ ID NO: 210604 - DNA, 20 bp, human
ggttaccttcttctctaagt

SEQ ID NO: 210605 - DNA, 20 bp, human
gagtggcaagaggccaaaga

SEQ ID NO: 210606 - DNA, 20 bp, human
gtaggcgcgcggtgcaatgt

SEQ ID NO: 210607 - DNA, 20 bp, human
gatggcattgtgaatccgga

SEQ ID NO: 210608 - DNA, 20 bp, human
ggccgcaggcgcttttccgg

SEQ ID NO: 210609 - DNA, 20 bp, human
ggtagcagatgccacgttgc

SEQ ID NO: 210610 - DNA, 20 bp, human
gtcccccggaaaagcgcctg

SEQ ID NO: 210611 - DNA, 20 bp, human
ggccgccgcaggcgcttttc

SEQ ID NO: 210612 - DNA, 20 bp, human
gacaatgaggcaggtggcgc

SEQ ID NO: 210613 - DNA, 20 bp, human
ggccacgtgggcggtgcaag

SEQ ID NO: 210614 - DNA, 20 bp, human
gacggatggcattgtgaatc

SEQ ID NO: 210615 - DNA, 20 bp, human
gggggtctatggtccagaca

SEQ ID NO: 210616 - DNA, 20 bp, human
gccgcggcggccttccccaa

SEQ ID NO: 210617 - DNA, 20 bp, human
gcggggcgcgggcgagcgtt

SEQ ID NO: 210618 - DNA, 20 bp, human
gggcggccttccccaagggt

SEQ ID NO: 210619 - DNA, 20 bp, human
gcgcgccccgcgtggcagaa

SEQ ID NO: 210620 - DNA, 20 bp, human
gcgcgggcgagcgttggggg

SEQ ID NO: 210621 - DNA, 20 bp, human
gtcggcagaaagggcgcctg

SEQ ID NO: 210622 - DNA, 20 bp, human
gacaacaaaggcattcttct

SEQ ID NO: 210623 - DNA, 20 bp, human
gcccgtgaggtcggcagaaa

SEQ ID NO: 210624 - DNA, 20 bp, human
gaagcatccccgccgaccct

SEQ ID NO: 210625 - DNA, 20 bp, human
gggccttccccaagggtcgg

SEQ ID NO: 210626 - DNA, 20 bp, human
gttggagtttctgcttgttc

SEQ ID NO: 210627 - DNA, 20 bp, human
gcaaaagttggaaggtaggg

SEQ ID NO: 210628 - DNA, 20 bp, human
gtaagagagaactttgcaca

SEQ ID NO: 210629 - DNA, 20 bp, human
gcagccaaaagttggaaggt

SEQ ID NO: 210630 - DNA, 20 bp, human
gaacacagccaaaagttgga

SEQ ID NO: 210631 - DNA, 20 bp, human
gtcttaggtgacagtatcat

SEQ ID NO: 210632 - DNA, 20 bp, human
gtggatttcctgtttggtta

SEQ ID NO: 210633 - DNA, 20 bp, human
gtatggcagggaagctactg

SEQ ID NO: 210634 - DNA, 20 bp, human
gccaggcttttgtgagattg

SEQ ID NO: 210635 - DNA, 20 bp, human
gagtgggaggagttggagcc

SEQ ID NO: 210636 - DNA, 20 bp, human
gccggtggcgaatctctctg

SEQ ID NO: 210637 - DNA, 20 bp, human
gccttggcctaaagagggga

SEQ ID NO: 210638 - DNA, 20 bp, human
gtataccttggcctaaagag

SEQ ID NO: 210639 - DNA, 20 bp, human
gtccttaaggagggggacaa

SEQ ID NO: 210640 - DNA, 20 bp, human
gaccaaccaagtgtgctccc

SEQ ID NO: 210641 - DNA, 20 bp, human
ggcttgaaattctctcggtc

SEQ ID NO: 210642 - DNA, 20 bp, human
gattctctctatgacttgct

SEQ ID NO: 210643 - DNA, 20 bp, human
gtcctgggagcacacttggt

SEQ ID NO: 210644 - DNA, 20 bp, human
gcccaaagtgataaaagcag

SEQ ID NO: 210645 - DNA, 20 bp, human
gcttgctcggttacgacatt

SEQ ID NO: 210646 - DNA, 20 bp, human
gcatgtgagaggagggacag

SEQ ID NO: 210647 - DNA, 20 bp, human
gttaaccaatggcatgtgag

SEQ ID NO: 210648 - DNA, 20 bp, human
gccaatggcatgtgagagga

SEQ ID NO: 210649 - DNA, 20 bp, human
gcagcagacagtgtgctcag

SEQ ID NO: 210650 - DNA, 20 bp, human
gaattttcttaggtaagaaa

SEQ ID NO: 210651 - DNA, 20 bp, human
gggctataagagcaatgagc

SEQ ID NO: 210652 - DNA, 20 bp, human
gaggtaagaaacggttgaac

SEQ ID NO: 210653 - DNA, 20 bp, human
gagaatacagaaacctctag

SEQ ID NO: 210654 - DNA, 20 bp, human
gactgcaccttgatcaggaa

SEQ ID NO: 210655 - DNA, 20 bp, human
gaagggatgtttctcttaca

SEQ ID NO: 210656 - DNA, 20 bp, human
gcagaaggaactcatcatca

SEQ ID NO: 210657 - DNA, 20 bp, human
gcatgtgagaggagggacag

SEQ ID NO: 210658 - DNA, 20 bp, human
gttaaccaatggcatgtgag

SEQ ID NO: 210659 - DNA, 20 bp, human
gccaatggcatgtgagagga

SEQ ID NO: 210660 - DNA, 20 bp, human
gcagcagacagtgtgctcag

SEQ ID NO: 210661 - DNA, 20 bp, human
gaattttcttaggtaagaaa

SEQ ID NO: 210662 - DNA, 20 bp, human
gggctataagagcaatgagc

SEQ ID NO: 210663 - DNA, 20 bp, human
gaggtaagaaacggttgaac

SEQ ID NO: 210664 - DNA, 20 bp, human
gaaaagagctgtgccgctag

SEQ ID NO: 210665 - DNA, 20 bp, human
gtttacttatgaattttctt

SEQ ID NO: 210666 - DNA, 20 bp, human
gactccaagtaagacaagag

SEQ ID NO: 210667 - DNA, 20 bp, human
ggaagcaccagaggttaggg

SEQ ID NO: 210668 - DNA, 20 bp, human
gggttagggtggcaacagca

SEQ ID NO: 210669 - DNA, 20 bp, human
gtctggaataccaaacgata

SEQ ID NO: 210670 - DNA, 20 bp, human
gctgttgccaccctaacctc

SEQ ID NO: 210671 - DNA, 20 bp, human
ggaggaagcaccagaggtta

SEQ ID NO: 210672 - DNA, 20 bp, human
gaatcccctcttgtcttact

SEQ ID NO: 210673 - DNA, 20 bp, human
gaattcccggtgttgaagga

SEQ ID NO: 210674 - DNA, 20 bp, human
gaggcccctccttcaacacc

SEQ ID NO: 210675 - DNA, 20 bp, human
gaacagcaaggcagaaattc

SEQ ID NO: 210676 - DNA, 20 bp, human
gcatgtaggaggaggtacat

SEQ ID NO: 210677 - DNA, 20 bp, human
gggcagtcttatatggtctg

SEQ ID NO: 210678 - DNA, 20 bp, human
gtaaagaaggggcattatca

SEQ ID NO: 210679 - DNA, 20 bp, human
gacccctgcaaactgactga

SEQ ID NO: 210680 - DNA, 20 bp, human
gtaaccatcagtcagtttgc

SEQ ID NO: 210681 - DNA, 20 bp, human
ggtgagagaaagacgtaaga

SEQ ID NO: 210682 - DNA, 20 bp, human
gctatattaaattattcaaa

SEQ ID NO: 210683 - DNA, 20 bp, human
gtgagaatttttcaaatagt

SEQ ID NO: 210684 - DNA, 20 bp, human
gacctcctcctacatgccat

SEQ ID NO: 210685 - DNA, 20 bp, human
gtcagagattacaaaaacaa

SEQ ID NO: 210686 - DNA, 20 bp, human
ggctccctggggctaatcaa

SEQ ID NO: 210687 - DNA, 20 bp, human
gcaggggttatgtaaaacat

SEQ ID NO: 210688 - DNA, 20 bp, human
gtctgataaactcatccaac

SEQ ID NO: 210689 - DNA, 20 bp, human
ggcagtgctgcactgctccc

SEQ ID NO: 210690 - DNA, 20 bp, human
gtgataagaaacgagtgaac

SEQ ID NO: 210691 - DNA, 20 bp, human
gctgagagaaagatgtaaga

SEQ ID NO: 210692 - DNA, 20 bp, human
gaacaggtttatagaatgat

SEQ ID NO: 210693 - DNA, 20 bp, human
ggggctaatcaatggcatgt

SEQ ID NO: 210694 - DNA, 20 bp, human
gtaaagatgggatatcatca

SEQ ID NO: 210695 - DNA, 20 bp, human
gatgccattgattagcccca

SEQ ID NO: 210696 - DNA, 20 bp, human
gtgtctggcctctatcagtt

SEQ ID NO: 210697 - DNA, 20 bp, human
gggcctattccatcaaagaa

SEQ ID NO: 210698 - DNA, 20 bp, human
ggtcctggaaatcctaagca

SEQ ID NO: 210699 - DNA, 20 bp, human
gaaagcatcctaactgatag

SEQ ID NO: 210700 - DNA, 20 bp, human
gtcaaaggacaaccatgctt

SEQ ID NO: 210701 - DNA, 20 bp, human
gtcaacctgtttttttttcc

SEQ ID NO: 210702 - DNA, 20 bp, human
gataagagactgacatagtt

SEQ ID NO: 210703 - DNA, 20 bp, human
gctttgatggaataggccct

SEQ ID NO: 210704 - DNA, 20 bp, human
gacaacctggaaaaaaaaac

SEQ ID NO: 210705 - DNA, 20 bp, human
ggtcctttgaacttcatcag

SEQ ID NO: 210706 - DNA, 20 bp, human
ggcgctctggacatcctgat

SEQ ID NO: 210707 - DNA, 20 bp, human
gtggctggcggcatagacga

SEQ ID NO: 210708 - DNA, 20 bp, human
gagacgacggaattttcgat

SEQ ID NO: 210709 - DNA, 20 bp, human
gtcgcgcgccgggcactgac

SEQ ID NO: 210710 - DNA, 20 bp, human
ggcggtgcttccagccattt

SEQ ID NO: 210711 - DNA, 20 bp, human
gtctatgccgccagccaatc

SEQ ID NO: 210712 - DNA, 20 bp, human
ggcgacaccagcagccagtc

SEQ ID NO: 210713 - DNA, 20 bp, human
gggctggaagcaccgcgctc

SEQ ID NO: 210714 - DNA, 20 bp, human
gtggctggttgtattaagga

SEQ ID NO: 210715 - DNA, 20 bp, human
gagctggagtcccaaatggc

SEQ ID NO: 210716 - DNA, 20 bp, human
ggccgcgcgctgggctgacc

SEQ ID NO: 210717 - DNA, 20 bp, human
gggagcgcggaggcagttgg

SEQ ID NO: 210718 - DNA, 20 bp, human
gcgggagactacgcgagacg

SEQ ID NO: 210719 - DNA, 20 bp, human
gggccccgcccatgccgggg

SEQ ID NO: 210720 - DNA, 20 bp, human
ggggcaggtggcaaacttca

SEQ ID NO: 210721 - DNA, 20 bp, human
gcgaagcgcgcagtggacgg

SEQ ID NO: 210722 - DNA, 20 bp, human
ggcgcctgcgcgttgggagc

SEQ ID NO: 210723 - DNA, 20 bp, human
gtggacgtggtgagccggac

SEQ ID NO: 210724 - DNA, 20 bp, human
gcttctgggtcaaggcccgc

SEQ ID NO: 210725 - DNA, 20 bp, human
ggagcgaagcgcgcagtgga

SEQ ID NO: 210726 - DNA, 20 bp, human
gacggggtggggtggaccta

SEQ ID NO: 210727 - DNA, 20 bp, human
gagggagcgcttacggggtg

SEQ ID NO: 210728 - DNA, 20 bp, human
gccaaaaggcggggactctt

SEQ ID NO: 210729 - DNA, 20 bp, human
gcccggagggagcgcttacg

SEQ ID NO: 210730 - DNA, 20 bp, human
gcgaggaaggagggacgacg

SEQ ID NO: 210731 - DNA, 20 bp, human
gctcacccttggggacgttg

SEQ ID NO: 210732 - DNA, 20 bp, human
ggggtggcgactatcccaaa

SEQ ID NO: 210733 - DNA, 20 bp, human
gagcgtggagtcgagctcgt

SEQ ID NO: 210734 - DNA, 20 bp, human
gcggcaggcgcgacagccct

SEQ ID NO: 210735 - DNA, 20 bp, human
ggtggagtcgagctcgtggg

SEQ ID NO: 210736 - DNA, 20 bp, human
gggggcagctcccgacgacc

SEQ ID NO: 210737 - DNA, 20 bp, human
gcgcgcggaggcagaagtcc

SEQ ID NO: 210738 - DNA, 20 bp, human
gaaggggcccgagacaggtc

SEQ ID NO: 210739 - DNA, 20 bp, human
gcgcgcggtggggacgcccc

SEQ ID NO: 210740 - DNA, 20 bp, human
gtctcgggccccttctgcta

SEQ ID NO: 210741 - DNA, 20 bp, human
ggagggcgtggccccgggac

SEQ ID NO: 210742 - DNA, 20 bp, human
gccagagagggcgtggcccc

SEQ ID NO: 210743 - DNA, 20 bp, human
gggtggccgggctccgttag

SEQ ID NO: 210744 - DNA, 20 bp, human
gcaggctgccccactctggg

SEQ ID NO: 210745 - DNA, 20 bp, human
gtgccgtgaccctagcagaa

SEQ ID NO: 210746 - DNA, 20 bp, human
ggggccgcccgagatcaaga

SEQ ID NO: 210747 - DNA, 20 bp, human
gtattccactggaacctcga

SEQ ID NO: 210748 - DNA, 20 bp, human
gcatccgaaccagttgacaa

SEQ ID NO: 210749 - DNA, 20 bp, human
gtcacccttgtcaactggtt

SEQ ID NO: 210750 - DNA, 20 bp, human
gggttcggatgaagcccctg

SEQ ID NO: 210751 - DNA, 20 bp, human
gaggaggcggggcaactgcg

SEQ ID NO: 210752 - DNA, 20 bp, human
gcagacgctgaaggtggatc

SEQ ID NO: 210753 - DNA, 20 bp, human
gataagggaggcggagtgtg

SEQ ID NO: 210754 - DNA, 20 bp, human
gatcaagatggcggccacag

SEQ ID NO: 210755 - DNA, 20 bp, human
gcgggcggccccgataaggg

SEQ ID NO: 210756 - DNA, 20 bp, human
gctctctcagagttcgtctc

SEQ ID NO: 210757 - DNA, 20 bp, human
ggagcgagagcgcaagagca

SEQ ID NO: 210758 - DNA, 20 bp, human
gaggcgagatggggctacgc

SEQ ID NO: 210759 - DNA, 20 bp, human
ggtggggcggaaaggcgaga

SEQ ID NO: 210760 - DNA, 20 bp, human
gtcactacggctaggcccta

SEQ ID NO: 210761 - DNA, 20 bp, human
ggctaggccgtggggcggaa

SEQ ID NO: 210762 - DNA, 20 bp, human
ggcctgtgtgggttagagat

SEQ ID NO: 210763 - DNA, 20 bp, human
gtgcgcacattagacaactt

SEQ ID NO: 210764 - DNA, 20 bp, human
ggccctctcgcgccacaaac

SEQ ID NO: 210765 - DNA, 20 bp, human
gccgacgtctgctttcccta

SEQ ID NO: 210766 - DNA, 20 bp, human
gaggaggcggagactctaca

SEQ ID NO: 210767 - DNA, 20 bp, human
gctacatgggaatcggatat

SEQ ID NO: 210768 - DNA, 20 bp, human
gggagactctacatgggaat

SEQ ID NO: 210769 - DNA, 20 bp, human
gccgcccgagcggtgttttc

SEQ ID NO: 210770 - DNA, 20 bp, human
gcccgggctgcgcctcgctg

SEQ ID NO: 210771 - DNA, 20 bp, human
gccgccccgccggcgtgacc

SEQ ID NO: 210772 - DNA, 20 bp, human
ggggggccgggtcacgccgg

SEQ ID NO: 210773 - DNA, 20 bp, human
gtcaccagaaaacaccgctc

SEQ ID NO: 210774 - DNA, 20 bp, human
ggacggcgagaaccgatcgg

SEQ ID NO: 210775 - DNA, 20 bp, human
gggcgacggcgagaaccgat

SEQ ID NO: 210776 - DNA, 20 bp, human
ggcgctgttacgtaagggga

SEQ ID NO: 210777 - DNA, 20 bp, human
gggccccccggggagggatg

SEQ ID NO: 210778 - DNA, 20 bp, human
gccccctgctgcacgatcct

SEQ ID NO: 210779 - DNA, 20 bp, human
gcccaggcgctgttacgtaa

SEQ ID NO: 210780 - DNA, 20 bp, human
gcccggaagaacgtctttga

SEQ ID NO: 210781 - DNA, 20 bp, human
gaagtatcggccccccgggg

SEQ ID NO: 210782 - DNA, 20 bp, human
gtgccccatccctccccggg

SEQ ID NO: 210783 - DNA, 20 bp, human
ggggccgcgcgactgcccag

SEQ ID NO: 210784 - DNA, 20 bp, human
gggaaggtctccgtggtgac

SEQ ID NO: 210785 - DNA, 20 bp, human
gaaatcaccccggtttgggt

SEQ ID NO: 210786 - DNA, 20 bp, human
ggccccgcccacacgcaacg

SEQ ID NO: 210787 - DNA, 20 bp, human
gtgtgcagcgaactgcagga

SEQ ID NO: 210788 - DNA, 20 bp, human
gcaacgaggcctggccaatt

SEQ ID NO: 210789 - DNA, 20 bp, human
ggccaggcctcgttgcgtgt

SEQ ID NO: 210790 - DNA, 20 bp, human
gccctgaaggcggtcttctg

SEQ ID NO: 210791 - DNA, 20 bp, human
gtggccaattgggtgtgtcg

SEQ ID NO: 210792 - DNA, 20 bp, human
gaaccgcttgggagggtccc

SEQ ID NO: 210793 - DNA, 20 bp, human
ggcagcgaactgcaggaggg

SEQ ID NO: 210794 - DNA, 20 bp, human
gggccctcgacacacccaat

SEQ ID NO: 210795 - DNA, 20 bp, human
gcgaggccggctcacaccca

SEQ ID NO: 210796 - DNA, 20 bp, human
ggcagagaggcccacttctt

SEQ ID NO: 210797 - DNA, 20 bp, human
gggtgctgccggggattccc

SEQ ID NO: 210798 - DNA, 20 bp, human
gtccgcagagcccaagaagt

SEQ ID NO: 210799 - DNA, 20 bp, human
gtcgaggcgaggtgccgcta

SEQ ID NO: 210800 - DNA, 20 bp, human
ggggaggaggaagcgctagg

SEQ ID NO: 210801 - DNA, 20 bp, human
gtagccctcggcgagccggg

SEQ ID NO: 210802 - DNA, 20 bp, human
gaggaggaagcgctaggcgg

SEQ ID NO: 210803 - DNA, 20 bp, human
gcgcccccccggctcgccga

SEQ ID NO: 210804 - DNA, 20 bp, human
gattccccggctcgcctgca

SEQ ID NO: 210805 - DNA, 20 bp, human
gcagaagaaggcagcgccca

SEQ ID NO: 210806 - DNA, 20 bp, human
gggggagggggtacactaga

SEQ ID NO: 210807 - DNA, 20 bp, human
gagggactgagatacctttg

SEQ ID NO: 210808 - DNA, 20 bp, human
ggagggggtacactagaggg

SEQ ID NO: 210809 - DNA, 20 bp, human
gactgtggcacaagttggga

SEQ ID NO: 210810 - DNA, 20 bp, human
gtatcccagctctatgtgga

SEQ ID NO: 210811 - DNA, 20 bp, human
gatacctttggggccaatgc

SEQ ID NO: 210812 - DNA, 20 bp, human
gagaccatccacatagagct

SEQ ID NO: 210813 - DNA, 20 bp, human
ggcacaagttgggagggctc

SEQ ID NO: 210814 - DNA, 20 bp, human
gaagtgactgtggcacaagt

SEQ ID NO: 210815 - DNA, 20 bp, human
gcaaccggggatctagtctg

SEQ ID NO: 210816 - DNA, 20 bp, human
gtggagaaaacagttccaga

SEQ ID NO: 210817 - DNA, 20 bp, human
gatacattgacaaggtcttg

SEQ ID NO: 210818 - DNA, 20 bp, human
gcttgtgtatatttaccatc

SEQ ID NO: 210819 - DNA, 20 bp, human
gtatgaattttgtaatcggt

SEQ ID NO: 210820 - DNA, 20 bp, human
ggttaataatctacaattat

SEQ ID NO: 210821 - DNA, 20 bp, human
gattagcaatagatgcaatt

SEQ ID NO: 210822 - DNA, 20 bp, human
gtaccttttattcattacca

SEQ ID NO: 210823 - DNA, 20 bp, human
gcaactttaatacattgaca

SEQ ID NO: 210824 - DNA, 20 bp, human
gctataggtaaaagcacact

SEQ ID NO: 210825 - DNA, 20 bp, human
gactcatctttgtatttcat

SEQ ID NO: 210826 - DNA, 20 bp, human
gaagctcaatttgcacatga

SEQ ID NO: 210827 - DNA, 20 bp, human
gtgtgcaaattgagcttaat

SEQ ID NO: 210828 - DNA, 20 bp, human
gtttggaatttggaggttct

SEQ ID NO: 210829 - DNA, 20 bp, human
gaagcatggagtaactccat

SEQ ID NO: 210830 - DNA, 20 bp, human
gagatatctttggaatttgg

SEQ ID NO: 210831 - DNA, 20 bp, human
gctgtcattctttaagtatg

SEQ ID NO: 210832 - DNA, 20 bp, human
gtttatagagtgttggccta

SEQ ID NO: 210833 - DNA, 20 bp, human
gttacgaagatatgtatata

SEQ ID NO: 210834 - DNA, 20 bp, human
gttttgaagtttattgaaac

SEQ ID NO: 210835 - DNA, 20 bp, human
ggttgaaaatatttttgtta

SEQ ID NO: 210836 - DNA, 20 bp, human
gagccagaggccttatcact

SEQ ID NO: 210837 - DNA, 20 bp, human
gttctccctgatcccggagc

SEQ ID NO: 210838 - DNA, 20 bp, human
gacgcggttctccctgatcc

SEQ ID NO: 210839 - DNA, 20 bp, human
ggaaccgcgtgccccggtcc

SEQ ID NO: 210840 - DNA, 20 bp, human
ggtcctggagcccggatgag

SEQ ID NO: 210841 - DNA, 20 bp, human
gcgctgcgtccggggaagtg

SEQ ID NO: 210842 - DNA, 20 bp, human
gcggcggagaaaaatctctg

SEQ ID NO: 210843 - DNA, 20 bp, human
gctgcagcgcctctaggctg

SEQ ID NO: 210844 - DNA, 20 bp, human
gcacagaaagtgttagtccc

SEQ ID NO: 210845 - DNA, 20 bp, human
gcagggagaaccgcgtgccc

SEQ ID NO: 210846 - DNA, 20 bp, human
ggccccgcctacgtccccca

SEQ ID NO: 210847 - DNA, 20 bp, human
ggggtcctaaggaaaaagtg

SEQ ID NO: 210848 - DNA, 20 bp, human
gcctaaatacgcttccccgt

SEQ ID NO: 210849 - DNA, 20 bp, human
ggaaggggagacggcgatgt

SEQ ID NO: 210850 - DNA, 20 bp, human
gtgcttaaaacggggaggaa

SEQ ID NO: 210851 - DNA, 20 bp, human
ggggacgtaggcggggccat

SEQ ID NO: 210852 - DNA, 20 bp, human
gcgcactgcttaaaacgggg

SEQ ID NO: 210853 - DNA, 20 bp, human
gtccccgtgggggacgtagg

SEQ ID NO: 210854 - DNA, 20 bp, human
gccaaaggggcggggctaat

SEQ ID NO: 210855 - DNA, 20 bp, human
ggggcggggctaatgggaat

SEQ ID NO: 210856 - DNA, 20 bp, human
gggcccgccacgtggagcgc

SEQ ID NO: 210857 - DNA, 20 bp, human
gggaacgcccacgtcccggg

SEQ ID NO: 210858 - DNA, 20 bp, human
gggacaggggccggagacag

SEQ ID NO: 210859 - DNA, 20 bp, human
gaggcgggactcgagttcag

SEQ ID NO: 210860 - DNA, 20 bp, human
ggccccacgtcaacagcgta

SEQ ID NO: 210861 - DNA, 20 bp, human
gcgctggcttgattctcgaa

SEQ ID NO: 210862 - DNA, 20 bp, human
ggggggaacgcccacgtccc

SEQ ID NO: 210863 - DNA, 20 bp, human
gcccggcagcctggaagagg

SEQ ID NO: 210864 - DNA, 20 bp, human
gaagccagcgctccacgtgg

SEQ ID NO: 210865 - DNA, 20 bp, human
gcgctgttgacgtggggcga

SEQ ID NO: 210866 - DNA, 20 bp, human
gctggagcactggtttctta

SEQ ID NO: 210867 - DNA, 20 bp, human
ggcagctgctctggccacta

SEQ ID NO: 210868 - DNA, 20 bp, human
gtatttgtaacacctagggc

SEQ ID NO: 210869 - DNA, 20 bp, human
gtacttatttgtaacaccta

SEQ ID NO: 210870 - DNA, 20 bp, human
gtgctgcatacacttatcac

SEQ ID NO: 210871 - DNA, 20 bp, human
gagggtagggtgtagataaa

SEQ ID NO: 210872 - DNA, 20 bp, human
gccagcatcgaatttgtacc

SEQ ID NO: 210873 - DNA, 20 bp, human
gaaattcgatgctggagcac

SEQ ID NO: 210874 - DNA, 20 bp, human
gcaaatagtgcactgtctcc

SEQ ID NO: 210875 - DNA, 20 bp, human
gttaaaactaacttagggta

SEQ ID NO: 210876 - DNA, 20 bp, human
gaggactgtggaggcggcgt

SEQ ID NO: 210877 - DNA, 20 bp, human
gaggctgcgccgggcgtcct

SEQ ID NO: 210878 - DNA, 20 bp, human
ggggacccggagaccaagtc

SEQ ID NO: 210879 - DNA, 20 bp, human
ggccgggcggacttgaccgt

SEQ ID NO: 210880 - DNA, 20 bp, human
gccgcctccacagtcctcga

SEQ ID NO: 210881 - DNA, 20 bp, human
gcggcgtgggctggtctccg

SEQ ID NO: 210882 - DNA, 20 bp, human
gccaccgtcgaggactgtgg

SEQ ID NO: 210883 - DNA, 20 bp, human
gccgggcgtcctaggtagga

SEQ ID NO: 210884 - DNA, 20 bp, human
ggggctggtccatcctacct

SEQ ID NO: 210885 - DNA, 20 bp, human
gtcccgccgactctgaccca

SEQ ID NO: 210886 - DNA, 20 bp, human
gcgggcgccgggacggtccg

SEQ ID NO: 210887 - DNA, 20 bp, human
gcgcgtgccgcggaccgtcc

SEQ ID NO: 210888 - DNA, 20 bp, human
gacggtccgcggcacgcggg

SEQ ID NO: 210889 - DNA, 20 bp, human
ggcgcgctctctcgccccgg

SEQ ID NO: 210890 - DNA, 20 bp, human
gtaattggctgcgggaccgg

SEQ ID NO: 210891 - DNA, 20 bp, human
gccgggccccggaagtcgca

SEQ ID NO: 210892 - DNA, 20 bp, human
gtggctgcgggaccggagga

SEQ ID NO: 210893 - DNA, 20 bp, human
gagcccgcccgacttcgggg

SEQ ID NO: 210894 - DNA, 20 bp, human
gcctcggggagctcgtccac

SEQ ID NO: 210895 - DNA, 20 bp, human
ggctcgggctcccgcagggg

SEQ ID NO: 210896 - DNA, 20 bp, human
gccaagttcagcaacatcca

SEQ ID NO: 210897 - DNA, 20 bp, human
gcagtgaagggacggcatcg

SEQ ID NO: 210898 - DNA, 20 bp, human
gggcttagaccaaggatccc

SEQ ID NO: 210899 - DNA, 20 bp, human
gcattctgatcaagcccggg

SEQ ID NO: 210900 - DNA, 20 bp, human
gttcactgatgtttacgcct

SEQ ID NO: 210901 - DNA, 20 bp, human
gggtggtggcactgccaccc

SEQ ID NO: 210902 - DNA, 20 bp, human
gatcggggcctggagcgcct

SEQ ID NO: 210903 - DNA, 20 bp, human
ggtcccggagcaatctgaag

SEQ ID NO: 210904 - DNA, 20 bp, human
gctcacacctgtaagtggag

SEQ ID NO: 210905 - DNA, 20 bp, human
gtgaacattctgatcaagcc

SEQ ID NO: 210906 - DNA, 20 bp, human
gcttgcggagacccgaggga

SEQ ID NO: 210907 - DNA, 20 bp, human
gagggagcgctgaagcggtg

SEQ ID NO: 210908 - DNA, 20 bp, human
gggcggggaccgggaaagac

SEQ ID NO: 210909 - DNA, 20 bp, human
gcgggctgccgggggtagag

SEQ ID NO: 210910 - DNA, 20 bp, human
gggaccgggaaagaccgggc

SEQ ID NO: 210911 - DNA, 20 bp, human
ggctgcctacgtcctgtcgc

SEQ ID NO: 210912 - DNA, 20 bp, human
gttggccggcgacaggacgt

SEQ ID NO: 210913 - DNA, 20 bp, human
gcgcgcagcccggggctcag

SEQ ID NO: 210914 - DNA, 20 bp, human
ggaagcggtgcgggctgccg

SEQ ID NO: 210915 - DNA, 20 bp, human
gggcgcaggcggagcctcat

SEQ ID NO: 210916 - DNA, 20 bp, human
ggagcgcagcgcaccctctc

SEQ ID NO: 210917 - DNA, 20 bp, human
ggcagcgcaccctctccggg

SEQ ID NO: 210918 - DNA, 20 bp, human
gggtgagcgccgcccccact

SEQ ID NO: 210919 - DNA, 20 bp, human
gagagtcagccgagtggggg

SEQ ID NO: 210920 - DNA, 20 bp, human
gaaagagcgcaggcccctgc

SEQ ID NO: 210921 - DNA, 20 bp, human
gcggagagtcagccgagtgg

SEQ ID NO: 210922 - DNA, 20 bp, human
gcccgccatagtcccaccac

SEQ ID NO: 210923 - DNA, 20 bp, human
gcctgcgctctttcccgctt

SEQ ID NO: 210924 - DNA, 20 bp, human
ggggcggagagtcagccgag

SEQ ID NO: 210925 - DNA, 20 bp, human
gttaaggccagagcccgtga

SEQ ID NO: 210926 - DNA, 20 bp, human
ggaggggtgcggactagcag

SEQ ID NO: 210927 - DNA, 20 bp, human
gcggggccttgcagctggta

SEQ ID NO: 210928 - DNA, 20 bp, human
gccgccgggtcgcaccaggt

SEQ ID NO: 210929 - DNA, 20 bp, human
gggcggggtcttgacagcta

SEQ ID NO: 210930 - DNA, 20 bp, human
ggcgacccggcggagcgcgt

SEQ ID NO: 210931 - DNA, 20 bp, human
ggggctgagtaactggtaga

SEQ ID NO: 210932 - DNA, 20 bp, human
ggactagcagaggccgagag

SEQ ID NO: 210933 - DNA, 20 bp, human
gccttgcagctggtagggtg

SEQ ID NO: 210934 - DNA, 20 bp, human
gcgctccgccgggtcgcacc

SEQ ID NO: 210935 - DNA, 20 bp, human
gtcccaaagcccacagcccg

SEQ ID NO: 210936 - DNA, 20 bp, human
gccatcccgaggaatggtag

SEQ ID NO: 210937 - DNA, 20 bp, human
ggcagccaatggaaaggcgg

SEQ ID NO: 210938 - DNA, 20 bp, human
ggggccgggtctttccgcac

SEQ ID NO: 210939 - DNA, 20 bp, human
ggctgcctctaccattcctc

SEQ ID NO: 210940 - DNA, 20 bp, human
gctgatgcaagcgaagcggg

SEQ ID NO: 210941 - DNA, 20 bp, human
ggcggcagccaatggaaagg

SEQ ID NO: 210942 - DNA, 20 bp, human
gcgcgccccatcccgaggaa

SEQ ID NO: 210943 - DNA, 20 bp, human
ggggtggcgctaggtacccc

SEQ ID NO: 210944 - DNA, 20 bp, human
ggctaggtacccccggcccg

SEQ ID NO: 210945 - DNA, 20 bp, human
gcagctgatgcaagcgaagc

SEQ ID NO: 210946 - DNA, 20 bp, human
gccccaaaacctgggctgta

SEQ ID NO: 210947 - DNA, 20 bp, human
ggagctgcatgctctcactg

SEQ ID NO: 210948 - DNA, 20 bp, human
gggggccctgtgcacactgg

SEQ ID NO: 210949 - DNA, 20 bp, human
gtcctgggcaggaactccaa

SEQ ID NO: 210950 - DNA, 20 bp, human
ggtggctgggggtgcgtttc

SEQ ID NO: 210951 - DNA, 20 bp, human
gcaacgagagagcagattta

SEQ ID NO: 210952 - DNA, 20 bp, human
gccggggcagcggtggctgg

SEQ ID NO: 210953 - DNA, 20 bp, human
gtgaacaaaagcaaacagcc

SEQ ID NO: 210954 - DNA, 20 bp, human
gccacgcccagggcaaacat

SEQ ID NO: 210955 - DNA, 20 bp, human
gcatctggcagcggcaagtc

SEQ ID NO: 210956 - DNA, 20 bp, human
gtgggcgaggccgtgaacag

SEQ ID NO: 210957 - DNA, 20 bp, human
ggggccgcccaggccaatag

SEQ ID NO: 210958 - DNA, 20 bp, human
gggcagcgggctgggatgta

SEQ ID NO: 210959 - DNA, 20 bp, human
ggagtcccactgccagtcgg

SEQ ID NO: 210960 - DNA, 20 bp, human
ggcccaggccaataggggtg

SEQ ID NO: 210961 - DNA, 20 bp, human
gtgccagtcggaggcgccgg

SEQ ID NO: 210962 - DNA, 20 bp, human
gactggcagtgggactcagc

SEQ ID NO: 210963 - DNA, 20 bp, human
gtcagcgggcgtggaggtcg

SEQ ID NO: 210964 - DNA, 20 bp, human
gcagcccgctgccagagccg

SEQ ID NO: 210965 - DNA, 20 bp, human
gccaataggggtgaggcttt

SEQ ID NO: 210966 - DNA, 20 bp, human
gaggctagagccacacagca

SEQ ID NO: 210967 - DNA, 20 bp, human
ggagatgtcgaggcccccga

SEQ ID NO: 210968 - DNA, 20 bp, human
gagaagaagtcaacgcccag

SEQ ID NO: 210969 - DNA, 20 bp, human
gtcaacgcccagagggcgcc

SEQ ID NO: 210970 - DNA, 20 bp, human
gccaacgcagggccagtccc

SEQ ID NO: 210971 - DNA, 20 bp, human
gagagtcaggcacgaggcta

SEQ ID NO: 210972 - DNA, 20 bp, human
gggtctgggaggagatgtcg

SEQ ID NO: 210973 - DNA, 20 bp, human
gatgtcgaggcccccgaggg

SEQ ID NO: 210974 - DNA, 20 bp, human
gctctagcctggcgccctct

SEQ ID NO: 210975 - DNA, 20 bp, human
gagggccagtccccggggga

SEQ ID NO: 210976 - DNA, 20 bp, human
gaaccccaggggaaggtcac

SEQ ID NO: 210977 - DNA, 20 bp, human
gggtcctggcagtgagacaa

SEQ ID NO: 210978 - DNA, 20 bp, human
gctgtgcagtgtggtccctg

SEQ ID NO: 210979 - DNA, 20 bp, human
gccccccatggcccctccta

SEQ ID NO: 210980 - DNA, 20 bp, human
gcacactgcacagccggctt

SEQ ID NO: 210981 - DNA, 20 bp, human
gtggcaatggggtaatcaat

SEQ ID NO: 210982 - DNA, 20 bp, human
ggaacaggttagacaagtca

SEQ ID NO: 210983 - DNA, 20 bp, human
ggcacagccggcttgggaac

SEQ ID NO: 210984 - DNA, 20 bp, human
gaagcctgaagagtgaggac

SEQ ID NO: 210985 - DNA, 20 bp, human
gaccctaggaggggccatgg

SEQ ID NO: 210986 - DNA, 20 bp, human
gaacccggggcgcacgccag

SEQ ID NO: 210987 - DNA, 20 bp, human
ggggtcgaggagtctggtag

SEQ ID NO: 210988 - DNA, 20 bp, human
ggctaaatatagtgggactt

SEQ ID NO: 210989 - DNA, 20 bp, human
ggcaggaccgccccgctgat

SEQ ID NO: 210990 - DNA, 20 bp, human
gggggggaaacggatcaccc

SEQ ID NO: 210991 - DNA, 20 bp, human
ggcaccacctcgatcctcgg

SEQ ID NO: 210992 - DNA, 20 bp, human
gtggtatgacccgggagaga

SEQ ID NO: 210993 - DNA, 20 bp, human
gcgggtcataccataaagag

SEQ ID NO: 210994 - DNA, 20 bp, human
gcccgagctcggaggacagc

SEQ ID NO: 210995 - DNA, 20 bp, human
gtggctgatcccgagctcgg

SEQ ID NO: 210996 - DNA, 20 bp, human
gtcgccagtagatgcacctg

SEQ ID NO: 210997 - DNA, 20 bp, human
gctggcgcgaccttctcccg

SEQ ID NO: 210998 - DNA, 20 bp, human
gccaaccctcccccgggaga

SEQ ID NO: 210999 - DNA, 20 bp, human
gccgcgcggcgcttagggca

SEQ ID NO: 211000 - DNA, 20 bp, human
gcggtgcagcgagaaagacg

SEQ ID NO: 211001 - DNA, 20 bp, human
gcgagaaagacgcggagaga

SEQ ID NO: 211002 - DNA, 20 bp, human
gcgcgcgcacgggaacgcag

SEQ ID NO: 211003 - DNA, 20 bp, human
ggagagagggcgctgctctg

SEQ ID NO: 211004 - DNA, 20 bp, human
gggagggttgggttcgggga

SEQ ID NO: 211005 - DNA, 20 bp, human
gggacgcgcggggaaagcgt

SEQ ID NO: 211006 - DNA, 20 bp, human
gctacctccgcctacgtcat

SEQ ID NO: 211007 - DNA, 20 bp, human
gcagccaatgacgtaggcgg

SEQ ID NO: 211008 - DNA, 20 bp, human
gccacctcagccaatgacgt

SEQ ID NO: 211009 - DNA, 20 bp, human
ggtagggagtgtccaagtca

SEQ ID NO: 211010 - DNA, 20 bp, human
gtggggataagtgattggtt

SEQ ID NO: 211011 - DNA, 20 bp, human
gcttccccgtgtgctcggta

SEQ ID NO: 211012 - DNA, 20 bp, human
gaactccgattggccaaggg

SEQ ID NO: 211013 - DNA, 20 bp, human
gtggaactccgattggccaa

SEQ ID NO: 211014 - DNA, 20 bp, human
ggggtgtgaggagaggaatc

SEQ ID NO: 211015 - DNA, 20 bp, human
gactccctaccgagcacacg

SEQ ID NO: 211016 - DNA, 20 bp, human
gggctcctccggaagaccag

SEQ ID NO: 211017 - DNA, 20 bp, human
ggaacaatgggagtgctaca

SEQ ID NO: 211018 - DNA, 20 bp, human
gagaccaggggcagacgggg

SEQ ID NO: 211019 - DNA, 20 bp, human
ggagtgctacagggaggagt

SEQ ID NO: 211020 - DNA, 20 bp, human
gccgcccgggagaacccatt

SEQ ID NO: 211021 - DNA, 20 bp, human
gtggcggggtcgtgcccagt

SEQ ID NO: 211022 - DNA, 20 bp, human
gctgcccaatgggttctccc

SEQ ID NO: 211023 - DNA, 20 bp, human
gccgtctgcccctggtcttc

SEQ ID NO: 211024 - DNA, 20 bp, human
gaggggtcgggtctgcccaa

SEQ ID NO: 211025 - DNA, 20 bp, human
ggaatcctgcctggaacaat

SEQ ID NO: 211026 - DNA, 20 bp, human
gggaagggggaggctcactc

SEQ ID NO: 211027 - DNA, 20 bp, human
gttggtaaaggggaagatgg

SEQ ID NO: 211028 - DNA, 20 bp, human
gccaatcagtgaatgtggga

SEQ ID NO: 211029 - DNA, 20 bp, human
gactctcttagttctgagtt

SEQ ID NO: 211030 - DNA, 20 bp, human
gcacattcactgattggtaa

SEQ ID NO: 211031 - DNA, 20 bp, human
gagtaatggttacttcatat

SEQ ID NO: 211032 - DNA, 20 bp, human
gaatgctctctgagagcgtc

SEQ ID NO: 211033 - DNA, 20 bp, human
gacacacaattatccatgtc

SEQ ID NO: 211034 - DNA, 20 bp, human
ggacagatgccctctttccg

SEQ ID NO: 211035 - DNA, 20 bp, human
gtctagtacattacctgaca

SEQ ID NO: 211036 - DNA, 20 bp, human
gtgtgtggggtatggcgggg

SEQ ID NO: 211037 - DNA, 20 bp, human
gaccccacacagtctccagg

SEQ ID NO: 211038 - DNA, 20 bp, human
ggactgtgtggggtatggcg

SEQ ID NO: 211039 - DNA, 20 bp, human
gcataccccacacagtctcc

SEQ ID NO: 211040 - DNA, 20 bp, human
gcagtcactcgattcctctg

SEQ ID NO: 211041 - DNA, 20 bp, human
ggggccgcgggatcggttct

SEQ ID NO: 211042 - DNA, 20 bp, human
gttcctctgcggtccaggcc

SEQ ID NO: 211043 - DNA, 20 bp, human
gtatcgcctgaagaaggcag

SEQ ID NO: 211044 - DNA, 20 bp, human
gtctcctagaaccgatcccg

SEQ ID NO: 211045 - DNA, 20 bp, human
gggcagaggctgacgggccg

SEQ ID NO: 211046 - DNA, 20 bp, human
gaggccgcgctaggaagggg

SEQ ID NO: 211047 - DNA, 20 bp, human
gcagaggccgcgctaggaag

SEQ ID NO: 211048 - DNA, 20 bp, human
gtggtccgagtcacgtccga

SEQ ID NO: 211049 - DNA, 20 bp, human
gtctgggctgcgcctctcgg

SEQ ID NO: 211050 - DNA, 20 bp, human
ggactcggaccacatcccgc

SEQ ID NO: 211051 - DNA, 20 bp, human
gtggggagggatcgtgttct

SEQ ID NO: 211052 - DNA, 20 bp, human
gtccgagtcacgtccgaggg

SEQ ID NO: 211053 - DNA, 20 bp, human
gcacatcccgcgggtcgcta

SEQ ID NO: 211054 - DNA, 20 bp, human
gccagagcgcgccaggctgg

SEQ ID NO: 211055 - DNA, 20 bp, human
gcaatggcaggcgacggact

SEQ ID NO: 211056 - DNA, 20 bp, human
gagtcaatgatggagctcta

SEQ ID NO: 211057 - DNA, 20 bp, human
ggggtccattaaatgatact

SEQ ID NO: 211058 - DNA, 20 bp, human
gtatgagcataaggagtata

SEQ ID NO: 211059 - DNA, 20 bp, human
gactaggtcaaggtagaaag

SEQ ID NO: 211060 - DNA, 20 bp, human
gtgggcatgattttaaggac

SEQ ID NO: 211061 - DNA, 20 bp, human
ggtctggattaggaactcca

SEQ ID NO: 211062 - DNA, 20 bp, human
gacacctccctactaggtca

SEQ ID NO: 211063 - DNA, 20 bp, human
gttgtttatgagccaatcag

SEQ ID NO: 211064 - DNA, 20 bp, human
gaggtcaaggtagaaagggg

SEQ ID NO: 211065 - DNA, 20 bp, human
ggactagctgtatgacttaa

SEQ ID NO: 211066 - DNA, 20 bp, human
gtagttgtgctcagtggcta

SEQ ID NO: 211067 - DNA, 20 bp, human
gccactgagcacaactaaac

SEQ ID NO: 211068 - DNA, 20 bp, human
ggcaacacattggtctaatg

SEQ ID NO: 211069 - DNA, 20 bp, human
gtctaatgaggcctggagat

SEQ ID NO: 211070 - DNA, 20 bp, human
gaaggacaagaggtcccacc

SEQ ID NO: 211071 - DNA, 20 bp, human
gtgaatgagaagctagatta

SEQ ID NO: 211072 - DNA, 20 bp, human
ggattaggggtgatgaagac

SEQ ID NO: 211073 - DNA, 20 bp, human
gccaggacctgaaggacaag

SEQ ID NO: 211074 - DNA, 20 bp, human
gctgcagtgtaaatgtgcca

SEQ ID NO: 211075 - DNA, 20 bp, human
ggctatggattgcaacacat

SEQ ID NO: 211076 - DNA, 20 bp, human
ggggcagtccctaacagcca

SEQ ID NO: 211077 - DNA, 20 bp, human
gcacgccctcagaggcgggg

SEQ ID NO: 211078 - DNA, 20 bp, human
ggcgccccgccaggcatccg

SEQ ID NO: 211079 - DNA, 20 bp, human
gcaggcatccgtggctgtta

SEQ ID NO: 211080 - DNA, 20 bp, human
gtgccccggacaccagtcct

SEQ ID NO: 211081 - DNA, 20 bp, human
gggactgccctcccacctcg

SEQ ID NO: 211082 - DNA, 20 bp, human
ggtgcccggcacgtggtaaa

SEQ ID NO: 211083 - DNA, 20 bp, human
gtccccaggactggtgtccg

SEQ ID NO: 211084 - DNA, 20 bp, human
gagggggtgtggtcagggcg

SEQ ID NO: 211085 - DNA, 20 bp, human
gagctacgtgactcctccgg

SEQ ID NO: 211086 - DNA, 20 bp, human
gaggggcccggggaaccccc

SEQ ID NO: 211087 - DNA, 20 bp, human
gcagaccgagcctccgaagt

SEQ ID NO: 211088 - DNA, 20 bp, human
gccctctcggcccacttcgg

SEQ ID NO: 211089 - DNA, 20 bp, human
ggttccccgggcccctgtta

SEQ ID NO: 211090 - DNA, 20 bp, human
gcactggtgtgtagggaatc

SEQ ID NO: 211091 - DNA, 20 bp, human
gtggacgcggttccctaaca

SEQ ID NO: 211092 - DNA, 20 bp, human
gagagggcgagaagtggacg

SEQ ID NO: 211093 - DNA, 20 bp, human
gggaaatacactggtgtgta

SEQ ID NO: 211094 - DNA, 20 bp, human
gcgcacagcgcgaggaagcg

SEQ ID NO: 211095 - DNA, 20 bp, human
ggccaagaattagtagtagt

SEQ ID NO: 211096 - DNA, 20 bp, human
gccgggcaatgcgattgaga

SEQ ID NO: 211097 - DNA, 20 bp, human
gagccacgcacctcccgcgc

SEQ ID NO: 211098 - DNA, 20 bp, human
gagcgcggatccggaaagat

SEQ ID NO: 211099 - DNA, 20 bp, human
gaacagcgacccgatctttc

SEQ ID NO: 211100 - DNA, 20 bp, human
gccaattccaagccctaaaa

SEQ ID NO: 211101 - DNA, 20 bp, human
gttgacactttgtgcgcccc

SEQ ID NO: 211102 - DNA, 20 bp, human
gaaaaaatgtgtccatttta

SEQ ID NO: 211103 - DNA, 20 bp, human
gtcaaaacttccggaagggg

SEQ ID NO: 211104 - DNA, 20 bp, human
gaagtgtcaaaacttccgga

SEQ ID NO: 211105 - DNA, 20 bp, human
gtctcggatttcgccagcgc

SEQ ID NO: 211106 - DNA, 20 bp, human
gtgcgccccgagtaatgtga

SEQ ID NO: 211107 - DNA, 20 bp, human
ggatttcgcgagcgcgggag

SEQ ID NO: 211108 - DNA, 20 bp, human
gctctccatcacattactcg

SEQ ID NO: 211109 - DNA, 20 bp, human
gggggcgtggcttgctgctt

SEQ ID NO: 211110 - DNA, 20 bp, human
ggcgcggatccggaaaacag

SEQ ID NO: 211111 - DNA, 20 bp, human
gacagcgacccgctgttttc

SEQ ID NO: 211112 - DNA, 20 bp, human
gaaaaaatgtgttaatttta

SEQ ID NO: 211113 - DNA, 20 bp, human
gaaccttggagtgtaggaag

SEQ ID NO: 211114 - DNA, 20 bp, human
ggtgtcaaaacttccggaaa

SEQ ID NO: 211115 - DNA, 20 bp, human
ggtaagtgatggaaatgagc

SEQ ID NO: 211116 - DNA, 20 bp, human
gcagccaatagaatatgccg

SEQ ID NO: 211117 - DNA, 20 bp, human
gacgcctcggcatattctat

SEQ ID NO: 211118 - DNA, 20 bp, human
gcgaacactagtctacgcct

SEQ ID NO: 211119 - DNA, 20 bp, human
gggctcccgcccccgtgggc

SEQ ID NO: 211120 - DNA, 20 bp, human
gagcgacggctgtcaatcac

SEQ ID NO: 211121 - DNA, 20 bp, human
gctattggctggaaggccgt

SEQ ID NO: 211122 - DNA, 20 bp, human
gcgtagactagtgttcggcg

SEQ ID NO: 211123 - DNA, 20 bp, human
gactgctgtcccgcccacgg

SEQ ID NO: 211124 - DNA, 20 bp, human
gcaggcgggggcttctagtg

SEQ ID NO: 211125 - DNA, 20 bp, human
gcgggggcttctagtggggg

SEQ ID NO: 211126 - DNA, 20 bp, human
gccgcgccggcctgtccccc

SEQ ID NO: 211127 - DNA, 20 bp, human
gcgccacgagaggtgaccaa

SEQ ID NO: 211128 - DNA, 20 bp, human
gcccgcccccggactcctgg

SEQ ID NO: 211129 - DNA, 20 bp, human
gtctcgtggcgaactcggat

SEQ ID NO: 211130 - DNA, 20 bp, human
ggggccatatcaggccgggg

SEQ ID NO: 211131 - DNA, 20 bp, human
gccgcgccgctattggttga

SEQ ID NO: 211132 - DNA, 20 bp, human
ggggtcccatcaaccaatag

SEQ ID NO: 211133 - DNA, 20 bp, human
gtcacctctcgtggcgaact

SEQ ID NO: 211134 - DNA, 20 bp, human
gagggcacagagggtctctg

SEQ ID NO: 211135 - DNA, 20 bp, human
gtcccattggtcacctctcg

SEQ ID NO: 211136 - DNA, 20 bp, human
ggggtggggcaaaagactat

SEQ ID NO: 211137 - DNA, 20 bp, human
gtggggcaaaagactattgg

SEQ ID NO: 211138 - DNA, 20 bp, human
gccaaccggtgacacagccc

SEQ ID NO: 211139 - DNA, 20 bp, human
ggctggctcctacacataaa

SEQ ID NO: 211140 - DNA, 20 bp, human
ggggaggcggaaatccgtaa

SEQ ID NO: 211141 - DNA, 20 bp, human
gagtgaggggtctcaagagc

SEQ ID NO: 211142 - DNA, 20 bp, human
gcgccccctggcggccatta

SEQ ID NO: 211143 - DNA, 20 bp, human
ggccggatatgacgcaactg

SEQ ID NO: 211144 - DNA, 20 bp, human
gtatccggcccttgcgatca

SEQ ID NO: 211145 - DNA, 20 bp, human
gccccattcccttatagtga

SEQ ID NO: 211146 - DNA, 20 bp, human
gggaggacgcacgtcttggt

SEQ ID NO: 211147 - DNA, 20 bp, human
gtgccgaagcgactcaaacg

SEQ ID NO: 211148 - DNA, 20 bp, human
gcgcatgcgtccaacttccg

SEQ ID NO: 211149 - DNA, 20 bp, human
gacgcggaggacgcacgtct

SEQ ID NO: 211150 - DNA, 20 bp, human
gcgaagcgactcaaacgcgg

SEQ ID NO: 211151 - DNA, 20 bp, human
ggacgcacgtcttggtgggc

SEQ ID NO: 211152 - DNA, 20 bp, human
gacaatccgcgcagaagcag

SEQ ID NO: 211153 - DNA, 20 bp, human
gaatatgcagtttccctgta

SEQ ID NO: 211154 - DNA, 20 bp, human
ggggagtttcgggaccttta

SEQ ID NO: 211155 - DNA, 20 bp, human
gtgtcaaagttcacaactac

SEQ ID NO: 211156 - DNA, 20 bp, human
gcatcagcgcaaatctgtga

SEQ ID NO: 211157 - DNA, 20 bp, human
gaactgacgcacgtacggca

SEQ ID NO: 211158 - DNA, 20 bp, human
gccgaaggaaaaatataacc

SEQ ID NO: 211159 - DNA, 20 bp, human
gccagctgccggtctttcgg

SEQ ID NO: 211160 - DNA, 20 bp, human
ggacgcacgtacggcagggc

SEQ ID NO: 211161 - DNA, 20 bp, human
gtcggcccgcagtggccagc

SEQ ID NO: 211162 - DNA, 20 bp, human
gaccttgcctgcaagtccgg

SEQ ID NO: 211163 - DNA, 20 bp, human
gcgcgctcgtagctcccagc

SEQ ID NO: 211164 - DNA, 20 bp, human
gcagctggcgagactgactc

SEQ ID NO: 211165 - DNA, 20 bp, human
gtcagacaagatattttctc

SEQ ID NO: 211166 - DNA, 20 bp, human
gggagcgtggagtgcatcag

SEQ ID NO: 211167 - DNA, 20 bp, human
gtctaggagggcacggaagg

SEQ ID NO: 211168 - DNA, 20 bp, human
gagggcgcctccggagttac

SEQ ID NO: 211169 - DNA, 20 bp, human
gtgagagcatggcctctcca

SEQ ID NO: 211170 - DNA, 20 bp, human
gggtacccgcagttccgctc

SEQ ID NO: 211171 - DNA, 20 bp, human
gcgcagctccggctctagga

SEQ ID NO: 211172 - DNA, 20 bp, human
ggtccagaccctgaatcctc

SEQ ID NO: 211173 - DNA, 20 bp, human
gtccctgctcctatggagcg

SEQ ID NO: 211174 - DNA, 20 bp, human
gcagggctgggtataaactg

SEQ ID NO: 211175 - DNA, 20 bp, human
gtccgctccggtaactccgg

SEQ ID NO: 211176 - DNA, 20 bp, human
gcgtgccctcggcgcccagt

SEQ ID NO: 211177 - DNA, 20 bp, human
gggagcgctaggttccacag

SEQ ID NO: 211178 - DNA, 20 bp, human
gggcgccgagggcacgagag

SEQ ID NO: 211179 - DNA, 20 bp, human
gtccaccgactgggcgccga

SEQ ID NO: 211180 - DNA, 20 bp, human
gcaatcccgcacctccacac

SEQ ID NO: 211181 - DNA, 20 bp, human
gtaaacctggcgccccgctg

SEQ ID NO: 211182 - DNA, 20 bp, human
gaacgccgctctcgtgccct

SEQ ID NO: 211183 - DNA, 20 bp, human
ggcgctcctctccaccgact

SEQ ID NO: 211184 - DNA, 20 bp, human
gtccgcctgtgtggaggtgc

SEQ ID NO: 211185 - DNA, 20 bp, human
gggcgcgacctctctggcgg

SEQ ID NO: 211186 - DNA, 20 bp, human
gcgagcccgtcgagcgtgag

SEQ ID NO: 211187 - DNA, 20 bp, human
gagagccgatggaacccgag

SEQ ID NO: 211188 - DNA, 20 bp, human
gcccgtcgagcgtgagggga

SEQ ID NO: 211189 - DNA, 20 bp, human
gaggggaggggcgggcaacc

SEQ ID NO: 211190 - DNA, 20 bp, human
ggaggcggggcaagagccga

SEQ ID NO: 211191 - DNA, 20 bp, human
ggggacctctcgggttccat

SEQ ID NO: 211192 - DNA, 20 bp, human
gaggcggccggcttaggagg

SEQ ID NO: 211193 - DNA, 20 bp, human
gccagccccgggttaggcta

SEQ ID NO: 211194 - DNA, 20 bp, human
ggacaggaggcggccggctt

SEQ ID NO: 211195 - DNA, 20 bp, human
gtgcgcgctcgcccccgcgg

SEQ ID NO: 211196 - DNA, 20 bp, human
gccggcccggggtgagacgc

SEQ ID NO: 211197 - DNA, 20 bp, human
ggtctcaccccgggccggaa

SEQ ID NO: 211198 - DNA, 20 bp, human
ggcgagcggcgcagccagtc

SEQ ID NO: 211199 - DNA, 20 bp, human
gagacgcgggtctaaagaaa

SEQ ID NO: 211200 - DNA, 20 bp, human
gctgactgcagtccccggac

SEQ ID NO: 211201 - DNA, 20 bp, human
gcaggagcccttccggcccg

SEQ ID NO: 211202 - DNA, 20 bp, human
ggcgggtctaaagaaaaggt

SEQ ID NO: 211203 - DNA, 20 bp, human
gtggctacaaacgcctgcgc

SEQ ID NO: 211204 - DNA, 20 bp, human
gcccgctagctgcgcgcatg

SEQ ID NO: 211205 - DNA, 20 bp, human
gtagacccgcgtctcacccc

SEQ ID NO: 211206 - DNA, 20 bp, human
gctgaaaagtgacggaaaag

SEQ ID NO: 211207 - DNA, 20 bp, human
gaatggctagagttagaagc

SEQ ID NO: 211208 - DNA, 20 bp, human
ggagcgcgcagacatagctt

SEQ ID NO: 211209 - DNA, 20 bp, human
gtgacggaaaagagggttgg

SEQ ID NO: 211210 - DNA, 20 bp, human
gctgaggagtttcttcatca

SEQ ID NO: 211211 - DNA, 20 bp, human
gcgcgctcaccgacttcata

SEQ ID NO: 211212 - DNA, 20 bp, human
ggagttagaagcaggtggat

SEQ ID NO: 211213 - DNA, 20 bp, human
gagcgaagaaatagaacctg

SEQ ID NO: 211214 - DNA, 20 bp, human
gagcgttactgggccaattg

SEQ ID NO: 211215 - DNA, 20 bp, human
gctcggggatctgccccaat

SEQ ID NO: 211216 - DNA, 20 bp, human
ggggcgaggccggactgcgt

SEQ ID NO: 211217 - DNA, 20 bp, human
gggcctctgcagatttgcat

SEQ ID NO: 211218 - DNA, 20 bp, human
gctcctatgcaaatctgcag

SEQ ID NO: 211219 - DNA, 20 bp, human
gctgcccgacccacgcagtc

SEQ ID NO: 211220 - DNA, 20 bp, human
gcaccctccaaccaatggcg

SEQ ID NO: 211221 - DNA, 20 bp, human
ggagactggagagggaacag

SEQ ID NO: 211222 - DNA, 20 bp, human
gaggccggactgcgtgggtc

SEQ ID NO: 211223 - DNA, 20 bp, human
gaatagggcagggaatctag

SEQ ID NO: 211224 - DNA, 20 bp, human
gacccgcaccctccaaccaa

SEQ ID NO: 211225 - DNA, 20 bp, human
ggaggggaagaacaagagac

SEQ ID NO: 211226 - DNA, 20 bp, human
gtcagcagcgagaggtgctg

SEQ ID NO: 211227 - DNA, 20 bp, human
gagggtataggccgcgagat

SEQ ID NO: 211228 - DNA, 20 bp, human
ggatccggaaattttttccg

SEQ ID NO: 211229 - DNA, 20 bp, human
gcttccggatcagagggtat

SEQ ID NO: 211230 - DNA, 20 bp, human
gaatctgcttccggatcaga

SEQ ID NO: 211231 - DNA, 20 bp, human
gcggcctataccctctgatc

SEQ ID NO: 211232 - DNA, 20 bp, human
gtggcggcctcagcagcgag

SEQ ID NO: 211233 - DNA, 20 bp, human
gcgtagaagtatcaatcagc

SEQ ID NO: 211234 - DNA, 20 bp, human
gcggccccggaaaaaatttc

SEQ ID NO: 211235 - DNA, 20 bp, human
gacacgagagaatctgcttc

SEQ ID NO: 211236 - DNA, 20 bp, human
gacggctggggtgagaactg

SEQ ID NO: 211237 - DNA, 20 bp, human
gttcccgttgatcacctgtt

SEQ ID NO: 211238 - DNA, 20 bp, human
ggggccactgtcgagaatca

SEQ ID NO: 211239 - DNA, 20 bp, human
gggcccaacaggtgatcaac

SEQ ID NO: 211240 - DNA, 20 bp, human
ggcacgctgggaactacggc

SEQ ID NO: 211241 - DNA, 20 bp, human
gcctgctggcctcccgtgtg

SEQ ID NO: 211242 - DNA, 20 bp, human
gagtgcttgccacacacggg

SEQ ID NO: 211243 - DNA, 20 bp, human
gaggccagcaggtggcacca

SEQ ID NO: 211244 - DNA, 20 bp, human
gaagacgcgccccagcgaat

SEQ ID NO: 211245 - DNA, 20 bp, human
gtgggaactacggcaggcta

SEQ ID NO: 211246 - DNA, 20 bp, human
gtggagggcctaatcaccga

SEQ ID NO: 211247 - DNA, 20 bp, human
gtcaccgaaggtgctgatga

SEQ ID NO: 211248 - DNA, 20 bp, human
ggcaggggagcggtgtgaag

SEQ ID NO: 211249 - DNA, 20 bp, human
gcggactgaggactgcgcac

SEQ ID NO: 211250 - DNA, 20 bp, human
ggcagcgccgccactacttc

SEQ ID NO: 211251 - DNA, 20 bp, human
ggaggggatatgtgttgcag

SEQ ID NO: 211252 - DNA, 20 bp, human
gatcccctcatcagcacctt

SEQ ID NO: 211253 - DNA, 20 bp, human
gcacatcccccgcgcctgga

SEQ ID NO: 211254 - DNA, 20 bp, human
ggacagggattgagagtgca

SEQ ID NO: 211255 - DNA, 20 bp, human
gggagcggtgtgaaggggtc

SEQ ID NO: 211256 - DNA, 20 bp, human
gacaagcgggccgttgggga

SEQ ID NO: 211257 - DNA, 20 bp, human
gcgaccggctggggaagatc

SEQ ID NO: 211258 - DNA, 20 bp, human
gagcccggcactggcgtccg

SEQ ID NO: 211259 - DNA, 20 bp, human
gctgacccagtcggccaccc

SEQ ID NO: 211260 - DNA, 20 bp, human
gctcctgggctcagttaccg

SEQ ID NO: 211261 - DNA, 20 bp, human
gtggccgactgggtcagcgc

SEQ ID NO: 211262 - DNA, 20 bp, human
ggcagggcgacgccacacgc

SEQ ID NO: 211263 - DNA, 20 bp, human
ggtctcctggagcccggcac

SEQ ID NO: 211264 - DNA, 20 bp, human
gccccaagagcgaccggctg

SEQ ID NO: 211265 - DNA, 20 bp, human
ggtccgcggtaactgagccc

SEQ ID NO: 211266 - DNA, 20 bp, human
gccccagggcgcattcacca

SEQ ID NO: 211267 - DNA, 20 bp, human
gaggggcggcggacggcaag

SEQ ID NO: 211268 - DNA, 20 bp, human
gcgcagacgcctcaacccca

SEQ ID NO: 211269 - DNA, 20 bp, human
gccgaagggctccctctaca

SEQ ID NO: 211270 - DNA, 20 bp, human
gcgccggcgcaagcgcagac

SEQ ID NO: 211271 - DNA, 20 bp, human
gggacccctaaaggagaaat

SEQ ID NO: 211272 - DNA, 20 bp, human
ggtgtccgtcacttaattag

SEQ ID NO: 211273 - DNA, 20 bp, human
gcgccgcctccaggaccgaa

SEQ ID NO: 211274 - DNA, 20 bp, human
ggggccgtgggccacgcgcc

SEQ ID NO: 211275 - DNA, 20 bp, human
gggcggcgcggcgtgaagac

SEQ ID NO: 211276 - DNA, 20 bp, human
gcctcctgccaatggctcag

SEQ ID NO: 211277 - DNA, 20 bp, human
gtgggcggggcatcgtcgtc

SEQ ID NO: 211278 - DNA, 20 bp, human
ggggcatcgtcgtctggcac

SEQ ID NO: 211279 - DNA, 20 bp, human
ggaccccgatgggtgggacg

SEQ ID NO: 211280 - DNA, 20 bp, human
ggcccccgtcccacccatcg

SEQ ID NO: 211281 - DNA, 20 bp, human
gcactggccactcagaactt

SEQ ID NO: 211282 - DNA, 20 bp, human
gtggcctctgagccattggc

SEQ ID NO: 211283 - DNA, 20 bp, human
gtggcggagtggaccccgat

SEQ ID NO: 211284 - DNA, 20 bp, human
gccttaggcgagcatgaagg

SEQ ID NO: 211285 - DNA, 20 bp, human
gactctgcgtctgtaatgtg

SEQ ID NO: 211286 - DNA, 20 bp, human
gcccgcctgacttacaccag

SEQ ID NO: 211287 - DNA, 20 bp, human
gccaataagctcaagagagg

SEQ ID NO: 211288 - DNA, 20 bp, human
gaggggatatgggcagtatc

SEQ ID NO: 211289 - DNA, 20 bp, human
ggtgtaagtcaggcgggagg

SEQ ID NO: 211290 - DNA, 20 bp, human
gtcagccactggtgtaagtc

SEQ ID NO: 211291 - DNA, 20 bp, human
gcgcccaataagctcaagag

SEQ ID NO: 211292 - DNA, 20 bp, human
gcaagagaggaggcgggttc

SEQ ID NO: 211293 - DNA, 20 bp, human
gggtcaggggactgacgtca

SEQ ID NO: 211294 - DNA, 20 bp, human
gaatagctatgagcgagagg

SEQ ID NO: 211295 - DNA, 20 bp, human
gcctggccaagacttcataa

SEQ ID NO: 211296 - DNA, 20 bp, human
ggggaggcgaagaggactgt

SEQ ID NO: 211297 - DNA, 20 bp, human
gagcagagggatgactcaga

SEQ ID NO: 211298 - DNA, 20 bp, human
gcaaatggacaaggtcaaac

SEQ ID NO: 211299 - DNA, 20 bp, human
gtcgaaaaagggtcactccc

SEQ ID NO: 211300 - DNA, 20 bp, human
gagcgctgttcgttgtcccg

SEQ ID NO: 211301 - DNA, 20 bp, human
gtcctcctgaatcttattag

SEQ ID NO: 211302 - DNA, 20 bp, human
gaagacacttggtcgaaaaa

SEQ ID NO: 211303 - DNA, 20 bp, human
ggacaaggtcaaacaggttt

SEQ ID NO: 211304 - DNA, 20 bp, human
gcgggctctgggaggcgaag

SEQ ID NO: 211305 - DNA, 20 bp, human
gtggggggagtagtaataat

SEQ ID NO: 211306 - DNA, 20 bp, human
gaagacaggggcccttggga

SEQ ID NO: 211307 - DNA, 20 bp, human
ggccggaggcagctttgtta

SEQ ID NO: 211308 - DNA, 20 bp, human
gaggcagctttgttagggac

SEQ ID NO: 211309 - DNA, 20 bp, human
gttgtgcgagggtcttgcag

SEQ ID NO: 211310 - DNA, 20 bp, human
ggttactggccggaccagga

SEQ ID NO: 211311 - DNA, 20 bp, human
gcaaggcccgaagccagaca

SEQ ID NO: 211312 - DNA, 20 bp, human
gtgcctgtatgatgtcacaa

SEQ ID NO: 211313 - DNA, 20 bp, human
gggcttcgggccttgtgcga

SEQ ID NO: 211314 - DNA, 20 bp, human
gggcctgcttggcttctccg

SEQ ID NO: 211315 - DNA, 20 bp, human
gctggccggaccaggaaggt

SEQ ID NO: 211316 - DNA, 20 bp, human
gcgggaacgccttagggcgg

SEQ ID NO: 211317 - DNA, 20 bp, human
gacgccgcgcgaggcccggc

SEQ ID NO: 211318 - DNA, 20 bp, human
ggcccggcgggaacgcctta

SEQ ID NO: 211319 - DNA, 20 bp, human
ggggccctctgcgccccgga

SEQ ID NO: 211320 - DNA, 20 bp, human
gaggtcccggccggtgacgg

SEQ ID NO: 211321 - DNA, 20 bp, human
gaggggagagccctgactgg

SEQ ID NO: 211322 - DNA, 20 bp, human
gccggccatggcagatcctc

SEQ ID NO: 211323 - DNA, 20 bp, human
ggggccacaaccgccagtca

SEQ ID NO: 211324 - DNA, 20 bp, human
gggagcccgaggatctgcca

SEQ ID NO: 211325 - DNA, 20 bp, human
ggccctaaggcgttcccgcc

SEQ ID NO: 211326 - DNA, 20 bp, human
gcggggagagctcagttaat

SEQ ID NO: 211327 - DNA, 20 bp, human
gagggtgaggccaacggggt

SEQ ID NO: 211328 - DNA, 20 bp, human
ggataaaggggcccgagcca

SEQ ID NO: 211329 - DNA, 20 bp, human
gcaaagagcaggttgtgcgg

SEQ ID NO: 211330 - DNA, 20 bp, human
ggggtccctcctactaagtc

SEQ ID NO: 211331 - DNA, 20 bp, human
ggggccggcttctggaaggt

SEQ ID NO: 211332 - DNA, 20 bp, human
ggacggaagcacagcgttca

SEQ ID NO: 211333 - DNA, 20 bp, human
ggggaaggcgggatcgaggt

SEQ ID NO: 211334 - DNA, 20 bp, human
gtccccgcgccggttcttgg

SEQ ID NO: 211335 - DNA, 20 bp, human
ggccgcgccgggtctagccg

SEQ ID NO: 211336 - DNA, 20 bp, human
gccctcccgcaacttcccta

SEQ ID NO: 211337 - DNA, 20 bp, human
gggcagtgagtgacttgcat

SEQ ID NO: 211338 - DNA, 20 bp, human
ggtagccaatggggactggc

SEQ ID NO: 211339 - DNA, 20 bp, human
gcccatggccctgcttagta

SEQ ID NO: 211340 - DNA, 20 bp, human
gtcctcctgccagtccccat

SEQ ID NO: 211341 - DNA, 20 bp, human
ggaagttgcgggagggggca

SEQ ID NO: 211342 - DNA, 20 bp, human
gctgcggggaggaacgatca

SEQ ID NO: 211343 - DNA, 20 bp, human
gactgggcctgcctctgaaa

SEQ ID NO: 211344 - DNA, 20 bp, human
ggtggatgaaggcgccttca

SEQ ID NO: 211345 - DNA, 20 bp, human
gtagggctcggggaccacat

SEQ ID NO: 211346 - DNA, 20 bp, human
gcggtgtcctggcgagagca

SEQ ID NO: 211347 - DNA, 20 bp, human
ggtcgcttggggtcggaatg

SEQ ID NO: 211348 - DNA, 20 bp, human
gaggcttggcccaaagtccg

SEQ ID NO: 211349 - DNA, 20 bp, human
gcaaggagcagagcttcaag

SEQ ID NO: 211350 - DNA, 20 bp, human
gagaaactggagacgaatta

SEQ ID NO: 211351 - DNA, 20 bp, human
gtgggggccccagcggtagg

SEQ ID NO: 211352 - DNA, 20 bp, human
gaggaatgagtcccagtggc

SEQ ID NO: 211353 - DNA, 20 bp, human
gtcagccccagtccaaaagg

SEQ ID NO: 211354 - DNA, 20 bp, human
gtgagaccccgccctctcgg

SEQ ID NO: 211355 - DNA, 20 bp, human
gccctctcggaggtcgcttg

SEQ ID NO: 211356 - DNA, 20 bp, human
gccaactgggtcccaactct

SEQ ID NO: 211357 - DNA, 20 bp, human
gttgggacccagttggggtg

SEQ ID NO: 211358 - DNA, 20 bp, human
ggcctggcaccaccactgaa

SEQ ID NO: 211359 - DNA, 20 bp, human
gagggactaagaataccctg

SEQ ID NO: 211360 - DNA, 20 bp, human
gaggccagagagcctagagt

SEQ ID NO: 211361 - DNA, 20 bp, human
gggaacacgcaactaaagtg

SEQ ID NO: 211362 - DNA, 20 bp, human
ggattggcagcgctgggaac

SEQ ID NO: 211363 - DNA, 20 bp, human
gataaccaggggcaataacc

SEQ ID NO: 211364 - DNA, 20 bp, human
gctaaagtgggggtgggcgg

SEQ ID NO: 211365 - DNA, 20 bp, human
ggagtcagtggcaataacca

SEQ ID NO: 211366 - DNA, 20 bp, human
gtgggagagaagtactgcgg

SEQ ID NO: 211367 - DNA, 20 bp, human
gtcggcgccgcgtgaagagt

SEQ ID NO: 211368 - DNA, 20 bp, human
ggggcaggggcctcgctcct

SEQ ID NO: 211369 - DNA, 20 bp, human
gactgggcgggacctcgcct

SEQ ID NO: 211370 - DNA, 20 bp, human
gcacgcggcgccgactgggc

SEQ ID NO: 211371 - DNA, 20 bp, human
gtcttcacgcggcgccgact

SEQ ID NO: 211372 - DNA, 20 bp, human
gcgggacctcgcctcgggcg

SEQ ID NO: 211373 - DNA, 20 bp, human
gggagcctggagccagaccg

SEQ ID NO: 211374 - DNA, 20 bp, human
ggaggagagacccaggagcg

SEQ ID NO: 211375 - DNA, 20 bp, human
gcctgggtctctcctcagcg

SEQ ID NO: 211376 - DNA, 20 bp, human
gaacctgccctgtacaggaa

SEQ ID NO: 211377 - DNA, 20 bp, human
gtcgtgctggtcatggtctt

SEQ ID NO: 211378 - DNA, 20 bp, human
gcaccaaaatgccctggctg

SEQ ID NO: 211379 - DNA, 20 bp, human
gagggaagtttcccatgaca

SEQ ID NO: 211380 - DNA, 20 bp, human
gaaccacagccagggcattt

SEQ ID NO: 211381 - DNA, 20 bp, human
gtgtctgacctgaaagtttt

SEQ ID NO: 211382 - DNA, 20 bp, human
gtccccttcctgtacagggc

SEQ ID NO: 211383 - DNA, 20 bp, human
gtggcagcttccagattctc

SEQ ID NO: 211384 - DNA, 20 bp, human
ggtgtcccaccaggagaagc

SEQ ID NO: 211385 - DNA, 20 bp, human
ggcactgtgtaattgtgccg

SEQ ID NO: 211386 - DNA, 20 bp, human
gaatggggaggaacagatct

SEQ ID NO: 211387 - DNA, 20 bp, human
gcgtggggggatcggtgtat

SEQ ID NO: 211388 - DNA, 20 bp, human
gctgccctccgcctggtcag

SEQ ID NO: 211389 - DNA, 20 bp, human
ggacaaagagggccatgcgt

SEQ ID NO: 211390 - DNA, 20 bp, human
gagcctgggttccactgcgg

SEQ ID NO: 211391 - DNA, 20 bp, human
gaggagcctgggttccactg

SEQ ID NO: 211392 - DNA, 20 bp, human
gtccctccgcagtggaaccc

SEQ ID NO: 211393 - DNA, 20 bp, human
ggtgagccagccagagggac

SEQ ID NO: 211394 - DNA, 20 bp, human
gaaagagggccatgcgtggg

SEQ ID NO: 211395 - DNA, 20 bp, human
gaggtaacgcctgtataatt

SEQ ID NO: 211396 - DNA, 20 bp, human
gtaggccagggcccgggtta

SEQ ID NO: 211397 - DNA, 20 bp, human
ggggtcaagatggacaccag

SEQ ID NO: 211398 - DNA, 20 bp, human
gtgtggctcacagtgtcttg

SEQ ID NO: 211399 - DNA, 20 bp, human
gtgaaaggaggcacactggg

SEQ ID NO: 211400 - DNA, 20 bp, human
gtacctgtgcaagggaacag

SEQ ID NO: 211401 - DNA, 20 bp, human
gctgaagccaagcttgctga

SEQ ID NO: 211402 - DNA, 20 bp, human
gatacaccaagtgggttcta

SEQ ID NO: 211403 - DNA, 20 bp, human
ggccaagcttgctgaaggga

SEQ ID NO: 211404 - DNA, 20 bp, human
gtggcttcaggtcacaggac

SEQ ID NO: 211405 - DNA, 20 bp, human
gggctgccctagaacccact

SEQ ID NO: 211406 - DNA, 20 bp, human
gcctaaaggggtgtgtctta

SEQ ID NO: 211407 - DNA, 20 bp, human
gcaccgaagcaattcctaaa

SEQ ID NO: 211408 - DNA, 20 bp, human
gacccctttaggaattgctt

SEQ ID NO: 211409 - DNA, 20 bp, human
gtggttgtgtaattcaattc

SEQ ID NO: 211410 - DNA, 20 bp, human
gtaggaattgcttcggtgaa

SEQ ID NO: 211411 - DNA, 20 bp, human
gcttcggtgaaaggtattct

SEQ ID NO: 211412 - DNA, 20 bp, human
gtctgagacagtcacaggat

SEQ ID NO: 211413 - DNA, 20 bp, human
ggcaagattgctgaaagtcc

SEQ ID NO: 211414 - DNA, 20 bp, human
gctctcttcttggctctaag

SEQ ID NO: 211415 - DNA, 20 bp, human
gttggatagaatatctgatt

SEQ ID NO: 211416 - DNA, 20 bp, human
gaacccagacgagctgtcac

SEQ ID NO: 211417 - DNA, 20 bp, human
gcagccagtgacagctcgtc

SEQ ID NO: 211418 - DNA, 20 bp, human
gtcaccaggcccccttgcca

SEQ ID NO: 211419 - DNA, 20 bp, human
gacagacaaggggtaagggg

SEQ ID NO: 211420 - DNA, 20 bp, human
gagaactggttgtgttactc

SEQ ID NO: 211421 - DNA, 20 bp, human
gacagacagacaaggggtaa

SEQ ID NO: 211422 - DNA, 20 bp, human
gataaccttggtatgagaac

SEQ ID NO: 211423 - DNA, 20 bp, human
ggacctagttcactgaaggg

SEQ ID NO: 211424 - DNA, 20 bp, human
gtccatgcccggggaagttc

SEQ ID NO: 211425 - DNA, 20 bp, human
gaaacccgtggagggggtgt

SEQ ID NO: 211426 - DNA, 20 bp, human
ggcaaggcgagggtcagtca

SEQ ID NO: 211427 - DNA, 20 bp, human
gtctagcccaagctggccag

SEQ ID NO: 211428 - DNA, 20 bp, human
gggcctgctcatgtcccgtg

SEQ ID NO: 211429 - DNA, 20 bp, human
gcactggcgaggcaaggcga

SEQ ID NO: 211430 - DNA, 20 bp, human
gtgggaggccggaaccccgt

SEQ ID NO: 211431 - DNA, 20 bp, human
gggtcccgggagctccacga

SEQ ID NO: 211432 - DNA, 20 bp, human
ggtcaaccgctggccagctt

SEQ ID NO: 211433 - DNA, 20 bp, human
gggactcaggtcactaatgg

SEQ ID NO: 211434 - DNA, 20 bp, human
ggtcccgtgtggcatatgag

SEQ ID NO: 211435 - DNA, 20 bp, human
gggggagccaggtcaaccgc

SEQ ID NO: 211436 - DNA, 20 bp, human
gcgggagcggagctaggaac

SEQ ID NO: 211437 - DNA, 20 bp, human
gcggtcgtgccacgaggcca

SEQ ID NO: 211438 - DNA, 20 bp, human
gagcggagctaggaacgggc

SEQ ID NO: 211439 - DNA, 20 bp, human
gagagaccgagagtgcgggg

SEQ ID NO: 211440 - DNA, 20 bp, human
gaggctcgctgagagaggaa

SEQ ID NO: 211441 - DNA, 20 bp, human
gggaacgggctggggtgacg

SEQ ID NO: 211442 - DNA, 20 bp, human
gtcgtggcacgaccggcccg

SEQ ID NO: 211443 - DNA, 20 bp, human
gtcctagctccgctcccggc

SEQ ID NO: 211444 - DNA, 20 bp, human
gcagagagaccgagagtgcg

SEQ ID NO: 211445 - DNA, 20 bp, human
gagcccaggctcgctgagag

SEQ ID NO: 211446 - DNA, 20 bp, human
ggccctaaggaaggttgtgg

SEQ ID NO: 211447 - DNA, 20 bp, human
ggaaacgggtcccagggtac

SEQ ID NO: 211448 - DNA, 20 bp, human
gaaggtccgctcgccgttgg

SEQ ID NO: 211449 - DNA, 20 bp, human
gcctgtctgcactccaccaa

SEQ ID NO: 211450 - DNA, 20 bp, human
gagtgccctaaggaaggttg

SEQ ID NO: 211451 - DNA, 20 bp, human
ggcgttgggagacagaacgg

SEQ ID NO: 211452 - DNA, 20 bp, human
ggcagacaggcacagcgcat

SEQ ID NO: 211453 - DNA, 20 bp, human
gactatgccaagcactagga

SEQ ID NO: 211454 - DNA, 20 bp, human
gaagatgtttaactaccgga

SEQ ID NO: 211455 - DNA, 20 bp, human
gtggagagaaacgggtccca

SEQ ID NO: 211456 - DNA, 20 bp, human
gagggtcaaggtggcaacga

SEQ ID NO: 211457 - DNA, 20 bp, human
gggtgaatgatccagtgaca

SEQ ID NO: 211458 - DNA, 20 bp, human
gtgagaaaggcagctcaggt

SEQ ID NO: 211459 - DNA, 20 bp, human
gcaataccgcacccttccct

SEQ ID NO: 211460 - DNA, 20 bp, human
gcagcctggccccagcttct

SEQ ID NO: 211461 - DNA, 20 bp, human
gcacaccacactcacccaaa

SEQ ID NO: 211462 - DNA, 20 bp, human
gatctgggcccagagctcta

SEQ ID NO: 211463 - DNA, 20 bp, human
gccaggccaaggtaagatga

SEQ ID NO: 211464 - DNA, 20 bp, human
gtggtgtgcctcccgcagcc

SEQ ID NO: 211465 - DNA, 20 bp, human
gaggtaagatgatggagcaa

SEQ ID NO: 211466 - DNA, 20 bp, human
ggggtcaaggtggtaacaag

SEQ ID NO: 211467 - DNA, 20 bp, human
gaaggtggtaacaaggggag

SEQ ID NO: 211468 - DNA, 20 bp, human
ggagaaaggcagcttagggt

SEQ ID NO: 211469 - DNA, 20 bp, human
gtcctgagaaaggcagctta

SEQ ID NO: 211470 - DNA, 20 bp, human
gacagcccgggccagatact

SEQ ID NO: 211471 - DNA, 20 bp, human
gggcagcttagggtgggacc

SEQ ID NO: 211472 - DNA, 20 bp, human
gtgaacccagtatctggccc

SEQ ID NO: 211473 - DNA, 20 bp, human
gaggccagatgttggagcaa

SEQ ID NO: 211474 - DNA, 20 bp, human
gtggtggatgaacgagtgac

SEQ ID NO: 211475 - DNA, 20 bp, human
gccggtgggaaaggggcaca

SEQ ID NO: 211476 - DNA, 20 bp, human
ggctcctgggaattgttctt

SEQ ID NO: 211477 - DNA, 20 bp, human
ggctgcagggcgactagcga

SEQ ID NO: 211478 - DNA, 20 bp, human
gatagctccgccctaaacta

SEQ ID NO: 211479 - DNA, 20 bp, human
gtaacaggcggtggtgaaag

SEQ ID NO: 211480 - DNA, 20 bp, human
gcgagcgctcccatggtaac

SEQ ID NO: 211481 - DNA, 20 bp, human
gcatcatcaaagcgcatctc

SEQ ID NO: 211482 - DNA, 20 bp, human
gtgggagcgctcgggtagct

SEQ ID NO: 211483 - DNA, 20 bp, human
gcgaaggtaaacgagggcgc

SEQ ID NO: 211484 - DNA, 20 bp, human
gcactgcaggctacgtactt

SEQ ID NO: 211485 - DNA, 20 bp, human
gtgtcgacggcgtctgttgg

SEQ ID NO: 211486 - DNA, 20 bp, human
ggacgccagagggaggcctc

SEQ ID NO: 211487 - DNA, 20 bp, human
gtgttgctctggagttgcgg

SEQ ID NO: 211488 - DNA, 20 bp, human
gccgcctccgggtgttgctc

SEQ ID NO: 211489 - DNA, 20 bp, human
gtgtgcgcgtgggtgcgtag

SEQ ID NO: 211490 - DNA, 20 bp, human
gactccagagcaacacccgg

SEQ ID NO: 211491 - DNA, 20 bp, human
gcggggcggggctgggcgaa

SEQ ID NO: 211492 - DNA, 20 bp, human
gtgcgagcgaggagccgcac

SEQ ID NO: 211493 - DNA, 20 bp, human
gggcagacccgggaggtcac

SEQ ID NO: 211494 - DNA, 20 bp, human
gaggggcctccggatcccgg

SEQ ID NO: 211495 - DNA, 20 bp, human
gcggcctcggagccttgcag

SEQ ID NO: 211496 - DNA, 20 bp, human
gactcgtgagggctacaggg

SEQ ID NO: 211497 - DNA, 20 bp, human
ggggagaaaaggactcgtga

SEQ ID NO: 211498 - DNA, 20 bp, human
gcgctgggaaaatgtgagaa

SEQ ID NO: 211499 - DNA, 20 bp, human
gaggactcgtgagggctaca

SEQ ID NO: 211500 - DNA, 20 bp, human
ggcctgagtgggtcactagg

SEQ ID NO: 211501 - DNA, 20 bp, human
ggccgcctagtgacccactc

SEQ ID NO: 211502 - DNA, 20 bp, human
gctcaggccgggcccatgct

SEQ ID NO: 211503 - DNA, 20 bp, human
gtgtgagaaaggctgcggga

SEQ ID NO: 211504 - DNA, 20 bp, human
gagctcacgggacagtgtag

SEQ ID NO: 211505 - DNA, 20 bp, human
gtctgctgcaagcacttgcc

SEQ ID NO: 211506 - DNA, 20 bp, human
ggtagctcctcattggctca

SEQ ID NO: 211507 - DNA, 20 bp, human
gtaccaggcaggatctgtga

SEQ ID NO: 211508 - DNA, 20 bp, human
gcactttcgtcatcagtcat

SEQ ID NO: 211509 - DNA, 20 bp, human
ggtgtcttggagaatttaat

SEQ ID NO: 211510 - DNA, 20 bp, human
gcagcacttttaggcttcat

SEQ ID NO: 211511 - DNA, 20 bp, human
gatggcaatagttaccaggc

SEQ ID NO: 211512 - DNA, 20 bp, human
gttcaaagccttaaactcga

SEQ ID NO: 211513 - DNA, 20 bp, human
ggtctatggcaatagttacc

SEQ ID NO: 211514 - DNA, 20 bp, human
gaaaaagtgtctagagtttt

SEQ ID NO: 211515 - DNA, 20 bp, human
gtgaaagtaaaaatccccca

SEQ ID NO: 211516 - DNA, 20 bp, human
gaaagcgagcgctgcggcgt

SEQ ID NO: 211517 - DNA, 20 bp, human
ggtcacggcggcaatgaatc

SEQ ID NO: 211518 - DNA, 20 bp, human
gagaactgggaggctgcccg

SEQ ID NO: 211519 - DNA, 20 bp, human
ggccctctgcccgggtaagt

SEQ ID NO: 211520 - DNA, 20 bp, human
gaaactcagctggcctcctc

SEQ ID NO: 211521 - DNA, 20 bp, human
gaatacgtcccggctggaaa

SEQ ID NO: 211522 - DNA, 20 bp, human
ggtcgggaactgccccgctc

SEQ ID NO: 211523 - DNA, 20 bp, human
gccagccgggacgtattaaa

SEQ ID NO: 211524 - DNA, 20 bp, human
ggggcgactaactccacccc

SEQ ID NO: 211525 - DNA, 20 bp, human
ggaagggaaagcgagcgctg

SEQ ID NO: 211526 - DNA, 20 bp, human
ggggccacacgtgacgtgga

SEQ ID NO: 211527 - DNA, 20 bp, human
gcacggggccacacgtgacg

SEQ ID NO: 211528 - DNA, 20 bp, human
gggttccagcattaagtcag

SEQ ID NO: 211529 - DNA, 20 bp, human
ggcaagagactcacctggat

SEQ ID NO: 211530 - DNA, 20 bp, human
ggaaccatccacgtcacgtg

SEQ ID NO: 211531 - DNA, 20 bp, human
gtgaagcagcttcctctcta

SEQ ID NO: 211532 - DNA, 20 bp, human
gccgaggggttaacccgcac

SEQ ID NO: 211533 - DNA, 20 bp, human
gacacggcctcacccctcta

SEQ ID NO: 211534 - DNA, 20 bp, human
gtctgggtgaatggggggag

SEQ ID NO: 211535 - DNA, 20 bp, human
gcctgtgagcgcccgccaag

SEQ ID NO: 211536 - DNA, 20 bp, human
gagagagaggccggcgtgga

SEQ ID NO: 211537 - DNA, 20 bp, human
gtggctgtgcactccttgcc

SEQ ID NO: 211538 - DNA, 20 bp, human
gtagccgagggaaagaacgg

SEQ ID NO: 211539 - DNA, 20 bp, human
gcgggcggggacgcgagcga

SEQ ID NO: 211540 - DNA, 20 bp, human
gagctagccgagggaaagaa

SEQ ID NO: 211541 - DNA, 20 bp, human
gcctccccacagctagccga

SEQ ID NO: 211542 - DNA, 20 bp, human
gtcccagccaaggcgcgcgg

SEQ ID NO: 211543 - DNA, 20 bp, human
gaggctaggctgagaattgg

SEQ ID NO: 211544 - DNA, 20 bp, human
gcgctagcggggattcaacc

SEQ ID NO: 211545 - DNA, 20 bp, human
gtcaacccggaggcgcccga

SEQ ID NO: 211546 - DNA, 20 bp, human
gcgggcggagcgtgcgggga

SEQ ID NO: 211547 - DNA, 20 bp, human
gactcggcgggcgctgttga

SEQ ID NO: 211548 - DNA, 20 bp, human
gctggcgtgcgagactcggc

SEQ ID NO: 211549 - DNA, 20 bp, human
ggggcgctgttgagggagtc

SEQ ID NO: 211550 - DNA, 20 bp, human
gacggctgcgcgcgcgggac

SEQ ID NO: 211551 - DNA, 20 bp, human
gcgctccgcccgatcggcca

SEQ ID NO: 211552 - DNA, 20 bp, human
ggccaacggaagggcgggta

SEQ ID NO: 211553 - DNA, 20 bp, human
gcccccagccctggccgatc

SEQ ID NO: 211554 - DNA, 20 bp, human
ggccggcgctgccaacggaa

SEQ ID NO: 211555 - DNA, 20 bp, human
gcggacgccggcgctgccaa

SEQ ID NO: 211556 - DNA, 20 bp, human
gtggcactggcggtcccggg

SEQ ID NO: 211557 - DNA, 20 bp, human
gcaggcccgcaaaagaggga

SEQ ID NO: 211558 - DNA, 20 bp, human
gtgcgcaggcccgcaaaaga

SEQ ID NO: 211559 - DNA, 20 bp, human
gccgcggcgccgcgccccaa

SEQ ID NO: 211560 - DNA, 20 bp, human
gcccgcggagtctgcgcact

SEQ ID NO: 211561 - DNA, 20 bp, human
ggcccgcaaaagagggacgg

SEQ ID NO: 211562 - DNA, 20 bp, human
gctagagcaaggcaggagta

SEQ ID NO: 211563 - DNA, 20 bp, human
gctactgcatttggcactgg

SEQ ID NO: 211564 - DNA, 20 bp, human
gaacctactgcatttggcac

SEQ ID NO: 211565 - DNA, 20 bp, human
gagactccgcgggcttgcgc

SEQ ID NO: 211566 - DNA, 20 bp, human
ggtccctgcacgcaataaaa

SEQ ID NO: 211567 - DNA, 20 bp, human
gaagtgaagcaaaatggcga

SEQ ID NO: 211568 - DNA, 20 bp, human
gttattgcgtgcagggacat

SEQ ID NO: 211569 - DNA, 20 bp, human
gcaaaatggcgaggggtggc

SEQ ID NO: 211570 - DNA, 20 bp, human
ggctctgtacttctcattca

SEQ ID NO: 211571 - DNA, 20 bp, human
gaaaaataatgagaccctac

SEQ ID NO: 211572 - DNA, 20 bp, human
ggaagcaaaatggcgagggg

SEQ ID NO: 211573 - DNA, 20 bp, human
gcagggacattggcccagta

SEQ ID NO: 211574 - DNA, 20 bp, human
gatagcagggaaggcagtaa

SEQ ID NO: 211575 - DNA, 20 bp, human
ggctctgaagacaattattt

SEQ ID NO: 211576 - DNA, 20 bp, human
gtggggtcagcagtaccaag

SEQ ID NO: 211577 - DNA, 20 bp, human
ggggatggctgcttcagaag

SEQ ID NO: 211578 - DNA, 20 bp, human
gcctctgtgggggacttttg

SEQ ID NO: 211579 - DNA, 20 bp, human
gacagagggcatgcgaggat

SEQ ID NO: 211580 - DNA, 20 bp, human
ggccaagcacaatagggccc

SEQ ID NO: 211581 - DNA, 20 bp, human
gccaatcgatccctgtagcc

SEQ ID NO: 211582 - DNA, 20 bp, human
gccaatcaggcttgacctgc

SEQ ID NO: 211583 - DNA, 20 bp, human
ggctgcttcagaagaggcat

SEQ ID NO: 211584 - DNA, 20 bp, human
gcagtaccaagaggccggga

SEQ ID NO: 211585 - DNA, 20 bp, human
gtcagcagtaccaagaggcc

SEQ ID NO: 211586 - DNA, 20 bp, human
gtcaactcctactcaaggtc

SEQ ID NO: 211587 - DNA, 20 bp, human
gaacccgtggcttatgatct

SEQ ID NO: 211588 - DNA, 20 bp, human
gaaacccagatcataagcca

SEQ ID NO: 211589 - DNA, 20 bp, human
gacgccccagacatcaaagg

SEQ ID NO: 211590 - DNA, 20 bp, human
gcacttctgccattttctgt

SEQ ID NO: 211591 - DNA, 20 bp, human
ggccggcgacccacagaaaa

SEQ ID NO: 211592 - DNA, 20 bp, human
gcaggctcttttttaacccg

SEQ ID NO: 211593 - DNA, 20 bp, human
gacagctcaactcctactca

SEQ ID NO: 211594 - DNA, 20 bp, human
ggttccttgaacgattgctt

SEQ ID NO: 211595 - DNA, 20 bp, human
gtaggagttgagctgttttt

SEQ ID NO: 211596 - DNA, 20 bp, human
gctctggccggctcctgagt

SEQ ID NO: 211597 - DNA, 20 bp, human
gcagcagctataggccgtgg

SEQ ID NO: 211598 - DNA, 20 bp, human
ggccgcctgtcaatcactcg

SEQ ID NO: 211599 - DNA, 20 bp, human
ggcccgagccgcagcgcagt

SEQ ID NO: 211600 - DNA, 20 bp, human
gacagcaccaactcccactc

SEQ ID NO: 211601 - DNA, 20 bp, human
gacgcatcgtcccacctcca

SEQ ID NO: 211602 - DNA, 20 bp, human
ggccgcgagtgattgacagg

SEQ ID NO: 211603 - DNA, 20 bp, human
gtcggccgcgagtgattgac

SEQ ID NO: 211604 - DNA, 20 bp, human
gggggagccgggatatataa

SEQ ID NO: 211605 - DNA, 20 bp, human
gatcactcgcggccgagtgg

SEQ ID NO: 211606 - DNA, 20 bp, human
gtgagggcacccggagtgtt

SEQ ID NO: 211607 - DNA, 20 bp, human
gtcaagggttggctgggtga

SEQ ID NO: 211608 - DNA, 20 bp, human
ggcggtaatcattgcaagaa

SEQ ID NO: 211609 - DNA, 20 bp, human
ggtatgtggaagcgcgtcaa

SEQ ID NO: 211610 - DNA, 20 bp, human
gtcccccaaccacagcaacg

SEQ ID NO: 211611 - DNA, 20 bp, human
ggtgtggatcacgtggtatg

SEQ ID NO: 211612 - DNA, 20 bp, human
ggtggaagcgcgtcaagggt

SEQ ID NO: 211613 - DNA, 20 bp, human
ggtctccatctcgtttactc

SEQ ID NO: 211614 - DNA, 20 bp, human
gctggggtagagccccggaa

SEQ ID NO: 211615 - DNA, 20 bp, human
gattaccgcccccgttgctg

SEQ ID NO: 211616 - DNA, 20 bp, human
ggccacgggcccggcggtga

SEQ ID NO: 211617 - DNA, 20 bp, human
gcgggcgctgccggtcacgt

SEQ ID NO: 211618 - DNA, 20 bp, human
gtgggctggctcgatcacgt

SEQ ID NO: 211619 - DNA, 20 bp, human
gtgggcgcggtctcagctct

SEQ ID NO: 211620 - DNA, 20 bp, human
gccgggcccgtggccctgcg

SEQ ID NO: 211621 - DNA, 20 bp, human
gatggagccgccctcaccgc

SEQ ID NO: 211622 - DNA, 20 bp, human
gacgggcccggcggtgaggg

SEQ ID NO: 211623 - DNA, 20 bp, human
gatagatagctgggagacaa

SEQ ID NO: 211624 - DNA, 20 bp, human
gtggctcgatcacgtgggcg

SEQ ID NO: 211625 - DNA, 20 bp, human
ggcctggaggggcgatgagt

SEQ ID NO: 211626 - DNA, 20 bp, human
gagaactgaggaaaaggcga

SEQ ID NO: 211627 - DNA, 20 bp, human
ggggcaataataggtttaac

SEQ ID NO: 211628 - DNA, 20 bp, human
gatatggaatctttcattat

SEQ ID NO: 211629 - DNA, 20 bp, human
gtttcattatgggcaataat

SEQ ID NO: 211630 - DNA, 20 bp, human
gagaaactagagagagcttt

SEQ ID NO: 211631 - DNA, 20 bp, human
gatgttgtgattagtgcata

SEQ ID NO: 211632 - DNA, 20 bp, human
gtttcctttagaaactggat

SEQ ID NO: 211633 - DNA, 20 bp, human
gtgtaatctggatatcctcc

SEQ ID NO: 211634 - DNA, 20 bp, human
gagggctggaaaaatcctgg

SEQ ID NO: 211635 - DNA, 20 bp, human
gcaaccaatccagtttctaa

SEQ ID NO: 211636 - DNA, 20 bp, human
gaaagcgccaaaagtctctc

SEQ ID NO: 211637 - DNA, 20 bp, human
ggcaaccatggctaaatata

SEQ ID NO: 211638 - DNA, 20 bp, human
gactataatgaagaactata

SEQ ID NO: 211639 - DNA, 20 bp, human
ggagtagcaacagggaacaa

SEQ ID NO: 211640 - DNA, 20 bp, human
gtgacaaatgagtagcaaca

SEQ ID NO: 211641 - DNA, 20 bp, human
gtaaaattttaatcgatcac

SEQ ID NO: 211642 - DNA, 20 bp, human
gactaccttatatttagcca

SEQ ID NO: 211643 - DNA, 20 bp, human
gcataatttttttgcaacca

SEQ ID NO: 211644 - DNA, 20 bp, human
gtctaaaaggcaagacaaga

SEQ ID NO: 211645 - DNA, 20 bp, human
ggttgttgtagataccttga

SEQ ID NO: 211646 - DNA, 20 bp, human
gggtgcggaaccactggctg

SEQ ID NO: 211647 - DNA, 20 bp, human
gggagagggtgcggaaccac

SEQ ID NO: 211648 - DNA, 20 bp, human
gaggacgcagatgccccacc

SEQ ID NO: 211649 - DNA, 20 bp, human
ggcacagcggccacagaaat

SEQ ID NO: 211650 - DNA, 20 bp, human
gactccaaggccaccgggtg

SEQ ID NO: 211651 - DNA, 20 bp, human
gccactaccagcccggcgtg

SEQ ID NO: 211652 - DNA, 20 bp, human
gcggcgagccccatccgggc

SEQ ID NO: 211653 - DNA, 20 bp, human
ggccttcccaccatagcgat

SEQ ID NO: 211654 - DNA, 20 bp, human
ggggagctacccaaagcctg

SEQ ID NO: 211655 - DNA, 20 bp, human
gagccccatccgggcaggac

SEQ ID NO: 211656 - DNA, 20 bp, human
gcccctcccccataccacca

SEQ ID NO: 211657 - DNA, 20 bp, human
gtatataagcccttgcggga

SEQ ID NO: 211658 - DNA, 20 bp, human
gagcccactgctgacgaaag

SEQ ID NO: 211659 - DNA, 20 bp, human
gcgaaggcccacctgtggag

SEQ ID NO: 211660 - DNA, 20 bp, human
gtagagaaggaatccgaagg

SEQ ID NO: 211661 - DNA, 20 bp, human
ggggcagaacccggactcga

SEQ ID NO: 211662 - DNA, 20 bp, human
gagcgccgagccaagtcgga

SEQ ID NO: 211663 - DNA, 20 bp, human
gcaagctgaccgagacacac

SEQ ID NO: 211664 - DNA, 20 bp, human
gcgaaggtgggtgagagttg

SEQ ID NO: 211665 - DNA, 20 bp, human
ggagccaagtcggatggaag

SEQ ID NO: 211666 - DNA, 20 bp, human
gagggagcccaccaagctca

SEQ ID NO: 211667 - DNA, 20 bp, human
gggtaggtcacccaagggtg

SEQ ID NO: 211668 - DNA, 20 bp, human
gaacaggaggctctcggccg

SEQ ID NO: 211669 - DNA, 20 bp, human
gcggcgccgggagctgaccg

SEQ ID NO: 211670 - DNA, 20 bp, human
gcgggtccacgctgaggcta

SEQ ID NO: 211671 - DNA, 20 bp, human
gccaggcggggcaggacggg

SEQ ID NO: 211672 - DNA, 20 bp, human
ggggaggatgcaggagtccc

SEQ ID NO: 211673 - DNA, 20 bp, human
ggggagaggctgatgccaac

SEQ ID NO: 211674 - DNA, 20 bp, human
gagtgtggggcggggttgtg

SEQ ID NO: 211675 - DNA, 20 bp, human
gaagagggtaggtcacccaa

SEQ ID NO: 211676 - DNA, 20 bp, human
gcggtcgcgccgccgcctag

SEQ ID NO: 211677 - DNA, 20 bp, human
gggctacgcccgctaggcgg

SEQ ID NO: 211678 - DNA, 20 bp, human
gatgctgggtgcccgccccc

SEQ ID NO: 211679 - DNA, 20 bp, human
gaggcggcggcgcgaccgct

SEQ ID NO: 211680 - DNA, 20 bp, human
ggcctagcgggcgtagcccc

SEQ ID NO: 211681 - DNA, 20 bp, human
ggacaggccgccgcccccag

SEQ ID NO: 211682 - DNA, 20 bp, human
ggcccggggctacgcccgct

SEQ ID NO: 211683 - DNA, 20 bp, human
gcaagccgtggtgcggacgg

SEQ ID NO: 211684 - DNA, 20 bp, human
ggctgggcccgcagacacag

SEQ ID NO: 211685 - DNA, 20 bp, human
gtgcgggcccagccaagccg

SEQ ID NO: 211686 - DNA, 20 bp, human
gcctcccggggtccatccgt

SEQ ID NO: 211687 - DNA, 20 bp, human
gttgaggggtgaactcccgg

SEQ ID NO: 211688 - DNA, 20 bp, human
gggcctgagggtgcatccct

SEQ ID NO: 211689 - DNA, 20 bp, human
ggggcctgagggtgaacggc

SEQ ID NO: 211690 - DNA, 20 bp, human
ggctgctgggtgcacccccg

SEQ ID NO: 211691 - DNA, 20 bp, human
gggtgcaccccaggatttga

SEQ ID NO: 211692 - DNA, 20 bp, human
gggtgaacccccgctgatgg

SEQ ID NO: 211693 - DNA, 20 bp, human
gtgttccctgggccttcgga

SEQ ID NO: 211694 - DNA, 20 bp, human
gaagtgggggcctcagcatt

SEQ ID NO: 211695 - DNA, 20 bp, human
gtgggccttcggagggaagt

SEQ ID NO: 211696 - DNA, 20 bp, human
gaaagcgtggggcgggagta

SEQ ID NO: 211697 - DNA, 20 bp, human
ggggcccaggttaggatgag

SEQ ID NO: 211698 - DNA, 20 bp, human
ggccaggaggaggaaagcgt

SEQ ID NO: 211699 - DNA, 20 bp, human
gcccaggttaggatgagagg

SEQ ID NO: 211700 - DNA, 20 bp, human
ggcgggagtagggtgagaac

SEQ ID NO: 211701 - DNA, 20 bp, human
gaggatgagaggtggaacca

SEQ ID NO: 211702 - DNA, 20 bp, human
ggccccaggtagccacccaa

SEQ ID NO: 211703 - DNA, 20 bp, human
gctggtgactgggagataag

SEQ ID NO: 211704 - DNA, 20 bp, human
gaggcttcagtacccttggg

SEQ ID NO: 211705 - DNA, 20 bp, human
gtccacctctcatcctaacc

SEQ ID NO: 211706 - DNA, 20 bp, human
gagggcttgtcatctaaaag

SEQ ID NO: 211707 - DNA, 20 bp, human
gtcacccaagaggttctcta

SEQ ID NO: 211708 - DNA, 20 bp, human
gctgaagaggtctgagtgtg

SEQ ID NO: 211709 - DNA, 20 bp, human
gtgaatggcaccaggcaaat

SEQ ID NO: 211710 - DNA, 20 bp, human
gtgacaaattcaacctactg

SEQ ID NO: 211711 - DNA, 20 bp, human
gtgtcatctaaaaggggaga

SEQ ID NO: 211712 - DNA, 20 bp, human
gggggagatggcacctgaag

SEQ ID NO: 211713 - DNA, 20 bp, human
gctgagggtaggagcttgaa

SEQ ID NO: 211714 - DNA, 20 bp, human
gtaggagcttgaatggcacc

SEQ ID NO: 211715 - DNA, 20 bp, human
gaacaggaacctctaaatca

SEQ ID NO: 211716 - DNA, 20 bp, human
gcgcacgcgccccgaggctc

SEQ ID NO: 211717 - DNA, 20 bp, human
gtccggagctcgctggttga

SEQ ID NO: 211718 - DNA, 20 bp, human
gccagcggagggagcggcgt

SEQ ID NO: 211719 - DNA, 20 bp, human
gccggtctgtgtagcgagaa

SEQ ID NO: 211720 - DNA, 20 bp, human
gtccctcaaccagcgagctc

SEQ ID NO: 211721 - DNA, 20 bp, human
gacgcgccccgaggctccgg

SEQ ID NO: 211722 - DNA, 20 bp, human
ggggatggaggaagttatag

SEQ ID NO: 211723 - DNA, 20 bp, human
gcgtgtgtttgtgtcggagc

SEQ ID NO: 211724 - DNA, 20 bp, human
gcgaaaattggcaggaagag

SEQ ID NO: 211725 - DNA, 20 bp, human
gtgtgtagcgagaagggtgc

SEQ ID NO: 211726 - DNA, 20 bp, human
gaggccgcggggcggtatga

SEQ ID NO: 211727 - DNA, 20 bp, human
ggggtccaggaaggctaaag

SEQ ID NO: 211728 - DNA, 20 bp, human
ggcggcgcagccaatccgag

SEQ ID NO: 211729 - DNA, 20 bp, human
ggggcaggggtccacaccag

SEQ ID NO: 211730 - DNA, 20 bp, human
gtccaagccgggcggtaatg

SEQ ID NO: 211731 - DNA, 20 bp, human
gcgccccgctcccagagccg

SEQ ID NO: 211732 - DNA, 20 bp, human
gtcctgcagcctcccgagtg

SEQ ID NO: 211733 - DNA, 20 bp, human
ggggcggtatgagggggcgc

SEQ ID NO: 211734 - DNA, 20 bp, human
gctggacgaagggacgtaat

SEQ ID NO: 211735 - DNA, 20 bp, human
gccgggcggtaatggggtcc

SEQ ID NO: 211736 - DNA, 20 bp, human
ggtcccggcccgggtctcca

SEQ ID NO: 211737 - DNA, 20 bp, human
ggccgccggcgtcggaacgt

SEQ ID NO: 211738 - DNA, 20 bp, human
gcgagtacgccgggctgcca

SEQ ID NO: 211739 - DNA, 20 bp, human
gctgccatggagacccgggc

SEQ ID NO: 211740 - DNA, 20 bp, human
gaatgagcgcccgagtacgc

SEQ ID NO: 211741 - DNA, 20 bp, human
gctcgccccgagggtgacca

SEQ ID NO: 211742 - DNA, 20 bp, human
gccaatggccagctgacccg

SEQ ID NO: 211743 - DNA, 20 bp, human
gggcggccgtgccacgtacg

SEQ ID NO: 211744 - DNA, 20 bp, human
gccagctgacccgcgggtcc

SEQ ID NO: 211745 - DNA, 20 bp, human
gtggccattggcggatccaa

SEQ ID NO: 211746 - DNA, 20 bp, human
gcggggccattgggcacaaa

SEQ ID NO: 211747 - DNA, 20 bp, human
ggccccgcatgaccgccaga

SEQ ID NO: 211748 - DNA, 20 bp, human
gtcctcaaacgggaaccaat

SEQ ID NO: 211749 - DNA, 20 bp, human
gcccgaggaaaaacgagcgg

SEQ ID NO: 211750 - DNA, 20 bp, human
ggcggggcccgggctcctat

SEQ ID NO: 211751 - DNA, 20 bp, human
gaaaggctgacggggacttt

SEQ ID NO: 211752 - DNA, 20 bp, human
gctccccgaggaaaaacgag

SEQ ID NO: 211753 - DNA, 20 bp, human
gttcctcggggagtaaaagg

SEQ ID NO: 211754 - DNA, 20 bp, human
ggccgccccgcctcctcaaa

SEQ ID NO: 211755 - DNA, 20 bp, human
ggcccctggggggagtattt

SEQ ID NO: 211756 - DNA, 20 bp, human
ggctcagaagaggcacgagt

SEQ ID NO: 211757 - DNA, 20 bp, human
gggagcgcgcaccgaggcgg

SEQ ID NO: 211758 - DNA, 20 bp, human
ggcgcccagccgcgaaagcg

SEQ ID NO: 211759 - DNA, 20 bp, human
gtggggctgcggctcagaag

SEQ ID NO: 211760 - DNA, 20 bp, human
gtggctaggcagacggggcc

SEQ ID NO: 211761 - DNA, 20 bp, human
gtgcgcgctcctcgctttcg

SEQ ID NO: 211762 - DNA, 20 bp, human
gccgcgtggctaggcagacg

SEQ ID NO: 211763 - DNA, 20 bp, human
gggccggagagattgagatt

SEQ ID NO: 211764 - DNA, 20 bp, human
gagaagaggcacgagtcggg

SEQ ID NO: 211765 - DNA, 20 bp, human
ggcggggcagccgcgtggct

SEQ ID NO: 211766 - DNA, 20 bp, human
ggggatccgcgtcgggttgt

SEQ ID NO: 211767 - DNA, 20 bp, human
gggcgcccggctgtcaaaac

SEQ ID NO: 211768 - DNA, 20 bp, human
gcccggctgtcaaaactggc

SEQ ID NO: 211769 - DNA, 20 bp, human
gcccggccgacaacccgacg

SEQ ID NO: 211770 - DNA, 20 bp, human
ggccggccagttttgacagc

SEQ ID NO: 211771 - DNA, 20 bp, human
gtccgcgtcgggttgtcggc

SEQ ID NO: 211772 - DNA, 20 bp, human
gtgcgtcgcggacaatgctg

SEQ ID NO: 211773 - DNA, 20 bp, human
ggcagctcgggatccgcgtc

SEQ ID NO: 211774 - DNA, 20 bp, human
ggcagccaccggaggcagtg

SEQ ID NO: 211775 - DNA, 20 bp, human
gggaggcagtgaggtaatgg

SEQ ID NO: 211776 - DNA, 20 bp, human
gtgcaggggcgggtaagggg

SEQ ID NO: 211777 - DNA, 20 bp, human
gtcccaggggcctgaagagt

SEQ ID NO: 211778 - DNA, 20 bp, human
gcgcccagggccgactcttc

SEQ ID NO: 211779 - DNA, 20 bp, human
gtggacccacgtgaccaggc

SEQ ID NO: 211780 - DNA, 20 bp, human
gctgagaaggtgcctcccag

SEQ ID NO: 211781 - DNA, 20 bp, human
ggggcctgaagagtcggccc

SEQ ID NO: 211782 - DNA, 20 bp, human
gccgacctgcctggtcacgt

SEQ ID NO: 211783 - DNA, 20 bp, human
gtggtcacgtgggtccagtg

SEQ ID NO: 211784 - DNA, 20 bp, human
gttacctccagacccgccca

SEQ ID NO: 211785 - DNA, 20 bp, human
gtggacgcatggcagatgaa

SEQ ID NO: 211786 - DNA, 20 bp, human
gtctggaaaggcatgttcag

SEQ ID NO: 211787 - DNA, 20 bp, human
gtggagggaaggcgcgtcga

SEQ ID NO: 211788 - DNA, 20 bp, human
gtgggctcgcacctggactg

SEQ ID NO: 211789 - DNA, 20 bp, human
gcgggtgaggcggtcgggca

SEQ ID NO: 211790 - DNA, 20 bp, human
gcgcacctggactgtggcgc

SEQ ID NO: 211791 - DNA, 20 bp, human
gctcacccgcgccacagtcc

SEQ ID NO: 211792 - DNA, 20 bp, human
ggtggcgcgggtgaggcggt

SEQ ID NO: 211793 - DNA, 20 bp, human
gctgcaagagacacgggctg

SEQ ID NO: 211794 - DNA, 20 bp, human
ggattcggcgtctcagacgt

SEQ ID NO: 211795 - DNA, 20 bp, human
ggggaactcgtcctggcttc

SEQ ID NO: 211796 - DNA, 20 bp, human
gagggctgcgcggaagaggc

SEQ ID NO: 211797 - DNA, 20 bp, human
gaactcggatgcaacgtgac

SEQ ID NO: 211798 - DNA, 20 bp, human
gtcttccgcgcagccctcag

SEQ ID NO: 211799 - DNA, 20 bp, human
gaagagagccccctttgggg

SEQ ID NO: 211800 - DNA, 20 bp, human
gaaacctcctgcagctgaac

SEQ ID NO: 211801 - DNA, 20 bp, human
gggagttggcggacggtccc

SEQ ID NO: 211802 - DNA, 20 bp, human
gacctggcgggcgtctgctc

SEQ ID NO: 211803 - DNA, 20 bp, human
gaagaagagagccccctttg

SEQ ID NO: 211804 - DNA, 20 bp, human
gccacgcttcggactccaca

SEQ ID NO: 211805 - DNA, 20 bp, human
ggtggccacgccccggtcac

SEQ ID NO: 211806 - DNA, 20 bp, human
gcggcgggaggggtggacga

SEQ ID NO: 211807 - DNA, 20 bp, human
ggggaggaaggcggagtaga

SEQ ID NO: 211808 - DNA, 20 bp, human
ggtagagggcggggaaagaa

SEQ ID NO: 211809 - DNA, 20 bp, human
gcgggaggggtggacgaggg

SEQ ID NO: 211810 - DNA, 20 bp, human
gccctggaagtgaggagtga

SEQ ID NO: 211811 - DNA, 20 bp, human
gggagctcgggcgaaagcaa

SEQ ID NO: 211812 - DNA, 20 bp, human
gaggaaggcggagtagaggg

SEQ ID NO: 211813 - DNA, 20 bp, human
ggtggggcggggagctgcac

SEQ ID NO: 211814 - DNA, 20 bp, human
gccggagcagggcggcggga

SEQ ID NO: 211815 - DNA, 20 bp, human
gccactagaggggcacgact

SEQ ID NO: 211816 - DNA, 20 bp, human
ggcggcgggtgtctgcagac

SEQ ID NO: 211817 - DNA, 20 bp, human
gtgtctgcagacgggctcta

SEQ ID NO: 211818 - DNA, 20 bp, human
gaaaacccggcaggggacaa

SEQ ID NO: 211819 - DNA, 20 bp, human
gcccgggccgcgagactgcc

SEQ ID NO: 211820 - DNA, 20 bp, human
gcagtctcgcggcccgggga

SEQ ID NO: 211821 - DNA, 20 bp, human
gacggcgggggtggagtgta

SEQ ID NO: 211822 - DNA, 20 bp, human
ggcccagcggccgggcgcca

SEQ ID NO: 211823 - DNA, 20 bp, human
ggtcgccctcctaagtctca

SEQ ID NO: 211824 - DNA, 20 bp, human
gtgtctccctgagacttagg

SEQ ID NO: 211825 - DNA, 20 bp, human
gggagcgcgcgagaagctct

SEQ ID NO: 211826 - DNA, 20 bp, human
ggcgccgcctccccggagga

SEQ ID NO: 211827 - DNA, 20 bp, human
gtgggagtggaggcgataat

SEQ ID NO: 211828 - DNA, 20 bp, human
gggcaggggcggacacaccg

SEQ ID NO: 211829 - DNA, 20 bp, human
ggcctccccggaggaaggcg

SEQ ID NO: 211830 - DNA, 20 bp, human
gggacacaccgcggcctgga

SEQ ID NO: 211831 - DNA, 20 bp, human
gtgcgctgagaggttatttg

SEQ ID NO: 211832 - DNA, 20 bp, human
gagctccgaaggcaaagcat

SEQ ID NO: 211833 - DNA, 20 bp, human
gccaggaatgtgagagtttc

SEQ ID NO: 211834 - DNA, 20 bp, human
gtgagagcgggtcggcgact

SEQ ID NO: 211835 - DNA, 20 bp, human
ggcgcggaggaacggagctc

SEQ ID NO: 211836 - DNA, 20 bp, human
gtgggattagaagatatctg

SEQ ID NO: 211837 - DNA, 20 bp, human
gaagtggtaactggatactc

SEQ ID NO: 211838 - DNA, 20 bp, human
gttcttacagactggatctt

SEQ ID NO: 211839 - DNA, 20 bp, human
ggattagaagatatctgtgg

SEQ ID NO: 211840 - DNA, 20 bp, human
gtggtaactggatactctgg

SEQ ID NO: 211841 - DNA, 20 bp, human
gtctgaagctatgatcctca

SEQ ID NO: 211842 - DNA, 20 bp, human
gcactgtatttcactagggt

SEQ ID NO: 211843 - DNA, 20 bp, human
gtgcgtgatgtgaaaccctg

SEQ ID NO: 211844 - DNA, 20 bp, human
gggtgggatatcaccatcag

SEQ ID NO: 211845 - DNA, 20 bp, human
gggatcatagcttcagaaac

SEQ ID NO: 211846 - DNA, 20 bp, human
gggaactggcccaagaccca

SEQ ID NO: 211847 - DNA, 20 bp, human
gtgagccgaccctgggtctt

SEQ ID NO: 211848 - DNA, 20 bp, human
gcagccaccacaccgcggta

SEQ ID NO: 211849 - DNA, 20 bp, human
ggctcaggccagccctaccg

SEQ ID NO: 211850 - DNA, 20 bp, human
gcagccctaccgcggtgtgg

SEQ ID NO: 211851 - DNA, 20 bp, human
gaggcggggtcggcaggcgg

SEQ ID NO: 211852 - DNA, 20 bp, human
gggctgcccacgtggcgccc

SEQ ID NO: 211853 - DNA, 20 bp, human
gggaagctgacgcacggaac

SEQ ID NO: 211854 - DNA, 20 bp, human
ggtgggcagccaccacaccg

SEQ ID NO: 211855 - DNA, 20 bp, human
gcgaccaagtgagattgcag

SEQ ID NO: 211856 - DNA, 20 bp, human
gatggaggccccactccccg

SEQ ID NO: 211857 - DNA, 20 bp, human
ggtcactcctgggactgagg

SEQ ID NO: 211858 - DNA, 20 bp, human
gtctaggcaacctcggggag

SEQ ID NO: 211859 - DNA, 20 bp, human
gcggaggaaggggttggatg

SEQ ID NO: 211860 - DNA, 20 bp, human
gcatcagtcacgtcactcct

SEQ ID NO: 211861 - DNA, 20 bp, human
gagggctcttggtgggttag

SEQ ID NO: 211862 - DNA, 20 bp, human
ggacgtgactgatggtggct

SEQ ID NO: 211863 - DNA, 20 bp, human
gcaggaagcagcggctccgc

SEQ ID NO: 211864 - DNA, 20 bp, human
gcagcgggagtgactgatgc

SEQ ID NO: 211865 - DNA, 20 bp, human
gtagacaacatgagaaatcg

SEQ ID NO: 211866 - DNA, 20 bp, human
gtgcacagagcagtattaca

SEQ ID NO: 211867 - DNA, 20 bp, human
gggacatgcggaggtgactc

SEQ ID NO: 211868 - DNA, 20 bp, human
gagcaaaatggctatttctg

SEQ ID NO: 211869 - DNA, 20 bp, human
gcggagctggaggcccacgt

SEQ ID NO: 211870 - DNA, 20 bp, human
ggggtcagttgtttaccggg

SEQ ID NO: 211871 - DNA, 20 bp, human
gaggctacaagcaacctaga

SEQ ID NO: 211872 - DNA, 20 bp, human
gctagctgtaaccctgactt

SEQ ID NO: 211873 - DNA, 20 bp, human
gatcctggggagaagagctc

SEQ ID NO: 211874 - DNA, 20 bp, human
gctcacgattggacatgcgg

SEQ ID NO: 211875 - DNA, 20 bp, human
gtatcaaggggattggtctc

SEQ ID NO: 211876 - DNA, 20 bp, human
ggggcgggatgcgtcgggac

SEQ ID NO: 211877 - DNA, 20 bp, human
gtaaagcgacagagcggggg

SEQ ID NO: 211878 - DNA, 20 bp, human
gggctgtgacatggggagaa

SEQ ID NO: 211879 - DNA, 20 bp, human
gagcgggggcgggatgcgtc

SEQ ID NO: 211880 - DNA, 20 bp, human
ggcttaaagcgacagagcgg

SEQ ID NO: 211881 - DNA, 20 bp, human
gccagcttaaagcgacagag

SEQ ID NO: 211882 - DNA, 20 bp, human
gaaaaaagggaagaacccta

SEQ ID NO: 211883 - DNA, 20 bp, human
ggtcgggactggctgtgaca

SEQ ID NO: 211884 - DNA, 20 bp, human
gtatcatcgaggagacaatc

SEQ ID NO: 211885 - DNA, 20 bp, human
ggctctgaagtggagctgat

SEQ ID NO: 211886 - DNA, 20 bp, human
gagtcagccgaaagagctgg

SEQ ID NO: 211887 - DNA, 20 bp, human
gggggcgtgggcagccccaa

SEQ ID NO: 211888 - DNA, 20 bp, human
ggaaccgccctgtctccaga

SEQ ID NO: 211889 - DNA, 20 bp, human
gagacagggcggttctgcag

SEQ ID NO: 211890 - DNA, 20 bp, human
ggggagagctgtggaactag

SEQ ID NO: 211891 - DNA, 20 bp, human
gagagagtaaggtcaagtgg

SEQ ID NO: 211892 - DNA, 20 bp, human
ggctgcccagaacaaagcta

SEQ ID NO: 211893 - DNA, 20 bp, human
gtctttcggctgactcttca

SEQ ID NO: 211894 - DNA, 20 bp, human
ggagggtcaaagttctggaa

SEQ ID NO: 211895 - DNA, 20 bp, human
gtgggcagcccaatcagctc

SEQ ID NO: 211896 - DNA, 20 bp, human
gacccacctaatgaagtgtt

SEQ ID NO: 211897 - DNA, 20 bp, human
ggaaacaccttctattcaaa

SEQ ID NO: 211898 - DNA, 20 bp, human
gaaatcatttgggaagaaga

SEQ ID NO: 211899 - DNA, 20 bp, human
gtctactatgtagattgctc

SEQ ID NO: 211900 - DNA, 20 bp, human
gtcccaacacttcattaggt

SEQ ID NO: 211901 - DNA, 20 bp, human
gctattcaaatggtagacat

SEQ ID NO: 211902 - DNA, 20 bp, human
gctctcagtttccaatctcc

SEQ ID NO: 211903 - DNA, 20 bp, human
ggtacatctgagaaatcatt

SEQ ID NO: 211904 - DNA, 20 bp, human
gcatttcccaacacttcatt

SEQ ID NO: 211905 - DNA, 20 bp, human
gcagacagctaaatcctgat

SEQ ID NO: 211906 - DNA, 20 bp, human
gggtatgtacagataccaag

SEQ ID NO: 211907 - DNA, 20 bp, human
ggtcagggagaaacagaata

SEQ ID NO: 211908 - DNA, 20 bp, human
gactacatgcacccgtggtc

SEQ ID NO: 211909 - DNA, 20 bp, human
gaacaaggaagcaaaatcaa

SEQ ID NO: 211910 - DNA, 20 bp, human
gtactaaacactgacatcaa

SEQ ID NO: 211911 - DNA, 20 bp, human
gtcaagttaactcttcccct

SEQ ID NO: 211912 - DNA, 20 bp, human
ggggagaaacagaatatgga

SEQ ID NO: 211913 - DNA, 20 bp, human
gaaatcaaaggcacaaaacc

SEQ ID NO: 211914 - DNA, 20 bp, human
gaagagttaacttgaatgcc

SEQ ID NO: 211915 - DNA, 20 bp, human
gagtccttgtcgcatatccc

SEQ ID NO: 211916 - DNA, 20 bp, human
ggggagaaacagaatacgga

SEQ ID NO: 211917 - DNA, 20 bp, human
ggtcagggagaaacagaata

SEQ ID NO: 211918 - DNA, 20 bp, human
gactacatgcacccgtggtc

SEQ ID NO: 211919 - DNA, 20 bp, human
gaacaaggaagcaaaatcaa

SEQ ID NO: 211920 - DNA, 20 bp, human
gagtccttgtcgcatatccc

SEQ ID NO: 211921 - DNA, 20 bp, human
gaaatcaaaggcacaaaacc

SEQ ID NO: 211922 - DNA, 20 bp, human
gaagccagggatatgcgaca

SEQ ID NO: 211923 - DNA, 20 bp, human
gcaaggactacatgcacccg

SEQ ID NO: 211924 - DNA, 20 bp, human
gagaaatgtagcaggacaag

SEQ ID NO: 211925 - DNA, 20 bp, human
ggtagctatccgatgctccc

SEQ ID NO: 211926 - DNA, 20 bp, human
gtgttctgagatttatctag

SEQ ID NO: 211927 - DNA, 20 bp, human
gtttatctagaggctgggaa

SEQ ID NO: 211928 - DNA, 20 bp, human
gtgagatttatctagaggct

SEQ ID NO: 211929 - DNA, 20 bp, human
ggcagggtattaatgtgtca

SEQ ID NO: 211930 - DNA, 20 bp, human
gacacaatgacatgttgctg

SEQ ID NO: 211931 - DNA, 20 bp, human
gccgtcttgtcggtctgtca

SEQ ID NO: 211932 - DNA, 20 bp, human
gagaaacattaatgtctaag

SEQ ID NO: 211933 - DNA, 20 bp, human
gccgacaagacggaaacaac

SEQ ID NO: 211934 - DNA, 20 bp, human
gagacggaaacaactggttc

SEQ ID NO: 211935 - DNA, 20 bp, human
gttgatgttcttcaccagtt

SEQ ID NO: 211936 - DNA, 20 bp, human
gcagactcaccgagccagac

SEQ ID NO: 211937 - DNA, 20 bp, human
gactacattcactgctggtc

SEQ ID NO: 211938 - DNA, 20 bp, human
gtttcagtctttactacacg

SEQ ID NO: 211939 - DNA, 20 bp, human
ggcagtctctgatctgtaca

SEQ ID NO: 211940 - DNA, 20 bp, human
gtgtctttggttgtacttcc

SEQ ID NO: 211941 - DNA, 20 bp, human
gcaaggactacattcactgc

SEQ ID NO: 211942 - DNA, 20 bp, human
gtcaagttaactgttgccct

SEQ ID NO: 211943 - DNA, 20 bp, human
gcagcgccaggcctgaaacc

SEQ ID NO: 211944 - DNA, 20 bp, human
ggtgtcagggctgagtgttc

SEQ ID NO: 211945 - DNA, 20 bp, human
gacaatataaaacaaggaga

SEQ ID NO: 211946 - DNA, 20 bp, human
gttaaagacccgattggcat

SEQ ID NO: 211947 - DNA, 20 bp, human
gaacccagccctatgccaat

SEQ ID NO: 211948 - DNA, 20 bp, human
gacccgattggcatagggct

SEQ ID NO: 211949 - DNA, 20 bp, human
gtataaatataaatggttca

SEQ ID NO: 211950 - DNA, 20 bp, human
gatagtgtagtaagaagagg

SEQ ID NO: 211951 - DNA, 20 bp, human
gataaccttaaagacccgat

SEQ ID NO: 211952 - DNA, 20 bp, human
gaagaaatagagattgcgag

SEQ ID NO: 211953 - DNA, 20 bp, human
ggatatagtgtagtaagaag

SEQ ID NO: 211954 - DNA, 20 bp, human
gtgtagtaagaagaggtggc

SEQ ID NO: 211955 - DNA, 20 bp, human
gggatattgtagaaaaagga

SEQ ID NO: 211956 - DNA, 20 bp, human
gtgaacgaggccaccaggtg

SEQ ID NO: 211957 - DNA, 20 bp, human
gcccctgcccgggtgtttct

SEQ ID NO: 211958 - DNA, 20 bp, human
gagcgccacgaggtgaggaa

SEQ ID NO: 211959 - DNA, 20 bp, human
gcacctggggaggcacgaac

SEQ ID NO: 211960 - DNA, 20 bp, human
gctgcccgggtgtttctggg

SEQ ID NO: 211961 - DNA, 20 bp, human
gtcccacgtgagctccaccg

SEQ ID NO: 211962 - DNA, 20 bp, human
ggaaccagcgccacgaggtg

SEQ ID NO: 211963 - DNA, 20 bp, human
gcaggtgagaggagtaaacc

SEQ ID NO: 211964 - DNA, 20 bp, human
gcactccctccagctgcccg

SEQ ID NO: 211965 - DNA, 20 bp, human
gcacctggggcctctcctgg

SEQ ID NO: 211966 - DNA, 20 bp, human
ggcgcggcgcgtggcgtaag

SEQ ID NO: 211967 - DNA, 20 bp, human
gcaggcggccgcacgctcag

SEQ ID NO: 211968 - DNA, 20 bp, human
gacgctcaggggcgtggcat

SEQ ID NO: 211969 - DNA, 20 bp, human
ggagttgggcggggcccaca

SEQ ID NO: 211970 - DNA, 20 bp, human
gtcaggggcgtggcatgggt

SEQ ID NO: 211971 - DNA, 20 bp, human
gtcgctggggtctcccgtgt

SEQ ID NO: 211972 - DNA, 20 bp, human
gagcgtgcggccgcctgggc

SEQ ID NO: 211973 - DNA, 20 bp, human
gctaccctctattctggaag

SEQ ID NO: 211974 - DNA, 20 bp, human
gtgcgtcgcgcacgccctgt

SEQ ID NO: 211975 - DNA, 20 bp, human
gtcctcgcttgcgctcgcgg

SEQ ID NO: 211976 - DNA, 20 bp, human
gctggcgcctgcgctgttga

SEQ ID NO: 211977 - DNA, 20 bp, human
gccgcggcgggttacaactt

SEQ ID NO: 211978 - DNA, 20 bp, human
gccccggcgcgaggcaagac

SEQ ID NO: 211979 - DNA, 20 bp, human
gcctacctccacgtggggtc

SEQ ID NO: 211980 - DNA, 20 bp, human
gcgccggggcggggcatcgc

SEQ ID NO: 211981 - DNA, 20 bp, human
ggactgtagcagacagagtc

SEQ ID NO: 211982 - DNA, 20 bp, human
gacgtggaggtaggcacctc

SEQ ID NO: 211983 - DNA, 20 bp, human
gtgttgagggaagaccgcgg

SEQ ID NO: 211984 - DNA, 20 bp, human
gcgctgttgagggaagaccg

SEQ ID NO: 211985 - DNA, 20 bp, human
gcaagacgggaaagtcaaga

SEQ ID NO: 211986 - DNA, 20 bp, human
gccacctaaggcctaaccaa

SEQ ID NO: 211987 - DNA, 20 bp, human
gcggaaccctggaggtaggt

SEQ ID NO: 211988 - DNA, 20 bp, human
ggaggcggaaccctggaggt

SEQ ID NO: 211989 - DNA, 20 bp, human
ggccgtgagaacacgctgtg

SEQ ID NO: 211990 - DNA, 20 bp, human
gcgcgacatagagcgtgagg

SEQ ID NO: 211991 - DNA, 20 bp, human
gagagcgtgaggcggaaccc

SEQ ID NO: 211992 - DNA, 20 bp, human
gcggctgggcaccgccattt

SEQ ID NO: 211993 - DNA, 20 bp, human
gcgccaacggcgttgaacaa

SEQ ID NO: 211994 - DNA, 20 bp, human
gcggccaccggccaaaatgg

SEQ ID NO: 211995 - DNA, 20 bp, human
ggaaaacgatccccttgcgg

SEQ ID NO: 211996 - DNA, 20 bp, human
gcgggcgcggaatcgggcat

SEQ ID NO: 211997 - DNA, 20 bp, human
gcacgccggcacgtcacttc

SEQ ID NO: 211998 - DNA, 20 bp, human
gtgccggcgtgctgacgcgc

SEQ ID NO: 211999 - DNA, 20 bp, human
gagcccgcgcgtcagcacgc

SEQ ID NO: 212000 - DNA, 20 bp, human
gggaaggcctcacgcggcgc

SEQ ID NO: 212001 - DNA, 20 bp, human
gcgctccgaggccgtggcac

SEQ ID NO: 212002 - DNA, 20 bp, human
gactcggcgggcgctgttga

SEQ ID NO: 212003 - DNA, 20 bp, human
gccgaggccgtggcaccgga

SEQ ID NO: 212004 - DNA, 20 bp, human
gggcaccggaaggcctcacg

SEQ ID NO: 212005 - DNA, 20 bp, human
gttgtcggccatggcgggcg

SEQ ID NO: 212006 - DNA, 20 bp, human
gtgcaggggaagtctggaga

SEQ ID NO: 212007 - DNA, 20 bp, human
gtaacggcgggaaggctcag

SEQ ID NO: 212008 - DNA, 20 bp, human
gctcgcgtgcaggggaagtc

SEQ ID NO: 212009 - DNA, 20 bp, human
gaggctggacgtaagcttag

SEQ ID NO: 212010 - DNA, 20 bp, human
gacaaacgcgccgactacag

SEQ ID NO: 212011 - DNA, 20 bp, human
gcgagtgcagacacgtgatg

SEQ ID NO: 212012 - DNA, 20 bp, human
gcagcgccggcccgaggtaa

SEQ ID NO: 212013 - DNA, 20 bp, human
gcctccaaaacctaggccgg

SEQ ID NO: 212014 - DNA, 20 bp, human
gcgccggcccgaggtaacgg

SEQ ID NO: 212015 - DNA, 20 bp, human
gtacgtccagcctctgtagt

SEQ ID NO: 212016 - DNA, 20 bp, human
gccaggatggagacgccgac

SEQ ID NO: 212017 - DNA, 20 bp, human
gcgggagcggggaaaacaaa

SEQ ID NO: 212018 - DNA, 20 bp, human
gcaaggcggggcagataggt

SEQ ID NO: 212019 - DNA, 20 bp, human
gcggggcagataggtaggcg

SEQ ID NO: 212020 - DNA, 20 bp, human
gcatcctggcgccagcacta

SEQ ID NO: 212021 - DNA, 20 bp, human
gctggctgagactcaaggcg

SEQ ID NO: 212022 - DNA, 20 bp, human
gcaaaagggcaggggttaaa

SEQ ID NO: 212023 - DNA, 20 bp, human
ggactcaaggcggggcagat

SEQ ID NO: 212024 - DNA, 20 bp, human
gccgctcccgcccactaaac

SEQ ID NO: 212025 - DNA, 20 bp, human
gctaccttagtcacattgtt

SEQ ID NO: 212026 - DNA, 20 bp, human
gcgcgcgcccgtgccgtggt

SEQ ID NO: 212027 - DNA, 20 bp, human
gcgctcgcgtagaggaattc

SEQ ID NO: 212028 - DNA, 20 bp, human
gaaaccaaggtagggcgagg

SEQ ID NO: 212029 - DNA, 20 bp, human
ggccacgcccaccacggcac

SEQ ID NO: 212030 - DNA, 20 bp, human
ggctgcaggtaaaccaaggt

SEQ ID NO: 212031 - DNA, 20 bp, human
gggcggctgcaggtaaacca

SEQ ID NO: 212032 - DNA, 20 bp, human
gagagaacgcgctcgcgtag

SEQ ID NO: 212033 - DNA, 20 bp, human
ggcgcagggccatgtaggac

SEQ ID NO: 212034 - DNA, 20 bp, human
gccctgaatcatcaaagaga

SEQ ID NO: 212035 - DNA, 20 bp, human
gactgctcggaaggaaagag

SEQ ID NO: 212036 - DNA, 20 bp, human
gcctgcgcacgactccccca

SEQ ID NO: 212037 - DNA, 20 bp, human
ggacagcgctgcttccgcgg

SEQ ID NO: 212038 - DNA, 20 bp, human
ggccgcgccctgctgggtca

SEQ ID NO: 212039 - DNA, 20 bp, human
ggtgagcggcgcagccggga

SEQ ID NO: 212040 - DNA, 20 bp, human
gctagttcggcgcgccgtgg

SEQ ID NO: 212041 - DNA, 20 bp, human
gcgagctggtcaagtgtgag

SEQ ID NO: 212042 - DNA, 20 bp, human
ggcttccgcggcggttgggg

SEQ ID NO: 212043 - DNA, 20 bp, human
ggcggacagcgctgcttccg

SEQ ID NO: 212044 - DNA, 20 bp, human
ggctgcttccgcggcggttg

SEQ ID NO: 212045 - DNA, 20 bp, human
gcagaactacaacaacgagc

SEQ ID NO: 212046 - DNA, 20 bp, human
gcggggcgcgcaccggtctt

SEQ ID NO: 212047 - DNA, 20 bp, human
gaggagcgaggggcggatcg

SEQ ID NO: 212048 - DNA, 20 bp, human
ggacagggacggggcgcggt

SEQ ID NO: 212049 - DNA, 20 bp, human
gcgaggggcggatcgaggtg

SEQ ID NO: 212050 - DNA, 20 bp, human
gagagccagaaggggcggac

SEQ ID NO: 212051 - DNA, 20 bp, human
gactgcctcgcgagaggagg

SEQ ID NO: 212052 - DNA, 20 bp, human
ggcggggcagggagccccga

SEQ ID NO: 212053 - DNA, 20 bp, human
gcgatggggcagagctagga

SEQ ID NO: 212054 - DNA, 20 bp, human
ggggactgcctcgcgagagg

SEQ ID NO: 212055 - DNA, 20 bp, human
gtgcctggagcgcgcgacag

SEQ ID NO: 212056 - DNA, 20 bp, human
gaatgtacaagagtgcgggg

SEQ ID NO: 212057 - DNA, 20 bp, human
gcgagtgggagcaggttccc

SEQ ID NO: 212058 - DNA, 20 bp, human
gcactcttgtacattctgac

SEQ ID NO: 212059 - DNA, 20 bp, human
gtggacagggaccggatggg

SEQ ID NO: 212060 - DNA, 20 bp, human
gacgtggacagggaccggat

SEQ ID NO: 212061 - DNA, 20 bp, human
gggaggggaagtcgatgctt

SEQ ID NO: 212062 - DNA, 20 bp, human
gggtccctgtccacgtagcc

SEQ ID NO: 212063 - DNA, 20 bp, human
ggaagtcgatgcttggggtc

SEQ ID NO: 212064 - DNA, 20 bp, human
gcagaatgtacaagagtgcg

SEQ ID NO: 212065 - DNA, 20 bp, human
ggcagtctgtcagagcacat

SEQ ID NO: 212066 - DNA, 20 bp, human
ggaaccaaggagttccccca

SEQ ID NO: 212067 - DNA, 20 bp, human
gggcgtcgccggggtccatc

SEQ ID NO: 212068 - DNA, 20 bp, human
ggtgccgcgtgtggacccga

SEQ ID NO: 212069 - DNA, 20 bp, human
gcaaaatggcggcgtcgccg

SEQ ID NO: 212070 - DNA, 20 bp, human
gcggccctgggggaactcct

SEQ ID NO: 212071 - DNA, 20 bp, human
gaaggaccacgacaggagca

SEQ ID NO: 212072 - DNA, 20 bp, human
gcgagtccctgctcctgtcg

SEQ ID NO: 212073 - DNA, 20 bp, human
ggggaactccttggttcgag

SEQ ID NO: 212074 - DNA, 20 bp, human
gtcctgtcgtggtccttttc

SEQ ID NO: 212075 - DNA, 20 bp, human
gacctgaaaaggaccacgac

SEQ ID NO: 212076 - DNA, 20 bp, human
ggctgcggcgccagctccaa

SEQ ID NO: 212077 - DNA, 20 bp, human
gagagcagatggcgggaaac

SEQ ID NO: 212078 - DNA, 20 bp, human
gaggaaggagcgcggatccc

SEQ ID NO: 212079 - DNA, 20 bp, human
gcgtggaggcagtgctctcg

SEQ ID NO: 212080 - DNA, 20 bp, human
gtccaagggcggatccaggc

SEQ ID NO: 212081 - DNA, 20 bp, human
gtgtacacggacggagatgg

SEQ ID NO: 212082 - DNA, 20 bp, human
gcgcagcagcacccgcccca

SEQ ID NO: 212083 - DNA, 20 bp, human
ggcccgttggggtccagctg

SEQ ID NO: 212084 - DNA, 20 bp, human
ggaagggccgcctggcaatt

SEQ ID NO: 212085 - DNA, 20 bp, human
gtgccagcctctgcgtagtt

SEQ ID NO: 212086 - DNA, 20 bp, human
gtattgggagcgcaggtcta

SEQ ID NO: 212087 - DNA, 20 bp, human
gaggggtggctagttgccat

SEQ ID NO: 212088 - DNA, 20 bp, human
gcgcggcggcggcaccacgt

SEQ ID NO: 212089 - DNA, 20 bp, human
gaggctatagtgtggtaaca

SEQ ID NO: 212090 - DNA, 20 bp, human
gtgggtggcagccgggtgct

SEQ ID NO: 212091 - DNA, 20 bp, human
ggcaccacgtgggccggacc

SEQ ID NO: 212092 - DNA, 20 bp, human
gttaattcgggacgcctggg

SEQ ID NO: 212093 - DNA, 20 bp, human
gactagccacccctagcacc

SEQ ID NO: 212094 - DNA, 20 bp, human
gaagagctggactttctcta

SEQ ID NO: 212095 - DNA, 20 bp, human
ggctagaagtcaaggttcag

SEQ ID NO: 212096 - DNA, 20 bp, human
ggggaagaggccggtcagta

SEQ ID NO: 212097 - DNA, 20 bp, human
ggtagggctgggtactcgga

SEQ ID NO: 212098 - DNA, 20 bp, human
gggaactggacgcacgcgga

SEQ ID NO: 212099 - DNA, 20 bp, human
gactgcgcaagatggagtgt

SEQ ID NO: 212100 - DNA, 20 bp, human
gcgacggcctaaagtatcta

SEQ ID NO: 212101 - DNA, 20 bp, human
gctgggaggtgcagtctcgc

SEQ ID NO: 212102 - DNA, 20 bp, human
gagtacccagccctactgac

SEQ ID NO: 212103 - DNA, 20 bp, human
gcctggcgctgtgtgaggaa

SEQ ID NO: 212104 - DNA, 20 bp, human
ggctgtgtgaggaagggcta

SEQ ID NO: 212105 - DNA, 20 bp, human
gggcgtccgggactaacccg

SEQ ID NO: 212106 - DNA, 20 bp, human
gggctcaaggcaattgtctg

SEQ ID NO: 212107 - DNA, 20 bp, human
gtgagtgtgcccctatacta

SEQ ID NO: 212108 - DNA, 20 bp, human
ggcgggatcgtcttacaaat

SEQ ID NO: 212109 - DNA, 20 bp, human
gtctgtggaaaggggcggga

SEQ ID NO: 212110 - DNA, 20 bp, human
gggagggccatacatgatcg

SEQ ID NO: 212111 - DNA, 20 bp, human
gaaggattgctgatggctta

SEQ ID NO: 212112 - DNA, 20 bp, human
gcatcagcaatccttagtat

SEQ ID NO: 212113 - DNA, 20 bp, human
gtgtcaagtcatcttgtgaa

SEQ ID NO: 212114 - DNA, 20 bp, human
gtgctgatggcttagggcgg

SEQ ID NO: 212115 - DNA, 20 bp, human
gcaccaaaagtgtattaagg

SEQ ID NO: 212116 - DNA, 20 bp, human
ggcagccagacatgtgtagt

SEQ ID NO: 212117 - DNA, 20 bp, human
gaccccctacaggaagataa

SEQ ID NO: 212118 - DNA, 20 bp, human
gcaggggtcctgtaacagat

SEQ ID NO: 212119 - DNA, 20 bp, human
gcatgctgcagaaaccctct

SEQ ID NO: 212120 - DNA, 20 bp, human
ggcagcccactacacatgtc

SEQ ID NO: 212121 - DNA, 20 bp, human
gaggaaatacttaattgggg

SEQ ID NO: 212122 - DNA, 20 bp, human
gggaaaaaccgatctgttac

SEQ ID NO: 212123 - DNA, 20 bp, human
gtaagctggcaaaatatctg

SEQ ID NO: 212124 - DNA, 20 bp, human
gtgggtcctggttggagggc

SEQ ID NO: 212125 - DNA, 20 bp, human
gtagccgttatcttcctgta

SEQ ID NO: 212126 - DNA, 20 bp, human
gtggtgcacgcttagggtaa

SEQ ID NO: 212127 - DNA, 20 bp, human
gcaaggttggtgcacgctta

SEQ ID NO: 212128 - DNA, 20 bp, human
gaggtgagagggtgtcgggt

SEQ ID NO: 212129 - DNA, 20 bp, human
gggtgtcgggtggggccgga

SEQ ID NO: 212130 - DNA, 20 bp, human
gggcctcactggataatcag

SEQ ID NO: 212131 - DNA, 20 bp, human
gctaacatggaaccagaggg

SEQ ID NO: 212132 - DNA, 20 bp, human
ggccctctgattatccagtg

SEQ ID NO: 212133 - DNA, 20 bp, human
gggcttccctgctggagggg

SEQ ID NO: 212134 - DNA, 20 bp, human
ggagggaggaaggtgcagcg

SEQ ID NO: 212135 - DNA, 20 bp, human
ggctccaatgctgcccgctt

SEQ ID NO: 212136 - DNA, 20 bp, human
gtgtgtgcaggttgaaggaa

SEQ ID NO: 212137 - DNA, 20 bp, human
ggatcccacccccctattta

SEQ ID NO: 212138 - DNA, 20 bp, human
gcaaaaattgctggagactg

SEQ ID NO: 212139 - DNA, 20 bp, human
gagagggaatcactattcag

SEQ ID NO: 212140 - DNA, 20 bp, human
gttgaaggaagggcaccatc

SEQ ID NO: 212141 - DNA, 20 bp, human
gtagccttaaataggggggt

SEQ ID NO: 212142 - DNA, 20 bp, human
gtgggggcgggaatctcctt

SEQ ID NO: 212143 - DNA, 20 bp, human
gctacaaagaggaaatccta

SEQ ID NO: 212144 - DNA, 20 bp, human
gcctctttgtagccttaaat

SEQ ID NO: 212145 - DNA, 20 bp, human
gagagctagactttgtcagg

SEQ ID NO: 212146 - DNA, 20 bp, human
ggggcggcccgcctctgtct

SEQ ID NO: 212147 - DNA, 20 bp, human
ggaggcccggagcctttctg

SEQ ID NO: 212148 - DNA, 20 bp, human
gggagctcgtgtgacatcac

SEQ ID NO: 212149 - DNA, 20 bp, human
gaggctgcccgtgccaagga

SEQ ID NO: 212150 - DNA, 20 bp, human
gcctgccgaggccgccaaag

SEQ ID NO: 212151 - DNA, 20 bp, human
gcagtgcaagaggatccccc

SEQ ID NO: 212152 - DNA, 20 bp, human
gcctcccgcccagcccgctt

SEQ ID NO: 212153 - DNA, 20 bp, human
gctcgtgtgacatcaccggg

SEQ ID NO: 212154 - DNA, 20 bp, human
gcccgcccagcccgctttgg

SEQ ID NO: 212155 - DNA, 20 bp, human
gatgaggcctccacgaaggg

SEQ ID NO: 212156 - DNA, 20 bp, human
gtgcccagaaaaggtaaggt

SEQ ID NO: 212157 - DNA, 20 bp, human
gtctaactcaatgtggaaga

SEQ ID NO: 212158 - DNA, 20 bp, human
gaatgagcaactaacttaat

SEQ ID NO: 212159 - DNA, 20 bp, human
ggagccgtaacaccacctga

SEQ ID NO: 212160 - DNA, 20 bp, human
gcagaaaaggtaaggttggt

SEQ ID NO: 212161 - DNA, 20 bp, human
gactccctcaggtggtgtta

SEQ ID NO: 212162 - DNA, 20 bp, human
gacattcgtgcaagttaaca

SEQ ID NO: 212163 - DNA, 20 bp, human
ggcattgatctaactcaatg

SEQ ID NO: 212164 - DNA, 20 bp, human
gaccttttctgggcaaatat

SEQ ID NO: 212165 - DNA, 20 bp, human
gaactacacattcaatgcta

SEQ ID NO: 212166 - DNA, 20 bp, human
gccccagcccgcagactacc

SEQ ID NO: 212167 - DNA, 20 bp, human
gccgcccccgccttacccag

SEQ ID NO: 212168 - DNA, 20 bp, human
gaaggcgggggcggaatagg

SEQ ID NO: 212169 - DNA, 20 bp, human
ggggcagggcctgtggccgg

SEQ ID NO: 212170 - DNA, 20 bp, human
gccctctccgccactgggta

SEQ ID NO: 212171 - DNA, 20 bp, human
gtggaggcctggtagtctgc

SEQ ID NO: 212172 - DNA, 20 bp, human
gccgccactgggtaaggcgg

SEQ ID NO: 212173 - DNA, 20 bp, human
ggggcgggagagccacagtt

SEQ ID NO: 212174 - DNA, 20 bp, human
gccctggggatgccaaactg

SEQ ID NO: 212175 - DNA, 20 bp, human
gtataagttgggtgcggagt

SEQ ID NO: 212176 - DNA, 20 bp, human
gaaaatgtcaggatctccag

SEQ ID NO: 212177 - DNA, 20 bp, human
gcatggaaactagtaagttt

SEQ ID NO: 212178 - DNA, 20 bp, human
gctaagtagaaatttgatcg

SEQ ID NO: 212179 - DNA, 20 bp, human
gcttactagtttccatgccc

SEQ ID NO: 212180 - DNA, 20 bp, human
ggttgtttcaaaccagggca

SEQ ID NO: 212181 - DNA, 20 bp, human
gaagggtgttgtttcaaacc

SEQ ID NO: 212182 - DNA, 20 bp, human
gtgcgcccagcgttgagatt

SEQ ID NO: 212183 - DNA, 20 bp, human
ggtcttcagttaaaaacctc

SEQ ID NO: 212184 - DNA, 20 bp, human
gagtcagccttttcttgcct

SEQ ID NO: 212185 - DNA, 20 bp, human
gtgcctatattgcaaaagct

SEQ ID NO: 212186 - DNA, 20 bp, human
ggcagagcccagagcgtggg

SEQ ID NO: 212187 - DNA, 20 bp, human
gatcacgcctggctgcccca

SEQ ID NO: 212188 - DNA, 20 bp, human
gactgcagagcccagagcgt

SEQ ID NO: 212189 - DNA, 20 bp, human
gtggggacttaccgtgtgta

SEQ ID NO: 212190 - DNA, 20 bp, human
gctgcagcctcccacgctct

SEQ ID NO: 212191 - DNA, 20 bp, human
ggggaaagggagggatgtcc

SEQ ID NO: 212192 - DNA, 20 bp, human
gtaaggatcaaatacgtaaa

SEQ ID NO: 212193 - DNA, 20 bp, human
gcaccagagcctgataacac

SEQ ID NO: 212194 - DNA, 20 bp, human
gacacagccaaaaagagacc

SEQ ID NO: 212195 - DNA, 20 bp, human
gtttctgagtcaagctacct

SEQ ID NO: 212196 - DNA, 20 bp, human
ggcctgttgggtgaagtcag

SEQ ID NO: 212197 - DNA, 20 bp, human
gggcaacttaggccagagga

SEQ ID NO: 212198 - DNA, 20 bp, human
gcctcccagctcatctggga

SEQ ID NO: 212199 - DNA, 20 bp, human
gggcaggggcataatctaat

SEQ ID NO: 212200 - DNA, 20 bp, human
ggtgaagtcagcggcaactt

SEQ ID NO: 212201 - DNA, 20 bp, human
ggtctctgggctaagacaag

SEQ ID NO: 212202 - DNA, 20 bp, human
gtccttgcctgtacagtctc

SEQ ID NO: 212203 - DNA, 20 bp, human
gtaaccatggggtgagcgta

SEQ ID NO: 212204 - DNA, 20 bp, human
gtgtacctccacccctacca

SEQ ID NO: 212205 - DNA, 20 bp, human
ggccgctgacttcacccaac

SEQ ID NO: 212206 - DNA, 20 bp, human
gggagctgaggggtccgtgg

SEQ ID NO: 212207 - DNA, 20 bp, human
ggactccgcggtcgcatcgg

SEQ ID NO: 212208 - DNA, 20 bp, human
gaggagtcccggacgacctg

SEQ ID NO: 212209 - DNA, 20 bp, human
ggtgcggtgcggggtcagaa

SEQ ID NO: 212210 - DNA, 20 bp, human
gggcccccgggacgccttgt

SEQ ID NO: 212211 - DNA, 20 bp, human
ggggggagctgaggggtccg

SEQ ID NO: 212212 - DNA, 20 bp, human
gccgagggagtcgtgaccca

SEQ ID NO: 212213 - DNA, 20 bp, human
gatgcgaccgcggagtccgg

SEQ ID NO: 212214 - DNA, 20 bp, human
ggggcggggcctcgcgggat

SEQ ID NO: 212215 - DNA, 20 bp, human
ggcggcgcggggtcagccgt

SEQ ID NO: 212216 - DNA, 20 bp, human
gggcaaccaggggtccgcgc

SEQ ID NO: 212217 - DNA, 20 bp, human
gctcggccggcgcggacccc

SEQ ID NO: 212218 - DNA, 20 bp, human
gccgacagcaagcgcctctg

SEQ ID NO: 212219 - DNA, 20 bp, human
ggggccgataaggccctcgg

SEQ ID NO: 212220 - DNA, 20 bp, human
gtcgaccccggggcaaccag

SEQ ID NO: 212221 - DNA, 20 bp, human
ggaggtgctcttgtaatctg

SEQ ID NO: 212222 - DNA, 20 bp, human
gcgggcgctcccggcacggg

SEQ ID NO: 212223 - DNA, 20 bp, human
gccggggtcgagagcagccg

SEQ ID NO: 212224 - DNA, 20 bp, human
gggcctggcccgcacgtcac

SEQ ID NO: 212225 - DNA, 20 bp, human
gtcccggcacgggcgggcgg

SEQ ID NO: 212226 - DNA, 20 bp, human
ggaaggggcgcgcactggga

SEQ ID NO: 212227 - DNA, 20 bp, human
gggcgcgcactgggagggta

SEQ ID NO: 212228 - DNA, 20 bp, human
gtacaggcggcacggtttga

SEQ ID NO: 212229 - DNA, 20 bp, human
ggtggggaaggggcgcgcac

SEQ ID NO: 212230 - DNA, 20 bp, human
gccagggactcgaatgattt

SEQ ID NO: 212231 - DNA, 20 bp, human
gtgagagctgatcctatcaa

SEQ ID NO: 212232 - DNA, 20 bp, human
gctagcgggtatgcacttac

SEQ ID NO: 212233 - DNA, 20 bp, human
ggcctgtacagaccactagc

SEQ ID NO: 212234 - DNA, 20 bp, human
ggcgggtatgcacttactgg

SEQ ID NO: 212235 - DNA, 20 bp, human
gaaggacggtgacgttgcca

SEQ ID NO: 212236 - DNA, 20 bp, human
gtaagtgattcctcggaagg

SEQ ID NO: 212237 - DNA, 20 bp, human
gggaagggggaatgctgcaa

SEQ ID NO: 212238 - DNA, 20 bp, human
gtcagcagttgaactaaagt

SEQ ID NO: 212239 - DNA, 20 bp, human
ggacagaggaagctgtatta

SEQ ID NO: 212240 - DNA, 20 bp, human
ggaacagctccattctatca

SEQ ID NO: 212241 - DNA, 20 bp, human
gcatcaccactagatctaca

SEQ ID NO: 212242 - DNA, 20 bp, human
ggaacagatgcctgattcat

SEQ ID NO: 212243 - DNA, 20 bp, human
gaggttttcagaattagcgc

SEQ ID NO: 212244 - DNA, 20 bp, human
gattctccgtgtagatctag

SEQ ID NO: 212245 - DNA, 20 bp, human
gaagtgtctaagtgattcct

SEQ ID NO: 212246 - DNA, 20 bp, human
gcggcgcccggccccttggc

SEQ ID NO: 212247 - DNA, 20 bp, human
gtagtccagcggcatgccgt

SEQ ID NO: 212248 - DNA, 20 bp, human
gtgggatgatgcgcacgcgg

SEQ ID NO: 212249 - DNA, 20 bp, human
ggcccgggcgcgggtcgaag

SEQ ID NO: 212250 - DNA, 20 bp, human
gaccaggcctagtcgcccgc

SEQ ID NO: 212251 - DNA, 20 bp, human
gactgccgccgcccgggcgc

SEQ ID NO: 212252 - DNA, 20 bp, human
gtgtttcggtgttttagcag

SEQ ID NO: 212253 - DNA, 20 bp, human
gcgcccgcaggctccgcccg

SEQ ID NO: 212254 - DNA, 20 bp, human
gcggttggtcctccgggccc

SEQ ID NO: 212255 - DNA, 20 bp, human
gttggccggcgaggcgagga

SEQ ID NO: 212256 - DNA, 20 bp, human
ggcctcgggcgcggaggggt

SEQ ID NO: 212257 - DNA, 20 bp, human
gagtcccgagaggcgcgagg

SEQ ID NO: 212258 - DNA, 20 bp, human
gcagtcccggaccaggacgc

SEQ ID NO: 212259 - DNA, 20 bp, human
ggacccgccggcctcgggcg

SEQ ID NO: 212260 - DNA, 20 bp, human
ggggccacgccgagttccgc

SEQ ID NO: 212261 - DNA, 20 bp, human
gacacctgcggaactcggcg

SEQ ID NO: 212262 - DNA, 20 bp, human
gggaggctgggcgaactccc

SEQ ID NO: 212263 - DNA, 20 bp, human
gccggggaggagactgggtc

SEQ ID NO: 212264 - DNA, 20 bp, human
ggctgggcgaactcccgggg

SEQ ID NO: 212265 - DNA, 20 bp, human
ggccaccccagtcccggacc

SEQ ID NO: 212266 - DNA, 20 bp, human
ggtgctaaggtttggttctc

SEQ ID NO: 212267 - DNA, 20 bp, human
gtgcacgccacacctgaggg

SEQ ID NO: 212268 - DNA, 20 bp, human
ggcccgttctcgatggtcgc

SEQ ID NO: 212269 - DNA, 20 bp, human
ggataatccgccctcaggtg

SEQ ID NO: 212270 - DNA, 20 bp, human
gcctgagggcggattatccc

SEQ ID NO: 212271 - DNA, 20 bp, human
gctgtgcacgccacacctga

SEQ ID NO: 212272 - DNA, 20 bp, human
gcgtgcacagtgctaaggtt

SEQ ID NO: 212273 - DNA, 20 bp, human
gtcccaggccagcccaagtc

SEQ ID NO: 212274 - DNA, 20 bp, human
ggggcagggctggaaactag

SEQ ID NO: 212275 - DNA, 20 bp, human
gtgtggcgtgcacagtgcta

SEQ ID NO: 212276 - DNA, 20 bp, human
gtggccggcctgggcgggat

SEQ ID NO: 212277 - DNA, 20 bp, human
gcaaccgcagcgtgcgcggt

SEQ ID NO: 212278 - DNA, 20 bp, human
gcgtcgaagccaggcgcgag

SEQ ID NO: 212279 - DNA, 20 bp, human
gcgggatggggtagctgcgc

SEQ ID NO: 212280 - DNA, 20 bp, human
gggggcaaccgcagcgtgcg

SEQ ID NO: 212281 - DNA, 20 bp, human
gagctgcgctgggtgttcca

SEQ ID NO: 212282 - DNA, 20 bp, human
gcgaagccaggcgcgagggg

SEQ ID NO: 212283 - DNA, 20 bp, human
ggacgccaggtggccggcct

SEQ ID NO: 212284 - DNA, 20 bp, human
gcgcagcgtgcgcggtgggg

SEQ ID NO: 212285 - DNA, 20 bp, human
gtgcccgcgcgctcgccttc

SEQ ID NO: 212286 - DNA, 20 bp, human
gggcaggggaagtgccacac

SEQ ID NO: 212287 - DNA, 20 bp, human
ggggaagtgccacacaggct

SEQ ID NO: 212288 - DNA, 20 bp, human
gggaaccctggctttatcca

SEQ ID NO: 212289 - DNA, 20 bp, human
gatcttaggaggtgcccggt

SEQ ID NO: 212290 - DNA, 20 bp, human
gaagtctggtgggaactgga

SEQ ID NO: 212291 - DNA, 20 bp, human
gtggagccaagccgtgggag

SEQ ID NO: 212292 - DNA, 20 bp, human
gttgaccctgcactgtaatc

SEQ ID NO: 212293 - DNA, 20 bp, human
gaccgtgtggacattcgcaa

SEQ ID NO: 212294 - DNA, 20 bp, human
gagtgtccagattacagtgc

SEQ ID NO: 212295 - DNA, 20 bp, human
ggataaagccagggttccct

SEQ ID NO: 212296 - DNA, 20 bp, human
gcggcaaaaggcggagccga

SEQ ID NO: 212297 - DNA, 20 bp, human
ggagccgagggtaggaaagt

SEQ ID NO: 212298 - DNA, 20 bp, human
gccttggcagggcaccgaaa

SEQ ID NO: 212299 - DNA, 20 bp, human
gtgggtgaatgaaagcggag

SEQ ID NO: 212300 - DNA, 20 bp, human
gcggctcaaccggggcggtg

SEQ ID NO: 212301 - DNA, 20 bp, human
ggagggggttgctggactct

SEQ ID NO: 212302 - DNA, 20 bp, human
gcaaccggggcggtgcggaa

SEQ ID NO: 212303 - DNA, 20 bp, human
gaaggacgtggaatatgaca

SEQ ID NO: 212304 - DNA, 20 bp, human
gcaagtctcgcgagaatcgc

SEQ ID NO: 212305 - DNA, 20 bp, human
gcggtgccctgccaaggacg

SEQ ID NO: 212306 - DNA, 20 bp, human
ggcaggcgacggcacaggaa

SEQ ID NO: 212307 - DNA, 20 bp, human
ggccgcccggaggaaatcag

SEQ ID NO: 212308 - DNA, 20 bp, human
ggaggcgcggacaccgccag

SEQ ID NO: 212309 - DNA, 20 bp, human
ggcccggaggaaatcagggg

SEQ ID NO: 212310 - DNA, 20 bp, human
ggggggcgctgcgcacgctc

SEQ ID NO: 212311 - DNA, 20 bp, human
gccgcgccaagcgcaggcga

SEQ ID NO: 212312 - DNA, 20 bp, human
gcagccggggcaagcgacgt

SEQ ID NO: 212313 - DNA, 20 bp, human
gccgcggccgcgccaagcgc

SEQ ID NO: 212314 - DNA, 20 bp, human
gaggaaatcaggggcgggcg

SEQ ID NO: 212315 - DNA, 20 bp, human
ggcgcggcggggacggtctg

SEQ ID NO: 212316 - DNA, 20 bp, human
gcaaccgcctaggcctgcgc

SEQ ID NO: 212317 - DNA, 20 bp, human
gtgacccgcgcaggcctagg

SEQ ID NO: 212318 - DNA, 20 bp, human
ggcagccagtggcgagtcga

SEQ ID NO: 212319 - DNA, 20 bp, human
gcgggttggccaatagacat

SEQ ID NO: 212320 - DNA, 20 bp, human
gtgacgaagagcctgagcga

SEQ ID NO: 212321 - DNA, 20 bp, human
gcgggtgttcgcaaccgcct

SEQ ID NO: 212322 - DNA, 20 bp, human
ggcgggtcaacgcagcttgg

SEQ ID NO: 212323 - DNA, 20 bp, human
gaagctgcgttgacccgcgc

SEQ ID NO: 212324 - DNA, 20 bp, human
gacgcgatagtcaggcgggt

SEQ ID NO: 212325 - DNA, 20 bp, human
gaggtcgtgacgcgatagtc

SEQ ID NO: 212326 - DNA, 20 bp, human
gcaaccgcctaggcctgcgc

SEQ ID NO: 212327 - DNA, 20 bp, human
gtgacccgcgcaggcctagg

SEQ ID NO: 212328 - DNA, 20 bp, human
ggcagccagtggcgagtcga

SEQ ID NO: 212329 - DNA, 20 bp, human
gcgggttggccaatagacat

SEQ ID NO: 212330 - DNA, 20 bp, human
gtgacgaagagcctgagcga

SEQ ID NO: 212331 - DNA, 20 bp, human
gcgggtgttcgcaaccgcct

SEQ ID NO: 212332 - DNA, 20 bp, human
ggcgggtcaacgcagcttgg

SEQ ID NO: 212333 - DNA, 20 bp, human
gaagctgcgttgacccgcgc

SEQ ID NO: 212334 - DNA, 20 bp, human
gacgcgatagtcaggcgggt

SEQ ID NO: 212335 - DNA, 20 bp, human
gaggtcgtgacgcgatagtc

SEQ ID NO: 212336 - DNA, 20 bp, human
ggtgctgaggtgcgaggaga

SEQ ID NO: 212337 - DNA, 20 bp, human
gccccaaaagctcaggtctc

SEQ ID NO: 212338 - DNA, 20 bp, human
ggaccccgtagtttcgggag

SEQ ID NO: 212339 - DNA, 20 bp, human
gcatagccacggtaacggcg

SEQ ID NO: 212340 - DNA, 20 bp, human
gccaaccgcgaggctgcaaa

SEQ ID NO: 212341 - DNA, 20 bp, human
gaccctctcccgaaactacg

SEQ ID NO: 212342 - DNA, 20 bp, human
gtagtttcgggagagggtga

SEQ ID NO: 212343 - DNA, 20 bp, human
gtgggacagtcacctggcga

SEQ ID NO: 212344 - DNA, 20 bp, human
gggtgaaagagcttccgggt

SEQ ID NO: 212345 - DNA, 20 bp, human
gacagtcacctggcgagggg

SEQ ID NO: 212346 - DNA, 20 bp, human
gaaactggatccaacttctc

SEQ ID NO: 212347 - DNA, 20 bp, human
ggaaatgcgagggcttcgga

SEQ ID NO: 212348 - DNA, 20 bp, human
gtcccagcatccctccctag

SEQ ID NO: 212349 - DNA, 20 bp, human
gccccagttccccctaggga

SEQ ID NO: 212350 - DNA, 20 bp, human
ggaaaatcaaaggctgagac

SEQ ID NO: 212351 - DNA, 20 bp, human
gtccccctagggagggatgc

SEQ ID NO: 212352 - DNA, 20 bp, human
gaggggaaatgcgagggctt

SEQ ID NO: 212353 - DNA, 20 bp, human
gacttgctggataggggcag

SEQ ID NO: 212354 - DNA, 20 bp, human
ggctcctgccccgcaaaggt

SEQ ID NO: 212355 - DNA, 20 bp, human
gagccgctcctgccccgcaa

SEQ ID NO: 212356 - DNA, 20 bp, human
gcgggtgtcaagggcccctg

SEQ ID NO: 212357 - DNA, 20 bp, human
gaggcgctcaagcagggtct

SEQ ID NO: 212358 - DNA, 20 bp, human
gaggctgccccgcgccgcac

SEQ ID NO: 212359 - DNA, 20 bp, human
gccacccgggctcttatcgg

SEQ ID NO: 212360 - DNA, 20 bp, human
gctcccacccgggctcttat

SEQ ID NO: 212361 - DNA, 20 bp, human
ggccgcacgggggtccacat

SEQ ID NO: 212362 - DNA, 20 bp, human
gaccctgcttgagcgcctcc

SEQ ID NO: 212363 - DNA, 20 bp, human
ggaaggcacccggctcgagt

SEQ ID NO: 212364 - DNA, 20 bp, human
gtgagcgcctccgggtgtca

SEQ ID NO: 212365 - DNA, 20 bp, human
gtagctccacccactcgagc

SEQ ID NO: 212366 - DNA, 20 bp, human
gcggggcgcgggcttctcgg

SEQ ID NO: 212367 - DNA, 20 bp, human
gcccgcccgcttgggtccca

SEQ ID NO: 212368 - DNA, 20 bp, human
gcgcccgttcccgcccgctt

SEQ ID NO: 212369 - DNA, 20 bp, human
gggtcccaggaccccgcgtc

SEQ ID NO: 212370 - DNA, 20 bp, human
gcccgcgcctcgccggtccc

SEQ ID NO: 212371 - DNA, 20 bp, human
gacggcggccccgctcgcgg

SEQ ID NO: 212372 - DNA, 20 bp, human
gcgcggggagcgcaatgtgc

SEQ ID NO: 212373 - DNA, 20 bp, human
ggagcgcaatgtgctggcgg

SEQ ID NO: 212374 - DNA, 20 bp, human
ggccctgggacccaagcggg

SEQ ID NO: 212375 - DNA, 20 bp, human
gccccacggacgccaggccg

SEQ ID NO: 212376 - DNA, 20 bp, human
gcgcccggaaaactcgtccc

SEQ ID NO: 212377 - DNA, 20 bp, human
ggggcgggtctctctcgtga

SEQ ID NO: 212378 - DNA, 20 bp, human
ggagaggggcgtgtcttccg

SEQ ID NO: 212379 - DNA, 20 bp, human
gcgggcttagggaagcagag

SEQ ID NO: 212380 - DNA, 20 bp, human
gcacctggaaggccttcgcc

SEQ ID NO: 212381 - DNA, 20 bp, human
ggggtctctctcgtgagggc

SEQ ID NO: 212382 - DNA, 20 bp, human
gccggcttcgggattgggac

SEQ ID NO: 212383 - DNA, 20 bp, human
ggggggcggtgtttcgagag

SEQ ID NO: 212384 - DNA, 20 bp, human
ggcgggcccagctgtaagag

SEQ ID NO: 212385 - DNA, 20 bp, human
gtaatggccagcaggggcca

SEQ ID NO: 212386 - DNA, 20 bp, human
gcagactgcgccactcccgg

SEQ ID NO: 212387 - DNA, 20 bp, human
gatcgccattggagcaacct

SEQ ID NO: 212388 - DNA, 20 bp, human
gtgtccgccagcccgcggga

SEQ ID NO: 212389 - DNA, 20 bp, human
gataggggagcggaacgtgt

SEQ ID NO: 212390 - DNA, 20 bp, human
gaccgcctgccgcctgtcat

SEQ ID NO: 212391 - DNA, 20 bp, human
gggtagcgagagatcgccat

SEQ ID NO: 212392 - DNA, 20 bp, human
ggccattggagcaacctggg

SEQ ID NO: 212393 - DNA, 20 bp, human
ggtacccccaccattccccc

SEQ ID NO: 212394 - DNA, 20 bp, human
ggtctccgcaggccctgcgg

SEQ ID NO: 212395 - DNA, 20 bp, human
gggggagcggaacgtgtagg

SEQ ID NO: 212396 - DNA, 20 bp, human
ggggcggggcgatctggagt

SEQ ID NO: 212397 - DNA, 20 bp, human
gggttcgctgtgtgtgtcgc

SEQ ID NO: 212398 - DNA, 20 bp, human
gtgtgtcgccggctccttga

SEQ ID NO: 212399 - DNA, 20 bp, human
gtgaccggagggcgaaattg

SEQ ID NO: 212400 - DNA, 20 bp, human
gcggggcgatctggagtagg

SEQ ID NO: 212401 - DNA, 20 bp, human
gacgcagcccggcggcgcag

SEQ ID NO: 212402 - DNA, 20 bp, human
ggggcctcggagcgtaaagg

SEQ ID NO: 212403 - DNA, 20 bp, human
ggagtaggaggtgtgaccgg

SEQ ID NO: 212404 - DNA, 20 bp, human
ggagtctcatgagcgtgctc

SEQ ID NO: 212405 - DNA, 20 bp, human
gctgctgaactgtgcagggt

SEQ ID NO: 212406 - DNA, 20 bp, human
ggggggtgggagtgttactt

SEQ ID NO: 212407 - DNA, 20 bp, human
gtaacactcccacccccatt

SEQ ID NO: 212408 - DNA, 20 bp, human
gtgtgagagggccattcctt

SEQ ID NO: 212409 - DNA, 20 bp, human
gtctgagttggctcctaatg

SEQ ID NO: 212410 - DNA, 20 bp, human
gcctgctgaatatgtgaatc

SEQ ID NO: 212411 - DNA, 20 bp, human
ggtaaacagcctgaggggaa

SEQ ID NO: 212412 - DNA, 20 bp, human
gcccctgactcttgacaaat

SEQ ID NO: 212413 - DNA, 20 bp, human
gtgagataatcttccaacct

SEQ ID NO: 212414 - DNA, 20 bp, human
ggcttcccagacactgagtc

SEQ ID NO: 212415 - DNA, 20 bp, human
gactgggggtgtgatatgta

SEQ ID NO: 212416 - DNA, 20 bp, human
gcggcggctccagaggtccg

SEQ ID NO: 212417 - DNA, 20 bp, human
gggggcggggcttgagccgg

SEQ ID NO: 212418 - DNA, 20 bp, human
gggagcggagcctggaccag

SEQ ID NO: 212419 - DNA, 20 bp, human
gacgccagcagcagccgatt

SEQ ID NO: 212420 - DNA, 20 bp, human
gccaggctccgctccctacc

SEQ ID NO: 212421 - DNA, 20 bp, human
ggacgcctggagcggccggt

SEQ ID NO: 212422 - DNA, 20 bp, human
ggctagaccccgccacctac

SEQ ID NO: 212423 - DNA, 20 bp, human
ggagctgcggacgcctggag

SEQ ID NO: 212424 - DNA, 20 bp, human
gctagcccaagcccaatgcc

SEQ ID NO: 212425 - DNA, 20 bp, human
ggcctggagcggccggtagg

SEQ ID NO: 212426 - DNA, 20 bp, human
ggaccctgcccaatcgttac

SEQ ID NO: 212427 - DNA, 20 bp, human
gaggacgtcccggtaacgat

SEQ ID NO: 212428 - DNA, 20 bp, human
gctaatggagtgaaggagag

SEQ ID NO: 212429 - DNA, 20 bp, human
gcgggactaggaggacgtcc

SEQ ID NO: 212430 - DNA, 20 bp, human
ggtgacgtgcacagcccctg

SEQ ID NO: 212431 - DNA, 20 bp, human
gccgtgagttagtgcgctaa

SEQ ID NO: 212432 - DNA, 20 bp, human
ggtcgcatgcgcccttacgc

SEQ ID NO: 212433 - DNA, 20 bp, human
gagcctctctggcggtccgg

SEQ ID NO: 212434 - DNA, 20 bp, human
ggcgggattgacagcctctc

SEQ ID NO: 212435 - DNA, 20 bp, human
gccaccctcctttgcgacgg

SEQ ID NO: 212436 - DNA, 20 bp, human
gcactagtccgagtggggcg

SEQ ID NO: 212437 - DNA, 20 bp, human
gacactatccgacaaaggag

SEQ ID NO: 212438 - DNA, 20 bp, human
gactaccgcgggcacgggac

SEQ ID NO: 212439 - DNA, 20 bp, human
gggagaccgaccagcacgaa

SEQ ID NO: 212440 - DNA, 20 bp, human
gggtgacactagtccgagtg

SEQ ID NO: 212441 - DNA, 20 bp, human
gagcacgaagggcggagttc

SEQ ID NO: 212442 - DNA, 20 bp, human
gggaagcgggacgtaccaag

SEQ ID NO: 212443 - DNA, 20 bp, human
ggacagcgtcgccccgcgat

SEQ ID NO: 212444 - DNA, 20 bp, human
gaccgcgggcacgggacggg

SEQ ID NO: 212445 - DNA, 20 bp, human
gtacgccgaagcactcgttc

SEQ ID NO: 212446 - DNA, 20 bp, human
gccattggctctgaagtcag

SEQ ID NO: 212447 - DNA, 20 bp, human
gcatggggctactggagcag

SEQ ID NO: 212448 - DNA, 20 bp, human
gcatctgtcctgctccaaaa

SEQ ID NO: 212449 - DNA, 20 bp, human
ggctggaatggtttggtccg

SEQ ID NO: 212450 - DNA, 20 bp, human
ggaagctggggacaggtaga

SEQ ID NO: 212451 - DNA, 20 bp, human
gaaaaaggctgcaagggtgt

SEQ ID NO: 212452 - DNA, 20 bp, human
gttgtggaccgaaccacatg

SEQ ID NO: 212453 - DNA, 20 bp, human
gaccccggacccggtgccca

SEQ ID NO: 212454 - DNA, 20 bp, human
gcgaccttgggcaccgggtc

SEQ ID NO: 212455 - DNA, 20 bp, human
gaggtcgcctatccccgccg

SEQ ID NO: 212456 - DNA, 20 bp, human
gcggggccctgacgccaggt

SEQ ID NO: 212457 - DNA, 20 bp, human
gggtggcaggtggccgaaga

SEQ ID NO: 212458 - DNA, 20 bp, human
gggacagtgcagaccctctt

SEQ ID NO: 212459 - DNA, 20 bp, human
gcactgtccccggatctcgt

SEQ ID NO: 212460 - DNA, 20 bp, human
gcgggcggggccctgacgcc

SEQ ID NO: 212461 - DNA, 20 bp, human
gcactctcccacgagatccg

SEQ ID NO: 212462 - DNA, 20 bp, human
gagtccgcctcgtgaaactg

SEQ ID NO: 212463 - DNA, 20 bp, human
ggatctcgtgggagagtggg

SEQ ID NO: 212464 - DNA, 20 bp, human
gtcagccccgcggcatcatg

SEQ ID NO: 212465 - DNA, 20 bp, human
ggcgcgggatacggggatgt

SEQ ID NO: 212466 - DNA, 20 bp, human
ggggagtgcgggttcggggt

SEQ ID NO: 212467 - DNA, 20 bp, human
gcggaaacacactgcctcgg

SEQ ID NO: 212468 - DNA, 20 bp, human
gctgggaatagaaggtgcga

SEQ ID NO: 212469 - DNA, 20 bp, human
ggggagactccagctctggg

SEQ ID NO: 212470 - DNA, 20 bp, human
gtggcgggagtgcgggttcg

SEQ ID NO: 212471 - DNA, 20 bp, human
gggaatagaaggtgcgaggg

SEQ ID NO: 212472 - DNA, 20 bp, human
ggccggcgcctagtgattct

SEQ ID NO: 212473 - DNA, 20 bp, human
gtcccagaatcactaggcgc

SEQ ID NO: 212474 - DNA, 20 bp, human
gctctcgcgagaggagcaag

SEQ ID NO: 212475 - DNA, 20 bp, human
gcgggaggctcagatccgga

SEQ ID NO: 212476 - DNA, 20 bp, human
gcacgcgcgtgcactaccga

SEQ ID NO: 212477 - DNA, 20 bp, human
ggaggcctgcaccctagttc

SEQ ID NO: 212478 - DNA, 20 bp, human
ggtcgggcccgggtccgctg

SEQ ID NO: 212479 - DNA, 20 bp, human
gagggccggaactgagctga

SEQ ID NO: 212480 - DNA, 20 bp, human
gtggggagctgtgttcaaga

SEQ ID NO: 212481 - DNA, 20 bp, human
ggctgggcctccagtaatca

SEQ ID NO: 212482 - DNA, 20 bp, human
ggccggaactgagctgacgg

SEQ ID NO: 212483 - DNA, 20 bp, human
gacctggggtaggaagaccg

SEQ ID NO: 212484 - DNA, 20 bp, human
gacccgggcccgaccgaggt

SEQ ID NO: 212485 - DNA, 20 bp, human
gtccacccacaccggaacta

SEQ ID NO: 212486 - DNA, 20 bp, human
ggggcgtggcccggtagctg

SEQ ID NO: 212487 - DNA, 20 bp, human
gcccgagcggaagcgcggat

SEQ ID NO: 212488 - DNA, 20 bp, human
gagtccccgcggagcagcgg

SEQ ID NO: 212489 - DNA, 20 bp, human
gacggcccccgcgaccaatc

SEQ ID NO: 212490 - DNA, 20 bp, human
gcgcgcttccgctcgggccg

SEQ ID NO: 212491 - DNA, 20 bp, human
gcggagcagcggcggtcgag

SEQ ID NO: 212492 - DNA, 20 bp, human
ggggagctcgaaggaactct

SEQ ID NO: 212493 - DNA, 20 bp, human
gagctcgcggaggaagtcgg

SEQ ID NO: 212494 - DNA, 20 bp, human
gggggactcggggagctcga

SEQ ID NO: 212495 - DNA, 20 bp, human
ggctgctccgcggggactcg

SEQ ID NO: 212496 - DNA, 20 bp, human
gtgtccccgccgttcccctt

SEQ ID NO: 212497 - DNA, 20 bp, human
gcgggtgtcgggagaaccag

SEQ ID NO: 212498 - DNA, 20 bp, human
ggaacggcggggacagatga

SEQ ID NO: 212499 - DNA, 20 bp, human
gaaggagggtgaggcgtaac

SEQ ID NO: 212500 - DNA, 20 bp, human
gtaacagggagaccgggtgt

SEQ ID NO: 212501 - DNA, 20 bp, human
gagggcggggagcctgacga

SEQ ID NO: 212502 - DNA, 20 bp, human
ggagcctgacgatgggaggg

SEQ ID NO: 212503 - DNA, 20 bp, human
gaagcggggaagtgtgcctg

SEQ ID NO: 212504 - DNA, 20 bp, human
gtgaggcgtaacagggagac

SEQ ID NO: 212505 - DNA, 20 bp, human
gaggagactggaaagaagcg

SEQ ID NO: 212506 - DNA, 20 bp, human
gtttttctagaactctacga

SEQ ID NO: 212507 - DNA, 20 bp, human
ggaatttgatgattaagacc

SEQ ID NO: 212508 - DNA, 20 bp, human
gttttgagtatgttgaaaag

SEQ ID NO: 212509 - DNA, 20 bp, human
gatgaaaggcaacaaaccta

SEQ ID NO: 212510 - DNA, 20 bp, human
gtttgatgattaagaccagg

SEQ ID NO: 212511 - DNA, 20 bp, human
gagttttctcttatgccacc

SEQ ID NO: 212512 - DNA, 20 bp, human
gctcactatagagtaaaagg

SEQ ID NO: 212513 - DNA, 20 bp, human
gattataagttaattaccat

SEQ ID NO: 212514 - DNA, 20 bp, human
gattctcactatagagtaaa

SEQ ID NO: 212515 - DNA, 20 bp, human
gggaaatttaaatatttaaa

SEQ ID NO: 212516 - DNA, 20 bp, human
gagtcacggccaggcgggaa

SEQ ID NO: 212517 - DNA, 20 bp, human
gagctcgcgtggcccgcaga

SEQ ID NO: 212518 - DNA, 20 bp, human
ggggaccgtccgcggggatg

SEQ ID NO: 212519 - DNA, 20 bp, human
gcgggacgttccggaatctc

SEQ ID NO: 212520 - DNA, 20 bp, human
gcgccagcccggactccgga

SEQ ID NO: 212521 - DNA, 20 bp, human
ggatctctcttcggagaaga

SEQ ID NO: 212522 - DNA, 20 bp, human
gccgcggacggtccctggag

SEQ ID NO: 212523 - DNA, 20 bp, human
ggagctgcagtcaccctctg

SEQ ID NO: 212524 - DNA, 20 bp, human
ggcgggccacgcgagctcga

SEQ ID NO: 212525 - DNA, 20 bp, human
ggagggcgccttccggagtc

SEQ ID NO: 212526 - DNA, 20 bp, human
gagtgccctccggctctaat

SEQ ID NO: 212527 - DNA, 20 bp, human
gagggcctgaaaaccaaacg

SEQ ID NO: 212528 - DNA, 20 bp, human
gagcaggtggcactgtcatc

SEQ ID NO: 212529 - DNA, 20 bp, human
gctaataggccaggagttgg

SEQ ID NO: 212530 - DNA, 20 bp, human
gcaaccagtcccaagtgctc

SEQ ID NO: 212531 - DNA, 20 bp, human
gtgggagtacagaactgtcc

SEQ ID NO: 212532 - DNA, 20 bp, human
gtgcccgaggtgaaggtgac

SEQ ID NO: 212533 - DNA, 20 bp, human
ggcactgtgtcccaagagca

SEQ ID NO: 212534 - DNA, 20 bp, human
gaggcaactgagttgcaaaa

SEQ ID NO: 212535 - DNA, 20 bp, human
ggtcccaagagcaggggtgc

SEQ ID NO: 212536 - DNA, 20 bp, human
gggaccgtcttctgggagct

SEQ ID NO: 212537 - DNA, 20 bp, human
gctccgctatttcaaatcta

SEQ ID NO: 212538 - DNA, 20 bp, human
ggtgcaggcgcgctccgcca

SEQ ID NO: 212539 - DNA, 20 bp, human
gtccgccagggaccgtcttc

SEQ ID NO: 212540 - DNA, 20 bp, human
gcagcccggcctgagaaaga

SEQ ID NO: 212541 - DNA, 20 bp, human
gcagacaggccctctttctc

SEQ ID NO: 212542 - DNA, 20 bp, human
gctgccgagctcccagaaga

SEQ ID NO: 212543 - DNA, 20 bp, human
gtggctgaacgctgaggctc

SEQ ID NO: 212544 - DNA, 20 bp, human
gtcctcctcagaagggagat

SEQ ID NO: 212545 - DNA, 20 bp, human
ggcaccctatctcccttctg

SEQ ID NO: 212546 - DNA, 20 bp, human
gagggatggaggcagagtca

SEQ ID NO: 212547 - DNA, 20 bp, human
ggtggcactggcagcagtga

SEQ ID NO: 212548 - DNA, 20 bp, human
ggcactggcagcagtgaggg

SEQ ID NO: 212549 - DNA, 20 bp, human
gtggcagcagtgagggcggg

SEQ ID NO: 212550 - DNA, 20 bp, human
gggatcgcccgggcagcccc

SEQ ID NO: 212551 - DNA, 20 bp, human
gtcctcctcagaagggagat

SEQ ID NO: 212552 - DNA, 20 bp, human
ggcaccctatctcccttctg

SEQ ID NO: 212553 - DNA, 20 bp, human
gccctatctcccttctgagg

SEQ ID NO: 212554 - DNA, 20 bp, human
gtagtgtcaggtagctggag

SEQ ID NO: 212555 - DNA, 20 bp, human
gtctgaccctgaagtctgtg

SEQ ID NO: 212556 - DNA, 20 bp, human
gtctggccctgaaatctgtg

SEQ ID NO: 212557 - DNA, 20 bp, human
gctgctggcgcgcgcctcta

SEQ ID NO: 212558 - DNA, 20 bp, human
gcactagccacacagatttc

SEQ ID NO: 212559 - DNA, 20 bp, human
gtggctgaacgctgaggctc

SEQ ID NO: 212560 - DNA, 20 bp, human
gaatctgtgtggctagtgtc

SEQ ID NO: 212561 - DNA, 20 bp, human
gcggaagggagatacggtgc

SEQ ID NO: 212562 - DNA, 20 bp, human
gccgtatctcccttccgagg

SEQ ID NO: 212563 - DNA, 20 bp, human
gtagtgtcaggtagctggag

SEQ ID NO: 212564 - DNA, 20 bp, human
gggtagctggagagggatgg

SEQ ID NO: 212565 - DNA, 20 bp, human
ggtggctagtgtcaggtagc

SEQ ID NO: 212566 - DNA, 20 bp, human
ggggatggaggcagagtcag

SEQ ID NO: 212567 - DNA, 20 bp, human
gaggagcggaccttgaggcc

SEQ ID NO: 212568 - DNA, 20 bp, human
ggtggcactggcagcagtga

SEQ ID NO: 212569 - DNA, 20 bp, human
gcggccctgaggccatccaa

SEQ ID NO: 212570 - DNA, 20 bp, human
ggcactggcagcagtgaggg

SEQ ID NO: 212571 - DNA, 20 bp, human
gtggcagcagtgagggcggg

SEQ ID NO: 212572 - DNA, 20 bp, human
gcaaaccgcgcgtgtggcac

SEQ ID NO: 212573 - DNA, 20 bp, human
ggctgccagtgccacacgcg

SEQ ID NO: 212574 - DNA, 20 bp, human
gaggtgggctgtgcgctctg

SEQ ID NO: 212575 - DNA, 20 bp, human
ggcggaccttgaggccaggt

SEQ ID NO: 212576 - DNA, 20 bp, human
gtggaaaagcgttacttgtt

SEQ ID NO: 212577 - DNA, 20 bp, human
gtgtgagagccacacgtgtc

SEQ ID NO: 212578 - DNA, 20 bp, human
gaaagaaggaagcaaagtta

SEQ ID NO: 212579 - DNA, 20 bp, human
gtctgccagtggtaacatgc

SEQ ID NO: 212580 - DNA, 20 bp, human
gctctcacaagtaagtttgt

SEQ ID NO: 212581 - DNA, 20 bp, human
gggtctctagcctttctcaa

SEQ ID NO: 212582 - DNA, 20 bp, human
gtttcagtggccattgagaa

SEQ ID NO: 212583 - DNA, 20 bp, human
gcccaatgaaacaaaggcac

SEQ ID NO: 212584 - DNA, 20 bp, human
ggcccagcccaatgaaacaa

SEQ ID NO: 212585 - DNA, 20 bp, human
gagttcttacattggcagga

SEQ ID NO: 212586 - DNA, 20 bp, human
gacgccgagcggccagatca

SEQ ID NO: 212587 - DNA, 20 bp, human
gttggcgagaaggcgggact

SEQ ID NO: 212588 - DNA, 20 bp, human
gcggccagatcagggacgcg

SEQ ID NO: 212589 - DNA, 20 bp, human
ggggactagggcgacagccg

SEQ ID NO: 212590 - DNA, 20 bp, human
gccgccccgcgtccctgatc

SEQ ID NO: 212591 - DNA, 20 bp, human
gcggcccggcggccctccag

SEQ ID NO: 212592 - DNA, 20 bp, human
gtctggccgctcggcgtccg

SEQ ID NO: 212593 - DNA, 20 bp, human
gagaaccaattgcaacggta

SEQ ID NO: 212594 - DNA, 20 bp, human
gtcgatccgccccgggtctc

SEQ ID NO: 212595 - DNA, 20 bp, human
gcaattgcaacggtagggcg

SEQ ID NO: 212596 - DNA, 20 bp, human
gcctgggcctccatgttgta

SEQ ID NO: 212597 - DNA, 20 bp, human
gagacgggcaggggtggaca

SEQ ID NO: 212598 - DNA, 20 bp, human
gccctgggccagatgactct

SEQ ID NO: 212599 - DNA, 20 bp, human
gacactgctagcccagattc

SEQ ID NO: 212600 - DNA, 20 bp, human
ggacagggaaggactggcgc

SEQ ID NO: 212601 - DNA, 20 bp, human
gtggcgcaggtgcaagcccc

SEQ ID NO: 212602 - DNA, 20 bp, human
ggagctgtttggagatgagt

SEQ ID NO: 212603 - DNA, 20 bp, human
gccaactaaaataccagtct

SEQ ID NO: 212604 - DNA, 20 bp, human
gggcctccatgttgtagggc

SEQ ID NO: 212605 - DNA, 20 bp, human
gcctcacgtggccaccatga

SEQ ID NO: 212606 - DNA, 20 bp, human
gctcccccacgggatggaat

SEQ ID NO: 212607 - DNA, 20 bp, human
ggccgccggctgcatctcca

SEQ ID NO: 212608 - DNA, 20 bp, human
gcccttggccgactcggagg

SEQ ID NO: 212609 - DNA, 20 bp, human
gagccccctcccccacggga

SEQ ID NO: 212610 - DNA, 20 bp, human
ggaatgggaagacccaggta

SEQ ID NO: 212611 - DNA, 20 bp, human
ggcgcccttggccgactcgg

SEQ ID NO: 212612 - DNA, 20 bp, human
gtgagtggcgagagccctgc

SEQ ID NO: 212613 - DNA, 20 bp, human
ggcatctccaggggacccgc

SEQ ID NO: 212614 - DNA, 20 bp, human
gccctcctgaccttgtcgcc

SEQ ID NO: 212615 - DNA, 20 bp, human
gcccctggagatgcagccgg

SEQ ID NO: 212616 - DNA, 20 bp, human
gcgtgcgcacgaaggcccag

SEQ ID NO: 212617 - DNA, 20 bp, human
ggcccagacctcgcaaatct

SEQ ID NO: 212618 - DNA, 20 bp, human
gacaaatgtcggtgggagtc

SEQ ID NO: 212619 - DNA, 20 bp, human
ggcacccaaagggacatgga

SEQ ID NO: 212620 - DNA, 20 bp, human
gtccacgcgcgtgcgcacga

SEQ ID NO: 212621 - DNA, 20 bp, human
gggagtctggctgagtgttc

SEQ ID NO: 212622 - DNA, 20 bp, human
gcgcttgcttggtaacccgg

SEQ ID NO: 212623 - DNA, 20 bp, human
ggtaacccggagggagagat

SEQ ID NO: 212624 - DNA, 20 bp, human
gctcgcaaatctcggcgact

SEQ ID NO: 212625 - DNA, 20 bp, human
gcctgtcaaacaaatgtcgg

SEQ ID NO: 212626 - DNA, 20 bp, human
gcgcgtgcccagaacgtgag

SEQ ID NO: 212627 - DNA, 20 bp, human
gccacggcggagtaaggggt

SEQ ID NO: 212628 - DNA, 20 bp, human
gagctggagtaggaagcgta

SEQ ID NO: 212629 - DNA, 20 bp, human
gggagccgggctgacactag

SEQ ID NO: 212630 - DNA, 20 bp, human
ggtgcccagaacgtgagggg

SEQ ID NO: 212631 - DNA, 20 bp, human
ggggccagatcgccgcgcga

SEQ ID NO: 212632 - DNA, 20 bp, human
gcgccccacggcggagtaag

SEQ ID NO: 212633 - DNA, 20 bp, human
gcacgcgcagttgcgggcgt

SEQ ID NO: 212634 - DNA, 20 bp, human
gtgccgccgtcgcccaggat

SEQ ID NO: 212635 - DNA, 20 bp, human
gcgtgtacgcagagcaatca

SEQ ID NO: 212636 - DNA, 20 bp, human
gagtacaccagatttccttg

SEQ ID NO: 212637 - DNA, 20 bp, human
gactaggcatttcatcctgt

SEQ ID NO: 212638 - DNA, 20 bp, human
gtgcctctgctgactaacag

SEQ ID NO: 212639 - DNA, 20 bp, human
ggagatctgagctacttctc

SEQ ID NO: 212640 - DNA, 20 bp, human
gatttccttgtggcttttag

SEQ ID NO: 212641 - DNA, 20 bp, human
gggatgtaacttcctctagc

SEQ ID NO: 212642 - DNA, 20 bp, human
gaaccactgttagtcagcag

SEQ ID NO: 212643 - DNA, 20 bp, human
gcgaaagcagttaagccgtt

SEQ ID NO: 212644 - DNA, 20 bp, human
gtgcaatggactcataaaaa

SEQ ID NO: 212645 - DNA, 20 bp, human
gtactgcaactgtcattata

SEQ ID NO: 212646 - DNA, 20 bp, human
gagtgtggaaagtatgtgtg

SEQ ID NO: 212647 - DNA, 20 bp, human
gggggcagaccagtctattt

SEQ ID NO: 212648 - DNA, 20 bp, human
ggcacagtgcgtgcggagtt

SEQ ID NO: 212649 - DNA, 20 bp, human
gcgcgcgcgcacactacaca

SEQ ID NO: 212650 - DNA, 20 bp, human
gggaaagtgcacagtgcgtg

SEQ ID NO: 212651 - DNA, 20 bp, human
gacgagtgagtgtggaagtg

SEQ ID NO: 212652 - DNA, 20 bp, human
gcgggagcgcgcggcgtcgg

SEQ ID NO: 212653 - DNA, 20 bp, human
gtgagtacatgcgggtgagt

SEQ ID NO: 212654 - DNA, 20 bp, human
ggaaggttgggagtcctctg

SEQ ID NO: 212655 - DNA, 20 bp, human
gcatatcctcccaaatagac

SEQ ID NO: 212656 - DNA, 20 bp, human
gcgtgcccagcatcagggtc

SEQ ID NO: 212657 - DNA, 20 bp, human
gcctccctggagcggaaagt

SEQ ID NO: 212658 - DNA, 20 bp, human
gacactcagtgccacccaag

SEQ ID NO: 212659 - DNA, 20 bp, human
ggggcacggtgcagcctctt

SEQ ID NO: 212660 - DNA, 20 bp, human
gtggggggcgccatgccaca

SEQ ID NO: 212661 - DNA, 20 bp, human
gaggagccggaccctgatgc

SEQ ID NO: 212662 - DNA, 20 bp, human
gtgcccggagaacgcggcca

SEQ ID NO: 212663 - DNA, 20 bp, human
gctgccgctgaggcactgcg

SEQ ID NO: 212664 - DNA, 20 bp, human
gaccagcagcgcggatcctt

SEQ ID NO: 212665 - DNA, 20 bp, human
gtgaggcactgcgaggctgg

SEQ ID NO: 212666 - DNA, 20 bp, human
ggggaccgaccccctcactt

SEQ ID NO: 212667 - DNA, 20 bp, human
gtgtggggctccctgcaaca

SEQ ID NO: 212668 - DNA, 20 bp, human
gggagctggaccctggtact

SEQ ID NO: 212669 - DNA, 20 bp, human
gtgcacggtgcccagtacca

SEQ ID NO: 212670 - DNA, 20 bp, human
gttccagggcgcctaagtga

SEQ ID NO: 212671 - DNA, 20 bp, human
gtgcactcggcgaccctcag

SEQ ID NO: 212672 - DNA, 20 bp, human
ggcccggtggagcgcggcca

SEQ ID NO: 212673 - DNA, 20 bp, human
gagcagcagggcggatactt

SEQ ID NO: 212674 - DNA, 20 bp, human
gcgccctggccgcgctccac

SEQ ID NO: 212675 - DNA, 20 bp, human
gcgcggtgcccggtggagcg

SEQ ID NO: 212676 - DNA, 20 bp, human
gcgcgcgcgcaggcctactc

SEQ ID NO: 212677 - DNA, 20 bp, human
gggcaggccacgcccagagt

SEQ ID NO: 212678 - DNA, 20 bp, human
gcgcaggcctactctgggcg

SEQ ID NO: 212679 - DNA, 20 bp, human
gccggccaagggtgttaagc

SEQ ID NO: 212680 - DNA, 20 bp, human
gcgagcctgcttaacaccct

SEQ ID NO: 212681 - DNA, 20 bp, human
gccgctgcgtgtttttttca

SEQ ID NO: 212682 - DNA, 20 bp, human
ggcgcgcggcctcccacttc

SEQ ID NO: 212683 - DNA, 20 bp, human
gaggctgtcaagggattaaa

SEQ ID NO: 212684 - DNA, 20 bp, human
ggccccctgtctgcgacgag

SEQ ID NO: 212685 - DNA, 20 bp, human
gtgcgccacgcctgcctttc

SEQ ID NO: 212686 - DNA, 20 bp, human
gtgagtctggccagcgggtc

SEQ ID NO: 212687 - DNA, 20 bp, human
gccgagaagtgagtgggcga

SEQ ID NO: 212688 - DNA, 20 bp, human
gacgctccggagccgtcgcc

SEQ ID NO: 212689 - DNA, 20 bp, human
gctggtgcagagcttgagtc

SEQ ID NO: 212690 - DNA, 20 bp, human
gtcgccagggtggtaatacc

SEQ ID NO: 212691 - DNA, 20 bp, human
gaccaccctggcgacggctc

SEQ ID NO: 212692 - DNA, 20 bp, human
gagcaccggaggtggaagac

SEQ ID NO: 212693 - DNA, 20 bp, human
gccggccagccattaatatc

SEQ ID NO: 212694 - DNA, 20 bp, human
gtagcaagagcctgacccgc

SEQ ID NO: 212695 - DNA, 20 bp, human
ggccagcccgagaagtgagt

SEQ ID NO: 212696 - DNA, 20 bp, human
ggggcgggtggtcacgtctc

SEQ ID NO: 212697 - DNA, 20 bp, human
gggcggagatgctgcctcgt

SEQ ID NO: 212698 - DNA, 20 bp, human
gtcagccttggggacgccgg

SEQ ID NO: 212699 - DNA, 20 bp, human
gcgcccacccggaggatctt

SEQ ID NO: 212700 - DNA, 20 bp, human
gatctccgccggcgtcccca

SEQ ID NO: 212701 - DNA, 20 bp, human
ggggactggggccccatgcg

SEQ ID NO: 212702 - DNA, 20 bp, human
gagtgggcgcgtccgtcagg

SEQ ID NO: 212703 - DNA, 20 bp, human
gaggctgggcctaaaaagtt

SEQ ID NO: 212704 - DNA, 20 bp, human
gtggagcgcgacttgctgaa

SEQ ID NO: 212705 - DNA, 20 bp, human
gatgctgcctcgtggggtct

SEQ ID NO: 212706 - DNA, 20 bp, human
gtctgaactctggccaggaa

SEQ ID NO: 212707 - DNA, 20 bp, human
gctcggcggaaaccggcacc

SEQ ID NO: 212708 - DNA, 20 bp, human
gtggccaggaaggggcgcga

SEQ ID NO: 212709 - DNA, 20 bp, human
ggccgcccgcgactcgggtt

SEQ ID NO: 212710 - DNA, 20 bp, human
gccgcctcggaaagcccccg

SEQ ID NO: 212711 - DNA, 20 bp, human
gaatccccggggcgcttggc

SEQ ID NO: 212712 - DNA, 20 bp, human
gtggaggccggggaatcccc

SEQ ID NO: 212713 - DNA, 20 bp, human
gctccgccggcccgcgggat

SEQ ID NO: 212714 - DNA, 20 bp, human
gctctctcgagcgcggggac

SEQ ID NO: 212715 - DNA, 20 bp, human
gggaccgcgggggctttccg

SEQ ID NO: 212716 - DNA, 20 bp, human
gcggctgagaaaaggaagtc

SEQ ID NO: 212717 - DNA, 20 bp, human
gagtcccctaaggaacactt

SEQ ID NO: 212718 - DNA, 20 bp, human
gggaacacttaggtttgttg

SEQ ID NO: 212719 - DNA, 20 bp, human
ggtccctgtctgggtcgcgg

SEQ ID NO: 212720 - DNA, 20 bp, human
ggtcgcggaggagtccccta

SEQ ID NO: 212721 - DNA, 20 bp, human
gaaacctaagtgttccttag

SEQ ID NO: 212722 - DNA, 20 bp, human
gacaccaagtgcggagaatg

SEQ ID NO: 212723 - DNA, 20 bp, human
ggcccccacccgcagtgact

SEQ ID NO: 212724 - DNA, 20 bp, human
gagcctagtcactgcgggtg

SEQ ID NO: 212725 - DNA, 20 bp, human
gctcctccgcgacccagaca

SEQ ID NO: 212726 - DNA, 20 bp, human
gtggccggggtgaacaagtt

SEQ ID NO: 212727 - DNA, 20 bp, human
ggtactgggcttcctcaagt

SEQ ID NO: 212728 - DNA, 20 bp, human
gttgggctccgctttgggga

SEQ ID NO: 212729 - DNA, 20 bp, human
gaaacggtagggagccagaa

SEQ ID NO: 212730 - DNA, 20 bp, human
gcagcaggtaaggcttgacc

SEQ ID NO: 212731 - DNA, 20 bp, human
gctcttcctaggcttcaaga

SEQ ID NO: 212732 - DNA, 20 bp, human
ggcccaggggagaaacggta

SEQ ID NO: 212733 - DNA, 20 bp, human
gaatgcaggagaagccgagg

SEQ ID NO: 212734 - DNA, 20 bp, human
gttcaagttggtcgcggctt

SEQ ID NO: 212735 - DNA, 20 bp, human
gccgagaaaactcaccaata

SEQ ID NO: 212736 - DNA, 20 bp, human
gcagcgaggcgcttccgctg

SEQ ID NO: 212737 - DNA, 20 bp, human
gtgggacttacggggacaga

SEQ ID NO: 212738 - DNA, 20 bp, human
gtccgctgggggtgacgcgt

SEQ ID NO: 212739 - DNA, 20 bp, human
ggacgggggtgggacttacg

SEQ ID NO: 212740 - DNA, 20 bp, human
ggtggccgaagcgggggacg

SEQ ID NO: 212741 - DNA, 20 bp, human
ggccgacgcgtcacccccag

SEQ ID NO: 212742 - DNA, 20 bp, human
ggcgacttggccaacaacag

SEQ ID NO: 212743 - DNA, 20 bp, human
gctggcccccctgggtccag

SEQ ID NO: 212744 - DNA, 20 bp, human
ggaggggtggaaggaccggt

SEQ ID NO: 212745 - DNA, 20 bp, human
ggctgcccgggcgtctggcg

SEQ ID NO: 212746 - DNA, 20 bp, human
gcgcagggaccgctccgcag

SEQ ID NO: 212747 - DNA, 20 bp, human
gggtgcgcctgctccgggat

SEQ ID NO: 212748 - DNA, 20 bp, human
ggcccacagccgctgcggag

SEQ ID NO: 212749 - DNA, 20 bp, human
ggttctgcccacagccgctg

SEQ ID NO: 212750 - DNA, 20 bp, human
gtgggcagaacccgttttca

SEQ ID NO: 212751 - DNA, 20 bp, human
gaccgctccgcagcggctgt

SEQ ID NO: 212752 - DNA, 20 bp, human
ggatcaccatccatgaaaac

SEQ ID NO: 212753 - DNA, 20 bp, human
ggggaaatggtgcgtctgag

SEQ ID NO: 212754 - DNA, 20 bp, human
gagctccagggcaccgatgg

SEQ ID NO: 212755 - DNA, 20 bp, human
ggagggccgcgtccggccgg

SEQ ID NO: 212756 - DNA, 20 bp, human
gccccaagagctagggtcga

SEQ ID NO: 212757 - DNA, 20 bp, human
ggggctcctagactccccga

SEQ ID NO: 212758 - DNA, 20 bp, human
gacacacgccctggaatctc

SEQ ID NO: 212759 - DNA, 20 bp, human
ggtcggagccccaagagcta

SEQ ID NO: 212760 - DNA, 20 bp, human
gcgtgtgtgaaggaaagccg

SEQ ID NO: 212761 - DNA, 20 bp, human
ggggccgcagagagaacaaa

SEQ ID NO: 212762 - DNA, 20 bp, human
gcctgctccgcgctcaccct

SEQ ID NO: 212763 - DNA, 20 bp, human
gcccctcgaccctagctctt

SEQ ID NO: 212764 - DNA, 20 bp, human
gacctgcaacgtcagacttt

SEQ ID NO: 212765 - DNA, 20 bp, human
ggactccccgagggtgagcg

SEQ ID NO: 212766 - DNA, 20 bp, human
gggctcgaggagagcctcta

SEQ ID NO: 212767 - DNA, 20 bp, human
ggaggggaaaaggccctagg

SEQ ID NO: 212768 - DNA, 20 bp, human
ggccccagggagcatcaaac

SEQ ID NO: 212769 - DNA, 20 bp, human
gccctaggaggcctggcaaa

SEQ ID NO: 212770 - DNA, 20 bp, human
ggaaaaggccctaggaggcc

SEQ ID NO: 212771 - DNA, 20 bp, human
gtggaggagttaggggagtt

SEQ ID NO: 212772 - DNA, 20 bp, human
gcccctccaagggcccctag

SEQ ID NO: 212773 - DNA, 20 bp, human
gaaggagaaaagggttcctg

SEQ ID NO: 212774 - DNA, 20 bp, human
gaacttgctggaggagttag

SEQ ID NO: 212775 - DNA, 20 bp, human
gtcagcacggggagtcccca

SEQ ID NO: 212776 - DNA, 20 bp, human
gcctgcccatcacaggactc

SEQ ID NO: 212777 - DNA, 20 bp, human
gtgtcgcccgagtcctgtga

SEQ ID NO: 212778 - DNA, 20 bp, human
ggtgtgaggaggggcaatcg

SEQ ID NO: 212779 - DNA, 20 bp, human
ggggggcgcactcagggccc

SEQ ID NO: 212780 - DNA, 20 bp, human
gccgcgcccaagggccccac

SEQ ID NO: 212781 - DNA, 20 bp, human
gaagggcagcgcagcctgtg

SEQ ID NO: 212782 - DNA, 20 bp, human
ggcctgcatgccactccgtg

SEQ ID NO: 212783 - DNA, 20 bp, human
gcgcagcctgtggggccctt

SEQ ID NO: 212784 - DNA, 20 bp, human
gtcctcacggagtggcatgc

SEQ ID NO: 212785 - DNA, 20 bp, human
gggcatgcaggcagcagcct

SEQ ID NO: 212786 - DNA, 20 bp, human
ggcggccggccagcgcccaa

SEQ ID NO: 212787 - DNA, 20 bp, human
ggtcgcccaagtcctatgat

SEQ ID NO: 212788 - DNA, 20 bp, human
ggcgcagcctgtgggccctt

SEQ ID NO: 212789 - DNA, 20 bp, human
gcgctggccggccgcagctc

SEQ ID NO: 212790 - DNA, 20 bp, human
ggtgtgaggaggggcaatcg

SEQ ID NO: 212791 - DNA, 20 bp, human
ggcctgcatgccactccgtg

SEQ ID NO: 212792 - DNA, 20 bp, human
gcctgcccatcataggactt

SEQ ID NO: 212793 - DNA, 20 bp, human
gggcatgcaggcagcagcct

SEQ ID NO: 212794 - DNA, 20 bp, human
gtaggacttgggcgacgggg

SEQ ID NO: 212795 - DNA, 20 bp, human
gatgatgggcaggtgtgagg

SEQ ID NO: 212796 - DNA, 20 bp, human
gcgtgcgcagggtaagtcag

SEQ ID NO: 212797 - DNA, 20 bp, human
gcacccgcggggccggacag

SEQ ID NO: 212798 - DNA, 20 bp, human
gcacgcgcgctgaggctccg

SEQ ID NO: 212799 - DNA, 20 bp, human
ggtaagtcagtgggcgtgag

SEQ ID NO: 212800 - DNA, 20 bp, human
gtccacagctggccaatcgg

SEQ ID NO: 212801 - DNA, 20 bp, human
ggacgcttagggagagtcta

SEQ ID NO: 212802 - DNA, 20 bp, human
gacggcgagcgcgaactcga

SEQ ID NO: 212803 - DNA, 20 bp, human
gcggccgggtccgctctccc

SEQ ID NO: 212804 - DNA, 20 bp, human
ggccgtggcggggctggaca

SEQ ID NO: 212805 - DNA, 20 bp, human
gtcagtgggcgtgagaggac

SEQ ID NO: 212806 - DNA, 20 bp, human
gcggcccggcggccctccag

SEQ ID NO: 212807 - DNA, 20 bp, human
gacgccgagcggccagatca

SEQ ID NO: 212808 - DNA, 20 bp, human
gagaaccaattgcaacggta

SEQ ID NO: 212809 - DNA, 20 bp, human
gcaattgcaacggtagggcg

SEQ ID NO: 212810 - DNA, 20 bp, human
gttggcgagaaggcgggact

SEQ ID NO: 212811 - DNA, 20 bp, human
ggctcgagaaccaattgcaa

SEQ ID NO: 212812 - DNA, 20 bp, human
ggggactagggcgacagccg

SEQ ID NO: 212813 - DNA, 20 bp, human
gctccgcgcgagggcgtcca

SEQ ID NO: 212814 - DNA, 20 bp, human
gcggccagatcagggacgcg

SEQ ID NO: 212815 - DNA, 20 bp, human
gccgccccgcgtccctgatc

SEQ ID NO: 212816 - DNA, 20 bp, human
gccggagccccgggtcggaa

SEQ ID NO: 212817 - DNA, 20 bp, human
gccccaccccgcagtttcaa

SEQ ID NO: 212818 - DNA, 20 bp, human
gggagggagcggaagtcccg

SEQ ID NO: 212819 - DNA, 20 bp, human
gtcccttgaaactgcggggt

SEQ ID NO: 212820 - DNA, 20 bp, human
gcctcctcccttgaaactgc

SEQ ID NO: 212821 - DNA, 20 bp, human
ggcggcccgctcccggccat

SEQ ID NO: 212822 - DNA, 20 bp, human
gaaaaatagtcaatgaatca

SEQ ID NO: 212823 - DNA, 20 bp, human
gaattcgtgcccagcaggat

SEQ ID NO: 212824 - DNA, 20 bp, human
gggtcggaacggaaaatatc

SEQ ID NO: 212825 - DNA, 20 bp, human
ggtcccccggagccggcctt

SEQ ID NO: 212826 - DNA, 20 bp, human
gagcgtgggccgtgaggaac

SEQ ID NO: 212827 - DNA, 20 bp, human
gaaagccatggaatagctga

SEQ ID NO: 212828 - DNA, 20 bp, human
ggacacaagtggaacccccc

SEQ ID NO: 212829 - DNA, 20 bp, human
gaggaaaccggaagtagcgt

SEQ ID NO: 212830 - DNA, 20 bp, human
gtcacggcccacgctacttc

SEQ ID NO: 212831 - DNA, 20 bp, human
ggggagggagggagtgtcga

SEQ ID NO: 212832 - DNA, 20 bp, human
gttcgtgtggacaaatcggg

SEQ ID NO: 212833 - DNA, 20 bp, human
gacgcagaatgcagtcctgg

SEQ ID NO: 212834 - DNA, 20 bp, human
gtccctcccaaggaccactg

SEQ ID NO: 212835 - DNA, 20 bp, human
gcctccgcctcagtggtcct

SEQ ID NO: 212836 - DNA, 20 bp, human
gaggctgtgagcagaagcta

SEQ ID NO: 212837 - DNA, 20 bp, human
ggtaagctgagtagtagaca

SEQ ID NO: 212838 - DNA, 20 bp, human
gacagggatcctatcatgga

SEQ ID NO: 212839 - DNA, 20 bp, human
gagctctcttctgtggaact

SEQ ID NO: 212840 - DNA, 20 bp, human
ggtagacagggatcctatca

SEQ ID NO: 212841 - DNA, 20 bp, human
gcacagggaacagtttcatt

SEQ ID NO: 212842 - DNA, 20 bp, human
gagggagcctgaacatacac

SEQ ID NO: 212843 - DNA, 20 bp, human
gagtgggtggtttttgagca

SEQ ID NO: 212844 - DNA, 20 bp, human
gtggagtgtcataacaagtt

SEQ ID NO: 212845 - DNA, 20 bp, human
gaacagtttcatttggctgg

SEQ ID NO: 212846 - DNA, 20 bp, human
gcccactggacttcttgtaa

SEQ ID NO: 212847 - DNA, 20 bp, human
ggttcaggttagagactatc

SEQ ID NO: 212848 - DNA, 20 bp, human
ggcaacatatcaatgttggt

SEQ ID NO: 212849 - DNA, 20 bp, human
gtcactgtagttcatagttc

SEQ ID NO: 212850 - DNA, 20 bp, human
gctggacttcttgtaagggt

SEQ ID NO: 212851 - DNA, 20 bp, human
gcagtgatgggtggtgttca

SEQ ID NO: 212852 - DNA, 20 bp, human
gtcaaagtttcagtgatggg

SEQ ID NO: 212853 - DNA, 20 bp, human
gggcccttaaatccctgaca

SEQ ID NO: 212854 - DNA, 20 bp, human
gagaatgagaacgtgagctc

SEQ ID NO: 212855 - DNA, 20 bp, human
gttattgaaccattatcagt

SEQ ID NO: 212856 - DNA, 20 bp, human
gagcgcgggaaggttattct

SEQ ID NO: 212857 - DNA, 20 bp, human
gttggttgttggcctgtctt

SEQ ID NO: 212858 - DNA, 20 bp, human
gtcctcctgcgccgcggttc

SEQ ID NO: 212859 - DNA, 20 bp, human
ggctgccggaaccgcggcgc

SEQ ID NO: 212860 - DNA, 20 bp, human
ggacaatgaccataaaccat

SEQ ID NO: 212861 - DNA, 20 bp, human
gggttcgaaagaaaccagca

SEQ ID NO: 212862 - DNA, 20 bp, human
gcacaagtgccaactacctt

SEQ ID NO: 212863 - DNA, 20 bp, human
gtcctggctgttttccactc

SEQ ID NO: 212864 - DNA, 20 bp, human
gtcccgcgctgccggaaccg

SEQ ID NO: 212865 - DNA, 20 bp, human
gcaccagcaaggagtgtttc

SEQ ID NO: 212866 - DNA, 20 bp, human
gtcaaggaggcggtgacggg

SEQ ID NO: 212867 - DNA, 20 bp, human
gtgctctgagtcagagactc

SEQ ID NO: 212868 - DNA, 20 bp, human
gaggtgggcggtcctcacgg

SEQ ID NO: 212869 - DNA, 20 bp, human
gagcagcccgagccaccgtg

SEQ ID NO: 212870 - DNA, 20 bp, human
gggaaagcctgctctgaatt

SEQ ID NO: 212871 - DNA, 20 bp, human
gtgaggaccgcccacctgca

SEQ ID NO: 212872 - DNA, 20 bp, human
gctgcagcgcgagaccgctc

SEQ ID NO: 212873 - DNA, 20 bp, human
ggcttcaaggaggcggtgac

SEQ ID NO: 212874 - DNA, 20 bp, human
gcgagaccgctctggcccag

SEQ ID NO: 212875 - DNA, 20 bp, human
gggggccagacaggggtagt

SEQ ID NO: 212876 - DNA, 20 bp, human
ggctaccgcacgcagtgagg

SEQ ID NO: 212877 - DNA, 20 bp, human
ggccgtaaacctgaattccg

SEQ ID NO: 212878 - DNA, 20 bp, human
gtggagctccagatgtggtg

SEQ ID NO: 212879 - DNA, 20 bp, human
gtagccaatgagagccgaac

SEQ ID NO: 212880 - DNA, 20 bp, human
gcccgccccctcactgcgtg

SEQ ID NO: 212881 - DNA, 20 bp, human
gtgaattccgcgggagagaa

SEQ ID NO: 212882 - DNA, 20 bp, human
ggccttgggtcgcgattgtg

SEQ ID NO: 212883 - DNA, 20 bp, human
gcggacgccgttctctcccg

SEQ ID NO: 212884 - DNA, 20 bp, human
gagtccagttcggctctcat

SEQ ID NO: 212885 - DNA, 20 bp, human
gggcggggaaagtagcggcg

SEQ ID NO: 212886 - DNA, 20 bp, human
gctgcgggagagcgcggtgg

SEQ ID NO: 212887 - DNA, 20 bp, human
ggccgcctgggacccgctgc

SEQ ID NO: 212888 - DNA, 20 bp, human
gcggcggggagacctgtctc

SEQ ID NO: 212889 - DNA, 20 bp, human
gtctccgcctcccctgagaa

SEQ ID NO: 212890 - DNA, 20 bp, human
gggcccagtggtgacgggga

SEQ ID NO: 212891 - DNA, 20 bp, human
gtcccgtgcctgggcgtgtg

SEQ ID NO: 212892 - DNA, 20 bp, human
gggagccggcgggcaaagaa

SEQ ID NO: 212893 - DNA, 20 bp, human
gatgctgcgggagagcgcgg

SEQ ID NO: 212894 - DNA, 20 bp, human
ggccggcagcgggtcccagg

SEQ ID NO: 212895 - DNA, 20 bp, human
gtgggggccccgcctttctc

SEQ ID NO: 212896 - DNA, 20 bp, human
gggggtgtggaatcgctgac

SEQ ID NO: 212897 - DNA, 20 bp, human
gcgcgcgagttcgggggtgc

SEQ ID NO: 212898 - DNA, 20 bp, human
gagccggcgcgcgagttcgg

SEQ ID NO: 212899 - DNA, 20 bp, human
ggccggggtccgtttgcgcg

SEQ ID NO: 212900 - DNA, 20 bp, human
ggggaccaggacggccgcca

SEQ ID NO: 212901 - DNA, 20 bp, human
ggtcttgtggggaacccctt

SEQ ID NO: 212902 - DNA, 20 bp, human
gcggccagctgcgtgagccg

SEQ ID NO: 212903 - DNA, 20 bp, human
ggggaggagttagctcgggc

SEQ ID NO: 212904 - DNA, 20 bp, human
gctgacgggaggagttagct

SEQ ID NO: 212905 - DNA, 20 bp, human
gaccccttgggccgccagac

SEQ ID NO: 212906 - DNA, 20 bp, human
gagaggcagccgaaccctag

SEQ ID NO: 212907 - DNA, 20 bp, human
gaaccctagcggcctggaag

SEQ ID NO: 212908 - DNA, 20 bp, human
gggactgggaggttgagtgg

SEQ ID NO: 212909 - DNA, 20 bp, human
gaaaccgcggccagctggca

SEQ ID NO: 212910 - DNA, 20 bp, human
gtgcccgcggaggccatcgc

SEQ ID NO: 212911 - DNA, 20 bp, human
gccaccacgcacagaaatca

SEQ ID NO: 212912 - DNA, 20 bp, human
gcagaccgggagcagagcgg

SEQ ID NO: 212913 - DNA, 20 bp, human
gtctgcccctccagctagag

SEQ ID NO: 212914 - DNA, 20 bp, human
ggggctactcacacacccgc

SEQ ID NO: 212915 - DNA, 20 bp, human
ggcatggagccacttggagt

SEQ ID NO: 212916 - DNA, 20 bp, human
gtcccaaaaccaatcggaaa

SEQ ID NO: 212917 - DNA, 20 bp, human
gaaaaccaatcggaaaggga

SEQ ID NO: 212918 - DNA, 20 bp, human
ggggagggcacagtacaagc

SEQ ID NO: 212919 - DNA, 20 bp, human
gaagctggaagggtagtcat

SEQ ID NO: 212920 - DNA, 20 bp, human
ggccgccaggctcgcgatct

SEQ ID NO: 212921 - DNA, 20 bp, human
gggaccggtttaagctggaa

SEQ ID NO: 212922 - DNA, 20 bp, human
gcaagcaggataattggaca

SEQ ID NO: 212923 - DNA, 20 bp, human
gaaccacggcaaccgagcgg

SEQ ID NO: 212924 - DNA, 20 bp, human
gggctcaggccgagacagag

SEQ ID NO: 212925 - DNA, 20 bp, human
ggtcacttcaagtttgtaat

SEQ ID NO: 212926 - DNA, 20 bp, human
gctccctgtcaattggagaa

SEQ ID NO: 212927 - DNA, 20 bp, human
ggggaaaggcgtcatttgaa

SEQ ID NO: 212928 - DNA, 20 bp, human
gttggagaacggagctgaaa

SEQ ID NO: 212929 - DNA, 20 bp, human
gccccatcctccctgtcaat

SEQ ID NO: 212930 - DNA, 20 bp, human
gtgggtgagtgaggattcac

SEQ ID NO: 212931 - DNA, 20 bp, human
gttcaaggctcgagtgtctg

SEQ ID NO: 212932 - DNA, 20 bp, human
gctccgttctccaattgaca

SEQ ID NO: 212933 - DNA, 20 bp, human
ggcagagagtgccatctcaa

SEQ ID NO: 212934 - DNA, 20 bp, human
gcccgaatgtacctcattca

SEQ ID NO: 212935 - DNA, 20 bp, human
gctgctggccatgtgctgtg

SEQ ID NO: 212936 - DNA, 20 bp, human
ggaccctcgcgagagagagg

SEQ ID NO: 212937 - DNA, 20 bp, human
gtggcaccgcggaggccctg

SEQ ID NO: 212938 - DNA, 20 bp, human
ggagagaggtggcaccgcgg

SEQ ID NO: 212939 - DNA, 20 bp, human
ggtgccacctctctctcgcg

SEQ ID NO: 212940 - DNA, 20 bp, human
gagggaccctcgcgagagag

SEQ ID NO: 212941 - DNA, 20 bp, human
gaggaagggggcctatagta

SEQ ID NO: 212942 - DNA, 20 bp, human
gcggcgagccggggcacggc

SEQ ID NO: 212943 - DNA, 20 bp, human
gaggagagggctgcagatcg

SEQ ID NO: 212944 - DNA, 20 bp, human
ggagggtccctgccgtgccc

SEQ ID NO: 212945 - DNA, 20 bp, human
gccagcggcgagccggggca

SEQ ID NO: 212946 - DNA, 20 bp, human
gcgcggccgcgcgtcatccg

SEQ ID NO: 212947 - DNA, 20 bp, human
gcgcccatcggtctccctgg

SEQ ID NO: 212948 - DNA, 20 bp, human
gggcccgccttggggcgtca

SEQ ID NO: 212949 - DNA, 20 bp, human
gcgggggcggcgatgacgcg

SEQ ID NO: 212950 - DNA, 20 bp, human
ggggcggcggggccaactgg

SEQ ID NO: 212951 - DNA, 20 bp, human
ggccgcccgccgcatccccc

SEQ ID NO: 212952 - DNA, 20 bp, human
ggtcatccgcggctcgagtg

SEQ ID NO: 212953 - DNA, 20 bp, human
gccttggggcgtcagggcgg

SEQ ID NO: 212954 - DNA, 20 bp, human
gggccaccgcactcgagccg

SEQ ID NO: 212955 - DNA, 20 bp, human
gggggcctgggcgtcacagt

SEQ ID NO: 212956 - DNA, 20 bp, human
gggagagaaatcagaaataa

SEQ ID NO: 212957 - DNA, 20 bp, human
gcaaatgtcagcagttttta

SEQ ID NO: 212958 - DNA, 20 bp, human
gaaaaactgaacccataatg

SEQ ID NO: 212959 - DNA, 20 bp, human
ggtttcagctacacttgaac

SEQ ID NO: 212960 - DNA, 20 bp, human
gtatgggttcagtttttctc

SEQ ID NO: 212961 - DNA, 20 bp, human
gtgaaggcaatccatcagtt

SEQ ID NO: 212962 - DNA, 20 bp, human
gtcgagaattggatctgtga

SEQ ID NO: 212963 - DNA, 20 bp, human
gacgcttggttccaaactga

SEQ ID NO: 212964 - DNA, 20 bp, human
gggaacaaagtctggacgct

SEQ ID NO: 212965 - DNA, 20 bp, human
gtcttccctctccccattat

SEQ ID NO: 212966 - DNA, 20 bp, human
gtctccgcggatggcctcgt

SEQ ID NO: 212967 - DNA, 20 bp, human
gggtgcctaacggctctgct

SEQ ID NO: 212968 - DNA, 20 bp, human
gctgaggtgcacatgcgcgc

SEQ ID NO: 212969 - DNA, 20 bp, human
gctcccgcgaagggcctcgc

SEQ ID NO: 212970 - DNA, 20 bp, human
gccagtctccagctgctcgg

SEQ ID NO: 212971 - DNA, 20 bp, human
gccagccgcaacctccgtca

SEQ ID NO: 212972 - DNA, 20 bp, human
gctagcccagcagagccgtt

SEQ ID NO: 212973 - DNA, 20 bp, human
gactggagtgtccctgacgg

SEQ ID NO: 212974 - DNA, 20 bp, human
gctgaggtgcgcatgtgccc

SEQ ID NO: 212975 - DNA, 20 bp, human
gaccacgtggcgcccgcgaa

SEQ ID NO: 212976 - DNA, 20 bp, human
gggagcggactgcgccgtca

SEQ ID NO: 212977 - DNA, 20 bp, human
gctgacccccaccccttcgt

SEQ ID NO: 212978 - DNA, 20 bp, human
gtggcccggcccccgcgaga

SEQ ID NO: 212979 - DNA, 20 bp, human
gcgcttgctccttacttggg

SEQ ID NO: 212980 - DNA, 20 bp, human
gccgtcagggcagagacgga

SEQ ID NO: 212981 - DNA, 20 bp, human
gcctccgcccccaaccgagt

SEQ ID NO: 212982 - DNA, 20 bp, human
gaccgccgccgcattcccag

SEQ ID NO: 212983 - DNA, 20 bp, human
gtcgtggcccacgaaggggt

SEQ ID NO: 212984 - DNA, 20 bp, human
ggggccacatgcacccaacc

SEQ ID NO: 212985 - DNA, 20 bp, human
gataaagtcaggtatctagg

SEQ ID NO: 212986 - DNA, 20 bp, human
gaaggcagggccttcctaag

SEQ ID NO: 212987 - DNA, 20 bp, human
ggcacatcggggtacatcca

SEQ ID NO: 212988 - DNA, 20 bp, human
gggagggagtatgttggaca

SEQ ID NO: 212989 - DNA, 20 bp, human
gtggctgagtaaacagcgtc

SEQ ID NO: 212990 - DNA, 20 bp, human
gagcaggggagggagtatgt

SEQ ID NO: 212991 - DNA, 20 bp, human
gtagccagctgggacaggag

SEQ ID NO: 212992 - DNA, 20 bp, human
gtgcccctggaaggcctcac

SEQ ID NO: 212993 - DNA, 20 bp, human
gcaggagggcagccgaactg

SEQ ID NO: 212994 - DNA, 20 bp, human
gctcctggggaacaaaggcc

SEQ ID NO: 212995 - DNA, 20 bp, human
ggaacaaaggccaggcggtt

SEQ ID NO: 212996 - DNA, 20 bp, human
ggacgcgcgcggctggacgg

SEQ ID NO: 212997 - DNA, 20 bp, human
gtggacggcggcgcactggg

SEQ ID NO: 212998 - DNA, 20 bp, human
gggcccgggacccgcggcag

SEQ ID NO: 212999 - DNA, 20 bp, human
gtggcacggacactcgcggg

SEQ ID NO: 213000 - DNA, 20 bp, human
gtgcagcgaggggccccggt

SEQ ID NO: 213001 - DNA, 20 bp, human
gcctcggcggcggctcgctc

SEQ ID NO: 213002 - DNA, 20 bp, human
gcggctggacggcggcgcac

SEQ ID NO: 213003 - DNA, 20 bp, human
gctggacggcgccctgctcg

SEQ ID NO: 213004 - DNA, 20 bp, human
gccggcggcgcgggcctgga

SEQ ID NO: 213005 - DNA, 20 bp, human
gccggcctgcgtggtccctg

SEQ ID NO: 213006 - DNA, 20 bp, human
gccaccccaccagacaccta

SEQ ID NO: 213007 - DNA, 20 bp, human
gctccgtcacagtattatgt

SEQ ID NO: 213008 - DNA, 20 bp, human
gagagatgtgagacctgtgg

SEQ ID NO: 213009 - DNA, 20 bp, human
ggcttccctaggtgtctggt

SEQ ID NO: 213010 - DNA, 20 bp, human
gacagctgcttctgaatgtg

SEQ ID NO: 213011 - DNA, 20 bp, human
gtagggaagctgaagttgac

SEQ ID NO: 213012 - DNA, 20 bp, human
ggtgagacctgtgggggagt

SEQ ID NO: 213013 - DNA, 20 bp, human
gataagagatgtgagacctg

SEQ ID NO: 213014 - DNA, 20 bp, human
gataatactgtgacggaggt

SEQ ID NO: 213015 - DNA, 20 bp, human
gatttgaaagaacctgttaa

SEQ ID NO: 213016 - DNA, 20 bp, human
gccaaggttcatgatctaat

SEQ ID NO: 213017 - DNA, 20 bp, human
gccttcaaaagcagatctaa

SEQ ID NO: 213018 - DNA, 20 bp, human
gcccatccccatcacaagga

SEQ ID NO: 213019 - DNA, 20 bp, human
gatggctgttaaggtcgtta

SEQ ID NO: 213020 - DNA, 20 bp, human
ggtctgcgagcccctaggac

SEQ ID NO: 213021 - DNA, 20 bp, human
gacggccgtaactgccataa

SEQ ID NO: 213022 - DNA, 20 bp, human
gctggtaagtttctattcca

SEQ ID NO: 213023 - DNA, 20 bp, human
gccggccgttatggcagtta

SEQ ID NO: 213024 - DNA, 20 bp, human
gaagtcctaggtgagaatgc

SEQ ID NO: 213025 - DNA, 20 bp, human
gtcgttatggtccggtccta

SEQ ID NO: 213026 - DNA, 20 bp, human
gtgacccagcgctagtgtaa

SEQ ID NO: 213027 - DNA, 20 bp, human
ggggcgctggctagagacga

SEQ ID NO: 213028 - DNA, 20 bp, human
gagcgctgggtcaaagaagc

SEQ ID NO: 213029 - DNA, 20 bp, human
gctggctagagacgagggat

SEQ ID NO: 213030 - DNA, 20 bp, human
gggaacccttacactagcgc

SEQ ID NO: 213031 - DNA, 20 bp, human
gcctctagccccagaggagc

SEQ ID NO: 213032 - DNA, 20 bp, human
ggagagggttcaggataccg

SEQ ID NO: 213033 - DNA, 20 bp, human
gctagccccagaggagccgg

SEQ ID NO: 213034 - DNA, 20 bp, human
ggtgccccatgacagagctc

SEQ ID NO: 213035 - DNA, 20 bp, human
gaaagaagcaggtctcgccg

SEQ ID NO: 213036 - DNA, 20 bp, human
ggggcgcaccgctggacccg

SEQ ID NO: 213037 - DNA, 20 bp, human
ggtgcagcgcggcggccaat

SEQ ID NO: 213038 - DNA, 20 bp, human
gaaaggggcggggcgttgat

SEQ ID NO: 213039 - DNA, 20 bp, human
gaaaacttcggagaaacttg

SEQ ID NO: 213040 - DNA, 20 bp, human
gccgagctgcgggcgaagaa

SEQ ID NO: 213041 - DNA, 20 bp, human
gtgcaccattgttacgtcac

SEQ ID NO: 213042 - DNA, 20 bp, human
ggcggcgccctcccgggcta

SEQ ID NO: 213043 - DNA, 20 bp, human
gggcggggccgtggcgaaag

SEQ ID NO: 213044 - DNA, 20 bp, human
ggagaaacttgagggagcgc

SEQ ID NO: 213045 - DNA, 20 bp, human
gctcccggaacccgagctgc

SEQ ID NO: 213046 - DNA, 20 bp, human
gcgcccagctaggtgagcta

SEQ ID NO: 213047 - DNA, 20 bp, human
gtcgggaggcgcgtacaggt

SEQ ID NO: 213048 - DNA, 20 bp, human
gccccctagctcacctagct

SEQ ID NO: 213049 - DNA, 20 bp, human
gggaaggagcgcacttcggg

SEQ ID NO: 213050 - DNA, 20 bp, human
gcatggggacagcgccttgt

SEQ ID NO: 213051 - DNA, 20 bp, human
gtgacgcgctcgtggggaaa

SEQ ID NO: 213052 - DNA, 20 bp, human
ggctgtccccatgccccgag

SEQ ID NO: 213053 - DNA, 20 bp, human
ggacgcgtgacgccggatcc

SEQ ID NO: 213054 - DNA, 20 bp, human
ggacacgcctctcggggcat

SEQ ID NO: 213055 - DNA, 20 bp, human
gcagcaaagtccacctgcgc

SEQ ID NO: 213056 - DNA, 20 bp, human
gggagcgcagggaacacccg

SEQ ID NO: 213057 - DNA, 20 bp, human
gcgggtgcggcgtgaggggg

SEQ ID NO: 213058 - DNA, 20 bp, human
gctcgcctcggcttcctcgg

SEQ ID NO: 213059 - DNA, 20 bp, human
ggggcgcagcttttacaatg

SEQ ID NO: 213060 - DNA, 20 bp, human
gtcccgcgggtgcggcgtga

SEQ ID NO: 213061 - DNA, 20 bp, human
gttcctcggcggttacgcgg

SEQ ID NO: 213062 - DNA, 20 bp, human
gtacgcgggggcggcgtccg

SEQ ID NO: 213063 - DNA, 20 bp, human
gcccgcgggaacgaggcctt

SEQ ID NO: 213064 - DNA, 20 bp, human
gaagagggccctggattttg

SEQ ID NO: 213065 - DNA, 20 bp, human
gcgcccccgcgtaaccgccg

SEQ ID NO: 213066 - DNA, 20 bp, human
gcccggaagtagttgcggga

SEQ ID NO: 213067 - DNA, 20 bp, human
ggaagctgaccggaaggtcc

SEQ ID NO: 213068 - DNA, 20 bp, human
gagcgagccgggaagctgac

SEQ ID NO: 213069 - DNA, 20 bp, human
ggggcatcagacagcgagcc

SEQ ID NO: 213070 - DNA, 20 bp, human
ggaagctcgcgggtcggcac

SEQ ID NO: 213071 - DNA, 20 bp, human
gacaaacaccactagctcat

SEQ ID NO: 213072 - DNA, 20 bp, human
gcggcaccgggacagctccc

SEQ ID NO: 213073 - DNA, 20 bp, human
ggtcccgcacccggaccttc

SEQ ID NO: 213074 - DNA, 20 bp, human
ggcctctcctgcaatgggat

SEQ ID NO: 213075 - DNA, 20 bp, human
gacgcgcaaaggcccgaaag

SEQ ID NO: 213076 - DNA, 20 bp, human
gagctggttaattagtgaca

SEQ ID NO: 213077 - DNA, 20 bp, human
gtggcatgagggatctttaa

SEQ ID NO: 213078 - DNA, 20 bp, human
ggaaactggattatgataat

SEQ ID NO: 213079 - DNA, 20 bp, human
gagtttcttgagtgtaatat

SEQ ID NO: 213080 - DNA, 20 bp, human
gacaaggaagagtgtcacca

SEQ ID NO: 213081 - DNA, 20 bp, human
gtcttcaatagtcaacgtca

SEQ ID NO: 213082 - DNA, 20 bp, human
gatattggccatctaggcac

SEQ ID NO: 213083 - DNA, 20 bp, human
gattaaccagctctatagga

SEQ ID NO: 213084 - DNA, 20 bp, human
gagtgtaatattggccatct

SEQ ID NO: 213085 - DNA, 20 bp, human
gccttgttgccttccgtgaa

SEQ ID NO: 213086 - DNA, 20 bp, human
gtccctggactcccgaatac

SEQ ID NO: 213087 - DNA, 20 bp, human
ggactcccgaatacgggcac

SEQ ID NO: 213088 - DNA, 20 bp, human
gcacctccagtgcccgtatt

SEQ ID NO: 213089 - DNA, 20 bp, human
gggagtccagggacgctcag

SEQ ID NO: 213090 - DNA, 20 bp, human
ggggcgccgaagaggcaaaa

SEQ ID NO: 213091 - DNA, 20 bp, human
gggaacacgcgggtctgcgg

SEQ ID NO: 213092 - DNA, 20 bp, human
gcgggagcgcgctagggccg

SEQ ID NO: 213093 - DNA, 20 bp, human
ggtgtgccgggagcgcgcta

SEQ ID NO: 213094 - DNA, 20 bp, human
gtcccgaatacgggcactgg

SEQ ID NO: 213095 - DNA, 20 bp, human
ggcccgtattcgggagtcca

SEQ ID NO: 213096 - DNA, 20 bp, human
gaacccccacttagtgttgg

SEQ ID NO: 213097 - DNA, 20 bp, human
gaccagggagatgaatgtgt

SEQ ID NO: 213098 - DNA, 20 bp, human
gacaatacccacttgcacca

SEQ ID NO: 213099 - DNA, 20 bp, human
ggtgtaggcaaatcattctg

SEQ ID NO: 213100 - DNA, 20 bp, human
gggttgaaggagataacaat

SEQ ID NO: 213101 - DNA, 20 bp, human
gaacactaagtgggggttga

SEQ ID NO: 213102 - DNA, 20 bp, human
gtcatctccctggtgcaagt

SEQ ID NO: 213103 - DNA, 20 bp, human
gagtagcaacacaatatagt

SEQ ID NO: 213104 - DNA, 20 bp, human
gttccaccaacactaagtgg

SEQ ID NO: 213105 - DNA, 20 bp, human
gctcttgagctgaaacattc

SEQ ID NO: 213106 - DNA, 20 bp, human
gcccacgtagagcacactat

SEQ ID NO: 213107 - DNA, 20 bp, human
gacggggggcggagacacaa

SEQ ID NO: 213108 - DNA, 20 bp, human
ggggactaaagtctcgaggc

SEQ ID NO: 213109 - DNA, 20 bp, human
ggcgacccgggtgattccag

SEQ ID NO: 213110 - DNA, 20 bp, human
ggctggccaataagcacggg

SEQ ID NO: 213111 - DNA, 20 bp, human
gggacgggactaaagtctcg

SEQ ID NO: 213112 - DNA, 20 bp, human
ggagcagcgaagaggacaac

SEQ ID NO: 213113 - DNA, 20 bp, human
gagacacaacggccaattct

SEQ ID NO: 213114 - DNA, 20 bp, human
gcggccaattctcggcttca

SEQ ID NO: 213115 - DNA, 20 bp, human
gcaggctggccaataagcac

SEQ ID NO: 213116 - DNA, 20 bp, human
gcgggccgggtggttcccag

SEQ ID NO: 213117 - DNA, 20 bp, human
gggcgcttcctgctctccaa

SEQ ID NO: 213118 - DNA, 20 bp, human
gtcctgctctccaacggcgt

SEQ ID NO: 213119 - DNA, 20 bp, human
ggccacgtgaccgagcgcag

SEQ ID NO: 213120 - DNA, 20 bp, human
ggccgggtggttcccagggg

SEQ ID NO: 213121 - DNA, 20 bp, human
ggccaggaacccgacgccgt

SEQ ID NO: 213122 - DNA, 20 bp, human
gccaccccgcggcgagggct

SEQ ID NO: 213123 - DNA, 20 bp, human
gtccaacggcgtcgggttcc

SEQ ID NO: 213124 - DNA, 20 bp, human
ggggaacacccaaacgcggt

SEQ ID NO: 213125 - DNA, 20 bp, human
ggtgaccgagcgcaggggcg

SEQ ID NO: 213126 - DNA, 20 bp, human
gaaaacttggaggggcccgc

SEQ ID NO: 213127 - DNA, 20 bp, human
ggggaccagcagccgggtgg

SEQ ID NO: 213128 - DNA, 20 bp, human
gtgcccctttggatttttga

SEQ ID NO: 213129 - DNA, 20 bp, human
gtccaaaggggcactttccc

SEQ ID NO: 213130 - DNA, 20 bp, human
gggcccgcgggaccagcagc

SEQ ID NO: 213131 - DNA, 20 bp, human
gcataccgggtgtgaaaggg

SEQ ID NO: 213132 - DNA, 20 bp, human
gaaccctcaaaaatccaaag

SEQ ID NO: 213133 - DNA, 20 bp, human
gctccgcccgcctatggcag

SEQ ID NO: 213134 - DNA, 20 bp, human
gcggcccgcgcgctcgatgc

SEQ ID NO: 213135 - DNA, 20 bp, human
gggccggcccgcgcctggtc

SEQ ID NO: 213136 - DNA, 20 bp, human
gacgcggcggggcctagatg

SEQ ID NO: 213137 - DNA, 20 bp, human
gccaggcgacagcccaatga

SEQ ID NO: 213138 - DNA, 20 bp, human
gtcgcctggaacaggagacc

SEQ ID NO: 213139 - DNA, 20 bp, human
gtgggcggtagctccgggag

SEQ ID NO: 213140 - DNA, 20 bp, human
gcctcactgggcgatcgtag

SEQ ID NO: 213141 - DNA, 20 bp, human
ggaggcggggcctcactggg

SEQ ID NO: 213142 - DNA, 20 bp, human
ggagaccaggccgggagaaa

SEQ ID NO: 213143 - DNA, 20 bp, human
gtagatgcggtcacacgcag

SEQ ID NO: 213144 - DNA, 20 bp, human
gagggctgcctttttttctt

SEQ ID NO: 213145 - DNA, 20 bp, human
gtccgggaggggcggaactg

SEQ ID NO: 213146 - DNA, 20 bp, human
ggggagcggggcgtcgagaa

SEQ ID NO: 213147 - DNA, 20 bp, human
gccgcggccgggttgagtcc

SEQ ID NO: 213148 - DNA, 20 bp, human
gagaatggagcgcggtcccg

SEQ ID NO: 213149 - DNA, 20 bp, human
gaggttgtggggcgttgccc

SEQ ID NO: 213150 - DNA, 20 bp, human
gggaagaaggttttgctggc

SEQ ID NO: 213151 - DNA, 20 bp, human
gcgcggggctaattccatcg

SEQ ID NO: 213152 - DNA, 20 bp, human
ggtgtgtcctggactcaacc

SEQ ID NO: 213153 - DNA, 20 bp, human
ggtctcgcccctcagcccca

SEQ ID NO: 213154 - DNA, 20 bp, human
gcgccccagggctaactctt

SEQ ID NO: 213155 - DNA, 20 bp, human
gggacacactcgggtccgtg

SEQ ID NO: 213156 - DNA, 20 bp, human
gtggacgcgcgggggatgcg

SEQ ID NO: 213157 - DNA, 20 bp, human
gggtgggcgttgagcggggt

SEQ ID NO: 213158 - DNA, 20 bp, human
ggcgtccagtgccacagtga

SEQ ID NO: 213159 - DNA, 20 bp, human
gtccccttagcggctactct

SEQ ID NO: 213160 - DNA, 20 bp, human
gagcgtccggctccccttag

SEQ ID NO: 213161 - DNA, 20 bp, human
gtgggagcagaagactttac

SEQ ID NO: 213162 - DNA, 20 bp, human
ggaggggtgggcgttgagcg

SEQ ID NO: 213163 - DNA, 20 bp, human
ggggagggcggtctagcgtc

SEQ ID NO: 213164 - DNA, 20 bp, human
gccgccggtgtcgttgtcat

SEQ ID NO: 213165 - DNA, 20 bp, human
ggcgttgagcggggttggct

SEQ ID NO: 213166 - DNA, 20 bp, human
ggcaggggaggcatggtcgg

SEQ ID NO: 213167 - DNA, 20 bp, human
gccctccccaggtgcagggg

SEQ ID NO: 213168 - DNA, 20 bp, human
ggcgtgatgctctgagacgg

SEQ ID NO: 213169 - DNA, 20 bp, human
ggagggggaggaccagtcct

SEQ ID NO: 213170 - DNA, 20 bp, human
ggtctcagagcatcacgccc

SEQ ID NO: 213171 - DNA, 20 bp, human
gggagggtgggcactaggct

SEQ ID NO: 213172 - DNA, 20 bp, human
gcgaccaatcagcccagcca

SEQ ID NO: 213173 - DNA, 20 bp, human
ggtcctgccgctctcagaac

SEQ ID NO: 213174 - DNA, 20 bp, human
gagtctggaacaggactctc

SEQ ID NO: 213175 - DNA, 20 bp, human
gtcacactgacacggccccc

SEQ ID NO: 213176 - DNA, 20 bp, human
ggacggcttgagcggagagg

SEQ ID NO: 213177 - DNA, 20 bp, human
ggacctggggacggcttgag

SEQ ID NO: 213178 - DNA, 20 bp, human
ggggagatggcggtctccga

SEQ ID NO: 213179 - DNA, 20 bp, human
gtgggtggacccagtggaaa

SEQ ID NO: 213180 - DNA, 20 bp, human
gcgggaggctgcatgtccgg

SEQ ID NO: 213181 - DNA, 20 bp, human
gggacgggaggctgcatgtc

SEQ ID NO: 213182 - DNA, 20 bp, human
ggggaaagaggcgtggaaac

SEQ ID NO: 213183 - DNA, 20 bp, human
ggccccccggccctgttggc

SEQ ID NO: 213184 - DNA, 20 bp, human
gccggccggcgccccaccct

SEQ ID NO: 213185 - DNA, 20 bp, human
ggccgagcaggcacagggac

SEQ ID NO: 213186 - DNA, 20 bp, human
gcgcgggggaactagctgga

SEQ ID NO: 213187 - DNA, 20 bp, human
gaggcgggaacacgtgagtg

SEQ ID NO: 213188 - DNA, 20 bp, human
ggggaactagctggagggca

SEQ ID NO: 213189 - DNA, 20 bp, human
ggggcgggacggacgggagt

SEQ ID NO: 213190 - DNA, 20 bp, human
ggaggcgcgcagaaggaagt

SEQ ID NO: 213191 - DNA, 20 bp, human
gtcggcaggcgagactgcag

SEQ ID NO: 213192 - DNA, 20 bp, human
gcgcgcagaaggaagtcggc

SEQ ID NO: 213193 - DNA, 20 bp, human
gaactagctggagggcaagg

SEQ ID NO: 213194 - DNA, 20 bp, human
ggtgagtgcgggagtggact

SEQ ID NO: 213195 - DNA, 20 bp, human
ggtagtgcgatcctgcgcgc

SEQ ID NO: 213196 - DNA, 20 bp, human
ggaactgcagcactgcgggg

SEQ ID NO: 213197 - DNA, 20 bp, human
gcgcctcgcgctgacccctc

SEQ ID NO: 213198 - DNA, 20 bp, human
gggaaggcctgggcgccgga

SEQ ID NO: 213199 - DNA, 20 bp, human
gcagcaacgtgaggcccggg

SEQ ID NO: 213200 - DNA, 20 bp, human
gggggcatcgggggctcgta

SEQ ID NO: 213201 - DNA, 20 bp, human
gttcgccctgctcaacaact

SEQ ID NO: 213202 - DNA, 20 bp, human
gagcggcgcgagcggacagg

SEQ ID NO: 213203 - DNA, 20 bp, human
gaaccagatgccgatgtcct

SEQ ID NO: 213204 - DNA, 20 bp, human
gaagagcggcgcgagcggac

SEQ ID NO: 213205 - DNA, 20 bp, human
ggaagtcggacgagaaggcc

SEQ ID NO: 213206 - DNA, 20 bp, human
ggggccgggaaggagaatcg

SEQ ID NO: 213207 - DNA, 20 bp, human
gcccgatgcacgtcactcta

SEQ ID NO: 213208 - DNA, 20 bp, human
gcagcagcagggagcgaggt

SEQ ID NO: 213209 - DNA, 20 bp, human
ggagaatcgaggttcggctc

SEQ ID NO: 213210 - DNA, 20 bp, human
ggggacgagaagcagcgctc

SEQ ID NO: 213211 - DNA, 20 bp, human
ggcgaaccaaagaactaggc

SEQ ID NO: 213212 - DNA, 20 bp, human
gagacgcgaaccaaagaact

SEQ ID NO: 213213 - DNA, 20 bp, human
ggggaaggagaatcgaggtt

SEQ ID NO: 213214 - DNA, 20 bp, human
gtatcacagccctactgggg

SEQ ID NO: 213215 - DNA, 20 bp, human
ggacgtgcatcgggccggga

SEQ ID NO: 213216 - DNA, 20 bp, human
gaggggctggggtactctcc

SEQ ID NO: 213217 - DNA, 20 bp, human
gcggggcggagccagcatcc

SEQ ID NO: 213218 - DNA, 20 bp, human
gagcccagatggcgggtcag

SEQ ID NO: 213219 - DNA, 20 bp, human
gcagcctaggaattcccctc

SEQ ID NO: 213220 - DNA, 20 bp, human
gttggtgctggctctgtcag

SEQ ID NO: 213221 - DNA, 20 bp, human
gggcccctgacccgccatct

SEQ ID NO: 213222 - DNA, 20 bp, human
ggccgcgcctgggtgtagtc

SEQ ID NO: 213223 - DNA, 20 bp, human
gcgcctgggtgtagtcgggg

SEQ ID NO: 213224 - DNA, 20 bp, human
gggcagctgcaggacgctgg

SEQ ID NO: 213225 - DNA, 20 bp, human
gactctcctggcctggatgc

SEQ ID NO: 213226 - DNA, 20 bp, human
gaggctcggccatttggtag

SEQ ID NO: 213227 - DNA, 20 bp, human
gccaaatggccgagcctccc

SEQ ID NO: 213228 - DNA, 20 bp, human
ggagcgcggcggctgctctg

SEQ ID NO: 213229 - DNA, 20 bp, human
gcaacagccaatggcagtgg

SEQ ID NO: 213230 - DNA, 20 bp, human
gacccctttagatttcgggg

SEQ ID NO: 213231 - DNA, 20 bp, human
gaatcgccgccgagggtctc

SEQ ID NO: 213232 - DNA, 20 bp, human
gctgctctgtggctgagtga

SEQ ID NO: 213233 - DNA, 20 bp, human
gctccggcaccactaccaaa

SEQ ID NO: 213234 - DNA, 20 bp, human
gggggaagggaccaatgggc

SEQ ID NO: 213235 - DNA, 20 bp, human
gggggtgggcggaatggcgg

SEQ ID NO: 213236 - DNA, 20 bp, human
gaaaggcgcagcccgaatag

SEQ ID NO: 213237 - DNA, 20 bp, human
ggctccgggcgcgacgacgt

SEQ ID NO: 213238 - DNA, 20 bp, human
ggccgcggctgcaccaaggc

SEQ ID NO: 213239 - DNA, 20 bp, human
ggctgcaccaaggcggggcg

SEQ ID NO: 213240 - DNA, 20 bp, human
gtctccgattgcacgtgggg

SEQ ID NO: 213241 - DNA, 20 bp, human
gggggcggggagactcgcgg

SEQ ID NO: 213242 - DNA, 20 bp, human
ggatgtaagacctttctcgt

SEQ ID NO: 213243 - DNA, 20 bp, human
gaggaagtcgctcctctatt

SEQ ID NO: 213244 - DNA, 20 bp, human
gacgtggggccggaggtaga

SEQ ID NO: 213245 - DNA, 20 bp, human
gccccgccttggtgcagccg

SEQ ID NO: 213246 - DNA, 20 bp, human
ggtccgtgagatatatacta

SEQ ID NO: 213247 - DNA, 20 bp, human
gctaaggttttggagcaact

SEQ ID NO: 213248 - DNA, 20 bp, human
gttacatcagatagatgtat

SEQ ID NO: 213249 - DNA, 20 bp, human
gtaagaatgatctagttagg

SEQ ID NO: 213250 - DNA, 20 bp, human
gcgccatagtatatatctca

SEQ ID NO: 213251 - DNA, 20 bp, human
ggatttaggatacactgtaa

SEQ ID NO: 213252 - DNA, 20 bp, human
gtgagcattctggctgctgc

SEQ ID NO: 213253 - DNA, 20 bp, human
gatcagctctattaaccttt

SEQ ID NO: 213254 - DNA, 20 bp, human
ggaaatttttcacctctcct

SEQ ID NO: 213255 - DNA, 20 bp, human
gatcacttctcatcatctct

SEQ ID NO: 213256 - DNA, 20 bp, human
gtctctgagcagccattgaa

SEQ ID NO: 213257 - DNA, 20 bp, human
gccagaaattccgtacctat

SEQ ID NO: 213258 - DNA, 20 bp, human
gtgatcgtagccaataggta

SEQ ID NO: 213259 - DNA, 20 bp, human
gaaaggtctatcagtcttca

SEQ ID NO: 213260 - DNA, 20 bp, human
gtccaggagggtgtacgtcc

SEQ ID NO: 213261 - DNA, 20 bp, human
gagactgagcctccatgaca

SEQ ID NO: 213262 - DNA, 20 bp, human
ggcgcttgatcgtagccaat

SEQ ID NO: 213263 - DNA, 20 bp, human
gacttcattgggctaggtaa

SEQ ID NO: 213264 - DNA, 20 bp, human
gtgggtggagtgtaggccag

SEQ ID NO: 213265 - DNA, 20 bp, human
gacccacctcccaaacgtgt

SEQ ID NO: 213266 - DNA, 20 bp, human
ggctccctgcgggacactca

SEQ ID NO: 213267 - DNA, 20 bp, human
ggcgacagggaccccgtcgg

SEQ ID NO: 213268 - DNA, 20 bp, human
gggcccgctaggggtgaatc

SEQ ID NO: 213269 - DNA, 20 bp, human
gagggagccttgtgcatccg

SEQ ID NO: 213270 - DNA, 20 bp, human
gcccgccggccacatctgga

SEQ ID NO: 213271 - DNA, 20 bp, human
gtgtggccggcgggtcccgc

SEQ ID NO: 213272 - DNA, 20 bp, human
gggctcctccgctcctccga

SEQ ID NO: 213273 - DNA, 20 bp, human
ggcggcgacagggaccccgt

SEQ ID NO: 213274 - DNA, 20 bp, human
gggcagatgccgtccagatg

SEQ ID NO: 213275 - DNA, 20 bp, human
gccgctaggggtgaatcggg

SEQ ID NO: 213276 - DNA, 20 bp, human
gatcaggcccgagggctgaa

SEQ ID NO: 213277 - DNA, 20 bp, human
gggcctgggatcaggcccga

SEQ ID NO: 213278 - DNA, 20 bp, human
ggcaaacagtgtctggttac

SEQ ID NO: 213279 - DNA, 20 bp, human
gaggcgaaggtcactggact

SEQ ID NO: 213280 - DNA, 20 bp, human
ggcccagtgggcaaagcaag

SEQ ID NO: 213281 - DNA, 20 bp, human
gaggaacggtgtgtggagct

SEQ ID NO: 213282 - DNA, 20 bp, human
gtacaggctgcaggcggcct

SEQ ID NO: 213283 - DNA, 20 bp, human
gtggcaagaagcggcaggga

SEQ ID NO: 213284 - DNA, 20 bp, human
ggccgggcttatatccccaa

SEQ ID NO: 213285 - DNA, 20 bp, human
gtccaacaggcgaaggtcac

SEQ ID NO: 213286 - DNA, 20 bp, human
gaaagcacgcgtgggacccg

SEQ ID NO: 213287 - DNA, 20 bp, human
ggggacccgcgggagtgcgt

SEQ ID NO: 213288 - DNA, 20 bp, human
ggcccccgacgcactcccgc

SEQ ID NO: 213289 - DNA, 20 bp, human
ggccaccttgtggacaaagg

SEQ ID NO: 213290 - DNA, 20 bp, human
gcccccctttcgcgttctta

SEQ ID NO: 213291 - DNA, 20 bp, human
gaggcggcgaaagcacgcgt

SEQ ID NO: 213292 - DNA, 20 bp, human
gaaaagatgcaggataggga

SEQ ID NO: 213293 - DNA, 20 bp, human
gcgaaacccagaaacagcat

SEQ ID NO: 213294 - DNA, 20 bp, human
gtccccgtaagaacgcgaaa

SEQ ID NO: 213295 - DNA, 20 bp, human
ggagccggagtcaccgtggt

SEQ ID NO: 213296 - DNA, 20 bp, human
gagtgtgcgcctggggacga

SEQ ID NO: 213297 - DNA, 20 bp, human
gctggagagaagccacgccg

SEQ ID NO: 213298 - DNA, 20 bp, human
gtggccctgggactcccggc

SEQ ID NO: 213299 - DNA, 20 bp, human
gcgggctcctgccctcggcg

SEQ ID NO: 213300 - DNA, 20 bp, human
ggcttgccagatttgggaaa

SEQ ID NO: 213301 - DNA, 20 bp, human
gctgacaggccgtccccttt

SEQ ID NO: 213302 - DNA, 20 bp, human
gccaagactaaggattccat

SEQ ID NO: 213303 - DNA, 20 bp, human
gagcccagacccggcccgag

SEQ ID NO: 213304 - DNA, 20 bp, human
gaggaggccgtcacctccca

SEQ ID NO: 213305 - DNA, 20 bp, human
gtagtcatcttcaactcggc

SEQ ID NO: 213306 - DNA, 20 bp, human
ggcaaccagaagttagtaat

SEQ ID NO: 213307 - DNA, 20 bp, human
gtgtgccaatcactggtatt

SEQ ID NO: 213308 - DNA, 20 bp, human
gaattcaactggcattacaa

SEQ ID NO: 213309 - DNA, 20 bp, human
gaatcactggtattaggatt

SEQ ID NO: 213310 - DNA, 20 bp, human
ggcagccaattactaacttc

SEQ ID NO: 213311 - DNA, 20 bp, human
gcacacttttgtagttaaat

SEQ ID NO: 213312 - DNA, 20 bp, human
gacaaaagtgtgccaatcac

SEQ ID NO: 213313 - DNA, 20 bp, human
ggcaaaataaatatcccatc

SEQ ID NO: 213314 - DNA, 20 bp, human
gtgattttataggattttaa

SEQ ID NO: 213315 - DNA, 20 bp, human
gacagaataataagtgatgg

SEQ ID NO: 213316 - DNA, 20 bp, human
gcaactggggattaggttaa

SEQ ID NO: 213317 - DNA, 20 bp, human
gtgaaaaagctgatgactta

SEQ ID NO: 213318 - DNA, 20 bp, human
gcaacatacaactggggatt

SEQ ID NO: 213319 - DNA, 20 bp, human
gttaaatcaacatacaactg

SEQ ID NO: 213320 - DNA, 20 bp, human
gaatttaagataggaaacta

SEQ ID NO: 213321 - DNA, 20 bp, human
gttatcagtcataggtgagt

SEQ ID NO: 213322 - DNA, 20 bp, human
gttacatttctttcattagt

SEQ ID NO: 213323 - DNA, 20 bp, human
gatacttagttatcagtcat

SEQ ID NO: 213324 - DNA, 20 bp, human
gtttcctatcttaaattgct

SEQ ID NO: 213325 - DNA, 20 bp, human
gaaataatgtatttaggggc

SEQ ID NO: 213326 - DNA, 20 bp, human
ggcgccgcaggggttagggg

SEQ ID NO: 213327 - DNA, 20 bp, human
gcggccccgcccccaagatg

SEQ ID NO: 213328 - DNA, 20 bp, human
ggagctgctccaggaagtct

SEQ ID NO: 213329 - DNA, 20 bp, human
gaggtcacgcacagtatgtg

SEQ ID NO: 213330 - DNA, 20 bp, human
gaggaagtctcgggctccgg

SEQ ID NO: 213331 - DNA, 20 bp, human
gactgggcgccgcaggggtt

SEQ ID NO: 213332 - DNA, 20 bp, human
ggagcagctccgcagccgga

SEQ ID NO: 213333 - DNA, 20 bp, human
ggcgaggagcagcagccttc

SEQ ID NO: 213334 - DNA, 20 bp, human
gaggggttaggggcggcaga

SEQ ID NO: 213335 - DNA, 20 bp, human
gagcagcagccttccggctg

SEQ ID NO: 213336 - DNA, 20 bp, human
gtgaatacattgttggggat

SEQ ID NO: 213337 - DNA, 20 bp, human
gactcacggaaaacctctgg

SEQ ID NO: 213338 - DNA, 20 bp, human
gaagagatattatgtccggg

SEQ ID NO: 213339 - DNA, 20 bp, human
gaacaattcagaagtgaggc

SEQ ID NO: 213340 - DNA, 20 bp, human
gcatgggtaccaaggaaacc

SEQ ID NO: 213341 - DNA, 20 bp, human
gaggactcacggaaaacctc

SEQ ID NO: 213342 - DNA, 20 bp, human
gaatatgcatggaccacttc

SEQ ID NO: 213343 - DNA, 20 bp, human
gtgcatggaccacttcagga

SEQ ID NO: 213344 - DNA, 20 bp, human
gtaaaggtcctgtgaaaagt

SEQ ID NO: 213345 - DNA, 20 bp, human
gacctctgggggaaggaaaa

SEQ ID NO: 213346 - DNA, 20 bp, human
ggagccgcgccacgcgggag

SEQ ID NO: 213347 - DNA, 20 bp, human
ggtgactcaccccggcccgc

SEQ ID NO: 213348 - DNA, 20 bp, human
ggcggctcgggagcgttcca

SEQ ID NO: 213349 - DNA, 20 bp, human
ggggccgctcccgcgtggcg

SEQ ID NO: 213350 - DNA, 20 bp, human
gtcggccgggctttctcgga

SEQ ID NO: 213351 - DNA, 20 bp, human
gggtgagtcacccctgactt

SEQ ID NO: 213352 - DNA, 20 bp, human
gctcccgagccgcgccacgc

SEQ ID NO: 213353 - DNA, 20 bp, human
gttccagggcgcggtccctg

SEQ ID NO: 213354 - DNA, 20 bp, human
gccgctcccaccccaagtca

SEQ ID NO: 213355 - DNA, 20 bp, human
gcgctggggccgctcccgcg

SEQ ID NO: 213356 - DNA, 20 bp, human
gaccggaaaactgtctgcta

SEQ ID NO: 213357 - DNA, 20 bp, human
ggccaagaaccacccgtttc

SEQ ID NO: 213358 - DNA, 20 bp, human
gcaccttgcaaacgagaaac

SEQ ID NO: 213359 - DNA, 20 bp, human
gcgttgaacttagcaagcgc

SEQ ID NO: 213360 - DNA, 20 bp, human
gctcgtttgcaaggtggtta

SEQ ID NO: 213361 - DNA, 20 bp, human
gtccgttttggcgccgtaaa

SEQ ID NO: 213362 - DNA, 20 bp, human
gcaaacaggttgtttaggtg

SEQ ID NO: 213363 - DNA, 20 bp, human
gcgccagtttctcgtttgca

SEQ ID NO: 213364 - DNA, 20 bp, human
gaccctttacggcgccaaaa

SEQ ID NO: 213365 - DNA, 20 bp, human
gtctttagcagcacccttta

SEQ ID NO: 213366 - DNA, 20 bp, human
ggaagcttagagaccggtga

SEQ ID NO: 213367 - DNA, 20 bp, human
gagctggggcgcctgtgtac

SEQ ID NO: 213368 - DNA, 20 bp, human
gggtggggaagcttagagac

SEQ ID NO: 213369 - DNA, 20 bp, human
gtgagggcgtagggagaaaa

SEQ ID NO: 213370 - DNA, 20 bp, human
ggggctctatccctgtacac

SEQ ID NO: 213371 - DNA, 20 bp, human
ggcctggggccgcaatcagg

SEQ ID NO: 213372 - DNA, 20 bp, human
ggagagcgaaatgagggcgt

SEQ ID NO: 213373 - DNA, 20 bp, human
ggcgcggcttccctttcccg

SEQ ID NO: 213374 - DNA, 20 bp, human
ggaaaccgagagcgaaatga

SEQ ID NO: 213375 - DNA, 20 bp, human
gatagagcccggcggcagca

SEQ ID NO: 213376 - DNA, 20 bp, human
gaccggaaaatccctctcta

SEQ ID NO: 213377 - DNA, 20 bp, human
gagcggggctggcgatactg

SEQ ID NO: 213378 - DNA, 20 bp, human
gacggatccgccccactgtg

SEQ ID NO: 213379 - DNA, 20 bp, human
ggaggaacaaccaggaactt

SEQ ID NO: 213380 - DNA, 20 bp, human
gcccctagagagggattttc

SEQ ID NO: 213381 - DNA, 20 bp, human
gagggattttccggtctcgt

SEQ ID NO: 213382 - DNA, 20 bp, human
gcaggagctctcggagaggc

SEQ ID NO: 213383 - DNA, 20 bp, human
gcccgggctcggccctccga

SEQ ID NO: 213384 - DNA, 20 bp, human
gcagtggggcggatccgtcc

SEQ ID NO: 213385 - DNA, 20 bp, human
ggctcctggcgcggccgtcc

SEQ ID NO: 213386 - DNA, 20 bp, human
ggcgccgcgggagaccaact

SEQ ID NO: 213387 - DNA, 20 bp, human
gcgtcccagttggtctcccg

SEQ ID NO: 213388 - DNA, 20 bp, human
gtggtctcgcgggcctgggt

SEQ ID NO: 213389 - DNA, 20 bp, human
ggacgagccgcgacccacgc

SEQ ID NO: 213390 - DNA, 20 bp, human
gactgtcccgctggtctcgc

SEQ ID NO: 213391 - DNA, 20 bp, human
gcacgcaggcgcgctgaggc

SEQ ID NO: 213392 - DNA, 20 bp, human
gtgtcctcgcgccgcgggaa

SEQ ID NO: 213393 - DNA, 20 bp, human
gcgaggacaagaggtctccg

SEQ ID NO: 213394 - DNA, 20 bp, human
gggtcgcggctcgtcccagt

SEQ ID NO: 213395 - DNA, 20 bp, human
ggcggcgcggactgtcccgc

SEQ ID NO: 213396 - DNA, 20 bp, human
gcctctgcgcgccacgtgtc

SEQ ID NO: 213397 - DNA, 20 bp, human
gagctaaggagctagagggg

SEQ ID NO: 213398 - DNA, 20 bp, human
gggaccgggaggacagccgt

SEQ ID NO: 213399 - DNA, 20 bp, human
gaagagctaaggagctagag

SEQ ID NO: 213400 - DNA, 20 bp, human
ggggctccgagccggacacg

SEQ ID NO: 213401 - DNA, 20 bp, human
gttctcccggcaagcccctc

SEQ ID NO: 213402 - DNA, 20 bp, human
gtggcgcgcagaggccaatc

SEQ ID NO: 213403 - DNA, 20 bp, human
gacagccgtgggctccgagc

SEQ ID NO: 213404 - DNA, 20 bp, human
gtctaagattccaagagcta

SEQ ID NO: 213405 - DNA, 20 bp, human
gtgagactgagaaggattag

SEQ ID NO: 213406 - DNA, 20 bp, human
gaacacccccggagccggag

SEQ ID NO: 213407 - DNA, 20 bp, human
gagtggcgggcggtagagaa

SEQ ID NO: 213408 - DNA, 20 bp, human
ggcccctaggcgccacctga

SEQ ID NO: 213409 - DNA, 20 bp, human
gcgcctaggggcgggactga

SEQ ID NO: 213410 - DNA, 20 bp, human
gtccctcaggtggcgcctag

SEQ ID NO: 213411 - DNA, 20 bp, human
gaggactgctgcaacttcct

SEQ ID NO: 213412 - DNA, 20 bp, human
gctgcagccgggaacacccc

SEQ ID NO: 213413 - DNA, 20 bp, human
gctaccgcccgccactgaag

SEQ ID NO: 213414 - DNA, 20 bp, human
gacttgaggcagccttaaaa

SEQ ID NO: 213415 - DNA, 20 bp, human
ggggccccttcagtggcggg

SEQ ID NO: 213416 - DNA, 20 bp, human
gtggctttgggcatctcctg

SEQ ID NO: 213417 - DNA, 20 bp, human
gccccacccagacactgccc

SEQ ID NO: 213418 - DNA, 20 bp, human
gtactgagtggggctttcgc

SEQ ID NO: 213419 - DNA, 20 bp, human
gagcaggcctgggcagtgtc

SEQ ID NO: 213420 - DNA, 20 bp, human
gccaactggcctcccatctg

SEQ ID NO: 213421 - DNA, 20 bp, human
gctggcagatatttgggctg

SEQ ID NO: 213422 - DNA, 20 bp, human
gggggaattacacaactcac

SEQ ID NO: 213423 - DNA, 20 bp, human
gaactcactggcagatattt

SEQ ID NO: 213424 - DNA, 20 bp, human
gacacagctccatgttgatt

SEQ ID NO: 213425 - DNA, 20 bp, human
gggtggggcctgggagccac

SEQ ID NO: 213426 - DNA, 20 bp, human
gagcaggcctgggcagtgtc

SEQ ID NO: 213427 - DNA, 20 bp, human
gtggctttgggcatctcctg

SEQ ID NO: 213428 - DNA, 20 bp, human
gccccacccagacactgccc

SEQ ID NO: 213429 - DNA, 20 bp, human
gccaactggcctcccatctg

SEQ ID NO: 213430 - DNA, 20 bp, human
gtactgagtggggctttcgc

SEQ ID NO: 213431 - DNA, 20 bp, human
gggggaattacacaactcac

SEQ ID NO: 213432 - DNA, 20 bp, human
gctggcagatatttgggctg

SEQ ID NO: 213433 - DNA, 20 bp, human
gaactcactggcagatattt

SEQ ID NO: 213434 - DNA, 20 bp, human
gaaagccaggcagagcccgg

SEQ ID NO: 213435 - DNA, 20 bp, human
gaattccccagagcaggcct

SEQ ID NO: 213436 - DNA, 20 bp, human
gcccagacgtgggagaggac

SEQ ID NO: 213437 - DNA, 20 bp, human
gcaggaaggtgtctgcatgt

SEQ ID NO: 213438 - DNA, 20 bp, human
gtctggcccctcccagacgt

SEQ ID NO: 213439 - DNA, 20 bp, human
gcctctcccacgtctgggag

SEQ ID NO: 213440 - DNA, 20 bp, human
gctaagagaggtcatctgac

SEQ ID NO: 213441 - DNA, 20 bp, human
gcttccctgtgggtccaggt

SEQ ID NO: 213442 - DNA, 20 bp, human
gcatctcttctcccaggaac

SEQ ID NO: 213443 - DNA, 20 bp, human
gccagcctgcaccccagagg

SEQ ID NO: 213444 - DNA, 20 bp, human
gctagtaaggcagcagtcaa

SEQ ID NO: 213445 - DNA, 20 bp, human
gaggaagggcacaagtattt

SEQ ID NO: 213446 - DNA, 20 bp, human
gcggaactgatctgttgggt

SEQ ID NO: 213447 - DNA, 20 bp, human
gttgccggaactgatctgtt

SEQ ID NO: 213448 - DNA, 20 bp, human
ggcacaacttccgtgctccc

SEQ ID NO: 213449 - DNA, 20 bp, human
gatctgttgggttggttagg

SEQ ID NO: 213450 - DNA, 20 bp, human
gggcaagcctcgaggctcac

SEQ ID NO: 213451 - DNA, 20 bp, human
gtgctgatcaaattgttaaa

SEQ ID NO: 213452 - DNA, 20 bp, human
gaatgggcagttagcatggt

SEQ ID NO: 213453 - DNA, 20 bp, human
gataaaccccgtgagcctcg

SEQ ID NO: 213454 - DNA, 20 bp, human
gtcagttccggcaagcctcg

SEQ ID NO: 213455 - DNA, 20 bp, human
gtcaacagctttatatggta

SEQ ID NO: 213456 - DNA, 20 bp, human
gaagccaaggcaaattcttg

SEQ ID NO: 213457 - DNA, 20 bp, human
gctggcctaggaggggccta

SEQ ID NO: 213458 - DNA, 20 bp, human
ggtggaaggcggcacttgtc

SEQ ID NO: 213459 - DNA, 20 bp, human
gccagggcaggggctgatag

SEQ ID NO: 213460 - DNA, 20 bp, human
gaggcctgagctggcctagg

SEQ ID NO: 213461 - DNA, 20 bp, human
gggtctgattgacttcaaga

SEQ ID NO: 213462 - DNA, 20 bp, human
gaagactaccggctaggaaa

SEQ ID NO: 213463 - DNA, 20 bp, human
gaacagatcgtggcattgca

SEQ ID NO: 213464 - DNA, 20 bp, human
gcttccacaagaatttgcct

SEQ ID NO: 213465 - DNA, 20 bp, human
ggaggcagagataaggacaa

SEQ ID NO: 213466 - DNA, 20 bp, human
gggcgctggggactatgcat

SEQ ID NO: 213467 - DNA, 20 bp, human
gatgaacttagttgtcttat

SEQ ID NO: 213468 - DNA, 20 bp, human
gatctctcgctccacggctc

SEQ ID NO: 213469 - DNA, 20 bp, human
gtgcacaggcagcggcccga

SEQ ID NO: 213470 - DNA, 20 bp, human
gcggctctggaatgcaatag

SEQ ID NO: 213471 - DNA, 20 bp, human
gggggaggaagctcagtcca

SEQ ID NO: 213472 - DNA, 20 bp, human
ggggccatggaattttccca

SEQ ID NO: 213473 - DNA, 20 bp, human
gttgtcttatgggcagagat

SEQ ID NO: 213474 - DNA, 20 bp, human
gccagcttggggcagggcaa

SEQ ID NO: 213475 - DNA, 20 bp, human
ggcagagatgggcttccctc

SEQ ID NO: 213476 - DNA, 20 bp, human
gctaacctccagtttccacc

SEQ ID NO: 213477 - DNA, 20 bp, human
ggtgccctgggccaaaccac

SEQ ID NO: 213478 - DNA, 20 bp, human
gttcgctaggatggatagga

SEQ ID NO: 213479 - DNA, 20 bp, human
gggagaaaactccaccccat

SEQ ID NO: 213480 - DNA, 20 bp, human
gggtactgactgctaccagt

SEQ ID NO: 213481 - DNA, 20 bp, human
gtgctaccagtgggagttca

SEQ ID NO: 213482 - DNA, 20 bp, human
gaccagatgaaagggaatct

SEQ ID NO: 213483 - DNA, 20 bp, human
gcaggctgcagaacttaatt

SEQ ID NO: 213484 - DNA, 20 bp, human
gctgccaggaggtaggaaaa

SEQ ID NO: 213485 - DNA, 20 bp, human
gtgtcctgtggtttggccca

SEQ ID NO: 213486 - DNA, 20 bp, human
gttggggagagttggggcta

SEQ ID NO: 213487 - DNA, 20 bp, human
gtctggccctgactaagtgg

SEQ ID NO: 213488 - DNA, 20 bp, human
gtctgggtcagggttggagt

SEQ ID NO: 213489 - DNA, 20 bp, human
ggaaggacacaggaaggcta

SEQ ID NO: 213490 - DNA, 20 bp, human
gcaaaaccatgtaaggtctg

SEQ ID NO: 213491 - DNA, 20 bp, human
gtcactctactttctgggtc

SEQ ID NO: 213492 - DNA, 20 bp, human
gagtagagtgatttggaggc

SEQ ID NO: 213493 - DNA, 20 bp, human
gagggcaagggggatagacc

SEQ ID NO: 213494 - DNA, 20 bp, human
gccagtcccccacttagtca

SEQ ID NO: 213495 - DNA, 20 bp, human
gagtcagatgcctgggacta

SEQ ID NO: 213496 - DNA, 20 bp, human
gtcactggcgccctctatgt

SEQ ID NO: 213497 - DNA, 20 bp, human
ggcaaagagctcaggaacgt

SEQ ID NO: 213498 - DNA, 20 bp, human
ggggtcgtcttcatcttcgc

SEQ ID NO: 213499 - DNA, 20 bp, human
gccactggcgaggagatgaa

SEQ ID NO: 213500 - DNA, 20 bp, human
ggtgacgcccacacacgtgc

SEQ ID NO: 213501 - DNA, 20 bp, human
gtatgtgggcggaaatcatc

SEQ ID NO: 213502 - DNA, 20 bp, human
gcaagccccgccccactcgg

SEQ ID NO: 213503 - DNA, 20 bp, human
ggggacaccagcacgtgtgt

SEQ ID NO: 213504 - DNA, 20 bp, human
gggcaccgacccgccgagtg

SEQ ID NO: 213505 - DNA, 20 bp, human
ggtgtcccgggaagagttcc

SEQ ID NO: 213506 - DNA, 20 bp, human
ggggtcccagatcaggaaca

SEQ ID NO: 213507 - DNA, 20 bp, human
gaactctggtatgcatccct

SEQ ID NO: 213508 - DNA, 20 bp, human
gcatcagggagagtcaccca

SEQ ID NO: 213509 - DNA, 20 bp, human
gacagccatgttcctgatct

SEQ ID NO: 213510 - DNA, 20 bp, human
gctgaagcatttgggaactc

SEQ ID NO: 213511 - DNA, 20 bp, human
ggtagggatagcagttgagg

SEQ ID NO: 213512 - DNA, 20 bp, human
gaccaccatcaccaataagc

SEQ ID NO: 213513 - DNA, 20 bp, human
ggtggtggtagtgatgtaag

SEQ ID NO: 213514 - DNA, 20 bp, human
ggtggtagggatagcagttg

SEQ ID NO: 213515 - DNA, 20 bp, human
ggaaagtggtggtgaggcga

SEQ ID NO: 213516 - DNA, 20 bp, human
ggcgagcggaagtgacgcac

SEQ ID NO: 213517 - DNA, 20 bp, human
gcctctcccgcgccccaatt

SEQ ID NO: 213518 - DNA, 20 bp, human
ggaggtagcgcgcccaattg

SEQ ID NO: 213519 - DNA, 20 bp, human
gagcgcgcccaattggggcg

SEQ ID NO: 213520 - DNA, 20 bp, human
ggccaacgctgccacacccc

SEQ ID NO: 213521 - DNA, 20 bp, human
gtgtgaggagccagagtccc

SEQ ID NO: 213522 - DNA, 20 bp, human
gaccgtctcgcaggcagagg

SEQ ID NO: 213523 - DNA, 20 bp, human
gaggaattgaaccgtctcgc

SEQ ID NO: 213524 - DNA, 20 bp, human
gggccggtcgccagagaagg

SEQ ID NO: 213525 - DNA, 20 bp, human
gacaggccggtcgccagaga

SEQ ID NO: 213526 - DNA, 20 bp, human
gcgtggggcggggcaagaaa

SEQ ID NO: 213527 - DNA, 20 bp, human
ggccgaggggttaataccgt

SEQ ID NO: 213528 - DNA, 20 bp, human
gcagcgccgcggctgccgag

SEQ ID NO: 213529 - DNA, 20 bp, human
gcccaacggtattaacccct

SEQ ID NO: 213530 - DNA, 20 bp, human
ggtcaagggtacaaccctgg

SEQ ID NO: 213531 - DNA, 20 bp, human
gcggccccctcacgctgaat

SEQ ID NO: 213532 - DNA, 20 bp, human
ggggtggtgcccgtggggcg

SEQ ID NO: 213533 - DNA, 20 bp, human
gggggtcaagggtacaaccc

SEQ ID NO: 213534 - DNA, 20 bp, human
gaggcctgaaggcggggtca

SEQ ID NO: 213535 - DNA, 20 bp, human
ggcccgcgcgcgggtacttc

SEQ ID NO: 213536 - DNA, 20 bp, human
gagtctgagcgagaaagatc

SEQ ID NO: 213537 - DNA, 20 bp, human
ggcaaacgtagcaaggatcg

SEQ ID NO: 213538 - DNA, 20 bp, human
ggagctaagtcaggtagccc

SEQ ID NO: 213539 - DNA, 20 bp, human
gacacggaaacgaccaggag

SEQ ID NO: 213540 - DNA, 20 bp, human
gaagcggtggagccacctgg

SEQ ID NO: 213541 - DNA, 20 bp, human
ggagctgggctaccaggaag

SEQ ID NO: 213542 - DNA, 20 bp, human
gaagtgagagcaagcgagac

SEQ ID NO: 213543 - DNA, 20 bp, human
gtcgctcagactcatcgcag

SEQ ID NO: 213544 - DNA, 20 bp, human
ggtagcggtggtgaggccga

SEQ ID NO: 213545 - DNA, 20 bp, human
gatccctccgcctgcggtag

SEQ ID NO: 213546 - DNA, 20 bp, human
gagcggagagacagcatgat

SEQ ID NO: 213547 - DNA, 20 bp, human
gcaaactgaggctctccggg

SEQ ID NO: 213548 - DNA, 20 bp, human
gagggatggggtaccaggta

SEQ ID NO: 213549 - DNA, 20 bp, human
ggggagagggaaggaccgca

SEQ ID NO: 213550 - DNA, 20 bp, human
ggctctgcagtcggcccagg

SEQ ID NO: 213551 - DNA, 20 bp, human
ggcctgaggcccgaggtcag

SEQ ID NO: 213552 - DNA, 20 bp, human
gctcgcggaagaaacagcgg

SEQ ID NO: 213553 - DNA, 20 bp, human
gcaggggttggtgctccgtg

SEQ ID NO: 213554 - DNA, 20 bp, human
gcggagcaccaacccctgct

SEQ ID NO: 213555 - DNA, 20 bp, human
gcgggtggtaaggatgtgcg

SEQ ID NO: 213556 - DNA, 20 bp, human
gcccaccgggccttacttcc

SEQ ID NO: 213557 - DNA, 20 bp, human
gggcggggccgaccaaatca

SEQ ID NO: 213558 - DNA, 20 bp, human
ggccactgggtgccctgatt

SEQ ID NO: 213559 - DNA, 20 bp, human
ggggaccgttatgtccggtc

SEQ ID NO: 213560 - DNA, 20 bp, human
gcggctccccgaaccggaag

SEQ ID NO: 213561 - DNA, 20 bp, human
gcccgcgcggctccccgaac

SEQ ID NO: 213562 - DNA, 20 bp, human
gctccccgaaccggaagtgg

SEQ ID NO: 213563 - DNA, 20 bp, human
gtggtggtgaaaccgacctg

SEQ ID NO: 213564 - DNA, 20 bp, human
gcgcaggacggactgtgcgc

SEQ ID NO: 213565 - DNA, 20 bp, human
gggtgctgtcaggaatgcgc

SEQ ID NO: 213566 - DNA, 20 bp, human
ggccacccaggagtaatgac

SEQ ID NO: 213567 - DNA, 20 bp, human
gcccgcagccatcttcaagt

SEQ ID NO: 213568 - DNA, 20 bp, human
gctgtcggccaacttgaaga

SEQ ID NO: 213569 - DNA, 20 bp, human
gcaggtgtgtgcgtcttaaa

SEQ ID NO: 213570 - DNA, 20 bp, human
gggctagggaaagtgaaggg

SEQ ID NO: 213571 - DNA, 20 bp, human
gtccacccgtcattactcct

SEQ ID NO: 213572 - DNA, 20 bp, human
gcattactcctgggtggcta

SEQ ID NO: 213573 - DNA, 20 bp, human
gacccaggagtaatgacggg

SEQ ID NO: 213574 - DNA, 20 bp, human
ggaagtcgcagtacctctcc

SEQ ID NO: 213575 - DNA, 20 bp, human
ggaggtactgcgacttcaga

SEQ ID NO: 213576 - DNA, 20 bp, human
gggcgcgccacgcactgcgc

SEQ ID NO: 213577 - DNA, 20 bp, human
ggggcttcgggcgagaggga

SEQ ID NO: 213578 - DNA, 20 bp, human
ggggcaaaaaggcgggaaaa

SEQ ID NO: 213579 - DNA, 20 bp, human
gggtaacgcggctgtcctgt

SEQ ID NO: 213580 - DNA, 20 bp, human
gtgcgcaggcgccgacgccg

SEQ ID NO: 213581 - DNA, 20 bp, human
gtcggcgcctgcgcagtgcg

SEQ ID NO: 213582 - DNA, 20 bp, human
gggcggagaagcggaaacca

SEQ ID NO: 213583 - DNA, 20 bp, human
ggaagctgcagtcaaggacc

SEQ ID NO: 213584 - DNA, 20 bp, human
gtctaggagcccggtcgtca

SEQ ID NO: 213585 - DNA, 20 bp, human
gtgtcctgtgggctggttgg

SEQ ID NO: 213586 - DNA, 20 bp, human
gcggtcgccagcggcaccgg

SEQ ID NO: 213587 - DNA, 20 bp, human
gctaggcgacgcgcgggaag

SEQ ID NO: 213588 - DNA, 20 bp, human
gcgggtaaccgctgagtcca

SEQ ID NO: 213589 - DNA, 20 bp, human
gcgcgcgggaagcggctcag

SEQ ID NO: 213590 - DNA, 20 bp, human
ggggccacgtgacccggaag

SEQ ID NO: 213591 - DNA, 20 bp, human
gcagcgaagaaacctccaat

SEQ ID NO: 213592 - DNA, 20 bp, human
gcccgggggccggacgaggg

SEQ ID NO: 213593 - DNA, 20 bp, human
ggaggtgcgaaccggaagcc

SEQ ID NO: 213594 - DNA, 20 bp, human
gaggacacccggctggcata

SEQ ID NO: 213595 - DNA, 20 bp, human
ggggcgggctaggcgacgcg

SEQ ID NO: 213596 - DNA, 20 bp, human
gcagcggggaggagcgtgca

SEQ ID NO: 213597 - DNA, 20 bp, human
gacagctgcagccgaggcgg

SEQ ID NO: 213598 - DNA, 20 bp, human
ggccgagctgcgggctgtcg

SEQ ID NO: 213599 - DNA, 20 bp, human
gaccacccgcgccgagctgc

SEQ ID NO: 213600 - DNA, 20 bp, human
ggggaggaggcagccgcgct

SEQ ID NO: 213601 - DNA, 20 bp, human
ggtgcagactcctcccagcg

SEQ ID NO: 213602 - DNA, 20 bp, human
gggtgcattcgctccaggtg

SEQ ID NO: 213603 - DNA, 20 bp, human
gcagaatcgcgaaaagtccc

SEQ ID NO: 213604 - DNA, 20 bp, human
gtccctgcgcggagaacacc

SEQ ID NO: 213605 - DNA, 20 bp, human
gcaactgctccctccctagg

SEQ ID NO: 213606 - DNA, 20 bp, human
gaggagctcaagccagtggg

SEQ ID NO: 213607 - DNA, 20 bp, human
gaagggagggacgtgaagga

SEQ ID NO: 213608 - DNA, 20 bp, human
gggagaaacccgcctgtgag

SEQ ID NO: 213609 - DNA, 20 bp, human
gaaacccgcctgtgagcggc

SEQ ID NO: 213610 - DNA, 20 bp, human
gggagctctgagccgcccac

SEQ ID NO: 213611 - DNA, 20 bp, human
ggaggcgttgcccgagagac

SEQ ID NO: 213612 - DNA, 20 bp, human
ggaggaagggagggacgtga

SEQ ID NO: 213613 - DNA, 20 bp, human
ggctcagagctccggaccgc

SEQ ID NO: 213614 - DNA, 20 bp, human
ggggttcgattgcgtatcat

SEQ ID NO: 213615 - DNA, 20 bp, human
ggtcctaggaggcgggactt

SEQ ID NO: 213616 - DNA, 20 bp, human
gcccccgcgcctgcctcgac

SEQ ID NO: 213617 - DNA, 20 bp, human
gcgcgcggcggcccagaaag

SEQ ID NO: 213618 - DNA, 20 bp, human
gcgcgagcgacgacggacgg

SEQ ID NO: 213619 - DNA, 20 bp, human
gctccccggcggctcctccg

SEQ ID NO: 213620 - DNA, 20 bp, human
gcgcgaacgcgtggcttcag

SEQ ID NO: 213621 - DNA, 20 bp, human
ggcacgcacgcgagcgacga

SEQ ID NO: 213622 - DNA, 20 bp, human
gtcccccacgggaagggcgt

SEQ ID NO: 213623 - DNA, 20 bp, human
gcctcacgcgacacccgccc

SEQ ID NO: 213624 - DNA, 20 bp, human
gcccgcgtcccccacgggaa

SEQ ID NO: 213625 - DNA, 20 bp, human
gagccggtcgaggcaggcgc

SEQ ID NO: 213626 - DNA, 20 bp, human
ggccctgaactcaccggagg

SEQ ID NO: 213627 - DNA, 20 bp, human
gtgccagggacaaagatggt

SEQ ID NO: 213628 - DNA, 20 bp, human
gaccgccctgaactcaccgg

SEQ ID NO: 213629 - DNA, 20 bp, human
gagccacttaacatcctctg

SEQ ID NO: 213630 - DNA, 20 bp, human
gacctagaaaagaatcgtga

SEQ ID NO: 213631 - DNA, 20 bp, human
ggtccgcccttgagcctgga

SEQ ID NO: 213632 - DNA, 20 bp, human
gaagagatcacaggctttct

SEQ ID NO: 213633 - DNA, 20 bp, human
ggaaaagaatcgtgacgggc

SEQ ID NO: 213634 - DNA, 20 bp, human
gggaaatctttgggtctgga

SEQ ID NO: 213635 - DNA, 20 bp, human
gcccggcaagctagcccatc

SEQ ID NO: 213636 - DNA, 20 bp, human
gggaatgtgtatttctggta

SEQ ID NO: 213637 - DNA, 20 bp, human
gggcgggggcggtttctcga

SEQ ID NO: 213638 - DNA, 20 bp, human
gcgggtggagcggtgtatgc

SEQ ID NO: 213639 - DNA, 20 bp, human
gcctaccccttcctgaggcg

SEQ ID NO: 213640 - DNA, 20 bp, human
ggccgactacaaatcccgtc

SEQ ID NO: 213641 - DNA, 20 bp, human
gaccgcccccgcctcaggaa

SEQ ID NO: 213642 - DNA, 20 bp, human
gtgtagtcggcgctagacgc

SEQ ID NO: 213643 - DNA, 20 bp, human
gtgcaagcaaggaggccgcg

SEQ ID NO: 213644 - DNA, 20 bp, human
gcttcaaattgcaagcaagg

SEQ ID NO: 213645 - DNA, 20 bp, human
gccacgcctaccccttcctg

SEQ ID NO: 213646 - DNA, 20 bp, human
gcgagagtctgcacaggagg

SEQ ID NO: 213647 - DNA, 20 bp, human
gtcccgccagtgactcacta

SEQ ID NO: 213648 - DNA, 20 bp, human
ggcaagccttagtgagtcac

SEQ ID NO: 213649 - DNA, 20 bp, human
gcattcctgagctcagtgct

SEQ ID NO: 213650 - DNA, 20 bp, human
ggtagtggagcccaagagac

SEQ ID NO: 213651 - DNA, 20 bp, human
gtgcagggtcacttactaaa

SEQ ID NO: 213652 - DNA, 20 bp, human
gcggctgcaggaatggcggt

SEQ ID NO: 213653 - DNA, 20 bp, human
ggcacaggagggggccgaaa

SEQ ID NO: 213654 - DNA, 20 bp, human
ggattaggcccaggattcta

SEQ ID NO: 213655 - DNA, 20 bp, human
gggggaggggcatgtctggg

SEQ ID NO: 213656 - DNA, 20 bp, human
gggccagcctgggtgaagat

SEQ ID NO: 213657 - DNA, 20 bp, human
ggggatctgactcgtttggt

SEQ ID NO: 213658 - DNA, 20 bp, human
gggtgaaggcgttgcattca

SEQ ID NO: 213659 - DNA, 20 bp, human
gcgtttggtaggaaaaggac

SEQ ID NO: 213660 - DNA, 20 bp, human
gaatgcaacgccttcaccgc

SEQ ID NO: 213661 - DNA, 20 bp, human
gacttgggatctgactcgtt

SEQ ID NO: 213662 - DNA, 20 bp, human
gggtctgtgcgcgagaaggc

SEQ ID NO: 213663 - DNA, 20 bp, human
gcacccatcttcacccaggc

SEQ ID NO: 213664 - DNA, 20 bp, human
ggctgaagaaccagcggtga

SEQ ID NO: 213665 - DNA, 20 bp, human
gcagagctagagcggacttc

SEQ ID NO: 213666 - DNA, 20 bp, human
gtgcgagccggactgcggaa

SEQ ID NO: 213667 - DNA, 20 bp, human
gggagcaggaaagtccgcgc

SEQ ID NO: 213668 - DNA, 20 bp, human
ggcccgggtggtaatctagc

SEQ ID NO: 213669 - DNA, 20 bp, human
gtacctctaaagcccggagc

SEQ ID NO: 213670 - DNA, 20 bp, human
gggctttagaggtagctgag

SEQ ID NO: 213671 - DNA, 20 bp, human
gtgcctccccttccgcagtc

SEQ ID NO: 213672 - DNA, 20 bp, human
gttcctgctccgggctttag

SEQ ID NO: 213673 - DNA, 20 bp, human
gcccgtttgaggtgtgtctt

SEQ ID NO: 213674 - DNA, 20 bp, human
gggcgcttccggactcgtca

SEQ ID NO: 213675 - DNA, 20 bp, human
gcagggagccgtgacgagtc

SEQ ID NO: 213676 - DNA, 20 bp, human
gcgacaggggcggtgcgtca

SEQ ID NO: 213677 - DNA, 20 bp, human
gtgtccgcgaggaggcgaca

SEQ ID NO: 213678 - DNA, 20 bp, human
gggctcgtctccagatctaa

SEQ ID NO: 213679 - DNA, 20 bp, human
gcgcgaggaggcgacagggg

SEQ ID NO: 213680 - DNA, 20 bp, human
gctaggaaatgccctcttca

SEQ ID NO: 213681 - DNA, 20 bp, human
gactcgcccacctttagatc

SEQ ID NO: 213682 - DNA, 20 bp, human
gtcggcgggacgggcctctg

SEQ ID NO: 213683 - DNA, 20 bp, human
ggcagaagacgccctgaaga

SEQ ID NO: 213684 - DNA, 20 bp, human
gcgtctccagatctaaaggt

SEQ ID NO: 213685 - DNA, 20 bp, human
ggccgaggccaggtggtcgg

SEQ ID NO: 213686 - DNA, 20 bp, human
ggcggagctccagtcttcct

SEQ ID NO: 213687 - DNA, 20 bp, human
gacgacgacaggtagtccaa

SEQ ID NO: 213688 - DNA, 20 bp, human
gcctctaaggggcgtggcta

SEQ ID NO: 213689 - DNA, 20 bp, human
gagagcgcaagttttggggc

SEQ ID NO: 213690 - DNA, 20 bp, human
gaaacgcagcgtctccctgc

SEQ ID NO: 213691 - DNA, 20 bp, human
gggactacctgtcgtcgtca

SEQ ID NO: 213692 - DNA, 20 bp, human
gcagctgacaggtgtgagcg

SEQ ID NO: 213693 - DNA, 20 bp, human
gtggcggggcggggctttct

SEQ ID NO: 213694 - DNA, 20 bp, human
ggaagaaggcggagttccgg

SEQ ID NO: 213695 - DNA, 20 bp, human
gcagcgtctccctgccgggg

SEQ ID NO: 213696 - DNA, 20 bp, human
gagaggaaagacgtctcttg

SEQ ID NO: 213697 - DNA, 20 bp, human
ggatgacagcggcacagaat

SEQ ID NO: 213698 - DNA, 20 bp, human
gagggaccccagactgcgtt

SEQ ID NO: 213699 - DNA, 20 bp, human
ggcacagaatgggcggagtc

SEQ ID NO: 213700 - DNA, 20 bp, human
ggtgggctgtagagccaaag

SEQ ID NO: 213701 - DNA, 20 bp, human
ggtctggggtccctcatggt

SEQ ID NO: 213702 - DNA, 20 bp, human
gtgctgcctaacgcagtctg

SEQ ID NO: 213703 - DNA, 20 bp, human
gtgggcggggcattcgctgt

SEQ ID NO: 213704 - DNA, 20 bp, human
gcggatagagccaatgattg

SEQ ID NO: 213705 - DNA, 20 bp, human
gcagggcctagaaaaatggt

SEQ ID NO: 213706 - DNA, 20 bp, human
gcaacagcgatcaatcagag

SEQ ID NO: 213707 - DNA, 20 bp, human
gctcccagatacccaatcag

SEQ ID NO: 213708 - DNA, 20 bp, human
ggggactcgagcccgacaac

SEQ ID NO: 213709 - DNA, 20 bp, human
ggccttcaggcgcagatcgt

SEQ ID NO: 213710 - DNA, 20 bp, human
gttcaggcgcagatcgtggg

SEQ ID NO: 213711 - DNA, 20 bp, human
gcgcctgaaggccgctgatt

SEQ ID NO: 213712 - DNA, 20 bp, human
gtggcggcttgccctgttgt

SEQ ID NO: 213713 - DNA, 20 bp, human
ggaccccgagtcctgattgg

SEQ ID NO: 213714 - DNA, 20 bp, human
gcagcgatcaatcagagggg

SEQ ID NO: 213715 - DNA, 20 bp, human
gcccccgattggccctgttg

SEQ ID NO: 213716 - DNA, 20 bp, human
gtccgagccagcggcctaac

SEQ ID NO: 213717 - DNA, 20 bp, human
gctgggcggggcaggcacta

SEQ ID NO: 213718 - DNA, 20 bp, human
gacctcgggagaggagcggt

SEQ ID NO: 213719 - DNA, 20 bp, human
gcacactccagttaggccgc

SEQ ID NO: 213720 - DNA, 20 bp, human
gtctccagggagcgtcgcaa

SEQ ID NO: 213721 - DNA, 20 bp, human
ggcaaaggaggcgccggagt

SEQ ID NO: 213722 - DNA, 20 bp, human
ggcgactgagcgcgtgcagt

SEQ ID NO: 213723 - DNA, 20 bp, human
gagcgtcgcaaaggaggcgc

SEQ ID NO: 213724 - DNA, 20 bp, human
ggcttggagacactcgagag

SEQ ID NO: 213725 - DNA, 20 bp, human
ggcgctcccgagccgtcggg

SEQ ID NO: 213726 - DNA, 20 bp, human
gtgggcgagggacatagatc

SEQ ID NO: 213727 - DNA, 20 bp, human
gagggcaggtgcggatgccg

SEQ ID NO: 213728 - DNA, 20 bp, human
gctgactggccaaccaacgc

SEQ ID NO: 213729 - DNA, 20 bp, human
ggccggacccttgggtgcta

SEQ ID NO: 213730 - DNA, 20 bp, human
gccgaggtgaccactctcct

SEQ ID NO: 213731 - DNA, 20 bp, human
gtgtccctcgcccagaccga

SEQ ID NO: 213732 - DNA, 20 bp, human
ggccctagcacccaagggtc

SEQ ID NO: 213733 - DNA, 20 bp, human
gcacgagccctagcacccaa

SEQ ID NO: 213734 - DNA, 20 bp, human
gtctgcgagcgctaagggga

SEQ ID NO: 213735 - DNA, 20 bp, human
ggccctccaaggcgtcagag

SEQ ID NO: 213736 - DNA, 20 bp, human
gggacgcggcgctggaaatc

SEQ ID NO: 213737 - DNA, 20 bp, human
gaagtagcgggagcgatctg

SEQ ID NO: 213738 - DNA, 20 bp, human
gacaccgcgagccccaccct

SEQ ID NO: 213739 - DNA, 20 bp, human
gggcctatccgcgatgagaa

SEQ ID NO: 213740 - DNA, 20 bp, human
ggtagggcctgaagagccta

SEQ ID NO: 213741 - DNA, 20 bp, human
gggcctgccggccgacggta

SEQ ID NO: 213742 - DNA, 20 bp, human
ggcctgaagagcctagggtg

SEQ ID NO: 213743 - DNA, 20 bp, human
ggggaagggcatcctaaggt

SEQ ID NO: 213744 - DNA, 20 bp, human
ggctccctctggtggagctg

SEQ ID NO: 213745 - DNA, 20 bp, human
ggcggcgggcaatcggaaat

SEQ ID NO: 213746 - DNA, 20 bp, human
gagggcgcaagagaccgcgg

SEQ ID NO: 213747 - DNA, 20 bp, human
gtaccccgtcgcgagaaagg

SEQ ID NO: 213748 - DNA, 20 bp, human
gcggaggcggctagtgggaa

SEQ ID NO: 213749 - DNA, 20 bp, human
gctcctgaggaagccgtcgg

SEQ ID NO: 213750 - DNA, 20 bp, human
gtcaggaggactcacggttc

SEQ ID NO: 213751 - DNA, 20 bp, human
ggagaccgcgggggtggaaa

SEQ ID NO: 213752 - DNA, 20 bp, human
gacgctgaacttgttcaggt

SEQ ID NO: 213753 - DNA, 20 bp, human
gctcgcgagaggccaccaga

SEQ ID NO: 213754 - DNA, 20 bp, human
gaggcggctagtgggaaagg

SEQ ID NO: 213755 - DNA, 20 bp, human
gcagagggcgcaagagaccg

SEQ ID NO: 213756 - DNA, 20 bp, human
gcgggcctagaatgagtgac

SEQ ID NO: 213757 - DNA, 20 bp, human
gggcgtcggaagggaatctc

SEQ ID NO: 213758 - DNA, 20 bp, human
gggcccgcacgcagtggcgc

SEQ ID NO: 213759 - DNA, 20 bp, human
gcgtgcgggccaatcggaca

SEQ ID NO: 213760 - DNA, 20 bp, human
gtcggaagggaatctccggg

SEQ ID NO: 213761 - DNA, 20 bp, human
gggggaggcggtgcgggcgt

SEQ ID NO: 213762 - DNA, 20 bp, human
gtctaggcccgcacggtgat

SEQ ID NO: 213763 - DNA, 20 bp, human
gaggcggtgcgggcgtcgga

SEQ ID NO: 213764 - DNA, 20 bp, human
gcgcaagccaatcaccgtgc

SEQ ID NO: 213765 - DNA, 20 bp, human
gcctccccgtcactcattct

SEQ ID NO: 213766 - DNA, 20 bp, human
ggggggtggtccggaaaagg

SEQ ID NO: 213767 - DNA, 20 bp, human
gctagggtgcacagtgactt

SEQ ID NO: 213768 - DNA, 20 bp, human
gcgtaccaagtctgagggag

SEQ ID NO: 213769 - DNA, 20 bp, human
gcaagcgcgtaccaagtctg

SEQ ID NO: 213770 - DNA, 20 bp, human
ggggaccgagcacctctctg

SEQ ID NO: 213771 - DNA, 20 bp, human
gaagaagcgtggctgtcaag

SEQ ID NO: 213772 - DNA, 20 bp, human
ggatgaagagcccgaagaga

SEQ ID NO: 213773 - DNA, 20 bp, human
gtatcctagtccctctcttc

SEQ ID NO: 213774 - DNA, 20 bp, human
ggatacgccaaatcggaaag

SEQ ID NO: 213775 - DNA, 20 bp, human
ggcagcccaggaaagaagcg

SEQ ID NO: 213776 - DNA, 20 bp, human
gccgccgcgggcactcaggc

SEQ ID NO: 213777 - DNA, 20 bp, human
gtgcccgcggcggctgagtc

SEQ ID NO: 213778 - DNA, 20 bp, human
ggggaggggcggggcgtaac

SEQ ID NO: 213779 - DNA, 20 bp, human
gccccggcgccggcggtaac

SEQ ID NO: 213780 - DNA, 20 bp, human
gcagcccggaaggagccggc

SEQ ID NO: 213781 - DNA, 20 bp, human
gccgcctgactcagccgccg

SEQ ID NO: 213782 - DNA, 20 bp, human
gcgactcgcaggtttcgcgg

SEQ ID NO: 213783 - DNA, 20 bp, human
ggcgcgggggcggccgagtc

SEQ ID NO: 213784 - DNA, 20 bp, human
ggagcgcggcccgttaccgc

SEQ ID NO: 213785 - DNA, 20 bp, human
gaggcggcctaacgagctct

SEQ ID NO: 213786 - DNA, 20 bp, human
gcgccagggaggttgtcggg

SEQ ID NO: 213787 - DNA, 20 bp, human
gcgcgcgccagggaggttgt

SEQ ID NO: 213788 - DNA, 20 bp, human
gcgtatgaggcggtgacaat

SEQ ID NO: 213789 - DNA, 20 bp, human
gggccggcgaataaaacgag

SEQ ID NO: 213790 - DNA, 20 bp, human
gcccctcccgacaacctccc

SEQ ID NO: 213791 - DNA, 20 bp, human
gcggcgaaagaaccgaaaaa

SEQ ID NO: 213792 - DNA, 20 bp, human
gcgcccctcctgggatctgt

SEQ ID NO: 213793 - DNA, 20 bp, human
ggtgacaatgggagcagcgc

SEQ ID NO: 213794 - DNA, 20 bp, human
ggctccccacagatcccagg

SEQ ID NO: 213795 - DNA, 20 bp, human
gcgggcggagcgtgaaatgg

SEQ ID NO: 213796 - DNA, 20 bp, human
gctggggctccgctgatcta

SEQ ID NO: 213797 - DNA, 20 bp, human
ggatctagggcaacgagcgg

SEQ ID NO: 213798 - DNA, 20 bp, human
gcgtggcaggagagcaatgg

SEQ ID NO: 213799 - DNA, 20 bp, human
ggaggcgcaaggcacttcgg

SEQ ID NO: 213800 - DNA, 20 bp, human
gcccaggctgccgaccccgg

SEQ ID NO: 213801 - DNA, 20 bp, human
gcgcctgcgcacgtcggtcg

SEQ ID NO: 213802 - DNA, 20 bp, human
gagcgcggagtctgcggaaa

SEQ ID NO: 213803 - DNA, 20 bp, human
gcggccccgagctgccggca

SEQ ID NO: 213804 - DNA, 20 bp, human
gccgccctccggggacaact

SEQ ID NO: 213805 - DNA, 20 bp, human
gtgcaggggcaacacattca

SEQ ID NO: 213806 - DNA, 20 bp, human
ggggcggggcgtaggtgccg

SEQ ID NO: 213807 - DNA, 20 bp, human
ggctccacgccaaagcccat

SEQ ID NO: 213808 - DNA, 20 bp, human
ggttgccgaccaatgggctt

SEQ ID NO: 213809 - DNA, 20 bp, human
gcgacccggacccccggccg

SEQ ID NO: 213810 - DNA, 20 bp, human
gcggtcccggaagttgaccg

SEQ ID NO: 213811 - DNA, 20 bp, human
gggacaggttgccgaccaat

SEQ ID NO: 213812 - DNA, 20 bp, human
gccgctgcgctcacgtgacg

SEQ ID NO: 213813 - DNA, 20 bp, human
gtgagcgcagcggccttacg

SEQ ID NO: 213814 - DNA, 20 bp, human
ggcgcgattccgcagctccc

SEQ ID NO: 213815 - DNA, 20 bp, human
gccctcctgctcatgtgatg

SEQ ID NO: 213816 - DNA, 20 bp, human
gccgccgcgcactcctgcca

SEQ ID NO: 213817 - DNA, 20 bp, human
ggggtcgcgcgcgccacgtc

SEQ ID NO: 213818 - DNA, 20 bp, human
gtgcccgcctaccccgcgga

SEQ ID NO: 213819 - DNA, 20 bp, human
gcgacgggacccgaggagga

SEQ ID NO: 213820 - DNA, 20 bp, human
gctaccccgcggacggggcg

SEQ ID NO: 213821 - DNA, 20 bp, human
ggaagtgcccgcctaccccg

SEQ ID NO: 213822 - DNA, 20 bp, human
gtccggcattggtgggaacg

SEQ ID NO: 213823 - DNA, 20 bp, human
gcgcaggccgacgggacccg

SEQ ID NO: 213824 - DNA, 20 bp, human
gggaacgcggcgcgtccctg

SEQ ID NO: 213825 - DNA, 20 bp, human
gcgcgcgcgggcatgagccg

SEQ ID NO: 213826 - DNA, 20 bp, human
gaggcaggggcgctactagc

SEQ ID NO: 213827 - DNA, 20 bp, human
ggccgcgcgcgcacgcgagt

SEQ ID NO: 213828 - DNA, 20 bp, human
gcaggggcgctactagcagg

SEQ ID NO: 213829 - DNA, 20 bp, human
gccccagcgcgcgtcacgag

SEQ ID NO: 213830 - DNA, 20 bp, human
ggcacgcgagtgggcgaggg

SEQ ID NO: 213831 - DNA, 20 bp, human
ggcaccgctgatgtcctccg

SEQ ID NO: 213832 - DNA, 20 bp, human
gcccctgccccggcgccggt

SEQ ID NO: 213833 - DNA, 20 bp, human
gggaacccggacgcgaggga

SEQ ID NO: 213834 - DNA, 20 bp, human
ggggccagcgagctagctgg

SEQ ID NO: 213835 - DNA, 20 bp, human
ggggcctccaccctcctcgg

SEQ ID NO: 213836 - DNA, 20 bp, human
gatcgcgcgccgtgaagaga

SEQ ID NO: 213837 - DNA, 20 bp, human
gacgcagcgtacggcacgca

SEQ ID NO: 213838 - DNA, 20 bp, human
gcacccgcgccgggcacact

SEQ ID NO: 213839 - DNA, 20 bp, human
ggtgcccggcgcgggtgagg

SEQ ID NO: 213840 - DNA, 20 bp, human
gggtgaggcggaagcggccg

SEQ ID NO: 213841 - DNA, 20 bp, human
gcggcagccgcaggccggtg

SEQ ID NO: 213842 - DNA, 20 bp, human
gcgcgtgcgcccggcagagg

SEQ ID NO: 213843 - DNA, 20 bp, human
gtgcggggcgcatcccgcac

SEQ ID NO: 213844 - DNA, 20 bp, human
gtccccccgggccggtctcc

SEQ ID NO: 213845 - DNA, 20 bp, human
ggaggcggaagcggccgggg

SEQ ID NO: 213846 - DNA, 20 bp, human
gggccagccggggcagtctg

SEQ ID NO: 213847 - DNA, 20 bp, human
gtctgcgggccgggaagcct

SEQ ID NO: 213848 - DNA, 20 bp, human
ggacaactgcagatgttgga

SEQ ID NO: 213849 - DNA, 20 bp, human
gctgggacaactgcagatgt

SEQ ID NO: 213850 - DNA, 20 bp, human
gggaggggagttcgaatccc

SEQ ID NO: 213851 - DNA, 20 bp, human
gcccggcccgcagactgccc

SEQ ID NO: 213852 - DNA, 20 bp, human
gccggtgcctcaaggtccca

SEQ ID NO: 213853 - DNA, 20 bp, human
gccacccagcctcgccacgc

SEQ ID NO: 213854 - DNA, 20 bp, human
gcgaggccgcgcatgctcaa

SEQ ID NO: 213855 - DNA, 20 bp, human
gtctgcgcggatagaggagc

SEQ ID NO: 213856 - DNA, 20 bp, human
gtccgcgcgtctcccggcgt

SEQ ID NO: 213857 - DNA, 20 bp, human
gtgcaggggtgtctgctggg

SEQ ID NO: 213858 - DNA, 20 bp, human
gtgagtctgtggaatagtag

SEQ ID NO: 213859 - DNA, 20 bp, human
gggcgcgggagcgagctcgg

SEQ ID NO: 213860 - DNA, 20 bp, human
gccgcgcggggaaggattcc

SEQ ID NO: 213861 - DNA, 20 bp, human
ggcaccgctccctgacgtcc

SEQ ID NO: 213862 - DNA, 20 bp, human
gacggcgccgcgctaggcgg

SEQ ID NO: 213863 - DNA, 20 bp, human
ggctccctgacgtcctggtg

SEQ ID NO: 213864 - DNA, 20 bp, human
gggaggcgcgcgcaagggga

SEQ ID NO: 213865 - DNA, 20 bp, human
gtcaccctgcgggcggccct

SEQ ID NO: 213866 - DNA, 20 bp, human
gcctgcaccgcgtcccctga

SEQ ID NO: 213867 - DNA, 20 bp, human
gccgagagacagctgaactc

SEQ ID NO: 213868 - DNA, 20 bp, human
gtcgacgcaagagggactaa

SEQ ID NO: 213869 - DNA, 20 bp, human
ggcctgcagcccgccctcag

SEQ ID NO: 213870 - DNA, 20 bp, human
gagcccgccctcaggggacg

SEQ ID NO: 213871 - DNA, 20 bp, human
gagacagctgaactccggcc

SEQ ID NO: 213872 - DNA, 20 bp, human
gggtgaggttaccaacctga

SEQ ID NO: 213873 - DNA, 20 bp, human
ggttcagctgtctctcgggt

SEQ ID NO: 213874 - DNA, 20 bp, human
gtcccctgagggcgggctgc

SEQ ID NO: 213875 - DNA, 20 bp, human
gactgagcgtggttaaacgt

SEQ ID NO: 213876 - DNA, 20 bp, human
ggcagcggctgcgcgaggga

SEQ ID NO: 213877 - DNA, 20 bp, human
gctcccagggcgacccctgc

SEQ ID NO: 213878 - DNA, 20 bp, human
gagggggccgaatgggagaa

SEQ ID NO: 213879 - DNA, 20 bp, human
gcggcccgcctccttctgcc

SEQ ID NO: 213880 - DNA, 20 bp, human
ggcaccctccccaatcgcct

SEQ ID NO: 213881 - DNA, 20 bp, human
ggccccgcctttctcccatt

SEQ ID NO: 213882 - DNA, 20 bp, human
gtttggcagcggctgcgcga

SEQ ID NO: 213883 - DNA, 20 bp, human
gctgcgcgagggaaggctgg

SEQ ID NO: 213884 - DNA, 20 bp, human
gaggacgtgcagtgcagccc

SEQ ID NO: 213885 - DNA, 20 bp, human
gctgcgcgggactcgcggaa

SEQ ID NO: 213886 - DNA, 20 bp, human
gcaggggtggtgcgtgtaaa

SEQ ID NO: 213887 - DNA, 20 bp, human
ggggcgtctggatccccgaa

SEQ ID NO: 213888 - DNA, 20 bp, human
gtgtgagcgcactcacgacc

SEQ ID NO: 213889 - DNA, 20 bp, human
ggggacacggggcgggacac

SEQ ID NO: 213890 - DNA, 20 bp, human
gcctcccccggacccacaca

SEQ ID NO: 213891 - DNA, 20 bp, human
gtgcgcctgcgcaacaagtt

SEQ ID NO: 213892 - DNA, 20 bp, human
gccccctcccgtcgagtctc

SEQ ID NO: 213893 - DNA, 20 bp, human
gggggcagtcggcacgaggg

SEQ ID NO: 213894 - DNA, 20 bp, human
gagttcggcggggaagatgg

SEQ ID NO: 213895 - DNA, 20 bp, human
gtatctgagagaggcgtact

SEQ ID NO: 213896 - DNA, 20 bp, human
gccactgcggagtgcgggtc

SEQ ID NO: 213897 - DNA, 20 bp, human
gcgcgagggcatacccccga

SEQ ID NO: 213898 - DNA, 20 bp, human
gcggagtgcgggtcgggaag

SEQ ID NO: 213899 - DNA, 20 bp, human
gcgccctggtccgcatccag

SEQ ID NO: 213900 - DNA, 20 bp, human
gcatacccccgaggggtacg

SEQ ID NO: 213901 - DNA, 20 bp, human
gcgggctcccgacgggaatg

SEQ ID NO: 213902 - DNA, 20 bp, human
gccgtcgggagcccgccgat

SEQ ID NO: 213903 - DNA, 20 bp, human
gtacggggctagggctaggc

SEQ ID NO: 213904 - DNA, 20 bp, human
gctagccccgtacccctcgg

SEQ ID NO: 213905 - DNA, 20 bp, human
gaagcagctgtgtaatccgc

SEQ ID NO: 213906 - DNA, 20 bp, human
gaagtgctgcaactgagact

SEQ ID NO: 213907 - DNA, 20 bp, human
gcataacaggctctagtctc

SEQ ID NO: 213908 - DNA, 20 bp, human
gcgaagcagtgcccggcaag

SEQ ID NO: 213909 - DNA, 20 bp, human
gctaggcagcaatggctcac

SEQ ID NO: 213910 - DNA, 20 bp, human
gtgcagaaggatctattaac

SEQ ID NO: 213911 - DNA, 20 bp, human
gtcggctgcctaggcagcaa

SEQ ID NO: 213912 - DNA, 20 bp, human
gcatgcgtgagaggtgttgc

SEQ ID NO: 213913 - DNA, 20 bp, human
gggtgctgcgctccgcttgc

SEQ ID NO: 213914 - DNA, 20 bp, human
gactagagcctgttatgcgc

SEQ ID NO: 213915 - DNA, 20 bp, human
gctgttatgcgcaggcgcaa

SEQ ID NO: 213916 - DNA, 20 bp, human
gaatgagggcgcgggaagac

SEQ ID NO: 213917 - DNA, 20 bp, human
gagacagccaatgagggcgc

SEQ ID NO: 213918 - DNA, 20 bp, human
gccccgccccgggccgccat

SEQ ID NO: 213919 - DNA, 20 bp, human
gcggggaccggcgtcggccg

SEQ ID NO: 213920 - DNA, 20 bp, human
ggctcaggggccgtgagtgc

SEQ ID NO: 213921 - DNA, 20 bp, human
gcaacagccaatggcggccc

SEQ ID NO: 213922 - DNA, 20 bp, human
ggggcacccccttccctcgg

SEQ ID NO: 213923 - DNA, 20 bp, human
ggtgccatggcaacagccaa

SEQ ID NO: 213924 - DNA, 20 bp, human
ggggggcgaaacccccccga

SEQ ID NO: 213925 - DNA, 20 bp, human
gagccaatggcggcccgggg

SEQ ID NO: 213926 - DNA, 20 bp, human
gggcggggctcctcccgaaa

SEQ ID NO: 213927 - DNA, 20 bp, human
gagggcgtaccgtggggtct

SEQ ID NO: 213928 - DNA, 20 bp, human
gcgcctgcgcggagaggggc

SEQ ID NO: 213929 - DNA, 20 bp, human
gacgctggggagttcgaatg

SEQ ID NO: 213930 - DNA, 20 bp, human
gctcctcccgaaaggggcga

SEQ ID NO: 213931 - DNA, 20 bp, human
ggaggggaggggactcgcgt

SEQ ID NO: 213932 - DNA, 20 bp, human
ggggtctgggggtgctcgcg

SEQ ID NO: 213933 - DNA, 20 bp, human
gaggggcgagggcgtaccgt

SEQ ID NO: 213934 - DNA, 20 bp, human
gcggtgggagatccaaggat

SEQ ID NO: 213935 - DNA, 20 bp, human
ggggagttcgaatgcggagg

SEQ ID NO: 213936 - DNA, 20 bp, human
gggagcgcggagacttgaaa

SEQ ID NO: 213937 - DNA, 20 bp, human
ggagacttgaaagggcgcgt

SEQ ID NO: 213938 - DNA, 20 bp, human
gaggaagcgcgcccggaatg

SEQ ID NO: 213939 - DNA, 20 bp, human
gcctggccgcggcacggagg

SEQ ID NO: 213940 - DNA, 20 bp, human
gtctccgcgctcccccccgg

SEQ ID NO: 213941 - DNA, 20 bp, human
gacgccgagccaccgccccc

SEQ ID NO: 213942 - DNA, 20 bp, human
ggcgcccggaatgggggacg

SEQ ID NO: 213943 - DNA, 20 bp, human
gccgccgccgggggggagcg

SEQ ID NO: 213944 - DNA, 20 bp, human
gcagcctggccgcggcacgg

SEQ ID NO: 213945 - DNA, 20 bp, human
ggcgtgggatccaagcaaag

SEQ ID NO: 213946 - DNA, 20 bp, human
gcagccgtgaggcggaggac

SEQ ID NO: 213947 - DNA, 20 bp, human
gaagcgaggcagccgtgagg

SEQ ID NO: 213948 - DNA, 20 bp, human
gacaggctgggggatcccaa

SEQ ID NO: 213949 - DNA, 20 bp, human
gaggaggaggagttgcgaga

SEQ ID NO: 213950 - DNA, 20 bp, human
ggggctggagcgcacccttt

SEQ ID NO: 213951 - DNA, 20 bp, human
gcgaggcagccgtgaggcgg

SEQ ID NO: 213952 - DNA, 20 bp, human
ggtgaggcggaggacaggct

SEQ ID NO: 213953 - DNA, 20 bp, human
gactctggtggcaccctggg

SEQ ID NO: 213954 - DNA, 20 bp, human
gaggaggagttgcgagaagg

SEQ ID NO: 213955 - DNA, 20 bp, human
ggatcaccgggtaactgcag

SEQ ID NO: 213956 - DNA, 20 bp, human
ggggcagcagggttatggat

SEQ ID NO: 213957 - DNA, 20 bp, human
gggcgcttacggtgaaggag

SEQ ID NO: 213958 - DNA, 20 bp, human
gctcctggcgcttacggtga

SEQ ID NO: 213959 - DNA, 20 bp, human
gagcacagagccatcagaga

SEQ ID NO: 213960 - DNA, 20 bp, human
ggttcccatagcccacaaga

SEQ ID NO: 213961 - DNA, 20 bp, human
gtgacccagattttattgct

SEQ ID NO: 213962 - DNA, 20 bp, human
gctgggaagagagtcattgc

SEQ ID NO: 213963 - DNA, 20 bp, human
ggatacactctgtgtggctc

SEQ ID NO: 213964 - DNA, 20 bp, human
gttgcagggcagcagggtta

SEQ ID NO: 213965 - DNA, 20 bp, human
gaatatgtgagtgattttcc

SEQ ID NO: 213966 - DNA, 20 bp, human
gagagcaggggtctcgccag

SEQ ID NO: 213967 - DNA, 20 bp, human
gcctgggagcgagaagtcct

SEQ ID NO: 213968 - DNA, 20 bp, human
gggtgaggaccgttggcagg

SEQ ID NO: 213969 - DNA, 20 bp, human
gacagattgccgcagggcag

SEQ ID NO: 213970 - DNA, 20 bp, human
gggaagcagcgcggtcggac

SEQ ID NO: 213971 - DNA, 20 bp, human
gaaggcgggcgggtccggat

SEQ ID NO: 213972 - DNA, 20 bp, human
ggccctgcggcaatctgtga

SEQ ID NO: 213973 - DNA, 20 bp, human
ggggcggggccttcggctaa

SEQ ID NO: 213974 - DNA, 20 bp, human
gggcggggcccgaggggaat

SEQ ID NO: 213975 - DNA, 20 bp, human
ggctaatgggtgaggaccgt

SEQ ID NO: 213976 - DNA, 20 bp, human
gaaacagcccgagggagggt

SEQ ID NO: 213977 - DNA, 20 bp, human
gacaacgataaacagcccga

SEQ ID NO: 213978 - DNA, 20 bp, human
gaccaatcacgcgcattctt

SEQ ID NO: 213979 - DNA, 20 bp, human
ggccgaagaatgcgcgtgat

SEQ ID NO: 213980 - DNA, 20 bp, human
gcccacgtgggtagcggacc

SEQ ID NO: 213981 - DNA, 20 bp, human
gacgataaacagcccgaggg

SEQ ID NO: 213982 - DNA, 20 bp, human
ggacctggtcacgtgatcag

SEQ ID NO: 213983 - DNA, 20 bp, human
gtctgtctgacaccacgtga

SEQ ID NO: 213984 - DNA, 20 bp, human
gctagagaattagaggaggg

SEQ ID NO: 213985 - DNA, 20 bp, human
gtaggaagacaggtccctgg

SEQ ID NO: 213986 - DNA, 20 bp, human
ggacgctgaaggaagcaaag

SEQ ID NO: 213987 - DNA, 20 bp, human
gggaactgggtggacgctga

SEQ ID NO: 213988 - DNA, 20 bp, human
gaagcaaagcggaagcctag

SEQ ID NO: 213989 - DNA, 20 bp, human
gaaagcgcctgacgcacgtc

SEQ ID NO: 213990 - DNA, 20 bp, human
gcgtgcgtcaggcgctttag

SEQ ID NO: 213991 - DNA, 20 bp, human
gcctgacgcacgtcgggcgg

SEQ ID NO: 213992 - DNA, 20 bp, human
ggcgagaggagtttccagtt

SEQ ID NO: 213993 - DNA, 20 bp, human
gctgtccgagcggaaggagc

SEQ ID NO: 213994 - DNA, 20 bp, human
ggcgcctgacgcacgtcggg

SEQ ID NO: 213995 - DNA, 20 bp, human
ggaaggagcgggagcccaac

SEQ ID NO: 213996 - DNA, 20 bp, human
ggaggccttgacttcgtcct

SEQ ID NO: 213997 - DNA, 20 bp, human
gaatggagaatcagcgcggg

SEQ ID NO: 213998 - DNA, 20 bp, human
ggccaatggagaatcagcgc

SEQ ID NO: 213999 - DNA, 20 bp, human
gcactcccaggacgaagtca

SEQ ID NO: 214000 - DNA, 20 bp, human
gggctcgagccggttaatgg

SEQ ID NO: 214001 - DNA, 20 bp, human
gcggagctgctcgacctgct

SEQ ID NO: 214002 - DNA, 20 bp, human
gccggcccacccccattaac

SEQ ID NO: 214003 - DNA, 20 bp, human
gagtggctcgagccggttaa

SEQ ID NO: 214004 - DNA, 20 bp, human
gaccggctcgagccactccc

SEQ ID NO: 214005 - DNA, 20 bp, human
gcccacccccggaaggccaa

SEQ ID NO: 214006 - DNA, 20 bp, human
gggcgtgggggtaaacgcta

SEQ ID NO: 214007 - DNA, 20 bp, human
gcgcaggggcgggctcaagg

SEQ ID NO: 214008 - DNA, 20 bp, human
gaggcggggtacgtgggtcg

SEQ ID NO: 214009 - DNA, 20 bp, human
gtgggcaggcacggggacgg

SEQ ID NO: 214010 - DNA, 20 bp, human
gggggcggggcgcggctcat

SEQ ID NO: 214011 - DNA, 20 bp, human
gagggcggagggcccaacgg

SEQ ID NO: 214012 - DNA, 20 bp, human
gcgcttccggacacccggta

SEQ ID NO: 214013 - DNA, 20 bp, human
gcgggtgtccggaagcgcca

SEQ ID NO: 214014 - DNA, 20 bp, human
gctcccgaggcgggcgtcct

SEQ ID NO: 214015 - DNA, 20 bp, human
gcggggcgcggctcatgggc

SEQ ID NO: 214016 - DNA, 20 bp, human
gagggcgacaaaaaccgcgg

SEQ ID NO: 214017 - DNA, 20 bp, human
gcgcggaggcgcattggggt

SEQ ID NO: 214018 - DNA, 20 bp, human
ggaggagcaaaaaagcggca

SEQ ID NO: 214019 - DNA, 20 bp, human
gaaaaaccgcggaggcgcat

SEQ ID NO: 214020 - DNA, 20 bp, human
gaagacgcgcacgtcgggag

SEQ ID NO: 214021 - DNA, 20 bp, human
gtagagggcgacaaaaaccg

SEQ ID NO: 214022 - DNA, 20 bp, human
gttgctcctccaggctgtag

SEQ ID NO: 214023 - DNA, 20 bp, human
gtgcaggctctccatggaag

SEQ ID NO: 214024 - DNA, 20 bp, human
gcaagctcaagctttcaaaa

SEQ ID NO: 214025 - DNA, 20 bp, human
ggtcgccctctacagcctgg

SEQ ID NO: 214026 - DNA, 20 bp, human
ggggtctggtaaggccccgc

SEQ ID NO: 214027 - DNA, 20 bp, human
ggagaaggccgtcaagatgg

SEQ ID NO: 214028 - DNA, 20 bp, human
ggcaaggccaacgtggttgg

SEQ ID NO: 214029 - DNA, 20 bp, human
gggggcgtggccaaccatgc

SEQ ID NO: 214030 - DNA, 20 bp, human
ggccccgcctcccgcatggt

SEQ ID NO: 214031 - DNA, 20 bp, human
gtggccaaccatgcgggagg

SEQ ID NO: 214032 - DNA, 20 bp, human
ggccccgcctccaaccacgt

SEQ ID NO: 214033 - DNA, 20 bp, human
gtccccggccgccgaagcgt

SEQ ID NO: 214034 - DNA, 20 bp, human
ggaagcgtagggctggtgaa

SEQ ID NO: 214035 - DNA, 20 bp, human
ggaggctgggctgtgatccg

SEQ ID NO: 214036 - DNA, 20 bp, human
gggtcggcccgcagtgatgg

SEQ ID NO: 214037 - DNA, 20 bp, human
gaccctgggcaaacgcagga

SEQ ID NO: 214038 - DNA, 20 bp, human
gaacgcatgcgcagccgcgg

SEQ ID NO: 214039 - DNA, 20 bp, human
gaacgcaggagggccgagaa

SEQ ID NO: 214040 - DNA, 20 bp, human
ggacggcggaatcccctcaa

SEQ ID NO: 214041 - DNA, 20 bp, human
gcagggtcggcccgcagtga

SEQ ID NO: 214042 - DNA, 20 bp, human
gggtgccgatgagaagccgc

SEQ ID NO: 214043 - DNA, 20 bp, human
gaacaggtacaggaaaacgg

SEQ ID NO: 214044 - DNA, 20 bp, human
ggcgcaccaccgccccttct

SEQ ID NO: 214045 - DNA, 20 bp, human
ggtacaggaaaacgggggtc

SEQ ID NO: 214046 - DNA, 20 bp, human
gggtcggcccgcagtgatgg

SEQ ID NO: 214047 - DNA, 20 bp, human
gaccctgggcaaacgcagga

SEQ ID NO: 214048 - DNA, 20 bp, human
gaacgcatgcgcagccgcgg

SEQ ID NO: 214049 - DNA, 20 bp, human
gaacgcaggagggccgagaa

SEQ ID NO: 214050 - DNA, 20 bp, human
ggacggcggaatcccctcaa

SEQ ID NO: 214051 - DNA, 20 bp, human
gcagggtcggcccgcagtga

SEQ ID NO: 214052 - DNA, 20 bp, human
gggtgccgatgagaagccgc

SEQ ID NO: 214053 - DNA, 20 bp, human
gaacaggtacaggaaaacgg

SEQ ID NO: 214054 - DNA, 20 bp, human
ggcgcaccaccgccccttct

SEQ ID NO: 214055 - DNA, 20 bp, human
ggtacaggaaaacgggggtc

SEQ ID NO: 214056 - DNA, 20 bp, human
ggcccggcgtcctccaagat

SEQ ID NO: 214057 - DNA, 20 bp, human
gggcgtcctccaagatggga

SEQ ID NO: 214058 - DNA, 20 bp, human
gttccagggcgtctccgctc

SEQ ID NO: 214059 - DNA, 20 bp, human
gatgcgaagagctatgggga

SEQ ID NO: 214060 - DNA, 20 bp, human
gaactcgcgcaggcgccgag

SEQ ID NO: 214061 - DNA, 20 bp, human
gcacctccctcccatcttgg

SEQ ID NO: 214062 - DNA, 20 bp, human
gtggggaaggattcgaattc

SEQ ID NO: 214063 - DNA, 20 bp, human
gccccggttgcgtcattagt

SEQ ID NO: 214064 - DNA, 20 bp, human
ggggcgtctccgctcgggaa

SEQ ID NO: 214065 - DNA, 20 bp, human
gacgccgggccttgtagtcc

SEQ ID NO: 214066 - DNA, 20 bp, human
gcccgagcgtgagcgcgaga

SEQ ID NO: 214067 - DNA, 20 bp, human
gcgcgctcacgctcgggctg

SEQ ID NO: 214068 - DNA, 20 bp, human
ggggctgcagagtgcgtgcc

SEQ ID NO: 214069 - DNA, 20 bp, human
gcgaggtggccccacaacaa

SEQ ID NO: 214070 - DNA, 20 bp, human
gtggtcatgtggtcatcggg

SEQ ID NO: 214071 - DNA, 20 bp, human
ggccaggcgggcattgtccg

SEQ ID NO: 214072 - DNA, 20 bp, human
gcatcgggagggctagaggg

SEQ ID NO: 214073 - DNA, 20 bp, human
ggccgcgcagcctttgttgt

SEQ ID NO: 214074 - DNA, 20 bp, human
gacaacctacaaccgctccc

SEQ ID NO: 214075 - DNA, 20 bp, human
gctgcagagtgcgtgcctgg

SEQ ID NO: 214076 - DNA, 20 bp, human
gtggccccgcctctcctttc

SEQ ID NO: 214077 - DNA, 20 bp, human
ggaggagggagtgccctaaa

SEQ ID NO: 214078 - DNA, 20 bp, human
gagggagtgacgagtcaagg

SEQ ID NO: 214079 - DNA, 20 bp, human
ggttcagcccagcacagtag

SEQ ID NO: 214080 - DNA, 20 bp, human
gagcacagtaggggtcaatt

SEQ ID NO: 214081 - DNA, 20 bp, human
gagggagtgccctaaagggc

SEQ ID NO: 214082 - DNA, 20 bp, human
gtgactcacaagagaggggc

SEQ ID NO: 214083 - DNA, 20 bp, human
ggatggaagggggtgagaac

SEQ ID NO: 214084 - DNA, 20 bp, human
gctgggctgaacattatctg

SEQ ID NO: 214085 - DNA, 20 bp, human
gaagtgtcttaactgagacg

SEQ ID NO: 214086 - DNA, 20 bp, human
ggggacgcctggaatctcga

SEQ ID NO: 214087 - DNA, 20 bp, human
gtcctggctgggcccttcat

SEQ ID NO: 214088 - DNA, 20 bp, human
gcggccccgccttcctggtc

SEQ ID NO: 214089 - DNA, 20 bp, human
gtgagtgtctgggtctaaag

SEQ ID NO: 214090 - DNA, 20 bp, human
gcgcctggaatctcgagggg

SEQ ID NO: 214091 - DNA, 20 bp, human
gggtcaggacaatagcgtgg

SEQ ID NO: 214092 - DNA, 20 bp, human
gctggaatctcgaggggcgg

SEQ ID NO: 214093 - DNA, 20 bp, human
gccagccaggagtccggcta

SEQ ID NO: 214094 - DNA, 20 bp, human
gaacgggcggagcccatagc

SEQ ID NO: 214095 - DNA, 20 bp, human
gggagctcctgtcaccgctg

SEQ ID NO: 214096 - DNA, 20 bp, human
gggggggcgcgcggttggac

SEQ ID NO: 214097 - DNA, 20 bp, human
gttaccacgccctccttctg

SEQ ID NO: 214098 - DNA, 20 bp, human
gtctggggccgcaaccctgt

SEQ ID NO: 214099 - DNA, 20 bp, human
gattgggagccgcagaagga

SEQ ID NO: 214100 - DNA, 20 bp, human
gtggtgtaaaacccccgggg

SEQ ID NO: 214101 - DNA, 20 bp, human
gggcgcgcggttggaccggg

SEQ ID NO: 214102 - DNA, 20 bp, human
ggatggccccgcccccgctc

SEQ ID NO: 214103 - DNA, 20 bp, human
gggtctggaccgcaaggggg

SEQ ID NO: 214104 - DNA, 20 bp, human
gttgcggtccagacccaatc

SEQ ID NO: 214105 - DNA, 20 bp, human
ggccacagggtccggagcgg

SEQ ID NO: 214106 - DNA, 20 bp, human
gaggggcggggagaacgctg

SEQ ID NO: 214107 - DNA, 20 bp, human
gccgcccatgaggccggaag

SEQ ID NO: 214108 - DNA, 20 bp, human
gctcatgggcgggaggtccc

SEQ ID NO: 214109 - DNA, 20 bp, human
gccgccccttccggcctcat

SEQ ID NO: 214110 - DNA, 20 bp, human
ggacctcccgcccatgaggc

SEQ ID NO: 214111 - DNA, 20 bp, human
gcggggagaacgctgcggaa

SEQ ID NO: 214112 - DNA, 20 bp, human
gtccccggcgcgtcgttgct

SEQ ID NO: 214113 - DNA, 20 bp, human
ggcgccgagcaacgacgcgc

SEQ ID NO: 214114 - DNA, 20 bp, human
gatagcaccgggagctgccg

SEQ ID NO: 214115 - DNA, 20 bp, human
gaacgctgcggaatggtccc

SEQ ID NO: 214116 - DNA, 20 bp, human
gggcaaacagcaagctgcgg

SEQ ID NO: 214117 - DNA, 20 bp, human
gggggctgggcaaatagagt

SEQ ID NO: 214118 - DNA, 20 bp, human
gcaggggtcaagggttcagt

SEQ ID NO: 214119 - DNA, 20 bp, human
ggggagtgaagtagtctccc

SEQ ID NO: 214120 - DNA, 20 bp, human
gggcttgcaggtctcccggg

SEQ ID NO: 214121 - DNA, 20 bp, human
gactaaagaagagcactggt

SEQ ID NO: 214122 - DNA, 20 bp, human
gcggccctgttgctgctcac

SEQ ID NO: 214123 - DNA, 20 bp, human
gcccctccatgggagtgtgt

SEQ ID NO: 214124 - DNA, 20 bp, human
gacactcccatggaggggaa

SEQ ID NO: 214125 - DNA, 20 bp, human
ggcccacacactcccatgga

SEQ ID NO: 214126 - DNA, 20 bp, human
gcgctcggggctggagtctt

SEQ ID NO: 214127 - DNA, 20 bp, human
gaagggaagctggaccgggt

SEQ ID NO: 214128 - DNA, 20 bp, human
gggagagctggaatcccaag

SEQ ID NO: 214129 - DNA, 20 bp, human
gagctggaatcccaagtgga

SEQ ID NO: 214130 - DNA, 20 bp, human
ggctggcccggcctcttcgg

SEQ ID NO: 214131 - DNA, 20 bp, human
gcccggccccggcgcatgtg

SEQ ID NO: 214132 - DNA, 20 bp, human
ggctcgccccgcccccgaag

SEQ ID NO: 214133 - DNA, 20 bp, human
gcggattccggaagccgctc

SEQ ID NO: 214134 - DNA, 20 bp, human
ggaggccgggccagcacgcg

SEQ ID NO: 214135 - DNA, 20 bp, human
ggagcgccgcacatgcgccg

SEQ ID NO: 214136 - DNA, 20 bp, human
gatggaagactcatggtgat

SEQ ID NO: 214137 - DNA, 20 bp, human
gggggtacagctcttagtgg

SEQ ID NO: 214138 - DNA, 20 bp, human
gactatggatgggcccagtg

SEQ ID NO: 214139 - DNA, 20 bp, human
gctcttagtggaggctaagg

SEQ ID NO: 214140 - DNA, 20 bp, human
gagtccctgtcacctgacag

SEQ ID NO: 214141 - DNA, 20 bp, human
gcaagcacatggaagactca

SEQ ID NO: 214142 - DNA, 20 bp, human
gggtgacagggactatggat

SEQ ID NO: 214143 - DNA, 20 bp, human
gggctaagggggtacacttc

SEQ ID NO: 214144 - DNA, 20 bp, human
gtatgtgaggataaacaagt

SEQ ID NO: 214145 - DNA, 20 bp, human
gcaccccctgtcaggtgaca

SEQ ID NO: 214146 - DNA, 20 bp, human
ggcctcgaggcatcagtccc

SEQ ID NO: 214147 - DNA, 20 bp, human
gaaagtccaagaggcctctt

SEQ ID NO: 214148 - DNA, 20 bp, human
gtcagcttccacgtagtctc

SEQ ID NO: 214149 - DNA, 20 bp, human
gtggagcagaggggccacac

SEQ ID NO: 214150 - DNA, 20 bp, human
gaggggccacacaggagacg

SEQ ID NO: 214151 - DNA, 20 bp, human
gctgcagactggatgatggt

SEQ ID NO: 214152 - DNA, 20 bp, human
gctcaggcgatagttagaag

SEQ ID NO: 214153 - DNA, 20 bp, human
gaggcgatagttagaagtgg

SEQ ID NO: 214154 - DNA, 20 bp, human
ggcatcagtcccgggctcat

SEQ ID NO: 214155 - DNA, 20 bp, human
gcgtggagtcacactgagga

SEQ ID NO: 214156 - DNA, 20 bp, human
gaccccaggaacagttctct

SEQ ID NO: 214157 - DNA, 20 bp, human
gcgccctcttcccatgtctg

SEQ ID NO: 214158 - DNA, 20 bp, human
gagagctgttggggctcaag

SEQ ID NO: 214159 - DNA, 20 bp, human
gggcctagagaactgttcct

SEQ ID NO: 214160 - DNA, 20 bp, human
ggggtgtcttcctcagacat

SEQ ID NO: 214161 - DNA, 20 bp, human
gctacctcagtcacatagca

SEQ ID NO: 214162 - DNA, 20 bp, human
gagcccaaggaaggggtaac

SEQ ID NO: 214163 - DNA, 20 bp, human
ggactgacctaggtgagtca

SEQ ID NO: 214164 - DNA, 20 bp, human
gtaggtgagtcaaggaggct

SEQ ID NO: 214165 - DNA, 20 bp, human
gggtctgggacctttgcgaa

SEQ ID NO: 214166 - DNA, 20 bp, human
ggggccatggccagcgcctc

SEQ ID NO: 214167 - DNA, 20 bp, human
gatgcagccgcagccaccag

SEQ ID NO: 214168 - DNA, 20 bp, human
gactgaagacgcttggggaa

SEQ ID NO: 214169 - DNA, 20 bp, human
gcagccccgcaggtcccggt

SEQ ID NO: 214170 - DNA, 20 bp, human
gccccactgagacacaggaa

SEQ ID NO: 214171 - DNA, 20 bp, human
gagagcactgaagacgcttg

SEQ ID NO: 214172 - DNA, 20 bp, human
gcaaacaggtcaggcccggg

SEQ ID NO: 214173 - DNA, 20 bp, human
gccttgaagagcctcgggga

SEQ ID NO: 214174 - DNA, 20 bp, human
gggtccaaagggcgcctccc

SEQ ID NO: 214175 - DNA, 20 bp, human
ggaagaaggcacccctggtc

SEQ ID NO: 214176 - DNA, 20 bp, human
gtgagctgtctgtacaaaca

SEQ ID NO: 214177 - DNA, 20 bp, human
gtgagagggacattatcgtg

SEQ ID NO: 214178 - DNA, 20 bp, human
gaacagggggccgactgaga

SEQ ID NO: 214179 - DNA, 20 bp, human
gcatcctctgcccaagcagg

SEQ ID NO: 214180 - DNA, 20 bp, human
gtgactcattcccgcatctc

SEQ ID NO: 214181 - DNA, 20 bp, human
gcgataatgtccctctcagt

SEQ ID NO: 214182 - DNA, 20 bp, human
gccataactgcctgagatgc

SEQ ID NO: 214183 - DNA, 20 bp, human
gtgacatgaattttgtaggg

SEQ ID NO: 214184 - DNA, 20 bp, human
gcttcaatgacatctgaatt

SEQ ID NO: 214185 - DNA, 20 bp, human
gtcctggactttgttgcttc

SEQ ID NO: 214186 - DNA, 20 bp, human
gggaacctggcaggtgggta

SEQ ID NO: 214187 - DNA, 20 bp, human
gggccaccctcctaaatctc

SEQ ID NO: 214188 - DNA, 20 bp, human
gccagtggagctagggaatt

SEQ ID NO: 214189 - DNA, 20 bp, human
gctggcaggtgggtatggct

SEQ ID NO: 214190 - DNA, 20 bp, human
gaacataaggtgagctgaga

SEQ ID NO: 214191 - DNA, 20 bp, human
gtggagctagggaatttggg

SEQ ID NO: 214192 - DNA, 20 bp, human
gctctcccccagtggagcta

SEQ ID NO: 214193 - DNA, 20 bp, human
gggcaggcatcctgagattt

SEQ ID NO: 214194 - DNA, 20 bp, human
gggtgggggaatggaaaatc

SEQ ID NO: 214195 - DNA, 20 bp, human
gtagctgctgacagctgctt

SEQ ID NO: 214196 - DNA, 20 bp, human
ggacactgtggagtgacaat

SEQ ID NO: 214197 - DNA, 20 bp, human
gacagtgtctggtggttcag

SEQ ID NO: 214198 - DNA, 20 bp, human
gttgctctgatgatatatta

SEQ ID NO: 214199 - DNA, 20 bp, human
gctaatgagggtggcacact

SEQ ID NO: 214200 - DNA, 20 bp, human
gggtcctgcatcttcttccc

SEQ ID NO: 214201 - DNA, 20 bp, human
gcatgcctctgggcaagctt

SEQ ID NO: 214202 - DNA, 20 bp, human
gcctgtgggccacaggaatc

SEQ ID NO: 214203 - DNA, 20 bp, human
gagggggcaggtgagaagac

SEQ ID NO: 214204 - DNA, 20 bp, human
gaagttctctgccatgcctc

SEQ ID NO: 214205 - DNA, 20 bp, human
gcctcattagcgtcagaaca

SEQ ID NO: 214206 - DNA, 20 bp, human
ggacactgtggagtgacaat

SEQ ID NO: 214207 - DNA, 20 bp, human
gacagtgtctggtggttcag

SEQ ID NO: 214208 - DNA, 20 bp, human
gttgctctgatgatatatta

SEQ ID NO: 214209 - DNA, 20 bp, human
gctaatgagggtggcacact

SEQ ID NO: 214210 - DNA, 20 bp, human
gggtcctgcatcttcttccc

SEQ ID NO: 214211 - DNA, 20 bp, human
gcatgcctctgggcaagctt

SEQ ID NO: 214212 - DNA, 20 bp, human
gcctgtgggccacaggaatc

SEQ ID NO: 214213 - DNA, 20 bp, human
gagggggcaggtgagaagac

SEQ ID NO: 214214 - DNA, 20 bp, human
gaagttctctgccatgcctc

SEQ ID NO: 214215 - DNA, 20 bp, human
gcctcattagcgtcagaaca

SEQ ID NO: 214216 - DNA, 20 bp, human
gtgccagcgggaagggtccg

SEQ ID NO: 214217 - DNA, 20 bp, human
gggaggggccatgactcata

SEQ ID NO: 214218 - DNA, 20 bp, human
gttccccggacccttcccgc

SEQ ID NO: 214219 - DNA, 20 bp, human
gcccagggccttatgagtca

SEQ ID NO: 214220 - DNA, 20 bp, human
ggttcctctgccagcgggaa

SEQ ID NO: 214221 - DNA, 20 bp, human
ggccatgactcataaggccc

SEQ ID NO: 214222 - DNA, 20 bp, human
gggcaggtcagcccctcaga

SEQ ID NO: 214223 - DNA, 20 bp, human
ggaagaggggacgcatgcca

SEQ ID NO: 214224 - DNA, 20 bp, human
ggtggactccgcacagcaca

SEQ ID NO: 214225 - DNA, 20 bp, human
gtttctctttgcaattccgt

SEQ ID NO: 214226 - DNA, 20 bp, human
ggggcccctcctactggcag

SEQ ID NO: 214227 - DNA, 20 bp, human
gttctccgggcccctcctac

SEQ ID NO: 214228 - DNA, 20 bp, human
ggttcctctgccagtaggag

SEQ ID NO: 214229 - DNA, 20 bp, human
gggaggggccatgattcaca

SEQ ID NO: 214230 - DNA, 20 bp, human
gcccagggccttgtgaatca

SEQ ID NO: 214231 - DNA, 20 bp, human
gcggaggttcctctgccagt

SEQ ID NO: 214232 - DNA, 20 bp, human
ggaagaggggatgcgtgcga

SEQ ID NO: 214233 - DNA, 20 bp, human
ggccatgattcacaaggccc

SEQ ID NO: 214234 - DNA, 20 bp, human
gcttctttttgcagttccgt

SEQ ID NO: 214235 - DNA, 20 bp, human
gaagctgggaggttggaaga

SEQ ID NO: 214236 - DNA, 20 bp, human
ggggcccctcctactggcag

SEQ ID NO: 214237 - DNA, 20 bp, human
gttctccgggcccctcctac

SEQ ID NO: 214238 - DNA, 20 bp, human
ggttcctctgccagtaggag

SEQ ID NO: 214239 - DNA, 20 bp, human
gggaggggccatgattcaca

SEQ ID NO: 214240 - DNA, 20 bp, human
gcccagggccttgtgaatca

SEQ ID NO: 214241 - DNA, 20 bp, human
gcggaggttcctctgccagt

SEQ ID NO: 214242 - DNA, 20 bp, human
ggaagaggggatgcgtgcga

SEQ ID NO: 214243 - DNA, 20 bp, human
ggccatgattcacaaggccc

SEQ ID NO: 214244 - DNA, 20 bp, human
gcttctttttgcagttccgt

SEQ ID NO: 214245 - DNA, 20 bp, human
gaagctgggaggttggaaga

SEQ ID NO: 214246 - DNA, 20 bp, human
gcaggtgtctgcctctcccc

SEQ ID NO: 214247 - DNA, 20 bp, human
gcagccagcgcccgcgaggt

SEQ ID NO: 214248 - DNA, 20 bp, human
gctggtgtggacccacctcg

SEQ ID NO: 214249 - DNA, 20 bp, human
gattgcagccagcgcccgcg

SEQ ID NO: 214250 - DNA, 20 bp, human
ggcgcgcatggcatcccggt

SEQ ID NO: 214251 - DNA, 20 bp, human
gtgggcctcagatgtcccac

SEQ ID NO: 214252 - DNA, 20 bp, human
gctcagtgtgggggcgcgca

SEQ ID NO: 214253 - DNA, 20 bp, human
ggggggcgcgcatggcatcc

SEQ ID NO: 214254 - DNA, 20 bp, human
ggggccctccccctggcaga

SEQ ID NO: 214255 - DNA, 20 bp, human
ggggaggggccatgactacg

SEQ ID NO: 214256 - DNA, 20 bp, human
gcctccgagggtgacggcct

SEQ ID NO: 214257 - DNA, 20 bp, human
gggagggagagtaaatggcc

SEQ ID NO: 214258 - DNA, 20 bp, human
ggcgcgcatggcatcccggt

SEQ ID NO: 214259 - DNA, 20 bp, human
gtgggcctcagatgtcccac

SEQ ID NO: 214260 - DNA, 20 bp, human
gagtcattgcagccagcgcc

SEQ ID NO: 214261 - DNA, 20 bp, human
gctcagtgtgggggcgcgca

SEQ ID NO: 214262 - DNA, 20 bp, human
ggggggcgcgcatggcatcc

SEQ ID NO: 214263 - DNA, 20 bp, human
ggggccctccccctggcaga

SEQ ID NO: 214264 - DNA, 20 bp, human
gcctgagcaggaagcgggag

SEQ ID NO: 214265 - DNA, 20 bp, human
gcgggaggtgggtccacacc

SEQ ID NO: 214266 - DNA, 20 bp, human
gtccaccctcttccttttgt

SEQ ID NO: 214267 - DNA, 20 bp, human
gtgtacctggagagggaatt

SEQ ID NO: 214268 - DNA, 20 bp, human
gggggtgcttcagatccctc

SEQ ID NO: 214269 - DNA, 20 bp, human
gccagtcccacaaaaggaag

SEQ ID NO: 214270 - DNA, 20 bp, human
gctggggagggagttgagtc

SEQ ID NO: 214271 - DNA, 20 bp, human
gaaaagtcactgcttgatga

SEQ ID NO: 214272 - DNA, 20 bp, human
gtgtaaactatacctgggga

SEQ ID NO: 214273 - DNA, 20 bp, human
gacttcccctgccaagcccg

SEQ ID NO: 214274 - DNA, 20 bp, human
gtatttcctcgggcttggca

SEQ ID NO: 214275 - DNA, 20 bp, human
gagttgagtctggctgtacc

SEQ ID NO: 214276 - DNA, 20 bp, human
gggactgcatatcccagtct

SEQ ID NO: 214277 - DNA, 20 bp, human
gctactctagaccaggagaa

SEQ ID NO: 214278 - DNA, 20 bp, human
gaggcccatagtccctgaag

SEQ ID NO: 214279 - DNA, 20 bp, human
gaggcttgccctctgtgaga

SEQ ID NO: 214280 - DNA, 20 bp, human
gctctgctccctctcacaga

SEQ ID NO: 214281 - DNA, 20 bp, human
gctggcacctactctagacc

SEQ ID NO: 214282 - DNA, 20 bp, human
gatatcccagtctgggtaaa

SEQ ID NO: 214283 - DNA, 20 bp, human
gcacccccttcagggactat

SEQ ID NO: 214284 - DNA, 20 bp, human
gacagagggcaagcctccca

SEQ ID NO: 214285 - DNA, 20 bp, human
ggagaaaggtgctgaggagc

SEQ ID NO: 214286 - DNA, 20 bp, human
gggagaccttagaactgggg

SEQ ID NO: 214287 - DNA, 20 bp, human
gctggggtggggacgcatca

SEQ ID NO: 214288 - DNA, 20 bp, human
gtgtgggcatcaggggccgt

SEQ ID NO: 214289 - DNA, 20 bp, human
gaggaagtgcctttggtcct

SEQ ID NO: 214290 - DNA, 20 bp, human
gggggctactgtgggcatca

SEQ ID NO: 214291 - DNA, 20 bp, human
gaatgggtgtacatcacaca

SEQ ID NO: 214292 - DNA, 20 bp, human
gcaaccttccccaggaccaa

SEQ ID NO: 214293 - DNA, 20 bp, human
gaaggttggcttgtcttggt

SEQ ID NO: 214294 - DNA, 20 bp, human
gcccactgcagcccgggaaa

SEQ ID NO: 214295 - DNA, 20 bp, human
ggcaggagaccttagaactg

SEQ ID NO: 214296 - DNA, 20 bp, human
gggcaggtcccaggcacgcg

SEQ ID NO: 214297 - DNA, 20 bp, human
gtgggaaaaccgcacgagaa

SEQ ID NO: 214298 - DNA, 20 bp, human
ggtaaagcctgaggcctccg

SEQ ID NO: 214299 - DNA, 20 bp, human
gatggagagaggaaatactc

SEQ ID NO: 214300 - DNA, 20 bp, human
ggacttggaggcaactccag

SEQ ID NO: 214301 - DNA, 20 bp, human
gggccagaccctggcggctg

SEQ ID NO: 214302 - DNA, 20 bp, human
gtcctcccgctgctcgccat

SEQ ID NO: 214303 - DNA, 20 bp, human
gctcaggaggatgcggccga

SEQ ID NO: 214304 - DNA, 20 bp, human
gaaggacctgagctgatggg

SEQ ID NO: 214305 - DNA, 20 bp, human
ggccgatggcgagcagcggg

SEQ ID NO: 214306 - DNA, 20 bp, human
gaccccaacgctcacgggac

SEQ ID NO: 214307 - DNA, 20 bp, human
ggtggggaaagggactaagg

SEQ ID NO: 214308 - DNA, 20 bp, human
gaagggactaaggtggtctg

SEQ ID NO: 214309 - DNA, 20 bp, human
gtccccactcagaatgtagc

SEQ ID NO: 214310 - DNA, 20 bp, human
gtgagagtgctgaacgggga

SEQ ID NO: 214311 - DNA, 20 bp, human
gaggaaggggtttattcgtt

SEQ ID NO: 214312 - DNA, 20 bp, human
gagacgctgagttaaggaag

SEQ ID NO: 214313 - DNA, 20 bp, human
gtaggagcgccgggccaact

SEQ ID NO: 214314 - DNA, 20 bp, human
gctcctgctacattctgagt

SEQ ID NO: 214315 - DNA, 20 bp, human
gttcctcagacgctgagtta

SEQ ID NO: 214316 - DNA, 20 bp, human
gtcccccaaggtcacgtcac

SEQ ID NO: 214317 - DNA, 20 bp, human
gccctgtgacgtgaccttgg

SEQ ID NO: 214318 - DNA, 20 bp, human
gccaacccagcctctgtcgg

SEQ ID NO: 214319 - DNA, 20 bp, human
gagggcgaagctctcagtga

SEQ ID NO: 214320 - DNA, 20 bp, human
gctggccaacagaactgcgg

SEQ ID NO: 214321 - DNA, 20 bp, human
gtctcagtgagggccatcat

SEQ ID NO: 214322 - DNA, 20 bp, human
gaaccttctctcaagtgaca

SEQ ID NO: 214323 - DNA, 20 bp, human
gaccccctccgcagttctgt

SEQ ID NO: 214324 - DNA, 20 bp, human
gagaagaggtgacacctgat

SEQ ID NO: 214325 - DNA, 20 bp, human
ggttccctgtgacgtgacct

SEQ ID NO: 214326 - DNA, 20 bp, human
ggggagccagtcagctagga

SEQ ID NO: 214327 - DNA, 20 bp, human
gtccagatgcagcaagcggg

SEQ ID NO: 214328 - DNA, 20 bp, human
gctgctgaccagtggagatg

SEQ ID NO: 214329 - DNA, 20 bp, human
gggtgtccagatgcagcaag

SEQ ID NO: 214330 - DNA, 20 bp, human
ggcgtggactcagtctccta

SEQ ID NO: 214331 - DNA, 20 bp, human
gctagctgactggctcccca

SEQ ID NO: 214332 - DNA, 20 bp, human
gccggcaaggcctggttaca

SEQ ID NO: 214333 - DNA, 20 bp, human
gaaggtcacctgctgaccag

SEQ ID NO: 214334 - DNA, 20 bp, human
gagtcagctaggaaggaatg

SEQ ID NO: 214335 - DNA, 20 bp, human
gctactccaggctgtgttca

SEQ ID NO: 214336 - DNA, 20 bp, human
gaaactgaggccagcaaatg

SEQ ID NO: 214337 - DNA, 20 bp, human
gttctctcagggcactgtgt

SEQ ID NO: 214338 - DNA, 20 bp, human
gaagtctctgccaagcgggg

SEQ ID NO: 214339 - DNA, 20 bp, human
gtgtgctcaactctgcgggc

SEQ ID NO: 214340 - DNA, 20 bp, human
gcagcaaatgaggctgtcat

SEQ ID NO: 214341 - DNA, 20 bp, human
gtctctgccaagcggggagg

SEQ ID NO: 214342 - DNA, 20 bp, human
gaactctgcgggccggggga

SEQ ID NO: 214343 - DNA, 20 bp, human
ggaacctgcctcagtgcagg

SEQ ID NO: 214344 - DNA, 20 bp, human
gtcagaggtcatgcctctgt

SEQ ID NO: 214345 - DNA, 20 bp, human
gaggtgacagtggcaatcag

SEQ ID NO: 214346 - DNA, 20 bp, human
gcagctgtgaaggaaatcgg

SEQ ID NO: 214347 - DNA, 20 bp, human
gcgcccccatccagtcagga

SEQ ID NO: 214348 - DNA, 20 bp, human
gccgccgcccccatccagtc

SEQ ID NO: 214349 - DNA, 20 bp, human
gaaccctcctgactggatgg

SEQ ID NO: 214350 - DNA, 20 bp, human
gttaggccaaccctcctgac

SEQ ID NO: 214351 - DNA, 20 bp, human
gtgtatcgaaacacaaagat

SEQ ID NO: 214352 - DNA, 20 bp, human
ggagtcaggtaatggcgcga

SEQ ID NO: 214353 - DNA, 20 bp, human
gcgatacagactaagctttt

SEQ ID NO: 214354 - DNA, 20 bp, human
gattacctgactcccattag

SEQ ID NO: 214355 - DNA, 20 bp, human
ggactccactaatgggagtc

SEQ ID NO: 214356 - DNA, 20 bp, human
gcagcccccagtcacgaggt

SEQ ID NO: 214357 - DNA, 20 bp, human
gcgaggtgtcctcccttcct

SEQ ID NO: 214358 - DNA, 20 bp, human
gttggcccccagaatggagg

SEQ ID NO: 214359 - DNA, 20 bp, human
gtgggggccaagcgtggaag

SEQ ID NO: 214360 - DNA, 20 bp, human
gccacgcttggcccccagaa

SEQ ID NO: 214361 - DNA, 20 bp, human
ggggccagcccccagtcacg

SEQ ID NO: 214362 - DNA, 20 bp, human
gggagggtgtctgtattact

SEQ ID NO: 214363 - DNA, 20 bp, human
gggaaggaggtggggcatag

SEQ ID NO: 214364 - DNA, 20 bp, human
gacagcccacctcgtgactg

SEQ ID NO: 214365 - DNA, 20 bp, human
gccgccctatccctggggga

SEQ ID NO: 214366 - DNA, 20 bp, human
gaacaggactgtaggcatag

SEQ ID NO: 214367 - DNA, 20 bp, human
gaggttgagtgtgtgacaag

SEQ ID NO: 214368 - DNA, 20 bp, human
gtgccaaagaacaggactgt

SEQ ID NO: 214369 - DNA, 20 bp, human
gttagagtgggaatgtggca

SEQ ID NO: 214370 - DNA, 20 bp, human
gcctatcatgagcttagagt

SEQ ID NO: 214371 - DNA, 20 bp, human
gcctcatgggacacagaact

SEQ ID NO: 214372 - DNA, 20 bp, human
gtaagctcatgataggagcc

SEQ ID NO: 214373 - DNA, 20 bp, human
ggtgtgtgacaaggggcaca

SEQ ID NO: 214374 - DNA, 20 bp, human
gttctgtgtcccatgaggaa

SEQ ID NO: 214375 - DNA, 20 bp, human
gaatatttgcccatttatac

SEQ ID NO: 214376 - DNA, 20 bp, human
gcataacagagccacataag

SEQ ID NO: 214377 - DNA, 20 bp, human
gccaaggctgtgagtgaaac

SEQ ID NO: 214378 - DNA, 20 bp, human
ggacagaaacttgttgtttc

SEQ ID NO: 214379 - DNA, 20 bp, human
gataaaagtacaccagaaaa

SEQ ID NO: 214380 - DNA, 20 bp, human
gctggaacatcattttagag

SEQ ID NO: 214381 - DNA, 20 bp, human
ggtaaatgattaaagaatgt

SEQ ID NO: 214382 - DNA, 20 bp, human
ggctctgttatgaaatcttt

SEQ ID NO: 214383 - DNA, 20 bp, human
gatagctctaaggtcctaac

SEQ ID NO: 214384 - DNA, 20 bp, human
gacaaagaatgtcttccagg

SEQ ID NO: 214385 - DNA, 20 bp, human
gttatgaaatctttgggaga

SEQ ID NO: 214386 - DNA, 20 bp, human
gccttcaaatggttgttgag

SEQ ID NO: 214387 - DNA, 20 bp, human
gaaatcatctggcttgggac

SEQ ID NO: 214388 - DNA, 20 bp, human
gtggaaaatggtaaatcatc

SEQ ID NO: 214389 - DNA, 20 bp, human
gagccgggctatgtgtcccg

SEQ ID NO: 214390 - DNA, 20 bp, human
gatagtgtatatgaggtatt

SEQ ID NO: 214391 - DNA, 20 bp, human
gcgggctatgtgtcccgagg

SEQ ID NO: 214392 - DNA, 20 bp, human
gacgggaccactgtggaaaa

SEQ ID NO: 214393 - DNA, 20 bp, human
gatggtaaatcatctggctt

SEQ ID NO: 214394 - DNA, 20 bp, human
ggacacatagcccggcttgc

SEQ ID NO: 214395 - DNA, 20 bp, human
gaatacgtaatctcttctcc

SEQ ID NO: 214396 - DNA, 20 bp, human
ggtctcaggctgctcctcta

SEQ ID NO: 214397 - DNA, 20 bp, human
gtgagagggatctggatgtc

SEQ ID NO: 214398 - DNA, 20 bp, human
ggggctggactgaaggtgga

SEQ ID NO: 214399 - DNA, 20 bp, human
gaggatggggagtaatctgc

SEQ ID NO: 214400 - DNA, 20 bp, human
gagccctgaggatgcgaggc

SEQ ID NO: 214401 - DNA, 20 bp, human
ggtggatgcacgggaggatg

SEQ ID NO: 214402 - DNA, 20 bp, human
ggtctcccacacatgccttg

SEQ ID NO: 214403 - DNA, 20 bp, human
gagcatccacaaggcatgtg

SEQ ID NO: 214404 - DNA, 20 bp, human
gttactcctgcccgtgccat

SEQ ID NO: 214405 - DNA, 20 bp, human
gctgctgtgcgcgatgactg

SEQ ID NO: 214406 - DNA, 20 bp, human
ggacccggatgtctggtctg

SEQ ID NO: 214407 - DNA, 20 bp, human
gcagccgcagaccagacatc

SEQ ID NO: 214408 - DNA, 20 bp, human
gtgtcagctgcccatgtctc

SEQ ID NO: 214409 - DNA, 20 bp, human
gctcacatcctcaggattca

SEQ ID NO: 214410 - DNA, 20 bp, human
gtgagagggacccggatgtc

SEQ ID NO: 214411 - DNA, 20 bp, human
gaactccccaggctcaactc

SEQ ID NO: 214412 - DNA, 20 bp, human
gaactgcagagatcggggcg

SEQ ID NO: 214413 - DNA, 20 bp, human
gcagcagaccttgaatcctg

SEQ ID NO: 214414 - DNA, 20 bp, human
ggggggcaagcggctcagat

SEQ ID NO: 214415 - DNA, 20 bp, human
gtcgaattccagggtatatc

SEQ ID NO: 214416 - DNA, 20 bp, human
gtggccaagaaggacgtctg

SEQ ID NO: 214417 - DNA, 20 bp, human
gcaagggtgctgctggacca

SEQ ID NO: 214418 - DNA, 20 bp, human
gagcaggagggtgggaccaa

SEQ ID NO: 214419 - DNA, 20 bp, human
gtggggagtgtggtgttatt

SEQ ID NO: 214420 - DNA, 20 bp, human
gcacctgcctcccatactta

SEQ ID NO: 214421 - DNA, 20 bp, human
gaacccccaaccctaagtat

SEQ ID NO: 214422 - DNA, 20 bp, human
ggtaatgctgatggcatgga

SEQ ID NO: 214423 - DNA, 20 bp, human
ggggctgctcttggatcagc

SEQ ID NO: 214424 - DNA, 20 bp, human
gtgctcttggatcagcagga

SEQ ID NO: 214425 - DNA, 20 bp, human
gctcccatacttagggttgg

SEQ ID NO: 214426 - DNA, 20 bp, human
gtgggctgcacaattgggca

SEQ ID NO: 214427 - DNA, 20 bp, human
ggcacaattgggcagggctt

SEQ ID NO: 214428 - DNA, 20 bp, human
gtctaggcgagtctaccagt

SEQ ID NO: 214429 - DNA, 20 bp, human
gaatctttgtcgtctgcatc

SEQ ID NO: 214430 - DNA, 20 bp, human
gctccctccatgtcgctgcg

SEQ ID NO: 214431 - DNA, 20 bp, human
gcattgctgcctagatctgc

SEQ ID NO: 214432 - DNA, 20 bp, human
gacccctcttttcctgccca

SEQ ID NO: 214433 - DNA, 20 bp, human
gtagtgctttctatcttgat

SEQ ID NO: 214434 - DNA, 20 bp, human
gcaattgtgcagcccagaca

SEQ ID NO: 214435 - DNA, 20 bp, human
gaggccccgcagcgacatgg

SEQ ID NO: 214436 - DNA, 20 bp, human
ggagagacaggtttcaggca

SEQ ID NO: 214437 - DNA, 20 bp, human
gtggtctcattttggcacct

SEQ ID NO: 214438 - DNA, 20 bp, human
gactgggagagacaggtttc

SEQ ID NO: 214439 - DNA, 20 bp, human
gaaaaaaaataggtgaggac

SEQ ID NO: 214440 - DNA, 20 bp, human
gaggtttcaggcatggagaa

SEQ ID NO: 214441 - DNA, 20 bp, human
gctcactgcagtaacctccc

SEQ ID NO: 214442 - DNA, 20 bp, human
gcttttggaaggatgattta

SEQ ID NO: 214443 - DNA, 20 bp, human
gtttggagatggtctcattt

SEQ ID NO: 214444 - DNA, 20 bp, human
gagctgctatggcttttgga

SEQ ID NO: 214445 - DNA, 20 bp, human
gctcattttggcacctgggc

SEQ ID NO: 214446 - DNA, 20 bp, human
gggctcttccaggaaatcat

SEQ ID NO: 214447 - DNA, 20 bp, human
gaaagagcagaatccaagtc

SEQ ID NO: 214448 - DNA, 20 bp, human
gagcccatgagcaagcgatg

SEQ ID NO: 214449 - DNA, 20 bp, human
gcgccccatcgcttgctcat

SEQ ID NO: 214450 - DNA, 20 bp, human
gggaaactgaaagtgacagc

SEQ ID NO: 214451 - DNA, 20 bp, human
gttctctaattggatgaaca

SEQ ID NO: 214452 - DNA, 20 bp, human
gggacagagacgagagactc

SEQ ID NO: 214453 - DNA, 20 bp, human
ggggctggagaaagacggat

SEQ ID NO: 214454 - DNA, 20 bp, human
gaaagctctagggctcttcc

SEQ ID NO: 214455 - DNA, 20 bp, human
ggagcagaatccaagtcagg

SEQ ID NO: 214456 - DNA, 20 bp, human
ggaaaggcagggtatcccac

SEQ ID NO: 214457 - DNA, 20 bp, human
gctagaaggacgtgacatgg

SEQ ID NO: 214458 - DNA, 20 bp, human
gcatctagaaggacgtgaca

SEQ ID NO: 214459 - DNA, 20 bp, human
ggttctcttcctgcgttcag

SEQ ID NO: 214460 - DNA, 20 bp, human
gcacagcacatcccgtattt

SEQ ID NO: 214461 - DNA, 20 bp, human
gttcgctttcccctgaacgc

SEQ ID NO: 214462 - DNA, 20 bp, human
gtatagttccagagaaccaa

SEQ ID NO: 214463 - DNA, 20 bp, human
gcagcctggggtgcgtttga

SEQ ID NO: 214464 - DNA, 20 bp, human
gagcggctatgtcagatatg

SEQ ID NO: 214465 - DNA, 20 bp, human
gcctgctgccttcatctaga

SEQ ID NO: 214466 - DNA, 20 bp, human
ggacccgaaacggcactcac

SEQ ID NO: 214467 - DNA, 20 bp, human
gacaaagggcaggagatcga

SEQ ID NO: 214468 - DNA, 20 bp, human
gggcggagccgcggggtggt

SEQ ID NO: 214469 - DNA, 20 bp, human
ggtgagttaggagggttcga

SEQ ID NO: 214470 - DNA, 20 bp, human
gcggtccgtggggaagtcgg

SEQ ID NO: 214471 - DNA, 20 bp, human
gttcgggtctatagtgagtt

SEQ ID NO: 214472 - DNA, 20 bp, human
ggtgggaaggcagtagacgc

SEQ ID NO: 214473 - DNA, 20 bp, human
gtgacggtccgtggggaagt

SEQ ID NO: 214474 - DNA, 20 bp, human
gcgttctgctggaacaccgt

SEQ ID NO: 214475 - DNA, 20 bp, human
ggctccctgcttattgtgat

SEQ ID NO: 214476 - DNA, 20 bp, human
ggtacgcggaggcgcgagga

SEQ ID NO: 214477 - DNA, 20 bp, human
gctaggcggcaagaaagcgc

SEQ ID NO: 214478 - DNA, 20 bp, human
ggcgcccagcggcgtgtact

SEQ ID NO: 214479 - DNA, 20 bp, human
gtatagagaggtgactacgg

SEQ ID NO: 214480 - DNA, 20 bp, human
ggctctgtgtggacggtacg

SEQ ID NO: 214481 - DNA, 20 bp, human
gaatcccagtacacgccgct

SEQ ID NO: 214482 - DNA, 20 bp, human
ggcgacgcggcttctagaac

SEQ ID NO: 214483 - DNA, 20 bp, human
gtgactacggaggcccggta

SEQ ID NO: 214484 - DNA, 20 bp, human
gctgtgtggacggtacgcgg

SEQ ID NO: 214485 - DNA, 20 bp, human
gcctggcgttgccgcggcgc

SEQ ID NO: 214486 - DNA, 20 bp, human
ggcaaggggcgtaacggggt

SEQ ID NO: 214487 - DNA, 20 bp, human
gggcaggcaaggggcgtaac

SEQ ID NO: 214488 - DNA, 20 bp, human
ggaccgggagggtcaaccac

SEQ ID NO: 214489 - DNA, 20 bp, human
ggccgccttggcaactgctg

SEQ ID NO: 214490 - DNA, 20 bp, human
gttggcaactgctgcggttt

SEQ ID NO: 214491 - DNA, 20 bp, human
ggcggagaaaaggcggtaac

SEQ ID NO: 214492 - DNA, 20 bp, human
gaccgcagcagttgccaagg

SEQ ID NO: 214493 - DNA, 20 bp, human
gagaaaaggcggtaactggc

SEQ ID NO: 214494 - DNA, 20 bp, human
ggggacaaatcagttcgact

SEQ ID NO: 214495 - DNA, 20 bp, human
gttgccaaggcggctggagg

SEQ ID NO: 214496 - DNA, 20 bp, human
gaacccggggacacctcctc

SEQ ID NO: 214497 - DNA, 20 bp, human
gagtgaccgcgaccaaggag

SEQ ID NO: 214498 - DNA, 20 bp, human
gccttggtcgcggtcactcc

SEQ ID NO: 214499 - DNA, 20 bp, human
gtcgctgcgccgctggcggt

SEQ ID NO: 214500 - DNA, 20 bp, human
ggcgcacggcagcattgcga

SEQ ID NO: 214501 - DNA, 20 bp, human
gtaggcgcggacgccggagg

SEQ ID NO: 214502 - DNA, 20 bp, human
gcgcccagcggggtaagcag

SEQ ID NO: 214503 - DNA, 20 bp, human
ggaccaaggagcggccgccc

SEQ ID NO: 214504 - DNA, 20 bp, human
gggcgcgaggggccgcttta

SEQ ID NO: 214505 - DNA, 20 bp, human
gacgccggaggaggtgtccc

SEQ ID NO: 214506 - DNA, 20 bp, human
ggccgctaggggtctctctc

SEQ ID NO: 214507 - DNA, 20 bp, human
gtgggccgtcggccggggag

SEQ ID NO: 214508 - DNA, 20 bp, human
ggagggacggtgcaggatca

SEQ ID NO: 214509 - DNA, 20 bp, human
gcaagggcgcgtgcacctgt

SEQ ID NO: 214510 - DNA, 20 bp, human
gcccggccgacggcccacct

SEQ ID NO: 214511 - DNA, 20 bp, human
gttccccggcggcgccgcta

SEQ ID NO: 214512 - DNA, 20 bp, human
gggggtgcaggcggcgccaa

SEQ ID NO: 214513 - DNA, 20 bp, human
gggcttcgtgaacagtggga

SEQ ID NO: 214514 - DNA, 20 bp, human
gctgtgggcgcggggcgcga

SEQ ID NO: 214515 - DNA, 20 bp, human
gcaagctcacggggacgagc

SEQ ID NO: 214516 - DNA, 20 bp, human
gaagcggccccggagtggag

SEQ ID NO: 214517 - DNA, 20 bp, human
gtggaagggacgctctccgt

SEQ ID NO: 214518 - DNA, 20 bp, human
gcgtcccttccaagcggccc

SEQ ID NO: 214519 - DNA, 20 bp, human
gcccctgcagagatcagcgc

SEQ ID NO: 214520 - DNA, 20 bp, human
gcggaggggaggaatgcggc

SEQ ID NO: 214521 - DNA, 20 bp, human
ggccccgagtgactcggaac

SEQ ID NO: 214522 - DNA, 20 bp, human
gggagagcgtcccttccaag

SEQ ID NO: 214523 - DNA, 20 bp, human
gaacctgctgaagtaaccga

SEQ ID NO: 214524 - DNA, 20 bp, human
gtaagcgcacgccggcgcgc

SEQ ID NO: 214525 - DNA, 20 bp, human
gaggggaggaatgcggcagg

SEQ ID NO: 214526 - DNA, 20 bp, human
gtggtcgggaggttcccgtg

SEQ ID NO: 214527 - DNA, 20 bp, human
gggagagcctagcgccgcac

SEQ ID NO: 214528 - DNA, 20 bp, human
ggggacgcccatccgcgctg

SEQ ID NO: 214529 - DNA, 20 bp, human
gcgagcgcgggcgtcggaag

SEQ ID NO: 214530 - DNA, 20 bp, human
gtcctcgcgccggcaagctg

SEQ ID NO: 214531 - DNA, 20 bp, human
gccaccgccgcagcgcggat

SEQ ID NO: 214532 - DNA, 20 bp, human
ggaggtggcagtgtctgccc

SEQ ID NO: 214533 - DNA, 20 bp, human
gggcccgccctctccggcaa

SEQ ID NO: 214534 - DNA, 20 bp, human
ggccgctcggcgcctggaga

SEQ ID NO: 214535 - DNA, 20 bp, human
gctcccgcgagcgcgggcgt

SEQ ID NO: 214536 - DNA, 20 bp, human
gggtgccagtcccgttgctg

SEQ ID NO: 214537 - DNA, 20 bp, human
gccggagctcaccacacttc

SEQ ID NO: 214538 - DNA, 20 bp, human
gggtcccgacaccggaaatg

SEQ ID NO: 214539 - DNA, 20 bp, human
ggttccctcagcaacgggac

SEQ ID NO: 214540 - DNA, 20 bp, human
gaagtgtggcgcgcccggca

SEQ ID NO: 214541 - DNA, 20 bp, human
gagcgcgggcgccacatttc

SEQ ID NO: 214542 - DNA, 20 bp, human
gtgagctccggtcccgacac

SEQ ID NO: 214543 - DNA, 20 bp, human
gacaggaagtgtggcgcgcc

SEQ ID NO: 214544 - DNA, 20 bp, human
ggccggatcaacaggaagtg

SEQ ID NO: 214545 - DNA, 20 bp, human
gcagagaacaaacacccgaa

SEQ ID NO: 214546 - DNA, 20 bp, human
gccagggcgcgcatccgcga

SEQ ID NO: 214547 - DNA, 20 bp, human
gcggggaagagccgcctcaa

SEQ ID NO: 214548 - DNA, 20 bp, human
gagtccatgaaatacggtac

SEQ ID NO: 214549 - DNA, 20 bp, human
gagggcggagcgtgggtgag

SEQ ID NO: 214550 - DNA, 20 bp, human
gtggcgcgcggggtggagaa

SEQ ID NO: 214551 - DNA, 20 bp, human
gtccccggagggcggagcgt

SEQ ID NO: 214552 - DNA, 20 bp, human
gcgtacgcgcgccaggtgcg

SEQ ID NO: 214553 - DNA, 20 bp, human
ggcgtagcccgagacaagga

SEQ ID NO: 214554 - DNA, 20 bp, human
gggggtggggcatccccgga

SEQ ID NO: 214555 - DNA, 20 bp, human
ggcgcgcagcgtggggatct

SEQ ID NO: 214556 - DNA, 20 bp, human
gagagagaacccaattgggg

SEQ ID NO: 214557 - DNA, 20 bp, human
gcgctgcgggatgacgtcag

SEQ ID NO: 214558 - DNA, 20 bp, human
gggcccagagagaacccaat

SEQ ID NO: 214559 - DNA, 20 bp, human
gctgggccgtggtccaactg

SEQ ID NO: 214560 - DNA, 20 bp, human
gaggatcctcagttggacca

SEQ ID NO: 214561 - DNA, 20 bp, human
gaaaaagcgtccgccccaat

SEQ ID NO: 214562 - DNA, 20 bp, human
ggcgggatgacgtcagaggc

SEQ ID NO: 214563 - DNA, 20 bp, human
gcagcacctctctaacggat

SEQ ID NO: 214564 - DNA, 20 bp, human
gggcggacgctttttgatct

SEQ ID NO: 214565 - DNA, 20 bp, human
gccccacaggcataacttcc

SEQ ID NO: 214566 - DNA, 20 bp, human
ggcgccagccaggggactag

SEQ ID NO: 214567 - DNA, 20 bp, human
gtggcagcggccgagaaggg

SEQ ID NO: 214568 - DNA, 20 bp, human
gcggtggcagcggccgagaa

SEQ ID NO: 214569 - DNA, 20 bp, human
gctacaaaagaggacggctg

SEQ ID NO: 214570 - DNA, 20 bp, human
gccgggttcggctacaaaag

SEQ ID NO: 214571 - DNA, 20 bp, human
gaacgctcggtgagaggcgg

SEQ ID NO: 214572 - DNA, 20 bp, human
gcagaacgctcggtgagagg

SEQ ID NO: 214573 - DNA, 20 bp, human
gcgggtgacgcgcccgggtt

SEQ ID NO: 214574 - DNA, 20 bp, human
gggctcaaactcaccggtgc

SEQ ID NO: 214575 - DNA, 20 bp, human
ggttacctgggcaacggcgc

SEQ ID NO: 214576 - DNA, 20 bp, human
gggtaccgctggagtcgtca

SEQ ID NO: 214577 - DNA, 20 bp, human
gtgaaccctgacgactccag

SEQ ID NO: 214578 - DNA, 20 bp, human
gaaaggctggccggtaccgc

SEQ ID NO: 214579 - DNA, 20 bp, human
gtgtgtggccccaacagggg

SEQ ID NO: 214580 - DNA, 20 bp, human
gcaggcccagagctgccgta

SEQ ID NO: 214581 - DNA, 20 bp, human
ggggtgcagccctcccctgt

SEQ ID NO: 214582 - DNA, 20 bp, human
gatcctgtgtggccccaaca

SEQ ID NO: 214583 - DNA, 20 bp, human
gagggagcagaagctaattc

SEQ ID NO: 214584 - DNA, 20 bp, human
gatacctgtatgtgagtgaa

SEQ ID NO: 214585 - DNA, 20 bp, human
gaggccaggtggaagccaac

SEQ ID NO: 214586 - DNA, 20 bp, human
ggggtaaaagagacagaggt

SEQ ID NO: 214587 - DNA, 20 bp, human
gcagaggttgggtaaactcc

SEQ ID NO: 214588 - DNA, 20 bp, human
gagatctaatgtctatgaag

SEQ ID NO: 214589 - DNA, 20 bp, human
gactacaggtccatcacacc

SEQ ID NO: 214590 - DNA, 20 bp, human
gccttctatttgtcaggatg

SEQ ID NO: 214591 - DNA, 20 bp, human
gtcatagacattagatctct

SEQ ID NO: 214592 - DNA, 20 bp, human
gccttatctttgctggaggc

SEQ ID NO: 214593 - DNA, 20 bp, human
gaaagacttggtttctcggg

SEQ ID NO: 214594 - DNA, 20 bp, human
gtgaagggtaaaagagacag

SEQ ID NO: 214595 - DNA, 20 bp, human
gagataacaagagaatgtct

SEQ ID NO: 214596 - DNA, 20 bp, human
gcccgcctacaaggccctga

SEQ ID NO: 214597 - DNA, 20 bp, human
gcggagggtgagtgcgcggt

SEQ ID NO: 214598 - DNA, 20 bp, human
gtccctcagggccttgtagg

SEQ ID NO: 214599 - DNA, 20 bp, human
gcggtgacacccggaccacg

SEQ ID NO: 214600 - DNA, 20 bp, human
gccctcggggcgggacgagc

SEQ ID NO: 214601 - DNA, 20 bp, human
ggtctccctcagggccttgt

SEQ ID NO: 214602 - DNA, 20 bp, human
gcctccccggcttggcgctg

SEQ ID NO: 214603 - DNA, 20 bp, human
gactgcggagggtgagtgcg

SEQ ID NO: 214604 - DNA, 20 bp, human
gaccgcccgcaggggcgcaa

SEQ ID NO: 214605 - DNA, 20 bp, human
gtgacacccggaccacgggg

SEQ ID NO: 214606 - DNA, 20 bp, human
gggtcaaagaacaggtgcag

SEQ ID NO: 214607 - DNA, 20 bp, human
gacaggtgcaggggccatga

SEQ ID NO: 214608 - DNA, 20 bp, human
gccgcctgggaggcccctca

SEQ ID NO: 214609 - DNA, 20 bp, human
ggagcgtggccagtgggtcc

SEQ ID NO: 214610 - DNA, 20 bp, human
ggtgacacacccggacccac

SEQ ID NO: 214611 - DNA, 20 bp, human
gcatcggcctgggccccccg

SEQ ID NO: 214612 - DNA, 20 bp, human
gtgcaggcacagctcctcgg

SEQ ID NO: 214613 - DNA, 20 bp, human
gggccagtctccagcgccca

SEQ ID NO: 214614 - DNA, 20 bp, human
gtccgggtgtgtcacatgac

SEQ ID NO: 214615 - DNA, 20 bp, human
gtgccctctcccacacgcct

SEQ ID NO: 214616 - DNA, 20 bp, human
gtgcaggcacagcatctcgg

SEQ ID NO: 214617 - DNA, 20 bp, human
ggcaggagggagcttcacct

SEQ ID NO: 214618 - DNA, 20 bp, human
gggtcaaagaacaggtgcag

SEQ ID NO: 214619 - DNA, 20 bp, human
gctaggctgggtcaaagaac

SEQ ID NO: 214620 - DNA, 20 bp, human
gacaggtgcaggggccatga

SEQ ID NO: 214621 - DNA, 20 bp, human
gccgcctgggaggcccctca

SEQ ID NO: 214622 - DNA, 20 bp, human
gagggagcttcacctaggct

SEQ ID NO: 214623 - DNA, 20 bp, human
ggagcgtggccagtggatcc

SEQ ID NO: 214624 - DNA, 20 bp, human
ggtgacacacccggatccac

SEQ ID NO: 214625 - DNA, 20 bp, human
gggccagtctccagcgccca

SEQ ID NO: 214626 - DNA, 20 bp, human
ggcagccctggggtaaccaa

SEQ ID NO: 214627 - DNA, 20 bp, human
gccctggggcagcagccctg

SEQ ID NO: 214628 - DNA, 20 bp, human
gcccacagggtcttgtgaat

SEQ ID NO: 214629 - DNA, 20 bp, human
gtgaatgggaacgtctggtg

SEQ ID NO: 214630 - DNA, 20 bp, human
ggatagggtgataggcctgt

SEQ ID NO: 214631 - DNA, 20 bp, human
gtgcccagatccgggatgga

SEQ ID NO: 214632 - DNA, 20 bp, human
gatctggagctcattaaatg

SEQ ID NO: 214633 - DNA, 20 bp, human
gtgttcccttggttacccca

SEQ ID NO: 214634 - DNA, 20 bp, human
gagggacgtcagtccttatc

SEQ ID NO: 214635 - DNA, 20 bp, human
gggaacaaacacggaaaacc

SEQ ID NO: 214636 - DNA, 20 bp, human
gaagggaggggacgtcaagg

SEQ ID NO: 214637 - DNA, 20 bp, human
gcctcccagccgaggtgggg

SEQ ID NO: 214638 - DNA, 20 bp, human
ggggaggctggtgcggacgc

SEQ ID NO: 214639 - DNA, 20 bp, human
gggtgcggacgccgggtgga

SEQ ID NO: 214640 - DNA, 20 bp, human
ggggacgggtggccttcgga

SEQ ID NO: 214641 - DNA, 20 bp, human
gtcggagggcgcttaaggga

SEQ ID NO: 214642 - DNA, 20 bp, human
gtctccagcgctcctataaa

SEQ ID NO: 214643 - DNA, 20 bp, human
gaaactggccgcatctctcc

SEQ ID NO: 214644 - DNA, 20 bp, human
gaccagcctcccagccgagg

SEQ ID NO: 214645 - DNA, 20 bp, human
gcttaagggaggggacgtca

SEQ ID NO: 214646 - DNA, 20 bp, human
gaagctgcccatctacaccc

SEQ ID NO: 214647 - DNA, 20 bp, human
gaatgagtgagtcatgagcc

SEQ ID NO: 214648 - DNA, 20 bp, human
gacgcacagggtcaaggtag

SEQ ID NO: 214649 - DNA, 20 bp, human
gtcaaggtagggggcacgaa

SEQ ID NO: 214650 - DNA, 20 bp, human
gggtcctgaacagagggacg

SEQ ID NO: 214651 - DNA, 20 bp, human
gtacaccctggcacagacgc

SEQ ID NO: 214652 - DNA, 20 bp, human
gagacggctaggacctgccc

SEQ ID NO: 214653 - DNA, 20 bp, human
gtacccccgtccctctgttc

SEQ ID NO: 214654 - DNA, 20 bp, human
ggaccctagcctgccgactg

SEQ ID NO: 214655 - DNA, 20 bp, human
gccctctgttcaggacctgc

SEQ ID NO: 214656 - DNA, 20 bp, human
gtgtgctgggagtcagatta

SEQ ID NO: 214657 - DNA, 20 bp, human
gtgtagacacagggcatttc

SEQ ID NO: 214658 - DNA, 20 bp, human
gccctgtgtctacagtgatc

SEQ ID NO: 214659 - DNA, 20 bp, human
gtgggtttttggagtgttag

SEQ ID NO: 214660 - DNA, 20 bp, human
gtaacttagcgattgccaca

SEQ ID NO: 214661 - DNA, 20 bp, human
gtacggccacttgtctgatt

SEQ ID NO: 214662 - DNA, 20 bp, human
gaggaaaaaagactgctcta

SEQ ID NO: 214663 - DNA, 20 bp, human
gaattctgaacaattcttca

SEQ ID NO: 214664 - DNA, 20 bp, human
gctgttacattaataatctg

SEQ ID NO: 214665 - DNA, 20 bp, human
gatatgttgtagttgaaatt

SEQ ID NO: 214666 - DNA, 20 bp, human
gctggggcgcgctatatagg

SEQ ID NO: 214667 - DNA, 20 bp, human
gccggggttgcgctggacga

SEQ ID NO: 214668 - DNA, 20 bp, human
gcgtccgggccacgtgaccc

SEQ ID NO: 214669 - DNA, 20 bp, human
gtagaccggcccagcgtccc

SEQ ID NO: 214670 - DNA, 20 bp, human
ggggcggctcctacgctcgg

SEQ ID NO: 214671 - DNA, 20 bp, human
gggtcgcgccggggttgcgc

SEQ ID NO: 214672 - DNA, 20 bp, human
gccgtctcccagggagtccg

SEQ ID NO: 214673 - DNA, 20 bp, human
gggcagccgccggcccgtcc

SEQ ID NO: 214674 - DNA, 20 bp, human
gagagcgcgggagccaacct

SEQ ID NO: 214675 - DNA, 20 bp, human
gtgcgctggacgacggagag

SEQ ID NO: 214676 - DNA, 20 bp, human
gccgccctggaaatcatcgt

SEQ ID NO: 214677 - DNA, 20 bp, human
ggcagggcagcggggctcat

SEQ ID NO: 214678 - DNA, 20 bp, human
gcgaccctcaggctagacct

SEQ ID NO: 214679 - DNA, 20 bp, human
gctgtctctgggcactgagc

SEQ ID NO: 214680 - DNA, 20 bp, human
ggaccccctgaagcaggccg

SEQ ID NO: 214681 - DNA, 20 bp, human
gatccccggcctgcttcagg

SEQ ID NO: 214682 - DNA, 20 bp, human
gtggaagcaaagcctagata

SEQ ID NO: 214683 - DNA, 20 bp, human
gtgtgagtgcgggtataggt

SEQ ID NO: 214684 - DNA, 20 bp, human
gagtcaggcccaacccgccc

SEQ ID NO: 214685 - DNA, 20 bp, human
gccctggaaatcatcgtagg

SEQ ID NO: 214686 - DNA, 20 bp, human
gggcactgctggccggacga

SEQ ID NO: 214687 - DNA, 20 bp, human
gtctccacggcactgctggc

SEQ ID NO: 214688 - DNA, 20 bp, human
gccccattgtgaagggggaa

SEQ ID NO: 214689 - DNA, 20 bp, human
gaggggacgggggaggccct

SEQ ID NO: 214690 - DNA, 20 bp, human
ggtgttggagattaacagcc

SEQ ID NO: 214691 - DNA, 20 bp, human
gtccctttcccccttcacaa

SEQ ID NO: 214692 - DNA, 20 bp, human
gggagaggtcagtaaggcag

SEQ ID NO: 214693 - DNA, 20 bp, human
gctcccccgtcccctccacc

SEQ ID NO: 214694 - DNA, 20 bp, human
gacagctctccccagcgctg

SEQ ID NO: 214695 - DNA, 20 bp, human
gggtcagtaaggcaggggtt

SEQ ID NO: 214696 - DNA, 20 bp, human
ggacctgctgatcacactat

SEQ ID NO: 214697 - DNA, 20 bp, human
gaaagcaataaacctcaggt

SEQ ID NO: 214698 - DNA, 20 bp, human
gagggaaaaacacgccagct

SEQ ID NO: 214699 - DNA, 20 bp, human
gctctgcagccctttaaaag

SEQ ID NO: 214700 - DNA, 20 bp, human
ggctgtagaaggtgggagat

SEQ ID NO: 214701 - DNA, 20 bp, human
gcactccaggctgtagaagg

SEQ ID NO: 214702 - DNA, 20 bp, human
gtcatctgggagcacactcc

SEQ ID NO: 214703 - DNA, 20 bp, human
gtggcgtgtttttccctcac

SEQ ID NO: 214704 - DNA, 20 bp, human
ggcaataaacctcaggtagg

SEQ ID NO: 214705 - DNA, 20 bp, human
gcagaacagcacatgttagt

SEQ ID NO: 214706 - DNA, 20 bp, human
gagggcccgtcactgtgatt

SEQ ID NO: 214707 - DNA, 20 bp, human
gtgtgatttggcaacacaac

SEQ ID NO: 214708 - DNA, 20 bp, human
gtaatctgtcaggcacaaaa

SEQ ID NO: 214709 - DNA, 20 bp, human
gcattcagaagtgggtggtt

SEQ ID NO: 214710 - DNA, 20 bp, human
gcacaaaagggattgttttg

SEQ ID NO: 214711 - DNA, 20 bp, human
ggaaaatcttttctggacca

SEQ ID NO: 214712 - DNA, 20 bp, human
gtgttgccaaatcacagtga

SEQ ID NO: 214713 - DNA, 20 bp, human
gaggttagtaagaaccacat

SEQ ID NO: 214714 - DNA, 20 bp, human
ggtaacatgaaaatcttttc

SEQ ID NO: 214715 - DNA, 20 bp, human
gtcttctggtatcatttcag

SEQ ID NO: 214716 - DNA, 20 bp, human
gcctggaggcatcttccgtg

SEQ ID NO: 214717 - DNA, 20 bp, human
gtggtcaagccaaacgaatc

SEQ ID NO: 214718 - DNA, 20 bp, human
gtccagggttggcgcgggga

SEQ ID NO: 214719 - DNA, 20 bp, human
gacccaaaggggtacgcgtc

SEQ ID NO: 214720 - DNA, 20 bp, human
gacccagacgcgtacccctt

SEQ ID NO: 214721 - DNA, 20 bp, human
gttcgaagagacagacccca

SEQ ID NO: 214722 - DNA, 20 bp, human
gcggaagatgcctccagggt

SEQ ID NO: 214723 - DNA, 20 bp, human
gctgtctcttcgaacccaaa

SEQ ID NO: 214724 - DNA, 20 bp, human
gtcttccctggcgctggccg

SEQ ID NO: 214725 - DNA, 20 bp, human
gcctgggccgcatgcctcct

SEQ ID NO: 214726 - DNA, 20 bp, human
gcgctagagggcgtgtacag

SEQ ID NO: 214727 - DNA, 20 bp, human
gtagagggcgtgtacagagg

SEQ ID NO: 214728 - DNA, 20 bp, human
gcggaagttcatgcaggcgt

SEQ ID NO: 214729 - DNA, 20 bp, human
gctctctgccgcccgctaga

SEQ ID NO: 214730 - DNA, 20 bp, human
ggtacacgccctctagcggg

SEQ ID NO: 214731 - DNA, 20 bp, human
gggacccggtggatggtgtt

SEQ ID NO: 214732 - DNA, 20 bp, human
gctcgctggcgggattagga

SEQ ID NO: 214733 - DNA, 20 bp, human
gaagcggaatggcgtgtagc

SEQ ID NO: 214734 - DNA, 20 bp, human
gccggtggatggtgttgggt

SEQ ID NO: 214735 - DNA, 20 bp, human
gaacgcttgggctgttgtac

SEQ ID NO: 214736 - DNA, 20 bp, human
gttagcgcgcggtgagggga

SEQ ID NO: 214737 - DNA, 20 bp, human
gaacgcctgcctagtggctt

SEQ ID NO: 214738 - DNA, 20 bp, human
gaggctagctctagccctgg

SEQ ID NO: 214739 - DNA, 20 bp, human
gagccctggcgcctaaacct

SEQ ID NO: 214740 - DNA, 20 bp, human
gacaagtgctggcgcagcgt

SEQ ID NO: 214741 - DNA, 20 bp, human
gagcgcgcagatgggagagt

SEQ ID NO: 214742 - DNA, 20 bp, human
gtgctggcgcagcgtgggcg

SEQ ID NO: 214743 - DNA, 20 bp, human
ggagggaggaaaaggacgat

SEQ ID NO: 214744 - DNA, 20 bp, human
gcgcgctaacgcctgcctag

SEQ ID NO: 214745 - DNA, 20 bp, human
ggcaaggaggccggcccggt

SEQ ID NO: 214746 - DNA, 20 bp, human
ggaccctgacccaataaggg

SEQ ID NO: 214747 - DNA, 20 bp, human
gcctgaaacgtcaagatctg

SEQ ID NO: 214748 - DNA, 20 bp, human
gctgacccaataagggtgga

SEQ ID NO: 214749 - DNA, 20 bp, human
gtcgtgttccggattaggag

SEQ ID NO: 214750 - DNA, 20 bp, human
gcaggcggcccctcctaatc

SEQ ID NO: 214751 - DNA, 20 bp, human
gcgctcgtcctgactcgcgc

SEQ ID NO: 214752 - DNA, 20 bp, human
gagagtccgagaggcgacgg

SEQ ID NO: 214753 - DNA, 20 bp, human
gacgagagtccgagaggcga

SEQ ID NO: 214754 - DNA, 20 bp, human
ggtgagtcgtgttccggatt

SEQ ID NO: 214755 - DNA, 20 bp, human
gtcagccttccacccttatt

SEQ ID NO: 214756 - DNA, 20 bp, human
ggatcttgcaggccctcaca

SEQ ID NO: 214757 - DNA, 20 bp, human
gggtggagaggccaccgcca

SEQ ID NO: 214758 - DNA, 20 bp, human
gaagggcgcaagttctgccc

SEQ ID NO: 214759 - DNA, 20 bp, human
gctgcacccccacccaagct

SEQ ID NO: 214760 - DNA, 20 bp, human
gctgggcatccaccctgtga

SEQ ID NO: 214761 - DNA, 20 bp, human
gtggactgcagggcagtcaa

SEQ ID NO: 214762 - DNA, 20 bp, human
gcccgcataaggagacagag

SEQ ID NO: 214763 - DNA, 20 bp, human
gcaagatcagtggacactgt

SEQ ID NO: 214764 - DNA, 20 bp, human
ggggcagtcaagggcacagg

SEQ ID NO: 214765 - DNA, 20 bp, human
gagggattggctggactgca

SEQ ID NO: 214766 - DNA, 20 bp, human
gccctccccccgcctagtca

SEQ ID NO: 214767 - DNA, 20 bp, human
ggcccgcccgccggacccgt

SEQ ID NO: 214768 - DNA, 20 bp, human
gctagtcacggtcctggagt

SEQ ID NO: 214769 - DNA, 20 bp, human
gaagacccgcaagcagctag

SEQ ID NO: 214770 - DNA, 20 bp, human
gcagggccccgccccctcat

SEQ ID NO: 214771 - DNA, 20 bp, human
gcccacgtgactcccgggga

SEQ ID NO: 214772 - DNA, 20 bp, human
ggtgggtggggtgtatgtca

SEQ ID NO: 214773 - DNA, 20 bp, human
gggccaggccaaccaactcc

SEQ ID NO: 214774 - DNA, 20 bp, human
gcaggaccgtgactaggcgg

SEQ ID NO: 214775 - DNA, 20 bp, human
gcggggggaggggccgatga

SEQ ID NO: 214776 - DNA, 20 bp, human
gggaagccggagctcaacgg

SEQ ID NO: 214777 - DNA, 20 bp, human
ggccaggcgcggccaagtcg

SEQ ID NO: 214778 - DNA, 20 bp, human
gccctggagcccagagcgac

SEQ ID NO: 214779 - DNA, 20 bp, human
ggaggtgcgccaggtggcga

SEQ ID NO: 214780 - DNA, 20 bp, human
ggaggcgtcagaccccgctg

SEQ ID NO: 214781 - DNA, 20 bp, human
gctatgctgcggaaccaggg

SEQ ID NO: 214782 - DNA, 20 bp, human
ggtcctgggcatctccgtcc

SEQ ID NO: 214783 - DNA, 20 bp, human
gagccggagctcaacggcgg

SEQ ID NO: 214784 - DNA, 20 bp, human
gcatctccgtcccgggaagg

SEQ ID NO: 214785 - DNA, 20 bp, human
ggggttgaatgtcaaatggg

SEQ ID NO: 214786 - DNA, 20 bp, human
gccctctcgcaggccgagaa

SEQ ID NO: 214787 - DNA, 20 bp, human
gcctgcgagagggcagactg

SEQ ID NO: 214788 - DNA, 20 bp, human
ggcggggctgggcccgtcga

SEQ ID NO: 214789 - DNA, 20 bp, human
ggactcggagataagcgcgg

SEQ ID NO: 214790 - DNA, 20 bp, human
gtgggacgaagacaacctca

SEQ ID NO: 214791 - DNA, 20 bp, human
gtgcaagcgcaggcctccaa

SEQ ID NO: 214792 - DNA, 20 bp, human
gcgcaggcctccaaagggtt

SEQ ID NO: 214793 - DNA, 20 bp, human
ggggctgggcccgtcgaggg

SEQ ID NO: 214794 - DNA, 20 bp, human
gccctccagtcctgccaaaa

SEQ ID NO: 214795 - DNA, 20 bp, human
ggcagactcggagataagcg

SEQ ID NO: 214796 - DNA, 20 bp, human
gctcccgggcggcaagggac

SEQ ID NO: 214797 - DNA, 20 bp, human
gtcagtccctcggtccccgc

SEQ ID NO: 214798 - DNA, 20 bp, human
gctggccccgccatgtgtgc

SEQ ID NO: 214799 - DNA, 20 bp, human
gaccccctgcacacatggcg

SEQ ID NO: 214800 - DNA, 20 bp, human
gcgggagccgagtgggcgca

SEQ ID NO: 214801 - DNA, 20 bp, human
gtgaatgagccccgccgtcc

SEQ ID NO: 214802 - DNA, 20 bp, human
ggccgagcccggtttctcat

SEQ ID NO: 214803 - DNA, 20 bp, human
ggctgggccaatgagaaacc

SEQ ID NO: 214804 - DNA, 20 bp, human
ggagccgagtgggcgcaggg

SEQ ID NO: 214805 - DNA, 20 bp, human
gtgccgcccgggagccgagt

SEQ ID NO: 214806 - DNA, 20 bp, human
gaaggcgatgacagtgaaag

SEQ ID NO: 214807 - DNA, 20 bp, human
gggaagcggcgcaggtcaaa

SEQ ID NO: 214808 - DNA, 20 bp, human
gattaagcccaggaggtgta

SEQ ID NO: 214809 - DNA, 20 bp, human
gaacgccccctacacctcct

SEQ ID NO: 214810 - DNA, 20 bp, human
gtccggttacgattaagccc

SEQ ID NO: 214811 - DNA, 20 bp, human
gggcgcaggtcaaagggcgg

SEQ ID NO: 214812 - DNA, 20 bp, human
gctgtgggctggggaaattg

SEQ ID NO: 214813 - DNA, 20 bp, human
gaattgagggtaccccgctc

SEQ ID NO: 214814 - DNA, 20 bp, human
gagcggcgcaggtcaaaggg

SEQ ID NO: 214815 - DNA, 20 bp, human
gacgaggttccacagctgga

SEQ ID NO: 214816 - DNA, 20 bp, human
gctccccaagccttcgagag

SEQ ID NO: 214817 - DNA, 20 bp, human
gggccgggccttgacgtcat

SEQ ID NO: 214818 - DNA, 20 bp, human
gcggcgcctcgggctgtccc

SEQ ID NO: 214819 - DNA, 20 bp, human
gtgtgcgaacgtctgtaggg

SEQ ID NO: 214820 - DNA, 20 bp, human
ggagtgtgcgccgctctcga

SEQ ID NO: 214821 - DNA, 20 bp, human
ggggctgtcccgggacctct

SEQ ID NO: 214822 - DNA, 20 bp, human
gtggaagagcgagtggagac

SEQ ID NO: 214823 - DNA, 20 bp, human
ggacgtcaaggcccggccgt

SEQ ID NO: 214824 - DNA, 20 bp, human
gcgcgcacctgccgctttat

SEQ ID NO: 214825 - DNA, 20 bp, human
gaggcttggggagctcgggg

SEQ ID NO: 214826 - DNA, 20 bp, human
gagagaagacggtccaagaa

SEQ ID NO: 214827 - DNA, 20 bp, human
ggaaggaggtagtcagaccg

SEQ ID NO: 214828 - DNA, 20 bp, human
gtccaagaagggacgttatc

SEQ ID NO: 214829 - DNA, 20 bp, human
gtacggaagaaccaggagtt

SEQ ID NO: 214830 - DNA, 20 bp, human
gtatcaggccactttttggg

SEQ ID NO: 214831 - DNA, 20 bp, human
gggaccgtcttctctcacca

SEQ ID NO: 214832 - DNA, 20 bp, human
ggcaaaggatagcccggaag

SEQ ID NO: 214833 - DNA, 20 bp, human
gcaggagtttggcgtgacca

SEQ ID NO: 214834 - DNA, 20 bp, human
ggcctgataacgtcccttct

SEQ ID NO: 214835 - DNA, 20 bp, human
gcgttatcaggccacttttt

SEQ ID NO: 214836 - DNA, 20 bp, human
gtgcgcgcgagctaagaccg

SEQ ID NO: 214837 - DNA, 20 bp, human
gaggcgcgctggctccggta

SEQ ID NO: 214838 - DNA, 20 bp, human
gtagctcgcgcgcaccctag

SEQ ID NO: 214839 - DNA, 20 bp, human
gcgagctaagaccgcggccc

SEQ ID NO: 214840 - DNA, 20 bp, human
gcaccgtgcgcccgcgacgc

SEQ ID NO: 214841 - DNA, 20 bp, human
ggggcacgccgggtaagggg

SEQ ID NO: 214842 - DNA, 20 bp, human
gccgccccctgcagccctac

SEQ ID NO: 214843 - DNA, 20 bp, human
ggcggaagactcacaggcgc

SEQ ID NO: 214844 - DNA, 20 bp, human
ggcggggcacgccgggtaag

SEQ ID NO: 214845 - DNA, 20 bp, human
gcagacgggtgcgcgcccct

SEQ ID NO: 214846 - DNA, 20 bp, human
ggggaggtgggaagtatccc

SEQ ID NO: 214847 - DNA, 20 bp, human
ggaggcgggagccgtgaatg

SEQ ID NO: 214848 - DNA, 20 bp, human
ggcagccgctgccatggtga

SEQ ID NO: 214849 - DNA, 20 bp, human
gatggcagcggctgcagcac

SEQ ID NO: 214850 - DNA, 20 bp, human
gatagctgcgcggtagctag

SEQ ID NO: 214851 - DNA, 20 bp, human
gatcgcgcgatcggggaggt

SEQ ID NO: 214852 - DNA, 20 bp, human
ggcttccggtgctaggtgga

SEQ ID NO: 214853 - DNA, 20 bp, human
gcggaagccgcgacggcgac

SEQ ID NO: 214854 - DNA, 20 bp, human
gagttggctgcgtaggagac

SEQ ID NO: 214855 - DNA, 20 bp, human
gagctatcgcgcgatcgggg

SEQ ID NO: 214856 - DNA, 20 bp, human
ggctgaggcacatgcgtact

SEQ ID NO: 214857 - DNA, 20 bp, human
gcccggatgaaggtattgtc

SEQ ID NO: 214858 - DNA, 20 bp, human
gaaactggccaatcccctgc

SEQ ID NO: 214859 - DNA, 20 bp, human
ggtgacgaagcgaggtattg

SEQ ID NO: 214860 - DNA, 20 bp, human
gtcactgccaaatcagactc

SEQ ID NO: 214861 - DNA, 20 bp, human
ggggcgcaccggaagcgcag

SEQ ID NO: 214862 - DNA, 20 bp, human
gcggcccggcccctccaacg

SEQ ID NO: 214863 - DNA, 20 bp, human
gagatgctcgtcagcgaaac

SEQ ID NO: 214864 - DNA, 20 bp, human
ggctgacgagcatctctcga

SEQ ID NO: 214865 - DNA, 20 bp, human
gtctcaccctgagtctgatt

SEQ ID NO: 214866 - DNA, 20 bp, human
gtaagggccgcacgggaccc

SEQ ID NO: 214867 - DNA, 20 bp, human
gcccgagcgcggctgaggaa

SEQ ID NO: 214868 - DNA, 20 bp, human
gcccccggctctggctccta

SEQ ID NO: 214869 - DNA, 20 bp, human
ggtcccgtgcggcccttact

SEQ ID NO: 214870 - DNA, 20 bp, human
ggcggcccttacttgggaac

SEQ ID NO: 214871 - DNA, 20 bp, human
ggagttgccgctgctggcct

SEQ ID NO: 214872 - DNA, 20 bp, human
gcgcgctcgggctgccggtt

SEQ ID NO: 214873 - DNA, 20 bp, human
gctcccctaggagccagagc

SEQ ID NO: 214874 - DNA, 20 bp, human
ggcccgcggtgacgtcggga

SEQ ID NO: 214875 - DNA, 20 bp, human
gaggcctgtggccgccgaac

SEQ ID NO: 214876 - DNA, 20 bp, human
gtacgtggataccggaggca

SEQ ID NO: 214877 - DNA, 20 bp, human
gagggagccccctagagacc

SEQ ID NO: 214878 - DNA, 20 bp, human
gggcaatgatcaaggcccag

SEQ ID NO: 214879 - DNA, 20 bp, human
gtcgtccccgggctcaccta

SEQ ID NO: 214880 - DNA, 20 bp, human
gtgagcccggggacgaagca

SEQ ID NO: 214881 - DNA, 20 bp, human
gccaaccataggtgagcccg

SEQ ID NO: 214882 - DNA, 20 bp, human
gctgttgaccgccagttctg

SEQ ID NO: 214883 - DNA, 20 bp, human
ggggatggagatgggagcga

SEQ ID NO: 214884 - DNA, 20 bp, human
ggggtcagggtatctctacg

SEQ ID NO: 214885 - DNA, 20 bp, human
gggccttgatcattgccttc

SEQ ID NO: 214886 - DNA, 20 bp, human
gcccgcgcgcctagcgtcat

SEQ ID NO: 214887 - DNA, 20 bp, human
ggcgtggcgcccatgacgct

SEQ ID NO: 214888 - DNA, 20 bp, human
ggacaagagcgacctctgta

SEQ ID NO: 214889 - DNA, 20 bp, human
gaggcgcgagtcagagtccg

SEQ ID NO: 214890 - DNA, 20 bp, human
gcgcatctgcgagccctccg

SEQ ID NO: 214891 - DNA, 20 bp, human
gcgtcatgggcgccacgcgc

SEQ ID NO: 214892 - DNA, 20 bp, human
ggcagcagaggccgaccgtt

SEQ ID NO: 214893 - DNA, 20 bp, human
ggtcagagtccgaggttcga

SEQ ID NO: 214894 - DNA, 20 bp, human
ggcgcctgcgtggtcgggag

SEQ ID NO: 214895 - DNA, 20 bp, human
ggcccagagccctcgaacct

SEQ ID NO: 214896 - DNA, 20 bp, human
ggtggcgataatcctatgaa

SEQ ID NO: 214897 - DNA, 20 bp, human
gaaatcaaaaacccattcat

SEQ ID NO: 214898 - DNA, 20 bp, human
gctacagtttggcggggacg

SEQ ID NO: 214899 - DNA, 20 bp, human
gcctgtcccgaatccgggtc

SEQ ID NO: 214900 - DNA, 20 bp, human
gctggcgagcctcatcgatg

SEQ ID NO: 214901 - DNA, 20 bp, human
ggaccgcgaccgcatcgatg

SEQ ID NO: 214902 - DNA, 20 bp, human
gtctggcggcattactacac

SEQ ID NO: 214903 - DNA, 20 bp, human
gtactgttctacagtttggc

SEQ ID NO: 214904 - DNA, 20 bp, human
gagcctcatcgatgcggtcg

SEQ ID NO: 214905 - DNA, 20 bp, human
gccagttcctgtcccgaatc

SEQ ID NO: 214906 - DNA, 20 bp, human
ggggcgggtgcgcgcgtcag

SEQ ID NO: 214907 - DNA, 20 bp, human
gggtgcgcgcgtcaggggct

SEQ ID NO: 214908 - DNA, 20 bp, human
gcagctgcggtccggggccc

SEQ ID NO: 214909 - DNA, 20 bp, human
gcgtccccatggcgaccggg

SEQ ID NO: 214910 - DNA, 20 bp, human
gggaccgcagctggtcgtag

SEQ ID NO: 214911 - DNA, 20 bp, human
gtgcgcgtccccatggcgac

SEQ ID NO: 214912 - DNA, 20 bp, human
ggggacggcgcgttcaccgg

SEQ ID NO: 214913 - DNA, 20 bp, human
gcgcacccgcccggtcgcca

SEQ ID NO: 214914 - DNA, 20 bp, human
gcatccgcggaaccaagctg

SEQ ID NO: 214915 - DNA, 20 bp, human
ggggtgggagttggactgcg

SEQ ID NO: 214916 - DNA, 20 bp, human
gctagcgtctgttatggggc

SEQ ID NO: 214917 - DNA, 20 bp, human
gcgtgggggcgactccacct

SEQ ID NO: 214918 - DNA, 20 bp, human
gcctgggccagccgaggggt

SEQ ID NO: 214919 - DNA, 20 bp, human
gtggaccaatgggcagccgg

SEQ ID NO: 214920 - DNA, 20 bp, human
gctcaccaggccggcctcag

SEQ ID NO: 214921 - DNA, 20 bp, human
ggagtccgatctggaccaat

SEQ ID NO: 214922 - DNA, 20 bp, human
gggggcggcgacgacaaccg

SEQ ID NO: 214923 - DNA, 20 bp, human
gccaatccgcagccggggcg

SEQ ID NO: 214924 - DNA, 20 bp, human
gcccgccgcgggccaatcca

SEQ ID NO: 214925 - DNA, 20 bp, human
ggctggcccaggcaccgctg

SEQ ID NO: 214926 - DNA, 20 bp, human
gggtggacgggcccggtcgt

SEQ ID NO: 214927 - DNA, 20 bp, human
gcacgcgcgtgcagcgcctg

SEQ ID NO: 214928 - DNA, 20 bp, human
gagcggcgcggctgaagcga

SEQ ID NO: 214929 - DNA, 20 bp, human
gcggcttcgcccagcgctaa

SEQ ID NO: 214930 - DNA, 20 bp, human
gcctgcgccccggcggtgga

SEQ ID NO: 214931 - DNA, 20 bp, human
gccaatccccgcccacgacc

SEQ ID NO: 214932 - DNA, 20 bp, human
gcgcgtgcagcgcctggggt

SEQ ID NO: 214933 - DNA, 20 bp, human
ggaccgggcccgtccaccgc

SEQ ID NO: 214934 - DNA, 20 bp, human
gggggctgcgcgtaacggtc

SEQ ID NO: 214935 - DNA, 20 bp, human
ggcgcctggggtcgggccag

SEQ ID NO: 214936 - DNA, 20 bp, human
gggcccgagccgcagcgcta

SEQ ID NO: 214937 - DNA, 20 bp, human
ggcaccgcgcccagcacttc

SEQ ID NO: 214938 - DNA, 20 bp, human
gcgggtgttgctgtgacccc

SEQ ID NO: 214939 - DNA, 20 bp, human
gcctccagcgttcgcctgca

SEQ ID NO: 214940 - DNA, 20 bp, human
gctgccccggccgccatgtt

SEQ ID NO: 214941 - DNA, 20 bp, human
gaccaagagcccgaagtgct

SEQ ID NO: 214942 - DNA, 20 bp, human
gaggagcaggggtgccgagt

SEQ ID NO: 214943 - DNA, 20 bp, human
gcgaacgctggaggccccgc

SEQ ID NO: 214944 - DNA, 20 bp, human
ggagaccctgcggctgagaa

SEQ ID NO: 214945 - DNA, 20 bp, human
gccgccgtagcgctgcggct

SEQ ID NO: 214946 - DNA, 20 bp, human
gagacagaaggcgagggtgg

SEQ ID NO: 214947 - DNA, 20 bp, human
ggggcatgggcgaagggtat

SEQ ID NO: 214948 - DNA, 20 bp, human
gggccccgtgacccccagcg

SEQ ID NO: 214949 - DNA, 20 bp, human
ggggagtgggcatgggcgaa

SEQ ID NO: 214950 - DNA, 20 bp, human
ggagagaagcgcaaggtaac

SEQ ID NO: 214951 - DNA, 20 bp, human
gaagggtataggggacgcgg

SEQ ID NO: 214952 - DNA, 20 bp, human
gcggagcctaaggctggggg

SEQ ID NO: 214953 - DNA, 20 bp, human
gggacgcgggggctaaagaa

SEQ ID NO: 214954 - DNA, 20 bp, human
gacggccgcctagcgtccgt

SEQ ID NO: 214955 - DNA, 20 bp, human
ggcgaagggtataggggacg

SEQ ID NO: 214956 - DNA, 20 bp, human
gcagcgacctaatgcgcgcg

SEQ ID NO: 214957 - DNA, 20 bp, human
gcgttgcccgggtaattttc

SEQ ID NO: 214958 - DNA, 20 bp, human
ggtcccggatgtggttgcta

SEQ ID NO: 214959 - DNA, 20 bp, human
gagggcggagggatcctcgt

SEQ ID NO: 214960 - DNA, 20 bp, human
gtagcccgcctcccggagaa

SEQ ID NO: 214961 - DNA, 20 bp, human
gtggttgctagggcagcaga

SEQ ID NO: 214962 - DNA, 20 bp, human
gttgcccggccacgtctcgg

SEQ ID NO: 214963 - DNA, 20 bp, human
ggacaccaccgagacgtggc

SEQ ID NO: 214964 - DNA, 20 bp, human
gacccgggcaacgacaccgc

SEQ ID NO: 214965 - DNA, 20 bp, human
gaccgccggagtcccggatg

SEQ ID NO: 214966 - DNA, 20 bp, human
gcggcaccgagaagctgaaa

SEQ ID NO: 214967 - DNA, 20 bp, human
gcgccggtggcgtgatggag

SEQ ID NO: 214968 - DNA, 20 bp, human
gctgaaacggaagtggcgta

SEQ ID NO: 214969 - DNA, 20 bp, human
gcgagaagctgaaacggaag

SEQ ID NO: 214970 - DNA, 20 bp, human
gggaatgcgagctgaacgtc

SEQ ID NO: 214971 - DNA, 20 bp, human
gacgtcgcagattataaggg

SEQ ID NO: 214972 - DNA, 20 bp, human
gcagcgagaggttacttccg

SEQ ID NO: 214973 - DNA, 20 bp, human
ggccacgtcgcagattataa

SEQ ID NO: 214974 - DNA, 20 bp, human
gagctctcgagatcagcgag

SEQ ID NO: 214975 - DNA, 20 bp, human
gggcgtacggcatgcgccgg

SEQ ID NO: 214976 - DNA, 20 bp, human
gcccgcgcgccaagcacttc

SEQ ID NO: 214977 - DNA, 20 bp, human
gctcgggaggaagtgccgat

SEQ ID NO: 214978 - DNA, 20 bp, human
gcggctgctggggcgaaaag

SEQ ID NO: 214979 - DNA, 20 bp, human
ggggacgcgggccggcctca

SEQ ID NO: 214980 - DNA, 20 bp, human
gcgccaagcacttccggaag

SEQ ID NO: 214981 - DNA, 20 bp, human
gcgggccgctctagccggtg

SEQ ID NO: 214982 - DNA, 20 bp, human
ggagctgaaccgcgtcccag

SEQ ID NO: 214983 - DNA, 20 bp, human
ggaggccggcgggctctctg

SEQ ID NO: 214984 - DNA, 20 bp, human
gcggttcagctcattccctg

SEQ ID NO: 214985 - DNA, 20 bp, human
gggcgccgggccgctctagc

SEQ ID NO: 214986 - DNA, 20 bp, human
ggtaacctaactctgagtct

SEQ ID NO: 214987 - DNA, 20 bp, human
gtatggggttacttcataca

SEQ ID NO: 214988 - DNA, 20 bp, human
gactgttgactgtcattctt

SEQ ID NO: 214989 - DNA, 20 bp, human
gcatacatggagtaactata

SEQ ID NO: 214990 - DNA, 20 bp, human
gcatgtatgaagtaactata

SEQ ID NO: 214991 - DNA, 20 bp, human
gaagtcaggttaatgtcatc

SEQ ID NO: 214992 - DNA, 20 bp, human
gcttgtcagttgttgaagtc

SEQ ID NO: 214993 - DNA, 20 bp, human
gtccttgtagaagaagggcc

SEQ ID NO: 214994 - DNA, 20 bp, human
gcattctttggtttagtggg

SEQ ID NO: 214995 - DNA, 20 bp, human
ggtcttcagagatctggagg

SEQ ID NO: 214996 - DNA, 20 bp, human
gagtggggtgacgtcatcga

SEQ ID NO: 214997 - DNA, 20 bp, human
gtgggcggggcctgcgaaga

SEQ ID NO: 214998 - DNA, 20 bp, human
gagcggcaggggcatgtccc

SEQ ID NO: 214999 - DNA, 20 bp, human
gtgcgaagaaggtgtgccgg

SEQ ID NO: 215000 - DNA, 20 bp, human
ggtccctggccggagagcac

SEQ ID NO: 215001 - DNA, 20 bp, human
gggcggcggggccaatgtgg

SEQ ID NO: 215002 - DNA, 20 bp, human
gcccagccttgcagagcggt

SEQ ID NO: 215003 - DNA, 20 bp, human
gtaagagcgcggtgaccaac

SEQ ID NO: 215004 - DNA, 20 bp, human
gtggcctgtgctctccggcc

SEQ ID NO: 215005 - DNA, 20 bp, human
gacgccagaaggccaatatc

SEQ ID NO: 215006 - DNA, 20 bp, human
gggtgtgtctgggtggtgca

SEQ ID NO: 215007 - DNA, 20 bp, human
gcgccttgaagggttgtcaa

SEQ ID NO: 215008 - DNA, 20 bp, human
ggtggtctgagttattcggg

SEQ ID NO: 215009 - DNA, 20 bp, human
gagcacaggagtcgccttga

SEQ ID NO: 215010 - DNA, 20 bp, human
gtggttgcatcaaaaagcac

SEQ ID NO: 215011 - DNA, 20 bp, human
gtacctttgacaacccttca

SEQ ID NO: 215012 - DNA, 20 bp, human
gcgtgtgttaccacgcctag

SEQ ID NO: 215013 - DNA, 20 bp, human
gggagtagactggtgcaatt

SEQ ID NO: 215014 - DNA, 20 bp, human
gtgtaaaattcctctaggcg

SEQ ID NO: 215015 - DNA, 20 bp, human
gttatcctatcaaacataaa

SEQ ID NO: 215016 - DNA, 20 bp, human
gaagcctgagacgcaataga

SEQ ID NO: 215017 - DNA, 20 bp, human
gtgtctccattctacgaatg

SEQ ID NO: 215018 - DNA, 20 bp, human
ggcagcaagtgatgagtgca

SEQ ID NO: 215019 - DNA, 20 bp, human
ggcaggcgagcgcttcggag

SEQ ID NO: 215020 - DNA, 20 bp, human
gtctccatctattgcgtctc

SEQ ID NO: 215021 - DNA, 20 bp, human
gaggcttccgccaagactgg

SEQ ID NO: 215022 - DNA, 20 bp, human
gggcaaaaatcgtcaggagg

SEQ ID NO: 215023 - DNA, 20 bp, human
gcgaaggcaggcgagcgctt

SEQ ID NO: 215024 - DNA, 20 bp, human
ggcgaaacgtgccgaagcgt

SEQ ID NO: 215025 - DNA, 20 bp, human
gagagtacgccaaggcgaaa

SEQ ID NO: 215026 - DNA, 20 bp, human
gcccgcctaagttcctgcct

SEQ ID NO: 215027 - DNA, 20 bp, human
gaacttaggcgggcatgtgc

SEQ ID NO: 215028 - DNA, 20 bp, human
gctaagttcctgcctcgggg

SEQ ID NO: 215029 - DNA, 20 bp, human
gtgacccggaatggaggagg

SEQ ID NO: 215030 - DNA, 20 bp, human
gtttggggccggaagtgggt

SEQ ID NO: 215031 - DNA, 20 bp, human
gaggtgtggcggaaatggtt

SEQ ID NO: 215032 - DNA, 20 bp, human
ggcatgtgcaggaagtgggc

SEQ ID NO: 215033 - DNA, 20 bp, human
gcctcagagctggacctcat

SEQ ID NO: 215034 - DNA, 20 bp, human
ggaaaggccatgtttggggc

SEQ ID NO: 215035 - DNA, 20 bp, human
gtcccagctagtcgaatcac

SEQ ID NO: 215036 - DNA, 20 bp, human
gcccgggagcccaagcaaag

SEQ ID NO: 215037 - DNA, 20 bp, human
gacgcctcggaaggaagagg

SEQ ID NO: 215038 - DNA, 20 bp, human
gaacccgaccgggaccgaga

SEQ ID NO: 215039 - DNA, 20 bp, human
gggaggggcagctgcgcgtg

SEQ ID NO: 215040 - DNA, 20 bp, human
gccgctgcacggaacccgac

SEQ ID NO: 215041 - DNA, 20 bp, human
ggcgcggcagacactccccg

SEQ ID NO: 215042 - DNA, 20 bp, human
gaggacgcctcggaaggaag

SEQ ID NO: 215043 - DNA, 20 bp, human
ggcccctcctcttccttccg

SEQ ID NO: 215044 - DNA, 20 bp, human
gagccccaggacgcctcgga

SEQ ID NO: 215045 - DNA, 20 bp, human
ggggcgacataactctgaag

SEQ ID NO: 215046 - DNA, 20 bp, human
ggaaccagacggggacagta

SEQ ID NO: 215047 - DNA, 20 bp, human
ggggtgtctgcggaggagct

SEQ ID NO: 215048 - DNA, 20 bp, human
gagacggggacagtaaggtt

SEQ ID NO: 215049 - DNA, 20 bp, human
gtatgaagaaaccgttctta

SEQ ID NO: 215050 - DNA, 20 bp, human
gatctgggcttccgtaagaa

SEQ ID NO: 215051 - DNA, 20 bp, human
gtttcagagcgaaccagacg

SEQ ID NO: 215052 - DNA, 20 bp, human
gtggctctgggtgtctgcgg

SEQ ID NO: 215053 - DNA, 20 bp, human
gtggtggctctgggtgtctg

SEQ ID NO: 215054 - DNA, 20 bp, human
gtgcctgtctagataagtgc

SEQ ID NO: 215055 - DNA, 20 bp, human
gttaaccctcggcccttggt

SEQ ID NO: 215056 - DNA, 20 bp, human
gttacgaagaaaccgttcta

SEQ ID NO: 215057 - DNA, 20 bp, human
gcaactgggcttccgtagaa

SEQ ID NO: 215058 - DNA, 20 bp, human
gtgcctgtctagataggtgc

SEQ ID NO: 215059 - DNA, 20 bp, human
ggaacggtttcttcgtaaga

SEQ ID NO: 215060 - DNA, 20 bp, human
gcttcagcgacagccgagct

SEQ ID NO: 215061 - DNA, 20 bp, human
ggtctcaagttgtctcaact

SEQ ID NO: 215062 - DNA, 20 bp, human
gttaaccctcggcctttggt

SEQ ID NO: 215063 - DNA, 20 bp, human
gagttcccaccaaaggccga

SEQ ID NO: 215064 - DNA, 20 bp, human
gaaccttaaccctcggcctt

SEQ ID NO: 215065 - DNA, 20 bp, human
gtgcgggcgaaggggtgtaa

SEQ ID NO: 215066 - DNA, 20 bp, human
gggacggtctggggtggcta

SEQ ID NO: 215067 - DNA, 20 bp, human
gcccggcggggatccgaata

SEQ ID NO: 215068 - DNA, 20 bp, human
ggggtctccgggacggtctg

SEQ ID NO: 215069 - DNA, 20 bp, human
gtctccgggacggtctgggg

SEQ ID NO: 215070 - DNA, 20 bp, human
gtgggcgggcgcgggtctcc

SEQ ID NO: 215071 - DNA, 20 bp, human
ggaggctcacgtgatggccc

SEQ ID NO: 215072 - DNA, 20 bp, human
gcgggagcctgcggtcaagg

SEQ ID NO: 215073 - DNA, 20 bp, human
ggggcagccagcgtacggtg

SEQ ID NO: 215074 - DNA, 20 bp, human
ggtaacttaccctccctcag

SEQ ID NO: 215075 - DNA, 20 bp, human
gagctccaggggccgacgaa

SEQ ID NO: 215076 - DNA, 20 bp, human
gagtaatgatgtgatgtgtg

SEQ ID NO: 215077 - DNA, 20 bp, human
gcgtaagagtaggcctgtgt

SEQ ID NO: 215078 - DNA, 20 bp, human
ggagatgctcccatgctatc

SEQ ID NO: 215079 - DNA, 20 bp, human
ggctgcttaatttcagtact

SEQ ID NO: 215080 - DNA, 20 bp, human
gcctctgcctcattcatgaa

SEQ ID NO: 215081 - DNA, 20 bp, human
gcagatggcggcgtggctct

SEQ ID NO: 215082 - DNA, 20 bp, human
gaatgaagcgtctactctgc

SEQ ID NO: 215083 - DNA, 20 bp, human
gaacaggttcatcaggcctt

SEQ ID NO: 215084 - DNA, 20 bp, human
ggcctgatgaacctgttaac

SEQ ID NO: 215085 - DNA, 20 bp, human
gtttttcagcccttgctaga

SEQ ID NO: 215086 - DNA, 20 bp, human
gtcttcgcccgtgtcaggta

SEQ ID NO: 215087 - DNA, 20 bp, human
gcggctcggccagacctaga

SEQ ID NO: 215088 - DNA, 20 bp, human
gcccgcccgccctctaggtc

SEQ ID NO: 215089 - DNA, 20 bp, human
gctagctcttcgcccgtgtc

SEQ ID NO: 215090 - DNA, 20 bp, human
gcgaagagctagaaggcccc

SEQ ID NO: 215091 - DNA, 20 bp, human
gactggaagtgacgaggcga

SEQ ID NO: 215092 - DNA, 20 bp, human
gggtaaggcactgttagcct

SEQ ID NO: 215093 - DNA, 20 bp, human
ggcctcggctcggttcgact

SEQ ID NO: 215094 - DNA, 20 bp, human
ggttcgactcggctctactc

SEQ ID NO: 215095 - DNA, 20 bp, human
gcccgggcgagaagaccact

SEQ ID NO: 215096 - DNA, 20 bp, human
gtggcgattcacacggggag

SEQ ID NO: 215097 - DNA, 20 bp, human
gtggacaattgcactctggg

SEQ ID NO: 215098 - DNA, 20 bp, human
gcaggctggcgattcacacg

SEQ ID NO: 215099 - DNA, 20 bp, human
gtctgggcggctttggttaa

SEQ ID NO: 215100 - DNA, 20 bp, human
gactctggacaattgcactc

SEQ ID NO: 215101 - DNA, 20 bp, human
ggcaactcgctcattagcat

SEQ ID NO: 215102 - DNA, 20 bp, human
ggggcggctttggttaaagg

SEQ ID NO: 215103 - DNA, 20 bp, human
gggcgaagggtggaagcgac

SEQ ID NO: 215104 - DNA, 20 bp, human
gttgcagcttctaattggag

SEQ ID NO: 215105 - DNA, 20 bp, human
gactacaagccgtcttactt

SEQ ID NO: 215106 - DNA, 20 bp, human
gcctccctctttttccgcca

SEQ ID NO: 215107 - DNA, 20 bp, human
gcagccctggcggaaaaaga

SEQ ID NO: 215108 - DNA, 20 bp, human
gggctgggaacgaccaatga

SEQ ID NO: 215109 - DNA, 20 bp, human
gtaaacggttcaggttgagg

SEQ ID NO: 215110 - DNA, 20 bp, human
gtgggggcgggacgtaaggt

SEQ ID NO: 215111 - DNA, 20 bp, human
gtcaaatgactaaccgtcat

SEQ ID NO: 215112 - DNA, 20 bp, human
gcgtcccgcccccacatatt

SEQ ID NO: 215113 - DNA, 20 bp, human
gaaggtctgtggaatcggaa

SEQ ID NO: 215114 - DNA, 20 bp, human
gcccggcaggcctcggggct

SEQ ID NO: 215115 - DNA, 20 bp, human
gtcatccaatcgcacggaag

SEQ ID NO: 215116 - DNA, 20 bp, human
gcgcgccgcaggctgggacg

SEQ ID NO: 215117 - DNA, 20 bp, human
gggctgggacgaggctagga

SEQ ID NO: 215118 - DNA, 20 bp, human
gggaagggatggggtctggt

SEQ ID NO: 215119 - DNA, 20 bp, human
ggcacggcgcgggaagggat

SEQ ID NO: 215120 - DNA, 20 bp, human
ggaaaaggtcagccggtggc

SEQ ID NO: 215121 - DNA, 20 bp, human
ggcagcccgcaggagctcat

SEQ ID NO: 215122 - DNA, 20 bp, human
gtcggtctgtgactccgcgt

SEQ ID NO: 215123 - DNA, 20 bp, human
gcgcaggctgggacgaggct

SEQ ID NO: 215124 - DNA, 20 bp, human
gagcctgcggcgcgcctggc

SEQ ID NO: 215125 - DNA, 20 bp, human
gaggcccccgtgcgtgacac

SEQ ID NO: 215126 - DNA, 20 bp, human
gagcaccccgctccggcctc

SEQ ID NO: 215127 - DNA, 20 bp, human
ggggaaccgacgctggagaa

SEQ ID NO: 215128 - DNA, 20 bp, human
gagacctggtggtagacgtc

SEQ ID NO: 215129 - DNA, 20 bp, human
gtcccgcgacccacggggag

SEQ ID NO: 215130 - DNA, 20 bp, human
ggattagccggaggccggag

SEQ ID NO: 215131 - DNA, 20 bp, human
ggagaagggggattagccgg

SEQ ID NO: 215132 - DNA, 20 bp, human
gctggagaagggggattagc

SEQ ID NO: 215133 - DNA, 20 bp, human
gaatcccccttctccagcgt

SEQ ID NO: 215134 - DNA, 20 bp, human
gtgtaggtcccgcgacccac

SEQ ID NO: 215135 - DNA, 20 bp, human
gacgtgggacttccagataa

SEQ ID NO: 215136 - DNA, 20 bp, human
gtggcccgggagagggtact

SEQ ID NO: 215137 - DNA, 20 bp, human
gggaccgcgccccgcgtctc

SEQ ID NO: 215138 - DNA, 20 bp, human
gcggggccagccagagacgc

SEQ ID NO: 215139 - DNA, 20 bp, human
gctcccaggcggcggctgaa

SEQ ID NO: 215140 - DNA, 20 bp, human
gggagagggtactggggttc

SEQ ID NO: 215141 - DNA, 20 bp, human
gactccctgccaagcccggg

SEQ ID NO: 215142 - DNA, 20 bp, human
gcagccagagacgcggggcg

SEQ ID NO: 215143 - DNA, 20 bp, human
gtccccgtggattgggctct

SEQ ID NO: 215144 - DNA, 20 bp, human
gcccgggtgggatagcgctt

SEQ ID NO: 215145 - DNA, 20 bp, human
gttccggccatcctttgctg

SEQ ID NO: 215146 - DNA, 20 bp, human
ggcacccagaagggagcgcg

SEQ ID NO: 215147 - DNA, 20 bp, human
gccccggcggcctcgctcaa

SEQ ID NO: 215148 - DNA, 20 bp, human
ggcgagcgctgcctgagagc

SEQ ID NO: 215149 - DNA, 20 bp, human
gtctgcctcagcccggttgc

SEQ ID NO: 215150 - DNA, 20 bp, human
gaactagcacggggataggg

SEQ ID NO: 215151 - DNA, 20 bp, human
gccaccccgcgctcccttct

SEQ ID NO: 215152 - DNA, 20 bp, human
gccagcctggcgaagagagg

SEQ ID NO: 215153 - DNA, 20 bp, human
ggggccccccacaccgcgct

SEQ ID NO: 215154 - DNA, 20 bp, human
gaagggaccggcccagatag

SEQ ID NO: 215155 - DNA, 20 bp, human
gaggccgggcaagcgtctcc

SEQ ID NO: 215156 - DNA, 20 bp, human
ggactcgagccgcactacag

SEQ ID NO: 215157 - DNA, 20 bp, human
gtcgagccgcactacagggg

SEQ ID NO: 215158 - DNA, 20 bp, human
ggccggcctcccctgtagtg

SEQ ID NO: 215159 - DNA, 20 bp, human
gtggcaactggtagcttcac

SEQ ID NO: 215160 - DNA, 20 bp, human
ggcagggcgcattctgtcag

SEQ ID NO: 215161 - DNA, 20 bp, human
ggccgcactacaggggaggc

SEQ ID NO: 215162 - DNA, 20 bp, human
ggaggctggaacaactgagt

SEQ ID NO: 215163 - DNA, 20 bp, human
gcgaggtttcagatttcatt

SEQ ID NO: 215164 - DNA, 20 bp, human
gaaccctcagacacagctcg

SEQ ID NO: 215165 - DNA, 20 bp, human
gtgtaaatatacagtacaag

SEQ ID NO: 215166 - DNA, 20 bp, human
ggatccgttaggtgaggaag

SEQ ID NO: 215167 - DNA, 20 bp, human
gtttggatgcttgatccgtt

SEQ ID NO: 215168 - DNA, 20 bp, human
gggtgtgggctttagaatca

SEQ ID NO: 215169 - DNA, 20 bp, human
gtgggctgtatacatggtgt

SEQ ID NO: 215170 - DNA, 20 bp, human
ggacccactcacatatccta

SEQ ID NO: 215171 - DNA, 20 bp, human
gtcaaaaccctccctacatc

SEQ ID NO: 215172 - DNA, 20 bp, human
gataacagaagcaaccattc

SEQ ID NO: 215173 - DNA, 20 bp, human
gtctcctcttcctcacctaa

SEQ ID NO: 215174 - DNA, 20 bp, human
gaccatgtcgcaagctctcc

SEQ ID NO: 215175 - DNA, 20 bp, human
gttagagttgaagtagatga

SEQ ID NO: 215176 - DNA, 20 bp, human
ggttgcagaccccgaaacct

SEQ ID NO: 215177 - DNA, 20 bp, human
gaggacgcccggcccttccg

SEQ ID NO: 215178 - DNA, 20 bp, human
gcggacctaggcgttggcga

SEQ ID NO: 215179 - DNA, 20 bp, human
gggtcttgatccaatcaaag

SEQ ID NO: 215180 - DNA, 20 bp, human
gagggccgggcgtcctcggg

SEQ ID NO: 215181 - DNA, 20 bp, human
gtggaggcagggtctgcggc

SEQ ID NO: 215182 - DNA, 20 bp, human
gcaggcgggcaaggtagcgg

SEQ ID NO: 215183 - DNA, 20 bp, human
gcaggggagggtgcgctgat

SEQ ID NO: 215184 - DNA, 20 bp, human
gctcgggcggcctgagggtc

SEQ ID NO: 215185 - DNA, 20 bp, human
ggtggccctcgccaacgcct

SEQ ID NO: 215186 - DNA, 20 bp, human
gccacaccatggctatgtct

SEQ ID NO: 215187 - DNA, 20 bp, human
gtatgtctgggcctcggatg

SEQ ID NO: 215188 - DNA, 20 bp, human
ggggcgcgcttgcacagaca

SEQ ID NO: 215189 - DNA, 20 bp, human
ggtcattagagcactgagtg

SEQ ID NO: 215190 - DNA, 20 bp, human
gcaccctccctgggcctaga

SEQ ID NO: 215191 - DNA, 20 bp, human
gcggaagtgctgcctgagtt

SEQ ID NO: 215192 - DNA, 20 bp, human
gtggaggggcctcaggttga

SEQ ID NO: 215193 - DNA, 20 bp, human
gcgaggcccagacatagcca

SEQ ID NO: 215194 - DNA, 20 bp, human
ggaccagtgagccgcatccg

SEQ ID NO: 215195 - DNA, 20 bp, human
gggcccagggagggtgtaat

SEQ ID NO: 215196 - DNA, 20 bp, human
gatcccagagtcaggaccaa

SEQ ID NO: 215197 - DNA, 20 bp, human
gaccaagggaagagtctcag

SEQ ID NO: 215198 - DNA, 20 bp, human
ggaagagttgatgtcccagg

SEQ ID NO: 215199 - DNA, 20 bp, human
gcccttctgagaggggatag

SEQ ID NO: 215200 - DNA, 20 bp, human
gaccatccccgcccagaggt

SEQ ID NO: 215201 - DNA, 20 bp, human
gtcctgggcagcaaaagaac

SEQ ID NO: 215202 - DNA, 20 bp, human
gggtcaccatccccgcccag

SEQ ID NO: 215203 - DNA, 20 bp, human
ggccttcccacctctgggcg

SEQ ID NO: 215204 - DNA, 20 bp, human
gcaaagccagtgcaataaag

SEQ ID NO: 215205 - DNA, 20 bp, human
gaactcttccacaacagggc

SEQ ID NO: 215206 - DNA, 20 bp, human
gcgaattcgcgcgcccgggg

SEQ ID NO: 215207 - DNA, 20 bp, human
gcgcccccactccagcccgt

SEQ ID NO: 215208 - DNA, 20 bp, human
ggggaaccacgcccacgggc

SEQ ID NO: 215209 - DNA, 20 bp, human
gacgctgggaaccacgccca

SEQ ID NO: 215210 - DNA, 20 bp, human
gacgcccacgggctggagtg

SEQ ID NO: 215211 - DNA, 20 bp, human
gcaggcgtgcacacgtacac

SEQ ID NO: 215212 - DNA, 20 bp, human
ggcggggcgggcctgcccgg

SEQ ID NO: 215213 - DNA, 20 bp, human
gcgcgcgaattcgcagacgc

SEQ ID NO: 215214 - DNA, 20 bp, human
gtaagcctccagttggaaga

SEQ ID NO: 215215 - DNA, 20 bp, human
gcaactggaggcttatcctg

SEQ ID NO: 215216 - DNA, 20 bp, human
gcgaccgcggcaggtacggg

SEQ ID NO: 215217 - DNA, 20 bp, human
gccggcgaccgcggcaggta

SEQ ID NO: 215218 - DNA, 20 bp, human
gtccggccgcgcgcaactga

SEQ ID NO: 215219 - DNA, 20 bp, human
gccagcatcacgggctgcgt

SEQ ID NO: 215220 - DNA, 20 bp, human
gttgcctcccgtacctgccg

SEQ ID NO: 215221 - DNA, 20 bp, human
gcggccgtggcggtagctgc

SEQ ID NO: 215222 - DNA, 20 bp, human
gccattggcccgcgctcccg

SEQ ID NO: 215223 - DNA, 20 bp, human
gggacgctgtcccagcatca

SEQ ID NO: 215224 - DNA, 20 bp, human
gtgcggctgcggctgagatt

SEQ ID NO: 215225 - DNA, 20 bp, human
ggtcacctgaggactagatg

SEQ ID NO: 215226 - DNA, 20 bp, human
gcctgtgtcaacttgctccc

SEQ ID NO: 215227 - DNA, 20 bp, human
gggtggggtgatggcgtctg

SEQ ID NO: 215228 - DNA, 20 bp, human
gaggtgatgtcagagccctg

SEQ ID NO: 215229 - DNA, 20 bp, human
ggtaaaaagcacactcacaa

SEQ ID NO: 215230 - DNA, 20 bp, human
gtggacttcattcattggtc

SEQ ID NO: 215231 - DNA, 20 bp, human
gaaccacagggcctagggtg

SEQ ID NO: 215232 - DNA, 20 bp, human
gggtccaaggtagagacctg

SEQ ID NO: 215233 - DNA, 20 bp, human
gaggctgggccacgagacac

SEQ ID NO: 215234 - DNA, 20 bp, human
gaagccccaggtctctacct

SEQ ID NO: 215235 - DNA, 20 bp, human
gacaataaggaattcaggct

SEQ ID NO: 215236 - DNA, 20 bp, human
gctagaggaagtaggtgggt

SEQ ID NO: 215237 - DNA, 20 bp, human
gtctccggggcacttagtaa

SEQ ID NO: 215238 - DNA, 20 bp, human
gggagctagaggaagtaggt

SEQ ID NO: 215239 - DNA, 20 bp, human
gcagctcaggaaatgctgga

SEQ ID NO: 215240 - DNA, 20 bp, human
gtcgtctgaaggcgagacag

SEQ ID NO: 215241 - DNA, 20 bp, human
gtcctgagctggatgatcct

SEQ ID NO: 215242 - DNA, 20 bp, human
ggggcacttagtaaggggtg

SEQ ID NO: 215243 - DNA, 20 bp, human
ggggtgggttgaggagcacg

SEQ ID NO: 215244 - DNA, 20 bp, human
gcccgcgtccgcgtcgtctc

SEQ ID NO: 215245 - DNA, 20 bp, human
gggggctgcccagttatctc

SEQ ID NO: 215246 - DNA, 20 bp, human
gtagaccctcccactgcctt

SEQ ID NO: 215247 - DNA, 20 bp, human
gggtctaggtgtcaccagta

SEQ ID NO: 215248 - DNA, 20 bp, human
gtcacgcagcctaaggcagt

SEQ ID NO: 215249 - DNA, 20 bp, human
ggcaccagtacctgtcacta

SEQ ID NO: 215250 - DNA, 20 bp, human
gtggagtccgagatcaaaaa

SEQ ID NO: 215251 - DNA, 20 bp, human
gttgatctcggactccagaa

SEQ ID NO: 215252 - DNA, 20 bp, human
gatagatctcacagttaagg

SEQ ID NO: 215253 - DNA, 20 bp, human
gagagtgagacataaaagct

SEQ ID NO: 215254 - DNA, 20 bp, human
gtgctggtttaattacagtc

SEQ ID NO: 215255 - DNA, 20 bp, human
gcacttaataagttaaaaat

SEQ ID NO: 215256 - DNA, 20 bp, human
gtggcgctgtcaaacttcga

SEQ ID NO: 215257 - DNA, 20 bp, human
gccacccggaggcttctcat

SEQ ID NO: 215258 - DNA, 20 bp, human
gtggctccgcccttggcctt

SEQ ID NO: 215259 - DNA, 20 bp, human
gcgaggacacagagccgggg

SEQ ID NO: 215260 - DNA, 20 bp, human
gtgggcggggcatcggccta

SEQ ID NO: 215261 - DNA, 20 bp, human
ggggcatcggcctaaggcca

SEQ ID NO: 215262 - DNA, 20 bp, human
ggctgtcaaacttcgagggg

SEQ ID NO: 215263 - DNA, 20 bp, human
ggcccatgactgcttttcat

SEQ ID NO: 215264 - DNA, 20 bp, human
gaaaccaatgagaagcctcc

SEQ ID NO: 215265 - DNA, 20 bp, human
ggctccggcgcgcgccccac

SEQ ID NO: 215266 - DNA, 20 bp, human
gccacccccactaataatgt

SEQ ID NO: 215267 - DNA, 20 bp, human
gtggtgaacagtgaccatac

SEQ ID NO: 215268 - DNA, 20 bp, human
gttggctatttggcgatgag

SEQ ID NO: 215269 - DNA, 20 bp, human
gccaacatttcttcctagat

SEQ ID NO: 215270 - DNA, 20 bp, human
gggaagaaatgttggctatt

SEQ ID NO: 215271 - DNA, 20 bp, human
ggctatttggcgatgagagg

SEQ ID NO: 215272 - DNA, 20 bp, human
gccagggttagggcaggata

SEQ ID NO: 215273 - DNA, 20 bp, human
gtactggtatacaacactat

SEQ ID NO: 215274 - DNA, 20 bp, human
ggacatgcagcaaaaatgcc

SEQ ID NO: 215275 - DNA, 20 bp, human
gagtaaacatctcatgtgtc

SEQ ID NO: 215276 - DNA, 20 bp, human
gctcgagcatgtcacgaagg

SEQ ID NO: 215277 - DNA, 20 bp, human
gcacctcgagcatgtcacga

SEQ ID NO: 215278 - DNA, 20 bp, human
gtctcttctggcaggagggg

SEQ ID NO: 215279 - DNA, 20 bp, human
gtctctgcctcccttcgcgt

SEQ ID NO: 215280 - DNA, 20 bp, human
gtcctgggaagctgattctg

SEQ ID NO: 215281 - DNA, 20 bp, human
gcaaggggctgcgggaccag

SEQ ID NO: 215282 - DNA, 20 bp, human
gccttgccccacgcgaaggg

SEQ ID NO: 215283 - DNA, 20 bp, human
gaggtagcgcacctgtccca

SEQ ID NO: 215284 - DNA, 20 bp, human
gcagcggcctctcttctggc

SEQ ID NO: 215285 - DNA, 20 bp, human
gtcagatttggggctcacca

SEQ ID NO: 215286 - DNA, 20 bp, human
ggaggcctctggcgcggcga

SEQ ID NO: 215287 - DNA, 20 bp, human
gatgccgcgcgcgccctccg

SEQ ID NO: 215288 - DNA, 20 bp, human
gcgccagcgcatgcgtgatg

SEQ ID NO: 215289 - DNA, 20 bp, human
gctctggcgcggcgacgggg

SEQ ID NO: 215290 - DNA, 20 bp, human
ggacctaccctgtgagttag

SEQ ID NO: 215291 - DNA, 20 bp, human
gtcacagggtaggtccgcgc

SEQ ID NO: 215292 - DNA, 20 bp, human
ggctctgcaccgaaagagac

SEQ ID NO: 215293 - DNA, 20 bp, human
gggtccgcgcgggaggcctc

SEQ ID NO: 215294 - DNA, 20 bp, human
gaagacaccgctaactcaca

SEQ ID NO: 215295 - DNA, 20 bp, human
gcaccgctaactcacagggt

SEQ ID NO: 215296 - DNA, 20 bp, human
gacaggccagcgcacggggc

SEQ ID NO: 215297 - DNA, 20 bp, human
gctgccgaggcgcggaataa

SEQ ID NO: 215298 - DNA, 20 bp, human
ggggctgtcgcgccgaggga

SEQ ID NO: 215299 - DNA, 20 bp, human
ggagccggtcagcgcggggc

SEQ ID NO: 215300 - DNA, 20 bp, human
gcggctgtgcgcgcgtctgt

SEQ ID NO: 215301 - DNA, 20 bp, human
gcacggggcgggccaatgcg

SEQ ID NO: 215302 - DNA, 20 bp, human
gcgcacagccgcaggtggag

SEQ ID NO: 215303 - DNA, 20 bp, human
gcgggacaggccagcgcacg

SEQ ID NO: 215304 - DNA, 20 bp, human
gcccggcggccgtgcacttc

SEQ ID NO: 215305 - DNA, 20 bp, human
ggctgaccggctccgcgcat

SEQ ID NO: 215306 - DNA, 20 bp, human
gggcaaggccggggcacagt

SEQ ID NO: 215307 - DNA, 20 bp, human
gtaggtgcaggcccaatggg

SEQ ID NO: 215308 - DNA, 20 bp, human
gccaatgggaggggacggca

SEQ ID NO: 215309 - DNA, 20 bp, human
ggggatgccagcttacgttg

SEQ ID NO: 215310 - DNA, 20 bp, human
ggggctggcactgcccgcga

SEQ ID NO: 215311 - DNA, 20 bp, human
gccaccgggagccgcgctgg

SEQ ID NO: 215312 - DNA, 20 bp, human
gcagctctcaaggctccctg

SEQ ID NO: 215313 - DNA, 20 bp, human
gggaccccatcggatgtctg

SEQ ID NO: 215314 - DNA, 20 bp, human
gccctccaggcccccttggt

SEQ ID NO: 215315 - DNA, 20 bp, human
ggcctaggtgcaggcccaat

SEQ ID NO: 215316 - DNA, 20 bp, human
gctgcactggaactgcgagg

SEQ ID NO: 215317 - DNA, 20 bp, human
gagttccagtgcaggcgggt

SEQ ID NO: 215318 - DNA, 20 bp, human
ggcgagtgcctgcctgtagg

SEQ ID NO: 215319 - DNA, 20 bp, human
gggcggggctggcttggccg

SEQ ID NO: 215320 - DNA, 20 bp, human
gcgcctgcactggaactgcg

SEQ ID NO: 215321 - DNA, 20 bp, human
ggccggggccacctacaggc

SEQ ID NO: 215322 - DNA, 20 bp, human
gcttggccggggccacctac

SEQ ID NO: 215323 - DNA, 20 bp, human
gggcgtccggagagcctccc

SEQ ID NO: 215324 - DNA, 20 bp, human
gcgacccaggggtttttatc

SEQ ID NO: 215325 - DNA, 20 bp, human
ggcggcgagtgcctgcctgt

SEQ ID NO: 215326 - DNA, 20 bp, human
gggagggcaaaggggcgaag

SEQ ID NO: 215327 - DNA, 20 bp, human
ggaaaccaggggcccaagag

SEQ ID NO: 215328 - DNA, 20 bp, human
gcagtgcgggcggacgggtg

SEQ ID NO: 215329 - DNA, 20 bp, human
gccctggagcccagtgcggg

SEQ ID NO: 215330 - DNA, 20 bp, human
gcacagccgcaactccggcc

SEQ ID NO: 215331 - DNA, 20 bp, human
gctaacaccccagccaaggc

SEQ ID NO: 215332 - DNA, 20 bp, human
gaaggccggagcgcaagcgc

SEQ ID NO: 215333 - DNA, 20 bp, human
gcagccccgcgcttgcgctc

SEQ ID NO: 215334 - DNA, 20 bp, human
gggtggaggggacactgtta

SEQ ID NO: 215335 - DNA, 20 bp, human
gctggggaaaccctccccct

SEQ ID NO: 215336 - DNA, 20 bp, human
gcaaactttggacagaggaa

SEQ ID NO: 215337 - DNA, 20 bp, human
gcggtccccgtgcgcctgtg

SEQ ID NO: 215338 - DNA, 20 bp, human
gggcgcgaaactacaagtcc

SEQ ID NO: 215339 - DNA, 20 bp, human
ggacagtggagtgcggaggt

SEQ ID NO: 215340 - DNA, 20 bp, human
gcaaggacagtggagtgcgg

SEQ ID NO: 215341 - DNA, 20 bp, human
gccccgcgccggactgggac

SEQ ID NO: 215342 - DNA, 20 bp, human
gcccggggcagagcaatgcc

SEQ ID NO: 215343 - DNA, 20 bp, human
gcggagaacgccgtgcatgc

SEQ ID NO: 215344 - DNA, 20 bp, human
gtggctgataaaacggtcta

SEQ ID NO: 215345 - DNA, 20 bp, human
gtgcacggcgttctccgcac

SEQ ID NO: 215346 - DNA, 20 bp, human
gccaggctcccgggagacga

SEQ ID NO: 215347 - DNA, 20 bp, human
gaaggcgcgagctatccagt

SEQ ID NO: 215348 - DNA, 20 bp, human
ggaggcgtcgcgaggtgaag

SEQ ID NO: 215349 - DNA, 20 bp, human
gcgcgccgggagagatgctg

SEQ ID NO: 215350 - DNA, 20 bp, human
ggcgtcgcgaggtgaagggg

SEQ ID NO: 215351 - DNA, 20 bp, human
gagctatccagtcggaggga

SEQ ID NO: 215352 - DNA, 20 bp, human
ggcgcgagctatccagtcgg

SEQ ID NO: 215353 - DNA, 20 bp, human
gcagccacacacccgaccgg

SEQ ID NO: 215354 - DNA, 20 bp, human
gagggaaccaatggtgggag

SEQ ID NO: 215355 - DNA, 20 bp, human
gaagccaatgggggagtgga

SEQ ID NO: 215356 - DNA, 20 bp, human
gccagcctgacacctgtcgt

SEQ ID NO: 215357 - DNA, 20 bp, human
gggtcccacgggtccgggga

SEQ ID NO: 215358 - DNA, 20 bp, human
gcgctcctggcgggtccctc

SEQ ID NO: 215359 - DNA, 20 bp, human
gtcctggcgggtccctccgg

SEQ ID NO: 215360 - DNA, 20 bp, human
gccgccgctgacagctgttg

SEQ ID NO: 215361 - DNA, 20 bp, human
gtcagcagccggggtcccac

SEQ ID NO: 215362 - DNA, 20 bp, human
gccgcccatcgcatcagact

SEQ ID NO: 215363 - DNA, 20 bp, human
gcggccgagtctgatgcgat

SEQ ID NO: 215364 - DNA, 20 bp, human
gccacgggtccggggagggt

SEQ ID NO: 215365 - DNA, 20 bp, human
ggccggggtcccacgggtcc

SEQ ID NO: 215366 - DNA, 20 bp, human
gagggtgagcacgtcctcag

SEQ ID NO: 215367 - DNA, 20 bp, human
ggcgagggggcgtgtgcaag

SEQ ID NO: 215368 - DNA, 20 bp, human
gcagacccagcgaggcgtcg

SEQ ID NO: 215369 - DNA, 20 bp, human
gcgtgtgcaagaggcggagc

SEQ ID NO: 215370 - DNA, 20 bp, human
gtcagagggcagacccagcg

SEQ ID NO: 215371 - DNA, 20 bp, human
gcgaggcgtcgtggcagctg

SEQ ID NO: 215372 - DNA, 20 bp, human
ggggtcgaaggacatcgtgt

SEQ ID NO: 215373 - DNA, 20 bp, human
gcgtggggccctcggaagag

SEQ ID NO: 215374 - DNA, 20 bp, human
ggctgccacgacgcctcgct

SEQ ID NO: 215375 - DNA, 20 bp, human
gcgaccgcagtgctgggcgg

SEQ ID NO: 215376 - DNA, 20 bp, human
gccgggaatcggggtgccca

SEQ ID NO: 215377 - DNA, 20 bp, human
gcccagggtgcgatgtgcga

SEQ ID NO: 215378 - DNA, 20 bp, human
ggcggcccagccgggaatcg

SEQ ID NO: 215379 - DNA, 20 bp, human
gggctcccgccgggtagcag

SEQ ID NO: 215380 - DNA, 20 bp, human
gggtccacctgtgtgtcggg

SEQ ID NO: 215381 - DNA, 20 bp, human
gcgacacacaggtggaccca

SEQ ID NO: 215382 - DNA, 20 bp, human
gccggcgggagccatttccc

SEQ ID NO: 215383 - DNA, 20 bp, human
gctgcccgggagccacgtcc

SEQ ID NO: 215384 - DNA, 20 bp, human
gacggcacccatgcctgggg

SEQ ID NO: 215385 - DNA, 20 bp, human
gagctcgtgcacctgggaaa

SEQ ID NO: 215386 - DNA, 20 bp, human
gcagagaagggtctacagaa

SEQ ID NO: 215387 - DNA, 20 bp, human
ggggcaagtcacatctctag

SEQ ID NO: 215388 - DNA, 20 bp, human
gaggggaacaggctttttgt

SEQ ID NO: 215389 - DNA, 20 bp, human
ggaggcgggaagttggcaac

SEQ ID NO: 215390 - DNA, 20 bp, human
gaagttggcaacaggaagtg

SEQ ID NO: 215391 - DNA, 20 bp, human
gaggagcccctttccaccca

SEQ ID NO: 215392 - DNA, 20 bp, human
gagacctgctgtagcctatc

SEQ ID NO: 215393 - DNA, 20 bp, human
gccctctctttcttaaccgt

SEQ ID NO: 215394 - DNA, 20 bp, human
ggtgcggggagacatctgtg

SEQ ID NO: 215395 - DNA, 20 bp, human
gaggcagccgagaggcaaac

SEQ ID NO: 215396 - DNA, 20 bp, human
ggccctgcctgtcacttccg

SEQ ID NO: 215397 - DNA, 20 bp, human
ggcacgccgtcgccatcttg

SEQ ID NO: 215398 - DNA, 20 bp, human
gggcgccctgggctcgcgta

SEQ ID NO: 215399 - DNA, 20 bp, human
gctcgcgtagggaagtgccc

SEQ ID NO: 215400 - DNA, 20 bp, human
gtcgtgggcgcgttccgcgt

SEQ ID NO: 215401 - DNA, 20 bp, human
gtcttgcggctgggcctcgt

SEQ ID NO: 215402 - DNA, 20 bp, human
gggaccggacctcgcctccc

SEQ ID NO: 215403 - DNA, 20 bp, human
gcagggcgcccgcacccggg

SEQ ID NO: 215404 - DNA, 20 bp, human
ggaagtgccctggcttacag

SEQ ID NO: 215405 - DNA, 20 bp, human
gaccccggaagtgacaggca

SEQ ID NO: 215406 - DNA, 20 bp, human
gataggcagtgcaaaggaac

SEQ ID NO: 215407 - DNA, 20 bp, human
gacaagaatgctgctcaagt

SEQ ID NO: 215408 - DNA, 20 bp, human
gcatgcatctccacgtcaca

SEQ ID NO: 215409 - DNA, 20 bp, human
gcatgacagcccgtgtgacg

SEQ ID NO: 215410 - DNA, 20 bp, human
gagttggctgatcaagagat

SEQ ID NO: 215411 - DNA, 20 bp, human
gcagtgggaacagaagtgag

SEQ ID NO: 215412 - DNA, 20 bp, human
ggtgtggagcctatagctat

SEQ ID NO: 215413 - DNA, 20 bp, human
gtcaggctccttacctccat

SEQ ID NO: 215414 - DNA, 20 bp, human
ggagtactggcagttagaac

SEQ ID NO: 215415 - DNA, 20 bp, human
gcagggtttcctcttcaagt

SEQ ID NO: 215416 - DNA, 20 bp, human
gacgcggacgcacgcagccg

SEQ ID NO: 215417 - DNA, 20 bp, human
gggtcctggcacgccggcgg

SEQ ID NO: 215418 - DNA, 20 bp, human
gcggggtcctggcacgccgg

SEQ ID NO: 215419 - DNA, 20 bp, human
ggcgtccgggcgcttctgtg

SEQ ID NO: 215420 - DNA, 20 bp, human
gtcgcccccgccggcgtgcc

SEQ ID NO: 215421 - DNA, 20 bp, human
gtgcccggctctggccagca

SEQ ID NO: 215422 - DNA, 20 bp, human
gacccgggtgccggcccgtg

SEQ ID NO: 215423 - DNA, 20 bp, human
gggctcccgccgcgccgtgg

SEQ ID NO: 215424 - DNA, 20 bp, human
gggctggcccaacaccctac

SEQ ID NO: 215425 - DNA, 20 bp, human
gggcgacacgcgcgtctctg

SEQ ID NO: 215426 - DNA, 20 bp, human
gggcgggcaagcggcgagaa

SEQ ID NO: 215427 - DNA, 20 bp, human
gttgccccccagcacctccg

SEQ ID NO: 215428 - DNA, 20 bp, human
gccccccagcacctccgggg

SEQ ID NO: 215429 - DNA, 20 bp, human
gggagcccgcgcccggcgga

SEQ ID NO: 215430 - DNA, 20 bp, human
ggactcgcatctcccggctg

SEQ ID NO: 215431 - DNA, 20 bp, human
gggaccgatggacaaagccg

SEQ ID NO: 215432 - DNA, 20 bp, human
gtctccccggctttgtccat

SEQ ID NO: 215433 - DNA, 20 bp, human
ggaggtcgtggctcggtcta

SEQ ID NO: 215434 - DNA, 20 bp, human
ggacaaagccggggagagct

SEQ ID NO: 215435 - DNA, 20 bp, human
ggcgggggccggtgcccgca

SEQ ID NO: 215436 - DNA, 20 bp, human
ggggaggagtagagtcgtcg

SEQ ID NO: 215437 - DNA, 20 bp, human
gaggccagatagggccgctc

SEQ ID NO: 215438 - DNA, 20 bp, human
ggcgccacgcaggccagata

SEQ ID NO: 215439 - DNA, 20 bp, human
ggacgggggcagtcgagata

SEQ ID NO: 215440 - DNA, 20 bp, human
ggggcgcaaaggtggactca

SEQ ID NO: 215441 - DNA, 20 bp, human
gaggccagagcggccctatc

SEQ ID NO: 215442 - DNA, 20 bp, human
gcggccctatctggcctgcg

SEQ ID NO: 215443 - DNA, 20 bp, human
ggcgacgcggcggcaggggt

SEQ ID NO: 215444 - DNA, 20 bp, human
gcgcgcccggaggtgcagat

SEQ ID NO: 215445 - DNA, 20 bp, human
gggagtagagtcgtcggggc

SEQ ID NO: 215446 - DNA, 20 bp, human
gggcggccacgtggcctcga

SEQ ID NO: 215447 - DNA, 20 bp, human
gtggcctcgaaggaatgcgc

SEQ ID NO: 215448 - DNA, 20 bp, human
ggcgcccgcgcattccttcg

SEQ ID NO: 215449 - DNA, 20 bp, human
ggcgctgccgagaaaccggc

SEQ ID NO: 215450 - DNA, 20 bp, human
gaaggaatgcgcgggcgcga

SEQ ID NO: 215451 - DNA, 20 bp, human
ggctgcgcacgcgtgggagg

SEQ ID NO: 215452 - DNA, 20 bp, human
gcggggcaggagatgatccg

SEQ ID NO: 215453 - DNA, 20 bp, human
gccacccaccatgctgtcat

SEQ ID NO: 215454 - DNA, 20 bp, human
gcccgccaatgacagcatgg

SEQ ID NO: 215455 - DNA, 20 bp, human
ggcccaggctgcgcacgcgt

SEQ ID NO: 215456 - DNA, 20 bp, human
ggggctgccgggaccgctgg

SEQ ID NO: 215457 - DNA, 20 bp, human
gtgctcccagcgcgccgcga

SEQ ID NO: 215458 - DNA, 20 bp, human
gcggccccccacagtacagg

SEQ ID NO: 215459 - DNA, 20 bp, human
gggaggccacgtctccctcg

SEQ ID NO: 215460 - DNA, 20 bp, human
ggaagtggggaccccggggt

SEQ ID NO: 215461 - DNA, 20 bp, human
gccggccaccaggggttaag

SEQ ID NO: 215462 - DNA, 20 bp, human
gtcccggggcgccgcggctg

SEQ ID NO: 215463 - DNA, 20 bp, human
gaccgctgggggctcgcagc

SEQ ID NO: 215464 - DNA, 20 bp, human
gacccgctgcgagcccccag

SEQ ID NO: 215465 - DNA, 20 bp, human
gaactgaggcccgcggggat

SEQ ID NO: 215466 - DNA, 20 bp, human
gacaggggcgggccggtcgg

SEQ ID NO: 215467 - DNA, 20 bp, human
ggggaaggagaaaggctcgc

SEQ ID NO: 215468 - DNA, 20 bp, human
ggaaaggctcgcagggaagg

SEQ ID NO: 215469 - DNA, 20 bp, human
gcgagcgagcggcgaaccga

SEQ ID NO: 215470 - DNA, 20 bp, human
gccccgccccgcgggagcga

SEQ ID NO: 215471 - DNA, 20 bp, human
ggggaccggccgaggagcga

SEQ ID NO: 215472 - DNA, 20 bp, human
gtcgccgctcgctcgggcgc

SEQ ID NO: 215473 - DNA, 20 bp, human
ggtcgcggccgcgggaaccg

SEQ ID NO: 215474 - DNA, 20 bp, human
gcgggaaccgaggcagggaa

SEQ ID NO: 215475 - DNA, 20 bp, human
gcgacggcaaagggttgtgg

SEQ ID NO: 215476 - DNA, 20 bp, human
gggggccataaagtcggcgg

SEQ ID NO: 215477 - DNA, 20 bp, human
gctcgcgccggacgcggcca

SEQ ID NO: 215478 - DNA, 20 bp, human
ggggaagcgcgagctcgcgc

SEQ ID NO: 215479 - DNA, 20 bp, human
gcttcccgaagtcagagggg

SEQ ID NO: 215480 - DNA, 20 bp, human
ggagggggccataaagtcgg

SEQ ID NO: 215481 - DNA, 20 bp, human
ggcggcttcccgaagtcaga

SEQ ID NO: 215482 - DNA, 20 bp, human
gctcccaaaccgggctccgg

SEQ ID NO: 215483 - DNA, 20 bp, human
gccgcgctctcgcccttgaa

SEQ ID NO: 215484 - DNA, 20 bp, human
gggggagggggccataaagt

SEQ ID NO: 215485 - DNA, 20 bp, human
gcctccgccggagcccggtt

SEQ ID NO: 215486 - DNA, 20 bp, human
gccttggagcgaggaatgca

SEQ ID NO: 215487 - DNA, 20 bp, human
gcccacccagccattgtgtc

SEQ ID NO: 215488 - DNA, 20 bp, human
ggggacctactgcagagtta

SEQ ID NO: 215489 - DNA, 20 bp, human
gattctggggtgggaactca

SEQ ID NO: 215490 - DNA, 20 bp, human
gtgttcctgtgattctgggg

SEQ ID NO: 215491 - DNA, 20 bp, human
gcagattgagatctctgcgg

SEQ ID NO: 215492 - DNA, 20 bp, human
gcataggggtgaggtggaca

SEQ ID NO: 215493 - DNA, 20 bp, human
gaggactgaagagagaagtg

SEQ ID NO: 215494 - DNA, 20 bp, human
gggggtgtccggttgggagg

SEQ ID NO: 215495 - DNA, 20 bp, human
gagcctgcgggagggtccct

SEQ ID NO: 215496 - DNA, 20 bp, human
ggctccagccggcccaggtg

SEQ ID NO: 215497 - DNA, 20 bp, human
gcggctcggcgggaatcgag

SEQ ID NO: 215498 - DNA, 20 bp, human
gccagtccgggcgatcacgt

SEQ ID NO: 215499 - DNA, 20 bp, human
ggcggcgccgcctgcgtcac

SEQ ID NO: 215500 - DNA, 20 bp, human
gactcccgggccggcctcga

SEQ ID NO: 215501 - DNA, 20 bp, human
gtggagcccacgtgatcgcc

SEQ ID NO: 215502 - DNA, 20 bp, human
ggggctgtgacctgtgacgc

SEQ ID NO: 215503 - DNA, 20 bp, human
ggagaggcgcgatccagtcc

SEQ ID NO: 215504 - DNA, 20 bp, human
gcgatcacgtgggctccagc

SEQ ID NO: 215505 - DNA, 20 bp, human
gggctggtctccttccccga

SEQ ID NO: 215506 - DNA, 20 bp, human
ggcctcgcgcccaaaagagg

SEQ ID NO: 215507 - DNA, 20 bp, human
gtggtgggagggaatcaggg

SEQ ID NO: 215508 - DNA, 20 bp, human
gcggcctgctgggctcccga

SEQ ID NO: 215509 - DNA, 20 bp, human
gagcctgggaaccgcgtggt

SEQ ID NO: 215510 - DNA, 20 bp, human
ggagccgcgggctaactgaa

SEQ ID NO: 215511 - DNA, 20 bp, human
gggctcccgagggacctctc

SEQ ID NO: 215512 - DNA, 20 bp, human
gccctccagagaggtccctc

SEQ ID NO: 215513 - DNA, 20 bp, human
gagggcgccgcgtccaccgc

SEQ ID NO: 215514 - DNA, 20 bp, human
gtccgcctgcccaacgccct

SEQ ID NO: 215515 - DNA, 20 bp, human
gtgggaaccgcgtggtggga

SEQ ID NO: 215516 - DNA, 20 bp, human
ggctccccgagccgtggtga

SEQ ID NO: 215517 - DNA, 20 bp, human
ggaaggaggcgtgccctcga

SEQ ID NO: 215518 - DNA, 20 bp, human
ggcagagggcgtgacccgga

SEQ ID NO: 215519 - DNA, 20 bp, human
gggtgctcgcggcgagggtg

SEQ ID NO: 215520 - DNA, 20 bp, human
ggccccctcaccacggctcg

SEQ ID NO: 215521 - DNA, 20 bp, human
gcgcgggcaccgaagtggga

SEQ ID NO: 215522 - DNA, 20 bp, human
gagccgtggtgagggggcgt

SEQ ID NO: 215523 - DNA, 20 bp, human
gtcggccttgagaggggcgc

SEQ ID NO: 215524 - DNA, 20 bp, human
gagggtgagggcgacttttg

SEQ ID NO: 215525 - DNA, 20 bp, human
gcgcgagcaccctcccactt

SEQ ID NO: 215526 - DNA, 20 bp, human
gggccagcgcccgcgaactg

SEQ ID NO: 215527 - DNA, 20 bp, human
gcccccagccgtcctctatc

SEQ ID NO: 215528 - DNA, 20 bp, human
gaagtgacgcgggctcttga

SEQ ID NO: 215529 - DNA, 20 bp, human
gtcctgatagaggacggctg

SEQ ID NO: 215530 - DNA, 20 bp, human
ggccgagcgctgcgcccgga

SEQ ID NO: 215531 - DNA, 20 bp, human
gggacggctgggggaaagac

SEQ ID NO: 215532 - DNA, 20 bp, human
gacgggcgggggagagcgtg

SEQ ID NO: 215533 - DNA, 20 bp, human
gggcccctcctctgcgccct

SEQ ID NO: 215534 - DNA, 20 bp, human
gccgaggaaaagccgggcag

SEQ ID NO: 215535 - DNA, 20 bp, human
gcgggctcttgagggaaccg

SEQ ID NO: 215536 - DNA, 20 bp, human
ggggacgccagggtttgtgt

SEQ ID NO: 215537 - DNA, 20 bp, human
gggcagctcggagaggtacg

SEQ ID NO: 215538 - DNA, 20 bp, human
gggcctctcaaacctgtcct

SEQ ID NO: 215539 - DNA, 20 bp, human
ggggtgcccgcgcgcaggac

SEQ ID NO: 215540 - DNA, 20 bp, human
gcgcgcaggacgggacgcca

SEQ ID NO: 215541 - DNA, 20 bp, human
ggccaacctgggtccggcga

SEQ ID NO: 215542 - DNA, 20 bp, human
gggtacgagggtcctaggac

SEQ ID NO: 215543 - DNA, 20 bp, human
gagggaaaaagggagggcga

SEQ ID NO: 215544 - DNA, 20 bp, human
gagctaagaggcgggtctct

SEQ ID NO: 215545 - DNA, 20 bp, human
gccttcctgagcttgggcgg

SEQ ID NO: 215546 - DNA, 20 bp, human
ggaacccggcgcaggcagga

SEQ ID NO: 215547 - DNA, 20 bp, human
gtggggaggggaaaaagcgc

SEQ ID NO: 215548 - DNA, 20 bp, human
gcagagcccgggatgcgaga

SEQ ID NO: 215549 - DNA, 20 bp, human
gagcgctggggacgtggagt

SEQ ID NO: 215550 - DNA, 20 bp, human
gtgggaacgtggtggtgtct

SEQ ID NO: 215551 - DNA, 20 bp, human
gagggggaacgcgatggaga

SEQ ID NO: 215552 - DNA, 20 bp, human
gcccgggatgcgagagggag

SEQ ID NO: 215553 - DNA, 20 bp, human
gtccccggccgagtggacag

SEQ ID NO: 215554 - DNA, 20 bp, human
gggcgatcggggcgggaacc

SEQ ID NO: 215555 - DNA, 20 bp, human
gtctgggggaggggcgatcg

SEQ ID NO: 215556 - DNA, 20 bp, human
gggagactggggctgattgt

SEQ ID NO: 215557 - DNA, 20 bp, human
ggctgattgtaggcacgcgg

SEQ ID NO: 215558 - DNA, 20 bp, human
ggatctgggcggggccgaaa

SEQ ID NO: 215559 - DNA, 20 bp, human
gcggtttcccagggagactg

SEQ ID NO: 215560 - DNA, 20 bp, human
gacttctagccccaaaacgc

SEQ ID NO: 215561 - DNA, 20 bp, human
ggtgcgctcgtcggtttccc

SEQ ID NO: 215562 - DNA, 20 bp, human
gcgacgagcgcacctgagct

SEQ ID NO: 215563 - DNA, 20 bp, human
ggctgcgatggaggcggatc

SEQ ID NO: 215564 - DNA, 20 bp, human
gttgcttctggctgcgatgg

SEQ ID NO: 215565 - DNA, 20 bp, human
gtgggggcgtagtcaggcgt

SEQ ID NO: 215566 - DNA, 20 bp, human
ggggctgaagccaaggttta

SEQ ID NO: 215567 - DNA, 20 bp, human
gtgggcaggcggggatccag

SEQ ID NO: 215568 - DNA, 20 bp, human
gcgggcctcgccatgtgatg

SEQ ID NO: 215569 - DNA, 20 bp, human
gcctccgcgcctccgatctc

SEQ ID NO: 215570 - DNA, 20 bp, human
gcgccggccgcgcccgacac

SEQ ID NO: 215571 - DNA, 20 bp, human
gccgggccgtattatgtcac

SEQ ID NO: 215572 - DNA, 20 bp, human
gtcgcggcggccgcatcaca

SEQ ID NO: 215573 - DNA, 20 bp, human
gctggcggagacagcgcggt

SEQ ID NO: 215574 - DNA, 20 bp, human
gaacggccgcagccccgcag

SEQ ID NO: 215575 - DNA, 20 bp, human
ggcccgacaccggctccagg

SEQ ID NO: 215576 - DNA, 20 bp, human
gtggggctgcgaggggcgtg

SEQ ID NO: 215577 - DNA, 20 bp, human
gaatcgcggcccacgctctg

SEQ ID NO: 215578 - DNA, 20 bp, human
ggggcgcccccgcagagcgt

SEQ ID NO: 215579 - DNA, 20 bp, human
ggggccctcccggcagcgtg

SEQ ID NO: 215580 - DNA, 20 bp, human
gcgcggcccacgctctgcgg

SEQ ID NO: 215581 - DNA, 20 bp, human
gccgcagcgcggacacctcc

SEQ ID NO: 215582 - DNA, 20 bp, human
gcgggcaacggggagaaagg

SEQ ID NO: 215583 - DNA, 20 bp, human
gagcccgaaaggagctatca

SEQ ID NO: 215584 - DNA, 20 bp, human
gcccggagtcgaataccagc

SEQ ID NO: 215585 - DNA, 20 bp, human
ggggcccacgtgccgcagcg

SEQ ID NO: 215586 - DNA, 20 bp, human
gaattcattattcaaattta

SEQ ID NO: 215587 - DNA, 20 bp, human
gaagtacacatttagcataa

SEQ ID NO: 215588 - DNA, 20 bp, human
gaccaatagatcttaattaa

SEQ ID NO: 215589 - DNA, 20 bp, human
gtccattaattaagatctat

SEQ ID NO: 215590 - DNA, 20 bp, human
ggtacatgcaatttcagaag

SEQ ID NO: 215591 - DNA, 20 bp, human
gttgaaatgaacacagcttg

SEQ ID NO: 215592 - DNA, 20 bp, human
gaaaacaaatccaggtatga

SEQ ID NO: 215593 - DNA, 20 bp, human
ggtatgatggcataagcctg

SEQ ID NO: 215594 - DNA, 20 bp, human
gtagaagtttgagaacaacc

SEQ ID NO: 215595 - DNA, 20 bp, human
gaaaatgctacattcttatt

SEQ ID NO: 215596 - DNA, 20 bp, human
gagtgccgggccggcggaga

SEQ ID NO: 215597 - DNA, 20 bp, human
gcccgggctcccctctccgc

SEQ ID NO: 215598 - DNA, 20 bp, human
gctgtcccagggagccccga

SEQ ID NO: 215599 - DNA, 20 bp, human
gcgcgccctcggggctccct

SEQ ID NO: 215600 - DNA, 20 bp, human
gaagctcccgcgtcagagct

SEQ ID NO: 215601 - DNA, 20 bp, human
gctgggaagtgccgggccgg

SEQ ID NO: 215602 - DNA, 20 bp, human
ggcgcaggcggggtgacccg

SEQ ID NO: 215603 - DNA, 20 bp, human
gcgtcagagctgggaagtgc

SEQ ID NO: 215604 - DNA, 20 bp, human
gcggtgcgcgggcgcaggtc

SEQ ID NO: 215605 - DNA, 20 bp, human
ggcggggtgacccggggaag

SEQ ID NO: 215606 - DNA, 20 bp, human
ggccaggggcgggtcgcggg

SEQ ID NO: 215607 - DNA, 20 bp, human
gtgggaagtgccgggccggc

SEQ ID NO: 215608 - DNA, 20 bp, human
gggttctcctaggaagtttc

SEQ ID NO: 215609 - DNA, 20 bp, human
gcctgcgctggggacggctc

SEQ ID NO: 215610 - DNA, 20 bp, human
gccctggccgcccgacggga

SEQ ID NO: 215611 - DNA, 20 bp, human
gctgtcccagggagccccga

SEQ ID NO: 215612 - DNA, 20 bp, human
gaaacagggacacaccttcc

SEQ ID NO: 215613 - DNA, 20 bp, human
gacacaccttcccggaggag

SEQ ID NO: 215614 - DNA, 20 bp, human
gccgacgggagggagggatc

SEQ ID NO: 215615 - DNA, 20 bp, human
gccgcccctggccgcccgac

SEQ ID NO: 215616 - DNA, 20 bp, human
gccggggtcagcattcccac

SEQ ID NO: 215617 - DNA, 20 bp, human
gtggctggcagccaacccga

SEQ ID NO: 215618 - DNA, 20 bp, human
gccggctcggaaccgtgccc

SEQ ID NO: 215619 - DNA, 20 bp, human
gttaatgagaggccgcggga

SEQ ID NO: 215620 - DNA, 20 bp, human
ggagaaggtggcttaatgag

SEQ ID NO: 215621 - DNA, 20 bp, human
ggccggccggggctgactcc

SEQ ID NO: 215622 - DNA, 20 bp, human
gaactccgcctgcaatcctt

SEQ ID NO: 215623 - DNA, 20 bp, human
gcgcctgcaatccttcgggt

SEQ ID NO: 215624 - DNA, 20 bp, human
gcccgaatcaccaaactgta

SEQ ID NO: 215625 - DNA, 20 bp, human
ggtgattcgggcaggagcaa

SEQ ID NO: 215626 - DNA, 20 bp, human
gcgaaggatcggcagcgaga

SEQ ID NO: 215627 - DNA, 20 bp, human
gggcagcgagagggcggaac

SEQ ID NO: 215628 - DNA, 20 bp, human
gggcgctcgctccgaaggat

SEQ ID NO: 215629 - DNA, 20 bp, human
ggctctgcgccgtgaagaag

SEQ ID NO: 215630 - DNA, 20 bp, human
gaggatcggcagcgagaggg

SEQ ID NO: 215631 - DNA, 20 bp, human
gactctgggaaagggatctc

SEQ ID NO: 215632 - DNA, 20 bp, human
gagggtgacgctcggagcgt

SEQ ID NO: 215633 - DNA, 20 bp, human
ggcgcagctgggcggtgaca

SEQ ID NO: 215634 - DNA, 20 bp, human
gaccggatccgtgagagtcg

SEQ ID NO: 215635 - DNA, 20 bp, human
ggcgtgggccgcgactctca

SEQ ID NO: 215636 - DNA, 20 bp, human
gggtgtgtgcaggtgcactc

SEQ ID NO: 215637 - DNA, 20 bp, human
gcactcagggcactgtgttg

SEQ ID NO: 215638 - DNA, 20 bp, human
gtctgtgctgcaagtctctc

SEQ ID NO: 215639 - DNA, 20 bp, human
gaatcctattgtatggggtg

SEQ ID NO: 215640 - DNA, 20 bp, human
gtgggacttcgtagaggtgg

SEQ ID NO: 215641 - DNA, 20 bp, human
ggagctctgggacttcgtag

SEQ ID NO: 215642 - DNA, 20 bp, human
ggcccctgcactgactccgt

SEQ ID NO: 215643 - DNA, 20 bp, human
gaggtggcagcttcccctgt

SEQ ID NO: 215644 - DNA, 20 bp, human
gcacagagctaggcaaagca

SEQ ID NO: 215645 - DNA, 20 bp, human
gaggtaaccctggagtgaag

SEQ ID NO: 215646 - DNA, 20 bp, human
gaaagcgccgctctggcggt

SEQ ID NO: 215647 - DNA, 20 bp, human
gcagggcagggcaaggttgg

SEQ ID NO: 215648 - DNA, 20 bp, human
gctcccgcccgcgagcggtt

SEQ ID NO: 215649 - DNA, 20 bp, human
ggggagggcagcgcgcagga

SEQ ID NO: 215650 - DNA, 20 bp, human
gggacagaagagaccctgcg

SEQ ID NO: 215651 - DNA, 20 bp, human
gcgcacctaaagcgccgctc

SEQ ID NO: 215652 - DNA, 20 bp, human
gcgagcggccggaccgcgca

SEQ ID NO: 215653 - DNA, 20 bp, human
gcacttccggctgcagtccg

SEQ ID NO: 215654 - DNA, 20 bp, human
gaccccctggcatttggcat

SEQ ID NO: 215655 - DNA, 20 bp, human
gacctaaagcgccgctctgg

SEQ ID NO: 215656 - DNA, 20 bp, human
ggcaaccctggcaaccaagc

SEQ ID NO: 215657 - DNA, 20 bp, human
gaggctcagagggaccgcgg

SEQ ID NO: 215658 - DNA, 20 bp, human
ggcaaccaagccggctgtgc

SEQ ID NO: 215659 - DNA, 20 bp, human
gcgcacggcgccggcttcgc

SEQ ID NO: 215660 - DNA, 20 bp, human
gacagccggcttggttgcca

SEQ ID NO: 215661 - DNA, 20 bp, human
gacgctgcggtcagtgaaga

SEQ ID NO: 215662 - DNA, 20 bp, human
gcacgccggcacagcagtcc

SEQ ID NO: 215663 - DNA, 20 bp, human
ggagaggctcagagggaccg

SEQ ID NO: 215664 - DNA, 20 bp, human
gcacctccttggaaagggtc

SEQ ID NO: 215665 - DNA, 20 bp, human
gaccaagccggctgtgcggg

SEQ ID NO: 215666 - DNA, 20 bp, human
gggagacagagtcccggcaa

SEQ ID NO: 215667 - DNA, 20 bp, human
gaacggcagagatctcggcg

SEQ ID NO: 215668 - DNA, 20 bp, human
ggaacgggacggataggctg

SEQ ID NO: 215669 - DNA, 20 bp, human
gcggggaacggcagagatct

SEQ ID NO: 215670 - DNA, 20 bp, human
ggtggcggctcggcccgctc

SEQ ID NO: 215671 - DNA, 20 bp, human
ggataggctggggacgcccg

SEQ ID NO: 215672 - DNA, 20 bp, human
gtacccgctggagggcgggg

SEQ ID NO: 215673 - DNA, 20 bp, human
ggccggtgaacgggacggat

SEQ ID NO: 215674 - DNA, 20 bp, human
gggcaaggggtcccgcgcgg

SEQ ID NO: 215675 - DNA, 20 bp, human
gcgggcgctgaagggcgggg

SEQ ID NO: 215676 - DNA, 20 bp, human
gtgggaagtgccgggccggc

SEQ ID NO: 215677 - DNA, 20 bp, human
gctgtcccagggagccccga

SEQ ID NO: 215678 - DNA, 20 bp, human
gcgtcagagctgggaagtgc

SEQ ID NO: 215679 - DNA, 20 bp, human
gcgcgccctcggggctccct

SEQ ID NO: 215680 - DNA, 20 bp, human
gaagctcccgcgtcagagct

SEQ ID NO: 215681 - DNA, 20 bp, human
gccctggccgcccgacggga

SEQ ID NO: 215682 - DNA, 20 bp, human
ggcgcaggcggggtgacccg

SEQ ID NO: 215683 - DNA, 20 bp, human
gcggtgcgcgggcgcaggtc

SEQ ID NO: 215684 - DNA, 20 bp, human
gggttctcctaggaagtttc

SEQ ID NO: 215685 - DNA, 20 bp, human
ggcggggtgacccggggaag

SEQ ID NO: 215686 - DNA, 20 bp, human
ggcagatgcaatcgcggatg

SEQ ID NO: 215687 - DNA, 20 bp, human
gtcgggtgcttgcagagcaa

SEQ ID NO: 215688 - DNA, 20 bp, human
gacaacagcagatgcaatcg

SEQ ID NO: 215689 - DNA, 20 bp, human
gagagtgcaagaagttataa

SEQ ID NO: 215690 - DNA, 20 bp, human
ggagatcacggtccaagatg

SEQ ID NO: 215691 - DNA, 20 bp, human
gtcttggaccgtgatctctg

SEQ ID NO: 215692 - DNA, 20 bp, human
gtaaaatcccatattttgag

SEQ ID NO: 215693 - DNA, 20 bp, human
gggaaaaaccagcgttatcc

SEQ ID NO: 215694 - DNA, 20 bp, human
gtgaaaatctggcttctgtt

SEQ ID NO: 215695 - DNA, 20 bp, human
gttggaaatgagacactcat

SEQ ID NO: 215696 - DNA, 20 bp, human
gcgcgcacggcctggagcgg

SEQ ID NO: 215697 - DNA, 20 bp, human
gcggcccagcaggtccggcc

SEQ ID NO: 215698 - DNA, 20 bp, human
gcctgcgcagcctccgctcc

SEQ ID NO: 215699 - DNA, 20 bp, human
ggccggcgccggccgctcga

SEQ ID NO: 215700 - DNA, 20 bp, human
gcggaggctgcgcagggcgc

SEQ ID NO: 215701 - DNA, 20 bp, human
gcggtgatgtcattgggcga

SEQ ID NO: 215702 - DNA, 20 bp, human
gctgagaaggcgcctgacag

SEQ ID NO: 215703 - DNA, 20 bp, human
gaaagacgcggccgtccgcc

SEQ ID NO: 215704 - DNA, 20 bp, human
gcatatgggtctgaatcggg

SEQ ID NO: 215705 - DNA, 20 bp, human
gcttccgagtgccccggcca

SEQ ID NO: 215706 - DNA, 20 bp, human
gtggtcggcgggtatgtcag

SEQ ID NO: 215707 - DNA, 20 bp, human
gggcagcgaacgtgctactg

SEQ ID NO: 215708 - DNA, 20 bp, human
gtagcacgttcgctgcccag

SEQ ID NO: 215709 - DNA, 20 bp, human
gtgcggcatctgttattggt

SEQ ID NO: 215710 - DNA, 20 bp, human
gggtgactctcgccggtctg

SEQ ID NO: 215711 - DNA, 20 bp, human
gagcttgcttgggagccttg

SEQ ID NO: 215712 - DNA, 20 bp, human
gggtggctggtgactctcgc

SEQ ID NO: 215713 - DNA, 20 bp, human
gaggctctgattggcggtcg

SEQ ID NO: 215714 - DNA, 20 bp, human
gggggagagcgagcttgctt

SEQ ID NO: 215715 - DNA, 20 bp, human
gagtcaccagccaccagttc

SEQ ID NO: 215716 - DNA, 20 bp, human
gccgcctggcaaacccggag

SEQ ID NO: 215717 - DNA, 20 bp, human
gtcggcccgcgctctgactc

SEQ ID NO: 215718 - DNA, 20 bp, human
gcccaagccgcagctggcga

SEQ ID NO: 215719 - DNA, 20 bp, human
ggcgacggcgctgggtaaaa

SEQ ID NO: 215720 - DNA, 20 bp, human
ggagcctcgtgtcggagtga

SEQ ID NO: 215721 - DNA, 20 bp, human
gccagctgcggcttgggtcg

SEQ ID NO: 215722 - DNA, 20 bp, human
gctgctgcgcggcagcgggc

SEQ ID NO: 215723 - DNA, 20 bp, human
gcggcgctgcctagcgaaag

SEQ ID NO: 215724 - DNA, 20 bp, human
gcctcccggcgtccctatcc

SEQ ID NO: 215725 - DNA, 20 bp, human
ggggcgggcgagcaagcggt

SEQ ID NO: 215726 - DNA, 20 bp, human
gggagcaggcccagagcgta

SEQ ID NO: 215727 - DNA, 20 bp, human
ggggccgcgtggatgcgcac

SEQ ID NO: 215728 - DNA, 20 bp, human
gcgggcacgccttacgctct

SEQ ID NO: 215729 - DNA, 20 bp, human
gaagccatgctgggcccgat

SEQ ID NO: 215730 - DNA, 20 bp, human
ggggccgcggcctgaaaagt

SEQ ID NO: 215731 - DNA, 20 bp, human
gacccatatccgggctagag

SEQ ID NO: 215732 - DNA, 20 bp, human
gtcctctctagcccggatat

SEQ ID NO: 215733 - DNA, 20 bp, human
ggcgtggatgcgcacaggag

SEQ ID NO: 215734 - DNA, 20 bp, human
ggagcctatcgggcccagca

SEQ ID NO: 215735 - DNA, 20 bp, human
gcgggcttgggctaaggctg

SEQ ID NO: 215736 - DNA, 20 bp, human
gccggctgtagcccggataa

SEQ ID NO: 215737 - DNA, 20 bp, human
gacaacaaagccccgggatg

SEQ ID NO: 215738 - DNA, 20 bp, human
gccggggccgccgctcgcag

SEQ ID NO: 215739 - DNA, 20 bp, human
gctgttggggtacccttcgt

SEQ ID NO: 215740 - DNA, 20 bp, human
gagccagtgcaaccattatc

SEQ ID NO: 215741 - DNA, 20 bp, human
ggacgcgccgcccaagatgg

SEQ ID NO: 215742 - DNA, 20 bp, human
gccctgcagaactcccacga

SEQ ID NO: 215743 - DNA, 20 bp, human
ggcccggataatggttgcac

SEQ ID NO: 215744 - DNA, 20 bp, human
gatccgggctacagccggcc

SEQ ID NO: 215745 - DNA, 20 bp, human
ggctacgagcacccgggctt

SEQ ID NO: 215746 - DNA, 20 bp, human
gcaaggcgagccgatggtga

SEQ ID NO: 215747 - DNA, 20 bp, human
ggaggggtctgggcggccag

SEQ ID NO: 215748 - DNA, 20 bp, human
gccggggacgcgattcaaca

SEQ ID NO: 215749 - DNA, 20 bp, human
gcgagagccgggccacgggg

SEQ ID NO: 215750 - DNA, 20 bp, human
gtagaagggcaggcgactgc

SEQ ID NO: 215751 - DNA, 20 bp, human
gggagcgaaactagaagggc

SEQ ID NO: 215752 - DNA, 20 bp, human
gagccggcggcgctgagagg

SEQ ID NO: 215753 - DNA, 20 bp, human
gcgggcgagagccgggccac

SEQ ID NO: 215754 - DNA, 20 bp, human
gaaatcggagcgaaactaga

SEQ ID NO: 215755 - DNA, 20 bp, human
gccgcggcttcgcgcggatc

SEQ ID NO: 215756 - DNA, 20 bp, human
ggggcgtgcggggaaaagtg

SEQ ID NO: 215757 - DNA, 20 bp, human
ggcgcgggagggcctcgcca

SEQ ID NO: 215758 - DNA, 20 bp, human
gggccgcggcgctgaatcac

SEQ ID NO: 215759 - DNA, 20 bp, human
gcccgcccccggcctaggga

SEQ ID NO: 215760 - DNA, 20 bp, human
gcccccggcctagggacggt

SEQ ID NO: 215761 - DNA, 20 bp, human
gaggccccgcccccggccta

SEQ ID NO: 215762 - DNA, 20 bp, human
gagtccacgaggcccagcgt

SEQ ID NO: 215763 - DNA, 20 bp, human
gagagtggacggaaattttc

SEQ ID NO: 215764 - DNA, 20 bp, human
gacgacgcgcaaccagcccg

SEQ ID NO: 215765 - DNA, 20 bp, human
gcccccagacaaatcaccag

SEQ ID NO: 215766 - DNA, 20 bp, human
ggcaaagtgcggacacagag

SEQ ID NO: 215767 - DNA, 20 bp, human
gctgctagaaagggaccggg

SEQ ID NO: 215768 - DNA, 20 bp, human
ggggctggaccgccagccag

SEQ ID NO: 215769 - DNA, 20 bp, human
gggcggggcgggaccgaagc

SEQ ID NO: 215770 - DNA, 20 bp, human
ggaagctgctagaaagggac

SEQ ID NO: 215771 - DNA, 20 bp, human
gagccggaagctgctagaaa

SEQ ID NO: 215772 - DNA, 20 bp, human
gtggaagcgggcggaagcct

SEQ ID NO: 215773 - DNA, 20 bp, human
ggggcggaagcctcggccaa

SEQ ID NO: 215774 - DNA, 20 bp, human
ggcgcagcccgactgagttg

SEQ ID NO: 215775 - DNA, 20 bp, human
gggaggaagcgaatggaagc

SEQ ID NO: 215776 - DNA, 20 bp, human
gagagggaccgacagagaca

SEQ ID NO: 215777 - DNA, 20 bp, human
gtagacaggggttgagatat

SEQ ID NO: 215778 - DNA, 20 bp, human
gacagggaccaaggagtcgc

SEQ ID NO: 215779 - DNA, 20 bp, human
gaaggagtcgcggggatgga

SEQ ID NO: 215780 - DNA, 20 bp, human
gtgggaggcgggcggagcaa

SEQ ID NO: 215781 - DNA, 20 bp, human
ggaccaaggagtcgcgggga

SEQ ID NO: 215782 - DNA, 20 bp, human
gcgcggggcgcccggagcga

SEQ ID NO: 215783 - DNA, 20 bp, human
ggcagcgggccacgccaggc

SEQ ID NO: 215784 - DNA, 20 bp, human
gttcccgtccctgtctctgt

SEQ ID NO: 215785 - DNA, 20 bp, human
gacgcccggctccctcgctc

SEQ ID NO: 215786 - DNA, 20 bp, human
gacgccgaagagcttcggat

SEQ ID NO: 215787 - DNA, 20 bp, human
gcactgattggtgaattgag

SEQ ID NO: 215788 - DNA, 20 bp, human
gggaaaaagccaatcataag

SEQ ID NO: 215789 - DNA, 20 bp, human
gtcgacacgaggattggcgg

SEQ ID NO: 215790 - DNA, 20 bp, human
gactccggatgtgcttgact

SEQ ID NO: 215791 - DNA, 20 bp, human
gaccaactctccaataaagt

SEQ ID NO: 215792 - DNA, 20 bp, human
ggcggagtgtcccatggaaa

SEQ ID NO: 215793 - DNA, 20 bp, human
gtgcttgactgggcactgat

SEQ ID NO: 215794 - DNA, 20 bp, human
gagttcgacacgaggattgg

SEQ ID NO: 215795 - DNA, 20 bp, human
ggtgcccagtcaagcacatc

SEQ ID NO: 215796 - DNA, 20 bp, human
gaccaataggaacagtgtat

SEQ ID NO: 215797 - DNA, 20 bp, human
gcactgttcctattggtccc

SEQ ID NO: 215798 - DNA, 20 bp, human
ggcgtcgttgtttgtatcca

SEQ ID NO: 215799 - DNA, 20 bp, human
gggggggaacctagagtcgg

SEQ ID NO: 215800 - DNA, 20 bp, human
gcccccgcaccggtccacgc

SEQ ID NO: 215801 - DNA, 20 bp, human
ggccctgcgcctgcgtggac

SEQ ID NO: 215802 - DNA, 20 bp, human
ggcggggcaacaaagcagta

SEQ ID NO: 215803 - DNA, 20 bp, human
gatggcctcttagacgacct

SEQ ID NO: 215804 - DNA, 20 bp, human
gcatagaactggtgggaaaa

SEQ ID NO: 215805 - DNA, 20 bp, human
ggcgggccttgcagttctcg

SEQ ID NO: 215806 - DNA, 20 bp, human
ggggaccgcccttgagtccg

SEQ ID NO: 215807 - DNA, 20 bp, human
gaggtccccggactcaaggg

SEQ ID NO: 215808 - DNA, 20 bp, human
gcagaggtccccggactcaa

SEQ ID NO: 215809 - DNA, 20 bp, human
gggtgaggagcctattccag

SEQ ID NO: 215810 - DNA, 20 bp, human
gtctgaaagcctagaggcga

SEQ ID NO: 215811 - DNA, 20 bp, human
gcttcgtcgcgcggagaagg

SEQ ID NO: 215812 - DNA, 20 bp, human
gacgaagccgggcttaccaa

SEQ ID NO: 215813 - DNA, 20 bp, human
gcggcttcgtcgcgcggaga

SEQ ID NO: 215814 - DNA, 20 bp, human
ggcctccgctcctctaggtg

SEQ ID NO: 215815 - DNA, 20 bp, human
gctccagtctgaaagcctag

SEQ ID NO: 215816 - DNA, 20 bp, human
gagaaagaggagcagcgccc

SEQ ID NO: 215817 - DNA, 20 bp, human
gagcgccccggaatctctgc

SEQ ID NO: 215818 - DNA, 20 bp, human
gcccccgccaaaaaagggag

SEQ ID NO: 215819 - DNA, 20 bp, human
gctgctcagaatatgaattc

SEQ ID NO: 215820 - DNA, 20 bp, human
gatttcctgcagagattccg

SEQ ID NO: 215821 - DNA, 20 bp, human
gcggacagcgactgcattta

SEQ ID NO: 215822 - DNA, 20 bp, human
gacgatatcccagacaggag

SEQ ID NO: 215823 - DNA, 20 bp, human
gctctctaaccgctcctgtc

SEQ ID NO: 215824 - DNA, 20 bp, human
ggaagctcccctcccttttt

SEQ ID NO: 215825 - DNA, 20 bp, human
gcaggagcggttagagagag

SEQ ID NO: 215826 - DNA, 20 bp, human
gcctgggcctgggacccgag

SEQ ID NO: 215827 - DNA, 20 bp, human
gagcggcagcggatcgaacc

SEQ ID NO: 215828 - DNA, 20 bp, human
ggctccacgcaggggcggtg

SEQ ID NO: 215829 - DNA, 20 bp, human
gtaagtgggctggatcccta

SEQ ID NO: 215830 - DNA, 20 bp, human
ggtgacgcacgcccctttgt

SEQ ID NO: 215831 - DNA, 20 bp, human
ggggaaggccgcgtccccaa

SEQ ID NO: 215832 - DNA, 20 bp, human
gctccccgggctccacgcag

SEQ ID NO: 215833 - DNA, 20 bp, human
gggggcgcagtgacgcaaag

SEQ ID NO: 215834 - DNA, 20 bp, human
gccccaagggactgcctaag

SEQ ID NO: 215835 - DNA, 20 bp, human
gccgccccaccgcccctgcg

SEQ ID NO: 215836 - DNA, 20 bp, human
gccgtaccctggtcagactc

SEQ ID NO: 215837 - DNA, 20 bp, human
ggacgctggtaggcgaatag

SEQ ID NO: 215838 - DNA, 20 bp, human
gccggatcggggtcgaccca

SEQ ID NO: 215839 - DNA, 20 bp, human
gctaaacaggccctctagcc

SEQ ID NO: 215840 - DNA, 20 bp, human
gagagcgctaagtttcaagg

SEQ ID NO: 215841 - DNA, 20 bp, human
gctcccctctgaccagatag

SEQ ID NO: 215842 - DNA, 20 bp, human
gctgacccagagtctgacca

SEQ ID NO: 215843 - DNA, 20 bp, human
gcgacaggctcccggctaga

SEQ ID NO: 215844 - DNA, 20 bp, human
gctcgacgggagacgctggt

SEQ ID NO: 215845 - DNA, 20 bp, human
ggcgaacgaggcctcggcag

SEQ ID NO: 215846 - DNA, 20 bp, human
gtcccctgaacatgtgactt

SEQ ID NO: 215847 - DNA, 20 bp, human
gccggggccgcacatcccta

SEQ ID NO: 215848 - DNA, 20 bp, human
gagccaaagtcacatgttca

SEQ ID NO: 215849 - DNA, 20 bp, human
gggacaaagttgctgtcacc

SEQ ID NO: 215850 - DNA, 20 bp, human
gcctaacaaccaaccatcct

SEQ ID NO: 215851 - DNA, 20 bp, human
gagctggggataccctccac

SEQ ID NO: 215852 - DNA, 20 bp, human
gacgcggagcccgcgagctg

SEQ ID NO: 215853 - DNA, 20 bp, human
ggcctctgaccaaccggcgc

SEQ ID NO: 215854 - DNA, 20 bp, human
ggtggtgggcaagcccagga

SEQ ID NO: 215855 - DNA, 20 bp, human
ggtgccaagtcgtttttctt

SEQ ID NO: 215856 - DNA, 20 bp, human
gaatcactgaagatcggcga

SEQ ID NO: 215857 - DNA, 20 bp, human
gagtccgacgtggaagttgc

SEQ ID NO: 215858 - DNA, 20 bp, human
gtcactggatgtagataccg

SEQ ID NO: 215859 - DNA, 20 bp, human
gcagccagcaacttccacgt

SEQ ID NO: 215860 - DNA, 20 bp, human
gacaactgaaaatgcgagtc

SEQ ID NO: 215861 - DNA, 20 bp, human
gcctgcgccagcgttcgacc

SEQ ID NO: 215862 - DNA, 20 bp, human
gaggacagggggttcatcat

SEQ ID NO: 215863 - DNA, 20 bp, human
gtggaagttgctggctgact

SEQ ID NO: 215864 - DNA, 20 bp, human
ggagctgcagccgaaggcca

SEQ ID NO: 215865 - DNA, 20 bp, human
ggcaggctgcggcgttgcag

SEQ ID NO: 215866 - DNA, 20 bp, human
gacagcggcagtgcattgtg

SEQ ID NO: 215867 - DNA, 20 bp, human
ggaaggagaggctgtgcctg

SEQ ID NO: 215868 - DNA, 20 bp, human
gaccgggagacagatcgctt

SEQ ID NO: 215869 - DNA, 20 bp, human
ggccggcgcgcggggacctc

SEQ ID NO: 215870 - DNA, 20 bp, human
gtccaccaggggttagctca

SEQ ID NO: 215871 - DNA, 20 bp, human
ggtagtgcgggactgggtct

SEQ ID NO: 215872 - DNA, 20 bp, human
ggcctggggaggacgggaga

SEQ ID NO: 215873 - DNA, 20 bp, human
gaaaacccctgtggtccggg

SEQ ID NO: 215874 - DNA, 20 bp, human
gaaagccgtgagctaacccc

SEQ ID NO: 215875 - DNA, 20 bp, human
ggccgtctcccgtcctcccc

SEQ ID NO: 215876 - DNA, 20 bp, human
gactgctctgaggcgcccta

SEQ ID NO: 215877 - DNA, 20 bp, human
gagagccggggacctctctg

SEQ ID NO: 215878 - DNA, 20 bp, human
gcttgccacagagaggtccc

SEQ ID NO: 215879 - DNA, 20 bp, human
gtgaggcgccctagggctga

SEQ ID NO: 215880 - DNA, 20 bp, human
gttctctgcgaggagctcag

SEQ ID NO: 215881 - DNA, 20 bp, human
ggaaggagggagcacgagct

SEQ ID NO: 215882 - DNA, 20 bp, human
gtgtgcttccttttcccagg

SEQ ID NO: 215883 - DNA, 20 bp, human
gctcagagcagtcatcttgc

SEQ ID NO: 215884 - DNA, 20 bp, human
gtaaaaaatggagctgtcac

SEQ ID NO: 215885 - DNA, 20 bp, human
gagccaccagaaaaaccttg

SEQ ID NO: 215886 - DNA, 20 bp, human
ggttgctatgaaccaggtag

SEQ ID NO: 215887 - DNA, 20 bp, human
gagagcagaggcagtttctc

SEQ ID NO: 215888 - DNA, 20 bp, human
ggtcctaataatggttgtca

SEQ ID NO: 215889 - DNA, 20 bp, human
gcacggtactgacatgtctg

SEQ ID NO: 215890 - DNA, 20 bp, human
gctacagcatgacaaagtag

SEQ ID NO: 215891 - DNA, 20 bp, human
gtatggcaatgtcctaataa

SEQ ID NO: 215892 - DNA, 20 bp, human
ggcagtttctctggtatctg

SEQ ID NO: 215893 - DNA, 20 bp, human
gatagagatacgcagagcag

SEQ ID NO: 215894 - DNA, 20 bp, human
gagtttggttgctatgaacc

SEQ ID NO: 215895 - DNA, 20 bp, human
gtaccgtgacaaccattatt

SEQ ID NO: 215896 - DNA, 20 bp, human
gactgcgctcgcccaatcat

SEQ ID NO: 215897 - DNA, 20 bp, human
gctcgcccaatcatcggttg

SEQ ID NO: 215898 - DNA, 20 bp, human
gggagcgtccggagataagc

SEQ ID NO: 215899 - DNA, 20 bp, human
gcgagactaggaaaagagaa

SEQ ID NO: 215900 - DNA, 20 bp, human
gactcagaggcctctacctc

SEQ ID NO: 215901 - DNA, 20 bp, human
gggttgaggtcctgaggtag

SEQ ID NO: 215902 - DNA, 20 bp, human
gcccgcccctgcgcgagact

SEQ ID NO: 215903 - DNA, 20 bp, human
gggactcttcagccactcag

SEQ ID NO: 215904 - DNA, 20 bp, human
gacgtgctgacgttacttcg

SEQ ID NO: 215905 - DNA, 20 bp, human
gggagtactctataagaagg

SEQ ID NO: 215906 - DNA, 20 bp, human
ggaaatctagaggaacctga

SEQ ID NO: 215907 - DNA, 20 bp, human
gcagtcccagccaatcctga

SEQ ID NO: 215908 - DNA, 20 bp, human
gactgcagcatcagccaggt

SEQ ID NO: 215909 - DNA, 20 bp, human
gtctgcgtgtctgaaccttc

SEQ ID NO: 215910 - DNA, 20 bp, human
gagattaggagaggcctacc

SEQ ID NO: 215911 - DNA, 20 bp, human
ggaatgagtaagattaggag

SEQ ID NO: 215912 - DNA, 20 bp, human
gtctgtgaatgagtaagatt

SEQ ID NO: 215913 - DNA, 20 bp, human
gtcaggtgctagaaatctag

SEQ ID NO: 215914 - DNA, 20 bp, human
gtggttccttatttacaact

SEQ ID NO: 215915 - DNA, 20 bp, human
gtcagacacgcagaggagca

SEQ ID NO: 215916 - DNA, 20 bp, human
gcacatccctaacctctcgg

SEQ ID NO: 215917 - DNA, 20 bp, human
ggccgcctccggggacggaa

SEQ ID NO: 215918 - DNA, 20 bp, human
gccgccccttccgtccccgg

SEQ ID NO: 215919 - DNA, 20 bp, human
ggaagcctagagcggacacg

SEQ ID NO: 215920 - DNA, 20 bp, human
ggcagtcctccgagaggtta

SEQ ID NO: 215921 - DNA, 20 bp, human
gtcccacatccctaacctct

SEQ ID NO: 215922 - DNA, 20 bp, human
gccaccacaaagagacgtcc

SEQ ID NO: 215923 - DNA, 20 bp, human
gcctagagcggacacgaggc

SEQ ID NO: 215924 - DNA, 20 bp, human
gtccccgcgctaccactgag

SEQ ID NO: 215925 - DNA, 20 bp, human
gtctcccggacgtctctttg

SEQ ID NO: 215926 - DNA, 20 bp, human
gtgggagtacagatacagtc

SEQ ID NO: 215927 - DNA, 20 bp, human
gcctcagtagggtggtctgg

SEQ ID NO: 215928 - DNA, 20 bp, human
ggcaaggtttaacagtgagt

SEQ ID NO: 215929 - DNA, 20 bp, human
ggagcctcagtagggtggtc

SEQ ID NO: 215930 - DNA, 20 bp, human
gtgagtgggagaaaaggttc

SEQ ID NO: 215931 - DNA, 20 bp, human
ggaataaagtgagacgtgta

SEQ ID NO: 215932 - DNA, 20 bp, human
gctgaggctctcctctgccg

SEQ ID NO: 215933 - DNA, 20 bp, human
gtgatgctaaggactgtcaa

SEQ ID NO: 215934 - DNA, 20 bp, human
gaatcaccagatatagttac

SEQ ID NO: 215935 - DNA, 20 bp, human
gtcttaatcctgcttaagag

SEQ ID NO: 215936 - DNA, 20 bp, human
gggtggcaggagagaaacgc

SEQ ID NO: 215937 - DNA, 20 bp, human
gtggctgcggcgcctataaa

SEQ ID NO: 215938 - DNA, 20 bp, human
gagaaacgcgggagtggtgg

SEQ ID NO: 215939 - DNA, 20 bp, human
ggcgccccttgtgtaatctc

SEQ ID NO: 215940 - DNA, 20 bp, human
gaggaaagaagcgtgctcat

SEQ ID NO: 215941 - DNA, 20 bp, human
ggaagcgtgctcattggctg

SEQ ID NO: 215942 - DNA, 20 bp, human
gtagccggagattacacaag

SEQ ID NO: 215943 - DNA, 20 bp, human
gagccaagagagcggaaaat

SEQ ID NO: 215944 - DNA, 20 bp, human
gcaggagagaaacgcgggag

SEQ ID NO: 215945 - DNA, 20 bp, human
gacacaaggggcgcggcgat

SEQ ID NO: 215946 - DNA, 20 bp, human
gtgcgcgcactggagggaaa

SEQ ID NO: 215947 - DNA, 20 bp, human
gcacgcgcacgtcaccgcgc

SEQ ID NO: 215948 - DNA, 20 bp, human
gaattagcgcgcagcgttag

SEQ ID NO: 215949 - DNA, 20 bp, human
gcgcagcgttagcgggagag

SEQ ID NO: 215950 - DNA, 20 bp, human
gcggctcaaggcccgcccac

SEQ ID NO: 215951 - DNA, 20 bp, human
gtgcgcgtgcgcgcactgga

SEQ ID NO: 215952 - DNA, 20 bp, human
gcgcccgcggcgtcgggttt

SEQ ID NO: 215953 - DNA, 20 bp, human
ggcccaccggccactctcat

SEQ ID NO: 215954 - DNA, 20 bp, human
ggagccgcggcgccgagcta

SEQ ID NO: 215955 - DNA, 20 bp, human
ggggcgcgccagctcgtagc

SEQ ID NO: 215956 - DNA, 20 bp, human
gaatctgtgtagaggtggga

SEQ ID NO: 215957 - DNA, 20 bp, human
gtgaaaatctgtgtagaggt

SEQ ID NO: 215958 - DNA, 20 bp, human
ggggagggcagtctagcctc

SEQ ID NO: 215959 - DNA, 20 bp, human
ggtctagcctcaggcggaat

SEQ ID NO: 215960 - DNA, 20 bp, human
gagggcagtctagcctcagg

SEQ ID NO: 215961 - DNA, 20 bp, human
gtctacacagattttcaagt

SEQ ID NO: 215962 - DNA, 20 bp, human
gagttttcctattccgcctg

SEQ ID NO: 215963 - DNA, 20 bp, human
gcccttactcttctttgcgt

SEQ ID NO: 215964 - DNA, 20 bp, human
gtggtcgcacatggcatcgg

SEQ ID NO: 215965 - DNA, 20 bp, human
gaggcgacgccatgaagctc

SEQ ID NO: 215966 - DNA, 20 bp, human
gtgtcccctcccggttggtg

SEQ ID NO: 215967 - DNA, 20 bp, human
gaatctgtgtagaggtggga

SEQ ID NO: 215968 - DNA, 20 bp, human
gtgaaaatctgtgtagaggt

SEQ ID NO: 215969 - DNA, 20 bp, human
ggggagggcagtctagcctc

SEQ ID NO: 215970 - DNA, 20 bp, human
ggtctagcctcaggcggaat

SEQ ID NO: 215971 - DNA, 20 bp, human
gagggcagtctagcctcagg

SEQ ID NO: 215972 - DNA, 20 bp, human
gtctacacagattttcaagt

SEQ ID NO: 215973 - DNA, 20 bp, human
gagttttcctattccgcctg

SEQ ID NO: 215974 - DNA, 20 bp, human
gcccttactcttctttgcat

SEQ ID NO: 215975 - DNA, 20 bp, human
gtggtcgcacatggcatcgg

SEQ ID NO: 215976 - DNA, 20 bp, human
gctgacgctgcgcctcccga

SEQ ID NO: 215977 - DNA, 20 bp, human
gaccctcgcagcagctgcgc

SEQ ID NO: 215978 - DNA, 20 bp, human
gggtccctctagcggcgcgg

SEQ ID NO: 215979 - DNA, 20 bp, human
gaaccccccgcgccgctaga

SEQ ID NO: 215980 - DNA, 20 bp, human
gggcccagatgagcaggatt

SEQ ID NO: 215981 - DNA, 20 bp, human
ggcgacctcgcggtcacgtg

SEQ ID NO: 215982 - DNA, 20 bp, human
gccggccaagagccccagtc

SEQ ID NO: 215983 - DNA, 20 bp, human
gcggtcacgtgcggcaaggg

SEQ ID NO: 215984 - DNA, 20 bp, human
gcccagtccggcaggggaaa

SEQ ID NO: 215985 - DNA, 20 bp, human
gtcgcggtcacgtgcggcaa

SEQ ID NO: 215986 - DNA, 20 bp, human
gcggccgtgaggcggtggaa

SEQ ID NO: 215987 - DNA, 20 bp, human
gccggccggcatccaatcac

SEQ ID NO: 215988 - DNA, 20 bp, human
gccggccggccgtgaggcgg

SEQ ID NO: 215989 - DNA, 20 bp, human
ggccggggcggggcaagaca

SEQ ID NO: 215990 - DNA, 20 bp, human
gtcccggaagggagtgcgga

SEQ ID NO: 215991 - DNA, 20 bp, human
ggcggtggaaggggttgcgg

SEQ ID NO: 215992 - DNA, 20 bp, human
gagggagaggaagtcccgga

SEQ ID NO: 215993 - DNA, 20 bp, human
gctcgcctgtgattggatgc

SEQ ID NO: 215994 - DNA, 20 bp, human
gtccgggcctcggtgactgc

SEQ ID NO: 215995 - DNA, 20 bp, human
gggtaacgctcgcctgtgat

SEQ ID NO: 215996 - DNA, 20 bp, human
gtggagaaagcctgcccacg

SEQ ID NO: 215997 - DNA, 20 bp, human
gggtcgaaaaggaggggcgt

SEQ ID NO: 215998 - DNA, 20 bp, human
gcgccggctcgcctggacca

SEQ ID NO: 215999 - DNA, 20 bp, human
ggaaaactggcccgggtgag

SEQ ID NO: 216000 - DNA, 20 bp, human
gagcccgcccactgcgtggg

SEQ ID NO: 216001 - DNA, 20 bp, human
gcgcccgcccacgcagtggg

SEQ ID NO: 216002 - DNA, 20 bp, human
gaaggcgcccgcccacgcag

SEQ ID NO: 216003 - DNA, 20 bp, human
gaactggcccgggtgagagg

SEQ ID NO: 216004 - DNA, 20 bp, human
gggcctgggattggtcgaaa

SEQ ID NO: 216005 - DNA, 20 bp, human
gaggccgccgccggctcgcc

SEQ ID NO: 216006 - DNA, 20 bp, human
gctacccggagcaaccgttc

SEQ ID NO: 216007 - DNA, 20 bp, human
gaaaaggcggcgttcccaga

SEQ ID NO: 216008 - DNA, 20 bp, human
gcccgctccctaattggtga

SEQ ID NO: 216009 - DNA, 20 bp, human
gtaagggcaacaggtggtgc

SEQ ID NO: 216010 - DNA, 20 bp, human
ggtaactgccgctcccagcg

SEQ ID NO: 216011 - DNA, 20 bp, human
gcggctgctcggctccctct

SEQ ID NO: 216012 - DNA, 20 bp, human
gcccgcccccgctccctaat

SEQ ID NO: 216013 - DNA, 20 bp, human
gcgggtgaccaatgggattt

SEQ ID NO: 216014 - DNA, 20 bp, human
ggacgccctagacgacgtga

SEQ ID NO: 216015 - DNA, 20 bp, human
gaccctcaccaattagggag

SEQ ID NO: 216016 - DNA, 20 bp, human
gcgaagcgcgcgaaaacggc

SEQ ID NO: 216017 - DNA, 20 bp, human
gggagggcgccgaacatctg

SEQ ID NO: 216018 - DNA, 20 bp, human
gcgcgccgcgcagacacaat

SEQ ID NO: 216019 - DNA, 20 bp, human
ggaggaccgcgcctgacccc

SEQ ID NO: 216020 - DNA, 20 bp, human
ggggcgccgaacatctgagg

SEQ ID NO: 216021 - DNA, 20 bp, human
ggcagcgaagcgcgcgaaaa

SEQ ID NO: 216022 - DNA, 20 bp, human
ggaccgcgcctgacccccgg

SEQ ID NO: 216023 - DNA, 20 bp, human
gcgcgcagacacaatgggcg

SEQ ID NO: 216024 - DNA, 20 bp, human
gaacgcgtcagccgctgggg

SEQ ID NO: 216025 - DNA, 20 bp, human
gaggacccgggcggggattc

SEQ ID NO: 216026 - DNA, 20 bp, human
gcagcccccaccatacgcgg

SEQ ID NO: 216027 - DNA, 20 bp, human
ggcccctccgcgtatggtgg

SEQ ID NO: 216028 - DNA, 20 bp, human
gggggcggagcgtggagcta

SEQ ID NO: 216029 - DNA, 20 bp, human
gctgcagcccccaccatacg

SEQ ID NO: 216030 - DNA, 20 bp, human
gcaaggcgcgggacaatcag

SEQ ID NO: 216031 - DNA, 20 bp, human
gcctctgcagagcctgccta

SEQ ID NO: 216032 - DNA, 20 bp, human
ggggacaatcagcggcggcg

SEQ ID NO: 216033 - DNA, 20 bp, human
gggggcgtttgcttaatccg

SEQ ID NO: 216034 - DNA, 20 bp, human
gctggtggagggggatgcga

SEQ ID NO: 216035 - DNA, 20 bp, human
gaacgcccctccgcgtatgg

SEQ ID NO: 216036 - DNA, 20 bp, human
gaggggcggagcgtaggaaa

SEQ ID NO: 216037 - DNA, 20 bp, human
gcaaataagcgaggacaggg

SEQ ID NO: 216038 - DNA, 20 bp, human
gtggagggacgtgagtgcgc

SEQ ID NO: 216039 - DNA, 20 bp, human
ggctgtgaagaccgcaagtt

SEQ ID NO: 216040 - DNA, 20 bp, human
gaggcgcaggactttaccct

SEQ ID NO: 216041 - DNA, 20 bp, human
gtatgcaaataagcgaggac

SEQ ID NO: 216042 - DNA, 20 bp, human
gagctcctctcgggcggctg

SEQ ID NO: 216043 - DNA, 20 bp, human
ggcggtggcgacgaccacgc

SEQ ID NO: 216044 - DNA, 20 bp, human
ggcgcagtggagaaaattcg

SEQ ID NO: 216045 - DNA, 20 bp, human
ggtggcgacgaccacgcggg

SEQ ID NO: 216046 - DNA, 20 bp, human
ggaagaaaacgccacgtcga

SEQ ID NO: 216047 - DNA, 20 bp, human
ggaagctaggcgcgtgacga

SEQ ID NO: 216048 - DNA, 20 bp, human
gggtggtcctgggatccgga

SEQ ID NO: 216049 - DNA, 20 bp, human
ggggactacgggtcggcgtt

SEQ ID NO: 216050 - DNA, 20 bp, human
gggaatttgcggtatcgcgg

SEQ ID NO: 216051 - DNA, 20 bp, human
gaacgccacgtcgaaggcgt

SEQ ID NO: 216052 - DNA, 20 bp, human
gcgtgacgacggcgcactta

SEQ ID NO: 216053 - DNA, 20 bp, human
ggagagtcccaaacggccag

SEQ ID NO: 216054 - DNA, 20 bp, human
gtcccagccgctggccgttt

SEQ ID NO: 216055 - DNA, 20 bp, human
gccggtaggagagtcccaaa

SEQ ID NO: 216056 - DNA, 20 bp, human
gagaagttgccaagcatcaa

SEQ ID NO: 216057 - DNA, 20 bp, human
gagacatggcactcagagga

SEQ ID NO: 216058 - DNA, 20 bp, human
gtcactagcgtgggtcttgt

SEQ ID NO: 216059 - DNA, 20 bp, human
gaggggaatgcaatttgagt

SEQ ID NO: 216060 - DNA, 20 bp, human
ggggcgcctgaagacaagga

SEQ ID NO: 216061 - DNA, 20 bp, human
gagctggtaggtacagaaag

SEQ ID NO: 216062 - DNA, 20 bp, human
gacagaaagtgggtcgcctg

SEQ ID NO: 216063 - DNA, 20 bp, human
gaccaactgcacatctgtgg

SEQ ID NO: 216064 - DNA, 20 bp, human
gtggcctcctggttctctgt

SEQ ID NO: 216065 - DNA, 20 bp, human
gcctgtctgtactacacagc

SEQ ID NO: 216066 - DNA, 20 bp, human
ggtagcatcatgggagttgt

SEQ ID NO: 216067 - DNA, 20 bp, human
gtggatccccaggaagacca

SEQ ID NO: 216068 - DNA, 20 bp, human
gggaggcgtggcttcaggac

SEQ ID NO: 216069 - DNA, 20 bp, human
gggctcgcgcacagctttct

SEQ ID NO: 216070 - DNA, 20 bp, human
gagctccgggaaaaggtcag

SEQ ID NO: 216071 - DNA, 20 bp, human
ggttcccggcgtagcatcat

SEQ ID NO: 216072 - DNA, 20 bp, human
gtgaagccacgcctccccgg

SEQ ID NO: 216073 - DNA, 20 bp, human
gaatgtgtgcacaggtggca

SEQ ID NO: 216074 - DNA, 20 bp, human
gaactcccatgatgctacgc

SEQ ID NO: 216075 - DNA, 20 bp, human
gatcgccaggacccccgggg

SEQ ID NO: 216076 - DNA, 20 bp, human
gacgccccgcccagcgctgt

SEQ ID NO: 216077 - DNA, 20 bp, human
gagtgcccaatcagcgccca

SEQ ID NO: 216078 - DNA, 20 bp, human
gggggcgtcgcgcagtccct

SEQ ID NO: 216079 - DNA, 20 bp, human
gggacccaaagccaccgcag

SEQ ID NO: 216080 - DNA, 20 bp, human
ggaaccgcttcccacagcgc

SEQ ID NO: 216081 - DNA, 20 bp, human
gggtcggccgcccttcccga

SEQ ID NO: 216082 - DNA, 20 bp, human
gggcttgaaatcgaggtcaa

SEQ ID NO: 216083 - DNA, 20 bp, human
gagagccggagaaccactga

SEQ ID NO: 216084 - DNA, 20 bp, human
gtcgcgggggccgtcgggaa

SEQ ID NO: 216085 - DNA, 20 bp, human
gagaggcagcgccgggccga

SEQ ID NO: 216086 - DNA, 20 bp, human
ggctgatatcatagctgcag

SEQ ID NO: 216087 - DNA, 20 bp, human
ggtggttaagtatatatcaa

SEQ ID NO: 216088 - DNA, 20 bp, human
gaaaaaagagtttaagtgtc

SEQ ID NO: 216089 - DNA, 20 bp, human
ggcacttttttaagagttta

SEQ ID NO: 216090 - DNA, 20 bp, human
gaagttagacatgtttagtt

SEQ ID NO: 216091 - DNA, 20 bp, human
gacagaagtactacaaattc

SEQ ID NO: 216092 - DNA, 20 bp, human
gcttttttaagagtttaggg

SEQ ID NO: 216093 - DNA, 20 bp, human
gctcacaagtggctttccag

SEQ ID NO: 216094 - DNA, 20 bp, human
ggagaaaattagaagaaaaa

SEQ ID NO: 216095 - DNA, 20 bp, human
gaatggcaaatatctctgag

SEQ ID NO: 216096 - DNA, 20 bp, human
ggaagctgcgcccacttcca

SEQ ID NO: 216097 - DNA, 20 bp, human
gcgcgcccgggacggaacct

SEQ ID NO: 216098 - DNA, 20 bp, human
gacgccccaggttccgtccc

SEQ ID NO: 216099 - DNA, 20 bp, human
ggaggggctgcggagctcga

SEQ ID NO: 216100 - DNA, 20 bp, human
ggatacgtgcaacgtggcat

SEQ ID NO: 216101 - DNA, 20 bp, human
ggcgtcagaacgaaaggcag

SEQ ID NO: 216102 - DNA, 20 bp, human
gtgggcgcgtcggaaagacc

SEQ ID NO: 216103 - DNA, 20 bp, human
gcgagggtcgccttcttccc

SEQ ID NO: 216104 - DNA, 20 bp, human
ggctcgcagtcgtatggaga

SEQ ID NO: 216105 - DNA, 20 bp, human
gccccccagtggactcgggt

SEQ ID NO: 216106 - DNA, 20 bp, human
gtggttgggtacaggaaaac

SEQ ID NO: 216107 - DNA, 20 bp, human
gcagcagagcaaaggaaatt

SEQ ID NO: 216108 - DNA, 20 bp, human
gggaacctccagacagaaca

SEQ ID NO: 216109 - DNA, 20 bp, human
gtctcggtcggctttgcggt

SEQ ID NO: 216110 - DNA, 20 bp, human
gttggctcttggttgggtac

SEQ ID NO: 216111 - DNA, 20 bp, human
gctcctctttacttcttcat

SEQ ID NO: 216112 - DNA, 20 bp, human
ggccacctcccttcagacag

SEQ ID NO: 216113 - DNA, 20 bp, human
gcggaaatcccctgtctgaa

SEQ ID NO: 216114 - DNA, 20 bp, human
gtccgtctcggtcggctttg

SEQ ID NO: 216115 - DNA, 20 bp, human
gcgccgccgccagattctgg

SEQ ID NO: 216116 - DNA, 20 bp, human
ggcgtcgcctgcatgggggg

SEQ ID NO: 216117 - DNA, 20 bp, human
gggcgtacgtaactcgggcg

SEQ ID NO: 216118 - DNA, 20 bp, human
gggtgggcggcgggttgcaa

SEQ ID NO: 216119 - DNA, 20 bp, human
gctctccgtggtttacccct

SEQ ID NO: 216120 - DNA, 20 bp, human
ggccgggacgaagccccgca

SEQ ID NO: 216121 - DNA, 20 bp, human
gaaaccacggagagcaaggg

SEQ ID NO: 216122 - DNA, 20 bp, human
gtcgaccagagctcgacccc

SEQ ID NO: 216123 - DNA, 20 bp, human
ggctcccgttggtgacgcgg

SEQ ID NO: 216124 - DNA, 20 bp, human
ggtccgcaacagccaatccg

SEQ ID NO: 216125 - DNA, 20 bp, human
gtccctgcggggcttcgtcc

SEQ ID NO: 216126 - DNA, 20 bp, human
gggccccccggctccagcga

SEQ ID NO: 216127 - DNA, 20 bp, human
gggccaggggccgcacccgc

SEQ ID NO: 216128 - DNA, 20 bp, human
gaggggccgcacccgcaggt

SEQ ID NO: 216129 - DNA, 20 bp, human
gggacacggcccggccgcga

SEQ ID NO: 216130 - DNA, 20 bp, human
gcgagggaggagcgcgcgct

SEQ ID NO: 216131 - DNA, 20 bp, human
gctcaccccacctgcgggtg

SEQ ID NO: 216132 - DNA, 20 bp, human
ggggaatccgcaggcttcag

SEQ ID NO: 216133 - DNA, 20 bp, human
ggagcagggaatccgcaggt

SEQ ID NO: 216134 - DNA, 20 bp, human
ggcgcggaagccacacccat

SEQ ID NO: 216135 - DNA, 20 bp, human
ggtgcgagcaggacacggcc

SEQ ID NO: 216136 - DNA, 20 bp, human
gaagcctcaagggggcccga

SEQ ID NO: 216137 - DNA, 20 bp, human
ggctggcatcgccacctggt

SEQ ID NO: 216138 - DNA, 20 bp, human
ggtaccctcgggcccccttg

SEQ ID NO: 216139 - DNA, 20 bp, human
gccgagggtacgctgtgctg

SEQ ID NO: 216140 - DNA, 20 bp, human
gtcggcacccacggcaagag

SEQ ID NO: 216141 - DNA, 20 bp, human
gaagagcggcgcggccaatc

SEQ ID NO: 216142 - DNA, 20 bp, human
gacccacggcaagagcggcg

SEQ ID NO: 216143 - DNA, 20 bp, human
gttgccgtgggtgccgacgg

SEQ ID NO: 216144 - DNA, 20 bp, human
gcggcgcggccaatccggcc

SEQ ID NO: 216145 - DNA, 20 bp, human
gaggtggcgatgccagcggc

SEQ ID NO: 216146 - DNA, 20 bp, human
gtgtctccagactactaccc

SEQ ID NO: 216147 - DNA, 20 bp, human
gagtctggagacactcctag

SEQ ID NO: 216148 - DNA, 20 bp, human
gctcccgagtaaactccgct

SEQ ID NO: 216149 - DNA, 20 bp, human
gactcctagcggagtttact

SEQ ID NO: 216150 - DNA, 20 bp, human
gccccaggggttcttcacac

SEQ ID NO: 216151 - DNA, 20 bp, human
ggcagtacaggctcatggtt

SEQ ID NO: 216152 - DNA, 20 bp, human
gctggggcgtcagaatccag

SEQ ID NO: 216153 - DNA, 20 bp, human
gaatagtcaactaataatcc

SEQ ID NO: 216154 - DNA, 20 bp, human
ggagtttactcgggagaggg

SEQ ID NO: 216155 - DNA, 20 bp, human
gtattagttgactattaccc

SEQ ID NO: 216156 - DNA, 20 bp, human
gggtggacggcgagtagtta

SEQ ID NO: 216157 - DNA, 20 bp, human
gtcaagggactgatccaatg

SEQ ID NO: 216158 - DNA, 20 bp, human
ggggccaatatagtgttcct

SEQ ID NO: 216159 - DNA, 20 bp, human
gagagtgaagcgctcatagg

SEQ ID NO: 216160 - DNA, 20 bp, human
ggtcgcttatgccctcctat

SEQ ID NO: 216161 - DNA, 20 bp, human
gggacccaggaacactatat

SEQ ID NO: 216162 - DNA, 20 bp, human
ggaaatacactaagagtcaa

SEQ ID NO: 216163 - DNA, 20 bp, human
gaatcaaatttcttcggtta

SEQ ID NO: 216164 - DNA, 20 bp, human
gactgatccaatgaggaccc

SEQ ID NO: 216165 - DNA, 20 bp, human
gcataagcgacagaggcgtc

SEQ ID NO: 216166 - DNA, 20 bp, human
gcgtcggtggggagttagaa

SEQ ID NO: 216167 - DNA, 20 bp, human
gggccccggcgtctccgcgt

SEQ ID NO: 216168 - DNA, 20 bp, human
gcggggcgctgcacaccggg

SEQ ID NO: 216169 - DNA, 20 bp, human
gagaagccgccgggacgcgc

SEQ ID NO: 216170 - DNA, 20 bp, human
gagacgggaagctcggctct

SEQ ID NO: 216171 - DNA, 20 bp, human
ggcgctgcacaccgggaggg

SEQ ID NO: 216172 - DNA, 20 bp, human
ggcgccccacgcggagacgc

SEQ ID NO: 216173 - DNA, 20 bp, human
ggccccgcgctccgctgcca

SEQ ID NO: 216174 - DNA, 20 bp, human
gccgtccgacccccccctcc

SEQ ID NO: 216175 - DNA, 20 bp, human
gtggttgcttcacgccccgg

SEQ ID NO: 216176 - DNA, 20 bp, human
gaaggaaactggggagataa

SEQ ID NO: 216177 - DNA, 20 bp, human
gagggcagtggtcaggaaat

SEQ ID NO: 216178 - DNA, 20 bp, human
gggagtgctcgagaacagat

SEQ ID NO: 216179 - DNA, 20 bp, human
gaactggggagataatggga

SEQ ID NO: 216180 - DNA, 20 bp, human
gggggagataatgggatgga

SEQ ID NO: 216181 - DNA, 20 bp, human
ggggtccccccttaaagaag

SEQ ID NO: 216182 - DNA, 20 bp, human
ggggatggagggcagtggtc

SEQ ID NO: 216183 - DNA, 20 bp, human
gccttccggaaccagaactc

SEQ ID NO: 216184 - DNA, 20 bp, human
gctaggcaacaaaggaaact

SEQ ID NO: 216185 - DNA, 20 bp, human
gagacagaaggggaataaaa

SEQ ID NO: 216186 - DNA, 20 bp, human
ggggagcaacaaatgtggtt

SEQ ID NO: 216187 - DNA, 20 bp, human
gtcagagcaggcgtcgtggg

SEQ ID NO: 216188 - DNA, 20 bp, human
gcagatcagagcaggcgtcg

SEQ ID NO: 216189 - DNA, 20 bp, human
ggagagggctgtaggccggg

SEQ ID NO: 216190 - DNA, 20 bp, human
gggcgtggcgacggccggag

SEQ ID NO: 216191 - DNA, 20 bp, human
gctggagagggctgtaggcc

SEQ ID NO: 216192 - DNA, 20 bp, human
ggacggaagcttaatgcttg

SEQ ID NO: 216193 - DNA, 20 bp, human
gctgctctgatctgacctcc

SEQ ID NO: 216194 - DNA, 20 bp, human
ggcgtagaagctccgaggcg

SEQ ID NO: 216195 - DNA, 20 bp, human
gcgcatgcgtagaagctccg

SEQ ID NO: 216196 - DNA, 20 bp, human
ggcgcccattgtcccgccga

SEQ ID NO: 216197 - DNA, 20 bp, human
gtgcgccctgggaacgctcg

SEQ ID NO: 216198 - DNA, 20 bp, human
gtgaacccacagccagtcct

SEQ ID NO: 216199 - DNA, 20 bp, human
gcgagggcagcggccagtgc

SEQ ID NO: 216200 - DNA, 20 bp, human
gctgccctcggcgggacaat

SEQ ID NO: 216201 - DNA, 20 bp, human
gtagcaacgaggcacaacaa

SEQ ID NO: 216202 - DNA, 20 bp, human
gaggcacaacaagggactgg

SEQ ID NO: 216203 - DNA, 20 bp, human
gcactggattcaggtaatcg

SEQ ID NO: 216204 - DNA, 20 bp, human
gcacttggctcctcccgcac

SEQ ID NO: 216205 - DNA, 20 bp, human
ggcagccccgagcgttccca

SEQ ID NO: 216206 - DNA, 20 bp, human
gcaccgcgtggagtgagtta

SEQ ID NO: 216207 - DNA, 20 bp, human
gtgagcagttgcggggtcgg

SEQ ID NO: 216208 - DNA, 20 bp, human
gcgcggaggtcccgagacca

SEQ ID NO: 216209 - DNA, 20 bp, human
ggaaaggttgactttgacag

SEQ ID NO: 216210 - DNA, 20 bp, human
ggagaccagggtaacggact

SEQ ID NO: 216211 - DNA, 20 bp, human
gagaggtcgtgagcagttgc

SEQ ID NO: 216212 - DNA, 20 bp, human
ggtgagttagggtgcacact

SEQ ID NO: 216213 - DNA, 20 bp, human
gtacggtgcaacgggtccgc

SEQ ID NO: 216214 - DNA, 20 bp, human
gacggactgggctgcggtcg

SEQ ID NO: 216215 - DNA, 20 bp, human
ggcagcccagtccgttaccc

SEQ ID NO: 216216 - DNA, 20 bp, human
ggtgcaaggacagacttccg

SEQ ID NO: 216217 - DNA, 20 bp, human
ggggccgcaccaccgctggg

SEQ ID NO: 216218 - DNA, 20 bp, human
ggcggtgcatgagggagatg

SEQ ID NO: 216219 - DNA, 20 bp, human
gtgcaccgcccgcacgtccc

SEQ ID NO: 216220 - DNA, 20 bp, human
gtggaagacagggaaatcgt

SEQ ID NO: 216221 - DNA, 20 bp, human
gaagttgtagttctcgaccc

SEQ ID NO: 216222 - DNA, 20 bp, human
gtgatcccagggagcggaac

SEQ ID NO: 216223 - DNA, 20 bp, human
ggacgtgcgggcggtgcatg

SEQ ID NO: 216224 - DNA, 20 bp, human
gggcacgaaggctccgtggt

SEQ ID NO: 216225 - DNA, 20 bp, human
gctaaacagcgtcagcgagg

SEQ ID NO: 216226 - DNA, 20 bp, human
gcctgcgcaccaggactcgg

SEQ ID NO: 216227 - DNA, 20 bp, human
gtccgcgcgcggtggtctcg

SEQ ID NO: 216228 - DNA, 20 bp, human
ggcggcgctgcggagaccgt

SEQ ID NO: 216229 - DNA, 20 bp, human
ggggccctggcgtcgtcggt

SEQ ID NO: 216230 - DNA, 20 bp, human
gaaccaaggtaaagccaacg

SEQ ID NO: 216231 - DNA, 20 bp, human
gggtgggtggctcccggggt

SEQ ID NO: 216232 - DNA, 20 bp, human
ggcccgggccctggcgtcgt

SEQ ID NO: 216233 - DNA, 20 bp, human
gccctggcgtcgtcggtggg

SEQ ID NO: 216234 - DNA, 20 bp, human
gaccgtgagcgtcccggaag

SEQ ID NO: 216235 - DNA, 20 bp, human
ggcgcaccaggactcggcgg

SEQ ID NO: 216236 - DNA, 20 bp, human
ggggccgtcgccgaactcct

SEQ ID NO: 216237 - DNA, 20 bp, human
ggcgccaaggagttcggcga

SEQ ID NO: 216238 - DNA, 20 bp, human
ggacggccccgccccttcgg

SEQ ID NO: 216239 - DNA, 20 bp, human
ggcacgcgcgccaaggagtt

SEQ ID NO: 216240 - DNA, 20 bp, human
gctgaggcaggtgcaggcgt

SEQ ID NO: 216241 - DNA, 20 bp, human
gccaacagatgggcgagtga

SEQ ID NO: 216242 - DNA, 20 bp, human
gtcgccgctggttccagcac

SEQ ID NO: 216243 - DNA, 20 bp, human
ggcatctggacatgggatac

SEQ ID NO: 216244 - DNA, 20 bp, human
gtagcctgtgctggaaccag

SEQ ID NO: 216245 - DNA, 20 bp, human
gcgtgggtgggtgtactgcg

SEQ ID NO: 216246 - DNA, 20 bp, human
gcaaaagggaatggcgtcag

SEQ ID NO: 216247 - DNA, 20 bp, human
ggaaaggcccgcagaaagaa

SEQ ID NO: 216248 - DNA, 20 bp, human
ggctaggcaccgctccctaa

SEQ ID NO: 216249 - DNA, 20 bp, human
gcccacctgccgctcgcggt

SEQ ID NO: 216250 - DNA, 20 bp, human
gcaccgctcaagtaccggaa

SEQ ID NO: 216251 - DNA, 20 bp, human
gcgcagaaagaagggcaaaa

SEQ ID NO: 216252 - DNA, 20 bp, human
gtctgagcctgggttagagg

SEQ ID NO: 216253 - DNA, 20 bp, human
gtactctgagcctgggttag

SEQ ID NO: 216254 - DNA, 20 bp, human
gcagccagatagacgagaac

SEQ ID NO: 216255 - DNA, 20 bp, human
ggggccggcacacaacgcta

SEQ ID NO: 216256 - DNA, 20 bp, human
gctcccaggctgctccgcgt

SEQ ID NO: 216257 - DNA, 20 bp, human
gccaggctgctccgcgtcgg

SEQ ID NO: 216258 - DNA, 20 bp, human
ggccaccccggcgtcacgtg

SEQ ID NO: 216259 - DNA, 20 bp, human
gcgaccccgaaacttcctgg

SEQ ID NO: 216260 - DNA, 20 bp, human
ggcggcggttgcccgggtga

SEQ ID NO: 216261 - DNA, 20 bp, human
gtgaacgaacgaaagtggag

SEQ ID NO: 216262 - DNA, 20 bp, human
ggtggtgaaggttcacgcgc

SEQ ID NO: 216263 - DNA, 20 bp, human
gccccgaaacttcctggcgg

SEQ ID NO: 216264 - DNA, 20 bp, human
gcggcggcgccccgcgcgat

SEQ ID NO: 216265 - DNA, 20 bp, human
gcgaaagtggagtggtggag

SEQ ID NO: 216266 - DNA, 20 bp, human
gaagctacttctagtctccg

SEQ ID NO: 216267 - DNA, 20 bp, human
gtacttctagtctccggggt

SEQ ID NO: 216268 - DNA, 20 bp, human
gcttctgcggcgctgctgat

SEQ ID NO: 216269 - DNA, 20 bp, human
gagagagagacagttggact

SEQ ID NO: 216270 - DNA, 20 bp, human
gtcggctccagctcacgtga

SEQ ID NO: 216271 - DNA, 20 bp, human
gctgatgggagtggtaattg

SEQ ID NO: 216272 - DNA, 20 bp, human
gtgacaggacctgatgtgtc

SEQ ID NO: 216273 - DNA, 20 bp, human
ggtctccggggttggcaaag

SEQ ID NO: 216274 - DNA, 20 bp, human
gaattggggtcctgatctca

SEQ ID NO: 216275 - DNA, 20 bp, human
gcatgacttgtgatgggggg

SEQ ID NO: 216276 - DNA, 20 bp, human
gaggggctgcatcttctcgg

SEQ ID NO: 216277 - DNA, 20 bp, human
gtgacaggacctgatgtggt

SEQ ID NO: 216278 - DNA, 20 bp, human
gtgggaatggaagtaaagga

SEQ ID NO: 216279 - DNA, 20 bp, human
ggaagagtgtccagtagccc

SEQ ID NO: 216280 - DNA, 20 bp, human
gagggggctcgtactcttgg

SEQ ID NO: 216281 - DNA, 20 bp, human
gctgcatcgccagtaagctt

SEQ ID NO: 216282 - DNA, 20 bp, human
gcgtgaccaggagctgacgt

SEQ ID NO: 216283 - DNA, 20 bp, human
gccctgaatagggtaatcta

SEQ ID NO: 216284 - DNA, 20 bp, human
gggacggagaacgacggtca

SEQ ID NO: 216285 - DNA, 20 bp, human
ggtgtccagtagcccaggaa

SEQ ID NO: 216286 - DNA, 20 bp, human
gggaaattggggacccgagt

SEQ ID NO: 216287 - DNA, 20 bp, human
gagtaataaggcctggtgtg

SEQ ID NO: 216288 - DNA, 20 bp, human
ggtccctttctggtaatcgg

SEQ ID NO: 216289 - DNA, 20 bp, human
ggtagactttcatagctcgg

SEQ ID NO: 216290 - DNA, 20 bp, human
gtgtcccaggagcctaggga

SEQ ID NO: 216291 - DNA, 20 bp, human
gaattggggacccgagttgg

SEQ ID NO: 216292 - DNA, 20 bp, human
gaagtggcccatagccccag

SEQ ID NO: 216293 - DNA, 20 bp, human
gagggacggcatcttcccct

SEQ ID NO: 216294 - DNA, 20 bp, human
gaccagcagtgcggcagaag

SEQ ID NO: 216295 - DNA, 20 bp, human
ggccgtccctttctggtaat

SEQ ID NO: 216296 - DNA, 20 bp, human
gctcccctgtaactgaagat

SEQ ID NO: 216297 - DNA, 20 bp, human
gcacagacatccccgttctc

SEQ ID NO: 216298 - DNA, 20 bp, human
gccaagggccgggagtgggt

SEQ ID NO: 216299 - DNA, 20 bp, human
gagtgacaacgcgtgcgcac

SEQ ID NO: 216300 - DNA, 20 bp, human
gagagagggcaggtcgtgta

SEQ ID NO: 216301 - DNA, 20 bp, human
gacggggatgtctgtgcgtg

SEQ ID NO: 216302 - DNA, 20 bp, human
gtgtgcgtgcggagtggagg

SEQ ID NO: 216303 - DNA, 20 bp, human
gacagccaagggccgggagt

SEQ ID NO: 216304 - DNA, 20 bp, human
gcggcccttggtgggtggta

SEQ ID NO: 216305 - DNA, 20 bp, human
ggggaggagggcgagctcgg

SEQ ID NO: 216306 - DNA, 20 bp, human
gcggccacagggtacaggac

SEQ ID NO: 216307 - DNA, 20 bp, human
ggggatccggcttatggaag

SEQ ID NO: 216308 - DNA, 20 bp, human
gtgaagcggccacagggtac

SEQ ID NO: 216309 - DNA, 20 bp, human
ggcgactcttttctgtcgga

SEQ ID NO: 216310 - DNA, 20 bp, human
gcagttcaggaaagaatggt

SEQ ID NO: 216311 - DNA, 20 bp, human
ggggacgaattccggatata

SEQ ID NO: 216312 - DNA, 20 bp, human
ggagctagagcgtagtttat

SEQ ID NO: 216313 - DNA, 20 bp, human
gctccctgtcctgtaccctg

SEQ ID NO: 216314 - DNA, 20 bp, human
ggctgggagggaggactcga

SEQ ID NO: 216315 - DNA, 20 bp, human
gcactgaaatgggcggtctc

SEQ ID NO: 216316 - DNA, 20 bp, human
gcggccacagggtacaggac

SEQ ID NO: 216317 - DNA, 20 bp, human
ggggatccggcttatggaag

SEQ ID NO: 216318 - DNA, 20 bp, human
gtgaagcggccacagggtac

SEQ ID NO: 216319 - DNA, 20 bp, human
ggcgactcttttctgtcgga

SEQ ID NO: 216320 - DNA, 20 bp, human
gcagttcaggaaagaatggt

SEQ ID NO: 216321 - DNA, 20 bp, human
ggggacgaattccggatata

SEQ ID NO: 216322 - DNA, 20 bp, human
ggagctagagcgtagtttat

SEQ ID NO: 216323 - DNA, 20 bp, human
gctccctgtcctgtaccctg

SEQ ID NO: 216324 - DNA, 20 bp, human
ggctgggagggaggactcga

SEQ ID NO: 216325 - DNA, 20 bp, human
gcactgaaatgggcggtctc

SEQ ID NO: 216326 - DNA, 20 bp, human
gcgcctgccgcactgcttgt

SEQ ID NO: 216327 - DNA, 20 bp, human
ggtaaatgaagggtagactc

SEQ ID NO: 216328 - DNA, 20 bp, human
gccacgtcaccagtgcgctc

SEQ ID NO: 216329 - DNA, 20 bp, human
gaggggcagcatctttagga

SEQ ID NO: 216330 - DNA, 20 bp, human
gtgagggggagatacaaggc

SEQ ID NO: 216331 - DNA, 20 bp, human
gaggaaggggcagcatcttt

SEQ ID NO: 216332 - DNA, 20 bp, human
gccccaagaagtgtaaatga

SEQ ID NO: 216333 - DNA, 20 bp, human
gaagtgacagggcccactgt

SEQ ID NO: 216334 - DNA, 20 bp, human
gttggtgtagagactgaaca

SEQ ID NO: 216335 - DNA, 20 bp, human
gcctgctagtcgcctccgtc

SEQ ID NO: 216336 - DNA, 20 bp, human
gagtgagatggcagctggct

SEQ ID NO: 216337 - DNA, 20 bp, human
gaacttgaatgatgtagcga

SEQ ID NO: 216338 - DNA, 20 bp, human
gttaaaaaatgcagagaccc

SEQ ID NO: 216339 - DNA, 20 bp, human
gatgatttcaatggatacta

SEQ ID NO: 216340 - DNA, 20 bp, human
ggagaccacccaacaattca

SEQ ID NO: 216341 - DNA, 20 bp, human
gaccacccaacaattcaggg

SEQ ID NO: 216342 - DNA, 20 bp, human
gtccaccctgaattgttggg

SEQ ID NO: 216343 - DNA, 20 bp, human
gaaaaatgcccccaggagtc

SEQ ID NO: 216344 - DNA, 20 bp, human
gcgggaaaagacaatgctcc

SEQ ID NO: 216345 - DNA, 20 bp, human
gtcagggcgccctgactcct

SEQ ID NO: 216346 - DNA, 20 bp, human
ggagaccccgcctatatagt

SEQ ID NO: 216347 - DNA, 20 bp, human
gaccgcggaatccaagatgg

SEQ ID NO: 216348 - DNA, 20 bp, human
gaccccgcctatatagtagg

SEQ ID NO: 216349 - DNA, 20 bp, human
gcggggtctccccgccgcag

SEQ ID NO: 216350 - DNA, 20 bp, human
gccaccgaaccgggagggag

SEQ ID NO: 216351 - DNA, 20 bp, human
gactccgcctactatatagg

SEQ ID NO: 216352 - DNA, 20 bp, human
gagtaggcggagtcaacaca

SEQ ID NO: 216353 - DNA, 20 bp, human
ggcgccagccagtccagtga

SEQ ID NO: 216354 - DNA, 20 bp, human
gaaaatgccaaatcgtccaa

SEQ ID NO: 216355 - DNA, 20 bp, human
gttgactccgcctactatat

SEQ ID NO: 216356 - DNA, 20 bp, human
ggccccccgccgcgcgacaa

SEQ ID NO: 216357 - DNA, 20 bp, human
gggacccccaagttgggcgc

SEQ ID NO: 216358 - DNA, 20 bp, human
gcgacaaaggctgaaccggg

SEQ ID NO: 216359 - DNA, 20 bp, human
gcggtagcaccgcgagactt

SEQ ID NO: 216360 - DNA, 20 bp, human
gcgggctcgcgcaggtgctc

SEQ ID NO: 216361 - DNA, 20 bp, human
gctctgcccccgccagtcgc

SEQ ID NO: 216362 - DNA, 20 bp, human
gtcgccggcgcccaacttgg

SEQ ID NO: 216363 - DNA, 20 bp, human
gggtgctaccgctctgaccg

SEQ ID NO: 216364 - DNA, 20 bp, human
gcgcggctccccggtcagag

SEQ ID NO: 216365 - DNA, 20 bp, human
gtaacaccgggccgtgtccc

SEQ ID NO: 216366 - DNA, 20 bp, human
gtcccttcgggcgttcggat

SEQ ID NO: 216367 - DNA, 20 bp, human
gcggctcctccattggtggg

SEQ ID NO: 216368 - DNA, 20 bp, human
gccgcctcgccattggtcag

SEQ ID NO: 216369 - DNA, 20 bp, human
gcgaagggagccggtcccgg

SEQ ID NO: 216370 - DNA, 20 bp, human
gagcccgctggccagttgtg

SEQ ID NO: 216371 - DNA, 20 bp, human
gcttccccgcccaccaatgg

SEQ ID NO: 216372 - DNA, 20 bp, human
gaggccgctgaccaatggcg

SEQ ID NO: 216373 - DNA, 20 bp, human
ggttgggcacagcgattggt

SEQ ID NO: 216374 - DNA, 20 bp, human
gggcaggggcgaggaaccca

SEQ ID NO: 216375 - DNA, 20 bp, human
gtagagaggccgctgaccaa

SEQ ID NO: 216376 - DNA, 20 bp, human
gaccctcggggcaaaggtaa

SEQ ID NO: 216377 - DNA, 20 bp, human
gggaaagagacccgggccaa

SEQ ID NO: 216378 - DNA, 20 bp, human
gagcggagggcacggggcta

SEQ ID NO: 216379 - DNA, 20 bp, human
gagggcacggggctagggtt

SEQ ID NO: 216380 - DNA, 20 bp, human
ggtctaacaactgcaatctt

SEQ ID NO: 216381 - DNA, 20 bp, human
gcgagcagcaaagcactaaa

SEQ ID NO: 216382 - DNA, 20 bp, human
gtcccggcgggaaagagacc

SEQ ID NO: 216383 - DNA, 20 bp, human
gcccgcggcgcccagagcgg

SEQ ID NO: 216384 - DNA, 20 bp, human
gcaatagggtggttgctaga

SEQ ID NO: 216385 - DNA, 20 bp, human
gcaaccaccctattgaaaac

SEQ ID NO: 216386 - DNA, 20 bp, human
ggggcagcatctcctctgaa

SEQ ID NO: 216387 - DNA, 20 bp, human
gccgcgcatgcgcacagctc

SEQ ID NO: 216388 - DNA, 20 bp, human
ggggcgcgcagtccggggtt

SEQ ID NO: 216389 - DNA, 20 bp, human
ggcgcagtccggggttaggc

SEQ ID NO: 216390 - DNA, 20 bp, human
gactgcagcctgcctaaccc

SEQ ID NO: 216391 - DNA, 20 bp, human
ggggagcggctgacagatcc

SEQ ID NO: 216392 - DNA, 20 bp, human
gcctgcgcgttgcgaccgcg

SEQ ID NO: 216393 - DNA, 20 bp, human
gactgtcggcggcccttcag

SEQ ID NO: 216394 - DNA, 20 bp, human
gcaggcgccgtgtccacttc

SEQ ID NO: 216395 - DNA, 20 bp, human
gcacttgccaggcgttccgt

SEQ ID NO: 216396 - DNA, 20 bp, human
ggcagcacccccaccccgaa

SEQ ID NO: 216397 - DNA, 20 bp, human
gccggtacccgcgcagacgt

SEQ ID NO: 216398 - DNA, 20 bp, human
gaggtcccgccctcccttcg

SEQ ID NO: 216399 - DNA, 20 bp, human
ggcacccccaccccgaaggg

SEQ ID NO: 216400 - DNA, 20 bp, human
gcttctgcggacagagcctt

SEQ ID NO: 216401 - DNA, 20 bp, human
gcggaggtccagcccagcgg

SEQ ID NO: 216402 - DNA, 20 bp, human
gtggttgcggacggcttctg

SEQ ID NO: 216403 - DNA, 20 bp, human
gccccccgcccacgaggaag

SEQ ID NO: 216404 - DNA, 20 bp, human
gcattgacggtggttgcgga

SEQ ID NO: 216405 - DNA, 20 bp, human
gaccgcctgctccccgccca

SEQ ID NO: 216406 - DNA, 20 bp, human
gggcgcgccggaggaaacgg

SEQ ID NO: 216407 - DNA, 20 bp, human
ggtaggcggtagacgtaagc

SEQ ID NO: 216408 - DNA, 20 bp, human
gtagacgtaagcggggtcgg

SEQ ID NO: 216409 - DNA, 20 bp, human
gaaagtagacggtggggcgg

SEQ ID NO: 216410 - DNA, 20 bp, human
ggggaatgacagctccgcgg

SEQ ID NO: 216411 - DNA, 20 bp, human
gcggtgggaaagtagacggt

SEQ ID NO: 216412 - DNA, 20 bp, human
ggcggagctgtcattccccg

SEQ ID NO: 216413 - DNA, 20 bp, human
gctgcgctcgcgttcacgag

SEQ ID NO: 216414 - DNA, 20 bp, human
gcgttcacgagtggttgaag

SEQ ID NO: 216415 - DNA, 20 bp, human
gcggtagacgtaagcggggt

SEQ ID NO: 216416 - DNA, 20 bp, human
gaagagacattgtatcctgg

SEQ ID NO: 216417 - DNA, 20 bp, human
gcaatggaatccttggatgc

SEQ ID NO: 216418 - DNA, 20 bp, human
gggatgccggaagattttca

SEQ ID NO: 216419 - DNA, 20 bp, human
gagaacctgggaactctgat

SEQ ID NO: 216420 - DNA, 20 bp, human
gatgccagcttgatgcacaa

SEQ ID NO: 216421 - DNA, 20 bp, human
gtacttccaattccaagaag

SEQ ID NO: 216422 - DNA, 20 bp, human
gcttctagacacagttgtaa

SEQ ID NO: 216423 - DNA, 20 bp, human
gatgggagaaagtcagaacc

SEQ ID NO: 216424 - DNA, 20 bp, human
gatttccaatcagagttccc

SEQ ID NO: 216425 - DNA, 20 bp, human
gaatagactatattctaccc

SEQ ID NO: 216426 - DNA, 20 bp, human
gcagcgcccagaatggagat

SEQ ID NO: 216427 - DNA, 20 bp, human
gaggcggaagcgaaacggaa

SEQ ID NO: 216428 - DNA, 20 bp, human
ggaaacggaaggggcgggtg

SEQ ID NO: 216429 - DNA, 20 bp, human
gcggccgctgcaaccagaag

SEQ ID NO: 216430 - DNA, 20 bp, human
ggaagcgaaacggaaggggc

SEQ ID NO: 216431 - DNA, 20 bp, human
gaaggaggcgccagagcact

SEQ ID NO: 216432 - DNA, 20 bp, human
gggcgccagagcactaggca

SEQ ID NO: 216433 - DNA, 20 bp, human
gggccgcgcggatctgaagg

SEQ ID NO: 216434 - DNA, 20 bp, human
gcgtgaggcagcgcccagaa

SEQ ID NO: 216435 - DNA, 20 bp, human
gaggcccctgcctagtgctc

SEQ ID NO: 216436 - DNA, 20 bp, human
gtagcagcattgaggtgcga

SEQ ID NO: 216437 - DNA, 20 bp, human
gagaagggatagcagcattg

SEQ ID NO: 216438 - DNA, 20 bp, human
gccctcccctaattaatctt

SEQ ID NO: 216439 - DNA, 20 bp, human
gaaccacccaagattaatta

SEQ ID NO: 216440 - DNA, 20 bp, human
gagcattgaggtgcgagggc

SEQ ID NO: 216441 - DNA, 20 bp, human
gtcccctaattaatcttggg

SEQ ID NO: 216442 - DNA, 20 bp, human
gtgcgagggctggttctttc

SEQ ID NO: 216443 - DNA, 20 bp, human
gttaattaggggagggagaa

SEQ ID NO: 216444 - DNA, 20 bp, human
ggcaaacaaccttcccttaa

SEQ ID NO: 216445 - DNA, 20 bp, human
gaaatgatgttggctggacg

SEQ ID NO: 216446 - DNA, 20 bp, human
gaaggcccaagcgttcgtaa

SEQ ID NO: 216447 - DNA, 20 bp, human
gccccttgcagttgacgcgg

SEQ ID NO: 216448 - DNA, 20 bp, human
gaagctgcacccattcctgg

SEQ ID NO: 216449 - DNA, 20 bp, human
gtcagattgggcaccaaatt

SEQ ID NO: 216450 - DNA, 20 bp, human
gaccccgctcggagcataga

SEQ ID NO: 216451 - DNA, 20 bp, human
gcagaaccggaagaaacgaa

SEQ ID NO: 216452 - DNA, 20 bp, human
gagcgccaggagctgcgggt

SEQ ID NO: 216453 - DNA, 20 bp, human
ggtaccatctatgctccgag

SEQ ID NO: 216454 - DNA, 20 bp, human
gacgaagggctcgtccgctt

SEQ ID NO: 216455 - DNA, 20 bp, human
ggcgaaagggcaggcatcgc

SEQ ID NO: 216456 - DNA, 20 bp, human
ggtaggaggccgcagcgagg

SEQ ID NO: 216457 - DNA, 20 bp, human
gcggcccctggggccgtagg

SEQ ID NO: 216458 - DNA, 20 bp, human
gccccttgcagttgacgcgg

SEQ ID NO: 216459 - DNA, 20 bp, human
gagggtgtccctagagaacg

SEQ ID NO: 216460 - DNA, 20 bp, human
gaccgccccggaactggcta

SEQ ID NO: 216461 - DNA, 20 bp, human
gggcggttgctcacatcgac

SEQ ID NO: 216462 - DNA, 20 bp, human
gtcagagtcctcgttctcta

SEQ ID NO: 216463 - DNA, 20 bp, human
ggcccccgcgtcaactgcaa

SEQ ID NO: 216464 - DNA, 20 bp, human
gcccatagccagttccgggg

SEQ ID NO: 216465 - DNA, 20 bp, human
ggggccccttgcagttgacg

SEQ ID NO: 216466 - DNA, 20 bp, human
gaccttggaaggcgtctcga

SEQ ID NO: 216467 - DNA, 20 bp, human
gtaacctggggtcagaccag

SEQ ID NO: 216468 - DNA, 20 bp, human
gactgtgaacagaacagact

SEQ ID NO: 216469 - DNA, 20 bp, human
gagctggaataggggatcgg

SEQ ID NO: 216470 - DNA, 20 bp, human
ggccttcgagacgccttcca

SEQ ID NO: 216471 - DNA, 20 bp, human
gaggtagcactgagggtgca

SEQ ID NO: 216472 - DNA, 20 bp, human
ggggaactgcaggcattcag

SEQ ID NO: 216473 - DNA, 20 bp, human
gcgccttccaaggtgtagag

SEQ ID NO: 216474 - DNA, 20 bp, human
gtgaagccaggtagcactga

SEQ ID NO: 216475 - DNA, 20 bp, human
gttaccaaatgtaccctggc

SEQ ID NO: 216476 - DNA, 20 bp, human
gggaagagcaggggcagcgt

SEQ ID NO: 216477 - DNA, 20 bp, human
gtctccgcaggcaaggggcg

SEQ ID NO: 216478 - DNA, 20 bp, human
gccaagggagcgcgaacctg

SEQ ID NO: 216479 - DNA, 20 bp, human
gagggagcgcgaacctgagg

SEQ ID NO: 216480 - DNA, 20 bp, human
gacctgaggaggaagaaacg

SEQ ID NO: 216481 - DNA, 20 bp, human
gccgcggctcggaccgttct

SEQ ID NO: 216482 - DNA, 20 bp, human
gagtcggcgacgcctcagag

SEQ ID NO: 216483 - DNA, 20 bp, human
gccacggagagcgcgcgcga

SEQ ID NO: 216484 - DNA, 20 bp, human
gcgctctccgtggaagagca

SEQ ID NO: 216485 - DNA, 20 bp, human
gagggccaaaagctggaccg

SEQ ID NO: 216486 - DNA, 20 bp, human
gggcacctggagtgcggtat

SEQ ID NO: 216487 - DNA, 20 bp, human
gcgtggaagggacactgagg

SEQ ID NO: 216488 - DNA, 20 bp, human
ggatccggaagcgccgtcag

SEQ ID NO: 216489 - DNA, 20 bp, human
gcggaagcgccgtcaggggc

SEQ ID NO: 216490 - DNA, 20 bp, human
ggggcgcccggcatctgtgc

SEQ ID NO: 216491 - DNA, 20 bp, human
gtgacaaaatagagactccg

SEQ ID NO: 216492 - DNA, 20 bp, human
gtaccggcagggatcacccc

SEQ ID NO: 216493 - DNA, 20 bp, human
gacggcgcttccggatccgg

SEQ ID NO: 216494 - DNA, 20 bp, human
gaaaatagagactccgtgga

SEQ ID NO: 216495 - DNA, 20 bp, human
gttacggcacacacgaggcg

SEQ ID NO: 216496 - DNA, 20 bp, human
gtccgagggaaagaggaagt

SEQ ID NO: 216497 - DNA, 20 bp, human
ggggaaagaggaagtaggcg

SEQ ID NO: 216498 - DNA, 20 bp, human
gcgcccgctccgagggaaag

SEQ ID NO: 216499 - DNA, 20 bp, human
gcgccacccggcagtagttg

SEQ ID NO: 216500 - DNA, 20 bp, human
ggacctccgcaactactgcc

SEQ ID NO: 216501 - DNA, 20 bp, human
ggccaatggcgccgcagcgg

SEQ ID NO: 216502 - DNA, 20 bp, human
ggtaccacggcgttcctcgg

SEQ ID NO: 216503 - DNA, 20 bp, human
gcacccggcagtagttgcgg

SEQ ID NO: 216504 - DNA, 20 bp, human
ggcggccaatggcgccgcag

SEQ ID NO: 216505 - DNA, 20 bp, human
ggctccggccctaccaggcg

SEQ ID NO: 216506 - DNA, 20 bp, human
ggggagaagcggggtcaagt

SEQ ID NO: 216507 - DNA, 20 bp, human
gtggctgccgagtgcttcct

SEQ ID NO: 216508 - DNA, 20 bp, human
gcaggagcggcgacctttga

SEQ ID NO: 216509 - DNA, 20 bp, human
ggaagcggggtcaagtaggt

SEQ ID NO: 216510 - DNA, 20 bp, human
ggcgacctttgaaggaaaaa

SEQ ID NO: 216511 - DNA, 20 bp, human
gagcactcggcagccacaaa

SEQ ID NO: 216512 - DNA, 20 bp, human
gaacagaactaggcgaggat

SEQ ID NO: 216513 - DNA, 20 bp, human
gggtcaagtaggtaggggtg

SEQ ID NO: 216514 - DNA, 20 bp, human
gaggcggcggccattttcgc

SEQ ID NO: 216515 - DNA, 20 bp, human
gcgacagcgagcgggagaag

SEQ ID NO: 216516 - DNA, 20 bp, human
gtctgagctaaatactgcaa

SEQ ID NO: 216517 - DNA, 20 bp, human
ggaatggcataaatcatgcc

SEQ ID NO: 216518 - DNA, 20 bp, human
ggctaataccacagttctca

SEQ ID NO: 216519 - DNA, 20 bp, human
gagcacatacaattctgtct

SEQ ID NO: 216520 - DNA, 20 bp, human
gactcaactgggatctaaga

SEQ ID NO: 216521 - DNA, 20 bp, human
gaaggtaaccatactcaact

SEQ ID NO: 216522 - DNA, 20 bp, human
ggccgagtaatctactatct

SEQ ID NO: 216523 - DNA, 20 bp, human
gagtggagcatgctctaaca

SEQ ID NO: 216524 - DNA, 20 bp, human
gtctaagagggaaagtcact

SEQ ID NO: 216525 - DNA, 20 bp, human
ggccaagatagtagattact

SEQ ID NO: 216526 - DNA, 20 bp, human
gagttcaggtgccaagagtt

SEQ ID NO: 216527 - DNA, 20 bp, human
gcatggtgggggattgaaat

SEQ ID NO: 216528 - DNA, 20 bp, human
gtgctgctgggacagagtgg

SEQ ID NO: 216529 - DNA, 20 bp, human
gaaagaatagggttcttggt

SEQ ID NO: 216530 - DNA, 20 bp, human
gtaaaggtgaagcatggtgg

SEQ ID NO: 216531 - DNA, 20 bp, human
gaggccttgaacctgagaac

SEQ ID NO: 216532 - DNA, 20 bp, human
ggagccgctgatatagagat

SEQ ID NO: 216533 - DNA, 20 bp, human
gactgtgggtataagaggct

SEQ ID NO: 216534 - DNA, 20 bp, human
gtagtggctaaaagattagc

SEQ ID NO: 216535 - DNA, 20 bp, human
ggggatcaaagtggagttgg

SEQ ID NO: 216536 - DNA, 20 bp, human
gcaggggcgtggaaccgcgc

SEQ ID NO: 216537 - DNA, 20 bp, human
gcgcgccgcccagcgaggca

SEQ ID NO: 216538 - DNA, 20 bp, human
ggtcgagcagcgcagcgccc

SEQ ID NO: 216539 - DNA, 20 bp, human
gccgcgctgccctgcctcgc

SEQ ID NO: 216540 - DNA, 20 bp, human
ggctgcgctgctcgacgcgg

SEQ ID NO: 216541 - DNA, 20 bp, human
ggggacgcgtcagggcccca

SEQ ID NO: 216542 - DNA, 20 bp, human
ggccccaaggtcggcgtttg

SEQ ID NO: 216543 - DNA, 20 bp, human
gcggagacccgcggccagca

SEQ ID NO: 216544 - DNA, 20 bp, human
gacaacagggacaggaagaa

SEQ ID NO: 216545 - DNA, 20 bp, human
gagggcgcacggctgtgtgc

SEQ ID NO: 216546 - DNA, 20 bp, human
gaaggagcgcgaagggctgg

SEQ ID NO: 216547 - DNA, 20 bp, human
gggctgggaaggagcgcgaa

SEQ ID NO: 216548 - DNA, 20 bp, human
gccggccccgctctggtctt

SEQ ID NO: 216549 - DNA, 20 bp, human
gcctctcctagcagacacgc

SEQ ID NO: 216550 - DNA, 20 bp, human
gtggccccgcgcgcggggga

SEQ ID NO: 216551 - DNA, 20 bp, human
gcgcgcgggggagggctacc

SEQ ID NO: 216552 - DNA, 20 bp, human
gcggtttcaaggggttgcag

SEQ ID NO: 216553 - DNA, 20 bp, human
gcaaggcgcccgccttccag

SEQ ID NO: 216554 - DNA, 20 bp, human
gaaggcgggcgccttggttt

SEQ ID NO: 216555 - DNA, 20 bp, human
gagcagacacgcggggccat

SEQ ID NO: 216556 - DNA, 20 bp, human
gcctccgagcggcagtccgc

SEQ ID NO: 216557 - DNA, 20 bp, human
gcggatggggcggggaatag

SEQ ID NO: 216558 - DNA, 20 bp, human
gggcgaggaggctgtcagag

SEQ ID NO: 216559 - DNA, 20 bp, human
gaggcaggggcgaagggcgg

SEQ ID NO: 216560 - DNA, 20 bp, human
gaggggcggggaataacgag

SEQ ID NO: 216561 - DNA, 20 bp, human
gggcctgggaggggccggat

SEQ ID NO: 216562 - DNA, 20 bp, human
ggccacacggacggatgggg

SEQ ID NO: 216563 - DNA, 20 bp, human
gcggcagtccgcgggctacg

SEQ ID NO: 216564 - DNA, 20 bp, human
gcagtccgcgggctacgggg

SEQ ID NO: 216565 - DNA, 20 bp, human
gggggccacacggacggatg

SEQ ID NO: 216566 - DNA, 20 bp, human
gcggggtccgcgagggaagg

SEQ ID NO: 216567 - DNA, 20 bp, human
gggtctctcgcggaccccgg

SEQ ID NO: 216568 - DNA, 20 bp, human
gaatagcgcgacaaggggcg

SEQ ID NO: 216569 - DNA, 20 bp, human
ggggagaaactgaagccctt

SEQ ID NO: 216570 - DNA, 20 bp, human
gccgccctgccgtataaaag

SEQ ID NO: 216571 - DNA, 20 bp, human
ggtccgcgagagaccagctc

SEQ ID NO: 216572 - DNA, 20 bp, human
gcggctgcccccttccctcg

SEQ ID NO: 216573 - DNA, 20 bp, human
ggggcagccggcggtgagca

SEQ ID NO: 216574 - DNA, 20 bp, human
gccaccaatagcgcgacaag

SEQ ID NO: 216575 - DNA, 20 bp, human
gaccagctctggcagcctaa

SEQ ID NO: 216576 - DNA, 20 bp, human
gaggggcgaatgagaccata

SEQ ID NO: 216577 - DNA, 20 bp, human
gcggcccgcgtgcgtcacgg

SEQ ID NO: 216578 - DNA, 20 bp, human
ggtagcggaacggcccagtg

SEQ ID NO: 216579 - DNA, 20 bp, human
gcagggcccgcccatctccg

SEQ ID NO: 216580 - DNA, 20 bp, human
gaacggatctggtagcggaa

SEQ ID NO: 216581 - DNA, 20 bp, human
gaggcgaagagagctactcg

SEQ ID NO: 216582 - DNA, 20 bp, human
gggccctgtttttgtagggt

SEQ ID NO: 216583 - DNA, 20 bp, human
ggcccgcccatctccgagga

SEQ ID NO: 216584 - DNA, 20 bp, human
gcgaagagagctactcgagg

SEQ ID NO: 216585 - DNA, 20 bp, human
ggcgccgaccctacaaaaac

SEQ ID NO: 216586 - DNA, 20 bp, human
gacccgggagcgagcgggca

SEQ ID NO: 216587 - DNA, 20 bp, human
ggtacagtaggtgtagagct

SEQ ID NO: 216588 - DNA, 20 bp, human
ggtggggtgcgagggtacaa

SEQ ID NO: 216589 - DNA, 20 bp, human
ggctccagatagcacgtcga

SEQ ID NO: 216590 - DNA, 20 bp, human
gaagagaagtcaggttcagc

SEQ ID NO: 216591 - DNA, 20 bp, human
gatagcacgtcgagggtata

SEQ ID NO: 216592 - DNA, 20 bp, human
gagctaggggaaggagatac

SEQ ID NO: 216593 - DNA, 20 bp, human
gcggtagcctgcctaccaat

SEQ ID NO: 216594 - DNA, 20 bp, human
gtgccggtaacgcacgcttc

SEQ ID NO: 216595 - DNA, 20 bp, human
gtactgtacccgggagcgag

SEQ ID NO: 216596 - DNA, 20 bp, human
gggaaggccgtgcgtgatca

SEQ ID NO: 216597 - DNA, 20 bp, human
gcattggcgctcccacgcgt

SEQ ID NO: 216598 - DNA, 20 bp, human
gcacgccggagcctcccgat

SEQ ID NO: 216599 - DNA, 20 bp, human
gaaacagtatctgtcaggga

SEQ ID NO: 216600 - DNA, 20 bp, human
gggcggaacagggttatctc

SEQ ID NO: 216601 - DNA, 20 bp, human
gcctgcgcccacccacgcgt

SEQ ID NO: 216602 - DNA, 20 bp, human
gttggccaatcgggaggctc

SEQ ID NO: 216603 - DNA, 20 bp, human
gtgggaaacagtatctgtca

SEQ ID NO: 216604 - DNA, 20 bp, human
gaccgcctcactattggcca

SEQ ID NO: 216605 - DNA, 20 bp, human
gggagtgttggccaatcggg

SEQ ID NO: 216606 - DNA, 20 bp, human
ggggaccccagtggccagga

SEQ ID NO: 216607 - DNA, 20 bp, human
ggaggcaaaactgttgttta

SEQ ID NO: 216608 - DNA, 20 bp, human
gttagggtgggtggttgatt

SEQ ID NO: 216609 - DNA, 20 bp, human
gtcactcagctcagagttcc

SEQ ID NO: 216610 - DNA, 20 bp, human
gaactgttgtttagggtggg

SEQ ID NO: 216611 - DNA, 20 bp, human
ggcaaaactgttgtttaggg

SEQ ID NO: 216612 - DNA, 20 bp, human
ggctcagagttccgggaagt

SEQ ID NO: 216613 - DNA, 20 bp, human
gacagttttgcctcccctcc

SEQ ID NO: 216614 - DNA, 20 bp, human
gccccagtggccaggagggg

SEQ ID NO: 216615 - DNA, 20 bp, human
gcactggggtccccacttcc

SEQ ID NO: 216616 - DNA, 20 bp, human
ggccctggctgaggcgtccc

SEQ ID NO: 216617 - DNA, 20 bp, human
ggctgcgcgtgctcgctccg

SEQ ID NO: 216618 - DNA, 20 bp, human
gcagcctcaggcgcacacgg

SEQ ID NO: 216619 - DNA, 20 bp, human
gttggctgcggtcttgaaac

SEQ ID NO: 216620 - DNA, 20 bp, human
ggaccgcagccaacagcctc

SEQ ID NO: 216621 - DNA, 20 bp, human
ggccagggccgaccgcgcag

SEQ ID NO: 216622 - DNA, 20 bp, human
gcaacagcctcaggcgcaca

SEQ ID NO: 216623 - DNA, 20 bp, human
gcccaggaggagccggtacc

SEQ ID NO: 216624 - DNA, 20 bp, human
gagggtcacaggtcacgggg

SEQ ID NO: 216625 - DNA, 20 bp, human
gagcgcccgcagcccggtac

SEQ ID NO: 216626 - DNA, 20 bp, human
ggcgcccgcgggttcgtctc

SEQ ID NO: 216627 - DNA, 20 bp, human
ggagccagagacgaacccgc

SEQ ID NO: 216628 - DNA, 20 bp, human
gcaagcccacggcccgctgg

SEQ ID NO: 216629 - DNA, 20 bp, human
gggcacccccagcgggccgt

SEQ ID NO: 216630 - DNA, 20 bp, human
gcaggctttacaggagacgc

SEQ ID NO: 216631 - DNA, 20 bp, human
gcgcgggacggcacccccag

SEQ ID NO: 216632 - DNA, 20 bp, human
gaaactcagctgacgcttgg

SEQ ID NO: 216633 - DNA, 20 bp, human
gtaattgccggggaagataa

SEQ ID NO: 216634 - DNA, 20 bp, human
gcgcccgctgcccggcttct

SEQ ID NO: 216635 - DNA, 20 bp, human
gggggaggaagcggcttcat

SEQ ID NO: 216636 - DNA, 20 bp, human
ggggacctgcgcgtggaaac

SEQ ID NO: 216637 - DNA, 20 bp, human
gcgtggaaacaggttttccc

SEQ ID NO: 216638 - DNA, 20 bp, human
gtcgtcacacgggaaggcct

SEQ ID NO: 216639 - DNA, 20 bp, human
gccagatcccgcagctgaga

SEQ ID NO: 216640 - DNA, 20 bp, human
gccttcccgtgtgacgacct

SEQ ID NO: 216641 - DNA, 20 bp, human
gcgcccggtcaatcgtaact

SEQ ID NO: 216642 - DNA, 20 bp, human
gttccacgcgcaggtcccgg

SEQ ID NO: 216643 - DNA, 20 bp, human
gcgagagccaggagatgacg

SEQ ID NO: 216644 - DNA, 20 bp, human
ggatcccgcagctgagaggg

SEQ ID NO: 216645 - DNA, 20 bp, human
gaaacccagttacgattgac

SEQ ID NO: 216646 - DNA, 20 bp, human
ggcaccctgtgtaacagcac

SEQ ID NO: 216647 - DNA, 20 bp, human
gggcagagagcacttgcaca

SEQ ID NO: 216648 - DNA, 20 bp, human
gattgcctgtgctgttacac

SEQ ID NO: 216649 - DNA, 20 bp, human
gaatatgatcatatccaacc

SEQ ID NO: 216650 - DNA, 20 bp, human
gtccccccacatcgcagcat

SEQ ID NO: 216651 - DNA, 20 bp, human
gcccacgtctaccaaaccag

SEQ ID NO: 216652 - DNA, 20 bp, human
gtcccccatgctgcgatgtg

SEQ ID NO: 216653 - DNA, 20 bp, human
gaggaaactgaccactggtt

SEQ ID NO: 216654 - DNA, 20 bp, human
gggtttggtagacgtgggcg

SEQ ID NO: 216655 - DNA, 20 bp, human
gacctaaggaaactgaccac

SEQ ID NO: 216656 - DNA, 20 bp, human
gaagaaaggctgtaggtatt

SEQ ID NO: 216657 - DNA, 20 bp, human
gacctctctctcccatggga

SEQ ID NO: 216658 - DNA, 20 bp, human
ggcgggctgcagattagcaa

SEQ ID NO: 216659 - DNA, 20 bp, human
ggacgctgaatgttcttatc

SEQ ID NO: 216660 - DNA, 20 bp, human
ggccctcccatgggagagag

SEQ ID NO: 216661 - DNA, 20 bp, human
gcaaagtgtggggtataatt

SEQ ID NO: 216662 - DNA, 20 bp, human
gtcgaggcagctgccaaaag

SEQ ID NO: 216663 - DNA, 20 bp, human
gcgtcagcaagaaaggctgt

SEQ ID NO: 216664 - DNA, 20 bp, human
gaacacaagggacatcaaat

SEQ ID NO: 216665 - DNA, 20 bp, human
gcaactcctactacacaccc

SEQ ID NO: 216666 - DNA, 20 bp, human
gggccgcgttgctccctctt

SEQ ID NO: 216667 - DNA, 20 bp, human
gactaactccacaggtgccc

SEQ ID NO: 216668 - DNA, 20 bp, human
gtagcactgctgctcccaag

SEQ ID NO: 216669 - DNA, 20 bp, human
gatgtcatagatcctgatcc

SEQ ID NO: 216670 - DNA, 20 bp, human
gtaagtagaagaatttgtcg

SEQ ID NO: 216671 - DNA, 20 bp, human
gttgcagagcaaaatctgcg

SEQ ID NO: 216672 - DNA, 20 bp, human
gcggccctctgtccctcgta

SEQ ID NO: 216673 - DNA, 20 bp, human
gaagccctacgagggacaga

SEQ ID NO: 216674 - DNA, 20 bp, human
gtgtgcttcaaaaagcaagc

SEQ ID NO: 216675 - DNA, 20 bp, human
gcaagctggacaagaaccga

SEQ ID NO: 216676 - DNA, 20 bp, human
gtttctgagtaagacaacac

SEQ ID NO: 216677 - DNA, 20 bp, human
gaaaaactaatgttctatac

SEQ ID NO: 216678 - DNA, 20 bp, human
gaaatgctttcaggagctgc

SEQ ID NO: 216679 - DNA, 20 bp, human
gtggtccatggccaggggat

SEQ ID NO: 216680 - DNA, 20 bp, human
gcaggcagtgatgcaagcaa

SEQ ID NO: 216681 - DNA, 20 bp, human
gccgtagcctgttagcaacc

SEQ ID NO: 216682 - DNA, 20 bp, human
gatgctgctaccgatctgac

SEQ ID NO: 216683 - DNA, 20 bp, human
gaatgttaattgatagtgcc

SEQ ID NO: 216684 - DNA, 20 bp, human
gtgatgcaagcaatggggag

SEQ ID NO: 216685 - DNA, 20 bp, human
gaccggggtccccaatcccc

SEQ ID NO: 216686 - DNA, 20 bp, human
gcccgcccctgaccgggatg

SEQ ID NO: 216687 - DNA, 20 bp, human
gcgatggaacagctccagaa

SEQ ID NO: 216688 - DNA, 20 bp, human
gccagggctggcactcagag

SEQ ID NO: 216689 - DNA, 20 bp, human
gggggctgcttggaattcga

SEQ ID NO: 216690 - DNA, 20 bp, human
gcgggaagccccggccctct

SEQ ID NO: 216691 - DNA, 20 bp, human
gtccccatcccggtcagggg

SEQ ID NO: 216692 - DNA, 20 bp, human
gagggccggggcttcccgcc

SEQ ID NO: 216693 - DNA, 20 bp, human
gccggggcttcccgcccggg

SEQ ID NO: 216694 - DNA, 20 bp, human
gacgcgttgaggctcatctc

SEQ ID NO: 216695 - DNA, 20 bp, human
gagaatgacccggttggact

SEQ ID NO: 216696 - DNA, 20 bp, human
gcggcggcgcgaatggggaa

SEQ ID NO: 216697 - DNA, 20 bp, human
gggcaggaggcgacactctt

SEQ ID NO: 216698 - DNA, 20 bp, human
gaggtggatggccaaggcag

SEQ ID NO: 216699 - DNA, 20 bp, human
ggggaggaggcaaaagaact

SEQ ID NO: 216700 - DNA, 20 bp, human
gggatcccccggaatcccgc

SEQ ID NO: 216701 - DNA, 20 bp, human
gccccaccccctcttcccgg

SEQ ID NO: 216702 - DNA, 20 bp, human
gccagcccagcgggattccg

SEQ ID NO: 216703 - DNA, 20 bp, human
gggggaaaaggactgtttag

SEQ ID NO: 216704 - DNA, 20 bp, human
gaggcgacactcttgggacg

SEQ ID NO: 216705 - DNA, 20 bp, human
ggtagcccaggcggatcccc

SEQ ID NO: 216706 - DNA, 20 bp, human
gagtcacgtgaatgagtcct

SEQ ID NO: 216707 - DNA, 20 bp, human
gtcctcttctacaaacgccg

SEQ ID NO: 216708 - DNA, 20 bp, human
gcgtgaatgagtcctgggaa

SEQ ID NO: 216709 - DNA, 20 bp, human
gtcacgtgactggaagtggc

SEQ ID NO: 216710 - DNA, 20 bp, human
gttcggcgagagcgtgaact

SEQ ID NO: 216711 - DNA, 20 bp, human
ggaactgggcggcgatgagg

SEQ ID NO: 216712 - DNA, 20 bp, human
gagaaagaaaggatcggggc

SEQ ID NO: 216713 - DNA, 20 bp, human
ggagcgcatgcgcctttccc

SEQ ID NO: 216714 - DNA, 20 bp, human
ggggcctagtaagaagtttc

SEQ ID NO: 216715 - DNA, 20 bp, human
gtgcgcgctctccgcctgat

SEQ ID NO: 216716 - DNA, 20 bp, human
gacactgggcaggtcagact

SEQ ID NO: 216717 - DNA, 20 bp, human
gtatttctggatgtctcctc

SEQ ID NO: 216718 - DNA, 20 bp, human
gtgtgtgggggaggttcaag

SEQ ID NO: 216719 - DNA, 20 bp, human
gtcctcccttagaagaacac

SEQ ID NO: 216720 - DNA, 20 bp, human
gcataagacaatatgaggta

SEQ ID NO: 216721 - DNA, 20 bp, human
gcccagtgttcttctaaggg

SEQ ID NO: 216722 - DNA, 20 bp, human
gacacgcccccatctatttc

SEQ ID NO: 216723 - DNA, 20 bp, human
ggggggaggttcaaggggtg

SEQ ID NO: 216724 - DNA, 20 bp, human
gggatgtctcctcagggctc

SEQ ID NO: 216725 - DNA, 20 bp, human
gctccaaagtaaacactaaa

SEQ ID NO: 216726 - DNA, 20 bp, human
gcagaactgaatgtgctgtg

SEQ ID NO: 216727 - DNA, 20 bp, human
ggttctgagcccacagttct

SEQ ID NO: 216728 - DNA, 20 bp, human
ggattccaaggcatagtgtg

SEQ ID NO: 216729 - DNA, 20 bp, human
gtggctaaagggaattgcta

SEQ ID NO: 216730 - DNA, 20 bp, human
gtgagagaagcccagaactg

SEQ ID NO: 216731 - DNA, 20 bp, human
gtccaaggcatagtgtgggg

SEQ ID NO: 216732 - DNA, 20 bp, human
ggcccccccacactatgcct

SEQ ID NO: 216733 - DNA, 20 bp, human
ggtgtcaaaggattaggaat

SEQ ID NO: 216734 - DNA, 20 bp, human
gtaagtgattcacataacta

SEQ ID NO: 216735 - DNA, 20 bp, human
gccactgccaagctactgct

SEQ ID NO: 216736 - DNA, 20 bp, human
gagcgcacacgcatgaggga

SEQ ID NO: 216737 - DNA, 20 bp, human
gctcagacggggagcgtcgc

SEQ ID NO: 216738 - DNA, 20 bp, human
gagtaagcgcacacgcatga

SEQ ID NO: 216739 - DNA, 20 bp, human
ggacgctccccgtctgagca

SEQ ID NO: 216740 - DNA, 20 bp, human
gagttggatagggtctgtaa

SEQ ID NO: 216741 - DNA, 20 bp, human
gggagctggctcggcaggtc

SEQ ID NO: 216742 - DNA, 20 bp, human
ggctcggcaggtctggaagt

SEQ ID NO: 216743 - DNA, 20 bp, human
ggcaggtctggaagttggat

SEQ ID NO: 216744 - DNA, 20 bp, human
ggctgaggtcgctgcgtgtg

SEQ ID NO: 216745 - DNA, 20 bp, human
gtctcaccgcacacttgcag

SEQ ID NO: 216746 - DNA, 20 bp, human
gcgccaccctgggtgtctat

SEQ ID NO: 216747 - DNA, 20 bp, human
ggctgggaacgcgccaccct

SEQ ID NO: 216748 - DNA, 20 bp, human
gtgggcagggcctatcagca

SEQ ID NO: 216749 - DNA, 20 bp, human
gctctgtgaacgcccgtcct

SEQ ID NO: 216750 - DNA, 20 bp, human
gaagattggcatgcgcaggg

SEQ ID NO: 216751 - DNA, 20 bp, human
gtagcattatctggagcccc

SEQ ID NO: 216752 - DNA, 20 bp, human
ggataagattggcatgcgca

SEQ ID NO: 216753 - DNA, 20 bp, human
gctcatctggccctgctgat

SEQ ID NO: 216754 - DNA, 20 bp, human
gctggaactgtgcggacaga

SEQ ID NO: 216755 - DNA, 20 bp, human
gctggattggagagtttcaa

SEQ ID NO: 216756 - DNA, 20 bp, human
gaggacccacttgaaggctg

SEQ ID NO: 216757 - DNA, 20 bp, human
ggcttccgcagccttcaagt

SEQ ID NO: 216758 - DNA, 20 bp, human
gtggctccgcctgagagggg

SEQ ID NO: 216759 - DNA, 20 bp, human
gctcaggcggagccaaactg

SEQ ID NO: 216760 - DNA, 20 bp, human
gggagtccggctgaaagcaa

SEQ ID NO: 216761 - DNA, 20 bp, human
gtgcggaagccgccagcggg

SEQ ID NO: 216762 - DNA, 20 bp, human
gcaagtgggtcctccgcccc

SEQ ID NO: 216763 - DNA, 20 bp, human
gcggactccggactcctccg

SEQ ID NO: 216764 - DNA, 20 bp, human
ggggcgggcaataaactccc

SEQ ID NO: 216765 - DNA, 20 bp, human
gggcctgcggggtctttctg

SEQ ID NO: 216766 - DNA, 20 bp, human
gggacctagccaagctaggg

SEQ ID NO: 216767 - DNA, 20 bp, human
ggggaggggcccctcggata

SEQ ID NO: 216768 - DNA, 20 bp, human
gggagagtagagaactcgag

SEQ ID NO: 216769 - DNA, 20 bp, human
gaggtcccccgaggttggga

SEQ ID NO: 216770 - DNA, 20 bp, human
gagcttggctaggtcccccg

SEQ ID NO: 216771 - DNA, 20 bp, human
gtagccaagctaggggggac

SEQ ID NO: 216772 - DNA, 20 bp, human
gaggggggtagatgctggga

SEQ ID NO: 216773 - DNA, 20 bp, human
gggtaagccggtccctgcgt

SEQ ID NO: 216774 - DNA, 20 bp, human
gtggctaggtcccccgaggt

SEQ ID NO: 216775 - DNA, 20 bp, human
ggtggagaggcacggaaacc

SEQ ID NO: 216776 - DNA, 20 bp, human
gtgactggtgagggagagca

SEQ ID NO: 216777 - DNA, 20 bp, human
ggcagcggttaggtgtggga

SEQ ID NO: 216778 - DNA, 20 bp, human
gaaggcggcttgactggtga

SEQ ID NO: 216779 - DNA, 20 bp, human
gttgggcagcggttaggtgt

SEQ ID NO: 216780 - DNA, 20 bp, human
gagggagggaccaggtgaat

SEQ ID NO: 216781 - DNA, 20 bp, human
gtgtgggagggaaaatggtc

SEQ ID NO: 216782 - DNA, 20 bp, human
gacctggtactgaggaaagg

SEQ ID NO: 216783 - DNA, 20 bp, human
gtgcctcaacaggagggtgg

SEQ ID NO: 216784 - DNA, 20 bp, human
gtgactcctacctggtactg

SEQ ID NO: 216785 - DNA, 20 bp, human
gggagcgggacttctctgaa

SEQ ID NO: 216786 - DNA, 20 bp, human
ggggagaagcattgtgtgct

SEQ ID NO: 216787 - DNA, 20 bp, human
ggggaatggtagtcccagct

SEQ ID NO: 216788 - DNA, 20 bp, human
gggcaggtggaccgtggcaa

SEQ ID NO: 216789 - DNA, 20 bp, human
gcagcccggggccgccttgc

SEQ ID NO: 216790 - DNA, 20 bp, human
gcctccccgcctctaaccta

SEQ ID NO: 216791 - DNA, 20 bp, human
gcctgcccgccgtaggttag

SEQ ID NO: 216792 - DNA, 20 bp, human
gtggcaagggggcgggacaa

SEQ ID NO: 216793 - DNA, 20 bp, human
gcatgcgccttgagggaaga

SEQ ID NO: 216794 - DNA, 20 bp, human
gtgcgccgcgcgggcttatt

SEQ ID NO: 216795 - DNA, 20 bp, human
gcgtagtcccggcaccggca

SEQ ID NO: 216796 - DNA, 20 bp, human
gtccaggccggcagtgggtg

SEQ ID NO: 216797 - DNA, 20 bp, human
gcccgccccctgtctctggg

SEQ ID NO: 216798 - DNA, 20 bp, human
gcccgccccccagagacagg

SEQ ID NO: 216799 - DNA, 20 bp, human
gacacccctgccgcagggag

SEQ ID NO: 216800 - DNA, 20 bp, human
gggtcccgccccccagagac

SEQ ID NO: 216801 - DNA, 20 bp, human
gcagaagtccaggccggcag

SEQ ID NO: 216802 - DNA, 20 bp, human
ggaagtgtggtcataaaccg

SEQ ID NO: 216803 - DNA, 20 bp, human
gggcgagcagccaatcgggc

SEQ ID NO: 216804 - DNA, 20 bp, human
gtccttcccaggcctcggtt

SEQ ID NO: 216805 - DNA, 20 bp, human
ggactcgctccccgcggggg

SEQ ID NO: 216806 - DNA, 20 bp, human
gggccgcggcccctccgcga

SEQ ID NO: 216807 - DNA, 20 bp, human
ggctacgcggccagagtccg

SEQ ID NO: 216808 - DNA, 20 bp, human
gctcggggctggatggtcgg

SEQ ID NO: 216809 - DNA, 20 bp, human
gcctgcccgaacctctgcgg

SEQ ID NO: 216810 - DNA, 20 bp, human
ggcacctgcccgaacctctg

SEQ ID NO: 216811 - DNA, 20 bp, human
gcggatgaccggccccctcg

SEQ ID NO: 216812 - DNA, 20 bp, human
gggcggatgcgcggagatga

SEQ ID NO: 216813 - DNA, 20 bp, human
ggcaaccggcgccgattggg

SEQ ID NO: 216814 - DNA, 20 bp, human
gtgacagcaaattttcccat

SEQ ID NO: 216815 - DNA, 20 bp, human
gagggggccggtcatccgcc

SEQ ID NO: 216816 - DNA, 20 bp, human
gctgagaggcgccctctgat

SEQ ID NO: 216817 - DNA, 20 bp, human
gattccagaggggcaggcgg

SEQ ID NO: 216818 - DNA, 20 bp, human
gaggtcctcgggttggtgga

SEQ ID NO: 216819 - DNA, 20 bp, human
gctggcgagagccaatcaga

SEQ ID NO: 216820 - DNA, 20 bp, human
gtccagggagcgaggtcctc

SEQ ID NO: 216821 - DNA, 20 bp, human
gccgggctgcgtcggcctgt

SEQ ID NO: 216822 - DNA, 20 bp, human
gcgcggcgcaaagcccggac

SEQ ID NO: 216823 - DNA, 20 bp, human
gagctgcaggaagaggatag

SEQ ID NO: 216824 - DNA, 20 bp, human
gggcgcctctcagcacgtgg

SEQ ID NO: 216825 - DNA, 20 bp, human
gctgcgtcggcctgtgggcg

SEQ ID NO: 216826 - DNA, 20 bp, human
ggagccccggcgctgtcctg

SEQ ID NO: 216827 - DNA, 20 bp, human
gcggctgcgggtggtggcac

SEQ ID NO: 216828 - DNA, 20 bp, human
gcgggcggcggcggcacgaa

SEQ ID NO: 216829 - DNA, 20 bp, human
gggggagctgtcacccaagg

SEQ ID NO: 216830 - DNA, 20 bp, human
ggacgcccgcgcgctgctca

SEQ ID NO: 216831 - DNA, 20 bp, human
gcgcagccggggcgctgccc

SEQ ID NO: 216832 - DNA, 20 bp, human
ggctgcggccacggcgccag

SEQ ID NO: 216833 - DNA, 20 bp, human
gctcgcggtacgacttgctg

SEQ ID NO: 216834 - DNA, 20 bp, human
gggctccttgagcagcgcgc

SEQ ID NO: 216835 - DNA, 20 bp, human
gccggggggcgtcacgcacc

SEQ ID NO: 216836 - DNA, 20 bp, human
gtcgcagtggagcgaacaag

SEQ ID NO: 216837 - DNA, 20 bp, human
gcgaggggctagagcgggat

SEQ ID NO: 216838 - DNA, 20 bp, human
ggcggtgggcgcctgagcga

SEQ ID NO: 216839 - DNA, 20 bp, human
ggatgctgataccgacctcc

SEQ ID NO: 216840 - DNA, 20 bp, human
ggaacagcgggtcaggcggt

SEQ ID NO: 216841 - DNA, 20 bp, human
ggacagtggaacagcgggtc

SEQ ID NO: 216842 - DNA, 20 bp, human
gagagcagcgcggatgacag

SEQ ID NO: 216843 - DNA, 20 bp, human
ggggctagagcgggatgggc

SEQ ID NO: 216844 - DNA, 20 bp, human
gtacaggctttccaaccagg

SEQ ID NO: 216845 - DNA, 20 bp, human
ggaaagcctgtagagcagcg

SEQ ID NO: 216846 - DNA, 20 bp, human
gcacccgtggcgcctcgatg

SEQ ID NO: 216847 - DNA, 20 bp, human
ggggccgggagcttcacccg

SEQ ID NO: 216848 - DNA, 20 bp, human
gggagccccgccccgtaggt

SEQ ID NO: 216849 - DNA, 20 bp, human
ggacgcgagtagctcggcag

SEQ ID NO: 216850 - DNA, 20 bp, human
gggcaatagtcggaccgagc

SEQ ID NO: 216851 - DNA, 20 bp, human
gtagggggaacgctcggagg

SEQ ID NO: 216852 - DNA, 20 bp, human
gccaggaagtgcaacccaga

SEQ ID NO: 216853 - DNA, 20 bp, human
gaccctgaggcgtatgttct

SEQ ID NO: 216854 - DNA, 20 bp, human
gccccaccgcgggcaatagt

SEQ ID NO: 216855 - DNA, 20 bp, human
ggctcccggccccacctacg

SEQ ID NO: 216856 - DNA, 20 bp, human
ggattggtcttgtctgccat

SEQ ID NO: 216857 - DNA, 20 bp, human
ggcttggtctatggaatgag

SEQ ID NO: 216858 - DNA, 20 bp, human
ggccaatgctaaatcatgaa

SEQ ID NO: 216859 - DNA, 20 bp, human
ggctctgtacttgtcgttct

SEQ ID NO: 216860 - DNA, 20 bp, human
gtggatctgtacatgggtct

SEQ ID NO: 216861 - DNA, 20 bp, human
gaagcagtgtgatatggctg

SEQ ID NO: 216862 - DNA, 20 bp, human
ggggttaggacagtactctg

SEQ ID NO: 216863 - DNA, 20 bp, human
gttagctcagttgagctcag

SEQ ID NO: 216864 - DNA, 20 bp, human
gatgaatggttgctgccagg

SEQ ID NO: 216865 - DNA, 20 bp, human
gagctaagatatcttaacct

SEQ ID NO: 216866 - DNA, 20 bp, human
gtcgcggaggactaaggcga

SEQ ID NO: 216867 - DNA, 20 bp, human
gtagtcctccgcgaaggcca

SEQ ID NO: 216868 - DNA, 20 bp, human
gcggaggactaaggcgaggg

SEQ ID NO: 216869 - DNA, 20 bp, human
ggctgccctggccttcgcgg

SEQ ID NO: 216870 - DNA, 20 bp, human
gctagtcaacagctgtgtgc

SEQ ID NO: 216871 - DNA, 20 bp, human
gtcaccgtgcccgggacaaa

SEQ ID NO: 216872 - DNA, 20 bp, human
gtccgctgcctcaactcccg

SEQ ID NO: 216873 - DNA, 20 bp, human
ggcccgggacaaatggacta

SEQ ID NO: 216874 - DNA, 20 bp, human
gcccccgcccaccgtctcgc

SEQ ID NO: 216875 - DNA, 20 bp, human
gcaccgcaccaactaatccg

SEQ ID NO: 216876 - DNA, 20 bp, human
gggcccgccggcagccacga

SEQ ID NO: 216877 - DNA, 20 bp, human
ggggccgggaatgcttagtc

SEQ ID NO: 216878 - DNA, 20 bp, human
gcgaccccggccgaggtctg

SEQ ID NO: 216879 - DNA, 20 bp, human
gggcatggggcggaaggcga

SEQ ID NO: 216880 - DNA, 20 bp, human
ggcacgatcccgctcggcgg

SEQ ID NO: 216881 - DNA, 20 bp, human
gctcgcacgatcccgctcgg

SEQ ID NO: 216882 - DNA, 20 bp, human
gccgccggcagccacgaggg

SEQ ID NO: 216883 - DNA, 20 bp, human
gtccccgcctgaggtggaag

SEQ ID NO: 216884 - DNA, 20 bp, human
gtgggaggggccccagacct

SEQ ID NO: 216885 - DNA, 20 bp, human
gccccggcgcggagcggctc

SEQ ID NO: 216886 - DNA, 20 bp, human
ggcggccaggaacggctcgg

SEQ ID NO: 216887 - DNA, 20 bp, human
gaccctgcggggaccacagc

SEQ ID NO: 216888 - DNA, 20 bp, human
gggagcgcatcctccggcag

SEQ ID NO: 216889 - DNA, 20 bp, human
gccgacgcctcccgcggaga

SEQ ID NO: 216890 - DNA, 20 bp, human
gccggcccatgaggaaagcg

SEQ ID NO: 216891 - DNA, 20 bp, human
gggtgcgccccgccggagtc

SEQ ID NO: 216892 - DNA, 20 bp, human
gtccgacccgctgcccgcga

SEQ ID NO: 216893 - DNA, 20 bp, human
ggggctccccacttgaacgg

SEQ ID NO: 216894 - DNA, 20 bp, human
gcctccacacgcaccctcgc

SEQ ID NO: 216895 - DNA, 20 bp, human
gccggaacgccgagacaatg

SEQ ID NO: 216896 - DNA, 20 bp, human
gagagcggctggagggtcgg

SEQ ID NO: 216897 - DNA, 20 bp, human
gggagcctggaccttggcgg

SEQ ID NO: 216898 - DNA, 20 bp, human
ggccggagcctggaccttgg

SEQ ID NO: 216899 - DNA, 20 bp, human
ggcggggtctgaggcggtga

SEQ ID NO: 216900 - DNA, 20 bp, human
gtggcctagggggccggcga

SEQ ID NO: 216901 - DNA, 20 bp, human
gtgggcgtacgcagcaaagg

SEQ ID NO: 216902 - DNA, 20 bp, human
ggaagcggcctgacgcggtg

SEQ ID NO: 216903 - DNA, 20 bp, human
gaaggtccaggctccggccc

SEQ ID NO: 216904 - DNA, 20 bp, human
gccagctgaggagcggagag

SEQ ID NO: 216905 - DNA, 20 bp, human
gacagagccctgaaggggca

SEQ ID NO: 216906 - DNA, 20 bp, human
gtcgctgtctagcagggcgc

SEQ ID NO: 216907 - DNA, 20 bp, human
gtagacagcgaggccggaag

SEQ ID NO: 216908 - DNA, 20 bp, human
ggcggccccggaaaccagtg

SEQ ID NO: 216909 - DNA, 20 bp, human
gccctgctagacagcgaggc

SEQ ID NO: 216910 - DNA, 20 bp, human
gccggcctcactggtttccg

SEQ ID NO: 216911 - DNA, 20 bp, human
gttagccgcgaagttcccgc

SEQ ID NO: 216912 - DNA, 20 bp, human
gtcgcggctaaccgactctc

SEQ ID NO: 216913 - DNA, 20 bp, human
ggtccccacccacacggacg

SEQ ID NO: 216914 - DNA, 20 bp, human
gtcgtccggcgggaacttcg

SEQ ID NO: 216915 - DNA, 20 bp, human
gtccggcctcgctgtctagc

SEQ ID NO: 216916 - DNA, 20 bp, human
gagccctggggtgaagctca

SEQ ID NO: 216917 - DNA, 20 bp, human
gaaccctgagcttcacccca

SEQ ID NO: 216918 - DNA, 20 bp, human
gaggccgggtgggggaatta

SEQ ID NO: 216919 - DNA, 20 bp, human
ggggtgaagctcagggttgg

SEQ ID NO: 216920 - DNA, 20 bp, human
gactggcccagctgtcagtc

SEQ ID NO: 216921 - DNA, 20 bp, human
gggggtgcctcacacagcga

SEQ ID NO: 216922 - DNA, 20 bp, human
ggtgtgaggcacccctcagg

SEQ ID NO: 216923 - DNA, 20 bp, human
gcgcaggggagcacaacatc

SEQ ID NO: 216924 - DNA, 20 bp, human
gacccggcctgactgacagc

SEQ ID NO: 216925 - DNA, 20 bp, human
gccgtcatctcggcattaaa

SEQ ID NO: 216926 - DNA, 20 bp, human
gtagaactattggatgtttc

SEQ ID NO: 216927 - DNA, 20 bp, human
gctacagagatctcggtaac

SEQ ID NO: 216928 - DNA, 20 bp, human
gtatgtagttctagaactat

SEQ ID NO: 216929 - DNA, 20 bp, human
gagtttatttaacactgctg

SEQ ID NO: 216930 - DNA, 20 bp, human
gataacttgctttgtttctg

SEQ ID NO: 216931 - DNA, 20 bp, human
gttatgttagaaagcagggt

SEQ ID NO: 216932 - DNA, 20 bp, human
gttagaacctacagagatct

SEQ ID NO: 216933 - DNA, 20 bp, human
gctgctttctaacataaaat

SEQ ID NO: 216934 - DNA, 20 bp, human
gatatgctgtatgttctaag

SEQ ID NO: 216935 - DNA, 20 bp, human
gagtgggaaatactactccc

SEQ ID NO: 216936 - DNA, 20 bp, human
ggacaatcccaggagtgaca

SEQ ID NO: 216937 - DNA, 20 bp, human
gcaaacactaaaaatacacg

SEQ ID NO: 216938 - DNA, 20 bp, human
gtctattaagtgacaatccc

SEQ ID NO: 216939 - DNA, 20 bp, human
ggcatgctaccatataaaat

SEQ ID NO: 216940 - DNA, 20 bp, human
gataaagaatgatgtaatcc

SEQ ID NO: 216941 - DNA, 20 bp, human
gaaccagactaaattctctc

SEQ ID NO: 216942 - DNA, 20 bp, human
gaacatgaaatgccaagatt

SEQ ID NO: 216943 - DNA, 20 bp, human
gttttgctgtcatttgcaac

SEQ ID NO: 216944 - DNA, 20 bp, human
gttaaccacttgtcactgtc

SEQ ID NO: 216945 - DNA, 20 bp, human
ggtatttttagtgtttgcag

SEQ ID NO: 216946 - DNA, 20 bp, human
ggggagggatataggaggat

SEQ ID NO: 216947 - DNA, 20 bp, human
gcaggtgcctggtgaggcta

SEQ ID NO: 216948 - DNA, 20 bp, human
gtggcagggagggatatagg

SEQ ID NO: 216949 - DNA, 20 bp, human
ggactgactgacagatagac

SEQ ID NO: 216950 - DNA, 20 bp, human
gtccctccctgccactcaaa

SEQ ID NO: 216951 - DNA, 20 bp, human
gtgccccctggtggaggtgt

SEQ ID NO: 216952 - DNA, 20 bp, human
gaccctgtctcccatttgag

SEQ ID NO: 216953 - DNA, 20 bp, human
gtgacagatagacaggtgcc

SEQ ID NO: 216954 - DNA, 20 bp, human
gaacacggcctgggaagagg

SEQ ID NO: 216955 - DNA, 20 bp, human
gggatataggaggataggct

SEQ ID NO: 216956 - DNA, 20 bp, human
gacactgccaaaacaggtca

SEQ ID NO: 216957 - DNA, 20 bp, human
gtcaaggagcgtgcatggtc

SEQ ID NO: 216958 - DNA, 20 bp, human
gcaaggaaatgccagatctg

SEQ ID NO: 216959 - DNA, 20 bp, human
gcatcaggctactcattcat

SEQ ID NO: 216960 - DNA, 20 bp, human
gagcctgatggtgaaatgga

SEQ ID NO: 216961 - DNA, 20 bp, human
gctagacgtaggagtttgag

SEQ ID NO: 216962 - DNA, 20 bp, human
ggagtagcctgatggtgaaa

SEQ ID NO: 216963 - DNA, 20 bp, human
gacgtaggagtttgaggggt

SEQ ID NO: 216964 - DNA, 20 bp, human
ggcatggtcaggcttttgat

SEQ ID NO: 216965 - DNA, 20 bp, human
gccctagtagggctatatca

SEQ ID NO: 216966 - DNA, 20 bp, human
ggggaacctcgccaaggcgg

SEQ ID NO: 216967 - DNA, 20 bp, human
gtcccggaggcgctgtccct

SEQ ID NO: 216968 - DNA, 20 bp, human
ggaggcgctgtccctgggtc

SEQ ID NO: 216969 - DNA, 20 bp, human
gtgggccgcgcgtcgtcccg

SEQ ID NO: 216970 - DNA, 20 bp, human
gtccgggaacctcgccaagg

SEQ ID NO: 216971 - DNA, 20 bp, human
gcgtcccgaggcgaccgagc

SEQ ID NO: 216972 - DNA, 20 bp, human
gggaactacaactcccggct

SEQ ID NO: 216973 - DNA, 20 bp, human
gctcccggctcggtcgcctc

SEQ ID NO: 216974 - DNA, 20 bp, human
gcccgtgcacagaatacgtc

SEQ ID NO: 216975 - DNA, 20 bp, human
gcacacactcctcggcgcga

SEQ ID NO: 216976 - DNA, 20 bp, human
gtaatggaatggtcactaca

SEQ ID NO: 216977 - DNA, 20 bp, human
ggggtcagagcaaaatgttt

SEQ ID NO: 216978 - DNA, 20 bp, human
gagtgtccttggaatcctaa

SEQ ID NO: 216979 - DNA, 20 bp, human
ggccacagttctgtaaccca

SEQ ID NO: 216980 - DNA, 20 bp, human
gtctccttgttttttacatg

SEQ ID NO: 216981 - DNA, 20 bp, human
gaatggtcactacaggggag

SEQ ID NO: 216982 - DNA, 20 bp, human
gtacattgggacagtcactt

SEQ ID NO: 216983 - DNA, 20 bp, human
gctacattcatcaaatttaa

SEQ ID NO: 216984 - DNA, 20 bp, human
gaattgattgtggtttgcag

SEQ ID NO: 216985 - DNA, 20 bp, human
ggacagtcactttggataat

SEQ ID NO: 216986 - DNA, 20 bp, human
gagattatctctgtcctgat

SEQ ID NO: 216987 - DNA, 20 bp, human
gaatcttattatacctctgt

SEQ ID NO: 216988 - DNA, 20 bp, human
ggacctgccaattcagctgc

SEQ ID NO: 216989 - DNA, 20 bp, human
gcagggagtgttgctactga

SEQ ID NO: 216990 - DNA, 20 bp, human
gaagaaacgcaagcctacag

SEQ ID NO: 216991 - DNA, 20 bp, human
gctgaaacataagcggtctc

SEQ ID NO: 216992 - DNA, 20 bp, human
gataagcggtctctggcaca

SEQ ID NO: 216993 - DNA, 20 bp, human
gggaacaaaaccaaaccact

SEQ ID NO: 216994 - DNA, 20 bp, human
gtgatatacagacggagata

SEQ ID NO: 216995 - DNA, 20 bp, human
gagagttctttgaaccaatc

SEQ ID NO: 216996 - DNA, 20 bp, human
gaaggtggatgcagatgctg

SEQ ID NO: 216997 - DNA, 20 bp, human
gtgcagatgctggggttcgg

SEQ ID NO: 216998 - DNA, 20 bp, human
gaaccaaagggtatcggcag

SEQ ID NO: 216999 - DNA, 20 bp, human
gggcctgctgaccaaccaaa

SEQ ID NO: 217000 - DNA, 20 bp, human
gcgggggtggcctcagctga

SEQ ID NO: 217001 - DNA, 20 bp, human
gatgctcgctctagagatga

SEQ ID NO: 217002 - DNA, 20 bp, human
gtctctagagcgagcatctt

SEQ ID NO: 217003 - DNA, 20 bp, human
gtgcccctgccgataccctt

SEQ ID NO: 217004 - DNA, 20 bp, human
gctcgctctagagatgaagg

SEQ ID NO: 217005 - DNA, 20 bp, human
gcctccagccaacatcagag

SEQ ID NO: 217006 - DNA, 20 bp, human
ggtcaccagcataggtcaga

SEQ ID NO: 217007 - DNA, 20 bp, human
gaggggatattgtatgtaac

SEQ ID NO: 217008 - DNA, 20 bp, human
gaggtagaggtcaccagcat

SEQ ID NO: 217009 - DNA, 20 bp, human
gtatcccctctgacctatgc

SEQ ID NO: 217010 - DNA, 20 bp, human
gcagttcaaggtagtctgcc

SEQ ID NO: 217011 - DNA, 20 bp, human
gataggggaaataatcaatg

SEQ ID NO: 217012 - DNA, 20 bp, human
gtggtgacctctacctattg

SEQ ID NO: 217013 - DNA, 20 bp, human
ggtggagattcctccacaat

SEQ ID NO: 217014 - DNA, 20 bp, human
gacatttgaaagagacatat

SEQ ID NO: 217015 - DNA, 20 bp, human
gtggatgacatcacaatagg

SEQ ID NO: 217016 - DNA, 20 bp, human
ggggactgtaagaggagcca

SEQ ID NO: 217017 - DNA, 20 bp, human
gctggcaggtggccctccgc

SEQ ID NO: 217018 - DNA, 20 bp, human
gcctccgcagggactgtaag

SEQ ID NO: 217019 - DNA, 20 bp, human
gagaaggactggctgatctc

SEQ ID NO: 217020 - DNA, 20 bp, human
gtttccagaggcctcagcaa

SEQ ID NO: 217021 - DNA, 20 bp, human
gcagcagctgtccgtgagag

SEQ ID NO: 217022 - DNA, 20 bp, human
ggaccagacgctccttttag

SEQ ID NO: 217023 - DNA, 20 bp, human
gcagcagacatgtttgtgag

SEQ ID NO: 217024 - DNA, 20 bp, human
gcaaaggattattctagaga

SEQ ID NO: 217025 - DNA, 20 bp, human
ggctataaatagcagcaccc

SEQ ID NO: 217026 - DNA, 20 bp, human
gagttgggagacaaagagtg

SEQ ID NO: 217027 - DNA, 20 bp, human
gtgcagtgggtcagagacag

SEQ ID NO: 217028 - DNA, 20 bp, human
gttcgatgcacccggaggaa

SEQ ID NO: 217029 - DNA, 20 bp, human
gatgcacccggaggaacgga

SEQ ID NO: 217030 - DNA, 20 bp, human
gcacgtgagggccaaagctc

SEQ ID NO: 217031 - DNA, 20 bp, human
ggacgaggagacgcatagtt

SEQ ID NO: 217032 - DNA, 20 bp, human
gagagaggatcccggagctt

SEQ ID NO: 217033 - DNA, 20 bp, human
gaaatgatgacatcacgtga

SEQ ID NO: 217034 - DNA, 20 bp, human
gctgtattcgatgcacccgg

SEQ ID NO: 217035 - DNA, 20 bp, human
gctcacttcagagaggatcc

SEQ ID NO: 217036 - DNA, 20 bp, human
gaggcccgcaaagacctccc

SEQ ID NO: 217037 - DNA, 20 bp, human
gccgctgcccgcctcacgag

SEQ ID NO: 217038 - DNA, 20 bp, human
gggctcaagcgcccctcgtg

SEQ ID NO: 217039 - DNA, 20 bp, human
gggaaagataggggtactga

SEQ ID NO: 217040 - DNA, 20 bp, human
gagagcaaggtggagtggta

SEQ ID NO: 217041 - DNA, 20 bp, human
ggccaggcccgggtgtccgg

SEQ ID NO: 217042 - DNA, 20 bp, human
ggggcagggtaagcagccta

SEQ ID NO: 217043 - DNA, 20 bp, human
ggacgccaggcccgggtgtc

SEQ ID NO: 217044 - DNA, 20 bp, human
gtgatggcacgcagggaccc

SEQ ID NO: 217045 - DNA, 20 bp, human
gtcaagcgcccctcgtgagg

SEQ ID NO: 217046 - DNA, 20 bp, human
gtggagagtccacaaactgt

SEQ ID NO: 217047 - DNA, 20 bp, human
gcatgcctggaaatgtatca

SEQ ID NO: 217048 - DNA, 20 bp, human
gaggaggtggggagacggtc

SEQ ID NO: 217049 - DNA, 20 bp, human
ggcctggaaatgtatcacgg

SEQ ID NO: 217050 - DNA, 20 bp, human
ggatccctatataaatagaa

SEQ ID NO: 217051 - DNA, 20 bp, human
ggatccgttctatttatata

SEQ ID NO: 217052 - DNA, 20 bp, human
ggcccccgtgatacatttcc

SEQ ID NO: 217053 - DNA, 20 bp, human
gccggggcagggactctttt

SEQ ID NO: 217054 - DNA, 20 bp, human
gaatgtagtgacagccaaga

SEQ ID NO: 217055 - DNA, 20 bp, human
gcgagcaaacaggcgcatgc

SEQ ID NO: 217056 - DNA, 20 bp, human
gtaaatcagtacacagtcca

SEQ ID NO: 217057 - DNA, 20 bp, human
gagtttgcgaagaactttta

SEQ ID NO: 217058 - DNA, 20 bp, human
gtcctcaggaccagctgttc

SEQ ID NO: 217059 - DNA, 20 bp, human
gaatgtgcctggctctcgtc

SEQ ID NO: 217060 - DNA, 20 bp, human
gagcatcccggacgagagcc

SEQ ID NO: 217061 - DNA, 20 bp, human
gaaaagtgtccattggatga

SEQ ID NO: 217062 - DNA, 20 bp, human
gtttgaaatttggagcacag

SEQ ID NO: 217063 - DNA, 20 bp, human
gtaaagttgtctatcattta

SEQ ID NO: 217064 - DNA, 20 bp, human
gatattgagaatggaaagtc

SEQ ID NO: 217065 - DNA, 20 bp, human
ggttcttcgcaaactcctat

SEQ ID NO: 217066 - DNA, 20 bp, human
gtgggcggccccagcggagt

SEQ ID NO: 217067 - DNA, 20 bp, human
gcccgcctgagtctcggatc

SEQ ID NO: 217068 - DNA, 20 bp, human
gacgaccggcggaactcgga

SEQ ID NO: 217069 - DNA, 20 bp, human
ggcagggccgagagcacgac

SEQ ID NO: 217070 - DNA, 20 bp, human
ggggccgagagcacgaccgg

SEQ ID NO: 217071 - DNA, 20 bp, human
gagggccagcccgaaccgga

SEQ ID NO: 217072 - DNA, 20 bp, human
gtcgggcgatgtccagtggg

SEQ ID NO: 217073 - DNA, 20 bp, human
gcacgaccgccaggccgact

SEQ ID NO: 217074 - DNA, 20 bp, human
gggacggcgcccagcggtcg

SEQ ID NO: 217075 - DNA, 20 bp, human
ggactcgggcgatgtccagt

SEQ ID NO: 217076 - DNA, 20 bp, human
gaagggaggcgtgccgaacg

SEQ ID NO: 217077 - DNA, 20 bp, human
gccaccacggggaagctgta

SEQ ID NO: 217078 - DNA, 20 bp, human
gcattcgcgacagttaaggg

SEQ ID NO: 217079 - DNA, 20 bp, human
gggagtagggacgacttggt

SEQ ID NO: 217080 - DNA, 20 bp, human
gggcgctgattggttgttga

SEQ ID NO: 217081 - DNA, 20 bp, human
gaaccaggtccgggatgggt

SEQ ID NO: 217082 - DNA, 20 bp, human
gggggctgccgggggtaagg

SEQ ID NO: 217083 - DNA, 20 bp, human
gggagggagtagggacgact

SEQ ID NO: 217084 - DNA, 20 bp, human
gagcctcggaagccaccacg

SEQ ID NO: 217085 - DNA, 20 bp, human
ggcaactttacggcaggcag

SEQ ID NO: 217086 - DNA, 20 bp, human
gccctccagaggcctagtta

SEQ ID NO: 217087 - DNA, 20 bp, human
gctgctgcacaagtctgcgc

SEQ ID NO: 217088 - DNA, 20 bp, human
ggaccaagacccgaaccctg

SEQ ID NO: 217089 - DNA, 20 bp, human
gcgcaaagcctctgagtaaa

SEQ ID NO: 217090 - DNA, 20 bp, human
gaaccccctaactaggcctc

SEQ ID NO: 217091 - DNA, 20 bp, human
gagaaagtaaccccctaact

SEQ ID NO: 217092 - DNA, 20 bp, human
gactcagaggctttgcgcgc

SEQ ID NO: 217093 - DNA, 20 bp, human
gagcggggataaaaaagctc

SEQ ID NO: 217094 - DNA, 20 bp, human
gtagaatcggcccaacactc

SEQ ID NO: 217095 - DNA, 20 bp, human
gctcaggaaccctgagtgtt

SEQ ID NO: 217096 - DNA, 20 bp, human
gcagcaacttcgcagactta

SEQ ID NO: 217097 - DNA, 20 bp, human
gtaacaaacggatctcagca

SEQ ID NO: 217098 - DNA, 20 bp, human
gactgtgcaagcaattcagc

SEQ ID NO: 217099 - DNA, 20 bp, human
gaacttcgcagacttagggc

SEQ ID NO: 217100 - DNA, 20 bp, human
gttcgcagacttagggctgg

SEQ ID NO: 217101 - DNA, 20 bp, human
gtgctaggtggcctgagatg

SEQ ID NO: 217102 - DNA, 20 bp, human
gctgagatccgtttgttaca

SEQ ID NO: 217103 - DNA, 20 bp, human
gtaacatgcacagcacgccc

SEQ ID NO: 217104 - DNA, 20 bp, human
gtagaagttaaaatgagtgg

SEQ ID NO: 217105 - DNA, 20 bp, human
gcacacacgttttacctaac

SEQ ID NO: 217106 - DNA, 20 bp, human
gtaagaggccgaggggtcga

SEQ ID NO: 217107 - DNA, 20 bp, human
gtacagctgcggcatctatt

SEQ ID NO: 217108 - DNA, 20 bp, human
ggatgccgcagctgtaacgg

SEQ ID NO: 217109 - DNA, 20 bp, human
gcgcgcgcccgtgccgtggt

SEQ ID NO: 217110 - DNA, 20 bp, human
gcccccccccgttacagctg

SEQ ID NO: 217111 - DNA, 20 bp, human
ggccgcagctgtaacggggg

SEQ ID NO: 217112 - DNA, 20 bp, human
gccccaggatcctacctgca

SEQ ID NO: 217113 - DNA, 20 bp, human
gccccaggaaactacgccat

SEQ ID NO: 217114 - DNA, 20 bp, human
gctagaaaaatggagaaggt

SEQ ID NO: 217115 - DNA, 20 bp, human
gggccctgtcaggtaagttg

SEQ ID NO: 217116 - DNA, 20 bp, human
ggctacagacgccgagtgtg

SEQ ID NO: 217117 - DNA, 20 bp, human
gacagacgccgagtgtgggg

SEQ ID NO: 217118 - DNA, 20 bp, human
gcagagaataggtcagctga

SEQ ID NO: 217119 - DNA, 20 bp, human
ggagaggcgcaacccgggtc

SEQ ID NO: 217120 - DNA, 20 bp, human
gtaagactccgccccacact

SEQ ID NO: 217121 - DNA, 20 bp, human
gccgccgggaagccggaccc

SEQ ID NO: 217122 - DNA, 20 bp, human
gaagaagagaggcgcaaccc

SEQ ID NO: 217123 - DNA, 20 bp, human
ggagccgagcaaactaccgc

SEQ ID NO: 217124 - DNA, 20 bp, human
gattctctgcttaagcagga

SEQ ID NO: 217125 - DNA, 20 bp, human
gggcggagtcttaagaagag

SEQ ID NO: 217126 - DNA, 20 bp, human
gtctgctcctccgaacccag

SEQ ID NO: 217127 - DNA, 20 bp, human
gtctagtccgctgggttcgg

SEQ ID NO: 217128 - DNA, 20 bp, human
ggggacgctccactttaccc

SEQ ID NO: 217129 - DNA, 20 bp, human
gctccagcctctagtccgct

SEQ ID NO: 217130 - DNA, 20 bp, human
gcagcggggcggtgacgtgt

SEQ ID NO: 217131 - DNA, 20 bp, human
ggcggcgaggatgcgcccca

SEQ ID NO: 217132 - DNA, 20 bp, human
ggagcagaggcggaaggtcc

SEQ ID NO: 217133 - DNA, 20 bp, human
gttaccctggctgcccgcaa

SEQ ID NO: 217134 - DNA, 20 bp, human
gaaaaaactcacaggtagag

SEQ ID NO: 217135 - DNA, 20 bp, human
ggcgggcagccagggtaaag

SEQ ID NO: 217136 - DNA, 20 bp, human
gcgggagaaaggaacgggag

SEQ ID NO: 217137 - DNA, 20 bp, human
ggaggaggagggggagttta

SEQ ID NO: 217138 - DNA, 20 bp, human
gaagaggaggggggggagtg

SEQ ID NO: 217139 - DNA, 20 bp, human
ggcaaactctccattcagct

SEQ ID NO: 217140 - DNA, 20 bp, human
ggctgggtgtcccattgaaa

SEQ ID NO: 217141 - DNA, 20 bp, human
gtcccggctgaataaacagg

SEQ ID NO: 217142 - DNA, 20 bp, human
gtttgcaaggagcgggagaa

SEQ ID NO: 217143 - DNA, 20 bp, human
ggagggggagtttagggagt

SEQ ID NO: 217144 - DNA, 20 bp, human
ggggtgtcccattgaaaagg

SEQ ID NO: 217145 - DNA, 20 bp, human
ggactcccggctgaataaac

SEQ ID NO: 217146 - DNA, 20 bp, human
gcaaacgggtggcccacgat

SEQ ID NO: 217147 - DNA, 20 bp, human
ggcgcccagcccagtcgcgg

SEQ ID NO: 217148 - DNA, 20 bp, human
gcgtacgcgcttcctcaatg

SEQ ID NO: 217149 - DNA, 20 bp, human
ggagccgcgccctgcgcgat

SEQ ID NO: 217150 - DNA, 20 bp, human
gtggccaatcgcgcagggcg

SEQ ID NO: 217151 - DNA, 20 bp, human
gagcgcgcccagcccagtcg

SEQ ID NO: 217152 - DNA, 20 bp, human
gcgcgtggcgcgtggctcac

SEQ ID NO: 217153 - DNA, 20 bp, human
gtggagggacggggaaagcg

SEQ ID NO: 217154 - DNA, 20 bp, human
gcgcgcttcctcaatggggc

SEQ ID NO: 217155 - DNA, 20 bp, human
gcagggcgcggctccacgcc

SEQ ID NO: 217156 - DNA, 20 bp, human
gaaaggcgtgcttacaaaac

SEQ ID NO: 217157 - DNA, 20 bp, human
gataaccatactaaatagaa

SEQ ID NO: 217158 - DNA, 20 bp, human
gcacgcctttctatttagta

SEQ ID NO: 217159 - DNA, 20 bp, human
gtcatataacccagaagaat

SEQ ID NO: 217160 - DNA, 20 bp, human
gaaacagaactgctcagttc

SEQ ID NO: 217161 - DNA, 20 bp, human
ggttaaggccagaactagga

SEQ ID NO: 217162 - DNA, 20 bp, human
gactcataatgtgcaaatat

SEQ ID NO: 217163 - DNA, 20 bp, human
gggctagttcctatgatact

SEQ ID NO: 217164 - DNA, 20 bp, human
ggactttagtgacacgaatg

SEQ ID NO: 217165 - DNA, 20 bp, human
gccccactgctaaatccaac

SEQ ID NO: 217166 - DNA, 20 bp, human
gtgggtgagattagaagagg

SEQ ID NO: 217167 - DNA, 20 bp, human
gtcctgggtgagattagaag

SEQ ID NO: 217168 - DNA, 20 bp, human
gtaatctcacccaggatata

SEQ ID NO: 217169 - DNA, 20 bp, human
gagatgatgtccttatatcc

SEQ ID NO: 217170 - DNA, 20 bp, human
gaagcactgtgagaaataac

SEQ ID NO: 217171 - DNA, 20 bp, human
gaaaaacactctttgcgcta

SEQ ID NO: 217172 - DNA, 20 bp, human
ggaaagcaacatttgaaagg

SEQ ID NO: 217173 - DNA, 20 bp, human
gctgcaaaccagtacattaa

SEQ ID NO: 217174 - DNA, 20 bp, human
ggaagacacctttaatgtac

SEQ ID NO: 217175 - DNA, 20 bp, human
gatcctttctccttggaact

SEQ ID NO: 217176 - DNA, 20 bp, human
gggcaagtgacatgcagctc

SEQ ID NO: 217177 - DNA, 20 bp, human
gaaggagagagggccactcc

SEQ ID NO: 217178 - DNA, 20 bp, human
gctgccctgctgagagccaa

SEQ ID NO: 217179 - DNA, 20 bp, human
ggctggagcctaggaggagt

SEQ ID NO: 217180 - DNA, 20 bp, human
gcactccaggggttgaaccg

SEQ ID NO: 217181 - DNA, 20 bp, human
gctctgggctggagcctagg

SEQ ID NO: 217182 - DNA, 20 bp, human
ggtggggatgctgtcctcta

SEQ ID NO: 217183 - DNA, 20 bp, human
ggggactgtcaggtgatcac

SEQ ID NO: 217184 - DNA, 20 bp, human
gcagcagggcagcgccctag

SEQ ID NO: 217185 - DNA, 20 bp, human
ggattggctgccctgagtct

SEQ ID NO: 217186 - DNA, 20 bp, human
ggagcgggagcccatcttgc

SEQ ID NO: 217187 - DNA, 20 bp, human
gcctcggcagccagcaagat

SEQ ID NO: 217188 - DNA, 20 bp, human
gtgggctcccgctcccggaa

SEQ ID NO: 217189 - DNA, 20 bp, human
ggactcggaaactttaactg

SEQ ID NO: 217190 - DNA, 20 bp, human
gctcgggtgcagccaatcga

SEQ ID NO: 217191 - DNA, 20 bp, human
gctggtgtggattaggacaa

SEQ ID NO: 217192 - DNA, 20 bp, human
gtaactgcggctccacctgc

SEQ ID NO: 217193 - DNA, 20 bp, human
gtggctgccgaggccctcgc

SEQ ID NO: 217194 - DNA, 20 bp, human
ggaccctcctcctccagcga

SEQ ID NO: 217195 - DNA, 20 bp, human
gaggaggagggtcagaactc

SEQ ID NO: 217196 - DNA, 20 bp, human
gggcgcgcgcccagactcct

SEQ ID NO: 217197 - DNA, 20 bp, human
gtccctctccgcagcgtgtg

SEQ ID NO: 217198 - DNA, 20 bp, human
gccgatcggcgctccaggac

SEQ ID NO: 217199 - DNA, 20 bp, human
gtcgccctcctcacacgctg

SEQ ID NO: 217200 - DNA, 20 bp, human
gtctccgcagcgtgtgagga

SEQ ID NO: 217201 - DNA, 20 bp, human
gagctccgctgattggtccg

SEQ ID NO: 217202 - DNA, 20 bp, human
gtccctcctgccaatcactt

SEQ ID NO: 217203 - DNA, 20 bp, human
gccgcgccgctggacctcaa

SEQ ID NO: 217204 - DNA, 20 bp, human
gtccttctggccaatcctga

SEQ ID NO: 217205 - DNA, 20 bp, human
gtgattggcaggagggagtg

SEQ ID NO: 217206 - DNA, 20 bp, human
gcacggaagagtgaggtgac

SEQ ID NO: 217207 - DNA, 20 bp, human
gtggaacttaggggagtgtg

SEQ ID NO: 217208 - DNA, 20 bp, human
ggctccggtgccagggtcac

SEQ ID NO: 217209 - DNA, 20 bp, human
ggcaggaagcgaaacgggga

SEQ ID NO: 217210 - DNA, 20 bp, human
gaggtgactggcatgtgtgg

SEQ ID NO: 217211 - DNA, 20 bp, human
gtatccctgaacaggatcag

SEQ ID NO: 217212 - DNA, 20 bp, human
ggaaatggattggaacttag

SEQ ID NO: 217213 - DNA, 20 bp, human
gcaggccccagtttcctgtg

SEQ ID NO: 217214 - DNA, 20 bp, human
gacccctcccaaacggtgca

SEQ ID NO: 217215 - DNA, 20 bp, human
gtgaacaggatcagagggac

SEQ ID NO: 217216 - DNA, 20 bp, human
gtcggaggcaggaagtgaga

SEQ ID NO: 217217 - DNA, 20 bp, human
gacctcctggcctgggactt

SEQ ID NO: 217218 - DNA, 20 bp, human
ggtccgggcaaggcctgcac

SEQ ID NO: 217219 - DNA, 20 bp, human
gccaggggacccccctctct

SEQ ID NO: 217220 - DNA, 20 bp, human
gtggggcaggtggagctcac

SEQ ID NO: 217221 - DNA, 20 bp, human
ggagctgtaactcatttgtg

SEQ ID NO: 217222 - DNA, 20 bp, human
ggagtggggtgagtggcgtg

SEQ ID NO: 217223 - DNA, 20 bp, human
gggtcgctgtgatcctggtc

SEQ ID NO: 217224 - DNA, 20 bp, human
gccaactcgcttcactctcc

SEQ ID NO: 217225 - DNA, 20 bp, human
ggcagggtctgggccggacg

SEQ ID NO: 217226 - DNA, 20 bp, human
gcgcacgcgcgaggggtgga

SEQ ID NO: 217227 - DNA, 20 bp, human
ggtgggaggcgcacgcgcga

SEQ ID NO: 217228 - DNA, 20 bp, human
gcgaggggtggagggtggta

SEQ ID NO: 217229 - DNA, 20 bp, human
gaggaatggaacagtcccgc

SEQ ID NO: 217230 - DNA, 20 bp, human
gcctcccacaatcccccccg

SEQ ID NO: 217231 - DNA, 20 bp, human
gggacgggccgagcgggtcg

SEQ ID NO: 217232 - DNA, 20 bp, human
gagggaggtaggttgtcgtg

SEQ ID NO: 217233 - DNA, 20 bp, human
ggtcccgcgggggggattgt

SEQ ID NO: 217234 - DNA, 20 bp, human
ggaggcgcacgcgcgagggg

SEQ ID NO: 217235 - DNA, 20 bp, human
gaggaagggacgggccgagc

SEQ ID NO: 217236 - DNA, 20 bp, human
gctcgcgagaagtccagggg

SEQ ID NO: 217237 - DNA, 20 bp, human
gtgcaacaggggcagaagag

SEQ ID NO: 217238 - DNA, 20 bp, human
gggaagctagatggttagtg

SEQ ID NO: 217239 - DNA, 20 bp, human
gtattctcgcgagaagtcca

SEQ ID NO: 217240 - DNA, 20 bp, human
gctgacgcggcgtattttcg

SEQ ID NO: 217241 - DNA, 20 bp, human
gcgcgggcctggcaggctga

SEQ ID NO: 217242 - DNA, 20 bp, human
gaggccgattccaggggcga

SEQ ID NO: 217243 - DNA, 20 bp, human
gccacgaccgctttaaggcc

SEQ ID NO: 217244 - DNA, 20 bp, human
ggagcggtcgcaaatgcaac

SEQ ID NO: 217245 - DNA, 20 bp, human
gcgtcagtccctgactcgaa

SEQ ID NO: 217246 - DNA, 20 bp, human
ggatccgggagcgggaccca

SEQ ID NO: 217247 - DNA, 20 bp, human
ggcggggagagggacgctag

SEQ ID NO: 217248 - DNA, 20 bp, human
gcaggcagggagacggctcc

SEQ ID NO: 217249 - DNA, 20 bp, human
ggatccgaaggagacagcgc

SEQ ID NO: 217250 - DNA, 20 bp, human
gacaagccatagggcctcgc

SEQ ID NO: 217251 - DNA, 20 bp, human
gccgaaagcggccgcgagga

SEQ ID NO: 217252 - DNA, 20 bp, human
gcgcgcggggccccggatcc

SEQ ID NO: 217253 - DNA, 20 bp, human
ggaggcagcgccgccgaaag

SEQ ID NO: 217254 - DNA, 20 bp, human
ggtgtctgcgaggctgtctc

SEQ ID NO: 217255 - DNA, 20 bp, human
gagccgtctccctgcctgcg

SEQ ID NO: 217256 - DNA, 20 bp, human
gctagtgggggcttcttcga

SEQ ID NO: 217257 - DNA, 20 bp, human
gccagcctgggatctccaga

SEQ ID NO: 217258 - DNA, 20 bp, human
gcccaggctgggtctaacct

SEQ ID NO: 217259 - DNA, 20 bp, human
gtgtcttcctgccacctggg

SEQ ID NO: 217260 - DNA, 20 bp, human
gccccccaaggcagcctagc

SEQ ID NO: 217261 - DNA, 20 bp, human
gtaggagccaggtgtgaggt

SEQ ID NO: 217262 - DNA, 20 bp, human
gatccctgacattgatgcaa

SEQ ID NO: 217263 - DNA, 20 bp, human
gcccaccgccacatagctgt

SEQ ID NO: 217264 - DNA, 20 bp, human
gcatcaatgtcagggatccc

SEQ ID NO: 217265 - DNA, 20 bp, human
gaggcagcctagcagggaca

SEQ ID NO: 217266 - DNA, 20 bp, human
gcacagttcttgtactgctg

SEQ ID NO: 217267 - DNA, 20 bp, human
gggaggctcgcccttaccta

SEQ ID NO: 217268 - DNA, 20 bp, human
ggcttctaaagccatctccc

SEQ ID NO: 217269 - DNA, 20 bp, human
ggggccgcgtcagacgcccg

SEQ ID NO: 217270 - DNA, 20 bp, human
gccccataagggtataggga

SEQ ID NO: 217271 - DNA, 20 bp, human
ggccaggcgacaccccataa

SEQ ID NO: 217272 - DNA, 20 bp, human
gactgtgcccacccggccat

SEQ ID NO: 217273 - DNA, 20 bp, human
gcccttacctatggccgggt

SEQ ID NO: 217274 - DNA, 20 bp, human
gcctgcgggtaccggggaga

SEQ ID NO: 217275 - DNA, 20 bp, human
gcgcgtcagacgcccgcggg

SEQ ID NO: 217276 - DNA, 20 bp, human
ggatctggggacccagtgag

SEQ ID NO: 217277 - DNA, 20 bp, human
ggggacccagtgagcggcta

SEQ ID NO: 217278 - DNA, 20 bp, human
gagcacgggcgtcaggagcc

SEQ ID NO: 217279 - DNA, 20 bp, human
ggggggatagccccagtctt

SEQ ID NO: 217280 - DNA, 20 bp, human
gccctgggtggccaggaagt

SEQ ID NO: 217281 - DNA, 20 bp, human
gttaagcgtggggagggctc

SEQ ID NO: 217282 - DNA, 20 bp, human
gtgagcggctagggtgcagc

SEQ ID NO: 217283 - DNA, 20 bp, human
gtgcaccctagccgctcact

SEQ ID NO: 217284 - DNA, 20 bp, human
gtccccacgcttaataattc

SEQ ID NO: 217285 - DNA, 20 bp, human
ggggtagtgggatcaggtgg

SEQ ID NO: 217286 - DNA, 20 bp, human
gacgttcccgggtgagtcat

SEQ ID NO: 217287 - DNA, 20 bp, human
gtcactcatgaaatcactct

SEQ ID NO: 217288 - DNA, 20 bp, human
ggtgtcaactagcctggtca

SEQ ID NO: 217289 - DNA, 20 bp, human
gaaccaggtatgggcattta

SEQ ID NO: 217290 - DNA, 20 bp, human
gcagttgaggttgtaaaaca

SEQ ID NO: 217291 - DNA, 20 bp, human
gttaactacacatatttgat

SEQ ID NO: 217292 - DNA, 20 bp, human
ggtccataaatgcccatacc

SEQ ID NO: 217293 - DNA, 20 bp, human
gaagctaagaagacgttccc

SEQ ID NO: 217294 - DNA, 20 bp, human
gatataaaatacagcagttg

SEQ ID NO: 217295 - DNA, 20 bp, human
gctggttctgtcaacatttt

SEQ ID NO: 217296 - DNA, 20 bp, human
gcatgggaagaggtaacctc

SEQ ID NO: 217297 - DNA, 20 bp, human
ggctcctgactccaagctgt

SEQ ID NO: 217298 - DNA, 20 bp, human
gataccagtggcagcagaga

SEQ ID NO: 217299 - DNA, 20 bp, human
ggagcaggagttcaattgtg

SEQ ID NO: 217300 - DNA, 20 bp, human
gttcttcattctagtcccat

SEQ ID NO: 217301 - DNA, 20 bp, human
gagttcaattgtggggtaaa

SEQ ID NO: 217302 - DNA, 20 bp, human
gttaaatgtggctgcagctt

SEQ ID NO: 217303 - DNA, 20 bp, human
gacagctttgttgtgccatg

SEQ ID NO: 217304 - DNA, 20 bp, human
gtccgaggaacctaaatgtc

SEQ ID NO: 217305 - DNA, 20 bp, human
gaatccctctctgctgccac

SEQ ID NO: 217306 - DNA, 20 bp, human
gcacggccaggattggagga

SEQ ID NO: 217307 - DNA, 20 bp, human
gccgccgggcggcctcctat

SEQ ID NO: 217308 - DNA, 20 bp, human
ggcggccggatgggcgggac

SEQ ID NO: 217309 - DNA, 20 bp, human
ggtggtcagcagacacgcag

SEQ ID NO: 217310 - DNA, 20 bp, human
gggggtggggacaggaccgg

SEQ ID NO: 217311 - DNA, 20 bp, human
gcgacggccgcgccaatagg

SEQ ID NO: 217312 - DNA, 20 bp, human
ggggcggcctcctattggcg

SEQ ID NO: 217313 - DNA, 20 bp, human
gccccgcccacggccaggat

SEQ ID NO: 217314 - DNA, 20 bp, human
ggcggccgtcgccaggggtg

SEQ ID NO: 217315 - DNA, 20 bp, human
ggggcgcgacactatccgtg

SEQ ID NO: 217316 - DNA, 20 bp, human
ggatgagtcaagggctcggg

SEQ ID NO: 217317 - DNA, 20 bp, human
ggctgatgagtcaagggctc

SEQ ID NO: 217318 - DNA, 20 bp, human
gcctgatgcagactatttta

SEQ ID NO: 217319 - DNA, 20 bp, human
gaaagcgtgtggcgattccc

SEQ ID NO: 217320 - DNA, 20 bp, human
ggcactcattaatcgtctta

SEQ ID NO: 217321 - DNA, 20 bp, human
gcccagtactcaaacaaaga

SEQ ID NO: 217322 - DNA, 20 bp, human
gattaatgagtgctaatgat

SEQ ID NO: 217323 - DNA, 20 bp, human
ggcagactattttagggctg

SEQ ID NO: 217324 - DNA, 20 bp, human
gtaggggatcacaaagcgtg

SEQ ID NO: 217325 - DNA, 20 bp, human
gtaatgatgggtgagcatat

SEQ ID NO: 217326 - DNA, 20 bp, human
gtggtctcaggggagatcaa

SEQ ID NO: 217327 - DNA, 20 bp, human
gctgacggagtgttcaatgg

SEQ ID NO: 217328 - DNA, 20 bp, human
gtggtctgggcgtggtctca

SEQ ID NO: 217329 - DNA, 20 bp, human
gggcctgacggagtgttcaa

SEQ ID NO: 217330 - DNA, 20 bp, human
gtgggcgcggtctcgcgggg

SEQ ID NO: 217331 - DNA, 20 bp, human
ggatcaatggggcgtgacat

SEQ ID NO: 217332 - DNA, 20 bp, human
ggtcaatggcggcgtgacat

SEQ ID NO: 217333 - DNA, 20 bp, human
ggccactgaaggcgcggact

SEQ ID NO: 217334 - DNA, 20 bp, human
gggagtgttcaatggaggcg

SEQ ID NO: 217335 - DNA, 20 bp, human
gggcctggcggagcggtcaa

SEQ ID NO: 217336 - DNA, 20 bp, human
ggatgtgttcattaggtagg

SEQ ID NO: 217337 - DNA, 20 bp, human
ggaacacatcggtacggtct

SEQ ID NO: 217338 - DNA, 20 bp, human
gaaggtgaggttggcgctac

SEQ ID NO: 217339 - DNA, 20 bp, human
gaggttgacaaagtgaaccc

SEQ ID NO: 217340 - DNA, 20 bp, human
gaggagagctgcaagaccta

SEQ ID NO: 217341 - DNA, 20 bp, human
gaagttgagcctatggagtc

SEQ ID NO: 217342 - DNA, 20 bp, human
gacctaccgtgaagaataga

SEQ ID NO: 217343 - DNA, 20 bp, human
gcctaatgaacacatcggta

SEQ ID NO: 217344 - DNA, 20 bp, human
gtagggcccaatcagtgaaa

SEQ ID NO: 217345 - DNA, 20 bp, human
gtaggtcccaacctcacctc

SEQ ID NO: 217346 - DNA, 20 bp, human
ggggcggagcaggactaagt

SEQ ID NO: 217347 - DNA, 20 bp, human
gactaagtggggcggcggaa

SEQ ID NO: 217348 - DNA, 20 bp, human
ggcactgagacgcaaggcgc

SEQ ID NO: 217349 - DNA, 20 bp, human
gggagcaggactaagtgggg

SEQ ID NO: 217350 - DNA, 20 bp, human
ggcaggactaagtggggcgg

SEQ ID NO: 217351 - DNA, 20 bp, human
gcggggccgcggggtgtccg

SEQ ID NO: 217352 - DNA, 20 bp, human
gtctgaggctatccttaaac

SEQ ID NO: 217353 - DNA, 20 bp, human
ggcggcggaagggcgcaagg

SEQ ID NO: 217354 - DNA, 20 bp, human
gaaccagcgcgcacaggggc

SEQ ID NO: 217355 - DNA, 20 bp, human
gaggaccaaccagcgcgcac

SEQ ID NO: 217356 - DNA, 20 bp, human
gagggagcgagtaaacagtc

SEQ ID NO: 217357 - DNA, 20 bp, human
gtggaagcgcgcatgcgctg

SEQ ID NO: 217358 - DNA, 20 bp, human
gcgcatgcgcaggccgggtc

SEQ ID NO: 217359 - DNA, 20 bp, human
gaggcgcgaaactcctcccc

SEQ ID NO: 217360 - DNA, 20 bp, human
gttcctgtactggcctcttg

SEQ ID NO: 217361 - DNA, 20 bp, human
gaagactcgcgggaaaagaa

SEQ ID NO: 217362 - DNA, 20 bp, human
gggaaaagaaagggtgagcg

SEQ ID NO: 217363 - DNA, 20 bp, human
ggcgctgtggctaatgccgt

SEQ ID NO: 217364 - DNA, 20 bp, human
gctcacttgaacgcatgcgc

SEQ ID NO: 217365 - DNA, 20 bp, human
gagttctgtgcgccctccag

SEQ ID NO: 217366 - DNA, 20 bp, human
gtagatctactgaccatctg

SEQ ID NO: 217367 - DNA, 20 bp, human
gctggatgacatcctagctg

SEQ ID NO: 217368 - DNA, 20 bp, human
gaagggagtgtccataaacg

SEQ ID NO: 217369 - DNA, 20 bp, human
gggcccactcagtatttcca

SEQ ID NO: 217370 - DNA, 20 bp, human
ggccaaatcaatgatcactt

SEQ ID NO: 217371 - DNA, 20 bp, human
ggcccgtggaaatactgagt

SEQ ID NO: 217372 - DNA, 20 bp, human
gaacttctaactccctcaga

SEQ ID NO: 217373 - DNA, 20 bp, human
gttcaagaggaggtctctga

SEQ ID NO: 217374 - DNA, 20 bp, human
gagcctttggctgtttatag

SEQ ID NO: 217375 - DNA, 20 bp, human
gtgggcgccggttcaagagg

SEQ ID NO: 217376 - DNA, 20 bp, human
gagagcgtgaacgggagcat

SEQ ID NO: 217377 - DNA, 20 bp, human
gccactacgaggggagaagg

SEQ ID NO: 217378 - DNA, 20 bp, human
gaggggccaagaccccgacg

SEQ ID NO: 217379 - DNA, 20 bp, human
gaccccgacgtggcacccaa

SEQ ID NO: 217380 - DNA, 20 bp, human
gacagcctgggccactacga

SEQ ID NO: 217381 - DNA, 20 bp, human
gagagccccaagttgacggg

SEQ ID NO: 217382 - DNA, 20 bp, human
ggagagaaagagagcgtgaa

SEQ ID NO: 217383 - DNA, 20 bp, human
gcaggattggcgctggaagg

SEQ ID NO: 217384 - DNA, 20 bp, human
gagccaggagcccccggtgt

SEQ ID NO: 217385 - DNA, 20 bp, human
gcgtgaacgggagcatgggg

SEQ ID NO: 217386 - DNA, 20 bp, human
ggggtcccggggactgtcca

SEQ ID NO: 217387 - DNA, 20 bp, human
ggagtggagtctgcccggga

SEQ ID NO: 217388 - DNA, 20 bp, human
gtgtccagggtcggagagag

SEQ ID NO: 217389 - DNA, 20 bp, human
gaaacgtgtaggaagaggtg

SEQ ID NO: 217390 - DNA, 20 bp, human
gcgcggccttggaaacgtgt

SEQ ID NO: 217391 - DNA, 20 bp, human
gagggccaatggccgcagga

SEQ ID NO: 217392 - DNA, 20 bp, human
gccgcctctctctccgaccc

SEQ ID NO: 217393 - DNA, 20 bp, human
ggctggggagcgcctgtcca

SEQ ID NO: 217394 - DNA, 20 bp, human
gagcgcctgtccagggacta

SEQ ID NO: 217395 - DNA, 20 bp, human
ggtctgcccgggagggtggg

SEQ ID NO: 217396 - DNA, 20 bp, human
ggcccccagcccatgagggg

SEQ ID NO: 217397 - DNA, 20 bp, human
gtcgggctgtgggcaaccct

SEQ ID NO: 217398 - DNA, 20 bp, human
gcgggagccggcgtcatctc

SEQ ID NO: 217399 - DNA, 20 bp, human
gtcgaagcctgagatgacgc

SEQ ID NO: 217400 - DNA, 20 bp, human
gtgtgcacaagcatgtcagt

SEQ ID NO: 217401 - DNA, 20 bp, human
ggctctgacccacccctcat

SEQ ID NO: 217402 - DNA, 20 bp, human
gatgacgccggctcccgcca

SEQ ID NO: 217403 - DNA, 20 bp, human
gtcaggcttcgacatgacat

SEQ ID NO: 217404 - DNA, 20 bp, human
gcacctccttcctgacatcc

SEQ ID NO: 217405 - DNA, 20 bp, human
gggcttcgacatgacatcgg

SEQ ID NO: 217406 - DNA, 20 bp, human
gacagggcgcggtgcggaat

SEQ ID NO: 217407 - DNA, 20 bp, human
ggcctgggacccaatcgcaa

SEQ ID NO: 217408 - DNA, 20 bp, human
gcgcaagggcccttacgagg

SEQ ID NO: 217409 - DNA, 20 bp, human
ggggtaccgccgcctcgtaa

SEQ ID NO: 217410 - DNA, 20 bp, human
gtccccgcccctgctcactt

SEQ ID NO: 217411 - DNA, 20 bp, human
ggaccccgctccatagggat

SEQ ID NO: 217412 - DNA, 20 bp, human
ggcgccgtcactcagccttc

SEQ ID NO: 217413 - DNA, 20 bp, human
gccgtcactcagccttccgg

SEQ ID NO: 217414 - DNA, 20 bp, human
ggcccttgcgattgggtccc

SEQ ID NO: 217415 - DNA, 20 bp, human
gaacctgtgactccctcccg

SEQ ID NO: 217416 - DNA, 20 bp, human
gagaaggggcgggtcgtatc

SEQ ID NO: 217417 - DNA, 20 bp, human
gtagggccagcgggagtcac

SEQ ID NO: 217418 - DNA, 20 bp, human
gcaccccccccgcccggaaa

SEQ ID NO: 217419 - DNA, 20 bp, human
ggggcgggtcgtatcgggcg

SEQ ID NO: 217420 - DNA, 20 bp, human
gcaaatcagccgggtgccgg

SEQ ID NO: 217421 - DNA, 20 bp, human
ggtcccgcaatgcgaaagaa

SEQ ID NO: 217422 - DNA, 20 bp, human
gccggaaagggcgccacgtg

SEQ ID NO: 217423 - DNA, 20 bp, human
gcggggcgagcgcggactga

SEQ ID NO: 217424 - DNA, 20 bp, human
gcgagcgcggactgacggct

SEQ ID NO: 217425 - DNA, 20 bp, human
gaccccggccagctaacagg

SEQ ID NO: 217426 - DNA, 20 bp, human
gtgggcgggcgctgcgtctc

SEQ ID NO: 217427 - DNA, 20 bp, human
gccagcccgaggttgcgcgc

SEQ ID NO: 217428 - DNA, 20 bp, human
gctgccaggaccctccggag

SEQ ID NO: 217429 - DNA, 20 bp, human
gccaggaccctccggagcgg

SEQ ID NO: 217430 - DNA, 20 bp, human
ggccgcctgcgcgcaacctc

SEQ ID NO: 217431 - DNA, 20 bp, human
gggcacctgcgctcgcagtg

SEQ ID NO: 217432 - DNA, 20 bp, human
gcctgcgctcgcagtgcggg

SEQ ID NO: 217433 - DNA, 20 bp, human
gcgcagcgcggcgtcggcac

SEQ ID NO: 217434 - DNA, 20 bp, human
ggttgcgcgcaggcggcgac

SEQ ID NO: 217435 - DNA, 20 bp, human
ggcgaaaaacgaaagagcga

SEQ ID NO: 217436 - DNA, 20 bp, human
gcgccaatcgctatctgcgg

SEQ ID NO: 217437 - DNA, 20 bp, human
ggcaccgccctcctcgtcac

SEQ ID NO: 217438 - DNA, 20 bp, human
ggaggaggtgagaacggtag

SEQ ID NO: 217439 - DNA, 20 bp, human
gggccgccaatcgctatctg

SEQ ID NO: 217440 - DNA, 20 bp, human
gccgccgtctcattggccag

SEQ ID NO: 217441 - DNA, 20 bp, human
gctcctccgcagatagcgat

SEQ ID NO: 217442 - DNA, 20 bp, human
gtcctcgtcacgggaccaat

SEQ ID NO: 217443 - DNA, 20 bp, human
ggcccggaggtcctcattgg

SEQ ID NO: 217444 - DNA, 20 bp, human
gagccccgggttttagacgg

SEQ ID NO: 217445 - DNA, 20 bp, human
gggccaccgtctaaaacccg

SEQ ID NO: 217446 - DNA, 20 bp, human
gactccgactgcactttcaa

SEQ ID NO: 217447 - DNA, 20 bp, human
gctaaactctagacgtctac

SEQ ID NO: 217448 - DNA, 20 bp, human
ggtccaagtaacaccctctt

SEQ ID NO: 217449 - DNA, 20 bp, human
gagagtttagctagaagtct

SEQ ID NO: 217450 - DNA, 20 bp, human
gtcaggtacatctgaagttt

SEQ ID NO: 217451 - DNA, 20 bp, human
ggagtccagggagcagttca

SEQ ID NO: 217452 - DNA, 20 bp, human
gatcacatatgttgagtcca

SEQ ID NO: 217453 - DNA, 20 bp, human
gttagtccatgttagtactg

SEQ ID NO: 217454 - DNA, 20 bp, human
gtttaataatgcatggcaac

SEQ ID NO: 217455 - DNA, 20 bp, human
gtagcatgtcagggaaacta

SEQ ID NO: 217456 - DNA, 20 bp, human
gaatgaccagcttggggagt

SEQ ID NO: 217457 - DNA, 20 bp, human
gagggtggagacaatgctca

SEQ ID NO: 217458 - DNA, 20 bp, human
gtccccaagctggtcatttg

SEQ ID NO: 217459 - DNA, 20 bp, human
gccctccaggtcctcaccac

SEQ ID NO: 217460 - DNA, 20 bp, human
gcccctcgctgcaggggtaa

SEQ ID NO: 217461 - DNA, 20 bp, human
gtccacaaatgaccagcttg

SEQ ID NO: 217462 - DNA, 20 bp, human
ggctcatggagtgcagtatg

SEQ ID NO: 217463 - DNA, 20 bp, human
gaggggtggccaagcaactc

SEQ ID NO: 217464 - DNA, 20 bp, human
gtggccaagcaactctgggt

SEQ ID NO: 217465 - DNA, 20 bp, human
ggttccagggccccttcccc

SEQ ID NO: 217466 - DNA, 20 bp, human
gccgcgcttcccggaggcag

SEQ ID NO: 217467 - DNA, 20 bp, human
gtccaagccgcgcttcccgg

SEQ ID NO: 217468 - DNA, 20 bp, human
ggctcagtgccgctcaccgg

SEQ ID NO: 217469 - DNA, 20 bp, human
gggccggggcgccgtgggtg

SEQ ID NO: 217470 - DNA, 20 bp, human
gcggggccgcagcgcacttc

SEQ ID NO: 217471 - DNA, 20 bp, human
gaggacccggaagtgcgctg

SEQ ID NO: 217472 - DNA, 20 bp, human
gcgcggtcacccccggtgag

SEQ ID NO: 217473 - DNA, 20 bp, human
ggcgggctttggcggcccaa

SEQ ID NO: 217474 - DNA, 20 bp, human
gccgagctggggacgtgtca

SEQ ID NO: 217475 - DNA, 20 bp, human
gggagagcagggcaccgagc

SEQ ID NO: 217476 - DNA, 20 bp, human
gccggccttcggggctttat

SEQ ID NO: 217477 - DNA, 20 bp, human
ggaacctcctgctcctgacc

SEQ ID NO: 217478 - DNA, 20 bp, human
gcggtcccgccctcgtgcgc

SEQ ID NO: 217479 - DNA, 20 bp, human
gctcttgagaggagtgagac

SEQ ID NO: 217480 - DNA, 20 bp, human
gaggttccccgcgtgccacc

SEQ ID NO: 217481 - DNA, 20 bp, human
gttggccggcccgagcttcc

SEQ ID NO: 217482 - DNA, 20 bp, human
gagttcccataaagccccga

SEQ ID NO: 217483 - DNA, 20 bp, human
gcgagcttcctggtggcacg

SEQ ID NO: 217484 - DNA, 20 bp, human
gggtggcgagaagcgtgaag

SEQ ID NO: 217485 - DNA, 20 bp, human
gtgcgcctgcgcacgagggc

SEQ ID NO: 217486 - DNA, 20 bp, human
ggcccaggcccggacctggt

SEQ ID NO: 217487 - DNA, 20 bp, human
gccgccggcgcgcccctggg

SEQ ID NO: 217488 - DNA, 20 bp, human
gtcccaccaggtccgggcct

SEQ ID NO: 217489 - DNA, 20 bp, human
gttcacagccacctgcagat

SEQ ID NO: 217490 - DNA, 20 bp, human
ggacccatgtaactcagggg

SEQ ID NO: 217491 - DNA, 20 bp, human
gggtggctgtgaacgctgag

SEQ ID NO: 217492 - DNA, 20 bp, human
gtgaccggggacacgtggcg

SEQ ID NO: 217493 - DNA, 20 bp, human
gcaggaggcaagtctctcga

SEQ ID NO: 217494 - DNA, 20 bp, human
gcatgtaactcaggggcgga

SEQ ID NO: 217495 - DNA, 20 bp, human
gggggcagggccggtgaccg

SEQ ID NO: 217496 - DNA, 20 bp, human
gcggggcatactgggaagtc

SEQ ID NO: 217497 - DNA, 20 bp, human
gcgggcaggcctcaaactag

SEQ ID NO: 217498 - DNA, 20 bp, human
ggggcgaggcggcaccaagg

SEQ ID NO: 217499 - DNA, 20 bp, human
ggagacggcgcggggcatac

SEQ ID NO: 217500 - DNA, 20 bp, human
gtctcccggtgtgacgtctc

SEQ ID NO: 217501 - DNA, 20 bp, human
gccaaggagcaggtgttctc

SEQ ID NO: 217502 - DNA, 20 bp, human
gaccgagcgccagacaccgc

SEQ ID NO: 217503 - DNA, 20 bp, human
gatgccccgcgccgtctccc

SEQ ID NO: 217504 - DNA, 20 bp, human
gaccgcgggccacggctgtt

SEQ ID NO: 217505 - DNA, 20 bp, human
gcgccgctccgaccacgaca

SEQ ID NO: 217506 - DNA, 20 bp, human
gcacaggccggggtaggaaa

SEQ ID NO: 217507 - DNA, 20 bp, human
ggggctggggtgggaaccac

SEQ ID NO: 217508 - DNA, 20 bp, human
gccacaggtaggcatcggag

SEQ ID NO: 217509 - DNA, 20 bp, human
gccgccccaaccagctctac

SEQ ID NO: 217510 - DNA, 20 bp, human
gccacccaaaccaggtctac

SEQ ID NO: 217511 - DNA, 20 bp, human
gtggggtgggaaccacaggt

SEQ ID NO: 217512 - DNA, 20 bp, human
gacctgctacagccaggaag

SEQ ID NO: 217513 - DNA, 20 bp, human
gtctccctcgctggaggaat

SEQ ID NO: 217514 - DNA, 20 bp, human
gcggcagcgccacccaaacc

SEQ ID NO: 217515 - DNA, 20 bp, human
ggctgccagtagacctggtt

SEQ ID NO: 217516 - DNA, 20 bp, human
gccgggaaacaaagaatccg

SEQ ID NO: 217517 - DNA, 20 bp, human
ggagctgcttatctggagaa

SEQ ID NO: 217518 - DNA, 20 bp, human
gaagggagctgaggattcta

SEQ ID NO: 217519 - DNA, 20 bp, human
gatgccgcttgcagagtcct

SEQ ID NO: 217520 - DNA, 20 bp, human
gtgcaagcggcatctcattc

SEQ ID NO: 217521 - DNA, 20 bp, human
gcatctcattccggggtcca

SEQ ID NO: 217522 - DNA, 20 bp, human
gtttcccggagctgcttatc

SEQ ID NO: 217523 - DNA, 20 bp, human
ggagcaccggcagccagctg

SEQ ID NO: 217524 - DNA, 20 bp, human
gctcgtgttggaggatgcaa

SEQ ID NO: 217525 - DNA, 20 bp, human
gaaggacgtcgaaaggaaag

SEQ ID NO: 217526 - DNA, 20 bp, human
ggggagccggagatcgggga

SEQ ID NO: 217527 - DNA, 20 bp, human
gaatgctgtgagggcggaat

SEQ ID NO: 217528 - DNA, 20 bp, human
gaaacgctcggggtctgcgg

SEQ ID NO: 217529 - DNA, 20 bp, human
ggccgcccgtccccgatctc

SEQ ID NO: 217530 - DNA, 20 bp, human
gcagaccccgagcgtttcgg

SEQ ID NO: 217531 - DNA, 20 bp, human
gcggagcctccgaaacgctc

SEQ ID NO: 217532 - DNA, 20 bp, human
gggagaaaggacttgttctt

SEQ ID NO: 217533 - DNA, 20 bp, human
ggccggagatcggggacggg

SEQ ID NO: 217534 - DNA, 20 bp, human
ggaactgggttgagtcaggg

SEQ ID NO: 217535 - DNA, 20 bp, human
gggcggaattgggggatctt

SEQ ID NO: 217536 - DNA, 20 bp, human
gagcgggtggaaaatctcga

SEQ ID NO: 217537 - DNA, 20 bp, human
gtcgccgaacaggaagaggg

SEQ ID NO: 217538 - DNA, 20 bp, human
gtgggtgggtcgtacgctta

SEQ ID NO: 217539 - DNA, 20 bp, human
ggggacgcctggccctacga

SEQ ID NO: 217540 - DNA, 20 bp, human
gggtgactgggaaaattagc

SEQ ID NO: 217541 - DNA, 20 bp, human
gaatagggagggacatagaa

SEQ ID NO: 217542 - DNA, 20 bp, human
gcagtcgccgaacaggaaga

SEQ ID NO: 217543 - DNA, 20 bp, human
gttgccccagaaggcagggc

SEQ ID NO: 217544 - DNA, 20 bp, human
gagcgccggtcggaggcggt

SEQ ID NO: 217545 - DNA, 20 bp, human
ggccgagcgaaagcctggga

SEQ ID NO: 217546 - DNA, 20 bp, human
gacgggtcgctgttcgggga

SEQ ID NO: 217547 - DNA, 20 bp, human
gctaggcggaggacgcgaga

SEQ ID NO: 217548 - DNA, 20 bp, human
gcccccgctccggaagaata

SEQ ID NO: 217549 - DNA, 20 bp, human
gtctctggcctcccccgctc

SEQ ID NO: 217550 - DNA, 20 bp, human
gtcacgcggccatattcttc

SEQ ID NO: 217551 - DNA, 20 bp, human
gtgaggtcggtgctaggcgg

SEQ ID NO: 217552 - DNA, 20 bp, human
gacgcgagagggagagcgga

SEQ ID NO: 217553 - DNA, 20 bp, human
gcctagctgaggtcggtgct

SEQ ID NO: 217554 - DNA, 20 bp, human
ggtagtcccaacggcctctc

SEQ ID NO: 217555 - DNA, 20 bp, human
gcggccatattcttccggag

SEQ ID NO: 217556 - DNA, 20 bp, human
gcggctgcgtacagtagtga

SEQ ID NO: 217557 - DNA, 20 bp, human
gcgcgcatgctcctgcggag

SEQ ID NO: 217558 - DNA, 20 bp, human
ggcgaggtaccgcagaccgc

SEQ ID NO: 217559 - DNA, 20 bp, human
gctatcgagccggcggtctg

SEQ ID NO: 217560 - DNA, 20 bp, human
ggctactgccggggcctcct

SEQ ID NO: 217561 - DNA, 20 bp, human
ggcggagaccggaagggcgg

SEQ ID NO: 217562 - DNA, 20 bp, human
gaggagcatgcgcgccaagg

SEQ ID NO: 217563 - DNA, 20 bp, human
ggcacaggttccgcttccgc

SEQ ID NO: 217564 - DNA, 20 bp, human
ggcatgctcctgcggagagg

SEQ ID NO: 217565 - DNA, 20 bp, human
gagcggtcacatgaccgtag

SEQ ID NO: 217566 - DNA, 20 bp, human
ggggccgagcggagcatccc

SEQ ID NO: 217567 - DNA, 20 bp, human
gagggagaggggtctcgcga

SEQ ID NO: 217568 - DNA, 20 bp, human
ggggtctcgcgagggtttca

SEQ ID NO: 217569 - DNA, 20 bp, human
gggaacggcctgcacggagt

SEQ ID NO: 217570 - DNA, 20 bp, human
gtgtgagcgcggtgagtgtg

SEQ ID NO: 217571 - DNA, 20 bp, human
gggacagaggcgtcgaggtg

SEQ ID NO: 217572 - DNA, 20 bp, human
ggcgcgcggcgagtgtgcac

SEQ ID NO: 217573 - DNA, 20 bp, human
gtgagcgggacagcgggaag

SEQ ID NO: 217574 - DNA, 20 bp, human
gcgggtgtgcgcgcgcgaga

SEQ ID NO: 217575 - DNA, 20 bp, human
ggcgtgagcgcacaggacag

SEQ ID NO: 217576 - DNA, 20 bp, human
gccgtccctccctaaccttg

SEQ ID NO: 217577 - DNA, 20 bp, human
ggaagcctcaaggttaggga

SEQ ID NO: 217578 - DNA, 20 bp, human
gggcgcatgcgcaccggggt

SEQ ID NO: 217579 - DNA, 20 bp, human
gccgtggaagcgctccagtc

SEQ ID NO: 217580 - DNA, 20 bp, human
ggctgtgcgcctgcgctgga

SEQ ID NO: 217581 - DNA, 20 bp, human
gcaccagtgtcagacacgcc

SEQ ID NO: 217582 - DNA, 20 bp, human
gtacgtagagatgcgcggga

SEQ ID NO: 217583 - DNA, 20 bp, human
ggtctggagccctccagcgc

SEQ ID NO: 217584 - DNA, 20 bp, human
gaacctggcgtgtctgacac

SEQ ID NO: 217585 - DNA, 20 bp, human
gtcaagaagcctcaaggtta

SEQ ID NO: 217586 - DNA, 20 bp, human
ggcggagggggcgtgctccc

SEQ ID NO: 217587 - DNA, 20 bp, human
gccctccgcgccggcgaccg

SEQ ID NO: 217588 - DNA, 20 bp, human
gcgacccgcggtcgccggcg

SEQ ID NO: 217589 - DNA, 20 bp, human
gtcgcgcatgctccgtggga

SEQ ID NO: 217590 - DNA, 20 bp, human
gtgggagagaacgcttccgg

SEQ ID NO: 217591 - DNA, 20 bp, human
gatgcgcgacccgcggtcgc

SEQ ID NO: 217592 - DNA, 20 bp, human
gacggagcatgcgcgacccg

SEQ ID NO: 217593 - DNA, 20 bp, human
ggggcgcaaccctgacaaat

SEQ ID NO: 217594 - DNA, 20 bp, human
gagagaacgcttccggcggg

SEQ ID NO: 217595 - DNA, 20 bp, human
gcgccccgagcccgcgagaa

SEQ ID NO: 217596 - DNA, 20 bp, human
gccaacgtggagaggaacac

SEQ ID NO: 217597 - DNA, 20 bp, human
gaggccgggccaacgtggag

SEQ ID NO: 217598 - DNA, 20 bp, human
ggacctgagcggagagtcct

SEQ ID NO: 217599 - DNA, 20 bp, human
gcctccttcgctctacaaat

SEQ ID NO: 217600 - DNA, 20 bp, human
ggaaggaggccgggccaacg

SEQ ID NO: 217601 - DNA, 20 bp, human
gctcggcggaaggagacggt

SEQ ID NO: 217602 - DNA, 20 bp, human
gagcaagcaggtgtcaacag

SEQ ID NO: 217603 - DNA, 20 bp, human
ggtggcgtgggcgggacaga

SEQ ID NO: 217604 - DNA, 20 bp, human
gtgggcgggacagacggcgg

SEQ ID NO: 217605 - DNA, 20 bp, human
gagcaggtgtcaacaggggt

SEQ ID NO: 217606 - DNA, 20 bp, human
gggccggggagcgacgctct

SEQ ID NO: 217607 - DNA, 20 bp, human
ggcgcggcgtcagcgctcgg

SEQ ID NO: 217608 - DNA, 20 bp, human
ggaggagcgagcagccggga

SEQ ID NO: 217609 - DNA, 20 bp, human
gcggccggaagcggtctcgt

SEQ ID NO: 217610 - DNA, 20 bp, human
gtccggccgcagccacggcg

SEQ ID NO: 217611 - DNA, 20 bp, human
ggaagccggccagcccttcc

SEQ ID NO: 217612 - DNA, 20 bp, human
gaaggcgcgaggagctgact

SEQ ID NO: 217613 - DNA, 20 bp, human
ggcgtcagcgctcggcggcc

SEQ ID NO: 217614 - DNA, 20 bp, human
gccagctctccccgaccgca

SEQ ID NO: 217615 - DNA, 20 bp, human
gcagcgccccgccgtggctg

SEQ ID NO: 217616 - DNA, 20 bp, human
ggcggcgaagcatctggcta

SEQ ID NO: 217617 - DNA, 20 bp, human
gccccgcgccgcatccgcgt

SEQ ID NO: 217618 - DNA, 20 bp, human
gtccctcgggaattttgtcc

SEQ ID NO: 217619 - DNA, 20 bp, human
ggcgactgccgaacaggctt

SEQ ID NO: 217620 - DNA, 20 bp, human
gggcgccgcgactgccgaac

SEQ ID NO: 217621 - DNA, 20 bp, human
ggcgggagcggcgaagcatc

SEQ ID NO: 217622 - DNA, 20 bp, human
ggcacggatcgagaaccttg

SEQ ID NO: 217623 - DNA, 20 bp, human
ggccgggacaaaattcccga

SEQ ID NO: 217624 - DNA, 20 bp, human
gcaaaattcccgagggacgt

SEQ ID NO: 217625 - DNA, 20 bp, human
gagcccacgcggatgcggcg

SEQ ID NO: 217626 - DNA, 20 bp, human
gccgcaccgggacaaaactc

SEQ ID NO: 217627 - DNA, 20 bp, human
gtggtgaagcgtctgggtac

SEQ ID NO: 217628 - DNA, 20 bp, human
gcggcgggaaccggggtgag

SEQ ID NO: 217629 - DNA, 20 bp, human
gcaccgggacaaaactccgg

SEQ ID NO: 217630 - DNA, 20 bp, human
gcccctccggagttttgtcc

SEQ ID NO: 217631 - DNA, 20 bp, human
gtcccggcccgcagccgcgt

SEQ ID NO: 217632 - DNA, 20 bp, human
gggggcgtggtgaagcgtct

SEQ ID NO: 217633 - DNA, 20 bp, human
gttaggagcgtgctccgggg

SEQ ID NO: 217634 - DNA, 20 bp, human
gctccggggtggtgccgacg

SEQ ID NO: 217635 - DNA, 20 bp, human
gagccgcgtcggcaccaccc

SEQ ID NO: 217636 - DNA, 20 bp, human
ggaagaagaccccctccctc

SEQ ID NO: 217637 - DNA, 20 bp, human
gagggccaggggcgtgtaca

SEQ ID NO: 217638 - DNA, 20 bp, human
gtctggtcgtcctgagggag

SEQ ID NO: 217639 - DNA, 20 bp, human
ggggctgctactggtgggta

SEQ ID NO: 217640 - DNA, 20 bp, human
gcgcacatggggttcaggcg

SEQ ID NO: 217641 - DNA, 20 bp, human
gtggtggggctgctactggt

SEQ ID NO: 217642 - DNA, 20 bp, human
gtggggccagggccgagctt

SEQ ID NO: 217643 - DNA, 20 bp, human
gcggtgttggtgagggcatc

SEQ ID NO: 217644 - DNA, 20 bp, human
gaggcgcccaagctcggccc

SEQ ID NO: 217645 - DNA, 20 bp, human
gtcaggcgtggagattggtg

SEQ ID NO: 217646 - DNA, 20 bp, human
gtaacggccatgcgccctgt

SEQ ID NO: 217647 - DNA, 20 bp, human
gtcaagggggcatctggcat

SEQ ID NO: 217648 - DNA, 20 bp, human
gctggcttgcgtcaggaagg

SEQ ID NO: 217649 - DNA, 20 bp, human
ggggcgcatggccgttaaac

SEQ ID NO: 217650 - DNA, 20 bp, human
gggtagagagtccctctcaa

SEQ ID NO: 217651 - DNA, 20 bp, human
ggggccctggcgcctcacac

SEQ ID NO: 217652 - DNA, 20 bp, human
ggccagatgcccccttgaga

SEQ ID NO: 217653 - DNA, 20 bp, human
gctgggctccccgacaccca

SEQ ID NO: 217654 - DNA, 20 bp, human
ggggtcggcaggggagaacc

SEQ ID NO: 217655 - DNA, 20 bp, human
gcccaggcctggcttgcgtc

SEQ ID NO: 217656 - DNA, 20 bp, human
gactccctcggcgaacccgc

SEQ ID NO: 217657 - DNA, 20 bp, human
gcctcccgcgggttcgccga

SEQ ID NO: 217658 - DNA, 20 bp, human
gagggccaaaatgactccct

SEQ ID NO: 217659 - DNA, 20 bp, human
gaggcggaaccattgcaccg

SEQ ID NO: 217660 - DNA, 20 bp, human
ggcgcaaggggcggagttta

SEQ ID NO: 217661 - DNA, 20 bp, human
gcgcggacggtgagccgaga

SEQ ID NO: 217662 - DNA, 20 bp, human
ggaaagccaacccgggagtt

SEQ ID NO: 217663 - DNA, 20 bp, human
gcaatggttccgcctcccgc

SEQ ID NO: 217664 - DNA, 20 bp, human
gttaaagaggggctagccta

SEQ ID NO: 217665 - DNA, 20 bp, human
gttcgccgagggagtcattt

SEQ ID NO: 217666 - DNA, 20 bp, human
ggaaaggagtggcactgcta

SEQ ID NO: 217667 - DNA, 20 bp, human
gaggcggtgcggcgagagga

SEQ ID NO: 217668 - DNA, 20 bp, human
gagggggcaaggtctacagg

SEQ ID NO: 217669 - DNA, 20 bp, human
ggcactgctaggggcacagc

SEQ ID NO: 217670 - DNA, 20 bp, human
ggaagtgacgtcgtgtgggg

SEQ ID NO: 217671 - DNA, 20 bp, human
gacagtgagacactgggcca

SEQ ID NO: 217672 - DNA, 20 bp, human
gggcggaagtgacgtcgtgt

SEQ ID NO: 217673 - DNA, 20 bp, human
gaagactccgagaggcggtg

SEQ ID NO: 217674 - DNA, 20 bp, human
ggggcccccactccacagca

SEQ ID NO: 217675 - DNA, 20 bp, human
gagcgtcctggcaactgaca

SEQ ID NO: 217676 - DNA, 20 bp, human
gagaatccgatcctccccat

SEQ ID NO: 217677 - DNA, 20 bp, human
gtgtctgtcagccaatgggg

SEQ ID NO: 217678 - DNA, 20 bp, human
ggggaggatcggattctggc

SEQ ID NO: 217679 - DNA, 20 bp, human
gtctccgaaagccacgccag

SEQ ID NO: 217680 - DNA, 20 bp, human
gccccaccccccattctcta

SEQ ID NO: 217681 - DNA, 20 bp, human
ggcttgtctgtcagccaatg

SEQ ID NO: 217682 - DNA, 20 bp, human
gccccattctctaaggaatg

SEQ ID NO: 217683 - DNA, 20 bp, human
gtccttagagaatggggggt

SEQ ID NO: 217684 - DNA, 20 bp, human
gggcagaaataattttctga

SEQ ID NO: 217685 - DNA, 20 bp, human
gagccatggcatccgacctg

SEQ ID NO: 217686 - DNA, 20 bp, human
gtcaccctcactgacgacgg

SEQ ID NO: 217687 - DNA, 20 bp, human
ggggccgccgtcgtcagtga

SEQ ID NO: 217688 - DNA, 20 bp, human
gcggagagacagagcgggaa

SEQ ID NO: 217689 - DNA, 20 bp, human
gcccgcgccatcttgaccga

SEQ ID NO: 217690 - DNA, 20 bp, human
ggggagagtcaagaggggaa

SEQ ID NO: 217691 - DNA, 20 bp, human
gggatggggagagtcaagag

SEQ ID NO: 217692 - DNA, 20 bp, human
gcggcggccccttatggaga

SEQ ID NO: 217693 - DNA, 20 bp, human
gggagaaggaacggaaatag

SEQ ID NO: 217694 - DNA, 20 bp, human
gcccccgccgagggcctgtg

SEQ ID NO: 217695 - DNA, 20 bp, human
ggccccgcacaggccctcgg

SEQ ID NO: 217696 - DNA, 20 bp, human
ggaacccctagccacaagtc

SEQ ID NO: 217697 - DNA, 20 bp, human
gtgtacgcggtcctgacttg

SEQ ID NO: 217698 - DNA, 20 bp, human
gcggtcctgacttgtggcta

SEQ ID NO: 217699 - DNA, 20 bp, human
ggggtggggtacagctccta

SEQ ID NO: 217700 - DNA, 20 bp, human
gtcctcggaacgcgttcctc

SEQ ID NO: 217701 - DNA, 20 bp, human
gcttgtggctaggggttcct

SEQ ID NO: 217702 - DNA, 20 bp, human
gagcggacgtagggcgggtg

SEQ ID NO: 217703 - DNA, 20 bp, human
ggcctccggaagcggacgta

SEQ ID NO: 217704 - DNA, 20 bp, human
ggcgcggtgacgcaggacgg

SEQ ID NO: 217705 - DNA, 20 bp, human
gagatggcggcgcgtcacgt

SEQ ID NO: 217706 - DNA, 20 bp, human
ggggaggggcgccagaagga

SEQ ID NO: 217707 - DNA, 20 bp, human
ggggcgggaagcagttctgg

SEQ ID NO: 217708 - DNA, 20 bp, human
gagaaggcgggtcttcggca

SEQ ID NO: 217709 - DNA, 20 bp, human
gcgagtcaggtgattccgtc

SEQ ID NO: 217710 - DNA, 20 bp, human
gtcccggggagccaaggggt

SEQ ID NO: 217711 - DNA, 20 bp, human
ggggcgctcatgattggaca

SEQ ID NO: 217712 - DNA, 20 bp, human
ggaaggcaagaaggggcgtg

SEQ ID NO: 217713 - DNA, 20 bp, human
ggaaggggcgtgtgggtgaa

SEQ ID NO: 217714 - DNA, 20 bp, human
gattggacaaggagcccgaa

SEQ ID NO: 217715 - DNA, 20 bp, human
gggagaagaaggcgggtctt

SEQ ID NO: 217716 - DNA, 20 bp, human
gccaaggcggggccgaaggc

SEQ ID NO: 217717 - DNA, 20 bp, human
gggcactggtgatgcaagtt

SEQ ID NO: 217718 - DNA, 20 bp, human
gcgaacggagcggaggaagg

SEQ ID NO: 217719 - DNA, 20 bp, human
gccgttcggccggttctccc

SEQ ID NO: 217720 - DNA, 20 bp, human
gcagcctgagggctataaaa

SEQ ID NO: 217721 - DNA, 20 bp, human
gaaccggccgaacggagcgg

SEQ ID NO: 217722 - DNA, 20 bp, human
ggagaaccggccgaacggag

SEQ ID NO: 217723 - DNA, 20 bp, human
ggccgaaggcgggtggagag

SEQ ID NO: 217724 - DNA, 20 bp, human
gaggctgggggaacgcgcct

SEQ ID NO: 217725 - DNA, 20 bp, human
gactccgtgttgccagtccc

SEQ ID NO: 217726 - DNA, 20 bp, human
gtaaacggttggggcgtcaa

SEQ ID NO: 217727 - DNA, 20 bp, human
gtgcgctgacaccggaagcg

SEQ ID NO: 217728 - DNA, 20 bp, human
ggcggggaaaggtcgttttc

SEQ ID NO: 217729 - DNA, 20 bp, human
ggctcagggccctagatggg

SEQ ID NO: 217730 - DNA, 20 bp, human
ggggagggaagggagcgggc

SEQ ID NO: 217731 - DNA, 20 bp, human
gccgcccactgcgctgacac

SEQ ID NO: 217732 - DNA, 20 bp, human
gcttccggtgtcagcgcagt

SEQ ID NO: 217733 - DNA, 20 bp, human
gccggcggcgaaggaaagaa

SEQ ID NO: 217734 - DNA, 20 bp, human
ggccctgggcataaacggtt

SEQ ID NO: 217735 - DNA, 20 bp, human
gggttggggcgtcaaaggga

SEQ ID NO: 217736 - DNA, 20 bp, human
gggtctgcgggaagagaatg

SEQ ID NO: 217737 - DNA, 20 bp, human
gaccccggagccacaaggag

SEQ ID NO: 217738 - DNA, 20 bp, human
ggtcggatccccagctgaga

SEQ ID NO: 217739 - DNA, 20 bp, human
ggactctgagaaaccctcgt

SEQ ID NO: 217740 - DNA, 20 bp, human
gacccggctgcctcccggtt

SEQ ID NO: 217741 - DNA, 20 bp, human
gccctgatccccaggaggag

SEQ ID NO: 217742 - DNA, 20 bp, human
gccctcgcgcggccccaacc

SEQ ID NO: 217743 - DNA, 20 bp, human
ggctggatcctcaaaatcac

SEQ ID NO: 217744 - DNA, 20 bp, human
gggcggggcgcggaaggatc

SEQ ID NO: 217745 - DNA, 20 bp, human
ggctggatccccggctcaga

SEQ ID NO: 217746 - DNA, 20 bp, human
gtgttttatggggaaggcgg

SEQ ID NO: 217747 - DNA, 20 bp, human
gcgtaacgctgacgagacgg

SEQ ID NO: 217748 - DNA, 20 bp, human
gcgagggatttgtacgacac

SEQ ID NO: 217749 - DNA, 20 bp, human
gtctgtcccgctgttttatg

SEQ ID NO: 217750 - DNA, 20 bp, human
gctccgtaacgctgacgaga

SEQ ID NO: 217751 - DNA, 20 bp, human
gagtcctgaaaactccaaaa

SEQ ID NO: 217752 - DNA, 20 bp, human
gccacgctgtggcattaaga

SEQ ID NO: 217753 - DNA, 20 bp, human
ggtcgtacaaatccctcgtg

SEQ ID NO: 217754 - DNA, 20 bp, human
gagccataatgttcagaaag

SEQ ID NO: 217755 - DNA, 20 bp, human
gaactacttttgccgcacga

SEQ ID NO: 217756 - DNA, 20 bp, human
ggcacgtgaatcaacagatg

SEQ ID NO: 217757 - DNA, 20 bp, human
gcagatgcggatgactgtgt

SEQ ID NO: 217758 - DNA, 20 bp, human
gactgtgtaggcgggcccaa

SEQ ID NO: 217759 - DNA, 20 bp, human
gctcccaggcgctttatcac

SEQ ID NO: 217760 - DNA, 20 bp, human
gacccaggtctcttactggt

SEQ ID NO: 217761 - DNA, 20 bp, human
gcaactgattagttggtgat

SEQ ID NO: 217762 - DNA, 20 bp, human
gagggtctgcgcaagatgtt

SEQ ID NO: 217763 - DNA, 20 bp, human
gggaaccgtctcctggttgg

SEQ ID NO: 217764 - DNA, 20 bp, human
gtaccgaccagtaagagacc

SEQ ID NO: 217765 - DNA, 20 bp, human
gctgctgctgtgctcccatt

SEQ ID NO: 217766 - DNA, 20 bp, human
gggaagggcgagatccgtgg

SEQ ID NO: 217767 - DNA, 20 bp, human
gaaggggccgggcttactgt

SEQ ID NO: 217768 - DNA, 20 bp, human
ggaaagcggccgagaggcgg

SEQ ID NO: 217769 - DNA, 20 bp, human
gagaagtcatgggtccgcgg

SEQ ID NO: 217770 - DNA, 20 bp, human
gtgggggctgagttggaaag

SEQ ID NO: 217771 - DNA, 20 bp, human
gggggctccgggaaaagaag

SEQ ID NO: 217772 - DNA, 20 bp, human
gttggaaagcggccgagagg

SEQ ID NO: 217773 - DNA, 20 bp, human
gaactctcgcgagaagtcat

SEQ ID NO: 217774 - DNA, 20 bp, human
ggccgggcttactgtgggca

SEQ ID NO: 217775 - DNA, 20 bp, human
ggggactggccagagttgaa

SEQ ID NO: 217776 - DNA, 20 bp, human
gaatatgggcggggctccgg

SEQ ID NO: 217777 - DNA, 20 bp, human
gctcctgcgtggaaaagaga

SEQ ID NO: 217778 - DNA, 20 bp, human
gacggccccggcgcgtgcaa

SEQ ID NO: 217779 - DNA, 20 bp, human
gggctagtccttgagcttat

SEQ ID NO: 217780 - DNA, 20 bp, human
ggaaaagagaaggaagcccg

SEQ ID NO: 217781 - DNA, 20 bp, human
gagacgcagcgccaccacct

SEQ ID NO: 217782 - DNA, 20 bp, human
ggctgatagcacagtgggcg

SEQ ID NO: 217783 - DNA, 20 bp, human
gtttgtgagcgccctctatg

SEQ ID NO: 217784 - DNA, 20 bp, human
gggtacatagcacgaccccc

SEQ ID NO: 217785 - DNA, 20 bp, human
gattggccccgcctcctgcg

SEQ ID NO: 217786 - DNA, 20 bp, human
gcaggctgacaaagtgggag

SEQ ID NO: 217787 - DNA, 20 bp, human
gctctgtaactgctaatatg

SEQ ID NO: 217788 - DNA, 20 bp, human
gtaactgctaatatgtggca

SEQ ID NO: 217789 - DNA, 20 bp, human
gcacaaaagtgtaattaaga

SEQ ID NO: 217790 - DNA, 20 bp, human
gattgcaagacgggattcac

SEQ ID NO: 217791 - DNA, 20 bp, human
gaaagtctgtattgcaagac

SEQ ID NO: 217792 - DNA, 20 bp, human
gatgtttgctctgtgtgatt

SEQ ID NO: 217793 - DNA, 20 bp, human
ggcatggatttcaagttgtt

SEQ ID NO: 217794 - DNA, 20 bp, human
gtttcaagttgtttgggatc

SEQ ID NO: 217795 - DNA, 20 bp, human
gaaaagttaaaccttgctca

SEQ ID NO: 217796 - DNA, 20 bp, human
gggaaatggaagtaggctga

SEQ ID NO: 217797 - DNA, 20 bp, human
gcggggcgaagggtcgcgag

SEQ ID NO: 217798 - DNA, 20 bp, human
gctagctggctgtgcctgac

SEQ ID NO: 217799 - DNA, 20 bp, human
gaggcacagccagctagagt

SEQ ID NO: 217800 - DNA, 20 bp, human
gcgcctggggttcgcctccg

SEQ ID NO: 217801 - DNA, 20 bp, human
ggcccacggaggcgaacccc

SEQ ID NO: 217802 - DNA, 20 bp, human
gtgaccggaagaagcgccca

SEQ ID NO: 217803 - DNA, 20 bp, human
gcagccagctagagtgggcg

SEQ ID NO: 217804 - DNA, 20 bp, human
ggaagggtcgcgaggggaaa

SEQ ID NO: 217805 - DNA, 20 bp, human
ggtaggctgaggggcgcctg

SEQ ID NO: 217806 - DNA, 20 bp, human
gaggccgcggacctgactga

SEQ ID NO: 217807 - DNA, 20 bp, human
gagagctgcccgccaggcga

SEQ ID NO: 217808 - DNA, 20 bp, human
gctgcccgccaggcgagggg

SEQ ID NO: 217809 - DNA, 20 bp, human
gccttggcgggggtggtcgc

SEQ ID NO: 217810 - DNA, 20 bp, human
gcgcaggccggtgacgtgat

SEQ ID NO: 217811 - DNA, 20 bp, human
ggcgcggccgatcacgtcac

SEQ ID NO: 217812 - DNA, 20 bp, human
gccgtggcggacctgactga

SEQ ID NO: 217813 - DNA, 20 bp, human
gtgagacccaggccgggact

SEQ ID NO: 217814 - DNA, 20 bp, human
gaccctacggaactgaatga

SEQ ID NO: 217815 - DNA, 20 bp, human
gtggcgggggtggtcgcggg

SEQ ID NO: 217816 - DNA, 20 bp, human
gtccgagccagcggcctaac

SEQ ID NO: 217817 - DNA, 20 bp, human
gacctcgggagaggagcggt

SEQ ID NO: 217818 - DNA, 20 bp, human
gctgggcggggcaggcacta

SEQ ID NO: 217819 - DNA, 20 bp, human
gcacactccagttaggccgc

SEQ ID NO: 217820 - DNA, 20 bp, human
ggcaaaggaggcgccggagt

SEQ ID NO: 217821 - DNA, 20 bp, human
gtctccagggagcgtcgcaa

SEQ ID NO: 217822 - DNA, 20 bp, human
ggcgctcccgagccgtcggg

SEQ ID NO: 217823 - DNA, 20 bp, human
gcgactacagacctcgggag

SEQ ID NO: 217824 - DNA, 20 bp, human
ggggccccgggaagtctcca

SEQ ID NO: 217825 - DNA, 20 bp, human
gccctcgcccggatcagcgg

SEQ ID NO: 217826 - DNA, 20 bp, human
gggaaccggcgactgcacag

SEQ ID NO: 217827 - DNA, 20 bp, human
gccaacccggctgggtgggt

SEQ ID NO: 217828 - DNA, 20 bp, human
ggcggcctctgtgcagtcgc

SEQ ID NO: 217829 - DNA, 20 bp, human
ggcgggcgctgacgcggaag

SEQ ID NO: 217830 - DNA, 20 bp, human
gcgcggggcgggcgctgacg

SEQ ID NO: 217831 - DNA, 20 bp, human
gaggagggcccaacccggct

SEQ ID NO: 217832 - DNA, 20 bp, human
ggggcccaacccggctgggt

SEQ ID NO: 217833 - DNA, 20 bp, human
gccgccacggcgcgcaacag

SEQ ID NO: 217834 - DNA, 20 bp, human
ggatgaaccgcaggtagccg

SEQ ID NO: 217835 - DNA, 20 bp, human
ggaagtcgggagcgaaaaag

SEQ ID NO: 217836 - DNA, 20 bp, human
ggggcaacaggtcccgaagc

SEQ ID NO: 217837 - DNA, 20 bp, human
ggattctgggaaaacggaat

SEQ ID NO: 217838 - DNA, 20 bp, human
gggacaggaacacgcggcgg

SEQ ID NO: 217839 - DNA, 20 bp, human
gtgcccgggacaggaacacg

SEQ ID NO: 217840 - DNA, 20 bp, human
gcggaaaaacaacagtgccc

SEQ ID NO: 217841 - DNA, 20 bp, human
gggggagagttatattagag

SEQ ID NO: 217842 - DNA, 20 bp, human
gtcctggcccagaatgcacc

SEQ ID NO: 217843 - DNA, 20 bp, human
gcagcagatgacattttgtt

SEQ ID NO: 217844 - DNA, 20 bp, human
gcggaatgggagcggaataa

SEQ ID NO: 217845 - DNA, 20 bp, human
gcaacaggtcccgaagcagg

SEQ ID NO: 217846 - DNA, 20 bp, human
gggaagcgtcagctgcagag

SEQ ID NO: 217847 - DNA, 20 bp, human
ggggcccggacgcccccaag

SEQ ID NO: 217848 - DNA, 20 bp, human
gcggcgctgggccttgcgca

SEQ ID NO: 217849 - DNA, 20 bp, human
gtgcagagaggtggccgctt

SEQ ID NO: 217850 - DNA, 20 bp, human
gtcacccgaagcacgggctc

SEQ ID NO: 217851 - DNA, 20 bp, human
ggagcgccctgcgtaggcac

SEQ ID NO: 217852 - DNA, 20 bp, human
gagtgacgccagcctgtagc

SEQ ID NO: 217853 - DNA, 20 bp, human
ggaagcacgggctcaggagc

SEQ ID NO: 217854 - DNA, 20 bp, human
ggacgcttccggctacaggc

SEQ ID NO: 217855 - DNA, 20 bp, human
gaggagccggtgcctacgca

SEQ ID NO: 217856 - DNA, 20 bp, human
gggcggcggcggggaatccc

SEQ ID NO: 217857 - DNA, 20 bp, human
gaggaccgaaggccgacgcc

SEQ ID NO: 217858 - DNA, 20 bp, human
gacggcctgggaagcaccag

SEQ ID NO: 217859 - DNA, 20 bp, human
gcggagcgctccacccgcgt

SEQ ID NO: 217860 - DNA, 20 bp, human
gctttggcggggaggaccga

SEQ ID NO: 217861 - DNA, 20 bp, human
gggccccggcggttcagacc

SEQ ID NO: 217862 - DNA, 20 bp, human
gtccccgccaaagccctctt

SEQ ID NO: 217863 - DNA, 20 bp, human
ggtgggggaagcctccccgg

SEQ ID NO: 217864 - DNA, 20 bp, human
gcgcgtgggggaagcctccc

SEQ ID NO: 217865 - DNA, 20 bp, human
ggaggcttcccccacgcggg

SEQ ID NO: 217866 - DNA, 20 bp, human
ggggctctctgcatgatata

SEQ ID NO: 217867 - DNA, 20 bp, human
gcgggcgcgaaaaagggact

SEQ ID NO: 217868 - DNA, 20 bp, human
gcccctacgctcactgtcat

SEQ ID NO: 217869 - DNA, 20 bp, human
ggagccttcgggcgcgaaaa

SEQ ID NO: 217870 - DNA, 20 bp, human
gacagtgagcgtagggggcg

SEQ ID NO: 217871 - DNA, 20 bp, human
gaagggcgaggcctactgat

SEQ ID NO: 217872 - DNA, 20 bp, human
gcctgtagaggggaggttaa

SEQ ID NO: 217873 - DNA, 20 bp, human
gctggcgcctagagaagcgg

SEQ ID NO: 217874 - DNA, 20 bp, human
gggcctggcgcctagagaag

SEQ ID NO: 217875 - DNA, 20 bp, human
gccaggtgccggcccctcaa

SEQ ID NO: 217876 - DNA, 20 bp, human
gggcgactggagccgaccgg

SEQ ID NO: 217877 - DNA, 20 bp, human
gcggctccagtcgcctccgg

SEQ ID NO: 217878 - DNA, 20 bp, human
ggcgggggctggagcagttc

SEQ ID NO: 217879 - DNA, 20 bp, human
gagggggcggcaccgccggt

SEQ ID NO: 217880 - DNA, 20 bp, human
ggaggggcggcccccgagaa

SEQ ID NO: 217881 - DNA, 20 bp, human
gcggcccccgagaagggcta

SEQ ID NO: 217882 - DNA, 20 bp, human
gagcccctagcccttctcgg

SEQ ID NO: 217883 - DNA, 20 bp, human
gcggaagtgacgccacactg

SEQ ID NO: 217884 - DNA, 20 bp, human
gggaggcgactggagccgac

SEQ ID NO: 217885 - DNA, 20 bp, human
gtccagtcgcctccggagga

SEQ ID NO: 217886 - DNA, 20 bp, human
gggcacgtgacgtgagaaag

SEQ ID NO: 217887 - DNA, 20 bp, human
gtgcctgcgcaatgggtgtc

SEQ ID NO: 217888 - DNA, 20 bp, human
gtggccccctcctgtcgggg

SEQ ID NO: 217889 - DNA, 20 bp, human
ggacccgacacccattgcgc

SEQ ID NO: 217890 - DNA, 20 bp, human
gtcagtgttacgcttccgga

SEQ ID NO: 217891 - DNA, 20 bp, human
gtgcgcatgtgtgactagaa

SEQ ID NO: 217892 - DNA, 20 bp, human
gtgtaggcgtgcgcccaatg

SEQ ID NO: 217893 - DNA, 20 bp, human
ggttacgcttccggaaggag

SEQ ID NO: 217894 - DNA, 20 bp, human
ggacgcctccccgacaggag

SEQ ID NO: 217895 - DNA, 20 bp, human
gaggacagacagctcgcaga

SEQ ID NO: 217896 - DNA, 20 bp, human
gaacgaggaaggccggtgat

SEQ ID NO: 217897 - DNA, 20 bp, human
gcgcgcgacgggaaaagaaa

SEQ ID NO: 217898 - DNA, 20 bp, human
gaacgcccgcctcacgtcgc

SEQ ID NO: 217899 - DNA, 20 bp, human
gctaggggccaagtctgtga

SEQ ID NO: 217900 - DNA, 20 bp, human
gcccagaggcgccgcgcgac

SEQ ID NO: 217901 - DNA, 20 bp, human
gaaagaaaagggaacgagga

SEQ ID NO: 217902 - DNA, 20 bp, human
gaaaagggaacgaggaaggc

SEQ ID NO: 217903 - DNA, 20 bp, human
ggctgggacagcgaaatgga

SEQ ID NO: 217904 - DNA, 20 bp, human
gcgcctcacgtcgccggctc

SEQ ID NO: 217905 - DNA, 20 bp, human
ggggccccgaaagccacgta

SEQ ID NO: 217906 - DNA, 20 bp, human
ggggtcgtgtcgtgggacga

SEQ ID NO: 217907 - DNA, 20 bp, human
gcgggccgacgcgagccccg

SEQ ID NO: 217908 - DNA, 20 bp, human
gcgcgcgagcggaaatacgc

SEQ ID NO: 217909 - DNA, 20 bp, human
gcggccgtacgccaaaatgg

SEQ ID NO: 217910 - DNA, 20 bp, human
gcggcatggggtcgtgtcgt

SEQ ID NO: 217911 - DNA, 20 bp, human
ggcaggcggcgaagacgata

SEQ ID NO: 217912 - DNA, 20 bp, human
gcctgcgccggcacacctat

SEQ ID NO: 217913 - DNA, 20 bp, human
gggcgccctgcgggcggcat

SEQ ID NO: 217914 - DNA, 20 bp, human
gatggcacacagtgtcccgt

SEQ ID NO: 217915 - DNA, 20 bp, human
ggctcggcgcgcccatgtcg

SEQ ID NO: 217916 - DNA, 20 bp, human
gtgctgcattggtggattag

SEQ ID NO: 217917 - DNA, 20 bp, human
gagcgatagcagcggcgtaa

SEQ ID NO: 217918 - DNA, 20 bp, human
ggcaagggcgtgatgctgca

SEQ ID NO: 217919 - DNA, 20 bp, human
ggataaagtaagcatagcag

SEQ ID NO: 217920 - DNA, 20 bp, human
ggcggcttggggtggcgaac

SEQ ID NO: 217921 - DNA, 20 bp, human
gggttctgcgcttgctgcat

SEQ ID NO: 217922 - DNA, 20 bp, human
ggaggcggttcctcttacta

SEQ ID NO: 217923 - DNA, 20 bp, human
gccccggccaccgtagtaag

SEQ ID NO: 217924 - DNA, 20 bp, human
gccggaagtggctgatctgt

SEQ ID NO: 217925 - DNA, 20 bp, human
ggatacgaaagccttgcgat

SEQ ID NO: 217926 - DNA, 20 bp, human
gcctccgataagggcctgaa

SEQ ID NO: 217927 - DNA, 20 bp, human
gtcctggcggtgtgataagg

SEQ ID NO: 217928 - DNA, 20 bp, human
ggctctgctgcctccgataa

SEQ ID NO: 217929 - DNA, 20 bp, human
gaggccgcgggaaggcgtcg

SEQ ID NO: 217930 - DNA, 20 bp, human
gcgctcctggcggtgtgata

SEQ ID NO: 217931 - DNA, 20 bp, human
gggtgtgataaggagggcgg

SEQ ID NO: 217932 - DNA, 20 bp, human
gcctgccaggaggtcagtcc

SEQ ID NO: 217933 - DNA, 20 bp, human
gaaaccccgacgccttcccg

SEQ ID NO: 217934 - DNA, 20 bp, human
gagcccgcgcaggtgcactc

SEQ ID NO: 217935 - DNA, 20 bp, human
ggggcccaggactgacctcc

SEQ ID NO: 217936 - DNA, 20 bp, human
gaatacaaccggcaacgctg

SEQ ID NO: 217937 - DNA, 20 bp, human
gtccgggcgccgagggtgac

SEQ ID NO: 217938 - DNA, 20 bp, human
gccgagggtgactggacttg

SEQ ID NO: 217939 - DNA, 20 bp, human
ggcggagttcggaccacgtg

SEQ ID NO: 217940 - DNA, 20 bp, human
ggacttgtggtgcgctgcca

SEQ ID NO: 217941 - DNA, 20 bp, human
gttaggcagaacacggaggg

SEQ ID NO: 217942 - DNA, 20 bp, human
gggtctcgtgacgtcatctc

SEQ ID NO: 217943 - DNA, 20 bp, human
gtgctgggttaggcagaaca

SEQ ID NO: 217944 - DNA, 20 bp, human
gttcaagcgtactgccccgt

SEQ ID NO: 217945 - DNA, 20 bp, human
ggaacacggagggcggagtt

SEQ ID NO: 217946 - DNA, 20 bp, human
gcgcgtgcgcaaaggagcag

SEQ ID NO: 217947 - DNA, 20 bp, human
gaggagggcggggcatcagg

SEQ ID NO: 217948 - DNA, 20 bp, human
ggggaggaacttgagtcgtg

SEQ ID NO: 217949 - DNA, 20 bp, human
gacgcccccgggggaagcga

SEQ ID NO: 217950 - DNA, 20 bp, human
gaagcggcgcgcgtgcgcaa

SEQ ID NO: 217951 - DNA, 20 bp, human
gccctagcaccgagctaagt

SEQ ID NO: 217952 - DNA, 20 bp, human
gaggaacttgagtcgtgagg

SEQ ID NO: 217953 - DNA, 20 bp, human
gggggcggtgacgcccccgg

SEQ ID NO: 217954 - DNA, 20 bp, human
gtagcaccgagctaagtggg

SEQ ID NO: 217955 - DNA, 20 bp, human
gctctccatcgcttcccccg

SEQ ID NO: 217956 - DNA, 20 bp, human
gcccacgtagagcacactat

SEQ ID NO: 217957 - DNA, 20 bp, human
ggagcagcgaagaggacaac

SEQ ID NO: 217958 - DNA, 20 bp, human
gaagacgcaccaaacgtccc

SEQ ID NO: 217959 - DNA, 20 bp, human
ggggactaaagtctcgaggc

SEQ ID NO: 217960 - DNA, 20 bp, human
ggtgtgctctacgtggggcg

SEQ ID NO: 217961 - DNA, 20 bp, human
gggacgggactaaagtctcg

SEQ ID NO: 217962 - DNA, 20 bp, human
gtcgctgctccgtagtgacg

SEQ ID NO: 217963 - DNA, 20 bp, human
gacggggggcggagacacaa

SEQ ID NO: 217964 - DNA, 20 bp, human
ggcgggtcttggacagtcag

SEQ ID NO: 217965 - DNA, 20 bp, human
ggagcggctcgcaagtcctc

SEQ ID NO: 217966 - DNA, 20 bp, human
gagaggggcatcagtttaag

SEQ ID NO: 217967 - DNA, 20 bp, human
gacctgaggccaaatccctc

SEQ ID NO: 217968 - DNA, 20 bp, human
ggggcatcagtttaagagga

SEQ ID NO: 217969 - DNA, 20 bp, human
gctcatctcaatgtgctctt

SEQ ID NO: 217970 - DNA, 20 bp, human
gccctgagggatttggcctc

SEQ ID NO: 217971 - DNA, 20 bp, human
gggggtgtgagtgatcagac

SEQ ID NO: 217972 - DNA, 20 bp, human
ggcaaaatcgtgttagagcc

SEQ ID NO: 217973 - DNA, 20 bp, human
ggtctgaagatggagataat

SEQ ID NO: 217974 - DNA, 20 bp, human
ggatcactcacaccccttcc

SEQ ID NO: 217975 - DNA, 20 bp, human
gatcgtgttagagccaggtg

SEQ ID NO: 217976 - DNA, 20 bp, human
ggctgccagcggggaccgag

SEQ ID NO: 217977 - DNA, 20 bp, human
gcccccggacgcgacccacg

SEQ ID NO: 217978 - DNA, 20 bp, human
ggccgcgtgggtcgcgtccg

SEQ ID NO: 217979 - DNA, 20 bp, human
ggcgccaccaggaaggtccg

SEQ ID NO: 217980 - DNA, 20 bp, human
gcccgagctgcgtcccgggg

SEQ ID NO: 217981 - DNA, 20 bp, human
gggggcgggacgtggactcg

SEQ ID NO: 217982 - DNA, 20 bp, human
gccacgcggccgctgccagc

SEQ ID NO: 217983 - DNA, 20 bp, human
gtccgcggtccccgccccga

SEQ ID NO: 217984 - DNA, 20 bp, human
gtcccggggcggctgtgggt

SEQ ID NO: 217985 - DNA, 20 bp, human
gcggggaccgcggaccttcc

SEQ ID NO: 217986 - DNA, 20 bp, human
gccggggctgaagggaacgg

SEQ ID NO: 217987 - DNA, 20 bp, human
gtctgcctggcgcgcctggg

SEQ ID NO: 217988 - DNA, 20 bp, human
gctgaagggaacggcgggat

SEQ ID NO: 217989 - DNA, 20 bp, human
ggcgcctgggcggagtgctt

SEQ ID NO: 217990 - DNA, 20 bp, human
gaccacgtgcgcaggtagga

SEQ ID NO: 217991 - DNA, 20 bp, human
gcactccgcccaggcgcgcc

SEQ ID NO: 217992 - DNA, 20 bp, human
gatgcaagatccgcgccccg

SEQ ID NO: 217993 - DNA, 20 bp, human
gcggagtgcttgggctggaa

SEQ ID NO: 217994 - DNA, 20 bp, human
gtgcccacgaccccaaagtg

SEQ ID NO: 217995 - DNA, 20 bp, human
ggatcccgaagtccaggcgt

SEQ ID NO: 217996 - DNA, 20 bp, human
gggggtggactgaggtaggg

SEQ ID NO: 217997 - DNA, 20 bp, human
gctggtatctgtgtgaactc

SEQ ID NO: 217998 - DNA, 20 bp, human
gtcactgtcttcacggtctg

SEQ ID NO: 217999 - DNA, 20 bp, human
gtggtctatcactgtcttca

SEQ ID NO: 218000 - DNA, 20 bp, human
gcgtaccgcaacattttcaa

SEQ ID NO: 218001 - DNA, 20 bp, human
gggtagggagggtgtgacgc

SEQ ID NO: 218002 - DNA, 20 bp, human
gtgtcttcacggtctggggg

SEQ ID NO: 218003 - DNA, 20 bp, human
gttgagagtgtgttcgaggg

SEQ ID NO: 218004 - DNA, 20 bp, human
gccagaatcatgcagtatat

SEQ ID NO: 218005 - DNA, 20 bp, human
gcaaggtcatgttagtaaag

SEQ ID NO: 218006 - DNA, 20 bp, human
gggcggagcgagcgagcgat

SEQ ID NO: 218007 - DNA, 20 bp, human
gtgggggtgtgagacggcgg

SEQ ID NO: 218008 - DNA, 20 bp, human
ggggagacggatctgcaggc

SEQ ID NO: 218009 - DNA, 20 bp, human
ggagcctggcccagcgctaa

SEQ ID NO: 218010 - DNA, 20 bp, human
ggagcgagcgagcgatgggc

SEQ ID NO: 218011 - DNA, 20 bp, human
gtcccgggaggttgataaag

SEQ ID NO: 218012 - DNA, 20 bp, human
gacggatctgcaggcgggca

SEQ ID NO: 218013 - DNA, 20 bp, human
gaggagatacaggcggagag

SEQ ID NO: 218014 - DNA, 20 bp, human
ggccggggagacggatctgc

SEQ ID NO: 218015 - DNA, 20 bp, human
ggcccagcgctaagggggtg

SEQ ID NO: 218016 - DNA, 20 bp, human
gtggcccaacggacagcccg

SEQ ID NO: 218017 - DNA, 20 bp, human
ggcgtggcgagcgcaggacg

SEQ ID NO: 218018 - DNA, 20 bp, human
gcccgccaacaggtacccgg

SEQ ID NO: 218019 - DNA, 20 bp, human
gcacacgcggcaggcggtgg

SEQ ID NO: 218020 - DNA, 20 bp, human
gccagcaggctgtgcgggaa

SEQ ID NO: 218021 - DNA, 20 bp, human
gtgcgcactcatctggggcg

SEQ ID NO: 218022 - DNA, 20 bp, human
gacgcctcgggctgtccgtt

SEQ ID NO: 218023 - DNA, 20 bp, human
gcgccccgccaacaggtacc

SEQ ID NO: 218024 - DNA, 20 bp, human
gcagatgagtgcgcagtatg

SEQ ID NO: 218025 - DNA, 20 bp, human
gcggggcgggaaagcgcacg

SEQ ID NO: 218026 - DNA, 20 bp, human
gagggcggggaggacgacga

SEQ ID NO: 218027 - DNA, 20 bp, human
gaggacgacgagggcgaaga

SEQ ID NO: 218028 - DNA, 20 bp, human
gccccggagcccgagccgaa

SEQ ID NO: 218029 - DNA, 20 bp, human
gcctgcgccatgtccaccaa

SEQ ID NO: 218030 - DNA, 20 bp, human
gacgctaagtcgctggccat

SEQ ID NO: 218031 - DNA, 20 bp, human
gccgacgggccgaatgtttt

SEQ ID NO: 218032 - DNA, 20 bp, human
ggcccagcgcccacttctgg

SEQ ID NO: 218033 - DNA, 20 bp, human
ggccagcgacttagcgtttg

SEQ ID NO: 218034 - DNA, 20 bp, human
gggcgctgggcagtcacgca

SEQ ID NO: 218035 - DNA, 20 bp, human
ggccgcaaacgctaagtcgc

SEQ ID NO: 218036 - DNA, 20 bp, human
ggcggagggcgcgccttgga

SEQ ID NO: 218037 - DNA, 20 bp, human
gggggcggggcctacgaact

SEQ ID NO: 218038 - DNA, 20 bp, human
ggccgcccggcccagttcgt

SEQ ID NO: 218039 - DNA, 20 bp, human
gaatggatcgattagagagg

SEQ ID NO: 218040 - DNA, 20 bp, human
ggcgccctccgcggccggca

SEQ ID NO: 218041 - DNA, 20 bp, human
gcggggcctacgaactgggc

SEQ ID NO: 218042 - DNA, 20 bp, human
gtggcggcctcgccccctgc

SEQ ID NO: 218043 - DNA, 20 bp, human
gtaatcgatccattcttcct

SEQ ID NO: 218044 - DNA, 20 bp, human
ggccgcagccacttccggca

SEQ ID NO: 218045 - DNA, 20 bp, human
gcggatgctaacaagcctgg

SEQ ID NO: 218046 - DNA, 20 bp, human
gagcgcgaggcaagccgcga

SEQ ID NO: 218047 - DNA, 20 bp, human
gggctccccacattccgcca

SEQ ID NO: 218048 - DNA, 20 bp, human
ggcgcggggagggctagccg

SEQ ID NO: 218049 - DNA, 20 bp, human
ggcgcagcgcgagttggccg

SEQ ID NO: 218050 - DNA, 20 bp, human
gcgggagagggctaggtagg

SEQ ID NO: 218051 - DNA, 20 bp, human
gccccctctctcccccctcg

SEQ ID NO: 218052 - DNA, 20 bp, human
ggcgaggcaagccgcgaggg

SEQ ID NO: 218053 - DNA, 20 bp, human
gggggaggcgcagcgcgagt

SEQ ID NO: 218054 - DNA, 20 bp, human
gctagccgtggcggaatgtg

SEQ ID NO: 218055 - DNA, 20 bp, human
ggggtagagattgggataat

SEQ ID NO: 218056 - DNA, 20 bp, human
gggctgagaagacacgcgac

SEQ ID NO: 218057 - DNA, 20 bp, human
ggcctgcccgcgccctccat

SEQ ID NO: 218058 - DNA, 20 bp, human
gcactcggagatcacacacc

SEQ ID NO: 218059 - DNA, 20 bp, human
gcacgcgaccggcgcgagga

SEQ ID NO: 218060 - DNA, 20 bp, human
gtgcggagccggctctcggc

SEQ ID NO: 218061 - DNA, 20 bp, human
gcccaaccccctcctcgcgc

SEQ ID NO: 218062 - DNA, 20 bp, human
gcgcgtgtcttctcagccaa

SEQ ID NO: 218063 - DNA, 20 bp, human
gggtgtaaaaactctttgat

SEQ ID NO: 218064 - DNA, 20 bp, human
gaagacacgcgaccggcgcg

SEQ ID NO: 218065 - DNA, 20 bp, human
ggtgtcttctcagccaatgg

SEQ ID NO: 218066 - DNA, 20 bp, human
gtaccctgggaactgcgggg

SEQ ID NO: 218067 - DNA, 20 bp, human
gacagccaggccactccaga

SEQ ID NO: 218068 - DNA, 20 bp, human
ggtaagctgcccactgatac

SEQ ID NO: 218069 - DNA, 20 bp, human
gctgggaactgcggggagga

SEQ ID NO: 218070 - DNA, 20 bp, human
gactaacacaccatctggag

SEQ ID NO: 218071 - DNA, 20 bp, human
gcaggtgggcgggcgtccct

SEQ ID NO: 218072 - DNA, 20 bp, human
gcaaaagaataacaaggtgg

SEQ ID NO: 218073 - DNA, 20 bp, human
gtcctaccctgggaactgcg

SEQ ID NO: 218074 - DNA, 20 bp, human
ggtgctgagatagaagccga

SEQ ID NO: 218075 - DNA, 20 bp, human
gatggtgtgttagttagtgt

SEQ ID NO: 218076 - DNA, 20 bp, human
ggtagggagcccgcggacaa

SEQ ID NO: 218077 - DNA, 20 bp, human
gggttctgggccaaggggat

SEQ ID NO: 218078 - DNA, 20 bp, human
gcccccgactagagtagggg

SEQ ID NO: 218079 - DNA, 20 bp, human
gcggggcggttgtgcaggag

SEQ ID NO: 218080 - DNA, 20 bp, human
ggcgcccccgactagagtag

SEQ ID NO: 218081 - DNA, 20 bp, human
ggaggcaggttctgggccaa

SEQ ID NO: 218082 - DNA, 20 bp, human
gctgactgatctcgcgaact

SEQ ID NO: 218083 - DNA, 20 bp, human
gcccgcccctactctagtcg

SEQ ID NO: 218084 - DNA, 20 bp, human
gccgccgggctgtccgttcc

SEQ ID NO: 218085 - DNA, 20 bp, human
gggccgcctcctttgtccgc

SEQ ID NO: 218086 - DNA, 20 bp, human
gggcagggatcaggactgga

SEQ ID NO: 218087 - DNA, 20 bp, human
gggcccggcccgcagaaagg

SEQ ID NO: 218088 - DNA, 20 bp, human
gactccgggcccggccgcga

SEQ ID NO: 218089 - DNA, 20 bp, human
gggcgcggccggcagggatc

SEQ ID NO: 218090 - DNA, 20 bp, human
ggaaaaaggccgacagtcga

SEQ ID NO: 218091 - DNA, 20 bp, human
gtcacctcctctctccgtcc

SEQ ID NO: 218092 - DNA, 20 bp, human
ggtccaggccgggtgaccac

SEQ ID NO: 218093 - DNA, 20 bp, human
gccgcctcctttctgcgggc

SEQ ID NO: 218094 - DNA, 20 bp, human
gggtgagaggggcgctgcgt

SEQ ID NO: 218095 - DNA, 20 bp, human
gacgggcccggcccgcagaa

SEQ ID NO: 218096 - DNA, 20 bp, human
gactgggccacgccggatag

SEQ ID NO: 218097 - DNA, 20 bp, human
gcgagctggaaacttcagag

SEQ ID NO: 218098 - DNA, 20 bp, human
gtccgggcgcggaacgaggg

SEQ ID NO: 218099 - DNA, 20 bp, human
gggaccgaactgatgcttct

SEQ ID NO: 218100 - DNA, 20 bp, human
gatccggcgtggcccagtcc

SEQ ID NO: 218101 - DNA, 20 bp, human
ggcgggcggcgaggacaagg

SEQ ID NO: 218102 - DNA, 20 bp, human
gcgcgcgggctgcttgggga

SEQ ID NO: 218103 - DNA, 20 bp, human
gcagcccgcgcgcccttcca

SEQ ID NO: 218104 - DNA, 20 bp, human
gcagtccgggcgcggaacga

SEQ ID NO: 218105 - DNA, 20 bp, human
gcgcccggactgggccacgc

SEQ ID NO: 218106 - DNA, 20 bp, human
gccgagtcccagaacagtga

SEQ ID NO: 218107 - DNA, 20 bp, human
gaacactgccttcactgttc

SEQ ID NO: 218108 - DNA, 20 bp, human
gtgctggctcattgattcac

SEQ ID NO: 218109 - DNA, 20 bp, human
gataaccttgcagttctctt

SEQ ID NO: 218110 - DNA, 20 bp, human
gaaggcagtgttcttcgact

SEQ ID NO: 218111 - DNA, 20 bp, human
gtagcaagtctgtgaatgtg

SEQ ID NO: 218112 - DNA, 20 bp, human
ggaaaatcagaattagtaat

SEQ ID NO: 218113 - DNA, 20 bp, human
gtgggaccaatatattatag

SEQ ID NO: 218114 - DNA, 20 bp, human
gatgcattaccaaaggtaga

SEQ ID NO: 218115 - DNA, 20 bp, human
gaccttgcagttctctttgg

SEQ ID NO: 218116 - DNA, 20 bp, human
gcggggcggtgggcgattgg

SEQ ID NO: 218117 - DNA, 20 bp, human
ggctgctacgtcacggaggg

SEQ ID NO: 218118 - DNA, 20 bp, human
gccctgccgctgctacgtca

SEQ ID NO: 218119 - DNA, 20 bp, human
gtcactggggcatctgcgct

SEQ ID NO: 218120 - DNA, 20 bp, human
gggcagctcggtcaaacagc

SEQ ID NO: 218121 - DNA, 20 bp, human
ggccgctgctacgtcacgga

SEQ ID NO: 218122 - DNA, 20 bp, human
ggcatctgcgctgggcagaa

SEQ ID NO: 218123 - DNA, 20 bp, human
ggggcggggcggtgggcgat

SEQ ID NO: 218124 - DNA, 20 bp, human
gtgggagccggtcagttgcc

SEQ ID NO: 218125 - DNA, 20 bp, human
gggctcccgcagctgagttt

SEQ ID NO: 218126 - DNA, 20 bp, human
gctccgggcgcgcacgtcac

SEQ ID NO: 218127 - DNA, 20 bp, human
gggggaggaggagactcggg

SEQ ID NO: 218128 - DNA, 20 bp, human
gccccatcgaggcttccggg

SEQ ID NO: 218129 - DNA, 20 bp, human
gacgtgcgcgcccggagcag

SEQ ID NO: 218130 - DNA, 20 bp, human
gggcgcatgctcacttgcgc

SEQ ID NO: 218131 - DNA, 20 bp, human
gtcggtccgcccgctcggtt

SEQ ID NO: 218132 - DNA, 20 bp, human
gcagccgagcccaaccgagc

SEQ ID NO: 218133 - DNA, 20 bp, human
ggggaagggactcggcactg

SEQ ID NO: 218134 - DNA, 20 bp, human
gctcgggaggagcagagcgc

SEQ ID NO: 218135 - DNA, 20 bp, human
ggggaggcggaagcaacagg

SEQ ID NO: 218136 - DNA, 20 bp, human
gcccccggacgtgacgaaag

SEQ ID NO: 218137 - DNA, 20 bp, human
ggggcgcgccaggcccccct

SEQ ID NO: 218138 - DNA, 20 bp, human
gagcgagcgtggaaaggtgc

SEQ ID NO: 218139 - DNA, 20 bp, human
gaccccccaactcggaacgg

SEQ ID NO: 218140 - DNA, 20 bp, human
gccccgccgccgttccgagt

SEQ ID NO: 218141 - DNA, 20 bp, human
gaagggggtgcgcggaccga

SEQ ID NO: 218142 - DNA, 20 bp, human
gccccaactcggaacggcgg

SEQ ID NO: 218143 - DNA, 20 bp, human
ggaaaccccccaactcggaa

SEQ ID NO: 218144 - DNA, 20 bp, human
gcaccccctttcgtcacgtc

SEQ ID NO: 218145 - DNA, 20 bp, human
gggaagaagcgagcgtggaa

SEQ ID NO: 218146 - DNA, 20 bp, human
ggtactgctttgagctctta

SEQ ID NO: 218147 - DNA, 20 bp, human
ggaactaggcaagccataat

SEQ ID NO: 218148 - DNA, 20 bp, human
ggctcaaagcagtactctgg

SEQ ID NO: 218149 - DNA, 20 bp, human
gagagctcaaagcagtactc

SEQ ID NO: 218150 - DNA, 20 bp, human
gtggtgcaataatggggcta

SEQ ID NO: 218151 - DNA, 20 bp, human
ggtaaagtttcccagaactt

SEQ ID NO: 218152 - DNA, 20 bp, human
gctgcctcccatggaagtac

SEQ ID NO: 218153 - DNA, 20 bp, human
gcctagttcctgtacttcca

SEQ ID NO: 218154 - DNA, 20 bp, human
gttacaaggatcacaggggt

SEQ ID NO: 218155 - DNA, 20 bp, human
gatatgaaatggtgcaataa

SEQ ID NO: 218156 - DNA, 20 bp, human
ggggaccgacagctaggggt

SEQ ID NO: 218157 - DNA, 20 bp, human
ggcacgcccacgtcctgtcc

SEQ ID NO: 218158 - DNA, 20 bp, human
gtaaagggaaggggattccc

SEQ ID NO: 218159 - DNA, 20 bp, human
gggagcagctggtccggctc

SEQ ID NO: 218160 - DNA, 20 bp, human
ggggaagcctggacaggacg

SEQ ID NO: 218161 - DNA, 20 bp, human
ggaccccgccccctggcgtt

SEQ ID NO: 218162 - DNA, 20 bp, human
gaaccagggctgtactcacc

SEQ ID NO: 218163 - DNA, 20 bp, human
gatccaggtgagtacagccc

SEQ ID NO: 218164 - DNA, 20 bp, human
gggagggggaccgacagcta

SEQ ID NO: 218165 - DNA, 20 bp, human
ggggcggggtctctaggggg

SEQ ID NO: 218166 - DNA, 20 bp, human
gaggctgtggccggaagaag

SEQ ID NO: 218167 - DNA, 20 bp, human
ggggcgtcgccatgacagag

SEQ ID NO: 218168 - DNA, 20 bp, human
ggccccggcagggactactt

SEQ ID NO: 218169 - DNA, 20 bp, human
ggaacaggctggccccggca

SEQ ID NO: 218170 - DNA, 20 bp, human
ggtgccgccatgacaggctg

SEQ ID NO: 218171 - DNA, 20 bp, human
gcccgaagtagtccctgccg

SEQ ID NO: 218172 - DNA, 20 bp, human
gggtgctggtgtagtcaagg

SEQ ID NO: 218173 - DNA, 20 bp, human
gcttaccggaagtaaaactt

SEQ ID NO: 218174 - DNA, 20 bp, human
gcctggactaggaagagcca

SEQ ID NO: 218175 - DNA, 20 bp, human
ggaggcggggtcgggagctt

SEQ ID NO: 218176 - DNA, 20 bp, human
gccgcccccggtgtgtgcgg

SEQ ID NO: 218177 - DNA, 20 bp, human
gtgctcctccgcacacaccg

SEQ ID NO: 218178 - DNA, 20 bp, human
gcagcacgtcccagtggtta

SEQ ID NO: 218179 - DNA, 20 bp, human
gggagacacacacctcacgg

SEQ ID NO: 218180 - DNA, 20 bp, human
gggcttgcggcgcgcacgga

SEQ ID NO: 218181 - DNA, 20 bp, human
ggtgtgcggaggagcaggcg

SEQ ID NO: 218182 - DNA, 20 bp, human
ggcgctgcgagggccgcaga

SEQ ID NO: 218183 - DNA, 20 bp, human
gcgcacagtccctaaccact

SEQ ID NO: 218184 - DNA, 20 bp, human
gccccgccagcacgtcccag

SEQ ID NO: 218185 - DNA, 20 bp, human
ggcaggcattgctatcctac

SEQ ID NO: 218186 - DNA, 20 bp, human
ggggcgcgggcgacgtcagg

SEQ ID NO: 218187 - DNA, 20 bp, human
ggaggggcggggcgatttat

SEQ ID NO: 218188 - DNA, 20 bp, human
gtcgagggtggcaaaggcga

SEQ ID NO: 218189 - DNA, 20 bp, human
gggtggcaaaggcgatgggt

SEQ ID NO: 218190 - DNA, 20 bp, human
ggaggggcgcgggcgacgtc

SEQ ID NO: 218191 - DNA, 20 bp, human
ggcggcgcccgatcacgctg

SEQ ID NO: 218192 - DNA, 20 bp, human
ggggctcaggactcccgcgc

SEQ ID NO: 218193 - DNA, 20 bp, human
gcgcgggcgacgtcaggagg

SEQ ID NO: 218194 - DNA, 20 bp, human
ggactcccgcgccggatgtg

SEQ ID NO: 218195 - DNA, 20 bp, human
gcggatgtgaggtcacgtgg

SEQ ID NO: 218196 - DNA, 20 bp, human
gagagcagctgtctcaaagg

SEQ ID NO: 218197 - DNA, 20 bp, human
gctagcagagggcgactcgt

SEQ ID NO: 218198 - DNA, 20 bp, human
gggcacaaaaagatcggcat

SEQ ID NO: 218199 - DNA, 20 bp, human
gtgagagaatgcaataagca

SEQ ID NO: 218200 - DNA, 20 bp, human
gctctgctaggaggaattgc

SEQ ID NO: 218201 - DNA, 20 bp, human
gtttttgtgcccaacttaca

SEQ ID NO: 218202 - DNA, 20 bp, human
gccgctcaacccaattcctt

SEQ ID NO: 218203 - DNA, 20 bp, human
gctcagagcagctgtctcaa

SEQ ID NO: 218204 - DNA, 20 bp, human
gagcgggtgcaagaactccc

SEQ ID NO: 218205 - DNA, 20 bp, human
gagttctttccctgtaagtt

SEQ ID NO: 218206 - DNA, 20 bp, human
gagaaaatcttctcaggaac

SEQ ID NO: 218207 - DNA, 20 bp, human
gaagaagttggcaaactaga

SEQ ID NO: 218208 - DNA, 20 bp, human
gtcttcccccgtcattcctc

SEQ ID NO: 218209 - DNA, 20 bp, human
gagtgactattctcattcct

SEQ ID NO: 218210 - DNA, 20 bp, human
gttgcctattagactaacaa

SEQ ID NO: 218211 - DNA, 20 bp, human
gccttgggcttctgtgaact

SEQ ID NO: 218212 - DNA, 20 bp, human
gctgttaatctggttattgt

SEQ ID NO: 218213 - DNA, 20 bp, human
gagctcaataaacaaacact

SEQ ID NO: 218214 - DNA, 20 bp, human
gacttgtgattgctcttccc

SEQ ID NO: 218215 - DNA, 20 bp, human
ggctaaaaacctaagataaa

SEQ ID NO: 218216 - DNA, 20 bp, human
ggccagtcctggctcccggc

SEQ ID NO: 218217 - DNA, 20 bp, human
gaggcgctgtccgggcccgt

SEQ ID NO: 218218 - DNA, 20 bp, human
ggcaacctgacaccggccgt

SEQ ID NO: 218219 - DNA, 20 bp, human
ggcccggacagcgcctgctg

SEQ ID NO: 218220 - DNA, 20 bp, human
gtgtccaccgtgtcccggga

SEQ ID NO: 218221 - DNA, 20 bp, human
gggccggtgtcaggttgctc

SEQ ID NO: 218222 - DNA, 20 bp, human
gcaggcccacggccggtgtc

SEQ ID NO: 218223 - DNA, 20 bp, human
gagccaggactggccgcagc

SEQ ID NO: 218224 - DNA, 20 bp, human
ggacacgcttgtcccagacc

SEQ ID NO: 218225 - DNA, 20 bp, human
ggacctgggcgccctcctgc

SEQ ID NO: 218226 - DNA, 20 bp, human
gggctcctctcaaccccctc

SEQ ID NO: 218227 - DNA, 20 bp, human
ggggacaaacgggctgtcta

SEQ ID NO: 218228 - DNA, 20 bp, human
ggggcatgccgtgggacaaa

SEQ ID NO: 218229 - DNA, 20 bp, human
gtctagggccagtggctaaa

SEQ ID NO: 218230 - DNA, 20 bp, human
gcgggaggggaggagtcctc

SEQ ID NO: 218231 - DNA, 20 bp, human
gccccttcagccagatccaa

SEQ ID NO: 218232 - DNA, 20 bp, human
gtgagtgccacaggccagag

SEQ ID NO: 218233 - DNA, 20 bp, human
gagtggctaaaggggcggga

SEQ ID NO: 218234 - DNA, 20 bp, human
gggagattggatgtagactc

SEQ ID NO: 218235 - DNA, 20 bp, human
ggcccaggaggagtcaaagg

SEQ ID NO: 218236 - DNA, 20 bp, human
gaaaagagagaatggtagga

SEQ ID NO: 218237 - DNA, 20 bp, human
gaggcctgagaatcagtgta

SEQ ID NO: 218238 - DNA, 20 bp, human
ggacagaggagaggcgaacc

SEQ ID NO: 218239 - DNA, 20 bp, human
gtgtttcagcagcagagtta

SEQ ID NO: 218240 - DNA, 20 bp, human
gctcaggtggggctattctt

SEQ ID NO: 218241 - DNA, 20 bp, human
gttcagcagcagagttaggg

SEQ ID NO: 218242 - DNA, 20 bp, human
gccgtccaagtctcctgtag

SEQ ID NO: 218243 - DNA, 20 bp, human
gtccccctacactgattctc

SEQ ID NO: 218244 - DNA, 20 bp, human
gagagctgagaaaaggtccc

SEQ ID NO: 218245 - DNA, 20 bp, human
gagggacactgcaaactggg

SEQ ID NO: 218246 - DNA, 20 bp, human
gcggacgcgggcatatgagg

SEQ ID NO: 218247 - DNA, 20 bp, human
gcggccgcgccgccactttg

SEQ ID NO: 218248 - DNA, 20 bp, human
gaggacagctgcagtaccag

SEQ ID NO: 218249 - DNA, 20 bp, human
gaccccctcaatatggagta

SEQ ID NO: 218250 - DNA, 20 bp, human
gacagctgcagtaccagggg

SEQ ID NO: 218251 - DNA, 20 bp, human
ggcgccgccgtgctgacgga

SEQ ID NO: 218252 - DNA, 20 bp, human
gtggcggcgcggccgcgaag

SEQ ID NO: 218253 - DNA, 20 bp, human
ggggccgtccgtcagcacgg

SEQ ID NO: 218254 - DNA, 20 bp, human
gactgcagctgtcctcccct

SEQ ID NO: 218255 - DNA, 20 bp, human
ggctccgcaaagtggcggcg

SEQ ID NO: 218256 - DNA, 20 bp, human
ggtcaggtgtgggagaccaa

SEQ ID NO: 218257 - DNA, 20 bp, human
gaattgggagagggaatcag

SEQ ID NO: 218258 - DNA, 20 bp, human
gaacaggcttaggcagctga

SEQ ID NO: 218259 - DNA, 20 bp, human
gactaagggctctaccaacc

SEQ ID NO: 218260 - DNA, 20 bp, human
gtgtgggagaccaaaggagt

SEQ ID NO: 218261 - DNA, 20 bp, human
gtaagtgtatggtcaggtgt

SEQ ID NO: 218262 - DNA, 20 bp, human
ggatgagagataacaggctt

SEQ ID NO: 218263 - DNA, 20 bp, human
gtctctggctatcctcataa

SEQ ID NO: 218264 - DNA, 20 bp, human
ggcttagactagtaagtgta

SEQ ID NO: 218265 - DNA, 20 bp, human
gtaaacttggtgtgggagag

SEQ ID NO: 218266 - DNA, 20 bp, human
gtccaggtctgctgtcgcaa

SEQ ID NO: 218267 - DNA, 20 bp, human
ggttgctggggcaatgaccc

SEQ ID NO: 218268 - DNA, 20 bp, human
gcagacctggaccatcgcca

SEQ ID NO: 218269 - DNA, 20 bp, human
ggtctcagtctttgggtttg

SEQ ID NO: 218270 - DNA, 20 bp, human
gactgagacttctaggttct

SEQ ID NO: 218271 - DNA, 20 bp, human
gataaagcgggtattcggcc

SEQ ID NO: 218272 - DNA, 20 bp, human
gcattgccccagcaaccaca

SEQ ID NO: 218273 - DNA, 20 bp, human
gtgtcgcaaaggcctcatga

SEQ ID NO: 218274 - DNA, 20 bp, human
gatcgccaaggcaagacttc

SEQ ID NO: 218275 - DNA, 20 bp, human
gcccaggtctggcatcacaa

SEQ ID NO: 218276 - DNA, 20 bp, human
gcggctgcgcgcccaccaat

SEQ ID NO: 218277 - DNA, 20 bp, human
gggagcccccgaccccccaa

SEQ ID NO: 218278 - DNA, 20 bp, human
gggggcgcggtatatagtaa

SEQ ID NO: 218279 - DNA, 20 bp, human
gtccccagtggcagcgggag

SEQ ID NO: 218280 - DNA, 20 bp, human
ggagccccgcacctattggt

SEQ ID NO: 218281 - DNA, 20 bp, human
gcctctgcagagacaggccc

SEQ ID NO: 218282 - DNA, 20 bp, human
gcggcccggtggccaatcgc

SEQ ID NO: 218283 - DNA, 20 bp, human
ggccgctcgcgggctttctt

SEQ ID NO: 218284 - DNA, 20 bp, human
gaccaaagaaagcccgcgag

SEQ ID NO: 218285 - DNA, 20 bp, human
ggagcgctcctctagccctt

SEQ ID NO: 218286 - DNA, 20 bp, human
gtactagactgggacagggt

SEQ ID NO: 218287 - DNA, 20 bp, human
gaggtccctaagagaagtca

SEQ ID NO: 218288 - DNA, 20 bp, human
gcccaccccaggtactagac

SEQ ID NO: 218289 - DNA, 20 bp, human
gtgtcccagtctagtacctg

SEQ ID NO: 218290 - DNA, 20 bp, human
gtccctaagagaagtcaggg

SEQ ID NO: 218291 - DNA, 20 bp, human
gtaaccccagagaaacacaa

SEQ ID NO: 218292 - DNA, 20 bp, human
gagagatagagggcgtgtcc

SEQ ID NO: 218293 - DNA, 20 bp, human
ggggtaatggagagacagct

SEQ ID NO: 218294 - DNA, 20 bp, human
gcgtgtccgggcggagtaga

SEQ ID NO: 218295 - DNA, 20 bp, human
ggcccccctgacttctctta

SEQ ID NO: 218296 - DNA, 20 bp, human
gcgccccgcagtagcctcgg

SEQ ID NO: 218297 - DNA, 20 bp, human
ggcgctgcctgaggcggcga

SEQ ID NO: 218298 - DNA, 20 bp, human
ggccggggcgctgcctgagg

SEQ ID NO: 218299 - DNA, 20 bp, human
gagcccccgaggctactgcg

SEQ ID NO: 218300 - DNA, 20 bp, human
gcggggaggcagttcgggga

SEQ ID NO: 218301 - DNA, 20 bp, human
ggagctgacgagtacgggag

SEQ ID NO: 218302 - DNA, 20 bp, human
gagaacgcctggggacggtc

SEQ ID NO: 218303 - DNA, 20 bp, human
gcggtcggggaggcagttcg

SEQ ID NO: 218304 - DNA, 20 bp, human
gccccgccccgcagtagcct

SEQ ID NO: 218305 - DNA, 20 bp, human
gcaagggccgcgatctctac

SEQ ID NO: 218306 - DNA, 20 bp, human
gcaagctcatcattacaagg

SEQ ID NO: 218307 - DNA, 20 bp, human
gggtggaaagacatataaag

SEQ ID NO: 218308 - DNA, 20 bp, human
gagggctttcccttgattca

SEQ ID NO: 218309 - DNA, 20 bp, human
gggagatattctgggtcacg

SEQ ID NO: 218310 - DNA, 20 bp, human
gaaggagggggagatattct

SEQ ID NO: 218311 - DNA, 20 bp, human
gaatcaagggaaagccctta

SEQ ID NO: 218312 - DNA, 20 bp, human
ggaaagacatataaaggggg

SEQ ID NO: 218313 - DNA, 20 bp, human
gaggagccaaccaatgacag

SEQ ID NO: 218314 - DNA, 20 bp, human
ggctggagaaagacaagggg

SEQ ID NO: 218315 - DNA, 20 bp, human
gtggctccttccctgaatca

SEQ ID NO: 218316 - DNA, 20 bp, human
ggcaacccctccctagggta

SEQ ID NO: 218317 - DNA, 20 bp, human
gccctcatgagtgacatctc

SEQ ID NO: 218318 - DNA, 20 bp, human
ggtaaccctaccctagggag

SEQ ID NO: 218319 - DNA, 20 bp, human
gctgacagagggggaacagt

SEQ ID NO: 218320 - DNA, 20 bp, human
ggcctgagatgtcactcatg

SEQ ID NO: 218321 - DNA, 20 bp, human
gcaccagatcagggattggc

SEQ ID NO: 218322 - DNA, 20 bp, human
gtcactcatgagggacgcaa

SEQ ID NO: 218323 - DNA, 20 bp, human
gtcccccctccaccagatca

SEQ ID NO: 218324 - DNA, 20 bp, human
gagactgcggcaatggaaac

SEQ ID NO: 218325 - DNA, 20 bp, human
ggggaagtcgaggcaatggg

SEQ ID NO: 218326 - DNA, 20 bp, human
ggcgcgcgcggcctcgatcc

SEQ ID NO: 218327 - DNA, 20 bp, human
ggcctcgatccgggttccta

SEQ ID NO: 218328 - DNA, 20 bp, human
gggggcctgcgcggcagcgt

SEQ ID NO: 218329 - DNA, 20 bp, human
ggcatgtggacgccgctcat

SEQ ID NO: 218330 - DNA, 20 bp, human
gggcgctctcggccaatgag

SEQ ID NO: 218331 - DNA, 20 bp, human
ggagcggcgtccacatgccg

SEQ ID NO: 218332 - DNA, 20 bp, human
gctaggggcggcgcgcggga

SEQ ID NO: 218333 - DNA, 20 bp, human
ggggtgggtcagagaaccgc

SEQ ID NO: 218334 - DNA, 20 bp, human
gcggcgtccacatgccgcgg

SEQ ID NO: 218335 - DNA, 20 bp, human
gcccctaggaacccggatcg

SEQ ID NO: 218336 - DNA, 20 bp, human
gcggccggaaggggtgtgat

SEQ ID NO: 218337 - DNA, 20 bp, human
ggccccggggcgcaccgcct

SEQ ID NO: 218338 - DNA, 20 bp, human
gggacccaggcggtgcgccc

SEQ ID NO: 218339 - DNA, 20 bp, human
gcgcccgcggggcgcgtgct

SEQ ID NO: 218340 - DNA, 20 bp, human
gccggaaggggtgtgatggg

SEQ ID NO: 218341 - DNA, 20 bp, human
gccggtccgcggagctgcta

SEQ ID NO: 218342 - DNA, 20 bp, human
ggcgacgcgcagcccagagc

SEQ ID NO: 218343 - DNA, 20 bp, human
gggtcctcggtcccggtccg

SEQ ID NO: 218344 - DNA, 20 bp, human
ggctgcgcgtcgcctcctct

SEQ ID NO: 218345 - DNA, 20 bp, human
ggggcgcgtgctgggcctgt

SEQ ID NO: 218346 - DNA, 20 bp, human
gcgccctgtgtgccgctctg

SEQ ID NO: 218347 - DNA, 20 bp, human
gaggaaccgcggctcggacc

SEQ ID NO: 218348 - DNA, 20 bp, human
gcctcctcggctccgcagag

SEQ ID NO: 218349 - DNA, 20 bp, human
gaaagggtggccggagtgag

SEQ ID NO: 218350 - DNA, 20 bp, human
gcactgggagggcgtttaag

SEQ ID NO: 218351 - DNA, 20 bp, human
gagccaaggcgctcagggga

SEQ ID NO: 218352 - DNA, 20 bp, human
gccgcagcccgccccactcg

SEQ ID NO: 218353 - DNA, 20 bp, human
ggcggcggcgcgagcttcgg

SEQ ID NO: 218354 - DNA, 20 bp, human
ggacccggcgagcgcgccct

SEQ ID NO: 218355 - DNA, 20 bp, human
gtcctgccgcagcctgcgat

SEQ ID NO: 218356 - DNA, 20 bp, human
gcggcaaaatgcaatctcgg

SEQ ID NO: 218357 - DNA, 20 bp, human
ggcacggagagggtagggct

SEQ ID NO: 218358 - DNA, 20 bp, human
gtcaagggcacggagagggt

SEQ ID NO: 218359 - DNA, 20 bp, human
gagggagggccggttctgga

SEQ ID NO: 218360 - DNA, 20 bp, human
gaggccgcccctgccgctgc

SEQ ID NO: 218361 - DNA, 20 bp, human
gaatgtcaagggcacggaga

SEQ ID NO: 218362 - DNA, 20 bp, human
gccctgccgctgccggaggc

SEQ ID NO: 218363 - DNA, 20 bp, human
gacacagggagggccggttc

SEQ ID NO: 218364 - DNA, 20 bp, human
gcgccggcaaaatgcaatct

SEQ ID NO: 218365 - DNA, 20 bp, human
gggtcctgagagtggtggtg

SEQ ID NO: 218366 - DNA, 20 bp, human
gacacgccccggggcaagac

SEQ ID NO: 218367 - DNA, 20 bp, human
ggtacctggagacacgcccc

SEQ ID NO: 218368 - DNA, 20 bp, human
ggtggccagttcacaggctc

SEQ ID NO: 218369 - DNA, 20 bp, human
gtcctccgcgcgcaccagtg

SEQ ID NO: 218370 - DNA, 20 bp, human
ggggtgtgctggggaggctt

SEQ ID NO: 218371 - DNA, 20 bp, human
ggggtgtggagtaggcagat

SEQ ID NO: 218372 - DNA, 20 bp, human
gcaggtacctccatcagcac

SEQ ID NO: 218373 - DNA, 20 bp, human
gcacacccgagcctgtgaac

SEQ ID NO: 218374 - DNA, 20 bp, human
ggccccactggtgcgcgcgg

SEQ ID NO: 218375 - DNA, 20 bp, human
gtcacaggctcgggtgtgct

SEQ ID NO: 218376 - DNA, 20 bp, human
gtgggtggggatggaaactg

SEQ ID NO: 218377 - DNA, 20 bp, human
ggggcaccctcgcgcgtcct

SEQ ID NO: 218378 - DNA, 20 bp, human
gaaagggcactggccgagtg

SEQ ID NO: 218379 - DNA, 20 bp, human
ggtgcgcggcgcaggggcct

SEQ ID NO: 218380 - DNA, 20 bp, human
gggcactggccgagtggggg

SEQ ID NO: 218381 - DNA, 20 bp, human
gctgtccccaggacgcgcga

SEQ ID NO: 218382 - DNA, 20 bp, human
gcaccctgagcttgcgactg

SEQ ID NO: 218383 - DNA, 20 bp, human
gttggggagacgcacctaga

SEQ ID NO: 218384 - DNA, 20 bp, human
ggggacagaagggcgcgcac

SEQ ID NO: 218385 - DNA, 20 bp, human
gcgagggtgcccgcccttcc

SEQ ID NO: 218386 - DNA, 20 bp, human
gaagaaagccgacaggggag

SEQ ID NO: 218387 - DNA, 20 bp, human
gcggggaagaaagccgacag

SEQ ID NO: 218388 - DNA, 20 bp, human
gcaacaagtgagagcaaggg

SEQ ID NO: 218389 - DNA, 20 bp, human
ggattcttgcggttacttcc

SEQ ID NO: 218390 - DNA, 20 bp, human
gacttcctggttcgtcttaa

SEQ ID NO: 218391 - DNA, 20 bp, human
ggctgagtaggggtggagga

SEQ ID NO: 218392 - DNA, 20 bp, human
gtgtgggtggcggtattcaa

SEQ ID NO: 218393 - DNA, 20 bp, human
gtgaatagaaagctgagtag

SEQ ID NO: 218394 - DNA, 20 bp, human
gaagcaatcctctcccctgt

SEQ ID NO: 218395 - DNA, 20 bp, human
gagctctccccaagcagtgc

SEQ ID NO: 218396 - DNA, 20 bp, human
gggcggagcgcaggagtcgg

SEQ ID NO: 218397 - DNA, 20 bp, human
gccggcccggcggaccgtga

SEQ ID NO: 218398 - DNA, 20 bp, human
gcaggagtgcggggcgcgac

SEQ ID NO: 218399 - DNA, 20 bp, human
ggacaccgtccctggggtaa

SEQ ID NO: 218400 - DNA, 20 bp, human
gagtgacaaagctgggttcg

SEQ ID NO: 218401 - DNA, 20 bp, human
ggaagtaatagtgacaaagc

SEQ ID NO: 218402 - DNA, 20 bp, human
gtgttcacgggctgggaagg

SEQ ID NO: 218403 - DNA, 20 bp, human
ggaagtgaaggccgagactt

SEQ ID NO: 218404 - DNA, 20 bp, human
ggaggtgaggggacccgtca

SEQ ID NO: 218405 - DNA, 20 bp, human
ggaaggccgagacttcggcc

SEQ ID NO: 218406 - DNA, 20 bp, human
gcccactccaggtgattctt

SEQ ID NO: 218407 - DNA, 20 bp, human
ggggtcccaggcgagctcgc

SEQ ID NO: 218408 - DNA, 20 bp, human
gccgccccgcgagctcgcct

SEQ ID NO: 218409 - DNA, 20 bp, human
ggagaggctgcgtcgcctca

SEQ ID NO: 218410 - DNA, 20 bp, human
ggagctcgcctgggacccca

SEQ ID NO: 218411 - DNA, 20 bp, human
gagcgccggctggccatgaa

SEQ ID NO: 218412 - DNA, 20 bp, human
gacccctccctgcccagtca

SEQ ID NO: 218413 - DNA, 20 bp, human
gggctggccatgaaaggccc

SEQ ID NO: 218414 - DNA, 20 bp, human
ggctgcgtcgcctcagggct

SEQ ID NO: 218415 - DNA, 20 bp, human
gcctctccctgggcctttca

SEQ ID NO: 218416 - DNA, 20 bp, human
gttgctgcagcggttcccag

SEQ ID NO: 218417 - DNA, 20 bp, human
gcacctcaggcattccctcc

SEQ ID NO: 218418 - DNA, 20 bp, human
gtctcagggcaggttgacat

SEQ ID NO: 218419 - DNA, 20 bp, human
gcgccctccctgggtatatc

SEQ ID NO: 218420 - DNA, 20 bp, human
ggagtgagaaccagatcagc

SEQ ID NO: 218421 - DNA, 20 bp, human
ggtcaacctgccctgagatc

SEQ ID NO: 218422 - DNA, 20 bp, human
gtctcctatggctccatcac

SEQ ID NO: 218423 - DNA, 20 bp, human
ggggttgagtcattctccta

SEQ ID NO: 218424 - DNA, 20 bp, human
gcccgaccacagctgattac

SEQ ID NO: 218425 - DNA, 20 bp, human
gtatacccagggagggcggt

SEQ ID NO: 218426 - DNA, 20 bp, human
gctctgagagctgcggggaa

SEQ ID NO: 218427 - DNA, 20 bp, human
gggggccgagagctcggtgc

SEQ ID NO: 218428 - DNA, 20 bp, human
ggggctgtggacgagggaac

SEQ ID NO: 218429 - DNA, 20 bp, human
gtggaggggtccttggtaga

SEQ ID NO: 218430 - DNA, 20 bp, human
ggaggcgaggctgtggacgg

SEQ ID NO: 218431 - DNA, 20 bp, human
gtaagcgttaaggcggggct

SEQ ID NO: 218432 - DNA, 20 bp, human
ggcggggctaggtgcagatt

SEQ ID NO: 218433 - DNA, 20 bp, human
gcccgcccacagcttctcct

SEQ ID NO: 218434 - DNA, 20 bp, human
ggaaggtaagcgttaaggcg

SEQ ID NO: 218435 - DNA, 20 bp, human
gtcctcggcgggactgtcca

SEQ ID NO: 218436 - DNA, 20 bp, human
gcgccccaggggcaacagcc

SEQ ID NO: 218437 - DNA, 20 bp, human
ggcagcagggtgaggaaagc

SEQ ID NO: 218438 - DNA, 20 bp, human
gtccctcctgaaggagagga

SEQ ID NO: 218439 - DNA, 20 bp, human
gccactgtgtccacgacctt

SEQ ID NO: 218440 - DNA, 20 bp, human
gcgggcctggcccgccccag

SEQ ID NO: 218441 - DNA, 20 bp, human
gcagcccggctgttgcccct

SEQ ID NO: 218442 - DNA, 20 bp, human
gatcgcctcaccaaacacca

SEQ ID NO: 218443 - DNA, 20 bp, human
gtctgctctgattgcggtga

SEQ ID NO: 218444 - DNA, 20 bp, human
gagggcgtcccaagagcagc

SEQ ID NO: 218445 - DNA, 20 bp, human
ggatggccggcgctgataaa

SEQ ID NO: 218446 - DNA, 20 bp, human
gacagccggcccacctgacc

SEQ ID NO: 218447 - DNA, 20 bp, human
ggtcacccggggcaaccaca

SEQ ID NO: 218448 - DNA, 20 bp, human
ggggagaggtggtgaacgcg

SEQ ID NO: 218449 - DNA, 20 bp, human
gaaaaaatgcagagtggcgg

SEQ ID NO: 218450 - DNA, 20 bp, human
gtgagggcctcacccgtctg

SEQ ID NO: 218451 - DNA, 20 bp, human
gttgccccgggtgaccacgt

SEQ ID NO: 218452 - DNA, 20 bp, human
gcctcacccgtctggggtcg

SEQ ID NO: 218453 - DNA, 20 bp, human
gacttccgggtcaggtgggc

SEQ ID NO: 218454 - DNA, 20 bp, human
gaggccccatctggtgctag

SEQ ID NO: 218455 - DNA, 20 bp, human
gcgcgaggggcagtacttcc

SEQ ID NO: 218456 - DNA, 20 bp, human
ggaacatcaatgaagctgaa

SEQ ID NO: 218457 - DNA, 20 bp, human
ggtagtattggtgtatgggg

SEQ ID NO: 218458 - DNA, 20 bp, human
gatgctattgatggaaaggt

SEQ ID NO: 218459 - DNA, 20 bp, human
gtacataagaaaatagtcgg

SEQ ID NO: 218460 - DNA, 20 bp, human
gttaaaagtcttaatcagag

SEQ ID NO: 218461 - DNA, 20 bp, human
gtaagaaaatagtcgggggg

SEQ ID NO: 218462 - DNA, 20 bp, human
ggagagggttgtttgttagt

SEQ ID NO: 218463 - DNA, 20 bp, human
gcagggtatgtccttgaact

SEQ ID NO: 218464 - DNA, 20 bp, human
gtcaaaactgattatgctta

SEQ ID NO: 218465 - DNA, 20 bp, human
gtatgtagtattggtgtatg

SEQ ID NO: 218466 - DNA, 20 bp, human
ggacctgcctactgcagcgt

SEQ ID NO: 218467 - DNA, 20 bp, human
ggggtcttgtgcatgcggat

SEQ ID NO: 218468 - DNA, 20 bp, human
gctgcagtaggcaggtccat

SEQ ID NO: 218469 - DNA, 20 bp, human
gtaggcctcgcctcaacggc

SEQ ID NO: 218470 - DNA, 20 bp, human
gtgggggcagcgacgctgaa

SEQ ID NO: 218471 - DNA, 20 bp, human
gacgccatgttggggtttgt

SEQ ID NO: 218472 - DNA, 20 bp, human
gtggacagtgtgaggttaga

SEQ ID NO: 218473 - DNA, 20 bp, human
ggagcagccagttcacccaa

SEQ ID NO: 218474 - DNA, 20 bp, human
gcaacatggcgtagtccggg

SEQ ID NO: 218475 - DNA, 20 bp, human
gcgttggacagggtaatcag

SEQ ID NO: 218476 - DNA, 20 bp, human
gccagctgagaggcggaagg

SEQ ID NO: 218477 - DNA, 20 bp, human
gctgagaggcggaaggaggt

SEQ ID NO: 218478 - DNA, 20 bp, human
gagccagccggaaacggaac

SEQ ID NO: 218479 - DNA, 20 bp, human
ggcccggttccgtttccggc

SEQ ID NO: 218480 - DNA, 20 bp, human
ggaaccgggctggcggcggt

SEQ ID NO: 218481 - DNA, 20 bp, human
gatcccagctgagaggcgga

SEQ ID NO: 218482 - DNA, 20 bp, human
gcaacaggatcaagtccaag

SEQ ID NO: 218483 - DNA, 20 bp, human
ggttgcaacccagtcttccc

SEQ ID NO: 218484 - DNA, 20 bp, human
gcacggcagcgatcactttc

SEQ ID NO: 218485 - DNA, 20 bp, human
gactgaagaagagagcaagg

SEQ ID NO: 218486 - DNA, 20 bp, human
gacgacgcgcagggacgtct

SEQ ID NO: 218487 - DNA, 20 bp, human
gccagggggtggtcagataa

SEQ ID NO: 218488 - DNA, 20 bp, human
gacgcgcagggacgtctggg

SEQ ID NO: 218489 - DNA, 20 bp, human
ggcggtgaaaccgtcctggg

SEQ ID NO: 218490 - DNA, 20 bp, human
gccgtcgtgaggtattctgg

SEQ ID NO: 218491 - DNA, 20 bp, human
gcgaactacgactcccggca

SEQ ID NO: 218492 - DNA, 20 bp, human
ggacgcagtgccccgtcgtg

SEQ ID NO: 218493 - DNA, 20 bp, human
gcgcagggacgtctgggagg

SEQ ID NO: 218494 - DNA, 20 bp, human
ggcggcctcggcataggcac

SEQ ID NO: 218495 - DNA, 20 bp, human
ggttctgccgcagcccgggc

SEQ ID NO: 218496 - DNA, 20 bp, human
gcccgccggggtaatacgga

SEQ ID NO: 218497 - DNA, 20 bp, human
ggccggccgcgcccacctat

SEQ ID NO: 218498 - DNA, 20 bp, human
gagctcttggagccaatagg

SEQ ID NO: 218499 - DNA, 20 bp, human
gtaccccggcggggacgacg

SEQ ID NO: 218500 - DNA, 20 bp, human
gcgtccccgccggggtaata

SEQ ID NO: 218501 - DNA, 20 bp, human
ggggtaatacggaaggtcgg

SEQ ID NO: 218502 - DNA, 20 bp, human
gccggggtaatacggaaggt

SEQ ID NO: 218503 - DNA, 20 bp, human
gggactgcgggtgccaatcc

SEQ ID NO: 218504 - DNA, 20 bp, human
gacgacgggggcaagaaggc

SEQ ID NO: 218505 - DNA, 20 bp, human
gggcccctgctgccctgccg

SEQ ID NO: 218506 - DNA, 20 bp, human
gctcgcgagaagtagagttg

SEQ ID NO: 218507 - DNA, 20 bp, human
gctcgcgagaattgcttcta

SEQ ID NO: 218508 - DNA, 20 bp, human
ggctgagagcctatcgcatg

SEQ ID NO: 218509 - DNA, 20 bp, human
gccggccggagactccgctc

SEQ ID NO: 218510 - DNA, 20 bp, human
gagggcgacagccggaaagc

SEQ ID NO: 218511 - DNA, 20 bp, human
ggctcagaggtgcaccacgt

SEQ ID NO: 218512 - DNA, 20 bp, human
gtaacatgcagggcggggat

SEQ ID NO: 218513 - DNA, 20 bp, human
gccgccgggggcactagggg

SEQ ID NO: 218514 - DNA, 20 bp, human
ggctgtcgccctcatgcgat

SEQ ID NO: 218515 - DNA, 20 bp, human
ggggggcactagggggggtg

SEQ ID NO: 218516 - DNA, 20 bp, human
gcccgcctccatgcggatag

SEQ ID NO: 218517 - DNA, 20 bp, human
gggcccaagcgcccgaatga

SEQ ID NO: 218518 - DNA, 20 bp, human
gctgagtcccgccaactcta

SEQ ID NO: 218519 - DNA, 20 bp, human
gcccgcctctatccgcatgg

SEQ ID NO: 218520 - DNA, 20 bp, human
ggagaaggtccaggacacgt

SEQ ID NO: 218521 - DNA, 20 bp, human
gggcaattcccgcctccatg

SEQ ID NO: 218522 - DNA, 20 bp, human
gtgccacgaagctcctgtgg

SEQ ID NO: 218523 - DNA, 20 bp, human
gtggggacgcggggatatta

SEQ ID NO: 218524 - DNA, 20 bp, human
gtgcggaaagccaataagag

SEQ ID NO: 218525 - DNA, 20 bp, human
gacgagatctggattacgat

SEQ ID NO: 218526 - DNA, 20 bp, human
gagcgccgactgcagaaatg

SEQ ID NO: 218527 - DNA, 20 bp, human
gttcgagaggagaaactaca

SEQ ID NO: 218528 - DNA, 20 bp, human
ggctccacctggcgttcgag

SEQ ID NO: 218529 - DNA, 20 bp, human
ggccaggtggagcaaccggc

SEQ ID NO: 218530 - DNA, 20 bp, human
gggctgtggcggtatccggc

SEQ ID NO: 218531 - DNA, 20 bp, human
gatcacagcgccgcctgcca

SEQ ID NO: 218532 - DNA, 20 bp, human
gaagtccgagatcccaaacg

SEQ ID NO: 218533 - DNA, 20 bp, human
gagtaagccgatccgtaacg

SEQ ID NO: 218534 - DNA, 20 bp, human
ggaacgccaggtggagcaac

SEQ ID NO: 218535 - DNA, 20 bp, human
gcgcagtccacgttacggat

SEQ ID NO: 218536 - DNA, 20 bp, human
gaaaaactgtagattcaccc

SEQ ID NO: 218537 - DNA, 20 bp, human
gcacccggatgaagaaggcg

SEQ ID NO: 218538 - DNA, 20 bp, human
gacctggtgatggggcaaga

SEQ ID NO: 218539 - DNA, 20 bp, human
gtggttgtcgttgtccttcc

SEQ ID NO: 218540 - DNA, 20 bp, human
gtcaatgcgcaagcgcggtc

SEQ ID NO: 218541 - DNA, 20 bp, human
gcggcagaggtcgaaggagt

SEQ ID NO: 218542 - DNA, 20 bp, human
gtgaccttgagtgtcttcct

SEQ ID NO: 218543 - DNA, 20 bp, human
gctgcggcgcgaataagagc

SEQ ID NO: 218544 - DNA, 20 bp, human
ggaggcgccggcacaatgaa

SEQ ID NO: 218545 - DNA, 20 bp, human
ggcaccaaggaagacactca

SEQ ID NO: 218546 - DNA, 20 bp, human
gagccgggccggcccatcgg

SEQ ID NO: 218547 - DNA, 20 bp, human
gaaccagccctcatctctat

SEQ ID NO: 218548 - DNA, 20 bp, human
gtccggaagtatcttcccgg

SEQ ID NO: 218549 - DNA, 20 bp, human
gaggcgctgtgcccgccccc

SEQ ID NO: 218550 - DNA, 20 bp, human
gggtccccgggcgctggttg

SEQ ID NO: 218551 - DNA, 20 bp, human
ggccgggccggcccatttct

SEQ ID NO: 218552 - DNA, 20 bp, human
ggagagccgggccggcccat

SEQ ID NO: 218553 - DNA, 20 bp, human
gctgccccacccccgccgat

SEQ ID NO: 218554 - DNA, 20 bp, human
ggcacagcgcctcccccgcg

SEQ ID NO: 218555 - DNA, 20 bp, human
gggttccggaagtatcttcc

SEQ ID NO: 218556 - DNA, 20 bp, human
gcgcacgcgcacaaaggctg

SEQ ID NO: 218557 - DNA, 20 bp, human
gggggcgcgcagtcaccctt

SEQ ID NO: 218558 - DNA, 20 bp, human
gggagtgcgcggaggatcat

SEQ ID NO: 218559 - DNA, 20 bp, human
gcgcgccccctggcgaccga

SEQ ID NO: 218560 - DNA, 20 bp, human
ggcggcggtgacgtcacgtg

SEQ ID NO: 218561 - DNA, 20 bp, human
gacaaaggctggggagtgcg

SEQ ID NO: 218562 - DNA, 20 bp, human
ggtgaggcgcacgcgcacaa

SEQ ID NO: 218563 - DNA, 20 bp, human
gccgtcagcggcgagagagc

SEQ ID NO: 218564 - DNA, 20 bp, human
gtcacccttcggtcgccagg

SEQ ID NO: 218565 - DNA, 20 bp, human
gcgcacgcatgcgccgtcag

SEQ ID NO: 218566 - DNA, 20 bp, human
gagacagtctgcgaccggac

SEQ ID NO: 218567 - DNA, 20 bp, human
gcggaggggagcttgaacta

SEQ ID NO: 218568 - DNA, 20 bp, human
gaaaaagaacgggtcaaatt

SEQ ID NO: 218569 - DNA, 20 bp, human
gcgtacagagcaaggtttca

SEQ ID NO: 218570 - DNA, 20 bp, human
gtcagtcggtcgacgctcac

SEQ ID NO: 218571 - DNA, 20 bp, human
gatggcggaggctgtgccag

SEQ ID NO: 218572 - DNA, 20 bp, human
ggagacagaagccaaacagg

SEQ ID NO: 218573 - DNA, 20 bp, human
ggtggagggtaagtgcttcc

SEQ ID NO: 218574 - DNA, 20 bp, human
gcgtcgaccgactgaaacgg

SEQ ID NO: 218575 - DNA, 20 bp, human
ggaacaggacgctgactcgg

SEQ ID NO: 218576 - DNA, 20 bp, human
gcctggacagcaaaaatccg

SEQ ID NO: 218577 - DNA, 20 bp, human
gctagaaggccatgaagcga

SEQ ID NO: 218578 - DNA, 20 bp, human
gatccaggggcgtagagcag

SEQ ID NO: 218579 - DNA, 20 bp, human
gtggccttctagtagttcca

SEQ ID NO: 218580 - DNA, 20 bp, human
ggtcctgcagttagagagag

SEQ ID NO: 218581 - DNA, 20 bp, human
gagcctctgctctacgcccc

SEQ ID NO: 218582 - DNA, 20 bp, human
gcacctcgcccttcgcttca

SEQ ID NO: 218583 - DNA, 20 bp, human
ggcagaggctcacgggaagc

SEQ ID NO: 218584 - DNA, 20 bp, human
gggccatgaagcgaagggcg

SEQ ID NO: 218585 - DNA, 20 bp, human
ggctctctaccttaaaaggt

SEQ ID NO: 218586 - DNA, 20 bp, human
gcctggacagcaaaaatccg

SEQ ID NO: 218587 - DNA, 20 bp, human
gctagaaggccatgaagcga

SEQ ID NO: 218588 - DNA, 20 bp, human
gatccaggggcgtagagcag

SEQ ID NO: 218589 - DNA, 20 bp, human
gtggccttctagtagttcca

SEQ ID NO: 218590 - DNA, 20 bp, human
ggtcctgcagttagagagag

SEQ ID NO: 218591 - DNA, 20 bp, human
gagcctctgctctacgcccc

SEQ ID NO: 218592 - DNA, 20 bp, human
gcacctcgcccttcgcttca

SEQ ID NO: 218593 - DNA, 20 bp, human
ggcagaggctcacgggaagc

SEQ ID NO: 218594 - DNA, 20 bp, human
gggccatgaagcgaagggcg

SEQ ID NO: 218595 - DNA, 20 bp, human
ggctctctaccttaaaaggt

SEQ ID NO: 218596 - DNA, 20 bp, human
gctagccgccagccgaacac

SEQ ID NO: 218597 - DNA, 20 bp, human
gccggcccttgcgcctgtcc

SEQ ID NO: 218598 - DNA, 20 bp, human
gggaacggcggagtctcgat

SEQ ID NO: 218599 - DNA, 20 bp, human
gctagctgggactagcggaa

SEQ ID NO: 218600 - DNA, 20 bp, human
gcggcggcgaggcgaagcga

SEQ ID NO: 218601 - DNA, 20 bp, human
gggcgctcccggcatccctc

SEQ ID NO: 218602 - DNA, 20 bp, human
gagtgcctggacaggcgcaa

SEQ ID NO: 218603 - DNA, 20 bp, human
ggtcctgcgaccaaagggga

SEQ ID NO: 218604 - DNA, 20 bp, human
gcggcgaggcgaagcgaagg

SEQ ID NO: 218605 - DNA, 20 bp, human
gttctggcgaggccggtgtt

SEQ ID NO: 218606 - DNA, 20 bp, human
ggagaagcaggcattttgtg

SEQ ID NO: 218607 - DNA, 20 bp, human
ggtggggcagccactcgtag

SEQ ID NO: 218608 - DNA, 20 bp, human
ggcagccactcgtagaggtc

SEQ ID NO: 218609 - DNA, 20 bp, human
ggaaaagcactgcaggttca

SEQ ID NO: 218610 - DNA, 20 bp, human
ggaggtccggaaaaccggca

SEQ ID NO: 218611 - DNA, 20 bp, human
gaccctacgcaaaatagcgg

SEQ ID NO: 218612 - DNA, 20 bp, human
gaaaagaggcggcctgacct

SEQ ID NO: 218613 - DNA, 20 bp, human
gggaccccgtcccacttcca

SEQ ID NO: 218614 - DNA, 20 bp, human
ggacctccgctattttgcgt

SEQ ID NO: 218615 - DNA, 20 bp, human
gcgaccggcgcgaaaagagg

SEQ ID NO: 218616 - DNA, 20 bp, human
gccttgttctcacgttgaga

SEQ ID NO: 218617 - DNA, 20 bp, human
gtgagtggttcacttataca

SEQ ID NO: 218618 - DNA, 20 bp, human
gctgtctcgggtgacagaag

SEQ ID NO: 218619 - DNA, 20 bp, human
gagaaggctgaggaggaggc

SEQ ID NO: 218620 - DNA, 20 bp, human
gtctcacgttgagaaggctg

SEQ ID NO: 218621 - DNA, 20 bp, human
gagtgaaccactcagggtcc

SEQ ID NO: 218622 - DNA, 20 bp, human
ggcccggccaggaccctgag

SEQ ID NO: 218623 - DNA, 20 bp, human
gaccactcagggtcctggcc

SEQ ID NO: 218624 - DNA, 20 bp, human
ggggggtagtcttgctgtct

SEQ ID NO: 218625 - DNA, 20 bp, human
gaagagaaaaaaaaatcata

SEQ ID NO: 218626 - DNA, 20 bp, human
gaggcgcagagacctccctc

SEQ ID NO: 218627 - DNA, 20 bp, human
gccctgtggctccaccccga

SEQ ID NO: 218628 - DNA, 20 bp, human
gggtaagggctggaccctcg

SEQ ID NO: 218629 - DNA, 20 bp, human
gtagttcttagcagtggtaa

SEQ ID NO: 218630 - DNA, 20 bp, human
gctctgggaagtgtaggcgt

SEQ ID NO: 218631 - DNA, 20 bp, human
gaagggctggaccctcgggg

SEQ ID NO: 218632 - DNA, 20 bp, human
gcagagacctccctcgggct

SEQ ID NO: 218633 - DNA, 20 bp, human
gagatgcagtcgaagccctg

SEQ ID NO: 218634 - DNA, 20 bp, human
gaccctcggggtggagccac

SEQ ID NO: 218635 - DNA, 20 bp, human
ggcgtagggcgtcaggccgc

SEQ ID NO: 218636 - DNA, 20 bp, human
gagggaggggagcgtgcgta

SEQ ID NO: 218637 - DNA, 20 bp, human
gggcttcttctgagcgctga

SEQ ID NO: 218638 - DNA, 20 bp, human
gcttctgagcgctgagggag

SEQ ID NO: 218639 - DNA, 20 bp, human
gaataggcgcgcgcgtcgga

SEQ ID NO: 218640 - DNA, 20 bp, human
gcgaaggcgcgccacttcat

SEQ ID NO: 218641 - DNA, 20 bp, human
gagccccgcccctcacgcgg

SEQ ID NO: 218642 - DNA, 20 bp, human
ggctaaagagcgcgggtcct

SEQ ID NO: 218643 - DNA, 20 bp, human
ggaagccacttgaccctcca

SEQ ID NO: 218644 - DNA, 20 bp, human
ggggcccgcgggcttttcgc

SEQ ID NO: 218645 - DNA, 20 bp, human
gtcggccgtggagggtcaag

SEQ ID NO: 218646 - DNA, 20 bp, human
gtcaaaacgagacacaggtc

SEQ ID NO: 218647 - DNA, 20 bp, human
ggttttgaagctcagggaga

SEQ ID NO: 218648 - DNA, 20 bp, human
gtccctgggcggtaagtgac

SEQ ID NO: 218649 - DNA, 20 bp, human
gccaacagaggccctgaatg

SEQ ID NO: 218650 - DNA, 20 bp, human
gaggacggttagaaaacgcg

SEQ ID NO: 218651 - DNA, 20 bp, human
ggatctgtgagggtcgcagg

SEQ ID NO: 218652 - DNA, 20 bp, human
gaaacgcggggcgtggccac

SEQ ID NO: 218653 - DNA, 20 bp, human
gaaggatctgtgagggtcgc

SEQ ID NO: 218654 - DNA, 20 bp, human
ggggagccgccatcttgcta

SEQ ID NO: 218655 - DNA, 20 bp, human
ggactaaccaatcagaggga

SEQ ID NO: 218656 - DNA, 20 bp, human
ggggcccagctagaccgact

SEQ ID NO: 218657 - DNA, 20 bp, human
gtacctgcggccctgccggt

SEQ ID NO: 218658 - DNA, 20 bp, human
gcggcagggccgcaggtaat

SEQ ID NO: 218659 - DNA, 20 bp, human
gtcacgctccgagtgggaaa

SEQ ID NO: 218660 - DNA, 20 bp, human
ggtacagccaaccagtgaga

SEQ ID NO: 218661 - DNA, 20 bp, human
ggcaacggtcacctgatctg

SEQ ID NO: 218662 - DNA, 20 bp, human
ggccactccttctcactggt

SEQ ID NO: 218663 - DNA, 20 bp, human
gaggcgctcacgctccgagt

SEQ ID NO: 218664 - DNA, 20 bp, human
gaacgcgtcgggtgggcgta

SEQ ID NO: 218665 - DNA, 20 bp, human
gcgactaggacgagacaaga

SEQ ID NO: 218666 - DNA, 20 bp, human
ggagtagtgtggcattagat

SEQ ID NO: 218667 - DNA, 20 bp, human
gggggtggctactctggata

SEQ ID NO: 218668 - DNA, 20 bp, human
ggatgggtgatagtgacttg

SEQ ID NO: 218669 - DNA, 20 bp, human
gctctgtgcagatgtagaat

SEQ ID NO: 218670 - DNA, 20 bp, human
gtgatagtgacttggggatg

SEQ ID NO: 218671 - DNA, 20 bp, human
gctctggatagggtagttta

SEQ ID NO: 218672 - DNA, 20 bp, human
gactgaaagatcagtgaaga

SEQ ID NO: 218673 - DNA, 20 bp, human
gtggggtctgagagttacac

SEQ ID NO: 218674 - DNA, 20 bp, human
gtagtgactgaggagtagtg

SEQ ID NO: 218675 - DNA, 20 bp, human
ggtaggtaccgggaatatgg

SEQ ID NO: 218676 - DNA, 20 bp, human
ggctggcgtccgtagccggg

SEQ ID NO: 218677 - DNA, 20 bp, human
gagaaagatctgcactcggg

SEQ ID NO: 218678 - DNA, 20 bp, human
gtgggaagcgacagcctgat

SEQ ID NO: 218679 - DNA, 20 bp, human
gtacggaagggacgtaacct

SEQ ID NO: 218680 - DNA, 20 bp, human
ggaagcgacagcctgatagg

SEQ ID NO: 218681 - DNA, 20 bp, human
gccccccggtcggtgatgac

SEQ ID NO: 218682 - DNA, 20 bp, human
gtcccagcggaagcgacgaa

SEQ ID NO: 218683 - DNA, 20 bp, human
ggtagggcgggtagtcggaa

SEQ ID NO: 218684 - DNA, 20 bp, human
ggacccgtcatcaccgaccg

SEQ ID NO: 218685 - DNA, 20 bp, human
ggggtgatggagctagtcga

SEQ ID NO: 218686 - DNA, 20 bp, human
gcagcagtgcggagtcacgg

SEQ ID NO: 218687 - DNA, 20 bp, human
gctggggagggttagcgggt

SEQ ID NO: 218688 - DNA, 20 bp, human
gctgcagcagtgcggagtca

SEQ ID NO: 218689 - DNA, 20 bp, human
gcacgctggggagggttagc

SEQ ID NO: 218690 - DNA, 20 bp, human
gagggaggctcaggaactta

SEQ ID NO: 218691 - DNA, 20 bp, human
gacaacctaccccagtataa

SEQ ID NO: 218692 - DNA, 20 bp, human
gtacagcacaggggccaaca

SEQ ID NO: 218693 - DNA, 20 bp, human
gaacatggcgtcagcacgct

SEQ ID NO: 218694 - DNA, 20 bp, human
ggcgtggagatacagcacag

SEQ ID NO: 218695 - DNA, 20 bp, human
gaatggggcgcagcctcgcc

SEQ ID NO: 218696 - DNA, 20 bp, human
gccaaccagcgcgaacccgg

SEQ ID NO: 218697 - DNA, 20 bp, human
ggtacccgccgggttcgcgc

SEQ ID NO: 218698 - DNA, 20 bp, human
ggggccaaccagcgcgaacc

SEQ ID NO: 218699 - DNA, 20 bp, human
ggccctgccgccacgtcgtg

SEQ ID NO: 218700 - DNA, 20 bp, human
gactgcagctggcgctccgc

SEQ ID NO: 218701 - DNA, 20 bp, human
gccccccgccggccgaccaa

SEQ ID NO: 218702 - DNA, 20 bp, human
gacctcgcggactgctgtgg

SEQ ID NO: 218703 - DNA, 20 bp, human
ggtcgtgcggcgacaacctc

SEQ ID NO: 218704 - DNA, 20 bp, human
gtgcagtggtcgtacccgcc

SEQ ID NO: 218705 - DNA, 20 bp, human
gttgtcgccgcacgacgtgg

SEQ ID NO: 218706 - DNA, 20 bp, human
gagctctgttgtatcaacac

SEQ ID NO: 218707 - DNA, 20 bp, human
gaagccacctgcggattcac

SEQ ID NO: 218708 - DNA, 20 bp, human
gtgctgggaacttaaggtca

SEQ ID NO: 218709 - DNA, 20 bp, human
gaggttgaggacaagattcc

SEQ ID NO: 218710 - DNA, 20 bp, human
gatcaacactggcctgttgt

SEQ ID NO: 218711 - DNA, 20 bp, human
ggtttactggggtccttcta

SEQ ID NO: 218712 - DNA, 20 bp, human
ggggtccttctaaggcctcc

SEQ ID NO: 218713 - DNA, 20 bp, human
ggaaagtaacttgcccctca

SEQ ID NO: 218714 - DNA, 20 bp, human
gcagccagtgaatccgcagg

SEQ ID NO: 218715 - DNA, 20 bp, human
ggattcctggaggccttaga

SEQ ID NO: 218716 - DNA, 20 bp, human
gctggggcagggggggtctt

SEQ ID NO: 218717 - DNA, 20 bp, human
gagtatctgatctccgtctc

SEQ ID NO: 218718 - DNA, 20 bp, human
gggcagggggggtcttaggt

SEQ ID NO: 218719 - DNA, 20 bp, human
gtgaaggattaggcaggggg

SEQ ID NO: 218720 - DNA, 20 bp, human
gcagcccagtggggctgaga

SEQ ID NO: 218721 - DNA, 20 bp, human
gtgctggagtctcacccatc

SEQ ID NO: 218722 - DNA, 20 bp, human
ggcaaagcacgacagcccag

SEQ ID NO: 218723 - DNA, 20 bp, human
gatactcaattcctcagcta

SEQ ID NO: 218724 - DNA, 20 bp, human
ggggatggaggacttaggaa

SEQ ID NO: 218725 - DNA, 20 bp, human
gggggaagattctttggcca

SEQ ID NO: 218726 - DNA, 20 bp, human
gtagtcacgcgtctcggcgg

SEQ ID NO: 218727 - DNA, 20 bp, human
gccgccgcccgtctagagca

SEQ ID NO: 218728 - DNA, 20 bp, human
ggctggaaccgcaggcgctg

SEQ ID NO: 218729 - DNA, 20 bp, human
gggagagactcgagaaggac

SEQ ID NO: 218730 - DNA, 20 bp, human
gcaggctcgggaataaaaca

SEQ ID NO: 218731 - DNA, 20 bp, human
ggcggcgctgcgcggggaac

SEQ ID NO: 218732 - DNA, 20 bp, human
gtcgccttgctctagacggg

SEQ ID NO: 218733 - DNA, 20 bp, human
gcttgggcgccctcctctct

SEQ ID NO: 218734 - DNA, 20 bp, human
gttgtagtcacgcgtctcgg

SEQ ID NO: 218735 - DNA, 20 bp, human
ggtaccacgtgaccccacgc

SEQ ID NO: 218736 - DNA, 20 bp, human
gaccagcgcccggaggggtg

SEQ ID NO: 218737 - DNA, 20 bp, human
ggtacaaagaaaagcgtcgc

SEQ ID NO: 218738 - DNA, 20 bp, human
gcgcccggaaacacccgcgg

SEQ ID NO: 218739 - DNA, 20 bp, human
gcggcccgttgacctccccc

SEQ ID NO: 218740 - DNA, 20 bp, human
gacagcccgggggaggtcaa

SEQ ID NO: 218741 - DNA, 20 bp, human
ggggcccaggtcatgtgacg

SEQ ID NO: 218742 - DNA, 20 bp, human
ggcgcgtcgtctgcaggtgt

SEQ ID NO: 218743 - DNA, 20 bp, human
gcccacggtgcgaagtggta

SEQ ID NO: 218744 - DNA, 20 bp, human
ggctgcggagatccagaggc

SEQ ID NO: 218745 - DNA, 20 bp, human
ggaaacacccgcggaggccg

SEQ ID NO: 218746 - DNA, 20 bp, human
ggggcgggcggggtaaagaa

SEQ ID NO: 218747 - DNA, 20 bp, human
gggaagcgcggtgcaggcgt

SEQ ID NO: 218748 - DNA, 20 bp, human
ggcgcctgcgcgctaaaaag

SEQ ID NO: 218749 - DNA, 20 bp, human
ggcctcacgtgaccataagg

SEQ ID NO: 218750 - DNA, 20 bp, human
gaaccggggaaagctagaga

SEQ ID NO: 218751 - DNA, 20 bp, human
gtcagagccacgccccctta

SEQ ID NO: 218752 - DNA, 20 bp, human
ggggtggctgcgcggaagcg

SEQ ID NO: 218753 - DNA, 20 bp, human
ggcggtgcccggcttccggg

SEQ ID NO: 218754 - DNA, 20 bp, human
gggccacaggcgccaccaag

SEQ ID NO: 218755 - DNA, 20 bp, human
gtgagcggtgcccggcttcc

SEQ ID NO: 218756 - DNA, 20 bp, human
gctgggaagggtcccatctg

SEQ ID NO: 218757 - DNA, 20 bp, human
gcaggcaacaaaccacgatt

SEQ ID NO: 218758 - DNA, 20 bp, human
gcattgttgctgtataaaca

SEQ ID NO: 218759 - DNA, 20 bp, human
gaaaaagagatatgagagtc

SEQ ID NO: 218760 - DNA, 20 bp, human
gtgaaagccactgaaaccag

SEQ ID NO: 218761 - DNA, 20 bp, human
gttgttgcctgggtttactt

SEQ ID NO: 218762 - DNA, 20 bp, human
gagatgacccaagtaaaccc

SEQ ID NO: 218763 - DNA, 20 bp, human
gcccaatagtaaagctggga

SEQ ID NO: 218764 - DNA, 20 bp, human
ggcagcacaagcaatctatc

SEQ ID NO: 218765 - DNA, 20 bp, human
gcccttcccagctttactat

SEQ ID NO: 218766 - DNA, 20 bp, human
gtgaccgaatccctagctct

SEQ ID NO: 218767 - DNA, 20 bp, human
gcgcccctcggggagcccag

SEQ ID NO: 218768 - DNA, 20 bp, human
gagacagccaggcgaaggcg

SEQ ID NO: 218769 - DNA, 20 bp, human
ggcagagccccgccttcgcc

SEQ ID NO: 218770 - DNA, 20 bp, human
gcgagtgaggcgacggggta

SEQ ID NO: 218771 - DNA, 20 bp, human
ggtcgctcaccccagagcta

SEQ ID NO: 218772 - DNA, 20 bp, human
gctagggattcggtcacccg

SEQ ID NO: 218773 - DNA, 20 bp, human
gggtgagcgacatgcctcca

SEQ ID NO: 218774 - DNA, 20 bp, human
gaggcggggcttgcacacgc

SEQ ID NO: 218775 - DNA, 20 bp, human
ggtaggggttggcgctcagg

SEQ ID NO: 218776 - DNA, 20 bp, human
gcggccgcgcccctattcct

SEQ ID NO: 218777 - DNA, 20 bp, human
gagcgagtgggctcctaggc

SEQ ID NO: 218778 - DNA, 20 bp, human
ggtcctgagtgacagcgcgg

SEQ ID NO: 218779 - DNA, 20 bp, human
gtaggagcccactcgctgat

SEQ ID NO: 218780 - DNA, 20 bp, human
gccggcccggctgatcgctt

SEQ ID NO: 218781 - DNA, 20 bp, human
gacccatcgccgaaaccggg

SEQ ID NO: 218782 - DNA, 20 bp, human
ggagaaatgccgaggaatag

SEQ ID NO: 218783 - DNA, 20 bp, human
gcggacagagagaaatgccg

SEQ ID NO: 218784 - DNA, 20 bp, human
gcccgaaagaccgctggggt

SEQ ID NO: 218785 - DNA, 20 bp, human
ggcccgccgcgctgtcactc

SEQ ID NO: 218786 - DNA, 20 bp, human
gccagcgctctacatctcgg

SEQ ID NO: 218787 - DNA, 20 bp, human
gggagggtagccaatctatc

SEQ ID NO: 218788 - DNA, 20 bp, human
ggagctcgacgtcatgtgac

SEQ ID NO: 218789 - DNA, 20 bp, human
gagtccgccggtaaaattcc

SEQ ID NO: 218790 - DNA, 20 bp, human
gacgttcacgccacaatcga

SEQ ID NO: 218791 - DNA, 20 bp, human
ggagatgtagagcgctggga

SEQ ID NO: 218792 - DNA, 20 bp, human
gcggtggcgttccgtccctc

SEQ ID NO: 218793 - DNA, 20 bp, human
gatcgagggacaggaaatgg

SEQ ID NO: 218794 - DNA, 20 bp, human
ggagcctggaattttaccgg

SEQ ID NO: 218795 - DNA, 20 bp, human
gtcagagcctggaattttac

SEQ ID NO: 218796 - DNA, 20 bp, human
ggcacctgatggtccagggg

SEQ ID NO: 218797 - DNA, 20 bp, human
ggggcagcctgccagaagtt

SEQ ID NO: 218798 - DNA, 20 bp, human
gtccagctctcaggtgacgg

SEQ ID NO: 218799 - DNA, 20 bp, human
gccagaaagagctgtggtga

SEQ ID NO: 218800 - DNA, 20 bp, human
gtctaggttgacagtaaaca

SEQ ID NO: 218801 - DNA, 20 bp, human
gtgtggtgagggacgagtgt

SEQ ID NO: 218802 - DNA, 20 bp, human
gaaccgcctagcacagaaga

SEQ ID NO: 218803 - DNA, 20 bp, human
gacaccaagctgtgcaggtc

SEQ ID NO: 218804 - DNA, 20 bp, human
ggacagcacctgatggtcca

SEQ ID NO: 218805 - DNA, 20 bp, human
gaggagtgcagggtaaggtc

SEQ ID NO: 218806 - DNA, 20 bp, human
gcgcgcgggcgcagagggaa

SEQ ID NO: 218807 - DNA, 20 bp, human
ggcgcgaagtcacgaggctg

SEQ ID NO: 218808 - DNA, 20 bp, human
ggcgccgcagcgcgcatagg

SEQ ID NO: 218809 - DNA, 20 bp, human
gccagcggcgcgaagtcacg

SEQ ID NO: 218810 - DNA, 20 bp, human
ggctccgcctatgcgcgctg

SEQ ID NO: 218811 - DNA, 20 bp, human
gaggagctgaccagcgtgct

SEQ ID NO: 218812 - DNA, 20 bp, human
gcaagcaggtctggccccag

SEQ ID NO: 218813 - DNA, 20 bp, human
gagacctgcttgcgagcaag

SEQ ID NO: 218814 - DNA, 20 bp, human
gcgcacgcgcagatatacca

SEQ ID NO: 218815 - DNA, 20 bp, human
gaggcgcacaagcggagtga

SEQ ID NO: 218816 - DNA, 20 bp, human
gcaaggggaccctatattcg

SEQ ID NO: 218817 - DNA, 20 bp, human
gggactaggaggctacgggg

SEQ ID NO: 218818 - DNA, 20 bp, human
gggaggctacggggcggcaa

SEQ ID NO: 218819 - DNA, 20 bp, human
ggggcgggactaggaggcta

SEQ ID NO: 218820 - DNA, 20 bp, human
ggcgatcagccccgaatata

SEQ ID NO: 218821 - DNA, 20 bp, human
ggctgccactgccgggcctt

SEQ ID NO: 218822 - DNA, 20 bp, human
gagtggagaagcccttgtag

SEQ ID NO: 218823 - DNA, 20 bp, human
gtgtctccaaccccctacaa

SEQ ID NO: 218824 - DNA, 20 bp, human
gtagtcccgcccctctccca

SEQ ID NO: 218825 - DNA, 20 bp, human
gatcgctgttgttccagagt

SEQ ID NO: 218826 - DNA, 20 bp, human
ggccctcgcgcgtaggggac

SEQ ID NO: 218827 - DNA, 20 bp, human
gtcccgcctcgctccagcca

SEQ ID NO: 218828 - DNA, 20 bp, human
ggccccggccctcgcgcgta

SEQ ID NO: 218829 - DNA, 20 bp, human
gcccctacgcgcgagggccg

SEQ ID NO: 218830 - DNA, 20 bp, human
gacgcggcagcgcagtcgtg

SEQ ID NO: 218831 - DNA, 20 bp, human
ggtgcggcaggagaccccgt

SEQ ID NO: 218832 - DNA, 20 bp, human
gccgccccgccttttatccc

SEQ ID NO: 218833 - DNA, 20 bp, human
gcacccgcgcccacacggac

SEQ ID NO: 218834 - DNA, 20 bp, human
gcccgtatgcaaatatcctg

SEQ ID NO: 218835 - DNA, 20 bp, human
gtccagtcccctacgcgcga

SEQ ID NO: 218836 - DNA, 20 bp, human
ggggaggcgaaccggaattg

SEQ ID NO: 218837 - DNA, 20 bp, human
ggaggggttgggaggcgaac

SEQ ID NO: 218838 - DNA, 20 bp, human
gttgtcacaggcgacgaagg

SEQ ID NO: 218839 - DNA, 20 bp, human
gtgcgcgcgcctcgacatcc

SEQ ID NO: 218840 - DNA, 20 bp, human
ggaattgaggggtggttccg

SEQ ID NO: 218841 - DNA, 20 bp, human
gcggttgtcacaggcgacga

SEQ ID NO: 218842 - DNA, 20 bp, human
gaggcgttgcccggatgtcg

SEQ ID NO: 218843 - DNA, 20 bp, human
gcgcctgtgacaaccggaag

SEQ ID NO: 218844 - DNA, 20 bp, human
ggacccctcttgttgctaag

SEQ ID NO: 218845 - DNA, 20 bp, human
gacagaacagaggcgttgcc

SEQ ID NO: 218846 - DNA, 20 bp, human
gcacgagtcagcgacgtaga

SEQ ID NO: 218847 - DNA, 20 bp, human
gggcgtcgctctcttcccat

SEQ ID NO: 218848 - DNA, 20 bp, human
gtaggaaaaaaataccggtc

SEQ ID NO: 218849 - DNA, 20 bp, human
ggcgcccacaggccgggaca

SEQ ID NO: 218850 - DNA, 20 bp, human
gccgccctgtcccggcctgt

SEQ ID NO: 218851 - DNA, 20 bp, human
gggcctgtgggcgcgtcctc

SEQ ID NO: 218852 - DNA, 20 bp, human
gaactgggatcttgggtagg

SEQ ID NO: 218853 - DNA, 20 bp, human
gagcgacgtagaaggacccg

SEQ ID NO: 218854 - DNA, 20 bp, human
gcgctgactcgtgacctgac

SEQ ID NO: 218855 - DNA, 20 bp, human
gacacagggttatgggctta

SEQ ID NO: 218856 - DNA, 20 bp, human
gccaacccgggcccctcccg

SEQ ID NO: 218857 - DNA, 20 bp, human
ggaggggcccgggttggcgc

SEQ ID NO: 218858 - DNA, 20 bp, human
gtgcgaggggagccgctgca

SEQ ID NO: 218859 - DNA, 20 bp, human
gcccccccggccccatgcag

SEQ ID NO: 218860 - DNA, 20 bp, human
ggagacggcaactttgggga

SEQ ID NO: 218861 - DNA, 20 bp, human
ggcaactttggggagggcgg

SEQ ID NO: 218862 - DNA, 20 bp, human
gccgggggagacggcaactt

SEQ ID NO: 218863 - DNA, 20 bp, human
gctccggggcgccgcgggag

SEQ ID NO: 218864 - DNA, 20 bp, human
gggcgccgcgggaggggccc

SEQ ID NO: 218865 - DNA, 20 bp, human
gtccccgccccgcgccaacc

SEQ ID NO: 218866 - DNA, 20 bp, human
gaggactgcgcatgctcgaa

SEQ ID NO: 218867 - DNA, 20 bp, human
gaacgaatgaatgcccgcga

SEQ ID NO: 218868 - DNA, 20 bp, human
ggtaaagacaggcccgaacc

SEQ ID NO: 218869 - DNA, 20 bp, human
gtggtgccgcgcggtcttct

SEQ ID NO: 218870 - DNA, 20 bp, human
gaatcgtagtcccctggttc

SEQ ID NO: 218871 - DNA, 20 bp, human
gcgcaggcgtattcacatgg

SEQ ID NO: 218872 - DNA, 20 bp, human
ggcggcaccacgtccttcgc

SEQ ID NO: 218873 - DNA, 20 bp, human
gcggcgcaggcgtattcaca

SEQ ID NO: 218874 - DNA, 20 bp, human
gcatgtcccggaatgcggct

SEQ ID NO: 218875 - DNA, 20 bp, human
gagtaactgcgtctcttctc

SEQ ID NO: 218876 - DNA, 20 bp, human
gagcaagcgcagattgtggg

SEQ ID NO: 218877 - DNA, 20 bp, human
gactgcgcagtagactgcac

SEQ ID NO: 218878 - DNA, 20 bp, human
gacagggtagccattaaaag

SEQ ID NO: 218879 - DNA, 20 bp, human
gctgtgattcggcagaaatg

SEQ ID NO: 218880 - DNA, 20 bp, human
gtgcggtcacgtgacaacgg

SEQ ID NO: 218881 - DNA, 20 bp, human
gtgattcggcagaaatgggg

SEQ ID NO: 218882 - DNA, 20 bp, human
gacagagtgaaccagcgaca

SEQ ID NO: 218883 - DNA, 20 bp, human
ggagcagtgtggagagtagg

SEQ ID NO: 218884 - DNA, 20 bp, human
gctgtgcggtcacgtgacaa

SEQ ID NO: 218885 - DNA, 20 bp, human
gttaatggctaccctgtcgc

SEQ ID NO: 218886 - DNA, 20 bp, human
gaggaccagtcatcaatagg

SEQ ID NO: 218887 - DNA, 20 bp, human
gaggaggaccagtcatcaat

SEQ ID NO: 218888 - DNA, 20 bp, human
ggctcccaggcggccccttt

SEQ ID NO: 218889 - DNA, 20 bp, human
gtcccagtcggaaaggtcta

SEQ ID NO: 218890 - DNA, 20 bp, human
gttagccatcccagtcggaa

SEQ ID NO: 218891 - DNA, 20 bp, human
gtgctcaggcagtacccaaa

SEQ ID NO: 218892 - DNA, 20 bp, human
gtcggaaaggtctagggatg

SEQ ID NO: 218893 - DNA, 20 bp, human
gaaaggtctagggatgaggc

SEQ ID NO: 218894 - DNA, 20 bp, human
gcggagacgggggagtactg

SEQ ID NO: 218895 - DNA, 20 bp, human
gcaggggagcactaagaccc

SEQ ID NO: 218896 - DNA, 20 bp, human
gtcccaaggaaagcccaagg

SEQ ID NO: 218897 - DNA, 20 bp, human
ggggtcccaaggaaagccca

SEQ ID NO: 218898 - DNA, 20 bp, human
gagctcttctgtatgagata

SEQ ID NO: 218899 - DNA, 20 bp, human
gcatacagaagagctaagat

SEQ ID NO: 218900 - DNA, 20 bp, human
ggagctaagattggcagaaa

SEQ ID NO: 218901 - DNA, 20 bp, human
ggctggatagctgggtccca

SEQ ID NO: 218902 - DNA, 20 bp, human
gggaaaccaacattcttaaa

SEQ ID NO: 218903 - DNA, 20 bp, human
gtaaacatgtcaatgtttct

SEQ ID NO: 218904 - DNA, 20 bp, human
gaatgtttcttggaagatta

SEQ ID NO: 218905 - DNA, 20 bp, human
gctttattgggctggatagc

SEQ ID NO: 218906 - DNA, 20 bp, human
ggggccccggagcgacgcaa

SEQ ID NO: 218907 - DNA, 20 bp, human
gcgctgcggcggggcttgtt

SEQ ID NO: 218908 - DNA, 20 bp, human
gcggcggggcttgttcggtg

SEQ ID NO: 218909 - DNA, 20 bp, human
ggggcccaagttacggactc

SEQ ID NO: 218910 - DNA, 20 bp, human
ggcgccggtcacgtgatcgg

SEQ ID NO: 218911 - DNA, 20 bp, human
gctagtgcctcgcctagggg

SEQ ID NO: 218912 - DNA, 20 bp, human
ggagacgttgagggccgcac

SEQ ID NO: 218913 - DNA, 20 bp, human
gctaggcgaggcactaggtc

SEQ ID NO: 218914 - DNA, 20 bp, human
gtgagggccgcacaggtaga

SEQ ID NO: 218915 - DNA, 20 bp, human
gcgctccggggcccaagtta

SEQ ID NO: 218916 - DNA, 20 bp, human
gaggggcatcacccggaagt

SEQ ID NO: 218917 - DNA, 20 bp, human
gcggaagtgggggtagtcga

SEQ ID NO: 218918 - DNA, 20 bp, human
gccacgggaaagagagcgac

SEQ ID NO: 218919 - DNA, 20 bp, human
gccgacacgcagcctcgagt

SEQ ID NO: 218920 - DNA, 20 bp, human
gccggaagcagggccgccac

SEQ ID NO: 218921 - DNA, 20 bp, human
gcctaacaaagacccactcg

SEQ ID NO: 218922 - DNA, 20 bp, human
gagcgactggtcacgtgaaa

SEQ ID NO: 218923 - DNA, 20 bp, human
gggcggccctgcttccggca

SEQ ID NO: 218924 - DNA, 20 bp, human
gaggctgcgtgtcggcccgg

SEQ ID NO: 218925 - DNA, 20 bp, human
gtgtcggcccgggggcagca

SEQ ID NO: 218926 - DNA, 20 bp, human
gagcgacggctgtcaatcac

SEQ ID NO: 218927 - DNA, 20 bp, human
gcaggcgggggcttctagtg

SEQ ID NO: 218928 - DNA, 20 bp, human
gcgggggcttctagtggggg

SEQ ID NO: 218929 - DNA, 20 bp, human
gggctcccgcccccgtgggc

SEQ ID NO: 218930 - DNA, 20 bp, human
gcagccaatagaatatgccg

SEQ ID NO: 218931 - DNA, 20 bp, human
gcgaggcgtagactagtgtt

SEQ ID NO: 218932 - DNA, 20 bp, human
gactgctgtcccgcccacgg

SEQ ID NO: 218933 - DNA, 20 bp, human
gacgcctcggcatattctat

SEQ ID NO: 218934 - DNA, 20 bp, human
ggtaacgcacaattggcccg

SEQ ID NO: 218935 - DNA, 20 bp, human
gcgtagactagtgttcggcg

SEQ ID NO: 218936 - DNA, 20 bp, human
ggtcaaccaactccacaggg

SEQ ID NO: 218937 - DNA, 20 bp, human
gagcaaggaaggcgggtgag

SEQ ID NO: 218938 - DNA, 20 bp, human
gaaacgctggaggactaagg

SEQ ID NO: 218939 - DNA, 20 bp, human
gcgaaaacgctggaggacta

SEQ ID NO: 218940 - DNA, 20 bp, human
gggaccgtatcacgactcaa

SEQ ID NO: 218941 - DNA, 20 bp, human
gccccctttgagtcgtgata

SEQ ID NO: 218942 - DNA, 20 bp, human
ggatacggtccgaagcgggg

SEQ ID NO: 218943 - DNA, 20 bp, human
gcgggtcaaccaactccaca

SEQ ID NO: 218944 - DNA, 20 bp, human
gacccgccttccttgctgag

SEQ ID NO: 218945 - DNA, 20 bp, human
gaagccaggggtagcgggag

SEQ ID NO: 218946 - DNA, 20 bp, human
ggcgatggggagggcttggt

SEQ ID NO: 218947 - DNA, 20 bp, human
ggaccggggcttttaggtgt

SEQ ID NO: 218948 - DNA, 20 bp, human
gacgcaggaccggggctttt

SEQ ID NO: 218949 - DNA, 20 bp, human
gaggtaaataggtagcagac

SEQ ID NO: 218950 - DNA, 20 bp, human
gaggagaggggtgcacctgg

SEQ ID NO: 218951 - DNA, 20 bp, human
ggaggagcggacgggaggct

SEQ ID NO: 218952 - DNA, 20 bp, human
gccggtcctgcgtaatattg

SEQ ID NO: 218953 - DNA, 20 bp, human
gttgctgttaaggttcccta

SEQ ID NO: 218954 - DNA, 20 bp, human
gtcccgcggggctccgctca

SEQ ID NO: 218955 - DNA, 20 bp, human
ggggatccgcaatattacgc

SEQ ID NO: 218956 - DNA, 20 bp, human
ggggctcggaagactgaaag

SEQ ID NO: 218957 - DNA, 20 bp, human
gtgactccaggacgcacgga

SEQ ID NO: 218958 - DNA, 20 bp, human
gcggccgccgagcctcgctg

SEQ ID NO: 218959 - DNA, 20 bp, human
ggggcgaggcaagggctcgt

SEQ ID NO: 218960 - DNA, 20 bp, human
gtccctccctagggcggaga

SEQ ID NO: 218961 - DNA, 20 bp, human
gaggcaagggctcgtaggct

SEQ ID NO: 218962 - DNA, 20 bp, human
gtggactgcaagccccgggg

SEQ ID NO: 218963 - DNA, 20 bp, human
gctcaggctgggcgaggcaa

SEQ ID NO: 218964 - DNA, 20 bp, human
gagggctcgtaggctgggct

SEQ ID NO: 218965 - DNA, 20 bp, human
ggccgcagcaactgggtctc

SEQ ID NO: 218966 - DNA, 20 bp, human
ggccacgccgaggctcggaa

SEQ ID NO: 218967 - DNA, 20 bp, human
ggctccgaggagcgagagtc

SEQ ID NO: 218968 - DNA, 20 bp, human
gtcccagcccagccacgccg

SEQ ID NO: 218969 - DNA, 20 bp, human
gcggatggacgtacgtgtgg

SEQ ID NO: 218970 - DNA, 20 bp, human
gtccacccagggggcgtggt

SEQ ID NO: 218971 - DNA, 20 bp, human
gtgagggcaacctggcgcca

SEQ ID NO: 218972 - DNA, 20 bp, human
gggaggctagatcgctctga

SEQ ID NO: 218973 - DNA, 20 bp, human
gggggcggaagtgacggagc

SEQ ID NO: 218974 - DNA, 20 bp, human
gcacgccccctgggtggagg

SEQ ID NO: 218975 - DNA, 20 bp, human
gtcttagcccttccgagcct

SEQ ID NO: 218976 - DNA, 20 bp, human
ggacacgccgagcacgccca

SEQ ID NO: 218977 - DNA, 20 bp, human
ggcagtccgctcacccgcat

SEQ ID NO: 218978 - DNA, 20 bp, human
gggactgccggcgttgtcgg

SEQ ID NO: 218979 - DNA, 20 bp, human
gcggttgcccccgacaacgc

SEQ ID NO: 218980 - DNA, 20 bp, human
gcacgctggcatccgccggg

SEQ ID NO: 218981 - DNA, 20 bp, human
gacacctgcagtcttatctt

SEQ ID NO: 218982 - DNA, 20 bp, human
gcgccccccatgccccccgg

SEQ ID NO: 218983 - DNA, 20 bp, human
gggcgtgctcggcgtgtccg

SEQ ID NO: 218984 - DNA, 20 bp, human
gtggaaaaacgaggggagca

SEQ ID NO: 218985 - DNA, 20 bp, human
ggcggaaccctgggcgtgct

SEQ ID NO: 218986 - DNA, 20 bp, human
gtggggccaaggcgaagaag

SEQ ID NO: 218987 - DNA, 20 bp, human
ggagcacggccgagcaggat

SEQ ID NO: 218988 - DNA, 20 bp, human
ggggacgcggtcacggccga

SEQ ID NO: 218989 - DNA, 20 bp, human
ggccgggatagaagacgctc

SEQ ID NO: 218990 - DNA, 20 bp, human
ggcctggcccccatcctgct

SEQ ID NO: 218991 - DNA, 20 bp, human
gtggccaagcccctgagtcc

SEQ ID NO: 218992 - DNA, 20 bp, human
ggagcctcgcagaacaggcc

SEQ ID NO: 218993 - DNA, 20 bp, human
gtatcccggcctgttctgcg

SEQ ID NO: 218994 - DNA, 20 bp, human
gcagtgttatggtaggggcg

SEQ ID NO: 218995 - DNA, 20 bp, human
ggagcggagcacggccgagc

SEQ ID NO: 218996 - DNA, 20 bp, human
gaaaacaaactgggtctcta

SEQ ID NO: 218997 - DNA, 20 bp, human
gcagcaggagcaggcaacta

SEQ ID NO: 218998 - DNA, 20 bp, human
gcctgctgacaggacagaac

SEQ ID NO: 218999 - DNA, 20 bp, human
gagcttccggtggtggtaag

SEQ ID NO: 219000 - DNA, 20 bp, human
ggacagaactggttaatctt

SEQ ID NO: 219001 - DNA, 20 bp, human
gaggagcaggcaactagggg

SEQ ID NO: 219002 - DNA, 20 bp, human
gcactgtcagtgaggaattg

SEQ ID NO: 219003 - DNA, 20 bp, human
gctgtcctgtcagcaggagc

SEQ ID NO: 219004 - DNA, 20 bp, human
ggccatctagcagcttccgg

SEQ ID NO: 219005 - DNA, 20 bp, human
gcctcagaagccagcctctt

SEQ ID NO: 219006 - DNA, 20 bp, human
ggggccgggcccgcagcgag

SEQ ID NO: 219007 - DNA, 20 bp, human
ggacactgcagcggtcgcgg

SEQ ID NO: 219008 - DNA, 20 bp, human
gcgagctcgccccctcgctg

SEQ ID NO: 219009 - DNA, 20 bp, human
gaaactgggtgcatggatga

SEQ ID NO: 219010 - DNA, 20 bp, human
gcggcccgaccgacggacac

SEQ ID NO: 219011 - DNA, 20 bp, human
gagcgcgcgtgtatagggct

SEQ ID NO: 219012 - DNA, 20 bp, human
ggcgccgcgcctgccacggg

SEQ ID NO: 219013 - DNA, 20 bp, human
gtgcgcccgtgtccgtcggt

SEQ ID NO: 219014 - DNA, 20 bp, human
ggtcacagcgcgcgtgtata

SEQ ID NO: 219015 - DNA, 20 bp, human
ggatgatggtgaccaacagg

SEQ ID NO: 219016 - DNA, 20 bp, human
gccgccgctcgttacgtcat

SEQ ID NO: 219017 - DNA, 20 bp, human
gggacctcgccgcttggcgg

SEQ ID NO: 219018 - DNA, 20 bp, human
ggtgcgccgacgccaaacga

SEQ ID NO: 219019 - DNA, 20 bp, human
gcgccgacgccaaacgaggg

SEQ ID NO: 219020 - DNA, 20 bp, human
gccccgccctcgtttggcgt

SEQ ID NO: 219021 - DNA, 20 bp, human
gggtccgatgacgtaacgag

SEQ ID NO: 219022 - DNA, 20 bp, human
gtaacgagcggcggcgcgga

SEQ ID NO: 219023 - DNA, 20 bp, human
gtcagcgccaaccccggctg

SEQ ID NO: 219024 - DNA, 20 bp, human
gagtggctaaagctgggacg

SEQ ID NO: 219025 - DNA, 20 bp, human
gcgcaggaggcagtggagtc

SEQ ID NO: 219026 - DNA, 20 bp, human
ggcgggccgtggcatacaca

SEQ ID NO: 219027 - DNA, 20 bp, human
gggccgtggcatacacaggg

SEQ ID NO: 219028 - DNA, 20 bp, human
gtccgcgcgcccaaggttcc

SEQ ID NO: 219029 - DNA, 20 bp, human
gatcccgcgcccggaacctt

SEQ ID NO: 219030 - DNA, 20 bp, human
gtcctcgcggtgcttgcccc

SEQ ID NO: 219031 - DNA, 20 bp, human
gcggcgagagcgcgcagtgc

SEQ ID NO: 219032 - DNA, 20 bp, human
gaggagggggcgcgccgctc

SEQ ID NO: 219033 - DNA, 20 bp, human
ggaggaagggcgttgaattt

SEQ ID NO: 219034 - DNA, 20 bp, human
gcgcgggatagcggcgaggc

SEQ ID NO: 219035 - DNA, 20 bp, human
ggcactacagcgagtgccag

SEQ ID NO: 219036 - DNA, 20 bp, human
gtgagccaatcggaaggggc

SEQ ID NO: 219037 - DNA, 20 bp, human
gggcgggaggagaaaacacg

SEQ ID NO: 219038 - DNA, 20 bp, human
gacaccccgccccttccgat

SEQ ID NO: 219039 - DNA, 20 bp, human
gcgcctgagccaatcggaag

SEQ ID NO: 219040 - DNA, 20 bp, human
gggcgcttccgcccattggc

SEQ ID NO: 219041 - DNA, 20 bp, human
ggagcctgctcccgcccccc

SEQ ID NO: 219042 - DNA, 20 bp, human
gacgtggcgcggtgcgcgag

SEQ ID NO: 219043 - DNA, 20 bp, human
gccgaggcgcggcgtggagg

SEQ ID NO: 219044 - DNA, 20 bp, human
ggaggagaaaacacgtggcg

SEQ ID NO: 219045 - DNA, 20 bp, human
gaggcggcgcttccgcccat

SEQ ID NO: 219046 - DNA, 20 bp, human
gagcaagggcttagggccaa

SEQ ID NO: 219047 - DNA, 20 bp, human
gggccctaagcccttgctag

SEQ ID NO: 219048 - DNA, 20 bp, human
gcacccaatctggtcgacgg

SEQ ID NO: 219049 - DNA, 20 bp, human
gcgaatcccgagcaagagac

SEQ ID NO: 219050 - DNA, 20 bp, human
gcggaggggcggatgaacac

SEQ ID NO: 219051 - DNA, 20 bp, human
gaatcacgggagagcggagg

SEQ ID NO: 219052 - DNA, 20 bp, human
ggtagcgaatcacgggagag

SEQ ID NO: 219053 - DNA, 20 bp, human
gcacaggagtagcgaatcac

SEQ ID NO: 219054 - DNA, 20 bp, human
gggtccaagagccgaaattt

SEQ ID NO: 219055 - DNA, 20 bp, human
gaagcacccaatctggtcga

SEQ ID NO: 219056 - DNA, 20 bp, human
gttcacgaacgtcgctcgct

SEQ ID NO: 219057 - DNA, 20 bp, human
gggaagccgggaagccgtta

SEQ ID NO: 219058 - DNA, 20 bp, human
gcgcttgccccgccccctaa

SEQ ID NO: 219059 - DNA, 20 bp, human
gcaagcgggcgggcgtgcgt

SEQ ID NO: 219060 - DNA, 20 bp, human
gtgcgtcggtcaagtttccc

SEQ ID NO: 219061 - DNA, 20 bp, human
gagaagcaagacttccgcat

SEQ ID NO: 219062 - DNA, 20 bp, human
gccgccccctaacggcttcc

SEQ ID NO: 219063 - DNA, 20 bp, human
gaagaagcctgacgcgaccc

SEQ ID NO: 219064 - DNA, 20 bp, human
ggcccgacggagccgtgtgg

SEQ ID NO: 219065 - DNA, 20 bp, human
gtccgcatcgggggaggata

SEQ ID NO: 219066 - DNA, 20 bp, human
gtccggacgcggggaacacc

SEQ ID NO: 219067 - DNA, 20 bp, human
gaggccacgcccggggaaga

SEQ ID NO: 219068 - DNA, 20 bp, human
ggggagcggcgtctgagccg

SEQ ID NO: 219069 - DNA, 20 bp, human
gggccagtatccccgaaaga

SEQ ID NO: 219070 - DNA, 20 bp, human
gctgcccggtctccacacgt

SEQ ID NO: 219071 - DNA, 20 bp, human
ggtgccgccatgtttactga

SEQ ID NO: 219072 - DNA, 20 bp, human
ggggcctggagagcgtgagc

SEQ ID NO: 219073 - DNA, 20 bp, human
gccccggtgcctctcggcac

SEQ ID NO: 219074 - DNA, 20 bp, human
gtccccgggcgtggcctaag

SEQ ID NO: 219075 - DNA, 20 bp, human
gagccccagggcgactggac

SEQ ID NO: 219076 - DNA, 20 bp, human
gtccacgggcgggattcggc

SEQ ID NO: 219077 - DNA, 20 bp, human
gcctgcgcggccctcctcca

SEQ ID NO: 219078 - DNA, 20 bp, human
ggcaacacgcgtgaatgcta

SEQ ID NO: 219079 - DNA, 20 bp, human
ggacctctaaacaccgggcg

SEQ ID NO: 219080 - DNA, 20 bp, human
gggccccgcccggtgtttag

SEQ ID NO: 219081 - DNA, 20 bp, human
gcgacccgttaccggagagg

SEQ ID NO: 219082 - DNA, 20 bp, human
gcctccctggcactccgtgg

SEQ ID NO: 219083 - DNA, 20 bp, human
gggcccgcctctccggtaac

SEQ ID NO: 219084 - DNA, 20 bp, human
ggcgcgacccgttaccggag

SEQ ID NO: 219085 - DNA, 20 bp, human
gcccgtggacctctaaacac

SEQ ID NO: 219086 - DNA, 20 bp, human
gcgcgcgtgcgcgagtacgt

SEQ ID NO: 219087 - DNA, 20 bp, human
gcgtgcgggggcgcagacag

SEQ ID NO: 219088 - DNA, 20 bp, human
gcggggacgaaaggcgaagg

SEQ ID NO: 219089 - DNA, 20 bp, human
gcagtggtctccggcgtccg

SEQ ID NO: 219090 - DNA, 20 bp, human
gcggaggcgatcttctgacg

SEQ ID NO: 219091 - DNA, 20 bp, human
gggctcctaggcatccagtg

SEQ ID NO: 219092 - DNA, 20 bp, human
gcggtccaaaggggccacag

SEQ ID NO: 219093 - DNA, 20 bp, human
gcccgcacggccaggcgaag

SEQ ID NO: 219094 - DNA, 20 bp, human
gcgtccggcagctggagtta

SEQ ID NO: 219095 - DNA, 20 bp, human
gtctccggcgtccgcggcgc

SEQ ID NO: 219096 - DNA, 20 bp, human
ggggcggccccacgcatcgt

SEQ ID NO: 219097 - DNA, 20 bp, human
gtgggcgcgcccaacgtgga

SEQ ID NO: 219098 - DNA, 20 bp, human
gagtccccggtccctgtcag

SEQ ID NO: 219099 - DNA, 20 bp, human
gccaaggcgccgggcctgtg

SEQ ID NO: 219100 - DNA, 20 bp, human
gtcgcccgcccggcggtcaa

SEQ ID NO: 219101 - DNA, 20 bp, human
gccggggcgcccttgaccgc

SEQ ID NO: 219102 - DNA, 20 bp, human
gcacgttgtggggtcagcga

SEQ ID NO: 219103 - DNA, 20 bp, human
gccgggagcccacgatgcgt

SEQ ID NO: 219104 - DNA, 20 bp, human
gccgcccctgacagggaccg

SEQ ID NO: 219105 - DNA, 20 bp, human
gcgaggcaccggagacagaa

SEQ ID NO: 219106 - DNA, 20 bp, human
gtgggggcctgttgctaagg

SEQ ID NO: 219107 - DNA, 20 bp, human
gcccctgcgaaaaggtggag

SEQ ID NO: 219108 - DNA, 20 bp, human
gtggaccccctgcgaaaagg

SEQ ID NO: 219109 - DNA, 20 bp, human
gcgtcgaccgccttagcaac

SEQ ID NO: 219110 - DNA, 20 bp, human
gggaaattcaccttctttgg

SEQ ID NO: 219111 - DNA, 20 bp, human
ggagcctcggcccaacaaaa

SEQ ID NO: 219112 - DNA, 20 bp, human
gaggtcaattgggactaaat

SEQ ID NO: 219113 - DNA, 20 bp, human
gccaataagactctgtgctt

SEQ ID NO: 219114 - DNA, 20 bp, human
gcacagagtcttattggcta

SEQ ID NO: 219115 - DNA, 20 bp, human
gaattggaccccctgcgaaa

SEQ ID NO: 219116 - DNA, 20 bp, human
gaagtcggatccttgagctg

SEQ ID NO: 219117 - DNA, 20 bp, human
gctcaaggatccgacttcat

SEQ ID NO: 219118 - DNA, 20 bp, human
gcagccaactgctccatatt

SEQ ID NO: 219119 - DNA, 20 bp, human
ggatccttgagctgcggcgg

SEQ ID NO: 219120 - DNA, 20 bp, human
gaagccaaatatggagcagt

SEQ ID NO: 219121 - DNA, 20 bp, human
ggcgcgcagcgaagggttaa

SEQ ID NO: 219122 - DNA, 20 bp, human
gccaaagagtggctcgggat

SEQ ID NO: 219123 - DNA, 20 bp, human
ggcgctcgccgtgctctgtg

SEQ ID NO: 219124 - DNA, 20 bp, human
gcgccgggccgcccgccaga

SEQ ID NO: 219125 - DNA, 20 bp, human
gcaactaggtgcagggaccc

SEQ ID NO: 219126 - DNA, 20 bp, human
gcagacggggctcctccgag

SEQ ID NO: 219127 - DNA, 20 bp, human
ggaagtcccgcctgagggga

SEQ ID NO: 219128 - DNA, 20 bp, human
gtgagagcggggagggatgc

SEQ ID NO: 219129 - DNA, 20 bp, human
gaaggcgaggaggacgaagg

SEQ ID NO: 219130 - DNA, 20 bp, human
gggaagttctgggtgagagc

SEQ ID NO: 219131 - DNA, 20 bp, human
ggactgggaagcgtcgcaga

SEQ ID NO: 219132 - DNA, 20 bp, human
gttctgggtgagagcgggga

SEQ ID NO: 219133 - DNA, 20 bp, human
gatgctgggggtgattgact

SEQ ID NO: 219134 - DNA, 20 bp, human
gggcggaagtcccgcctgag

SEQ ID NO: 219135 - DNA, 20 bp, human
gggggcgcggcggaagttct

SEQ ID NO: 219136 - DNA, 20 bp, human
gggaccgggtcacgtgaata

SEQ ID NO: 219137 - DNA, 20 bp, human
gagccccggggcgtggtcat

SEQ ID NO: 219138 - DNA, 20 bp, human
gttcacgtgacccggtccca

SEQ ID NO: 219139 - DNA, 20 bp, human
ggagggaacgcccgacgcga

SEQ ID NO: 219140 - DNA, 20 bp, human
ggtcgggcgttccctctggt

SEQ ID NO: 219141 - DNA, 20 bp, human
ggggtcacgtgaatagggct

SEQ ID NO: 219142 - DNA, 20 bp, human
ggcccgacgcgaaggcagtg

SEQ ID NO: 219143 - DNA, 20 bp, human
gcccttctggggaacttcgg

SEQ ID NO: 219144 - DNA, 20 bp, human
ggtgacccggtcccagggag

SEQ ID NO: 219145 - DNA, 20 bp, human
gtgccacactgccttcgcgt

SEQ ID NO: 219146 - DNA, 20 bp, human
ggcgaagcggcgagactcgg

SEQ ID NO: 219147 - DNA, 20 bp, human
ggggccgggagggacacgtg

SEQ ID NO: 219148 - DNA, 20 bp, human
gtgggagcggaggtgcggat

SEQ ID NO: 219149 - DNA, 20 bp, human
ggcggcgaagcggcgagact

SEQ ID NO: 219150 - DNA, 20 bp, human
gcgggtctgcccttcgggga

SEQ ID NO: 219151 - DNA, 20 bp, human
gcagacggaagcagaacgtg

SEQ ID NO: 219152 - DNA, 20 bp, human
gtcagcctctggggcctgcc

SEQ ID NO: 219153 - DNA, 20 bp, human
ggcagctcctcggagtcccg

SEQ ID NO: 219154 - DNA, 20 bp, human
ggggacacgtgaggagcggg

SEQ ID NO: 219155 - DNA, 20 bp, human
ggctggagcgagcgccaccc

SEQ ID NO: 219156 - DNA, 20 bp, human
gcgggtgggagctcccgggg

SEQ ID NO: 219157 - DNA, 20 bp, human
gcggccgccggcttctaagg

SEQ ID NO: 219158 - DNA, 20 bp, human
gttagctcccggcgggaaag

SEQ ID NO: 219159 - DNA, 20 bp, human
gcgcgacgcagcgacggcgt

SEQ ID NO: 219160 - DNA, 20 bp, human
gaggcatcgcgacgcagcga

SEQ ID NO: 219161 - DNA, 20 bp, human
gctagccctgggagtgggta

SEQ ID NO: 219162 - DNA, 20 bp, human
gcggctggaggaaagcgaga

SEQ ID NO: 219163 - DNA, 20 bp, human
gcctccgcgggagtgtgagg

SEQ ID NO: 219164 - DNA, 20 bp, human
ggcgcgggtgggagctcccg

SEQ ID NO: 219165 - DNA, 20 bp, human
gcccacgggccgccaagtgg

SEQ ID NO: 219166 - DNA, 20 bp, human
ggaagagcgagtgaacgccg

SEQ ID NO: 219167 - DNA, 20 bp, human
gaggcccgctaacagaagct

SEQ ID NO: 219168 - DNA, 20 bp, human
gcgcagaccaatcacccgtg

SEQ ID NO: 219169 - DNA, 20 bp, human
gcccgctaacagaagctagg

SEQ ID NO: 219170 - DNA, 20 bp, human
gtaccaaggtcacgtgtccc

SEQ ID NO: 219171 - DNA, 20 bp, human
gtctgttagcgggccttctg

SEQ ID NO: 219172 - DNA, 20 bp, human
gctaggaggacgcgctacca

SEQ ID NO: 219173 - DNA, 20 bp, human
gcacgacactcgcatcctca

SEQ ID NO: 219174 - DNA, 20 bp, human
gtctgcgtgcggcacgtggg

SEQ ID NO: 219175 - DNA, 20 bp, human
gcgccggggacacgtgacct

SEQ ID NO: 219176 - DNA, 20 bp, human
ggtaaacctaaagtgaatat

SEQ ID NO: 219177 - DNA, 20 bp, human
gggacatctgaaattccaac

SEQ ID NO: 219178 - DNA, 20 bp, human
gagaagatttggcaggtaac

SEQ ID NO: 219179 - DNA, 20 bp, human
gtcagcttttgactggatac

SEQ ID NO: 219180 - DNA, 20 bp, human
gattccaacgggcactacta

SEQ ID NO: 219181 - DNA, 20 bp, human
gaacatgggctttaaccgaa

SEQ ID NO: 219182 - DNA, 20 bp, human
gttaaccgaatggacaccat

SEQ ID NO: 219183 - DNA, 20 bp, human
gagtcaccattatcatctat

SEQ ID NO: 219184 - DNA, 20 bp, human
gactgggagagaaataacat

SEQ ID NO: 219185 - DNA, 20 bp, human
gaaatcccatggtgtccatt

SEQ ID NO: 219186 - DNA, 20 bp, human
gtccgggcgagctcacctgg

SEQ ID NO: 219187 - DNA, 20 bp, human
ggccgcccccggggagtacc

SEQ ID NO: 219188 - DNA, 20 bp, human
gcccaggagaggcgggacta

SEQ ID NO: 219189 - DNA, 20 bp, human
ggccggcgcgagttggggcg

SEQ ID NO: 219190 - DNA, 20 bp, human
gtgacggggacgcccggatc

SEQ ID NO: 219191 - DNA, 20 bp, human
ggggtgggctcgtttccctg

SEQ ID NO: 219192 - DNA, 20 bp, human
gaagccgggaccccgactgc

SEQ ID NO: 219193 - DNA, 20 bp, human
gggactaggggtaccgaggg

SEQ ID NO: 219194 - DNA, 20 bp, human
gggccgcagtcaccttcccg

SEQ ID NO: 219195 - DNA, 20 bp, human
ggcgtccgggcgagctcacc

SEQ ID NO: 219196 - DNA, 20 bp, human
ggactcccgcggccgcccga

SEQ ID NO: 219197 - DNA, 20 bp, human
gcgggccgcggatgacgtca

SEQ ID NO: 219198 - DNA, 20 bp, human
ggacccagcgccgcggtggc

SEQ ID NO: 219199 - DNA, 20 bp, human
gcccgcggccgcccgaggga

SEQ ID NO: 219200 - DNA, 20 bp, human
ggatgcaagcggccgaaggg

SEQ ID NO: 219201 - DNA, 20 bp, human
ggcccgtcccctccctcggg

SEQ ID NO: 219202 - DNA, 20 bp, human
gagcaggcggcccgccaccg

SEQ ID NO: 219203 - DNA, 20 bp, human
gaggcgccagggagttccgg

SEQ ID NO: 219204 - DNA, 20 bp, human
gaggtcctggggtgcggctc

SEQ ID NO: 219205 - DNA, 20 bp, human
gggctgccatggtggggcgc

SEQ ID NO: 219206 - DNA, 20 bp, human
gccgacgcggggccgaagga

SEQ ID NO: 219207 - DNA, 20 bp, human
gcgcgcgagccccaccgagc

SEQ ID NO: 219208 - DNA, 20 bp, human
gagccccaccgagccggctc

SEQ ID NO: 219209 - DNA, 20 bp, human
gctcccggagccggctcggt

SEQ ID NO: 219210 - DNA, 20 bp, human
gcgggctcccggagccggct

SEQ ID NO: 219211 - DNA, 20 bp, human
gaacgctccgacgtcatctt

SEQ ID NO: 219212 - DNA, 20 bp, human
gagcagcagccgagagacac

SEQ ID NO: 219213 - DNA, 20 bp, human
ggcctctctgctgcccctgg

SEQ ID NO: 219214 - DNA, 20 bp, human
gcgacattgagtgttctgaa

SEQ ID NO: 219215 - DNA, 20 bp, human
ggagtgttctgaaaggggga

SEQ ID NO: 219216 - DNA, 20 bp, human
gcagaaggctgtgagtgggt

SEQ ID NO: 219217 - DNA, 20 bp, human
ggggaggcgtgcccgcgacg

SEQ ID NO: 219218 - DNA, 20 bp, human
gcgtgcccgcgacggggcga

SEQ ID NO: 219219 - DNA, 20 bp, human
gaagactgcgctggaaaggc

SEQ ID NO: 219220 - DNA, 20 bp, human
gcgaaatgcacaattgcagg

SEQ ID NO: 219221 - DNA, 20 bp, human
gactgcgctggaaaggcagg

SEQ ID NO: 219222 - DNA, 20 bp, human
gaggggagggagtctgtagg

SEQ ID NO: 219223 - DNA, 20 bp, human
gggcggacgcacggcttaga

SEQ ID NO: 219224 - DNA, 20 bp, human
gctccccctcgccccgtcgc

SEQ ID NO: 219225 - DNA, 20 bp, human
gggagagatgcagtgagctt

SEQ ID NO: 219226 - DNA, 20 bp, human
gagtctttagggaaggcggg

SEQ ID NO: 219227 - DNA, 20 bp, human
gtggggcggcgttcaaggtg

SEQ ID NO: 219228 - DNA, 20 bp, human
gccgggaggaccaataagat

SEQ ID NO: 219229 - DNA, 20 bp, human
gtggtcggggaggtccgcga

SEQ ID NO: 219230 - DNA, 20 bp, human
gcacgcctcggggtaaaggg

SEQ ID NO: 219231 - DNA, 20 bp, human
ggtgggtggggcggcgttca

SEQ ID NO: 219232 - DNA, 20 bp, human
gtggcgtcgaaagagagcgc

SEQ ID NO: 219233 - DNA, 20 bp, human
gctgggccggaaggcgtccc

SEQ ID NO: 219234 - DNA, 20 bp, human
gaggcctccctgcgattggt

SEQ ID NO: 219235 - DNA, 20 bp, human
gacctccccgaccaatcgca

SEQ ID NO: 219236 - DNA, 20 bp, human
gtggttccgcgcagactctt

SEQ ID NO: 219237 - DNA, 20 bp, human
ggcggggctaggcccgacag

SEQ ID NO: 219238 - DNA, 20 bp, human
ggcgcaggcgctctgagggg

SEQ ID NO: 219239 - DNA, 20 bp, human
gcccgacaggggagcggaag

SEQ ID NO: 219240 - DNA, 20 bp, human
gagtgcgcaggcgctctgag

SEQ ID NO: 219241 - DNA, 20 bp, human
gctgcgcggaaccagtgcgc

SEQ ID NO: 219242 - DNA, 20 bp, human
gaggggagcggaagaggccc

SEQ ID NO: 219243 - DNA, 20 bp, human
ggcctcttccgctcccctgt

SEQ ID NO: 219244 - DNA, 20 bp, human
gagcgtttgagtttatgaaa

SEQ ID NO: 219245 - DNA, 20 bp, human
gagaggatatcaattaagcg

SEQ ID NO: 219246 - DNA, 20 bp, human
gggcttcggcggggcagtga

SEQ ID NO: 219247 - DNA, 20 bp, human
ggcagtgaggggcgggaaca

SEQ ID NO: 219248 - DNA, 20 bp, human
gcggacccgccgcctcgctc

SEQ ID NO: 219249 - DNA, 20 bp, human
gtcgggtcaccgggcttcgg

SEQ ID NO: 219250 - DNA, 20 bp, human
ggggcaaggcctcgggtcac

SEQ ID NO: 219251 - DNA, 20 bp, human
gcgggcgccgccagcatgca

SEQ ID NO: 219252 - DNA, 20 bp, human
ggcgggaacacggctccgga

SEQ ID NO: 219253 - DNA, 20 bp, human
gaacacggctccggagggcg

SEQ ID NO: 219254 - DNA, 20 bp, human
ggaccgcagggcatggtcca

SEQ ID NO: 219255 - DNA, 20 bp, human
gtcgcttggagaatggggca

SEQ ID NO: 219256 - DNA, 20 bp, human
gcgtgggcggggcacagcga

SEQ ID NO: 219257 - DNA, 20 bp, human
gccgcacgcactcaagggac

SEQ ID NO: 219258 - DNA, 20 bp, human
gaacacgcactcctccgcgc

SEQ ID NO: 219259 - DNA, 20 bp, human
ggcgaaagttagtgcgtggg

SEQ ID NO: 219260 - DNA, 20 bp, human
gacccctggtctggagtcga

SEQ ID NO: 219261 - DNA, 20 bp, human
ggccgcgaaagttagtgcgt

SEQ ID NO: 219262 - DNA, 20 bp, human
gcgcgagatccgaacgtcgg

SEQ ID NO: 219263 - DNA, 20 bp, human
gcccgtcgactccagaccag

SEQ ID NO: 219264 - DNA, 20 bp, human
ggctacgtcgcgaccgcccc

SEQ ID NO: 219265 - DNA, 20 bp, human
gaaccgcggccgccgacgtt

SEQ ID NO: 219266 - DNA, 20 bp, human
gccgggaccaggattccggg

SEQ ID NO: 219267 - DNA, 20 bp, human
ggtgccgcctctgagtaggg

SEQ ID NO: 219268 - DNA, 20 bp, human
gctactcagaggcggcaccc

SEQ ID NO: 219269 - DNA, 20 bp, human
gcacgccgggaccaggattc

SEQ ID NO: 219270 - DNA, 20 bp, human
gccgtctcacaactcgcgtc

SEQ ID NO: 219271 - DNA, 20 bp, human
gcgcccgccctactcagagg

SEQ ID NO: 219272 - DNA, 20 bp, human
gcaggcggacagtaggacgc

SEQ ID NO: 219273 - DNA, 20 bp, human
gacgcgagcaggcggacagt

SEQ ID NO: 219274 - DNA, 20 bp, human
gtcccggcgtgcacttctga

SEQ ID NO: 219275 - DNA, 20 bp, human
gcacaattcccggcattcgt

SEQ ID NO: 219276 - DNA, 20 bp, human
gccgaccgcggagagcaccc

SEQ ID NO: 219277 - DNA, 20 bp, human
ggcgtcaagcttgacgtcaa

SEQ ID NO: 219278 - DNA, 20 bp, human
gagcgaggctgccttgtgat

SEQ ID NO: 219279 - DNA, 20 bp, human
gccaccacttccgggttctt

SEQ ID NO: 219280 - DNA, 20 bp, human
ggctgggactgccacaggtc

SEQ ID NO: 219281 - DNA, 20 bp, human
gaaacgcgactcaaggcgtc

SEQ ID NO: 219282 - DNA, 20 bp, human
gagccccagggtgctctccg

SEQ ID NO: 219283 - DNA, 20 bp, human
gccgacgggtgggtagaccg

SEQ ID NO: 219284 - DNA, 20 bp, human
gcgcccttaaacgcgactca

SEQ ID NO: 219285 - DNA, 20 bp, human
ggagcaagtgcgcctgcgcg

SEQ ID NO: 219286 - DNA, 20 bp, human
gtgagccaatgcagaatcgg

SEQ ID NO: 219287 - DNA, 20 bp, human
gcaggggccggattcccaac

SEQ ID NO: 219288 - DNA, 20 bp, human
gactacggaagtgacgtatc

SEQ ID NO: 219289 - DNA, 20 bp, human
gggacctgcgggtatatcca

SEQ ID NO: 219290 - DNA, 20 bp, human
ggggccctggatatacccgc

SEQ ID NO: 219291 - DNA, 20 bp, human
gaagtgcgggctcaagacta

SEQ ID NO: 219292 - DNA, 20 bp, human
gtgggaatccggcccctggg

SEQ ID NO: 219293 - DNA, 20 bp, human
ggcggcccccgattctgcat

SEQ ID NO: 219294 - DNA, 20 bp, human
gcccgaaaggcgacggtttc

SEQ ID NO: 219295 - DNA, 20 bp, human
ggggccgcgaggacgccagc

SEQ ID NO: 219296 - DNA, 20 bp, human
gggaagaggcggaatgagaa

SEQ ID NO: 219297 - DNA, 20 bp, human
ggtcctgtgacgtaagtcat

SEQ ID NO: 219298 - DNA, 20 bp, human
ggtaagtcatgggaacccaa

SEQ ID NO: 219299 - DNA, 20 bp, human
gaatgagaagggctcacgct

SEQ ID NO: 219300 - DNA, 20 bp, human
gcgggagtgggcagatgatc

SEQ ID NO: 219301 - DNA, 20 bp, human
gttgcccaatggggccgggg

SEQ ID NO: 219302 - DNA, 20 bp, human
gcatcgagccaatgggaact

SEQ ID NO: 219303 - DNA, 20 bp, human
ggccaatgggaactaggcat

SEQ ID NO: 219304 - DNA, 20 bp, human
gctcccgccccggccccatt

SEQ ID NO: 219305 - DNA, 20 bp, human
gccggcgcaaggcctgcgac

SEQ ID NO: 219306 - DNA, 20 bp, human
gggaagtgcgcccaatagaa

SEQ ID NO: 219307 - DNA, 20 bp, human
ggaactggagtgctgcggtc

SEQ ID NO: 219308 - DNA, 20 bp, human
ggagtgctgcggtccgggct

SEQ ID NO: 219309 - DNA, 20 bp, human
ggaaacgggagcctcagtcc

SEQ ID NO: 219310 - DNA, 20 bp, human
gcgctcagagaggtacttcc

SEQ ID NO: 219311 - DNA, 20 bp, human
ggggcggaactggagtgctg

SEQ ID NO: 219312 - DNA, 20 bp, human
gctattgggcgcacttccga

SEQ ID NO: 219313 - DNA, 20 bp, human
gttgacgcatgcacaccccg

SEQ ID NO: 219314 - DNA, 20 bp, human
gaggagaggggtaagtgagc

SEQ ID NO: 219315 - DNA, 20 bp, human
ggcactgaaagcgagggcca

SEQ ID NO: 219316 - DNA, 20 bp, human
ggccggcgggatcacgtgga

SEQ ID NO: 219317 - DNA, 20 bp, human
gcacgtgatcccgccggccg

SEQ ID NO: 219318 - DNA, 20 bp, human
gcgggatcacgtggacggct

SEQ ID NO: 219319 - DNA, 20 bp, human
gacacactctacaactgggg

SEQ ID NO: 219320 - DNA, 20 bp, human
gtctacacactctacaactg

SEQ ID NO: 219321 - DNA, 20 bp, human
ggagcccagggcatgcgcgc

SEQ ID NO: 219322 - DNA, 20 bp, human
gcgggcctgcgcactggggg

SEQ ID NO: 219323 - DNA, 20 bp, human
gggccgcgctcgcgagccca

SEQ ID NO: 219324 - DNA, 20 bp, human
ggggcagagttggcgcgcca

SEQ ID NO: 219325 - DNA, 20 bp, human
ggccccagcgcgcatgccct

SEQ ID NO: 219326 - DNA, 20 bp, human
gggccggcgtcccgcaggtg

SEQ ID NO: 219327 - DNA, 20 bp, human
gcccgcgcctcgctgctacc

SEQ ID NO: 219328 - DNA, 20 bp, human
gcggaggagccgcgagcgaa

SEQ ID NO: 219329 - DNA, 20 bp, human
gaaggcgcccggtagcagcg

SEQ ID NO: 219330 - DNA, 20 bp, human
ggtgcggcccgcttccggtg

SEQ ID NO: 219331 - DNA, 20 bp, human
gccgcaggtggggccggaac

SEQ ID NO: 219332 - DNA, 20 bp, human
gcccgcttccggtggggcca

SEQ ID NO: 219333 - DNA, 20 bp, human
gcaaggcatcagagataggt

SEQ ID NO: 219334 - DNA, 20 bp, human
ggcgcgcgggagccgagctg

SEQ ID NO: 219335 - DNA, 20 bp, human
gcggggcggggggattctca

SEQ ID NO: 219336 - DNA, 20 bp, human
gatgcaggaaagaggttgga

SEQ ID NO: 219337 - DNA, 20 bp, human
ggatgcattatggtgatgac

SEQ ID NO: 219338 - DNA, 20 bp, human
ggccaagctcagtgctaggt

SEQ ID NO: 219339 - DNA, 20 bp, human
gctcaaagggaggggaagtc

SEQ ID NO: 219340 - DNA, 20 bp, human
gtctttcctgcattattgat

SEQ ID NO: 219341 - DNA, 20 bp, human
ggagagcccagcatggttcc

SEQ ID NO: 219342 - DNA, 20 bp, human
ggtgctaggttggctctgat

SEQ ID NO: 219343 - DNA, 20 bp, human
gcacagcccatcaataatgc

SEQ ID NO: 219344 - DNA, 20 bp, human
gttgccaacctagacatcac

SEQ ID NO: 219345 - DNA, 20 bp, human
gttagatcagggcgtggagc

SEQ ID NO: 219346 - DNA, 20 bp, human
gaggagagatcgactctgtg

SEQ ID NO: 219347 - DNA, 20 bp, human
gagagatcgactctgtgggg

SEQ ID NO: 219348 - DNA, 20 bp, human
gggggcttacgtgacccggg

SEQ ID NO: 219349 - DNA, 20 bp, human
gagcggggtgggtctaggag

SEQ ID NO: 219350 - DNA, 20 bp, human
ggccgcacctccaggtcccg

SEQ ID NO: 219351 - DNA, 20 bp, human
gaagctgcggaagcggatga

SEQ ID NO: 219352 - DNA, 20 bp, human
gaggccgggagggccctgac

SEQ ID NO: 219353 - DNA, 20 bp, human
ggggctgtcacctgacacgg

SEQ ID NO: 219354 - DNA, 20 bp, human
gggtgggacttgacgaggag

SEQ ID NO: 219355 - DNA, 20 bp, human
gttacgtgacccgggcggct

SEQ ID NO: 219356 - DNA, 20 bp, human
gagagggtaagaggaaccga

SEQ ID NO: 219357 - DNA, 20 bp, human
gctgcagcgctctggattca

SEQ ID NO: 219358 - DNA, 20 bp, human
gtctgtgcaggggatcatag

SEQ ID NO: 219359 - DNA, 20 bp, human
gtgcaggggatcatagggga

SEQ ID NO: 219360 - DNA, 20 bp, human
ggatcataggggaggggtac

SEQ ID NO: 219361 - DNA, 20 bp, human
gaacacctgcggacataaat

SEQ ID NO: 219362 - DNA, 20 bp, human
gaccgaggggctgcgtgtta

SEQ ID NO: 219363 - DNA, 20 bp, human
gggtccaagaagagggtaag

SEQ ID NO: 219364 - DNA, 20 bp, human
ggggaggggtacgggccgcc

SEQ ID NO: 219365 - DNA, 20 bp, human
gcagccgtcagcagtgattc

SEQ ID NO: 219366 - DNA, 20 bp, human
ggggactgacgtcaatgaag

SEQ ID NO: 219367 - DNA, 20 bp, human
gcctccgctggcctcgaaag

SEQ ID NO: 219368 - DNA, 20 bp, human
gcggcggagcggcggtgagg

SEQ ID NO: 219369 - DNA, 20 bp, human
gaacctaatcggcggcggag

SEQ ID NO: 219370 - DNA, 20 bp, human
gtccgtgcgccaatcatcgg

SEQ ID NO: 219371 - DNA, 20 bp, human
gccgccgccgattaggtttg

SEQ ID NO: 219372 - DNA, 20 bp, human
gctaatcggcggcggagcgg

SEQ ID NO: 219373 - DNA, 20 bp, human
gcttcctcaaacctaatcgg

SEQ ID NO: 219374 - DNA, 20 bp, human
gcaaaaccgcgctggccctg

SEQ ID NO: 219375 - DNA, 20 bp, human
gaagcttcctcaaacctaat

SEQ ID NO: 219376 - DNA, 20 bp, human
gtagcgaggaaggctagtga

SEQ ID NO: 219377 - DNA, 20 bp, human
gttaaggaggctagcgagga

SEQ ID NO: 219378 - DNA, 20 bp, human
gtcctctgcatcactgtgga

SEQ ID NO: 219379 - DNA, 20 bp, human
gaagaaacccggactggagg

SEQ ID NO: 219380 - DNA, 20 bp, human
gtggacgccggtgcgtggac

SEQ ID NO: 219381 - DNA, 20 bp, human
ggagctagatgcgtggacgc

SEQ ID NO: 219382 - DNA, 20 bp, human
gcccctccacagtgatgcag

SEQ ID NO: 219383 - DNA, 20 bp, human
ggattcctcctcacagtagg

SEQ ID NO: 219384 - DNA, 20 bp, human
gtagctcctgcacctgaacc

SEQ ID NO: 219385 - DNA, 20 bp, human
gaaacctccagtccacgcac

SEQ ID NO: 219386 - DNA, 20 bp, human
gggcctctcggtcatcccgc

SEQ ID NO: 219387 - DNA, 20 bp, human
gacccggcgggatgaccgag

SEQ ID NO: 219388 - DNA, 20 bp, human
ggggtagcggacgagggaca

SEQ ID NO: 219389 - DNA, 20 bp, human
gtcgcaggcacccacccggc

SEQ ID NO: 219390 - DNA, 20 bp, human
ggaagtgcccccgcgtaggt

SEQ ID NO: 219391 - DNA, 20 bp, human
gagacggcccgagagttcca

SEQ ID NO: 219392 - DNA, 20 bp, human
gcgagaggccggctgctgga

SEQ ID NO: 219393 - DNA, 20 bp, human
gcgagacaagcaggcgacgc

SEQ ID NO: 219394 - DNA, 20 bp, human
gcagagggggtagcggacga

SEQ ID NO: 219395 - DNA, 20 bp, human
gtatctgcctgcctgcgggt

SEQ ID NO: 219396 - DNA, 20 bp, human
gtggaggctatggcagtggg

SEQ ID NO: 219397 - DNA, 20 bp, human
gagggtgggcgtggaggcta

SEQ ID NO: 219398 - DNA, 20 bp, human
gaggaccccaacttgggaag

SEQ ID NO: 219399 - DNA, 20 bp, human
ggagtcctgggccgggacca

SEQ ID NO: 219400 - DNA, 20 bp, human
gcaaccaggggggcgtggta

SEQ ID NO: 219401 - DNA, 20 bp, human
gccagacaatccaaccaggg

SEQ ID NO: 219402 - DNA, 20 bp, human
gggggggcgtggtagggtga

SEQ ID NO: 219403 - DNA, 20 bp, human
gcccagttggccggagacga

SEQ ID NO: 219404 - DNA, 20 bp, human
gaacccagacaatccaacca

SEQ ID NO: 219405 - DNA, 20 bp, human
gaactgggccctaactgggg

SEQ ID NO: 219406 - DNA, 20 bp, human
ggagctggaccagacctgac

SEQ ID NO: 219407 - DNA, 20 bp, human
gagtcaaagggcaaatgagc

SEQ ID NO: 219408 - DNA, 20 bp, human
gaggctactcagaaactata

SEQ ID NO: 219409 - DNA, 20 bp, human
gcccagcagtcatctcccaa

SEQ ID NO: 219410 - DNA, 20 bp, human
gtcagagcctgcccctgcgg

SEQ ID NO: 219411 - DNA, 20 bp, human
ggtggggagcacctgggatt

SEQ ID NO: 219412 - DNA, 20 bp, human
ggtacaaggactgccccgtc

SEQ ID NO: 219413 - DNA, 20 bp, human
ggcccccccacccaccgcag

SEQ ID NO: 219414 - DNA, 20 bp, human
gatgtagtcagagtgacaca

SEQ ID NO: 219415 - DNA, 20 bp, human
gctgcccctgcggtgggtgg

SEQ ID NO: 219416 - DNA, 20 bp, human
gcccaagtgggtaaaagtac

SEQ ID NO: 219417 - DNA, 20 bp, human
gggtaaaagtacaggtgagt

SEQ ID NO: 219418 - DNA, 20 bp, human
gctggtgtgaaagttagtgt

SEQ ID NO: 219419 - DNA, 20 bp, human
gaggggcggaggctagccag

SEQ ID NO: 219420 - DNA, 20 bp, human
gtctctagccaagtgcgcaa

SEQ ID NO: 219421 - DNA, 20 bp, human
gagggctcaaatgggacaca

SEQ ID NO: 219422 - DNA, 20 bp, human
gtctgtggaggggtggtaca

SEQ ID NO: 219423 - DNA, 20 bp, human
gaggggtggtacaggggcgg

SEQ ID NO: 219424 - DNA, 20 bp, human
gaaggagcccagggctcaaa

SEQ ID NO: 219425 - DNA, 20 bp, human
ggtccaggcaatacccaagt

SEQ ID NO: 219426 - DNA, 20 bp, human
gtgaaggcagcccctatgga

SEQ ID NO: 219427 - DNA, 20 bp, human
gacgcacgcgggttaagcaa

SEQ ID NO: 219428 - DNA, 20 bp, human
gggtttagcgccctccatag

SEQ ID NO: 219429 - DNA, 20 bp, human
ggggcgggtacgcaatgtgt

SEQ ID NO: 219430 - DNA, 20 bp, human
gtggagggcgctaaacctcg

SEQ ID NO: 219431 - DNA, 20 bp, human
gcgtcacgggctacaggggt

SEQ ID NO: 219432 - DNA, 20 bp, human
gccccggcgtgagacacttt

SEQ ID NO: 219433 - DNA, 20 bp, human
gaatgtgtgggtaggatcgc

SEQ ID NO: 219434 - DNA, 20 bp, human
ggaaactccaagagggtgta

SEQ ID NO: 219435 - DNA, 20 bp, human
ggaagtgagcggatgctggg

SEQ ID NO: 219436 - DNA, 20 bp, human
gagcgcggggacgaggtaaa

SEQ ID NO: 219437 - DNA, 20 bp, human
gaaagcgcgaggataaagtg

SEQ ID NO: 219438 - DNA, 20 bp, human
gggcccgcctcgagcagaag

SEQ ID NO: 219439 - DNA, 20 bp, human
ggggcggggccgacagcgag

SEQ ID NO: 219440 - DNA, 20 bp, human
gggacgaggtaaagggtgtg

SEQ ID NO: 219441 - DNA, 20 bp, human
gaggataaagtgaggagcgt

SEQ ID NO: 219442 - DNA, 20 bp, human
ggcggggcctcaacacgggg

SEQ ID NO: 219443 - DNA, 20 bp, human
ggcggggcggggcctcaaca

SEQ ID NO: 219444 - DNA, 20 bp, human
ggggcggggctgaaagcgcg

SEQ ID NO: 219445 - DNA, 20 bp, human
ggggaccagggagtaaggcg

SEQ ID NO: 219446 - DNA, 20 bp, human
gacagcgacgcgacccccgg

SEQ ID NO: 219447 - DNA, 20 bp, human
gtgcgcgcgggagtgccttt

SEQ ID NO: 219448 - DNA, 20 bp, human
gcgcgtcgctgtcgcggtta

SEQ ID NO: 219449 - DNA, 20 bp, human
gagggggcagataccccccg

SEQ ID NO: 219450 - DNA, 20 bp, human
gacccggcgcccagcgttcc

SEQ ID NO: 219451 - DNA, 20 bp, human
gcaacccggtcaccgcgctg

SEQ ID NO: 219452 - DNA, 20 bp, human
gcggtgaccgggttggcggg

SEQ ID NO: 219453 - DNA, 20 bp, human
gaggtgggatgaaagggtag

SEQ ID NO: 219454 - DNA, 20 bp, human
gctgccgcgggtccgcgcta

SEQ ID NO: 219455 - DNA, 20 bp, human
gaggagacttatccgagtgg

SEQ ID NO: 219456 - DNA, 20 bp, human
gcggaggagaggccggggaa

SEQ ID NO: 219457 - DNA, 20 bp, human
ggccggggaagggttaacgc

SEQ ID NO: 219458 - DNA, 20 bp, human
gaatgccctcggggccgcgg

SEQ ID NO: 219459 - DNA, 20 bp, human
gcccgcgccgcccgccttaa

SEQ ID NO: 219460 - DNA, 20 bp, human
gcgggagcggagcgtgcggc

SEQ ID NO: 219461 - DNA, 20 bp, human
gaacgcgggagcggagcgtg

SEQ ID NO: 219462 - DNA, 20 bp, human
ggccccctgccagccccccg

SEQ ID NO: 219463 - DNA, 20 bp, human
gggcgcgggccggccgagcg

SEQ ID NO: 219464 - DNA, 20 bp, human
gggaagggttaacgcgggag

SEQ ID NO: 219465 - DNA, 20 bp, human
gcgggctgagaatgccctcg

SEQ ID NO: 219466 - DNA, 20 bp, human
gtgagaggggagtggagttc

SEQ ID NO: 219467 - DNA, 20 bp, human
gaggccgtgtctctctatcc

SEQ ID NO: 219468 - DNA, 20 bp, human
ggggccacctggacaatcag

SEQ ID NO: 219469 - DNA, 20 bp, human
gtagagagacacggcctcac

SEQ ID NO: 219470 - DNA, 20 bp, human
gtcaggggttaactcaagag

SEQ ID NO: 219471 - DNA, 20 bp, human
gaggatcagctctttcttaa

SEQ ID NO: 219472 - DNA, 20 bp, human
gggagccaggggcggagaaa

SEQ ID NO: 219473 - DNA, 20 bp, human
gacgggcaggggcatgctac

SEQ ID NO: 219474 - DNA, 20 bp, human
ggagcccggatagagagaca

SEQ ID NO: 219475 - DNA, 20 bp, human
gctggtgggcggaggcaaag

SEQ ID NO: 219476 - DNA, 20 bp, human
gggtaggaggtgcgtgtgat

SEQ ID NO: 219477 - DNA, 20 bp, human
gtgagtccagagttgatctc

SEQ ID NO: 219478 - DNA, 20 bp, human
gtggaaggatgccagtgggt

SEQ ID NO: 219479 - DNA, 20 bp, human
gtcagtccagagatcaactc

SEQ ID NO: 219480 - DNA, 20 bp, human
gccaatgggagtgccaggac

SEQ ID NO: 219481 - DNA, 20 bp, human
gaatgcccctactggcccag

SEQ ID NO: 219482 - DNA, 20 bp, human
gtgatgggtggcaagcgcct

SEQ ID NO: 219483 - DNA, 20 bp, human
gaggggttgtcacaatagac

SEQ ID NO: 219484 - DNA, 20 bp, human
gccacatccgatcctgccag

SEQ ID NO: 219485 - DNA, 20 bp, human
gttaggggaggagcccgtcc

SEQ ID NO: 219486 - DNA, 20 bp, human
gaggagcggcggatggctga

SEQ ID NO: 219487 - DNA, 20 bp, human
ggggccgctcggctgtcctt

SEQ ID NO: 219488 - DNA, 20 bp, human
gtgggcggggcgtgaggtgg

SEQ ID NO: 219489 - DNA, 20 bp, human
gggaaaggggcgggtcatat

SEQ ID NO: 219490 - DNA, 20 bp, human
gctcccgctcaggccgtccc

SEQ ID NO: 219491 - DNA, 20 bp, human
gccacgcttgaacttcccga

SEQ ID NO: 219492 - DNA, 20 bp, human
gaaggggcgggtcatatagg

SEQ ID NO: 219493 - DNA, 20 bp, human
gggagcgtgaagggccaatc

SEQ ID NO: 219494 - DNA, 20 bp, human
ggccgtcccgggagctcatt

SEQ ID NO: 219495 - DNA, 20 bp, human
ggcctgagcgggagcgtgaa

SEQ ID NO: 219496 - DNA, 20 bp, human
gaagccaggttcggtcgtgg

SEQ ID NO: 219497 - DNA, 20 bp, human
gctccctcgggcctgacttc

SEQ ID NO: 219498 - DNA, 20 bp, human
gtcccgccgcggaggctcac

SEQ ID NO: 219499 - DNA, 20 bp, human
ggggaccagcacgggccgga

SEQ ID NO: 219500 - DNA, 20 bp, human
ggaagtgcaggagtggcgcg

SEQ ID NO: 219501 - DNA, 20 bp, human
ggggccgaggtcccccttca

SEQ ID NO: 219502 - DNA, 20 bp, human
gccagagggcgcccctgaag

SEQ ID NO: 219503 - DNA, 20 bp, human
ggcgccgagcccgcggacag

SEQ ID NO: 219504 - DNA, 20 bp, human
gaaccggaagtcaggcccga

SEQ ID NO: 219505 - DNA, 20 bp, human
ggcgaagccaggttcggtcg

SEQ ID NO: 219506 - DNA, 20 bp, human
ggggtcatgcaggtgcagac

SEQ ID NO: 219507 - DNA, 20 bp, human
gggttgcagcccggagaaaa

SEQ ID NO: 219508 - DNA, 20 bp, human
gcatgcaggtgcagactggc

SEQ ID NO: 219509 - DNA, 20 bp, human
gggtgtgggccgagagaggg

SEQ ID NO: 219510 - DNA, 20 bp, human
gggaggggtcggcgcgcgac

SEQ ID NO: 219511 - DNA, 20 bp, human
gctccccggcaggcgaaggg

SEQ ID NO: 219512 - DNA, 20 bp, human
ggcagctccccggcaggcga

SEQ ID NO: 219513 - DNA, 20 bp, human
gcggccgcccttcgcctgcc

SEQ ID NO: 219514 - DNA, 20 bp, human
gagcgcaggcgcccgagagg

SEQ ID NO: 219515 - DNA, 20 bp, human
ggcggaacccggttgcagcc

SEQ ID NO: 219516 - DNA, 20 bp, human
ggatcagtgcagaatgtagg

SEQ ID NO: 219517 - DNA, 20 bp, human
ggggacgccaccaactgcca

SEQ ID NO: 219518 - DNA, 20 bp, human
ggaggatcagtgcagaatgt

SEQ ID NO: 219519 - DNA, 20 bp, human
gcccagggagcagttggcgg

SEQ ID NO: 219520 - DNA, 20 bp, human
gtgagggtgtcaggaaccag

SEQ ID NO: 219521 - DNA, 20 bp, human
gagggacagccccactcagt

SEQ ID NO: 219522 - DNA, 20 bp, human
gcagaatgtagggggagccc

SEQ ID NO: 219523 - DNA, 20 bp, human
ggtgtggccatcttctagag

SEQ ID NO: 219524 - DNA, 20 bp, human
ggctgggctccgggatccac

SEQ ID NO: 219525 - DNA, 20 bp, human
gtggccacacccccaggggc

SEQ ID NO: 219526 - DNA, 20 bp, human
gagagtctatccctgtctca

SEQ ID NO: 219527 - DNA, 20 bp, human
gcagcactgttctgtctaga

SEQ ID NO: 219528 - DNA, 20 bp, human
gctgaaaagtttttgaggcc

SEQ ID NO: 219529 - DNA, 20 bp, human
gagacagcgagctcgccctg

SEQ ID NO: 219530 - DNA, 20 bp, human
ggtcagtgtgccctgagaca

SEQ ID NO: 219531 - DNA, 20 bp, human
gattacccgggcatagtcct

SEQ ID NO: 219532 - DNA, 20 bp, human
gatattctgaaaagtttttg

SEQ ID NO: 219533 - DNA, 20 bp, human
ggagttgcactctgtcgtct

SEQ ID NO: 219534 - DNA, 20 bp, human
gaggcgcccaggactatgcc

SEQ ID NO: 219535 - DNA, 20 bp, human
gtgcactctgtcgtctaggc

SEQ ID NO: 219536 - DNA, 20 bp, human
gtaacctggcactgcgtcgc

SEQ ID NO: 219537 - DNA, 20 bp, human
ggcagtgccaggttagagag

SEQ ID NO: 219538 - DNA, 20 bp, human
gggcgcgcaccccagatcgg

SEQ ID NO: 219539 - DNA, 20 bp, human
gaaagtccctctctctaacc

SEQ ID NO: 219540 - DNA, 20 bp, human
gtgcccagccaatcaggaca

SEQ ID NO: 219541 - DNA, 20 bp, human
gaacgcgtgcccagccaatc

SEQ ID NO: 219542 - DNA, 20 bp, human
gcatcggcgccctccgatct

SEQ ID NO: 219543 - DNA, 20 bp, human
gcgcccggtgtcccaagctg

SEQ ID NO: 219544 - DNA, 20 bp, human
gtggggcgcgcaccccagat

SEQ ID NO: 219545 - DNA, 20 bp, human
gagtctcgtgatgtttaaga

SEQ ID NO: 219546 - DNA, 20 bp, human
gtgccagggtatttcacttg

SEQ ID NO: 219547 - DNA, 20 bp, human
gtgaatctttggagtacctg

SEQ ID NO: 219548 - DNA, 20 bp, human
ggtgagtaaacctgaatctt

SEQ ID NO: 219549 - DNA, 20 bp, human
gggagtacctgaggaatatc

SEQ ID NO: 219550 - DNA, 20 bp, human
gagtcaacttcaatgtcgga

SEQ ID NO: 219551 - DNA, 20 bp, human
ggggaaggtggaagctcatt

SEQ ID NO: 219552 - DNA, 20 bp, human
gtcctgaattgctatgtgtc

SEQ ID NO: 219553 - DNA, 20 bp, human
gcaaaatggaggtggcttgt

SEQ ID NO: 219554 - DNA, 20 bp, human
gttgactttccattctctgc

SEQ ID NO: 219555 - DNA, 20 bp, human
gcccagacacatagcaattc

SEQ ID NO: 219556 - DNA, 20 bp, human
gcgcgccatgcgagctcaca

SEQ ID NO: 219557 - DNA, 20 bp, human
ggtgaccgcgaggacccaga

SEQ ID NO: 219558 - DNA, 20 bp, human
gtggcaggactcaaccgcct

SEQ ID NO: 219559 - DNA, 20 bp, human
gcgcgccctctgggtcctcg

SEQ ID NO: 219560 - DNA, 20 bp, human
gctcgcatggcgcgccctct

SEQ ID NO: 219561 - DNA, 20 bp, human
gccgcctcggagaccctgca

SEQ ID NO: 219562 - DNA, 20 bp, human
gtgcgagctcacagggctgg

SEQ ID NO: 219563 - DNA, 20 bp, human
gcggccgtgctcggaatgca

SEQ ID NO: 219564 - DNA, 20 bp, human
gaagcccctggctgcacgcg

SEQ ID NO: 219565 - DNA, 20 bp, human
gtggctgcacgcgcgggccc

SEQ ID NO: 219566 - DNA, 20 bp, human
ggggtggcagcaaacgtcaa

SEQ ID NO: 219567 - DNA, 20 bp, human
ggggagctgaagtcccgctc

SEQ ID NO: 219568 - DNA, 20 bp, human
gccccgcggccgccgagtga

SEQ ID NO: 219569 - DNA, 20 bp, human
gctggcgcgtgtggaaacgc

SEQ ID NO: 219570 - DNA, 20 bp, human
ggtgacggaagcgcgtgctt

SEQ ID NO: 219571 - DNA, 20 bp, human
ggatgcgcatgctctgtgtg

SEQ ID NO: 219572 - DNA, 20 bp, human
gtgtggaaacgcgggaggag

SEQ ID NO: 219573 - DNA, 20 bp, human
gacgcgcttccgtcactcgg

SEQ ID NO: 219574 - DNA, 20 bp, human
gagcgcgtgcttaggctcat

SEQ ID NO: 219575 - DNA, 20 bp, human
ggcctcgcgcttcgcccccg

SEQ ID NO: 219576 - DNA, 20 bp, human
gggtataagaattgccctca

SEQ ID NO: 219577 - DNA, 20 bp, human
gactgaaataaacataacaa

SEQ ID NO: 219578 - DNA, 20 bp, human
gggttatgacaggaagtttt

SEQ ID NO: 219579 - DNA, 20 bp, human
gaaggggagatggttatgac

SEQ ID NO: 219580 - DNA, 20 bp, human
gtagatgaaggtgaagtaag

SEQ ID NO: 219581 - DNA, 20 bp, human
gaaaactcagactcggaaac

SEQ ID NO: 219582 - DNA, 20 bp, human
ggaaagtagaatgagcgcag

SEQ ID NO: 219583 - DNA, 20 bp, human
gcagcttctatcaaggagag

SEQ ID NO: 219584 - DNA, 20 bp, human
gaatacgtcatgtgaagagg

SEQ ID NO: 219585 - DNA, 20 bp, human
gatgtgtattttaatccttg

SEQ ID NO: 219586 - DNA, 20 bp, human
gtgactaaaaacctaaggta

SEQ ID NO: 219587 - DNA, 20 bp, human
gtgaatgcaaacaatcacgt

SEQ ID NO: 219588 - DNA, 20 bp, human
gcaaaccccagaaaacgggg

SEQ ID NO: 219589 - DNA, 20 bp, human
gtaagcttttgtgtgtaagt

SEQ ID NO: 219590 - DNA, 20 bp, human
gatccccccccccgttttct

SEQ ID NO: 219591 - DNA, 20 bp, human
gaatatgtagttaagaccta

SEQ ID NO: 219592 - DNA, 20 bp, human
ggtttcttacatgcttttgt

SEQ ID NO: 219593 - DNA, 20 bp, human
gttgtataaataagctgtct

SEQ ID NO: 219594 - DNA, 20 bp, human
gagaagagaatgcactgaag

SEQ ID NO: 219595 - DNA, 20 bp, human
gaccccagaaaacggggggg

SEQ ID NO: 219596 - DNA, 20 bp, human
gtctccctggtggagtacgt

SEQ ID NO: 219597 - DNA, 20 bp, human
ggcggcagggcgcggaaacc

SEQ ID NO: 219598 - DNA, 20 bp, human
ggcgtcggagcagcgcggca

SEQ ID NO: 219599 - DNA, 20 bp, human
gccctggtggagtacgtcgg

SEQ ID NO: 219600 - DNA, 20 bp, human
gcgggtggagtggcaccaaa

SEQ ID NO: 219601 - DNA, 20 bp, human
gggagcgcgcaacgcggaag

SEQ ID NO: 219602 - DNA, 20 bp, human
ggtggagtacgtcggtgggt

SEQ ID NO: 219603 - DNA, 20 bp, human
gacgtcggtgggttgggatg

SEQ ID NO: 219604 - DNA, 20 bp, human
gcagctgcggaccgcggtcg

SEQ ID NO: 219605 - DNA, 20 bp, human
gcggtcgaggcatgctgcgg

SEQ ID NO: 219606 - DNA, 20 bp, human
gcatgcaagctggagacgct

SEQ ID NO: 219607 - DNA, 20 bp, human
gggtaggtaggtaagtcggt

SEQ ID NO: 219608 - DNA, 20 bp, human
gttggctagcgtgattacgg

SEQ ID NO: 219609 - DNA, 20 bp, human
gctagcgtgattacggaggt

SEQ ID NO: 219610 - DNA, 20 bp, human
gcgctgggatgccaggagtg

SEQ ID NO: 219611 - DNA, 20 bp, human
gcgtgacaggccatgcaagc

SEQ ID NO: 219612 - DNA, 20 bp, human
ggttacaccattggcatatc

SEQ ID NO: 219613 - DNA, 20 bp, human
ggagattggctgtgagtcag

SEQ ID NO: 219614 - DNA, 20 bp, human
gtctatctgggcccagtcaa

SEQ ID NO: 219615 - DNA, 20 bp, human
gattggcatatctggttctg

SEQ ID NO: 219616 - DNA, 20 bp, human
gagggcgggagccagcagat

SEQ ID NO: 219617 - DNA, 20 bp, human
gaggcactatggccagaagg

SEQ ID NO: 219618 - DNA, 20 bp, human
ggacgctgcacgtgcctgtg

SEQ ID NO: 219619 - DNA, 20 bp, human
ggagattggctgtgagtcag

SEQ ID NO: 219620 - DNA, 20 bp, human
gtctggccatagtgcctgaa

SEQ ID NO: 219621 - DNA, 20 bp, human
gtctatctgggcccagtcaa

SEQ ID NO: 219622 - DNA, 20 bp, human
gtagggaaaggctctctaac

SEQ ID NO: 219623 - DNA, 20 bp, human
gtgcacgtgcctgtgcgggt

SEQ ID NO: 219624 - DNA, 20 bp, human
gtaggtcactgccccccttc

SEQ ID NO: 219625 - DNA, 20 bp, human
ggttctctggggtttcagga

SEQ ID NO: 219626 - DNA, 20 bp, human
gtgaagaggcaaactgtgga

SEQ ID NO: 219627 - DNA, 20 bp, human
gggctctcagagccacttca

SEQ ID NO: 219628 - DNA, 20 bp, human
gtcccgaagcttttgtggtg

SEQ ID NO: 219629 - DNA, 20 bp, human
gaaactgtggagggttagcc

SEQ ID NO: 219630 - DNA, 20 bp, human
gggaaagcacctgttttctc

SEQ ID NO: 219631 - DNA, 20 bp, human
gacctcaccacaaaagcttc

SEQ ID NO: 219632 - DNA, 20 bp, human
gtggctcatatattagcatg

SEQ ID NO: 219633 - DNA, 20 bp, human
gcattaacaagtaacagtat

SEQ ID NO: 219634 - DNA, 20 bp, human
gctcagagccacttcatgga

SEQ ID NO: 219635 - DNA, 20 bp, human
gagggttagcctggtaacca

SEQ ID NO: 219636 - DNA, 20 bp, human
gcgaggttgaccaatgacaa

SEQ ID NO: 219637 - DNA, 20 bp, human
gaacgggcgcgacctcacgg

SEQ ID NO: 219638 - DNA, 20 bp, human
gcttccgcccggaggagaga

SEQ ID NO: 219639 - DNA, 20 bp, human
gggcgccaccatctctcctc

SEQ ID NO: 219640 - DNA, 20 bp, human
ggcgaacgggcgcgacctca

SEQ ID NO: 219641 - DNA, 20 bp, human
gggcggccgtcacgtggcct

SEQ ID NO: 219642 - DNA, 20 bp, human
gcccccgcccgcaagaaaga

SEQ ID NO: 219643 - DNA, 20 bp, human
gccaatcggcggccgtcacg

SEQ ID NO: 219644 - DNA, 20 bp, human
gccgggcggaagcggtcgcg

SEQ ID NO: 219645 - DNA, 20 bp, human
gccaatgacaagggtgcccg

SEQ ID NO: 219646 - DNA, 20 bp, human
gatggcgcggcggagacgga

SEQ ID NO: 219647 - DNA, 20 bp, human
gccgcagcagcccgtcgggc

SEQ ID NO: 219648 - DNA, 20 bp, human
ggacgctggaagcgcgcaca

SEQ ID NO: 219649 - DNA, 20 bp, human
gtctaccgcagcagcccgtc

SEQ ID NO: 219650 - DNA, 20 bp, human
gtcgaaggagggcgccgtga

SEQ ID NO: 219651 - DNA, 20 bp, human
gggcggctgcggctggtgtc

SEQ ID NO: 219652 - DNA, 20 bp, human
gccgccagcccggcagacgc

SEQ ID NO: 219653 - DNA, 20 bp, human
gaggtcagacgcctcgaagg

SEQ ID NO: 219654 - DNA, 20 bp, human
gggctggtgtccggcccgac

SEQ ID NO: 219655 - DNA, 20 bp, human
gcgggctgctgcggtagagg

SEQ ID NO: 219656 - DNA, 20 bp, human
ggaggtgataccaatcccgg

SEQ ID NO: 219657 - DNA, 20 bp, human
gcgaggagggaggccggcga

SEQ ID NO: 219658 - DNA, 20 bp, human
gtccgcgggggacggtgccg

SEQ ID NO: 219659 - DNA, 20 bp, human
gccaacctcgccagcctagg

SEQ ID NO: 219660 - DNA, 20 bp, human
gcggcgaggggacccccccc

SEQ ID NO: 219661 - DNA, 20 bp, human
gggggaggtgataccaatcc

SEQ ID NO: 219662 - DNA, 20 bp, human
gcgagcgcacccccagatct

SEQ ID NO: 219663 - DNA, 20 bp, human
ggtgataccaatcccggggg

SEQ ID NO: 219664 - DNA, 20 bp, human
ggaagcgggagccgcctccg

SEQ ID NO: 219665 - DNA, 20 bp, human
gaaggagccgcatcccccac

SEQ ID NO: 219666 - DNA, 20 bp, human
ggggccgttagcgccagacc

SEQ ID NO: 219667 - DNA, 20 bp, human
ggtggagaggggctgcgaga

SEQ ID NO: 219668 - DNA, 20 bp, human
gagacccggcggagagccaa

SEQ ID NO: 219669 - DNA, 20 bp, human
gcgctgctactggtggagag

SEQ ID NO: 219670 - DNA, 20 bp, human
gggaccccttggctctccgc

SEQ ID NO: 219671 - DNA, 20 bp, human
ggcctcccgagcttgctcgc

SEQ ID NO: 219672 - DNA, 20 bp, human
gaagacagcagcgctgctac

SEQ ID NO: 219673 - DNA, 20 bp, human
gtcctccacccgcggtgcag

SEQ ID NO: 219674 - DNA, 20 bp, human
gccccgcgagcaagctcggg

SEQ ID NO: 219675 - DNA, 20 bp, human
ggcggccgctgcaccgcggg

SEQ ID NO: 219676 - DNA, 20 bp, human
gaatcaagtctacaaggcgg

SEQ ID NO: 219677 - DNA, 20 bp, human
gtaggtgcagaatctcgagt

SEQ ID NO: 219678 - DNA, 20 bp, human
gagggggcgggtctcgaggt

SEQ ID NO: 219679 - DNA, 20 bp, human
gtggccggcagtcaaaaccc

SEQ ID NO: 219680 - DNA, 20 bp, human
gccggcgtgccaaactcgcg

SEQ ID NO: 219681 - DNA, 20 bp, human
gggaaatcaagtctacaagg

SEQ ID NO: 219682 - DNA, 20 bp, human
gcggtcccaccgccaggttc

SEQ ID NO: 219683 - DNA, 20 bp, human
gggggctggcagcgccgcca

SEQ ID NO: 219684 - DNA, 20 bp, human
ggggggggtgcacagatgac

SEQ ID NO: 219685 - DNA, 20 bp, human
gaccggaaatcaagtctaca

SEQ ID NO: 219686 - DNA, 20 bp, human
gggctcgccccctacgaggg

SEQ ID NO: 219687 - DNA, 20 bp, human
ggtggctcctcctccctcgt

SEQ ID NO: 219688 - DNA, 20 bp, human
ggctcctcctccctcgtagg

SEQ ID NO: 219689 - DNA, 20 bp, human
gagggagaggagtgcgtccc

SEQ ID NO: 219690 - DNA, 20 bp, human
gggcgcgcgcaccctggacc

SEQ ID NO: 219691 - DNA, 20 bp, human
ggccggctcgccccctacga

SEQ ID NO: 219692 - DNA, 20 bp, human
gaaacagggccgacgaggat

SEQ ID NO: 219693 - DNA, 20 bp, human
gcgagcgcgccgcgcgttca

SEQ ID NO: 219694 - DNA, 20 bp, human
gcgggcgcgccctgaacgcg

SEQ ID NO: 219695 - DNA, 20 bp, human
ggcgctcggccggactcgga

SEQ ID NO: 219696 - DNA, 20 bp, human
ggtgggtcctggtaccgggt

SEQ ID NO: 219697 - DNA, 20 bp, human
gttgtgggtggcccctcttg

SEQ ID NO: 219698 - DNA, 20 bp, human
ggggccacccacaactggag

SEQ ID NO: 219699 - DNA, 20 bp, human
ggccccgcgccccaagtttt

SEQ ID NO: 219700 - DNA, 20 bp, human
gccgtcgggcggtgacgtga

SEQ ID NO: 219701 - DNA, 20 bp, human
gcccgggtgggtcctggtac

SEQ ID NO: 219702 - DNA, 20 bp, human
gcggggccgggccccattgg

SEQ ID NO: 219703 - DNA, 20 bp, human
gcaccctcctgcaaagccga

SEQ ID NO: 219704 - DNA, 20 bp, human
gcgcgccccaagttttggga

SEQ ID NO: 219705 - DNA, 20 bp, human
gcggaaccctcccaaaactt

SEQ ID NO: 219706 - DNA, 20 bp, human
gccggcagagaacttcgcct

SEQ ID NO: 219707 - DNA, 20 bp, human
gggaagaggcatggccgggg

SEQ ID NO: 219708 - DNA, 20 bp, human
gggaaggcgtgaggcccggt

SEQ ID NO: 219709 - DNA, 20 bp, human
gactcagccgagctgggaag

SEQ ID NO: 219710 - DNA, 20 bp, human
gggcaagcggccaaggcgga

SEQ ID NO: 219711 - DNA, 20 bp, human
ggactggcaagcggccaagg

SEQ ID NO: 219712 - DNA, 20 bp, human
gtaagcccatggcgataagg

SEQ ID NO: 219713 - DNA, 20 bp, human
gacgtgggccaacgctgacc

SEQ ID NO: 219714 - DNA, 20 bp, human
gtggcagccgggaccggaga

SEQ ID NO: 219715 - DNA, 20 bp, human
gggaggcaggttaaaccttg

SEQ ID NO: 219716 - DNA, 20 bp, human
ggtcccgccgcacgcgtcgg

SEQ ID NO: 219717 - DNA, 20 bp, human
gggtccgcacgagccgggtc

SEQ ID NO: 219718 - DNA, 20 bp, human
gtggcgccggcgtcctgggg

SEQ ID NO: 219719 - DNA, 20 bp, human
gaaccagtgccgctcggcgg

SEQ ID NO: 219720 - DNA, 20 bp, human
gctgcccgacccggctcgtg

SEQ ID NO: 219721 - DNA, 20 bp, human
ggcgtgcggcgggacagaag

SEQ ID NO: 219722 - DNA, 20 bp, human
ggtgtggcgccggcgtcctg

SEQ ID NO: 219723 - DNA, 20 bp, human
ggagcagcctctgcccgacc

SEQ ID NO: 219724 - DNA, 20 bp, human
gtgcggcgggacagaagcgg

SEQ ID NO: 219725 - DNA, 20 bp, human
gctcgtgcggaccccaggac

SEQ ID NO: 219726 - DNA, 20 bp, human
gaggacattcatgtgcactc

SEQ ID NO: 219727 - DNA, 20 bp, human
gatcgcaattaactgacgag

SEQ ID NO: 219728 - DNA, 20 bp, human
gcctcccggcgcgtaggtga

SEQ ID NO: 219729 - DNA, 20 bp, human
gagacaagaacaaactgggg

SEQ ID NO: 219730 - DNA, 20 bp, human
ggcgcgtaggtgaaggtgat

SEQ ID NO: 219731 - DNA, 20 bp, human
gctacgcgccgggagggtgg

SEQ ID NO: 219732 - DNA, 20 bp, human
gccgtgacgccgagagtgcg

SEQ ID NO: 219733 - DNA, 20 bp, human
ggcggcagggaaacacttcc

SEQ ID NO: 219734 - DNA, 20 bp, human
ggatgcgggctgtatgcggg

SEQ ID NO: 219735 - DNA, 20 bp, human
gcggcgtcacggcccgagcc

SEQ ID NO: 219736 - DNA, 20 bp, human
gtcactggacccacactcta

SEQ ID NO: 219737 - DNA, 20 bp, human
gtgggtccagtgaatatcct

SEQ ID NO: 219738 - DNA, 20 bp, human
gttaggggtaaggtgaagag

SEQ ID NO: 219739 - DNA, 20 bp, human
gacatcacccctcctcctta

SEQ ID NO: 219740 - DNA, 20 bp, human
gcccctcctccttaggggta

SEQ ID NO: 219741 - DNA, 20 bp, human
ggaggggtgatgtcatggat

SEQ ID NO: 219742 - DNA, 20 bp, human
gctcctccaaggatattcac

SEQ ID NO: 219743 - DNA, 20 bp, human
ggcagggggcctccacatga

SEQ ID NO: 219744 - DNA, 20 bp, human
gaggacatttgagcttaaag

SEQ ID NO: 219745 - DNA, 20 bp, human
gaggccccctgcaagttgcc

SEQ ID NO: 219746 - DNA, 20 bp, human
ggggccgtctcggagaaatg

SEQ ID NO: 219747 - DNA, 20 bp, human
gcgggccctgggcgccgaag

SEQ ID NO: 219748 - DNA, 20 bp, human
gccgtctcggagaaatgggg

SEQ ID NO: 219749 - DNA, 20 bp, human
ggattggaggtgacccccgt

SEQ ID NO: 219750 - DNA, 20 bp, human
gacagtgcatggccgaggcg

SEQ ID NO: 219751 - DNA, 20 bp, human
ggcggggcttcggaacccac

SEQ ID NO: 219752 - DNA, 20 bp, human
gcggccatgcactgtctact

SEQ ID NO: 219753 - DNA, 20 bp, human
gggacaggcgtccccgggat

SEQ ID NO: 219754 - DNA, 20 bp, human
ggggaagaggaaagtcgcgg

SEQ ID NO: 219755 - DNA, 20 bp, human
ggggagcctaggggccgtct

SEQ ID NO: 219756 - DNA, 20 bp, human
ggccctgtggggtgctcatg

SEQ ID NO: 219757 - DNA, 20 bp, human
ggggttgcggaagccctgtg

SEQ ID NO: 219758 - DNA, 20 bp, human
gtccccatgagcaccccaca

SEQ ID NO: 219759 - DNA, 20 bp, human
ggagatggcgagaaagataa

SEQ ID NO: 219760 - DNA, 20 bp, human
gagctcccggggttccccgt

SEQ ID NO: 219761 - DNA, 20 bp, human
ggaaaagactggagcttcaa

SEQ ID NO: 219762 - DNA, 20 bp, human
gggagcttcaagggcaatag

SEQ ID NO: 219763 - DNA, 20 bp, human
ggcaatagagggtgacgggg

SEQ ID NO: 219764 - DNA, 20 bp, human
ggctccaggccggaggttgg

SEQ ID NO: 219765 - DNA, 20 bp, human
gcaacagcaggggcccctgg

SEQ ID NO: 219766 - DNA, 20 bp, human
gtggggactaatccctgaga

SEQ ID NO: 219767 - DNA, 20 bp, human
gcagaccagcccttcccaga

SEQ ID NO: 219768 - DNA, 20 bp, human
gctctcagtccctctgggaa

SEQ ID NO: 219769 - DNA, 20 bp, human
gctcccgcgtctctggagtg

SEQ ID NO: 219770 - DNA, 20 bp, human
gtgaacctggccaccatccc

SEQ ID NO: 219771 - DNA, 20 bp, human
gggagtggggagtggatagt

SEQ ID NO: 219772 - DNA, 20 bp, human
gcccagagggactgagagtg

SEQ ID NO: 219773 - DNA, 20 bp, human
gcaccctgcctgatggaatc

SEQ ID NO: 219774 - DNA, 20 bp, human
ggctgaggagaggcccgccc

SEQ ID NO: 219775 - DNA, 20 bp, human
ggtggggagtggatagttgg

SEQ ID NO: 219776 - DNA, 20 bp, human
gggcccagggcggaagactg

SEQ ID NO: 219777 - DNA, 20 bp, human
gaggggtgggcctcccggag

SEQ ID NO: 219778 - DNA, 20 bp, human
gccagggcggaagactgagg

SEQ ID NO: 219779 - DNA, 20 bp, human
gcgccctaggggagagcagg

SEQ ID NO: 219780 - DNA, 20 bp, human
ggagcggcgtccataggggt

SEQ ID NO: 219781 - DNA, 20 bp, human
gcccgcggcggcgtctacgg

SEQ ID NO: 219782 - DNA, 20 bp, human
gaggccaggcaatctccgat

SEQ ID NO: 219783 - DNA, 20 bp, human
gggaaggcggggctgtgcga

SEQ ID NO: 219784 - DNA, 20 bp, human
gcggctccgagaggtgaccc

SEQ ID NO: 219785 - DNA, 20 bp, human
gcttccacgggccaaggagg

SEQ ID NO: 219786 - DNA, 20 bp, human
gtcaaccgttgcttacactg

SEQ ID NO: 219787 - DNA, 20 bp, human
ggtggctggacgaatgtttg

SEQ ID NO: 219788 - DNA, 20 bp, human
gcaacggttgactgttcgga

SEQ ID NO: 219789 - DNA, 20 bp, human
gtcagccccagtgtaagcaa

SEQ ID NO: 219790 - DNA, 20 bp, human
gtggggctgagtcacccgac

SEQ ID NO: 219791 - DNA, 20 bp, human
gttcagcgttgtggactggg

SEQ ID NO: 219792 - DNA, 20 bp, human
gtaagcaacggttgactgtt

SEQ ID NO: 219793 - DNA, 20 bp, human
gcacaacgctgaaccgtggc

SEQ ID NO: 219794 - DNA, 20 bp, human
ggactgggaggataatagac

SEQ ID NO: 219795 - DNA, 20 bp, human
gcggttcagcgttgtggact

SEQ ID NO: 219796 - DNA, 20 bp, human
gtgcaccaagcggcagttcg

SEQ ID NO: 219797 - DNA, 20 bp, human
gggtatcaggctatgaccta

SEQ ID NO: 219798 - DNA, 20 bp, human
gcgccccggcgccttctagt

SEQ ID NO: 219799 - DNA, 20 bp, human
gggcgcggaggaaactgcgg

SEQ ID NO: 219800 - DNA, 20 bp, human
gaaccccagagaggccagat

SEQ ID NO: 219801 - DNA, 20 bp, human
ggcaatggaatggatgtcgt

SEQ ID NO: 219802 - DNA, 20 bp, human
gcgggggcgcggagcaaacg

SEQ ID NO: 219803 - DNA, 20 bp, human
gtgagcttgtaggcaaggat

SEQ ID NO: 219804 - DNA, 20 bp, human
ggaagcagccgcaacgagcc

SEQ ID NO: 219805 - DNA, 20 bp, human
gttgagatgccagtgtttgg

SEQ ID NO: 219806 - DNA, 20 bp, human
gggaccgtggtgatagacta

SEQ ID NO: 219807 - DNA, 20 bp, human
gtagcgaggaaggaacggta

SEQ ID NO: 219808 - DNA, 20 bp, human
gggacacagcatagcgagga

SEQ ID NO: 219809 - DNA, 20 bp, human
gtgggggcggtcaggagaga

SEQ ID NO: 219810 - DNA, 20 bp, human
gtcaaggccgcgaggttgga

SEQ ID NO: 219811 - DNA, 20 bp, human
gacagtaggtgtggagtgcg

SEQ ID NO: 219812 - DNA, 20 bp, human
gtagactaggggtggacgcg

SEQ ID NO: 219813 - DNA, 20 bp, human
ggagagagaagcccgatcac

SEQ ID NO: 219814 - DNA, 20 bp, human
ggccagggcggggcagtcgg

SEQ ID NO: 219815 - DNA, 20 bp, human
ggaaaagtccagggtagaga

SEQ ID NO: 219816 - DNA, 20 bp, human
ggcctgcgacgggagaggcg

SEQ ID NO: 219817 - DNA, 20 bp, human
gaggccattcggcttcccta

SEQ ID NO: 219818 - DNA, 20 bp, human
gccctaggggagcgagaggt

SEQ ID NO: 219819 - DNA, 20 bp, human
ggggacgcgaagaggccatt

SEQ ID NO: 219820 - DNA, 20 bp, human
gtgcctcccccgactgggaa

SEQ ID NO: 219821 - DNA, 20 bp, human
gcgcgtccctggcttctcgg

SEQ ID NO: 219822 - DNA, 20 bp, human
gcccccgactgggaacgggt

SEQ ID NO: 219823 - DNA, 20 bp, human
gctccgcccccgagaagcca

SEQ ID NO: 219824 - DNA, 20 bp, human
gtcaccacccaggcgcctaa

SEQ ID NO: 219825 - DNA, 20 bp, human
gagcccacctgtgcccgggg

SEQ ID NO: 219826 - DNA, 20 bp, human
ggaggggtgcgggacggaca

SEQ ID NO: 219827 - DNA, 20 bp, human
gccaggccgcggggagccaa

SEQ ID NO: 219828 - DNA, 20 bp, human
gggcgcggcacacagacgcg

SEQ ID NO: 219829 - DNA, 20 bp, human
ggcggggcgcgcgtccacct

SEQ ID NO: 219830 - DNA, 20 bp, human
gcggcctggctcggtccgat

SEQ ID NO: 219831 - DNA, 20 bp, human
ggccggggcccgatccgcgg

SEQ ID NO: 219832 - DNA, 20 bp, human
gcgccgccattggctccccg

SEQ ID NO: 219833 - DNA, 20 bp, human
gccgcgcgcgcggaaccaat

SEQ ID NO: 219834 - DNA, 20 bp, human
gggagccaatggcggcgcgc

SEQ ID NO: 219835 - DNA, 20 bp, human
ggaaccaatcggaccgagcc

SEQ ID NO: 219836 - DNA, 20 bp, human
ggggttttctggacgagggc

SEQ ID NO: 219837 - DNA, 20 bp, human
gagcgcggcggcggagagaa

SEQ ID NO: 219838 - DNA, 20 bp, human
ggggaaggcggggcagcccg

SEQ ID NO: 219839 - DNA, 20 bp, human
ggggcagcccgtggcgggat

SEQ ID NO: 219840 - DNA, 20 bp, human
gcacagcggcgactagggga

SEQ ID NO: 219841 - DNA, 20 bp, human
gaagtggcgcggcctgtcga

SEQ ID NO: 219842 - DNA, 20 bp, human
gaaggcggggcagcccgtgg

SEQ ID NO: 219843 - DNA, 20 bp, human
gttctcgccgctcccaggtc

SEQ ID NO: 219844 - DNA, 20 bp, human
gacaggccgcgccacttcct

SEQ ID NO: 219845 - DNA, 20 bp, human
gcggagctgcagtcatactc

SEQ ID NO: 219846 - DNA, 20 bp, human
gcctgccggcggccgaaccc

SEQ ID NO: 219847 - DNA, 20 bp, human
gcaggccgcacagaccgggt

SEQ ID NO: 219848 - DNA, 20 bp, human
gcctcctgggtgcccgggtt

SEQ ID NO: 219849 - DNA, 20 bp, human
gtgggagcgcgggaggaaat

SEQ ID NO: 219850 - DNA, 20 bp, human
gtgcgagcccgccctgccgg

SEQ ID NO: 219851 - DNA, 20 bp, human
gaacccctgcgccggaggga

SEQ ID NO: 219852 - DNA, 20 bp, human
gcggccgaacccgggcaccc

SEQ ID NO: 219853 - DNA, 20 bp, human
gggaaggggacctggaggtt

SEQ ID NO: 219854 - DNA, 20 bp, human
ggcgcgggaggaaatgggtc

SEQ ID NO: 219855 - DNA, 20 bp, human
gggtgggaatgtctgcacgt

SEQ ID NO: 219856 - DNA, 20 bp, human
gtcagcggagcaccagaaac

SEQ ID NO: 219857 - DNA, 20 bp, human
gtaggcgaccccctggggag

SEQ ID NO: 219858 - DNA, 20 bp, human
gccactgacacactgggaga

SEQ ID NO: 219859 - DNA, 20 bp, human
ggcgcctgagcctgcccacc

SEQ ID NO: 219860 - DNA, 20 bp, human
gcccacctggaacgcgttgt

SEQ ID NO: 219861 - DNA, 20 bp, human
gcggcccagaggaaaatgaa

SEQ ID NO: 219862 - DNA, 20 bp, human
gcgttgtaggcgaccccctg

SEQ ID NO: 219863 - DNA, 20 bp, human
gccctggggagcgggtgcta

SEQ ID NO: 219864 - DNA, 20 bp, human
gcaaccacaaggtgataacg

SEQ ID NO: 219865 - DNA, 20 bp, human
ggccacgcggtgtctgggac

SEQ ID NO: 219866 - DNA, 20 bp, human
gagcaccgggagggaaacgg

SEQ ID NO: 219867 - DNA, 20 bp, human
gggtgtggtcgatttggcgg

SEQ ID NO: 219868 - DNA, 20 bp, human
gcgccaggcgcgtgcagagc

SEQ ID NO: 219869 - DNA, 20 bp, human
gtactcaagagccgcctccc

SEQ ID NO: 219870 - DNA, 20 bp, human
gcctgtgccaatagtagact

SEQ ID NO: 219871 - DNA, 20 bp, human
gcctcccgccttggccggag

SEQ ID NO: 219872 - DNA, 20 bp, human
ggcgcccggtgtggtcgatt

SEQ ID NO: 219873 - DNA, 20 bp, human
gccagcctctccggccaagg

SEQ ID NO: 219874 - DNA, 20 bp, human
gcccggtgtggtcgatttgg

SEQ ID NO: 219875 - DNA, 20 bp, human
gaaacggagggttgacgcct

SEQ ID NO: 219876 - DNA, 20 bp, human
ggccccttggcccccgagat

SEQ ID NO: 219877 - DNA, 20 bp, human
gactccatgcgggctgctgt

SEQ ID NO: 219878 - DNA, 20 bp, human
ggccaccgcccaggctttcg

SEQ ID NO: 219879 - DNA, 20 bp, human
gagctcgtcccccatctcgg

SEQ ID NO: 219880 - DNA, 20 bp, human
gctcgccgccgaccctcgct

SEQ ID NO: 219881 - DNA, 20 bp, human
gccactgcagcagaagagtg

SEQ ID NO: 219882 - DNA, 20 bp, human
gaggcggggccagtgccgcc

SEQ ID NO: 219883 - DNA, 20 bp, human
ggagctagcgcggagcactt

SEQ ID NO: 219884 - DNA, 20 bp, human
gagtggggactgcaaggctt

SEQ ID NO: 219885 - DNA, 20 bp, human
ggctagctcgtcccccatct

SEQ ID NO: 219886 - DNA, 20 bp, human
ggggagcggacggaatgaat

SEQ ID NO: 219887 - DNA, 20 bp, human
gaagccccgtgcttaaggtc

SEQ ID NO: 219888 - DNA, 20 bp, human
gtaagcacggggcttcgcgg

SEQ ID NO: 219889 - DNA, 20 bp, human
gggcccggaccttaagcacg

SEQ ID NO: 219890 - DNA, 20 bp, human
gcgcggcgcccctgcggaga

SEQ ID NO: 219891 - DNA, 20 bp, human
gcggcaggacggaagaaagc

SEQ ID NO: 219892 - DNA, 20 bp, human
gagggcctgccgagcggacg

SEQ ID NO: 219893 - DNA, 20 bp, human
gtcctcccgccgctgcttgg

SEQ ID NO: 219894 - DNA, 20 bp, human
gcctgccgagcggacgcggg

SEQ ID NO: 219895 - DNA, 20 bp, human
gggcccggcgcggcatgagg

SEQ ID NO: 219896 - DNA, 20 bp, human
gcgggcgcgcctccctctct

SEQ ID NO: 219897 - DNA, 20 bp, human
gggcctcccaacaaatcact

SEQ ID NO: 219898 - DNA, 20 bp, human
gggtcccggggcggctagga

SEQ ID NO: 219899 - DNA, 20 bp, human
gctcgcaagcagaaccttgg

SEQ ID NO: 219900 - DNA, 20 bp, human
gcgtcccggggtccccgtct

SEQ ID NO: 219901 - DNA, 20 bp, human
gtgggccgagacggggaccc

SEQ ID NO: 219902 - DNA, 20 bp, human
gactcccaaaccaacgctcg

SEQ ID NO: 219903 - DNA, 20 bp, human
ggggaggcgggagcgtcccg

SEQ ID NO: 219904 - DNA, 20 bp, human
gccggcctcccgggcctacg

SEQ ID NO: 219905 - DNA, 20 bp, human
gtctccccgagcgttggttt

SEQ ID NO: 219906 - DNA, 20 bp, human
gctaaggaggggtggagcct

SEQ ID NO: 219907 - DNA, 20 bp, human
gaacgggcgccgttataagg

SEQ ID NO: 219908 - DNA, 20 bp, human
ggtgccccgcccccttataa

SEQ ID NO: 219909 - DNA, 20 bp, human
gctcggtcatacctgcccta

SEQ ID NO: 219910 - DNA, 20 bp, human
gatgcgcaggcgcagtgaac

SEQ ID NO: 219911 - DNA, 20 bp, human
gtacctgccctaaggagggg

SEQ ID NO: 219912 - DNA, 20 bp, human
gggcagcgacaccttcgcga

SEQ ID NO: 219913 - DNA, 20 bp, human
ggcaactgagtcgagcggta

SEQ ID NO: 219914 - DNA, 20 bp, human
gtatgaccgagagctggggc

SEQ ID NO: 219915 - DNA, 20 bp, human
ggtgaacgggcgccgttata

SEQ ID NO: 219916 - DNA, 20 bp, human
ggaagctgccatgttgagtg

SEQ ID NO: 219917 - DNA, 20 bp, human
gggtgctagccgtctgcggg

SEQ ID NO: 219918 - DNA, 20 bp, human
gtcccaaaatggagcggagg

SEQ ID NO: 219919 - DNA, 20 bp, human
ggtctctccagctacggcaa

SEQ ID NO: 219920 - DNA, 20 bp, human
gcaaagggttccgccatttt

SEQ ID NO: 219921 - DNA, 20 bp, human
ggttgccccagcaacaacca

SEQ ID NO: 219922 - DNA, 20 bp, human
gtcctcctccgctccatttt

SEQ ID NO: 219923 - DNA, 20 bp, human
gagagcgagtacaaagctag

SEQ ID NO: 219924 - DNA, 20 bp, human
gggttccgccattttgggcg

SEQ ID NO: 219925 - DNA, 20 bp, human
gttttcccaaaatggagcgg

SEQ ID NO: 219926 - DNA, 20 bp, human
ggtcacggagccctgaggga

SEQ ID NO: 219927 - DNA, 20 bp, human
gggccgtcacggagccctga

SEQ ID NO: 219928 - DNA, 20 bp, human
gtgggagagggcccggacta

SEQ ID NO: 219929 - DNA, 20 bp, human
gccggcccgcaaggaggcgg

SEQ ID NO: 219930 - DNA, 20 bp, human
gagactgggaacggtaatgc

SEQ ID NO: 219931 - DNA, 20 bp, human
gtcctgctcccgggccgtca

SEQ ID NO: 219932 - DNA, 20 bp, human
gcagccgcgcggagctcctg

SEQ ID NO: 219933 - DNA, 20 bp, human
ggtgcccgccgcccctagtc

SEQ ID NO: 219934 - DNA, 20 bp, human
gaacggtaatgccggccaga

SEQ ID NO: 219935 - DNA, 20 bp, human
gccgcagccggaggagggct

SEQ ID NO: 219936 - DNA, 20 bp, human
gggaaaagaattgcattccc

SEQ ID NO: 219937 - DNA, 20 bp, human
gctaaattcttcttgtagca

SEQ ID NO: 219938 - DNA, 20 bp, human
gacctcagatttaccacagc

SEQ ID NO: 219939 - DNA, 20 bp, human
ggggcaatgcaaagatcaca

SEQ ID NO: 219940 - DNA, 20 bp, human
gagggtaccgcaggagacca

SEQ ID NO: 219941 - DNA, 20 bp, human
gaatacaccctggtctcctg

SEQ ID NO: 219942 - DNA, 20 bp, human
gcaagacaatacatgcacag

SEQ ID NO: 219943 - DNA, 20 bp, human
gccagggggaggtctataaa

SEQ ID NO: 219944 - DNA, 20 bp, human
gaacttagaattactgatga

SEQ ID NO: 219945 - DNA, 20 bp, human
gcggtaccctcaggcttatt

SEQ ID NO: 219946 - DNA, 20 bp, human
ggtagtggcaatccctaaga

SEQ ID NO: 219947 - DNA, 20 bp, human
gtgccctaatggtgccaata

SEQ ID NO: 219948 - DNA, 20 bp, human
gacccctattggcaccatta

SEQ ID NO: 219949 - DNA, 20 bp, human
gtctaaatccgtccctctta

SEQ ID NO: 219950 - DNA, 20 bp, human
gaactagagcaagaggtatg

SEQ ID NO: 219951 - DNA, 20 bp, human
gactcaaggtaacttctgga

SEQ ID NO: 219952 - DNA, 20 bp, human
gtccccaaattctgaaagtg

SEQ ID NO: 219953 - DNA, 20 bp, human
gaagccccactttcagaatt

SEQ ID NO: 219954 - DNA, 20 bp, human
gttaaaaagtgcaaacttaa

SEQ ID NO: 219955 - DNA, 20 bp, human
ggaagttgtttgacccctat

SEQ ID NO: 219956 - DNA, 20 bp, human
ggcgggacctggaatgtgat

SEQ ID NO: 219957 - DNA, 20 bp, human
ggtggagcttgcaatgtgat

SEQ ID NO: 219958 - DNA, 20 bp, human
ggaaactgataggctgaaac

SEQ ID NO: 219959 - DNA, 20 bp, human
gtaggctgaaactgggttgg

SEQ ID NO: 219960 - DNA, 20 bp, human
gcagagacagaaactggttg

SEQ ID NO: 219961 - DNA, 20 bp, human
gagtgagagctgcctggagc

SEQ ID NO: 219962 - DNA, 20 bp, human
gaccgtgataggctgaaacg

SEQ ID NO: 219963 - DNA, 20 bp, human
gtcagtgcttctaccgtgat

SEQ ID NO: 219964 - DNA, 20 bp, human
gggaagggccctggatgctc

SEQ ID NO: 219965 - DNA, 20 bp, human
gggacggagaaggccgattt

SEQ ID NO: 219966 - DNA, 20 bp, human
ggcaggcaatccggcttccg

SEQ ID NO: 219967 - DNA, 20 bp, human
gctgcaaggccctggcggga

SEQ ID NO: 219968 - DNA, 20 bp, human
gcggcttccggggctggaga

SEQ ID NO: 219969 - DNA, 20 bp, human
ggggatgccctctgccgagg

SEQ ID NO: 219970 - DNA, 20 bp, human
ggggaagtgtagtcttccca

SEQ ID NO: 219971 - DNA, 20 bp, human
gagaaagactgacagacggg

SEQ ID NO: 219972 - DNA, 20 bp, human
gcttcccatggcaggcaatc

SEQ ID NO: 219973 - DNA, 20 bp, human
gggatctgggaagactcagt

SEQ ID NO: 219974 - DNA, 20 bp, human
ggtgcccctctccatccgtc

SEQ ID NO: 219975 - DNA, 20 bp, human
gcggactccacctcggcaga

SEQ ID NO: 219976 - DNA, 20 bp, human
gggggccggggccctagttc

SEQ ID NO: 219977 - DNA, 20 bp, human
gcagcccgcgccgccaagtt

SEQ ID NO: 219978 - DNA, 20 bp, human
gtctccgctgccccctctgg

SEQ ID NO: 219979 - DNA, 20 bp, human
gcccgcggccaaggtcacag

SEQ ID NO: 219980 - DNA, 20 bp, human
gacggccaacggatgtgacg

SEQ ID NO: 219981 - DNA, 20 bp, human
ggagaagaacttgcccaact

SEQ ID NO: 219982 - DNA, 20 bp, human
ggcagtcgcggccgccagag

SEQ ID NO: 219983 - DNA, 20 bp, human
gcctgagcccggcgagggtg

SEQ ID NO: 219984 - DNA, 20 bp, human
gttgcccaacttggcggcgc

SEQ ID NO: 219985 - DNA, 20 bp, human
gcgcggcctgagcccggcga

SEQ ID NO: 219986 - DNA, 20 bp, human
gcggccggaagcccacgcgg

SEQ ID NO: 219987 - DNA, 20 bp, human
gtcgctgacagaggcttcga

SEQ ID NO: 219988 - DNA, 20 bp, human
gctgacagaggcttcgaggg

SEQ ID NO: 219989 - DNA, 20 bp, human
gcgcgctcgttcgctgacag

SEQ ID NO: 219990 - DNA, 20 bp, human
gtgaagcgagagcgcccggc

SEQ ID NO: 219991 - DNA, 20 bp, human
gaggcggcggaggacaatac

SEQ ID NO: 219992 - DNA, 20 bp, human
gcgagcgcgcgcaatagcgc

SEQ ID NO: 219993 - DNA, 20 bp, human
ggcagagcggcgcagaaggg

SEQ ID NO: 219994 - DNA, 20 bp, human
gcgccggcccttctccggga

SEQ ID NO: 219995 - DNA, 20 bp, human
ggcagcagagcggcgcagaa

SEQ ID NO: 219996 - DNA, 20 bp, human
gcgctggggcgcggtacgcc

SEQ ID NO: 219997 - DNA, 20 bp, human
gtccgcgaatggcgctccgg

SEQ ID NO: 219998 - DNA, 20 bp, human
ggcgtaagccgctccgcgaa

SEQ ID NO: 219999 - DNA, 20 bp, human
gtaccgcgccccagcggccg

SEQ ID NO: 220000 - DNA, 20 bp, human
gaatggcgctccgggggctg

SEQ ID NO: 220001 - DNA, 20 bp, human
ggccgggcagcgcacctccc

SEQ ID NO: 220002 - DNA, 20 bp, human
ggccggggaggtgcgctgcc

SEQ ID NO: 220003 - DNA, 20 bp, human
ggccccctcccgcgagccag

SEQ ID NO: 220004 - DNA, 20 bp, human
ggcccccggagcgccattcg

SEQ ID NO: 220005 - DNA, 20 bp, human
gccgcgcggccgcacaaagc

SEQ ID NO: 220006 - DNA, 20 bp, human
ggagccccggggccgaagga

SEQ ID NO: 220007 - DNA, 20 bp, human
gcgcccccccgccggatcca

SEQ ID NO: 220008 - DNA, 20 bp, human
gacctctcggaacgtcactc

SEQ ID NO: 220009 - DNA, 20 bp, human
gtccagaggcggggtcaacc

SEQ ID NO: 220010 - DNA, 20 bp, human
gaggaaaaaggatgcggacg

SEQ ID NO: 220011 - DNA, 20 bp, human
gaggagccttggatccggcg

SEQ ID NO: 220012 - DNA, 20 bp, human
gcacacacgcccaaggtgtg

SEQ ID NO: 220013 - DNA, 20 bp, human
gagcgaggatgtgagccccg

SEQ ID NO: 220014 - DNA, 20 bp, human
gcctcgctgcctcacacctt

SEQ ID NO: 220015 - DNA, 20 bp, human
gcccgttgcccaagcaacta

SEQ ID NO: 220016 - DNA, 20 bp, human
ggaagacccggctgaaaatc

SEQ ID NO: 220017 - DNA, 20 bp, human
gggggcggggtgttggtaga

SEQ ID NO: 220018 - DNA, 20 bp, human
ggggtgttggtagaaggagt

SEQ ID NO: 220019 - DNA, 20 bp, human
gggcctcagttgagtgggtg

SEQ ID NO: 220020 - DNA, 20 bp, human
ggctgggcggtcaacaagtg

SEQ ID NO: 220021 - DNA, 20 bp, human
ggggctgggaagtagtcggg

SEQ ID NO: 220022 - DNA, 20 bp, human
ggaggggccggaagtcgagg

SEQ ID NO: 220023 - DNA, 20 bp, human
ggcggggctgggaagtagtc

SEQ ID NO: 220024 - DNA, 20 bp, human
gggcctggaggcaactaacg

SEQ ID NO: 220025 - DNA, 20 bp, human
gctaacgcggcatagggcga

SEQ ID NO: 220026 - DNA, 20 bp, human
gcccacgcgaaggttcctat

SEQ ID NO: 220027 - DNA, 20 bp, human
gtggggagcgcaagtctctg

SEQ ID NO: 220028 - DNA, 20 bp, human
gagtctctgaggcacgggag

SEQ ID NO: 220029 - DNA, 20 bp, human
gccacagcccgtcgaccgat

SEQ ID NO: 220030 - DNA, 20 bp, human
ggaaggttcctatcggtcga

SEQ ID NO: 220031 - DNA, 20 bp, human
gaccaactccccccacgcga

SEQ ID NO: 220032 - DNA, 20 bp, human
ggccacacgggctcgaggat

SEQ ID NO: 220033 - DNA, 20 bp, human
ggtggtctgtgggtccgcgc

SEQ ID NO: 220034 - DNA, 20 bp, human
gcgggtagttcctgggtccg

SEQ ID NO: 220035 - DNA, 20 bp, human
gcccgcgggcgtcagaggga

SEQ ID NO: 220036 - DNA, 20 bp, human
gcacgcgcacgagtcggaag

SEQ ID NO: 220037 - DNA, 20 bp, human
gggccccagtccagctcgtc

SEQ ID NO: 220038 - DNA, 20 bp, human
gcggcttcggggtccgcctg

SEQ ID NO: 220039 - DNA, 20 bp, human
ggagctccgccctgagtcat

SEQ ID NO: 220040 - DNA, 20 bp, human
ggaaacccgcccggggcgca

SEQ ID NO: 220041 - DNA, 20 bp, human
gcccgggccggagtcgccgc

SEQ ID NO: 220042 - DNA, 20 bp, human
gcccgggcacgcgcacgagt

SEQ ID NO: 220043 - DNA, 20 bp, human
gggtgggaagccggacgagc

SEQ ID NO: 220044 - DNA, 20 bp, human
gaagggaggtagcaactggc

SEQ ID NO: 220045 - DNA, 20 bp, human
gaagccggacgagctggact

SEQ ID NO: 220046 - DNA, 20 bp, human
gcccgaaagctgagggacgg

SEQ ID NO: 220047 - DNA, 20 bp, human
gcggggttcggcagcagaag

SEQ ID NO: 220048 - DNA, 20 bp, human
ggacgacgccagccaatccc

SEQ ID NO: 220049 - DNA, 20 bp, human
ggccgaaccccgaaagctga

SEQ ID NO: 220050 - DNA, 20 bp, human
gcggggcagccgtaccgttg

SEQ ID NO: 220051 - DNA, 20 bp, human
gagggtgtcccccaacggta

SEQ ID NO: 220052 - DNA, 20 bp, human
gcgaatggagagcagcgaag

SEQ ID NO: 220053 - DNA, 20 bp, human
ggcccccggcggctgaaagc

SEQ ID NO: 220054 - DNA, 20 bp, human
ggaagtgggtaagggtaata

SEQ ID NO: 220055 - DNA, 20 bp, human
ggcccgcgggcgattgcgaa

SEQ ID NO: 220056 - DNA, 20 bp, human
gaacccggggacacctcctc

SEQ ID NO: 220057 - DNA, 20 bp, human
gccttggtcgcggtcactcc

SEQ ID NO: 220058 - DNA, 20 bp, human
gagtgaccgcgaccaaggag

SEQ ID NO: 220059 - DNA, 20 bp, human
gtcgctgcgccgctggcggt

SEQ ID NO: 220060 - DNA, 20 bp, human
ggggacaggtgagcgaagcg

SEQ ID NO: 220061 - DNA, 20 bp, human
gtaggcgcggacgccggagg

SEQ ID NO: 220062 - DNA, 20 bp, human
ggcgcacggcagcattgcga

SEQ ID NO: 220063 - DNA, 20 bp, human
gggcgtccgcgcctagccgc

SEQ ID NO: 220064 - DNA, 20 bp, human
gacgccggaggaggtgtccc

SEQ ID NO: 220065 - DNA, 20 bp, human
gggcggccgctccttggtcg

SEQ ID NO: 220066 - DNA, 20 bp, human
ggggcgcagcgagggcaata

SEQ ID NO: 220067 - DNA, 20 bp, human
gactgcctcgagaggggcta

SEQ ID NO: 220068 - DNA, 20 bp, human
gcctcgagaggggctatgga

SEQ ID NO: 220069 - DNA, 20 bp, human
ggtcccccgggcgacagcgg

SEQ ID NO: 220070 - DNA, 20 bp, human
gcgcagcgagggcaataggg

SEQ ID NO: 220071 - DNA, 20 bp, human
gaacgccgccagagggggga

SEQ ID NO: 220072 - DNA, 20 bp, human
ggacgtgaacgccgccagag

SEQ ID NO: 220073 - DNA, 20 bp, human
ggacgcacgcaggcgtagta

SEQ ID NO: 220074 - DNA, 20 bp, human
ggtaaagcttggggacctgg

SEQ ID NO: 220075 - DNA, 20 bp, human
gggtggagaagagttttagc

SEQ ID NO: 220076 - DNA, 20 bp, human
gcaggcctcacgccagttta

SEQ ID NO: 220077 - DNA, 20 bp, human
ggataccagagaccctaaac

SEQ ID NO: 220078 - DNA, 20 bp, human
gaactggcgtgaggcctgct

SEQ ID NO: 220079 - DNA, 20 bp, human
gcacgccagtttagggtctc

SEQ ID NO: 220080 - DNA, 20 bp, human
gttcgtggactacactttcc

SEQ ID NO: 220081 - DNA, 20 bp, human
ggcacatggggttacgcgca

SEQ ID NO: 220082 - DNA, 20 bp, human
gaggccagccacggtgcagc

SEQ ID NO: 220083 - DNA, 20 bp, human
gctgattggatgaaagtctt

SEQ ID NO: 220084 - DNA, 20 bp, human
gataacttcagtacataaat

SEQ ID NO: 220085 - DNA, 20 bp, human
gtagcctgctgcaccgtggc

SEQ ID NO: 220086 - DNA, 20 bp, human
gttcgtggactacactttcc

SEQ ID NO: 220087 - DNA, 20 bp, human
ggcacatggggttacgcgca

SEQ ID NO: 220088 - DNA, 20 bp, human
gaggccagccacggtgcagc

SEQ ID NO: 220089 - DNA, 20 bp, human
gctgattggatgaaagtctt

SEQ ID NO: 220090 - DNA, 20 bp, human
gataacttcagtacataaat

SEQ ID NO: 220091 - DNA, 20 bp, human
gtagcctgctgcaccgtggc

SEQ ID NO: 220092 - DNA, 20 bp, human
ggttatgcatatgcggttcg

SEQ ID NO: 220093 - DNA, 20 bp, human
gcactgtagtgtggctggaa

SEQ ID NO: 220094 - DNA, 20 bp, human
gagaagagtcaggctgttcc

SEQ ID NO: 220095 - DNA, 20 bp, human
gtgtggctggaaaggtagga

SEQ ID NO: 220096 - DNA, 20 bp, human
gttcgtggactacactttcc

SEQ ID NO: 220097 - DNA, 20 bp, human
ggcacatggggttacgcgca

SEQ ID NO: 220098 - DNA, 20 bp, human
gaggccagccacggtgcagc

SEQ ID NO: 220099 - DNA, 20 bp, human
gctgattggatgaaagtctt

SEQ ID NO: 220100 - DNA, 20 bp, human
gataacttcagtacataaat

SEQ ID NO: 220101 - DNA, 20 bp, human
gtagcctgctgcaccgtggc

SEQ ID NO: 220102 - DNA, 20 bp, human
ggttatgcatatgcggttcg

SEQ ID NO: 220103 - DNA, 20 bp, human
gcactgtagtgtggctggaa

SEQ ID NO: 220104 - DNA, 20 bp, human
gagaagagtcaggctgttcc

SEQ ID NO: 220105 - DNA, 20 bp, human
gtgtggctggaaaggtagga

SEQ ID NO: 220106 - DNA, 20 bp, human
gttcgtggactacactttcc

SEQ ID NO: 220107 - DNA, 20 bp, human
ggcacatggggttacgcgca

SEQ ID NO: 220108 - DNA, 20 bp, human
gaggccagccacggtgcagc

SEQ ID NO: 220109 - DNA, 20 bp, human
gctgattggatgaaagtctt

SEQ ID NO: 220110 - DNA, 20 bp, human
gataacttcagtacataaat

SEQ ID NO: 220111 - DNA, 20 bp, human
gtagcctgctgcaccgtggc

SEQ ID NO: 220112 - DNA, 20 bp, human
ggttatgcatatgcggttcg

SEQ ID NO: 220113 - DNA, 20 bp, human
gcactgtagtgtggctggaa

SEQ ID NO: 220114 - DNA, 20 bp, human
gagaagagtcaggctgttcc

SEQ ID NO: 220115 - DNA, 20 bp, human
gtgtggctggaaaggtagga

SEQ ID NO: 220116 - DNA, 20 bp, human
gggacccgcggggacgagaa

SEQ ID NO: 220117 - DNA, 20 bp, human
gccctagctgcagggacccg

SEQ ID NO: 220118 - DNA, 20 bp, human
gccgcggggacgagaacggg

SEQ ID NO: 220119 - DNA, 20 bp, human
gccccgccggcccgagcgag

SEQ ID NO: 220120 - DNA, 20 bp, human
gcagtgcggctgggttcccc

SEQ ID NO: 220121 - DNA, 20 bp, human
gctagggcgccgcggcgaag

SEQ ID NO: 220122 - DNA, 20 bp, human
gggctgccccgggccaagcg

SEQ ID NO: 220123 - DNA, 20 bp, human
gggggagacaccgagcgccc

SEQ ID NO: 220124 - DNA, 20 bp, human
ggcgcgcgcacgcaccgtcc

SEQ ID NO: 220125 - DNA, 20 bp, human
ggcgcgcgcagcccagcacc

SEQ ID NO: 220126 - DNA, 20 bp, human
gtgggccccaggaacgcctt

SEQ ID NO: 220127 - DNA, 20 bp, human
gggggagccgagggccggat

SEQ ID NO: 220128 - DNA, 20 bp, human
ggcagggcggggcggctgat

SEQ ID NO: 220129 - DNA, 20 bp, human
ggtgccaagggtggtggcaa

SEQ ID NO: 220130 - DNA, 20 bp, human
gctggctccgccagccaatc

SEQ ID NO: 220131 - DNA, 20 bp, human
ggggcgcgctgctgattggc

SEQ ID NO: 220132 - DNA, 20 bp, human
gaccgacccacggttctgat

SEQ ID NO: 220133 - DNA, 20 bp, human
gaccaatcagaaccgtgggt

SEQ ID NO: 220134 - DNA, 20 bp, human
ggttctgattggtcagagac

SEQ ID NO: 220135 - DNA, 20 bp, human
gcgaggggcgcgctgctgat

SEQ ID NO: 220136 - DNA, 20 bp, human
gggaggggagcgagataagg

SEQ ID NO: 220137 - DNA, 20 bp, human
gtgaaactggatcccgaatc

SEQ ID NO: 220138 - DNA, 20 bp, human
gagcaggggagtggccccac

SEQ ID NO: 220139 - DNA, 20 bp, human
gctaggcaatgcaggtgcgt

SEQ ID NO: 220140 - DNA, 20 bp, human
gcagtctctggctcccgatt

SEQ ID NO: 220141 - DNA, 20 bp, human
gtaatccgtaatgcagtctc

SEQ ID NO: 220142 - DNA, 20 bp, human
gggagccagagactgcatta

SEQ ID NO: 220143 - DNA, 20 bp, human
gccccctctaatgtgtgatc

SEQ ID NO: 220144 - DNA, 20 bp, human
gtcgccaggaaggggaaaaa

SEQ ID NO: 220145 - DNA, 20 bp, human
ggcgagagattggggagcgc

SEQ ID NO: 220146 - DNA, 20 bp, human
gctgggcgggggcttaccca

SEQ ID NO: 220147 - DNA, 20 bp, human
gcgcgccgcctcctgttaaa

SEQ ID NO: 220148 - DNA, 20 bp, human
gcgcgcgccgggccgagtga

SEQ ID NO: 220149 - DNA, 20 bp, human
gaccgaagaggatgcggcac

SEQ ID NO: 220150 - DNA, 20 bp, human
gccgccgaacccggttcctc

SEQ ID NO: 220151 - DNA, 20 bp, human
gcgcgaggagccgcgggaga

SEQ ID NO: 220152 - DNA, 20 bp, human
gcggcgctcagagaccgaag

SEQ ID NO: 220153 - DNA, 20 bp, human
ggctgcccgcagcgcgcgcc

SEQ ID NO: 220154 - DNA, 20 bp, human
gtatagctggaggggcgtcg

SEQ ID NO: 220155 - DNA, 20 bp, human
gtgacggccgaggcgggacg

SEQ ID NO: 220156 - DNA, 20 bp, human
gccgcagctgtgcataagaa

SEQ ID NO: 220157 - DNA, 20 bp, human
gcggggggtgcgcgtgtccc

SEQ ID NO: 220158 - DNA, 20 bp, human
gagaagggcgcgcggcaccc

SEQ ID NO: 220159 - DNA, 20 bp, human
ggcgcacacgagcacgcggg

SEQ ID NO: 220160 - DNA, 20 bp, human
ggagccgagcctctggcggg

SEQ ID NO: 220161 - DNA, 20 bp, human
gctgtctcgggtgtgcgcgc

SEQ ID NO: 220162 - DNA, 20 bp, human
gtcgtgtgcgcgcgcgtccc

SEQ ID NO: 220163 - DNA, 20 bp, human
ggaactccaggaagtcgcag

SEQ ID NO: 220164 - DNA, 20 bp, human
ggcagtgctcgctctccctt

SEQ ID NO: 220165 - DNA, 20 bp, human
gcgcgcgcacacgagcacgc

SEQ ID NO: 220166 - DNA, 20 bp, human
gaatggaaagggcggtgcgg

SEQ ID NO: 220167 - DNA, 20 bp, human
gcggaacccaccaatggaaa

SEQ ID NO: 220168 - DNA, 20 bp, human
gctgcggcggcgtcgatcct

SEQ ID NO: 220169 - DNA, 20 bp, human
ggggcctagtggccgactcc

SEQ ID NO: 220170 - DNA, 20 bp, human
gaccaatcgctgcctggagt

SEQ ID NO: 220171 - DNA, 20 bp, human
gccaggcagcgattggtctg

SEQ ID NO: 220172 - DNA, 20 bp, human
gccgctgctaggcaaccgcc

SEQ ID NO: 220173 - DNA, 20 bp, human
ggggcctgaggcggctataa

SEQ ID NO: 220174 - DNA, 20 bp, human
gaacccaccaatggaaaggg

SEQ ID NO: 220175 - DNA, 20 bp, human
ggccctgggagcagcctgag

SEQ ID NO: 220176 - DNA, 20 bp, human
ggccctgtccgccacaggtg

SEQ ID NO: 220177 - DNA, 20 bp, human
gggaagcgggccccccgagt

SEQ ID NO: 220178 - DNA, 20 bp, human
ggtggcgtacccacctgagg

SEQ ID NO: 220179 - DNA, 20 bp, human
gtcaccaggccgcctcaggt

SEQ ID NO: 220180 - DNA, 20 bp, human
gggcggggtcaccccacctg

SEQ ID NO: 220181 - DNA, 20 bp, human
ggtctcgggccctacgtcgc

SEQ ID NO: 220182 - DNA, 20 bp, human
gaccccacctgtggcggaca

SEQ ID NO: 220183 - DNA, 20 bp, human
gagctctgggagagccgcga

SEQ ID NO: 220184 - DNA, 20 bp, human
gtcgctgccctgtccgccac

SEQ ID NO: 220185 - DNA, 20 bp, human
gggcgtggcgtacccacctg

SEQ ID NO: 220186 - DNA, 20 bp, human
gctgcagcaggagggatcga

SEQ ID NO: 220187 - DNA, 20 bp, human
gtccctgccccgcacgccgt

SEQ ID NO: 220188 - DNA, 20 bp, human
ggggacgcgggcctcgcgtc

SEQ ID NO: 220189 - DNA, 20 bp, human
gggcacggctccggctccta

SEQ ID NO: 220190 - DNA, 20 bp, human
gcccgcagccggcacggctc

SEQ ID NO: 220191 - DNA, 20 bp, human
gagaacgcgccggggcggaa

SEQ ID NO: 220192 - DNA, 20 bp, human
gcgtcggcgtaggggttctg

SEQ ID NO: 220193 - DNA, 20 bp, human
gcacaggccgacggcgtgcg

SEQ ID NO: 220194 - DNA, 20 bp, human
gggggcagggagcgacggtc

SEQ ID NO: 220195 - DNA, 20 bp, human
gaacccctacgccgacgcct

SEQ ID NO: 220196 - DNA, 20 bp, human
ggggcagcgcccgcccagta

SEQ ID NO: 220197 - DNA, 20 bp, human
gaatgcctggtataggcagg

SEQ ID NO: 220198 - DNA, 20 bp, human
gaaagcggcgttcccctcca

SEQ ID NO: 220199 - DNA, 20 bp, human
gccaaggggtgaataattga

SEQ ID NO: 220200 - DNA, 20 bp, human
gtatcagcccacagctccaa

SEQ ID NO: 220201 - DNA, 20 bp, human
gaaggcatcctgtgccgggc

SEQ ID NO: 220202 - DNA, 20 bp, human
gggcggggccccccagggtt

SEQ ID NO: 220203 - DNA, 20 bp, human
gtgtgggagccaagctcaga

SEQ ID NO: 220204 - DNA, 20 bp, human
ggggtgaataattgaagggc

SEQ ID NO: 220205 - DNA, 20 bp, human
gtcctcaaggaccccaaccc

SEQ ID NO: 220206 - DNA, 20 bp, human
gaccccggccgggtccccta

SEQ ID NO: 220207 - DNA, 20 bp, human
gtggcgcgtggggtctagaa

SEQ ID NO: 220208 - DNA, 20 bp, human
ggggctgtgagtcaacccac

SEQ ID NO: 220209 - DNA, 20 bp, human
gccccctcccccgggatgcg

SEQ ID NO: 220210 - DNA, 20 bp, human
ggccccgccccccgcgtcca

SEQ ID NO: 220211 - DNA, 20 bp, human
gaaggcgccgtggacgcggg

SEQ ID NO: 220212 - DNA, 20 bp, human
gcgggggcggggtctgactg

SEQ ID NO: 220213 - DNA, 20 bp, human
ggggtctccgtgccttgagc

SEQ ID NO: 220214 - DNA, 20 bp, human
gccagcagttgctcagtcgt

SEQ ID NO: 220215 - DNA, 20 bp, human
ggaccgcccgccccctccga

SEQ ID NO: 220216 - DNA, 20 bp, human
gcaggcagggcggctgtcag

SEQ ID NO: 220217 - DNA, 20 bp, human
gcacaggccgacagcctgta

SEQ ID NO: 220218 - DNA, 20 bp, human
gcctgtagggtgatctgggt

SEQ ID NO: 220219 - DNA, 20 bp, human
gaagacaaggattgagaatc

SEQ ID NO: 220220 - DNA, 20 bp, human
gacagcctgtagggtgatct

SEQ ID NO: 220221 - DNA, 20 bp, human
ggtgggcgggacatgctcct

SEQ ID NO: 220222 - DNA, 20 bp, human
gcctgtgcgtctgcatccgg

SEQ ID NO: 220223 - DNA, 20 bp, human
gtctagaggaagttgctctg

SEQ ID NO: 220224 - DNA, 20 bp, human
gagagggagctgattggagc

SEQ ID NO: 220225 - DNA, 20 bp, human
gtcctctagagggagctgat

SEQ ID NO: 220226 - DNA, 20 bp, human
gctcccccggcgcctcgcga

SEQ ID NO: 220227 - DNA, 20 bp, human
gcgagcggcgccggcgtctg

SEQ ID NO: 220228 - DNA, 20 bp, human
gccgccccacggcgtccgat

SEQ ID NO: 220229 - DNA, 20 bp, human
ggtcccccagcgctcgcgtc

SEQ ID NO: 220230 - DNA, 20 bp, human
ggggttcccgagccggtccc

SEQ ID NO: 220231 - DNA, 20 bp, human
ggacgcgcaggcctccgcaa

SEQ ID NO: 220232 - DNA, 20 bp, human
ggcgaaggtcactgacgcgc

SEQ ID NO: 220233 - DNA, 20 bp, human
gagccgggcgccccagacgc

SEQ ID NO: 220234 - DNA, 20 bp, human
gccagccgggcgccccagcc

SEQ ID NO: 220235 - DNA, 20 bp, human
gcgctgcggggcggattgac

SEQ ID NO: 220236 - DNA, 20 bp, human
gacccggaactcaaggactt

SEQ ID NO: 220237 - DNA, 20 bp, human
gcggaagtacggttttcgga

SEQ ID NO: 220238 - DNA, 20 bp, human
gaaggcagggcttcccgcga

SEQ ID NO: 220239 - DNA, 20 bp, human
gtagaagacggacaagggag

SEQ ID NO: 220240 - DNA, 20 bp, human
gagaaaggaagtcctctccc

SEQ ID NO: 220241 - DNA, 20 bp, human
ggaggcgccccggacctcga

SEQ ID NO: 220242 - DNA, 20 bp, human
gcgagaagcgagaccttaga

SEQ ID NO: 220243 - DNA, 20 bp, human
gagagttagaagacggacaa

SEQ ID NO: 220244 - DNA, 20 bp, human
ggtagcgtcagttagaaatc

SEQ ID NO: 220245 - DNA, 20 bp, human
gagggcttcccgcgaaggac

SEQ ID NO: 220246 - DNA, 20 bp, human
gggttgctgggaaagagtga

SEQ ID NO: 220247 - DNA, 20 bp, human
gcaggtgagaataggaaccg

SEQ ID NO: 220248 - DNA, 20 bp, human
gacgcaggccaggtgagaat

SEQ ID NO: 220249 - DNA, 20 bp, human
gtctgggtgctgttctcagc

SEQ ID NO: 220250 - DNA, 20 bp, human
ggggcaggagcaagagcctc

SEQ ID NO: 220251 - DNA, 20 bp, human
gagaagaaatcagcctgtct

SEQ ID NO: 220252 - DNA, 20 bp, human
ggctgctggcatcagggcac

SEQ ID NO: 220253 - DNA, 20 bp, human
ggtcgggggtgagcacaaaa

SEQ ID NO: 220254 - DNA, 20 bp, human
gcacggaagtcactttgtgc

SEQ ID NO: 220255 - DNA, 20 bp, human
ggtgatgtcacaccacaggt

SEQ ID NO: 220256 - DNA, 20 bp, human
ggctcatgcccgcaaggcca

SEQ ID NO: 220257 - DNA, 20 bp, human
gcaaagcggccttttgagaa

SEQ ID NO: 220258 - DNA, 20 bp, human
gaggagagctacaataacag

SEQ ID NO: 220259 - DNA, 20 bp, human
ggccttgcgggcatgagccc

SEQ ID NO: 220260 - DNA, 20 bp, human
gtgagaagggatgtaagagc

SEQ ID NO: 220261 - DNA, 20 bp, human
gcctacgtctgcctggaagt

SEQ ID NO: 220262 - DNA, 20 bp, human
gagcggtctaaatatatcct

SEQ ID NO: 220263 - DNA, 20 bp, human
ggagcagtttcacttcctct

SEQ ID NO: 220264 - DNA, 20 bp, human
gcagtatggaagacctagaa

SEQ ID NO: 220265 - DNA, 20 bp, human
gtccagcaaatgttcacttc

SEQ ID NO: 220266 - DNA, 20 bp, human
ggggcacccctgtggcagtg

SEQ ID NO: 220267 - DNA, 20 bp, human
gggcgtgggcgaaaaacggg

SEQ ID NO: 220268 - DNA, 20 bp, human
gtgcgcgcgcttttcccgct

SEQ ID NO: 220269 - DNA, 20 bp, human
gcctgcgcatgctcaccagg

SEQ ID NO: 220270 - DNA, 20 bp, human
gccctccgcgcaggctcact

SEQ ID NO: 220271 - DNA, 20 bp, human
gtgggaagccggtaccgtcg

SEQ ID NO: 220272 - DNA, 20 bp, human
gcgggaaaagcgcgcgcagc

SEQ ID NO: 220273 - DNA, 20 bp, human
gcaggcatggcccagacgca

SEQ ID NO: 220274 - DNA, 20 bp, human
gtgtcggggagatgcgataa

SEQ ID NO: 220275 - DNA, 20 bp, human
ggctggcctcactgccacag

SEQ ID NO: 220276 - DNA, 20 bp, human
gcgcacgcgcggagggacgg

SEQ ID NO: 220277 - DNA, 20 bp, human
ggatgcgggcatgcgctcga

SEQ ID NO: 220278 - DNA, 20 bp, human
gcccgcatctgctgtccgac

SEQ ID NO: 220279 - DNA, 20 bp, human
gcgcaggtggggcgagagga

SEQ ID NO: 220280 - DNA, 20 bp, human
gaggcgggcgaagggaagag

SEQ ID NO: 220281 - DNA, 20 bp, human
ggcggggcggcgaacggaag

SEQ ID NO: 220282 - DNA, 20 bp, human
gaggcgcgagaggaggggat

SEQ ID NO: 220283 - DNA, 20 bp, human
gaggcggaagacgagcccag

SEQ ID NO: 220284 - DNA, 20 bp, human
gctaggcccgggtgctgcga

SEQ ID NO: 220285 - DNA, 20 bp, human
ggggcgggacgggcagtact

SEQ ID NO: 220286 - DNA, 20 bp, human
gtgggcgggacctaggggtg

SEQ ID NO: 220287 - DNA, 20 bp, human
ggccgagtgggcgggaccta

SEQ ID NO: 220288 - DNA, 20 bp, human
gaacacgccggggacagagg

SEQ ID NO: 220289 - DNA, 20 bp, human
gtcccggcgtgtgggactta

SEQ ID NO: 220290 - DNA, 20 bp, human
ggacccgcgcgccgggactt

SEQ ID NO: 220291 - DNA, 20 bp, human
gagccagccgctggccgagt

SEQ ID NO: 220292 - DNA, 20 bp, human
gtcccggcgcgcgggtccta

SEQ ID NO: 220293 - DNA, 20 bp, human
ggccccgcgcgccaggactt

SEQ ID NO: 220294 - DNA, 20 bp, human
gcagccgctggccgagtggg

SEQ ID NO: 220295 - DNA, 20 bp, human
ggaggggccgcgagagccgt

SEQ ID NO: 220296 - DNA, 20 bp, human
gccaagttggggagagcaaa

SEQ ID NO: 220297 - DNA, 20 bp, human
ggcgcctccctgctcctcgg

SEQ ID NO: 220298 - DNA, 20 bp, human
gagagaggacctccccggcc

SEQ ID NO: 220299 - DNA, 20 bp, human
gccgggcccgcagctatctg

SEQ ID NO: 220300 - DNA, 20 bp, human
ggacggcccgagggccccct

SEQ ID NO: 220301 - DNA, 20 bp, human
ggtgtcagggaggaatggga

SEQ ID NO: 220302 - DNA, 20 bp, human
gagaagaaacgcgaggatgt

SEQ ID NO: 220303 - DNA, 20 bp, human
gagggagggcgcgccaagtt

SEQ ID NO: 220304 - DNA, 20 bp, human
gggagaaggcgcgcgcggac

SEQ ID NO: 220305 - DNA, 20 bp, human
gagagctgccgccgaggagc

SEQ ID NO: 220306 - DNA, 20 bp, human
gaacgactgcgcacgtggcg

SEQ ID NO: 220307 - DNA, 20 bp, human
gcgccctcggaactcccccg

SEQ ID NO: 220308 - DNA, 20 bp, human
ggttcggggcggctgctgaa

SEQ ID NO: 220309 - DNA, 20 bp, human
gccacgtgcgcagtcgttcc

SEQ ID NO: 220310 - DNA, 20 bp, human
gcggttgcggcaacccgagg

SEQ ID NO: 220311 - DNA, 20 bp, human
gggaaagaaaaaagatgcgg

SEQ ID NO: 220312 - DNA, 20 bp, human
gtgcgcacgtggcgcggcgg

SEQ ID NO: 220313 - DNA, 20 bp, human
gggcgcgcggctgccacctc

SEQ ID NO: 220314 - DNA, 20 bp, human
gagccgcgggggagttccga

SEQ ID NO: 220315 - DNA, 20 bp, human
gaccgctgccgcccggtgcc

SEQ ID NO: 220316 - DNA, 20 bp, human
ggaagggaggccaaaaagga

SEQ ID NO: 220317 - DNA, 20 bp, human
ggccggccgaccgagaccga

SEQ ID NO: 220318 - DNA, 20 bp, human
gagggagggacccagaaggg

SEQ ID NO: 220319 - DNA, 20 bp, human
gtcggccggcctctttcacg

SEQ ID NO: 220320 - DNA, 20 bp, human
gcgctccgctcagtctccct

SEQ ID NO: 220321 - DNA, 20 bp, human
gccccagagacgagagtcgg

SEQ ID NO: 220322 - DNA, 20 bp, human
gggcggaagggaggccaaaa

SEQ ID NO: 220323 - DNA, 20 bp, human
ggctcagtctccctcggtct

SEQ ID NO: 220324 - DNA, 20 bp, human
gagtctccctcggtctcggt

SEQ ID NO: 220325 - DNA, 20 bp, human
gggagggggccacgtgaaag

SEQ ID NO: 220326 - DNA, 20 bp, human
gtccacgcggggaaggagaa

SEQ ID NO: 220327 - DNA, 20 bp, human
gaggcagtaaggtgctcatg

SEQ ID NO: 220328 - DNA, 20 bp, human
ggtgccctcccgctgggctg

SEQ ID NO: 220329 - DNA, 20 bp, human
gcatggggaacactgccccg

SEQ ID NO: 220330 - DNA, 20 bp, human
gggaaggagaaaggcacggt

SEQ ID NO: 220331 - DNA, 20 bp, human
gcagcccgcggccaaggccc

SEQ ID NO: 220332 - DNA, 20 bp, human
ggacctgcgcgcctagtgcc

SEQ ID NO: 220333 - DNA, 20 bp, human
gtaggcgcgcaggtcggcgc

SEQ ID NO: 220334 - DNA, 20 bp, human
gcacctggagcgcgtcccgg

SEQ ID NO: 220335 - DNA, 20 bp, human
gctgcgcgcctagtgcccgg

SEQ ID NO: 220336 - DNA, 20 bp, human
gagggtctgcgccggaggag

SEQ ID NO: 220337 - DNA, 20 bp, human
gcgggcgtgtccaggctgga

SEQ ID NO: 220338 - DNA, 20 bp, human
gaagggggacgcaggaatgg

SEQ ID NO: 220339 - DNA, 20 bp, human
ggcggataggagagaaatgg

SEQ ID NO: 220340 - DNA, 20 bp, human
gatggcggataggagagaaa

SEQ ID NO: 220341 - DNA, 20 bp, human
ggggggtgactgtgctggag

SEQ ID NO: 220342 - DNA, 20 bp, human
gttcccccgccgcgccgcct

SEQ ID NO: 220343 - DNA, 20 bp, human
gaggaaccaggatggcggat

SEQ ID NO: 220344 - DNA, 20 bp, human
ggttggcggggcacagagtt

SEQ ID NO: 220345 - DNA, 20 bp, human
ggcgagcgcgagaaatgcag

SEQ ID NO: 220346 - DNA, 20 bp, human
gacgctggaagtcacatggg

SEQ ID NO: 220347 - DNA, 20 bp, human
ggaggctggctggacttaag

SEQ ID NO: 220348 - DNA, 20 bp, human
gctcacgctggaagtcacat

SEQ ID NO: 220349 - DNA, 20 bp, human
gcagagaggagaggacaacc

SEQ ID NO: 220350 - DNA, 20 bp, human
gtatcttcatcaattgaaga

SEQ ID NO: 220351 - DNA, 20 bp, human
gtgtctttcaaactgtcgga

SEQ ID NO: 220352 - DNA, 20 bp, human
gcaggaaaggagaataccct

SEQ ID NO: 220353 - DNA, 20 bp, human
gttatctccagaccaccccg

SEQ ID NO: 220354 - DNA, 20 bp, human
gaagacggacttgctaattc

SEQ ID NO: 220355 - DNA, 20 bp, human
gtgcccatgttgacagaaga

SEQ ID NO: 220356 - DNA, 20 bp, human
ggtatgaggagggtgttcta

SEQ ID NO: 220357 - DNA, 20 bp, human
ggggccccttctctggaaag

SEQ ID NO: 220358 - DNA, 20 bp, human
gcaaaggccaggtatgagga

SEQ ID NO: 220359 - DNA, 20 bp, human
gcggaaggccagttcatgtt

SEQ ID NO: 220360 - DNA, 20 bp, human
gtggccactccgcccccaga

SEQ ID NO: 220361 - DNA, 20 bp, human
gggggaccgatgctcatgtg

SEQ ID NO: 220362 - DNA, 20 bp, human
gtccggttgggccccttctc

SEQ ID NO: 220363 - DNA, 20 bp, human
gctctggaggcctaaggaag

SEQ ID NO: 220364 - DNA, 20 bp, human
gaaacttggccctctggggg

SEQ ID NO: 220365 - DNA, 20 bp, human
ggttctaggggagggaggac

SEQ ID NO: 220366 - DNA, 20 bp, human
gcttcgtggaagtcacgtgg

SEQ ID NO: 220367 - DNA, 20 bp, human
gcccgggcgtcgcctcgcgt

SEQ ID NO: 220368 - DNA, 20 bp, human
gtgggcttcgcgttccctcc

SEQ ID NO: 220369 - DNA, 20 bp, human
ggggcgccggcggaaagccg

SEQ ID NO: 220370 - DNA, 20 bp, human
gcagaggaggaaacgaggcg

SEQ ID NO: 220371 - DNA, 20 bp, human
ggggagagcgggaagcctga

SEQ ID NO: 220372 - DNA, 20 bp, human
ggggcggggcagacgtggga

SEQ ID NO: 220373 - DNA, 20 bp, human
gtgcccgtggggctgcctac

SEQ ID NO: 220374 - DNA, 20 bp, human
gcgcccgtaggcagccccac

SEQ ID NO: 220375 - DNA, 20 bp, human
gaggctgcatggcgcccccc

SEQ ID NO: 220376 - DNA, 20 bp, human
gcctgcctcgctccctcggg

SEQ ID NO: 220377 - DNA, 20 bp, human
gtggacggacggctgttgga

SEQ ID NO: 220378 - DNA, 20 bp, human
gagagctgcgattggacgga

SEQ ID NO: 220379 - DNA, 20 bp, human
gacgggaccaaacctcccga

SEQ ID NO: 220380 - DNA, 20 bp, human
gcgccactgctggcacttat

SEQ ID NO: 220381 - DNA, 20 bp, human
ggggcagcggccattttgcg

SEQ ID NO: 220382 - DNA, 20 bp, human
gtgaacgtgcgtccttcacg

SEQ ID NO: 220383 - DNA, 20 bp, human
gtcattggacagtcacgtga

SEQ ID NO: 220384 - DNA, 20 bp, human
gacgtggccgccccgcaaaa

SEQ ID NO: 220385 - DNA, 20 bp, human
gcttatcgggagatgctcat

SEQ ID NO: 220386 - DNA, 20 bp, human
gaagagacagcggagagcct

SEQ ID NO: 220387 - DNA, 20 bp, human
gtacagcctgtcactgatac

SEQ ID NO: 220388 - DNA, 20 bp, human
ggcttctgaatcttcacgag

SEQ ID NO: 220389 - DNA, 20 bp, human
gcatcgagtagccaataaaa

SEQ ID NO: 220390 - DNA, 20 bp, human
gctcgcttctacctttttat

SEQ ID NO: 220391 - DNA, 20 bp, human
gtggctgataatctcaaaca

SEQ ID NO: 220392 - DNA, 20 bp, human
gaaagtaaagccttcaagtc

SEQ ID NO: 220393 - DNA, 20 bp, human
gtgactacacgatgggaaaa

SEQ ID NO: 220394 - DNA, 20 bp, human
ggcgctttccctagatcttt

SEQ ID NO: 220395 - DNA, 20 bp, human
gagactcttgactacacgat

SEQ ID NO: 220396 - DNA, 20 bp, human
gtaggcgtgcgggcctccga

SEQ ID NO: 220397 - DNA, 20 bp, human
gttatgtaagcgcccgtgat

SEQ ID NO: 220398 - DNA, 20 bp, human
gtgggttgcagcgcactaga

SEQ ID NO: 220399 - DNA, 20 bp, human
ggcaacccaactacgcgaca

SEQ ID NO: 220400 - DNA, 20 bp, human
gggcagtctgaagaggtgaa

SEQ ID NO: 220401 - DNA, 20 bp, human
gcaactacgcgacaggggca

SEQ ID NO: 220402 - DNA, 20 bp, human
gactagagggcagtctgaag

SEQ ID NO: 220403 - DNA, 20 bp, human
gcggtggcgaatgctccaat

SEQ ID NO: 220404 - DNA, 20 bp, human
gaggcccgcacgcctatcac

SEQ ID NO: 220405 - DNA, 20 bp, human
gtatatgcgaggggcttctc

SEQ ID NO: 220406 - DNA, 20 bp, human
gcggcgctaggacccaggtc

SEQ ID NO: 220407 - DNA, 20 bp, human
gaggtccgggtcggaaagat

SEQ ID NO: 220408 - DNA, 20 bp, human
ggctgtgcctcctgcaactc

SEQ ID NO: 220409 - DNA, 20 bp, human
gctaggacccaggtccgggt

SEQ ID NO: 220410 - DNA, 20 bp, human
gccactgcctccatgagatg

SEQ ID NO: 220411 - DNA, 20 bp, human
ggcgtggggagactctctcc

SEQ ID NO: 220412 - DNA, 20 bp, human
gcacagcggcgctaggaccc

SEQ ID NO: 220413 - DNA, 20 bp, human
gcaggtgccacttctctaac

SEQ ID NO: 220414 - DNA, 20 bp, human
gccgggtcggaaagatgggc

SEQ ID NO: 220415 - DNA, 20 bp, human
ggctggtaggggtaagagtc

SEQ ID NO: 220416 - DNA, 20 bp, human
gcagaccaggagaaatatgg

SEQ ID NO: 220417 - DNA, 20 bp, human
ggaaggacgtgaacatgttg

SEQ ID NO: 220418 - DNA, 20 bp, human
gctgctgccaaggacgtcac

SEQ ID NO: 220419 - DNA, 20 bp, human
ggtagaagaggccggcaaag

SEQ ID NO: 220420 - DNA, 20 bp, human
gtggggaaatgctgagttat

SEQ ID NO: 220421 - DNA, 20 bp, human
gagctgtgttgacactccag

SEQ ID NO: 220422 - DNA, 20 bp, human
ggtccctgtgtgacagactg

SEQ ID NO: 220423 - DNA, 20 bp, human
gggaagggcggggctttctc

SEQ ID NO: 220424 - DNA, 20 bp, human
gacgtgaacatgttggggga

SEQ ID NO: 220425 - DNA, 20 bp, human
gcctgtgtgacagactgggg

SEQ ID NO: 220426 - DNA, 20 bp, human
ggcggccggcacaaaggcgg

SEQ ID NO: 220427 - DNA, 20 bp, human
gtccctgccggggtagtttc

SEQ ID NO: 220428 - DNA, 20 bp, human
ggcagctcgtcagtccgaca

SEQ ID NO: 220429 - DNA, 20 bp, human
ggggagcagcggatattccg

SEQ ID NO: 220430 - DNA, 20 bp, human
gagggcggccggcacaaagg

SEQ ID NO: 220431 - DNA, 20 bp, human
gaagaagcaaccccctccct

SEQ ID NO: 220432 - DNA, 20 bp, human
gtgagcgctggaagccgaag

SEQ ID NO: 220433 - DNA, 20 bp, human
gagggggcggaggcaaaaaa

SEQ ID NO: 220434 - DNA, 20 bp, human
gaaggctggggtggttctcg

SEQ ID NO: 220435 - DNA, 20 bp, human
gcggagaaggagggagtcga

SEQ ID NO: 220436 - DNA, 20 bp, human
gggggagatcgcccagacac

SEQ ID NO: 220437 - DNA, 20 bp, human
gaacccccggcgcggaggta

SEQ ID NO: 220438 - DNA, 20 bp, human
gccccggcgcggaggtaggg

SEQ ID NO: 220439 - DNA, 20 bp, human
ggcgctgtgcggcggggtgt

SEQ ID NO: 220440 - DNA, 20 bp, human
gcccccccctacctccgcgc

SEQ ID NO: 220441 - DNA, 20 bp, human
gcggggcagggcctagccca

SEQ ID NO: 220442 - DNA, 20 bp, human
gggacccaggcgctgtgcgg

SEQ ID NO: 220443 - DNA, 20 bp, human
gaggccgcccggcggatccc

SEQ ID NO: 220444 - DNA, 20 bp, human
gcggggccgtagcgtcacgc

SEQ ID NO: 220445 - DNA, 20 bp, human
gagtcctgacttgtccgcgg

SEQ ID NO: 220446 - DNA, 20 bp, human
gctagccagaggcgcccagt

SEQ ID NO: 220447 - DNA, 20 bp, human
gagacggcgtagaggaactg

SEQ ID NO: 220448 - DNA, 20 bp, human
gtgggcgggagacggcgtag

SEQ ID NO: 220449 - DNA, 20 bp, human
ggcgcccagtgggcgggaga

SEQ ID NO: 220450 - DNA, 20 bp, human
gacagagtaagcctccagca

SEQ ID NO: 220451 - DNA, 20 bp, human
gtgggcgcctctggctagcc

SEQ ID NO: 220452 - DNA, 20 bp, human
gagtgacgggcccacggcag

SEQ ID NO: 220453 - DNA, 20 bp, human
ggcactgcccgtctctgatt

SEQ ID NO: 220454 - DNA, 20 bp, human
ggcgtagaggaactgaggaa

SEQ ID NO: 220455 - DNA, 20 bp, human
gaagctgcccaatcagagac

SEQ ID NO: 220456 - DNA, 20 bp, human
gactcagctgtcagagtctg

SEQ ID NO: 220457 - DNA, 20 bp, human
gacagctgagtgaatagcag

SEQ ID NO: 220458 - DNA, 20 bp, human
ggggatgtaagtgctgagtc

SEQ ID NO: 220459 - DNA, 20 bp, human
gcaccagttaaaataggaca

SEQ ID NO: 220460 - DNA, 20 bp, human
ggaagtgttcacactctcag

SEQ ID NO: 220461 - DNA, 20 bp, human
ggacgctgggacctttgttc

SEQ ID NO: 220462 - DNA, 20 bp, human
gagagtgtgaacacttcaag

SEQ ID NO: 220463 - DNA, 20 bp, human
gattaaagtgcatatgtcat

SEQ ID NO: 220464 - DNA, 20 bp, human
gcggtttgacttattgacgc

SEQ ID NO: 220465 - DNA, 20 bp, human
gggcagataagatctaaact

SEQ ID NO: 220466 - DNA, 20 bp, human
gaaggtgtagcaactactga

SEQ ID NO: 220467 - DNA, 20 bp, human
gactactgaagggagcttgg

SEQ ID NO: 220468 - DNA, 20 bp, human
gccagcgctcaccctagcag

SEQ ID NO: 220469 - DNA, 20 bp, human
gcagctgaggtttgtaaatg

SEQ ID NO: 220470 - DNA, 20 bp, human
gagggcagaggcattgagat

SEQ ID NO: 220471 - DNA, 20 bp, human
ggcaaagcattgcctcagtt

SEQ ID NO: 220472 - DNA, 20 bp, human
ggcaactactgaagggagct

SEQ ID NO: 220473 - DNA, 20 bp, human
gaatgctttgcattgagtcc

SEQ ID NO: 220474 - DNA, 20 bp, human
gtaccacttcacctctgcta

SEQ ID NO: 220475 - DNA, 20 bp, human
ggaggctttatggcctagag

SEQ ID NO: 220476 - DNA, 20 bp, human
gtggaagccagagggctctg

SEQ ID NO: 220477 - DNA, 20 bp, human
gcaggctcaggaggacgcgc

SEQ ID NO: 220478 - DNA, 20 bp, human
gcagggaagggcgagtacaa

SEQ ID NO: 220479 - DNA, 20 bp, human
ggcgccaagctttcccaccc

SEQ ID NO: 220480 - DNA, 20 bp, human
gaaggtggctctgactggga

SEQ ID NO: 220481 - DNA, 20 bp, human
gcccaatagtgcccgagcac

SEQ ID NO: 220482 - DNA, 20 bp, human
ggagacagattcctcaaccc

SEQ ID NO: 220483 - DNA, 20 bp, human
gactattgggcgttacgcga

SEQ ID NO: 220484 - DNA, 20 bp, human
ggtctgggtcctacaatctc

SEQ ID NO: 220485 - DNA, 20 bp, human
ggggcgagtacaaaggttcc

SEQ ID NO: 220486 - DNA, 20 bp, human
gaataggcggggagaaaacc

SEQ ID NO: 220487 - DNA, 20 bp, human
ggtaaggagagcaactcgtg

SEQ ID NO: 220488 - DNA, 20 bp, human
ggaacggccggaaacggaat

SEQ ID NO: 220489 - DNA, 20 bp, human
gccaagaagccgtgctaccc

SEQ ID NO: 220490 - DNA, 20 bp, human
gagtcgaagccggggtagca

SEQ ID NO: 220491 - DNA, 20 bp, human
gcccacctggcaaagctgca

SEQ ID NO: 220492 - DNA, 20 bp, human
ggtagcacggcttcttggtt

SEQ ID NO: 220493 - DNA, 20 bp, human
ggccgaccgaaaacaggggt

SEQ ID NO: 220494 - DNA, 20 bp, human
gctaccccggcttcgactcc

SEQ ID NO: 220495 - DNA, 20 bp, human
gagggagatgaattcaccta

SEQ ID NO: 220496 - DNA, 20 bp, human
ggggacgtcacgctattggt

SEQ ID NO: 220497 - DNA, 20 bp, human
gaggtgacgccgggaggtcc

SEQ ID NO: 220498 - DNA, 20 bp, human
gggcggggacgtcacgctat

SEQ ID NO: 220499 - DNA, 20 bp, human
gaactggatgtcaataactc

SEQ ID NO: 220500 - DNA, 20 bp, human
gtcaataactcaggctgggt

SEQ ID NO: 220501 - DNA, 20 bp, human
gcagtgagctgtgaagactt

SEQ ID NO: 220502 - DNA, 20 bp, human
ggagctgtgaagacttgggt

SEQ ID NO: 220503 - DNA, 20 bp, human
gaaactgcggacggggaact

SEQ ID NO: 220504 - DNA, 20 bp, human
gagaagttccgcttaacgcc

SEQ ID NO: 220505 - DNA, 20 bp, human
gtgaagacttgggttgggcg

SEQ ID NO: 220506 - DNA, 20 bp, human
ggcgcagtggaacccctgct

SEQ ID NO: 220507 - DNA, 20 bp, human
gcgcacccgcggcccagcag

SEQ ID NO: 220508 - DNA, 20 bp, human
gtggaacccctgctgggccg

SEQ ID NO: 220509 - DNA, 20 bp, human
ggacccgtccgctctttttg

SEQ ID NO: 220510 - DNA, 20 bp, human
gcagccgcaaaaagagcgga

SEQ ID NO: 220511 - DNA, 20 bp, human
gtccactgcgcagccacaga

SEQ ID NO: 220512 - DNA, 20 bp, human
ggctagaaggggaagcctct

SEQ ID NO: 220513 - DNA, 20 bp, human
gcgaacgtgagtctaaggat

SEQ ID NO: 220514 - DNA, 20 bp, human
gtagaccgaacgtgagtcta

SEQ ID NO: 220515 - DNA, 20 bp, human
gcttggatgtggtgctagaa

SEQ ID NO: 220516 - DNA, 20 bp, human
gcctctgaaagagtcgggga

SEQ ID NO: 220517 - DNA, 20 bp, human
ggaggcaagcggaagtcgta

SEQ ID NO: 220518 - DNA, 20 bp, human
gggaagtcgtagggctgtgg

SEQ ID NO: 220519 - DNA, 20 bp, human
gagcggaagtcgtagggctg

SEQ ID NO: 220520 - DNA, 20 bp, human
gggaatcagggggaggatta

SEQ ID NO: 220521 - DNA, 20 bp, human
gccacggcgaggggtgttag

SEQ ID NO: 220522 - DNA, 20 bp, human
ggaggactgtgaggaagcgg

SEQ ID NO: 220523 - DNA, 20 bp, human
gcgagtgacctaaggaatca

SEQ ID NO: 220524 - DNA, 20 bp, human
ggtaaggtggcgggagaact

SEQ ID NO: 220525 - DNA, 20 bp, human
gactgtgaggaagcggggga

SEQ ID NO: 220526 - DNA, 20 bp, human
gaggtcaggcacgctcccct

SEQ ID NO: 220527 - DNA, 20 bp, human
gcctgcctcgcatctcaaat

SEQ ID NO: 220528 - DNA, 20 bp, human
gtccccttggcggacacagc

SEQ ID NO: 220529 - DNA, 20 bp, human
gcgacgcgcgcgcactctcg

SEQ ID NO: 220530 - DNA, 20 bp, human
ggcccagctgtgtccgccaa

SEQ ID NO: 220531 - DNA, 20 bp, human
ggagatgcgaggcaggattt

SEQ ID NO: 220532 - DNA, 20 bp, human
gagaggggtaaaatggctaa

SEQ ID NO: 220533 - DNA, 20 bp, human
ggcctctgtcacgacgtcta

SEQ ID NO: 220534 - DNA, 20 bp, human
ggggagcgtgcctgacctct

SEQ ID NO: 220535 - DNA, 20 bp, human
gttaacgacgcgaaagagct

SEQ ID NO: 220536 - DNA, 20 bp, human
ggacagcgtgttccaatcag

SEQ ID NO: 220537 - DNA, 20 bp, human
gggagccaagactgcgtctg

SEQ ID NO: 220538 - DNA, 20 bp, human
gaggtccgggagacccatac

SEQ ID NO: 220539 - DNA, 20 bp, human
gccgggagacccatacaggg

SEQ ID NO: 220540 - DNA, 20 bp, human
ggaacaaaagaggcgaggtc

SEQ ID NO: 220541 - DNA, 20 bp, human
ggggcggtgcttcgggaaag

SEQ ID NO: 220542 - DNA, 20 bp, human
gtgtggaaaccgccctgtat

SEQ ID NO: 220543 - DNA, 20 bp, human
gctgcacaggcggggcgaca

SEQ ID NO: 220544 - DNA, 20 bp, human
ggattggaacacgctgtcag

SEQ ID NO: 220545 - DNA, 20 bp, human
gtgtcagtgggcggtgcttc

SEQ ID NO: 220546 - DNA, 20 bp, human
gcacacgcaccgaggggaga

SEQ ID NO: 220547 - DNA, 20 bp, human
gcgtgccgcgccgacttctg

SEQ ID NO: 220548 - DNA, 20 bp, human
gcggggaccgacttctgaga

SEQ ID NO: 220549 - DNA, 20 bp, human
gaggctgaggcgcaaaggcg

SEQ ID NO: 220550 - DNA, 20 bp, human
gaggaggagggtcttcctta

SEQ ID NO: 220551 - DNA, 20 bp, human
gcagagaggctgaggcgcaa

SEQ ID NO: 220552 - DNA, 20 bp, human
gccctcggtgcgtgtgggtg

SEQ ID NO: 220553 - DNA, 20 bp, human
gtcctggcagcagttcctta

SEQ ID NO: 220554 - DNA, 20 bp, human
gagtgggggcggggcgtcac

SEQ ID NO: 220555 - DNA, 20 bp, human
ggactccagcccccagaagt

SEQ ID NO: 220556 - DNA, 20 bp, human
gtcttccatggggcaccaaa

SEQ ID NO: 220557 - DNA, 20 bp, human
gttcgggacctgtagacagt

SEQ ID NO: 220558 - DNA, 20 bp, human
gggcccgcgcagtgacggac

SEQ ID NO: 220559 - DNA, 20 bp, human
gggcctgtccgtcactgcgc

SEQ ID NO: 220560 - DNA, 20 bp, human
ggggttgcatgtactgtatg

SEQ ID NO: 220561 - DNA, 20 bp, human
ggcagtgtacagtgaagcgg

SEQ ID NO: 220562 - DNA, 20 bp, human
gccactggatatggaagtga

SEQ ID NO: 220563 - DNA, 20 bp, human
gtgcgtgtgtttgggtgtaa

SEQ ID NO: 220564 - DNA, 20 bp, human
gcactgcgcgggccaatggc

SEQ ID NO: 220565 - DNA, 20 bp, human
gaagttgcaaggcttgaaac

SEQ ID NO: 220566 - DNA, 20 bp, human
gcccaagcctagagctgtcc

SEQ ID NO: 220567 - DNA, 20 bp, human
gcctcccagtgcacggggcc

SEQ ID NO: 220568 - DNA, 20 bp, human
gccccgcgcccgggcatcgg

SEQ ID NO: 220569 - DNA, 20 bp, human
gtgcactgggaggtccgctc

SEQ ID NO: 220570 - DNA, 20 bp, human
gagtgcacggggccaggctc

SEQ ID NO: 220571 - DNA, 20 bp, human
gcccgggcatcgggggacga

SEQ ID NO: 220572 - DNA, 20 bp, human
gtggccccgcgcccgggcat

SEQ ID NO: 220573 - DNA, 20 bp, human
ggcccctggtcagaataacg

SEQ ID NO: 220574 - DNA, 20 bp, human
gagtaagcccggacagctct

SEQ ID NO: 220575 - DNA, 20 bp, human
gtcccccgatgcccgggcgc

SEQ ID NO: 220576 - DNA, 20 bp, human
gtcagcggatgagaagccga

SEQ ID NO: 220577 - DNA, 20 bp, human
ggggctctcgggacggtcac

SEQ ID NO: 220578 - DNA, 20 bp, human
ggaagtaggacatcgttcag

SEQ ID NO: 220579 - DNA, 20 bp, human
gccgcccccgccccctggtc

SEQ ID NO: 220580 - DNA, 20 bp, human
ggagccccgcgctcccgacc

SEQ ID NO: 220581 - DNA, 20 bp, human
gccccctggtcgggagcgcg

SEQ ID NO: 220582 - DNA, 20 bp, human
ggccttctctgcttcggctc

SEQ ID NO: 220583 - DNA, 20 bp, human
ggccgcaggacattcggaag

SEQ ID NO: 220584 - DNA, 20 bp, human
ggctcccgaccagggggcgg

SEQ ID NO: 220585 - DNA, 20 bp, human
gtcgggagcgcggggctctc

SEQ ID NO: 220586 - DNA, 20 bp, human
gcccgcccgcgggtccgtcc

SEQ ID NO: 220587 - DNA, 20 bp, human
ggcggcgcgaccacgtttat

SEQ ID NO: 220588 - DNA, 20 bp, human
gcgcgggtccgtcccggctg

SEQ ID NO: 220589 - DNA, 20 bp, human
gggggtccaggtctaaggag

SEQ ID NO: 220590 - DNA, 20 bp, human
gcggcgccgctccttagacc

SEQ ID NO: 220591 - DNA, 20 bp, human
gagagagtaggtgaccggaa

SEQ ID NO: 220592 - DNA, 20 bp, human
gcgggagcctgcggggcgtg

SEQ ID NO: 220593 - DNA, 20 bp, human
ggagcctgcggggcgtgagg

SEQ ID NO: 220594 - DNA, 20 bp, human
gcgttcccgttcccgtccat

SEQ ID NO: 220595 - DNA, 20 bp, human
gccggggccgcacttagcag

SEQ ID NO: 220596 - DNA, 20 bp, human
ggcgccggccctccgctccg

SEQ ID NO: 220597 - DNA, 20 bp, human
ggggcgagaacgggaggtgg

SEQ ID NO: 220598 - DNA, 20 bp, human
ggagcctccggggcctcgcg

SEQ ID NO: 220599 - DNA, 20 bp, human
ggagggccggcgctccgagc

SEQ ID NO: 220600 - DNA, 20 bp, human
gccgccgaggggcgagaaca

SEQ ID NO: 220601 - DNA, 20 bp, human
ggggcctgcacgttgactgt

SEQ ID NO: 220602 - DNA, 20 bp, human
ggccgcgcggactagagaag

SEQ ID NO: 220603 - DNA, 20 bp, human
gctccccggcccatcgacga

SEQ ID NO: 220604 - DNA, 20 bp, human
gccgccccggagcggagggc

SEQ ID NO: 220605 - DNA, 20 bp, human
gttccccaggggcgagtcgg

SEQ ID NO: 220606 - DNA, 20 bp, human
gcgcccgcgcccccgacagg

SEQ ID NO: 220607 - DNA, 20 bp, human
gcaaataagccgcctgtcgg

SEQ ID NO: 220608 - DNA, 20 bp, human
ggacagaagcccgcccagta

SEQ ID NO: 220609 - DNA, 20 bp, human
gaggccaggcttccagccta

SEQ ID NO: 220610 - DNA, 20 bp, human
gtggaagcctggcctcgggc

SEQ ID NO: 220611 - DNA, 20 bp, human
gggggcggcccctactgggc

SEQ ID NO: 220612 - DNA, 20 bp, human
ggagagcggcggcggccaat

SEQ ID NO: 220613 - DNA, 20 bp, human
ggcggggggcggcccctact

SEQ ID NO: 220614 - DNA, 20 bp, human
ggacacgcgatgaatgccct

SEQ ID NO: 220615 - DNA, 20 bp, human
gaactcctccacttctggga

SEQ ID NO: 220616 - DNA, 20 bp, human
gccacagggcagtgtagtgt

SEQ ID NO: 220617 - DNA, 20 bp, human
ggcgagggatcggcgaggag

SEQ ID NO: 220618 - DNA, 20 bp, human
ggaggtggcccgcgagggat

SEQ ID NO: 220619 - DNA, 20 bp, human
gggcccgcgagggatcggcg

SEQ ID NO: 220620 - DNA, 20 bp, human
ggactggaggtggcccgcga

SEQ ID NO: 220621 - DNA, 20 bp, human
ggctcctaggccctgtgtcc

SEQ ID NO: 220622 - DNA, 20 bp, human
ggcggccagggacgcgttaa

SEQ ID NO: 220623 - DNA, 20 bp, human
ggcgttgggccgacagaaaa

SEQ ID NO: 220624 - DNA, 20 bp, human
gagaaaaaggcctaggtccg

SEQ ID NO: 220625 - DNA, 20 bp, human
ggacccagagctggtgcgac

SEQ ID NO: 220626 - DNA, 20 bp, human
gggaaggagtggattcgacg

SEQ ID NO: 220627 - DNA, 20 bp, human
gctaaaatccgggcagagga

SEQ ID NO: 220628 - DNA, 20 bp, human
gacttgaggactggctcctt

SEQ ID NO: 220629 - DNA, 20 bp, human
gtcgagctatacttgaggac

SEQ ID NO: 220630 - DNA, 20 bp, human
gcgaatcggctcgccggggt

SEQ ID NO: 220631 - DNA, 20 bp, human
gagtgatcgagctatacttg

SEQ ID NO: 220632 - DNA, 20 bp, human
gtccgcaaggcagcgcgaat

SEQ ID NO: 220633 - DNA, 20 bp, human
ggccctcaactggtgatttg

SEQ ID NO: 220634 - DNA, 20 bp, human
ggattcgacgaggctgtctc

SEQ ID NO: 220635 - DNA, 20 bp, human
gggctggctttcaatgtgaa

SEQ ID NO: 220636 - DNA, 20 bp, human
ggggtcgccgaccttgttga

SEQ ID NO: 220637 - DNA, 20 bp, human
gagcctgcggctggcgtttg

SEQ ID NO: 220638 - DNA, 20 bp, human
gcggggagaccgagagcctg

SEQ ID NO: 220639 - DNA, 20 bp, human
ggctgggcccggaccgtgaa

SEQ ID NO: 220640 - DNA, 20 bp, human
gcccggaccgtgaaggggac

SEQ ID NO: 220641 - DNA, 20 bp, human
gtccgacggtcccacctggt

SEQ ID NO: 220642 - DNA, 20 bp, human
gcggccgcccttggctcaac

SEQ ID NO: 220643 - DNA, 20 bp, human
gcgtgaaggggaccgggttg

SEQ ID NO: 220644 - DNA, 20 bp, human
ggccctcacaccgaccaggt

SEQ ID NO: 220645 - DNA, 20 bp, human
gaggtgggaccgtcggactg

SEQ ID NO: 220646 - DNA, 20 bp, human
gcggcagcctcagtaggtga

SEQ ID NO: 220647 - DNA, 20 bp, human
ggcactgggtagaatacttg

SEQ ID NO: 220648 - DNA, 20 bp, human
gtcaacccggcagcctcagt

SEQ ID NO: 220649 - DNA, 20 bp, human
gaggctgccgggttgacctg

SEQ ID NO: 220650 - DNA, 20 bp, human
gcaggatggtccggggagaa

SEQ ID NO: 220651 - DNA, 20 bp, human
gcattaatgcgagaggagtc

SEQ ID NO: 220652 - DNA, 20 bp, human
gtcagtaggtgaggggcact

SEQ ID NO: 220653 - DNA, 20 bp, human
ggtaggtcatggtcagagca

SEQ ID NO: 220654 - DNA, 20 bp, human
gagggaggcattaatgcgag

SEQ ID NO: 220655 - DNA, 20 bp, human
gtggctgaatacacagagca

SEQ ID NO: 220656 - DNA, 20 bp, human
gaaaaaggggcagtaagcag

SEQ ID NO: 220657 - DNA, 20 bp, human
gcggacgtgacgtaacgtct

SEQ ID NO: 220658 - DNA, 20 bp, human
gtatctagaaattgccgggc

SEQ ID NO: 220659 - DNA, 20 bp, human
ggcactaacgtcaatacgga

SEQ ID NO: 220660 - DNA, 20 bp, human
gcagttgctaattttgaagg

SEQ ID NO: 220661 - DNA, 20 bp, human
gcgggctggtttgttttggg

SEQ ID NO: 220662 - DNA, 20 bp, human
ggctcagttgctaattttga

SEQ ID NO: 220663 - DNA, 20 bp, human
gaatggcggcgatttgaagt

SEQ ID NO: 220664 - DNA, 20 bp, human
gcccggtatctagaaattgc

SEQ ID NO: 220665 - DNA, 20 bp, human
gtcaaatcgccgccattcgc

SEQ ID NO: 220666 - DNA, 20 bp, human
gcaaccagcaagtaggaaag

SEQ ID NO: 220667 - DNA, 20 bp, human
gccctccagccccagcggat

SEQ ID NO: 220668 - DNA, 20 bp, human
gtgaatgtgtccaatccgct

SEQ ID NO: 220669 - DNA, 20 bp, human
gtatggccgggcaccgccct

SEQ ID NO: 220670 - DNA, 20 bp, human
gcgggtgaagccgaggtgtc

SEQ ID NO: 220671 - DNA, 20 bp, human
gcggattggacacattcaga

SEQ ID NO: 220672 - DNA, 20 bp, human
gcccagaagcaaaccggcta

SEQ ID NO: 220673 - DNA, 20 bp, human
gaaggtaaacacatcgccaa

SEQ ID NO: 220674 - DNA, 20 bp, human
gcgaagctgacctccaaggg

SEQ ID NO: 220675 - DNA, 20 bp, human
gccggcgatcagccgaggag

SEQ ID NO: 220676 - DNA, 20 bp, human
gcgcgccgctcgccactggg

SEQ ID NO: 220677 - DNA, 20 bp, human
gtgatgcccaggtgctgcgg

SEQ ID NO: 220678 - DNA, 20 bp, human
gagcgcgcgccgctcgccac

SEQ ID NO: 220679 - DNA, 20 bp, human
gcccgcggaccgcctggcgg

SEQ ID NO: 220680 - DNA, 20 bp, human
gcggtccgcggggcatgcag

SEQ ID NO: 220681 - DNA, 20 bp, human
ggaggcccgggcgcaaccac

SEQ ID NO: 220682 - DNA, 20 bp, human
gtgccccgcggaccgcctgg

SEQ ID NO: 220683 - DNA, 20 bp, human
gggagcccgtggttgcgccc

SEQ ID NO: 220684 - DNA, 20 bp, human
gaccgggattccgatgggga

SEQ ID NO: 220685 - DNA, 20 bp, human
gcggtccgctgcatgccccg

SEQ ID NO: 220686 - DNA, 20 bp, human
gcatcagcaggaagacacta

SEQ ID NO: 220687 - DNA, 20 bp, human
gcccccaggccgcccccaga

SEQ ID NO: 220688 - DNA, 20 bp, human
ggcggagactcgcgacctag

SEQ ID NO: 220689 - DNA, 20 bp, human
gctcggatacgcacccacag

SEQ ID NO: 220690 - DNA, 20 bp, human
gcctgctgatgcaatccgct

SEQ ID NO: 220691 - DNA, 20 bp, human
gtgggtgcgtatccgagtgt

SEQ ID NO: 220692 - DNA, 20 bp, human
gggagagactccaccatctg

SEQ ID NO: 220693 - DNA, 20 bp, human
gacccccgaatcagccactg

SEQ ID NO: 220694 - DNA, 20 bp, human
gggcgctggctccgaatctt

SEQ ID NO: 220695 - DNA, 20 bp, human
gtggctccgaatcttcgggc

SEQ ID NO: 220696 - DNA, 20 bp, human
gtgcgccccgcagcagtgtc

SEQ ID NO: 220697 - DNA, 20 bp, human
gcggtccctgccaggcgaag

SEQ ID NO: 220698 - DNA, 20 bp, human
gtggccggaacgtctctctt

SEQ ID NO: 220699 - DNA, 20 bp, human
gccaggccgtcccagctcca

SEQ ID NO: 220700 - DNA, 20 bp, human
ggctccgaagagagacgttc

SEQ ID NO: 220701 - DNA, 20 bp, human
gccagctccagggcgtcggc

SEQ ID NO: 220702 - DNA, 20 bp, human
gggagccggacactgctgcg

SEQ ID NO: 220703 - DNA, 20 bp, human
gcccgctcacgcctccttct

SEQ ID NO: 220704 - DNA, 20 bp, human
ggccgccttcccccagaagg

SEQ ID NO: 220705 - DNA, 20 bp, human
gcggctccctgccgacgccc

SEQ ID NO: 220706 - DNA, 20 bp, human
ggaatccagcaggggcattg

SEQ ID NO: 220707 - DNA, 20 bp, human
gggtccggaaggtcaggcaa

SEQ ID NO: 220708 - DNA, 20 bp, human
gaacctctggcctcattccg

SEQ ID NO: 220709 - DNA, 20 bp, human
gaaccactacgggaagggga

SEQ ID NO: 220710 - DNA, 20 bp, human
gcagcccatagtagccaagg

SEQ ID NO: 220711 - DNA, 20 bp, human
ggaccccgcacctcagactg

SEQ ID NO: 220712 - DNA, 20 bp, human
gcctcagactggggtcgcgt

SEQ ID NO: 220713 - DNA, 20 bp, human
gcagactggggtcgcgtggg

SEQ ID NO: 220714 - DNA, 20 bp, human
ggggttgaaccactacggga

SEQ ID NO: 220715 - DNA, 20 bp, human
gaagctggacgtgactgtaa

SEQ ID NO: 220716 - DNA, 20 bp, human
gcgcgtgcgtcgaacggcta

SEQ ID NO: 220717 - DNA, 20 bp, human
gccagcgcgcgtgcgtcgaa

SEQ ID NO: 220718 - DNA, 20 bp, human
gtggagccggcgagcgcctg

SEQ ID NO: 220719 - DNA, 20 bp, human
ggcgggtggctagaattctg

SEQ ID NO: 220720 - DNA, 20 bp, human
ggggaacctgctgtcggcgt

SEQ ID NO: 220721 - DNA, 20 bp, human
gaacctgctgtcggcgtggg

SEQ ID NO: 220722 - DNA, 20 bp, human
gtatacagcgagaggaaatc

SEQ ID NO: 220723 - DNA, 20 bp, human
ggaagccgggaacctgctgt

SEQ ID NO: 220724 - DNA, 20 bp, human
gccctcccagtgttgtgatg

SEQ ID NO: 220725 - DNA, 20 bp, human
ggggatgaaacaaactctga

SEQ ID NO: 220726 - DNA, 20 bp, human
gcaacttgaaatctgttcag

SEQ ID NO: 220727 - DNA, 20 bp, human
gtgacaaagctcgcgagagt

SEQ ID NO: 220728 - DNA, 20 bp, human
gtcagtgcagtccaatttac

SEQ ID NO: 220729 - DNA, 20 bp, human
ggcacagattgaagctataa

SEQ ID NO: 220730 - DNA, 20 bp, human
gtcatttacagaagtattac

SEQ ID NO: 220731 - DNA, 20 bp, human
gattcatgctttacaattgc

SEQ ID NO: 220732 - DNA, 20 bp, human
gcttagttctattaactgaa

SEQ ID NO: 220733 - DNA, 20 bp, human
ggtcatacaaatttcagcat

SEQ ID NO: 220734 - DNA, 20 bp, human
gtaaatcttaagacaagcat

SEQ ID NO: 220735 - DNA, 20 bp, human
gaaatctgttcagaggctaa

SEQ ID NO: 220736 - DNA, 20 bp, human
ggtaaagcggatcaatgcca

SEQ ID NO: 220737 - DNA, 20 bp, human
gcagtcccacctcctaactc

SEQ ID NO: 220738 - DNA, 20 bp, human
ggcaacgccattggacattt

SEQ ID NO: 220739 - DNA, 20 bp, human
gaagccacgtgcggacgccc

SEQ ID NO: 220740 - DNA, 20 bp, human
gcaacctgaccagggcctca

SEQ ID NO: 220741 - DNA, 20 bp, human
gccgggggcccagagtaaag

SEQ ID NO: 220742 - DNA, 20 bp, human
gactcacgtaggctagattc

SEQ ID NO: 220743 - DNA, 20 bp, human
gccctaaatccctgaggccc

SEQ ID NO: 220744 - DNA, 20 bp, human
gtacaggagtaactacaatg

SEQ ID NO: 220745 - DNA, 20 bp, human
ggttgccagagttaggaggt

SEQ ID NO: 220746 - DNA, 20 bp, human
gaaactggcaagccgaggtt

SEQ ID NO: 220747 - DNA, 20 bp, human
ggaaggccctggagaatccg

SEQ ID NO: 220748 - DNA, 20 bp, human
gtacatcattggttcattga

SEQ ID NO: 220749 - DNA, 20 bp, human
gagaaaaacccggagctgag

SEQ ID NO: 220750 - DNA, 20 bp, human
gataaacgattatgcctctt

SEQ ID NO: 220751 - DNA, 20 bp, human
gaatgtaaagcgtttaacac

SEQ ID NO: 220752 - DNA, 20 bp, human
gtattattgcgcaaagggga

SEQ ID NO: 220753 - DNA, 20 bp, human
gtaggcaatttacctaacct

SEQ ID NO: 220754 - DNA, 20 bp, human
gttattgtcctgtttcacgc

SEQ ID NO: 220755 - DNA, 20 bp, human
gttgtcctgtttcacgcggg

SEQ ID NO: 220756 - DNA, 20 bp, human
gggaaggcgacgtgacgagc

SEQ ID NO: 220757 - DNA, 20 bp, human
ggaactggaaatttaggggc

SEQ ID NO: 220758 - DNA, 20 bp, human
ggaaacagaccaatcggaac

SEQ ID NO: 220759 - DNA, 20 bp, human
gcttgtgcgcatgcggaaga

SEQ ID NO: 220760 - DNA, 20 bp, human
gaggtcggccgtgcggtcct

SEQ ID NO: 220761 - DNA, 20 bp, human
ggccgtgcggtcctcgggtg

SEQ ID NO: 220762 - DNA, 20 bp, human
ggaccgcacggccgacctcg

SEQ ID NO: 220763 - DNA, 20 bp, human
gtctgctccttgtgcgcatg

SEQ ID NO: 220764 - DNA, 20 bp, human
gcccgaggaggcttccacat

SEQ ID NO: 220765 - DNA, 20 bp, human
ggcgccaatgaaatagtttc

SEQ ID NO: 220766 - DNA, 20 bp, human
ggggcctccgcggactgagt

SEQ ID NO: 220767 - DNA, 20 bp, human
gagcctcgagagccgtgtgg

SEQ ID NO: 220768 - DNA, 20 bp, human
gggaggaagcggtgctgttt

SEQ ID NO: 220769 - DNA, 20 bp, human
gcccgggcgcccgcgcatcc

SEQ ID NO: 220770 - DNA, 20 bp, human
gtctgaggacgtgccgtccc

SEQ ID NO: 220771 - DNA, 20 bp, human
gtccgagaaggagtcaggta

SEQ ID NO: 220772 - DNA, 20 bp, human
ggtttggggtccgggagcaa

SEQ ID NO: 220773 - DNA, 20 bp, human
gcgcccacgcgacgtcacgg

SEQ ID NO: 220774 - DNA, 20 bp, human
gagggcgtggcctggatgcg

SEQ ID NO: 220775 - DNA, 20 bp, human
ggagagcctcgagagccgtg

SEQ ID NO: 220776 - DNA, 20 bp, human
gtgagcctctacgagaggga

SEQ ID NO: 220777 - DNA, 20 bp, human
gcgcctgagcctctacgaga

SEQ ID NO: 220778 - DNA, 20 bp, human
gcccgcgggctggcgtcgat

SEQ ID NO: 220779 - DNA, 20 bp, human
ggccccgcctctgaggtcga

SEQ ID NO: 220780 - DNA, 20 bp, human
ggtgggcggagccacccgaa

SEQ ID NO: 220781 - DNA, 20 bp, human
gaagcgacgcgcctcgccgt

SEQ ID NO: 220782 - DNA, 20 bp, human
ggggaacaggatcggcccgc

SEQ ID NO: 220783 - DNA, 20 bp, human
gcacccgaaaggctccggtc

SEQ ID NO: 220784 - DNA, 20 bp, human
gaggcgcaggcaccgcccca

SEQ ID NO: 220785 - DNA, 20 bp, human
gcactgacggaccccaccca

SEQ ID NO: 220786 - DNA, 20 bp, human
gccaatggccagtgcgggga

SEQ ID NO: 220787 - DNA, 20 bp, human
ggggccgcgtctggcgtccg

SEQ ID NO: 220788 - DNA, 20 bp, human
gcaccaatggacacacatca

SEQ ID NO: 220789 - DNA, 20 bp, human
gtgggtgtgcgtacggagga

SEQ ID NO: 220790 - DNA, 20 bp, human
gtgagctgcaagttcaagtg

SEQ ID NO: 220791 - DNA, 20 bp, human
gtggacatgaaaaagagacc

SEQ ID NO: 220792 - DNA, 20 bp, human
gaaggggaagctcacaccaa

SEQ ID NO: 220793 - DNA, 20 bp, human
gcaagccaatggccagtgcg

SEQ ID NO: 220794 - DNA, 20 bp, human
ggctccgcggacgccagacg

SEQ ID NO: 220795 - DNA, 20 bp, human
gtccccgcgtgtggacgcca

SEQ ID NO: 220796 - DNA, 20 bp, human
gcctgccaggtgaactggga

SEQ ID NO: 220797 - DNA, 20 bp, human
gggagctctcggtctctcta

SEQ ID NO: 220798 - DNA, 20 bp, human
gtctgcgcccgcaccgaccc

SEQ ID NO: 220799 - DNA, 20 bp, human
ggccagcctgccaggtgaac

SEQ ID NO: 220800 - DNA, 20 bp, human
gtgacccttccgaggctctg

SEQ ID NO: 220801 - DNA, 20 bp, human
gcagagagtcggagcactgg

SEQ ID NO: 220802 - DNA, 20 bp, human
gggctccttcccagttcacc

SEQ ID NO: 220803 - DNA, 20 bp, human
gcactgggggcgactagcgg

SEQ ID NO: 220804 - DNA, 20 bp, human
ggagcgctggggagcgctcg

SEQ ID NO: 220805 - DNA, 20 bp, human
gtcacctggcaggctggcgc

SEQ ID NO: 220806 - DNA, 20 bp, human
gtacgcacaggaaaccggtc

SEQ ID NO: 220807 - DNA, 20 bp, human
ggagtggcgcgtcccgccgg

SEQ ID NO: 220808 - DNA, 20 bp, human
gcggtcgggtggctcagagg

SEQ ID NO: 220809 - DNA, 20 bp, human
ggcgcctttaacccgggcca

SEQ ID NO: 220810 - DNA, 20 bp, human
gcccgcgcgccatgtgcccc

SEQ ID NO: 220811 - DNA, 20 bp, human
ggctccctggcccgggttaa

SEQ ID NO: 220812 - DNA, 20 bp, human
gcgcgccatgtgcccccggc

SEQ ID NO: 220813 - DNA, 20 bp, human
ggcccgggttaaaggcgccg

SEQ ID NO: 220814 - DNA, 20 bp, human
gcggccgcgtgcggttcccc

SEQ ID NO: 220815 - DNA, 20 bp, human
gaccgtgtgacgttacgcac

SEQ ID NO: 220816 - DNA, 20 bp, human
gcctacgcacgaaagtgact

SEQ ID NO: 220817 - DNA, 20 bp, human
ggacacatgatgatacatgg

SEQ ID NO: 220818 - DNA, 20 bp, human
gacgcacgaaagtgactagg

SEQ ID NO: 220819 - DNA, 20 bp, human
gctgaattaatcacaggatg

SEQ ID NO: 220820 - DNA, 20 bp, human
gaaactgccaacattttcac

SEQ ID NO: 220821 - DNA, 20 bp, human
gcatgatgatacatggaggc

SEQ ID NO: 220822 - DNA, 20 bp, human
gacaacccctgtgaaaatgt

SEQ ID NO: 220823 - DNA, 20 bp, human
ggatgatacatggaggctgg

SEQ ID NO: 220824 - DNA, 20 bp, human
gacttacatacgaatgtaca

SEQ ID NO: 220825 - DNA, 20 bp, human
ggcaaagctgaattaatcac

SEQ ID NO: 220826 - DNA, 20 bp, human
ggagcggccgccctcgatcc

SEQ ID NO: 220827 - DNA, 20 bp, human
ggggatgccggtaactcagc

SEQ ID NO: 220828 - DNA, 20 bp, human
ggacgcctccacctcaccct

SEQ ID NO: 220829 - DNA, 20 bp, human
gacctccgggagagtactcc

SEQ ID NO: 220830 - DNA, 20 bp, human
gactcctggctcccagtagg

SEQ ID NO: 220831 - DNA, 20 bp, human
gaaggggcgtgcaagagaga

SEQ ID NO: 220832 - DNA, 20 bp, human
gggagccaggagtactctcc

SEQ ID NO: 220833 - DNA, 20 bp, human
ggaggcgtccgaaaccctaa

SEQ ID NO: 220834 - DNA, 20 bp, human
gtaggaggcggagagccaag

SEQ ID NO: 220835 - DNA, 20 bp, human
gcaaaccagcggcatttgtt

SEQ ID NO: 220836 - DNA, 20 bp, human
gccccctcgcggtagatctg

SEQ ID NO: 220837 - DNA, 20 bp, human
gagtgactggcatcaggacc

SEQ ID NO: 220838 - DNA, 20 bp, human
ggggagagatcgccccctcg

SEQ ID NO: 220839 - DNA, 20 bp, human
gcgcgagcccgagacgcaaa

SEQ ID NO: 220840 - DNA, 20 bp, human
ggtagatctggggaatcggg

SEQ ID NO: 220841 - DNA, 20 bp, human
gagtgcgcgccttgagtgac

SEQ ID NO: 220842 - DNA, 20 bp, human
gactgacggacggatgaaat

SEQ ID NO: 220843 - DNA, 20 bp, human
gtccccagatctaccgcgag

SEQ ID NO: 220844 - DNA, 20 bp, human
gcgcactccctttgcgtctc

SEQ ID NO: 220845 - DNA, 20 bp, human
gcacaatagctcaacgagag

SEQ ID NO: 220846 - DNA, 20 bp, human
ggcgcagtaccccaggtagt

SEQ ID NO: 220847 - DNA, 20 bp, human
gcacggcagccctaccctgg

SEQ ID NO: 220848 - DNA, 20 bp, human
gccgcgcctcccccagggta

SEQ ID NO: 220849 - DNA, 20 bp, human
ggggccaagaaaaccagcga

SEQ ID NO: 220850 - DNA, 20 bp, human
gtcccgcagcgggtcggcca

SEQ ID NO: 220851 - DNA, 20 bp, human
gtagtcggccagcaacagct

SEQ ID NO: 220852 - DNA, 20 bp, human
gttgcgggagcgcaccacca

SEQ ID NO: 220853 - DNA, 20 bp, human
ggctcggtgcgctcccgcag

SEQ ID NO: 220854 - DNA, 20 bp, human
gaccaccaggccttgccttg

SEQ ID NO: 220855 - DNA, 20 bp, human
gcaccatggccgacccgctg

SEQ ID NO: 220856 - DNA, 20 bp, human
gccgagcctgcacgcgccgg

SEQ ID NO: 220857 - DNA, 20 bp, human
gctcggacaggtaaaggcgg

SEQ ID NO: 220858 - DNA, 20 bp, human
gtgcaggctcggacaggtaa

SEQ ID NO: 220859 - DNA, 20 bp, human
gcgcgcgggaggcaacccag

SEQ ID NO: 220860 - DNA, 20 bp, human
ggggaggctagggtacactt

SEQ ID NO: 220861 - DNA, 20 bp, human
gcgccggggcgggacctagc

SEQ ID NO: 220862 - DNA, 20 bp, human
gctcctacgcccaatcactg

SEQ ID NO: 220863 - DNA, 20 bp, human
gggcgtgcgcggcacagagg

SEQ ID NO: 220864 - DNA, 20 bp, human
gccgggttggggtaggtgag

SEQ ID NO: 220865 - DNA, 20 bp, human
ggctagggtacacttcgggg

SEQ ID NO: 220866 - DNA, 20 bp, human
gcgaccgcgcgcggaccaat

SEQ ID NO: 220867 - DNA, 20 bp, human
ggggtgcccgcgttcccaat

SEQ ID NO: 220868 - DNA, 20 bp, human
gagcggcgcggggaggtcgg

SEQ ID NO: 220869 - DNA, 20 bp, human
gggggcggcgcctacgggtc

SEQ ID NO: 220870 - DNA, 20 bp, human
gaggcggaggatgttcccgg

SEQ ID NO: 220871 - DNA, 20 bp, human
gttcccaattggtccgcgcg

SEQ ID NO: 220872 - DNA, 20 bp, human
gccaatcggcagccgcggtg

SEQ ID NO: 220873 - DNA, 20 bp, human
gcgcggaccaattgggaacg

SEQ ID NO: 220874 - DNA, 20 bp, human
ggcggctgccgcttcgtcgg

SEQ ID NO: 220875 - DNA, 20 bp, human
gtccccgcgccgctggcgcc

SEQ ID NO: 220876 - DNA, 20 bp, human
gtggccggaaacccaaaaaa

SEQ ID NO: 220877 - DNA, 20 bp, human
gaaacccaaaaaagggcata

SEQ ID NO: 220878 - DNA, 20 bp, human
gcggcccagcgtagaaaggg

SEQ ID NO: 220879 - DNA, 20 bp, human
gcgcccctatgccctttttt

SEQ ID NO: 220880 - DNA, 20 bp, human
ggacccaaaagccgatggga

SEQ ID NO: 220881 - DNA, 20 bp, human
ggaagagcccgggagagcgt

SEQ ID NO: 220882 - DNA, 20 bp, human
gggggcgggaacagcccagc

SEQ ID NO: 220883 - DNA, 20 bp, human
gaaccggcccagcgtagaaa

SEQ ID NO: 220884 - DNA, 20 bp, human
ggcccagcgggccgtcccat

SEQ ID NO: 220885 - DNA, 20 bp, human
gcgccccgaccttccatcgt

SEQ ID NO: 220886 - DNA, 20 bp, human
gctggacggagagacctccg

SEQ ID NO: 220887 - DNA, 20 bp, human
ggaggggttgggattctgac

SEQ ID NO: 220888 - DNA, 20 bp, human
gcggaaggaccgaccaacgg

SEQ ID NO: 220889 - DNA, 20 bp, human
ggaccgaccaacggaggccc

SEQ ID NO: 220890 - DNA, 20 bp, human
gagacctccggggcctccgt

SEQ ID NO: 220891 - DNA, 20 bp, human
ggagcggaaggaccgaccaa

SEQ ID NO: 220892 - DNA, 20 bp, human
ggtcgcaatcagatttgggc

SEQ ID NO: 220893 - DNA, 20 bp, human
gagatttgggcgggctagga

SEQ ID NO: 220894 - DNA, 20 bp, human
gtcacggccggcgtcggggc

SEQ ID NO: 220895 - DNA, 20 bp, human
gtccgctccggataccgttc

SEQ ID NO: 220896 - DNA, 20 bp, human
gccaggggcagggcgtaata

SEQ ID NO: 220897 - DNA, 20 bp, human
ggtacctgtaccatgttagg

SEQ ID NO: 220898 - DNA, 20 bp, human
gtgaccgcctaacatggtac

SEQ ID NO: 220899 - DNA, 20 bp, human
gcccctggctttttaattga

SEQ ID NO: 220900 - DNA, 20 bp, human
gccctttgggataactaggt

SEQ ID NO: 220901 - DNA, 20 bp, human
gacagtacctgtaccatgtt

SEQ ID NO: 220902 - DNA, 20 bp, human
gaaagggcaggaagagtgct

SEQ ID NO: 220903 - DNA, 20 bp, human
ggtttaactaacaactgata

SEQ ID NO: 220904 - DNA, 20 bp, human
gctggctttttaattgaagg

SEQ ID NO: 220905 - DNA, 20 bp, human
ggtttactgaccgcctaaca

SEQ ID NO: 220906 - DNA, 20 bp, human
ggtgtagaacggtgtttcta

SEQ ID NO: 220907 - DNA, 20 bp, human
gtatttctagaattccgcct

SEQ ID NO: 220908 - DNA, 20 bp, human
gaattccgccttggattgct

SEQ ID NO: 220909 - DNA, 20 bp, human
gatcgcagcaccaggcgcga

SEQ ID NO: 220910 - DNA, 20 bp, human
gctaaaggaatcgcagcacc

SEQ ID NO: 220911 - DNA, 20 bp, human
gtgaggaatcaccgcatacc

SEQ ID NO: 220912 - DNA, 20 bp, human
gataatgagtttacactgcc

SEQ ID NO: 220913 - DNA, 20 bp, human
gtgattcctcaataaattgc

SEQ ID NO: 220914 - DNA, 20 bp, human
gtcttttaatatgggggtag

SEQ ID NO: 220915 - DNA, 20 bp, human
ggaatcccagcaatccaagg

SEQ ID NO: 220916 - DNA, 20 bp, human
gtgcaggacctaagaagtcg

SEQ ID NO: 220917 - DNA, 20 bp, human
gataaacagaagttgaacgc

SEQ ID NO: 220918 - DNA, 20 bp, human
gacttcttaggtcctgcaca

SEQ ID NO: 220919 - DNA, 20 bp, human
gaatacttcctcgacttctt

SEQ ID NO: 220920 - DNA, 20 bp, human
gtgatcagtgaagtgtaaca

SEQ ID NO: 220921 - DNA, 20 bp, human
gcctcagagctcatgtcaga

SEQ ID NO: 220922 - DNA, 20 bp, human
gtaacatagaaaaatgatac

SEQ ID NO: 220923 - DNA, 20 bp, human
ggaaacaaacctaggggact

SEQ ID NO: 220924 - DNA, 20 bp, human
gctctatttcagttctaggt

SEQ ID NO: 220925 - DNA, 20 bp, human
gaatagggaaacaaacctag

SEQ ID NO: 220926 - DNA, 20 bp, human
gctggctgagagggcacggt

SEQ ID NO: 220927 - DNA, 20 bp, human
gctgcaaagggccactactc

SEQ ID NO: 220928 - DNA, 20 bp, human
ggctgaaggcaaagaagggc

SEQ ID NO: 220929 - DNA, 20 bp, human
gtgggacgcaggcctgcaaa

SEQ ID NO: 220930 - DNA, 20 bp, human
ggggccactactcaggaaga

SEQ ID NO: 220931 - DNA, 20 bp, human
gcccggcgccgggtgatgat

SEQ ID NO: 220932 - DNA, 20 bp, human
ggagatgcgtccagagagag

SEQ ID NO: 220933 - DNA, 20 bp, human
gtctgggccccatcatcacc

SEQ ID NO: 220934 - DNA, 20 bp, human
gccccatcatcacccggcgc

SEQ ID NO: 220935 - DNA, 20 bp, human
gccggacttcgggacatctc

SEQ ID NO: 220936 - DNA, 20 bp, human
gctgcaaagggccactactc

SEQ ID NO: 220937 - DNA, 20 bp, human
gctggctgagagggcacggt

SEQ ID NO: 220938 - DNA, 20 bp, human
gtgggacgcaggcctgcaaa

SEQ ID NO: 220939 - DNA, 20 bp, human
gcccggcgccgggtgatgat

SEQ ID NO: 220940 - DNA, 20 bp, human
ggctgaaggcaaagaagggc

SEQ ID NO: 220941 - DNA, 20 bp, human
ggggccactactcaggaaga

SEQ ID NO: 220942 - DNA, 20 bp, human
ggagatgcgtccagagagag

SEQ ID NO: 220943 - DNA, 20 bp, human
gtctgggccccatcatcacc

SEQ ID NO: 220944 - DNA, 20 bp, human
gacggcccggatcccggcag

SEQ ID NO: 220945 - DNA, 20 bp, human
gccccatcatcacccggcgc

SEQ ID NO: 220946 - DNA, 20 bp, human
gggccacccgtacgccccag

SEQ ID NO: 220947 - DNA, 20 bp, human
gcgtacgggtggccccgggg

SEQ ID NO: 220948 - DNA, 20 bp, human
gaggctgcacctcagagcgg

SEQ ID NO: 220949 - DNA, 20 bp, human
gcgggtccaggaaacccctg

SEQ ID NO: 220950 - DNA, 20 bp, human
gaacccctggggcgtacggg

SEQ ID NO: 220951 - DNA, 20 bp, human
gggaaacccctggggcgtac

SEQ ID NO: 220952 - DNA, 20 bp, human
ggagcggcccttggcagcag

SEQ ID NO: 220953 - DNA, 20 bp, human
ggggcgtacgggtggccccg

SEQ ID NO: 220954 - DNA, 20 bp, human
gcgccccgcttgccccctcc

SEQ ID NO: 220955 - DNA, 20 bp, human
gtccccacccctgctgccaa

SEQ ID NO: 220956 - DNA, 20 bp, human
gggcccctcgagcctcgaac

SEQ ID NO: 220957 - DNA, 20 bp, human
ggggagggagagccaccttc

SEQ ID NO: 220958 - DNA, 20 bp, human
gctccccgggcccaagacga

SEQ ID NO: 220959 - DNA, 20 bp, human
gtgctattcggtgacataag

SEQ ID NO: 220960 - DNA, 20 bp, human
gggccagtgaaaaaatcttg

SEQ ID NO: 220961 - DNA, 20 bp, human
gtaccactgctacgtggcag

SEQ ID NO: 220962 - DNA, 20 bp, human
gaagcagagcgtctcggatt

SEQ ID NO: 220963 - DNA, 20 bp, human
gcgaggctcgaggggcctga

SEQ ID NO: 220964 - DNA, 20 bp, human
gctcccctgccacgtagcag

SEQ ID NO: 220965 - DNA, 20 bp, human
ggaaggcgccgacgtcacag

SEQ ID NO: 220966 - DNA, 20 bp, human
ggggcgggacctcagaaaca

SEQ ID NO: 220967 - DNA, 20 bp, human
gaaggggtggtcgtaacgta

SEQ ID NO: 220968 - DNA, 20 bp, human
gaggacggggatattggaat

SEQ ID NO: 220969 - DNA, 20 bp, human
ggccgggcggggtacggaga

SEQ ID NO: 220970 - DNA, 20 bp, human
gggcctgggccagtgaaaat

SEQ ID NO: 220971 - DNA, 20 bp, human
gtctccagatggcgagtcca

SEQ ID NO: 220972 - DNA, 20 bp, human
ggacacgaggacggggatat

SEQ ID NO: 220973 - DNA, 20 bp, human
ggtcactgcaagtggacacg

SEQ ID NO: 220974 - DNA, 20 bp, human
gaaaggagccgaggccaaga

SEQ ID NO: 220975 - DNA, 20 bp, human
gatacgggagtctgagtcgt

SEQ ID NO: 220976 - DNA, 20 bp, human
gcgcgctgacccttcctcgg

SEQ ID NO: 220977 - DNA, 20 bp, human
gcaggtgccgaggggtccat

SEQ ID NO: 220978 - DNA, 20 bp, human
ggccaccgggcagcgccccc

SEQ ID NO: 220979 - DNA, 20 bp, human
gcgtccggggcgtcccctct

SEQ ID NO: 220980 - DNA, 20 bp, human
gctcctggggaggtggcgaa

SEQ ID NO: 220981 - DNA, 20 bp, human
gaagggcgcacggcgacccc

SEQ ID NO: 220982 - DNA, 20 bp, human
gctccccaggagggcgtccg

SEQ ID NO: 220983 - DNA, 20 bp, human
gccggaggccgcactgccgg

SEQ ID NO: 220984 - DNA, 20 bp, human
gtcggaggctgcaggtgccg

SEQ ID NO: 220985 - DNA, 20 bp, human
gagcacctcgcgtcccgaac

SEQ ID NO: 220986 - DNA, 20 bp, human
ggactcccggggcactcagg

SEQ ID NO: 220987 - DNA, 20 bp, human
gtcgcaccccggcccgggta

SEQ ID NO: 220988 - DNA, 20 bp, human
gcgcacccgcccgccccttg

SEQ ID NO: 220989 - DNA, 20 bp, human
ggagccccctacccgggccg

SEQ ID NO: 220990 - DNA, 20 bp, human
gcactcaggagggacgcccc

SEQ ID NO: 220991 - DNA, 20 bp, human
ggcgcgatccccggtgtctt

SEQ ID NO: 220992 - DNA, 20 bp, human
gtgaggccgtgagccccaag

SEQ ID NO: 220993 - DNA, 20 bp, human
ggccgacctccaaactctca

SEQ ID NO: 220994 - DNA, 20 bp, human
ggcgtccctcctgagtgccc

SEQ ID NO: 220995 - DNA, 20 bp, human
gagccgggaggaccgctgat

SEQ ID NO: 220996 - DNA, 20 bp, human
ggggacttgcggaggcgttg

SEQ ID NO: 220997 - DNA, 20 bp, human
gcggacgcgcgagttgggga

SEQ ID NO: 220998 - DNA, 20 bp, human
gtgggcgcggggtgcgcgac

SEQ ID NO: 220999 - DNA, 20 bp, human
ggcgcgggcggccagagccc

SEQ ID NO: 221000 - DNA, 20 bp, human
ggggcgcggcggcaggaaac

SEQ ID NO: 221001 - DNA, 20 bp, human
ggggacggacgcgcgagttg

SEQ ID NO: 221002 - DNA, 20 bp, human
ggaaacggggcggggacttg

SEQ ID NO: 221003 - DNA, 20 bp, human
gtggtctgaacacacggcct

SEQ ID NO: 221004 - DNA, 20 bp, human
ggcgtccaggcgctccaagg

SEQ ID NO: 221005 - DNA, 20 bp, human
gccgccgagagcgggagttg

SEQ ID NO: 221006 - DNA, 20 bp, human
gactggtggagttaagagac

SEQ ID NO: 221007 - DNA, 20 bp, human
gctgcgagcctgcctgtcac

SEQ ID NO: 221008 - DNA, 20 bp, human
ggctgcggtgacacttggta

SEQ ID NO: 221009 - DNA, 20 bp, human
ggtgacacttggtacggccc

SEQ ID NO: 221010 - DNA, 20 bp, human
gtgtgcctgcgtgcgcagct

SEQ ID NO: 221011 - DNA, 20 bp, human
gaaaagcccaggctgagttg

SEQ ID NO: 221012 - DNA, 20 bp, human
gcaagtgtcaccgcagcaag

SEQ ID NO: 221013 - DNA, 20 bp, human
gttggcctagctgcgcacgc

SEQ ID NO: 221014 - DNA, 20 bp, human
gctcctgtgtcctagtaaaa

SEQ ID NO: 221015 - DNA, 20 bp, human
gtccatgtgtgaaagctact

SEQ ID NO: 221016 - DNA, 20 bp, human
ggggaggcaggttggcccgg

SEQ ID NO: 221017 - DNA, 20 bp, human
gcgcccggccggctagcggg

SEQ ID NO: 221018 - DNA, 20 bp, human
ggacgcgccaacaacatccc

SEQ ID NO: 221019 - DNA, 20 bp, human
gcggctagcgggaggcaggt

SEQ ID NO: 221020 - DNA, 20 bp, human
gactcggtaaggcgcccggc

SEQ ID NO: 221021 - DNA, 20 bp, human
gtgggtgggtacaacgaaga

SEQ ID NO: 221022 - DNA, 20 bp, human
gaccgagtcagaccactggg

SEQ ID NO: 221023 - DNA, 20 bp, human
gaaggcgcccggccggctag

SEQ ID NO: 221024 - DNA, 20 bp, human
gaggctgggggagccgggtt

SEQ ID NO: 221025 - DNA, 20 bp, human
gaggcaggttggcccggggg

SEQ ID NO: 221026 - DNA, 20 bp, human
ggtctcgcgggaagatgtga

SEQ ID NO: 221027 - DNA, 20 bp, human
gccacccttccgctccggtc

SEQ ID NO: 221028 - DNA, 20 bp, human
ggtcgcgtggctggtctcgc

SEQ ID NO: 221029 - DNA, 20 bp, human
gcccgcccacccttccgctc

SEQ ID NO: 221030 - DNA, 20 bp, human
ggacgctacgggccagaggg

SEQ ID NO: 221031 - DNA, 20 bp, human
gccggccaaggctgacgcta

SEQ ID NO: 221032 - DNA, 20 bp, human
gccggagaggcggtagagta

SEQ ID NO: 221033 - DNA, 20 bp, human
gccaggaagccggaccggag

SEQ ID NO: 221034 - DNA, 20 bp, human
ggctgacgctacgggccaga

SEQ ID NO: 221035 - DNA, 20 bp, human
gagaggcggtagagtagggt

SEQ ID NO: 221036 - DNA, 20 bp, human
gaagagatgctgggaatcag

SEQ ID NO: 221037 - DNA, 20 bp, human
gccagctcttggattacgtc

SEQ ID NO: 221038 - DNA, 20 bp, human
gactggagagggaaagctga

SEQ ID NO: 221039 - DNA, 20 bp, human
gcgtcgggcaacataacagc

SEQ ID NO: 221040 - DNA, 20 bp, human
gggcaacataacagcaggca

SEQ ID NO: 221041 - DNA, 20 bp, human
gaagctgagggaacaataag

SEQ ID NO: 221042 - DNA, 20 bp, human
gcagaacaagaagagatgct

SEQ ID NO: 221043 - DNA, 20 bp, human
gggaaccccttcagcagaga

SEQ ID NO: 221044 - DNA, 20 bp, human
ggctgggaatcagaggtgct

SEQ ID NO: 221045 - DNA, 20 bp, human
gccttcagcagagacgggaa

SEQ ID NO: 221046 - DNA, 20 bp, human
gaggacgcagcttaaggggc

SEQ ID NO: 221047 - DNA, 20 bp, human
gttaactgtagtgtgagaac

SEQ ID NO: 221048 - DNA, 20 bp, human
gagagaggacgcagcttaag

SEQ ID NO: 221049 - DNA, 20 bp, human
gtatagctagggtgtttgga

SEQ ID NO: 221050 - DNA, 20 bp, human
gcgggggagaccactattgg

SEQ ID NO: 221051 - DNA, 20 bp, human
ggggcgggggagaccactat

SEQ ID NO: 221052 - DNA, 20 bp, human
gtgtcggaatcttccagaag

SEQ ID NO: 221053 - DNA, 20 bp, human
gactagaggacgctacaatc

SEQ ID NO: 221054 - DNA, 20 bp, human
gcagctgcgtattatagcta

SEQ ID NO: 221055 - DNA, 20 bp, human
gtctagtggcagtctaaatt

SEQ ID NO: 221056 - DNA, 20 bp, human
gccaacgcgtcccccctccc

SEQ ID NO: 221057 - DNA, 20 bp, human
gaggggaggcggctgttggg

SEQ ID NO: 221058 - DNA, 20 bp, human
ggagggtgagcggagactgg

SEQ ID NO: 221059 - DNA, 20 bp, human
gcccccgcaggcgcagcgct

SEQ ID NO: 221060 - DNA, 20 bp, human
ggcggagggtgagcggagac

SEQ ID NO: 221061 - DNA, 20 bp, human
gaggggtgattccccaggaa

SEQ ID NO: 221062 - DNA, 20 bp, human
gaacttgcgagagctggagg

SEQ ID NO: 221063 - DNA, 20 bp, human
ggatgacggccggggaaact

SEQ ID NO: 221064 - DNA, 20 bp, human
gctccgctcaccctccgctg

SEQ ID NO: 221065 - DNA, 20 bp, human
gccgggccgtgcatcgatga

SEQ ID NO: 221066 - DNA, 20 bp, human
ggaccgagcggattccggag

SEQ ID NO: 221067 - DNA, 20 bp, human
gaatgcggcctacgcgggtg

SEQ ID NO: 221068 - DNA, 20 bp, human
gagccccggtgacactggga

SEQ ID NO: 221069 - DNA, 20 bp, human
gctacgcgggtgggggggaa

SEQ ID NO: 221070 - DNA, 20 bp, human
ggggcagagccaagcagccc

SEQ ID NO: 221071 - DNA, 20 bp, human
ggaccggcacccactccacc

SEQ ID NO: 221072 - DNA, 20 bp, human
gcgcagggctcgacgggaag

SEQ ID NO: 221073 - DNA, 20 bp, human
ggcgccaacccccgctccac

SEQ ID NO: 221074 - DNA, 20 bp, human
gcccagaatgcggcctacgc

SEQ ID NO: 221075 - DNA, 20 bp, human
gaagcagccccggtgacact

SEQ ID NO: 221076 - DNA, 20 bp, human
gggggggaggttgcttctgt

SEQ ID NO: 221077 - DNA, 20 bp, human
gggcctctgacacgacgact

SEQ ID NO: 221078 - DNA, 20 bp, human
ggggccgcgccgtgggcaca

SEQ ID NO: 221079 - DNA, 20 bp, human
ggggagggtggcggctcgat

SEQ ID NO: 221080 - DNA, 20 bp, human
gccaaaaggcacagggacgg

SEQ ID NO: 221081 - DNA, 20 bp, human
gctgcgccgcaggaagggga

SEQ ID NO: 221082 - DNA, 20 bp, human
gggccgtggccagagtctgg

SEQ ID NO: 221083 - DNA, 20 bp, human
gcccgcgcctcgccgtgcgg

SEQ ID NO: 221084 - DNA, 20 bp, human
gggggcggtgcggaagcgag

SEQ ID NO: 221085 - DNA, 20 bp, human
gggaacacttggctcccctc

SEQ ID NO: 221086 - DNA, 20 bp, human
ggctctcgatggtgcttctc

SEQ ID NO: 221087 - DNA, 20 bp, human
gtaccccggcagccggcaag

SEQ ID NO: 221088 - DNA, 20 bp, human
gctctggggtagagtggcgt

SEQ ID NO: 221089 - DNA, 20 bp, human
gagcaccatcgagagctctg

SEQ ID NO: 221090 - DNA, 20 bp, human
gtctaccccagagctctcga

SEQ ID NO: 221091 - DNA, 20 bp, human
ggtggcgtgggcttctctgt

SEQ ID NO: 221092 - DNA, 20 bp, human
gcagccgcctctaggatatt

SEQ ID NO: 221093 - DNA, 20 bp, human
ggcttctccggcttcagggc

SEQ ID NO: 221094 - DNA, 20 bp, human
gtagatgaaaggacccgggg

SEQ ID NO: 221095 - DNA, 20 bp, human
gatggtgcttctccggcttc

SEQ ID NO: 221096 - DNA, 20 bp, human
gcggtcggggagcgagaagg

SEQ ID NO: 221097 - DNA, 20 bp, human
ggaaagggttgcagcctcgc

SEQ ID NO: 221098 - DNA, 20 bp, human
gggatctggcgcccggctta

SEQ ID NO: 221099 - DNA, 20 bp, human
gccaaggtgccctgatcgct

SEQ ID NO: 221100 - DNA, 20 bp, human
gaccgggagcctagcgatca

SEQ ID NO: 221101 - DNA, 20 bp, human
ggcacccagcgcggaggagg

SEQ ID NO: 221102 - DNA, 20 bp, human
gctcgcccccgcccagcggt

SEQ ID NO: 221103 - DNA, 20 bp, human
gatggagccaggtgcggaaa

SEQ ID NO: 221104 - DNA, 20 bp, human
gtcgctccccgaccgctggg

SEQ ID NO: 221105 - DNA, 20 bp, human
gaggggcgagacggccgcac

SEQ ID NO: 221106 - DNA, 20 bp, human
gtgatcctctgcttgtcaga

SEQ ID NO: 221107 - DNA, 20 bp, human
gtgtgtgacaagtacagtgg

SEQ ID NO: 221108 - DNA, 20 bp, human
gtgcccacacatacctggca

SEQ ID NO: 221109 - DNA, 20 bp, human
gctccctgccaggtatgtgt

SEQ ID NO: 221110 - DNA, 20 bp, human
ggcaaggaaccggcctgaac

SEQ ID NO: 221111 - DNA, 20 bp, human
gagctaaagatggagttggt

SEQ ID NO: 221112 - DNA, 20 bp, human
ggaatgtcacagtggaggta

SEQ ID NO: 221113 - DNA, 20 bp, human
ggccaagtggtttttagata

SEQ ID NO: 221114 - DNA, 20 bp, human
gtttctcaggtcctgattct

SEQ ID NO: 221115 - DNA, 20 bp, human
gaatactgagagacgtccta

SEQ ID NO: 221116 - DNA, 20 bp, human
gctgccatctagtggaattc

SEQ ID NO: 221117 - DNA, 20 bp, human
ggtgccagggtagacgagat

SEQ ID NO: 221118 - DNA, 20 bp, human
gttagagcttacttaggatg

SEQ ID NO: 221119 - DNA, 20 bp, human
gactatgaattccaagtgga

SEQ ID NO: 221120 - DNA, 20 bp, human
gttgacttgcttccagacaa

SEQ ID NO: 221121 - DNA, 20 bp, human
gtagaactatgaattccaag

SEQ ID NO: 221122 - DNA, 20 bp, human
gcctactatatgcggtgcca

SEQ ID NO: 221123 - DNA, 20 bp, human
ggccactaaactctgaaagc

SEQ ID NO: 221124 - DNA, 20 bp, human
gttggggagaacgtgaaact

SEQ ID NO: 221125 - DNA, 20 bp, human
gcagccaatctcgtctaccc

SEQ ID NO: 221126 - DNA, 20 bp, human
ggcagatggtaccaaagtaa

SEQ ID NO: 221127 - DNA, 20 bp, human
gctgcccaagacctgtatgt

SEQ ID NO: 221128 - DNA, 20 bp, human
ggctctgcagcagcttttgt

SEQ ID NO: 221129 - DNA, 20 bp, human
gactttggtaccatctgcag

SEQ ID NO: 221130 - DNA, 20 bp, human
ggccgcaaaagtgagtcttt

SEQ ID NO: 221131 - DNA, 20 bp, human
gcaaaagaggccattcgaag

SEQ ID NO: 221132 - DNA, 20 bp, human
gaccatctccccctttactt

SEQ ID NO: 221133 - DNA, 20 bp, human
gcatttcactttgcacttta

SEQ ID NO: 221134 - DNA, 20 bp, human
gacatcgccaacttgcccca

SEQ ID NO: 221135 - DNA, 20 bp, human
gatccccacaatgacatcac

SEQ ID NO: 221136 - DNA, 20 bp, human
gtgtggggccgggaaggctg

SEQ ID NO: 221137 - DNA, 20 bp, human
gctcccggctgaccacaaag

SEQ ID NO: 221138 - DNA, 20 bp, human
ggtggcagagcggagagcga

SEQ ID NO: 221139 - DNA, 20 bp, human
gacggcaaaaacgtccctcc

SEQ ID NO: 221140 - DNA, 20 bp, human
gggctgcccgttggagtcgt

SEQ ID NO: 221141 - DNA, 20 bp, human
gccagcctgagccttgacat

SEQ ID NO: 221142 - DNA, 20 bp, human
ggcccgttggagtcgtggga

SEQ ID NO: 221143 - DNA, 20 bp, human
gaaacggccgcgtgtctcag

SEQ ID NO: 221144 - DNA, 20 bp, human
gtgccgtcccacgactccaa

SEQ ID NO: 221145 - DNA, 20 bp, human
ggccaccctctgagccctgg

SEQ ID NO: 221146 - DNA, 20 bp, human
gtcctcgcgcggggaaccga

SEQ ID NO: 221147 - DNA, 20 bp, human
gggaactccccgctcccccg

SEQ ID NO: 221148 - DNA, 20 bp, human
gcgatgtcgcggggccctag

SEQ ID NO: 221149 - DNA, 20 bp, human
gcgggacgcggggttccccg

SEQ ID NO: 221150 - DNA, 20 bp, human
gtgtcgcggggccctagggg

SEQ ID NO: 221151 - DNA, 20 bp, human
gaggacgcccgcggcttcga

SEQ ID NO: 221152 - DNA, 20 bp, human
gaggacaggccccgggggag

SEQ ID NO: 221153 - DNA, 20 bp, human
gcccctcggttccccgcgcg

SEQ ID NO: 221154 - DNA, 20 bp, human
gacgcggcgttccctttaag

SEQ ID NO: 221155 - DNA, 20 bp, human
gagaacttgggtgctgggat

SEQ ID NO: 221156 - DNA, 20 bp, human
ggacgtcagacgcacagcac

SEQ ID NO: 221157 - DNA, 20 bp, human
gactgagactgggttacctg

SEQ ID NO: 221158 - DNA, 20 bp, human
gtgagcgcggggatgctggg

SEQ ID NO: 221159 - DNA, 20 bp, human
gtgacgtcattctgcggcgc

SEQ ID NO: 221160 - DNA, 20 bp, human
gtgcgtctgacgtcattctg

SEQ ID NO: 221161 - DNA, 20 bp, human
gcttaggagtagttgaaaag

SEQ ID NO: 221162 - DNA, 20 bp, human
gctaccaagctactgagact

SEQ ID NO: 221163 - DNA, 20 bp, human
gctgatggcgcaatcagttg

SEQ ID NO: 221164 - DNA, 20 bp, human
gaactactcctaaggactcc

SEQ ID NO: 221165 - DNA, 20 bp, human
gtctctgctcaaacctttac

SEQ ID NO: 221166 - DNA, 20 bp, human
ggcggcgcggggacgacggg

SEQ ID NO: 221167 - DNA, 20 bp, human
ggtcactccgagatgcgggg

SEQ ID NO: 221168 - DNA, 20 bp, human
gggggcgcgccgctacgctt

SEQ ID NO: 221169 - DNA, 20 bp, human
gccgcccacgccaccgtcac

SEQ ID NO: 221170 - DNA, 20 bp, human
gccccggcccccctcggcgg

SEQ ID NO: 221171 - DNA, 20 bp, human
gtgcctcggcccgggatcgc

SEQ ID NO: 221172 - DNA, 20 bp, human
gccgcatctcggagtgaccc

SEQ ID NO: 221173 - DNA, 20 bp, human
gctcccgggcctcagcaccg

SEQ ID NO: 221174 - DNA, 20 bp, human
gaccagccgcccgcgatccc

SEQ ID NO: 221175 - DNA, 20 bp, human
ggggctggctgtgcgcaaag

SEQ ID NO: 221176 - DNA, 20 bp, human
gggagcctccccattctctg

SEQ ID NO: 221177 - DNA, 20 bp, human
gagccaaggccgcagagaat

SEQ ID NO: 221178 - DNA, 20 bp, human
ggaaaagcagcgggcttcag

SEQ ID NO: 221179 - DNA, 20 bp, human
gaaggccgcagagaatgggg

SEQ ID NO: 221180 - DNA, 20 bp, human
gctcggcggaagttttccgg

SEQ ID NO: 221181 - DNA, 20 bp, human
gccgaggtgaagagcatcgg

SEQ ID NO: 221182 - DNA, 20 bp, human
gctcccgaggtgaagagcat

SEQ ID NO: 221183 - DNA, 20 bp, human
gttggctcctacacttcccg

SEQ ID NO: 221184 - DNA, 20 bp, human
gaccggacgtgacgctacga

SEQ ID NO: 221185 - DNA, 20 bp, human
gtcgctccggggccgacccg

SEQ ID NO: 221186 - DNA, 20 bp, human
gcggccggggcgcaagtggt

SEQ ID NO: 221187 - DNA, 20 bp, human
ggaacccgcgccagcttgaa

SEQ ID NO: 221188 - DNA, 20 bp, human
gccaggcgaggaatggcaga

SEQ ID NO: 221189 - DNA, 20 bp, human
gcagccattcaagctggcgc

SEQ ID NO: 221190 - DNA, 20 bp, human
gtagagcatgcggggctggg

SEQ ID NO: 221191 - DNA, 20 bp, human
gcggtagagcatgcggggct

SEQ ID NO: 221192 - DNA, 20 bp, human
ggcgggggccaggcgaggaa

SEQ ID NO: 221193 - DNA, 20 bp, human
gacctgcccaaccttttcat

SEQ ID NO: 221194 - DNA, 20 bp, human
ggagtgcggtagagcatgcg

SEQ ID NO: 221195 - DNA, 20 bp, human
gcaagtggtgggcgcagggc

SEQ ID NO: 221196 - DNA, 20 bp, human
gcccggaggcagacccacgt

SEQ ID NO: 221197 - DNA, 20 bp, human
ggggactcctatgccatcct

SEQ ID NO: 221198 - DNA, 20 bp, human
gagacctgtcctccccaggg

SEQ ID NO: 221199 - DNA, 20 bp, human
gctatagagtgctagaagtg

SEQ ID NO: 221200 - DNA, 20 bp, human
gtgcctccgggagcgctctc

SEQ ID NO: 221201 - DNA, 20 bp, human
gagggaacagtcgacttcag

SEQ ID NO: 221202 - DNA, 20 bp, human
ggctagaagtggggcagcca

SEQ ID NO: 221203 - DNA, 20 bp, human
ggggaggtggtgaacttcct

SEQ ID NO: 221204 - DNA, 20 bp, human
gacctcagggtgcccagaag

SEQ ID NO: 221205 - DNA, 20 bp, human
gctctatagctacaggtccc

SEQ ID NO: 221206 - DNA, 20 bp, human
gtaagaaagtaggtcaaaag

SEQ ID NO: 221207 - DNA, 20 bp, human
gaggccatcgaggtgtgcga

SEQ ID NO: 221208 - DNA, 20 bp, human
gctctccccgagtgcggcaa

SEQ ID NO: 221209 - DNA, 20 bp, human
gagcctggaccacgtctccg

SEQ ID NO: 221210 - DNA, 20 bp, human
gacgagcagaattacactgt

SEQ ID NO: 221211 - DNA, 20 bp, human
gcatgcgtgcgtgactcctg

SEQ ID NO: 221212 - DNA, 20 bp, human
ggaaagtaggtcaaaagtgg

SEQ ID NO: 221213 - DNA, 20 bp, human
ggcgaggccctttgaccccc

SEQ ID NO: 221214 - DNA, 20 bp, human
ggtgactcctgggggtcaaa

SEQ ID NO: 221215 - DNA, 20 bp, human
gagccgcggagacgtggtcc

SEQ ID NO: 221216 - DNA, 20 bp, human
ggtacaggggacattgttcg

SEQ ID NO: 221217 - DNA, 20 bp, human
gagctcgggcgcgcactccc

SEQ ID NO: 221218 - DNA, 20 bp, human
gcccaccgcgagttcgtcct

SEQ ID NO: 221219 - DNA, 20 bp, human
gcgcactcccgggacccagg

SEQ ID NO: 221220 - DNA, 20 bp, human
gcccgcgtgtgccccgctga

SEQ ID NO: 221221 - DNA, 20 bp, human
gcgggcgtgaacggccgcgg

SEQ ID NO: 221222 - DNA, 20 bp, human
gccgcccctccccctcagcg

SEQ ID NO: 221223 - DNA, 20 bp, human
gagcggggcacacgcgggac

SEQ ID NO: 221224 - DNA, 20 bp, human
gggggcacacgcgggaccgg

SEQ ID NO: 221225 - DNA, 20 bp, human
ggctcgggcgtgaacggccg

SEQ ID NO: 221226 - DNA, 20 bp, human
gttcccccgctccccgtcgg

SEQ ID NO: 221227 - DNA, 20 bp, human
ggcccgcggggtctgcctgg

SEQ ID NO: 221228 - DNA, 20 bp, human
ggccgcccgcggggtctgcc

SEQ ID NO: 221229 - DNA, 20 bp, human
gaaggtggggatccgggatc

SEQ ID NO: 221230 - DNA, 20 bp, human
gagccgccaggcagaccccg

SEQ ID NO: 221231 - DNA, 20 bp, human
gaagcctcgagtccacatct

SEQ ID NO: 221232 - DNA, 20 bp, human
gcggctccgcgcctccgacg

SEQ ID NO: 221233 - DNA, 20 bp, human
ggcccgggaactggtgaaga

SEQ ID NO: 221234 - DNA, 20 bp, human
gagacccagatgtggactcg

SEQ ID NO: 221235 - DNA, 20 bp, human
gtgtggactcgaggcttctg

SEQ ID NO: 221236 - DNA, 20 bp, human
ggacgaggggcggatgaggg

SEQ ID NO: 221237 - DNA, 20 bp, human
gttcgcctgggcgcggaaaa

SEQ ID NO: 221238 - DNA, 20 bp, human
gccggagcgcgattcgaatg

SEQ ID NO: 221239 - DNA, 20 bp, human
gagcgcgattcgaatgggga

SEQ ID NO: 221240 - DNA, 20 bp, human
ggggggggaaagggggacga

SEQ ID NO: 221241 - DNA, 20 bp, human
gcggaggtggggatccggcg

SEQ ID NO: 221242 - DNA, 20 bp, human
gtctcgctacggtgctgggg

SEQ ID NO: 221243 - DNA, 20 bp, human
ggggggcgcgagtctcgcta

SEQ ID NO: 221244 - DNA, 20 bp, human
ggcacaaaggcgtacatggt

SEQ ID NO: 221245 - DNA, 20 bp, human
gtacggtgctggggggggcg

SEQ ID NO: 221246 - DNA, 20 bp, human
ggcgctacgcgagtgatcca

SEQ ID NO: 221247 - DNA, 20 bp, human
ggggatgctgaggtcggcgg

SEQ ID NO: 221248 - DNA, 20 bp, human
gcgacgaggctgcgactcgg

SEQ ID NO: 221249 - DNA, 20 bp, human
ggccgggcgcacgtgggtcg

SEQ ID NO: 221250 - DNA, 20 bp, human
gcccacgtgcgcccggcttc

SEQ ID NO: 221251 - DNA, 20 bp, human
gccgccggggacgcggcgag

SEQ ID NO: 221252 - DNA, 20 bp, human
ggcggccgcaggacgatgcg

SEQ ID NO: 221253 - DNA, 20 bp, human
gggccccgcgcatcgtcctg

SEQ ID NO: 221254 - DNA, 20 bp, human
ggggggctgcgcacggacgg

SEQ ID NO: 221255 - DNA, 20 bp, human
ggactcagcagacagcgacg

SEQ ID NO: 221256 - DNA, 20 bp, human
gcggccgccgccatccccgg

SEQ ID NO: 221257 - DNA, 20 bp, human
gcggcccccggggatggcgg

SEQ ID NO: 221258 - DNA, 20 bp, human
ggcggcggcgtcgtccccgg

SEQ ID NO: 221259 - DNA, 20 bp, human
gcggcggcccccggggatgg

SEQ ID NO: 221260 - DNA, 20 bp, human
gcggtgccgctgggacccca

SEQ ID NO: 221261 - DNA, 20 bp, human
gtccgccagcaggtggccct

SEQ ID NO: 221262 - DNA, 20 bp, human
ggccgggctccgccagcagg

SEQ ID NO: 221263 - DNA, 20 bp, human
gcggggcgcccgggatgtga

SEQ ID NO: 221264 - DNA, 20 bp, human
gagcccgcccgccgcgtctt

SEQ ID NO: 221265 - DNA, 20 bp, human
gcggagggggcggtgccgct

SEQ ID NO: 221266 - DNA, 20 bp, human
ggccttgcagagagagttgg

SEQ ID NO: 221267 - DNA, 20 bp, human
gttagggagtcaagtgacgg

SEQ ID NO: 221268 - DNA, 20 bp, human
gtctgagcagattacaagaa

SEQ ID NO: 221269 - DNA, 20 bp, human
gtaagccaggacctccacaa

SEQ ID NO: 221270 - DNA, 20 bp, human
gagcctctaagagtgggcag

SEQ ID NO: 221271 - DNA, 20 bp, human
gagaccagggctggaattta

SEQ ID NO: 221272 - DNA, 20 bp, human
gagtgccagcctctaagagt

SEQ ID NO: 221273 - DNA, 20 bp, human
ggaccccagggcctagtcag

SEQ ID NO: 221274 - DNA, 20 bp, human
gagggctgtcaaagacccca

SEQ ID NO: 221275 - DNA, 20 bp, human
gggcccctctaatttcttct

SEQ ID NO: 221276 - DNA, 20 bp, human
gtgtggacgcagcgaggaga

SEQ ID NO: 221277 - DNA, 20 bp, human
gcccggccctgggtaggagt

SEQ ID NO: 221278 - DNA, 20 bp, human
gcagggccgggctagacctg

SEQ ID NO: 221279 - DNA, 20 bp, human
ggcagtcccactcctaccca

SEQ ID NO: 221280 - DNA, 20 bp, human
gactgtccccaggtctagcc

SEQ ID NO: 221281 - DNA, 20 bp, human
gacccagcacgaaggaaatg

SEQ ID NO: 221282 - DNA, 20 bp, human
gaaaatgtgggatagcatcg

SEQ ID NO: 221283 - DNA, 20 bp, human
gtacagccccaaacccggac

SEQ ID NO: 221284 - DNA, 20 bp, human
gaggaggaggccccctccag

SEQ ID NO: 221285 - DNA, 20 bp, human
gagctgttgttcttccgtga

SEQ ID NO: 221286 - DNA, 20 bp, human
ggacctgccagtgagcgact

SEQ ID NO: 221287 - DNA, 20 bp, human
gcgctcactggcaggtccta

SEQ ID NO: 221288 - DNA, 20 bp, human
gtgccagtgagcgactggga

SEQ ID NO: 221289 - DNA, 20 bp, human
gtcccctcccagtcgctcac

SEQ ID NO: 221290 - DNA, 20 bp, human
gtgggcgtgcctccctttcc

SEQ ID NO: 221291 - DNA, 20 bp, human
ggaagctacagcctagccga

SEQ ID NO: 221292 - DNA, 20 bp, human
gctagggatctggaacccag

SEQ ID NO: 221293 - DNA, 20 bp, human
gaagtttgttacctggtacg

SEQ ID NO: 221294 - DNA, 20 bp, human
ggtcccacaagtttgttacc

SEQ ID NO: 221295 - DNA, 20 bp, human
gtgtgacactgtgtgattac

SEQ ID NO: 221296 - DNA, 20 bp, human
gccctgggatcaaggaagaa

SEQ ID NO: 221297 - DNA, 20 bp, human
gacccctttgaatgagaagt

SEQ ID NO: 221298 - DNA, 20 bp, human
gcagctataactgtcatcag

SEQ ID NO: 221299 - DNA, 20 bp, human
gaaggggtacttggggtggc

SEQ ID NO: 221300 - DNA, 20 bp, human
gtcattcaaaggggtacttg

SEQ ID NO: 221301 - DNA, 20 bp, human
gcaaggaagaaaggttgatt

SEQ ID NO: 221302 - DNA, 20 bp, human
ggccaacttctcattcaaag

SEQ ID NO: 221303 - DNA, 20 bp, human
gcagtgacatgaaggatgtt

SEQ ID NO: 221304 - DNA, 20 bp, human
gcagagtgtgacaagaacag

SEQ ID NO: 221305 - DNA, 20 bp, human
gctgtcatcagtggctaaac

SEQ ID NO: 221306 - DNA, 20 bp, human
gtcccagcaccaggggaagc

SEQ ID NO: 221307 - DNA, 20 bp, human
gggccagcccaaccctacag

SEQ ID NO: 221308 - DNA, 20 bp, human
gtccttacccctgtagggtt

SEQ ID NO: 221309 - DNA, 20 bp, human
gtacccctgtagggttgggc

SEQ ID NO: 221310 - DNA, 20 bp, human
ggtcgtctgtgtgagctgtg

SEQ ID NO: 221311 - DNA, 20 bp, human
gcatactggcttgaaggaca

SEQ ID NO: 221312 - DNA, 20 bp, human
gtgtgtctccttacccctgt

SEQ ID NO: 221313 - DNA, 20 bp, human
ggactgaggcctatcattga

SEQ ID NO: 221314 - DNA, 20 bp, human
gtccttcaagccagtatgac

SEQ ID NO: 221315 - DNA, 20 bp, human
gggttgggctggccttcgag

SEQ ID NO: 221316 - DNA, 20 bp, human
gacggggcgtccggaaaagg

SEQ ID NO: 221317 - DNA, 20 bp, human
gagcggaacagcgggaacgt

SEQ ID NO: 221318 - DNA, 20 bp, human
ggggcgtccggaaaaggggg

SEQ ID NO: 221319 - DNA, 20 bp, human
ggggctgcgagcggaacagc

SEQ ID NO: 221320 - DNA, 20 bp, human
gcgactgcggctctgattct

SEQ ID NO: 221321 - DNA, 20 bp, human
gcggacggggcgtccggaaa

SEQ ID NO: 221322 - DNA, 20 bp, human
gtgagggcgtgatgtgaacc

SEQ ID NO: 221323 - DNA, 20 bp, human
gccggatgatggcgtcacca

SEQ ID NO: 221324 - DNA, 20 bp, human
gaagggggcggcttcgactg

SEQ ID NO: 221325 - DNA, 20 bp, human
gtcagcaacacgttatgcgt

SEQ ID NO: 221326 - DNA, 20 bp, human
ggaagcgatgggcatatctg

SEQ ID NO: 221327 - DNA, 20 bp, human
gaaggggctgggctatctag

SEQ ID NO: 221328 - DNA, 20 bp, human
gacttccggcttagggccga

SEQ ID NO: 221329 - DNA, 20 bp, human
gtgccgggcgcggaagcgat

SEQ ID NO: 221330 - DNA, 20 bp, human
gtcagcgagcccgaagcgga

SEQ ID NO: 221331 - DNA, 20 bp, human
gccggcttagggccgagggt

SEQ ID NO: 221332 - DNA, 20 bp, human
ggaagtcagcgagcccgaag

SEQ ID NO: 221333 - DNA, 20 bp, human
gctcgctgacttccggctta

SEQ ID NO: 221334 - DNA, 20 bp, human
gggctatctaggggcgtggt

SEQ ID NO: 221335 - DNA, 20 bp, human
gttggtgttcctgtgaacgt

SEQ ID NO: 221336 - DNA, 20 bp, human
ggggccggcggccagttaac

SEQ ID NO: 221337 - DNA, 20 bp, human
gaactggccgccggcccgtg

SEQ ID NO: 221338 - DNA, 20 bp, human
gcgcgcacagacgggaggag

SEQ ID NO: 221339 - DNA, 20 bp, human
gaggacggagatgagtgacg

SEQ ID NO: 221340 - DNA, 20 bp, human
gctggggcaccgcgcacaga

SEQ ID NO: 221341 - DNA, 20 bp, human
gggtgtctgtgtgttccaaa

SEQ ID NO: 221342 - DNA, 20 bp, human
gtaactggtactcccccctt

SEQ ID NO: 221343 - DNA, 20 bp, human
ggtgacggggctgtgcgcac

SEQ ID NO: 221344 - DNA, 20 bp, human
gatacacagccagtgagaag

SEQ ID NO: 221345 - DNA, 20 bp, human
ggccgccggcccgtgggggt

SEQ ID NO: 221346 - DNA, 20 bp, human
ggggactcccggtgaggatg

SEQ ID NO: 221347 - DNA, 20 bp, human
gttaaaagggactcccggtg

SEQ ID NO: 221348 - DNA, 20 bp, human
gcaggctggggatgttaaaa

SEQ ID NO: 221349 - DNA, 20 bp, human
gcgaaagcaccacctgactc

SEQ ID NO: 221350 - DNA, 20 bp, human
gaggacagaaggaggtagac

SEQ ID NO: 221351 - DNA, 20 bp, human
ggacaacagccacacgtgat

SEQ ID NO: 221352 - DNA, 20 bp, human
gacgaggtaagactcagtgt

SEQ ID NO: 221353 - DNA, 20 bp, human
ggcagaaggaggtgaatcct

SEQ ID NO: 221354 - DNA, 20 bp, human
gtggctgttgtcatcgccag

SEQ ID NO: 221355 - DNA, 20 bp, human
ggacggaaggtatcttctca

SEQ ID NO: 221356 - DNA, 20 bp, human
gagactccggatgaggatag

SEQ ID NO: 221357 - DNA, 20 bp, human
gcgaaagccccgcctgactc

SEQ ID NO: 221358 - DNA, 20 bp, human
gctaaaagagactccggatg

SEQ ID NO: 221359 - DNA, 20 bp, human
ggggctgttgtcatcgccaa

SEQ ID NO: 221360 - DNA, 20 bp, human
gtgcagcccggagtcaggcg

SEQ ID NO: 221361 - DNA, 20 bp, human
gtctgcgcccgcgtcctggt

SEQ ID NO: 221362 - DNA, 20 bp, human
gcccaagaatacacaaagac

SEQ ID NO: 221363 - DNA, 20 bp, human
gacgcgggcgcagaatttaa

SEQ ID NO: 221364 - DNA, 20 bp, human
gcagtgttggccggtcacgt

SEQ ID NO: 221365 - DNA, 20 bp, human
ggagatgtggggaaaatcct

SEQ ID NO: 221366 - DNA, 20 bp, human
gtgcgggtgtgaatggtaat

SEQ ID NO: 221367 - DNA, 20 bp, human
gcacccgcagtgcggcagga

SEQ ID NO: 221368 - DNA, 20 bp, human
gagggtgggggcgggactgt

SEQ ID NO: 221369 - DNA, 20 bp, human
gccaccctcctgccgcactg

SEQ ID NO: 221370 - DNA, 20 bp, human
ggagacccagagccaatgcg

SEQ ID NO: 221371 - DNA, 20 bp, human
ggggagagaagtgtgcgttt

SEQ ID NO: 221372 - DNA, 20 bp, human
ggcagtctggtagttgtcgc

SEQ ID NO: 221373 - DNA, 20 bp, human
ggccgcactgcgggtgtgaa

SEQ ID NO: 221374 - DNA, 20 bp, human
gggatagtagcctgtggtag

SEQ ID NO: 221375 - DNA, 20 bp, human
ggagggactaatccacgcat

SEQ ID NO: 221376 - DNA, 20 bp, human
ggtctctgggtgaagaggaa

SEQ ID NO: 221377 - DNA, 20 bp, human
gactcccagccggaggaagt

SEQ ID NO: 221378 - DNA, 20 bp, human
ggggaggtcgcggggttgag

SEQ ID NO: 221379 - DNA, 20 bp, human
gggcgcatgcgtaataccgc

SEQ ID NO: 221380 - DNA, 20 bp, human
ggtcacagcccaaggggtga

SEQ ID NO: 221381 - DNA, 20 bp, human
gcacacacccgtcacccctt

SEQ ID NO: 221382 - DNA, 20 bp, human
gagcccgggtactcggtctc

SEQ ID NO: 221383 - DNA, 20 bp, human
gactgccgagcccgggtact

SEQ ID NO: 221384 - DNA, 20 bp, human
gggttgaggggggttgtgaa

SEQ ID NO: 221385 - DNA, 20 bp, human
gcacccagagaccgagtacc

SEQ ID NO: 221386 - DNA, 20 bp, human
gactcactggctcaaggggt

SEQ ID NO: 221387 - DNA, 20 bp, human
gggaccacctcttaatgact

SEQ ID NO: 221388 - DNA, 20 bp, human
gaagtgactcactggctcaa

SEQ ID NO: 221389 - DNA, 20 bp, human
ggggagggaaggctttccac

SEQ ID NO: 221390 - DNA, 20 bp, human
gagctccctttgcccagaca

SEQ ID NO: 221391 - DNA, 20 bp, human
gttcaggcccagtcattaag

SEQ ID NO: 221392 - DNA, 20 bp, human
ggtgagtggtcactaaattc

SEQ ID NO: 221393 - DNA, 20 bp, human
ggctttagaggtttgcagag

SEQ ID NO: 221394 - DNA, 20 bp, human
gttgggctctagacaaaaca

SEQ ID NO: 221395 - DNA, 20 bp, human
gttgcccagacatggatagt

SEQ ID NO: 221396 - DNA, 20 bp, human
gtccaaccccggagctgtat

SEQ ID NO: 221397 - DNA, 20 bp, human
gtagcggcccatacagctcc

SEQ ID NO: 221398 - DNA, 20 bp, human
ggtggcgcccaactgctgat

SEQ ID NO: 221399 - DNA, 20 bp, human
gcccaactgctgatcggctc

SEQ ID NO: 221400 - DNA, 20 bp, human
gagcagcggcccgctttgtg

SEQ ID NO: 221401 - DNA, 20 bp, human
gcggggttggaaggttacgc

SEQ ID NO: 221402 - DNA, 20 bp, human
ggcctccggtgtttatttag

SEQ ID NO: 221403 - DNA, 20 bp, human
gcagcccgctaaataaacac

SEQ ID NO: 221404 - DNA, 20 bp, human
gcaacaggcctgaacaatca

SEQ ID NO: 221405 - DNA, 20 bp, human
gagcggcccgctttgtgcgg

SEQ ID NO: 221406 - DNA, 20 bp, human
gggaatctcccctatccctg

SEQ ID NO: 221407 - DNA, 20 bp, human
gcaaagcagccccagggata

SEQ ID NO: 221408 - DNA, 20 bp, human
gcagaataatctgggaggtt

SEQ ID NO: 221409 - DNA, 20 bp, human
gaccagcagaataatctggg

SEQ ID NO: 221410 - DNA, 20 bp, human
ggataggggagattccagag

SEQ ID NO: 221411 - DNA, 20 bp, human
gagagaaatgggcactgccc

SEQ ID NO: 221412 - DNA, 20 bp, human
gaccaggccacagggatgct

SEQ ID NO: 221413 - DNA, 20 bp, human
gggggaggctggatcagtgc

SEQ ID NO: 221414 - DNA, 20 bp, human
gaggcccgtgaccaggccac

SEQ ID NO: 221415 - DNA, 20 bp, human
gtcatgcattctttgatgca

SEQ ID NO: 221416 - DNA, 20 bp, human
ggaggctgagggcagcgggg

SEQ ID NO: 221417 - DNA, 20 bp, human
ggggaagtcatcggaggctg

SEQ ID NO: 221418 - DNA, 20 bp, human
ggcgggggcggggaagtcat

SEQ ID NO: 221419 - DNA, 20 bp, human
gaggcgaggctctgcgcggt

SEQ ID NO: 221420 - DNA, 20 bp, human
gctgtcaccgagcagggcgg

SEQ ID NO: 221421 - DNA, 20 bp, human
gcgcgcaagccaaagctcgg

SEQ ID NO: 221422 - DNA, 20 bp, human
gaatcggaggcacccttcgc

SEQ ID NO: 221423 - DNA, 20 bp, human
ggccaatcgggagctccggc

SEQ ID NO: 221424 - DNA, 20 bp, human
gagaacgtctgtcaccgagc

SEQ ID NO: 221425 - DNA, 20 bp, human
ggcctgccggagctcccgat

SEQ ID NO: 221426 - DNA, 20 bp, human
gcccccctggcagcttcaaa

SEQ ID NO: 221427 - DNA, 20 bp, human
gggggcagacagcaaaggaa

SEQ ID NO: 221428 - DNA, 20 bp, human
gctgggcaggcgggccgacg

SEQ ID NO: 221429 - DNA, 20 bp, human
gggagcaattttcttgtaga

SEQ ID NO: 221430 - DNA, 20 bp, human
ggggctgctaggcccatgag

SEQ ID NO: 221431 - DNA, 20 bp, human
ggggaggctaaaggctgggc

SEQ ID NO: 221432 - DNA, 20 bp, human
gagtgtccccatctgggcag

SEQ ID NO: 221433 - DNA, 20 bp, human
gtgaagctgccaggggggcc

SEQ ID NO: 221434 - DNA, 20 bp, human
gttctggaaggacttcatgt

SEQ ID NO: 221435 - DNA, 20 bp, human
gaattccaggggccactcat

SEQ ID NO: 221436 - DNA, 20 bp, human
gctgtcttgggggacgaggg

SEQ ID NO: 221437 - DNA, 20 bp, human
ggctgcgcggccacctggtc

SEQ ID NO: 221438 - DNA, 20 bp, human
gggcgggaggccggcgcctg

SEQ ID NO: 221439 - DNA, 20 bp, human
gcaaatgagccctcggggcg

SEQ ID NO: 221440 - DNA, 20 bp, human
gaggctgtctgggggaacga

SEQ ID NO: 221441 - DNA, 20 bp, human
gctggggctcccggaccagg

SEQ ID NO: 221442 - DNA, 20 bp, human
ggggaggttttctatcttgg

SEQ ID NO: 221443 - DNA, 20 bp, human
gggccggggtccgggtgtcc

SEQ ID NO: 221444 - DNA, 20 bp, human
gtggctgtcttgggggacga

SEQ ID NO: 221445 - DNA, 20 bp, human
ggcagcagtggcggcacctg

SEQ ID NO: 221446 - DNA, 20 bp, human
gaggcagggcaaggtccccg

SEQ ID NO: 221447 - DNA, 20 bp, human
gtccccggggcagcgtggcc

SEQ ID NO: 221448 - DNA, 20 bp, human
gcctagctctggggccgctg

SEQ ID NO: 221449 - DNA, 20 bp, human
gcggcgggggaggaaccgag

SEQ ID NO: 221450 - DNA, 20 bp, human
gaccttgccctgcctagctc

SEQ ID NO: 221451 - DNA, 20 bp, human
gcggcctccaggtaggtcgg

SEQ ID NO: 221452 - DNA, 20 bp, human
gcctccaggtaggtcggcgg

SEQ ID NO: 221453 - DNA, 20 bp, human
ggggccgctgtggggtgtct

SEQ ID NO: 221454 - DNA, 20 bp, human
gaggagggagatggatggac

SEQ ID NO: 221455 - DNA, 20 bp, human
gcttgtaagcggggaccaga

SEQ ID NO: 221456 - DNA, 20 bp, human
ggtcacgtggggctgacggt

SEQ ID NO: 221457 - DNA, 20 bp, human
gtcgccgcagtcctgtacca

SEQ ID NO: 221458 - DNA, 20 bp, human
ggctgactgcgcagtcacgt

SEQ ID NO: 221459 - DNA, 20 bp, human
gcatccatggtacaggactg

SEQ ID NO: 221460 - DNA, 20 bp, human
gagactgtcatccatggtac

SEQ ID NO: 221461 - DNA, 20 bp, human
gcgcagtcacgtggggctga

SEQ ID NO: 221462 - DNA, 20 bp, human
gatgacagtcttctgcctct

SEQ ID NO: 221463 - DNA, 20 bp, human
gggaaggctggcctttgctc

SEQ ID NO: 221464 - DNA, 20 bp, human
gctgcattaggcctgccgag

SEQ ID NO: 221465 - DNA, 20 bp, human
gagaagatcctgaagctcct

SEQ ID NO: 221466 - DNA, 20 bp, human
gcaagctaaaggcagttgtt

SEQ ID NO: 221467 - DNA, 20 bp, human
ggcgaagcctgggagtcctg

SEQ ID NO: 221468 - DNA, 20 bp, human
ggctgcctgtcttcagacct

SEQ ID NO: 221469 - DNA, 20 bp, human
gatactccacccctgttcgt

SEQ ID NO: 221470 - DNA, 20 bp, human
gaaggagcaaagaacatcct

SEQ ID NO: 221471 - DNA, 20 bp, human
ggacagcagtggcgagggaa

SEQ ID NO: 221472 - DNA, 20 bp, human
ggcagctagagctttataaa

SEQ ID NO: 221473 - DNA, 20 bp, human
gtagatcggcggcgaagcct

SEQ ID NO: 221474 - DNA, 20 bp, human
gctgggacaccaccttctct

SEQ ID NO: 221475 - DNA, 20 bp, human
gacatcctcggctctaagta

SEQ ID NO: 221476 - DNA, 20 bp, human
gggtgggggctctggaccga

SEQ ID NO: 221477 - DNA, 20 bp, human
gtggcccctgcgtgtcgcca

SEQ ID NO: 221478 - DNA, 20 bp, human
ggggtcggggtcagggtcgt

SEQ ID NO: 221479 - DNA, 20 bp, human
gtcacccggtcccccctgat

SEQ ID NO: 221480 - DNA, 20 bp, human
gaccagcgccgcaggctcac

SEQ ID NO: 221481 - DNA, 20 bp, human
ggcggcgcgcccccccgctc

SEQ ID NO: 221482 - DNA, 20 bp, human
gctgtccaatcaggggggac

SEQ ID NO: 221483 - DNA, 20 bp, human
gaaaaccgaagcgggggcga

SEQ ID NO: 221484 - DNA, 20 bp, human
ggcctgtgagcctgcggcgc

SEQ ID NO: 221485 - DNA, 20 bp, human
gacagcagcgaggtcccacc

SEQ ID NO: 221486 - DNA, 20 bp, human
gaaagaaaccccagcctctg

SEQ ID NO: 221487 - DNA, 20 bp, human
gcgctgcggagggagtcgcc

SEQ ID NO: 221488 - DNA, 20 bp, human
gttaaatgggagcgagtggg

SEQ ID NO: 221489 - DNA, 20 bp, human
gaagccgaggagtaatggag

SEQ ID NO: 221490 - DNA, 20 bp, human
ggggttaaatgggagcgagt

SEQ ID NO: 221491 - DNA, 20 bp, human
gaagtaagttcccgtctcct

SEQ ID NO: 221492 - DNA, 20 bp, human
gggggcaagccgaggagtaa

SEQ ID NO: 221493 - DNA, 20 bp, human
ggctgcgggctgggttaaat

SEQ ID NO: 221494 - DNA, 20 bp, human
ggcccgcgtctgactcaagc

SEQ ID NO: 221495 - DNA, 20 bp, human
ggtgttggacaacgctccgg

SEQ ID NO: 221496 - DNA, 20 bp, human
gcgggggcgtcgggagaagg

SEQ ID NO: 221497 - DNA, 20 bp, human
gagaaggcgaacggcaggag

SEQ ID NO: 221498 - DNA, 20 bp, human
gggggcggggacacctgatc

SEQ ID NO: 221499 - DNA, 20 bp, human
ggacacctgatcagggccac

SEQ ID NO: 221500 - DNA, 20 bp, human
gccagcacccagctcacgtg

SEQ ID NO: 221501 - DNA, 20 bp, human
ggcgagagaaggcgaacggc

SEQ ID NO: 221502 - DNA, 20 bp, human
gtgtgtgcgagcgcggtgga

SEQ ID NO: 221503 - DNA, 20 bp, human
gctgatcagggccaccggaa

SEQ ID NO: 221504 - DNA, 20 bp, human
gcatccgcggtccagcccgg

SEQ ID NO: 221505 - DNA, 20 bp, human
gcaaaggcgatgcagtcggc

SEQ ID NO: 221506 - DNA, 20 bp, human
gcccaactgcgggtataaag

SEQ ID NO: 221507 - DNA, 20 bp, human
gccaggttcccaacaggagg

SEQ ID NO: 221508 - DNA, 20 bp, human
gggcaggccaggttcccaac

SEQ ID NO: 221509 - DNA, 20 bp, human
gtcggtggttccacccattt

SEQ ID NO: 221510 - DNA, 20 bp, human
gtatacccgcagttgggcgt

SEQ ID NO: 221511 - DNA, 20 bp, human
gatcaggcccgcctcctgtt

SEQ ID NO: 221512 - DNA, 20 bp, human
gtccgtgttggcccgcgcgg

SEQ ID NO: 221513 - DNA, 20 bp, human
gggccaacacggaccttggg

SEQ ID NO: 221514 - DNA, 20 bp, human
gcgcgggccaacacggacct

SEQ ID NO: 221515 - DNA, 20 bp, human
gggaacctggcctgccaagg

SEQ ID NO: 221516 - DNA, 20 bp, human
gacggagcatgactaggccg

SEQ ID NO: 221517 - DNA, 20 bp, human
gtcccggcgcgcagctgctg

SEQ ID NO: 221518 - DNA, 20 bp, human
ggctctgtctgcggccggga

SEQ ID NO: 221519 - DNA, 20 bp, human
gggcgcaggcgcctgctccg

SEQ ID NO: 221520 - DNA, 20 bp, human
gccggccgcagacagagcgc

SEQ ID NO: 221521 - DNA, 20 bp, human
gctgctcagaggcgacgggg

SEQ ID NO: 221522 - DNA, 20 bp, human
ggccgggacggagcatgact

SEQ ID NO: 221523 - DNA, 20 bp, human
gcccgggggagccctgcagc

SEQ ID NO: 221524 - DNA, 20 bp, human
ggcctagtcatgctccgtcc

SEQ ID NO: 221525 - DNA, 20 bp, human
gtgcggagctgcccgctgca

SEQ ID NO: 221526 - DNA, 20 bp, human
ggaaagtggcagtgtgtacg

SEQ ID NO: 221527 - DNA, 20 bp, human
gaatgagcgcgcggctgtag

SEQ ID NO: 221528 - DNA, 20 bp, human
ggcagccactggacccggac

SEQ ID NO: 221529 - DNA, 20 bp, human
gggccccggtccgggtccag

SEQ ID NO: 221530 - DNA, 20 bp, human
gtacgtgtaagtgcagaaag

SEQ ID NO: 221531 - DNA, 20 bp, human
ggagcgcgcggctgtagggg

SEQ ID NO: 221532 - DNA, 20 bp, human
gcacccgccaccccgggtcg

SEQ ID NO: 221533 - DNA, 20 bp, human
ggcggcgcagccactggacc

SEQ ID NO: 221534 - DNA, 20 bp, human
gccggggtggcgggtggcgt

SEQ ID NO: 221535 - DNA, 20 bp, human
gttggcccggccagcccacg

SEQ ID NO: 221536 - DNA, 20 bp, human
gcgcccggcgggaggcgcct

SEQ ID NO: 221537 - DNA, 20 bp, human
ggaggcgcaggcgacgggtc

SEQ ID NO: 221538 - DNA, 20 bp, human
gcgggtctgggactgggaag

SEQ ID NO: 221539 - DNA, 20 bp, human
gcaggcgacgggtctgggac

SEQ ID NO: 221540 - DNA, 20 bp, human
gaccagacggaaacatcccg

SEQ ID NO: 221541 - DNA, 20 bp, human
gcgcccccgcgagccggaca

SEQ ID NO: 221542 - DNA, 20 bp, human
gctgggactgggaagcggtg

SEQ ID NO: 221543 - DNA, 20 bp, human
gggagcggatggagtcagcg

SEQ ID NO: 221544 - DNA, 20 bp, human
gatcccgaggcgcctcccgc

SEQ ID NO: 221545 - DNA, 20 bp, human
gcgcgagccggacagggcgg

SEQ ID NO: 221546 - DNA, 20 bp, human
ggacgccaatgtggcccagg

SEQ ID NO: 221547 - DNA, 20 bp, human
gcccgcccctcacagagcat

SEQ ID NO: 221548 - DNA, 20 bp, human
gtgggccacattggcgtcag

SEQ ID NO: 221549 - DNA, 20 bp, human
gggcgcaggccaatcacgga

SEQ ID NO: 221550 - DNA, 20 bp, human
gcccactcgaccgccgtcca

SEQ ID NO: 221551 - DNA, 20 bp, human
gcccggcccccggctatgat

SEQ ID NO: 221552 - DNA, 20 bp, human
gcatgggccaatcatagccg

SEQ ID NO: 221553 - DNA, 20 bp, human
ggcagccactgacgccaatg

SEQ ID NO: 221554 - DNA, 20 bp, human
gccaggggactgcaaggcgc

SEQ ID NO: 221555 - DNA, 20 bp, human
ggctggacgggttttgtagt

SEQ ID NO: 221556 - DNA, 20 bp, human
gcggcagcgcagtgagaacc

SEQ ID NO: 221557 - DNA, 20 bp, human
gggtccccgcaagccgccgg

SEQ ID NO: 221558 - DNA, 20 bp, human
ggtcgcgtaaggggtaaggg

SEQ ID NO: 221559 - DNA, 20 bp, human
gacagtcgcgtaaggggtaa

SEQ ID NO: 221560 - DNA, 20 bp, human
gccagcggcgctggagtaag

SEQ ID NO: 221561 - DNA, 20 bp, human
gggcggcttgcggggacccg

SEQ ID NO: 221562 - DNA, 20 bp, human
gtaagtggccaacttaaagt

SEQ ID NO: 221563 - DNA, 20 bp, human
gtctgaaacagtcgcgtaag

SEQ ID NO: 221564 - DNA, 20 bp, human
gcgcgcggggcgccataagg

SEQ ID NO: 221565 - DNA, 20 bp, human
gagtctggggtggtcattct

SEQ ID NO: 221566 - DNA, 20 bp, human
gcaccccgagcgcggaatcc

SEQ ID NO: 221567 - DNA, 20 bp, human
gaggggaaacagcgacgcac

SEQ ID NO: 221568 - DNA, 20 bp, human
gaggctgtaaacaagccaac

SEQ ID NO: 221569 - DNA, 20 bp, human
gactggggtctgaatggcat

SEQ ID NO: 221570 - DNA, 20 bp, human
gagcgcggaatcccggactg

SEQ ID NO: 221571 - DNA, 20 bp, human
gagcacgggcgtgcactcag

SEQ ID NO: 221572 - DNA, 20 bp, human
ggcctctcgcaccccgagcg

SEQ ID NO: 221573 - DNA, 20 bp, human
ggagaggccgctcccgggga

SEQ ID NO: 221574 - DNA, 20 bp, human
gacccggagccccgacggga

SEQ ID NO: 221575 - DNA, 20 bp, human
gcgctacaagtgcagcccgt

SEQ ID NO: 221576 - DNA, 20 bp, human
gaccgccaggtccgcgagga

SEQ ID NO: 221577 - DNA, 20 bp, human
gcagctgcaccgccccgggg

SEQ ID NO: 221578 - DNA, 20 bp, human
gcgagcgacgcggggacaga

SEQ ID NO: 221579 - DNA, 20 bp, human
gggtgcagctggagcgtcag

SEQ ID NO: 221580 - DNA, 20 bp, human
gcagcggagccaactgacgg

SEQ ID NO: 221581 - DNA, 20 bp, human
ggagccccctccttttccag

SEQ ID NO: 221582 - DNA, 20 bp, human
gcggagccaactgacggagg

SEQ ID NO: 221583 - DNA, 20 bp, human
gtatccgggcgaaaacccga

SEQ ID NO: 221584 - DNA, 20 bp, human
gaggaaaggagactaggtgg

SEQ ID NO: 221585 - DNA, 20 bp, human
gctagccagcgagcgacgcg

SEQ ID NO: 221586 - DNA, 20 bp, human
ggctgcctgagggtaggccc

SEQ ID NO: 221587 - DNA, 20 bp, human
gagcccgcacttcctcctcg

SEQ ID NO: 221588 - DNA, 20 bp, human
gtcccggcatgcctcgcatc

SEQ ID NO: 221589 - DNA, 20 bp, human
gtcgagcgagcgctgcctga

SEQ ID NO: 221590 - DNA, 20 bp, human
ggagtgtgggcccaccactg

SEQ ID NO: 221591 - DNA, 20 bp, human
gctgctccagctgacagtgg

SEQ ID NO: 221592 - DNA, 20 bp, human
gtctaagcctggaactggta

SEQ ID NO: 221593 - DNA, 20 bp, human
gagccacctcaggccgcccc

SEQ ID NO: 221594 - DNA, 20 bp, human
ggaaccaggtcctcagtggt

SEQ ID NO: 221595 - DNA, 20 bp, human
gtaggctctaagcctggaac

SEQ ID NO: 221596 - DNA, 20 bp, human
gcccggaagaggcggttggg

SEQ ID NO: 221597 - DNA, 20 bp, human
gcgagcacgcagcagcagaa

SEQ ID NO: 221598 - DNA, 20 bp, human
gaggctgcaacgggggatga

SEQ ID NO: 221599 - DNA, 20 bp, human
ggccaagcgcttagacacac

SEQ ID NO: 221600 - DNA, 20 bp, human
ggccagagagtcgccggcaa

SEQ ID NO: 221601 - DNA, 20 bp, human
ggacacacaggctgcaacgg

SEQ ID NO: 221602 - DNA, 20 bp, human
gctgcccggaagaggcggtt

SEQ ID NO: 221603 - DNA, 20 bp, human
gcctctctgcccggaagagg

SEQ ID NO: 221604 - DNA, 20 bp, human
gcctggagactggttgaatc

SEQ ID NO: 221605 - DNA, 20 bp, human
gtgctgctgcgtgctcgccg

SEQ ID NO: 221606 - DNA, 20 bp, human
gggaggctggggccggaaag

SEQ ID NO: 221607 - DNA, 20 bp, human
gaacctccgggaaagacgct

SEQ ID NO: 221608 - DNA, 20 bp, human
gctccgggaaagacgctggg

SEQ ID NO: 221609 - DNA, 20 bp, human
ggggtcggccctcaggggaa

SEQ ID NO: 221610 - DNA, 20 bp, human
gctcgcgcggcggctaacgc

SEQ ID NO: 221611 - DNA, 20 bp, human
gctaacgctggtcctcggcc

SEQ ID NO: 221612 - DNA, 20 bp, human
gtcatcgggagtcacggggt

SEQ ID NO: 221613 - DNA, 20 bp, human
ggacgctcatcgggagtcac

SEQ ID NO: 221614 - DNA, 20 bp, human
gccgtgcggcgatgaacctc

SEQ ID NO: 221615 - DNA, 20 bp, human
ggagaatggtagacacagag

SEQ ID NO: 221616 - DNA, 20 bp, human
gggaacgcctggtacagata

SEQ ID NO: 221617 - DNA, 20 bp, human
gtgccaggccactgattaag

SEQ ID NO: 221618 - DNA, 20 bp, human
ggcgccctccggcacggaaa

SEQ ID NO: 221619 - DNA, 20 bp, human
ggggaggagtgcggaacgcc

SEQ ID NO: 221620 - DNA, 20 bp, human
gtggcctggcaaacccactc

SEQ ID NO: 221621 - DNA, 20 bp, human
gagttcccctaagtcctaaa

SEQ ID NO: 221622 - DNA, 20 bp, human
ggcacatgcaaaccactggg

SEQ ID NO: 221623 - DNA, 20 bp, human
ggcctggtacagataggggt

SEQ ID NO: 221624 - DNA, 20 bp, human
ggataacaacccatatagag

SEQ ID NO: 221625 - DNA, 20 bp, human
gagactcgcgccctccggca

SEQ ID NO: 221626 - DNA, 20 bp, human
gggggcgctaggtgtgggca

SEQ ID NO: 221627 - DNA, 20 bp, human
gcacgggcagagccacgcgg

SEQ ID NO: 221628 - DNA, 20 bp, human
gtcgagggggcgctaggtgt

SEQ ID NO: 221629 - DNA, 20 bp, human
gccaccccccgcggccttct

SEQ ID NO: 221630 - DNA, 20 bp, human
ggcgcgccgcggggcatgtc

SEQ ID NO: 221631 - DNA, 20 bp, human
ggtggctctgcccgtggtcg

SEQ ID NO: 221632 - DNA, 20 bp, human
gtctactcccagaaggccgc

SEQ ID NO: 221633 - DNA, 20 bp, human
gcgggagcgcacgccctctt

SEQ ID NO: 221634 - DNA, 20 bp, human
gggtgtgggcagggacgagc

SEQ ID NO: 221635 - DNA, 20 bp, human
ggggggtggaccgcctaaga

SEQ ID NO: 221636 - DNA, 20 bp, human
gccggaggggccaaactcgg

SEQ ID NO: 221637 - DNA, 20 bp, human
gaggggccaaactcggaggg

SEQ ID NO: 221638 - DNA, 20 bp, human
ggggtggagcatgcgcggga

SEQ ID NO: 221639 - DNA, 20 bp, human
gcggccggaggggccaaact

SEQ ID NO: 221640 - DNA, 20 bp, human
gtccgccccgctcctcgcgg

SEQ ID NO: 221641 - DNA, 20 bp, human
gagggaggctgacgggagag

SEQ ID NO: 221642 - DNA, 20 bp, human
ggacctctgggtctcggtca

SEQ ID NO: 221643 - DNA, 20 bp, human
ggcgaggagcggggcggact

SEQ ID NO: 221644 - DNA, 20 bp, human
gcgtaccggacaggtcgcaa

SEQ ID NO: 221645 - DNA, 20 bp, human
ggtcgatcgcccggccggag

SEQ ID NO: 221646 - DNA, 20 bp, human
ggtgacctcccaccttgcgg

SEQ ID NO: 221647 - DNA, 20 bp, human
gcagcctccggaagcagaga

SEQ ID NO: 221648 - DNA, 20 bp, human
ggctccaaggtcaggcgccc

SEQ ID NO: 221649 - DNA, 20 bp, human
gtgtcacggggcccctggca

SEQ ID NO: 221650 - DNA, 20 bp, human
gctctctgaacaagacggga

SEQ ID NO: 221651 - DNA, 20 bp, human
ggcatccgcaaccctgccag

SEQ ID NO: 221652 - DNA, 20 bp, human
gtgccctgggcgcctgacct

SEQ ID NO: 221653 - DNA, 20 bp, human
gccgctgactgcacgtgggc

SEQ ID NO: 221654 - DNA, 20 bp, human
gtgagctgtgctgcctgtgc

SEQ ID NO: 221655 - DNA, 20 bp, human
gggggtgactctagcctcac

SEQ ID NO: 221656 - DNA, 20 bp, human
gaagaacgagacacgggcgt

SEQ ID NO: 221657 - DNA, 20 bp, human
gtatctgttcgggcacattg

SEQ ID NO: 221658 - DNA, 20 bp, human
gcacacgtgtgtaggttgca

SEQ ID NO: 221659 - DNA, 20 bp, human
gcaagtggcattttttttaa

SEQ ID NO: 221660 - DNA, 20 bp, human
gccacttgcaacaacgtaga

SEQ ID NO: 221661 - DNA, 20 bp, human
gatgtgcccgaacagataaa

SEQ ID NO: 221662 - DNA, 20 bp, human
gataatgctccaaaaaacat

SEQ ID NO: 221663 - DNA, 20 bp, human
gcatacatatatttttgggg

SEQ ID NO: 221664 - DNA, 20 bp, human
ggggaattcaagatatattt

SEQ ID NO: 221665 - DNA, 20 bp, human
gtgaggttatttccgtatct

SEQ ID NO: 221666 - DNA, 20 bp, human
gaggttccagccaaggtgta

SEQ ID NO: 221667 - DNA, 20 bp, human
gccccggcgcgcccaggtga

SEQ ID NO: 221668 - DNA, 20 bp, human
gtgagcctggcccgacgcac

SEQ ID NO: 221669 - DNA, 20 bp, human
gcagccaaggtgtagggcga

SEQ ID NO: 221670 - DNA, 20 bp, human
gaggggattggcccgtgcgt

SEQ ID NO: 221671 - DNA, 20 bp, human
gccctggcgttctgctgtcc

SEQ ID NO: 221672 - DNA, 20 bp, human
ggcggggtggacacgcgtcc

SEQ ID NO: 221673 - DNA, 20 bp, human
gttgggagcgaatccgtctc

SEQ ID NO: 221674 - DNA, 20 bp, human
gccgtctcaggttccagcca

SEQ ID NO: 221675 - DNA, 20 bp, human
gttggcccgtgcgtcgggcc

SEQ ID NO: 221676 - DNA, 20 bp, human
gggacgctgttggtgttaaa

SEQ ID NO: 221677 - DNA, 20 bp, human
ggcatccgggctaagagctg

SEQ ID NO: 221678 - DNA, 20 bp, human
gcccggggcaagcatgttcg

SEQ ID NO: 221679 - DNA, 20 bp, human
gggggcaagcatgttcgagg

SEQ ID NO: 221680 - DNA, 20 bp, human
gaacaccaacagcgtccccg

SEQ ID NO: 221681 - DNA, 20 bp, human
gtcttccggccggtgaggga

SEQ ID NO: 221682 - DNA, 20 bp, human
gggagccccagctcttagcc

SEQ ID NO: 221683 - DNA, 20 bp, human
gcgggccccggggacgctgt

SEQ ID NO: 221684 - DNA, 20 bp, human
gcctcaccggccggaagacg

SEQ ID NO: 221685 - DNA, 20 bp, human
gtggttcggcgccaggaaag

SEQ ID NO: 221686 - DNA, 20 bp, human
gtgcaaaatgagctcctaag

SEQ ID NO: 221687 - DNA, 20 bp, human
gaaatgagctcctaagagga

SEQ ID NO: 221688 - DNA, 20 bp, human
gtggctctttgtgtatctgg

SEQ ID NO: 221689 - DNA, 20 bp, human
gcagaaaggtcaaatgattc

SEQ ID NO: 221690 - DNA, 20 bp, human
gtagtggctctttgtgtatc

SEQ ID NO: 221691 - DNA, 20 bp, human
gtttctgtttctgcaacgtt

SEQ ID NO: 221692 - DNA, 20 bp, human
gtaaaattaatatagaatga

SEQ ID NO: 221693 - DNA, 20 bp, human
gtttacaactactatatgac

SEQ ID NO: 221694 - DNA, 20 bp, human
gggtcaaatgattctggaaa

SEQ ID NO: 221695 - DNA, 20 bp, human
gaacttgctatgctttttag

SEQ ID NO: 221696 - DNA, 20 bp, human
gggctcgactagaagactaa

SEQ ID NO: 221697 - DNA, 20 bp, human
gaggggacccggccgcgctt

SEQ ID NO: 221698 - DNA, 20 bp, human
gagtcctcaaaggtggtctg

SEQ ID NO: 221699 - DNA, 20 bp, human
gccggccgaggacccatcct

SEQ ID NO: 221700 - DNA, 20 bp, human
ggcccagcgctcacggagta

SEQ ID NO: 221701 - DNA, 20 bp, human
gcgaggacccatcctgggat

SEQ ID NO: 221702 - DNA, 20 bp, human
gtgatcacaaggtccgaagt

SEQ ID NO: 221703 - DNA, 20 bp, human
gccggcccgcccagcgctca

SEQ ID NO: 221704 - DNA, 20 bp, human
gcacgcgggcaagaacgaag

SEQ ID NO: 221705 - DNA, 20 bp, human
gggtctgtggctgatattta

SEQ ID NO: 221706 - DNA, 20 bp, human
gcctcgccatggcagaccac

SEQ ID NO: 221707 - DNA, 20 bp, human
gcttaggtctgttcacagta

SEQ ID NO: 221708 - DNA, 20 bp, human
gagtacatacagcttcgctg

SEQ ID NO: 221709 - DNA, 20 bp, human
gttgatttctgaattgtaaa

SEQ ID NO: 221710 - DNA, 20 bp, human
gtcacactgatcattccctg

SEQ ID NO: 221711 - DNA, 20 bp, human
gaaataaagtaagtactctt

SEQ ID NO: 221712 - DNA, 20 bp, human
ggtatgtactgcctaaaagt

SEQ ID NO: 221713 - DNA, 20 bp, human
ggaaagtatcaccctcgcca

SEQ ID NO: 221714 - DNA, 20 bp, human
gggaacttgttgcttcccca

SEQ ID NO: 221715 - DNA, 20 bp, human
gtgcaagcatcactgagaag

SEQ ID NO: 221716 - DNA, 20 bp, human
ggcccacaggagcttcagaa

SEQ ID NO: 221717 - DNA, 20 bp, human
gtccctggccctgggcaacg

SEQ ID NO: 221718 - DNA, 20 bp, human
gtgctccaggaaaactcgtg

SEQ ID NO: 221719 - DNA, 20 bp, human
gaagctcctgtgggctccct

SEQ ID NO: 221720 - DNA, 20 bp, human
gacccacgttgcccagggcc

SEQ ID NO: 221721 - DNA, 20 bp, human
gaaactttctggtgacagaa

SEQ ID NO: 221722 - DNA, 20 bp, human
gccaggaaaactcgtgagga

SEQ ID NO: 221723 - DNA, 20 bp, human
ggaagggctcggctggaggg

SEQ ID NO: 221724 - DNA, 20 bp, human
gccaaacccagggagcccac

SEQ ID NO: 221725 - DNA, 20 bp, human
gctgttgcacttgctcactg

SEQ ID NO: 221726 - DNA, 20 bp, human
gcggggtcgccgtacagcgc

SEQ ID NO: 221727 - DNA, 20 bp, human
gcgggagggtcagatgacta

SEQ ID NO: 221728 - DNA, 20 bp, human
gtcgccgtacagcgccggga

SEQ ID NO: 221729 - DNA, 20 bp, human
gtccggcgggaagtgagcca

SEQ ID NO: 221730 - DNA, 20 bp, human
gcgtccctcccggcgctgta

SEQ ID NO: 221731 - DNA, 20 bp, human
gatgactacggttacatctc

SEQ ID NO: 221732 - DNA, 20 bp, human
gcgagtgcgacagtattggt

SEQ ID NO: 221733 - DNA, 20 bp, human
gtggagatacgcgtccctcc

SEQ ID NO: 221734 - DNA, 20 bp, human
gtcccgtccggactctgatt

SEQ ID NO: 221735 - DNA, 20 bp, human
ggcccaatcagagtccggac

SEQ ID NO: 221736 - DNA, 20 bp, human
gtgggtccgccagcgcccgg

SEQ ID NO: 221737 - DNA, 20 bp, human
gcccggaggcgggaacctag

SEQ ID NO: 221738 - DNA, 20 bp, human
gcccgggggagggccgacgg

SEQ ID NO: 221739 - DNA, 20 bp, human
gcatctgtgcggtcctgcgc

SEQ ID NO: 221740 - DNA, 20 bp, human
gaggctgacgggttccctgt

SEQ ID NO: 221741 - DNA, 20 bp, human
ggctggccccgcccggggga

SEQ ID NO: 221742 - DNA, 20 bp, human
gcgctgactcagcaacgcga

SEQ ID NO: 221743 - DNA, 20 bp, human
gtccaaggagggaggctgac

SEQ ID NO: 221744 - DNA, 20 bp, human
gcggacccagcgcgtcagct

SEQ ID NO: 221745 - DNA, 20 bp, human
gggcggcctagctgacgcgc

SEQ ID NO: 221746 - DNA, 20 bp, human
gctataactgggaacttcct

SEQ ID NO: 221747 - DNA, 20 bp, human
gtctccaagagaggttcaga

SEQ ID NO: 221748 - DNA, 20 bp, human
gagcagaaagtctccaagag

SEQ ID NO: 221749 - DNA, 20 bp, human
ggaaacttgactatgtgctc

SEQ ID NO: 221750 - DNA, 20 bp, human
gagtccatctgaacctctct

SEQ ID NO: 221751 - DNA, 20 bp, human
ggagtaatcaccaagctggc

SEQ ID NO: 221752 - DNA, 20 bp, human
gagcaggtgcatgctataac

SEQ ID NO: 221753 - DNA, 20 bp, human
gtctacataatcatgtgatc

SEQ ID NO: 221754 - DNA, 20 bp, human
gagaaatttgcctgcccaat

SEQ ID NO: 221755 - DNA, 20 bp, human
ggaaacagactatatgtgtt

SEQ ID NO: 221756 - DNA, 20 bp, human
gagaccttgggtgaagatct

SEQ ID NO: 221757 - DNA, 20 bp, human
gagaggtagagggttgcgga

SEQ ID NO: 221758 - DNA, 20 bp, human
gttcacccaaggtctcaaga

SEQ ID NO: 221759 - DNA, 20 bp, human
ggtgaccgctgtgtcacgtg

SEQ ID NO: 221760 - DNA, 20 bp, human
ggtcacgtgacatggccccg

SEQ ID NO: 221761 - DNA, 20 bp, human
gccaacctcacgtgacacag

SEQ ID NO: 221762 - DNA, 20 bp, human
ggtagagggttgcggagggc

SEQ ID NO: 221763 - DNA, 20 bp, human
gtgtggatctcaggcttcga

SEQ ID NO: 221764 - DNA, 20 bp, human
gaccgccctcttgagacctt

SEQ ID NO: 221765 - DNA, 20 bp, human
gttgggtgaagatcttggcg

SEQ ID NO: 221766 - DNA, 20 bp, human
gacacagcaaagggcgattc

SEQ ID NO: 221767 - DNA, 20 bp, human
ggtacccggaatggatgggg

SEQ ID NO: 221768 - DNA, 20 bp, human
gaacagcgcggggtccgcta

SEQ ID NO: 221769 - DNA, 20 bp, human
gacgtcgcgactgttggcag

SEQ ID NO: 221770 - DNA, 20 bp, human
ggggcctggggctccgtctc

SEQ ID NO: 221771 - DNA, 20 bp, human
gggactggaccgctaggcgc

SEQ ID NO: 221772 - DNA, 20 bp, human
gcctacagtcacaccctgga

SEQ ID NO: 221773 - DNA, 20 bp, human
gcaggtctatgacacagcaa

SEQ ID NO: 221774 - DNA, 20 bp, human
ggggaggaagcgtccggtgg

SEQ ID NO: 221775 - DNA, 20 bp, human
gcggaccccgcgctgtttcc

SEQ ID NO: 221776 - DNA, 20 bp, human
gtgcagaagagtcacatgaa

SEQ ID NO: 221777 - DNA, 20 bp, human
gttgtgcgacgaggaaagtc

SEQ ID NO: 221778 - DNA, 20 bp, human
gggcccagctgtttctctat

SEQ ID NO: 221779 - DNA, 20 bp, human
gcgggcgaatccacgtgact

SEQ ID NO: 221780 - DNA, 20 bp, human
gtctcaccgtggcagctgaa

SEQ ID NO: 221781 - DNA, 20 bp, human
gcagctgggccggctcttcc

SEQ ID NO: 221782 - DNA, 20 bp, human
gggcgcgagccctcctactc

SEQ ID NO: 221783 - DNA, 20 bp, human
gagtctggagtggaccaata

SEQ ID NO: 221784 - DNA, 20 bp, human
gccagctgtttctctattgg

SEQ ID NO: 221785 - DNA, 20 bp, human
gcgggttgggcgggcattag

SEQ ID NO: 221786 - DNA, 20 bp, human
ggggagaggaaccagatcta

SEQ ID NO: 221787 - DNA, 20 bp, human
ggggccctggtctccgcagt

SEQ ID NO: 221788 - DNA, 20 bp, human
gcaggcggcagggtcaggat

SEQ ID NO: 221789 - DNA, 20 bp, human
ggccccactatccttagatc

SEQ ID NO: 221790 - DNA, 20 bp, human
gaaccagatctaaggatagt

SEQ ID NO: 221791 - DNA, 20 bp, human
gaacccctactgcggagacc

SEQ ID NO: 221792 - DNA, 20 bp, human
gcccatcttggtgtcaccca

SEQ ID NO: 221793 - DNA, 20 bp, human
ggggaccggattagccccca

SEQ ID NO: 221794 - DNA, 20 bp, human
gggggctaatccggtcccct

SEQ ID NO: 221795 - DNA, 20 bp, human
gtcacccatgggggctaatc

SEQ ID NO: 221796 - DNA, 20 bp, human
ggggaggccggaaacaaagg

SEQ ID NO: 221797 - DNA, 20 bp, human
ggctgggaggccggaaacaa

SEQ ID NO: 221798 - DNA, 20 bp, human
gtgagcgtgagcgcgctggg

SEQ ID NO: 221799 - DNA, 20 bp, human
gacaggagggagacgttcat

SEQ ID NO: 221800 - DNA, 20 bp, human
gcgtgaacagacgccctcgc

SEQ ID NO: 221801 - DNA, 20 bp, human
gtgcttccggcggcctgcga

SEQ ID NO: 221802 - DNA, 20 bp, human
gggtctggatagaagatgca

SEQ ID NO: 221803 - DNA, 20 bp, human
gctcacgcctttgcttccgg

SEQ ID NO: 221804 - DNA, 20 bp, human
gaaaaggttgaatgtgagtt

SEQ ID NO: 221805 - DNA, 20 bp, human
ggcgtgagcgtgagcgcgct

SEQ ID NO: 221806 - DNA, 20 bp, human
gccagcgggcggttccggaa

SEQ ID NO: 221807 - DNA, 20 bp, human
gaggcgcctgccgtgtagtc

SEQ ID NO: 221808 - DNA, 20 bp, human
gccgccatgctggatcaggg

SEQ ID NO: 221809 - DNA, 20 bp, human
gtacacggcaggcgcctttc

SEQ ID NO: 221810 - DNA, 20 bp, human
gcatccgccctgatccagca

SEQ ID NO: 221811 - DNA, 20 bp, human
ggggcggatgctgctagaat

SEQ ID NO: 221812 - DNA, 20 bp, human
gcggaactggtcgggatgag

SEQ ID NO: 221813 - DNA, 20 bp, human
gcacagcctgactacacggc

SEQ ID NO: 221814 - DNA, 20 bp, human
gtgggtagattaaatttctc

SEQ ID NO: 221815 - DNA, 20 bp, human
gagttcacagcctgactaca

SEQ ID NO: 221816 - DNA, 20 bp, human
gtcagcggactcagcagtgt

SEQ ID NO: 221817 - DNA, 20 bp, human
ggccccggacgcagtgtcag

SEQ ID NO: 221818 - DNA, 20 bp, human
ggggtccccacaacgccatg

SEQ ID NO: 221819 - DNA, 20 bp, human
gtccgctgacactgcgtccg

SEQ ID NO: 221820 - DNA, 20 bp, human
gctcccaccaatcggatcgc

SEQ ID NO: 221821 - DNA, 20 bp, human
gtcccccagctcccaccaat

SEQ ID NO: 221822 - DNA, 20 bp, human
gtccctgcgatccgattggt

SEQ ID NO: 221823 - DNA, 20 bp, human
gtttgggctgctcacggggt

SEQ ID NO: 221824 - DNA, 20 bp, human
gcggggtgggtcacgaagac

SEQ ID NO: 221825 - DNA, 20 bp, human
ggtcgcacccggaagtgacg

SEQ ID NO: 221826 - DNA, 20 bp, human
ggaccggaggcggtggggaa

SEQ ID NO: 221827 - DNA, 20 bp, human
ggggaagggagtggacggaa

SEQ ID NO: 221828 - DNA, 20 bp, human
gaccgggaggggaccggagg

SEQ ID NO: 221829 - DNA, 20 bp, human
ggccccaggcgccagaccca

SEQ ID NO: 221830 - DNA, 20 bp, human
gaagcggggtggcggagacc

SEQ ID NO: 221831 - DNA, 20 bp, human
gaagctgggtgcagagaaca

SEQ ID NO: 221832 - DNA, 20 bp, human
gcacccctcgccaccaagct

SEQ ID NO: 221833 - DNA, 20 bp, human
gacgcgcgaccgcacgaggc

SEQ ID NO: 221834 - DNA, 20 bp, human
gccccagccgggcagccaat

SEQ ID NO: 221835 - DNA, 20 bp, human
gtggctgcccggctgggggg

SEQ ID NO: 221836 - DNA, 20 bp, human
ggcacaactcacaagtgcgg

SEQ ID NO: 221837 - DNA, 20 bp, human
gcaactcacaagtgcggggg

SEQ ID NO: 221838 - DNA, 20 bp, human
ggttagacccacacatattc

SEQ ID NO: 221839 - DNA, 20 bp, human
gccacacatattctggcgtg

SEQ ID NO: 221840 - DNA, 20 bp, human
gagcgccttaaaaaatctaa

SEQ ID NO: 221841 - DNA, 20 bp, human
ggcacacatgagttgaaata

SEQ ID NO: 221842 - DNA, 20 bp, human
gaaggccttttcaaagtctg

SEQ ID NO: 221843 - DNA, 20 bp, human
gcacatgagttgaaatatgg

SEQ ID NO: 221844 - DNA, 20 bp, human
gcacctgaaatctgagaact

SEQ ID NO: 221845 - DNA, 20 bp, human
gaatattcaactattcactc

SEQ ID NO: 221846 - DNA, 20 bp, human
gcgcggctcaggtcaagggg

SEQ ID NO: 221847 - DNA, 20 bp, human
gtctaagtggcgcgcagaga

SEQ ID NO: 221848 - DNA, 20 bp, human
gcgcccgcggctcaggtcaa

SEQ ID NO: 221849 - DNA, 20 bp, human
ggccgcgggcggagagtctg

SEQ ID NO: 221850 - DNA, 20 bp, human
gcgcgcagagagggcggtgc

SEQ ID NO: 221851 - DNA, 20 bp, human
gccccgccttccagtctaag

SEQ ID NO: 221852 - DNA, 20 bp, human
ggccaggcgagcctcaccca

SEQ ID NO: 221853 - DNA, 20 bp, human
gctactcaagccaggaacaa

SEQ ID NO: 221854 - DNA, 20 bp, human
gcgccacttagactggaagg

SEQ ID NO: 221855 - DNA, 20 bp, human
ggctgagtgacaagttatct

SEQ ID NO: 221856 - DNA, 20 bp, human
ggaggggcgggtctgtcgat

SEQ ID NO: 221857 - DNA, 20 bp, human
gccctccacgctgtcgcctg

SEQ ID NO: 221858 - DNA, 20 bp, human
ggatctcagcactagaaaat

SEQ ID NO: 221859 - DNA, 20 bp, human
gccactaaggacgaagaggt

SEQ ID NO: 221860 - DNA, 20 bp, human
gccactgtcgcacgaggcgt

SEQ ID NO: 221861 - DNA, 20 bp, human
gagagctgctggatatgcgg

SEQ ID NO: 221862 - DNA, 20 bp, human
ggatgccagaagaacggctc

SEQ ID NO: 221863 - DNA, 20 bp, human
gaaccctgagtaatcggaag

SEQ ID NO: 221864 - DNA, 20 bp, human
gactgccggaaacagaataa

SEQ ID NO: 221865 - DNA, 20 bp, human
ggtagccccaggcgacagcg

SEQ ID NO: 221866 - DNA, 20 bp, human
gacagaatccgcactggcga

SEQ ID NO: 221867 - DNA, 20 bp, human
gctgtccctaacacaggctc

SEQ ID NO: 221868 - DNA, 20 bp, human
ggagtgaagcgccaagtccc

SEQ ID NO: 221869 - DNA, 20 bp, human
ggcttccagagcctgtgtta

SEQ ID NO: 221870 - DNA, 20 bp, human
gcacgccgaggactgaccaa

SEQ ID NO: 221871 - DNA, 20 bp, human
gccccctgcgcgtcacgccg

SEQ ID NO: 221872 - DNA, 20 bp, human
ggctgcgcgtccacaaaggg

SEQ ID NO: 221873 - DNA, 20 bp, human
gccgactgcgcttctggcga

SEQ ID NO: 221874 - DNA, 20 bp, human
gccccttgcaatgtttccat

SEQ ID NO: 221875 - DNA, 20 bp, human
gttcccatggaaacattgca

SEQ ID NO: 221876 - DNA, 20 bp, human
gtgctcccctcattccttaa

SEQ ID NO: 221877 - DNA, 20 bp, human
ggcggcctgggaattagtgt

SEQ ID NO: 221878 - DNA, 20 bp, human
gtacaccgacactaattccc

SEQ ID NO: 221879 - DNA, 20 bp, human
ggaaaaaaatgcaccgctga

SEQ ID NO: 221880 - DNA, 20 bp, human
ggccgcccttaaggaatgag

SEQ ID NO: 221881 - DNA, 20 bp, human
gaattagtgtcggtgtagtc

SEQ ID NO: 221882 - DNA, 20 bp, human
ggggagcacgtgacccgctg

SEQ ID NO: 221883 - DNA, 20 bp, human
ggggagaaagaaagaacggg

SEQ ID NO: 221884 - DNA, 20 bp, human
gaattcccaggccgccctta

SEQ ID NO: 221885 - DNA, 20 bp, human
ggcagagtggaaactgacac

SEQ ID NO: 221886 - DNA, 20 bp, human
gccgccccccgctcggtccg

SEQ ID NO: 221887 - DNA, 20 bp, human
gggagccgcggaccgagcgg

SEQ ID NO: 221888 - DNA, 20 bp, human
ggcccggccgagcactgtcc

SEQ ID NO: 221889 - DNA, 20 bp, human
gactgtcccggccccgaggg

SEQ ID NO: 221890 - DNA, 20 bp, human
gtcgcgatcgagcaagcaag

SEQ ID NO: 221891 - DNA, 20 bp, human
gggcgccgaaagcccgtgga

SEQ ID NO: 221892 - DNA, 20 bp, human
gggtccaagaaggggagata

SEQ ID NO: 221893 - DNA, 20 bp, human
gtggagcccgaggacgagcg

SEQ ID NO: 221894 - DNA, 20 bp, human
gactccccccccccttttta

SEQ ID NO: 221895 - DNA, 20 bp, human
ggctctgcccccctcggggc

SEQ ID NO: 221896 - DNA, 20 bp, human
gtacactagggagataagaa

SEQ ID NO: 221897 - DNA, 20 bp, human
gaaaggctaggcccctatag

SEQ ID NO: 221898 - DNA, 20 bp, human
gtggtgcacaagtttacact

SEQ ID NO: 221899 - DNA, 20 bp, human
gaaagtcaggttgcagtaat

SEQ ID NO: 221900 - DNA, 20 bp, human
gtagggagataagaaaggct

SEQ ID NO: 221901 - DNA, 20 bp, human
gtactgcaacctgactttta

SEQ ID NO: 221902 - DNA, 20 bp, human
ggataacaaaatcccctata

SEQ ID NO: 221903 - DNA, 20 bp, human
gcaaacttgtctccagtgac

SEQ ID NO: 221904 - DNA, 20 bp, human
gctcaaccagtgtcagaatg

SEQ ID NO: 221905 - DNA, 20 bp, human
gcatgttaatttgagaggta

SEQ ID NO: 221906 - DNA, 20 bp, human
gggccccaacacaagcccaa

SEQ ID NO: 221907 - DNA, 20 bp, human
gtgtaggggcaagtaggatc

SEQ ID NO: 221908 - DNA, 20 bp, human
gtggctccacaaccaaggat

SEQ ID NO: 221909 - DNA, 20 bp, human
ggcaaagaggccaagttatg

SEQ ID NO: 221910 - DNA, 20 bp, human
ggtcccttgggcttgtgttg

SEQ ID NO: 221911 - DNA, 20 bp, human
gccaagttatgaggcaactt

SEQ ID NO: 221912 - DNA, 20 bp, human
gtatgaggcaactttggtcc

SEQ ID NO: 221913 - DNA, 20 bp, human
gatgcccctcccgctctccc

SEQ ID NO: 221914 - DNA, 20 bp, human
ggcattagaggcatggaagt

SEQ ID NO: 221915 - DNA, 20 bp, human
gctatgttgctttctctaag

SEQ ID NO: 221916 - DNA, 20 bp, human
gccgcccgctcggggatccc

SEQ ID NO: 221917 - DNA, 20 bp, human
gcgggcgggagctgcgcgca

SEQ ID NO: 221918 - DNA, 20 bp, human
gtcgccggggatccccgagc

SEQ ID NO: 221919 - DNA, 20 bp, human
gctggcgcgccggaccctcg

SEQ ID NO: 221920 - DNA, 20 bp, human
ggcgcgagcgccccccttgg

SEQ ID NO: 221921 - DNA, 20 bp, human
gggggcgcgcggccgccaag

SEQ ID NO: 221922 - DNA, 20 bp, human
gagggggaggtgttcggccg

SEQ ID NO: 221923 - DNA, 20 bp, human
gaccctcgcggggactctgg

SEQ ID NO: 221924 - DNA, 20 bp, human
gtaaaggggacgccgcctgc

SEQ ID NO: 221925 - DNA, 20 bp, human
ggaggcgcgagcgcccccct

SEQ ID NO: 221926 - DNA, 20 bp, human
gcaaacgtttgggataatga

SEQ ID NO: 221927 - DNA, 20 bp, human
ggaccgaagctcaaacgttt

SEQ ID NO: 221928 - DNA, 20 bp, human
gtggctggcgtgcctcctcc

SEQ ID NO: 221929 - DNA, 20 bp, human
ggaactcgggtgactcacgt

SEQ ID NO: 221930 - DNA, 20 bp, human
gaggactgggcggggaactc

SEQ ID NO: 221931 - DNA, 20 bp, human
gaagtgacagtcattggcgc

SEQ ID NO: 221932 - DNA, 20 bp, human
gatgggagcgataaatcatc

SEQ ID NO: 221933 - DNA, 20 bp, human
gtcattggcgctggtttggt

SEQ ID NO: 221934 - DNA, 20 bp, human
gacaaaaaagtgacagtcat

SEQ ID NO: 221935 - DNA, 20 bp, human
gcgggccgcgggggcgcgag

SEQ ID NO: 221936 - DNA, 20 bp, human
gggagcgcgagccggggtag

SEQ ID NO: 221937 - DNA, 20 bp, human
gtgggcggccggcccctcca

SEQ ID NO: 221938 - DNA, 20 bp, human
gcaggcgcttagtgaggcgg

SEQ ID NO: 221939 - DNA, 20 bp, human
gggggcgggtccgaatccag

SEQ ID NO: 221940 - DNA, 20 bp, human
gccgccggaagtgacggttc

SEQ ID NO: 221941 - DNA, 20 bp, human
ggtcgcccggcctcagtgag

SEQ ID NO: 221942 - DNA, 20 bp, human
ggggactagggcaaagtcgg

SEQ ID NO: 221943 - DNA, 20 bp, human
ggccgcctccgccagtgccc

SEQ ID NO: 221944 - DNA, 20 bp, human
ggcggcgtcgcccctggatt

SEQ ID NO: 221945 - DNA, 20 bp, human
gtgaggcggcgggacgcccg

SEQ ID NO: 221946 - DNA, 20 bp, human
ggctaagagggcgaggacga

SEQ ID NO: 221947 - DNA, 20 bp, human
gagcctggtgcaagctaaga

SEQ ID NO: 221948 - DNA, 20 bp, human
gcctcccgctgccagttctc

SEQ ID NO: 221949 - DNA, 20 bp, human
ggggggagtaaccagagaac

SEQ ID NO: 221950 - DNA, 20 bp, human
gcgccctcttagcttgcacc

SEQ ID NO: 221951 - DNA, 20 bp, human
ggagagaggggcgttatgat

SEQ ID NO: 221952 - DNA, 20 bp, human
ggactaaagaaatggtagga

SEQ ID NO: 221953 - DNA, 20 bp, human
gtgtccgtcagaagaggctc

SEQ ID NO: 221954 - DNA, 20 bp, human
gaccacacagccactgttct

SEQ ID NO: 221955 - DNA, 20 bp, human
gggtatgctctcagaaagac

SEQ ID NO: 221956 - DNA, 20 bp, human
gcctgctaggcgaggtcggg

SEQ ID NO: 221957 - DNA, 20 bp, human
ggggcctgctaggcgaggtc

SEQ ID NO: 221958 - DNA, 20 bp, human
ggacccgggcctgctaggcg

SEQ ID NO: 221959 - DNA, 20 bp, human
gtcgctcgcctccctttctg

SEQ ID NO: 221960 - DNA, 20 bp, human
gctaggcgaggtcgggcggc

SEQ ID NO: 221961 - DNA, 20 bp, human
ggcctgggcttccgggaccc

SEQ ID NO: 221962 - DNA, 20 bp, human
gcgcctccctttctggggat

SEQ ID NO: 221963 - DNA, 20 bp, human
gacctggggaccacgtgcgg

SEQ ID NO: 221964 - DNA, 20 bp, human
gggaaggtacggcgactagt

SEQ ID NO: 221965 - DNA, 20 bp, human
gctcacctggggaccacgtg

SEQ ID NO: 221966 - DNA, 20 bp, human
gcccgcggcaggcggcgaaa

SEQ ID NO: 221967 - DNA, 20 bp, human
ggcccgagcctcagcggtcc

SEQ ID NO: 221968 - DNA, 20 bp, human
gcgagcctcagcggtccggg

SEQ ID NO: 221969 - DNA, 20 bp, human
gggcgctcacgtgactccga

SEQ ID NO: 221970 - DNA, 20 bp, human
gtcgccgcctgccgcgggag

SEQ ID NO: 221971 - DNA, 20 bp, human
gaccgctgaggctcgggcgg

SEQ ID NO: 221972 - DNA, 20 bp, human
ggccgcggggcaccggccga

SEQ ID NO: 221973 - DNA, 20 bp, human
gttggcctcgcctggagggg

SEQ ID NO: 221974 - DNA, 20 bp, human
ggtccgggaggagctcccgg

SEQ ID NO: 221975 - DNA, 20 bp, human
gaggagctcccggcggcgct

SEQ ID NO: 221976 - DNA, 20 bp, human
gatgggacatacaaattcta

SEQ ID NO: 221977 - DNA, 20 bp, human
gagtgtaagcacaaccctgc

SEQ ID NO: 221978 - DNA, 20 bp, human
gaacatgaaacagtgatgca

SEQ ID NO: 221979 - DNA, 20 bp, human
gcacttctgtattaagtctc

SEQ ID NO: 221980 - DNA, 20 bp, human
ggtgaaaatggagacttttc

SEQ ID NO: 221981 - DNA, 20 bp, human
gaagttagcttgatgaatct

SEQ ID NO: 221982 - DNA, 20 bp, human
gctgtttcatgttagatgcg

SEQ ID NO: 221983 - DNA, 20 bp, human
gaaggatgagttgtaaattg

SEQ ID NO: 221984 - DNA, 20 bp, human
gcttaaagacacttaaagct

SEQ ID NO: 221985 - DNA, 20 bp, human
gaaagaagtactatgtaaaa

SEQ ID NO: 221986 - DNA, 20 bp, human
ggacaggctggcagccaatg

SEQ ID NO: 221987 - DNA, 20 bp, human
gaggcgacgcctctcgggag

SEQ ID NO: 221988 - DNA, 20 bp, human
gccgccccgcggtaaccgac

SEQ ID NO: 221989 - DNA, 20 bp, human
ggacgcctctcgggagaggg

SEQ ID NO: 221990 - DNA, 20 bp, human
gaatggggacgcgaagctcg

SEQ ID NO: 221991 - DNA, 20 bp, human
gcatgcctccaagaattccc

SEQ ID NO: 221992 - DNA, 20 bp, human
gggcggaggcgacgcctctc

SEQ ID NO: 221993 - DNA, 20 bp, human
gtccccgcagcggccaacgt

SEQ ID NO: 221994 - DNA, 20 bp, human
gaagacccgggaattcttgg

SEQ ID NO: 221995 - DNA, 20 bp, human
gaagagccgcgaggtgccaa

SEQ ID NO: 221996 - DNA, 20 bp, human
gcgcgccggaggttggaaga

SEQ ID NO: 221997 - DNA, 20 bp, human
ggcgggacgtcgcggggatg

SEQ ID NO: 221998 - DNA, 20 bp, human
ggagcctggcgggacgtcgc

SEQ ID NO: 221999 - DNA, 20 bp, human
gcggcctcttgtgcgatcca

SEQ ID NO: 222000 - DNA, 20 bp, human
gcggctggaggaatcggagc

SEQ ID NO: 222001 - DNA, 20 bp, human
ggccccagcgcgtaccactc

SEQ ID NO: 222002 - DNA, 20 bp, human
gccggaggttggaagagggt

SEQ ID NO: 222003 - DNA, 20 bp, human
gtaccactctggcgctcccg

SEQ ID NO: 222004 - DNA, 20 bp, human
gagaaagcagcgtctgatgg

SEQ ID NO: 222005 - DNA, 20 bp, human
ggaccgcggtgggaaaagtt

SEQ ID NO: 222006 - DNA, 20 bp, human
gcgaccccgaggtgcgacct

SEQ ID NO: 222007 - DNA, 20 bp, human
gagccggggcaaggactcgc

SEQ ID NO: 222008 - DNA, 20 bp, human
gcgccgcccggggctcctag

SEQ ID NO: 222009 - DNA, 20 bp, human
gccgcgcccgctaggagccc

SEQ ID NO: 222010 - DNA, 20 bp, human
gaggggcgaccggcgagctc

SEQ ID NO: 222011 - DNA, 20 bp, human
gacagccggactggtgggaa

SEQ ID NO: 222012 - DNA, 20 bp, human
ggcccgctaggagccccggg

SEQ ID NO: 222013 - DNA, 20 bp, human
ggccgccgttcccaccagtc

SEQ ID NO: 222014 - DNA, 20 bp, human
ggaagcgcatgcaggggcca

SEQ ID NO: 222015 - DNA, 20 bp, human
gccacgccgaggtcgcacct

SEQ ID NO: 222016 - DNA, 20 bp, human
ggggctgcggccggtgtcgc

SEQ ID NO: 222017 - DNA, 20 bp, human
gcacgcctgcgagggggccc

SEQ ID NO: 222018 - DNA, 20 bp, human
ggggcagggcagggactcgc

SEQ ID NO: 222019 - DNA, 20 bp, human
gacagccggactggcgggta

SEQ ID NO: 222020 - DNA, 20 bp, human
gcccgggactgaccaatggg

SEQ ID NO: 222021 - DNA, 20 bp, human
gcgaggccggggctactctg

SEQ ID NO: 222022 - DNA, 20 bp, human
gtgcggccggtgtcgcgggt

SEQ ID NO: 222023 - DNA, 20 bp, human
gtcgcgggaaccgcaccaag

SEQ ID NO: 222024 - DNA, 20 bp, human
gggcgcacgccgcgcagcga

SEQ ID NO: 222025 - DNA, 20 bp, human
ggccgccgtacccgccagtc

SEQ ID NO: 222026 - DNA, 20 bp, human
gcccctcagcgccggagagg

SEQ ID NO: 222027 - DNA, 20 bp, human
ggggagagaccaaggtgtgg

SEQ ID NO: 222028 - DNA, 20 bp, human
ggcccccagcgggttccggg

SEQ ID NO: 222029 - DNA, 20 bp, human
ggcgcgacagcgaactcagg

SEQ ID NO: 222030 - DNA, 20 bp, human
ggccccctctccggcgctga

SEQ ID NO: 222031 - DNA, 20 bp, human
gcagccggagatagactgag

SEQ ID NO: 222032 - DNA, 20 bp, human
gggcaggaggtgaggagtgc

SEQ ID NO: 222033 - DNA, 20 bp, human
gcactgcaagcaactccctc

SEQ ID NO: 222034 - DNA, 20 bp, human
gcgcctcccggaacccgctg

SEQ ID NO: 222035 - DNA, 20 bp, human
gcggccaggctcctccgatg

SEQ ID NO: 222036 - DNA, 20 bp, human
ggaagcgcccgaagagttcg

SEQ ID NO: 222037 - DNA, 20 bp, human
ggagcccggcgcccagttgc

SEQ ID NO: 222038 - DNA, 20 bp, human
gccgggctccgcgaactctt

SEQ ID NO: 222039 - DNA, 20 bp, human
gccctcctggcaagagtcgg

SEQ ID NO: 222040 - DNA, 20 bp, human
gctggtgcgggcgggagtcg

SEQ ID NO: 222041 - DNA, 20 bp, human
gcgccgcgcgcacccgacca

SEQ ID NO: 222042 - DNA, 20 bp, human
gagggccagccgccggcaag

SEQ ID NO: 222043 - DNA, 20 bp, human
gcggcgcgcgcgcactggga

SEQ ID NO: 222044 - DNA, 20 bp, human
gagcacgcgatggaacgcgg

SEQ ID NO: 222045 - DNA, 20 bp, human
gtggggctggcttgtgggga

SEQ ID NO: 222046 - DNA, 20 bp, human
gcactagtgggagctggaga

SEQ ID NO: 222047 - DNA, 20 bp, human
gaatccctccgctaagtact

SEQ ID NO: 222048 - DNA, 20 bp, human
gatgctctgagcagcggacg

SEQ ID NO: 222049 - DNA, 20 bp, human
gacccatgagggaaatcttg

SEQ ID NO: 222050 - DNA, 20 bp, human
ggcactccgcacacaggcgg

SEQ ID NO: 222051 - DNA, 20 bp, human
ggaagcgcacccctgtaccc

SEQ ID NO: 222052 - DNA, 20 bp, human
gtccagctcccactagtgat

SEQ ID NO: 222053 - DNA, 20 bp, human
gcagcgccgccgcctgtgtg

SEQ ID NO: 222054 - DNA, 20 bp, human
gcggaggcagcccgggtaca

SEQ ID NO: 222055 - DNA, 20 bp, human
gttggggatgctctgagcag

SEQ ID NO: 222056 - DNA, 20 bp, human
gcggccccgcccctcgttcg

SEQ ID NO: 222057 - DNA, 20 bp, human
gcccgcccctcgttcggggc

SEQ ID NO: 222058 - DNA, 20 bp, human
gccaccgcagcgcgtctctc

SEQ ID NO: 222059 - DNA, 20 bp, human
gctctccggtgaatggccga

SEQ ID NO: 222060 - DNA, 20 bp, human
ggaagagccggagactgagg

SEQ ID NO: 222061 - DNA, 20 bp, human
gtcaccggagagacgcgctg

SEQ ID NO: 222062 - DNA, 20 bp, human
ggcggggcgactccggtgac

SEQ ID NO: 222063 - DNA, 20 bp, human
gcctcgttcggggctggctg

SEQ ID NO: 222064 - DNA, 20 bp, human
ggccagccccgaacgagggg

SEQ ID NO: 222065 - DNA, 20 bp, human
gctgcggcgctcccggtcac

SEQ ID NO: 222066 - DNA, 20 bp, human
gtggaaggacctggacccgg

SEQ ID NO: 222067 - DNA, 20 bp, human
gtcaccgtgccaaggacgga

SEQ ID NO: 222068 - DNA, 20 bp, human
gaaagagaccggcatgggga

SEQ ID NO: 222069 - DNA, 20 bp, human
gtggcgccggttagttagtg

SEQ ID NO: 222070 - DNA, 20 bp, human
gtggcacggtgactgccggg

SEQ ID NO: 222071 - DNA, 20 bp, human
gttctcgccgaaggccaggg

SEQ ID NO: 222072 - DNA, 20 bp, human
gtggccttcggcgagaactc

SEQ ID NO: 222073 - DNA, 20 bp, human
gagaggaatctggaaggacc

SEQ ID NO: 222074 - DNA, 20 bp, human
gtccgcggcctcaacttccg

SEQ ID NO: 222075 - DNA, 20 bp, human
ggcggcctcaacttccgcgg

SEQ ID NO: 222076 - DNA, 20 bp, human
gatgtacccgagagctgcct

SEQ ID NO: 222077 - DNA, 20 bp, human
gtgattgaacgcaacaaaaa

SEQ ID NO: 222078 - DNA, 20 bp, human
ggagctctacaaacaaaggc

SEQ ID NO: 222079 - DNA, 20 bp, human
gtgcactttgcattacctaa

SEQ ID NO: 222080 - DNA, 20 bp, human
ggttgagcgtggtttcctgt

SEQ ID NO: 222081 - DNA, 20 bp, human
gcatagagctctacaaacaa

SEQ ID NO: 222082 - DNA, 20 bp, human
ggagccttacacaatcccac

SEQ ID NO: 222083 - DNA, 20 bp, human
ggttggctaagtgttgagcg

SEQ ID NO: 222084 - DNA, 20 bp, human
gggattgtgtaaggctctgt

SEQ ID NO: 222085 - DNA, 20 bp, human
gcttttcccaggcagctctc

SEQ ID NO: 222086 - DNA, 20 bp, human
gaagcagcgcccgcggcgtg

SEQ ID NO: 222087 - DNA, 20 bp, human
gaggtctccgcggtctgcgg

SEQ ID NO: 222088 - DNA, 20 bp, human
gagggcgccccagggtagga

SEQ ID NO: 222089 - DNA, 20 bp, human
gcgccccagggtaggagggg

SEQ ID NO: 222090 - DNA, 20 bp, human
gaggggcggagaggcgtccc

SEQ ID NO: 222091 - DNA, 20 bp, human
ggccgccggcgaggtctccg

SEQ ID NO: 222092 - DNA, 20 bp, human
gccgtggcccccgcagaccg

SEQ ID NO: 222093 - DNA, 20 bp, human
gaccgcggagacctcgccgg

SEQ ID NO: 222094 - DNA, 20 bp, human
gcgggaggcggcctcccggg

SEQ ID NO: 222095 - DNA, 20 bp, human
gtagggcgttatccggtccc

SEQ ID NO: 222096 - DNA, 20 bp, human
gaggagccggggaaccgtgc

SEQ ID NO: 222097 - DNA, 20 bp, human
gaggcccggaggaactcgga

SEQ ID NO: 222098 - DNA, 20 bp, human
gcccagccggcacggttccc

SEQ ID NO: 222099 - DNA, 20 bp, human
gccccgagtcccagccggca

SEQ ID NO: 222100 - DNA, 20 bp, human
gtcgcgccccgagtcccagc

SEQ ID NO: 222101 - DNA, 20 bp, human
ggcgggcgaggtgacctcgg

SEQ ID NO: 222102 - DNA, 20 bp, human
gccggcgggcgaggtgacct

SEQ ID NO: 222103 - DNA, 20 bp, human
ggaacggcttgtcccgggag

SEQ ID NO: 222104 - DNA, 20 bp, human
gaagcccccaaagaagtcac

SEQ ID NO: 222105 - DNA, 20 bp, human
gctgccctgctcgcgggagg

SEQ ID NO: 222106 - DNA, 20 bp, human
gagggccataccaagaggag

SEQ ID NO: 222107 - DNA, 20 bp, human
gggcagcgccccctagagac

SEQ ID NO: 222108 - DNA, 20 bp, human
ggagggtcactgcgcagagt

SEQ ID NO: 222109 - DNA, 20 bp, human
gtggtatggccctaataaca

SEQ ID NO: 222110 - DNA, 20 bp, human
gttattagggccataccaag

SEQ ID NO: 222111 - DNA, 20 bp, human
gggggcgctgccccgagact

SEQ ID NO: 222112 - DNA, 20 bp, human
gcggcgaaaatggcaagcga

SEQ ID NO: 222113 - DNA, 20 bp, human
gactttccctgacacgtgta

SEQ ID NO: 222114 - DNA, 20 bp, human
gctaataacatggagaggaa

SEQ ID NO: 222115 - DNA, 20 bp, human
gccctagagaccggcgaaaa

SEQ ID NO: 222116 - DNA, 20 bp, human
gctagcccgtgacgtctgag

SEQ ID NO: 222117 - DNA, 20 bp, human
gcaaccccctcagacgtcac

SEQ ID NO: 222118 - DNA, 20 bp, human
gacgcgacgggtccgcccac

SEQ ID NO: 222119 - DNA, 20 bp, human
ggtccgcccacaggcaagga

SEQ ID NO: 222120 - DNA, 20 bp, human
gacgggtccgcccacaggca

SEQ ID NO: 222121 - DNA, 20 bp, human
gaataaggagtcgacgcgac

SEQ ID NO: 222122 - DNA, 20 bp, human
ggctcgcgcctgcactcgcg

SEQ ID NO: 222123 - DNA, 20 bp, human
gaggccgaccccgcgagtgc

SEQ ID NO: 222124 - DNA, 20 bp, human
gcgtagtaacgccaccaata

SEQ ID NO: 222125 - DNA, 20 bp, human
ggcgcctgcactcgcggggt

SEQ ID NO: 222126 - DNA, 20 bp, human
gtgcgcgtgcgcaggggcgt

SEQ ID NO: 222127 - DNA, 20 bp, human
gcccgcgtcccgcgcaccgc

SEQ ID NO: 222128 - DNA, 20 bp, human
gcgggccggctcacctcagg

SEQ ID NO: 222129 - DNA, 20 bp, human
ggcggggccgggcggatctg

SEQ ID NO: 222130 - DNA, 20 bp, human
gcgggtcctgcggtgggcga

SEQ ID NO: 222131 - DNA, 20 bp, human
ggcggggcgggtcctgcggt

SEQ ID NO: 222132 - DNA, 20 bp, human
gcccggccggaggaactcac

SEQ ID NO: 222133 - DNA, 20 bp, human
gtcgcccattggccgcgact

SEQ ID NO: 222134 - DNA, 20 bp, human
ggccccaagtcgcggccaat

SEQ ID NO: 222135 - DNA, 20 bp, human
gcgcgggccgcgtgacgagt

SEQ ID NO: 222136 - DNA, 20 bp, human
gacgtggagacgctcgagtc

SEQ ID NO: 222137 - DNA, 20 bp, human
ggggcaggggcgctcccctg

SEQ ID NO: 222138 - DNA, 20 bp, human
gtgggcgggccctgacgtca

SEQ ID NO: 222139 - DNA, 20 bp, human
gtcgagcgtctccacgtccg

SEQ ID NO: 222140 - DNA, 20 bp, human
gacggcgcaggcgcagaaaa

SEQ ID NO: 222141 - DNA, 20 bp, human
gggccctgacgtcaggggca

SEQ ID NO: 222142 - DNA, 20 bp, human
gacaagcgaccggacggggc

SEQ ID NO: 222143 - DNA, 20 bp, human
gtgacttgggatgaccggat

SEQ ID NO: 222144 - DNA, 20 bp, human
gctcccctgcccctgacgtc

SEQ ID NO: 222145 - DNA, 20 bp, human
ggcgtgtgacttgggatgac

SEQ ID NO: 222146 - DNA, 20 bp, human
ggagagggatatatggagtc

SEQ ID NO: 222147 - DNA, 20 bp, human
gttctagtgggggccagtct

SEQ ID NO: 222148 - DNA, 20 bp, human
gagagtgcattttctagtgg

SEQ ID NO: 222149 - DNA, 20 bp, human
ggccagtctcggttgagtct

SEQ ID NO: 222150 - DNA, 20 bp, human
gcaaggagggaggtgtggaa

SEQ ID NO: 222151 - DNA, 20 bp, human
gaggagagtgcattttctag

SEQ ID NO: 222152 - DNA, 20 bp, human
gaaacccgccccctcacagg

SEQ ID NO: 222153 - DNA, 20 bp, human
gaaaccctgcctcctgtgag

SEQ ID NO: 222154 - DNA, 20 bp, human
gccaaaacccgccccctcac

SEQ ID NO: 222155 - DNA, 20 bp, human
gggatatatggagtctggaa

SEQ ID NO: 222156 - DNA, 20 bp, human
gcccctgggttcggggaaaa

SEQ ID NO: 222157 - DNA, 20 bp, human
gggaaagcaaaagaagttgg

SEQ ID NO: 222158 - DNA, 20 bp, human
gctgaggcacagcaaaaagt

SEQ ID NO: 222159 - DNA, 20 bp, human
gaaaagtcccccaaactcta

SEQ ID NO: 222160 - DNA, 20 bp, human
ggaaaactgccctagagttt

SEQ ID NO: 222161 - DNA, 20 bp, human
gaagagactaggcgaaagga

SEQ ID NO: 222162 - DNA, 20 bp, human
gcctccccaaccgaccgagg

SEQ ID NO: 222163 - DNA, 20 bp, human
gggaggagagcgcgggtctg

SEQ ID NO: 222164 - DNA, 20 bp, human
ggcaaaaagtgggtgttaac

SEQ ID NO: 222165 - DNA, 20 bp, human
gtcagaaaatgggacagcgg

SEQ ID NO: 222166 - DNA, 20 bp, human
gagcaagcacgaaccctgcc

SEQ ID NO: 222167 - DNA, 20 bp, human
gacaacctctgctgtatcag

SEQ ID NO: 222168 - DNA, 20 bp, human
gaacgtgtagaggtggtgaa

SEQ ID NO: 222169 - DNA, 20 bp, human
gcatctccggcgttctttat

SEQ ID NO: 222170 - DNA, 20 bp, human
gcgggagttgtagtttctct

SEQ ID NO: 222171 - DNA, 20 bp, human
gctgggacgtgttgattgaa

SEQ ID NO: 222172 - DNA, 20 bp, human
ggcgggttgcagcgatcacg

SEQ ID NO: 222173 - DNA, 20 bp, human
gaaacggcctgctcgattcc

SEQ ID NO: 222174 - DNA, 20 bp, human
gtgggaagtgagcagagagt

SEQ ID NO: 222175 - DNA, 20 bp, human
ggcgatttcgcggggtaata

SEQ ID NO: 222176 - DNA, 20 bp, human
ggcccggcgacggtcgaaac

SEQ ID NO: 222177 - DNA, 20 bp, human
ggacgaaagtccggcgacgg

SEQ ID NO: 222178 - DNA, 20 bp, human
ggggcgcaagcgccctcgcg

SEQ ID NO: 222179 - DNA, 20 bp, human
ggcgcagctcggcctcgcga

SEQ ID NO: 222180 - DNA, 20 bp, human
ggggtttaggtcaccggcag

SEQ ID NO: 222181 - DNA, 20 bp, human
ggggccctaggtctgagcgg

SEQ ID NO: 222182 - DNA, 20 bp, human
ggggcgcttgcgcccggcga

SEQ ID NO: 222183 - DNA, 20 bp, human
gtcttcgcggcctccgtcgc

SEQ ID NO: 222184 - DNA, 20 bp, human
gcgagctgcgccggaagtgg

SEQ ID NO: 222185 - DNA, 20 bp, human
gacaagactgtgctggtcgc

SEQ ID NO: 222186 - DNA, 20 bp, human
ggactctggaggtgaaggac

SEQ ID NO: 222187 - DNA, 20 bp, human
gaatatcgacatggcatcat

SEQ ID NO: 222188 - DNA, 20 bp, human
gagggcaccatgcaaatctg

SEQ ID NO: 222189 - DNA, 20 bp, human
gtcttggttaagagaagtta

SEQ ID NO: 222190 - DNA, 20 bp, human
gttgtcagtactagtatcag

SEQ ID NO: 222191 - DNA, 20 bp, human
ggaaagaacttcagaggaca

SEQ ID NO: 222192 - DNA, 20 bp, human
ggttgaagccctagcagcac

SEQ ID NO: 222193 - DNA, 20 bp, human
gttaaggtgttcctactcct

SEQ ID NO: 222194 - DNA, 20 bp, human
gctacattagcactgggccc

SEQ ID NO: 222195 - DNA, 20 bp, human
gacaactcctcagatttgca

SEQ ID NO: 222196 - DNA, 20 bp, human
gagtgggcaagggcgaaaca

SEQ ID NO: 222197 - DNA, 20 bp, human
ggtgggaaacaaatgccagt

SEQ ID NO: 222198 - DNA, 20 bp, human
ggtggcctggcaggtgaaga

SEQ ID NO: 222199 - DNA, 20 bp, human
gcagtgccctaagaaggaga

SEQ ID NO: 222200 - DNA, 20 bp, human
gcccagggattggagaacaa

SEQ ID NO: 222201 - DNA, 20 bp, human
gaggagatagactcatccca

SEQ ID NO: 222202 - DNA, 20 bp, human
gacaacggggtgagggacga

SEQ ID NO: 222203 - DNA, 20 bp, human
gggcaggtgaagaaggtaac

SEQ ID NO: 222204 - DNA, 20 bp, human
ggaggagtgaatgatcttcg

SEQ ID NO: 222205 - DNA, 20 bp, human
ggagaacaggtatagaggtg

SEQ ID NO: 222206 - DNA, 20 bp, human
gcggcctggtcgccttctcc

SEQ ID NO: 222207 - DNA, 20 bp, human
gccctggatgcgcccggaga

SEQ ID NO: 222208 - DNA, 20 bp, human
ggaaggcgaccaggccggag

SEQ ID NO: 222209 - DNA, 20 bp, human
gaccccggggaacacccagg

SEQ ID NO: 222210 - DNA, 20 bp, human
gaagggaaaggcaaccctgg

SEQ ID NO: 222211 - DNA, 20 bp, human
gccactgctctgccttgcgg

SEQ ID NO: 222212 - DNA, 20 bp, human
gcagccgcctgggtgttccc

SEQ ID NO: 222213 - DNA, 20 bp, human
gtggagacgtgttcttggtc

SEQ ID NO: 222214 - DNA, 20 bp, human
gcgcatccagggaactcgct

SEQ ID NO: 222215 - DNA, 20 bp, human
gtggaccccggggaacaccc

SEQ ID NO: 222216 - DNA, 20 bp, human
gaggtccgcacacggaccaa

SEQ ID NO: 222217 - DNA, 20 bp, human
gaaaacgcaaggtccgcaca

SEQ ID NO: 222218 - DNA, 20 bp, human
ggtaagacacagtacaaacg

SEQ ID NO: 222219 - DNA, 20 bp, human
gggccaatcaagtcaagagt

SEQ ID NO: 222220 - DNA, 20 bp, human
gacgcattgctgaaaacgca

SEQ ID NO: 222221 - DNA, 20 bp, human
ggaaagtcgttcatttccat

SEQ ID NO: 222222 - DNA, 20 bp, human
gataagctttcctaggggtg

SEQ ID NO: 222223 - DNA, 20 bp, human
gcggagccctaatttgcata

SEQ ID NO: 222224 - DNA, 20 bp, human
gcctaatatggcttcagaac

SEQ ID NO: 222225 - DNA, 20 bp, human
gtcaagaacgagtttttcat

SEQ ID NO: 222226 - DNA, 20 bp, human
gtcccagcgtgcctcaggaa

SEQ ID NO: 222227 - DNA, 20 bp, human
gtctgaccaccttaccagtg

SEQ ID NO: 222228 - DNA, 20 bp, human
gcggattctccccactggta

SEQ ID NO: 222229 - DNA, 20 bp, human
gtggtgccctgagggctcat

SEQ ID NO: 222230 - DNA, 20 bp, human
gattctccccactggtaagg

SEQ ID NO: 222231 - DNA, 20 bp, human
gagtctcggattctccccac

SEQ ID NO: 222232 - DNA, 20 bp, human
gctcatgggaactgtagtct

SEQ ID NO: 222233 - DNA, 20 bp, human
ggggactggggagtcaagtc

SEQ ID NO: 222234 - DNA, 20 bp, human
gagggaattcacgcgcagtt

SEQ ID NO: 222235 - DNA, 20 bp, human
gtcgctgcgcgttggtagca

SEQ ID NO: 222236 - DNA, 20 bp, human
gaggcggggcgtctgtggtg

SEQ ID NO: 222237 - DNA, 20 bp, human
ggcccggggcatctccgcgg

SEQ ID NO: 222238 - DNA, 20 bp, human
ggggacggggcctgtcgcag

SEQ ID NO: 222239 - DNA, 20 bp, human
gccgcggcggaactcaggga

SEQ ID NO: 222240 - DNA, 20 bp, human
ggaaggagctagctggggcg

SEQ ID NO: 222241 - DNA, 20 bp, human
ggacagaggcggggcgtctg

SEQ ID NO: 222242 - DNA, 20 bp, human
gacggggcctgtcgcagggg

SEQ ID NO: 222243 - DNA, 20 bp, human
gtcgcaggggaggagcgtga

SEQ ID NO: 222244 - DNA, 20 bp, human
gcatctccgcggcggaactc

SEQ ID NO: 222245 - DNA, 20 bp, human
gtcagggaaggagctagctg

SEQ ID NO: 222246 - DNA, 20 bp, human
gaggcggggcgtctgtggtg

SEQ ID NO: 222247 - DNA, 20 bp, human
ggcccggggcatctccgcgg

SEQ ID NO: 222248 - DNA, 20 bp, human
ggggacggggcctgtcgcag

SEQ ID NO: 222249 - DNA, 20 bp, human
gccgcggcggaactcaggga

SEQ ID NO: 222250 - DNA, 20 bp, human
ggaaggagctagctggggcg

SEQ ID NO: 222251 - DNA, 20 bp, human
ggacagaggcggggcgtctg

SEQ ID NO: 222252 - DNA, 20 bp, human
gacggggcctgtcgcagggg

SEQ ID NO: 222253 - DNA, 20 bp, human
gtcgcaggggaggagcgtga

SEQ ID NO: 222254 - DNA, 20 bp, human
gcatctccgcggcggaactc

SEQ ID NO: 222255 - DNA, 20 bp, human
gtcagggaaggagctagctg

SEQ ID NO: 222256 - DNA, 20 bp, human
ggcaggcgctgcagtgtcgg

SEQ ID NO: 222257 - DNA, 20 bp, human
ggcggcctctcccacggcgg

SEQ ID NO: 222258 - DNA, 20 bp, human
gcaggagcacgaggggtatt

SEQ ID NO: 222259 - DNA, 20 bp, human
ggcctccggtcgcctggctc

SEQ ID NO: 222260 - DNA, 20 bp, human
gatgagggaaggccagtata

SEQ ID NO: 222261 - DNA, 20 bp, human
ggcagcgcctgccgacctcg

SEQ ID NO: 222262 - DNA, 20 bp, human
gccaggcgaccggaggcctc

SEQ ID NO: 222263 - DNA, 20 bp, human
ggggaccctatccatgaaac

SEQ ID NO: 222264 - DNA, 20 bp, human
ggaggctgacggcctccggg

SEQ ID NO: 222265 - DNA, 20 bp, human
ggcggggccccgaggtcggc

SEQ ID NO: 222266 - DNA, 20 bp, human
ggacccggacactctagccc

SEQ ID NO: 222267 - DNA, 20 bp, human
ggggactggtgggtttcgag

SEQ ID NO: 222268 - DNA, 20 bp, human
gcccgactgggctgaatggc

SEQ ID NO: 222269 - DNA, 20 bp, human
gacctggcagggcccgcctg

SEQ ID NO: 222270 - DNA, 20 bp, human
gcctgactcgcaaaactcgg

SEQ ID NO: 222271 - DNA, 20 bp, human
gccggtgagtacggcgatca

SEQ ID NO: 222272 - DNA, 20 bp, human
ggggcgctgcaagccggaga

SEQ ID NO: 222273 - DNA, 20 bp, human
gcgcctggcgggatgagtga

SEQ ID NO: 222274 - DNA, 20 bp, human
gggcgcgggagggcgagttt

SEQ ID NO: 222275 - DNA, 20 bp, human
gccgagccggggcgtctcag

SEQ ID NO: 222276 - DNA, 20 bp, human
gggcctgcgtgctcgcgccg

SEQ ID NO: 222277 - DNA, 20 bp, human
gcgcgcccgttgcaagatgg

SEQ ID NO: 222278 - DNA, 20 bp, human
gccagcccggccccgattgg

SEQ ID NO: 222279 - DNA, 20 bp, human
ggggtgggaccaacacgcgc

SEQ ID NO: 222280 - DNA, 20 bp, human
ggagcgcgcccgttgcaaga

SEQ ID NO: 222281 - DNA, 20 bp, human
gctcgcgccgggggtgacgc

SEQ ID NO: 222282 - DNA, 20 bp, human
ggggcccgtggggaccggga

SEQ ID NO: 222283 - DNA, 20 bp, human
ggccccgattggcgggtgga

SEQ ID NO: 222284 - DNA, 20 bp, human
gacagccccggggcccagca

SEQ ID NO: 222285 - DNA, 20 bp, human
gaccgggccgcgtgcgcagg

SEQ ID NO: 222286 - DNA, 20 bp, human
ggggggctgcaaggaaacac

SEQ ID NO: 222287 - DNA, 20 bp, human
ggatgaggaaggctcaggtt

SEQ ID NO: 222288 - DNA, 20 bp, human
gacatggagctgctggtggg

SEQ ID NO: 222289 - DNA, 20 bp, human
gcctccggagtgtcagtggg

SEQ ID NO: 222290 - DNA, 20 bp, human
gcaactgcccctccaggcat

SEQ ID NO: 222291 - DNA, 20 bp, human
ggcgaggagagtgtgttctc

SEQ ID NO: 222292 - DNA, 20 bp, human
gggtggaagtttgtgactgg

SEQ ID NO: 222293 - DNA, 20 bp, human
gagggcctccggagtgtcag

SEQ ID NO: 222294 - DNA, 20 bp, human
gagaatcgctgccggtgctg

SEQ ID NO: 222295 - DNA, 20 bp, human
gacagggaaggggcttttca

SEQ ID NO: 222296 - DNA, 20 bp, human
gcgcgctcgccgccggcgtg

SEQ ID NO: 222297 - DNA, 20 bp, human
ggccgcgtaggaaattcgaa

SEQ ID NO: 222298 - DNA, 20 bp, human
ggatggcgggacgacacgat

SEQ ID NO: 222299 - DNA, 20 bp, human
gcaacgcagcctcacgccgg

SEQ ID NO: 222300 - DNA, 20 bp, human
ggaaccagccaatcgcacgg

SEQ ID NO: 222301 - DNA, 20 bp, human
gaatcgcacggaggccgcgt

SEQ ID NO: 222302 - DNA, 20 bp, human
gaatcaacgcagcctcacgc

SEQ ID NO: 222303 - DNA, 20 bp, human
ggaagggcctgacccggaac

SEQ ID NO: 222304 - DNA, 20 bp, human
gtggctggttcgcggatggc

SEQ ID NO: 222305 - DNA, 20 bp, human
gcgattggctggttcgcgga

SEQ ID NO: 222306 - DNA, 20 bp, human
ggtcgctggtgcaaaacctc

SEQ ID NO: 222307 - DNA, 20 bp, human
ggtgcaaaacctcgggtgcg

SEQ ID NO: 222308 - DNA, 20 bp, human
gcctactcccggaacaggag

SEQ ID NO: 222309 - DNA, 20 bp, human
gactcctgggatttggtaaa

SEQ ID NO: 222310 - DNA, 20 bp, human
gaatcccaggagtaagaagt

SEQ ID NO: 222311 - DNA, 20 bp, human
gcagacgtgggcaggtccta

SEQ ID NO: 222312 - DNA, 20 bp, human
gagccccacttcttactcct

SEQ ID NO: 222313 - DNA, 20 bp, human
gcacggtcccggcctactcc

SEQ ID NO: 222314 - DNA, 20 bp, human
gcctgcccacgtctggttca

SEQ ID NO: 222315 - DNA, 20 bp, human
gtcgaactgtcactcatcca

SEQ ID NO: 222316 - DNA, 20 bp, human
gccgacggggacactcatcc

SEQ ID NO: 222317 - DNA, 20 bp, human
gctgccgggtgctttcccat

SEQ ID NO: 222318 - DNA, 20 bp, human
gtccaggcgggactccggag

SEQ ID NO: 222319 - DNA, 20 bp, human
gcccatgggcgaccgaaact

SEQ ID NO: 222320 - DNA, 20 bp, human
ggcagcgagggcgctatggc

SEQ ID NO: 222321 - DNA, 20 bp, human
gcgacgcagcgagggcgcta

SEQ ID NO: 222322 - DNA, 20 bp, human
gagccagcaccgagagggga

SEQ ID NO: 222323 - DNA, 20 bp, human
gtcgcccatgggaaagcacc

SEQ ID NO: 222324 - DNA, 20 bp, human
gcggggctccggctctaggc

SEQ ID NO: 222325 - DNA, 20 bp, human
gtcgctgaggcgacgagcga

SEQ ID NO: 222326 - DNA, 20 bp, human
gtgtggggccctaaccacaa

SEQ ID NO: 222327 - DNA, 20 bp, human
gggaatggggtgcctaggga

SEQ ID NO: 222328 - DNA, 20 bp, human
gggaggaaggaacctggtga

SEQ ID NO: 222329 - DNA, 20 bp, human
gccgctgtggttttccattg

SEQ ID NO: 222330 - DNA, 20 bp, human
gtctgtgccacccaccttca

SEQ ID NO: 222331 - DNA, 20 bp, human
gtggttagggccccacaggc

SEQ ID NO: 222332 - DNA, 20 bp, human
gttcaagggagtctgtagat

SEQ ID NO: 222333 - DNA, 20 bp, human
gaatgcaagtcagtagaatg

SEQ ID NO: 222334 - DNA, 20 bp, human
gggaccactagagaatgaca

SEQ ID NO: 222335 - DNA, 20 bp, human
gatggacatgcgagcctccc

SEQ ID NO: 222336 - DNA, 20 bp, human
gcccaaccttggctccgctc

SEQ ID NO: 222337 - DNA, 20 bp, human
ggggacgaggaagcatgtgt

SEQ ID NO: 222338 - DNA, 20 bp, human
gagctcctgacgtgcaatag

SEQ ID NO: 222339 - DNA, 20 bp, human
gttggggacccacgctccca

SEQ ID NO: 222340 - DNA, 20 bp, human
gcaagctaccttgggagcgt

SEQ ID NO: 222341 - DNA, 20 bp, human
gacactgcatcctacatctg

SEQ ID NO: 222342 - DNA, 20 bp, human
gcgtccccatactataaaag

SEQ ID NO: 222343 - DNA, 20 bp, human
ggagcgtgggtccccaacct

SEQ ID NO: 222344 - DNA, 20 bp, human
ggagactgaggtcccttcct

SEQ ID NO: 222345 - DNA, 20 bp, human
gggtagcttggagcattgaa

SEQ ID NO: 222346 - DNA, 20 bp, human
gtaacaggtgcccatgtctt

SEQ ID NO: 222347 - DNA, 20 bp, human
gggtgaggaccactgatcag

SEQ ID NO: 222348 - DNA, 20 bp, human
gtgccctgacacctgggggg

SEQ ID NO: 222349 - DNA, 20 bp, human
gaccccaccccccaggtgtc

SEQ ID NO: 222350 - DNA, 20 bp, human
ggtgaccccctggtgttctg

SEQ ID NO: 222351 - DNA, 20 bp, human
gaaatcagacaagtgaactg

SEQ ID NO: 222352 - DNA, 20 bp, human
gaccacctgccctgacacct

SEQ ID NO: 222353 - DNA, 20 bp, human
ggcaaacaaccccacccccc

SEQ ID NO: 222354 - DNA, 20 bp, human
gtcatcacaaccctaagaca

SEQ ID NO: 222355 - DNA, 20 bp, human
gcacaagtgggtttcaagaa

SEQ ID NO: 222356 - DNA, 20 bp, human
gtccaactcaaaggtcaccc

SEQ ID NO: 222357 - DNA, 20 bp, human
ggaaacggatggctatggag

SEQ ID NO: 222358 - DNA, 20 bp, human
ggagcctgcagctaccgagg

SEQ ID NO: 222359 - DNA, 20 bp, human
gaatggtggcggctattata

SEQ ID NO: 222360 - DNA, 20 bp, human
gcaggatgcttgaattgaaa

SEQ ID NO: 222361 - DNA, 20 bp, human
gccaccccctcggtagctgc

SEQ ID NO: 222362 - DNA, 20 bp, human
gttagaccggatggtcatta

SEQ ID NO: 222363 - DNA, 20 bp, human
gaggacccataatgaccatc

SEQ ID NO: 222364 - DNA, 20 bp, human
gtggggtcattcagcaagac

SEQ ID NO: 222365 - DNA, 20 bp, human
gatggagcctgcagctaccg

SEQ ID NO: 222366 - DNA, 20 bp, human
gaaccccaggctctccaatt

SEQ ID NO: 222367 - DNA, 20 bp, human
gtctgggagaggactcctgt

SEQ ID NO: 222368 - DNA, 20 bp, human
gccagcctgtgccagggtct

SEQ ID NO: 222369 - DNA, 20 bp, human
gagtgaggatggctaacccc

SEQ ID NO: 222370 - DNA, 20 bp, human
gtgggttaggactttcttaa

SEQ ID NO: 222371 - DNA, 20 bp, human
ggacaagcaagtatcgtggt

SEQ ID NO: 222372 - DNA, 20 bp, human
gaacccaattggagagcctg

SEQ ID NO: 222373 - DNA, 20 bp, human
gaagcaacaaggcctccctc

SEQ ID NO: 222374 - DNA, 20 bp, human
gctcaaatgtattcattcat

SEQ ID NO: 222375 - DNA, 20 bp, human
gctacaaatgaatgaataac

SEQ ID NO: 222376 - DNA, 20 bp, human
gtcccaaggctgcctccggg

SEQ ID NO: 222377 - DNA, 20 bp, human
gtttggagaaaggaaggtcc

SEQ ID NO: 222378 - DNA, 20 bp, human
ggaccaggccgaggtctcca

SEQ ID NO: 222379 - DNA, 20 bp, human
ggagacctcggcctggtctg

SEQ ID NO: 222380 - DNA, 20 bp, human
gctggggtgtgcaggatata

SEQ ID NO: 222381 - DNA, 20 bp, human
ggaggcctcagaccaggccg

SEQ ID NO: 222382 - DNA, 20 bp, human
gtgttgtaatccctctacaa

SEQ ID NO: 222383 - DNA, 20 bp, human
gtaggcagaggcctcagacc

SEQ ID NO: 222384 - DNA, 20 bp, human
gcttcctgaggtttggagaa

SEQ ID NO: 222385 - DNA, 20 bp, human
gtaccttggagacctcggcc

SEQ ID NO: 222386 - DNA, 20 bp, human
gtagccccaggggcttgtag

SEQ ID NO: 222387 - DNA, 20 bp, human
ggcagccccagcgcacatgt

SEQ ID NO: 222388 - DNA, 20 bp, human
ggggagctgggcctggctac

SEQ ID NO: 222389 - DNA, 20 bp, human
gccaggggcttgtagtggtt

SEQ ID NO: 222390 - DNA, 20 bp, human
gcctcccataggcaagggga

SEQ ID NO: 222391 - DNA, 20 bp, human
ggtgcagagtccactgggaa

SEQ ID NO: 222392 - DNA, 20 bp, human
gccctggggctaggcagcta

SEQ ID NO: 222393 - DNA, 20 bp, human
ggatctcctggccctcacta

SEQ ID NO: 222394 - DNA, 20 bp, human
gcagccatccccttgcctat

SEQ ID NO: 222395 - DNA, 20 bp, human
gtcccccctcccataggcaa

SEQ ID NO: 222396 - DNA, 20 bp, human
ggggaaaactgagaccgaaa

SEQ ID NO: 222397 - DNA, 20 bp, human
ggagaaatggaacccaatga

SEQ ID NO: 222398 - DNA, 20 bp, human
ggtaagcagagctaacacgc

SEQ ID NO: 222399 - DNA, 20 bp, human
gaactgagaccgaaaggggt

SEQ ID NO: 222400 - DNA, 20 bp, human
gtgggagtgaagctcaattt

SEQ ID NO: 222401 - DNA, 20 bp, human
gctgataatgggaacagaga

SEQ ID NO: 222402 - DNA, 20 bp, human
gtccaagcctctccctcatt

SEQ ID NO: 222403 - DNA, 20 bp, human
ggaagggggaaggctgataa

SEQ ID NO: 222404 - DNA, 20 bp, human
ggacacccggccaggctcac

SEQ ID NO: 222405 - DNA, 20 bp, human
gaaaggcttgagcaggagaa

SEQ ID NO: 222406 - DNA, 20 bp, human
ggctcatgtgacaccatctg

SEQ ID NO: 222407 - DNA, 20 bp, human
gtggggctgagtgcaagtct

SEQ ID NO: 222408 - DNA, 20 bp, human
gtagaaactagatgcatctg

SEQ ID NO: 222409 - DNA, 20 bp, human
gctacccagatcatctggaa

SEQ ID NO: 222410 - DNA, 20 bp, human
gccagatgatctgggtagac

SEQ ID NO: 222411 - DNA, 20 bp, human
gaatccagctcctcaaactt

SEQ ID NO: 222412 - DNA, 20 bp, human
ggcagagcaaatctgaattc

SEQ ID NO: 222413 - DNA, 20 bp, human
gccagctaggcctcaagctt

SEQ ID NO: 222414 - DNA, 20 bp, human
gctgggttttatcagccctt

SEQ ID NO: 222415 - DNA, 20 bp, human
gcataaaggtttgcggtttg

SEQ ID NO: 222416 - DNA, 20 bp, human
gcctcctctgacctggtcca

SEQ ID NO: 222417 - DNA, 20 bp, human
gtatcaccacgtagccctga

SEQ ID NO: 222418 - DNA, 20 bp, human
ggcaaaggaaaccatggacc

SEQ ID NO: 222419 - DNA, 20 bp, human
gtacccccaaagtgacagac

SEQ ID NO: 222420 - DNA, 20 bp, human
ggctacgtggtgatatccag

SEQ ID NO: 222421 - DNA, 20 bp, human
gccaggctgagggggcggct

SEQ ID NO: 222422 - DNA, 20 bp, human
gtagcataggggagctatgg

SEQ ID NO: 222423 - DNA, 20 bp, human
gactgcaggagcattctgga

SEQ ID NO: 222424 - DNA, 20 bp, human
ggcactggttgctgctccga

SEQ ID NO: 222425 - DNA, 20 bp, human
gagacccccatggaaggcac

SEQ ID NO: 222426 - DNA, 20 bp, human
gtggcactgtctgtttatct

SEQ ID NO: 222427 - DNA, 20 bp, human
gcttcactacaattacccaa

SEQ ID NO: 222428 - DNA, 20 bp, human
gaagctggttccttctggtc

SEQ ID NO: 222429 - DNA, 20 bp, human
gctactgcccagaatacctt

SEQ ID NO: 222430 - DNA, 20 bp, human
gaggaagataattattgcat

SEQ ID NO: 222431 - DNA, 20 bp, human
gtagtgctcattcatgccat

SEQ ID NO: 222432 - DNA, 20 bp, human
gaagataattattgcatagg

SEQ ID NO: 222433 - DNA, 20 bp, human
gagcatgaggcttgacaatc

SEQ ID NO: 222434 - DNA, 20 bp, human
gaccacttgtgaaattgtga

SEQ ID NO: 222435 - DNA, 20 bp, human
gccagcttatgattccagac

SEQ ID NO: 222436 - DNA, 20 bp, human
gggagagcttggagaaaaca

SEQ ID NO: 222437 - DNA, 20 bp, human
ggacaagtggaattttcccg

SEQ ID NO: 222438 - DNA, 20 bp, human
gaacaggtgacttgcaccta

SEQ ID NO: 222439 - DNA, 20 bp, human
gttttctccaagctctccgt

SEQ ID NO: 222440 - DNA, 20 bp, human
gtgaactctacgaagtgggc

SEQ ID NO: 222441 - DNA, 20 bp, human
gtctttagactcctgatccg

SEQ ID NO: 222442 - DNA, 20 bp, human
gtggaattttcccgcggatc

SEQ ID NO: 222443 - DNA, 20 bp, human
gtggagaaaacacggacaag

SEQ ID NO: 222444 - DNA, 20 bp, human
gacctgctgaagcctgtcca

SEQ ID NO: 222445 - DNA, 20 bp, human
ggcctgtccacggaccgcta

SEQ ID NO: 222446 - DNA, 20 bp, human
gcgcgggagcgtcgagtcgg

SEQ ID NO: 222447 - DNA, 20 bp, human
gacggagcgaagcggcgcgg

SEQ ID NO: 222448 - DNA, 20 bp, human
gcggccgcaggcccagagcg

SEQ ID NO: 222449 - DNA, 20 bp, human
gacagagggaaattagtcga

SEQ ID NO: 222450 - DNA, 20 bp, human
gtccgtcccaggctcgtcgg

SEQ ID NO: 222451 - DNA, 20 bp, human
gagcctgggacggagcgaag

SEQ ID NO: 222452 - DNA, 20 bp, human
gggctcggcacagcgcggtg

SEQ ID NO: 222453 - DNA, 20 bp, human
gcgccgcttcgctccgtccc

SEQ ID NO: 222454 - DNA, 20 bp, human
ggggtggcgcggcaaaactc

SEQ ID NO: 222455 - DNA, 20 bp, human
gtgaccgcgctctgggcctg

SEQ ID NO: 222456 - DNA, 20 bp, human
ggtactgttcagccagggac

SEQ ID NO: 222457 - DNA, 20 bp, human
gtagcaatgtgtcactatgc

SEQ ID NO: 222458 - DNA, 20 bp, human
gtgatggtactgttcagcca

SEQ ID NO: 222459 - DNA, 20 bp, human
gcaatgtgtcactatgcagg

SEQ ID NO: 222460 - DNA, 20 bp, human
ggagcattgtgacatatgtg

SEQ ID NO: 222461 - DNA, 20 bp, human
gaggccagacacaaaggtga

SEQ ID NO: 222462 - DNA, 20 bp, human
gataaggcaggtgccatggc

SEQ ID NO: 222463 - DNA, 20 bp, human
gatgtgtggaacctgcactt

SEQ ID NO: 222464 - DNA, 20 bp, human
gattgctaggccagacacaa

SEQ ID NO: 222465 - DNA, 20 bp, human
gtaagaaaagttttatggct

SEQ ID NO: 222466 - DNA, 20 bp, human
ggtactgttcagccagggac

SEQ ID NO: 222467 - DNA, 20 bp, human
gtagcaatgtgtcactatgc

SEQ ID NO: 222468 - DNA, 20 bp, human
gtgatggtactgttcagcca

SEQ ID NO: 222469 - DNA, 20 bp, human
gcaatgtgtcactatgcagg

SEQ ID NO: 222470 - DNA, 20 bp, human
ggagcattgtgacatatgtg

SEQ ID NO: 222471 - DNA, 20 bp, human
gaggccagacacaaaggtga

SEQ ID NO: 222472 - DNA, 20 bp, human
gataaggcaggtgccatggc

SEQ ID NO: 222473 - DNA, 20 bp, human
gatgtgtggaacctgcactt

SEQ ID NO: 222474 - DNA, 20 bp, human
gattgctaggccagacacaa

SEQ ID NO: 222475 - DNA, 20 bp, human
gtaagaaaagttttatggct

SEQ ID NO: 222476 - DNA, 20 bp, human
ggtactgttcagccagggac

SEQ ID NO: 222477 - DNA, 20 bp, human
gtagcaatgtgtcactatgc

SEQ ID NO: 222478 - DNA, 20 bp, human
gtgatggtactgttcagcca

SEQ ID NO: 222479 - DNA, 20 bp, human
gcaatgtgtcactatgcagg

SEQ ID NO: 222480 - DNA, 20 bp, human
ggagcattgtgacatatgtg

SEQ ID NO: 222481 - DNA, 20 bp, human
gaggccagacacaaaggtga

SEQ ID NO: 222482 - DNA, 20 bp, human
gataaggcaggtgccatggc

SEQ ID NO: 222483 - DNA, 20 bp, human
gatgtgtggaacctgcactt

SEQ ID NO: 222484 - DNA, 20 bp, human
gattgctaggccagacacaa

SEQ ID NO: 222485 - DNA, 20 bp, human
gtaagaaaagttttatggct

SEQ ID NO: 222486 - DNA, 20 bp, human
gcggtgcgtgacgtaatctg

SEQ ID NO: 222487 - DNA, 20 bp, human
gaggcaaagtgtgagagcgc

SEQ ID NO: 222488 - DNA, 20 bp, human
gtccccggacgacggcgcga

SEQ ID NO: 222489 - DNA, 20 bp, human
gaaaaaccctccccggacga

SEQ ID NO: 222490 - DNA, 20 bp, human
gcaaagtgtgagagcgcggg

SEQ ID NO: 222491 - DNA, 20 bp, human
ggggcgcagccgagcctgag

SEQ ID NO: 222492 - DNA, 20 bp, human
gcgccttcgcgccgtcgtcc

SEQ ID NO: 222493 - DNA, 20 bp, human
gcatggaaacggcggagcgg

SEQ ID NO: 222494 - DNA, 20 bp, human
gacgtcacgaccgtgacacg

SEQ ID NO: 222495 - DNA, 20 bp, human
gagacgacgagaagtcgccg

SEQ ID NO: 222496 - DNA, 20 bp, human
gaccgcgcacagcgattggg

SEQ ID NO: 222497 - DNA, 20 bp, human
ggggtcacccactgctcttc

SEQ ID NO: 222498 - DNA, 20 bp, human
ggtaaaccgcaggtcagcga

SEQ ID NO: 222499 - DNA, 20 bp, human
gaggaccgcgcacagcgatt

SEQ ID NO: 222500 - DNA, 20 bp, human
gtcggagcggaaggacgtcg

SEQ ID NO: 222501 - DNA, 20 bp, human
gtccggacgcaattttgagg

SEQ ID NO: 222502 - DNA, 20 bp, human
gcgtggagattgcttgcgct

SEQ ID NO: 222503 - DNA, 20 bp, human
gggccgccgtcgctgacctg

SEQ ID NO: 222504 - DNA, 20 bp, human
gaattttgaggaggtcggag

SEQ ID NO: 222505 - DNA, 20 bp, human
gtcttccggacgcaattttg

SEQ ID NO: 222506 - DNA, 20 bp, human
gggtgggcggggcgtctcga

SEQ ID NO: 222507 - DNA, 20 bp, human
ggaaggagttcaagctgaga

SEQ ID NO: 222508 - DNA, 20 bp, human
gtcgagggcggggatctctg

SEQ ID NO: 222509 - DNA, 20 bp, human
ggacggagacggctggcgtg

SEQ ID NO: 222510 - DNA, 20 bp, human
ggaaggcgcggggttgtgtc

SEQ ID NO: 222511 - DNA, 20 bp, human
ggggcgcccagtgtctgcac

SEQ ID NO: 222512 - DNA, 20 bp, human
ggccgctctggaagcctcga

SEQ ID NO: 222513 - DNA, 20 bp, human
ggaggcggagccttgggcga

SEQ ID NO: 222514 - DNA, 20 bp, human
ggggcggggcgtctcgaggg

SEQ ID NO: 222515 - DNA, 20 bp, human
gagacgccccgcccacccac

SEQ ID NO: 222516 - DNA, 20 bp, human
ggtctctcggggctctggat

SEQ ID NO: 222517 - DNA, 20 bp, human
gtgcccccggatgacgtaaa

SEQ ID NO: 222518 - DNA, 20 bp, human
gaaagagccaagcgtctctc

SEQ ID NO: 222519 - DNA, 20 bp, human
gtggaagagtagaggctaga

SEQ ID NO: 222520 - DNA, 20 bp, human
ggtacaatcagaggatggga

SEQ ID NO: 222521 - DNA, 20 bp, human
gcatccgggggcagactggg

SEQ ID NO: 222522 - DNA, 20 bp, human
ggaaatcaaggtacaatcag

SEQ ID NO: 222523 - DNA, 20 bp, human
gctagagggcaggcacttta

SEQ ID NO: 222524 - DNA, 20 bp, human
gtcaaggtacaatcagagga

SEQ ID NO: 222525 - DNA, 20 bp, human
gcgtcatccgggggcagact

SEQ ID NO: 222526 - DNA, 20 bp, human
gcggtcagatactgacggtt

SEQ ID NO: 222527 - DNA, 20 bp, human
gcacgcaccacccggaagtc

SEQ ID NO: 222528 - DNA, 20 bp, human
gccacccggaagtcaggcct

SEQ ID NO: 222529 - DNA, 20 bp, human
ggggtggcctgggactctta

SEQ ID NO: 222530 - DNA, 20 bp, human
ggtcccaggtcgtgtcccga

SEQ ID NO: 222531 - DNA, 20 bp, human
gcccacccaggcctgacttc

SEQ ID NO: 222532 - DNA, 20 bp, human
gttattcggtcagatactga

SEQ ID NO: 222533 - DNA, 20 bp, human
gcctccaagcagggtggcct

SEQ ID NO: 222534 - DNA, 20 bp, human
gtacccgcagcggcccaccc

SEQ ID NO: 222535 - DNA, 20 bp, human
gcgccctcgggacacgacct

SEQ ID NO: 222536 - DNA, 20 bp, human
gaacccgcgcgccgaaggcc

SEQ ID NO: 222537 - DNA, 20 bp, human
gcggcgcgcgggttcctagg

SEQ ID NO: 222538 - DNA, 20 bp, human
gctgcgccgcagcacccggt

SEQ ID NO: 222539 - DNA, 20 bp, human
gggcccgcccagcagcacct

SEQ ID NO: 222540 - DNA, 20 bp, human
gcggcctgacgcccggaccg

SEQ ID NO: 222541 - DNA, 20 bp, human
gcacctgggaaacgcccgcg

SEQ ID NO: 222542 - DNA, 20 bp, human
gttggggcaggcgtggccgt

SEQ ID NO: 222543 - DNA, 20 bp, human
ggccccgcccccgtgcccca

SEQ ID NO: 222544 - DNA, 20 bp, human
ggaaacgcccgcgcggtttg

SEQ ID NO: 222545 - DNA, 20 bp, human
gctgacgcccggaccgcggc

SEQ ID NO: 222546 - DNA, 20 bp, human
gcggcgtcccgggtgcacta

SEQ ID NO: 222547 - DNA, 20 bp, human
gcactagggtcgctctctgc

SEQ ID NO: 222548 - DNA, 20 bp, human
gagtgggggcccttgagtta

SEQ ID NO: 222549 - DNA, 20 bp, human
gccggtcctccctaactcaa

SEQ ID NO: 222550 - DNA, 20 bp, human
ggcgaggagcgggggccaaa

SEQ ID NO: 222551 - DNA, 20 bp, human
gcgggccagaaggtccctga

SEQ ID NO: 222552 - DNA, 20 bp, human
gagtccgcgcgtcatggcgg

SEQ ID NO: 222553 - DNA, 20 bp, human
gcggagtccgcgcgtcatgg

SEQ ID NO: 222554 - DNA, 20 bp, human
ggagggggcgccgcgaggag

SEQ ID NO: 222555 - DNA, 20 bp, human
ggggacgtaggcctaggagt

SEQ ID NO: 222556 - DNA, 20 bp, human
gtttcgtgccggccaggcag

SEQ ID NO: 222557 - DNA, 20 bp, human
gacagactccgaggattggg

SEQ ID NO: 222558 - DNA, 20 bp, human
gcgcgcgcgctcgctcacgc

SEQ ID NO: 222559 - DNA, 20 bp, human
ggggaaggaacacctctccg

SEQ ID NO: 222560 - DNA, 20 bp, human
ggtgaagaagctgagtcgaa

SEQ ID NO: 222561 - DNA, 20 bp, human
ggggaaaagctcaagcaggg

SEQ ID NO: 222562 - DNA, 20 bp, human
ggaagctgagtcgaagggga

SEQ ID NO: 222563 - DNA, 20 bp, human
gagaaaaagctcccgcggag

SEQ ID NO: 222564 - DNA, 20 bp, human
gagtgccgcagagacccaca

SEQ ID NO: 222565 - DNA, 20 bp, human
ggaaacgggaggggtcgcgt

SEQ ID NO: 222566 - DNA, 20 bp, human
ggcccaggttttctcgggtg

SEQ ID NO: 222567 - DNA, 20 bp, human
ggaggggcaggagccatttt

SEQ ID NO: 222568 - DNA, 20 bp, human
gaagacttaagagtaagttg

SEQ ID NO: 222569 - DNA, 20 bp, human
ggccccggaagggctcgtaa

SEQ ID NO: 222570 - DNA, 20 bp, human
ggacggccccagagatgctc

SEQ ID NO: 222571 - DNA, 20 bp, human
gccccggccgtccgcctccg

SEQ ID NO: 222572 - DNA, 20 bp, human
gaacttggttatctaaataa

SEQ ID NO: 222573 - DNA, 20 bp, human
ggcgaagaaaggggaaacgg

SEQ ID NO: 222574 - DNA, 20 bp, human
gctctggagatcctgactct

SEQ ID NO: 222575 - DNA, 20 bp, human
gaggatctccagagcatctc

SEQ ID NO: 222576 - DNA, 20 bp, human
ggacgcgccggagccgagca

SEQ ID NO: 222577 - DNA, 20 bp, human
gccgctctcggccgggtcgg

SEQ ID NO: 222578 - DNA, 20 bp, human
ggcgcgcggactacatgtcc

SEQ ID NO: 222579 - DNA, 20 bp, human
gcatgagccctgctcggctc

SEQ ID NO: 222580 - DNA, 20 bp, human
gcgttgttgccctgccgggc

SEQ ID NO: 222581 - DNA, 20 bp, human
gcgctcccgccaggctaatt

SEQ ID NO: 222582 - DNA, 20 bp, human
ggctcggcgcccgcccggca

SEQ ID NO: 222583 - DNA, 20 bp, human
gaacaacgctgggaccccgt

SEQ ID NO: 222584 - DNA, 20 bp, human
gctacatgtcccggccccgc

SEQ ID NO: 222585 - DNA, 20 bp, human
ggggagtcgtagtccgcggc

SEQ ID NO: 222586 - DNA, 20 bp, human
gtgctgaagtcatgaggtgt

SEQ ID NO: 222587 - DNA, 20 bp, human
gccactgtgctgaagtcatg

SEQ ID NO: 222588 - DNA, 20 bp, human
ggtgacctcctctacctgaa

SEQ ID NO: 222589 - DNA, 20 bp, human
gggctgtagtcagttggcat

SEQ ID NO: 222590 - DNA, 20 bp, human
gtgaacttgtgatttcatga

SEQ ID NO: 222591 - DNA, 20 bp, human
gcaagcagtaagatgcctga

SEQ ID NO: 222592 - DNA, 20 bp, human
gcattggctggcagtctgta

SEQ ID NO: 222593 - DNA, 20 bp, human
ggagatatatcccgtgtcat

SEQ ID NO: 222594 - DNA, 20 bp, human
gcatacccttcaggtagagg

SEQ ID NO: 222595 - DNA, 20 bp, human
gttcaagagccttggagcgg

SEQ ID NO: 222596 - DNA, 20 bp, human
gagaaagacgagagtctgag

SEQ ID NO: 222597 - DNA, 20 bp, human
ggggtctggcacccagtatg

SEQ ID NO: 222598 - DNA, 20 bp, human
gacaagacagacaaattgag

SEQ ID NO: 222599 - DNA, 20 bp, human
gcagacaaattgaggggaaa

SEQ ID NO: 222600 - DNA, 20 bp, human
gcgcgcgcacagggtgccgg

SEQ ID NO: 222601 - DNA, 20 bp, human
gaggtggtgctgcagctcgc

SEQ ID NO: 222602 - DNA, 20 bp, human
gggtggcggcccctggcgac

SEQ ID NO: 222603 - DNA, 20 bp, human
gtgagcggtggatcccgccc

SEQ ID NO: 222604 - DNA, 20 bp, human
gggcggcccctggcgaccgg

SEQ ID NO: 222605 - DNA, 20 bp, human
ggtgctgcagctcgcgggcc

SEQ ID NO: 222606 - DNA, 20 bp, human
gggagcaagtggcacgtctt

SEQ ID NO: 222607 - DNA, 20 bp, human
gaggcaccgcgaaccaacgc

SEQ ID NO: 222608 - DNA, 20 bp, human
gtaacaaagctgcacctcgt

SEQ ID NO: 222609 - DNA, 20 bp, human
gccttagcaacaatcttaac

SEQ ID NO: 222610 - DNA, 20 bp, human
gcaggagtgcacagggtaac

SEQ ID NO: 222611 - DNA, 20 bp, human
gggaaatagtgtaccggcgt

SEQ ID NO: 222612 - DNA, 20 bp, human
gtgacctctgagttctaatg

SEQ ID NO: 222613 - DNA, 20 bp, human
gaagcctcaagatttccttt

SEQ ID NO: 222614 - DNA, 20 bp, human
gtgcacagggtaactggttt

SEQ ID NO: 222615 - DNA, 20 bp, human
gggccgaaaccctggaattc

SEQ ID NO: 222616 - DNA, 20 bp, human
gagcagtggggacccaacca

SEQ ID NO: 222617 - DNA, 20 bp, human
gaagctagggcggggcccgc

SEQ ID NO: 222618 - DNA, 20 bp, human
ggggtccccactgctctcgg

SEQ ID NO: 222619 - DNA, 20 bp, human
ggacgctgggcgtgaggtgg

SEQ ID NO: 222620 - DNA, 20 bp, human
gcggcggccgcgccctggtt

SEQ ID NO: 222621 - DNA, 20 bp, human
gtggggacccaaccagggcg

SEQ ID NO: 222622 - DNA, 20 bp, human
ggcgccatggacgaggccgt

SEQ ID NO: 222623 - DNA, 20 bp, human
gccaccgcagggcactgacc

SEQ ID NO: 222624 - DNA, 20 bp, human
gaggatgtgtcggacaggtc

SEQ ID NO: 222625 - DNA, 20 bp, human
gggcagattcgaagctaggg

SEQ ID NO: 222626 - DNA, 20 bp, human
gagtctgagccgggcagctc

SEQ ID NO: 222627 - DNA, 20 bp, human
gagctcaggcctgttagggc

SEQ ID NO: 222628 - DNA, 20 bp, human
gctaacaggcctgagctgcc

SEQ ID NO: 222629 - DNA, 20 bp, human
gggcggtgcaaaaaaggtgt

SEQ ID NO: 222630 - DNA, 20 bp, human
gccactctgcctgccctaac

SEQ ID NO: 222631 - DNA, 20 bp, human
gtaacccccggctctctaca

SEQ ID NO: 222632 - DNA, 20 bp, human
ggccccgggcggtgcaaaaa

SEQ ID NO: 222633 - DNA, 20 bp, human
ggggcaggcagagtgggttc

SEQ ID NO: 222634 - DNA, 20 bp, human
gagtaggagcgctacactca

SEQ ID NO: 222635 - DNA, 20 bp, human
gtgattgccgtgtagagagc

SEQ ID NO: 222636 - DNA, 20 bp, human
gccgagccgggcgctcggaa

SEQ ID NO: 222637 - DNA, 20 bp, human
gcctctgcggccccgaagct

SEQ ID NO: 222638 - DNA, 20 bp, human
ggctcggaaaggcgtccccg

SEQ ID NO: 222639 - DNA, 20 bp, human
gaggagggccctgttacgtg

SEQ ID NO: 222640 - DNA, 20 bp, human
ggagtctcgccatatcagga

SEQ ID NO: 222641 - DNA, 20 bp, human
gcgcacgccgcccagcttcg

SEQ ID NO: 222642 - DNA, 20 bp, human
gtcctcgtcactcacggggc

SEQ ID NO: 222643 - DNA, 20 bp, human
gctgcggccccgaagctggg

SEQ ID NO: 222644 - DNA, 20 bp, human
gtgtgcaccgagactattcc

SEQ ID NO: 222645 - DNA, 20 bp, human
gaggtcggtgcgtctgtcgg

SEQ ID NO: 222646 - DNA, 20 bp, human
gcagccggggacgggaccca

SEQ ID NO: 222647 - DNA, 20 bp, human
gacaccggggactagagcta

SEQ ID NO: 222648 - DNA, 20 bp, human
ggggactagagctaagggtg

SEQ ID NO: 222649 - DNA, 20 bp, human
gggtgagtgcagccggggac

SEQ ID NO: 222650 - DNA, 20 bp, human
gagaccgcgctcactatccg

SEQ ID NO: 222651 - DNA, 20 bp, human
ggaactggagctgtgggcgg

SEQ ID NO: 222652 - DNA, 20 bp, human
gggggcctcccgtggagaga

SEQ ID NO: 222653 - DNA, 20 bp, human
gcagccttgggtcccgtccc

SEQ ID NO: 222654 - DNA, 20 bp, human
gtgggcggggcttgaggcga

SEQ ID NO: 222655 - DNA, 20 bp, human
gctggacgcggggcagagga

SEQ ID NO: 222656 - DNA, 20 bp, human
ggctaggagaggaggttcct

SEQ ID NO: 222657 - DNA, 20 bp, human
gcggaggcacagaccggaag

SEQ ID NO: 222658 - DNA, 20 bp, human
gtagaaacgtgagctaggag

SEQ ID NO: 222659 - DNA, 20 bp, human
gtcgggtagaaacgtgagct

SEQ ID NO: 222660 - DNA, 20 bp, human
gtaggaggggacacttcaaa

SEQ ID NO: 222661 - DNA, 20 bp, human
gtttctacccgagcccgcgg

SEQ ID NO: 222662 - DNA, 20 bp, human
gagcgcgacggaggcatagg

SEQ ID NO: 222663 - DNA, 20 bp, human
ggcgcgcagcctcccagcgg

SEQ ID NO: 222664 - DNA, 20 bp, human
ggtcgcgctggccggaagac

SEQ ID NO: 222665 - DNA, 20 bp, human
gctagactggggttgaattt

SEQ ID NO: 222666 - DNA, 20 bp, human
gccggcggggcgtcttaaag

SEQ ID NO: 222667 - DNA, 20 bp, human
ggggcccagtcacaagaccg

SEQ ID NO: 222668 - DNA, 20 bp, human
gtgggagatcggggcgtagg

SEQ ID NO: 222669 - DNA, 20 bp, human
gccggccgaggtccccctac

SEQ ID NO: 222670 - DNA, 20 bp, human
ggtctagagagcagcggcgg

SEQ ID NO: 222671 - DNA, 20 bp, human
gtccccctaccggtggagga

SEQ ID NO: 222672 - DNA, 20 bp, human
gctgctctctagacctcccg

SEQ ID NO: 222673 - DNA, 20 bp, human
gtggaagcgctggcgatcat

SEQ ID NO: 222674 - DNA, 20 bp, human
gggcgtctctgggtcgtcgt

SEQ ID NO: 222675 - DNA, 20 bp, human
gtgaccctatggggcgtctc

SEQ ID NO: 222676 - DNA, 20 bp, human
gatgagaagccgcaccgggt

SEQ ID NO: 222677 - DNA, 20 bp, human
gccccggggccgggtcgcgt

SEQ ID NO: 222678 - DNA, 20 bp, human
gccgggtcggggcaggcttc

SEQ ID NO: 222679 - DNA, 20 bp, human
ggggtacaaccaagagggga

SEQ ID NO: 222680 - DNA, 20 bp, human
gcggcggcggctgtgggtaa

SEQ ID NO: 222681 - DNA, 20 bp, human
ggaccaacgcgacccggccc

SEQ ID NO: 222682 - DNA, 20 bp, human
gcccacgagggcgaattttg

SEQ ID NO: 222683 - DNA, 20 bp, human
gcaaccaagaggggagggtt

SEQ ID NO: 222684 - DNA, 20 bp, human
gaagctgttgcaagttttac

SEQ ID NO: 222685 - DNA, 20 bp, human
gtgccccgccccgcgcgcaa

SEQ ID NO: 222686 - DNA, 20 bp, human
ggccgcgtggaaatccagtc

SEQ ID NO: 222687 - DNA, 20 bp, human
gtcagggtctgggaggcgta

SEQ ID NO: 222688 - DNA, 20 bp, human
gtgacaggcatcccccaggt

SEQ ID NO: 222689 - DNA, 20 bp, human
gagtcaccctggccgggcct

SEQ ID NO: 222690 - DNA, 20 bp, human
gctggtgacaggcatccccc

SEQ ID NO: 222691 - DNA, 20 bp, human
ggactcgctaagtgtggttg

SEQ ID NO: 222692 - DNA, 20 bp, human
gcctgtgcagactggagctc

SEQ ID NO: 222693 - DNA, 20 bp, human
gagactggagctcagggtct

SEQ ID NO: 222694 - DNA, 20 bp, human
ggtctgggaggcgtagggct

SEQ ID NO: 222695 - DNA, 20 bp, human
gcagggtgactcgctaagtg

SEQ ID NO: 222696 - DNA, 20 bp, human
gaacgccggggttgcttccg

SEQ ID NO: 222697 - DNA, 20 bp, human
gagacgggaggccgcctcga

SEQ ID NO: 222698 - DNA, 20 bp, human
gagggaggagctgaacgccg

SEQ ID NO: 222699 - DNA, 20 bp, human
gccgggccgcccttccctcg

SEQ ID NO: 222700 - DNA, 20 bp, human
ggacggccgaaaatgaatgg

SEQ ID NO: 222701 - DNA, 20 bp, human
gggcgacggccgaaaatgaa

SEQ ID NO: 222702 - DNA, 20 bp, human
ggagccgtagggagtttcgt

SEQ ID NO: 222703 - DNA, 20 bp, human
ggggaggccgcctcgaggga

SEQ ID NO: 222704 - DNA, 20 bp, human
gtgcgccgcggtctccgggc

SEQ ID NO: 222705 - DNA, 20 bp, human
gggaggccgggctacgccgg

SEQ ID NO: 222706 - DNA, 20 bp, human
gccccactgcaacgctggga

SEQ ID NO: 222707 - DNA, 20 bp, human
gaaccctcccagcgttgcag

SEQ ID NO: 222708 - DNA, 20 bp, human
gtggctgggcggcttggcag

SEQ ID NO: 222709 - DNA, 20 bp, human
ggaagccttgggtacattca

SEQ ID NO: 222710 - DNA, 20 bp, human
gctgggagggttaacagagc

SEQ ID NO: 222711 - DNA, 20 bp, human
gacagcgccacactccccac

SEQ ID NO: 222712 - DNA, 20 bp, human
gaccaaaggagagagcggtg

SEQ ID NO: 222713 - DNA, 20 bp, human
gccacccgtgaatgtaccca

SEQ ID NO: 222714 - DNA, 20 bp, human
gtggggaacaagaagtagct

SEQ ID NO: 222715 - DNA, 20 bp, human
ggcgttggacactcttaaaa

SEQ ID NO: 222716 - DNA, 20 bp, human
gggtgcgggcggtgatcgaa

SEQ ID NO: 222717 - DNA, 20 bp, human
gtgggggaattggttgtgtt

SEQ ID NO: 222718 - DNA, 20 bp, human
gcaaagaagtgggacctggg

SEQ ID NO: 222719 - DNA, 20 bp, human
ggtaatgtgaccggtcgtag

SEQ ID NO: 222720 - DNA, 20 bp, human
gcgaagggctgaagatgcgg

SEQ ID NO: 222721 - DNA, 20 bp, human
gcgttgggaccattatcatt

SEQ ID NO: 222722 - DNA, 20 bp, human
gcgggggcgctgtgccggtg

SEQ ID NO: 222723 - DNA, 20 bp, human
ggatttgcacgaggcggtgg

SEQ ID NO: 222724 - DNA, 20 bp, human
gggtcgtagtggtttatttg

SEQ ID NO: 222725 - DNA, 20 bp, human
ggcaggaacgccaaagaagt

SEQ ID NO: 222726 - DNA, 20 bp, human
gcaccgccctccagattctt

SEQ ID NO: 222727 - DNA, 20 bp, human
gtggaaccagcagtaaccag

SEQ ID NO: 222728 - DNA, 20 bp, human
ggattcttgggagttggtga

SEQ ID NO: 222729 - DNA, 20 bp, human
gccccctctccggtggactc

SEQ ID NO: 222730 - DNA, 20 bp, human
gtcaacttgaagctagagct

SEQ ID NO: 222731 - DNA, 20 bp, human
gagcaccaccccctctccgg

SEQ ID NO: 222732 - DNA, 20 bp, human
gttccagagtccaccggaga

SEQ ID NO: 222733 - DNA, 20 bp, human
gagaatagacttaagatctc

SEQ ID NO: 222734 - DNA, 20 bp, human
gcagacaaggacagtgatta

SEQ ID NO: 222735 - DNA, 20 bp, human
gagctagagcttggaatata

SEQ ID NO: 222736 - DNA, 20 bp, human
gaagggctcaaggtacgcgg

SEQ ID NO: 222737 - DNA, 20 bp, human
gggaggcgggaattcgtctc

SEQ ID NO: 222738 - DNA, 20 bp, human
gcagtcccggtgcgaggtga

SEQ ID NO: 222739 - DNA, 20 bp, human
gctcgaccaatcacccgcca

SEQ ID NO: 222740 - DNA, 20 bp, human
gcgagaacttcggcatccaa

SEQ ID NO: 222741 - DNA, 20 bp, human
ggctcaaggtacgcggcgga

SEQ ID NO: 222742 - DNA, 20 bp, human
gtgaggggtctggtgggtcg

SEQ ID NO: 222743 - DNA, 20 bp, human
gtcgccccctcacctcgcac

SEQ ID NO: 222744 - DNA, 20 bp, human
gattgggcgctgggagtcga

SEQ ID NO: 222745 - DNA, 20 bp, human
gcctggccttggcgggtgat

SEQ ID NO: 222746 - DNA, 20 bp, human
gcagacctggaggacgaccg

SEQ ID NO: 222747 - DNA, 20 bp, human
ggcggcacgcgcggctctct

SEQ ID NO: 222748 - DNA, 20 bp, human
gcaccgagaccggaaggagg

SEQ ID NO: 222749 - DNA, 20 bp, human
gcgtgccgcgccaccgagac

SEQ ID NO: 222750 - DNA, 20 bp, human
gcgcgggcgggctggtgaat

SEQ ID NO: 222751 - DNA, 20 bp, human
gaggcggctccgaggaaccg

SEQ ID NO: 222752 - DNA, 20 bp, human
gggagggccggtctgaagag

SEQ ID NO: 222753 - DNA, 20 bp, human
gccgcgccaccgagaccgga

SEQ ID NO: 222754 - DNA, 20 bp, human
gagctccgcggtcgtcctcc

SEQ ID NO: 222755 - DNA, 20 bp, human
gctcggtggcgcggcacgcg

SEQ ID NO: 222756 - DNA, 20 bp, human
gaattctcgggcactatgat

SEQ ID NO: 222757 - DNA, 20 bp, human
gcgtgggtgctcaagaggat

SEQ ID NO: 222758 - DNA, 20 bp, human
gatagtgcccgagaattcgt

SEQ ID NO: 222759 - DNA, 20 bp, human
gcttctgtgttctatagcgt

SEQ ID NO: 222760 - DNA, 20 bp, human
gaacacagaagcctggacgc

SEQ ID NO: 222761 - DNA, 20 bp, human
gtgcactacaacctcgccgc

SEQ ID NO: 222762 - DNA, 20 bp, human
gtagagagcaaacgccggcg

SEQ ID NO: 222763 - DNA, 20 bp, human
ggggagtagagagcaaacgc

SEQ ID NO: 222764 - DNA, 20 bp, human
gcgaggacgtgacgttgcac

SEQ ID NO: 222765 - DNA, 20 bp, human
gtgagcacccacgaattctc

SEQ ID NO: 222766 - DNA, 20 bp, human
gggccggtctccatagtaac

SEQ ID NO: 222767 - DNA, 20 bp, human
gcgaaggcctgcgcgaatgt

SEQ ID NO: 222768 - DNA, 20 bp, human
gcaactgtgagcatccccga

SEQ ID NO: 222769 - DNA, 20 bp, human
gaggcatgctgggataccgc

SEQ ID NO: 222770 - DNA, 20 bp, human
gaactggccgacattcgcgc

SEQ ID NO: 222771 - DNA, 20 bp, human
gggagatggccgcggacgaa

SEQ ID NO: 222772 - DNA, 20 bp, human
gttctccccttgcacgccgt

SEQ ID NO: 222773 - DNA, 20 bp, human
gatctccccacggcgtgcaa

SEQ ID NO: 222774 - DNA, 20 bp, human
gcatcaggaggcgaccgtcg

SEQ ID NO: 222775 - DNA, 20 bp, human
gagacggtgcccttcgtccg

SEQ ID NO: 222776 - DNA, 20 bp, human
gtgccctgctctggtacgat

SEQ ID NO: 222777 - DNA, 20 bp, human
gacctacgaactacaactcc

SEQ ID NO: 222778 - DNA, 20 bp, human
gtaacccgcaggctctgcga

SEQ ID NO: 222779 - DNA, 20 bp, human
gactcccggcaagcatcgga

SEQ ID NO: 222780 - DNA, 20 bp, human
gaaggccgcgtcgtaattgc

SEQ ID NO: 222781 - DNA, 20 bp, human
ggccgggagttgtagttcgt

SEQ ID NO: 222782 - DNA, 20 bp, human
gtacaactcccggcaagcat

SEQ ID NO: 222783 - DNA, 20 bp, human
ggctgcacgcttccatccct

SEQ ID NO: 222784 - DNA, 20 bp, human
gcggccttccgatgcttgcc

SEQ ID NO: 222785 - DNA, 20 bp, human
gaagtgatcagggctgccga

SEQ ID NO: 222786 - DNA, 20 bp, human
ggagccgcaaagtttggctg

SEQ ID NO: 222787 - DNA, 20 bp, human
gtcgctggggctggtggcga

SEQ ID NO: 222788 - DNA, 20 bp, human
ggagaatgccgcaatagcga

SEQ ID NO: 222789 - DNA, 20 bp, human
gacaacggctccgctctctg

SEQ ID NO: 222790 - DNA, 20 bp, human
gtgtggcggcaaatgggctt

SEQ ID NO: 222791 - DNA, 20 bp, human
ggactgggcacgggaggaag

SEQ ID NO: 222792 - DNA, 20 bp, human
ggcggcctcaacctaacccg

SEQ ID NO: 222793 - DNA, 20 bp, human
gctattgcggcattctccct

SEQ ID NO: 222794 - DNA, 20 bp, human
gcgcacgactggagccggtc

SEQ ID NO: 222795 - DNA, 20 bp, human
gccctagagcagcctcgctg

SEQ ID NO: 222796 - DNA, 20 bp, human
gaggaggcagggagcggata

SEQ ID NO: 222797 - DNA, 20 bp, human
ggggatctggggtcgtcggg

SEQ ID NO: 222798 - DNA, 20 bp, human
gcgaccccagatcccgagta

SEQ ID NO: 222799 - DNA, 20 bp, human
gtcaccgtactcgggatctg

SEQ ID NO: 222800 - DNA, 20 bp, human
gagagctagagaagccctgt

SEQ ID NO: 222801 - DNA, 20 bp, human
gcgtctgcgcagggtaaacg

SEQ ID NO: 222802 - DNA, 20 bp, human
gaggcagggagcggataggg

SEQ ID NO: 222803 - DNA, 20 bp, human
ggcggggctggagactagac

SEQ ID NO: 222804 - DNA, 20 bp, human
gcgtgctccgggattcagaa

SEQ ID NO: 222805 - DNA, 20 bp, human
gcagggagcggatagggagg

SEQ ID NO: 222806 - DNA, 20 bp, human
gagagcccgcagagtcaggg

SEQ ID NO: 222807 - DNA, 20 bp, human
ggggacctagggccgctcaa

SEQ ID NO: 222808 - DNA, 20 bp, human
gccgccgccgcgccaggcac

SEQ ID NO: 222809 - DNA, 20 bp, human
ggggacaccgagcaagagac

SEQ ID NO: 222810 - DNA, 20 bp, human
gcgccagcgaatgagcgggg

SEQ ID NO: 222811 - DNA, 20 bp, human
gaaggggcgggactctcgtc

SEQ ID NO: 222812 - DNA, 20 bp, human
gcggagaggcgagaacccat

SEQ ID NO: 222813 - DNA, 20 bp, human
gacggggcgagcccgataag

SEQ ID NO: 222814 - DNA, 20 bp, human
gaggagcgagagcgcgaaag

SEQ ID NO: 222815 - DNA, 20 bp, human
gcgggagagcccgcagagtc

SEQ ID NO: 222816 - DNA, 20 bp, human
gcctgggtagatatgaaaac

SEQ ID NO: 222817 - DNA, 20 bp, human
gctgtcataaggagagggag

SEQ ID NO: 222818 - DNA, 20 bp, human
gggcactgaagagtaggagg

SEQ ID NO: 222819 - DNA, 20 bp, human
gttccctgttggggaatctt

SEQ ID NO: 222820 - DNA, 20 bp, human
ggtcccaagattccccaaca

SEQ ID NO: 222821 - DNA, 20 bp, human
ggtaggaggtggagttttat

SEQ ID NO: 222822 - DNA, 20 bp, human
ggacctgaatgatcactcct

SEQ ID NO: 222823 - DNA, 20 bp, human
gtacccaggatggtctatat

SEQ ID NO: 222824 - DNA, 20 bp, human
gaacctatatagaccatcct

SEQ ID NO: 222825 - DNA, 20 bp, human
gactaccatgtgattgcagg

SEQ ID NO: 222826 - DNA, 20 bp, human
gagagaggacccaacagatg

SEQ ID NO: 222827 - DNA, 20 bp, human
gcatctctgccccatctgtt

SEQ ID NO: 222828 - DNA, 20 bp, human
gccccctcccccctccgaaa

SEQ ID NO: 222829 - DNA, 20 bp, human
ggatggagaccaccagagac

SEQ ID NO: 222830 - DNA, 20 bp, human
gtgacacagagacgggagac

SEQ ID NO: 222831 - DNA, 20 bp, human
ggtgccggagagaaaggacg

SEQ ID NO: 222832 - DNA, 20 bp, human
gacgctgacatcaccatccg

SEQ ID NO: 222833 - DNA, 20 bp, human
gaaccctttcggagggggga

SEQ ID NO: 222834 - DNA, 20 bp, human
gccggagagaaaggacgagg

SEQ ID NO: 222835 - DNA, 20 bp, human
gagagaaaggacgaggtggc

SEQ ID NO: 222836 - DNA, 20 bp, human
ggaacagccgagccgaacag

SEQ ID NO: 222837 - DNA, 20 bp, human
gagcgctcggggagactcta

SEQ ID NO: 222838 - DNA, 20 bp, human
gcatcccgctgcgttcgtac

SEQ ID NO: 222839 - DNA, 20 bp, human
gtgcgcggctcggctcgtct

SEQ ID NO: 222840 - DNA, 20 bp, human
gcgagcctgtacgaacgcag

SEQ ID NO: 222841 - DNA, 20 bp, human
gagcgctcgtagcggcgggg

SEQ ID NO: 222842 - DNA, 20 bp, human
gccgccgctacgagcgctcg

SEQ ID NO: 222843 - DNA, 20 bp, human
gtgcgctcgactccgctgtt

SEQ ID NO: 222844 - DNA, 20 bp, human
gcgaacgcagcgggatgccg

SEQ ID NO: 222845 - DNA, 20 bp, human
ggtacaggctcgtgtcgact

SEQ ID NO: 222846 - DNA, 20 bp, human
gtggaccgacgcctccgcgg

SEQ ID NO: 222847 - DNA, 20 bp, human
gtgcctccggggactcgatg

SEQ ID NO: 222848 - DNA, 20 bp, human
gaacccccgccccccgcgga

SEQ ID NO: 222849 - DNA, 20 bp, human
gggaggaagtagttcctccg

SEQ ID NO: 222850 - DNA, 20 bp, human
gtgaggagaaagtgacgcgg

SEQ ID NO: 222851 - DNA, 20 bp, human
gtgggcgccgcagcagcgag

SEQ ID NO: 222852 - DNA, 20 bp, human
gcgcaatgaggcggctgccc

SEQ ID NO: 222853 - DNA, 20 bp, human
ggctcgtgtcccgcccgggg

SEQ ID NO: 222854 - DNA, 20 bp, human
gggcgcgcacggtatggcgg

SEQ ID NO: 222855 - DNA, 20 bp, human
gctgccgcctcacaaagccc

SEQ ID NO: 222856 - DNA, 20 bp, human
gggagggtaaaaatggtgat

SEQ ID NO: 222857 - DNA, 20 bp, human
ggccgaagtggcgaagaggt

SEQ ID NO: 222858 - DNA, 20 bp, human
ggctgtattagtgcctctag

SEQ ID NO: 222859 - DNA, 20 bp, human
gccaccacagagttccaagg

SEQ ID NO: 222860 - DNA, 20 bp, human
gaggagccgaagtggcgaag

SEQ ID NO: 222861 - DNA, 20 bp, human
gaaggcggctgccagagcgt

SEQ ID NO: 222862 - DNA, 20 bp, human
ggaagggtcctccaccggaa

SEQ ID NO: 222863 - DNA, 20 bp, human
gagactctcccggagcccga

SEQ ID NO: 222864 - DNA, 20 bp, human
ggcccacctcttcgccactt

SEQ ID NO: 222865 - DNA, 20 bp, human
gttggtaccgggaggaaaaa

SEQ ID NO: 222866 - DNA, 20 bp, human
gtcccctggggcacatcttg

SEQ ID NO: 222867 - DNA, 20 bp, human
ggggtccagcacggcggggc

SEQ ID NO: 222868 - DNA, 20 bp, human
ggcagtcagcgcatcccctg

SEQ ID NO: 222869 - DNA, 20 bp, human
ggcgacctcgcagctcggga

SEQ ID NO: 222870 - DNA, 20 bp, human
gcctcccacggctacaaaag

SEQ ID NO: 222871 - DNA, 20 bp, human
gagagccagtggcgagcgca

SEQ ID NO: 222872 - DNA, 20 bp, human
ggaggcggggcttcagccca

SEQ ID NO: 222873 - DNA, 20 bp, human
gccgtgctggaccccgccct

SEQ ID NO: 222874 - DNA, 20 bp, human
ggtctccttgcgctcgccac

SEQ ID NO: 222875 - DNA, 20 bp, human
gtggtgaaggtgtgcacgga

SEQ ID NO: 222876 - DNA, 20 bp, human
ggagaacgccggttgcctgg

SEQ ID NO: 222877 - DNA, 20 bp, human
gtcacggagtttaccgtaca

SEQ ID NO: 222878 - DNA, 20 bp, human
ggcaaccggcgttctcaata

SEQ ID NO: 222879 - DNA, 20 bp, human
gagaccagaagagggcggaa

SEQ ID NO: 222880 - DNA, 20 bp, human
gccctcttctggtctcaaaa

SEQ ID NO: 222881 - DNA, 20 bp, human
ggggaccatattgagaacgc

SEQ ID NO: 222882 - DNA, 20 bp, human
gcaagatggccgtaccaaca

SEQ ID NO: 222883 - DNA, 20 bp, human
gggtacggccatcttggaat

SEQ ID NO: 222884 - DNA, 20 bp, human
gacggtaaactccgtgacgt

SEQ ID NO: 222885 - DNA, 20 bp, human
gcatggcagcccccacgtca

SEQ ID NO: 222886 - DNA, 20 bp, human
ggtgccgtgtcggaagtcaa

SEQ ID NO: 222887 - DNA, 20 bp, human
ggggaggcgggacctaatga

SEQ ID NO: 222888 - DNA, 20 bp, human
ggcgaactcgggacagagac

SEQ ID NO: 222889 - DNA, 20 bp, human
ggggacctaatgatggcgca

SEQ ID NO: 222890 - DNA, 20 bp, human
gcggagtttgagggcgaact

SEQ ID NO: 222891 - DNA, 20 bp, human
gacgattgaactgagagttc

SEQ ID NO: 222892 - DNA, 20 bp, human
ggttcaggggcggagtttga

SEQ ID NO: 222893 - DNA, 20 bp, human
gctaatgatggcgcagggag

SEQ ID NO: 222894 - DNA, 20 bp, human
gtcgggtacggtggcctcta

SEQ ID NO: 222895 - DNA, 20 bp, human
ggacaaagagtcaagcttgg

SEQ ID NO: 222896 - DNA, 20 bp, human
gcacgctcgcatgtacgcgc

SEQ ID NO: 222897 - DNA, 20 bp, human
gctccggcaggctcacgcta

SEQ ID NO: 222898 - DNA, 20 bp, human
gtgtacgcgccggctccggc

SEQ ID NO: 222899 - DNA, 20 bp, human
gtcacgctacggaatccggg

SEQ ID NO: 222900 - DNA, 20 bp, human
gacccggcgttgctaggaaa

SEQ ID NO: 222901 - DNA, 20 bp, human
gcacgcacggcgtcatctcg

SEQ ID NO: 222902 - DNA, 20 bp, human
gaggctcacgctacggaatc

SEQ ID NO: 222903 - DNA, 20 bp, human
gcaggaaggaagaaatgcgc

SEQ ID NO: 222904 - DNA, 20 bp, human
gggcggcggcgcacgtgacc

SEQ ID NO: 222905 - DNA, 20 bp, human
gtcaacgcttcaaccccctc

SEQ ID NO: 222906 - DNA, 20 bp, human
gcccgcgcatgcgctgtcca

SEQ ID NO: 222907 - DNA, 20 bp, human
gagcgcgcacaggggaaggg

SEQ ID NO: 222908 - DNA, 20 bp, human
gcggttgtatcatgctgaga

SEQ ID NO: 222909 - DNA, 20 bp, human
gacagcgcatgcgcgggcgc

SEQ ID NO: 222910 - DNA, 20 bp, human
gcagcatgatacaaccgcgt

SEQ ID NO: 222911 - DNA, 20 bp, human
ggtcgctgggaaacagccgc

SEQ ID NO: 222912 - DNA, 20 bp, human
ggctggcgggagcgcgcaca

SEQ ID NO: 222913 - DNA, 20 bp, human
gcagagacgcaaggtcgtag

SEQ ID NO: 222914 - DNA, 20 bp, human
gcgccagcctcggggtcgct

SEQ ID NO: 222915 - DNA, 20 bp, human
ggatacaaccgcgtcggccc

SEQ ID NO: 222916 - DNA, 20 bp, human
gtgagcgagggagcacacag

SEQ ID NO: 222917 - DNA, 20 bp, human
gcctactgtggggttgagct

SEQ ID NO: 222918 - DNA, 20 bp, human
gggagagtgggaggttaccg

SEQ ID NO: 222919 - DNA, 20 bp, human
gacctcatttgcctactgtg

SEQ ID NO: 222920 - DNA, 20 bp, human
ggcgagggagcacacagggg

SEQ ID NO: 222921 - DNA, 20 bp, human
gcttccagctctagaaaaca

SEQ ID NO: 222922 - DNA, 20 bp, human
gagagctgttagaatgctat

SEQ ID NO: 222923 - DNA, 20 bp, human
gagtgggaggttaccggggc

SEQ ID NO: 222924 - DNA, 20 bp, human
gggggttgagctgggtggac

SEQ ID NO: 222925 - DNA, 20 bp, human
ggaagagtgtagaattcttc

SEQ ID NO: 222926 - DNA, 20 bp, human
gaacaagtggtgcagcctta

SEQ ID NO: 222927 - DNA, 20 bp, human
gtaacctaatgggctgcaga

SEQ ID NO: 222928 - DNA, 20 bp, human
gggaaatgtaggtgtccata

SEQ ID NO: 222929 - DNA, 20 bp, human
gccttggtgattaacctaat

SEQ ID NO: 222930 - DNA, 20 bp, human
gctccacaaaccttcagtgt

SEQ ID NO: 222931 - DNA, 20 bp, human
ggctcgaacctatgagtcgg

SEQ ID NO: 222932 - DNA, 20 bp, human
gacgttgggtttcagaattc

SEQ ID NO: 222933 - DNA, 20 bp, human
gcagtaactaagaacacgtt

SEQ ID NO: 222934 - DNA, 20 bp, human
gagatggctttgaagttctg

SEQ ID NO: 222935 - DNA, 20 bp, human
gggcccacactgaaggtttg

SEQ ID NO: 222936 - DNA, 20 bp, human
gatgggagcgcgggttgggt

SEQ ID NO: 222937 - DNA, 20 bp, human
gcgggatgggagcgcgggtt

SEQ ID NO: 222938 - DNA, 20 bp, human
ggcgcgctggcgcaccggga

SEQ ID NO: 222939 - DNA, 20 bp, human
gtaaagagacctgctgcccc

SEQ ID NO: 222940 - DNA, 20 bp, human
gcgcacggccatgtccgccg

SEQ ID NO: 222941 - DNA, 20 bp, human
gcgccgccacctgcgacagg

SEQ ID NO: 222942 - DNA, 20 bp, human
ggcgacaggtggagcgcacg

SEQ ID NO: 222943 - DNA, 20 bp, human
ggcccgccgccacctgcgac

SEQ ID NO: 222944 - DNA, 20 bp, human
ggcgctccacctgtcgcagg

SEQ ID NO: 222945 - DNA, 20 bp, human
gtgcctctcaaaaagggcag

SEQ ID NO: 222946 - DNA, 20 bp, human
ggtgaggaggcttgacccca

SEQ ID NO: 222947 - DNA, 20 bp, human
gacctgcgaggtgagatgtg

SEQ ID NO: 222948 - DNA, 20 bp, human
gacaaacctgagtaacatac

SEQ ID NO: 222949 - DNA, 20 bp, human
gcaagactgagcgtggggcg

SEQ ID NO: 222950 - DNA, 20 bp, human
gtcctcacatctcacctcgc

SEQ ID NO: 222951 - DNA, 20 bp, human
ggcagggcgggactctcgct

SEQ ID NO: 222952 - DNA, 20 bp, human
gtgagcttggaacatcaccc

SEQ ID NO: 222953 - DNA, 20 bp, human
gttgaccgctgtccacgggg

SEQ ID NO: 222954 - DNA, 20 bp, human
ggctccctccccgtggacag

SEQ ID NO: 222955 - DNA, 20 bp, human
gtccgcaaactgatgcaggg

SEQ ID NO: 222956 - DNA, 20 bp, human
gccagctgggaagggcccaa

SEQ ID NO: 222957 - DNA, 20 bp, human
gtgtcccaggcagccacagt

SEQ ID NO: 222958 - DNA, 20 bp, human
ggaggcacagggacttaaga

SEQ ID NO: 222959 - DNA, 20 bp, human
ggcccaagggcttttaaagc

SEQ ID NO: 222960 - DNA, 20 bp, human
gatgaggcacctacaggcag

SEQ ID NO: 222961 - DNA, 20 bp, human
gtacaggcagaggattaatt

SEQ ID NO: 222962 - DNA, 20 bp, human
gtcttgcatgaggcacctac

SEQ ID NO: 222963 - DNA, 20 bp, human
gggactatgggagacatgga

SEQ ID NO: 222964 - DNA, 20 bp, human
gaggttgcacagttgcgtgg

SEQ ID NO: 222965 - DNA, 20 bp, human
gaaaaagcccacctcctttc

SEQ ID NO: 222966 - DNA, 20 bp, human
ggccgggagagccaatgacg

SEQ ID NO: 222967 - DNA, 20 bp, human
ggtaggaacaagaaccctgc

SEQ ID NO: 222968 - DNA, 20 bp, human
gcctctggcagcctcgtcat

SEQ ID NO: 222969 - DNA, 20 bp, human
gtgcgggctctgttgttccc

SEQ ID NO: 222970 - DNA, 20 bp, human
gaacaccaccggccgagcct

SEQ ID NO: 222971 - DNA, 20 bp, human
gtgaggtcgagaaacctggt

SEQ ID NO: 222972 - DNA, 20 bp, human
gagaattggcagcttggaga

SEQ ID NO: 222973 - DNA, 20 bp, human
gccggtggtgttcagcaccg

SEQ ID NO: 222974 - DNA, 20 bp, human
gttctgccccgtcactgcag

SEQ ID NO: 222975 - DNA, 20 bp, human
gaaattgaggtcgagaaacc

SEQ ID NO: 222976 - DNA, 20 bp, human
gcgcccgcgtcagcaaagag

SEQ ID NO: 222977 - DNA, 20 bp, human
gtcagcaaagagcggagctg

SEQ ID NO: 222978 - DNA, 20 bp, human
gagctcggcgcgagcgcctt

SEQ ID NO: 222979 - DNA, 20 bp, human
gggcgcgagcgcctttggtt

SEQ ID NO: 222980 - DNA, 20 bp, human
gtccaggtggtgaagccagt

SEQ ID NO: 222981 - DNA, 20 bp, human
gaaagcgctttgtgctgatg

SEQ ID NO: 222982 - DNA, 20 bp, human
ggcacaaagcgcttttattt

SEQ ID NO: 222983 - DNA, 20 bp, human
ggcgcgtgccgccaaaccaa

SEQ ID NO: 222984 - DNA, 20 bp, human
ggtgtctagtcttaaaacta

SEQ ID NO: 222985 - DNA, 20 bp, human
ggtcttaaaactagggaagg

SEQ ID NO: 222986 - DNA, 20 bp, human
gcggccgcgggaggtgtaac

SEQ ID NO: 222987 - DNA, 20 bp, human
gggcgcgcgcggtcagggag

SEQ ID NO: 222988 - DNA, 20 bp, human
gtggactcccggcagcccca

SEQ ID NO: 222989 - DNA, 20 bp, human
ggcgggaggtgtaacaggac

SEQ ID NO: 222990 - DNA, 20 bp, human
gcggcaacccgggcgtgcgg

SEQ ID NO: 222991 - DNA, 20 bp, human
gacccagggcactgagccag

SEQ ID NO: 222992 - DNA, 20 bp, human
gcctccctgccttccgggaa

SEQ ID NO: 222993 - DNA, 20 bp, human
gtgtaacaggactggactcc

SEQ ID NO: 222994 - DNA, 20 bp, human
gaggtggagcttctgcaggc

SEQ ID NO: 222995 - DNA, 20 bp, human
gttgccgctgtgcgcggccg

SEQ ID NO: 222996 - DNA, 20 bp, human
gcggccacgggtgggatctc

SEQ ID NO: 222997 - DNA, 20 bp, human
ggtgctctccgcccaggggt

SEQ ID NO: 222998 - DNA, 20 bp, human
gagaacggtgctctccgccc

SEQ ID NO: 222999 - DNA, 20 bp, human
gtaacagccctcagccactc

SEQ ID NO: 223000 - DNA, 20 bp, human
ggggcgcggcggccacgggt

SEQ ID NO: 223001 - DNA, 20 bp, human
gccgaaggagaaggcagttg

SEQ ID NO: 223002 - DNA, 20 bp, human
gaaggcagttgagggcgcgg

SEQ ID NO: 223003 - DNA, 20 bp, human
gagcagcgttctcgcgagaa

SEQ ID NO: 223004 - DNA, 20 bp, human
ggagaaggcagttgagggcg

SEQ ID NO: 223005 - DNA, 20 bp, human
gctctccgcccaggggtggg

SEQ ID NO: 223006 - DNA, 20 bp, human
gaacaaaacgcaggagttga

SEQ ID NO: 223007 - DNA, 20 bp, human
gtagctctgccagcttgcca

SEQ ID NO: 223008 - DNA, 20 bp, human
gagcatgcgtacttccatgt

SEQ ID NO: 223009 - DNA, 20 bp, human
gttaaagaatagttcttgag

SEQ ID NO: 223010 - DNA, 20 bp, human
ggacaggcataacaaaacgc

SEQ ID NO: 223011 - DNA, 20 bp, human
gctagaattagctttacaga

SEQ ID NO: 223012 - DNA, 20 bp, human
gcatttctaaactgctgcta

SEQ ID NO: 223013 - DNA, 20 bp, human
gtagctttacagatggcatt

SEQ ID NO: 223014 - DNA, 20 bp, human
ggctatgaagtgacttaaaa

SEQ ID NO: 223015 - DNA, 20 bp, human
gatgtgggaatgaaaccttg

SEQ ID NO: 223016 - DNA, 20 bp, human
gggcgtatgcaaagcagggg

SEQ ID NO: 223017 - DNA, 20 bp, human
gcagcctcggtgtccgccgg

SEQ ID NO: 223018 - DNA, 20 bp, human
gacgcccccggcggacaccg

SEQ ID NO: 223019 - DNA, 20 bp, human
gcgcccctcacacacgcccc

SEQ ID NO: 223020 - DNA, 20 bp, human
gcgccgggggcgtgtgtgag

SEQ ID NO: 223021 - DNA, 20 bp, human
gtggagagcacacctaggtg

SEQ ID NO: 223022 - DNA, 20 bp, human
gtggctgcccggggtttgct

SEQ ID NO: 223023 - DNA, 20 bp, human
gctgcagcctcggtgtccgc

SEQ ID NO: 223024 - DNA, 20 bp, human
ggtatgcaaagcaggggcgg

SEQ ID NO: 223025 - DNA, 20 bp, human
gacgggcgtatgcaaagcag

SEQ ID NO: 223026 - DNA, 20 bp, human
ggaccccggggcaggctctc

SEQ ID NO: 223027 - DNA, 20 bp, human
gtgccccggggtcaccggtg

SEQ ID NO: 223028 - DNA, 20 bp, human
ggagcctgccccggggtcac

SEQ ID NO: 223029 - DNA, 20 bp, human
gctggggagtcgggagatgg

SEQ ID NO: 223030 - DNA, 20 bp, human
gtccagggaaagcggggtgt

SEQ ID NO: 223031 - DNA, 20 bp, human
gagggtctccagggaaagcg

SEQ ID NO: 223032 - DNA, 20 bp, human
gcggggtcaccggtgcggtc

SEQ ID NO: 223033 - DNA, 20 bp, human
gcctctgaattccagagtag

SEQ ID NO: 223034 - DNA, 20 bp, human
ggcaggctctctggaatcct

SEQ ID NO: 223035 - DNA, 20 bp, human
gaaaggctctcccactactc

SEQ ID NO: 223036 - DNA, 20 bp, human
gggcatctcagagaccagtg

SEQ ID NO: 223037 - DNA, 20 bp, human
gcaccccagaatgccagagc

SEQ ID NO: 223038 - DNA, 20 bp, human
gcagcacctggggcaaccca

SEQ ID NO: 223039 - DNA, 20 bp, human
gcaggtttcaactcaggctc

SEQ ID NO: 223040 - DNA, 20 bp, human
gaaccaacccccaaatcttc

SEQ ID NO: 223041 - DNA, 20 bp, human
gcctgttcctcacagcacct

SEQ ID NO: 223042 - DNA, 20 bp, human
gctcccagctctggcattct

SEQ ID NO: 223043 - DNA, 20 bp, human
gctgctctctctgggagcta

SEQ ID NO: 223044 - DNA, 20 bp, human
gccaagcacttcctgttcca

SEQ ID NO: 223045 - DNA, 20 bp, human
ggatgaagcctgaagatttg

SEQ ID NO: 223046 - DNA, 20 bp, human
gcccccaaggggaacagatc

SEQ ID NO: 223047 - DNA, 20 bp, human
ggggctattgtgctgcctgt

SEQ ID NO: 223048 - DNA, 20 bp, human
gccagagagcggcagccccg

SEQ ID NO: 223049 - DNA, 20 bp, human
gggcagcacaatagcccccg

SEQ ID NO: 223050 - DNA, 20 bp, human
gtgccgctctctggcttaag

SEQ ID NO: 223051 - DNA, 20 bp, human
gtctctgcagaataggcgag

SEQ ID NO: 223052 - DNA, 20 bp, human
gtgctgggtggtaaggagat

SEQ ID NO: 223053 - DNA, 20 bp, human
gttccggatctgttcccctt

SEQ ID NO: 223054 - DNA, 20 bp, human
gggctagccgtgcctctccc

SEQ ID NO: 223055 - DNA, 20 bp, human
gttccaccaatccatggagg

SEQ ID NO: 223056 - DNA, 20 bp, human
gcctgactgaccctggtagt

SEQ ID NO: 223057 - DNA, 20 bp, human
gccaaggacgttgccaccct

SEQ ID NO: 223058 - DNA, 20 bp, human
ggggtcagtcaggctcgctt

SEQ ID NO: 223059 - DNA, 20 bp, human
ggaccttcccgcagagtcag

SEQ ID NO: 223060 - DNA, 20 bp, human
ggacgttgccacccttggct

SEQ ID NO: 223061 - DNA, 20 bp, human
ggtcaagtacacccagccaa

SEQ ID NO: 223062 - DNA, 20 bp, human
gtatcacactaaccagcaga

SEQ ID NO: 223063 - DNA, 20 bp, human
ggagaagcctctgactctgc

SEQ ID NO: 223064 - DNA, 20 bp, human
gaagtacacccagccaaggg

SEQ ID NO: 223065 - DNA, 20 bp, human
gacacagctgtgcagtgagt

SEQ ID NO: 223066 - DNA, 20 bp, human
gtggctgtataatctcacac

SEQ ID NO: 223067 - DNA, 20 bp, human
ggaccttcccgcagagtcag

SEQ ID NO: 223068 - DNA, 20 bp, human
gtaagcctaggtttgggtct

SEQ ID NO: 223069 - DNA, 20 bp, human
gtatcacactaaccagcaga

SEQ ID NO: 223070 - DNA, 20 bp, human
gtcagagataagcctaggtt

SEQ ID NO: 223071 - DNA, 20 bp, human
gagattaaatgagtcagtga

SEQ ID NO: 223072 - DNA, 20 bp, human
gagttgagtctcagtggtaa

SEQ ID NO: 223073 - DNA, 20 bp, human
ggagaagcctctgactctgc

SEQ ID NO: 223074 - DNA, 20 bp, human
gtgtagcagttgagtctcag

SEQ ID NO: 223075 - DNA, 20 bp, human
gttggtagttattttgtgcc

SEQ ID NO: 223076 - DNA, 20 bp, human
gggcctgcccgggagatggg

SEQ ID NO: 223077 - DNA, 20 bp, human
gcatctcccgggcaggccca

SEQ ID NO: 223078 - DNA, 20 bp, human
gcccaggcagccgacggggt

SEQ ID NO: 223079 - DNA, 20 bp, human
ggcgcttaatgcccctctaa

SEQ ID NO: 223080 - DNA, 20 bp, human
gcacaggcttcccaccccgt

SEQ ID NO: 223081 - DNA, 20 bp, human
gcggggccctgacccatcta

SEQ ID NO: 223082 - DNA, 20 bp, human
gagtctgcccaggcagccga

SEQ ID NO: 223083 - DNA, 20 bp, human
gagccagccagcttcttccc

SEQ ID NO: 223084 - DNA, 20 bp, human
gcgcccccatagatgggtca

SEQ ID NO: 223085 - DNA, 20 bp, human
ggggaaacccccactcaaca

SEQ ID NO: 223086 - DNA, 20 bp, human
gagtaggaggggcctgtaga

SEQ ID NO: 223087 - DNA, 20 bp, human
gccacaaaatggcggcgggt

SEQ ID NO: 223088 - DNA, 20 bp, human
gggagaagggaggtgaatgg

SEQ ID NO: 223089 - DNA, 20 bp, human
gccacgccgcagccacaaaa

SEQ ID NO: 223090 - DNA, 20 bp, human
gggccccgggacagacgcgc

SEQ ID NO: 223091 - DNA, 20 bp, human
gaagcccagactccagaccg

SEQ ID NO: 223092 - DNA, 20 bp, human
gcggcctgcgcgtctgtccc

SEQ ID NO: 223093 - DNA, 20 bp, human
gcagaccgaggtccagaatt

SEQ ID NO: 223094 - DNA, 20 bp, human
gaccccggcccccggcaacg

SEQ ID NO: 223095 - DNA, 20 bp, human
ggcgtgcgtcgtgcccgccg

SEQ ID NO: 223096 - DNA, 20 bp, human
gaacccgggcttggagaagg

SEQ ID NO: 223097 - DNA, 20 bp, human
gagcgcgcgtgcccggtcac

SEQ ID NO: 223098 - DNA, 20 bp, human
gggagggagcggagcggcat

SEQ ID NO: 223099 - DNA, 20 bp, human
gcacccctcactcctgcttg

SEQ ID NO: 223100 - DNA, 20 bp, human
gtgcgcatgccccgtatcca

SEQ ID NO: 223101 - DNA, 20 bp, human
gcgcgtgcccggtcaccggg

SEQ ID NO: 223102 - DNA, 20 bp, human
ggtctgccctgtcctcaagc

SEQ ID NO: 223103 - DNA, 20 bp, human
gtgtcctcaagcaggagtga

SEQ ID NO: 223104 - DNA, 20 bp, human
gcggaggcggccttggatac

SEQ ID NO: 223105 - DNA, 20 bp, human
gtcgtgggacaaggacgaag

SEQ ID NO: 223106 - DNA, 20 bp, human
gcagaggtagccgtggaagg

SEQ ID NO: 223107 - DNA, 20 bp, human
gcgccgggagccgccttcca

SEQ ID NO: 223108 - DNA, 20 bp, human
gcgcggccagaggcagactc

SEQ ID NO: 223109 - DNA, 20 bp, human
gcgagccgcgcgctgtgcag

SEQ ID NO: 223110 - DNA, 20 bp, human
ggagcagcttcgaggatgtc

SEQ ID NO: 223111 - DNA, 20 bp, human
gcatggcactgcgggtctgg

SEQ ID NO: 223112 - DNA, 20 bp, human
ggctacctctgcacagcgcg

SEQ ID NO: 223113 - DNA, 20 bp, human
ggtgcagaggtagccgtgga

SEQ ID NO: 223114 - DNA, 20 bp, human
ggcgcatggcactgcgggtc

SEQ ID NO: 223115 - DNA, 20 bp, human
gggtgcgtcacgctgcgtca

SEQ ID NO: 223116 - DNA, 20 bp, human
gcgagtcgggccgcgtgggg

SEQ ID NO: 223117 - DNA, 20 bp, human
gcgactcgcgcggcgacgtc

SEQ ID NO: 223118 - DNA, 20 bp, human
ggtgcgttcgctggatccat

SEQ ID NO: 223119 - DNA, 20 bp, human
gaacgcaccgcccccccacg

SEQ ID NO: 223120 - DNA, 20 bp, human
gcgcgcgagtcgggccgcgt

SEQ ID NO: 223121 - DNA, 20 bp, human
ggtgaccctgagcgggacga

SEQ ID NO: 223122 - DNA, 20 bp, human
ggggggggcggtgcgttcgc

SEQ ID NO: 223123 - DNA, 20 bp, human
gtcggctgggagccgggcgt

SEQ ID NO: 223124 - DNA, 20 bp, human
ggtcgggccgcgtggggggg

SEQ ID NO: 223125 - DNA, 20 bp, human
gcgggccacgtgaccctgag

SEQ ID NO: 223126 - DNA, 20 bp, human
ggcggggcaaaccaatcctc

SEQ ID NO: 223127 - DNA, 20 bp, human
gtcccagagaagccggaccg

SEQ ID NO: 223128 - DNA, 20 bp, human
gtccgcgcctgagccatggg

SEQ ID NO: 223129 - DNA, 20 bp, human
gcaccgcggtccggcttctc

SEQ ID NO: 223130 - DNA, 20 bp, human
gcaggcgcggaccatcccgc

SEQ ID NO: 223131 - DNA, 20 bp, human
gccgagccggctcttgaccc

SEQ ID NO: 223132 - DNA, 20 bp, human
gacccaggaagagcgtgcgc

SEQ ID NO: 223133 - DNA, 20 bp, human
ggaatgaacaccaaccggaa

SEQ ID NO: 223134 - DNA, 20 bp, human
gaggaagacacagcatagaa

SEQ ID NO: 223135 - DNA, 20 bp, human
ggcctgcgcacgctcttcct

SEQ ID NO: 223136 - DNA, 20 bp, human
gaggcccagaaagtcgccta

SEQ ID NO: 223137 - DNA, 20 bp, human
gccagcagcccgctgtcgat

SEQ ID NO: 223138 - DNA, 20 bp, human
gctgctgggtccggcgatgc

SEQ ID NO: 223139 - DNA, 20 bp, human
gctggggccccctgttctgg

SEQ ID NO: 223140 - DNA, 20 bp, human
gtcgcctaaggcagcttccg

SEQ ID NO: 223141 - DNA, 20 bp, human
gtcaccggcgcacgtcacta

SEQ ID NO: 223142 - DNA, 20 bp, human
gaccctggggccccctgttc

SEQ ID NO: 223143 - DNA, 20 bp, human
gaacttgccgatcgggtctg

SEQ ID NO: 223144 - DNA, 20 bp, human
gccggagccaggtgccggca

SEQ ID NO: 223145 - DNA, 20 bp, human
gctgccttaggcgactttct

SEQ ID NO: 223146 - DNA, 20 bp, human
gtgtccctgggtgtgggtat

SEQ ID NO: 223147 - DNA, 20 bp, human
ggcagcccgaatatgtccct

SEQ ID NO: 223148 - DNA, 20 bp, human
gggtgtggggcaatttgggt

SEQ ID NO: 223149 - DNA, 20 bp, human
gccacacccagggacatatt

SEQ ID NO: 223150 - DNA, 20 bp, human
gaatccgcgtggaggggtgt

SEQ ID NO: 223151 - DNA, 20 bp, human
ggggaaatgaacagtcagtc

SEQ ID NO: 223152 - DNA, 20 bp, human
gtatgggtgtggggcaattt

SEQ ID NO: 223153 - DNA, 20 bp, human
ggagtggtgagctggtccga

SEQ ID NO: 223154 - DNA, 20 bp, human
gccgcgtggaggggtgtcgg

SEQ ID NO: 223155 - DNA, 20 bp, human
gggcgtaaacaaggtaggga

SEQ ID NO: 223156 - DNA, 20 bp, human
gctaagagcaggtacggagg

SEQ ID NO: 223157 - DNA, 20 bp, human
gttaaacaacgggaaggaag

SEQ ID NO: 223158 - DNA, 20 bp, human
gaagagagcgcagttctgat

SEQ ID NO: 223159 - DNA, 20 bp, human
gcgcgcgccagaatgccaga

SEQ ID NO: 223160 - DNA, 20 bp, human
gctaaattcgtccacttccc

SEQ ID NO: 223161 - DNA, 20 bp, human
gcagaactgcgctctcttct

SEQ ID NO: 223162 - DNA, 20 bp, human
gtggcattctggcgcgcgaa

SEQ ID NO: 223163 - DNA, 20 bp, human
gcggggctgtaaagggagaa

SEQ ID NO: 223164 - DNA, 20 bp, human
gcgcggagggggtgtggtaa

SEQ ID NO: 223165 - DNA, 20 bp, human
gcggaaggcgcgctaagagc

SEQ ID NO: 223166 - DNA, 20 bp, human
gtggcctctcccagaggtac

SEQ ID NO: 223167 - DNA, 20 bp, human
gaggccctacgagagactgc

SEQ ID NO: 223168 - DNA, 20 bp, human
gggagaggccacaaaggggt

SEQ ID NO: 223169 - DNA, 20 bp, human
gcaagccagcagtctctcgt

SEQ ID NO: 223170 - DNA, 20 bp, human
gcagggaggaaccgagttcg

SEQ ID NO: 223171 - DNA, 20 bp, human
ggaggagaatagggactcgc

SEQ ID NO: 223172 - DNA, 20 bp, human
gcgtgtgtgcgcctaatctc

SEQ ID NO: 223173 - DNA, 20 bp, human
gacgcaagatggcagctaaa

SEQ ID NO: 223174 - DNA, 20 bp, human
gaaggggagagctgcttgag

SEQ ID NO: 223175 - DNA, 20 bp, human
gctgtcgcgcgtgcgcaggg

SEQ ID NO: 223176 - DNA, 20 bp, human
ggtggccgcgcggcatcctg

SEQ ID NO: 223177 - DNA, 20 bp, human
ggggacacaacagaacgctc

SEQ ID NO: 223178 - DNA, 20 bp, human
ggccgccactagcactaaga

SEQ ID NO: 223179 - DNA, 20 bp, human
ggggatgcgcaaagcaggcg

SEQ ID NO: 223180 - DNA, 20 bp, human
gtccctcttagtgctagtgg

SEQ ID NO: 223181 - DNA, 20 bp, human
gtaagagggatgcgcaaagc

SEQ ID NO: 223182 - DNA, 20 bp, human
gcggggtcggctgtatcacg

SEQ ID NO: 223183 - DNA, 20 bp, human
gaacctaataaaagggtggt

SEQ ID NO: 223184 - DNA, 20 bp, human
ggtccctgcctacaatttta

SEQ ID NO: 223185 - DNA, 20 bp, human
gtaccgaccacccttttatt

SEQ ID NO: 223186 - DNA, 20 bp, human
gtaaacaaataaacccggag

SEQ ID NO: 223187 - DNA, 20 bp, human
gacccagttgcttgtgtcga

SEQ ID NO: 223188 - DNA, 20 bp, human
gggaggcgggtccagagata

SEQ ID NO: 223189 - DNA, 20 bp, human
gaagcgggaaggaggagcta

SEQ ID NO: 223190 - DNA, 20 bp, human
gggcgggaaaagagttcagg

SEQ ID NO: 223191 - DNA, 20 bp, human
gagccggttcggagccgaaa

SEQ ID NO: 223192 - DNA, 20 bp, human
gaggggcgggaaaagagttc

SEQ ID NO: 223193 - DNA, 20 bp, human
gtggacctgctgaagcggga

SEQ ID NO: 223194 - DNA, 20 bp, human
gggttcggagccgaaagggg

SEQ ID NO: 223195 - DNA, 20 bp, human
ggggaaaagagttcaggagg

SEQ ID NO: 223196 - DNA, 20 bp, human
ggagctctcagtcccgtccc

SEQ ID NO: 223197 - DNA, 20 bp, human
ggctcattggtcgcggccag

SEQ ID NO: 223198 - DNA, 20 bp, human
gcccgccctcgcagccttgg

SEQ ID NO: 223199 - DNA, 20 bp, human
ggccgccaaggctgcgaggg

SEQ ID NO: 223200 - DNA, 20 bp, human
ggctcgctgtcgtcagtgct

SEQ ID NO: 223201 - DNA, 20 bp, human
gggagaggtggtgtcaccga

SEQ ID NO: 223202 - DNA, 20 bp, human
ggaaagcgaggcccggggac

SEQ ID NO: 223203 - DNA, 20 bp, human
ggactgagagctctgaaagg

SEQ ID NO: 223204 - DNA, 20 bp, human
gcgggggcggggaaaagcgc

SEQ ID NO: 223205 - DNA, 20 bp, human
gagtgctaggaacctgcgcc

SEQ ID NO: 223206 - DNA, 20 bp, human
gaggggcgatgacccgggaa

SEQ ID NO: 223207 - DNA, 20 bp, human
gcaggctcagggtagggcga

SEQ ID NO: 223208 - DNA, 20 bp, human
ggggctcgcggcccggaaga

SEQ ID NO: 223209 - DNA, 20 bp, human
gggatcggctcgcgcgcctg

SEQ ID NO: 223210 - DNA, 20 bp, human
ggggtgtgtcgcctcccgtg

SEQ ID NO: 223211 - DNA, 20 bp, human
gaggggaggggcgatgaccc

SEQ ID NO: 223212 - DNA, 20 bp, human
gcgcgcctgaggggcggtgc

SEQ ID NO: 223213 - DNA, 20 bp, human
gcagccccaaagcggcgcgc

SEQ ID NO: 223214 - DNA, 20 bp, human
gagccccctgcgcgccgctt

SEQ ID NO: 223215 - DNA, 20 bp, human
gaccgcgccgtcgcggtcga

SEQ ID NO: 223216 - DNA, 20 bp, human
gtgcgccccgccgctctgag

SEQ ID NO: 223217 - DNA, 20 bp, human
gccgaggaggcgaaggggaa

SEQ ID NO: 223218 - DNA, 20 bp, human
ggtcgagagagccagctcta

SEQ ID NO: 223219 - DNA, 20 bp, human
ggagccagctctagggtttg

SEQ ID NO: 223220 - DNA, 20 bp, human
gcccgggccgaggaggcgaa

SEQ ID NO: 223221 - DNA, 20 bp, human
ggaggggaacctgagcggga

SEQ ID NO: 223222 - DNA, 20 bp, human
ggggcgggcgcgagacgggg

SEQ ID NO: 223223 - DNA, 20 bp, human
gactcggccgctcagagcgg

SEQ ID NO: 223224 - DNA, 20 bp, human
gcgcccccgccacagtcact

SEQ ID NO: 223225 - DNA, 20 bp, human
gtgagcgggagggccctgag

SEQ ID NO: 223226 - DNA, 20 bp, human
ggtcccaagcaaatgaaggg

SEQ ID NO: 223227 - DNA, 20 bp, human
ggaggtcccaagcaaatgaa

SEQ ID NO: 223228 - DNA, 20 bp, human
ggccactgagactctagatg

SEQ ID NO: 223229 - DNA, 20 bp, human
gcagttgagggggtggaata

SEQ ID NO: 223230 - DNA, 20 bp, human
gtgaagggcggggacagttg

SEQ ID NO: 223231 - DNA, 20 bp, human
ggaactgagtggctgtgaaa

SEQ ID NO: 223232 - DNA, 20 bp, human
ggccccagtcatgttgagaa

SEQ ID NO: 223233 - DNA, 20 bp, human
gctcaagatagtagtgtcag

SEQ ID NO: 223234 - DNA, 20 bp, human
ggccccatctagagtctcag

SEQ ID NO: 223235 - DNA, 20 bp, human
gtggaatagggacggcagca

SEQ ID NO: 223236 - DNA, 20 bp, human
ggggcaaaaacgtggtagag

SEQ ID NO: 223237 - DNA, 20 bp, human
gtcaacctggggcaaaaacg

SEQ ID NO: 223238 - DNA, 20 bp, human
gaaaaacgtggtagagcgga

SEQ ID NO: 223239 - DNA, 20 bp, human
ggaggagagtaggaagagcc

SEQ ID NO: 223240 - DNA, 20 bp, human
gttcactgaacattgagtgc

SEQ ID NO: 223241 - DNA, 20 bp, human
ggatgtggtactctgttctg

SEQ ID NO: 223242 - DNA, 20 bp, human
gtgcaggaaaaacctcaacc

SEQ ID NO: 223243 - DNA, 20 bp, human
gacctgagataaatcttcac

SEQ ID NO: 223244 - DNA, 20 bp, human
gaatcacaagctatcacaaa

SEQ ID NO: 223245 - DNA, 20 bp, human
gagtgaacagaaagacgatg

SEQ ID NO: 223246 - DNA, 20 bp, human
gaaatccatactggggatgg

SEQ ID NO: 223247 - DNA, 20 bp, human
gtaaaaatccatactgggga

SEQ ID NO: 223248 - DNA, 20 bp, human
gtaaactaaaaatccatact

SEQ ID NO: 223249 - DNA, 20 bp, human
gtagagttagagtagtgggt

SEQ ID NO: 223250 - DNA, 20 bp, human
gtactctaactctaaaactt

SEQ ID NO: 223251 - DNA, 20 bp, human
ggaggactttggaaagcgga

SEQ ID NO: 223252 - DNA, 20 bp, human
gtcagcctccatccccagta

SEQ ID NO: 223253 - DNA, 20 bp, human
gactctaaaacttaggagaa

SEQ ID NO: 223254 - DNA, 20 bp, human
gaggcataacactcattagt

SEQ ID NO: 223255 - DNA, 20 bp, human
ggctggaaagaactgtagag

SEQ ID NO: 223256 - DNA, 20 bp, human
gtccttggggagattccctg

SEQ ID NO: 223257 - DNA, 20 bp, human
gacctcagtgacaaacccca

SEQ ID NO: 223258 - DNA, 20 bp, human
gctcacacccggccaatcct

SEQ ID NO: 223259 - DNA, 20 bp, human
gtgctggtgtccacaaggag

SEQ ID NO: 223260 - DNA, 20 bp, human
gggtttgtcactgaggtcgg

SEQ ID NO: 223261 - DNA, 20 bp, human
ggtagagggcaattttgctg

SEQ ID NO: 223262 - DNA, 20 bp, human
gtagggaactcttgggactg

SEQ ID NO: 223263 - DNA, 20 bp, human
gtctcgctttgagattcctt

SEQ ID NO: 223264 - DNA, 20 bp, human
gggagcgcaggagggcttgg

SEQ ID NO: 223265 - DNA, 20 bp, human
gcaaagccagcaacttgaac

SEQ ID NO: 223266 - DNA, 20 bp, human
ggtgaggctgaaccaaccaa

SEQ ID NO: 223267 - DNA, 20 bp, human
gataaggctcgagacaccat

SEQ ID NO: 223268 - DNA, 20 bp, human
gtgggctctaaactgctcag

SEQ ID NO: 223269 - DNA, 20 bp, human
ggcctcactcggccaatcct

SEQ ID NO: 223270 - DNA, 20 bp, human
gtgctgcttgagatttttgg

SEQ ID NO: 223271 - DNA, 20 bp, human
gggctcgagacaccattggt

SEQ ID NO: 223272 - DNA, 20 bp, human
gaaacatcgcgattaatagg

SEQ ID NO: 223273 - DNA, 20 bp, human
gtccaaacatcgcgattaat

SEQ ID NO: 223274 - DNA, 20 bp, human
gcaagcagcaaataaccttt

SEQ ID NO: 223275 - DNA, 20 bp, human
ggagatccccaaggtgtcag

SEQ ID NO: 223276 - DNA, 20 bp, human
ggataaacagtaagggaggt

SEQ ID NO: 223277 - DNA, 20 bp, human
gaagagataaacagtaaggg

SEQ ID NO: 223278 - DNA, 20 bp, human
gaatatcagcagaacacaat

SEQ ID NO: 223279 - DNA, 20 bp, human
gatgggaaaagattttaatg

SEQ ID NO: 223280 - DNA, 20 bp, human
ggaatatgggtacatggagg

SEQ ID NO: 223281 - DNA, 20 bp, human
gagtcaaataaacgtatgaa

SEQ ID NO: 223282 - DNA, 20 bp, human
gtgaaagagataaacagtaa

SEQ ID NO: 223283 - DNA, 20 bp, human
gcctcagctcctgaataact

SEQ ID NO: 223284 - DNA, 20 bp, human
gcaggtgctcgccccatgcc

SEQ ID NO: 223285 - DNA, 20 bp, human
gttgcatgaatatgggtaca

SEQ ID NO: 223286 - DNA, 20 bp, human
gcatgtaaaagacacgagac

SEQ ID NO: 223287 - DNA, 20 bp, human
gaacagtaagagtcgctctt

SEQ ID NO: 223288 - DNA, 20 bp, human
gtcatttcaacgttcctcag

SEQ ID NO: 223289 - DNA, 20 bp, human
gaatattagcagaatggagt

SEQ ID NO: 223290 - DNA, 20 bp, human
gcgactcttactgtttctca

SEQ ID NO: 223291 - DNA, 20 bp, human
ggtagataggtacgtagaag

SEQ ID NO: 223292 - DNA, 20 bp, human
gagtttgcttgcatgtagat

SEQ ID NO: 223293 - DNA, 20 bp, human
ggataggtacgtagaagagg

SEQ ID NO: 223294 - DNA, 20 bp, human
gggcatttaggcttaggata

SEQ ID NO: 223295 - DNA, 20 bp, human
gacttctggcatttaggctt

SEQ ID NO: 223296 - DNA, 20 bp, human
gtgggaggaaaccactgagg

SEQ ID NO: 223297 - DNA, 20 bp, human
gcatgaatatgggtacctga

SEQ ID NO: 223298 - DNA, 20 bp, human
gatgagaaaagattataatg

SEQ ID NO: 223299 - DNA, 20 bp, human
gtaaaaatgtgcattgcgtc

SEQ ID NO: 223300 - DNA, 20 bp, human
gtagtaaaatctcctccttc

SEQ ID NO: 223301 - DNA, 20 bp, human
ggtagaaatacttatataca

SEQ ID NO: 223302 - DNA, 20 bp, human
gcgtcaaataaatgtataca

SEQ ID NO: 223303 - DNA, 20 bp, human
gtcaaataatataatgtttc

SEQ ID NO: 223304 - DNA, 20 bp, human
ggaatatgggtacctgaagg

SEQ ID NO: 223305 - DNA, 20 bp, human
ggacattttttacctttttc

SEQ ID NO: 223306 - DNA, 20 bp, human
gtgtgtgaggacctaactgg

SEQ ID NO: 223307 - DNA, 20 bp, human
gcgctgatgtgtgggacggt

SEQ ID NO: 223308 - DNA, 20 bp, human
gaaagccaaggccttcatgg

SEQ ID NO: 223309 - DNA, 20 bp, human
gatagcacccgctgatgtgt

SEQ ID NO: 223310 - DNA, 20 bp, human
gccagagcatggcactcatc

SEQ ID NO: 223311 - DNA, 20 bp, human
gcatctgcaaccccccagtt

SEQ ID NO: 223312 - DNA, 20 bp, human
ggtctgtgtgaggacctaac

SEQ ID NO: 223313 - DNA, 20 bp, human
gctgggccaaggtcccttgt

SEQ ID NO: 223314 - DNA, 20 bp, human
gtgatgtgtggcaaggtgga

SEQ ID NO: 223315 - DNA, 20 bp, human
gtggagacttggcactagtt

SEQ ID NO: 223316 - DNA, 20 bp, human
gagagtagggtacacttgga

SEQ ID NO: 223317 - DNA, 20 bp, human
gcttggagggactttgttct

SEQ ID NO: 223318 - DNA, 20 bp, human
gctgtccctgaaagagagat

SEQ ID NO: 223319 - DNA, 20 bp, human
gtctgggttgtgccccacat

SEQ ID NO: 223320 - DNA, 20 bp, human
gaaacatggctgtatgaatg

SEQ ID NO: 223321 - DNA, 20 bp, human
gcattcctttaccacctatg

SEQ ID NO: 223322 - DNA, 20 bp, human
gaaagagagtagggtacact

SEQ ID NO: 223323 - DNA, 20 bp, human
gtgataatggaaagagagta

SEQ ID NO: 223324 - DNA, 20 bp, human
gagtcactgcatttattggc

SEQ ID NO: 223325 - DNA, 20 bp, human
gaaagagatcatctcagcac

SEQ ID NO: 223326 - DNA, 20 bp, human
ggcaaaacgatgccctgtgt

SEQ ID NO: 223327 - DNA, 20 bp, human
gatagtgtggataagattgg

SEQ ID NO: 223328 - DNA, 20 bp, human
gtgccctgtgtgggtgaaac

SEQ ID NO: 223329 - DNA, 20 bp, human
gacagggcatcgttttgccc

SEQ ID NO: 223330 - DNA, 20 bp, human
ggaaatagtgtggataagat

SEQ ID NO: 223331 - DNA, 20 bp, human
gaggcagggctgtatggcca

SEQ ID NO: 223332 - DNA, 20 bp, human
gacgtccaatctggcaggca

SEQ ID NO: 223333 - DNA, 20 bp, human
gtctagagtccctacacttc

SEQ ID NO: 223334 - DNA, 20 bp, human
gtgctaacatgaggtttttc

SEQ ID NO: 223335 - DNA, 20 bp, human
gggccaggactgtaatcatg

SEQ ID NO: 223336 - DNA, 20 bp, human
gtctccagggtcacagaagg

SEQ ID NO: 223337 - DNA, 20 bp, human
gatctctccagggtcacaga

SEQ ID NO: 223338 - DNA, 20 bp, human
gtgaagctcggactccaagg

SEQ ID NO: 223339 - DNA, 20 bp, human
gctaactaaccacgaggaag

SEQ ID NO: 223340 - DNA, 20 bp, human
ggcaaacggcatatatctta

SEQ ID NO: 223341 - DNA, 20 bp, human
gtcagtaaggaacaaatcct

SEQ ID NO: 223342 - DNA, 20 bp, human
gaggagaaaacgctccagct

SEQ ID NO: 223343 - DNA, 20 bp, human
gcctcaggacaaggtcagta

SEQ ID NO: 223344 - DNA, 20 bp, human
gaaacgctccagctgggttc

SEQ ID NO: 223345 - DNA, 20 bp, human
gccatgtaaaatatctctcc

SEQ ID NO: 223346 - DNA, 20 bp, human
ggcgggaagacgcggggcga

SEQ ID NO: 223347 - DNA, 20 bp, human
ggccgcagaagcctcgagcc

SEQ ID NO: 223348 - DNA, 20 bp, human
gtgcgggcgggtcctccctg

SEQ ID NO: 223349 - DNA, 20 bp, human
gggctggcggcggatgtccg

SEQ ID NO: 223350 - DNA, 20 bp, human
ggcgagggcgggaagacgcg

SEQ ID NO: 223351 - DNA, 20 bp, human
gaccctcccgcctgcggacg

SEQ ID NO: 223352 - DNA, 20 bp, human
gaggccgcgcgcacgtggtt

SEQ ID NO: 223353 - DNA, 20 bp, human
gcgccgcggggcgtgcggga

SEQ ID NO: 223354 - DNA, 20 bp, human
gcaagcgaggagacgacttg

SEQ ID NO: 223355 - DNA, 20 bp, human
gcgcaggcgggagggtccca

SEQ ID NO: 223356 - DNA, 20 bp, human
gtgcgcaggcgaaagcccac

SEQ ID NO: 223357 - DNA, 20 bp, human
gacgctgccgcagtgaactg

SEQ ID NO: 223358 - DNA, 20 bp, human
gcgaaagcccactggctcac

SEQ ID NO: 223359 - DNA, 20 bp, human
gctctcaggcgcaggctgag

SEQ ID NO: 223360 - DNA, 20 bp, human
gaggggcacgggtgtctccg

SEQ ID NO: 223361 - DNA, 20 bp, human
gtctaaggatgagaaacggg

SEQ ID NO: 223362 - DNA, 20 bp, human
gaatcggcttctccgtgcgc

SEQ ID NO: 223363 - DNA, 20 bp, human
gacaaatcccgtgagccagt

SEQ ID NO: 223364 - DNA, 20 bp, human
gcggagaagccgattctcct

SEQ ID NO: 223365 - DNA, 20 bp, human
gcctgagaggtaagagaggg

SEQ ID NO: 223366 - DNA, 20 bp, human
ggagctactggctcaaggga

SEQ ID NO: 223367 - DNA, 20 bp, human
ggggggagcaggcttggctc

SEQ ID NO: 223368 - DNA, 20 bp, human
gcaccggggccgttgctcgg

SEQ ID NO: 223369 - DNA, 20 bp, human
ggggaagtgggaggagctac

SEQ ID NO: 223370 - DNA, 20 bp, human
gtgaaccgaaacctggccgt

SEQ ID NO: 223371 - DNA, 20 bp, human
gtgagcgagcgcggggtgtt

SEQ ID NO: 223372 - DNA, 20 bp, human
gctactggctcaagggaggg

SEQ ID NO: 223373 - DNA, 20 bp, human
gggcgcctgcccattggtgg

SEQ ID NO: 223374 - DNA, 20 bp, human
gtcggctcgccgaacgtttc

SEQ ID NO: 223375 - DNA, 20 bp, human
ggagcaacggccccggtgat

SEQ ID NO: 223376 - DNA, 20 bp, human
gtctcgcccaaggcattctg

SEQ ID NO: 223377 - DNA, 20 bp, human
gcgaactcgcggtgcataat

SEQ ID NO: 223378 - DNA, 20 bp, human
gtacaagccccagaatgcct

SEQ ID NO: 223379 - DNA, 20 bp, human
ggcgagacgcgagagcacgg

SEQ ID NO: 223380 - DNA, 20 bp, human
gacgcgagagcacggaggag

SEQ ID NO: 223381 - DNA, 20 bp, human
gtgctctcgcgtctcgccca

SEQ ID NO: 223382 - DNA, 20 bp, human
gtgaggtggccggtttgtta

SEQ ID NO: 223383 - DNA, 20 bp, human
gaatgggaattgtagttttt

SEQ ID NO: 223384 - DNA, 20 bp, human
ggcgagttcgcggactaaac

SEQ ID NO: 223385 - DNA, 20 bp, human
gcacttggcgtgactcttgt

SEQ ID NO: 223386 - DNA, 20 bp, human
ggagccggaacaggatgact

SEQ ID NO: 223387 - DNA, 20 bp, human
gggggcatcagcgttcgagc

SEQ ID NO: 223388 - DNA, 20 bp, human
ggccaacgtctcagtctagg

SEQ ID NO: 223389 - DNA, 20 bp, human
ggctgcttttccgatcacgt

SEQ ID NO: 223390 - DNA, 20 bp, human
gcatcctgttccggctcaaa

SEQ ID NO: 223391 - DNA, 20 bp, human
gtaaaatgagcccacgtgat

SEQ ID NO: 223392 - DNA, 20 bp, human
gccttggcgcgatgctcctt

SEQ ID NO: 223393 - DNA, 20 bp, human
gctcgcaggctaggcgaagg

SEQ ID NO: 223394 - DNA, 20 bp, human
gctaggcgaaggaggcggag

SEQ ID NO: 223395 - DNA, 20 bp, human
ggggaaatgtagttttctag

SEQ ID NO: 223396 - DNA, 20 bp, human
ggggccacggccggaagtgg

SEQ ID NO: 223397 - DNA, 20 bp, human
gccgaaggtgcgcacgtccc

SEQ ID NO: 223398 - DNA, 20 bp, human
ggagagtgctaagaatcgcg

SEQ ID NO: 223399 - DNA, 20 bp, human
gaacctggtggcgtcgtccc

SEQ ID NO: 223400 - DNA, 20 bp, human
ggggctgtggagcgccccga

SEQ ID NO: 223401 - DNA, 20 bp, human
gtggcgtcgtcccagggctg

SEQ ID NO: 223402 - DNA, 20 bp, human
gcgcgctcgcaggctagcca

SEQ ID NO: 223403 - DNA, 20 bp, human
ggcctgcgagcgcgtcccgg

SEQ ID NO: 223404 - DNA, 20 bp, human
gaggccacaacctgacccaa

SEQ ID NO: 223405 - DNA, 20 bp, human
gttgctgcggttggatggat

SEQ ID NO: 223406 - DNA, 20 bp, human
ggccactgcggccactgaag

SEQ ID NO: 223407 - DNA, 20 bp, human
ggggcaagcctggacttagg

SEQ ID NO: 223408 - DNA, 20 bp, human
gcggaggcctccctgaggtc

SEQ ID NO: 223409 - DNA, 20 bp, human
gaggacggtccgacttcgtg

SEQ ID NO: 223410 - DNA, 20 bp, human
gtgccacccaccggaagtga

SEQ ID NO: 223411 - DNA, 20 bp, human
gcgcaaggacccggacctca

SEQ ID NO: 223412 - DNA, 20 bp, human
gggaggcctccgcacgaagt

SEQ ID NO: 223413 - DNA, 20 bp, human
ggacgggcaagcctggactt

SEQ ID NO: 223414 - DNA, 20 bp, human
gagagggaggctgtccgcac

SEQ ID NO: 223415 - DNA, 20 bp, human
gactgcggccactgaagcgg

SEQ ID NO: 223416 - DNA, 20 bp, human
gcagacccgcagcggagtcg

SEQ ID NO: 223417 - DNA, 20 bp, human
gctcctgctgcggaggaaga

SEQ ID NO: 223418 - DNA, 20 bp, human
gcggagtcgcgggagcgagg

SEQ ID NO: 223419 - DNA, 20 bp, human
gtggggggcggcagtctcgt

SEQ ID NO: 223420 - DNA, 20 bp, human
gcgggtgtgcagacccgcag

SEQ ID NO: 223421 - DNA, 20 bp, human
gaggtgggaaatcctggccg

SEQ ID NO: 223422 - DNA, 20 bp, human
gcgctcccgcgactccgctg

SEQ ID NO: 223423 - DNA, 20 bp, human
gcgtttcaaaccgagtcctc

SEQ ID NO: 223424 - DNA, 20 bp, human
gaattcgagaagtgcggtcc

SEQ ID NO: 223425 - DNA, 20 bp, human
gtcccccgccacaatcggac

SEQ ID NO: 223426 - DNA, 20 bp, human
gtcagtggaggcgtcaccga

SEQ ID NO: 223427 - DNA, 20 bp, human
gaatccgcagatgatgtcag

SEQ ID NO: 223428 - DNA, 20 bp, human
ggagacagaaggttgtgttg

SEQ ID NO: 223429 - DNA, 20 bp, human
gcctccactgacatcatctg

SEQ ID NO: 223430 - DNA, 20 bp, human
gaacccgggagctcttttag

SEQ ID NO: 223431 - DNA, 20 bp, human
ggagacacgccccattcctt

SEQ ID NO: 223432 - DNA, 20 bp, human
gctcctagcttcatggatgt

SEQ ID NO: 223433 - DNA, 20 bp, human
gctggcctccgaatgctagg

SEQ ID NO: 223434 - DNA, 20 bp, human
gtgagagaagctaacgttaa

SEQ ID NO: 223435 - DNA, 20 bp, human
gcacgccttccccaaggaat

SEQ ID NO: 223436 - DNA, 20 bp, human
gtgaaccggctgacagggtc

SEQ ID NO: 223437 - DNA, 20 bp, human
gaatgtgtgaagatgagggt

SEQ ID NO: 223438 - DNA, 20 bp, human
ggtgatggcgctggactggt

SEQ ID NO: 223439 - DNA, 20 bp, human
gcagtccagcgccatcacca

SEQ ID NO: 223440 - DNA, 20 bp, human
gactgatagagacagaacgg

SEQ ID NO: 223441 - DNA, 20 bp, human
gtgggctgaaccggctgaca

SEQ ID NO: 223442 - DNA, 20 bp, human
gccacccaccaataggaagt

SEQ ID NO: 223443 - DNA, 20 bp, human
gcggagtacagaggcgagtg

SEQ ID NO: 223444 - DNA, 20 bp, human
gagtctcacccgatgtaggg

SEQ ID NO: 223445 - DNA, 20 bp, human
gctcacggcatgtcagccca

SEQ ID NO: 223446 - DNA, 20 bp, human
gcctccgccctggccgggat

SEQ ID NO: 223447 - DNA, 20 bp, human
ggggccctcgggtcgtgcgg

SEQ ID NO: 223448 - DNA, 20 bp, human
gactccgcccatcccggcca

SEQ ID NO: 223449 - DNA, 20 bp, human
gtgcgcgcggattagggtga

SEQ ID NO: 223450 - DNA, 20 bp, human
gcccccgccggtctcgaagt

SEQ ID NO: 223451 - DNA, 20 bp, human
ggcgacgtggaacccagtaa

SEQ ID NO: 223452 - DNA, 20 bp, human
ggaagcgcctgtccacgatc

SEQ ID NO: 223453 - DNA, 20 bp, human
gggaactaacgccaggagga

SEQ ID NO: 223454 - DNA, 20 bp, human
gcgccctcttcacacatgga

SEQ ID NO: 223455 - DNA, 20 bp, human
ggccggcggcgagggactcc

SEQ ID NO: 223456 - DNA, 20 bp, human
gctcgggcgagccaggcgga

SEQ ID NO: 223457 - DNA, 20 bp, human
gcagactgcgccactcccgg

SEQ ID NO: 223458 - DNA, 20 bp, human
gcactcccgggggaatggtg

SEQ ID NO: 223459 - DNA, 20 bp, human
ggtacccccaccattccccc

SEQ ID NO: 223460 - DNA, 20 bp, human
gtgtccgccagcccgcggga

SEQ ID NO: 223461 - DNA, 20 bp, human
gggggtacggcgacaacctg

SEQ ID NO: 223462 - DNA, 20 bp, human
gagtggcgcagtctgggcgg

SEQ ID NO: 223463 - DNA, 20 bp, human
gatcgccattggagcaacct

SEQ ID NO: 223464 - DNA, 20 bp, human
gaccgcctgccgcctgtcat

SEQ ID NO: 223465 - DNA, 20 bp, human
gataggggagcggaacgtgt

SEQ ID NO: 223466 - DNA, 20 bp, human
gtacgctgcagggcaggaaa

SEQ ID NO: 223467 - DNA, 20 bp, human
ggggtggtgtaacacagagt

SEQ ID NO: 223468 - DNA, 20 bp, human
ggaaaacagcttggtgggcg

SEQ ID NO: 223469 - DNA, 20 bp, human
ggggccaaaaatagcctgct

SEQ ID NO: 223470 - DNA, 20 bp, human
gctcagggaagagcctgcta

SEQ ID NO: 223471 - DNA, 20 bp, human
gaaaggggtgggttcactgc

SEQ ID NO: 223472 - DNA, 20 bp, human
ggggtccagcgtggggtcgc

SEQ ID NO: 223473 - DNA, 20 bp, human
ggctggtcaagtaggggcac

SEQ ID NO: 223474 - DNA, 20 bp, human
gagggaagagcctgctacgg

SEQ ID NO: 223475 - DNA, 20 bp, human
gcaaaaatagcctgctcgga

SEQ ID NO: 223476 - DNA, 20 bp, human
gtctccttggagccctctca

SEQ ID NO: 223477 - DNA, 20 bp, human
gtctcaggggtggaagactc

SEQ ID NO: 223478 - DNA, 20 bp, human
gtagggatggcaactgggtt

SEQ ID NO: 223479 - DNA, 20 bp, human
ggggctccaaggagacaggc

SEQ ID NO: 223480 - DNA, 20 bp, human
gtgtctggctacagaagcga

SEQ ID NO: 223481 - DNA, 20 bp, human
gatagctaagggagtaggga

SEQ ID NO: 223482 - DNA, 20 bp, human
ggagcgccatggggccgcag

SEQ ID NO: 223483 - DNA, 20 bp, human
ggggtgaggggcatcttcaa

SEQ ID NO: 223484 - DNA, 20 bp, human
gggcgctcaccttcccctgt

SEQ ID NO: 223485 - DNA, 20 bp, human
ggcactgaatagcgaacctc

SEQ ID NO: 223486 - DNA, 20 bp, human
gcctctgcccgccgggtaga

SEQ ID NO: 223487 - DNA, 20 bp, human
gacggaggccctgaatcctc

SEQ ID NO: 223488 - DNA, 20 bp, human
gcggtccccagccctctacc

SEQ ID NO: 223489 - DNA, 20 bp, human
gcgacagcagcccgctacgg

SEQ ID NO: 223490 - DNA, 20 bp, human
gtgcccgccgggtagagggc

SEQ ID NO: 223491 - DNA, 20 bp, human
ggtctctcccagaggattca

SEQ ID NO: 223492 - DNA, 20 bp, human
gagggctggggaccgcgcag

SEQ ID NO: 223493 - DNA, 20 bp, human
gcacctaggcaactggggtg

SEQ ID NO: 223494 - DNA, 20 bp, human
gggccgacagcagcccgcta

SEQ ID NO: 223495 - DNA, 20 bp, human
gggattcagggcctccgtag

SEQ ID NO: 223496 - DNA, 20 bp, human
gcagcaccctggccgacctc

SEQ ID NO: 223497 - DNA, 20 bp, human
gactctacttggaactgcac

SEQ ID NO: 223498 - DNA, 20 bp, human
gcatgccattcccaacccaa

SEQ ID NO: 223499 - DNA, 20 bp, human
gaagccaggcacttgtgaga

SEQ ID NO: 223500 - DNA, 20 bp, human
ggacctcaggctgaaagtac

SEQ ID NO: 223501 - DNA, 20 bp, human
gtggaactgcaccggcagcg

SEQ ID NO: 223502 - DNA, 20 bp, human
gggccagggtgctgcaattc

SEQ ID NO: 223503 - DNA, 20 bp, human
gaacatcctgtgaagcggaa

SEQ ID NO: 223504 - DNA, 20 bp, human
gtctccatctcacaagtgcc

SEQ ID NO: 223505 - DNA, 20 bp, human
gggcctcctttccgcttcac

SEQ ID NO: 223506 - DNA, 20 bp, human
gctgggcggcccaaccggga

SEQ ID NO: 223507 - DNA, 20 bp, human
gccaggggcggcgtgcagtg

SEQ ID NO: 223508 - DNA, 20 bp, human
ggatcccgccggtagccgag

SEQ ID NO: 223509 - DNA, 20 bp, human
gaccggcgggatccagaaac

SEQ ID NO: 223510 - DNA, 20 bp, human
gaaggtactcgatccagggg

SEQ ID NO: 223511 - DNA, 20 bp, human
gcaccaaggtactcgatcca

SEQ ID NO: 223512 - DNA, 20 bp, human
ggtcgcccctcggctaccgg

SEQ ID NO: 223513 - DNA, 20 bp, human
gtgggtcggccgtcgcccct

SEQ ID NO: 223514 - DNA, 20 bp, human
gcgcccggcccgggactggg

SEQ ID NO: 223515 - DNA, 20 bp, human
ggggactgggcggcccaacc

SEQ ID NO: 223516 - DNA, 20 bp, human
gtagcatgagatgtagatag

SEQ ID NO: 223517 - DNA, 20 bp, human
gctatctgtaccacccataa

SEQ ID NO: 223518 - DNA, 20 bp, human
gaatgatcttgctcagtgta

SEQ ID NO: 223519 - DNA, 20 bp, human
gagagaaaggaaagctagta

SEQ ID NO: 223520 - DNA, 20 bp, human
gggactgattcctttatggg

SEQ ID NO: 223521 - DNA, 20 bp, human
gaaacgcttcattaacctat

SEQ ID NO: 223522 - DNA, 20 bp, human
ggcatggactgattccttta

SEQ ID NO: 223523 - DNA, 20 bp, human
ggctccgtatccagtcaaaa

SEQ ID NO: 223524 - DNA, 20 bp, human
gcgttgagactatgatcccg

SEQ ID NO: 223525 - DNA, 20 bp, human
gctcaaggtaagaagcaaac

SEQ ID NO: 223526 - DNA, 20 bp, human
ggaaaagaattgcaatgccc

SEQ ID NO: 223527 - DNA, 20 bp, human
gtaaacagctgtcgaagctc

SEQ ID NO: 223528 - DNA, 20 bp, human
gctctgggagataggcctta

SEQ ID NO: 223529 - DNA, 20 bp, human
gtgtcgaagctctgggagat

SEQ ID NO: 223530 - DNA, 20 bp, human
gagaagttcagtaatatctt

SEQ ID NO: 223531 - DNA, 20 bp, human
gtgagtgggaagaggcgtta

SEQ ID NO: 223532 - DNA, 20 bp, human
gcccactcaagatttctgaa

SEQ ID NO: 223533 - DNA, 20 bp, human
gtgcattgactaaaacccta

SEQ ID NO: 223534 - DNA, 20 bp, human
ggcccttcagaaatcttgag

SEQ ID NO: 223535 - DNA, 20 bp, human
gaagaggcgttatggcaggg

SEQ ID NO: 223536 - DNA, 20 bp, human
gcctctcgggccgcaaggtg

SEQ ID NO: 223537 - DNA, 20 bp, human
ggacccggctctccaggtcg

SEQ ID NO: 223538 - DNA, 20 bp, human
ggggtccggaggagcttgaa

SEQ ID NO: 223539 - DNA, 20 bp, human
ggcgctgattggttcctcca

SEQ ID NO: 223540 - DNA, 20 bp, human
gtgcccagccaggcggagtg

SEQ ID NO: 223541 - DNA, 20 bp, human
gcagcacaccttgaggtcct

SEQ ID NO: 223542 - DNA, 20 bp, human
gccggctctccaggtcgcgg

SEQ ID NO: 223543 - DNA, 20 bp, human
ggcctcctgggccgggaggt

SEQ ID NO: 223544 - DNA, 20 bp, human
gcactgcagacaggttaccc

SEQ ID NO: 223545 - DNA, 20 bp, human
gccctcagctgtaaccgggc

SEQ ID NO: 223546 - DNA, 20 bp, human
gccagtaacactataatcaa

SEQ ID NO: 223547 - DNA, 20 bp, human
gctggactgattactttgtg

SEQ ID NO: 223548 - DNA, 20 bp, human
gtaacactataatcaagggc

SEQ ID NO: 223549 - DNA, 20 bp, human
gaggctgctagttaacagga

SEQ ID NO: 223550 - DNA, 20 bp, human
gttaactagcagcctctcaa

SEQ ID NO: 223551 - DNA, 20 bp, human
ggtgtctattaattggattt

SEQ ID NO: 223552 - DNA, 20 bp, human
gtcttaactggctggcatta

SEQ ID NO: 223553 - DNA, 20 bp, human
gctcaatggtcatatttcca

SEQ ID NO: 223554 - DNA, 20 bp, human
gaataagttttatagtctgt

SEQ ID NO: 223555 - DNA, 20 bp, human
gggtgaaatatgaactaaat

SEQ ID NO: 223556 - DNA, 20 bp, human
gctgttccgtcaagtgtaga

SEQ ID NO: 223557 - DNA, 20 bp, human
gcacagccctctacacttga

SEQ ID NO: 223558 - DNA, 20 bp, human
gcatctacagggtttatctc

SEQ ID NO: 223559 - DNA, 20 bp, human
gttagtggttggaagttcag

SEQ ID NO: 223560 - DNA, 20 bp, human
gaagttcagaggaatctttc

SEQ ID NO: 223561 - DNA, 20 bp, human
ggacctgcagccttctgatt

SEQ ID NO: 223562 - DNA, 20 bp, human
gtctttctggacaacagtca

SEQ ID NO: 223563 - DNA, 20 bp, human
ggctgcaggtcctcagtgcc

SEQ ID NO: 223564 - DNA, 20 bp, human
gcagggtttatctcaggagg

SEQ ID NO: 223565 - DNA, 20 bp, human
gctacagggtttatctcagg

SEQ ID NO: 223566 - DNA, 20 bp, human
gaatggatagagaatgtggc

SEQ ID NO: 223567 - DNA, 20 bp, human
ggaaatggacacacattacc

SEQ ID NO: 223568 - DNA, 20 bp, human
gttacctgggggctattgtg

SEQ ID NO: 223569 - DNA, 20 bp, human
gtgtgtccatttcaccccag

SEQ ID NO: 223570 - DNA, 20 bp, human
ggtgttggagtcgaagagaa

SEQ ID NO: 223571 - DNA, 20 bp, human
gacacacattaccaggctcc

SEQ ID NO: 223572 - DNA, 20 bp, human
gtcttcgactccaacacacc

SEQ ID NO: 223573 - DNA, 20 bp, human
gagacattgaatgatcccct

SEQ ID NO: 223574 - DNA, 20 bp, human
ggatcaagcatgaggagcta

SEQ ID NO: 223575 - DNA, 20 bp, human
gactgctcagttttcacaag

SEQ ID NO: 223576 - DNA, 20 bp, human
ggatgtgagcatcgtcctca

SEQ ID NO: 223577 - DNA, 20 bp, human
ggactcctgaaacccctcca

SEQ ID NO: 223578 - DNA, 20 bp, human
gactatttggaagttagttt

SEQ ID NO: 223579 - DNA, 20 bp, human
gagaacaaggagggactatt

SEQ ID NO: 223580 - DNA, 20 bp, human
gggtttcaggagtcaagaac

SEQ ID NO: 223581 - DNA, 20 bp, human
gtcaggagtcaagaacaggt

SEQ ID NO: 223582 - DNA, 20 bp, human
gaggcttgcacaacctgcac

SEQ ID NO: 223583 - DNA, 20 bp, human
ggtcagtttttgtcagaaca

SEQ ID NO: 223584 - DNA, 20 bp, human
gtgaggcgttttgctattag

SEQ ID NO: 223585 - DNA, 20 bp, human
gcacatcttctctcatgcgc

SEQ ID NO: 223586 - DNA, 20 bp, human
ggtggagtccagaatgacag

SEQ ID NO: 223587 - DNA, 20 bp, human
gttcagccctgtcttcagag

SEQ ID NO: 223588 - DNA, 20 bp, human
gcccacgtgactgatgggga

SEQ ID NO: 223589 - DNA, 20 bp, human
gactctgtggggaagattat

SEQ ID NO: 223590 - DNA, 20 bp, human
gaacaaagctcggtaaggtg

SEQ ID NO: 223591 - DNA, 20 bp, human
gcaagacccacgtgactgat

SEQ ID NO: 223592 - DNA, 20 bp, human
gagagtgtgggaacaaagct

SEQ ID NO: 223593 - DNA, 20 bp, human
gaagtctcagagaggaatgt

SEQ ID NO: 223594 - DNA, 20 bp, human
gagacccattgtacatgctg

SEQ ID NO: 223595 - DNA, 20 bp, human
gataccccagcatgtacaat

SEQ ID NO: 223596 - DNA, 20 bp, human
gagtcctggctcactttcat

SEQ ID NO: 223597 - DNA, 20 bp, human
gagggtgtggttacctcacc

SEQ ID NO: 223598 - DNA, 20 bp, human
gtcagtgggttaaagaggca

SEQ ID NO: 223599 - DNA, 20 bp, human
gtcatctcagtgggttaaag

SEQ ID NO: 223600 - DNA, 20 bp, human
ggcacatcgaaggccctcta

SEQ ID NO: 223601 - DNA, 20 bp, human
gtcgagaggcaatccctaga

SEQ ID NO: 223602 - DNA, 20 bp, human
gccggcaactaaactataag

SEQ ID NO: 223603 - DNA, 20 bp, human
gctcccaccgccccccgctg

SEQ ID NO: 223604 - DNA, 20 bp, human
ggcaaaagagattgcctttt

SEQ ID NO: 223605 - DNA, 20 bp, human
ggccagcacaaactaagtcc

SEQ ID NO: 223606 - DNA, 20 bp, human
gctacaactcacacgctcac

SEQ ID NO: 223607 - DNA, 20 bp, human
gatacccagcgggtgagtac

SEQ ID NO: 223608 - DNA, 20 bp, human
gtcctccagaacagacccca

SEQ ID NO: 223609 - DNA, 20 bp, human
gcccaggcaaccccgctctc

SEQ ID NO: 223610 - DNA, 20 bp, human
gcggcagcgcgcatgctcct

SEQ ID NO: 223611 - DNA, 20 bp, human
gcgtaccctggggtctgttc

SEQ ID NO: 223612 - DNA, 20 bp, human
ggcagcccgcgggcgccgta

SEQ ID NO: 223613 - DNA, 20 bp, human
ggggcgggggtgatagaccc

SEQ ID NO: 223614 - DNA, 20 bp, human
gctcacacgctcacgggcag

SEQ ID NO: 223615 - DNA, 20 bp, human
gtccccggggaggacgctgc

SEQ ID NO: 223616 - DNA, 20 bp, human
ggcgaaggtggcacccgcag

SEQ ID NO: 223617 - DNA, 20 bp, human
gcgcactacaattcccgccc

SEQ ID NO: 223618 - DNA, 20 bp, human
gaagaggttcggacaagcgc

SEQ ID NO: 223619 - DNA, 20 bp, human
ggtagtctcccgaagaggtt

SEQ ID NO: 223620 - DNA, 20 bp, human
ggtgagcggcgtgcagaggg

SEQ ID NO: 223621 - DNA, 20 bp, human
ggagaagtagtctcccgaag

SEQ ID NO: 223622 - DNA, 20 bp, human
ggagcgtcagataccgtgag

SEQ ID NO: 223623 - DNA, 20 bp, human
gggtgccaccttcgcggcca

SEQ ID NO: 223624 - DNA, 20 bp, human
gagaccggaagtgcggtccg

SEQ ID NO: 223625 - DNA, 20 bp, human
gctcgcggtatctgactcct

SEQ ID NO: 223626 - DNA, 20 bp, human
gagcctaagcagcgaggaga

SEQ ID NO: 223627 - DNA, 20 bp, human
gtggccagcgttctccacaa

SEQ ID NO: 223628 - DNA, 20 bp, human
gccccctctcctcgctgctt

SEQ ID NO: 223629 - DNA, 20 bp, human
gggtaggtcgcccccagtca

SEQ ID NO: 223630 - DNA, 20 bp, human
gcgcgcctgcgcacttccct

SEQ ID NO: 223631 - DNA, 20 bp, human
gagtccgttgtggagaacgc

SEQ ID NO: 223632 - DNA, 20 bp, human
gggggcgggactaaacctcg

SEQ ID NO: 223633 - DNA, 20 bp, human
gggagcggtcgtcccggaac

SEQ ID NO: 223634 - DNA, 20 bp, human
ggcgacggcgcctcgtctcg

SEQ ID NO: 223635 - DNA, 20 bp, human
gtgagccaagggaagtgcgc

SEQ ID NO: 223636 - DNA, 20 bp, human
ggcccagcgagccagagtgg

SEQ ID NO: 223637 - DNA, 20 bp, human
ggcgaggccctcacttccgg

SEQ ID NO: 223638 - DNA, 20 bp, human
ggcggcgaggccctcacttc

SEQ ID NO: 223639 - DNA, 20 bp, human
gagcgcgctggccgcaacga

SEQ ID NO: 223640 - DNA, 20 bp, human
ggcgggaccagccaccactc

SEQ ID NO: 223641 - DNA, 20 bp, human
gcccgcgcggtgagtgggat

SEQ ID NO: 223642 - DNA, 20 bp, human
gagcgaccctctatggtccc

SEQ ID NO: 223643 - DNA, 20 bp, human
ggggcctgcgtcggatactc

SEQ ID NO: 223644 - DNA, 20 bp, human
gcgggcgggccgggtcaatg

SEQ ID NO: 223645 - DNA, 20 bp, human
ggcgccgccgcggtcgctct

SEQ ID NO: 223646 - DNA, 20 bp, human
ggggtccaggcaaacatctc

SEQ ID NO: 223647 - DNA, 20 bp, human
gggacgcatgcgcctgatgg

SEQ ID NO: 223648 - DNA, 20 bp, human
gccctccagagatgtttgcc

SEQ ID NO: 223649 - DNA, 20 bp, human
ggacagtttcattgactcta

SEQ ID NO: 223650 - DNA, 20 bp, human
gtgactctatggttcagaat

SEQ ID NO: 223651 - DNA, 20 bp, human
gacatctctggaggggatgg

SEQ ID NO: 223652 - DNA, 20 bp, human
gaatcggaaagcctgcggca

SEQ ID NO: 223653 - DNA, 20 bp, human
gagcaaagcggaaggaaaag

SEQ ID NO: 223654 - DNA, 20 bp, human
ggaggcgtctcttcctccat

SEQ ID NO: 223655 - DNA, 20 bp, human
ggcgtcccttccttttccca

SEQ ID NO: 223656 - DNA, 20 bp, human
gcacctgcccggcccagggt

SEQ ID NO: 223657 - DNA, 20 bp, human
gggtcggggagatggggcgt

SEQ ID NO: 223658 - DNA, 20 bp, human
gtgctgggggtcggggagat

SEQ ID NO: 223659 - DNA, 20 bp, human
gtccacggaggaaaaaccca

SEQ ID NO: 223660 - DNA, 20 bp, human
gtcctcaggcggcctacaga

SEQ ID NO: 223661 - DNA, 20 bp, human
gagaagacacgtggaaaaga

SEQ ID NO: 223662 - DNA, 20 bp, human
ggaggaaaaacccagggggt

SEQ ID NO: 223663 - DNA, 20 bp, human
gaattgcacctgcccggccc

SEQ ID NO: 223664 - DNA, 20 bp, human
ggccctctgtaggccgcctg

SEQ ID NO: 223665 - DNA, 20 bp, human
gacggggcagaaccctctgt

SEQ ID NO: 223666 - DNA, 20 bp, human
gagggtcacgtgagcagctt

SEQ ID NO: 223667 - DNA, 20 bp, human
gtggcgctaggggatcctcc

SEQ ID NO: 223668 - DNA, 20 bp, human
gcacgtgagcagcttggggc

SEQ ID NO: 223669 - DNA, 20 bp, human
gggggccggggtggcgctag

SEQ ID NO: 223670 - DNA, 20 bp, human
ggagtgacaggggtgtagta

SEQ ID NO: 223671 - DNA, 20 bp, human
gtagcgacgcccacgcgccc

SEQ ID NO: 223672 - DNA, 20 bp, human
gtgagcagcttggggccggg

SEQ ID NO: 223673 - DNA, 20 bp, human
gtttgcggaccaggcgctga

SEQ ID NO: 223674 - DNA, 20 bp, human
gacagtaagttcgtgtcagg

SEQ ID NO: 223675 - DNA, 20 bp, human
gggcacagtaagttcgtgtc

SEQ ID NO: 223676 - DNA, 20 bp, human
gtcccggaggccggccccgt

SEQ ID NO: 223677 - DNA, 20 bp, human
gcgagtcagctccacttgat

SEQ ID NO: 223678 - DNA, 20 bp, human
gggaggccggccccgtgggt

SEQ ID NO: 223679 - DNA, 20 bp, human
gggctccccacccacggggc

SEQ ID NO: 223680 - DNA, 20 bp, human
gcaagtggagctgactcgct

SEQ ID NO: 223681 - DNA, 20 bp, human
gcccccacacggccccccgg

SEQ ID NO: 223682 - DNA, 20 bp, human
ggcctctccgagggccgcgt

SEQ ID NO: 223683 - DNA, 20 bp, human
gggaggggcttcccggaggc

SEQ ID NO: 223684 - DNA, 20 bp, human
gcgcccccggggggccgtgt

SEQ ID NO: 223685 - DNA, 20 bp, human
gcgggggcgctgcgcgaagg

SEQ ID NO: 223686 - DNA, 20 bp, human
gcccccacgtgacagtgcct

SEQ ID NO: 223687 - DNA, 20 bp, human
gtgcagaataatacattccc

SEQ ID NO: 223688 - DNA, 20 bp, human
gagtgaggattggatgaact

SEQ ID NO: 223689 - DNA, 20 bp, human
ggtcactcctggggcctctt

SEQ ID NO: 223690 - DNA, 20 bp, human
gaggttataggtcactcctg

SEQ ID NO: 223691 - DNA, 20 bp, human
gtcatccaatcctcactggg

SEQ ID NO: 223692 - DNA, 20 bp, human
gttcccaggcactgtcacgt

SEQ ID NO: 223693 - DNA, 20 bp, human
gccacacagagtggtctttc

SEQ ID NO: 223694 - DNA, 20 bp, human
ggtcacgtgggggacccaag

SEQ ID NO: 223695 - DNA, 20 bp, human
gagtgaaactgagacagtgc

SEQ ID NO: 223696 - DNA, 20 bp, human
gcctgccaggctagacatga

SEQ ID NO: 223697 - DNA, 20 bp, human
ggtccccaggctcagtgaaa

SEQ ID NO: 223698 - DNA, 20 bp, human
ggaggtgcactggtctcaga

SEQ ID NO: 223699 - DNA, 20 bp, human
gctagacatgagggatgctg

SEQ ID NO: 223700 - DNA, 20 bp, human
ggcatccctcatgtctagcc

SEQ ID NO: 223701 - DNA, 20 bp, human
gctgccctgtagtgaggcga

SEQ ID NO: 223702 - DNA, 20 bp, human
gtgaggaaggcagttgcggg

SEQ ID NO: 223703 - DNA, 20 bp, human
gcccctgggggccaccagat

SEQ ID NO: 223704 - DNA, 20 bp, human
ggggcaaagtatgctgggtc

SEQ ID NO: 223705 - DNA, 20 bp, human
gctacagggcagagttcaga

SEQ ID NO: 223706 - DNA, 20 bp, human
gggaccaaggccatcataag

SEQ ID NO: 223707 - DNA, 20 bp, human
gcaggtggagacagcttatt

SEQ ID NO: 223708 - DNA, 20 bp, human
ggaacgcctacgtttgtggc

SEQ ID NO: 223709 - DNA, 20 bp, human
gctccacctgccacaaacgt

SEQ ID NO: 223710 - DNA, 20 bp, human
ggccttggtccgggatcgca

SEQ ID NO: 223711 - DNA, 20 bp, human
gccaggaacgcctacgtttg

SEQ ID NO: 223712 - DNA, 20 bp, human
gtaaactataccatctagtg

SEQ ID NO: 223713 - DNA, 20 bp, human
ggcaaggaaatattttgtcc

SEQ ID NO: 223714 - DNA, 20 bp, human
ggccctgcgatcccggacca

SEQ ID NO: 223715 - DNA, 20 bp, human
gataatgagccctgcgatcc

SEQ ID NO: 223716 - DNA, 20 bp, human
gcacgagtaacagatcactt

SEQ ID NO: 223717 - DNA, 20 bp, human
gtggaatcgtggttagggtc

SEQ ID NO: 223718 - DNA, 20 bp, human
ggaaggccaggctgggtctc

SEQ ID NO: 223719 - DNA, 20 bp, human
gctgccccgggacatcagca

SEQ ID NO: 223720 - DNA, 20 bp, human
gcgcccgcattcctcgagta

SEQ ID NO: 223721 - DNA, 20 bp, human
gaaatagcccgtttcatcat

SEQ ID NO: 223722 - DNA, 20 bp, human
ggagccctgctgatgtcccg

SEQ ID NO: 223723 - DNA, 20 bp, human
gccacgcgggtgttgcagtg

SEQ ID NO: 223724 - DNA, 20 bp, human
gtgaagttggaatcgtggtt

SEQ ID NO: 223725 - DNA, 20 bp, human
ggaggacggctccttactcg

SEQ ID NO: 223726 - DNA, 20 bp, human
gcacgcccgcttcctgagac

SEQ ID NO: 223727 - DNA, 20 bp, human
ggacacgggaagggtcgggg

SEQ ID NO: 223728 - DNA, 20 bp, human
gcagtggacttgtctattga

SEQ ID NO: 223729 - DNA, 20 bp, human
ggcgagaaataaattcgcag

SEQ ID NO: 223730 - DNA, 20 bp, human
gcgatgcttgctgggaatcg

SEQ ID NO: 223731 - DNA, 20 bp, human
gcggggacacgggaagggtc

SEQ ID NO: 223732 - DNA, 20 bp, human
gcgtggtctgagccggtctc

SEQ ID NO: 223733 - DNA, 20 bp, human
gtgggaatcgtggtctgagc

SEQ ID NO: 223734 - DNA, 20 bp, human
ggccgctgctccgggctcac

SEQ ID NO: 223735 - DNA, 20 bp, human
gactgctattgcgacccagt

SEQ ID NO: 223736 - DNA, 20 bp, human
gcccctcctaacaggagaca

SEQ ID NO: 223737 - DNA, 20 bp, human
gtccaatacaggagcttcct

SEQ ID NO: 223738 - DNA, 20 bp, human
ggcccaggaagctcctgtat

SEQ ID NO: 223739 - DNA, 20 bp, human
ggccctggcgcctccaatac

SEQ ID NO: 223740 - DNA, 20 bp, human
gccaggggaaggatatgcgg

SEQ ID NO: 223741 - DNA, 20 bp, human
gttaggaggggcagattttc

SEQ ID NO: 223742 - DNA, 20 bp, human
gaggagtggctgtccacctg

SEQ ID NO: 223743 - DNA, 20 bp, human
gtccctgtctcctgttagga

SEQ ID NO: 223744 - DNA, 20 bp, human
gcagcacatgctggttcata

SEQ ID NO: 223745 - DNA, 20 bp, human
gaagcgggtgggcgggaaca

SEQ ID NO: 223746 - DNA, 20 bp, human
ggcgcggcgttcaaagtgtg

SEQ ID NO: 223747 - DNA, 20 bp, human
gaagcggcgggtacttgaag

SEQ ID NO: 223748 - DNA, 20 bp, human
ggcggggaggaggtcgagag

SEQ ID NO: 223749 - DNA, 20 bp, human
gtgccagctggcctcaggcg

SEQ ID NO: 223750 - DNA, 20 bp, human
gtacccgccgcttcttgctt

SEQ ID NO: 223751 - DNA, 20 bp, human
ggcgttcaaagtgtgcgggg

SEQ ID NO: 223752 - DNA, 20 bp, human
ggtctccagcgaaagagcaa

SEQ ID NO: 223753 - DNA, 20 bp, human
ggcactgcgcgccggcacga

SEQ ID NO: 223754 - DNA, 20 bp, human
ggggcaggcaaagcgacttc

SEQ ID NO: 223755 - DNA, 20 bp, human
gccaccaaagcaagaagcgg

SEQ ID NO: 223756 - DNA, 20 bp, human
gacaagaaatgtcacaaggt

SEQ ID NO: 223757 - DNA, 20 bp, human
gtttacagggcaaccagggg

SEQ ID NO: 223758 - DNA, 20 bp, human
ggactcaaacccaaaagcct

SEQ ID NO: 223759 - DNA, 20 bp, human
gggttgccctgtaaacattc

SEQ ID NO: 223760 - DNA, 20 bp, human
gcctgggctaaagatagcac

SEQ ID NO: 223761 - DNA, 20 bp, human
gaagtcaccggaatgtttac

SEQ ID NO: 223762 - DNA, 20 bp, human
gagtcttataagagcttgca

SEQ ID NO: 223763 - DNA, 20 bp, human
gtcaccagtgtgacgttatc

SEQ ID NO: 223764 - DNA, 20 bp, human
gatgtttacagggcaaccag

SEQ ID NO: 223765 - DNA, 20 bp, human
gtctttgatgtttacatttg

SEQ ID NO: 223766 - DNA, 20 bp, human
gccagcagctggggtgtctg

SEQ ID NO: 223767 - DNA, 20 bp, human
ggtaccctgcagagagggta

SEQ ID NO: 223768 - DNA, 20 bp, human
gaatgagcagggagccttga

SEQ ID NO: 223769 - DNA, 20 bp, human
gggagcaaggcccaacggtt

SEQ ID NO: 223770 - DNA, 20 bp, human
gaccccagagggaatgagca

SEQ ID NO: 223771 - DNA, 20 bp, human
gggtctctgcccttaatgtg

SEQ ID NO: 223772 - DNA, 20 bp, human
gggagatgcccctgtggctg

SEQ ID NO: 223773 - DNA, 20 bp, human
gggacacgactgcccctagt

SEQ ID NO: 223774 - DNA, 20 bp, human
gtccctctcgcctctcctca

SEQ ID NO: 223775 - DNA, 20 bp, human
gtgggcaccccccaaccgtt

SEQ ID NO: 223776 - DNA, 20 bp, human
gaggctggggtgtagtgact

SEQ ID NO: 223777 - DNA, 20 bp, human
ggtagtgactgggagctaac

SEQ ID NO: 223778 - DNA, 20 bp, human
gacactgaatcgagttgtct

SEQ ID NO: 223779 - DNA, 20 bp, human
gtactgatggctgtctaatc

SEQ ID NO: 223780 - DNA, 20 bp, human
gggggccactacgaccagta

SEQ ID NO: 223781 - DNA, 20 bp, human
ggataacccaatccacctgc

SEQ ID NO: 223782 - DNA, 20 bp, human
gagggcatccttgtagggtg

SEQ ID NO: 223783 - DNA, 20 bp, human
gcttcctacagtattactga

SEQ ID NO: 223784 - DNA, 20 bp, human
gacactggacaccaactgtg

SEQ ID NO: 223785 - DNA, 20 bp, human
gcgaccagtacggctcaccc

SEQ ID NO: 223786 - DNA, 20 bp, human
gcccagagaggtttcagaac

SEQ ID NO: 223787 - DNA, 20 bp, human
gctagacagtggctcttcct

SEQ ID NO: 223788 - DNA, 20 bp, human
ggccagttctgaaacctctc

SEQ ID NO: 223789 - DNA, 20 bp, human
gaggaagagctgcatttgat

SEQ ID NO: 223790 - DNA, 20 bp, human
gacacagctgaggaatgagc

SEQ ID NO: 223791 - DNA, 20 bp, human
gactctataaatgtccaagg

SEQ ID NO: 223792 - DNA, 20 bp, human
gaacgttcaactctagacag

SEQ ID NO: 223793 - DNA, 20 bp, human
gctactagggctctgcccat

SEQ ID NO: 223794 - DNA, 20 bp, human
gtcctggagtcagatgacct

SEQ ID NO: 223795 - DNA, 20 bp, human
gttacagctttctgtgttac

SEQ ID NO: 223796 - DNA, 20 bp, human
gagccggtgtaccgactccc

SEQ ID NO: 223797 - DNA, 20 bp, human
gcaccggggagtcggtacac

SEQ ID NO: 223798 - DNA, 20 bp, human
gggcggagagagatccgtga

SEQ ID NO: 223799 - DNA, 20 bp, human
gactgcttgtgacctcatgc

SEQ ID NO: 223800 - DNA, 20 bp, human
gtgcgtcatcaactagtgac

SEQ ID NO: 223801 - DNA, 20 bp, human
ggctgggcggggtttcgcag

SEQ ID NO: 223802 - DNA, 20 bp, human
gcggccggcgcgtcccaaag

SEQ ID NO: 223803 - DNA, 20 bp, human
gaactagtgacgggagaaga

SEQ ID NO: 223804 - DNA, 20 bp, human
gaggcactgcagattctccc

SEQ ID NO: 223805 - DNA, 20 bp, human
ggggtgaaagaaacggggcg

SEQ ID NO: 223806 - DNA, 20 bp, human
gtggcaaccaggagtcggtt

SEQ ID NO: 223807 - DNA, 20 bp, human
ggggtggggcaggaagtgat

SEQ ID NO: 223808 - DNA, 20 bp, human
gtgcaccgagcatgcggaga

SEQ ID NO: 223809 - DNA, 20 bp, human
gctggggacgctgtcgtctg

SEQ ID NO: 223810 - DNA, 20 bp, human
gtgttctccaggtttccctt

SEQ ID NO: 223811 - DNA, 20 bp, human
gcctgcctctagtgtgtaca

SEQ ID NO: 223812 - DNA, 20 bp, human
gggaagccctcacggatccc

SEQ ID NO: 223813 - DNA, 20 bp, human
ggagtctcctgggatccgtg

SEQ ID NO: 223814 - DNA, 20 bp, human
gcctgagctttggagaactg

SEQ ID NO: 223815 - DNA, 20 bp, human
gaggctgcacccatggtaac

SEQ ID NO: 223816 - DNA, 20 bp, human
ggggccttggagtcgagtca

SEQ ID NO: 223817 - DNA, 20 bp, human
gcggatgcagcctacctcct

SEQ ID NO: 223818 - DNA, 20 bp, human
gcacccagcagctcggtcct

SEQ ID NO: 223819 - DNA, 20 bp, human
gagaggagaggaaccgtcat

SEQ ID NO: 223820 - DNA, 20 bp, human
gggcagtgagctgcggtctg

SEQ ID NO: 223821 - DNA, 20 bp, human
gggtgccccggaagaagggc

SEQ ID NO: 223822 - DNA, 20 bp, human
gcgactccaaggccccatga

SEQ ID NO: 223823 - DNA, 20 bp, human
gtgtctgtcaacatcgccct

SEQ ID NO: 223824 - DNA, 20 bp, human
gaggaaccgtcatggggcct

SEQ ID NO: 223825 - DNA, 20 bp, human
gtgggggcaccagggtgagg

SEQ ID NO: 223826 - DNA, 20 bp, human
gcggcggggcctgtggcgaa

SEQ ID NO: 223827 - DNA, 20 bp, human
gacggaggcgagccggaagt

SEQ ID NO: 223828 - DNA, 20 bp, human
gcggggcctgtggcgaacgg

SEQ ID NO: 223829 - DNA, 20 bp, human
gccgcagccgctcttcgccc

SEQ ID NO: 223830 - DNA, 20 bp, human
gcgcaagaagtggcccgagc

SEQ ID NO: 223831 - DNA, 20 bp, human
gtggggtgcccggtagttaa

SEQ ID NO: 223832 - DNA, 20 bp, human
gtctggcagcgcgcaagaag

SEQ ID NO: 223833 - DNA, 20 bp, human
ggtgcccggtagttaagggt

SEQ ID NO: 223834 - DNA, 20 bp, human
ggcaccccgggaccccaaga

SEQ ID NO: 223835 - DNA, 20 bp, human
gagcaggtctgtggcggaag

SEQ ID NO: 223836 - DNA, 20 bp, human
gagcagagagcgcagccgat

SEQ ID NO: 223837 - DNA, 20 bp, human
gagagcgcagccgattggct

SEQ ID NO: 223838 - DNA, 20 bp, human
gaaaggacagacatcgcgga

SEQ ID NO: 223839 - DNA, 20 bp, human
ggcgacaggtaacagggcgc

SEQ ID NO: 223840 - DNA, 20 bp, human
gagacatcgcggagggtgct

SEQ ID NO: 223841 - DNA, 20 bp, human
gcagccgattggctgggaga

SEQ ID NO: 223842 - DNA, 20 bp, human
gcagagacaggagggtatgc

SEQ ID NO: 223843 - DNA, 20 bp, human
gccgcgcgcggccagtcggg

SEQ ID NO: 223844 - DNA, 20 bp, human
gggtatgcaggagaaaccaa

SEQ ID NO: 223845 - DNA, 20 bp, human
ggcgctagcggttggagcag

SEQ ID NO: 223846 - DNA, 20 bp, human
gtggcctggaggcggacctt

SEQ ID NO: 223847 - DNA, 20 bp, human
ggaaacctctctcaaaggaa

SEQ ID NO: 223848 - DNA, 20 bp, human
gggtccgcctccaggccacg

SEQ ID NO: 223849 - DNA, 20 bp, human
gcggaaccacccatcgcttc

SEQ ID NO: 223850 - DNA, 20 bp, human
gccgcagcacccacgtggcc

SEQ ID NO: 223851 - DNA, 20 bp, human
gcagcacccacgtggcctgg

SEQ ID NO: 223852 - DNA, 20 bp, human
gcggagacgcgaccactgag

SEQ ID NO: 223853 - DNA, 20 bp, human
gcgaccactgagcggaaact

SEQ ID NO: 223854 - DNA, 20 bp, human
gggaagctctgctcctacag

SEQ ID NO: 223855 - DNA, 20 bp, human
gtcccctccacccgaagcga

SEQ ID NO: 223856 - DNA, 20 bp, human
ggtgactggtgattcattcc

SEQ ID NO: 223857 - DNA, 20 bp, human
gggtattcacatcttctcaa

SEQ ID NO: 223858 - DNA, 20 bp, human
ggccccttctgaatatacat

SEQ ID NO: 223859 - DNA, 20 bp, human
gggccagaggtgagtaatta

SEQ ID NO: 223860 - DNA, 20 bp, human
gtagacatctcattcctcag

SEQ ID NO: 223861 - DNA, 20 bp, human
gtgcagttttgctcaagaaa

SEQ ID NO: 223862 - DNA, 20 bp, human
gaatcatcggtgacaggtaa

SEQ ID NO: 223863 - DNA, 20 bp, human
ggccctggcatataaacaag

SEQ ID NO: 223864 - DNA, 20 bp, human
gaaaagcttggacgaatccc

SEQ ID NO: 223865 - DNA, 20 bp, human
gctgcaatttgcaaaatcat

SEQ ID NO: 223866 - DNA, 20 bp, human
ggcgacgagccaatgggtcg

SEQ ID NO: 223867 - DNA, 20 bp, human
gtcggggaggggcgtgacag

SEQ ID NO: 223868 - DNA, 20 bp, human
gccgcccctagcacccctat

SEQ ID NO: 223869 - DNA, 20 bp, human
gcacacctgtagtctcgggg

SEQ ID NO: 223870 - DNA, 20 bp, human
gacgagccaatgggtcgggg

SEQ ID NO: 223871 - DNA, 20 bp, human
gcgtgacagaggcagccaat

SEQ ID NO: 223872 - DNA, 20 bp, human
ggcagccaataggggtgcta

SEQ ID NO: 223873 - DNA, 20 bp, human
ggggcgcggcgacgagccaa

SEQ ID NO: 223874 - DNA, 20 bp, human
gccgccccccccgagactac

SEQ ID NO: 223875 - DNA, 20 bp, human
gccagcctggagacccgctc

SEQ ID NO: 223876 - DNA, 20 bp, human
gagaagcatgggagcaacaa

SEQ ID NO: 223877 - DNA, 20 bp, human
gcaaacttgctgaatcatgc

SEQ ID NO: 223878 - DNA, 20 bp, human
gttggtcaaggaataagcca

SEQ ID NO: 223879 - DNA, 20 bp, human
ggccttgctaacactataca

SEQ ID NO: 223880 - DNA, 20 bp, human
gtcacccattgtaacgtata

SEQ ID NO: 223881 - DNA, 20 bp, human
gcatccatatacgttacaat

SEQ ID NO: 223882 - DNA, 20 bp, human
ggagagtccattctatcatc

SEQ ID NO: 223883 - DNA, 20 bp, human
gggaactatgataagaagca

SEQ ID NO: 223884 - DNA, 20 bp, human
gttcagcaagtttgttgcac

SEQ ID NO: 223885 - DNA, 20 bp, human
gtgttaagacattatgaaac

SEQ ID NO: 223886 - DNA, 20 bp, human
gattaggggaagaaaatgca

SEQ ID NO: 223887 - DNA, 20 bp, human
gccactgcatgacatcatag

SEQ ID NO: 223888 - DNA, 20 bp, human
gtaattgtaccttggatagg

SEQ ID NO: 223889 - DNA, 20 bp, human
gatccatcctcctgcattag

SEQ ID NO: 223890 - DNA, 20 bp, human
gctgctagataattgtacct

SEQ ID NO: 223891 - DNA, 20 bp, human
gttcccctaatgcaggagga

SEQ ID NO: 223892 - DNA, 20 bp, human
gtctctgtgaggttggattg

SEQ ID NO: 223893 - DNA, 20 bp, human
ggatgtcatgcagtggttta

SEQ ID NO: 223894 - DNA, 20 bp, human
gtttcttcccctaatgcagg

SEQ ID NO: 223895 - DNA, 20 bp, human
gtcttggtctgagttcttta

SEQ ID NO: 223896 - DNA, 20 bp, human
gtggggacaccattggatgg

SEQ ID NO: 223897 - DNA, 20 bp, human
gcctcccagcaaatcatcag

SEQ ID NO: 223898 - DNA, 20 bp, human
gaggtggggacaccattgga

SEQ ID NO: 223899 - DNA, 20 bp, human
ggctctcatgtgaaaatcag

SEQ ID NO: 223900 - DNA, 20 bp, human
ggactggcaacccattctat

SEQ ID NO: 223901 - DNA, 20 bp, human
gaaagaggccactgtgttta

SEQ ID NO: 223902 - DNA, 20 bp, human
gaccccagccataaacacag

SEQ ID NO: 223903 - DNA, 20 bp, human
gcatcaggtggggacaccat

SEQ ID NO: 223904 - DNA, 20 bp, human
gtatgggtgggtttaagggt

SEQ ID NO: 223905 - DNA, 20 bp, human
ggtgggaggctctttcatcc

SEQ ID NO: 223906 - DNA, 20 bp, human
gtcatagcacatgatggagt

SEQ ID NO: 223907 - DNA, 20 bp, human
gcatgtgctatgaaacaaac

SEQ ID NO: 223908 - DNA, 20 bp, human
gtgtgcccaagccacaccgg

SEQ ID NO: 223909 - DNA, 20 bp, human
gaaacctccgagtacactag

SEQ ID NO: 223910 - DNA, 20 bp, human
gagtaggtgtgaaatcccag

SEQ ID NO: 223911 - DNA, 20 bp, human
gtatcctctagtgtactcgg

SEQ ID NO: 223912 - DNA, 20 bp, human
ggagtccccggcactgccaa

SEQ ID NO: 223913 - DNA, 20 bp, human
gagtgtactcggaggtttaa

SEQ ID NO: 223914 - DNA, 20 bp, human
gaggatcctgtccaccggtg

SEQ ID NO: 223915 - DNA, 20 bp, human
ggactgtgcccaagccacac

SEQ ID NO: 223916 - DNA, 20 bp, human
gaggagggctcctgtaaacc

SEQ ID NO: 223917 - DNA, 20 bp, human
gcctcagctccaggcaaaat

SEQ ID NO: 223918 - DNA, 20 bp, human
gccaggcaaaataggaacct

SEQ ID NO: 223919 - DNA, 20 bp, human
gtaagagctacctctcagga

SEQ ID NO: 223920 - DNA, 20 bp, human
gggatcataaacagttagga

SEQ ID NO: 223921 - DNA, 20 bp, human
gaaccacaggagcttgaagg

SEQ ID NO: 223922 - DNA, 20 bp, human
gagtcggatcataaacagtt

SEQ ID NO: 223923 - DNA, 20 bp, human
gatcctaagagctacctctc

SEQ ID NO: 223924 - DNA, 20 bp, human
gcctggagctgaggcacatt

SEQ ID NO: 223925 - DNA, 20 bp, human
gagaaaatccagtacagaaa

SEQ ID NO: 223926 - DNA, 20 bp, human
ggtgcgggaggcctttcgga

SEQ ID NO: 223927 - DNA, 20 bp, human
gcactcccggccgcccaatc

SEQ ID NO: 223928 - DNA, 20 bp, human
gcgggccaatcgcaactcgg

SEQ ID NO: 223929 - DNA, 20 bp, human
ggggtcctcgggctatataa

SEQ ID NO: 223930 - DNA, 20 bp, human
gtaaaggagctccgcggtgc

SEQ ID NO: 223931 - DNA, 20 bp, human
gccgcccagagccttccacc

SEQ ID NO: 223932 - DNA, 20 bp, human
gggtggtgagctagtaagtg

SEQ ID NO: 223933 - DNA, 20 bp, human
gttgggcggccgggagtggt

SEQ ID NO: 223934 - DNA, 20 bp, human
gctccgccccggccttccgc

SEQ ID NO: 223935 - DNA, 20 bp, human
gctgtagtagccagattggg

SEQ ID NO: 223936 - DNA, 20 bp, human
gtgtcccaccccaccagaag

SEQ ID NO: 223937 - DNA, 20 bp, human
gaccacgcgtctctaagcat

SEQ ID NO: 223938 - DNA, 20 bp, human
gccgagacgcgagtcggatg

SEQ ID NO: 223939 - DNA, 20 bp, human
gcgactgcagggctcattct

SEQ ID NO: 223940 - DNA, 20 bp, human
gctgcagggctcattctggg

SEQ ID NO: 223941 - DNA, 20 bp, human
gccagggccgagacgcgagt

SEQ ID NO: 223942 - DNA, 20 bp, human
gagaagaggctgatcccgat

SEQ ID NO: 223943 - DNA, 20 bp, human
gagacgcgtggtcggtgctg

SEQ ID NO: 223944 - DNA, 20 bp, human
gcgcgtctctaagcattggt

SEQ ID NO: 223945 - DNA, 20 bp, human
gaggtccgcaaggcgggcca

SEQ ID NO: 223946 - DNA, 20 bp, human
ggcacccacgcggcggaagg

SEQ ID NO: 223947 - DNA, 20 bp, human
gactgcccccggaacttgag

SEQ ID NO: 223948 - DNA, 20 bp, human
gcagaaactgcgtatatggg

SEQ ID NO: 223949 - DNA, 20 bp, human
ggggggcagtcgcttcacga

SEQ ID NO: 223950 - DNA, 20 bp, human
ggaagggggacgggagctgg

SEQ ID NO: 223951 - DNA, 20 bp, human
gtgccatggcacccacgcgg

SEQ ID NO: 223952 - DNA, 20 bp, human
ggctggccactcaagttccg

SEQ ID NO: 223953 - DNA, 20 bp, human
gcgttgccatggcacccacg

SEQ ID NO: 223954 - DNA, 20 bp, human
gcacgcggcggaagggggac

SEQ ID NO: 223955 - DNA, 20 bp, human
ggcggaagggggacgggagc

SEQ ID NO: 223956 - DNA, 20 bp, human
gacagctgaagagtgtgcgg

SEQ ID NO: 223957 - DNA, 20 bp, human
ggaccctcagctgtcctctc

SEQ ID NO: 223958 - DNA, 20 bp, human
gccctgagtgagagcaacga

SEQ ID NO: 223959 - DNA, 20 bp, human
gaggggactaggggtccggg

SEQ ID NO: 223960 - DNA, 20 bp, human
gcactcttcagctgtcgcag

SEQ ID NO: 223961 - DNA, 20 bp, human
gggggaggggactaggggtc

SEQ ID NO: 223962 - DNA, 20 bp, human
gctgaagagtgtgcggggga

SEQ ID NO: 223963 - DNA, 20 bp, human
gctgtcgcagggggcctgag

SEQ ID NO: 223964 - DNA, 20 bp, human
ggtgcgggggaggggactag

SEQ ID NO: 223965 - DNA, 20 bp, human
gcaccgaagaggagaaaatg

SEQ ID NO: 223966 - DNA, 20 bp, human
gcgtgtgttgttctaccctt

SEQ ID NO: 223967 - DNA, 20 bp, human
gacctgctggaatgattccc

SEQ ID NO: 223968 - DNA, 20 bp, human
gtgactgtgttcccagccaa

SEQ ID NO: 223969 - DNA, 20 bp, human
gaatggagaagcatttcgta

SEQ ID NO: 223970 - DNA, 20 bp, human
gtgagagctatctcaacttc

SEQ ID NO: 223971 - DNA, 20 bp, human
gttcctggttgagctttccg

SEQ ID NO: 223972 - DNA, 20 bp, human
gacctgggaatcattccagc

SEQ ID NO: 223973 - DNA, 20 bp, human
gtgccgcggaaagctcaacc

SEQ ID NO: 223974 - DNA, 20 bp, human
ggaaagctcaaccaggaacc

SEQ ID NO: 223975 - DNA, 20 bp, human
gagaacaacacacgggctcc

SEQ ID NO: 223976 - DNA, 20 bp, human
gtgcagctgagtctctgcct

SEQ ID NO: 223977 - DNA, 20 bp, human
gacagcgccggtcaccggga

SEQ ID NO: 223978 - DNA, 20 bp, human
gagagactcagctgcaaccg

SEQ ID NO: 223979 - DNA, 20 bp, human
gcggtcacgtcaggttacta

SEQ ID NO: 223980 - DNA, 20 bp, human
gaggccttgaccgccctggg

SEQ ID NO: 223981 - DNA, 20 bp, human
ggttagtaacatcgtttccc

SEQ ID NO: 223982 - DNA, 20 bp, human
gtgggcagaaaattcctccc

SEQ ID NO: 223983 - DNA, 20 bp, human
gaccgaggccttgaccgccc

SEQ ID NO: 223984 - DNA, 20 bp, human
gtagcacagcgccggtcacc

SEQ ID NO: 223985 - DNA, 20 bp, human
gccatgttagcgttggagtc

SEQ ID NO: 223986 - DNA, 20 bp, human
gcgggaagaaggcgagcggt

SEQ ID NO: 223987 - DNA, 20 bp, human
ggggaggagacgcgacgtgg

SEQ ID NO: 223988 - DNA, 20 bp, human
gccaaccgtgcggaagaaaa

SEQ ID NO: 223989 - DNA, 20 bp, human
gctggttatcgggagttgga

SEQ ID NO: 223990 - DNA, 20 bp, human
ggtggtgtgtacagagctct

SEQ ID NO: 223991 - DNA, 20 bp, human
gagggaggactgactaacgt

SEQ ID NO: 223992 - DNA, 20 bp, human
ggaggactgactaacgtggg

SEQ ID NO: 223993 - DNA, 20 bp, human
gccgacctcctccaaccgtg

SEQ ID NO: 223994 - DNA, 20 bp, human
gcgtggcccaagtaatagtc

SEQ ID NO: 223995 - DNA, 20 bp, human
gtcttccgcacggttggagg

SEQ ID NO: 223996 - DNA, 20 bp, human
gagcccagagactcccacaa

SEQ ID NO: 223997 - DNA, 20 bp, human
gcaagcctggcaccagaagg

SEQ ID NO: 223998 - DNA, 20 bp, human
gaccgcgacgcctgttacca

SEQ ID NO: 223999 - DNA, 20 bp, human
gctgggtacaacatctaatt

SEQ ID NO: 224000 - DNA, 20 bp, human
ggtacccaggctggttaccc

SEQ ID NO: 224001 - DNA, 20 bp, human
gaccctggtaacaggcgtcg

SEQ ID NO: 224002 - DNA, 20 bp, human
gaggaaggcgggcgctttcc

SEQ ID NO: 224003 - DNA, 20 bp, human
gcctggaagagaagtgggtc

SEQ ID NO: 224004 - DNA, 20 bp, human
gacaacatctaattgggtcc

SEQ ID NO: 224005 - DNA, 20 bp, human
gcaggcgtcgcggtttgtca

SEQ ID NO: 224006 - DNA, 20 bp, human
gccgaaggcggggcctctga

SEQ ID NO: 224007 - DNA, 20 bp, human
gttcccgcggatgtgtatgg

SEQ ID NO: 224008 - DNA, 20 bp, human
ggccgcaacggtgacgactg

SEQ ID NO: 224009 - DNA, 20 bp, human
gtgtgtatggcggtgagcgt

SEQ ID NO: 224010 - DNA, 20 bp, human
gggtggaggaagcgttcccg

SEQ ID NO: 224011 - DNA, 20 bp, human
gtcctccaccagccgaaggc

SEQ ID NO: 224012 - DNA, 20 bp, human
gcagcgcgaattgagcctcg

SEQ ID NO: 224013 - DNA, 20 bp, human
gcaccgccatacacatccgc

SEQ ID NO: 224014 - DNA, 20 bp, human
gaggccccgccttcggctgg

SEQ ID NO: 224015 - DNA, 20 bp, human
gtcaattcgcgctgtgtggc

SEQ ID NO: 224016 - DNA, 20 bp, human
gacccccggccctggcacgg

SEQ ID NO: 224017 - DNA, 20 bp, human
gcggacttcccagcgccgga

SEQ ID NO: 224018 - DNA, 20 bp, human
gccggcgtctgtgttgtctg

SEQ ID NO: 224019 - DNA, 20 bp, human
gcggaggagcccgaacgccc

SEQ ID NO: 224020 - DNA, 20 bp, human
ggggacgcgggatcctaggt

SEQ ID NO: 224021 - DNA, 20 bp, human
gacggccgtaataacgacat

SEQ ID NO: 224022 - DNA, 20 bp, human
gacgccggcgccacatgggc

SEQ ID NO: 224023 - DNA, 20 bp, human
gagcctctcccggggcgttc

SEQ ID NO: 224024 - DNA, 20 bp, human
gaacgacatcggggcagagc

SEQ ID NO: 224025 - DNA, 20 bp, human
gtgccccgatgtcgttatta

SEQ ID NO: 224026 - DNA, 20 bp, human
gcgcgctctgacaaagtgca

SEQ ID NO: 224027 - DNA, 20 bp, human
ggactcctaggtaacgtcgc

SEQ ID NO: 224028 - DNA, 20 bp, human
ggctaggagggcaatggggc

SEQ ID NO: 224029 - DNA, 20 bp, human
gagcgcgaatagaggaaagg

SEQ ID NO: 224030 - DNA, 20 bp, human
ggctttgaggcaaaggattt

SEQ ID NO: 224031 - DNA, 20 bp, human
gctagaaggcggggctagga

SEQ ID NO: 224032 - DNA, 20 bp, human
ggcggggctaggagggcaat

SEQ ID NO: 224033 - DNA, 20 bp, human
gtccgcctgcgacgttacct

SEQ ID NO: 224034 - DNA, 20 bp, human
ggaggcaaaggattttggaa

SEQ ID NO: 224035 - DNA, 20 bp, human
ggcccgctttcgattgtcag

SEQ ID NO: 224036 - DNA, 20 bp, human
gactccgcgggaaacggcgg

SEQ ID NO: 224037 - DNA, 20 bp, human
ggggagcggcggtccagact

SEQ ID NO: 224038 - DNA, 20 bp, human
gcggggaggtgctgactcgg

SEQ ID NO: 224039 - DNA, 20 bp, human
gactggggagggacgcgcac

SEQ ID NO: 224040 - DNA, 20 bp, human
gggacccaggggaaccgcga

SEQ ID NO: 224041 - DNA, 20 bp, human
gccggccaggaggcttcaag

SEQ ID NO: 224042 - DNA, 20 bp, human
gaggccagaagagcgaacgt

SEQ ID NO: 224043 - DNA, 20 bp, human
gcgacggggaggtgctgact

SEQ ID NO: 224044 - DNA, 20 bp, human
gcgcccgtcgcggttcccct

SEQ ID NO: 224045 - DNA, 20 bp, human
gaggactccgcgggaaacgg

SEQ ID NO: 224046 - DNA, 20 bp, human
gtggcggttagggaaactag

SEQ ID NO: 224047 - DNA, 20 bp, human
ggttagggaaactaggggtc

SEQ ID NO: 224048 - DNA, 20 bp, human
gggaaactaggggtcgggga

SEQ ID NO: 224049 - DNA, 20 bp, human
ggcggggccacacgtctcta

SEQ ID NO: 224050 - DNA, 20 bp, human
gtaaccgccaagcccggggt

SEQ ID NO: 224051 - DNA, 20 bp, human
gttccctaaccgccaagccc

SEQ ID NO: 224052 - DNA, 20 bp, human
gagttccggccttgccgccg

SEQ ID NO: 224053 - DNA, 20 bp, human
gtgtcggagcgacgctgcgg

SEQ ID NO: 224054 - DNA, 20 bp, human
gcacacgtctctagggaccc

SEQ ID NO: 224055 - DNA, 20 bp, human
ggacggccgccgcgtctcca

SEQ ID NO: 224056 - DNA, 20 bp, human
gcagggagcgtgaggacgtg

SEQ ID NO: 224057 - DNA, 20 bp, human
gcacccgtcgggtcccctga

SEQ ID NO: 224058 - DNA, 20 bp, human
gtaacctggccaaaaggtcg

SEQ ID NO: 224059 - DNA, 20 bp, human
ggaatgcgcagtgggtgcgt

SEQ ID NO: 224060 - DNA, 20 bp, human
gggcttccgtgaatgcgcag

SEQ ID NO: 224061 - DNA, 20 bp, human
ggggcgacgacgtgcgcgga

SEQ ID NO: 224062 - DNA, 20 bp, human
ggacccgacgggtggctgtt

SEQ ID NO: 224063 - DNA, 20 bp, human
gtagtcatcgggtccgacac

SEQ ID NO: 224064 - DNA, 20 bp, human
gggagggggcgacgctgaga

SEQ ID NO: 224065 - DNA, 20 bp, human
gccgccttgcctttaacgag

SEQ ID NO: 224066 - DNA, 20 bp, human
gagggcaccgcgccagtttc

SEQ ID NO: 224067 - DNA, 20 bp, human
gaactggcgcggtgccctct

SEQ ID NO: 224068 - DNA, 20 bp, human
gtcccagaacaagtcccaga

SEQ ID NO: 224069 - DNA, 20 bp, human
gcaggcaacaagtacttccg

SEQ ID NO: 224070 - DNA, 20 bp, human
ggggacttgtagtcttgtac

SEQ ID NO: 224071 - DNA, 20 bp, human
ggcctccaggcttaccttcc

SEQ ID NO: 224072 - DNA, 20 bp, human
gtgccctctgggacttgttc

SEQ ID NO: 224073 - DNA, 20 bp, human
gagaaggtcagagttcgcgg

SEQ ID NO: 224074 - DNA, 20 bp, human
gcctaagcagcccactgctc

SEQ ID NO: 224075 - DNA, 20 bp, human
gaggctttgcacactgggat

SEQ ID NO: 224076 - DNA, 20 bp, human
gctagggagcatatagtccg

SEQ ID NO: 224077 - DNA, 20 bp, human
gaatggcagtaaaggttctg

SEQ ID NO: 224078 - DNA, 20 bp, human
gttggatggaatggcagtaa

SEQ ID NO: 224079 - DNA, 20 bp, human
gcttgcagtgggactgaatg

SEQ ID NO: 224080 - DNA, 20 bp, human
gccagagagaacggattctt

SEQ ID NO: 224081 - DNA, 20 bp, human
ggaggaaaatccaaggagtt

SEQ ID NO: 224082 - DNA, 20 bp, human
ggacgcatggtgactcttta

SEQ ID NO: 224083 - DNA, 20 bp, human
gctgggacatgttttagcca

SEQ ID NO: 224084 - DNA, 20 bp, human
gcctcccacacgcttgcagt

SEQ ID NO: 224085 - DNA, 20 bp, human
gcagtcccactgcaagcgtg

SEQ ID NO: 224086 - DNA, 20 bp, human
gggcgctcagaggctctagg

SEQ ID NO: 224087 - DNA, 20 bp, human
gcccgcaggtgggaggttcg

SEQ ID NO: 224088 - DNA, 20 bp, human
gcgcgcgcgcgggaagggat

SEQ ID NO: 224089 - DNA, 20 bp, human
gtctaggtggctcccggcgg

SEQ ID NO: 224090 - DNA, 20 bp, human
gtgccagtgggcccgcaggt

SEQ ID NO: 224091 - DNA, 20 bp, human
gggctcccggcggcggttcg

SEQ ID NO: 224092 - DNA, 20 bp, human
ggcgggcccactggcacccg

SEQ ID NO: 224093 - DNA, 20 bp, human
gagccttggccgcctctcgc

SEQ ID NO: 224094 - DNA, 20 bp, human
gagaggctctaggtggctcc

SEQ ID NO: 224095 - DNA, 20 bp, human
ggagcgccgcgggtgccagt

SEQ ID NO: 224096 - DNA, 20 bp, human
gtggcggggtgactgaaaga

SEQ ID NO: 224097 - DNA, 20 bp, human
gaggacgcgggagattcgat

SEQ ID NO: 224098 - DNA, 20 bp, human
gcagaagaaggcgccgcaga

SEQ ID NO: 224099 - DNA, 20 bp, human
gtgcggcgccttcttctgat

SEQ ID NO: 224100 - DNA, 20 bp, human
ggtactactgatccacctgt

SEQ ID NO: 224101 - DNA, 20 bp, human
gctcctgggcgtagggttcc

SEQ ID NO: 224102 - DNA, 20 bp, human
gagacccggcgctgtcctag

SEQ ID NO: 224103 - DNA, 20 bp, human
gtcccgggaaccctacgccc

SEQ ID NO: 224104 - DNA, 20 bp, human
gaagagggttgagggagctt

SEQ ID NO: 224105 - DNA, 20 bp, human
ggtcgtttccagatgcttgt

SEQ ID NO: 224106 - DNA, 20 bp, human
gaaaacgcgcgggtgactgc

SEQ ID NO: 224107 - DNA, 20 bp, human
ggataagcggccggctagag

SEQ ID NO: 224108 - DNA, 20 bp, human
gctagccggccgcttatcta

SEQ ID NO: 224109 - DNA, 20 bp, human
gcaagaagtgctggcaccaa

SEQ ID NO: 224110 - DNA, 20 bp, human
gccggggtgggattgctagg

SEQ ID NO: 224111 - DNA, 20 bp, human
gaggcccgagctgtgctctg

SEQ ID NO: 224112 - DNA, 20 bp, human
gtctactgatcgggaaacgt

SEQ ID NO: 224113 - DNA, 20 bp, human
gaccgcgcggcaacagcttg

SEQ ID NO: 224114 - DNA, 20 bp, human
ggctagagaggacctgctcg

SEQ ID NO: 224115 - DNA, 20 bp, human
ggcgctgtgttgaaaacgcg

SEQ ID NO: 224116 - DNA, 20 bp, human
ggaagggccgaggggacccg

SEQ ID NO: 224117 - DNA, 20 bp, human
ggcttggcccgcagactgag

SEQ ID NO: 224118 - DNA, 20 bp, human
gggcggcgggaagggccgag

SEQ ID NO: 224119 - DNA, 20 bp, human
gtaacggggccgcgtgcccg

SEQ ID NO: 224120 - DNA, 20 bp, human
gactcccgatcaaaatccgg

SEQ ID NO: 224121 - DNA, 20 bp, human
gagtctgcgggccaagcccg

SEQ ID NO: 224122 - DNA, 20 bp, human
gacgcgggcccctcagtctg

SEQ ID NO: 224123 - DNA, 20 bp, human
gcgggtccagggtttctaac

SEQ ID NO: 224124 - DNA, 20 bp, human
ggggcggggccacgcgcgat

SEQ ID NO: 224125 - DNA, 20 bp, human
gattggccgcgcggcatcgg

SEQ ID NO: 224126 - DNA, 20 bp, human
gcaggcgcgaaataaacaat

SEQ ID NO: 224127 - DNA, 20 bp, human
gtgggctggtaaatccagga

SEQ ID NO: 224128 - DNA, 20 bp, human
gaaatccaggagggacctga

SEQ ID NO: 224129 - DNA, 20 bp, human
gcgtgcgcagaaggcctggt

SEQ ID NO: 224130 - DNA, 20 bp, human
gccttggagctgcgcccgaa

SEQ ID NO: 224131 - DNA, 20 bp, human
gatcgccgaggaataaagga

SEQ ID NO: 224132 - DNA, 20 bp, human
gcgcgaaataaacaatgggc

SEQ ID NO: 224133 - DNA, 20 bp, human
gaggcgccaaggcgtcctct

SEQ ID NO: 224134 - DNA, 20 bp, human
gtcctcggcgatatgctctg

SEQ ID NO: 224135 - DNA, 20 bp, human
ggcacttgcgcgtgcgcaga

SEQ ID NO: 224136 - DNA, 20 bp, human
gactccttgacccagaaggt

SEQ ID NO: 224137 - DNA, 20 bp, human
gaggggggaaggataggtga

SEQ ID NO: 224138 - DNA, 20 bp, human
gcttctgggtcaaggagtga

SEQ ID NO: 224139 - DNA, 20 bp, human
gggcactgggccacctcaga

SEQ ID NO: 224140 - DNA, 20 bp, human
gggcagtggtgaggtgactc

SEQ ID NO: 224141 - DNA, 20 bp, human
gaaggttggtgctgccaagg

SEQ ID NO: 224142 - DNA, 20 bp, human
gctccccaccttctgggtca

SEQ ID NO: 224143 - DNA, 20 bp, human
ggaggtgactcagggatgct

SEQ ID NO: 224144 - DNA, 20 bp, human
ggcctggcccaattcttaaa

SEQ ID NO: 224145 - DNA, 20 bp, human
gttcagggatgaggtagtca

SEQ ID NO: 224146 - DNA, 20 bp, human
gacaaggtgttggggtacta

SEQ ID NO: 224147 - DNA, 20 bp, human
gtatgctaggacaaggtgtt

SEQ ID NO: 224148 - DNA, 20 bp, human
gtggagaagggcagggaact

SEQ ID NO: 224149 - DNA, 20 bp, human
gtagttcctgggctggagaa

SEQ ID NO: 224150 - DNA, 20 bp, human
gtgcttgcagggtggaggta

SEQ ID NO: 224151 - DNA, 20 bp, human
ggggctccaagccacccctc

SEQ ID NO: 224152 - DNA, 20 bp, human
gggtggctgcctgacgtcac

SEQ ID NO: 224153 - DNA, 20 bp, human
gaggtgttggggtactaggg

SEQ ID NO: 224154 - DNA, 20 bp, human
gctccagcccaggaactagg

SEQ ID NO: 224155 - DNA, 20 bp, human
gcagagaggccggtgacgtc

SEQ ID NO: 224156 - DNA, 20 bp, human
gccaacttggcggttctcgg

SEQ ID NO: 224157 - DNA, 20 bp, human
gcgtcggaagcccacccctg

SEQ ID NO: 224158 - DNA, 20 bp, human
gggggctggtaccaacttgg

SEQ ID NO: 224159 - DNA, 20 bp, human
ggcaggggctggtaccaact

SEQ ID NO: 224160 - DNA, 20 bp, human
gtaaaacctgatcaccgcag

SEQ ID NO: 224161 - DNA, 20 bp, human
ggaaaccgagggcagccggc

SEQ ID NO: 224162 - DNA, 20 bp, human
gtgccctcggtttcctaggt

SEQ ID NO: 224163 - DNA, 20 bp, human
gcggccgctaggttcttcgc

SEQ ID NO: 224164 - DNA, 20 bp, human
ggtgtcctgtcggagtcagt

SEQ ID NO: 224165 - DNA, 20 bp, human
ggacccagcgaagaacctag

SEQ ID NO: 224166 - DNA, 20 bp, human
gaggcggtgggcggagtcga

SEQ ID NO: 224167 - DNA, 20 bp, human
ggggctgaggcgaaagggtg

SEQ ID NO: 224168 - DNA, 20 bp, human
ggggtcgcagagcaagagcg

SEQ ID NO: 224169 - DNA, 20 bp, human
gaacgcggccccgcccacct

SEQ ID NO: 224170 - DNA, 20 bp, human
ggggccgcgctccatcgggg

SEQ ID NO: 224171 - DNA, 20 bp, human
ggggccgggctgaggcgaaa

SEQ ID NO: 224172 - DNA, 20 bp, human
ggggtgcggccagccgaggt

SEQ ID NO: 224173 - DNA, 20 bp, human
gggcctgagcgcgcgtctcc

SEQ ID NO: 224174 - DNA, 20 bp, human
ggtggggccgcgctccatcg

SEQ ID NO: 224175 - DNA, 20 bp, human
ggtgggcggagtcgagggac

SEQ ID NO: 224176 - DNA, 20 bp, human
gactagaacaagatcgggtt

SEQ ID NO: 224177 - DNA, 20 bp, human
ggtagaccctgagacaggca

SEQ ID NO: 224178 - DNA, 20 bp, human
ggatcccctgccctcttcgg

SEQ ID NO: 224179 - DNA, 20 bp, human
gtggccctgggagccggcaa

SEQ ID NO: 224180 - DNA, 20 bp, human
gcccagggccacctcacaaa

SEQ ID NO: 224181 - DNA, 20 bp, human
gtggagtcagatctcagttg

SEQ ID NO: 224182 - DNA, 20 bp, human
gaggccctccgaagagggca

SEQ ID NO: 224183 - DNA, 20 bp, human
gcggagggcctatgtctgta

SEQ ID NO: 224184 - DNA, 20 bp, human
gaagcctcgggggagactgc

SEQ ID NO: 224185 - DNA, 20 bp, human
ggtccggctagtaagaggca

SEQ ID NO: 224186 - DNA, 20 bp, human
ggcccctggggctcctttaa

SEQ ID NO: 224187 - DNA, 20 bp, human
gcgcccgctccggacgctag

SEQ ID NO: 224188 - DNA, 20 bp, human
gagcccttaaaggagcccca

SEQ ID NO: 224189 - DNA, 20 bp, human
gggtccgtgcccctagcgtc

SEQ ID NO: 224190 - DNA, 20 bp, human
ggccacctcagtgacccttt

SEQ ID NO: 224191 - DNA, 20 bp, human
gggctcccaaagggtcactg

SEQ ID NO: 224192 - DNA, 20 bp, human
ggtggccgcgagccgagccc

SEQ ID NO: 224193 - DNA, 20 bp, human
gtcccaaagggtcactgagg

SEQ ID NO: 224194 - DNA, 20 bp, human
ggcgcgggctggaccggggt

SEQ ID NO: 224195 - DNA, 20 bp, human
gtccggtcccggctcccaaa

SEQ ID NO: 224196 - DNA, 20 bp, human
ggccccccgccaaccggctc

SEQ ID NO: 224197 - DNA, 20 bp, human
ggccccgcggccaacccggt

SEQ ID NO: 224198 - DNA, 20 bp, human
ggcttctcccggaacccccg

SEQ ID NO: 224199 - DNA, 20 bp, human
gaaagtaacggccccttccc

SEQ ID NO: 224200 - DNA, 20 bp, human
gaggcaggccccgcccgcgg

SEQ ID NO: 224201 - DNA, 20 bp, human
gcgccgctctgggaaagtaa

SEQ ID NO: 224202 - DNA, 20 bp, human
gcccgccaaccggctccgga

SEQ ID NO: 224203 - DNA, 20 bp, human
gtgacgtcgccccgccgctc

SEQ ID NO: 224204 - DNA, 20 bp, human
ggcggcggggcgacgtcagg

SEQ ID NO: 224205 - DNA, 20 bp, human
ggggccagccgcgtgctccg

SEQ ID NO: 224206 - DNA, 20 bp, human
gtggtcaaagggccctgcga

SEQ ID NO: 224207 - DNA, 20 bp, human
gaccagctggaagaaatcct

SEQ ID NO: 224208 - DNA, 20 bp, human
gggggtgtggtcgagagtgt

SEQ ID NO: 224209 - DNA, 20 bp, human
gctgcgatggagcctccaag

SEQ ID NO: 224210 - DNA, 20 bp, human
gcaagggactggtgatgaga

SEQ ID NO: 224211 - DNA, 20 bp, human
ggatgcgatgcgcctcttgg

SEQ ID NO: 224212 - DNA, 20 bp, human
gcgcatcaggctctgagacg

SEQ ID NO: 224213 - DNA, 20 bp, human
gtggttgccaagggaacggt

SEQ ID NO: 224214 - DNA, 20 bp, human
gatttcttccagctggtcaa

SEQ ID NO: 224215 - DNA, 20 bp, human
gcgcatcacccctgcgcatc

SEQ ID NO: 224216 - DNA, 20 bp, human
gtcccacggaggcgtccagg

SEQ ID NO: 224217 - DNA, 20 bp, human
gaggcgtccagggggcgaag

SEQ ID NO: 224218 - DNA, 20 bp, human
gggaccctgcgagaacgggt

SEQ ID NO: 224219 - DNA, 20 bp, human
ggggccggaccctgcgagaa

SEQ ID NO: 224220 - DNA, 20 bp, human
gcgcgcgtgcgcgtcggaac

SEQ ID NO: 224221 - DNA, 20 bp, human
gtgcccggtgggcgcgggag

SEQ ID NO: 224222 - DNA, 20 bp, human
gaagaaggcggggagacccc

SEQ ID NO: 224223 - DNA, 20 bp, human
ggggtgggcgtgtgcccggt

SEQ ID NO: 224224 - DNA, 20 bp, human
gcacgcccacccgttctcgc

SEQ ID NO: 224225 - DNA, 20 bp, human
gggttcccacggaggcgtcc

SEQ ID NO: 224226 - DNA, 20 bp, human
ggggaacgcccgtccagaag

SEQ ID NO: 224227 - DNA, 20 bp, human
gagaagctgaggcgcctggt

SEQ ID NO: 224228 - DNA, 20 bp, human
gacgcacgtgggaacccacc

SEQ ID NO: 224229 - DNA, 20 bp, human
gcctcgctgggcttggtagt

SEQ ID NO: 224230 - DNA, 20 bp, human
gtattaaaaccgagggtggg

SEQ ID NO: 224231 - DNA, 20 bp, human
gcaggaagccgcttctggac

SEQ ID NO: 224232 - DNA, 20 bp, human
gtcacggttattaaaaccga

SEQ ID NO: 224233 - DNA, 20 bp, human
gttgctaagtacccacgttc

SEQ ID NO: 224234 - DNA, 20 bp, human
gggttattaaaaccgagggt

SEQ ID NO: 224235 - DNA, 20 bp, human
gcccacgaactaaagataac

SEQ ID NO: 224236 - DNA, 20 bp, human
ggaaaacaatcaatagtcca

SEQ ID NO: 224237 - DNA, 20 bp, human
gacacattctgaaggcctcc

SEQ ID NO: 224238 - DNA, 20 bp, human
ggaagtagaggaatgattga

SEQ ID NO: 224239 - DNA, 20 bp, human
gcaaggattgtgtgtctcat

SEQ ID NO: 224240 - DNA, 20 bp, human
gttcctgcaatgaagctccc

SEQ ID NO: 224241 - DNA, 20 bp, human
gtgatgctgacacattctga

SEQ ID NO: 224242 - DNA, 20 bp, human
gctccagggagcttcattgc

SEQ ID NO: 224243 - DNA, 20 bp, human
gtggctaaagatgtatgaaa

SEQ ID NO: 224244 - DNA, 20 bp, human
gtttacttttgattctgcct

SEQ ID NO: 224245 - DNA, 20 bp, human
gccacacacacctacgatta

SEQ ID NO: 224246 - DNA, 20 bp, human
gcaaagagaccggtaggtga

SEQ ID NO: 224247 - DNA, 20 bp, human
ggagaccggtaggtgaggga

SEQ ID NO: 224248 - DNA, 20 bp, human
ggggaagagtccctgattat

SEQ ID NO: 224249 - DNA, 20 bp, human
gttggtccaaatggggactc

SEQ ID NO: 224250 - DNA, 20 bp, human
gccacccctccctcacctac

SEQ ID NO: 224251 - DNA, 20 bp, human
gccgcaagggcgctttggag

SEQ ID NO: 224252 - DNA, 20 bp, human
gcaagggcgctttggagcgg

SEQ ID NO: 224253 - DNA, 20 bp, human
gaggggtcttccattattgt

SEQ ID NO: 224254 - DNA, 20 bp, human
gggagtcaggaacagataga

SEQ ID NO: 224255 - DNA, 20 bp, human
gagaagcaaccctccagttt

SEQ ID NO: 224256 - DNA, 20 bp, human
gaaaagcggtgccttgggga

SEQ ID NO: 224257 - DNA, 20 bp, human
gggctctggtggaccggata

SEQ ID NO: 224258 - DNA, 20 bp, human
gtgaaacaggttgggacata

SEQ ID NO: 224259 - DNA, 20 bp, human
gaagcatggctggtgatgat

SEQ ID NO: 224260 - DNA, 20 bp, human
gtggaccggatacggaaaag

SEQ ID NO: 224261 - DNA, 20 bp, human
gcccgcccaaaaccagactt

SEQ ID NO: 224262 - DNA, 20 bp, human
ggcgccgccgcaagcatggc

SEQ ID NO: 224263 - DNA, 20 bp, human
gcaaagcacaaactcggctc

SEQ ID NO: 224264 - DNA, 20 bp, human
gagcacaaactcggctctgg

SEQ ID NO: 224265 - DNA, 20 bp, human
gagttcctgacattcgtcgg

SEQ ID NO: 224266 - DNA, 20 bp, human
ggggccgcaaggggacgctg

SEQ ID NO: 224267 - DNA, 20 bp, human
gtgcggcaaagcagccgacc

SEQ ID NO: 224268 - DNA, 20 bp, human
gaaaacgatgtcagccaggt

SEQ ID NO: 224269 - DNA, 20 bp, human
gggtcctgatagggccgcaa

SEQ ID NO: 224270 - DNA, 20 bp, human
gcggccctatcaggaccgga

SEQ ID NO: 224271 - DNA, 20 bp, human
ggaacacgcagaagccgcag

SEQ ID NO: 224272 - DNA, 20 bp, human
gggcttctgcgtgttccttc

SEQ ID NO: 224273 - DNA, 20 bp, human
gtgttccttccggtcctgat

SEQ ID NO: 224274 - DNA, 20 bp, human
gttaatcgctgaggcaaggc

SEQ ID NO: 224275 - DNA, 20 bp, human
gaaagcctaaatttttgaca

SEQ ID NO: 224276 - DNA, 20 bp, human
ggggaatttcaggatttctg

SEQ ID NO: 224277 - DNA, 20 bp, human
gtcgccgggcaaccacaatg

SEQ ID NO: 224278 - DNA, 20 bp, human
gggcagagcaaggctgtaga

SEQ ID NO: 224279 - DNA, 20 bp, human
gctgttggctgcattattcc

SEQ ID NO: 224280 - DNA, 20 bp, human
gcagatgagtaggtggaagg

SEQ ID NO: 224281 - DNA, 20 bp, human
gaggtggaagggggaatttc

SEQ ID NO: 224282 - DNA, 20 bp, human
gcaattcgaggcagatgagt

SEQ ID NO: 224283 - DNA, 20 bp, human
gcggcaaggcagccccattg

SEQ ID NO: 224284 - DNA, 20 bp, human
gtccagaagtaccccctccg

SEQ ID NO: 224285 - DNA, 20 bp, human
gactactcctctattcaaaa

SEQ ID NO: 224286 - DNA, 20 bp, human
ggagaggcgcgaggcattgt

SEQ ID NO: 224287 - DNA, 20 bp, human
gtggggataccaggtgggaa

SEQ ID NO: 224288 - DNA, 20 bp, human
gcccaacccagtacagttca

SEQ ID NO: 224289 - DNA, 20 bp, human
gtcaaaggcaagagctagaa

SEQ ID NO: 224290 - DNA, 20 bp, human
gtcacgtgacgtcatgaagg

SEQ ID NO: 224291 - DNA, 20 bp, human
gctctcacgtgacgtcatga

SEQ ID NO: 224292 - DNA, 20 bp, human
gcatgaaggaggcttgataa

SEQ ID NO: 224293 - DNA, 20 bp, human
ggtactgggttggggatacc

SEQ ID NO: 224294 - DNA, 20 bp, human
ggccatgaactgtactgggt

SEQ ID NO: 224295 - DNA, 20 bp, human
gccaagacttggaccgccat

SEQ ID NO: 224296 - DNA, 20 bp, human
gactacgcggatgttgtggg

SEQ ID NO: 224297 - DNA, 20 bp, human
gaggcggccgagagcccgta

SEQ ID NO: 224298 - DNA, 20 bp, human
gtggcggaagtgagttgtac

SEQ ID NO: 224299 - DNA, 20 bp, human
gccacagcgttctcggtggt

SEQ ID NO: 224300 - DNA, 20 bp, human
gctaggccgagcggagtcat

SEQ ID NO: 224301 - DNA, 20 bp, human
ggatgaagatccccctcatg

SEQ ID NO: 224302 - DNA, 20 bp, human
gtcaccagatcccacggccc

SEQ ID NO: 224303 - DNA, 20 bp, human
gttccctccagtctctatgg

SEQ ID NO: 224304 - DNA, 20 bp, human
ggtgactacgcggatgttgt

SEQ ID NO: 224305 - DNA, 20 bp, human
gtccgctcggcctagggagg

SEQ ID NO: 224306 - DNA, 20 bp, human
ggggagagggccgcgattgg

SEQ ID NO: 224307 - DNA, 20 bp, human
gaggggccattcctactcct

SEQ ID NO: 224308 - DNA, 20 bp, human
gaactgcggtgggcggagta

SEQ ID NO: 224309 - DNA, 20 bp, human
gcggtgggcggagtaaggag

SEQ ID NO: 224310 - DNA, 20 bp, human
gcaggaaaaaggctcgggta

SEQ ID NO: 224311 - DNA, 20 bp, human
ggaaaaaggctcgggtaagg

SEQ ID NO: 224312 - DNA, 20 bp, human
ggattggaggaaactgcggt

SEQ ID NO: 224313 - DNA, 20 bp, human
ggggcgagcgtggtgcagcc

SEQ ID NO: 224314 - DNA, 20 bp, human
gtaaggagcggagagagagg

SEQ ID NO: 224315 - DNA, 20 bp, human
gtggaggaaactgcggtggg

SEQ ID NO: 224316 - DNA, 20 bp, human
ggacaatcgcgtgagtgctg

SEQ ID NO: 224317 - DNA, 20 bp, human
gctccgctccgcagcgacaa

SEQ ID NO: 224318 - DNA, 20 bp, human
gggttaagtgccgggaaagg

SEQ ID NO: 224319 - DNA, 20 bp, human
gaggaggccgccgttcctta

SEQ ID NO: 224320 - DNA, 20 bp, human
gtgtgcccgggtcctagcgc

SEQ ID NO: 224321 - DNA, 20 bp, human
gttcccggcacttaaccaat

SEQ ID NO: 224322 - DNA, 20 bp, human
gaggctgccgggagcagact

SEQ ID NO: 224323 - DNA, 20 bp, human
gcctcctattggttaagtgc

SEQ ID NO: 224324 - DNA, 20 bp, human
gcccaggctgcgcgggtgat

SEQ ID NO: 224325 - DNA, 20 bp, human
gcttccggcctcctattggg

SEQ ID NO: 224326 - DNA, 20 bp, human
gcatccccgaaggccactca

SEQ ID NO: 224327 - DNA, 20 bp, human
ggagggaaggaatcctaccg

SEQ ID NO: 224328 - DNA, 20 bp, human
ggcaggctgccggctatcga

SEQ ID NO: 224329 - DNA, 20 bp, human
gagccggcagcctgcgttcg

SEQ ID NO: 224330 - DNA, 20 bp, human
gcctgccgcgcgccaatcac

SEQ ID NO: 224331 - DNA, 20 bp, human
ggccacgggggccccgccca

SEQ ID NO: 224332 - DNA, 20 bp, human
ggctccgccgccataggccg

SEQ ID NO: 224333 - DNA, 20 bp, human
gagggccgggcgaggccgac

SEQ ID NO: 224334 - DNA, 20 bp, human
gctaccgcggactccgcggg

SEQ ID NO: 224335 - DNA, 20 bp, human
gccggccctgagtggccttc

SEQ ID NO: 224336 - DNA, 20 bp, human
gtgcaggccaatgttcactc

SEQ ID NO: 224337 - DNA, 20 bp, human
gggaaatacagtgttcactc

SEQ ID NO: 224338 - DNA, 20 bp, human
gtcaatgttctcgttgaata

SEQ ID NO: 224339 - DNA, 20 bp, human
gaatatgctaaaactgagta

SEQ ID NO: 224340 - DNA, 20 bp, human
gagtttacctgagtgaacat

SEQ ID NO: 224341 - DNA, 20 bp, human
gtgacctcacatgtaactgc

SEQ ID NO: 224342 - DNA, 20 bp, human
ggggctacttattcatcttg

SEQ ID NO: 224343 - DNA, 20 bp, human
gtaaatcttcgtttctatag

SEQ ID NO: 224344 - DNA, 20 bp, human
gtctggaaactttctgctat

SEQ ID NO: 224345 - DNA, 20 bp, human
gtttagcatattaactacaa

SEQ ID NO: 224346 - DNA, 20 bp, human
gaggagcgcaccaactgcgt

SEQ ID NO: 224347 - DNA, 20 bp, human
gggcactggcgaaagctcag

SEQ ID NO: 224348 - DNA, 20 bp, human
gaggtccctaaacatggaga

SEQ ID NO: 224349 - DNA, 20 bp, human
gacgcccgggcccggaaggt

SEQ ID NO: 224350 - DNA, 20 bp, human
gcccgaatggcggccgacaa

SEQ ID NO: 224351 - DNA, 20 bp, human
gggcctgagcacgtgtctcg

SEQ ID NO: 224352 - DNA, 20 bp, human
gcccggaaggtaggcgcgtg

SEQ ID NO: 224353 - DNA, 20 bp, human
ggcgcgctgggaacgcagaa

SEQ ID NO: 224354 - DNA, 20 bp, human
gtcccagcgcgcggcccgaa

SEQ ID NO: 224355 - DNA, 20 bp, human
gtggctgcctcctgctcgtg

SEQ ID NO: 224356 - DNA, 20 bp, human
ggggaagaggcattaggtgt

SEQ ID NO: 224357 - DNA, 20 bp, human
gaaaatggcaaggttgatat

SEQ ID NO: 224358 - DNA, 20 bp, human
gaatggagggataatgttgt

SEQ ID NO: 224359 - DNA, 20 bp, human
gaatggatttccaatgcaat

SEQ ID NO: 224360 - DNA, 20 bp, human
gatggagcctagtgtgtggc

SEQ ID NO: 224361 - DNA, 20 bp, human
gaggtgtaggtgtgcaactc

SEQ ID NO: 224362 - DNA, 20 bp, human
gagcctagtgtgtggctggg

SEQ ID NO: 224363 - DNA, 20 bp, human
gcattcaatccaaacgataa

SEQ ID NO: 224364 - DNA, 20 bp, human
gaaatcaggtctgagaaatc

SEQ ID NO: 224365 - DNA, 20 bp, human
gaaaccatttagatttagaa

SEQ ID NO: 224366 - DNA, 20 bp, human
gggcagagcgagaaagaacc

SEQ ID NO: 224367 - DNA, 20 bp, human
gaaaacaatgatgctcctga

SEQ ID NO: 224368 - DNA, 20 bp, human
ggcgttgcctggttgtgcgc

SEQ ID NO: 224369 - DNA, 20 bp, human
gacaaccaggcaacgccctc

SEQ ID NO: 224370 - DNA, 20 bp, human
gcaggggccgctgtgtttct

SEQ ID NO: 224371 - DNA, 20 bp, human
gccggggcgcgtcaatatgg

SEQ ID NO: 224372 - DNA, 20 bp, human
ggggccggggcgcgtcaata

SEQ ID NO: 224373 - DNA, 20 bp, human
gggaatgcgcgcgggatgcc

SEQ ID NO: 224374 - DNA, 20 bp, human
gttgcctggcgacggtctcg

SEQ ID NO: 224375 - DNA, 20 bp, human
gaatgttctgagcagagcgc

SEQ ID NO: 224376 - DNA, 20 bp, human
ggtggtggggactggcatta

SEQ ID NO: 224377 - DNA, 20 bp, human
gccttcaggcccgagttgat

SEQ ID NO: 224378 - DNA, 20 bp, human
ggaagggcggtggattttta

SEQ ID NO: 224379 - DNA, 20 bp, human
ggactggcattaggggtggg

SEQ ID NO: 224380 - DNA, 20 bp, human
ggtcccctgcggccgaaggg

SEQ ID NO: 224381 - DNA, 20 bp, human
gtggggactggcattagggg

SEQ ID NO: 224382 - DNA, 20 bp, human
ggatgggcggggcaagacgc

SEQ ID NO: 224383 - DNA, 20 bp, human
gcccgaggtgcccatcaact

SEQ ID NO: 224384 - DNA, 20 bp, human
gtcggccgcaggggacttca

SEQ ID NO: 224385 - DNA, 20 bp, human
gccccgcccatcgccgtctg

SEQ ID NO: 224386 - DNA, 20 bp, human
gtggcaacaaacatcataag

SEQ ID NO: 224387 - DNA, 20 bp, human
ggggcgttgggaacggttgt

SEQ ID NO: 224388 - DNA, 20 bp, human
ggcaccgaactcatttgcat

SEQ ID NO: 224389 - DNA, 20 bp, human
gctcccaggggcgttgggaa

SEQ ID NO: 224390 - DNA, 20 bp, human
gtgggcgcttccggctgcgc

SEQ ID NO: 224391 - DNA, 20 bp, human
gaggctttctggctttttac

SEQ ID NO: 224392 - DNA, 20 bp, human
gaaccgttcccaacgcccct

SEQ ID NO: 224393 - DNA, 20 bp, human
ggacctggattcggcagtaa

SEQ ID NO: 224394 - DNA, 20 bp, human
ggggcttaacaacaacgaag

SEQ ID NO: 224395 - DNA, 20 bp, human
gcatcataagaggggctttc

SEQ ID NO: 224396 - DNA, 20 bp, human
gctaagagaaggcgggacag

SEQ ID NO: 224397 - DNA, 20 bp, human
gaagcggcgctaagagaagg

SEQ ID NO: 224398 - DNA, 20 bp, human
ggtcaagcggcgctaagaga

SEQ ID NO: 224399 - DNA, 20 bp, human
gggaaatgacgtgaggagtg

SEQ ID NO: 224400 - DNA, 20 bp, human
gtactcaattggttggttgt

SEQ ID NO: 224401 - DNA, 20 bp, human
gaattcttgggtattctcta

SEQ ID NO: 224402 - DNA, 20 bp, human
gcaagatggcggtagctgag

SEQ ID NO: 224403 - DNA, 20 bp, human
gtcttagcgccgcttgaccc

SEQ ID NO: 224404 - DNA, 20 bp, human
gatgacgtgaggagtgcgga

SEQ ID NO: 224405 - DNA, 20 bp, human
ggacgtggaagggacgaaag

SEQ ID NO: 224406 - DNA, 20 bp, human
gaggcacgggaccacgcgga

SEQ ID NO: 224407 - DNA, 20 bp, human
ggggacagcccgcgaagcct

SEQ ID NO: 224408 - DNA, 20 bp, human
gggaccgcgatgcattttaa

SEQ ID NO: 224409 - DNA, 20 bp, human
ggagggcagcaaagcggctc

SEQ ID NO: 224410 - DNA, 20 bp, human
gccgggcgccgaggcttcgc

SEQ ID NO: 224411 - DNA, 20 bp, human
gaggaaggacggaggagcgc

SEQ ID NO: 224412 - DNA, 20 bp, human
gcggcgcggggggaaggcaa

SEQ ID NO: 224413 - DNA, 20 bp, human
gaggggcggcgggccgacgt

SEQ ID NO: 224414 - DNA, 20 bp, human
gtttcctagaaggaattgag

SEQ ID NO: 224415 - DNA, 20 bp, human
gcacgcggagggcagcaaag

SEQ ID NO: 224416 - DNA, 20 bp, human
gaaccccgggggagtgacaa

SEQ ID NO: 224417 - DNA, 20 bp, human
gggagccagccgctgccacg

SEQ ID NO: 224418 - DNA, 20 bp, human
gcgcgcgctccctcgggtaa

SEQ ID NO: 224419 - DNA, 20 bp, human
gtggacgcgcgcgccatgcg

SEQ ID NO: 224420 - DNA, 20 bp, human
gacgccgaagggctccgagg

SEQ ID NO: 224421 - DNA, 20 bp, human
gtctcgcgaccgttacccga

SEQ ID NO: 224422 - DNA, 20 bp, human
ggagagacatccaaccccgg

SEQ ID NO: 224423 - DNA, 20 bp, human
gagagctcccacacgccgaa

SEQ ID NO: 224424 - DNA, 20 bp, human
gccggcgtctctccagtgat

SEQ ID NO: 224425 - DNA, 20 bp, human
ggcccccttgtcactccccc

SEQ ID NO: 224426 - DNA, 20 bp, human
gaagacgcggataagggcca

SEQ ID NO: 224427 - DNA, 20 bp, human
gttagagaagacgcggataa

SEQ ID NO: 224428 - DNA, 20 bp, human
gtgcgcgtgaccgcctccac

SEQ ID NO: 224429 - DNA, 20 bp, human
gggcgcgctcacgagtccgc

SEQ ID NO: 224430 - DNA, 20 bp, human
gcggaccgtcaaggtagaat

SEQ ID NO: 224431 - DNA, 20 bp, human
gctcacgagtccgccggtgg

SEQ ID NO: 224432 - DNA, 20 bp, human
gctgggccttagagaagacg

SEQ ID NO: 224433 - DNA, 20 bp, human
gccaggagcggtcccggcag

SEQ ID NO: 224434 - DNA, 20 bp, human
ggcgtgaccgcctccaccgg

SEQ ID NO: 224435 - DNA, 20 bp, human
gagcccgttccctcagaacc

SEQ ID NO: 224436 - DNA, 20 bp, human
ggggtctcataccccggcta

SEQ ID NO: 224437 - DNA, 20 bp, human
ggagtctggactagcggggt

SEQ ID NO: 224438 - DNA, 20 bp, human
gaggagaggggacgctacag

SEQ ID NO: 224439 - DNA, 20 bp, human
gtctggactagcggggtggg

SEQ ID NO: 224440 - DNA, 20 bp, human
ggctctggagtctggactag

SEQ ID NO: 224441 - DNA, 20 bp, human
gcagctggggtgggtctccc

SEQ ID NO: 224442 - DNA, 20 bp, human
gtaaatgacgtgtgtctcca

SEQ ID NO: 224443 - DNA, 20 bp, human
gctcgctgggtctcataccc

SEQ ID NO: 224444 - DNA, 20 bp, human
gcaggaagtggcgaagaaaa

SEQ ID NO: 224445 - DNA, 20 bp, human
gtcataccccggctagggga

SEQ ID NO: 224446 - DNA, 20 bp, human
gcaggcacgtgacgcagagg

SEQ ID NO: 224447 - DNA, 20 bp, human
gacgtgacgcagaggaggtg

SEQ ID NO: 224448 - DNA, 20 bp, human
ggcgcaggcacgtgacgcag

SEQ ID NO: 224449 - DNA, 20 bp, human
gacccggggccgcaccggac

SEQ ID NO: 224450 - DNA, 20 bp, human
gcctcctaaaaaagtggtaa

SEQ ID NO: 224451 - DNA, 20 bp, human
gaggccggacccaaaataca

SEQ ID NO: 224452 - DNA, 20 bp, human
ggctgagaaagtgtcggaat

SEQ ID NO: 224453 - DNA, 20 bp, human
gtgctgggcaacaggtctaa

SEQ ID NO: 224454 - DNA, 20 bp, human
gggtccctgtattttgggtc

SEQ ID NO: 224455 - DNA, 20 bp, human
gttcctgtccggtgcggccc

SEQ ID NO: 224456 - DNA, 20 bp, human
ggctggcagtacccagacag

SEQ ID NO: 224457 - DNA, 20 bp, human
gcggaagtgcagcacagaaa

SEQ ID NO: 224458 - DNA, 20 bp, human
gggggacggtagaagcctgg

SEQ ID NO: 224459 - DNA, 20 bp, human
gctggggcgccaacgagaag

SEQ ID NO: 224460 - DNA, 20 bp, human
gacagaaagggggtccgtgg

SEQ ID NO: 224461 - DNA, 20 bp, human
gggccagtacgcgtgggatt

SEQ ID NO: 224462 - DNA, 20 bp, human
gccatcgggcccaggtctct

SEQ ID NO: 224463 - DNA, 20 bp, human
gagaagggggtgagcgtgat

SEQ ID NO: 224464 - DNA, 20 bp, human
gaggccaagcggcggagctg

SEQ ID NO: 224465 - DNA, 20 bp, human
gagcacagaaagggggtccg

SEQ ID NO: 224466 - DNA, 20 bp, human
ggaagccagctcagaatcta

SEQ ID NO: 224467 - DNA, 20 bp, human
gagttcagtgaagcagttct

SEQ ID NO: 224468 - DNA, 20 bp, human
gactggaaatgtctctaagg

SEQ ID NO: 224469 - DNA, 20 bp, human
ggttgtgagatgcattcttt

SEQ ID NO: 224470 - DNA, 20 bp, human
gataactggaaatgtctcta

SEQ ID NO: 224471 - DNA, 20 bp, human
gatttgttgaatgcctcaag

SEQ ID NO: 224472 - DNA, 20 bp, human
gtctgagctggcttcccttt

SEQ ID NO: 224473 - DNA, 20 bp, human
gaactttttacttcctcttg

SEQ ID NO: 224474 - DNA, 20 bp, human
gatatgcattatctccacct

SEQ ID NO: 224475 - DNA, 20 bp, human
gggaaatgattagagcacca

SEQ ID NO: 224476 - DNA, 20 bp, human
gcaaggcgaggaggatgctg

SEQ ID NO: 224477 - DNA, 20 bp, human
gaggggcgggagtttaaagt

SEQ ID NO: 224478 - DNA, 20 bp, human
gcgaccgcgaagcgcgcagg

SEQ ID NO: 224479 - DNA, 20 bp, human
ggccccagcaacctcggcac

SEQ ID NO: 224480 - DNA, 20 bp, human
gtctccgcccccaggacccg

SEQ ID NO: 224481 - DNA, 20 bp, human
gtctcggccgcgggtcctgg

SEQ ID NO: 224482 - DNA, 20 bp, human
ggggcggagacccagacgaa

SEQ ID NO: 224483 - DNA, 20 bp, human
gccctcgtaataacgaccaa

SEQ ID NO: 224484 - DNA, 20 bp, human
gggccagtgccgaggttgct

SEQ ID NO: 224485 - DNA, 20 bp, human
gaggggccaggaaccgagtg

SEQ ID NO: 224486 - DNA, 20 bp, human
gtgaacggaaagttggtccg

SEQ ID NO: 224487 - DNA, 20 bp, human
gacgcgcgccctaagggcgg

SEQ ID NO: 224488 - DNA, 20 bp, human
gagggcgcgcgtcattgcca

SEQ ID NO: 224489 - DNA, 20 bp, human
ggcaatgacgcgcgccctaa

SEQ ID NO: 224490 - DNA, 20 bp, human
gcagcgacgcagagagacct

SEQ ID NO: 224491 - DNA, 20 bp, human
ggcagggcttgcgacggaag

SEQ ID NO: 224492 - DNA, 20 bp, human
gatgacgcgcgccctaaggg

SEQ ID NO: 224493 - DNA, 20 bp, human
gcgacgcagagagacctggg

SEQ ID NO: 224494 - DNA, 20 bp, human
gccaggacgcacagttacca

SEQ ID NO: 224495 - DNA, 20 bp, human
gcgtcgctgccaccgccctt

SEQ ID NO: 224496 - DNA, 20 bp, human
gaagtcaagcgaaaataagg

SEQ ID NO: 224497 - DNA, 20 bp, human
gctcggccttcgatgactaa

SEQ ID NO: 224498 - DNA, 20 bp, human
ggcgaagtcaagcgaaaata

SEQ ID NO: 224499 - DNA, 20 bp, human
gagaaagagtggagacctac

SEQ ID NO: 224500 - DNA, 20 bp, human
gggagcccatttctacagag

SEQ ID NO: 224501 - DNA, 20 bp, human
gcagatggttcttggagcac

SEQ ID NO: 224502 - DNA, 20 bp, human
ggctggcctttagtcatcga

SEQ ID NO: 224503 - DNA, 20 bp, human
gcatttctacagagtggctt

SEQ ID NO: 224504 - DNA, 20 bp, human
gacctacaggtcagatgaca

SEQ ID NO: 224505 - DNA, 20 bp, human
gacaggtcagatgacatggg

SEQ ID NO: 224506 - DNA, 20 bp, human
gaaaacatggacacattcac

SEQ ID NO: 224507 - DNA, 20 bp, human
gaaataaggataagagacca

SEQ ID NO: 224508 - DNA, 20 bp, human
gccaaaaatgtgatactcaa

SEQ ID NO: 224509 - DNA, 20 bp, human
gtttcaaaggtgggtcagaa

SEQ ID NO: 224510 - DNA, 20 bp, human
gttatatcttcacttcaaca

SEQ ID NO: 224511 - DNA, 20 bp, human
gtttttggtagatgctaccg

SEQ ID NO: 224512 - DNA, 20 bp, human
gaattgaacaaagaatccat

SEQ ID NO: 224513 - DNA, 20 bp, human
ggctctgtatatacatgttt

SEQ ID NO: 224514 - DNA, 20 bp, human
gtgttgcacactggtcatgc

SEQ ID NO: 224515 - DNA, 20 bp, human
gtaggttttacaggaaacac

SEQ ID NO: 224516 - DNA, 20 bp, human
gtcaggaagtgatgggagtg

SEQ ID NO: 224517 - DNA, 20 bp, human
gggctgtttcaggaagtgat

SEQ ID NO: 224518 - DNA, 20 bp, human
ggtggggaaggctgttgaac

SEQ ID NO: 224519 - DNA, 20 bp, human
gcagctgatgggtgagcaag

SEQ ID NO: 224520 - DNA, 20 bp, human
gcaggcccgtcccccagaga

SEQ ID NO: 224521 - DNA, 20 bp, human
gttctcgctctggctgtttc

SEQ ID NO: 224522 - DNA, 20 bp, human
gtgcccccaccatggggttc

SEQ ID NO: 224523 - DNA, 20 bp, human
gaactggtgatgtcacaatt

SEQ ID NO: 224524 - DNA, 20 bp, human
gccccggctgagtgtctcct

SEQ ID NO: 224525 - DNA, 20 bp, human
gccactgctccggaacccca

SEQ ID NO: 224526 - DNA, 20 bp, human
gtaattcaacccaaactggt

SEQ ID NO: 224527 - DNA, 20 bp, human
gactgtaacctgccctggaa

SEQ ID NO: 224528 - DNA, 20 bp, human
gcgagaacttcagctttctg

SEQ ID NO: 224529 - DNA, 20 bp, human
gggtggtgacctaccagttt

SEQ ID NO: 224530 - DNA, 20 bp, human
gtaaaaggcttacccttcca

SEQ ID NO: 224531 - DNA, 20 bp, human
gacaatcaatacaatattgc

SEQ ID NO: 224532 - DNA, 20 bp, human
gtgcagaattcaggtgtgtt

SEQ ID NO: 224533 - DNA, 20 bp, human
gtgaacaaccagatgaaagt

SEQ ID NO: 224534 - DNA, 20 bp, human
gtaatacaagctacatatgg

SEQ ID NO: 224535 - DNA, 20 bp, human
gagttctcgatgcagaattc

SEQ ID NO: 224536 - DNA, 20 bp, human
gggcagtgttagcacagacg

SEQ ID NO: 224537 - DNA, 20 bp, human
gacggggaaaaaaaacactg

SEQ ID NO: 224538 - DNA, 20 bp, human
gttaagactgacactatctg

SEQ ID NO: 224539 - DNA, 20 bp, human
ggtcacaagaagctcatgag

SEQ ID NO: 224540 - DNA, 20 bp, human
gtcagctttccagatgaaac

SEQ ID NO: 224541 - DNA, 20 bp, human
ggacactatctgaggcttag

SEQ ID NO: 224542 - DNA, 20 bp, human
ggcaattagcacttagaaag

SEQ ID NO: 224543 - DNA, 20 bp, human
gtcgtattcataacactagg

SEQ ID NO: 224544 - DNA, 20 bp, human
gtcatcaaggttacatgcgc

SEQ ID NO: 224545 - DNA, 20 bp, human
gtaaattcacgtgaagctct

SEQ ID NO: 224546 - DNA, 20 bp, human
gttcgcccgagcaggagatg

SEQ ID NO: 224547 - DNA, 20 bp, human
ggctgcctaagcctctcccc

SEQ ID NO: 224548 - DNA, 20 bp, human
ggagcggcgtacctggggag

SEQ ID NO: 224549 - DNA, 20 bp, human
gccgctgattggcagtaaag

SEQ ID NO: 224550 - DNA, 20 bp, human
gggcgtgagcggcgtacctg

SEQ ID NO: 224551 - DNA, 20 bp, human
gtccgctaggtccaacagga

SEQ ID NO: 224552 - DNA, 20 bp, human
gtttggagtcaacctcttag

SEQ ID NO: 224553 - DNA, 20 bp, human
gggagggcttacggcgtgag

SEQ ID NO: 224554 - DNA, 20 bp, human
gcgtcagtactctctctgat

SEQ ID NO: 224555 - DNA, 20 bp, human
gggagtcaacctcttagggg

SEQ ID NO: 224556 - DNA, 20 bp, human
gctcccaggaagtggccaaa

SEQ ID NO: 224557 - DNA, 20 bp, human
gttctgaaatactcagtgat

SEQ ID NO: 224558 - DNA, 20 bp, human
gctgaaacggcaaagttgaa

SEQ ID NO: 224559 - DNA, 20 bp, human
gagttgaagggaagtctcca

SEQ ID NO: 224560 - DNA, 20 bp, human
gggattctttgggtctgaaa

SEQ ID NO: 224561 - DNA, 20 bp, human
gtctctgttaataaccttcc

SEQ ID NO: 224562 - DNA, 20 bp, human
gaggaaagaaagcagcggag

SEQ ID NO: 224563 - DNA, 20 bp, human
gaagggggtgaatacattgc

SEQ ID NO: 224564 - DNA, 20 bp, human
gaaccaagtcaatgtttaac

SEQ ID NO: 224565 - DNA, 20 bp, human
gacccttttggccacttcct

SEQ ID NO: 224566 - DNA, 20 bp, human
gtccgattatggttatacca

SEQ ID NO: 224567 - DNA, 20 bp, human
gtaggggtatagttgcgcga

SEQ ID NO: 224568 - DNA, 20 bp, human
ggcagtgggcggggtcatct

SEQ ID NO: 224569 - DNA, 20 bp, human
gaaaaccgagcctgaaagca

SEQ ID NO: 224570 - DNA, 20 bp, human
gatggttataccagggtcga

SEQ ID NO: 224571 - DNA, 20 bp, human
gggcctgaggggggcgagtt

SEQ ID NO: 224572 - DNA, 20 bp, human
gtgggctgggtcggagttag

SEQ ID NO: 224573 - DNA, 20 bp, human
gcgagaaaaggggcgctgca

SEQ ID NO: 224574 - DNA, 20 bp, human
gagcgcgagcccaaatggga

SEQ ID NO: 224575 - DNA, 20 bp, human
ggaacccggggagttctgag

SEQ ID NO: 224576 - DNA, 20 bp, human
gcgcaatcgcctcccttcgt

SEQ ID NO: 224577 - DNA, 20 bp, human
gtgtgggcagcgctctcttg

SEQ ID NO: 224578 - DNA, 20 bp, human
gcggggagtggtcacgtgga

SEQ ID NO: 224579 - DNA, 20 bp, human
gggcggggcgccaacagctc

SEQ ID NO: 224580 - DNA, 20 bp, human
gctcccttcgtgggcgggat

SEQ ID NO: 224581 - DNA, 20 bp, human
gaatcgcctcccttcgtggg

SEQ ID NO: 224582 - DNA, 20 bp, human
ggcgccaacagctcaggact

SEQ ID NO: 224583 - DNA, 20 bp, human
gcgagcctgaggaccaagat

SEQ ID NO: 224584 - DNA, 20 bp, human
gcactccgatcttggtcctc

SEQ ID NO: 224585 - DNA, 20 bp, human
gcagttgaacccaacccacc

SEQ ID NO: 224586 - DNA, 20 bp, human
gtccggcgcaggcgggagaa

SEQ ID NO: 224587 - DNA, 20 bp, human
gcggccgtgaggggcgtagc

SEQ ID NO: 224588 - DNA, 20 bp, human
gccggcggaggcgggaaaag

SEQ ID NO: 224589 - DNA, 20 bp, human
gccggggccgagccgctgtt

SEQ ID NO: 224590 - DNA, 20 bp, human
gccgtgaggggcgtagccgg

SEQ ID NO: 224591 - DNA, 20 bp, human
gctggagcccgtggtatcgt

SEQ ID NO: 224592 - DNA, 20 bp, human
gtcaactgtcagccgaacag

SEQ ID NO: 224593 - DNA, 20 bp, human
ggaaaaaaagcgaaggaagg

SEQ ID NO: 224594 - DNA, 20 bp, human
gcgggaaaagcggccgtgag

SEQ ID NO: 224595 - DNA, 20 bp, human
ggtgccaggaaccaatgaca

SEQ ID NO: 224596 - DNA, 20 bp, human
gaactcttgcagggagaact

SEQ ID NO: 224597 - DNA, 20 bp, human
gggagaccacgctgctgcat

SEQ ID NO: 224598 - DNA, 20 bp, human
gctctccccggctcaacaga

SEQ ID NO: 224599 - DNA, 20 bp, human
gctgctacagtcagcgcttg

SEQ ID NO: 224600 - DNA, 20 bp, human
gagagcaggttaactcttgc

SEQ ID NO: 224601 - DNA, 20 bp, human
gggctcgggtctacaagctg

SEQ ID NO: 224602 - DNA, 20 bp, human
gttacccctctgttgagccg

SEQ ID NO: 224603 - DNA, 20 bp, human
gcaccagatcggctgcacat

SEQ ID NO: 224604 - DNA, 20 bp, human
ggcaaggtggatactgcctg

SEQ ID NO: 224605 - DNA, 20 bp, human
gcccacagcctgagctcacg

SEQ ID NO: 224606 - DNA, 20 bp, human
gttaaagggtcattctacta

SEQ ID NO: 224607 - DNA, 20 bp, human
gttctgggaagttgtgaatt

SEQ ID NO: 224608 - DNA, 20 bp, human
gctcattaagatagtaaaag

SEQ ID NO: 224609 - DNA, 20 bp, human
gtgtttttcaagcttagaat

SEQ ID NO: 224610 - DNA, 20 bp, human
gcagtagaaggctagtgtcc

SEQ ID NO: 224611 - DNA, 20 bp, human
gtgaaaaattatatatttaa

SEQ ID NO: 224612 - DNA, 20 bp, human
gaaaatctctcttcttgcac

SEQ ID NO: 224613 - DNA, 20 bp, human
gttaagatagtaaaaggggc

SEQ ID NO: 224614 - DNA, 20 bp, human
gcattttcttctagaacatc

SEQ ID NO: 224615 - DNA, 20 bp, human
gaaaaaaaaaagacagtaga

SEQ ID NO: 224616 - DNA, 20 bp, human
gggcaaatgcccaccaatcg

SEQ ID NO: 224617 - DNA, 20 bp, human
gtgcccaccaatcgcggctc

SEQ ID NO: 224618 - DNA, 20 bp, human
gcaccaatcgcggctccggc

SEQ ID NO: 224619 - DNA, 20 bp, human
gccccagccggagccgcgat

SEQ ID NO: 224620 - DNA, 20 bp, human
ggccaatcgtggcttaaaag

SEQ ID NO: 224621 - DNA, 20 bp, human
gaaggaaagtggcttcccgg

SEQ ID NO: 224622 - DNA, 20 bp, human
gaatcgtggcttaaaagcgg

SEQ ID NO: 224623 - DNA, 20 bp, human
gagtcgctccgaaatgacgg

SEQ ID NO: 224624 - DNA, 20 bp, human
ggagcgggaggcgcaggcac

SEQ ID NO: 224625 - DNA, 20 bp, human
gtttaagccacgattggcga

SEQ ID NO: 224626 - DNA, 20 bp, human
gactgccagaaccacccaga

SEQ ID NO: 224627 - DNA, 20 bp, human
gggtggggatcctttcaaca

SEQ ID NO: 224628 - DNA, 20 bp, human
gccagtagacatatgagaac

SEQ ID NO: 224629 - DNA, 20 bp, human
gaggcttcccgccctctggg

SEQ ID NO: 224630 - DNA, 20 bp, human
ggggttgggtcctgactcag

SEQ ID NO: 224631 - DNA, 20 bp, human
gagcaggcttcccgccctct

SEQ ID NO: 224632 - DNA, 20 bp, human
gcaacccaagccccttaatt

SEQ ID NO: 224633 - DNA, 20 bp, human
gtcacctaattaaggggctt

SEQ ID NO: 224634 - DNA, 20 bp, human
gcacaaagtcacaggcgggt

SEQ ID NO: 224635 - DNA, 20 bp, human
gtgtggggggttcctctcag

SEQ ID NO: 224636 - DNA, 20 bp, human
ggggccgaatagaagaatga

SEQ ID NO: 224637 - DNA, 20 bp, human
gcgggcggggaagactggtg

SEQ ID NO: 224638 - DNA, 20 bp, human
gggcgtggccaaccccgagg

SEQ ID NO: 224639 - DNA, 20 bp, human
gtaatgaaagagagcgggag

SEQ ID NO: 224640 - DNA, 20 bp, human
gccggccgggcggggaagac

SEQ ID NO: 224641 - DNA, 20 bp, human
ggcggtgcactctgggaagg

SEQ ID NO: 224642 - DNA, 20 bp, human
ggctgcggtgcactctggga

SEQ ID NO: 224643 - DNA, 20 bp, human
gaacccttgccaaacaaaca

SEQ ID NO: 224644 - DNA, 20 bp, human
gcgcctcaacggccctgcac

SEQ ID NO: 224645 - DNA, 20 bp, human
gctggcctggagcccatcca

SEQ ID NO: 224646 - DNA, 20 bp, human
ggcacagaggactatataac

SEQ ID NO: 224647 - DNA, 20 bp, human
gtgtgaggtcatcaccaccc

SEQ ID NO: 224648 - DNA, 20 bp, human
ggcaggaggaaagaaggctc

SEQ ID NO: 224649 - DNA, 20 bp, human
gagaaagcaaccatggcagg

SEQ ID NO: 224650 - DNA, 20 bp, human
ggagagaaagcaaccatggc

SEQ ID NO: 224651 - DNA, 20 bp, human
gtatataactggtgaaaaga

SEQ ID NO: 224652 - DNA, 20 bp, human
gaataacagaaagttaggga

SEQ ID NO: 224653 - DNA, 20 bp, human
gactaagaattacacaacac

SEQ ID NO: 224654 - DNA, 20 bp, human
ggtttttgtttgtctcactt

SEQ ID NO: 224655 - DNA, 20 bp, human
gaaataataacagaaagtta

SEQ ID NO: 224656 - DNA, 20 bp, human
ggcggagagcactttacaga

SEQ ID NO: 224657 - DNA, 20 bp, human
gcagacggcggtcactactg

SEQ ID NO: 224658 - DNA, 20 bp, human
gagcaaggctgggaactagt

SEQ ID NO: 224659 - DNA, 20 bp, human
gggcgcatatcagcagacgg

SEQ ID NO: 224660 - DNA, 20 bp, human
gactgaggtggttctatcta

SEQ ID NO: 224661 - DNA, 20 bp, human
gtgggcggagtgaagcgcgc

SEQ ID NO: 224662 - DNA, 20 bp, human
gaaaggagagagaccaccac

SEQ ID NO: 224663 - DNA, 20 bp, human
gcacttaaaatggggcagca

SEQ ID NO: 224664 - DNA, 20 bp, human
gcatgcgtgaggagaatgaa

SEQ ID NO: 224665 - DNA, 20 bp, human
gcactgggtgtcccgaaaca

SEQ ID NO: 224666 - DNA, 20 bp, human
ggggccagcggcctgtcctc

SEQ ID NO: 224667 - DNA, 20 bp, human
gacccagcatggggcctccg

SEQ ID NO: 224668 - DNA, 20 bp, human
gatggtctgttgtccaccgg

SEQ ID NO: 224669 - DNA, 20 bp, human
gctctggaattgacctggga

SEQ ID NO: 224670 - DNA, 20 bp, human
ggggagaggtaattatagcc

SEQ ID NO: 224671 - DNA, 20 bp, human
gttggaattcggggcagagt

SEQ ID NO: 224672 - DNA, 20 bp, human
gcctgccagggcaatatcga

SEQ ID NO: 224673 - DNA, 20 bp, human
gtataattacctctcccctt

SEQ ID NO: 224674 - DNA, 20 bp, human
gcacagctctggaattgacc

SEQ ID NO: 224675 - DNA, 20 bp, human
gtgggtcagggtcttattgg

SEQ ID NO: 224676 - DNA, 20 bp, human
ggggcggtcagcccagccag

SEQ ID NO: 224677 - DNA, 20 bp, human
gcgagaacgcatgttgtctg

SEQ ID NO: 224678 - DNA, 20 bp, human
gcgagccctaactgcacctc

SEQ ID NO: 224679 - DNA, 20 bp, human
ggcacctgagcaagcccagt

SEQ ID NO: 224680 - DNA, 20 bp, human
gcctgagcaagcccagtggg

SEQ ID NO: 224681 - DNA, 20 bp, human
gctcaccactggaaccacgc

SEQ ID NO: 224682 - DNA, 20 bp, human
ggggctcctgggaaaagcct

SEQ ID NO: 224683 - DNA, 20 bp, human
gtggttccagtggtgagcgt

SEQ ID NO: 224684 - DNA, 20 bp, human
ggtaagagggagaacttgtg

SEQ ID NO: 224685 - DNA, 20 bp, human
gcgttctcgacttaagtaag

SEQ ID NO: 224686 - DNA, 20 bp, human
ggaggcaaagctctggtaaa

SEQ ID NO: 224687 - DNA, 20 bp, human
gggaaccaaaggatctgcaa

SEQ ID NO: 224688 - DNA, 20 bp, human
ggactatgtgaattgaatcg

SEQ ID NO: 224689 - DNA, 20 bp, human
gtcagggcagaacactgtac

SEQ ID NO: 224690 - DNA, 20 bp, human
gtcttctccgagtttcttga

SEQ ID NO: 224691 - DNA, 20 bp, human
gacgggtagaggggaaccaa

SEQ ID NO: 224692 - DNA, 20 bp, human
gttaaagtcagggttgctct

SEQ ID NO: 224693 - DNA, 20 bp, human
gtttcctggaacgggtagag

SEQ ID NO: 224694 - DNA, 20 bp, human
gcatcagccctcaagaaact

SEQ ID NO: 224695 - DNA, 20 bp, human
ggcaatggtacctagacatc

SEQ ID NO: 224696 - DNA, 20 bp, human
gtggccatgcagaccccctc

SEQ ID NO: 224697 - DNA, 20 bp, human
gtgacctgagggggtctgca

SEQ ID NO: 224698 - DNA, 20 bp, human
gcttcaaccaggagagggac

SEQ ID NO: 224699 - DNA, 20 bp, human
gggtcaccctgtccctctcc

SEQ ID NO: 224700 - DNA, 20 bp, human
gtggctgtgagttctgaggc

SEQ ID NO: 224701 - DNA, 20 bp, human
gctgagataaatcttcaacc

SEQ ID NO: 224702 - DNA, 20 bp, human
gtaaatcttcaaccaggaga

SEQ ID NO: 224703 - DNA, 20 bp, human
gaaaaacaaactcagactga

SEQ ID NO: 224704 - DNA, 20 bp, human
gtcacttggtggggattttc

SEQ ID NO: 224705 - DNA, 20 bp, human
gttttttcacctgtgagaca

SEQ ID NO: 224706 - DNA, 20 bp, human
gcggggagagggtgcgttag

SEQ ID NO: 224707 - DNA, 20 bp, human
gtgcccgcgtgtgtcactgt

SEQ ID NO: 224708 - DNA, 20 bp, human
gctggtgtcgcaggcaagaa

SEQ ID NO: 224709 - DNA, 20 bp, human
gcagtcgtgggaagatgtgg

SEQ ID NO: 224710 - DNA, 20 bp, human
gtcgcaggcaagaaggggcg

SEQ ID NO: 224711 - DNA, 20 bp, human
gcatcagtcgtgggaagatg

SEQ ID NO: 224712 - DNA, 20 bp, human
gggccagagtgcctccccag

SEQ ID NO: 224713 - DNA, 20 bp, human
gggcgcgcgcaggggatgcc

SEQ ID NO: 224714 - DNA, 20 bp, human
gcagcccacagtgacacacg

SEQ ID NO: 224715 - DNA, 20 bp, human
gcgccgggggcgctgtggtg

SEQ ID NO: 224716 - DNA, 20 bp, human
ggggcgggacctcgcagaga

SEQ ID NO: 224717 - DNA, 20 bp, human
gctgtcaggcggctgaaaac

SEQ ID NO: 224718 - DNA, 20 bp, human
gtgggaaccaggatcaggtg

SEQ ID NO: 224719 - DNA, 20 bp, human
ggagaggggcggggttccac

SEQ ID NO: 224720 - DNA, 20 bp, human
gcagcctaatgtgcgtgtgt

SEQ ID NO: 224721 - DNA, 20 bp, human
gtccactggtagaaggtggg

SEQ ID NO: 224722 - DNA, 20 bp, human
gcaggcggctgaaaacgggg

SEQ ID NO: 224723 - DNA, 20 bp, human
ggggacctcgcagagagggg

SEQ ID NO: 224724 - DNA, 20 bp, human
gcacggaggcggagctttat

SEQ ID NO: 224725 - DNA, 20 bp, human
ggcatccagattcgcccaat

SEQ ID NO: 224726 - DNA, 20 bp, human
gggggcgtgggcgacggcgt

SEQ ID NO: 224727 - DNA, 20 bp, human
gagagcggaggcggggaagt

SEQ ID NO: 224728 - DNA, 20 bp, human
ggctacggccggggattggg

SEQ ID NO: 224729 - DNA, 20 bp, human
gagtgggcgcaggggggcgt

SEQ ID NO: 224730 - DNA, 20 bp, human
gcggagcacgggatctccga

SEQ ID NO: 224731 - DNA, 20 bp, human
gtgagtaggtgtgcccgccc

SEQ ID NO: 224732 - DNA, 20 bp, human
gagtgccagcagagccaggg

SEQ ID NO: 224733 - DNA, 20 bp, human
gcggggattgggcggtgagt

SEQ ID NO: 224734 - DNA, 20 bp, human
ggcgactccctccgctgtct

SEQ ID NO: 224735 - DNA, 20 bp, human
gaaggccgcggctacggccg

SEQ ID NO: 224736 - DNA, 20 bp, human
ggcaaccgctccttcttcgc

SEQ ID NO: 224737 - DNA, 20 bp, human
gtccacccgcgaagaaggag

SEQ ID NO: 224738 - DNA, 20 bp, human
ggctctggacgagacctgcg

SEQ ID NO: 224739 - DNA, 20 bp, human
ggagcagcgagatcgcgctc

SEQ ID NO: 224740 - DNA, 20 bp, human
ggctcccgcggcgtgctccg

SEQ ID NO: 224741 - DNA, 20 bp, human
gaccgctccttcttcgcggg

SEQ ID NO: 224742 - DNA, 20 bp, human
gcccgtaaaaccacagaagt

SEQ ID NO: 224743 - DNA, 20 bp, human
gaccccgcggagcacgccgc

SEQ ID NO: 224744 - DNA, 20 bp, human
gaaacaggagagtctctgac

SEQ ID NO: 224745 - DNA, 20 bp, human
gtgctcttcagcgcgatctg

SEQ ID NO: 224746 - DNA, 20 bp, human
gctccgctgcgggtgggatc

SEQ ID NO: 224747 - DNA, 20 bp, human
gcgtgctgacgccacggcga

SEQ ID NO: 224748 - DNA, 20 bp, human
gagcccgatcccacccgcag

SEQ ID NO: 224749 - DNA, 20 bp, human
ggcccagggctcggccagtg

SEQ ID NO: 224750 - DNA, 20 bp, human
gcggggcgggtcctgaacgg

SEQ ID NO: 224751 - DNA, 20 bp, human
gtgggatcgggcttccacac

SEQ ID NO: 224752 - DNA, 20 bp, human
gggcgggtcctgaacggcgg

SEQ ID NO: 224753 - DNA, 20 bp, human
ggtggcgtcagcacgcatcc

SEQ ID NO: 224754 - DNA, 20 bp, human
gacgccacggcgacggacgc

SEQ ID NO: 224755 - DNA, 20 bp, human
gtccacactggccgagccct

SEQ ID NO: 224756 - DNA, 20 bp, human
gtccaggggaaccgttcatt

SEQ ID NO: 224757 - DNA, 20 bp, human
gaccctgccgacgcagtgat

SEQ ID NO: 224758 - DNA, 20 bp, human
gggagcgcgcagactccgga

SEQ ID NO: 224759 - DNA, 20 bp, human
gctgccaggagcccggaagt

SEQ ID NO: 224760 - DNA, 20 bp, human
gtctcgggagcgcggtgatt

SEQ ID NO: 224761 - DNA, 20 bp, human
ggggaaccgttcattgggct

SEQ ID NO: 224762 - DNA, 20 bp, human
ggtgattgggtacaggtctc

SEQ ID NO: 224763 - DNA, 20 bp, human
gcgggccgggtttagtgcgg

SEQ ID NO: 224764 - DNA, 20 bp, human
gattgggcgcaggtcccagc

SEQ ID NO: 224765 - DNA, 20 bp, human
gggcgtgaggcgctgatggg

SEQ ID NO: 224766 - DNA, 20 bp, human
gccccccgcccccaactccg

SEQ ID NO: 224767 - DNA, 20 bp, human
gccaaggtccaggcgaggtt

SEQ ID NO: 224768 - DNA, 20 bp, human
gggcgccaaccccggagttg

SEQ ID NO: 224769 - DNA, 20 bp, human
gaaggggtctgccaaggtcc

SEQ ID NO: 224770 - DNA, 20 bp, human
gcaatccgggagggcgtccg

SEQ ID NO: 224771 - DNA, 20 bp, human
gctcccggattggccgtccg

SEQ ID NO: 224772 - DNA, 20 bp, human
gccgggagggcgtccgggga

SEQ ID NO: 224773 - DNA, 20 bp, human
ggtgggaaaggggtctgcca

SEQ ID NO: 224774 - DNA, 20 bp, human
ggcgcggcgcgtgtgcttgc

SEQ ID NO: 224775 - DNA, 20 bp, human
ggcgcccgaggcgccaaccc

SEQ ID NO: 224776 - DNA, 20 bp, human
gagccagaaggcaaacgggg

SEQ ID NO: 224777 - DNA, 20 bp, human
gcaaaaagtcaggtagggga

SEQ ID NO: 224778 - DNA, 20 bp, human
gagggagggacaagactgtg

SEQ ID NO: 224779 - DNA, 20 bp, human
gcactcaaaaagtcaggtag

SEQ ID NO: 224780 - DNA, 20 bp, human
gagactgtgaggctttttca

SEQ ID NO: 224781 - DNA, 20 bp, human
ggcagggtcacggacactat

SEQ ID NO: 224782 - DNA, 20 bp, human
ggggaggggcctcctcaggg

SEQ ID NO: 224783 - DNA, 20 bp, human
gggcggttagacgatggctg

SEQ ID NO: 224784 - DNA, 20 bp, human
ggtgattggcggttagacga

SEQ ID NO: 224785 - DNA, 20 bp, human
ggccagcagtaactaaaagt

SEQ ID NO: 224786 - DNA, 20 bp, human
gtcgccctggggcgggagat

SEQ ID NO: 224787 - DNA, 20 bp, human
ggcgcaccctcgccctgggg

SEQ ID NO: 224788 - DNA, 20 bp, human
ggggcgggagatggggcgtc

SEQ ID NO: 224789 - DNA, 20 bp, human
gacagcgcgcaccctcgccc

SEQ ID NO: 224790 - DNA, 20 bp, human
gaatctaagaggtggaagtg

SEQ ID NO: 224791 - DNA, 20 bp, human
gggtgcgcgctgtcgcttat

SEQ ID NO: 224792 - DNA, 20 bp, human
gtcaaggtctgggaccctgc

SEQ ID NO: 224793 - DNA, 20 bp, human
gctgggtcagcggctgtctg

SEQ ID NO: 224794 - DNA, 20 bp, human
gtaactgcagggtgggcgag

SEQ ID NO: 224795 - DNA, 20 bp, human
ggcctggggccgggtcgtca

SEQ ID NO: 224796 - DNA, 20 bp, human
gcctccgcccaccgcgctcg

SEQ ID NO: 224797 - DNA, 20 bp, human
ggtctaggaaaccgcggcgt

SEQ ID NO: 224798 - DNA, 20 bp, human
gaggctgcggaacggcggcg

SEQ ID NO: 224799 - DNA, 20 bp, human
gaacggcggcgcggctgtct

SEQ ID NO: 224800 - DNA, 20 bp, human
ggcgcgcccccgagcgcggt

SEQ ID NO: 224801 - DNA, 20 bp, human
gcgagcgtgtggagaggcga

SEQ ID NO: 224802 - DNA, 20 bp, human
gcggggctgccacgcagagc

SEQ ID NO: 224803 - DNA, 20 bp, human
ggcggctgtctaggaaaccg

SEQ ID NO: 224804 - DNA, 20 bp, human
gccgcggcgtcggctggcag

SEQ ID NO: 224805 - DNA, 20 bp, human
gtcgcgcgcgcccccgagcg

SEQ ID NO: 224806 - DNA, 20 bp, human
gtacccaggaggctctttcc

SEQ ID NO: 224807 - DNA, 20 bp, human
gtgagctcataaaggtcttt

SEQ ID NO: 224808 - DNA, 20 bp, human
gcataaaggtctttggggtg

SEQ ID NO: 224809 - DNA, 20 bp, human
ggagccttgccttacccagg

SEQ ID NO: 224810 - DNA, 20 bp, human
gcatgagccttgccttaccc

SEQ ID NO: 224811 - DNA, 20 bp, human
gatgccctggaaggtggaag

SEQ ID NO: 224812 - DNA, 20 bp, human
ggctcatgaaattctctgag

SEQ ID NO: 224813 - DNA, 20 bp, human
gagggcataggtgacccctg

SEQ ID NO: 224814 - DNA, 20 bp, human
ggagtgggtcaaatggggac

SEQ ID NO: 224815 - DNA, 20 bp, human
gtgcaatgtgaccatatccc

SEQ ID NO: 224816 - DNA, 20 bp, human
ggccgcgcgcggcaggagtt

SEQ ID NO: 224817 - DNA, 20 bp, human
gggggcagggatcttcctct

SEQ ID NO: 224818 - DNA, 20 bp, human
ggcggcctggcgtgcaggaa

SEQ ID NO: 224819 - DNA, 20 bp, human
gggatcttcctctaggaatg

SEQ ID NO: 224820 - DNA, 20 bp, human
gcaggagttgggcttccggg

SEQ ID NO: 224821 - DNA, 20 bp, human
gttagcacagtggggcagaa

SEQ ID NO: 224822 - DNA, 20 bp, human
gctccctcgtcacagatccc

SEQ ID NO: 224823 - DNA, 20 bp, human
gaacagccactggggaggat

SEQ ID NO: 224824 - DNA, 20 bp, human
ggccctcaggcgttcctcgg

SEQ ID NO: 224825 - DNA, 20 bp, human
gccagaaacccatccttccc

SEQ ID NO: 224826 - DNA, 20 bp, human
gtgggcgagggacatagatc

SEQ ID NO: 224827 - DNA, 20 bp, human
gctgactggccaaccaacgc

SEQ ID NO: 224828 - DNA, 20 bp, human
gagggcaggtgcggatgccg

SEQ ID NO: 224829 - DNA, 20 bp, human
gtgtccctcgcccagaccga

SEQ ID NO: 224830 - DNA, 20 bp, human
gccgaggtgaccactctcct

SEQ ID NO: 224831 - DNA, 20 bp, human
ggccggacccttgggtgcta

SEQ ID NO: 224832 - DNA, 20 bp, human
gtctgcgagcgctaagggga

SEQ ID NO: 224833 - DNA, 20 bp, human
ggccctagcacccaagggtc

SEQ ID NO: 224834 - DNA, 20 bp, human
gcacgagccctagcacccaa

SEQ ID NO: 224835 - DNA, 20 bp, human
ggccctccaaggcgtcagag

SEQ ID NO: 224836 - DNA, 20 bp, human
ggccgcgcgcggcaggagtt

SEQ ID NO: 224837 - DNA, 20 bp, human
ggcggcctggcgtgcaggaa

SEQ ID NO: 224838 - DNA, 20 bp, human
gggggcagggatcttcctct

SEQ ID NO: 224839 - DNA, 20 bp, human
gcaggagttgggcttccggg

SEQ ID NO: 224840 - DNA, 20 bp, human
gattcccagccggcggatcc

SEQ ID NO: 224841 - DNA, 20 bp, human
ggccctcaggcgttcctcgg

SEQ ID NO: 224842 - DNA, 20 bp, human
gttagcacagtggggcagaa

SEQ ID NO: 224843 - DNA, 20 bp, human
gggatcttcctctaggaatg

SEQ ID NO: 224844 - DNA, 20 bp, human
gctccctcgtcacagatccc

SEQ ID NO: 224845 - DNA, 20 bp, human
gtccgccggctgggaatcgc

SEQ ID NO: 224846 - DNA, 20 bp, human
gggtgcggagggcccgcgtg

SEQ ID NO: 224847 - DNA, 20 bp, human
gcccgccgggcactggttcg

SEQ ID NO: 224848 - DNA, 20 bp, human
gtgacgggcccgccgggcac

SEQ ID NO: 224849 - DNA, 20 bp, human
gcgcgtggggccagctcgct

SEQ ID NO: 224850 - DNA, 20 bp, human
gggggccagctcgctaggag

SEQ ID NO: 224851 - DNA, 20 bp, human
ggcgcgaacggcagctagga

SEQ ID NO: 224852 - DNA, 20 bp, human
ggatctaagggagcgactga

SEQ ID NO: 224853 - DNA, 20 bp, human
gtgggagcctgcgctcctgt

SEQ ID NO: 224854 - DNA, 20 bp, human
ggcggggcgactcgcagggt

SEQ ID NO: 224855 - DNA, 20 bp, human
ggggcgccgtctgcggtccc

SEQ ID NO: 224856 - DNA, 20 bp, human
ggagactcgcgcatgttctg

SEQ ID NO: 224857 - DNA, 20 bp, human
gccgcccggcgcatccgctc

SEQ ID NO: 224858 - DNA, 20 bp, human
gctccgcagctccacttcct

SEQ ID NO: 224859 - DNA, 20 bp, human
ggccagagggcgacacctta

SEQ ID NO: 224860 - DNA, 20 bp, human
gccggcgggagcgagtctcg

SEQ ID NO: 224861 - DNA, 20 bp, human
gggtgggccaagacacggtg

SEQ ID NO: 224862 - DNA, 20 bp, human
ggcgcggcaaggagtgcaca

SEQ ID NO: 224863 - DNA, 20 bp, human
gcaagcgcagagggctcttc

SEQ ID NO: 224864 - DNA, 20 bp, human
gggcgacaccttaaggccgg

SEQ ID NO: 224865 - DNA, 20 bp, human
gtgtcgccctctggccagag

SEQ ID NO: 224866 - DNA, 20 bp, human
ggtacagccagtccccgccg

SEQ ID NO: 224867 - DNA, 20 bp, human
gtggcgcggcgcctttccaa

SEQ ID NO: 224868 - DNA, 20 bp, human
gcgccctggcttctagtaat

SEQ ID NO: 224869 - DNA, 20 bp, human
gtagccgccatgtcagttaa

SEQ ID NO: 224870 - DNA, 20 bp, human
gctctggcaggggctttcgg

SEQ ID NO: 224871 - DNA, 20 bp, human
gcaaaccaaccaggaagtag

SEQ ID NO: 224872 - DNA, 20 bp, human
ggcggccgctacttcctggt

SEQ ID NO: 224873 - DNA, 20 bp, human
gaggatcaaagggtcaacaa

SEQ ID NO: 224874 - DNA, 20 bp, human
gtctgtgcgtcaggccgccc

SEQ ID NO: 224875 - DNA, 20 bp, human
gttgcccttaactgacatgg

SEQ ID NO: 224876 - DNA, 20 bp, human
gccctcctcttatcagggga

SEQ ID NO: 224877 - DNA, 20 bp, human
ggcctgaggccctcagataa

SEQ ID NO: 224878 - DNA, 20 bp, human
gagtgactgtcccttatctg

SEQ ID NO: 224879 - DNA, 20 bp, human
gactgagctgactggttctc

SEQ ID NO: 224880 - DNA, 20 bp, human
gtggttctcgggatcactta

SEQ ID NO: 224881 - DNA, 20 bp, human
gtcagccttcccctgataag

SEQ ID NO: 224882 - DNA, 20 bp, human
gtcgccgccctcctcttatc

SEQ ID NO: 224883 - DNA, 20 bp, human
gcaagaggaatggccgggaa

SEQ ID NO: 224884 - DNA, 20 bp, human
gcggcgactcgagttggtga

SEQ ID NO: 224885 - DNA, 20 bp, human
gggagggcggcgactcgagt

SEQ ID NO: 224886 - DNA, 20 bp, human
gcgaccggggtcggcaggta

SEQ ID NO: 224887 - DNA, 20 bp, human
ggacgtgaagcgcccgaacg

SEQ ID NO: 224888 - DNA, 20 bp, human
gagaccgcggcgagcggcag

SEQ ID NO: 224889 - DNA, 20 bp, human
ggggcggtgcgcacggacga

SEQ ID NO: 224890 - DNA, 20 bp, human
ggtaacgcccggaaccgaac

SEQ ID NO: 224891 - DNA, 20 bp, human
gggccaagagcgaccggggt

SEQ ID NO: 224892 - DNA, 20 bp, human
gcgggagtcgcgtgcccaac

SEQ ID NO: 224893 - DNA, 20 bp, human
gaagagcgaccggggtcggc

SEQ ID NO: 224894 - DNA, 20 bp, human
gcggcaggtaaggaagaccg

SEQ ID NO: 224895 - DNA, 20 bp, human
gccaacggggaaagcgagtc

SEQ ID NO: 224896 - DNA, 20 bp, human
gggtcctcgccctctgagag

SEQ ID NO: 224897 - DNA, 20 bp, human
ggcagccaggcctcctgtgt

SEQ ID NO: 224898 - DNA, 20 bp, human
gtgtctggggacgctggggt

SEQ ID NO: 224899 - DNA, 20 bp, human
gggtggcggcccgacgttcc

SEQ ID NO: 224900 - DNA, 20 bp, human
ggctcccagccaggaacgtc

SEQ ID NO: 224901 - DNA, 20 bp, human
gcgtccccagacagactggt

SEQ ID NO: 224902 - DNA, 20 bp, human
gccagcgtccccagacagac

SEQ ID NO: 224903 - DNA, 20 bp, human
gtgggtcaagcctacacagg

SEQ ID NO: 224904 - DNA, 20 bp, human
gaagtccctaccagtctgtc

SEQ ID NO: 224905 - DNA, 20 bp, human
ggcctgcctgcagacaagat

SEQ ID NO: 224906 - DNA, 20 bp, human
gcagagatgacgggccactg

SEQ ID NO: 224907 - DNA, 20 bp, human
gcgggccactgtggcatctt

SEQ ID NO: 224908 - DNA, 20 bp, human
gaatggcatgaggttatcca

SEQ ID NO: 224909 - DNA, 20 bp, human
gcccctggggcttgaggttt

SEQ ID NO: 224910 - DNA, 20 bp, human
ggcggcccaagatgccacag

SEQ ID NO: 224911 - DNA, 20 bp, human
gggggcttgaggtttaggag

SEQ ID NO: 224912 - DNA, 20 bp, human
gagaagagctgactcccaca

SEQ ID NO: 224913 - DNA, 20 bp, human
gccaggggctaaaaccctgc

SEQ ID NO: 224914 - DNA, 20 bp, human
gacccagagcactcaaacaa

SEQ ID NO: 224915 - DNA, 20 bp, human
gtggaggcccagaccatgtc

SEQ ID NO: 224916 - DNA, 20 bp, human
gtgctgactcaccatccttg

SEQ ID NO: 224917 - DNA, 20 bp, human
gccaccaggagctctgctga

SEQ ID NO: 224918 - DNA, 20 bp, human
gagccaggccagggacgtcc

SEQ ID NO: 224919 - DNA, 20 bp, human
ggggttctcaaccacaagga

SEQ ID NO: 224920 - DNA, 20 bp, human
gaccacagcacaggctgatc

SEQ ID NO: 224921 - DNA, 20 bp, human
gagctgcaaaatataggccg

SEQ ID NO: 224922 - DNA, 20 bp, human
ggggctgaagacttcctccc

SEQ ID NO: 224923 - DNA, 20 bp, human
gccctggagctgcaaaatat

SEQ ID NO: 224924 - DNA, 20 bp, human
gtaggccggggtacctcagc

SEQ ID NO: 224925 - DNA, 20 bp, human
ggagccaccaatttgctgat

SEQ ID NO: 224926 - DNA, 20 bp, human
ggaaacccaaggtatacatt

SEQ ID NO: 224927 - DNA, 20 bp, human
gtctgcctaagacactttta

SEQ ID NO: 224928 - DNA, 20 bp, human
ggagacatccaggaaaccca

SEQ ID NO: 224929 - DNA, 20 bp, human
ggactcagacctattctttg

SEQ ID NO: 224930 - DNA, 20 bp, human
ggactcactatgaacaaagt

SEQ ID NO: 224931 - DNA, 20 bp, human
gtcctccctaaaagtgtctt

SEQ ID NO: 224932 - DNA, 20 bp, human
gaataatttgcataaggaca

SEQ ID NO: 224933 - DNA, 20 bp, human
gagttcctaatgtatacctt

SEQ ID NO: 224934 - DNA, 20 bp, human
gactatgaacaaagttggta

SEQ ID NO: 224935 - DNA, 20 bp, human
gggtgagtgttttgacagag

SEQ ID NO: 224936 - DNA, 20 bp, human
gttcccgcgggtgttgcgac

SEQ ID NO: 224937 - DNA, 20 bp, human
gctcttaggcgctgaggaga

SEQ ID NO: 224938 - DNA, 20 bp, human
gtcctcagcgcctaagagag

SEQ ID NO: 224939 - DNA, 20 bp, human
ggcggggcttacggggagaa

SEQ ID NO: 224940 - DNA, 20 bp, human
gctaagagagaggcccagtg

SEQ ID NO: 224941 - DNA, 20 bp, human
gcagccagtcgcaacacccg

SEQ ID NO: 224942 - DNA, 20 bp, human
gtgctgggccagtcctccgc

SEQ ID NO: 224943 - DNA, 20 bp, human
ggtcgcgaggaagaggcgga

SEQ ID NO: 224944 - DNA, 20 bp, human
gcgcctcccgactgaactcc

SEQ ID NO: 224945 - DNA, 20 bp, human
ggtgaggagtcgcgaggaag

SEQ ID NO: 224946 - DNA, 20 bp, human
ggaggggaggggcaatgctc

SEQ ID NO: 224947 - DNA, 20 bp, human
gaagaggcgagcggtggacg

SEQ ID NO: 224948 - DNA, 20 bp, human
gaggagcagcaagaggcgag

SEQ ID NO: 224949 - DNA, 20 bp, human
gtcgacgcacagaacatcgt

SEQ ID NO: 224950 - DNA, 20 bp, human
gtggacggggctctggttgc

SEQ ID NO: 224951 - DNA, 20 bp, human
ggcacagaacatcgtcgggt

SEQ ID NO: 224952 - DNA, 20 bp, human
gcgagcggtggacggggctc

SEQ ID NO: 224953 - DNA, 20 bp, human
ggatctgcaaggaatcaacc

SEQ ID NO: 224954 - DNA, 20 bp, human
ggcccggaggaaatcgggag

SEQ ID NO: 224955 - DNA, 20 bp, human
gtcccctagtgacggagccc

SEQ ID NO: 224956 - DNA, 20 bp, human
ggggaacgagggcaccctgg

SEQ ID NO: 224957 - DNA, 20 bp, human
gagggcgaggcggtgaaggg

SEQ ID NO: 224958 - DNA, 20 bp, human
gcgcgtgagccaaagtcgga

SEQ ID NO: 224959 - DNA, 20 bp, human
ggggcagggcgaggcggtga

SEQ ID NO: 224960 - DNA, 20 bp, human
ggcaaacaggcgccgggtcg

SEQ ID NO: 224961 - DNA, 20 bp, human
ggcacccgcggcgtccggag

SEQ ID NO: 224962 - DNA, 20 bp, human
gcgcctgtttgccccaccgg

SEQ ID NO: 224963 - DNA, 20 bp, human
ggcccgctccccaagcgccg

SEQ ID NO: 224964 - DNA, 20 bp, human
ggcggggagccgagagcgaa

SEQ ID NO: 224965 - DNA, 20 bp, human
gccccagcgaggaagggtgc

SEQ ID NO: 224966 - DNA, 20 bp, human
ggggcgctccgcttactgat

SEQ ID NO: 224967 - DNA, 20 bp, human
gaacgtagaagcaaccatct

SEQ ID NO: 224968 - DNA, 20 bp, human
gccgttcagcagaagccaat

SEQ ID NO: 224969 - DNA, 20 bp, human
gacagggagtcaggcagttt

SEQ ID NO: 224970 - DNA, 20 bp, human
gcggtgtctctcttgacctt

SEQ ID NO: 224971 - DNA, 20 bp, human
gtggcttctgctgaacggga

SEQ ID NO: 224972 - DNA, 20 bp, human
ggaaaggccgctatgaggaa

SEQ ID NO: 224973 - DNA, 20 bp, human
gcggttgtgacccttattag

SEQ ID NO: 224974 - DNA, 20 bp, human
ggcaaccatctcggtgccca

SEQ ID NO: 224975 - DNA, 20 bp, human
gtccctgtagcgtacaccct

SEQ ID NO: 224976 - DNA, 20 bp, human
gggggtggagtccgggggat

SEQ ID NO: 224977 - DNA, 20 bp, human
ggtgagctgcgcgaggcgga

SEQ ID NO: 224978 - DNA, 20 bp, human
gcgctgggggtggagtccgg

SEQ ID NO: 224979 - DNA, 20 bp, human
ggggaagcgtgagctgcgcg

SEQ ID NO: 224980 - DNA, 20 bp, human
gcggccccgtggcctcccgc

SEQ ID NO: 224981 - DNA, 20 bp, human
gggcctgaggaaaattcagg

SEQ ID NO: 224982 - DNA, 20 bp, human
gcccgagagcccccggtgtg

SEQ ID NO: 224983 - DNA, 20 bp, human
gcggggaggtctcatcaatt

SEQ ID NO: 224984 - DNA, 20 bp, human
gtagtaactcgggcagggga

SEQ ID NO: 224985 - DNA, 20 bp, human
gaagcgtgagctgcgcgagg

SEQ ID NO: 224986 - DNA, 20 bp, human
ggggagcttaagattcctct

SEQ ID NO: 224987 - DNA, 20 bp, human
gcagctgggaccaacacccc

SEQ ID NO: 224988 - DNA, 20 bp, human
gcctctggggactcgtgtgg

SEQ ID NO: 224989 - DNA, 20 bp, human
gcgtggtgacacataaagca

SEQ ID NO: 224990 - DNA, 20 bp, human
gtctgggtaggaagagttcg

SEQ ID NO: 224991 - DNA, 20 bp, human
gggtaggaagagttcggggc

SEQ ID NO: 224992 - DNA, 20 bp, human
gcagcatccgcgtgcaggga

SEQ ID NO: 224993 - DNA, 20 bp, human
ggagccaggcgcacctgctg

SEQ ID NO: 224994 - DNA, 20 bp, human
gggcgtgtggaacgattgtt

SEQ ID NO: 224995 - DNA, 20 bp, human
ggggcagagggtgtgttaat

SEQ ID NO: 224996 - DNA, 20 bp, human
gtgcgcctcctgcccggcag

SEQ ID NO: 224997 - DNA, 20 bp, human
gcaggcgggactacgcgtca

SEQ ID NO: 224998 - DNA, 20 bp, human
ggcagccggcaggcggtgac

SEQ ID NO: 224999 - DNA, 20 bp, human
ggcggcctgcgctccacttc

SEQ ID NO: 225000 - DNA, 20 bp, human
gtggggcagccagcacaatc

SEQ ID NO: 225001 - DNA, 20 bp, human
gcggctcagtagaggagcag

SEQ ID NO: 225002 - DNA, 20 bp, human
ggacacgctcggctcagtag

SEQ ID NO: 225003 - DNA, 20 bp, human
gcagcacaatcgggcggagg

SEQ ID NO: 225004 - DNA, 20 bp, human
gagccagcacaatcgggcgg

SEQ ID NO: 225005 - DNA, 20 bp, human
gagtccctggccgacacgct

SEQ ID NO: 225006 - DNA, 20 bp, human
ggaggtgcgagcggcgtcgg

SEQ ID NO: 225007 - DNA, 20 bp, human
gcggcctcgtgcgccgggac

SEQ ID NO: 225008 - DNA, 20 bp, human
ggggtccgcggtccctcgag

SEQ ID NO: 225009 - DNA, 20 bp, human
gggactgcggcgcaggtgtg

SEQ ID NO: 225010 - DNA, 20 bp, human
gcctgggctccgggctccgg

SEQ ID NO: 225011 - DNA, 20 bp, human
ggtccccgccgcggcgtgat

SEQ ID NO: 225012 - DNA, 20 bp, human
gccggtgagtgcgcgccagg

SEQ ID NO: 225013 - DNA, 20 bp, human
gcaggtgtgcggccgagtca

SEQ ID NO: 225014 - DNA, 20 bp, human
ggaagggagcccggctccgc

SEQ ID NO: 225015 - DNA, 20 bp, human
gctcccgaagttggcggcag

SEQ ID NO: 225016 - DNA, 20 bp, human
ggcgacccgcgccgcgtccg

SEQ ID NO: 225017 - DNA, 20 bp, human
gacggtggggagcggctcag

SEQ ID NO: 225018 - DNA, 20 bp, human
gagtcgccagaggcacggtg

SEQ ID NO: 225019 - DNA, 20 bp, human
gcacgcgcgcctcctgttaa

SEQ ID NO: 225020 - DNA, 20 bp, human
gccgctccccaccgtgcctc

SEQ ID NO: 225021 - DNA, 20 bp, human
ggcggcgcgggtcgcgtcgg

SEQ ID NO: 225022 - DNA, 20 bp, human
gtcccaggcaggggactgaa

SEQ ID NO: 225023 - DNA, 20 bp, human
ggacgcggcgcgggtcgcgt

SEQ ID NO: 225024 - DNA, 20 bp, human
gaggaggcgcgcgtgctcct

SEQ ID NO: 225025 - DNA, 20 bp, human
gggcttccgcggggcacgtc

SEQ ID NO: 225026 - DNA, 20 bp, human
gtggcagtaactgattctta

SEQ ID NO: 225027 - DNA, 20 bp, human
gcaattgcgaatctgcaaat

SEQ ID NO: 225028 - DNA, 20 bp, human
gacaggcttccagctttctc

SEQ ID NO: 225029 - DNA, 20 bp, human
gaatgagctcccgagaaagc

SEQ ID NO: 225030 - DNA, 20 bp, human
gtagactctaaaatctcaag

SEQ ID NO: 225031 - DNA, 20 bp, human
gaaattagagtatatcaact

SEQ ID NO: 225032 - DNA, 20 bp, human
gaatcagttactgccaggcg

SEQ ID NO: 225033 - DNA, 20 bp, human
gcttaacattatatcttcaa

SEQ ID NO: 225034 - DNA, 20 bp, human
gtcatttgcatatttttttt

SEQ ID NO: 225035 - DNA, 20 bp, human
gttaaaaaaaaatgtaggac

SEQ ID NO: 225036 - DNA, 20 bp, human
gcccatgccaagcatcacta

SEQ ID NO: 225037 - DNA, 20 bp, human
gcacggcacatgcgcagtgg

SEQ ID NO: 225038 - DNA, 20 bp, human
gggggctctagaataggcag

SEQ ID NO: 225039 - DNA, 20 bp, human
gcacatgcgcagtggaggct

SEQ ID NO: 225040 - DNA, 20 bp, human
ggcttggaggggaggcttgg

SEQ ID NO: 225041 - DNA, 20 bp, human
gtcactaggggctctagaat

SEQ ID NO: 225042 - DNA, 20 bp, human
gcagaaggggcagggatgca

SEQ ID NO: 225043 - DNA, 20 bp, human
gcgcctacgggtacccagaa

SEQ ID NO: 225044 - DNA, 20 bp, human
ggaggcttgggggctgggta

SEQ ID NO: 225045 - DNA, 20 bp, human
gatgcacggcacatgcgcag

SEQ ID NO: 225046 - DNA, 20 bp, human
gccgccggaagggccagcga

SEQ ID NO: 225047 - DNA, 20 bp, human
gccggaagggccagcgacgg

SEQ ID NO: 225048 - DNA, 20 bp, human
ggggtcggcgagtcccgttg

SEQ ID NO: 225049 - DNA, 20 bp, human
gaacaggcccagaacgtcca

SEQ ID NO: 225050 - DNA, 20 bp, human
gtggtcgtaacccaaggcaa

SEQ ID NO: 225051 - DNA, 20 bp, human
gaagcctagcactggcgagg

SEQ ID NO: 225052 - DNA, 20 bp, human
gccggatgggccgttgcctt

SEQ ID NO: 225053 - DNA, 20 bp, human
gccgacccgagagcccgggt

SEQ ID NO: 225054 - DNA, 20 bp, human
gcggagggtctcagatggcg

SEQ ID NO: 225055 - DNA, 20 bp, human
gaggcacaagggctccccaa

SEQ ID NO: 225056 - DNA, 20 bp, human
ggggtctgaatacgtggagt

SEQ ID NO: 225057 - DNA, 20 bp, human
ggggaaagtggcagattgtt

SEQ ID NO: 225058 - DNA, 20 bp, human
gcgtggagtaggacacagcg

SEQ ID NO: 225059 - DNA, 20 bp, human
ggtggcagattgtttggctg

SEQ ID NO: 225060 - DNA, 20 bp, human
gtttcctgttagggacttaa

SEQ ID NO: 225061 - DNA, 20 bp, human
gtttcaggggtctgaatacg

SEQ ID NO: 225062 - DNA, 20 bp, human
gaagcctttaagtccctaac

SEQ ID NO: 225063 - DNA, 20 bp, human
gggagagaggaaaacacctt

SEQ ID NO: 225064 - DNA, 20 bp, human
gccactttgcggggaggggc

SEQ ID NO: 225065 - DNA, 20 bp, human
gctgcattcgttgggtttca

SEQ ID NO: 225066 - DNA, 20 bp, human
gcggctcggccggccgccct

SEQ ID NO: 225067 - DNA, 20 bp, human
gcgcctctacgttctggacc

SEQ ID NO: 225068 - DNA, 20 bp, human
ggggccgagcagttccgggg

SEQ ID NO: 225069 - DNA, 20 bp, human
gagccgggaggacggagctg

SEQ ID NO: 225070 - DNA, 20 bp, human
ggtccgggtccagaacgtag

SEQ ID NO: 225071 - DNA, 20 bp, human
ggacccggacccgaccggcc

SEQ ID NO: 225072 - DNA, 20 bp, human
gggaagcgaagccgcggcgt

SEQ ID NO: 225073 - DNA, 20 bp, human
ggcgttggcgaggccggtcc

SEQ ID NO: 225074 - DNA, 20 bp, human
gttctggacccggacccgac

SEQ ID NO: 225075 - DNA, 20 bp, human
gtgggcagaaagccaagagg

SEQ ID NO: 225076 - DNA, 20 bp, human
gcaaggggatgtggtcactg

SEQ ID NO: 225077 - DNA, 20 bp, human
gcccaggggcagacgagttg

SEQ ID NO: 225078 - DNA, 20 bp, human
ggcccggcctcggatgaagg

SEQ ID NO: 225079 - DNA, 20 bp, human
gggagggcaccgcctgttgc

SEQ ID NO: 225080 - DNA, 20 bp, human
gcggtgaggaggcttttcct

SEQ ID NO: 225081 - DNA, 20 bp, human
ggcctcggatgaaggcggaa

SEQ ID NO: 225082 - DNA, 20 bp, human
gttagtgtcaccccatagcc

SEQ ID NO: 225083 - DNA, 20 bp, human
gcttttcggtgaatgttctg

SEQ ID NO: 225084 - DNA, 20 bp, human
gggatgtggtcactgcggtg

SEQ ID NO: 225085 - DNA, 20 bp, human
gggaaacaaacactccccag

SEQ ID NO: 225086 - DNA, 20 bp, human
gtctcgaacacaactggcgg

SEQ ID NO: 225087 - DNA, 20 bp, human
gggcgtccgaagcagcgccg

SEQ ID NO: 225088 - DNA, 20 bp, human
gaactgactgtcgctctctc

SEQ ID NO: 225089 - DNA, 20 bp, human
gtccgaagcagcgccgaggc

SEQ ID NO: 225090 - DNA, 20 bp, human
ggcttcggacgccccggcac

SEQ ID NO: 225091 - DNA, 20 bp, human
ggcgtctcgaacacaactgg

SEQ ID NO: 225092 - DNA, 20 bp, human
ggcaggcggcacttccggct

SEQ ID NO: 225093 - DNA, 20 bp, human
gacagcaaaaaaggcacctg

SEQ ID NO: 225094 - DNA, 20 bp, human
ggaatgctacaaagcaacgg

SEQ ID NO: 225095 - DNA, 20 bp, human
gacgtggcaggcggcacttc

SEQ ID NO: 225096 - DNA, 20 bp, human
gctgcctcccaggtctgacg

SEQ ID NO: 225097 - DNA, 20 bp, human
gagtccccgtcagacctggg

SEQ ID NO: 225098 - DNA, 20 bp, human
gccggagtccccgtcagacc

SEQ ID NO: 225099 - DNA, 20 bp, human
ggggctgcccaatcctgaac

SEQ ID NO: 225100 - DNA, 20 bp, human
gttgaggcttgcccgcaagg

SEQ ID NO: 225101 - DNA, 20 bp, human
ggagggagagaaagcttcgg

SEQ ID NO: 225102 - DNA, 20 bp, human
gtctgacggggactccggct

SEQ ID NO: 225103 - DNA, 20 bp, human
gggggactccggctcggagc

SEQ ID NO: 225104 - DNA, 20 bp, human
gagccacgccccttccggga

SEQ ID NO: 225105 - DNA, 20 bp, human
gggcccaggcgtcagcaaga

SEQ ID NO: 225106 - DNA, 20 bp, human
gccggcgggagttgtaaccc

SEQ ID NO: 225107 - DNA, 20 bp, human
ggcgacgctccgcacagcac

SEQ ID NO: 225108 - DNA, 20 bp, human
gcgccggcgccatgcttcgg

SEQ ID NO: 225109 - DNA, 20 bp, human
gcgggcgtcatgatggtaaa

SEQ ID NO: 225110 - DNA, 20 bp, human
gtcccgccggcgccatgctt

SEQ ID NO: 225111 - DNA, 20 bp, human
gtgcttcggaggagcaacgt

SEQ ID NO: 225112 - DNA, 20 bp, human
ggcagctggccgccccgcag

SEQ ID NO: 225113 - DNA, 20 bp, human
gggagtggcggggtaaggat

SEQ ID NO: 225114 - DNA, 20 bp, human
gctccccgctccggacagcc

SEQ ID NO: 225115 - DNA, 20 bp, human
ggcgtcctctaggggcagaa

SEQ ID NO: 225116 - DNA, 20 bp, human
gtcgggcagggctgtaacgt

SEQ ID NO: 225117 - DNA, 20 bp, human
ggtaacgttgggaactgttc

SEQ ID NO: 225118 - DNA, 20 bp, human
gctgtggtgcacagatgtag

SEQ ID NO: 225119 - DNA, 20 bp, human
gggcgcgactgcagtaaaag

SEQ ID NO: 225120 - DNA, 20 bp, human
ggggccgtaaagcgcgggga

SEQ ID NO: 225121 - DNA, 20 bp, human
ggcggaggctgagtcgggca

SEQ ID NO: 225122 - DNA, 20 bp, human
ggccgcgcacgcgcaaactg

SEQ ID NO: 225123 - DNA, 20 bp, human
ggcctccgcagagacggcgg

SEQ ID NO: 225124 - DNA, 20 bp, human
gggcgggagtgccagcgcga

SEQ ID NO: 225125 - DNA, 20 bp, human
gccaggctcctccctcgcgc

SEQ ID NO: 225126 - DNA, 20 bp, human
gcccggaagtagttgcggga

SEQ ID NO: 225127 - DNA, 20 bp, human
ggaagctgaccggaaggtcc

SEQ ID NO: 225128 - DNA, 20 bp, human
ggaagctcgcgggtcggcac

SEQ ID NO: 225129 - DNA, 20 bp, human
gagcgagccgggaagctgac

SEQ ID NO: 225130 - DNA, 20 bp, human
gcggcaccgggacagctccc

SEQ ID NO: 225131 - DNA, 20 bp, human
ggggcatcagacagcgagcc

SEQ ID NO: 225132 - DNA, 20 bp, human
gacaaacaccactagctcat

SEQ ID NO: 225133 - DNA, 20 bp, human
ggtcccgcacccggaccttc

SEQ ID NO: 225134 - DNA, 20 bp, human
ggcgggacgtgtgcattcca

SEQ ID NO: 225135 - DNA, 20 bp, human
gccgccccggaagtagttgc

SEQ ID NO: 225136 - DNA, 20 bp, human
ggccacgcctcaaccgggca

SEQ ID NO: 225137 - DNA, 20 bp, human
gcggccggatccgactaata

SEQ ID NO: 225138 - DNA, 20 bp, human
gtccaagggcccctattagt

SEQ ID NO: 225139 - DNA, 20 bp, human
gaccctgcccggttgaggcg

SEQ ID NO: 225140 - DNA, 20 bp, human
gggcccctattagtcggatc

SEQ ID NO: 225141 - DNA, 20 bp, human
gtgaggcgtggccgctccaa

SEQ ID NO: 225142 - DNA, 20 bp, human
gcaaccgggcagggtagctt

SEQ ID NO: 225143 - DNA, 20 bp, human
ggagcggccacgcctcaacc

SEQ ID NO: 225144 - DNA, 20 bp, human
gtctgcctgacgtaaccaat

SEQ ID NO: 225145 - DNA, 20 bp, human
gtggaggggaagagctagaa

SEQ ID NO: 225146 - DNA, 20 bp, human
gcgacgcaataaggatgtgt

SEQ ID NO: 225147 - DNA, 20 bp, human
gaataaggatgtgttggctt

SEQ ID NO: 225148 - DNA, 20 bp, human
gaagggaatacgggctctaa

SEQ ID NO: 225149 - DNA, 20 bp, human
gggctatcagcgacgcaata

SEQ ID NO: 225150 - DNA, 20 bp, human
gcacatcatggtattcactt

SEQ ID NO: 225151 - DNA, 20 bp, human
gtggaggaacttttccacac

SEQ ID NO: 225152 - DNA, 20 bp, human
gtggtaaatgcagatgagcg

SEQ ID NO: 225153 - DNA, 20 bp, human
gatcaacgaagttttgatat

SEQ ID NO: 225154 - DNA, 20 bp, human
gatattactgatgggctcag

SEQ ID NO: 225155 - DNA, 20 bp, human
gctctagagtttcgtggtgg

SEQ ID NO: 225156 - DNA, 20 bp, human
gggtcctggcacgctcccca

SEQ ID NO: 225157 - DNA, 20 bp, human
ggtcccgccccgctcctaga

SEQ ID NO: 225158 - DNA, 20 bp, human
gcccgcccgtcgcctccctg

SEQ ID NO: 225159 - DNA, 20 bp, human
gcctccctggggagcgtgcc

SEQ ID NO: 225160 - DNA, 20 bp, human
gccgccccgctcctagaggg

SEQ ID NO: 225161 - DNA, 20 bp, human
gcgcctggcccgtgcaatcc

SEQ ID NO: 225162 - DNA, 20 bp, human
ggcgggcgccaggattgcac

SEQ ID NO: 225163 - DNA, 20 bp, human
gaacccgggccccccagtat

SEQ ID NO: 225164 - DNA, 20 bp, human
gggaaacaggcaagcagcga

SEQ ID NO: 225165 - DNA, 20 bp, human
ggcacggtggggagccctac

SEQ ID NO: 225166 - DNA, 20 bp, human
gagcgcctgaagaggggtag

SEQ ID NO: 225167 - DNA, 20 bp, human
gaagaggggtagtggccaca

SEQ ID NO: 225168 - DNA, 20 bp, human
gagacatagcgcctgaagag

SEQ ID NO: 225169 - DNA, 20 bp, human
gtcaggcgctatgtctcctc

SEQ ID NO: 225170 - DNA, 20 bp, human
gtcagggccagctaccaaga

SEQ ID NO: 225171 - DNA, 20 bp, human
gaagatctctgtggaggtag

SEQ ID NO: 225172 - DNA, 20 bp, human
gtgacttagaaggtagggtg

SEQ ID NO: 225173 - DNA, 20 bp, human
gcattgcccgtcttggtagc

SEQ ID NO: 225174 - DNA, 20 bp, human
gtgggctagtggaaaagaca

SEQ ID NO: 225175 - DNA, 20 bp, human
gctgggatattggccttaaa

SEQ ID NO: 225176 - DNA, 20 bp, human
ggggaccaggcgggacttac

SEQ ID NO: 225177 - DNA, 20 bp, human
gaccaggcgggacttacagg

SEQ ID NO: 225178 - DNA, 20 bp, human
ggggcggtgagtgacgtgag

SEQ ID NO: 225179 - DNA, 20 bp, human
gggaacgaaacggaagtccg

SEQ ID NO: 225180 - DNA, 20 bp, human
gtgcccgcgcgggagaacag

SEQ ID NO: 225181 - DNA, 20 bp, human
gtgaaggcggggaaataccg

SEQ ID NO: 225182 - DNA, 20 bp, human
gtggtgtcatgagaacgtgg

SEQ ID NO: 225183 - DNA, 20 bp, human
gggccctccgcctccattga

SEQ ID NO: 225184 - DNA, 20 bp, human
gacttacaggcggaacgaaa

SEQ ID NO: 225185 - DNA, 20 bp, human
gtccccgccttcaatggagg

SEQ ID NO: 225186 - DNA, 20 bp, human
gtggccagacatcaggtcag

SEQ ID NO: 225187 - DNA, 20 bp, human
gtggcctggagggtaggagt

SEQ ID NO: 225188 - DNA, 20 bp, human
gaactcggctcataggatct

SEQ ID NO: 225189 - DNA, 20 bp, human
ggaaaggggctcatggccag

SEQ ID NO: 225190 - DNA, 20 bp, human
gagggagaacaatgctgtcc

SEQ ID NO: 225191 - DNA, 20 bp, human
gcctcagaaaggctcccgag

SEQ ID NO: 225192 - DNA, 20 bp, human
ggggtgacacccaccccctc

SEQ ID NO: 225193 - DNA, 20 bp, human
gaggcccctgacctgatgtc

SEQ ID NO: 225194 - DNA, 20 bp, human
gcggctgggacacacgcctg

SEQ ID NO: 225195 - DNA, 20 bp, human
gcatggtgatggggcttgtg

SEQ ID NO: 225196 - DNA, 20 bp, human
ggggcaggggctcactcgag

SEQ ID NO: 225197 - DNA, 20 bp, human
gaagtcccgtcgggtggcag

SEQ ID NO: 225198 - DNA, 20 bp, human
gagcccctgcccgagtgccg

SEQ ID NO: 225199 - DNA, 20 bp, human
gaccccggggacggaagcca

SEQ ID NO: 225200 - DNA, 20 bp, human
gcggcaacaacaagtcccgt

SEQ ID NO: 225201 - DNA, 20 bp, human
gtgggccctgaccccgggga

SEQ ID NO: 225202 - DNA, 20 bp, human
gcccccgcggcactcgggca

SEQ ID NO: 225203 - DNA, 20 bp, human
gcaaccgtggcttccgtccc

SEQ ID NO: 225204 - DNA, 20 bp, human
gtcagtgggccctgaccccg

SEQ ID NO: 225205 - DNA, 20 bp, human
gaacaacaagtcccgtcggg

SEQ ID NO: 225206 - DNA, 20 bp, human
gcgggacctgggcgccaagg

SEQ ID NO: 225207 - DNA, 20 bp, human
gaccgtgggagcgaaggctg

SEQ ID NO: 225208 - DNA, 20 bp, human
gcgtcggccggcggctcctg

SEQ ID NO: 225209 - DNA, 20 bp, human
ggcgacacgcgctcccacgg

SEQ ID NO: 225210 - DNA, 20 bp, human
gcgcgtgcgcgagctcgcgc

SEQ ID NO: 225211 - DNA, 20 bp, human
gctggggaatgaatggtgaa

SEQ ID NO: 225212 - DNA, 20 bp, human
gcggcctggccgactacgag

SEQ ID NO: 225213 - DNA, 20 bp, human
gcgggcctcaaacaagcctc

SEQ ID NO: 225214 - DNA, 20 bp, human
gcccgccagaggcttgtttg

SEQ ID NO: 225215 - DNA, 20 bp, human
gggcgggactcggcagtaac

SEQ ID NO: 225216 - DNA, 20 bp, human
gggcctgggcaaaggactct

SEQ ID NO: 225217 - DNA, 20 bp, human
gcggaggttaggccagtcct

SEQ ID NO: 225218 - DNA, 20 bp, human
gggggatgacggttaggcag

SEQ ID NO: 225219 - DNA, 20 bp, human
gcagggctgccaagaagcct

SEQ ID NO: 225220 - DNA, 20 bp, human
gctgtgagcctggagaatca

SEQ ID NO: 225221 - DNA, 20 bp, human
gcggttaggcagcggaggtt

SEQ ID NO: 225222 - DNA, 20 bp, human
ggatgacggttaggcagcgg

SEQ ID NO: 225223 - DNA, 20 bp, human
gctctgggaagggtggctgc

SEQ ID NO: 225224 - DNA, 20 bp, human
gctgcagggggatgacggtt

SEQ ID NO: 225225 - DNA, 20 bp, human
gtccacgggatgctggggag

SEQ ID NO: 225226 - DNA, 20 bp, human
gggaccagggacttccccca

SEQ ID NO: 225227 - DNA, 20 bp, human
gcaagggcagggtgaaagaa

SEQ ID NO: 225228 - DNA, 20 bp, human
ggaccccagccagagggacc

SEQ ID NO: 225229 - DNA, 20 bp, human
gcatctggggtgggaaatga

SEQ ID NO: 225230 - DNA, 20 bp, human
gtccctggtccctctggctg

SEQ ID NO: 225231 - DNA, 20 bp, human
gtggacccctagtttgggag

SEQ ID NO: 225232 - DNA, 20 bp, human
gccaaactaggggtccagga

SEQ ID NO: 225233 - DNA, 20 bp, human
gcacataaaacagacagctc

SEQ ID NO: 225234 - DNA, 20 bp, human
gtaccgacctaggtcttcct

SEQ ID NO: 225235 - DNA, 20 bp, human
gagtgcccaaggcaagggca

SEQ ID NO: 225236 - DNA, 20 bp, human
ggcgcagcggaaatgacgtt

SEQ ID NO: 225237 - DNA, 20 bp, human
ggcgcactccgggcctgcga

SEQ ID NO: 225238 - DNA, 20 bp, human
ggccccgcgcaccttcatga

SEQ ID NO: 225239 - DNA, 20 bp, human
ggcaggcccggagtgcgcga

SEQ ID NO: 225240 - DNA, 20 bp, human
gcggcgcccgcctctcttcg

SEQ ID NO: 225241 - DNA, 20 bp, human
ggggccagggaccggggtgt

SEQ ID NO: 225242 - DNA, 20 bp, human
gtctctgccggcttccccga

SEQ ID NO: 225243 - DNA, 20 bp, human
gggtgtcggtcctattcgaa

SEQ ID NO: 225244 - DNA, 20 bp, human
gaggacaacgtccgcccccg

SEQ ID NO: 225245 - DNA, 20 bp, human
gggtccctggccccgaagag

SEQ ID NO: 225246 - DNA, 20 bp, human
ggactcctatcatgaggtgg

SEQ ID NO: 225247 - DNA, 20 bp, human
ggggaccagtcttcaccccc

SEQ ID NO: 225248 - DNA, 20 bp, human
gccagcatttacaaagagga

SEQ ID NO: 225249 - DNA, 20 bp, human
gtcctcttctgatgagagtg

SEQ ID NO: 225250 - DNA, 20 bp, human
ggggagaaagtgctaggagc

SEQ ID NO: 225251 - DNA, 20 bp, human
gtcatcagcgacattccagg

SEQ ID NO: 225252 - DNA, 20 bp, human
gtgatccaaggggtaaccgg

SEQ ID NO: 225253 - DNA, 20 bp, human
gtaccccttggatcaaccac

SEQ ID NO: 225254 - DNA, 20 bp, human
gcctcatgataggagtcatg

SEQ ID NO: 225255 - DNA, 20 bp, human
gtggacaacaggcacaattt

SEQ ID NO: 225256 - DNA, 20 bp, human
ggcgccctgcgcaccgttgg

SEQ ID NO: 225257 - DNA, 20 bp, human
gaaaggcagccccggatgtg

SEQ ID NO: 225258 - DNA, 20 bp, human
gccccccccaacggtgcgca

SEQ ID NO: 225259 - DNA, 20 bp, human
gcgcagggcgcaggcgccaa

SEQ ID NO: 225260 - DNA, 20 bp, human
gagccagaggacccgagtgg

SEQ ID NO: 225261 - DNA, 20 bp, human
gcctgcgccctgcgcaccgt

SEQ ID NO: 225262 - DNA, 20 bp, human
gctggtgagggctctggcgc

SEQ ID NO: 225263 - DNA, 20 bp, human
gcagcctagcgccgccatct

SEQ ID NO: 225264 - DNA, 20 bp, human
gaagaagtttcctcacatcc

SEQ ID NO: 225265 - DNA, 20 bp, human
ggctaggctgaccctcctgc

SEQ ID NO: 225266 - DNA, 20 bp, human
ggctcagagcgcggctgtgt

SEQ ID NO: 225267 - DNA, 20 bp, human
ggctcccgccatgcccgctg

SEQ ID NO: 225268 - DNA, 20 bp, human
ggcccctccggcccatccgt

SEQ ID NO: 225269 - DNA, 20 bp, human
gccgccatgcccgctggggt

SEQ ID NO: 225270 - DNA, 20 bp, human
ggggtcagcggctcagagcg

SEQ ID NO: 225271 - DNA, 20 bp, human
gaagacgcagggccccgcgc

SEQ ID NO: 225272 - DNA, 20 bp, human
gggacctaccccagcgggca

SEQ ID NO: 225273 - DNA, 20 bp, human
ggccgccccagccagggtct

SEQ ID NO: 225274 - DNA, 20 bp, human
ggaccccgcgtctctcgtga

SEQ ID NO: 225275 - DNA, 20 bp, human
gtccgcaggacctaccccag

SEQ ID NO: 225276 - DNA, 20 bp, human
gccagtctcacatcaccaga

SEQ ID NO: 225277 - DNA, 20 bp, human
gcctagaagcacatatggaa

SEQ ID NO: 225278 - DNA, 20 bp, human
gtcgaatccgggcagaagac

SEQ ID NO: 225279 - DNA, 20 bp, human
gagaatctgaagtactggct

SEQ ID NO: 225280 - DNA, 20 bp, human
gcaattcaaagtctggagtg

SEQ ID NO: 225281 - DNA, 20 bp, human
gctctgggtgaggcttacca

SEQ ID NO: 225282 - DNA, 20 bp, human
gcggattcgagaaaattcca

SEQ ID NO: 225283 - DNA, 20 bp, human
gatctgaagtactggctggg

SEQ ID NO: 225284 - DNA, 20 bp, human
gccaaagaatgtgatgaaac

SEQ ID NO: 225285 - DNA, 20 bp, human
ggaagcacatatggaaggga

SEQ ID NO: 225286 - DNA, 20 bp, human
gtgaggcagtataggaaaga

SEQ ID NO: 225287 - DNA, 20 bp, human
gccctggtggatcatcggtg

SEQ ID NO: 225288 - DNA, 20 bp, human
ggctacctgtgggtgacttc

SEQ ID NO: 225289 - DNA, 20 bp, human
ggtacctttcagctacctgt

SEQ ID NO: 225290 - DNA, 20 bp, human
gatgtagggtaactaattgc

SEQ ID NO: 225291 - DNA, 20 bp, human
ggcctcaccgatgatccacc

SEQ ID NO: 225292 - DNA, 20 bp, human
gtcggattcaaacgatgcca

SEQ ID NO: 225293 - DNA, 20 bp, human
gatcatcggtgaggcagtat

SEQ ID NO: 225294 - DNA, 20 bp, human
gttatcagtggcattatgta

SEQ ID NO: 225295 - DNA, 20 bp, human
gctttgctgagattttcact

SEQ ID NO: 225296 - DNA, 20 bp, human
ggcaggagagagcggcataa

SEQ ID NO: 225297 - DNA, 20 bp, human
gtggctggtgaacttgagat

SEQ ID NO: 225298 - DNA, 20 bp, human
gtagtttagctgttccagag

SEQ ID NO: 225299 - DNA, 20 bp, human
gcctgggaactgagaccaaa

SEQ ID NO: 225300 - DNA, 20 bp, human
ggccgctctctcctgccatt

SEQ ID NO: 225301 - DNA, 20 bp, human
gatgggaacaacgctccctt

SEQ ID NO: 225302 - DNA, 20 bp, human
gaagtgtagaaaatgcctgc

SEQ ID NO: 225303 - DNA, 20 bp, human
gtacactcagtgcagcgaga

SEQ ID NO: 225304 - DNA, 20 bp, human
gtcatactgtgaaaggcccc

SEQ ID NO: 225305 - DNA, 20 bp, human
gtaaactcagaagttgcaat

SEQ ID NO: 225306 - DNA, 20 bp, human
gggcactgtgggatatgggg

SEQ ID NO: 225307 - DNA, 20 bp, human
gcgcgggtggagccatccca

SEQ ID NO: 225308 - DNA, 20 bp, human
gccggggcactgtgggatat

SEQ ID NO: 225309 - DNA, 20 bp, human
gcccagggctggtcggggat

SEQ ID NO: 225310 - DNA, 20 bp, human
gagagacgcgggcgaagttc

SEQ ID NO: 225311 - DNA, 20 bp, human
ggagcaaaagcccagagacg

SEQ ID NO: 225312 - DNA, 20 bp, human
gtgtgggatatggggcgggg

SEQ ID NO: 225313 - DNA, 20 bp, human
ggtagcgtctagaaagacta

SEQ ID NO: 225314 - DNA, 20 bp, human
gctggctccaaaatagcgag

SEQ ID NO: 225315 - DNA, 20 bp, human
ggccaagagtaaggcctgga

SEQ ID NO: 225316 - DNA, 20 bp, human
ggaccacggggaatctggga

SEQ ID NO: 225317 - DNA, 20 bp, human
gcccggcagcatcgagacag

SEQ ID NO: 225318 - DNA, 20 bp, human
gaagcggcagctggtgccta

SEQ ID NO: 225319 - DNA, 20 bp, human
gtcgcccaaactgactcgga

SEQ ID NO: 225320 - DNA, 20 bp, human
ggcctcctcggcgctcgcgc

SEQ ID NO: 225321 - DNA, 20 bp, human
gcctgcgcagcttgcggcca

SEQ ID NO: 225322 - DNA, 20 bp, human
gcggctgcttcgtgcaactg

SEQ ID NO: 225323 - DNA, 20 bp, human
gcgaacgggcgtccggggac

SEQ ID NO: 225324 - DNA, 20 bp, human
ggctgcgggcggtgagacgc

SEQ ID NO: 225325 - DNA, 20 bp, human
gtctctcgagtcatttacgg

SEQ ID NO: 225326 - DNA, 20 bp, human
gggcccgtgttgttttgttt

SEQ ID NO: 225327 - DNA, 20 bp, human
ggggtcccaaagttgcacgt

SEQ ID NO: 225328 - DNA, 20 bp, human
gcggcagcaacaaaaagggt

SEQ ID NO: 225329 - DNA, 20 bp, human
gaaaagtagccggcgcggcg

SEQ ID NO: 225330 - DNA, 20 bp, human
gacgtgggacaaacgcaaga

SEQ ID NO: 225331 - DNA, 20 bp, human
gtcagctgtgaggtcacgtg

SEQ ID NO: 225332 - DNA, 20 bp, human
gagccccaaacaaaacaaca

SEQ ID NO: 225333 - DNA, 20 bp, human
gagtgcgcacccacccgtgt

SEQ ID NO: 225334 - DNA, 20 bp, human
gaaaaaggccgcgcgtccac

SEQ ID NO: 225335 - DNA, 20 bp, human
gcgcgcagccagtggacgcg

SEQ ID NO: 225336 - DNA, 20 bp, human
gggtccgatgcccatccaat

SEQ ID NO: 225337 - DNA, 20 bp, human
ggcgggctgcgaaacgggag

SEQ ID NO: 225338 - DNA, 20 bp, human
gtggatgggcatcggaccaa

SEQ ID NO: 225339 - DNA, 20 bp, human
gcggagaggccggtcgtgga

SEQ ID NO: 225340 - DNA, 20 bp, human
gtcggcacgcgacacggcac

SEQ ID NO: 225341 - DNA, 20 bp, human
gggctgcgaaacgggagggg

SEQ ID NO: 225342 - DNA, 20 bp, human
gccgttaccccccagagaca

SEQ ID NO: 225343 - DNA, 20 bp, human
gtgggcatcggaccaatggc

SEQ ID NO: 225344 - DNA, 20 bp, human
ggagtggtcgcccattggat

SEQ ID NO: 225345 - DNA, 20 bp, human
ggccctatcagcaaatcatc

SEQ ID NO: 225346 - DNA, 20 bp, human
ggggtgggcaggcacggggt

SEQ ID NO: 225347 - DNA, 20 bp, human
gtcggctcaagtcaagatga

SEQ ID NO: 225348 - DNA, 20 bp, human
gagaagtggtgcaccgggag

SEQ ID NO: 225349 - DNA, 20 bp, human
gcagggacaggtcccgggaa

SEQ ID NO: 225350 - DNA, 20 bp, human
ggggctgggctcaggatgtg

SEQ ID NO: 225351 - DNA, 20 bp, human
gagcccaagatgtgtaacca

SEQ ID NO: 225352 - DNA, 20 bp, human
gtgtccctgatgtcataact

SEQ ID NO: 225353 - DNA, 20 bp, human
gttcaggggagctattgcag

SEQ ID NO: 225354 - DNA, 20 bp, human
gagccttggttacacatctt

SEQ ID NO: 225355 - DNA, 20 bp, human
gagtggtgcaccgggagggg

SEQ ID NO: 225356 - DNA, 20 bp, human
ggggacatggcgtgggtggt

SEQ ID NO: 225357 - DNA, 20 bp, human
gcagccgcggggacatggcg

SEQ ID NO: 225358 - DNA, 20 bp, human
gacgaagccccaccccgacc

SEQ ID NO: 225359 - DNA, 20 bp, human
gagctgctgccgcgcctcct

SEQ ID NO: 225360 - DNA, 20 bp, human
gccgccgcccgaggcccccc

SEQ ID NO: 225361 - DNA, 20 bp, human
gtgcgccacgtaagcgcgga

SEQ ID NO: 225362 - DNA, 20 bp, human
gtgggtggtgggcgtccgct

SEQ ID NO: 225363 - DNA, 20 bp, human
gcgccccctccgcgcttacg

SEQ ID NO: 225364 - DNA, 20 bp, human
gccgcgcggggtgcctgcca

SEQ ID NO: 225365 - DNA, 20 bp, human
gccaaggcgggcgtcgtcgg

SEQ ID NO: 225366 - DNA, 20 bp, human
gtccctaggcagtagtgaga

SEQ ID NO: 225367 - DNA, 20 bp, human
gagttgactctcagatggaa

SEQ ID NO: 225368 - DNA, 20 bp, human
gttccttgagccaaatccct

SEQ ID NO: 225369 - DNA, 20 bp, human
gcattctgccatatggttcc

SEQ ID NO: 225370 - DNA, 20 bp, human
gtccctctcactactgccta

SEQ ID NO: 225371 - DNA, 20 bp, human
gcattttgaacttggaataa

SEQ ID NO: 225372 - DNA, 20 bp, human
gcagttgcacaagaatgtcc

SEQ ID NO: 225373 - DNA, 20 bp, human
gtgcctagggatttggctca

SEQ ID NO: 225374 - DNA, 20 bp, human
gtagacatttgctcaaccag

SEQ ID NO: 225375 - DNA, 20 bp, human
gagcaattgtgacagaataa

SEQ ID NO: 225376 - DNA, 20 bp, human
gtagaatctcgggagagtaa

SEQ ID NO: 225377 - DNA, 20 bp, human
gaatctcgggagagtaaagg

SEQ ID NO: 225378 - DNA, 20 bp, human
gtcccaaagaagtacctgaa

SEQ ID NO: 225379 - DNA, 20 bp, human
gagtacctgaaaggaatctg

SEQ ID NO: 225380 - DNA, 20 bp, human
gcagacagagaggtagctaa

SEQ ID NO: 225381 - DNA, 20 bp, human
gggggcgaacacagcgtgtt

SEQ ID NO: 225382 - DNA, 20 bp, human
gttgtcttcataggatcttc

SEQ ID NO: 225383 - DNA, 20 bp, human
gcgagattctagaaattctc

SEQ ID NO: 225384 - DNA, 20 bp, human
ggggattctgtgaagaattg

SEQ ID NO: 225385 - DNA, 20 bp, human
gtcctttcaggtacttcttt

SEQ ID NO: 225386 - DNA, 20 bp, human
gccgcctgccgcccccggat

SEQ ID NO: 225387 - DNA, 20 bp, human
gcgggggcggcaggcggaaa

SEQ ID NO: 225388 - DNA, 20 bp, human
ggtagctagggcgtgagtat

SEQ ID NO: 225389 - DNA, 20 bp, human
ggggagggggaccaacaaac

SEQ ID NO: 225390 - DNA, 20 bp, human
gctcccgcgaaagtcctgag

SEQ ID NO: 225391 - DNA, 20 bp, human
gcccctctgcccccctgcga

SEQ ID NO: 225392 - DNA, 20 bp, human
gctgccgcccccggatggga

SEQ ID NO: 225393 - DNA, 20 bp, human
ggcctcaaccatcccatccg

SEQ ID NO: 225394 - DNA, 20 bp, human
ggcggcaggcggaaaaggct

SEQ ID NO: 225395 - DNA, 20 bp, human
ggccctagctacagaggtca

SEQ ID NO: 225396 - DNA, 20 bp, human
gtcggcgcgcccagtcgatg

SEQ ID NO: 225397 - DNA, 20 bp, human
gtggcgcggaagtgaggcga

SEQ ID NO: 225398 - DNA, 20 bp, human
gcgactgcgtctgatggggc

SEQ ID NO: 225399 - DNA, 20 bp, human
gagcacggggctgagactag

SEQ ID NO: 225400 - DNA, 20 bp, human
ggcggataggctcaacccgg

SEQ ID NO: 225401 - DNA, 20 bp, human
ggaagtgtggcgcggaagtg

SEQ ID NO: 225402 - DNA, 20 bp, human
gtaagcgactgcgtctgatg

SEQ ID NO: 225403 - DNA, 20 bp, human
gcccactcaagcacagacac

SEQ ID NO: 225404 - DNA, 20 bp, human
ggggttgagcctatccgctg

SEQ ID NO: 225405 - DNA, 20 bp, human
gagtggagcgaagtgtggcg

SEQ ID NO: 225406 - DNA, 20 bp, human
ggtctcctaccttccctctt

SEQ ID NO: 225407 - DNA, 20 bp, human
gccagtaccaaggaacacaa

SEQ ID NO: 225408 - DNA, 20 bp, human
gagaacctcacctgcccata

SEQ ID NO: 225409 - DNA, 20 bp, human
ggagttgttagtgctttggg

SEQ ID NO: 225410 - DNA, 20 bp, human
ggcctctattaggtcacaag

SEQ ID NO: 225411 - DNA, 20 bp, human
gcatggggtgaagaaggata

SEQ ID NO: 225412 - DNA, 20 bp, human
gtattaggtcacaaggggtg

SEQ ID NO: 225413 - DNA, 20 bp, human
gttcctgggcagagccttat

SEQ ID NO: 225414 - DNA, 20 bp, human
gcctcttaggaaggcattaa

SEQ ID NO: 225415 - DNA, 20 bp, human
ggaactttgtctcatgtcta

SEQ ID NO: 225416 - DNA, 20 bp, human
gcggagccgggcggggttga

SEQ ID NO: 225417 - DNA, 20 bp, human
gacagcgcatgccccggggt

SEQ ID NO: 225418 - DNA, 20 bp, human
ggcgcacagcgcatgccccg

SEQ ID NO: 225419 - DNA, 20 bp, human
gtataaataaagcacgtaca

SEQ ID NO: 225420 - DNA, 20 bp, human
gaaatagcttagatacgatt

SEQ ID NO: 225421 - DNA, 20 bp, human
gtggtttttttcttctcggg

SEQ ID NO: 225422 - DNA, 20 bp, human
gatactgtataaaccaatac

SEQ ID NO: 225423 - DNA, 20 bp, human
gaaacaacactgttaaggcg

SEQ ID NO: 225424 - DNA, 20 bp, human
gttggttttactcaataaaa

SEQ ID NO: 225425 - DNA, 20 bp, human
gagaagaaaaaaaccagtat

SEQ ID NO: 225426 - DNA, 20 bp, human
gtccaggagcctttgtgtat

SEQ ID NO: 225427 - DNA, 20 bp, human
gaggtggagaataactcacc

SEQ ID NO: 225428 - DNA, 20 bp, human
gagaataactcaccagggag

SEQ ID NO: 225429 - DNA, 20 bp, human
gaggtaagcgtgatatgtcc

SEQ ID NO: 225430 - DNA, 20 bp, human
ggcccatacacaaaggctcc

SEQ ID NO: 225431 - DNA, 20 bp, human
gtacggggcccagtatgggg

SEQ ID NO: 225432 - DNA, 20 bp, human
gggatacggggcccagtatg

SEQ ID NO: 225433 - DNA, 20 bp, human
gtgcgtagctcctggaagtc

SEQ ID NO: 225434 - DNA, 20 bp, human
gtcccacgccgccccatact

SEQ ID NO: 225435 - DNA, 20 bp, human
ggggaagggcccatacacaa

SEQ ID NO: 225436 - DNA, 20 bp, human
gagcggctcctcttcccagt

SEQ ID NO: 225437 - DNA, 20 bp, human
gtcttaaaggggaaacggat

SEQ ID NO: 225438 - DNA, 20 bp, human
gggcaggattaggcatcgtg

SEQ ID NO: 225439 - DNA, 20 bp, human
ggctctcggtcgcccccaag

SEQ ID NO: 225440 - DNA, 20 bp, human
gcagtcggctggttcagcac

SEQ ID NO: 225441 - DNA, 20 bp, human
gttcccctttaagaccagag

SEQ ID NO: 225442 - DNA, 20 bp, human
ggctcctcttcccagtcggc

SEQ ID NO: 225443 - DNA, 20 bp, human
ggcgtctccgccttcttaaa

SEQ ID NO: 225444 - DNA, 20 bp, human
gttccgctctggtcttaaag

SEQ ID NO: 225445 - DNA, 20 bp, human
ggcggaagactacagtgaga

SEQ ID NO: 225446 - DNA, 20 bp, human
gcgcccgcgctcgccaccga

SEQ ID NO: 225447 - DNA, 20 bp, human
gcgccgcgagcccgcgtcgg

SEQ ID NO: 225448 - DNA, 20 bp, human
gcgtgcggcctcccggaagc

SEQ ID NO: 225449 - DNA, 20 bp, human
ggctgcggggcctcaaggag

SEQ ID NO: 225450 - DNA, 20 bp, human
gaggccgcacgcgcgcccgc

SEQ ID NO: 225451 - DNA, 20 bp, human
gcgccggaagcccccaccgc

SEQ ID NO: 225452 - DNA, 20 bp, human
gcggaagctggcctggttgt

SEQ ID NO: 225453 - DNA, 20 bp, human
gaaccaggccagcttccggg

SEQ ID NO: 225454 - DNA, 20 bp, human
gcgcggggcgtcctccgacg

SEQ ID NO: 225455 - DNA, 20 bp, human
gaaagccgaggaagccgaga

SEQ ID NO: 225456 - DNA, 20 bp, human
ggcagcggctgacaatggta

SEQ ID NO: 225457 - DNA, 20 bp, human
ggaggcgagccgattggcag

SEQ ID NO: 225458 - DNA, 20 bp, human
ggcggaacacacgtgaacgc

SEQ ID NO: 225459 - DNA, 20 bp, human
gacacacgtgaacgccggca

SEQ ID NO: 225460 - DNA, 20 bp, human
ggggcagatcttaaagacca

SEQ ID NO: 225461 - DNA, 20 bp, human
ggattggcagcggctgacaa

SEQ ID NO: 225462 - DNA, 20 bp, human
gcgcggcgaccaggaagtcc

SEQ ID NO: 225463 - DNA, 20 bp, human
gacaggaaaagcattttgat

SEQ ID NO: 225464 - DNA, 20 bp, human
gtcagaaagggcggggcgac

SEQ ID NO: 225465 - DNA, 20 bp, human
gttggggggggtacaattac

SEQ ID NO: 225466 - DNA, 20 bp, human
gcggccccgcccccgaaagt

SEQ ID NO: 225467 - DNA, 20 bp, human
gcgcgcttacgggattgggg

SEQ ID NO: 225468 - DNA, 20 bp, human
gcgcacttccgggattggag

SEQ ID NO: 225469 - DNA, 20 bp, human
ggagccgagccgactttcgg

SEQ ID NO: 225470 - DNA, 20 bp, human
gcgcgcgcttccgggattgg

SEQ ID NO: 225471 - DNA, 20 bp, human
gaaccacccgcctcctcctg

SEQ ID NO: 225472 - DNA, 20 bp, human
ggccgcaagcatttcctgga

SEQ ID NO: 225473 - DNA, 20 bp, human
gccgcccccgaaagtcggct

SEQ ID NO: 225474 - DNA, 20 bp, human
gcggatcccggaaatccgct

SEQ ID NO: 225475 - DNA, 20 bp, human
gggaccgctgtgctctcggt

SEQ ID NO: 225476 - DNA, 20 bp, human
ggggaacggagcaagatgtg

SEQ ID NO: 225477 - DNA, 20 bp, human
gcggggtcgagcgaagactt

SEQ ID NO: 225478 - DNA, 20 bp, human
gtgggatctggactagggaa

SEQ ID NO: 225479 - DNA, 20 bp, human
gatcctgacaccacctggta

SEQ ID NO: 225480 - DNA, 20 bp, human
ggcagccacccctaagaatg

SEQ ID NO: 225481 - DNA, 20 bp, human
gcaccacggcgtaacccagc

SEQ ID NO: 225482 - DNA, 20 bp, human
gacggcgtaacccagcaggc

SEQ ID NO: 225483 - DNA, 20 bp, human
ggatttgggacagaggtcta

SEQ ID NO: 225484 - DNA, 20 bp, human
gagcatctgacagtattctt

SEQ ID NO: 225485 - DNA, 20 bp, human
gtgacagtattcttgggaga

SEQ ID NO: 225486 - DNA, 20 bp, human
gtaaccgcgcgcaggagcgc

SEQ ID NO: 225487 - DNA, 20 bp, human
gctgcgattggcgggaagat

SEQ ID NO: 225488 - DNA, 20 bp, human
gcctgcgcgcggttagcttg

SEQ ID NO: 225489 - DNA, 20 bp, human
gcagctccgccgagggtcac

SEQ ID NO: 225490 - DNA, 20 bp, human
ggccctgggcggccgttacc

SEQ ID NO: 225491 - DNA, 20 bp, human
gggcgcgcggctgcgattgg

SEQ ID NO: 225492 - DNA, 20 bp, human
gtggcaagagggcgtgagga

SEQ ID NO: 225493 - DNA, 20 bp, human
ggggtcgtcctcaagcgccc

SEQ ID NO: 225494 - DNA, 20 bp, human
gcgggcgcctccgctggcga

SEQ ID NO: 225495 - DNA, 20 bp, human
ggcgcggttagcttggggag

SEQ ID NO: 225496 - DNA, 20 bp, human
gccagtagataccacagctg

SEQ ID NO: 225497 - DNA, 20 bp, human
gcctgtctggcttaactaga

SEQ ID NO: 225498 - DNA, 20 bp, human
gcctgtggtgaggcataaac

SEQ ID NO: 225499 - DNA, 20 bp, human
gtgttcttaggattattcac

SEQ ID NO: 225500 - DNA, 20 bp, human
gcaggtcttgatcctaacat

SEQ ID NO: 225501 - DNA, 20 bp, human
gaagtgactagctcaagtcc

SEQ ID NO: 225502 - DNA, 20 bp, human
gagcttgacagttcaccaga

SEQ ID NO: 225503 - DNA, 20 bp, human
gggcttaactagagggcctg

SEQ ID NO: 225504 - DNA, 20 bp, human
ggctgtggtatctactggcc

SEQ ID NO: 225505 - DNA, 20 bp, human
ggtttgctcactggacgagt

SEQ ID NO: 225506 - DNA, 20 bp, human
gcggagccagggctgacggg

SEQ ID NO: 225507 - DNA, 20 bp, human
gggaggaggctggagacgga

SEQ ID NO: 225508 - DNA, 20 bp, human
gccgccccgcccgtcagccc

SEQ ID NO: 225509 - DNA, 20 bp, human
gctggctccgcccagccacg

SEQ ID NO: 225510 - DNA, 20 bp, human
gtaacagtggggcgtttgag

SEQ ID NO: 225511 - DNA, 20 bp, human
ggggcgtttgagaggatgga

SEQ ID NO: 225512 - DNA, 20 bp, human
gccgccagcagggatgaagc

SEQ ID NO: 225513 - DNA, 20 bp, human
gcctccacccgcgcgaggta

SEQ ID NO: 225514 - DNA, 20 bp, human
gacggaccggcctgaggggg

SEQ ID NO: 225515 - DNA, 20 bp, human
ggcggccccgcgcgccggat

SEQ ID NO: 225516 - DNA, 20 bp, human
ggggcggtcgctggtaccca

SEQ ID NO: 225517 - DNA, 20 bp, human
gagcaggggagccttcctag

SEQ ID NO: 225518 - DNA, 20 bp, human
gaggtcgaggttgacccggc

SEQ ID NO: 225519 - DNA, 20 bp, human
gctgctgcacgggttcccca

SEQ ID NO: 225520 - DNA, 20 bp, human
gggaacccgtgcagcagccg

SEQ ID NO: 225521 - DNA, 20 bp, human
gaggctcccctgctccccgt

SEQ ID NO: 225522 - DNA, 20 bp, human
gtcaacctcgacctgcggca

SEQ ID NO: 225523 - DNA, 20 bp, human
gttgacccggccgggctggt

SEQ ID NO: 225524 - DNA, 20 bp, human
gcccaagagcaacctctgct

SEQ ID NO: 225525 - DNA, 20 bp, human
gaccgccgaccgctttacgg

SEQ ID NO: 225526 - DNA, 20 bp, human
gcatgcgtgggaagagacct

SEQ ID NO: 225527 - DNA, 20 bp, human
ggcgggaggtggacatgccg

SEQ ID NO: 225528 - DNA, 20 bp, human
gcctggggaccccaagtccg

SEQ ID NO: 225529 - DNA, 20 bp, human
gagcgcagtcccgacggtga

SEQ ID NO: 225530 - DNA, 20 bp, human
gaataagcgagtgactgggg

SEQ ID NO: 225531 - DNA, 20 bp, human
gctaacccaggcccagttct

SEQ ID NO: 225532 - DNA, 20 bp, human
gggggaccccaagtccgcgg

SEQ ID NO: 225533 - DNA, 20 bp, human
ggcgggctccgcgcatgcgt

SEQ ID NO: 225534 - DNA, 20 bp, human
ggcgccagccatggcctctg

SEQ ID NO: 225535 - DNA, 20 bp, human
gggaggtggacatgccgggg

SEQ ID NO: 225536 - DNA, 20 bp, human
gctgaagatagggtagttag

SEQ ID NO: 225537 - DNA, 20 bp, human
gggttcctgagctgaagata

SEQ ID NO: 225538 - DNA, 20 bp, human
gaggctgacacggtcgtcac

SEQ ID NO: 225539 - DNA, 20 bp, human
ggtggagatggcggtagaag

SEQ ID NO: 225540 - DNA, 20 bp, human
ggggtagttagaggctgaca

SEQ ID NO: 225541 - DNA, 20 bp, human
gagaggaacagactgagatc

SEQ ID NO: 225542 - DNA, 20 bp, human
ggactgagatctgggatatg

SEQ ID NO: 225543 - DNA, 20 bp, human
ggtagaaggggccagcagaa

SEQ ID NO: 225544 - DNA, 20 bp, human
gggaccaggctccaccaagt

SEQ ID NO: 225545 - DNA, 20 bp, human
gagcgagagtcacaatgtgg

SEQ ID NO: 225546 - DNA, 20 bp, human
gtctccccacaggggctgac

SEQ ID NO: 225547 - DNA, 20 bp, human
gcgggagcaggggagcggtt

SEQ ID NO: 225548 - DNA, 20 bp, human
gaacgcaggtgtgcgagggc

SEQ ID NO: 225549 - DNA, 20 bp, human
gggtaaaagcttgtcagtaa

SEQ ID NO: 225550 - DNA, 20 bp, human
ggtacgcctgtcagcccctg

SEQ ID NO: 225551 - DNA, 20 bp, human
gtcgcaggcaaggactggcc

SEQ ID NO: 225552 - DNA, 20 bp, human
ggcgttccgctggtttcccc

SEQ ID NO: 225553 - DNA, 20 bp, human
gttccccgggttcgcaggca

SEQ ID NO: 225554 - DNA, 20 bp, human
gcgtgcagccgtcggtatca

SEQ ID NO: 225555 - DNA, 20 bp, human
gggagtctcttctccccaca

SEQ ID NO: 225556 - DNA, 20 bp, human
ggttgtggggggcaccagtt

SEQ ID NO: 225557 - DNA, 20 bp, human
gacataatatagtaacatag

SEQ ID NO: 225558 - DNA, 20 bp, human
gctgataagttttgtgaacc

SEQ ID NO: 225559 - DNA, 20 bp, human
gttattattattattacccc

SEQ ID NO: 225560 - DNA, 20 bp, human
gtggtgccccccacaacatg

SEQ ID NO: 225561 - DNA, 20 bp, human
ggtgaaaggcatgtattata

SEQ ID NO: 225562 - DNA, 20 bp, human
ggacttcgttttctataagt

SEQ ID NO: 225563 - DNA, 20 bp, human
gctataagtgggaatagtaa

SEQ ID NO: 225564 - DNA, 20 bp, human
gttaacctctctgtgtgata

SEQ ID NO: 225565 - DNA, 20 bp, human
gcaaaccgtatcacacagag

SEQ ID NO: 225566 - DNA, 20 bp, human
gtgtcgctgttggttgctag

SEQ ID NO: 225567 - DNA, 20 bp, human
gaaccaacagcgacaagtgg

SEQ ID NO: 225568 - DNA, 20 bp, human
gggccaccacttgtcgctgt

SEQ ID NO: 225569 - DNA, 20 bp, human
gagcaaccaacagcgacaag

SEQ ID NO: 225570 - DNA, 20 bp, human
gcaacacagtatagcactgg

SEQ ID NO: 225571 - DNA, 20 bp, human
gcacaaggaacacagcactt

SEQ ID NO: 225572 - DNA, 20 bp, human
gtttgctcacgttcctgtcc

SEQ ID NO: 225573 - DNA, 20 bp, human
gacggtgtctgctgcccgaa

SEQ ID NO: 225574 - DNA, 20 bp, human
gaagcaggatgttggaaaac

SEQ ID NO: 225575 - DNA, 20 bp, human
ggatgttggaaaactggcaa

SEQ ID NO: 225576 - DNA, 20 bp, human
gtagttctctatgtcggcac

SEQ ID NO: 225577 - DNA, 20 bp, human
ggtggaatcagagtctctca

SEQ ID NO: 225578 - DNA, 20 bp, human
ggtaatctagttctctatgt

SEQ ID NO: 225579 - DNA, 20 bp, human
gagagaactagattacctag

SEQ ID NO: 225580 - DNA, 20 bp, human
gagtctctcagggtcaaact

SEQ ID NO: 225581 - DNA, 20 bp, human
ggaaatggggcaaaataatc

SEQ ID NO: 225582 - DNA, 20 bp, human
gacccaggaatagatctaat

SEQ ID NO: 225583 - DNA, 20 bp, human
gtcctgctcgagaaacctct

SEQ ID NO: 225584 - DNA, 20 bp, human
gacctagaggtttctcgagc

SEQ ID NO: 225585 - DNA, 20 bp, human
gcttcttctgacttcgctgc

SEQ ID NO: 225586 - DNA, 20 bp, human
ggcggggttaccagtcggtg

SEQ ID NO: 225587 - DNA, 20 bp, human
gaccacggcggcagcgacat

SEQ ID NO: 225588 - DNA, 20 bp, human
gtaaccccgcccacgggaag

SEQ ID NO: 225589 - DNA, 20 bp, human
ggagcagacgccggaagtag

SEQ ID NO: 225590 - DNA, 20 bp, human
gccgtggtaccgccctctcg

SEQ ID NO: 225591 - DNA, 20 bp, human
ggttaccagtcggtgcggtt

SEQ ID NO: 225592 - DNA, 20 bp, human
gcggcggcagcgacatgggg

SEQ ID NO: 225593 - DNA, 20 bp, human
gccacgggaagaggcgggct

SEQ ID NO: 225594 - DNA, 20 bp, human
gccactgcgcagccgcgaga

SEQ ID NO: 225595 - DNA, 20 bp, human
gcgtgggcggggttaccagt

SEQ ID NO: 225596 - DNA, 20 bp, human
ggcgaccccggggacaatga

SEQ ID NO: 225597 - DNA, 20 bp, human
ggggcgtgtgaggtctaaga

SEQ ID NO: 225598 - DNA, 20 bp, human
gatggagggtgtgagtgcag

SEQ ID NO: 225599 - DNA, 20 bp, human
gtcccggaggaactcggaga

SEQ ID NO: 225600 - DNA, 20 bp, human
gaggccttgcggcaccggag

SEQ ID NO: 225601 - DNA, 20 bp, human
gctcgcgtgtggggcgtgtg

SEQ ID NO: 225602 - DNA, 20 bp, human
gggaggaactcggagatgga

SEQ ID NO: 225603 - DNA, 20 bp, human
gtggcgcgtgcgattcccgg

SEQ ID NO: 225604 - DNA, 20 bp, human
ggcctcgggctctcgcgtgt

SEQ ID NO: 225605 - DNA, 20 bp, human
gaggcctccttaacccttca

SEQ ID NO: 225606 - DNA, 20 bp, human
gaggagaccggggtagtcaa

SEQ ID NO: 225607 - DNA, 20 bp, human
gtggcgggagaaaaccgggc

SEQ ID NO: 225608 - DNA, 20 bp, human
gacgctctaggtagctgcgg

SEQ ID NO: 225609 - DNA, 20 bp, human
gcagctacctagagcgtcgc

SEQ ID NO: 225610 - DNA, 20 bp, human
ggcgctaagggcggccttct

SEQ ID NO: 225611 - DNA, 20 bp, human
ggcggggcctgcgggaacta

SEQ ID NO: 225612 - DNA, 20 bp, human
gcgccgccgccccctggtgg

SEQ ID NO: 225613 - DNA, 20 bp, human
gctggtggcgggagaaaacc

SEQ ID NO: 225614 - DNA, 20 bp, human
ggagaaggcgggactgagcg

SEQ ID NO: 225615 - DNA, 20 bp, human
gggggcggcggcgctaaggg

SEQ ID NO: 225616 - DNA, 20 bp, human
gagggcccgccctaccgtga

SEQ ID NO: 225617 - DNA, 20 bp, human
gggacaagagccaattgcgg

SEQ ID NO: 225618 - DNA, 20 bp, human
gtccgccggccaatccctca

SEQ ID NO: 225619 - DNA, 20 bp, human
ggaagcggggcagaccggga

SEQ ID NO: 225620 - DNA, 20 bp, human
gtgtctgtgctctgggactt

SEQ ID NO: 225621 - DNA, 20 bp, human
ggacccgcgcagtgattgga

SEQ ID NO: 225622 - DNA, 20 bp, human
gggccctccaatcactgcgc

SEQ ID NO: 225623 - DNA, 20 bp, human
gtaagatggcggcctccagg

SEQ ID NO: 225624 - DNA, 20 bp, human
gcggccaatccctcacggta

SEQ ID NO: 225625 - DNA, 20 bp, human
gccgccctaccgtgagggat

SEQ ID NO: 225626 - DNA, 20 bp, human
gggagggagcgtgcgcgggt

SEQ ID NO: 225627 - DNA, 20 bp, human
ggggtccgggctaacgtcac

SEQ ID NO: 225628 - DNA, 20 bp, human
gggccccggcgctggtattg

SEQ ID NO: 225629 - DNA, 20 bp, human
gtgtgtctgtgtgcggaatg

SEQ ID NO: 225630 - DNA, 20 bp, human
gtgccccaataccagcgccg

SEQ ID NO: 225631 - DNA, 20 bp, human
ggcgcgggtgggatcgcgag

SEQ ID NO: 225632 - DNA, 20 bp, human
gcacacacgtggacccggcg

SEQ ID NO: 225633 - DNA, 20 bp, human
ggctggtattggggcagcga

SEQ ID NO: 225634 - DNA, 20 bp, human
gacacgtggacccggcgcgg

SEQ ID NO: 225635 - DNA, 20 bp, human
ggcgcgggagggagcgtgcg

SEQ ID NO: 225636 - DNA, 20 bp, human
gtgcgcatgcgtacatctgt

SEQ ID NO: 225637 - DNA, 20 bp, human
gcgcacaccgctgtgtgcca

SEQ ID NO: 225638 - DNA, 20 bp, human
gcatgcgtgcttccgtcttt

SEQ ID NO: 225639 - DNA, 20 bp, human
gcggagtgctaggtacgcag

SEQ ID NO: 225640 - DNA, 20 bp, human
gcatgcgtgcttccatctgt

SEQ ID NO: 225641 - DNA, 20 bp, human
gtgccaaggtcgccaaaaga

SEQ ID NO: 225642 - DNA, 20 bp, human
gcatgcgcacatcgctgtgc

SEQ ID NO: 225643 - DNA, 20 bp, human
ggcgcacaccgcggtccgtg

SEQ ID NO: 225644 - DNA, 20 bp, human
gcggtccgtggggcaccggg

SEQ ID NO: 225645 - DNA, 20 bp, human
gtgccggtatcgccaacaga

SEQ ID NO: 225646 - DNA, 20 bp, human
gagggcccaccggtcaaccc

SEQ ID NO: 225647 - DNA, 20 bp, human
gctgactatgcaagaggagt

SEQ ID NO: 225648 - DNA, 20 bp, human
gagactggataaccgattgt

SEQ ID NO: 225649 - DNA, 20 bp, human
gtcctcttgcatagtcagtc

SEQ ID NO: 225650 - DNA, 20 bp, human
gacttcccccacggccttaa

SEQ ID NO: 225651 - DNA, 20 bp, human
ggttgaccggtgggccctta

SEQ ID NO: 225652 - DNA, 20 bp, human
gcggtgggcccttaaggccg

SEQ ID NO: 225653 - DNA, 20 bp, human
gctcaccccgggttgaccgg

SEQ ID NO: 225654 - DNA, 20 bp, human
gctcccccagttttccttta

SEQ ID NO: 225655 - DNA, 20 bp, human
gaaatagcatgtaataccgt

SEQ ID NO: 225656 - DNA, 20 bp, human
gaggcccctgggatgctccc

SEQ ID NO: 225657 - DNA, 20 bp, human
gcagtggggagataacctgg

SEQ ID NO: 225658 - DNA, 20 bp, human
gggccccgccctggtagctg

SEQ ID NO: 225659 - DNA, 20 bp, human
gtgctgtaccgggcctgccg

SEQ ID NO: 225660 - DNA, 20 bp, human
ggatcccgggctcacgtggt

SEQ ID NO: 225661 - DNA, 20 bp, human
gcacttctctggggattgag

SEQ ID NO: 225662 - DNA, 20 bp, human
gctgagtctaagccctggtc

SEQ ID NO: 225663 - DNA, 20 bp, human
ggactgctgagtctaagccc

SEQ ID NO: 225664 - DNA, 20 bp, human
gccactgcaggcacccaccc

SEQ ID NO: 225665 - DNA, 20 bp, human
gggggaggccaggaactagg

SEQ ID NO: 225666 - DNA, 20 bp, human
gccaaggggtggaactgagg

SEQ ID NO: 225667 - DNA, 20 bp, human
gaggccaaggggtggaactg

SEQ ID NO: 225668 - DNA, 20 bp, human
gtggcctgccgggtcctctc

SEQ ID NO: 225669 - DNA, 20 bp, human
gaccgtaggcagacaggttc

SEQ ID NO: 225670 - DNA, 20 bp, human
ggtgcctgagaggacccggc

SEQ ID NO: 225671 - DNA, 20 bp, human
gcaagccagactggacgcga

SEQ ID NO: 225672 - DNA, 20 bp, human
gcggcagggcaatcacaaaa

SEQ ID NO: 225673 - DNA, 20 bp, human
ggaggacccggcaggccaag

SEQ ID NO: 225674 - DNA, 20 bp, human
gtgagtccggacaccaacga

SEQ ID NO: 225675 - DNA, 20 bp, human
gtccggaagcagcttgagtc

SEQ ID NO: 225676 - DNA, 20 bp, human
gcctcccgctgcagaccgcg

SEQ ID NO: 225677 - DNA, 20 bp, human
gcagctgcgccggagacctc

SEQ ID NO: 225678 - DNA, 20 bp, human
gccggcgccttcacgccccg

SEQ ID NO: 225679 - DNA, 20 bp, human
gacgccccgcggtctgcagc

SEQ ID NO: 225680 - DNA, 20 bp, human
gctcgggcgccagtctccag

SEQ ID NO: 225681 - DNA, 20 bp, human
ggccggagacctctggagac

SEQ ID NO: 225682 - DNA, 20 bp, human
gtcaacagaaggagggagcg

SEQ ID NO: 225683 - DNA, 20 bp, human
gagctgggctcggggagact

SEQ ID NO: 225684 - DNA, 20 bp, human
gtctccccgagcccagctat

SEQ ID NO: 225685 - DNA, 20 bp, human
gacagcgccatctggcgcga

SEQ ID NO: 225686 - DNA, 20 bp, human
gccaatgggcgccttcaacg

SEQ ID NO: 225687 - DNA, 20 bp, human
gaagcctcgccgcgcccctt

SEQ ID NO: 225688 - DNA, 20 bp, human
gacgcagcagtgttgcccaa

SEQ ID NO: 225689 - DNA, 20 bp, human
gcagtgttgcccaaggggcg

SEQ ID NO: 225690 - DNA, 20 bp, human
gccttcaacggggacgacaa

SEQ ID NO: 225691 - DNA, 20 bp, human
ggcgcccattggctcggctg

SEQ ID NO: 225692 - DNA, 20 bp, human
gggcgaggcttccggctctg

SEQ ID NO: 225693 - DNA, 20 bp, human
gggcgcgcttgcgtcaaccc

SEQ ID NO: 225694 - DNA, 20 bp, human
gacaatgtccgcacttccgg

SEQ ID NO: 225695 - DNA, 20 bp, human
gcgcagcgaagcttttagtt

SEQ ID NO: 225696 - DNA, 20 bp, human
gagaactgggtgtatgagcg

SEQ ID NO: 225697 - DNA, 20 bp, human
gaacgcatacacccttcaca

SEQ ID NO: 225698 - DNA, 20 bp, human
gactatggagcgctcgagga

SEQ ID NO: 225699 - DNA, 20 bp, human
gaaagtgagcaatgattagg

SEQ ID NO: 225700 - DNA, 20 bp, human
gactctgagttctccgagtt

SEQ ID NO: 225701 - DNA, 20 bp, human
gcgaggagggcgctactatc

SEQ ID NO: 225702 - DNA, 20 bp, human
ggaaaaagcaaggccggcca

SEQ ID NO: 225703 - DNA, 20 bp, human
gctggctcgaatagaggggc

SEQ ID NO: 225704 - DNA, 20 bp, human
ggggagaggctggaggattc

SEQ ID NO: 225705 - DNA, 20 bp, human
gtattcgagccagcccaact

SEQ ID NO: 225706 - DNA, 20 bp, human
ggaaggaagaacactgtagg

SEQ ID NO: 225707 - DNA, 20 bp, human
gtccacaagcgccctccctc

SEQ ID NO: 225708 - DNA, 20 bp, human
gcgggcgcgagcggagatga

SEQ ID NO: 225709 - DNA, 20 bp, human
gaaggagggtgtcttttcga

SEQ ID NO: 225710 - DNA, 20 bp, human
ggggagtgccccctgggcga

SEQ ID NO: 225711 - DNA, 20 bp, human
gccaacatggcgccggcctg

SEQ ID NO: 225712 - DNA, 20 bp, human
gctgaggcggcgacaggaag

SEQ ID NO: 225713 - DNA, 20 bp, human
gagctctgctgtgactgcgg

SEQ ID NO: 225714 - DNA, 20 bp, human
gtcgcgggacgcggcggagg

SEQ ID NO: 225715 - DNA, 20 bp, human
gaacaggcctgagctttcgg

SEQ ID NO: 225716 - DNA, 20 bp, human
gaagaggagagcactgaagc

SEQ ID NO: 225717 - DNA, 20 bp, human
gaaagctggttcgtggggat

SEQ ID NO: 225718 - DNA, 20 bp, human
gtggttcgtggggattggat

SEQ ID NO: 225719 - DNA, 20 bp, human
gtgaagctggcgcgggaact

SEQ ID NO: 225720 - DNA, 20 bp, human
gggtccacaggggaaaacgg

SEQ ID NO: 225721 - DNA, 20 bp, human
ggcgaagcggaatggtccac

SEQ ID NO: 225722 - DNA, 20 bp, human
gaaaacgctgcgaagcggaa

SEQ ID NO: 225723 - DNA, 20 bp, human
gagcgaaagtgatgtgggcg

SEQ ID NO: 225724 - DNA, 20 bp, human
gactggagcgaaagtgatgt

SEQ ID NO: 225725 - DNA, 20 bp, human
gagagcactgaagctggcgc

SEQ ID NO: 225726 - DNA, 20 bp, human
gcaggctgagagaatctcac

SEQ ID NO: 225727 - DNA, 20 bp, human
ggggccgggacacaaggttc

SEQ ID NO: 225728 - DNA, 20 bp, human
gagctccggcgctgaagccc

SEQ ID NO: 225729 - DNA, 20 bp, human
gccagctttcccgccttcga

SEQ ID NO: 225730 - DNA, 20 bp, human
gaaccgaccaaagctggtca

SEQ ID NO: 225731 - DNA, 20 bp, human
gggagagcgcgggaaatact

SEQ ID NO: 225732 - DNA, 20 bp, human
gttagccggggcttcagcgc

SEQ ID NO: 225733 - DNA, 20 bp, human
gaatctcacagggcttcact

SEQ ID NO: 225734 - DNA, 20 bp, human
gttctggccgccctcgaagg

SEQ ID NO: 225735 - DNA, 20 bp, human
gaagcgtggtgcaagctcgt

SEQ ID NO: 225736 - DNA, 20 bp, human
gcccgagggcggtcggaacg

SEQ ID NO: 225737 - DNA, 20 bp, human
ggctcctcccctctccccga

SEQ ID NO: 225738 - DNA, 20 bp, human
ggggaaccacgcgggcttcc

SEQ ID NO: 225739 - DNA, 20 bp, human
gccgaccgccctcggggaga

SEQ ID NO: 225740 - DNA, 20 bp, human
gaagcccgcgtggttccccg

SEQ ID NO: 225741 - DNA, 20 bp, human
ggggcagcgtctggctgcgg

SEQ ID NO: 225742 - DNA, 20 bp, human
gaacgggcagcgtctggctg

SEQ ID NO: 225743 - DNA, 20 bp, human
gggcggggcgtggttaaggc

SEQ ID NO: 225744 - DNA, 20 bp, human
ggagggcggtcggaacgcgg

SEQ ID NO: 225745 - DNA, 20 bp, human
ggtcacgtggtgggcggggt

SEQ ID NO: 225746 - DNA, 20 bp, human
gcgcccggggccaccatctt

SEQ ID NO: 225747 - DNA, 20 bp, human
ggggctacgcagggtcccta

SEQ ID NO: 225748 - DNA, 20 bp, human
gtacgaggccgccccctcgg

SEQ ID NO: 225749 - DNA, 20 bp, human
ggggggcgggactttgtcga

SEQ ID NO: 225750 - DNA, 20 bp, human
ggggcgcggcgagggacacg

SEQ ID NO: 225751 - DNA, 20 bp, human
gtggccccgggcggtggaca

SEQ ID NO: 225752 - DNA, 20 bp, human
ggggcgggacttttgccgag

SEQ ID NO: 225753 - DNA, 20 bp, human
gggggcggcctcgtacccta

SEQ ID NO: 225754 - DNA, 20 bp, human
gcgtccgccggaggccacgt

SEQ ID NO: 225755 - DNA, 20 bp, human
gtagcccggcgatccttgga

SEQ ID NO: 225756 - DNA, 20 bp, human
gcacctgcctccaggaccgc

SEQ ID NO: 225757 - DNA, 20 bp, human
gcgacccccggctcccccta

SEQ ID NO: 225758 - DNA, 20 bp, human
ggcgcccggagaagagtcct

SEQ ID NO: 225759 - DNA, 20 bp, human
gggtgcccagcagcgacccc

SEQ ID NO: 225760 - DNA, 20 bp, human
ggagctgcgcccggccttag

SEQ ID NO: 225761 - DNA, 20 bp, human
ggggccctggcttgggttgc

SEQ ID NO: 225762 - DNA, 20 bp, human
ggttcccaggactcttctcc

SEQ ID NO: 225763 - DNA, 20 bp, human
ggaggtccccgcggtcctgg

SEQ ID NO: 225764 - DNA, 20 bp, human
ggcagctcggagccaggagc

SEQ ID NO: 225765 - DNA, 20 bp, human
gggcccggcgcgtggcttcc

SEQ ID NO: 225766 - DNA, 20 bp, human
ggggagactacagtgtaaga

SEQ ID NO: 225767 - DNA, 20 bp, human
gggggaactatgcatgcgga

SEQ ID NO: 225768 - DNA, 20 bp, human
gaggactgacctcacactgg

SEQ ID NO: 225769 - DNA, 20 bp, human
gggtcagcatggttccatga

SEQ ID NO: 225770 - DNA, 20 bp, human
gtacactgtagtctccccat

SEQ ID NO: 225771 - DNA, 20 bp, human
gagtgtgcagattagtgagg

SEQ ID NO: 225772 - DNA, 20 bp, human
gtgcagtgtgcagattagtg

SEQ ID NO: 225773 - DNA, 20 bp, human
ggcaaggactgacctcacac

SEQ ID NO: 225774 - DNA, 20 bp, human
gttgttggaaatcacggatg

SEQ ID NO: 225775 - DNA, 20 bp, human
ggtgcaggcatgatgagacc

SEQ ID NO: 225776 - DNA, 20 bp, human
gaggcccggagcccgcccgt

SEQ ID NO: 225777 - DNA, 20 bp, human
ggacgaagcaagttccgcgg

SEQ ID NO: 225778 - DNA, 20 bp, human
gagcccgcccgtgggagtcc

SEQ ID NO: 225779 - DNA, 20 bp, human
gtgacagcgcgcataggggc

SEQ ID NO: 225780 - DNA, 20 bp, human
ggccggggctcaccaggcgg

SEQ ID NO: 225781 - DNA, 20 bp, human
gcggaggcggagcttgacgc

SEQ ID NO: 225782 - DNA, 20 bp, human
ggggcactgtgggtagcgcc

SEQ ID NO: 225783 - DNA, 20 bp, human
gcctatgcgcgctgtcagtc

SEQ ID NO: 225784 - DNA, 20 bp, human
gggcccggcggaagcggtgg

SEQ ID NO: 225785 - DNA, 20 bp, human
gctccaagggatcaggacgg

SEQ ID NO: 225786 - DNA, 20 bp, human
ggggctccgccccgtcttaa

SEQ ID NO: 225787 - DNA, 20 bp, human
ggctgagatccgagtctcaa

SEQ ID NO: 225788 - DNA, 20 bp, human
ggggcactatccctttaaga

SEQ ID NO: 225789 - DNA, 20 bp, human
gcggcccgccgctcatcgcg

SEQ ID NO: 225790 - DNA, 20 bp, human
gaggttcgggttcgcctgag

SEQ ID NO: 225791 - DNA, 20 bp, human
ggtggtgcatgagcactcgg

SEQ ID NO: 225792 - DNA, 20 bp, human
gtgcaccaccaggctccctt

SEQ ID NO: 225793 - DNA, 20 bp, human
gggagccccgcgatgagcgg

SEQ ID NO: 225794 - DNA, 20 bp, human
gccagcaccgtccccgaggt

SEQ ID NO: 225795 - DNA, 20 bp, human
ggtgctcccgtcagccacat

SEQ ID NO: 225796 - DNA, 20 bp, human
ggtccctgggacctcaggac

SEQ ID NO: 225797 - DNA, 20 bp, human
gttcacctcgcccggtcctg

SEQ ID NO: 225798 - DNA, 20 bp, human
gcgccccgccggaagggaag

SEQ ID NO: 225799 - DNA, 20 bp, human
gccccccgcacccgccgcgg

SEQ ID NO: 225800 - DNA, 20 bp, human
gcgaggtgaatcgtgccgat

SEQ ID NO: 225801 - DNA, 20 bp, human
gcggcacgattcacctcgcc

SEQ ID NO: 225802 - DNA, 20 bp, human
ggccgcgcacgtgaccgcgt

SEQ ID NO: 225803 - DNA, 20 bp, human
ggccccccgccccgccggaa

SEQ ID NO: 225804 - DNA, 20 bp, human
gaggggagtccgtgcccccc

SEQ ID NO: 225805 - DNA, 20 bp, human
gagcgggcgcgccgccaacg

SEQ ID NO: 225806 - DNA, 20 bp, human
gggtgccgggcaatgagtca

SEQ ID NO: 225807 - DNA, 20 bp, human
gaggggaggccgactgaggg

SEQ ID NO: 225808 - DNA, 20 bp, human
gtcccctgaggcaccaaggc

SEQ ID NO: 225809 - DNA, 20 bp, human
gggaggaagctgtattgtcg

SEQ ID NO: 225810 - DNA, 20 bp, human
gcctcaggggaggccgactg

SEQ ID NO: 225811 - DNA, 20 bp, human
gggcctcccctgaggcacca

SEQ ID NO: 225812 - DNA, 20 bp, human
ggggctctgtggatggcatt

SEQ ID NO: 225813 - DNA, 20 bp, human
ggccagccttggtgcctcag

SEQ ID NO: 225814 - DNA, 20 bp, human
ggctgagacctgcccgttgg

SEQ ID NO: 225815 - DNA, 20 bp, human
gagcgctgagacctgcccgt

SEQ ID NO: 225816 - DNA, 20 bp, human
gcccagggctgacagccggg

SEQ ID NO: 225817 - DNA, 20 bp, human
gggacaggatgtaaccggga

SEQ ID NO: 225818 - DNA, 20 bp, human
ggcagaggacaggatgtaac

SEQ ID NO: 225819 - DNA, 20 bp, human
gtaaccgggagggaacagcc

SEQ ID NO: 225820 - DNA, 20 bp, human
gctgaaagtcaatagcccca

SEQ ID NO: 225821 - DNA, 20 bp, human
gctgcccgcccgcagaggac

SEQ ID NO: 225822 - DNA, 20 bp, human
gagcgcacagaacacggtgg

SEQ ID NO: 225823 - DNA, 20 bp, human
gcagagctggcccaccgtag

SEQ ID NO: 225824 - DNA, 20 bp, human
gccactgtcagaccgcagcc

SEQ ID NO: 225825 - DNA, 20 bp, human
gtaggggagcgcacagaaca

SEQ ID NO: 225826 - DNA, 20 bp, human
gcgggtctgatgtgtgtttg

SEQ ID NO: 225827 - DNA, 20 bp, human
gtcagacccgcgcacctctc

SEQ ID NO: 225828 - DNA, 20 bp, human
gctggcctcacaggaggagt

SEQ ID NO: 225829 - DNA, 20 bp, human
gtgcagaaccgcaaccagag

SEQ ID NO: 225830 - DNA, 20 bp, human
gtgcggttctgcagattaga

SEQ ID NO: 225831 - DNA, 20 bp, human
gctcctgtgaggccagatcg

SEQ ID NO: 225832 - DNA, 20 bp, human
gttccccgatctggcctcac

SEQ ID NO: 225833 - DNA, 20 bp, human
gcgcaaccagagaggtgcgc

SEQ ID NO: 225834 - DNA, 20 bp, human
gaactcctgggaatgagaca

SEQ ID NO: 225835 - DNA, 20 bp, human
gcccgccaactcctcctgtg

SEQ ID NO: 225836 - DNA, 20 bp, human
ggcctcccgcagcgccggat

SEQ ID NO: 225837 - DNA, 20 bp, human
ggccctggcggggatttgaa

SEQ ID NO: 225838 - DNA, 20 bp, human
gtctgacgccacagcctatc

SEQ ID NO: 225839 - DNA, 20 bp, human
gtaggctgtggcgtcagaaa

SEQ ID NO: 225840 - DNA, 20 bp, human
gagggcggacgtttccgccc

SEQ ID NO: 225841 - DNA, 20 bp, human
gccaataagagaacggataa

SEQ ID NO: 225842 - DNA, 20 bp, human
gactggttgccaagaacgac

SEQ ID NO: 225843 - DNA, 20 bp, human
gagcaccgagggcgtgaacc

SEQ ID NO: 225844 - DNA, 20 bp, human
gcgcagcgccggataggctg

SEQ ID NO: 225845 - DNA, 20 bp, human
gaaggactgggcgagcaccg

SEQ ID NO: 225846 - DNA, 20 bp, human
gagcgggggcggggcgaatg

SEQ ID NO: 225847 - DNA, 20 bp, human
gtagccccgccccttcgggt

SEQ ID NO: 225848 - DNA, 20 bp, human
gggaaccaacccgaaggggc

SEQ ID NO: 225849 - DNA, 20 bp, human
gaatgagggaaccaacccga

SEQ ID NO: 225850 - DNA, 20 bp, human
gcatgccgggaagagcggtc

SEQ ID NO: 225851 - DNA, 20 bp, human
gaaaaaaacccgcgagacgg

SEQ ID NO: 225852 - DNA, 20 bp, human
gggaggagcccccgtctcgc

SEQ ID NO: 225853 - DNA, 20 bp, human
gcgagtcgggcgccaagcgc

SEQ ID NO: 225854 - DNA, 20 bp, human
ggactccgggaaggccgctc

SEQ ID NO: 225855 - DNA, 20 bp, human
gcttcccggcatgcattgtt

SEQ ID NO: 225856 - DNA, 20 bp, human
gcacaatcgcggggtgtcat

SEQ ID NO: 225857 - DNA, 20 bp, human
gacaccccgcgattgtgatt

SEQ ID NO: 225858 - DNA, 20 bp, human
ggcgccccgaatcacaatcg

SEQ ID NO: 225859 - DNA, 20 bp, human
ggggagcggtagttccgggg

SEQ ID NO: 225860 - DNA, 20 bp, human
gtcgcggggtgtcatgggag

SEQ ID NO: 225861 - DNA, 20 bp, human
gtatgacctgagggtcccat

SEQ ID NO: 225862 - DNA, 20 bp, human
gctgcggcgcggggcacgtt

SEQ ID NO: 225863 - DNA, 20 bp, human
gaactcgcgattatgacctg

SEQ ID NO: 225864 - DNA, 20 bp, human
gagggtcccattggtcgctg

SEQ ID NO: 225865 - DNA, 20 bp, human
gcatgggagcggtagttccg

SEQ ID NO: 225866 - DNA, 20 bp, human
ggggcaggctagcgggtcag

SEQ ID NO: 225867 - DNA, 20 bp, human
gaacccagagctagggcata

SEQ ID NO: 225868 - DNA, 20 bp, human
gcatagggctaagaaggtca

SEQ ID NO: 225869 - DNA, 20 bp, human
gcaggctagcgggtcagggg

SEQ ID NO: 225870 - DNA, 20 bp, human
gggggaggaacccagagcta

SEQ ID NO: 225871 - DNA, 20 bp, human
ggaggaggacggaggagcta

SEQ ID NO: 225872 - DNA, 20 bp, human
gcccacagactcatctggcc

SEQ ID NO: 225873 - DNA, 20 bp, human
gcggagccagagtctgacaa

SEQ ID NO: 225874 - DNA, 20 bp, human
gccagatgagtctgtgggca

SEQ ID NO: 225875 - DNA, 20 bp, human
gggctaagaaggtcaggggc

SEQ ID NO: 225876 - DNA, 20 bp, human
gcgggaagagcgcgtgtcgg

SEQ ID NO: 225877 - DNA, 20 bp, human
gccaacgcgcacgccgccta

SEQ ID NO: 225878 - DNA, 20 bp, human
gcccacggcggcgtggatgg

SEQ ID NO: 225879 - DNA, 20 bp, human
gctgctgcaagcgcaggcgc

SEQ ID NO: 225880 - DNA, 20 bp, human
ggctcccacggcggcgtgga

SEQ ID NO: 225881 - DNA, 20 bp, human
gggcggcgtgcgcgttggag

SEQ ID NO: 225882 - DNA, 20 bp, human
ggcgcttgcagcagctccca

SEQ ID NO: 225883 - DNA, 20 bp, human
gctgacctgcggctgcacga

SEQ ID NO: 225884 - DNA, 20 bp, human
gacaccagccacctgcgaga

SEQ ID NO: 225885 - DNA, 20 bp, human
gggaaaagcagcgcgggcgg

SEQ ID NO: 225886 - DNA, 20 bp, human
gggagcgccgggccgacggt

SEQ ID NO: 225887 - DNA, 20 bp, human
gtggggctgggtctcggagt

SEQ ID NO: 225888 - DNA, 20 bp, human
gcactctcgctggtgtcggt

SEQ ID NO: 225889 - DNA, 20 bp, human
gtcacgtgaccgcccaccgt

SEQ ID NO: 225890 - DNA, 20 bp, human
ggcggcgcggccaatgagaa

SEQ ID NO: 225891 - DNA, 20 bp, human
ggcgccgggccgacggtggg

SEQ ID NO: 225892 - DNA, 20 bp, human
gggcggtcacgtgatggtta

SEQ ID NO: 225893 - DNA, 20 bp, human
ggttacgactgcactctcgc

SEQ ID NO: 225894 - DNA, 20 bp, human
ggccgcactctcgctggtgg

SEQ ID NO: 225895 - DNA, 20 bp, human
gcagcctggaaggtgcgtgt

SEQ ID NO: 225896 - DNA, 20 bp, human
ggtgcctgagacaaggccca

SEQ ID NO: 225897 - DNA, 20 bp, human
ggcacaagcgatgatggtgg

SEQ ID NO: 225898 - DNA, 20 bp, human
gtcaccgcccaggaatagcc

SEQ ID NO: 225899 - DNA, 20 bp, human
gggctaggggctcaccgccc

SEQ ID NO: 225900 - DNA, 20 bp, human
gcttttccagccaacctttt

SEQ ID NO: 225901 - DNA, 20 bp, human
gatcgcttgtgcctgagaca

SEQ ID NO: 225902 - DNA, 20 bp, human
gaggaatgttcctgggctag

SEQ ID NO: 225903 - DNA, 20 bp, human
gtctcaggcacaagcgatga

SEQ ID NO: 225904 - DNA, 20 bp, human
gctctggcatgcagacagac

SEQ ID NO: 225905 - DNA, 20 bp, human
gagctggcaggaagtcagcc

SEQ ID NO: 225906 - DNA, 20 bp, human
gcgaggagacgctgtctctg

SEQ ID NO: 225907 - DNA, 20 bp, human
gtctctggggctgacaaaaa

SEQ ID NO: 225908 - DNA, 20 bp, human
gaggcggggcccaagccgaa

SEQ ID NO: 225909 - DNA, 20 bp, human
ggggctgacaaaaaggggca

SEQ ID NO: 225910 - DNA, 20 bp, human
ggggactatttgcgcggcag

SEQ ID NO: 225911 - DNA, 20 bp, human
gtgaagagaaaggaccccga

SEQ ID NO: 225912 - DNA, 20 bp, human
ggccgcgcaaatagtcccag

SEQ ID NO: 225913 - DNA, 20 bp, human
ggggtccggcccttcggctt

SEQ ID NO: 225914 - DNA, 20 bp, human
gccagtgtggagattgacag

SEQ ID NO: 225915 - DNA, 20 bp, human
gtgaagacagcatcaaagat

SEQ ID NO: 225916 - DNA, 20 bp, human
gacctgggccggcgtggctg

SEQ ID NO: 225917 - DNA, 20 bp, human
gggggcggagcgcacctgtg

SEQ ID NO: 225918 - DNA, 20 bp, human
gacgggtaggcgagacgcgc

SEQ ID NO: 225919 - DNA, 20 bp, human
gagtggcttcccaacgggag

SEQ ID NO: 225920 - DNA, 20 bp, human
gaccggaagtggcttcccaa

SEQ ID NO: 225921 - DNA, 20 bp, human
ggagtcggttggagtctgac

SEQ ID NO: 225922 - DNA, 20 bp, human
ggttgctgtcaggtctgagt

SEQ ID NO: 225923 - DNA, 20 bp, human
gaggacccccaagacggaag

SEQ ID NO: 225924 - DNA, 20 bp, human
gactcccgggctcttaacgt

SEQ ID NO: 225925 - DNA, 20 bp, human
gatagaaagaggacaggcgc

SEQ ID NO: 225926 - DNA, 20 bp, human
gatccactacactacccttg

SEQ ID NO: 225927 - DNA, 20 bp, human
gggaaccatgggatacagcg

SEQ ID NO: 225928 - DNA, 20 bp, human
ggaaaaacgcaagaactcac

SEQ ID NO: 225929 - DNA, 20 bp, human
gtagtgtagtggatcacagt

SEQ ID NO: 225930 - DNA, 20 bp, human
ggaactcacgggatacaacg

SEQ ID NO: 225931 - DNA, 20 bp, human
gagggtgtggcactcacctc

SEQ ID NO: 225932 - DNA, 20 bp, human
gtccgccccgctgtatccca

SEQ ID NO: 225933 - DNA, 20 bp, human
gaaagagacagcatcccaca

SEQ ID NO: 225934 - DNA, 20 bp, human
gagtcgtagccggaaggcac

SEQ ID NO: 225935 - DNA, 20 bp, human
gaaaaactcagactaggtta

SEQ ID NO: 225936 - DNA, 20 bp, human
gtctacggaccaatcagtga

SEQ ID NO: 225937 - DNA, 20 bp, human
gaagaggcgggactccaaaa

SEQ ID NO: 225938 - DNA, 20 bp, human
gggaaggaggtgggctttca

SEQ ID NO: 225939 - DNA, 20 bp, human
ggggcgccacggaaggaggt

SEQ ID NO: 225940 - DNA, 20 bp, human
gtctggcgggggtaagaggc

SEQ ID NO: 225941 - DNA, 20 bp, human
ggcgctgcggtgtcttccgg

SEQ ID NO: 225942 - DNA, 20 bp, human
gagaaaacgcagctctggcg

SEQ ID NO: 225943 - DNA, 20 bp, human
gcagctctggcgggggtaag

SEQ ID NO: 225944 - DNA, 20 bp, human
gacccgggcgccacggaagg

SEQ ID NO: 225945 - DNA, 20 bp, human
gtagacccgggcgccacgga

SEQ ID NO: 225946 - DNA, 20 bp, human
ggagggaggtgtttcaggat

SEQ ID NO: 225947 - DNA, 20 bp, human
gcaccaatgggaaggatctg

SEQ ID NO: 225948 - DNA, 20 bp, human
gaggaaacagaagtacccgg

SEQ ID NO: 225949 - DNA, 20 bp, human
gtgcccgcgccggaggcgag

SEQ ID NO: 225950 - DNA, 20 bp, human
ggacgactgcctgcccgaca

SEQ ID NO: 225951 - DNA, 20 bp, human
gcaaacacgccctgtcgggc

SEQ ID NO: 225952 - DNA, 20 bp, human
gtccggcgcgggcacagaga

SEQ ID NO: 225953 - DNA, 20 bp, human
gaggtgtttcaggattggct

SEQ ID NO: 225954 - DNA, 20 bp, human
gccgacagggcgtgtttgat

SEQ ID NO: 225955 - DNA, 20 bp, human
ggagaggggcggggctgata

SEQ ID NO: 225956 - DNA, 20 bp, human
ggagcccagtggccgcgctc

SEQ ID NO: 225957 - DNA, 20 bp, human
ggggagttgtagtttcggct

SEQ ID NO: 225958 - DNA, 20 bp, human
ggcaccggagcgcggccact

SEQ ID NO: 225959 - DNA, 20 bp, human
ggcccgaggcggaagtggga

SEQ ID NO: 225960 - DNA, 20 bp, human
ggggcggtgctgactgtcgc

SEQ ID NO: 225961 - DNA, 20 bp, human
gctcccggcaggtagtgcgt

SEQ ID NO: 225962 - DNA, 20 bp, human
ggcctcgggcgccgccgcac

SEQ ID NO: 225963 - DNA, 20 bp, human
gcgcccacgcactacctgcc

SEQ ID NO: 225964 - DNA, 20 bp, human
gtggccgcgctccggtgcgg

SEQ ID NO: 225965 - DNA, 20 bp, human
gagagcgcgcgcaggtgtga

SEQ ID NO: 225966 - DNA, 20 bp, human
gccccagggtgcgagagtcg

SEQ ID NO: 225967 - DNA, 20 bp, human
gcccgcccaccggaaggtgt

SEQ ID NO: 225968 - DNA, 20 bp, human
gcacgtccccgcccaccgga

SEQ ID NO: 225969 - DNA, 20 bp, human
ggtcgtggatccctgaaaag

SEQ ID NO: 225970 - DNA, 20 bp, human
ggtggatccctgaaaagagg

SEQ ID NO: 225971 - DNA, 20 bp, human
gctcccaagagcctcttgat

SEQ ID NO: 225972 - DNA, 20 bp, human
gtctgcccacaccttccggt

SEQ ID NO: 225973 - DNA, 20 bp, human
gaggagggtgaggtccatcc

SEQ ID NO: 225974 - DNA, 20 bp, human
ggatgaggaaatctggaggt

SEQ ID NO: 225975 - DNA, 20 bp, human
gccccgatcaagaggctctt

SEQ ID NO: 225976 - DNA, 20 bp, human
ggccctggacgggaacaaga

SEQ ID NO: 225977 - DNA, 20 bp, human
gggacgggaacaagaagggt

SEQ ID NO: 225978 - DNA, 20 bp, human
gtggccggccgcagggtagg

SEQ ID NO: 225979 - DNA, 20 bp, human
gtgaagcgggtactgagcgt

SEQ ID NO: 225980 - DNA, 20 bp, human
ggcagcggaagggcctgctc

SEQ ID NO: 225981 - DNA, 20 bp, human
gggacctcccggcctgtagg

SEQ ID NO: 225982 - DNA, 20 bp, human
gaaaggggaaccaagaccgc

SEQ ID NO: 225983 - DNA, 20 bp, human
gaagaagggtgggcttgact

SEQ ID NO: 225984 - DNA, 20 bp, human
gcaaggaaaaacacgatcgg

SEQ ID NO: 225985 - DNA, 20 bp, human
gacgccccctacaggccggg

SEQ ID NO: 225986 - DNA, 20 bp, human
gggagcgcgcagacctcgga

SEQ ID NO: 225987 - DNA, 20 bp, human
ggccccgggtctgcaccctg

SEQ ID NO: 225988 - DNA, 20 bp, human
ggggccgcatcagaaggccg

SEQ ID NO: 225989 - DNA, 20 bp, human
gtcgccgcggccttctgatg

SEQ ID NO: 225990 - DNA, 20 bp, human
gcggcggagcgcgcagacct

SEQ ID NO: 225991 - DNA, 20 bp, human
ggtagctaggacagagactc

SEQ ID NO: 225992 - DNA, 20 bp, human
ggtctgcgcgctccgccgca

SEQ ID NO: 225993 - DNA, 20 bp, human
ggcggcgcggcctctgcagt

SEQ ID NO: 225994 - DNA, 20 bp, human
gagacccggggcgcccgcct

SEQ ID NO: 225995 - DNA, 20 bp, human
ggtttggggcgcaagagcag

SEQ ID NO: 225996 - DNA, 20 bp, human
ggcggcgcgtgtgcaggggt

SEQ ID NO: 225997 - DNA, 20 bp, human
ggcgtgcggcgcgtgtgcag

SEQ ID NO: 225998 - DNA, 20 bp, human
ggggagggacccgcctaggg

SEQ ID NO: 225999 - DNA, 20 bp, human
ggcctctggccgtgtcctgg

SEQ ID NO: 226000 - DNA, 20 bp, human
gcagtcggaggctcccgggg

SEQ ID NO: 226001 - DNA, 20 bp, human
gagaggccacctccctaggc

SEQ ID NO: 226002 - DNA, 20 bp, human
gacccccaggacacggccag

SEQ ID NO: 226003 - DNA, 20 bp, human
gggtggattcctagagtgga

SEQ ID NO: 226004 - DNA, 20 bp, human
gggtggggagggacccgcct

SEQ ID NO: 226005 - DNA, 20 bp, human
ggtggcctctggccgtgtcc

SEQ ID NO: 226006 - DNA, 20 bp, human
ggatgagcgggtgtggctga

SEQ ID NO: 226007 - DNA, 20 bp, human
gagccacacccgctcatcca

SEQ ID NO: 226008 - DNA, 20 bp, human
gggtctgaggagtgactggc

SEQ ID NO: 226009 - DNA, 20 bp, human
gtccctcgccctggatgagc

SEQ ID NO: 226010 - DNA, 20 bp, human
gcggggcatcccgggagcaa

SEQ ID NO: 226011 - DNA, 20 bp, human
gacccgctcatccagggcga

SEQ ID NO: 226012 - DNA, 20 bp, human
gcgcccccgcgaggcacggc

SEQ ID NO: 226013 - DNA, 20 bp, human
gccctcccgcagagcacact

SEQ ID NO: 226014 - DNA, 20 bp, human
gcccgcgctttccctcgccc

SEQ ID NO: 226015 - DNA, 20 bp, human
ggtcctccgcgcgacggcgg

SEQ ID NO: 226016 - DNA, 20 bp, human
ggaggggtcaggcctgagac

SEQ ID NO: 226017 - DNA, 20 bp, human
gtgagcgcccctgaggggtc

SEQ ID NO: 226018 - DNA, 20 bp, human
gctcaggcctgacccctcag

SEQ ID NO: 226019 - DNA, 20 bp, human
ggaagtagcaaggtccaggg

SEQ ID NO: 226020 - DNA, 20 bp, human
ggtggagagtaaagggcaga

SEQ ID NO: 226021 - DNA, 20 bp, human
gtgtgcgtggtggagagtaa

SEQ ID NO: 226022 - DNA, 20 bp, human
gtctctgaagagtggacttt

SEQ ID NO: 226023 - DNA, 20 bp, human
gccctggggagctgtgtgcg

SEQ ID NO: 226024 - DNA, 20 bp, human
gaacctcaactctgctcaca

SEQ ID NO: 226025 - DNA, 20 bp, human
gatacccataggcaagtcca

SEQ ID NO: 226026 - DNA, 20 bp, human
gaagggctgcggtctcgcag

SEQ ID NO: 226027 - DNA, 20 bp, human
gtgggagtcgtggtgtcttg

SEQ ID NO: 226028 - DNA, 20 bp, human
gcccggccctggcaccgtga

SEQ ID NO: 226029 - DNA, 20 bp, human
ggcccgacgcaaggtcctct

SEQ ID NO: 226030 - DNA, 20 bp, human
gctcccagaggaccttgcgt

SEQ ID NO: 226031 - DNA, 20 bp, human
gtctcgcagcggagggccgc

SEQ ID NO: 226032 - DNA, 20 bp, human
ggaaagaggcgtcaggtgcc

SEQ ID NO: 226033 - DNA, 20 bp, human
ggctgcggtctcgcagcgga

SEQ ID NO: 226034 - DNA, 20 bp, human
gcgcccgcgcgggggaccaa

SEQ ID NO: 226035 - DNA, 20 bp, human
ggggcgcgggtggatctctc

SEQ ID NO: 226036 - DNA, 20 bp, human
gcggggtgaggtggcctcga

SEQ ID NO: 226037 - DNA, 20 bp, human
ggtgaggtggcctcgaggga

SEQ ID NO: 226038 - DNA, 20 bp, human
gtcctcccagctgcggggtg

SEQ ID NO: 226039 - DNA, 20 bp, human
gtggttgccgagacactggg

SEQ ID NO: 226040 - DNA, 20 bp, human
gcactgccaggtggggtccg

SEQ ID NO: 226041 - DNA, 20 bp, human
gtaaaggccacccagtgtct

SEQ ID NO: 226042 - DNA, 20 bp, human
gtctatgcaccccccacctg

SEQ ID NO: 226043 - DNA, 20 bp, human
ggccacctcaccccgcagct

SEQ ID NO: 226044 - DNA, 20 bp, human
gcctgcgatcgaaggggcag

SEQ ID NO: 226045 - DNA, 20 bp, human
gacctcaccccgcagctggg

SEQ ID NO: 226046 - DNA, 20 bp, human
gaccgcccgggagccgtggg

SEQ ID NO: 226047 - DNA, 20 bp, human
gcccccccacggctcccggg

SEQ ID NO: 226048 - DNA, 20 bp, human
gttaacaggagactgacaga

SEQ ID NO: 226049 - DNA, 20 bp, human
gggccaatgggagagagcgt

SEQ ID NO: 226050 - DNA, 20 bp, human
gccgcgcgacccctcccggc

SEQ ID NO: 226051 - DNA, 20 bp, human
gctagaccccgcctccacac

SEQ ID NO: 226052 - DNA, 20 bp, human
gacggcgaagagcggccaat

SEQ ID NO: 226053 - DNA, 20 bp, human
gactgacagacggcgaagag

SEQ ID NO: 226054 - DNA, 20 bp, human
gggaacgcgagtcgcgaccc

SEQ ID NO: 226055 - DNA, 20 bp, human
gggaggcggggtctagtcgc

SEQ ID NO: 226056 - DNA, 20 bp, human
ggtccccagggcagggtgca

SEQ ID NO: 226057 - DNA, 20 bp, human
gctcccggagggagagcgat

SEQ ID NO: 226058 - DNA, 20 bp, human
gcctgcagcagggatcacaa

SEQ ID NO: 226059 - DNA, 20 bp, human
gaccgcctgtgccttatcac

SEQ ID NO: 226060 - DNA, 20 bp, human
gaggggcaggatgcccaatc

SEQ ID NO: 226061 - DNA, 20 bp, human
gtggctgcgacctcccgtcc

SEQ ID NO: 226062 - DNA, 20 bp, human
ggttacacaggtccagagtc

SEQ ID NO: 226063 - DNA, 20 bp, human
gcagagtctggcctcccgga

SEQ ID NO: 226064 - DNA, 20 bp, human
gcctgtgtaacaattaactg

SEQ ID NO: 226065 - DNA, 20 bp, human
gataaggcacaggcggtccc

SEQ ID NO: 226066 - DNA, 20 bp, human
ggttgcatcaggcgaatgtc

SEQ ID NO: 226067 - DNA, 20 bp, human
gggtgccccgcattgcacaa

SEQ ID NO: 226068 - DNA, 20 bp, human
gattgactggggatcagtgg

SEQ ID NO: 226069 - DNA, 20 bp, human
ggtggtgcgatagttgcatc

SEQ ID NO: 226070 - DNA, 20 bp, human
ggggggcattgggagaggac

SEQ ID NO: 226071 - DNA, 20 bp, human
ggatcccggcgtggcctagc

SEQ ID NO: 226072 - DNA, 20 bp, human
gcacgtggcaagtatgtggg

SEQ ID NO: 226073 - DNA, 20 bp, human
gccccacgtggcaagtatgt

SEQ ID NO: 226074 - DNA, 20 bp, human
ggccccaggaagcgtgatcc

SEQ ID NO: 226075 - DNA, 20 bp, human
gtgtccggctaggccacgcc

SEQ ID NO: 226076 - DNA, 20 bp, human
gagtgaaagcatgaatgggc

SEQ ID NO: 226077 - DNA, 20 bp, human
gggaaccggtgagtaagcgg

SEQ ID NO: 226078 - DNA, 20 bp, human
gctcttatctagtggctccg

SEQ ID NO: 226079 - DNA, 20 bp, human
gttgtgaggcggggcgacag

SEQ ID NO: 226080 - DNA, 20 bp, human
ggccggaaccggtgagtaag

SEQ ID NO: 226081 - DNA, 20 bp, human
gcaagagtgaaagcatgaat

SEQ ID NO: 226082 - DNA, 20 bp, human
ggggcgaccgggtaagagcg

SEQ ID NO: 226083 - DNA, 20 bp, human
gttggtgtaagggtgctgag

SEQ ID NO: 226084 - DNA, 20 bp, human
gcctggtaactgggcctcca

SEQ ID NO: 226085 - DNA, 20 bp, human
ggttctgcaggtggggtcta

SEQ ID NO: 226086 - DNA, 20 bp, human
ggggaggggctcgtactcgg

SEQ ID NO: 226087 - DNA, 20 bp, human
gccagcgccggaaaagatgg

SEQ ID NO: 226088 - DNA, 20 bp, human
gcagacggaactgtgggcga

SEQ ID NO: 226089 - DNA, 20 bp, human
gtactcggggggtgatttag

SEQ ID NO: 226090 - DNA, 20 bp, human
gctggccgggcgaggctcgt

SEQ ID NO: 226091 - DNA, 20 bp, human
ggcgccggaaaagatggcgg

SEQ ID NO: 226092 - DNA, 20 bp, human
ggaggggaggggctcgtact

SEQ ID NO: 226093 - DNA, 20 bp, human
gttagaaccgggcctccaga

SEQ ID NO: 226094 - DNA, 20 bp, human
ggcggtcccggggatagcag

SEQ ID NO: 226095 - DNA, 20 bp, human
ggaagtgaagcggatctgag

SEQ ID NO: 226096 - DNA, 20 bp, human
gtagctcagacccatgttgt

SEQ ID NO: 226097 - DNA, 20 bp, human
ggggaagcgccgctcgtggc

SEQ ID NO: 226098 - DNA, 20 bp, human
ggcgagcagcgtgagatcat

SEQ ID NO: 226099 - DNA, 20 bp, human
gttgtgggagacgattgcgg

SEQ ID NO: 226100 - DNA, 20 bp, human
gcaatcgtctcccacaacat

SEQ ID NO: 226101 - DNA, 20 bp, human
ggagtgttagccgggtacaa

SEQ ID NO: 226102 - DNA, 20 bp, human
gctccttaactcttctccaa

SEQ ID NO: 226103 - DNA, 20 bp, human
gctagaggcagacaataaaa

SEQ ID NO: 226104 - DNA, 20 bp, human
gtgcctttggagaagagtta

SEQ ID NO: 226105 - DNA, 20 bp, human
ggagaagagttaaggagcag

SEQ ID NO: 226106 - DNA, 20 bp, human
ggcgaaggggtctgggaagt

SEQ ID NO: 226107 - DNA, 20 bp, human
ggctccgccctaatgcgaag

SEQ ID NO: 226108 - DNA, 20 bp, human
gtacagcaggatcagaaatg

SEQ ID NO: 226109 - DNA, 20 bp, human
gacggcgacgtgaggaagcg

SEQ ID NO: 226110 - DNA, 20 bp, human
gagcgccaggagacttcggg

SEQ ID NO: 226111 - DNA, 20 bp, human
gccaggccgtggcccgccta

SEQ ID NO: 226112 - DNA, 20 bp, human
gcccagaccccttcgcatta

SEQ ID NO: 226113 - DNA, 20 bp, human
ggtagcagacacaagccgca

SEQ ID NO: 226114 - DNA, 20 bp, human
ggccctaatgcgaaggggtc

SEQ ID NO: 226115 - DNA, 20 bp, human
gctgcgccataggcgggcca

SEQ ID NO: 226116 - DNA, 20 bp, human
gtgcccgcccgcgcaggcgt

SEQ ID NO: 226117 - DNA, 20 bp, human
gcgcccgcgcaggcgtcgga

SEQ ID NO: 226118 - DNA, 20 bp, human
ggagagcgtccgggtcacgc

SEQ ID NO: 226119 - DNA, 20 bp, human
gctggacgcccgttgggtaa

SEQ ID NO: 226120 - DNA, 20 bp, human
gggcggggtaaaggagccgg

SEQ ID NO: 226121 - DNA, 20 bp, human
gacgctctcctttacccaac

SEQ ID NO: 226122 - DNA, 20 bp, human
gtgggtaaaggagagcgtcc

SEQ ID NO: 226123 - DNA, 20 bp, human
gcgcgaaggcgggggtagtg

SEQ ID NO: 226124 - DNA, 20 bp, human
gaaaggagccggcggctggg

SEQ ID NO: 226125 - DNA, 20 bp, human
gggcccttccgacgcctgcg

SEQ ID NO: 226126 - DNA, 20 bp, human
ggccactggggaagttcagg

SEQ ID NO: 226127 - DNA, 20 bp, human
ggccccagcaacagctggtg

SEQ ID NO: 226128 - DNA, 20 bp, human
gtcccacaccagctgttgct

SEQ ID NO: 226129 - DNA, 20 bp, human
gctccaccccacatcctcac

SEQ ID NO: 226130 - DNA, 20 bp, human
ggaagcacagaacaccagag

SEQ ID NO: 226131 - DNA, 20 bp, human
gcacagaacaccagagcgga

SEQ ID NO: 226132 - DNA, 20 bp, human
gttcagcaagactgggacat

SEQ ID NO: 226133 - DNA, 20 bp, human
gagggggcaggtctgaagaa

SEQ ID NO: 226134 - DNA, 20 bp, human
gttaaagattccttccgctc

SEQ ID NO: 226135 - DNA, 20 bp, human
gtaggaagggatgtgaaact

SEQ ID NO: 226136 - DNA, 20 bp, human
ggggagaacacgctgtcctg

SEQ ID NO: 226137 - DNA, 20 bp, human
gttactgtaaatgagacggg

SEQ ID NO: 226138 - DNA, 20 bp, human
gcatgggaggggaccgtcag

SEQ ID NO: 226139 - DNA, 20 bp, human
gagcctgctggtccatggga

SEQ ID NO: 226140 - DNA, 20 bp, human
gccttcccgcctctggggaa

SEQ ID NO: 226141 - DNA, 20 bp, human
gctccccacagctgctgagt

SEQ ID NO: 226142 - DNA, 20 bp, human
ggccactgggaggataatgg

SEQ ID NO: 226143 - DNA, 20 bp, human
gaaagcccttcccgcctctg

SEQ ID NO: 226144 - DNA, 20 bp, human
ggggaagggaacttccgctt

SEQ ID NO: 226145 - DNA, 20 bp, human
ggagctgtggatgttccccc

SEQ ID NO: 226146 - DNA, 20 bp, human
gccggcgctctgacgaccta

SEQ ID NO: 226147 - DNA, 20 bp, human
ggcaagaaagctccggaatc

SEQ ID NO: 226148 - DNA, 20 bp, human
ggcccgggaagcctcgaatc

SEQ ID NO: 226149 - DNA, 20 bp, human
gtgggtaagcggccactaga

SEQ ID NO: 226150 - DNA, 20 bp, human
gggagactccggtgcagccc

SEQ ID NO: 226151 - DNA, 20 bp, human
gcagcgcagcaagaaagctc

SEQ ID NO: 226152 - DNA, 20 bp, human
gcaggtggaaagtgggtaag

SEQ ID NO: 226153 - DNA, 20 bp, human
gaagcctcgaatccggattc

SEQ ID NO: 226154 - DNA, 20 bp, human
gagagggaattaaacagctt

SEQ ID NO: 226155 - DNA, 20 bp, human
gcgccctctgctggagactc

SEQ ID NO: 226156 - DNA, 20 bp, human
gcggacccctgcccaggtat

SEQ ID NO: 226157 - DNA, 20 bp, human
gtgggggagggcacgagaag

SEQ ID NO: 226158 - DNA, 20 bp, human
ggagaggggaagcagatctg

SEQ ID NO: 226159 - DNA, 20 bp, human
gtgtggatggggtattgctg

SEQ ID NO: 226160 - DNA, 20 bp, human
gacaccgtgtcctcttgcct

SEQ ID NO: 226161 - DNA, 20 bp, human
ggcagtcagtgtccgaaatg

SEQ ID NO: 226162 - DNA, 20 bp, human
ggacactgactgccggtggg

SEQ ID NO: 226163 - DNA, 20 bp, human
gaaggaaggcgagctcccga

SEQ ID NO: 226164 - DNA, 20 bp, human
gagaggacacggtgtctgag

SEQ ID NO: 226165 - DNA, 20 bp, human
gtcggacactgactgccggt

SEQ ID NO: 226166 - DNA, 20 bp, human
gaggtgggcggggcataagg

SEQ ID NO: 226167 - DNA, 20 bp, human
gcgcggctctgggctctcta

SEQ ID NO: 226168 - DNA, 20 bp, human
ggctctgggctctctagggg

SEQ ID NO: 226169 - DNA, 20 bp, human
gaggcgcccgcggcccaatt

SEQ ID NO: 226170 - DNA, 20 bp, human
gaaagaagagactgagtacg

SEQ ID NO: 226171 - DNA, 20 bp, human
gggcggggccggcgcctaat

SEQ ID NO: 226172 - DNA, 20 bp, human
gagacccgagaggcgctcca

SEQ ID NO: 226173 - DNA, 20 bp, human
gccggcgcctaattgggccg

SEQ ID NO: 226174 - DNA, 20 bp, human
gcaaggaggcgggaggagtc

SEQ ID NO: 226175 - DNA, 20 bp, human
ggcggtggcccggctcaagg

SEQ ID NO: 226176 - DNA, 20 bp, human
ggaggacgccgccagatagg

SEQ ID NO: 226177 - DNA, 20 bp, human
gtcctcggcagaggcggtga

SEQ ID NO: 226178 - DNA, 20 bp, human
gcgggcgcggtcccaagccg

SEQ ID NO: 226179 - DNA, 20 bp, human
gaaggcgcggttccccctgg

SEQ ID NO: 226180 - DNA, 20 bp, human
gctggcggcgtcctcggcag

SEQ ID NO: 226181 - DNA, 20 bp, human
gtaggaggctgatgacatga

SEQ ID NO: 226182 - DNA, 20 bp, human
gcgcccgctgcgcccacttg

SEQ ID NO: 226183 - DNA, 20 bp, human
ggtcccaagccggggcacat

SEQ ID NO: 226184 - DNA, 20 bp, human
ggctcccaggagccacaagt

SEQ ID NO: 226185 - DNA, 20 bp, human
ggagccacaagtgggcgcag

SEQ ID NO: 226186 - DNA, 20 bp, human
gccatcgcttggttcagcaa

SEQ ID NO: 226187 - DNA, 20 bp, human
ggcgcgccggagcaatttat

SEQ ID NO: 226188 - DNA, 20 bp, human
gaggtcctgctggacccacc

SEQ ID NO: 226189 - DNA, 20 bp, human
gagaggaaggggagccgctt

SEQ ID NO: 226190 - DNA, 20 bp, human
gtaccacctgccaggagaag

SEQ ID NO: 226191 - DNA, 20 bp, human
gcacctccaccctccaactg

SEQ ID NO: 226192 - DNA, 20 bp, human
gagcagccccagttggaggg

SEQ ID NO: 226193 - DNA, 20 bp, human
gctcctggcaggtggtaccc

SEQ ID NO: 226194 - DNA, 20 bp, human
gaagcgatggcaggtcctgc

SEQ ID NO: 226195 - DNA, 20 bp, human
ggccagcagccccagttgga

SEQ ID NO: 226196 - DNA, 20 bp, human
gaacccgctcagagccggga

SEQ ID NO: 226197 - DNA, 20 bp, human
gcagagccgggaaggaacct

SEQ ID NO: 226198 - DNA, 20 bp, human
gcggcgggagccactataag

SEQ ID NO: 226199 - DNA, 20 bp, human
gaaaagtaaagatacagcgg

SEQ ID NO: 226200 - DNA, 20 bp, human
gaaggaacctaggggcagtg

SEQ ID NO: 226201 - DNA, 20 bp, human
ggctctgagcgggttcttca

SEQ ID NO: 226202 - DNA, 20 bp, human
ggcccagagtgggaagtgcg

SEQ ID NO: 226203 - DNA, 20 bp, human
gacagcgatgggataaagag

SEQ ID NO: 226204 - DNA, 20 bp, human
gcgcctctggccgcttatag

SEQ ID NO: 226205 - DNA, 20 bp, human
gcccgggcgcgggtggtatg

SEQ ID NO: 226206 - DNA, 20 bp, human
gagtctggaggtccgtccag

SEQ ID NO: 226207 - DNA, 20 bp, human
ggaggtccgtccagaggcgg

SEQ ID NO: 226208 - DNA, 20 bp, human
gccgctgtggccaaccctga

SEQ ID NO: 226209 - DNA, 20 bp, human
ggggcacccccatcctgcgg

SEQ ID NO: 226210 - DNA, 20 bp, human
gaatgccccccgcaggatgg

SEQ ID NO: 226211 - DNA, 20 bp, human
gcggggggcattctcgtccg

SEQ ID NO: 226212 - DNA, 20 bp, human
gcagcctggcgggctcccca

SEQ ID NO: 226213 - DNA, 20 bp, human
ggcgcggcgcggggcacaca

SEQ ID NO: 226214 - DNA, 20 bp, human
gtcgctgctcacatctggct

SEQ ID NO: 226215 - DNA, 20 bp, human
gctggaggtccgtccagagg

SEQ ID NO: 226216 - DNA, 20 bp, human
gcacacctttgcaaacgcgt

SEQ ID NO: 226217 - DNA, 20 bp, human
ggcagtgctgatgacaactc

SEQ ID NO: 226218 - DNA, 20 bp, human
gaggctctcccgcccatgac

SEQ ID NO: 226219 - DNA, 20 bp, human
gggcgggagagccttcctcc

SEQ ID NO: 226220 - DNA, 20 bp, human
gaaactggagggcacatcag

SEQ ID NO: 226221 - DNA, 20 bp, human
ggccttcctcccggtcacgt

SEQ ID NO: 226222 - DNA, 20 bp, human
ggccagcccacgtgaccggg

SEQ ID NO: 226223 - DNA, 20 bp, human
gagcttgttagcgtatttgg

SEQ ID NO: 226224 - DNA, 20 bp, human
gtagagcttgttagcgtatt

SEQ ID NO: 226225 - DNA, 20 bp, human
ggagtgtgatgataaatcat

SEQ ID NO: 226226 - DNA, 20 bp, human
gaaaacatacacaaccagct

SEQ ID NO: 226227 - DNA, 20 bp, human
gcacaaatcgttcttgcttg

SEQ ID NO: 226228 - DNA, 20 bp, human
gtgtcgtgaaagccctgaat

SEQ ID NO: 226229 - DNA, 20 bp, human
ggaatgggggctgttctgcc

SEQ ID NO: 226230 - DNA, 20 bp, human
gaatttcctggcaagcacaa

SEQ ID NO: 226231 - DNA, 20 bp, human
gtcgttcttgcttgtggtgt

SEQ ID NO: 226232 - DNA, 20 bp, human
gcttcaacagaaacgtgcca

SEQ ID NO: 226233 - DNA, 20 bp, human
gctgccactggtatccggaa

SEQ ID NO: 226234 - DNA, 20 bp, human
gaaaacactgagcaggattc

SEQ ID NO: 226235 - DNA, 20 bp, human
gcagttaagcctgaatttcc

SEQ ID NO: 226236 - DNA, 20 bp, human
ggggctagagctggactcag

SEQ ID NO: 226237 - DNA, 20 bp, human
gcccagaggacgaagctcta

SEQ ID NO: 226238 - DNA, 20 bp, human
ggctcggcgcagactccgtg

SEQ ID NO: 226239 - DNA, 20 bp, human
gtcctctgggtctagagagc

SEQ ID NO: 226240 - DNA, 20 bp, human
gccagaggcagcagctaacg

SEQ ID NO: 226241 - DNA, 20 bp, human
gaggcgggggagagacggga

SEQ ID NO: 226242 - DNA, 20 bp, human
gctctctccccacactagga

SEQ ID NO: 226243 - DNA, 20 bp, human
gtctaaggaggtcacagatg

SEQ ID NO: 226244 - DNA, 20 bp, human
gccgagcgagagcgaagagg

SEQ ID NO: 226245 - DNA, 20 bp, human
ggggcgagctgcggggccta

SEQ ID NO: 226246 - DNA, 20 bp, human
gggcggccggccaaagttta

SEQ ID NO: 226247 - DNA, 20 bp, human
gtgagggtggagagttctag

SEQ ID NO: 226248 - DNA, 20 bp, human
ggggagccccagagaaggat

SEQ ID NO: 226249 - DNA, 20 bp, human
gctctggccctgggaacagg

SEQ ID NO: 226250 - DNA, 20 bp, human
gacagccagttggatcccta

SEQ ID NO: 226251 - DNA, 20 bp, human
ggaagagaagtcctcagctg

SEQ ID NO: 226252 - DNA, 20 bp, human
ggaggcagaacttcgagaga

SEQ ID NO: 226253 - DNA, 20 bp, human
ggcccctgtcctaggcccta

SEQ ID NO: 226254 - DNA, 20 bp, human
gccaaagtttagggggagaa

SEQ ID NO: 226255 - DNA, 20 bp, human
gctcctctggccctgggaac

SEQ ID NO: 226256 - DNA, 20 bp, human
gtgtgcggggatgtgacgag

SEQ ID NO: 226257 - DNA, 20 bp, human
gttcttaaaggcacaggcgg

SEQ ID NO: 226258 - DNA, 20 bp, human
gacagggtggcagttcttaa

SEQ ID NO: 226259 - DNA, 20 bp, human
ggaggtcaagcccctggcac

SEQ ID NO: 226260 - DNA, 20 bp, human
gaaactaggtgctctgtgcg

SEQ ID NO: 226261 - DNA, 20 bp, human
gagaaggtgcccaggtcttg

SEQ ID NO: 226262 - DNA, 20 bp, human
gcactgagtgagcacttagg

SEQ ID NO: 226263 - DNA, 20 bp, human
gaactgccaccctgtgccag

SEQ ID NO: 226264 - DNA, 20 bp, human
gcactcagtgccttgggtga

SEQ ID NO: 226265 - DNA, 20 bp, human
gaaggcccctggtagatcac

SEQ ID NO: 226266 - DNA, 20 bp, human
ggttctgcggagataaaggg

SEQ ID NO: 226267 - DNA, 20 bp, human
gtgggttctgcggagataaa

SEQ ID NO: 226268 - DNA, 20 bp, human
gcagagcaggcaggagtctg

SEQ ID NO: 226269 - DNA, 20 bp, human
gcccttcctgagcaacctag

SEQ ID NO: 226270 - DNA, 20 bp, human
ggaatcaagcaagaccccac

SEQ ID NO: 226271 - DNA, 20 bp, human
ggcggagataaagggaggca

SEQ ID NO: 226272 - DNA, 20 bp, human
gatggggcacaggagcccct

SEQ ID NO: 226273 - DNA, 20 bp, human
gccccctgatgattgggaaa

SEQ ID NO: 226274 - DNA, 20 bp, human
gtcaccaaagagttaagcaa

SEQ ID NO: 226275 - DNA, 20 bp, human
ggggctgaggactgcagttc

SEQ ID NO: 226276 - DNA, 20 bp, human
gtcccagcacaacaatgaga

SEQ ID NO: 226277 - DNA, 20 bp, human
gagatcagggcacctctgac

SEQ ID NO: 226278 - DNA, 20 bp, human
gggaaatagcacagtgagtc

SEQ ID NO: 226279 - DNA, 20 bp, human
gccacagcgtcattgcacgc

SEQ ID NO: 226280 - DNA, 20 bp, human
gaagggccatgtccagtgat

SEQ ID NO: 226281 - DNA, 20 bp, human
gtagaaagaaacgatgccca

SEQ ID NO: 226282 - DNA, 20 bp, human
gtcgctccccaaatcatatt

SEQ ID NO: 226283 - DNA, 20 bp, human
gcgggctcgatcaaacaatc

SEQ ID NO: 226284 - DNA, 20 bp, human
gacaatcaggagatctgtgt

SEQ ID NO: 226285 - DNA, 20 bp, human
gaatgtcgacgtcttctttc

SEQ ID NO: 226286 - DNA, 20 bp, human
gaggccacaacacacagaga

SEQ ID NO: 226287 - DNA, 20 bp, human
gtgcacagcacatagaatga

SEQ ID NO: 226288 - DNA, 20 bp, human
gtcctgaaacattcactcag

SEQ ID NO: 226289 - DNA, 20 bp, human
gagtgcctgctttccttcag

SEQ ID NO: 226290 - DNA, 20 bp, human
gaggtagagcctttagattc

SEQ ID NO: 226291 - DNA, 20 bp, human
ggacctaggatggtgtcttg

SEQ ID NO: 226292 - DNA, 20 bp, human
ggctctaaacttaccactga

SEQ ID NO: 226293 - DNA, 20 bp, human
gtgaacactgtccctattct

SEQ ID NO: 226294 - DNA, 20 bp, human
ggacgactagtcatatgctt

SEQ ID NO: 226295 - DNA, 20 bp, human
ggcctttagattctggacct

SEQ ID NO: 226296 - DNA, 20 bp, human
gctggtgcggggcctcccca

SEQ ID NO: 226297 - DNA, 20 bp, human
gagggctgtgcgtcacccgg

SEQ ID NO: 226298 - DNA, 20 bp, human
gtggggcccggcgtcttggc

SEQ ID NO: 226299 - DNA, 20 bp, human
ggggccccagccccgctcat

SEQ ID NO: 226300 - DNA, 20 bp, human
ggcgcccaggcgggcatgaa

SEQ ID NO: 226301 - DNA, 20 bp, human
gcaggcttcgcagtggacac

SEQ ID NO: 226302 - DNA, 20 bp, human
gcctcagggcgccgcacccc

SEQ ID NO: 226303 - DNA, 20 bp, human
gcagccccgctcatgggcac

SEQ ID NO: 226304 - DNA, 20 bp, human
gagcaggcttggtttcccga

SEQ ID NO: 226305 - DNA, 20 bp, human
gccgctcatgggcacggggc

SEQ ID NO: 226306 - DNA, 20 bp, human
gaaggctgctaactgttaag

SEQ ID NO: 226307 - DNA, 20 bp, human
gttacagcaacacgtaaatc

SEQ ID NO: 226308 - DNA, 20 bp, human
gctgctaactgttaagtggc

SEQ ID NO: 226309 - DNA, 20 bp, human
ggtaggaattctaatggtcc

SEQ ID NO: 226310 - DNA, 20 bp, human
ggaaaatctaattaagcggt

SEQ ID NO: 226311 - DNA, 20 bp, human
gatctgaaaatctaattaag

SEQ ID NO: 226312 - DNA, 20 bp, human
gatatgaaagaaacctgcct

SEQ ID NO: 226313 - DNA, 20 bp, human
gtaagcggtaggaattctaa

SEQ ID NO: 226314 - DNA, 20 bp, human
gtgaaaaagaaaggagttaa

SEQ ID NO: 226315 - DNA, 20 bp, human
gctgggtctcatttggatcc

SEQ ID NO: 226316 - DNA, 20 bp, human
gaaaggaggaagtggagagc

SEQ ID NO: 226317 - DNA, 20 bp, human
gctccacttcctccttttaa

SEQ ID NO: 226318 - DNA, 20 bp, human
gagcctttaaaaggaggaag

SEQ ID NO: 226319 - DNA, 20 bp, human
ggaatgggacttctgaactg

SEQ ID NO: 226320 - DNA, 20 bp, human
gaatcttgtacactatactt

SEQ ID NO: 226321 - DNA, 20 bp, human
ggttagcgagtcatacagaa

SEQ ID NO: 226322 - DNA, 20 bp, human
ggatgatgtgtcatctgtat

SEQ ID NO: 226323 - DNA, 20 bp, human
gtctgtataggtcaaagaat

SEQ ID NO: 226324 - DNA, 20 bp, human
gttgcctttagttatctcac

SEQ ID NO: 226325 - DNA, 20 bp, human
gttgagtagcagcctttaaa

SEQ ID NO: 226326 - DNA, 20 bp, human
ggagcaagctggttattacc

SEQ ID NO: 226327 - DNA, 20 bp, human
ggccaagtctgtccaggtgt

SEQ ID NO: 226328 - DNA, 20 bp, human
gcagacttggcagaagactc

SEQ ID NO: 226329 - DNA, 20 bp, human
gttggcagaagactcagggc

SEQ ID NO: 226330 - DNA, 20 bp, human
gataagtaagcattggtctg

SEQ ID NO: 226331 - DNA, 20 bp, human
gacccacacctggacagact

SEQ ID NO: 226332 - DNA, 20 bp, human
gctgtgagataagtaagcat

SEQ ID NO: 226333 - DNA, 20 bp, human
gtccaaggacaatgtcatcc

SEQ ID NO: 226334 - DNA, 20 bp, human
gaaccactcttcaagctgaa

SEQ ID NO: 226335 - DNA, 20 bp, human
gcctgccccagacccacacc

SEQ ID NO: 226336 - DNA, 20 bp, human
gttgaaaaagaaacctgcct

SEQ ID NO: 226337 - DNA, 20 bp, human
ggaaggctgctaacagtggc

SEQ ID NO: 226338 - DNA, 20 bp, human
gaactgaaggctgctaacag

SEQ ID NO: 226339 - DNA, 20 bp, human
gataggaattctaatggtct

SEQ ID NO: 226340 - DNA, 20 bp, human
ggtgtgtgattgtgagtgag

SEQ ID NO: 226341 - DNA, 20 bp, human
gtcacacactccatctaacg

SEQ ID NO: 226342 - DNA, 20 bp, human
gccgcgttctccgcgttaga

SEQ ID NO: 226343 - DNA, 20 bp, human
gtaagtgataggaattctaa

SEQ ID NO: 226344 - DNA, 20 bp, human
gttgtgagtgagaggggaat

SEQ ID NO: 226345 - DNA, 20 bp, human
gttacggcaacacttaaatc

SEQ ID NO: 226346 - DNA, 20 bp, human
ggggatctgcgttggaggaa

SEQ ID NO: 226347 - DNA, 20 bp, human
ggctacagtcctgccttaag

SEQ ID NO: 226348 - DNA, 20 bp, human
gccgccctctgcatacactc

SEQ ID NO: 226349 - DNA, 20 bp, human
gtaaggcaggactgtagcgc

SEQ ID NO: 226350 - DNA, 20 bp, human
ggctgcctgcagtcgagtaa

SEQ ID NO: 226351 - DNA, 20 bp, human
ggggcagggatctgcgttgg

SEQ ID NO: 226352 - DNA, 20 bp, human
ggcgcctgagtgtatgcaga

SEQ ID NO: 226353 - DNA, 20 bp, human
ggcagggcagggatctgcgt

SEQ ID NO: 226354 - DNA, 20 bp, human
gcctgtgaacgcacagggat

SEQ ID NO: 226355 - DNA, 20 bp, human
gcacagggataggcctctta

SEQ ID NO: 226356 - DNA, 20 bp, human
ggccacctgctggtcggtga

SEQ ID NO: 226357 - DNA, 20 bp, human
gctgctggtcggtgagggaa

SEQ ID NO: 226358 - DNA, 20 bp, human
gtcggtgagggaaagggcta

SEQ ID NO: 226359 - DNA, 20 bp, human
gcatctgggcctccaaccca

SEQ ID NO: 226360 - DNA, 20 bp, human
gttagggcccggggagcctt

SEQ ID NO: 226361 - DNA, 20 bp, human
gcctccaacccaaggctccc

SEQ ID NO: 226362 - DNA, 20 bp, human
gttcccggaggaatgttgga

SEQ ID NO: 226363 - DNA, 20 bp, human
ggaggggggaccattcccgg

SEQ ID NO: 226364 - DNA, 20 bp, human
gggctaaggagacgggagtc

SEQ ID NO: 226365 - DNA, 20 bp, human
gagcaggtggcaccacaaac

SEQ ID NO: 226366 - DNA, 20 bp, human
gcgggcccgccgcagcttag

SEQ ID NO: 226367 - DNA, 20 bp, human
gcagcccggagaattggaga

SEQ ID NO: 226368 - DNA, 20 bp, human
gcgggaggctgtagggattg

SEQ ID NO: 226369 - DNA, 20 bp, human
ggccacctgccgtctgactc

SEQ ID NO: 226370 - DNA, 20 bp, human
ggagccgcgctaggactcag

SEQ ID NO: 226371 - DNA, 20 bp, human
ggccggaagcctgtgggtgt

SEQ ID NO: 226372 - DNA, 20 bp, human
gttccccttctccaattctc

SEQ ID NO: 226373 - DNA, 20 bp, human
gctcagaggtcagggtggca

SEQ ID NO: 226374 - DNA, 20 bp, human
ggatagggaacaaaaggtga

SEQ ID NO: 226375 - DNA, 20 bp, human
gagagaactggcccaggata

SEQ ID NO: 226376 - DNA, 20 bp, human
gccagagagccctctatcca

SEQ ID NO: 226377 - DNA, 20 bp, human
gagagggagctccaagatca

SEQ ID NO: 226378 - DNA, 20 bp, human
gatagagggctctctggcct

SEQ ID NO: 226379 - DNA, 20 bp, human
ggggctccagcggggaaagg

SEQ ID NO: 226380 - DNA, 20 bp, human
gccagggctccagcggggaa

SEQ ID NO: 226381 - DNA, 20 bp, human
ggctgggagaccatgactta

SEQ ID NO: 226382 - DNA, 20 bp, human
gaactcagaaacacaccctt

SEQ ID NO: 226383 - DNA, 20 bp, human
gtccctgatctaaacagagg

SEQ ID NO: 226384 - DNA, 20 bp, human
gtctatccagggctccagcg

SEQ ID NO: 226385 - DNA, 20 bp, human
gttggagggctggactttct

SEQ ID NO: 226386 - DNA, 20 bp, human
gacaacgtaaggtgaaaatc

SEQ ID NO: 226387 - DNA, 20 bp, human
gttcaccttacgttgtcctt

SEQ ID NO: 226388 - DNA, 20 bp, human
gtccttgggacaatctttac

SEQ ID NO: 226389 - DNA, 20 bp, human
ggccagccccgccttgtcca

SEQ ID NO: 226390 - DNA, 20 bp, human
gagggtattgtgacgcacac

SEQ ID NO: 226391 - DNA, 20 bp, human
gttgtcccaaggacaacgta

SEQ ID NO: 226392 - DNA, 20 bp, human
ggtctctccctagagaccaa

SEQ ID NO: 226393 - DNA, 20 bp, human
gaccttggacaaggcggggc

SEQ ID NO: 226394 - DNA, 20 bp, human
gcctttgcaagctggaattg

SEQ ID NO: 226395 - DNA, 20 bp, human
gcctgacctaaccttggaca

SEQ ID NO: 226396 - DNA, 20 bp, human
gcgggcctgaagaccagcga

SEQ ID NO: 226397 - DNA, 20 bp, human
gcgcgtgcgcgccgctacct

SEQ ID NO: 226398 - DNA, 20 bp, human
gccgccctgtccagaggcgc

SEQ ID NO: 226399 - DNA, 20 bp, human
gggtcccggcgcctctggac

SEQ ID NO: 226400 - DNA, 20 bp, human
gcctctggacagggcgggcc

SEQ ID NO: 226401 - DNA, 20 bp, human
gtcgcactccggctactttc

SEQ ID NO: 226402 - DNA, 20 bp, human
gcgtgtgcaggttcgcactc

SEQ ID NO: 226403 - DNA, 20 bp, human
gaggcctcgcgcattcccgt

SEQ ID NO: 226404 - DNA, 20 bp, human
gaacctgcacacgagatttt

SEQ ID NO: 226405 - DNA, 20 bp, human
gcgccgggccgacgtcccac

SEQ ID NO: 226406 - DNA, 20 bp, human
gtggaacattagcatgtgtt

SEQ ID NO: 226407 - DNA, 20 bp, human
ggtggaggtaagaagagttg

SEQ ID NO: 226408 - DNA, 20 bp, human
gaagtttggttgtctttcca

SEQ ID NO: 226409 - DNA, 20 bp, human
gcagatgttggtagagaaaa

SEQ ID NO: 226410 - DNA, 20 bp, human
gggtagagaaaaaggcatac

SEQ ID NO: 226411 - DNA, 20 bp, human
gtacttctctggtattccca

SEQ ID NO: 226412 - DNA, 20 bp, human
ggttaggagacgaagtaaac

SEQ ID NO: 226413 - DNA, 20 bp, human
gtcagagttgatcataactc

SEQ ID NO: 226414 - DNA, 20 bp, human
gtactaaaggcataatagtt

SEQ ID NO: 226415 - DNA, 20 bp, human
gtctggtattcccagggtcc

SEQ ID NO: 226416 - DNA, 20 bp, human
gtgggcctctgcacttccgg

SEQ ID NO: 226417 - DNA, 20 bp, human
gagctcagaatgttgtacta

SEQ ID NO: 226418 - DNA, 20 bp, human
gtctttggggattcctccat

SEQ ID NO: 226419 - DNA, 20 bp, human
gctgctggcaccagttgcac

SEQ ID NO: 226420 - DNA, 20 bp, human
gatgacttgagtcagagggg

SEQ ID NO: 226421 - DNA, 20 bp, human
gcacgggattagttcaggga

SEQ ID NO: 226422 - DNA, 20 bp, human
gtgcacttccggggggcagg

SEQ ID NO: 226423 - DNA, 20 bp, human
gtcccctggcccggcagcct

SEQ ID NO: 226424 - DNA, 20 bp, human
gtcaggacaggagggcacgc

SEQ ID NO: 226425 - DNA, 20 bp, human
gtacaacattctgagctgtg

SEQ ID NO: 226426 - DNA, 20 bp, human
ggggcccgctggctgaactc

SEQ ID NO: 226427 - DNA, 20 bp, human
ggagtgacgacgtacccgca

SEQ ID NO: 226428 - DNA, 20 bp, human
gtcgggacggggccgcacgc

SEQ ID NO: 226429 - DNA, 20 bp, human
gaagaggggaagacgcaaga

SEQ ID NO: 226430 - DNA, 20 bp, human
gtgtcccctggggcatacca

SEQ ID NO: 226431 - DNA, 20 bp, human
gcccgtcccgactcttggat

SEQ ID NO: 226432 - DNA, 20 bp, human
gagagcgcgcgaatgaaagg

SEQ ID NO: 226433 - DNA, 20 bp, human
ggagaagcttcgtcccgcct

SEQ ID NO: 226434 - DNA, 20 bp, human
gccccaggggacagatgtct

SEQ ID NO: 226435 - DNA, 20 bp, human
ggacagcctcgcccctcgag

SEQ ID NO: 226436 - DNA, 20 bp, human
gagaagtcgccgtgtttgga

SEQ ID NO: 226437 - DNA, 20 bp, human
ggagtggccagtccacatgt

SEQ ID NO: 226438 - DNA, 20 bp, human
gaccggaggcgcaagataag

SEQ ID NO: 226439 - DNA, 20 bp, human
gacccaatttaaactgccgc

SEQ ID NO: 226440 - DNA, 20 bp, human
gctcggcttgaagcttcctt

SEQ ID NO: 226441 - DNA, 20 bp, human
gtgtagtccaacatgtggac

SEQ ID NO: 226442 - DNA, 20 bp, human
ggtcccaacatccaatccca

SEQ ID NO: 226443 - DNA, 20 bp, human
gaatgagaagtcgccgtgtt

SEQ ID NO: 226444 - DNA, 20 bp, human
gcttccttgggattggatgt

SEQ ID NO: 226445 - DNA, 20 bp, human
gggtactgtagtccaacatg

SEQ ID NO: 226446 - DNA, 20 bp, human
gctgtcgcactcaggctata

SEQ ID NO: 226447 - DNA, 20 bp, human
ggcattgggcggaagaccct

SEQ ID NO: 226448 - DNA, 20 bp, human
gtgggcggaagaccctgggc

SEQ ID NO: 226449 - DNA, 20 bp, human
gtgactgtggagtttgaatt

SEQ ID NO: 226450 - DNA, 20 bp, human
gaggctatagggggcgcatt

SEQ ID NO: 226451 - DNA, 20 bp, human
gccaggagtacccgcgacgg

SEQ ID NO: 226452 - DNA, 20 bp, human
gcggcctcgctgtcgcactc

SEQ ID NO: 226453 - DNA, 20 bp, human
gacctgcggtcccgagacaa

SEQ ID NO: 226454 - DNA, 20 bp, human
gctcccaggagtacccgcga

SEQ ID NO: 226455 - DNA, 20 bp, human
ggcggggagcggcggagatg

SEQ ID NO: 226456 - DNA, 20 bp, human
gggagagcactaagagacac

SEQ ID NO: 226457 - DNA, 20 bp, human
gcctaacccccagtacctta

SEQ ID NO: 226458 - DNA, 20 bp, human
gaggtcccaccctaaggtac

SEQ ID NO: 226459 - DNA, 20 bp, human
gggtactaatcctatattac

SEQ ID NO: 226460 - DNA, 20 bp, human
gacccccagtaccttagggt

SEQ ID NO: 226461 - DNA, 20 bp, human
ggttgatctggtgtgataga

SEQ ID NO: 226462 - DNA, 20 bp, human
gcaccaaggtttatacacat

SEQ ID NO: 226463 - DNA, 20 bp, human
gatcaatatgtcaaacatgc

SEQ ID NO: 226464 - DNA, 20 bp, human
gaaccaatgtgtataaacct

SEQ ID NO: 226465 - DNA, 20 bp, human
gtaatgtgtaatatacacca

SEQ ID NO: 226466 - DNA, 20 bp, human
gacttggggttgttgcgggg

SEQ ID NO: 226467 - DNA, 20 bp, human
gccaggtggaggctgtaaca

SEQ ID NO: 226468 - DNA, 20 bp, human
gttgttgcgggggggcatgg

SEQ ID NO: 226469 - DNA, 20 bp, human
ggtacacaactctattgaca

SEQ ID NO: 226470 - DNA, 20 bp, human
gcagttgtggtagtactggg

SEQ ID NO: 226471 - DNA, 20 bp, human
gtttagcagccggtagcctg

SEQ ID NO: 226472 - DNA, 20 bp, human
ggatggggcgagacgcctcc

SEQ ID NO: 226473 - DNA, 20 bp, human
gactggggggaactggcagt

SEQ ID NO: 226474 - DNA, 20 bp, human
gctttttaacaatttggatg

SEQ ID NO: 226475 - DNA, 20 bp, human
gtaccggctgctaaagaaaa

SEQ ID NO: 226476 - DNA, 20 bp, human
ggtcaatcagggcctgccac

SEQ ID NO: 226477 - DNA, 20 bp, human
gtaccaactaggttaccctt

SEQ ID NO: 226478 - DNA, 20 bp, human
gctctgggtattgtcaatca

SEQ ID NO: 226479 - DNA, 20 bp, human
gttccaaagggtaacctagt

SEQ ID NO: 226480 - DNA, 20 bp, human
gggacagaggtttccagggc

SEQ ID NO: 226481 - DNA, 20 bp, human
gttgacttgccattgcccag

SEQ ID NO: 226482 - DNA, 20 bp, human
gagacaggacagaggtttcc

SEQ ID NO: 226483 - DNA, 20 bp, human
ggactccattcatcttccaa

SEQ ID NO: 226484 - DNA, 20 bp, human
gcttgccattgcccagtggc

SEQ ID NO: 226485 - DNA, 20 bp, human
gcatgattccactaccaact

SEQ ID NO: 226486 - DNA, 20 bp, human
gcagtgagtcgagtcctcca

SEQ ID NO: 226487 - DNA, 20 bp, human
gagaagcccgactttctttc

SEQ ID NO: 226488 - DNA, 20 bp, human
gtcgggaagcaagcatcccc

SEQ ID NO: 226489 - DNA, 20 bp, human
gccaagccttgcagcgtgat

SEQ ID NO: 226490 - DNA, 20 bp, human
ggccagaagtccccacttct

SEQ ID NO: 226491 - DNA, 20 bp, human
gagagcgcgcaagggttggc

SEQ ID NO: 226492 - DNA, 20 bp, human
gactcactggtgcgcgattt

SEQ ID NO: 226493 - DNA, 20 bp, human
gtcaaggccggaaagaaagt

SEQ ID NO: 226494 - DNA, 20 bp, human
gccttgcagcgtgatgggag

SEQ ID NO: 226495 - DNA, 20 bp, human
gaaaaccatagagaggaggg

SEQ ID NO: 226496 - DNA, 20 bp, human
gagcgcgcccgccgcctggt

SEQ ID NO: 226497 - DNA, 20 bp, human
gggccggcaggtgggatgaa

SEQ ID NO: 226498 - DNA, 20 bp, human
ggcagcgccccctggccgtg

SEQ ID NO: 226499 - DNA, 20 bp, human
gatcccgggccccacggcca

SEQ ID NO: 226500 - DNA, 20 bp, human
gctggtaggccagttcggag

SEQ ID NO: 226501 - DNA, 20 bp, human
ggcggagccaacgctatccc

SEQ ID NO: 226502 - DNA, 20 bp, human
gggccaaactgtgcagacta

SEQ ID NO: 226503 - DNA, 20 bp, human
ggaactggcctaccaggcgg

SEQ ID NO: 226504 - DNA, 20 bp, human
gaacgctatcccgggcccca

SEQ ID NO: 226505 - DNA, 20 bp, human
gcacagtttggccggcaggt

SEQ ID NO: 226506 - DNA, 20 bp, human
gagggaggggaggctaggat

SEQ ID NO: 226507 - DNA, 20 bp, human
ggctctaaacaggaaagggg

SEQ ID NO: 226508 - DNA, 20 bp, human
ggaatgggaggggaatgagc

SEQ ID NO: 226509 - DNA, 20 bp, human
gaggagatgattggctaaga

SEQ ID NO: 226510 - DNA, 20 bp, human
gctaggattggctgagtcag

SEQ ID NO: 226511 - DNA, 20 bp, human
gttagctctaaacaggaaag

SEQ ID NO: 226512 - DNA, 20 bp, human
gactggaaggacaggtggca

SEQ ID NO: 226513 - DNA, 20 bp, human
ggggctgagactggaaggac

SEQ ID NO: 226514 - DNA, 20 bp, human
gccctccctgaggaaacagc

SEQ ID NO: 226515 - DNA, 20 bp, human
ggggcagtgtgcttttccat

SEQ ID NO: 226516 - DNA, 20 bp, human
ggaggcgcagagagcgggag

SEQ ID NO: 226517 - DNA, 20 bp, human
gccagcgtggggttgagcga

SEQ ID NO: 226518 - DNA, 20 bp, human
gtaaagggaccacgaccccc

SEQ ID NO: 226519 - DNA, 20 bp, human
ggggtgagagggggcccgtc

SEQ ID NO: 226520 - DNA, 20 bp, human
gagagacagacggtcagggc

SEQ ID NO: 226521 - DNA, 20 bp, human
ggaaggagaccggtggggac

SEQ ID NO: 226522 - DNA, 20 bp, human
ggggctcagactggtcacgg

SEQ ID NO: 226523 - DNA, 20 bp, human
gcgcaagcggagatggaatg

SEQ ID NO: 226524 - DNA, 20 bp, human
gcggccttacctgtagacgt

SEQ ID NO: 226525 - DNA, 20 bp, human
ggggaggggtttccggtgac

SEQ ID NO: 226526 - DNA, 20 bp, human
gagccagcaccgggcggaga

SEQ ID NO: 226527 - DNA, 20 bp, human
ggcgaaaagcccagtgggcc

SEQ ID NO: 226528 - DNA, 20 bp, human
gcccggccccgccctactga

SEQ ID NO: 226529 - DNA, 20 bp, human
ggctgctcgcctggcccact

SEQ ID NO: 226530 - DNA, 20 bp, human
gcccgccgcggggacacgga

SEQ ID NO: 226531 - DNA, 20 bp, human
ggggcggagagggctaccat

SEQ ID NO: 226532 - DNA, 20 bp, human
gccgcgagcaacctgtgctc

SEQ ID NO: 226533 - DNA, 20 bp, human
gcgccggaaagcaacggcaa

SEQ ID NO: 226534 - DNA, 20 bp, human
gcgtctgcgcaccctcagta

SEQ ID NO: 226535 - DNA, 20 bp, human
gaagggccgcagccagcacc

SEQ ID NO: 226536 - DNA, 20 bp, human
ggggcttgtggaagagggat

SEQ ID NO: 226537 - DNA, 20 bp, human
gcacaagcccaccttctagg

SEQ ID NO: 226538 - DNA, 20 bp, human
gcatgaacctcctagaaggt

SEQ ID NO: 226539 - DNA, 20 bp, human
gccagacccaagctccgtgt

SEQ ID NO: 226540 - DNA, 20 bp, human
ggggatgggaaacgagacca

SEQ ID NO: 226541 - DNA, 20 bp, human
ggaaggtgggcttgtggaag

SEQ ID NO: 226542 - DNA, 20 bp, human
gtccgtgttggtgtcgacct

SEQ ID NO: 226543 - DNA, 20 bp, human
gaccaaggtcgacaccaaca

SEQ ID NO: 226544 - DNA, 20 bp, human
gagacactggtgagcatcaa

SEQ ID NO: 226545 - DNA, 20 bp, human
ggggactgacctataattgc

SEQ ID NO: 226546 - DNA, 20 bp, human
ggacggccctacttcgccta

SEQ ID NO: 226547 - DNA, 20 bp, human
gccctgcgcggcttccgtcc

SEQ ID NO: 226548 - DNA, 20 bp, human
gcccagcaggagcaccacca

SEQ ID NO: 226549 - DNA, 20 bp, human
gccgccgccctaggcgaagt

SEQ ID NO: 226550 - DNA, 20 bp, human
ggtgcggctgccttcccggg

SEQ ID NO: 226551 - DNA, 20 bp, human
gagcacgacagcgctgggac

SEQ ID NO: 226552 - DNA, 20 bp, human
gtagaggagcacgacagcgc

SEQ ID NO: 226553 - DNA, 20 bp, human
gcgcccgggatcctgtgtag

SEQ ID NO: 226554 - DNA, 20 bp, human
ggacagcgctgggactggtt

SEQ ID NO: 226555 - DNA, 20 bp, human
ggggggcggttctttcgctc

SEQ ID NO: 226556 - DNA, 20 bp, human
ggagacctcccaggaggcac

SEQ ID NO: 226557 - DNA, 20 bp, human
gcaaagtggggagggcaaca

SEQ ID NO: 226558 - DNA, 20 bp, human
ggacgcctgtgcctcctggg

SEQ ID NO: 226559 - DNA, 20 bp, human
ggtcgacgcctgtgcctcct

SEQ ID NO: 226560 - DNA, 20 bp, human
ggagaccctgtgtgactgga

SEQ ID NO: 226561 - DNA, 20 bp, human
gcaaacaagaggtgtctccc

SEQ ID NO: 226562 - DNA, 20 bp, human
gctgtggtgatggaggtccc

SEQ ID NO: 226563 - DNA, 20 bp, human
gccctgggtgaggacaaagt

SEQ ID NO: 226564 - DNA, 20 bp, human
gtcgactattcaaagcattg

SEQ ID NO: 226565 - DNA, 20 bp, human
gttcttacatgcacgtgttc

SEQ ID NO: 226566 - DNA, 20 bp, human
ggtctaggcaggagaggctt

SEQ ID NO: 226567 - DNA, 20 bp, human
gccagtgcagatcaagagag

SEQ ID NO: 226568 - DNA, 20 bp, human
ggggaagctagagttgttgc

SEQ ID NO: 226569 - DNA, 20 bp, human
gtggagctgcatgtctaggc

SEQ ID NO: 226570 - DNA, 20 bp, human
gactaatcaaaagttgcttc

SEQ ID NO: 226571 - DNA, 20 bp, human
gcactggaggcggacatgga

SEQ ID NO: 226572 - DNA, 20 bp, human
ggcagggaccacaaaacaat

SEQ ID NO: 226573 - DNA, 20 bp, human
gtgggtggagctgcatgtct

SEQ ID NO: 226574 - DNA, 20 bp, human
gttgcttctggcacccagcc

SEQ ID NO: 226575 - DNA, 20 bp, human
gaggttccagacgttcccgt

SEQ ID NO: 226576 - DNA, 20 bp, human
gagcatctggggagtcacct

SEQ ID NO: 226577 - DNA, 20 bp, human
gcagagttctcttctcagag

SEQ ID NO: 226578 - DNA, 20 bp, human
ggtgactccccagatgctta

SEQ ID NO: 226579 - DNA, 20 bp, human
gagctctgcctacctctgaa

SEQ ID NO: 226580 - DNA, 20 bp, human
gtgctctctaggcctttcag

SEQ ID NO: 226581 - DNA, 20 bp, human
gtccactccttcagcataat

SEQ ID NO: 226582 - DNA, 20 bp, human
ggtaggcagagctcggcaac

SEQ ID NO: 226583 - DNA, 20 bp, human
gtttagtgacaaaagtctgt

SEQ ID NO: 226584 - DNA, 20 bp, human
gagacctgcaagctgtatgg

SEQ ID NO: 226585 - DNA, 20 bp, human
ggaccgaggacgcgttgcta

SEQ ID NO: 226586 - DNA, 20 bp, human
ggtgagaggcgccgccggta

SEQ ID NO: 226587 - DNA, 20 bp, human
gggagccagaagcgcggaaa

SEQ ID NO: 226588 - DNA, 20 bp, human
gaaaaggtttgcggggtctg

SEQ ID NO: 226589 - DNA, 20 bp, human
gcggtagggcagagcgccca

SEQ ID NO: 226590 - DNA, 20 bp, human
ggcagggttctgcagtcgct

SEQ ID NO: 226591 - DNA, 20 bp, human
gcttctggctccctagagcg

SEQ ID NO: 226592 - DNA, 20 bp, human
ggaagcgcggaaaaggtttg

SEQ ID NO: 226593 - DNA, 20 bp, human
gtcctgcaaacctcgctcta

SEQ ID NO: 226594 - DNA, 20 bp, human
ggtttgcaggaagccggaag

SEQ ID NO: 226595 - DNA, 20 bp, human
ggcccagggtgcctggggca

SEQ ID NO: 226596 - DNA, 20 bp, human
gatagatcaactctccctaa

SEQ ID NO: 226597 - DNA, 20 bp, human
gcccctacaaagtagcagat

SEQ ID NO: 226598 - DNA, 20 bp, human
gaaggatgatactagtattg

SEQ ID NO: 226599 - DNA, 20 bp, human
gcttctggcgactgcttttg

SEQ ID NO: 226600 - DNA, 20 bp, human
gagggagagttgatctatct

SEQ ID NO: 226601 - DNA, 20 bp, human
ggactgcttttgtggtgtgg

SEQ ID NO: 226602 - DNA, 20 bp, human
gggcgactgcttttgtggtg

SEQ ID NO: 226603 - DNA, 20 bp, human
gggttcagacctaaaccagt

SEQ ID NO: 226604 - DNA, 20 bp, human
ggaatggagcccactggttt

SEQ ID NO: 226605 - DNA, 20 bp, human
gataatggcatctgcgtcag

SEQ ID NO: 226606 - DNA, 20 bp, human
gagacggggcggggcgtcgt

SEQ ID NO: 226607 - DNA, 20 bp, human
gcggcgcgcgaggaatccgg

SEQ ID NO: 226608 - DNA, 20 bp, human
gcgatggtaccaccaggcga

SEQ ID NO: 226609 - DNA, 20 bp, human
gagccggcgcgcgaggaatc

SEQ ID NO: 226610 - DNA, 20 bp, human
gaagaaccagcgcatgtctc

SEQ ID NO: 226611 - DNA, 20 bp, human
ggcggggcgcgaagcgccct

SEQ ID NO: 226612 - DNA, 20 bp, human
ggacatgcgctggttcttct

SEQ ID NO: 226613 - DNA, 20 bp, human
gagggacccgagacatgcgc

SEQ ID NO: 226614 - DNA, 20 bp, human
gatcgcgcgcggccgtgggt

SEQ ID NO: 226615 - DNA, 20 bp, human
gtggtaccaccaggcgaggg

SEQ ID NO: 226616 - DNA, 20 bp, human
gacggtaggcttcctctttg

SEQ ID NO: 226617 - DNA, 20 bp, human
ggctacacacaatgtgatgc

SEQ ID NO: 226618 - DNA, 20 bp, human
gaagatcttactaaactcaa

SEQ ID NO: 226619 - DNA, 20 bp, human
gtcttactaaactcaacggt

SEQ ID NO: 226620 - DNA, 20 bp, human
gtgaaacatagaagccgtaa

SEQ ID NO: 226621 - DNA, 20 bp, human
ggaacataaggaggcaagac

SEQ ID NO: 226622 - DNA, 20 bp, human
gacatgaatgacagaacata

SEQ ID NO: 226623 - DNA, 20 bp, human
gtgtgtcagacacaaagaaa

SEQ ID NO: 226624 - DNA, 20 bp, human
gaaaatcataatgttgggct

SEQ ID NO: 226625 - DNA, 20 bp, human
gcataatgttgacctcaaag

SEQ ID NO: 226626 - DNA, 20 bp, human
gaagccaaggggaacggcct

SEQ ID NO: 226627 - DNA, 20 bp, human
gtccgaagagggaatggatg

SEQ ID NO: 226628 - DNA, 20 bp, human
gcaaagagaaatcacagggg

SEQ ID NO: 226629 - DNA, 20 bp, human
gcacataagaccgtgtccca

SEQ ID NO: 226630 - DNA, 20 bp, human
gacggcctgggctcagagta

SEQ ID NO: 226631 - DNA, 20 bp, human
gaggagcacctgaaccccat

SEQ ID NO: 226632 - DNA, 20 bp, human
ggaaatcacaggggcggggc

SEQ ID NO: 226633 - DNA, 20 bp, human
gaaacattccgaagagggaa

SEQ ID NO: 226634 - DNA, 20 bp, human
gtaaggagaccttgccccgg

SEQ ID NO: 226635 - DNA, 20 bp, human
gctaggagttgagtacagtg

SEQ ID NO: 226636 - DNA, 20 bp, human
gccgcttgctgagaagaggt

SEQ ID NO: 226637 - DNA, 20 bp, human
ggcagaggttgttactaacg

SEQ ID NO: 226638 - DNA, 20 bp, human
gtgcctgggcacaaatgccc

SEQ ID NO: 226639 - DNA, 20 bp, human
gctgcatggtctgtactaac

SEQ ID NO: 226640 - DNA, 20 bp, human
gagagccgcttgctgagaag

SEQ ID NO: 226641 - DNA, 20 bp, human
gaccagccggaggggagcaa

SEQ ID NO: 226642 - DNA, 20 bp, human
gtaaaggagcaccctgtttt

SEQ ID NO: 226643 - DNA, 20 bp, human
gactgtcagaccagccggag

SEQ ID NO: 226644 - DNA, 20 bp, human
gtcttcccgttgctcccctc

SEQ ID NO: 226645 - DNA, 20 bp, human
ggtgaaggaatggggatggc

SEQ ID NO: 226646 - DNA, 20 bp, human
gaacgggccgagcactcgag

SEQ ID NO: 226647 - DNA, 20 bp, human
gctaccgcgcacctggaccg

SEQ ID NO: 226648 - DNA, 20 bp, human
ggaggggtcgagaggcgctg

SEQ ID NO: 226649 - DNA, 20 bp, human
gcgttcagcctagtccgggt

SEQ ID NO: 226650 - DNA, 20 bp, human
gagcctagtccgggtaggtg

SEQ ID NO: 226651 - DNA, 20 bp, human
gtcaaagggaagctctcttc

SEQ ID NO: 226652 - DNA, 20 bp, human
gcacctgtggaacttctgcc

SEQ ID NO: 226653 - DNA, 20 bp, human
gtctcgcgggagcgctgcac

SEQ ID NO: 226654 - DNA, 20 bp, human
gcacctcacctacccggact

SEQ ID NO: 226655 - DNA, 20 bp, human
ggggcctcggtccaggtgcg

SEQ ID NO: 226656 - DNA, 20 bp, human
gcagaaaaaggggtagaagc

SEQ ID NO: 226657 - DNA, 20 bp, human
gacagagcaggggcttgctt

SEQ ID NO: 226658 - DNA, 20 bp, human
gcctatcagggcccagaaaa

SEQ ID NO: 226659 - DNA, 20 bp, human
gcccctgctctgttgctcta

SEQ ID NO: 226660 - DNA, 20 bp, human
ggaaccgagcctgcggaagc

SEQ ID NO: 226661 - DNA, 20 bp, human
gaagctgtggataccaacgg

SEQ ID NO: 226662 - DNA, 20 bp, human
gacagcttccctgttgctaa

SEQ ID NO: 226663 - DNA, 20 bp, human
gcacgccagccaaaatgtgt

SEQ ID NO: 226664 - DNA, 20 bp, human
gttgggtctcctccctatca

SEQ ID NO: 226665 - DNA, 20 bp, human
gcgccctagagcaacagagc

SEQ ID NO: 226666 - DNA, 20 bp, human
gtggccggccatgttcatga

SEQ ID NO: 226667 - DNA, 20 bp, human
gggcgaaggtcacaggcctt

SEQ ID NO: 226668 - DNA, 20 bp, human
ggaagcgcccctcacgaaca

SEQ ID NO: 226669 - DNA, 20 bp, human
gacgaaagagccaacacggg

SEQ ID NO: 226670 - DNA, 20 bp, human
ggggaaacatagcggctaca

SEQ ID NO: 226671 - DNA, 20 bp, human
gcaggaagtcggcctgtggc

SEQ ID NO: 226672 - DNA, 20 bp, human
gtgctccagtgtcccaccac

SEQ ID NO: 226673 - DNA, 20 bp, human
gcaggccttgggccagtggt

SEQ ID NO: 226674 - DNA, 20 bp, human
gagcggcgggcgaaggtcac

SEQ ID NO: 226675 - DNA, 20 bp, human
gaaagagccaacacgggggg

SEQ ID NO: 226676 - DNA, 20 bp, human
gagggccattacatctgcag

SEQ ID NO: 226677 - DNA, 20 bp, human
gtacgtgcgcacgccggtgg

SEQ ID NO: 226678 - DNA, 20 bp, human
ggggggcgccacgtgggcga

SEQ ID NO: 226679 - DNA, 20 bp, human
gcaaagctgcaggggtagtc

SEQ ID NO: 226680 - DNA, 20 bp, human
gggggcgcatcacaaggccc

SEQ ID NO: 226681 - DNA, 20 bp, human
gtgggtgccagggacgtcta

SEQ ID NO: 226682 - DNA, 20 bp, human
gcaggggagcagaagtaagg

SEQ ID NO: 226683 - DNA, 20 bp, human
gagtcaggggagcagaagta

SEQ ID NO: 226684 - DNA, 20 bp, human
gagctccggggcgcatcaca

SEQ ID NO: 226685 - DNA, 20 bp, human
ggcccacgtggcgcccccac

SEQ ID NO: 226686 - DNA, 20 bp, human
gggggtggagatgatcccta

SEQ ID NO: 226687 - DNA, 20 bp, human
gtctccctttgggctgacgg

SEQ ID NO: 226688 - DNA, 20 bp, human
gccacccccgtcagcccaaa

SEQ ID NO: 226689 - DNA, 20 bp, human
gtatgcattttgctctcgtt

SEQ ID NO: 226690 - DNA, 20 bp, human
gataatgtatcatgtgtact

SEQ ID NO: 226691 - DNA, 20 bp, human
gatgatccctagggaaacct

SEQ ID NO: 226692 - DNA, 20 bp, human
gtggtagtaacatcaatacg

SEQ ID NO: 226693 - DNA, 20 bp, human
gcatcaatacgtggcttcca

SEQ ID NO: 226694 - DNA, 20 bp, human
gccactaaagcactacttat

SEQ ID NO: 226695 - DNA, 20 bp, human
ggtatcatgtgtacttggaa

SEQ ID NO: 226696 - DNA, 20 bp, human
gctggccggagtccgcctca

SEQ ID NO: 226697 - DNA, 20 bp, human
ggcatccctgaggcggactc

SEQ ID NO: 226698 - DNA, 20 bp, human
gcctcagggatgctccacag

SEQ ID NO: 226699 - DNA, 20 bp, human
ggacggaaattgtgcattcg

SEQ ID NO: 226700 - DNA, 20 bp, human
ggttacctcgtttcctggtc

SEQ ID NO: 226701 - DNA, 20 bp, human
gtggatcgcgtcactcgggc

SEQ ID NO: 226702 - DNA, 20 bp, human
ggttccctgaccaggaaacg

SEQ ID NO: 226703 - DNA, 20 bp, human
gggtaactgatggacagccg

SEQ ID NO: 226704 - DNA, 20 bp, human
gaagcaggcggtatgtgaca

SEQ ID NO: 226705 - DNA, 20 bp, human
gcatcagttacctcgtttcc

SEQ ID NO: 226706 - DNA, 20 bp, human
gcctgggcctaggagttgat

SEQ ID NO: 226707 - DNA, 20 bp, human
gcagaacaaggattctctca

SEQ ID NO: 226708 - DNA, 20 bp, human
gtgcctgtgtcaccaacaga

SEQ ID NO: 226709 - DNA, 20 bp, human
gggagtatgtgtatggtcgt

SEQ ID NO: 226710 - DNA, 20 bp, human
gaggctatgtgacagtagga

SEQ ID NO: 226711 - DNA, 20 bp, human
gcacaggcatctatgagcaa

SEQ ID NO: 226712 - DNA, 20 bp, human
gcacagtcccaccaattctc

SEQ ID NO: 226713 - DNA, 20 bp, human
gtcaaggtttctggggcaac

SEQ ID NO: 226714 - DNA, 20 bp, human
gtgggactgtgtgcataccc

SEQ ID NO: 226715 - DNA, 20 bp, human
ggtgtatggtcgtaggtcca

SEQ ID NO: 226716 - DNA, 20 bp, human
gtgggactaccaatgagcag

SEQ ID NO: 226717 - DNA, 20 bp, human
gtgcccccatttgttttctc

SEQ ID NO: 226718 - DNA, 20 bp, human
ggctgtagagccagatactg

SEQ ID NO: 226719 - DNA, 20 bp, human
gaaaggcagcctctgctcat

SEQ ID NO: 226720 - DNA, 20 bp, human
gtgcagaaggccgacctcct

SEQ ID NO: 226721 - DNA, 20 bp, human
ggaagttcttaagcaggggt

SEQ ID NO: 226722 - DNA, 20 bp, human
ggctcattggtagtcccagg

SEQ ID NO: 226723 - DNA, 20 bp, human
gccaacaagcatagctctca

SEQ ID NO: 226724 - DNA, 20 bp, human
gatgggggcagtgtgagcca

SEQ ID NO: 226725 - DNA, 20 bp, human
gcatagctctcagggttaca

SEQ ID NO: 226726 - DNA, 20 bp, human
gaagctccggggactgcaga

SEQ ID NO: 226727 - DNA, 20 bp, human
gaagtctcgggcccgctcag

SEQ ID NO: 226728 - DNA, 20 bp, human
gagcctcggcggaaaagtgc

SEQ ID NO: 226729 - DNA, 20 bp, human
ggagggaacgttccgctgag

SEQ ID NO: 226730 - DNA, 20 bp, human
ggacagaggaattccctcag

SEQ ID NO: 226731 - DNA, 20 bp, human
gaggtggcgccctcctctga

SEQ ID NO: 226732 - DNA, 20 bp, human
gagaggaattccctcagagg

SEQ ID NO: 226733 - DNA, 20 bp, human
gagccagcacttttccgccg

SEQ ID NO: 226734 - DNA, 20 bp, human
gcctggcggctgaccacggg

SEQ ID NO: 226735 - DNA, 20 bp, human
ggcccagccatctatgacag

SEQ ID NO: 226736 - DNA, 20 bp, human
gtcaaggcgacgtgggtagg

SEQ ID NO: 226737 - DNA, 20 bp, human
gttgtcaaggcgacgtgggt

SEQ ID NO: 226738 - DNA, 20 bp, human
gcacccgcgcggagccagag

SEQ ID NO: 226739 - DNA, 20 bp, human
gggcagaaggcggaaaaaaa

SEQ ID NO: 226740 - DNA, 20 bp, human
ggagggaggtacacaggcgg

SEQ ID NO: 226741 - DNA, 20 bp, human
gagagaggaggcggttgtca

SEQ ID NO: 226742 - DNA, 20 bp, human
ggcgacgtgggtaggaggag

SEQ ID NO: 226743 - DNA, 20 bp, human
gccgcgcggagccagagagg

SEQ ID NO: 226744 - DNA, 20 bp, human
ggcggaggatgcaagaggcc

SEQ ID NO: 226745 - DNA, 20 bp, human
gaaaggggagggaggtacac

SEQ ID NO: 226746 - DNA, 20 bp, human
gaacccacaggtggtttctg

SEQ ID NO: 226747 - DNA, 20 bp, human
ggatctgagcaaggggttgt

SEQ ID NO: 226748 - DNA, 20 bp, human
gaggactgattgatcagctg

SEQ ID NO: 226749 - DNA, 20 bp, human
gtggtcaaaagaggaatctg

SEQ ID NO: 226750 - DNA, 20 bp, human
ggatcaatcagtccttgccg

SEQ ID NO: 226751 - DNA, 20 bp, human
gagccccagaaaccacctgt

SEQ ID NO: 226752 - DNA, 20 bp, human
gttaaccaagcccgcacagc

SEQ ID NO: 226753 - DNA, 20 bp, human
ggttcaaggaggaggttccg

SEQ ID NO: 226754 - DNA, 20 bp, human
gcagctgatgatctgagcaa

SEQ ID NO: 226755 - DNA, 20 bp, human
gaccacctgtgggttcaagg

SEQ ID NO: 226756 - DNA, 20 bp, human
gagggaggagctcccgggga

SEQ ID NO: 226757 - DNA, 20 bp, human
gtggagacccgggtacgcgg

SEQ ID NO: 226758 - DNA, 20 bp, human
gtgcagggcggggttcccgg

SEQ ID NO: 226759 - DNA, 20 bp, human
gcgagggcgggcacagcgag

SEQ ID NO: 226760 - DNA, 20 bp, human
gagcgccgggcgcggactca

SEQ ID NO: 226761 - DNA, 20 bp, human
gcgcgcccggcgctctgaga

SEQ ID NO: 226762 - DNA, 20 bp, human
gaccacctgagccgggtaag

SEQ ID NO: 226763 - DNA, 20 bp, human
gtacgcggcggtgcagggcg

SEQ ID NO: 226764 - DNA, 20 bp, human
gggactcgtggggtccgcga

SEQ ID NO: 226765 - DNA, 20 bp, human
gcctgcaccgccgcgtaccc

SEQ ID NO: 226766 - DNA, 20 bp, human
gttactgtggagactatatt

SEQ ID NO: 226767 - DNA, 20 bp, human
gtagtctccacagtaagtgg

SEQ ID NO: 226768 - DNA, 20 bp, human
gaataatccgccacttactg

SEQ ID NO: 226769 - DNA, 20 bp, human
gagagaaatcagtgggattc

SEQ ID NO: 226770 - DNA, 20 bp, human
gcaacataatatattgaagc

SEQ ID NO: 226771 - DNA, 20 bp, human
ggtgagatggcctcatcttc

SEQ ID NO: 226772 - DNA, 20 bp, human
gttatgagaccggaagttta

SEQ ID NO: 226773 - DNA, 20 bp, human
gatttctgggccggaagatg

SEQ ID NO: 226774 - DNA, 20 bp, human
gcatgagaccaagtttctaa

SEQ ID NO: 226775 - DNA, 20 bp, human
gaatccttgtttaataatat

SEQ ID NO: 226776 - DNA, 20 bp, human
gcgccacggcgtcctctctg

SEQ ID NO: 226777 - DNA, 20 bp, human
ggggaggcgcgggagacaag

SEQ ID NO: 226778 - DNA, 20 bp, human
gccgtgcccacgccccgctg

SEQ ID NO: 226779 - DNA, 20 bp, human
ggacccaggaagggtcacaa

SEQ ID NO: 226780 - DNA, 20 bp, human
gaagggtcacaaaggacagt

SEQ ID NO: 226781 - DNA, 20 bp, human
gggcgccagggccacgtcct

SEQ ID NO: 226782 - DNA, 20 bp, human
ggccgcgtcacccacctcct

SEQ ID NO: 226783 - DNA, 20 bp, human
gtgagcgggctgctccgcag

SEQ ID NO: 226784 - DNA, 20 bp, human
ggcaatgcctcggggatgga

SEQ ID NO: 226785 - DNA, 20 bp, human
gagtacgcgcctcccccctg

SEQ ID NO: 226786 - DNA, 20 bp, human
gagcgggttgggggctgcta

SEQ ID NO: 226787 - DNA, 20 bp, human
gcccgccggggtcttccctc

SEQ ID NO: 226788 - DNA, 20 bp, human
ggcgcgctggggagcgggtt

SEQ ID NO: 226789 - DNA, 20 bp, human
ggctccctgcccactcccgg

SEQ ID NO: 226790 - DNA, 20 bp, human
ggctcagtcactcactcgag

SEQ ID NO: 226791 - DNA, 20 bp, human
gcgcgcgcgggagctaggct

SEQ ID NO: 226792 - DNA, 20 bp, human
gcagcggccggccagccgga

SEQ ID NO: 226793 - DNA, 20 bp, human
gcggcacggaacgtcccccc

SEQ ID NO: 226794 - DNA, 20 bp, human
gaggagagccaggcgcgcgc

SEQ ID NO: 226795 - DNA, 20 bp, human
ggggaagactgcgtcccgtc

SEQ ID NO: 226796 - DNA, 20 bp, human
gtgcggcagcgcctccagtg

SEQ ID NO: 226797 - DNA, 20 bp, human
gcgtccagcgggccctagag

SEQ ID NO: 226798 - DNA, 20 bp, human
ggatcctgagatccagatga

SEQ ID NO: 226799 - DNA, 20 bp, human
ggtacaaaccgcaagcattg

SEQ ID NO: 226800 - DNA, 20 bp, human
gcctcaccccccaatgcttg

SEQ ID NO: 226801 - DNA, 20 bp, human
gtagaattatccctccccac

SEQ ID NO: 226802 - DNA, 20 bp, human
ggtgaggggtggatctggat

SEQ ID NO: 226803 - DNA, 20 bp, human
ggaggggcagacacctcagc

SEQ ID NO: 226804 - DNA, 20 bp, human
gaaagttcttggcaaaagct

SEQ ID NO: 226805 - DNA, 20 bp, human
gtggacaggtgggcgggtca

SEQ ID NO: 226806 - DNA, 20 bp, human
gagagagcaccggacctgga

SEQ ID NO: 226807 - DNA, 20 bp, human
ggccttaggggttgtcccgg

SEQ ID NO: 226808 - DNA, 20 bp, human
ggcgaggctaactgatggga

SEQ ID NO: 226809 - DNA, 20 bp, human
ggccccgcgcgggggcgaag

SEQ ID NO: 226810 - DNA, 20 bp, human
gttaggggttgtcccggcgg

SEQ ID NO: 226811 - DNA, 20 bp, human
gcgaccggtcccacgtgggc

SEQ ID NO: 226812 - DNA, 20 bp, human
ggaaccggcccacgtgggac

SEQ ID NO: 226813 - DNA, 20 bp, human
gtgcagcgaggctaactgat

SEQ ID NO: 226814 - DNA, 20 bp, human
gaaaccgaaccggcccacgt

SEQ ID NO: 226815 - DNA, 20 bp, human
ggggagggtaactgcggaga

SEQ ID NO: 226816 - DNA, 20 bp, human
ggccggggcaaggaggtcgc

SEQ ID NO: 226817 - DNA, 20 bp, human
ggccccgaggcgcggctgaa

SEQ ID NO: 226818 - DNA, 20 bp, human
gccccggcccgcgcggtcgg

SEQ ID NO: 226819 - DNA, 20 bp, human
ggaccggggcgggtgcatga

SEQ ID NO: 226820 - DNA, 20 bp, human
gggcccgcgcggtcggtggt

SEQ ID NO: 226821 - DNA, 20 bp, human
gtccagccggggagcagaac

SEQ ID NO: 226822 - DNA, 20 bp, human
ggcaacggaagactccatcg

SEQ ID NO: 226823 - DNA, 20 bp, human
gcgcgcggtcggtggtgggt

SEQ ID NO: 226824 - DNA, 20 bp, human
gaaaccacccgctccagccg

SEQ ID NO: 226825 - DNA, 20 bp, human
gcgcggggcggggacgtctc

SEQ ID NO: 226826 - DNA, 20 bp, human
gccactgaaggctctgaata

SEQ ID NO: 226827 - DNA, 20 bp, human
gagctccagacacacctcgc

SEQ ID NO: 226828 - DNA, 20 bp, human
gccctccagcgaggtgtgtc

SEQ ID NO: 226829 - DNA, 20 bp, human
gtctgaatagggttagtggt

SEQ ID NO: 226830 - DNA, 20 bp, human
gaggctctgaatagggttag

SEQ ID NO: 226831 - DNA, 20 bp, human
gtgtgtctggagctatgtgg

SEQ ID NO: 226832 - DNA, 20 bp, human
gcgctggaggggaggagctt

SEQ ID NO: 226833 - DNA, 20 bp, human
gaggcttccagagtggtgaa

SEQ ID NO: 226834 - DNA, 20 bp, human
gtggttctggtagccactga

SEQ ID NO: 226835 - DNA, 20 bp, human
gagggttagtggtaggaaaa

SEQ ID NO: 226836 - DNA, 20 bp, human
gtggtgactccaaggtaaag

SEQ ID NO: 226837 - DNA, 20 bp, human
gtgggttggaagctggtgga

SEQ ID NO: 226838 - DNA, 20 bp, human
gttggagtcaccacgccctt

SEQ ID NO: 226839 - DNA, 20 bp, human
ggcccatgagtcaaggaggc

SEQ ID NO: 226840 - DNA, 20 bp, human
ggtcaaggaggcaggtttac

SEQ ID NO: 226841 - DNA, 20 bp, human
ggggcttggcccctttacct

SEQ ID NO: 226842 - DNA, 20 bp, human
gtcactgattaacttgggtg

SEQ ID NO: 226843 - DNA, 20 bp, human
ggctgctgccccattttttg

SEQ ID NO: 226844 - DNA, 20 bp, human
gcacctagggaggtggtaca

SEQ ID NO: 226845 - DNA, 20 bp, human
gtcggtgccagtgaagcacg

SEQ ID NO: 226846 - DNA, 20 bp, human
ggatgaaaccaatattacga

SEQ ID NO: 226847 - DNA, 20 bp, human
gttacgagggttgaatggct

SEQ ID NO: 226848 - DNA, 20 bp, human
gtccagaacctctcttaacc

SEQ ID NO: 226849 - DNA, 20 bp, human
ggcctggttaagagaggttc

SEQ ID NO: 226850 - DNA, 20 bp, human
gatagaagcctggttaagag

SEQ ID NO: 226851 - DNA, 20 bp, human
gtctatgaatagaacaaagt

SEQ ID NO: 226852 - DNA, 20 bp, human
gggagctattgtggatactg

SEQ ID NO: 226853 - DNA, 20 bp, human
gtgttctattcatagaagcc

SEQ ID NO: 226854 - DNA, 20 bp, human
gactgtgcttggagctattg

SEQ ID NO: 226855 - DNA, 20 bp, human
gcattcaaccctcgtaatat

SEQ ID NO: 226856 - DNA, 20 bp, human
ggggcggggcatggttgcta

SEQ ID NO: 226857 - DNA, 20 bp, human
gggctctggaagagactcgg

SEQ ID NO: 226858 - DNA, 20 bp, human
gtggctgcgggtcagtaata

SEQ ID NO: 226859 - DNA, 20 bp, human
gcctcacccgggcgcctcct

SEQ ID NO: 226860 - DNA, 20 bp, human
ggaggccatggtgaaggcgc

SEQ ID NO: 226861 - DNA, 20 bp, human
gggtgcgcaagcgggagttc

SEQ ID NO: 226862 - DNA, 20 bp, human
ggaggtgtgtggtgattggg

SEQ ID NO: 226863 - DNA, 20 bp, human
gcgcaagcgggagttccggc

SEQ ID NO: 226864 - DNA, 20 bp, human
gtgaggcacgggtgcgcaag

SEQ ID NO: 226865 - DNA, 20 bp, human
gcgggtcagtaataggggcg

SEQ ID NO: 226866 - DNA, 20 bp, human
gaggccccagcgatgagcaa

SEQ ID NO: 226867 - DNA, 20 bp, human
gtccccgcccggccatgctc

SEQ ID NO: 226868 - DNA, 20 bp, human
gcggctcctcaccccggcaa

SEQ ID NO: 226869 - DNA, 20 bp, human
gtgcagggggcctgatccgg

SEQ ID NO: 226870 - DNA, 20 bp, human
gggtcccggcagatcttccc

SEQ ID NO: 226871 - DNA, 20 bp, human
ggcctgatccggtggacgat

SEQ ID NO: 226872 - DNA, 20 bp, human
gaagatctgccgggacctca

SEQ ID NO: 226873 - DNA, 20 bp, human
gcagcccccttgctcatcgc

SEQ ID NO: 226874 - DNA, 20 bp, human
ggggggcccttgccggggtg

SEQ ID NO: 226875 - DNA, 20 bp, human
gtcgctggggcctccctgcg

SEQ ID NO: 226876 - DNA, 20 bp, human
ggggccgcggcctacgggtg

SEQ ID NO: 226877 - DNA, 20 bp, human
gtacgggtgcgggggatcgg

SEQ ID NO: 226878 - DNA, 20 bp, human
ggcccggcgagggttaaggg

SEQ ID NO: 226879 - DNA, 20 bp, human
ggcggcccggcgagggttaa

SEQ ID NO: 226880 - DNA, 20 bp, human
gcccccgcacccgtaggccg

SEQ ID NO: 226881 - DNA, 20 bp, human
ggtaggccgcggcccggcga

SEQ ID NO: 226882 - DNA, 20 bp, human
gaggcggccggagtgccggt

SEQ ID NO: 226883 - DNA, 20 bp, human
ggaaaagccgcaggggtcca

SEQ ID NO: 226884 - DNA, 20 bp, human
gggccacagcccgtgagttt

SEQ ID NO: 226885 - DNA, 20 bp, human
gggcagggccgccgctctcc

SEQ ID NO: 226886 - DNA, 20 bp, human
ggcaaggcatgattctatat

SEQ ID NO: 226887 - DNA, 20 bp, human
gaccatgcctcactgaacga

SEQ ID NO: 226888 - DNA, 20 bp, human
gcagtatactcaaaatggtt

SEQ ID NO: 226889 - DNA, 20 bp, human
ggtgaggcatggtcctagca

SEQ ID NO: 226890 - DNA, 20 bp, human
gtgtatcccatcgttcagtg

SEQ ID NO: 226891 - DNA, 20 bp, human
gcccatcgttcagtgaggca

SEQ ID NO: 226892 - DNA, 20 bp, human
gctaaacagtatactcaaaa

SEQ ID NO: 226893 - DNA, 20 bp, human
gatatgaattagttatttct

SEQ ID NO: 226894 - DNA, 20 bp, human
gttatttctggggaaaaaac

SEQ ID NO: 226895 - DNA, 20 bp, human
ggtaaaaatatcagttttag

SEQ ID NO: 226896 - DNA, 20 bp, human
ggtggcgaccgcagtcgctt

SEQ ID NO: 226897 - DNA, 20 bp, human
gaccgcagtcgctttggctg

SEQ ID NO: 226898 - DNA, 20 bp, human
ggataccgccacgctctcta

SEQ ID NO: 226899 - DNA, 20 bp, human
gtatcccggagcctgccgtc

SEQ ID NO: 226900 - DNA, 20 bp, human
ggctgaggctctgcggggaa

SEQ ID NO: 226901 - DNA, 20 bp, human
gtatggcgcccagaaggggg

SEQ ID NO: 226902 - DNA, 20 bp, human
gctctctatggcgcccagaa

SEQ ID NO: 226903 - DNA, 20 bp, human
gagggccggacggcaggctc

SEQ ID NO: 226904 - DNA, 20 bp, human
gtgggtgcgcaagaggatca

SEQ ID NO: 226905 - DNA, 20 bp, human
gcgggaccgatgccctctag

SEQ ID NO: 226906 - DNA, 20 bp, human
gtctgcgcagcgcactgccc

SEQ ID NO: 226907 - DNA, 20 bp, human
ggcgcccaaagccgacgtgg

SEQ ID NO: 226908 - DNA, 20 bp, human
gcagggtaggcgcagtgcgc

SEQ ID NO: 226909 - DNA, 20 bp, human
gatgcgcgggagcacagatc

SEQ ID NO: 226910 - DNA, 20 bp, human
gccgacgtggaggtgatgcg

SEQ ID NO: 226911 - DNA, 20 bp, human
ggggtcgggcctgggtccga

SEQ ID NO: 226912 - DNA, 20 bp, human
gacccgctacccactaccgt

SEQ ID NO: 226913 - DNA, 20 bp, human
gcgcgggaacgcctctgaac

SEQ ID NO: 226914 - DNA, 20 bp, human
ggtagtgggtagcgggtctc

SEQ ID NO: 226915 - DNA, 20 bp, human
gcggcgaagccgagtgggcg

SEQ ID NO: 226916 - DNA, 20 bp, human
gagggccgccgtgaaggagg

SEQ ID NO: 226917 - DNA, 20 bp, human
ggactcgcggagccggaaag

SEQ ID NO: 226918 - DNA, 20 bp, human
ggcgtcacgtggtggaggca

SEQ ID NO: 226919 - DNA, 20 bp, human
gcggccatccgtgcgtcacg

SEQ ID NO: 226920 - DNA, 20 bp, human
gtccccctgacacgtgactc

SEQ ID NO: 226921 - DNA, 20 bp, human
gagcgagcgcgagagggaaa

SEQ ID NO: 226922 - DNA, 20 bp, human
ggcggaactacgacagtaag

SEQ ID NO: 226923 - DNA, 20 bp, human
gagcgtcgagcgctcagacg

SEQ ID NO: 226924 - DNA, 20 bp, human
gtctgagcgctcgacgctcc

SEQ ID NO: 226925 - DNA, 20 bp, human
gcgacagtaagaggaagcgg

SEQ ID NO: 226926 - DNA, 20 bp, human
ggacgcgccgggattcgctg

SEQ ID NO: 226927 - DNA, 20 bp, human
ggggatccgggctgactgaa

SEQ ID NO: 226928 - DNA, 20 bp, human
ggggctccggctgacgcgcc

SEQ ID NO: 226929 - DNA, 20 bp, human
ggagcaaggcctgagctcgg

SEQ ID NO: 226930 - DNA, 20 bp, human
gtcagcccggatccccccac

SEQ ID NO: 226931 - DNA, 20 bp, human
gcaaggcctgagctcggagg

SEQ ID NO: 226932 - DNA, 20 bp, human
gctcgtgggcatgcgccgcc

SEQ ID NO: 226933 - DNA, 20 bp, human
ggagccccgcctccgagctc

SEQ ID NO: 226934 - DNA, 20 bp, human
gcctgcgcataaaggcgcgt

SEQ ID NO: 226935 - DNA, 20 bp, human
gaccggccctcagcgaatcc

SEQ ID NO: 226936 - DNA, 20 bp, human
ggaggcagccaggtgatgat

SEQ ID NO: 226937 - DNA, 20 bp, human
ggggcggggcccactgagag

SEQ ID NO: 226938 - DNA, 20 bp, human
ggggccgcacgtgtctggga

SEQ ID NO: 226939 - DNA, 20 bp, human
gaccggcgacacaaccaatg

SEQ ID NO: 226940 - DNA, 20 bp, human
gaggacaaagcgagctgtta

SEQ ID NO: 226941 - DNA, 20 bp, human
gaacaggtaaggagattcgg

SEQ ID NO: 226942 - DNA, 20 bp, human
gaggtgatgattggctgtaa

SEQ ID NO: 226943 - DNA, 20 bp, human
gtactgtagcaaatgggcta

SEQ ID NO: 226944 - DNA, 20 bp, human
gaggacccggtgatgagaaa

SEQ ID NO: 226945 - DNA, 20 bp, human
gccctcattggttgtgtcgc

SEQ ID NO: 226946 - DNA, 20 bp, human
gctcctgctccccctcggag

SEQ ID NO: 226947 - DNA, 20 bp, human
gcgttcccaagcaggggcgg

SEQ ID NO: 226948 - DNA, 20 bp, human
ggagcgtggcgcaaccgcca

SEQ ID NO: 226949 - DNA, 20 bp, human
gttggggcggggccacgcga

SEQ ID NO: 226950 - DNA, 20 bp, human
gccggcacgttcccaagcag

SEQ ID NO: 226951 - DNA, 20 bp, human
gtgcagtctgcgccccctgg

SEQ ID NO: 226952 - DNA, 20 bp, human
ggaagtttggctgggatccc

SEQ ID NO: 226953 - DNA, 20 bp, human
gagcagcccccgcccctgct

SEQ ID NO: 226954 - DNA, 20 bp, human
gtatttgtaagagttggggc

SEQ ID NO: 226955 - DNA, 20 bp, human
gttgtcatggaagacctcta

SEQ ID NO: 226956 - DNA, 20 bp, human
gcccgctgcggaaataaaat

SEQ ID NO: 226957 - DNA, 20 bp, human
gccggaggggcgaccaacgc

SEQ ID NO: 226958 - DNA, 20 bp, human
ggccacgagctgcccaagac

SEQ ID NO: 226959 - DNA, 20 bp, human
gggcgcggcgagccggtctt

SEQ ID NO: 226960 - DNA, 20 bp, human
gaaccgaccccacgcagcga

SEQ ID NO: 226961 - DNA, 20 bp, human
gatggcggccaggcagatct

SEQ ID NO: 226962 - DNA, 20 bp, human
ggcagcgggcccgctggtga

SEQ ID NO: 226963 - DNA, 20 bp, human
gccgggtgctccgcctccca

SEQ ID NO: 226964 - DNA, 20 bp, human
gctcgtggccatcgctgcgt

SEQ ID NO: 226965 - DNA, 20 bp, human
gaggcagatctgggcacgga

SEQ ID NO: 226966 - DNA, 20 bp, human
gggcagaactccccgcctac

SEQ ID NO: 226967 - DNA, 20 bp, human
gggctgactgactagatctc

SEQ ID NO: 226968 - DNA, 20 bp, human
ggctggggaccggcagtaac

SEQ ID NO: 226969 - DNA, 20 bp, human
gcgggagaggggaaacttct

SEQ ID NO: 226970 - DNA, 20 bp, human
gaggggaggcggggtaagtt

SEQ ID NO: 226971 - DNA, 20 bp, human
gtcccctcctcctccaaagc

SEQ ID NO: 226972 - DNA, 20 bp, human
gctctcaatctgggcagctc

SEQ ID NO: 226973 - DNA, 20 bp, human
gcaatctgggcagctctggc

SEQ ID NO: 226974 - DNA, 20 bp, human
ggcaactcttctcctcccag

SEQ ID NO: 226975 - DNA, 20 bp, human
gtgacagtgggagtcttgaa

SEQ ID NO: 226976 - DNA, 20 bp, human
ggccgcgcggggtgctccta

SEQ ID NO: 226977 - DNA, 20 bp, human
gaaagagtcgttcacttctt

SEQ ID NO: 226978 - DNA, 20 bp, human
gtgctcctaaggaacctctg

SEQ ID NO: 226979 - DNA, 20 bp, human
gtgggtctacagcggaaggg

SEQ ID NO: 226980 - DNA, 20 bp, human
gcatcccaaaccttcggttc

SEQ ID NO: 226981 - DNA, 20 bp, human
gcgacccggtgggtctacag

SEQ ID NO: 226982 - DNA, 20 bp, human
gaaccgaggcccgcggggaa

SEQ ID NO: 226983 - DNA, 20 bp, human
ggcagcagacatgacttaga

SEQ ID NO: 226984 - DNA, 20 bp, human
gggcctcggttcaaacgacc

SEQ ID NO: 226985 - DNA, 20 bp, human
gagaactctgccagaaccga

SEQ ID NO: 226986 - DNA, 20 bp, human
ggaggtggcaagcagagtgg

SEQ ID NO: 226987 - DNA, 20 bp, human
gcccctgcccacacaggcat

SEQ ID NO: 226988 - DNA, 20 bp, human
gggaggggcttcgtcagagt

SEQ ID NO: 226989 - DNA, 20 bp, human
gttagaaaaggcagcagggg

SEQ ID NO: 226990 - DNA, 20 bp, human
gtagacagatgctacgtcat

SEQ ID NO: 226991 - DNA, 20 bp, human
gcttcccttggggacgaggg

SEQ ID NO: 226992 - DNA, 20 bp, human
gtgcccacacaggcattgga

SEQ ID NO: 226993 - DNA, 20 bp, human
gtcagagtgggctgttattt

SEQ ID NO: 226994 - DNA, 20 bp, human
gagagtgattaagtggtgtg

SEQ ID NO: 226995 - DNA, 20 bp, human
gttgcttcccttggggacga

SEQ ID NO: 226996 - DNA, 20 bp, human
gcggccggggagcgcaattg

SEQ ID NO: 226997 - DNA, 20 bp, human
gcccctccccactggagaat

SEQ ID NO: 226998 - DNA, 20 bp, human
gcccactggagaatagggat

SEQ ID NO: 226999 - DNA, 20 bp, human
gaggtggcaggcgggtctcg

SEQ ID NO: 227000 - DNA, 20 bp, human
gtcaccagctcgttccccgc

SEQ ID NO: 227001 - DNA, 20 bp, human
gacgcggtagagccaatcag

SEQ ID NO: 227002 - DNA, 20 bp, human
gttggggcgcccctccccac

SEQ ID NO: 227003 - DNA, 20 bp, human
gactggagaatagggatcgg

SEQ ID NO: 227004 - DNA, 20 bp, human
gacaaatggcaatggattgg

SEQ ID NO: 227005 - DNA, 20 bp, human
ggcaatggattggaggtggc

SEQ ID NO: 227006 - DNA, 20 bp, human
gcatgcgcgatggggctcca

SEQ ID NO: 227007 - DNA, 20 bp, human
gagggtgcgcatgcgcgatg

SEQ ID NO: 227008 - DNA, 20 bp, human
gcctcgagcgcttgcctcca

SEQ ID NO: 227009 - DNA, 20 bp, human
ggaggcacagggcgcggctt

SEQ ID NO: 227010 - DNA, 20 bp, human
gggcaagcgctcgaggcaca

SEQ ID NO: 227011 - DNA, 20 bp, human
ggggaggtgtttgatacatc

SEQ ID NO: 227012 - DNA, 20 bp, human
gcatgcgcagagatgttccg

SEQ ID NO: 227013 - DNA, 20 bp, human
ggcctggtgtagccccacgc

SEQ ID NO: 227014 - DNA, 20 bp, human
ggcgctcgaggcacagggcg

SEQ ID NO: 227015 - DNA, 20 bp, human
gtcgcgcatgcgcaccctgg

SEQ ID NO: 227016 - DNA, 20 bp, human
gacaggggaaaaagccaaac

SEQ ID NO: 227017 - DNA, 20 bp, human
gaactggcccagagcagtca

SEQ ID NO: 227018 - DNA, 20 bp, human
ggcagctgcttcctgattta

SEQ ID NO: 227019 - DNA, 20 bp, human
gtgctctgggccagttcctt

SEQ ID NO: 227020 - DNA, 20 bp, human
gtgttggctcaatgggaggc

SEQ ID NO: 227021 - DNA, 20 bp, human
gggattattgttggctcaat

SEQ ID NO: 227022 - DNA, 20 bp, human
gtctgtttggtctgtttggt

SEQ ID NO: 227023 - DNA, 20 bp, human
gtcaacagggttatgtcaac

SEQ ID NO: 227024 - DNA, 20 bp, human
gaaccactggataatgactg

SEQ ID NO: 227025 - DNA, 20 bp, human
gggaatgcactcagagaatc

SEQ ID NO: 227026 - DNA, 20 bp, human
gggtgctagcaaagctgggg

SEQ ID NO: 227027 - DNA, 20 bp, human
gcacccggagcacctggaat

SEQ ID NO: 227028 - DNA, 20 bp, human
gtggtcaaatagaacggctg

SEQ ID NO: 227029 - DNA, 20 bp, human
gtctccctgaaacactggtg

SEQ ID NO: 227030 - DNA, 20 bp, human
gcttcccattccaggtgctc

SEQ ID NO: 227031 - DNA, 20 bp, human
gaagctggggtgggcggcgc

SEQ ID NO: 227032 - DNA, 20 bp, human
ggaagtggcccgagcgtcac

SEQ ID NO: 227033 - DNA, 20 bp, human
gaggggttgtatgttggagg

SEQ ID NO: 227034 - DNA, 20 bp, human
ggtcccccaccagtgtttca

SEQ ID NO: 227035 - DNA, 20 bp, human
ggtcaccctcagaatggaag

SEQ ID NO: 227036 - DNA, 20 bp, human
gggagccaggcatactgggg

SEQ ID NO: 227037 - DNA, 20 bp, human
gactgaggagccaggcatac

SEQ ID NO: 227038 - DNA, 20 bp, human
gagaagggatggtgttgcat

SEQ ID NO: 227039 - DNA, 20 bp, human
gcatgtctgtgcttgacatt

SEQ ID NO: 227040 - DNA, 20 bp, human
gtggctcctcagtcagaggc

SEQ ID NO: 227041 - DNA, 20 bp, human
ggagactgacttgtttcctg

SEQ ID NO: 227042 - DNA, 20 bp, human
ggcccacagaacactcattt

SEQ ID NO: 227043 - DNA, 20 bp, human
gccagagatcacaaggagaa

SEQ ID NO: 227044 - DNA, 20 bp, human
ggattcctccccagtatgcc

SEQ ID NO: 227045 - DNA, 20 bp, human
gggcatcactcataacttat

SEQ ID NO: 227046 - DNA, 20 bp, human
gtgaacgcggccccatctgt

SEQ ID NO: 227047 - DNA, 20 bp, human
gcggccccatctgtcggctt

SEQ ID NO: 227048 - DNA, 20 bp, human
ggggccgcgttcagtctggc

SEQ ID NO: 227049 - DNA, 20 bp, human
gctaacgcgaggcgcgcgag

SEQ ID NO: 227050 - DNA, 20 bp, human
gtcagtctggccggaaaggg

SEQ ID NO: 227051 - DNA, 20 bp, human
ggcacggtggcccaaacttc

SEQ ID NO: 227052 - DNA, 20 bp, human
gggcggaagtaaacgagaaa

SEQ ID NO: 227053 - DNA, 20 bp, human
ggtcggcttaggaactggga

SEQ ID NO: 227054 - DNA, 20 bp, human
ggagcggctggatgacgtca

SEQ ID NO: 227055 - DNA, 20 bp, human
gttactgcgcgccggaagtt

SEQ ID NO: 227056 - DNA, 20 bp, human
gttcagctgatccctttcaa

SEQ ID NO: 227057 - DNA, 20 bp, human
gggacagggttgggaactta

SEQ ID NO: 227058 - DNA, 20 bp, human
gtactggagtagttccctgt

SEQ ID NO: 227059 - DNA, 20 bp, human
gtggcggctccgcccttgaa

SEQ ID NO: 227060 - DNA, 20 bp, human
gggaacttaaggcaatgtac

SEQ ID NO: 227061 - DNA, 20 bp, human
gcgcgagtcatgtgaccctc

SEQ ID NO: 227062 - DNA, 20 bp, human
gttgtattctatcttaaaac

SEQ ID NO: 227063 - DNA, 20 bp, human
gagctgatccctttcaaggg

SEQ ID NO: 227064 - DNA, 20 bp, human
gcaaaaacacagtattcaaa

SEQ ID NO: 227065 - DNA, 20 bp, human
gtccacaatgggacagggtt

SEQ ID NO: 227066 - DNA, 20 bp, human
ggggcccgagacagtcataa

SEQ ID NO: 227067 - DNA, 20 bp, human
gccccctactccgagggcga

SEQ ID NO: 227068 - DNA, 20 bp, human
gcgccctcgccctcggagta

SEQ ID NO: 227069 - DNA, 20 bp, human
gcccaggcctaggaccgcgg

SEQ ID NO: 227070 - DNA, 20 bp, human
gtagtccaggcggctctcgg

SEQ ID NO: 227071 - DNA, 20 bp, human
gccgctaccccctactccga

SEQ ID NO: 227072 - DNA, 20 bp, human
ggcccccaggcctaggaccg

SEQ ID NO: 227073 - DNA, 20 bp, human
ggagtagggggtagcggctt

SEQ ID NO: 227074 - DNA, 20 bp, human
gccgctcggcctccgactac

SEQ ID NO: 227075 - DNA, 20 bp, human
gttccacccaccgcggtcct

SEQ ID NO: 227076 - DNA, 20 bp, human
ggggctgcccggacgggaaa

SEQ ID NO: 227077 - DNA, 20 bp, human
gcagccatcggggtaacgga

SEQ ID NO: 227078 - DNA, 20 bp, human
ggagacagtcggaaccccag

SEQ ID NO: 227079 - DNA, 20 bp, human
gggccctgatcccagcctgt

SEQ ID NO: 227080 - DNA, 20 bp, human
gtccctacaggctgggatca

SEQ ID NO: 227081 - DNA, 20 bp, human
ggggttccgactgtctcgga

SEQ ID NO: 227082 - DNA, 20 bp, human
gcggagccgcctctcctccc

SEQ ID NO: 227083 - DNA, 20 bp, human
gcgggcagccatcggggtaa

SEQ ID NO: 227084 - DNA, 20 bp, human
gaggcccccctgtgcggtgc

SEQ ID NO: 227085 - DNA, 20 bp, human
ggtgcaggacgaaggaaccc

SEQ ID NO: 227086 - DNA, 20 bp, human
ggggaccgagcccaggaatc

SEQ ID NO: 227087 - DNA, 20 bp, human
gctgcctaggcaatggaccc

SEQ ID NO: 227088 - DNA, 20 bp, human
gacagggcccgcatcgcggg

SEQ ID NO: 227089 - DNA, 20 bp, human
ggggacaagggtgaccacac

SEQ ID NO: 227090 - DNA, 20 bp, human
gtcagacccggggacgggac

SEQ ID NO: 227091 - DNA, 20 bp, human
gtggtcgctaaggacgctga

SEQ ID NO: 227092 - DNA, 20 bp, human
gggacgcccgcatatctctg

SEQ ID NO: 227093 - DNA, 20 bp, human
gtgttccgccctggtcgcta

SEQ ID NO: 227094 - DNA, 20 bp, human
gggcggcgcctgttccgccc

SEQ ID NO: 227095 - DNA, 20 bp, human
gttctccactgcctaggcaa

SEQ ID NO: 227096 - DNA, 20 bp, human
gggaccccagagcgcttcgg

SEQ ID NO: 227097 - DNA, 20 bp, human
gcaccccaccggcgggtctt

SEQ ID NO: 227098 - DNA, 20 bp, human
gtgtgtggagcggcgaagtg

SEQ ID NO: 227099 - DNA, 20 bp, human
ggcaggagctgagatttgtg

SEQ ID NO: 227100 - DNA, 20 bp, human
gaagctgtctcagtggtcaa

SEQ ID NO: 227101 - DNA, 20 bp, human
ggccccataaaatggcagtt

SEQ ID NO: 227102 - DNA, 20 bp, human
ggatcccccgaagcgctctg

SEQ ID NO: 227103 - DNA, 20 bp, human
gtccaaggccccctgagaaa

SEQ ID NO: 227104 - DNA, 20 bp, human
gactcagaccccagcactct

SEQ ID NO: 227105 - DNA, 20 bp, human
gttgccctgtgccaagcgct

SEQ ID NO: 227106 - DNA, 20 bp, human
gcagggaaaccggaacaact

SEQ ID NO: 227107 - DNA, 20 bp, human
gaaccggaacaacttggggt

SEQ ID NO: 227108 - DNA, 20 bp, human
gcccccaccccaagttgttc

SEQ ID NO: 227109 - DNA, 20 bp, human
gtgagctcatcccacagctg

SEQ ID NO: 227110 - DNA, 20 bp, human
ggggcatacaagcgtgttgg

SEQ ID NO: 227111 - DNA, 20 bp, human
gcatacaagcgtgttggggg

SEQ ID NO: 227112 - DNA, 20 bp, human
gcgaatctcctcagaatcgc

SEQ ID NO: 227113 - DNA, 20 bp, human
ggaccaggcccgcgattctg

SEQ ID NO: 227114 - DNA, 20 bp, human
gctaggaggctgcgaaagcg

SEQ ID NO: 227115 - DNA, 20 bp, human
gttcgcccgcccagggccac

SEQ ID NO: 227116 - DNA, 20 bp, human
gcctcccagacaggtgaact

SEQ ID NO: 227117 - DNA, 20 bp, human
gggcgtcagagcgctgtcac

SEQ ID NO: 227118 - DNA, 20 bp, human
gcacacactcccagttcgca

SEQ ID NO: 227119 - DNA, 20 bp, human
gggagggaaagcagtggaag

SEQ ID NO: 227120 - DNA, 20 bp, human
gagtggaagaggaccgcaaa

SEQ ID NO: 227121 - DNA, 20 bp, human
ggctccgcgccgagctcagg

SEQ ID NO: 227122 - DNA, 20 bp, human
gaccacgaagccctgcgaac

SEQ ID NO: 227123 - DNA, 20 bp, human
gtgagcggtggttttggttg

SEQ ID NO: 227124 - DNA, 20 bp, human
gaaccaccgctcacaaggaa

SEQ ID NO: 227125 - DNA, 20 bp, human
gtccccacacgcccggcgga

SEQ ID NO: 227126 - DNA, 20 bp, human
ggattggggactgaactgaa

SEQ ID NO: 227127 - DNA, 20 bp, human
ggcagtacacaaagcctgtg

SEQ ID NO: 227128 - DNA, 20 bp, human
gaaaaccagggagtggcaag

SEQ ID NO: 227129 - DNA, 20 bp, human
ggcatgggtgggtggagcgt

SEQ ID NO: 227130 - DNA, 20 bp, human
gggaaataataagcagggat

SEQ ID NO: 227131 - DNA, 20 bp, human
ggtcaatagatctcccccac

SEQ ID NO: 227132 - DNA, 20 bp, human
gcacatgtgcacgcatgggt

SEQ ID NO: 227133 - DNA, 20 bp, human
gctgccagagaagaaaaacc

SEQ ID NO: 227134 - DNA, 20 bp, human
ggggggatggtcttctgtta

SEQ ID NO: 227135 - DNA, 20 bp, human
ggagaagaaaaaccagggag

SEQ ID NO: 227136 - DNA, 20 bp, human
gcggccgccgaggtgcggaa

SEQ ID NO: 227137 - DNA, 20 bp, human
gcggccgccccgggtcacgt

SEQ ID NO: 227138 - DNA, 20 bp, human
gcgcgcccgtgcaatgctcc

SEQ ID NO: 227139 - DNA, 20 bp, human
gcccccagcgcaagcggcga

SEQ ID NO: 227140 - DNA, 20 bp, human
gctccccttccgcacctcgg

SEQ ID NO: 227141 - DNA, 20 bp, human
gccagcgcaagcggcgatgg

SEQ ID NO: 227142 - DNA, 20 bp, human
gtcgcccacgtgacccgggg

SEQ ID NO: 227143 - DNA, 20 bp, human
ggctcggcccccagcgcaag

SEQ ID NO: 227144 - DNA, 20 bp, human
gcacccccggagcattgcac

SEQ ID NO: 227145 - DNA, 20 bp, human
ggccccaggagcacgcgtga

SEQ ID NO: 227146 - DNA, 20 bp, human
gcggcgcgctctgtcctgct

SEQ ID NO: 227147 - DNA, 20 bp, human
gcgcggccgcgtctgtcccg

SEQ ID NO: 227148 - DNA, 20 bp, human
gcgctcctgcatcccggccg

SEQ ID NO: 227149 - DNA, 20 bp, human
gccctctgcacctccgggcc

SEQ ID NO: 227150 - DNA, 20 bp, human
gcgggagcctgagcaagagc

SEQ ID NO: 227151 - DNA, 20 bp, human
gtgggagcgagaccgagcct

SEQ ID NO: 227152 - DNA, 20 bp, human
ggctgcccccgcgcccccag

SEQ ID NO: 227153 - DNA, 20 bp, human
gcccgcctccaccacgccgc

SEQ ID NO: 227154 - DNA, 20 bp, human
gcagtggctgtcagcttgcg

SEQ ID NO: 227155 - DNA, 20 bp, human
gtctaacaggtgggatcccg

SEQ ID NO: 227156 - DNA, 20 bp, human
gtgccctagggccctccctt

SEQ ID NO: 227157 - DNA, 20 bp, human
ggggatctgagttgtcagga

SEQ ID NO: 227158 - DNA, 20 bp, human
gtgcagctctgcaaactcac

SEQ ID NO: 227159 - DNA, 20 bp, human
gaactcagatccccaaggga

SEQ ID NO: 227160 - DNA, 20 bp, human
gcttggggatctgagttgtc

SEQ ID NO: 227161 - DNA, 20 bp, human
gtagggcagagaatcagcaa

SEQ ID NO: 227162 - DNA, 20 bp, human
gcagatgcccaagtagtaat

SEQ ID NO: 227163 - DNA, 20 bp, human
gaaagcagacctcgctccct

SEQ ID NO: 227164 - DNA, 20 bp, human
ggacccacagggaagacagc

SEQ ID NO: 227165 - DNA, 20 bp, human
gtacttgggcatctgtccaa

SEQ ID NO: 227166 - DNA, 20 bp, human
gagggcccacaggtgaatct

SEQ ID NO: 227167 - DNA, 20 bp, human
ggcttagtggtgaatagagg

SEQ ID NO: 227168 - DNA, 20 bp, human
gaaggctagaagtgactgag

SEQ ID NO: 227169 - DNA, 20 bp, human
ggaatagagggggatttctg

SEQ ID NO: 227170 - DNA, 20 bp, human
gccagagaggttgattacct

SEQ ID NO: 227171 - DNA, 20 bp, human
gggcaacattgtgacctcac

SEQ ID NO: 227172 - DNA, 20 bp, human
gaggttgattacctgggcta

SEQ ID NO: 227173 - DNA, 20 bp, human
gggtgcttagtggtgaatag

SEQ ID NO: 227174 - DNA, 20 bp, human
gtgcaaaatggggtcaatta

SEQ ID NO: 227175 - DNA, 20 bp, human
gagggggatttctgtggttt

SEQ ID NO: 227176 - DNA, 20 bp, human
gcggccaccgggaacagggt

SEQ ID NO: 227177 - DNA, 20 bp, human
gtggcccggccaccgggaac

SEQ ID NO: 227178 - DNA, 20 bp, human
ggacccgccgtcaatggcgt

SEQ ID NO: 227179 - DNA, 20 bp, human
gcacccacgccattgacggc

SEQ ID NO: 227180 - DNA, 20 bp, human
ggctcccaccctgttcccgg

SEQ ID NO: 227181 - DNA, 20 bp, human
gctggccaagtggccccctc

SEQ ID NO: 227182 - DNA, 20 bp, human
ggtcagggagcgcagcccga

SEQ ID NO: 227183 - DNA, 20 bp, human
ggcccgggacccgccgtcaa

SEQ ID NO: 227184 - DNA, 20 bp, human
ggctgggctaaaaatagcgg

SEQ ID NO: 227185 - DNA, 20 bp, human
gggagcacccacgccattga

SEQ ID NO: 227186 - DNA, 20 bp, human
gctaagtcttagagctgcag

SEQ ID NO: 227187 - DNA, 20 bp, human
gtcggtgtcagagaaagggt

SEQ ID NO: 227188 - DNA, 20 bp, human
gtagggtggtggcttttttc

SEQ ID NO: 227189 - DNA, 20 bp, human
gacaccgaaatgacctccac

SEQ ID NO: 227190 - DNA, 20 bp, human
gactggatgtaagattcatg

SEQ ID NO: 227191 - DNA, 20 bp, human
ggacagcaaggcccccactg

SEQ ID NO: 227192 - DNA, 20 bp, human
gtttcaggcaggctaaagga

SEQ ID NO: 227193 - DNA, 20 bp, human
gtataactgggatgacagca

SEQ ID NO: 227194 - DNA, 20 bp, human
gcaggcaggctaaaggaggg

SEQ ID NO: 227195 - DNA, 20 bp, human
gtcatttcggtgtcagagaa

SEQ ID NO: 227196 - DNA, 20 bp, human
gggggcgcgcgcaccgagag

SEQ ID NO: 227197 - DNA, 20 bp, human
gagccccgctctatgatgcc

SEQ ID NO: 227198 - DNA, 20 bp, human
gccggagcggaagacttcgc

SEQ ID NO: 227199 - DNA, 20 bp, human
gcgcgcaccgagagcggatg

SEQ ID NO: 227200 - DNA, 20 bp, human
gaagcgggaagacaccgttc

SEQ ID NO: 227201 - DNA, 20 bp, human
ggggaggtgcgctgggtact

SEQ ID NO: 227202 - DNA, 20 bp, human
gttaagaagtggggtccctg

SEQ ID NO: 227203 - DNA, 20 bp, human
ggcctcgcagcttaagaagt

SEQ ID NO: 227204 - DNA, 20 bp, human
ggacacgcgctcccaacatc

SEQ ID NO: 227205 - DNA, 20 bp, human
gagcccggcatcatagagcg

SEQ ID NO: 227206 - DNA, 20 bp, human
gggcccgcgtccccgactga

SEQ ID NO: 227207 - DNA, 20 bp, human
ggcccctcagtcggggacgc

SEQ ID NO: 227208 - DNA, 20 bp, human
ggagtggtgcgcccgcggaa

SEQ ID NO: 227209 - DNA, 20 bp, human
gccgccgtggcccctcagtc

SEQ ID NO: 227210 - DNA, 20 bp, human
ggcaacccgcggagtgcgga

SEQ ID NO: 227211 - DNA, 20 bp, human
gccgaagccgggggtgcgtg

SEQ ID NO: 227212 - DNA, 20 bp, human
gccacccagcgcctggacag

SEQ ID NO: 227213 - DNA, 20 bp, human
gctccaggaagcgaagcgga

SEQ ID NO: 227214 - DNA, 20 bp, human
gaagcggatggaagattact

SEQ ID NO: 227215 - DNA, 20 bp, human
ggcacccccggcttcgggcg

SEQ ID NO: 227216 - DNA, 20 bp, human
gagtgaagggcaatggaagc

SEQ ID NO: 227217 - DNA, 20 bp, human
gccaaaagcctcagtcaaca

SEQ ID NO: 227218 - DNA, 20 bp, human
gtgtggcaagcctcattgac

SEQ ID NO: 227219 - DNA, 20 bp, human
gtcactgcccgcagtaagga

SEQ ID NO: 227220 - DNA, 20 bp, human
gcccgcagtaaggatggctc

SEQ ID NO: 227221 - DNA, 20 bp, human
ggtcgcggccatgttgactg

SEQ ID NO: 227222 - DNA, 20 bp, human
gtgcggatggtgagtgtgtc

SEQ ID NO: 227223 - DNA, 20 bp, human
ggaggttcgaaggaagtcac

SEQ ID NO: 227224 - DNA, 20 bp, human
ggggcaatggaagccggtcg

SEQ ID NO: 227225 - DNA, 20 bp, human
gaccggagccatccttactg

SEQ ID NO: 227226 - DNA, 20 bp, human
gggctctgcagcagctgatg

SEQ ID NO: 227227 - DNA, 20 bp, human
ggccttgcttagttctttca

SEQ ID NO: 227228 - DNA, 20 bp, human
gggaagtgaggtggcatcca

SEQ ID NO: 227229 - DNA, 20 bp, human
gggcaagttcaaggggttca

SEQ ID NO: 227230 - DNA, 20 bp, human
gcccctgaaagaactaagca

SEQ ID NO: 227231 - DNA, 20 bp, human
ggaggagcattccgttttca

SEQ ID NO: 227232 - DNA, 20 bp, human
gtggctctgtggctgtcaga

SEQ ID NO: 227233 - DNA, 20 bp, human
gtaagcaaggcaagttcaag

SEQ ID NO: 227234 - DNA, 20 bp, human
ggtaactatgacggttatca

SEQ ID NO: 227235 - DNA, 20 bp, human
ggatgtgcctggaaccacag

SEQ ID NO: 227236 - DNA, 20 bp, human
ggggacgtgcgcttgggaga

SEQ ID NO: 227237 - DNA, 20 bp, human
gggagctggggcgcacgttg

SEQ ID NO: 227238 - DNA, 20 bp, human
gtgggcaaagctcagaggct

SEQ ID NO: 227239 - DNA, 20 bp, human
gctgctggggacgtgcgctt

SEQ ID NO: 227240 - DNA, 20 bp, human
gcggaactcaaaaccgactg

SEQ ID NO: 227241 - DNA, 20 bp, human
gccgctgggctctccgcagt

SEQ ID NO: 227242 - DNA, 20 bp, human
gggcctgagatcaacccagt

SEQ ID NO: 227243 - DNA, 20 bp, human
gaccccactgggttgatctc

SEQ ID NO: 227244 - DNA, 20 bp, human
gacgttggggccctgccgag

SEQ ID NO: 227245 - DNA, 20 bp, human
gaggatgccgccgccagcga

SEQ ID NO: 227246 - DNA, 20 bp, human
gaagggagggagaccattat

SEQ ID NO: 227247 - DNA, 20 bp, human
gtgctctgaacagaacaagg

SEQ ID NO: 227248 - DNA, 20 bp, human
gggacttgggacacccgtgg

SEQ ID NO: 227249 - DNA, 20 bp, human
gtagtgctctgaacagaaca

SEQ ID NO: 227250 - DNA, 20 bp, human
gtgttggcatcacatattct

SEQ ID NO: 227251 - DNA, 20 bp, human
ggctggaaatgggtcacatg

SEQ ID NO: 227252 - DNA, 20 bp, human
gcagggacttgggacacccg

SEQ ID NO: 227253 - DNA, 20 bp, human
gcagcaggctccaaggtact

SEQ ID NO: 227254 - DNA, 20 bp, human
gtagataagtaaatgaggac

SEQ ID NO: 227255 - DNA, 20 bp, human
gtcttggcttctggaacagc

SEQ ID NO: 227256 - DNA, 20 bp, human
gggatcccttgagtgaggag

SEQ ID NO: 227257 - DNA, 20 bp, human
ggccttggatcccttgagtg

SEQ ID NO: 227258 - DNA, 20 bp, human
gctgcaaagccacaccacta

SEQ ID NO: 227259 - DNA, 20 bp, human
ggctcaacaaatgtcaacat

SEQ ID NO: 227260 - DNA, 20 bp, human
ggcctcttcctcttccgtag

SEQ ID NO: 227261 - DNA, 20 bp, human
gagccacaccactacggaag

SEQ ID NO: 227262 - DNA, 20 bp, human
gaatgtcaacataggaatcc

SEQ ID NO: 227263 - DNA, 20 bp, human
gttcctcttccgtagtggtg

SEQ ID NO: 227264 - DNA, 20 bp, human
gattcatcttagtcccttcc

SEQ ID NO: 227265 - DNA, 20 bp, human
gttctctctccttccagact

SEQ ID NO: 227266 - DNA, 20 bp, human
ggggctcgcggtaaggtgtg

SEQ ID NO: 227267 - DNA, 20 bp, human
ggtgaggggagggacaatct

SEQ ID NO: 227268 - DNA, 20 bp, human
ggcaagcgcgctactcgtgg

SEQ ID NO: 227269 - DNA, 20 bp, human
gggcgcaagcgcgctactcg

SEQ ID NO: 227270 - DNA, 20 bp, human
ggcccctcgagcagcgagtg

SEQ ID NO: 227271 - DNA, 20 bp, human
gtcagcatccgccgggctcg

SEQ ID NO: 227272 - DNA, 20 bp, human
gagggacaatcttggtagaa

SEQ ID NO: 227273 - DNA, 20 bp, human
gtgccccactcgctgctcga

SEQ ID NO: 227274 - DNA, 20 bp, human
gtggcttcgcggtcgccgat

SEQ ID NO: 227275 - DNA, 20 bp, human
gcgccggtcgctgtttcact

SEQ ID NO: 227276 - DNA, 20 bp, human
gcggcacggacgctagaaat

SEQ ID NO: 227277 - DNA, 20 bp, human
ggccggggacaggtgtccag

SEQ ID NO: 227278 - DNA, 20 bp, human
gggctcaagcgagaggtcaa

SEQ ID NO: 227279 - DNA, 20 bp, human
gaagcagcggattcccaaag

SEQ ID NO: 227280 - DNA, 20 bp, human
ggtctgcagcagtcgacctc

SEQ ID NO: 227281 - DNA, 20 bp, human
gtcgactgctgcagacatgg

SEQ ID NO: 227282 - DNA, 20 bp, human
gcccaacccgggcaccctca

SEQ ID NO: 227283 - DNA, 20 bp, human
gaggatctcggaaccggaag

SEQ ID NO: 227284 - DNA, 20 bp, human
gtagcgtccgtgccggggac

SEQ ID NO: 227285 - DNA, 20 bp, human
gacgcgcagcctggtcacca

SEQ ID NO: 227286 - DNA, 20 bp, human
gcgaccctggcacgtgacgt

SEQ ID NO: 227287 - DNA, 20 bp, human
gcggcaggcgcggactagca

SEQ ID NO: 227288 - DNA, 20 bp, human
gcgcccccgcctccgcccat

SEQ ID NO: 227289 - DNA, 20 bp, human
ggagctctcgcgaggaagac

SEQ ID NO: 227290 - DNA, 20 bp, human
gaagaacggccaactggcga

SEQ ID NO: 227291 - DNA, 20 bp, human
gaggcggcccaactaggcca

SEQ ID NO: 227292 - DNA, 20 bp, human
gtcacgtgccagggtcgccg

SEQ ID NO: 227293 - DNA, 20 bp, human
gccctggcacgtgacgtagg

SEQ ID NO: 227294 - DNA, 20 bp, human
ggccgcctacgtcacgtgcc

SEQ ID NO: 227295 - DNA, 20 bp, human
ggacgctccggaccaatgag

SEQ ID NO: 227296 - DNA, 20 bp, human
gaaaatacaacaacccggcc

SEQ ID NO: 227297 - DNA, 20 bp, human
gtggccgttggaacagacaa

SEQ ID NO: 227298 - DNA, 20 bp, human
gcagcagcacttgatgtctg

SEQ ID NO: 227299 - DNA, 20 bp, human
gccgggttgttgtattttaa

SEQ ID NO: 227300 - DNA, 20 bp, human
gcctcccgaagtgagatttc

SEQ ID NO: 227301 - DNA, 20 bp, human
gggttgttgtattttaacgg

SEQ ID NO: 227302 - DNA, 20 bp, human
gtttaacggtgggaaaggaa

SEQ ID NO: 227303 - DNA, 20 bp, human
gtgacatagaaggctcactt

SEQ ID NO: 227304 - DNA, 20 bp, human
gtcgggacaagtgacataga

SEQ ID NO: 227305 - DNA, 20 bp, human
gtgtattttaacggtgggaa

SEQ ID NO: 227306 - DNA, 20 bp, human
gagggcccagacgtgagcaa

SEQ ID NO: 227307 - DNA, 20 bp, human
gcgccgcgtcgcttgggtcc

SEQ ID NO: 227308 - DNA, 20 bp, human
ggatgagcaaatgggcctag

SEQ ID NO: 227309 - DNA, 20 bp, human
gagcccggacccaagcgacg

SEQ ID NO: 227310 - DNA, 20 bp, human
gcaggactcggaggcggaaa

SEQ ID NO: 227311 - DNA, 20 bp, human
gaagtctagggtgttaggtc

SEQ ID NO: 227312 - DNA, 20 bp, human
gtgggcctagaggtggacaa

SEQ ID NO: 227313 - DNA, 20 bp, human
gcaggcaacgcaggactcgg

SEQ ID NO: 227314 - DNA, 20 bp, human
gaggcccatttgctcatctg

SEQ ID NO: 227315 - DNA, 20 bp, human
gcaaagaagtctagggtgtt

SEQ ID NO: 227316 - DNA, 20 bp, human
gacgggggtcagaagaccga

SEQ ID NO: 227317 - DNA, 20 bp, human
gaagaccgagggcgacctcg

SEQ ID NO: 227318 - DNA, 20 bp, human
gcccgcggggctattgtccc

SEQ ID NO: 227319 - DNA, 20 bp, human
gtacactgagacaaggaagt

SEQ ID NO: 227320 - DNA, 20 bp, human
gggcgaaagcatcgggtctc

SEQ ID NO: 227321 - DNA, 20 bp, human
gggcgacctcgaggcgaggg

SEQ ID NO: 227322 - DNA, 20 bp, human
ggcgagggcgggacagcggc

SEQ ID NO: 227323 - DNA, 20 bp, human
gctcgcctcgaggtcgccct

SEQ ID NO: 227324 - DNA, 20 bp, human
ggagacgctggcgaaagcat

SEQ ID NO: 227325 - DNA, 20 bp, human
gctgtcccgccctcgcctcg

SEQ ID NO: 227326 - DNA, 20 bp, human
gcccaggaaccgagcggggt

SEQ ID NO: 227327 - DNA, 20 bp, human
gccccgagtcggcccagtga

SEQ ID NO: 227328 - DNA, 20 bp, human
ggaagcgcgcagcgagcaga

SEQ ID NO: 227329 - DNA, 20 bp, human
ggcggggcccgcgtcgtcag

SEQ ID NO: 227330 - DNA, 20 bp, human
gcaggtggcggtccccgagt

SEQ ID NO: 227331 - DNA, 20 bp, human
ggggcgacgcgagcccgctg

SEQ ID NO: 227332 - DNA, 20 bp, human
gagcgcaggcctagcgtgga

SEQ ID NO: 227333 - DNA, 20 bp, human
ggctgctcccaggaaccgag

SEQ ID NO: 227334 - DNA, 20 bp, human
ggagcccgctggggccgctt

SEQ ID NO: 227335 - DNA, 20 bp, human
gcagcagttcagccctcact

SEQ ID NO: 227336 - DNA, 20 bp, human
gttcccggaactctattcgg

SEQ ID NO: 227337 - DNA, 20 bp, human
gccggcgaactcactggata

SEQ ID NO: 227338 - DNA, 20 bp, human
ggccctcagccaccaccgga

SEQ ID NO: 227339 - DNA, 20 bp, human
gtcactggatagggctgaga

SEQ ID NO: 227340 - DNA, 20 bp, human
gagcctccgaatagagttcc

SEQ ID NO: 227341 - DNA, 20 bp, human
gcgcccaccggcgaactcac

SEQ ID NO: 227342 - DNA, 20 bp, human
gtgcgcctgcgcagccttct

SEQ ID NO: 227343 - DNA, 20 bp, human
ggggttcccggaactctatt

SEQ ID NO: 227344 - DNA, 20 bp, human
gcaccaccggaaggaagaca

SEQ ID NO: 227345 - DNA, 20 bp, human
gaacgcgtttgtagaggggt

SEQ ID NO: 227346 - DNA, 20 bp, human
gcgagcccaagcgcggggga

SEQ ID NO: 227347 - DNA, 20 bp, human
gtgtggccggcgagcgtaaa

SEQ ID NO: 227348 - DNA, 20 bp, human
gaaagggcggggctccgccc

SEQ ID NO: 227349 - DNA, 20 bp, human
gacgctcgccggccacagat

SEQ ID NO: 227350 - DNA, 20 bp, human
ggctctgggcggtgcagcct

SEQ ID NO: 227351 - DNA, 20 bp, human
ggctgcgtgacagttgtcgc

SEQ ID NO: 227352 - DNA, 20 bp, human
ggcctggcgcccgctgtgat

SEQ ID NO: 227353 - DNA, 20 bp, human
gtggtcctgccgtaggaggc

SEQ ID NO: 227354 - DNA, 20 bp, human
gctcacgtacccgcctccta

SEQ ID NO: 227355 - DNA, 20 bp, human
gacacgcgccgccaatcagg

SEQ ID NO: 227356 - DNA, 20 bp, human
gaggacgcacagtggaaacc

SEQ ID NO: 227357 - DNA, 20 bp, human
ggtcacgcggcgcccagcgc

SEQ ID NO: 227358 - DNA, 20 bp, human
ggcgccgcgtgacagttgcc

SEQ ID NO: 227359 - DNA, 20 bp, human
gcctggggatgagtgtttac

SEQ ID NO: 227360 - DNA, 20 bp, human
gagaacctgtgtgtcagggg

SEQ ID NO: 227361 - DNA, 20 bp, human
gcagcctggcaactgtcacg

SEQ ID NO: 227362 - DNA, 20 bp, human
ggcgcccagcgctggcttct

SEQ ID NO: 227363 - DNA, 20 bp, human
ggtagcctgaggacgcacag

SEQ ID NO: 227364 - DNA, 20 bp, human
gttgccaggctgccagacac

SEQ ID NO: 227365 - DNA, 20 bp, human
gctcctggagaccagcctga

SEQ ID NO: 227366 - DNA, 20 bp, human
gcaagctcagaacccgagtg

SEQ ID NO: 227367 - DNA, 20 bp, human
gaccaagtcgctgaagggga

SEQ ID NO: 227368 - DNA, 20 bp, human
gtccactcagggagatacgt

SEQ ID NO: 227369 - DNA, 20 bp, human
gggccccagaccagtcgatt

SEQ ID NO: 227370 - DNA, 20 bp, human
gacaacagtcacttccggga

SEQ ID NO: 227371 - DNA, 20 bp, human
ggggcccgagatttccactc

SEQ ID NO: 227372 - DNA, 20 bp, human
gccggcctgggaaagttcgg

SEQ ID NO: 227373 - DNA, 20 bp, human
gaagtggagactgaaagcgg

SEQ ID NO: 227374 - DNA, 20 bp, human
ggggacgctggaatgtggag

SEQ ID NO: 227375 - DNA, 20 bp, human
gggcggacctcccaatcgac

SEQ ID NO: 227376 - DNA, 20 bp, human
gctgaggagactgttgctgt

SEQ ID NO: 227377 - DNA, 20 bp, human
ggctgctggccctccgaaga

SEQ ID NO: 227378 - DNA, 20 bp, human
gtgactgctgaccactcttt

SEQ ID NO: 227379 - DNA, 20 bp, human
gagtctcattaactacacgc

SEQ ID NO: 227380 - DNA, 20 bp, human
gtcttttggggttctaaact

SEQ ID NO: 227381 - DNA, 20 bp, human
gcccaaaggattgacacaaa

SEQ ID NO: 227382 - DNA, 20 bp, human
gaagtttctagaagaaactg

SEQ ID NO: 227383 - DNA, 20 bp, human
ggttcttttccgtcttcgga

SEQ ID NO: 227384 - DNA, 20 bp, human
ggaagaaattctactttagc

SEQ ID NO: 227385 - DNA, 20 bp, human
gactttagcaggaaattgaa

SEQ ID NO: 227386 - DNA, 20 bp, human
gggcacacctgcgcgctcgc

SEQ ID NO: 227387 - DNA, 20 bp, human
gacaggagaactcgaggcga

SEQ ID NO: 227388 - DNA, 20 bp, human
gcgaggcgaaggtgcggcgt

SEQ ID NO: 227389 - DNA, 20 bp, human
gggcgtcggtgcaggagcgg

SEQ ID NO: 227390 - DNA, 20 bp, human
gccaggaaacacgggatcac

SEQ ID NO: 227391 - DNA, 20 bp, human
gagaactcgaggcgaaggtg

SEQ ID NO: 227392 - DNA, 20 bp, human
ggggatcacaggagaactcg

SEQ ID NO: 227393 - DNA, 20 bp, human
gcggggcagtagtttgcact

SEQ ID NO: 227394 - DNA, 20 bp, human
gtgcggcgtcggtgcaggag

SEQ ID NO: 227395 - DNA, 20 bp, human
gcgtctatctacgcacctcg

SEQ ID NO: 227396 - DNA, 20 bp, human
gaggcggggaatgccatcat

SEQ ID NO: 227397 - DNA, 20 bp, human
gcccccatgggccccgttaa

SEQ ID NO: 227398 - DNA, 20 bp, human
gggccccgttaacggataca

SEQ ID NO: 227399 - DNA, 20 bp, human
ggagaccagcttggaagctt

SEQ ID NO: 227400 - DNA, 20 bp, human
gtatccgttaacggggccca

SEQ ID NO: 227401 - DNA, 20 bp, human
gctagggctgagtacaaagg

SEQ ID NO: 227402 - DNA, 20 bp, human
gacggtgagaaccggtgtga

SEQ ID NO: 227403 - DNA, 20 bp, human
ggatggcattccccgcctca

SEQ ID NO: 227404 - DNA, 20 bp, human
gagtgggggcggagacatct

SEQ ID NO: 227405 - DNA, 20 bp, human
gcgactagggctgagtacaa

SEQ ID NO: 227406 - DNA, 20 bp, human
gaacgaggacaagtgagtgc

SEQ ID NO: 227407 - DNA, 20 bp, human
gcgcctgcgccgtaacccag

SEQ ID NO: 227408 - DNA, 20 bp, human
ggggcgcagcggggtcgctg

SEQ ID NO: 227409 - DNA, 20 bp, human
gagcggggtcgctgaggcga

SEQ ID NO: 227410 - DNA, 20 bp, human
gtctaggggcaatgtctgag

SEQ ID NO: 227411 - DNA, 20 bp, human
gcgcaggcgcaagataagct

SEQ ID NO: 227412 - DNA, 20 bp, human
gcccctctccacatagaagt

SEQ ID NO: 227413 - DNA, 20 bp, human
gaaagtgcgcatgcgctgac

SEQ ID NO: 227414 - DNA, 20 bp, human
gcccggaagtgatttcctct

SEQ ID NO: 227415 - DNA, 20 bp, human
gagcgacactacgactcgcg

SEQ ID NO: 227416 - DNA, 20 bp, human
gggtctaaggcggagttcaa

SEQ ID NO: 227417 - DNA, 20 bp, human
gaaacctggggctgtggagt

SEQ ID NO: 227418 - DNA, 20 bp, human
gctgcagaatcgatttatga

SEQ ID NO: 227419 - DNA, 20 bp, human
ggagagagtgagatggtaac

SEQ ID NO: 227420 - DNA, 20 bp, human
ggacccacggtattttgcta

SEQ ID NO: 227421 - DNA, 20 bp, human
gatcgattctgcagcttctc

SEQ ID NO: 227422 - DNA, 20 bp, human
ggaggttgtacactgaacat

SEQ ID NO: 227423 - DNA, 20 bp, human
gatcgatttatgagggtctc

SEQ ID NO: 227424 - DNA, 20 bp, human
gtgaatgtataggtctaagg

SEQ ID NO: 227425 - DNA, 20 bp, human
ggcaggtggtgtgtgaccca

SEQ ID NO: 227426 - DNA, 20 bp, human
gggcccccggttctggatgg

SEQ ID NO: 227427 - DNA, 20 bp, human
ggctgcggggcccccggttc

SEQ ID NO: 227428 - DNA, 20 bp, human
gtctggaggcggatgcaaaa

SEQ ID NO: 227429 - DNA, 20 bp, human
gtcctcctgcttcgcggggt

SEQ ID NO: 227430 - DNA, 20 bp, human
gaaagcagcgcttcctctgg

SEQ ID NO: 227431 - DNA, 20 bp, human
gggcccgtccttcctgagca

SEQ ID NO: 227432 - DNA, 20 bp, human
gctgggcccaaaccctgctc

SEQ ID NO: 227433 - DNA, 20 bp, human
ggagaaagcagcgcttcctc

SEQ ID NO: 227434 - DNA, 20 bp, human
gcccccccaccccgcgaagc

SEQ ID NO: 227435 - DNA, 20 bp, human
gaggaagggccggagcgagg

SEQ ID NO: 227436 - DNA, 20 bp, human
ggtgccgcgcggtgggtgat

SEQ ID NO: 227437 - DNA, 20 bp, human
ggccacacggcatacagcgc

SEQ ID NO: 227438 - DNA, 20 bp, human
gctgccgcgccagcagggac

SEQ ID NO: 227439 - DNA, 20 bp, human
gcgtgtggccgctacctcgc

SEQ ID NO: 227440 - DNA, 20 bp, human
gcggcactgccgcgccagca

SEQ ID NO: 227441 - DNA, 20 bp, human
gacggcatacagcgcaggcg

SEQ ID NO: 227442 - DNA, 20 bp, human
gctggcgcggcagtgccgcg

SEQ ID NO: 227443 - DNA, 20 bp, human
ggggagagcctgcgaggtag

SEQ ID NO: 227444 - DNA, 20 bp, human
gtgtacaggcgcgagacggt

SEQ ID NO: 227445 - DNA, 20 bp, human
ggcgcggcagtgccgcgcgg

SEQ ID NO: 227446 - DNA, 20 bp, human
ggagctgttagcagtgtcaa

SEQ ID NO: 227447 - DNA, 20 bp, human
gcattcctggtccctaacct

SEQ ID NO: 227448 - DNA, 20 bp, human
gtgtgggaagaagttctata

SEQ ID NO: 227449 - DNA, 20 bp, human
gagaacagctgccaaggtta

SEQ ID NO: 227450 - DNA, 20 bp, human
gcagaccagatttggggata

SEQ ID NO: 227451 - DNA, 20 bp, human
ggggaagactacatggtttc

SEQ ID NO: 227452 - DNA, 20 bp, human
gaacaaagccgcctcttcct

SEQ ID NO: 227453 - DNA, 20 bp, human
gagggcacttttgcacatgt

SEQ ID NO: 227454 - DNA, 20 bp, human
gcaaatatgcagaccagatt

SEQ ID NO: 227455 - DNA, 20 bp, human
gagtatttgtgatgtcactt

SEQ ID NO: 227456 - DNA, 20 bp, human
ggggtcgcagggtaaatccg

SEQ ID NO: 227457 - DNA, 20 bp, human
gacgacagcgccattcaccc

SEQ ID NO: 227458 - DNA, 20 bp, human
gaaccaatagcaaccgaggg

SEQ ID NO: 227459 - DNA, 20 bp, human
gaagacgtgattgaatgtgt

SEQ ID NO: 227460 - DNA, 20 bp, human
gtgtcggcgcttctcgaaga

SEQ ID NO: 227461 - DNA, 20 bp, human
gatgacatatggtggatcta

SEQ ID NO: 227462 - DNA, 20 bp, human
gagccgccctcggttgctat

SEQ ID NO: 227463 - DNA, 20 bp, human
gcggcgcttctcgaagaagg

SEQ ID NO: 227464 - DNA, 20 bp, human
gccgcctggcccggggtgaa

SEQ ID NO: 227465 - DNA, 20 bp, human
gttgagaggcggctgacgta

SEQ ID NO: 227466 - DNA, 20 bp, human
gcaacccctgcacttttctc

SEQ ID NO: 227467 - DNA, 20 bp, human
ggaggcatttggtgggtctg

SEQ ID NO: 227468 - DNA, 20 bp, human
gtgactgcattattcatcct

SEQ ID NO: 227469 - DNA, 20 bp, human
ggcattgtgaggcatttggt

SEQ ID NO: 227470 - DNA, 20 bp, human
gaggaggttttgtggttact

SEQ ID NO: 227471 - DNA, 20 bp, human
gtggttgtttcctggcaacc

SEQ ID NO: 227472 - DNA, 20 bp, human
gctattttatagacaatgaa

SEQ ID NO: 227473 - DNA, 20 bp, human
gcagtcaccacagagggaca

SEQ ID NO: 227474 - DNA, 20 bp, human
gaggggttggaggttgttat

SEQ ID NO: 227475 - DNA, 20 bp, human
gtcaccacagagggacaggg

SEQ ID NO: 227476 - DNA, 20 bp, human
gaggcattggggggggctgt

SEQ ID NO: 227477 - DNA, 20 bp, human
ggcattatgaggcattgggg

SEQ ID NO: 227478 - DNA, 20 bp, human
gtagtgcagtccccacagag

SEQ ID NO: 227479 - DNA, 20 bp, human
ggacaggcattatgaggcat

SEQ ID NO: 227480 - DNA, 20 bp, human
gcctgcacttagctcaggac

SEQ ID NO: 227481 - DNA, 20 bp, human
gctccccctgcacttagctc

SEQ ID NO: 227482 - DNA, 20 bp, human
gagcagggacaggcattatg

SEQ ID NO: 227483 - DNA, 20 bp, human
gaccactcccggccatacca

SEQ ID NO: 227484 - DNA, 20 bp, human
ggcctgacctggctgtttcc

SEQ ID NO: 227485 - DNA, 20 bp, human
gtgttattgcgagtcaccct

SEQ ID NO: 227486 - DNA, 20 bp, human
gccggcgcacgcactcacca

SEQ ID NO: 227487 - DNA, 20 bp, human
gccgggaagcgggagactca

SEQ ID NO: 227488 - DNA, 20 bp, human
gacgtcagctgcgctcccct

SEQ ID NO: 227489 - DNA, 20 bp, human
gccggcggatgagacggcgc

SEQ ID NO: 227490 - DNA, 20 bp, human
gggttaagacccaacgccgg

SEQ ID NO: 227491 - DNA, 20 bp, human
gccagtgcccccgtagaggg

SEQ ID NO: 227492 - DNA, 20 bp, human
gccaacgccggcggatgaga

SEQ ID NO: 227493 - DNA, 20 bp, human
gtggcccgaggttagaactc

SEQ ID NO: 227494 - DNA, 20 bp, human
gaccatggctgcggttccgc

SEQ ID NO: 227495 - DNA, 20 bp, human
ggcccgcggaaccgcagcca

SEQ ID NO: 227496 - DNA, 20 bp, human
ggcgacgcgcgcacgtggcg

SEQ ID NO: 227497 - DNA, 20 bp, human
gcacgccgcgttgggagcag

SEQ ID NO: 227498 - DNA, 20 bp, human
gttcatcagcccaaccccgg

SEQ ID NO: 227499 - DNA, 20 bp, human
ggcacagcagccgccggggt

SEQ ID NO: 227500 - DNA, 20 bp, human
gcccgcgggcaggcgccgga

SEQ ID NO: 227501 - DNA, 20 bp, human
gctcccccctgctcccaacg

SEQ ID NO: 227502 - DNA, 20 bp, human
gcgggcctttaggggggcgg

SEQ ID NO: 227503 - DNA, 20 bp, human
gcgtgcccccgcccccctaa

SEQ ID NO: 227504 - DNA, 20 bp, human
gggaaggccgggcctttagg

SEQ ID NO: 227505 - DNA, 20 bp, human
ggttgggctgatgaatccgg

SEQ ID NO: 227506 - DNA, 20 bp, human
gaggttccggggttgaaaat

SEQ ID NO: 227507 - DNA, 20 bp, human
gtcgctggaggagggcggga

SEQ ID NO: 227508 - DNA, 20 bp, human
gagcaccgcgattgcaagat

SEQ ID NO: 227509 - DNA, 20 bp, human
ggcgctccctcgctggagga

SEQ ID NO: 227510 - DNA, 20 bp, human
gcgggagggctagcagcgag

SEQ ID NO: 227511 - DNA, 20 bp, human
gaaaggagccgcacccgcgc

SEQ ID NO: 227512 - DNA, 20 bp, human
gcagcgagcggaggaggttc

SEQ ID NO: 227513 - DNA, 20 bp, human
gggtgcggctcctttaaggg

SEQ ID NO: 227514 - DNA, 20 bp, human
ggagggctagcagcgagcgg

SEQ ID NO: 227515 - DNA, 20 bp, human
gttccggggttgaaaatagg

SEQ ID NO: 227516 - DNA, 20 bp, human
ggtgtcagacacgtggtaca

SEQ ID NO: 227517 - DNA, 20 bp, human
gacaccggggaacctctcta

SEQ ID NO: 227518 - DNA, 20 bp, human
ggtgcagcggggcagaacat

SEQ ID NO: 227519 - DNA, 20 bp, human
gtccataggtcaagcttaaa

SEQ ID NO: 227520 - DNA, 20 bp, human
ggacggagctaaaactgacg

SEQ ID NO: 227521 - DNA, 20 bp, human
ggtgagcggtgtcagacacg

SEQ ID NO: 227522 - DNA, 20 bp, human
ggaggcattcatcttggaac

SEQ ID NO: 227523 - DNA, 20 bp, human
gtaagcttgacctatggagg

SEQ ID NO: 227524 - DNA, 20 bp, human
gttagggaagtatccgttct

SEQ ID NO: 227525 - DNA, 20 bp, human
gaatatgggcattagagggt

SEQ ID NO: 227526 - DNA, 20 bp, human
gggaacccgacgactttcac

SEQ ID NO: 227527 - DNA, 20 bp, human
gggaaggaggagcgctcttc

SEQ ID NO: 227528 - DNA, 20 bp, human
gccttccggtgaaagtcgtc

SEQ ID NO: 227529 - DNA, 20 bp, human
gtgagaactccgcagactcc

SEQ ID NO: 227530 - DNA, 20 bp, human
gtgggcggtaggcggtgcta

SEQ ID NO: 227531 - DNA, 20 bp, human
gtccagctgcgcaagcgcat

SEQ ID NO: 227532 - DNA, 20 bp, human
gtaggggagcgagtcgtgac

SEQ ID NO: 227533 - DNA, 20 bp, human
gtgctgttgcgcacttccgg

SEQ ID NO: 227534 - DNA, 20 bp, human
gcctctccggggttggctgg

SEQ ID NO: 227535 - DNA, 20 bp, human
gcgcaacagcactcatacaa

SEQ ID NO: 227536 - DNA, 20 bp, human
gtccctgtccctctgccacg

SEQ ID NO: 227537 - DNA, 20 bp, human
gcaggcagcgcccctctgct

SEQ ID NO: 227538 - DNA, 20 bp, human
gaacttgttcggggtttccg

SEQ ID NO: 227539 - DNA, 20 bp, human
gcactggcaagcgctcccag

SEQ ID NO: 227540 - DNA, 20 bp, human
gagcctggcgtcaggttacc

SEQ ID NO: 227541 - DNA, 20 bp, human
gtgcctggtaacctgacgcc

SEQ ID NO: 227542 - DNA, 20 bp, human
gaggaaacagaaacttgttc

SEQ ID NO: 227543 - DNA, 20 bp, human
gagtcattgtgaggatcgac

SEQ ID NO: 227544 - DNA, 20 bp, human
gtaaacccctctgggttagg

SEQ ID NO: 227545 - DNA, 20 bp, human
ggccagtgggccgagcagag

SEQ ID NO: 227546 - DNA, 20 bp, human
gccagtgcatgcagacctcc

SEQ ID NO: 227547 - DNA, 20 bp, human
gctggccgcagtactgaagg

SEQ ID NO: 227548 - DNA, 20 bp, human
gctcctggccgcagtactga

SEQ ID NO: 227549 - DNA, 20 bp, human
ggcagacctcccggcgtcgt

SEQ ID NO: 227550 - DNA, 20 bp, human
gcgccagcggcccaacccgg

SEQ ID NO: 227551 - DNA, 20 bp, human
gttacatgcagggtgagtga

SEQ ID NO: 227552 - DNA, 20 bp, human
gactcagcctacggtataag

SEQ ID NO: 227553 - DNA, 20 bp, human
gcctctcccacgacgccggg

SEQ ID NO: 227554 - DNA, 20 bp, human
gggtctgcgcgaagctgtcg

SEQ ID NO: 227555 - DNA, 20 bp, human
gagtactgcggccaggagag

SEQ ID NO: 227556 - DNA, 20 bp, human
gacaagcaggtggtcacggt

SEQ ID NO: 227557 - DNA, 20 bp, human
gtccctgccaccagcctccg

SEQ ID NO: 227558 - DNA, 20 bp, human
gggagacaagcaggtggtca

SEQ ID NO: 227559 - DNA, 20 bp, human
gcagcccccgggccctggcg

SEQ ID NO: 227560 - DNA, 20 bp, human
ggcagggaggagcctcgcca

SEQ ID NO: 227561 - DNA, 20 bp, human
gaatctgcgggcgtgagcgc

SEQ ID NO: 227562 - DNA, 20 bp, human
gagtcgggaaagctcctcgc

SEQ ID NO: 227563 - DNA, 20 bp, human
gtcctcgccggcagcgagta

SEQ ID NO: 227564 - DNA, 20 bp, human
gcgtactcggaggaatacgg

SEQ ID NO: 227565 - DNA, 20 bp, human
gcgcgggcggccgtactcgg

SEQ ID NO: 227566 - DNA, 20 bp, human
gaggagcgcagaggagtcag

SEQ ID NO: 227567 - DNA, 20 bp, human
ggagcactcccatctgagac

SEQ ID NO: 227568 - DNA, 20 bp, human
gtccaaatcccgtctcagat

SEQ ID NO: 227569 - DNA, 20 bp, human
gctcagatgggagtgctcgg

SEQ ID NO: 227570 - DNA, 20 bp, human
gagtcagaggtgagtgatgc

SEQ ID NO: 227571 - DNA, 20 bp, human
gggcgcgacgcttggagaac

SEQ ID NO: 227572 - DNA, 20 bp, human
gaaggcgcccaacgggccgc

SEQ ID NO: 227573 - DNA, 20 bp, human
gccagtgggtccggagaccg

SEQ ID NO: 227574 - DNA, 20 bp, human
ggaattccgcagggccgaga

SEQ ID NO: 227575 - DNA, 20 bp, human
gaggccggaaggcgcccaac

SEQ ID NO: 227576 - DNA, 20 bp, human
gaggggcggcagaggctcaa

SEQ ID NO: 227577 - DNA, 20 bp, human
gtcgccgaggaaagataagg

SEQ ID NO: 227578 - DNA, 20 bp, human
gctcactgtcgcaggaggaa

SEQ ID NO: 227579 - DNA, 20 bp, human
gcagccttgtggggccggga

SEQ ID NO: 227580 - DNA, 20 bp, human
gatccacagcccccactcgg

SEQ ID NO: 227581 - DNA, 20 bp, human
ggaagggtgctgtcccgcgc

SEQ ID NO: 227582 - DNA, 20 bp, human
ggggctgacgttgagaaagc

SEQ ID NO: 227583 - DNA, 20 bp, human
gcgggaggaagggctttgat

SEQ ID NO: 227584 - DNA, 20 bp, human
gcccccgctctcaaaaatgg

SEQ ID NO: 227585 - DNA, 20 bp, human
gagacaagcaggggcggcag

SEQ ID NO: 227586 - DNA, 20 bp, human
gacccgctcaacttcatcct

SEQ ID NO: 227587 - DNA, 20 bp, human
gcgcctgcgctctctttcta

SEQ ID NO: 227588 - DNA, 20 bp, human
gaagtggtcatgtgataccc

SEQ ID NO: 227589 - DNA, 20 bp, human
gccaaggcggggaggacctg

SEQ ID NO: 227590 - DNA, 20 bp, human
gaaagagagcgcaggcgcct

SEQ ID NO: 227591 - DNA, 20 bp, human
gtcatcctgggttgaggcgg

SEQ ID NO: 227592 - DNA, 20 bp, human
gaacccaggatgaagttgag

SEQ ID NO: 227593 - DNA, 20 bp, human
gagcgggtctgctgcgcttc

SEQ ID NO: 227594 - DNA, 20 bp, human
gggcgaaatccctcccactc

SEQ ID NO: 227595 - DNA, 20 bp, human
gttctcctccgcctcaaccc

SEQ ID NO: 227596 - DNA, 20 bp, human
gatgctgcctgaggtgtgaa

SEQ ID NO: 227597 - DNA, 20 bp, human
gcaccaaaggagttcaactc

SEQ ID NO: 227598 - DNA, 20 bp, human
gggccagagttgaactcctt

SEQ ID NO: 227599 - DNA, 20 bp, human
gctgcaaggtatgaattctg

SEQ ID NO: 227600 - DNA, 20 bp, human
gtaaaatgtgaactgactcc

SEQ ID NO: 227601 - DNA, 20 bp, human
gaattcataccttgcagctg

SEQ ID NO: 227602 - DNA, 20 bp, human
gaacttgcgccacacttgca

SEQ ID NO: 227603 - DNA, 20 bp, human
gcttgcaaggtgtagaatca

SEQ ID NO: 227604 - DNA, 20 bp, human
gcttctacgtgcagcaccta

SEQ ID NO: 227605 - DNA, 20 bp, human
gtctcacattatgctgcctg

SEQ ID NO: 227606 - DNA, 20 bp, human
gcccgggagcgcgccgaatg

SEQ ID NO: 227607 - DNA, 20 bp, human
ggtgcccagtccccagccgg

SEQ ID NO: 227608 - DNA, 20 bp, human
gccgggctcgggccccccgg

SEQ ID NO: 227609 - DNA, 20 bp, human
gttcgcgctgccgccggctg

SEQ ID NO: 227610 - DNA, 20 bp, human
gggctcgggccccccggcgg

SEQ ID NO: 227611 - DNA, 20 bp, human
gacgccgggctcgggccccc

SEQ ID NO: 227612 - DNA, 20 bp, human
gcagagacagcggtgagagc

SEQ ID NO: 227613 - DNA, 20 bp, human
gactgggcaccgccctcccg

SEQ ID NO: 227614 - DNA, 20 bp, human
gcgaagcgccttccccgctt

SEQ ID NO: 227615 - DNA, 20 bp, human
gcagctgcagacgcgccgcc

SEQ ID NO: 227616 - DNA, 20 bp, human
ggcgggagagaggacctcgg

SEQ ID NO: 227617 - DNA, 20 bp, human
ggcgctgcccgcagcgaaag

SEQ ID NO: 227618 - DNA, 20 bp, human
gaaagcggttaggacaagct

SEQ ID NO: 227619 - DNA, 20 bp, human
gcaggggctgcgttcccctt

SEQ ID NO: 227620 - DNA, 20 bp, human
ggcccgcagcgaaagcggtt

SEQ ID NO: 227621 - DNA, 20 bp, human
gggccccctggccactcaga

SEQ ID NO: 227622 - DNA, 20 bp, human
gcgccgcgccagagggctga

SEQ ID NO: 227623 - DNA, 20 bp, human
ggttccccttggggccgggg

SEQ ID NO: 227624 - DNA, 20 bp, human
ggcacgggcgagtaccaccg

SEQ ID NO: 227625 - DNA, 20 bp, human
gctgccggggcgggacccag

SEQ ID NO: 227626 - DNA, 20 bp, human
ggagaccgctgagacactgg

SEQ ID NO: 227627 - DNA, 20 bp, human
gggtgagcgcccagtaagat

SEQ ID NO: 227628 - DNA, 20 bp, human
ggccacttgccgcgcgtggg

SEQ ID NO: 227629 - DNA, 20 bp, human
gagacaacgcgagctcaggt

SEQ ID NO: 227630 - DNA, 20 bp, human
gtactgggcgctcacctcca

SEQ ID NO: 227631 - DNA, 20 bp, human
gcaacgcgagctcaggtggg

SEQ ID NO: 227632 - DNA, 20 bp, human
gtcagagaccgctgagacac

SEQ ID NO: 227633 - DNA, 20 bp, human
gggtcagagccgcccacgcg

SEQ ID NO: 227634 - DNA, 20 bp, human
gcctagcggctgtaaagctc

SEQ ID NO: 227635 - DNA, 20 bp, human
gagaacatacgccgacctag

SEQ ID NO: 227636 - DNA, 20 bp, human
gtggtacagtttaaaaatag

SEQ ID NO: 227637 - DNA, 20 bp, human
gtatagaacagagttaaatc

SEQ ID NO: 227638 - DNA, 20 bp, human
ggagaaatgctttgattatt

SEQ ID NO: 227639 - DNA, 20 bp, human
gttaaaaaaataggtatgaa

SEQ ID NO: 227640 - DNA, 20 bp, human
gggatagcagccaggcgccg

SEQ ID NO: 227641 - DNA, 20 bp, human
gttaaatttatgttgttttg

SEQ ID NO: 227642 - DNA, 20 bp, human
gtattaggatttaaaaaaat

SEQ ID NO: 227643 - DNA, 20 bp, human
gccactttcattttgtttgt

SEQ ID NO: 227644 - DNA, 20 bp, human
gtttaactttttgtgtgtga

SEQ ID NO: 227645 - DNA, 20 bp, human
gaaaatagtggatagcagcc

SEQ ID NO: 227646 - DNA, 20 bp, human
gtggctgggagatttcttac

SEQ ID NO: 227647 - DNA, 20 bp, human
gccgcgcgccaggctgacat

SEQ ID NO: 227648 - DNA, 20 bp, human
gtctctctgatctggaccac

SEQ ID NO: 227649 - DNA, 20 bp, human
gtaccgcgccggagctgatc

SEQ ID NO: 227650 - DNA, 20 bp, human
ggtactgtgacgtcacctga

SEQ ID NO: 227651 - DNA, 20 bp, human
gccaagaggtctctctgatc

SEQ ID NO: 227652 - DNA, 20 bp, human
gagaagccagaagcacatca

SEQ ID NO: 227653 - DNA, 20 bp, human
gaaccccgacaccctccaag

SEQ ID NO: 227654 - DNA, 20 bp, human
ggaccggaagtgcccccctc

SEQ ID NO: 227655 - DNA, 20 bp, human
gtgacgtcacagtaccgcgc

SEQ ID NO: 227656 - DNA, 20 bp, human
gagcgtgcctatcctatcag

SEQ ID NO: 227657 - DNA, 20 bp, human
gagctcaagtgcttaaggga

SEQ ID NO: 227658 - DNA, 20 bp, human
gtgaatatgcacattagcag

SEQ ID NO: 227659 - DNA, 20 bp, human
gagcagagggttcgtcccac

SEQ ID NO: 227660 - DNA, 20 bp, human
gcggccctcagtcctctgat

SEQ ID NO: 227661 - DNA, 20 bp, human
gccactcccagcgatccgtg

SEQ ID NO: 227662 - DNA, 20 bp, human
ggataggtgggcggtgatat

SEQ ID NO: 227663 - DNA, 20 bp, human
gccaatagacggggccatct

SEQ ID NO: 227664 - DNA, 20 bp, human
ggctctgccgcacggatcgc

SEQ ID NO: 227665 - DNA, 20 bp, human
gccagagcttattggccagt

SEQ ID NO: 227666 - DNA, 20 bp, human
gcgcggggcgggttgccgaa

SEQ ID NO: 227667 - DNA, 20 bp, human
gcggtgtcggagaaagagac

SEQ ID NO: 227668 - DNA, 20 bp, human
ggacggggccgactcaccag

SEQ ID NO: 227669 - DNA, 20 bp, human
gtgccgaagggcctcggcct

SEQ ID NO: 227670 - DNA, 20 bp, human
gcaggacggcagcagatcac

SEQ ID NO: 227671 - DNA, 20 bp, human
ggtgctggagagcggggacg

SEQ ID NO: 227672 - DNA, 20 bp, human
gcgctcggacccagccactc

SEQ ID NO: 227673 - DNA, 20 bp, human
gctccagccggggtaccggg

SEQ ID NO: 227674 - DNA, 20 bp, human
ggcgggttgccgaagggcct

SEQ ID NO: 227675 - DNA, 20 bp, human
gaacacgagcgacagagaaa

SEQ ID NO: 227676 - DNA, 20 bp, human
gtgcagcagtgcatacagga

SEQ ID NO: 227677 - DNA, 20 bp, human
gaggtggcaccaactcccta

SEQ ID NO: 227678 - DNA, 20 bp, human
gaggagggtatgattagctc

SEQ ID NO: 227679 - DNA, 20 bp, human
gcacctgcagcagtgcatac

SEQ ID NO: 227680 - DNA, 20 bp, human
gtggggtactgttccaagca

SEQ ID NO: 227681 - DNA, 20 bp, human
gggagactgccagccctcgt

SEQ ID NO: 227682 - DNA, 20 bp, human
ggggctctgtttcccgtgct

SEQ ID NO: 227683 - DNA, 20 bp, human
gccttcccaagaacaggtcg

SEQ ID NO: 227684 - DNA, 20 bp, human
ggagacctcgacctgttctt

SEQ ID NO: 227685 - DNA, 20 bp, human
gagaagatgcacacccacga

SEQ ID NO: 227686 - DNA, 20 bp, human
gacctcgagggaaagaattc

SEQ ID NO: 227687 - DNA, 20 bp, human
gattcctggggcaacctcga

SEQ ID NO: 227688 - DNA, 20 bp, human
gtccaatggcagaggtcaaa

SEQ ID NO: 227689 - DNA, 20 bp, human
gcggaagtgacgtactcggg

SEQ ID NO: 227690 - DNA, 20 bp, human
ggaaagaattctggctccga

SEQ ID NO: 227691 - DNA, 20 bp, human
gccccgcgaaggaagcgttg

SEQ ID NO: 227692 - DNA, 20 bp, human
gttgcggaagtgacgtactc

SEQ ID NO: 227693 - DNA, 20 bp, human
gaggcgcgactaatcgtggc

SEQ ID NO: 227694 - DNA, 20 bp, human
gcagaaggcgcgactaatcg

SEQ ID NO: 227695 - DNA, 20 bp, human
gcaagtttcgcaggaagaga

SEQ ID NO: 227696 - DNA, 20 bp, human
gactccggccttggggtagg

SEQ ID NO: 227697 - DNA, 20 bp, human
gccccctcgtggatgctgcg

SEQ ID NO: 227698 - DNA, 20 bp, human
gagcaagtgcaataatggtg

SEQ ID NO: 227699 - DNA, 20 bp, human
gcctcccccaccctgtgcgg

SEQ ID NO: 227700 - DNA, 20 bp, human
gaggactccggccttggggt

SEQ ID NO: 227701 - DNA, 20 bp, human
gagcctcgcagcatccacga

SEQ ID NO: 227702 - DNA, 20 bp, human
gctgcgaggctcgcaagaaa

SEQ ID NO: 227703 - DNA, 20 bp, human
gaggccggagtcctccgcac

SEQ ID NO: 227704 - DNA, 20 bp, human
gccggaagcaagtgcaataa

SEQ ID NO: 227705 - DNA, 20 bp, human
gggagtcctccgcacagggt

SEQ ID NO: 227706 - DNA, 20 bp, human
gtggggagagcaatggatga

SEQ ID NO: 227707 - DNA, 20 bp, human
gagaaggtcccagagcttcg

SEQ ID NO: 227708 - DNA, 20 bp, human
gcccactaacacagcctgtc

SEQ ID NO: 227709 - DNA, 20 bp, human
gtgcttcacagcgttatcaa

SEQ ID NO: 227710 - DNA, 20 bp, human
gcagcccccacctctactct

SEQ ID NO: 227711 - DNA, 20 bp, human
gtgcctatgtcacaaaggtc

SEQ ID NO: 227712 - DNA, 20 bp, human
gttggagctgtaaagtgtat

SEQ ID NO: 227713 - DNA, 20 bp, human
gataggccaagagtagaggt

SEQ ID NO: 227714 - DNA, 20 bp, human
ggtgtataggccaagagtag

SEQ ID NO: 227715 - DNA, 20 bp, human
gcctgagttcagttcccccc

SEQ ID NO: 227716 - DNA, 20 bp, human
gtctccagggaccccaagcc

SEQ ID NO: 227717 - DNA, 20 bp, human
ggggccaagggtcgatgggg

SEQ ID NO: 227718 - DNA, 20 bp, human
ggtgacattcccaattgctg

SEQ ID NO: 227719 - DNA, 20 bp, human
gatgagagagctcttctgaa

SEQ ID NO: 227720 - DNA, 20 bp, human
gagcccaggggccgggtatc

SEQ ID NO: 227721 - DNA, 20 bp, human
ggtgagaggcccacgtgcgg

SEQ ID NO: 227722 - DNA, 20 bp, human
ggggcggctccctgctggtt

SEQ ID NO: 227723 - DNA, 20 bp, human
gagagagctcttctgaaggg

SEQ ID NO: 227724 - DNA, 20 bp, human
ggggctgcagcccctcatag

SEQ ID NO: 227725 - DNA, 20 bp, human
ggggagcccccgactctcta

SEQ ID NO: 227726 - DNA, 20 bp, human
gtccaagtgggctaagtcta

SEQ ID NO: 227727 - DNA, 20 bp, human
gctggagcagccttccaagt

SEQ ID NO: 227728 - DNA, 20 bp, human
gacaaccacagggacacagg

SEQ ID NO: 227729 - DNA, 20 bp, human
gagtacaaccacagggacac

SEQ ID NO: 227730 - DNA, 20 bp, human
gcaggggcaagtacaaccac

SEQ ID NO: 227731 - DNA, 20 bp, human
gtagacagagaggtgccagg

SEQ ID NO: 227732 - DNA, 20 bp, human
ggctcaagacccttgctcta

SEQ ID NO: 227733 - DNA, 20 bp, human
gacaggtacccatagagcaa

SEQ ID NO: 227734 - DNA, 20 bp, human
gagcaagggtcttgagcttc

SEQ ID NO: 227735 - DNA, 20 bp, human
gctgggctgagttgtccaag

SEQ ID NO: 227736 - DNA, 20 bp, human
ggcgtgaaatgaagaacgtg

SEQ ID NO: 227737 - DNA, 20 bp, human
gagaacgtgcggcttccatg

SEQ ID NO: 227738 - DNA, 20 bp, human
gtcaataaggggcgggaaag

SEQ ID NO: 227739 - DNA, 20 bp, human
gtgtggcagggaaggatacg

SEQ ID NO: 227740 - DNA, 20 bp, human
gaaagtgggtgagtgtggca

SEQ ID NO: 227741 - DNA, 20 bp, human
gaggttaaaaagctgagttc

SEQ ID NO: 227742 - DNA, 20 bp, human
gcccgtgtccagatttacat

SEQ ID NO: 227743 - DNA, 20 bp, human
gtctacccctcaataagggg

SEQ ID NO: 227744 - DNA, 20 bp, human
gttcgtctacccctcaataa

SEQ ID NO: 227745 - DNA, 20 bp, human
gagggaaggatacgtggaag

SEQ ID NO: 227746 - DNA, 20 bp, human
gcgcgcgcctgggaccgctc

SEQ ID NO: 227747 - DNA, 20 bp, human
ggaaaagggaggcttgttaa

SEQ ID NO: 227748 - DNA, 20 bp, human
gtaaggatctgcgaaaaggg

SEQ ID NO: 227749 - DNA, 20 bp, human
ggctagagagccctcgggta

SEQ ID NO: 227750 - DNA, 20 bp, human
ggggtaaggatctgcgaaaa

SEQ ID NO: 227751 - DNA, 20 bp, human
ggagttgctagagagccctc

SEQ ID NO: 227752 - DNA, 20 bp, human
gcgcgcgaagaactgcgcag

SEQ ID NO: 227753 - DNA, 20 bp, human
ggaaaaccctcgaaaagaga

SEQ ID NO: 227754 - DNA, 20 bp, human
gacaaacctggcgggtcccc

SEQ ID NO: 227755 - DNA, 20 bp, human
gccgctccgggggacccgcc

SEQ ID NO: 227756 - DNA, 20 bp, human
gtggagggaactgacactgc

SEQ ID NO: 227757 - DNA, 20 bp, human
gggtctgggtgtagtaaagt

SEQ ID NO: 227758 - DNA, 20 bp, human
gtgaggtgttgtccagcaga

SEQ ID NO: 227759 - DNA, 20 bp, human
ggggttgatggccctttaag

SEQ ID NO: 227760 - DNA, 20 bp, human
gtcagttccctccaaggtct

SEQ ID NO: 227761 - DNA, 20 bp, human
ggtgtagtaaagtgggttga

SEQ ID NO: 227762 - DNA, 20 bp, human
ggctggacagtgcctcttaa

SEQ ID NO: 227763 - DNA, 20 bp, human
ggttcaagcaattcttcttg

SEQ ID NO: 227764 - DNA, 20 bp, human
gcacatttgatattcttaag

SEQ ID NO: 227765 - DNA, 20 bp, human
ggaactgacactgcaggttt

SEQ ID NO: 227766 - DNA, 20 bp, human
gagtggctgccgcatttcta

SEQ ID NO: 227767 - DNA, 20 bp, human
gccactggcacccaatccat

SEQ ID NO: 227768 - DNA, 20 bp, human
ggaagtcactgacttgagca

SEQ ID NO: 227769 - DNA, 20 bp, human
gcatgggtacttataaccaa

SEQ ID NO: 227770 - DNA, 20 bp, human
ggaattgccttgccaattat

SEQ ID NO: 227771 - DNA, 20 bp, human
gataaagcttaccaggagtt

SEQ ID NO: 227772 - DNA, 20 bp, human
gtctctttcacaccttggag

SEQ ID NO: 227773 - DNA, 20 bp, human
gagatcttcaagcttcttca

SEQ ID NO: 227774 - DNA, 20 bp, human
gtgccttgccaattataggc

SEQ ID NO: 227775 - DNA, 20 bp, human
gaaggctaataaagcttacc

SEQ ID NO: 227776 - DNA, 20 bp, human
gggtcgggtcgggtggagta

SEQ ID NO: 227777 - DNA, 20 bp, human
gaggccggggcctcccagac

SEQ ID NO: 227778 - DNA, 20 bp, human
ggcctcccagaccggaagtc

SEQ ID NO: 227779 - DNA, 20 bp, human
gaaagtcacgcagatggcga

SEQ ID NO: 227780 - DNA, 20 bp, human
gcgcacggagttttcgggtc

SEQ ID NO: 227781 - DNA, 20 bp, human
gcaaaagccctccgtccggg

SEQ ID NO: 227782 - DNA, 20 bp, human
gatgcagcgcacggagtttt

SEQ ID NO: 227783 - DNA, 20 bp, human
gggagttttcgggtctggtc

SEQ ID NO: 227784 - DNA, 20 bp, human
gttgacttccaccccccgga

SEQ ID NO: 227785 - DNA, 20 bp, human
gggccccgcatcctgacttc

SEQ ID NO: 227786 - DNA, 20 bp, human
gggatcccggagaagacggt

SEQ ID NO: 227787 - DNA, 20 bp, human
gtgtgggcgaaatcggtctt

SEQ ID NO: 227788 - DNA, 20 bp, human
gcacgcccaccgtcttctcc

SEQ ID NO: 227789 - DNA, 20 bp, human
ggcgcagcgtgcgtaaggaa

SEQ ID NO: 227790 - DNA, 20 bp, human
ggaggaagggcgtttgtgat

SEQ ID NO: 227791 - DNA, 20 bp, human
gtccgcgcgcagcgtgcgta

SEQ ID NO: 227792 - DNA, 20 bp, human
gggaggggtgtgggcgaaat

SEQ ID NO: 227793 - DNA, 20 bp, human
ggctgaggcgacgacgtcag

SEQ ID NO: 227794 - DNA, 20 bp, human
gcttgggatcccggagaaga

SEQ ID NO: 227795 - DNA, 20 bp, human
gaagggcgtttgtgattggt

SEQ ID NO: 227796 - DNA, 20 bp, human
gcgcgccggggcaagtgaca

SEQ ID NO: 227797 - DNA, 20 bp, human
gcagagctcgcggaaatggg

SEQ ID NO: 227798 - DNA, 20 bp, human
ggaaatgggaggcgccttct

SEQ ID NO: 227799 - DNA, 20 bp, human
gccttctgggcgcgccctat

SEQ ID NO: 227800 - DNA, 20 bp, human
gctcccggagcagccccata

SEQ ID NO: 227801 - DNA, 20 bp, human
ggagggaggcagaacatcgc

SEQ ID NO: 227802 - DNA, 20 bp, human
gcagaggctcagatgcggga

SEQ ID NO: 227803 - DNA, 20 bp, human
ggcacatcccgcaggcagca

SEQ ID NO: 227804 - DNA, 20 bp, human
gagacactgcgcccccctgg

SEQ ID NO: 227805 - DNA, 20 bp, human
gcagcagagctcgcggaaat

SEQ ID NO: 227806 - DNA, 20 bp, human
gtgtgagtgctgactggcta

SEQ ID NO: 227807 - DNA, 20 bp, human
gagggcatgattaacctaat

SEQ ID NO: 227808 - DNA, 20 bp, human
gaaatgagccataattgcaa

SEQ ID NO: 227809 - DNA, 20 bp, human
ggagagggctcgttgattac

SEQ ID NO: 227810 - DNA, 20 bp, human
ggctcgcgtcctgacagatg

SEQ ID NO: 227811 - DNA, 20 bp, human
gtctcagcatttactatctt

SEQ ID NO: 227812 - DNA, 20 bp, human
ggctcgttgattacaggccc

SEQ ID NO: 227813 - DNA, 20 bp, human
gacacactgtgagtgctgac

SEQ ID NO: 227814 - DNA, 20 bp, human
gagtgcagcttaagcctatt

SEQ ID NO: 227815 - DNA, 20 bp, human
gtccagagcctttgcaatta

SEQ ID NO: 227816 - DNA, 20 bp, human
ggggaggagccacccttgga

SEQ ID NO: 227817 - DNA, 20 bp, human
gtctgcgcagggacttcggg

SEQ ID NO: 227818 - DNA, 20 bp, human
gtgggcgcagcccgcatcgc

SEQ ID NO: 227819 - DNA, 20 bp, human
ggcgctgggcagccgaggtt

SEQ ID NO: 227820 - DNA, 20 bp, human
gcacacagaggccccgcccg

SEQ ID NO: 227821 - DNA, 20 bp, human
ggcagcccgcatcgcgggcc

SEQ ID NO: 227822 - DNA, 20 bp, human
gacagaggacacgcccccga

SEQ ID NO: 227823 - DNA, 20 bp, human
gcgctgcccgcctctcgggg

SEQ ID NO: 227824 - DNA, 20 bp, human
gtctgtgtgcacgcgcccct

SEQ ID NO: 227825 - DNA, 20 bp, human
gcccacccgggcccgcgatg

SEQ ID NO: 227826 - DNA, 20 bp, human
gtgcgcaggcgcagttaagc

SEQ ID NO: 227827 - DNA, 20 bp, human
gcgcgactgcgcggcgagga

SEQ ID NO: 227828 - DNA, 20 bp, human
ggggcgctagtcctcggaaa

SEQ ID NO: 227829 - DNA, 20 bp, human
gggtgcctggccgcgtctct

SEQ ID NO: 227830 - DNA, 20 bp, human
gagtcctcggaaaggggcgt

SEQ ID NO: 227831 - DNA, 20 bp, human
gggaaactcctggagtgcgc

SEQ ID NO: 227832 - DNA, 20 bp, human
ggccgcgtctctaggcgtgt

SEQ ID NO: 227833 - DNA, 20 bp, human
gcaacagtccagcaccaacc

SEQ ID NO: 227834 - DNA, 20 bp, human
gcctggccctacaatgggaa

SEQ ID NO: 227835 - DNA, 20 bp, human
gaggcgcagttaagccgggt

SEQ ID NO: 227836 - DNA, 20 bp, human
gccaaggagccgcgccccat

SEQ ID NO: 227837 - DNA, 20 bp, human
ggccccatcggcttccctaa

SEQ ID NO: 227838 - DNA, 20 bp, human
gcatgcgcacacagatgtta

SEQ ID NO: 227839 - DNA, 20 bp, human
gctcataaacctgctctcct

SEQ ID NO: 227840 - DNA, 20 bp, human
gcgcagcggattttccgtta

SEQ ID NO: 227841 - DNA, 20 bp, human
ggccacaaggggtcttcctg

SEQ ID NO: 227842 - DNA, 20 bp, human
gtttgtgtgcgcatgctcca

SEQ ID NO: 227843 - DNA, 20 bp, human
gcacacagatgttagggttc

SEQ ID NO: 227844 - DNA, 20 bp, human
gaatgctaggggcgggacgg

SEQ ID NO: 227845 - DNA, 20 bp, human
gtccgttagggaagccgatg

SEQ ID NO: 227846 - DNA, 20 bp, human
gaactccagggagacagcgg

SEQ ID NO: 227847 - DNA, 20 bp, human
ggggacgccgggaacaggtg

SEQ ID NO: 227848 - DNA, 20 bp, human
gtgcgcaagcggtcccacgt

SEQ ID NO: 227849 - DNA, 20 bp, human
ggctcgcccgagcagggttg

SEQ ID NO: 227850 - DNA, 20 bp, human
gcacgcccctagcgcatagc

SEQ ID NO: 227851 - DNA, 20 bp, human
ggccccgcccgagcccacgt

SEQ ID NO: 227852 - DNA, 20 bp, human
gcgggcgggaggcccgttgg

SEQ ID NO: 227853 - DNA, 20 bp, human
gcactggcaagcgcctttag

SEQ ID NO: 227854 - DNA, 20 bp, human
gagaagccagctatgcgcta

SEQ ID NO: 227855 - DNA, 20 bp, human
gtccggtgctcgcccgagca

SEQ ID NO: 227856 - DNA, 20 bp, human
gtcccccaggctctcatgtt

SEQ ID NO: 227857 - DNA, 20 bp, human
gtgagagcctgggggaaagt

SEQ ID NO: 227858 - DNA, 20 bp, human
gaaggtgtaacagcactaag

SEQ ID NO: 227859 - DNA, 20 bp, human
ggatagtcccactttccccc

SEQ ID NO: 227860 - DNA, 20 bp, human
gattccccacaagacaggat

SEQ ID NO: 227861 - DNA, 20 bp, human
gccagccaatcctgtcttgt

SEQ ID NO: 227862 - DNA, 20 bp, human
gctccctaacatgagagcct

SEQ ID NO: 227863 - DNA, 20 bp, human
gtctgcgatagccaataggg

SEQ ID NO: 227864 - DNA, 20 bp, human
gagacaggattggctggcag

SEQ ID NO: 227865 - DNA, 20 bp, human
gatccttggggagaaaggaa

SEQ ID NO: 227866 - DNA, 20 bp, human
ggggtcaaaaagccacctgg

SEQ ID NO: 227867 - DNA, 20 bp, human
gcgagtaagaggcctgaatg

SEQ ID NO: 227868 - DNA, 20 bp, human
gctcttactcggcaggttca

SEQ ID NO: 227869 - DNA, 20 bp, human
gggactccatgactggtatt

SEQ ID NO: 227870 - DNA, 20 bp, human
gtcagggtcaaaaagccacc

SEQ ID NO: 227871 - DNA, 20 bp, human
gtggagtcctaggctctgga

SEQ ID NO: 227872 - DNA, 20 bp, human
gcagatcccttccagagcct

SEQ ID NO: 227873 - DNA, 20 bp, human
ggagcctaggactccatgac

SEQ ID NO: 227874 - DNA, 20 bp, human
gagagtgtagatggattcta

SEQ ID NO: 227875 - DNA, 20 bp, human
gactcccagtgagttcaccc

SEQ ID NO: 227876 - DNA, 20 bp, human
gtacccagtatcatacaagt

SEQ ID NO: 227877 - DNA, 20 bp, human
gtgttgcaaatgtctttgag

SEQ ID NO: 227878 - DNA, 20 bp, human
gacttagaagagcacagccc

SEQ ID NO: 227879 - DNA, 20 bp, human
gcatcctacttgtatgatac

SEQ ID NO: 227880 - DNA, 20 bp, human
gtgagcttttaatttactcg

SEQ ID NO: 227881 - DNA, 20 bp, human
gttttaagctcccctgagcc

SEQ ID NO: 227882 - DNA, 20 bp, human
gaaatggagataagaatagt

SEQ ID NO: 227883 - DNA, 20 bp, human
gtgggtaaattaccataaaa

SEQ ID NO: 227884 - DNA, 20 bp, human
gaagagcacagccccggctc

SEQ ID NO: 227885 - DNA, 20 bp, human
gaaatgtctttgagaggctc

SEQ ID NO: 227886 - DNA, 20 bp, human
gagtcaggcgagccgatctg

SEQ ID NO: 227887 - DNA, 20 bp, human
gcgtacgcacggcccttggg

SEQ ID NO: 227888 - DNA, 20 bp, human
ggccccgcccacagttgccc

SEQ ID NO: 227889 - DNA, 20 bp, human
gtggtggcggcggatttgga

SEQ ID NO: 227890 - DNA, 20 bp, human
gtggagggaccctacgaacc

SEQ ID NO: 227891 - DNA, 20 bp, human
gagcaagacaggggagtccc

SEQ ID NO: 227892 - DNA, 20 bp, human
gtgcgtcgtctctatggtgg

SEQ ID NO: 227893 - DNA, 20 bp, human
gggccgctcaccccgcccaa

SEQ ID NO: 227894 - DNA, 20 bp, human
gcggttgccggggcaactgt

SEQ ID NO: 227895 - DNA, 20 bp, human
gtgcccaggcgactgttagg

SEQ ID NO: 227896 - DNA, 20 bp, human
gcaggggaggacaactgggg

SEQ ID NO: 227897 - DNA, 20 bp, human
gtcagtcccacagaaagcac

SEQ ID NO: 227898 - DNA, 20 bp, human
ggtggtcaggggaggacaac

SEQ ID NO: 227899 - DNA, 20 bp, human
gacgctggaaagctcaacat

SEQ ID NO: 227900 - DNA, 20 bp, human
ggcaggatttggggtaccca

SEQ ID NO: 227901 - DNA, 20 bp, human
ggggatggatggcccagggt

SEQ ID NO: 227902 - DNA, 20 bp, human
gttgggagttggcaggattt

SEQ ID NO: 227903 - DNA, 20 bp, human
gccatccccggcaaccagac

SEQ ID NO: 227904 - DNA, 20 bp, human
gtgtctgttcagtgtaaggg

SEQ ID NO: 227905 - DNA, 20 bp, human
gagcagagaagggctttgtg

SEQ ID NO: 227906 - DNA, 20 bp, human
gggtgcgggcacgatgtccc

SEQ ID NO: 227907 - DNA, 20 bp, human
ggcagccccgctcttggaga

SEQ ID NO: 227908 - DNA, 20 bp, human
gcgctcttggagagggaaag

SEQ ID NO: 227909 - DNA, 20 bp, human
gctcccaggttcaggaaagc

SEQ ID NO: 227910 - DNA, 20 bp, human
gccaggcatggagaacccag

SEQ ID NO: 227911 - DNA, 20 bp, human
ggtggtccaggagtaaatgt

SEQ ID NO: 227912 - DNA, 20 bp, human
gcacctcccacatttactcc

SEQ ID NO: 227913 - DNA, 20 bp, human
gtggccactgtgtttcagtg

SEQ ID NO: 227914 - DNA, 20 bp, human
gaaagactagagctgcctga

SEQ ID NO: 227915 - DNA, 20 bp, human
gctgggagcagccccgctct

SEQ ID NO: 227916 - DNA, 20 bp, human
gtggtctgctgaggaagccc

SEQ ID NO: 227917 - DNA, 20 bp, human
gcgtactatatcccatccca

SEQ ID NO: 227918 - DNA, 20 bp, human
gaaactgtcaatagaaacct

SEQ ID NO: 227919 - DNA, 20 bp, human
gtgtatcaggccggtcactg

SEQ ID NO: 227920 - DNA, 20 bp, human
gtcaaggctttggtctgctg

SEQ ID NO: 227921 - DNA, 20 bp, human
gtgtgttcttctcaaggctt

SEQ ID NO: 227922 - DNA, 20 bp, human
gatgtattttaacattccgt

SEQ ID NO: 227923 - DNA, 20 bp, human
gattttaacattccgtggga

SEQ ID NO: 227924 - DNA, 20 bp, human
ggactgaagaaatagacaaa

SEQ ID NO: 227925 - DNA, 20 bp, human
gaggcctgagccacagtgac

SEQ ID NO: 227926 - DNA, 20 bp, human
ggggagcgacccacgaactt

SEQ ID NO: 227927 - DNA, 20 bp, human
gcctccagatggccgcccaa

SEQ ID NO: 227928 - DNA, 20 bp, human
gggcggtggcccagaccaac

SEQ ID NO: 227929 - DNA, 20 bp, human
gtcctcaggcgcagggtccg

SEQ ID NO: 227930 - DNA, 20 bp, human
gcccctggtctcggccccct

SEQ ID NO: 227931 - DNA, 20 bp, human
gtctgccacccgaagttcgt

SEQ ID NO: 227932 - DNA, 20 bp, human
gaggacggggcgtccttcgg

SEQ ID NO: 227933 - DNA, 20 bp, human
ggctccagggcgcgccctct

SEQ ID NO: 227934 - DNA, 20 bp, human
gagccagcgaggcatcgcag

SEQ ID NO: 227935 - DNA, 20 bp, human
gtgcgcctgaggaagtatcg

SEQ ID NO: 227936 - DNA, 20 bp, human
gccaccctcgggatacatca

SEQ ID NO: 227937 - DNA, 20 bp, human
gaaggtgatgagtgctaaag

SEQ ID NO: 227938 - DNA, 20 bp, human
ggaaaggtaggcagcagcat

SEQ ID NO: 227939 - DNA, 20 bp, human
ggaggaaggggggttgagag

SEQ ID NO: 227940 - DNA, 20 bp, human
gttggaagttatacttgagc

SEQ ID NO: 227941 - DNA, 20 bp, human
gccatgggatggcccaccct

SEQ ID NO: 227942 - DNA, 20 bp, human
gcatggtaggcttatgggga

SEQ ID NO: 227943 - DNA, 20 bp, human
gccacaggctgtggagtttg

SEQ ID NO: 227944 - DNA, 20 bp, human
gtataacttccaaaagggta

SEQ ID NO: 227945 - DNA, 20 bp, human
gaaataggatgggtcatggt

SEQ ID NO: 227946 - DNA, 20 bp, human
gcatggggtgagtaacctga

SEQ ID NO: 227947 - DNA, 20 bp, human
gctggggccaacatgtccat

SEQ ID NO: 227948 - DNA, 20 bp, human
gaggtccaagacatctgcgg

SEQ ID NO: 227949 - DNA, 20 bp, human
ggggagaagggggggctgag

SEQ ID NO: 227950 - DNA, 20 bp, human
gaccaggtggccctgaccct

SEQ ID NO: 227951 - DNA, 20 bp, human
gtgctggggaacatgccctc

SEQ ID NO: 227952 - DNA, 20 bp, human
gttgtagtggaagaacacta

SEQ ID NO: 227953 - DNA, 20 bp, human
gtcccagggtcagggccacc

SEQ ID NO: 227954 - DNA, 20 bp, human
gagaagggggggctgagtgg

SEQ ID NO: 227955 - DNA, 20 bp, human
gttcctaggaatctctctgt

SEQ ID NO: 227956 - DNA, 20 bp, human
ggaccactatctgacctcac

SEQ ID NO: 227957 - DNA, 20 bp, human
gttcctgtgaggtcagatag

SEQ ID NO: 227958 - DNA, 20 bp, human
gtggcttagaaaggcaaagc

SEQ ID NO: 227959 - DNA, 20 bp, human
gcagagaatggttagagaga

SEQ ID NO: 227960 - DNA, 20 bp, human
gagagggtacctctgtacat

SEQ ID NO: 227961 - DNA, 20 bp, human
gataagacttaacttattgc

SEQ ID NO: 227962 - DNA, 20 bp, human
gaagactctatgagatgtga

SEQ ID NO: 227963 - DNA, 20 bp, human
gacatagggttcaactttat

SEQ ID NO: 227964 - DNA, 20 bp, human
ggttggagtggggagtggtt

SEQ ID NO: 227965 - DNA, 20 bp, human
gagttgaaccctatgtacag

SEQ ID NO: 227966 - DNA, 20 bp, human
gggggcgcgaaaagttcgtg

SEQ ID NO: 227967 - DNA, 20 bp, human
gttaccacacgcccacctcc

SEQ ID NO: 227968 - DNA, 20 bp, human
gaggtgtagtcgcggcaacc

SEQ ID NO: 227969 - DNA, 20 bp, human
gagttcgtgaggtgtagtcg

SEQ ID NO: 227970 - DNA, 20 bp, human
gtgtagtcgcggcaaccagg

SEQ ID NO: 227971 - DNA, 20 bp, human
gagtcgcggcaaccaggagg

SEQ ID NO: 227972 - DNA, 20 bp, human
gaccagacggcctttcccta

SEQ ID NO: 227973 - DNA, 20 bp, human
gcgcgggagggtggcttgaa

SEQ ID NO: 227974 - DNA, 20 bp, human
gcgccgcgcgtgcgcaaata

SEQ ID NO: 227975 - DNA, 20 bp, human
gtgcgctaaggccccggcgt

SEQ ID NO: 227976 - DNA, 20 bp, human
gtaaacgcgtgggactggga

SEQ ID NO: 227977 - DNA, 20 bp, human
ggacccagtcatctgtatat

SEQ ID NO: 227978 - DNA, 20 bp, human
gtggccgcgtagaatcatgg

SEQ ID NO: 227979 - DNA, 20 bp, human
gattctacgcggccacgtgt

SEQ ID NO: 227980 - DNA, 20 bp, human
gacgtccagcgaccggaggt

SEQ ID NO: 227981 - DNA, 20 bp, human
gtccgggccggaagggagca

SEQ ID NO: 227982 - DNA, 20 bp, human
ggacccagtccgggccggaa

SEQ ID NO: 227983 - DNA, 20 bp, human
gtcgagtaaacgcgtgggac

SEQ ID NO: 227984 - DNA, 20 bp, human
gacgtggccgcgtagaatca

SEQ ID NO: 227985 - DNA, 20 bp, human
ggatgggacccagtccgggc

SEQ ID NO: 227986 - DNA, 20 bp, human
gaggcccgacagccaatcgg

SEQ ID NO: 227987 - DNA, 20 bp, human
gggcctgcgccgaagttggg

SEQ ID NO: 227988 - DNA, 20 bp, human
ggaacggtccaattctgggc

SEQ ID NO: 227989 - DNA, 20 bp, human
gacagccaatcggaggccgg

SEQ ID NO: 227990 - DNA, 20 bp, human
gcctagagcccgcccagaat

SEQ ID NO: 227991 - DNA, 20 bp, human
gaaaactgcgaccaggttct

SEQ ID NO: 227992 - DNA, 20 bp, human
gttcgcttgtcgctcgggtc

SEQ ID NO: 227993 - DNA, 20 bp, human
gaggttctaggctccctctg

SEQ ID NO: 227994 - DNA, 20 bp, human
ggatgtacagaggagacttg

SEQ ID NO: 227995 - DNA, 20 bp, human
gaagttgggcggaggacagt

SEQ ID NO: 227996 - DNA, 20 bp, human
gagcaggaatctcatgtata

SEQ ID NO: 227997 - DNA, 20 bp, human
gcagctgaaaacctccctgt

SEQ ID NO: 227998 - DNA, 20 bp, human
gacagcagcactagatgcat

SEQ ID NO: 227999 - DNA, 20 bp, human
gtggccaataaatttttccc

SEQ ID NO: 228000 - DNA, 20 bp, human
gactctatcaaaacacacaa

SEQ ID NO: 228001 - DNA, 20 bp, human
gataaacgacatcacaagtc

SEQ ID NO: 228002 - DNA, 20 bp, human
gttaacttgggagcaagtag

SEQ ID NO: 228003 - DNA, 20 bp, human
gatggatctgaatgttcttt

SEQ ID NO: 228004 - DNA, 20 bp, human
gctgtggccatgtttaactt

SEQ ID NO: 228005 - DNA, 20 bp, human
gacttagagccgctctgtcc

SEQ ID NO: 228006 - DNA, 20 bp, human
gtcaccaattgtgacctcaa

SEQ ID NO: 228007 - DNA, 20 bp, human
gagaagagacgcccagaaat

SEQ ID NO: 228008 - DNA, 20 bp, human
ggatgtggatgcttctgtct

SEQ ID NO: 228009 - DNA, 20 bp, human
ggtgcgtggagctgagaggc

SEQ ID NO: 228010 - DNA, 20 bp, human
gtgcagaaaagctgtttctg

SEQ ID NO: 228011 - DNA, 20 bp, human
gtcacagctgctgacccatg

SEQ ID NO: 228012 - DNA, 20 bp, human
gtgtatgcagaacctgaaca

SEQ ID NO: 228013 - DNA, 20 bp, human
ggagtggacaccaggttgca

SEQ ID NO: 228014 - DNA, 20 bp, human
gcagagacctctccctgttc

SEQ ID NO: 228015 - DNA, 20 bp, human
gtgcaaagtcagcagcacat

SEQ ID NO: 228016 - DNA, 20 bp, human
gaggggaaaacaggtgccgt

SEQ ID NO: 228017 - DNA, 20 bp, human
gtgggtgggcagcgtgaccc

SEQ ID NO: 228018 - DNA, 20 bp, human
ggggcaggggctgtggccaa

SEQ ID NO: 228019 - DNA, 20 bp, human
ggcccagcacggagcgggca

SEQ ID NO: 228020 - DNA, 20 bp, human
gcccgctccgtgctgggccg

SEQ ID NO: 228021 - DNA, 20 bp, human
gaggtcgcgaatgaagtggt

SEQ ID NO: 228022 - DNA, 20 bp, human
gcatcacctgcccctgaacc

SEQ ID NO: 228023 - DNA, 20 bp, human
gtgctgaggctgcctcacca

SEQ ID NO: 228024 - DNA, 20 bp, human
gctggaagctggcccctcag

SEQ ID NO: 228025 - DNA, 20 bp, human
gccttggcctcggcccagca

SEQ ID NO: 228026 - DNA, 20 bp, human
gcgctcgcctgcacactgca

SEQ ID NO: 228027 - DNA, 20 bp, human
gtcccgctgttgtaagtgga

SEQ ID NO: 228028 - DNA, 20 bp, human
gctgagaaggggcgattctc

SEQ ID NO: 228029 - DNA, 20 bp, human
gaggaagagggtaacactct

SEQ ID NO: 228030 - DNA, 20 bp, human
gaacgccccatgattcccac

SEQ ID NO: 228031 - DNA, 20 bp, human
ggtccctccacttacaacag

SEQ ID NO: 228032 - DNA, 20 bp, human
ggggaatcatggggcgttcc

SEQ ID NO: 228033 - DNA, 20 bp, human
gcagtgtgcaggcgagcgca

SEQ ID NO: 228034 - DNA, 20 bp, human
ggggttgggctgggtcgtct

SEQ ID NO: 228035 - DNA, 20 bp, human
gtgacccgaacaaagcccgt

SEQ ID NO: 228036 - DNA, 20 bp, human
gacctgcagtcgccagtggg

SEQ ID NO: 228037 - DNA, 20 bp, human
gttaagacgtctgatatctg

SEQ ID NO: 228038 - DNA, 20 bp, human
gaccctgcataaaagcggtt

SEQ ID NO: 228039 - DNA, 20 bp, human
gatctctgagcagcactgtg

SEQ ID NO: 228040 - DNA, 20 bp, human
gggcgccgctcacctcggga

SEQ ID NO: 228041 - DNA, 20 bp, human
gcactggcgactgcaggtcg

SEQ ID NO: 228042 - DNA, 20 bp, human
ggccccaaccgcttttatgc

SEQ ID NO: 228043 - DNA, 20 bp, human
gatatctggggcccgcccac

SEQ ID NO: 228044 - DNA, 20 bp, human
gccaccccggtccgcgggga

SEQ ID NO: 228045 - DNA, 20 bp, human
gggaccccgccgccttcccg

SEQ ID NO: 228046 - DNA, 20 bp, human
gacggggttttgccacgtcc

SEQ ID NO: 228047 - DNA, 20 bp, human
gagtagtgtggctgagtagt

SEQ ID NO: 228048 - DNA, 20 bp, human
ggagcaagccgcaaaatgct

SEQ ID NO: 228049 - DNA, 20 bp, human
gcgtgcctcaaggtactgca

SEQ ID NO: 228050 - DNA, 20 bp, human
gagtgcaagagcatttcagc

SEQ ID NO: 228051 - DNA, 20 bp, human
ggaggcacgttcttacctca

SEQ ID NO: 228052 - DNA, 20 bp, human
gcaagagcatttcagctgga

SEQ ID NO: 228053 - DNA, 20 bp, human
gctctccttgcagtaccttg

SEQ ID NO: 228054 - DNA, 20 bp, human
gctgattgcctagcattttg

SEQ ID NO: 228055 - DNA, 20 bp, human
gagatatctgacaaagatga

SEQ ID NO: 228056 - DNA, 20 bp, human
ggccaggcagaggttactga

SEQ ID NO: 228057 - DNA, 20 bp, human
gtcccagtagttgtaatcat

SEQ ID NO: 228058 - DNA, 20 bp, human
ggctaatggtagagccctta

SEQ ID NO: 228059 - DNA, 20 bp, human
gtggacccacctgggaacag

SEQ ID NO: 228060 - DNA, 20 bp, human
gtactgggactatgctggtc

SEQ ID NO: 228061 - DNA, 20 bp, human
gccctatgattacaactact

SEQ ID NO: 228062 - DNA, 20 bp, human
gagcagccatatctgtatga

SEQ ID NO: 228063 - DNA, 20 bp, human
ggcagagaagaacgcaagcc

SEQ ID NO: 228064 - DNA, 20 bp, human
ggcacattccccctgttccc

SEQ ID NO: 228065 - DNA, 20 bp, human
gaagatctggaaagattcac

SEQ ID NO: 228066 - DNA, 20 bp, human
gcctgctgaagacgagctag

SEQ ID NO: 228067 - DNA, 20 bp, human
gtcagcagggtgattctcca

SEQ ID NO: 228068 - DNA, 20 bp, human
gcctgcatatcccagggtgc

SEQ ID NO: 228069 - DNA, 20 bp, human
gctggaagaaaccttaacat

SEQ ID NO: 228070 - DNA, 20 bp, human
gaagatgcctgcatatccca

SEQ ID NO: 228071 - DNA, 20 bp, human
gcatgcaggaactccaggca

SEQ ID NO: 228072 - DNA, 20 bp, human
gaagaaatgaattcgtgaga

SEQ ID NO: 228073 - DNA, 20 bp, human
gcacaccacgtgagtgatgc

SEQ ID NO: 228074 - DNA, 20 bp, human
gcatggaagttccagcaccc

SEQ ID NO: 228075 - DNA, 20 bp, human
gacgaattcatttcttctca

SEQ ID NO: 228076 - DNA, 20 bp, human
ggtgttcaataagttctgga

SEQ ID NO: 228077 - DNA, 20 bp, human
gtctctttgcaggggagaaa

SEQ ID NO: 228078 - DNA, 20 bp, human
gaatgactcctctcactgta

SEQ ID NO: 228079 - DNA, 20 bp, human
ggagaagaaaaggtgacaat

SEQ ID NO: 228080 - DNA, 20 bp, human
gtgaacacctactgggtttc

SEQ ID NO: 228081 - DNA, 20 bp, human
gctagagagagtataccata

SEQ ID NO: 228082 - DNA, 20 bp, human
gtctcactgtaaggaagttt

SEQ ID NO: 228083 - DNA, 20 bp, human
gcatgttccccaacatgtaa

SEQ ID NO: 228084 - DNA, 20 bp, human
gacctgattcccttacatgt

SEQ ID NO: 228085 - DNA, 20 bp, human
gcttaatctgttatgttcac

SEQ ID NO: 228086 - DNA, 20 bp, human
ggctctcaggccaatcctcc

SEQ ID NO: 228087 - DNA, 20 bp, human
gacagaacctgtggtgatct

SEQ ID NO: 228088 - DNA, 20 bp, human
gggtgatctgggtgactctc

SEQ ID NO: 228089 - DNA, 20 bp, human
gaatcctccaggccctgagc

SEQ ID NO: 228090 - DNA, 20 bp, human
gcaagtgactaagattcgag

SEQ ID NO: 228091 - DNA, 20 bp, human
gcagggctggagacatgatg

SEQ ID NO: 228092 - DNA, 20 bp, human
gtactgagacactggttggg

SEQ ID NO: 228093 - DNA, 20 bp, human
gagttactgagacactggtt

SEQ ID NO: 228094 - DNA, 20 bp, human
gcacttgacacaacaaaaga

SEQ ID NO: 228095 - DNA, 20 bp, human
ggtctgagttactgagacac

SEQ ID NO: 228096 - DNA, 20 bp, human
gaatactggaggcccttcga

SEQ ID NO: 228097 - DNA, 20 bp, human
gcggggccggccaatggagg

SEQ ID NO: 228098 - DNA, 20 bp, human
gagcgcttgaatgtcttctg

SEQ ID NO: 228099 - DNA, 20 bp, human
ggccggccccgcggcatcac

SEQ ID NO: 228100 - DNA, 20 bp, human
gcgacggagaacaacaagaa

SEQ ID NO: 228101 - DNA, 20 bp, human
gggaaagcagcccgccaccc

SEQ ID NO: 228102 - DNA, 20 bp, human
gcagcccggaaccacaagtg

SEQ ID NO: 228103 - DNA, 20 bp, human
gaacgcagtgccctcacttg

SEQ ID NO: 228104 - DNA, 20 bp, human
gcgcgacatcgcctcttcta

SEQ ID NO: 228105 - DNA, 20 bp, human
gtcggtaaccagctcccttg

SEQ ID NO: 228106 - DNA, 20 bp, human
gcaggaggggcaactgtgag

SEQ ID NO: 228107 - DNA, 20 bp, human
gcggaccggagcggacagga

SEQ ID NO: 228108 - DNA, 20 bp, human
gccactccctggatcccgcg

SEQ ID NO: 228109 - DNA, 20 bp, human
gccgcggggtagagcacctg

SEQ ID NO: 228110 - DNA, 20 bp, human
ggggcgtcgcggacctcggg

SEQ ID NO: 228111 - DNA, 20 bp, human
gccggcagggaaagtctgag

SEQ ID NO: 228112 - DNA, 20 bp, human
gggagcggaccggagcggac

SEQ ID NO: 228113 - DNA, 20 bp, human
ggtgagtggcggccactccc

SEQ ID NO: 228114 - DNA, 20 bp, human
gtcacactccacccactggg

SEQ ID NO: 228115 - DNA, 20 bp, human
gccgcgacgccccgcccagt

SEQ ID NO: 228116 - DNA, 20 bp, human
gtgggggaggtcgtgtccca

SEQ ID NO: 228117 - DNA, 20 bp, human
ggaaaaaaacgaggcggggt

SEQ ID NO: 228118 - DNA, 20 bp, human
gacagtggagccaggacgtc

SEQ ID NO: 228119 - DNA, 20 bp, human
ggctccactgtcagaaccct

SEQ ID NO: 228120 - DNA, 20 bp, human
gttcccctccgcgactgcca

SEQ ID NO: 228121 - DNA, 20 bp, human
gtctaaacgcgacctgggaa

SEQ ID NO: 228122 - DNA, 20 bp, human
ggctggggaaaaaaacgagg

SEQ ID NO: 228123 - DNA, 20 bp, human
gcctgggaaggggcggtagc

SEQ ID NO: 228124 - DNA, 20 bp, human
gtcgcggaggggaaggctga

SEQ ID NO: 228125 - DNA, 20 bp, human
gttccctggcagtcgcggag

SEQ ID NO: 228126 - DNA, 20 bp, human
gccaatgcctcccatccgag

SEQ ID NO: 228127 - DNA, 20 bp, human
ggggggagtggagctgacga

SEQ ID NO: 228128 - DNA, 20 bp, human
gcggatgggaggcattgggg

SEQ ID NO: 228129 - DNA, 20 bp, human
gtggaactcaattgtattga

SEQ ID NO: 228130 - DNA, 20 bp, human
gaagacgttcccctctcgga

SEQ ID NO: 228131 - DNA, 20 bp, human
ggacgccggtggggttgatt

SEQ ID NO: 228132 - DNA, 20 bp, human
gcccaccggcgtctacacct

SEQ ID NO: 228133 - DNA, 20 bp, human
gggatgggccccagcagtgc

SEQ ID NO: 228134 - DNA, 20 bp, human
gcagcgcagaggtgttacca

SEQ ID NO: 228135 - DNA, 20 bp, human
gctgacccaatcaaccccac

SEQ ID NO: 228136 - DNA, 20 bp, human
ggccgcccggaaagcgtaag

SEQ ID NO: 228137 - DNA, 20 bp, human
gtgtgggggcggttcagaga

SEQ ID NO: 228138 - DNA, 20 bp, human
gagctcgggctcttgaggtg

SEQ ID NO: 228139 - DNA, 20 bp, human
gaggtgggggcatgaactcg

SEQ ID NO: 228140 - DNA, 20 bp, human
ggcctcccctcgccttatat

SEQ ID NO: 228141 - DNA, 20 bp, human
gagcgtaagcgggagctcgc

SEQ ID NO: 228142 - DNA, 20 bp, human
gaagcgggagctcgcgggag

SEQ ID NO: 228143 - DNA, 20 bp, human
gggggaagctcgggctcttg

SEQ ID NO: 228144 - DNA, 20 bp, human
gagaccaagaaggggagccg

SEQ ID NO: 228145 - DNA, 20 bp, human
gagctcccgcttacgctttc

SEQ ID NO: 228146 - DNA, 20 bp, human
gtggccccgcggtgggagtg

SEQ ID NO: 228147 - DNA, 20 bp, human
gggggccccgggaagagtct

SEQ ID NO: 228148 - DNA, 20 bp, human
ggggacggggctttcgaatg

SEQ ID NO: 228149 - DNA, 20 bp, human
gaatcccggacccatacgtc

SEQ ID NO: 228150 - DNA, 20 bp, human
gcctgccaagactcttcccg

SEQ ID NO: 228151 - DNA, 20 bp, human
ggggaaagggctccagttca

SEQ ID NO: 228152 - DNA, 20 bp, human
gccccaaacccccacggatt

SEQ ID NO: 228153 - DNA, 20 bp, human
ggaaccggacgtatgggtcc

SEQ ID NO: 228154 - DNA, 20 bp, human
gggggccagccgctgcgtgt

SEQ ID NO: 228155 - DNA, 20 bp, human
gggttccacaggaggttgag

SEQ ID NO: 228156 - DNA, 20 bp, human
gcctgcgcgttgcgctctct

SEQ ID NO: 228157 - DNA, 20 bp, human
gacgggcacgggaggatacg

SEQ ID NO: 228158 - DNA, 20 bp, human
ggcttctcgccgacgggcac

SEQ ID NO: 228159 - DNA, 20 bp, human
gggactcctggagaaatggt

SEQ ID NO: 228160 - DNA, 20 bp, human
ggcgcccattggttcccact

SEQ ID NO: 228161 - DNA, 20 bp, human
gcaacgcgcaggcgcccagt

SEQ ID NO: 228162 - DNA, 20 bp, human
gggcgcccagtgggaaccaa

SEQ ID NO: 228163 - DNA, 20 bp, human
gcggtgacgtagcgttgccc

SEQ ID NO: 228164 - DNA, 20 bp, human
gactgggcgccccgtcacgt

SEQ ID NO: 228165 - DNA, 20 bp, human
gtctctaggcttctcgccga

SEQ ID NO: 228166 - DNA, 20 bp, human
gcacggggaggtgtgtacga

SEQ ID NO: 228167 - DNA, 20 bp, human
ggggaagtgcatatgtaggc

SEQ ID NO: 228168 - DNA, 20 bp, human
ggtggccagtgtcactcggg

SEQ ID NO: 228169 - DNA, 20 bp, human
gaggaggacctcgctgtgac

SEQ ID NO: 228170 - DNA, 20 bp, human
gaggacctcgctgtgaccgg

SEQ ID NO: 228171 - DNA, 20 bp, human
gcagccctccgtggagcgtg

SEQ ID NO: 228172 - DNA, 20 bp, human
ggccactaggaggttcgggt

SEQ ID NO: 228173 - DNA, 20 bp, human
gtcgctgaggaacgtcgcgc

SEQ ID NO: 228174 - DNA, 20 bp, human
gcgctggggagcttggccgt

SEQ ID NO: 228175 - DNA, 20 bp, human
gaacgtcgcgcggggccgac

SEQ ID NO: 228176 - DNA, 20 bp, human
gctctggcggagctgcctcc

SEQ ID NO: 228177 - DNA, 20 bp, human
ggaagcacgacccgcgtctc

SEQ ID NO: 228178 - DNA, 20 bp, human
gtgacgcaagcggaactcgg

SEQ ID NO: 228179 - DNA, 20 bp, human
ggggagtccgcccaacagag

SEQ ID NO: 228180 - DNA, 20 bp, human
gcgtgcttcgggaaaccggg

SEQ ID NO: 228181 - DNA, 20 bp, human
ggcagctccgccagagacgc

SEQ ID NO: 228182 - DNA, 20 bp, human
ggcacgacccgcgtctctgg

SEQ ID NO: 228183 - DNA, 20 bp, human
ggggtcgtgcttcgggaaac

SEQ ID NO: 228184 - DNA, 20 bp, human
gcgaggctcctggcgcacta

SEQ ID NO: 228185 - DNA, 20 bp, human
gcccgccggccgctccctag

SEQ ID NO: 228186 - DNA, 20 bp, human
gggactcagcaaatatagga

SEQ ID NO: 228187 - DNA, 20 bp, human
gttagtgggaatcaatagga

SEQ ID NO: 228188 - DNA, 20 bp, human
gcagaggactcagcaaatat

SEQ ID NO: 228189 - DNA, 20 bp, human
gttggttagtgggaatcaat

SEQ ID NO: 228190 - DNA, 20 bp, human
gaagactgtgagcccctctg

SEQ ID NO: 228191 - DNA, 20 bp, human
gagacgttaaaaaatcatat

SEQ ID NO: 228192 - DNA, 20 bp, human
gggtgtggttcctaccccag

SEQ ID NO: 228193 - DNA, 20 bp, human
gagaagcctggcactgaatt

SEQ ID NO: 228194 - DNA, 20 bp, human
gctgtgagcccctctggggt

SEQ ID NO: 228195 - DNA, 20 bp, human
gggaagagtacgctgtgcta

SEQ ID NO: 228196 - DNA, 20 bp, human
gtcctcacttggccacgctt

SEQ ID NO: 228197 - DNA, 20 bp, human
ggaggggccgacggacgcga

SEQ ID NO: 228198 - DNA, 20 bp, human
ggacccggggtcactgctga

SEQ ID NO: 228199 - DNA, 20 bp, human
gactgctgagggcctgtcgg

SEQ ID NO: 228200 - DNA, 20 bp, human
gcagacctcggctaacgtcc

SEQ ID NO: 228201 - DNA, 20 bp, human
gggacccgagcggagcgccg

SEQ ID NO: 228202 - DNA, 20 bp, human
gagcccccgccgccccgcga

SEQ ID NO: 228203 - DNA, 20 bp, human
gctggcgggcctaagcgcga

SEQ ID NO: 228204 - DNA, 20 bp, human
ggtgaccccgggtccccaca

SEQ ID NO: 228205 - DNA, 20 bp, human
gcccgcgcctcagctacctg

SEQ ID NO: 228206 - DNA, 20 bp, human
gtaagatacagtctatgggg

SEQ ID NO: 228207 - DNA, 20 bp, human
gcactgcaagggaagactgg

SEQ ID NO: 228208 - DNA, 20 bp, human
ggcttctgaagccatcagtc

SEQ ID NO: 228209 - DNA, 20 bp, human
gtgccactgcaagggaagac

SEQ ID NO: 228210 - DNA, 20 bp, human
ggctactggttaatcctatc

SEQ ID NO: 228211 - DNA, 20 bp, human
gtctttaagatacagtctat

SEQ ID NO: 228212 - DNA, 20 bp, human
gtatcagttaccataaacaa

SEQ ID NO: 228213 - DNA, 20 bp, human
ggatgacatcaccattgatc

SEQ ID NO: 228214 - DNA, 20 bp, human
gtggttaatcctatctggtt

SEQ ID NO: 228215 - DNA, 20 bp, human
gccccaaggaacctgatcaa

SEQ ID NO: 228216 - DNA, 20 bp, human
gaatccattagactctacca

SEQ ID NO: 228217 - DNA, 20 bp, human
gagaaacacacagggctcca

SEQ ID NO: 228218 - DNA, 20 bp, human
gctagggcagcaaggacaaa

SEQ ID NO: 228219 - DNA, 20 bp, human
ggctccatggtagagtctaa

SEQ ID NO: 228220 - DNA, 20 bp, human
ggaaatgttaaagaggttgg

SEQ ID NO: 228221 - DNA, 20 bp, human
ggacaggtgaaatgttacaa

SEQ ID NO: 228222 - DNA, 20 bp, human
gttttgttgcttagtgacaa

SEQ ID NO: 228223 - DNA, 20 bp, human
gctatatataagggctcttc

SEQ ID NO: 228224 - DNA, 20 bp, human
ggttgcttagtgacaaggga

SEQ ID NO: 228225 - DNA, 20 bp, human
gcctatgcatccatactgcc

SEQ ID NO: 228226 - DNA, 20 bp, human
gtcacctctacccctaaaca

SEQ ID NO: 228227 - DNA, 20 bp, human
gtgtttgggtgccttgttta

SEQ ID NO: 228228 - DNA, 20 bp, human
ggtgccttgtttaggggtag

SEQ ID NO: 228229 - DNA, 20 bp, human
gagctttgcctcattcagag

SEQ ID NO: 228230 - DNA, 20 bp, human
ggcctcaggcccagagttgt

SEQ ID NO: 228231 - DNA, 20 bp, human
ggctcaggcactggaatgag

SEQ ID NO: 228232 - DNA, 20 bp, human
ggaaggacagggttatttct

SEQ ID NO: 228233 - DNA, 20 bp, human
gcggacacctgggtgtccat

SEQ ID NO: 228234 - DNA, 20 bp, human
gtggaatgagaggagttaac

SEQ ID NO: 228235 - DNA, 20 bp, human
ggggggaggtgctcaggcac

SEQ ID NO: 228236 - DNA, 20 bp, human
gtcacctctacccctaaaca

SEQ ID NO: 228237 - DNA, 20 bp, human
gtgtttgggtgccttgttta

SEQ ID NO: 228238 - DNA, 20 bp, human
ggtgccttgtttaggggtag

SEQ ID NO: 228239 - DNA, 20 bp, human
gagctttgcctcattcagag

SEQ ID NO: 228240 - DNA, 20 bp, human
ggcctcaggcccagagttgt

SEQ ID NO: 228241 - DNA, 20 bp, human
ggctcaggcactggaatgag

SEQ ID NO: 228242 - DNA, 20 bp, human
ggaaggacagggttatttct

SEQ ID NO: 228243 - DNA, 20 bp, human
gtacagatatacctggtagg

SEQ ID NO: 228244 - DNA, 20 bp, human
gcggacacctgggtgtccat

SEQ ID NO: 228245 - DNA, 20 bp, human
gtggaatgagaggagttaac

SEQ ID NO: 228246 - DNA, 20 bp, human
gagaatgaggactagcaaag

SEQ ID NO: 228247 - DNA, 20 bp, human
ggtggttggctggtcaagga

SEQ ID NO: 228248 - DNA, 20 bp, human
gacggttgatggaaatagat

SEQ ID NO: 228249 - DNA, 20 bp, human
ggacctagtgtcatggaaag

SEQ ID NO: 228250 - DNA, 20 bp, human
gcgacatgttacgaagaatg

SEQ ID NO: 228251 - DNA, 20 bp, human
gatgggcagaaacttttgac

SEQ ID NO: 228252 - DNA, 20 bp, human
ggccaaccatttcccctaag

SEQ ID NO: 228253 - DNA, 20 bp, human
gggaaagtggatcatttttg

SEQ ID NO: 228254 - DNA, 20 bp, human
gggaaaccttggatactgcg

SEQ ID NO: 228255 - DNA, 20 bp, human
gctgaacctcgcagtatcca

SEQ ID NO: 228256 - DNA, 20 bp, human
ggtcacaagcaagatgatat

SEQ ID NO: 228257 - DNA, 20 bp, human
ggctttggtctcaggaatta

SEQ ID NO: 228258 - DNA, 20 bp, human
gaggagaatgctttggtctc

SEQ ID NO: 228259 - DNA, 20 bp, human
gaagtaggaagcctgggtac

SEQ ID NO: 228260 - DNA, 20 bp, human
gcacaaacagtagtaatgga

SEQ ID NO: 228261 - DNA, 20 bp, human
gaccaaatgagtaaagagag

SEQ ID NO: 228262 - DNA, 20 bp, human
gacccaggcttcctactttg

SEQ ID NO: 228263 - DNA, 20 bp, human
gagggtaggtctatcctgga

SEQ ID NO: 228264 - DNA, 20 bp, human
ggagaacaatgtgtcactgc

SEQ ID NO: 228265 - DNA, 20 bp, human
gagccacaaagtaggaagcc

SEQ ID NO: 228266 - DNA, 20 bp, human
gagctttgcctcattcagag

SEQ ID NO: 228267 - DNA, 20 bp, human
ggaaggacagggttatttct

SEQ ID NO: 228268 - DNA, 20 bp, human
ggcctcaggcccagagttgt

SEQ ID NO: 228269 - DNA, 20 bp, human
gcggacacctgggtgtccat

SEQ ID NO: 228270 - DNA, 20 bp, human
gaagaagtgcaactggcctc

SEQ ID NO: 228271 - DNA, 20 bp, human
gcggggtgcccccacaactc

SEQ ID NO: 228272 - DNA, 20 bp, human
gtggaatgagaggagttaac

SEQ ID NO: 228273 - DNA, 20 bp, human
ggggggaggtgctcaggcac

SEQ ID NO: 228274 - DNA, 20 bp, human
gctggtagggggaggtgctc

SEQ ID NO: 228275 - DNA, 20 bp, human
gtacagatatacctggtagg

SEQ ID NO: 228276 - DNA, 20 bp, human
gagctttgcctcattcagag

SEQ ID NO: 228277 - DNA, 20 bp, human
ggaaggacagggttatttct

SEQ ID NO: 228278 - DNA, 20 bp, human
ggcctcaggcccagagttgt

SEQ ID NO: 228279 - DNA, 20 bp, human
gcggacacctgggtgtccat

SEQ ID NO: 228280 - DNA, 20 bp, human
gaagaagtgcaactggcctc

SEQ ID NO: 228281 - DNA, 20 bp, human
gcggggtgcccccacaactc

SEQ ID NO: 228282 - DNA, 20 bp, human
gtggaatgagaggagttaac

SEQ ID NO: 228283 - DNA, 20 bp, human
gtacagatatacctggtagg

SEQ ID NO: 228284 - DNA, 20 bp, human
gcatgggaaactctgaatct

SEQ ID NO: 228285 - DNA, 20 bp, human
ggggggaggtgctcaggcac

SEQ ID NO: 228286 - DNA, 20 bp, human
ggaggtctgagaagaatagt

SEQ ID NO: 228287 - DNA, 20 bp, human
gttgtcaagtgggtaactgg

SEQ ID NO: 228288 - DNA, 20 bp, human
gaaaaccatgtggccacaaa

SEQ ID NO: 228289 - DNA, 20 bp, human
ggttttgtcaagtgggtaac

SEQ ID NO: 228290 - DNA, 20 bp, human
ggttctttaagcagaattgt

SEQ ID NO: 228291 - DNA, 20 bp, human
gccacatggttttgtcaagt

SEQ ID NO: 228292 - DNA, 20 bp, human
gtccaaaaccaacggggaga

SEQ ID NO: 228293 - DNA, 20 bp, human
gaaagccatttgtggccaca

SEQ ID NO: 228294 - DNA, 20 bp, human
ggcttaatccaaaaccaacg

SEQ ID NO: 228295 - DNA, 20 bp, human
gtaacatatcttaacaacca

SEQ ID NO: 228296 - DNA, 20 bp, human
gctcggggcgtgcaggtaaa

SEQ ID NO: 228297 - DNA, 20 bp, human
ggggccggggtggcagtccc

SEQ ID NO: 228298 - DNA, 20 bp, human
ggggctagggctcgaaaccc

SEQ ID NO: 228299 - DNA, 20 bp, human
gtagccccgccgcatcctcg

SEQ ID NO: 228300 - DNA, 20 bp, human
ggggcccaatgacagcgctg

SEQ ID NO: 228301 - DNA, 20 bp, human
ggccgccccagcgctgtcat

SEQ ID NO: 228302 - DNA, 20 bp, human
gcggccgctgcgagctcggc

SEQ ID NO: 228303 - DNA, 20 bp, human
gtgtcggacatcgtactcca

SEQ ID NO: 228304 - DNA, 20 bp, human
gcctgcacgccccgaggatg

SEQ ID NO: 228305 - DNA, 20 bp, human
ggtaaagggttacgcgtgtc

SEQ ID NO: 228306 - DNA, 20 bp, human
gcgcgctccacctacgtcac

SEQ ID NO: 228307 - DNA, 20 bp, human
gtcacaggcgaggtggttcc

SEQ ID NO: 228308 - DNA, 20 bp, human
ggggcccgtctttctcaatt

SEQ ID NO: 228309 - DNA, 20 bp, human
gaccacctcgcctgtgacgt

SEQ ID NO: 228310 - DNA, 20 bp, human
gcgccaatcaaattcttcct

SEQ ID NO: 228311 - DNA, 20 bp, human
gacctcgcctgtgacgtagg

SEQ ID NO: 228312 - DNA, 20 bp, human
gcggagacggaaatgtccga

SEQ ID NO: 228313 - DNA, 20 bp, human
gtccacctacgtcacaggcg

SEQ ID NO: 228314 - DNA, 20 bp, human
gcaggcgaggtggttccagg

SEQ ID NO: 228315 - DNA, 20 bp, human
gggtcccaattgagaaagac

SEQ ID NO: 228316 - DNA, 20 bp, human
ggatacccatccaccgactc

SEQ ID NO: 228317 - DNA, 20 bp, human
gaaactgcaacaaaccgccg

SEQ ID NO: 228318 - DNA, 20 bp, human
ggggtatccgacctgaactt

SEQ ID NO: 228319 - DNA, 20 bp, human
gtcggccgaggataccgcaa

SEQ ID NO: 228320 - DNA, 20 bp, human
gtgattggcaggaacgaagt

SEQ ID NO: 228321 - DNA, 20 bp, human
gttgaagccggtgtgagctt

SEQ ID NO: 228322 - DNA, 20 bp, human
gtcactgaagcctgagtcgg

SEQ ID NO: 228323 - DNA, 20 bp, human
gtatccgacctgaacttggg

SEQ ID NO: 228324 - DNA, 20 bp, human
gccgcaatggatcaggaaga

SEQ ID NO: 228325 - DNA, 20 bp, human
gtacccacccaagttcaggt

SEQ ID NO: 228326 - DNA, 20 bp, human
ggggggagatgattgatatc

SEQ ID NO: 228327 - DNA, 20 bp, human
gtgtccaaaatccccctctg

SEQ ID NO: 228328 - DNA, 20 bp, human
gatcagggcttgcggtgtga

SEQ ID NO: 228329 - DNA, 20 bp, human
gtgtcattccaagaagcttc

SEQ ID NO: 228330 - DNA, 20 bp, human
gaactaaaaggcactaacat

SEQ ID NO: 228331 - DNA, 20 bp, human
gtctccactgcaaaccaccg

SEQ ID NO: 228332 - DNA, 20 bp, human
gaatcatctccccccagagg

SEQ ID NO: 228333 - DNA, 20 bp, human
gtgaccccggtggtttgcag

SEQ ID NO: 228334 - DNA, 20 bp, human
gctggttgacaaatactgtc

SEQ ID NO: 228335 - DNA, 20 bp, human
gagaaagtgatcttccctag

SEQ ID NO: 228336 - DNA, 20 bp, human
gcccgggcggcgctgaaatt

SEQ ID NO: 228337 - DNA, 20 bp, human
gcacgcgcccagcacgggag

SEQ ID NO: 228338 - DNA, 20 bp, human
ggccccgcccactcccgtgc

SEQ ID NO: 228339 - DNA, 20 bp, human
gggcggggcctcaacgcgtc

SEQ ID NO: 228340 - DNA, 20 bp, human
gccttgcacgcgcccagcac

SEQ ID NO: 228341 - DNA, 20 bp, human
ggcccagcacgggagtgggc

SEQ ID NO: 228342 - DNA, 20 bp, human
gcccgggctcgccaatttag

SEQ ID NO: 228343 - DNA, 20 bp, human
ggctcgccaatttaggggaa

SEQ ID NO: 228344 - DNA, 20 bp, human
gcctcaacgcgtccggtgcc

SEQ ID NO: 228345 - DNA, 20 bp, human
gaataaccgtacagtagggt

SEQ ID NO: 228346 - DNA, 20 bp, human
gtgaccccgcctatgacctc

SEQ ID NO: 228347 - DNA, 20 bp, human
gtgggctctcagtccccgtc

SEQ ID NO: 228348 - DNA, 20 bp, human
gcctgacggtcagacgtagg

SEQ ID NO: 228349 - DNA, 20 bp, human
gcggaacgccccgaggtcat

SEQ ID NO: 228350 - DNA, 20 bp, human
gggcagcgcagggcgaaagg

SEQ ID NO: 228351 - DNA, 20 bp, human
ggcggggtcacgcggaaggc

SEQ ID NO: 228352 - DNA, 20 bp, human
gcagtccccgtcaggatggg

SEQ ID NO: 228353 - DNA, 20 bp, human
gacgccccgaggtcataggc

SEQ ID NO: 228354 - DNA, 20 bp, human
gccgggcagcgcagggcgaa

SEQ ID NO: 228355 - DNA, 20 bp, human
gcggaaggccgggcagcgca

SEQ ID NO: 228356 - DNA, 20 bp, human
gcctgcgcgctgggaagagt

SEQ ID NO: 228357 - DNA, 20 bp, human
gtgacttagtgtcaaggcgg

SEQ ID NO: 228358 - DNA, 20 bp, human
gccgcgaggcagaagtaggc

SEQ ID NO: 228359 - DNA, 20 bp, human
gaggccgcgcttcatgccag

SEQ ID NO: 228360 - DNA, 20 bp, human
gccgctgcctccgtgaccgc

SEQ ID NO: 228361 - DNA, 20 bp, human
gtgaccgctggcatgaagcg

SEQ ID NO: 228362 - DNA, 20 bp, human
ggacgccgcgaggcagaagt

SEQ ID NO: 228363 - DNA, 20 bp, human
gttctgcctcgcggcgtccc

SEQ ID NO: 228364 - DNA, 20 bp, human
ggcccattgacttagtgtca

SEQ ID NO: 228365 - DNA, 20 bp, human
gttcatgccagcggtcacgg

SEQ ID NO: 228366 - DNA, 20 bp, human
ggggccaacggtgtgttggg

SEQ ID NO: 228367 - DNA, 20 bp, human
gcaggggaggggccaagaca

SEQ ID NO: 228368 - DNA, 20 bp, human
gtcggggcggagccgtacag

SEQ ID NO: 228369 - DNA, 20 bp, human
ggcggggccaacggtgtgtt

SEQ ID NO: 228370 - DNA, 20 bp, human
gccgccccccaacacaccgt

SEQ ID NO: 228371 - DNA, 20 bp, human
gggcggagccgtacagggga

SEQ ID NO: 228372 - DNA, 20 bp, human
gtcgcccaacccccggccgt

SEQ ID NO: 228373 - DNA, 20 bp, human
gcaacccccggccgtcgggg

SEQ ID NO: 228374 - DNA, 20 bp, human
ggggcgagccagtgacagga

SEQ ID NO: 228375 - DNA, 20 bp, human
ggcccggcccctcctgtcac

SEQ ID NO: 228376 - DNA, 20 bp, human
gggagaggacaacgccaaga

SEQ ID NO: 228377 - DNA, 20 bp, human
gagaggcgccaccgtctcca

SEQ ID NO: 228378 - DNA, 20 bp, human
gggtgccccggaccactcct

SEQ ID NO: 228379 - DNA, 20 bp, human
gcgccctgcgactttgaaac

SEQ ID NO: 228380 - DNA, 20 bp, human
ggtctccaaggagtggtccg

SEQ ID NO: 228381 - DNA, 20 bp, human
ggcaccggtttcaaagtcgc

SEQ ID NO: 228382 - DNA, 20 bp, human
ggaccactccttggagacgg

SEQ ID NO: 228383 - DNA, 20 bp, human
ggcccgcgtgatgacgcaag

SEQ ID NO: 228384 - DNA, 20 bp, human
ggcgtcccgcgggtcactct

SEQ ID NO: 228385 - DNA, 20 bp, human
gcgcgtagaacgccgctctc

SEQ ID NO: 228386 - DNA, 20 bp, human
gcagctgcctacacgttctg

SEQ ID NO: 228387 - DNA, 20 bp, human
gtggtttcctagaagaagga

SEQ ID NO: 228388 - DNA, 20 bp, human
gcgttccactaaagtatgag

SEQ ID NO: 228389 - DNA, 20 bp, human
gcccctcccccagaacgtgt

SEQ ID NO: 228390 - DNA, 20 bp, human
ggctatgaacatgcctcccc

SEQ ID NO: 228391 - DNA, 20 bp, human
gtgcctacacgttctggggg

SEQ ID NO: 228392 - DNA, 20 bp, human
gtgagtggtttcctagaaga

SEQ ID NO: 228393 - DNA, 20 bp, human
ggaacgtgtaggcagctggg

SEQ ID NO: 228394 - DNA, 20 bp, human
gtaagacgcttgatttttct

SEQ ID NO: 228395 - DNA, 20 bp, human
ggaaaccactcatactttag

SEQ ID NO: 228396 - DNA, 20 bp, human
gcggccctcccgggattggt

SEQ ID NO: 228397 - DNA, 20 bp, human
gggcgccacccaagcggcaa

SEQ ID NO: 228398 - DNA, 20 bp, human
ggaacccggtaccgcagctc

SEQ ID NO: 228399 - DNA, 20 bp, human
gctagctggcgccacccaag

SEQ ID NO: 228400 - DNA, 20 bp, human
gcctcccaccaatcccggga

SEQ ID NO: 228401 - DNA, 20 bp, human
gccggcccgcgccctctagc

SEQ ID NO: 228402 - DNA, 20 bp, human
gcaagcggcaagggacgtcg

SEQ ID NO: 228403 - DNA, 20 bp, human
gacgtcccttgccgcttggg

SEQ ID NO: 228404 - DNA, 20 bp, human
gaatacggcaatgaccgccc

SEQ ID NO: 228405 - DNA, 20 bp, human
ggattggtgggaggatcgtg

SEQ ID NO: 228406 - DNA, 20 bp, human
gcccgcaacgtgcaccaagg

SEQ ID NO: 228407 - DNA, 20 bp, human
ggcggggtgtgactcaccac

SEQ ID NO: 228408 - DNA, 20 bp, human
gtcactttgcaactgtccca

SEQ ID NO: 228409 - DNA, 20 bp, human
gtcccccttggtgcacgttg

SEQ ID NO: 228410 - DNA, 20 bp, human
gcgttaggtaggagtctgag

SEQ ID NO: 228411 - DNA, 20 bp, human
gaagcacagaaacgttaggt

SEQ ID NO: 228412 - DNA, 20 bp, human
ggtcgtgcggtgtgtgtaga

SEQ ID NO: 228413 - DNA, 20 bp, human
gcaccccgcaacgtgcacca

SEQ ID NO: 228414 - DNA, 20 bp, human
gaatcagtctgatttccccg

SEQ ID NO: 228415 - DNA, 20 bp, human
gggtgtgtgtagaaggtagg

SEQ ID NO: 228416 - DNA, 20 bp, human
ggtggagaaggcatattctc

SEQ ID NO: 228417 - DNA, 20 bp, human
gtcaggtgtgtgtcttgatt

SEQ ID NO: 228418 - DNA, 20 bp, human
gcaactcatttagctcccca

SEQ ID NO: 228419 - DNA, 20 bp, human
gtatgaattcagtgggagat

SEQ ID NO: 228420 - DNA, 20 bp, human
gattgcaaaatatgtccctg

SEQ ID NO: 228421 - DNA, 20 bp, human
gcttaaatgtcaccattcta

SEQ ID NO: 228422 - DNA, 20 bp, human
gagacagtagttaaatagca

SEQ ID NO: 228423 - DNA, 20 bp, human
gactgtctgtataccttaac

SEQ ID NO: 228424 - DNA, 20 bp, human
gtcagttggagaatggtttt

SEQ ID NO: 228425 - DNA, 20 bp, human
gccgaaaaattgcatataca

SEQ ID NO: 228426 - DNA, 20 bp, human
gtgtctctgctcttggagat

SEQ ID NO: 228427 - DNA, 20 bp, human
ggctaatgactctttatgac

SEQ ID NO: 228428 - DNA, 20 bp, human
gaaaaagcccccacaaacca

SEQ ID NO: 228429 - DNA, 20 bp, human
gtcagaatacacttgttcac

SEQ ID NO: 228430 - DNA, 20 bp, human
gctgggacataagctggaac

SEQ ID NO: 228431 - DNA, 20 bp, human
ggacttgatattgacaaata

SEQ ID NO: 228432 - DNA, 20 bp, human
ggcactatttaaggagggat

SEQ ID NO: 228433 - DNA, 20 bp, human
gtggaatgcagaactctgca

SEQ ID NO: 228434 - DNA, 20 bp, human
gaaagcacaagcactattta

SEQ ID NO: 228435 - DNA, 20 bp, human
gatatttaaccatggtttgt

SEQ ID NO: 228436 - DNA, 20 bp, human
ggcgacgcacacggcttcct

SEQ ID NO: 228437 - DNA, 20 bp, human
ggaaggcggggcgacgcaca

SEQ ID NO: 228438 - DNA, 20 bp, human
gagcctccaatcgatctcga

SEQ ID NO: 228439 - DNA, 20 bp, human
gagtgcccttcgagatcgat

SEQ ID NO: 228440 - DNA, 20 bp, human
gacgacgcacgcgcagtgaa

SEQ ID NO: 228441 - DNA, 20 bp, human
gtggctgtttcaccgctccc

SEQ ID NO: 228442 - DNA, 20 bp, human
gtgcgcgtgcgtcgtgctgt

SEQ ID NO: 228443 - DNA, 20 bp, human
gagccacagcgcggccagag

SEQ ID NO: 228444 - DNA, 20 bp, human
gggactccaagtcccagccg

SEQ ID NO: 228445 - DNA, 20 bp, human
ggaaacgtctttgtggtccg

SEQ ID NO: 228446 - DNA, 20 bp, human
gcccgcctcgccgtccgcga

SEQ ID NO: 228447 - DNA, 20 bp, human
gcaactcccgacatgctcgg

SEQ ID NO: 228448 - DNA, 20 bp, human
gtatcctcccacagcgtgct

SEQ ID NO: 228449 - DNA, 20 bp, human
ggctcggcggcatgacgtca

SEQ ID NO: 228450 - DNA, 20 bp, human
ggtagccgaagacttatgtt

SEQ ID NO: 228451 - DNA, 20 bp, human
gcacgctgtgggaggatacg

SEQ ID NO: 228452 - DNA, 20 bp, human
gtccgcgagggactgcggtg

SEQ ID NO: 228453 - DNA, 20 bp, human
gaccacaccgcagtccctcg

SEQ ID NO: 228454 - DNA, 20 bp, human
ggacgcctgcccaaaagttc

SEQ ID NO: 228455 - DNA, 20 bp, human
ggtcctgccggggtccaaga

SEQ ID NO: 228456 - DNA, 20 bp, human
gaacccgggcggggtcgggt

SEQ ID NO: 228457 - DNA, 20 bp, human
gaccagcagcgcggggacac

SEQ ID NO: 228458 - DNA, 20 bp, human
gggcctggacgctgctcccg

SEQ ID NO: 228459 - DNA, 20 bp, human
ggccaggcacacccgattcc

SEQ ID NO: 228460 - DNA, 20 bp, human
gggtccctgaaccgcggtaa

SEQ ID NO: 228461 - DNA, 20 bp, human
gctaggacgctccaggaatc

SEQ ID NO: 228462 - DNA, 20 bp, human
gaccccgggaccagcagcgc

SEQ ID NO: 228463 - DNA, 20 bp, human
gtggaaacccgagactgcgc

SEQ ID NO: 228464 - DNA, 20 bp, human
gggcgagtggggtccagtgt

SEQ ID NO: 228465 - DNA, 20 bp, human
gtcccggggtccctgaaccg

SEQ ID NO: 228466 - DNA, 20 bp, human
gccactgggaggacagctag

SEQ ID NO: 228467 - DNA, 20 bp, human
gtcaagaagcatccggtctg

SEQ ID NO: 228468 - DNA, 20 bp, human
gtgtggatgaccatgatcag

SEQ ID NO: 228469 - DNA, 20 bp, human
ggaggaagcctggaggacaa

SEQ ID NO: 228470 - DNA, 20 bp, human
ggggccgaacccactgatca

SEQ ID NO: 228471 - DNA, 20 bp, human
ggggtgcaggggtgcccccg

SEQ ID NO: 228472 - DNA, 20 bp, human
gaggacagctaggggcaagg

SEQ ID NO: 228473 - DNA, 20 bp, human
gcaaggaggaaaaccaagtg

SEQ ID NO: 228474 - DNA, 20 bp, human
gtcaactgataaggcaaatc

SEQ ID NO: 228475 - DNA, 20 bp, human
ggatacgtctggggtctccg

SEQ ID NO: 228476 - DNA, 20 bp, human
gctatccccttgcctcccaa

SEQ ID NO: 228477 - DNA, 20 bp, human
gtccccttgcctcccaaggg

SEQ ID NO: 228478 - DNA, 20 bp, human
gacctcccttgggaggcaag

SEQ ID NO: 228479 - DNA, 20 bp, human
gggcaaggggatagcatttg

SEQ ID NO: 228480 - DNA, 20 bp, human
gtcacagagtagtggtgctc

SEQ ID NO: 228481 - DNA, 20 bp, human
gaaaatttacctcccttggg

SEQ ID NO: 228482 - DNA, 20 bp, human
gctaaagacctccaagtgtc

SEQ ID NO: 228483 - DNA, 20 bp, human
gaatctctgtggtgggggcg

SEQ ID NO: 228484 - DNA, 20 bp, human
gctcatatgtcacagagtag

SEQ ID NO: 228485 - DNA, 20 bp, human
gggaagctgttaaaataagc

SEQ ID NO: 228486 - DNA, 20 bp, human
gggtcatgacctcactgatc

SEQ ID NO: 228487 - DNA, 20 bp, human
ggctggcagggcttgttttc

SEQ ID NO: 228488 - DNA, 20 bp, human
gaaactgtcacggcacccat

SEQ ID NO: 228489 - DNA, 20 bp, human
gcatggccatctgcttattt

SEQ ID NO: 228490 - DNA, 20 bp, human
gaattggggatcaacctgag

SEQ ID NO: 228491 - DNA, 20 bp, human
ggccatctgcttattttggc

SEQ ID NO: 228492 - DNA, 20 bp, human
ggatctggtttgaaaggata

SEQ ID NO: 228493 - DNA, 20 bp, human
gtagcataaagacattccca

SEQ ID NO: 228494 - DNA, 20 bp, human
gctcactgatctggtttgaa

SEQ ID NO: 228495 - DNA, 20 bp, human
gtcacccttgagttcgttcc

SEQ ID NO: 228496 - DNA, 20 bp, human
gatgcccaggaatacagata

SEQ ID NO: 228497 - DNA, 20 bp, human
gactccctatctgtattcct

SEQ ID NO: 228498 - DNA, 20 bp, human
gaaaacaccctttcatgccc

SEQ ID NO: 228499 - DNA, 20 bp, human
ggctctgcaaaggaggtcta

SEQ ID NO: 228500 - DNA, 20 bp, human
ggaaaggtgaacctctaagt

SEQ ID NO: 228501 - DNA, 20 bp, human
gaatttggcactatgaagag

SEQ ID NO: 228502 - DNA, 20 bp, human
gaaggggcctggtttagaca

SEQ ID NO: 228503 - DNA, 20 bp, human
gtcagtgtgaaactgagtcc

SEQ ID NO: 228504 - DNA, 20 bp, human
gttacaggaacttacaccca

SEQ ID NO: 228505 - DNA, 20 bp, human
gaataaagggaccctaaaat

SEQ ID NO: 228506 - DNA, 20 bp, human
ggaggtggttagagtcccct

SEQ ID NO: 228507 - DNA, 20 bp, human
gtgggtgtgtgccccgcaga

SEQ ID NO: 228508 - DNA, 20 bp, human
gagaggggccgagcctgcac

SEQ ID NO: 228509 - DNA, 20 bp, human
ggccggcgctcggaaaaccg

SEQ ID NO: 228510 - DNA, 20 bp, human
gagaagagatggccccaaat

SEQ ID NO: 228511 - DNA, 20 bp, human
gttctctctggggctctcat

SEQ ID NO: 228512 - DNA, 20 bp, human
gtctcattggtctgcacact

SEQ ID NO: 228513 - DNA, 20 bp, human
ggtctgcacactgggcactg

SEQ ID NO: 228514 - DNA, 20 bp, human
gctccctgcatcttcccttg

SEQ ID NO: 228515 - DNA, 20 bp, human
ggagaaggggggccggcgct

SEQ ID NO: 228516 - DNA, 20 bp, human
ggagggctcggttgggtgga

SEQ ID NO: 228517 - DNA, 20 bp, human
gggggcagctggcatgttgt

SEQ ID NO: 228518 - DNA, 20 bp, human
gaggggttgaacacagttag

SEQ ID NO: 228519 - DNA, 20 bp, human
gagactagggttggggactt

SEQ ID NO: 228520 - DNA, 20 bp, human
gaaggtgggacttcgagact

SEQ ID NO: 228521 - DNA, 20 bp, human
gagaacccaaaattacgggg

SEQ ID NO: 228522 - DNA, 20 bp, human
gggcaggagagggctcggtt

SEQ ID NO: 228523 - DNA, 20 bp, human
gagcaaaccgcatgcaggtc

SEQ ID NO: 228524 - DNA, 20 bp, human
gtctcgaagtcccaccttcc

SEQ ID NO: 228525 - DNA, 20 bp, human
gggacttcgagactagggtt

SEQ ID NO: 228526 - DNA, 20 bp, human
gtctgctgactattatgggt

SEQ ID NO: 228527 - DNA, 20 bp, human
gtggactcttcactgctacc

SEQ ID NO: 228528 - DNA, 20 bp, human
gagcactccagctggtgttg

SEQ ID NO: 228529 - DNA, 20 bp, human
gggctctctgctgactatta

SEQ ID NO: 228530 - DNA, 20 bp, human
gttcactgctacctggcatg

SEQ ID NO: 228531 - DNA, 20 bp, human
gggtgtgtgtattcggagtc

SEQ ID NO: 228532 - DNA, 20 bp, human
ggataaaaataatacgaaag

SEQ ID NO: 228533 - DNA, 20 bp, human
gctgactattatgggttggc

SEQ ID NO: 228534 - DNA, 20 bp, human
gcactctgacattgtggggg

SEQ ID NO: 228535 - DNA, 20 bp, human
gctgcacaccttttactcta

SEQ ID NO: 228536 - DNA, 20 bp, human
ggaaaccggaataagaagga

SEQ ID NO: 228537 - DNA, 20 bp, human
gtggctgcggattaaaggta

SEQ ID NO: 228538 - DNA, 20 bp, human
ggaagcctggagacgtgctc

SEQ ID NO: 228539 - DNA, 20 bp, human
gagggtgtgacgtgctgaag

SEQ ID NO: 228540 - DNA, 20 bp, human
gggcagggaggggctcgctt

SEQ ID NO: 228541 - DNA, 20 bp, human
gacagttggctgcggattaa

SEQ ID NO: 228542 - DNA, 20 bp, human
ggtggggaccgccacacagt

SEQ ID NO: 228543 - DNA, 20 bp, human
gttgccgctaggcgaaagtg

SEQ ID NO: 228544 - DNA, 20 bp, human
gtctggaaaccggaataaga

SEQ ID NO: 228545 - DNA, 20 bp, human
gtccctgccgcctgcatgat

SEQ ID NO: 228546 - DNA, 20 bp, human
gtggagggaaaggcgacagc

SEQ ID NO: 228547 - DNA, 20 bp, human
gactcatcaaagatattgag

SEQ ID NO: 228548 - DNA, 20 bp, human
gtgaaacaaagtgtagaatc

SEQ ID NO: 228549 - DNA, 20 bp, human
gtttttaaaaacctgtgaga

SEQ ID NO: 228550 - DNA, 20 bp, human
gcgcggcgcttgcggccagc

SEQ ID NO: 228551 - DNA, 20 bp, human
gtgctaaatgcccatctcac

SEQ ID NO: 228552 - DNA, 20 bp, human
gaatgttttttaagatgtat

SEQ ID NO: 228553 - DNA, 20 bp, human
ggaaaggcgacagcgggaac

SEQ ID NO: 228554 - DNA, 20 bp, human
ggcgcttccggcgctgcgcg

SEQ ID NO: 228555 - DNA, 20 bp, human
ggccgccaaagtgagaaccc

SEQ ID NO: 228556 - DNA, 20 bp, human
gctacctgctagagttacga

SEQ ID NO: 228557 - DNA, 20 bp, human
gcatcagtagctatgcgatt

SEQ ID NO: 228558 - DNA, 20 bp, human
gcccagcacacacttaataa

SEQ ID NO: 228559 - DNA, 20 bp, human
gtaactgcacttaacagata

SEQ ID NO: 228560 - DNA, 20 bp, human
gcaccatccacacggagcta

SEQ ID NO: 228561 - DNA, 20 bp, human
gtatttctcccgctggaaaa

SEQ ID NO: 228562 - DNA, 20 bp, human
gggtaggcactcaacaggca

SEQ ID NO: 228563 - DNA, 20 bp, human
gacccttattaagtgtgtgc

SEQ ID NO: 228564 - DNA, 20 bp, human
gactgaaccagaagtgaata

SEQ ID NO: 228565 - DNA, 20 bp, human
gcacttctggttcagttccg

SEQ ID NO: 228566 - DNA, 20 bp, human
gggcgcgtcaacgaaagcga

SEQ ID NO: 228567 - DNA, 20 bp, human
gcgcgcacaaggccctgcgg

SEQ ID NO: 228568 - DNA, 20 bp, human
ggggccttgtgcgcggtgat

SEQ ID NO: 228569 - DNA, 20 bp, human
gcgaaaacgcaaccgggtga

SEQ ID NO: 228570 - DNA, 20 bp, human
gtaaacggggctggagtctc

SEQ ID NO: 228571 - DNA, 20 bp, human
gtcggattggaggacgtagg

SEQ ID NO: 228572 - DNA, 20 bp, human
gagggggcgcgggctccaaa

SEQ ID NO: 228573 - DNA, 20 bp, human
gaactcttcagcccaccgca

SEQ ID NO: 228574 - DNA, 20 bp, human
gccgcccgcgcctccggaac

SEQ ID NO: 228575 - DNA, 20 bp, human
ggaaagccggcgcctcatcc

SEQ ID NO: 228576 - DNA, 20 bp, human
gccaacctgcacgcaagctt

SEQ ID NO: 228577 - DNA, 20 bp, human
gcaccagcagctcaggctta

SEQ ID NO: 228578 - DNA, 20 bp, human
gcttgcgtgcaggttggcgg

SEQ ID NO: 228579 - DNA, 20 bp, human
gcggcgtggaccgtccccag

SEQ ID NO: 228580 - DNA, 20 bp, human
gtggaccgtccccagtggct

SEQ ID NO: 228581 - DNA, 20 bp, human
gcctcccaaagcttgcgtgc

SEQ ID NO: 228582 - DNA, 20 bp, human
gacgccgcctctaacactac

SEQ ID NO: 228583 - DNA, 20 bp, human
gggcgtgcgcgagctcgcga

SEQ ID NO: 228584 - DNA, 20 bp, human
ggccgcgcacggtcctgccc

SEQ ID NO: 228585 - DNA, 20 bp, human
gccccggacgcagtacgaag

SEQ ID NO: 228586 - DNA, 20 bp, human
gtggcctcagaccgcagcgt

SEQ ID NO: 228587 - DNA, 20 bp, human
gtggccagctccaagtcgaa

SEQ ID NO: 228588 - DNA, 20 bp, human
gaagcgacgcatgagttgtt

SEQ ID NO: 228589 - DNA, 20 bp, human
gaagccctcagggtgggcaa

SEQ ID NO: 228590 - DNA, 20 bp, human
gccggcagccgacgtctcta

SEQ ID NO: 228591 - DNA, 20 bp, human
ggtcggagccatagagacgt

SEQ ID NO: 228592 - DNA, 20 bp, human
gcgagaggacgccgggatac

SEQ ID NO: 228593 - DNA, 20 bp, human
gcggccgacgctgcggtctg

SEQ ID NO: 228594 - DNA, 20 bp, human
gaggggtcggggcctacggt

SEQ ID NO: 228595 - DNA, 20 bp, human
ggctccgttgcccaccctga

SEQ ID NO: 228596 - DNA, 20 bp, human
gcacccccgccaacttcttc

SEQ ID NO: 228597 - DNA, 20 bp, human
gccagctctcagacacccgg

SEQ ID NO: 228598 - DNA, 20 bp, human
ggggcggggttgttgactgg

SEQ ID NO: 228599 - DNA, 20 bp, human
gggtgggcggggttgttgac

SEQ ID NO: 228600 - DNA, 20 bp, human
ggggccggctggctgcagaa

SEQ ID NO: 228601 - DNA, 20 bp, human
gtctcagacacccggaggaa

SEQ ID NO: 228602 - DNA, 20 bp, human
gcgcccagctctcagacacc

SEQ ID NO: 228603 - DNA, 20 bp, human
gaggccagaagaagttggcg

SEQ ID NO: 228604 - DNA, 20 bp, human
gctaagaggccagaagaagt

SEQ ID NO: 228605 - DNA, 20 bp, human
gagacacccggaggaagggc

SEQ ID NO: 228606 - DNA, 20 bp, human
gctgttgcggagctctgaag

SEQ ID NO: 228607 - DNA, 20 bp, human
gtccttgttcggaatggggt

SEQ ID NO: 228608 - DNA, 20 bp, human
ggcaggaattggtgtaggaa

SEQ ID NO: 228609 - DNA, 20 bp, human
gaagtcccgcccctccactc

SEQ ID NO: 228610 - DNA, 20 bp, human
ggggcagcctccggagtgga

SEQ ID NO: 228611 - DNA, 20 bp, human
gtcccgcccctccactccgg

SEQ ID NO: 228612 - DNA, 20 bp, human
gttcgtagggaacgcagcga

SEQ ID NO: 228613 - DNA, 20 bp, human
gtcctgctccgcccttcgta

SEQ ID NO: 228614 - DNA, 20 bp, human
gtccctacgaagggcggagc

SEQ ID NO: 228615 - DNA, 20 bp, human
ggtcgggactgcttttgcgt

SEQ ID NO: 228616 - DNA, 20 bp, human
gggctgcagcgggcggagca

SEQ ID NO: 228617 - DNA, 20 bp, human
gcgctcatctgcatattcgg

SEQ ID NO: 228618 - DNA, 20 bp, human
gccggccgggcgtggatgga

SEQ ID NO: 228619 - DNA, 20 bp, human
gcaggggcgaagacggtggc

SEQ ID NO: 228620 - DNA, 20 bp, human
gacgcgctcatctgcatatt

SEQ ID NO: 228621 - DNA, 20 bp, human
gtatgcagatgagcgcgtga

SEQ ID NO: 228622 - DNA, 20 bp, human
gggggccggagctgctagag

SEQ ID NO: 228623 - DNA, 20 bp, human
ggacgtggctccgagtggat

SEQ ID NO: 228624 - DNA, 20 bp, human
gggccgcccaggctagtacc

SEQ ID NO: 228625 - DNA, 20 bp, human
gagggaccggcaggcttttg

SEQ ID NO: 228626 - DNA, 20 bp, human
gaaggtgcccacgtgaactg

SEQ ID NO: 228627 - DNA, 20 bp, human
gtgcccacgtgaactgagga

SEQ ID NO: 228628 - DNA, 20 bp, human
ggtccggcggccgctgagga

SEQ ID NO: 228629 - DNA, 20 bp, human
gcgcgcgctcccctcctcag

SEQ ID NO: 228630 - DNA, 20 bp, human
gaaccggccgggaacgccgc

SEQ ID NO: 228631 - DNA, 20 bp, human
gagcgcacaggcattgggcg

SEQ ID NO: 228632 - DNA, 20 bp, human
ggcgcggctggcagcttaga

SEQ ID NO: 228633 - DNA, 20 bp, human
gaggacgcaggctcgcgtca

SEQ ID NO: 228634 - DNA, 20 bp, human
gtccgaggaacgcgttaact

SEQ ID NO: 228635 - DNA, 20 bp, human
gtgctctcaggcctccgccc

SEQ ID NO: 228636 - DNA, 20 bp, human
gagaggcgcggcaggctaga

SEQ ID NO: 228637 - DNA, 20 bp, human
gccctggtcagacgacgagt

SEQ ID NO: 228638 - DNA, 20 bp, human
gagacggcgtaggggactag

SEQ ID NO: 228639 - DNA, 20 bp, human
gcgacctcggaaagagtcct

SEQ ID NO: 228640 - DNA, 20 bp, human
gactctttccgaggtcggag

SEQ ID NO: 228641 - DNA, 20 bp, human
ggagggatcccagtgcgcag

SEQ ID NO: 228642 - DNA, 20 bp, human
gagcgcatgcgagacggcgt

SEQ ID NO: 228643 - DNA, 20 bp, human
ggcacccaggactctttccg

SEQ ID NO: 228644 - DNA, 20 bp, human
ggggccggaaccagtgcctt

SEQ ID NO: 228645 - DNA, 20 bp, human
gggcgcagatgaccagcgag

SEQ ID NO: 228646 - DNA, 20 bp, human
gggaaggcatagagtgtaaa

SEQ ID NO: 228647 - DNA, 20 bp, human
gcatgcccatgtgggaacaa

SEQ ID NO: 228648 - DNA, 20 bp, human
gtgtcccagagcacgaggga

SEQ ID NO: 228649 - DNA, 20 bp, human
gacaaggaggagggtatctg

SEQ ID NO: 228650 - DNA, 20 bp, human
gttctggagtgaatctcttg

SEQ ID NO: 228651 - DNA, 20 bp, human
gtaacaaactgcctggagaa

SEQ ID NO: 228652 - DNA, 20 bp, human
gggattgtcccagagcacga

SEQ ID NO: 228653 - DNA, 20 bp, human
gcagacgcatggggtgtgaa

SEQ ID NO: 228654 - DNA, 20 bp, human
gagagcaagagcagacgcat

SEQ ID NO: 228655 - DNA, 20 bp, human
gatacgtaggagtgatccga

SEQ ID NO: 228656 - DNA, 20 bp, human
gaggaccagaccaccctgtg

SEQ ID NO: 228657 - DNA, 20 bp, human
ggggccggaccaccccccta

SEQ ID NO: 228658 - DNA, 20 bp, human
ggcaccgcgatgagggggac

SEQ ID NO: 228659 - DNA, 20 bp, human
gccagaccaccctgtgggga

SEQ ID NO: 228660 - DNA, 20 bp, human
gcctgtcaccgcatccctag

SEQ ID NO: 228661 - DNA, 20 bp, human
gccatggcaccgcgatgagg

SEQ ID NO: 228662 - DNA, 20 bp, human
gccaccctgcggggattggg

SEQ ID NO: 228663 - DNA, 20 bp, human
gggggacaaagggttagggc

SEQ ID NO: 228664 - DNA, 20 bp, human
gccaccgcgtgaggattggg

SEQ ID NO: 228665 - DNA, 20 bp, human
gggaccatggcaccgcgatg

SEQ ID NO: 228666 - DNA, 20 bp, human
gagtgtccagctcacaggtg

SEQ ID NO: 228667 - DNA, 20 bp, human
gcagctcagagctattttca

SEQ ID NO: 228668 - DNA, 20 bp, human
gttaaaaaaaatcccccttc

SEQ ID NO: 228669 - DNA, 20 bp, human
ggtccagctcacaggtgtgg

SEQ ID NO: 228670 - DNA, 20 bp, human
gttaagagtgtccagctcac

SEQ ID NO: 228671 - DNA, 20 bp, human
gcaccaccacacctgtgagc

SEQ ID NO: 228672 - DNA, 20 bp, human
gactgtgccaggccagaagg

SEQ ID NO: 228673 - DNA, 20 bp, human
gtgggcaacatagtaaattc

SEQ ID NO: 228674 - DNA, 20 bp, human
gaaaaatcccccttctggcc

SEQ ID NO: 228675 - DNA, 20 bp, human
gctaacttcatagtaactct

SEQ ID NO: 228676 - DNA, 20 bp, human
gagaccccaggtgtagtcga

SEQ ID NO: 228677 - DNA, 20 bp, human
ggaagcaggggctgctgcat

SEQ ID NO: 228678 - DNA, 20 bp, human
gccccgcggcgtctcccagt

SEQ ID NO: 228679 - DNA, 20 bp, human
gggcccctcgactacacctg

SEQ ID NO: 228680 - DNA, 20 bp, human
gtggaaatgggtagtccccg

SEQ ID NO: 228681 - DNA, 20 bp, human
gcccgactgggagacgccgc

SEQ ID NO: 228682 - DNA, 20 bp, human
gctgcagcattcccgctcca

SEQ ID NO: 228683 - DNA, 20 bp, human
ggtcactaatggtctcgcga

SEQ ID NO: 228684 - DNA, 20 bp, human
ggggctcctcccgaggagga

SEQ ID NO: 228685 - DNA, 20 bp, human
ggtgtagtcgaggggccggg

SEQ ID NO: 228686 - DNA, 20 bp, human
gagggaagggactaaaaatc

SEQ ID NO: 228687 - DNA, 20 bp, human
gggactaaaaatcagggtgg

SEQ ID NO: 228688 - DNA, 20 bp, human
gtgcctggtgaccacaggtg

SEQ ID NO: 228689 - DNA, 20 bp, human
gcccttctgtctgttgagtg

SEQ ID NO: 228690 - DNA, 20 bp, human
gtcaatgtttgcaggatgcc

SEQ ID NO: 228691 - DNA, 20 bp, human
gatcagaactcaatgtttgc

SEQ ID NO: 228692 - DNA, 20 bp, human
gaaatgtatggagataattg

SEQ ID NO: 228693 - DNA, 20 bp, human
gaagggactaaaaatcaggg

SEQ ID NO: 228694 - DNA, 20 bp, human
gacagaaggtagggacagca

SEQ ID NO: 228695 - DNA, 20 bp, human
gaatcagggtggtggaaagg

SEQ ID NO: 228696 - DNA, 20 bp, human
ggctgctcaggattatggga

SEQ ID NO: 228697 - DNA, 20 bp, human
gggcacggctggctccctat

SEQ ID NO: 228698 - DNA, 20 bp, human
gtgggaggagacatcagctc

SEQ ID NO: 228699 - DNA, 20 bp, human
ggcgggaagcacagtctgga

SEQ ID NO: 228700 - DNA, 20 bp, human
gtgagcagcaaggagactag

SEQ ID NO: 228701 - DNA, 20 bp, human
ggcccctcggctgacccaat

SEQ ID NO: 228702 - DNA, 20 bp, human
gagacatcagctccggaaga

SEQ ID NO: 228703 - DNA, 20 bp, human
ggacccggaaagacctttgc

SEQ ID NO: 228704 - DNA, 20 bp, human
gctcaggattatgggaggga

SEQ ID NO: 228705 - DNA, 20 bp, human
gcggacctctcctggttggt

SEQ ID NO: 228706 - DNA, 20 bp, human
ggacgggtctggaagaagtg

SEQ ID NO: 228707 - DNA, 20 bp, human
ggcgccgggtctcaccacgg

SEQ ID NO: 228708 - DNA, 20 bp, human
gaacgcgccgggtctcacca

SEQ ID NO: 228709 - DNA, 20 bp, human
gcgttgctgtgaagacggac

SEQ ID NO: 228710 - DNA, 20 bp, human
gcatccgccgtggtgagacc

SEQ ID NO: 228711 - DNA, 20 bp, human
gtgtccctcggcatccgccg

SEQ ID NO: 228712 - DNA, 20 bp, human
gtcaccacggcggatgccga

SEQ ID NO: 228713 - DNA, 20 bp, human
gcggcgcgttgctgtgaaga

SEQ ID NO: 228714 - DNA, 20 bp, human
gccccacgtcgaagcggaaa

SEQ ID NO: 228715 - DNA, 20 bp, human
gtgaccccggcctgctggcg

SEQ ID NO: 228716 - DNA, 20 bp, human
gacgcaggcgcagtagcaaa

SEQ ID NO: 228717 - DNA, 20 bp, human
gcgcagtagcaaagggctgt

SEQ ID NO: 228718 - DNA, 20 bp, human
gagacgcctctcccagtttg

SEQ ID NO: 228719 - DNA, 20 bp, human
gagaggcgtctcccacacgc

SEQ ID NO: 228720 - DNA, 20 bp, human
ggcctctcccagtttgcggg

SEQ ID NO: 228721 - DNA, 20 bp, human
gttgtacagttcatcctctc

SEQ ID NO: 228722 - DNA, 20 bp, human
gaactgtacaatttcaggaa

SEQ ID NO: 228723 - DNA, 20 bp, human
gtaaacttttatattgtgtc

SEQ ID NO: 228724 - DNA, 20 bp, human
gtgcttcccgcccgcaaact

SEQ ID NO: 228725 - DNA, 20 bp, human
ggatcccactttccgtaagt

SEQ ID NO: 228726 - DNA, 20 bp, human
ggccaccgactcaccctcta

SEQ ID NO: 228727 - DNA, 20 bp, human
ggccgtagagggtgagtcgg

SEQ ID NO: 228728 - DNA, 20 bp, human
gcccgcgcgctgtccacttc

SEQ ID NO: 228729 - DNA, 20 bp, human
ggtagccgtagagggtgagt

SEQ ID NO: 228730 - DNA, 20 bp, human
gcggaggcagcgaaggcgga

SEQ ID NO: 228731 - DNA, 20 bp, human
gggcggcggcgtagccgtag

SEQ ID NO: 228732 - DNA, 20 bp, human
ggcgccggaagcacgggtcc

SEQ ID NO: 228733 - DNA, 20 bp, human
gcggccggcgggtccttggg

SEQ ID NO: 228734 - DNA, 20 bp, human
gccacctcccaaggacccgc

SEQ ID NO: 228735 - DNA, 20 bp, human
ggggacacctacgcctgggg

SEQ ID NO: 228736 - DNA, 20 bp, human
gcgaagccgcgccccctgat

SEQ ID NO: 228737 - DNA, 20 bp, human
gggcaaggcccctacggaga

SEQ ID NO: 228738 - DNA, 20 bp, human
gactcgcgcggccacgttgg

SEQ ID NO: 228739 - DNA, 20 bp, human
gagcagggagccgacggtga

SEQ ID NO: 228740 - DNA, 20 bp, human
gtctccgcctgcggcatcct

SEQ ID NO: 228741 - DNA, 20 bp, human
gctgactcgcgcggccacgt

SEQ ID NO: 228742 - DNA, 20 bp, human
ggagaagctggccaatcagg

SEQ ID NO: 228743 - DNA, 20 bp, human
ggcccctacggagaaggttc

SEQ ID NO: 228744 - DNA, 20 bp, human
gtgcgactcaaatgcagata

SEQ ID NO: 228745 - DNA, 20 bp, human
ggggttacaactgactcgcg

SEQ ID NO: 228746 - DNA, 20 bp, human
gtgtttctgacaggttgagc

SEQ ID NO: 228747 - DNA, 20 bp, human
ggtgtgccagggcaagagga

SEQ ID NO: 228748 - DNA, 20 bp, human
gggttgcagtgagcaggcag

SEQ ID NO: 228749 - DNA, 20 bp, human
gttctgacaggttgagcagg

SEQ ID NO: 228750 - DNA, 20 bp, human
gtcttgccctggcacacaga

SEQ ID NO: 228751 - DNA, 20 bp, human
ggttttccgtcctcttgccc

SEQ ID NO: 228752 - DNA, 20 bp, human
gagaggacggaaaacggacc

SEQ ID NO: 228753 - DNA, 20 bp, human
gggaaataacaggaatttca

SEQ ID NO: 228754 - DNA, 20 bp, human
gagggtggagggaactgcag

SEQ ID NO: 228755 - DNA, 20 bp, human
gtgcaggggtgggtggtggt

SEQ ID NO: 228756 - DNA, 20 bp, human
ggtcccgtctacgctctcaa

SEQ ID NO: 228757 - DNA, 20 bp, human
gccgctgggcgttctatctc

SEQ ID NO: 228758 - DNA, 20 bp, human
gggcgtggggcggaagtgcg

SEQ ID NO: 228759 - DNA, 20 bp, human
gcacccttgagagcgtagac

SEQ ID NO: 228760 - DNA, 20 bp, human
gtcttcacgagtaaaggttc

SEQ ID NO: 228761 - DNA, 20 bp, human
gcctgaggcctcttattaaa

SEQ ID NO: 228762 - DNA, 20 bp, human
gtgtcactcttcacgagtaa

SEQ ID NO: 228763 - DNA, 20 bp, human
gacgagtaaaggttcaggcg

SEQ ID NO: 228764 - DNA, 20 bp, human
gaaaagtgaccccgcatgtt

SEQ ID NO: 228765 - DNA, 20 bp, human
gcggcagtgctgccggcgtg

SEQ ID NO: 228766 - DNA, 20 bp, human
gtgtgtgacctaactggaca

SEQ ID NO: 228767 - DNA, 20 bp, human
gtggctttgtgtgacctaac

SEQ ID NO: 228768 - DNA, 20 bp, human
gaacacaatgctccctcaca

SEQ ID NO: 228769 - DNA, 20 bp, human
gaactgaaaaatctctcaaa

SEQ ID NO: 228770 - DNA, 20 bp, human
gagcactagcaagaagctaa

SEQ ID NO: 228771 - DNA, 20 bp, human
gtctctctaaataatcagcc

SEQ ID NO: 228772 - DNA, 20 bp, human
gacccactcagaagagaaca

SEQ ID NO: 228773 - DNA, 20 bp, human
gtcagaattgcctgcctcca

SEQ ID NO: 228774 - DNA, 20 bp, human
gaattgcctgcctccatggc

SEQ ID NO: 228775 - DNA, 20 bp, human
gttgctagtgctgcgtcccc

SEQ ID NO: 228776 - DNA, 20 bp, human
gaagcctagcaacacctaga

SEQ ID NO: 228777 - DNA, 20 bp, human
gtaaaattgctgcccccctt

SEQ ID NO: 228778 - DNA, 20 bp, human
gagtagtaaccctgaaactc

SEQ ID NO: 228779 - DNA, 20 bp, human
gatccaacacccagagtttc

SEQ ID NO: 228780 - DNA, 20 bp, human
gaatctatacattcctaagg

SEQ ID NO: 228781 - DNA, 20 bp, human
gtcagtgagttttcaattca

SEQ ID NO: 228782 - DNA, 20 bp, human
gaaaatagcaatgatcaaat

SEQ ID NO: 228783 - DNA, 20 bp, human
gcaaccctctaggtgttgct

SEQ ID NO: 228784 - DNA, 20 bp, human
gaagaatctatacattccta

SEQ ID NO: 228785 - DNA, 20 bp, human
gtgattacgcttctctgaaa

SEQ ID NO: 228786 - DNA, 20 bp, human
gggggtgggcggtgcgaagg

SEQ ID NO: 228787 - DNA, 20 bp, human
gtctggagccgccaatccgg

SEQ ID NO: 228788 - DNA, 20 bp, human
gggcgcgcgcagttttccgg

SEQ ID NO: 228789 - DNA, 20 bp, human
ggccgccaatccggaggcgg

SEQ ID NO: 228790 - DNA, 20 bp, human
ggggccggacggggtagggc

SEQ ID NO: 228791 - DNA, 20 bp, human
gcgccccgccctaccccgtc

SEQ ID NO: 228792 - DNA, 20 bp, human
gccaatccggaggcgggggt

SEQ ID NO: 228793 - DNA, 20 bp, human
gccgtcaggcgcgtgatcaa

SEQ ID NO: 228794 - DNA, 20 bp, human
gcgcggggccggacggggta

SEQ ID NO: 228795 - DNA, 20 bp, human
gccggtggcctggagatttc

SEQ ID NO: 228796 - DNA, 20 bp, human
gcttgtataggatactggaa

SEQ ID NO: 228797 - DNA, 20 bp, human
ggaagggaactcactctttc

SEQ ID NO: 228798 - DNA, 20 bp, human
ggaggaccttgaacttgtat

SEQ ID NO: 228799 - DNA, 20 bp, human
gctaatgtttgtaactcttg

SEQ ID NO: 228800 - DNA, 20 bp, human
gttgaacttgtataggatac

SEQ ID NO: 228801 - DNA, 20 bp, human
gattaatgatgtacaatctc

SEQ ID NO: 228802 - DNA, 20 bp, human
ggagttacaaacattaggct

SEQ ID NO: 228803 - DNA, 20 bp, human
gcttagaacattagtgaggc

SEQ ID NO: 228804 - DNA, 20 bp, human
ggaaaaggcagaggatcaaa

SEQ ID NO: 228805 - DNA, 20 bp, human
gggcagaggatcaaaaggct

SEQ ID NO: 228806 - DNA, 20 bp, human
gcctcaccgctgcggggcga

SEQ ID NO: 228807 - DNA, 20 bp, human
gttgtgacgacactaagagg

SEQ ID NO: 228808 - DNA, 20 bp, human
ggggcgatggagcgaaaagt

SEQ ID NO: 228809 - DNA, 20 bp, human
gacggggcggagtaatggtc

SEQ ID NO: 228810 - DNA, 20 bp, human
ggggctgcgggagaagttga

SEQ ID NO: 228811 - DNA, 20 bp, human
gtggggacggggcggagtaa

SEQ ID NO: 228812 - DNA, 20 bp, human
ggatggagcgaaaagtagga

SEQ ID NO: 228813 - DNA, 20 bp, human
gagaggcgggcgtccgggag

SEQ ID NO: 228814 - DNA, 20 bp, human
gacactaagaggcgggcgtc

SEQ ID NO: 228815 - DNA, 20 bp, human
gccgcgtgacctcaccgctg

SEQ ID NO: 228816 - DNA, 20 bp, human
ggaacccagacaaagagcac

SEQ ID NO: 228817 - DNA, 20 bp, human
gcagaagaggggaggagttg

SEQ ID NO: 228818 - DNA, 20 bp, human
gttccagaaggcacagaaga

SEQ ID NO: 228819 - DNA, 20 bp, human
ggggggaggttccgcagcag

SEQ ID NO: 228820 - DNA, 20 bp, human
gcaatactctctgttccaga

SEQ ID NO: 228821 - DNA, 20 bp, human
gcatatggaaggatgcgtat

SEQ ID NO: 228822 - DNA, 20 bp, human
gggagggcttagaatgtttg

SEQ ID NO: 228823 - DNA, 20 bp, human
gtaagggactacagtatctt

SEQ ID NO: 228824 - DNA, 20 bp, human
gcagtgaaggaagccaagga

SEQ ID NO: 228825 - DNA, 20 bp, human
gtcccctcttctgtgccttc

SEQ ID NO: 228826 - DNA, 20 bp, human
gaaccatagcggcgagcgtg

SEQ ID NO: 228827 - DNA, 20 bp, human
gtgtcgcgagatagcgaaag

SEQ ID NO: 228828 - DNA, 20 bp, human
gcgacccacgcgagccgcta

SEQ ID NO: 228829 - DNA, 20 bp, human
gtaaccatagcggctcgcgt

SEQ ID NO: 228830 - DNA, 20 bp, human
gaaaggggcgtgggcgcgag

SEQ ID NO: 228831 - DNA, 20 bp, human
gcgccccacgctcgccgcta

SEQ ID NO: 228832 - DNA, 20 bp, human
gcggaggcggaagtgacgct

SEQ ID NO: 228833 - DNA, 20 bp, human
ggcgagcgtggggcggagtg

SEQ ID NO: 228834 - DNA, 20 bp, human
ggagaccagcccgctagggg

SEQ ID NO: 228835 - DNA, 20 bp, human
gagtgagccggccggaagcg

SEQ ID NO: 228836 - DNA, 20 bp, human
gagggctccgaagagaatgt

SEQ ID NO: 228837 - DNA, 20 bp, human
gagggggtggcccgtctccc

SEQ ID NO: 228838 - DNA, 20 bp, human
ggcgtgcagggaggaacctg

SEQ ID NO: 228839 - DNA, 20 bp, human
gcaccgggccgtgccaacaa

SEQ ID NO: 228840 - DNA, 20 bp, human
gccccctagtccgggaaagg

SEQ ID NO: 228841 - DNA, 20 bp, human
gtcccggactagggggaagt

SEQ ID NO: 228842 - DNA, 20 bp, human
gggtcagtatgggtacatcg

SEQ ID NO: 228843 - DNA, 20 bp, human
gcctagtccgggaaaggagg

SEQ ID NO: 228844 - DNA, 20 bp, human
gtcacgccccacatatttga

SEQ ID NO: 228845 - DNA, 20 bp, human
gggcacggcccggtgggctg

SEQ ID NO: 228846 - DNA, 20 bp, human
gtaagcgcgcctgcgcccgc

SEQ ID NO: 228847 - DNA, 20 bp, human
gaggcagtctccgagcccgc

SEQ ID NO: 228848 - DNA, 20 bp, human
ggtgaatacagcgcttgggg

SEQ ID NO: 228849 - DNA, 20 bp, human
gtgggtgcaacgacagtgag

SEQ ID NO: 228850 - DNA, 20 bp, human
gcagcccagtcctggacagt

SEQ ID NO: 228851 - DNA, 20 bp, human
gttgcgcactgcaggctcga

SEQ ID NO: 228852 - DNA, 20 bp, human
gaacttgcgcaagcgcactc

SEQ ID NO: 228853 - DNA, 20 bp, human
ggctgtgaatacagcgcttg

SEQ ID NO: 228854 - DNA, 20 bp, human
gtcccgcgcttgcgcactgc

SEQ ID NO: 228855 - DNA, 20 bp, human
gaggccggggcgggggggta

SEQ ID NO: 228856 - DNA, 20 bp, human
gtccgcacgcggttagcctg

SEQ ID NO: 228857 - DNA, 20 bp, human
gggagcagggctccggacag

SEQ ID NO: 228858 - DNA, 20 bp, human
gggctccggacaggggtagg

SEQ ID NO: 228859 - DNA, 20 bp, human
gagaaaaacgaaaggtgggt

SEQ ID NO: 228860 - DNA, 20 bp, human
gtgaatcagcgaatgacaaa

SEQ ID NO: 228861 - DNA, 20 bp, human
ggggtgggaaactaggatag

SEQ ID NO: 228862 - DNA, 20 bp, human
gtcttcctcctacccctgtc

SEQ ID NO: 228863 - DNA, 20 bp, human
gagctccggagaaaaacgaa

SEQ ID NO: 228864 - DNA, 20 bp, human
ggtgtcaagcttcttctgaa

SEQ ID NO: 228865 - DNA, 20 bp, human
ggacagccgccaggtgggag

SEQ ID NO: 228866 - DNA, 20 bp, human
gaccccactaccaggataaa

SEQ ID NO: 228867 - DNA, 20 bp, human
gctggctcacagctcatccc

SEQ ID NO: 228868 - DNA, 20 bp, human
gccaaggtgaaggagatatg

SEQ ID NO: 228869 - DNA, 20 bp, human
gaccacattaggaatgaggg

SEQ ID NO: 228870 - DNA, 20 bp, human
gcacaaggacctccaccctg

SEQ ID NO: 228871 - DNA, 20 bp, human
gtgttgccacagaccacatt

SEQ ID NO: 228872 - DNA, 20 bp, human
gagccctttatcctggtagt

SEQ ID NO: 228873 - DNA, 20 bp, human
gagctgggtgtctcccgccc

SEQ ID NO: 228874 - DNA, 20 bp, human
ggaatgtcccagaggaagct

SEQ ID NO: 228875 - DNA, 20 bp, human
gtatgaggatgcatgagaaa

SEQ ID NO: 228876 - DNA, 20 bp, human
gtcataccctataccacctc

SEQ ID NO: 228877 - DNA, 20 bp, human
gtatttcttacagtttatgg

SEQ ID NO: 228878 - DNA, 20 bp, human
gttaatgctagagtctggga

SEQ ID NO: 228879 - DNA, 20 bp, human
gtcactgaagattcctgagg

SEQ ID NO: 228880 - DNA, 20 bp, human
gtgatgcaactcctccacct

SEQ ID NO: 228881 - DNA, 20 bp, human
gggtggtatagggtatgaca

SEQ ID NO: 228882 - DNA, 20 bp, human
gacaacttaatgctagagtc

SEQ ID NO: 228883 - DNA, 20 bp, human
gttacttggcaactgttgct

SEQ ID NO: 228884 - DNA, 20 bp, human
gtatagggtatgacatggcc

SEQ ID NO: 228885 - DNA, 20 bp, human
ggaattcactcaccccttaa

SEQ ID NO: 228886 - DNA, 20 bp, human
ggggcggggtcccactttga

SEQ ID NO: 228887 - DNA, 20 bp, human
gagagacatcttaacctccg

SEQ ID NO: 228888 - DNA, 20 bp, human
gggccccgccccctctggtc

SEQ ID NO: 228889 - DNA, 20 bp, human
gggaaggctccggaccagag

SEQ ID NO: 228890 - DNA, 20 bp, human
gatgaggcggctttgaaagc

SEQ ID NO: 228891 - DNA, 20 bp, human
ggagaggctgggaaaacgga

SEQ ID NO: 228892 - DNA, 20 bp, human
gaacggaagggctgtatcct

SEQ ID NO: 228893 - DNA, 20 bp, human
gcatctccatggttacgcgg

SEQ ID NO: 228894 - DNA, 20 bp, human
gcggctttgaaagcggggtg

SEQ ID NO: 228895 - DNA, 20 bp, human
gggtctttcccccaaaagat

SEQ ID NO: 228896 - DNA, 20 bp, human
ggtaaccacacacagcaaat

SEQ ID NO: 228897 - DNA, 20 bp, human
gccaccccctgaggagtcaa

SEQ ID NO: 228898 - DNA, 20 bp, human
gcctagcccaggtttctaat

SEQ ID NO: 228899 - DNA, 20 bp, human
gcctgaggagtcaaaggctc

SEQ ID NO: 228900 - DNA, 20 bp, human
gcacacacagcaaataggtt

SEQ ID NO: 228901 - DNA, 20 bp, human
gcatgtttcagcacaatgac

SEQ ID NO: 228902 - DNA, 20 bp, human
gttgtcatctttcctagccc

SEQ ID NO: 228903 - DNA, 20 bp, human
gagcccaggtttctaatggg

SEQ ID NO: 228904 - DNA, 20 bp, human
gataggtttggagtatggtg

SEQ ID NO: 228905 - DNA, 20 bp, human
ggtagaacacatgtttgcat

SEQ ID NO: 228906 - DNA, 20 bp, human
ggccaggcccgagagagcgc

SEQ ID NO: 228907 - DNA, 20 bp, human
gacccggcctgcgctctctc

SEQ ID NO: 228908 - DNA, 20 bp, human
ggctcagttacggtttctat

SEQ ID NO: 228909 - DNA, 20 bp, human
gaagtccccaggaagcgtta

SEQ ID NO: 228910 - DNA, 20 bp, human
gctctcgggcctggccgcat

SEQ ID NO: 228911 - DNA, 20 bp, human
gcccaggaagcgttaaggcc

SEQ ID NO: 228912 - DNA, 20 bp, human
ggggcagtgttgtcattcgc

SEQ ID NO: 228913 - DNA, 20 bp, human
ggtggggaagccgcgtggtg

SEQ ID NO: 228914 - DNA, 20 bp, human
gggcccgagagagcgcaggc

SEQ ID NO: 228915 - DNA, 20 bp, human
ggccaggcttcctcaccacg

SEQ ID NO: 228916 - DNA, 20 bp, human
gtggacatggaccatttctg

SEQ ID NO: 228917 - DNA, 20 bp, human
gcgggggcgcgcgtatccag

SEQ ID NO: 228918 - DNA, 20 bp, human
gttggggcctcgtaggtctg

SEQ ID NO: 228919 - DNA, 20 bp, human
gcttctacaaagtaccagat

SEQ ID NO: 228920 - DNA, 20 bp, human
gctctctcttggggcctcgt

SEQ ID NO: 228921 - DNA, 20 bp, human
ggaaatgcccagattaacac

SEQ ID NO: 228922 - DNA, 20 bp, human
ggtcacaatggcccaggtat

SEQ ID NO: 228923 - DNA, 20 bp, human
gaatggcccaggtattggtc

SEQ ID NO: 228924 - DNA, 20 bp, human
ggatgtaaccactctctctt

SEQ ID NO: 228925 - DNA, 20 bp, human
gaaggctccacagacctacg

SEQ ID NO: 228926 - DNA, 20 bp, human
gcctccgcgtgcgtggctga

SEQ ID NO: 228927 - DNA, 20 bp, human
ggctccgcgggcttccccac

SEQ ID NO: 228928 - DNA, 20 bp, human
gcagcccggtcggcagtgca

SEQ ID NO: 228929 - DNA, 20 bp, human
gtgcagcggggggacaaaga

SEQ ID NO: 228930 - DNA, 20 bp, human
gcggccccggaaggtctctc

SEQ ID NO: 228931 - DNA, 20 bp, human
gggaaggtctctctgggccc

SEQ ID NO: 228932 - DNA, 20 bp, human
ggccttgagcgcagcccggt

SEQ ID NO: 228933 - DNA, 20 bp, human
gggcaactaccagagagcgg

SEQ ID NO: 228934 - DNA, 20 bp, human
gggggggacaaagagggcgg

SEQ ID NO: 228935 - DNA, 20 bp, human
ggcagggcctgcgaagcccg

SEQ ID NO: 228936 - DNA, 20 bp, human
ggccgcggggagggacgaga

SEQ ID NO: 228937 - DNA, 20 bp, human
gaaggggcggggcgcagata

SEQ ID NO: 228938 - DNA, 20 bp, human
gactgcgcgggaagtaggct

SEQ ID NO: 228939 - DNA, 20 bp, human
gggaggactgcgcgggaagt

SEQ ID NO: 228940 - DNA, 20 bp, human
ggcgtcttggaggactgcgc

SEQ ID NO: 228941 - DNA, 20 bp, human
gggcgcagtgagagcgggtc

SEQ ID NO: 228942 - DNA, 20 bp, human
ggctggaggccgcgtcttgg

SEQ ID NO: 228943 - DNA, 20 bp, human
gacgagagggcctgacgtac

SEQ ID NO: 228944 - DNA, 20 bp, human
gtcggggcacaccattctcc

SEQ ID NO: 228945 - DNA, 20 bp, human
ggcagtgagagcgggtcggg

SEQ ID NO: 228946 - DNA, 20 bp, human
gctggccccgccttcgtccc

SEQ ID NO: 228947 - DNA, 20 bp, human
ggcgactagaggagcggata

SEQ ID NO: 228948 - DNA, 20 bp, human
gcgaaggaggagctgagaat

SEQ ID NO: 228949 - DNA, 20 bp, human
gcgaaggcggggccagcgga

SEQ ID NO: 228950 - DNA, 20 bp, human
gcgggaggtcccagggccta

SEQ ID NO: 228951 - DNA, 20 bp, human
ggccagaagacccaatcttc

SEQ ID NO: 228952 - DNA, 20 bp, human
ggccagcggagggcgactag

SEQ ID NO: 228953 - DNA, 20 bp, human
gagggcctagggagcggaag

SEQ ID NO: 228954 - DNA, 20 bp, human
gccttcgtccccggaagatt

SEQ ID NO: 228955 - DNA, 20 bp, human
gtagggagcggaagaggtcg

SEQ ID NO: 228956 - DNA, 20 bp, human
gccgctcctccaatgataag

SEQ ID NO: 228957 - DNA, 20 bp, human
gggagcagtcctgggatggg

SEQ ID NO: 228958 - DNA, 20 bp, human
ggaggagcggggagcagtcc

SEQ ID NO: 228959 - DNA, 20 bp, human
gagcccatggctctctggat

SEQ ID NO: 228960 - DNA, 20 bp, human
ggacctggagacaacccaga

SEQ ID NO: 228961 - DNA, 20 bp, human
gtgggatgggtggtaacagg

SEQ ID NO: 228962 - DNA, 20 bp, human
gcagaaaataacctaaggtc

SEQ ID NO: 228963 - DNA, 20 bp, human
gctggggtttgggtgcaata

SEQ ID NO: 228964 - DNA, 20 bp, human
gttaatgggaaatgcaggtt

SEQ ID NO: 228965 - DNA, 20 bp, human
gtagggggagaaagtcgagg

SEQ ID NO: 228966 - DNA, 20 bp, human
gactcagtaggttgtaggga

SEQ ID NO: 228967 - DNA, 20 bp, human
ggtaatgagcctcccatcta

SEQ ID NO: 228968 - DNA, 20 bp, human
gtgtcctcacccaatgggat

SEQ ID NO: 228969 - DNA, 20 bp, human
gctagcactcagtaggttgt

SEQ ID NO: 228970 - DNA, 20 bp, human
gcaatgggatagggtgacat

SEQ ID NO: 228971 - DNA, 20 bp, human
ggcactgactacaaagggta

SEQ ID NO: 228972 - DNA, 20 bp, human
gtggggtgatgcctgctcaa

SEQ ID NO: 228973 - DNA, 20 bp, human
gagcaggcatcaccccaccc

SEQ ID NO: 228974 - DNA, 20 bp, human
ggccgcggcgggagtgctgg

SEQ ID NO: 228975 - DNA, 20 bp, human
ggggagtgtcctcacccaat

SEQ ID NO: 228976 - DNA, 20 bp, human
gcgggggtgtgcatgaaaat

SEQ ID NO: 228977 - DNA, 20 bp, human
gtgctcccccagttctgggc

SEQ ID NO: 228978 - DNA, 20 bp, human
gcaagccggcccagaactgg

SEQ ID NO: 228979 - DNA, 20 bp, human
gggtgcaaccaccatggggg

SEQ ID NO: 228980 - DNA, 20 bp, human
gcgcgtccgttgggcactct

SEQ ID NO: 228981 - DNA, 20 bp, human
gccgttgggcactctgggtt

SEQ ID NO: 228982 - DNA, 20 bp, human
gcgaatgggtgcaaccacca

SEQ ID NO: 228983 - DNA, 20 bp, human
ggctgtagaccgtaccaagc

SEQ ID NO: 228984 - DNA, 20 bp, human
gcggacgtgccaaaacttga

SEQ ID NO: 228985 - DNA, 20 bp, human
gcaagtgctcccccagttct

SEQ ID NO: 228986 - DNA, 20 bp, human
gtaggcgtggggagaacgga

SEQ ID NO: 228987 - DNA, 20 bp, human
gcagctgcccagatcccttt

SEQ ID NO: 228988 - DNA, 20 bp, human
gtgcctgcgaggattcccaa

SEQ ID NO: 228989 - DNA, 20 bp, human
ggggggctccgataagagag

SEQ ID NO: 228990 - DNA, 20 bp, human
gccggagggaagttaggcgt

SEQ ID NO: 228991 - DNA, 20 bp, human
gcagcggcgtggggccggtt

SEQ ID NO: 228992 - DNA, 20 bp, human
ggcgtggggccggttggggg

SEQ ID NO: 228993 - DNA, 20 bp, human
ggcgagcgaatcagcggcgt

SEQ ID NO: 228994 - DNA, 20 bp, human
gaggattcccaaagggatct

SEQ ID NO: 228995 - DNA, 20 bp, human
gtggggagaacggaggggct

SEQ ID NO: 228996 - DNA, 20 bp, human
ggggagctgggtttatatta

SEQ ID NO: 228997 - DNA, 20 bp, human
gccggcgcgcacagacagcg

SEQ ID NO: 228998 - DNA, 20 bp, human
gagacagcgcggggtatacg

SEQ ID NO: 228999 - DNA, 20 bp, human
ggggcggtgccgcagctcat

SEQ ID NO: 229000 - DNA, 20 bp, human
ggatgtggaaaagaacccag

SEQ ID NO: 229001 - DNA, 20 bp, human
gtagggggcgaccgagttta

SEQ ID NO: 229002 - DNA, 20 bp, human
gagcgcggggtatacggggg

SEQ ID NO: 229003 - DNA, 20 bp, human
gtggaaaagaacccaggggc

SEQ ID NO: 229004 - DNA, 20 bp, human
gtagggaagcatgagaaacc

SEQ ID NO: 229005 - DNA, 20 bp, human
gcatgagaaacccgggaaaa

SEQ ID NO: 229006 - DNA, 20 bp, human
gaggccggggccatttatgg

SEQ ID NO: 229007 - DNA, 20 bp, human
gggctgctgggaaacggctt

SEQ ID NO: 229008 - DNA, 20 bp, human
ggcgcgcgggaagagtccca

SEQ ID NO: 229009 - DNA, 20 bp, human
ggaacggagtgcgaagtgtc

SEQ ID NO: 229010 - DNA, 20 bp, human
gccaggcggaagaaagtccc

SEQ ID NO: 229011 - DNA, 20 bp, human
gagggtcattaacggaccat

SEQ ID NO: 229012 - DNA, 20 bp, human
gtatggcggcgccgggttgg

SEQ ID NO: 229013 - DNA, 20 bp, human
gacagtctgcgggatcgaac

SEQ ID NO: 229014 - DNA, 20 bp, human
gggaagaaagtccccggcgc

SEQ ID NO: 229015 - DNA, 20 bp, human
gtgcgaagtgtcagggtagc

SEQ ID NO: 229016 - DNA, 20 bp, human
ggggcaagcaggcatatctc

SEQ ID NO: 229017 - DNA, 20 bp, human
gtacgcccgtctgaagggag

SEQ ID NO: 229018 - DNA, 20 bp, human
gtaagcgcggggaggtcaca

SEQ ID NO: 229019 - DNA, 20 bp, human
gccagctacgcccgtctgaa

SEQ ID NO: 229020 - DNA, 20 bp, human
gccgcccgctcccttcagac

SEQ ID NO: 229021 - DNA, 20 bp, human
ggaaatgaagggcttcgcag

SEQ ID NO: 229022 - DNA, 20 bp, human
ggggccgggaaggtcgggtt

SEQ ID NO: 229023 - DNA, 20 bp, human
gaggaggtggggccgacttc

SEQ ID NO: 229024 - DNA, 20 bp, human
gccacctcctcctgatgtca

SEQ ID NO: 229025 - DNA, 20 bp, human
ggctgaatggagctggtcgc

SEQ ID NO: 229026 - DNA, 20 bp, human
gcgtggctgcagttagaaga

SEQ ID NO: 229027 - DNA, 20 bp, human
gagcctccctgcagagggcg

SEQ ID NO: 229028 - DNA, 20 bp, human
gcgcaggcgcaaagcagtag

SEQ ID NO: 229029 - DNA, 20 bp, human
ggaggcatccctgggctctt

SEQ ID NO: 229030 - DNA, 20 bp, human
gacccaggctaccttgagcc

SEQ ID NO: 229031 - DNA, 20 bp, human
gaggagcagggggcatgatc

SEQ ID NO: 229032 - DNA, 20 bp, human
gaggagttagaggcatccct

SEQ ID NO: 229033 - DNA, 20 bp, human
gtctcttggccaaagagccc

SEQ ID NO: 229034 - DNA, 20 bp, human
gtctgagccgaaatggcccg

SEQ ID NO: 229035 - DNA, 20 bp, human
gctgacaagcatgaacggaa

SEQ ID NO: 229036 - DNA, 20 bp, human
gagaacctaaatacaaggtt

SEQ ID NO: 229037 - DNA, 20 bp, human
ggtgtcagaacctaaataca

SEQ ID NO: 229038 - DNA, 20 bp, human
gaaagtgttgatatgctgtg

SEQ ID NO: 229039 - DNA, 20 bp, human
gcaagcctaaccttgtattt

SEQ ID NO: 229040 - DNA, 20 bp, human
gtgtaatcacaatgcagcct

SEQ ID NO: 229041 - DNA, 20 bp, human
gttctgacgctgaagagtct

SEQ ID NO: 229042 - DNA, 20 bp, human
gtagcaggttttgttccagc

SEQ ID NO: 229043 - DNA, 20 bp, human
gcttttttgttttcctggat

SEQ ID NO: 229044 - DNA, 20 bp, human
gcagaacattgtattacaac

SEQ ID NO: 229045 - DNA, 20 bp, human
gatattaagaattaactagc

SEQ ID NO: 229046 - DNA, 20 bp, human
gcaaatggtggggtcccgca

SEQ ID NO: 229047 - DNA, 20 bp, human
ggggcggtgccggtgagagg

SEQ ID NO: 229048 - DNA, 20 bp, human
gcgcgcagtcgcagtcacac

SEQ ID NO: 229049 - DNA, 20 bp, human
gtatccaaggggcgtggaaa

SEQ ID NO: 229050 - DNA, 20 bp, human
gcatttgcgcagaatcaaag

SEQ ID NO: 229051 - DNA, 20 bp, human
ggggacttcctgaagaaggg

SEQ ID NO: 229052 - DNA, 20 bp, human
gccagtatggagtatccaag

SEQ ID NO: 229053 - DNA, 20 bp, human
gggaggtgggaaagttttca

SEQ ID NO: 229054 - DNA, 20 bp, human
gtgagaggcgggtgacgcag

SEQ ID NO: 229055 - DNA, 20 bp, human
gtgaggggcgattactgaaa

SEQ ID NO: 229056 - DNA, 20 bp, human
gccgcctgagggtgaaaatg

SEQ ID NO: 229057 - DNA, 20 bp, human
ggcgggcagctgtggcccaa

SEQ ID NO: 229058 - DNA, 20 bp, human
gagggtgaaaatgtgggtga

SEQ ID NO: 229059 - DNA, 20 bp, human
gcacagggaagtctcccttg

SEQ ID NO: 229060 - DNA, 20 bp, human
gctgccaaggagaatcatga

SEQ ID NO: 229061 - DNA, 20 bp, human
ggatctgcccccgttcaaaa

SEQ ID NO: 229062 - DNA, 20 bp, human
gactccgctgttttttctca

SEQ ID NO: 229063 - DNA, 20 bp, human
gcaactacagtgtataccgg

SEQ ID NO: 229064 - DNA, 20 bp, human
gatagagaaaagtgcaaaat

SEQ ID NO: 229065 - DNA, 20 bp, human
ggagccatgagaaaaaacag

SEQ ID NO: 229066 - DNA, 20 bp, human
gaagccaatgagtgtggaca

SEQ ID NO: 229067 - DNA, 20 bp, human
gggaacctgcgagtcatctc

SEQ ID NO: 229068 - DNA, 20 bp, human
gccaccaatggcagtattaa

SEQ ID NO: 229069 - DNA, 20 bp, human
gaaggggtgattagggagaa

SEQ ID NO: 229070 - DNA, 20 bp, human
ggcagtattaaggggtgatt

SEQ ID NO: 229071 - DNA, 20 bp, human
gcaaccatgtccacactcat

SEQ ID NO: 229072 - DNA, 20 bp, human
gaatactgccattggtggta

SEQ ID NO: 229073 - DNA, 20 bp, human
gccactaaagccaatgagtg

SEQ ID NO: 229074 - DNA, 20 bp, human
gtaggggcccctaccaccaa

SEQ ID NO: 229075 - DNA, 20 bp, human
gtggcatggagccagaacat

SEQ ID NO: 229076 - DNA, 20 bp, human
gacactgagtgttctgtttt

SEQ ID NO: 229077 - DNA, 20 bp, human
gggggcgaaaagagccagaa

SEQ ID NO: 229078 - DNA, 20 bp, human
gaacggaagaaggacgccag

SEQ ID NO: 229079 - DNA, 20 bp, human
gaaagagccagaacggaaga

SEQ ID NO: 229080 - DNA, 20 bp, human
ggggctgagtgaaaactgga

SEQ ID NO: 229081 - DNA, 20 bp, human
gcgcgatatctggagagtgt

SEQ ID NO: 229082 - DNA, 20 bp, human
gaagacaaggatttaggact

SEQ ID NO: 229083 - DNA, 20 bp, human
gaagagcagccccttccttc

SEQ ID NO: 229084 - DNA, 20 bp, human
gtcagtgtcgtggcgagcgc

SEQ ID NO: 229085 - DNA, 20 bp, human
ggggtcgcgctcccggaaac

SEQ ID NO: 229086 - DNA, 20 bp, human
ggcagaagcaggtgcgcggt

SEQ ID NO: 229087 - DNA, 20 bp, human
ggggttgcgcgcgcaggtga

SEQ ID NO: 229088 - DNA, 20 bp, human
gggtgcagagcctcgcgctg

SEQ ID NO: 229089 - DNA, 20 bp, human
gtcaggcagaagcaggtgcg

SEQ ID NO: 229090 - DNA, 20 bp, human
ggggaggggccaagatctgg

SEQ ID NO: 229091 - DNA, 20 bp, human
ggcggggccggcgcgaccgg

SEQ ID NO: 229092 - DNA, 20 bp, human
gcagagcctcgcgctggggt

SEQ ID NO: 229093 - DNA, 20 bp, human
gtcagggaggggccaagatc

SEQ ID NO: 229094 - DNA, 20 bp, human
gaaaagctggatggcgggcg

SEQ ID NO: 229095 - DNA, 20 bp, human
gcgccctgattggccgggag

SEQ ID NO: 229096 - DNA, 20 bp, human
gtcccagctggctgtagcta

SEQ ID NO: 229097 - DNA, 20 bp, human
gacttccaaacagtcccagc

SEQ ID NO: 229098 - DNA, 20 bp, human
gacagccagctgggactgtt

SEQ ID NO: 229099 - DNA, 20 bp, human
ggtcaggctcttgctgtcgt

SEQ ID NO: 229100 - DNA, 20 bp, human
gtggagaatccggttggggt

SEQ ID NO: 229101 - DNA, 20 bp, human
gggggtaggagctaaatctc

SEQ ID NO: 229102 - DNA, 20 bp, human
gaaccaaaggagactctgta

SEQ ID NO: 229103 - DNA, 20 bp, human
gaggagactctgtaaggcaa

SEQ ID NO: 229104 - DNA, 20 bp, human
gtgtcgttggagaatccggt

SEQ ID NO: 229105 - DNA, 20 bp, human
gttgctgtcgttggagaatc

SEQ ID NO: 229106 - DNA, 20 bp, human
gagtctgtcggtcagaccaa

SEQ ID NO: 229107 - DNA, 20 bp, human
gagaccaagggcactcagac

SEQ ID NO: 229108 - DNA, 20 bp, human
ggccacccgccgccactggg

SEQ ID NO: 229109 - DNA, 20 bp, human
ggggccagcttctagtctgt

SEQ ID NO: 229110 - DNA, 20 bp, human
ggcaagcggcgaactccgtg

SEQ ID NO: 229111 - DNA, 20 bp, human
ggaactgatgtgccgtaggg

SEQ ID NO: 229112 - DNA, 20 bp, human
ggactggaaaggttgttgct

SEQ ID NO: 229113 - DNA, 20 bp, human
gatgtgccgtagggtggctg

SEQ ID NO: 229114 - DNA, 20 bp, human
gactcccgtacccgtctcga

SEQ ID NO: 229115 - DNA, 20 bp, human
ggacttggcgagagactcag

SEQ ID NO: 229116 - DNA, 20 bp, human
gtcccgagccgggttgacgc

SEQ ID NO: 229117 - DNA, 20 bp, human
gcaggtgccctcaataaaca

SEQ ID NO: 229118 - DNA, 20 bp, human
gccacctggctccaggaaga

SEQ ID NO: 229119 - DNA, 20 bp, human
gcagcgcggcctcccgagcc

SEQ ID NO: 229120 - DNA, 20 bp, human
gctgaaggcgcgcacccacc

SEQ ID NO: 229121 - DNA, 20 bp, human
gcgccgccgggtgagcctga

SEQ ID NO: 229122 - DNA, 20 bp, human
gcgccttcaggctcacccgg

SEQ ID NO: 229123 - DNA, 20 bp, human
ggctcacccggcggcgcaag

SEQ ID NO: 229124 - DNA, 20 bp, human
gccgcctcggcgttcgagcg

SEQ ID NO: 229125 - DNA, 20 bp, human
gcgagctcggtccctcttcc

SEQ ID NO: 229126 - DNA, 20 bp, human
gggcgcgccgcggtcccagg

SEQ ID NO: 229127 - DNA, 20 bp, human
gcctgcaccggcggttgggc

SEQ ID NO: 229128 - DNA, 20 bp, human
gacagcccgcgagggagcct

SEQ ID NO: 229129 - DNA, 20 bp, human
gccgccgcgcagccgaacag

SEQ ID NO: 229130 - DNA, 20 bp, human
gcctaggcgcgctctccgga

SEQ ID NO: 229131 - DNA, 20 bp, human
gcgggcctgcaccggcggtt

SEQ ID NO: 229132 - DNA, 20 bp, human
gcgaatgccgggcacggaga

SEQ ID NO: 229133 - DNA, 20 bp, human
ggcccgctccgtccttgccc

SEQ ID NO: 229134 - DNA, 20 bp, human
gcggagcgggcctgcaccgg

SEQ ID NO: 229135 - DNA, 20 bp, human
gtggcggcgcgagcggtgag

SEQ ID NO: 229136 - DNA, 20 bp, human
gcggggtccgactggaggca

SEQ ID NO: 229137 - DNA, 20 bp, human
ggggcaaggcggggtccgac

SEQ ID NO: 229138 - DNA, 20 bp, human
gtcaccgccctgcctccagt

SEQ ID NO: 229139 - DNA, 20 bp, human
gggggccaggggtcgcaagg

SEQ ID NO: 229140 - DNA, 20 bp, human
ggcccccaggcgccctctag

SEQ ID NO: 229141 - DNA, 20 bp, human
gggagtgcgaggcgccgggt

SEQ ID NO: 229142 - DNA, 20 bp, human
gcagggcggtgagccgagag

SEQ ID NO: 229143 - DNA, 20 bp, human
ggcgcgggtggggcaaggcg

SEQ ID NO: 229144 - DNA, 20 bp, human
gcatcgccgccgccgctaga

SEQ ID NO: 229145 - DNA, 20 bp, human
ggagctctctcatgtggact

SEQ ID NO: 229146 - DNA, 20 bp, human
gagttctggccatatggtga

SEQ ID NO: 229147 - DNA, 20 bp, human
gggagacgacaggagcaggt

SEQ ID NO: 229148 - DNA, 20 bp, human
ggataatgagctggcggaag

SEQ ID NO: 229149 - DNA, 20 bp, human
gaataggagacgacaggagc

SEQ ID NO: 229150 - DNA, 20 bp, human
ggattctaataggagacgac

SEQ ID NO: 229151 - DNA, 20 bp, human
gctcgcattaggattctaat

SEQ ID NO: 229152 - DNA, 20 bp, human
gcaacgtgatctgaattaca

SEQ ID NO: 229153 - DNA, 20 bp, human
gctactgaaaaagtaattaa

SEQ ID NO: 229154 - DNA, 20 bp, human
gtgcctatcacactgctcgg

SEQ ID NO: 229155 - DNA, 20 bp, human
gcacgttgcctgcagctctt

SEQ ID NO: 229156 - DNA, 20 bp, human
ggcttccaagatgaccacag

SEQ ID NO: 229157 - DNA, 20 bp, human
gcaatggcgaggcacaagaa

SEQ ID NO: 229158 - DNA, 20 bp, human
gaggcccagaacagatgagc

SEQ ID NO: 229159 - DNA, 20 bp, human
gaggtcctatggaaggtgag

SEQ ID NO: 229160 - DNA, 20 bp, human
gtgacccactgtggtcatct

SEQ ID NO: 229161 - DNA, 20 bp, human
gaagtcagaggtcctatgga

SEQ ID NO: 229162 - DNA, 20 bp, human
gcgtggatctaatggtgtaa

SEQ ID NO: 229163 - DNA, 20 bp, human
gaatacagaatgacccactg

SEQ ID NO: 229164 - DNA, 20 bp, human
gtctgtgacatcacagccat

SEQ ID NO: 229165 - DNA, 20 bp, human
gtggggaggagcatagggta

SEQ ID NO: 229166 - DNA, 20 bp, human
gccccgggccgtgacgtcat

SEQ ID NO: 229167 - DNA, 20 bp, human
gccggccgcgccaaccccca

SEQ ID NO: 229168 - DNA, 20 bp, human
gcgggcgcccggattttcct

SEQ ID NO: 229169 - DNA, 20 bp, human
gcaagccgcggcgcggtctc

SEQ ID NO: 229170 - DNA, 20 bp, human
ggccgcgccaacccccacgg

SEQ ID NO: 229171 - DNA, 20 bp, human
gggagcctgagaccgcgccg

SEQ ID NO: 229172 - DNA, 20 bp, human
ggcccatgacgtcacggccc

SEQ ID NO: 229173 - DNA, 20 bp, human
gaggctccggtgattggctg

SEQ ID NO: 229174 - DNA, 20 bp, human
gcccacggcggcccgcaagg

SEQ ID NO: 229175 - DNA, 20 bp, human
gtcaccgggctcgcaagccg

SEQ ID NO: 229176 - DNA, 20 bp, human
ggcggggtcccgctgctctg

SEQ ID NO: 229177 - DNA, 20 bp, human
ggctgcgagaatgcaggcgg

SEQ ID NO: 229178 - DNA, 20 bp, human
ggaagacctcgtcggccagg

SEQ ID NO: 229179 - DNA, 20 bp, human
ggtgcccggaccgtggagga

SEQ ID NO: 229180 - DNA, 20 bp, human
gccaacccgcctggccgacg

SEQ ID NO: 229181 - DNA, 20 bp, human
ggaggctgcgagaatgcagg

SEQ ID NO: 229182 - DNA, 20 bp, human
gcgggcacccgcagattccg

SEQ ID NO: 229183 - DNA, 20 bp, human
gcggcccggtcccggcaccg

SEQ ID NO: 229184 - DNA, 20 bp, human
gcggctcagtaccccggttc

SEQ ID NO: 229185 - DNA, 20 bp, human
gaagaaatggaagacctcgt

SEQ ID NO: 229186 - DNA, 20 bp, human
gccggcgcccgggacacttc

SEQ ID NO: 229187 - DNA, 20 bp, human
gccgccggctggcatccggt

SEQ ID NO: 229188 - DNA, 20 bp, human
gctggcagtggtaatgccgc

SEQ ID NO: 229189 - DNA, 20 bp, human
gcgggagccggaagtgtccc

SEQ ID NO: 229190 - DNA, 20 bp, human
gagcgccaccggcttgagga

SEQ ID NO: 229191 - DNA, 20 bp, human
ggtccgcgggcgccccatgc

SEQ ID NO: 229192 - DNA, 20 bp, human
gccgggcgccgggactgcga

SEQ ID NO: 229193 - DNA, 20 bp, human
gttcccagcgcgcagccaac

SEQ ID NO: 229194 - DNA, 20 bp, human
gaatgccgccggctggcatc

SEQ ID NO: 229195 - DNA, 20 bp, human
ggcccgcggacctccgactg

SEQ ID NO: 229196 - DNA, 20 bp, human
ggcaagcggcggcagcacgg

SEQ ID NO: 229197 - DNA, 20 bp, human
gaactctaggcctctagaga

SEQ ID NO: 229198 - DNA, 20 bp, human
gggaggctccgcactcctga

SEQ ID NO: 229199 - DNA, 20 bp, human
gggcctagagttgcttggag

SEQ ID NO: 229200 - DNA, 20 bp, human
ggccgccgcttgccattagc

SEQ ID NO: 229201 - DNA, 20 bp, human
gagaacaagtgcagatgact

SEQ ID NO: 229202 - DNA, 20 bp, human
gggggggcggttccaggacc

SEQ ID NO: 229203 - DNA, 20 bp, human
gccggccgggctggcgtccc

SEQ ID NO: 229204 - DNA, 20 bp, human
gtctgcgtccgtctctccgc

SEQ ID NO: 229205 - DNA, 20 bp, human
ggccgcttgccattagccgg

SEQ ID NO: 229206 - DNA, 20 bp, human
gagggcgagtctcgaagatc

SEQ ID NO: 229207 - DNA, 20 bp, human
ggccctctgaacgtcagctc

SEQ ID NO: 229208 - DNA, 20 bp, human
gcaccagagctgacgttcag

SEQ ID NO: 229209 - DNA, 20 bp, human
gcgcaacaccggaaaaggtc

SEQ ID NO: 229210 - DNA, 20 bp, human
gacacctagcgcccacgtga

SEQ ID NO: 229211 - DNA, 20 bp, human
ggcgcgctgggcaaattggc

SEQ ID NO: 229212 - DNA, 20 bp, human
gcatacgtcacccctcacgt

SEQ ID NO: 229213 - DNA, 20 bp, human
gtgcgcaggcgcggggacta

SEQ ID NO: 229214 - DNA, 20 bp, human
gtcgcggagcacagcgcgct

SEQ ID NO: 229215 - DNA, 20 bp, human
gcgcggcaggcgccatctaa

SEQ ID NO: 229216 - DNA, 20 bp, human
gcacgcgcccagagccgtta

SEQ ID NO: 229217 - DNA, 20 bp, human
ggagatccggggtaaagggg

SEQ ID NO: 229218 - DNA, 20 bp, human
gtcgcgagatccggggtaaa

SEQ ID NO: 229219 - DNA, 20 bp, human
ggagtggagttccaccctaa

SEQ ID NO: 229220 - DNA, 20 bp, human
ggcgcccagagccgttaggg

SEQ ID NO: 229221 - DNA, 20 bp, human
gtggcgcctcggggcggatc

SEQ ID NO: 229222 - DNA, 20 bp, human
gcgggagggaatgtaatgta

SEQ ID NO: 229223 - DNA, 20 bp, human
gggcgtcagagcttgagggg

SEQ ID NO: 229224 - DNA, 20 bp, human
ggggtggaactccactcggg

SEQ ID NO: 229225 - DNA, 20 bp, human
gtccgcccgccccgcccgag

SEQ ID NO: 229226 - DNA, 20 bp, human
ggggagcggtgggccaatca

SEQ ID NO: 229227 - DNA, 20 bp, human
gcccctcaggcttcccctat

SEQ ID NO: 229228 - DNA, 20 bp, human
gcagcgatgccacggggaac

SEQ ID NO: 229229 - DNA, 20 bp, human
ggctacgggcagttgacagg

SEQ ID NO: 229230 - DNA, 20 bp, human
gggagcactgtcagccaata

SEQ ID NO: 229231 - DNA, 20 bp, human
gtggcccaccgctccccctc

SEQ ID NO: 229232 - DNA, 20 bp, human
gatgccacggggaaccgggc

SEQ ID NO: 229233 - DNA, 20 bp, human
ggacgtggggacgtggacgc

SEQ ID NO: 229234 - DNA, 20 bp, human
ggcagcgcagcgatgccacg

SEQ ID NO: 229235 - DNA, 20 bp, human
gaagcctgagggggagcggt

SEQ ID NO: 229236 - DNA, 20 bp, human
gcgaacccggttgtttggga

SEQ ID NO: 229237 - DNA, 20 bp, human
ggtttgggaaggcgagcagc

SEQ ID NO: 229238 - DNA, 20 bp, human
gggcggagcttgcggggata

SEQ ID NO: 229239 - DNA, 20 bp, human
gcgcctgcgcacagaatccg

SEQ ID NO: 229240 - DNA, 20 bp, human
gtgcgcacagaatccgggga

SEQ ID NO: 229241 - DNA, 20 bp, human
gcggaaacggaaaaggctaa

SEQ ID NO: 229242 - DNA, 20 bp, human
ggccaatgggcagaaagcgc

SEQ ID NO: 229243 - DNA, 20 bp, human
ggaaaaggctaagggccaat

SEQ ID NO: 229244 - DNA, 20 bp, human
gaaagcgccggcggcgaacc

SEQ ID NO: 229245 - DNA, 20 bp, human
ggcggcgaacccggttgttt

SEQ ID NO: 229246 - DNA, 20 bp, human
gtcttcttcgctcagatcca

SEQ ID NO: 229247 - DNA, 20 bp, human
gggctgctgtgaaggactgc

SEQ ID NO: 229248 - DNA, 20 bp, human
gtaggtgagaacctacagtg

SEQ ID NO: 229249 - DNA, 20 bp, human
gggactgcaggacgtgatgc

SEQ ID NO: 229250 - DNA, 20 bp, human
gcacagcagcccttcaagat

SEQ ID NO: 229251 - DNA, 20 bp, human
gtagaactctccctcactgt

SEQ ID NO: 229252 - DNA, 20 bp, human
gagatggactctgtgggtct

SEQ ID NO: 229253 - DNA, 20 bp, human
gatctgagcgaagaagagcc

SEQ ID NO: 229254 - DNA, 20 bp, human
gttaaacatagtgagttggg

SEQ ID NO: 229255 - DNA, 20 bp, human
gagaccattgtgaggctgcc

SEQ ID NO: 229256 - DNA, 20 bp, human
gctgactcacgtatgcccga

SEQ ID NO: 229257 - DNA, 20 bp, human
ggcgccaagtttcttaatac

SEQ ID NO: 229258 - DNA, 20 bp, human
gtggcgctctggtcctttaa

SEQ ID NO: 229259 - DNA, 20 bp, human
gccgagggaaggcagaacac

SEQ ID NO: 229260 - DNA, 20 bp, human
ggaatggtttatttttagtc

SEQ ID NO: 229261 - DNA, 20 bp, human
gcatttgtaagtcagacaga

SEQ ID NO: 229262 - DNA, 20 bp, human
gatacccgtattaagaaact

SEQ ID NO: 229263 - DNA, 20 bp, human
gcatatctgaatctatctaa

SEQ ID NO: 229264 - DNA, 20 bp, human
gattaagaaacttggcgctc

SEQ ID NO: 229265 - DNA, 20 bp, human
gctcacgtatgcccgaggga

SEQ ID NO: 229266 - DNA, 20 bp, human
gcccggcagggcgagtttgc

SEQ ID NO: 229267 - DNA, 20 bp, human
gtgcacctcggtaggtagcg

SEQ ID NO: 229268 - DNA, 20 bp, human
gcactccccgctacctaccg

SEQ ID NO: 229269 - DNA, 20 bp, human
gctgcaggatgcacctcggt

SEQ ID NO: 229270 - DNA, 20 bp, human
ggaggggtgagggatgtcta

SEQ ID NO: 229271 - DNA, 20 bp, human
gtcaaacaggcatgagtggg

SEQ ID NO: 229272 - DNA, 20 bp, human
gcgagactggtcacttccct

SEQ ID NO: 229273 - DNA, 20 bp, human
gagtttgcaggcttgcggta

SEQ ID NO: 229274 - DNA, 20 bp, human
ggggcgagtttgcaggcttg

SEQ ID NO: 229275 - DNA, 20 bp, human
gccgggcgcggagtgcaatt

SEQ ID NO: 229276 - DNA, 20 bp, human
gtgtaagtgcagagatgcta

SEQ ID NO: 229277 - DNA, 20 bp, human
ggcgcaggatgccagggtat

SEQ ID NO: 229278 - DNA, 20 bp, human
gtgcacttacaggagaacca

SEQ ID NO: 229279 - DNA, 20 bp, human
gaggacttcagtgaaactgt

SEQ ID NO: 229280 - DNA, 20 bp, human
gctgcgccccaggcacccga

SEQ ID NO: 229281 - DNA, 20 bp, human
gcctggggcgcaggatgcca

SEQ ID NO: 229282 - DNA, 20 bp, human
gggtccctgaaatagaggca

SEQ ID NO: 229283 - DNA, 20 bp, human
gctcggggaatatttgagtg

SEQ ID NO: 229284 - DNA, 20 bp, human
ggagcagagctcctataccc

SEQ ID NO: 229285 - DNA, 20 bp, human
ggcagggtacgggaaattat

SEQ ID NO: 229286 - DNA, 20 bp, human
gacactgtaactcccattgt

SEQ ID NO: 229287 - DNA, 20 bp, human
gcatattagcatggagcaca

SEQ ID NO: 229288 - DNA, 20 bp, human
gtgattattacatattagca

SEQ ID NO: 229289 - DNA, 20 bp, human
gattctatttatcacaacta

SEQ ID NO: 229290 - DNA, 20 bp, human
gcatctttcaaacccaacaa

SEQ ID NO: 229291 - DNA, 20 bp, human
gaaagagacaatgaaaaatc

SEQ ID NO: 229292 - DNA, 20 bp, human
gtgcaaaaatgtcaagttga

SEQ ID NO: 229293 - DNA, 20 bp, human
gtctgagaattttgaataac

SEQ ID NO: 229294 - DNA, 20 bp, human
gacaaattaacttaagaaaa

SEQ ID NO: 229295 - DNA, 20 bp, human
gtggagcacacggaaaacaa

SEQ ID NO: 229296 - DNA, 20 bp, human
ggattccagggctcacatgt

SEQ ID NO: 229297 - DNA, 20 bp, human
gatcacctacatgtgagccc

SEQ ID NO: 229298 - DNA, 20 bp, human
gtaaaatttgattgacctgt

SEQ ID NO: 229299 - DNA, 20 bp, human
gggagcagaatgatattgtt

SEQ ID NO: 229300 - DNA, 20 bp, human
gtctagttgagatttgaata

SEQ ID NO: 229301 - DNA, 20 bp, human
gcagagctgcccaagaccat

SEQ ID NO: 229302 - DNA, 20 bp, human
gtgatgctgatgccagaggt

SEQ ID NO: 229303 - DNA, 20 bp, human
gtaggtgatgctgatgccag

SEQ ID NO: 229304 - DNA, 20 bp, human
gtagatacaatgggggtaca

SEQ ID NO: 229305 - DNA, 20 bp, human
ggaccatgggaacccacctc

SEQ ID NO: 229306 - DNA, 20 bp, human
ggggaagcatcttataacaa

SEQ ID NO: 229307 - DNA, 20 bp, human
gaataaacctgaccctctaa

SEQ ID NO: 229308 - DNA, 20 bp, human
gctggacaccgcaaagctct

SEQ ID NO: 229309 - DNA, 20 bp, human
gaaaatcagcagtaggatct

SEQ ID NO: 229310 - DNA, 20 bp, human
ggggtttctatcaagtagtt

SEQ ID NO: 229311 - DNA, 20 bp, human
gaggtaggtggtaatgtaaa

SEQ ID NO: 229312 - DNA, 20 bp, human
gggtcaggtttatttgctgg

SEQ ID NO: 229313 - DNA, 20 bp, human
gcccgctgacctcattgttg

SEQ ID NO: 229314 - DNA, 20 bp, human
gtatcagcctttagagggtc

SEQ ID NO: 229315 - DNA, 20 bp, human
ggatagagcagaaattgcac

SEQ ID NO: 229316 - DNA, 20 bp, human
gactggggagaaaagtatca

SEQ ID NO: 229317 - DNA, 20 bp, human
gccataagttggtattttat

SEQ ID NO: 229318 - DNA, 20 bp, human
gcatggaaatattagtacca

SEQ ID NO: 229319 - DNA, 20 bp, human
gaagaattctagccgttgcc

SEQ ID NO: 229320 - DNA, 20 bp, human
gaacattactaaagttaaat

SEQ ID NO: 229321 - DNA, 20 bp, human
gagccgttgccaggcaacaa

SEQ ID NO: 229322 - DNA, 20 bp, human
gacagctttcctgagcactg

SEQ ID NO: 229323 - DNA, 20 bp, human
gtgggtataaaatatattta

SEQ ID NO: 229324 - DNA, 20 bp, human
gacttttctccccagtgctc

SEQ ID NO: 229325 - DNA, 20 bp, human
gttaaaatttttccataagt

SEQ ID NO: 229326 - DNA, 20 bp, human
gaggccaacgcgctccgcca

SEQ ID NO: 229327 - DNA, 20 bp, human
gtccccctggcggagcgcgt

SEQ ID NO: 229328 - DNA, 20 bp, human
ggctgccccgccggttcagg

SEQ ID NO: 229329 - DNA, 20 bp, human
gtgacccggaagtcgacgag

SEQ ID NO: 229330 - DNA, 20 bp, human
ggcagcgcccaggttccccc

SEQ ID NO: 229331 - DNA, 20 bp, human
gcgctccgccagggggaacc

SEQ ID NO: 229332 - DNA, 20 bp, human
ggcctcaccgcctgaaccgg

SEQ ID NO: 229333 - DNA, 20 bp, human
gcctacctccccatgcgcgg

SEQ ID NO: 229334 - DNA, 20 bp, human
gcagctgcgaacctagggat

SEQ ID NO: 229335 - DNA, 20 bp, human
gttggcctcaccgcctgaac

SEQ ID NO: 229336 - DNA, 20 bp, human
gagaaggacccttaatgaca

SEQ ID NO: 229337 - DNA, 20 bp, human
gggtgtgctgaaataacaca

SEQ ID NO: 229338 - DNA, 20 bp, human
gcataaaggccctgtcatta

SEQ ID NO: 229339 - DNA, 20 bp, human
ggttccatggccaacccaat

SEQ ID NO: 229340 - DNA, 20 bp, human
gagaagctaatcaatgtccc

SEQ ID NO: 229341 - DNA, 20 bp, human
ggaagcattagaaaattcca

SEQ ID NO: 229342 - DNA, 20 bp, human
gtgggcagtaccacagtatc

SEQ ID NO: 229343 - DNA, 20 bp, human
gctgatgctgaaaataaatg

SEQ ID NO: 229344 - DNA, 20 bp, human
gagagctcatgcagctgtaa

SEQ ID NO: 229345 - DNA, 20 bp, human
gggcagcaatcctcagttta

SEQ ID NO: 229346 - DNA, 20 bp, human
gaaagtgttccaggcaccaa

SEQ ID NO: 229347 - DNA, 20 bp, human
gaacaatatccgtgtggtta

SEQ ID NO: 229348 - DNA, 20 bp, human
gttgaaaaacaatatccgtg

SEQ ID NO: 229349 - DNA, 20 bp, human
ggaacacttttagagtattt

SEQ ID NO: 229350 - DNA, 20 bp, human
ggtgcaaatcaatgtgtatc

SEQ ID NO: 229351 - DNA, 20 bp, human
ggtgtctcttggaacttctg

SEQ ID NO: 229352 - DNA, 20 bp, human
gactgaaacaaggctaatat

SEQ ID NO: 229353 - DNA, 20 bp, human
gaaagcactcagaaaaatgt

SEQ ID NO: 229354 - DNA, 20 bp, human
gcctcaataaacagataccc

SEQ ID NO: 229355 - DNA, 20 bp, human
gcttcctttccttaaccaca

SEQ ID NO: 229356 - DNA, 20 bp, human
gggacaggctattagtgagg

SEQ ID NO: 229357 - DNA, 20 bp, human
gggcaaggactgtgggatct

SEQ ID NO: 229358 - DNA, 20 bp, human
gtttgcaccaacctagtcag

SEQ ID NO: 229359 - DNA, 20 bp, human
gggtaagctgccaagtggac

SEQ ID NO: 229360 - DNA, 20 bp, human
gagtggacaggctattagtg

SEQ ID NO: 229361 - DNA, 20 bp, human
gggctattagtgaggtggca

SEQ ID NO: 229362 - DNA, 20 bp, human
gaaaaacttacctgtcactc

SEQ ID NO: 229363 - DNA, 20 bp, human
gatatctgagcgctgaacat

SEQ ID NO: 229364 - DNA, 20 bp, human
gtttagggtaagctgccaag

SEQ ID NO: 229365 - DNA, 20 bp, human
gtgcagagctatttgctctt

SEQ ID NO: 229366 - DNA, 20 bp, human
ggactgtcggtggaaatcag

SEQ ID NO: 229367 - DNA, 20 bp, human
gaccactgggtgatggttta

SEQ ID NO: 229368 - DNA, 20 bp, human
gaagggctaaggactgtcgg

SEQ ID NO: 229369 - DNA, 20 bp, human
gcggtggaaatcaggggtgc

SEQ ID NO: 229370 - DNA, 20 bp, human
gcgaagctaggctcacgagg

SEQ ID NO: 229371 - DNA, 20 bp, human
gcaaagtccgagttgacctc

SEQ ID NO: 229372 - DNA, 20 bp, human
gtctccatggccaacgtcac

SEQ ID NO: 229373 - DNA, 20 bp, human
gcaaggcgcaggcgcacgag

SEQ ID NO: 229374 - DNA, 20 bp, human
gcctgcgccttgggctccgg

SEQ ID NO: 229375 - DNA, 20 bp, human
gggcgcaggcgcacgagggg

SEQ ID NO: 229376 - DNA, 20 bp, human
gtggctgcagtcagcaggga

SEQ ID NO: 229377 - DNA, 20 bp, human
ggggtgactcggagtgaggt

SEQ ID NO: 229378 - DNA, 20 bp, human
gtggctggaacctgagctgt

SEQ ID NO: 229379 - DNA, 20 bp, human
ggcaggctgctgcgttcgga

SEQ ID NO: 229380 - DNA, 20 bp, human
gcgcagcagcctgccaagtt

SEQ ID NO: 229381 - DNA, 20 bp, human
gagcggttgtgatattaaag

SEQ ID NO: 229382 - DNA, 20 bp, human
gagtgcttgcttgctgcctc

SEQ ID NO: 229383 - DNA, 20 bp, human
gccgctggtgactacagaga

SEQ ID NO: 229384 - DNA, 20 bp, human
ggctgagtccaaaagagcat

SEQ ID NO: 229385 - DNA, 20 bp, human
ggcaccacgctgggcacgtg

SEQ ID NO: 229386 - DNA, 20 bp, human
gcctctgcagggtctcccat

SEQ ID NO: 229387 - DNA, 20 bp, human
gaactgggggtcaccagctc

SEQ ID NO: 229388 - DNA, 20 bp, human
ggatcccctgccaaatacaa

SEQ ID NO: 229389 - DNA, 20 bp, human
ggcctggggactgtcctctc

SEQ ID NO: 229390 - DNA, 20 bp, human
gccagatgtctcaacatacc

SEQ ID NO: 229391 - DNA, 20 bp, human
gtgtccctgactcctctcaa

SEQ ID NO: 229392 - DNA, 20 bp, human
gaacataccaggagaggttt

SEQ ID NO: 229393 - DNA, 20 bp, human
gagaggctggcccagcctat

SEQ ID NO: 229394 - DNA, 20 bp, human
ggaaaagaaatcccgccctg

SEQ ID NO: 229395 - DNA, 20 bp, human
gtctcccttgtatttggcag

SEQ ID NO: 229396 - DNA, 20 bp, human
gcagctacggcgcaagaggg

SEQ ID NO: 229397 - DNA, 20 bp, human
gcccatctcagcttcgtccc

SEQ ID NO: 229398 - DNA, 20 bp, human
gtgcgactctaggttccgcg

SEQ ID NO: 229399 - DNA, 20 bp, human
gggctggggtgggatgaagc

SEQ ID NO: 229400 - DNA, 20 bp, human
ggcctgggacgaagctgaga

SEQ ID NO: 229401 - DNA, 20 bp, human
ggtcgcaggcgcgttcttga

SEQ ID NO: 229402 - DNA, 20 bp, human
ggcgaagctgggacgcgcct

SEQ ID NO: 229403 - DNA, 20 bp, human
gagaacgcgcctgcgactct

SEQ ID NO: 229404 - DNA, 20 bp, human
gttcggggaagaggctgaag

SEQ ID NO: 229405 - DNA, 20 bp, human
ggaaggacggaattcggcgt

SEQ ID NO: 229406 - DNA, 20 bp, human
gggcgcacgcgggcggacag

SEQ ID NO: 229407 - DNA, 20 bp, human
gcggcgctgtcgctagggag

SEQ ID NO: 229408 - DNA, 20 bp, human
ggtgacggaacaaacagccc

SEQ ID NO: 229409 - DNA, 20 bp, human
gttggcctggagcaagtcga

SEQ ID NO: 229410 - DNA, 20 bp, human
gagaaggtgcgtgggtttaa

SEQ ID NO: 229411 - DNA, 20 bp, human
gcgctagggagcggctggta

SEQ ID NO: 229412 - DNA, 20 bp, human
gtgtgtcgaggggcgcacgc

SEQ ID NO: 229413 - DNA, 20 bp, human
gttaagcggcgctgtcgcta

SEQ ID NO: 229414 - DNA, 20 bp, human
gaggaaggccaactttggag

SEQ ID NO: 229415 - DNA, 20 bp, human
gggtagggcgagcagcctcg

SEQ ID NO: 229416 - DNA, 20 bp, human
gaacgcggtgggttcgtgag

SEQ ID NO: 229417 - DNA, 20 bp, human
gtcgcggcagagaacgcggt

SEQ ID NO: 229418 - DNA, 20 bp, human
gggcaacccggcgcccacga

SEQ ID NO: 229419 - DNA, 20 bp, human
gcgtatgcagggacagagtt

SEQ ID NO: 229420 - DNA, 20 bp, human
gcggcgcccacgagggctcg

SEQ ID NO: 229421 - DNA, 20 bp, human
gcatgcgcggggacgcctaa

SEQ ID NO: 229422 - DNA, 20 bp, human
gcgtgcttgtggttacaacg

SEQ ID NO: 229423 - DNA, 20 bp, human
gcggtgggttcgtgaggggc

SEQ ID NO: 229424 - DNA, 20 bp, human
gtgaggggcgggcgtatgca

SEQ ID NO: 229425 - DNA, 20 bp, human
gctctgccgcgagccctcgt

SEQ ID NO: 229426 - DNA, 20 bp, human
gttacttcctatgtggcagt

SEQ ID NO: 229427 - DNA, 20 bp, human
gcaaagataagacataaacg

SEQ ID NO: 229428 - DNA, 20 bp, human
gtgttcagtgattaggcgca

SEQ ID NO: 229429 - DNA, 20 bp, human
gtaagaaaatagctgaatac

SEQ ID NO: 229430 - DNA, 20 bp, human
gtattatcctactgccacat

SEQ ID NO: 229431 - DNA, 20 bp, human
gcaaacgacagttagaacaa

SEQ ID NO: 229432 - DNA, 20 bp, human
gaaagctgtgttcagtgatt

SEQ ID NO: 229433 - DNA, 20 bp, human
gtgacatcagagtgatctca

SEQ ID NO: 229434 - DNA, 20 bp, human
gctccaggctcaaattacac

SEQ ID NO: 229435 - DNA, 20 bp, human
gcaatcaaggataataattt

SEQ ID NO: 229436 - DNA, 20 bp, human
gaaaaggggcgaaagaaaga

SEQ ID NO: 229437 - DNA, 20 bp, human
gaggacggcaacaggaaaag

SEQ ID NO: 229438 - DNA, 20 bp, human
gcggttcagcgctagaggag

SEQ ID NO: 229439 - DNA, 20 bp, human
gagagtggggaagacgacga

SEQ ID NO: 229440 - DNA, 20 bp, human
gttcagcgctagaggagagg

SEQ ID NO: 229441 - DNA, 20 bp, human
gccaagcggttcagcgctag

SEQ ID NO: 229442 - DNA, 20 bp, human
gtaaaactacaactaccggc

SEQ ID NO: 229443 - DNA, 20 bp, human
ggaagactctaattcccaga

SEQ ID NO: 229444 - DNA, 20 bp, human
gccagtaaaactacaactac

SEQ ID NO: 229445 - DNA, 20 bp, human
gacgttcggggcaacggcta

SEQ ID NO: 229446 - DNA, 20 bp, human
gaaaaggggcgaaagaaaga

SEQ ID NO: 229447 - DNA, 20 bp, human
gaggacggcaacaggaaaag

SEQ ID NO: 229448 - DNA, 20 bp, human
gcggttcagcgctagaggag

SEQ ID NO: 229449 - DNA, 20 bp, human
gagagtggggaagacgacga

SEQ ID NO: 229450 - DNA, 20 bp, human
gttcagcgctagaggagagg

SEQ ID NO: 229451 - DNA, 20 bp, human
gccaagcggttcagcgctag

SEQ ID NO: 229452 - DNA, 20 bp, human
gtaaaactacaactaccggc

SEQ ID NO: 229453 - DNA, 20 bp, human
ggaagactctaattcccaga

SEQ ID NO: 229454 - DNA, 20 bp, human
gccagtaaaactacaactac

SEQ ID NO: 229455 - DNA, 20 bp, human
gacgttcggggcaacggcta

SEQ ID NO: 229456 - DNA, 20 bp, human
gaaggcttccaaattcactg

SEQ ID NO: 229457 - DNA, 20 bp, human
gggaggggattgaagcctcc

SEQ ID NO: 229458 - DNA, 20 bp, human
gagcctccaggctcaatcaa

SEQ ID NO: 229459 - DNA, 20 bp, human
gaaatacatcctagctggga

SEQ ID NO: 229460 - DNA, 20 bp, human
ggtgtctgccgcagtgaatt

SEQ ID NO: 229461 - DNA, 20 bp, human
gtggagaatttccaccaaaa

SEQ ID NO: 229462 - DNA, 20 bp, human
gaaaaaggaaacgtgaattt

SEQ ID NO: 229463 - DNA, 20 bp, human
gagcttggcgctaacagagt

SEQ ID NO: 229464 - DNA, 20 bp, human
gtgttagcgccaagcttggc

SEQ ID NO: 229465 - DNA, 20 bp, human
gaatatcccgttctcctgga

SEQ ID NO: 229466 - DNA, 20 bp, human
gagggccaggacgcagagga

SEQ ID NO: 229467 - DNA, 20 bp, human
gagcgcaaagcggaagagag

SEQ ID NO: 229468 - DNA, 20 bp, human
gcgcagcggggctaatggta

SEQ ID NO: 229469 - DNA, 20 bp, human
gggagcctgggagcgcaaag

SEQ ID NO: 229470 - DNA, 20 bp, human
ggggatagggaggatgtcag

SEQ ID NO: 229471 - DNA, 20 bp, human
gcaaagcggaagagagcggg

SEQ ID NO: 229472 - DNA, 20 bp, human
gggcaaaaagggaacatgga

SEQ ID NO: 229473 - DNA, 20 bp, human
ggggactaggggctattgat

SEQ ID NO: 229474 - DNA, 20 bp, human
gaggaaaagcccctaaagca

SEQ ID NO: 229475 - DNA, 20 bp, human
gggaggatgtcagggggcga

SEQ ID NO: 229476 - DNA, 20 bp, human
gcaagcagcgcaagcgcagt

SEQ ID NO: 229477 - DNA, 20 bp, human
gagcaggagtgcagaagaca

SEQ ID NO: 229478 - DNA, 20 bp, human
ggccgctcatgcgcagtgac

SEQ ID NO: 229479 - DNA, 20 bp, human
ggcgcttgcgctgcttgcgc

SEQ ID NO: 229480 - DNA, 20 bp, human
gcagggcaaaatcgccaacc

SEQ ID NO: 229481 - DNA, 20 bp, human
gtgcgctgcttgcgccgggt

SEQ ID NO: 229482 - DNA, 20 bp, human
ggaaaaggcgggacgccgca

SEQ ID NO: 229483 - DNA, 20 bp, human
gctaaagtcgagtagtcaac

SEQ ID NO: 229484 - DNA, 20 bp, human
gcccgcgttgccaagacagc

SEQ ID NO: 229485 - DNA, 20 bp, human
gttcccaggggtcagacagg

SEQ ID NO: 229486 - DNA, 20 bp, human
ggggcaagacgagggatgag

SEQ ID NO: 229487 - DNA, 20 bp, human
gaaggggcggggcaagacga

SEQ ID NO: 229488 - DNA, 20 bp, human
gtaggggagcggcgagagga

SEQ ID NO: 229489 - DNA, 20 bp, human
gagcgagacgaggaagggag

SEQ ID NO: 229490 - DNA, 20 bp, human
gagagaggaagagcgagacg

SEQ ID NO: 229491 - DNA, 20 bp, human
ggatgagaggaacgaggcga

SEQ ID NO: 229492 - DNA, 20 bp, human
gagaagggggcgaggagaaa

SEQ ID NO: 229493 - DNA, 20 bp, human
gccccgctgggagtgtctgg

SEQ ID NO: 229494 - DNA, 20 bp, human
gacgagggatgagaggaacg

SEQ ID NO: 229495 - DNA, 20 bp, human
gagcgcgtcccgacccagct

SEQ ID NO: 229496 - DNA, 20 bp, human
ggggtgggaactcactctat

SEQ ID NO: 229497 - DNA, 20 bp, human
ggagccaagtctaaggagca

SEQ ID NO: 229498 - DNA, 20 bp, human
gaagccccacccatagagcg

SEQ ID NO: 229499 - DNA, 20 bp, human
gcgaacggagccccgtccat

SEQ ID NO: 229500 - DNA, 20 bp, human
gcgtctaggaagttccgggg

SEQ ID NO: 229501 - DNA, 20 bp, human
gcggagctacggctcgtgag

SEQ ID NO: 229502 - DNA, 20 bp, human
ggaacctcgctctatgggtg

SEQ ID NO: 229503 - DNA, 20 bp, human
ggcccatagagccaagtcta

SEQ ID NO: 229504 - DNA, 20 bp, human
gtgggcgggactacgccagg

SEQ ID NO: 229505 - DNA, 20 bp, human
gcgggactacgccaggtggg

SEQ ID NO: 229506 - DNA, 20 bp, human
ggcccagcgcatcgcaggag

SEQ ID NO: 229507 - DNA, 20 bp, human
gaccaggcccagcgcatcgc

SEQ ID NO: 229508 - DNA, 20 bp, human
ggtcacgaatggcttctccc

SEQ ID NO: 229509 - DNA, 20 bp, human
gagaacaggttatgagggag

SEQ ID NO: 229510 - DNA, 20 bp, human
gtccacggaaaggactgccc

SEQ ID NO: 229511 - DNA, 20 bp, human
gtcaggaagtgagcattctg

SEQ ID NO: 229512 - DNA, 20 bp, human
gggggaggccagaccctaat

SEQ ID NO: 229513 - DNA, 20 bp, human
ggaaggagaacaggttatga

SEQ ID NO: 229514 - DNA, 20 bp, human
gcactggccagtagcatcca

SEQ ID NO: 229515 - DNA, 20 bp, human
gaccctaataggaggagtca

SEQ ID NO: 229516 - DNA, 20 bp, human
gctggggttcggtcagttag

SEQ ID NO: 229517 - DNA, 20 bp, human
gtgaccgaaccccaggacgg

SEQ ID NO: 229518 - DNA, 20 bp, human
ggggcccgccggaaaaggcg

SEQ ID NO: 229519 - DNA, 20 bp, human
gaagtcaaaacctccgtcct

SEQ ID NO: 229520 - DNA, 20 bp, human
gcgctgctggttgggagtag

SEQ ID NO: 229521 - DNA, 20 bp, human
gaagcggggcccgccggaaa

SEQ ID NO: 229522 - DNA, 20 bp, human
gtcccagcgtgccgcgctct

SEQ ID NO: 229523 - DNA, 20 bp, human
gaaacctccgtcctggggtt

SEQ ID NO: 229524 - DNA, 20 bp, human
gggacgtggccgctgctggt

SEQ ID NO: 229525 - DNA, 20 bp, human
gaactgaccgaaccccagga

SEQ ID NO: 229526 - DNA, 20 bp, human
ggacgcggggcggaccggaa

SEQ ID NO: 229527 - DNA, 20 bp, human
gcggccgcgcccacaaggaa

SEQ ID NO: 229528 - DNA, 20 bp, human
gggaccggaaggggcgtcac

SEQ ID NO: 229529 - DNA, 20 bp, human
gcccgacgcatggacccgag

SEQ ID NO: 229530 - DNA, 20 bp, human
gaggaacgggaggacgcgca

SEQ ID NO: 229531 - DNA, 20 bp, human
gcgcgcccacaaggaacggg

SEQ ID NO: 229532 - DNA, 20 bp, human
ggcgtcctcccgttccttgt

SEQ ID NO: 229533 - DNA, 20 bp, human
ggcctctcgggtccatgcgt

SEQ ID NO: 229534 - DNA, 20 bp, human
gccccgaggcccgagggaga

SEQ ID NO: 229535 - DNA, 20 bp, human
gcgggggcgggaagagacgc

SEQ ID NO: 229536 - DNA, 20 bp, human
ggggagccctcacacaggag

SEQ ID NO: 229537 - DNA, 20 bp, human
gaaggaagcagagactccag

SEQ ID NO: 229538 - DNA, 20 bp, human
ggatgtgaagtcaggggtat

SEQ ID NO: 229539 - DNA, 20 bp, human
gggaccacagctactagcag

SEQ ID NO: 229540 - DNA, 20 bp, human
gtgggctagacattaaccac

SEQ ID NO: 229541 - DNA, 20 bp, human
gcacatcagaggatacagaa

SEQ ID NO: 229542 - DNA, 20 bp, human
gcagagtgtgatgtgaagtc

SEQ ID NO: 229543 - DNA, 20 bp, human
gtagcctctgctagtagctg

SEQ ID NO: 229544 - DNA, 20 bp, human
ggaaagacaggagctattct

SEQ ID NO: 229545 - DNA, 20 bp, human
gacagctgggtccagagcag

SEQ ID NO: 229546 - DNA, 20 bp, human
gcactgcttctgtggtttcg

SEQ ID NO: 229547 - DNA, 20 bp, human
ggggttacagattgttgctg

SEQ ID NO: 229548 - DNA, 20 bp, human
gtagtctcttagtgatcaat

SEQ ID NO: 229549 - DNA, 20 bp, human
gtcaaagcaacaagaagcta

SEQ ID NO: 229550 - DNA, 20 bp, human
gttagtgacacttctgtaat

SEQ ID NO: 229551 - DNA, 20 bp, human
gtggaggtataaactgagaa

SEQ ID NO: 229552 - DNA, 20 bp, human
gggataaatgtctttaggaa

SEQ ID NO: 229553 - DNA, 20 bp, human
gcacctctgggtcaggaaat

SEQ ID NO: 229554 - DNA, 20 bp, human
gtggtgtatacaaagcttat

SEQ ID NO: 229555 - DNA, 20 bp, human
gaaagataaacatgaaatcc

SEQ ID NO: 229556 - DNA, 20 bp, human
gacaagtagatatggggcaa

SEQ ID NO: 229557 - DNA, 20 bp, human
gaatgctaaagtccctaaga

SEQ ID NO: 229558 - DNA, 20 bp, human
gagcactgctgcccatctta

SEQ ID NO: 229559 - DNA, 20 bp, human
gcatattgacaagtagatat

SEQ ID NO: 229560 - DNA, 20 bp, human
gtggttggacttcagtaccc

SEQ ID NO: 229561 - DNA, 20 bp, human
gtgcaaactaagaactgctg

SEQ ID NO: 229562 - DNA, 20 bp, human
gtagggactttagcattcac

SEQ ID NO: 229563 - DNA, 20 bp, human
gcttgtcaatatgagaaagc

SEQ ID NO: 229564 - DNA, 20 bp, human
gcagcagtgctgtgtgaaaa

SEQ ID NO: 229565 - DNA, 20 bp, human
gtgtgtgaaaatggaaacaa

SEQ ID NO: 229566 - DNA, 20 bp, human
gctgcccagagcaacccccg

SEQ ID NO: 229567 - DNA, 20 bp, human
gcgggagcaggcagccgccg

SEQ ID NO: 229568 - DNA, 20 bp, human
gtgcggtccccgcccgaaag

SEQ ID NO: 229569 - DNA, 20 bp, human
ggagctgtgctcagtcttgg

SEQ ID NO: 229570 - DNA, 20 bp, human
gagggcggtccgcagctcgg

SEQ ID NO: 229571 - DNA, 20 bp, human
gttccccatggcagccccgg

SEQ ID NO: 229572 - DNA, 20 bp, human
gagacaagctagactgaggg

SEQ ID NO: 229573 - DNA, 20 bp, human
ggagagccggctgcagggct

SEQ ID NO: 229574 - DNA, 20 bp, human
gcaacccccggggctgccat

SEQ ID NO: 229575 - DNA, 20 bp, human
gccccagaaccgaacagaag

SEQ ID NO: 229576 - DNA, 20 bp, human
gcggaagaggcgagtctcat

SEQ ID NO: 229577 - DNA, 20 bp, human
gacgcgggctggagtaggtt

SEQ ID NO: 229578 - DNA, 20 bp, human
gacgggctgcaggggtacgc

SEQ ID NO: 229579 - DNA, 20 bp, human
gggagagccaatatcgccca

SEQ ID NO: 229580 - DNA, 20 bp, human
gtactgtgctgaattttgga

SEQ ID NO: 229581 - DNA, 20 bp, human
gcgtggcctgggcgcccgac

SEQ ID NO: 229582 - DNA, 20 bp, human
gtcggagcccccctctgagt

SEQ ID NO: 229583 - DNA, 20 bp, human
ggctgcaggggtacgcgggc

SEQ ID NO: 229584 - DNA, 20 bp, human
gcgattggacagcttaatgg

SEQ ID NO: 229585 - DNA, 20 bp, human
gccaatatcgcccaggggcg

SEQ ID NO: 229586 - DNA, 20 bp, human
gcgtgggccgggttcctctg

SEQ ID NO: 229587 - DNA, 20 bp, human
gctgccgggcgactccccaa

SEQ ID NO: 229588 - DNA, 20 bp, human
ggactccccaagggccggga

SEQ ID NO: 229589 - DNA, 20 bp, human
gcacccgcgccgagtattcg

SEQ ID NO: 229590 - DNA, 20 bp, human
gcggatggcgacggaagggg

SEQ ID NO: 229591 - DNA, 20 bp, human
ggcccagcgggcttccccaa

SEQ ID NO: 229592 - DNA, 20 bp, human
ggggtggcccggtccccccg

SEQ ID NO: 229593 - DNA, 20 bp, human
gacgcggaggggacccgtta

SEQ ID NO: 229594 - DNA, 20 bp, human
ggcggccgaggatgtcgcca

SEQ ID NO: 229595 - DNA, 20 bp, human
gctgccccgaatactcggcg

SEQ ID NO: 229596 - DNA, 20 bp, human
gggtaccaggtcccactcca

SEQ ID NO: 229597 - DNA, 20 bp, human
ggctcccagggcaacttttt

SEQ ID NO: 229598 - DNA, 20 bp, human
ggggaaagttcatgtgggtc

SEQ ID NO: 229599 - DNA, 20 bp, human
ggagtgaggctgggcttaaa

SEQ ID NO: 229600 - DNA, 20 bp, human
gtggtcccgtacatagcaac

SEQ ID NO: 229601 - DNA, 20 bp, human
ggaaaggatggcgatttcca

SEQ ID NO: 229602 - DNA, 20 bp, human
ggaagcccaaaaagttgccc

SEQ ID NO: 229603 - DNA, 20 bp, human
gccatggggaaagttcatgt

SEQ ID NO: 229604 - DNA, 20 bp, human
ggtacatagcaacaggccga

SEQ ID NO: 229605 - DNA, 20 bp, human
gagaggccaggtggttgcta

SEQ ID NO: 229606 - DNA, 20 bp, human
gcgggcagaaccggcggtaa

SEQ ID NO: 229607 - DNA, 20 bp, human
gggagccacgcgctctggtg

SEQ ID NO: 229608 - DNA, 20 bp, human
gccgggggagccacgcgctc

SEQ ID NO: 229609 - DNA, 20 bp, human
ggcagtgcgggcagaaccgg

SEQ ID NO: 229610 - DNA, 20 bp, human
gaacgggctgggggccacga

SEQ ID NO: 229611 - DNA, 20 bp, human
ggaaccggcggtaagggcgt

SEQ ID NO: 229612 - DNA, 20 bp, human
gagcgcagtgcgggcagaac

SEQ ID NO: 229613 - DNA, 20 bp, human
ggtgggacgccgaaagcgaa

SEQ ID NO: 229614 - DNA, 20 bp, human
gaagaggaagccgccgacga

SEQ ID NO: 229615 - DNA, 20 bp, human
gggagaggcgagcccggccg

SEQ ID NO: 229616 - DNA, 20 bp, human
gctgaactgggcaatcaaaa

SEQ ID NO: 229617 - DNA, 20 bp, human
gggagaaggctgttaagccc

SEQ ID NO: 229618 - DNA, 20 bp, human
ggcttcacacagtgaaatgt

SEQ ID NO: 229619 - DNA, 20 bp, human
gcagttcagaattatgcttc

SEQ ID NO: 229620 - DNA, 20 bp, human
gaattatgcttcaggcattg

SEQ ID NO: 229621 - DNA, 20 bp, human
gctcagggtaaactgccaga

SEQ ID NO: 229622 - DNA, 20 bp, human
gtgatgcaatgatgacctca

SEQ ID NO: 229623 - DNA, 20 bp, human
gggcattgtggttaagtaca

SEQ ID NO: 229624 - DNA, 20 bp, human
gagcatgaattgcctgatag

SEQ ID NO: 229625 - DNA, 20 bp, human
gtaagcccaggcctctgtgg

SEQ ID NO: 229626 - DNA, 20 bp, human
ggggctacacaggtgatgaa

SEQ ID NO: 229627 - DNA, 20 bp, human
gctacacaggtgatgaaggg

SEQ ID NO: 229628 - DNA, 20 bp, human
gggtagcgaccgggctacac

SEQ ID NO: 229629 - DNA, 20 bp, human
gaggcgaaactgcggatccc

SEQ ID NO: 229630 - DNA, 20 bp, human
gacaacgtctaggaaacgtt

SEQ ID NO: 229631 - DNA, 20 bp, human
ggggagtggtaggtcagtta

SEQ ID NO: 229632 - DNA, 20 bp, human
ggctaccctcactgcattct

SEQ ID NO: 229633 - DNA, 20 bp, human
ggggtggacaggcgaaactg

SEQ ID NO: 229634 - DNA, 20 bp, human
gatgcagtgagggtagcgac

SEQ ID NO: 229635 - DNA, 20 bp, human
ggccccgccccaggttgctt

SEQ ID NO: 229636 - DNA, 20 bp, human
ggcaacgtggttgggtgaag

SEQ ID NO: 229637 - DNA, 20 bp, human
gctgatggggcctcccactg

SEQ ID NO: 229638 - DNA, 20 bp, human
gctccaggccctggcttaga

SEQ ID NO: 229639 - DNA, 20 bp, human
gccctggcttagagggagcg

SEQ ID NO: 229640 - DNA, 20 bp, human
gagcggggagtctggacttc

SEQ ID NO: 229641 - DNA, 20 bp, human
gctgctgcaggctggaggaa

SEQ ID NO: 229642 - DNA, 20 bp, human
ggggctcagggtgaccccgc

SEQ ID NO: 229643 - DNA, 20 bp, human
gcccgctccaggaagaggaa

SEQ ID NO: 229644 - DNA, 20 bp, human
ggcagagtggcaacgtggtt

SEQ ID NO: 229645 - DNA, 20 bp, human
ggcctggctggcacccaacg

SEQ ID NO: 229646 - DNA, 20 bp, human
ggggaggggcggggctgtgc

SEQ ID NO: 229647 - DNA, 20 bp, human
gtgtgtggaggcggggttag

SEQ ID NO: 229648 - DNA, 20 bp, human
gactggcctgcacccggctc

SEQ ID NO: 229649 - DNA, 20 bp, human
gagggggcgaggttcgagtg

SEQ ID NO: 229650 - DNA, 20 bp, human
gggcttagggagcttgcgcg

SEQ ID NO: 229651 - DNA, 20 bp, human
gccgccccgcgcactaaact

SEQ ID NO: 229652 - DNA, 20 bp, human
gtgcgcggaagaacgacttc

SEQ ID NO: 229653 - DNA, 20 bp, human
gagctccctaagcccgcgac

SEQ ID NO: 229654 - DNA, 20 bp, human
gggggcggggttatgagggt

SEQ ID NO: 229655 - DNA, 20 bp, human
ggttaggggcggggttatga

SEQ ID NO: 229656 - DNA, 20 bp, human
ggtgacaagcggggattaat

SEQ ID NO: 229657 - DNA, 20 bp, human
ggaaagaaggggcagcgaag

SEQ ID NO: 229658 - DNA, 20 bp, human
gccgcggggcacacatccag

SEQ ID NO: 229659 - DNA, 20 bp, human
ggggtctgagtggagatctt

SEQ ID NO: 229660 - DNA, 20 bp, human
ggaagtgacgggcaaaagga

SEQ ID NO: 229661 - DNA, 20 bp, human
gtcccagctctgccaggaaa

SEQ ID NO: 229662 - DNA, 20 bp, human
ggaaaggggagacttcaccg

SEQ ID NO: 229663 - DNA, 20 bp, human
gcaacccctccatccggatc

SEQ ID NO: 229664 - DNA, 20 bp, human
gcagccctaaagtcagccat

SEQ ID NO: 229665 - DNA, 20 bp, human
ggggagacagtggcagtaag

SEQ ID NO: 229666 - DNA, 20 bp, human
gtatcttgctgcttggtggg

SEQ ID NO: 229667 - DNA, 20 bp, human
gaattatcttgctgcttggt

SEQ ID NO: 229668 - DNA, 20 bp, human
ggactgtccattgtgacatg

SEQ ID NO: 229669 - DNA, 20 bp, human
gtgacatgtggacattctca

SEQ ID NO: 229670 - DNA, 20 bp, human
gttctgcctcagcttgtggc

SEQ ID NO: 229671 - DNA, 20 bp, human
gggggaattatcttgctgct

SEQ ID NO: 229672 - DNA, 20 bp, human
gggcgtggtggcgtgcgccc

SEQ ID NO: 229673 - DNA, 20 bp, human
ggaatgtccacatgtcacaa

SEQ ID NO: 229674 - DNA, 20 bp, human
gaattgagagagataataga

SEQ ID NO: 229675 - DNA, 20 bp, human
gattatactcacgccagcct

SEQ ID NO: 229676 - DNA, 20 bp, human
gaggggcacacgcccgggat

SEQ ID NO: 229677 - DNA, 20 bp, human
ggggcttcgaaccctatccc

SEQ ID NO: 229678 - DNA, 20 bp, human
gtgcgcgcgcacattctcct

SEQ ID NO: 229679 - DNA, 20 bp, human
gcgcgcgcagggtggcgttg

SEQ ID NO: 229680 - DNA, 20 bp, human
gagaatgtgcgcgcgcaggg

SEQ ID NO: 229681 - DNA, 20 bp, human
ggatagggttcgaagcccca

SEQ ID NO: 229682 - DNA, 20 bp, human
gaggccactgcgcatgcgtc

SEQ ID NO: 229683 - DNA, 20 bp, human
gaagctttgagttctccatg

SEQ ID NO: 229684 - DNA, 20 bp, human
gcccgggcgtgtgcccctcc

SEQ ID NO: 229685 - DNA, 20 bp, human
gcgagattggggtcccggag

SEQ ID NO: 229686 - DNA, 20 bp, human
ggggcggagttcgactgtga

SEQ ID NO: 229687 - DNA, 20 bp, human
ggaggcgggagtccggtggt

SEQ ID NO: 229688 - DNA, 20 bp, human
gaggggccgaagcagcagat

SEQ ID NO: 229689 - DNA, 20 bp, human
gcccaggagtagggaggtcc

SEQ ID NO: 229690 - DNA, 20 bp, human
ggctgggcggggccaccacg

SEQ ID NO: 229691 - DNA, 20 bp, human
gcggagttcgactgtgaggg

SEQ ID NO: 229692 - DNA, 20 bp, human
ggggccggaagggtagaacg

SEQ ID NO: 229693 - DNA, 20 bp, human
ggcggggccagaacagcggc

SEQ ID NO: 229694 - DNA, 20 bp, human
gagcggcgggggcggagttc

SEQ ID NO: 229695 - DNA, 20 bp, human
gcgggggcggagttccggct

SEQ ID NO: 229696 - DNA, 20 bp, human
ggggcgggaacgacaggatg

SEQ ID NO: 229697 - DNA, 20 bp, human
gacgacgggcggggctaagg

SEQ ID NO: 229698 - DNA, 20 bp, human
gccaaaggggcgggaacgac

SEQ ID NO: 229699 - DNA, 20 bp, human
gaggcgaggaacgacggaag

SEQ ID NO: 229700 - DNA, 20 bp, human
gagaatgaggcgaggaacga

SEQ ID NO: 229701 - DNA, 20 bp, human
gggaactacaggataaggcg

SEQ ID NO: 229702 - DNA, 20 bp, human
gaggcgtggaagacgggcgg

SEQ ID NO: 229703 - DNA, 20 bp, human
ggccccgcccctcggctcgt

SEQ ID NO: 229704 - DNA, 20 bp, human
ggcggggccaagcggtgagg

SEQ ID NO: 229705 - DNA, 20 bp, human
gcaaggggagcgggaactac

SEQ ID NO: 229706 - DNA, 20 bp, human
ggccatgccccggatgtgag

SEQ ID NO: 229707 - DNA, 20 bp, human
ggccccgcccctcccaagga

SEQ ID NO: 229708 - DNA, 20 bp, human
ggccacccacctgaggacga

SEQ ID NO: 229709 - DNA, 20 bp, human
gactcagcccctcacatccg

SEQ ID NO: 229710 - DNA, 20 bp, human
gatgtgaggggctgagtcac

SEQ ID NO: 229711 - DNA, 20 bp, human
gccagccctcgtcctcaggt

SEQ ID NO: 229712 - DNA, 20 bp, human
gtgaggtcacggctctggaa

SEQ ID NO: 229713 - DNA, 20 bp, human
ggggttcccaagatcccaag

SEQ ID NO: 229714 - DNA, 20 bp, human
ggcatggcctgggccctaaa

SEQ ID NO: 229715 - DNA, 20 bp, human
gatggggcggggctcagaga

SEQ ID NO: 229716 - DNA, 20 bp, human
ggccgcggggccgggaaaca

SEQ ID NO: 229717 - DNA, 20 bp, human
gagggccgggattgtattaa

SEQ ID NO: 229718 - DNA, 20 bp, human
gcgggattgtattaacggga

SEQ ID NO: 229719 - DNA, 20 bp, human
gcctgcagccaggcgggaac

SEQ ID NO: 229720 - DNA, 20 bp, human
gaggaggtggagtctgccac

SEQ ID NO: 229721 - DNA, 20 bp, human
gaggagggcccgggggactc

SEQ ID NO: 229722 - DNA, 20 bp, human
gcaatcccggccctgtttcc

SEQ ID NO: 229723 - DNA, 20 bp, human
gctaaaaccccacctaaagg

SEQ ID NO: 229724 - DNA, 20 bp, human
gcccgggggactcaggtctg

SEQ ID NO: 229725 - DNA, 20 bp, human
gtcctggcagcactggaagg

SEQ ID NO: 229726 - DNA, 20 bp, human
ggggccccgcgttgcagact

SEQ ID NO: 229727 - DNA, 20 bp, human
gccctggaggacgaatgcaa

SEQ ID NO: 229728 - DNA, 20 bp, human
ggagccccgcgggatcctca

SEQ ID NO: 229729 - DNA, 20 bp, human
gacgccaacagagcccggct

SEQ ID NO: 229730 - DNA, 20 bp, human
gggcccgtctccttggcgac

SEQ ID NO: 229731 - DNA, 20 bp, human
ggacgccctgaggatcccgc

SEQ ID NO: 229732 - DNA, 20 bp, human
gaagccgagccgggctctgt

SEQ ID NO: 229733 - DNA, 20 bp, human
gacgggacgccaacagagcc

SEQ ID NO: 229734 - DNA, 20 bp, human
gcgtcccgtcgccaaggaga

SEQ ID NO: 229735 - DNA, 20 bp, human
gccgcaccaccgggatcctg

SEQ ID NO: 229736 - DNA, 20 bp, human
gccactgtgcgcgatcggag

SEQ ID NO: 229737 - DNA, 20 bp, human
ggctcgcggctcgatggctt

SEQ ID NO: 229738 - DNA, 20 bp, human
ggcccccagagagcataccc

SEQ ID NO: 229739 - DNA, 20 bp, human
gaggcctggaagctgcccgc

SEQ ID NO: 229740 - DNA, 20 bp, human
ggccttccactgtgcgcgat

SEQ ID NO: 229741 - DNA, 20 bp, human
gtctgaccccaagtatcttt

SEQ ID NO: 229742 - DNA, 20 bp, human
ggaccccaagtatctttggg

SEQ ID NO: 229743 - DNA, 20 bp, human
gttttctggcctggggctcg

SEQ ID NO: 229744 - DNA, 20 bp, human
gtcaaccacccaaagatact

SEQ ID NO: 229745 - DNA, 20 bp, human
ggcagtgggcgctgtgacgg

SEQ ID NO: 229746 - DNA, 20 bp, human
gaggggcccaccaggggtcg

SEQ ID NO: 229747 - DNA, 20 bp, human
gcacagctgggcatctccta

SEQ ID NO: 229748 - DNA, 20 bp, human
gccgggccccgacccctggt

SEQ ID NO: 229749 - DNA, 20 bp, human
ggagctccgtggtgccgttg

SEQ ID NO: 229750 - DNA, 20 bp, human
gacagaggggcctaccagtg

SEQ ID NO: 229751 - DNA, 20 bp, human
gaggactgaggcctcagcag

SEQ ID NO: 229752 - DNA, 20 bp, human
gtcaggagtcccagcaacag

SEQ ID NO: 229753 - DNA, 20 bp, human
gggtaggcccctctgttgct

SEQ ID NO: 229754 - DNA, 20 bp, human
ggctgggccaggagtcaccg

SEQ ID NO: 229755 - DNA, 20 bp, human
gccgctgatcatctagttag

SEQ ID NO: 229756 - DNA, 20 bp, human
ggctgagacagggttgtcac

SEQ ID NO: 229757 - DNA, 20 bp, human
gggtccacgcacccgcatcg

SEQ ID NO: 229758 - DNA, 20 bp, human
gcaaagaggggtaaaatcaa

SEQ ID NO: 229759 - DNA, 20 bp, human
ggaagggctgaaggtggatg

SEQ ID NO: 229760 - DNA, 20 bp, human
gcaggctgatggctgaccct

SEQ ID NO: 229761 - DNA, 20 bp, human
gggaagggggcggggttctg

SEQ ID NO: 229762 - DNA, 20 bp, human
ggcagctccccacctctcca

SEQ ID NO: 229763 - DNA, 20 bp, human
ggccctgcgaaccttacagt

SEQ ID NO: 229764 - DNA, 20 bp, human
gagccggggctcttaactgc

SEQ ID NO: 229765 - DNA, 20 bp, human
gggagcagagcgcgaagtga

SEQ ID NO: 229766 - DNA, 20 bp, human
ggtagatgctcatggctaga

SEQ ID NO: 229767 - DNA, 20 bp, human
gggagcacttaggtcttatt

SEQ ID NO: 229768 - DNA, 20 bp, human
gaggatggtggtcaacttgc

SEQ ID NO: 229769 - DNA, 20 bp, human
gagcagttgcaggagcactt

SEQ ID NO: 229770 - DNA, 20 bp, human
gccgcttgggggattattta

SEQ ID NO: 229771 - DNA, 20 bp, human
gtgaaagaaagctgcattat

SEQ ID NO: 229772 - DNA, 20 bp, human
ggaggcccatgccatccagt

SEQ ID NO: 229773 - DNA, 20 bp, human
gtgtgctttccttttttgcc

SEQ ID NO: 229774 - DNA, 20 bp, human
gcaactgatgtcacaaatta

SEQ ID NO: 229775 - DNA, 20 bp, human
gcccaagcggtagatgctca

SEQ ID NO: 229776 - DNA, 20 bp, human
gcaggcgcaggcgcagacgt

SEQ ID NO: 229777 - DNA, 20 bp, human
gtgcgcccgcgcctgcgcgt

SEQ ID NO: 229778 - DNA, 20 bp, human
gcggtcgagctccaacgcgc

SEQ ID NO: 229779 - DNA, 20 bp, human
ggggcggggcgatggcgcgc

SEQ ID NO: 229780 - DNA, 20 bp, human
gcggggcgatggcgcgcggg

SEQ ID NO: 229781 - DNA, 20 bp, human
gccgctgctcacctcggcat

SEQ ID NO: 229782 - DNA, 20 bp, human
gaggcgcagacgtaggcgat

SEQ ID NO: 229783 - DNA, 20 bp, human
ggcgcctgcgcactggaacc

SEQ ID NO: 229784 - DNA, 20 bp, human
ggaacgcgcgcccgcggggt

SEQ ID NO: 229785 - DNA, 20 bp, human
gctcacctcggcatcggcgg

SEQ ID NO: 229786 - DNA, 20 bp, human
gtgcgcgcgcgcactctgtc

SEQ ID NO: 229787 - DNA, 20 bp, human
gaccggaagtgcgcgctcgg

SEQ ID NO: 229788 - DNA, 20 bp, human
gcgcgcacttccggtcgcga

SEQ ID NO: 229789 - DNA, 20 bp, human
gcggagccgctggttggtgg

SEQ ID NO: 229790 - DNA, 20 bp, human
ggaagtgcgcgctcgggggt

SEQ ID NO: 229791 - DNA, 20 bp, human
gcgctcgggggtaggcggga

SEQ ID NO: 229792 - DNA, 20 bp, human
gtgcgcgctcgggggtaggc

SEQ ID NO: 229793 - DNA, 20 bp, human
gtcccgagcgccctcgcgac

SEQ ID NO: 229794 - DNA, 20 bp, human
ggcgaccggaagtgcgcgct

SEQ ID NO: 229795 - DNA, 20 bp, human
gcctctgcgggccgcttgat

SEQ ID NO: 229796 - DNA, 20 bp, human
ggggctccgccaggtcttca

SEQ ID NO: 229797 - DNA, 20 bp, human
gaggcggaggaggagctcgt

SEQ ID NO: 229798 - DNA, 20 bp, human
gggtacgcggagggcccgtg

SEQ ID NO: 229799 - DNA, 20 bp, human
gcggaggaggagctcgtagg

SEQ ID NO: 229800 - DNA, 20 bp, human
ggaggagctcgtaggtgggg

SEQ ID NO: 229801 - DNA, 20 bp, human
gcgtgtgccttggtacgcgg

SEQ ID NO: 229802 - DNA, 20 bp, human
gcacgcatgcgcattggttc

SEQ ID NO: 229803 - DNA, 20 bp, human
gaaggcacacgcatgcgcat

SEQ ID NO: 229804 - DNA, 20 bp, human
gtacctgtgcgcggccgcgt

SEQ ID NO: 229805 - DNA, 20 bp, human
gcaaatgagcgcagaccgca

SEQ ID NO: 229806 - DNA, 20 bp, human
ggggcaccatgggaaacgga

SEQ ID NO: 229807 - DNA, 20 bp, human
gcgcagcgcgtgggagacga

SEQ ID NO: 229808 - DNA, 20 bp, human
ggggcgtgcggggtgcggta

SEQ ID NO: 229809 - DNA, 20 bp, human
gagcctgcctcgggtcctaa

SEQ ID NO: 229810 - DNA, 20 bp, human
gcgcgtgggagacgaaggcg

SEQ ID NO: 229811 - DNA, 20 bp, human
gcggcggggcggatcccttt

SEQ ID NO: 229812 - DNA, 20 bp, human
ggaaggcgtggctgactcgg

SEQ ID NO: 229813 - DNA, 20 bp, human
gacctggggaggggcgtgcg

SEQ ID NO: 229814 - DNA, 20 bp, human
gcagagaaatggacctgggg

SEQ ID NO: 229815 - DNA, 20 bp, human
gccgcgccgtcacccagcag

SEQ ID NO: 229816 - DNA, 20 bp, human
gaagggggtcgcatgggggt

SEQ ID NO: 229817 - DNA, 20 bp, human
gagcagcgcccctcctagac

SEQ ID NO: 229818 - DNA, 20 bp, human
ggcaaatccgcgtgaggaag

SEQ ID NO: 229819 - DNA, 20 bp, human
gggggtcggctgagatctgc

SEQ ID NO: 229820 - DNA, 20 bp, human
ggaggaagggggtcgcatgg

SEQ ID NO: 229821 - DNA, 20 bp, human
ggaggggcgctgctctgtgc

SEQ ID NO: 229822 - DNA, 20 bp, human
gcggcccaggaatgcacggt

SEQ ID NO: 229823 - DNA, 20 bp, human
gcgctgctctgtgccggagt

SEQ ID NO: 229824 - DNA, 20 bp, human
gtgctggctgccggtctagg

SEQ ID NO: 229825 - DNA, 20 bp, human
ggaaacaactgtagaagctt

SEQ ID NO: 229826 - DNA, 20 bp, human
gaaggcagagggaagttaat

SEQ ID NO: 229827 - DNA, 20 bp, human
gtaagcttggccagcgtgcc

SEQ ID NO: 229828 - DNA, 20 bp, human
ggcaagctcggtacagtgcc

SEQ ID NO: 229829 - DNA, 20 bp, human
gcaagagtagccaactttgg

SEQ ID NO: 229830 - DNA, 20 bp, human
gtcacagcaacccccaaagt

SEQ ID NO: 229831 - DNA, 20 bp, human
gagtcttagaacagcaagct

SEQ ID NO: 229832 - DNA, 20 bp, human
gggcatcaccgcatcaccgc

SEQ ID NO: 229833 - DNA, 20 bp, human
gaaacctggaaccagcttga

SEQ ID NO: 229834 - DNA, 20 bp, human
ggtgctgcctcagagacccc

SEQ ID NO: 229835 - DNA, 20 bp, human
gaactttgaaatactaagaa

SEQ ID NO: 229836 - DNA, 20 bp, human
gcagaaatagattgccttgt

SEQ ID NO: 229837 - DNA, 20 bp, human
gtagttaaactaactaaatt

SEQ ID NO: 229838 - DNA, 20 bp, human
gtaatataataaggctaagt

SEQ ID NO: 229839 - DNA, 20 bp, human
gaatagatagtatgcccaca

SEQ ID NO: 229840 - DNA, 20 bp, human
ggacactcactgggtttgat

SEQ ID NO: 229841 - DNA, 20 bp, human
gtaaactgtttggaatctag

SEQ ID NO: 229842 - DNA, 20 bp, human
ggatgggaacatagtcaaag

SEQ ID NO: 229843 - DNA, 20 bp, human
gttgataatgtggttacatt

SEQ ID NO: 229844 - DNA, 20 bp, human
gacccaacatattgataatg

SEQ ID NO: 229845 - DNA, 20 bp, human
gaccacattatcaatatgtt

SEQ ID NO: 229846 - DNA, 20 bp, human
gcccggtggggtctctgcct

SEQ ID NO: 229847 - DNA, 20 bp, human
gtgcatggggacaaaaccca

SEQ ID NO: 229848 - DNA, 20 bp, human
gccagcagggacaaccccgg

SEQ ID NO: 229849 - DNA, 20 bp, human
gaggtcccactgagcctcat

SEQ ID NO: 229850 - DNA, 20 bp, human
gaggaggggaatgtgtcatt

SEQ ID NO: 229851 - DNA, 20 bp, human
gtcctgagcccccactgcat

SEQ ID NO: 229852 - DNA, 20 bp, human
gagggacaaccccggaggag

SEQ ID NO: 229853 - DNA, 20 bp, human
gtctggtgatcgagcccggt

SEQ ID NO: 229854 - DNA, 20 bp, human
gcaccaggtgctccacgttt

SEQ ID NO: 229855 - DNA, 20 bp, human
ggaagctcccccatctcccc

SEQ ID NO: 229856 - DNA, 20 bp, human
ggctccgcttccggttccaa

SEQ ID NO: 229857 - DNA, 20 bp, human
gaggccaaggagcccggatg

SEQ ID NO: 229858 - DNA, 20 bp, human
gagtcccacctgtccgaagc

SEQ ID NO: 229859 - DNA, 20 bp, human
gcctgagagcgcgcccgaga

SEQ ID NO: 229860 - DNA, 20 bp, human
gtgccgaaggcgtcttgctc

SEQ ID NO: 229861 - DNA, 20 bp, human
ggtgagttgcccaccctggg

SEQ ID NO: 229862 - DNA, 20 bp, human
gcaaagccatgcacctccca

SEQ ID NO: 229863 - DNA, 20 bp, human
gcgcccgagagggcgtgaac

SEQ ID NO: 229864 - DNA, 20 bp, human
gagggtgggcaactcacggc

SEQ ID NO: 229865 - DNA, 20 bp, human
gccgcccatgtcgcagtctg

SEQ ID NO: 229866 - DNA, 20 bp, human
gaggaattggatggtgagtt

SEQ ID NO: 229867 - DNA, 20 bp, human
gaacaaatcggacagccctg

SEQ ID NO: 229868 - DNA, 20 bp, human
gggcgataaggtcttctaga

SEQ ID NO: 229869 - DNA, 20 bp, human
gccagcaaaaagctaaggac

SEQ ID NO: 229870 - DNA, 20 bp, human
gcacaaagatgaacctacgg

SEQ ID NO: 229871 - DNA, 20 bp, human
gagacagtctagctttctca

SEQ ID NO: 229872 - DNA, 20 bp, human
gaaaactgctgacaagtaat

SEQ ID NO: 229873 - DNA, 20 bp, human
ggaaaggtggattccaccgt

SEQ ID NO: 229874 - DNA, 20 bp, human
ggtccaaaggagccatgaag

SEQ ID NO: 229875 - DNA, 20 bp, human
ggaactccagcaaaaagcta

SEQ ID NO: 229876 - DNA, 20 bp, human
gcggaggcgcggcccaggaa

SEQ ID NO: 229877 - DNA, 20 bp, human
gcctgcgcactgcctctcca

SEQ ID NO: 229878 - DNA, 20 bp, human
gtcgcagacacctcagtccg

SEQ ID NO: 229879 - DNA, 20 bp, human
ggcccaggaacggcaagcgc

SEQ ID NO: 229880 - DNA, 20 bp, human
gcacgcgctaccgcatcccg

SEQ ID NO: 229881 - DNA, 20 bp, human
gcggcaccgagggcgttcgg

SEQ ID NO: 229882 - DNA, 20 bp, human
ggctaccgcatcccgtggag

SEQ ID NO: 229883 - DNA, 20 bp, human
gcgcacgcacgcacgccctc

SEQ ID NO: 229884 - DNA, 20 bp, human
gttcgggggagggaacgcta

SEQ ID NO: 229885 - DNA, 20 bp, human
gtggtcctggccccggactg

SEQ ID NO: 229886 - DNA, 20 bp, human
gtactgtgagagcaagtagt

SEQ ID NO: 229887 - DNA, 20 bp, human
ggagtcgcgcgctaggggcc

SEQ ID NO: 229888 - DNA, 20 bp, human
ggtgtcccgctaggaaagag

SEQ ID NO: 229889 - DNA, 20 bp, human
gctctcacagtactcgctga

SEQ ID NO: 229890 - DNA, 20 bp, human
gactcaggagtcgcgcgcta

SEQ ID NO: 229891 - DNA, 20 bp, human
gaggctagcgaaatggggcg

SEQ ID NO: 229892 - DNA, 20 bp, human
gcaagcgtcatcttttacgt

SEQ ID NO: 229893 - DNA, 20 bp, human
ggagttccagagcttgctac

SEQ ID NO: 229894 - DNA, 20 bp, human
ggcccggttgcttctctttt

SEQ ID NO: 229895 - DNA, 20 bp, human
gtttcctagcgggacaccgt

SEQ ID NO: 229896 - DNA, 20 bp, human
gaggcgacgcgcagggttgt

SEQ ID NO: 229897 - DNA, 20 bp, human
gaggctgacgccaggagagg

SEQ ID NO: 229898 - DNA, 20 bp, human
gggcgcgcttgactgacagg

SEQ ID NO: 229899 - DNA, 20 bp, human
ggtcaagcgcgccccctctg

SEQ ID NO: 229900 - DNA, 20 bp, human
gcccctctgaggcgacgcgc

SEQ ID NO: 229901 - DNA, 20 bp, human
gtcttccgattggacggcag

SEQ ID NO: 229902 - DNA, 20 bp, human
gtcagcctcttccgattgga

SEQ ID NO: 229903 - DNA, 20 bp, human
gggcgtcagcctcttccgat

SEQ ID NO: 229904 - DNA, 20 bp, human
gccacagaagcagccggtgg

SEQ ID NO: 229905 - DNA, 20 bp, human
gcttgactgacaggcggcgg

SEQ ID NO: 229906 - DNA, 20 bp, human
gaacactgggcggagtgtga

SEQ ID NO: 229907 - DNA, 20 bp, human
gtagggaggtaaggattgtg

SEQ ID NO: 229908 - DNA, 20 bp, human
ggggcagcgccgaggtcctc

SEQ ID NO: 229909 - DNA, 20 bp, human
gcgcgagtgggcacagccta

SEQ ID NO: 229910 - DNA, 20 bp, human
gactccgcccagtgttatga

SEQ ID NO: 229911 - DNA, 20 bp, human
gggcacagcctagggaggta

SEQ ID NO: 229912 - DNA, 20 bp, human
gactgggcggagtgtgacgg

SEQ ID NO: 229913 - DNA, 20 bp, human
gtaaggattgtggggattcg

SEQ ID NO: 229914 - DNA, 20 bp, human
ggaaccctcataacactggg

SEQ ID NO: 229915 - DNA, 20 bp, human
ggcacagagtgcaggctcag

SEQ ID NO: 229916 - DNA, 20 bp, human
gggcgcagcctcgacccctc

SEQ ID NO: 229917 - DNA, 20 bp, human
gaaagtgggacttgttctcc

SEQ ID NO: 229918 - DNA, 20 bp, human
ggaaagaggctgcgcggagc

SEQ ID NO: 229919 - DNA, 20 bp, human
ggcagcctctttctcaaacc

SEQ ID NO: 229920 - DNA, 20 bp, human
gcctcccagaagagtcacgt

SEQ ID NO: 229921 - DNA, 20 bp, human
gctgccgggcggcctctgat

SEQ ID NO: 229922 - DNA, 20 bp, human
gtcagcccacgtgactcttc

SEQ ID NO: 229923 - DNA, 20 bp, human
ggtagtccatcaaatcaaag

SEQ ID NO: 229924 - DNA, 20 bp, human
gagaggccgcccggcagggt

SEQ ID NO: 229925 - DNA, 20 bp, human
gccgggcggcctctgattgg

SEQ ID NO: 229926 - DNA, 20 bp, human
ggcggagtttagagccctgg

SEQ ID NO: 229927 - DNA, 20 bp, human
gggcgggactcgagtgagag

SEQ ID NO: 229928 - DNA, 20 bp, human
ggggactcgagtgagagggg

SEQ ID NO: 229929 - DNA, 20 bp, human
ggcctatcccaggacggcaa

SEQ ID NO: 229930 - DNA, 20 bp, human
gcctcgcagcggcctatccc

SEQ ID NO: 229931 - DNA, 20 bp, human
gccccttgccgtcctgggat

SEQ ID NO: 229932 - DNA, 20 bp, human
gagggggcggggctcgtcaa

SEQ ID NO: 229933 - DNA, 20 bp, human
ggggcggggcctaacggtag

SEQ ID NO: 229934 - DNA, 20 bp, human
gggctccaggatcctcgcag

SEQ ID NO: 229935 - DNA, 20 bp, human
ggcccgctacggctccccca

SEQ ID NO: 229936 - DNA, 20 bp, human
gcggccgggacccgcagctg

SEQ ID NO: 229937 - DNA, 20 bp, human
gatacggtgcggggcgatag

SEQ ID NO: 229938 - DNA, 20 bp, human
ggcacccgacgtcgcagtgg

SEQ ID NO: 229939 - DNA, 20 bp, human
ggagatgccccagtacgggg

SEQ ID NO: 229940 - DNA, 20 bp, human
gcgcgacgggcaggggtgtc

SEQ ID NO: 229941 - DNA, 20 bp, human
ggccgccgccagcgtcgcga

SEQ ID NO: 229942 - DNA, 20 bp, human
gcgtactggggcatctcggg

SEQ ID NO: 229943 - DNA, 20 bp, human
ggggcatctcgggggggata

SEQ ID NO: 229944 - DNA, 20 bp, human
gcctagcgacgcggttacta

SEQ ID NO: 229945 - DNA, 20 bp, human
gctgcccgtcgcgacgctgg

SEQ ID NO: 229946 - DNA, 20 bp, human
ggcacggcatcttggggcac

SEQ ID NO: 229947 - DNA, 20 bp, human
gtccgcgcggaggctccttc

SEQ ID NO: 229948 - DNA, 20 bp, human
gaagatgccgtgcacgtggt

SEQ ID NO: 229949 - DNA, 20 bp, human
ggccggaaggagcctccgcg

SEQ ID NO: 229950 - DNA, 20 bp, human
gtaagccgctcctttacagt

SEQ ID NO: 229951 - DNA, 20 bp, human
gaaggagcggcttactccag

SEQ ID NO: 229952 - DNA, 20 bp, human
ggcggagccgaccacgtgca

SEQ ID NO: 229953 - DNA, 20 bp, human
ggcgctcggctgatgaaacg

SEQ ID NO: 229954 - DNA, 20 bp, human
gccccaagatgccgtgcacg

SEQ ID NO: 229955 - DNA, 20 bp, human
gcgccgtctccccactgtaa

SEQ ID NO: 229956 - DNA, 20 bp, human
gggtcactgggtgtccccat

SEQ ID NO: 229957 - DNA, 20 bp, human
gggggacacccagtgacctc

SEQ ID NO: 229958 - DNA, 20 bp, human
gttggcttaagtcaccctat

SEQ ID NO: 229959 - DNA, 20 bp, human
gcctgccccctgaatagtct

SEQ ID NO: 229960 - DNA, 20 bp, human
gtccagagggagggtgttgg

SEQ ID NO: 229961 - DNA, 20 bp, human
gtcacttctcaataagccag

SEQ ID NO: 229962 - DNA, 20 bp, human
gttaatcccagactattcag

SEQ ID NO: 229963 - DNA, 20 bp, human
gttactccctggtaaatcag

SEQ ID NO: 229964 - DNA, 20 bp, human
gtcaggggagaaggaacctg

SEQ ID NO: 229965 - DNA, 20 bp, human
gagctctgggctgggacata

SEQ ID NO: 229966 - DNA, 20 bp, human
gtcgggaggctgtatcacaa

SEQ ID NO: 229967 - DNA, 20 bp, human
ggattggggtctctggtctc

SEQ ID NO: 229968 - DNA, 20 bp, human
gtctacgcttggttggtgcc

SEQ ID NO: 229969 - DNA, 20 bp, human
gaggctcgccctgcatgcca

SEQ ID NO: 229970 - DNA, 20 bp, human
ggcacggagtcctggcacgg

SEQ ID NO: 229971 - DNA, 20 bp, human
gaaagccgcccacacaagca

SEQ ID NO: 229972 - DNA, 20 bp, human
gttggcacggagtcctggca

SEQ ID NO: 229973 - DNA, 20 bp, human
gctaaattatggaattaaga

SEQ ID NO: 229974 - DNA, 20 bp, human
gcggctttggcacggagtcc

SEQ ID NO: 229975 - DNA, 20 bp, human
gtgggacatcagatgcaact

SEQ ID NO: 229976 - DNA, 20 bp, human
ggcggggcctccagcgtgag

SEQ ID NO: 229977 - DNA, 20 bp, human
gccgccgcgcgcaggccctg

SEQ ID NO: 229978 - DNA, 20 bp, human
gggccggcctcgctccgcgt

SEQ ID NO: 229979 - DNA, 20 bp, human
gcgccccggtgcgtcttaaa

SEQ ID NO: 229980 - DNA, 20 bp, human
gtggcttcgagcggatgggt

SEQ ID NO: 229981 - DNA, 20 bp, human
gggcgtggcttcgagcggat

SEQ ID NO: 229982 - DNA, 20 bp, human
gttcgagcggatgggtcggg

SEQ ID NO: 229983 - DNA, 20 bp, human
gcggcgggcgtggcttcgag

SEQ ID NO: 229984 - DNA, 20 bp, human
ggcctccagcgtgagaggcg

SEQ ID NO: 229985 - DNA, 20 bp, human
gggaacgcgtcccttttaag

SEQ ID NO: 229986 - DNA, 20 bp, human
gtacccactctaatcaccac

SEQ ID NO: 229987 - DNA, 20 bp, human
gtagccaaggcctccatact

SEQ ID NO: 229988 - DNA, 20 bp, human
ggattagagtgggtacatag

SEQ ID NO: 229989 - DNA, 20 bp, human
gtatgtacagcaaaaagggt

SEQ ID NO: 229990 - DNA, 20 bp, human
gtgacctagtatggaggcct

SEQ ID NO: 229991 - DNA, 20 bp, human
ggtgctgtcttgacctagta

SEQ ID NO: 229992 - DNA, 20 bp, human
gagcttatgtacagcaaaaa

SEQ ID NO: 229993 - DNA, 20 bp, human
gctgtcttgacctagtatgg

SEQ ID NO: 229994 - DNA, 20 bp, human
gtgagtggcctgaatagtag

SEQ ID NO: 229995 - DNA, 20 bp, human
gtggccaacgccaaacaaat

SEQ ID NO: 229996 - DNA, 20 bp, human
ggggctgcggagctgacgct

SEQ ID NO: 229997 - DNA, 20 bp, human
ggggaagcgtagggatccgt

SEQ ID NO: 229998 - DNA, 20 bp, human
gctgacgctgggacgcccgg

SEQ ID NO: 229999 - DNA, 20 bp, human
gtgcctccgcccccgggtgc

SEQ ID NO: 230000 - DNA, 20 bp, human
gtccagggcgccgaggggaa

SEQ ID NO: 230001 - DNA, 20 bp, human
gcccaggcaggactcatcct

SEQ ID NO: 230002 - DNA, 20 bp, human
gggttccggcagtgcgtcca

SEQ ID NO: 230003 - DNA, 20 bp, human
ggaaaggggtaaagggtggg

SEQ ID NO: 230004 - DNA, 20 bp, human
ggggcatgagagggacgaaa

SEQ ID NO: 230005 - DNA, 20 bp, human
gtcgacagcggcgctagttg

SEQ ID NO: 230006 - DNA, 20 bp, human
gggggtggccgggacacctg

SEQ ID NO: 230007 - DNA, 20 bp, human
gctccgcagcaaggggaagg

SEQ ID NO: 230008 - DNA, 20 bp, human
gggagcaggtgatctcatag

SEQ ID NO: 230009 - DNA, 20 bp, human
gtggaggccgacactgaggg

SEQ ID NO: 230010 - DNA, 20 bp, human
gtggggtgggatgtgcgaaa

SEQ ID NO: 230011 - DNA, 20 bp, human
gcaccacgggagaggagaga

SEQ ID NO: 230012 - DNA, 20 bp, human
gagactgaaacagggagaag

SEQ ID NO: 230013 - DNA, 20 bp, human
ggggcgcttaaggtggagct

SEQ ID NO: 230014 - DNA, 20 bp, human
gcggcaaacactcctcgggt

SEQ ID NO: 230015 - DNA, 20 bp, human
gaagctggaggccgacactg

SEQ ID NO: 230016 - DNA, 20 bp, human
gatccagaagggtgcgtcta

SEQ ID NO: 230017 - DNA, 20 bp, human
gggctggcgccccagatcct

SEQ ID NO: 230018 - DNA, 20 bp, human
gacgcctgccagcagctcct

SEQ ID NO: 230019 - DNA, 20 bp, human
gaccaagggcatgccactga

SEQ ID NO: 230020 - DNA, 20 bp, human
gcgcctgtctcacatccaga

SEQ ID NO: 230021 - DNA, 20 bp, human
gtctgggccagggctgaccc

SEQ ID NO: 230022 - DNA, 20 bp, human
gatccctagacgcacccttc

SEQ ID NO: 230023 - DNA, 20 bp, human
gacaactcacctaggatctg

SEQ ID NO: 230024 - DNA, 20 bp, human
gcgtctagggattccttcag

SEQ ID NO: 230025 - DNA, 20 bp, human
gacccttctggatgtgagac

SEQ ID NO: 230026 - DNA, 20 bp, human
gtgggaggtggggatcccgg

SEQ ID NO: 230027 - DNA, 20 bp, human
gcccggtggaggcgtaaaag

SEQ ID NO: 230028 - DNA, 20 bp, human
ggaaggcaggagatcccccc

SEQ ID NO: 230029 - DNA, 20 bp, human
gcggcagaggcgtgcgggga

SEQ ID NO: 230030 - DNA, 20 bp, human
gcccgcctgcgtcctccaga

SEQ ID NO: 230031 - DNA, 20 bp, human
gggagagagaaaggtttccg

SEQ ID NO: 230032 - DNA, 20 bp, human
gagaccgtgaacccggtccg

SEQ ID NO: 230033 - DNA, 20 bp, human
ggaggtggggatcccggtgg

SEQ ID NO: 230034 - DNA, 20 bp, human
ggcgccgctggctgactcct

SEQ ID NO: 230035 - DNA, 20 bp, human
ggcgtaaaagaggtcggtga

SEQ ID NO: 230036 - DNA, 20 bp, human
gaactggtgtatgtggggac

SEQ ID NO: 230037 - DNA, 20 bp, human
gaaagtcgctggccagctag

SEQ ID NO: 230038 - DNA, 20 bp, human
ggaggcagttgtaaagtcgc

SEQ ID NO: 230039 - DNA, 20 bp, human
gggagcgcggcaagtttcac

SEQ ID NO: 230040 - DNA, 20 bp, human
ggtgttcagtagggtatcat

SEQ ID NO: 230041 - DNA, 20 bp, human
gtgtgggcttccaggggatt

SEQ ID NO: 230042 - DNA, 20 bp, human
gcagctccctgggtggtatg

SEQ ID NO: 230043 - DNA, 20 bp, human
gggggattcggtgttcagta

SEQ ID NO: 230044 - DNA, 20 bp, human
gcagtctccactccactagc

SEQ ID NO: 230045 - DNA, 20 bp, human
ggctctgaactggtgtatgt

SEQ ID NO: 230046 - DNA, 20 bp, human
gccgggcgggcgagtctccg

SEQ ID NO: 230047 - DNA, 20 bp, human
gggacctaggcgacaagggg

SEQ ID NO: 230048 - DNA, 20 bp, human
gggcggggaaaacgccctct

SEQ ID NO: 230049 - DNA, 20 bp, human
ggacaccggggccctgccgt

SEQ ID NO: 230050 - DNA, 20 bp, human
gcgacaaggggaggtggtga

SEQ ID NO: 230051 - DNA, 20 bp, human
gggcagggccccggtgtcct

SEQ ID NO: 230052 - DNA, 20 bp, human
gaactccccgcgctcggggc

SEQ ID NO: 230053 - DNA, 20 bp, human
gccggggtctccagcgcgaa

SEQ ID NO: 230054 - DNA, 20 bp, human
ggggccctgccgtgggccga

SEQ ID NO: 230055 - DNA, 20 bp, human
gcgggcgagtctccgggggc

SEQ ID NO: 230056 - DNA, 20 bp, human
gcccaagaatgcatggagga

SEQ ID NO: 230057 - DNA, 20 bp, human
gacagctgtcgaggtgacgg

SEQ ID NO: 230058 - DNA, 20 bp, human
ggccaggagccacgactccc

SEQ ID NO: 230059 - DNA, 20 bp, human
gaagagcgggacagctgtcg

SEQ ID NO: 230060 - DNA, 20 bp, human
ggggacagctgtcgaggtga

SEQ ID NO: 230061 - DNA, 20 bp, human
gtcccgggagagcgcaggga

SEQ ID NO: 230062 - DNA, 20 bp, human
gggggggctaaactagattg

SEQ ID NO: 230063 - DNA, 20 bp, human
gtcccgctcttggaattcat

SEQ ID NO: 230064 - DNA, 20 bp, human
ggggagctacataaaagcgc

SEQ ID NO: 230065 - DNA, 20 bp, human
gacgactcccgggagagcgc

SEQ ID NO: 230066 - DNA, 20 bp, human
gagtggagaggacgcggagt

SEQ ID NO: 230067 - DNA, 20 bp, human
gctcccgcgtccagctgtcg

SEQ ID NO: 230068 - DNA, 20 bp, human
gagccccgacagctggacgc

SEQ ID NO: 230069 - DNA, 20 bp, human
ggggaccaggagtaggatgg

SEQ ID NO: 230070 - DNA, 20 bp, human
gaccaggagtaggatggggg

SEQ ID NO: 230071 - DNA, 20 bp, human
gcacagggcaagaggtggcc

SEQ ID NO: 230072 - DNA, 20 bp, human
gtgaaatcctccgctctccc

SEQ ID NO: 230073 - DNA, 20 bp, human
ggagcggaggatttcagatg

SEQ ID NO: 230074 - DNA, 20 bp, human
ggggggaccggggagagcgg

SEQ ID NO: 230075 - DNA, 20 bp, human
ggccttgcgcacagggcaag

SEQ ID NO: 230076 - DNA, 20 bp, human
gcctgtggacccaccctgtt

SEQ ID NO: 230077 - DNA, 20 bp, human
gctagaaaaactgtacggtg

SEQ ID NO: 230078 - DNA, 20 bp, human
gatgcctttcccaacagggt

SEQ ID NO: 230079 - DNA, 20 bp, human
gtgctggggacaggccactc

SEQ ID NO: 230080 - DNA, 20 bp, human
gctgctgggtagacaggcca

SEQ ID NO: 230081 - DNA, 20 bp, human
gcagaggccactaatccctg

SEQ ID NO: 230082 - DNA, 20 bp, human
ggtgggtccacagggattag

SEQ ID NO: 230083 - DNA, 20 bp, human
gaacccatgcctttcccaac

SEQ ID NO: 230084 - DNA, 20 bp, human
gcaaccccatgaaagaaaca

SEQ ID NO: 230085 - DNA, 20 bp, human
gcaggggattacgcgggagg

SEQ ID NO: 230086 - DNA, 20 bp, human
gaggcgtggcccaggctaga

SEQ ID NO: 230087 - DNA, 20 bp, human
gcgcagaggcggggctagga

SEQ ID NO: 230088 - DNA, 20 bp, human
gaataagtacggacgtagtg

SEQ ID NO: 230089 - DNA, 20 bp, human
ggggcgtggctgtagctaaa

SEQ ID NO: 230090 - DNA, 20 bp, human
ggtgaccggggcaataagta

SEQ ID NO: 230091 - DNA, 20 bp, human
gctggtatgtggggcgtaac

SEQ ID NO: 230092 - DNA, 20 bp, human
ggagactggcacagtttggt

SEQ ID NO: 230093 - DNA, 20 bp, human
gccagggccacgcccctcaa

SEQ ID NO: 230094 - DNA, 20 bp, human
ggggctcagaggcgtggccc

SEQ ID NO: 230095 - DNA, 20 bp, human
gggctgtagctaaaggggtg

SEQ ID NO: 230096 - DNA, 20 bp, human
gggagccagaagtgctgtta

SEQ ID NO: 230097 - DNA, 20 bp, human
gtcatatccggtcagtccat

SEQ ID NO: 230098 - DNA, 20 bp, human
gacgtgggaggagatcaggc

SEQ ID NO: 230099 - DNA, 20 bp, human
gccggatatgaaattgacgt

SEQ ID NO: 230100 - DNA, 20 bp, human
gaggagatcaggcaggtgct

SEQ ID NO: 230101 - DNA, 20 bp, human
gtaaaccagtggttgatcct

SEQ ID NO: 230102 - DNA, 20 bp, human
gccacacagtgcagccattg

SEQ ID NO: 230103 - DNA, 20 bp, human
gtggctccgtgcattgcgcc

SEQ ID NO: 230104 - DNA, 20 bp, human
ggggccttttcccatttccg

SEQ ID NO: 230105 - DNA, 20 bp, human
gggcagccacatgtctgcag

SEQ ID NO: 230106 - DNA, 20 bp, human
ggaaccccgagcggagattc

SEQ ID NO: 230107 - DNA, 20 bp, human
gagtccgcacgggttgctgg

SEQ ID NO: 230108 - DNA, 20 bp, human
gagggatagtcgcccagcca

SEQ ID NO: 230109 - DNA, 20 bp, human
gtagtcgcccagccagggca

SEQ ID NO: 230110 - DNA, 20 bp, human
gccgagcggagattcagggc

SEQ ID NO: 230111 - DNA, 20 bp, human
ggggacgccatgtgcggcac

SEQ ID NO: 230112 - DNA, 20 bp, human
gtctccgctcggggttcaac

SEQ ID NO: 230113 - DNA, 20 bp, human
gctggggcaagcctagggaa

SEQ ID NO: 230114 - DNA, 20 bp, human
gtagtgtcccagagtccgca

SEQ ID NO: 230115 - DNA, 20 bp, human
gagccctatctgacagagga

SEQ ID NO: 230116 - DNA, 20 bp, human
gccaacggccagagagagaa

SEQ ID NO: 230117 - DNA, 20 bp, human
gagggagcggctgtggcctg

SEQ ID NO: 230118 - DNA, 20 bp, human
gtaccagacacgccccggtc

SEQ ID NO: 230119 - DNA, 20 bp, human
gaggggtcccgagtgacctt

SEQ ID NO: 230120 - DNA, 20 bp, human
ggcttctggaaggaaggctc

SEQ ID NO: 230121 - DNA, 20 bp, human
gtccggacgcgcttcccacg

SEQ ID NO: 230122 - DNA, 20 bp, human
gtcggctcccctggccccaa

SEQ ID NO: 230123 - DNA, 20 bp, human
gagtacggatgaaaatgaat

SEQ ID NO: 230124 - DNA, 20 bp, human
gcgaggcgcattctaactgt

SEQ ID NO: 230125 - DNA, 20 bp, human
gtacccgaccggggcgtgtc

SEQ ID NO: 230126 - DNA, 20 bp, human
gggaaacgagagctgggtgg

SEQ ID NO: 230127 - DNA, 20 bp, human
ggcaccacctggcactatgc

SEQ ID NO: 230128 - DNA, 20 bp, human
gagcaggccagggttagctg

SEQ ID NO: 230129 - DNA, 20 bp, human
gtccacccccatcctagctt

SEQ ID NO: 230130 - DNA, 20 bp, human
gcataccaaagctaggatgg

SEQ ID NO: 230131 - DNA, 20 bp, human
ggggttccaagctgagtcca

SEQ ID NO: 230132 - DNA, 20 bp, human
ggatggagccaaagtctcac

SEQ ID NO: 230133 - DNA, 20 bp, human
gaggctggctggcaagcagc

SEQ ID NO: 230134 - DNA, 20 bp, human
ggggaggagcaagcctggag

SEQ ID NO: 230135 - DNA, 20 bp, human
gaggctgctaggggagcccg

SEQ ID NO: 230136 - DNA, 20 bp, human
gccggccgtggcacagaacg

SEQ ID NO: 230137 - DNA, 20 bp, human
gcttccccctccggtcgcgg

SEQ ID NO: 230138 - DNA, 20 bp, human
ggaacgtggtgaagcgttat

SEQ ID NO: 230139 - DNA, 20 bp, human
gcgacctccgcgaccggagg

SEQ ID NO: 230140 - DNA, 20 bp, human
gtggtgaagcgttatgggcc

SEQ ID NO: 230141 - DNA, 20 bp, human
gggggaagcgcaactggtta

SEQ ID NO: 230142 - DNA, 20 bp, human
ggtcgatttgagtgtgtagc

SEQ ID NO: 230143 - DNA, 20 bp, human
ggaagcgttatgggccgggg

SEQ ID NO: 230144 - DNA, 20 bp, human
gggccgcaggagtcgggctt

SEQ ID NO: 230145 - DNA, 20 bp, human
gcgactcctgcggccgtggg

SEQ ID NO: 230146 - DNA, 20 bp, human
gcgctcaggcggaggagaaa

SEQ ID NO: 230147 - DNA, 20 bp, human
gcgggcctcgcgcctacttg

SEQ ID NO: 230148 - DNA, 20 bp, human
gcggaggaagaggaactgcg

SEQ ID NO: 230149 - DNA, 20 bp, human
ggactcagggcgccgcaagt

SEQ ID NO: 230150 - DNA, 20 bp, human
ggagtccgccggccgctcgg

SEQ ID NO: 230151 - DNA, 20 bp, human
ggcaacgcccccttccgcct

SEQ ID NO: 230152 - DNA, 20 bp, human
gtgcggcgccctgagtccgc

SEQ ID NO: 230153 - DNA, 20 bp, human
gcgcgaggcccgagcgggag

SEQ ID NO: 230154 - DNA, 20 bp, human
ggggcgcccgaggcggaagg

SEQ ID NO: 230155 - DNA, 20 bp, human
gccgcccgacgtcgcgtcct

SEQ ID NO: 230156 - DNA, 20 bp, human
gtaagtgcgccgagtctctg

SEQ ID NO: 230157 - DNA, 20 bp, human
gtctgaggcgtgaaccagtg

SEQ ID NO: 230158 - DNA, 20 bp, human
gaggcagggcgggactgttg

SEQ ID NO: 230159 - DNA, 20 bp, human
ggggagtgcgaccaatcaat

SEQ ID NO: 230160 - DNA, 20 bp, human
gcagccaggagcccattgat

SEQ ID NO: 230161 - DNA, 20 bp, human
ggattggtcgcactccccac

SEQ ID NO: 230162 - DNA, 20 bp, human
gcctgcctctaccggggatg

SEQ ID NO: 230163 - DNA, 20 bp, human
gactcctcccatgtagtgat

SEQ ID NO: 230164 - DNA, 20 bp, human
ggtaacctccgccggggacc

SEQ ID NO: 230165 - DNA, 20 bp, human
gctagcagtcaatcgggagg

SEQ ID NO: 230166 - DNA, 20 bp, human
gtaaaagggagctgtgactg

SEQ ID NO: 230167 - DNA, 20 bp, human
gaagaatgcgtgtaaagctg

SEQ ID NO: 230168 - DNA, 20 bp, human
ggacgttacaggactgagga

SEQ ID NO: 230169 - DNA, 20 bp, human
gcaggagctagcatattagc

SEQ ID NO: 230170 - DNA, 20 bp, human
gttgtgacgttacaggactg

SEQ ID NO: 230171 - DNA, 20 bp, human
gcgcattcttgtgacgttac

SEQ ID NO: 230172 - DNA, 20 bp, human
gcttatacttgttcatgcat

SEQ ID NO: 230173 - DNA, 20 bp, human
gttttgtcaactgattaaac

SEQ ID NO: 230174 - DNA, 20 bp, human
ggctccactttcttatggtt

SEQ ID NO: 230175 - DNA, 20 bp, human
gtacggtatattttgaaact

SEQ ID NO: 230176 - DNA, 20 bp, human
ggggagcacgccttgttgtc

SEQ ID NO: 230177 - DNA, 20 bp, human
gtggctggcacaaccggcac

SEQ ID NO: 230178 - DNA, 20 bp, human
gcgcgccgctcgctctccgc

SEQ ID NO: 230179 - DNA, 20 bp, human
gggctgcgcgcctgacaaca

SEQ ID NO: 230180 - DNA, 20 bp, human
gcctgcagacggctaccctt

SEQ ID NO: 230181 - DNA, 20 bp, human
gcaacaaggcgtgctcccat

SEQ ID NO: 230182 - DNA, 20 bp, human
gaaccggcaccggagccaat

SEQ ID NO: 230183 - DNA, 20 bp, human
gaggactgacgacggggatc

SEQ ID NO: 230184 - DNA, 20 bp, human
ggcagcccgcggagagcgag

SEQ ID NO: 230185 - DNA, 20 bp, human
gtgtcaggcgcgcagccgga

SEQ ID NO: 230186 - DNA, 20 bp, human
gcggccgcagaggcagacgg

SEQ ID NO: 230187 - DNA, 20 bp, human
ggtggggaatgcgacctggg

SEQ ID NO: 230188 - DNA, 20 bp, human
ggcgggaggcaaggggccac

SEQ ID NO: 230189 - DNA, 20 bp, human
gctcccgccgtctgcctctg

SEQ ID NO: 230190 - DNA, 20 bp, human
gtgagcgagcagaacccggt

SEQ ID NO: 230191 - DNA, 20 bp, human
gcgtgtggggaatgcgacct

SEQ ID NO: 230192 - DNA, 20 bp, human
gcggcggccgcagaggcaga

SEQ ID NO: 230193 - DNA, 20 bp, human
gaacccggtgggttaggtcc

SEQ ID NO: 230194 - DNA, 20 bp, human
gcgagagccgagcgggtggt

SEQ ID NO: 230195 - DNA, 20 bp, human
ggggagagttggcgactccc

SEQ ID NO: 230196 - DNA, 20 bp, human
gctcccctgggtcctagagg

SEQ ID NO: 230197 - DNA, 20 bp, human
gcctgagcgcggcacctcgc

SEQ ID NO: 230198 - DNA, 20 bp, human
gggccgcaggtcccaagacg

SEQ ID NO: 230199 - DNA, 20 bp, human
gccaagacggggactcgaac

SEQ ID NO: 230200 - DNA, 20 bp, human
gcgaccgcctctaggaccca

SEQ ID NO: 230201 - DNA, 20 bp, human
gcgatggaggccatccgcga

SEQ ID NO: 230202 - DNA, 20 bp, human
ggcgctcccctgggtcctag

SEQ ID NO: 230203 - DNA, 20 bp, human
gaaggccgccatacagcaaa

SEQ ID NO: 230204 - DNA, 20 bp, human
gacggggactcgaaccggcg

SEQ ID NO: 230205 - DNA, 20 bp, human
ggcggtcggacgcagcagca

SEQ ID NO: 230206 - DNA, 20 bp, human
gcggaagcggggctccccca

SEQ ID NO: 230207 - DNA, 20 bp, human
gcggagcgggagcacgagga

SEQ ID NO: 230208 - DNA, 20 bp, human
ggcggggcgcggcggtacct

SEQ ID NO: 230209 - DNA, 20 bp, human
gcgggagcacgaggagggaa

SEQ ID NO: 230210 - DNA, 20 bp, human
ggggacgctgcaacgcggag

SEQ ID NO: 230211 - DNA, 20 bp, human
gcggctggcggtgcagatct

SEQ ID NO: 230212 - DNA, 20 bp, human
gcgaaggggacgctgcaacg

SEQ ID NO: 230213 - DNA, 20 bp, human
gcaggggccgcccggaagcg

SEQ ID NO: 230214 - DNA, 20 bp, human
gagggaaggggcttggcaat

SEQ ID NO: 230215 - DNA, 20 bp, human
gggggagccccgcttccggg

SEQ ID NO: 230216 - DNA, 20 bp, human
gaccctcaggaggcagtctg

SEQ ID NO: 230217 - DNA, 20 bp, human
gctgctgaggggagccactt

SEQ ID NO: 230218 - DNA, 20 bp, human
gtggggaggctgtgctctcc

SEQ ID NO: 230219 - DNA, 20 bp, human
ggaatggcacagattccggt

SEQ ID NO: 230220 - DNA, 20 bp, human
ggtgggctgggccctccgaa

SEQ ID NO: 230221 - DNA, 20 bp, human
gggtgccccgcccttggatg

SEQ ID NO: 230222 - DNA, 20 bp, human
gggaatctgtgccattcgga

SEQ ID NO: 230223 - DNA, 20 bp, human
gctccccagactgcctcctg

SEQ ID NO: 230224 - DNA, 20 bp, human
gcctgattgggagagattag

SEQ ID NO: 230225 - DNA, 20 bp, human
ggcggggcaccagtccaggc

SEQ ID NO: 230226 - DNA, 20 bp, human
gtgcccctctgggtctgcgc

SEQ ID NO: 230227 - DNA, 20 bp, human
ggtggccagcacccagacac

SEQ ID NO: 230228 - DNA, 20 bp, human
gcagggcacgctgaagagtg

SEQ ID NO: 230229 - DNA, 20 bp, human
gacaccggcgcagacccaga

SEQ ID NO: 230230 - DNA, 20 bp, human
gtgggtctgcgccggtgtct

SEQ ID NO: 230231 - DNA, 20 bp, human
gccagaggggcaggcggact

SEQ ID NO: 230232 - DNA, 20 bp, human
gaggaagaggccggaggagt

SEQ ID NO: 230233 - DNA, 20 bp, human
gcgccagcaggcagcggtcg

SEQ ID NO: 230234 - DNA, 20 bp, human
gtcctccggcctcttcctgc

SEQ ID NO: 230235 - DNA, 20 bp, human
gggggcgtgtcctactcctc

SEQ ID NO: 230236 - DNA, 20 bp, human
gaggactgggattagggcca

SEQ ID NO: 230237 - DNA, 20 bp, human
gagggggattagggtaagtg

SEQ ID NO: 230238 - DNA, 20 bp, human
gcccctcagagcccgatcct

SEQ ID NO: 230239 - DNA, 20 bp, human
ggagctgagagcctaggatc

SEQ ID NO: 230240 - DNA, 20 bp, human
gcgggctctgagggggatta

SEQ ID NO: 230241 - DNA, 20 bp, human
gggtgcataagcagctttat

SEQ ID NO: 230242 - DNA, 20 bp, human
gcggacaacggctgggaggt

SEQ ID NO: 230243 - DNA, 20 bp, human
gagcctaggatcgggctctg

SEQ ID NO: 230244 - DNA, 20 bp, human
ggtagcagatctggcatctg

SEQ ID NO: 230245 - DNA, 20 bp, human
gccccccatgggtgacatcc

SEQ ID NO: 230246 - DNA, 20 bp, human
gcatctggcttgaatgatat

SEQ ID NO: 230247 - DNA, 20 bp, human
gtggcttgaatgatatgggt

SEQ ID NO: 230248 - DNA, 20 bp, human
ggacgcctttatccccagag

SEQ ID NO: 230249 - DNA, 20 bp, human
ggtcttagagctgtgacagc

SEQ ID NO: 230250 - DNA, 20 bp, human
gagagctgtgacagctgggc

SEQ ID NO: 230251 - DNA, 20 bp, human
gggaaatctctacccgggtt

SEQ ID NO: 230252 - DNA, 20 bp, human
gaattccactctggggataa

SEQ ID NO: 230253 - DNA, 20 bp, human
ggcactttccaattccactc

SEQ ID NO: 230254 - DNA, 20 bp, human
gatctctacccgggttgggg

SEQ ID NO: 230255 - DNA, 20 bp, human
gttttataaatggggattag

SEQ ID NO: 230256 - DNA, 20 bp, human
gaggggagccctagtgggaa

SEQ ID NO: 230257 - DNA, 20 bp, human
ggaacagaggggagccctag

SEQ ID NO: 230258 - DNA, 20 bp, human
gcctagtgggaaaggggaat

SEQ ID NO: 230259 - DNA, 20 bp, human
gaggggaatcggggccgaag

SEQ ID NO: 230260 - DNA, 20 bp, human
gcggggctccttctcccctt

SEQ ID NO: 230261 - DNA, 20 bp, human
gcggccgccccaaacctgcc

SEQ ID NO: 230262 - DNA, 20 bp, human
gcctggtggctgcagactta

SEQ ID NO: 230263 - DNA, 20 bp, human
ggggccagtctcacctctct

SEQ ID NO: 230264 - DNA, 20 bp, human
gaaggagccccgggcaggtt

SEQ ID NO: 230265 - DNA, 20 bp, human
gtccgctcctggtgcgtgga

SEQ ID NO: 230266 - DNA, 20 bp, human
gagactgccaggcacctttt

SEQ ID NO: 230267 - DNA, 20 bp, human
gctccttggaggttgtttct

SEQ ID NO: 230268 - DNA, 20 bp, human
gtccctgcaattgaaatgct

SEQ ID NO: 230269 - DNA, 20 bp, human
gagcctagaaacaacctcca

SEQ ID NO: 230270 - DNA, 20 bp, human
ggtctcctgatatagagcta

SEQ ID NO: 230271 - DNA, 20 bp, human
gcgattggttatctaattgc

SEQ ID NO: 230272 - DNA, 20 bp, human
gctatgggagcaatgtcact

SEQ ID NO: 230273 - DNA, 20 bp, human
gagacatagcagagactgcc

SEQ ID NO: 230274 - DNA, 20 bp, human
ggtaaccctagctctatatc

SEQ ID NO: 230275 - DNA, 20 bp, human
gcaatgtcactgggtctcct

SEQ ID NO: 230276 - DNA, 20 bp, human
gacagcggccgcagccaatg

SEQ ID NO: 230277 - DNA, 20 bp, human
gggggagccgaaagcgacaa

SEQ ID NO: 230278 - DNA, 20 bp, human
ggtcgctttcggctccccat

SEQ ID NO: 230279 - DNA, 20 bp, human
ggtggccccgcctccttgag

SEQ ID NO: 230280 - DNA, 20 bp, human
gacaaaggccatgatttggc

SEQ ID NO: 230281 - DNA, 20 bp, human
gcccgcctccttgagtggtg

SEQ ID NO: 230282 - DNA, 20 bp, human
gagctccgcaccactcaagg

SEQ ID NO: 230283 - DNA, 20 bp, human
gcaaagctccgcaccactca

SEQ ID NO: 230284 - DNA, 20 bp, human
gagcaatgtgtggaatggcg

SEQ ID NO: 230285 - DNA, 20 bp, human
gggaaataagtctccctcgc

SEQ ID NO: 230286 - DNA, 20 bp, human
gactaggggcgtttgagggg

SEQ ID NO: 230287 - DNA, 20 bp, human
gaggctgcggcgaggagctg

SEQ ID NO: 230288 - DNA, 20 bp, human
ggaccctcatgccgcgacta

SEQ ID NO: 230289 - DNA, 20 bp, human
ggcgaggcgcgcccgaaggg

SEQ ID NO: 230290 - DNA, 20 bp, human
ggggcggggctcgcaggcat

SEQ ID NO: 230291 - DNA, 20 bp, human
gtaggtgctcattattgtag

SEQ ID NO: 230292 - DNA, 20 bp, human
ggcgactaggggcgtttgag

SEQ ID NO: 230293 - DNA, 20 bp, human
gagctcgttagcatacgggg

SEQ ID NO: 230294 - DNA, 20 bp, human
ggggagctcgttagcatacg

SEQ ID NO: 230295 - DNA, 20 bp, human
ggcccctagtcgcggcatga

SEQ ID NO: 230296 - DNA, 20 bp, human
gggtccccgagcagagagag

SEQ ID NO: 230297 - DNA, 20 bp, human
gagaggcggggaaattcccc

SEQ ID NO: 230298 - DNA, 20 bp, human
gagagagaggaggggcaacc

SEQ ID NO: 230299 - DNA, 20 bp, human
ggtgccaccacgctgcgctc

SEQ ID NO: 230300 - DNA, 20 bp, human
ggctggaacctgggccgggt

SEQ ID NO: 230301 - DNA, 20 bp, human
gcagccacgggaaggtccgt

SEQ ID NO: 230302 - DNA, 20 bp, human
gcccggctgggccgccgcgg

SEQ ID NO: 230303 - DNA, 20 bp, human
gcggcggctgcggtgattta

SEQ ID NO: 230304 - DNA, 20 bp, human
gggaaccagcaagagaggcg

SEQ ID NO: 230305 - DNA, 20 bp, human
ggaggcggggagcgctggcg

SEQ ID NO: 230306 - DNA, 20 bp, human
ggcggctggagctacgactg

SEQ ID NO: 230307 - DNA, 20 bp, human
gcaaaccgttcgcgtcttaa

SEQ ID NO: 230308 - DNA, 20 bp, human
ggctcggcgcctcgggtcgg

SEQ ID NO: 230309 - DNA, 20 bp, human
gaaagacgaaacccaggtct

SEQ ID NO: 230310 - DNA, 20 bp, human
gagcctgacccggacctcgg

SEQ ID NO: 230311 - DNA, 20 bp, human
gaccccctttaagacgcgaa

SEQ ID NO: 230312 - DNA, 20 bp, human
gagacgcgaacggtttgcaa

SEQ ID NO: 230313 - DNA, 20 bp, human
gcgagccgccgccgcccgat

SEQ ID NO: 230314 - DNA, 20 bp, human
ggaagcttccactgcgtccc

SEQ ID NO: 230315 - DNA, 20 bp, human
gtcttaaagggggtgtgcgt

SEQ ID NO: 230316 - DNA, 20 bp, human
gcggagcgaggggtccgtct

SEQ ID NO: 230317 - DNA, 20 bp, human
gacgtgaccggccccttata

SEQ ID NO: 230318 - DNA, 20 bp, human
gcgagcctgtgggtcctcga

SEQ ID NO: 230319 - DNA, 20 bp, human
gagggcacccaggggcggtg

SEQ ID NO: 230320 - DNA, 20 bp, human
gaaggggccggtcacgtggc

SEQ ID NO: 230321 - DNA, 20 bp, human
gaggagccgagggcacccag

SEQ ID NO: 230322 - DNA, 20 bp, human
gcgagccgagcgcacccgga

SEQ ID NO: 230323 - DNA, 20 bp, human
gcacccaggggcggtgcggc

SEQ ID NO: 230324 - DNA, 20 bp, human
ggcggccgtcgaggacccac

SEQ ID NO: 230325 - DNA, 20 bp, human
gcacaggctcgtccgctcct

SEQ ID NO: 230326 - DNA, 20 bp, human
ggcggactggagcccgaagt

SEQ ID NO: 230327 - DNA, 20 bp, human
gccgggagggggcccgactt

SEQ ID NO: 230328 - DNA, 20 bp, human
gtccgcccgcatgacgtcaa

SEQ ID NO: 230329 - DNA, 20 bp, human
gcagggacgcgccgccgcag

SEQ ID NO: 230330 - DNA, 20 bp, human
gtgtgagcggaattccaagg

SEQ ID NO: 230331 - DNA, 20 bp, human
gcgctgaacgcttccagatg

SEQ ID NO: 230332 - DNA, 20 bp, human
gcgttcagcgcgtctgcctc

SEQ ID NO: 230333 - DNA, 20 bp, human
gcgcacccgggcgccagccg

SEQ ID NO: 230334 - DNA, 20 bp, human
ggcggcggcgcgcagggagc

SEQ ID NO: 230335 - DNA, 20 bp, human
ggcggaggagagaacgcggg

SEQ ID NO: 230336 - DNA, 20 bp, human
gcaccccgagtcccacgcga

SEQ ID NO: 230337 - DNA, 20 bp, human
gctgacctgcgggctccaaa

SEQ ID NO: 230338 - DNA, 20 bp, human
gtggccgtcgcgtgggactc

SEQ ID NO: 230339 - DNA, 20 bp, human
gcgggcgcgcagcgtcgcca

SEQ ID NO: 230340 - DNA, 20 bp, human
gcgagcgcgcaagtggtgcc

SEQ ID NO: 230341 - DNA, 20 bp, human
gcctggcccggctgacctgc

SEQ ID NO: 230342 - DNA, 20 bp, human
ggccgggcagaaccgcgcgc

SEQ ID NO: 230343 - DNA, 20 bp, human
gctcctctgcgcacacctgg

SEQ ID NO: 230344 - DNA, 20 bp, human
gcagccggagctcacatccg

SEQ ID NO: 230345 - DNA, 20 bp, human
gagcccagaaatgcgcgggg

SEQ ID NO: 230346 - DNA, 20 bp, human
ggcgctgcctgcggggaaga

SEQ ID NO: 230347 - DNA, 20 bp, human
gaagatgcggaaggagaatg

SEQ ID NO: 230348 - DNA, 20 bp, human
gccgccgagggcgctgcctg

SEQ ID NO: 230349 - DNA, 20 bp, human
gcgcactcccgccctctcgg

SEQ ID NO: 230350 - DNA, 20 bp, human
gagcgccctcggcggagcac

SEQ ID NO: 230351 - DNA, 20 bp, human
ggcactggagaagatgcgga

SEQ ID NO: 230352 - DNA, 20 bp, human
gagtgaggaagttcggtctg

SEQ ID NO: 230353 - DNA, 20 bp, human
gagccgttagtgaggaagtt

SEQ ID NO: 230354 - DNA, 20 bp, human
gttctccagtgctccgccga

SEQ ID NO: 230355 - DNA, 20 bp, human
gagtctccgcaagagagcga

SEQ ID NO: 230356 - DNA, 20 bp, human
ggtgcaaatgggacgtttgt

SEQ ID NO: 230357 - DNA, 20 bp, human
gacagtgttgtatgggaggg

SEQ ID NO: 230358 - DNA, 20 bp, human
gaataacagtgttgtatggg

SEQ ID NO: 230359 - DNA, 20 bp, human
gtgtatgggagggtggcggt

SEQ ID NO: 230360 - DNA, 20 bp, human
ggccttaatccctccaaagc

SEQ ID NO: 230361 - DNA, 20 bp, human
gcccagctttggagggatta

SEQ ID NO: 230362 - DNA, 20 bp, human
gttcatctgttgccaggctc

SEQ ID NO: 230363 - DNA, 20 bp, human
gttggagggattaaggccgc

SEQ ID NO: 230364 - DNA, 20 bp, human
gggggcacggctagtggcgg

SEQ ID NO: 230365 - DNA, 20 bp, human
gtatatgtgcaatatctcta

SEQ ID NO: 230366 - DNA, 20 bp, human
gggagcggacccaggggcaa

SEQ ID NO: 230367 - DNA, 20 bp, human
gcccctgggtccgctcccga

SEQ ID NO: 230368 - DNA, 20 bp, human
ggccgtccgccgtggcagtg

SEQ ID NO: 230369 - DNA, 20 bp, human
ggaggcttgaagttgaagtg

SEQ ID NO: 230370 - DNA, 20 bp, human
gtggctccagccttcgggag

SEQ ID NO: 230371 - DNA, 20 bp, human
gccgccgtggcagtgcgggc

SEQ ID NO: 230372 - DNA, 20 bp, human
ggcgtccggcgattggctgc

SEQ ID NO: 230373 - DNA, 20 bp, human
gggagtcccaaagaccccaa

SEQ ID NO: 230374 - DNA, 20 bp, human
ggccaatcgccggacgccgc

SEQ ID NO: 230375 - DNA, 20 bp, human
gaggaaagtgggttcggtct

SEQ ID NO: 230376 - DNA, 20 bp, human
gggcgggcgggggggtactg

SEQ ID NO: 230377 - DNA, 20 bp, human
gcgacagggaggggtcgctc

SEQ ID NO: 230378 - DNA, 20 bp, human
gcggccgcccccgcagttgg

SEQ ID NO: 230379 - DNA, 20 bp, human
gccaacttcccgcacccggg

SEQ ID NO: 230380 - DNA, 20 bp, human
ggggtccaacttcccgcacc

SEQ ID NO: 230381 - DNA, 20 bp, human
gccgggcgtggggtgcacca

SEQ ID NO: 230382 - DNA, 20 bp, human
gagcggggagcccagtgcgg

SEQ ID NO: 230383 - DNA, 20 bp, human
gtccctgcccccaactgcgg

SEQ ID NO: 230384 - DNA, 20 bp, human
gggggcgccgggcggcgaca

SEQ ID NO: 230385 - DNA, 20 bp, human
gcgggaggctccggcggggt

SEQ ID NO: 230386 - DNA, 20 bp, human
gggcccagctgcacccaact

SEQ ID NO: 230387 - DNA, 20 bp, human
gaatcctcatgcaagagtga

SEQ ID NO: 230388 - DNA, 20 bp, human
gttggcaaacgaagatagtg

SEQ ID NO: 230389 - DNA, 20 bp, human
gtggaagcagattccaagtt

SEQ ID NO: 230390 - DNA, 20 bp, human
gaggattacgaaacagctga

SEQ ID NO: 230391 - DNA, 20 bp, human
gctgcctctccaccaataag

SEQ ID NO: 230392 - DNA, 20 bp, human
gagccccacctgagccccac

SEQ ID NO: 230393 - DNA, 20 bp, human
ggctgcatccgtccacttat

SEQ ID NO: 230394 - DNA, 20 bp, human
gggggcaagtctgctcaccc

SEQ ID NO: 230395 - DNA, 20 bp, human
gtcaccctcactcttgcatg

SEQ ID NO: 230396 - DNA, 20 bp, human
gcctcctcaggggacagatt

SEQ ID NO: 230397 - DNA, 20 bp, human
ggcagcggggagccgagtgg

SEQ ID NO: 230398 - DNA, 20 bp, human
gggcaacagaggtcaggaat

SEQ ID NO: 230399 - DNA, 20 bp, human
ggggggaagaacttacacac

SEQ ID NO: 230400 - DNA, 20 bp, human
ggcctggggcaacagaggtc

SEQ ID NO: 230401 - DNA, 20 bp, human
gagaacttacacacaggcct

SEQ ID NO: 230402 - DNA, 20 bp, human
gtgagccagccagggggcgg

SEQ ID NO: 230403 - DNA, 20 bp, human
gtcctgacctctgttgcccc

SEQ ID NO: 230404 - DNA, 20 bp, human
gttctccagacaatgtcatg

SEQ ID NO: 230405 - DNA, 20 bp, human
ggaggctaattttacttgct

SEQ ID NO: 230406 - DNA, 20 bp, human
ggggagcagccctccataca

SEQ ID NO: 230407 - DNA, 20 bp, human
ggctgggcgtcagagcagtc

SEQ ID NO: 230408 - DNA, 20 bp, human
gccgcccagcgggcatccac

SEQ ID NO: 230409 - DNA, 20 bp, human
ggggcgtcagagcagtcggg

SEQ ID NO: 230410 - DNA, 20 bp, human
gagagcagtcgggcggagac

SEQ ID NO: 230411 - DNA, 20 bp, human
gagccaggaactcccaaagt

SEQ ID NO: 230412 - DNA, 20 bp, human
gggaagcgagaggctccgtc

SEQ ID NO: 230413 - DNA, 20 bp, human
ggcaggaatcggggaatggc

SEQ ID NO: 230414 - DNA, 20 bp, human
gcctggctgccttgtatgga

SEQ ID NO: 230415 - DNA, 20 bp, human
gtgggcggctggccgtcccc

SEQ ID NO: 230416 - DNA, 20 bp, human
ggaggcgcgcgggcacgggt

SEQ ID NO: 230417 - DNA, 20 bp, human
gggtgccggcaggttggcgg

SEQ ID NO: 230418 - DNA, 20 bp, human
gcaggacgcccgagccagta

SEQ ID NO: 230419 - DNA, 20 bp, human
gacgcccgagccagtagggc

SEQ ID NO: 230420 - DNA, 20 bp, human
gaatcctgccctactggctc

SEQ ID NO: 230421 - DNA, 20 bp, human
gagcccgaatcctgccctac

SEQ ID NO: 230422 - DNA, 20 bp, human
gcggcagggtctgaggtgtg

SEQ ID NO: 230423 - DNA, 20 bp, human
gggaggagcggcagggtctg

SEQ ID NO: 230424 - DNA, 20 bp, human
ggggactcttcccgcgggtg

SEQ ID NO: 230425 - DNA, 20 bp, human
ggggcaggattcgggctgcg

SEQ ID NO: 230426 - DNA, 20 bp, human
gcggccccggggagtccggc

SEQ ID NO: 230427 - DNA, 20 bp, human
ggggccgcggaacctaaagg

SEQ ID NO: 230428 - DNA, 20 bp, human
ggcggcccgccggactcccc

SEQ ID NO: 230429 - DNA, 20 bp, human
gggagtccggcgggccgcgg

SEQ ID NO: 230430 - DNA, 20 bp, human
gcgcgcgcccggctcacttg

SEQ ID NO: 230431 - DNA, 20 bp, human
gcaccgcgggcgcgactctg

SEQ ID NO: 230432 - DNA, 20 bp, human
gccgcagcgggcgcgtcgga

SEQ ID NO: 230433 - DNA, 20 bp, human
gcggccgcagtagcccgggt

SEQ ID NO: 230434 - DNA, 20 bp, human
gtaactccgcgacccccctc

SEQ ID NO: 230435 - DNA, 20 bp, human
gcaggagaatcgcgcggcgg

SEQ ID NO: 230436 - DNA, 20 bp, human
gaggacacacccccacctca

SEQ ID NO: 230437 - DNA, 20 bp, human
ggaagggcttgctgtgacta

SEQ ID NO: 230438 - DNA, 20 bp, human
ggggtgcactatagccctga

SEQ ID NO: 230439 - DNA, 20 bp, human
gaaggtggttccacaggaac

SEQ ID NO: 230440 - DNA, 20 bp, human
ggcacccctctgctttaaag

SEQ ID NO: 230441 - DNA, 20 bp, human
ggggtcaacaagagatttgt

SEQ ID NO: 230442 - DNA, 20 bp, human
ggtccagaaggtggttccac

SEQ ID NO: 230443 - DNA, 20 bp, human
ggagaggccagcggattaaa

SEQ ID NO: 230444 - DNA, 20 bp, human
gagggcctctccgggaaagg

SEQ ID NO: 230445 - DNA, 20 bp, human
gctcttgttgaccctgaggt

SEQ ID NO: 230446 - DNA, 20 bp, human
gaggacacacccccacctca

SEQ ID NO: 230447 - DNA, 20 bp, human
ggaagggcttgctgtgacta

SEQ ID NO: 230448 - DNA, 20 bp, human
ggggtgcactatagccctga

SEQ ID NO: 230449 - DNA, 20 bp, human
gcccccagtccctgtctccg

SEQ ID NO: 230450 - DNA, 20 bp, human
gaaggtggttccacaggaac

SEQ ID NO: 230451 - DNA, 20 bp, human
ggcacccctctgctttaaag

SEQ ID NO: 230452 - DNA, 20 bp, human
ggggtcaacaagagatttgt

SEQ ID NO: 230453 - DNA, 20 bp, human
ggagaggccagcggattaaa

SEQ ID NO: 230454 - DNA, 20 bp, human
ggtccagaaggtggttccac

SEQ ID NO: 230455 - DNA, 20 bp, human
gagggcctctccgggaaagg

SEQ ID NO: 230456 - DNA, 20 bp, human
gccggctcggcgcacacaat

SEQ ID NO: 230457 - DNA, 20 bp, human
gtgtgcgccgagccggcgga

SEQ ID NO: 230458 - DNA, 20 bp, human
gggcgcacacaatgggcgtg

SEQ ID NO: 230459 - DNA, 20 bp, human
ggcaccccacggccagtcag

SEQ ID NO: 230460 - DNA, 20 bp, human
gcagggaggcaagcccctct

SEQ ID NO: 230461 - DNA, 20 bp, human
gggccacctagagccgagag

SEQ ID NO: 230462 - DNA, 20 bp, human
gtgggcgtgcggcagcaggg

SEQ ID NO: 230463 - DNA, 20 bp, human
gtgggcctctgactggccgt

SEQ ID NO: 230464 - DNA, 20 bp, human
ggggggacccgcaggaagag

SEQ ID NO: 230465 - DNA, 20 bp, human
ggaaactaggcgtggaactt

SEQ ID NO: 230466 - DNA, 20 bp, human
gcctcccgcgaggaactttt

SEQ ID NO: 230467 - DNA, 20 bp, human
ggcgcgtcgccgtggcacac

SEQ ID NO: 230468 - DNA, 20 bp, human
gcgacgcgcagcggctgagt

SEQ ID NO: 230469 - DNA, 20 bp, human
ggtgccacggcgacgcgcag

SEQ ID NO: 230470 - DNA, 20 bp, human
gggccatgggaacaggatca

SEQ ID NO: 230471 - DNA, 20 bp, human
gtcaaggccccctgagcgcc

SEQ ID NO: 230472 - DNA, 20 bp, human
gtgctctaagggttcctgag

SEQ ID NO: 230473 - DNA, 20 bp, human
gagagcagatctcttaactt

SEQ ID NO: 230474 - DNA, 20 bp, human
gaagccgaaaagttcctcgc

SEQ ID NO: 230475 - DNA, 20 bp, human
gaggggtggtctggggccat

SEQ ID NO: 230476 - DNA, 20 bp, human
ggaggacgcactcccacact

SEQ ID NO: 230477 - DNA, 20 bp, human
gtgcgtaaaaaggcgacata

SEQ ID NO: 230478 - DNA, 20 bp, human
gtatggagcatgcccagtgt

SEQ ID NO: 230479 - DNA, 20 bp, human
gttatctttggagatctcga

SEQ ID NO: 230480 - DNA, 20 bp, human
gtggagatctcgagggggag

SEQ ID NO: 230481 - DNA, 20 bp, human
gagtggagcaggtaatggaa

SEQ ID NO: 230482 - DNA, 20 bp, human
gtgtgagcatctgcgtaaaa

SEQ ID NO: 230483 - DNA, 20 bp, human
gaggacacacttagtggagc

SEQ ID NO: 230484 - DNA, 20 bp, human
ggtgacgtggccatttaatt

SEQ ID NO: 230485 - DNA, 20 bp, human
gtcttcggttctatagtaat

SEQ ID NO: 230486 - DNA, 20 bp, human
ggggaaacaaagggctgcgg

SEQ ID NO: 230487 - DNA, 20 bp, human
gaaacaaagggctgcggcgg

SEQ ID NO: 230488 - DNA, 20 bp, human
gaacccaggaactactccgc

SEQ ID NO: 230489 - DNA, 20 bp, human
gcgcgagggagacgcgaccc

SEQ ID NO: 230490 - DNA, 20 bp, human
gtactccgccgggaaacaaa

SEQ ID NO: 230491 - DNA, 20 bp, human
ggggggcgctgagaccgcga

SEQ ID NO: 230492 - DNA, 20 bp, human
ggggaacgagcggcagacgg

SEQ ID NO: 230493 - DNA, 20 bp, human
gtcccggcggagtagttcct

SEQ ID NO: 230494 - DNA, 20 bp, human
ggcagccctttgtttcccgg

SEQ ID NO: 230495 - DNA, 20 bp, human
gggcggggcgaggagagatg

SEQ ID NO: 230496 - DNA, 20 bp, human
gaggagcgagggtgcgacgt

SEQ ID NO: 230497 - DNA, 20 bp, human
gagccagagactgacagagg

SEQ ID NO: 230498 - DNA, 20 bp, human
gctgacagaggcggcgagaa

SEQ ID NO: 230499 - DNA, 20 bp, human
gacggaagtggagagaggct

SEQ ID NO: 230500 - DNA, 20 bp, human
gaggggaagccgaggagcga

SEQ ID NO: 230501 - DNA, 20 bp, human
gtagacaggagagacggaag

SEQ ID NO: 230502 - DNA, 20 bp, human
gcacacggaaaaacagaacg

SEQ ID NO: 230503 - DNA, 20 bp, human
gcgccgcctctgtcagtctc

SEQ ID NO: 230504 - DNA, 20 bp, human
gcagaggcggcgagaaagga

SEQ ID NO: 230505 - DNA, 20 bp, human
ggcgaccccgacctcggcgg

SEQ ID NO: 230506 - DNA, 20 bp, human
ggggaagccgagccaatcag

SEQ ID NO: 230507 - DNA, 20 bp, human
gcgttccctcggagagtgga

SEQ ID NO: 230508 - DNA, 20 bp, human
gggcgccctccactctccga

SEQ ID NO: 230509 - DNA, 20 bp, human
gtaggaaagcggcctctgat

SEQ ID NO: 230510 - DNA, 20 bp, human
gctgcgtggaatgtttggaa

SEQ ID NO: 230511 - DNA, 20 bp, human
gccagtctgtggttgaggaa

SEQ ID NO: 230512 - DNA, 20 bp, human
gtcttcagctgactgaagca

SEQ ID NO: 230513 - DNA, 20 bp, human
gacagactggtgactgagct

SEQ ID NO: 230514 - DNA, 20 bp, human
gcagctgaagagcgttccct

SEQ ID NO: 230515 - DNA, 20 bp, human
gtgctgggtaggatgctccg

SEQ ID NO: 230516 - DNA, 20 bp, human
gcagctgcccagacgcgtca

SEQ ID NO: 230517 - DNA, 20 bp, human
gagacgcgtcaggggcctga

SEQ ID NO: 230518 - DNA, 20 bp, human
gtgggctggccttggggccg

SEQ ID NO: 230519 - DNA, 20 bp, human
gcccgagcagaagctgtcct

SEQ ID NO: 230520 - DNA, 20 bp, human
gggtaagcctgttaccggca

SEQ ID NO: 230521 - DNA, 20 bp, human
gaccccagtgcggcggggca

SEQ ID NO: 230522 - DNA, 20 bp, human
gcgccgcactggggtatttc

SEQ ID NO: 230523 - DNA, 20 bp, human
gattaatagcagcctccctc

SEQ ID NO: 230524 - DNA, 20 bp, human
gcggtgccacgcctggagat

SEQ ID NO: 230525 - DNA, 20 bp, human
gaccctgccccgccgcactg

SEQ ID NO: 230526 - DNA, 20 bp, human
gctaaaatgagcgctctcct

SEQ ID NO: 230527 - DNA, 20 bp, human
ggtgcccgtctgactgtgat

SEQ ID NO: 230528 - DNA, 20 bp, human
gccagggccgcccgccagga

SEQ ID NO: 230529 - DNA, 20 bp, human
gaagcggcgaacatgtaacc

SEQ ID NO: 230530 - DNA, 20 bp, human
gccgcttccaggcagagaaa

SEQ ID NO: 230531 - DNA, 20 bp, human
gttacatgttcgccgcttcc

SEQ ID NO: 230532 - DNA, 20 bp, human
gcctcccatcacagtcagac

SEQ ID NO: 230533 - DNA, 20 bp, human
gagctctgggcacgtagaga

SEQ ID NO: 230534 - DNA, 20 bp, human
gaaagggcgactcgtagctg

SEQ ID NO: 230535 - DNA, 20 bp, human
gagctggaagaaacaccaag

SEQ ID NO: 230536 - DNA, 20 bp, human
gcagtgaacactcttctcag

SEQ ID NO: 230537 - DNA, 20 bp, human
gacgacggaggcggggcaac

SEQ ID NO: 230538 - DNA, 20 bp, human
gccaaggtccgtggtgctga

SEQ ID NO: 230539 - DNA, 20 bp, human
gagaaacccggggtgctaaa

SEQ ID NO: 230540 - DNA, 20 bp, human
gtggcaaaaaatagcactgc

SEQ ID NO: 230541 - DNA, 20 bp, human
gaaaaaatagcactgctggg

SEQ ID NO: 230542 - DNA, 20 bp, human
gggccggctggtttccctgg

SEQ ID NO: 230543 - DNA, 20 bp, human
gctaggcgttaagacgacgg

SEQ ID NO: 230544 - DNA, 20 bp, human
gtgactgggcagagccgagc

SEQ ID NO: 230545 - DNA, 20 bp, human
gcagctgcacaccgccgccc

SEQ ID NO: 230546 - DNA, 20 bp, human
ggggcggcgccgagagaaac

SEQ ID NO: 230547 - DNA, 20 bp, human
gggcgggggccgaggctcga

SEQ ID NO: 230548 - DNA, 20 bp, human
gggggagaaaatcctggctg

SEQ ID NO: 230549 - DNA, 20 bp, human
ggctcagaggagcgcacagc

SEQ ID NO: 230550 - DNA, 20 bp, human
gggcgagggggagaaaatcc

SEQ ID NO: 230551 - DNA, 20 bp, human
gaggggaggctggatgtcct

SEQ ID NO: 230552 - DNA, 20 bp, human
gtcctggggaacacttccct

SEQ ID NO: 230553 - DNA, 20 bp, human
ggagaaacggggcgcggacc

SEQ ID NO: 230554 - DNA, 20 bp, human
gcctgggcgggtaagagagg

SEQ ID NO: 230555 - DNA, 20 bp, human
gaaagaatccgcagggccgt

SEQ ID NO: 230556 - DNA, 20 bp, human
gcgggaggtgagcacctctg

SEQ ID NO: 230557 - DNA, 20 bp, human
gtgcaggcggggtttgggac

SEQ ID NO: 230558 - DNA, 20 bp, human
gcggcggcggccacggtcat

SEQ ID NO: 230559 - DNA, 20 bp, human
gtggggtgagcacccttgtg

SEQ ID NO: 230560 - DNA, 20 bp, human
gcgcgccccggaccccgaga

SEQ ID NO: 230561 - DNA, 20 bp, human
gctgggagaccgcatctgac

SEQ ID NO: 230562 - DNA, 20 bp, human
ggccagctgcaggcggggtt

SEQ ID NO: 230563 - DNA, 20 bp, human
gaggtgctcacctcccgggc

SEQ ID NO: 230564 - DNA, 20 bp, human
gcagctggcagcgccggggt

SEQ ID NO: 230565 - DNA, 20 bp, human
gcattggcgccgagcggttc

SEQ ID NO: 230566 - DNA, 20 bp, human
gggctggggcagatgggacc

SEQ ID NO: 230567 - DNA, 20 bp, human
gcctcctggggctcacacta

SEQ ID NO: 230568 - DNA, 20 bp, human
ggagtccccccagggttcaa

SEQ ID NO: 230569 - DNA, 20 bp, human
gatgggaccgggggccctcc

SEQ ID NO: 230570 - DNA, 20 bp, human
gggctcacactatggggctg

SEQ ID NO: 230571 - DNA, 20 bp, human
gggagacggactgatcccga

SEQ ID NO: 230572 - DNA, 20 bp, human
gggggctgtggtccgcactg

SEQ ID NO: 230573 - DNA, 20 bp, human
gagcctggcgcgaacccgac

SEQ ID NO: 230574 - DNA, 20 bp, human
gaacccgaccgggaaggccc

SEQ ID NO: 230575 - DNA, 20 bp, human
gccagaggcgggaggctacg

SEQ ID NO: 230576 - DNA, 20 bp, human
ggggaaggatgcagcgaggg

SEQ ID NO: 230577 - DNA, 20 bp, human
ggaggcagagagcccgagag

SEQ ID NO: 230578 - DNA, 20 bp, human
gtctgcgcctaggtggtgag

SEQ ID NO: 230579 - DNA, 20 bp, human
gccgagaaatccagggactc

SEQ ID NO: 230580 - DNA, 20 bp, human
gggaaccggcggccgctcat

SEQ ID NO: 230581 - DNA, 20 bp, human
gaagtcacgccgagaccttg

SEQ ID NO: 230582 - DNA, 20 bp, human
gaaatccagggactcaggtc

SEQ ID NO: 230583 - DNA, 20 bp, human
gggagatgggccttgaggat

SEQ ID NO: 230584 - DNA, 20 bp, human
gcgctcattggctactgcgg

SEQ ID NO: 230585 - DNA, 20 bp, human
gcattggctactgcggagga

SEQ ID NO: 230586 - DNA, 20 bp, human
ggaaggagtttctggagctg

SEQ ID NO: 230587 - DNA, 20 bp, human
gccagaaactccttccactc

SEQ ID NO: 230588 - DNA, 20 bp, human
gtgaggcagggattttgggg

SEQ ID NO: 230589 - DNA, 20 bp, human
gcagtggagccccgagtgga

SEQ ID NO: 230590 - DNA, 20 bp, human
ggaagcagtggagccccgag

SEQ ID NO: 230591 - DNA, 20 bp, human
ggcagggattttgggggggg

SEQ ID NO: 230592 - DNA, 20 bp, human
ggagctgaggcagggatttt

SEQ ID NO: 230593 - DNA, 20 bp, human
gagtttctggagctgaggca

SEQ ID NO: 230594 - DNA, 20 bp, human
gttttgagaaagagaagcag

SEQ ID NO: 230595 - DNA, 20 bp, human
gttagaggagaagaaggcac

SEQ ID NO: 230596 - DNA, 20 bp, human
gggtaggggctgatcagtta

SEQ ID NO: 230597 - DNA, 20 bp, human
gtaggacagaggcacagggt

SEQ ID NO: 230598 - DNA, 20 bp, human
gcaccataggacagaggcac

SEQ ID NO: 230599 - DNA, 20 bp, human
gaagtagcaggtcttcgagg

SEQ ID NO: 230600 - DNA, 20 bp, human
gagatctgatgggaagtgct

SEQ ID NO: 230601 - DNA, 20 bp, human
gtgagccgagatcagcccac

SEQ ID NO: 230602 - DNA, 20 bp, human
gaaagagaggtgagaaagtc

SEQ ID NO: 230603 - DNA, 20 bp, human
ggtggatctgctcaccgcac

SEQ ID NO: 230604 - DNA, 20 bp, human
gggctgatcagttagggcct

SEQ ID NO: 230605 - DNA, 20 bp, human
ggaaaagtagcaggtcttcg

SEQ ID NO: 230606 - DNA, 20 bp, human
gcgggctggggcgacgggat

SEQ ID NO: 230607 - DNA, 20 bp, human
gaggcgtggggacccgccta

SEQ ID NO: 230608 - DNA, 20 bp, human
ggccccgcccacagtttctc

SEQ ID NO: 230609 - DNA, 20 bp, human
ggcagcctggagagcgccgt

SEQ ID NO: 230610 - DNA, 20 bp, human
gggcggggcaagggcaaact

SEQ ID NO: 230611 - DNA, 20 bp, human
ggcctccagcactgcctgaa

SEQ ID NO: 230612 - DNA, 20 bp, human
ggcgggtccccacgcctcag

SEQ ID NO: 230613 - DNA, 20 bp, human
gctcgcccacggcgctctcc

SEQ ID NO: 230614 - DNA, 20 bp, human
ggggattgttgcctccaggg

SEQ ID NO: 230615 - DNA, 20 bp, human
gcccactggagtcaatcacg

SEQ ID NO: 230616 - DNA, 20 bp, human
gaacctctgccctgttgcgt

SEQ ID NO: 230617 - DNA, 20 bp, human
gaaagcggagccaaaagggg

SEQ ID NO: 230618 - DNA, 20 bp, human
gaggagggcacgtggtgcga

SEQ ID NO: 230619 - DNA, 20 bp, human
gcgagaaagcggagccaaaa

SEQ ID NO: 230620 - DNA, 20 bp, human
gctaacaggggaggcgcgac

SEQ ID NO: 230621 - DNA, 20 bp, human
gggcagggagctaacagggg

SEQ ID NO: 230622 - DNA, 20 bp, human
ggctggcagggagctaacag

SEQ ID NO: 230623 - DNA, 20 bp, human
gggcacgtggtgcgagggac

SEQ ID NO: 230624 - DNA, 20 bp, human
ggcccggcctcacgtgacaa

SEQ ID NO: 230625 - DNA, 20 bp, human
gaggccctcgccggttcctg

SEQ ID NO: 230626 - DNA, 20 bp, human
gcgggcggagccagactcgg

SEQ ID NO: 230627 - DNA, 20 bp, human
gtcggcgaggcgaggaaggg

SEQ ID NO: 230628 - DNA, 20 bp, human
ggggctgtgcgtgctcgcgg

SEQ ID NO: 230629 - DNA, 20 bp, human
ggagccagactcggcggggc

SEQ ID NO: 230630 - DNA, 20 bp, human
gtgagcgttgctaggagatt

SEQ ID NO: 230631 - DNA, 20 bp, human
ggatcggtacgttatttccg

SEQ ID NO: 230632 - DNA, 20 bp, human
gtgtgcgtgctcgcggtggg

SEQ ID NO: 230633 - DNA, 20 bp, human
gacgcacagcccgccaagcc

SEQ ID NO: 230634 - DNA, 20 bp, human
gggcggcggctgcctcgcga

SEQ ID NO: 230635 - DNA, 20 bp, human
ggcccgcctcccgcacgcga

SEQ ID NO: 230636 - DNA, 20 bp, human
ggcggggccgggcacgtaag

SEQ ID NO: 230637 - DNA, 20 bp, human
gctccgcactgcaaaaccgg

SEQ ID NO: 230638 - DNA, 20 bp, human
gtccgcggagccacggggag

SEQ ID NO: 230639 - DNA, 20 bp, human
gacacaggcggcgtgagggg

SEQ ID NO: 230640 - DNA, 20 bp, human
gggtctccgcactgcaaaac

SEQ ID NO: 230641 - DNA, 20 bp, human
gactgcggcggcgcggacac

SEQ ID NO: 230642 - DNA, 20 bp, human
gtgcagtgcggagaccacgg

SEQ ID NO: 230643 - DNA, 20 bp, human
gaagccgggcgcggcagcgt

SEQ ID NO: 230644 - DNA, 20 bp, human
ggccgggcacgtaaggggcg

SEQ ID NO: 230645 - DNA, 20 bp, human
gacgtaaggggcggggtccg

SEQ ID NO: 230646 - DNA, 20 bp, human
gcgcccgcgccacctagggg

SEQ ID NO: 230647 - DNA, 20 bp, human
gccctggcgctggcgttcgg

SEQ ID NO: 230648 - DNA, 20 bp, human
gagcccaacccggctctcgg

SEQ ID NO: 230649 - DNA, 20 bp, human
ggccctccgagagccgggtt

SEQ ID NO: 230650 - DNA, 20 bp, human
ggcgcgcccgcgccacctag

SEQ ID NO: 230651 - DNA, 20 bp, human
gagcgaggccctccgagagc

SEQ ID NO: 230652 - DNA, 20 bp, human
ggccccctggcgctggcgtt

SEQ ID NO: 230653 - DNA, 20 bp, human
ggggctcgcggcgctgtgat

SEQ ID NO: 230654 - DNA, 20 bp, human
gggacagaggaccctcttaa

SEQ ID NO: 230655 - DNA, 20 bp, human
ggcctggcgtgcaaggactc

SEQ ID NO: 230656 - DNA, 20 bp, human
ggccaatgagagaaggggat

SEQ ID NO: 230657 - DNA, 20 bp, human
gcgccaggggtgctgaatgg

SEQ ID NO: 230658 - DNA, 20 bp, human
gggaaactcccccgcccacc

SEQ ID NO: 230659 - DNA, 20 bp, human
gctcccccgcccaccaggtc

SEQ ID NO: 230660 - DNA, 20 bp, human
ggatgggtggagacaagcgc

SEQ ID NO: 230661 - DNA, 20 bp, human
gcacaagggcaagctcagag

SEQ ID NO: 230662 - DNA, 20 bp, human
gaagggcaagctcagagcgg

SEQ ID NO: 230663 - DNA, 20 bp, human
gggcaagctcagagcggcgg

SEQ ID NO: 230664 - DNA, 20 bp, human
gggggagtttccattggccg

SEQ ID NO: 230665 - DNA, 20 bp, human
ggtgggagaggctaagtata

SEQ ID NO: 230666 - DNA, 20 bp, human
gagggtggaaggcaccacga

SEQ ID NO: 230667 - DNA, 20 bp, human
gccggctggccgagctcccg

SEQ ID NO: 230668 - DNA, 20 bp, human
ggccgagctcccgggggaga

SEQ ID NO: 230669 - DNA, 20 bp, human
gcaccacgaaggcaaggagg

SEQ ID NO: 230670 - DNA, 20 bp, human
gcctaagaggggtgagcgca

SEQ ID NO: 230671 - DNA, 20 bp, human
gggagggaggggagtcggac

SEQ ID NO: 230672 - DNA, 20 bp, human
gaggcaccacgaaggcaagg

SEQ ID NO: 230673 - DNA, 20 bp, human
gtccctgggtacatggttgg

SEQ ID NO: 230674 - DNA, 20 bp, human
gctcacccctcttaggcttg

SEQ ID NO: 230675 - DNA, 20 bp, human
gaccctctcccccgggagct

SEQ ID NO: 230676 - DNA, 20 bp, human
gaggcccggagacaatcggg

SEQ ID NO: 230677 - DNA, 20 bp, human
ggagaggcccggagacaatc

SEQ ID NO: 230678 - DNA, 20 bp, human
gccgtccccccgattgtctc

SEQ ID NO: 230679 - DNA, 20 bp, human
ggggagggcgacagcggcgt

SEQ ID NO: 230680 - DNA, 20 bp, human
gagggcgggaaggggtgcgc

SEQ ID NO: 230681 - DNA, 20 bp, human
ggtgcgcgggagggcgacag

SEQ ID NO: 230682 - DNA, 20 bp, human
gggtgagcgcgggaaatgga

SEQ ID NO: 230683 - DNA, 20 bp, human
ggcacggtgggggaacggtg

SEQ ID NO: 230684 - DNA, 20 bp, human
gaagggagggagtgcgacgt

SEQ ID NO: 230685 - DNA, 20 bp, human
gagggagtgcgacgtgggaa

SEQ ID NO: 230686 - DNA, 20 bp, human
gaggagggtggcaaggtatt

SEQ ID NO: 230687 - DNA, 20 bp, human
gcccgtgtccgcggcgtaaa

SEQ ID NO: 230688 - DNA, 20 bp, human
ggcatcttgccgattgggga

SEQ ID NO: 230689 - DNA, 20 bp, human
ggaagggagaggtgcgtccg

SEQ ID NO: 230690 - DNA, 20 bp, human
ggcagcagccctttacgccg

SEQ ID NO: 230691 - DNA, 20 bp, human
gcgtctccaaacagcccgct

SEQ ID NO: 230692 - DNA, 20 bp, human
gcgcagccggatgccatctg

SEQ ID NO: 230693 - DNA, 20 bp, human
gatgcagccaagagccgaag

SEQ ID NO: 230694 - DNA, 20 bp, human
ggtcgggggcgctacataaa

SEQ ID NO: 230695 - DNA, 20 bp, human
ggacccagaagcgcgaaggg

SEQ ID NO: 230696 - DNA, 20 bp, human
gggagccgccgggactgaat

SEQ ID NO: 230697 - DNA, 20 bp, human
ggctggcggagcaattcctg

SEQ ID NO: 230698 - DNA, 20 bp, human
gaataggcggagttagcgtt

SEQ ID NO: 230699 - DNA, 20 bp, human
gtccgcctattcagtcccgg

SEQ ID NO: 230700 - DNA, 20 bp, human
gcgagcgcccggacgcaggt

SEQ ID NO: 230701 - DNA, 20 bp, human
gtagcgttgggggtgagctt

SEQ ID NO: 230702 - DNA, 20 bp, human
ggccgccgggactgaatagg

SEQ ID NO: 230703 - DNA, 20 bp, human
gcgctgggtcggcgcgcccg

SEQ ID NO: 230704 - DNA, 20 bp, human
gaactccgcctattcagtcc

SEQ ID NO: 230705 - DNA, 20 bp, human
gctctggggaaccgctgggt

SEQ ID NO: 230706 - DNA, 20 bp, human
gcacgccaaggcctttggat

SEQ ID NO: 230707 - DNA, 20 bp, human
gcggtgaggggcttccggtt

SEQ ID NO: 230708 - DNA, 20 bp, human
gcccggaagtctgacttgag

SEQ ID NO: 230709 - DNA, 20 bp, human
gctggatggcgcgctgtata

SEQ ID NO: 230710 - DNA, 20 bp, human
gacggccgatccaaaggcct

SEQ ID NO: 230711 - DNA, 20 bp, human
ggctcagacggatgtaccca

SEQ ID NO: 230712 - DNA, 20 bp, human
gcgcacgtggtggccactgt

SEQ ID NO: 230713 - DNA, 20 bp, human
gagagccgtacccagagcca

SEQ ID NO: 230714 - DNA, 20 bp, human
gagtccacaccccaaggggg

SEQ ID NO: 230715 - DNA, 20 bp, human
ggaattgcccggggaccacc

SEQ ID NO: 230716 - DNA, 20 bp, human
gctagctggagcgagagttt

SEQ ID NO: 230717 - DNA, 20 bp, human
gtggactaggaggatgtagg

SEQ ID NO: 230718 - DNA, 20 bp, human
gtatcccgacggccccaagc

SEQ ID NO: 230719 - DNA, 20 bp, human
gctggtgagagcaagaggcg

SEQ ID NO: 230720 - DNA, 20 bp, human
ggaaggggaaagctgatgac

SEQ ID NO: 230721 - DNA, 20 bp, human
gtggcccggcttggggccgt

SEQ ID NO: 230722 - DNA, 20 bp, human
gtgggcttgttggaagcagc

SEQ ID NO: 230723 - DNA, 20 bp, human
gcgctccagctagctttcct

SEQ ID NO: 230724 - DNA, 20 bp, human
ggattggatgctgaaaacag

SEQ ID NO: 230725 - DNA, 20 bp, human
ggcatccaatctctgagcaa

SEQ ID NO: 230726 - DNA, 20 bp, human
gggtctcagcgcagaggtaa

SEQ ID NO: 230727 - DNA, 20 bp, human
gccgaggggtctcagcgcag

SEQ ID NO: 230728 - DNA, 20 bp, human
ggctcggcccggactcctag

SEQ ID NO: 230729 - DNA, 20 bp, human
gggctccagagcgtatataa

SEQ ID NO: 230730 - DNA, 20 bp, human
ggtactcaagacggtcggga

SEQ ID NO: 230731 - DNA, 20 bp, human
gcgctcagggaatccgaccg

SEQ ID NO: 230732 - DNA, 20 bp, human
ggcgcccggccgccagaagg

SEQ ID NO: 230733 - DNA, 20 bp, human
ggtccctggccccgcgccga

SEQ ID NO: 230734 - DNA, 20 bp, human
ggggacacccggaggatttt

SEQ ID NO: 230735 - DNA, 20 bp, human
gcggggccagggacacccgg

SEQ ID NO: 230736 - DNA, 20 bp, human
gcaggggtggagtggggcga

SEQ ID NO: 230737 - DNA, 20 bp, human
gtgagggtgacgcaacccag

SEQ ID NO: 230738 - DNA, 20 bp, human
gtgacgcaacccaggggcaa

SEQ ID NO: 230739 - DNA, 20 bp, human
gacaagtgggacggtcctgc

SEQ ID NO: 230740 - DNA, 20 bp, human
gccagtgcacagcaaccaat

SEQ ID NO: 230741 - DNA, 20 bp, human
gcggaggggtcctttgcccc

SEQ ID NO: 230742 - DNA, 20 bp, human
gggggcgagggttcaaaacc

SEQ ID NO: 230743 - DNA, 20 bp, human
gtattcccgccgctgtgggt

SEQ ID NO: 230744 - DNA, 20 bp, human
gtcatgcttccagaacctgg

SEQ ID NO: 230745 - DNA, 20 bp, human
gtgagggcagtttgacgtca

SEQ ID NO: 230746 - DNA, 20 bp, human
gagcacagtggacttctggg

SEQ ID NO: 230747 - DNA, 20 bp, human
gaaaaccaggataggagcca

SEQ ID NO: 230748 - DNA, 20 bp, human
ggacttctgggaggttcagt

SEQ ID NO: 230749 - DNA, 20 bp, human
gctggaggagcgatcctaga

SEQ ID NO: 230750 - DNA, 20 bp, human
gtggctttgtggcttcagac

SEQ ID NO: 230751 - DNA, 20 bp, human
gtgcgccagttcgaagttct

SEQ ID NO: 230752 - DNA, 20 bp, human
ggtgccagcaggcggagctt

SEQ ID NO: 230753 - DNA, 20 bp, human
ggggatcagcttctgtgaca

SEQ ID NO: 230754 - DNA, 20 bp, human
gggctcctagaacttcgaac

SEQ ID NO: 230755 - DNA, 20 bp, human
gaacttcgaactggcgcagg

SEQ ID NO: 230756 - DNA, 20 bp, human
ggacgcaatcggagctcggt

SEQ ID NO: 230757 - DNA, 20 bp, human
gcactggtactctggagcgg

SEQ ID NO: 230758 - DNA, 20 bp, human
gactgccggcactggtactc

SEQ ID NO: 230759 - DNA, 20 bp, human
gccgcgcggccaatccaaag

SEQ ID NO: 230760 - DNA, 20 bp, human
gtagctcgcactgccggcac

SEQ ID NO: 230761 - DNA, 20 bp, human
gtacagagatagctggaggg

SEQ ID NO: 230762 - DNA, 20 bp, human
ggctcggtcggtcctttgat

SEQ ID NO: 230763 - DNA, 20 bp, human
gctatgacgcaatcggagct

SEQ ID NO: 230764 - DNA, 20 bp, human
ggtgcgagctatgacgcaat

SEQ ID NO: 230765 - DNA, 20 bp, human
ggccaggactagccaatcaa

SEQ ID NO: 230766 - DNA, 20 bp, human
ggggaagagggcgtccgtga

SEQ ID NO: 230767 - DNA, 20 bp, human
gaggctgcgcgcaaggaggg

SEQ ID NO: 230768 - DNA, 20 bp, human
gtaggactatacatcccaga

SEQ ID NO: 230769 - DNA, 20 bp, human
gagaaggctgcgcgcaagga

SEQ ID NO: 230770 - DNA, 20 bp, human
gccccctcctaagggatcat

SEQ ID NO: 230771 - DNA, 20 bp, human
ggcagccggccccctcctaa

SEQ ID NO: 230772 - DNA, 20 bp, human
gcgtgacggcggcctcaccg

SEQ ID NO: 230773 - DNA, 20 bp, human
gaagagggcgtccgtgacgg

SEQ ID NO: 230774 - DNA, 20 bp, human
gcgagcacgcagcggcaaaa

SEQ ID NO: 230775 - DNA, 20 bp, human
gctcaccgcggcatcctggg

SEQ ID NO: 230776 - DNA, 20 bp, human
gaggcagaagaccgctcctg

SEQ ID NO: 230777 - DNA, 20 bp, human
ggacttaggagagccatcaa

SEQ ID NO: 230778 - DNA, 20 bp, human
gcccccgcgcggcgcttgct

SEQ ID NO: 230779 - DNA, 20 bp, human
ggcgggacgggctctccctt

SEQ ID NO: 230780 - DNA, 20 bp, human
gccccgcccacacgtcacaa

SEQ ID NO: 230781 - DNA, 20 bp, human
ggctgggacttgtagtgttc

SEQ ID NO: 230782 - DNA, 20 bp, human
ggaccgttgtgacgtgtggg

SEQ ID NO: 230783 - DNA, 20 bp, human
ggctgaccgttgtgacgtgt

SEQ ID NO: 230784 - DNA, 20 bp, human
gagtcccagcaagcgccgcg

SEQ ID NO: 230785 - DNA, 20 bp, human
gagtaaacagcttcttccag

SEQ ID NO: 230786 - DNA, 20 bp, human
gtaggaagttgtgactgaga

SEQ ID NO: 230787 - DNA, 20 bp, human
gataagcctctgttcatgtg

SEQ ID NO: 230788 - DNA, 20 bp, human
ggtgagggttgtggtgcctg

SEQ ID NO: 230789 - DNA, 20 bp, human
gtctgttcatgtgagggttg

SEQ ID NO: 230790 - DNA, 20 bp, human
gtaaagtcatagggcttgtt

SEQ ID NO: 230791 - DNA, 20 bp, human
gcagaaaattctcgtagcat

SEQ ID NO: 230792 - DNA, 20 bp, human
gtctttaacttcttcaccac

SEQ ID NO: 230793 - DNA, 20 bp, human
gattctgtgcaaagcaagtc

SEQ ID NO: 230794 - DNA, 20 bp, human
ggggttctaaattagaatgg

SEQ ID NO: 230795 - DNA, 20 bp, human
gtggactttcctaaagtcat

SEQ ID NO: 230796 - DNA, 20 bp, human
gtcgccccggcccgcgagtg

SEQ ID NO: 230797 - DNA, 20 bp, human
gtcgcgggccggggcgactg

SEQ ID NO: 230798 - DNA, 20 bp, human
ggacaggagggggctgactg

SEQ ID NO: 230799 - DNA, 20 bp, human
gcgagcgcagccccactcgc

SEQ ID NO: 230800 - DNA, 20 bp, human
gggggctcaccctgcgagtc

SEQ ID NO: 230801 - DNA, 20 bp, human
gtcctctgccgcctgtcggg

SEQ ID NO: 230802 - DNA, 20 bp, human
gctgctgtctcgctccagtc

SEQ ID NO: 230803 - DNA, 20 bp, human
gccgcccgcctcccgacagg

SEQ ID NO: 230804 - DNA, 20 bp, human
ggcctcccgacaggcggcag

SEQ ID NO: 230805 - DNA, 20 bp, human
ggtctcgctccagtcagggc

SEQ ID NO: 230806 - DNA, 20 bp, human
gcccgcctgcagttagtgtt

SEQ ID NO: 230807 - DNA, 20 bp, human
gctgaacagagagagatcat

SEQ ID NO: 230808 - DNA, 20 bp, human
gaaggagtgctgctttcctg

SEQ ID NO: 230809 - DNA, 20 bp, human
ggtaagtgatcagcagcaga

SEQ ID NO: 230810 - DNA, 20 bp, human
gttctcaaatagcatacccc

SEQ ID NO: 230811 - DNA, 20 bp, human
gaagccagccagctttttac

SEQ ID NO: 230812 - DNA, 20 bp, human
ggtaacctaacactaactgc

SEQ ID NO: 230813 - DNA, 20 bp, human
gaaatcacaagtagcttgtt

SEQ ID NO: 230814 - DNA, 20 bp, human
gttctaacagaactcagtca

SEQ ID NO: 230815 - DNA, 20 bp, human
gtcaaagaatcaaaggagtt

SEQ ID NO: 230816 - DNA, 20 bp, human
gttggctggggtgtcgtcat

SEQ ID NO: 230817 - DNA, 20 bp, human
gtctgggaggggccaaggaa

SEQ ID NO: 230818 - DNA, 20 bp, human
ggagatgcctgtcattccct

SEQ ID NO: 230819 - DNA, 20 bp, human
gcctcccgactgtaaacata

SEQ ID NO: 230820 - DNA, 20 bp, human
gaggcaggctgcatccacct

SEQ ID NO: 230821 - DNA, 20 bp, human
gaggctgcatccaccttggc

SEQ ID NO: 230822 - DNA, 20 bp, human
ggctaaggataaccaaaaaa

SEQ ID NO: 230823 - DNA, 20 bp, human
ggtttacagtcgggaggcgg

SEQ ID NO: 230824 - DNA, 20 bp, human
ggtcctgtcgtttttctaat

SEQ ID NO: 230825 - DNA, 20 bp, human
gacaatggattcacttccag

SEQ ID NO: 230826 - DNA, 20 bp, human
gctagagaccagctttctgt

SEQ ID NO: 230827 - DNA, 20 bp, human
gctggctgaacccacaggat

SEQ ID NO: 230828 - DNA, 20 bp, human
gcagccctggctgaacccac

SEQ ID NO: 230829 - DNA, 20 bp, human
gaccagctttctgtgggtgt

SEQ ID NO: 230830 - DNA, 20 bp, human
gtagcaggtgctagcgccgg

SEQ ID NO: 230831 - DNA, 20 bp, human
gagacaaggtccaggacctc

SEQ ID NO: 230832 - DNA, 20 bp, human
ggtgctagcgccggaggtgg

SEQ ID NO: 230833 - DNA, 20 bp, human
gtagtcaggtgctggctgag

SEQ ID NO: 230834 - DNA, 20 bp, human
ggcagattgaccaatcctgt

SEQ ID NO: 230835 - DNA, 20 bp, human
gggaatctttagtcaggtgc

SEQ ID NO: 230836 - DNA, 20 bp, human
gcagcgggggtcaagtacgt

SEQ ID NO: 230837 - DNA, 20 bp, human
gggtctgggccgagggcgga

SEQ ID NO: 230838 - DNA, 20 bp, human
gtccgggtctgggccgaggg

SEQ ID NO: 230839 - DNA, 20 bp, human
gccaatgggaccagtcggga

SEQ ID NO: 230840 - DNA, 20 bp, human
gcggtccgggtctgggccga

SEQ ID NO: 230841 - DNA, 20 bp, human
ggtggagcatggcccggtcc

SEQ ID NO: 230842 - DNA, 20 bp, human
gtcccggcgccaccaggcag

SEQ ID NO: 230843 - DNA, 20 bp, human
ggagaccccgcgagggtcaa

SEQ ID NO: 230844 - DNA, 20 bp, human
gagggagaagggccagtaga

SEQ ID NO: 230845 - DNA, 20 bp, human
gccgactggtcccattggtg

SEQ ID NO: 230846 - DNA, 20 bp, human
gcaaagagaaatgggccggg

SEQ ID NO: 230847 - DNA, 20 bp, human
gcgggaggaatggagtgaca

SEQ ID NO: 230848 - DNA, 20 bp, human
ggacaggcaaattctgggtg

SEQ ID NO: 230849 - DNA, 20 bp, human
gtgggctgcccggtcacaga

SEQ ID NO: 230850 - DNA, 20 bp, human
gggaatggagtgacagggcg

SEQ ID NO: 230851 - DNA, 20 bp, human
gggcagcccaaagcacctct

SEQ ID NO: 230852 - DNA, 20 bp, human
ggcggggcccatttgcctag

SEQ ID NO: 230853 - DNA, 20 bp, human
gcagccgttggagcttcctt

SEQ ID NO: 230854 - DNA, 20 bp, human
gccgttggagcttccttcgg

SEQ ID NO: 230855 - DNA, 20 bp, human
gtcactcccccagacaggag

SEQ ID NO: 230856 - DNA, 20 bp, human
gccctgcgcgccagtcgcgg

SEQ ID NO: 230857 - DNA, 20 bp, human
ggggaggcctggcgaacccg

SEQ ID NO: 230858 - DNA, 20 bp, human
ggccccctgcgcgccagtcg

SEQ ID NO: 230859 - DNA, 20 bp, human
gtgggtcggggaagcgttct

SEQ ID NO: 230860 - DNA, 20 bp, human
gagtcgcggcggccctacgc

SEQ ID NO: 230861 - DNA, 20 bp, human
ggcttccccgacccagcgta

SEQ ID NO: 230862 - DNA, 20 bp, human
ggcggccctacgctgggtcg

SEQ ID NO: 230863 - DNA, 20 bp, human
ggggcgcgcggtctcgggtc

SEQ ID NO: 230864 - DNA, 20 bp, human
gaggagacgcccaccctggg

SEQ ID NO: 230865 - DNA, 20 bp, human
gcgcggtctcgggtcaggtg

SEQ ID NO: 230866 - DNA, 20 bp, human
gaagccgcaccgcgtcccgg

SEQ ID NO: 230867 - DNA, 20 bp, human
gccgccgccgggacgcggtg

SEQ ID NO: 230868 - DNA, 20 bp, human
gagtcccagtgacgcattgc

SEQ ID NO: 230869 - DNA, 20 bp, human
ggcggcgatgcgtcccccgt

SEQ ID NO: 230870 - DNA, 20 bp, human
ggcgtgaaatgaagaacgtg

SEQ ID NO: 230871 - DNA, 20 bp, human
gtgtggcagggaaggatacg

SEQ ID NO: 230872 - DNA, 20 bp, human
gagaacgtgcggcttccatg

SEQ ID NO: 230873 - DNA, 20 bp, human
gtcaataaggggcgggaaag

SEQ ID NO: 230874 - DNA, 20 bp, human
gaaagtgggtgagtgtggca

SEQ ID NO: 230875 - DNA, 20 bp, human
gccgcaaagtagcgcccctc

SEQ ID NO: 230876 - DNA, 20 bp, human
gagggaaagtagtccggcga

SEQ ID NO: 230877 - DNA, 20 bp, human
ggggcccacttcactttctt

SEQ ID NO: 230878 - DNA, 20 bp, human
ggccaggcccaatagtgacg

SEQ ID NO: 230879 - DNA, 20 bp, human
gccccaccctgcacaggaat

SEQ ID NO: 230880 - DNA, 20 bp, human
ggtggggacgagagattcgc

SEQ ID NO: 230881 - DNA, 20 bp, human
ggcggaggggcacagctcgg

SEQ ID NO: 230882 - DNA, 20 bp, human
gtgtgagccgcgtcactatt

SEQ ID NO: 230883 - DNA, 20 bp, human
gggcccgtaggtgtggagcg

SEQ ID NO: 230884 - DNA, 20 bp, human
gggggcgcggagggatccgt

SEQ ID NO: 230885 - DNA, 20 bp, human
ggcgcgctcgctcccgtcgc

SEQ ID NO: 230886 - DNA, 20 bp, human
gtgactgcaggtgtgattcg

SEQ ID NO: 230887 - DNA, 20 bp, human
ggggcgtctgccaatgatgg

SEQ ID NO: 230888 - DNA, 20 bp, human
gcctgcagtcagggcgtggt

SEQ ID NO: 230889 - DNA, 20 bp, human
gcacacctgcagtcagggcg

SEQ ID NO: 230890 - DNA, 20 bp, human
gcaggggcgtctgccaatga

SEQ ID NO: 230891 - DNA, 20 bp, human
gaggcggcaggtgggagacg

SEQ ID NO: 230892 - DNA, 20 bp, human
ggctgggtccaggtgcaagc

SEQ ID NO: 230893 - DNA, 20 bp, human
ggggcctgtcctgtttagac

SEQ ID NO: 230894 - DNA, 20 bp, human
ggggcgtggtgggtgagctt

SEQ ID NO: 230895 - DNA, 20 bp, human
gctgtttagacaggagtcca

SEQ ID NO: 230896 - DNA, 20 bp, human
ggctgcagaaggctctccct

SEQ ID NO: 230897 - DNA, 20 bp, human
ggcgtcgggcccagtctcca

SEQ ID NO: 230898 - DNA, 20 bp, human
gcctccagaagccgaagcaa

SEQ ID NO: 230899 - DNA, 20 bp, human
gggaagctggaatctgaccc

SEQ ID NO: 230900 - DNA, 20 bp, human
gactgggcccgacgccacca

SEQ ID NO: 230901 - DNA, 20 bp, human
gagccctggactccaggaag

SEQ ID NO: 230902 - DNA, 20 bp, human
ggaccccttcctggagtcca

SEQ ID NO: 230903 - DNA, 20 bp, human
gcgggtcatgagctgtgctc

SEQ ID NO: 230904 - DNA, 20 bp, human
gtgggcaggttggatttttg

SEQ ID NO: 230905 - DNA, 20 bp, human
gagctcatgacccgccacct

SEQ ID NO: 230906 - DNA, 20 bp, human
gtcaccccagggcatttgga

SEQ ID NO: 230907 - DNA, 20 bp, human
ggggcctgctgtgcccttga

SEQ ID NO: 230908 - DNA, 20 bp, human
ggccaggtgggaactgccat

SEQ ID NO: 230909 - DNA, 20 bp, human
gatggggtcggggtatcgga

SEQ ID NO: 230910 - DNA, 20 bp, human
gaaggccaggcggggttggc

SEQ ID NO: 230911 - DNA, 20 bp, human
ggcaggggaaactatccctt

SEQ ID NO: 230912 - DNA, 20 bp, human
gtgccatggggtcggggtat

SEQ ID NO: 230913 - DNA, 20 bp, human
ggggagagctgtcaggtgcc

SEQ ID NO: 230914 - DNA, 20 bp, human
gctagcctgccaaccccgcc

SEQ ID NO: 230915 - DNA, 20 bp, human
gagacaggaaatgcaggaat

SEQ ID NO: 230916 - DNA, 20 bp, human
gccacccaggcaagagtgtg

SEQ ID NO: 230917 - DNA, 20 bp, human
gcaccgaaggctaagtgcgg

SEQ ID NO: 230918 - DNA, 20 bp, human
ggggcaccgaaggctaagtg

SEQ ID NO: 230919 - DNA, 20 bp, human
ggagggccgcacctctggga

SEQ ID NO: 230920 - DNA, 20 bp, human
ggctctcggccttatccaca

SEQ ID NO: 230921 - DNA, 20 bp, human
gggaaggtagacttggagct

SEQ ID NO: 230922 - DNA, 20 bp, human
gccaggaaagggctgagaca

SEQ ID NO: 230923 - DNA, 20 bp, human
gggccaatgttgagtccacc

SEQ ID NO: 230924 - DNA, 20 bp, human
ggccccttcccggcccgctt

SEQ ID NO: 230925 - DNA, 20 bp, human
gggcccccgcacttagcctt

SEQ ID NO: 230926 - DNA, 20 bp, human
ggcggggcgccgaagtggag

SEQ ID NO: 230927 - DNA, 20 bp, human
gcgagcaggcgcttggcaga

SEQ ID NO: 230928 - DNA, 20 bp, human
gaggtgtaatcgtggatcta

SEQ ID NO: 230929 - DNA, 20 bp, human
gaggctgcccacgttaactc

SEQ ID NO: 230930 - DNA, 20 bp, human
gggaaggcggggcgccgaag

SEQ ID NO: 230931 - DNA, 20 bp, human
gttaacgtgggcagcctctt

SEQ ID NO: 230932 - DNA, 20 bp, human
gaactgctgctcctcagcac

SEQ ID NO: 230933 - DNA, 20 bp, human
gtgggcagcctctttgggaa

SEQ ID NO: 230934 - DNA, 20 bp, human
gcacacaggcagacacgcgg

SEQ ID NO: 230935 - DNA, 20 bp, human
ggccttcactacttcatccc

SEQ ID NO: 230936 - DNA, 20 bp, human
gaaagagcggggctccgtgg

SEQ ID NO: 230937 - DNA, 20 bp, human
ggctgctgccgtgtctgctc

SEQ ID NO: 230938 - DNA, 20 bp, human
gtcactccagcaagaaaacg

SEQ ID NO: 230939 - DNA, 20 bp, human
gcactggcacccttcaaatt

SEQ ID NO: 230940 - DNA, 20 bp, human
gaaagtgcccccagaaacac

SEQ ID NO: 230941 - DNA, 20 bp, human
ggacactgcctggggaaagt

SEQ ID NO: 230942 - DNA, 20 bp, human
gcaagaaaacggggctgaga

SEQ ID NO: 230943 - DNA, 20 bp, human
gaggaccttggtacttccta

SEQ ID NO: 230944 - DNA, 20 bp, human
ggctagagtcccaatttgaa

SEQ ID NO: 230945 - DNA, 20 bp, human
gcctagggtaggcagtgcgt

SEQ ID NO: 230946 - DNA, 20 bp, human
gcgcgcgtcgttgcccatct

SEQ ID NO: 230947 - DNA, 20 bp, human
gggaacgctgggttcccaga

SEQ ID NO: 230948 - DNA, 20 bp, human
gtggtgaggccaatagaaat

SEQ ID NO: 230949 - DNA, 20 bp, human
ggtggtcgaccatcattggt

SEQ ID NO: 230950 - DNA, 20 bp, human
gatggtcgaccacgcgtggg

SEQ ID NO: 230951 - DNA, 20 bp, human
gagcggctctgcagtacgga

SEQ ID NO: 230952 - DNA, 20 bp, human
ggcggggttgggttcaggtc

SEQ ID NO: 230953 - DNA, 20 bp, human
gtgaaccgacgaaggtccaa

SEQ ID NO: 230954 - DNA, 20 bp, human
gtaacatagtgaaccgacga

SEQ ID NO: 230955 - DNA, 20 bp, human
ggggggggacgcccactggt

SEQ ID NO: 230956 - DNA, 20 bp, human
gacaccccgcgattgtgatt

SEQ ID NO: 230957 - DNA, 20 bp, human
gcacaatcgcggggtgtcat

SEQ ID NO: 230958 - DNA, 20 bp, human
gccttcaggcgtgaatgtgg

SEQ ID NO: 230959 - DNA, 20 bp, human
ggcgccccgaatcacaatcg

SEQ ID NO: 230960 - DNA, 20 bp, human
gtggcggctgcctctgcgaa

SEQ ID NO: 230961 - DNA, 20 bp, human
ggctccttcaggcgtgaatg

SEQ ID NO: 230962 - DNA, 20 bp, human
ggggagcggtagttccgggg

SEQ ID NO: 230963 - DNA, 20 bp, human
gaccgcgccccgcagaccaa

SEQ ID NO: 230964 - DNA, 20 bp, human
gtcgcggggtgtcatgggag

SEQ ID NO: 230965 - DNA, 20 bp, human
gctctgcgaatggacggcgt

SEQ ID NO: 230966 - DNA, 20 bp, human
gcaatcccggggacgagagt

SEQ ID NO: 230967 - DNA, 20 bp, human
gcggggacgctatgcgacag

SEQ ID NO: 230968 - DNA, 20 bp, human
ggcaactcggcgcggtcccg

SEQ ID NO: 230969 - DNA, 20 bp, human
gcccacgccacccgcagtac

SEQ ID NO: 230970 - DNA, 20 bp, human
gctggaaagcgccacgtccc

SEQ ID NO: 230971 - DNA, 20 bp, human
gtatgcgattgttagaccaa

SEQ ID NO: 230972 - DNA, 20 bp, human
gcccgcccaactctcgtccc

SEQ ID NO: 230973 - DNA, 20 bp, human
gggacgctatgcgacagcgg

SEQ ID NO: 230974 - DNA, 20 bp, human
gcgccgtcccaacaatcccg

SEQ ID NO: 230975 - DNA, 20 bp, human
gcggcgggtttgctgatgat

SEQ ID NO: 230976 - DNA, 20 bp, human
gcgcggctccctagccgggg

SEQ ID NO: 230977 - DNA, 20 bp, human
gccacccaccgccccggcta

SEQ ID NO: 230978 - DNA, 20 bp, human
gagaggcggggcctcgactc

SEQ ID NO: 230979 - DNA, 20 bp, human
ggctccctagccggggcggt

SEQ ID NO: 230980 - DNA, 20 bp, human
gcatgcgcggctccctagcc

SEQ ID NO: 230981 - DNA, 20 bp, human
gggctgcagctgcgagaccg

SEQ ID NO: 230982 - DNA, 20 bp, human
ggggtgcgggaccagagtcg

SEQ ID NO: 230983 - DNA, 20 bp, human
gggaaacgcggctagaggcg

SEQ ID NO: 230984 - DNA, 20 bp, human
gtgtcaggtgtgtgtgcatc

SEQ ID NO: 230985 - DNA, 20 bp, human
gtggatgtgtctggtgttcg

SEQ ID NO: 230986 - DNA, 20 bp, human
gagaggggcgcagacaccag

SEQ ID NO: 230987 - DNA, 20 bp, human
ggtaaggggaggggccaccc

SEQ ID NO: 230988 - DNA, 20 bp, human
gcagcgcagcaaggactctg

SEQ ID NO: 230989 - DNA, 20 bp, human
gctgcgctgggcaggtccac

SEQ ID NO: 230990 - DNA, 20 bp, human
gaccccctgcctggaggcta

SEQ ID NO: 230991 - DNA, 20 bp, human
gaggaggtcgcgcgttgtaa

SEQ ID NO: 230992 - DNA, 20 bp, human
ggtcgcgcgttgtaagggga

SEQ ID NO: 230993 - DNA, 20 bp, human
gaactccatggtttatgctc

SEQ ID NO: 230994 - DNA, 20 bp, human
gggacctgcccagcgcagca

SEQ ID NO: 230995 - DNA, 20 bp, human
gccctgcagccacctctcta

SEQ ID NO: 230996 - DNA, 20 bp, human
ggaggcgaggcaccgctcca

SEQ ID NO: 230997 - DNA, 20 bp, human
gggaccccgcttaagaccaa

SEQ ID NO: 230998 - DNA, 20 bp, human
gggcggagggacccgggatt

SEQ ID NO: 230999 - DNA, 20 bp, human
ggccggccaaactcaccctg

SEQ ID NO: 231000 - DNA, 20 bp, human
ggtgcctcgcctcccaatcc

SEQ ID NO: 231001 - DNA, 20 bp, human
gtctgaggagcaagtgtctg

SEQ ID NO: 231002 - DNA, 20 bp, human
ggaactgcacgggagtctgg

SEQ ID NO: 231003 - DNA, 20 bp, human
gcctgcggctctgatgtcag

SEQ ID NO: 231004 - DNA, 20 bp, human
gcgaggcaccgctccaaggc

SEQ ID NO: 231005 - DNA, 20 bp, human
gctaagggaggtcgcagaac

SEQ ID NO: 231006 - DNA, 20 bp, human
ggccgtggcccggcgctctt

SEQ ID NO: 231007 - DNA, 20 bp, human
gcccgaaggcggcgcgctgg

SEQ ID NO: 231008 - DNA, 20 bp, human
gtggcccggcgctcttggga

SEQ ID NO: 231009 - DNA, 20 bp, human
ggggagcgggacatccccga

SEQ ID NO: 231010 - DNA, 20 bp, human
ggacccgaggggcaaggcgt

SEQ ID NO: 231011 - DNA, 20 bp, human
gccggggcgcacggagaggg

SEQ ID NO: 231012 - DNA, 20 bp, human
gagcgggacatccccgaagg

SEQ ID NO: 231013 - DNA, 20 bp, human
gaaggcggcgcgctggaggc

SEQ ID NO: 231014 - DNA, 20 bp, human
gatccccgaaggcggcgcgc

SEQ ID NO: 231015 - DNA, 20 bp, human
ggggccacaggccacagcgc

SEQ ID NO: 231016 - DNA, 20 bp, human
gggtgagcagagccgaggaa

SEQ ID NO: 231017 - DNA, 20 bp, human
gtactgcacgctgggaggga

SEQ ID NO: 231018 - DNA, 20 bp, human
gggagtaaaagtagctaggg

SEQ ID NO: 231019 - DNA, 20 bp, human
gaggggagtaaaagtagcta

SEQ ID NO: 231020 - DNA, 20 bp, human
gcgtaaccacgcagccttaa

SEQ ID NO: 231021 - DNA, 20 bp, human
ggctgcgtggttacggtcct

SEQ ID NO: 231022 - DNA, 20 bp, human
gctacactggctgacatgta

SEQ ID NO: 231023 - DNA, 20 bp, human
gagactcattactgcacgct

SEQ ID NO: 231024 - DNA, 20 bp, human
gctacttttactccccttta

SEQ ID NO: 231025 - DNA, 20 bp, human
gtcattactgcacgctggga

SEQ ID NO: 231026 - DNA, 20 bp, human
ggggaatcccctatctgagt

SEQ ID NO: 231027 - DNA, 20 bp, human
gcctgtctccccactcagat

SEQ ID NO: 231028 - DNA, 20 bp, human
ggagtcatcgaccctgtcat

SEQ ID NO: 231029 - DNA, 20 bp, human
ggagaatactcagtgtaatc

SEQ ID NO: 231030 - DNA, 20 bp, human
ggttggactggggatctcca

SEQ ID NO: 231031 - DNA, 20 bp, human
gtgggagctcctaatctaat

SEQ ID NO: 231032 - DNA, 20 bp, human
ggagtcacccccattagatt

SEQ ID NO: 231033 - DNA, 20 bp, human
gagactgtgggtaccttctg

SEQ ID NO: 231034 - DNA, 20 bp, human
gagagagatcacacttgccc

SEQ ID NO: 231035 - DNA, 20 bp, human
gcagctctctacaccccaca

SEQ ID NO: 231036 - DNA, 20 bp, human
ggggacctggatgctgacga

SEQ ID NO: 231037 - DNA, 20 bp, human
gaggcttgcagtattgtgtg

SEQ ID NO: 231038 - DNA, 20 bp, human
gacaagggccccacagttgg

SEQ ID NO: 231039 - DNA, 20 bp, human
gtgcaagcctgtgtgggcct

SEQ ID NO: 231040 - DNA, 20 bp, human
gccgagagcaggtttcgcag

SEQ ID NO: 231041 - DNA, 20 bp, human
ggaacagggcgttttggagg

SEQ ID NO: 231042 - DNA, 20 bp, human
gtccttgggtccatcacccc

SEQ ID NO: 231043 - DNA, 20 bp, human
gtaccggggcaacgggaaca

SEQ ID NO: 231044 - DNA, 20 bp, human
gtgttggggaggcagttacc

SEQ ID NO: 231045 - DNA, 20 bp, human
gtggggcccttgtagcagac

SEQ ID NO: 231046 - DNA, 20 bp, human
gtgcaggagcagcgtgtgca

SEQ ID NO: 231047 - DNA, 20 bp, human
gcggggaaggcgcgtgcagg

SEQ ID NO: 231048 - DNA, 20 bp, human
gcagggcgccggtgccctgc

SEQ ID NO: 231049 - DNA, 20 bp, human
gaaggcgtcagtacagggcg

SEQ ID NO: 231050 - DNA, 20 bp, human
ggggccttcgagagagagag

SEQ ID NO: 231051 - DNA, 20 bp, human
gtgcaggtgcaggtgcgttg

SEQ ID NO: 231052 - DNA, 20 bp, human
gtaggtgtgcggcgcgctcc

SEQ ID NO: 231053 - DNA, 20 bp, human
gctccccgcgcgtaggtgtg

SEQ ID NO: 231054 - DNA, 20 bp, human
gcgttgcgggtgcggggcaa

SEQ ID NO: 231055 - DNA, 20 bp, human
ggagcagcgtgtgcagggcg

SEQ ID NO: 231056 - DNA, 20 bp, human
gagaaggctgcctcaatctg

SEQ ID NO: 231057 - DNA, 20 bp, human
gagcccgcgcggcttcaaga

SEQ ID NO: 231058 - DNA, 20 bp, human
gcgtgtgtgcaaccaaagga

SEQ ID NO: 231059 - DNA, 20 bp, human
ggcttggagtcgctagaggg

SEQ ID NO: 231060 - DNA, 20 bp, human
ggagagatccacgaagggac

SEQ ID NO: 231061 - DNA, 20 bp, human
gcacacgagcacaccagtct

SEQ ID NO: 231062 - DNA, 20 bp, human
gctcgggcgcgcacgctcgt

SEQ ID NO: 231063 - DNA, 20 bp, human
gggtggaggaggatgtgcgg

SEQ ID NO: 231064 - DNA, 20 bp, human
gcacccggtgggccgagcaa

SEQ ID NO: 231065 - DNA, 20 bp, human
ggatgtgcgggggagaagac

SEQ ID NO: 231066 - DNA, 20 bp, human
gcgcgcgcctggcccagcga

SEQ ID NO: 231067 - DNA, 20 bp, human
gttaccggggagagcgaggg

SEQ ID NO: 231068 - DNA, 20 bp, human
gctcgggaacgtgcatgcga

SEQ ID NO: 231069 - DNA, 20 bp, human
gcgctccgggccacctgtct

SEQ ID NO: 231070 - DNA, 20 bp, human
gtggaaggttcgcgacttat

SEQ ID NO: 231071 - DNA, 20 bp, human
ggggtcccgagcccccaacc

SEQ ID NO: 231072 - DNA, 20 bp, human
gagcaccgcgagactttacc

SEQ ID NO: 231073 - DNA, 20 bp, human
gcagctccgtctgcccagac

SEQ ID NO: 231074 - DNA, 20 bp, human
gttcaggcgcgggttgatca

SEQ ID NO: 231075 - DNA, 20 bp, human
ggacttatgggcttgtcccg

SEQ ID NO: 231076 - DNA, 20 bp, human
gcctcccgaggggacctcgg

SEQ ID NO: 231077 - DNA, 20 bp, human
gcccccgccgtcccgctcac

SEQ ID NO: 231078 - DNA, 20 bp, human
gtaaacacccgtgagcggga

SEQ ID NO: 231079 - DNA, 20 bp, human
gaagcatgctgacccccctg

SEQ ID NO: 231080 - DNA, 20 bp, human
ggctgcggggcaaagatcgg

SEQ ID NO: 231081 - DNA, 20 bp, human
gccccgtaaacacccgtgag

SEQ ID NO: 231082 - DNA, 20 bp, human
gggcgggcgcgcaccagctc

SEQ ID NO: 231083 - DNA, 20 bp, human
gacgacgcacacgcggggaa

SEQ ID NO: 231084 - DNA, 20 bp, human
ggcgagcggagcgacgtcac

SEQ ID NO: 231085 - DNA, 20 bp, human
gcacccgtgagcgggacggc

SEQ ID NO: 231086 - DNA, 20 bp, human
ggacgatgagcgcccgactg

SEQ ID NO: 231087 - DNA, 20 bp, human
gtggccaggggaaagaggcg

SEQ ID NO: 231088 - DNA, 20 bp, human
gaacccggccgggacctcgc

SEQ ID NO: 231089 - DNA, 20 bp, human
gggaggggcgggaccgaagg

SEQ ID NO: 231090 - DNA, 20 bp, human
gggcggggcgcggtggaggc

SEQ ID NO: 231091 - DNA, 20 bp, human
ggagcgcgcccagctacccc

SEQ ID NO: 231092 - DNA, 20 bp, human
gggaggttcccgcactgtgg

SEQ ID NO: 231093 - DNA, 20 bp, human
gactggaggagcttggagga

SEQ ID NO: 231094 - DNA, 20 bp, human
gggaatagtaccagccaacc

SEQ ID NO: 231095 - DNA, 20 bp, human
ggcccgactgcggcagagca

SEQ ID NO: 231096 - DNA, 20 bp, human
gcctctgcgagagggcgcga

SEQ ID NO: 231097 - DNA, 20 bp, human
gggcgggaaaggctcggcgc

SEQ ID NO: 231098 - DNA, 20 bp, human
ggcagctagtctccctccag

SEQ ID NO: 231099 - DNA, 20 bp, human
gggggcgagcctctgcgaga

SEQ ID NO: 231100 - DNA, 20 bp, human
gggagtcgccgcccgctgga

SEQ ID NO: 231101 - DNA, 20 bp, human
ggctgcaccgctgaggagag

SEQ ID NO: 231102 - DNA, 20 bp, human
ggagactagctgcaccgctg

SEQ ID NO: 231103 - DNA, 20 bp, human
gctagtctccctccagcggg

SEQ ID NO: 231104 - DNA, 20 bp, human
gtccccgcgggagggcgcgt

SEQ ID NO: 231105 - DNA, 20 bp, human
ggagggcggcgggaaaggct

SEQ ID NO: 231106 - DNA, 20 bp, human
gccgccccctcctggactaa

SEQ ID NO: 231107 - DNA, 20 bp, human
gcggtcccttagtccaggag

SEQ ID NO: 231108 - DNA, 20 bp, human
gtggactaagggaccgcggt

SEQ ID NO: 231109 - DNA, 20 bp, human
gggagtcccgggctccgatt

SEQ ID NO: 231110 - DNA, 20 bp, human
ggaggtcggccccgccgcag

SEQ ID NO: 231111 - DNA, 20 bp, human
ggcggtgggcggcgcggtag

SEQ ID NO: 231112 - DNA, 20 bp, human
ggggtccccgaagtccctcc

SEQ ID NO: 231113 - DNA, 20 bp, human
gactaagggaccgcggtggg

SEQ ID NO: 231114 - DNA, 20 bp, human
gccgccccaccgcctcgctg

SEQ ID NO: 231115 - DNA, 20 bp, human
ggcgcggtgcgtgcgaggga

SEQ ID NO: 231116 - DNA, 20 bp, human
ggcagcgcggggattggcca

SEQ ID NO: 231117 - DNA, 20 bp, human
ggcggcgggaaacccgaaag

SEQ ID NO: 231118 - DNA, 20 bp, human
gcggccgggaggatcggagg

SEQ ID NO: 231119 - DNA, 20 bp, human
ggagccgcccggctcggctt

SEQ ID NO: 231120 - DNA, 20 bp, human
gcggggattggccacggcgg

SEQ ID NO: 231121 - DNA, 20 bp, human
ggggaggaggcgaagaacgg

SEQ ID NO: 231122 - DNA, 20 bp, human
ggcgcccaagccgagccggg

SEQ ID NO: 231123 - DNA, 20 bp, human
gaaagtagcgaagaggcgaa

SEQ ID NO: 231124 - DNA, 20 bp, human
gggcgccgcgggaagaacct

SEQ ID NO: 231125 - DNA, 20 bp, human
ggggccccgggtgttcttgc

SEQ ID NO: 231126 - DNA, 20 bp, human
gagagcgcgcatgcctggtc

SEQ ID NO: 231127 - DNA, 20 bp, human
gaccctccctccaccggacc

SEQ ID NO: 231128 - DNA, 20 bp, human
gttgagtgagggcggaccag

SEQ ID NO: 231129 - DNA, 20 bp, human
gtccggtactcgcatctcct

SEQ ID NO: 231130 - DNA, 20 bp, human
gggagggtgccgggcgtcac

SEQ ID NO: 231131 - DNA, 20 bp, human
gcgcatgcctggtccggtgg

SEQ ID NO: 231132 - DNA, 20 bp, human
ggtgcaatggcgtgacagct

SEQ ID NO: 231133 - DNA, 20 bp, human
gactcgcgactccatctcac

SEQ ID NO: 231134 - DNA, 20 bp, human
ggggcgtcacaggtcctgac

SEQ ID NO: 231135 - DNA, 20 bp, human
gggatgagagagctgtggca

SEQ ID NO: 231136 - DNA, 20 bp, human
gccctggccaaggttctcaa

SEQ ID NO: 231137 - DNA, 20 bp, human
ggaccctggcggagccttaa

SEQ ID NO: 231138 - DNA, 20 bp, human
gctcctatgcccaatgtaag

SEQ ID NO: 231139 - DNA, 20 bp, human
gcagcggtgctggtgagcac

SEQ ID NO: 231140 - DNA, 20 bp, human
gggagcgcgcgggatggcag

SEQ ID NO: 231141 - DNA, 20 bp, human
ggtggtgagtggagagttgg

SEQ ID NO: 231142 - DNA, 20 bp, human
gtgcccttaaggctccgcca

SEQ ID NO: 231143 - DNA, 20 bp, human
gccggcccggggtgcgaatc

SEQ ID NO: 231144 - DNA, 20 bp, human
gcgcgggatggcagcggtgc

SEQ ID NO: 231145 - DNA, 20 bp, human
gcgtagctaggggatgctag

SEQ ID NO: 231146 - DNA, 20 bp, human
gaagagttggggaggcacga

SEQ ID NO: 231147 - DNA, 20 bp, human
gccctctgctgttcactcgg

SEQ ID NO: 231148 - DNA, 20 bp, human
gggtgagggccagaagagtt

SEQ ID NO: 231149 - DNA, 20 bp, human
ggcgaccaagcgcgaggctc

SEQ ID NO: 231150 - DNA, 20 bp, human
ggccccctctgctgttcact

SEQ ID NO: 231151 - DNA, 20 bp, human
gcagagggggctgttgggtg

SEQ ID NO: 231152 - DNA, 20 bp, human
gggcgggtctatagtgggaa

SEQ ID NO: 231153 - DNA, 20 bp, human
ggcggccagagcctcgcgct

SEQ ID NO: 231154 - DNA, 20 bp, human
ggcctcgcgcttggtcgcgt

SEQ ID NO: 231155 - DNA, 20 bp, human
gctcgggggcgggtctatag

SEQ ID NO: 231156 - DNA, 20 bp, human
gcccctggctattgcttcac

SEQ ID NO: 231157 - DNA, 20 bp, human
gtcctgtgaagcaatagcca

SEQ ID NO: 231158 - DNA, 20 bp, human
gagccagggatgggtggatc

SEQ ID NO: 231159 - DNA, 20 bp, human
gtaacgctcttgagcacccc

SEQ ID NO: 231160 - DNA, 20 bp, human
gacaatctccggtcaggtct

SEQ ID NO: 231161 - DNA, 20 bp, human
gttgcttcacaggacttgct

SEQ ID NO: 231162 - DNA, 20 bp, human
gctcaggctgggcataaagg

SEQ ID NO: 231163 - DNA, 20 bp, human
gatctccggtcaggtctggg

SEQ ID NO: 231164 - DNA, 20 bp, human
ggcgttaaatccctccagag

SEQ ID NO: 231165 - DNA, 20 bp, human
gctcatcttgcacacaagga

SEQ ID NO: 231166 - DNA, 20 bp, human
gcaccgccggggcctcgcac

SEQ ID NO: 231167 - DNA, 20 bp, human
gcgcctgtgcgaggccccgg

SEQ ID NO: 231168 - DNA, 20 bp, human
ggcagcgcgtgcgcggtccc

SEQ ID NO: 231169 - DNA, 20 bp, human
ggggagcgcgctcaccgccg

SEQ ID NO: 231170 - DNA, 20 bp, human
gctgcgcctgtgcgaggccc

SEQ ID NO: 231171 - DNA, 20 bp, human
gggcgccctggggacctcgt

SEQ ID NO: 231172 - DNA, 20 bp, human
gctgaggaaagcaacggggc

SEQ ID NO: 231173 - DNA, 20 bp, human
gagcccgcggcccaaagagg

SEQ ID NO: 231174 - DNA, 20 bp, human
gtcgacgctcactgcgcctg

SEQ ID NO: 231175 - DNA, 20 bp, human
gcctccccgcccgcttccgc

SEQ ID NO: 231176 - DNA, 20 bp, human
ggggaaggaggagacggcga

SEQ ID NO: 231177 - DNA, 20 bp, human
gggaagggcccggaatttta

SEQ ID NO: 231178 - DNA, 20 bp, human
gtctccccgctccgagggaa

SEQ ID NO: 231179 - DNA, 20 bp, human
gcccgccggagacgcagcag

SEQ ID NO: 231180 - DNA, 20 bp, human
ggagggacgagcaggacgag

SEQ ID NO: 231181 - DNA, 20 bp, human
ggtcacacgggcttggggga

SEQ ID NO: 231182 - DNA, 20 bp, human
gaggggtctccccgctccga

SEQ ID NO: 231183 - DNA, 20 bp, human
gtgtctcggtttagtcacac

SEQ ID NO: 231184 - DNA, 20 bp, human
gggaggagacggcgacggga

SEQ ID NO: 231185 - DNA, 20 bp, human
gcgtgcgggcatcgcgatgg

SEQ ID NO: 231186 - DNA, 20 bp, human
gcgcctaagggtagacactg

SEQ ID NO: 231187 - DNA, 20 bp, human
gggactgcggcgatggtgga

SEQ ID NO: 231188 - DNA, 20 bp, human
gcaggggcgcgccagggtcc

SEQ ID NO: 231189 - DNA, 20 bp, human
gccgcccccgaacccggacc

SEQ ID NO: 231190 - DNA, 20 bp, human
ggcggcctggactgcggcga

SEQ ID NO: 231191 - DNA, 20 bp, human
gagccccagtgtctaccctt

SEQ ID NO: 231192 - DNA, 20 bp, human
gtgcgctggcgacgctgcgt

SEQ ID NO: 231193 - DNA, 20 bp, human
gcgcgcctagcttactggaa

SEQ ID NO: 231194 - DNA, 20 bp, human
ggcgcgccagggtccgggtc

SEQ ID NO: 231195 - DNA, 20 bp, human
ggcagcgtcgccagcgcaag

SEQ ID NO: 231196 - DNA, 20 bp, human
gggtgcggggcgattggcgg

SEQ ID NO: 231197 - DNA, 20 bp, human
ggaggagcgtcctatccatc

SEQ ID NO: 231198 - DNA, 20 bp, human
gcaccacccaacggactgaa

SEQ ID NO: 231199 - DNA, 20 bp, human
gcccacgcacagctcccgtt

SEQ ID NO: 231200 - DNA, 20 bp, human
gcaggggtctcactactctc

SEQ ID NO: 231201 - DNA, 20 bp, human
gtggcggcgggagcgatgag

SEQ ID NO: 231202 - DNA, 20 bp, human
gtgggtggtgaccagccaat

SEQ ID NO: 231203 - DNA, 20 bp, human
ggccaatcgccccgcaccag

SEQ ID NO: 231204 - DNA, 20 bp, human
gagtagtgagacccctggtg

SEQ ID NO: 231205 - DNA, 20 bp, human
gcccaacggactgaaaggat

SEQ ID NO: 231206 - DNA, 20 bp, human
gcagagggactcggcttcta

SEQ ID NO: 231207 - DNA, 20 bp, human
ggcggggcctcccaattaag

SEQ ID NO: 231208 - DNA, 20 bp, human
gaacctggggtcagcacacg

SEQ ID NO: 231209 - DNA, 20 bp, human
gctcccaattaaggggatga

SEQ ID NO: 231210 - DNA, 20 bp, human
gccccgggaggtaagagcca

SEQ ID NO: 231211 - DNA, 20 bp, human
gtgctgggaagtccccaaaa

SEQ ID NO: 231212 - DNA, 20 bp, human
gccccagcgccggctgacag

SEQ ID NO: 231213 - DNA, 20 bp, human
gttacctcccggggtcccgc

SEQ ID NO: 231214 - DNA, 20 bp, human
gacacgtggagttctgggtg

SEQ ID NO: 231215 - DNA, 20 bp, human
gcaccagtgctggaacccga

SEQ ID NO: 231216 - DNA, 20 bp, human
gggcggcggggcgtacagaa

SEQ ID NO: 231217 - DNA, 20 bp, human
gggccctgagtggaagtgtc

SEQ ID NO: 231218 - DNA, 20 bp, human
gcgggcgctacggaaagcta

SEQ ID NO: 231219 - DNA, 20 bp, human
gcccgcccccggagcgaagg

SEQ ID NO: 231220 - DNA, 20 bp, human
ggcggcagacgcgggcgcta

SEQ ID NO: 231221 - DNA, 20 bp, human
gactctaaagcgacggttaa

SEQ ID NO: 231222 - DNA, 20 bp, human
gggcctccccacgcacgctg

SEQ ID NO: 231223 - DNA, 20 bp, human
ggcccccgcccccggagcga

SEQ ID NO: 231224 - DNA, 20 bp, human
ggctccgcactcgctcccta

SEQ ID NO: 231225 - DNA, 20 bp, human
gggagcgagacggccctgag

SEQ ID NO: 231226 - DNA, 20 bp, human
gtgcgctgtcagcagggcaa

SEQ ID NO: 231227 - DNA, 20 bp, human
gacggccaaggcgtgagcac

SEQ ID NO: 231228 - DNA, 20 bp, human
gccgccccgtgctcacgcct

SEQ ID NO: 231229 - DNA, 20 bp, human
gcagcccgcgcagctggcga

SEQ ID NO: 231230 - DNA, 20 bp, human
gcggcgctgcgctgtcagca

SEQ ID NO: 231231 - DNA, 20 bp, human
ggtagtgagctccccgtctc

SEQ ID NO: 231232 - DNA, 20 bp, human
gcctccctcgccagctgcgc

SEQ ID NO: 231233 - DNA, 20 bp, human
gaggggcgggcaagcatcgt

SEQ ID NO: 231234 - DNA, 20 bp, human
gggcacctacgggaataaca

SEQ ID NO: 231235 - DNA, 20 bp, human
gggagggaatatggcggcgc

SEQ ID NO: 231236 - DNA, 20 bp, human
gcgcctgcgcgctggaggag

SEQ ID NO: 231237 - DNA, 20 bp, human
gtgggcccagcagatctttt

SEQ ID NO: 231238 - DNA, 20 bp, human
gggccgctcctccagcgcgc

SEQ ID NO: 231239 - DNA, 20 bp, human
gggtccgcactggcacatga

SEQ ID NO: 231240 - DNA, 20 bp, human
gctgcgcgcggacggcgcga

SEQ ID NO: 231241 - DNA, 20 bp, human
gttggggtgggaggcattga

SEQ ID NO: 231242 - DNA, 20 bp, human
gggggcgcgagggtccgcac

SEQ ID NO: 231243 - DNA, 20 bp, human
gtcgggaggcccatgtaagg

SEQ ID NO: 231244 - DNA, 20 bp, human
ggaacgcgggcccagaggcg

SEQ ID NO: 231245 - DNA, 20 bp, human
ggggtgaaggctactaggga

SEQ ID NO: 231246 - DNA, 20 bp, human
gcccctacggctattcttcg

SEQ ID NO: 231247 - DNA, 20 bp, human
gcgtttgccccgtcagcgaa

SEQ ID NO: 231248 - DNA, 20 bp, human
gggagggcgggacttggcgc

SEQ ID NO: 231249 - DNA, 20 bp, human
ggccggccaaccggatgtcg

SEQ ID NO: 231250 - DNA, 20 bp, human
ggcaagccccgacatccggt

SEQ ID NO: 231251 - DNA, 20 bp, human
gccgcgcaagccccgacatc

SEQ ID NO: 231252 - DNA, 20 bp, human
gaatagccgtagggggcgta

SEQ ID NO: 231253 - DNA, 20 bp, human
gcttcgtggagtgtgaagat

SEQ ID NO: 231254 - DNA, 20 bp, human
ggatgcccacgccggccaac

SEQ ID NO: 231255 - DNA, 20 bp, human
gccgtagggggcgtatggga

SEQ ID NO: 231256 - DNA, 20 bp, human
gaggattggttacacagatg

SEQ ID NO: 231257 - DNA, 20 bp, human
ggctctttatgtgtagatca

SEQ ID NO: 231258 - DNA, 20 bp, human
ggatcttcatgaagtttgat

SEQ ID NO: 231259 - DNA, 20 bp, human
gtgtaaattagtgtatgaaa

SEQ ID NO: 231260 - DNA, 20 bp, human
gagttaaaagattccatttc

SEQ ID NO: 231261 - DNA, 20 bp, human
gaattagctgggagcgatag

SEQ ID NO: 231262 - DNA, 20 bp, human
gtcatacactaatttacagg

SEQ ID NO: 231263 - DNA, 20 bp, human
gaaccaatcctctctatatg

SEQ ID NO: 231264 - DNA, 20 bp, human
gatcctcatatagagaggat

SEQ ID NO: 231265 - DNA, 20 bp, human
gtttatgtgtagatcatgga

SEQ ID NO: 231266 - DNA, 20 bp, human
gaggggcggagtcacgagcg

SEQ ID NO: 231267 - DNA, 20 bp, human
gtctccggggcgtggcgaag

SEQ ID NO: 231268 - DNA, 20 bp, human
gagccgggccgctctctccg

SEQ ID NO: 231269 - DNA, 20 bp, human
ggcggcccggctctcacaga

SEQ ID NO: 231270 - DNA, 20 bp, human
gggcgggagcgacacgggga

SEQ ID NO: 231271 - DNA, 20 bp, human
gggtaggtaaagcggaacga

SEQ ID NO: 231272 - DNA, 20 bp, human
gctcaaggcgggagcgacac

SEQ ID NO: 231273 - DNA, 20 bp, human
gccagtgagggcccggaagt

SEQ ID NO: 231274 - DNA, 20 bp, human
gtcgctcccgccttgagggc

SEQ ID NO: 231275 - DNA, 20 bp, human
gagacttcctgcccagtcgc

SEQ ID NO: 231276 - DNA, 20 bp, human
gtgctccaggggagagtcgc

SEQ ID NO: 231277 - DNA, 20 bp, human
gagggagagcaaagccacgc

SEQ ID NO: 231278 - DNA, 20 bp, human
gtgtcagtcacgctgctcca

SEQ ID NO: 231279 - DNA, 20 bp, human
gaggaggggcagatgggccg

SEQ ID NO: 231280 - DNA, 20 bp, human
gaatacagacgagctgaggg

SEQ ID NO: 231281 - DNA, 20 bp, human
gagagcaaagccacgcgggt

SEQ ID NO: 231282 - DNA, 20 bp, human
gctcccagctgaataggagc

SEQ ID NO: 231283 - DNA, 20 bp, human
gtccaaatacagacgagctg

SEQ ID NO: 231284 - DNA, 20 bp, human
gcaggcaggctggcgttccc

SEQ ID NO: 231285 - DNA, 20 bp, human
gagcctgcctgccaagcgcc

SEQ ID NO: 231286 - DNA, 20 bp, human
gggaggctggggcgcccgaa

SEQ ID NO: 231287 - DNA, 20 bp, human
ggggcccggccggtctgagc

SEQ ID NO: 231288 - DNA, 20 bp, human
ggggtcctagaattgggcgt

SEQ ID NO: 231289 - DNA, 20 bp, human
gggcggggagcccctatggg

SEQ ID NO: 231290 - DNA, 20 bp, human
ggccgcccccggtgagtcag

SEQ ID NO: 231291 - DNA, 20 bp, human
gcccgaaagggtcctagaat

SEQ ID NO: 231292 - DNA, 20 bp, human
ggcgtgggaaggagggtata

SEQ ID NO: 231293 - DNA, 20 bp, human
gggcgccccagcctcccata

SEQ ID NO: 231294 - DNA, 20 bp, human
gtcctggccgcgcacctcca

SEQ ID NO: 231295 - DNA, 20 bp, human
ggacgcaccaagcacatagt

SEQ ID NO: 231296 - DNA, 20 bp, human
ggaagagcagtcactggggt

SEQ ID NO: 231297 - DNA, 20 bp, human
ggctccttccccagccggtg

SEQ ID NO: 231298 - DNA, 20 bp, human
ggatgtcccccgacagggag

SEQ ID NO: 231299 - DNA, 20 bp, human
gtgccaggccgtctcctcag

SEQ ID NO: 231300 - DNA, 20 bp, human
gtgcctgcccctccctgtcg

SEQ ID NO: 231301 - DNA, 20 bp, human
ggaggcgatgtcccccgaca

SEQ ID NO: 231302 - DNA, 20 bp, human
gactaacccagcagcggtgg

SEQ ID NO: 231303 - DNA, 20 bp, human
gtctcctcagaggggcacac

SEQ ID NO: 231304 - DNA, 20 bp, human
gccttccccagccggtgtgg

SEQ ID NO: 231305 - DNA, 20 bp, human
gatcgcctccacaccggctg

SEQ ID NO: 231306 - DNA, 20 bp, human
gagaccgtgccggagagata

SEQ ID NO: 231307 - DNA, 20 bp, human
ggcaccgcggggaacggagg

SEQ ID NO: 231308 - DNA, 20 bp, human
ggggctggggcgcggcggaa

SEQ ID NO: 231309 - DNA, 20 bp, human
gcggctctcccttatctctc

SEQ ID NO: 231310 - DNA, 20 bp, human
gggccagcgcggggggggat

SEQ ID NO: 231311 - DNA, 20 bp, human
gagccgagaggaagcggggt

SEQ ID NO: 231312 - DNA, 20 bp, human
gccctccctccgcaggccgg

SEQ ID NO: 231313 - DNA, 20 bp, human
ggcggggccgagattacctc

SEQ ID NO: 231314 - DNA, 20 bp, human
gtaaaaggcagagcagtccc

SEQ ID NO: 231315 - DNA, 20 bp, human
ggctccccggggaacgcagg

SEQ ID NO: 231316 - DNA, 20 bp, human
gaaagcgccacggacgtcgg

SEQ ID NO: 231317 - DNA, 20 bp, human
gcaaccgggcgtggggtctc

SEQ ID NO: 231318 - DNA, 20 bp, human
gcggaggccgggatagccct

SEQ ID NO: 231319 - DNA, 20 bp, human
ggccctccgggtatgagcgg

SEQ ID NO: 231320 - DNA, 20 bp, human
gcggcccgctagtctcccat

SEQ ID NO: 231321 - DNA, 20 bp, human
ggggtctcgggtcacgtgac

SEQ ID NO: 231322 - DNA, 20 bp, human
gcccaatcgcactcgcgcga

SEQ ID NO: 231323 - DNA, 20 bp, human
gacggacgtcggaggcccag

SEQ ID NO: 231324 - DNA, 20 bp, human
gcccgagctccgctctttcg

SEQ ID NO: 231325 - DNA, 20 bp, human
gccggccctccgggtatgag

SEQ ID NO: 231326 - DNA, 20 bp, human
ggactgggacctaccctgat

SEQ ID NO: 231327 - DNA, 20 bp, human
gtagccctcagctgggtaag

SEQ ID NO: 231328 - DNA, 20 bp, human
gggtggaggctgtgcaaggc

SEQ ID NO: 231329 - DNA, 20 bp, human
gtatcacggtcatcccatca

SEQ ID NO: 231330 - DNA, 20 bp, human
ggggtcatctgtccctaaag

SEQ ID NO: 231331 - DNA, 20 bp, human
gggatgaccgtgatacagtg

SEQ ID NO: 231332 - DNA, 20 bp, human
ggggaaggcagctgttaaac

SEQ ID NO: 231333 - DNA, 20 bp, human
gctgagggctacccgcttta

SEQ ID NO: 231334 - DNA, 20 bp, human
gaggggctgggttactgaga

SEQ ID NO: 231335 - DNA, 20 bp, human
gtgggctgaaaaaaagggac

SEQ ID NO: 231336 - DNA, 20 bp, human
ggctagatggagaatctaga

SEQ ID NO: 231337 - DNA, 20 bp, human
gccccagcaggcagacattc

SEQ ID NO: 231338 - DNA, 20 bp, human
gccacccaggtccactacag

SEQ ID NO: 231339 - DNA, 20 bp, human
gaagaggcagtcccctggag

SEQ ID NO: 231340 - DNA, 20 bp, human
gtctagctccgcaccccagc

SEQ ID NO: 231341 - DNA, 20 bp, human
gaccgactggtgtcccatct

SEQ ID NO: 231342 - DNA, 20 bp, human
gcatctctgctccagtgcca

SEQ ID NO: 231343 - DNA, 20 bp, human
gtccctgaatgtctgcctgc

SEQ ID NO: 231344 - DNA, 20 bp, human
gcggtgccaggtggaccgac

SEQ ID NO: 231345 - DNA, 20 bp, human
gggcagtcccctggagagga

SEQ ID NO: 231346 - DNA, 20 bp, human
gaatcgcgtggggtctaggt

SEQ ID NO: 231347 - DNA, 20 bp, human
ggccccgcgaggatgagccc

SEQ ID NO: 231348 - DNA, 20 bp, human
ggccctgggctcatcctcgc

SEQ ID NO: 231349 - DNA, 20 bp, human
ggaggaatcgcgtggggtct

SEQ ID NO: 231350 - DNA, 20 bp, human
gctgtgtgggacggggtctc

SEQ ID NO: 231351 - DNA, 20 bp, human
ggctcggcaccaccaggtag

SEQ ID NO: 231352 - DNA, 20 bp, human
gggggcaggtcaggtctcgg

SEQ ID NO: 231353 - DNA, 20 bp, human
gggcctgtctaggcagggat

SEQ ID NO: 231354 - DNA, 20 bp, human
ggctcatcctcgcggggcgg

SEQ ID NO: 231355 - DNA, 20 bp, human
gctcaggtgaggaatcgcgt

SEQ ID NO: 231356 - DNA, 20 bp, human
gtaaggcagagataggcttg

SEQ ID NO: 231357 - DNA, 20 bp, human
gggcagagataggcttgggg

SEQ ID NO: 231358 - DNA, 20 bp, human
gaggcttggggcggagaatc

SEQ ID NO: 231359 - DNA, 20 bp, human
ggccaagaaacgggcagctt

SEQ ID NO: 231360 - DNA, 20 bp, human
gcgggcagcttaggggcccc

SEQ ID NO: 231361 - DNA, 20 bp, human
gtgacttcagcattgggcag

SEQ ID NO: 231362 - DNA, 20 bp, human
ggcagtggcctgccacctct

SEQ ID NO: 231363 - DNA, 20 bp, human
gccctaagctgcccgtttct

SEQ ID NO: 231364 - DNA, 20 bp, human
gagggaagcaaccttccttc

SEQ ID NO: 231365 - DNA, 20 bp, human
ggtagaacacattaactcct

SEQ ID NO: 231366 - DNA, 20 bp, human
gtagctgtcaatgaggatct

SEQ ID NO: 231367 - DNA, 20 bp, human
ggacaaattagctgtcaatg

SEQ ID NO: 231368 - DNA, 20 bp, human
gcatctgagaaaggccctgg

SEQ ID NO: 231369 - DNA, 20 bp, human
ggcacatctgagaaaggccc

SEQ ID NO: 231370 - DNA, 20 bp, human
ggatgtggcacatctgagaa

SEQ ID NO: 231371 - DNA, 20 bp, human
gcagaaagaatttactgaag

SEQ ID NO: 231372 - DNA, 20 bp, human
gagcctcaagacaggatccc

SEQ ID NO: 231373 - DNA, 20 bp, human
gtcccggggatcctgtcttg

SEQ ID NO: 231374 - DNA, 20 bp, human
ggtttaccatacctgctaaa

SEQ ID NO: 231375 - DNA, 20 bp, human
gccatgcataaggttcactt

SEQ ID NO: 231376 - DNA, 20 bp, human
ggaagggagtggagtaccca

SEQ ID NO: 231377 - DNA, 20 bp, human
gaatctctgtcttggttctt

SEQ ID NO: 231378 - DNA, 20 bp, human
gaggtggggtcgcaaattct

SEQ ID NO: 231379 - DNA, 20 bp, human
ggtacccagggctttgcgac

SEQ ID NO: 231380 - DNA, 20 bp, human
gtggtgtcctgggagttgtg

SEQ ID NO: 231381 - DNA, 20 bp, human
gggggaggaaccaaggtcct

SEQ ID NO: 231382 - DNA, 20 bp, human
ggaaacaggctttctctgta

SEQ ID NO: 231383 - DNA, 20 bp, human
gacctgaaagtaccctcccc

SEQ ID NO: 231384 - DNA, 20 bp, human
gccctggggagggtactttc

SEQ ID NO: 231385 - DNA, 20 bp, human
gttagcaggaaacatccctg

SEQ ID NO: 231386 - DNA, 20 bp, human
gaagtggcccgggcggtcgg

SEQ ID NO: 231387 - DNA, 20 bp, human
gcggcgccgcgcagccctgt

SEQ ID NO: 231388 - DNA, 20 bp, human
ggggctgcgcggcgccgacg

SEQ ID NO: 231389 - DNA, 20 bp, human
gccggactacggctcccaca

SEQ ID NO: 231390 - DNA, 20 bp, human
gacggggcggaagctcgggg

SEQ ID NO: 231391 - DNA, 20 bp, human
gccgacggggcggaagctcg

SEQ ID NO: 231392 - DNA, 20 bp, human
gcggccgtctccagcagcga

SEQ ID NO: 231393 - DNA, 20 bp, human
ggcaggagaagtggcccggg

SEQ ID NO: 231394 - DNA, 20 bp, human
gctgcgcggcgccgacgggg

SEQ ID NO: 231395 - DNA, 20 bp, human
ggggagttgtagtcctcggg

SEQ ID NO: 231396 - DNA, 20 bp, human
ggggccgggccgcttccctc

SEQ ID NO: 231397 - DNA, 20 bp, human
ggggccggtgctgccatctg

SEQ ID NO: 231398 - DNA, 20 bp, human
gcgccgggccgcgccatccc

SEQ ID NO: 231399 - DNA, 20 bp, human
ggaatcgcggtccagagttg

SEQ ID NO: 231400 - DNA, 20 bp, human
ggccgggaacgccgcgaccc

SEQ ID NO: 231401 - DNA, 20 bp, human
gccgggaccaggccatcctg

SEQ ID NO: 231402 - DNA, 20 bp, human
ggctgcgagcgatgattcac

SEQ ID NO: 231403 - DNA, 20 bp, human
gccccgggtcgcggcgttcc

SEQ ID NO: 231404 - DNA, 20 bp, human
ggcgagcgatgattcaccgg

SEQ ID NO: 231405 - DNA, 20 bp, human
gcccgggagctgtccgcaga

SEQ ID NO: 231406 - DNA, 20 bp, human
gcagcagcatgcatgccaga

SEQ ID NO: 231407 - DNA, 20 bp, human
gaaaagggagtatctgagta

SEQ ID NO: 231408 - DNA, 20 bp, human
gagtgagggttgtgtttcag

SEQ ID NO: 231409 - DNA, 20 bp, human
ggcatggtagagagagaacc

SEQ ID NO: 231410 - DNA, 20 bp, human
gttgatggccagtagttggg

SEQ ID NO: 231411 - DNA, 20 bp, human
gaacagaaatgtccctagcc

SEQ ID NO: 231412 - DNA, 20 bp, human
gctactggccatcaaatgaa

SEQ ID NO: 231413 - DNA, 20 bp, human
gttcttgggtcagcgctcat

SEQ ID NO: 231414 - DNA, 20 bp, human
gtgctgacatgttattgagt

SEQ ID NO: 231415 - DNA, 20 bp, human
gatacagaccacccaactac

SEQ ID NO: 231416 - DNA, 20 bp, human
gccaccgcaccagtgcgcat

SEQ ID NO: 231417 - DNA, 20 bp, human
gccacgggagaccacgcctc

SEQ ID NO: 231418 - DNA, 20 bp, human
ggggcggccgctcagaggag

SEQ ID NO: 231419 - DNA, 20 bp, human
ggcgcccatgcgcactggtg

SEQ ID NO: 231420 - DNA, 20 bp, human
gcccatgggcagcctcccaa

SEQ ID NO: 231421 - DNA, 20 bp, human
gaacgagggcccgaccgagc

SEQ ID NO: 231422 - DNA, 20 bp, human
gcggcacccaccgcctctac

SEQ ID NO: 231423 - DNA, 20 bp, human
ggggtgggcggcccggtggc

SEQ ID NO: 231424 - DNA, 20 bp, human
gcacgcctccggctcgcaac

SEQ ID NO: 231425 - DNA, 20 bp, human
gcatgggcgcacccggccac

SEQ ID NO: 231426 - DNA, 20 bp, human
ggtaccaagctctgctcaca

SEQ ID NO: 231427 - DNA, 20 bp, human
ggcctcgcagcaacttcagg

SEQ ID NO: 231428 - DNA, 20 bp, human
gccgtctgcacatctggtag

SEQ ID NO: 231429 - DNA, 20 bp, human
gggcatcccgtctgcacatc

SEQ ID NO: 231430 - DNA, 20 bp, human
gaaactgatcctgagtcatg

SEQ ID NO: 231431 - DNA, 20 bp, human
ggcctcctgaagttgctgcg

SEQ ID NO: 231432 - DNA, 20 bp, human
gggtgcctcgcagcaacttc

SEQ ID NO: 231433 - DNA, 20 bp, human
gagtttctgactgctgggcg

SEQ ID NO: 231434 - DNA, 20 bp, human
gagaaataagactttcagcg

SEQ ID NO: 231435 - DNA, 20 bp, human
ggagagaagggattgttaag

SEQ ID NO: 231436 - DNA, 20 bp, human
ggcgacggtcacgtgcacag

SEQ ID NO: 231437 - DNA, 20 bp, human
gtgtgtgggcagctcggacg

SEQ ID NO: 231438 - DNA, 20 bp, human
ggcccgggattgagcagctg

SEQ ID NO: 231439 - DNA, 20 bp, human
gcacgcataaggcggtgtgt

SEQ ID NO: 231440 - DNA, 20 bp, human
ggccaccgccacgcataagg

SEQ ID NO: 231441 - DNA, 20 bp, human
gcgtgaccgtcgcggcgccc

SEQ ID NO: 231442 - DNA, 20 bp, human
gtcggcggccccagcttcta

SEQ ID NO: 231443 - DNA, 20 bp, human
gccgcgggggcggggcaaaa

SEQ ID NO: 231444 - DNA, 20 bp, human
gcggtcacgtgcacagcggc

SEQ ID NO: 231445 - DNA, 20 bp, human
gaccgccaccgccacgcata

SEQ ID NO: 231446 - DNA, 20 bp, human
ggcagattggcctggacctt

SEQ ID NO: 231447 - DNA, 20 bp, human
gaggaagtgagtcatggcca

SEQ ID NO: 231448 - DNA, 20 bp, human
ggggagctataaggcactaa

SEQ ID NO: 231449 - DNA, 20 bp, human
gggtggggtcaagatcctaa

SEQ ID NO: 231450 - DNA, 20 bp, human
gagggacaaatatgtaccca

SEQ ID NO: 231451 - DNA, 20 bp, human
gccagagagtagtgattcac

SEQ ID NO: 231452 - DNA, 20 bp, human
gcactgggaggggagctata

SEQ ID NO: 231453 - DNA, 20 bp, human
ggccatgactcacttccttc

SEQ ID NO: 231454 - DNA, 20 bp, human
gactcacttccttctggaac

SEQ ID NO: 231455 - DNA, 20 bp, human
gtataaggcactaaaggagg

SEQ ID NO: 231456 - DNA, 20 bp, human
ggagctgcctctgagtctgc

SEQ ID NO: 231457 - DNA, 20 bp, human
gaacagctcagagggccact

SEQ ID NO: 231458 - DNA, 20 bp, human
gtcaagaaggaacagctcag

SEQ ID NO: 231459 - DNA, 20 bp, human
gtgtcccatctcagtctaac

SEQ ID NO: 231460 - DNA, 20 bp, human
ggtgcccagaaaataggtgg

SEQ ID NO: 231461 - DNA, 20 bp, human
gggtccaggaggtggcttta

SEQ ID NO: 231462 - DNA, 20 bp, human
gggggcctcatgggagagag

SEQ ID NO: 231463 - DNA, 20 bp, human
gcctctgcttagtgcgctca

SEQ ID NO: 231464 - DNA, 20 bp, human
gcctctgagtggaatgtgcc

SEQ ID NO: 231465 - DNA, 20 bp, human
gctccctgttagactgagat

SEQ ID NO: 231466 - DNA, 20 bp, human
ggcatactgaggacactctt

SEQ ID NO: 231467 - DNA, 20 bp, human
ggtccaggaaggaatgattc

SEQ ID NO: 231468 - DNA, 20 bp, human
gcgctggaaacgcgtagggc

SEQ ID NO: 231469 - DNA, 20 bp, human
gcgcccggctagctggatcc

SEQ ID NO: 231470 - DNA, 20 bp, human
gcagctagccgggcggtgtg

SEQ ID NO: 231471 - DNA, 20 bp, human
gccggcgctggaaacgcgta

SEQ ID NO: 231472 - DNA, 20 bp, human
gagggcggggccggtgactc

SEQ ID NO: 231473 - DNA, 20 bp, human
ggactcaggccgcaactctc

SEQ ID NO: 231474 - DNA, 20 bp, human
gggtgcacgcgtgaagggga

SEQ ID NO: 231475 - DNA, 20 bp, human
gtgggggtctgagtttgcga

SEQ ID NO: 231476 - DNA, 20 bp, human
ggaactcaggtatcttcagt

SEQ ID NO: 231477 - DNA, 20 bp, human
gaggccttgtaaaatatggc

SEQ ID NO: 231478 - DNA, 20 bp, human
gctaggacctcatggaactc

SEQ ID NO: 231479 - DNA, 20 bp, human
gggcgtggtgcagtgtaagc

SEQ ID NO: 231480 - DNA, 20 bp, human
gatagtatgtaggacacctt

SEQ ID NO: 231481 - DNA, 20 bp, human
gtgtgaaacatcacatcatg

SEQ ID NO: 231482 - DNA, 20 bp, human
gattgaggccttgtaaaata

SEQ ID NO: 231483 - DNA, 20 bp, human
gagttcaagtagtttacatg

SEQ ID NO: 231484 - DNA, 20 bp, human
gtttttaggtgctgagacag

SEQ ID NO: 231485 - DNA, 20 bp, human
gagtttacatgtggaagaac

SEQ ID NO: 231486 - DNA, 20 bp, human
gcccctccgaccctggtcgc

SEQ ID NO: 231487 - DNA, 20 bp, human
gtggggcgcctcctggacgc

SEQ ID NO: 231488 - DNA, 20 bp, human
gggacggcggagaagctagc

SEQ ID NO: 231489 - DNA, 20 bp, human
gaggaggcgccccacagcgc

SEQ ID NO: 231490 - DNA, 20 bp, human
ggcgcctcctggacgcaggt

SEQ ID NO: 231491 - DNA, 20 bp, human
gcccggcaaggccgaaggaa

SEQ ID NO: 231492 - DNA, 20 bp, human
gatggccccggcaaggccga

SEQ ID NO: 231493 - DNA, 20 bp, human
gacgcccaaacggggacaat

SEQ ID NO: 231494 - DNA, 20 bp, human
gggtggggatggccccggca

SEQ ID NO: 231495 - DNA, 20 bp, human
gcggcggagaagctagcggg

SEQ ID NO: 231496 - DNA, 20 bp, human
gtgccccgcaatctgcgcaa

SEQ ID NO: 231497 - DNA, 20 bp, human
gctggtggtaggtcgggaga

SEQ ID NO: 231498 - DNA, 20 bp, human
gtgggcgcgagcggctgagt

SEQ ID NO: 231499 - DNA, 20 bp, human
gaaggagcaccggaaggagg

SEQ ID NO: 231500 - DNA, 20 bp, human
gaacacccgacaagcgctgg

SEQ ID NO: 231501 - DNA, 20 bp, human
gtcctcgcccgcggcctctg

SEQ ID NO: 231502 - DNA, 20 bp, human
gcttgtcgggtgttagttcc

SEQ ID NO: 231503 - DNA, 20 bp, human
ggggcgggcctgggcgcgag

SEQ ID NO: 231504 - DNA, 20 bp, human
gggaggcaggagcgctgcgg

SEQ ID NO: 231505 - DNA, 20 bp, human
gccgaggcgacgccgaacgc

SEQ ID NO: 231506 - DNA, 20 bp, human
gatgcagtgccacagggatc

SEQ ID NO: 231507 - DNA, 20 bp, human
gtccctctctggcttcacag

SEQ ID NO: 231508 - DNA, 20 bp, human
gggcttctcagcccgagcca

SEQ ID NO: 231509 - DNA, 20 bp, human
gctggatggagacaagtccg

SEQ ID NO: 231510 - DNA, 20 bp, human
gggagacaagtccgtggctg

SEQ ID NO: 231511 - DNA, 20 bp, human
gggcagttgagtaagcagtc

SEQ ID NO: 231512 - DNA, 20 bp, human
gtcctccttggagccaggaa

SEQ ID NO: 231513 - DNA, 20 bp, human
gagtggccggtcagaacctg

SEQ ID NO: 231514 - DNA, 20 bp, human
gcaacaaaaatgccccaggt

SEQ ID NO: 231515 - DNA, 20 bp, human
gggggctgaaatgccctgga

SEQ ID NO: 231516 - DNA, 20 bp, human
gccagtgacctgccaatcta

SEQ ID NO: 231517 - DNA, 20 bp, human
gctcccggaaggagaaaggg

SEQ ID NO: 231518 - DNA, 20 bp, human
gacggccagcgcgtgcgcac

SEQ ID NO: 231519 - DNA, 20 bp, human
ggccgcaaggcccttcgccc

SEQ ID NO: 231520 - DNA, 20 bp, human
gccccctactgccaggggta

SEQ ID NO: 231521 - DNA, 20 bp, human
ggattggcaggtcactggga

SEQ ID NO: 231522 - DNA, 20 bp, human
gagggaggggagagtgggta

SEQ ID NO: 231523 - DNA, 20 bp, human
gccgcctcccggaaggagaa

SEQ ID NO: 231524 - DNA, 20 bp, human
ggtgacctgccaatctacgg

SEQ ID NO: 231525 - DNA, 20 bp, human
gaaaacgccccctactgcca

SEQ ID NO: 231526 - DNA, 20 bp, human
gaatctgcagcagtgatccc

SEQ ID NO: 231527 - DNA, 20 bp, human
gaatactaagagagtggacc

SEQ ID NO: 231528 - DNA, 20 bp, human
gtcactgtcaatctctactc

SEQ ID NO: 231529 - DNA, 20 bp, human
gtgccagcaaaacttctggc

SEQ ID NO: 231530 - DNA, 20 bp, human
gccattgccagcaaaacttc

SEQ ID NO: 231531 - DNA, 20 bp, human
gcctagcagtaagctttctg

SEQ ID NO: 231532 - DNA, 20 bp, human
gccactctcttagtattaat

SEQ ID NO: 231533 - DNA, 20 bp, human
ggcttctctcccagtgcaaa

SEQ ID NO: 231534 - DNA, 20 bp, human
gagcaggcaggggtaattat

SEQ ID NO: 231535 - DNA, 20 bp, human
gggactacagaaggacagga

SEQ ID NO: 231536 - DNA, 20 bp, human
ggcccgcgccccaggaagta

SEQ ID NO: 231537 - DNA, 20 bp, human
gggaaatgagtgtaactcat

SEQ ID NO: 231538 - DNA, 20 bp, human
gctcccgcgcataactgaca

SEQ ID NO: 231539 - DNA, 20 bp, human
gaaggcaaaccctacttcct

SEQ ID NO: 231540 - DNA, 20 bp, human
gccggaaacgccgaccaaga

SEQ ID NO: 231541 - DNA, 20 bp, human
ggctgccagcgcccattaga

SEQ ID NO: 231542 - DNA, 20 bp, human
ggccccatgtcagttatgcg

SEQ ID NO: 231543 - DNA, 20 bp, human
gcggcagctggaacgatcgg

SEQ ID NO: 231544 - DNA, 20 bp, human
gtccgggcgggtccttccga

SEQ ID NO: 231545 - DNA, 20 bp, human
gcgggaagaaagccgagtga

SEQ ID NO: 231546 - DNA, 20 bp, human
gtccgcgagggccgggtcga

SEQ ID NO: 231547 - DNA, 20 bp, human
gagccgcgctcagtccgcga

SEQ ID NO: 231548 - DNA, 20 bp, human
gcgggcgcctggtggccggg

SEQ ID NO: 231549 - DNA, 20 bp, human
gagccccgcctccctcgacc

SEQ ID NO: 231550 - DNA, 20 bp, human
gctccccactgtgaccatat

SEQ ID NO: 231551 - DNA, 20 bp, human
gtgcgcgggcgcctggtggc

SEQ ID NO: 231552 - DNA, 20 bp, human
gggccctcgcggactgagcg

SEQ ID NO: 231553 - DNA, 20 bp, human
gctcccggggtgcgcgtgcg

SEQ ID NO: 231554 - DNA, 20 bp, human
gtgagcccatatggtcacag

SEQ ID NO: 231555 - DNA, 20 bp, human
gagggaggggcccgccgctc

SEQ ID NO: 231556 - DNA, 20 bp, human
gtcgaagaagactgttcagg

SEQ ID NO: 231557 - DNA, 20 bp, human
ggaacagtcttcttcgaaag

SEQ ID NO: 231558 - DNA, 20 bp, human
gggctgggcaccacactgtc

SEQ ID NO: 231559 - DNA, 20 bp, human
gcaaaagaggtatagctggt

SEQ ID NO: 231560 - DNA, 20 bp, human
gagtagctgcccaaacccac

SEQ ID NO: 231561 - DNA, 20 bp, human
ggcaacttcaggaatcacaa

SEQ ID NO: 231562 - DNA, 20 bp, human
gtcttcaaaagaggtatagc

SEQ ID NO: 231563 - DNA, 20 bp, human
gggaaaaatgccagacatca

SEQ ID NO: 231564 - DNA, 20 bp, human
gagaagccaaacagtttcaa

SEQ ID NO: 231565 - DNA, 20 bp, human
gtgacagtcacctgacagtg

SEQ ID NO: 231566 - DNA, 20 bp, human
gaacccgtgccggggactcc

SEQ ID NO: 231567 - DNA, 20 bp, human
ggatcgccaagtatggagag

SEQ ID NO: 231568 - DNA, 20 bp, human
gcccgcccgcggggactgtg

SEQ ID NO: 231569 - DNA, 20 bp, human
gccccgcccccgcaccccgt

SEQ ID NO: 231570 - DNA, 20 bp, human
gccggcccgcaacccgtgcc

SEQ ID NO: 231571 - DNA, 20 bp, human
gtgagcgcgtgcacggggtg

SEQ ID NO: 231572 - DNA, 20 bp, human
gctgcggcgatcgccaagta

SEQ ID NO: 231573 - DNA, 20 bp, human
gggccgcgagctggcggcgt

SEQ ID NO: 231574 - DNA, 20 bp, human
gcgagaggcgggcgccgacg

SEQ ID NO: 231575 - DNA, 20 bp, human
ggacccggatgttcactcct

SEQ ID NO: 231576 - DNA, 20 bp, human
ggggccggacgcacgacccg

SEQ ID NO: 231577 - DNA, 20 bp, human
ggcccggggaaggtgtgtcg

SEQ ID NO: 231578 - DNA, 20 bp, human
ggatgcgcgtggcccgggga

SEQ ID NO: 231579 - DNA, 20 bp, human
gcggcgggaaacaggaagca

SEQ ID NO: 231580 - DNA, 20 bp, human
gccggacgcacgacccgggg

SEQ ID NO: 231581 - DNA, 20 bp, human
gcgccgcgacacaccttccc

SEQ ID NO: 231582 - DNA, 20 bp, human
gtggagagccggcgggaaac

SEQ ID NO: 231583 - DNA, 20 bp, human
gggacgcgcggggtggccgg

SEQ ID NO: 231584 - DNA, 20 bp, human
gcgggcgcgctgtgggcgtg

SEQ ID NO: 231585 - DNA, 20 bp, human
ggctctccagcccggctcgg

SEQ ID NO: 231586 - DNA, 20 bp, human
gggtgcttggggacagatca

SEQ ID NO: 231587 - DNA, 20 bp, human
gagtcggtgcttcgggagga

SEQ ID NO: 231588 - DNA, 20 bp, human
gggggcggagtcggtgcttc

SEQ ID NO: 231589 - DNA, 20 bp, human
ggccgggggtgggggtgctt

SEQ ID NO: 231590 - DNA, 20 bp, human
ggcggagtcggtgcttcggg

SEQ ID NO: 231591 - DNA, 20 bp, human
ggggaaatgcaaaacccgac

SEQ ID NO: 231592 - DNA, 20 bp, human
gcagcccacctgcatcagtc

SEQ ID NO: 231593 - DNA, 20 bp, human
gggtgaggctggaccagtct

SEQ ID NO: 231594 - DNA, 20 bp, human
gtggggactgatgcccagac

SEQ ID NO: 231595 - DNA, 20 bp, human
gcttcgggaggagggcggca

SEQ ID NO: 231596 - DNA, 20 bp, human
ggccgtaagaaccacaggga

SEQ ID NO: 231597 - DNA, 20 bp, human
gaggagcagtgccttatatg

SEQ ID NO: 231598 - DNA, 20 bp, human
ggactgcactggtgcttcga

SEQ ID NO: 231599 - DNA, 20 bp, human
gggtgattgagggtgattga

SEQ ID NO: 231600 - DNA, 20 bp, human
gtgtgggtcgaccagatgca

SEQ ID NO: 231601 - DNA, 20 bp, human
gctggtcgacccacagaaga

SEQ ID NO: 231602 - DNA, 20 bp, human
gctgaatgtggcccaatctc

SEQ ID NO: 231603 - DNA, 20 bp, human
gcacagaagatggtgattga

SEQ ID NO: 231604 - DNA, 20 bp, human
gtacggcaatgtctagctgt

SEQ ID NO: 231605 - DNA, 20 bp, human
gtggctgaactgaacggcag

SEQ ID NO: 231606 - DNA, 20 bp, human
gagctgtgaggtggggtcaa

SEQ ID NO: 231607 - DNA, 20 bp, human
gcatcagagagtgtatccaa

SEQ ID NO: 231608 - DNA, 20 bp, human
gtccccaaagctgtgaggtg

SEQ ID NO: 231609 - DNA, 20 bp, human
gggcttagagaataagcccc

SEQ ID NO: 231610 - DNA, 20 bp, human
ggaccccacctcacagcttt

SEQ ID NO: 231611 - DNA, 20 bp, human
gcagctttggggaaagtttg

SEQ ID NO: 231612 - DNA, 20 bp, human
gacatactttctcaatcctg

SEQ ID NO: 231613 - DNA, 20 bp, human
ggtcaagttttcgaatgaat

SEQ ID NO: 231614 - DNA, 20 bp, human
gggagaaaaaagaattccct

SEQ ID NO: 231615 - DNA, 20 bp, human
gacagttctgattctttctc

SEQ ID NO: 231616 - DNA, 20 bp, human
gctaccctgacttgttcaaa

SEQ ID NO: 231617 - DNA, 20 bp, human
gtgaacaagtcagggtagga

SEQ ID NO: 231618 - DNA, 20 bp, human
gccctgccaaaatgtataaa

SEQ ID NO: 231619 - DNA, 20 bp, human
gccagccctttgaacaagtc

SEQ ID NO: 231620 - DNA, 20 bp, human
gtttgaaccactgctctcct

SEQ ID NO: 231621 - DNA, 20 bp, human
gattcagattcctgaactgt

SEQ ID NO: 231622 - DNA, 20 bp, human
gggagtgcagtggcactaac

SEQ ID NO: 231623 - DNA, 20 bp, human
gaaaaaaaatctgaaaagga

SEQ ID NO: 231624 - DNA, 20 bp, human
ggaattttattctgtcacac

SEQ ID NO: 231625 - DNA, 20 bp, human
gtgaagtaaaattgtttcac

SEQ ID NO: 231626 - DNA, 20 bp, human
ggtgggtgagaaacaagaat

SEQ ID NO: 231627 - DNA, 20 bp, human
gggtaaagcaattttcttat

SEQ ID NO: 231628 - DNA, 20 bp, human
gcaattgtgtaaaaatacct

SEQ ID NO: 231629 - DNA, 20 bp, human
gagctctatccttttaggca

SEQ ID NO: 231630 - DNA, 20 bp, human
gttgctttaccattccttgg

SEQ ID NO: 231631 - DNA, 20 bp, human
gtgaactggatactgtaaaa

SEQ ID NO: 231632 - DNA, 20 bp, human
ggttgccagggactgatgga

SEQ ID NO: 231633 - DNA, 20 bp, human
gaactcttagtacttgattt

SEQ ID NO: 231634 - DNA, 20 bp, human
gtacagttggatgatattga

SEQ ID NO: 231635 - DNA, 20 bp, human
gcaatagttaacagcttctt

SEQ ID NO: 231636 - DNA, 20 bp, human
gtcaccatgactcagaccca

SEQ ID NO: 231637 - DNA, 20 bp, human
gacagtggggcaacccagct

SEQ ID NO: 231638 - DNA, 20 bp, human
gcggagcactctctgatccg

SEQ ID NO: 231639 - DNA, 20 bp, human
gttcaagagcgacttcttgg

SEQ ID NO: 231640 - DNA, 20 bp, human
gaaataatccacaaggaccc

SEQ ID NO: 231641 - DNA, 20 bp, human
gctctgatccggggtccttg

SEQ ID NO: 231642 - DNA, 20 bp, human
gtcagagagtgctccgagct

SEQ ID NO: 231643 - DNA, 20 bp, human
gttgaacttcaggttggact

SEQ ID NO: 231644 - DNA, 20 bp, human
ggacaaagaacaattctatt

SEQ ID NO: 231645 - DNA, 20 bp, human
gtgcagatacaagcacagtg

SEQ ID NO: 231646 - DNA, 20 bp, human
gaggctgtcggaaagggaaa

SEQ ID NO: 231647 - DNA, 20 bp, human
gaaagggagaagttcctatg

SEQ ID NO: 231648 - DNA, 20 bp, human
gcctatgaggctgtcggaaa

SEQ ID NO: 231649 - DNA, 20 bp, human
gttggtcacttgagaagaaa

SEQ ID NO: 231650 - DNA, 20 bp, human
gcaaaggtgacattagtctg

SEQ ID NO: 231651 - DNA, 20 bp, human
ggccacaggatcaggcacaa

SEQ ID NO: 231652 - DNA, 20 bp, human
gaattaaaacaacttgagta

SEQ ID NO: 231653 - DNA, 20 bp, human
gggtgacattagtctgaggt

SEQ ID NO: 231654 - DNA, 20 bp, human
gttttgttttcaacaagcgg

SEQ ID NO: 231655 - DNA, 20 bp, human
ggttttgacaggattttcct

SEQ ID NO: 231656 - DNA, 20 bp, human
gatggctgtgggcagtcaat

SEQ ID NO: 231657 - DNA, 20 bp, human
gttcctgcccacattaaaga

SEQ ID NO: 231658 - DNA, 20 bp, human
gatctgggccatctttaatg

SEQ ID NO: 231659 - DNA, 20 bp, human
gtagtggtaacagctgagag

SEQ ID NO: 231660 - DNA, 20 bp, human
gtaacgctcgcagaggaggt

SEQ ID NO: 231661 - DNA, 20 bp, human
ggaaataacgctcgcagagg

SEQ ID NO: 231662 - DNA, 20 bp, human
gttgcatgagaatgcatagc

SEQ ID NO: 231663 - DNA, 20 bp, human
gtttgaaataacgctcgcag

SEQ ID NO: 231664 - DNA, 20 bp, human
gtgggctttctgagaactga

SEQ ID NO: 231665 - DNA, 20 bp, human
gctgagggaagtaagctctc

SEQ ID NO: 231666 - DNA, 20 bp, human
gcccaagaggcagacggaag

SEQ ID NO: 231667 - DNA, 20 bp, human
ggtcccgccagtcctcccac

SEQ ID NO: 231668 - DNA, 20 bp, human
ggggactgtccccctgtggg

SEQ ID NO: 231669 - DNA, 20 bp, human
gcgcctgtgcacttcctgat

SEQ ID NO: 231670 - DNA, 20 bp, human
ggggagcagctttcctctgg

SEQ ID NO: 231671 - DNA, 20 bp, human
gcccctgtgggaggactggc

SEQ ID NO: 231672 - DNA, 20 bp, human
gtggccttgtccagccccct

SEQ ID NO: 231673 - DNA, 20 bp, human
gaatcagaaagcaggtcacc

SEQ ID NO: 231674 - DNA, 20 bp, human
gaacccatcaggaagtgcac

SEQ ID NO: 231675 - DNA, 20 bp, human
gcaggaagtgcacaggcgtc

SEQ ID NO: 231676 - DNA, 20 bp, human
ggccgagtgagcctctggtt

SEQ ID NO: 231677 - DNA, 20 bp, human
gtgagagaggaaacggtcga

SEQ ID NO: 231678 - DNA, 20 bp, human
gcctctgccgagtgagcctc

SEQ ID NO: 231679 - DNA, 20 bp, human
ggcagaggaaatttgatatc

SEQ ID NO: 231680 - DNA, 20 bp, human
gatagtggtcctactgtcgt

SEQ ID NO: 231681 - DNA, 20 bp, human
gggtctgggcgtctgtagaa

SEQ ID NO: 231682 - DNA, 20 bp, human
ggagaggaaacggtcgacgg

SEQ ID NO: 231683 - DNA, 20 bp, human
gtcccaaccagaggctcact

SEQ ID NO: 231684 - DNA, 20 bp, human
gaactgcggcttttagagag

SEQ ID NO: 231685 - DNA, 20 bp, human
gagagcagtcccacgacagt

SEQ ID NO: 231686 - DNA, 20 bp, human
gccgctctcccgccagtcta

SEQ ID NO: 231687 - DNA, 20 bp, human
gaacgcagagcgcgggacgt

SEQ ID NO: 231688 - DNA, 20 bp, human
gagagcggaacgcagagcgc

SEQ ID NO: 231689 - DNA, 20 bp, human
gtgtccgcgccttagactgg

SEQ ID NO: 231690 - DNA, 20 bp, human
gctcccgccagtctaaggcg

SEQ ID NO: 231691 - DNA, 20 bp, human
gcggacacaaaggtcctgtc

SEQ ID NO: 231692 - DNA, 20 bp, human
ggggcggggcgggagtggcc

SEQ ID NO: 231693 - DNA, 20 bp, human
ggaaaacgcccctgcaaagt

SEQ ID NO: 231694 - DNA, 20 bp, human
ggcgcgggacgtaggggccg

SEQ ID NO: 231695 - DNA, 20 bp, human
gttgcaggggcgttttctgc

SEQ ID NO: 231696 - DNA, 20 bp, human
gccttccagccgaacctctt

SEQ ID NO: 231697 - DNA, 20 bp, human
ggtcccagctctggcctaag

SEQ ID NO: 231698 - DNA, 20 bp, human
gtccgcgcggctgtcggcag

SEQ ID NO: 231699 - DNA, 20 bp, human
gacgccgcaagcctaaaaat

SEQ ID NO: 231700 - DNA, 20 bp, human
gttgtcaatcatctagaacc

SEQ ID NO: 231701 - DNA, 20 bp, human
ggggtgtgattgagcgagtt

SEQ ID NO: 231702 - DNA, 20 bp, human
gagctctggcctaagaggtt

SEQ ID NO: 231703 - DNA, 20 bp, human
gagctgggaccaggccgggt

SEQ ID NO: 231704 - DNA, 20 bp, human
ggccgacagccgcgcggagg

SEQ ID NO: 231705 - DNA, 20 bp, human
gctggcctaagaggttcggc

SEQ ID NO: 231706 - DNA, 20 bp, human
ggggcgggagggtacgtcgg

SEQ ID NO: 231707 - DNA, 20 bp, human
gaacgagagggcaccccgtg

SEQ ID NO: 231708 - DNA, 20 bp, human
gtccccgcgcccaggacggc

SEQ ID NO: 231709 - DNA, 20 bp, human
gagctagcgagcgaacgaga

SEQ ID NO: 231710 - DNA, 20 bp, human
gccgccccgcagttcccggg

SEQ ID NO: 231711 - DNA, 20 bp, human
ggcgctgcccggctcggcct

SEQ ID NO: 231712 - DNA, 20 bp, human
gctgggccacgcctccctga

SEQ ID NO: 231713 - DNA, 20 bp, human
gccaccgcccgggaactgcg

SEQ ID NO: 231714 - DNA, 20 bp, human
ggtagccggtcccgccccac

SEQ ID NO: 231715 - DNA, 20 bp, human
gtagctccccgcgcccagga

SEQ ID NO: 231716 - DNA, 20 bp, human
ggtcgagggtcacagacgta

SEQ ID NO: 231717 - DNA, 20 bp, human
gggacagggactgtcgtcga

SEQ ID NO: 231718 - DNA, 20 bp, human
ggggccaggtacagatggac

SEQ ID NO: 231719 - DNA, 20 bp, human
ggggacacggacccagcagg

SEQ ID NO: 231720 - DNA, 20 bp, human
gcacggacccagcaggagga

SEQ ID NO: 231721 - DNA, 20 bp, human
ggaagtcccgacagagggcc

SEQ ID NO: 231722 - DNA, 20 bp, human
gagggcccgcccttaggggt

SEQ ID NO: 231723 - DNA, 20 bp, human
gcaggcagagactggtacta

SEQ ID NO: 231724 - DNA, 20 bp, human
ggggaccgatagggacccgc

SEQ ID NO: 231725 - DNA, 20 bp, human
gacctccggcctccatccaa

SEQ ID NO: 231726 - DNA, 20 bp, human
gccggagcgcgggtcgccat

SEQ ID NO: 231727 - DNA, 20 bp, human
ggtcgctaggcaactaccag

SEQ ID NO: 231728 - DNA, 20 bp, human
gcaggggctccggatgtcgc

SEQ ID NO: 231729 - DNA, 20 bp, human
ggctccggatgtcgccggcc

SEQ ID NO: 231730 - DNA, 20 bp, human
gcgcgcggccaagcgttcag

SEQ ID NO: 231731 - DNA, 20 bp, human
ggcgtggggcgcgacttccg

SEQ ID NO: 231732 - DNA, 20 bp, human
gcacgccgggcccgtcttcc

SEQ ID NO: 231733 - DNA, 20 bp, human
gtggggcgcgacttccgggg

SEQ ID NO: 231734 - DNA, 20 bp, human
gcgcgctccggagcatcgcg

SEQ ID NO: 231735 - DNA, 20 bp, human
gccgtcttccgggacacgcc

SEQ ID NO: 231736 - DNA, 20 bp, human
gctcgagtcgcccgcggcaa

SEQ ID NO: 231737 - DNA, 20 bp, human
gcaaagggaggcgctacctg

SEQ ID NO: 231738 - DNA, 20 bp, human
gccagggcccgaagaggttg

SEQ ID NO: 231739 - DNA, 20 bp, human
gggagtgggcgtggccccaa

SEQ ID NO: 231740 - DNA, 20 bp, human
gttccccgccccaacctctt

SEQ ID NO: 231741 - DNA, 20 bp, human
ggagtcgcccgcggcaaggg

SEQ ID NO: 231742 - DNA, 20 bp, human
gggagaaccagggcccgaag

SEQ ID NO: 231743 - DNA, 20 bp, human
ggccgcgggcgactcgagcc

SEQ ID NO: 231744 - DNA, 20 bp, human
gactcccggaagcagtcctc

SEQ ID NO: 231745 - DNA, 20 bp, human
gcggacgcctcgcaggacct

SEQ ID NO: 231746 - DNA, 20 bp, human
gaggggcagcagcctcacgc

SEQ ID NO: 231747 - DNA, 20 bp, human
gagcccccgtgcaggaaaga

SEQ ID NO: 231748 - DNA, 20 bp, human
gggctcgggctcactataaa

SEQ ID NO: 231749 - DNA, 20 bp, human
gggcaagggatgctccccga

SEQ ID NO: 231750 - DNA, 20 bp, human
ggggctagagcgcagagaac

SEQ ID NO: 231751 - DNA, 20 bp, human
ggctgtcagtctcacggcaa

SEQ ID NO: 231752 - DNA, 20 bp, human
gccgaccagctccttctcgt

SEQ ID NO: 231753 - DNA, 20 bp, human
ggggcctgagctgaagccga

SEQ ID NO: 231754 - DNA, 20 bp, human
ggggcattgacgtcaagcgc

SEQ ID NO: 231755 - DNA, 20 bp, human
ggggcacgggtacccaacag

SEQ ID NO: 231756 - DNA, 20 bp, human
ggcgaagcggggtggcgttg

SEQ ID NO: 231757 - DNA, 20 bp, human
ggggcaacctgtcagtaaag

SEQ ID NO: 231758 - DNA, 20 bp, human
gggccggaagagcctccgcg

SEQ ID NO: 231759 - DNA, 20 bp, human
gacggacagaggagtcgtag

SEQ ID NO: 231760 - DNA, 20 bp, human
gaacctgtcagtaaaggggg

SEQ ID NO: 231761 - DNA, 20 bp, human
gcgtctactgcgaagcgggg

SEQ ID NO: 231762 - DNA, 20 bp, human
gccccgccccctttactgac

SEQ ID NO: 231763 - DNA, 20 bp, human
gtgggcggggcctgtcgtcc

SEQ ID NO: 231764 - DNA, 20 bp, human
gcttcgcagtagacggacag

SEQ ID NO: 231765 - DNA, 20 bp, human
gagaggagtcgtagcggtcg

SEQ ID NO: 231766 - DNA, 20 bp, human
gagacggggagttgcgtccc

SEQ ID NO: 231767 - DNA, 20 bp, human
gcaacctgcagaggcgtccc

SEQ ID NO: 231768 - DNA, 20 bp, human
gctggccgccagctctcggg

SEQ ID NO: 231769 - DNA, 20 bp, human
gagtcccaagcccgaactgc

SEQ ID NO: 231770 - DNA, 20 bp, human
gtcgggaaagcccgcagttc

SEQ ID NO: 231771 - DNA, 20 bp, human
ggcggccagctcaggatgcc

SEQ ID NO: 231772 - DNA, 20 bp, human
gctagctgctctctcggcag

SEQ ID NO: 231773 - DNA, 20 bp, human
gaactccccgtctcctggag

SEQ ID NO: 231774 - DNA, 20 bp, human
gaaagccccccaaggcgcca

SEQ ID NO: 231775 - DNA, 20 bp, human
gaggaacgcggaatttggca

SEQ ID NO: 231776 - DNA, 20 bp, human
gtaggcctgcggcacgtttg

SEQ ID NO: 231777 - DNA, 20 bp, human
gttcctggcccggccatctt

SEQ ID NO: 231778 - DNA, 20 bp, human
gacgtctatcggtgatgtaa

SEQ ID NO: 231779 - DNA, 20 bp, human
gtcgccctaggcctgcccaa

SEQ ID NO: 231780 - DNA, 20 bp, human
ggcggctcctgacttccctt

SEQ ID NO: 231781 - DNA, 20 bp, human
gtcccggcgtgctacgcgtg

SEQ ID NO: 231782 - DNA, 20 bp, human
gtcgggaagcccaagatggc

SEQ ID NO: 231783 - DNA, 20 bp, human
gcgcaccgcgcccgtcgcag

SEQ ID NO: 231784 - DNA, 20 bp, human
gcttcccttgggcaggccta

SEQ ID NO: 231785 - DNA, 20 bp, human
gcgccgcacgcgtagcacgc

SEQ ID NO: 231786 - DNA, 20 bp, human
ggcgacaagaggggtgtcga

SEQ ID NO: 231787 - DNA, 20 bp, human
ggctggggccgggtcgtcta

SEQ ID NO: 231788 - DNA, 20 bp, human
gaggaggcgggcttaccggt

SEQ ID NO: 231789 - DNA, 20 bp, human
ggtcgacggaaactcggaaa

SEQ ID NO: 231790 - DNA, 20 bp, human
gacgacccggccccagctag

SEQ ID NO: 231791 - DNA, 20 bp, human
gctcccaaccgtgaggtgtt

SEQ ID NO: 231792 - DNA, 20 bp, human
gaggggtgtcgacggaaact

SEQ ID NO: 231793 - DNA, 20 bp, human
gccggccccagctagtgggt

SEQ ID NO: 231794 - DNA, 20 bp, human
ggaaaggggcggatgtaccc

SEQ ID NO: 231795 - DNA, 20 bp, human
ggcggggaaaaaaaccggaa

SEQ ID NO: 231796 - DNA, 20 bp, human
gtggccgctcccacgattgt

SEQ ID NO: 231797 - DNA, 20 bp, human
ggggctgtgacgcaatgtta

SEQ ID NO: 231798 - DNA, 20 bp, human
ggcaagcaatcgaaagaaga

SEQ ID NO: 231799 - DNA, 20 bp, human
gagacctcccccacaatcgt

SEQ ID NO: 231800 - DNA, 20 bp, human
gtggtctggaacctaagggg

SEQ ID NO: 231801 - DNA, 20 bp, human
ggcaaagcggctctacgcgt

SEQ ID NO: 231802 - DNA, 20 bp, human
gggggaggtctccactgggg

SEQ ID NO: 231803 - DNA, 20 bp, human
gggttggtctggaacctaag

SEQ ID NO: 231804 - DNA, 20 bp, human
gtggaagccgccattttgta

SEQ ID NO: 231805 - DNA, 20 bp, human
ggtaacttaccgggacgagg

SEQ ID NO: 231806 - DNA, 20 bp, human
ggggaggagacaggcgtcca

SEQ ID NO: 231807 - DNA, 20 bp, human
ggcgcgtgacccggtgaccc

SEQ ID NO: 231808 - DNA, 20 bp, human
gcccagtgctccggggtcac

SEQ ID NO: 231809 - DNA, 20 bp, human
ggtgtggggagagagtacta

SEQ ID NO: 231810 - DNA, 20 bp, human
ggtcaccgggtcacgcgccc

SEQ ID NO: 231811 - DNA, 20 bp, human
gtagcctcctgccttaatag

SEQ ID NO: 231812 - DNA, 20 bp, human
gggcgggttctggcagtaga

SEQ ID NO: 231813 - DNA, 20 bp, human
ggctgagaaaggggagtgtt

SEQ ID NO: 231814 - DNA, 20 bp, human
gagtactaggggtacccgcc

SEQ ID NO: 231815 - DNA, 20 bp, human
gaaccggcacggcggagcag

SEQ ID NO: 231816 - DNA, 20 bp, human
gcggtcggctgctgaggcgt

SEQ ID NO: 231817 - DNA, 20 bp, human
ggcgcggcttccagaaccac

SEQ ID NO: 231818 - DNA, 20 bp, human
gtctgcgcgaggcgggtgag

SEQ ID NO: 231819 - DNA, 20 bp, human
gagggcgtgtctgcgcgagg

SEQ ID NO: 231820 - DNA, 20 bp, human
gcctcccgaccggttggagt

SEQ ID NO: 231821 - DNA, 20 bp, human
gcgggcaccgggattctaga

SEQ ID NO: 231822 - DNA, 20 bp, human
gccaccgcctcccgaccggt

SEQ ID NO: 231823 - DNA, 20 bp, human
gaggctccgcccactccaac

SEQ ID NO: 231824 - DNA, 20 bp, human
ggtgagcggggctggcgagc

SEQ ID NO: 231825 - DNA, 20 bp, human
gtggaagccgcgccgccgac

SEQ ID NO: 231826 - DNA, 20 bp, human
ggcgctgcgcgcacgtgggg
